United States Patent 10,706,955 (BIOINFORMATIC PROCESSES FOR DETERMINATION OF PEPTIDE BINDING) - sequence listing, part 87

SEQ ID NO: 3309306 - protein, 6 aa, Plasmodium falciparum
EKNGNM

SEQ ID NO: 3309307 - protein, 7 aa, Plasmodium falciparum
EKNGNRV

SEQ ID NO: 3309308 - protein, 14 aa, Plasmodium falciparum
EKNGTYDDDDKGYI

SEQ ID NO: 3309309 - protein, 9 aa, Plasmodium falciparum
EKNGYKEEI

SEQ ID NO: 3309310 - protein, 6 aa, Plasmodium falciparum
EKNHEN

SEQ ID NO: 3309311 - protein, 8 aa, Plasmodium falciparum
EKNHGTLR

SEQ ID NO: 3309312 - protein, 28 aa, Plasmodium falciparum
EKNHQSDCSNNNNNNNNNNNNNNNNNAS

SEQ ID NO: 3309313 - protein, 4 aa, Plasmodium falciparum
EKNI

SEQ ID NO: 3309314 - protein, 31 aa, Plasmodium falciparum
EKNIENQEDDENEEETHEGKHTNSNSENYYE

SEQ ID NO: 3309315 - protein, 61 aa, Plasmodium falciparum
EKNIKEKEKNKDNDKDDDKGNDKGNDKGNDKDNDKGNDKGNDKDNDKGNDKGNDKGNHNIN

SEQ ID NO: 3309316 - protein, 6 aa, Plasmodium falciparum
EKNINE

SEQ ID NO: 3309317 - protein, 5 aa, Plasmodium falciparum
EKNIS

SEQ ID NO: 3309318 - protein, 14 aa, Plasmodium falciparum
EKNISEYPNLSNNS

SEQ ID NO: 3309319 - protein, 5 aa, Plasmodium falciparum
EKNIT

SEQ ID NO: 3309320 - protein, 13 aa, Plasmodium falciparum
EKNKDSKKKRNLK

SEQ ID NO: 3309321 - protein, 5 aa, Plasmodium falciparum
EKNKE

SEQ ID NO: 3309322 - protein, 7 aa, Plasmodium falciparum
EKNKELK

SEQ ID NO: 3309323 - protein, 8 aa, Plasmodium falciparum
EKNKERET

SEQ ID NO: 3309324 - protein, 25 aa, Plasmodium falciparum
EKNKGYYKDSSNKNMNNNNIGNNNT

SEQ ID NO: 3309325 - protein, 8 aa, Plasmodium falciparum
EKNKHNKI

SEQ ID NO: 3309326 - protein, 9 aa, Plasmodium falciparum
EKNKKDKDC

SEQ ID NO: 3309327 - protein, 10 aa, Plasmodium falciparum
EKNKKDNETM

SEQ ID NO: 3309328 - protein, 9 aa, Plasmodium falciparum
EKNKKGNID

SEQ ID NO: 3309329 - protein, 10 aa, Plasmodium falciparum
EKNKKNKKKL

SEQ ID NO: 3309330 - protein, 9 aa, Plasmodium falciparum
EKNKKYTDF

SEQ ID NO: 3309331 - protein, 17 aa, Plasmodium falciparum
EKNKMSEKKRSNHKTKD

SEQ ID NO: 3309332 - protein, 5 aa, Plasmodium falciparum
EKNKN

SEQ ID NO: 3309333 - protein, 10 aa, Plasmodium falciparum
EKNKNEETIN

SEQ ID NO: 3309334 - protein, 10 aa, Plasmodium falciparum
EKNKNEVETN

SEQ ID NO: 3309335 - protein, 20 aa, Plasmodium falciparum
EKNKNEYNNLSKNEDEKSII

SEQ ID NO: 3309336 - protein, 28 aa, Plasmodium falciparum
EKNKNINLKGNGNLNNMNNKKGNDLSKN

SEQ ID NO: 3309337 - protein, 9 aa, Plasmodium falciparum
EKNKNKINA

SEQ ID NO: 3309338 - protein, 5 aa, Plasmodium falciparum
EKNKQ

SEQ ID NO: 3309339 - protein, 40 aa, Plasmodium falciparum
EKNKQEIENNKNNKNNKNNKNNKNTYKKNSDKNDNPRNDL

SEQ ID NO: 3309340 - protein, 9 aa, Plasmodium falciparum
EKNKQRKEY

SEQ ID NO: 3309341 - protein, 21 aa, Plasmodium falciparum
EKNKQTNKKKKKLPKIPEKKK

SEQ ID NO: 3309342 - protein, 21 aa, Plasmodium falciparum
EKNKRDKKKGTHINNKNDAEE

SEQ ID NO: 3309343 - protein, 13 aa, Plasmodium falciparum
EKNKRDNRINEEK

SEQ ID NO: 3309344 - protein, 36 aa, Plasmodium falciparum
EKNKSEQLNETQDTNNENDITSNQKEEAKDPNGSIS

SEQ ID NO: 3309345 - protein, 12 aa, Plasmodium falciparum
EKNKSINELKKI

SEQ ID NO: 3309346 - protein, 9 aa, Plasmodium falciparum
EKNKTQTNL

SEQ ID NO: 3309347 - protein, 21 aa, Plasmodium falciparum
EKNKYNEETNADYKKKEISIP

SEQ ID NO: 3309348 - protein, 8 aa, Plasmodium falciparum
EKNKYNKH

SEQ ID NO: 3309349 - protein, 4 aa, Plasmodium falciparum
EKNL

SEQ ID NO: 3309350 - protein, 5 aa, Plasmodium falciparum
EKNLS

SEQ ID NO: 3309351 - protein, 21 aa, Plasmodium falciparum
EKNMKEDNIPDDTHYKEKRRN

SEQ ID NO: 3309352 - protein, 16 aa, Plasmodium falciparum
EKNMSTKKDDSNNKCV

SEQ ID NO: 3309353 - protein, 4 aa, Plasmodium falciparum
EKNN

SEQ ID NO: 3309354 - protein, 8 aa, Plasmodium falciparum
EKNNDINE

SEQ ID NO: 3309355 - protein, 7 aa, Plasmodium falciparum
EKNNDSL

SEQ ID NO: 3309356 - protein, 8 aa, Plasmodium falciparum
EKNNEQDI

SEQ ID NO: 3309357 - protein, 11 aa, Plasmodium falciparum
EKNNGEQNGRC

SEQ ID NO: 3309358 - protein, 9 aa, Plasmodium falciparum
EKNNGGSKI

SEQ ID NO: 3309359 - protein, 7 aa, Plasmodium falciparum
EKNNGNT

SEQ ID NO: 3309360 - protein, 10 aa, Plasmodium falciparum
EKNNHIPSNN

SEQ ID NO: 3309361 - protein, 5 aa, Plasmodium falciparum
EKNNI

SEQ ID NO: 3309362 - protein, 13 aa, Plasmodium falciparum
EKNNKEKTNKYSR

SEQ ID NO: 3309363 - protein, 10 aa, Plasmodium falciparum
EKNNKKENKI

SEQ ID NO: 3309364 - protein, 9 aa, Plasmodium falciparum
EKNNKNTAK

SEQ ID NO: 3309365 - protein, 8 aa, Plasmodium falciparum
EKNNKQTY

SEQ ID NO: 3309366 - protein, 9 aa, Plasmodium falciparum
EKNNKTDHH

SEQ ID NO: 3309367 - protein, 51 aa, Plasmodium falciparum
EKNNLSSNKSDSSDKTNNSKKEKRKKKSNHNNHNNNNNNKRTDTQRKDTLN

SEQ ID NO: 3309368 - protein, 7 aa, Plasmodium falciparum
EKNNMNS

SEQ ID NO: 3309369 - protein, 5 aa, Plasmodium falciparum
EKNNN

SEQ ID NO: 3309370 - protein, 7 aa, Plasmodium falciparum
EKNNNCM

SEQ ID NO: 3309371 - protein, 15 aa, Plasmodium falciparum
EKNNNDNDNNNNNNI

SEQ ID NO: 3309372 - protein, 16 aa, Plasmodium falciparum
EKNNNEEKSDKRNGHY

SEQ ID NO: 3309373 - protein, 8 aa, Plasmodium falciparum
EKNNNLEC

SEQ ID NO: 3309374 - protein, 8 aa, Plasmodium falciparum
EKNNNTND

SEQ ID NO: 3309375 - protein, 10 aa, Plasmodium falciparum
EKNNQCESNE

SEQ ID NO: 3309376 - protein, 7 aa, Plasmodium falciparum
EKNNQHT

SEQ ID NO: 3309377 - protein, 5 aa, Plasmodium falciparum
EKNNS

SEQ ID NO: 3309378 - protein, 8 aa, Plasmodium falciparum
EKNNSIPL

SEQ ID NO: 3309379 - protein, 9 aa, Plasmodium falciparum
EKNNSNNIG

SEQ ID NO: 3309380 - protein, 8 aa, Plasmodium falciparum
EKNNSRKL

SEQ ID NO: 3309381 - protein, 14 aa, Plasmodium falciparum
EKNNSTEKNSTHSI

SEQ ID NO: 3309382 - protein, 9 aa, Plasmodium falciparum
EKNNTNKKY

SEQ ID NO: 3309383 - protein, 8 aa, Plasmodium falciparum
EKNNTNNW

SEQ ID NO: 3309384 - protein, 7 aa, Plasmodium falciparum
EKNNYEN

SEQ ID NO: 3309385 - protein, 22 aa, Plasmodium falciparum
EKNPDETNTRKLRKKSVKKNKN

SEQ ID NO: 3309386 - protein, 7 aa, Plasmodium falciparum
EKNPDIS

SEQ ID NO: 3309387 - protein, 8 aa, Plasmodium falciparum
EKNPDKNN

SEQ ID NO: 3309388 - protein, 6 aa, Plasmodium falciparum
EKNPDM

SEQ ID NO: 3309389 - protein, 10 aa, Plasmodium falciparum
EKNPQKKDKI

SEQ ID NO: 3309390 - protein, 35 aa, Plasmodium falciparum
EKNQDTSLSNSYDNHDNTSDDNSSDDYKIKETDLN

SEQ ID NO: 3309391 - protein, 14 aa, Plasmodium falciparum
EKNQESHDEYNEEA

SEQ ID NO: 3309392 - protein, 32 aa, Plasmodium falciparum
EKNREREKEMDRERDMDRNREKERNMDREREM

SEQ ID NO: 3309393 - protein, 10 aa, Plasmodium falciparum
EKNRKRKSEQ

SEQ ID NO: 3309394 - protein, 6 aa, Plasmodium falciparum
EKNRQI

SEQ ID NO: 3309395 - protein, 14 aa, Plasmodium falciparum
EKNRQKQSKVSSNS

SEQ ID NO: 3309396 - protein, 15 aa, Plasmodium falciparum
EKNRSKIKKELSKEE

SEQ ID NO: 3309397 - protein, 5 aa, Plasmodium falciparum
EKNSK

SEQ ID NO: 3309398 - protein, 7 aa, Plasmodium falciparum
EKNSKIQ

SEQ ID NO: 3309399 - protein, 11 aa, Plasmodium falciparum
EKNSKPDSNNI

SEQ ID NO: 3309400 - protein, 5 aa, Plasmodium falciparum
EKNSN

SEQ ID NO: 3309401 - protein, 7 aa, Plasmodium falciparum
EKNSNIG

SEQ ID NO: 3309402 - protein, 18 aa, Plasmodium falciparum
EKNSNNSLDDKSKGGKCL

SEQ ID NO: 3309403 - protein, 5 aa, Plasmodium falciparum
EKNSS

SEQ ID NO: 3309404 - protein, 10 aa, Plasmodium falciparum
EKNSSEPSDV

SEQ ID NO: 3309405 - protein, 23 aa, Plasmodium falciparum
EKNSTTKLEKPNHKNKCSEKDAY

SEQ ID NO: 3309406 - protein, 5 aa, Plasmodium falciparum
EKNSY

SEQ ID NO: 3309407 - protein, 7 aa, Plasmodium falciparum
EKNTDMK

SEQ ID NO: 3309408 - protein, 5 aa, Plasmodium falciparum
EKNTE

SEQ ID NO: 3309409 - protein, 7 aa, Plasmodium falciparum
EKNTKPF

SEQ ID NO: 3309410 - protein, 9 aa, Plasmodium falciparum
EKNTKRKSY

SEQ ID NO: 3309411 - protein, 8 aa, Plasmodium falciparum
EKNTLRKK

SEQ ID NO: 3309412 - protein, 5 aa, Plasmodium falciparum
EKNTN

SEQ ID NO: 3309413 - protein, 45 aa, Plasmodium falciparum
EKNTNISNNKTSSNHSNISNISNKSNKSNISNKSNISKISNESFN

SEQ ID NO: 3309414 - protein, 7 aa, Plasmodium falciparum
EKNTNLT

SEQ ID NO: 3309415 - protein, 9 aa, Plasmodium falciparum
EKNTSNMKN

SEQ ID NO: 3309416 - protein, 5 aa, Plasmodium falciparum
EKNVE

SEQ ID NO: 3309417 - protein, 9 aa, Plasmodium falciparum
EKNVHSTKK

SEQ ID NO: 3309418 - protein, 10 aa, Plasmodium falciparum
EKNVKETKEE

SEQ ID NO: 3309419 - protein, 8 aa, Plasmodium falciparum
EKNVKNEK

SEQ ID NO: 3309420 - protein, 17 aa, Plasmodium falciparum
EKNVNTSDQCNDKINAP

SEQ ID NO: 3309421 - protein, 9 aa, Plasmodium falciparum
EKNVQSKKY

SEQ ID NO: 3309422 - protein, 16 aa, Plasmodium falciparum
EKNYHPEKKNFNNNLE

SEQ ID NO: 3309423 - protein, 5 aa, Plasmodium falciparum
EKNYN

SEQ ID NO: 3309424 - protein, 6 aa, Plasmodium falciparum
EKPARF

SEQ ID NO: 3309425 - protein, 4 aa, Plasmodium falciparum
EKPD

SEQ ID NO: 3309426 - protein, 6 aa, Plasmodium falciparum
EKPEEV

SEQ ID NO: 3309427 - protein, 7 aa, Plasmodium falciparum
EKPIDAY

SEQ ID NO: 3309428 - protein, 14 aa, Plasmodium falciparum
EKPINNEQEEDHSL

SEQ ID NO: 3309429 - protein, 4 aa, Plasmodium falciparum
EKPK

SEQ ID NO: 3309430 - protein, 5 aa, Plasmodium falciparum
EKPLA

SEQ ID NO: 3309431 - protein, 5 aa, Plasmodium falciparum
EKPLN

SEQ ID NO: 3309432 - protein, 7 aa, Plasmodium falciparum
EKPNDVY

SEQ ID NO: 3309433 - protein, 5 aa, Plasmodium falciparum
EKPNL

SEQ ID NO: 3309434 - protein, 8 aa, Plasmodium falciparum
EKPNQNGG

SEQ ID NO: 3309435 - protein, 5 aa, Plasmodium falciparum
EKPNV

SEQ ID NO: 3309436 - protein, 7 aa, Plasmodium falciparum
EKPPDIT

SEQ ID NO: 3309437 - protein, 7 aa, Plasmodium falciparum
EKPQNLT

SEQ ID NO: 3309438 - protein, 10 aa, Plasmodium falciparum
EKPSIPKSKN

SEQ ID NO: 3309439 - protein, 7 aa, Plasmodium falciparum
EKPSNEL

SEQ ID NO: 3309440 - protein, 10 aa, Plasmodium falciparum
EKPTNQKEAT

SEQ ID NO: 3309441 - protein, 11 aa, Plasmodium falciparum
EKPVNKNSGVV

SEQ ID NO: 3309442 - protein, 9 aa, Plasmodium falciparum
EKPWSNHGD

SEQ ID NO: 3309443 - protein, 6 aa, Plasmodium falciparum
EKPYYK

SEQ ID NO: 3309444 - protein, 7 aa, Plasmodium falciparum
EKQANKK

SEQ ID NO: 3309445 - protein, 13 aa, Plasmodium falciparum
EKQDDNEKQNIGS

SEQ ID NO: 3309446 - protein, 7 aa, Plasmodium falciparum
EKQDYNK

SEQ ID NO: 3309447 - protein, 34 aa, Plasmodium falciparum
EKQEANNKNTKQITSGSNNTSSNLKKNNNYYDSK

SEQ ID NO: 3309448 - protein, 10 aa, Plasmodium falciparum
EKQEDEHKGD

SEQ ID NO: 3309449 - protein, 10 aa, Plasmodium falciparum
EKQEIDKNNS

SEQ ID NO: 3309450 - protein, 9 aa, Plasmodium falciparum
EKQENKGVS

SEQ ID NO: 3309451 - protein, 5 aa, Plasmodium falciparum
EKQES

SEQ ID NO: 3309452 - protein, 7 aa, Plasmodium falciparum
EKQIEDL

SEQ ID NO: 3309453 - protein, 5 aa, Plasmodium falciparum
EKQIN

SEQ ID NO: 3309454 - protein, 14 aa, Plasmodium falciparum
EKQINKSKENETNN

SEQ ID NO: 3309455 - protein, 6 aa, Plasmodium falciparum
EKQITN

SEQ ID NO: 3309456 - protein, 7 aa, Plasmodium falciparum
EKQKDCT

SEQ ID NO: 3309457 - protein, 14 aa, Plasmodium falciparum
EKQKELKSVEENNK

SEQ ID NO: 3309458 - protein, 7 aa, Plasmodium falciparum
EKQKEYQ

SEQ ID NO: 3309459 - protein, 11 aa, Plasmodium falciparum
EKQKKKTNQCT

SEQ ID NO: 3309460 - protein, 9 aa, Plasmodium falciparum
EKQKKYNSF

SEQ ID NO: 3309461 - protein, 15 aa, Plasmodium falciparum
EKQKYNDEDGKENVS

SEQ ID NO: 3309462 - protein, 10 aa, Plasmodium falciparum
EKQLNKNDQQ

SEQ ID NO: 3309463 - protein, 7 aa, Plasmodium falciparum
EKQNDNL

SEQ ID NO: 3309464 - protein, 12 aa, Plasmodium falciparum
EKQNKEKPEAVK

SEQ ID NO: 3309465 - protein, 10 aa, Plasmodium falciparum
EKQNKKYNTY

SEQ ID NO: 3309466 - protein, 13 aa, Plasmodium falciparum
EKQNMDDEKINDN

SEQ ID NO: 3309467 - protein, 10 aa, Plasmodium falciparum
EKQNNNNNNN

SEQ ID NO: 3309468 - protein, 7 aa, Plasmodium falciparum
EKQNNSD

SEQ ID NO: 3309469 - protein, 7 aa, Plasmodium falciparum
EKQNSHK

SEQ ID NO: 3309470 - protein, 36 aa, Plasmodium falciparum
EKQNSLSDSSEVDKKKNKKEKEKEKDKEKEKRKIKK

SEQ ID NO: 3309471 - protein, 6 aa, Plasmodium falciparum
EKQQED

SEQ ID NO: 3309472 - protein, 12 aa, Plasmodium falciparum
EKQQNKGNYRNT

SEQ ID NO: 3309473 - protein, 7 aa, Plasmodium falciparum
EKQRSEI

SEQ ID NO: 3309474 - protein, 10 aa, Plasmodium falciparum
EKQRTEEKWK

SEQ ID NO: 3309475 - protein, 19 aa, Plasmodium falciparum
EKQTENEKNSYIKEENSSI

SEQ ID NO: 3309476 - protein, 8 aa, Plasmodium falciparum
EKQTNDDN

SEQ ID NO: 3309477 - protein, 20 aa, Plasmodium falciparum
EKQTTNQGCNEKRKDNQYDN

SEQ ID NO: 3309478 - protein, 4 aa, Plasmodium falciparum
EKQV

SEQ ID NO: 3309479 - protein, 6 aa, Plasmodium falciparum
EKQYTN

SEQ ID NO: 3309480 - protein, 4 aa, Plasmodium falciparum
EKRD

SEQ ID NO: 3309481 - protein, 44 aa, Plasmodium falciparum
EKRDEEKKNDRKKEEKGSKKLINDSNSKPHKNDMGKHEKNVENK

SEQ ID NO: 3309482 - protein, 6 aa, Plasmodium falciparum
EKRDKI

SEQ ID NO: 3309483 - protein, 13 aa, Plasmodium falciparum
EKRDLEKENLKKR

SEQ ID NO: 3309484 - protein, 8 aa, Plasmodium falciparum
EKRDRVKE

SEQ ID NO: 3309485 - protein, 10 aa, Plasmodium falciparum
EKREEDTNKN

SEQ ID NO: 3309486 - protein, 30 aa, Plasmodium falciparum
EKREEENKNYEKDEHEYESDNYDKEKINKK

SEQ ID NO: 3309487 - protein, 6 aa, Plasmodium falciparum
EKREEF

SEQ ID NO: 3309488 - protein, 12 aa, Plasmodium falciparum
EKREKNKSNGVG

SEQ ID NO: 3309489 - protein, 8 aa, Plasmodium falciparum
EKREKPLA

SEQ ID NO: 3309490 - protein, 12 aa, Plasmodium falciparum
EKREMNNGDGKE

SEQ ID NO: 3309491 - protein, 9 aa, Plasmodium falciparum
EKRFTNNDT

SEQ ID NO: 3309492 - protein, 10 aa, Plasmodium falciparum
EKRGNNKNKI

SEQ ID NO: 3309493 - protein, 9 aa, Plasmodium falciparum
EKRHSSNFD

SEQ ID NO: 3309494 - protein, 4 aa, Plasmodium falciparum
EKRI

SEQ ID NO: 3309495 - protein, 39 aa, Plasmodium falciparum
EKRIQYKKGKKDRRDFEEDDDDDDEDDEEEDDDENNDEM

SEQ ID NO: 3309496 - protein, 39 aa, Plasmodium falciparum
EKRKEELKKLEEQKKREERKKMEEEEKKREEEKKREEEI

SEQ ID NO: 3309497 - protein, 17 aa, Plasmodium falciparum
EKRKEKKNQKKTQTKRQ

SEQ ID NO: 3309498 - protein, 7 aa, Plasmodium falciparum
EKRKGKD

SEQ ID NO: 3309499 - protein, 17 aa, Plasmodium falciparum
EKRKHEKSKKSKYDKDY

SEQ ID NO: 3309500 - protein, 5 aa, Plasmodium falciparum
EKRKK

SEQ ID NO: 3309501 - protein, 14 aa, Plasmodium falciparum
EKRKKKEKQKNSID

SEQ ID NO: 3309502 - protein, 9 aa, Plasmodium falciparum
EKRKKNESE

SEQ ID NO: 3309503 - protein, 18 aa, Plasmodium falciparum
EKRKLEERINKNENIKNL

SEQ ID NO: 3309504 - protein, 14 aa, Plasmodium falciparum
EKRKNKNNKNKMND

SEQ ID NO: 3309505 - protein, 11 aa, Plasmodium falciparum
EKRKRKKSSGH

SEQ ID NO: 3309506 - protein, 10 aa, Plasmodium falciparum
EKRKSDHPSY

SEQ ID NO: 3309507 - protein, 99 aa, Plasmodium falciparum
EKRNDFTTTKGNNNNYENKDENNEKKNEKKNEKKNEKKNKNKNEKKNKNKNENNEKKNENKNKNKNENNENTNENNKNNKNNKNNKNNKNNSNSNNNNN

SEQ ID NO: 3309508 - protein, 6 aa, Plasmodium falciparum
EKRNEQ

SEQ ID NO: 3309509 - protein, 11 aa, Plasmodium falciparum
EKRNKTYKINN

SEQ ID NO: 3309510 - protein, 7 aa, Plasmodium falciparum
EKRNNDK

SEQ ID NO: 3309511 - protein, 11 aa, Plasmodium falciparum
EKRNNSQDVHS

SEQ ID NO: 3309512 - protein, 18 aa, Plasmodium falciparum
EKRNRERERADNKNKENI

SEQ ID NO: 3309513 - protein, 24 aa, Plasmodium falciparum
EKRNTNGGDIKNENGSTKKGKCES

SEQ ID NO: 3309514 - protein, 22 aa, Plasmodium falciparum
EKRQKQIKQENKKIQKNGTKEL

SEQ ID NO: 3309515 - protein, 13 aa, Plasmodium falciparum
EKRRLEKKQQLKE

SEQ ID NO: 3309516 - protein, 14 aa, Plasmodium falciparum
EKRRNSVHNPTGRI

SEQ ID NO: 3309517 - protein, 6 aa, Plasmodium falciparum
EKRRQT

SEQ ID NO: 3309518 - protein, 54 aa, Plasmodium falciparum
EKRRTNRYVSSSSNSSDSSTSNSSDSSSFSTSSDDSDSDSDSDMDSDSYDKKRK

SEQ ID NO: 3309519 - protein, 11 aa, Plasmodium falciparum
EKRSTFNKTNG

SEQ ID NO: 3309520 - protein, 10 aa, Plasmodium falciparum
EKRTCSDKNN

SEQ ID NO: 3309521 - protein, 6 aa, Plasmodium falciparum
EKRTKH

SEQ ID NO: 3309522 - protein, 20 aa, Plasmodium falciparum
EKRTKKSDNSNEHKNDNIYD

SEQ ID NO: 3309523 - protein, 10 aa, Plasmodium falciparum
EKRTTPYQKN

SEQ ID NO: 3309524 - protein, 7 aa, Plasmodium falciparum
EKSADDL

SEQ ID NO: 3309525 - protein, 7 aa, Plasmodium falciparum
EKSDDEI

SEQ ID NO: 3309526 - protein, 5 aa, Plasmodium falciparum
EKSDE

SEQ ID NO: 3309527 - protein, 8 aa, Plasmodium falciparum
EKSDEKNT

SEQ ID NO: 3309528 - protein, 11 aa, Plasmodium falciparum
EKSDKKKTNYN

SEQ ID NO: 3309529 - protein, 13 aa, Plasmodium falciparum
EKSDNKLNNSTNH

SEQ ID NO: 3309530 - protein, 5 aa, Plasmodium falciparum
EKSDS

SEQ ID NO: 3309531 - protein, 8 aa, Plasmodium falciparum
EKSEDGKN

SEQ ID NO: 3309532 - protein, 30 aa, Plasmodium falciparum
EKSENKEPCINESNQKKKKKKNNKKKYNNM

SEQ ID NO: 3309533 - protein, 16 aa, Plasmodium falciparum
EKSENKKKDDDKSNIV

SEQ ID NO: 3309534 - protein, 10 aa, Plasmodium falciparum
EKSENSNKNL

SEQ ID NO: 3309535 - protein, 9 aa, Plasmodium falciparum
EKSETEEDL

SEQ ID NO: 3309536 - protein, 7 aa, Plasmodium falciparum
EKSEVGL

SEQ ID NO: 3309537 - protein, 6 aa, Plasmodium falciparum
EKSFNK

SEQ ID NO: 3309538 - protein, 18 aa, Plasmodium falciparum
EKSFNKDEKKKKKSILET

SEQ ID NO: 3309539 - protein, 4 aa, Plasmodium falciparum
EKSI

SEQ ID NO: 3309540 - protein, 6 aa, Plasmodium falciparum
EKSIEN

SEQ ID NO: 3309541 - protein, 5 aa, Plasmodium falciparum
EKSIH

SEQ ID NO: 3309542 - protein, 9 aa, Plasmodium falciparum
EKSISETKE

SEQ ID NO: 3309543 - protein, 7 aa, Plasmodium falciparum
EKSISQA

SEQ ID NO: 3309544 - protein, 6 aa, Plasmodium falciparum
EKSKCY

SEQ ID NO: 3309545 - protein, 6 aa, Plasmodium falciparum
EKSKLE

SEQ ID NO: 3309546 - protein, 15 aa, Plasmodium falciparum
EKSKNKKEKRVQKQI

SEQ ID NO: 3309547 - protein, 7 aa, Plasmodium falciparum
EKSKQGI

SEQ ID NO: 3309548 - protein, 10 aa, Plasmodium falciparum
EKSLEGSLKE

SEQ ID NO: 3309549 - protein, 9 aa, Plasmodium falciparum
EKSLRGKKS

SEQ ID NO: 3309550 - protein, 6 aa, Plasmodium falciparum
EKSLSN

SEQ ID NO: 3309551 - protein, 7 aa, Plasmodium falciparum
EKSLTEN

SEQ ID NO: 3309552 - protein, 16 aa, Plasmodium falciparum
EKSNEDIKNKDAESVR

SEQ ID NO: 3309553 - protein, 28 aa, Plasmodium falciparum
EKSNIKGNIKSNTNNNTNNNTNNITNNI

SEQ ID NO: 3309554 - protein, 7 aa, Plasmodium falciparum
EKSNKTN

SEQ ID NO: 3309555 - protein, 5 aa, Plasmodium falciparum
EKSNN

SEQ ID NO: 3309556 - protein, 6 aa, Plasmodium falciparum
EKSNNF

SEQ ID NO: 3309557 - protein, 8 aa, Plasmodium falciparum
EKSNQKNS

SEQ ID NO: 3309558 - protein, 14 aa, Plasmodium falciparum
EKSNSSKAINVDYI

SEQ ID NO: 3309559 - protein, 13 aa, Plasmodium falciparum
EKSQGKKKKNMSE

SEQ ID NO: 3309560 - protein, 8 aa, Plasmodium falciparum
EKSQKDRQ

SEQ ID NO: 3309561 - protein, 4 aa, Plasmodium falciparum
EKSR

SEQ ID NO: 3309562 - protein, 10 aa, Plasmodium falciparum
EKSRAKEFKG

SEQ ID NO: 3309563 - protein, 7 aa, Plasmodium falciparum
EKSSKRI

SEQ ID NO: 3309564 - protein, 4 aa, Plasmodium falciparum
EKST

SEQ ID NO: 3309565 - protein, 8 aa, Plasmodium falciparum
EKSTEYNN

SEQ ID NO: 3309566 - protein, 8 aa, Plasmodium falciparum
EKSTGKQN

SEQ ID NO: 3309567 - protein, 7 aa, Plasmodium falciparum
EKSTMQD

SEQ ID NO: 3309568 - protein, 7 aa, Plasmodium falciparum
EKSWDDE

SEQ ID NO: 3309569 - protein, 4 aa, Plasmodium falciparum
EKSY

SEQ ID NO: 3309570 - protein, 7 aa, Plasmodium falciparum
EKSYSLK

SEQ ID NO: 3309571 - protein, 9 aa, Plasmodium falciparum
EKTASQNDI

SEQ ID NO: 3309572 - protein, 10 aa, Plasmodium falciparum
EKTDEENKNS

SEQ ID NO: 3309573 - protein, 36 aa, Plasmodium falciparum
EKTDKGNHRRDSYKEQKGKNKNDEKSKKKESTVNEE

SEQ ID NO: 3309574 - protein, 15 aa, Plasmodium falciparum
EKTDMSKTKCSNDDV

SEQ ID NO: 3309575 - protein, 12 aa, Plasmodium falciparum
EKTDSQKEYKNK

SEQ ID NO: 3309576 - protein, 4 aa, Plasmodium falciparum
EKTE

SEQ ID NO: 3309577 - protein, 7 aa, Plasmodium falciparum
EKTEESV

SEQ ID NO: 3309578 - protein, 19 aa, Plasmodium falciparum
EKTENEKIKQNEEDISGND

SEQ ID NO: 3309579 - protein, 32 aa, Plasmodium falciparum
EKTESASKKKKKKDDDMSEPEEDEQKINEVED

SEQ ID NO: 3309580 - protein, 29 aa, Plasmodium falciparum
EKTETKKKLENNIEDTNVNDDIKKNNNIN

SEQ ID NO: 3309581 - protein, 8 aa, Plasmodium falciparum
EKTFEDED

SEQ ID NO: 3309582 - protein, 6 aa, Plasmodium falciparum
EKTFGE

SEQ ID NO: 3309583 - protein, 13 aa, Plasmodium falciparum
EKTFNNEKNKHLD

SEQ ID NO: 3309584 - protein, 7 aa, Plasmodium falciparum
EKTGKID

SEQ ID NO: 3309585 - protein, 12 aa, Plasmodium falciparum
EKTGRSPSDKRI

SEQ ID NO: 3309586 - protein, 8 aa, Plasmodium falciparum
EKTGSTPA

SEQ ID NO: 3309587 - protein, 22 aa, Plasmodium falciparum
EKTGVSQGVSTANNNDNNVNNM

SEQ ID NO: 3309588 - protein, 6 aa, Plasmodium falciparum
EKTHET

SEQ ID NO: 3309589 - protein, 9 aa, Plasmodium falciparum
EKTKDEIKK

SEQ ID NO: 3309590 - protein, 6 aa, Plasmodium falciparum
EKTKEK

SEQ ID NO: 3309591 - protein, 12 aa, Plasmodium falciparum
EKTKKKTKKCYC

SEQ ID NO: 3309592 - protein, 13 aa, Plasmodium falciparum
EKTKNNKKEDKKF

SEQ ID NO: 3309593 - protein, 7 aa, Plasmodium falciparum
EKTKNQY

SEQ ID NO: 3309594 - protein, 10 aa, Plasmodium falciparum
EKTKNTSDLN

SEQ ID NO: 3309595 - protein, 9 aa, Plasmodium falciparum
EKTKPKNDS

SEQ ID NO: 3309596 - protein, 17 aa, Plasmodium falciparum
EKTKSVKAAYKKYEEEN

SEQ ID NO: 3309597 - protein, 12 aa, Plasmodium falciparum
EKTLEEGDDELQ

SEQ ID NO: 3309598 - protein, 9 aa, Plasmodium falciparum
EKTNDTLEE

SEQ ID NO: 3309599 - protein, 17 aa, Plasmodium falciparum
EKTNEEKISTNDLDTYE

SEQ ID NO: 3309600 - protein, 9 aa, Plasmodium falciparum
EKTNKNNTS

SEQ ID NO: 3309601 - protein, 6 aa, Plasmodium falciparum
EKTNMN

SEQ ID NO: 3309602 - protein, 11 aa, Plasmodium falciparum
EKTNQDKPLND

SEQ ID NO: 3309603 - protein, 7 aa, Plasmodium falciparum
EKTNRSS

SEQ ID NO: 3309604 - protein, 10 aa, Plasmodium falciparum
EKTNVKGGME

SEQ ID NO: 3309605 - protein, 4 aa, Plasmodium falciparum
EKTP

SEQ ID NO: 3309606 - protein, 6 aa, Plasmodium falciparum
EKTQIT

SEQ ID NO: 3309607 - protein, 39 aa, Plasmodium falciparum
EKTQTKYKHEKDTEKKKKKNEYKNENNSISNNKNESHET

SEQ ID NO: 3309608 - protein, 8 aa, Plasmodium falciparum
EKTRDNTY

SEQ ID NO: 3309609 - protein, 13 aa, Plasmodium falciparum
EKTRDTSNNGVSR

SEQ ID NO: 3309610 - protein, 4 aa, Plasmodium falciparum
EKTS

SEQ ID NO: 3309611 - protein, 6 aa, Plasmodium falciparum
EKTSND

SEQ ID NO: 3309612 - protein, 9 aa, Plasmodium falciparum
EKTSSIDGN

SEQ ID NO: 3309613 - protein, 5 aa, Plasmodium falciparum
EKTTI

SEQ ID NO: 3309614 - protein, 9 aa, Plasmodium falciparum
EKTTRETYS

SEQ ID NO: 3309615 - protein, 6 aa, Plasmodium falciparum
EKTTTF

SEQ ID NO: 3309616 - protein, 4 aa, Plasmodium falciparum
EKTY

SEQ ID NO: 3309617 - protein, 6 aa, Plasmodium falciparum
EKVDES

SEQ ID NO: 3309618 - protein, 59 aa, Plasmodium falciparum
EKVENKKEADTNEKEKNMKKKKKKRNEEKNDNNGDDYKEDNYDDDDDDDDDDDEKNNLY

SEQ ID NO: 3309619 - protein, 8 aa, Plasmodium falciparum
EKVGTTSK

SEQ ID NO: 3309620 - protein, 8 aa, Plasmodium falciparum
EKVHNSNN

SEQ ID NO: 3309621 - protein, 14 aa, Plasmodium falciparum
EKVKEEKKNNNKIN

SEQ ID NO: 3309622 - protein, 57 aa, Plasmodium falciparum
EKVKSNTSNNNNNNNNNNNNNNNNNNNNNNNNNNNNNNNNNNNNNNNNNDNNNNNIS

SEQ ID NO: 3309623 - protein, 6 aa, Plasmodium falciparum
EKVNSN

SEQ ID NO: 3309624 - protein, 10 aa, Plasmodium falciparum
EKVQDQDNTL

SEQ ID NO: 3309625 - protein, 17 aa, Plasmodium falciparum
EKVSSHTDYSRAKHSSH

SEQ ID NO: 3309626 - protein, 8 aa, Plasmodium falciparum
EKVTASSA

SEQ ID NO: 3309627 - protein, 4 aa, Plasmodium falciparum
EKWE

SEQ ID NO: 3309628 - protein, 7 aa, Plasmodium falciparum
EKWQPKL

SEQ ID NO: 3309629 - protein, 7 aa, Plasmodium falciparum
EKYADKK

SEQ ID NO: 3309630 - protein, 4 aa, Plasmodium falciparum
EKYD

SEQ ID NO: 3309631 - protein, 9 aa, Plasmodium falciparum
EKYDDQTKS

SEQ ID NO: 3309632 - protein, 7 aa, Plasmodium falciparum
EKYDEKV

SEQ ID NO: 3309633 - protein, 11 aa, Plasmodium falciparum
EKYDKDNNYTH

SEQ ID NO: 3309634 - protein, 23 aa, Plasmodium falciparum
EKYEEDKYYEKENNNEINNAENY

SEQ ID NO: 3309635 - protein, 63 aa, Plasmodium falciparum
EKYEEEKKKNEEERKKNEEERKKNEEERKKNEEEKKKNEEERKKNEEEKKKLEKDKHQFEEEK

SEQ ID NO: 3309636 - protein, 7 aa, Plasmodium falciparum
EKYEEER

SEQ ID NO: 3309637 - protein, 9 aa, Plasmodium falciparum
EKYEEERKN

SEQ ID NO: 3309638 - protein, 10 aa, Plasmodium falciparum
EKYEKRDNEF

SEQ ID NO: 3309639 - protein, 20 aa, Plasmodium falciparum
EKYEKYEKYEKSDNTSHGNK

SEQ ID NO: 3309640 - protein, 9 aa, Plasmodium falciparum
EKYENSGHT

SEQ ID NO: 3309641 - protein, 6 aa, Plasmodium falciparum
EKYEQN

SEQ ID NO: 3309642 - protein, 13 aa, Plasmodium falciparum
EKYEREAKEKSRE

SEQ ID NO: 3309643 - protein, 16 aa, Plasmodium falciparum
EKYETEKKEKEKEQQM

SEQ ID NO: 3309644 - protein, 13 aa, Plasmodium falciparum
EKYETNQSYNSTK

SEQ ID NO: 3309645 - protein, 7 aa, Plasmodium falciparum
EKYGEED

SEQ ID NO: 3309646 - protein, 6 aa, Plasmodium falciparum
EKYGNI

SEQ ID NO: 3309647 - protein, 7 aa, Plasmodium falciparum
EKYKDKD

SEQ ID NO: 3309648 - protein, 8 aa, Plasmodium falciparum
EKYKENTQ

SEQ ID NO: 3309649 - protein, 9 aa, Plasmodium falciparum
EKYKEYGPH

SEQ ID NO: 3309650 - protein, 12 aa, Plasmodium falciparum
EKYKKKKKKKLH

SEQ ID NO: 3309651 - protein, 6 aa, Plasmodium falciparum
EKYKND

SEQ ID NO: 3309652 - protein, 6 aa, Plasmodium falciparum
EKYKNE

SEQ ID NO: 3309653 - protein, 20 aa, Plasmodium falciparum
EKYKNNNNNYRNDDSESNHN

SEQ ID NO: 3309654 - protein, 9 aa, Plasmodium falciparum
EKYKNRKKN

SEQ ID NO: 3309655 - protein, 7 aa, Plasmodium falciparum
EKYKNSR

SEQ ID NO: 3309656 - protein, 10 aa, Plasmodium falciparum
EKYKNVKNNK

SEQ ID NO: 3309657 - protein, 110 aa, Plasmodium falciparum
EKYNDDNKKYDADNNKTYDDDDNNKTYDDDDNNKTYDDDNDNNKKCDGDDNNKKYDGDDNNKKYDDDDDDNNKKYDDDDDDNNKKYDDDDDDNNNKYDNDNDNNKKYDHD

SEQ ID NO: 3309658 - protein, 19 aa, Plasmodium falciparum
EKYNENQKTKTKLNTINKT

SEQ ID NO: 3309659 - protein, 16 aa, Plasmodium falciparum
EKYNSEDDKDEKINKD

SEQ ID NO: 3309660 - protein, 9 aa, Plasmodium falciparum
EKYNTKDNR

SEQ ID NO: 3309661 - protein, 4 aa, Plasmodium falciparum
EKYP

SEQ ID NO: 3309662 - protein, 16 aa, Plasmodium falciparum
EKYPERYKDKKENDED

SEQ ID NO: 3309663 - protein, 4 aa, Plasmodium falciparum
EKYQ

SEQ ID NO: 3309664 - protein, 27 aa, Plasmodium falciparum
EKYQNNINTNEQHNKNEENKNKNVINN

SEQ ID NO: 3309665 - protein, 9 aa, Plasmodium falciparum
EKYSDQNDN

SEQ ID NO: 3309666 - protein, 19 aa, Plasmodium falciparum
EKYSKDNITKNQITSEQDK

SEQ ID NO: 3309667 - protein, 7 aa, Plasmodium falciparum
EKYSKNN

SEQ ID NO: 3309668 - protein, 13 aa, Plasmodium falciparum
EKYSSMDDECSED

SEQ ID NO: 3309669 - protein, 6 aa, Plasmodium falciparum
ELAEQT

SEQ ID NO: 3309670 - protein, 5 aa, Plasmodium falciparum
ELAIP

SEQ ID NO: 3309671 - protein, 17 aa, Plasmodium falciparum
ELARKSSLASQILTKKK

SEQ ID NO: 3309672 - protein, 9 aa, Plasmodium falciparum
ELDDDDNNM

SEQ ID NO: 3309673 - protein, 13 aa, Plasmodium falciparum
ELDDTEEKNISDV

SEQ ID NO: 3309674 - protein, 17 aa, Plasmodium falciparum
ELDKEADKEIKKKQNNL

SEQ ID NO: 3309675 - protein, 4 aa, Plasmodium falciparum
ELDN

SEQ ID NO: 3309676 - protein, 7 aa, Plasmodium falciparum
ELDNNEN

SEQ ID NO: 3309677 - protein, 12 aa, Plasmodium falciparum
ELDNSHDPESIQ

SEQ ID NO: 3309678 - protein, 7 aa, Plasmodium falciparum
ELDPNNK

SEQ ID NO: 3309679 - protein, 5 aa, Plasmodium falciparum
ELDQL

SEQ ID NO: 3309680 - protein, 5 aa, Plasmodium falciparum
ELDRK

SEQ ID NO: 3309681 - protein, 19 aa, Plasmodium falciparum
ELDTPTNSEVFKGFRKVQE

SEQ ID NO: 3309682 - protein, 11 aa, Plasmodium falciparum
ELEADEKKNKM

SEQ ID NO: 3309683 - protein, 4 aa, Plasmodium falciparum
ELEE

SEQ ID NO: 3309684 - protein, 17 aa, Plasmodium falciparum
ELEEDEENLNDDSLKGD

SEQ ID NO: 3309685 - protein, 9 aa, Plasmodium falciparum
ELEENQIDK

SEQ ID NO: 3309686 - protein, 10 aa, Plasmodium falciparum
ELEETNNTLE

SEQ ID NO: 3309687 - protein, 6 aa, Plasmodium falciparum
ELENEF

SEQ ID NO: 3309688 - protein, 11 aa, Plasmodium falciparum
ELENEKKQNKE

SEQ ID NO: 3309689 - protein, 5 aa, Plasmodium falciparum
ELENQ

SEQ ID NO: 3309690 - protein, 6 aa, Plasmodium falciparum
ELEQNY

SEQ ID NO: 3309691 - protein, 8 aa, Plasmodium falciparum
ELESAENK

SEQ ID NO: 3309692 - protein, 9 aa, Plasmodium falciparum
ELETPIPEK

SEQ ID NO: 3309693 - protein, 11 aa, Plasmodium falciparum
ELGEDGPTHQP

SEQ ID NO: 3309694 - protein, 9 aa, Plasmodium falciparum
ELGENEDIN

SEQ ID NO: 3309695 - protein, 7 aa, Plasmodium falciparum
ELGETKA

SEQ ID NO: 3309696 - protein, 6 aa, Plasmodium falciparum
ELGTTE

SEQ ID NO: 3309697 - protein, 7 aa, Plasmodium falciparum
ELHSSTS

SEQ ID NO: 3309698 - protein, 4 aa, Plasmodium falciparum
ELKA

SEQ ID NO: 3309699 - protein, 4 aa, Plasmodium falciparum
ELKD

SEQ ID NO: 3309700 - protein, 11 aa, Plasmodium falciparum
ELKDKDAKASA

SEQ ID NO: 3309701 - protein, 12 aa, Plasmodium falciparum
ELKEEKSNKQNK

SEQ ID NO: 3309702 - protein, 5 aa, Plasmodium falciparum
ELKEK

SEQ ID NO: 3309703 - protein, 8 aa, Plasmodium falciparum
ELKEKDIP

SEQ ID NO: 3309704 - protein, 10 aa, Plasmodium falciparum
ELKEKENLKK

SEQ ID NO: 3309705 - protein, 26 aa, Plasmodium falciparum
ELKEQEDQYSEKNKMNSSLSNNECEQ

SEQ ID NO: 3309706 - protein, 5 aa, Plasmodium falciparum
ELKGD

SEQ ID NO: 3309707 - protein, 5 aa, Plasmodium falciparum
ELKGG

SEQ ID NO: 3309708 - protein, 12 aa, Plasmodium falciparum
ELKGKGGMYPNK

SEQ ID NO: 3309709 - protein, 4 aa, Plasmodium falciparum
ELKI

SEQ ID NO: 3309710 - protein, 4 aa, Plasmodium falciparum
ELKK

SEQ ID NO: 3309711 - protein, 7 aa, Plasmodium falciparum
ELKKKSK

SEQ ID NO: 3309712 - protein, 7 aa, Plasmodium falciparum
ELKKNQS

SEQ ID NO: 3309713 - protein, 17 aa, Plasmodium falciparum
ELKKQNKKKNKIKNYDQ

SEQ ID NO: 3309714 - protein, 16 aa, Plasmodium falciparum
ELKKRKKKKYSNESKV

SEQ ID NO: 3309715 - protein, 12 aa, Plasmodium falciparum
ELKNKTQDEDNH

SEQ ID NO: 3309716 - protein, 5 aa, Plasmodium falciparum
ELKNQ

SEQ ID NO: 3309717 - protein, 6 aa, Plasmodium falciparum
ELKPGD

SEQ ID NO: 3309718 - protein, 25 aa, Plasmodium falciparum
ELKQDDNQEYITEENNKKENEEINV

SEQ ID NO: 3309719 - protein, 12 aa, Plasmodium falciparum
ELKQESKNNIQS

SEQ ID NO: 3309720 - protein, 11 aa, Plasmodium falciparum
ELKRSEEHSDE

SEQ ID NO: 3309721 - protein, 4 aa, Plasmodium falciparum
ELKS

SEQ ID NO: 3309722 - protein, 7 aa, Plasmodium falciparum
ELKSDRS

SEQ ID NO: 3309723 - protein, 4 aa, Plasmodium falciparum
ELKT

SEQ ID NO: 3309724 - protein, 6 aa, Plasmodium falciparum
ELKTEG

SEQ ID NO: 3309725 - protein, 8 aa, Plasmodium falciparum
ELKTKEGD

SEQ ID NO: 3309726 - protein, 6 aa, Plasmodium falciparum
ELKTNN

SEQ ID NO: 3309727 - protein, 5 aa, Plasmodium falciparum
ELLDD

SEQ ID NO: 3309728 - protein, 5 aa, Plasmodium falciparum
ELNDD

SEQ ID NO: 3309729 - protein, 120 aa, Plasmodium falciparum
ELNEKDHKQISSKKMSNSVATARSEYTSESKEYQANDINKKKNEFNRNDTCKNDVKTNDVKTNDVKTNDVKTNDGQTNDVKTNDVKTNDMKTNDMKTNDMKTNDMKTNDIRPMNKDQNMK

SEQ ID NO: 3309730 - protein, 5 aa, Plasmodium falciparum
ELNET

SEQ ID NO: 3309731 - protein, 45 aa, Plasmodium falciparum
ELNETQNNNNNKDKNEYKKIDTNDKINNNNSNNNSNNNSKSNHNN

SEQ ID NO: 3309732 - protein, 4 aa, Plasmodium falciparum
ELNG

SEQ ID NO: 3309733 - protein, 8 aa, Plasmodium falciparum
ELNKKGDD

SEQ ID NO: 3309734 - protein, 22 aa, Plasmodium falciparum
ELNKKKDYETKSEEELKNDNNV

SEQ ID NO: 3309735 - protein, 10 aa, Plasmodium falciparum
ELNKKTKKQI

SEQ ID NO: 3309736 - protein, 6 aa, Plasmodium falciparum
ELNNAT

SEQ ID NO: 3309737 - protein, 13 aa, Plasmodium falciparum
ELNNEEKKKQVES

SEQ ID NO: 3309738 - protein, 23 aa, Plasmodium falciparum
ELNNHNNINNNNNNNNNNNNNSE

SEQ ID NO: 3309739 - protein, 5 aa, Plasmodium falciparum
ELNNK

SEQ ID NO: 3309740 - protein, 9 aa, Plasmodium falciparum
ELNNNDSHI

SEQ ID NO: 3309741 - protein, 8 aa, Plasmodium falciparum
ELNNNNEE

SEQ ID NO: 3309742 - protein, 7 aa, Plasmodium falciparum
ELNNNNN

SEQ ID NO: 3309743 - protein, 9 aa, Plasmodium falciparum
ELNNQQNKD

SEQ ID NO: 3309744 - protein, 6 aa, Plasmodium falciparum
ELNNSC

SEQ ID NO: 3309745 - protein, 10 aa, Plasmodium falciparum
ELNNSNNYHE

SEQ ID NO: 3309746 - protein, 8 aa, Plasmodium falciparum
ELNNSTNQ

SEQ ID NO: 3309747 - protein, 33 aa, Plasmodium falciparum
ELNNVESDKYKSENEDNDSKIKNDEDKKQGNVQ

SEQ ID NO: 3309748 - protein, 9 aa, Plasmodium falciparum
ELNQGNEDN

SEQ ID NO: 3309749 - protein, 22 aa, Plasmodium falciparum
ELNREKDQLKKNLTDSKNEAET

SEQ ID NO: 3309750 - protein, 11 aa, Plasmodium falciparum
ELNSNNNNKLN

SEQ ID NO: 3309751 - protein, 5 aa, Plasmodium falciparum
ELNSS

SEQ ID NO: 3309752 - protein, 4 aa, Plasmodium falciparum
ELNT

SEQ ID NO: 3309753 - protein, 5 aa, Plasmodium falciparum
ELNTR

SEQ ID NO: 3309754 - protein, 10 aa, Plasmodium falciparum
ELPEKKKENM

SEQ ID NO: 3309755 - protein, 6 aa, Plasmodium falciparum
ELPENA

SEQ ID NO: 3309756 - protein, 5 aa, Plasmodium falciparum
ELPHH

SEQ ID NO: 3309757 - protein, 21 aa, Plasmodium falciparum
ELPNDTIKKDSVHKKESLSQE

SEQ ID NO: 3309758 - protein, 14 aa, Plasmodium falciparum
ELPPEKEKINNESI

SEQ ID NO: 3309759 - protein, 5 aa, Plasmodium falciparum
ELQDP

SEQ ID NO: 3309760 - protein, 7 aa, Plasmodium falciparum
ELQEERR

SEQ ID NO: 3309761 - protein, 9 aa, Plasmodium falciparum
ELQEKVEDK

SEQ ID NO: 3309762 - protein, 12 aa, Plasmodium falciparum
ELQERGDRSVRR

SEQ ID NO: 3309763 - protein, 4 aa, Plasmodium falciparum
ELQN

SEQ ID NO: 3309764 - protein, 7 aa, Plasmodium falciparum
ELQNEEK

SEQ ID NO: 3309765 - protein, 16 aa, Plasmodium falciparum
ELSDEEVSSENEYNKK

SEQ ID NO: 3309766 - protein, 7 aa, Plasmodium falciparum
ELSDYTG

SEQ ID NO: 3309767 - protein, 5 aa, Plasmodium falciparum
ELSGA

SEQ ID NO: 3309768 - protein, 9 aa, Plasmodium falciparum
ELSGSNNLT

SEQ ID NO: 3309769 - protein, 5 aa, Plasmodium falciparum
ELSGT

SEQ ID NO: 3309770 - protein, 8 aa, Plasmodium falciparum
ELSQPPNQ

SEQ ID NO: 3309771 - protein, 5 aa, Plasmodium falciparum
ELSSD

SEQ ID NO: 3309772 - protein, 5 aa, Plasmodium falciparum
ELSTD

SEQ ID NO: 3309773 - protein, 9 aa, Plasmodium falciparum
ELSTTECDK

SEQ ID NO: 3309774 - protein, 6 aa, Plasmodium falciparum
ELTEED

SEQ ID NO: 3309775 - protein, 11 aa, Plasmodium falciparum
ELTKKNRQRNT

SEQ ID NO: 3309776 - protein, 14 aa, Plasmodium falciparum
ELTKNKSTNIAKDQ

SEQ ID NO: 3309777 - protein, 6 aa, Plasmodium falciparum
ELTNEE

SEQ ID NO: 3309778 - protein, 13 aa, Plasmodium falciparum
ELTSSAEENNEDI

SEQ ID NO: 3309779 - protein, 10 aa, Plasmodium falciparum
ELTSSNNNKL

SEQ ID NO: 3309780 - protein, 12 aa, Plasmodium falciparum
ELYKSKKDSTLS

SEQ ID NO: 3309781 - protein, 29 aa, Plasmodium falciparum
EMASSHNRKRKKTGDNNNNNNNNNNVTTA

SEQ ID NO: 3309782 - protein, 13 aa, Plasmodium falciparum
EMCNESDVNNNNI

SEQ ID NO: 3309783 - protein, 6 aa, Plasmodium falciparum
EMDNEN

SEQ ID NO: 3309784 - protein, 4 aa, Plasmodium falciparum
EMDY

SEQ ID NO: 3309785 - protein, 5 aa, Plasmodium falciparum
EMEDE

SEQ ID NO: 3309786 - protein, 18 aa, Plasmodium falciparum
EMEEREKEIDNERRNIER

SEQ ID NO: 3309787 - protein, 16 aa, Plasmodium falciparum
EMETGRINQEDKSDIS

SEQ ID NO: 3309788 - protein, 15 aa, Plasmodium falciparum
EMGNIEKEEQDNDMY

SEQ ID NO: 3309789 - protein, 9 aa, Plasmodium falciparum
EMGTSGNMK

SEQ ID NO: 3309790 - protein, 10 aa, Plasmodium falciparum
EMKDQNNSYH

SEQ ID NO: 3309791 - protein, 6 aa, Plasmodium falciparum
EMKETN

SEQ ID NO: 3309792 - protein, 13 aa, Plasmodium falciparum
EMKGAKNDSLNQN

SEQ ID NO: 3309793 - protein, 10 aa, Plasmodium falciparum
EMKGNNDNID

SEQ ID NO: 3309794 - protein, 14 aa, Plasmodium falciparum
EMKKSSNKNKKSET

SEQ ID NO: 3309795 - protein, 5 aa, Plasmodium falciparum
EMKNE

SEQ ID NO: 3309796 - protein, 10 aa, Plasmodium falciparum
EMKNQNENVP

SEQ ID NO: 3309797 - protein, 5 aa, Plasmodium falciparum
EMMNN

SEQ ID NO: 3309798 - protein, 4 aa, Plasmodium falciparum
EMNE

SEQ ID NO: 3309799 - protein, 8 aa, Plasmodium falciparum
EMNKMGPN

SEQ ID NO: 3309800 - protein, 4 aa, Plasmodium falciparum
EMNN

SEQ ID NO: 3309801 - protein, 5 aa, Plasmodium falciparum
EMNNN

SEQ ID NO: 3309802 - protein, 6 aa, Plasmodium falciparum
EMNNNT

SEQ ID NO: 3309803 - protein, 14 aa, Plasmodium falciparum
EMNSQNINEHNEEY

SEQ ID NO: 3309804 - protein, 8 aa, Plasmodium falciparum
EMNSSPSI

SEQ ID NO: 3309805 - protein, 5 aa, Plasmodium falciparum
EMNTQ

SEQ ID NO: 3309806 - protein, 15 aa, Plasmodium falciparum
EMQNEDNEEQGSNSF

SEQ ID NO: 3309807 - protein, 48 aa, Plasmodium falciparum
EMSGELSDEMSDEMSDEMSDEMSDEMSDEMSDEMSDEMSDKTSDEMSN

SEQ ID NO: 3309808 - protein, 26 aa, Plasmodium falciparum
EMSNNTDKINEDSTVGVTDKGDNKLD

SEQ ID NO: 3309809 - protein, 31 aa, Plasmodium falciparum
EMSSNDEYKNVQKKKQVYNNSDDHKNSNEDQ

SEQ ID NO: 3309810 - protein, 6 aa, Plasmodium falciparum
EMTQGT

SEQ ID NO: 3309811 - protein, 7 aa, Plasmodium falciparum
ENAADCG

SEQ ID NO: 3309812 - protein, 5 aa, Plasmodium falciparum
ENADT

SEQ ID NO: 3309813 - protein, 8 aa, Plasmodium falciparum
ENADTNVN

SEQ ID NO: 3309814 - protein, 4 aa, Plasmodium falciparum
ENAE

SEQ ID NO: 3309815 - protein, 16 aa, Plasmodium falciparum
ENAEESNNYSSPYNEK

SEQ ID NO: 3309816 - protein, 19 aa, Plasmodium falciparum
ENAGGFPNYPKEGPPPNHF

SEQ ID NO: 3309817 - protein, 8 aa, Plasmodium falciparum
ENAGHEGS

SEQ ID NO: 3309818 - protein, 9 aa, Plasmodium falciparum
ENAKGNGTS

SEQ ID NO: 3309819 - protein, 6 aa, Plasmodium falciparum
ENAKKR

SEQ ID NO: 3309820 - protein, 4 aa, Plasmodium falciparum
ENAN

SEQ ID NO: 3309821 - protein, 10 aa, Plasmodium falciparum
ENANGTIENE

SEQ ID NO: 3309822 - protein, 5 aa, Plasmodium falciparum
ENANM

SEQ ID NO: 3309823 - protein, 7 aa, Plasmodium falciparum
ENASSIN

SEQ ID NO: 3309824 - protein, 269 aa, Plasmodium falciparum
ENAVTNDKGSHYSSRRSRSHSNKVSRGSSRRREGSSRRRDSSRRRDSSRRRDRYSRRYERRSERKDDSRREERRGDSRRDSSRRDSSRRNDRRDESRRDESRRDESRRDESRRDESRRDESRRDESRRDESRRDESRRDESRRDESRREESRRDESRREESRRDESRRTADDRKDDHADSVTTKKDDYKRRGTDDSKKEENNRGGSSYDYNNRKHRTYDKHSSSRNNYDRKRNSRYSVSDKKNYDNKSYISDDKRKHRDSYDKSFRNSH

SEQ ID NO: 3309825 - protein, 6 aa, Plasmodium falciparum
ENCRGS

SEQ ID NO: 3309826 - protein, 22 aa, Plasmodium falciparum
ENDDDEEVEENDEDDDDDNNNK

SEQ ID NO: 3309827 - protein, 12 aa, Plasmodium falciparum
ENDDDNINNENV

SEQ ID NO: 3309828 - protein, 8 aa, Plasmodium falciparum
ENDDGTTN

SEQ ID NO: 3309829 - protein, 24 aa, Plasmodium falciparum
ENDDKNNNNDNNNYMDSNNYAKNN

SEQ ID NO: 3309830 - protein, 16 aa, Plasmodium falciparum
ENDDVEDTEEDANKNY

SEQ ID NO: 3309831 - protein, 5 aa, Plasmodium falciparum
ENDDY

SEQ ID NO: 3309832 - protein, 6 aa, Plasmodium falciparum
ENDDYD

SEQ ID NO: 3309833 - protein, 4 aa, Plasmodium falciparum
ENDE

SEQ ID NO: 3309834 - protein, 60 aa, Plasmodium falciparum
ENDEEEATDDNEEKNEEEKNDDNEEEEEYENNDNEKYNKNNSDDVNEDNKSLEDAEEEDT

SEQ ID NO: 3309835 - protein, 7 aa, Plasmodium falciparum
ENDEHLE

SEQ ID NO: 3309836 - protein, 12 aa, Plasmodium falciparum
ENDEKDNQNEKQ

SEQ ID NO: 3309837 - protein, 6 aa, Plasmodium falciparum
ENDEKI

SEQ ID NO: 3309838 - protein, 8 aa, Plasmodium falciparum
ENDELRDN

SEQ ID NO: 3309839 - protein, 24 aa, Plasmodium falciparum
ENDENEKKKRRKRSNNNDNYNSHD

SEQ ID NO: 3309840 - protein, 8 aa, Plasmodium falciparum
ENDENMSK

SEQ ID NO: 3309841 - protein, 9 aa, Plasmodium falciparum
ENDENQNFQ

SEQ ID NO: 3309842 - protein, 5 aa, Plasmodium falciparum
ENDEP

SEQ ID NO: 3309843 - protein, 6 aa, Plasmodium falciparum
ENDEPV

SEQ ID NO: 3309844 - protein, 4 aa, Plasmodium falciparum
ENDF

SEQ ID NO: 3309845 - protein, 14 aa, Plasmodium falciparum
ENDFTDRKKGNNKI

SEQ ID NO: 3309846 - protein, 6 aa, Plasmodium falciparum
ENDGCI

SEQ ID NO: 3309847 - protein, 10 aa, Plasmodium falciparum
ENDGDDYKKN

SEQ ID NO: 3309848 - protein, 5 aa, Plasmodium falciparum
ENDGQ

SEQ ID NO: 3309849 - protein, 5 aa, Plasmodium falciparum
ENDGT

SEQ ID NO: 3309850 - protein, 23 aa, Plasmodium falciparum
ENDGVEGREKQKISSQEYRGDKS

SEQ ID NO: 3309851 - protein, 4 aa, Plasmodium falciparum
ENDI

SEQ ID NO: 3309852 - protein, 6 aa, Plasmodium falciparum
ENDIGG

SEQ ID NO: 3309853 - protein, 21 aa, Plasmodium falciparum
ENDIKDDNNDDNNNNNNNNVN

SEQ ID NO: 3309854 - protein, 13 aa, Plasmodium falciparum
ENDINNEDNNTHS

SEQ ID NO: 3309855 - protein, 8 aa, Plasmodium falciparum
ENDKDKDI

SEQ ID NO: 3309856 - protein, 6 aa, Plasmodium falciparum
ENDKDL

SEQ ID NO: 3309857 - protein, 28 aa, Plasmodium falciparum
ENDKEENNKNSLNNKEYKEDIKNKTYKS

SEQ ID NO: 3309858 - protein, 6 aa, Plasmodium falciparum
ENDKIE

SEQ ID NO: 3309859 - protein, 10 aa, Plasmodium falciparum
ENDKKAETFD

SEQ ID NO: 3309860 - protein, 6 aa, Plasmodium falciparum
ENDKKE

SEQ ID NO: 3309861 - protein, 8 aa, Plasmodium falciparum
ENDKTENI

SEQ ID NO: 3309862 - protein, 4 aa, Plasmodium falciparum
ENDL

SEQ ID NO: 3309863 - protein, 7 aa, Plasmodium falciparum
ENDLKNM

SEQ ID NO: 3309864 - protein, 5 aa, Plasmodium falciparum
ENDLT

SEQ ID NO: 3309865 - protein, 7 aa, Plasmodium falciparum
ENDMNGN

SEQ ID NO: 3309866 - protein, 5 aa, Plasmodium falciparum
ENDNC

SEQ ID NO: 3309867 - protein, 12 aa, Plasmodium falciparum
ENDNDNKISSEK

SEQ ID NO: 3309868 - protein, 8 aa, Plasmodium falciparum
ENDNKDDW

SEQ ID NO: 3309869 - protein, 24 aa, Plasmodium falciparum
ENDNNNNNKNNNKNESNNNRNEKK

SEQ ID NO: 3309870 - protein, 12 aa, Plasmodium falciparum
ENDNNNNNNNDN

SEQ ID NO: 3309871 - protein, 6 aa, Plasmodium falciparum
ENDNSI

SEQ ID NO: 3309872 - protein, 7 aa, Plasmodium falciparum
ENDNSQL

SEQ ID NO: 3309873 - protein, 13 aa, Plasmodium falciparum
ENDNVGKEHETNI

SEQ ID NO: 3309874 - protein, 30 aa, Plasmodium falciparum
ENDNVKDEKSEEIKPMEKKTSKKNKKEIRI

SEQ ID NO: 3309875 - protein, 29 aa, Plasmodium falciparum
ENDNVNDDEDNYYDEEENNYNNDDNYDEE

SEQ ID NO: 3309876 - protein, 12 aa, Plasmodium falciparum
ENDPNGKVETNE

SEQ ID NO: 3309877 - protein, 7 aa, Plasmodium falciparum
ENDPPNV

SEQ ID NO: 3309878 - protein, 14 aa, Plasmodium falciparum
ENDQREDEDEYENK

SEQ ID NO: 3309879 - protein, 10 aa, Plasmodium falciparum
ENDQSKESVE

SEQ ID NO: 3309880 - protein, 9 aa, Plasmodium falciparum
ENDRSETTF

SEQ ID NO: 3309881 - protein, 21 aa, Plasmodium falciparum
ENDSDYIDDNYNSDDNNNNNY

SEQ ID NO: 3309882 - protein, 9 aa, Plasmodium falciparum
ENDSKEKYF

SEQ ID NO: 3309883 - protein, 10 aa, Plasmodium falciparum
ENDSKSLKGN

SEQ ID NO: 3309884 - protein, 10 aa, Plasmodium falciparum
ENDSPEPCKD

SEQ ID NO: 3309885 - protein, 12 aa, Plasmodium falciparum
ENDSSSNDEQKP

SEQ ID NO: 3309886 - protein, 6 aa, Plasmodium falciparum
ENDVDN

SEQ ID NO: 3309887 - protein, 14 aa, Plasmodium falciparum
ENDVTNKNQSNEEN

SEQ ID NO: 3309888 - protein, 4 aa, Plasmodium falciparum
ENDY

SEQ ID NO: 3309889 - protein, 18 aa, Plasmodium falciparum
ENDYNNDEQEKQNIGKYT

SEQ ID NO: 3309890 - protein, 21 aa, Plasmodium falciparum
ENDYRNNNNKEKNKIKNNKRD

SEQ ID NO: 3309891 - protein, 6 aa, Plasmodium falciparum
ENDYSL

SEQ ID NO: 3309892 - protein, 13 aa, Plasmodium falciparum
ENDYVEKRNKNNV

SEQ ID NO: 3309893 - protein, 6 aa, Plasmodium falciparum
ENEAQT

SEQ ID NO: 3309894 - protein, 4 aa, Plasmodium falciparum
ENED

SEQ ID NO: 3309895 - protein, 7 aa, Plasmodium falciparum
ENEDDLE

SEQ ID NO: 3309896 - protein, 7 aa, Plasmodium falciparum
ENEDNIK

SEQ ID NO: 3309897 - protein, 7 aa, Plasmodium falciparum
ENEDPSS

SEQ ID NO: 3309898 - protein, 17 aa, Plasmodium falciparum
ENEDRKDKYTNSSHTSE

SEQ ID NO: 3309899 - protein, 13 aa, Plasmodium falciparum
ENEEDEVRKPDNT

SEQ ID NO: 3309900 - protein, 7 aa, Plasmodium falciparum
ENEEDIE

SEQ ID NO: 3309901 - protein, 20 aa, Plasmodium falciparum
ENEEDNKNKQKKKKNDTTIQ

SEQ ID NO: 3309902 - protein, 9 aa, Plasmodium falciparum
ENEEEREKI

SEQ ID NO: 3309903 - protein, 7 aa, Plasmodium falciparum
ENEEESE

SEQ ID NO: 3309904 - protein, 6 aa, Plasmodium falciparum
ENEEKA

SEQ ID NO: 3309905 - protein, 20 aa, Plasmodium falciparum
ENEEKRKTINYQQEQERITA

SEQ ID NO: 3309906 - protein, 15 aa, Plasmodium falciparum
ENEELPKEVQNNERV

SEQ ID NO: 3309907 - protein, 8 aa, Plasmodium falciparum
ENEELPRK

SEQ ID NO: 3309908 - protein, 9 aa, Plasmodium falciparum
ENEENEESG

SEQ ID NO: 3309909 - protein, 6 aa, Plasmodium falciparum
ENEENS

SEQ ID NO: 3309910 - protein, 81 aa, Plasmodium falciparum
ENEGGKKKVQRQKKYHQENDERDAYKRNNAKYEEDDNREQVEKNNEGEKNDEGGKKGEGEKKGEGEKKGEGEKKDEQEEQI

SEQ ID NO: 3309911 - protein, 21 aa, Plasmodium falciparum
ENEGNSKNIKKGKKKKSKIKI

SEQ ID NO: 3309912 - protein, 7 aa, Plasmodium falciparum
ENEHGKI

SEQ ID NO: 3309913 - protein, 8 aa, Plasmodium falciparum
ENEHHTTK

SEQ ID NO: 3309914 - protein, 4 aa, Plasmodium falciparum
ENEI

SEQ ID NO: 3309915 - protein, 5 aa, Plasmodium falciparum
ENEID

SEQ ID NO: 3309916 - protein, 12 aa, Plasmodium falciparum
ENEIEEKNEEAT

SEQ ID NO: 3309917 - protein, 7 aa, Plasmodium falciparum
ENEISEE

SEQ ID NO: 3309918 - protein, 4 aa, Plasmodium falciparum
ENEK

SEQ ID NO: 3309919 - protein, 8 aa, Plasmodium falciparum
ENEKAEDI

SEQ ID NO: 3309920 - protein, 8 aa, Plasmodium falciparum
ENEKDNDN

SEQ ID NO: 3309921 - protein, 121 aa, Plasmodium falciparum
ENEKDTEKKEADGGEDKEKEGKEEEDKEEEDKEEEDKKEEDKKEECKEEYKEDCKDKEEDKKECKDKEEGKKECKEEGKKECKEECKEEGKKECKEEGKEEDKEKDKEENNEKEDKEEEIN

SEQ ID NO: 3309922 - protein, 5 aa, Plasmodium falciparum
ENEKE

SEQ ID NO: 3309923 - protein, 9 aa, Plasmodium falciparum
ENEKEENEK

SEQ ID NO: 3309924 - protein, 12 aa, Plasmodium falciparum
ENEKEKDEDKSV

SEQ ID NO: 3309925 - protein, 12 aa, Plasmodium falciparum
ENEKEKKNRKSV

SEQ ID NO: 3309926 - protein, 6 aa, Plasmodium falciparum
ENEKEY

SEQ ID NO: 3309927 - protein, 8 aa, Plasmodium falciparum
ENEKGATK

SEQ ID NO: 3309928 - protein, 7 aa, Plasmodium falciparum
ENEKHSE

SEQ ID NO: 3309929 - protein, 5 aa, Plasmodium falciparum
ENEKK

SEQ ID NO: 3309930 - protein, 14 aa, Plasmodium falciparum
ENEKKELDELEDKE

SEQ ID NO: 3309931 - protein, 28 aa, Plasmodium falciparum
ENEKKQREKKNENAENNIYEEKENNKIQ

SEQ ID NO: 3309932 - protein, 13 aa, Plasmodium falciparum
ENEKKRKEEEEKY

SEQ ID NO: 3309933 - protein, 9 aa, Plasmodium falciparum
ENEKKRTHI

SEQ ID NO: 3309934 - protein, 16 aa, Plasmodium falciparum
ENEKKTEKKNSKSTML

SEQ ID NO: 3309935 - protein, 5 aa, Plasmodium falciparum
ENEKN

SEQ ID NO: 3309936 - protein, 10 aa, Plasmodium falciparum
ENEKNEKDHI

SEQ ID NO: 3309937 - protein, 9 aa, Plasmodium falciparum
ENEKQENGN

SEQ ID NO: 3309938 - protein, 10 aa, Plasmodium falciparum
ENEKQKEEEK

SEQ ID NO: 3309939 - protein, 7 aa, Plasmodium falciparum
ENEKQYN

SEQ ID NO: 3309940 - protein, 16 aa, Plasmodium falciparum
ENEKSDDYSSLSNNQN

SEQ ID NO: 3309941 - protein, 9 aa, Plasmodium falciparum
ENEKTDTNF

SEQ ID NO: 3309942 - protein, 9 aa, Plasmodium falciparum
ENEKTNDIN

SEQ ID NO: 3309943 - protein, 7 aa, Plasmodium falciparum
ENEKYRN

SEQ ID NO: 3309944 - protein, 10 aa, Plasmodium falciparum
ENEMESDKEK

SEQ ID NO: 3309945 - protein, 5 aa, Plasmodium falciparum
ENEMN

SEQ ID NO: 3309946 - protein, 21 aa, Plasmodium falciparum
ENENDNDDVNTGNNNEEGFEN

SEQ ID NO: 3309947 - protein, 9 aa, Plasmodium falciparum
ENENEEEKI

SEQ ID NO: 3309948 - protein, 12 aa, Plasmodium falciparum
ENENEKRTDNVN

SEQ ID NO: 3309949 - protein, 6 aa, Plasmodium falciparum
ENENEN

SEQ ID NO: 3309950 - protein, 9 aa, Plasmodium falciparum
ENENEYKSS

SEQ ID NO: 3309951 - protein, 7 aa, Plasmodium falciparum
ENENIPK

SEQ ID NO: 3309952 - protein, 19 aa, Plasmodium falciparum
ENENKKYLPDGSSKSFDID

SEQ ID NO: 3309953 - protein, 5 aa, Plasmodium falciparum
ENENL

SEQ ID NO: 3309954 - protein, 6 aa, Plasmodium falciparum
ENENLD

SEQ ID NO: 3309955 - protein, 6 aa, Plasmodium falciparum
ENENLR

SEQ ID NO: 3309956 - protein, 17 aa, Plasmodium falciparum
ENENNEWKEKNQKMHEE

SEQ ID NO: 3309957 - protein, 6 aa, Plasmodium falciparum
ENENNS

SEQ ID NO: 3309958 - protein, 11 aa, Plasmodium falciparum
ENENSKEPKIS

SEQ ID NO: 3309959 - protein, 9 aa, Plasmodium falciparum
ENENSNEAF

SEQ ID NO: 3309960 - protein, 8 aa, Plasmodium falciparum
ENENSNMS

SEQ ID NO: 3309961 - protein, 10 aa, Plasmodium falciparum
ENENSYEEEE

SEQ ID NO: 3309962 - protein, 12 aa, Plasmodium falciparum
ENENYKSSKELS

SEQ ID NO: 3309963 - protein, 7 aa, Plasmodium falciparum
ENEPSDF

SEQ ID NO: 3309964 - protein, 9 aa, Plasmodium falciparum
ENEQPPKLQ

SEQ ID NO: 3309965 - protein, 18 aa, Plasmodium falciparum
ENERAQIDDNKNGYEKNI

SEQ ID NO: 3309966 - protein, 5 aa, Plasmodium falciparum
ENERN

SEQ ID NO: 3309967 - protein, 7 aa, Plasmodium falciparum
ENERQEY

SEQ ID NO: 3309968 - protein, 46 aa, Plasmodium falciparum
ENERTNQHNNCNNNNNNNYYDDDDNNNNNDNNYNNNNNNNNDNNLN

SEQ ID NO: 3309969 - protein, 23 aa, Plasmodium falciparum
ENERYDSKRGTNNNISGEYQNAS

SEQ ID NO: 3309970 - protein, 16 aa, Plasmodium falciparum
ENESDDYDNNNNDEFY

SEQ ID NO: 3309971 - protein, 9 aa, Plasmodium falciparum
ENESEQSYS

SEQ ID NO: 3309972 - protein, 12 aa, Plasmodium falciparum
ENESHTERTEGD

SEQ ID NO: 3309973 - protein, 7 aa, Plasmodium falciparum
ENETEEL

SEQ ID NO: 3309974 - protein, 5 aa, Plasmodium falciparum
ENETK

SEQ ID NO: 3309975 - protein, 5 aa, Plasmodium falciparum
ENETL

SEQ ID NO: 3309976 - protein, 6 aa, Plasmodium falciparum
ENETLR

SEQ ID NO: 3309977 - protein, 5 aa, Plasmodium falciparum
ENETN

SEQ ID NO: 3309978 - protein, 11 aa, Plasmodium falciparum
ENETNDSIKKI

SEQ ID NO: 3309979 - protein, 11 aa, Plasmodium falciparum
ENEVRKNKKDT

SEQ ID NO: 3309980 - protein, 5 aa, Plasmodium falciparum
ENEYN

SEQ ID NO: 3309981 - protein, 12 aa, Plasmodium falciparum
ENFKNDNKKKNI

SEQ ID NO: 3309982 - protein, 118 aa, Plasmodium falciparum
ENFNASETINSNSNSNSNINSNINSNSNSNSNSNSNINSNSNSNSNINSNSNNNCFEPTGNNLNESDDTTNQINESDHSTNPFNESDDTNNEHKTLEKKEKEINPYRNNNDNKKDNDV

SEQ ID NO: 3309983 - protein, 5 aa, Plasmodium falciparum
ENFQG

SEQ ID NO: 3309984 - protein, 5 aa, Plasmodium falciparum
ENFQN

SEQ ID NO: 3309985 - protein, 11 aa, Plasmodium falciparum
ENFSNNSPDNL

SEQ ID NO: 3309986 - protein, 9 aa, Plasmodium falciparum
ENFSSDSSN

SEQ ID NO: 3309987 - protein, 12 aa, Plasmodium falciparum
ENFSTSEKLSSK

SEQ ID NO: 3309988 - protein, 103 aa, Plasmodium falciparum
ENGEETKVEKKVKKKKDKKKVNKEDKKKVNKEDKKKVNKEDKKKVNKEDKKKDKKKDKKKDKKKDKKKVNKKDKKKVNKKDKEKDNKLNRNTHTELDETSIQN

SEQ ID NO: 3309989 - protein, 9 aa, Plasmodium falciparum
ENGEQEPIG

SEQ ID NO: 3309990 - protein, 8 aa, Plasmodium falciparum
ENGGKHSG

SEQ ID NO: 3309991 - protein, 6 aa, Plasmodium falciparum
ENGGYN

SEQ ID NO: 3309992 - protein, 58 aa, Plasmodium falciparum
ENGHNVNNNKNNDGGDADGDADGDDNGDDNGDDNGDDNGDDNGDDNGDDNGDDYDEDN

SEQ ID NO: 3309993 - protein, 4 aa, Plasmodium falciparum
ENGI

SEQ ID NO: 3309994 - protein, 7 aa, Plasmodium falciparum
ENGKAIP

SEQ ID NO: 3309995 - protein, 8 aa, Plasmodium falciparum
ENGKDGNL

SEQ ID NO: 3309996 - protein, 5 aa, Plasmodium falciparum
ENGKE

SEQ ID NO: 3309997 - protein, 25 aa, Plasmodium falciparum
ENGKEETVKKGENVYGEKQILFDED

SEQ ID NO: 3309998 - protein, 9 aa, Plasmodium falciparum
ENGKIQTKG

SEQ ID NO: 3309999 - protein, 7 aa, Plasmodium falciparum
ENGKNSF

SEQ ID NO: 3310000 - protein, 13 aa, Plasmodium falciparum
ENGKNTKLNPVPS

SEQ ID NO: 3310001 - protein, 7 aa, Plasmodium falciparum
ENGKRRK

SEQ ID NO: 3310002 - protein, 22 aa, Plasmodium falciparum
ENGNCDDNNNIDDNNNIDDNNY

SEQ ID NO: 3310003 - protein, 9 aa, Plasmodium falciparum
ENGNDKSVN

SEQ ID NO: 3310004 - protein, 5 aa, Plasmodium falciparum
ENGNN

SEQ ID NO: 3310005 - protein, 10 aa, Plasmodium falciparum
ENGNNKDNFN

SEQ ID NO: 3310006 - protein, 19 aa, Plasmodium falciparum
ENGNNNNNNNNKNDKLKNS

SEQ ID NO: 3310007 - protein, 6 aa, Plasmodium falciparum
ENGNNY

SEQ ID NO: 3310008 - protein, 10 aa, Plasmodium falciparum
ENGPKNNYVS

SEQ ID NO: 3310009 - protein, 9 aa, Plasmodium falciparum
ENGSGKTTI

SEQ ID NO: 3310010 - protein, 6 aa, Plasmodium falciparum
ENGSLR

SEQ ID NO: 3310011 - protein, 5 aa, Plasmodium falciparum
ENGTY

SEQ ID NO: 3310012 - protein, 8 aa, Plasmodium falciparum
ENHEEDKN

SEQ ID NO: 3310013 - protein, 17 aa, Plasmodium falciparum
ENHEKKKCDRTKQCNDV

SEQ ID NO: 3310014 - protein, 16 aa, Plasmodium falciparum
ENHINNGTIENEQNNF

SEQ ID NO: 3310015 - protein, 8 aa, Plasmodium falciparum
ENHKKEEK

SEQ ID NO: 3310016 - protein, 4 aa, Plasmodium falciparum
ENHM

SEQ ID NO: 3310017 - protein, 5 aa, Plasmodium falciparum
ENHNN

SEQ ID NO: 3310018 - protein, 22 aa, Plasmodium falciparum
ENHPNKISDGNYNKNNQKDNHM

SEQ ID NO: 3310019 - protein, 11 aa, Plasmodium falciparum
ENHSKDHEIPN

SEQ ID NO: 3310020 - protein, 6 aa, Plasmodium falciparum
ENHSNN

SEQ ID NO: 3310021 - protein, 11 aa, Plasmodium falciparum
ENHSNYSSGTT

SEQ ID NO: 3310022 - protein, 35 aa, Plasmodium falciparum
ENHSTMNNNNNNNNNNNNNDNNNYNYDYNNNNKKY

SEQ ID NO: 3310023 - protein, 5 aa, Plasmodium falciparum
ENHSV

SEQ ID NO: 3310024 - protein, 15 aa, Plasmodium falciparum
ENHTEDETDHEQNYE

SEQ ID NO: 3310025 - protein, 7 aa, Plasmodium falciparum
ENHTIDP

SEQ ID NO: 3310026 - protein, 5 aa, Plasmodium falciparum
ENHTK

SEQ ID NO: 3310027 - protein, 7 aa, Plasmodium falciparum
ENHTSNT

SEQ ID NO: 3310028 - protein, 11 aa, Plasmodium falciparum
ENIDNDKNKLV

SEQ ID NO: 3310029 - protein, 12 aa, Plasmodium falciparum
ENIEDDEIEENV

SEQ ID NO: 3310030 - protein, 40 aa, Plasmodium falciparum
ENIEENTNEIKKNANNANDTNDANDANDANDAKANKQSQI

SEQ ID NO: 3310031 - protein, 12 aa, Plasmodium falciparum
ENIEKKPPKGSI

SEQ ID NO: 3310032 - protein, 6 aa, Plasmodium falciparum
ENIEME

SEQ ID NO: 3310033 - protein, 6 aa, Plasmodium falciparum
ENIENV

SEQ ID NO: 3310034 - protein, 5 aa, Plasmodium falciparum
ENIEQ

SEQ ID NO: 3310035 - protein, 8 aa, Plasmodium falciparum
ENIGENEK

SEQ ID NO: 3310036 - protein, 7 aa, Plasmodium falciparum
ENIGNNR

SEQ ID NO: 3310037 - protein, 4 aa, Plasmodium falciparum
ENIK

SEQ ID NO: 3310038 - protein, 5 aa, Plasmodium falciparum
ENIKE

SEQ ID NO: 3310039 - protein, 10 aa, Plasmodium falciparum
ENIKKENKNI

SEQ ID NO: 3310040 - protein, 7 aa, Plasmodium falciparum
ENIKKES

SEQ ID NO: 3310041 - protein, 15 aa, Plasmodium falciparum
ENIKKKKEKYTDNLD

SEQ ID NO: 3310042 - protein, 16 aa, Plasmodium falciparum
ENIKSSNNKMNKEQKL

SEQ ID NO: 3310043 - protein, 16 aa, Plasmodium falciparum
ENIKTDKKVKNEKEDI

SEQ ID NO: 3310044 - protein, 9 aa, Plasmodium falciparum
ENIKTQHPL

SEQ ID NO: 3310045 - protein, 4 aa, Plasmodium falciparum
ENIL

SEQ ID NO: 3310046 - protein, 5 aa, Plasmodium falciparum
ENIND

SEQ ID NO: 3310047 - protein, 18 aa, Plasmodium falciparum
ENINDDNNNENNDNIEDM

SEQ ID NO: 3310048 - protein, 7 aa, Plasmodium falciparum
ENINEEL

SEQ ID NO: 3310049 - protein, 7 aa, Plasmodium falciparum
ENINKQN

SEQ ID NO: 3310050 - protein, 53 aa, Plasmodium falciparum
ENINKTNDNPAPPVKRKRGRPKMKKNTPEETQPTDLASNSNASSSYQATNTNI

SEQ ID NO: 3310051 - protein, 31 aa, Plasmodium falciparum
ENINNTEIKEDSNGKEINENINNKEINENIN

SEQ ID NO: 3310052 - protein, 5 aa, Plasmodium falciparum
ENINS

SEQ ID NO: 3310053 - protein, 16 aa, Plasmodium falciparum
ENINSNSNLKKKKGTY

SEQ ID NO: 3310054 - protein, 10 aa, Plasmodium falciparum
ENINTNEREY

SEQ ID NO: 3310055 - protein, 12 aa, Plasmodium falciparum
ENINTSGSFNTE

SEQ ID NO: 3310056 - protein, 12 aa, Plasmodium falciparum
ENIPEDKKHEQN

SEQ ID NO: 3310057 - protein, 4 aa, Plasmodium falciparum
ENIQ

SEQ ID NO: 3310058 - protein, 6 aa, Plasmodium falciparum
ENIQDC

SEQ ID NO: 3310059 - protein, 5 aa, Plasmodium falciparum
ENIQE

SEQ ID NO: 3310060 - protein, 8 aa, Plasmodium falciparum
ENIQEEKD

SEQ ID NO: 3310061 - protein, 6 aa, Plasmodium falciparum
ENIQGG

SEQ ID NO: 3310062 - protein, 6 aa, Plasmodium falciparum
ENIQNR

SEQ ID NO: 3310063 - protein, 4 aa, Plasmodium falciparum
ENIS

SEQ ID NO: 3310064 - protein, 22 aa, Plasmodium falciparum
ENISDDEQNTCDNDSELSDLND

SEQ ID NO: 3310065 - protein, 7 aa, Plasmodium falciparum
ENISNKQ

SEQ ID NO: 3310066 - protein, 6 aa, Plasmodium falciparum
ENISSS

SEQ ID NO: 3310067 - protein, 10 aa, Plasmodium falciparum
ENISTSPGIK

SEQ ID NO: 3310068 - protein, 5 aa, Plasmodium falciparum
ENITA

SEQ ID NO: 3310069 - protein, 6 aa, Plasmodium falciparum
ENITDD

SEQ ID NO: 3310070 - protein, 10 aa, Plasmodium falciparum
ENITKEKNEV

SEQ ID NO: 3310071 - protein, 6 aa, Plasmodium falciparum
ENITNK

SEQ ID NO: 3310072 - protein, 21 aa, Plasmodium falciparum
ENITNKNNTCNNNQKRKNTYN

SEQ ID NO: 3310073 - protein, 6 aa, Plasmodium falciparum
ENITRY

SEQ ID NO: 3310074 - protein, 13 aa, Plasmodium falciparum
ENITTSNKYYPND

SEQ ID NO: 3310075 - protein, 19 aa, Plasmodium falciparum
ENKDEMKKKGKKGKDENVN

SEQ ID NO: 3310076 - protein, 18 aa, Plasmodium falciparum
ENKDHTVRQKKNSIEEYN

SEQ ID NO: 3310077 - protein, 5 aa, Plasmodium falciparum
ENKDI

SEQ ID NO: 3310078 - protein, 5 aa, Plasmodium falciparum
ENKDK

SEQ ID NO: 3310079 - protein, 8 aa, Plasmodium falciparum
ENKDMQEE

SEQ ID NO: 3310080 - protein, 6 aa, Plasmodium falciparum
ENKDNV

SEQ ID NO: 3310081 - protein, 5 aa, Plasmodium falciparum
ENKDS

SEQ ID NO: 3310082 - protein, 5 aa, Plasmodium falciparum
ENKED

SEQ ID NO: 3310083 - protein, 9 aa, Plasmodium falciparum
ENKEDKDKI

SEQ ID NO: 3310084 - protein, 13 aa, Plasmodium falciparum
ENKEDKYTSRSSQ

SEQ ID NO: 3310085 - protein, 10 aa, Plasmodium falciparum
ENKEEEKYNN

SEQ ID NO: 3310086 - protein, 83 aa, Plasmodium falciparum
ENKEEREDKDNMDRESDMKDHKSGNNIDSDIESGSDNDSDNKSDSNIDSDNESGNNIDSNIDSDNKSGSNIDSGEDDETHNKK

SEQ ID NO: 3310087 - protein, 55 aa, Plasmodium falciparum
ENKEITKNQSNNITHKSGETNNNLEKKENQNIETKNEKTSKKKDKKKNENYNKNN

SEQ ID NO: 3310088 - protein, 11 aa, Plasmodium falciparum
ENKEKEIKTSN

SEQ ID NO: 3310089 - protein, 7 aa, Plasmodium falciparum
ENKEKKN

SEQ ID NO: 3310090 - protein, 15 aa, Plasmodium falciparum
ENKELNENENENDNI

SEQ ID NO: 3310091 - protein, 9 aa, Plasmodium falciparum
ENKENTSEK

SEQ ID NO: 3310092 - protein, 6 aa, Plasmodium falciparum
ENKENY

SEQ ID NO: 3310093 - protein, 5 aa, Plasmodium falciparum
ENKES

SEQ ID NO: 3310094 - protein, 13 aa, Plasmodium falciparum
ENKESINNTTTNI

SEQ ID NO: 3310095 - protein, 8 aa, Plasmodium falciparum
ENKETNTN

SEQ ID NO: 3310096 - protein, 19 aa, Plasmodium falciparum
ENKEVEEEKEKEFEESEYN

SEQ ID NO: 3310097 - protein, 4 aa, Plasmodium falciparum
ENKF

SEQ ID NO: 3310098 - protein, 4 aa, Plasmodium falciparum
ENKG

SEQ ID NO: 3310099 - protein, 7 aa, Plasmodium falciparum
ENKGIPI

SEQ ID NO: 3310100 - protein, 6 aa, Plasmodium falciparum
ENKGVD

SEQ ID NO: 3310101 - protein, 17 aa, Plasmodium falciparum
ENKHKSKKGRKPKESNL

SEQ ID NO: 3310102 - protein, 7 aa, Plasmodium falciparum
ENKHNHT

SEQ ID NO: 3310103 - protein, 21 aa, Plasmodium falciparum
ENKIHNNNNNNNKKKTHVNNK

SEQ ID NO: 3310104 - protein, 5 aa, Plasmodium falciparum
ENKIS

SEQ ID NO: 3310105 - protein, 18 aa, Plasmodium falciparum
ENKIYKNNKNNKNDKTHI

SEQ ID NO: 3310106 - protein, 14 aa, Plasmodium falciparum
ENKKEEEEAKSDIS

SEQ ID NO: 3310107 - protein, 14 aa, Plasmodium falciparum
ENKKEIDKKSTNYD

SEQ ID NO: 3310108 - protein, 6 aa, Plasmodium falciparum
ENKKEN

SEQ ID NO: 3310109 - protein, 10 aa, Plasmodium falciparum
ENKKEQVNYK

SEQ ID NO: 3310110 - protein, 9 aa, Plasmodium falciparum
ENKKEVMQN

SEQ ID NO: 3310111 - protein, 10 aa, Plasmodium falciparum
ENKKFKGKYY

SEQ ID NO: 3310112 - protein, 13 aa, Plasmodium falciparum
ENKKGEKKNSVKN

SEQ ID NO: 3310113 - protein, 24 aa, Plasmodium falciparum
ENKKINDKDIKNNDELNTNKLEQK

SEQ ID NO: 3310114 - protein, 21 aa, Plasmodium falciparum
ENKKKDEKEKKNKIHNNDENN

SEQ ID NO: 3310115 - protein, 12 aa, Plasmodium falciparum
ENKKKKNKKIKK

SEQ ID NO: 3310116 - protein, 14 aa, Plasmodium falciparum
ENKKKNKKENKYKN

SEQ ID NO: 3310117 - protein, 6 aa, Plasmodium falciparum
ENKKKQ

SEQ ID NO: 3310118 - protein, 11 aa, Plasmodium falciparum
ENKKLKKRGDL

SEQ ID NO: 3310119 - protein, 5 aa, Plasmodium falciparum
ENKKN

SEQ ID NO: 3310120 - protein, 10 aa, Plasmodium falciparum
ENKKNEENKS

SEQ ID NO: 3310121 - protein, 14 aa, Plasmodium falciparum
ENKKNEGEHQNKKI

SEQ ID NO: 3310122 - protein, 10 aa, Plasmodium falciparum
ENKKNISNIQ

SEQ ID NO: 3310123 - protein, 25 aa, Plasmodium falciparum
ENKKNKRKRKKKKKKKKKENNIQNE

SEQ ID NO: 3310124 - protein, 6 aa, Plasmodium falciparum
ENKKNM

SEQ ID NO: 3310125 - protein, 9 aa, Plasmodium falciparum
ENKKNQDMT

SEQ ID NO: 3310126 - protein, 10 aa, Plasmodium falciparum
ENKKNQEKMK

SEQ ID NO: 3310127 - protein, 9 aa, Plasmodium falciparum
ENKKNSTSS

SEQ ID NO: 3310128 - protein, 9 aa, Plasmodium falciparum
ENKKNVNEE

SEQ ID NO: 3310129 - protein, 10 aa, Plasmodium falciparum
ENKKPKTGKL

SEQ ID NO: 3310130 - protein, 9 aa, Plasmodium falciparum
ENKKPYTNY

SEQ ID NO: 3310131 - protein, 7 aa, Plasmodium falciparum
ENKKQGI

SEQ ID NO: 3310132 - protein, 13 aa, Plasmodium falciparum
ENKKTAQNSPSLE

SEQ ID NO: 3310133 - protein, 8 aa, Plasmodium falciparum
ENKKTNDV

SEQ ID NO: 3310134 - protein, 9 aa, Plasmodium falciparum
ENKKTNHND

SEQ ID NO: 3310135 - protein, 6 aa, Plasmodium falciparum
ENKKYI

SEQ ID NO: 3310136 - protein, 8 aa, Plasmodium falciparum
ENKNAYPK

SEQ ID NO: 3310137 - protein, 9 aa, Plasmodium falciparum
ENKNAYPPI

SEQ ID NO: 3310138 - protein, 8 aa, Plasmodium falciparum
ENKNDEIN

SEQ ID NO: 3310139 - protein, 32 aa, Plasmodium falciparum
ENKNDEYEKNMDNRTSDNIKPESLSKQNDYEN

SEQ ID NO: 3310140 - protein, 25 aa, Plasmodium falciparum
ENKNDTVDTSDLEKKNIPDLSNDNN

SEQ ID NO: 3310141 - protein, 28 aa, Plasmodium falciparum
ENKNDVDRSGCNKREGDNNINNNNNNNI

SEQ ID NO: 3310142 - protein, 8 aa, Plasmodium falciparum
ENKNDVSQ

SEQ ID NO: 3310143 - protein, 18 aa, Plasmodium falciparum
ENKNEDIKENEPNNFNKT

SEQ ID NO: 3310144 - protein, 8 aa, Plasmodium falciparum
ENKNEEKE

SEQ ID NO: 3310145 - protein, 7 aa, Plasmodium falciparum
ENKNEKI

SEQ ID NO: 3310146 - protein, 19 aa, Plasmodium falciparum
ENKNENEKVYNSESELKER

SEQ ID NO: 3310147 - protein, 18 aa, Plasmodium falciparum
ENKNEQDVKKSSSSPLSI

SEQ ID NO: 3310148 - protein, 10 aa, Plasmodium falciparum
ENKNGDLSDD

SEQ ID NO: 3310149 - protein, 9 aa, Plasmodium falciparum
ENKNHYNGS

SEQ ID NO: 3310150 - protein, 12 aa, Plasmodium falciparum
ENKNKGKNKINP

SEQ ID NO: 3310151 - protein, 8 aa, Plasmodium falciparum
ENKNKHQG

SEQ ID NO: 3310152 - protein, 16 aa, Plasmodium falciparum
ENKNKIISNEEDPNNI

SEQ ID NO: 3310153 - protein, 21 aa, Plasmodium falciparum
ENKNKKKQNNQNYMEGTSNVQ

SEQ ID NO: 3310154 - protein, 23 aa, Plasmodium falciparum
ENKNKNIKKKNNNNKKKKASNDN

SEQ ID NO: 3310155 - protein, 9 aa, Plasmodium falciparum
ENKNKNKNF

SEQ ID NO: 3310156 - protein, 19 aa, Plasmodium falciparum
ENKNKNKRRKKEDFPTEEE

SEQ ID NO: 3310157 - protein, 6 aa, Plasmodium falciparum
ENKNME

SEQ ID NO: 3310158 - protein, 5 aa, Plasmodium falciparum
ENKNN

SEQ ID NO: 3310159 - protein, 11 aa, Plasmodium falciparum
ENKNNGALSSQ

SEQ ID NO: 3310160 - protein, 6 aa, Plasmodium falciparum
ENKNNI

SEQ ID NO: 3310161 - protein, 115 aa, Plasmodium falciparum
ENKNNKKKINKLRKEKKIDKENKQNDDNKENIQNDDNKENKQNDDNKLNIQNDDNKENIQNDDNKVNIQNDDNKVNIQNDDNKENIQNDDNKVNIQNDDNKVNIQNDDNKENIQI

SEQ ID NO: 3310162 - protein, 9 aa, Plasmodium falciparum
ENKNNLNSA

SEQ ID NO: 3310163 - protein, 27 aa, Plasmodium falciparum
ENKNNNKNDDGDDDDVNKREDNNNNEY

SEQ ID NO: 3310164 - protein, 8 aa, Plasmodium falciparum
ENKNNSIA

SEQ ID NO: 3310165 - protein, 27 aa, Plasmodium falciparum
ENKNQKDKKRQINKLGEQDSNNEELTS

SEQ ID NO: 3310166 - protein, 12 aa, Plasmodium falciparum
ENKNQTKKEKKR

SEQ ID NO: 3310167 - protein, 6 aa, Plasmodium falciparum
ENKNRM

SEQ ID NO: 3310168 - protein, 31 aa, Plasmodium falciparum
ENKNRNKNGDTDIDNDTRNNKSYKENNPMTR

SEQ ID NO: 3310169 - protein, 6 aa, Plasmodium falciparum
ENKNSQ

SEQ ID NO: 3310170 - protein, 15 aa, Plasmodium falciparum
ENKNTDDYRVNDDSN

SEQ ID NO: 3310171 - protein, 5 aa, Plasmodium falciparum
ENKNY

SEQ ID NO: 3310172 - protein, 7 aa, Plasmodium falciparum
ENKNYDV

SEQ ID NO: 3310173 - protein, 6 aa, Plasmodium falciparum
ENKPED

SEQ ID NO: 3310174 - protein, 7 aa, Plasmodium falciparum
ENKPQNL

SEQ ID NO: 3310175 - protein, 22 aa, Plasmodium falciparum
ENKQKRENISSNTYKDKYENFE

SEQ ID NO: 3310176 - protein, 5 aa, Plasmodium falciparum
ENKQV

SEQ ID NO: 3310177 - protein, 4 aa, Plasmodium falciparum
ENKR

SEQ ID NO: 3310178 - protein, 25 aa, Plasmodium falciparum
ENKRIDKEEKEKEKKINNNNNNNNN

SEQ ID NO: 3310179 - protein, 8 aa, Plasmodium falciparum
ENKRKLEN

SEQ ID NO: 3310180 - protein, 7 aa, Plasmodium falciparum
ENKRREQ

SEQ ID NO: 3310181 - protein, 24 aa, Plasmodium falciparum
ENKRRRRKNIKRKKKEKKKRNNHD

SEQ ID NO: 3310182 - protein, 4 aa, Plasmodium falciparum
ENKS

SEQ ID NO: 3310183 - protein, 31 aa, Plasmodium falciparum
ENKSDHNNNVENTQNVKTTSNNNTQNNYRTK

SEQ ID NO: 3310184 - protein, 7 aa, Plasmodium falciparum
ENKSHDN

SEQ ID NO: 3310185 - protein, 14 aa, Plasmodium falciparum
ENKSIRYEEVFRKR

SEQ ID NO: 3310186 - protein, 7 aa, Plasmodium falciparum
ENKSKSF

SEQ ID NO: 3310187 - protein, 5 aa, Plasmodium falciparum
ENKSL

SEQ ID NO: 3310188 - protein, 9 aa, Plasmodium falciparum
ENKSREEKH

SEQ ID NO: 3310189 - protein, 12 aa, Plasmodium falciparum
ENKSVEKKRKRN

SEQ ID NO: 3310190 - protein, 8 aa, Plasmodium falciparum
ENKTENNI

SEQ ID NO: 3310191 - protein, 7 aa, Plasmodium falciparum
ENKTHTG

SEQ ID NO: 3310192 - protein, 7 aa, Plasmodium falciparum
ENKTLGT

SEQ ID NO: 3310193 - protein, 5 aa, Plasmodium falciparum
ENKTN

SEQ ID NO: 3310194 - protein, 27 aa, Plasmodium falciparum
ENKVKEKNKIGEYKKDNTLHKDDEKVS

SEQ ID NO: 3310195 - protein, 7 aa, Plasmodium falciparum
ENKYPFN

SEQ ID NO: 3310196 - protein, 6 aa, Plasmodium falciparum
ENKYPL

SEQ ID NO: 3310197 - protein, 7 aa, Plasmodium falciparum
ENKYYGN

SEQ ID NO: 3310198 - protein, 10 aa, Plasmodium falciparum
ENLEKEKKEH

SEQ ID NO: 3310199 - protein, 16 aa, Plasmodium falciparum
ENLEKKNIQEKKEFNE

SEQ ID NO: 3310200 - protein, 11 aa, Plasmodium falciparum
ENLKDKERKIT

SEQ ID NO: 3310201 - protein, 6 aa, Plasmodium falciparum
ENLKNN

SEQ ID NO: 3310202 - protein, 13 aa, Plasmodium falciparum
ENLKRDDSSDYNV

SEQ ID NO: 3310203 - protein, 7 aa, Plasmodium falciparum
ENLKRSY

SEQ ID NO: 3310204 - protein, 9 aa, Plasmodium falciparum
ENLNEGKKV

SEQ ID NO: 3310205 - protein, 6 aa, Plasmodium falciparum
ENLNFD

SEQ ID NO: 3310206 - protein, 9 aa, Plasmodium falciparum
ENLNSGDDA

SEQ ID NO: 3310207 - protein, 9 aa, Plasmodium falciparum
ENLPEQPNS

SEQ ID NO: 3310208 - protein, 8 aa, Plasmodium falciparum
ENLPRTKG

SEQ ID NO: 3310209 - protein, 10 aa, Plasmodium falciparum
ENLSKSKKRK

SEQ ID NO: 3310210 - protein, 5 aa, Plasmodium falciparum
ENLSL

SEQ ID NO: 3310211 - protein, 12 aa, Plasmodium falciparum
ENLSSDKYTKNS

SEQ ID NO: 3310212 - protein, 4 aa, Plasmodium falciparum
ENLT

SEQ ID NO: 3310213 - protein, 6 aa, Plasmodium falciparum
ENMEGK

SEQ ID NO: 3310214 - protein, 6 aa, Plasmodium falciparum
ENMGEN

SEQ ID NO: 3310215 - protein, 9 aa, Plasmodium falciparum
ENMKDENEE

SEQ ID NO: 3310216 - protein, 13 aa, Plasmodium falciparum
ENMKEENKSPQFI

SEQ ID NO: 3310217 - protein, 12 aa, Plasmodium falciparum
ENMKKEKNKLRN

SEQ ID NO: 3310218 - protein, 11 aa, Plasmodium falciparum
ENMNEEEKDNK

SEQ ID NO: 3310219 - protein, 50 aa, Plasmodium falciparum
ENMNKEKINKENVNKEKINKEKINKEKINKEKINKENMNKENMNKENMNK

SEQ ID NO: 3310220 - protein, 21 aa, Plasmodium falciparum
ENMNNNSSKNVNTLSDNNYNN

SEQ ID NO: 3310221 - protein, 18 aa, Plasmodium falciparum
ENMNNSNTMHSRNSNVEE

SEQ ID NO: 3310222 - protein, 5 aa, Plasmodium falciparum
ENMNQ

SEQ ID NO: 3310223 - protein, 4 aa, Plasmodium falciparum
ENMQ

SEQ ID NO: 3310224 - protein, 6 aa, Plasmodium falciparum
ENMQDS

SEQ ID NO: 3310225 - protein, 5 aa, Plasmodium falciparum
ENMSP

SEQ ID NO: 3310226 - protein, 4 aa, Plasmodium falciparum
ENNA

SEQ ID NO: 3310227 - protein, 6 aa, Plasmodium falciparum
ENNATL

SEQ ID NO: 3310228 - protein, 4 aa, Plasmodium falciparum
ENND

SEQ ID NO: 3310229 - protein, 10 aa, Plasmodium falciparum
ENNDAEAATL

SEQ ID NO: 3310230 - protein, 11 aa, Plasmodium falciparum
ENNDEKKKKKK

SEQ ID NO: 3310231 - protein, 19 aa, Plasmodium falciparum
ENNDKDKESNNNNKTNVDI

SEQ ID NO: 3310232 - protein, 6 aa, Plasmodium falciparum
ENNDKE

SEQ ID NO: 3310233 - protein, 7 aa, Plasmodium falciparum
ENNDKQK

SEQ ID NO: 3310234 - protein, 9 aa, Plasmodium falciparum
ENNDNIRSK

SEQ ID NO: 3310235 - protein, 18 aa, Plasmodium falciparum
ENNDNNDLSDNQSSQSDF

SEQ ID NO: 3310236 - protein, 12 aa, Plasmodium falciparum
ENNDNNMNDDMN

SEQ ID NO: 3310237 - protein, 6 aa, Plasmodium falciparum
ENNDSS

SEQ ID NO: 3310238 - protein, 4 aa, Plasmodium falciparum
ENNE

SEQ ID NO: 3310239 - protein, 18 aa, Plasmodium falciparum
ENNEGIDQNTEKNNNISV

SEQ ID NO: 3310240 - protein, 5 aa, Plasmodium falciparum
ENNEK

SEQ ID NO: 3310241 - protein, 11 aa, Plasmodium falciparum
ENNEKDEEIER

SEQ ID NO: 3310242 - protein, 12 aa, Plasmodium falciparum
ENNEKDTSNEEI

SEQ ID NO: 3310243 - protein, 16 aa, Plasmodium falciparum
ENNERHNSERRKRSSV

SEQ ID NO: 3310244 - protein, 12 aa, Plasmodium falciparum
ENNESKNEDLKK

SEQ ID NO: 3310245 - protein, 7 aa, Plasmodium falciparum
ENNEVES

SEQ ID NO: 3310246 - protein, 6 aa, Plasmodium falciparum
ENNEYS

SEQ ID NO: 3310247 - protein, 7 aa, Plasmodium falciparum
ENNFDKE

SEQ ID NO: 3310248 - protein, 5 aa, Plasmodium falciparum
ENNFN

SEQ ID NO: 3310249 - protein, 8 aa, Plasmodium falciparum
ENNFQNNQ

SEQ ID NO: 3310250 - protein, 17 aa, Plasmodium falciparum
ENNFTSPMSRNPDAPFV

SEQ ID NO: 3310251 - protein, 37 aa, Plasmodium falciparum
ENNGKKKNRKRNKTNDKSDNKNCNQYDNNKKDYQDGI

SEQ ID NO: 3310252 - protein, 11 aa, Plasmodium falciparum
ENNGKKNKTQE

SEQ ID NO: 3310253 - protein, 8 aa, Plasmodium falciparum
ENNGNYEN

SEQ ID NO: 3310254 - protein, 23 aa, Plasmodium falciparum
ENNGRKKSGKGKGGRSKSKQLND

SEQ ID NO: 3310255 - protein, 8 aa, Plasmodium falciparum
ENNGTTLR

SEQ ID NO: 3310256 - protein, 7 aa, Plasmodium falciparum
ENNHDNI

SEQ ID NO: 3310257 - protein, 5 aa, Plasmodium falciparum
ENNHK

SEQ ID NO: 3310258 - protein, 6 aa, Plasmodium falciparum
ENNHPI

SEQ ID NO: 3310259 - protein, 26 aa, Plasmodium falciparum
ENNIADSDNYNKDDNNNDNNQHAKKN

SEQ ID NO: 3310260 - protein, 8 aa, Plasmodium falciparum
ENNIDDND

SEQ ID NO: 3310261 - protein, 7 aa, Plasmodium falciparum
ENNIEKD

SEQ ID NO: 3310262 - protein, 35 aa, Plasmodium falciparum
ENNINGDDNNINGDENNINGDDNNINGDDNNINVD

SEQ ID NO: 3310263 - protein, 6 aa, Plasmodium falciparum
ENNINN

SEQ ID NO: 3310264 - protein, 6 aa, Plasmodium falciparum
ENNIQD

SEQ ID NO: 3310265 - protein, 5 aa, Plasmodium falciparum
ENNIS

SEQ ID NO: 3310266 - protein, 14 aa, Plasmodium falciparum
ENNITHTKNETNYI

SEQ ID NO: 3310267 - protein, 13 aa, Plasmodium falciparum
ENNITKNSAYNNN

SEQ ID NO: 3310268 - protein, 5 aa, Plasmodium falciparum
ENNKD

SEQ ID NO: 3310269 - protein, 8 aa, Plasmodium falciparum
ENNKDDIK

SEQ ID NO: 3310270 - protein, 18 aa, Plasmodium falciparum
ENNKIDKNKNVDKEKDEF

SEQ ID NO: 3310271 - protein, 7 aa, Plasmodium falciparum
ENNKINV

SEQ ID NO: 3310272 - protein, 15 aa, Plasmodium falciparum
ENNKKKQDKKKDEEL

SEQ ID NO: 3310273 - protein, 5 aa, Plasmodium falciparum
ENNKN

SEQ ID NO: 3310274 - protein, 13 aa, Plasmodium falciparum
ENNKNIYDKDEDN

SEQ ID NO: 3310275 - protein, 10 aa, Plasmodium falciparum
ENNKNKKSHH

SEQ ID NO: 3310276 - protein, 22 aa, Plasmodium falciparum
ENNKNKNNCNWKDGNENFNNSS

SEQ ID NO: 3310277 - protein, 6 aa, Plasmodium falciparum
ENNKNY

SEQ ID NO: 3310278 - protein, 6 aa, Plasmodium falciparum
ENNKPE

SEQ ID NO: 3310279 - protein, 6 aa, Plasmodium falciparum
ENNKQI

SEQ ID NO: 3310280 - protein, 13 aa, Plasmodium falciparum
ENNKTNQKKSIKS

SEQ ID NO: 3310281 - protein, 12 aa, Plasmodium falciparum
ENNLESDNVKYN

SEQ ID NO: 3310282 - protein, 12 aa, Plasmodium falciparum
ENNNCSKKENLK

SEQ ID NO: 3310283 - protein, 37 aa, Plasmodium falciparum
ENNNDDNNDNNNDDNNEDNNDDNNDNNNNNNNNDNND

SEQ ID NO: 3310284 - protein, 7 aa, Plasmodium falciparum
ENNNDKL

SEQ ID NO: 3310285 - protein, 80 aa, Plasmodium falciparum
ENNNDVNGDNGDNGDNDDDNGDNDDNNDDNNDEDNNDDNNDEDNNNDDNNDEDNNNDEDNNNDDNNNNDDNNNDGNNVST

SEQ ID NO: 3310286 - protein, 6 aa, Plasmodium falciparum
ENNNEC

SEQ ID NO: 3310287 - protein, 5 aa, Plasmodium falciparum
ENNNG

SEQ ID NO: 3310288 - protein, 13 aa, Plasmodium falciparum
ENNNHDDSEKEEI

SEQ ID NO: 3310289 - protein, 6 aa, Plasmodium falciparum
ENNNHN

SEQ ID NO: 3310290 - protein, 19 aa, Plasmodium falciparum
ENNNHRNTYHPSNNNTRNS

SEQ ID NO: 3310291 - protein, 6 aa, Plasmodium falciparum
ENNNIG

SEQ ID NO: 3310292 - protein, 9 aa, Plasmodium falciparum
ENNNKDDQR

SEQ ID NO: 3310293 - protein, 6 aa, Plasmodium falciparum
ENNNKE

SEQ ID NO: 3310294 - protein, 8 aa, Plasmodium falciparum
ENNNKKGV

SEQ ID NO: 3310295 - protein, 13 aa, Plasmodium falciparum
ENNNKQNEIVDET

SEQ ID NO: 3310296 - protein, 8 aa, Plasmodium falciparum
ENNNKTMP

SEQ ID NO: 3310297 - protein, 19 aa, Plasmodium falciparum
ENNNKYDNDNDNNNYDGYE

SEQ ID NO: 3310298 - protein, 7 aa, Plasmodium falciparum
ENNNLKE

SEQ ID NO: 3310299 - protein, 19 aa, Plasmodium falciparum
ENNNLKKKKKNVGNITNDN

SEQ ID NO: 3310300 - protein, 5 aa, Plasmodium falciparum
ENNNM

SEQ ID NO: 3310301 - protein, 13 aa, Plasmodium falciparum
ENNNNHNRNNNNN

SEQ ID NO: 3310302 - protein, 8 aa, Plasmodium falciparum
ENNNNKTD

SEQ ID NO: 3310303 - protein, 9 aa, Plasmodium falciparum
ENNNNNDDN

SEQ ID NO: 3310304 - protein, 9 aa, Plasmodium falciparum
ENNNNNNNN

SEQ ID NO: 3310305 - protein, 37 aa, Plasmodium falciparum
ENNNNNNNNNNKIDDDDDDNNNNNNIDDRNNNNNNYE

SEQ ID NO: 3310306 - protein, 25 aa, Plasmodium falciparum
ENNNNNNNNNNNKTQSKYEETSDGH

SEQ ID NO: 3310307 - protein, 23 aa, Plasmodium falciparum
ENNNNNNNNNNNNNIPKKNSMND

SEQ ID NO: 3310308 - protein, 26 aa, Plasmodium falciparum
ENNNNNNNNNNNNNNNNNSNVDDGNN

SEQ ID NO: 3310309 - protein, 23 aa, Plasmodium falciparum
ENNNNNNVNPSPFTSSNDIPLTN

SEQ ID NO: 3310310 - protein, 27 aa, Plasmodium falciparum
ENNNNSNNNNNNNNNNNNNNRRKTYTS

SEQ ID NO: 3310311 - protein, 7 aa, Plasmodium falciparum
ENNNQIQ

SEQ ID NO: 3310312 - protein, 13 aa, Plasmodium falciparum
ENNNRNKKEVDDE

SEQ ID NO: 3310313 - protein, 7 aa, Plasmodium falciparum
ENNNSRY

SEQ ID NO: 3310314 - protein, 4 aa, Plasmodium falciparum
ENNQ

SEQ ID NO: 3310315 - protein, 7 aa, Plasmodium falciparum
ENNQDVN

SEQ ID NO: 3310316 - protein, 6 aa, Plasmodium falciparum
ENNQKA

SEQ ID NO: 3310317 - protein, 5 aa, Plasmodium falciparum
ENNQN

SEQ ID NO: 3310318 - protein, 11 aa, Plasmodium falciparum
ENNQNKLEDTK

SEQ ID NO: 3310319 - protein, 7 aa, Plasmodium falciparum
ENNQQNK

SEQ ID NO: 3310320 - protein, 5 aa, Plasmodium falciparum
ENNRG

SEQ ID NO: 3310321 - protein, 6 aa, Plasmodium falciparum
ENNRKE

SEQ ID NO: 3310322 - protein, 5 aa, Plasmodium falciparum
ENNRR

SEQ ID NO: 3310323 - protein, 13 aa, Plasmodium falciparum
ENNRTDDKNTKFN

SEQ ID NO: 3310324 - protein, 8 aa, Plasmodium falciparum
ENNSCDEE

SEQ ID NO: 3310325 - protein, 5 aa, Plasmodium falciparum
ENNSE

SEQ ID NO: 3310326 - protein, 13 aa, Plasmodium falciparum
ENNSEKNESSKLN

SEQ ID NO: 3310327 - protein, 9 aa, Plasmodium falciparum
ENNSENVRK

SEQ ID NO: 3310328 - protein, 18 aa, Plasmodium falciparum
ENNSGQIYSKDKSTDEHI

SEQ ID NO: 3310329 - protein, 5 aa, Plasmodium falciparum
ENNSI

SEQ ID NO: 3310330 - protein, 7 aa, Plasmodium falciparum
ENNSIKQ

SEQ ID NO: 3310331 - protein, 10 aa, Plasmodium falciparum
ENNSKAKKKS

SEQ ID NO: 3310332 - protein, 12 aa, Plasmodium falciparum
ENNSKSTKNVSA

SEQ ID NO: 3310333 - protein, 6 aa, Plasmodium falciparum
ENNSQK

SEQ ID NO: 3310334 - protein, 11 aa, Plasmodium falciparum
ENNSQQNVEQY

SEQ ID NO: 3310335 - protein, 6 aa, Plasmodium falciparum
ENNSTI

SEQ ID NO: 3310336 - protein, 6 aa, Plasmodium falciparum
ENNSTM

SEQ ID NO: 3310337 - protein, 7 aa, Plasmodium falciparum
ENNSTPV

SEQ ID NO: 3310338 - protein, 20 aa, Plasmodium falciparum
ENNTIGGNNTISGNKTISGN

SEQ ID NO: 3310339 - protein, 18 aa, Plasmodium falciparum
ENNTKDDHKGDSKTSNLT

SEQ ID NO: 3310340 - protein, 19 aa, Plasmodium falciparum
ENNTKVIEGENNDMNVPSQ

SEQ ID NO: 3310341 - protein, 22 aa, Plasmodium falciparum
ENNTNDNNNHHHNDKESKEQVN

SEQ ID NO: 3310342 - protein, 17 aa, Plasmodium falciparum
ENNTNNQGNGKDEYASD

SEQ ID NO: 3310343 - protein, 19 aa, Plasmodium falciparum
ENNTRGKDITNNNNISGDP

SEQ ID NO: 3310344 - protein, 13 aa, Plasmodium falciparum
ENNTTQEKTENNK

SEQ ID NO: 3310345 - protein, 6 aa, Plasmodium falciparum
ENNTYG

SEQ ID NO: 3310346 - protein, 15 aa, Plasmodium falciparum
ENNVDKKNQIKENEL

SEQ ID NO: 3310347 - protein, 14 aa, Plasmodium falciparum
ENNVQSNDTPDNNY

SEQ ID NO: 3310348 - protein, 5 aa, Plasmodium falciparum
ENNVS

SEQ ID NO: 3310349 - protein, 26 aa, Plasmodium falciparum
ENNYDRDDNYNNNNYDDGEKHGNRSF

SEQ ID NO: 3310350 - protein, 7 aa, Plasmodium falciparum
ENNYENP

SEQ ID NO: 3310351 - protein, 8 aa, Plasmodium falciparum
ENNYGEKE

SEQ ID NO: 3310352 - protein, 23 aa, Plasmodium falciparum
ENNYNDNNDNNNNDNSNNDNNNN

SEQ ID NO: 3310353 - protein, 10 aa, Plasmodium falciparum
ENNYNSNNRN

SEQ ID NO: 3310354 - protein, 12 aa, Plasmodium falciparum
ENNYQKNRNSYN

SEQ ID NO: 3310355 - protein, 6 aa, Plasmodium falciparum
ENNYSL

SEQ ID NO: 3310356 - protein, 7 aa, Plasmodium falciparum
ENNYYEE

SEQ ID NO: 3310357 - protein, 4 aa, Plasmodium falciparum
ENPA

SEQ ID NO: 3310358 - protein, 4 aa, Plasmodium falciparum
ENPD

SEQ ID NO: 3310359 - protein, 7 aa, Plasmodium falciparum
ENPDDNI

SEQ ID NO: 3310360 - protein, 5 aa, Plasmodium falciparum
ENPDF

SEQ ID NO: 3310361 - protein, 9 aa, Plasmodium falciparum
ENPDPNNEN

SEQ ID NO: 3310362 - protein, 8 aa, Plasmodium falciparum
ENPFEEPS

SEQ ID NO: 3310363 - protein, 8 aa, Plasmodium falciparum
ENPKKPIY

SEQ ID NO: 3310364 - protein, 6 aa, Plasmodium falciparum
ENPNEY

SEQ ID NO: 3310365 - protein, 22 aa, Plasmodium falciparum
ENPNYTEDKNINDDKENYPGDN

SEQ ID NO: 3310366 - protein, 8 aa, Plasmodium falciparum
ENPPEYTK

SEQ ID NO: 3310367 - protein, 6 aa, Plasmodium falciparum
ENPPVV

SEQ ID NO: 3310368 - protein, 5 aa, Plasmodium falciparum
ENPQR

SEQ ID NO: 3310369 - protein, 5 aa, Plasmodium falciparum
ENPQS

SEQ ID NO: 3310370 - protein, 6 aa, Plasmodium falciparum
ENPREH

SEQ ID NO: 3310371 - protein, 9 aa, Plasmodium falciparum
ENPRENKNI

SEQ ID NO: 3310372 - protein, 7 aa, Plasmodium falciparum
ENPSRAK

SEQ ID NO: 3310373 - protein, 5 aa, Plasmodium falciparum
ENPSS

SEQ ID NO: 3310374 - protein, 9 aa, Plasmodium falciparum
ENPSSLNEN

SEQ ID NO: 3310375 - protein, 7 aa, Plasmodium falciparum
ENPVSSP

SEQ ID NO: 3310376 - protein, 5 aa, Plasmodium falciparum
ENPYY

SEQ ID NO: 3310377 - protein, 5 aa, Plasmodium falciparum
ENQDI

SEQ ID NO: 3310378 - protein, 7 aa, Plasmodium falciparum
ENQEEEG

SEQ ID NO: 3310379 - protein, 7 aa, Plasmodium falciparum
ENQEGTI

SEQ ID NO: 3310380 - protein, 13 aa, Plasmodium falciparum
ENQENKNQHNHNN

SEQ ID NO: 3310381 - protein, 5 aa, Plasmodium falciparum
ENQKE

SEQ ID NO: 3310382 - protein, 11 aa, Plasmodium falciparum
ENQKETQDEKR

SEQ ID NO: 3310383 - protein, 8 aa, Plasmodium falciparum
ENQKGKTN

SEQ ID NO: 3310384 - protein, 10 aa, Plasmodium falciparum
ENQKKDEEDY

SEQ ID NO: 3310385 - protein, 5 aa, Plasmodium falciparum
ENQKL

SEQ ID NO: 3310386 - protein, 9 aa, Plasmodium falciparum
ENQMNSPTR

SEQ ID NO: 3310387 - protein, 6 aa, Plasmodium falciparum
ENQNDI

SEQ ID NO: 3310388 - protein, 16 aa, Plasmodium falciparum
ENQNENYEQEENTLAQ

SEQ ID NO: 3310389 - protein, 9 aa, Plasmodium falciparum
ENQNEQKHT

SEQ ID NO: 3310390 - protein, 33 aa, Plasmodium falciparum
ENQNKNQYQYQNKNKNDLNNNNNNNNTCNHNTN

SEQ ID NO: 3310391 - protein, 8 aa, Plasmodium falciparum
ENQNQQNK

SEQ ID NO: 3310392 - protein, 16 aa, Plasmodium falciparum
ENQQSYTKNMKTDDPI

SEQ ID NO: 3310393 - protein, 4 aa, Plasmodium falciparum
ENQR

SEQ ID NO: 3310394 - protein, 6 aa, Plasmodium falciparum
ENQTDI

SEQ ID NO: 3310395 - protein, 5 aa, Plasmodium falciparum
ENQTI

SEQ ID NO: 3310396 - protein, 6 aa, Plasmodium falciparum
ENQYNN

SEQ ID NO: 3310397 - protein, 7 aa, Plasmodium falciparum
ENRANEN

SEQ ID NO: 3310398 - protein, 5 aa, Plasmodium falciparum
ENRGG

SEQ ID NO: 3310399 - protein, 10 aa, Plasmodium falciparum
ENRKNEKLKE

SEQ ID NO: 3310400 - protein, 37 aa, Plasmodium falciparum
ENRKRTKENNKSKESAYTSKSRKNNKIKGEEKKTKRS

SEQ ID NO: 3310401 - protein, 16 aa, Plasmodium falciparum
ENRKTLPQNEHNEHNE

SEQ ID NO: 3310402 - protein, 5 aa, Plasmodium falciparum
ENRNK

SEQ ID NO: 3310403 - protein, 134 aa, Plasmodium falciparum
ENRNKKNMDNTYEDNNNNNKYNVDEDNNNKYNVDEDNNNKYNVDEDNNNKYNVDEDNNNKYNVDEDNNNKYNVDEDNNNKYNVDEDNNNKYNVDEDNNNKYNVDEDNNNKYNVDEDNNNKYNVDEDNNSLDSFS

SEQ ID NO: 3310404 - protein, 36 aa, Plasmodium falciparum
ENRNNNRDIKNNKIEGESTDSLYTSSSEDEYNDRHD

SEQ ID NO: 3310405 - protein, 9 aa, Plasmodium falciparum
ENRNQTSFS

SEQ ID NO: 3310406 - protein, 23 aa, Plasmodium falciparum
ENRNSRKNRRRKKKKGKLKQPFP

SEQ ID NO: 3310407 - protein, 20 aa, Plasmodium falciparum
ENRNTKKNIKKNEKKKNKLN

SEQ ID NO: 3310408 - protein, 31 aa, Plasmodium falciparum
ENRRKVKKKNQMKEANYEDVNNQKRKKNKKL

SEQ ID NO: 3310409 - protein, 39 aa, Plasmodium falciparum
ENRTDNITNNNNNNNSSSSSSSNNNNSNNFYNKSNRDAP

SEQ ID NO: 3310410 - protein, 5 aa, Plasmodium falciparum
ENRTP

SEQ ID NO: 3310411 - protein, 8 aa, Plasmodium falciparum
ENRTYNSK

SEQ ID NO: 3310412 - protein, 8 aa, Plasmodium falciparum
ENSEELDT

SEQ ID NO: 3310413 - protein, 9 aa, Plasmodium falciparum
ENSEIESDI

SEQ ID NO: 3310414 - protein, 15 aa, Plasmodium falciparum
ENSEIKKEKESDISC

SEQ ID NO: 3310415 - protein, 7 aa, Plasmodium falciparum
ENSERNI

SEQ ID NO: 3310416 - protein, 7 aa, Plasmodium falciparum
ENSESFT

SEQ ID NO: 3310417 - protein, 5 aa, Plasmodium falciparum
ENSHD

SEQ ID NO: 3310418 - protein, 28 aa, Plasmodium falciparum
ENSIKKKESNHNHTTRHNNNNNNTSYIT

SEQ ID NO: 3310419 - protein, 4 aa, Plasmodium falciparum
ENSK

SEQ ID NO: 3310420 - protein, 17 aa, Plasmodium falciparum
ENSKEHDFTPPSRKRGT

SEQ ID NO: 3310421 - protein, 5 aa, Plasmodium falciparum
ENSKK

SEQ ID NO: 3310422 - protein, 8 aa, Plasmodium falciparum
ENSKNEKI

SEQ ID NO: 3310423 - protein, 10 aa, Plasmodium falciparum
ENSKNMSENL

SEQ ID NO: 3310424 - protein, 10 aa, Plasmodium falciparum
ENSKNSSLSD

SEQ ID NO: 3310425 - protein, 17 aa, Plasmodium falciparum
ENSLDTPMRGDNIGQPS

SEQ ID NO: 3310426 - protein, 14 aa, Plasmodium falciparum
ENSLNSYNKNDTSF

SEQ ID NO: 3310427 - protein, 4 aa, Plasmodium falciparum
ENSN

SEQ ID NO: 3310428 - protein, 5 aa, Plasmodium falciparum
ENSNI

SEQ ID NO: 3310429 - protein, 9 aa, Plasmodium falciparum
ENSNIENKS

SEQ ID NO: 3310430 - protein, 9 aa, Plasmodium falciparum
ENSNKTDEM

SEQ ID NO: 3310431 - protein, 25 aa, Plasmodium falciparum
ENSNNNNNNNNNNNNNNDCKNEAHK

SEQ ID NO: 3310432 - protein, 10 aa, Plasmodium falciparum
ENSNNNYLSD

SEQ ID NO: 3310433 - protein, 7 aa, Plasmodium falciparum
ENSNTDV

SEQ ID NO: 3310434 - protein, 8 aa, Plasmodium falciparum
ENSNTGKF

SEQ ID NO: 3310435 - protein, 6 aa, Plasmodium falciparum
ENSNTY

SEQ ID NO: 3310436 - protein, 7 aa, Plasmodium falciparum
ENSPCSN

SEQ ID NO: 3310437 - protein, 6 aa, Plasmodium falciparum
ENSPKK

SEQ ID NO: 3310438 - protein, 10 aa, Plasmodium falciparum
ENSPSHKSGL

SEQ ID NO: 3310439 - protein, 12 aa, Plasmodium falciparum
ENSPTSSEKKRR

SEQ ID NO: 3310440 - protein, 9 aa, Plasmodium falciparum
ENSQKGDHI

SEQ ID NO: 3310441 - protein, 11 aa, Plasmodium falciparum
ENSQNEKEKSY

SEQ ID NO: 3310442 - protein, 48 aa, Plasmodium falciparum
ENSSDDYDMNNENNNLTNDMRKDKNIKKKKKNKHYNNNNNNNNNKKKK

SEQ ID NO: 3310443 - protein, 15 aa, Plasmodium falciparum
ENSSFKSSTLKSNNL

SEQ ID NO: 3310444 - protein, 6 aa, Plasmodium falciparum
ENSSKI

SEQ ID NO: 3310445 - protein, 20 aa, Plasmodium falciparum
ENSSLNNNMRNSYENNIHKK

SEQ ID NO: 3310446 - protein, 20 aa, Plasmodium falciparum
ENSSNAESSCYSDEESEYSL

SEQ ID NO: 3310447 - protein, 10 aa, Plasmodium falciparum
ENSSNNLNEY

SEQ ID NO: 3310448 - protein, 10 aa, Plasmodium falciparum
ENSSQEDVYN

SEQ ID NO: 3310449 - protein, 6 aa, Plasmodium falciparum
ENSSTE

SEQ ID NO: 3310450 - protein, 7 aa, Plasmodium falciparum
ENSSTIN

SEQ ID NO: 3310451 - protein, 6 aa, Plasmodium falciparum
ENSSYS

SEQ ID NO: 3310452 - protein, 7 aa, Plasmodium falciparum
ENSTDKY

SEQ ID NO: 3310453 - protein, 7 aa, Plasmodium falciparum
ENSTNNK

SEQ ID NO: 3310454 - protein, 8 aa, Plasmodium falciparum
ENSTSKEK

SEQ ID NO: 3310455 - protein, 7 aa, Plasmodium falciparum
ENSVYDS

SEQ ID NO: 3310456 - protein, 6 aa, Plasmodium falciparum
ENSYAA

SEQ ID NO: 3310457 - protein, 8 aa, Plasmodium falciparum
ENSYQHDK

SEQ ID NO: 3310458 - protein, 20 aa, Plasmodium falciparum
ENSYSNSEQIRSDGIKDSKR

SEQ ID NO: 3310459 - protein, 15 aa, Plasmodium falciparum
ENTAGLGTSNSNVSY

SEQ ID NO: 3310460 - protein, 6 aa, Plasmodium falciparum
ENTDKL

SEQ ID NO: 3310461 - protein, 10 aa, Plasmodium falciparum
ENTEGDKDNN

SEQ ID NO: 3310462 - protein, 9 aa, Plasmodium falciparum
ENTENKNRY

SEQ ID NO: 3310463 - protein, 12 aa, Plasmodium falciparum
ENTENYDKESNG

SEQ ID NO: 3310464 - protein, 4 aa, Plasmodium falciparum
ENTG

SEQ ID NO: 3310465 - protein, 6 aa, Plasmodium falciparum
ENTHCK

SEQ ID NO: 3310466 - protein, 5 aa, Plasmodium falciparum
ENTIS

SEQ ID NO: 3310467 - protein, 10 aa, Plasmodium falciparum
ENTKANEYDK

SEQ ID NO: 3310468 - protein, 6 aa, Plasmodium falciparum
ENTKET

SEQ ID NO: 3310469 - protein, 9 aa, Plasmodium falciparum
ENTKKVDEY

SEQ ID NO: 3310470 - protein, 8 aa, Plasmodium falciparum
ENTKLREH

SEQ ID NO: 3310471 - protein, 12 aa, Plasmodium falciparum
ENTKRKENDNCK

SEQ ID NO: 3310472 - protein, 27 aa, Plasmodium falciparum
ENTLDHQTEHSDKNDHDDKEESNNYPM

SEQ ID NO: 3310473 - protein, 4 aa, Plasmodium falciparum
ENTN

SEQ ID NO: 3310474 - protein, 6 aa, Plasmodium falciparum
ENTNDV

SEQ ID NO: 3310475 - protein, 5 aa, Plasmodium falciparum
ENTNI

SEQ ID NO: 3310476 - protein, 26 aa, Plasmodium falciparum
ENTNKDIRRKKKKKKNKLKDNIDKSP

SEQ ID NO: 3310477 - protein, 45 aa, Plasmodium falciparum
ENTNKEDHKDDNKNSSNDNIPNVNNSDNCNLTSDDRIKSSIQENN

SEQ ID NO: 3310478 - protein, 15 aa, Plasmodium falciparum
ENTNMDDNNNNEIYS

SEQ ID NO: 3310479 - protein, 7 aa, Plasmodium falciparum
ENTNNIK

SEQ ID NO: 3310480 - protein, 37 aa, Plasmodium falciparum
ENTNTNANTNTNTNTNTNTNKKTNTNANTNTSTTFSC

SEQ ID NO: 3310481 - protein, 18 aa, Plasmodium falciparum
ENTNTNHNNHNNHNNHNN

SEQ ID NO: 3310482 - protein, 8 aa, Plasmodium falciparum
ENTNTYTN

SEQ ID NO: 3310483 - protein, 8 aa, Plasmodium falciparum
ENTNVNMN

SEQ ID NO: 3310484 - protein, 13 aa, Plasmodium falciparum
ENTNYEEGSSKYD

SEQ ID NO: 3310485 - protein, 4 aa, Plasmodium falciparum
ENTP

SEQ ID NO: 3310486 - protein, 8 aa, Plasmodium falciparum
ENTPDLPS

SEQ ID NO: 3310487 - protein, 5 aa, Plasmodium falciparum
ENTQD

SEQ ID NO: 3310488 - protein, 7 aa, Plasmodium falciparum
ENTQVDK

SEQ ID NO: 3310489 - protein, 6 aa, Plasmodium falciparum
ENTRTI

SEQ ID NO: 3310490 - protein, 6 aa, Plasmodium falciparum
ENTSEW

SEQ ID NO: 3310491 - protein, 16 aa, Plasmodium falciparum
ENTTQDEQTNDFEKET

SEQ ID NO: 3310492 - protein, 31 aa, Plasmodium falciparum
ENTTTNNSKNYAHNNNNKDNNIDSASGSIPP

SEQ ID NO: 3310493 - protein, 27 aa, Plasmodium falciparum
ENVAKKRNKSKNKNTLKRNKKCDDNNI

SEQ ID NO: 3310494 - protein, 9 aa, Plasmodium falciparum
ENVDDEKGL

SEQ ID NO: 3310495 - protein, 11 aa, Plasmodium falciparum
ENVDKDEKKKK

SEQ ID NO: 3310496 - protein, 7 aa, Plasmodium falciparum
ENVEEPN

SEQ ID NO: 3310497 - protein, 104 aa, Plasmodium falciparum
ENVEEYDEENVEEVEENVEENVEENVEENVEEYDEENVEEVEENVEENVEENVEENVEENVEEVEENVEENVEENVEENVEENVEENVEEYDEENVEEHNEEYD

SEQ ID NO: 3310498 - protein, 17 aa, Plasmodium falciparum
ENVEGSNKNEYENDFDE

SEQ ID NO: 3310499 - protein, 14 aa, Plasmodium falciparum
ENVEKGSKLKKKYQ

SEQ ID NO: 3310500 - protein, 6 aa, Plasmodium falciparum
ENVEKP

SEQ ID NO: 3310501 - protein, 15 aa, Plasmodium falciparum
ENVENEKEENTENKI

SEQ ID NO: 3310502 - protein, 12 aa, Plasmodium falciparum
ENVERGKKGTTL

SEQ ID NO: 3310503 - protein, 5 aa, Plasmodium falciparum
ENVHK

SEQ ID NO: 3310504 - protein, 4 aa, Plasmodium falciparum
ENVK

SEQ ID NO: 3310505 - protein, 9 aa, Plasmodium falciparum
ENVKEKEKF

SEQ ID NO: 3310506 - protein, 10 aa, Plasmodium falciparum
ENVKGDESNN

SEQ ID NO: 3310507 - protein, 9 aa, Plasmodium falciparum
ENVKGEDSK

SEQ ID NO: 3310508 - protein, 4 aa, Plasmodium falciparum
ENVN

SEQ ID NO: 3310509 - protein, 26 aa, Plasmodium falciparum
ENVNENTNNINDNKKERLKRNYEKDD

SEQ ID NO: 3310510 - protein, 9 aa, Plasmodium falciparum
ENVNLTEGG

SEQ ID NO: 3310511 - protein, 6 aa, Plasmodium falciparum
ENVNNN

SEQ ID NO: 3310512 - protein, 80 aa, Plasmodium falciparum
ENVPNEQNITNETNITNGEYVSSGPNVSGGPNMPGGSNMPGGPNMPGGSNMPGGPNMPGGSNMPGGPNIPGGPSPPSIPQ

SEQ ID NO: 3310513 - protein, 8 aa, Plasmodium falciparum
ENVQNKDK

SEQ ID NO: 3310514 - protein, 42 aa, Plasmodium falciparum
ENVQNKKKTNISNKEIKPKSSNNKNNSNNSNNNNSENSNKLN

SEQ ID NO: 3310515 - protein, 5 aa, Plasmodium falciparum
ENVQS

SEQ ID NO: 3310516 - protein, 7 aa, Plasmodium falciparum
ENVQSDK

SEQ ID NO: 3310517 - protein, 17 aa, Plasmodium falciparum
ENVSKREGEQSKENLEK

SEQ ID NO: 3310518 - protein, 7 aa, Plasmodium falciparum
ENVSPSF

SEQ ID NO: 3310519 - protein, 7 aa, Plasmodium falciparum
ENVSRKR

SEQ ID NO: 3310520 - protein, 7 aa, Plasmodium falciparum
ENVSSTI

SEQ ID NO: 3310521 - protein, 6 aa, Plasmodium falciparum
ENVTES

SEQ ID NO: 3310522 - protein, 29 aa, Plasmodium falciparum
ENVTKKEGSSNIDNADSYTKKSSYNENQD

SEQ ID NO: 3310523 - protein, 6 aa, Plasmodium falciparum
ENWSPD

SEQ ID NO: 3310524 - protein, 14 aa, Plasmodium falciparum
ENYAQEQENLEKQE

SEQ ID NO: 3310525 - protein, 6 aa, Plasmodium falciparum
ENYASY

SEQ ID NO: 3310526 - protein, 62 aa, Plasmodium falciparum
ENYDGDNNDNDGDNDGDNDGDNDGDNDGDNDGDNDGDNDGDNDGDNDGGNNDYDDDNNNIEK

SEQ ID NO: 3310527 - protein, 20 aa, Plasmodium falciparum
ENYDGKQDMDNMKPSKSSVR

SEQ ID NO: 3310528 - protein, 11 aa, Plasmodium falciparum
ENYDGYKNYEQ

SEQ ID NO: 3310529 - protein, 43 aa, Plasmodium falciparum
ENYDKKKGKNNNLEPYDDDHDDNDNDSNNNDDDMGEKKMNDKN

SEQ ID NO: 3310530 - protein, 4 aa, Plasmodium falciparum
ENYE

SEQ ID NO: 3310531 - protein, 31 aa, Plasmodium falciparum
ENYEDDENDENNLESPEGEENPFTNNPNRRN

SEQ ID NO: 3310532 - protein, 9 aa, Plasmodium falciparum
ENYEDEEKR

SEQ ID NO: 3310533 - protein, 11 aa, Plasmodium falciparum
ENYEDGSDDYM

SEQ ID NO: 3310534 - protein, 26 aa, Plasmodium falciparum
ENYEKGNYTIPNPTAPGIGYCPVPML

SEQ ID NO: 3310535 - protein, 13 aa, Plasmodium falciparum
ENYEKSKVNNKKY

SEQ ID NO: 3310536 - protein, 6 aa, Plasmodium falciparum
ENYEQK

SEQ ID NO: 3310537 - protein, 7 aa, Plasmodium falciparum
ENYGENN

SEQ ID NO: 3310538 - protein, 35 aa, Plasmodium falciparum
ENYHNNNNNNFYGNNNYNNASNSSSNSSRSNSSCK

SEQ ID NO: 3310539 - protein, 5 aa, Plasmodium falciparum
ENYKE

SEQ ID NO: 3310540 - protein, 8 aa, Plasmodium falciparum
ENYKNSRI

SEQ ID NO: 3310541 - protein, 4 aa, Plasmodium falciparum
ENYN

SEQ ID NO: 3310542 - protein, 7 aa, Plasmodium falciparum
ENYNETI

SEQ ID NO: 3310543 - protein, 7 aa, Plasmodium falciparum
ENYNGNK

SEQ ID NO: 3310544 - protein, 5 aa, Plasmodium falciparum
ENYNH

SEQ ID NO: 3310545 - protein, 16 aa, Plasmodium falciparum
ENYNKNRNGKNTDHAK

SEQ ID NO: 3310546 - protein, 23 aa, Plasmodium falciparum
ENYNNEENNSSNSTLPTSENSSN

SEQ ID NO: 3310547 - protein, 13 aa, Plasmodium falciparum
ENYNNGDKMNNPS

SEQ ID NO: 3310548 - protein, 8 aa, Plasmodium falciparum
ENYNNNES

SEQ ID NO: 3310549 - protein, 13 aa, Plasmodium falciparum
ENYNNTKEKSSIN

SEQ ID NO: 3310550 - protein, 11 aa, Plasmodium falciparum
ENYNQENDKYN

SEQ ID NO: 3310551 - protein, 11 aa, Plasmodium falciparum
ENYNTDKQTHV

SEQ ID NO: 3310552 - protein, 10 aa, Plasmodium falciparum
ENYPNDNTKI

SEQ ID NO: 3310553 - protein, 16 aa, Plasmodium falciparum
ENYPNNLKNKNDIEKE

SEQ ID NO: 3310554 - protein, 7 aa, Plasmodium falciparum
ENYPNNN

SEQ ID NO: 3310555 - protein, 6 aa, Plasmodium falciparum
ENYPSI

SEQ ID NO: 3310556 - protein, 7 aa, Plasmodium falciparum
ENYQGPE

SEQ ID NO: 3310557 - protein, 8 aa, Plasmodium falciparum
ENYRNQNS

SEQ ID NO: 3310558 - protein, 20 aa, Plasmodium falciparum
ENYSKIKKEEYEKIHEKNIN

SEQ ID NO: 3310559 - protein, 6 aa, Plasmodium falciparum
ENYSNQ

SEQ ID NO: 3310560 - protein, 4 aa, Plasmodium falciparum
ENYT

SEQ ID NO: 3310561 - protein, 7 aa, Plasmodium falciparum
ENYTEED

SEQ ID NO: 3310562 - protein, 5 aa, Plasmodium falciparum
ENYTG

SEQ ID NO: 3310563 - protein, 6 aa, Plasmodium falciparum
ENYTSE

SEQ ID NO: 3310564 - protein, 5 aa, Plasmodium falciparum
ENYYD

SEQ ID NO: 3310565 - protein, 6 aa, Plasmodium falciparum
EPAKTP

SEQ ID NO: 3310566 - protein, 9 aa, Plasmodium falciparum
EPAQSEGSF

SEQ ID NO: 3310567 - protein, 31 aa, Plasmodium falciparum
EPCDNKNKNKNKNDGIRDRGKIKNSDQKSLA

SEQ ID NO: 3310568 - protein, 5 aa, Plasmodium falciparum
EPDDE

SEQ ID NO: 3310569 - protein, 4 aa, Plasmodium falciparum
EPDN

SEQ ID NO: 3310570 - protein, 15 aa, Plasmodium falciparum
EPDNNKNGKKNEGQQ

SEQ ID NO: 3310571 - protein, 6 aa, Plasmodium falciparum
EPDTTE

SEQ ID NO: 3310572 - protein, 7 aa, Plasmodium falciparum
EPENEQA

SEQ ID NO: 3310573 - protein, 5 aa, Plasmodium falciparum
EPESL

SEQ ID NO: 3310574 - protein, 6 aa, Plasmodium falciparum
EPETAE

SEQ ID NO: 3310575 - protein, 20 aa, Plasmodium falciparum
EPETEREKTIEDKNESELEK

SEQ ID NO: 3310576 - protein, 15 aa, Plasmodium falciparum
EPGDVHNKNEDSNHD

SEQ ID NO: 3310577 - protein, 6 aa, Plasmodium falciparum
EPGNES

SEQ ID NO: 3310578 - protein, 5 aa, Plasmodium falciparum
EPGPM

SEQ ID NO: 3310579 - protein, 8 aa, Plasmodium falciparum
EPGRVQDG

SEQ ID NO: 3310580 - protein, 8 aa, Plasmodium falciparum
EPGTNGQH

SEQ ID NO: 3310581 - protein, 4 aa, Plasmodium falciparum
EPGY

SEQ ID NO: 3310582 - protein, 9 aa, Plasmodium falciparum
EPHTRNGKG

SEQ ID NO: 3310583 - protein, 4 aa, Plasmodium falciparum
EPIG

SEQ ID NO: 3310584 - protein, 15 aa, Plasmodium falciparum
EPIHKKNNDDNNSTC

SEQ ID NO: 3310585 - protein, 4 aa, Plasmodium falciparum
EPIN

SEQ ID NO: 3310586 - protein, 6 aa, Plasmodium falciparum
EPINNN

SEQ ID NO: 3310587 - protein, 13 aa, Plasmodium falciparum
EPINTDNDKTSRL

SEQ ID NO: 3310588 - protein, 4 aa, Plasmodium falciparum
EPIQ

SEQ ID NO: 3310589 - protein, 4 aa, Plasmodium falciparum
EPIS

SEQ ID NO: 3310590 - protein, 5 aa, Plasmodium falciparum
EPISE

SEQ ID NO: 3310591 - protein, 7 aa, Plasmodium falciparum
EPKAGEE

SEQ ID NO: 3310592 - protein, 8 aa, Plasmodium falciparum
EPKGNEHT

SEQ ID NO: 3310593 - protein, 4 aa, Plasmodium falciparum
EPKI

SEQ ID NO: 3310594 - protein, 5 aa, Plasmodium falciparum
EPKKE

SEQ ID NO: 3310595 - protein, 12 aa, Plasmodium falciparum
EPKKKKKKKNIK

SEQ ID NO: 3310596 - protein, 11 aa, Plasmodium falciparum
EPKKKKKWKEE

SEQ ID NO: 3310597 - protein, 8 aa, Plasmodium falciparum
EPKRKDID

SEQ ID NO: 3310598 - protein, 10 aa, Plasmodium falciparum
EPKSSKQPQI

SEQ ID NO: 3310599 - protein, 24 aa, Plasmodium falciparum
EPKVKTTNDTHVDYNDDNNDDSNI

SEQ ID NO: 3310600 - protein, 7 aa, Plasmodium falciparum
EPLASAS

SEQ ID NO: 3310601 - protein, 4 aa, Plasmodium falciparum
EPLD

SEQ ID NO: 3310602 - protein, 10 aa, Plasmodium falciparum
EPLGNSDGMY

SEQ ID NO: 3310603 - protein, 8 aa, Plasmodium falciparum
EPLGTGGP

SEQ ID NO: 3310604 - protein, 7 aa, Plasmodium falciparum
EPLYSDS

SEQ ID NO: 3310605 - protein, 7 aa, Plasmodium falciparum
EPNDDIS

SEQ ID NO: 3310606 - protein, 4 aa, Plasmodium falciparum
EPNE

SEQ ID NO: 3310607 - protein, 6 aa, Plasmodium falciparum
EPNEDL

SEQ ID NO: 3310608 - protein, 7 aa, Plasmodium falciparum
EPNEKDE

SEQ ID NO: 3310609 - protein, 11 aa, Plasmodium falciparum
EPNKTDRKYRE

SEQ ID NO: 3310610 - protein, 7 aa, Plasmodium falciparum
EPNMNTK

SEQ ID NO: 3310611 - protein, 7 aa, Plasmodium falciparum
EPNSQES

SEQ ID NO: 3310612 - protein, 6 aa, Plasmodium falciparum
EPPANL

SEQ ID NO: 3310613 - protein, 7 aa, Plasmodium falciparum
EPPINSY

SEQ ID NO: 3310614 - protein, 7 aa, Plasmodium falciparum
EPPKPKI

SEQ ID NO: 3310615 - protein, 5 aa, Plasmodium falciparum
EPPNV

SEQ ID NO: 3310616 - protein, 6 aa, Plasmodium falciparum
EPPPLK

SEQ ID NO: 3310617 - protein, 9 aa, Plasmodium falciparum
EPPQAGNRA

SEQ ID NO: 3310618 - protein, 4 aa, Plasmodium falciparum
EPPY

SEQ ID NO: 3310619 - protein, 17 aa, Plasmodium falciparum
EPQECKENKKGNKLNEA

SEQ ID NO: 3310620 - protein, 4 aa, Plasmodium falciparum
EPQG

SEQ ID NO: 3310621 - protein, 5 aa, Plasmodium falciparum
EPRPP

SEQ ID NO: 3310622 - protein, 8 aa, Plasmodium falciparum
EPRQTTSN

SEQ ID NO: 3310623 - protein, 6 aa, Plasmodium falciparum
EPRRKN

SEQ ID NO: 3310624 - protein, 5 aa, Plasmodium falciparum
EPRSA

SEQ ID NO: 3310625 - protein, 32 aa, Plasmodium falciparum
EPRSSFRGGRGSGYGGNFGRGGYRSGGGMGGG

SEQ ID NO: 3310626 - protein, 6 aa, Plasmodium falciparum
EPRTAS

SEQ ID NO: 3310627 - protein, 49 aa, Plasmodium falciparum
EPSAPGTTLEDENENNFSEESKEELENEEDTTEDTDADGWSSSPEEEID

SEQ ID NO: 3310628 - protein, 11 aa, Plasmodium falciparum
EPSDQKIKEEY

SEQ ID NO: 3310629 - protein, 9 aa, Plasmodium falciparum
EPSGTNTRF

SEQ ID NO: 3310630 - protein, 8 aa, Plasmodium falciparum
EPSTDDPF

SEQ ID NO: 3310631 - protein, 8 aa, Plasmodium falciparum
EPSTSSAV

SEQ ID NO: 3310632 - protein, 4 aa, Plasmodium falciparum
EPTA

SEQ ID NO: 3310633 - protein, 13 aa, Plasmodium falciparum
EPTDSTTNNQNKN

SEQ ID NO: 3310634 - protein, 5 aa, Plasmodium falciparum
EPTKK

SEQ ID NO: 3310635 - protein, 4 aa, Plasmodium falciparum
EPTL

SEQ ID NO: 3310636 - protein, 16 aa, Plasmodium falciparum
EPTLEHETTKEHNDLS

SEQ ID NO: 3310637 - protein, 15 aa, Plasmodium falciparum
EPTNKMKKKNKEKKN

SEQ ID NO: 3310638 - protein, 5 aa, Plasmodium falciparum
EPTNL

SEQ ID NO: 3310639 - protein, 4 aa, Plasmodium falciparum
EPTP

SEQ ID NO: 3310640 - protein, 15 aa, Plasmodium falciparum
EPTSFSQDNENVNAS

SEQ ID NO: 3310641 - protein, 7 aa, Plasmodium falciparum
EPTSNNE

SEQ ID NO: 3310642 - protein, 6 aa, Plasmodium falciparum
EPTTAR

SEQ ID NO: 3310643 - protein, 5 aa, Plasmodium falciparum
EPTTF

SEQ ID NO: 3310644 - protein, 14 aa, Plasmodium falciparum
EPTTNLDKANSRNL

SEQ ID NO: 3310645 - protein, 210 aa, Plasmodium falciparum
EPVATQEPVATQEPVATQEPVATQEPVATQEPVTTQEPVTTQEPVTTQEPATTQEPATTQETVTTQEAVTTQEPVTTQEPVTTQEPVTTQEPVTTQEPVTTQEPVAPQATVTTQETVAPQETVTTQEPVTTQEPVTTQEPVTTQEPVTTQEPVTTQEPVTTQEPVTTQEPVTPQQPVTPQQPVTPQQPVTPQQPATPQQPATPQQPVTPV

SEQ ID NO: 3310646 - protein, 5 aa, Plasmodium falciparum
EPVEN

SEQ ID NO: 3310647 - protein, 5 aa, Plasmodium falciparum
EPVPK

SEQ ID NO: 3310648 - protein, 86 aa, Plasmodium falciparum
EPVTPQEPVTPQEPVTPQEPVTPQEPVTPQEPVTTQESVTTQEPVTTQEPVTTQEPATTQEPVTTQEPVTPQEPVTTQEPVTTQEP

SEQ ID NO: 3310649 - protein, 68 aa, Plasmodium falciparum
EPVTTQEAVTTQEPVTTQEPVTTQEPVTTQEPVTTQEPVTTQEPVTTQEPVTTQEPVTTQEPVTTQEP

SEQ ID NO: 3310650 - protein, 14 aa, Plasmodium falciparum
EPVTTQEPVTTQEP

SEQ ID NO: 3310651 - protein, 4 aa, Plasmodium falciparum
EPVY

SEQ ID NO: 3310652 - protein, 5 aa, Plasmodium falciparum
EPWKN

SEQ ID NO: 3310653 - protein, 6 aa, Plasmodium falciparum
EPYKNS

SEQ ID NO: 3310654 - protein, 11 aa, Plasmodium falciparum
EQAEVRENNKL

SEQ ID NO: 3310655 - protein, 14 aa, Plasmodium falciparum
EQAGATTTENRTKR

SEQ ID NO: 3310656 - protein, 10 aa, Plasmodium falciparum
EQAKIAEEAG

SEQ ID NO: 3310657 - protein, 9 aa, Plasmodium falciparum
EQAPINKKS

SEQ ID NO: 3310658 - protein, 5 aa, Plasmodium falciparum
EQARK

SEQ ID NO: 3310659 - protein, 4 aa, Plasmodium falciparum
EQCG

SEQ ID NO: 3310660 - protein, 4 aa, Plasmodium falciparum
EQCP

SEQ ID NO: 3310661 - protein, 14 aa, Plasmodium falciparum
EQDASSELKDKKEE

SEQ ID NO: 3310662 - protein, 5 aa, Plasmodium falciparum
EQDCC

SEQ ID NO: 3310663 - protein, 4 aa, Plasmodium falciparum
EQDE

SEQ ID NO: 3310664 - protein, 7 aa, Plasmodium falciparum
EQDENMK

SEQ ID NO: 3310665 - protein, 5 aa, Plasmodium falciparum
EQDIN

SEQ ID NO: 3310666 - protein, 6 aa, Plasmodium falciparum
EQDITN

SEQ ID NO: 3310667 - protein, 5 aa, Plasmodium falciparum
EQDKN

SEQ ID NO: 3310668 - protein, 6 aa, Plasmodium falciparum
EQDKTK

SEQ ID NO: 3310669 - protein, 4 aa, Plasmodium falciparum
EQDL

SEQ ID NO: 3310670 - protein, 26 aa, Plasmodium falciparum
EQDNIHQEQNDITQQSNNIYEQKNDN

SEQ ID NO: 3310671 - protein, 5 aa, Plasmodium falciparum
EQDNR

SEQ ID NO: 3310672 - protein, 6 aa, Plasmodium falciparum
EQDPYQ

SEQ ID NO: 3310673 - protein, 4 aa, Plasmodium falciparum
EQDR

SEQ ID NO: 3310674 - protein, 14 aa, Plasmodium falciparum
EQDSKYKPSKIFKK

SEQ ID NO: 3310675 - protein, 16 aa, Plasmodium falciparum
EQDTEEKNKEKEREKQ

SEQ ID NO: 3310676 - protein, 54 aa, Plasmodium falciparum
EQDYEEKYNNDNNNNNDNNNDNNNDNNNDNNNNNNNDNNNNNNNNNSNNNNNNN

SEQ ID NO: 3310677 - protein, 4 aa, Plasmodium falciparum
EQEA

SEQ ID NO: 3310678 - protein, 9 aa, Plasmodium falciparum
EQEDINRES

SEQ ID NO: 3310679 - protein, 13 aa, Plasmodium falciparum
EQEDKNKKNTLLP

SEQ ID NO: 3310680 - protein, 7 aa, Plasmodium falciparum
EQEDNEI

SEQ ID NO: 3310681 - protein, 9 aa, Plasmodium falciparum
EQEDSEEQR

SEQ ID NO: 3310682 - protein, 75 aa, Plasmodium falciparum
EQEEEEEEEEEEEEEEEGAEDNKEDFDNEESDEDEEGIDDEIERNKKYNNEENIGKDENNNSRDGSKRIDENSKT

SEQ ID NO: 3310683 - protein, 7 aa, Plasmodium falciparum
EQEEKNE

SEQ ID NO: 3310684 - protein, 12 aa, Plasmodium falciparum
EQEEKNINDVSS

SEQ ID NO: 3310685 - protein, 13 aa, Plasmodium falciparum
EQEEQKKIKESVN

SEQ ID NO: 3310686 - protein, 5 aa, Plasmodium falciparum
EQEHK

SEQ ID NO: 3310687 - protein, 5 aa, Plasmodium falciparum
EQEHN

SEQ ID NO: 3310688 - protein, 16 aa, Plasmodium falciparum
EQEHNKKENDENSKNI

SEQ ID NO: 3310689 - protein, 10 aa, Plasmodium falciparum
EQEKDNSIKL

SEQ ID NO: 3310690 - protein, 17 aa, Plasmodium falciparum
EQEKEKEVPEKKDEEKC

SEQ ID NO: 3310691 - protein, 10 aa, Plasmodium falciparum
EQEKKDNPEH

SEQ ID NO: 3310692 - protein, 13 aa, Plasmodium falciparum
EQEKKKRKVESSP

SEQ ID NO: 3310693 - protein, 15 aa, Plasmodium falciparum
EQEKQKKKQNDNNKM

SEQ ID NO: 3310694 - protein, 6 aa, Plasmodium falciparum
EQEKYN

SEQ ID NO: 3310695 - protein, 82 aa, Plasmodium falciparum
EQENDQGGNNNNNDDNNDDNNDNNDDNNDNNDDNNDNNDNNDDNNNDNNNNNNNDNNDNNNNNNNNNNNNDNDNNNNNNCDE

SEQ ID NO: 3310696 - protein, 19 aa, Plasmodium falciparum
EQENGIPSSEMKKGKDQLL

SEQ ID NO: 3310697 - protein, 5 aa, Plasmodium falciparum
EQENI

SEQ ID NO: 3310698 - protein, 8 aa, Plasmodium falciparum
EQENKYKQ

SEQ ID NO: 3310699 - protein, 16 aa, Plasmodium falciparum
EQENNKMDENQHIDKN

SEQ ID NO: 3310700 - protein, 12 aa, Plasmodium falciparum
EQENNKRKYEEL

SEQ ID NO: 3310701 - protein, 4 aa, Plasmodium falciparum
EQER

SEQ ID NO: 3310702 - protein, 7 aa, Plasmodium falciparum
EQESSQL

SEQ ID NO: 3310703 - protein, 6 aa, Plasmodium falciparum
EQEYNQ

SEQ ID NO: 3310704 - protein, 7 aa, Plasmodium falciparum
EQFDPEK

SEQ ID NO: 3310705 - protein, 6 aa, Plasmodium falciparum
EQFSDG

SEQ ID NO: 3310706 - protein, 10 aa, Plasmodium falciparum
EQGGVTEESS

SEQ ID NO: 3310707 - protein, 35 aa, Plasmodium falciparum
EQGKADDIDKTKKEKTEENEIENIDNEKKKDEQIE

SEQ ID NO: 3310708 - protein, 6 aa, Plasmodium falciparum
EQGKGK

SEQ ID NO: 3310709 - protein, 8 aa, Plasmodium falciparum
EQGLNPKK

SEQ ID NO: 3310710 - protein, 4 aa, Plasmodium falciparum
EQGN

SEQ ID NO: 3310711 - protein, 5 aa, Plasmodium falciparum
EQGNY

SEQ ID NO: 3310712 - protein, 7 aa, Plasmodium falciparum
EQGPRTK

SEQ ID NO: 3310713 - protein, 8 aa, Plasmodium falciparum
EQGRDERV

SEQ ID NO: 3310714 - protein, 9 aa, Plasmodium falciparum
EQGSKGNPS

SEQ ID NO: 3310715 - protein, 4 aa, Plasmodium falciparum
EQGY

SEQ ID NO: 3310716 - protein, 6 aa, Plasmodium falciparum
EQGYMK

SEQ ID NO: 3310717 - protein, 28 aa, Plasmodium falciparum
EQHDTNLDKNGDKNDDGNKNDDKNDDKV

SEQ ID NO: 3310718 - protein, 10 aa, Plasmodium falciparum
EQHGKDGKYN

SEQ ID NO: 3310719 - protein, 6 aa, Plasmodium falciparum
EQHNSD

SEQ ID NO: 3310720 - protein, 5 aa, Plasmodium falciparum
EQHSE

SEQ ID NO: 3310721 - protein, 26 aa, Plasmodium falciparum
EQIDKSRQNGGKREEDQINYAFTCTN

SEQ ID NO: 3310722 - protein, 6 aa, Plasmodium falciparum
EQIENM

SEQ ID NO: 3310723 - protein, 4 aa, Plasmodium falciparum
EQIK

SEQ ID NO: 3310724 - protein, 5 aa, Plasmodium falciparum
EQIKD

SEQ ID NO: 3310725 - protein, 13 aa, Plasmodium falciparum
EQIKEKNDQQNHN

SEQ ID NO: 3310726 - protein, 5 aa, Plasmodium falciparum
EQIKK

SEQ ID NO: 3310727 - protein, 11 aa, Plasmodium falciparum
EQIKSSDDKNY

SEQ ID NO: 3310728 - protein, 4 aa, Plasmodium falciparum
EQIN

SEQ ID NO: 3310729 - protein, 11 aa, Plasmodium falciparum
EQINNSTNNNI

SEQ ID NO: 3310730 - protein, 4 aa, Plasmodium falciparum
EQIP

SEQ ID NO: 3310731 - protein, 19 aa, Plasmodium falciparum
EQKDIDQNNNISKKYDAKE

SEQ ID NO: 3310732 - protein, 5 aa, Plasmodium falciparum
EQKDN

SEQ ID NO: 3310733 - protein, 8 aa, Plasmodium falciparum
EQKEEGEE

SEQ ID NO: 3310734 - protein, 8 aa, Plasmodium falciparum
EQKEGTME

SEQ ID NO: 3310735 - protein, 13 aa, Plasmodium falciparum
EQKEKEKEKNYIN

SEQ ID NO: 3310736 - protein, 9 aa, Plasmodium falciparum
EQKEKKEAQ

SEQ ID NO: 3310737 - protein, 12 aa, Plasmodium falciparum
EQKEMSKANVHN

SEQ ID NO: 3310738 - protein, 10 aa, Plasmodium falciparum
EQKENNNDNN

SEQ ID NO: 3310739 - protein, 7 aa, Plasmodium falciparum
EQKGDDQ

SEQ ID NO: 3310740 - protein, 19 aa, Plasmodium falciparum
EQKHETGSGVTKEEEEGRK

SEQ ID NO: 3310741 - protein, 18 aa, Plasmodium falciparum
EQKHRDKNAKLRKETELK

SEQ ID NO: 3310742 - protein, 10 aa, Plasmodium falciparum
EQKIKNNPKK

SEQ ID NO: 3310743 - protein, 6 aa, Plasmodium falciparum
EQKINS

SEQ ID NO: 3310744 - protein, 4 aa, Plasmodium falciparum
EQKK

SEQ ID NO: 3310745 - protein, 7 aa, Plasmodium falciparum
EQKKEMK

SEQ ID NO: 3310746 - protein, 9 aa, Plasmodium falciparum
EQKKENQIK

SEQ ID NO: 3310747 - protein, 8 aa, Plasmodium falciparum
EQKKKRNN

SEQ ID NO: 3310748 - protein, 12 aa, Plasmodium falciparum
EQKKNEKEEKNL

SEQ ID NO: 3310749 - protein, 13 aa, Plasmodium falciparum
EQKKNKENEDQLD

SEQ ID NO: 3310750 - protein, 10 aa, Plasmodium falciparum
EQKKNSIKDV

SEQ ID NO: 3310751 - protein, 8 aa, Plasmodium falciparum
EQKKSFEE

SEQ ID NO: 3310752 - protein, 11 aa, Plasmodium falciparum
EQKKSSDETLE

SEQ ID NO: 3310753 - protein, 25 aa, Plasmodium falciparum
EQKKSSNNNNNNNNNITYTSTNNYE

SEQ ID NO: 3310754 - protein, 4 aa, Plasmodium falciparum
EQKL

SEQ ID NO: 3310755 - protein, 6 aa, Plasmodium falciparum
EQKLKG

SEQ ID NO: 3310756 - protein, 9 aa, Plasmodium falciparum
EQKNDILSP

SEQ ID NO: 3310757 - protein, 8 aa, Plasmodium falciparum
EQKNDNNI

SEQ ID NO: 3310758 - protein, 19 aa, Plasmodium falciparum
EQKNESSFEKKKNKTNNTN

SEQ ID NO: 3310759 - protein, 11 aa, Plasmodium falciparum
EQKNGKKICDE

SEQ ID NO: 3310760 - protein, 10 aa, Plasmodium falciparum
EQKNKLKQNK

SEQ ID NO: 3310761 - protein, 20 aa, Plasmodium falciparum
EQKNNLSEHNEDKDKDRNVN

SEQ ID NO: 3310762 - protein, 4 aa, Plasmodium falciparum
EQKQ

SEQ ID NO: 3310763 - protein, 5 aa, Plasmodium falciparum
EQKRN

SEQ ID NO: 3310764 - protein, 11 aa, Plasmodium falciparum
EQKSFSKEVQN

SEQ ID NO: 3310765 - protein, 13 aa, Plasmodium falciparum
EQKSNSNNDKRNQ

SEQ ID NO: 3310766 - protein, 9 aa, Plasmodium falciparum
EQKTKPTQH

SEQ ID NO: 3310767 - protein, 5 aa, Plasmodium falciparum
EQLER

SEQ ID NO: 3310768 - protein, 15 aa, Plasmodium falciparum
EQLKEEEKEKNTMKN

SEQ ID NO: 3310769 - protein, 5 aa, Plasmodium falciparum
EQLKK

SEQ ID NO: 3310770 - protein, 4 aa, Plasmodium falciparum
EQLQ

SEQ ID NO: 3310771 - protein, 17 aa, Plasmodium falciparum
EQLSDNDKNPNEQITED

SEQ ID NO: 3310772 - protein, 8 aa, Plasmodium falciparum
EQLSYEEK

SEQ ID NO: 3310773 - protein, 17 aa, Plasmodium falciparum
EQMASNSDTHKNSCTNS

SEQ ID NO: 3310774 - protein, 9 aa, Plasmodium falciparum
EQMENTKRK

SEQ ID NO: 3310775 - protein, 5 aa, Plasmodium falciparum
EQMGK

SEQ ID NO: 3310776 - protein, 4 aa, Plasmodium falciparum
EQMK

SEQ ID NO: 3310777 - protein, 5 aa, Plasmodium falciparum
EQMKE

SEQ ID NO: 3310778 - protein, 5 aa, Plasmodium falciparum
EQMNK

SEQ ID NO: 3310779 - protein, 4 aa, Plasmodium falciparum
EQND

SEQ ID NO: 3310780 - protein, 8 aa, Plasmodium falciparum
EQNDDDNN

SEQ ID NO: 3310781 - protein, 12 aa, Plasmodium falciparum
EQNDKKKKNSLD

SEQ ID NO: 3310782 - protein, 5 aa, Plasmodium falciparum
EQNDM

SEQ ID NO: 3310783 - protein, 6 aa, Plasmodium falciparum
EQNDMN

SEQ ID NO: 3310784 - protein, 4 aa, Plasmodium falciparum
EQNE

SEQ ID NO: 3310785 - protein, 17 aa, Plasmodium falciparum
EQNEEGERLKEKNDYVE

SEQ ID NO: 3310786 - protein, 9 aa, Plasmodium falciparum
EQNEENNND

SEQ ID NO: 3310787 - protein, 7 aa, Plasmodium falciparum
EQNEEPK

SEQ ID NO: 3310788 - protein, 6 aa, Plasmodium falciparum
EQNEHF

SEQ ID NO: 3310789 - protein, 9 aa, Plasmodium falciparum
EQNEKAQKK

SEQ ID NO: 3310790 - protein, 8 aa, Plasmodium falciparum
EQNEKKNK

SEQ ID NO: 3310791 - protein, 6 aa, Plasmodium falciparum
EQNENV

SEQ ID NO: 3310792 - protein, 23 aa, Plasmodium falciparum
EQNEQDLNSDYSSSLSENSSSTI

SEQ ID NO: 3310793 - protein, 7 aa, Plasmodium falciparum
EQNETNR

SEQ ID NO: 3310794 - protein, 6 aa, Plasmodium falciparum
EQNEYE

SEQ ID NO: 3310795 - protein, 4 aa, Plasmodium falciparum
EQNG

SEQ ID NO: 3310796 - protein, 6 aa, Plasmodium falciparum
EQNGLN

SEQ ID NO: 3310797 - protein, 10 aa, Plasmodium falciparum
EQNHYDNNAG

SEQ ID NO: 3310798 - protein, 4 aa, Plasmodium falciparum
EQNI

SEQ ID NO: 3310799 - protein, 13 aa, Plasmodium falciparum
EQNISEEQNISEE

SEQ ID NO: 3310800 - protein, 7 aa, Plasmodium falciparum
EQNKEKQ

SEQ ID NO: 3310801 - protein, 11 aa, Plasmodium falciparum
EQNKKLENEYK

SEQ ID NO: 3310802 - protein, 9 aa, Plasmodium falciparum
EQNKKSNRN

SEQ ID NO: 3310803 - protein, 10 aa, Plasmodium falciparum
EQNKNDQINN

SEQ ID NO: 3310804 - protein, 19 aa, Plasmodium falciparum
EQNKNDSKKHRNNKHVRDS

SEQ ID NO: 3310805 - protein, 11 aa, Plasmodium falciparum
EQNKNTKCSSL

SEQ ID NO: 3310806 - protein, 7 aa, Plasmodium falciparum
EQNKSSF

SEQ ID NO: 3310807 - protein, 4 aa, Plasmodium falciparum
EQNM

SEQ ID NO: 3310808 - protein, 28 aa, Plasmodium falciparum
EQNNDERKKKMKDNNKGNKVDKKKKDEE

SEQ ID NO: 3310809 - protein, 8 aa, Plasmodium falciparum
EQNNDNEY

SEQ ID NO: 3310810 - protein, 7 aa, Plasmodium falciparum
EQNNEEI

SEQ ID NO: 3310811 - protein, 5 aa, Plasmodium falciparum
EQNNK

SEQ ID NO: 3310812 - protein, 14 aa, Plasmodium falciparum
EQNNLTSNLEEKRE

SEQ ID NO: 3310813 - protein, 12 aa, Plasmodium falciparum
EQNNNDKGQDKN

SEQ ID NO: 3310814 - protein, 20 aa, Plasmodium falciparum
EQNNNLENSNITYEDDEVQN

SEQ ID NO: 3310815 - protein, 60 aa, Plasmodium falciparum
EQNNNNSKDNNNNIDNNNNIDNNNNIDNNNNIDNNNNIDNNNNNIDNNNNIDNHHNNNQH

SEQ ID NO: 3310816 - protein, 15 aa, Plasmodium falciparum
EQNNNYNNEDDNNNI

SEQ ID NO: 3310817 - protein, 8 aa, Plasmodium falciparum
EQNNQEDE

SEQ ID NO: 3310818 - protein, 17 aa, Plasmodium falciparum
EQNNQENELQSNKWSAQ

SEQ ID NO: 3310819 - protein, 6 aa, Plasmodium falciparum
EQNNST

SEQ ID NO: 3310820 - protein, 6 aa, Plasmodium falciparum
EQNNTI

SEQ ID NO: 3310821 - protein, 8 aa, Plasmodium falciparum
EQNNTKNV

SEQ ID NO: 3310822 - protein, 19 aa, Plasmodium falciparum
EQNPKKKGRRLTTKGENAI

SEQ ID NO: 3310823 - protein, 6 aa, Plasmodium falciparum
EQNQKA

SEQ ID NO: 3310824 - protein, 8 aa, Plasmodium falciparum
EQNQPKRL

SEQ ID NO: 3310825 - protein, 9 aa, Plasmodium falciparum
EQNREEQKI

SEQ ID NO: 3310826 - protein, 23 aa, Plasmodium falciparum
EQNREKRKHKIPKYQKKKKKKKL

SEQ ID NO: 3310827 - protein, 10 aa, Plasmodium falciparum
EQNSNNNQDN

SEQ ID NO: 3310828 - protein, 9 aa, Plasmodium falciparum
EQNSSLEKV

SEQ ID NO: 3310829 - protein, 4 aa, Plasmodium falciparum
EQNT

SEQ ID NO: 3310830 - protein, 15 aa, Plasmodium falciparum
EQNTCQTSDDNTTYR

SEQ ID NO: 3310831 - protein, 14 aa, Plasmodium falciparum
EQNTPGDLKNTPNI

SEQ ID NO: 3310832 - protein, 7 aa, Plasmodium falciparum
EQNTVTQ

SEQ ID NO: 3310833 - protein, 4 aa, Plasmodium falciparum
EQNV

SEQ ID NO: 3310834 - protein, 5 aa, Plasmodium falciparum
EQNYD

SEQ ID NO: 3310835 - protein, 5 aa, Plasmodium falciparum
EQNYE

SEQ ID NO: 3310836 - protein, 7 aa, Plasmodium falciparum
EQNYSKN

SEQ ID NO: 3310837 - protein, 8 aa, Plasmodium falciparum
EQPEQGQE

SEQ ID NO: 3310838 - protein, 6 aa, Plasmodium falciparum
EQPKRS

SEQ ID NO: 3310839 - protein, 22 aa, Plasmodium falciparum
EQPMKKRKRGEGPQANSEKGEL

SEQ ID NO: 3310840 - protein, 7 aa, Plasmodium falciparum
EQPPPNL

SEQ ID NO: 3310841 - protein, 13 aa, Plasmodium falciparum
EQQEGKKKMTEEI

SEQ ID NO: 3310842 - protein, 6 aa, Plasmodium falciparum
EQQERI

SEQ ID NO: 3310843 - protein, 10 aa, Plasmodium falciparum
EQQGGEGKEY

SEQ ID NO: 3310844 - protein, 9 aa, Plasmodium falciparum
EQQKEVDKT

SEQ ID NO: 3310845 - protein, 18 aa, Plasmodium falciparum
EQQKKEKKPSNINGNISP

SEQ ID NO: 3310846 - protein, 14 aa, Plasmodium falciparum
EQQKNTQKSASDGI

SEQ ID NO: 3310847 - protein, 4 aa, Plasmodium falciparum
EQQN

SEQ ID NO: 3310848 - protein, 149 aa, Plasmodium falciparum
EQQNEKLDEQLNEQPNENFDEQPNENFDEQPNENFDEQPNENFDEQPNENFDEQPNENFDEQPNENFDEQPNENFDEQPNENFDEQPNENFDEQPNENFDEQPNENFDEQPNENFDEQPNENFDEQPNENSDEQSNNTNKDEPNTSNYV

SEQ ID NO: 3310849 - protein, 12 aa, Plasmodium falciparum
EQQNKKDFSSDV

SEQ ID NO: 3310850 - protein, 11 aa, Plasmodium falciparum
EQQNNDETNNM

SEQ ID NO: 3310851 - protein, 22 aa, Plasmodium falciparum
EQQNSHETETERDDLQTMQDYR

SEQ ID NO: 3310852 - protein, 5 aa, Plasmodium falciparum
EQQPK

SEQ ID NO: 3310853 - protein, 49 aa, Plasmodium falciparum
EQQQEKDEEEKGEGEEDEEEKGKGEEEEEEEEEEEEGEEEVEEEGEEGV

SEQ ID NO: 3310854 - protein, 4 aa, Plasmodium falciparum
EQQR

SEQ ID NO: 3310855 - protein, 5 aa, Plasmodium falciparum
EQQTD

SEQ ID NO: 3310856 - protein, 7 aa, Plasmodium falciparum
EQQTKES

SEQ ID NO: 3310857 - protein, 5 aa, Plasmodium falciparum
EQQVN

SEQ ID NO: 3310858 - protein, 4 aa, Plasmodium falciparum
EQRE

SEQ ID NO: 3310859 - protein, 5 aa, Plasmodium falciparum
EQREN

SEQ ID NO: 3310860 - protein, 8 aa, Plasmodium falciparum
EQREQNKT

SEQ ID NO: 3310861 - protein, 28 aa, Plasmodium falciparum
EQRMNEQSINEDYTSEDYTSEEYTDEDY

SEQ ID NO: 3310862 - protein, 7 aa, Plasmodium falciparum
EQRNTSN

SEQ ID NO: 3310863 - protein, 5 aa, Plasmodium falciparum
EQRRH

SEQ ID NO: 3310864 - protein, 19 aa, Plasmodium falciparum
EQSATLSKSLNNGGRFSSG

SEQ ID NO: 3310865 - protein, 14 aa, Plasmodium falciparum
EQSCKKNKERSNIK

SEQ ID NO: 3310866 - protein, 5 aa, Plasmodium falciparum
EQSEM

SEQ ID NO: 3310867 - protein, 7 aa, Plasmodium falciparum
EQSGGEG

SEQ ID NO: 3310868 - protein, 8 aa, Plasmodium falciparum
EQSGSQIQ

SEQ ID NO: 3310869 - protein, 8 aa, Plasmodium falciparum
EQSKEGKN

SEQ ID NO: 3310870 - protein, 15 aa, Plasmodium falciparum
EQSNDDHDNNNNNNN

SEQ ID NO: 3310871 - protein, 26 aa, Plasmodium falciparum
EQSNEKKSSKINTYNNNSYRRKSTNE

SEQ ID NO: 3310872 - protein, 7 aa, Plasmodium falciparum
EQSRNPV

SEQ ID NO: 3310873 - protein, 27 aa, Plasmodium falciparum
EQSSMHEKEENELNDNNVNDENNNMNG

SEQ ID NO: 3310874 - protein, 6 aa, Plasmodium falciparum
EQTDNK

SEQ ID NO: 3310875 - protein, 4 aa, Plasmodium falciparum
EQTE

SEQ ID NO: 3310876 - protein, 9 aa, Plasmodium falciparum
EQTGQENMS

SEQ ID NO: 3310877 - protein, 14 aa, Plasmodium falciparum
EQTHAKEENNESNI

SEQ ID NO: 3310878 - protein, 16 aa, Plasmodium falciparum
EQTKGPIEKKTTDNNE

SEQ ID NO: 3310879 - protein, 5 aa, Plasmodium falciparum
EQTKK

SEQ ID NO: 3310880 - protein, 16 aa, Plasmodium falciparum
EQTKKKNDHKENNNID

SEQ ID NO: 3310881 - protein, 6 aa, Plasmodium falciparum
EQTKKS

SEQ ID NO: 3310882 - protein, 24 aa, Plasmodium falciparum
EQTKSYEDDNINDNEKDSSSPSYS

SEQ ID NO: 3310883 - protein, 13 aa, Plasmodium falciparum
EQTNERDQPTQEM

SEQ ID NO: 3310884 - protein, 36 aa, Plasmodium falciparum
EQTNTDNTHDKKETIKTKNRDNHNISNNEKQKPTFE

SEQ ID NO: 3310885 - protein, 8 aa, Plasmodium falciparum
EQTNTTQW

SEQ ID NO: 3310886 - protein, 5 aa, Plasmodium falciparum
EQTNY

SEQ ID NO: 3310887 - protein, 14 aa, Plasmodium falciparum
EQTTENNKTETNQI

SEQ ID NO: 3310888 - protein, 10 aa, Plasmodium falciparum
EQVGKKKKNR

SEQ ID NO: 3310889 - protein, 4 aa, Plasmodium falciparum
EQVK

SEQ ID NO: 3310890 - protein, 14 aa, Plasmodium falciparum
EQVKEENEKNKMSP

SEQ ID NO: 3310891 - protein, 4 aa, Plasmodium falciparum
EQVN

SEQ ID NO: 3310892 - protein, 11 aa, Plasmodium falciparum
EQVNDKNDTKY

SEQ ID NO: 3310893 - protein, 9 aa, Plasmodium falciparum
EQVPINSNK

SEQ ID NO: 3310894 - protein, 11 aa, Plasmodium falciparum
EQVQKNNLPNS

SEQ ID NO: 3310895 - protein, 5 aa, Plasmodium falciparum
EQWTD

SEQ ID NO: 3310896 - protein, 7 aa, Plasmodium falciparum
EQYDENS

SEQ ID NO: 3310897 - protein, 20 aa, Plasmodium falciparum
EQYNENGNENVYKESGNYEI

SEQ ID NO: 3310898 - protein, 30 aa, Plasmodium falciparum
EQYNYDEKHNYDEHNNDEQYNYDENNHDEH

SEQ ID NO: 3310899 - protein, 20 aa, Plasmodium falciparum
EQYTNNNKMKENYDRNANMN

SEQ ID NO: 3310900 - protein, 6 aa, Plasmodium falciparum
ERAKIG

SEQ ID NO: 3310901 - protein, 8 aa, Plasmodium falciparum
ERALTKDN

SEQ ID NO: 3310902 - protein, 8 aa, Plasmodium falciparum
ERAMTKDN

SEQ ID NO: 3310903 - protein, 7 aa, Plasmodium falciparum
ERANREN

SEQ ID NO: 3310904 - protein, 7 aa, Plasmodium falciparum
ERASHGS

SEQ ID NO: 3310905 - protein, 7 aa, Plasmodium falciparum
ERASKYS

SEQ ID NO: 3310906 - protein, 4 aa, Plasmodium falciparum
ERAY

SEQ ID NO: 3310907 - protein, 5 aa, Plasmodium falciparum
ERCES

SEQ ID NO: 3310908 - protein, 4 aa, Plasmodium falciparum
ERCS

SEQ ID NO: 3310909 - protein, 4 aa, Plasmodium falciparum
ERDE

SEQ ID NO: 3310910 - protein, 24 aa, Plasmodium falciparum
ERDEEEVEKEENNKKEEDGESDLS

SEQ ID NO: 3310911 - protein, 7 aa, Plasmodium falciparum
ERDGELP

SEQ ID NO: 3310912 - protein, 41 aa, Plasmodium falciparum
ERDHKKCDDKKYSDNTNETYDDQKCDDNTNETYDNEKCDEA

SEQ ID NO: 3310913 - protein, 4 aa, Plasmodium falciparum
ERDI

SEQ ID NO: 3310914 - protein, 11 aa, Plasmodium falciparum
ERDINNKNKKL

SEQ ID NO: 3310915 - protein, 5 aa, Plasmodium falciparum
ERDIQ

SEQ ID NO: 3310916 - protein, 10 aa, Plasmodium falciparum
ERDITNNKSC

SEQ ID NO: 3310917 - protein, 4 aa, Plasmodium falciparum
ERDK

SEQ ID NO: 3310918 - protein, 14 aa, Plasmodium falciparum
ERDKDIIKDNEWLK

SEQ ID NO: 3310919 - protein, 18 aa, Plasmodium falciparum
ERDKLRKENLEKDENHTM

SEQ ID NO: 3310920 - protein, 4 aa, Plasmodium falciparum
ERDN

SEQ ID NO: 3310921 - protein, 10 aa, Plasmodium falciparum
ERDTKHEKSI

SEQ ID NO: 3310922 - protein, 6 aa, Plasmodium falciparum
ERDTKS

SEQ ID NO: 3310923 - protein, 11 aa, Plasmodium falciparum
ERDVKAKKGIQ

SEQ ID NO: 3310924 - protein, 11 aa, Plasmodium falciparum
ERECQNNNSYS

SEQ ID NO: 3310925 - protein, 7 aa, Plasmodium falciparum
ERECSDY

SEQ ID NO: 3310926 - protein, 7 aa, Plasmodium falciparum
EREDTEE

SEQ ID NO: 3310927 - protein, 4 aa, Plasmodium falciparum
EREE

SEQ ID NO: 3310928 - protein, 8 aa, Plasmodium falciparum
EREEDNIN

SEQ ID NO: 3310929 - protein, 10 aa, Plasmodium falciparum
EREEGDQNGY

SEQ ID NO: 3310930 - protein, 9 aa, Plasmodium falciparum
EREEKEMEK

SEQ ID NO: 3310931 - protein, 6 aa, Plasmodium falciparum
EREGID

SEQ ID NO: 3310932 - protein, 14 aa, Plasmodium falciparum
EREHERESEHEHEH

SEQ ID NO: 3310933 - protein, 24 aa, Plasmodium falciparum
EREKKNSYHSKYKTEKYLKQKNEF

SEQ ID NO: 3310934 - protein, 7 aa, Plasmodium falciparum
EREKKRP

SEQ ID NO: 3310935 - protein, 8 aa, Plasmodium falciparum
EREKNINN

SEQ ID NO: 3310936 - protein, 6 aa, Plasmodium falciparum
EREKNK

SEQ ID NO: 3310937 - protein, 5 aa, Plasmodium falciparum
EREKP

SEQ ID NO: 3310938 - protein, 7 aa, Plasmodium falciparum
EREMASD

SEQ ID NO: 3310939 - protein, 11 aa, Plasmodium falciparum
ERENETHTNNI

SEQ ID NO: 3310940 - protein, 6 aa, Plasmodium falciparum
ERENIE

SEQ ID NO: 3310941 - protein, 11 aa, Plasmodium falciparum
ERENKTNQPTM

SEQ ID NO: 3310942 - protein, 7 aa, Plasmodium falciparum
ERENNAP

SEQ ID NO: 3310943 - protein, 7 aa, Plasmodium falciparum
ERENNQN

SEQ ID NO: 3310944 - protein, 5 aa, Plasmodium falciparum
ERENY

SEQ ID NO: 3310945 - protein, 5 aa, Plasmodium falciparum
EREQK

SEQ ID NO: 3310946 - protein, 7 aa, Plasmodium falciparum
EREQKQK

SEQ ID NO: 3310947 - protein, 5 aa, Plasmodium falciparum
EREQT

SEQ ID NO: 3310948 - protein, 6 aa, Plasmodium falciparum
ERERGI

SEQ ID NO: 3310949 - protein, 12 aa, Plasmodium falciparum
ERERKDSDVTSF

SEQ ID NO: 3310950 - protein, 10 aa, Plasmodium falciparum
ERERKKEECI

SEQ ID NO: 3310951 - protein, 5 aa, Plasmodium falciparum
ERERR

SEQ ID NO: 3310952 - protein, 8 aa, Plasmodium falciparum
ERERSQRK

SEQ ID NO: 3310953 - protein, 17 aa, Plasmodium falciparum
ERETKKPSVKNSTLGNY

SEQ ID NO: 3310954 - protein, 7 aa, Plasmodium falciparum
ERFKKNG

SEQ ID NO: 3310955 - protein, 21 aa, Plasmodium falciparum
ERFNGNDKDLSSASSYNSSYN

SEQ ID NO: 3310956 - protein, 26 aa, Plasmodium falciparum
ERGEQKQNKKKIYNNNNINSHNNSCN

SEQ ID NO: 3310957 - protein, 8 aa, Plasmodium falciparum
ERGGQTRE

SEQ ID NO: 3310958 - protein, 49 aa, Plasmodium falciparum
ERGKGNDNRLGVSSTSNDKKKNNKKRYNNNNNNDNNNDINNDCNNNKYN

SEQ ID NO: 3310959 - protein, 10 aa, Plasmodium falciparum
ERGKMKKDKM

SEQ ID NO: 3310960 - protein, 5 aa, Plasmodium falciparum
ERGKY

SEQ ID NO: 3310961 - protein, 6 aa, Plasmodium falciparum
ERGLGE

SEQ ID NO: 3310962 - protein, 4 aa, Plasmodium falciparum
ERGN

SEQ ID NO: 3310963 - protein, 5 aa, Plasmodium falciparum
ERGNE

SEQ ID NO: 3310964 - protein, 4 aa, Plasmodium falciparum
ERGQ

SEQ ID NO: 3310965 - protein, 11 aa, Plasmodium falciparum
ERGQKGNVSEG

SEQ ID NO: 3310966 - protein, 7 aa, Plasmodium falciparum
ERGSRGR

SEQ ID NO: 3310967 - protein, 51 aa, Plasmodium falciparum
ERGYINRDKEGKHIRRDKEGKHIRRDKEEKHIRRDKEGKHIRGEQERRHQI

SEQ ID NO: 3310968 - protein, 5 aa, Plasmodium falciparum
ERGYS

SEQ ID NO: 3310969 - protein, 6 aa, Plasmodium falciparum
ERHDEN

SEQ ID NO: 3310970 - protein, 8 aa, Plasmodium falciparum
ERHGNQSR

SEQ ID NO: 3310971 - protein, 5 aa, Plasmodium falciparum
ERHTK

SEQ ID NO: 3310972 - protein, 9 aa, Plasmodium falciparum
ERIKPNTSI

SEQ ID NO: 3310973 - protein, 4 aa, Plasmodium falciparum
ERIN

SEQ ID NO: 3310974 - protein, 21 aa, Plasmodium falciparum
ERITEKNQNGNENGNENEKKN

SEQ ID NO: 3310975 - protein, 6 aa, Plasmodium falciparum
ERKDID

SEQ ID NO: 3310976 - protein, 16 aa, Plasmodium falciparum
ERKEKEKEKEKDYGME

SEQ ID NO: 3310977 - protein, 7 aa, Plasmodium falciparum
ERKENDS

SEQ ID NO: 3310978 - protein, 6 aa, Plasmodium falciparum
ERKENH

SEQ ID NO: 3310979 - protein, 7 aa, Plasmodium falciparum
ERKEQHN

SEQ ID NO: 3310980 - protein, 5 aa, Plasmodium falciparum
ERKIN

SEQ ID NO: 3310981 - protein, 11 aa, Plasmodium falciparum
ERKKKKKRKLY

SEQ ID NO: 3310982 - protein, 8 aa, Plasmodium falciparum
ERKKNNSI

SEQ ID NO: 3310983 - protein, 6 aa, Plasmodium falciparum
ERKKPQ

SEQ ID NO: 3310984 - protein, 7 aa, Plasmodium falciparum
ERKNNNS

SEQ ID NO: 3310985 - protein, 9 aa, Plasmodium falciparum
ERKNNQKTT

SEQ ID NO: 3310986 - protein, 9 aa, Plasmodium falciparum
ERKQNEYNN

SEQ ID NO: 3310987 - protein, 19 aa, Plasmodium falciparum
ERKSLKEKSQLAKSEEEKI

SEQ ID NO: 3310988 - protein, 28 aa, Plasmodium falciparum
ERKSNDNDNDNIKNNDNINSNNNINSNN

SEQ ID NO: 3310989 - protein, 28 aa, Plasmodium falciparum
ERKSNNVSTSTITNTNTNTNTNTNTKTN

SEQ ID NO: 3310990 - protein, 8 aa, Plasmodium falciparum
ERKSRRSN

SEQ ID NO: 3310991 - protein, 8 aa, Plasmodium falciparum
ERKTDVSQ

SEQ ID NO: 3310992 - protein, 13 aa, Plasmodium falciparum
ERKTGKTYGPIGN

SEQ ID NO: 3310993 - protein, 11 aa, Plasmodium falciparum
ERKYKKSYTAS

SEQ ID NO: 3310994 - protein, 4 aa, Plasmodium falciparum
ERLE

SEQ ID NO: 3310995 - protein, 4 aa, Plasmodium falciparum
ERLK

SEQ ID NO: 3310996 - protein, 6 aa, Plasmodium falciparum
ERLSRN

SEQ ID NO: 3310997 - protein, 7 aa, Plasmodium falciparum
ERNDDGN

SEQ ID NO: 3310998 - protein, 23 aa, Plasmodium falciparum
ERNDNNDSNDNHHNNHNNHNINN

SEQ ID NO: 3310999 - protein, 5 aa, Plasmodium falciparum
ERNET

SEQ ID NO: 3311000 - protein, 10 aa, Plasmodium falciparum
ERNHDEKDDS

SEQ ID NO: 3311001 - protein, 5 aa, Plasmodium falciparum
ERNHN

SEQ ID NO: 3311002 - protein, 6 aa, Plasmodium falciparum
ERNHSE

SEQ ID NO: 3311003 - protein, 4 aa, Plasmodium falciparum
ERNI

SEQ ID NO: 3311004 - protein, 6 aa, Plasmodium falciparum
ERNKDI

SEQ ID NO: 3311005 - protein, 19 aa, Plasmodium falciparum
ERNKDMKYNKRESLQPNAS

SEQ ID NO: 3311006 - protein, 6 aa, Plasmodium falciparum
ERNKKK

SEQ ID NO: 3311007 - protein, 6 aa, Plasmodium falciparum
ERNKLE

SEQ ID NO: 3311008 - protein, 5 aa, Plasmodium falciparum
ERNKN

SEQ ID NO: 3311009 - protein, 7 aa, Plasmodium falciparum
ERNKNQI

SEQ ID NO: 3311010 - protein, 5 aa, Plasmodium falciparum
ERNKR

SEQ ID NO: 3311011 - protein, 4 aa, Plasmodium falciparum
ERNN

SEQ ID NO: 3311012 - protein, 16 aa, Plasmodium falciparum
ERNNDDDEDDGISSTM

SEQ ID NO: 3311013 - protein, 9 aa, Plasmodium falciparum
ERNNDSLSD

SEQ ID NO: 3311014 - protein, 36 aa, Plasmodium falciparum
ERNNETNCTKGNNNDDDKSNNINNNNYNNNYNNNYN

SEQ ID NO: 3311015 - protein, 8 aa, Plasmodium falciparum
ERNNNSSL

SEQ ID NO: 3311016 - protein, 7 aa, Plasmodium falciparum
ERNPNTL

SEQ ID NO: 3311017 - protein, 27 aa, Plasmodium falciparum
ERNREKNNIPSYTSDSTQQQKKKKDYK

SEQ ID NO: 3311018 - protein, 7 aa, Plasmodium falciparum
ERNSIPE

SEQ ID NO: 3311019 - protein, 7 aa, Plasmodium falciparum
ERNSSPN

SEQ ID NO: 3311020 - protein, 11 aa, Plasmodium falciparum
ERNTTNGNVDS

SEQ ID NO: 3311021 - protein, 8 aa, Plasmodium falciparum
ERNTTYNN

SEQ ID NO: 3311022 - protein, 13 aa, Plasmodium falciparum
ERNVTSTSDPRRS

SEQ ID NO: 3311023 - protein, 15 aa, Plasmodium falciparum
ERNYKPDLRRYLHIS

SEQ ID NO: 3311024 - protein, 5 aa, Plasmodium falciparum
ERPDH

SEQ ID NO: 3311025 - protein, 7 aa, Plasmodium falciparum
ERPDIDK

SEQ ID NO: 3311026 - protein, 10 aa, Plasmodium falciparum
ERPGKLDATP

SEQ ID NO: 3311027 - protein, 5 aa, Plasmodium falciparum
ERPKD

SEQ ID NO: 3311028 - protein, 7 aa, Plasmodium falciparum
ERPREKF

SEQ ID NO: 3311029 - protein, 12 aa, Plasmodium falciparum
ERPTNYQDTRNY

SEQ ID NO: 3311030 - protein, 5 aa, Plasmodium falciparum
ERPTY

SEQ ID NO: 3311031 - protein, 31 aa, Plasmodium falciparum
ERQAEENTHDKKNHGNDQDSDNDEDEDDDDI

SEQ ID NO: 3311032 - protein, 4 aa, Plasmodium falciparum
ERQY

SEQ ID NO: 3311033 - protein, 7 aa, Plasmodium falciparum
ERRDELK

SEQ ID NO: 3311034 - protein, 29 aa, Plasmodium falciparum
ERRKEKEEKEAYIDPDKAEEHKNKGNEYF

SEQ ID NO: 3311035 - protein, 4 aa, Plasmodium falciparum
ERRN

SEQ ID NO: 3311036 - protein, 6 aa, Plasmodium falciparum
ERRNKV

SEQ ID NO: 3311037 - protein, 5 aa, Plasmodium falciparum
ERRNR

SEQ ID NO: 3311038 - protein, 4 aa, Plasmodium falciparum
ERRP

SEQ ID NO: 3311039 - protein, 8 aa, Plasmodium falciparum
ERRQNSEK

SEQ ID NO: 3311040 - protein, 6 aa, Plasmodium falciparum
ERRRER

SEQ ID NO: 3311041 - protein, 7 aa, Plasmodium falciparum
ERRRERE

SEQ ID NO: 3311042 - protein, 7 aa, Plasmodium falciparum
ERSDHTY

SEQ ID NO: 3311043 - protein, 12 aa, Plasmodium falciparum
ERSHNKSSDNIS

SEQ ID NO: 3311044 - protein, 4 aa, Plasmodium falciparum
ERSI

SEQ ID NO: 3311045 - protein, 4 aa, Plasmodium falciparum
ERSL

SEQ ID NO: 3311046 - protein, 11 aa, Plasmodium falciparum
ERSLEKDGTIY

SEQ ID NO: 3311047 - protein, 8 aa, Plasmodium falciparum
ERSNGECD

SEQ ID NO: 3311048 - protein, 8 aa, Plasmodium falciparum
ERSRREKE

SEQ ID NO: 3311049 - protein, 18 aa, Plasmodium falciparum
ERSSTFEKDQKKPKNYSN

SEQ ID NO: 3311050 - protein, 9 aa, Plasmodium falciparum
ERSTDNDDL

SEQ ID NO: 3311051 - protein, 7 aa, Plasmodium falciparum
ERSVSEN

SEQ ID NO: 3311052 - protein, 10 aa, Plasmodium falciparum
ERTFNKEENR

SEQ ID NO: 3311053 - protein, 4 aa, Plasmodium falciparum
ERTI

SEQ ID NO: 3311054 - protein, 4 aa, Plasmodium falciparum
ERTN

SEQ ID NO: 3311055 - protein, 6 aa, Plasmodium falciparum
ERTNID

SEQ ID NO: 3311056 - protein, 5 aa, Plasmodium falciparum
ERTNN

SEQ ID NO: 3311057 - protein, 7 aa, Plasmodium falciparum
ERTPPNI

SEQ ID NO: 3311058 - protein, 8 aa, Plasmodium falciparum
ERTSENAH

SEQ ID NO: 3311059 - protein, 6 aa, Plasmodium falciparum
ERTYED

SEQ ID NO: 3311060 - protein, 15 aa, Plasmodium falciparum
ERVPDDSVSLKDGDK

SEQ ID NO: 3311061 - protein, 6 aa, Plasmodium falciparum
ERVSGN

SEQ ID NO: 3311062 - protein, 5 aa, Plasmodium falciparum
ERVSL

SEQ ID NO: 3311063 - protein, 14 aa, Plasmodium falciparum
ERYSENSTMKYEGK

SEQ ID NO: 3311064 - protein, 12 aa, Plasmodium falciparum
ESADNAESMENG

SEQ ID NO: 3311065 - protein, 10 aa, Plasmodium falciparum
ESAHTKGDND

SEQ ID NO: 3311066 - protein, 4 aa, Plasmodium falciparum
ESAI

SEQ ID NO: 3311067 - protein, 6 aa, Plasmodium falciparum
ESAKGL

SEQ ID NO: 3311068 - protein, 5 aa, Plasmodium falciparum
ESAKI

SEQ ID NO: 3311069 - protein, 13 aa, Plasmodium falciparum
ESANEKESDNMKN

SEQ ID NO: 3311070 - protein, 5 aa, Plasmodium falciparum
ESAPK

SEQ ID NO: 3311071 - protein, 34 aa, Plasmodium falciparum
ESATTCKDNNANEACSSSQKSSPNPCADKSGGKL

SEQ ID NO: 3311072 - protein, 10 aa, Plasmodium falciparum
ESATTKEDDI

SEQ ID NO: 3311073 - protein, 4 aa, Plasmodium falciparum
ESCA

SEQ ID NO: 3311074 - protein, 6 aa, Plasmodium falciparum
ESCEKI

SEQ ID NO: 3311075 - protein, 12 aa, Plasmodium falciparum
ESCHKDEKEEEK

SEQ ID NO: 3311076 - protein, 9 aa, Plasmodium falciparum
ESCKDNKCS

SEQ ID NO: 3311077 - protein, 5 aa, Plasmodium falciparum
ESCNA

SEQ ID NO: 3311078 - protein, 10 aa, Plasmodium falciparum
ESCPQPQTSE

SEQ ID NO: 3311079 - protein, 24 aa, Plasmodium falciparum
ESCYESDYSSKYGTDGSIKDNKTN

SEQ ID NO: 3311080 - protein, 8 aa, Plasmodium falciparum
ESDAAKEL

SEQ ID NO: 3311081 - protein, 8 aa, Plasmodium falciparum
ESDDNSSL

SEQ ID NO: 3311082 - protein, 5 aa, Plasmodium falciparum
ESDEN

SEQ ID NO: 3311083 - protein, 7 aa, Plasmodium falciparum
ESDENVS

SEQ ID NO: 3311084 - protein, 5 aa, Plasmodium falciparum
ESDER

SEQ ID NO: 3311085 - protein, 7 aa, Plasmodium falciparum
ESDFSNK

SEQ ID NO: 3311086 - protein, 7 aa, Plasmodium falciparum
ESDGTRN

SEQ ID NO: 3311087 - protein, 13 aa, Plasmodium falciparum
ESDGYSDEEYDTN

SEQ ID NO: 3311088 - protein, 37 aa, Plasmodium falciparum
ESDIEREDESKEISSNKNDDTEYIENEEKNDKDQNNY

SEQ ID NO: 3311089 - protein, 8 aa, Plasmodium falciparum
ESDKCNGD

SEQ ID NO: 3311090 - protein, 7 aa, Plasmodium falciparum
ESDLADI

SEQ ID NO: 3311091 - protein, 8 aa, Plasmodium falciparum
ESDNDEVE

SEQ ID NO: 3311092 - protein, 13 aa, Plasmodium falciparum
ESDNGCYDNTYDN

SEQ ID NO: 3311093 - protein, 12 aa, Plasmodium falciparum
ESDNISSSKSFK

SEQ ID NO: 3311094 - protein, 6 aa, Plasmodium falciparum
ESDNKE

SEQ ID NO: 3311095 - protein, 17 aa, Plasmodium falciparum
ESDSSLENDKKKKENVK

SEQ ID NO: 3311096 - protein, 4 aa, Plasmodium falciparum
ESDT

SEQ ID NO: 3311097 - protein, 76 aa, Plasmodium falciparum
ESDTYENNKNDKEINSQSDKKLNSQSDKKLNSQSDKKLNSQSDKEINSQNDKEVNSQSDKEINSQSDKGINSQSDN

SEQ ID NO: 3311098 - protein, 4 aa, Plasmodium falciparum
ESED

SEQ ID NO: 3311099 - protein, 12 aa, Plasmodium falciparum
ESEDIKEQVKND

SEQ ID NO: 3311100 - protein, 6 aa, Plasmodium falciparum
ESEETN

SEQ ID NO: 3311101 - protein, 8 aa, Plasmodium falciparum
ESEHNQNE

SEQ ID NO: 3311102 - protein, 5 aa, Plasmodium falciparum
ESEHT

SEQ ID NO: 3311103 - protein, 4 aa, Plasmodium falciparum
ESEK

SEQ ID NO: 3311104 - protein, 11 aa, Plasmodium falciparum
ESEKMQEEMNE

SEQ ID NO: 3311105 - protein, 10 aa, Plasmodium falciparum
ESEKNLENDK

SEQ ID NO: 3311106 - protein, 7 aa, Plasmodium falciparum
ESEKRGN

SEQ ID NO: 3311107 - protein, 6 aa, Plasmodium falciparum
ESELNK

SEQ ID NO: 3311108 - protein, 11 aa, Plasmodium falciparum
ESENDRNESIQ

SEQ ID NO: 3311109 - protein, 8 aa, Plasmodium falciparum
ESENPRKM

SEQ ID NO: 3311110 - protein, 6 aa, Plasmodium falciparum
ESEQKN

SEQ ID NO: 3311111 - protein, 5 aa, Plasmodium falciparum
ESEQV

SEQ ID NO: 3311112 - protein, 5 aa, Plasmodium falciparum
ESERE

SEQ ID NO: 3311113 - protein, 11 aa, Plasmodium falciparum
ESETRKYKPYP

SEQ ID NO: 3311114 - protein, 4 aa, Plasmodium falciparum
ESFC

SEQ ID NO: 3311115 - protein, 33 aa, Plasmodium falciparum
ESFEKNKDDNNIMSTKSSASSYPYGDDEDGDNI

SEQ ID NO: 3311116 - protein, 6 aa, Plasmodium falciparum
ESFEPY

SEQ ID NO: 3311117 - protein, 4 aa, Plasmodium falciparum
ESFS

SEQ ID NO: 3311118 - protein, 6 aa, Plasmodium falciparum
ESGEID

SEQ ID NO: 3311119 - protein, 5 aa, Plasmodium falciparum
ESGEK

SEQ ID NO: 3311120 - protein, 4 aa, Plasmodium falciparum
ESGG

SEQ ID NO: 3311121 - protein, 4 aa, Plasmodium falciparum
ESGK

SEQ ID NO: 3311122 - protein, 24 aa, Plasmodium falciparum
ESGLGKRVDNNNNNCSSSSSSSAF

SEQ ID NO: 3311123 - protein, 4 aa, Plasmodium falciparum
ESGN

SEQ ID NO: 3311124 - protein, 10 aa, Plasmodium falciparum
ESGNNKLTND

SEQ ID NO: 3311125 - protein, 5 aa, Plasmodium falciparum
ESGRY

SEQ ID NO: 3311126 - protein, 6 aa, Plasmodium falciparum
ESGSKG

SEQ ID NO: 3311127 - protein, 7 aa, Plasmodium falciparum
ESGSNNS

SEQ ID NO: 3311128 - protein, 6 aa, Plasmodium falciparum
ESGTEI

SEQ ID NO: 3311129 - protein, 5 aa, Plasmodium falciparum
ESGTY

SEQ ID NO: 3311130 - protein, 5 aa, Plasmodium falciparum
ESGVD

SEQ ID NO: 3311131 - protein, 24 aa, Plasmodium falciparum
ESHDKKHKSEDSKYGEKRSNELYE

SEQ ID NO: 3311132 - protein, 4 aa, Plasmodium falciparum
ESHH

SEQ ID NO: 3311133 - protein, 21 aa, Plasmodium falciparum
ESHKGGKNMKKKNKKKKKKKD

SEQ ID NO: 3311134 - protein, 8 aa, Plasmodium falciparum
ESHKKCKN

SEQ ID NO: 3311135 - protein, 4 aa, Plasmodium falciparum
ESHL

SEQ ID NO: 3311136 - protein, 4 aa, Plasmodium falciparum
ESHM

SEQ ID NO: 3311137 - protein, 4 aa, Plasmodium falciparum
ESHN

SEQ ID NO: 3311138 - protein, 22 aa, Plasmodium falciparum
ESHTEKDEIKDDNNNNNNNNKH

SEQ ID NO: 3311139 - protein, 4 aa, Plasmodium falciparum
ESHY

SEQ ID NO: 3311140 - protein, 5 aa, Plasmodium falciparum
ESIDE

SEQ ID NO: 3311141 - protein, 7 aa, Plasmodium falciparum
ESIDNNN

SEQ ID NO: 3311142 - protein, 6 aa, Plasmodium falciparum
ESIDSD

SEQ ID NO: 3311143 - protein, 22 aa, Plasmodium falciparum
ESIDTTQTETFDDKNYNNEKKP

SEQ ID NO: 3311144 - protein, 5 aa, Plasmodium falciparum
ESIEK

SEQ ID NO: 3311145 - protein, 6 aa, Plasmodium falciparum
ESIEKQ

SEQ ID NO: 3311146 - protein, 8 aa, Plasmodium falciparum
ESIKEKNL

SEQ ID NO: 3311147 - protein, 4 aa, Plasmodium falciparum
ESIN

SEQ ID NO: 3311148 - protein, 6 aa, Plasmodium falciparum
ESINDD

SEQ ID NO: 3311149 - protein, 13 aa, Plasmodium falciparum
ESINESQTPEKVD

SEQ ID NO: 3311150 - protein, 13 aa, Plasmodium falciparum
ESINNNKKKYINK

SEQ ID NO: 3311151 - protein, 4 aa, Plasmodium falciparum
ESIQ

SEQ ID NO: 3311152 - protein, 5 aa, Plasmodium falciparum
ESIQS

SEQ ID NO: 3311153 - protein, 5 aa, Plasmodium falciparum
ESIQY

SEQ ID NO: 3311154 - protein, 14 aa, Plasmodium falciparum
ESIRHNSKSPNYYN

SEQ ID NO: 3311155 - protein, 5 aa, Plasmodium falciparum
ESIRR

SEQ ID NO: 3311156 - protein, 4 aa, Plasmodium falciparum
ESIY

SEQ ID NO: 3311157 - protein, 8 aa, Plasmodium falciparum
ESKDEALK

SEQ ID NO: 3311158 - protein, 10 aa, Plasmodium falciparum
ESKDQAQNAL

SEQ ID NO: 3311159 - protein, 5 aa, Plasmodium falciparum
ESKDY

SEQ ID NO: 3311160 - protein, 8 aa, Plasmodium falciparum
ESKEDKLK

SEQ ID NO: 3311161 - protein, 27 aa, Plasmodium falciparum
ESKEENKKDTNETKKKEEESKHYEDRH

SEQ ID NO: 3311162 - protein, 22 aa, Plasmodium falciparum
ESKEKEEKKEGVETNAKEKRSV

SEQ ID NO: 3311163 - protein, 9 aa, Plasmodium falciparum
ESKGADTSI

SEQ ID NO: 3311164 - protein, 4 aa, Plasmodium falciparum
ESKH

SEQ ID NO: 3311165 - protein, 7 aa, Plasmodium falciparum
ESKIGQD

SEQ ID NO: 3311166 - protein, 9 aa, Plasmodium falciparum
ESKKEENEK

SEQ ID NO: 3311167 - protein, 12 aa, Plasmodium falciparum
ESKKNKKESYIN

SEQ ID NO: 3311168 - protein, 45 aa, Plasmodium falciparum
ESKKQQNAAKKINGEVETNENKDDNKTKNENNNKKAKSKKDKQKT

SEQ ID NO: 3311169 - protein, 8 aa, Plasmodium falciparum
ESKKSLVE

SEQ ID NO: 3311170 - protein, 6 aa, Plasmodium falciparum
ESKLED

SEQ ID NO: 3311171 - protein, 6 aa, Plasmodium falciparum
ESKLGK

SEQ ID NO: 3311172 - protein, 10 aa, Plasmodium falciparum
ESKNEGKKNE

SEQ ID NO: 3311173 - protein, 54 aa, Plasmodium falciparum
ESKNKNVNQKEDNKEINKENNKDDNKENNKEDNKEYNKEDDKEDDKEDDKEDDK

SEQ ID NO: 3311174 - protein, 5 aa, Plasmodium falciparum
ESKNM

SEQ ID NO: 3311175 - protein, 8 aa, Plasmodium falciparum
ESKNNIDG

SEQ ID NO: 3311176 - protein, 8 aa, Plasmodium falciparum
ESKNNNGM

SEQ ID NO: 3311177 - protein, 6 aa, Plasmodium falciparum
ESKNRP

SEQ ID NO: 3311178 - protein, 13 aa, Plasmodium falciparum
ESKNVGKNIGQNI

SEQ ID NO: 3311179 - protein, 8 aa, Plasmodium falciparum
ESKRNRNR

SEQ ID NO: 3311180 - protein, 7 aa, Plasmodium falciparum
ESKRTKH

SEQ ID NO: 3311181 - protein, 9 aa, Plasmodium falciparum
ESKSKNETN

SEQ ID NO: 3311182 - protein, 5 aa, Plasmodium falciparum
ESKSM

SEQ ID NO: 3311183 - protein, 5 aa, Plasmodium falciparum
ESKTK

SEQ ID NO: 3311184 - protein, 5 aa, Plasmodium falciparum
ESKYE

SEQ ID NO: 3311185 - protein, 9 aa, Plasmodium falciparum
ESKYEENKE

SEQ ID NO: 3311186 - protein, 8 aa, Plasmodium falciparum
ESKYSTQR

SEQ ID NO: 3311187 - protein, 26 aa, Plasmodium falciparum
ESLCNKSSSSIQNVEGTKKRETNIKS

SEQ ID NO: 3311188 - protein, 4 aa, Plasmodium falciparum
ESLD

SEQ ID NO: 3311189 - protein, 7 aa, Plasmodium falciparum
ESLEKEK

SEQ ID NO: 3311190 - protein, 12 aa, Plasmodium falciparum
ESLEKKNKVKTS

SEQ ID NO: 3311191 - protein, 12 aa, Plasmodium falciparum
ESLETKKERRLG

SEQ ID NO: 3311192 - protein, 5 aa, Plasmodium falciparum
ESLKE

SEQ ID NO: 3311193 - protein, 20 aa, Plasmodium falciparum
ESLKENEKKMKRRKKGELDK

SEQ ID NO: 3311194 - protein, 6 aa, Plasmodium falciparum
ESLKES

SEQ ID NO: 3311195 - protein, 19 aa, Plasmodium falciparum
ESLNKESYKECDNKKSVNE

SEQ ID NO: 3311196 - protein, 4 aa, Plasmodium falciparum
ESLP

SEQ ID NO: 3311197 - protein, 4 aa, Plasmodium falciparum
ESLQ

SEQ ID NO: 3311198 - protein, 5 aa, Plasmodium falciparum
ESLQQ

SEQ ID NO: 3311199 - protein, 5 aa, Plasmodium falciparum
ESLSD

SEQ ID NO: 3311200 - protein, 9 aa, Plasmodium falciparum
ESLSKTKEA

SEQ ID NO: 3311201 - protein, 16 aa, Plasmodium falciparum
ESLTSEEEKLKESDEQ

SEQ ID NO: 3311202 - protein, 4 aa, Plasmodium falciparum
ESMD

SEQ ID NO: 3311203 - protein, 42 aa, Plasmodium falciparum
ESMNDEERVSSEDENKKRKNKEDDKDIREREKSKKHDEDKMK

SEQ ID NO: 3311204 - protein, 12 aa, Plasmodium falciparum
ESMNDLSDDKME

SEQ ID NO: 3311205 - protein, 12 aa, Plasmodium falciparum
ESNDKKKKETNK

SEQ ID NO: 3311206 - protein, 20 aa, Plasmodium falciparum
ESNDSIEGNKNKYDKNKVKE

SEQ ID NO: 3311207 - protein, 15 aa, Plasmodium falciparum
ESNEAEGEDEGYEAD

SEQ ID NO: 3311208 - protein, 7 aa, Plasmodium falciparum
ESNEDIS

SEQ ID NO: 3311209 - protein, 8 aa, Plasmodium falciparum
ESNEMKGK

SEQ ID NO: 3311210 - protein, 13 aa, Plasmodium falciparum
ESNESQNETNPEQ

SEQ ID NO: 3311211 - protein, 7 aa, Plasmodium falciparum
ESNETIR

SEQ ID NO: 3311212 - protein, 18 aa, Plasmodium falciparum
ESNFSHSKTNNDDINEKL

SEQ ID NO: 3311213 - protein, 13 aa, Plasmodium falciparum
ESNGKSVDRNNQP

SEQ ID NO: 3311214 - protein, 11 aa, Plasmodium falciparum
ESNINKEKENY

SEQ ID NO: 3311215 - protein, 4 aa, Plasmodium falciparum
ESNK

SEQ ID NO: 3311216 - protein, 5 aa, Plasmodium falciparum
ESNKC

SEQ ID NO: 3311217 - protein, 8 aa, Plasmodium falciparum
ESNKIHKS

SEQ ID NO: 3311218 - protein, 10 aa, Plasmodium falciparum
ESNKYDDNYE

SEQ ID NO: 3311219 - protein, 8 aa, Plasmodium falciparum
ESNKYDID

SEQ ID NO: 3311220 - protein, 5 aa, Plasmodium falciparum
ESNLD

SEQ ID NO: 3311221 - protein, 5 aa, Plasmodium falciparum
ESNLS

SEQ ID NO: 3311222 - protein, 6 aa, Plasmodium falciparum
ESNLSD

SEQ ID NO: 3311223 - protein, 10 aa, Plasmodium falciparum
ESNLSPKESE

SEQ ID NO: 3311224 - protein, 4 aa, Plasmodium falciparum
ESNN

SEQ ID NO: 3311225 - protein, 13 aa, Plasmodium falciparum
ESNNFDSNSEEFA

SEQ ID NO: 3311226 - protein, 10 aa, Plasmodium falciparum
ESNNMSGNKN

SEQ ID NO: 3311227 - protein, 5 aa, Plasmodium falciparum
ESNNN

SEQ ID NO: 3311228 - protein, 9 aa, Plasmodium falciparum
ESNNNNNNN

SEQ ID NO: 3311229 - protein, 10 aa, Plasmodium falciparum
ESNNNQKDFV

SEQ ID NO: 3311230 - protein, 15 aa, Plasmodium falciparum
ESNNSIKKKEEIKKK

SEQ ID NO: 3311231 - protein, 11 aa, Plasmodium falciparum
ESNNYNSRNNN

SEQ ID NO: 3311232 - protein, 8 aa, Plasmodium falciparum
ESNQQNNV

SEQ ID NO: 3311233 - protein, 7 aa, Plasmodium falciparum
ESNQTNI

SEQ ID NO: 3311234 - protein, 28 aa, Plasmodium falciparum
ESNRGKRRSVKSKNKNENEKKGKTKDEL

SEQ ID NO: 3311235 - protein, 7 aa, Plasmodium falciparum
ESNRNNN

SEQ ID NO: 3311236 - protein, 6 aa, Plasmodium falciparum
ESNSIV

SEQ ID NO: 3311237 - protein, 5 aa, Plasmodium falciparum
ESNSN

SEQ ID NO: 3311238 - protein, 10 aa, Plasmodium falciparum
ESNTDNVQTN

SEQ ID NO: 3311239 - protein, 7 aa, Plasmodium falciparum
ESNTELH

SEQ ID NO: 3311240 - protein, 14 aa, Plasmodium falciparum
ESNTISHNNNNHNN

SEQ ID NO: 3311241 - protein, 5 aa, Plasmodium falciparum
ESNVT

SEQ ID NO: 3311242 - protein, 7 aa, Plasmodium falciparum
ESNYSDL

SEQ ID NO: 3311243 - protein, 9 aa, Plasmodium falciparum
ESNYTTKDT

SEQ ID NO: 3311244 - protein, 9 aa, Plasmodium falciparum
ESPFSSNSS

SEQ ID NO: 3311245 - protein, 4 aa, Plasmodium falciparum
ESPI

SEQ ID NO: 3311246 - protein, 12 aa, Plasmodium falciparum
ESPIGEKGKNIA

SEQ ID NO: 3311247 - protein, 10 aa, Plasmodium falciparum
ESPIKENKNG

SEQ ID NO: 3311248 - protein, 7 aa, Plasmodium falciparum
ESPPDID

SEQ ID NO: 3311249 - protein, 5 aa, Plasmodium falciparum
ESPQK

SEQ ID NO: 3311250 - protein, 8 aa, Plasmodium falciparum
ESPRRGET

SEQ ID NO: 3311251 - protein, 9 aa, Plasmodium falciparum
ESPSENNTI

SEQ ID NO: 3311252 - protein, 8 aa, Plasmodium falciparum
ESPTGTGK

SEQ ID NO: 3311253 - protein, 59 aa, Plasmodium falciparum
ESQDGKKGKGHKNGKREEDEDEDEFDGDEEDNDEEDEFDDDDDEEEEENDDDNDEEDEF

SEQ ID NO: 3311254 - protein, 6 aa, Plasmodium falciparum
ESQETD

SEQ ID NO: 3311255 - protein, 4 aa, Plasmodium falciparum
ESQH

SEQ ID NO: 3311256 - protein, 23 aa, Plasmodium falciparum
ESQKALATGKDYARRPTSYKSSL

SEQ ID NO: 3311257 - protein, 5 aa, Plasmodium falciparum
ESQKK

SEQ ID NO: 3311258 - protein, 12 aa, Plasmodium falciparum
ESQKKKNSIETY

SEQ ID NO: 3311259 - protein, 6 aa, Plasmodium falciparum
ESQKKS

SEQ ID NO: 3311260 - protein, 8 aa, Plasmodium falciparum
ESQLEVSE

SEQ ID NO: 3311261 - protein, 6 aa, Plasmodium falciparum
ESQRIK

SEQ ID NO: 3311262 - protein, 5 aa, Plasmodium falciparum
ESRDI

SEQ ID NO: 3311263 - protein, 7 aa, Plasmodium falciparum
ESREKQL

SEQ ID NO: 3311264 - protein, 68 aa, Plasmodium falciparum
ESRENHSSKESTKCQDGEAANVEENEENEKNEKKEKNEKNENIEQNKNVEQNKNIEQNKNIEQNKNVE

SEQ ID NO: 3311265 - protein, 21 aa, Plasmodium falciparum
ESRENQQNKYDINKTNSRPIK

SEQ ID NO: 3311266 - protein, 5 aa, Plasmodium falciparum
ESRGH

SEQ ID NO: 3311267 - protein, 14 aa, Plasmodium falciparum
ESRHPNKEWTATSG

SEQ ID NO: 3311268 - protein, 8 aa, Plasmodium falciparum
ESRKKKCS

SEQ ID NO: 3311269 - protein, 5 aa, Plasmodium falciparum
ESRKR

SEQ ID NO: 3311270 - protein, 9 aa, Plasmodium falciparum
ESRKRKEMS

SEQ ID NO: 3311271 - protein, 14 aa, Plasmodium falciparum
ESRRTGGKDTLAND

SEQ ID NO: 3311272 - protein, 5 aa, Plasmodium falciparum
ESSAI

SEQ ID NO: 3311273 - protein, 8 aa, Plasmodium falciparum
ESSATCGG

SEQ ID NO: 3311274 - protein, 7 aa, Plasmodium falciparum
ESSCSNK

SEQ ID NO: 3311275 - protein, 5 aa, Plasmodium falciparum
ESSDN

SEQ ID NO: 3311276 - protein, 8 aa, Plasmodium falciparum
ESSDPLEN

SEQ ID NO: 3311277 - protein, 24 aa, Plasmodium falciparum
ESSEEEYEKRDVRKKSQDYQKNNS

SEQ ID NO: 3311278 - protein, 4 aa, Plasmodium falciparum
ESSF

SEQ ID NO: 3311279 - protein, 6 aa, Plasmodium falciparum
ESSGIN

SEQ ID NO: 3311280 - protein, 55 aa, Plasmodium falciparum
ESSGSKEKADNNTEEESKKQREKEENVADNNNRNVDDKKKEGDKNVEETNKISST

SEQ ID NO: 3311281 - protein, 7 aa, Plasmodium falciparum
ESSGTKL

SEQ ID NO: 3311282 - protein, 8 aa, Plasmodium falciparum
ESSINSNK

SEQ ID NO: 3311283 - protein, 20 aa, Plasmodium falciparum
ESSKCEVTNEDAPSDEDISY

SEQ ID NO: 3311284 - protein, 9 aa, Plasmodium falciparum
ESSKDLNIS

SEQ ID NO: 3311285 - protein, 7 aa, Plasmodium falciparum
ESSKKEF

SEQ ID NO: 3311286 - protein, 6 aa, Plasmodium falciparum
ESSKNF

SEQ ID NO: 3311287 - protein, 9 aa, Plasmodium falciparum
ESSKSISDD

SEQ ID NO: 3311288 - protein, 8 aa, Plasmodium falciparum
ESSMNNND

SEQ ID NO: 3311289 - protein, 104 aa, Plasmodium falciparum
ESSNDNNRGHNNNSDDNNGGDNNNGGDNNNGGDNNNGGDNNNGGVNTNGGDNNNGGDNNNGGDNTNSSNDTNRSDDDNTDPSNNSDYSSNDVDNYEDDDYNNYS

SEQ ID NO: 3311290 - protein, 20 aa, Plasmodium falciparum
ESSNNSTNQLDNKIGNKNKY

SEQ ID NO: 3311291 - protein, 6 aa, Plasmodium falciparum
ESSNRK

SEQ ID NO: 3311292 - protein, 16 aa, Plasmodium falciparum
ESSNSRDRMTYASSKQ

SEQ ID NO: 3311293 - protein, 5 aa, Plasmodium falciparum
ESSQL

SEQ ID NO: 3311294 - protein, 9 aa, Plasmodium falciparum
ESSQSLEKT

SEQ ID NO: 3311295 - protein, 5 aa, Plasmodium falciparum
ESSQT

SEQ ID NO: 3311296 - protein, 8 aa, Plasmodium falciparum
ESSTGVNR

SEQ ID NO: 3311297 - protein, 10 aa, Plasmodium falciparum
ESSTNSNNNK

SEQ ID NO: 3311298 - protein, 15 aa, Plasmodium falciparum
ESSTQTDNTNCNDRD

SEQ ID NO: 3311299 - protein, 5 aa, Plasmodium falciparum
ESSVG

SEQ ID NO: 3311300 - protein, 6 aa, Plasmodium falciparum
ESSVQS

SEQ ID NO: 3311301 - protein, 7 aa, Plasmodium falciparum
ESSYNGA

SEQ ID NO: 3311302 - protein, 7 aa, Plasmodium falciparum
ESTDNDV

SEQ ID NO: 3311303 - protein, 9 aa, Plasmodium falciparum
ESTEESNNK

SEQ ID NO: 3311304 - protein, 15 aa, Plasmodium falciparum
ESTENLNSQHNENIS

SEQ ID NO: 3311305 - protein, 5 aa, Plasmodium falciparum
ESTGK

SEQ ID NO: 3311306 - protein, 7 aa, Plasmodium falciparum
ESTGPHT

SEQ ID NO: 3311307 - protein, 6 aa, Plasmodium falciparum
ESTGYL

SEQ ID NO: 3311308 - protein, 8 aa, Plasmodium falciparum
ESTIRSPT

SEQ ID NO: 3311309 - protein, 8 aa, Plasmodium falciparum
ESTKGTII

SEQ ID NO: 3311310 - protein, 7 aa, Plasmodium falciparum
ESTKPDY

SEQ ID NO: 3311311 - protein, 5 aa, Plasmodium falciparum
ESTKT

SEQ ID NO: 3311312 - protein, 6 aa, Plasmodium falciparum
ESTLEN

SEQ ID NO: 3311313 - protein, 7 aa, Plasmodium falciparum
ESTLPRT

SEQ ID NO: 3311314 - protein, 34 aa, Plasmodium falciparum
ESTNEEERDSDNTTLNDKTKSDNKSSKKKESNTK

SEQ ID NO: 3311315 - protein, 5 aa, Plasmodium falciparum
ESTPA

SEQ ID NO: 3311316 - protein, 12 aa, Plasmodium falciparum
ESTQQKEKKEAQ

SEQ ID NO: 3311317 - protein, 4 aa, Plasmodium falciparum
ESTR

SEQ ID NO: 3311318 - protein, 7 aa, Plasmodium falciparum
ESTSDRN

SEQ ID NO: 3311319 - protein, 7 aa, Plasmodium falciparum
ESTSFEK

SEQ ID NO: 3311320 - protein, 7 aa, Plasmodium falciparum
ESTSKEI

SEQ ID NO: 3311321 - protein, 11 aa, Plasmodium falciparum
ESTSNKKPKEY

SEQ ID NO: 3311322 - protein, 18 aa, Plasmodium falciparum
ESTSSKLDKNSPNNSEST

SEQ ID NO: 3311323 - protein, 7 aa, Plasmodium falciparum
ESTWNKE

SEQ ID NO: 3311324 - protein, 5 aa, Plasmodium falciparum
ESTYE

SEQ ID NO: 3311325 - protein, 6 aa, Plasmodium falciparum
ESVGNY

SEQ ID NO: 3311326 - protein, 17 aa, Plasmodium falciparum
ESVKEYSPNDDTNYDAT

SEQ ID NO: 3311327 - protein, 28 aa, Plasmodium falciparum
ESVNHNNNNNNNNNSSSSSSGSNKFRKG

SEQ ID NO: 3311328 - protein, 6 aa, Plasmodium falciparum
ESVNIS

SEQ ID NO: 3311329 - protein, 5 aa, Plasmodium falciparum
ESVNS

SEQ ID NO: 3311330 - protein, 39 aa, Plasmodium falciparum
ESVQKKKKKKKTNNNNNNNNNNDDDNNENNSSEDQYSSE

SEQ ID NO: 3311331 - protein, 5 aa, Plasmodium falciparum
ESVSK

SEQ ID NO: 3311332 - protein, 5 aa, Plasmodium falciparum
ESYEA

SEQ ID NO: 3311333 - protein, 6 aa, Plasmodium falciparum
ESYETY

SEQ ID NO: 3311334 - protein, 52 aa, Plasmodium falciparum
ESYEYDDEEGADYDDDGDDDGDDDGDDDDDDDDDNDDDDDNNNDDEDNYYDD

SEQ ID NO: 3311335 - protein, 7 aa, Plasmodium falciparum
ESYGEHK

SEQ ID NO: 3311336 - protein, 5 aa, Plasmodium falciparum
ESYGP

SEQ ID NO: 3311337 - protein, 15 aa, Plasmodium falciparum
ESYNESDLYKGNSEH

SEQ ID NO: 3311338 - protein, 7 aa, Plasmodium falciparum
ESYNNSI

SEQ ID NO: 3311339 - protein, 4 aa, Plasmodium falciparum
ESYR

SEQ ID NO: 3311340 - protein, 5 aa, Plasmodium falciparum
ESYRN

SEQ ID NO: 3311341 - protein, 40 aa, Plasmodium falciparum
ESYSSKNDEYISEEKKESLAASHKNDEREENVEEKEVKDV

SEQ ID NO: 3311342 - protein, 22 aa, Plasmodium falciparum
ESYYKSNKKHSSSRQISEDIPS

SEQ ID NO: 3311343 - protein, 6 aa, Plasmodium falciparum
ETADFG

SEQ ID NO: 3311344 - protein, 6 aa, Plasmodium falciparum
ETAENY

SEQ ID NO: 3311345 - protein, 7 aa, Plasmodium falciparum
ETAGGKF

SEQ ID NO: 3311346 - protein, 5 aa, Plasmodium falciparum
ETAKE

SEQ ID NO: 3311347 - protein, 5 aa, Plasmodium falciparum
ETAKK

SEQ ID NO: 3311348 - protein, 5 aa, Plasmodium falciparum
ETAKN

SEQ ID NO: 3311349 - protein, 30 aa, Plasmodium falciparum
ETCDDTTSCTHSKNTRSDKKTDASISGKDD

SEQ ID NO: 3311350 - protein, 19 aa, Plasmodium falciparum
ETDDDLKSENNKSDDFNDI

SEQ ID NO: 3311351 - protein, 5 aa, Plasmodium falciparum
ETDDK

SEQ ID NO: 3311352 - protein, 5 aa, Plasmodium falciparum
ETDDL

SEQ ID NO: 3311353 - protein, 20 aa, Plasmodium falciparum
ETDDNIGGKKENVIDEEKDE

SEQ ID NO: 3311354 - protein, 4 aa, Plasmodium falciparum
ETDE

SEQ ID NO: 3311355 - protein, 11 aa, Plasmodium falciparum
ETDEEDKRVDE

SEQ ID NO: 3311356 - protein, 11 aa, Plasmodium falciparum
ETDEKDEHYES

SEQ ID NO: 3311357 - protein, 6 aa, Plasmodium falciparum
ETDELN

SEQ ID NO: 3311358 - protein, 5 aa, Plasmodium falciparum
ETDEP

SEQ ID NO: 3311359 - protein, 22 aa, Plasmodium falciparum
ETDESNSSNLSNVSYKSSSSYE

SEQ ID NO: 3311360 - protein, 13 aa, Plasmodium falciparum
ETDGYGKQKAKKG

SEQ ID NO: 3311361 - protein, 25 aa, Plasmodium falciparum
ETDINEEKKEEDSKRKRGESKYYAP

SEQ ID NO: 3311362 - protein, 11 aa, Plasmodium falciparum
ETDNNHNMNSG

SEQ ID NO: 3311363 - protein, 4 aa, Plasmodium falciparum
ETDQ

SEQ ID NO: 3311364 - protein, 7 aa, Plasmodium falciparum
ETDTPKN

SEQ ID NO: 3311365 - protein, 11 aa, Plasmodium falciparum
ETDYSSDDLED

SEQ ID NO: 3311366 - protein, 14 aa, Plasmodium falciparum
ETECSISQSETNNN

SEQ ID NO: 3311367 - protein, 93 aa, Plasmodium falciparum
ETEDGEEDDDVEDDDVEDDDVEDDDVEDDDVEDDDVEDDDVEDDDEEDDDDEEDDDDEEDDDDEEDNEDEDDDNNDDDNNNDEDNEEDQNNLQ

SEQ ID NO: 3311368 - protein, 5 aa, Plasmodium falciparum
ETEDT

SEQ ID NO: 3311369 - protein, 8 aa, Plasmodium falciparum
ETEGRSCN

SEQ ID NO: 3311370 - protein, 12 aa, Plasmodium falciparum
ETEHSYKQNVEE

SEQ ID NO: 3311371 - protein, 19 aa, Plasmodium falciparum
ETEIKKTNDIEKEKNTKLS

SEQ ID NO: 3311372 - protein, 14 aa, Plasmodium falciparum
ETEKGQGVYQQTKR

SEQ ID NO: 3311373 - protein, 23 aa, Plasmodium falciparum
ETELSSDEESKEDENNDERKKKR

SEQ ID NO: 3311374 - protein, 15 aa, Plasmodium falciparum
ETEQNIYDNNKPEEL

SEQ ID NO: 3311375 - protein, 10 aa, Plasmodium falciparum
ETESNKNGVA

SEQ ID NO: 3311376 - protein, 7 aa, Plasmodium falciparum
ETEYGQN

SEQ ID NO: 3311377 - protein, 17 aa, Plasmodium falciparum
ETFAKGKKHTLQQTPRN

SEQ ID NO: 3311378 - protein, 18 aa, Plasmodium falciparum
ETFDEEEQREKKRNNLED

SEQ ID NO: 3311379 - protein, 15 aa, Plasmodium falciparum
ETFEKSKQGDQHSDK

SEQ ID NO: 3311380 - protein, 14 aa, Plasmodium falciparum
ETFEPNNKLDSYED

SEQ ID NO: 3311381 - protein, 91 aa, Plasmodium falciparum
ETGDITIPGDDKNEEGNKNGKGNKNGKGNKYGKGNKYGKGNKYGKGNKNEKNNKNNNDNNIEENDNYNDKEKITKKKNINHNNSNRNNNNN

SEQ ID NO: 3311382 - protein, 7 aa, Plasmodium falciparum
ETGHSSR

SEQ ID NO: 3311383 - protein, 4 aa, Plasmodium falciparum
ETGI

SEQ ID NO: 3311384 - protein, 11 aa, Plasmodium falciparum
ETGKQGSRLTH

SEQ ID NO: 3311385 - protein, 7 aa, Plasmodium falciparum
ETGNHNN

SEQ ID NO: 3311386 - protein, 10 aa, Plasmodium falciparum
ETGSGKSTQL

SEQ ID NO: 3311387 - protein, 7 aa, Plasmodium falciparum
ETGSGKT

SEQ ID NO: 3311388 - protein, 8 aa, Plasmodium falciparum
ETGSGKTA

SEQ ID NO: 3311389 - protein, 10 aa, Plasmodium falciparum
ETGSGKTTQI

SEQ ID NO: 3311390 - protein, 8 aa, Plasmodium falciparum
ETGTEDKL

SEQ ID NO: 3311391 - protein, 6 aa, Plasmodium falciparum
ETGTGK

SEQ ID NO: 3311392 - protein, 6 aa, Plasmodium falciparum
ETGTPY

SEQ ID NO: 3311393 - protein, 10 aa, Plasmodium falciparum
ETGVTKTNAR

SEQ ID NO: 3311394 - protein, 4 aa, Plasmodium falciparum
ETGY

SEQ ID NO: 3311395 - protein, 6 aa, Plasmodium falciparum
ETHEND

SEQ ID NO: 3311396 - protein, 13 aa, Plasmodium falciparum
ETHHKQNKGTDYI

SEQ ID NO: 3311397 - protein, 22 aa, Plasmodium falciparum
ETHNNKEKYKKIETQSGKKNTH

SEQ ID NO: 3311398 - protein, 4 aa, Plasmodium falciparum
ETHQ

SEQ ID NO: 3311399 - protein, 20 aa, Plasmodium falciparum
ETHTNDMSNKNTKKKEESKQ

SEQ ID NO: 3311400 - protein, 5 aa, Plasmodium falciparum
ETIDE

SEQ ID NO: 3311401 - protein, 6 aa, Plasmodium falciparum
ETIGSS

SEQ ID NO: 3311402 - protein, 21 aa, Plasmodium falciparum
ETIKKKEINRRENKNDVNRNE

SEQ ID NO: 3311403 - protein, 6 aa, Plasmodium falciparum
ETINEK

SEQ ID NO: 3311404 - protein, 15 aa, Plasmodium falciparum
ETINGTNSEPSNSKR

SEQ ID NO: 3311405 - protein, 5 aa, Plasmodium falciparum
ETIRK

SEQ ID NO: 3311406 - protein, 19 aa, Plasmodium falciparum
ETIRRNEKYNKSLNSTSSF

SEQ ID NO: 3311407 - protein, 7 aa, Plasmodium falciparum
ETISENE

SEQ ID NO: 3311408 - protein, 17 aa, Plasmodium falciparum
ETITEKQRNDALTFEIL

SEQ ID NO: 3311409 - protein, 8 aa, Plasmodium falciparum
ETKATDSK

SEQ ID NO: 3311410 - protein, 6 aa, Plasmodium falciparum
ETKDSN

SEQ ID NO: 3311411 - protein, 8 aa, Plasmodium falciparum
ETKEDNKN

SEQ ID NO: 3311412 - protein, 7 aa, Plasmodium falciparum
ETKEKNK

SEQ ID NO: 3311413 - protein, 20 aa, Plasmodium falciparum
ETKGKSKTKYKNDNSLDDNI

SEQ ID NO: 3311414 - protein, 15 aa, Plasmodium falciparum
ETKGTLRNNENTKDM

SEQ ID NO: 3311415 - protein, 6 aa, Plasmodium falciparum
ETKKCN

SEQ ID NO: 3311416 - protein, 17 aa, Plasmodium falciparum
ETKKEDVHSKGDNQRNC

SEQ ID NO: 3311417 - protein, 24 aa, Plasmodium falciparum
ETKKGHNNNNNQNDYNNDNSLNYS

SEQ ID NO: 3311418 - protein, 10 aa, Plasmodium falciparum
ETKKKEKELN

SEQ ID NO: 3311419 - protein, 10 aa, Plasmodium falciparum
ETKKKKKKKK

SEQ ID NO: 3311420 - protein, 11 aa, Plasmodium falciparum
ETKKKKRRDTL

SEQ ID NO: 3311421 - protein, 21 aa, Plasmodium falciparum
ETKKLKEGKQIGTTKRGIGPC

SEQ ID NO: 3311422 - protein, 11 aa, Plasmodium falciparum
ETKKNEKREDL

SEQ ID NO: 3311423 - protein, 8 aa, Plasmodium falciparum
ETKKNKPL

SEQ ID NO: 3311424 - protein, 8 aa, Plasmodium falciparum
ETKKTDNI

SEQ ID NO: 3311425 - protein, 6 aa, Plasmodium falciparum
ETKNDM

SEQ ID NO: 3311426 - protein, 16 aa, Plasmodium falciparum
ETKNKKDDNKPSPRSG

SEQ ID NO: 3311427 - protein, 7 aa, Plasmodium falciparum
ETKNNIN

SEQ ID NO: 3311428 - protein, 10 aa, Plasmodium falciparum
ETKNVENKDV

SEQ ID NO: 3311429 - protein, 9 aa, Plasmodium falciparum
ETKPAFGAE

SEQ ID NO: 3311430 - protein, 20 aa, Plasmodium falciparum
ETKPLNYKNKEAQYEQKEKM

SEQ ID NO: 3311431 - protein, 10 aa, Plasmodium falciparum
ETKSEEEKSY

SEQ ID NO: 3311432 - protein, 9 aa, Plasmodium falciparum
ETKSSIEAD

SEQ ID NO: 3311433 - protein, 7 aa, Plasmodium falciparum
ETKSVNV

SEQ ID NO: 3311434 - protein, 6 aa, Plasmodium falciparum
ETKTNQ

SEQ ID NO: 3311435 - protein, 19 aa, Plasmodium falciparum
ETKTTLKQNKLQNLKKRRK

SEQ ID NO: 3311436 - protein, 5 aa, Plasmodium falciparum
ETKVT

SEQ ID NO: 3311437 - protein, 6 aa, Plasmodium falciparum
ETKYEG

SEQ ID NO: 3311438 - protein, 6 aa, Plasmodium falciparum
ETLDSL

SEQ ID NO: 3311439 - protein, 10 aa, Plasmodium falciparum
ETLGDGSSSN

SEQ ID NO: 3311440 - protein, 5 aa, Plasmodium falciparum
ETLKE

SEQ ID NO: 3311441 - protein, 8 aa, Plasmodium falciparum
ETLKEERR

SEQ ID NO: 3311442 - protein, 21 aa, Plasmodium falciparum
ETLKKEEKKLKENDINDKEED

SEQ ID NO: 3311443 - protein, 6 aa, Plasmodium falciparum
ETLPSA

SEQ ID NO: 3311444 - protein, 6 aa, Plasmodium falciparum
ETLSNA

SEQ ID NO: 3311445 - protein, 9 aa, Plasmodium falciparum
ETMGKKNES

SEQ ID NO: 3311446 - protein, 4 aa, Plasmodium falciparum
ETMK

SEQ ID NO: 3311447 - protein, 7 aa, Plasmodium falciparum
ETMNSNA

SEQ ID NO: 3311448 - protein, 16 aa, Plasmodium falciparum
ETNDETNNEEEGRNVE

SEQ ID NO: 3311449 - protein, 10 aa, Plasmodium falciparum
ETNDHNENRK

SEQ ID NO: 3311450 - protein, 5 aa, Plasmodium falciparum
ETNDK

SEQ ID NO: 3311451 - protein, 17 aa, Plasmodium falciparum
ETNDKVKSFKKKKNKKI

SEQ ID NO: 3311452 - protein, 28 aa, Plasmodium falciparum
ETNDNIDTSNINNNNNNNNNNDNSQENN

SEQ ID NO: 3311453 - protein, 7 aa, Plasmodium falciparum
ETNDTNI

SEQ ID NO: 3311454 - protein, 8 aa, Plasmodium falciparum
ETNEDDPE

SEQ ID NO: 3311455 - protein, 6 aa, Plasmodium falciparum
ETNEFK

SEQ ID NO: 3311456 - protein, 5 aa, Plasmodium falciparum
ETNEK

SEQ ID NO: 3311457 - protein, 5 aa, Plasmodium falciparum
ETNEL

SEQ ID NO: 3311458 - protein, 5 aa, Plasmodium falciparum
ETNEN

SEQ ID NO: 3311459 - protein, 7 aa, Plasmodium falciparum
ETNGNTL

SEQ ID NO: 3311460 - protein, 4 aa, Plasmodium falciparum
ETNI

SEQ ID NO: 3311461 - protein, 12 aa, Plasmodium falciparum
ETNIENKKSIRK

SEQ ID NO: 3311462 - protein, 33 aa, Plasmodium falciparum
ETNILSSDGEQESDISKNCDTQDPKHNRNNDYT

SEQ ID NO: 3311463 - protein, 10 aa, Plasmodium falciparum
ETNKEGNKQI

SEQ ID NO: 3311464 - protein, 9 aa, Plasmodium falciparum
ETNKEKEQI

SEQ ID NO: 3311465 - protein, 9 aa, Plasmodium falciparum
ETNKENEEL

SEQ ID NO: 3311466 - protein, 8 aa, Plasmodium falciparum
ETNKKHEY

SEQ ID NO: 3311467 - protein, 5 aa, Plasmodium falciparum
ETNKL

SEQ ID NO: 3311468 - protein, 20 aa, Plasmodium falciparum
ETNKPKSKSYNYNSNNNSSH

SEQ ID NO: 3311469 - protein, 21 aa, Plasmodium falciparum
ETNNEKRTNKKIYKKSKAQSL

SEQ ID NO: 3311470 - protein, 12 aa, Plasmodium falciparum
ETNPLTSNTGTI

SEQ ID NO: 3311471 - protein, 18 aa, Plasmodium falciparum
ETNQDNNATFSASQNVKN

SEQ ID NO: 3311472 - protein, 6 aa, Plasmodium falciparum
ETNQLN

SEQ ID NO: 3311473 - protein, 13 aa, Plasmodium falciparum
ETNRNDDVNNGEH

SEQ ID NO: 3311474 - protein, 7 aa, Plasmodium falciparum
ETNSKTL

SEQ ID NO: 3311475 - protein, 7 aa, Plasmodium falciparum
ETNSNPY

SEQ ID NO: 3311476 - protein, 6 aa, Plasmodium falciparum
ETNSNQ

SEQ ID NO: 3311477 - protein, 12 aa, Plasmodium falciparum
ETNTIPTSNTDV

SEQ ID NO: 3311478 - protein, 5 aa, Plasmodium falciparum
ETNTN

SEQ ID NO: 3311479 - protein, 40 aa, Plasmodium falciparum
ETNTNLSSDVSEDDSSNTDSEDDSSNTDSEDSGKDNFDEN

SEQ ID NO: 3311480 - protein, 22 aa, Plasmodium falciparum
ETNTSNNNHNNNNNNDDTSSCS

SEQ ID NO: 3311481 - protein, 10 aa, Plasmodium falciparum
ETNTTVNDNL

SEQ ID NO: 3311482 - protein, 12 aa, Plasmodium falciparum
ETPALKNHQENS

SEQ ID NO: 3311483 - protein, 4 aa, Plasmodium falciparum
ETPE

SEQ ID NO: 3311484 - protein, 11 aa, Plasmodium falciparum
ETPEDAPTGQM

SEQ ID NO: 3311485 - protein, 6 aa, Plasmodium falciparum
ETPIKS

SEQ ID NO: 3311486 - protein, 8 aa, Plasmodium falciparum
ETPNAIGT

SEQ ID NO: 3311487 - protein, 7 aa, Plasmodium falciparum
ETPNISS

SEQ ID NO: 3311488 - protein, 7 aa, Plasmodium falciparum
ETPNKKN

SEQ ID NO: 3311489 - protein, 9 aa, Plasmodium falciparum
ETPNSSNDF

SEQ ID NO: 3311490 - protein, 10 aa, Plasmodium falciparum
ETPPDKASKL

SEQ ID NO: 3311491 - protein, 18 aa, Plasmodium falciparum
ETPVKQMNTNKNKTPTNI

SEQ ID NO: 3311492 - protein, 7 aa, Plasmodium falciparum
ETQEING

SEQ ID NO: 3311493 - protein, 9 aa, Plasmodium falciparum
ETQEQENVT

SEQ ID NO: 3311494 - protein, 18 aa, Plasmodium falciparum
ETQNGEIAKKNKMRKGSF

SEQ ID NO: 3311495 - protein, 8 aa, Plasmodium falciparum
ETRGDGSI

SEQ ID NO: 3311496 - protein, 6 aa, Plasmodium falciparum
ETRGEK

SEQ ID NO: 3311497 - protein, 5 aa, Plasmodium falciparum
ETRKK

SEQ ID NO: 3311498 - protein, 18 aa, Plasmodium falciparum
ETRKKEKIYPRDNNINST

SEQ ID NO: 3311499 - protein, 5 aa, Plasmodium falciparum
ETRNY

SEQ ID NO: 3311500 - protein, 80 aa, Plasmodium falciparum
ETRSDYNESHDETNENNEKEEINREEGNEEEKRSKRKKTNDYDDNKDVYNNASGSNSNHSNHSNNNNNNKGNEKNERKED

SEQ ID NO: 3311501 - protein, 6 aa, Plasmodium falciparum
ETSDKN

SEQ ID NO: 3311502 - protein, 5 aa, Plasmodium falciparum
ETSDT

SEQ ID NO: 3311503 - protein, 10 aa, Plasmodium falciparum
ETSEKGNNNE

SEQ ID NO: 3311504 - protein, 5 aa, Plasmodium falciparum
ETSID

SEQ ID NO: 3311505 - protein, 11 aa, Plasmodium falciparum
ETSKEITINEE

SEQ ID NO: 3311506 - protein, 11 aa, Plasmodium falciparum
ETSKEKNNSGL

SEQ ID NO: 3311507 - protein, 12 aa, Plasmodium falciparum
ETSKENYNQTQI

SEQ ID NO: 3311508 - protein, 10 aa, Plasmodium falciparum
ETSKFDDNKE

SEQ ID NO: 3311509 - protein, 13 aa, Plasmodium falciparum
ETSNNKRNIMEKN

SEQ ID NO: 3311510 - protein, 10 aa, Plasmodium falciparum
ETSNQDTEDC

SEQ ID NO: 3311511 - protein, 5 aa, Plasmodium falciparum
ETSNV

SEQ ID NO: 3311512 - protein, 4 aa, Plasmodium falciparum
ETSP

SEQ ID NO: 3311513 - protein, 7 aa, Plasmodium falciparum
ETSPGLS

SEQ ID NO: 3311514 - protein, 18 aa, Plasmodium falciparum
ETSPLERHNKDKDTITSS

SEQ ID NO: 3311515 - protein, 12 aa, Plasmodium falciparum
ETSQEEKKNMSN

SEQ ID NO: 3311516 - protein, 6 aa, Plasmodium falciparum
ETSSNF

SEQ ID NO: 3311517 - protein, 17 aa, Plasmodium falciparum
ETSSSDKRGVVIDLNIG

SEQ ID NO: 3311518 - protein, 6 aa, Plasmodium falciparum
ETSSST

SEQ ID NO: 3311519 - protein, 4 aa, Plasmodium falciparum
ETST

SEQ ID NO: 3311520 - protein, 10 aa, Plasmodium falciparum
ETSTSNGGKF

SEQ ID NO: 3311521 - protein, 5 aa, Plasmodium falciparum
ETSYN

SEQ ID NO: 3311522 - protein, 5 aa, Plasmodium falciparum
ETTAT

SEQ ID NO: 3311523 - protein, 5 aa, Plasmodium falciparum
ETTEE

SEQ ID NO: 3311524 - protein, 7 aa, Plasmodium falciparum
ETTEEIQ

SEQ ID NO: 3311525 - protein, 6 aa, Plasmodium falciparum
ETTESF

SEQ ID NO: 3311526 - protein, 13 aa, Plasmodium falciparum
ETTHNSNNYDGQI

SEQ ID NO: 3311527 - protein, 10 aa, Plasmodium falciparum
ETTKGDNKQH

SEQ ID NO: 3311528 - protein, 10 aa, Plasmodium falciparum
ETTKNETHKE

SEQ ID NO: 3311529 - protein, 6 aa, Plasmodium falciparum
ETTNKQ

SEQ ID NO: 3311530 - protein, 10 aa, Plasmodium falciparum
ETTNNKNHIE

SEQ ID NO: 3311531 - protein, 14 aa, Plasmodium falciparum
ETTQDNFTSITFNF

SEQ ID NO: 3311532 - protein, 16 aa, Plasmodium falciparum
ETTSGEKFGRCSSTSN

SEQ ID NO: 3311533 - protein, 18 aa, Plasmodium falciparum
ETTSKQNTTTEKNKKIND

SEQ ID NO: 3311534 - protein, 7 aa, Plasmodium falciparum
ETTSTMK

SEQ ID NO: 3311535 - protein, 5 aa, Plasmodium falciparum
ETTVQ

SEQ ID NO: 3311536 - protein, 16 aa, Plasmodium falciparum
ETTYQEDNKKVDDNNI

SEQ ID NO: 3311537 - protein, 16 aa, Plasmodium falciparum
ETVAPETEHLNTSTNN

SEQ ID NO: 3311538 - protein, 5 aa, Plasmodium falciparum
ETVDN

SEQ ID NO: 3311539 - protein, 26 aa, Plasmodium falciparum
ETVENIPNNNDNNNDSSSNNKEEECL

SEQ ID NO: 3311540 - protein, 11 aa, Plasmodium falciparum
ETVEPKEPVEE

SEQ ID NO: 3311541 - protein, 21 aa, Plasmodium falciparum
ETVHNNNNIEDESIKENKNEL

SEQ ID NO: 3311542 - protein, 11 aa, Plasmodium falciparum
ETVSTDYDESD

SEQ ID NO: 3311543 - protein, 13 aa, Plasmodium falciparum
ETYAGEKTTIKKK

SEQ ID NO: 3311544 - protein, 27 aa, Plasmodium falciparum
ETYDEKGDNEKEQRNLERADSEKKNIV

SEQ ID NO: 3311545 - protein, 6 aa, Plasmodium falciparum
ETYDET

SEQ ID NO: 3311546 - protein, 13 aa, Plasmodium falciparum
ETYDGVDSSTDDM

SEQ ID NO: 3311547 - protein, 49 aa, Plasmodium falciparum
ETYEDNESEYNAEQNEVYTEQQTSSSNVEPEKEKENEHEHENDNNVYSK

SEQ ID NO: 3311548 - protein, 26 aa, Plasmodium falciparum
ETYEEDQRIKKKNSLENKIENGEEQK

SEQ ID NO: 3311549 - protein, 6 aa, Plasmodium falciparum
ETYEEN

SEQ ID NO: 3311550 - protein, 5 aa, Plasmodium falciparum
ETYEH

SEQ ID NO: 3311551 - protein, 28 aa, Plasmodium falciparum
ETYGSKNNEVSPNKKKMKVNEKKDVSKE

SEQ ID NO: 3311552 - protein, 10 aa, Plasmodium falciparum
ETYKNNHEEK

SEQ ID NO: 3311553 - protein, 11 aa, Plasmodium falciparum
ETYSENPNDDN

SEQ ID NO: 3311554 - protein, 4 aa, Plasmodium falciparum
EVAE

SEQ ID NO: 3311555 - protein, 6 aa, Plasmodium falciparum
EVAENN

SEQ ID NO: 3311556 - protein, 7 aa, Plasmodium falciparum
EVDDEDK

SEQ ID NO: 3311557 - protein, 14 aa, Plasmodium falciparum
EVDDTQKSDKNHSN

SEQ ID NO: 3311558 - protein, 4 aa, Plasmodium falciparum
EVDE

SEQ ID NO: 3311559 - protein, 49 aa, Plasmodium falciparum
EVDEEENDGYDDEEDGNENFDDEEDRPRINNNNNNDISNNNNNDDEYTN

SEQ ID NO: 3311560 - protein, 5 aa, Plasmodium falciparum
EVDIS

SEQ ID NO: 3311561 - protein, 6 aa, Plasmodium falciparum
EVDNNN

SEQ ID NO: 3311562 - protein, 50 aa, Plasmodium falciparum
EVDNNNNNNNSNSSSSSSSSSSSSSSSSSSSSSSSSSSSSSSSSNRSSNF

SEQ ID NO: 3311563 - protein, 8 aa, Plasmodium falciparum
EVDNSSLQ

SEQ ID NO: 3311564 - protein, 5 aa, Plasmodium falciparum
EVDYE

SEQ ID NO: 3311565 - protein, 11 aa, Plasmodium falciparum
EVEDDEETGVH

SEQ ID NO: 3311566 - protein, 9 aa, Plasmodium falciparum
EVEDKEEIP

SEQ ID NO: 3311567 - protein, 8 aa, Plasmodium falciparum
EVEEDHKN

SEQ ID NO: 3311568 - protein, 5 aa, Plasmodium falciparum
EVEEQ

SEQ ID NO: 3311569 - protein, 9 aa, Plasmodium falciparum
EVEKNNSKV

SEQ ID NO: 3311570 - protein, 7 aa, Plasmodium falciparum
EVEKTNR

SEQ ID NO: 3311571 - protein, 16 aa, Plasmodium falciparum
EVELPSNQRARRKTAE

SEQ ID NO: 3311572 - protein, 12 aa, Plasmodium falciparum
EVENTEDEGQEL

SEQ ID NO: 3311573 - protein, 36 aa, Plasmodium falciparum
EVEQKEKKNNNNKKIKKIKNKKKNKKKKNKKINKKI

SEQ ID NO: 3311574 - protein, 9 aa, Plasmodium falciparum
EVEQNKSNM

SEQ ID NO: 3311575 - protein, 6 aa, Plasmodium falciparum
EVGNYS

SEQ ID NO: 3311576 - protein, 5 aa, Plasmodium falciparum
EVGTK

SEQ ID NO: 3311577 - protein, 12 aa, Plasmodium falciparum
EVHHEQKEEKKV

SEQ ID NO: 3311578 - protein, 26 aa, Plasmodium falciparum
EVKEQGSKNNNNKNNNDNNNNNNNVD

SEQ ID NO: 3311579 - protein, 10 aa, Plasmodium falciparum
EVKGNDQNDL

SEQ ID NO: 3311580 - protein, 12 aa, Plasmodium falciparum
EVKKSKTSEYGC

SEQ ID NO: 3311581 - protein, 11 aa, Plasmodium falciparum
EVKNKSDENWD

SEQ ID NO: 3311582 - protein, 10 aa, Plasmodium falciparum
EVKTKYDKTH

SEQ ID NO: 3311583 - protein, 7 aa, Plasmodium falciparum
EVLTDNG

SEQ ID NO: 3311584 - protein, 12 aa, Plasmodium falciparum
EVNDEEIKTREN

SEQ ID NO: 3311585 - protein, 14 aa, Plasmodium falciparum
EVNDIRNANDTFNK

SEQ ID NO: 3311586 - protein, 8 aa, Plasmodium falciparum
EVNEASAG

SEQ ID NO: 3311587 - protein, 11 aa, Plasmodium falciparum
EVNENGEAKKT

SEQ ID NO: 3311588 - protein, 8 aa, Plasmodium falciparum
EVNKKNEK

SEQ ID NO: 3311589 - protein, 15 aa, Plasmodium falciparum
EVNKKQTKKPTKNVS

SEQ ID NO: 3311590 - protein, 18 aa, Plasmodium falciparum
EVNQNYTNSINNNDQNNV

SEQ ID NO: 3311591 - protein, 9 aa, Plasmodium falciparum
EVNSGSPEL

SEQ ID NO: 3311592 - protein, 6 aa, Plasmodium falciparum
EVNSTC

SEQ ID NO: 3311593 - protein, 23 aa, Plasmodium falciparum
EVNTNVTSNVKENKPSKNNTDTN

SEQ ID NO: 3311594 - protein, 4 aa, Plasmodium falciparum
EVPP

SEQ ID NO: 3311595 - protein, 9 aa, Plasmodium falciparum
EVPTNNEIQ

SEQ ID NO: 3311596 - protein, 11 aa, Plasmodium falciparum
EVQDDSDEDIL

SEQ ID NO: 3311597 - protein, 5 aa, Plasmodium falciparum
EVQNI

SEQ ID NO: 3311598 - protein, 5 aa, Plasmodium falciparum
EVQNK

SEQ ID NO: 3311599 - protein, 18 aa, Plasmodium falciparum
EVQSKDSHDNQNEHEQNY

SEQ ID NO: 3311600 - protein, 13 aa, Plasmodium falciparum
EVQSTDISDTNDI

SEQ ID NO: 3311601 - protein, 4 aa, Plasmodium falciparum
EVRS

SEQ ID NO: 3311602 - protein, 11 aa, Plasmodium falciparum
EVSAEEGAQFA

SEQ ID NO: 3311603 - protein, 14 aa, Plasmodium falciparum
EVSDKKKNFNTTDK

SEQ ID NO: 3311604 - protein, 4 aa, Plasmodium falciparum
EVSE

SEQ ID NO: 3311605 - protein, 16 aa, Plasmodium falciparum
EVSKNKDEWDSTLNGD

SEQ ID NO: 3311606 - protein, 6 aa, Plasmodium falciparum
EVSQKK

SEQ ID NO: 3311607 - protein, 7 aa, Plasmodium falciparum
EVTDSLG

SEQ ID NO: 3311608 - protein, 5 aa, Plasmodium falciparum
EVTED

SEQ ID NO: 3311609 - protein, 8 aa, Plasmodium falciparum
EVTGSSYE

SEQ ID NO: 3311610 - protein, 29 aa, Plasmodium falciparum
EVTHKNSNCNIENDHSNNNINEKNSLNHK

SEQ ID NO: 3311611 - protein, 10 aa, Plasmodium falciparum
EVTNVNKNES

SEQ ID NO: 3311612 - protein, 4 aa, Plasmodium falciparum
EVTS

SEQ ID NO: 3311613 - protein, 5 aa, Plasmodium falciparum
EVYDN

SEQ ID NO: 3311614 - protein, 5 aa, Plasmodium falciparum
EVYNT

SEQ ID NO: 3311615 - protein, 13 aa, Plasmodium falciparum
EWEDKNISSCSSS

SEQ ID NO: 3311616 - protein, 5 aa, Plasmodium falciparum
EWNND

SEQ ID NO: 3311617 - protein, 88 aa, Plasmodium falciparum
EWNNSSENENSDNNNNDREDNIKEKVDNNNKNDDNNNNDREDNIKEKVDNNNNNDDNNNDNNNNNKSDNNNNKSDNNNNKSDNYNNKI

SEQ ID NO: 3311618 - protein, 7 aa, Plasmodium falciparum
EWNPKDN

SEQ ID NO: 3311619 - protein, 15 aa, Plasmodium falciparum
EWRKKTHKDTAKGLN

SEQ ID NO: 3311620 - protein, 6 aa, Plasmodium falciparum
EWTTEH

SEQ ID NO: 3311621 - protein, 5 aa, Plasmodium falciparum
EYAEK

SEQ ID NO: 3311622 - protein, 11 aa, Plasmodium falciparum
EYATDNKNPLK

SEQ ID NO: 3311623 - protein, 11 aa, Plasmodium falciparum
EYDDTNDNIND

SEQ ID NO: 3311624 - protein, 9 aa, Plasmodium falciparum
EYDEESNKL

SEQ ID NO: 3311625 - protein, 9 aa, Plasmodium falciparum
EYDEKKVPK

SEQ ID NO: 3311626 - protein, 5 aa, Plasmodium falciparum
EYDEL

SEQ ID NO: 3311627 - protein, 5 aa, Plasmodium falciparum
EYDEN

SEQ ID NO: 3311628 - protein, 14 aa, Plasmodium falciparum
EYDESGPSIVHRKC

SEQ ID NO: 3311629 - protein, 12 aa, Plasmodium falciparum
EYDGNRNKSMTS

SEQ ID NO: 3311630 - protein, 5 aa, Plasmodium falciparum
EYDGS

SEQ ID NO: 3311631 - protein, 4 aa, Plasmodium falciparum
EYDK

SEQ ID NO: 3311632 - protein, 10 aa, Plasmodium falciparum
EYDKNDGNIL

SEQ ID NO: 3311633 - protein, 8 aa, Plasmodium falciparum
EYDKPNVT

SEQ ID NO: 3311634 - protein, 4 aa, Plasmodium falciparum
EYDL

SEQ ID NO: 3311635 - protein, 4 aa, Plasmodium falciparum
EYDN

SEQ ID NO: 3311636 - protein, 5 aa, Plasmodium falciparum
EYDNY

SEQ ID NO: 3311637 - protein, 10 aa, Plasmodium falciparum
EYDTSNKNYE

SEQ ID NO: 3311638 - protein, 11 aa, Plasmodium falciparum
EYDYTGNINDQ

SEQ ID NO: 3311639 - protein, 11 aa, Plasmodium falciparum
EYEDDEMNPNI

SEQ ID NO: 3311640 - protein, 14 aa, Plasmodium falciparum
EYEDSGPSIVHRKC

SEQ ID NO: 3311641 - protein, 4 aa, Plasmodium falciparum
EYEE

SEQ ID NO: 3311642 - protein, 17 aa, Plasmodium falciparum
EYEEDKSKIINEKEKTI

SEQ ID NO: 3311643 - protein, 8 aa, Plasmodium falciparum
EYEEENKN

SEQ ID NO: 3311644 - protein, 5 aa, Plasmodium falciparum
EYEEI

SEQ ID NO: 3311645 - protein, 7 aa, Plasmodium falciparum
EYEETYK

SEQ ID NO: 3311646 - protein, 9 aa, Plasmodium falciparum
EYEGANNKR

SEQ ID NO: 3311647 - protein, 4 aa, Plasmodium falciparum
EYEK

SEQ ID NO: 3311648 - protein, 7 aa, Plasmodium falciparum
EYEKGSK

SEQ ID NO: 3311649 - protein, 5 aa, Plasmodium falciparum
EYEKQ

SEQ ID NO: 3311650 - protein, 4 aa, Plasmodium falciparum
EYEN

SEQ ID NO: 3311651 - protein, 10 aa, Plasmodium falciparum
EYENDKKYEH

SEQ ID NO: 3311652 - protein, 6 aa, Plasmodium falciparum
EYENPA

SEQ ID NO: 3311653 - protein, 4 aa, Plasmodium falciparum
EYEP

SEQ ID NO: 3311654 - protein, 6 aa, Plasmodium falciparum
EYERKR

SEQ ID NO: 3311655 - protein, 22 aa, Plasmodium falciparum
EYESESSKHNIPRKSLSKKHSI

SEQ ID NO: 3311656 - protein, 7 aa, Plasmodium falciparum
EYESGRQ

SEQ ID NO: 3311657 - protein, 13 aa, Plasmodium falciparum
EYESPLNSEQEKT

SEQ ID NO: 3311658 - protein, 13 aa, Plasmodium falciparum
EYFSGSENINSQS

SEQ ID NO: 3311659 - protein, 17 aa, Plasmodium falciparum
EYGEEGLENGEQPADAT

SEQ ID NO: 3311660 - protein, 5 aa, Plasmodium falciparum
EYGEN

SEQ ID NO: 3311661 - protein, 5 aa, Plasmodium falciparum
EYGER

SEQ ID NO: 3311662 - protein, 11 aa, Plasmodium falciparum
EYGKDQPLKNA

SEQ ID NO: 3311663 - protein, 15 aa, Plasmodium falciparum
EYGKEDQNEDDDNIR

SEQ ID NO: 3311664 - protein, 25 aa, Plasmodium falciparum
EYGKKRRAHTNRINTEQQKKRDSNK

SEQ ID NO: 3311665 - protein, 14 aa, Plasmodium falciparum
EYGMPTKPSPNRYV

SEQ ID NO: 3311666 - protein, 14 aa, Plasmodium falciparum
EYHESGHNIILDRC

SEQ ID NO: 3311667 - protein, 4 aa, Plasmodium falciparum
EYIE

SEQ ID NO: 3311668 - protein, 12 aa, Plasmodium falciparum
EYIKEKKKKKYK

SEQ ID NO: 3311669 - protein, 9 aa, Plasmodium falciparum
EYKDDEHQI

SEQ ID NO: 3311670 - protein, 8 aa, Plasmodium falciparum
EYKEATKE

SEQ ID NO: 3311671 - protein, 10 aa, Plasmodium falciparum
EYKEEKKKIS

SEQ ID NO: 3311672 - protein, 40 aa, Plasmodium falciparum
EYKENKKEQKEQKKEDQEEEKEEEKGEEEEKEEKEKETYS

SEQ ID NO: 3311673 - protein, 15 aa, Plasmodium falciparum
EYKEQQKNLQTKETN

SEQ ID NO: 3311674 - protein, 8 aa, Plasmodium falciparum
EYKGQEAN

SEQ ID NO: 3311675 - protein, 9 aa, Plasmodium falciparum
EYKGSAKNK

SEQ ID NO: 3311676 - protein, 4 aa, Plasmodium falciparum
EYKK

SEQ ID NO: 3311677 - protein, 17 aa, Plasmodium falciparum
EYKKDEGKQPNCEMPGN

SEQ ID NO: 3311678 - protein, 11 aa, Plasmodium falciparum
EYKKERNDTEM

SEQ ID NO: 3311679 - protein, 13 aa, Plasmodium falciparum
EYKKKQPSYKRDR

SEQ ID NO: 3311680 - protein, 7 aa, Plasmodium falciparum
EYKKKSN

SEQ ID NO: 3311681 - protein, 21 aa, Plasmodium falciparum
EYKKQKDIPTNHSNNNNNNNN

SEQ ID NO: 3311682 - protein, 5 aa, Plasmodium falciparum
EYKKY

SEQ ID NO: 3311683 - protein, 11 aa, Plasmodium falciparum
EYKKYGSNNKM

SEQ ID NO: 3311684 - protein, 5 aa, Plasmodium falciparum
EYKLP

SEQ ID NO: 3311685 - protein, 5 aa, Plasmodium falciparum
EYKND

SEQ ID NO: 3311686 - protein, 11 aa, Plasmodium falciparum
EYKNNKGTSNY

SEQ ID NO: 3311687 - protein, 7 aa, Plasmodium falciparum
EYKNTPI

SEQ ID NO: 3311688 - protein, 10 aa, Plasmodium falciparum
EYKPTKQKKK

SEQ ID NO: 3311689 - protein, 17 aa, Plasmodium falciparum
EYKQNVNNNISNDNNSF

SEQ ID NO: 3311690 - protein, 8 aa, Plasmodium falciparum
EYKQSGEN

SEQ ID NO: 3311691 - protein, 10 aa, Plasmodium falciparum
EYKQTNNQNF

SEQ ID NO: 3311692 - protein, 10 aa, Plasmodium falciparum
EYKRSPMKGK

SEQ ID NO: 3311693 - protein, 7 aa, Plasmodium falciparum
EYKTTKD

SEQ ID NO: 3311694 - protein, 6 aa, Plasmodium falciparum
EYKYND

SEQ ID NO: 3311695 - protein, 6 aa, Plasmodium falciparum
EYKYNG

SEQ ID NO: 3311696 - protein, 28 aa, Plasmodium falciparum
EYLKKKGDEGVSKEECENMSSEGRRNYS

SEQ ID NO: 3311697 - protein, 5 aa, Plasmodium falciparum
EYLKR

SEQ ID NO: 3311698 - protein, 11 aa, Plasmodium falciparum
EYNAYKDKNTL

SEQ ID NO: 3311699 - protein, 12 aa, Plasmodium falciparum
EYNDKPKVKQLE

SEQ ID NO: 3311700 - protein, 22 aa, Plasmodium falciparum
EYNDNHSDEDNNNNNNNNFSYN

SEQ ID NO: 3311701 - protein, 4 aa, Plasmodium falciparum
EYNE

SEQ ID NO: 3311702 - protein, 6 aa, Plasmodium falciparum
EYNEES

SEQ ID NO: 3311703 - protein, 5 aa, Plasmodium falciparum
EYNEK

SEQ ID NO: 3311704 - protein, 16 aa, Plasmodium falciparum
EYNEKIKKNKKQDYSN

SEQ ID NO: 3311705 - protein, 11 aa, Plasmodium falciparum
EYNEKNLTAQD

SEQ ID NO: 3311706 - protein, 5 aa, Plasmodium falciparum
EYNEN

SEQ ID NO: 3311707 - protein, 15 aa, Plasmodium falciparum
EYNENENNDIKGNKN

SEQ ID NO: 3311708 - protein, 10 aa, Plasmodium falciparum
EYNEQLDAGG

SEQ ID NO: 3311709 - protein, 12 aa, Plasmodium falciparum
EYNESSSKGHLK

SEQ ID NO: 3311710 - protein, 10 aa, Plasmodium falciparum
EYNIEDNENN

SEQ ID NO: 3311711 - protein, 19 aa, Plasmodium falciparum
EYNKETKVITESNNELENK

SEQ ID NO: 3311712 - protein, 8 aa, Plasmodium falciparum
EYNKKRGK

SEQ ID NO: 3311713 - protein, 67 aa, Plasmodium falciparum
EYNKNDAGDYNDDHENDDENDNEDDEEDDDEEDDEDDDEDDDEDDDEDDDEDDPASDDDYMNEGNNE

SEQ ID NO: 3311714 - protein, 9 aa, Plasmodium falciparum
EYNKNENNI

SEQ ID NO: 3311715 - protein, 29 aa, Plasmodium falciparum
EYNKNVDKNEKESRYEKQYEDKNEDEEKL

SEQ ID NO: 3311716 - protein, 8 aa, Plasmodium falciparum
EYNNNNNM

SEQ ID NO: 3311717 - protein, 5 aa, Plasmodium falciparum
EYNNS

SEQ ID NO: 3311718 - protein, 11 aa, Plasmodium falciparum
EYNNSNNNKTY

SEQ ID NO: 3311719 - protein, 13 aa, Plasmodium falciparum
EYNNSSNKKTSKN

SEQ ID NO: 3311720 - protein, 6 aa, Plasmodium falciparum
EYNQNN

SEQ ID NO: 3311721 - protein, 6 aa, Plasmodium falciparum
EYNTKN

SEQ ID NO: 3311722 - protein, 12 aa, Plasmodium falciparum
EYNTSEKNNDMN

SEQ ID NO: 3311723 - protein, 5 aa, Plasmodium falciparum
EYNYD

SEQ ID NO: 3311724 - protein, 7 aa, Plasmodium falciparum
EYNYDGQ

SEQ ID NO: 3311725 - protein, 6 aa, Plasmodium falciparum
EYPDDA

SEQ ID NO: 3311726 - protein, 5 aa, Plasmodium falciparum
EYPDP

SEQ ID NO: 3311727 - protein, 8 aa, Plasmodium falciparum
EYPKSGIK

SEQ ID NO: 3311728 - protein, 5 aa, Plasmodium falciparum
EYPKT

SEQ ID NO: 3311729 - protein, 5 aa, Plasmodium falciparum
EYPNL

SEQ ID NO: 3311730 - protein, 13 aa, Plasmodium falciparum
EYPSRKKRKNKKK

SEQ ID NO: 3311731 - protein, 17 aa, Plasmodium falciparum
EYQQNDDQNRGSHNKNT

SEQ ID NO: 3311732 - protein, 4 aa, Plasmodium falciparum
EYQS

SEQ ID NO: 3311733 - protein, 12 aa, Plasmodium falciparum
EYRDQDEYQDEY

SEQ ID NO: 3311734 - protein, 10 aa, Plasmodium falciparum
EYRETGQTKI

SEQ ID NO: 3311735 - protein, 5 aa, Plasmodium falciparum
EYRKN

SEQ ID NO: 3311736 - protein, 6 aa, Plasmodium falciparum
EYSAQE

SEQ ID NO: 3311737 - protein, 4 aa, Plasmodium falciparum
EYSK

SEQ ID NO: 3311738 - protein, 5 aa, Plasmodium falciparum
EYSKQ

SEQ ID NO: 3311739 - protein, 4 aa, Plasmodium falciparum
EYSL

SEQ ID NO: 3311740 - protein, 15 aa, Plasmodium falciparum
EYSNYNLSDKGKIKP

SEQ ID NO: 3311741 - protein, 6 aa, Plasmodium falciparum
EYSPSI

SEQ ID NO: 3311742 - protein, 4 aa, Plasmodium falciparum
EYSR

SEQ ID NO: 3311743 - protein, 6 aa, Plasmodium falciparum
EYSRTP

SEQ ID NO: 3311744 - protein, 26 aa, Plasmodium falciparum
EYSSDENIDDNGDVYENNDNGDGNSN

SEQ ID NO: 3311745 - protein, 6 aa, Plasmodium falciparum
EYSSDN

SEQ ID NO: 3311746 - protein, 10 aa, Plasmodium falciparum
EYSSKTNNNM

SEQ ID NO: 3311747 - protein, 8 aa, Plasmodium falciparum
EYSSSSKE

SEQ ID NO: 3311748 - protein, 19 aa, Plasmodium falciparum
EYSTEDSSDESSNESNDLS

SEQ ID NO: 3311749 - protein, 11 aa, Plasmodium falciparum
EYSTNDDKKFP

SEQ ID NO: 3311750 - protein, 5 aa, Plasmodium falciparum
EYTED

SEQ ID NO: 3311751 - protein, 15 aa, Plasmodium falciparum
EYTEESNITNLSESQ

SEQ ID NO: 3311752 - protein, 4 aa, Plasmodium falciparum
EYTF

SEQ ID NO: 3311753 - protein, 8 aa, Plasmodium falciparum
EYTKDDTN

SEQ ID NO: 3311754 - protein, 8 aa, Plasmodium falciparum
EYTNKNPK

SEQ ID NO: 3311755 - protein, 5 aa, Plasmodium falciparum
EYTNS

SEQ ID NO: 3311756 - protein, 5 aa, Plasmodium falciparum
EYVTD

SEQ ID NO: 3311757 - protein, 12 aa, Plasmodium falciparum
EYYDSDTSSISF

SEQ ID NO: 3311758 - protein, 4 aa, Plasmodium falciparum
EYYN

SEQ ID NO: 3311759 - protein, 22 aa, Plasmodium falciparum
EYYNKNNIKSNTHFNDEQQMNN

SEQ ID NO: 3311760 - protein, 14 aa, Plasmodium falciparum
EYYSNNKPNHLNSK

SEQ ID NO: 3311761 - protein, 5 aa, Plasmodium falciparum
FAGED

SEQ ID NO: 3311762 - protein, 9 aa, Plasmodium falciparum
FAGTGSPKI

SEQ ID NO: 3311763 - protein, 10 aa, Plasmodium falciparum
FAKSKKNSSD

SEQ ID NO: 3311764 - protein, 8 aa, Plasmodium falciparum
FANENSRT

SEQ ID NO: 3311765 - protein, 9 aa, Plasmodium falciparum
FAPKATKIS

SEQ ID NO: 3311766 - protein, 12 aa, Plasmodium falciparum
FAQDDDKNIEDV

SEQ ID NO: 3311767 - protein, 8 aa, Plasmodium falciparum
FAQENKVP

SEQ ID NO: 3311768 - protein, 11 aa, Plasmodium falciparum
FAQNKENEKYD

SEQ ID NO: 3311769 - protein, 11 aa, Plasmodium falciparum
FARSKDYDAMD

SEQ ID NO: 3311770 - protein, 12 aa, Plasmodium falciparum
FASSYNSQNSDV

SEQ ID NO: 3311771 - protein, 13 aa, Plasmodium falciparum
FATEEEYETLENN

SEQ ID NO: 3311772 - protein, 10 aa, Plasmodium falciparum
FATTKGNSLS

SEQ ID NO: 3311773 - protein, 4 aa, Plasmodium falciparum
FCSD

SEQ ID NO: 3311774 - protein, 4 aa, Plasmodium falciparum
FDAP

SEQ ID NO: 3311775 - protein, 11 aa, Plasmodium falciparum
FDDENTTRQIG

SEQ ID NO: 3311776 - protein, 34 aa, Plasmodium falciparum
FDDMNNRNNSLNNNDMNNNNNNNNMNNSDNSKLS

SEQ ID NO: 3311777 - protein, 5 aa, Plasmodium falciparum
FDDND

SEQ ID NO: 3311778 - protein, 17 aa, Plasmodium falciparum
FDDPKNSHIEAENRTSL

SEQ ID NO: 3311779 - protein, 21 aa, Plasmodium falciparum
FDDRKDNLKNNNKSMNNTDDV

SEQ ID NO: 3311780 - protein, 9 aa, Plasmodium falciparum
FDDSSNDEF

SEQ ID NO: 3311781 - protein, 7 aa, Plasmodium falciparum
FDDTEGG

SEQ ID NO: 3311782 - protein, 6 aa, Plasmodium falciparum
FDDTKQ

SEQ ID NO: 3311783 - protein, 7 aa, Plasmodium falciparum
FDDTQKI

SEQ ID NO: 3311784 - protein, 110 aa, Plasmodium falciparum
FDEDNDENVDKNVDKNVDKNVDKNDDEDDGEDDGEDDGEDDGEHDGEDDGEDDSDEDKHENIPKNKADTLKEESDVSDNHHNNRKSKNIKNSIRSKSSNSKTKKEDDDNN

SEQ ID NO: 3311785 - protein, 9 aa, Plasmodium falciparum
FDEDNDQQY

SEQ ID NO: 3311786 - protein, 11 aa, Plasmodium falciparum
FDEDSSSSKYI

SEQ ID NO: 3311787 - protein, 21 aa, Plasmodium falciparum
FDEEEEDDDDDEEEDDEEKNL

SEQ ID NO: 3311788 - protein, 7 aa, Plasmodium falciparum
FDEGEPK

SEQ ID NO: 3311789 - protein, 11 aa, Plasmodium falciparum
FDEHKNNSFSD

SEQ ID NO: 3311790 - protein, 4 aa, Plasmodium falciparum
FDEK

SEQ ID NO: 3311791 - protein, 10 aa, Plasmodium falciparum
FDEKAKKRSL

SEQ ID NO: 3311792 - protein, 4 aa, Plasmodium falciparum
FDEN

SEQ ID NO: 3311793 - protein, 6 aa, Plasmodium falciparum
FDENNN

SEQ ID NO: 3311794 - protein, 7 aa, Plasmodium falciparum
FDESDSD

SEQ ID NO: 3311795 - protein, 5 aa, Plasmodium falciparum
FDESS

SEQ ID NO: 3311796 - protein, 5 aa, Plasmodium falciparum
FDESY

SEQ ID NO: 3311797 - protein, 4 aa, Plasmodium falciparum
FDGD

SEQ ID NO: 3311798 - protein, 29 aa, Plasmodium falciparum
FDGDNNKNNNDNKNNNNNNNNNNNNNGRH

SEQ ID NO: 3311799 - protein, 5 aa, Plasmodium falciparum
FDGSN

SEQ ID NO: 3311800 - protein, 6 aa, Plasmodium falciparum
FDGTKT

SEQ ID NO: 3311801 - protein, 7 aa, Plasmodium falciparum
FDGTTNE

SEQ ID NO: 3311802 - protein, 9 aa, Plasmodium falciparum
FDKDDESQM

SEQ ID NO: 3311803 - protein, 4 aa, Plasmodium falciparum
FDKK

SEQ ID NO: 3311804 - protein, 5 aa, Plasmodium falciparum
FDKNG

SEQ ID NO: 3311805 - protein, 41 aa, Plasmodium falciparum
FDKNSKTINVNEDKGEEYAEKEEFDPEDQYEEDEYDEEDDL

SEQ ID NO: 3311806 - protein, 8 aa, Plasmodium falciparum
FDKSESKN

SEQ ID NO: 3311807 - protein, 6 aa, Plasmodium falciparum
FDKSGS

SEQ ID NO: 3311808 - protein, 5 aa, Plasmodium falciparum
FDKST

SEQ ID NO: 3311809 - protein, 4 aa, Plasmodium falciparum
FDND

SEQ ID NO: 3311810 - protein, 15 aa, Plasmodium falciparum
FDNEDEKNNMEPNDC

SEQ ID NO: 3311811 - protein, 11 aa, Plasmodium falciparum
FDNENNISKEI

SEQ ID NO: 3311812 - protein, 10 aa, Plasmodium falciparum
FDNKNRKTNN

SEQ ID NO: 3311813 - protein, 8 aa, Plasmodium falciparum
FDNNANTK

SEQ ID NO: 3311814 - protein, 64 aa, Plasmodium falciparum
FDNNDNNDDNNDNNNDDNNDNNKNNNNDNNKNNNNNNNNNNNNNNNNNNNNNNNNNNDNNKQNI

SEQ ID NO: 3311815 - protein, 5 aa, Plasmodium falciparum
FDNNM

SEQ ID NO: 3311816 - protein, 15 aa, Plasmodium falciparum
FDNNNKKKTCDNNNK

SEQ ID NO: 3311817 - protein, 23 aa, Plasmodium falciparum
FDNNNKNNNNSNNSSNHMNSGVS

SEQ ID NO: 3311818 - protein, 5 aa, Plasmodium falciparum
FDNRG

SEQ ID NO: 3311819 - protein, 15 aa, Plasmodium falciparum
FDNSSNGESNRYSNA

SEQ ID NO: 3311820 - protein, 10 aa, Plasmodium falciparum
FDPDDDLKKE

SEQ ID NO: 3311821 - protein, 6 aa, Plasmodium falciparum
FDPDTD

SEQ ID NO: 3311822 - protein, 40 aa, Plasmodium falciparum
FDPKEKDKKKKNKKHKNYNKNNTHYEKSENNTTVNNTNKG

SEQ ID NO: 3311823 - protein, 6 aa, Plasmodium falciparum
FDPQGL

SEQ ID NO: 3311824 - protein, 4 aa, Plasmodium falciparum
FDQD

SEQ ID NO: 3311825 - protein, 9 aa, Plasmodium falciparum
FDQKGISTE

SEQ ID NO: 3311826 - protein, 7 aa, Plasmodium falciparum
FDQQQSD

SEQ ID NO: 3311827 - protein, 18 aa, Plasmodium falciparum
FDRGGKTTDGNSTEFNDK

SEQ ID NO: 3311828 - protein, 7 aa, Plasmodium falciparum
FDSDDDQ

SEQ ID NO: 3311829 - protein, 11 aa, Plasmodium falciparum
FDSEGSNKEDY

SEQ ID NO: 3311830 - protein, 5 aa, Plasmodium falciparum
FDSGG

SEQ ID NO: 3311831 - protein, 12 aa, Plasmodium falciparum
FDSKDSDDNYVR

SEQ ID NO: 3311832 - protein, 6 aa, Plasmodium falciparum
FDSNET

SEQ ID NO: 3311833 - protein, 26 aa, Plasmodium falciparum
FDSPAKDHHNNNPHQNNDENNNRHSN

SEQ ID NO: 3311834 - protein, 12 aa, Plasmodium falciparum
FDSPLKASDEFP

SEQ ID NO: 3311835 - protein, 15 aa, Plasmodium falciparum
FDSQTKETLTTKPVK

SEQ ID NO: 3311836 - protein, 5 aa, Plasmodium falciparum
FDSRG

SEQ ID NO: 3311837 - protein, 30 aa, Plasmodium falciparum
FDSTYEKKYDSAYEKKYDGAYEKKNDHRYA

SEQ ID NO: 3311838 - protein, 4 aa, Plasmodium falciparum
FDTE

SEQ ID NO: 3311839 - protein, 70 aa, Plasmodium falciparum
FDTNNSSSISNHNNNNNNTHNHNNNNNNNNNNNNNNNNNNNNNNNNNNNNNNNNNNNNNNNSSSSCSNRR

SEQ ID NO: 3311840 - protein, 9 aa, Plasmodium falciparum
FDYSGTQAI

SEQ ID NO: 3311841 - protein, 4 aa, Plasmodium falciparum
FDYT

SEQ ID NO: 3311842 - protein, 14 aa, Plasmodium falciparum
FEANKKKNNEMDET

SEQ ID NO: 3311843 - protein, 4 aa, Plasmodium falciparum
FEDE

SEQ ID NO: 3311844 - protein, 5 aa, Plasmodium falciparum
FEDNN

SEQ ID NO: 3311845 - protein, 19 aa, Plasmodium falciparum
FEDSESDDNDEEDEHRNSM

SEQ ID NO: 3311846 - protein, 4 aa, Plasmodium falciparum
FEEG

SEQ ID NO: 3311847 - protein, 7 aa, Plasmodium falciparum
FEEKRKK

SEQ ID NO: 3311848 - protein, 4 aa, Plasmodium falciparum
FEEN

SEQ ID NO: 3311849 - protein, 44 aa, Plasmodium falciparum
FEEPKKKFNNNNNNNNKNKSNNNNNNNNNNNNNNNNNNNLDNIK

SEQ ID NO: 3311850 - protein, 4 aa, Plasmodium falciparum
FEES

SEQ ID NO: 3311851 - protein, 20 aa, Plasmodium falciparum
FEGESNYRSEFGPKALPELP

SEQ ID NO: 3311852 - protein, 10 aa, Plasmodium falciparum
FEGESSYRTE

SEQ ID NO: 3311853 - protein, 12 aa, Plasmodium falciparum
FEGKNKKHIGEQ

SEQ ID NO: 3311854 - protein, 11 aa, Plasmodium falciparum
FEGSSSKEENF

SEQ ID NO: 3311855 - protein, 5 aa, Plasmodium falciparum
FEGTL

SEQ ID NO: 3311856 - protein, 10 aa, Plasmodium falciparum
FEKAKNKEKL

SEQ ID NO: 3311857 - protein, 11 aa, Plasmodium falciparum
FEKDNNERKNY

SEQ ID NO: 3311858 - protein, 12 aa, Plasmodium falciparum
FEKEQNQQRKDK

SEQ ID NO: 3311859 - protein, 10 aa, Plasmodium falciparum
FEKGKREGKN

SEQ ID NO: 3311860 - protein, 16 aa, Plasmodium falciparum
FEKGRKVSGPRALQPS

SEQ ID NO: 3311861 - protein, 10 aa, Plasmodium falciparum
FEKKNEENLC

SEQ ID NO: 3311862 - protein, 11 aa, Plasmodium falciparum
FEKNEKVQNDI

SEQ ID NO: 3311863 - protein, 10 aa, Plasmodium falciparum
FEKNESKESI

SEQ ID NO: 3311864 - protein, 17 aa, Plasmodium falciparum
FEKSSTNNSEINTNTET

SEQ ID NO: 3311865 - protein, 4 aa, Plasmodium falciparum
FEKT

SEQ ID NO: 3311866 - protein, 23 aa, Plasmodium falciparum
FEKTDTHNHNNNDTNDQNNHNLQ

SEQ ID NO: 3311867 - protein, 11 aa, Plasmodium falciparum
FENDDKRCNNK

SEQ ID NO: 3311868 - protein, 8 aa, Plasmodium falciparum
FENDKGNE

SEQ ID NO: 3311869 - protein, 6 aa, Plasmodium falciparum
FENDKK

SEQ ID NO: 3311870 - protein, 9 aa, Plasmodium falciparum
FENDTNDVL

SEQ ID NO: 3311871 - protein, 8 aa, Plasmodium falciparum
FENKADRN

SEQ ID NO: 3311872 - protein, 5 aa, Plasmodium falciparum
FENKD

SEQ ID NO: 3311873 - protein, 14 aa, Plasmodium falciparum
FENKRSSKKNKNNI

SEQ ID NO: 3311874 - protein, 10 aa, Plasmodium falciparum
FENKSYPNDI

SEQ ID NO: 3311875 - protein, 9 aa, Plasmodium falciparum
FENNEKKLY

SEQ ID NO: 3311876 - protein, 6 aa, Plasmodium falciparum
FENNHK

SEQ ID NO: 3311877 - protein, 8 aa, Plasmodium falciparum
FENNSDPT

SEQ ID NO: 3311878 - protein, 6 aa, Plasmodium falciparum
FENRTG

SEQ ID NO: 3311879 - protein, 11 aa, Plasmodium falciparum
FENSEESEESV

SEQ ID NO: 3311880 - protein, 6 aa, Plasmodium falciparum
FEPKSD

SEQ ID NO: 3311881 - protein, 6 aa, Plasmodium falciparum
FEPPKK

SEQ ID NO: 3311882 - protein, 16 aa, Plasmodium falciparum
FEPPPKPRFKGDKNGR

SEQ ID NO: 3311883 - protein, 6 aa, Plasmodium falciparum
FEPPQP

SEQ ID NO: 3311884 - protein, 7 aa, Plasmodium falciparum
FEQQKKE

SEQ ID NO: 3311885 - protein, 8 aa, Plasmodium falciparum
FERDKEKN

SEQ ID NO: 3311886 - protein, 21 aa, Plasmodium falciparum
FESCSSNKDHREVCSSDTSDS

SEQ ID NO: 3311887 - protein, 14 aa, Plasmodium falciparum
FESEEQKKLFFMYL

SEQ ID NO: 3311888 - protein, 5 aa, Plasmodium falciparum
FESES

SEQ ID NO: 3311889 - protein, 6 aa, Plasmodium falciparum
FESKDK

SEQ ID NO: 3311890 - protein, 5 aa, Plasmodium falciparum
FESSG

SEQ ID NO: 3311891 - protein, 5 aa, Plasmodium falciparum
FESTQ

SEQ ID NO: 3311892 - protein, 4 aa, Plasmodium falciparum
FETA

SEQ ID NO: 3311893 - protein, 18 aa, Plasmodium falciparum
FETDNESDLDLEDDEGDD

SEQ ID NO: 3311894 - protein, 14 aa, Plasmodium falciparum
FETGRATNDPVEGR

SEQ ID NO: 3311895 - protein, 6 aa, Plasmodium falciparum
FETPEQ

SEQ ID NO: 3311896 - protein, 4 aa, Plasmodium falciparum
FEYG

SEQ ID NO: 3311897 - protein, 14 aa, Plasmodium falciparum
FFSSSDANLDSPDK

SEQ ID NO: 3311898 - protein, 4 aa, Plasmodium falciparum
FGAN

SEQ ID NO: 3311899 - protein, 15 aa, Plasmodium falciparum
FGASSDNEDENEELP

SEQ ID NO: 3311900 - protein, 21 aa, Plasmodium falciparum
FGDNEKKKKNHDNNNDINNDD

SEQ ID NO: 3311901 - protein, 5 aa, Plasmodium falciparum
FGEEK

SEQ ID NO: 3311902 - protein, 4 aa, Plasmodium falciparum
FGEN

SEQ ID NO: 3311903 - protein, 6 aa, Plasmodium falciparum
FGEPAT

SEQ ID NO: 3311904 - protein, 9 aa, Plasmodium falciparum
FGEPTAEEK

SEQ ID NO: 3311905 - protein, 11 aa, Plasmodium falciparum
FGESKNETFPR

SEQ ID NO: 3311906 - protein, 4 aa, Plasmodium falciparum
FGGE

SEQ ID NO: 3311907 - protein, 4 aa, Plasmodium falciparum
FGGI

SEQ ID NO: 3311908 - protein, 4 aa, Plasmodium falciparum
FGGK

SEQ ID NO: 3311909 - protein, 11 aa, Plasmodium falciparum
FGGKNKSSKGN

SEQ ID NO: 3311910 - protein, 8 aa, Plasmodium falciparum
FGGNTYDE

SEQ ID NO: 3311911 - protein, 4 aa, Plasmodium falciparum
FGGS

SEQ ID NO: 3311912 - protein, 5 aa, Plasmodium falciparum
FGGSN

SEQ ID NO: 3311913 - protein, 6 aa, Plasmodium falciparum
FGHKEG

SEQ ID NO: 3311914 - protein, 11 aa, Plasmodium falciparum
FGKDNKKENKL

SEQ ID NO: 3311915 - protein, 5 aa, Plasmodium falciparum
FGKER

SEQ ID NO: 3311916 - protein, 6 aa, Plasmodium falciparum
FGKPNG

SEQ ID NO: 3311917 - protein, 8 aa, Plasmodium falciparum
FGKTKDQI

SEQ ID NO: 3311918 - protein, 5 aa, Plasmodium falciparum
FGKTR

SEQ ID NO: 3311919 - protein, 19 aa, Plasmodium falciparum
FGNEPNSDNRPFEYQNNFP

SEQ ID NO: 3311920 - protein, 11 aa, Plasmodium falciparum
FGNGSYTGEVS

SEQ ID NO: 3311921 - protein, 11 aa, Plasmodium falciparum
FGNKKNRRTLN

SEQ ID NO: 3311922 - protein, 21 aa, Plasmodium falciparum
FGNNKEESALPTDTYNDKNDM

SEQ ID NO: 3311923 - protein, 30 aa, Plasmodium falciparum
FGNSNDNNTKQSDNVLKGNNKNGSKNDKYE

SEQ ID NO: 3311924 - protein, 10 aa, Plasmodium falciparum
FGNSSTCGKE

SEQ ID NO: 3311925 - protein, 7 aa, Plasmodium falciparum
FGPETTD

SEQ ID NO: 3311926 - protein, 11 aa, Plasmodium falciparum
FGQNENKQIIG

SEQ ID NO: 3311927 - protein, 5 aa, Plasmodium falciparum
FGQPG

SEQ ID NO: 3311928 - protein, 11 aa, Plasmodium falciparum
FGSASSSSREV

SEQ ID NO: 3311929 - protein, 11 aa, Plasmodium falciparum
FGSGYPGDPVT

SEQ ID NO: 3311930 - protein, 16 aa, Plasmodium falciparum
FGSKKQKEKVDKETKK

SEQ ID NO: 3311931 - protein, 8 aa, Plasmodium falciparum
FGSSGPKE

SEQ ID NO: 3311932 - protein, 9 aa, Plasmodium falciparum
FGSSGTPNI

SEQ ID NO: 3311933 - protein, 15 aa, Plasmodium falciparum
FGTEGRRQPDIAPSN

SEQ ID NO: 3311934 - protein, 6 aa, Plasmodium falciparum
FGTKSC

SEQ ID NO: 3311935 - protein, 9 aa, Plasmodium falciparum
FGTNTSTNL

SEQ ID NO: 3311936 - protein, 4 aa, Plasmodium falciparum
FGTT

SEQ ID NO: 3311937 - protein, 12 aa, Plasmodium falciparum
FGTTTNSTTIGG

SEQ ID NO: 3311938 - protein, 19 aa, Plasmodium falciparum
FGVPSSSPPAQQQVGGSVT

SEQ ID NO: 3311939 - protein, 28 aa, Plasmodium falciparum
FHANKQDTTMEKNNNSLHKETKSYYKNK

SEQ ID NO: 3311940 - protein, 9 aa, Plasmodium falciparum
FHENTNTTI

SEQ ID NO: 3311941 - protein, 9 aa, Plasmodium falciparum
FHSDDSNEF

SEQ ID NO: 3311942 - protein, 6 aa, Plasmodium falciparum
FIPKKN

SEQ ID NO: 3311943 - protein, 6 aa, Plasmodium falciparum
FKDDEK

SEQ ID NO: 3311944 - protein, 5 aa, Plasmodium falciparum
FKDEN

SEQ ID NO: 3311945 - protein, 8 aa, Plasmodium falciparum
FKDKNTCP

SEQ ID NO: 3311946 - protein, 8 aa, Plasmodium falciparum
FKDNEENI

SEQ ID NO: 3311947 - protein, 5 aa, Plasmodium falciparum
FKDNR

SEQ ID NO: 3311948 - protein, 8 aa, Plasmodium falciparum
FKDSYAEE

SEQ ID NO: 3311949 - protein, 8 aa, Plasmodium falciparum
FKEDTCEE

SEQ ID NO: 3311950 - protein, 24 aa, Plasmodium falciparum
FKEDTNQCVTNQKGVEEKINEEEN

SEQ ID NO: 3311951 - protein, 41 aa, Plasmodium falciparum
FKEEEEKEEKEKEKEKKKIEKKDNEKEKEKLPNEQEEEQQR

SEQ ID NO: 3311952 - protein, 9 aa, Plasmodium falciparum
FKEEEKDTH

SEQ ID NO: 3311953 - protein, 31 aa, Plasmodium falciparum
FKEGDRDQSSSSEHSSINTEKKKKDNDNTKQ

SEQ ID NO: 3311954 - protein, 12 aa, Plasmodium falciparum
FKEGNKKDNISK

SEQ ID NO: 3311955 - protein, 9 aa, Plasmodium falciparum
FKEKGSKLN

SEQ ID NO: 3311956 - protein, 13 aa, Plasmodium falciparum
FKENKKEGKSNSL

SEQ ID NO: 3311957 - protein, 9 aa, Plasmodium falciparum
FKEQEKHDI

SEQ ID NO: 3311958 - protein, 14 aa, Plasmodium falciparum
FKERKEKKKKEKMA

SEQ ID NO: 3311959 - protein, 4 aa, Plasmodium falciparum
FKET

SEQ ID NO: 3311960 - protein, 9 aa, Plasmodium falciparum
FKGAEPKTI

SEQ ID NO: 3311961 - protein, 7 aa, Plasmodium falciparum
FKGDQRR

SEQ ID NO: 3311962 - protein, 18 aa, Plasmodium falciparum
FKGGGSTYNFSGTQNNIN

SEQ ID NO: 3311963 - protein, 7 aa, Plasmodium falciparum
FKGGNKD

SEQ ID NO: 3311964 - protein, 14 aa, Plasmodium falciparum
FKGKKDNKKIEKTN

SEQ ID NO: 3311965 - protein, 16 aa, Plasmodium falciparum
FKGNKKKEFKKKTRRR

SEQ ID NO: 3311966 - protein, 12 aa, Plasmodium falciparum
FKIDNNKNNQIN

SEQ ID NO: 3311967 - protein, 21 aa, Plasmodium falciparum
FKKDKDNKKYKDYPSTERDIE

SEQ ID NO: 3311968 - protein, 13 aa, Plasmodium falciparum
FKKDNTKVNKTNS

SEQ ID NO: 3311969 - protein, 9 aa, Plasmodium falciparum
FKKDSNESL

SEQ ID NO: 3311970 - protein, 5 aa, Plasmodium falciparum
FKKEA

SEQ ID NO: 3311971 - protein, 5 aa, Plasmodium falciparum
FKKGI

SEQ ID NO: 3311972 - protein, 7 aa, Plasmodium falciparum
FKKKDNL

SEQ ID NO: 3311973 - protein, 8 aa, Plasmodium falciparum
FKKKEGEL

SEQ ID NO: 3311974 - protein, 4 aa, Plasmodium falciparum
FKKN

SEQ ID NO: 3311975 - protein, 8 aa, Plasmodium falciparum
FKKNSYNN

SEQ ID NO: 3311976 - protein, 7 aa, Plasmodium falciparum
FKKSSTI

SEQ ID NO: 3311977 - protein, 10 aa, Plasmodium falciparum
FKNDDYDTEM

SEQ ID NO: 3311978 - protein, 33 aa, Plasmodium falciparum
FKNDQTDEMGEYTATTTNNVKHTNNTNNNDTHI

SEQ ID NO: 3311979 - protein, 7 aa, Plasmodium falciparum
FKNENNE

SEQ ID NO: 3311980 - protein, 24 aa, Plasmodium falciparum
FKNKDRKRKAQKENLKEDSQTNHH

SEQ ID NO: 3311981 - protein, 15 aa, Plasmodium falciparum
FKNKEIEQDEDDAIT

SEQ ID NO: 3311982 - protein, 10 aa, Plasmodium falciparum
FKNKEREENY

SEQ ID NO: 3311983 - protein, 5 aa, Plasmodium falciparum
FKNKQ

SEQ ID NO: 3311984 - protein, 5 aa, Plasmodium falciparum
FKNNK

SEQ ID NO: 3311985 - protein, 54 aa, Plasmodium falciparum
FKNNTVGNNNIGNNHNIGNNNNIGNNHNIGNNNNNIGNNNNNTQSYTDINKSSS

SEQ ID NO: 3311986 - protein, 8 aa, Plasmodium falciparum
FKNQEKKE

SEQ ID NO: 3311987 - protein, 10 aa, Plasmodium falciparum
FKNSSDNNDI

SEQ ID NO: 3311988 - protein, 8 aa, Plasmodium falciparum
FKNTSGQL

SEQ ID NO: 3311989 - protein, 7 aa, Plasmodium falciparum
FKPGEGV

SEQ ID NO: 3311990 - protein, 4 aa, Plasmodium falciparum
FKPY

SEQ ID NO: 3311991 - protein, 8 aa, Plasmodium falciparum
FKQEQEKG

SEQ ID NO: 3311992 - protein, 19 aa, Plasmodium falciparum
FKQKDDKNENDMENQSHNN

SEQ ID NO: 3311993 - protein, 25 aa, Plasmodium falciparum
FKQNNNQDNINQDTREENKSDPGYS

SEQ ID NO: 3311994 - protein, 4 aa, Plasmodium falciparum
FKQY

SEQ ID NO: 3311995 - protein, 18 aa, Plasmodium falciparum
FKREDNMDPLKKDNNENF

SEQ ID NO: 3311996 - protein, 22 aa, Plasmodium falciparum
FKRNSNNFGKGNNNAVRKGSNW

SEQ ID NO: 3311997 - protein, 9 aa, Plasmodium falciparum
FKSDEDDSD

SEQ ID NO: 3311998 - protein, 4 aa, Plasmodium falciparum
FKSE

SEQ ID NO: 3311999 - protein, 12 aa, Plasmodium falciparum
FKSESTDVTERT

SEQ ID NO: 3312000 - protein, 10 aa, Plasmodium falciparum
FKSKKQKKYI

SEQ ID NO: 3312001 - protein, 5 aa, Plasmodium falciparum
FKSKQ

SEQ ID NO: 3312002 - protein, 4 aa, Plasmodium falciparum
FKSN

SEQ ID NO: 3312003 - protein, 9 aa, Plasmodium falciparum
FKSNTDTEV

SEQ ID NO: 3312004 - protein, 5 aa, Plasmodium falciparum
FKSPS

SEQ ID NO: 3312005 - protein, 23 aa, Plasmodium falciparum
FKSSSKKKKKIIEESSDYASSEK

SEQ ID NO: 3312006 - protein, 8 aa, Plasmodium falciparum
FKTEPPKH

SEQ ID NO: 3312007 - protein, 12 aa, Plasmodium falciparum
FKTETKSKLESK

SEQ ID NO: 3312008 - protein, 4 aa, Plasmodium falciparum
FKTG

SEQ ID NO: 3312009 - protein, 26 aa, Plasmodium falciparum
FKTRRSKFTNGNNYGKSGNNKNSEDL

SEQ ID NO: 3312010 - protein, 4 aa, Plasmodium falciparum
FKTT

SEQ ID NO: 3312011 - protein, 5 aa, Plasmodium falciparum
FKTTK

SEQ ID NO: 3312012 - protein, 11 aa, Plasmodium falciparum
FKYNDEDSYKL

SEQ ID NO: 3312013 - protein, 4 aa, Plasmodium falciparum
FMGN

SEQ ID NO: 3312014 - protein, 10 aa, Plasmodium falciparum
FMPNPKKNID

SEQ ID NO: 3312015 - protein, 12 aa, Plasmodium falciparum
FMPPKNDKNFNN

SEQ ID NO: 3312016 - protein, 10 aa, Plasmodium falciparum
FNAPQDNTLT

SEQ ID NO: 3312017 - protein, 12 aa, Plasmodium falciparum
FNDDNNCSEPTN

SEQ ID NO: 3312018 - protein, 8 aa, Plasmodium falciparum
FNDDSNED

SEQ ID NO: 3312019 - protein, 20 aa, Plasmodium falciparum
FNDGDNKNGEENSNLTTQHD

SEQ ID NO: 3312020 - protein, 11 aa, Plasmodium falciparum
FNDNRKNNVDY

SEQ ID NO: 3312021 - protein, 10 aa, Plasmodium falciparum
FNDRDNNNAY

SEQ ID NO: 3312022 - protein, 7 aa, Plasmodium falciparum
FNDSDDE

SEQ ID NO: 3312023 - protein, 21 aa, Plasmodium falciparum
FNDTHNNNNNNNNNNNYNYNG

SEQ ID NO: 3312024 - protein, 7 aa, Plasmodium falciparum
FNDYSED

SEQ ID NO: 3312025 - protein, 5 aa, Plasmodium falciparum
FNEAN

SEQ ID NO: 3312026 - protein, 4 aa, Plasmodium falciparum
FNED

SEQ ID NO: 3312027 - protein, 12 aa, Plasmodium falciparum
FNEDVLKKKKSI

SEQ ID NO: 3312028 - protein, 5 aa, Plasmodium falciparum
FNEEE

SEQ ID NO: 3312029 - protein, 17 aa, Plasmodium falciparum
FNEESDDEELKELIGEM

SEQ ID NO: 3312030 - protein, 16 aa, Plasmodium falciparum
FNEISGKEKNQNNIEY

SEQ ID NO: 3312031 - protein, 6 aa, Plasmodium falciparum
FNEKEK

SEQ ID NO: 3312032 - protein, 14 aa, Plasmodium falciparum
FNEKKEDSNDRGVS

SEQ ID NO: 3312033 - protein, 8 aa, Plasmodium falciparum
FNENEENS

SEQ ID NO: 3312034 - protein, 12 aa, Plasmodium falciparum
FNEPRPGDWGNR

SEQ ID NO: 3312035 - protein, 8 aa, Plasmodium falciparum
FNEQEKEQ

SEQ ID NO: 3312036 - protein, 10 aa, Plasmodium falciparum
FNEREEDQRG

SEQ ID NO: 3312037 - protein, 25 aa, Plasmodium falciparum
FNETNKTKYIQGTGGRKSKSTGKNK

SEQ ID NO: 3312038 - protein, 9 aa, Plasmodium falciparum
FNETSSRSH

SEQ ID NO: 3312039 - protein, 4 aa, Plasmodium falciparum
FNEY

SEQ ID NO: 3312040 - protein, 14 aa, Plasmodium falciparum
FNFPPGQDDHDKSI

SEQ ID NO: 3312041 - protein, 21 aa, Plasmodium falciparum
FNGNKKDINNKYEEGSYYKSQ

SEQ ID NO: 3312042 - protein, 9 aa, Plasmodium falciparum
FNGTNSTGS

SEQ ID NO: 3312043 - protein, 12 aa, Plasmodium falciparum
FNHNNNNNNNNN

SEQ ID NO: 3312044 - protein, 5 aa, Plasmodium falciparum
FNHSK

SEQ ID NO: 3312045 - protein, 9 aa, Plasmodium falciparum
FNKAPTSRT

SEQ ID NO: 3312046 - protein, 7 aa, Plasmodium falciparum
FNKEENN

SEQ ID NO: 3312047 - protein, 14 aa, Plasmodium falciparum
FNKEEYKDDQFDED

SEQ ID NO: 3312048 - protein, 29 aa, Plasmodium falciparum
FNKGTQKKGLLSKKDFKKKRTSSKNNNSI

SEQ ID NO: 3312049 - protein, 8 aa, Plasmodium falciparum
FNKKNDNS

SEQ ID NO: 3312050 - protein, 4 aa, Plasmodium falciparum
FNKN

SEQ ID NO: 3312051 - protein, 32 aa, Plasmodium falciparum
FNKNEKENENEIEKQQTHANNYSNVNTQDIRQ

SEQ ID NO: 3312052 - protein, 22 aa, Plasmodium falciparum
FNKNKEKKQVSADDKDVSNSSE

SEQ ID NO: 3312053 - protein, 7 aa, Plasmodium falciparum
FNKNNET

SEQ ID NO: 3312054 - protein, 6 aa, Plasmodium falciparum
FNKNRN

SEQ ID NO: 3312055 - protein, 7 aa, Plasmodium falciparum
FNKNRNN

SEQ ID NO: 3312056 - protein, 7 aa, Plasmodium falciparum
FNKSKRK

SEQ ID NO: 3312057 - protein, 21 aa, Plasmodium falciparum
FNKSSKGENSEIGKIGGRSKS

SEQ ID NO: 3312058 - protein, 11 aa, Plasmodium falciparum
FNNDEGNKYLR

SEQ ID NO: 3312059 - protein, 23 aa, Plasmodium falciparum
FNNDNSCDGEYDSNKGKNKSTQK

SEQ ID NO: 3312060 - protein, 7 aa, Plasmodium falciparum
FNNDTVE

SEQ ID NO: 3312061 - protein, 7 aa, Plasmodium falciparum
FNNEEAK

SEQ ID NO: 3312062 - protein, 10 aa, Plasmodium falciparum
FNNERNDIKQ

SEQ ID NO: 3312063 - protein, 5 aa, Plasmodium falciparum
FNNGE

SEQ ID NO: 3312064 - protein, 6 aa, Plasmodium falciparum
FNNGNE

SEQ ID NO: 3312065 - protein, 10 aa, Plasmodium falciparum
FNNKKNENKY

SEQ ID NO: 3312066 - protein, 13 aa, Plasmodium falciparum
FNNKKRKTSTCST

SEQ ID NO: 3312067 - protein, 9 aa, Plasmodium falciparum
FNNKKTHDY

SEQ ID NO: 3312068 - protein, 15 aa, Plasmodium falciparum
FNNKQVDNDNNKNSL

SEQ ID NO: 3312069 - protein, 4 aa, Plasmodium falciparum
FNNN

SEQ ID NO: 3312070 - protein, 6 aa, Plasmodium falciparum
FNNNNN

SEQ ID NO: 3312071 - protein, 26 aa, Plasmodium falciparum
FNNNNNNKNNNNNSSNNNNNNNNKPF

SEQ ID NO: 3312072 - protein, 12 aa, Plasmodium falciparum
FNNNNNNNNNSK

SEQ ID NO: 3312073 - protein, 30 aa, Plasmodium falciparum
FNNNNRDNKNKEKKMKSRTNKQDDRSQNNM

SEQ ID NO: 3312074 - protein, 8 aa, Plasmodium falciparum
FNNNNSTI

SEQ ID NO: 3312075 - protein, 11 aa, Plasmodium falciparum
FNNNSNKNFKA

SEQ ID NO: 3312076 - protein, 9 aa, Plasmodium falciparum
FNNNSRNTI

SEQ ID NO: 3312077 - protein, 8 aa, Plasmodium falciparum
FNNNVENT

SEQ ID NO: 3312078 - protein, 6 aa, Plasmodium falciparum
FNNPNN

SEQ ID NO: 3312079 - protein, 41 aa, Plasmodium falciparum
FNNQNKNHANSEYEQNIREEKNSTYKPMDDNTKEENKSDVP

SEQ ID NO: 3312080 - protein, 9 aa, Plasmodium falciparum
FNNSNNNIN

SEQ ID NO: 3312081 - protein, 19 aa, Plasmodium falciparum
FNNTKKNSVTDNLNNNGNV

SEQ ID NO: 3312082 - protein, 10 aa, Plasmodium falciparum
FNNTNDNNYN

SEQ ID NO: 3312083 - protein, 18 aa, Plasmodium falciparum
FNNTSDDISSHSSVNKKE

SEQ ID NO: 3312084 - protein, 19 aa, Plasmodium falciparum
FNNTSNTNHMDNTNHTNHM

SEQ ID NO: 3312085 - protein, 13 aa, Plasmodium falciparum
FNNYGEKNNSIFP

SEQ ID NO: 3312086 - protein, 9 aa, Plasmodium falciparum
FNPNDNINN

SEQ ID NO: 3312087 - protein, 22 aa, Plasmodium falciparum
FNPNDNKKKNSYNNNNNNNNNN

SEQ ID NO: 3312088 - protein, 6 aa, Plasmodium falciparum
FNPQSV

SEQ ID NO: 3312089 - protein, 11 aa, Plasmodium falciparum
FNPTKKMKNQP

SEQ ID NO: 3312090 - protein, 12 aa, Plasmodium falciparum
FNPTYKNSTPVV

SEQ ID NO: 3312091 - protein, 15 aa, Plasmodium falciparum
FNPYPNNNITTNDEY

SEQ ID NO: 3312092 - protein, 7 aa, Plasmodium falciparum
FNPYTEP

SEQ ID NO: 3312093 - protein, 10 aa, Plasmodium falciparum
FNQENNVKPY

SEQ ID NO: 3312094 - protein, 7 aa, Plasmodium falciparum
FNQPNQE

SEQ ID NO: 3312095 - protein, 4 aa, Plasmodium falciparum
FNQS

SEQ ID NO: 3312096 - protein, 5 aa, Plasmodium falciparum
FNRGG

SEQ ID NO: 3312097 - protein, 4 aa, Plasmodium falciparum
FNRN

SEQ ID NO: 3312098 - protein, 22 aa, Plasmodium falciparum
FNSDKKDDLKDRLKNTKESIDC

SEQ ID NO: 3312099 - protein, 52 aa, Plasmodium falciparum
FNSEKDDAKKKNDNTSERDNSNDWKGSEQRKEEEDEEVEKEKENEEEEEAIY

SEQ ID NO: 3312100 - protein, 7 aa, Plasmodium falciparum
FNSESGS

SEQ ID NO: 3312101 - protein, 11 aa, Plasmodium falciparum
FNSHDKNITNP

SEQ ID NO: 3312102 - protein, 8 aa, Plasmodium falciparum
FNSKENPN

SEQ ID NO: 3312103 - protein, 22 aa, Plasmodium falciparum
FNSKEYDKTSDCDKNNTPLKNG

SEQ ID NO: 3312104 - protein, 11 aa, Plasmodium falciparum
FNSKNQSKQIN

SEQ ID NO: 3312105 - protein, 5 aa, Plasmodium falciparum
FNSKS

SEQ ID NO: 3312106 - protein, 5 aa, Plasmodium falciparum
FNSLN

SEQ ID NO: 3312107 - protein, 6 aa, Plasmodium falciparum
FNSNED

SEQ ID NO: 3312108 - protein, 5 aa, Plasmodium falciparum
FNSQE

SEQ ID NO: 3312109 - protein, 18 aa, Plasmodium falciparum
FNSSDNIYNEDKNEHVDG

SEQ ID NO: 3312110 - protein, 15 aa, Plasmodium falciparum
FNSSKSSVIENTSKN

SEQ ID NO: 3312111 - protein, 9 aa, Plasmodium falciparum
FNSTNVKRR

SEQ ID NO: 3312112 - protein, 12 aa, Plasmodium falciparum
FNSYANKNTMEN

SEQ ID NO: 3312113 - protein, 4 aa, Plasmodium falciparum
FNTN

SEQ ID NO: 3312114 - protein, 15 aa, Plasmodium falciparum
FNTYGKSEASENLSK

SEQ ID NO: 3312115 - protein, 12 aa, Plasmodium falciparum
FNVEKNNKNLIL

SEQ ID NO: 3312116 - protein, 9 aa, Plasmodium falciparum
FNYEENQNK

SEQ ID NO: 3312117 - protein, 14 aa, Plasmodium falciparum
FNYPTSIKGKDKKV

SEQ ID NO: 3312118 - protein, 7 aa, Plasmodium falciparum
FPDKEKD

SEQ ID NO: 3312119 - protein, 5 aa, Plasmodium falciparum
FPDKK

SEQ ID NO: 3312120 - protein, 20 aa, Plasmodium falciparum
FPDKNNTDKYESNTLKQENK

SEQ ID NO: 3312121 - protein, 5 aa, Plasmodium falciparum
FPDLS

SEQ ID NO: 3312122 - protein, 5 aa, Plasmodium falciparum
FPEET

SEQ ID NO: 3312123 - protein, 4 aa, Plasmodium falciparum
FPEH

SEQ ID NO: 3312124 - protein, 6 aa, Plasmodium falciparum
FPEPTA

SEQ ID NO: 3312125 - protein, 9 aa, Plasmodium falciparum
FPESSEVNY

SEQ ID NO: 3312126 - protein, 8 aa, Plasmodium falciparum
FPHKKEKN

SEQ ID NO: 3312127 - protein, 4 aa, Plasmodium falciparum
FPHP

SEQ ID NO: 3312128 - protein, 10 aa, Plasmodium falciparum
FPKKASPALK

SEQ ID NO: 3312129 - protein, 5 aa, Plasmodium falciparum
FPKKE

SEQ ID NO: 3312130 - protein, 5 aa, Plasmodium falciparum
FPKNL

SEQ ID NO: 3312131 - protein, 8 aa, Plasmodium falciparum
FPLSGEND

SEQ ID NO: 3312132 - protein, 11 aa, Plasmodium falciparum
FPNDNKSTKQD

SEQ ID NO: 3312133 - protein, 4 aa, Plasmodium falciparum
FPNE

SEQ ID NO: 3312134 - protein, 5 aa, Plasmodium falciparum
FPNEN

SEQ ID NO: 3312135 - protein, 9 aa, Plasmodium falciparum
FPNPEEKGA

SEQ ID NO: 3312136 - protein, 10 aa, Plasmodium falciparum
FPNTQTKNEN

SEQ ID NO: 3312137 - protein, 4 aa, Plasmodium falciparum
FPPD

SEQ ID NO: 3312138 - protein, 7 aa, Plasmodium falciparum
FPPEPSG

SEQ ID NO: 3312139 - protein, 6 aa, Plasmodium falciparum
FPPKKE

SEQ ID NO: 3312140 - protein, 5 aa, Plasmodium falciparum
FPPNV

SEQ ID NO: 3312141 - protein, 31 aa, Plasmodium falciparum
FPQNEKEITDKTLKKKRNNYSYKKPKNVKDS

SEQ ID NO: 3312142 - protein, 9 aa, Plasmodium falciparum
FPQPTAQNA

SEQ ID NO: 3312143 - protein, 8 aa, Plasmodium falciparum
FPQTNKQN

SEQ ID NO: 3312144 - protein, 5 aa, Plasmodium falciparum
FPSDN

SEQ ID NO: 3312145 - protein, 8 aa, Plasmodium falciparum
FPSDPDTL

SEQ ID NO: 3312146 - protein, 5 aa, Plasmodium falciparum
FPSGQ

SEQ ID NO: 3312147 - protein, 4 aa, Plasmodium falciparum
FPSN

SEQ ID NO: 3312148 - protein, 9 aa, Plasmodium falciparum
FPSNEGNYE

SEQ ID NO: 3312149 - protein, 6 aa, Plasmodium falciparum
FPSNRN

SEQ ID NO: 3312150 - protein, 6 aa, Plasmodium falciparum
FPSTNY

SEQ ID NO: 3312151 - protein, 9 aa, Plasmodium falciparum
FPSTSGGNN

SEQ ID NO: 3312152 - protein, 5 aa, Plasmodium falciparum
FPTDV

SEQ ID NO: 3312153 - protein, 4 aa, Plasmodium falciparum
FPTE

SEQ ID NO: 3312154 - protein, 4 aa, Plasmodium falciparum
FPYE

SEQ ID NO: 3312155 - protein, 4 aa, Plasmodium falciparum
FQAN

SEQ ID NO: 3312156 - protein, 14 aa, Plasmodium falciparum
FQDKPKSLKNKKDT

SEQ ID NO: 3312157 - protein, 9 aa, Plasmodium falciparum
FQDQNYNNN

SEQ ID NO: 3312158 - protein, 8 aa, Plasmodium falciparum
FQDYRTKR

SEQ ID NO: 3312159 - protein, 7 aa, Plasmodium falciparum
FQGGGAY

SEQ ID NO: 3312160 - protein, 8 aa, Plasmodium falciparum
FQGNGKGY

SEQ ID NO: 3312161 - protein, 4 aa, Plasmodium falciparum
FQGR

SEQ ID NO: 3312162 - protein, 5 aa, Plasmodium falciparum
FQGRE

SEQ ID NO: 3312163 - protein, 7 aa, Plasmodium falciparum
FQKEKKE

SEQ ID NO: 3312164 - protein, 12 aa, Plasmodium falciparum
FQKESNVKPDMP

SEQ ID NO: 3312165 - protein, 28 aa, Plasmodium falciparum
FQKGKQKKKQMQKKKQMQKKKQIQEQIQ

SEQ ID NO: 3312166 - protein, 8 aa, Plasmodium falciparum
FQKKNEAL

SEQ ID NO: 3312167 - protein, 5 aa, Plasmodium falciparum
FQNDL

SEQ ID NO: 3312168 - protein, 9 aa, Plasmodium falciparum
FQNDNANVP

SEQ ID NO: 3312169 - protein, 6 aa, Plasmodium falciparum
FQNSKG

SEQ ID NO: 3312170 - protein, 15 aa, Plasmodium falciparum
FQNSTIGAHEKNDMS

SEQ ID NO: 3312171 - protein, 8 aa, Plasmodium falciparum
FQNTNDEN

SEQ ID NO: 3312172 - protein, 8 aa, Plasmodium falciparum
FQTNEEQI

SEQ ID NO: 3312173 - protein, 7 aa, Plasmodium falciparum
FQTSEEK

SEQ ID NO: 3312174 - protein, 34 aa, Plasmodium falciparum
FRGGRDGGYRGGNRGGSRSGFRGGRGGFRGGRAL

SEQ ID NO: 3312175 - protein, 5 aa, Plasmodium falciparum
FRGRS

SEQ ID NO: 3312176 - protein, 6 aa, Plasmodium falciparum
FRGRSK

SEQ ID NO: 3312177 - protein, 6 aa, Plasmodium falciparum
FRGRTG

SEQ ID NO: 3312178 - protein, 18 aa, Plasmodium falciparum
FRKNSKAKKNKKKRSTSH

SEQ ID NO: 3312179 - protein, 9 aa, Plasmodium falciparum
FRNDKEEIK

SEQ ID NO: 3312180 - protein, 4 aa, Plasmodium falciparum
FRPG

SEQ ID NO: 3312181 - protein, 8 aa, Plasmodium falciparum
FRPNNRNQ

SEQ ID NO: 3312182 - protein, 8 aa, Plasmodium falciparum
FRSDPENR

SEQ ID NO: 3312183 - protein, 5 aa, Plasmodium falciparum
FSAQS

SEQ ID NO: 3312184 - protein, 9 aa, Plasmodium falciparum
FSCEDDKGT

SEQ ID NO: 3312185 - protein, 11 aa, Plasmodium falciparum
FSDDDESEESF

SEQ ID NO: 3312186 - protein, 31 aa, Plasmodium falciparum
FSDDEKDDSYEREKQVYSGSETQNAENEYSK

SEQ ID NO: 3312187 - protein, 9 aa, Plasmodium falciparum
FSDDEYKNK

SEQ ID NO: 3312188 - protein, 9 aa, Plasmodium falciparum
FSDEDSEKN

SEQ ID NO: 3312189 - protein, 25 aa, Plasmodium falciparum
FSDEEGMKMDNDNKIDDNTLNNNKI

SEQ ID NO: 3312190 - protein, 9 aa, Plasmodium falciparum
FSDEKKNDC

SEQ ID NO: 3312191 - protein, 6 aa, Plasmodium falciparum
FSDEQK

SEQ ID NO: 3312192 - protein, 17 aa, Plasmodium falciparum
FSDKYTDKNDNKYYNNN

SEQ ID NO: 3312193 - protein, 9 aa, Plasmodium falciparum
FSDNEDDKE

SEQ ID NO: 3312194 - protein, 5 aa, Plasmodium falciparum
FSDPN

SEQ ID NO: 3312195 - protein, 9 aa, Plasmodium falciparum
FSDPNTSVK

SEQ ID NO: 3312196 - protein, 4 aa, Plasmodium falciparum
FSDS

SEQ ID NO: 3312197 - protein, 8 aa, Plasmodium falciparum
FSDTEKEN

SEQ ID NO: 3312198 - protein, 4 aa, Plasmodium falciparum
FSED

SEQ ID NO: 3312199 - protein, 18 aa, Plasmodium falciparum
FSEDTQQKFNDDKDTCNK

SEQ ID NO: 3312200 - protein, 21 aa, Plasmodium falciparum
FSEGSKESTITNNSKRDKKTC

SEQ ID NO: 3312201 - protein, 4 aa, Plasmodium falciparum
FSEK

SEQ ID NO: 3312202 - protein, 5 aa, Plasmodium falciparum
FSEND

SEQ ID NO: 3312203 - protein, 9 aa, Plasmodium falciparum
FSENKEKKE

SEQ ID NO: 3312204 - protein, 7 aa, Plasmodium falciparum
FSENPSS

SEQ ID NO: 3312205 - protein, 6 aa, Plasmodium falciparum
FSEPQR

SEQ ID NO: 3312206 - protein, 6 aa, Plasmodium falciparum
FSEPTA

SEQ ID NO: 3312207 - protein, 6 aa, Plasmodium falciparum
FSESNE

SEQ ID NO: 3312208 - protein, 5 aa, Plasmodium falciparum
FSETD

SEQ ID NO: 3312209 - protein, 8 aa, Plasmodium falciparum
FSGGKQHP

SEQ ID NO: 3312210 - protein, 5 aa, Plasmodium falciparum
FSGKE

SEQ ID NO: 3312211 - protein, 18 aa, Plasmodium falciparum
FSGKNKSHGTESKAHRSL

SEQ ID NO: 3312212 - protein, 5 aa, Plasmodium falciparum
FSGPQ

SEQ ID NO: 3312213 - protein, 19 aa, Plasmodium falciparum
FSGRSGGLKRKKKRKEERI

SEQ ID NO: 3312214 - protein, 14 aa, Plasmodium falciparum
FSHKENSQNKRDDQ

SEQ ID NO: 3312215 - protein, 6 aa, Plasmodium falciparum
FSKAKN

SEQ ID NO: 3312216 - protein, 39 aa, Plasmodium falciparum
FSKDDDSEYKEIKRKNKDNANKKESSNYKKKKEDKYNKR

SEQ ID NO: 3312217 - protein, 26 aa, Plasmodium falciparum
FSKEGEQQKDDAIKSNETYEEENEEI

SEQ ID NO: 3312218 - protein, 12 aa, Plasmodium falciparum
FSKEQNNTTNSL

SEQ ID NO: 3312219 - protein, 7 aa, Plasmodium falciparum
FSKKEYS

SEQ ID NO: 3312220 - protein, 9 aa, Plasmodium falciparum
FSKKRKHYD

SEQ ID NO: 3312221 - protein, 6 aa, Plasmodium falciparum
FSKNEL

SEQ ID NO: 3312222 - protein, 18 aa, Plasmodium falciparum
FSKNNSQSINDSQNKYNT

SEQ ID NO: 3312223 - protein, 7 aa, Plasmodium falciparum
FSKPPHN

SEQ ID NO: 3312224 - protein, 16 aa, Plasmodium falciparum
FSKPTSSNDNSSVGRI

SEQ ID NO: 3312225 - protein, 9 aa, Plasmodium falciparum
FSKQKKRKA

SEQ ID NO: 3312226 - protein, 8 aa, Plasmodium falciparum
FSLSDEKK

SEQ ID NO: 3312227 - protein, 14 aa, Plasmodium falciparum
FSNDKSNDKKTSPF

SEQ ID NO: 3312228 - protein, 5 aa, Plasmodium falciparum
FSNDN

SEQ ID NO: 3312229 - protein, 18 aa, Plasmodium falciparum
FSNEKNEGEQKKKNMKNY

SEQ ID NO: 3312230 - protein, 10 aa, Plasmodium falciparum
FSNEPSHGYV

SEQ ID NO: 3312231 - protein, 21 aa, Plasmodium falciparum
FSNGTLNKNKKTGIDNNEQFN

SEQ ID NO: 3312232 - protein, 4 aa, Plasmodium falciparum
FSNK

SEQ ID NO: 3312233 - protein, 16 aa, Plasmodium falciparum
FSNKAENNNNSTYTNK

SEQ ID NO: 3312234 - protein, 8 aa, Plasmodium falciparum
FSNKSKQW

SEQ ID NO: 3312235 - protein, 7 aa, Plasmodium falciparum
FSNNPAN

SEQ ID NO: 3312236 - protein, 10 aa, Plasmodium falciparum
FSNNSNMTEN

SEQ ID NO: 3312237 - protein, 6 aa, Plasmodium falciparum
FSNPDR

SEQ ID NO: 3312238 - protein, 15 aa, Plasmodium falciparum
FSNPQGQNNISSYNP

SEQ ID NO: 3312239 - protein, 11 aa, Plasmodium falciparum
FSNQYDNKKNL

SEQ ID NO: 3312240 - protein, 4 aa, Plasmodium falciparum
FSNR

SEQ ID NO: 3312241 - protein, 29 aa, Plasmodium falciparum
FSNSADDKNNGVIPEQRTQYSGTNEYKDF

SEQ ID NO: 3312242 - protein, 12 aa, Plasmodium falciparum
FSNSSNNNNCDN

SEQ ID NO: 3312243 - protein, 7 aa, Plasmodium falciparum
FSNTSEN

SEQ ID NO: 3312244 - protein, 5 aa, Plasmodium falciparum
FSPDN

SEQ ID NO: 3312245 - protein, 5 aa, Plasmodium falciparum
FSPEG

SEQ ID NO: 3312246 - protein, 4 aa, Plasmodium falciparum
FSPF

SEQ ID NO: 3312247 - protein, 7 aa, Plasmodium falciparum
FSPSTSV

SEQ ID NO: 3312248 - protein, 5 aa, Plasmodium falciparum
FSPTG

SEQ ID NO: 3312249 - protein, 11 aa, Plasmodium falciparum
FSQGTSADREI

SEQ ID NO: 3312250 - protein, 9 aa, Plasmodium falciparum
FSQNEEKKN

SEQ ID NO: 3312251 - protein, 12 aa, Plasmodium falciparum
FSQSSRDKITQV

SEQ ID NO: 3312252 - protein, 9 aa, Plasmodium falciparum
FSQSTNKKI

SEQ ID NO: 3312253 - protein, 21 aa, Plasmodium falciparum
FSRKNNDGFYRNNDNNYNNET

SEQ ID NO: 3312254 - protein, 5 aa, Plasmodium falciparum
FSRQD

SEQ ID NO: 3312255 - protein, 19 aa, Plasmodium falciparum
FSRTSKTDSFIDESDDGIY

SEQ ID NO: 3312256 - protein, 8 aa, Plasmodium falciparum
FSSDDNTK

SEQ ID NO: 3312257 - protein, 11 aa, Plasmodium falciparum
FSSDENSNNDN

SEQ ID NO: 3312258 - protein, 17 aa, Plasmodium falciparum
FSSDSNSNLLSDTTQNV

SEQ ID NO: 3312259 - protein, 5 aa, Plasmodium falciparum
FSSEE

SEQ ID NO: 3312260 - protein, 9 aa, Plasmodium falciparum
FSSESGKLE

SEQ ID NO: 3312261 - protein, 7 aa, Plasmodium falciparum
FSSGSKR

SEQ ID NO: 3312262 - protein, 10 aa, Plasmodium falciparum
FSSGSMKSGN

SEQ ID NO: 3312263 - protein, 5 aa, Plasmodium falciparum
FSSNE

SEQ ID NO: 3312264 - protein, 18 aa, Plasmodium falciparum
FSSNKKKKYDLTKKHGKD

SEQ ID NO: 3312265 - protein, 10 aa, Plasmodium falciparum
FSSNKTNEVS

SEQ ID NO: 3312266 - protein, 5 aa, Plasmodium falciparum
FSSNN

SEQ ID NO: 3312267 - protein, 10 aa, Plasmodium falciparum
FSSNNERERS

SEQ ID NO: 3312268 - protein, 9 aa, Plasmodium falciparum
FSSNNNMES

SEQ ID NO: 3312269 - protein, 6 aa, Plasmodium falciparum
FSSNQK

SEQ ID NO: 3312270 - protein, 18 aa, Plasmodium falciparum
FSSREEKTLNTKNQKKEN

SEQ ID NO: 3312271 - protein, 9 aa, Plasmodium falciparum
FSSRHGQKG

SEQ ID NO: 3312272 - protein, 6 aa, Plasmodium falciparum
FSSRTM

SEQ ID NO: 3312273 - protein, 4 aa, Plasmodium falciparum
FSSS

SEQ ID NO: 3312274 - protein, 10 aa, Plasmodium falciparum
FSSSESEYEE

SEQ ID NO: 3312275 - protein, 5 aa, Plasmodium falciparum
FSSSH

SEQ ID NO: 3312276 - protein, 18 aa, Plasmodium falciparum
FSSSNNQNNNNNNNNNND

SEQ ID NO: 3312277 - protein, 7 aa, Plasmodium falciparum
FSSSPQK

SEQ ID NO: 3312278 - protein, 20 aa, Plasmodium falciparum
FSSSSSMDDDDDDNNNNNNV

SEQ ID NO: 3312279 - protein, 5 aa, Plasmodium falciparum
FSSTC

SEQ ID NO: 3312280 - protein, 5 aa, Plasmodium falciparum
FSTDD

SEQ ID NO: 3312281 - protein, 7 aa, Plasmodium falciparum
FSTGKRG

SEQ ID NO: 3312282 - protein, 6 aa, Plasmodium falciparum
FSTGRR

SEQ ID NO: 3312283 - protein, 11 aa, Plasmodium falciparum
FSTKEPSTPMR

SEQ ID NO: 3312284 - protein, 11 aa, Plasmodium falciparum
FSTQHGQYDKS

SEQ ID NO: 3312285 - protein, 8 aa, Plasmodium falciparum
FSTSAEKE

SEQ ID NO: 3312286 - protein, 17 aa, Plasmodium falciparum
FSTSKMSDNAHYKGEDM

SEQ ID NO: 3312287 - protein, 7 aa, Plasmodium falciparum
FSTTSSD

SEQ ID NO: 3312288 - protein, 6 aa, Plasmodium falciparum
FSVSKG

SEQ ID NO: 3312289 - protein, 15 aa, Plasmodium falciparum
FSYDGYDDKYSYDQN

SEQ ID NO: 3312290 - protein, 4 aa, Plasmodium falciparum
FSYG

SEQ ID NO: 3312291 - protein, 4 aa, Plasmodium falciparum
FSYK

SEQ ID NO: 3312292 - protein, 4 aa, Plasmodium falciparum
FTAQ

SEQ ID NO: 3312293 - protein, 6 aa, Plasmodium falciparum
FTDDTQ

SEQ ID NO: 3312294 - protein, 4 aa, Plasmodium falciparum
FTEE

SEQ ID NO: 3312295 - protein, 9 aa, Plasmodium falciparum
FTERPGFTE

SEQ ID NO: 3312296 - protein, 5 aa, Plasmodium falciparum
FTGEA

SEQ ID NO: 3312297 - protein, 12 aa, Plasmodium falciparum
FTGEENQEVEPS

SEQ ID NO: 3312298 - protein, 5 aa, Plasmodium falciparum
FTGTP

SEQ ID NO: 3312299 - protein, 4 aa, Plasmodium falciparum
FTKD

SEQ ID NO: 3312300 - protein, 7 aa, Plasmodium falciparum
FTKEDPT

SEQ ID NO: 3312301 - protein, 4 aa, Plasmodium falciparum
FTKQ

SEQ ID NO: 3312302 - protein, 6 aa, Plasmodium falciparum
FTKSRK

SEQ ID NO: 3312303 - protein, 7 aa, Plasmodium falciparum
FTNDEKK

SEQ ID NO: 3312304 - protein, 7 aa, Plasmodium falciparum
FTNDKEK

SEQ ID NO: 3312305 - protein, 12 aa, Plasmodium falciparum
FTNEYKSNNVNT

SEQ ID NO: 3312306 - protein, 45 aa, Plasmodium falciparum
FTNFSSSSSFNMSNNNNNNNNNSNNNNNNNNNNNYNNNNNNNNHT

SEQ ID NO: 3312307 - protein, 26 aa, Plasmodium falciparum
FTNNNNNNDNNNNNNNNNNSDGHYDD

SEQ ID NO: 3312308 - protein, 4 aa, Plasmodium falciparum
FTNQ

SEQ ID NO: 3312309 - protein, 8 aa, Plasmodium falciparum
FTPDTNNY

SEQ ID NO: 3312310 - protein, 12 aa, Plasmodium falciparum
FTPNFEKKTGSI

SEQ ID NO: 3312311 - protein, 6 aa, Plasmodium falciparum
FTQEDN

SEQ ID NO: 3312312 - protein, 5 aa, Plasmodium falciparum
FTQKQ

SEQ ID NO: 3312313 - protein, 26 aa, Plasmodium falciparum
FTQNNNDNMNTNEDNNNNNNNNNNGV

SEQ ID NO: 3312314 - protein, 25 aa, Plasmodium falciparum
FTSDQSANYFSEDEEEDDDDYYDDD

SEQ ID NO: 3312315 - protein, 19 aa, Plasmodium falciparum
FTSEKNQKINDEENNSKEL

SEQ ID NO: 3312316 - protein, 4 aa, Plasmodium falciparum
FTSN

SEQ ID NO: 3312317 - protein, 15 aa, Plasmodium falciparum
FTSNDDEEQRKSYDK

SEQ ID NO: 3312318 - protein, 6 aa, Plasmodium falciparum
FTSNYE

SEQ ID NO: 3312319 - protein, 14 aa, Plasmodium falciparum
FTSPSGKRRGGKYT

SEQ ID NO: 3312320 - protein, 6 aa, Plasmodium falciparum
FTSTQE

SEQ ID NO: 3312321 - protein, 11 aa, Plasmodium falciparum
FTTKDNKRETY

SEQ ID NO: 3312322 - protein, 4 aa, Plasmodium falciparum
FTTL

SEQ ID NO: 3312323 - protein, 5 aa, Plasmodium falciparum
FTTTA

SEQ ID NO: 3312324 - protein, 4 aa, Plasmodium falciparum
FVNS

SEQ ID NO: 3312325 - protein, 5 aa, Plasmodium falciparum
FVTSA

SEQ ID NO: 3312326 - protein, 4 aa, Plasmodium falciparum
FYDS

SEQ ID NO: 3312327 - protein, 6 aa, Plasmodium falciparum
FYGDEN

SEQ ID NO: 3312328 - protein, 4 aa, Plasmodium falciparum
FYKS

SEQ ID NO: 3312329 - protein, 7 aa, Plasmodium falciparum
FYNDRKD

SEQ ID NO: 3312330 - protein, 9 aa, Plasmodium falciparum
FYNSENKTY

SEQ ID NO: 3312331 - protein, 13 aa, Plasmodium falciparum
FYNTTKKKGYSFS

SEQ ID NO: 3312332 - protein, 25 aa, Plasmodium falciparum
FYRNKPSSNIINNDDDKKKKMVPSK

SEQ ID NO: 3312333 - protein, 6 aa, Plasmodium falciparum
GAAANK

SEQ ID NO: 3312334 - protein, 7 aa, Plasmodium falciparum
GADNINN

SEQ ID NO: 3312335 - protein, 6 aa, Plasmodium falciparum
GADPNY

SEQ ID NO: 3312336 - protein, 6 aa, Plasmodium falciparum
GADPSY

SEQ ID NO: 3312337 - protein, 4 aa, Plasmodium falciparum
GADT

SEQ ID NO: 3312338 - protein, 9 aa, Plasmodium falciparum
GAESGPTIE

SEQ ID NO: 3312339 - protein, 7 aa, Plasmodium falciparum
GAGDMGN

SEQ ID NO: 3312340 - protein, 7 aa, Plasmodium falciparum
GAGDNSN

SEQ ID NO: 3312341 - protein, 7 aa, Plasmodium falciparum
GAGEKPC

SEQ ID NO: 3312342 - protein, 11 aa, Plasmodium falciparum
GAGISGQSVHQ

SEQ ID NO: 3312343 - protein, 25 aa, Plasmodium falciparum
GAGNGYIPSGRTNNTNENQAPRTIE

SEQ ID NO: 3312344 - protein, 8 aa, Plasmodium falciparum
GAGQNDMP

SEQ ID NO: 3312345 - protein, 15 aa, Plasmodium falciparum
GAGRALSRNKSRNTL

SEQ ID NO: 3312346 - protein, 5 aa, Plasmodium falciparum
GAGSI

SEQ ID NO: 3312347 - protein, 5 aa, Plasmodium falciparum
GAGTT

SEQ ID NO: 3312348 - protein, 19 aa, Plasmodium falciparum
GAHGGGAFSGKDASKVDRS

SEQ ID NO: 3312349 - protein, 11 aa, Plasmodium falciparum
GAHTPKERITN

SEQ ID NO: 3312350 - protein, 8 aa, Plasmodium falciparum
GAKDGFGQ

SEQ ID NO: 3312351 - protein, 11 aa, Plasmodium falciparum
GAKDGKGRGKQ

SEQ ID NO: 3312352 - protein, 6 aa, Plasmodium falciparum
GAKEGD

SEQ ID NO: 3312353 - protein, 6 aa, Plasmodium falciparum
GAKGNI

SEQ ID NO: 3312354 - protein, 7 aa, Plasmodium falciparum
GAKGTGK

SEQ ID NO: 3312355 - protein, 22 aa, Plasmodium falciparum
GAKKKKKKVYKKPKKEKHKKKK

SEQ ID NO: 3312356 - protein, 16 aa, Plasmodium falciparum
GAKNPSIIESQNSPRN

SEQ ID NO: 3312357 - protein, 8 aa, Plasmodium falciparum
GAKNQVKG

SEQ ID NO: 3312358 - protein, 5 aa, Plasmodium falciparum
GANAR

SEQ ID NO: 3312359 - protein, 7 aa, Plasmodium falciparum
GANATNN

SEQ ID NO: 3312360 - protein, 45 aa, Plasmodium falciparum
GANDEYKYEDGDNLERKKRSSKKDKKKKKNKLKEKKNKRKRKRRK

SEQ ID NO: 3312361 - protein, 52 aa, Plasmodium falciparum
GANEREDDSTNRNYNNGKSSNEEENEGTPADNEDENDDSNNSNNSNQEQKEK

SEQ ID NO: 3312362 - protein, 9 aa, Plasmodium falciparum
GANNPYPSS

SEQ ID NO: 3312363 - protein, 6 aa, Plasmodium falciparum
GANPNL

SEQ ID NO: 3312364 - protein, 4 aa, Plasmodium falciparum
GANR

SEQ ID NO: 3312365 - protein, 7 aa, Plasmodium falciparum
GANTSFR

SEQ ID NO: 3312366 - protein, 16 aa, Plasmodium falciparum
GAPAGPAGTGKTETVK

SEQ ID NO: 3312367 - protein, 9 aa, Plasmodium falciparum
GAPDTEGSI

SEQ ID NO: 3312368 - protein, 9 aa, Plasmodium falciparum
GAPNVGTTY

SEQ ID NO: 3312369 - protein, 6 aa, Plasmodium falciparum
GAPQKR

SEQ ID NO: 3312370 - protein, 15 aa, Plasmodium falciparum
GAPTNDEKYNNNNNN

SEQ ID NO: 3312371 - protein, 6 aa, Plasmodium falciparum
GAPTTK

SEQ ID NO: 3312372 - protein, 9 aa, Plasmodium falciparum
GAQEDKGEI

SEQ ID NO: 3312373 - protein, 9 aa, Plasmodium falciparum
GAQKNNDSL

SEQ ID NO: 3312374 - protein, 6 aa, Plasmodium falciparum
GAQSSI

SEQ ID NO: 3312375 - protein, 6 aa, Plasmodium falciparum
GARDIK

SEQ ID NO: 3312376 - protein, 14 aa, Plasmodium falciparum
GARRREKKNMQREM

SEQ ID NO: 3312377 - protein, 7 aa, Plasmodium falciparum
GASAHSQ

SEQ ID NO: 3312378 - protein, 35 aa, Plasmodium falciparum
GASAQEPQKAEATNLRGRNSENKEAQNNGPTVEEV

SEQ ID NO: 3312379 - protein, 10 aa, Plasmodium falciparum
GASDRQRDDD

SEQ ID NO: 3312380 - protein, 10 aa, Plasmodium falciparum
GASEGRGRGR

SEQ ID NO: 3312381 - protein, 5 aa, Plasmodium falciparum
GASID

SEQ ID NO: 3312382 - protein, 8 aa, Plasmodium falciparum
GASIDGAS

SEQ ID NO: 3312383 - protein, 7 aa, Plasmodium falciparum
GASMQSA

SEQ ID NO: 3312384 - protein, 7 aa, Plasmodium falciparum
GASNEKH

SEQ ID NO: 3312385 - protein, 32 aa, Plasmodium falciparum
GASNNKEAGIRNKKNKKKNNNRKSDINENEES

SEQ ID NO: 3312386 - protein, 5 aa, Plasmodium falciparum
GASPS

SEQ ID NO: 3312387 - protein, 11 aa, Plasmodium falciparum
GASSASNSLSH

SEQ ID NO: 3312388 - protein, 7 aa, Plasmodium falciparum
GASTGRL

SEQ ID NO: 3312389 - protein, 6 aa, Plasmodium falciparum
GASTTL

SEQ ID NO: 3312390 - protein, 7 aa, Plasmodium falciparum
GATESNN

SEQ ID NO: 3312391 - protein, 11 aa, Plasmodium falciparum
GATNIGNGKNK

SEQ ID NO: 3312392 - protein, 16 aa, Plasmodium falciparum
GATRSFSNTKSFNEQN

SEQ ID NO: 3312393 - protein, 6 aa, Plasmodium falciparum
GATTTI

SEQ ID NO: 3312394 - protein, 11 aa, Plasmodium falciparum
GAVRTNPVSSE

SEQ ID NO: 3312395 - protein, 46 aa, Plasmodium falciparum
GCDDTKSDDSKDKNINTKRTTSPKHYTTTNNNDDDANNDSSCTSNN

SEQ ID NO: 3312396 - protein, 5 aa, Plasmodium falciparum
GCEEA

SEQ ID NO: 3312397 - protein, 5 aa, Plasmodium falciparum
GCEEM

SEQ ID NO: 3312398 - protein, 14 aa, Plasmodium falciparum
GCEKSTADARASDK

SEQ ID NO: 3312399 - protein, 5 aa, Plasmodium falciparum
GCESV

SEQ ID NO: 3312400 - protein, 5 aa, Plasmodium falciparum
GCGKS

SEQ ID NO: 3312401 - protein, 5 aa, Plasmodium falciparum
GCGKT

SEQ ID NO: 3312402 - protein, 10 aa, Plasmodium falciparum
GCGNNDIPKR

SEQ ID NO: 3312403 - protein, 4 aa, Plasmodium falciparum
GCGT

SEQ ID NO: 3312404 - protein, 8 aa, Plasmodium falciparum
GCKGNNSI

SEQ ID NO: 3312405 - protein, 7 aa, Plasmodium falciparum
GCKQNTS

SEQ ID NO: 3312406 - protein, 11 aa, Plasmodium falciparum
GCNKSDDSSMI

SEQ ID NO: 3312407 - protein, 10 aa, Plasmodium falciparum
GCRKKNDPFT

SEQ ID NO: 3312408 - protein, 11 aa, Plasmodium falciparum
GCTKKSSIEKN

SEQ ID NO: 3312409 - protein, 19 aa, Plasmodium falciparum
GDAASGDVEAADVEGAGVE

SEQ ID NO: 3312410 - protein, 10 aa, Plasmodium falciparum
GDANTQGIDP

SEQ ID NO: 3312411 - protein, 9 aa, Plasmodium falciparum
GDASQDVNN

SEQ ID NO: 3312412 - protein, 106 aa, Plasmodium falciparum
GDDDKKKKSTSKSRKHSKHSDADDNRYDKGYRKYRKSSSSYKSFKRDKRKSTNSSNDKDIDEEDYNSGVSSIDNNDNSDTYISSSKYNSNNMSSRTSKNKDETYEI

SEQ ID NO: 3312413 - protein, 45 aa, Plasmodium falciparum
GDDFEDDGNGNNNNNNNNNNNNNSNNSNNNNNNNKDEVSDEGNKN

SEQ ID NO: 3312414 - protein, 85 aa, Plasmodium falciparum
GDDGGDGNEEEENEENNNNEDKDNNENDEEGDVQGEGEGEGEGDEEKTADTDKEKPKKSSTSTQKKKGSVSSTISKKSVKKSNKV

SEQ ID NO: 3312415 - protein, 20 aa, Plasmodium falciparum
GDDKNKRDKSYTCSHKNNTN

SEQ ID NO: 3312416 - protein, 20 aa, Plasmodium falciparum
GDDKREDDVDSHDREGSLNK

SEQ ID NO: 3312417 - protein, 15 aa, Plasmodium falciparum
GDDNCTDINSKEQKD

SEQ ID NO: 3312418 - protein, 7 aa, Plasmodium falciparum
GDDNMEG

SEQ ID NO: 3312419 - protein, 11 aa, Plasmodium falciparum
GDDTESDNSFN

SEQ ID NO: 3312420 - protein, 6 aa, Plasmodium falciparum
GDDTSM

SEQ ID NO: 3312421 - protein, 9 aa, Plasmodium falciparum
GDEAQNKRG

SEQ ID NO: 3312422 - protein, 9 aa, Plasmodium falciparum
GDEAQTKRG

SEQ ID NO: 3312423 - protein, 10 aa, Plasmodium falciparum
GDEDKKSIKI

SEQ ID NO: 3312424 - protein, 7 aa, Plasmodium falciparum
GDEEDDI

SEQ ID NO: 3312425 - protein, 88 aa, Plasmodium falciparum
GDEEENKKESNNNDGDKGDHISDDKGDHMSDDKGDHKDDDKGDHMSDDKGDHKDDDKGDHMSDDKGDHKDDDKGDHMSDDKDKSNVNL

SEQ ID NO: 3312426 - protein, 7 aa, Plasmodium falciparum
GDEEQRK

SEQ ID NO: 3312427 - protein, 11 aa, Plasmodium falciparum
GDEGCGESIPG

SEQ ID NO: 3312428 - protein, 9 aa, Plasmodium falciparum
GDEKNKKIN

SEQ ID NO: 3312429 - protein, 9 aa, Plasmodium falciparum
GDEKTKDTL

SEQ ID NO: 3312430 - protein, 7 aa, Plasmodium falciparum
GDENKKT

SEQ ID NO: 3312431 - protein, 5 aa, Plasmodium falciparum
GDENM

SEQ ID NO: 3312432 - protein, 7 aa, Plasmodium falciparum
GDEPPFT

SEQ ID NO: 3312433 - protein, 5 aa, Plasmodium falciparum
GDETD

SEQ ID NO: 3312434 - protein, 4 aa, Plasmodium falciparum
GDFA

SEQ ID NO: 3312435 - protein, 7 aa, Plasmodium falciparum
GDFIKPN

SEQ ID NO: 3312436 - protein, 94 aa, Plasmodium falciparum
GDFPGGMPGGMPGGMPGGMPGGFPGGFPGGMPGGMPGGFPGGMPGGMPGGMPGGMPGGMPGGMPSGMPGGMPSGMPGGMPGGMPGGMPDLNSPE

SEQ ID NO: 3312437 - protein, 12 aa, Plasmodium falciparum
GDFPPNAEKGKS

SEQ ID NO: 3312438 - protein, 13 aa, Plasmodium falciparum
GDFSGSKNYGSYE

SEQ ID NO: 3312439 - protein, 6 aa, Plasmodium falciparum
GDGIHK

SEQ ID NO: 3312440 - protein, 16 aa, Plasmodium falciparum
GDGKAYKGTVESLKEN

SEQ ID NO: 3312441 - protein, 5 aa, Plasmodium falciparum
GDGNC

SEQ ID NO: 3312442 - protein, 9 aa, Plasmodium falciparum
GDGNDCEEA

SEQ ID NO: 3312443 - protein, 7 aa, Plasmodium falciparum
GDGNNIH

SEQ ID NO: 3312444 - protein, 5 aa, Plasmodium falciparum
GDGPK

SEQ ID NO: 3312445 - protein, 21 aa, Plasmodium falciparum
GDGSGTQALKRSKRSKSNSKY

SEQ ID NO: 3312446 - protein, 8 aa, Plasmodium falciparum
GDGSNSNA

SEQ ID NO: 3312447 - protein, 9 aa, Plasmodium falciparum
GDGSSSEGD

SEQ ID NO: 3312448 - protein, 4 aa, Plasmodium falciparum
GDGT

SEQ ID NO: 3312449 - protein, 5 aa, Plasmodium falciparum
GDGTY

SEQ ID NO: 3312450 - protein, 5 aa, Plasmodium falciparum
GDHQK

SEQ ID NO: 3312451 - protein, 8 aa, Plasmodium falciparum
GDHTNTGL

SEQ ID NO: 3312452 - protein, 9 aa, Plasmodium falciparum
GDIKNYSKG

SEQ ID NO: 3312453 - protein, 5 aa, Plasmodium falciparum
GDINN

SEQ ID NO: 3312454 - protein, 47 aa, Plasmodium falciparum
GDINNENKNNDNKNKNNDNKNKNNDNKNKNNDNKNKNNDNIHNNNHN

SEQ ID NO: 3312455 - protein, 4 aa, Plasmodium falciparum
GDIS

SEQ ID NO: 3312456 - protein, 28 aa, Plasmodium falciparum
GDITGKTNMTTNNFSNNTTNDEGYTNEE

SEQ ID NO: 3312457 - protein, 13 aa, Plasmodium falciparum
GDITNNNRNGGDV

SEQ ID NO: 3312458 - protein, 14 aa, Plasmodium falciparum
GDKDPSDSNLPQQP

SEQ ID NO: 3312459 - protein, 10 aa, Plasmodium falciparum
GDKDSHAEEE

SEQ ID NO: 3312460 - protein, 24 aa, Plasmodium falciparum
GDKEKIKKKEENDADNNTKQNLNE

SEQ ID NO: 3312461 - protein, 4 aa, Plasmodium falciparum
GDKG

SEQ ID NO: 3312462 - protein, 4 aa, Plasmodium falciparum
GDKI

SEQ ID NO: 3312463 - protein, 9 aa, Plasmodium falciparum
GDKIGEENH

SEQ ID NO: 3312464 - protein, 4 aa, Plasmodium falciparum
GDKK

SEQ ID NO: 3312465 - protein, 9 aa, Plasmodium falciparum
GDKKEQTND

SEQ ID NO: 3312466 - protein, 4 aa, Plasmodium falciparum
GDKM

SEQ ID NO: 3312467 - protein, 8 aa, Plasmodium falciparum
GDKNDKTF

SEQ ID NO: 3312468 - protein, 11 aa, Plasmodium falciparum
GDKPEDIKEDH

SEQ ID NO: 3312469 - protein, 9 aa, Plasmodium falciparum
GDKQQRERD

SEQ ID NO: 3312470 - protein, 4 aa, Plasmodium falciparum
GDKR

SEQ ID NO: 3312471 - protein, 7 aa, Plasmodium falciparum
GDKRNNV

SEQ ID NO: 3312472 - protein, 7 aa, Plasmodium falciparum
GDKYEGE

SEQ ID NO: 3312473 - protein, 10 aa, Plasmodium falciparum
GDKYNEKKDD

SEQ ID NO: 3312474 - protein, 11 aa, Plasmodium falciparum
GDLKKDGPSAG

SEQ ID NO: 3312475 - protein, 4 aa, Plasmodium falciparum
GDLN

SEQ ID NO: 3312476 - protein, 6 aa, Plasmodium falciparum
GDLQKQ

SEQ ID NO: 3312477 - protein, 7 aa, Plasmodium falciparum
GDMDRQA

SEQ ID NO: 3312478 - protein, 7 aa, Plasmodium falciparum
GDMHSQN

SEQ ID NO: 3312479 - protein, 5 aa, Plasmodium falciparum
GDMNP

SEQ ID NO: 3312480 - protein, 8 aa, Plasmodium falciparum
GDNDDMDD

SEQ ID NO: 3312481 - protein, 4 aa, Plasmodium falciparum
GDNE

SEQ ID NO: 3312482 - protein, 8 aa, Plasmodium falciparum
GDNETRKF

SEQ ID NO: 3312483 - protein, 7 aa, Plasmodium falciparum
GDNIGSS

SEQ ID NO: 3312484 - protein, 14 aa, Plasmodium falciparum
GDNIKKSKENKRVE

SEQ ID NO: 3312485 - protein, 12 aa, Plasmodium falciparum
GDNIKRDDNEYV

SEQ ID NO: 3312486 - protein, 41 aa, Plasmodium falciparum
GDNKNDNNNNNNNNNNNDGNNNATTINNNNNNNNNITNNSN

SEQ ID NO: 3312487 - protein, 26 aa, Plasmodium falciparum
GDNKVRNVKKQTNKYNNVDNNKNNYY

SEQ ID NO: 3312488 - protein, 24 aa, Plasmodium falciparum
GDNMENEKYQQNEQNDGSPKNVES

SEQ ID NO: 3312489 - protein, 19 aa, Plasmodium falciparum
GDNMSRDEFDDKRKLKEEK

SEQ ID NO: 3312490 - protein, 4 aa, Plasmodium falciparum
GDNN

SEQ ID NO: 3312491 - protein, 8 aa, Plasmodium falciparum
GDNNDLGT

SEQ ID NO: 3312492 - protein, 9 aa, Plasmodium falciparum
GDNNEDDDL

SEQ ID NO: 3312493 - protein, 5 aa, Plasmodium falciparum
GDNNI

SEQ ID NO: 3312494 - protein, 87 aa, Plasmodium falciparum
GDNNINGDNNINGDNNINGENNINGENNINGENNINGENNINGENNINGENNINGENNINGDNNINGDNKKNGDNNNNNMEEGDETK

SEQ ID NO: 3312495 - protein, 14 aa, Plasmodium falciparum
GDNNKKNIENDPNV

SEQ ID NO: 3312496 - protein, 17 aa, Plasmodium falciparum
GDNNKNDDKCDDKCDDK

SEQ ID NO: 3312497 - protein, 19 aa, Plasmodium falciparum
GDNNKNVTSHGESRDIQNK

SEQ ID NO: 3312498 - protein, 7 aa, Plasmodium falciparum
GDNNMNN

SEQ ID NO: 3312499 - protein, 13 aa, Plasmodium falciparum
GDNNNNNNRRDQF

SEQ ID NO: 3312500 - protein, 12 aa, Plasmodium falciparum
GDNNNNNSSSSS

SEQ ID NO: 3312501 - protein, 27 aa, Plasmodium falciparum
GDNNQEHVGKDDECYNKNEENNFRKNT

SEQ ID NO: 3312502 - protein, 9 aa, Plasmodium falciparum
GDNNTSDRM

SEQ ID NO: 3312503 - protein, 8 aa, Plasmodium falciparum
GDNQTSHL

SEQ ID NO: 3312504 - protein, 6 aa, Plasmodium falciparum
GDNTND

SEQ ID NO: 3312505 - protein, 8 aa, Plasmodium falciparum
GDNTNDNN

SEQ ID NO: 3312506 - protein, 9 aa, Plasmodium falciparum
GDNTNVGKL

SEQ ID NO: 3312507 - protein, 5 aa, Plasmodium falciparum
GDNVN

SEQ ID NO: 3312508 - protein, 4 aa, Plasmodium falciparum
GDNY

SEQ ID NO: 3312509 - protein, 8 aa, Plasmodium falciparum
GDNYTEEA

SEQ ID NO: 3312510 - protein, 11 aa, Plasmodium falciparum
GDPGAGKRSIE

SEQ ID NO: 3312511 - protein, 5 aa, Plasmodium falciparum
GDPHT

SEQ ID NO: 3312512 - protein, 4 aa, Plasmodium falciparum
GDPL

SEQ ID NO: 3312513 - protein, 9 aa, Plasmodium falciparum
GDPNFSGSK

SEQ ID NO: 3312514 - protein, 12 aa, Plasmodium falciparum
GDPSGDGTGGES

SEQ ID NO: 3312515 - protein, 41 aa, Plasmodium falciparum
GDQKNDDMSDDSNSCDDKGNDKNGDSIDSTDKKKGSKCDSE

SEQ ID NO: 3312516 - protein, 7 aa, Plasmodium falciparum
GDQSPFK

SEQ ID NO: 3312517 - protein, 19 aa, Plasmodium falciparum
GDRETEGKNDINSDNENKV

SEQ ID NO: 3312518 - protein, 8 aa, Plasmodium falciparum
GDSAKTSC

SEQ ID NO: 3312519 - protein, 5 aa, Plasmodium falciparum
GDSKG

SEQ ID NO: 3312520 - protein, 14 aa, Plasmodium falciparum
GDSKGNIVFWRRSF

SEQ ID NO: 3312521 - protein, 15 aa, Plasmodium falciparum
GDSKKTGKVGSDIQN

SEQ ID NO: 3312522 - protein, 9 aa, Plasmodium falciparum
GDSKSFSRK

SEQ ID NO: 3312523 - protein, 15 aa, Plasmodium falciparum
GDSKYPKSGNNKYYD

SEQ ID NO: 3312524 - protein, 7 aa, Plasmodium falciparum
GDSNLPE

SEQ ID NO: 3312525 - protein, 6 aa, Plasmodium falciparum
GDSNYS

SEQ ID NO: 3312526 - protein, 6 aa, Plasmodium falciparum
GDSSSA

SEQ ID NO: 3312527 - protein, 7 aa, Plasmodium falciparum
GDSYKNW

SEQ ID NO: 3312528 - protein, 9 aa, Plasmodium falciparum
GDTANQETD

SEQ ID NO: 3312529 - protein, 13 aa, Plasmodium falciparum
GDTCTHDNKTYKK

SEQ ID NO: 3312530 - protein, 7 aa, Plasmodium falciparum
GDTDEEK

SEQ ID NO: 3312531 - protein, 7 aa, Plasmodium falciparum
GDTDNEV

SEQ ID NO: 3312532 - protein, 14 aa, Plasmodium falciparum
GDTENNISNNKITP

SEQ ID NO: 3312533 - protein, 8 aa, Plasmodium falciparum
GDTGEIKN

SEQ ID NO: 3312534 - protein, 12 aa, Plasmodium falciparum
GDTGVGKSETIK

SEQ ID NO: 3312535 - protein, 19 aa, Plasmodium falciparum
GDTHKSYEEKNVESDQLDE

SEQ ID NO: 3312536 - protein, 5 aa, Plasmodium falciparum
GDTNE

SEQ ID NO: 3312537 - protein, 10 aa, Plasmodium falciparum
GDTNHNEENF

SEQ ID NO: 3312538 - protein, 63 aa, Plasmodium falciparum
GDTNSDDENDYDEDNNHNNNHNNNHNNNHNNYHNNNHNNNHNYNHNNNHNNYHNNNQNKYDNR

SEQ ID NO: 3312539 - protein, 19 aa, Plasmodium falciparum
GDTRSSSSDKYPLSSTKQD

SEQ ID NO: 3312540 - protein, 4 aa, Plasmodium falciparum
GDTT

SEQ ID NO: 3312541 - protein, 116 aa, Plasmodium falciparum
GDVGKTDMKSKNHTNDKNGDSVKNDDSFKNDDSFKNDDSVKNGDSVKNDDSAKNDDRVKNGDSVKNGDSVKNGDSVKNDDIYKNDDRVKNDDNYKNDDNVINDDSVKNDKNNTSDH

SEQ ID NO: 3312542 - protein, 9 aa, Plasmodium falciparum
GDVKSDKDF

SEQ ID NO: 3312543 - protein, 9 aa, Plasmodium falciparum
GDVLEPSGN

SEQ ID NO: 3312544 - protein, 6 aa, Plasmodium falciparum
GDVPRS

SEQ ID NO: 3312545 - protein, 9 aa, Plasmodium falciparum
GDVSNNKTV

SEQ ID NO: 3312546 - protein, 6 aa, Plasmodium falciparum
GDYEEN

SEQ ID NO: 3312547 - protein, 4 aa, Plasmodium falciparum
GDYK

SEQ ID NO: 3312548 - protein, 4 aa, Plasmodium falciparum
GDYV

SEQ ID NO: 3312549 - protein, 4 aa, Plasmodium falciparum
GDYY

SEQ ID NO: 3312550 - protein, 6 aa, Plasmodium falciparum
GEAEAN

SEQ ID NO: 3312551 - protein, 4 aa, Plasmodium falciparum
GEAK

SEQ ID NO: 3312552 - protein, 6 aa, Plasmodium falciparum
GEARDD

SEQ ID NO: 3312553 - protein, 5 aa, Plasmodium falciparum
GEARG

SEQ ID NO: 3312554 - protein, 6 aa, Plasmodium falciparum
GEATKM

SEQ ID NO: 3312555 - protein, 5 aa, Plasmodium falciparum
GECYE

SEQ ID NO: 3312556 - protein, 16 aa, Plasmodium falciparum
GEDDDKKNTSDNDLTS

SEQ ID NO: 3312557 - protein, 23 aa, Plasmodium falciparum
GEDDQNECKKKNKVNNHNNNNNL

SEQ ID NO: 3312558 - protein, 5 aa, Plasmodium falciparum
GEDGD

SEQ ID NO: 3312559 - protein, 8 aa, Plasmodium falciparum
GEDKPRDI

SEQ ID NO: 3312560 - protein, 7 aa, Plasmodium falciparum
GEDNDNI

SEQ ID NO: 3312561 - protein, 11 aa, Plasmodium falciparum
GEDNNKINEKT

SEQ ID NO: 3312562 - protein, 17 aa, Plasmodium falciparum
GEDQNLNEEEYERTYEQ

SEQ ID NO: 3312563 - protein, 7 aa, Plasmodium falciparum
GEDSAEK

SEQ ID NO: 3312564 - protein, 21 aa, Plasmodium falciparum
GEDSNQNKSNSKKKKEKKTGY

SEQ ID NO: 3312565 - protein, 4 aa, Plasmodium falciparum
GEDY

SEQ ID NO: 3312566 - protein, 11 aa, Plasmodium falciparum
GEEDESEKIKK

SEQ ID NO: 3312567 - protein, 5 aa, Plasmodium falciparum
GEEDY

SEQ ID NO: 3312568 - protein, 4 aa, Plasmodium falciparum
GEEE

SEQ ID NO: 3312569 - protein, 22 aa, Plasmodium falciparum
GEEEEEGENKKKKKKKKKKNTL

SEQ ID NO: 3312570 - protein, 9 aa, Plasmodium falciparum
GEEEGCKGE

SEQ ID NO: 3312571 - protein, 4 aa, Plasmodium falciparum
GEEG

SEQ ID NO: 3312572 - protein, 12 aa, Plasmodium falciparum
GEEGPRNATTTN

SEQ ID NO: 3312573 - protein, 34 aa, Plasmodium falciparum
GEEIPDDSMSSSNISSSNMSSSNKSSHNSATSYD

SEQ ID NO: 3312574 - protein, 5 aa, Plasmodium falciparum
GEEKA

SEQ ID NO: 3312575 - protein, 29 aa, Plasmodium falciparum
GEEKKGKANLDTTYKNYDNNDNYNNYDNY

SEQ ID NO: 3312576 - protein, 10 aa, Plasmodium falciparum
GEEKKTEDNI

SEQ ID NO: 3312577 - protein, 12 aa, Plasmodium falciparum
GEENDDNNSAQC

SEQ ID NO: 3312578 - protein, 17 aa, Plasmodium falciparum
GEERKSRCTGQNRASSV

SEQ ID NO: 3312579 - protein, 9 aa, Plasmodium falciparum
GEESKEDIK

SEQ ID NO: 3312580 - protein, 7 aa, Plasmodium falciparum
GEETDDY

SEQ ID NO: 3312581 - protein, 374 aa, Plasmodium falciparum
GEETKDDEKEDKEGTDDEEDTDDEEDTDDEEDTDDEEDTSDEETTGDQENKEETEVDEKKTEKAEEELEEDKEESEKDKEESEKDKEESEKDKEESEKDKEKTEEDEEKTEDEKGTEVYKKETDVDEKKEKGEYGEGTDDEEDKEKEEDDEETKVEEKKTEKDEEGTDYEEDTDDSDKDEETKVEEKKTERDEEETEEDEKETEVEKKKTEKDEEGTDYEEDTDDSDKDVETEVEETDAEDKEENEEGTDDEEDKVEETDLDDQEEDGEEDKEDDKEKDKEDDKEDDKEKDKEDDKEKYKEDDKEDDKEDDKEKDKEDNKEKDKEDNKEKDKEDDKEKDKEDDKEKDKEDNKEKDKEDNKEKDKEDDKEKHDKH

SEQ ID NO: 3312582 - protein, 76 aa, Plasmodium falciparum
GEETLNNDSKNKEAENKSNIKNNKSNQSNQSNKKTKNNNNNKNNNNNNNNNNNNNNNNNKNSTSNKKNSKNKKKVD

SEQ ID NO: 3312583 - protein, 13 aa, Plasmodium falciparum
GEFDEEKEGNQEM

SEQ ID NO: 3312584 - protein, 5 aa, Plasmodium falciparum
GEFGR

SEQ ID NO: 3312585 - protein, 21 aa, Plasmodium falciparum
GEFPHDKEKKKKKKNQKENSL

SEQ ID NO: 3312586 - protein, 6 aa, Plasmodium falciparum
GEGDGS

SEQ ID NO: 3312587 - protein, 5 aa, Plasmodium falciparum
GEGDQ

SEQ ID NO: 3312588 - protein, 21 aa, Plasmodium falciparum
GEGEELPSSDGESSDGSFGPV

SEQ ID NO: 3312589 - protein, 10 aa, Plasmodium falciparum
GEGKKEEINE

SEQ ID NO: 3312590 - protein, 53 aa, Plasmodium falciparum
GEGNDAEERQRQQREEEERRKKKEEEERKKKEEEEMKKQNRTPEQIQGDEHKL

SEQ ID NO: 3312591 - protein, 8 aa, Plasmodium falciparum
GEGNLNNP

SEQ ID NO: 3312592 - protein, 7 aa, Plasmodium falciparum
GEGSDEI

SEQ ID NO: 3312593 - protein, 5 aa, Plasmodium falciparum
GEHEY

SEQ ID NO: 3312594 - protein, 4 aa, Plasmodium falciparum
GEHG

SEQ ID NO: 3312595 - protein, 11 aa, Plasmodium falciparum
GEHGSTYGGNP

SEQ ID NO: 3312596 - protein, 5 aa, Plasmodium falciparum
GEHVN

SEQ ID NO: 3312597 - protein, 11 aa, Plasmodium falciparum
GEIEKKNSEIK

SEQ ID NO: 3312598 - protein, 17 aa, Plasmodium falciparum
GEIENNEDKEDEEGRKP

SEQ ID NO: 3312599 - protein, 6 aa, Plasmodium falciparum
GEINTP

SEQ ID NO: 3312600 - protein, 13 aa, Plasmodium falciparum
GEIPQAVDSKQDI

SEQ ID NO: 3312601 - protein, 11 aa, Plasmodium falciparum
GEKDIDEEADT

SEQ ID NO: 3312602 - protein, 4 aa, Plasmodium falciparum
GEKE

SEQ ID NO: 3312603 - protein, 11 aa, Plasmodium falciparum
GEKEEPLNEQQ

SEQ ID NO: 3312604 - protein, 13 aa, Plasmodium falciparum
GEKEKNPKGENGC

SEQ ID NO: 3312605 - protein, 8 aa, Plasmodium falciparum
GEKENAYK

SEQ ID NO: 3312606 - protein, 34 aa, Plasmodium falciparum
GEKENEKKSSTNDKKYDIANDENYKKLKEDKKRL

SEQ ID NO: 3312607 - protein, 10 aa, Plasmodium falciparum
GEKGCKQESY

SEQ ID NO: 3312608 - protein, 5 aa, Plasmodium falciparum
GEKGF

SEQ ID NO: 3312609 - protein, 7 aa, Plasmodium falciparum
GEKGIKR

SEQ ID NO: 3312610 - protein, 9 aa, Plasmodium falciparum
GEKGKKPGF

SEQ ID NO: 3312611 - protein, 4 aa, Plasmodium falciparum
GEKK

SEQ ID NO: 3312612 - protein, 13 aa, Plasmodium falciparum
GEKKKTEEKCVSN

SEQ ID NO: 3312613 - protein, 5 aa, Plasmodium falciparum
GEKKN

SEQ ID NO: 3312614 - protein, 22 aa, Plasmodium falciparum
GEKKNRNINYNNNNNNNNNNNM

SEQ ID NO: 3312615 - protein, 5 aa, Plasmodium falciparum
GEKKS

SEQ ID NO: 3312616 - protein, 11 aa, Plasmodium falciparum
GEKKSAARNIS

SEQ ID NO: 3312617 - protein, 14 aa, Plasmodium falciparum
GEKMNDKDDKNSYL

SEQ ID NO: 3312618 - protein, 4 aa, Plasmodium falciparum
GEKN

SEQ ID NO: 3312619 - protein, 59 aa, Plasmodium falciparum
GEKNDNQLNSKDGNNSPSKLNSNQNNNNNNNNNNKQKKKKKKNEKDNKLTKNVEDNDVN

SEQ ID NO: 3312620 - protein, 9 aa, Plasmodium falciparum
GEKNKMPEK

SEQ ID NO: 3312621 - protein, 10 aa, Plasmodium falciparum
GEKNNSDNIN

SEQ ID NO: 3312622 - protein, 9 aa, Plasmodium falciparum
GEKNSWGKE

SEQ ID NO: 3312623 - protein, 7 aa, Plasmodium falciparum
GEKSDNY

SEQ ID NO: 3312624 - protein, 17 aa, Plasmodium falciparum
GEKSEERLKYENKKNKK

SEQ ID NO: 3312625 - protein, 8 aa, Plasmodium falciparum
GEKTKEKK

SEQ ID NO: 3312626 - protein, 6 aa, Plasmodium falciparum
GELEDE

SEQ ID NO: 3312627 - protein, 8 aa, Plasmodium falciparum
GELENNNN

SEQ ID NO: 3312628 - protein, 4 aa, Plasmodium falciparum
GELG

SEQ ID NO: 3312629 - protein, 4 aa, Plasmodium falciparum
GELN

SEQ ID NO: 3312630 - protein, 117 aa, Plasmodium falciparum
GELNNEKVKKNETNDDKAKKNETYDDKAKKNETYDDKAKKNETYDDKAKKNETYDDKAKKNETYDDKAKKNETYDEKVKKNETYDEKVKKNETYDEKVKKNETYDEKVKKNEQKCED

SEQ ID NO: 3312631 - protein, 6 aa, Plasmodium falciparum
GELNPI

SEQ ID NO: 3312632 - protein, 9 aa, Plasmodium falciparum
GELPETAKI

SEQ ID NO: 3312633 - protein, 5 aa, Plasmodium falciparum
GELQK

SEQ ID NO: 3312634 - protein, 15 aa, Plasmodium falciparum
GEMKTGYSGECTPRY

SEQ ID NO: 3312635 - protein, 27 aa, Plasmodium falciparum
GEMQTSTNKYNSDSGIGVTAKTNTDIN

SEQ ID NO: 3312636 - protein, 7 aa, Plasmodium falciparum
GEMSEED

SEQ ID NO: 3312637 - protein, 8 aa, Plasmodium falciparum
GEMSPNHL

SEQ ID NO: 3312638 - protein, 9 aa, Plasmodium falciparum
GENDTEDDI

SEQ ID NO: 3312639 - protein, 14 aa, Plasmodium falciparum
GENDVSQNTMHKQD

SEQ ID NO: 3312640 - protein, 4 aa, Plasmodium falciparum
GENE

SEQ ID NO: 3312641 - protein, 6 aa, Plasmodium falciparum
GENEEK

SEQ ID NO: 3312642 - protein, 13 aa, Plasmodium falciparum
GENENFNDKGNSN

SEQ ID NO: 3312643 - protein, 19 aa, Plasmodium falciparum
GENESVKKEEGDSSNNSLY

SEQ ID NO: 3312644 - protein, 10 aa, Plasmodium falciparum
GENGREQKVE

SEQ ID NO: 3312645 - protein, 23 aa, Plasmodium falciparum
GENHLNSSSINPSSELNEKSDEL

SEQ ID NO: 3312646 - protein, 13 aa, Plasmodium falciparum
GENIYTKHESKIF

SEQ ID NO: 3312647 - protein, 6 aa, Plasmodium falciparum
GENKTR

SEQ ID NO: 3312648 - protein, 4 aa, Plasmodium falciparum
GENN

SEQ ID NO: 3312649 - protein, 33 aa, Plasmodium falciparum
GENNKPLSYNNKSTNSNNNMSENYHETDSPVQN

SEQ ID NO: 3312650 - protein, 11 aa, Plasmodium falciparum
GENNKTLDKEN

SEQ ID NO: 3312651 - protein, 10 aa, Plasmodium falciparum
GENNMKNSGD

SEQ ID NO: 3312652 - protein, 6 aa, Plasmodium falciparum
GENNNS

SEQ ID NO: 3312653 - protein, 9 aa, Plasmodium falciparum
GENNPDTKT

SEQ ID NO: 3312654 - protein, 11 aa, Plasmodium falciparum
GENNTNDDYKK

SEQ ID NO: 3312655 - protein, 18 aa, Plasmodium falciparum
GENTDDDTKLSKKKQKEV

SEQ ID NO: 3312656 - protein, 10 aa, Plasmodium falciparum
GENTGINDNQ

SEQ ID NO: 3312657 - protein, 6 aa, Plasmodium falciparum
GENVEK

SEQ ID NO: 3312658 - protein, 6 aa, Plasmodium falciparum
GEPINP

SEQ ID NO: 3312659 - protein, 4 aa, Plasmodium falciparum
GEPK

SEQ ID NO: 3312660 - protein, 7 aa, Plasmodium falciparum
GEPRKPF

SEQ ID NO: 3312661 - protein, 8 aa, Plasmodium falciparum
GEPSNTSD

SEQ ID NO: 3312662 - protein, 4 aa, Plasmodium falciparum
GEQE

SEQ ID NO: 3312663 - protein, 34 aa, Plasmodium falciparum
GEQEMNTDQNYMDSNEDNYVDSNTNNNFKNPTNN

SEQ ID NO: 3312664 - protein, 10 aa, Plasmodium falciparum
GEQENINKDN

SEQ ID NO: 3312665 - protein, 4 aa, Plasmodium falciparum
GEQF

SEQ ID NO: 3312666 - protein, 7 aa, Plasmodium falciparum
GEQIKSR

SEQ ID NO: 3312667 - protein, 4 aa, Plasmodium falciparum
GEQQ

SEQ ID NO: 3312668 - protein, 23 aa, Plasmodium falciparum
GEQQLTKKNKNIEQKDNVSNEEK

SEQ ID NO: 3312669 - protein, 15 aa, Plasmodium falciparum
GEQRNKGHHMNDDGS

SEQ ID NO: 3312670 - protein, 11 aa, Plasmodium falciparum
GERKKEIRGDN

SEQ ID NO: 3312671 - protein, 8 aa, Plasmodium falciparum
GERTREGN

SEQ ID NO: 3312672 - protein, 6 aa, Plasmodium falciparum
GESEKK

SEQ ID NO: 3312673 - protein, 7 aa, Plasmodium falciparum
GESEKSI

SEQ ID NO: 3312674 - protein, 8 aa, Plasmodium falciparum
GESELQPK

SEQ ID NO: 3312675 - protein, 18 aa, Plasmodium falciparum
GESFSEENHIGKAGDRYR

SEQ ID NO: 3312676 - protein, 12 aa, Plasmodium falciparum
GESGAGKTEATK

SEQ ID NO: 3312677 - protein, 13 aa, Plasmodium falciparum
GESGAGKTESSKQ

SEQ ID NO: 3312678 - protein, 12 aa, Plasmodium falciparum
GESGAGKTESTK

SEQ ID NO: 3312679 - protein, 11 aa, Plasmodium falciparum
GESGSGKTEAS

SEQ ID NO: 3312680 - protein, 10 aa, Plasmodium falciparum
GESGSRVTPV

SEQ ID NO: 3312681 - protein, 4 aa, Plasmodium falciparum
GESN

SEQ ID NO: 3312682 - protein, 10 aa, Plasmodium falciparum
GESSEGGANA

SEQ ID NO: 3312683 - protein, 10 aa, Plasmodium falciparum
GESTGTASEK

SEQ ID NO: 3312684 - protein, 5 aa, Plasmodium falciparum
GESYN

SEQ ID NO: 3312685 - protein, 8 aa, Plasmodium falciparum
GETDPTQV

SEQ ID NO: 3312686 - protein, 19 aa, Plasmodium falciparum
GETELHKSKKRKSSHLTSD

SEQ ID NO: 3312687 - protein, 17 aa, Plasmodium falciparum
GETNDEKNKEEQNRSYN

SEQ ID NO: 3312688 - protein, 8 aa, Plasmodium falciparum
GETPSNHN

SEQ ID NO: 3312689 - protein, 42 aa, Plasmodium falciparum
GETREYASNKGKNNNDDDNNNSYYSDAKSYTSESSDESYQGD

SEQ ID NO: 3312690 - protein, 4 aa, Plasmodium falciparum
GETS

SEQ ID NO: 3312691 - protein, 6 aa, Plasmodium falciparum
GEVGAS

SEQ ID NO: 3312692 - protein, 8 aa, Plasmodium falciparum
GEVPSSTL

SEQ ID NO: 3312693 - protein, 5 aa, Plasmodium falciparum
GEVSD

SEQ ID NO: 3312694 - protein, 4 aa, Plasmodium falciparum
GEVY

SEQ ID NO: 3312695 - protein, 8 aa, Plasmodium falciparum
GEVYTGTK

SEQ ID NO: 3312696 - protein, 4 aa, Plasmodium falciparum
GEYI

SEQ ID NO: 3312697 - protein, 14 aa, Plasmodium falciparum
GEYKKENDKNVIDT

SEQ ID NO: 3312698 - protein, 4 aa, Plasmodium falciparum
GEYL

SEQ ID NO: 3312699 - protein, 5 aa, Plasmodium falciparum
GEYTN

SEQ ID NO: 3312700 - protein, 13 aa, Plasmodium falciparum
GFDLPPDETEELN

SEQ ID NO: 3312701 - protein, 5 aa, Plasmodium falciparum
GFDQE

SEQ ID NO: 3312702 - protein, 5 aa, Plasmodium falciparum
GFDQT

SEQ ID NO: 3312703 - protein, 6 aa, Plasmodium falciparum
GFDSSE

SEQ ID NO: 3312704 - protein, 5 aa, Plasmodium falciparum
GFEES

SEQ ID NO: 3312705 - protein, 7 aa, Plasmodium falciparum
GFEGTKN

SEQ ID NO: 3312706 - protein, 4 aa, Plasmodium falciparum
GFGG

SEQ ID NO: 3312707 - protein, 9 aa, Plasmodium falciparum
GFKGENHYS

SEQ ID NO: 3312708 - protein, 55 aa, Plasmodium falciparum
GFNGGRGGGGGGRGGGGGGRGGGGGGRGGGGGRGGGGGRGNKDRKSFKKDNKSGK

SEQ ID NO: 3312709 - protein, 12 aa, Plasmodium falciparum
GFNNNNNNNNMN

SEQ ID NO: 3312710 - protein, 7 aa, Plasmodium falciparum
GFPREGG

SEQ ID NO: 3312711 - protein, 6 aa, Plasmodium falciparum
GFQGTE

SEQ ID NO: 3312712 - protein, 7 aa, Plasmodium falciparum
GFSSNGM

SEQ ID NO: 3312713 - protein, 5 aa, Plasmodium falciparum
GFTNE

SEQ ID NO: 3312714 - protein, 5 aa, Plasmodium falciparum
GGAGL

SEQ ID NO: 3312715 - protein, 4 aa, Plasmodium falciparum
GGAK

SEQ ID NO: 3312716 - protein, 9 aa, Plasmodium falciparum
GGANAGHTI

SEQ ID NO: 3312717 - protein, 15 aa, Plasmodium falciparum
GGAPQNGAAEDKKTE

SEQ ID NO: 3312718 - protein, 9 aa, Plasmodium falciparum
GGATEEEIT

SEQ ID NO: 3312719 - protein, 5 aa, Plasmodium falciparum
GGDDN

SEQ ID NO: 3312720 - protein, 6 aa, Plasmodium falciparum
GGDGNL

SEQ ID NO: 3312721 - protein, 7 aa, Plasmodium falciparum
GGDLNNE

SEQ ID NO: 3312722 - protein, 5 aa, Plasmodium falciparum
GGDNC

SEQ ID NO: 3312723 - protein, 7 aa, Plasmodium falciparum
GGDNFSE

SEQ ID NO: 3312724 - protein, 13 aa, Plasmodium falciparum
GGDNQGGNRKVSQ

SEQ ID NO: 3312725 - protein, 5 aa, Plasmodium falciparum
GGDNT

SEQ ID NO: 3312726 - protein, 15 aa, Plasmodium falciparum
GGDPTGTGKGGKSIY

SEQ ID NO: 3312727 - protein, 7 aa, Plasmodium falciparum
GGDRDGN

SEQ ID NO: 3312728 - protein, 5 aa, Plasmodium falciparum
GGDRG

SEQ ID NO: 3312729 - protein, 7 aa, Plasmodium falciparum
GGDSEEQ

SEQ ID NO: 3312730 - protein, 15 aa, Plasmodium falciparum
GGDSNEELVNNKGGT

SEQ ID NO: 3312731 - protein, 10 aa, Plasmodium falciparum
GGDSSNSNMN

SEQ ID NO: 3312732 - protein, 27 aa, Plasmodium falciparum
GGDTASLVEQQNKKNEISHVSTGGGAS

SEQ ID NO: 3312733 - protein, 23 aa, Plasmodium falciparum
GGDTQNYEHEEDAKHNEHNEYNE

SEQ ID NO: 3312734 - protein, 7 aa, Plasmodium falciparum
GGEITNN

SEQ ID NO: 3312735 - protein, 15 aa, Plasmodium falciparum
GGEKEGNLKEGEEEK

SEQ ID NO: 3312736 - protein, 9 aa, Plasmodium falciparum
GGELPTPDK

SEQ ID NO: 3312737 - protein, 7 aa, Plasmodium falciparum
GGENGEV

SEQ ID NO: 3312738 - protein, 7 aa, Plasmodium falciparum
GGESSGP

SEQ ID NO: 3312739 - protein, 7 aa, Plasmodium falciparum
GGESTTV

SEQ ID NO: 3312740 - protein, 14 aa, Plasmodium falciparum
GGETGGSSNGFTRE

SEQ ID NO: 3312741 - protein, 4 aa, Plasmodium falciparum
GGEV

SEQ ID NO: 3312742 - protein, 13 aa, Plasmodium falciparum
GGFSSSSSTFAKS

SEQ ID NO: 3312743 - protein, 5 aa, Plasmodium falciparum
GGGDG

SEQ ID NO: 3312744 - protein, 5 aa, Plasmodium falciparum
GGGDV

SEQ ID NO: 3312745 - protein, 12 aa, Plasmodium falciparum
GGGGEDIDKTSA

SEQ ID NO: 3312746 - protein, 7 aa, Plasmodium falciparum
GGGKGDL

SEQ ID NO: 3312747 - protein, 14 aa, Plasmodium falciparum
GGGKGPARGSEEKK

SEQ ID NO: 3312748 - protein, 13 aa, Plasmodium falciparum
GGGKKKKKKLQSN

SEQ ID NO: 3312749 - protein, 9 aa, Plasmodium falciparum
GGGKTSPKV

SEQ ID NO: 3312750 - protein, 4 aa, Plasmodium falciparum
GGGL

SEQ ID NO: 3312751 - protein, 54 aa, Plasmodium falciparum
GGGMDNKNVKGNSGNSERGINSSRTSTNNKNNNNNNHNHNSNSSSSIKTSEYDE

SEQ ID NO: 3312752 - protein, 8 aa, Plasmodium falciparum
GGGPTGVE

SEQ ID NO: 3312753 - protein, 13 aa, Plasmodium falciparum
GGGQERGLRSGTL

SEQ ID NO: 3312754 - protein, 7 aa, Plasmodium falciparum
GGGRTKG

SEQ ID NO: 3312755 - protein, 7 aa, Plasmodium falciparum
GGGSANK

SEQ ID NO: 3312756 - protein, 14 aa, Plasmodium falciparum
GGGSFSTGGPGKGM

SEQ ID NO: 3312757 - protein, 5 aa, Plasmodium falciparum
GGGSY

SEQ ID NO: 3312758 - protein, 5 aa, Plasmodium falciparum
GGHNN

SEQ ID NO: 3312759 - protein, 7 aa, Plasmodium falciparum
GGHNSNQ

SEQ ID NO: 3312760 - protein, 5 aa, Plasmodium falciparum
GGIDS

SEQ ID NO: 3312761 - protein, 14 aa, Plasmodium falciparum
GGIEENKNEKSNYS

SEQ ID NO: 3312762 - protein, 4 aa, Plasmodium falciparum
GGIG

SEQ ID NO: 3312763 - protein, 19 aa, Plasmodium falciparum
GGIKKKGKNENDREEEERK

SEQ ID NO: 3312764 - protein, 11 aa, Plasmodium falciparum
GGISGQSKAAR

SEQ ID NO: 3312765 - protein, 6 aa, Plasmodium falciparum
GGKDSS

SEQ ID NO: 3312766 - protein, 14 aa, Plasmodium falciparum
GGKDTDDKDSISNV

SEQ ID NO: 3312767 - protein, 6 aa, Plasmodium falciparum
GGKGCR

SEQ ID NO: 3312768 - protein, 7 aa, Plasmodium falciparum
GGKGGIS

SEQ ID NO: 3312769 - protein, 23 aa, Plasmodium falciparum
GGKIGTIGTTGDKDTRDTTPTVY

SEQ ID NO: 3312770 - protein, 7 aa, Plasmodium falciparum
GGKKTNQ

SEQ ID NO: 3312771 - protein, 7 aa, Plasmodium falciparum
GGKLSAD

SEQ ID NO: 3312772 - protein, 5 aa, Plasmodium falciparum
GGKNE

SEQ ID NO: 3312773 - protein, 9 aa, Plasmodium falciparum
GGKNISNKM

SEQ ID NO: 3312774 - protein, 5 aa, Plasmodium falciparum
GGKRE

SEQ ID NO: 3312775 - protein, 5 aa, Plasmodium falciparum
GGKST

SEQ ID NO: 3312776 - protein, 6 aa, Plasmodium falciparum
GGKTEE

SEQ ID NO: 3312777 - protein, 8 aa, Plasmodium falciparum
GGKVTDDL

SEQ ID NO: 3312778 - protein, 5 aa, Plasmodium falciparum
GGLKA

SEQ ID NO: 3312779 - protein, 9 aa, Plasmodium falciparum
GGLKNSNHN

SEQ ID NO: 3312780 - protein, 6 aa, Plasmodium falciparum
GGMNES

SEQ ID NO: 3312781 - protein, 23 aa, Plasmodium falciparum
GGMPGAGMPGNAPAGSGPTVEEV

SEQ ID NO: 3312782 - protein, 10 aa, Plasmodium falciparum
GGMSSNDGPF

SEQ ID NO: 3312783 - protein, 5 aa, Plasmodium falciparum
GGMTK

SEQ ID NO: 3312784 - protein, 6 aa, Plasmodium falciparum
GGNAQS

SEQ ID NO: 3312785 - protein, 6 aa, Plasmodium falciparum
GGNDGN

SEQ ID NO: 3312786 - protein, 8 aa, Plasmodium falciparum
GGNDKQGF

SEQ ID NO: 3312787 - protein, 4 aa, Plasmodium falciparum
GGNE

SEQ ID NO: 3312788 - protein, 8 aa, Plasmodium falciparum
GGNEFDEN

SEQ ID NO: 3312789 - protein, 12 aa, Plasmodium falciparum
GGNEKNENDEKF

SEQ ID NO: 3312790 - protein, 5 aa, Plasmodium falciparum
GGNFK

SEQ ID NO: 3312791 - protein, 7 aa, Plasmodium falciparum
GGNGGNV

SEQ ID NO: 3312792 - protein, 28 aa, Plasmodium falciparum
GGNKHSEEDLSNKNNIPIEENKKEINNK

SEQ ID NO: 3312793 - protein, 6 aa, Plasmodium falciparum
GGNKKE

SEQ ID NO: 3312794 - protein, 14 aa, Plasmodium falciparum
GGNKNTSTRGEDIQ

SEQ ID NO: 3312795 - protein, 35 aa, Plasmodium falciparum
GGNKSISNSNSNGHSNSISHSNSHSNSHSNGHSNN

SEQ ID NO: 3312796 - protein, 6 aa, Plasmodium falciparum
GGNPDH

SEQ ID NO: 3312797 - protein, 4 aa, Plasmodium falciparum
GGNY

SEQ ID NO: 3312798 - protein, 8 aa, Plasmodium falciparum
GGPAPGGH

SEQ ID NO: 3312799 - protein, 54 aa, Plasmodium falciparum
GGPEKNEKNEKNEKNEKNEKNEENEKNEKNEENEKNEKNEENEKNEKKENLPSN

SEQ ID NO: 3312800 - protein, 5 aa, Plasmodium falciparum
GGPEL

SEQ ID NO: 3312801 - protein, 5 aa, Plasmodium falciparum
GGPGA

SEQ ID NO: 3312802 - protein, 5 aa, Plasmodium falciparum
GGPGG

SEQ ID NO: 3312803 - protein, 16 aa, Plasmodium falciparum
GGPGGMASAKEAAAHG

SEQ ID NO: 3312804 - protein, 4 aa, Plasmodium falciparum
GGQD

SEQ ID NO: 3312805 - protein, 6 aa, Plasmodium falciparum
GGQERF

SEQ ID NO: 3312806 - protein, 6 aa, Plasmodium falciparum
GGQKMS

SEQ ID NO: 3312807 - protein, 6 aa, Plasmodium falciparum
GGQKSK

SEQ ID NO: 3312808 - protein, 13 aa, Plasmodium falciparum
GGQQARRKREVNN

SEQ ID NO: 3312809 - protein, 9 aa, Plasmodium falciparum
GGQSANQPV

SEQ ID NO: 3312810 - protein, 10 aa, Plasmodium falciparum
GGQSEEEASV

SEQ ID NO: 3312811 - protein, 4 aa, Plasmodium falciparum
GGQT

SEQ ID NO: 3312812 - protein, 5 aa, Plasmodium falciparum
GGQVE

SEQ ID NO: 3312813 - protein, 4 aa, Plasmodium falciparum
GGRE

SEQ ID NO: 3312814 - protein, 4 aa, Plasmodium falciparum
GGRG

SEQ ID NO: 3312815 - protein, 5 aa, Plasmodium falciparum
GGRPH

SEQ ID NO: 3312816 - protein, 6 aa, Plasmodium falciparum
GGRTPI

SEQ ID NO: 3312817 - protein, 13 aa, Plasmodium falciparum
GGRTTEANSQSLS

SEQ ID NO: 3312818 - protein, 6 aa, Plasmodium falciparum
GGSDTL

SEQ ID NO: 3312819 - protein, 8 aa, Plasmodium falciparum
GGSGKRSL

SEQ ID NO: 3312820 - protein, 8 aa, Plasmodium falciparum
GGSGSGLS

SEQ ID NO: 3312821 - protein, 8 aa, Plasmodium falciparum
GGSHAGNK

SEQ ID NO: 3312822 - protein, 4 aa, Plasmodium falciparum
GGSK

SEQ ID NO: 3312823 - protein, 4 aa, Plasmodium falciparum
GGSM

SEQ ID NO: 3312824 - protein, 4 aa, Plasmodium falciparum
GGSN

SEQ ID NO: 3312825 - protein, 11 aa, Plasmodium falciparum
GGSNEEKEKLK

SEQ ID NO: 3312826 - protein, 9 aa, Plasmodium falciparum
GGSQREDNL

SEQ ID NO: 3312827 - protein, 10 aa, Plasmodium falciparum
GGSSGGSASC

SEQ ID NO: 3312828 - protein, 8 aa, Plasmodium falciparum
GGSTGVKN

SEQ ID NO: 3312829 - protein, 6 aa, Plasmodium falciparum
GGSTKF

SEQ ID NO: 3312830 - protein, 18 aa, Plasmodium falciparum
GGSVRNKMKQKKQPLNEE

SEQ ID NO: 3312831 - protein, 11 aa, Plasmodium falciparum
GGSVSRGGGPQ

SEQ ID NO: 3312832 - protein, 5 aa, Plasmodium falciparum
GGTGD

SEQ ID NO: 3312833 - protein, 7 aa, Plasmodium falciparum
GGTGENE

SEQ ID NO: 3312834 - protein, 4 aa, Plasmodium falciparum
GGTK

SEQ ID NO: 3312835 - protein, 15 aa, Plasmodium falciparum
GGTKIEGRWNKNDAE

SEQ ID NO: 3312836 - protein, 6 aa, Plasmodium falciparum
GGTKVP

SEQ ID NO: 3312837 - protein, 8 aa, Plasmodium falciparum
GGTPGYAD

SEQ ID NO: 3312838 - protein, 6 aa, Plasmodium falciparum
GGTSLR

SEQ ID NO: 3312839 - protein, 11 aa, Plasmodium falciparum
GGTSTNKCQPI

SEQ ID NO: 3312840 - protein, 5 aa, Plasmodium falciparum
GGVAG

SEQ ID NO: 3312841 - protein, 4 aa, Plasmodium falciparum
GGVG

SEQ ID NO: 3312842 - protein, 10 aa, Plasmodium falciparum
GGVGGSGGPC

SEQ ID NO: 3312843 - protein, 6 aa, Plasmodium falciparum
GGVGKT

SEQ ID NO: 3312844 - protein, 20 aa, Plasmodium falciparum
GGVGRTNQAKEFNHTQGRWP

SEQ ID NO: 3312845 - protein, 8 aa, Plasmodium falciparum
GGVPKSGQ

SEQ ID NO: 3312846 - protein, 11 aa, Plasmodium falciparum
GGVTGGNKKNI

SEQ ID NO: 3312847 - protein, 4 aa, Plasmodium falciparum
GGWT

SEQ ID NO: 3312848 - protein, 4 aa, Plasmodium falciparum
GGYD

SEQ ID NO: 3312849 - protein, 9 aa, Plasmodium falciparum
GGYDRSSYN

SEQ ID NO: 3312850 - protein, 4 aa, Plasmodium falciparum
GGYG

SEQ ID NO: 3312851 - protein, 17 aa, Plasmodium falciparum
GGYIDKTNDVDNIGTSV

SEQ ID NO: 3312852 - protein, 10 aa, Plasmodium falciparum
GGYKKSGRRS

SEQ ID NO: 3312853 - protein, 4 aa, Plasmodium falciparum
GGYN

SEQ ID NO: 3312854 - protein, 7 aa, Plasmodium falciparum
GGYPEEL

SEQ ID NO: 3312855 - protein, 24 aa, Plasmodium falciparum
GGYRPKDKSKYLPYDDGKKLLPRI

SEQ ID NO: 3312856 - protein, 4 aa, Plasmodium falciparum
GGYT

SEQ ID NO: 3312857 - protein, 10 aa, Plasmodium falciparum
GGYTSSEKSI

SEQ ID NO: 3312858 - protein, 10 aa, Plasmodium falciparum
GHAKGGGALS

SEQ ID NO: 3312859 - protein, 14 aa, Plasmodium falciparum
GHASHENKQNVSRG

SEQ ID NO: 3312860 - protein, 5 aa, Plasmodium falciparum
GHDEI

SEQ ID NO: 3312861 - protein, 15 aa, Plasmodium falciparum
GHDHDENNNNTSGIC

SEQ ID NO: 3312862 - protein, 4 aa, Plasmodium falciparum
GHDP

SEQ ID NO: 3312863 - protein, 13 aa, Plasmodium falciparum
GHDQLNGGNISDD

SEQ ID NO: 3312864 - protein, 10 aa, Plasmodium falciparum
GHDTDSTFYE

SEQ ID NO: 3312865 - protein, 15 aa, Plasmodium falciparum
GHEESGYIDDNDDNI

SEQ ID NO: 3312866 - protein, 11 aa, Plasmodium falciparum
GHENKQSAEES

SEQ ID NO: 3312867 - protein, 25 aa, Plasmodium falciparum
GHENYNHNNNVNNVKNDNIHNNSNI

SEQ ID NO: 3312868 - protein, 5 aa, Plasmodium falciparum
GHETA

SEQ ID NO: 3312869 - protein, 13 aa, Plasmodium falciparum
GHEYGTTTKRPRR

SEQ ID NO: 3312870 - protein, 8 aa, Plasmodium falciparum
GHGESDGI

SEQ ID NO: 3312871 - protein, 8 aa, Plasmodium falciparum
GHGESDGL

SEQ ID NO: 3312872 - protein, 9 aa, Plasmodium falciparum
GHGESDGYD

SEQ ID NO: 3312873 - protein, 10 aa, Plasmodium falciparum
GHGGPKDAKV

SEQ ID NO: 3312874 - protein, 7 aa, Plasmodium falciparum
GHGGSNC

SEQ ID NO: 3312875 - protein, 9 aa, Plasmodium falciparum
GHGKSDGWN

SEQ ID NO: 3312876 - protein, 6 aa, Plasmodium falciparum
GHGTYK

SEQ ID NO: 3312877 - protein, 11 aa, Plasmodium falciparum
GHHHSDNNTNL

SEQ ID NO: 3312878 - protein, 12 aa, Plasmodium falciparum
GHHTTNKSEIST

SEQ ID NO: 3312879 - protein, 9 aa, Plasmodium falciparum
GHINDTQKD

SEQ ID NO: 3312880 - protein, 10 aa, Plasmodium falciparum
GHKDDPPVDD

SEQ ID NO: 3312881 - protein, 9 aa, Plasmodium falciparum
GHKNIPYNK

SEQ ID NO: 3312882 - protein, 12 aa, Plasmodium falciparum
GHKSTDKEEIEE

SEQ ID NO: 3312883 - protein, 5 aa, Plasmodium falciparum
GHLDE

SEQ ID NO: 3312884 - protein, 70 aa, Plasmodium falciparum
GHMNDANNNNNNNINCGDDGNNNNNNNNSFDADINSSSHVGNEPTGDKHETSKKEDTENEEAINAKTEGN

SEQ ID NO: 3312885 - protein, 7 aa, Plasmodium falciparum
GHNGDNA

SEQ ID NO: 3312886 - protein, 18 aa, Plasmodium falciparum
GHNNCNDNTSLSSKDSNN

SEQ ID NO: 3312887 - protein, 25 aa, Plasmodium falciparum
GHNNNNENNQHVNKDDGDSKLTPSH

SEQ ID NO: 3312888 - protein, 6 aa, Plasmodium falciparum
GHNPDI

SEQ ID NO: 3312889 - protein, 10 aa, Plasmodium falciparum
GHNYNGDPLT

SEQ ID NO: 3312890 - protein, 5 aa, Plasmodium falciparum
GHPQS

SEQ ID NO: 3312891 - protein, 4 aa, Plasmodium falciparum
GHSF

SEQ ID NO: 3312892 - protein, 6 aa, Plasmodium falciparum
GHSLGS

SEQ ID NO: 3312893 - protein, 30 aa, Plasmodium falciparum
GHSQWEKPKEMSATNFPGKGSAPSFGPPGA

SEQ ID NO: 3312894 - protein, 10 aa, Plasmodium falciparum
GHSSVDTGEH

SEQ ID NO: 3312895 - protein, 5 aa, Plasmodium falciparum
GHTIR

SEQ ID NO: 3312896 - protein, 5 aa, Plasmodium falciparum
GHTND

SEQ ID NO: 3312897 - protein, 10 aa, Plasmodium falciparum
GHTNSHTHGL

SEQ ID NO: 3312898 - protein, 5 aa, Plasmodium falciparum
GHTPY

SEQ ID NO: 3312899 - protein, 6 aa, Plasmodium falciparum
GHTQPV

SEQ ID NO: 3312900 - protein, 4 aa, Plasmodium falciparum
GHTV

SEQ ID NO: 3312901 - protein, 6 aa, Plasmodium falciparum
GHYTEG

SEQ ID NO: 3312902 - protein, 8 aa, Plasmodium falciparum
GICTPKKN

SEQ ID NO: 3312903 - protein, 14 aa, Plasmodium falciparum
GIDATNVGDEGGFA

SEQ ID NO: 3312904 - protein, 5 aa, Plasmodium falciparum
GIDDD

SEQ ID NO: 3312905 - protein, 5 aa, Plasmodium falciparum
GIDDS

SEQ ID NO: 3312906 - protein, 4 aa, Plasmodium falciparum
GIDE

SEQ ID NO: 3312907 - protein, 5 aa, Plasmodium falciparum
GIDGD

SEQ ID NO: 3312908 - protein, 11 aa, Plasmodium falciparum
GIDQSNNIKND

SEQ ID NO: 3312909 - protein, 11 aa, Plasmodium falciparum
GIENNNNNNIH

SEQ ID NO: 3312910 - protein, 8 aa, Plasmodium falciparum
GIERNGSY

SEQ ID NO: 3312911 - protein, 6 aa, Plasmodium falciparum
GIETGG

SEQ ID NO: 3312912 - protein, 6 aa, Plasmodium falciparum
GIGDYT

SEQ ID NO: 3312913 - protein, 5 aa, Plasmodium falciparum
GIGKS

SEQ ID NO: 3312914 - protein, 4 aa, Plasmodium falciparum
GIGM

SEQ ID NO: 3312915 - protein, 10 aa, Plasmodium falciparum
GIGNKDNLDN

SEQ ID NO: 3312916 - protein, 4 aa, Plasmodium falciparum
GIGS

SEQ ID NO: 3312917 - protein, 7 aa, Plasmodium falciparum
GIGSKTA

SEQ ID NO: 3312918 - protein, 7 aa, Plasmodium falciparum
GIGSSTQ

SEQ ID NO: 3312919 - protein, 5 aa, Plasmodium falciparum
GIGTG

SEQ ID NO: 3312920 - protein, 14 aa, Plasmodium falciparum
GIHNGNKNNNNNIN

SEQ ID NO: 3312921 - protein, 10 aa, Plasmodium falciparum
GIKKSDGIKN

SEQ ID NO: 3312922 - protein, 4 aa, Plasmodium falciparum
GIKN

SEQ ID NO: 3312923 - protein, 9 aa, Plasmodium falciparum
GIKSNDKNN

SEQ ID NO: 3312924 - protein, 4 aa, Plasmodium falciparum
GINH

SEQ ID NO: 3312925 - protein, 35 aa, Plasmodium falciparum
GINIDNNNNDKENNNNNKKKNNKKNKKNSNDHNNH

SEQ ID NO: 3312926 - protein, 11 aa, Plasmodium falciparum
GINKEDKDYEE

SEQ ID NO: 3312927 - protein, 4 aa, Plasmodium falciparum
GINN

SEQ ID NO: 3312928 - protein, 10 aa, Plasmodium falciparum
GINNEQKEND

SEQ ID NO: 3312929 - protein, 10 aa, Plasmodium falciparum
GINSEDKKKK

SEQ ID NO: 3312930 - protein, 122 aa, Plasmodium falciparum
GINSENERGSYSDSRSASYRSESYRSESNRRSESDGRSESDGRSEGDRRSESDRRSEGDKRSEGDKRSEGDKRSESDKKSESDKSSNDDDKRSNDGNTSESERSEVSEKSSYVSSEKPKKRP

SEQ ID NO: 3312931 - protein, 5 aa, Plasmodium falciparum
GINTT

SEQ ID NO: 3312932 - protein, 5 aa, Plasmodium falciparum
GIPGQ

SEQ ID NO: 3312933 - protein, 12 aa, Plasmodium falciparum
GIPNQPNKPGPV

SEQ ID NO: 3312934 - protein, 5 aa, Plasmodium falciparum
GIPPP

SEQ ID NO: 3312935 - protein, 6 aa, Plasmodium falciparum
GIPQGK

SEQ ID NO: 3312936 - protein, 4 aa, Plasmodium falciparum
GIPT

SEQ ID NO: 3312937 - protein, 8 aa, Plasmodium falciparum
GIPTKAGS

SEQ ID NO: 3312938 - protein, 7 aa, Plasmodium falciparum
GIQGNKH

SEQ ID NO: 3312939 - protein, 15 aa, Plasmodium falciparum
GIQKGANGLTGATEN

SEQ ID NO: 3312940 - protein, 9 aa, Plasmodium falciparum
GIQKNEKKQ

SEQ ID NO: 3312941 - protein, 14 aa, Plasmodium falciparum
GIQKRKKNVPFNNK

SEQ ID NO: 3312942 - protein, 25 aa, Plasmodium falciparum
GIQPPHRDTTTVPEKSYNAKTKDHI

SEQ ID NO: 3312943 - protein, 4 aa, Plasmodium falciparum
GIQS

SEQ ID NO: 3312944 - protein, 4 aa, Plasmodium falciparum
GIRA

SEQ ID NO: 3312945 - protein, 9 aa, Plasmodium falciparum
GISNENNMK

SEQ ID NO: 3312946 - protein, 10 aa, Plasmodium falciparum
GISNGNSQSV

SEQ ID NO: 3312947 - protein, 11 aa, Plasmodium falciparum
GISNKHKTNNI

SEQ ID NO: 3312948 - protein, 11 aa, Plasmodium falciparum
GITKNDDPILG

SEQ ID NO: 3312949 - protein, 6 aa, Plasmodium falciparum
GITPQD

SEQ ID NO: 3312950 - protein, 16 aa, Plasmodium falciparum
GITSPRNNGNTNDTYI

SEQ ID NO: 3312951 - protein, 10 aa, Plasmodium falciparum
GIYKDSQNNM

SEQ ID NO: 3312952 - protein, 4 aa, Plasmodium falciparum
GIYN

SEQ ID NO: 3312953 - protein, 24 aa, Plasmodium falciparum
GIYNENNDGNEIDEGYDTKNDNME

SEQ ID NO: 3312954 - protein, 24 aa, Plasmodium falciparum
GIYSSTDHNSSDEYSFNDNKDIKK

SEQ ID NO: 3312955 - protein, 8 aa, Plasmodium falciparum
GKAEKYKQ

SEQ ID NO: 3312956 - protein, 9 aa, Plasmodium falciparum
GKAETGSGK

SEQ ID NO: 3312957 - protein, 16 aa, Plasmodium falciparum
GKAHEGKYKRKGRENY

SEQ ID NO: 3312958 - protein, 4 aa, Plasmodium falciparum
GKAI

SEQ ID NO: 3312959 - protein, 16 aa, Plasmodium falciparum
GKAPGKPKSKARPYVR

SEQ ID NO: 3312960 - protein, 8 aa, Plasmodium falciparum
GKAQEIRE

SEQ ID NO: 3312961 - protein, 4 aa, Plasmodium falciparum
GKAY

SEQ ID NO: 3312962 - protein, 4 aa, Plasmodium falciparum
GKCQ

SEQ ID NO: 3312963 - protein, 6 aa, Plasmodium falciparum
GKCSYN

SEQ ID NO: 3312964 - protein, 7 aa, Plasmodium falciparum
GKDDNTL

SEQ ID NO: 3312965 - protein, 4 aa, Plasmodium falciparum
GKDI

SEQ ID NO: 3312966 - protein, 4 aa, Plasmodium falciparum
GKDK

SEQ ID NO: 3312967 - protein, 10 aa, Plasmodium falciparum
GKDKKNNINS

SEQ ID NO: 3312968 - protein, 19 aa, Plasmodium falciparum
GKDKNKDEQKKIDNIKDQN

SEQ ID NO: 3312969 - protein, 8 aa, Plasmodium falciparum
GKDKQTKI

SEQ ID NO: 3312970 - protein, 21 aa, Plasmodium falciparum
GKDMNKRKSMAQQQNKRKSNY

SEQ ID NO: 3312971 - protein, 8 aa, Plasmodium falciparum
GKDNKTAD

SEQ ID NO: 3312972 - protein, 6 aa, Plasmodium falciparum
GKDNMN

SEQ ID NO: 3312973 - protein, 7 aa, Plasmodium falciparum
GKDNNYI

SEQ ID NO: 3312974 - protein, 4 aa, Plasmodium falciparum
GKDS

SEQ ID NO: 3312975 - protein, 16 aa, Plasmodium falciparum
GKECQHNNSCGNNRNS

SEQ ID NO: 3312976 - protein, 8 aa, Plasmodium falciparum
GKEDDSIK

SEQ ID NO: 3312977 - protein, 12 aa, Plasmodium falciparum
GKEETLNNENDE

SEQ ID NO: 3312978 - protein, 4 aa, Plasmodium falciparum
GKEF

SEQ ID NO: 3312979 - protein, 7 aa, Plasmodium falciparum
GKEFDHP

SEQ ID NO: 3312980 - protein, 4 aa, Plasmodium falciparum
GKEG

SEQ ID NO: 3312981 - protein, 5 aa, Plasmodium falciparum
GKEGR

SEQ ID NO: 3312982 - protein, 10 aa, Plasmodium falciparum
GKEGTSKKNI

SEQ ID NO: 3312983 - protein, 5 aa, Plasmodium falciparum
GKEHL

SEQ ID NO: 3312984 - protein, 5 aa, Plasmodium falciparum
GKEIL

SEQ ID NO: 3312985 - protein, 8 aa, Plasmodium falciparum
GKEKEAEN

SEQ ID NO: 3312986 - protein, 40 aa, Plasmodium falciparum
GKEKNELGNNECNNNNNNYISKNGDEDDDNIEDSYNDDEI

SEQ ID NO: 3312987 - protein, 9 aa, Plasmodium falciparum
GKEKQRKKN

SEQ ID NO: 3312988 - protein, 5 aa, Plasmodium falciparum
GKELN

SEQ ID NO: 3312989 - protein, 8 aa, Plasmodium falciparum
GKENIERE

SEQ ID NO: 3312990 - protein, 14 aa, Plasmodium falciparum
GKENKTNHNKENNV

SEQ ID NO: 3312991 - protein, 6 aa, Plasmodium falciparum
GKENMY

SEQ ID NO: 3312992 - protein, 9 aa, Plasmodium falciparum
GKENNKKEL

SEQ ID NO: 3312993 - protein, 4 aa, Plasmodium falciparum
GKEP

SEQ ID NO: 3312994 - protein, 7 aa, Plasmodium falciparum
GKEPLRQ

SEQ ID NO: 3312995 - protein, 8 aa, Plasmodium falciparum
GKEPSKNK

SEQ ID NO: 3312996 - protein, 34 aa, Plasmodium falciparum
GKEQNVNDMNNKKNTNNLNDNFERDKENIERNKK

SEQ ID NO: 3312997 - protein, 4 aa, Plasmodium falciparum
GKES

SEQ ID NO: 3312998 - protein, 12 aa, Plasmodium falciparum
GKESNEKTNNLK

SEQ ID NO: 3312999 - protein, 25 aa, Plasmodium falciparum
GKETIEYSSENKNIKKSSSSKWKPP

SEQ ID NO: 3313000 - protein, 21 aa, Plasmodium falciparum
GKETKRHDDNNNNNINDGDEN

SEQ ID NO: 3313001 - protein, 6 aa, Plasmodium falciparum
GKETQV

SEQ ID NO: 3313002 - protein, 9 aa, Plasmodium falciparum
GKFDKSSKV

SEQ ID NO: 3313003 - protein, 12 aa, Plasmodium falciparum
GKFKKKKSNEYY

SEQ ID NO: 3313004 - protein, 4 aa, Plasmodium falciparum
GKGA

SEQ ID NO: 3313005 - protein, 146 aa, Plasmodium falciparum
GKGADKRSKYQKSKKYNDEKLKEEKHRGKKDKHKKHKDEKYKDEKYKDEKYKDEKYKDEKYKDEKYKDEKYKDEKYKDEKYKDEKYRDKKYKEDKYKDDKYKSDKYKNDKYKDEKYRDKKYKEDKYKDDKYKDDKHKDDKYKDEKY

SEQ ID NO: 3313006 - protein, 12 aa, Plasmodium falciparum
GKGAENYKNSNY

SEQ ID NO: 3313007 - protein, 9 aa, Plasmodium falciparum
GKGCASSMK

SEQ ID NO: 3313008 - protein, 5 aa, Plasmodium falciparum
GKGEM

SEQ ID NO: 3313009 - protein, 8 aa, Plasmodium falciparum
GKGGAKRH

SEQ ID NO: 3313010 - protein, 12 aa, Plasmodium falciparum
GKGIPNNGDTID

SEQ ID NO: 3313011 - protein, 17 aa, Plasmodium falciparum
GKGKKKCNPINKKGNNF

SEQ ID NO: 3313012 - protein, 11 aa, Plasmodium falciparum
GKGKKKRGEDI

SEQ ID NO: 3313013 - protein, 8 aa, Plasmodium falciparum
GKGKNLPK

SEQ ID NO: 3313014 - protein, 6 aa, Plasmodium falciparum
GKGKTN

SEQ ID NO: 3313015 - protein, 5 aa, Plasmodium falciparum
GKGLN

SEQ ID NO: 3313016 - protein, 6 aa, Plasmodium falciparum
GKGNDR

SEQ ID NO: 3313017 - protein, 7 aa, Plasmodium falciparum
GKGNHGD

SEQ ID NO: 3313018 - protein, 21 aa, Plasmodium falciparum
GKGNIEMNEKENKKDSCNYSE

SEQ ID NO: 3313019 - protein, 9 aa, Plasmodium falciparum
GKGNKQNSF

SEQ ID NO: 3313020 - protein, 14 aa, Plasmodium falciparum
GKGNTNRKKSNNLK

SEQ ID NO: 3313021 - protein, 13 aa, Plasmodium falciparum
GKGPCKVDSHNNG

SEQ ID NO: 3313022 - protein, 8 aa, Plasmodium falciparum
GKGQRASR

SEQ ID NO: 3313023 - protein, 8 aa, Plasmodium falciparum
GKGRKLAP

SEQ ID NO: 3313024 - protein, 7 aa, Plasmodium falciparum
GKGSYGN

SEQ ID NO: 3313025 - protein, 7 aa, Plasmodium falciparum
GKGTASL

SEQ ID NO: 3313026 - protein, 16 aa, Plasmodium falciparum
GKGTLKEGKKTDHQTE

SEQ ID NO: 3313027 - protein, 14 aa, Plasmodium falciparum
GKGTVATGKVEQGT

SEQ ID NO: 3313028 - protein, 5 aa, Plasmodium falciparum
GKGTY

SEQ ID NO: 3313029 - protein, 8 aa, Plasmodium falciparum
GKGVDQSP

SEQ ID NO: 3313030 - protein, 6 aa, Plasmodium falciparum
GKHGHI

SEQ ID NO: 3313031 - protein, 4 aa, Plasmodium falciparum
GKHN

SEQ ID NO: 3313032 - protein, 6 aa, Plasmodium falciparum
GKHPSY

SEQ ID NO: 3313033 - protein, 8 aa, Plasmodium falciparum
GKHQNGDL

SEQ ID NO: 3313034 - protein, 5 aa, Plasmodium falciparum
GKHSM

SEQ ID NO: 3313035 - protein, 8 aa, Plasmodium falciparum
GKIAKGSL

SEQ ID NO: 3313036 - protein, 13 aa, Plasmodium falciparum
GKINQDKNKDTCT

SEQ ID NO: 3313037 - protein, 15 aa, Plasmodium falciparum
GKIQGKHDDNNKYSD

SEQ ID NO: 3313038 - protein, 4 aa, Plasmodium falciparum
GKIS

SEQ ID NO: 3313039 - protein, 8 aa, Plasmodium falciparum
GKITNKTQ

SEQ ID NO: 3313040 - protein, 20 aa, Plasmodium falciparum
GKKDDIYNNNGEEEKKNVPL

SEQ ID NO: 3313041 - protein, 15 aa, Plasmodium falciparum
GKKDEASNINTSEQV

SEQ ID NO: 3313042 - protein, 11 aa, Plasmodium falciparum
GKKDEDEHNEY

SEQ ID NO: 3313043 - protein, 10 aa, Plasmodium falciparum
GKKEENNKKI

SEQ ID NO: 3313044 - protein, 8 aa, Plasmodium falciparum
GKKEKNSA

SEQ ID NO: 3313045 - protein, 9 aa, Plasmodium falciparum
GKKENVAKA

SEQ ID NO: 3313046 - protein, 8 aa, Plasmodium falciparum
GKKETNTL

SEQ ID NO: 3313047 - protein, 6 aa, Plasmodium falciparum
GKKGEV

SEQ ID NO: 3313048 - protein, 11 aa, Plasmodium falciparum
GKKGGKKKVTD

SEQ ID NO: 3313049 - protein, 6 aa, Plasmodium falciparum
GKKGGL

SEQ ID NO: 3313050 - protein, 8 aa, Plasmodium falciparum
GKKHGQNV

SEQ ID NO: 3313051 - protein, 8 aa, Plasmodium falciparum
GKKIAPSG

SEQ ID NO: 3313052 - protein, 29 aa, Plasmodium falciparum
GKKINNKNKQSNKNKNNNNNNNMEEQQND

SEQ ID NO: 3313053 - protein, 14 aa, Plasmodium falciparum
GKKIRDDDETFEDS

SEQ ID NO: 3313054 - protein, 162 aa, Plasmodium falciparum
GKKITDDGQIDETYDPKKEEATASTSGAANQTTGTDADKTDKNDKNNKADKNEKGDSSNANNNATATGATTTDTTTTPGETTTTTANADSTGANNNNGLSPNTNTSNTTTGSSNNSINLNENNNTAGNNNSTNNNNNSGSSMNNAGSAKKDETAASDCADTP

SEQ ID NO: 3313055 - protein, 4 aa, Plasmodium falciparum
GKKK

SEQ ID NO: 3313056 - protein, 11 aa, Plasmodium falciparum
GKKKHGKENRV

SEQ ID NO: 3313057 - protein, 11 aa, Plasmodium falciparum
GKKKKKYNNLN

SEQ ID NO: 3313058 - protein, 11 aa, Plasmodium falciparum
GKKKKNALTEY

SEQ ID NO: 3313059 - protein, 10 aa, Plasmodium falciparum
GKKKKNKGTV

SEQ ID NO: 3313060 - protein, 42 aa, Plasmodium falciparum
GKKKKSLQESNDEHEENEEYEEYSKKELKKKKKRKKGKNNKY

SEQ ID NO: 3313061 - protein, 9 aa, Plasmodium falciparum
GKKKNFKNM

SEQ ID NO: 3313062 - protein, 9 aa, Plasmodium falciparum
GKKKNHYKD

SEQ ID NO: 3313063 - protein, 9 aa, Plasmodium falciparum
GKKKNKERS

SEQ ID NO: 3313064 - protein, 22 aa, Plasmodium falciparum
GKKKNVTKNVNEKNKNGVNEEG

SEQ ID NO: 3313065 - protein, 5 aa, Plasmodium falciparum
GKKKS

SEQ ID NO: 3313066 - protein, 7 aa, Plasmodium falciparum
GKKMSKS

SEQ ID NO: 3313067 - protein, 6 aa, Plasmodium falciparum
GKKNIN

SEQ ID NO: 3313068 - protein, 51 aa, Plasmodium falciparum
GKKNKNGSNMNKSYNSNNKKRKNNNKYNNRYNKYNKKGINKNHNKRNTNFN

SEQ ID NO: 3313069 - protein, 12 aa, Plasmodium falciparum
GKKNKTTNQNKH

SEQ ID NO: 3313070 - protein, 8 aa, Plasmodium falciparum
GKKNKYKD

SEQ ID NO: 3313071 - protein, 9 aa, Plasmodium falciparum
GKKNSGKSS

SEQ ID NO: 3313072 - protein, 39 aa, Plasmodium falciparum
GKKNSRSKNVKQKQIENDNSNDNNNNNSKMKKNDKRDKL

SEQ ID NO: 3313073 - protein, 8 aa, Plasmodium falciparum
GKKNYTEQ

SEQ ID NO: 3313074 - protein, 9 aa, Plasmodium falciparum
GKKPSKRYG

SEQ ID NO: 3313075 - protein, 46 aa, Plasmodium falciparum
GKKRNEKQLNDENYRNNKKYQNDSGYNKLNNNNNKMQGEKGNYNNT

SEQ ID NO: 3313076 - protein, 11 aa, Plasmodium falciparum
GKKRNNSMEHT

SEQ ID NO: 3313077 - protein, 4 aa, Plasmodium falciparum
GKKS

SEQ ID NO: 3313078 - protein, 11 aa, Plasmodium falciparum
GKKTKTEDKQY

SEQ ID NO: 3313079 - protein, 4 aa, Plasmodium falciparum
GKKV

SEQ ID NO: 3313080 - protein, 11 aa, Plasmodium falciparum
GKKYKSRMTNN

SEQ ID NO: 3313081 - protein, 9 aa, Plasmodium falciparum
GKKYSPSQI

SEQ ID NO: 3313082 - protein, 7 aa, Plasmodium falciparum
GKLENDK

SEQ ID NO: 3313083 - protein, 23 aa, Plasmodium falciparum
GKLENNNNNNNNNNSKKNTSINT

SEQ ID NO: 3313084 - protein, 27 aa, Plasmodium falciparum
GKLNPENSNNSFGRKNKNFQKDVKNNS

SEQ ID NO: 3313085 - protein, 10 aa, Plasmodium falciparum
GKLRKNGGVP

SEQ ID NO: 3313086 - protein, 9 aa, Plasmodium falciparum
GKLSDHNKN

SEQ ID NO: 3313087 - protein, 8 aa, Plasmodium falciparum
GKLSPDVA

SEQ ID NO: 3313088 - protein, 12 aa, Plasmodium falciparum
GKLTTRVSDLYK

SEQ ID NO: 3313089 - protein, 5 aa, Plasmodium falciparum
GKMHE

SEQ ID NO: 3313090 - protein, 59 aa, Plasmodium falciparum
GKMKTEDNDNSYDEYEDDNSYENKNRRNKKNKTNSNENQKINEDNEESYSDSYNDEFDK

SEQ ID NO: 3313091 - protein, 13 aa, Plasmodium falciparum
GKMPNMDNTNKIS

SEQ ID NO: 3313092 - protein, 9 aa, Plasmodium falciparum
GKNDDHVNA

SEQ ID NO: 3313093 - protein, 15 aa, Plasmodium falciparum
GKNDINKKLKKQEKY

SEQ ID NO: 3313094 - protein, 14 aa, Plasmodium falciparum
GKNDSDGKKKPIGS

SEQ ID NO: 3313095 - protein, 9 aa, Plasmodium falciparum
GKNEEKEKS

SEQ ID NO: 3313096 - protein, 9 aa, Plasmodium falciparum
GKNEEKQEH

SEQ ID NO: 3313097 - protein, 18 aa, Plasmodium falciparum
GKNEENNNIDNKNNDDIN

SEQ ID NO: 3313098 - protein, 7 aa, Plasmodium falciparum
GKNEIHD

SEQ ID NO: 3313099 - protein, 7 aa, Plasmodium falciparum
GKNEKGV

SEQ ID NO: 3313100 - protein, 7 aa, Plasmodium falciparum
GKNENMY

SEQ ID NO: 3313101 - protein, 5 aa, Plasmodium falciparum
GKNEY

SEQ ID NO: 3313102 - protein, 13 aa, Plasmodium falciparum
GKNGLLSSNDMTG

SEQ ID NO: 3313103 - protein, 14 aa, Plasmodium falciparum
GKNIKDEKDKRKKL

SEQ ID NO: 3313104 - protein, 9 aa, Plasmodium falciparum
GKNITTDKQ

SEQ ID NO: 3313105 - protein, 4 aa, Plasmodium falciparum
GKNK

SEQ ID NO: 3313106 - protein, 7 aa, Plasmodium falciparum
GKNKKEN

SEQ ID NO: 3313107 - protein, 27 aa, Plasmodium falciparum
GKNKLNTVKDKTKLSATQEIYDDDDDL

SEQ ID NO: 3313108 - protein, 7 aa, Plasmodium falciparum
GKNKTKI

SEQ ID NO: 3313109 - protein, 11 aa, Plasmodium falciparum
GKNKTTEQEIN

SEQ ID NO: 3313110 - protein, 12 aa, Plasmodium falciparum
GKNKTVGRTSNK

SEQ ID NO: 3313111 - protein, 4 aa, Plasmodium falciparum
GKNL

SEQ ID NO: 3313112 - protein, 4 aa, Plasmodium falciparum
GKNN

SEQ ID NO: 3313113 - protein, 11 aa, Plasmodium falciparum
GKNNDDMEYKE

SEQ ID NO: 3313114 - protein, 67 aa, Plasmodium falciparum
GKNNDNDNDNNNDNNNDNNNNIDDDNNNENNNNNNDDNNNINNDDNNNNNNDDNNNNNDKSNSMNNN

SEQ ID NO: 3313115 - protein, 9 aa, Plasmodium falciparum
GKNNFEKST

SEQ ID NO: 3313116 - protein, 6 aa, Plasmodium falciparum
GKNNIS

SEQ ID NO: 3313117 - protein, 26 aa, Plasmodium falciparum
GKNNNQTIDHSEEPNNVKGKGKGIRR

SEQ ID NO: 3313118 - protein, 9 aa, Plasmodium falciparum
GKNNQRERY

SEQ ID NO: 3313119 - protein, 5 aa, Plasmodium falciparum
GKNNR

SEQ ID NO: 3313120 - protein, 15 aa, Plasmodium falciparum
GKNNSISSESKENLD

SEQ ID NO: 3313121 - protein, 8 aa, Plasmodium falciparum
GKNNSNNV

SEQ ID NO: 3313122 - protein, 10 aa, Plasmodium falciparum
GKNNSVSGTN

SEQ ID NO: 3313123 - protein, 6 aa, Plasmodium falciparum
GKNNTR

SEQ ID NO: 3313124 - protein, 9 aa, Plasmodium falciparum
GKNNTSSPY

SEQ ID NO: 3313125 - protein, 17 aa, Plasmodium falciparum
GKNQEEEKKNLSKSNNI

SEQ ID NO: 3313126 - protein, 9 aa, Plasmodium falciparum
GKNSKYLQG

SEQ ID NO: 3313127 - protein, 10 aa, Plasmodium falciparum
GKNSNNEEDI

SEQ ID NO: 3313128 - protein, 23 aa, Plasmodium falciparum
GKNSTCKYNDHEKNKKHITERTD

SEQ ID NO: 3313129 - protein, 7 aa, Plasmodium falciparum
GKNSYSD

SEQ ID NO: 3313130 - protein, 9 aa, Plasmodium falciparum
GKNTFGKRT

SEQ ID NO: 3313131 - protein, 6 aa, Plasmodium falciparum
GKNYDG

SEQ ID NO: 3313132 - protein, 7 aa, Plasmodium falciparum
GKPAPKF

SEQ ID NO: 3313133 - protein, 7 aa, Plasmodium falciparum
GKPDDTT

SEQ ID NO: 3313134 - protein, 5 aa, Plasmodium falciparum
GKPEL

SEQ ID NO: 3313135 - protein, 8 aa, Plasmodium falciparum
GKPELEDT

SEQ ID NO: 3313136 - protein, 5 aa, Plasmodium falciparum
GKPFN

SEQ ID NO: 3313137 - protein, 4 aa, Plasmodium falciparum
GKPG

SEQ ID NO: 3313138 - protein, 7 aa, Plasmodium falciparum
GKPINEA

SEQ ID NO: 3313139 - protein, 18 aa, Plasmodium falciparum
GKPKHQGVHKQKSTRNLK

SEQ ID NO: 3313140 - protein, 9 aa, Plasmodium falciparum
GKPNEEMNS

SEQ ID NO: 3313141 - protein, 12 aa, Plasmodium falciparum
GKQDKKENIKDN

SEQ ID NO: 3313142 - protein, 4 aa, Plasmodium falciparum
GKQI

SEQ ID NO: 3313143 - protein, 9 aa, Plasmodium falciparum
GKQIRGKEK

SEQ ID NO: 3313144 - protein, 17 aa, Plasmodium falciparum
GKQKHDDINKDQHNEIE

SEQ ID NO: 3313145 - protein, 9 aa, Plasmodium falciparum
GKQSRKFDN

SEQ ID NO: 3313146 - protein, 6 aa, Plasmodium falciparum
GKQYTN

SEQ ID NO: 3313147 - protein, 6 aa, Plasmodium falciparum
GKRDSG

SEQ ID NO: 3313148 - protein, 17 aa, Plasmodium falciparum
GKRDTDKKTVYFLKNCI

SEQ ID NO: 3313149 - protein, 9 aa, Plasmodium falciparum
GKRKKNGNI

SEQ ID NO: 3313150 - protein, 32 aa, Plasmodium falciparum
GKRKNVSSECDEKKRLHKEKNVENDDTKKKYS

SEQ ID NO: 3313151 - protein, 9 aa, Plasmodium falciparum
GKRNFQKKK

SEQ ID NO: 3313152 - protein, 6 aa, Plasmodium falciparum
GKRNGK

SEQ ID NO: 3313153 - protein, 8 aa, Plasmodium falciparum
GKRNGTGQ

SEQ ID NO: 3313154 - protein, 9 aa, Plasmodium falciparum
GKRNYSPTD

SEQ ID NO: 3313155 - protein, 8 aa, Plasmodium falciparum
GKRQIEPN

SEQ ID NO: 3313156 - protein, 8 aa, Plasmodium falciparum
GKRRETEA

SEQ ID NO: 3313157 - protein, 21 aa, Plasmodium falciparum
GKRSDASSSYYKKRKKKKKII

SEQ ID NO: 3313158 - protein, 13 aa, Plasmodium falciparum
GKRSHSYSDCRNE

SEQ ID NO: 3313159 - protein, 5 aa, Plasmodium falciparum
GKRSK

SEQ ID NO: 3313160 - protein, 12 aa, Plasmodium falciparum
GKRSSDVVENSD

SEQ ID NO: 3313161 - protein, 23 aa, Plasmodium falciparum
GKSCANENKCTTNDKCSGENKHV

SEQ ID NO: 3313162 - protein, 24 aa, Plasmodium falciparum
GKSDTGTHKNQGDDPNQEETFADN

SEQ ID NO: 3313163 - protein, 4 aa, Plasmodium falciparum
GKSF

SEQ ID NO: 3313164 - protein, 15 aa, Plasmodium falciparum
GKSHSPSKSFSSINN

SEQ ID NO: 3313165 - protein, 12 aa, Plasmodium falciparum
GKSICNNKISYK

SEQ ID NO: 3313166 - protein, 5 aa, Plasmodium falciparum
GKSIN

SEQ ID NO: 3313167 - protein, 6 aa, Plasmodium falciparum
GKSINT

SEQ ID NO: 3313168 - protein, 6 aa, Plasmodium falciparum
GKSKNI

SEQ ID NO: 3313169 - protein, 6 aa, Plasmodium falciparum
GKSLGL

SEQ ID NO: 3313170 - protein, 7 aa, Plasmodium falciparum
GKSMNEN

SEQ ID NO: 3313171 - protein, 4 aa, Plasmodium falciparum
GKSN

SEQ ID NO: 3313172 - protein, 5 aa, Plasmodium falciparum
GKSNI

SEQ ID NO: 3313173 - protein, 16 aa, Plasmodium falciparum
GKSNNKDDSKDETNKL

SEQ ID NO: 3313174 - protein, 6 aa, Plasmodium falciparum
GKSQGK

SEQ ID NO: 3313175 - protein, 11 aa, Plasmodium falciparum
GKSSKDENATI

SEQ ID NO: 3313176 - protein, 4 aa, Plasmodium falciparum
GKST

SEQ ID NO: 3313177 - protein, 8 aa, Plasmodium falciparum
GKSTKEYK

SEQ ID NO: 3313178 - protein, 8 aa, Plasmodium falciparum
GKSTLTDS

SEQ ID NO: 3313179 - protein, 11 aa, Plasmodium falciparum
GKTAKAAEAAI

SEQ ID NO: 3313180 - protein, 9 aa, Plasmodium falciparum
GKTATPEQA

SEQ ID NO: 3313181 - protein, 8 aa, Plasmodium falciparum
GKTDIPSN

SEQ ID NO: 3313182 - protein, 5 aa, Plasmodium falciparum
GKTDK

SEQ ID NO: 3313183 - protein, 6 aa, Plasmodium falciparum
GKTDVN

SEQ ID NO: 3313184 - protein, 5 aa, Plasmodium falciparum
GKTEH

SEQ ID NO: 3313185 - protein, 6 aa, Plasmodium falciparum
GKTGFS

SEQ ID NO: 3313186 - protein, 6 aa, Plasmodium falciparum
GKTGGL

SEQ ID NO: 3313187 - protein, 4 aa, Plasmodium falciparum
GKTH

SEQ ID NO: 3313188 - protein, 20 aa, Plasmodium falciparum
GKTKKRKKKKHDDYNDHNDQ

SEQ ID NO: 3313189 - protein, 7 aa, Plasmodium falciparum
GKTKNEK

SEQ ID NO: 3313190 - protein, 4 aa, Plasmodium falciparum
GKTL

SEQ ID NO: 3313191 - protein, 6 aa, Plasmodium falciparum
GKTNGD

SEQ ID NO: 3313192 - protein, 6 aa, Plasmodium falciparum
GKTNGT

SEQ ID NO: 3313193 - protein, 6 aa, Plasmodium falciparum
GKTNIK

SEQ ID NO: 3313194 - protein, 8 aa, Plasmodium falciparum
GKTNPIPA

SEQ ID NO: 3313195 - protein, 21 aa, Plasmodium falciparum
GKTNSDSNNNNNNSNSNNKNK

SEQ ID NO: 3313196 - protein, 7 aa, Plasmodium falciparum
GKTNTSD

SEQ ID NO: 3313197 - protein, 55 aa, Plasmodium falciparum
GKTSQKKKNINSQQENKHTEQGKKKKKKKKKNQKNENIEDVEKQNEKNDPNQNYQ

SEQ ID NO: 3313198 - protein, 5 aa, Plasmodium falciparum
GKTTI

SEQ ID NO: 3313199 - protein, 6 aa, Plasmodium falciparum
GKTTIS

SEQ ID NO: 3313200 - protein, 5 aa, Plasmodium falciparum
GKTTL

SEQ ID NO: 3313201 - protein, 6 aa, Plasmodium falciparum
GKTTND

SEQ ID NO: 3313202 - protein, 7 aa, Plasmodium falciparum
GKVKNKD

SEQ ID NO: 3313203 - protein, 14 aa, Plasmodium falciparum
GKVKNQTPKVPKLD

SEQ ID NO: 3313204 - protein, 48 aa, Plasmodium falciparum
GKVSKAGKNIKAGKSSKGGKNDENKNSNSNNNNNNNINNMNDGDDKDC

SEQ ID NO: 3313205 - protein, 8 aa, Plasmodium falciparum
GKVSKDKE

SEQ ID NO: 3313206 - protein, 12 aa, Plasmodium falciparum
GKVSKKNTYVSG

SEQ ID NO: 3313207 - protein, 14 aa, Plasmodium falciparum
GKVSQKKITEYFHK

SEQ ID NO: 3313208 - protein, 7 aa, Plasmodium falciparum
GKVTDPL

SEQ ID NO: 3313209 - protein, 11 aa, Plasmodium falciparum
GKYAKRVGAGA

SEQ ID NO: 3313210 - protein, 4 aa, Plasmodium falciparum
GKYD

SEQ ID NO: 3313211 - protein, 6 aa, Plasmodium falciparum
GKYDND

SEQ ID NO: 3313212 - protein, 8 aa, Plasmodium falciparum
GKYGTRYG

SEQ ID NO: 3313213 - protein, 11 aa, Plasmodium falciparum
GKYGTRYGSSL

SEQ ID NO: 3313214 - protein, 6 aa, Plasmodium falciparum
GKYKAE

SEQ ID NO: 3313215 - protein, 18 aa, Plasmodium falciparum
GKYKDKKKKQEEEKKRKL

SEQ ID NO: 3313216 - protein, 8 aa, Plasmodium falciparum
GKYKGKWE

SEQ ID NO: 3313217 - protein, 11 aa, Plasmodium falciparum
GKYKSKKAKRR

SEQ ID NO: 3313218 - protein, 7 aa, Plasmodium falciparum
GKYNYNN

SEQ ID NO: 3313219 - protein, 7 aa, Plasmodium falciparum
GKYTGSV

SEQ ID NO: 3313220 - protein, 8 aa, Plasmodium falciparum
GKYTKGDI

SEQ ID NO: 3313221 - protein, 9 aa, Plasmodium falciparum
GKYTNNSRV

SEQ ID NO: 3313222 - protein, 8 aa, Plasmodium falciparum
GLAGDDAP

SEQ ID NO: 3313223 - protein, 7 aa, Plasmodium falciparum
GLDEQGQ

SEQ ID NO: 3313224 - protein, 25 aa, Plasmodium falciparum
GLDGEEEGGGDYDEKEDDLLDENKN

SEQ ID NO: 3313225 - protein, 20 aa, Plasmodium falciparum
GLEGTTNNAAVTQPANNLNN

SEQ ID NO: 3313226 - protein, 4 aa, Plasmodium falciparum
GLEN

SEQ ID NO: 3313227 - protein, 7 aa, Plasmodium falciparum
GLENNRD

SEQ ID NO: 3313228 - protein, 4 aa, Plasmodium falciparum
GLEQ

SEQ ID NO: 3313229 - protein, 5 aa, Plasmodium falciparum
GLGED

SEQ ID NO: 3313230 - protein, 9 aa, Plasmodium falciparum
GLGENEYEK

SEQ ID NO: 3313231 - protein, 7 aa, Plasmodium falciparum
GLGQGPS

SEQ ID NO: 3313232 - protein, 8 aa, Plasmodium falciparum
GLKGEEEI

SEQ ID NO: 3313233 - protein, 11 aa, Plasmodium falciparum
GLKKSTACSTE

SEQ ID NO: 3313234 - protein, 4 aa, Plasmodium falciparum
GLKN

SEQ ID NO: 3313235 - protein, 9 aa, Plasmodium falciparum
GLKTPLSGL

SEQ ID NO: 3313236 - protein, 6 aa, Plasmodium falciparum
GLNDPK

SEQ ID NO: 3313237 - protein, 10 aa, Plasmodium falciparum
GLNGSGKSNV

SEQ ID NO: 3313238 - protein, 4 aa, Plasmodium falciparum
GLNK

SEQ ID NO: 3313239 - protein, 16 aa, Plasmodium falciparum
GLPKKDKKKDNTYTTK

SEQ ID NO: 3313240 - protein, 5 aa, Plasmodium falciparum
GLPSD

SEQ ID NO: 3313241 - protein, 17 aa, Plasmodium falciparum
GLQGGEEKLKKGVSGKI

SEQ ID NO: 3313242 - protein, 6 aa, Plasmodium falciparum
GLQKKT

SEQ ID NO: 3313243 - protein, 4 aa, Plasmodium falciparum
GLQS

SEQ ID NO: 3313244 - protein, 12 aa, Plasmodium falciparum
GLREDKLNADDE

SEQ ID NO: 3313245 - protein, 5 aa, Plasmodium falciparum
GLRKG

SEQ ID NO: 3313246 - protein, 28 aa, Plasmodium falciparum
GLSAEGKSESHNKNNKDDIEDNDKDTIK

SEQ ID NO: 3313247 - protein, 57 aa, Plasmodium falciparum
GLSEEAMDDQNVKETEINKSTNADNKKDEKNDPSVKHTNNNDSNDSNDNDYNSKEDD

SEQ ID NO: 3313248 - protein, 25 aa, Plasmodium falciparum
GLSNNDNNISSQYYKEENNNNMNNR

SEQ ID NO: 3313249 - protein, 7 aa, Plasmodium falciparum
GLSNQDE

SEQ ID NO: 3313250 - protein, 6 aa, Plasmodium falciparum
GLSRTR

SEQ ID NO: 3313251 - protein, 18 aa, Plasmodium falciparum
GLSSEKDRWTDDSNNFSN

SEQ ID NO: 3313252 - protein, 8 aa, Plasmodium falciparum
GLSSPNNL

SEQ ID NO: 3313253 - protein, 7 aa, Plasmodium falciparum
GLSSPVS

SEQ ID NO: 3313254 - protein, 5 aa, Plasmodium falciparum
GLSTL

SEQ ID NO: 3313255 - protein, 5 aa, Plasmodium falciparum
GLTPA

SEQ ID NO: 3313256 - protein, 12 aa, Plasmodium falciparum
GLTQENDENEKL

SEQ ID NO: 3313257 - protein, 4 aa, Plasmodium falciparum
GLTR

SEQ ID NO: 3313258 - protein, 10 aa, Plasmodium falciparum
GLTTGQAREF

SEQ ID NO: 3313259 - protein, 6 aa, Plasmodium falciparum
GLYDDR

SEQ ID NO: 3313260 - protein, 4 aa, Plasmodium falciparum
GLYE

SEQ ID NO: 3313261 - protein, 15 aa, Plasmodium falciparum
GLYTSKNKCENKDEI

SEQ ID NO: 3313262 - protein, 7 aa, Plasmodium falciparum
GMEKEEY

SEQ ID NO: 3313263 - protein, 15 aa, Plasmodium falciparum
GMNEVGKKRAPRRRA

SEQ ID NO: 3313264 - protein, 5 aa, Plasmodium falciparum
GMNSE

SEQ ID NO: 3313265 - protein, 94 aa, Plasmodium falciparum
GMNTTQGNNNSNNNNNNNNNNSSSFNNSSSFNNSSSNNSSSNNNNSSNYNSSCSNNNSSSNNNNSSTSSNNNGNNNKNNYNNNYNNSLSTNENF

SEQ ID NO: 3313266 - protein, 12 aa, Plasmodium falciparum
GMQNGKKIKEKN

SEQ ID NO: 3313267 - protein, 4 aa, Plasmodium falciparum
GMSK

SEQ ID NO: 3313268 - protein, 15 aa, Plasmodium falciparum
GMSKGAKGRGRKLSK

SEQ ID NO: 3313269 - protein, 5 aa, Plasmodium falciparum
GMSTD

SEQ ID NO: 3313270 - protein, 5 aa, Plasmodium falciparum
GNAEY

SEQ ID NO: 3313271 - protein, 4 aa, Plasmodium falciparum
GNAN

SEQ ID NO: 3313272 - protein, 6 aa, Plasmodium falciparum
GNASNY

SEQ ID NO: 3313273 - protein, 6 aa, Plasmodium falciparum
GNATKD

SEQ ID NO: 3313274 - protein, 6 aa, Plasmodium falciparum
GNDDND

SEQ ID NO: 3313275 - protein, 14 aa, Plasmodium falciparum
GNDDSLNNSRRISN

SEQ ID NO: 3313276 - protein, 7 aa, Plasmodium falciparum
GNDEEDQ

SEQ ID NO: 3313277 - protein, 7 aa, Plasmodium falciparum
GNDEKDI

SEQ ID NO: 3313278 - protein, 18 aa, Plasmodium falciparum
GNDEKTNNNIHNNESHKS

SEQ ID NO: 3313279 - protein, 21 aa, Plasmodium falciparum
GNDENNTSKKKEAKKKAKRND

SEQ ID NO: 3313280 - protein, 4 aa, Plasmodium falciparum
GNDI

SEQ ID NO: 3313281 - protein, 5 aa, Plasmodium falciparum
GNDIK

SEQ ID NO: 3313282 - protein, 5 aa, Plasmodium falciparum
GNDKE

SEQ ID NO: 3313283 - protein, 12 aa, Plasmodium falciparum
GNDKEQYNKNVQ

SEQ ID NO: 3313284 - protein, 6 aa, Plasmodium falciparum
GNDLSK

SEQ ID NO: 3313285 - protein, 4 aa, Plasmodium falciparum
GNDN

SEQ ID NO: 3313286 - protein, 9 aa, Plasmodium falciparum
GNDNEVVKK

SEQ ID NO: 3313287 - protein, 5 aa, Plasmodium falciparum
GNDNK

SEQ ID NO: 3313288 - protein, 31 aa, Plasmodium falciparum
GNDQTRKKRLQHEKKKSTNSKNSINNNNNNY

SEQ ID NO: 3313289 - protein, 4 aa, Plasmodium falciparum
GNDR

SEQ ID NO: 3313290 - protein, 5 aa, Plasmodium falciparum
GNDRY

SEQ ID NO: 3313291 - protein, 4 aa, Plasmodium falciparum
GNDT

SEQ ID NO: 3313292 - protein, 9 aa, Plasmodium falciparum
GNDTEDNEI

SEQ ID NO: 3313293 - protein, 9 aa, Plasmodium falciparum
GNDVSNVES

SEQ ID NO: 3313294 - protein, 14 aa, Plasmodium falciparum
GNDYKKKNKEGKKF

SEQ ID NO: 3313295 - protein, 11 aa, Plasmodium falciparum
GNDYSNNDNEN

SEQ ID NO: 3313296 - protein, 6 aa, Plasmodium falciparum
GNEDGT

SEQ ID NO: 3313297 - protein, 6 aa, Plasmodium falciparum
GNEDSA

SEQ ID NO: 3313298 - protein, 7 aa, Plasmodium falciparum
GNEDSCQ

SEQ ID NO: 3313299 - protein, 9 aa, Plasmodium falciparum
GNEENKNEK

SEQ ID NO: 3313300 - protein, 16 aa, Plasmodium falciparum
GNEENNVGENSDEEEI

SEQ ID NO: 3313301 - protein, 5 aa, Plasmodium falciparum
GNEGD

SEQ ID NO: 3313302 - protein, 5 aa, Plasmodium falciparum
GNEGS

SEQ ID NO: 3313303 - protein, 4 aa, Plasmodium falciparum
GNEH

SEQ ID NO: 3313304 - protein, 20 aa, Plasmodium falciparum
GNEIISSKKKKKNQKNPYYN

SEQ ID NO: 3313305 - protein, 4 aa, Plasmodium falciparum
GNEK

SEQ ID NO: 3313306 - protein, 14 aa, Plasmodium falciparum
GNEKDKDQGGQPYE

SEQ ID NO: 3313307 - protein, 9 aa, Plasmodium falciparum
GNEKGDISK

SEQ ID NO: 3313308 - protein, 17 aa, Plasmodium falciparum
GNEKKKLQDLTENEKRD

SEQ ID NO: 3313309 - protein, 7 aa, Plasmodium falciparum
GNEKYDE

SEQ ID NO: 3313310 - protein, 4 aa, Plasmodium falciparum
GNEL

SEQ ID NO: 3313311 - protein, 7 aa, Plasmodium falciparum
GNENEDV

SEQ ID NO: 3313312 - protein, 7 aa, Plasmodium falciparum
GNENNDM

SEQ ID NO: 3313313 - protein, 10 aa, Plasmodium falciparum
GNENPSTKEV

SEQ ID NO: 3313314 - protein, 9 aa, Plasmodium falciparum
GNENVNNKD

SEQ ID NO: 3313315 - protein, 6 aa, Plasmodium falciparum
GNEPHA

SEQ ID NO: 3313316 - protein, 6 aa, Plasmodium falciparum
GNEQMT

SEQ ID NO: 3313317 - protein, 15 aa, Plasmodium falciparum
GNERAGRAAEGIENS

SEQ ID NO: 3313318 - protein, 14 aa, Plasmodium falciparum
GNFENDNNNMGPKL

SEQ ID NO: 3313319 - protein, 5 aa, Plasmodium falciparum
GNFNN

SEQ ID NO: 3313320 - protein, 8 aa, Plasmodium falciparum
GNFNNNRN

SEQ ID NO: 3313321 - protein, 7 aa, Plasmodium falciparum
GNGCPPA

SEQ ID NO: 3313322 - protein, 7 aa, Plasmodium falciparum
GNGDIKN

SEQ ID NO: 3313323 - protein, 11 aa, Plasmodium falciparum
GNGEAKIGTPN

SEQ ID NO: 3313324 - protein, 21 aa, Plasmodium falciparum
GNGENYYNKNKKHQKKNKGKI

SEQ ID NO: 3313325 - protein, 5 aa, Plasmodium falciparum
GNGKG

SEQ ID NO: 3313326 - protein, 4 aa, Plasmodium falciparum
GNGL

SEQ ID NO: 3313327 - protein, 25 aa, Plasmodium falciparum
GNGLTSNINNNNNVSNNNSISCNAD

SEQ ID NO: 3313328 - protein, 5 aa, Plasmodium falciparum
GNGNY

SEQ ID NO: 3313329 - protein, 4 aa, Plasmodium falciparum
GNGR

SEQ ID NO: 3313330 - protein, 6 aa, Plasmodium falciparum
GNGYDC

SEQ ID NO: 3313331 - protein, 8 aa, Plasmodium falciparum
GNGYGGES

SEQ ID NO: 3313332 - protein, 7 aa, Plasmodium falciparum
GNHETDN

SEQ ID NO: 3313333 - protein, 7 aa, Plasmodium falciparum
GNHNSDK

SEQ ID NO: 3313334 - protein, 8 aa, Plasmodium falciparum
GNHPNNDN

SEQ ID NO: 3313335 - protein, 7 aa, Plasmodium falciparum
GNHQHGK

SEQ ID NO: 3313336 - protein, 10 aa, Plasmodium falciparum
GNIEEQQKES

SEQ ID NO: 3313337 - protein, 6 aa, Plasmodium falciparum
GNIGRE

SEQ ID NO: 3313338 - protein, 4 aa, Plasmodium falciparum
GNIK

SEQ ID NO: 3313339 - protein, 4 aa, Plasmodium falciparum
GNIN

SEQ ID NO: 3313340 - protein, 8 aa, Plasmodium falciparum
GNINDQNT

SEQ ID NO: 3313341 - protein, 7 aa, Plasmodium falciparum
GNINEND

SEQ ID NO: 3313342 - protein, 49 aa, Plasmodium falciparum
GNINNDGNINNDGNINNDGNINNDDNINNDGNINNNGNINNDDNINNNG

SEQ ID NO: 3313343 - protein, 60 aa, Plasmodium falciparum
GNINNNKNNNINNNNNNINNNNNNINNNNNNINNNNNINNNNNINNNNNINNNNNINNNN

SEQ ID NO: 3313344 - protein, 28 aa, Plasmodium falciparum
GNINNNNTENMYNNNNNNNIRYNSTTNP

SEQ ID NO: 3313345 - protein, 6 aa, Plasmodium falciparum
GNIPNE

SEQ ID NO: 3313346 - protein, 5 aa, Plasmodium falciparum
GNISN

SEQ ID NO: 3313347 - protein, 4 aa, Plasmodium falciparum
GNIT

SEQ ID NO: 3313348 - protein, 10 aa, Plasmodium falciparum
GNKDKEETKE

SEQ ID NO: 3313349 - protein, 9 aa, Plasmodium falciparum
GNKDQRKEL

SEQ ID NO: 3313350 - protein, 18 aa, Plasmodium falciparum
GNKDRKSSLEEAKDEEKY

SEQ ID NO: 3313351 - protein, 4 aa, Plasmodium falciparum
GNKE

SEQ ID NO: 3313352 - protein, 7 aa, Plasmodium falciparum
GNKETAR

SEQ ID NO: 3313353 - protein, 8 aa, Plasmodium falciparum
GNKGIGND

SEQ ID NO: 3313354 - protein, 7 aa, Plasmodium falciparum
GNKGSGY

SEQ ID NO: 3313355 - protein, 10 aa, Plasmodium falciparum
GNKIEDDNAT

SEQ ID NO: 3313356 - protein, 4 aa, Plasmodium falciparum
GNKK

SEQ ID NO: 3313357 - protein, 11 aa, Plasmodium falciparum
GNKNDDINTYS

SEQ ID NO: 3313358 - protein, 11 aa, Plasmodium falciparum
GNKNDKKGKWA

SEQ ID NO: 3313359 - protein, 6 aa, Plasmodium falciparum
GNKNNN

SEQ ID NO: 3313360 - protein, 9 aa, Plasmodium falciparum
GNKNSVSEN

SEQ ID NO: 3313361 - protein, 7 aa, Plasmodium falciparum
GNKNTRY

SEQ ID NO: 3313362 - protein, 13 aa, Plasmodium falciparum
GNKRSDKNFSYNT

SEQ ID NO: 3313363 - protein, 10 aa, Plasmodium falciparum
GNKSDNENDE

SEQ ID NO: 3313364 - protein, 9 aa, Plasmodium falciparum
GNKSNIGPL

SEQ ID NO: 3313365 - protein, 4 aa, Plasmodium falciparum
GNKV

SEQ ID NO: 3313366 - protein, 14 aa, Plasmodium falciparum
GNKVNVKQKGAEKY

SEQ ID NO: 3313367 - protein, 6 aa, Plasmodium falciparum
GNKWTN

SEQ ID NO: 3313368 - protein, 7 aa, Plasmodium falciparum
GNKYEGE

SEQ ID NO: 3313369 - protein, 15 aa, Plasmodium falciparum
GNKYNEEKEINDEKE

SEQ ID NO: 3313370 - protein, 6 aa, Plasmodium falciparum
GNLKRE

SEQ ID NO: 3313371 - protein, 22 aa, Plasmodium falciparum
GNLKRKKKKEKNNKNISKNVNE

SEQ ID NO: 3313372 - protein, 10 aa, Plasmodium falciparum
GNLNNRKDMT

SEQ ID NO: 3313373 - protein, 7 aa, Plasmodium falciparum
GNLPEKE

SEQ ID NO: 3313374 - protein, 21 aa, Plasmodium falciparum
GNLPNENMDNRNNNDNNNINN

SEQ ID NO: 3313375 - protein, 9 aa, Plasmodium falciparum
GNLSNTSIK

SEQ ID NO: 3313376 - protein, 24 aa, Plasmodium falciparum
GNLSSTHNHKESKKRRKRRRRKNK

SEQ ID NO: 3313377 - protein, 13 aa, Plasmodium falciparum
GNMNLPPPPPNNL

SEQ ID NO: 3313378 - protein, 40 aa, Plasmodium falciparum
GNMNNMDNNDQDKMNTTTNNNNNTNNNNNNNNNNNSNNNI

SEQ ID NO: 3313379 - protein, 9 aa, Plasmodium falciparum
GNMNSTNEN

SEQ ID NO: 3313380 - protein, 6 aa, Plasmodium falciparum
GNNATT

SEQ ID NO: 3313381 - protein, 10 aa, Plasmodium falciparum
GNNDGKNLSS

SEQ ID NO: 3313382 - protein, 13 aa, Plasmodium falciparum
GNNDYRKKDTNEL

SEQ ID NO: 3313383 - protein, 45 aa, Plasmodium falciparum
GNNEKEYETNSFSSSSISDSNSEKEMSDYPDESSSERKYDSDYQM

SEQ ID NO: 3313384 - protein, 14 aa, Plasmodium falciparum
GNNEKKNINMSDEK

SEQ ID NO: 3313385 - protein, 5 aa, Plasmodium falciparum
GNNEN

SEQ ID NO: 3313386 - protein, 14 aa, Plasmodium falciparum
GNNFSSSNSKLGNI

SEQ ID NO: 3313387 - protein, 7 aa, Plasmodium falciparum
GNNGGFN

SEQ ID NO: 3313388 - protein, 12 aa, Plasmodium falciparum
GNNGNNAYNDNY

SEQ ID NO: 3313389 - protein, 19 aa, Plasmodium falciparum
GNNHINGNNHINGNDHING

SEQ ID NO: 3313390 - protein, 18 aa, Plasmodium falciparum
GNNHINGNNHINGNNHIN

SEQ ID NO: 3313391 - protein, 5 aa, Plasmodium falciparum
GNNIH

SEQ ID NO: 3313392 - protein, 5 aa, Plasmodium falciparum
GNNIN

SEQ ID NO: 3313393 - protein, 38 aa, Plasmodium falciparum
GNNINNNNNNINNNNNNINNNNNNNNNNNNNNNNNNNS

SEQ ID NO: 3313394 - protein, 25 aa, Plasmodium falciparum
GNNKDAEGNKRKKKKRSKPETENKV

SEQ ID NO: 3313395 - protein, 12 aa, Plasmodium falciparum
GNNKECKKETMN

SEQ ID NO: 3313396 - protein, 29 aa, Plasmodium falciparum
GNNKIRKKKKTNHNDSDKSYKNKSEKSEG

SEQ ID NO: 3313397 - protein, 9 aa, Plasmodium falciparum
GNNKNDKEI

SEQ ID NO: 3313398 - protein, 26 aa, Plasmodium falciparum
GNNKNNHKATSKGNDNNNKVGGTQNV

SEQ ID NO: 3313399 - protein, 8 aa, Plasmodium falciparum
GNNKPIAN

SEQ ID NO: 3313400 - protein, 12 aa, Plasmodium falciparum
GNNKQEKRNEDM

SEQ ID NO: 3313401 - protein, 10 aa, Plasmodium falciparum
GNNKSEEKKI

SEQ ID NO: 3313402 - protein, 15 aa, Plasmodium falciparum
GNNLQKRKKEKNYEN

SEQ ID NO: 3313403 - protein, 11 aa, Plasmodium falciparum
GNNNDMKSDLE

SEQ ID NO: 3313404 - protein, 22 aa, Plasmodium falciparum
GNNNDSEELDNQEEDSDNNSLD

SEQ ID NO: 3313405 - protein, 6 aa, Plasmodium falciparum
GNNNEI

SEQ ID NO: 3313406 - protein, 39 aa, Plasmodium falciparum
GNNNINSNNNINSNNNINSNNNINSNNNINSNNNINSNN

SEQ ID NO: 3313407 - protein, 5 aa, Plasmodium falciparum
GNNNN

SEQ ID NO: 3313408 - protein, 19 aa, Plasmodium falciparum
GNNNNNINSNTTEETMSNR

SEQ ID NO: 3313409 - protein, 9 aa, Plasmodium falciparum
GNNNNNNNN

SEQ ID NO: 3313410 - protein, 20 aa, Plasmodium falciparum
GNNNNNNNNNITNNNSDNVE

SEQ ID NO: 3313411 - protein, 30 aa, Plasmodium falciparum
GNNNNNNNNNNNINNNNNINNNNNNNNNIV

SEQ ID NO: 3313412 - protein, 24 aa, Plasmodium falciparum
GNNNNNNNNNNNNNNNNNNNNNIY

SEQ ID NO: 3313413 - protein, 15 aa, Plasmodium falciparum
GNNNNNNNNNNNPMN

SEQ ID NO: 3313414 - protein, 7 aa, Plasmodium falciparum
GNNNNNY

SEQ ID NO: 3313415 - protein, 20 aa, Plasmodium falciparum
GNNNNSDRNNNHNNHNNQNY

SEQ ID NO: 3313416 - protein, 9 aa, Plasmodium falciparum
GNNNNSSNN

SEQ ID NO: 3313417 - protein, 8 aa, Plasmodium falciparum
GNNNNVGD

SEQ ID NO: 3313418 - protein, 10 aa, Plasmodium falciparum
GNNNSGKSSV

SEQ ID NO: 3313419 - protein, 29 aa, Plasmodium falciparum
GNNQRRNPYYSSGRSNNVNNIPLRGNNRF

SEQ ID NO: 3313420 - protein, 12 aa, Plasmodium falciparum
GNNRNSTKSLDS

SEQ ID NO: 3313421 - protein, 9 aa, Plasmodium falciparum
GNNSMNDAQ

SEQ ID NO: 3313422 - protein, 9 aa, Plasmodium falciparum
GNNSNGTNM

SEQ ID NO: 3313423 - protein, 9 aa, Plasmodium falciparum
GNNSNVTTD

SEQ ID NO: 3313424 - protein, 7 aa, Plasmodium falciparum
GNNSSSW

SEQ ID NO: 3313425 - protein, 63 aa, Plasmodium falciparum
GNNSTNNNNNNNNKSNCSNNNNNSSSSNSSSSSLNNNNNNNNSVSCSDGESQYHQQGDNNKIG

SEQ ID NO: 3313426 - protein, 8 aa, Plasmodium falciparum
GNNSTPTN

SEQ ID NO: 3313427 - protein, 11 aa, Plasmodium falciparum
GNNTHDDPNNV

SEQ ID NO: 3313428 - protein, 7 aa, Plasmodium falciparum
GNNTKDM

SEQ ID NO: 3313429 - protein, 12 aa, Plasmodium falciparum
GNNTKKKKEYDE

SEQ ID NO: 3313430 - protein, 9 aa, Plasmodium falciparum
GNNTQENNI

SEQ ID NO: 3313431 - protein, 9 aa, Plasmodium falciparum
GNNTSNNSN

SEQ ID NO: 3313432 - protein, 15 aa, Plasmodium falciparum
GNNTSTGNNTAGSGL

SEQ ID NO: 3313433 - protein, 4 aa, Plasmodium falciparum
GNNY

SEQ ID NO: 3313434 - protein, 5 aa, Plasmodium falciparum
GNNYK

SEQ ID NO: 3313435 - protein, 29 aa, Plasmodium falciparum
GNNYNDNEEDGDGDGDDDEQKKRKQKELH

SEQ ID NO: 3313436 - protein, 11 aa, Plasmodium falciparum
GNNYTKNNMTH

SEQ ID NO: 3313437 - protein, 16 aa, Plasmodium falciparum
GNNYYNDNKNTQNNIN

SEQ ID NO: 3313438 - protein, 9 aa, Plasmodium falciparum
GNPAEKKKI

SEQ ID NO: 3313439 - protein, 7 aa, Plasmodium falciparum
GNPANNN

SEQ ID NO: 3313440 - protein, 16 aa, Plasmodium falciparum
GNPFGPAGTGKTESVK

SEQ ID NO: 3313441 - protein, 6 aa, Plasmodium falciparum
GNPHES

SEQ ID NO: 3313442 - protein, 5 aa, Plasmodium falciparum
GNPHT

SEQ ID NO: 3313443 - protein, 5 aa, Plasmodium falciparum
GNPIN

SEQ ID NO: 3313444 - protein, 5 aa, Plasmodium falciparum
GNQAK

SEQ ID NO: 3313445 - protein, 6 aa, Plasmodium falciparum
GNQQRR

SEQ ID NO: 3313446 - protein, 8 aa, Plasmodium falciparum
GNQRSEDD

SEQ ID NO: 3313447 - protein, 5 aa, Plasmodium falciparum
GNRFD

SEQ ID NO: 3313448 - protein, 6 aa, Plasmodium falciparum
GNRGVN

SEQ ID NO: 3313449 - protein, 14 aa, Plasmodium falciparum
GNRINSNKEKEMKE

SEQ ID NO: 3313450 - protein, 5 aa, Plasmodium falciparum
GNRNF

SEQ ID NO: 3313451 - protein, 20 aa, Plasmodium falciparum
GNRNRTQEPTDANKTSSRSH

SEQ ID NO: 3313452 - protein, 5 aa, Plasmodium falciparum
GNRPS

SEQ ID NO: 3313453 - protein, 6 aa, Plasmodium falciparum
GNRSGV

SEQ ID NO: 3313454 - protein, 5 aa, Plasmodium falciparum
GNRTQ

SEQ ID NO: 3313455 - protein, 27 aa, Plasmodium falciparum
GNSENCITNENHDNHNTNKSISNDKDY

SEQ ID NO: 3313456 - protein, 10 aa, Plasmodium falciparum
GNSENEEEHD

SEQ ID NO: 3313457 - protein, 8 aa, Plasmodium falciparum
GNSEYSKN

SEQ ID NO: 3313458 - protein, 7 aa, Plasmodium falciparum
GNSLSQR

SEQ ID NO: 3313459 - protein, 6 aa, Plasmodium falciparum
GNSNDS

SEQ ID NO: 3313460 - protein, 17 aa, Plasmodium falciparum
GNSNNNMNNISNNNNNS

SEQ ID NO: 3313461 - protein, 16 aa, Plasmodium falciparum
GNSNNNNNNNNNNISN

SEQ ID NO: 3313462 - protein, 16 aa, Plasmodium falciparum
GNSNSNSNNNSNNNRN

SEQ ID NO: 3313463 - protein, 6 aa, Plasmodium falciparum
GNSRNY

SEQ ID NO: 3313464 - protein, 8 aa, Plasmodium falciparum
GNSSPYDE

SEQ ID NO: 3313465 - protein, 7 aa, Plasmodium falciparum
GNSSSTL

SEQ ID NO: 3313466 - protein, 4 aa, Plasmodium falciparum
GNST

SEQ ID NO: 3313467 - protein, 90 aa, Plasmodium falciparum
GNSWNKRKGKGSSINSNNDYSDNNDYSDNNDYSDNIDDSNNIDDSNNIDDSDNIDDSNNIDDSDNIDDSNNIDDSDNIDDSNNIDDSNNN

SEQ ID NO: 3313468 - protein, 5 aa, Plasmodium falciparum
GNSYN

SEQ ID NO: 3313469 - protein, 5 aa, Plasmodium falciparum
GNSYY

SEQ ID NO: 3313470 - protein, 6 aa, Plasmodium falciparum
GNTEEL

SEQ ID NO: 3313471 - protein, 4 aa, Plasmodium falciparum
GNTG

SEQ ID NO: 3313472 - protein, 8 aa, Plasmodium falciparum
GNTGTTNN

SEQ ID NO: 3313473 - protein, 5 aa, Plasmodium falciparum
GNTKH

SEQ ID NO: 3313474 - protein, 12 aa, Plasmodium falciparum
GNTNDKPTLDVK

SEQ ID NO: 3313475 - protein, 7 aa, Plasmodium falciparum
GNTNMEN

SEQ ID NO: 3313476 - protein, 9 aa, Plasmodium falciparum
GNTNNKNEL

SEQ ID NO: 3313477 - protein, 10 aa, Plasmodium falciparum
GNTNSGKTYT

SEQ ID NO: 3313478 - protein, 8 aa, Plasmodium falciparum
GNTPFSSN

SEQ ID NO: 3313479 - protein, 4 aa, Plasmodium falciparum
GNTR

SEQ ID NO: 3313480 - protein, 27 aa, Plasmodium falciparum
GNTSNNNHNNNKKNKDDDYNKKDDNNS

SEQ ID NO: 3313481 - protein, 63 aa, Plasmodium falciparum
GNTSSNKNNKIKNVDDKNNNVDDKNNNVDDKNNNVDDKNKNVGDKNKNGDDKNKNVGDSNKAK

SEQ ID NO: 3313482 - protein, 10 aa, Plasmodium falciparum
GNTSSPRSLK

SEQ ID NO: 3313483 - protein, 6 aa, Plasmodium falciparum
GNTTSY

SEQ ID NO: 3313484 - protein, 25 aa, Plasmodium falciparum
GNTTTNITTTNNNNNNNNNNSGYNN

SEQ ID NO: 3313485 - protein, 9 aa, Plasmodium falciparum
GNTTTNNSD

SEQ ID NO: 3313486 - protein, 4 aa, Plasmodium falciparum
GNTY

SEQ ID NO: 3313487 - protein, 18 aa, Plasmodium falciparum
GNTYTNSHNNNNNNNNNC

SEQ ID NO: 3313488 - protein, 12 aa, Plasmodium falciparum
GNVDEMESDEKL

SEQ ID NO: 3313489 - protein, 6 aa, Plasmodium falciparum
GNVDKK

SEQ ID NO: 3313490 - protein, 66 aa, Plasmodium falciparum
GNVEDNKGEDDKGEDDKGEDNKGEDNKGEDNKGEDDKGEDIKGEDIKGEDIKRDEKNNKTTEDKIN

SEQ ID NO: 3313491 - protein, 14 aa, Plasmodium falciparum
GNVEVTGNGGNEEM

SEQ ID NO: 3313492 - protein, 5 aa, Plasmodium falciparum
GNVHK

SEQ ID NO: 3313493 - protein, 12 aa, Plasmodium falciparum
GNVKNKVEKNNL

SEQ ID NO: 3313494 - protein, 10 aa, Plasmodium falciparum
GNVKNSELKN

SEQ ID NO: 3313495 - protein, 5 aa, Plasmodium falciparum
GNVKQ

SEQ ID NO: 3313496 - protein, 13 aa, Plasmodium falciparum
GNVKSDQINNETL

SEQ ID NO: 3313497 - protein, 18 aa, Plasmodium falciparum
GNVKSGKKKKGSTNDDEN

SEQ ID NO: 3313498 - protein, 9 aa, Plasmodium falciparum
GNVNRQKKK

SEQ ID NO: 3313499 - protein, 7 aa, Plasmodium falciparum
GNVPSTR

SEQ ID NO: 3313500 - protein, 7 aa, Plasmodium falciparum
GNVRKGK

SEQ ID NO: 3313501 - protein, 8 aa, Plasmodium falciparum
GNVSGNTS

SEQ ID NO: 3313502 - protein, 12 aa, Plasmodium falciparum
GNWGKDKDGKVI

SEQ ID NO: 3313503 - protein, 6 aa, Plasmodium falciparum
GNYDRE

SEQ ID NO: 3313504 - protein, 7 aa, Plasmodium falciparum
GNYGSNK

SEQ ID NO: 3313505 - protein, 4 aa, Plasmodium falciparum
GNYN

SEQ ID NO: 3313506 - protein, 13 aa, Plasmodium falciparum
GNYNSDSSNTQIN

SEQ ID NO: 3313507 - protein, 7 aa, Plasmodium falciparum
GNYNTPY

SEQ ID NO: 3313508 - protein, 9 aa, Plasmodium falciparum
GNYQNSEYY

SEQ ID NO: 3313509 - protein, 7 aa, Plasmodium falciparum
GNYRQSK

SEQ ID NO: 3313510 - protein, 8 aa, Plasmodium falciparum
GNYSNNEY

SEQ ID NO: 3313511 - protein, 4 aa, Plasmodium falciparum
GNYT

SEQ ID NO: 3313512 - protein, 7 aa, Plasmodium falciparum
GNYTNRN

SEQ ID NO: 3313513 - protein, 5 aa, Plasmodium falciparum
GNYTR

SEQ ID NO: 3313514 - protein, 10 aa, Plasmodium falciparum
GPAADAGLTG

SEQ ID NO: 3313515 - protein, 4 aa, Plasmodium falciparum
GPAC

SEQ ID NO: 3313516 - protein, 22 aa, Plasmodium falciparum
GPAKTPDNYASGSFGPTTAGRM

SEQ ID NO: 3313517 - protein, 6 aa, Plasmodium falciparum
GPATDK

SEQ ID NO: 3313518 - protein, 5 aa, Plasmodium falciparum
GPAVK

SEQ ID NO: 3313519 - protein, 5 aa, Plasmodium falciparum
GPDDS

SEQ ID NO: 3313520 - protein, 20 aa, Plasmodium falciparum
GPDEMNKTDLTASYAGGKYG

SEQ ID NO: 3313521 - protein, 8 aa, Plasmodium falciparum
GPDGKTQI

SEQ ID NO: 3313522 - protein, 11 aa, Plasmodium falciparum
GPDGTPYEGGT

SEQ ID NO: 3313523 - protein, 8 aa, Plasmodium falciparum
GPDKDKEG

SEQ ID NO: 3313524 - protein, 7 aa, Plasmodium falciparum
GPDKTKD

SEQ ID NO: 3313525 - protein, 5 aa, Plasmodium falciparum
GPDYD

SEQ ID NO: 3313526 - protein, 4 aa, Plasmodium falciparum
GPEE

SEQ ID NO: 3313527 - protein, 5 aa, Plasmodium falciparum
GPEKY

SEQ ID NO: 3313528 - protein, 6 aa, Plasmodium falciparum
GPENKE

SEQ ID NO: 3313529 - protein, 7 aa, Plasmodium falciparum
GPEPTTD

SEQ ID NO: 3313530 - protein, 6 aa, Plasmodium falciparum
GPESRG

SEQ ID NO: 3313531 - protein, 12 aa, Plasmodium falciparum
GPFDASKLQKSK

SEQ ID NO: 3313532 - protein, 9 aa, Plasmodium falciparum
GPGDSPYEN

SEQ ID NO: 3313533 - protein, 5 aa, Plasmodium falciparum
GPGIG

SEQ ID NO: 3313534 - protein, 18 aa, Plasmodium falciparum
GPGRVTSNGTKISPSVKE

SEQ ID NO: 3313535 - protein, 7 aa, Plasmodium falciparum
GPGSSGN

SEQ ID NO: 3313536 - protein, 6 aa, Plasmodium falciparum
GPHQSN

SEQ ID NO: 3313537 - protein, 4 aa, Plasmodium falciparum
GPHT

SEQ ID NO: 3313538 - protein, 10 aa, Plasmodium falciparum
GPIKRTKKKN

SEQ ID NO: 3313539 - protein, 5 aa, Plasmodium falciparum
GPINN

SEQ ID NO: 3313540 - protein, 5 aa, Plasmodium falciparum
GPITP

SEQ ID NO: 3313541 - protein, 5 aa, Plasmodium falciparum
GPKDE

SEQ ID NO: 3313542 - protein, 10 aa, Plasmodium falciparum
GPKDSPYEGG

SEQ ID NO: 3313543 - protein, 8 aa, Plasmodium falciparum
GPKFSSDR

SEQ ID NO: 3313544 - protein, 9 aa, Plasmodium falciparum
GPKLSSSEQ

SEQ ID NO: 3313545 - protein, 6 aa, Plasmodium falciparum
GPKNQT

SEQ ID NO: 3313546 - protein, 8 aa, Plasmodium falciparum
GPKSRRGR

SEQ ID NO: 3313547 - protein, 14 aa, Plasmodium falciparum
GPKVSCGNKERMTK

SEQ ID NO: 3313548 - protein, 25 aa, Plasmodium falciparum
GPLEKNNEWGKKKMNKKNNQSGMNQ

SEQ ID NO: 3313549 - protein, 6 aa, Plasmodium falciparum
GPLENI

SEQ ID NO: 3313550 - protein, 21 aa, Plasmodium falciparum
GPLGLSPKKVGDDIAKETQSW

SEQ ID NO: 3313551 - protein, 6 aa, Plasmodium falciparum
GPLRPE

SEQ ID NO: 3313552 - protein, 9 aa, Plasmodium falciparum
GPMDDEAAN

SEQ ID NO: 3313553 - protein, 4 aa, Plasmodium falciparum
GPNI

SEQ ID NO: 3313554 - protein, 9 aa, Plasmodium falciparum
GPNMGGKST

SEQ ID NO: 3313555 - protein, 13 aa, Plasmodium falciparum
GPNPDSKYATYSK

SEQ ID NO: 3313556 - protein, 4 aa, Plasmodium falciparum
GPNS

SEQ ID NO: 3313557 - protein, 8 aa, Plasmodium falciparum
GPPGSGKT

SEQ ID NO: 3313558 - protein, 9 aa, Plasmodium falciparum
GPPGTGKTL

SEQ ID NO: 3313559 - protein, 9 aa, Plasmodium falciparum
GPPGTGKTS

SEQ ID NO: 3313560 - protein, 4 aa, Plasmodium falciparum
GPPL

SEQ ID NO: 3313561 - protein, 9 aa, Plasmodium falciparum
GPPNSGKTY

SEQ ID NO: 3313562 - protein, 77 aa, Plasmodium falciparum
GPQGNNNNMNNSNSNNNNNSGSNNNSNNNNNNNNTNNNNNSGSNNNSNNNNNMNNNKNNNNNNNNSNSGNSNSSQNQ

SEQ ID NO: 3313563 - protein, 6 aa, Plasmodium falciparum
GPRSQT

SEQ ID NO: 3313564 - protein, 38 aa, Plasmodium falciparum
GPSETSKKNLRNNSLTKNEGLKRSKRNLKKNDIAKRKA

SEQ ID NO: 3313565 - protein, 8 aa, Plasmodium falciparum
GPSGQGKT

SEQ ID NO: 3313566 - protein, 9 aa, Plasmodium falciparum
GPSGSGKSA

SEQ ID NO: 3313567 - protein, 9 aa, Plasmodium falciparum
GPSGSGKTA

SEQ ID NO: 3313568 - protein, 9 aa, Plasmodium falciparum
GPSGTPYEG

SEQ ID NO: 3313569 - protein, 5 aa, Plasmodium falciparum
GPSIR

SEQ ID NO: 3313570 - protein, 4 aa, Plasmodium falciparum
GPSK

SEQ ID NO: 3313571 - protein, 7 aa, Plasmodium falciparum
GPSKAGN

SEQ ID NO: 3313572 - protein, 9 aa, Plasmodium falciparum
GPSKGKGPL

SEQ ID NO: 3313573 - protein, 9 aa, Plasmodium falciparum
GPSKGTHEY

SEQ ID NO: 3313574 - protein, 5 aa, Plasmodium falciparum
GPSNV

SEQ ID NO: 3313575 - protein, 6 aa, Plasmodium falciparum
GPSPLY

SEQ ID NO: 3313576 - protein, 8 aa, Plasmodium falciparum
GPSSDGET

SEQ ID NO: 3313577 - protein, 4 aa, Plasmodium falciparum
GPST

SEQ ID NO: 3313578 - protein, 15 aa, Plasmodium falciparum
GPTDRISKSKKSYER

SEQ ID NO: 3313579 - protein, 6 aa, Plasmodium falciparum
GPTGIT

SEQ ID NO: 3313580 - protein, 8 aa, Plasmodium falciparum
GPTPSQTK

SEQ ID NO: 3313581 - protein, 31 aa, Plasmodium falciparum
GPTYKNSHNRENELKKKKNTKAIKKKNDTDM

SEQ ID NO: 3313582 - protein, 8 aa, Plasmodium falciparum
GPVGGAPL

SEQ ID NO: 3313583 - protein, 5 aa, Plasmodium falciparum
GPVRE

SEQ ID NO: 3313584 - protein, 8 aa, Plasmodium falciparum
GPYAQSSY

SEQ ID NO: 3313585 - protein, 14 aa, Plasmodium falciparum
GPYESYQGSPASQG

SEQ ID NO: 3313586 - protein, 5 aa, Plasmodium falciparum
GPYEW

SEQ ID NO: 3313587 - protein, 4 aa, Plasmodium falciparum
GPYN

SEQ ID NO: 3313588 - protein, 13 aa, Plasmodium falciparum
GPYSVTEAGSPHL

SEQ ID NO: 3313589 - protein, 7 aa, Plasmodium falciparum
GPYVSGE

SEQ ID NO: 3313590 - protein, 7 aa, Plasmodium falciparum
GQADSTR

SEQ ID NO: 3313591 - protein, 8 aa, Plasmodium falciparum
GQAGITKG

SEQ ID NO: 3313592 - protein, 9 aa, Plasmodium falciparum
GQAKCEEEK

SEQ ID NO: 3313593 - protein, 4 aa, Plasmodium falciparum
GQAQ

SEQ ID NO: 3313594 - protein, 4 aa, Plasmodium falciparum
GQDK

SEQ ID NO: 3313595 - protein, 5 aa, Plasmodium falciparum
GQDKE

SEQ ID NO: 3313596 - protein, 6 aa, Plasmodium falciparum
GQDNYN

SEQ ID NO: 3313597 - protein, 8 aa, Plasmodium falciparum
GQDQTDRQ

SEQ ID NO: 3313598 - protein, 7 aa, Plasmodium falciparum
GQDVRTA

SEQ ID NO: 3313599 - protein, 37 aa, Plasmodium falciparum
GQEERKQCSGHNKRSSYNRGRSYSYEPNNNNNNNKKR

SEQ ID NO: 3313600 - protein, 32 aa, Plasmodium falciparum
GQEKNEQENPNEEKEERDISSENRKRSQEKKI

SEQ ID NO: 3313601 - protein, 5 aa, Plasmodium falciparum
GQEND

SEQ ID NO: 3313602 - protein, 16 aa, Plasmodium falciparum
GQENNLDEKKKKKTII

SEQ ID NO: 3313603 - protein, 5 aa, Plasmodium falciparum
GQENR

SEQ ID NO: 3313604 - protein, 9 aa, Plasmodium falciparum
GQEQDVNSG

SEQ ID NO: 3313605 - protein, 5 aa, Plasmodium falciparum
GQERF

SEQ ID NO: 3313606 - protein, 5 aa, Plasmodium falciparum
GQERY

SEQ ID NO: 3313607 - protein, 5 aa, Plasmodium falciparum
GQEYS

SEQ ID NO: 3313608 - protein, 4 aa, Plasmodium falciparum
GQGA

SEQ ID NO: 3313609 - protein, 13 aa, Plasmodium falciparum
GQGNTTRKDNYTK

SEQ ID NO: 3313610 - protein, 6 aa, Plasmodium falciparum
GQGQEN

SEQ ID NO: 3313611 - protein, 10 aa, Plasmodium falciparum
GQGRASPDHP

SEQ ID NO: 3313612 - protein, 5 aa, Plasmodium falciparum
GQHTD

SEQ ID NO: 3313613 - protein, 8 aa, Plasmodium falciparum
GQIAPGGS

SEQ ID NO: 3313614 - protein, 10 aa, Plasmodium falciparum
GQKAFKPTTE

SEQ ID NO: 3313615 - protein, 15 aa, Plasmodium falciparum
GQKDDDDKSIHNNND

SEQ ID NO: 3313616 - protein, 10 aa, Plasmodium falciparum
GQKIKQTNNM

SEQ ID NO: 3313617 - protein, 9 aa, Plasmodium falciparum
GQKKRHVEK

SEQ ID NO: 3313618 - protein, 6 aa, Plasmodium falciparum
GQKMNN

SEQ ID NO: 3313619 - protein, 12 aa, Plasmodium falciparum
GQLTEKQEQLSS

SEQ ID NO: 3313620 - protein, 5 aa, Plasmodium falciparum
GQNDG

SEQ ID NO: 3313621 - protein, 13 aa, Plasmodium falciparum
GQNEDKKNKENYN

SEQ ID NO: 3313622 - protein, 23 aa, Plasmodium falciparum
GQNGNPSENPSENPSESQNENPI

SEQ ID NO: 3313623 - protein, 23 aa, Plasmodium falciparum
GQNINNTNANTMKEKRNNNLRDD

SEQ ID NO: 3313624 - protein, 9 aa, Plasmodium falciparum
GQNKNNLSA

SEQ ID NO: 3313625 - protein, 5 aa, Plasmodium falciparum
GQNNS

SEQ ID NO: 3313626 - protein, 16 aa, Plasmodium falciparum
GQNNSNCNSNNEEYRN

SEQ ID NO: 3313627 - protein, 8 aa, Plasmodium falciparum
GQNPTEAE

SEQ ID NO: 3313628 - protein, 4 aa, Plasmodium falciparum
GQNY

SEQ ID NO: 3313629 - protein, 8 aa, Plasmodium falciparum
GQPGTGKT

SEQ ID NO: 3313630 - protein, 6 aa, Plasmodium falciparum
GQQVNN

SEQ ID NO: 3313631 - protein, 15 aa, Plasmodium falciparum
GQREGMNNVKSTNSC

SEQ ID NO: 3313632 - protein, 6 aa, Plasmodium falciparum
GQREVS

SEQ ID NO: 3313633 - protein, 5 aa, Plasmodium falciparum
GQRTP

SEQ ID NO: 3313634 - protein, 4 aa, Plasmodium falciparum
GQSE

SEQ ID NO: 3313635 - protein, 24 aa, Plasmodium falciparum
GQSEDGKKTKVRLPSGAKKTIDAK

SEQ ID NO: 3313636 - protein, 6 aa, Plasmodium falciparum
GQSEEN

SEQ ID NO: 3313637 - protein, 13 aa, Plasmodium falciparum
GQSKIKDVTQNAS

SEQ ID NO: 3313638 - protein, 20 aa, Plasmodium falciparum
GQSNESDETNKEGKNVHNSV

SEQ ID NO: 3313639 - protein, 8 aa, Plasmodium falciparum
GQSSFNDQ

SEQ ID NO: 3313640 - protein, 5 aa, Plasmodium falciparum
GQSSI

SEQ ID NO: 3313641 - protein, 5 aa, Plasmodium falciparum
GQSSV

SEQ ID NO: 3313642 - protein, 8 aa, Plasmodium falciparum
GQTGSGKT

SEQ ID NO: 3313643 - protein, 9 aa, Plasmodium falciparum
GQTGSGKTY

SEQ ID NO: 3313644 - protein, 9 aa, Plasmodium falciparum
GQTNSGKTY

SEQ ID NO: 3313645 - protein, 18 aa, Plasmodium falciparum
GQTNYRSEFGPKPLPELP

SEQ ID NO: 3313646 - protein, 5 aa, Plasmodium falciparum
GQTRL

SEQ ID NO: 3313647 - protein, 5 aa, Plasmodium falciparum
GQTSK

SEQ ID NO: 3313648 - protein, 5 aa, Plasmodium falciparum
GQTSN

SEQ ID NO: 3313649 - protein, 11 aa, Plasmodium falciparum
GQTSQHKKKSD

SEQ ID NO: 3313650 - protein, 10 aa, Plasmodium falciparum
GQTTKAGAKL

SEQ ID NO: 3313651 - protein, 5 aa, Plasmodium falciparum
GQTVG

SEQ ID NO: 3313652 - protein, 13 aa, Plasmodium falciparum
GQYAPKTSSGPHK

SEQ ID NO: 3313653 - protein, 30 aa, Plasmodium falciparum
GQYDHDNNNKKNNSSNSSNNNNNNSNNSMN

SEQ ID NO: 3313654 - protein, 6 aa, Plasmodium falciparum
GQYKNK

SEQ ID NO: 3313655 - protein, 12 aa, Plasmodium falciparum
GQYSNPSQPNKQ

SEQ ID NO: 3313656 - protein, 10 aa, Plasmodium falciparum
GRAGRDNSDA

SEQ ID NO: 3313657 - protein, 6 aa, Plasmodium falciparum
GRAIQA

SEQ ID NO: 3313658 - protein, 7 aa, Plasmodium falciparum
GRANRNP

SEQ ID NO: 3313659 - protein, 8 aa, Plasmodium falciparum
GRDEGEKG

SEQ ID NO: 3313660 - protein, 33 aa, Plasmodium falciparum
GRDESSLEGMEERRTEKPVKSYYNQRKKKTNLL

SEQ ID NO: 3313661 - protein, 6 aa, Plasmodium falciparum
GRDIDG

SEQ ID NO: 3313662 - protein, 5 aa, Plasmodium falciparum
GRDNH

SEQ ID NO: 3313663 - protein, 8 aa, Plasmodium falciparum
GRDYSKES

SEQ ID NO: 3313664 - protein, 8 aa, Plasmodium falciparum
GREEDSSN

SEQ ID NO: 3313665 - protein, 8 aa, Plasmodium falciparum
GRERLQND

SEQ ID NO: 3313666 - protein, 7 aa, Plasmodium falciparum
GREVDAE

SEQ ID NO: 3313667 - protein, 11 aa, Plasmodium falciparum
GRFKGDKTNKF

SEQ ID NO: 3313668 - protein, 12 aa, Plasmodium falciparum
GRGELSERQQKL

SEQ ID NO: 3313669 - protein, 6 aa, Plasmodium falciparum
GRGESR

SEQ ID NO: 3313670 - protein, 5 aa, Plasmodium falciparum
GRGKY

SEQ ID NO: 3313671 - protein, 6 aa, Plasmodium falciparum
GRGPLV

SEQ ID NO: 3313672 - protein, 18 aa, Plasmodium falciparum
GRGSGYLEGEEKKEANES

SEQ ID NO: 3313673 - protein, 10 aa, Plasmodium falciparum
GRGTSSFDGT

SEQ ID NO: 3313674 - protein, 9 aa, Plasmodium falciparum
GRGTSTYEG

SEQ ID NO: 3313675 - protein, 9 aa, Plasmodium falciparum
GRGTYTYED

SEQ ID NO: 3313676 - protein, 17 aa, Plasmodium falciparum
GRGVNDNENISENTEKM

SEQ ID NO: 3313677 - protein, 5 aa, Plasmodium falciparum
GRHLE

SEQ ID NO: 3313678 - protein, 5 aa, Plasmodium falciparum
GRHSF

SEQ ID NO: 3313679 - protein, 4 aa, Plasmodium falciparum
GRII

SEQ ID NO: 3313680 - protein, 6 aa, Plasmodium falciparum
GRKDHP

SEQ ID NO: 3313681 - protein, 5 aa, Plasmodium falciparum
GRKEK

SEQ ID NO: 3313682 - protein, 16 aa, Plasmodium falciparum
GRKNTDNGNINSSKNN

SEQ ID NO: 3313683 - protein, 16 aa, Plasmodium falciparum
GRKNYKKNALDSVSSQ

SEQ ID NO: 3313684 - protein, 6 aa, Plasmodium falciparum
GRKQKS

SEQ ID NO: 3313685 - protein, 11 aa, Plasmodium falciparum
GRKRSVRERSN

SEQ ID NO: 3313686 - protein, 6 aa, Plasmodium falciparum
GRKSGY

SEQ ID NO: 3313687 - protein, 8 aa, Plasmodium falciparum
GRMGTPEE

SEQ ID NO: 3313688 - protein, 6 aa, Plasmodium falciparum
GRMQDN

SEQ ID NO: 3313689 - protein, 4 aa, Plasmodium falciparum
GRNA

SEQ ID NO: 3313690 - protein, 7 aa, Plasmodium falciparum
GRNAEAQ

SEQ ID NO: 3313691 - protein, 11 aa, Plasmodium falciparum
GRNAGSSLSEG

SEQ ID NO: 3313692 - protein, 4 aa, Plasmodium falciparum
GRNE

SEQ ID NO: 3313693 - protein, 16 aa, Plasmodium falciparum
GRNFDQKNKISSHEKN

SEQ ID NO: 3313694 - protein, 21 aa, Plasmodium falciparum
GRNKTSSNNKNNNNKNHNSNI

SEQ ID NO: 3313695 - protein, 5 aa, Plasmodium falciparum
GRNPS

SEQ ID NO: 3313696 - protein, 5 aa, Plasmodium falciparum
GRNPY

SEQ ID NO: 3313697 - protein, 6 aa, Plasmodium falciparum
GRPQFD

SEQ ID NO: 3313698 - protein, 48 aa, Plasmodium falciparum
GRPSKYRPPIEPPPNPDNINSNNNNNNNNNNNNDNNNDNNNDNTINNN

SEQ ID NO: 3313699 - protein, 4 aa, Plasmodium falciparum
GRQG

SEQ ID NO: 3313700 - protein, 4 aa, Plasmodium falciparum
GRQN

SEQ ID NO: 3313701 - protein, 5 aa, Plasmodium falciparum
GRQNE

SEQ ID NO: 3313702 - protein, 8 aa, Plasmodium falciparum
GRQNEDTK

SEQ ID NO: 3313703 - protein, 135 aa, Plasmodium falciparum
GRRDSSRRGSVKQEKGKERRGSKNVSKKVSNSKYTRKKSKRIKEESDESDDDDEEEEEEDDEEEEEEEEEEEEEEEEEEEEEEEEEEEEEEEEEEEEEEEEEEEEEEEVEEDNDNSDNNDESDEVYTNRSRRSTR

SEQ ID NO: 3313704 - protein, 14 aa, Plasmodium falciparum
GRRNDQSRCDQGNT

SEQ ID NO: 3313705 - protein, 12 aa, Plasmodium falciparum
GRRNPCGNREQN

SEQ ID NO: 3313706 - protein, 9 aa, Plasmodium falciparum
GRRQSENLG

SEQ ID NO: 3313707 - protein, 5 aa, Plasmodium falciparum
GRRRK

SEQ ID NO: 3313708 - protein, 11 aa, Plasmodium falciparum
GRRRKEKYEDL

SEQ ID NO: 3313709 - protein, 5 aa, Plasmodium falciparum
GRRYT

SEQ ID NO: 3313710 - protein, 10 aa, Plasmodium falciparum
GRSGHSVGDL

SEQ ID NO: 3313711 - protein, 17 aa, Plasmodium falciparum
GRSGNLDDVQPKSAGNS

SEQ ID NO: 3313712 - protein, 7 aa, Plasmodium falciparum
GRSKKYS

SEQ ID NO: 3313713 - protein, 7 aa, Plasmodium falciparum
GRSRKDF

SEQ ID NO: 3313714 - protein, 25 aa, Plasmodium falciparum
GRSSYTNELSNEKNKYNEENSDEGN

SEQ ID NO: 3313715 - protein, 8 aa, Plasmodium falciparum
GRTARNFK

SEQ ID NO: 3313716 - protein, 8 aa, Plasmodium falciparum
GRTGRAGM

SEQ ID NO: 3313717 - protein, 10 aa, Plasmodium falciparum
GRTGRFDKTG

SEQ ID NO: 3313718 - protein, 7 aa, Plasmodium falciparum
GRTGRFT

SEQ ID NO: 3313719 - protein, 8 aa, Plasmodium falciparum
GRTGSRGG

SEQ ID NO: 3313720 - protein, 7 aa, Plasmodium falciparum
GRTNEEN

SEQ ID NO: 3313721 - protein, 8 aa, Plasmodium falciparum
GRTPSNTF

SEQ ID NO: 3313722 - protein, 13 aa, Plasmodium falciparum
GRTRRRSSNGSNF

SEQ ID NO: 3313723 - protein, 10 aa, Plasmodium falciparum
GRVEGRNGSI

SEQ ID NO: 3313724 - protein, 4 aa, Plasmodium falciparum
GRYD

SEQ ID NO: 3313725 - protein, 6 aa, Plasmodium falciparum
GRYDEQ

SEQ ID NO: 3313726 - protein, 4 aa, Plasmodium falciparum
GRYV

SEQ ID NO: 3313727 - protein, 7 aa, Plasmodium falciparum
GSAENKF

SEQ ID NO: 3313728 - protein, 17 aa, Plasmodium falciparum
GSALENKKQQDKKRKYF

SEQ ID NO: 3313729 - protein, 4 aa, Plasmodium falciparum
GSAT

SEQ ID NO: 3313730 - protein, 9 aa, Plasmodium falciparum
GSCGVSSKD

SEQ ID NO: 3313731 - protein, 10 aa, Plasmodium falciparum
GSCISSTSSC

SEQ ID NO: 3313732 - protein, 4 aa, Plasmodium falciparum
GSDA

SEQ ID NO: 3313733 - protein, 13 aa, Plasmodium falciparum
GSDAYNKKHEKTL

SEQ ID NO: 3313734 - protein, 6 aa, Plasmodium falciparum
GSDDKT

SEQ ID NO: 3313735 - protein, 6 aa, Plasmodium falciparum
GSDEYE

SEQ ID NO: 3313736 - protein, 17 aa, Plasmodium falciparum
GSDKEKYIEQNEPSIYN

SEQ ID NO: 3313737 - protein, 17 aa, Plasmodium falciparum
GSDNSGVVSKGLKDNNQ

SEQ ID NO: 3313738 - protein, 6 aa, Plasmodium falciparum
GSDPKC

SEQ ID NO: 3313739 - protein, 10 aa, Plasmodium falciparum
GSDPQNINKY

SEQ ID NO: 3313740 - protein, 10 aa, Plasmodium falciparum
GSDSCAGAGM

SEQ ID NO: 3313741 - protein, 9 aa, Plasmodium falciparum
GSDTKKKKV

SEQ ID NO: 3313742 - protein, 6 aa, Plasmodium falciparum
GSDYNI

SEQ ID NO: 3313743 - protein, 6 aa, Plasmodium falciparum
GSEDGN

SEQ ID NO: 3313744 - protein, 8 aa, Plasmodium falciparum
GSEEYEKN

SEQ ID NO: 3313745 - protein, 5 aa, Plasmodium falciparum
GSEKN

SEQ ID NO: 3313746 - protein, 5 aa, Plasmodium falciparum
GSELL

SEQ ID NO: 3313747 - protein, 6 aa, Plasmodium falciparum
GSELSK

SEQ ID NO: 3313748 - protein, 12 aa, Plasmodium falciparum
GSENALKSSYGS

SEQ ID NO: 3313749 - protein, 5 aa, Plasmodium falciparum
GSENF

SEQ ID NO: 3313750 - protein, 22 aa, Plasmodium falciparum
GSEQTRRKGYSINKNKENSKNL

SEQ ID NO: 3313751 - protein, 20 aa, Plasmodium falciparum
GSERASATSNKGERFKEGSY

SEQ ID NO: 3313752 - protein, 12 aa, Plasmodium falciparum
GSERASQTNNKG

SEQ ID NO: 3313753 - protein, 22 aa, Plasmodium falciparum
GSERGADTVSQNKQTQTDGANI

SEQ ID NO: 3313754 - protein, 6 aa, Plasmodium falciparum
GSESKK

SEQ ID NO: 3313755 - protein, 7 aa, Plasmodium falciparum
GSEYSEQ

SEQ ID NO: 3313756 - protein, 5 aa, Plasmodium falciparum
GSFKK

SEQ ID NO: 3313757 - protein, 14 aa, Plasmodium falciparum
GSFSGDENGKEEDH

SEQ ID NO: 3313758 - protein, 8 aa, Plasmodium falciparum
GSFTEKNA

SEQ ID NO: 3313759 - protein, 5 aa, Plasmodium falciparum
GSGAY

SEQ ID NO: 3313760 - protein, 4 aa, Plasmodium falciparum
GSGC

SEQ ID NO: 3313761 - protein, 11 aa, Plasmodium falciparum
GSGDGNSYNKA

SEQ ID NO: 3313762 - protein, 6 aa, Plasmodium falciparum
GSGDSL

SEQ ID NO: 3313763 - protein, 8 aa, Plasmodium falciparum
GSGEINDY

SEQ ID NO: 3313764 - protein, 6 aa, Plasmodium falciparum
GSGGKT

SEQ ID NO: 3313765 - protein, 5 aa, Plasmodium falciparum
GSGGN

SEQ ID NO: 3313766 - protein, 11 aa, Plasmodium falciparum
GSGKPIDKGPN

SEQ ID NO: 3313767 - protein, 7 aa, Plasmodium falciparum
GSGKSTY

SEQ ID NO: 3313768 - protein, 9 aa, Plasmodium falciparum
GSGKTSTLT

SEQ ID NO: 3313769 - protein, 8 aa, Plasmodium falciparum
GSGKTTTC

SEQ ID NO: 3313770 - protein, 7 aa, Plasmodium falciparum
GSGKTTY

SEQ ID NO: 3313771 - protein, 4 aa, Plasmodium falciparum
GSGL

SEQ ID NO: 3313772 - protein, 4 aa, Plasmodium falciparum
GSGM

SEQ ID NO: 3313773 - protein, 6 aa, Plasmodium falciparum
GSGMPL

SEQ ID NO: 3313774 - protein, 5 aa, Plasmodium falciparum
GSGNN

SEQ ID NO: 3313775 - protein, 7 aa, Plasmodium falciparum
GSGPRSD

SEQ ID NO: 3313776 - protein, 5 aa, Plasmodium falciparum
GSGPS

SEQ ID NO: 3313777 - protein, 4 aa, Plasmodium falciparum
GSGS

SEQ ID NO: 3313778 - protein, 6 aa, Plasmodium falciparum
GSGSTY

SEQ ID NO: 3313779 - protein, 6 aa, Plasmodium falciparum
GSGTDY

SEQ ID NO: 3313780 - protein, 7 aa, Plasmodium falciparum
GSGTNGY

SEQ ID NO: 3313781 - protein, 19 aa, Plasmodium falciparum
GSGTSAESNIPSFRGSSNS

SEQ ID NO: 3313782 - protein, 6 aa, Plasmodium falciparum
GSHDKT

SEQ ID NO: 3313783 - protein, 6 aa, Plasmodium falciparum
GSHEDH

SEQ ID NO: 3313784 - protein, 9 aa, Plasmodium falciparum
GSHGNHNKT

SEQ ID NO: 3313785 - protein, 5 aa, Plasmodium falciparum
GSHPH

SEQ ID NO: 3313786 - protein, 9 aa, Plasmodium falciparum
GSHTNNNVK

SEQ ID NO: 3313787 - protein, 14 aa, Plasmodium falciparum
GSIHNNNHNNIGHN

SEQ ID NO: 3313788 - protein, 4 aa, Plasmodium falciparum
GSIN

SEQ ID NO: 3313789 - protein, 8 aa, Plasmodium falciparum
GSINPSEW

SEQ ID NO: 3313790 - protein, 4 aa, Plasmodium falciparum
GSIP

SEQ ID NO: 3313791 - protein, 6 aa, Plasmodium falciparum
GSIPEG

SEQ ID NO: 3313792 - protein, 6 aa, Plasmodium falciparum
GSIPPE

SEQ ID NO: 3313793 - protein, 5 aa, Plasmodium falciparum
GSIQN

SEQ ID NO: 3313794 - protein, 4 aa, Plasmodium falciparum
GSIR

SEQ ID NO: 3313795 - protein, 26 aa, Plasmodium falciparum
GSISKKKKKRNDKLKKDVSNNKDERL

SEQ ID NO: 3313796 - protein, 26 aa, Plasmodium falciparum
GSISSSNNNNSNNNSNNNNSNSTMTS

SEQ ID NO: 3313797 - protein, 16 aa, Plasmodium falciparum
GSIVTKETKEIKEKTY

SEQ ID NO: 3313798 - protein, 4 aa, Plasmodium falciparum
GSKD

SEQ ID NO: 3313799 - protein, 6 aa, Plasmodium falciparum
GSKDNI

SEQ ID NO: 3313800 - protein, 7 aa, Plasmodium falciparum
GSKDSTV

SEQ ID NO: 3313801 - protein, 13 aa, Plasmodium falciparum
GSKEEGNNNIEEY

SEQ ID NO: 3313802 - protein, 5 aa, Plasmodium falciparum
GSKGI

SEQ ID NO: 3313803 - protein, 10 aa, Plasmodium falciparum
GSKGSPNTSI

SEQ ID NO: 3313804 - protein, 12 aa, Plasmodium falciparum
GSKHKKKGISHY

SEQ ID NO: 3313805 - protein, 6 aa, Plasmodium falciparum
GSKHLG

SEQ ID NO: 3313806 - protein, 20 aa, Plasmodium falciparum
GSKIYNRQSYKSLKDIKEDS

SEQ ID NO: 3313807 - protein, 33 aa, Plasmodium falciparum
GSKKKKGKEKKVEKSSKGKSEKTDKNEDNNRNG

SEQ ID NO: 3313808 - protein, 6 aa, Plasmodium falciparum
GSKMGN

SEQ ID NO: 3313809 - protein, 19 aa, Plasmodium falciparum
GSKRKRHFKEDDDKSRNSH

SEQ ID NO: 3313810 - protein, 8 aa, Plasmodium falciparum
GSKSQGLN

SEQ ID NO: 3313811 - protein, 7 aa, Plasmodium falciparum
GSKSSDV

SEQ ID NO: 3313812 - protein, 4 aa, Plasmodium falciparum
GSKT

SEQ ID NO: 3313813 - protein, 12 aa, Plasmodium falciparum
GSKYENKKNNGV

SEQ ID NO: 3313814 - protein, 4 aa, Plasmodium falciparum
GSLG

SEQ ID NO: 3313815 - protein, 10 aa, Plasmodium falciparum
GSLHQSTKNC

SEQ ID NO: 3313816 - protein, 19 aa, Plasmodium falciparum
GSLKSVNKEEENCSQRTWK

SEQ ID NO: 3313817 - protein, 14 aa, Plasmodium falciparum
GSLNKKSEEANDCR

SEQ ID NO: 3313818 - protein, 47 aa, Plasmodium falciparum
GSLNNKKRKKEHTAYENGNENGNENGNGNENGNENENGNENGNENEY

SEQ ID NO: 3313819 - protein, 9 aa, Plasmodium falciparum
GSLNTTSHI

SEQ ID NO: 3313820 - protein, 8 aa, Plasmodium falciparum
GSLPKENI

SEQ ID NO: 3313821 - protein, 4 aa, Plasmodium falciparum
GSLQ

SEQ ID NO: 3313822 - protein, 33 aa, Plasmodium falciparum
GSLSYESNEESENSDNRRNVSDTLNKDRNNKVE

SEQ ID NO: 3313823 - protein, 4 aa, Plasmodium falciparum
GSMY

SEQ ID NO: 3313824 - protein, 7 aa, Plasmodium falciparum
GSNDNDK

SEQ ID NO: 3313825 - protein, 7 aa, Plasmodium falciparum
GSNDSYR

SEQ ID NO: 3313826 - protein, 4 aa, Plasmodium falciparum
GSNG

SEQ ID NO: 3313827 - protein, 9 aa, Plasmodium falciparum
GSNGKNKKI

SEQ ID NO: 3313828 - protein, 9 aa, Plasmodium falciparum
GSNGSTKYA

SEQ ID NO: 3313829 - protein, 7 aa, Plasmodium falciparum
GSNIKPN

SEQ ID NO: 3313830 - protein, 4 aa, Plasmodium falciparum
GSNK

SEQ ID NO: 3313831 - protein, 16 aa, Plasmodium falciparum
GSNKNTTKINSSSANT

SEQ ID NO: 3313832 - protein, 4 aa, Plasmodium falciparum
GSNN

SEQ ID NO: 3313833 - protein, 7 aa, Plasmodium falciparum
GSNNINM

SEQ ID NO: 3313834 - protein, 21 aa, Plasmodium falciparum
GSNNSSINNSNHNNSNGLHNS

SEQ ID NO: 3313835 - protein, 10 aa, Plasmodium falciparum
GSNNSSSYVT

SEQ ID NO: 3313836 - protein, 7 aa, Plasmodium falciparum
GSNPGSD

SEQ ID NO: 3313837 - protein, 5 aa, Plasmodium falciparum
GSNQM

SEQ ID NO: 3313838 - protein, 17 aa, Plasmodium falciparum
GSNTMSSTISKTEPNSR

SEQ ID NO: 3313839 - protein, 7 aa, Plasmodium falciparum
GSNTSKR

SEQ ID NO: 3313840 - protein, 33 aa, Plasmodium falciparum
GSNTSNNNNNTSNNNNKTNQGNALRGSCGSNSL

SEQ ID NO: 3313841 - protein, 6 aa, Plasmodium falciparum
GSPEAK

SEQ ID NO: 3313842 - protein, 5 aa, Plasmodium falciparum
GSPEK

SEQ ID NO: 3313843 - protein, 10 aa, Plasmodium falciparum
GSPKITKDGV

SEQ ID NO: 3313844 - protein, 6 aa, Plasmodium falciparum
GSPKMN

SEQ ID NO: 3313845 - protein, 5 aa, Plasmodium falciparum
GSPLA

SEQ ID NO: 3313846 - protein, 6 aa, Plasmodium falciparum
GSPSRI

SEQ ID NO: 3313847 - protein, 14 aa, Plasmodium falciparum
GSPYMKKNSSGNKL

SEQ ID NO: 3313848 - protein, 12 aa, Plasmodium falciparum
GSQAFEKEEEEL

SEQ ID NO: 3313849 - protein, 15 aa, Plasmodium falciparum
GSQKIKSHKEALEKK

SEQ ID NO: 3313850 - protein, 5 aa, Plasmodium falciparum
GSQLE

SEQ ID NO: 3313851 - protein, 4 aa, Plasmodium falciparum
GSQN

SEQ ID NO: 3313852 - protein, 5 aa, Plasmodium falciparum
GSQRI

SEQ ID NO: 3313853 - protein, 10 aa, Plasmodium falciparum
GSRDNGINKR

SEQ ID NO: 3313854 - protein, 7 aa, Plasmodium falciparum
GSRGNGN

SEQ ID NO: 3313855 - protein, 13 aa, Plasmodium falciparum
GSRKEGGKDASAA

SEQ ID NO: 3313856 - protein, 14 aa, Plasmodium falciparum
GSRPTNYEPRKEKI

SEQ ID NO: 3313857 - protein, 14 aa, Plasmodium falciparum
GSRTDGENESTRRI

SEQ ID NO: 3313858 - protein, 4 aa, Plasmodium falciparum
GSRY

SEQ ID NO: 3313859 - protein, 4 aa, Plasmodium falciparum
GSSD

SEQ ID NO: 3313860 - protein, 10 aa, Plasmodium falciparum
GSSEKTKNEP

SEQ ID NO: 3313861 - protein, 8 aa, Plasmodium falciparum
GSSGTPKG

SEQ ID NO: 3313862 - protein, 4 aa, Plasmodium falciparum
GSSI

SEQ ID NO: 3313863 - protein, 18 aa, Plasmodium falciparum
GSSLKKKENYVKQEEQSN

SEQ ID NO: 3313864 - protein, 6 aa, Plasmodium falciparum
GSSLNK

SEQ ID NO: 3313865 - protein, 12 aa, Plasmodium falciparum
GSSNFDKNNNSL

SEQ ID NO: 3313866 - protein, 77 aa, Plasmodium falciparum
GSSNNSNDINRHNNNRNNTTTPTTNNNNNNNNNNNNNNNNNNNNNNNHMGNRNSSRNNENTNETNENETSQNDNRNR

SEQ ID NO: 3313867 - protein, 5 aa, Plasmodium falciparum
GSSNS

SEQ ID NO: 3313868 - protein, 10 aa, Plasmodium falciparum
GSSPVNNQGE

SEQ ID NO: 3313869 - protein, 6 aa, Plasmodium falciparum
GSSQGY

SEQ ID NO: 3313870 - protein, 8 aa, Plasmodium falciparum
GSSSSIPK

SEQ ID NO: 3313871 - protein, 10 aa, Plasmodium falciparum
GSSTNNNNRS

SEQ ID NO: 3313872 - protein, 7 aa, Plasmodium falciparum
GSSYNSY

SEQ ID NO: 3313873 - protein, 6 aa, Plasmodium falciparum
GSTDSL

SEQ ID NO: 3313874 - protein, 10 aa, Plasmodium falciparum
GSTGTTYTNG

SEQ ID NO: 3313875 - protein, 4 aa, Plasmodium falciparum
GSTK

SEQ ID NO: 3313876 - protein, 7 aa, Plasmodium falciparum
GSTLNNT

SEQ ID NO: 3313877 - protein, 6 aa, Plasmodium falciparum
GSTNEY

SEQ ID NO: 3313878 - protein, 9 aa, Plasmodium falciparum
GSTNSENCN

SEQ ID NO: 3313879 - protein, 7 aa, Plasmodium falciparum
GSTNTIE

SEQ ID NO: 3313880 - protein, 9 aa, Plasmodium falciparum
GSTPGDERQ

SEQ ID NO: 3313881 - protein, 22 aa, Plasmodium falciparum
GSTRVSDKWKNKNEEHTKFLTP

SEQ ID NO: 3313882 - protein, 5 aa, Plasmodium falciparum
GSTSD

SEQ ID NO: 3313883 - protein, 5 aa, Plasmodium falciparum
GSTSL

SEQ ID NO: 3313884 - protein, 5 aa, Plasmodium falciparum
GSTTF

SEQ ID NO: 3313885 - protein, 7 aa, Plasmodium falciparum
GSTTKTS

SEQ ID NO: 3313886 - protein, 7 aa, Plasmodium falciparum
GSVDDRR

SEQ ID NO: 3313887 - protein, 6 aa, Plasmodium falciparum
GSVDSS

SEQ ID NO: 3313888 - protein, 9 aa, Plasmodium falciparum
GSVGKGPGC

SEQ ID NO: 3313889 - protein, 34 aa, Plasmodium falciparum
GSVKKEKRKYNTNSNNNNNNNDNNNNNNNRDVDA

SEQ ID NO: 3313890 - protein, 6 aa, Plasmodium falciparum
GSYESP

SEQ ID NO: 3313891 - protein, 5 aa, Plasmodium falciparum
GSYNS

SEQ ID NO: 3313892 - protein, 7 aa, Plasmodium falciparum
GSYSHEK

SEQ ID NO: 3313893 - protein, 6 aa, Plasmodium falciparum
GSYSVD

SEQ ID NO: 3313894 - protein, 5 aa, Plasmodium falciparum
GSYTH

SEQ ID NO: 3313895 - protein, 9 aa, Plasmodium falciparum
GTAADSAPI

SEQ ID NO: 3313896 - protein, 15 aa, Plasmodium falciparum
GTAHTKRKSKRNDDD

SEQ ID NO: 3313897 - protein, 11 aa, Plasmodium falciparum
GTDDEEKDTKQ

SEQ ID NO: 3313898 - protein, 4 aa, Plasmodium falciparum
GTDE

SEQ ID NO: 3313899 - protein, 9 aa, Plasmodium falciparum
GTDGKKKYG

SEQ ID NO: 3313900 - protein, 19 aa, Plasmodium falciparum
GTDKNYDKKSNERQNQKNI

SEQ ID NO: 3313901 - protein, 6 aa, Plasmodium falciparum
GTDSHT

SEQ ID NO: 3313902 - protein, 5 aa, Plasmodium falciparum
GTDSI

SEQ ID NO: 3313903 - protein, 9 aa, Plasmodium falciparum
GTDTAQGRS

SEQ ID NO: 3313904 - protein, 7 aa, Plasmodium falciparum
GTEDFST

SEQ ID NO: 3313905 - protein, 10 aa, Plasmodium falciparum
GTEGSIAGEG

SEQ ID NO: 3313906 - protein, 10 aa, Plasmodium falciparum
GTEKDGDEMT

SEQ ID NO: 3313907 - protein, 4 aa, Plasmodium falciparum
GTFG

SEQ ID NO: 3313908 - protein, 8 aa, Plasmodium falciparum
GTFSNNPV

SEQ ID NO: 3313909 - protein, 5 aa, Plasmodium falciparum
GTGHG

SEQ ID NO: 3313910 - protein, 4 aa, Plasmodium falciparum
GTGI

SEQ ID NO: 3313911 - protein, 7 aa, Plasmodium falciparum
GTGKITK

SEQ ID NO: 3313912 - protein, 10 aa, Plasmodium falciparum
GTGKTTLSAD

SEQ ID NO: 3313913 - protein, 7 aa, Plasmodium falciparum
GTGSVPR

SEQ ID NO: 3313914 - protein, 4 aa, Plasmodium falciparum
GTGV

SEQ ID NO: 3313915 - protein, 5 aa, Plasmodium falciparum
GTGYG

SEQ ID NO: 3313916 - protein, 5 aa, Plasmodium falciparum
GTHDY

SEQ ID NO: 3313917 - protein, 5 aa, Plasmodium falciparum
GTHIR

SEQ ID NO: 3313918 - protein, 6 aa, Plasmodium falciparum
GTIDNK

SEQ ID NO: 3313919 - protein, 5 aa, Plasmodium falciparum
GTIED

SEQ ID NO: 3313920 - protein, 6 aa, Plasmodium falciparum
GTIENG

SEQ ID NO: 3313921 - protein, 4 aa, Plasmodium falciparum
GTIK

SEQ ID NO: 3313922 - protein, 16 aa, Plasmodium falciparum
GTINNSNNNYNNNNIK

SEQ ID NO: 3313923 - protein, 6 aa, Plasmodium falciparum
GTIPRN

SEQ ID NO: 3313924 - protein, 11 aa, Plasmodium falciparum
GTIQGKNSNIN

SEQ ID NO: 3313925 - protein, 8 aa, Plasmodium falciparum
GTISRTRN

SEQ ID NO: 3313926 - protein, 5 aa, Plasmodium falciparum
GTITR

SEQ ID NO: 3313927 - protein, 8 aa, Plasmodium falciparum
GTKAPQAA

SEQ ID NO: 3313928 - protein, 19 aa, Plasmodium falciparum
GTKNKEDTEKKTDNIDTTN

SEQ ID NO: 3313929 - protein, 7 aa, Plasmodium falciparum
GTKQVQK

SEQ ID NO: 3313930 - protein, 21 aa, Plasmodium falciparum
GTKRPRKKKKDNVSSESSNNE

SEQ ID NO: 3313931 - protein, 15 aa, Plasmodium falciparum
GTKRYEATSGGEREI

SEQ ID NO: 3313932 - protein, 6 aa, Plasmodium falciparum
GTKSAN

SEQ ID NO: 3313933 - protein, 6 aa, Plasmodium falciparum
GTKSDK

SEQ ID NO: 3313934 - protein, 6 aa, Plasmodium falciparum
GTKSPM

SEQ ID NO: 3313935 - protein, 5 aa, Plasmodium falciparum
GTKVP

SEQ ID NO: 3313936 - protein, 16 aa, Plasmodium falciparum
GTLGAKYARDDPPYTN

SEQ ID NO: 3313937 - protein, 4 aa, Plasmodium falciparum
GTLS

SEQ ID NO: 3313938 - protein, 4 aa, Plasmodium falciparum
GTLT

SEQ ID NO: 3313939 - protein, 5 aa, Plasmodium falciparum
GTLTG

SEQ ID NO: 3313940 - protein, 4 aa, Plasmodium falciparum
GTMD

SEQ ID NO: 3313941 - protein, 6 aa, Plasmodium falciparum
GTNAKN

SEQ ID NO: 3313942 - protein, 13 aa, Plasmodium falciparum
GTNGATGGSGGIA

SEQ ID NO: 3313943 - protein, 7 aa, Plasmodium falciparum
GTNGERL

SEQ ID NO: 3313944 - protein, 7 aa, Plasmodium falciparum
GTNGKGS

SEQ ID NO: 3313945 - protein, 9 aa, Plasmodium falciparum
GTNKTMNNT

SEQ ID NO: 3313946 - protein, 9 aa, Plasmodium falciparum
GTNLNSNDY

SEQ ID NO: 3313947 - protein, 33 aa, Plasmodium falciparum
GTNNMGTNNMGNNNIGTNNMGNNNMGNNNIGTN

SEQ ID NO: 3313948 - protein, 11 aa, Plasmodium falciparum
GTNNNEYTGSF

SEQ ID NO: 3313949 - protein, 10 aa, Plasmodium falciparum
GTNNNTSTNV

SEQ ID NO: 3313950 - protein, 5 aa, Plasmodium falciparum
GTNNS

SEQ ID NO: 3313951 - protein, 7 aa, Plasmodium falciparum
GTNQEQA

SEQ ID NO: 3313952 - protein, 18 aa, Plasmodium falciparum
GTNQNNHNNNNNNNNNTM

SEQ ID NO: 3313953 - protein, 9 aa, Plasmodium falciparum
GTNSKRNKT

SEQ ID NO: 3313954 - protein, 11 aa, Plasmodium falciparum
GTNTDSTNTAC

SEQ ID NO: 3313955 - protein, 11 aa, Plasmodium falciparum
GTNTNEQQNIK

SEQ ID NO: 3313956 - protein, 6 aa, Plasmodium falciparum
GTNTTT

SEQ ID NO: 3313957 - protein, 4 aa, Plasmodium falciparum
GTPE

SEQ ID NO: 3313958 - protein, 4 aa, Plasmodium falciparum
GTPG

SEQ ID NO: 3313959 - protein, 6 aa, Plasmodium falciparum
GTPRRA

SEQ ID NO: 3313960 - protein, 9 aa, Plasmodium falciparum
GTPSEETIP

SEQ ID NO: 3313961 - protein, 6 aa, Plasmodium falciparum
GTPSVE

SEQ ID NO: 3313962 - protein, 5 aa, Plasmodium falciparum
GTPTG

SEQ ID NO: 3313963 - protein, 4 aa, Plasmodium falciparum
GTPV

SEQ ID NO: 3313964 - protein, 9 aa, Plasmodium falciparum
GTQENEKIN

SEQ ID NO: 3313965 - protein, 4 aa, Plasmodium falciparum
GTQN

SEQ ID NO: 3313966 - protein, 34 aa, Plasmodium falciparum
GTQNPVPPPPAPPLTNNQGENNIPTDNRNNENKK

SEQ ID NO: 3313967 - protein, 9 aa, Plasmodium falciparum
GTQRSDGTF

SEQ ID NO: 3313968 - protein, 9 aa, Plasmodium falciparum
GTRDTYKNE

SEQ ID NO: 3313969 - protein, 10 aa, Plasmodium falciparum
GTRFSRSDKS

SEQ ID NO: 3313970 - protein, 5 aa, Plasmodium falciparum
GTRGI

SEQ ID NO: 3313971 - protein, 5 aa, Plasmodium falciparum
GTRSE

SEQ ID NO: 3313972 - protein, 15 aa, Plasmodium falciparum
GTRSHQHTVTNDGAT

SEQ ID NO: 3313973 - protein, 7 aa, Plasmodium falciparum
GTRSHSI

SEQ ID NO: 3313974 - protein, 8 aa, Plasmodium falciparum
GTRTKKDS

SEQ ID NO: 3313975 - protein, 7 aa, Plasmodium falciparum
GTSAEKL

SEQ ID NO: 3313976 - protein, 17 aa, Plasmodium falciparum
GTSEGEHEQKLDESKNI

SEQ ID NO: 3313977 - protein, 5 aa, Plasmodium falciparum
GTSHI

SEQ ID NO: 3313978 - protein, 11 aa, Plasmodium falciparum
GTSKEREKLNK

SEQ ID NO: 3313979 - protein, 10 aa, Plasmodium falciparum
GTSNKTKYFP

SEQ ID NO: 3313980 - protein, 6 aa, Plasmodium falciparum
GTSQMD

SEQ ID NO: 3313981 - protein, 7 aa, Plasmodium falciparum
GTSRSSL

SEQ ID NO: 3313982 - protein, 7 aa, Plasmodium falciparum
GTSSSNK

SEQ ID NO: 3313983 - protein, 5 aa, Plasmodium falciparum
GTSTN

SEQ ID NO: 3313984 - protein, 7 aa, Plasmodium falciparum
GTSYSNA

SEQ ID NO: 3313985 - protein, 4 aa, Plasmodium falciparum
GTTG

SEQ ID NO: 3313986 - protein, 4 aa, Plasmodium falciparum
GTTL

SEQ ID NO: 3313987 - protein, 39 aa, Plasmodium falciparum
GTTLGKKKKEKKEEDNKEENKQEVENNEEAAKDETTKTY

SEQ ID NO: 3313988 - protein, 4 aa, Plasmodium falciparum
GTTN

SEQ ID NO: 3313989 - protein, 9 aa, Plasmodium falciparum
GTTNNTRYK

SEQ ID NO: 3313990 - protein, 14 aa, Plasmodium falciparum
GTTNNTRYKTGEST

SEQ ID NO: 3313991 - protein, 4 aa, Plasmodium falciparum
GTTS

SEQ ID NO: 3313992 - protein, 13 aa, Plasmodium falciparum
GTTSSSKKTLDEY

SEQ ID NO: 3313993 - protein, 4 aa, Plasmodium falciparum
GTTT

SEQ ID NO: 3313994 - protein, 9 aa, Plasmodium falciparum
GTTTPNTQH

SEQ ID NO: 3313995 - protein, 7 aa, Plasmodium falciparum
GTTTQDK

SEQ ID NO: 3313996 - protein, 4 aa, Plasmodium falciparum
GTTV

SEQ ID NO: 3313997 - protein, 6 aa, Plasmodium falciparum
GTVKNA

SEQ ID NO: 3313998 - protein, 4 aa, Plasmodium falciparum
GTWG

SEQ ID NO: 3313999 - protein, 11 aa, Plasmodium falciparum
GTYDENGTYNI

SEQ ID NO: 3314000 - protein, 4 aa, Plasmodium falciparum
GTYG

SEQ ID NO: 3314001 - protein, 9 aa, Plasmodium falciparum
GTYGGNRKP

SEQ ID NO: 3314002 - protein, 10 aa, Plasmodium falciparum
GTYHEDKKKV

SEQ ID NO: 3314003 - protein, 4 aa, Plasmodium falciparum
GTYK

SEQ ID NO: 3314004 - protein, 12 aa, Plasmodium falciparum
GTYKKKDERINR

SEQ ID NO: 3314005 - protein, 5 aa, Plasmodium falciparum
GTYND

SEQ ID NO: 3314006 - protein, 4 aa, Plasmodium falciparum
GTYS

SEQ ID NO: 3314007 - protein, 16 aa, Plasmodium falciparum
GVAKNHKEISDENNDD

SEQ ID NO: 3314008 - protein, 7 aa, Plasmodium falciparum
GVATPAD

SEQ ID NO: 3314009 - protein, 68 aa, Plasmodium falciparum
GVDDEHENDNDDDDNDCDDNDCDDNDCDDNDCDDNDCDDNDCDDNDCDDNDCDDNDCDDDNNNDNDDN

SEQ ID NO: 3314010 - protein, 9 aa, Plasmodium falciparum
GVDITEDQS

SEQ ID NO: 3314011 - protein, 57 aa, Plasmodium falciparum
GVDNPNNINNPNNINNPHDVNNPNDVNNPNNINNPHDVNNPNDVNNPHDVNNPNDDV

SEQ ID NO: 3314012 - protein, 14 aa, Plasmodium falciparum
GVDSNNNNTHNETD

SEQ ID NO: 3314013 - protein, 6 aa, Plasmodium falciparum
GVGDLN

SEQ ID NO: 3314014 - protein, 15 aa, Plasmodium falciparum
GVGKDEKVQKTIKNE

SEQ ID NO: 3314015 - protein, 6 aa, Plasmodium falciparum
GVGKTE

SEQ ID NO: 3314016 - protein, 5 aa, Plasmodium falciparum
GVGPK

SEQ ID NO: 3314017 - protein, 6 aa, Plasmodium falciparum
GVHSGD

SEQ ID NO: 3314018 - protein, 6 aa, Plasmodium falciparum
GVNKER

SEQ ID NO: 3314019 - protein, 13 aa, Plasmodium falciparum
GVNPRKKGTTWTS

SEQ ID NO: 3314020 - protein, 19 aa, Plasmodium falciparum
GVNTYNGINTEDIKNNNFN

SEQ ID NO: 3314021 - protein, 6 aa, Plasmodium falciparum
GVPHKE

SEQ ID NO: 3314022 - protein, 7 aa, Plasmodium falciparum
GVPNKSN

SEQ ID NO: 3314023 - protein, 11 aa, Plasmodium falciparum
GVQKDNDAKYN

SEQ ID NO: 3314024 - protein, 4 aa, Plasmodium falciparum
GVQN

SEQ ID NO: 3314025 - protein, 7 aa, Plasmodium falciparum
GVQNGNK

SEQ ID NO: 3314026 - protein, 5 aa, Plasmodium falciparum
GVQRK

SEQ ID NO: 3314027 - protein, 24 aa, Plasmodium falciparum
GVRGTRGRGGRGARGRGRGSAEDD

SEQ ID NO: 3314028 - protein, 7 aa, Plasmodium falciparum
GVRTNSL

SEQ ID NO: 3314029 - protein, 6 aa, Plasmodium falciparum
GVSQIK

SEQ ID NO: 3314030 - protein, 10 aa, Plasmodium falciparum
GVSSKTNEGF

SEQ ID NO: 3314031 - protein, 12 aa, Plasmodium falciparum
GVTNEYPEEEEE

SEQ ID NO: 3314032 - protein, 18 aa, Plasmodium falciparum
GVTPSVNDTITSDENMES

SEQ ID NO: 3314033 - protein, 7 aa, Plasmodium falciparum
GVTTTAD

SEQ ID NO: 3314034 - protein, 14 aa, Plasmodium falciparum
GVYKEDQKKNIQSD

SEQ ID NO: 3314035 - protein, 9 aa, Plasmodium falciparum
GVYNGKTET

SEQ ID NO: 3314036 - protein, 5 aa, Plasmodium falciparum
GWKDG

SEQ ID NO: 3314037 - protein, 6 aa, Plasmodium falciparum
GYADKS

SEQ ID NO: 3314038 - protein, 4 aa, Plasmodium falciparum
GYAG

SEQ ID NO: 3314039 - protein, 11 aa, Plasmodium falciparum
GYAGDENPTNV

SEQ ID NO: 3314040 - protein, 11 aa, Plasmodium falciparum
GYAGRSNLPDN

SEQ ID NO: 3314041 - protein, 16 aa, Plasmodium falciparum
GYASNGYASNGYASNE

SEQ ID NO: 3314042 - protein, 15 aa, Plasmodium falciparum
GYDEERKKKETDIRK

SEQ ID NO: 3314043 - protein, 6 aa, Plasmodium falciparum
GYDGNR

SEQ ID NO: 3314044 - protein, 6 aa, Plasmodium falciparum
GYDKNS

SEQ ID NO: 3314045 - protein, 8 aa, Plasmodium falciparum
GYDNTKRL

SEQ ID NO: 3314046 - protein, 12 aa, Plasmodium falciparum
GYDPEKKKKKLD

SEQ ID NO: 3314047 - protein, 7 aa, Plasmodium falciparum
GYDPPKK

SEQ ID NO: 3314048 - protein, 8 aa, Plasmodium falciparum
GYDPSKEI

SEQ ID NO: 3314049 - protein, 5 aa, Plasmodium falciparum
GYDPY

SEQ ID NO: 3314050 - protein, 6 aa, Plasmodium falciparum
GYDPYK

SEQ ID NO: 3314051 - protein, 10 aa, Plasmodium falciparum
GYEDKSMENY

SEQ ID NO: 3314052 - protein, 8 aa, Plasmodium falciparum
GYEGENKV

SEQ ID NO: 3314053 - protein, 11 aa, Plasmodium falciparum
GYEKTKNYNKK

SEQ ID NO: 3314054 - protein, 8 aa, Plasmodium falciparum
GYENEEIE

SEQ ID NO: 3314055 - protein, 4 aa, Plasmodium falciparum
GYEP

SEQ ID NO: 3314056 - protein, 5 aa, Plasmodium falciparum
GYESD

SEQ ID NO: 3314057 - protein, 22 aa, Plasmodium falciparum
GYESQLTKEPEREVADPSKLPP

SEQ ID NO: 3314058 - protein, 9 aa, Plasmodium falciparum
GYETNKNEK

SEQ ID NO: 3314059 - protein, 10 aa, Plasmodium falciparum
GYFPSSNKDV

SEQ ID NO: 3314060 - protein, 5 aa, Plasmodium falciparum
GYGAN

SEQ ID NO: 3314061 - protein, 8 aa, Plasmodium falciparum
GYGGYEES

SEQ ID NO: 3314062 - protein, 10 aa, Plasmodium falciparum
GYGKDASAIA

SEQ ID NO: 3314063 - protein, 11 aa, Plasmodium falciparum
GYGQSTGYPTE

SEQ ID NO: 3314064 - protein, 4 aa, Plasmodium falciparum
GYHK

SEQ ID NO: 3314065 - protein, 5 aa, Plasmodium falciparum
GYHTN

SEQ ID NO: 3314066 - protein, 10 aa, Plasmodium falciparum
GYKDDNYKKT

SEQ ID NO: 3314067 - protein, 4 aa, Plasmodium falciparum
GYKK

SEQ ID NO: 3314068 - protein, 12 aa, Plasmodium falciparum
GYKKKKKKMIPN

SEQ ID NO: 3314069 - protein, 8 aa, Plasmodium falciparum
GYKNDNRS

SEQ ID NO: 3314070 - protein, 73 aa, Plasmodium falciparum
GYKSPEKKQGKNGDNNDDDDKDNYNDDDDNDDDDNDDDNDDDDDNDDKDNYNDNYNDNYNDNYYDDNTKSMKD

SEQ ID NO: 3314071 - protein, 6 aa, Plasmodium falciparum
GYKTKE

SEQ ID NO: 3314072 - protein, 11 aa, Plasmodium falciparum
GYKTRSKKKPL

SEQ ID NO: 3314073 - protein, 10 aa, Plasmodium falciparum
GYLSPSDKKC

SEQ ID NO: 3314074 - protein, 5 aa, Plasmodium falciparum
GYMNS

SEQ ID NO: 3314075 - protein, 5 aa, Plasmodium falciparum
GYNEM

SEQ ID NO: 3314076 - protein, 11 aa, Plasmodium falciparum
GYNGSSSSGVQ

SEQ ID NO: 3314077 - protein, 25 aa, Plasmodium falciparum
GYNNNNNIQGYNNNNNNIQDYNNNN

SEQ ID NO: 3314078 - protein, 4 aa, Plasmodium falciparum
GYNT

SEQ ID NO: 3314079 - protein, 6 aa, Plasmodium falciparum
GYNTTD

SEQ ID NO: 3314080 - protein, 6 aa, Plasmodium falciparum
GYPPQY

SEQ ID NO: 3314081 - protein, 6 aa, Plasmodium falciparum
GYPQRS

SEQ ID NO: 3314082 - protein, 7 aa, Plasmodium falciparum
GYPSEKN

SEQ ID NO: 3314083 - protein, 36 aa, Plasmodium falciparum
GYQRSNMSKDNKYNDNEGNNMYENGENNNKGDTIKN

SEQ ID NO: 3314084 - protein, 18 aa, Plasmodium falciparum
GYRGGATENLDVKEDPKR

SEQ ID NO: 3314085 - protein, 7 aa, Plasmodium falciparum
GYRGGKS

SEQ ID NO: 3314086 - protein, 4 aa, Plasmodium falciparum
GYRN

SEQ ID NO: 3314087 - protein, 9 aa, Plasmodium falciparum
GYRRTQANV

SEQ ID NO: 3314088 - protein, 12 aa, Plasmodium falciparum
GYSDDENTWEPE

SEQ ID NO: 3314089 - protein, 6 aa, Plasmodium falciparum
GYSSES

SEQ ID NO: 3314090 - protein, 11 aa, Plasmodium falciparum
GYTGASSGGQL

SEQ ID NO: 3314091 - protein, 14 aa, Plasmodium falciparum
GYTNDDDNNRFNEK

SEQ ID NO: 3314092 - protein, 9 aa, Plasmodium falciparum
GYTNNNVNN

SEQ ID NO: 3314093 - protein, 4 aa, Plasmodium falciparum
GYTR

SEQ ID NO: 3314094 - protein, 6 aa, Plasmodium falciparum
GYTSEY

SEQ ID NO: 3314095 - protein, 4 aa, Plasmodium falciparum
GYTT

SEQ ID NO: 3314096 - protein, 27 aa, Plasmodium falciparum
GYTTSDNNSPQEENDTIKKAKKNYDYD

SEQ ID NO: 3314097 - protein, 7 aa, Plasmodium falciparum
GYYPKED

SEQ ID NO: 3314098 - protein, 12 aa, Plasmodium falciparum
GYYSASDEPIQL

SEQ ID NO: 3314099 - protein, 9 aa, Plasmodium falciparum
GYYSPGNGH

SEQ ID NO: 3314100 - protein, 11 aa, Plasmodium falciparum
GYYSTKGWNES

SEQ ID NO: 3314101 - protein, 6 aa, Plasmodium falciparum
HADGPT

SEQ ID NO: 3314102 - protein, 6 aa, Plasmodium falciparum
HADQSS

SEQ ID NO: 3314103 - protein, 7 aa, Plasmodium falciparum
HADSNGI

SEQ ID NO: 3314104 - protein, 20 aa, Plasmodium falciparum
HAENKHNKDVKECFPQKFID

SEQ ID NO: 3314105 - protein, 10 aa, Plasmodium falciparum
HAESNNADDD

SEQ ID NO: 3314106 - protein, 37 aa, Plasmodium falciparum
HAGNNTNYYNSNKNSISSENLNKQIKKGAEGGDADNV

SEQ ID NO: 3314107 - protein, 17 aa, Plasmodium falciparum
HAHGQNELRKPDYRNNE

SEQ ID NO: 3314108 - protein, 11 aa, Plasmodium falciparum
HAKTKNKNENV

SEQ ID NO: 3314109 - protein, 25 aa, Plasmodium falciparum
HANANANPTTSHSNIKGNSHLSNAN

SEQ ID NO: 3314110 - protein, 4 aa, Plasmodium falciparum
HANN

SEQ ID NO: 3314111 - protein, 14 aa, Plasmodium falciparum
HAPSQSKAQMGMKI

SEQ ID NO: 3314112 - protein, 14 aa, Plasmodium falciparum
HAQSTWEENPKRKK

SEQ ID NO: 3314113 - protein, 6 aa, Plasmodium falciparum
HASNKN

SEQ ID NO: 3314114 - protein, 18 aa, Plasmodium falciparum
HASSKEYLQKEDSSEFNQ

SEQ ID NO: 3314115 - protein, 10 aa, Plasmodium falciparum
HASSKQYTNK

SEQ ID NO: 3314116 - protein, 16 aa, Plasmodium falciparum
HASSSYSGECSDDDKI

SEQ ID NO: 3314117 - protein, 18 aa, Plasmodium falciparum
HATNQYQGTHKNHSNSKT

SEQ ID NO: 3314118 - protein, 13 aa, Plasmodium falciparum
HAYGSIKDGTLDN

SEQ ID NO: 3314119 - protein, 34 aa, Plasmodium falciparum
HAYNNNNNNNNKNNNNNNNNKNNNNNNDNNNNNV

SEQ ID NO: 3314120 - protein, 11 aa, Plasmodium falciparum
HCGSKTSTKCP

SEQ ID NO: 3314121 - protein, 11 aa, Plasmodium falciparum
HCQDKPDEGNV

SEQ ID NO: 3314122 - protein, 8 aa, Plasmodium falciparum
HDDDDDVN

SEQ ID NO: 3314123 - protein, 8 aa, Plasmodium falciparum
HDDDNNNN

SEQ ID NO: 3314124 - protein, 11 aa, Plasmodium falciparum
HDDDNNNNNNI

SEQ ID NO: 3314125 - protein, 14 aa, Plasmodium falciparum
HDDDVKKNEPTHDK

SEQ ID NO: 3314126 - protein, 15 aa, Plasmodium falciparum
HDDIDKGDEKNQHNL

SEQ ID NO: 3314127 - protein, 9 aa, Plasmodium falciparum
HDDLPDQQS

SEQ ID NO: 3314128 - protein, 6 aa, Plasmodium falciparum
HDDQQI

SEQ ID NO: 3314129 - protein, 4 aa, Plasmodium falciparum
HDDR

SEQ ID NO: 3314130 - protein, 4 aa, Plasmodium falciparum
HDDS

SEQ ID NO: 3314131 - protein, 26 aa, Plasmodium falciparum
HDDSNKTEENNSSPDNNNHNENNNDF

SEQ ID NO: 3314132 - protein, 8 aa, Plasmodium falciparum
HDDSVEKN

SEQ ID NO: 3314133 - protein, 12 aa, Plasmodium falciparum
HDDYKTNNQHNR

SEQ ID NO: 3314134 - protein, 35 aa, Plasmodium falciparum
HDEEEEEEEEEDGCKSNEKFNNDNSIPKDKNKYGI

SEQ ID NO: 3314135 - protein, 15 aa, Plasmodium falciparum
HDEENKSEDDKNYNR

SEQ ID NO: 3314136 - protein, 16 aa, Plasmodium falciparum
HDEEQLEQEEDDLQDE

SEQ ID NO: 3314137 - protein, 11 aa, Plasmodium falciparum
HDEKGDKHINK

SEQ ID NO: 3314138 - protein, 8 aa, Plasmodium falciparum
HDEKGDNM

SEQ ID NO: 3314139 - protein, 10 aa, Plasmodium falciparum
HDEKKDKNEI

SEQ ID NO: 3314140 - protein, 28 aa, Plasmodium falciparum
HDEKNDQDNEDDDDDGEPPKGNGGKTDK

SEQ ID NO: 3314141 - protein, 35 aa, Plasmodium falciparum
HDEKSRHNEGMKEEEEDEDDEDDDDEDDDDDDSVD

SEQ ID NO: 3314142 - protein, 11 aa, Plasmodium falciparum
HDEQQNENKNI

SEQ ID NO: 3314143 - protein, 5 aa, Plasmodium falciparum
HDERK

SEQ ID NO: 3314144 - protein, 9 aa, Plasmodium falciparum
HDESNQNTK

SEQ ID NO: 3314145 - protein, 14 aa, Plasmodium falciparum
HDESSCCKSKMLGT

SEQ ID NO: 3314146 - protein, 88 aa, Plasmodium falciparum
HDEYKDDDDNNNNNNNNNNNNNNNNNNNNINVNNNGNNNGNKENHHGHKENGDNKKDNDRNNKENCGHNNNQDNDYNNTYKDNEGNNM

SEQ ID NO: 3314147 - protein, 24 aa, Plasmodium falciparum
HDEYNNNNNNNNKQTKLNHTENDL

SEQ ID NO: 3314148 - protein, 5 aa, Plasmodium falciparum
HDEYT

SEQ ID NO: 3314149 - protein, 13 aa, Plasmodium falciparum
HDFNNEKNRYKNR

SEQ ID NO: 3314150 - protein, 10 aa, Plasmodium falciparum
HDGESTSSKL

SEQ ID NO: 3314151 - protein, 5 aa, Plasmodium falciparum
HDGYT

SEQ ID NO: 3314152 - protein, 13 aa, Plasmodium falciparum
HDHKKNNHDTHNN

SEQ ID NO: 3314153 - protein, 9 aa, Plasmodium falciparum
HDHNDGKKM

SEQ ID NO: 3314154 - protein, 15 aa, Plasmodium falciparum
HDINNDSDCSTKCGS

SEQ ID NO: 3314155 - protein, 4 aa, Plasmodium falciparum
HDIQ

SEQ ID NO: 3314156 - protein, 6 aa, Plasmodium falciparum
HDISNE

SEQ ID NO: 3314157 - protein, 8 aa, Plasmodium falciparum
HDISRSRE

SEQ ID NO: 3314158 - protein, 22 aa, Plasmodium falciparum
HDKEKNRPFKGGHQKGENGMQT

SEQ ID NO: 3314159 - protein, 8 aa, Plasmodium falciparum
HDKENGVI

SEQ ID NO: 3314160 - protein, 13 aa, Plasmodium falciparum
HDKERDQTGEEIN

SEQ ID NO: 3314161 - protein, 9 aa, Plasmodium falciparum
HDKGNNTLK

SEQ ID NO: 3314162 - protein, 4 aa, Plasmodium falciparum
HDKK

SEQ ID NO: 3314163 - protein, 9 aa, Plasmodium falciparum
HDKKKEKKQ

SEQ ID NO: 3314164 - protein, 5 aa, Plasmodium falciparum
HDKKL

SEQ ID NO: 3314165 - protein, 6 aa, Plasmodium falciparum
HDKNGE

SEQ ID NO: 3314166 - protein, 10 aa, Plasmodium falciparum
HDKSKQKNGL

SEQ ID NO: 3314167 - protein, 98 aa, Plasmodium falciparum
HDKYSNGYNSDQHNEQNNDHSSEQNNEQNYERNNERNNERNNGKNNEQNNERNNERNNERNNEQNNEHNNEKYNEQNNEQNNEQNNNNNNNGDNNYDN

SEQ ID NO: 3314168 - protein, 19 aa, Plasmodium falciparum
HDNAFNKEEQDVTEKNKGI

SEQ ID NO: 3314169 - protein, 4 aa, Plasmodium falciparum
HDND

SEQ ID NO: 3314170 - protein, 7 aa, Plasmodium falciparum
HDNDDSS

SEQ ID NO: 3314171 - protein, 7 aa, Plasmodium falciparum
HDNDNED

SEQ ID NO: 3314172 - protein, 5 aa, Plasmodium falciparum
HDNEQ

SEQ ID NO: 3314173 - protein, 10 aa, Plasmodium falciparum
HDNEQGNNLD

SEQ ID NO: 3314174 - protein, 29 aa, Plasmodium falciparum
HDNESNHNSSCTNNNIDNNNNNNNNNNNS

SEQ ID NO: 3314175 - protein, 7 aa, Plasmodium falciparum
HDNHTNK

SEQ ID NO: 3314176 - protein, 4 aa, Plasmodium falciparum
HDNI

SEQ ID NO: 3314177 - protein, 9 aa, Plasmodium falciparum
HDNKENSPC

SEQ ID NO: 3314178 - protein, 7 aa, Plasmodium falciparum
HDNNMAR

SEQ ID NO: 3314179 - protein, 10 aa, Plasmodium falciparum
HDNNNNNNNN

SEQ ID NO: 3314180 - protein, 17 aa, Plasmodium falciparum
HDNNNNNNNNNNNNSNS

SEQ ID NO: 3314181 - protein, 10 aa, Plasmodium falciparum
HDNNVEKNNI

SEQ ID NO: 3314182 - protein, 11 aa, Plasmodium falciparum
HDNPDTNDEDI

SEQ ID NO: 3314183 - protein, 8 aa, Plasmodium falciparum
HDNQDEMY

SEQ ID NO: 3314184 - protein, 19 aa, Plasmodium falciparum
HDNSKKIKKKSSSKNVQNI

SEQ ID NO: 3314185 - protein, 10 aa, Plasmodium falciparum
HDNSNNNTCY

SEQ ID NO: 3314186 - protein, 14 aa, Plasmodium falciparum
HDNSSDDNDKTPQI

SEQ ID NO: 3314187 - protein, 46 aa, Plasmodium falciparum
HDNSTNNVNQNATNVNNNNSSNNNNNNNNNNNNNNNNNNNNNNNNG

SEQ ID NO: 3314188 - protein, 18 aa, Plasmodium falciparum
HDNTNKNKQNTSNDKNDY

SEQ ID NO: 3314189 - protein, 7 aa, Plasmodium falciparum
HDNTTNE

SEQ ID NO: 3314190 - protein, 6 aa, Plasmodium falciparum
HDQKEN

SEQ ID NO: 3314191 - protein, 5 aa, Plasmodium falciparum
HDQND

SEQ ID NO: 3314192 - protein, 9 aa, Plasmodium falciparum
HDSDSTTFL

SEQ ID NO: 3314193 - protein, 8 aa, Plasmodium falciparum
HDSEDPLG

SEQ ID NO: 3314194 - protein, 4 aa, Plasmodium falciparum
HDSQ

SEQ ID NO: 3314195 - protein, 11 aa, Plasmodium falciparum
HDSSSKHHISK

SEQ ID NO: 3314196 - protein, 5 aa, Plasmodium falciparum
HDSYC

SEQ ID NO: 3314197 - protein, 7 aa, Plasmodium falciparum
HDTDDLQ

SEQ ID NO: 3314198 - protein, 10 aa, Plasmodium falciparum
HDTEKNRDQR

SEQ ID NO: 3314199 - protein, 4 aa, Plasmodium falciparum
HDTN

SEQ ID NO: 3314200 - protein, 8 aa, Plasmodium falciparum
HDTQNKEC

SEQ ID NO: 3314201 - protein, 83 aa, Plasmodium falciparum
HDVETTKKKKVKKSLSKTNKTASKSKLNTKQEQKDKTEKKQNKTNNIKNDKSEKKEQAKKKTKTNENTQQTKQNKPDKKNKAK

SEQ ID NO: 3314202 - protein, 8 aa, Plasmodium falciparum
HDVPRKEK

SEQ ID NO: 3314203 - protein, 8 aa, Plasmodium falciparum
HEASGNTK

SEQ ID NO: 3314204 - protein, 18 aa, Plasmodium falciparum
HEATSEDAIEEEEDDEYF

SEQ ID NO: 3314205 - protein, 10 aa, Plasmodium falciparum
HEDKNTDEVL

SEQ ID NO: 3314206 - protein, 10 aa, Plasmodium falciparum
HEDNDQNKNV

SEQ ID NO: 3314207 - protein, 12 aa, Plasmodium falciparum
HEDNKNQKDNIE

SEQ ID NO: 3314208 - protein, 95 aa, Plasmodium falciparum
HEDNMNEGQEEEGKYDEEGKYDEEGKYDEEGKYDEEGKYDEEGKYDEEGKYDEEGKYDEEGKYDEEGKYDEEGKYDEEGKYDEEGKYDEEEKYYE

SEQ ID NO: 3314209 - protein, 10 aa, Plasmodium falciparum
HEDNVSNQSI

SEQ ID NO: 3314210 - protein, 6 aa, Plasmodium falciparum
HEDPLH

SEQ ID NO: 3314211 - protein, 7 aa, Plasmodium falciparum
HEEAKED

SEQ ID NO: 3314212 - protein, 14 aa, Plasmodium falciparum
HEEDEIKNVRNENN

SEQ ID NO: 3314213 - protein, 10 aa, Plasmodium falciparum
HEEDNDDINN

SEQ ID NO: 3314214 - protein, 21 aa, Plasmodium falciparum
HEEEDANKCKECPKPEDKSAA

SEQ ID NO: 3314215 - protein, 16 aa, Plasmodium falciparum
HEEEEEKKKTKKSNII

SEQ ID NO: 3314216 - protein, 5 aa, Plasmodium falciparum
HEEGQ

SEQ ID NO: 3314217 - protein, 4 aa, Plasmodium falciparum
HEEI

SEQ ID NO: 3314218 - protein, 10 aa, Plasmodium falciparum
HEEINSSHKN

SEQ ID NO: 3314219 - protein, 9 aa, Plasmodium falciparum
HEEKESTHK

SEQ ID NO: 3314220 - protein, 14 aa, Plasmodium falciparum
HEEKNAENKKSSKY

SEQ ID NO: 3314221 - protein, 15 aa, Plasmodium falciparum
HEEKQKKKKIKKKEN

SEQ ID NO: 3314222 - protein, 4 aa, Plasmodium falciparum
HEEN

SEQ ID NO: 3314223 - protein, 15 aa, Plasmodium falciparum
HEENINSQKKNSSMS

SEQ ID NO: 3314224 - protein, 7 aa, Plasmodium falciparum
HEENTKL

SEQ ID NO: 3314225 - protein, 6 aa, Plasmodium falciparum
HEENTN

SEQ ID NO: 3314226 - protein, 27 aa, Plasmodium falciparum
HEEPALTTHEKKEDKKERIDEKNNKKK

SEQ ID NO: 3314227 - protein, 4 aa, Plasmodium falciparum
HEES

SEQ ID NO: 3314228 - protein, 21 aa, Plasmodium falciparum
HEEYDENYTYDENNKANYSAD

SEQ ID NO: 3314229 - protein, 12 aa, Plasmodium falciparum
HEFDDEEKYKNE

SEQ ID NO: 3314230 - protein, 11 aa, Plasmodium falciparum
HEGEKSKISIR

SEQ ID NO: 3314231 - protein, 8 aa, Plasmodium falciparum
HEGGNASA

SEQ ID NO: 3314232 - protein, 6 aa, Plasmodium falciparum
HEGKSL

SEQ ID NO: 3314233 - protein, 12 aa, Plasmodium falciparum
HEGPMNNNESGA

SEQ ID NO: 3314234 - protein, 9 aa, Plasmodium falciparum
HEGPPNNVS

SEQ ID NO: 3314235 - protein, 5 aa, Plasmodium falciparum
HEHEH

SEQ ID NO: 3314236 - protein, 14 aa, Plasmodium falciparum
HEHEKKKKNEANNV

SEQ ID NO: 3314237 - protein, 13 aa, Plasmodium falciparum
HEHENEREYEHER

SEQ ID NO: 3314238 - protein, 5 aa, Plasmodium falciparum
HEHKD

SEQ ID NO: 3314239 - protein, 12 aa, Plasmodium falciparum
HEIGNTKEQNID

SEQ ID NO: 3314240 - protein, 6 aa, Plasmodium falciparum
HEIKGR

SEQ ID NO: 3314241 - protein, 18 aa, Plasmodium falciparum
HEINNDEKKKEVQKDTTN

SEQ ID NO: 3314242 - protein, 5 aa, Plasmodium falciparum
HEINY

SEQ ID NO: 3314243 - protein, 6 aa, Plasmodium falciparum
HEISDD

SEQ ID NO: 3314244 - protein, 21 aa, Plasmodium falciparum
HEKEKKEEEENEKLKKKDYYE

SEQ ID NO: 3314245 - protein, 9 aa, Plasmodium falciparum
HEKEKKSYT

SEQ ID NO: 3314246 - protein, 5 aa, Plasmodium falciparum
HEKKC

SEQ ID NO: 3314247 - protein, 14 aa, Plasmodium falciparum
HEKKHSKNAYEDCF

SEQ ID NO: 3314248 - protein, 5 aa, Plasmodium falciparum
HEKKI

SEQ ID NO: 3314249 - protein, 6 aa, Plasmodium falciparum
HEKKKC

SEQ ID NO: 3314250 - protein, 7 aa, Plasmodium falciparum
HEKKKEM

SEQ ID NO: 3314251 - protein, 9 aa, Plasmodium falciparum
HEKKNKEIN

SEQ ID NO: 3314252 - protein, 13 aa, Plasmodium falciparum
HEKNDKSNNDYNY

SEQ ID NO: 3314253 - protein, 17 aa, Plasmodium falciparum
HEKNGKDIINSDNNKIN

SEQ ID NO: 3314254 - protein, 4 aa, Plasmodium falciparum
HEKP

SEQ ID NO: 3314255 - protein, 6 aa, Plasmodium falciparum
HEKPEF

SEQ ID NO: 3314256 - protein, 4 aa, Plasmodium falciparum
HEKR

SEQ ID NO: 3314257 - protein, 6 aa, Plasmodium falciparum
HEKSGT

SEQ ID NO: 3314258 - protein, 11 aa, Plasmodium falciparum
HELDKHNKNNV

SEQ ID NO: 3314259 - protein, 4 aa, Plasmodium falciparum
HENA

SEQ ID NO: 3314260 - protein, 4 aa, Plasmodium falciparum
HEND

SEQ ID NO: 3314261 - protein, 30 aa, Plasmodium falciparum
HENETNEETYEDENELDNNGQPVSKTYEDK

SEQ ID NO: 3314262 - protein, 10 aa, Plasmodium falciparum
HENKNISPKY

SEQ ID NO: 3314263 - protein, 18 aa, Plasmodium falciparum
HENQENDIHSSSHNVNNE

SEQ ID NO: 3314264 - protein, 5 aa, Plasmodium falciparum
HENRS

SEQ ID NO: 3314265 - protein, 5 aa, Plasmodium falciparum
HENSE

SEQ ID NO: 3314266 - protein, 6 aa, Plasmodium falciparum
HENTNY

SEQ ID NO: 3314267 - protein, 12 aa, Plasmodium falciparum
HENYDSSSGTCN

SEQ ID NO: 3314268 - protein, 5 aa, Plasmodium falciparum
HENYT

SEQ ID NO: 3314269 - protein, 27 aa, Plasmodium falciparum
HEPKADDKVLSNEEVEKNIDRDKNVDI

SEQ ID NO: 3314270 - protein, 6 aa, Plasmodium falciparum
HEPSGI

SEQ ID NO: 3314271 - protein, 6 aa, Plasmodium falciparum
HEPSTC

SEQ ID NO: 3314272 - protein, 4 aa, Plasmodium falciparum
HEPY

SEQ ID NO: 3314273 - protein, 8 aa, Plasmodium falciparum
HEQEGGQE

SEQ ID NO: 3314274 - protein, 13 aa, Plasmodium falciparum
HEQKNNQGDNYNN

SEQ ID NO: 3314275 - protein, 10 aa, Plasmodium falciparum
HEQNNKKQLN

SEQ ID NO: 3314276 - protein, 9 aa, Plasmodium falciparum
HEQRELEEN

SEQ ID NO: 3314277 - protein, 15 aa, Plasmodium falciparum
HEQSQIKQKNCEEKI

SEQ ID NO: 3314278 - protein, 4 aa, Plasmodium falciparum
HEQY

SEQ ID NO: 3314279 - protein, 44 aa, Plasmodium falciparum
HEREKKKNNNNNNNNNNNNNNNNNNKNNNNNNNLDNISDKNNLN

SEQ ID NO: 3314280 - protein, 9 aa, Plasmodium falciparum
HESDTYNLP

SEQ ID NO: 3314281 - protein, 9 aa, Plasmodium falciparum
HESKPQEVG

SEQ ID NO: 3314282 - protein, 5 aa, Plasmodium falciparum
HESRQ

SEQ ID NO: 3314283 - protein, 43 aa, Plasmodium falciparum
HESRYNNRHSNNSSSAHHRKSHKSTSRSAPRSSHKSESKSKGV

SEQ ID NO: 3314284 - protein, 5 aa, Plasmodium falciparum
HESTD

SEQ ID NO: 3314285 - protein, 11 aa, Plasmodium falciparum
HESVQTNNEKK

SEQ ID NO: 3314286 - protein, 7 aa, Plasmodium falciparum
HETKRNR

SEQ ID NO: 3314287 - protein, 5 aa, Plasmodium falciparum
HETNQ

SEQ ID NO: 3314288 - protein, 7 aa, Plasmodium falciparum
HEVSDLQ

SEQ ID NO: 3314289 - protein, 6 aa, Plasmodium falciparum
HEYDKK

SEQ ID NO: 3314290 - protein, 12 aa, Plasmodium falciparum
HEYGKREDVNIN

SEQ ID NO: 3314291 - protein, 8 aa, Plasmodium falciparum
HEYQDKNS

SEQ ID NO: 3314292 - protein, 4 aa, Plasmodium falciparum
HFKN

SEQ ID NO: 3314293 - protein, 44 aa, Plasmodium falciparum
HFSRSSYEKEGEKEKNNKKKKRNENGYAYGEDNYNDNIYDNSDD

SEQ ID NO: 3314294 - protein, 7 aa, Plasmodium falciparum
HFTPTEK

SEQ ID NO: 3314295 - protein, 22 aa, Plasmodium falciparum
HGAKSNSNHNNIHDNNNNNNMH

SEQ ID NO: 3314296 - protein, 13 aa, Plasmodium falciparum
HGDINNDSKNQKG

SEQ ID NO: 3314297 - protein, 11 aa, Plasmodium falciparum
HGDMSNKKYRY

SEQ ID NO: 3314298 - protein, 13 aa, Plasmodium falciparum
HGDQCSRSHYKPN

SEQ ID NO: 3314299 - protein, 5 aa, Plasmodium falciparum
HGDSL

SEQ ID NO: 3314300 - protein, 5 aa, Plasmodium falciparum
HGECT

SEQ ID NO: 3314301 - protein, 11 aa, Plasmodium falciparum
HGEKDTNNQHK

SEQ ID NO: 3314302 - protein, 27 aa, Plasmodium falciparum
HGEKRKKSKNDEDNKRSRKKHKSHREN

SEQ ID NO: 3314303 - protein, 6 aa, Plasmodium falciparum
HGESSL

SEQ ID NO: 3314304 - protein, 11 aa, Plasmodium falciparum
HGGPKVYSNRR

SEQ ID NO: 3314305 - protein, 6 aa, Plasmodium falciparum
HGGPNV

SEQ ID NO: 3314306 - protein, 6 aa, Plasmodium falciparum
HGHGEK

SEQ ID NO: 3314307 - protein, 34 aa, Plasmodium falciparum
HGHNNNRGQGNNNNNNNNNNFNRRNDKNDNRNFR

SEQ ID NO: 3314308 - protein, 11 aa, Plasmodium falciparum
HGIDPSGTYCG

SEQ ID NO: 3314309 - protein, 13 aa, Plasmodium falciparum
HGKASEKNTEDID

SEQ ID NO: 3314310 - protein, 19 aa, Plasmodium falciparum
HGKIDSNNNNNNNNNNING

SEQ ID NO: 3314311 - protein, 7 aa, Plasmodium falciparum
HGKKKNK

SEQ ID NO: 3314312 - protein, 5 aa, Plasmodium falciparum
HGKKS

SEQ ID NO: 3314313 - protein, 5 aa, Plasmodium falciparum
HGKMT

SEQ ID NO: 3314314 - protein, 9 aa, Plasmodium falciparum
HGKNEIKQN

SEQ ID NO: 3314315 - protein, 10 aa, Plasmodium falciparum
HGKNKEDTIK

SEQ ID NO: 3314316 - protein, 8 aa, Plasmodium falciparum
HGKNNSQT

SEQ ID NO: 3314317 - protein, 7 aa, Plasmodium falciparum
HGKREDV

SEQ ID NO: 3314318 - protein, 10 aa, Plasmodium falciparum
HGKSGYMKNN

SEQ ID NO: 3314319 - protein, 15 aa, Plasmodium falciparum
HGNSNTYQENSLENS

SEQ ID NO: 3314320 - protein, 7 aa, Plasmodium falciparum
HGNTGND

SEQ ID NO: 3314321 - protein, 4 aa, Plasmodium falciparum
HGNV

SEQ ID NO: 3314322 - protein, 9 aa, Plasmodium falciparum
HGPQTYSNN

SEQ ID NO: 3314323 - protein, 6 aa, Plasmodium falciparum
HGPSPR

SEQ ID NO: 3314324 - protein, 8 aa, Plasmodium falciparum
HGQSDSIE

SEQ ID NO: 3314325 - protein, 88 aa, Plasmodium falciparum
HGRHDKHDRHDKYDRNDKYDRHDKYDRHDKYDKHDRYDRHDKYDRHNRHDKYDRHDRHDKYDRHDKHHNSDNPYDNSTKDDIRKENEI

SEQ ID NO: 3314326 - protein, 9 aa, Plasmodium falciparum
HGRRSEEIK

SEQ ID NO: 3314327 - protein, 25 aa, Plasmodium falciparum
HGRTEFSPTYTHKNSKRKYDQEKRT

SEQ ID NO: 3314328 - protein, 4 aa, Plasmodium falciparum
HGSD

SEQ ID NO: 3314329 - protein, 6 aa, Plasmodium falciparum
HGSLQK

SEQ ID NO: 3314330 - protein, 9 aa, Plasmodium falciparum
HGSNNSNIN

SEQ ID NO: 3314331 - protein, 19 aa, Plasmodium falciparum
HGSNYEGTISTATTINNNH

SEQ ID NO: 3314332 - protein, 19 aa, Plasmodium falciparum
HGSQEKDHNHIEKDGYNES

SEQ ID NO: 3314333 - protein, 6 aa, Plasmodium falciparum
HGTAED

SEQ ID NO: 3314334 - protein, 5 aa, Plasmodium falciparum
HGTCD

SEQ ID NO: 3314335 - protein, 11 aa, Plasmodium falciparum
HGTDKEKMHEK

SEQ ID NO: 3314336 - protein, 15 aa, Plasmodium falciparum
HGTSKSKKHKSDYST

SEQ ID NO: 3314337 - protein, 4 aa, Plasmodium falciparum
HGTV

SEQ ID NO: 3314338 - protein, 5 aa, Plasmodium falciparum
HGVGE

SEQ ID NO: 3314339 - protein, 11 aa, Plasmodium falciparum
HGVSSNESTPV

SEQ ID NO: 3314340 - protein, 6 aa, Plasmodium falciparum
HGVTSD

SEQ ID NO: 3314341 - protein, 48 aa, Plasmodium falciparum
HGYDNKKKNEEQNVDEITKNEEQNNDEITGNKNNYKNDCNDNNSCNTD

SEQ ID NO: 3314342 - protein, 9 aa, Plasmodium falciparum
HHDNSTNHN

SEQ ID NO: 3314343 - protein, 12 aa, Plasmodium falciparum
HHDTSSQENIQH

SEQ ID NO: 3314344 - protein, 6 aa, Plasmodium falciparum
HHEKEE

SEQ ID NO: 3314345 - protein, 5 aa, Plasmodium falciparum
HHGNR

SEQ ID NO: 3314346 - protein, 5 aa, Plasmodium falciparum
HHHNN

SEQ ID NO: 3314347 - protein, 30 aa, Plasmodium falciparum
HHHSNKHHHSNDHHHSNDHHHSKDHHHSNK

SEQ ID NO: 3314348 - protein, 15 aa, Plasmodium falciparum
HHKNEELKRSQLNEN

SEQ ID NO: 3314349 - protein, 14 aa, Plasmodium falciparum
HHKSNERKNPTDNI

SEQ ID NO: 3314350 - protein, 20 aa, Plasmodium falciparum
HHKSTSPSQKHKGNEKPNDN

SEQ ID NO: 3314351 - protein, 24 aa, Plasmodium falciparum
HHKTNSITNYKNDDINKKSDNNKY

SEQ ID NO: 3314352 - protein, 12 aa, Plasmodium falciparum
HHNDNEKDSSSK

SEQ ID NO: 3314353 - protein, 12 aa, Plasmodium falciparum
HHNNHHNNHHNN

SEQ ID NO: 3314354 - protein, 15 aa, Plasmodium falciparum
HHNNNNNDDTNYTYE

SEQ ID NO: 3314355 - protein, 23 aa, Plasmodium falciparum
HHNPFNNKNNSAFNNNNNNPGTL

SEQ ID NO: 3314356 - protein, 19 aa, Plasmodium falciparum
HHNYNNAKYDENNKNDDDH

SEQ ID NO: 3314357 - protein, 4 aa, Plasmodium falciparum
HHPA

SEQ ID NO: 3314358 - protein, 9 aa, Plasmodium falciparum
HHQKKKKET

SEQ ID NO: 3314359 - protein, 6 aa, Plasmodium falciparum
HHRKGA

SEQ ID NO: 3314360 - protein, 9 aa, Plasmodium falciparum
HHRQTNNHI

SEQ ID NO: 3314361 - protein, 9 aa, Plasmodium falciparum
HHSNSKKDV

SEQ ID NO: 3314362 - protein, 21 aa, Plasmodium falciparum
HHSTSDDSSLYRPKEENEAWR

SEQ ID NO: 3314363 - protein, 11 aa, Plasmodium falciparum
HHTKKRRKMKK

SEQ ID NO: 3314364 - protein, 13 aa, Plasmodium falciparum
HHTNNNNSCTSNR

SEQ ID NO: 3314365 - protein, 21 aa, Plasmodium falciparum
HIDEDEENSSYDENINYHTND

SEQ ID NO: 3314366 - protein, 4 aa, Plasmodium falciparum
HIEK

SEQ ID NO: 3314367 - protein, 9 aa, Plasmodium falciparum
HIEKNGKKI

SEQ ID NO: 3314368 - protein, 13 aa, Plasmodium falciparum
HIGKEKNVDCNKD

SEQ ID NO: 3314369 - protein, 6 aa, Plasmodium falciparum
HIGKNS

SEQ ID NO: 3314370 - protein, 16 aa, Plasmodium falciparum
HIGKNSKEDERSQKIK

SEQ ID NO: 3314371 - protein, 7 aa, Plasmodium falciparum
HIGNDQH

SEQ ID NO: 3314372 - protein, 13 aa, Plasmodium falciparum
HIKNAQNNTTNNR

SEQ ID NO: 3314373 - protein, 7 aa, Plasmodium falciparum
HIKNEED

SEQ ID NO: 3314374 - protein, 5 aa, Plasmodium falciparum
HIKNS

SEQ ID NO: 3314375 - protein, 19 aa, Plasmodium falciparum
HIKSNNNNSSSSSSSNNNI

SEQ ID NO: 3314376 - protein, 10 aa, Plasmodium falciparum
HIKTSNKENI

SEQ ID NO: 3314377 - protein, 15 aa, Plasmodium falciparum
HINDNKQNSYDVEQG

SEQ ID NO: 3314378 - protein, 5 aa, Plasmodium falciparum
HINEK

SEQ ID NO: 3314379 - protein, 7 aa, Plasmodium falciparum
HINEQSN

SEQ ID NO: 3314380 - protein, 10 aa, Plasmodium falciparum
HINGNNSMND

SEQ ID NO: 3314381 - protein, 9 aa, Plasmodium falciparum
HINKNENNI

SEQ ID NO: 3314382 - protein, 7 aa, Plasmodium falciparum
HINKNNN

SEQ ID NO: 3314383 - protein, 9 aa, Plasmodium falciparum
HINNDKEKN

SEQ ID NO: 3314384 - protein, 15 aa, Plasmodium falciparum
HINNKQRVKKKNNKM

SEQ ID NO: 3314385 - protein, 7 aa, Plasmodium falciparum
HINNNND

SEQ ID NO: 3314386 - protein, 16 aa, Plasmodium falciparum
HINNNNKNTKKKRTSE

SEQ ID NO: 3314387 - protein, 27 aa, Plasmodium falciparum
HINNNVNNNNNNNNNNNNNNNNNNNNE

SEQ ID NO: 3314388 - protein, 12 aa, Plasmodium falciparum
HINNTSQNIKTR

SEQ ID NO: 3314389 - protein, 16 aa, Plasmodium falciparum
HINPNGNLDDQEDSES

SEQ ID NO: 3314390 - protein, 17 aa, Plasmodium falciparum
HIQNNDNSFNSSSSNVP

SEQ ID NO: 3314391 - protein, 5 aa, Plasmodium falciparum
HIQTK

SEQ ID NO: 3314392 - protein, 5 aa, Plasmodium falciparum
HISDE

SEQ ID NO: 3314393 - protein, 11 aa, Plasmodium falciparum
HISSTYEEKYK

SEQ ID NO: 3314394 - protein, 4 aa, Plasmodium falciparum
HITD

SEQ ID NO: 3314395 - protein, 5 aa, Plasmodium falciparum
HITEA

SEQ ID NO: 3314396 - protein, 7 aa, Plasmodium falciparum
HKATTNK

SEQ ID NO: 3314397 - protein, 7 aa, Plasmodium falciparum
HKDDENT

SEQ ID NO: 3314398 - protein, 7 aa, Plasmodium falciparum
HKDENDI

SEQ ID NO: 3314399 - protein, 14 aa, Plasmodium falciparum
HKDKATIKGKDNIP

SEQ ID NO: 3314400 - protein, 20 aa, Plasmodium falciparum
HKDKDDKKNANSSFESEHED

SEQ ID NO: 3314401 - protein, 5 aa, Plasmodium falciparum
HKDMK

SEQ ID NO: 3314402 - protein, 11 aa, Plasmodium falciparum
HKDNKDNNDEN

SEQ ID NO: 3314403 - protein, 12 aa, Plasmodium falciparum
HKDNKKFNSVTS

SEQ ID NO: 3314404 - protein, 5 aa, Plasmodium falciparum
HKDSQ

SEQ ID NO: 3314405 - protein, 8 aa, Plasmodium falciparum
HKDTKEEE

SEQ ID NO: 3314406 - protein, 12 aa, Plasmodium falciparum
HKDTPRKLGPNQ

SEQ ID NO: 3314407 - protein, 37 aa, Plasmodium falciparum
HKEDDDEKYKKYEDKEKDDINSKQIQNSQTSPSNNDN

SEQ ID NO: 3314408 - protein, 9 aa, Plasmodium falciparum
HKEDTNTMH

SEQ ID NO: 3314409 - protein, 4 aa, Plasmodium falciparum
HKEE

SEQ ID NO: 3314410 - protein, 6 aa, Plasmodium falciparum
HKEESF

SEQ ID NO: 3314411 - protein, 8 aa, Plasmodium falciparum
HKEGEQNN

SEQ ID NO: 3314412 - protein, 7 aa, Plasmodium falciparum
HKEGGMY

SEQ ID NO: 3314413 - protein, 6 aa, Plasmodium falciparum
HKEIKE

SEQ ID NO: 3314414 - protein, 4 aa, Plasmodium falciparum
HKEK

SEQ ID NO: 3314415 - protein, 12 aa, Plasmodium falciparum
HKEKEKDKTKME

SEQ ID NO: 3314416 - protein, 7 aa, Plasmodium falciparum
HKEKENL

SEQ ID NO: 3314417 - protein, 6 aa, Plasmodium falciparum
HKEKKD

SEQ ID NO: 3314418 - protein, 27 aa, Plasmodium falciparum
HKEKKHRELRSSRRKSNSSKLYKRGSD

SEQ ID NO: 3314419 - protein, 11 aa, Plasmodium falciparum
HKEKQQDEDTY

SEQ ID NO: 3314420 - protein, 6 aa, Plasmodium falciparum
HKEKSE

SEQ ID NO: 3314421 - protein, 13 aa, Plasmodium falciparum
HKENKDPSTNGIN

SEQ ID NO: 3314422 - protein, 9 aa, Plasmodium falciparum
HKENKLKNK

SEQ ID NO: 3314423 - protein, 30 aa, Plasmodium falciparum
HKENNKNNNNNNEKNNYNNNNNNNNNNNNN

SEQ ID NO: 3314424 - protein, 10 aa, Plasmodium falciparum
HKENNNNNNN

SEQ ID NO: 3314425 - protein, 6 aa, Plasmodium falciparum
HKEPAD

SEQ ID NO: 3314426 - protein, 15 aa, Plasmodium falciparum
HKEQSTKKNTEMDNN

SEQ ID NO: 3314427 - protein, 8 aa, Plasmodium falciparum
HKETEAFR

SEQ ID NO: 3314428 - protein, 19 aa, Plasmodium falciparum
HKETNNNKKKNSFSDEKEI

SEQ ID NO: 3314429 - protein, 5 aa, Plasmodium falciparum
HKGAD

SEQ ID NO: 3314430 - protein, 4 aa, Plasmodium falciparum
HKGE

SEQ ID NO: 3314431 - protein, 7 aa, Plasmodium falciparum
HKGPNGT

SEQ ID NO: 3314432 - protein, 12 aa, Plasmodium falciparum
HKGSIEKKEPNN

SEQ ID NO: 3314433 - protein, 6 aa, Plasmodium falciparum
HKHDAS

SEQ ID NO: 3314434 - protein, 8 aa, Plasmodium falciparum
HKHEQEHK

SEQ ID NO: 3314435 - protein, 12 aa, Plasmodium falciparum
HKIDNTKESNVE

SEQ ID NO: 3314436 - protein, 16 aa, Plasmodium falciparum
HKIEGSSKAAHFRFDA

SEQ ID NO: 3314437 - protein, 4 aa, Plasmodium falciparum
HKIG

SEQ ID NO: 3314438 - protein, 10 aa, Plasmodium falciparum
HKINKETNSY

SEQ ID NO: 3314439 - protein, 6 aa, Plasmodium falciparum
HKKCSK

SEQ ID NO: 3314440 - protein, 4 aa, Plasmodium falciparum
HKKD

SEQ ID NO: 3314441 - protein, 9 aa, Plasmodium falciparum
HKKDDDNIR

SEQ ID NO: 3314442 - protein, 10 aa, Plasmodium falciparum
HKKDDDNIRN

SEQ ID NO: 3314443 - protein, 5 aa, Plasmodium falciparum
HKKDE

SEQ ID NO: 3314444 - protein, 25 aa, Plasmodium falciparum
HKKDVSYNKEEEQFTDNNKNDTENV

SEQ ID NO: 3314445 - protein, 4 aa, Plasmodium falciparum
HKKE

SEQ ID NO: 3314446 - protein, 14 aa, Plasmodium falciparum
HKKEDRRRKKFRNR

SEQ ID NO: 3314447 - protein, 11 aa, Plasmodium falciparum
HKKEKNDEKYQ

SEQ ID NO: 3314448 - protein, 18 aa, Plasmodium falciparum
HKKEQYHDNENKLKEVSE

SEQ ID NO: 3314449 - protein, 18 aa, Plasmodium falciparum
HKKETNEYNIKDEKNDNI

SEQ ID NO: 3314450 - protein, 8 aa, Plasmodium falciparum
HKKGNEIK

SEQ ID NO: 3314451 - protein, 10 aa, Plasmodium falciparum
HKKKDYPADK

SEQ ID NO: 3314452 - protein, 10 aa, Plasmodium falciparum
HKKKENHKNK

SEQ ID NO: 3314453 - protein, 10 aa, Plasmodium falciparum
HKKKESSSRM

SEQ ID NO: 3314454 - protein, 14 aa, Plasmodium falciparum
HKKKKVRKKKKIHK

SEQ ID NO: 3314455 - protein, 7 aa, Plasmodium falciparum
HKKKNSE

SEQ ID NO: 3314456 - protein, 9 aa, Plasmodium falciparum
HKKKQKKLI

SEQ ID NO: 3314457 - protein, 13 aa, Plasmodium falciparum
HKKKRSKNNDDNM

SEQ ID NO: 3314458 - protein, 35 aa, Plasmodium falciparum
HKKNDKINHKKNDKINHKKNDKINHKKNDKINNKI

SEQ ID NO: 3314459 - protein, 10 aa, Plasmodium falciparum
HKKNNNSTWT

SEQ ID NO: 3314460 - protein, 26 aa, Plasmodium falciparum
HKKNQSNEENGKYNENRKSSYESSYY

SEQ ID NO: 3314461 - protein, 11 aa, Plasmodium falciparum
HKKRKSTSKSK

SEQ ID NO: 3314462 - protein, 17 aa, Plasmodium falciparum
HKKRNESNKKKKEKNIT

SEQ ID NO: 3314463 - protein, 9 aa, Plasmodium falciparum
HKKRSNTPS

SEQ ID NO: 3314464 - protein, 17 aa, Plasmodium falciparum
HKKSKETKNTKTSKGYT

SEQ ID NO: 3314465 - protein, 6 aa, Plasmodium falciparum
HKKTNQ

SEQ ID NO: 3314466 - protein, 5 aa, Plasmodium falciparum
HKKTP

SEQ ID NO: 3314467 - protein, 12 aa, Plasmodium falciparum
HKKTTNKENNDN

SEQ ID NO: 3314468 - protein, 6 aa, Plasmodium falciparum
HKKYGL

SEQ ID NO: 3314469 - protein, 16 aa, Plasmodium falciparum
HKKYSNNNINNNNRTY

SEQ ID NO: 3314470 - protein, 25 aa, Plasmodium falciparum
HKLEESKFDDNNNIYDNDDELEKNL

SEQ ID NO: 3314471 - protein, 5 aa, Plasmodium falciparum
HKLNE

SEQ ID NO: 3314472 - protein, 8 aa, Plasmodium falciparum
HKLPPSGG

SEQ ID NO: 3314473 - protein, 11 aa, Plasmodium falciparum
HKLTRNEEDNV

SEQ ID NO: 3314474 - protein, 8 aa, Plasmodium falciparum
HKNDKEAY

SEQ ID NO: 3314475 - protein, 16 aa, Plasmodium falciparum
HKNDNSTTEAGQKNNN

SEQ ID NO: 3314476 - protein, 11 aa, Plasmodium falciparum
HKNDPKSFSNN

SEQ ID NO: 3314477 - protein, 6 aa, Plasmodium falciparum
HKNDSY

SEQ ID NO: 3314478 - protein, 27 aa, Plasmodium falciparum
HKNDTVKNNAINNNNNDDNDDDRFNEN

SEQ ID NO: 3314479 - protein, 11 aa, Plasmodium falciparum
HKNEEEIKTKD

SEQ ID NO: 3314480 - protein, 8 aa, Plasmodium falciparum
HKNEEYKN

SEQ ID NO: 3314481 - protein, 10 aa, Plasmodium falciparum
HKNEKEPKLE

SEQ ID NO: 3314482 - protein, 7 aa, Plasmodium falciparum
HKNESEK

SEQ ID NO: 3314483 - protein, 27 aa, Plasmodium falciparum
HKNGNNHKKKREDNMNSSDKNNTQQDY

SEQ ID NO: 3314484 - protein, 8 aa, Plasmodium falciparum
HKNKKDNK

SEQ ID NO: 3314485 - protein, 8 aa, Plasmodium falciparum
HKNKKKTH

SEQ ID NO: 3314486 - protein, 8 aa, Plasmodium falciparum
HKNKKSVH

SEQ ID NO: 3314487 - protein, 8 aa, Plasmodium falciparum
HKNKNDNK

SEQ ID NO: 3314488 - protein, 5 aa, Plasmodium falciparum
HKNME

SEQ ID NO: 3314489 - protein, 28 aa, Plasmodium falciparum
HKNNDTNNNDNNNNNNNNNNNNNSCDNN

SEQ ID NO: 3314490 - protein, 6 aa, Plasmodium falciparum
HKNNKD

SEQ ID NO: 3314491 - protein, 16 aa, Plasmodium falciparum
HKNNKEIRTGKGGGHY

SEQ ID NO: 3314492 - protein, 22 aa, Plasmodium falciparum
HKNNNHNENDNNENDNNNNNVL

SEQ ID NO: 3314493 - protein, 8 aa, Plasmodium falciparum
HKNNSTNV

SEQ ID NO: 3314494 - protein, 23 aa, Plasmodium falciparum
HKNPSTNKNTPYGSSLQKGKNQN

SEQ ID NO: 3314495 - protein, 4 aa, Plasmodium falciparum
HKNQ

SEQ ID NO: 3314496 - protein, 23 aa, Plasmodium falciparum
HKNSNDSTLSQGLPNKSSNDDNC

SEQ ID NO: 3314497 - protein, 8 aa, Plasmodium falciparum
HKNSNEKK

SEQ ID NO: 3314498 - protein, 4 aa, Plasmodium falciparum
HKNT

SEQ ID NO: 3314499 - protein, 10 aa, Plasmodium falciparum
HKNTSDDVAE

SEQ ID NO: 3314500 - protein, 10 aa, Plasmodium falciparum
HKNTSKQIKN

SEQ ID NO: 3314501 - protein, 9 aa, Plasmodium falciparum
HKNVDNNAD

SEQ ID NO: 3314502 - protein, 6 aa, Plasmodium falciparum
HKPEYQ

SEQ ID NO: 3314503 - protein, 6 aa, Plasmodium falciparum
HKPFRS

SEQ ID NO: 3314504 - protein, 4 aa, Plasmodium falciparum
HKPI

SEQ ID NO: 3314505 - protein, 12 aa, Plasmodium falciparum
HKPNEEVKSTSD

SEQ ID NO: 3314506 - protein, 40 aa, Plasmodium falciparum
HKPQEDDDDNEEEVDEEDDEEAENQKNYNNNNNNNNNNTD

SEQ ID NO: 3314507 - protein, 7 aa, Plasmodium falciparum
HKQENNK

SEQ ID NO: 3314508 - protein, 27 aa, Plasmodium falciparum
HKQINNKYDTKELTKESTNTNNIKPRD

SEQ ID NO: 3314509 - protein, 9 aa, Plasmodium falciparum
HKQNNKKDT

SEQ ID NO: 3314510 - protein, 26 aa, Plasmodium falciparum
HKRDTSSFSSSHSSYISNTSRVRDDI

SEQ ID NO: 3314511 - protein, 5 aa, Plasmodium falciparum
HKRGN

SEQ ID NO: 3314512 - protein, 9 aa, Plasmodium falciparum
HKRNSTNNH

SEQ ID NO: 3314513 - protein, 9 aa, Plasmodium falciparum
HKRSSSSNV

SEQ ID NO: 3314514 - protein, 5 aa, Plasmodium falciparum
HKSDV

SEQ ID NO: 3314515 - protein, 42 aa, Plasmodium falciparum
HKSHATNHRRDDNDDDEDEDDDDDEDEDDDDEEEEDDDVDEN

SEQ ID NO: 3314516 - protein, 11 aa, Plasmodium falciparum
HKSKDKKKSGS

SEQ ID NO: 3314517 - protein, 11 aa, Plasmodium falciparum
HKSKLNNKENN

SEQ ID NO: 3314518 - protein, 7 aa, Plasmodium falciparum
HKSLEDE

SEQ ID NO: 3314519 - protein, 10 aa, Plasmodium falciparum
HKSNLSNDNY

SEQ ID NO: 3314520 - protein, 8 aa, Plasmodium falciparum
HKSNNDVS

SEQ ID NO: 3314521 - protein, 7 aa, Plasmodium falciparum
HKSNNKS

SEQ ID NO: 3314522 - protein, 7 aa, Plasmodium falciparum
HKSNSTP

SEQ ID NO: 3314523 - protein, 16 aa, Plasmodium falciparum
HKSSFDLSSQKSSFDL

SEQ ID NO: 3314524 - protein, 25 aa, Plasmodium falciparum
HKSSFDVSSHKSSFDVSSHKSSFDL

SEQ ID NO: 3314525 - protein, 16 aa, Plasmodium falciparum
HKSSFSSSSCPPSSTF

SEQ ID NO: 3314526 - protein, 12 aa, Plasmodium falciparum
HKSSTKKKNLYN

SEQ ID NO: 3314527 - protein, 10 aa, Plasmodium falciparum
HKSTLDNKNC

SEQ ID NO: 3314528 - protein, 9 aa, Plasmodium falciparum
HKTASQSNL

SEQ ID NO: 3314529 - protein, 12 aa, Plasmodium falciparum
HKTDDNTEYKKK

SEQ ID NO: 3314530 - protein, 9 aa, Plasmodium falciparum
HKTKDLSTQ

SEQ ID NO: 3314531 - protein, 14 aa, Plasmodium falciparum
HKTNDINKNIKKNQ

SEQ ID NO: 3314532 - protein, 21 aa, Plasmodium falciparum
HKTQPEKKKKKKKKKKEKEKN

SEQ ID NO: 3314533 - protein, 8 aa, Plasmodium falciparum
HKTSNKKN

SEQ ID NO: 3314534 - protein, 23 aa, Plasmodium falciparum
HKTTRRNKRDERNKHKGKNNKFE

SEQ ID NO: 3314535 - protein, 8 aa, Plasmodium falciparum
HKYEQNEQ

SEQ ID NO: 3314536 - protein, 95 aa, Plasmodium falciparum
HKYNNKGDNKYNNKGDNKYNNKGDSEYNKCDSEYNKCDSEYNKCDSEYNKCDSEYNKCDSEYNKCDSEYNKCDSEYNNKGDNKYNNKDYSEYNKG

SEQ ID NO: 3314537 - protein, 14 aa, Plasmodium falciparum
HKYSSDKLNYDNDD

SEQ ID NO: 3314538 - protein, 6 aa, Plasmodium falciparum
HLAPEQ

SEQ ID NO: 3314539 - protein, 24 aa, Plasmodium falciparum
HLDDPIKNTNNQTKKELSNNNKEI

SEQ ID NO: 3314540 - protein, 15 aa, Plasmodium falciparum
HLDEQNNNEHELTSP

SEQ ID NO: 3314541 - protein, 11 aa, Plasmodium falciparum
HLDNKKKKNII

SEQ ID NO: 3314542 - protein, 9 aa, Plasmodium falciparum
HLDNSNNMN

SEQ ID NO: 3314543 - protein, 5 aa, Plasmodium falciparum
HLEDK

SEQ ID NO: 3314544 - protein, 9 aa, Plasmodium falciparum
HLGSTGNPF

SEQ ID NO: 3314545 - protein, 10 aa, Plasmodium falciparum
HLNEPSDEED

SEQ ID NO: 3314546 - protein, 12 aa, Plasmodium falciparum
HLNTSDNVNNMK

SEQ ID NO: 3314547 - protein, 10 aa, Plasmodium falciparum
HLPDENTNSQ

SEQ ID NO: 3314548 - protein, 10 aa, Plasmodium falciparum
HLSNEKNNLS

SEQ ID NO: 3314549 - protein, 16 aa, Plasmodium falciparum
HLSSNDKNEKTEKKNL

SEQ ID NO: 3314550 - protein, 14 aa, Plasmodium falciparum
HLSSRGANKLPPSN

SEQ ID NO: 3314551 - protein, 4 aa, Plasmodium falciparum
HLYN

SEQ ID NO: 3314552 - protein, 10 aa, Plasmodium falciparum
HMDEPNGEHP

SEQ ID NO: 3314553 - protein, 4 aa, Plasmodium falciparum
HMDN

SEQ ID NO: 3314554 - protein, 8 aa, Plasmodium falciparum
HMKEKGGY

SEQ ID NO: 3314555 - protein, 4 aa, Plasmodium falciparum
HMKG

SEQ ID NO: 3314556 - protein, 24 aa, Plasmodium falciparum
HMKKENNNCEENSEQNKQVNGMSS

SEQ ID NO: 3314557 - protein, 8 aa, Plasmodium falciparum
HMNGHTND

SEQ ID NO: 3314558 - protein, 5 aa, Plasmodium falciparum
HMNKN

SEQ ID NO: 3314559 - protein, 16 aa, Plasmodium falciparum
HMNSNNANSLNKDPRI

SEQ ID NO: 3314560 - protein, 57 aa, Plasmodium falciparum
HMSSHTSNRNIPGIKSDNDDSHHNSKDIYDNKSSNIYEKDKDNKKSNKDLSSSNQSN

SEQ ID NO: 3314561 - protein, 9 aa, Plasmodium falciparum
HNADNNQSN

SEQ ID NO: 3314562 - protein, 8 aa, Plasmodium falciparum
HNAYNSDV

SEQ ID NO: 3314563 - protein, 61 aa, Plasmodium falciparum
HNDDDYEEEDEDEDDDDEDYESDVDYDDDDEYDEGQEHDADQDEKNNDNEKQQEQQNYGEK

SEQ ID NO: 3314564 - protein, 38 aa, Plasmodium falciparum
HNDEKKNRHGRKRDKEKKYRDNSSSIEKNDNIKTKPEF

SEQ ID NO: 3314565 - protein, 22 aa, Plasmodium falciparum
HNDENNNVINQGEEKEQSASSL

SEQ ID NO: 3314566 - protein, 7 aa, Plasmodium falciparum
HNDETKS

SEQ ID NO: 3314567 - protein, 8 aa, Plasmodium falciparum
HNDGGGHH

SEQ ID NO: 3314568 - protein, 9 aa, Plasmodium falciparum
HNDHNNNGQ

SEQ ID NO: 3314569 - protein, 7 aa, Plasmodium falciparum
HNDKFND

SEQ ID NO: 3314570 - protein, 8 aa, Plasmodium falciparum
HNDKKENT

SEQ ID NO: 3314571 - protein, 42 aa, Plasmodium falciparum
HNDKKKKNENDNEMDKTDTYLREKKNKKEYIKEKKNTQNNYE

SEQ ID NO: 3314572 - protein, 5 aa, Plasmodium falciparum
HNDKQ

SEQ ID NO: 3314573 - protein, 29 aa, Plasmodium falciparum
HNDKSNQKNKNTKNKNKNKKKKKKKKKKI

SEQ ID NO: 3314574 - protein, 4 aa, Plasmodium falciparum
HNDM

SEQ ID NO: 3314575 - protein, 7 aa, Plasmodium falciparum
HNDMKDE

SEQ ID NO: 3314576 - protein, 18 aa, Plasmodium falciparum
HNDNDNDDDDNYKTMDGY

SEQ ID NO: 3314577 - protein, 11 aa, Plasmodium falciparum
HNDNDNKDNSL

SEQ ID NO: 3314578 - protein, 9 aa, Plasmodium falciparum
HNDNKKSYI

SEQ ID NO: 3314579 - protein, 33 aa, Plasmodium falciparum
HNDNNDDNNNNNNNNNVDDDNNSNIQNDEQSYF

SEQ ID NO: 3314580 - protein, 6 aa, Plasmodium falciparum
HNDRNE

SEQ ID NO: 3314581 - protein, 11 aa, Plasmodium falciparum
HNDSEYNKNNC

SEQ ID NO: 3314582 - protein, 7 aa, Plasmodium falciparum
HNDTYDD

SEQ ID NO: 3314583 - protein, 7 aa, Plasmodium falciparum
HNDYRKN

SEQ ID NO: 3314584 - protein, 19 aa, Plasmodium falciparum
HNEANSNNNQTCDNNNNKK

SEQ ID NO: 3314585 - protein, 9 aa, Plasmodium falciparum
HNEDETYTS

SEQ ID NO: 3314586 - protein, 7 aa, Plasmodium falciparum
HNEEDES

SEQ ID NO: 3314587 - protein, 6 aa, Plasmodium falciparum
HNEEGS

SEQ ID NO: 3314588 - protein, 5 aa, Plasmodium falciparum
HNEEL

SEQ ID NO: 3314589 - protein, 5 aa, Plasmodium falciparum
HNEEQ

SEQ ID NO: 3314590 - protein, 21 aa, Plasmodium falciparum
HNEESVSSTLGKEQTGQGKSN

SEQ ID NO: 3314591 - protein, 9 aa, Plasmodium falciparum
HNEETQESN

SEQ ID NO: 3314592 - protein, 5 aa, Plasmodium falciparum
HNEIN

SEQ ID NO: 3314593 - protein, 15 aa, Plasmodium falciparum
HNEKGQPQKPSNQNI

SEQ ID NO: 3314594 - protein, 4 aa, Plasmodium falciparum
HNEL

SEQ ID NO: 3314595 - protein, 8 aa, Plasmodium falciparum
HNENEKKY

SEQ ID NO: 3314596 - protein, 25 aa, Plasmodium falciparum
HNENEQKSDQDEDEDENEDEDSNDI

SEQ ID NO: 3314597 - protein, 7 aa, Plasmodium falciparum
HNENNVN

SEQ ID NO: 3314598 - protein, 22 aa, Plasmodium falciparum
HNENSYNSNDDNKDTTTSKKDF

SEQ ID NO: 3314599 - protein, 8 aa, Plasmodium falciparum
HNEPDKKY

SEQ ID NO: 3314600 - protein, 18 aa, Plasmodium falciparum
HNEPSEEAKSFDQKKNTK

SEQ ID NO: 3314601 - protein, 6 aa, Plasmodium falciparum
HNESNM

SEQ ID NO: 3314602 - protein, 7 aa, Plasmodium falciparum
HNETHEY

SEQ ID NO: 3314603 - protein, 6 aa, Plasmodium falciparum
HNEYEN

SEQ ID NO: 3314604 - protein, 6 aa, Plasmodium falciparum
HNEYTQ

SEQ ID NO: 3314605 - protein, 4 aa, Plasmodium falciparum
HNGD

SEQ ID NO: 3314606 - protein, 16 aa, Plasmodium falciparum
HNGETNHTKDNENKDC

SEQ ID NO: 3314607 - protein, 11 aa, Plasmodium falciparum
HNGNEKNVKKD

SEQ ID NO: 3314608 - protein, 7 aa, Plasmodium falciparum
HNGSDNN

SEQ ID NO: 3314609 - protein, 5 aa, Plasmodium falciparum
HNGSI

SEQ ID NO: 3314610 - protein, 11 aa, Plasmodium falciparum
HNGSPNYTSNK

SEQ ID NO: 3314611 - protein, 6 aa, Plasmodium falciparum
HNHMSN

SEQ ID NO: 3314612 - protein, 7 aa, Plasmodium falciparum
HNHNDKN

SEQ ID NO: 3314613 - protein, 23 aa, Plasmodium falciparum
HNHNNNHNNNNNNNNNNNGGNTK

SEQ ID NO: 3314614 - protein, 7 aa, Plasmodium falciparum
HNHNNNQ

SEQ ID NO: 3314615 - protein, 11 aa, Plasmodium falciparum
HNIDDDDDDDY

SEQ ID NO: 3314616 - protein, 12 aa, Plasmodium falciparum
HNIDDDNNNNNN

SEQ ID NO: 3314617 - protein, 5 aa, Plasmodium falciparum
HNIEH

SEQ ID NO: 3314618 - protein, 8 aa, Plasmodium falciparum
HNIESKDD

SEQ ID NO: 3314619 - protein, 4 aa, Plasmodium falciparum
HNIN

SEQ ID NO: 3314620 - protein, 11 aa, Plasmodium falciparum
HNISTSENIQK

SEQ ID NO: 3314621 - protein, 52 aa, Plasmodium falciparum
HNITNDNIKNDNITNDNCTNNNITNNNIKNDNCTNNNIKNDNCTNNNITNNN

SEQ ID NO: 3314622 - protein, 10 aa, Plasmodium falciparum
HNKCTHNPND

SEQ ID NO: 3314623 - protein, 9 aa, Plasmodium falciparum
HNKDKCKNN

SEQ ID NO: 3314624 - protein, 12 aa, Plasmodium falciparum
HNKDPSNKENEI

SEQ ID NO: 3314625 - protein, 8 aa, Plasmodium falciparum
HNKDRREK

SEQ ID NO: 3314626 - protein, 15 aa, Plasmodium falciparum
HNKEEKLKGEEGNTY

SEQ ID NO: 3314627 - protein, 8 aa, Plasmodium falciparum
HNKEENEI

SEQ ID NO: 3314628 - protein, 9 aa, Plasmodium falciparum
HNKEKENNI

SEQ ID NO: 3314629 - protein, 10 aa, Plasmodium falciparum
HNKENKNNIN

SEQ ID NO: 3314630 - protein, 73 aa, Plasmodium falciparum
HNKGEDSSNTKNNNSKNFNNNNKKKNKNKNKNKNKDKHKKNNNQENSVNSKSSNSNNTINENIEESNINDSNN

SEQ ID NO: 3314631 - protein, 7 aa, Plasmodium falciparum
HNKGNTH

SEQ ID NO: 3314632 - protein, 10 aa, Plasmodium falciparum
HNKGNVKSYP

SEQ ID NO: 3314633 - protein, 5 aa, Plasmodium falciparum
HNKIN

SEQ ID NO: 3314634 - protein, 8 aa, Plasmodium falciparum
HNKINSTK

SEQ ID NO: 3314635 - protein, 14 aa, Plasmodium falciparum
HNKKKKKKKKKKIH

SEQ ID NO: 3314636 - protein, 8 aa, Plasmodium falciparum
HNKKNIEN

SEQ ID NO: 3314637 - protein, 4 aa, Plasmodium falciparum
HNKN

SEQ ID NO: 3314638 - protein, 9 aa, Plasmodium falciparum
HNKNDEKNK

SEQ ID NO: 3314639 - protein, 17 aa, Plasmodium falciparum
HNKQNGDNKNINVNNKK

SEQ ID NO: 3314640 - protein, 20 aa, Plasmodium falciparum
HNKQNTTQAFTQKQQEEDNL

SEQ ID NO: 3314641 - protein, 4 aa, Plasmodium falciparum
HNKS

SEQ ID NO: 3314642 - protein, 5 aa, Plasmodium falciparum
HNKSS

SEQ ID NO: 3314643 - protein, 8 aa, Plasmodium falciparum
HNKSSENI

SEQ ID NO: 3314644 - protein, 10 aa, Plasmodium falciparum
HNKSTNEQNY

SEQ ID NO: 3314645 - protein, 5 aa, Plasmodium falciparum
HNLRN

SEQ ID NO: 3314646 - protein, 4 aa, Plasmodium falciparum
HNLS

SEQ ID NO: 3314647 - protein, 33 aa, Plasmodium falciparum
HNLSDDSKTNNYEATHKKHENNLDHKKKEEYKI

SEQ ID NO: 3314648 - protein, 17 aa, Plasmodium falciparum
HNLSSARERSLIILKNK

SEQ ID NO: 3314649 - protein, 13 aa, Plasmodium falciparum
HNLSSTSTKNNKN

SEQ ID NO: 3314650 - protein, 13 aa, Plasmodium falciparum
HNNDNNKNKTGHL

SEQ ID NO: 3314651 - protein, 12 aa, Plasmodium falciparum
HNNDNNNKKDLN

SEQ ID NO: 3314652 - protein, 20 aa, Plasmodium falciparum
HNNDNNNNNNNDNNYNDNYY

SEQ ID NO: 3314653 - protein, 47 aa, Plasmodium falciparum
HNNDNNNNNNNNNNINNNNNNNNNNINNNNNSNNNNNNNNNSSSGSI

SEQ ID NO: 3314654 - protein, 16 aa, Plasmodium falciparum
HNNDNNTYDYNNTANN

SEQ ID NO: 3314655 - protein, 15 aa, Plasmodium falciparum
HNNDSAKKESMQNDY

SEQ ID NO: 3314656 - protein, 14 aa, Plasmodium falciparum
HNNDSNNNNNYKDC

SEQ ID NO: 3314657 - protein, 6 aa, Plasmodium falciparum
HNNEDP

SEQ ID NO: 3314658 - protein, 6 aa, Plasmodium falciparum
HNNEKG

SEQ ID NO: 3314659 - protein, 7 aa, Plasmodium falciparum
HNNEKYP

SEQ ID NO: 3314660 - protein, 17 aa, Plasmodium falciparum
HNNEQEKLHKTNKKNDF

SEQ ID NO: 3314661 - protein, 8 aa, Plasmodium falciparum
HNNESEHA

SEQ ID NO: 3314662 - protein, 8 aa, Plasmodium falciparum
HNNGDDNN

SEQ ID NO: 3314663 - protein, 8 aa, Plasmodium falciparum
HNNGHNND

SEQ ID NO: 3314664 - protein, 13 aa, Plasmodium falciparum
HNNHEKGKREHSN

SEQ ID NO: 3314665 - protein, 5 aa, Plasmodium falciparum
HNNHH

SEQ ID NO: 3314666 - protein, 6 aa, Plasmodium falciparum
HNNHHN

SEQ ID NO: 3314667 - protein, 5 aa, Plasmodium falciparum
HNNHK

SEQ ID NO: 3314668 - protein, 7 aa, Plasmodium falciparum
HNNHNNH

SEQ ID NO: 3314669 - protein, 7 aa, Plasmodium falciparum
HNNHNNN

SEQ ID NO: 3314670 - protein, 6 aa, Plasmodium falciparum
HNNIKA

SEQ ID NO: 3314671 - protein, 5 aa, Plasmodium falciparum
HNNIP

SEQ ID NO: 3314672 - protein, 8 aa, Plasmodium falciparum
HNNKDRNL

SEQ ID NO: 3314673 - protein, 9 aa, Plasmodium falciparum
HNNKEDSLR

SEQ ID NO: 3314674 - protein, 16 aa, Plasmodium falciparum
HNNKEKDNDNDKDKDI

SEQ ID NO: 3314675 - protein, 12 aa, Plasmodium falciparum
HNNKENEQDNSD

SEQ ID NO: 3314676 - protein, 11 aa, Plasmodium falciparum
HNNKEQEDSVS

SEQ ID NO: 3314677 - protein, 10 aa, Plasmodium falciparum
HNNKNDQKKI

SEQ ID NO: 3314678 - protein, 7 aa, Plasmodium falciparum
HNNKSET

SEQ ID NO: 3314679 - protein, 4 aa, Plasmodium falciparum
HNNN

SEQ ID NO: 3314680 - protein, 10 aa, Plasmodium falciparum
HNNNDNNKIK

SEQ ID NO: 3314681 - protein, 22 aa, Plasmodium falciparum
HNNNENLYNDSGERYNLSNNNS

SEQ ID NO: 3314682 - protein, 6 aa, Plasmodium falciparum
HNNNES

SEQ ID NO: 3314683 - protein, 10 aa, Plasmodium falciparum
HNNNGDIKTY

SEQ ID NO: 3314684 - protein, 10 aa, Plasmodium falciparum
HNNNHNNNNN

SEQ ID NO: 3314685 - protein, 12 aa, Plasmodium falciparum
HNNNIKENKPYN

SEQ ID NO: 3314686 - protein, 16 aa, Plasmodium falciparum
HNNNKKKNSLYDSNGS

SEQ ID NO: 3314687 - protein, 12 aa, Plasmodium falciparum
HNNNKYNNKNNY

SEQ ID NO: 3314688 - protein, 11 aa, Plasmodium falciparum
HNNNMDDKNIS

SEQ ID NO: 3314689 - protein, 34 aa, Plasmodium falciparum
HNNNNKDNKKSKKNDKVDEEEDDDENIPSELNDK

SEQ ID NO: 3314690 - protein, 17 aa, Plasmodium falciparum
HNNNNKSSNNNSNTSAI

SEQ ID NO: 3314691 - protein, 7 aa, Plasmodium falciparum
HNNNNND

SEQ ID NO: 3314692 - protein, 27 aa, Plasmodium falciparum
HNNNNNKTSSNNYNNNHNSNDNNMSDN

SEQ ID NO: 3314693 - protein, 14 aa, Plasmodium falciparum
HNNNNNLSSSSRSY

SEQ ID NO: 3314694 - protein, 7 aa, Plasmodium falciparum
HNNNNNN

SEQ ID NO: 3314695 - protein, 9 aa, Plasmodium falciparum
HNNNNNNCN

SEQ ID NO: 3314696 - protein, 14 aa, Plasmodium falciparum
HNNNNNNDDENNPL

SEQ ID NO: 3314697 - protein, 8 aa, Plasmodium falciparum
HNNNNNNM

SEQ ID NO: 3314698 - protein, 8 aa, Plasmodium falciparum
HNNNNNNN

SEQ ID NO: 3314699 - protein, 9 aa, Plasmodium falciparum
HNNNNNNNF

SEQ ID NO: 3314700 - protein, 48 aa, Plasmodium falciparum
HNNNNNNNISCNDNSDHNSNLNSNLNSNLNSNLNSNLNSNLSSNHISN

SEQ ID NO: 3314701 - protein, 22 aa, Plasmodium falciparum
HNNNNNNNNGNVHKHKKKKKKI

SEQ ID NO: 3314702 - protein, 10 aa, Plasmodium falciparum
HNNNNNNNNN

SEQ ID NO: 3314703 - protein, 20 aa, Plasmodium falciparum
HNNNNNNNNNNNNNNNKSSH

SEQ ID NO: 3314704 - protein, 44 aa, Plasmodium falciparum
HNNNNNNNNNNNNNNNNNNNNNNNNNNNNNNNNNNSSSSIDSSC

SEQ ID NO: 3314705 - protein, 33 aa, Plasmodium falciparum
HNNNNNNNNNNSNNNNNNSNNINSNSNNNVSSD

SEQ ID NO: 3314706 - protein, 15 aa, Plasmodium falciparum
HNNNNNNNSNNNNNA

SEQ ID NO: 3314707 - protein, 9 aa, Plasmodium falciparum
HNNNNNNTI

SEQ ID NO: 3314708 - protein, 7 aa, Plasmodium falciparum
HNNNNSI

SEQ ID NO: 3314709 - protein, 6 aa, Plasmodium falciparum
HNNNNY

SEQ ID NO: 3314710 - protein, 11 aa, Plasmodium falciparum
HNNNSNSNSHY

SEQ ID NO: 3314711 - protein, 11 aa, Plasmodium falciparum
HNNNSSERCPY

SEQ ID NO: 3314712 - protein, 45 aa, Plasmodium falciparum
HNNNTSTSHGNRHNDPHEEAEPKKGKKKRVTEEGSKESGKINVGD

SEQ ID NO: 3314713 - protein, 30 aa, Plasmodium falciparum
HNNNYGNNYNECNDSNEHCREKENLQTSNF

SEQ ID NO: 3314714 - protein, 22 aa, Plasmodium falciparum
HNNNYKNKNSDRSRSRSVSSDI

SEQ ID NO: 3314715 - protein, 14 aa, Plasmodium falciparum
HNNNYNDNNFNNNN

SEQ ID NO: 3314716 - protein, 7 aa, Plasmodium falciparum
HNNPNQQ

SEQ ID NO: 3314717 - protein, 8 aa, Plasmodium falciparum
HNNPSSPH

SEQ ID NO: 3314718 - protein, 9 aa, Plasmodium falciparum
HNNQLANPE

SEQ ID NO: 3314719 - protein, 12 aa, Plasmodium falciparum
HNNRENSKYSNK

SEQ ID NO: 3314720 - protein, 8 aa, Plasmodium falciparum
HNNRNNDG

SEQ ID NO: 3314721 - protein, 5 aa, Plasmodium falciparum
HNNSI

SEQ ID NO: 3314722 - protein, 9 aa, Plasmodium falciparum
HNNSNSNTF

SEQ ID NO: 3314723 - protein, 7 aa, Plasmodium falciparum
HNNSPNE

SEQ ID NO: 3314724 - protein, 5 aa, Plasmodium falciparum
HNNSQ

SEQ ID NO: 3314725 - protein, 9 aa, Plasmodium falciparum
HNNSVNDSI

SEQ ID NO: 3314726 - protein, 23 aa, Plasmodium falciparum
HNNSYSSSDDKYHNGRSLSSSDI

SEQ ID NO: 3314727 - protein, 27 aa, Plasmodium falciparum
HNNTDNNNNNNNNNNNNINNNNNNVKQ

SEQ ID NO: 3314728 - protein, 9 aa, Plasmodium falciparum
HNNTENGDV

SEQ ID NO: 3314729 - protein, 6 aa, Plasmodium falciparum
HNNTGD

SEQ ID NO: 3314730 - protein, 6 aa, Plasmodium falciparum
HNNTIN

SEQ ID NO: 3314731 - protein, 8 aa, Plasmodium falciparum
HNNTNSEL

SEQ ID NO: 3314732 - protein, 24 aa, Plasmodium falciparum
HNNTNTYKTSSNNNNNNNNNNNNS

SEQ ID NO: 3314733 - protein, 8 aa, Plasmodium falciparum
HNNTTATK

SEQ ID NO: 3314734 - protein, 4 aa, Plasmodium falciparum
HNNY

SEQ ID NO: 3314735 - protein, 12 aa, Plasmodium falciparum
HNNYNEDNNYKN

SEQ ID NO: 3314736 - protein, 15 aa, Plasmodium falciparum
HNNYNNNNNNINEMS

SEQ ID NO: 3314737 - protein, 8 aa, Plasmodium falciparum
HNNYNNNY

SEQ ID NO: 3314738 - protein, 9 aa, Plasmodium falciparum
HNPEQNKDF

SEQ ID NO: 3314739 - protein, 7 aa, Plasmodium falciparum
HNPHDEN

SEQ ID NO: 3314740 - protein, 6 aa, Plasmodium falciparum
HNPISN

SEQ ID NO: 3314741 - protein, 7 aa, Plasmodium falciparum
HNPKLDN

SEQ ID NO: 3314742 - protein, 20 aa, Plasmodium falciparum
HNPQNYVKSNGKRGESLGDG

SEQ ID NO: 3314743 - protein, 15 aa, Plasmodium falciparum
HNPQPYNKQSDSISI

SEQ ID NO: 3314744 - protein, 11 aa, Plasmodium falciparum
HNPYGTNSKYE

SEQ ID NO: 3314745 - protein, 5 aa, Plasmodium falciparum
HNPYK

SEQ ID NO: 3314746 - protein, 106 aa, Plasmodium falciparum
HNQDNDNNKTNRTGNENNNTNGIGNENNNTNGIGNENNNTNGIGNENNNTNGIGNENNNTNGIGNENNNTNRTGNENNKTNRTGNENNKTNRTGNENNNNNNHNNH

SEQ ID NO: 3314747 - protein, 7 aa, Plasmodium falciparum
HNQEDTP

SEQ ID NO: 3314748 - protein, 7 aa, Plasmodium falciparum
HNQEVDK

SEQ ID NO: 3314749 - protein, 4 aa, Plasmodium falciparum
HNQN

SEQ ID NO: 3314750 - protein, 25 aa, Plasmodium falciparum
HNQNEENNLNKNTSKGKKKIENNNK

SEQ ID NO: 3314751 - protein, 13 aa, Plasmodium falciparum
HNQSPRNTYQSAM

SEQ ID NO: 3314752 - protein, 30 aa, Plasmodium falciparum
HNRENHKNFGNSYKSQNYYNNNSLNDKYTS

SEQ ID NO: 3314753 - protein, 9 aa, Plasmodium falciparum
HNRGAKKNM

SEQ ID NO: 3314754 - protein, 12 aa, Plasmodium falciparum
HNRKREDEQKNH

SEQ ID NO: 3314755 - protein, 4 aa, Plasmodium falciparum
HNRN

SEQ ID NO: 3314756 - protein, 9 aa, Plasmodium falciparum
HNRNVEDEN

SEQ ID NO: 3314757 - protein, 9 aa, Plasmodium falciparum
HNRSNSSNL

SEQ ID NO: 3314758 - protein, 12 aa, Plasmodium falciparum
HNRSPSKNKNSF

SEQ ID NO: 3314759 - protein, 5 aa, Plasmodium falciparum
HNRTG

SEQ ID NO: 3314760 - protein, 11 aa, Plasmodium falciparum
HNSAEHTQIQD

SEQ ID NO: 3314761 - protein, 73 aa, Plasmodium falciparum
HNSAINNNETDQKDEAKEKDEAKEKGEAKEKEKDETNETYQTNETYQTNETYQTNETYQTNERDEIDESSKNF

SEQ ID NO: 3314762 - protein, 9 aa, Plasmodium falciparum
HNSDTNDMK

SEQ ID NO: 3314763 - protein, 12 aa, Plasmodium falciparum
HNSEVEEEEEEI

SEQ ID NO: 3314764 - protein, 25 aa, Plasmodium falciparum
HNSHTQTHKRDNKYKSASNKFHDDN

SEQ ID NO: 3314765 - protein, 7 aa, Plasmodium falciparum
HNSLNDN

SEQ ID NO: 3314766 - protein, 43 aa, Plasmodium falciparum
HNSNDEGTKGKGAYTHNRKDEKKEDTTNNVDSKKNDMNDPKSI

SEQ ID NO: 3314767 - protein, 25 aa, Plasmodium falciparum
HNSNDQNKNTISKSSTLHHSSQKVN

SEQ ID NO: 3314768 - protein, 7 aa, Plasmodium falciparum
HNSNENL

SEQ ID NO: 3314769 - protein, 7 aa, Plasmodium falciparum
HNSNRTQ

SEQ ID NO: 3314770 - protein, 31 aa, Plasmodium falciparum
HNSPPVPPTCPPPPTPPAPPGQPTQSNYPSQ

SEQ ID NO: 3314771 - protein, 17 aa, Plasmodium falciparum
HNSQEKLSNGNNENDRG

SEQ ID NO: 3314772 - protein, 4 aa, Plasmodium falciparum
HNSS

SEQ ID NO: 3314773 - protein, 5 aa, Plasmodium falciparum
HNSSI

SEQ ID NO: 3314774 - protein, 15 aa, Plasmodium falciparum
HNSSKNKNSSNKKKI

SEQ ID NO: 3314775 - protein, 24 aa, Plasmodium falciparum
HNSSSDDEKELIGTTKKKNRKKKI

SEQ ID NO: 3314776 - protein, 8 aa, Plasmodium falciparum
HNSSSSYR

SEQ ID NO: 3314777 - protein, 19 aa, Plasmodium falciparum
HNSTNNYNNNNNNNNHDNN

SEQ ID NO: 3314778 - protein, 5 aa, Plasmodium falciparum
HNSYD

SEQ ID NO: 3314779 - protein, 12 aa, Plasmodium falciparum
HNSYDENTQREI

SEQ ID NO: 3314780 - protein, 6 aa, Plasmodium falciparum
HNSYDT

SEQ ID NO: 3314781 - protein, 23 aa, Plasmodium falciparum
HNSYKEPLRNYSNDHPRNSYNKN

SEQ ID NO: 3314782 - protein, 7 aa, Plasmodium falciparum
HNTDPQE

SEQ ID NO: 3314783 - protein, 16 aa, Plasmodium falciparum
HNTERNNELNNNNTNM

SEQ ID NO: 3314784 - protein, 6 aa, Plasmodium falciparum
HNTHNT

SEQ ID NO: 3314785 - protein, 9 aa, Plasmodium falciparum
HNTNDDNSL

SEQ ID NO: 3314786 - protein, 11 aa, Plasmodium falciparum
HNTNDENNLSS

SEQ ID NO: 3314787 - protein, 17 aa, Plasmodium falciparum
HNTNEEPKDDKNAYNSS

SEQ ID NO: 3314788 - protein, 9 aa, Plasmodium falciparum
HNTNEYGEN

SEQ ID NO: 3314789 - protein, 41 aa, Plasmodium falciparum
HNTNGDINNGEEKKNSEHTNSTRKQKGNKKNDTFEKNNTFE

SEQ ID NO: 3314790 - protein, 14 aa, Plasmodium falciparum
HNTNNIPDQNRTYN

SEQ ID NO: 3314791 - protein, 9 aa, Plasmodium falciparum
HNTQETEKL

SEQ ID NO: 3314792 - protein, 9 aa, Plasmodium falciparum
HNTQNNNNH

SEQ ID NO: 3314793 - protein, 5 aa, Plasmodium falciparum
HNTQQ

SEQ ID NO: 3314794 - protein, 4 aa, Plasmodium falciparum
HNTT

SEQ ID NO: 3314795 - protein, 5 aa, Plasmodium falciparum
HNTTL

SEQ ID NO: 3314796 - protein, 5 aa, Plasmodium falciparum
HNVDG

SEQ ID NO: 3314797 - protein, 18 aa, Plasmodium falciparum
HNVGEKRSVSNTNFGRNN

SEQ ID NO: 3314798 - protein, 6 aa, Plasmodium falciparum
HNVNTN

SEQ ID NO: 3314799 - protein, 10 aa, Plasmodium falciparum
HNVTNENDQF

SEQ ID NO: 3314800 - protein, 5 aa, Plasmodium falciparum
HNYAH

SEQ ID NO: 3314801 - protein, 21 aa, Plasmodium falciparum
HNYEQREKRDRSSSVDSKPEI

SEQ ID NO: 3314802 - protein, 5 aa, Plasmodium falciparum
HNYND

SEQ ID NO: 3314803 - protein, 12 aa, Plasmodium falciparum
HNYNNGNKASTI

SEQ ID NO: 3314804 - protein, 17 aa, Plasmodium falciparum
HNYTNDNDNNNNNNNCP

SEQ ID NO: 3314805 - protein, 4 aa, Plasmodium falciparum
HNYY

SEQ ID NO: 3314806 - protein, 4 aa, Plasmodium falciparum
HPAA

SEQ ID NO: 3314807 - protein, 8 aa, Plasmodium falciparum
HPARNEKK

SEQ ID NO: 3314808 - protein, 9 aa, Plasmodium falciparum
HPDEQMKKD

SEQ ID NO: 3314809 - protein, 14 aa, Plasmodium falciparum
HPDINPSPDAKQKM

SEQ ID NO: 3314810 - protein, 12 aa, Plasmodium falciparum
HPDKNANDPEAK

SEQ ID NO: 3314811 - protein, 11 aa, Plasmodium falciparum
HPDKNKNDNAS

SEQ ID NO: 3314812 - protein, 10 aa, Plasmodium falciparum
HPDKNKNDNV

SEQ ID NO: 3314813 - protein, 17 aa, Plasmodium falciparum
HPDNRNKMNNPNIPNYP

SEQ ID NO: 3314814 - protein, 8 aa, Plasmodium falciparum
HPDTGISR

SEQ ID NO: 3314815 - protein, 9 aa, Plasmodium falciparum
HPEKHNNKV

SEQ ID NO: 3314816 - protein, 8 aa, Plasmodium falciparum
HPETGVTK

SEQ ID NO: 3314817 - protein, 5 aa, Plasmodium falciparum
HPETK

SEQ ID NO: 3314818 - protein, 6 aa, Plasmodium falciparum
HPFPGP

SEQ ID NO: 3314819 - protein, 7 aa, Plasmodium falciparum
HPGVESK

SEQ ID NO: 3314820 - protein, 9 aa, Plasmodium falciparum
HPHETSNGQ

SEQ ID NO: 3314821 - protein, 8 aa, Plasmodium falciparum
HPHGGGNH

SEQ ID NO: 3314822 - protein, 36 aa, Plasmodium falciparum
HPIDNNNNNNDGDNNNDGDNNNNGDNNNNNDKDNIA

SEQ ID NO: 3314823 - protein, 6 aa, Plasmodium falciparum
HPIYSK

SEQ ID NO: 3314824 - protein, 26 aa, Plasmodium falciparum
HPKNNNNNNNINNNNNNNNNNSSNNL

SEQ ID NO: 3314825 - protein, 10 aa, Plasmodium falciparum
HPKNYSANIN

SEQ ID NO: 3314826 - protein, 4 aa, Plasmodium falciparum
HPKY

SEQ ID NO: 3314827 - protein, 4 aa, Plasmodium falciparum
HPLG

SEQ ID NO: 3314828 - protein, 6 aa, Plasmodium falciparum
HPLSKT

SEQ ID NO: 3314829 - protein, 62 aa, Plasmodium falciparum
HPMGDNDNDINYNNNHENNNHSIDNNNNNYSNDHINNDDVEYDNNNVNSKNNNTKISNSGNF

SEQ ID NO: 3314830 - protein, 5 aa, Plasmodium falciparum
HPMKG

SEQ ID NO: 3314831 - protein, 5 aa, Plasmodium falciparum
HPMKP

SEQ ID NO: 3314832 - protein, 6 aa, Plasmodium falciparum
HPNGYG

SEQ ID NO: 3314833 - protein, 4 aa, Plasmodium falciparum
HPNK

SEQ ID NO: 3314834 - protein, 5 aa, Plasmodium falciparum
HPNKM

SEQ ID NO: 3314835 - protein, 16 aa, Plasmodium falciparum
HPNKSNQYNCNDQPYD

SEQ ID NO: 3314836 - protein, 6 aa, Plasmodium falciparum
HPNNNN

SEQ ID NO: 3314837 - protein, 6 aa, Plasmodium falciparum
HPNNSI

SEQ ID NO: 3314838 - protein, 8 aa, Plasmodium falciparum
HPNRNQNK

SEQ ID NO: 3314839 - protein, 9 aa, Plasmodium falciparum
HPPSYSKNR

SEQ ID NO: 3314840 - protein, 7 aa, Plasmodium falciparum
HPQEKTK

SEQ ID NO: 3314841 - protein, 8 aa, Plasmodium falciparum
HPQPNNHH

SEQ ID NO: 3314842 - protein, 4 aa, Plasmodium falciparum
HPRN

SEQ ID NO: 3314843 - protein, 8 aa, Plasmodium falciparum
HPSDSSDY

SEQ ID NO: 3314844 - protein, 6 aa, Plasmodium falciparum
HPSDYN

SEQ ID NO: 3314845 - protein, 6 aa, Plasmodium falciparum
HPSGRR

SEQ ID NO: 3314846 - protein, 32 aa, Plasmodium falciparum
HPSNGTLKSSSPDVSPNSSGTNITSKDNSLSK

SEQ ID NO: 3314847 - protein, 5 aa, Plasmodium falciparum
HPSPL

SEQ ID NO: 3314848 - protein, 18 aa, Plasmodium falciparum
HPSSAPYSSMLPSEAEQR

SEQ ID NO: 3314849 - protein, 5 aa, Plasmodium falciparum
HPSST

SEQ ID NO: 3314850 - protein, 5 aa, Plasmodium falciparum
HPSTL

SEQ ID NO: 3314851 - protein, 14 aa, Plasmodium falciparum
HPSTVSRSAPAGQK

SEQ ID NO: 3314852 - protein, 4 aa, Plasmodium falciparum
HPSV

SEQ ID NO: 3314853 - protein, 5 aa, Plasmodium falciparum
HPSVN

SEQ ID NO: 3314854 - protein, 7 aa, Plasmodium falciparum
HPTAVSG

SEQ ID NO: 3314855 - protein, 4 aa, Plasmodium falciparum
HPTN

SEQ ID NO: 3314856 - protein, 4 aa, Plasmodium falciparum
HPYE

SEQ ID NO: 3314857 - protein, 25 aa, Plasmodium falciparum
HQAQPQGAQAQQKNPQQMQQVPQGN

SEQ ID NO: 3314858 - protein, 8 aa, Plasmodium falciparum
HQEDEEKK

SEQ ID NO: 3314859 - protein, 5 aa, Plasmodium falciparum
HQEME

SEQ ID NO: 3314860 - protein, 5 aa, Plasmodium falciparum
HQENS

SEQ ID NO: 3314861 - protein, 11 aa, Plasmodium falciparum
HQFQNNKREDN

SEQ ID NO: 3314862 - protein, 11 aa, Plasmodium falciparum
HQGKIQKNTSY

SEQ ID NO: 3314863 - protein, 6 aa, Plasmodium falciparum
HQGSSP

SEQ ID NO: 3314864 - protein, 10 aa, Plasmodium falciparum
HQKEKNENIE

SEQ ID NO: 3314865 - protein, 10 aa, Plasmodium falciparum
HQKITDPKKA

SEQ ID NO: 3314866 - protein, 10 aa, Plasmodium falciparum
HQKKEQNNTF

SEQ ID NO: 3314867 - protein, 6 aa, Plasmodium falciparum
HQKKGY

SEQ ID NO: 3314868 - protein, 11 aa, Plasmodium falciparum
HQKLKETNELK

SEQ ID NO: 3314869 - protein, 19 aa, Plasmodium falciparum
HQKNDINERDDSHKKGDIY

SEQ ID NO: 3314870 - protein, 8 aa, Plasmodium falciparum
HQKNEYEE

SEQ ID NO: 3314871 - protein, 19 aa, Plasmodium falciparum
HQLNDQHNYQTDIQTGTYT

SEQ ID NO: 3314872 - protein, 6 aa, Plasmodium falciparum
HQLNSK

SEQ ID NO: 3314873 - protein, 4 aa, Plasmodium falciparum
HQNA

SEQ ID NO: 3314874 - protein, 7 aa, Plasmodium falciparum
HQNDIPK

SEQ ID NO: 3314875 - protein, 8 aa, Plasmodium falciparum
HQNDYKDS

SEQ ID NO: 3314876 - protein, 12 aa, Plasmodium falciparum
HQNEEKTQKKIR

SEQ ID NO: 3314877 - protein, 73 aa, Plasmodium falciparum
HQNNNNNNNDNNNDEHDHNNNNSSGHGNNNNNNSNSHSNSQNNNNNNNSNSNSNHNHGNGHNNYNKSHSNNHN

SEQ ID NO: 3314878 - protein, 19 aa, Plasmodium falciparum
HQNNNNSNNNINNNNNNNN

SEQ ID NO: 3314879 - protein, 22 aa, Plasmodium falciparum
HQPNFTNENVKSNNVSTEQDTY

SEQ ID NO: 3314880 - protein, 12 aa, Plasmodium falciparum
HQQKKKKKNLYD

SEQ ID NO: 3314881 - protein, 5 aa, Plasmodium falciparum
HQQNS

SEQ ID NO: 3314882 - protein, 5 aa, Plasmodium falciparum
HQRND

SEQ ID NO: 3314883 - protein, 7 aa, Plasmodium falciparum
HQRSYEE

SEQ ID NO: 3314884 - protein, 6 aa, Plasmodium falciparum
HQSERN

SEQ ID NO: 3314885 - protein, 9 aa, Plasmodium falciparum
HQSGGERSL

SEQ ID NO: 3314886 - protein, 4 aa, Plasmodium falciparum
HQSP

SEQ ID NO: 3314887 - protein, 6 aa, Plasmodium falciparum
HQSRAR

SEQ ID NO: 3314888 - protein, 14 aa, Plasmodium falciparum
HQTHEYTQDTNKSY

SEQ ID NO: 3314889 - protein, 12 aa, Plasmodium falciparum
HQTNKTSTQKDV

SEQ ID NO: 3314890 - protein, 37 aa, Plasmodium falciparum
HQTYDNSSALNDNLNNKDKKGKEEGNGDNEKNGTSNM

SEQ ID NO: 3314891 - protein, 8 aa, Plasmodium falciparum
HQYGQKGS

SEQ ID NO: 3314892 - protein, 25 aa, Plasmodium falciparum
HRAAKAAEAEMKKRAQKPKKKKSRR

SEQ ID NO: 3314893 - protein, 6 aa, Plasmodium falciparum
HRARAS

SEQ ID NO: 3314894 - protein, 13 aa, Plasmodium falciparum
HRDGHMKDDRDDD

SEQ ID NO: 3314895 - protein, 4 aa, Plasmodium falciparum
HREE

SEQ ID NO: 3314896 - protein, 58 aa, Plasmodium falciparum
HREHKHEKKKEKERKRYSNKYDKYDKYDKYDKYDKYDKYDKYDKYDKYNKNDKNDNYK

SEQ ID NO: 3314897 - protein, 63 aa, Plasmodium falciparum
HRERERDIERNREREREMERNREREREMERNREREREMDRERERERERNMDREREMNRNRESL

SEQ ID NO: 3314898 - protein, 12 aa, Plasmodium falciparum
HRESKDDYELLG

SEQ ID NO: 3314899 - protein, 11 aa, Plasmodium falciparum
HRFPQNNTKDV

SEQ ID NO: 3314900 - protein, 6 aa, Plasmodium falciparum
HRGNDC

SEQ ID NO: 3314901 - protein, 29 aa, Plasmodium falciparum
HRHGNKKKKKDDKINNKNNHKKKNKNHMT

SEQ ID NO: 3314902 - protein, 6 aa, Plasmodium falciparum
HRIGQT

SEQ ID NO: 3314903 - protein, 13 aa, Plasmodium falciparum
HRKHPGGRGKAGG

SEQ ID NO: 3314904 - protein, 11 aa, Plasmodium falciparum
HRKKKTEKVKN

SEQ ID NO: 3314905 - protein, 4 aa, Plasmodium falciparum
HRNE

SEQ ID NO: 3314906 - protein, 104 aa, Plasmodium falciparum
HRNIEDEDSEESDSKWRRRKRERSRDKYKERRRDSIRDRDKERYRDKERYRERERDRDRDRDRERDRDRDRERERERHRHRERERERDRERDRDRERERERRKS

SEQ ID NO: 3314907 - protein, 13 aa, Plasmodium falciparum
HRNKSEEKKSTKM

SEQ ID NO: 3314908 - protein, 6 aa, Plasmodium falciparum
HRNSDY

SEQ ID NO: 3314909 - protein, 5 aa, Plasmodium falciparum
HRQEQ

SEQ ID NO: 3314910 - protein, 10 aa, Plasmodium falciparum
HRQPNARQDI

SEQ ID NO: 3314911 - protein, 28 aa, Plasmodium falciparum
HRSDDHRRGSKRDRRHRSRRSESSDRHH

SEQ ID NO: 3314912 - protein, 4 aa, Plasmodium falciparum
HRSG

SEQ ID NO: 3314913 - protein, 7 aa, Plasmodium falciparum
HRSRERE

SEQ ID NO: 3314914 - protein, 17 aa, Plasmodium falciparum
HRTCDDKSKNVNDKINR

SEQ ID NO: 3314915 - protein, 16 aa, Plasmodium falciparum
HRVPQSGAIRRERGRE

SEQ ID NO: 3314916 - protein, 12 aa, Plasmodium falciparum
HRYDKGKSDIQI

SEQ ID NO: 3314917 - protein, 22 aa, Plasmodium falciparum
HSAGKTPAYGDSSVRAGTGKYN

SEQ ID NO: 3314918 - protein, 8 aa, Plasmodium falciparum
HSAKIPED

SEQ ID NO: 3314919 - protein, 6 aa, Plasmodium falciparum
HSAQEH

SEQ ID NO: 3314920 - protein, 65 aa, Plasmodium falciparum
HSASEKSKAGNKNNRKGLQEKENNSSNLKEDLEKNIKNKRTNSKDTAKNNIKNNVPRRKEKKNNI

SEQ ID NO: 3314921 - protein, 17 aa, Plasmodium falciparum
HSAYEEVNKTSSDSEFV

SEQ ID NO: 3314922 - protein, 5 aa, Plasmodium falciparum
HSDDN

SEQ ID NO: 3314923 - protein, 5 aa, Plasmodium falciparum
HSDEN

SEQ ID NO: 3314924 - protein, 6 aa, Plasmodium falciparum
HSDERP

SEQ ID NO: 3314925 - protein, 13 aa, Plasmodium falciparum
HSDGGYDNLDNGK

SEQ ID NO: 3314926 - protein, 14 aa, Plasmodium falciparum
HSDHSDHSNKSEKL

SEQ ID NO: 3314927 - protein, 5 aa, Plasmodium falciparum
HSDNN

SEQ ID NO: 3314928 - protein, 15 aa, Plasmodium falciparum
HSDRGANKNPSRDTY

SEQ ID NO: 3314929 - protein, 15 aa, Plasmodium falciparum
HSDVNSNDKDYKRSS

SEQ ID NO: 3314930 - protein, 17 aa, Plasmodium falciparum
HSDYNNSSDITKEKKKN

SEQ ID NO: 3314931 - protein, 6 aa, Plasmodium falciparum
HSEENK

SEQ ID NO: 3314932 - protein, 12 aa, Plasmodium falciparum
HSEGHNNYNDED

SEQ ID NO: 3314933 - protein, 21 aa, Plasmodium falciparum
HSEIPKNEDKKKSKRKKQDSL

SEQ ID NO: 3314934 - protein, 6 aa, Plasmodium falciparum
HSEMTP

SEQ ID NO: 3314935 - protein, 5 aa, Plasmodium falciparum
HSENK

SEQ ID NO: 3314936 - protein, 9 aa, Plasmodium falciparum
HSEPDEKHD

SEQ ID NO: 3314937 - protein, 9 aa, Plasmodium falciparum
HSESSYSSV

SEQ ID NO: 3314938 - protein, 20 aa, Plasmodium falciparum
HSGDQDDHHVDDDSSSVQDS

SEQ ID NO: 3314939 - protein, 24 aa, Plasmodium falciparum
HSGENRSFGKYRKKDDGVGPPIRT

SEQ ID NO: 3314940 - protein, 5 aa, Plasmodium falciparum
HSGGN

SEQ ID NO: 3314941 - protein, 5 aa, Plasmodium falciparum
HSGKG

SEQ ID NO: 3314942 - protein, 8 aa, Plasmodium falciparum
HSGLSGPL

SEQ ID NO: 3314943 - protein, 10 aa, Plasmodium falciparum
HSGTKSDNFQ

SEQ ID NO: 3314944 - protein, 7 aa, Plasmodium falciparum
HSISNSS

SEQ ID NO: 3314945 - protein, 8 aa, Plasmodium falciparum
HSKDESSE

SEQ ID NO: 3314946 - protein, 4 aa, Plasmodium falciparum
HSKE

SEQ ID NO: 3314947 - protein, 12 aa, Plasmodium falciparum
HSKENNNYGRYD

SEQ ID NO: 3314948 - protein, 13 aa, Plasmodium falciparum
HSKENNRKQSNSI

SEQ ID NO: 3314949 - protein, 24 aa, Plasmodium falciparum
HSKGKKNKETQEGIGSLRGEQKED

SEQ ID NO: 3314950 - protein, 8 aa, Plasmodium falciparum
HSKNDNIN

SEQ ID NO: 3314951 - protein, 18 aa, Plasmodium falciparum
HSKNYNAKNFNNNPNGNI

SEQ ID NO: 3314952 - protein, 9 aa, Plasmodium falciparum
HSKPPSRFR

SEQ ID NO: 3314953 - protein, 5 aa, Plasmodium falciparum
HSKVQ

SEQ ID NO: 3314954 - protein, 4 aa, Plasmodium falciparum
HSKY

SEQ ID NO: 3314955 - protein, 7 aa, Plasmodium falciparum
HSLRSDT

SEQ ID NO: 3314956 - protein, 6 aa, Plasmodium falciparum
HSNCSN

SEQ ID NO: 3314957 - protein, 9 aa, Plasmodium falciparum
HSNDDKTKY

SEQ ID NO: 3314958 - protein, 37 aa, Plasmodium falciparum
HSNDSSGENIRDSFSKNNIKNISKDTYKINNNENINN

SEQ ID NO: 3314959 - protein, 6 aa, Plasmodium falciparum
HSNGEM

SEQ ID NO: 3314960 - protein, 5 aa, Plasmodium falciparum
HSNGM

SEQ ID NO: 3314961 - protein, 11 aa, Plasmodium falciparum
HSNINKNDAQK

SEQ ID NO: 3314962 - protein, 13 aa, Plasmodium falciparum
HSNISEKKKKSHF

SEQ ID NO: 3314963 - protein, 11 aa, Plasmodium falciparum
HSNKNEKKKKM

SEQ ID NO: 3314964 - protein, 21 aa, Plasmodium falciparum
HSNKNISKGNSNSSDGSITYA

SEQ ID NO: 3314965 - protein, 59 aa, Plasmodium falciparum
HSNKRSRKRSHSDRSKSSSVHHSNKKSRKRSHSDRSKSSSVHNSNDRHKRRSVKYDIED

SEQ ID NO: 3314966 - protein, 27 aa, Plasmodium falciparum
HSNNEHDNNVNGNNNINSNNNNNNGNN

SEQ ID NO: 3314967 - protein, 8 aa, Plasmodium falciparum
HSNNNNNM

SEQ ID NO: 3314968 - protein, 10 aa, Plasmodium falciparum
HSNNNNNNMN

SEQ ID NO: 3314969 - protein, 27 aa, Plasmodium falciparum
HSNNNTKCTYNDKCSSSISNSHDPIKN

SEQ ID NO: 3314970 - protein, 12 aa, Plasmodium falciparum
HSNNSGGDPKEI

SEQ ID NO: 3314971 - protein, 15 aa, Plasmodium falciparum
HSNNVNPHNTNDPSA

SEQ ID NO: 3314972 - protein, 9 aa, Plasmodium falciparum
HSNQNKKNY

SEQ ID NO: 3314973 - protein, 5 aa, Plasmodium falciparum
HSNRL

SEQ ID NO: 3314974 - protein, 14 aa, Plasmodium falciparum
HSNRTKRNEQKNSD

SEQ ID NO: 3314975 - protein, 66 aa, Plasmodium falciparum
HSNSEENKQEKRRTKSRERSIEYRKKSKDKWRDRSKEKSRQRSRDRSKERSRQRSRDRWRDRSRDR

SEQ ID NO: 3314976 - protein, 6 aa, Plasmodium falciparum
HSNSHS

SEQ ID NO: 3314977 - protein, 7 aa, Plasmodium falciparum
HSNSIKY

SEQ ID NO: 3314978 - protein, 5 aa, Plasmodium falciparum
HSNSM

SEQ ID NO: 3314979 - protein, 10 aa, Plasmodium falciparum
HSNSNHMNNN

SEQ ID NO: 3314980 - protein, 5 aa, Plasmodium falciparum
HSNTL

SEQ ID NO: 3314981 - protein, 4 aa, Plasmodium falciparum
HSPL

SEQ ID NO: 3314982 - protein, 9 aa, Plasmodium falciparum
HSPNQGKAT

SEQ ID NO: 3314983 - protein, 28 aa, Plasmodium falciparum
HSPSSDKIKNNNNNNNNKNKKTNNNIKN

SEQ ID NO: 3314984 - protein, 6 aa, Plasmodium falciparum
HSQNYT

SEQ ID NO: 3314985 - protein, 79 aa, Plasmodium falciparum
HSRNNEEKEKQEKKQEKKQEKKQEKKQEKKQEKKQEKKQEKKQEEEQEEEQEEEQEEEQDHKNKHKNKQNCYADEKNND

SEQ ID NO: 3314986 - protein, 12 aa, Plasmodium falciparum
HSRNNKKSPFDR

SEQ ID NO: 3314987 - protein, 32 aa, Plasmodium falciparum
HSRRKGKANSNELCDDDDEEERDGEQVDDQDQ

SEQ ID NO: 3314988 - protein, 61 aa, Plasmodium falciparum
HSSAYRDSDSEKNKSYRKRLSSDNRSHSRRRTVSEDRSERRRSLSEDRSNSRKRNASSDFK

SEQ ID NO: 3314989 - protein, 28 aa, Plasmodium falciparum
HSSENIEKKEKIGKKKKTKKQKKEVKKS

SEQ ID NO: 3314990 - protein, 6 aa, Plasmodium falciparum
HSSENP

SEQ ID NO: 3314991 - protein, 12 aa, Plasmodium falciparum
HSSHKEKKKEAI

SEQ ID NO: 3314992 - protein, 7 aa, Plasmodium falciparum
HSSKKEL

SEQ ID NO: 3314993 - protein, 7 aa, Plasmodium falciparum
HSSKNSY

SEQ ID NO: 3314994 - protein, 10 aa, Plasmodium falciparum
HSSNKKMREH

SEQ ID NO: 3314995 - protein, 7 aa, Plasmodium falciparum
HSSNRND

SEQ ID NO: 3314996 - protein, 13 aa, Plasmodium falciparum
HSSNTNYTNEEKK

SEQ ID NO: 3314997 - protein, 43 aa, Plasmodium falciparum
HSSNYNNTGYNNNNNNNNFNNNNNFNNNNNFNNNNNFNNNNNF

SEQ ID NO: 3314998 - protein, 7 aa, Plasmodium falciparum
HSSQSSL

SEQ ID NO: 3314999 - protein, 8 aa, Plasmodium falciparum
HSSSHYNN

SEQ ID NO: 3315000 - protein, 12 aa, Plasmodium falciparum
HSSSNNTYDEKE

SEQ ID NO: 3315001 - protein, 9 aa, Plasmodium falciparum
HSSSQYENN

SEQ ID NO: 3315002 - protein, 7 aa, Plasmodium falciparum
HSSTEEI

SEQ ID NO: 3315003 - protein, 16 aa, Plasmodium falciparum
HSTHVSSEYDKYNNSQ

SEQ ID NO: 3315004 - protein, 11 aa, Plasmodium falciparum
HSTKGANNTTI

SEQ ID NO: 3315005 - protein, 10 aa, Plasmodium falciparum
HSTNKKYEHN

SEQ ID NO: 3315006 - protein, 9 aa, Plasmodium falciparum
HSTSNGNNM

SEQ ID NO: 3315007 - protein, 5 aa, Plasmodium falciparum
HSYGN

SEQ ID NO: 3315008 - protein, 36 aa, Plasmodium falciparum
HSYSNHSSDRKKRKKYREEKHKEKKKKKKKSYSSSI

SEQ ID NO: 3315009 - protein, 4 aa, Plasmodium falciparum
HTCD

SEQ ID NO: 3315010 - protein, 9 aa, Plasmodium falciparum
HTDEGPSSR

SEQ ID NO: 3315011 - protein, 4 aa, Plasmodium falciparum
HTDN

SEQ ID NO: 3315012 - protein, 12 aa, Plasmodium falciparum
HTDNNGEDNNIA

SEQ ID NO: 3315013 - protein, 40 aa, Plasmodium falciparum
HTDQHNNNNHHTDQHNNNNHHTDQHNNNNHHTDQHNNTIS

SEQ ID NO: 3315014 - protein, 16 aa, Plasmodium falciparum
HTDTEKASMNEKKNGN

SEQ ID NO: 3315015 - protein, 5 aa, Plasmodium falciparum
HTEEE

SEQ ID NO: 3315016 - protein, 10 aa, Plasmodium falciparum
HTEENSNDGL

SEQ ID NO: 3315017 - protein, 6 aa, Plasmodium falciparum
HTEKKN

SEQ ID NO: 3315018 - protein, 30 aa, Plasmodium falciparum
HTENTGATNINKTNDQCVDGNDKDNENDDI

SEQ ID NO: 3315019 - protein, 25 aa, Plasmodium falciparum
HTGHNEDGDHVDNASIKKKKKINKK

SEQ ID NO: 3315020 - protein, 5 aa, Plasmodium falciparum
HTGNI

SEQ ID NO: 3315021 - protein, 7 aa, Plasmodium falciparum
HTGTGKT

SEQ ID NO: 3315022 - protein, 13 aa, Plasmodium falciparum
HTHEEEPKDANGD

SEQ ID NO: 3315023 - protein, 108 aa, Plasmodium falciparum
HTHNNDNNHHVERDKNREREKEPEKYERKEKQAEMEREREREKERERNKNKEREKQIERDKEKQMERDKEKQMERDREKQMERDREKQMEKDREKEWDRDRERNRERH

SEQ ID NO: 3315024 - protein, 18 aa, Plasmodium falciparum
HTHNNNNNNNINNNNNNN

SEQ ID NO: 3315025 - protein, 14 aa, Plasmodium falciparum
HTHNSNDHTHNSKN

SEQ ID NO: 3315026 - protein, 10 aa, Plasmodium falciparum
HTKDDNINKN

SEQ ID NO: 3315027 - protein, 5 aa, Plasmodium falciparum
HTKDF

SEQ ID NO: 3315028 - protein, 18 aa, Plasmodium falciparum
HTKESKKMIEKKKEDNLK

SEQ ID NO: 3315029 - protein, 9 aa, Plasmodium falciparum
HTKNDNIYN

SEQ ID NO: 3315030 - protein, 6 aa, Plasmodium falciparum
HTKSNH

SEQ ID NO: 3315031 - protein, 9 aa, Plasmodium falciparum
HTKSSLHKN

SEQ ID NO: 3315032 - protein, 5 aa, Plasmodium falciparum
HTLRE

SEQ ID NO: 3315033 - protein, 4 aa, Plasmodium falciparum
HTND

SEQ ID NO: 3315034 - protein, 6 aa, Plasmodium falciparum
HTNEGS

SEQ ID NO: 3315035 - protein, 11 aa, Plasmodium falciparum
HTNEKENPYGK

SEQ ID NO: 3315036 - protein, 4 aa, Plasmodium falciparum
HTNG

SEQ ID NO: 3315037 - protein, 8 aa, Plasmodium falciparum
HTNKKGYK

SEQ ID NO: 3315038 - protein, 9 aa, Plasmodium falciparum
HTNKKNEHN

SEQ ID NO: 3315039 - protein, 9 aa, Plasmodium falciparum
HTNKSDEMN

SEQ ID NO: 3315040 - protein, 8 aa, Plasmodium falciparum
HTNKSNQI

SEQ ID NO: 3315041 - protein, 9 aa, Plasmodium falciparum
HTNKTQSNF

SEQ ID NO: 3315042 - protein, 4 aa, Plasmodium falciparum
HTNN

SEQ ID NO: 3315043 - protein, 13 aa, Plasmodium falciparum
HTNNANDSHYPKK

SEQ ID NO: 3315044 - protein, 9 aa, Plasmodium falciparum
HTNNNNHYY

SEQ ID NO: 3315045 - protein, 27 aa, Plasmodium falciparum
HTNNNTNNLGRGAKKKSSDDNNSSQES

SEQ ID NO: 3315046 - protein, 5 aa, Plasmodium falciparum
HTNNS

SEQ ID NO: 3315047 - protein, 13 aa, Plasmodium falciparum
HTNTNKSKNFYDD

SEQ ID NO: 3315048 - protein, 4 aa, Plasmodium falciparum
HTNY

SEQ ID NO: 3315049 - protein, 7 aa, Plasmodium falciparum
HTNYKNE

SEQ ID NO: 3315050 - protein, 15 aa, Plasmodium falciparum
HTNYRKEEGRNYSHK

SEQ ID NO: 3315051 - protein, 4 aa, Plasmodium falciparum
HTPE

SEQ ID NO: 3315052 - protein, 4 aa, Plasmodium falciparum
HTPN

SEQ ID NO: 3315053 - protein, 7 aa, Plasmodium falciparum
HTQNYNE

SEQ ID NO: 3315054 - protein, 11 aa, Plasmodium falciparum
HTREKNNKQIK

SEQ ID NO: 3315055 - protein, 7 aa, Plasmodium falciparum
HTSAGKT

SEQ ID NO: 3315056 - protein, 9 aa, Plasmodium falciparum
HTSDISNNT

SEQ ID NO: 3315057 - protein, 4 aa, Plasmodium falciparum
HTSN

SEQ ID NO: 3315058 - protein, 7 aa, Plasmodium falciparum
HTSNKEP

SEQ ID NO: 3315059 - protein, 9 aa, Plasmodium falciparum
HTSNNNNMN

SEQ ID NO: 3315060 - protein, 9 aa, Plasmodium falciparum
HTSNTEDEN

SEQ ID NO: 3315061 - protein, 4 aa, Plasmodium falciparum
HTSP

SEQ ID NO: 3315062 - protein, 5 aa, Plasmodium falciparum
HTSTM

SEQ ID NO: 3315063 - protein, 6 aa, Plasmodium falciparum
HTTANS

SEQ ID NO: 3315064 - protein, 7 aa, Plasmodium falciparum
HTTDYEQ

SEQ ID NO: 3315065 - protein, 7 aa, Plasmodium falciparum
HTTGGNS

SEQ ID NO: 3315066 - protein, 5 aa, Plasmodium falciparum
HTTKK

SEQ ID NO: 3315067 - protein, 7 aa, Plasmodium falciparum
HTTNNDN

SEQ ID NO: 3315068 - protein, 7 aa, Plasmodium falciparum
HTTNYNT

SEQ ID NO: 3315069 - protein, 6 aa, Plasmodium falciparum
HTTRKG

SEQ ID NO: 3315070 - protein, 6 aa, Plasmodium falciparum
HTTYNK

SEQ ID NO: 3315071 - protein, 4 aa, Plasmodium falciparum
HTYG

SEQ ID NO: 3315072 - protein, 12 aa, Plasmodium falciparum
HTYNTRNTTNIS

SEQ ID NO: 3315073 - protein, 5 aa, Plasmodium falciparum
HTYQE

SEQ ID NO: 3315074 - protein, 13 aa, Plasmodium falciparum
HVDKNNMQSGSTT

SEQ ID NO: 3315075 - protein, 20 aa, Plasmodium falciparum
HVEEPASDVQQTSEAAPTIE

SEQ ID NO: 3315076 - protein, 17 aa, Plasmodium falciparum
HVENDTYNINNKNNSIQ

SEQ ID NO: 3315077 - protein, 4 aa, Plasmodium falciparum
HVGK

SEQ ID NO: 3315078 - protein, 10 aa, Plasmodium falciparum
HVKEDQPNIK

SEQ ID NO: 3315079 - protein, 7 aa, Plasmodium falciparum
HVNDPLN

SEQ ID NO: 3315080 - protein, 5 aa, Plasmodium falciparum
HVNNE

SEQ ID NO: 3315081 - protein, 8 aa, Plasmodium falciparum
HVNNNDKC

SEQ ID NO: 3315082 - protein, 13 aa, Plasmodium falciparum
HVNNNENEKNTNY

SEQ ID NO: 3315083 - protein, 21 aa, Plasmodium falciparum
HVNSDEEKKKKNIKMQNEKND

SEQ ID NO: 3315084 - protein, 13 aa, Plasmodium falciparum
HVNTENETIQNSY

SEQ ID NO: 3315085 - protein, 12 aa, Plasmodium falciparum
HVNTNKEKYTDY

SEQ ID NO: 3315086 - protein, 7 aa, Plasmodium falciparum
HVPEGTQ

SEQ ID NO: 3315087 - protein, 16 aa, Plasmodium falciparum
HVQKEDEKGTNTNKEQ

SEQ ID NO: 3315088 - protein, 10 aa, Plasmodium falciparum
HVRSSKKKKV

SEQ ID NO: 3315089 - protein, 9 aa, Plasmodium falciparum
HVSSRDVEN

SEQ ID NO: 3315090 - protein, 4 aa, Plasmodium falciparum
HVVE

SEQ ID NO: 3315091 - protein, 4 aa, Plasmodium falciparum
HYED

SEQ ID NO: 3315092 - protein, 10 aa, Plasmodium falciparum
HYEENEKTIK

SEQ ID NO: 3315093 - protein, 13 aa, Plasmodium falciparum
HYHNKKKKKNYNY

SEQ ID NO: 3315094 - protein, 9 aa, Plasmodium falciparum
HYKKEDVER

SEQ ID NO: 3315095 - protein, 11 aa, Plasmodium falciparum
HYKKPVNSNVA

SEQ ID NO: 3315096 - protein, 28 aa, Plasmodium falciparum
HYNAASSNEYNHNNKNTNNYNNNSYNNN

SEQ ID NO: 3315097 - protein, 10 aa, Plasmodium falciparum
HYNAEGNTSH

SEQ ID NO: 3315098 - protein, 27 aa, Plasmodium falciparum
HYNKDNNKNVGKNRCNNGKKSYTTTND

SEQ ID NO: 3315099 - protein, 5 aa, Plasmodium falciparum
HYNNN

SEQ ID NO: 3315100 - protein, 25 aa, Plasmodium falciparum
HYNSPNNNNNNNNNNNNKKHSRYNS

SEQ ID NO: 3315101 - protein, 4 aa, Plasmodium falciparum
HYSK

SEQ ID NO: 3315102 - protein, 4 aa, Plasmodium falciparum
HYSP

SEQ ID NO: 3315103 - protein, 4 aa, Plasmodium falciparum
HYTP

SEQ ID NO: 3315104 - protein, 5 aa, Plasmodium falciparum
HYYDD

SEQ ID NO: 3315105 - protein, 4 aa, Plasmodium falciparum
HYYN

SEQ ID NO: 3315106 - protein, 4 aa, Plasmodium falciparum
HYYS

SEQ ID NO: 3315107 - protein, 7 aa, Plasmodium falciparum
IAAPSAN

SEQ ID NO: 3315108 - protein, 12 aa, Plasmodium falciparum
IADDESNENMQS

SEQ ID NO: 3315109 - protein, 4 aa, Plasmodium falciparum
IADQ

SEQ ID NO: 3315110 - protein, 13 aa, Plasmodium falciparum
IAEGEKEEGDNIN

SEQ ID NO: 3315111 - protein, 5 aa, Plasmodium falciparum
IAEKI

SEQ ID NO: 3315112 - protein, 12 aa, Plasmodium falciparum
IAENLSKSKNVT

SEQ ID NO: 3315113 - protein, 7 aa, Plasmodium falciparum
IAEPDEA

SEQ ID NO: 3315114 - protein, 5 aa, Plasmodium falciparum
IAESD

SEQ ID NO: 3315115 - protein, 4 aa, Plasmodium falciparum
IAEY

SEQ ID NO: 3315116 - protein, 13 aa, Plasmodium falciparum
IAGKKKNYSNNKT

SEQ ID NO: 3315117 - protein, 6 aa, Plasmodium falciparum
IAKSGS

SEQ ID NO: 3315118 - protein, 70 aa, Plasmodium falciparum
IAKSKPSSDNNNSENDNNNDNNNDNNNDNNDDNNDDNNDDNNDDNNDDNNDDNNDDNNNEHKNDSDDNDD

SEQ ID NO: 3315119 - protein, 9 aa, Plasmodium falciparum
IAKTVTKQR

SEQ ID NO: 3315120 - protein, 6 aa, Plasmodium falciparum
IANKGE

SEQ ID NO: 3315121 - protein, 8 aa, Plasmodium falciparum
IANSTSGN

SEQ ID NO: 3315122 - protein, 5 aa, Plasmodium falciparum
IAPKE

SEQ ID NO: 3315123 - protein, 12 aa, Plasmodium falciparum
IAPKIKKKKMRC

SEQ ID NO: 3315124 - protein, 13 aa, Plasmodium falciparum
IAPKREKTNGEVE

SEQ ID NO: 3315125 - protein, 7 aa, Plasmodium falciparum
IAQSGTA

SEQ ID NO: 3315126 - protein, 7 aa, Plasmodium falciparum
IARSGTK

SEQ ID NO: 3315127 - protein, 5 aa, Plasmodium falciparum
IASDS

SEQ ID NO: 3315128 - protein, 9 aa, Plasmodium falciparum
IASKKNNSL

SEQ ID NO: 3315129 - protein, 24 aa, Plasmodium falciparum
IASPNYSPYSITSPKFSPTSPAYS

SEQ ID NO: 3315130 - protein, 7 aa, Plasmodium falciparum
IASQDNT

SEQ ID NO: 3315131 - protein, 6 aa, Plasmodium falciparum
IASSNF

SEQ ID NO: 3315132 - protein, 8 aa, Plasmodium falciparum
IASSSYAT

SEQ ID NO: 3315133 - protein, 6 aa, Plasmodium falciparum
IASTSE

SEQ ID NO: 3315134 - protein, 6 aa, Plasmodium falciparum
IATGRG

SEQ ID NO: 3315135 - protein, 13 aa, Plasmodium falciparum
ICDNNTKNNSLNQ

SEQ ID NO: 3315136 - protein, 10 aa, Plasmodium falciparum
ICERSEKKEK

SEQ ID NO: 3315137 - protein, 5 aa, Plasmodium falciparum
ICGGA

SEQ ID NO: 3315138 - protein, 12 aa, Plasmodium falciparum
ICNEKKDHNKNL

SEQ ID NO: 3315139 - protein, 4 aa, Plasmodium falciparum
ICSE

SEQ ID NO: 3315140 - protein, 7 aa, Plasmodium falciparum
IDADASE

SEQ ID NO: 3315141 - protein, 10 aa, Plasmodium falciparum
IDDDDDDNIN

SEQ ID NO: 3315142 - protein, 20 aa, Plasmodium falciparum
IDDDDDNNNNNNAKSDMNKE

SEQ ID NO: 3315143 - protein, 10 aa, Plasmodium falciparum
IDDDENNFED

SEQ ID NO: 3315144 - protein, 10 aa, Plasmodium falciparum
IDDEESLKDT

SEQ ID NO: 3315145 - protein, 12 aa, Plasmodium falciparum
IDDEGEKNKINN

SEQ ID NO: 3315146 - protein, 10 aa, Plasmodium falciparum
IDDEKGGIYD

SEQ ID NO: 3315147 - protein, 5 aa, Plasmodium falciparum
IDDEN

SEQ ID NO: 3315148 - protein, 20 aa, Plasmodium falciparum
IDDENIDDENIDDENIDDEN

SEQ ID NO: 3315149 - protein, 9 aa, Plasmodium falciparum
IDDENKTNE

SEQ ID NO: 3315150 - protein, 33 aa, Plasmodium falciparum
IDDESDKNQYELKDDSGGGRAPGTRAKEHSTTH

SEQ ID NO: 3315151 - protein, 8 aa, Plasmodium falciparum
IDDGDNNN

SEQ ID NO: 3315152 - protein, 4 aa, Plasmodium falciparum
IDDI

SEQ ID NO: 3315153 - protein, 11 aa, Plasmodium falciparum
IDDKDNNNNNI

SEQ ID NO: 3315154 - protein, 57 aa, Plasmodium falciparum
IDDKENKTNISQENITNNNSTTNNKTQNNNYTNASSEQHTSNNHQNEVEDENVKKNN

SEQ ID NO: 3315155 - protein, 35 aa, Plasmodium falciparum
IDDKNKKQQMDTYSPKENEEDNSNNMKKSSSLKNI

SEQ ID NO: 3315156 - protein, 8 aa, Plasmodium falciparum
IDDKNRRT

SEQ ID NO: 3315157 - protein, 12 aa, Plasmodium falciparum
IDDNDNYSVPKE

SEQ ID NO: 3315158 - protein, 9 aa, Plasmodium falciparum
IDDNNDQNK

SEQ ID NO: 3315159 - protein, 8 aa, Plasmodium falciparum
IDDNNMDK

SEQ ID NO: 3315160 - protein, 5 aa, Plasmodium falciparum
IDDNQ

SEQ ID NO: 3315161 - protein, 23 aa, Plasmodium falciparum
IDDNRNTNESNIKEVKSNTNQKD

SEQ ID NO: 3315162 - protein, 12 aa, Plasmodium falciparum
IDDPDNLNNNIN

SEQ ID NO: 3315163 - protein, 112 aa, Plasmodium falciparum
IDDPNNSDNDIKRRKEMKKRRKKNDTNKRDTNKRDTNKRDTNKRDTNKRDTNKRDTNKSDTNNSDTNKSDTNNSDTSSINSNMSNNYKKNTSDISEMSDNSSTNTRRKKYRE

SEQ ID NO: 3315164 - protein, 9 aa, Plasmodium falciparum
IDDPSEASD

SEQ ID NO: 3315165 - protein, 4 aa, Plasmodium falciparum
IDDS

SEQ ID NO: 3315166 - protein, 12 aa, Plasmodium falciparum
IDDSEEAKKDFE

SEQ ID NO: 3315167 - protein, 36 aa, Plasmodium falciparum
IDDTETSDKKELDDLEKKKKALEEMKRKKKEKDHKK

SEQ ID NO: 3315168 - protein, 7 aa, Plasmodium falciparum
IDDTSSN

SEQ ID NO: 3315169 - protein, 11 aa, Plasmodium falciparum
IDEDKEEHTIQ

SEQ ID NO: 3315170 - protein, 4 aa, Plasmodium falciparum
IDEE

SEQ ID NO: 3315171 - protein, 11 aa, Plasmodium falciparum
IDEEENMKNSD

SEQ ID NO: 3315172 - protein, 6 aa, Plasmodium falciparum
IDEEKK

SEQ ID NO: 3315173 - protein, 26 aa, Plasmodium falciparum
IDEEKNNNNDENHNENNLGANTNGTC

SEQ ID NO: 3315174 - protein, 6 aa, Plasmodium falciparum
IDEETL

SEQ ID NO: 3315175 - protein, 36 aa, Plasmodium falciparum
IDEGSIKNTSRKKENSLSRSDVSYHSKEEGNKYEKY

SEQ ID NO: 3315176 - protein, 4 aa, Plasmodium falciparum
IDEK

SEQ ID NO: 3315177 - protein, 15 aa, Plasmodium falciparum
IDEKDNIDNKDNIYN

SEQ ID NO: 3315178 - protein, 18 aa, Plasmodium falciparum
IDEKENDLTVQENKTERM

SEQ ID NO: 3315179 - protein, 6 aa, Plasmodium falciparum
IDEKGV

SEQ ID NO: 3315180 - protein, 16 aa, Plasmodium falciparum
IDEKKKKNEDIENNKA

SEQ ID NO: 3315181 - protein, 25 aa, Plasmodium falciparum
IDEKKRKRKKKDKMKYDKREETEEI

SEQ ID NO: 3315182 - protein, 15 aa, Plasmodium falciparum
IDEKQQKIDEQEKQF

SEQ ID NO: 3315183 - protein, 12 aa, Plasmodium falciparum
IDENRKVKDIKS

SEQ ID NO: 3315184 - protein, 11 aa, Plasmodium falciparum
IDENRSPNNYV

SEQ ID NO: 3315185 - protein, 4 aa, Plasmodium falciparum
IDEQ

SEQ ID NO: 3315186 - protein, 16 aa, Plasmodium falciparum
IDEQNKNIAKNNGDLK

SEQ ID NO: 3315187 - protein, 6 aa, Plasmodium falciparum
IDEQNN

SEQ ID NO: 3315188 - protein, 9 aa, Plasmodium falciparum
IDEQQKKRE

SEQ ID NO: 3315189 - protein, 7 aa, Plasmodium falciparum
IDERKPN

SEQ ID NO: 3315190 - protein, 9 aa, Plasmodium falciparum
IDESDDEYN

SEQ ID NO: 3315191 - protein, 6 aa, Plasmodium falciparum
IDESKK

SEQ ID NO: 3315192 - protein, 33 aa, Plasmodium falciparum
IDESNKEESEAEQNLKKEDYDNVDEDKKDNLQK

SEQ ID NO: 3315193 - protein, 8 aa, Plasmodium falciparum
IDETEGMD

SEQ ID NO: 3315194 - protein, 12 aa, Plasmodium falciparum
IDETNSDDLEKK

SEQ ID NO: 3315195 - protein, 5 aa, Plasmodium falciparum
IDETQ

SEQ ID NO: 3315196 - protein, 7 aa, Plasmodium falciparum
IDEVEND

SEQ ID NO: 3315197 - protein, 7 aa, Plasmodium falciparum
IDGDGQI

SEQ ID NO: 3315198 - protein, 5 aa, Plasmodium falciparum
IDGDQ

SEQ ID NO: 3315199 - protein, 13 aa, Plasmodium falciparum
IDGDSPDMALTPP

SEQ ID NO: 3315200 - protein, 5 aa, Plasmodium falciparum
IDGGG

SEQ ID NO: 3315201 - protein, 29 aa, Plasmodium falciparum
IDGKDNKKYEKKGKQNDVYKEDEKGSYIN

SEQ ID NO: 3315202 - protein, 9 aa, Plasmodium falciparum
IDGKNKIKE

SEQ ID NO: 3315203 - protein, 5 aa, Plasmodium falciparum
IDGNI

SEQ ID NO: 3315204 - protein, 31 aa, Plasmodium falciparum
IDGNISDNNKIDDKTLNNNKIDDKTSDNNKI

SEQ ID NO: 3315205 - protein, 8 aa, Plasmodium falciparum
IDGTEKFE

SEQ ID NO: 3315206 - protein, 13 aa, Plasmodium falciparum
IDHASSNNNIASS

SEQ ID NO: 3315207 - protein, 12 aa, Plasmodium falciparum
IDHNNDNNNNMD

SEQ ID NO: 3315208 - protein, 48 aa, Plasmodium falciparum
IDHNNDYKDHNNNNNNDDDNKNNDDNKNNDDNKNNDDNKNNDDKSDGI

SEQ ID NO: 3315209 - protein, 6 aa, Plasmodium falciparum
IDHTDD

SEQ ID NO: 3315210 - protein, 10 aa, Plasmodium falciparum
IDIEKKKKQV

SEQ ID NO: 3315211 - protein, 7 aa, Plasmodium falciparum
IDIEPRQ

SEQ ID NO: 3315212 - protein, 4 aa, Plasmodium falciparum
IDIN

SEQ ID NO: 3315213 - protein, 5 aa, Plasmodium falciparum
IDINS

SEQ ID NO: 3315214 - protein, 8 aa, Plasmodium falciparum
IDISPEQT

SEQ ID NO: 3315215 - protein, 16 aa, Plasmodium falciparum
IDKDDNLSKKKKRPNY

SEQ ID NO: 3315216 - protein, 10 aa, Plasmodium falciparum
IDKDEDGYIS

SEQ ID NO: 3315217 - protein, 4 aa, Plasmodium falciparum
IDKE

SEQ ID NO: 3315218 - protein, 9 aa, Plasmodium falciparum
IDKETTNLD

SEQ ID NO: 3315219 - protein, 19 aa, Plasmodium falciparum
IDKKNAKEKPAYVKTPRTS

SEQ ID NO: 3315220 - protein, 21 aa, Plasmodium falciparum
IDKNDTPLDNSNGNSGRNLGD

SEQ ID NO: 3315221 - protein, 8 aa, Plasmodium falciparum
IDKNKEKI

SEQ ID NO: 3315222 - protein, 21 aa, Plasmodium falciparum
IDKNNTDIKKNTDPSHKNDNI

SEQ ID NO: 3315223 - protein, 24 aa, Plasmodium falciparum
IDKNSNNNKDINDTKNKKNVERTN

SEQ ID NO: 3315224 - protein, 7 aa, Plasmodium falciparum
IDKNTSE

SEQ ID NO: 3315225 - protein, 12 aa, Plasmodium falciparum
IDKPDAASEDEL

SEQ ID NO: 3315226 - protein, 43 aa, Plasmodium falciparum
IDKSKGKDTNAIKSNGVNNNKNGTYNNNDKKINNKNLKPSDAN

SEQ ID NO: 3315227 - protein, 9 aa, Plasmodium falciparum
IDKSRNKSV

SEQ ID NO: 3315228 - protein, 10 aa, Plasmodium falciparum
IDKSSSDISL

SEQ ID NO: 3315229 - protein, 8 aa, Plasmodium falciparum
IDKSTVQG

SEQ ID NO: 3315230 - protein, 15 aa, Plasmodium falciparum
IDKTNKDNKYEEEKH

SEQ ID NO: 3315231 - protein, 11 aa, Plasmodium falciparum
IDKTPEEQKRG

SEQ ID NO: 3315232 - protein, 8 aa, Plasmodium falciparum
IDKTSASY

SEQ ID NO: 3315233 - protein, 4 aa, Plasmodium falciparum
IDND

SEQ ID NO: 3315234 - protein, 18 aa, Plasmodium falciparum
IDNDNELHNGKEEIENGG

SEQ ID NO: 3315235 - protein, 7 aa, Plasmodium falciparum
IDNEQND

SEQ ID NO: 3315236 - protein, 5 aa, Plasmodium falciparum
IDNGE

SEQ ID NO: 3315237 - protein, 8 aa, Plasmodium falciparum
IDNHQGNE

SEQ ID NO: 3315238 - protein, 5 aa, Plasmodium falciparum
IDNIN

SEQ ID NO: 3315239 - protein, 23 aa, Plasmodium falciparum
IDNKKKKKNVSSIHSNNNKNEMI

SEQ ID NO: 3315240 - protein, 9 aa, Plasmodium falciparum
IDNKNERNV

SEQ ID NO: 3315241 - protein, 14 aa, Plasmodium falciparum
IDNKQKSDDNQNNM

SEQ ID NO: 3315242 - protein, 4 aa, Plasmodium falciparum
IDNL

SEQ ID NO: 3315243 - protein, 14 aa, Plasmodium falciparum
IDNLGSSKNSFANN

SEQ ID NO: 3315244 - protein, 43 aa, Plasmodium falciparum
IDNNDNIDKIDKNDNIDKIDNNDKIDNIDKNDNNDKNDNIDKN

SEQ ID NO: 3315245 - protein, 45 aa, Plasmodium falciparum
IDNNDNNNDNNNDNNNNNDNNNDNNNDNNNDNNNDNNNDNTNESM

SEQ ID NO: 3315246 - protein, 20 aa, Plasmodium falciparum
IDNNIDNNIDNNIDNNIDNN

SEQ ID NO: 3315247 - protein, 13 aa, Plasmodium falciparum
IDNNIDNSSPPFM

SEQ ID NO: 3315248 - protein, 21 aa, Plasmodium falciparum
IDNNKNNGSHNEINSKKGGEA

SEQ ID NO: 3315249 - protein, 10 aa, Plasmodium falciparum
IDNNNDHKNG

SEQ ID NO: 3315250 - protein, 9 aa, Plasmodium falciparum
IDNNNNNNI

SEQ ID NO: 3315251 - protein, 10 aa, Plasmodium falciparum
IDNNNNNNIS

SEQ ID NO: 3315252 - protein, 12 aa, Plasmodium falciparum
IDNNNNNNKSSL

SEQ ID NO: 3315253 - protein, 19 aa, Plasmodium falciparum
IDNNNNNNNNNNDNKDDGV

SEQ ID NO: 3315254 - protein, 13 aa, Plasmodium falciparum
IDNNNNNNNNNNH

SEQ ID NO: 3315255 - protein, 17 aa, Plasmodium falciparum
IDNNSDNNNNNNNNNFP

SEQ ID NO: 3315256 - protein, 5 aa, Plasmodium falciparum
IDNNV

SEQ ID NO: 3315257 - protein, 5 aa, Plasmodium falciparum
IDNNY

SEQ ID NO: 3315258 - protein, 9 aa, Plasmodium falciparum
IDNNYKQKI

SEQ ID NO: 3315259 - protein, 8 aa, Plasmodium falciparum
IDNPMDDS

SEQ ID NO: 3315260 - protein, 4 aa, Plasmodium falciparum
IDNQ

SEQ ID NO: 3315261 - protein, 9 aa, Plasmodium falciparum
IDNRKKSIN

SEQ ID NO: 3315262 - protein, 9 aa, Plasmodium falciparum
IDNSGEDET

SEQ ID NO: 3315263 - protein, 9 aa, Plasmodium falciparum
IDNSNSRNI

SEQ ID NO: 3315264 - protein, 12 aa, Plasmodium falciparum
IDNSSNNNNMSS

SEQ ID NO: 3315265 - protein, 7 aa, Plasmodium falciparum
IDNTDNI

SEQ ID NO: 3315266 - protein, 8 aa, Plasmodium falciparum
IDNTHNPE

SEQ ID NO: 3315267 - protein, 7 aa, Plasmodium falciparum
IDNTNNI

SEQ ID NO: 3315268 - protein, 33 aa, Plasmodium falciparum
IDNTNNSDNTNNSDNTNNIDNTNNLNNNMNSVN

SEQ ID NO: 3315269 - protein, 10 aa, Plasmodium falciparum
IDNTNSEHSF

SEQ ID NO: 3315270 - protein, 10 aa, Plasmodium falciparum
IDNTQNDSKL

SEQ ID NO: 3315271 - protein, 10 aa, Plasmodium falciparum
IDNYKKNDSE

SEQ ID NO: 3315272 - protein, 6 aa, Plasmodium falciparum
IDPNSN

SEQ ID NO: 3315273 - protein, 21 aa, Plasmodium falciparum
IDPPKKDKKDEKQKKKKKNFK

SEQ ID NO: 3315274 - protein, 4 aa, Plasmodium falciparum
IDPQ

SEQ ID NO: 3315275 - protein, 5 aa, Plasmodium falciparum
IDPYD

SEQ ID NO: 3315276 - protein, 28 aa, Plasmodium falciparum
IDQDDSDETEEEDDLSDVDQNKEQNKNQ

SEQ ID NO: 3315277 - protein, 8 aa, Plasmodium falciparum
IDQDNTKE

SEQ ID NO: 3315278 - protein, 4 aa, Plasmodium falciparum
IDQL

SEQ ID NO: 3315279 - protein, 11 aa, Plasmodium falciparum
IDQNNRTYNHN

SEQ ID NO: 3315280 - protein, 4 aa, Plasmodium falciparum
IDQT

SEQ ID NO: 3315281 - protein, 11 aa, Plasmodium falciparum
IDQTNKMDDQL

SEQ ID NO: 3315282 - protein, 5 aa, Plasmodium falciparum
IDQTT

SEQ ID NO: 3315283 - protein, 11 aa, Plasmodium falciparum
IDRKGTKKFQK

SEQ ID NO: 3315284 - protein, 5 aa, Plasmodium falciparum
IDRTK

SEQ ID NO: 3315285 - protein, 15 aa, Plasmodium falciparum
IDSDENDESLAPPVD

SEQ ID NO: 3315286 - protein, 4 aa, Plasmodium falciparum
IDSI

SEQ ID NO: 3315287 - protein, 16 aa, Plasmodium falciparum
IDSKKTGIYRAPRSTG

SEQ ID NO: 3315288 - protein, 5 aa, Plasmodium falciparum
IDSLD

SEQ ID NO: 3315289 - protein, 9 aa, Plasmodium falciparum
IDSNENSDY

SEQ ID NO: 3315290 - protein, 7 aa, Plasmodium falciparum
IDSNYSP

SEQ ID NO: 3315291 - protein, 30 aa, Plasmodium falciparum
IDSTAAESKPIDEKDPMYDSEIEKINKYLK

SEQ ID NO: 3315292 - protein, 8 aa, Plasmodium falciparum
IDSTESTC

SEQ ID NO: 3315293 - protein, 22 aa, Plasmodium falciparum
IDSTKMDSYQKNNKTLNEKEDK

SEQ ID NO: 3315294 - protein, 17 aa, Plasmodium falciparum
IDSTSKRDSEGTKSAVH

SEQ ID NO: 3315295 - protein, 6 aa, Plasmodium falciparum
IDSYDN

SEQ ID NO: 3315296 - protein, 14 aa, Plasmodium falciparum
IDTDQNFTNSYVNF

SEQ ID NO: 3315297 - protein, 12 aa, Plasmodium falciparum
IDTEKKESQDDN

SEQ ID NO: 3315298 - protein, 10 aa, Plasmodium falciparum
IDTHQSTCKN

SEQ ID NO: 3315299 - protein, 77 aa, Plasmodium falciparum
IDTKGDGDKIKDGDKIKDGDKIKDGDDIKDGDDIKDGDDIKDGDKIKYGDNINDDDNTNDDDNIKDGDKIKYGDGKN

SEQ ID NO: 3315300 - protein, 11 aa, Plasmodium falciparum
IDTKNSEEDLK

SEQ ID NO: 3315301 - protein, 4 aa, Plasmodium falciparum
IDTN

SEQ ID NO: 3315302 - protein, 6 aa, Plasmodium falciparum
IDTNKK

SEQ ID NO: 3315303 - protein, 29 aa, Plasmodium falciparum
IDTNNNNNNNNNSNNSHSNSNSNNYGNIP

SEQ ID NO: 3315304 - protein, 21 aa, Plasmodium falciparum
IDTPKKQKNDYINKKETEKNM

SEQ ID NO: 3315305 - protein, 16 aa, Plasmodium falciparum
IDTQNGTTKRTGNNSV

SEQ ID NO: 3315306 - protein, 9 aa, Plasmodium falciparum
IDTQTNDKN

SEQ ID NO: 3315307 - protein, 11 aa, Plasmodium falciparum
IDTSASADENY

SEQ ID NO: 3315308 - protein, 9 aa, Plasmodium falciparum
IDTSNSDKI

SEQ ID NO: 3315309 - protein, 7 aa, Plasmodium falciparum
IDYNNKK

SEQ ID NO: 3315310 - protein, 11 aa, Plasmodium falciparum
IDYPRRSSYRE

SEQ ID NO: 3315311 - protein, 16 aa, Plasmodium falciparum
IEAEGGVSTALDDDNY

SEQ ID NO: 3315312 - protein, 50 aa, Plasmodium falciparum
IEANKDGDNKEHNNKDKDGENDEHNNKDKDGDNDEHNNKDKYGDNNEHNY

SEQ ID NO: 3315313 - protein, 10 aa, Plasmodium falciparum
IEDDKKNKVH

SEQ ID NO: 3315314 - protein, 4 aa, Plasmodium falciparum
IEDE

SEQ ID NO: 3315315 - protein, 8 aa, Plasmodium falciparum
IEDEKEEK

SEQ ID NO: 3315316 - protein, 6 aa, Plasmodium falciparum
IEDEKR

SEQ ID NO: 3315317 - protein, 5 aa, Plasmodium falciparum
IEDEN

SEQ ID NO: 3315318 - protein, 12 aa, Plasmodium falciparum
IEDENNKNEELK

SEQ ID NO: 3315319 - protein, 5 aa, Plasmodium falciparum
IEDGN

SEQ ID NO: 3315320 - protein, 10 aa, Plasmodium falciparum
IEDKKELTRS

SEQ ID NO: 3315321 - protein, 4 aa, Plasmodium falciparum
IEDM

SEQ ID NO: 3315322 - protein, 5 aa, Plasmodium falciparum
IEDNI

SEQ ID NO: 3315323 - protein, 5 aa, Plasmodium falciparum
IEDNK

SEQ ID NO: 3315324 - protein, 12 aa, Plasmodium falciparum
IEDNKDKVNKES

SEQ ID NO: 3315325 - protein, 13 aa, Plasmodium falciparum
IEDNNENKVTNNY

SEQ ID NO: 3315326 - protein, 7 aa, Plasmodium falciparum
IEDNNGK

SEQ ID NO: 3315327 - protein, 5 aa, Plasmodium falciparum
IEDPK

SEQ ID NO: 3315328 - protein, 91 aa, Plasmodium falciparum
IEDPQEDNKDEDEDEETETENLETEDDNNEEIEENEEDDIDEESVEEKEEEEEKKEEEEKKEEKKEEKKPDNEITNEVKEEQKYSSPSDIN

SEQ ID NO: 3315329 - protein, 21 aa, Plasmodium falciparum
IEDQGKLNNDYVEGEEENNMD

SEQ ID NO: 3315330 - protein, 8 aa, Plasmodium falciparum
IEDQNEAE

SEQ ID NO: 3315331 - protein, 5 aa, Plasmodium falciparum
IEDSE

SEQ ID NO: 3315332 - protein, 27 aa, Plasmodium falciparum
IEDSKSRLSGGKKSEGSSSKSKDVISS

SEQ ID NO: 3315333 - protein, 7 aa, Plasmodium falciparum
IEDSQTN

SEQ ID NO: 3315334 - protein, 10 aa, Plasmodium falciparum
IEDSSSCRNN

SEQ ID NO: 3315335 - protein, 7 aa, Plasmodium falciparum
IEDTYKD

SEQ ID NO: 3315336 - protein, 31 aa, Plasmodium falciparum
IEEAKKQKKMDKDNLKKEEKIKKKEKTIQEK

SEQ ID NO: 3315337 - protein, 10 aa, Plasmodium falciparum
IEEDKEKMNN

SEQ ID NO: 3315338 - protein, 10 aa, Plasmodium falciparum
IEEDKKSENV

SEQ ID NO: 3315339 - protein, 39 aa, Plasmodium falciparum
IEEDNELNENSENNENNENDEDNKNNKNNENNENTSSEE

SEQ ID NO: 3315340 - protein, 43 aa, Plasmodium falciparum
IEEDNNEDDDKQMDRESSYPHNNNNNNNDNNENYNKLSGGYEN

SEQ ID NO: 3315341 - protein, 6 aa, Plasmodium falciparum
IEEDQS

SEQ ID NO: 3315342 - protein, 7 aa, Plasmodium falciparum
IEEEDDV

SEQ ID NO: 3315343 - protein, 17 aa, Plasmodium falciparum
IEEEDKITQKKNTKIYT

SEQ ID NO: 3315344 - protein, 11 aa, Plasmodium falciparum
IEEEEEEKEEC

SEQ ID NO: 3315345 - protein, 9 aa, Plasmodium falciparum
IEEEEEKKH

SEQ ID NO: 3315346 - protein, 13 aa, Plasmodium falciparum
IEEEEKKKKIEEL

SEQ ID NO: 3315347 - protein, 15 aa, Plasmodium falciparum
IEEEENDKTSKNEKT

SEQ ID NO: 3315348 - protein, 11 aa, Plasmodium falciparum
IEEEKKKNPIN

SEQ ID NO: 3315349 - protein, 7 aa, Plasmodium falciparum
IEEEKRK

SEQ ID NO: 3315350 - protein, 5 aa, Plasmodium falciparum
IEEEN

SEQ ID NO: 3315351 - protein, 6 aa, Plasmodium falciparum
IEEENE

SEQ ID NO: 3315352 - protein, 6 aa, Plasmodium falciparum
IEEENK

SEQ ID NO: 3315353 - protein, 12 aa, Plasmodium falciparum
IEEESKKRNMDK

SEQ ID NO: 3315354 - protein, 18 aa, Plasmodium falciparum
IEEEYDDDDEQNNINNYD

SEQ ID NO: 3315355 - protein, 172 aa, Plasmodium falciparum
IEEGERVTDRNNTNDTNSNYSKKNEDIEDHKNDNNNDDNEDDNNDDGNYDDGNYDDGNYDDGNNNDGNNDDGNNNDGNNDDDNNDDGNNDDDNNDDDNNDDDNNDDDNNDDDNNDDGNNDDDNNDDDDNNNNDNNNNDNNNNDNNNNNNNNNNNNNNNNNDDDNNKKNEYKT

SEQ ID NO: 3315356 - protein, 53 aa, Plasmodium falciparum
IEEGGASEKNNIEDDDDIESGDNIKSNDNTKSKLDNSHNNDNNMEENKNNSIL

SEQ ID NO: 3315357 - protein, 11 aa, Plasmodium falciparum
IEEKDEKQNNI

SEQ ID NO: 3315358 - protein, 10 aa, Plasmodium falciparum
IEEKDKIEEK

SEQ ID NO: 3315359 - protein, 7 aa, Plasmodium falciparum
IEEKEEY

SEQ ID NO: 3315360 - protein, 9 aa, Plasmodium falciparum
IEEKENEIK

SEQ ID NO: 3315361 - protein, 37 aa, Plasmodium falciparum
IEEKKEEKKKKNKLQQSMNERANNNNDINDDKNNEMY

SEQ ID NO: 3315362 - protein, 6 aa, Plasmodium falciparum
IEEKKT

SEQ ID NO: 3315363 - protein, 12 aa, Plasmodium falciparum
IEEKKTGENKIK

SEQ ID NO: 3315364 - protein, 4 aa, Plasmodium falciparum
IEEL

SEQ ID NO: 3315365 - protein, 16 aa, Plasmodium falciparum
IEENETNKKKIQQQNE

SEQ ID NO: 3315366 - protein, 5 aa, Plasmodium falciparum
IEENN

SEQ ID NO: 3315367 - protein, 17 aa, Plasmodium falciparum
IEENTNNSKNQNTRNTN

SEQ ID NO: 3315368 - protein, 4 aa, Plasmodium falciparum
IEEP

SEQ ID NO: 3315369 - protein, 4 aa, Plasmodium falciparum
IEEQ

SEQ ID NO: 3315370 - protein, 6 aa, Plasmodium falciparum
IEEQNV

SEQ ID NO: 3315371 - protein, 5 aa, Plasmodium falciparum
IEEQP

SEQ ID NO: 3315372 - protein, 16 aa, Plasmodium falciparum
IEEQTNEEQKNNKVDD

SEQ ID NO: 3315373 - protein, 5 aa, Plasmodium falciparum
IEERC

SEQ ID NO: 3315374 - protein, 6 aa, Plasmodium falciparum
IEETEK

SEQ ID NO: 3315375 - protein, 7 aa, Plasmodium falciparum
IEFEDDE

SEQ ID NO: 3315376 - protein, 9 aa, Plasmodium falciparum
IEGDRKKIQ

SEQ ID NO: 3315377 - protein, 7 aa, Plasmodium falciparum
IEGEHKD

SEQ ID NO: 3315378 - protein, 11 aa, Plasmodium falciparum
IEGGEGDATPF

SEQ ID NO: 3315379 - protein, 10 aa, Plasmodium falciparum
IEGKAEKKIQ

SEQ ID NO: 3315380 - protein, 12 aa, Plasmodium falciparum
IEGNDNEETYDT

SEQ ID NO: 3315381 - protein, 8 aa, Plasmodium falciparum
IEGNHDRL

SEQ ID NO: 3315382 - protein, 6 aa, Plasmodium falciparum
IEGNNE

SEQ ID NO: 3315383 - protein, 14 aa, Plasmodium falciparum
IEGNVEGNVEGNVE

SEQ ID NO: 3315384 - protein, 6 aa, Plasmodium falciparum
IEGSNK

SEQ ID NO: 3315385 - protein, 6 aa, Plasmodium falciparum
IEGTNK

SEQ ID NO: 3315386 - protein, 17 aa, Plasmodium falciparum
IEGTTDIQSNKNYLTTN

SEQ ID NO: 3315387 - protein, 5 aa, Plasmodium falciparum
IEHDE

SEQ ID NO: 3315388 - protein, 9 aa, Plasmodium falciparum
IEHEGTDDN

SEQ ID NO: 3315389 - protein, 17 aa, Plasmodium falciparum
IEHSEEKDSDNNDKPFI

SEQ ID NO: 3315390 - protein, 9 aa, Plasmodium falciparum
IEKDDGDNK

SEQ ID NO: 3315391 - protein, 7 aa, Plasmodium falciparum
IEKDGNN

SEQ ID NO: 3315392 - protein, 10 aa, Plasmodium falciparum
IEKDSRDKRL

SEQ ID NO: 3315393 - protein, 4 aa, Plasmodium falciparum
IEKE

SEQ ID NO: 3315394 - protein, 7 aa, Plasmodium falciparum
IEKEDTS

SEQ ID NO: 3315395 - protein, 10 aa, Plasmodium falciparum
IEKEEDKKDY

SEQ ID NO: 3315396 - protein, 11 aa, Plasmodium falciparum
IEKEEKTLEVE

SEQ ID NO: 3315397 - protein, 129 aa, Plasmodium falciparum
IEKEETKKEIKQVGNKQVSETEKEPKDKLENNPDGNKLQNDKDSGKLQNDKDSGKLQNEKDSGKLQNDKDSGKLQNDKDSGKLQNDKDSGKLQNDKVSGKLQNDKDSGKLQNDKVSGKLQNDRDGNKLQ

SEQ ID NO: 3315398 - protein, 15 aa, Plasmodium falciparum
IEKENEIKKSSNINI

SEQ ID NO: 3315399 - protein, 13 aa, Plasmodium falciparum
IEKENEKKNNNEN

SEQ ID NO: 3315400 - protein, 10 aa, Plasmodium falciparum
IEKENKGELL

SEQ ID NO: 3315401 - protein, 6 aa, Plasmodium falciparum
IEKESE

SEQ ID NO: 3315402 - protein, 10 aa, Plasmodium falciparum
IEKFKGKESI

SEQ ID NO: 3315403 - protein, 10 aa, Plasmodium falciparum
IEKGNKNQVN

SEQ ID NO: 3315404 - protein, 4 aa, Plasmodium falciparum
IEKK

SEQ ID NO: 3315405 - protein, 11 aa, Plasmodium falciparum
IEKKKDNKNVP

SEQ ID NO: 3315406 - protein, 5 aa, Plasmodium falciparum
IEKKN

SEQ ID NO: 3315407 - protein, 45 aa, Plasmodium falciparum
IEKKNKNQGNCSSSSCVDSNNHVSSSTPSLTSSSNSSDSSKLSRP

SEQ ID NO: 3315408 - protein, 10 aa, Plasmodium falciparum
IEKKNNNNII

SEQ ID NO: 3315409 - protein, 8 aa, Plasmodium falciparum
IEKKNPPI

SEQ ID NO: 3315410 - protein, 16 aa, Plasmodium falciparum
IEKKNSDNEIKADIND

SEQ ID NO: 3315411 - protein, 17 aa, Plasmodium falciparum
IEKMNKRKKKVDNPQKY

SEQ ID NO: 3315412 - protein, 7 aa, Plasmodium falciparum
IEKNEDS

SEQ ID NO: 3315413 - protein, 8 aa, Plasmodium falciparum
IEKNETFE

SEQ ID NO: 3315414 - protein, 8 aa, Plasmodium falciparum
IEKNKSDI

SEQ ID NO: 3315415 - protein, 11 aa, Plasmodium falciparum
IEKNKSNEYYK

SEQ ID NO: 3315416 - protein, 9 aa, Plasmodium falciparum
IEKNNNNSY

SEQ ID NO: 3315417 - protein, 11 aa, Plasmodium falciparum
IEKNSNLSKKF

SEQ ID NO: 3315418 - protein, 9 aa, Plasmodium falciparum
IEKNTNTMK

SEQ ID NO: 3315419 - protein, 6 aa, Plasmodium falciparum
IEKNTQ

SEQ ID NO: 3315420 - protein, 5 aa, Plasmodium falciparum
IEKNV

SEQ ID NO: 3315421 - protein, 5 aa, Plasmodium falciparum
IEKPN

SEQ ID NO: 3315422 - protein, 7 aa, Plasmodium falciparum
IEKPNNH

SEQ ID NO: 3315423 - protein, 4 aa, Plasmodium falciparum
IEKQ

SEQ ID NO: 3315424 - protein, 9 aa, Plasmodium falciparum
IEKQKKEKE

SEQ ID NO: 3315425 - protein, 7 aa, Plasmodium falciparum
IEKQQPK

SEQ ID NO: 3315426 - protein, 7 aa, Plasmodium falciparum
IEKQQQH

SEQ ID NO: 3315427 - protein, 18 aa, Plasmodium falciparum
IEKQSRKRKKNKLSDKKN

SEQ ID NO: 3315428 - protein, 12 aa, Plasmodium falciparum
IEKQTEQNEKGF

SEQ ID NO: 3315429 - protein, 9 aa, Plasmodium falciparum
IEKRPNDQH

SEQ ID NO: 3315430 - protein, 5 aa, Plasmodium falciparum
IEKRQ

SEQ ID NO: 3315431 - protein, 9 aa, Plasmodium falciparum
IEKRQGELG

SEQ ID NO: 3315432 - protein, 8 aa, Plasmodium falciparum
IEKSNESL

SEQ ID NO: 3315433 - protein, 6 aa, Plasmodium falciparum
IEKTEE

SEQ ID NO: 3315434 - protein, 12 aa, Plasmodium falciparum
IEKTHERGKSIE

SEQ ID NO: 3315435 - protein, 8 aa, Plasmodium falciparum
IEKTNKLK

SEQ ID NO: 3315436 - protein, 10 aa, Plasmodium falciparum
IEKTNKNINN

SEQ ID NO: 3315437 - protein, 27 aa, Plasmodium falciparum
IEKTNNIANNTLNKKKKKKRKRKKRKR

SEQ ID NO: 3315438 - protein, 15 aa, Plasmodium falciparum
IEKTNNSDRKKDEEI

SEQ ID NO: 3315439 - protein, 4 aa, Plasmodium falciparum
IEKY

SEQ ID NO: 3315440 - protein, 12 aa, Plasmodium falciparum
IEKYQKELDNKN

SEQ ID NO: 3315441 - protein, 6 aa, Plasmodium falciparum
IEMENE

SEQ ID NO: 3315442 - protein, 4 aa, Plasmodium falciparum
IEMS

SEQ ID NO: 3315443 - protein, 16 aa, Plasmodium falciparum
IEMSTNKKNTMEQNKN

SEQ ID NO: 3315444 - protein, 8 aa, Plasmodium falciparum
IENATAQD

SEQ ID NO: 3315445 - protein, 4 aa, Plasmodium falciparum
IEND

SEQ ID NO: 3315446 - protein, 13 aa, Plasmodium falciparum
IENDEKEDNKNNL

SEQ ID NO: 3315447 - protein, 15 aa, Plasmodium falciparum
IENDENDIKRKQSQI

SEQ ID NO: 3315448 - protein, 9 aa, Plasmodium falciparum
IENDGNHNE

SEQ ID NO: 3315449 - protein, 28 aa, Plasmodium falciparum
IENDSDETSEHIKRDSRSSCQKQNCEKK

SEQ ID NO: 3315450 - protein, 9 aa, Plasmodium falciparum
IENDTSENV

SEQ ID NO: 3315451 - protein, 13 aa, Plasmodium falciparum
IENDTSNSNESKL

SEQ ID NO: 3315452 - protein, 5 aa, Plasmodium falciparum
IENEE

SEQ ID NO: 3315453 - protein, 30 aa, Plasmodium falciparum
IENEEKKNVQRKEIEKQNNNISKGKKDVED

SEQ ID NO: 3315454 - protein, 16 aa, Plasmodium falciparum
IENEEKNNYDKEQNEN

SEQ ID NO: 3315455 - protein, 10 aa, Plasmodium falciparum
IENEEKSNIN

SEQ ID NO: 3315456 - protein, 5 aa, Plasmodium falciparum
IENEH

SEQ ID NO: 3315457 - protein, 14 aa, Plasmodium falciparum
IENEKKKKNNNNNI

SEQ ID NO: 3315458 - protein, 7 aa, Plasmodium falciparum
IENENKS

SEQ ID NO: 3315459 - protein, 31 aa, Plasmodium falciparum
IENESNNKVNKKELKKKKKKKNNNNNKTYTS

SEQ ID NO: 3315460 - protein, 7 aa, Plasmodium falciparum
IENETNN

SEQ ID NO: 3315461 - protein, 8 aa, Plasmodium falciparum
IENEYSKN

SEQ ID NO: 3315462 - protein, 8 aa, Plasmodium falciparum
IENHSEEK

SEQ ID NO: 3315463 - protein, 8 aa, Plasmodium falciparum
IENKNTKN

SEQ ID NO: 3315464 - protein, 6 aa, Plasmodium falciparum
IENKSN

SEQ ID NO: 3315465 - protein, 4 aa, Plasmodium falciparum
IENN

SEQ ID NO: 3315466 - protein, 28 aa, Plasmodium falciparum
IENNANDKNISNTDNNNNNNIPNGGNIE

SEQ ID NO: 3315467 - protein, 8 aa, Plasmodium falciparum
IENNDKKK

SEQ ID NO: 3315468 - protein, 6 aa, Plasmodium falciparum
IENNDS

SEQ ID NO: 3315469 - protein, 9 aa, Plasmodium falciparum
IENNGIKDS

SEQ ID NO: 3315470 - protein, 14 aa, Plasmodium falciparum
IENNNNKESFDNNE

SEQ ID NO: 3315471 - protein, 7 aa, Plasmodium falciparum
IENNNPD

SEQ ID NO: 3315472 - protein, 8 aa, Plasmodium falciparum
IENNQSDY

SEQ ID NO: 3315473 - protein, 12 aa, Plasmodium falciparum
IENQGATSGNYN

SEQ ID NO: 3315474 - protein, 10 aa, Plasmodium falciparum
IENRDNKRNE

SEQ ID NO: 3315475 - protein, 28 aa, Plasmodium falciparum
IENRDTYDNSNNKSNKSDDVDNKTGDIS

SEQ ID NO: 3315476 - protein, 8 aa, Plasmodium falciparum
IENSDDYY

SEQ ID NO: 3315477 - protein, 6 aa, Plasmodium falciparum
IENTNT

SEQ ID NO: 3315478 - protein, 12 aa, Plasmodium falciparum
IENVSDDDKNKR

SEQ ID NO: 3315479 - protein, 9 aa, Plasmodium falciparum
IEPNNTKQP

SEQ ID NO: 3315480 - protein, 15 aa, Plasmodium falciparum
IEPPNRNNNNNNNNM

SEQ ID NO: 3315481 - protein, 4 aa, Plasmodium falciparum
IEQD

SEQ ID NO: 3315482 - protein, 35 aa, Plasmodium falciparum
IEQDIKEDDEEEKEKEEKKNGADKKDTIEKEEEEY

SEQ ID NO: 3315483 - protein, 8 aa, Plasmodium falciparum
IEQGQKID

SEQ ID NO: 3315484 - protein, 9 aa, Plasmodium falciparum
IEQKGSKDT

SEQ ID NO: 3315485 - protein, 7 aa, Plasmodium falciparum
IEQKTNK

SEQ ID NO: 3315486 - protein, 23 aa, Plasmodium falciparum
IEQNNNKSCDSISNTSWSSDNDQ

SEQ ID NO: 3315487 - protein, 21 aa, Plasmodium falciparum
IEQNTGQDKNSNIKGKSVEEE

SEQ ID NO: 3315488 - protein, 11 aa, Plasmodium falciparum
IEQPPSDYGLP

SEQ ID NO: 3315489 - protein, 12 aa, Plasmodium falciparum
IEQRDEEGRKKI

SEQ ID NO: 3315490 - protein, 8 aa, Plasmodium falciparum
IEQSEPKQ

SEQ ID NO: 3315491 - protein, 23 aa, Plasmodium falciparum
IEQSQNLGKNEEYTEMEQEQNEL

SEQ ID NO: 3315492 - protein, 6 aa, Plasmodium falciparum
IEQSSN

SEQ ID NO: 3315493 - protein, 4 aa, Plasmodium falciparum
IEQT

SEQ ID NO: 3315494 - protein, 10 aa, Plasmodium falciparum
IEQTNQENDP

SEQ ID NO: 3315495 - protein, 4 aa, Plasmodium falciparum
IERD

SEQ ID NO: 3315496 - protein, 4 aa, Plasmodium falciparum
IERE

SEQ ID NO: 3315497 - protein, 13 aa, Plasmodium falciparum
IEREASKDESKQK

SEQ ID NO: 3315498 - protein, 14 aa, Plasmodium falciparum
IEREDQSVCENDNY

SEQ ID NO: 3315499 - protein, 9 aa, Plasmodium falciparum
IERENAESF

SEQ ID NO: 3315500 - protein, 26 aa, Plasmodium falciparum
IERGNRNQDEQEEYKDEGEDENNEVS

SEQ ID NO: 3315501 - protein, 6 aa, Plasmodium falciparum
IERKKE

SEQ ID NO: 3315502 - protein, 9 aa, Plasmodium falciparum
IERKNNEKH

SEQ ID NO: 3315503 - protein, 4 aa, Plasmodium falciparum
IERY

SEQ ID NO: 3315504 - protein, 19 aa, Plasmodium falciparum
IESDDKDYSDNNNNNNNNN

SEQ ID NO: 3315505 - protein, 7 aa, Plasmodium falciparum
IESEENL

SEQ ID NO: 3315506 - protein, 5 aa, Plasmodium falciparum
IESEH

SEQ ID NO: 3315507 - protein, 12 aa, Plasmodium falciparum
IESESNNQSISS

SEQ ID NO: 3315508 - protein, 10 aa, Plasmodium falciparum
IESIKKENAS

SEQ ID NO: 3315509 - protein, 13 aa, Plasmodium falciparum
IESNDGEGEDEGY

SEQ ID NO: 3315510 - protein, 5 aa, Plasmodium falciparum
IESNK

SEQ ID NO: 3315511 - protein, 10 aa, Plasmodium falciparum
IESNKIEKEN

SEQ ID NO: 3315512 - protein, 4 aa, Plasmodium falciparum
IESP

SEQ ID NO: 3315513 - protein, 5 aa, Plasmodium falciparum
IESQE

SEQ ID NO: 3315514 - protein, 54 aa, Plasmodium falciparum
IESSDEDNEEEDSSDEAQSIHSAESQKSIDDKLSDDPFSSDEESDKKKKKKKVS

SEQ ID NO: 3315515 - protein, 5 aa, Plasmodium falciparum
IESSV

SEQ ID NO: 3315516 - protein, 29 aa, Plasmodium falciparum
IESSVRQDIKKKKKKEKRREKKKKLKEKK

SEQ ID NO: 3315517 - protein, 4 aa, Plasmodium falciparum
IEST

SEQ ID NO: 3315518 - protein, 15 aa, Plasmodium falciparum
IESTKKSDELSKSYE

SEQ ID NO: 3315519 - protein, 87 aa, Plasmodium falciparum
IESTNDGKDDNNDKLDGDEINGDEINGDEINGDEINGDEINGDEINGDNLNNDNLNNDQLNDDQLNDDNLNNKDEPNDKQNSAYNNS

SEQ ID NO: 3315520 - protein, 18 aa, Plasmodium falciparum
IESYTSRKVQKDIGNNSY

SEQ ID NO: 3315521 - protein, 10 aa, Plasmodium falciparum
IETCNKNKKK

SEQ ID NO: 3315522 - protein, 12 aa, Plasmodium falciparum
IETDNNNNNDDI

SEQ ID NO: 3315523 - protein, 36 aa, Plasmodium falciparum
IETENTNKKQDENIGGEVKKKKKEKKKKKKKLEHNK

SEQ ID NO: 3315524 - protein, 8 aa, Plasmodium falciparum
IETGTKIK

SEQ ID NO: 3315525 - protein, 10 aa, Plasmodium falciparum
IETKRTDKME

SEQ ID NO: 3315526 - protein, 17 aa, Plasmodium falciparum
IETNEQNYDTQDDEYNN

SEQ ID NO: 3315527 - protein, 11 aa, Plasmodium falciparum
IETNNNNCHHK

SEQ ID NO: 3315528 - protein, 18 aa, Plasmodium falciparum
IETNNNNNNNNNNSGNNR

SEQ ID NO: 3315529 - protein, 41 aa, Plasmodium falciparum
IETPEQNDNIKKENPSSNNNNNNNKDDAICNNNKDDTICNN

SEQ ID NO: 3315530 - protein, 5 aa, Plasmodium falciparum
IETQD

SEQ ID NO: 3315531 - protein, 6 aa, Plasmodium falciparum
IETSNF

SEQ ID NO: 3315532 - protein, 7 aa, Plasmodium falciparum
IETTPRD

SEQ ID NO: 3315533 - protein, 15 aa, Plasmodium falciparum
IETVEPQQEEPVQTV

SEQ ID NO: 3315534 - protein, 10 aa, Plasmodium falciparum
IEVTDNEDEI

SEQ ID NO: 3315535 - protein, 17 aa, Plasmodium falciparum
IEYDQSADSFSKSSDKD

SEQ ID NO: 3315536 - protein, 9 aa, Plasmodium falciparum
IEYGDPKTV

SEQ ID NO: 3315537 - protein, 4 aa, Plasmodium falciparum
IEYK

SEQ ID NO: 3315538 - protein, 20 aa, Plasmodium falciparum
IEYNKNDDEDYNNNESKDKI

SEQ ID NO: 3315539 - protein, 13 aa, Plasmodium falciparum
IEYNNKDNCSEQN

SEQ ID NO: 3315540 - protein, 8 aa, Plasmodium falciparum
IFDEKDNE

SEQ ID NO: 3315541 - protein, 4 aa, Plasmodium falciparum
IFPT

SEQ ID NO: 3315542 - protein, 4 aa, Plasmodium falciparum
IGAD

SEQ ID NO: 3315543 - protein, 9 aa, Plasmodium falciparum
IGANNGRNS

SEQ ID NO: 3315544 - protein, 8 aa, Plasmodium falciparum
IGAQNGDL

SEQ ID NO: 3315545 - protein, 21 aa, Plasmodium falciparum
IGDDDGHSNESNNNNDNNNTK

SEQ ID NO: 3315546 - protein, 5 aa, Plasmodium falciparum
IGDDN

SEQ ID NO: 3315547 - protein, 4 aa, Plasmodium falciparum
IGDE

SEQ ID NO: 3315548 - protein, 14 aa, Plasmodium falciparum
IGDKKGKYTNTDGK

SEQ ID NO: 3315549 - protein, 21 aa, Plasmodium falciparum
IGDSGNAMQKLSKEDLAFLFH

SEQ ID NO: 3315550 - protein, 10 aa, Plasmodium falciparum
IGDTKSESIA

SEQ ID NO: 3315551 - protein, 4 aa, Plasmodium falciparum
IGDV

SEQ ID NO: 3315552 - protein, 11 aa, Plasmodium falciparum
IGEARSKQEED

SEQ ID NO: 3315553 - protein, 5 aa, Plasmodium falciparum
IGEDY

SEQ ID NO: 3315554 - protein, 5 aa, Plasmodium falciparum
IGEEA

SEQ ID NO: 3315555 - protein, 5 aa, Plasmodium falciparum
IGEEG

SEQ ID NO: 3315556 - protein, 6 aa, Plasmodium falciparum
IGENTK

SEQ ID NO: 3315557 - protein, 6 aa, Plasmodium falciparum
IGESEE

SEQ ID NO: 3315558 - protein, 14 aa, Plasmodium falciparum
IGGDQEKDKHNINH

SEQ ID NO: 3315559 - protein, 10 aa, Plasmodium falciparum
IGGKGSARRK

SEQ ID NO: 3315560 - protein, 13 aa, Plasmodium falciparum
IGGKTGKWSDDEN

SEQ ID NO: 3315561 - protein, 4 aa, Plasmodium falciparum
IGGM

SEQ ID NO: 3315562 - protein, 10 aa, Plasmodium falciparum
IGGNRKYYGN

SEQ ID NO: 3315563 - protein, 15 aa, Plasmodium falciparum
IGGSRGDESAHGDHE

SEQ ID NO: 3315564 - protein, 6 aa, Plasmodium falciparum
IGGSSI

SEQ ID NO: 3315565 - protein, 14 aa, Plasmodium falciparum
IGGTDPSVPHFYKH

SEQ ID NO: 3315566 - protein, 5 aa, Plasmodium falciparum
IGHNG

SEQ ID NO: 3315567 - protein, 5 aa, Plasmodium falciparum
IGKDE

SEQ ID NO: 3315568 - protein, 7 aa, Plasmodium falciparum
IGKDEYN

SEQ ID NO: 3315569 - protein, 12 aa, Plasmodium falciparum
IGKEDEEGGTIG

SEQ ID NO: 3315570 - protein, 9 aa, Plasmodium falciparum
IGKGNNDTC

SEQ ID NO: 3315571 - protein, 9 aa, Plasmodium falciparum
IGKGNSVGQ

SEQ ID NO: 3315572 - protein, 7 aa, Plasmodium falciparum
IGKGSFS

SEQ ID NO: 3315573 - protein, 9 aa, Plasmodium falciparum
IGKKDGLKG

SEQ ID NO: 3315574 - protein, 5 aa, Plasmodium falciparum
IGKKN

SEQ ID NO: 3315575 - protein, 9 aa, Plasmodium falciparum
IGKNDSNSF

SEQ ID NO: 3315576 - protein, 9 aa, Plasmodium falciparum
IGKNNDSLK

SEQ ID NO: 3315577 - protein, 4 aa, Plasmodium falciparum
IGKP

SEQ ID NO: 3315578 - protein, 10 aa, Plasmodium falciparum
IGKQKKSISM

SEQ ID NO: 3315579 - protein, 4 aa, Plasmodium falciparum
IGKR

SEQ ID NO: 3315580 - protein, 4 aa, Plasmodium falciparum
IGKS

SEQ ID NO: 3315581 - protein, 8 aa, Plasmodium falciparum
IGKSTKKL

SEQ ID NO: 3315582 - protein, 6 aa, Plasmodium falciparum
IGKTEF

SEQ ID NO: 3315583 - protein, 5 aa, Plasmodium falciparum
IGLEE

SEQ ID NO: 3315584 - protein, 8 aa, Plasmodium falciparum
IGNEEKRS

SEQ ID NO: 3315585 - protein, 6 aa, Plasmodium falciparum
IGNGRT

SEQ ID NO: 3315586 - protein, 11 aa, Plasmodium falciparum
IGNHPNDINKT

SEQ ID NO: 3315587 - protein, 10 aa, Plasmodium falciparum
IGNKISPIKD

SEQ ID NO: 3315588 - protein, 16 aa, Plasmodium falciparum
IGNKKKVDKNADVEDL

SEQ ID NO: 3315589 - protein, 11 aa, Plasmodium falciparum
IGNKKRIDYGT

SEQ ID NO: 3315590 - protein, 14 aa, Plasmodium falciparum
IGNKNEEKHNTNED

SEQ ID NO: 3315591 - protein, 40 aa, Plasmodium falciparum
IGNNNNMKTNEGPYNAPTYYNPGQHQQQQQQQQQQGPPLH

SEQ ID NO: 3315592 - protein, 8 aa, Plasmodium falciparum
IGNNSCEQ

SEQ ID NO: 3315593 - protein, 8 aa, Plasmodium falciparum
IGNNTGKY

SEQ ID NO: 3315594 - protein, 11 aa, Plasmodium falciparum
IGNNYNERDIK

SEQ ID NO: 3315595 - protein, 5 aa, Plasmodium falciparum
IGNQN

SEQ ID NO: 3315596 - protein, 9 aa, Plasmodium falciparum
IGNQSHDKF

SEQ ID NO: 3315597 - protein, 12 aa, Plasmodium falciparum
IGNSDIKKKEKD

SEQ ID NO: 3315598 - protein, 12 aa, Plasmodium falciparum
IGNSSGGTRNIS

SEQ ID NO: 3315599 - protein, 4 aa, Plasmodium falciparum
IGNT

SEQ ID NO: 3315600 - protein, 9 aa, Plasmodium falciparum
IGNTQTNTL

SEQ ID NO: 3315601 - protein, 9 aa, Plasmodium falciparum
IGPDKGEKK

SEQ ID NO: 3315602 - protein, 4 aa, Plasmodium falciparum
IGPK

SEQ ID NO: 3315603 - protein, 9 aa, Plasmodium falciparum
IGPNNEENY

SEQ ID NO: 3315604 - protein, 5 aa, Plasmodium falciparum
IGPPI

SEQ ID NO: 3315605 - protein, 11 aa, Plasmodium falciparum
IGPPPQVKETN

SEQ ID NO: 3315606 - protein, 4 aa, Plasmodium falciparum
IGPS

SEQ ID NO: 3315607 - protein, 12 aa, Plasmodium falciparum
IGQAQSGTGKTA

SEQ ID NO: 3315608 - protein, 4 aa, Plasmodium falciparum
IGQK

SEQ ID NO: 3315609 - protein, 4 aa, Plasmodium falciparum
IGQT

SEQ ID NO: 3315610 - protein, 4 aa, Plasmodium falciparum
IGSD

SEQ ID NO: 3315611 - protein, 13 aa, Plasmodium falciparum
IGSEDKDEDDENG

SEQ ID NO: 3315612 - protein, 8 aa, Plasmodium falciparum
IGSEGNSN

SEQ ID NO: 3315613 - protein, 7 aa, Plasmodium falciparum
IGSESNI

SEQ ID NO: 3315614 - protein, 5 aa, Plasmodium falciparum
IGSKK

SEQ ID NO: 3315615 - protein, 4 aa, Plasmodium falciparum
IGSM

SEQ ID NO: 3315616 - protein, 5 aa, Plasmodium falciparum
IGSNS

SEQ ID NO: 3315617 - protein, 7 aa, Plasmodium falciparum
IGSPSSK

SEQ ID NO: 3315618 - protein, 16 aa, Plasmodium falciparum
IGSQRIEGEHGDSEVQ

SEQ ID NO: 3315619 - protein, 6 aa, Plasmodium falciparum
IGSSAQ

SEQ ID NO: 3315620 - protein, 8 aa, Plasmodium falciparum
IGSSNVKP

SEQ ID NO: 3315621 - protein, 7 aa, Plasmodium falciparum
IGSSTMP

SEQ ID NO: 3315622 - protein, 11 aa, Plasmodium falciparum
IGSYNNEDNKF

SEQ ID NO: 3315623 - protein, 7 aa, Plasmodium falciparum
IGTETDK

SEQ ID NO: 3315624 - protein, 12 aa, Plasmodium falciparum
IGTNEMHNTKEN

SEQ ID NO: 3315625 - protein, 7 aa, Plasmodium falciparum
IGTPNRR

SEQ ID NO: 3315626 - protein, 18 aa, Plasmodium falciparum
IGTQRGSSLGDGSGAGDR

SEQ ID NO: 3315627 - protein, 6 aa, Plasmodium falciparum
IGTSAC

SEQ ID NO: 3315628 - protein, 6 aa, Plasmodium falciparum
IGTTGS

SEQ ID NO: 3315629 - protein, 6 aa, Plasmodium falciparum
IGVGKE

SEQ ID NO: 3315630 - protein, 9 aa, Plasmodium falciparum
IGVNKEKDN

SEQ ID NO: 3315631 - protein, 8 aa, Plasmodium falciparum
IGVPTKKN

SEQ ID NO: 3315632 - protein, 21 aa, Plasmodium falciparum
IGYKNDKKEFNEDKIEDDNTF

SEQ ID NO: 3315633 - protein, 14 aa, Plasmodium falciparum
IGYNSTKNSHESYS

SEQ ID NO: 3315634 - protein, 36 aa, Plasmodium falciparum
IGYQKKTSKKNEGIMNGKKGKRKYQRKDNKNVNDSN

SEQ ID NO: 3315635 - protein, 11 aa, Plasmodium falciparum
IHDDDNYNTPV

SEQ ID NO: 3315636 - protein, 11 aa, Plasmodium falciparum
IHDEKKNKNQI

SEQ ID NO: 3315637 - protein, 4 aa, Plasmodium falciparum
IHDT

SEQ ID NO: 3315638 - protein, 27 aa, Plasmodium falciparum
IHEEDEDDENNNNDEETGEDDCNGVYS

SEQ ID NO: 3315639 - protein, 11 aa, Plasmodium falciparum
IHGDNTPEQLG

SEQ ID NO: 3315640 - protein, 4 aa, Plasmodium falciparum
IHKE

SEQ ID NO: 3315641 - protein, 5 aa, Plasmodium falciparum
IHKKE

SEQ ID NO: 3315642 - protein, 7 aa, Plasmodium falciparum
IHKPNKT

SEQ ID NO: 3315643 - protein, 10 aa, Plasmodium falciparum
IHKSKENNNF

SEQ ID NO: 3315644 - protein, 11 aa, Plasmodium falciparum
IHMSPKKKKSI

SEQ ID NO: 3315645 - protein, 6 aa, Plasmodium falciparum
IHNDGI

SEQ ID NO: 3315646 - protein, 23 aa, Plasmodium falciparum
IHNDNNYPLNENQKNLHESDEQN

SEQ ID NO: 3315647 - protein, 61 aa, Plasmodium falciparum
IHNEDSDDCNNNNSNNNNSNNNNDDDNNNNDDDNNNNDDDNNNNDDDNNNNDDDNNNNNNN

SEQ ID NO: 3315648 - protein, 13 aa, Plasmodium falciparum
IHNEEDKNECTIE

SEQ ID NO: 3315649 - protein, 8 aa, Plasmodium falciparum
IHNNGNIH

SEQ ID NO: 3315650 - protein, 6 aa, Plasmodium falciparum
IHNNNH

SEQ ID NO: 3315651 - protein, 10 aa, Plasmodium falciparum
IHNNNNNNNI

SEQ ID NO: 3315652 - protein, 12 aa, Plasmodium falciparum
IHNNNNNTTSIN

SEQ ID NO: 3315653 - protein, 21 aa, Plasmodium falciparum
IHNQKKKNNINNQHQNEYDSN

SEQ ID NO: 3315654 - protein, 13 aa, Plasmodium falciparum
IHNRKKRKTWDAG

SEQ ID NO: 3315655 - protein, 11 aa, Plasmodium falciparum
IHNRRSTKKSL

SEQ ID NO: 3315656 - protein, 4 aa, Plasmodium falciparum
IHNS

SEQ ID NO: 3315657 - protein, 21 aa, Plasmodium falciparum
IHNSNNNIYNSENKDRNNYND

SEQ ID NO: 3315658 - protein, 10 aa, Plasmodium falciparum
IHNTKDELTN

SEQ ID NO: 3315659 - protein, 13 aa, Plasmodium falciparum
IHRGKSNDNGNMN

SEQ ID NO: 3315660 - protein, 12 aa, Plasmodium falciparum
IHSDDKYKNEHM

SEQ ID NO: 3315661 - protein, 9 aa, Plasmodium falciparum
IHSTQNNEL

SEQ ID NO: 3315662 - protein, 7 aa, Plasmodium falciparum
IHSYNNN

SEQ ID NO: 3315663 - protein, 18 aa, Plasmodium falciparum
IHTDNTSNNNQKNNGYND

SEQ ID NO: 3315664 - protein, 8 aa, Plasmodium falciparum
IHTKTNNN

SEQ ID NO: 3315665 - protein, 9 aa, Plasmodium falciparum
IHTNNNKNC

SEQ ID NO: 3315666 - protein, 4 aa, Plasmodium falciparum
IIEE

SEQ ID NO: 3315667 - protein, 13 aa, Plasmodium falciparum
IIEGSSSSSSFNH

SEQ ID NO: 3315668 - protein, 5 aa, Plasmodium falciparum
IIEPK

SEQ ID NO: 3315669 - protein, 35 aa, Plasmodium falciparum
IIESEEETNINSDDEEEEEEYQRKKQKKQKNSNVS

SEQ ID NO: 3315670 - protein, 6 aa, Plasmodium falciparum
IIESQN

SEQ ID NO: 3315671 - protein, 47 aa, Plasmodium falciparum
IIGNNNNNNNAENTKNHNINSNDNNNDNNNDNNNDNNNDDSGNNNYN

SEQ ID NO: 3315672 - protein, 5 aa, Plasmodium falciparum
IINDE

SEQ ID NO: 3315673 - protein, 15 aa, Plasmodium falciparum
IINGDNKKINDDNKI

SEQ ID NO: 3315674 - protein, 17 aa, Plasmodium falciparum
IIPDNKEKQINNDKNTI

SEQ ID NO: 3315675 - protein, 4 aa, Plasmodium falciparum
IIPS

SEQ ID NO: 3315676 - protein, 4 aa, Plasmodium falciparum
IIQN

SEQ ID NO: 3315677 - protein, 12 aa, Plasmodium falciparum
IIQNSDKKKGVS

SEQ ID NO: 3315678 - protein, 4 aa, Plasmodium falciparum
IISQ

SEQ ID NO: 3315679 - protein, 7 aa, Plasmodium falciparum
IISSGPY

SEQ ID NO: 3315680 - protein, 8 aa, Plasmodium falciparum
IKAPTNIK

SEQ ID NO: 3315681 - protein, 5 aa, Plasmodium falciparum
IKAQQ

SEQ ID NO: 3315682 - protein, 5 aa, Plasmodium falciparum
IKASE

SEQ ID NO: 3315683 - protein, 8 aa, Plasmodium falciparum
IKASKDAI

SEQ ID NO: 3315684 - protein, 6 aa, Plasmodium falciparum
IKATDE

SEQ ID NO: 3315685 - protein, 15 aa, Plasmodium falciparum
IKDAKKKKKKKNQNL

SEQ ID NO: 3315686 - protein, 9 aa, Plasmodium falciparum
IKDDDNNNC

SEQ ID NO: 3315687 - protein, 8 aa, Plasmodium falciparum
IKDDEDER

SEQ ID NO: 3315688 - protein, 6 aa, Plasmodium falciparum
IKDDNE

SEQ ID NO: 3315689 - protein, 12 aa, Plasmodium falciparum
IKDDSKAGSELT

SEQ ID NO: 3315690 - protein, 13 aa, Plasmodium falciparum
IKDEEKNLQNELE

SEQ ID NO: 3315691 - protein, 8 aa, Plasmodium falciparum
IKDEGNKV

SEQ ID NO: 3315692 - protein, 14 aa, Plasmodium falciparum
IKDEGYNNENITTL

SEQ ID NO: 3315693 - protein, 7 aa, Plasmodium falciparum
IKDEIRD

SEQ ID NO: 3315694 - protein, 5 aa, Plasmodium falciparum
IKDEK

SEQ ID NO: 3315695 - protein, 6 aa, Plasmodium falciparum
IKDEKE

SEQ ID NO: 3315696 - protein, 12 aa, Plasmodium falciparum
IKDEKEGTSSYR

SEQ ID NO: 3315697 - protein, 7 aa, Plasmodium falciparum
IKDENDN

SEQ ID NO: 3315698 - protein, 8 aa, Plasmodium falciparum
IKDENSKK

SEQ ID NO: 3315699 - protein, 31 aa, Plasmodium falciparum
IKDEPDEKNKNNNNKNNNNNNNNNNNNYNND

SEQ ID NO: 3315700 - protein, 8 aa, Plasmodium falciparum
IKDEQNRK

SEQ ID NO: 3315701 - protein, 14 aa, Plasmodium falciparum
IKDESNGKSPNNFN

SEQ ID NO: 3315702 - protein, 8 aa, Plasmodium falciparum
IKDETQEI

SEQ ID NO: 3315703 - protein, 30 aa, Plasmodium falciparum
IKDGEKKSDLLKNKKNKKNKIKNDDDDNNI

SEQ ID NO: 3315704 - protein, 12 aa, Plasmodium falciparum
IKDGLSDDNDGN

SEQ ID NO: 3315705 - protein, 6 aa, Plasmodium falciparum
IKDGSY

SEQ ID NO: 3315706 - protein, 12 aa, Plasmodium falciparum
IKDKKKKERELK

SEQ ID NO: 3315707 - protein, 7 aa, Plasmodium falciparum
IKDKQND

SEQ ID NO: 3315708 - protein, 4 aa, Plasmodium falciparum
IKDN

SEQ ID NO: 3315709 - protein, 17 aa, Plasmodium falciparum
IKDNNENCEKEKKEYND

SEQ ID NO: 3315710 - protein, 35 aa, Plasmodium falciparum
IKDPSVNDYSSQKINEDKHIEQNQELPKTSNVDNV

SEQ ID NO: 3315711 - protein, 10 aa, Plasmodium falciparum
IKDPTDSTNM

SEQ ID NO: 3315712 - protein, 7 aa, Plasmodium falciparum
IKDPYSD

SEQ ID NO: 3315713 - protein, 13 aa, Plasmodium falciparum
IKDRNKDIKSKER

SEQ ID NO: 3315714 - protein, 10 aa, Plasmodium falciparum
IKDSINKAEE

SEQ ID NO: 3315715 - protein, 13 aa, Plasmodium falciparum
IKDTNSDKIDEEN

SEQ ID NO: 3315716 - protein, 9 aa, Plasmodium falciparum
IKDTSSNDE

SEQ ID NO: 3315717 - protein, 11 aa, Plasmodium falciparum
IKDTVTTSKIQ

SEQ ID NO: 3315718 - protein, 7 aa, Plasmodium falciparum
IKEARNS

SEQ ID NO: 3315719 - protein, 6 aa, Plasmodium falciparum
IKEDDK

SEQ ID NO: 3315720 - protein, 9 aa, Plasmodium falciparum
IKEDDRDHF

SEQ ID NO: 3315721 - protein, 11 aa, Plasmodium falciparum
IKEDDSDSSSM

SEQ ID NO: 3315722 - protein, 8 aa, Plasmodium falciparum
IKEDEKKS

SEQ ID NO: 3315723 - protein, 12 aa, Plasmodium falciparum
IKEDKKKKNVHN

SEQ ID NO: 3315724 - protein, 10 aa, Plasmodium falciparum
IKEDSNNTND

SEQ ID NO: 3315725 - protein, 14 aa, Plasmodium falciparum
IKEDTNSNNYHNNS

SEQ ID NO: 3315726 - protein, 4 aa, Plasmodium falciparum
IKEE

SEQ ID NO: 3315727 - protein, 11 aa, Plasmodium falciparum
IKEEEDINGSE

SEQ ID NO: 3315728 - protein, 41 aa, Plasmodium falciparum
IKEEEDNLNHTENNNEENSSDNNNISTKENNIDESNSENFH

SEQ ID NO: 3315729 - protein, 6 aa, Plasmodium falciparum
IKEEEK

SEQ ID NO: 3315730 - protein, 11 aa, Plasmodium falciparum
IKEEGSNKHNH

SEQ ID NO: 3315731 - protein, 10 aa, Plasmodium falciparum
IKEEHTEEEY

SEQ ID NO: 3315732 - protein, 10 aa, Plasmodium falciparum
IKEEKKDKKY

SEQ ID NO: 3315733 - protein, 10 aa, Plasmodium falciparum
IKEENEKKFK

SEQ ID NO: 3315734 - protein, 15 aa, Plasmodium falciparum
IKEEQYKDFSKENNN

SEQ ID NO: 3315735 - protein, 6 aa, Plasmodium falciparum
IKEERP

SEQ ID NO: 3315736 - protein, 9 aa, Plasmodium falciparum
IKEESNESN

SEQ ID NO: 3315737 - protein, 10 aa, Plasmodium falciparum
IKEEYDESKN

SEQ ID NO: 3315738 - protein, 5 aa, Plasmodium falciparum
IKEGE

SEQ ID NO: 3315739 - protein, 7 aa, Plasmodium falciparum
IKEGQST

SEQ ID NO: 3315740 - protein, 28 aa, Plasmodium falciparum
IKEHTKEIEEKNNDMSYKTHNEDSQPFH

SEQ ID NO: 3315741 - protein, 8 aa, Plasmodium falciparum
IKEHTPNN

SEQ ID NO: 3315742 - protein, 4 aa, Plasmodium falciparum
IKEK

SEQ ID NO: 3315743 - protein, 9 aa, Plasmodium falciparum
IKEKDKNIE

SEQ ID NO: 3315744 - protein, 6 aa, Plasmodium falciparum
IKEKED

SEQ ID NO: 3315745 - protein, 15 aa, Plasmodium falciparum
IKEKEGNNSSLVNNE

SEQ ID NO: 3315746 - protein, 11 aa, Plasmodium falciparum
IKEKEKDKETF

SEQ ID NO: 3315747 - protein, 8 aa, Plasmodium falciparum
IKEKEKDN

SEQ ID NO: 3315748 - protein, 12 aa, Plasmodium falciparum
IKEKEKKKIEIK

SEQ ID NO: 3315749 - protein, 162 aa, Plasmodium falciparum
IKEKEKYTLGGRERGSRRSKESDSFRGRERGSRRSKEVDTLKGRERDSLKGKERDSLKGRERDSLKGKERDSFRGKERDSFRGKERETLKGRERDSLKGRERDSLKGRERGSFRGKERDSFRGKERDSFRGKERDSFRGRKRDTFRSRDRGSFRNKTGDVYK

SEQ ID NO: 3315750 - protein, 32 aa, Plasmodium falciparum
IKEKENQNNNNNFDDDKVNNSTELSRNNTKVS

SEQ ID NO: 3315751 - protein, 9 aa, Plasmodium falciparum
IKEKESSEY

SEQ ID NO: 3315752 - protein, 11 aa, Plasmodium falciparum
IKEKKKKETNY

SEQ ID NO: 3315753 - protein, 25 aa, Plasmodium falciparum
IKEKKKKKKMKKKKKKKKKKKKYDY

SEQ ID NO: 3315754 - protein, 23 aa, Plasmodium falciparum
IKEKNDNHKEIEKYNSDTENKDV

SEQ ID NO: 3315755 - protein, 8 aa, Plasmodium falciparum
IKEKNDVD

SEQ ID NO: 3315756 - protein, 6 aa, Plasmodium falciparum
IKEKNE

SEQ ID NO: 3315757 - protein, 9 aa, Plasmodium falciparum
IKEKQKHKK

SEQ ID NO: 3315758 - protein, 10 aa, Plasmodium falciparum
IKEKRKKQQK

SEQ ID NO: 3315759 - protein, 28 aa, Plasmodium falciparum
IKEKTTDKIKYDTSNNIKDKISKDLEQD

SEQ ID NO: 3315760 - protein, 7 aa, Plasmodium falciparum
IKELDDD

SEQ ID NO: 3315761 - protein, 4 aa, Plasmodium falciparum
IKEM

SEQ ID NO: 3315762 - protein, 19 aa, Plasmodium falciparum
IKENDDEINMNNSNNRNRK

SEQ ID NO: 3315763 - protein, 15 aa, Plasmodium falciparum
IKENDNNNNNYDNRY

SEQ ID NO: 3315764 - protein, 24 aa, Plasmodium falciparum
IKENDSKNDSENDSKNDKENDNDF

SEQ ID NO: 3315765 - protein, 6 aa, Plasmodium falciparum
IKENEE

SEQ ID NO: 3315766 - protein, 9 aa, Plasmodium falciparum
IKENEENIK

SEQ ID NO: 3315767 - protein, 43 aa, Plasmodium falciparum
IKENETLSQKYGSEINELNNKSEKCVEQKRQCQQKISEGTTNL

SEQ ID NO: 3315768 - protein, 24 aa, Plasmodium falciparum
IKENNENENENENKNDDGTIYSKN

SEQ ID NO: 3315769 - protein, 19 aa, Plasmodium falciparum
IKENNESIDNTNNNSSTKL

SEQ ID NO: 3315770 - protein, 10 aa, Plasmodium falciparum
IKENNQMKDN

SEQ ID NO: 3315771 - protein, 244 aa, Plasmodium falciparum
IKENQKKKDKDNKRKRKYNKKERIHNNKNNSNNGNENGNNNNGNGNGNGNGNCNGNGNGNGNGNGNGNCNGNGNGNGNGNGNGNGNGNGNGNCNGNGNGNGNGNGNGNGNCNGNGNGNGNGNGNGNGNGNGNGNGNGNGNGNCNGNGNGNGNGNGNGNGNGNGNGNGNGNGNVNGNGNGNGNGNGNGNCNGKCNGNGNGNGNGNGNGNDNGNGNGNNENGNGNGNGNGNGNNENGNDNNGDSNK

SEQ ID NO: 3315772 - protein, 21 aa, Plasmodium falciparum
IKENRKSIQNKKMNSSNTYNN

SEQ ID NO: 3315773 - protein, 5 aa, Plasmodium falciparum
IKENT

SEQ ID NO: 3315774 - protein, 9 aa, Plasmodium falciparum
IKENTANRN

SEQ ID NO: 3315775 - protein, 9 aa, Plasmodium falciparum
IKENTNLSD

SEQ ID NO: 3315776 - protein, 8 aa, Plasmodium falciparum
IKENTSNN

SEQ ID NO: 3315777 - protein, 15 aa, Plasmodium falciparum
IKEQDEKNNENNNYN

SEQ ID NO: 3315778 - protein, 12 aa, Plasmodium falciparum
IKEQNDRRKRSF

SEQ ID NO: 3315779 - protein, 20 aa, Plasmodium falciparum
IKEQQKKEEMKKQEEQRKKE

SEQ ID NO: 3315780 - protein, 20 aa, Plasmodium falciparum
IKEQSNLDNNHNSSCTKNND

SEQ ID NO: 3315781 - protein, 6 aa, Plasmodium falciparum
IKESDK

SEQ ID NO: 3315782 - protein, 5 aa, Plasmodium falciparum
IKESN

SEQ ID NO: 3315783 - protein, 10 aa, Plasmodium falciparum
IKESNENQTV

SEQ ID NO: 3315784 - protein, 9 aa, Plasmodium falciparum
IKESNTNMN

SEQ ID NO: 3315785 - protein, 21 aa, Plasmodium falciparum
IKESSNSTITGSNEKKNSNNI

SEQ ID NO: 3315786 - protein, 13 aa, Plasmodium falciparum
IKESSVKNSSCST

SEQ ID NO: 3315787 - protein, 23 aa, Plasmodium falciparum
IKESYDKNKKIRGDLKDEESELR

SEQ ID NO: 3315788 - protein, 18 aa, Plasmodium falciparum
IKETEKNRTMNKSSSYKQ

SEQ ID NO: 3315789 - protein, 10 aa, Plasmodium falciparum
IKETNPKRQL

SEQ ID NO: 3315790 - protein, 8 aa, Plasmodium falciparum
IKETSAAY

SEQ ID NO: 3315791 - protein, 27 aa, Plasmodium falciparum
IKETSENEYTKNDDKYNNSTNSNGYNK

SEQ ID NO: 3315792 - protein, 6 aa, Plasmodium falciparum
IKEYEK

SEQ ID NO: 3315793 - protein, 8 aa, Plasmodium falciparum
IKGAEEEI

SEQ ID NO: 3315794 - protein, 4 aa, Plasmodium falciparum
IKGD

SEQ ID NO: 3315795 - protein, 31 aa, Plasmodium falciparum
IKGDDDNNDDDNNDNDNNDDENYDNDDEYEN

SEQ ID NO: 3315796 - protein, 10 aa, Plasmodium falciparum
IKGDENRDEI

SEQ ID NO: 3315797 - protein, 11 aa, Plasmodium falciparum
IKGDKINEYDN

SEQ ID NO: 3315798 - protein, 8 aa, Plasmodium falciparum
IKGEEENL

SEQ ID NO: 3315799 - protein, 21 aa, Plasmodium falciparum
IKGENKNNGNNINYKGPATKA

SEQ ID NO: 3315800 - protein, 7 aa, Plasmodium falciparum
IKGETSR

SEQ ID NO: 3315801 - protein, 22 aa, Plasmodium falciparum
IKGGNKKNNKNNKNNHNNNSVN

SEQ ID NO: 3315802 - protein, 4 aa, Plasmodium falciparum
IKGH

SEQ ID NO: 3315803 - protein, 4 aa, Plasmodium falciparum
IKGK

SEQ ID NO: 3315804 - protein, 32 aa, Plasmodium falciparum
IKGKDNHSDNNNKHNNNFNNHNNNNKTNYDSH

SEQ ID NO: 3315805 - protein, 37 aa, Plasmodium falciparum
IKGKENKTKNKKSGLGTDDNNDNGDHNKNEGSNINGE

SEQ ID NO: 3315806 - protein, 7 aa, Plasmodium falciparum
IKGKYTK

SEQ ID NO: 3315807 - protein, 13 aa, Plasmodium falciparum
IKGNHKKEKSFKD

SEQ ID NO: 3315808 - protein, 16 aa, Plasmodium falciparum
IKGNNQTTNLTNNNNS

SEQ ID NO: 3315809 - protein, 13 aa, Plasmodium falciparum
IKGNNTENGGACA

SEQ ID NO: 3315810 - protein, 6 aa, Plasmodium falciparum
IKGQPA

SEQ ID NO: 3315811 - protein, 5 aa, Plasmodium falciparum
IKGSA

SEQ ID NO: 3315812 - protein, 10 aa, Plasmodium falciparum
IKGSDPGKVT

SEQ ID NO: 3315813 - protein, 10 aa, Plasmodium falciparum
IKGSEDASFH

SEQ ID NO: 3315814 - protein, 7 aa, Plasmodium falciparum
IKGSRGT

SEQ ID NO: 3315815 - protein, 7 aa, Plasmodium falciparum
IKGYRDD

SEQ ID NO: 3315816 - protein, 17 aa, Plasmodium falciparum
IKHEQKKNKNDDVNNSD

SEQ ID NO: 3315817 - protein, 11 aa, Plasmodium falciparum
IKHGDDENKNN

SEQ ID NO: 3315818 - protein, 11 aa, Plasmodium falciparum
IKHKQKSSYIG

SEQ ID NO: 3315819 - protein, 14 aa, Plasmodium falciparum
IKHKQNEKQIDNED

SEQ ID NO: 3315820 - protein, 29 aa, Plasmodium falciparum
IKHTNDTSIHNDDKKKEIKGGNKNNEINK

SEQ ID NO: 3315821 - protein, 11 aa, Plasmodium falciparum
IKIKNKNESYH

SEQ ID NO: 3315822 - protein, 8 aa, Plasmodium falciparum
IKKDDSTF

SEQ ID NO: 3315823 - protein, 20 aa, Plasmodium falciparum
IKKDEKNKGVLKSSSNSKEL

SEQ ID NO: 3315824 - protein, 32 aa, Plasmodium falciparum
IKKDERSDDHDKVGYKNDDEEDEKKKKKKKSH

SEQ ID NO: 3315825 - protein, 12 aa, Plasmodium falciparum
IKKDGENNLPEQ

SEQ ID NO: 3315826 - protein, 8 aa, Plasmodium falciparum
IKKDIENK

SEQ ID NO: 3315827 - protein, 10 aa, Plasmodium falciparum
IKKDKNNNLE

SEQ ID NO: 3315828 - protein, 30 aa, Plasmodium falciparum
IKKDNINNDNINNDNINNDNINNDNINNNN

SEQ ID NO: 3315829 - protein, 11 aa, Plasmodium falciparum
IKKDSSSETLI

SEQ ID NO: 3315830 - protein, 9 aa, Plasmodium falciparum
IKKDTINNN

SEQ ID NO: 3315831 - protein, 48 aa, Plasmodium falciparum
IKKDTTKNIQSRNDNKNDHGDEDDHRTNNINSNMKNSNNNNNNNNNNI

SEQ ID NO: 3315832 - protein, 4 aa, Plasmodium falciparum
IKKE

SEQ ID NO: 3315833 - protein, 16 aa, Plasmodium falciparum
IKKEDEKSSIEKKRKT

SEQ ID NO: 3315834 - protein, 22 aa, Plasmodium falciparum
IKKEDGNEGALRGGGDSNTSAL

SEQ ID NO: 3315835 - protein, 8 aa, Plasmodium falciparum
IKKEDKDI

SEQ ID NO: 3315836 - protein, 14 aa, Plasmodium falciparum
IKKEDNNTQSIDES

SEQ ID NO: 3315837 - protein, 8 aa, Plasmodium falciparum
IKKEEEAG

SEQ ID NO: 3315838 - protein, 10 aa, Plasmodium falciparum
IKKEEEKKDN

SEQ ID NO: 3315839 - protein, 13 aa, Plasmodium falciparum
IKKEEEKNEGKFE

SEQ ID NO: 3315840 - protein, 22 aa, Plasmodium falciparum
IKKEEKDKNKINGINKTSNLNN

SEQ ID NO: 3315841 - protein, 8 aa, Plasmodium falciparum
IKKEESYK

SEQ ID NO: 3315842 - protein, 6 aa, Plasmodium falciparum
IKKEET

SEQ ID NO: 3315843 - protein, 6 aa, Plasmodium falciparum
IKKEHK

SEQ ID NO: 3315844 - protein, 7 aa, Plasmodium falciparum
IKKEHSN

SEQ ID NO: 3315845 - protein, 7 aa, Plasmodium falciparum
IKKEKED

SEQ ID NO: 3315846 - protein, 36 aa, Plasmodium falciparum
IKKEKEKENKKIYSKNDDDNNNNNNNNNKKNNNITS

SEQ ID NO: 3315847 - protein, 15 aa, Plasmodium falciparum
IKKEKKRKKKKIEQI

SEQ ID NO: 3315848 - protein, 27 aa, Plasmodium falciparum
IKKENDEENDEENEENEQNEKNEKNEL

SEQ ID NO: 3315849 - protein, 34 aa, Plasmodium falciparum
IKKENDSVNNEQNNSSGNTKQIDNIQKDNNVEEN

SEQ ID NO: 3315850 - protein, 11 aa, Plasmodium falciparum
IKKENIKEENI

SEQ ID NO: 3315851 - protein, 11 aa, Plasmodium falciparum
IKKENKKNTKI

SEQ ID NO: 3315852 - protein, 8 aa, Plasmodium falciparum
IKKENNKE

SEQ ID NO: 3315853 - protein, 7 aa, Plasmodium falciparum
IKKETNV

SEQ ID NO: 3315854 - protein, 149 aa, Plasmodium falciparum
IKKETSMELSNDKKGKKKYQNKKNKKLKTIRKSNADRNGEKKDISKVSSSAKSAINAENDNRKYNGEEVKGENVEEDEEDEEDEEDDEEEEEEDEEEGDEDDEEGDEDYDEENEEEEEDANEEEEEDANEELDENEENEDKVEDPNEED

SEQ ID NO: 3315855 - protein, 4 aa, Plasmodium falciparum
IKKG

SEQ ID NO: 3315856 - protein, 12 aa, Plasmodium falciparum
IKKGKEKKKGNI

SEQ ID NO: 3315857 - protein, 10 aa, Plasmodium falciparum
IKKGKSKNMV

SEQ ID NO: 3315858 - protein, 10 aa, Plasmodium falciparum
IKKGSSGLSA

SEQ ID NO: 3315859 - protein, 8 aa, Plasmodium falciparum
IKKGTTNV

SEQ ID NO: 3315860 - protein, 4 aa, Plasmodium falciparum
IKKK

SEQ ID NO: 3315861 - protein, 11 aa, Plasmodium falciparum
IKKKAEDLNNS

SEQ ID NO: 3315862 - protein, 8 aa, Plasmodium falciparum
IKKKEDAV

SEQ ID NO: 3315863 - protein, 11 aa, Plasmodium falciparum
IKKKEEESHDM

SEQ ID NO: 3315864 - protein, 23 aa, Plasmodium falciparum
IKKKEEGKGKEEEEKKKKNGDMI

SEQ ID NO: 3315865 - protein, 13 aa, Plasmodium falciparum
IKKKENEKIKDKQ

SEQ ID NO: 3315866 - protein, 75 aa, Plasmodium falciparum
IKKKGKKKSIKNKDNNNNDDDDDNSGDNNDDNNDDNNDDNYDDDDTSYDDNNYGDDEEYSSESKSRASSTSKYEE

SEQ ID NO: 3315867 - protein, 12 aa, Plasmodium falciparum
IKKKKEKNEYNN

SEQ ID NO: 3315868 - protein, 43 aa, Plasmodium falciparum
IKKKKKKKKRNKQEYDTNENNYSDFQKNKQDNDLTHKRNNNDH

SEQ ID NO: 3315869 - protein, 8 aa, Plasmodium falciparum
IKKKKKKN

SEQ ID NO: 3315870 - protein, 8 aa, Plasmodium falciparum
IKKKKKSA

SEQ ID NO: 3315871 - protein, 10 aa, Plasmodium falciparum
IKKKKNINDH

SEQ ID NO: 3315872 - protein, 8 aa, Plasmodium falciparum
IKKKKNKY

SEQ ID NO: 3315873 - protein, 6 aa, Plasmodium falciparum
IKKKKR

SEQ ID NO: 3315874 - protein, 8 aa, Plasmodium falciparum
IKKKQEDI

SEQ ID NO: 3315875 - protein, 18 aa, Plasmodium falciparum
IKKKRESLSNNNTNENNY

SEQ ID NO: 3315876 - protein, 10 aa, Plasmodium falciparum
IKKKRKHDGL

SEQ ID NO: 3315877 - protein, 17 aa, Plasmodium falciparum
IKKKTDSSWNNKKGRIY

SEQ ID NO: 3315878 - protein, 9 aa, Plasmodium falciparum
IKKKTSNDN

SEQ ID NO: 3315879 - protein, 4 aa, Plasmodium falciparum
IKKM

SEQ ID NO: 3315880 - protein, 4 aa, Plasmodium falciparum
IKKN

SEQ ID NO: 3315881 - protein, 68 aa, Plasmodium falciparum
IKKNDDKKKNDNKENDDKENDDKNNDDNNNDEKKKGDKKNDDKKNDEKKKGDKKNDENNDDNNNDKYF

SEQ ID NO: 3315882 - protein, 9 aa, Plasmodium falciparum
IKKNDEKMR

SEQ ID NO: 3315883 - protein, 11 aa, Plasmodium falciparum
IKKNDENVTTW

SEQ ID NO: 3315884 - protein, 7 aa, Plasmodium falciparum
IKKNDKK

SEQ ID NO: 3315885 - protein, 14 aa, Plasmodium falciparum
IKKNEEKKKGNPQD

SEQ ID NO: 3315886 - protein, 6 aa, Plasmodium falciparum
IKKNEN

SEQ ID NO: 3315887 - protein, 6 aa, Plasmodium falciparum
IKKNER

SEQ ID NO: 3315888 - protein, 21 aa, Plasmodium falciparum
IKKNKDKMNSSINGKQQLYIN

SEQ ID NO: 3315889 - protein, 8 aa, Plasmodium falciparum
IKKNKEEL

SEQ ID NO: 3315890 - protein, 17 aa, Plasmodium falciparum
IKKNKGNQQYKNQKKNK

SEQ ID NO: 3315891 - protein, 9 aa, Plasmodium falciparum
IKKNKKKGL

SEQ ID NO: 3315892 - protein, 11 aa, Plasmodium falciparum
IKKNKTKKKHK

SEQ ID NO: 3315893 - protein, 5 aa, Plasmodium falciparum
IKKNN

SEQ ID NO: 3315894 - protein, 11 aa, Plasmodium falciparum
IKKNNNGNYNN

SEQ ID NO: 3315895 - protein, 9 aa, Plasmodium falciparum
IKKNQERKE

SEQ ID NO: 3315896 - protein, 11 aa, Plasmodium falciparum
IKKNSSTDDNI

SEQ ID NO: 3315897 - protein, 13 aa, Plasmodium falciparum
IKKNYKDKEKIST

SEQ ID NO: 3315898 - protein, 5 aa, Plasmodium falciparum
IKKPP

SEQ ID NO: 3315899 - protein, 24 aa, Plasmodium falciparum
IKKQEEKKKKFDESKTVEEKKNNT

SEQ ID NO: 3315900 - protein, 48 aa, Plasmodium falciparum
IKKQESIHSKNSSSYSSEISSSCEKTDDMLSNEKDDFNNDDEVEKSKN

SEQ ID NO: 3315901 - protein, 9 aa, Plasmodium falciparum
IKKQNENDY

SEQ ID NO: 3315902 - protein, 4 aa, Plasmodium falciparum
IKKR

SEQ ID NO: 3315903 - protein, 5 aa, Plasmodium falciparum
IKKRI

SEQ ID NO: 3315904 - protein, 17 aa, Plasmodium falciparum
IKKRKEKKSQQKNGNKN

SEQ ID NO: 3315905 - protein, 15 aa, Plasmodium falciparum
IKKRNDDNERTRDEL

SEQ ID NO: 3315906 - protein, 20 aa, Plasmodium falciparum
IKKSKDTNPNSVDQNIEENK

SEQ ID NO: 3315907 - protein, 8 aa, Plasmodium falciparum
IKKSKKPL

SEQ ID NO: 3315908 - protein, 23 aa, Plasmodium falciparum
IKKSQNKLNHKTTPLEKDNYNNY

SEQ ID NO: 3315909 - protein, 9 aa, Plasmodium falciparum
IKKSQTKLL

SEQ ID NO: 3315910 - protein, 20 aa, Plasmodium falciparum
IKKSSTNTQKKNVSTSDNSS

SEQ ID NO: 3315911 - protein, 68 aa, Plasmodium falciparum
IKKTDKRNKRNNKSNKRSKKKKDERSENINYDSDEELKKKEIQNDPKDSELEKNSDNNNNNNKKVGRK

SEQ ID NO: 3315912 - protein, 31 aa, Plasmodium falciparum
IKKTEESGDLNNNNNSVENKNLDENAYAEEN

SEQ ID NO: 3315913 - protein, 7 aa, Plasmodium falciparum
IKKTPEA

SEQ ID NO: 3315914 - protein, 8 aa, Plasmodium falciparum
IKKTQNNI

SEQ ID NO: 3315915 - protein, 8 aa, Plasmodium falciparum
IKKYKQED

SEQ ID NO: 3315916 - protein, 12 aa, Plasmodium falciparum
IKLTKKKKKQTI

SEQ ID NO: 3315917 - protein, 12 aa, Plasmodium falciparum
IKNAKSNMSNNN

SEQ ID NO: 3315918 - protein, 5 aa, Plasmodium falciparum
IKNDE

SEQ ID NO: 3315919 - protein, 5 aa, Plasmodium falciparum
IKNDH

SEQ ID NO: 3315920 - protein, 11 aa, Plasmodium falciparum
IKNDIKNDNQY

SEQ ID NO: 3315921 - protein, 13 aa, Plasmodium falciparum
IKNDKDENTTLKS

SEQ ID NO: 3315922 - protein, 17 aa, Plasmodium falciparum
IKNDNNNNNNNNENNDI

SEQ ID NO: 3315923 - protein, 16 aa, Plasmodium falciparum
IKNDNSTTNDKINDEE

SEQ ID NO: 3315924 - protein, 17 aa, Plasmodium falciparum
IKNDPNMNGYNDDNINN

SEQ ID NO: 3315925 - protein, 7 aa, Plasmodium falciparum
IKNDSSS

SEQ ID NO: 3315926 - protein, 4 aa, Plasmodium falciparum
IKNE

SEQ ID NO: 3315927 - protein, 14 aa, Plasmodium falciparum
IKNEDGSNKKNEDK

SEQ ID NO: 3315928 - protein, 10 aa, Plasmodium falciparum
IKNEDKEKKE

SEQ ID NO: 3315929 - protein, 8 aa, Plasmodium falciparum
IKNEDSSN

SEQ ID NO: 3315930 - protein, 11 aa, Plasmodium falciparum
IKNEEANKRNV

SEQ ID NO: 3315931 - protein, 7 aa, Plasmodium falciparum
IKNEEKK

SEQ ID NO: 3315932 - protein, 6 aa, Plasmodium falciparum
IKNEGI

SEQ ID NO: 3315933 - protein, 15 aa, Plasmodium falciparum
IKNEKKDNELGNDNL

SEQ ID NO: 3315934 - protein, 83 aa, Plasmodium falciparum
IKNENKKENKKENKNENKNENKNENKNESKKENKKEVKKDDSSSDSDSSSDSDDSDDSDSDEVEEKKEKESDKVVKPSNNTHK

SEQ ID NO: 3315935 - protein, 7 aa, Plasmodium falciparum
IKNEQDE

SEQ ID NO: 3315936 - protein, 23 aa, Plasmodium falciparum
IKNEQNVKNGDVNDEIATTTSSN

SEQ ID NO: 3315937 - protein, 5 aa, Plasmodium falciparum
IKNES

SEQ ID NO: 3315938 - protein, 10 aa, Plasmodium falciparum
IKNESTSDDD

SEQ ID NO: 3315939 - protein, 9 aa, Plasmodium falciparum
IKNETGDDN

SEQ ID NO: 3315940 - protein, 7 aa, Plasmodium falciparum
IKNETKI

SEQ ID NO: 3315941 - protein, 4 aa, Plasmodium falciparum
IKNG

SEQ ID NO: 3315942 - protein, 12 aa, Plasmodium falciparum
IKNGEGKDQNEL

SEQ ID NO: 3315943 - protein, 12 aa, Plasmodium falciparum
IKNGEGKIKNGE

SEQ ID NO: 3315944 - protein, 19 aa, Plasmodium falciparum
IKNGEGRIKNGEGKIKNGE

SEQ ID NO: 3315945 - protein, 6 aa, Plasmodium falciparum
IKNGEI

SEQ ID NO: 3315946 - protein, 7 aa, Plasmodium falciparum
IKNGPKY

SEQ ID NO: 3315947 - protein, 8 aa, Plasmodium falciparum
IKNHEKHS

SEQ ID NO: 3315948 - protein, 13 aa, Plasmodium falciparum
IKNINKRKKEEDA

SEQ ID NO: 3315949 - protein, 4 aa, Plasmodium falciparum
IKNK

SEQ ID NO: 3315950 - protein, 8 aa, Plasmodium falciparum
IKNKDEEI

SEQ ID NO: 3315951 - protein, 34 aa, Plasmodium falciparum
IKNKDEEITKEEIKKEDNNITNDEINKEENNITK

SEQ ID NO: 3315952 - protein, 8 aa, Plasmodium falciparum
IKNKDEGI

SEQ ID NO: 3315953 - protein, 9 aa, Plasmodium falciparum
IKNKDTQNE

SEQ ID NO: 3315954 - protein, 12 aa, Plasmodium falciparum
IKNKKAPQIIVK

SEQ ID NO: 3315955 - protein, 113 aa, Plasmodium falciparum
IKNKNDDNEGDDNEGDDDEGDDDNEGDDDNEGDDDEGDDDEGDDDEGDDDNEGDDDNEGDDDNEGDDDNEGDDNNDDSDNNDDSDNNDDSDNNDHSDNNDHSDYNDDNGLDKS

SEQ ID NO: 3315956 - protein, 15 aa, Plasmodium falciparum
IKNKNEIDARNYSGR

SEQ ID NO: 3315957 - protein, 9 aa, Plasmodium falciparum
IKNKNEKEE

SEQ ID NO: 3315958 - protein, 20 aa, Plasmodium falciparum
IKNKNKKLNNKLKENQNNYE

SEQ ID NO: 3315959 - protein, 9 aa, Plasmodium falciparum
IKNKNNDQT

SEQ ID NO: 3315960 - protein, 8 aa, Plasmodium falciparum
IKNKNSVS

SEQ ID NO: 3315961 - protein, 18 aa, Plasmodium falciparum
IKNKSDNTNEEIKKKKEF

SEQ ID NO: 3315962 - protein, 11 aa, Plasmodium falciparum
IKNKSENNTCD

SEQ ID NO: 3315963 - protein, 14 aa, Plasmodium falciparum
IKNKTRDSSYIRNE

SEQ ID NO: 3315964 - protein, 5 aa, Plasmodium falciparum
IKNLS

SEQ ID NO: 3315965 - protein, 4 aa, Plasmodium falciparum
IKNN

SEQ ID NO: 3315966 - protein, 8 aa, Plasmodium falciparum
IKNNDDKQ

SEQ ID NO: 3315967 - protein, 6 aa, Plasmodium falciparum
IKNNDK

SEQ ID NO: 3315968 - protein, 27 aa, Plasmodium falciparum
IKNNDVKDTNKKKEKFEKYKNDDNKKK

SEQ ID NO: 3315969 - protein, 6 aa, Plasmodium falciparum
IKNNEE

SEQ ID NO: 3315970 - protein, 6 aa, Plasmodium falciparum
IKNNEI

SEQ ID NO: 3315971 - protein, 33 aa, Plasmodium falciparum
IKNNENISETIKSEDDKNLISNKSNSLSNQTCK

SEQ ID NO: 3315972 - protein, 13 aa, Plasmodium falciparum
IKNNESESNNYKK

SEQ ID NO: 3315973 - protein, 12 aa, Plasmodium falciparum
IKNNKIKNNIIK

SEQ ID NO: 3315974 - protein, 8 aa, Plasmodium falciparum
IKNNKNDY

SEQ ID NO: 3315975 - protein, 29 aa, Plasmodium falciparum
IKNNKTHRKAGRQKRDESITSTDSSSIYN

SEQ ID NO: 3315976 - protein, 5 aa, Plasmodium falciparum
IKNNN

SEQ ID NO: 3315977 - protein, 14 aa, Plasmodium falciparum
IKNNNENADSNKKY

SEQ ID NO: 3315978 - protein, 9 aa, Plasmodium falciparum
IKNNNNIDH

SEQ ID NO: 3315979 - protein, 29 aa, Plasmodium falciparum
IKNNNNNNYQDDNEVNKKNIKSGDIPKDD

SEQ ID NO: 3315980 - protein, 6 aa, Plasmodium falciparum
IKNNQD

SEQ ID NO: 3315981 - protein, 14 aa, Plasmodium falciparum
IKNNQKNKSYSISS

SEQ ID NO: 3315982 - protein, 8 aa, Plasmodium falciparum
IKNNSNDK

SEQ ID NO: 3315983 - protein, 16 aa, Plasmodium falciparum
IKNNTKKDMDNENNNM

SEQ ID NO: 3315984 - protein, 15 aa, Plasmodium falciparum
IKNPSSAAGTQRSPY

SEQ ID NO: 3315985 - protein, 15 aa, Plasmodium falciparum
IKNQKKNNNSKNSSH

SEQ ID NO: 3315986 - protein, 8 aa, Plasmodium falciparum
IKNQSGAI

SEQ ID NO: 3315987 - protein, 11 aa, Plasmodium falciparum
IKNRKNTQNEN

SEQ ID NO: 3315988 - protein, 5 aa, Plasmodium falciparum
IKNRN

SEQ ID NO: 3315989 - protein, 20 aa, Plasmodium falciparum
IKNRNNNNKTVERNISNGTN

SEQ ID NO: 3315990 - protein, 7 aa, Plasmodium falciparum
IKNRPEI

SEQ ID NO: 3315991 - protein, 8 aa, Plasmodium falciparum
IKNRPSSK

SEQ ID NO: 3315992 - protein, 4 aa, Plasmodium falciparum
IKNS

SEQ ID NO: 3315993 - protein, 33 aa, Plasmodium falciparum
IKNSDEQNNSNNNNNNSSSSNFCSNNNSPFSHK

SEQ ID NO: 3315994 - protein, 5 aa, Plasmodium falciparum
IKNSI

SEQ ID NO: 3315995 - protein, 5 aa, Plasmodium falciparum
IKNSN

SEQ ID NO: 3315996 - protein, 15 aa, Plasmodium falciparum
IKNSNSSGNKKEEKN

SEQ ID NO: 3315997 - protein, 10 aa, Plasmodium falciparum
IKNSSSCDEK

SEQ ID NO: 3315998 - protein, 6 aa, Plasmodium falciparum
IKNSTT

SEQ ID NO: 3315999 - protein, 4 aa, Plasmodium falciparum
IKNT

SEQ ID NO: 3316000 - protein, 16 aa, Plasmodium falciparum
IKNTNNKEEEGKKKNL

SEQ ID NO: 3316001 - protein, 9 aa, Plasmodium falciparum
IKNTNQNTE

SEQ ID NO: 3316002 - protein, 11 aa, Plasmodium falciparum
IKNTSGNSNYE

SEQ ID NO: 3316003 - protein, 7 aa, Plasmodium falciparum
IKNTTRN

SEQ ID NO: 3316004 - protein, 4 aa, Plasmodium falciparum
IKNV

SEQ ID NO: 3316005 - protein, 6 aa, Plasmodium falciparum
IKNYED

SEQ ID NO: 3316006 - protein, 12 aa, Plasmodium falciparum
IKNYENKKRNDK

SEQ ID NO: 3316007 - protein, 6 aa, Plasmodium falciparum
IKPANY

SEQ ID NO: 3316008 - protein, 7 aa, Plasmodium falciparum
IKPEKKS

SEQ ID NO: 3316009 - protein, 11 aa, Plasmodium falciparum
IKPKEKYNDDT

SEQ ID NO: 3316010 - protein, 4 aa, Plasmodium falciparum
IKPL

SEQ ID NO: 3316011 - protein, 5 aa, Plasmodium falciparum
IKPLQ

SEQ ID NO: 3316012 - protein, 5 aa, Plasmodium falciparum
IKPND

SEQ ID NO: 3316013 - protein, 4 aa, Plasmodium falciparum
IKPP

SEQ ID NO: 3316014 - protein, 8 aa, Plasmodium falciparum
IKPSKEDI

SEQ ID NO: 3316015 - protein, 19 aa, Plasmodium falciparum
IKPSKLGETFSKHNNKESI

SEQ ID NO: 3316016 - protein, 7 aa, Plasmodium falciparum
IKPSYGK

SEQ ID NO: 3316017 - protein, 5 aa, Plasmodium falciparum
IKPTH

SEQ ID NO: 3316018 - protein, 11 aa, Plasmodium falciparum
IKPYSSNESDM

SEQ ID NO: 3316019 - protein, 4 aa, Plasmodium falciparum
IKQD

SEQ ID NO: 3316020 - protein, 16 aa, Plasmodium falciparum
IKQDLPEETCKKEDNI

SEQ ID NO: 3316021 - protein, 6 aa, Plasmodium falciparum
IKQEQH

SEQ ID NO: 3316022 - protein, 7 aa, Plasmodium falciparum
IKQKEDA

SEQ ID NO: 3316023 - protein, 7 aa, Plasmodium falciparum
IKQKKTN

SEQ ID NO: 3316024 - protein, 23 aa, Plasmodium falciparum
IKQNNNIYNNNGNNDNNDNNNND

SEQ ID NO: 3316025 - protein, 11 aa, Plasmodium falciparum
IKQNNNTKDIM

SEQ ID NO: 3316026 - protein, 9 aa, Plasmodium falciparum
IKQRKEKDV

SEQ ID NO: 3316027 - protein, 14 aa, Plasmodium falciparum
IKQSNDKNISTTNE

SEQ ID NO: 3316028 - protein, 6 aa, Plasmodium falciparum
IKQTNI

SEQ ID NO: 3316029 - protein, 4 aa, Plasmodium falciparum
IKRC

SEQ ID NO: 3316030 - protein, 7 aa, Plasmodium falciparum
IKRDSNK

SEQ ID NO: 3316031 - protein, 12 aa, Plasmodium falciparum
IKREDTENKNEM

SEQ ID NO: 3316032 - protein, 9 aa, Plasmodium falciparum
IKREEEKKK

SEQ ID NO: 3316033 - protein, 6 aa, Plasmodium falciparum
IKREKV

SEQ ID NO: 3316034 - protein, 9 aa, Plasmodium falciparum
IKRESNQKF

SEQ ID NO: 3316035 - protein, 8 aa, Plasmodium falciparum
IKRGDEND

SEQ ID NO: 3316036 - protein, 7 aa, Plasmodium falciparum
IKRGSKV

SEQ ID NO: 3316037 - protein, 11 aa, Plasmodium falciparum
IKRKDEGGKNY

SEQ ID NO: 3316038 - protein, 6 aa, Plasmodium falciparum
IKRKPN

SEQ ID NO: 3316039 - protein, 13 aa, Plasmodium falciparum
IKRNKKSLSEENL

SEQ ID NO: 3316040 - protein, 7 aa, Plasmodium falciparum
IKRRDDQ

SEQ ID NO: 3316041 - protein, 9 aa, Plasmodium falciparum
IKRRTRSRE

SEQ ID NO: 3316042 - protein, 10 aa, Plasmodium falciparum
IKRSVKKNKP

SEQ ID NO: 3316043 - protein, 7 aa, Plasmodium falciparum
IKSASRS

SEQ ID NO: 3316044 - protein, 4 aa, Plasmodium falciparum
IKSD

SEQ ID NO: 3316045 - protein, 6 aa, Plasmodium falciparum
IKSDDN

SEQ ID NO: 3316046 - protein, 18 aa, Plasmodium falciparum
IKSDQNIYEKKNKSIDDE

SEQ ID NO: 3316047 - protein, 9 aa, Plasmodium falciparum
IKSEDEYIE

SEQ ID NO: 3316048 - protein, 8 aa, Plasmodium falciparum
IKSEQNNV

SEQ ID NO: 3316049 - protein, 8 aa, Plasmodium falciparum
IKSETNEL

SEQ ID NO: 3316050 - protein, 14 aa, Plasmodium falciparum
IKSGEKKEKDTDKI

SEQ ID NO: 3316051 - protein, 9 aa, Plasmodium falciparum
IKSGNTLSE

SEQ ID NO: 3316052 - protein, 20 aa, Plasmodium falciparum
IKSITNNNNNNNDNDNNINN

SEQ ID NO: 3316053 - protein, 4 aa, Plasmodium falciparum
IKSK

SEQ ID NO: 3316054 - protein, 6 aa, Plasmodium falciparum
IKSKDD

SEQ ID NO: 3316055 - protein, 9 aa, Plasmodium falciparum
IKSKDDEIE

SEQ ID NO: 3316056 - protein, 10 aa, Plasmodium falciparum
IKSKEKKIKE

SEQ ID NO: 3316057 - protein, 7 aa, Plasmodium falciparum
IKSKEQP

SEQ ID NO: 3316058 - protein, 6 aa, Plasmodium falciparum
IKSKGE

SEQ ID NO: 3316059 - protein, 11 aa, Plasmodium falciparum
IKSKKENEQKN

SEQ ID NO: 3316060 - protein, 37 aa, Plasmodium falciparum
IKSKNKKKKKGYPNKDKSYSNSSKNINSNSNVDSKQI

SEQ ID NO: 3316061 - protein, 9 aa, Plasmodium falciparum
IKSKRKKNE

SEQ ID NO: 3316062 - protein, 6 aa, Plasmodium falciparum
IKSKSY

SEQ ID NO: 3316063 - protein, 6 aa, Plasmodium falciparum
IKSMKG

SEQ ID NO: 3316064 - protein, 12 aa, Plasmodium falciparum
IKSNEEKTQNSL

SEQ ID NO: 3316065 - protein, 14 aa, Plasmodium falciparum
IKSNEESDKSSTKN

SEQ ID NO: 3316066 - protein, 15 aa, Plasmodium falciparum
IKSNGLKSSGIKSSG

SEQ ID NO: 3316067 - protein, 10 aa, Plasmodium falciparum
IKSNKNKESI

SEQ ID NO: 3316068 - protein, 14 aa, Plasmodium falciparum
IKSNNNNNNNNDNN

SEQ ID NO: 3316069 - protein, 57 aa, Plasmodium falciparum
IKSNNTTTTTNNNNNNNNNNNNKNSSSSNNNNNNKNSSSSNNSNNCYSPNESYHTNN

SEQ ID NO: 3316070 - protein, 8 aa, Plasmodium falciparum
IKSNTYKS

SEQ ID NO: 3316071 - protein, 4 aa, Plasmodium falciparum
IKSP

SEQ ID NO: 3316072 - protein, 11 aa, Plasmodium falciparum
IKSPAKNKTKM

SEQ ID NO: 3316073 - protein, 15 aa, Plasmodium falciparum
IKSPGLEKKNFKKSN

SEQ ID NO: 3316074 - protein, 5 aa, Plasmodium falciparum
IKSPK

SEQ ID NO: 3316075 - protein, 12 aa, Plasmodium falciparum
IKSPPKKDEENV

SEQ ID NO: 3316076 - protein, 10 aa, Plasmodium falciparum
IKSQNESING

SEQ ID NO: 3316077 - protein, 4 aa, Plasmodium falciparum
IKSS

SEQ ID NO: 3316078 - protein, 14 aa, Plasmodium falciparum
IKSSAKDKNQSDEK

SEQ ID NO: 3316079 - protein, 6 aa, Plasmodium falciparum
IKSSFE

SEQ ID NO: 3316080 - protein, 8 aa, Plasmodium falciparum
IKSSQQDC

SEQ ID NO: 3316081 - protein, 5 aa, Plasmodium falciparum
IKSSS

SEQ ID NO: 3316082 - protein, 11 aa, Plasmodium falciparum
IKSTQKKKTHK

SEQ ID NO: 3316083 - protein, 7 aa, Plasmodium falciparum
IKSTTHN

SEQ ID NO: 3316084 - protein, 11 aa, Plasmodium falciparum
IKSTTKKDKIE

SEQ ID NO: 3316085 - protein, 23 aa, Plasmodium falciparum
IKSTTSTISTSSSITTHAGPIRN

SEQ ID NO: 3316086 - protein, 5 aa, Plasmodium falciparum
IKSYK

SEQ ID NO: 3316087 - protein, 27 aa, Plasmodium falciparum
IKTDDSSDNYKSSRKKKKKKKKNMNIK

SEQ ID NO: 3316088 - protein, 6 aa, Plasmodium falciparum
IKTDER

SEQ ID NO: 3316089 - protein, 7 aa, Plasmodium falciparum
IKTDKQT

SEQ ID NO: 3316090 - protein, 11 aa, Plasmodium falciparum
IKTDKRQIHEG

SEQ ID NO: 3316091 - protein, 12 aa, Plasmodium falciparum
IKTENSNNDTSL

SEQ ID NO: 3316092 - protein, 13 aa, Plasmodium falciparum
IKTKEENEGNNIE

SEQ ID NO: 3316093 - protein, 12 aa, Plasmodium falciparum
IKTKKDINKNNV

SEQ ID NO: 3316094 - protein, 11 aa, Plasmodium falciparum
IKTKMNNSKPF

SEQ ID NO: 3316095 - protein, 13 aa, Plasmodium falciparum
IKTKNADYKYNNQ

SEQ ID NO: 3316096 - protein, 8 aa, Plasmodium falciparum
IKTKNSKE

SEQ ID NO: 3316097 - protein, 13 aa, Plasmodium falciparum
IKTKRKCSQEKTI

SEQ ID NO: 3316098 - protein, 5 aa, Plasmodium falciparum
IKTKT

SEQ ID NO: 3316099 - protein, 9 aa, Plasmodium falciparum
IKTNAPKGI

SEQ ID NO: 3316100 - protein, 9 aa, Plasmodium falciparum
IKTNEDSSL

SEQ ID NO: 3316101 - protein, 12 aa, Plasmodium falciparum
IKTNKKYNNNIN

SEQ ID NO: 3316102 - protein, 10 aa, Plasmodium falciparum
IKTNNSTVNK

SEQ ID NO: 3316103 - protein, 38 aa, Plasmodium falciparum
IKTPGRGRGKGKGKGRGRGKGKGNGRGRRRGKGRNRGR

SEQ ID NO: 3316104 - protein, 5 aa, Plasmodium falciparum
IKTPK

SEQ ID NO: 3316105 - protein, 22 aa, Plasmodium falciparum
IKTPTELNEKQDAYLKDKNNPI

SEQ ID NO: 3316106 - protein, 8 aa, Plasmodium falciparum
IKTQQQIQ

SEQ ID NO: 3316107 - protein, 9 aa, Plasmodium falciparum
IKTSGSSNE

SEQ ID NO: 3316108 - protein, 6 aa, Plasmodium falciparum
IKTSKN

SEQ ID NO: 3316109 - protein, 7 aa, Plasmodium falciparum
IKTTQSY

SEQ ID NO: 3316110 - protein, 5 aa, Plasmodium falciparum
IKTTT

SEQ ID NO: 3316111 - protein, 4 aa, Plasmodium falciparum
IKYD

SEQ ID NO: 3316112 - protein, 13 aa, Plasmodium falciparum
IKYDNTDDDNYNY

SEQ ID NO: 3316113 - protein, 5 aa, Plasmodium falciparum
IKYEN

SEQ ID NO: 3316114 - protein, 31 aa, Plasmodium falciparum
IKYEQNGDNKKKELYNNDSSMDDKDYKKNED

SEQ ID NO: 3316115 - protein, 4 aa, Plasmodium falciparum
IKYN

SEQ ID NO: 3316116 - protein, 9 aa, Plasmodium falciparum
IKYPSNNIY

SEQ ID NO: 3316117 - protein, 67 aa, Plasmodium falciparum
IKYSDDNKYNDDNKYNDDNKYNDDNKYNDDNKYNDDNKYNDDNKYNDDNKYNDDNKYNDDNKYNDDN

SEQ ID NO: 3316118 - protein, 4 aa, Plasmodium falciparum
ILNN

SEQ ID NO: 3316119 - protein, 17 aa, Plasmodium falciparum
ILNPPNRTKMSKGERRA

SEQ ID NO: 3316120 - protein, 19 aa, Plasmodium falciparum
ILPNKKRKYPEDTGSNDIN

SEQ ID NO: 3316121 - protein, 47 aa, Plasmodium falciparum
IMEEKRKTKTKVDDKAKTKNDTHINEKKKKKRNENNKVDTKKSVENF

SEQ ID NO: 3316122 - protein, 25 aa, Plasmodium falciparum
IMKEGKEKKHSNDINEHNNIEGSLS

SEQ ID NO: 3316123 - protein, 4 aa, Plasmodium falciparum
IMTP

SEQ ID NO: 3316124 - protein, 8 aa, Plasmodium falciparum
INAESYDG

SEQ ID NO: 3316125 - protein, 11 aa, Plasmodium falciparum
INAQPKTNYSF

SEQ ID NO: 3316126 - protein, 4 aa, Plasmodium falciparum
INAS

SEQ ID NO: 3316127 - protein, 11 aa, Plasmodium falciparum
INATDDNKNNL

SEQ ID NO: 3316128 - protein, 4 aa, Plasmodium falciparum
INDD

SEQ ID NO: 3316129 - protein, 29 aa, Plasmodium falciparum
INDDDDDNINHNNNNYGEEYQPASDRSKA

SEQ ID NO: 3316130 - protein, 11 aa, Plasmodium falciparum
INDDDKDEKEI

SEQ ID NO: 3316131 - protein, 11 aa, Plasmodium falciparum
INDDDKNYNRY

SEQ ID NO: 3316132 - protein, 10 aa, Plasmodium falciparum
INDDDNNNYY

SEQ ID NO: 3316133 - protein, 7 aa, Plasmodium falciparum
INDDEQI

SEQ ID NO: 3316134 - protein, 11 aa, Plasmodium falciparum
INDDKAMEQSE

SEQ ID NO: 3316135 - protein, 11 aa, Plasmodium falciparum
INDDKNMTTDI

SEQ ID NO: 3316136 - protein, 29 aa, Plasmodium falciparum
INDDNKYSNNYVKSEDSISLDDKSYDAGF

SEQ ID NO: 3316137 - protein, 29 aa, Plasmodium falciparum
INDDQDEKLNSSKKKKKKKKKKPNKEIAE

SEQ ID NO: 3316138 - protein, 4 aa, Plasmodium falciparum
INDE

SEQ ID NO: 3316139 - protein, 7 aa, Plasmodium falciparum
INDEDLK

SEQ ID NO: 3316140 - protein, 10 aa, Plasmodium falciparum
INDEDSAAEY

SEQ ID NO: 3316141 - protein, 25 aa, Plasmodium falciparum
INDEEKNKEIKKNEKIGEEAPNNSM

SEQ ID NO: 3316142 - protein, 9 aa, Plasmodium falciparum
INDEEKTEE

SEQ ID NO: 3316143 - protein, 69 aa, Plasmodium falciparum
INDEGEKIKDEKKYKEEGEQEKSEELPKEEKKGGKRRGRKKQTDDKKNDDDNDQNENYKINDQSQTTLN

SEQ ID NO: 3316144 - protein, 11 aa, Plasmodium falciparum
INDEGTSEIND

SEQ ID NO: 3316145 - protein, 15 aa, Plasmodium falciparum
INDEHNDKNKEKDLD

SEQ ID NO: 3316146 - protein, 8 aa, Plasmodium falciparum
INDEINDE

SEQ ID NO: 3316147 - protein, 7 aa, Plasmodium falciparum
INDENDI

SEQ ID NO: 3316148 - protein, 6 aa, Plasmodium falciparum
INDENI

SEQ ID NO: 3316149 - protein, 7 aa, Plasmodium falciparum
INDGNKK

SEQ ID NO: 3316150 - protein, 22 aa, Plasmodium falciparum
INDGSDDLETYKKNSSINDEEP

SEQ ID NO: 3316151 - protein, 45 aa, Plasmodium falciparum
INDGTQNNNDNNNDNNDNNDNNNDNNNDNNNDNNNDNNNNNNNND

SEQ ID NO: 3316152 - protein, 4 aa, Plasmodium falciparum
INDI

SEQ ID NO: 3316153 - protein, 5 aa, Plasmodium falciparum
INDKN

SEQ ID NO: 3316154 - protein, 10 aa, Plasmodium falciparum
INDKTLQEEV

SEQ ID NO: 3316155 - protein, 4 aa, Plasmodium falciparum
INDN

SEQ ID NO: 3316156 - protein, 5 aa, Plasmodium falciparum
INDNA

SEQ ID NO: 3316157 - protein, 10 aa, Plasmodium falciparum
INDNDEHNNF

SEQ ID NO: 3316158 - protein, 8 aa, Plasmodium falciparum
INDNINDN

SEQ ID NO: 3316159 - protein, 29 aa, Plasmodium falciparum
INDNKKGYKIDSQNNSELSQINKKKNQII

SEQ ID NO: 3316160 - protein, 13 aa, Plasmodium falciparum
INDNNNNNNNNYN

SEQ ID NO: 3316161 - protein, 10 aa, Plasmodium falciparum
INDNNSINDA

SEQ ID NO: 3316162 - protein, 63 aa, Plasmodium falciparum
INDNPNSRDNPNDRDNLNNNDNPNINDNPNNNDNPNNNDNPNNNDNPNNNDNPNNNDNPNINE

SEQ ID NO: 3316163 - protein, 4 aa, Plasmodium falciparum
INDP

SEQ ID NO: 3316164 - protein, 5 aa, Plasmodium falciparum
INDQN

SEQ ID NO: 3316165 - protein, 5 aa, Plasmodium falciparum
INDQS

SEQ ID NO: 3316166 - protein, 6 aa, Plasmodium falciparum
INDQSD

SEQ ID NO: 3316167 - protein, 4 aa, Plasmodium falciparum
INDS

SEQ ID NO: 3316168 - protein, 9 aa, Plasmodium falciparum
INDSEKKEK

SEQ ID NO: 3316169 - protein, 13 aa, Plasmodium falciparum
INDSNESINGEVE

SEQ ID NO: 3316170 - protein, 14 aa, Plasmodium falciparum
INDSPKNFWKFDFF

SEQ ID NO: 3316171 - protein, 13 aa, Plasmodium falciparum
INDTKEDALPRNE

SEQ ID NO: 3316172 - protein, 5 aa, Plasmodium falciparum
INDTN

SEQ ID NO: 3316173 - protein, 14 aa, Plasmodium falciparum
INDTNDTNDTNNIN

SEQ ID NO: 3316174 - protein, 22 aa, Plasmodium falciparum
INDTNNTNDTNNINNINDKSNI

SEQ ID NO: 3316175 - protein, 10 aa, Plasmodium falciparum
INDTSDDVNY

SEQ ID NO: 3316176 - protein, 7 aa, Plasmodium falciparum
INDTSNN

SEQ ID NO: 3316177 - protein, 21 aa, Plasmodium falciparum
INDVKRSKQEINESNESLDER

SEQ ID NO: 3316178 - protein, 12 aa, Plasmodium falciparum
INDYNKKGNMSD

SEQ ID NO: 3316179 - protein, 15 aa, Plasmodium falciparum
INECDNNGKEVDEDK

SEQ ID NO: 3316180 - protein, 12 aa, Plasmodium falciparum
INEDEHETSNDD

SEQ ID NO: 3316181 - protein, 24 aa, Plasmodium falciparum
INEDEVNSKGDENTKKTENTINDK

SEQ ID NO: 3316182 - protein, 12 aa, Plasmodium falciparum
INEDKKDPLSQE

SEQ ID NO: 3316183 - protein, 12 aa, Plasmodium falciparum
INEDKNNYNMSD

SEQ ID NO: 3316184 - protein, 7 aa, Plasmodium falciparum
INEDNTK

SEQ ID NO: 3316185 - protein, 6 aa, Plasmodium falciparum
INEDRK

SEQ ID NO: 3316186 - protein, 16 aa, Plasmodium falciparum
INEEDKKDELKKYTEG

SEQ ID NO: 3316187 - protein, 25 aa, Plasmodium falciparum
INEEEEEEEESSSLKLGERKKKKNA

SEQ ID NO: 3316188 - protein, 6 aa, Plasmodium falciparum
INEEGD

SEQ ID NO: 3316189 - protein, 7 aa, Plasmodium falciparum
INEEGEQ

SEQ ID NO: 3316190 - protein, 7 aa, Plasmodium falciparum
INEEGKR

SEQ ID NO: 3316191 - protein, 166 aa, Plasmodium falciparum
INEEKEEKFYKDKKKEKNNKKKEKGKKRNQENEEKEMNKEKKKEKEKEKEKEKEKENKKERNKEKKKEKEKEKEKEKENKKERNKEKKKEKEKEKEKEKEKEKENKKERNKEKEKNKKIEKKNRKEENYTENKYEEEKDKKKMEKDNIKKDKHKKNDNHKKSDKDI

SEQ ID NO: 3316192 - protein, 14 aa, Plasmodium falciparum
INEEKKKKKKKNIN

SEQ ID NO: 3316193 - protein, 33 aa, Plasmodium falciparum
INEEKYKDNNISSNNTQYNNNSSNSGSLNDEGP

SEQ ID NO: 3316194 - protein, 9 aa, Plasmodium falciparum
INEENEEIK

SEQ ID NO: 3316195 - protein, 8 aa, Plasmodium falciparum
INEENENI

SEQ ID NO: 3316196 - protein, 10 aa, Plasmodium falciparum
INEESDDNVE

SEQ ID NO: 3316197 - protein, 13 aa, Plasmodium falciparum
INEEYNKEKEINS

SEQ ID NO: 3316198 - protein, 14 aa, Plasmodium falciparum
INEGEKKTFEENKS

SEQ ID NO: 3316199 - protein, 9 aa, Plasmodium falciparum
INEGGSSQK

SEQ ID NO: 3316200 - protein, 10 aa, Plasmodium falciparum
INEGHQKEKL

SEQ ID NO: 3316201 - protein, 105 aa, Plasmodium falciparum
INEHKGNNTNEHKGNNTNEHKGNNTNEHKGNGTNEHKGNNTNDHKGNNTNEHKGNYTNEHKGNDTNEHKGNDTKELQNESRNHNRDERRKENIDEHKNDNKNGYK

SEQ ID NO: 3316202 - protein, 6 aa, Plasmodium falciparum
INEKAN

SEQ ID NO: 3316203 - protein, 6 aa, Plasmodium falciparum
INEKEK

SEQ ID NO: 3316204 - protein, 6 aa, Plasmodium falciparum
INEKHT

SEQ ID NO: 3316205 - protein, 22 aa, Plasmodium falciparum
INEKINEEDNKNDNEEEKNDHR

SEQ ID NO: 3316206 - protein, 10 aa, Plasmodium falciparum
INEKKNSYDI

SEQ ID NO: 3316207 - protein, 5 aa, Plasmodium falciparum
INEKN

SEQ ID NO: 3316208 - protein, 6 aa, Plasmodium falciparum
INEKNK

SEQ ID NO: 3316209 - protein, 10 aa, Plasmodium falciparum
INEKNKKNKY

SEQ ID NO: 3316210 - protein, 12 aa, Plasmodium falciparum
INEKNNDDIQND

SEQ ID NO: 3316211 - protein, 5 aa, Plasmodium falciparum
INEKQ

SEQ ID NO: 3316212 - protein, 29 aa, Plasmodium falciparum
INEKSNLKNSSHMDTNKNEENMSDDEKKK

SEQ ID NO: 3316213 - protein, 5 aa, Plasmodium falciparum
INEKY

SEQ ID NO: 3316214 - protein, 4 aa, Plasmodium falciparum
INEM

SEQ ID NO: 3316215 - protein, 13 aa, Plasmodium falciparum
INENANNANKELS

SEQ ID NO: 3316216 - protein, 27 aa, Plasmodium falciparum
INENDNIKYDDKNLSNINSEEDKNNKK

SEQ ID NO: 3316217 - protein, 6 aa, Plasmodium falciparum
INENGG

SEQ ID NO: 3316218 - protein, 14 aa, Plasmodium falciparum
INENITSKKEEQNI

SEQ ID NO: 3316219 - protein, 8 aa, Plasmodium falciparum
INENKKDE

SEQ ID NO: 3316220 - protein, 23 aa, Plasmodium falciparum
INENKNKENITNTNDDEKEKETM

SEQ ID NO: 3316221 - protein, 8 aa, Plasmodium falciparum
INENKQKI

SEQ ID NO: 3316222 - protein, 9 aa, Plasmodium falciparum
INENKTHVN

SEQ ID NO: 3316223 - protein, 11 aa, Plasmodium falciparum
INENNKKKDNF

SEQ ID NO: 3316224 - protein, 6 aa, Plasmodium falciparum
INENNN

SEQ ID NO: 3316225 - protein, 46 aa, Plasmodium falciparum
INENNNKKNNDDNNKKNNDDDDNNNNNNDDDDNNNNNNNNNNNNNN

SEQ ID NO: 3316226 - protein, 10 aa, Plasmodium falciparum
INENNSMEDT

SEQ ID NO: 3316227 - protein, 11 aa, Plasmodium falciparum
INENNSPNKCS

SEQ ID NO: 3316228 - protein, 7 aa, Plasmodium falciparum
INENSDF

SEQ ID NO: 3316229 - protein, 14 aa, Plasmodium falciparum
INENSKQNNNRNKE

SEQ ID NO: 3316230 - protein, 10 aa, Plasmodium falciparum
INENYKGNTF

SEQ ID NO: 3316231 - protein, 7 aa, Plasmodium falciparum
INEPNTN

SEQ ID NO: 3316232 - protein, 7 aa, Plasmodium falciparum
INEPSSI

SEQ ID NO: 3316233 - protein, 6 aa, Plasmodium falciparum
INEQEN

SEQ ID NO: 3316234 - protein, 6 aa, Plasmodium falciparum
INEQRN

SEQ ID NO: 3316235 - protein, 52 aa, Plasmodium falciparum
INEQSEGSNLPSEQNKRRRSVKTKSYLSNESPTRKQPRRSCKEHTSLNENAN

SEQ ID NO: 3316236 - protein, 17 aa, Plasmodium falciparum
INERHKPKYNPQQNKEH

SEQ ID NO: 3316237 - protein, 31 aa, Plasmodium falciparum
INESGHMSNDNINKNQEKNKKKKKKKNTHKK

SEQ ID NO: 3316238 - protein, 11 aa, Plasmodium falciparum
INESKEPKNIK

SEQ ID NO: 3316239 - protein, 17 aa, Plasmodium falciparum
INESSDYANLSKNTEYD

SEQ ID NO: 3316240 - protein, 11 aa, Plasmodium falciparum
INETKDEHTCS

SEQ ID NO: 3316241 - protein, 11 aa, Plasmodium falciparum
INETSSENENM

SEQ ID NO: 3316242 - protein, 9 aa, Plasmodium falciparum
INEYENDEN

SEQ ID NO: 3316243 - protein, 4 aa, Plasmodium falciparum
INFS

SEQ ID NO: 3316244 - protein, 11 aa, Plasmodium falciparum
INGDDDKENHV

SEQ ID NO: 3316245 - protein, 9 aa, Plasmodium falciparum
INGEKQPTI

SEQ ID NO: 3316246 - protein, 13 aa, Plasmodium falciparum
INGEPSTSVENIT

SEQ ID NO: 3316247 - protein, 5 aa, Plasmodium falciparum
INGEQ

SEQ ID NO: 3316248 - protein, 7 aa, Plasmodium falciparum
INGGSID

SEQ ID NO: 3316249 - protein, 13 aa, Plasmodium falciparum
INGIENKDNTKIE

SEQ ID NO: 3316250 - protein, 9 aa, Plasmodium falciparum
INGNESYPQ

SEQ ID NO: 3316251 - protein, 9 aa, Plasmodium falciparum
INGNGKRCS

SEQ ID NO: 3316252 - protein, 13 aa, Plasmodium falciparum
INGNSNKSQKYGT

SEQ ID NO: 3316253 - protein, 6 aa, Plasmodium falciparum
INGPSL

SEQ ID NO: 3316254 - protein, 19 aa, Plasmodium falciparum
INGRNKEHVNEKNKEEDTF

SEQ ID NO: 3316255 - protein, 11 aa, Plasmodium falciparum
INGSEKNNFVD

SEQ ID NO: 3316256 - protein, 4 aa, Plasmodium falciparum
INGT

SEQ ID NO: 3316257 - protein, 57 aa, Plasmodium falciparum
INGTNNNNNNNNNNNNNNNNNNNNNNINRNNVSDNSTNIVDNDSYDKTNNSSNGSMY

SEQ ID NO: 3316258 - protein, 15 aa, Plasmodium falciparum
INGTNQSVNRKKNMD

SEQ ID NO: 3316259 - protein, 16 aa, Plasmodium falciparum
INHDKYSYDDKNINDD

SEQ ID NO: 3316260 - protein, 11 aa, Plasmodium falciparum
INHKATNTNYK

SEQ ID NO: 3316261 - protein, 4 aa, Plasmodium falciparum
INHN

SEQ ID NO: 3316262 - protein, 6 aa, Plasmodium falciparum
INHNNN

SEQ ID NO: 3316263 - protein, 16 aa, Plasmodium falciparum
INHNNNNNNNNNNNNY

SEQ ID NO: 3316264 - protein, 6 aa, Plasmodium falciparum
INHTNG

SEQ ID NO: 3316265 - protein, 12 aa, Plasmodium falciparum
ININNGQSTNNN

SEQ ID NO: 3316266 - protein, 6 aa, Plasmodium falciparum
ININNK

SEQ ID NO: 3316267 - protein, 4 aa, Plasmodium falciparum
INIP

SEQ ID NO: 3316268 - protein, 18 aa, Plasmodium falciparum
INIPRGKAEKYDENESNR

SEQ ID NO: 3316269 - protein, 15 aa, Plasmodium falciparum
INIQDDANDLEKKQD

SEQ ID NO: 3316270 - protein, 17 aa, Plasmodium falciparum
INISKSDDNIKNDKKKY

SEQ ID NO: 3316271 - protein, 12 aa, Plasmodium falciparum
INISPDKRRKFD

SEQ ID NO: 3316272 - protein, 12 aa, Plasmodium falciparum
INKDINKGINKD

SEQ ID NO: 3316273 - protein, 6 aa, Plasmodium falciparum
INKDLE

SEQ ID NO: 3316274 - protein, 12 aa, Plasmodium falciparum
INKDMTTNSTPH

SEQ ID NO: 3316275 - protein, 7 aa, Plasmodium falciparum
INKDNEK

SEQ ID NO: 3316276 - protein, 18 aa, Plasmodium falciparum
INKDNKKKKKLSNAAETD

SEQ ID NO: 3316277 - protein, 28 aa, Plasmodium falciparum
INKDNNKHNYKENQFSADYTNRGRNDEK

SEQ ID NO: 3316278 - protein, 8 aa, Plasmodium falciparum
INKDQTDI

SEQ ID NO: 3316279 - protein, 7 aa, Plasmodium falciparum
INKDYNN

SEQ ID NO: 3316280 - protein, 8 aa, Plasmodium falciparum
INKEASKR

SEQ ID NO: 3316281 - protein, 26 aa, Plasmodium falciparum
INKEHNSEKTDTRNEINNTKNNDTKI

SEQ ID NO: 3316282 - protein, 13 aa, Plasmodium falciparum
INKEKNKSFEASP

SEQ ID NO: 3316283 - protein, 10 aa, Plasmodium falciparum
INKEKNQNKH

SEQ ID NO: 3316284 - protein, 17 aa, Plasmodium falciparum
INKEQKDEDIKKEDQGM

SEQ ID NO: 3316285 - protein, 10 aa, Plasmodium falciparum
INKGEQNNIP

SEQ ID NO: 3316286 - protein, 5 aa, Plasmodium falciparum
INKGI

SEQ ID NO: 3316287 - protein, 9 aa, Plasmodium falciparum
INKGNQRGY

SEQ ID NO: 3316288 - protein, 10 aa, Plasmodium falciparum
INKGYKDKEH

SEQ ID NO: 3316289 - protein, 10 aa, Plasmodium falciparum
INKGYQENKN

SEQ ID NO: 3316290 - protein, 6 aa, Plasmodium falciparum
INKHEN

SEQ ID NO: 3316291 - protein, 4 aa, Plasmodium falciparum
INKK

SEQ ID NO: 3316292 - protein, 9 aa, Plasmodium falciparum
INKKDDGDD

SEQ ID NO: 3316293 - protein, 8 aa, Plasmodium falciparum
INKKEELE

SEQ ID NO: 3316294 - protein, 12 aa, Plasmodium falciparum
INKKENKKINDI

SEQ ID NO: 3316295 - protein, 5 aa, Plasmodium falciparum
INKKK

SEQ ID NO: 3316296 - protein, 12 aa, Plasmodium falciparum
INKKKKKYEELK

SEQ ID NO: 3316297 - protein, 14 aa, Plasmodium falciparum
INKKNTDKYQRNNT

SEQ ID NO: 3316298 - protein, 7 aa, Plasmodium falciparum
INKKPNE

SEQ ID NO: 3316299 - protein, 10 aa, Plasmodium falciparum
INKKTKDEEY

SEQ ID NO: 3316300 - protein, 5 aa, Plasmodium falciparum
INKND

SEQ ID NO: 3316301 - protein, 10 aa, Plasmodium falciparum
INKNEKNRNI

SEQ ID NO: 3316302 - protein, 8 aa, Plasmodium falciparum
INKNERIN

SEQ ID NO: 3316303 - protein, 15 aa, Plasmodium falciparum
INKNERNNKNENNNI

SEQ ID NO: 3316304 - protein, 15 aa, Plasmodium falciparum
INKNESNGSTKDPMG

SEQ ID NO: 3316305 - protein, 6 aa, Plasmodium falciparum
INKNGD

SEQ ID NO: 3316306 - protein, 7 aa, Plasmodium falciparum
INKNGVP

SEQ ID NO: 3316307 - protein, 19 aa, Plasmodium falciparum
INKNKNKNLTKDNNKKHIT

SEQ ID NO: 3316308 - protein, 9 aa, Plasmodium falciparum
INKNKQDNL

SEQ ID NO: 3316309 - protein, 39 aa, Plasmodium falciparum
INKNKSKGKNDNNNNNNNNNSNSNGNGNNYKSDDDKNYI

SEQ ID NO: 3316310 - protein, 5 aa, Plasmodium falciparum
INKNN

SEQ ID NO: 3316311 - protein, 162 aa, Plasmodium falciparum
INKNNDEDDDYSESRRSSESRQRSESRRSNVSRRSDVSKKDDMSVKSDASRRSDASRRSDASRRSDVSKKDDISAKSDASKKDDISAKSDVSRRSDVSRRSDASRRSDASRRSDASRRSDASRRSDASRRSDVSKKDDISAKSDASKKDDISAKSDVSRRSD

SEQ ID NO: 3316312 - protein, 16 aa, Plasmodium falciparum
INKNNRNNKVNFDRGS

SEQ ID NO: 3316313 - protein, 5 aa, Plasmodium falciparum
INKNR

SEQ ID NO: 3316314 - protein, 10 aa, Plasmodium falciparum
INKNSKDQNR

SEQ ID NO: 3316315 - protein, 6 aa, Plasmodium falciparum
INKNSN

SEQ ID NO: 3316316 - protein, 9 aa, Plasmodium falciparum
INKNTNITN

SEQ ID NO: 3316317 - protein, 16 aa, Plasmodium falciparum
INKNVNKNVNKNINDT

SEQ ID NO: 3316318 - protein, 7 aa, Plasmodium falciparum
INKNVSK

SEQ ID NO: 3316319 - protein, 13 aa, Plasmodium falciparum
INKPGLSKEDDVD

SEQ ID NO: 3316320 - protein, 8 aa, Plasmodium falciparum
INKPQYNE

SEQ ID NO: 3316321 - protein, 16 aa, Plasmodium falciparum
INKQNESKNKKNKNKI

SEQ ID NO: 3316322 - protein, 6 aa, Plasmodium falciparum
INKQSL

SEQ ID NO: 3316323 - protein, 14 aa, Plasmodium falciparum
INKREKKINEKEKN

SEQ ID NO: 3316324 - protein, 8 aa, Plasmodium falciparum
INKRKTDD

SEQ ID NO: 3316325 - protein, 10 aa, Plasmodium falciparum
INKRNQEKIK

SEQ ID NO: 3316326 - protein, 8 aa, Plasmodium falciparum
INKSNELY

SEQ ID NO: 3316327 - protein, 8 aa, Plasmodium falciparum
INKSNENI

SEQ ID NO: 3316328 - protein, 10 aa, Plasmodium falciparum
INKSNTDKTL

SEQ ID NO: 3316329 - protein, 9 aa, Plasmodium falciparum
INKSNTNYR

SEQ ID NO: 3316330 - protein, 16 aa, Plasmodium falciparum
INKSQDSKKNKPINNN

SEQ ID NO: 3316331 - protein, 8 aa, Plasmodium falciparum
INKSRREE

SEQ ID NO: 3316332 - protein, 20 aa, Plasmodium falciparum
INKSSNCSNNNNNNNTCSIS

SEQ ID NO: 3316333 - protein, 8 aa, Plasmodium falciparum
INKSSNYN

SEQ ID NO: 3316334 - protein, 10 aa, Plasmodium falciparum
INKSTNGTLQ

SEQ ID NO: 3316335 - protein, 6 aa, Plasmodium falciparum
INKSYT

SEQ ID NO: 3316336 - protein, 35 aa, Plasmodium falciparum
INKTDNNKIDNNNDNNISNDENINKKKKQNEPYNH

SEQ ID NO: 3316337 - protein, 5 aa, Plasmodium falciparum
INKTP

SEQ ID NO: 3316338 - protein, 6 aa, Plasmodium falciparum
INKVGS

SEQ ID NO: 3316339 - protein, 4 aa, Plasmodium falciparum
INLE

SEQ ID NO: 3316340 - protein, 9 aa, Plasmodium falciparum
INMNEPDYN

SEQ ID NO: 3316341 - protein, 16 aa, Plasmodium falciparum
INNANDTNNANDTNND

SEQ ID NO: 3316342 - protein, 5 aa, Plasmodium falciparum
INNCN

SEQ ID NO: 3316343 - protein, 5 aa, Plasmodium falciparum
INNDD

SEQ ID NO: 3316344 - protein, 23 aa, Plasmodium falciparum
INNDDDNNNNDDNNNNDNNNNNN

SEQ ID NO: 3316345 - protein, 15 aa, Plasmodium falciparum
INNDDNNNNNNNNNI

SEQ ID NO: 3316346 - protein, 10 aa, Plasmodium falciparum
INNDDPNKYT

SEQ ID NO: 3316347 - protein, 6 aa, Plasmodium falciparum
INNDEK

SEQ ID NO: 3316348 - protein, 101 aa, Plasmodium falciparum
INNDGNNNDGNNNDGNNNDDNNNDDNNNDDNNNDGNNNDDNNNEGINNDDNNNEGINNDDNNNEGINNNDDNNNNDDNNNEGINNDDNNDDNNNDNEMSQN

SEQ ID NO: 3316349 - protein, 30 aa, Plasmodium falciparum
INNDNNDNNDNNNDNNNNNNNNNNNNNNAS

SEQ ID NO: 3316350 - protein, 19 aa, Plasmodium falciparum
INNDNNNNNNNNDSFSKDN

SEQ ID NO: 3316351 - protein, 14 aa, Plasmodium falciparum
INNDNNNNNNNNNK

SEQ ID NO: 3316352 - protein, 18 aa, Plasmodium falciparum
INNDNRNKKNRYNDEENG

SEQ ID NO: 3316353 - protein, 49 aa, Plasmodium falciparum
INNDNVSYNKGNHDNKNENNSIRSTNNDSIDNNASNMESTDNTCSNIKD

SEQ ID NO: 3316354 - protein, 10 aa, Plasmodium falciparum
INNDRPKKLK

SEQ ID NO: 3316355 - protein, 9 aa, Plasmodium falciparum
INNDTNTNN

SEQ ID NO: 3316356 - protein, 15 aa, Plasmodium falciparum
INNEDGKDNKVNIKE

SEQ ID NO: 3316357 - protein, 13 aa, Plasmodium falciparum
INNEDQDDSENAN

SEQ ID NO: 3316358 - protein, 17 aa, Plasmodium falciparum
INNEEDKGEDINMFSSV

SEQ ID NO: 3316359 - protein, 7 aa, Plasmodium falciparum
INNEENK

SEQ ID NO: 3316360 - protein, 7 aa, Plasmodium falciparum
INNEKEV

SEQ ID NO: 3316361 - protein, 7 aa, Plasmodium falciparum
INNENDE

SEQ ID NO: 3316362 - protein, 11 aa, Plasmodium falciparum
INNENTCDDTL

SEQ ID NO: 3316363 - protein, 9 aa, Plasmodium falciparum
INNENTQTE

SEQ ID NO: 3316364 - protein, 12 aa, Plasmodium falciparum
INNEQNKESEMQ

SEQ ID NO: 3316365 - protein, 5 aa, Plasmodium falciparum
INNES

SEQ ID NO: 3316366 - protein, 9 aa, Plasmodium falciparum
INNETPKKG

SEQ ID NO: 3316367 - protein, 10 aa, Plasmodium falciparum
INNGDKKSVV

SEQ ID NO: 3316368 - protein, 6 aa, Plasmodium falciparum
INNGGA

SEQ ID NO: 3316369 - protein, 12 aa, Plasmodium falciparum
INNGKDEKNNNQ

SEQ ID NO: 3316370 - protein, 59 aa, Plasmodium falciparum
INNGNNNNNNKNKKSSSNSKNINKNSSNTKNSSNTKSSSNTKSSSNTKNKNNKNNHNNS

SEQ ID NO: 3316371 - protein, 10 aa, Plasmodium falciparum
INNHNDIDKR

SEQ ID NO: 3316372 - protein, 4 aa, Plasmodium falciparum
INNI

SEQ ID NO: 3316373 - protein, 34 aa, Plasmodium falciparum
INNINSNNSNNSNSNSNSNNNNNNNYNSNNISDN

SEQ ID NO: 3316374 - protein, 16 aa, Plasmodium falciparum
INNISTSNNLNSSNEH

SEQ ID NO: 3316375 - protein, 4 aa, Plasmodium falciparum
INNK

SEQ ID NO: 3316376 - protein, 14 aa, Plasmodium falciparum
INNKDETNNNNNNM

SEQ ID NO: 3316377 - protein, 21 aa, Plasmodium falciparum
INNKEKNNIKNNNSQNIAEKK

SEQ ID NO: 3316378 - protein, 9 aa, Plasmodium falciparum
INNKEKTKY

SEQ ID NO: 3316379 - protein, 10 aa, Plasmodium falciparum
INNKENNDLM

SEQ ID NO: 3316380 - protein, 30 aa, Plasmodium falciparum
INNKEQKSNDNKKDEKSNNGKCEDKDNSEL

SEQ ID NO: 3316381 - protein, 18 aa, Plasmodium falciparum
INNKGDKNKLNVKTNHNN

SEQ ID NO: 3316382 - protein, 7 aa, Plasmodium falciparum
INNKHKR

SEQ ID NO: 3316383 - protein, 9 aa, Plasmodium falciparum
INNKKKNTY

SEQ ID NO: 3316384 - protein, 9 aa, Plasmodium falciparum
INNKKNDDL

SEQ ID NO: 3316385 - protein, 5 aa, Plasmodium falciparum
INNKL

SEQ ID NO: 3316386 - protein, 24 aa, Plasmodium falciparum
INNKNEKEEEDKKFNGDNNISDNE

SEQ ID NO: 3316387 - protein, 17 aa, Plasmodium falciparum
INNKNINKNVNTNTSAH

SEQ ID NO: 3316388 - protein, 17 aa, Plasmodium falciparum
INNKNKENSSLLKGDEE

SEQ ID NO: 3316389 - protein, 12 aa, Plasmodium falciparum
INNKNKNNSNNN

SEQ ID NO: 3316390 - protein, 41 aa, Plasmodium falciparum
INNKNTNMISSNSNSNISKDKNNNVTNSHSDDKNNKRNNDK

SEQ ID NO: 3316391 - protein, 8 aa, Plasmodium falciparum
INNKREES

SEQ ID NO: 3316392 - protein, 13 aa, Plasmodium falciparum
INNKSKKKKNIEN

SEQ ID NO: 3316393 - protein, 16 aa, Plasmodium falciparum
INNKSNVDGVNNNNVD

SEQ ID NO: 3316394 - protein, 9 aa, Plasmodium falciparum
INNKTNDDV

SEQ ID NO: 3316395 - protein, 56 aa, Plasmodium falciparum
INNMNNDNNINNNNFNNNNNNNNNFNNNNNNNNNNNNFNNEDDNNKSTCKASKNDN

SEQ ID NO: 3316396 - protein, 10 aa, Plasmodium falciparum
INNNATSNAF

SEQ ID NO: 3316397 - protein, 38 aa, Plasmodium falciparum
INNNDINNNDVNNNDINNNDINNNDINNDDNPNNENNK

SEQ ID NO: 3316398 - protein, 20 aa, Plasmodium falciparum
INNNDKKKLRRSSMSGSLKT

SEQ ID NO: 3316399 - protein, 6 aa, Plasmodium falciparum
INNNDN

SEQ ID NO: 3316400 - protein, 10 aa, Plasmodium falciparum
INNNDNNNNN

SEQ ID NO: 3316401 - protein, 26 aa, Plasmodium falciparum
INNNDNNNNTTNLKKKKKKKKKKNID

SEQ ID NO: 3316402 - protein, 9 aa, Plasmodium falciparum
INNNDNVTS

SEQ ID NO: 3316403 - protein, 11 aa, Plasmodium falciparum
INNNDQKEESP

SEQ ID NO: 3316404 - protein, 9 aa, Plasmodium falciparum
INNNDSNRS

SEQ ID NO: 3316405 - protein, 35 aa, Plasmodium falciparum
INNNDYDDHTSCNNRSNGCKENNSLASNKNDDIQK

SEQ ID NO: 3316406 - protein, 9 aa, Plasmodium falciparum
INNNEENTF

SEQ ID NO: 3316407 - protein, 10 aa, Plasmodium falciparum
INNNENNDNI

SEQ ID NO: 3316408 - protein, 18 aa, Plasmodium falciparum
INNNENNKYDEENNKGIS

SEQ ID NO: 3316409 - protein, 7 aa, Plasmodium falciparum
INNNEPV

SEQ ID NO: 3316410 - protein, 9 aa, Plasmodium falciparum
INNNGNIHK

SEQ ID NO: 3316411 - protein, 24 aa, Plasmodium falciparum
INNNIEKEKKIKNRSDDIKKKNLN

SEQ ID NO: 3316412 - protein, 24 aa, Plasmodium falciparum
INNNIKSGNHKTSYINDSNNNNYD

SEQ ID NO: 3316413 - protein, 28 aa, Plasmodium falciparum
INNNINEDNLTGETYPNDDSIPQENNKI

SEQ ID NO: 3316414 - protein, 8 aa, Plasmodium falciparum
INNNKEIN

SEQ ID NO: 3316415 - protein, 10 aa, Plasmodium falciparum
INNNKSNMDG

SEQ ID NO: 3316416 - protein, 37 aa, Plasmodium falciparum
INNNKYDDNNNNNNNNNDNHNNYDNNNNNNNNIDEDE

SEQ ID NO: 3316417 - protein, 13 aa, Plasmodium falciparum
INNNMSNNSISGV

SEQ ID NO: 3316418 - protein, 5 aa, Plasmodium falciparum
INNNN

SEQ ID NO: 3316419 - protein, 6 aa, Plasmodium falciparum
INNNND

SEQ ID NO: 3316420 - protein, 9 aa, Plasmodium falciparum
INNNNDDKF

SEQ ID NO: 3316421 - protein, 13 aa, Plasmodium falciparum
INNNNDNNEKKGS

SEQ ID NO: 3316422 - protein, 16 aa, Plasmodium falciparum
INNNNDNNNEDDDDND

SEQ ID NO: 3316423 - protein, 11 aa, Plasmodium falciparum
INNNNDNNNNN

SEQ ID NO: 3316424 - protein, 11 aa, Plasmodium falciparum
INNNNENYKSE

SEQ ID NO: 3316425 - protein, 16 aa, Plasmodium falciparum
INNNNINNNNNNKGKD

SEQ ID NO: 3316426 - protein, 8 aa, Plasmodium falciparum
INNNNKNN

SEQ ID NO: 3316427 - protein, 24 aa, Plasmodium falciparum
INNNNNDDANINNDNNNVEGETNA

SEQ ID NO: 3316428 - protein, 51 aa, Plasmodium falciparum
INNNNNDDNNNNNDNNNNDNNNDNDNNNDNNNNNNNNNNNNNNNNNNNNNN

SEQ ID NO: 3316429 - protein, 7 aa, Plasmodium falciparum
INNNNNK

SEQ ID NO: 3316430 - protein, 22 aa, Plasmodium falciparum
INNNNNKKEVKINNKRKNITKS

SEQ ID NO: 3316431 - protein, 10 aa, Plasmodium falciparum
INNNNNNDSI

SEQ ID NO: 3316432 - protein, 19 aa, Plasmodium falciparum
INNNNNNININSSNNNINN

SEQ ID NO: 3316433 - protein, 44 aa, Plasmodium falciparum
INNNNNNKKDNSNSNKSNNSNKSNKSNKSNSNSYSNNDESNRKS

SEQ ID NO: 3316434 - protein, 8 aa, Plasmodium falciparum
INNNNNNN

SEQ ID NO: 3316435 - protein, 10 aa, Plasmodium falciparum
INNNNNNNGC

SEQ ID NO: 3316436 - protein, 10 aa, Plasmodium falciparum
INNNNNNNIN

SEQ ID NO: 3316437 - protein, 16 aa, Plasmodium falciparum
INNNNNNNNIKQESSS

SEQ ID NO: 3316438 - protein, 15 aa, Plasmodium falciparum
INNNNNNNNNDDDVV

SEQ ID NO: 3316439 - protein, 12 aa, Plasmodium falciparum
INNNNNNNNNKY

SEQ ID NO: 3316440 - protein, 11 aa, Plasmodium falciparum
INNNNNNNNNN

SEQ ID NO: 3316441 - protein, 40 aa, Plasmodium falciparum
INNNNNNNNNNKNNNNNNNNDKNNNNNNNNNNNNNNNNNS

SEQ ID NO: 3316442 - protein, 13 aa, Plasmodium falciparum
INNNNNNNNNNNM

SEQ ID NO: 3316443 - protein, 24 aa, Plasmodium falciparum
INNNNNNNNNNNNIGGNKKNQHIN

SEQ ID NO: 3316444 - protein, 43 aa, Plasmodium falciparum
INNNNNNNNNNNNNNNNNNNNNNNNNNNNNNNNGIGDNNNNIN

SEQ ID NO: 3316445 - protein, 28 aa, Plasmodium falciparum
INNNNNNNNNNNNNNNNNNNNNNNNNYN

SEQ ID NO: 3316446 - protein, 14 aa, Plasmodium falciparum
INNNNNNNNNNNSY

SEQ ID NO: 3316447 - protein, 14 aa, Plasmodium falciparum
INNNNNNNNNNNVN

SEQ ID NO: 3316448 - protein, 18 aa, Plasmodium falciparum
INNNNNNNNNNSNNNNNN

SEQ ID NO: 3316449 - protein, 13 aa, Plasmodium falciparum
INNNNNNNRMHPN

SEQ ID NO: 3316450 - protein, 12 aa, Plasmodium falciparum
INNNNNNNSNIT

SEQ ID NO: 3316451 - protein, 10 aa, Plasmodium falciparum
INNNNNNNVE

SEQ ID NO: 3316452 - protein, 27 aa, Plasmodium falciparum
INNNNNNNYNNNSNSNNNSSNSNNNND

SEQ ID NO: 3316453 - protein, 37 aa, Plasmodium falciparum
INNNNSNNNNNSNNNNNNNNSYNFNENKENSSSTNKL

SEQ ID NO: 3316454 - protein, 31 aa, Plasmodium falciparum
INNNNTLNNNNEYNNQNNNEDEDDDDWGELG

SEQ ID NO: 3316455 - protein, 10 aa, Plasmodium falciparum
INNNPGSVNA

SEQ ID NO: 3316456 - protein, 8 aa, Plasmodium falciparum
INNNRKEH

SEQ ID NO: 3316457 - protein, 5 aa, Plasmodium falciparum
INNNS

SEQ ID NO: 3316458 - protein, 18 aa, Plasmodium falciparum
INNNSKNCNDIPKNIQQE

SEQ ID NO: 3316459 - protein, 17 aa, Plasmodium falciparum
INNNSNDNSNNYSNNNS

SEQ ID NO: 3316460 - protein, 19 aa, Plasmodium falciparum
INNNSNNNNNNNNNNGNNC

SEQ ID NO: 3316461 - protein, 21 aa, Plasmodium falciparum
INNNSNNNNSNNNSNNNNKHY

SEQ ID NO: 3316462 - protein, 13 aa, Plasmodium falciparum
INNNSNSTNGNMN

SEQ ID NO: 3316463 - protein, 14 aa, Plasmodium falciparum
INNNSNTNNTANNN

SEQ ID NO: 3316464 - protein, 8 aa, Plasmodium falciparum
INNNSSNN

SEQ ID NO: 3316465 - protein, 13 aa, Plasmodium falciparum
INNNYDSSSNKYK

SEQ ID NO: 3316466 - protein, 4 aa, Plasmodium falciparum
INNP

SEQ ID NO: 3316467 - protein, 5 aa, Plasmodium falciparum
INNPI

SEQ ID NO: 3316468 - protein, 6 aa, Plasmodium falciparum
INNPLG

SEQ ID NO: 3316469 - protein, 7 aa, Plasmodium falciparum
INNPRDI

SEQ ID NO: 3316470 - protein, 13 aa, Plasmodium falciparum
INNQDTKENNGKV

SEQ ID NO: 3316471 - protein, 8 aa, Plasmodium falciparum
INNRDNNL

SEQ ID NO: 3316472 - protein, 19 aa, Plasmodium falciparum
INNRDSLNDHKHENNKSNH

SEQ ID NO: 3316473 - protein, 13 aa, Plasmodium falciparum
INNRRRKSYENNT

SEQ ID NO: 3316474 - protein, 4 aa, Plasmodium falciparum
INNS

SEQ ID NO: 3316475 - protein, 9 aa, Plasmodium falciparum
INNSIKKNS

SEQ ID NO: 3316476 - protein, 36 aa, Plasmodium falciparum
INNSKKKKIVNSKGTINGKEKIENKRGSTKGSKKNM

SEQ ID NO: 3316477 - protein, 10 aa, Plasmodium falciparum
INNSNDEKME

SEQ ID NO: 3316478 - protein, 17 aa, Plasmodium falciparum
INNSNSLESIQTTPKRK

SEQ ID NO: 3316479 - protein, 8 aa, Plasmodium falciparum
INNSQNKV

SEQ ID NO: 3316480 - protein, 14 aa, Plasmodium falciparum
INNSSNEINSKSYR

SEQ ID NO: 3316481 - protein, 8 aa, Plasmodium falciparum
INNSTTSD

SEQ ID NO: 3316482 - protein, 5 aa, Plasmodium falciparum
INNSV

SEQ ID NO: 3316483 - protein, 4 aa, Plasmodium falciparum
INNT

SEQ ID NO: 3316484 - protein, 8 aa, Plasmodium falciparum
INNTDKNM

SEQ ID NO: 3316485 - protein, 5 aa, Plasmodium falciparum
INNTI

SEQ ID NO: 3316486 - protein, 12 aa, Plasmodium falciparum
INNTLNDDNQYH

SEQ ID NO: 3316487 - protein, 9 aa, Plasmodium falciparum
INNTNENNL

SEQ ID NO: 3316488 - protein, 11 aa, Plasmodium falciparum
INNTNIKEQPI

SEQ ID NO: 3316489 - protein, 7 aa, Plasmodium falciparum
INNTNNI

SEQ ID NO: 3316490 - protein, 18 aa, Plasmodium falciparum
INNTNNINNNNNNNNNNN

SEQ ID NO: 3316491 - protein, 24 aa, Plasmodium falciparum
INNTNNTNNTNNTNNTNNINNTNN

SEQ ID NO: 3316492 - protein, 191 aa, Plasmodium falciparum
INNTNSSNKYSEGKDKDANTEDNKIGYKANDNNNNSSNNNRNNNGKVLSNNKNSNKGNNKNSKNKSKNNNDPNKKASGDNLNEPDYKENNMNNNNNNNNNNNNNNNNNNNNNNNNNNNNNNSNNNNSNNNNSNNNNNSNNNNNNNNNNNNSNNNNNNSNNNNNNNNNNNNNNNNSNNNNYNNSNNNNNNHS

SEQ ID NO: 3316493 - protein, 7 aa, Plasmodium falciparum
INNTNYK

SEQ ID NO: 3316494 - protein, 8 aa, Plasmodium falciparum
INNTQDKK

SEQ ID NO: 3316495 - protein, 11 aa, Plasmodium falciparum
INNTSNDESEH

SEQ ID NO: 3316496 - protein, 11 aa, Plasmodium falciparum
INNTSNSNNNS

SEQ ID NO: 3316497 - protein, 20 aa, Plasmodium falciparum
INNTSSNKSSSDKSYSNESC

SEQ ID NO: 3316498 - protein, 5 aa, Plasmodium falciparum
INNYE

SEQ ID NO: 3316499 - protein, 10 aa, Plasmodium falciparum
INNYTNQQTR

SEQ ID NO: 3316500 - protein, 4 aa, Plasmodium falciparum
INPD

SEQ ID NO: 3316501 - protein, 5 aa, Plasmodium falciparum
INPDD

SEQ ID NO: 3316502 - protein, 4 aa, Plasmodium falciparum
INPE

SEQ ID NO: 3316503 - protein, 4 aa, Plasmodium falciparum
INPG

SEQ ID NO: 3316504 - protein, 10 aa, Plasmodium falciparum
INPNEDKKKL

SEQ ID NO: 3316505 - protein, 16 aa, Plasmodium falciparum
INPPQPPLGKPPTLSE

SEQ ID NO: 3316506 - protein, 27 aa, Plasmodium falciparum
INPPSSDINSRKNDEKYVNGSNGLENS

SEQ ID NO: 3316507 - protein, 25 aa, Plasmodium falciparum
INPQQSNGKNQNDISNNINKNDEYY

SEQ ID NO: 3316508 - protein, 5 aa, Plasmodium falciparum
INPSE

SEQ ID NO: 3316509 - protein, 5 aa, Plasmodium falciparum
INPTN

SEQ ID NO: 3316510 - protein, 4 aa, Plasmodium falciparum
INQD

SEQ ID NO: 3316511 - protein, 6 aa, Plasmodium falciparum
INQDDF

SEQ ID NO: 3316512 - protein, 5 aa, Plasmodium falciparum
INQES

SEQ ID NO: 3316513 - protein, 58 aa, Plasmodium falciparum
INQETNHGTNHETNHETNHGTNHGTNHGTNHGTNHETNHETNHETNHETNHETNHETN

SEQ ID NO: 3316514 - protein, 5 aa, Plasmodium falciparum
INQGN

SEQ ID NO: 3316515 - protein, 13 aa, Plasmodium falciparum
INQGQLQNQNQNY

SEQ ID NO: 3316516 - protein, 7 aa, Plasmodium falciparum
INQKDQE

SEQ ID NO: 3316517 - protein, 6 aa, Plasmodium falciparum
INQKPE

SEQ ID NO: 3316518 - protein, 7 aa, Plasmodium falciparum
INQKTQN

SEQ ID NO: 3316519 - protein, 11 aa, Plasmodium falciparum
INQNENKNDEE

SEQ ID NO: 3316520 - protein, 7 aa, Plasmodium falciparum
INQNGKY

SEQ ID NO: 3316521 - protein, 125 aa, Plasmodium falciparum
INQNGNKSKPDDNKSKPDDNKSKPDDNKSKPDDNKSKPDDNKSNPDDNKSKPDDNKSNPNDNKSKPDDNKNKPNDNKNKPDDNKSKPDDNKSKPDDNKSKPNDNKSKPNDNKSKPDDNKSNPNDN

SEQ ID NO: 3316522 - protein, 6 aa, Plasmodium falciparum
INQNND

SEQ ID NO: 3316523 - protein, 7 aa, Plasmodium falciparum
INQPKSL

SEQ ID NO: 3316524 - protein, 42 aa, Plasmodium falciparum
INQPNNNNNNKENINDNNNNNKENINDNNNNNKENNINPCST

SEQ ID NO: 3316525 - protein, 9 aa, Plasmodium falciparum
INQQTQQKN

SEQ ID NO: 3316526 - protein, 20 aa, Plasmodium falciparum
INQSSNKEYNPNKSTIHKNH

SEQ ID NO: 3316527 - protein, 16 aa, Plasmodium falciparum
INQVNDEMGNKPSANT

SEQ ID NO: 3316528 - protein, 15 aa, Plasmodium falciparum
INRDNNFEKTHKNNI

SEQ ID NO: 3316529 - protein, 4 aa, Plasmodium falciparum
INRE

SEQ ID NO: 3316530 - protein, 8 aa, Plasmodium falciparum
INRKKENE

SEQ ID NO: 3316531 - protein, 12 aa, Plasmodium falciparum
INRKKGTKENYN

SEQ ID NO: 3316532 - protein, 9 aa, Plasmodium falciparum
INRNDRTKM

SEQ ID NO: 3316533 - protein, 7 aa, Plasmodium falciparum
INRNKNK

SEQ ID NO: 3316534 - protein, 11 aa, Plasmodium falciparum
INRSNNSALAD

SEQ ID NO: 3316535 - protein, 9 aa, Plasmodium falciparum
INRSPNKSY

SEQ ID NO: 3316536 - protein, 8 aa, Plasmodium falciparum
INRSSNSI

SEQ ID NO: 3316537 - protein, 36 aa, Plasmodium falciparum
INRSTVQNKGSGNNDEGEENCVTNDDRNDDDEGENN

SEQ ID NO: 3316538 - protein, 11 aa, Plasmodium falciparum
INRTNDKNRQI

SEQ ID NO: 3316539 - protein, 16 aa, Plasmodium falciparum
INRTNYNDTNNKHTNS

SEQ ID NO: 3316540 - protein, 6 aa, Plasmodium falciparum
INSAQN

SEQ ID NO: 3316541 - protein, 5 aa, Plasmodium falciparum
INSDD

SEQ ID NO: 3316542 - protein, 7 aa, Plasmodium falciparum
INSDEEN

SEQ ID NO: 3316543 - protein, 7 aa, Plasmodium falciparum
INSDNKN

SEQ ID NO: 3316544 - protein, 17 aa, Plasmodium falciparum
INSDRNNLKENGSKLEN

SEQ ID NO: 3316545 - protein, 4 aa, Plasmodium falciparum
INSE

SEQ ID NO: 3316546 - protein, 10 aa, Plasmodium falciparum
INSEGEDEGD

SEQ ID NO: 3316547 - protein, 10 aa, Plasmodium falciparum
INSEKTHSYN

SEQ ID NO: 3316548 - protein, 23 aa, Plasmodium falciparum
INSGESDKDMSSDFKSSNKECKQ

SEQ ID NO: 3316549 - protein, 23 aa, Plasmodium falciparum
INSGGKINEQTNSYQNQDGSSLR

SEQ ID NO: 3316550 - protein, 5 aa, Plasmodium falciparum
INSGN

SEQ ID NO: 3316551 - protein, 12 aa, Plasmodium falciparum
INSGTKSNYDSR

SEQ ID NO: 3316552 - protein, 18 aa, Plasmodium falciparum
INSHNNINSHNNINSHNN

SEQ ID NO: 3316553 - protein, 17 aa, Plasmodium falciparum
INSKDDGNNKNENQENI

SEQ ID NO: 3316554 - protein, 7 aa, Plasmodium falciparum
INSKKEN

SEQ ID NO: 3316555 - protein, 8 aa, Plasmodium falciparum
INSKNSCD

SEQ ID NO: 3316556 - protein, 8 aa, Plasmodium falciparum
INSKNTNY

SEQ ID NO: 3316557 - protein, 8 aa, Plasmodium falciparum
INSKRDIS

SEQ ID NO: 3316558 - protein, 4 aa, Plasmodium falciparum
INSM

SEQ ID NO: 3316559 - protein, 16 aa, Plasmodium falciparum
INSMNKNNNNTGNSKL

SEQ ID NO: 3316560 - protein, 4 aa, Plasmodium falciparum
INSN

SEQ ID NO: 3316561 - protein, 29 aa, Plasmodium falciparum
INSNAEQKIQSTEEHEQNGETLQTDSVGK

SEQ ID NO: 3316562 - protein, 7 aa, Plasmodium falciparum
INSNHSN

SEQ ID NO: 3316563 - protein, 8 aa, Plasmodium falciparum
INSNINNN

SEQ ID NO: 3316564 - protein, 10 aa, Plasmodium falciparum
INSNMNNNTN

SEQ ID NO: 3316565 - protein, 5 aa, Plasmodium falciparum
INSNN

SEQ ID NO: 3316566 - protein, 8 aa, Plasmodium falciparum
INSNNDKS

SEQ ID NO: 3316567 - protein, 6 aa, Plasmodium falciparum
INSNNN

SEQ ID NO: 3316568 - protein, 98 aa, Plasmodium falciparum
INSNNNNNNINSNNNINSNNNNNNNNNNNNNNSNNNINSNSNNNNNNNHNNNNNHNNHNNNHNNNHNNNHNNHNHNNHNNHNNNNHNNQSCNNASDNT

SEQ ID NO: 3316569 - protein, 32 aa, Plasmodium falciparum
INSNNNNNNNDNNNNNNNDNNNNNNNIEQYRQ

SEQ ID NO: 3316570 - protein, 5 aa, Plasmodium falciparum
INSNP

SEQ ID NO: 3316571 - protein, 5 aa, Plasmodium falciparum
INSNS

SEQ ID NO: 3316572 - protein, 10 aa, Plasmodium falciparum
INSPNNIKSM

SEQ ID NO: 3316573 - protein, 5 aa, Plasmodium falciparum
INSRE

SEQ ID NO: 3316574 - protein, 15 aa, Plasmodium falciparum
INSREKDVKNYDDNF

SEQ ID NO: 3316575 - protein, 40 aa, Plasmodium falciparum
INSSEELENDSKKKQKQVSNGLEGLKEEKNEKKKKREDID

SEQ ID NO: 3316576 - protein, 8 aa, Plasmodium falciparum
INSSEEPT

SEQ ID NO: 3316577 - protein, 12 aa, Plasmodium falciparum
INSSFNKKKNKL

SEQ ID NO: 3316578 - protein, 9 aa, Plasmodium falciparum
INSSNEKKK

SEQ ID NO: 3316579 - protein, 15 aa, Plasmodium falciparum
INSSSNNNNNNNNNK

SEQ ID NO: 3316580 - protein, 14 aa, Plasmodium falciparum
INSSSNQNSNKKKE

SEQ ID NO: 3316581 - protein, 16 aa, Plasmodium falciparum
INSSSSMKKNESNKNN

SEQ ID NO: 3316582 - protein, 19 aa, Plasmodium falciparum
INSSSSNYNNNKVKDTSVN

SEQ ID NO: 3316583 - protein, 13 aa, Plasmodium falciparum
INSSSSSNNNKRN

SEQ ID NO: 3316584 - protein, 16 aa, Plasmodium falciparum
INSSSSSNNNNNNNNY

SEQ ID NO: 3316585 - protein, 6 aa, Plasmodium falciparum
INSSYS

SEQ ID NO: 3316586 - protein, 12 aa, Plasmodium falciparum
INSTDKKDDDQM

SEQ ID NO: 3316587 - protein, 5 aa, Plasmodium falciparum
INSTN

SEQ ID NO: 3316588 - protein, 6 aa, Plasmodium falciparum
INSTRK

SEQ ID NO: 3316589 - protein, 7 aa, Plasmodium falciparum
INSTTSV

SEQ ID NO: 3316590 - protein, 7 aa, Plasmodium falciparum
INSVNKD

SEQ ID NO: 3316591 - protein, 118 aa, Plasmodium falciparum
INTEDEKAVEKNTEDEKAVEKNTEDEKAIEKNTEDEKAVEKNTEDEKAVEKNTEDEKAIEKNTEDEKAVEKNTEDEKAVEQNTEDEKVVEENTEDEKAVEKNTEDEKAVEKNTEDEKV

SEQ ID NO: 3316592 - protein, 5 aa, Plasmodium falciparum
INTEE

SEQ ID NO: 3316593 - protein, 29 aa, Plasmodium falciparum
INTEEEEQDNEKIDNDDGDGGGLIAGTGS

SEQ ID NO: 3316594 - protein, 5 aa, Plasmodium falciparum
INTEI

SEQ ID NO: 3316595 - protein, 24 aa, Plasmodium falciparum
INTEKEHIRSKSNHNRINNNSYDN

SEQ ID NO: 3316596 - protein, 14 aa, Plasmodium falciparum
INTEKRNDDNINGD

SEQ ID NO: 3316597 - protein, 10 aa, Plasmodium falciparum
INTHNNANNT

SEQ ID NO: 3316598 - protein, 23 aa, Plasmodium falciparum
INTHQYENENTPNAVNNNVDTTS

SEQ ID NO: 3316599 - protein, 5 aa, Plasmodium falciparum
INTHY

SEQ ID NO: 3316600 - protein, 11 aa, Plasmodium falciparum
INTKENINQIN

SEQ ID NO: 3316601 - protein, 12 aa, Plasmodium falciparum
INTKQNNNEITN

SEQ ID NO: 3316602 - protein, 9 aa, Plasmodium falciparum
INTNKENNY

SEQ ID NO: 3316603 - protein, 12 aa, Plasmodium falciparum
INTNKNNQDGNV

SEQ ID NO: 3316604 - protein, 6 aa, Plasmodium falciparum
INTNNK

SEQ ID NO: 3316605 - protein, 12 aa, Plasmodium falciparum
INTNNNDTNQMD

SEQ ID NO: 3316606 - protein, 9 aa, Plasmodium falciparum
INTNNNKDD

SEQ ID NO: 3316607 - protein, 11 aa, Plasmodium falciparum
INTNNSSNNSF

SEQ ID NO: 3316608 - protein, 10 aa, Plasmodium falciparum
INTNPNTYSG

SEQ ID NO: 3316609 - protein, 41 aa, Plasmodium falciparum
INTNREQNSDYTPEEQDDYDTNENQKGGQDKNKGKLENNGN

SEQ ID NO: 3316610 - protein, 25 aa, Plasmodium falciparum
INTPPSINKKNAHSNNNNNNNNNKY

SEQ ID NO: 3316611 - protein, 35 aa, Plasmodium falciparum
INTPSGNSSNNNNNNNSKKKNCEDDDVGRTSADVY

SEQ ID NO: 3316612 - protein, 23 aa, Plasmodium falciparum
INTQDNKTSNPYSSKNQNKENDD

SEQ ID NO: 3316613 - protein, 11 aa, Plasmodium falciparum
INTQNEKQITQ

SEQ ID NO: 3316614 - protein, 11 aa, Plasmodium falciparum
INTQNNNSNTL

SEQ ID NO: 3316615 - protein, 12 aa, Plasmodium falciparum
INTQPNTDLNTD

SEQ ID NO: 3316616 - protein, 7 aa, Plasmodium falciparum
INTRESD

SEQ ID NO: 3316617 - protein, 18 aa, Plasmodium falciparum
INTSNLSNNCKKNNSKEN

SEQ ID NO: 3316618 - protein, 4 aa, Plasmodium falciparum
INTT

SEQ ID NO: 3316619 - protein, 24 aa, Plasmodium falciparum
INTTENEQIKQERTINKSNDINDT

SEQ ID NO: 3316620 - protein, 41 aa, Plasmodium falciparum
INTTGNNVNNISSNNSKNIYNSKGVKREGYNSEDNDNTAGN

SEQ ID NO: 3316621 - protein, 7 aa, Plasmodium falciparum
INTTKEE

SEQ ID NO: 3316622 - protein, 6 aa, Plasmodium falciparum
INTTNI

SEQ ID NO: 3316623 - protein, 7 aa, Plasmodium falciparum
INTTPNM

SEQ ID NO: 3316624 - protein, 4 aa, Plasmodium falciparum
INTY

SEQ ID NO: 3316625 - protein, 21 aa, Plasmodium falciparum
INVDGNKNKNVNGNKYEHVDG

SEQ ID NO: 3316626 - protein, 4 aa, Plasmodium falciparum
INVE

SEQ ID NO: 3316627 - protein, 10 aa, Plasmodium falciparum
INVGEKHQAK

SEQ ID NO: 3316628 - protein, 18 aa, Plasmodium falciparum
INVNDSPRHDKYNDSDFS

SEQ ID NO: 3316629 - protein, 13 aa, Plasmodium falciparum
INYDNKSSFKKND

SEQ ID NO: 3316630 - protein, 21 aa, Plasmodium falciparum
INYKDNNNNNDNNNDNDNNYY

SEQ ID NO: 3316631 - protein, 13 aa, Plasmodium falciparum
INYNNTNNINNNI

SEQ ID NO: 3316632 - protein, 11 aa, Plasmodium falciparum
INYNSKTELNI

SEQ ID NO: 3316633 - protein, 6 aa, Plasmodium falciparum
INYPPE

SEQ ID NO: 3316634 - protein, 4 aa, Plasmodium falciparum
INYS

SEQ ID NO: 3316635 - protein, 12 aa, Plasmodium falciparum
INYSSSCSSTCN

SEQ ID NO: 3316636 - protein, 6 aa, Plasmodium falciparum
INYSYS

SEQ ID NO: 3316637 - protein, 6 aa, Plasmodium falciparum
IPATNT

SEQ ID NO: 3316638 - protein, 5 aa, Plasmodium falciparum
IPCTN

SEQ ID NO: 3316639 - protein, 9 aa, Plasmodium falciparum
IPDDSEESY

SEQ ID NO: 3316640 - protein, 6 aa, Plasmodium falciparum
IPDGYP

SEQ ID NO: 3316641 - protein, 5 aa, Plasmodium falciparum
IPDKL

SEQ ID NO: 3316642 - protein, 6 aa, Plasmodium falciparum
IPDSNT

SEQ ID NO: 3316643 - protein, 17 aa, Plasmodium falciparum
IPDTGSEYEEAGGGDIN

SEQ ID NO: 3316644 - protein, 13 aa, Plasmodium falciparum
IPDTNSSKSLLEN

SEQ ID NO: 3316645 - protein, 14 aa, Plasmodium falciparum
IPEDDTENNFSIAD

SEQ ID NO: 3316646 - protein, 11 aa, Plasmodium falciparum
IPEKSGNEERH

SEQ ID NO: 3316647 - protein, 4 aa, Plasmodium falciparum
IPEP

SEQ ID NO: 3316648 - protein, 5 aa, Plasmodium falciparum
IPEPK

SEQ ID NO: 3316649 - protein, 5 aa, Plasmodium falciparum
IPEPR

SEQ ID NO: 3316650 - protein, 16 aa, Plasmodium falciparum
IPESNDSFKTQTNSQI

SEQ ID NO: 3316651 - protein, 6 aa, Plasmodium falciparum
IPFPNN

SEQ ID NO: 3316652 - protein, 5 aa, Plasmodium falciparum
IPGGR

SEQ ID NO: 3316653 - protein, 5 aa, Plasmodium falciparum
IPGRQ

SEQ ID NO: 3316654 - protein, 6 aa, Plasmodium falciparum
IPGTSY

SEQ ID NO: 3316655 - protein, 5 aa, Plasmodium falciparum
IPHEK

SEQ ID NO: 3316656 - protein, 15 aa, Plasmodium falciparum
IPHNDITTKNNGFQT

SEQ ID NO: 3316657 - protein, 5 aa, Plasmodium falciparum
IPHNE

SEQ ID NO: 3316658 - protein, 7 aa, Plasmodium falciparum
IPKDNNI

SEQ ID NO: 3316659 - protein, 6 aa, Plasmodium falciparum
IPKDPF

SEQ ID NO: 3316660 - protein, 4 aa, Plasmodium falciparum
IPKE

SEQ ID NO: 3316661 - protein, 5 aa, Plasmodium falciparum
IPKEN

SEQ ID NO: 3316662 - protein, 8 aa, Plasmodium falciparum
IPKETKEN

SEQ ID NO: 3316663 - protein, 8 aa, Plasmodium falciparum
IPKKKNYN

SEQ ID NO: 3316664 - protein, 8 aa, Plasmodium falciparum
IPKKKPKK

SEQ ID NO: 3316665 - protein, 6 aa, Plasmodium falciparum
IPKNKR

SEQ ID NO: 3316666 - protein, 6 aa, Plasmodium falciparum
IPKNSN

SEQ ID NO: 3316667 - protein, 14 aa, Plasmodium falciparum
IPKNTNENEEESSK

SEQ ID NO: 3316668 - protein, 30 aa, Plasmodium falciparum
IPKPKDYTKDKLESNKSNQVEKKENDQNVD

SEQ ID NO: 3316669 - protein, 4 aa, Plasmodium falciparum
IPKQ

SEQ ID NO: 3316670 - protein, 37 aa, Plasmodium falciparum
IPKSEDNTNDDDTLEKKNNDVITKNTNNNNNENNNNM

SEQ ID NO: 3316671 - protein, 12 aa, Plasmodium falciparum
IPLNPTKKMKNK

SEQ ID NO: 3316672 - protein, 7 aa, Plasmodium falciparum
IPLPRDQ

SEQ ID NO: 3316673 - protein, 11 aa, Plasmodium falciparum
IPNEEEQDEEL

SEQ ID NO: 3316674 - protein, 8 aa, Plasmodium falciparum
IPNEKDTK

SEQ ID NO: 3316675 - protein, 6 aa, Plasmodium falciparum
IPNELN

SEQ ID NO: 3316676 - protein, 4 aa, Plasmodium falciparum
IPNG

SEQ ID NO: 3316677 - protein, 12 aa, Plasmodium falciparum
IPNGNNNNNNNT

SEQ ID NO: 3316678 - protein, 5 aa, Plasmodium falciparum
IPNGS

SEQ ID NO: 3316679 - protein, 6 aa, Plasmodium falciparum
IPNKFD

SEQ ID NO: 3316680 - protein, 7 aa, Plasmodium falciparum
IPNNDNK

SEQ ID NO: 3316681 - protein, 8 aa, Plasmodium falciparum
IPNNDNQN

SEQ ID NO: 3316682 - protein, 27 aa, Plasmodium falciparum
IPNNKNEDNNEINHDDSNDDDSNSSHI

SEQ ID NO: 3316683 - protein, 6 aa, Plasmodium falciparum
IPNQKP

SEQ ID NO: 3316684 - protein, 6 aa, Plasmodium falciparum
IPNQNY

SEQ ID NO: 3316685 - protein, 5 aa, Plasmodium falciparum
IPNRA

SEQ ID NO: 3316686 - protein, 8 aa, Plasmodium falciparum
IPNSKNKN

SEQ ID NO: 3316687 - protein, 4 aa, Plasmodium falciparum
IPNY

SEQ ID NO: 3316688 - protein, 6 aa, Plasmodium falciparum
IPNYER

SEQ ID NO: 3316689 - protein, 10 aa, Plasmodium falciparum
IPPAKEEGKK

SEQ ID NO: 3316690 - protein, 9 aa, Plasmodium falciparum
IPPANGYPS

SEQ ID NO: 3316691 - protein, 8 aa, Plasmodium falciparum
IPPAPRKV

SEQ ID NO: 3316692 - protein, 9 aa, Plasmodium falciparum
IPPAPRSVP

SEQ ID NO: 3316693 - protein, 5 aa, Plasmodium falciparum
IPPKA

SEQ ID NO: 3316694 - protein, 5 aa, Plasmodium falciparum
IPPKG

SEQ ID NO: 3316695 - protein, 5 aa, Plasmodium falciparum
IPPKT

SEQ ID NO: 3316696 - protein, 9 aa, Plasmodium falciparum
IPPLDGEQK

SEQ ID NO: 3316697 - protein, 5 aa, Plasmodium falciparum
IPPNR

SEQ ID NO: 3316698 - protein, 8 aa, Plasmodium falciparum
IPPNSKQE

SEQ ID NO: 3316699 - protein, 9 aa, Plasmodium falciparum
IPPPEGDPA

SEQ ID NO: 3316700 - protein, 14 aa, Plasmodium falciparum
IPPPKLDKEDNRWP

SEQ ID NO: 3316701 - protein, 7 aa, Plasmodium falciparum
IPPPPFN

SEQ ID NO: 3316702 - protein, 11 aa, Plasmodium falciparum
IPPPPLPNNNI

SEQ ID NO: 3316703 - protein, 36 aa, Plasmodium falciparum
IPPPPPKSSSKPISENQNISNREHNGVTNNSAKLDN

SEQ ID NO: 3316704 - protein, 11 aa, Plasmodium falciparum
IPPPPPPTSLY

SEQ ID NO: 3316705 - protein, 9 aa, Plasmodium falciparum
IPPPPSTDN

SEQ ID NO: 3316706 - protein, 8 aa, Plasmodium falciparum
IPPPTAPP

SEQ ID NO: 3316707 - protein, 4 aa, Plasmodium falciparum
IPPQ

SEQ ID NO: 3316708 - protein, 6 aa, Plasmodium falciparum
IPPTEN

SEQ ID NO: 3316709 - protein, 4 aa, Plasmodium falciparum
IPQD

SEQ ID NO: 3316710 - protein, 8 aa, Plasmodium falciparum
IPQDFSKK

SEQ ID NO: 3316711 - protein, 9 aa, Plasmodium falciparum
IPQTNYRSN

SEQ ID NO: 3316712 - protein, 5 aa, Plasmodium falciparum
IPRNS

SEQ ID NO: 3316713 - protein, 14 aa, Plasmodium falciparum
IPRRSDETEEQEKI

SEQ ID NO: 3316714 - protein, 44 aa, Plasmodium falciparum
IPRSRRNNHNNNNNNDDGSNNNRHNSSNSNNNNNNTRSSHVRGE

SEQ ID NO: 3316715 - protein, 19 aa, Plasmodium falciparum
IPRYPNRQAQEYDSNEYNS

SEQ ID NO: 3316716 - protein, 5 aa, Plasmodium falciparum
IPSDE

SEQ ID NO: 3316717 - protein, 29 aa, Plasmodium falciparum
IPSESSSTNNSSTNNYNNSNNTSASTQYS

SEQ ID NO: 3316718 - protein, 13 aa, Plasmodium falciparum
IPSGEEIKQPKYN

SEQ ID NO: 3316719 - protein, 8 aa, Plasmodium falciparum
IPSGRDKS

SEQ ID NO: 3316720 - protein, 5 aa, Plasmodium falciparum
IPSKE

SEQ ID NO: 3316721 - protein, 10 aa, Plasmodium falciparum
IPSKTDTTLE

SEQ ID NO: 3316722 - protein, 11 aa, Plasmodium falciparum
IPSNKNYKTNL

SEQ ID NO: 3316723 - protein, 44 aa, Plasmodium falciparum
IPSNNKQTNSNNNSEYNNEQNNCSNKQITNDEQNDNEYEKEESI

SEQ ID NO: 3316724 - protein, 10 aa, Plasmodium falciparum
IPSNPSYIDQ

SEQ ID NO: 3316725 - protein, 15 aa, Plasmodium falciparum
IPSPLKEQKNTEVNL

SEQ ID NO: 3316726 - protein, 14 aa, Plasmodium falciparum
IPSRNNVSTYDEAT

SEQ ID NO: 3316727 - protein, 7 aa, Plasmodium falciparum
IPSSQQK

SEQ ID NO: 3316728 - protein, 5 aa, Plasmodium falciparum
IPSTI

SEQ ID NO: 3316729 - protein, 4 aa, Plasmodium falciparum
IPSV

SEQ ID NO: 3316730 - protein, 10 aa, Plasmodium falciparum
IPTAKDKNPN

SEQ ID NO: 3316731 - protein, 4 aa, Plasmodium falciparum
IPTD

SEQ ID NO: 3316732 - protein, 22 aa, Plasmodium falciparum
IPTDDKSVKKKNKKKKNNKNST

SEQ ID NO: 3316733 - protein, 4 aa, Plasmodium falciparum
IPTE

SEQ ID NO: 3316734 - protein, 6 aa, Plasmodium falciparum
IPTEKR

SEQ ID NO: 3316735 - protein, 6 aa, Plasmodium falciparum
IPTENK

SEQ ID NO: 3316736 - protein, 9 aa, Plasmodium falciparum
IPTGQEKGT

SEQ ID NO: 3316737 - protein, 5 aa, Plasmodium falciparum
IPTMN

SEQ ID NO: 3316738 - protein, 8 aa, Plasmodium falciparum
IPTNDSDN

SEQ ID NO: 3316739 - protein, 8 aa, Plasmodium falciparum
IPTNKNRD

SEQ ID NO: 3316740 - protein, 4 aa, Plasmodium falciparum
IPTP

SEQ ID NO: 3316741 - protein, 6 aa, Plasmodium falciparum
IPTPEG

SEQ ID NO: 3316742 - protein, 7 aa, Plasmodium falciparum
IPTPSNK

SEQ ID NO: 3316743 - protein, 13 aa, Plasmodium falciparum
IPTSQITSKNSSL

SEQ ID NO: 3316744 - protein, 19 aa, Plasmodium falciparum
IPYEKEDTQNRTYNTKNDW

SEQ ID NO: 3316745 - protein, 25 aa, Plasmodium falciparum
IPYQNNNNDMKKGYTNVSNNSFNNS

SEQ ID NO: 3316746 - protein, 8 aa, Plasmodium falciparum
IQAKQEEY

SEQ ID NO: 3316747 - protein, 4 aa, Plasmodium falciparum
IQCP

SEQ ID NO: 3316748 - protein, 4 aa, Plasmodium falciparum
IQDD

SEQ ID NO: 3316749 - protein, 9 aa, Plasmodium falciparum
IQDKQEEHI

SEQ ID NO: 3316750 - protein, 9 aa, Plasmodium falciparum
IQDNLKENY

SEQ ID NO: 3316751 - protein, 15 aa, Plasmodium falciparum
IQEEAEKDVEVEEEH

SEQ ID NO: 3316752 - protein, 10 aa, Plasmodium falciparum
IQEGKDRATA

SEQ ID NO: 3316753 - protein, 16 aa, Plasmodium falciparum
IQEIENKKKEYQGEYL

SEQ ID NO: 3316754 - protein, 14 aa, Plasmodium falciparum
IQENGDSINGYNTN

SEQ ID NO: 3316755 - protein, 7 aa, Plasmodium falciparum
IQENKKN

SEQ ID NO: 3316756 - protein, 5 aa, Plasmodium falciparum
IQENS

SEQ ID NO: 3316757 - protein, 17 aa, Plasmodium falciparum
IQEQEQEQIQKHDDNSN

SEQ ID NO: 3316758 - protein, 7 aa, Plasmodium falciparum
IQEQHTP

SEQ ID NO: 3316759 - protein, 13 aa, Plasmodium falciparum
IQEYQNDNKNNVI

SEQ ID NO: 3316760 - protein, 9 aa, Plasmodium falciparum
IQGKNKETI

SEQ ID NO: 3316761 - protein, 5 aa, Plasmodium falciparum
IQGNR

SEQ ID NO: 3316762 - protein, 5 aa, Plasmodium falciparum
IQGTT

SEQ ID NO: 3316763 - protein, 13 aa, Plasmodium falciparum
IQHDNNKKEDNKN

SEQ ID NO: 3316764 - protein, 13 aa, Plasmodium falciparum
IQHKEDKKNDQLL

SEQ ID NO: 3316765 - protein, 4 aa, Plasmodium falciparum
IQHN

SEQ ID NO: 3316766 - protein, 16 aa, Plasmodium falciparum
IQINNKKKSNSNEKCK

SEQ ID NO: 3316767 - protein, 5 aa, Plasmodium falciparum
IQIPS

SEQ ID NO: 3316768 - protein, 10 aa, Plasmodium falciparum
IQKDNTNSNV

SEQ ID NO: 3316769 - protein, 13 aa, Plasmodium falciparum
IQKEEQKKSQVQK

SEQ ID NO: 3316770 - protein, 20 aa, Plasmodium falciparum
IQKEKDVNNIKETDEDTYCN

SEQ ID NO: 3316771 - protein, 18 aa, Plasmodium falciparum
IQKEKNDSVKKKKKTNKY

SEQ ID NO: 3316772 - protein, 12 aa, Plasmodium falciparum
IQKHKSDERKKN

SEQ ID NO: 3316773 - protein, 5 aa, Plasmodium falciparum
IQKKD

SEQ ID NO: 3316774 - protein, 9 aa, Plasmodium falciparum
IQKKGENNY

SEQ ID NO: 3316775 - protein, 14 aa, Plasmodium falciparum
IQKKGKHKKEQKTY

SEQ ID NO: 3316776 - protein, 11 aa, Plasmodium falciparum
IQKKNKTLEEL

SEQ ID NO: 3316777 - protein, 10 aa, Plasmodium falciparum
IQKKQSDNNQ

SEQ ID NO: 3316778 - protein, 13 aa, Plasmodium falciparum
IQKKSGKKIKKEY

SEQ ID NO: 3316779 - protein, 10 aa, Plasmodium falciparum
IQKKSKAAAG

SEQ ID NO: 3316780 - protein, 4 aa, Plasmodium falciparum
IQKN

SEQ ID NO: 3316781 - protein, 10 aa, Plasmodium falciparum
IQKNNNDNIY

SEQ ID NO: 3316782 - protein, 10 aa, Plasmodium falciparum
IQKNNNQEEI

SEQ ID NO: 3316783 - protein, 6 aa, Plasmodium falciparum
IQKNPS

SEQ ID NO: 3316784 - protein, 4 aa, Plasmodium falciparum
IQKQ

SEQ ID NO: 3316785 - protein, 7 aa, Plasmodium falciparum
IQKSGSD

SEQ ID NO: 3316786 - protein, 9 aa, Plasmodium falciparum
IQKSNNSYI

SEQ ID NO: 3316787 - protein, 7 aa, Plasmodium falciparum
IQKSQID

SEQ ID NO: 3316788 - protein, 10 aa, Plasmodium falciparum
IQNDAQPNHD

SEQ ID NO: 3316789 - protein, 16 aa, Plasmodium falciparum
IQNDETYNNTKYTNES

SEQ ID NO: 3316790 - protein, 9 aa, Plasmodium falciparum
IQNEEPSCD

SEQ ID NO: 3316791 - protein, 12 aa, Plasmodium falciparum
IQNEKEKISDDI

SEQ ID NO: 3316792 - protein, 4 aa, Plasmodium falciparum
IQNG

SEQ ID NO: 3316793 - protein, 8 aa, Plasmodium falciparum
IQNGYQTS

SEQ ID NO: 3316794 - protein, 11 aa, Plasmodium falciparum
IQNKDNVKRKI

SEQ ID NO: 3316795 - protein, 8 aa, Plasmodium falciparum
IQNKKEEV

SEQ ID NO: 3316796 - protein, 11 aa, Plasmodium falciparum
IQNKKEVNKTL

SEQ ID NO: 3316797 - protein, 18 aa, Plasmodium falciparum
IQNKKKKGDDKKNIKRDQ

SEQ ID NO: 3316798 - protein, 13 aa, Plasmodium falciparum
IQNKLGKKRNTNL

SEQ ID NO: 3316799 - protein, 8 aa, Plasmodium falciparum
IQNKTIEN

SEQ ID NO: 3316800 - protein, 22 aa, Plasmodium falciparum
IQNNDDNNNNINSNDNNNNNIN

SEQ ID NO: 3316801 - protein, 8 aa, Plasmodium falciparum
IQNNEDQI

SEQ ID NO: 3316802 - protein, 9 aa, Plasmodium falciparum
IQNNNNNNN

SEQ ID NO: 3316803 - protein, 9 aa, Plasmodium falciparum
IQNNQNNQH

SEQ ID NO: 3316804 - protein, 12 aa, Plasmodium falciparum
IQNNQSRNDTKI

SEQ ID NO: 3316805 - protein, 37 aa, Plasmodium falciparum
IQNQNQNQSQNQNQNQIQNQNQIQNQSQNQSQNQSEI

SEQ ID NO: 3316806 - protein, 6 aa, Plasmodium falciparum
IQNQNT

SEQ ID NO: 3316807 - protein, 8 aa, Plasmodium falciparum
IQNSKEKG

SEQ ID NO: 3316808 - protein, 10 aa, Plasmodium falciparum
IQNSNDDIYH

SEQ ID NO: 3316809 - protein, 5 aa, Plasmodium falciparum
IQNTE

SEQ ID NO: 3316810 - protein, 19 aa, Plasmodium falciparum
IQNTNRTNSSSSNNNISYN

SEQ ID NO: 3316811 - protein, 8 aa, Plasmodium falciparum
IQNTQDQI

SEQ ID NO: 3316812 - protein, 19 aa, Plasmodium falciparum
IQNVGENYKNGNNDDEHKD

SEQ ID NO: 3316813 - protein, 6 aa, Plasmodium falciparum
IQPEKK

SEQ ID NO: 3316814 - protein, 6 aa, Plasmodium falciparum
IQPNEP

SEQ ID NO: 3316815 - protein, 6 aa, Plasmodium falciparum
IQPNKK

SEQ ID NO: 3316816 - protein, 7 aa, Plasmodium falciparum
IQPNNDN

SEQ ID NO: 3316817 - protein, 7 aa, Plasmodium falciparum
IQPNNTN

SEQ ID NO: 3316818 - protein, 8 aa, Plasmodium falciparum
IQPQNEQL

SEQ ID NO: 3316819 - protein, 6 aa, Plasmodium falciparum
IQPQSP

SEQ ID NO: 3316820 - protein, 23 aa, Plasmodium falciparum
IQQHADKKDDDNSYDDKKENKIY

SEQ ID NO: 3316821 - protein, 5 aa, Plasmodium falciparum
IQQNE

SEQ ID NO: 3316822 - protein, 6 aa, Plasmodium falciparum
IQQQNG

SEQ ID NO: 3316823 - protein, 11 aa, Plasmodium falciparum
IQRDSTGRNSG

SEQ ID NO: 3316824 - protein, 7 aa, Plasmodium falciparum
IQRNNDS

SEQ ID NO: 3316825 - protein, 7 aa, Plasmodium falciparum
IQRPKNN

SEQ ID NO: 3316826 - protein, 4 aa, Plasmodium falciparum
IQSA

SEQ ID NO: 3316827 - protein, 18 aa, Plasmodium falciparum
IQSDEKPEHEETSDDPLN

SEQ ID NO: 3316828 - protein, 8 aa, Plasmodium falciparum
IQSDNKKL

SEQ ID NO: 3316829 - protein, 5 aa, Plasmodium falciparum
IQSKN

SEQ ID NO: 3316830 - protein, 10 aa, Plasmodium falciparum
IQSNDQENYD

SEQ ID NO: 3316831 - protein, 11 aa, Plasmodium falciparum
IQSNEHEKDNG

SEQ ID NO: 3316832 - protein, 9 aa, Plasmodium falciparum
IQSNKEEKN

SEQ ID NO: 3316833 - protein, 8 aa, Plasmodium falciparum
IQSNKSND

SEQ ID NO: 3316834 - protein, 33 aa, Plasmodium falciparum
IQSPKSDDDEISPISNNDNEESDMSQKKKQPLI

SEQ ID NO: 3316835 - protein, 23 aa, Plasmodium falciparum
IQSSQAEKNRAAKAAKHQPIDPN

SEQ ID NO: 3316836 - protein, 11 aa, Plasmodium falciparum
IQSSQQNNQYV

SEQ ID NO: 3316837 - protein, 9 aa, Plasmodium falciparum
IQSTESHKS

SEQ ID NO: 3316838 - protein, 4 aa, Plasmodium falciparum
IQTE

SEQ ID NO: 3316839 - protein, 15 aa, Plasmodium falciparum
IQTEPTDKSSQRRSY

SEQ ID NO: 3316840 - protein, 6 aa, Plasmodium falciparum
IQTGRP

SEQ ID NO: 3316841 - protein, 5 aa, Plasmodium falciparum
IQTKI

SEQ ID NO: 3316842 - protein, 8 aa, Plasmodium falciparum
IQTKSSKN

SEQ ID NO: 3316843 - protein, 21 aa, Plasmodium falciparum
IQTNNNNNINDNKELYKNENE

SEQ ID NO: 3316844 - protein, 6 aa, Plasmodium falciparum
IQTSNS

SEQ ID NO: 3316845 - protein, 5 aa, Plasmodium falciparum
IQTTE

SEQ ID NO: 3316846 - protein, 11 aa, Plasmodium falciparum
IQYKSDDITAA

SEQ ID NO: 3316847 - protein, 5 aa, Plasmodium falciparum
IRDEK

SEQ ID NO: 3316848 - protein, 17 aa, Plasmodium falciparum
IRDEQNQNECDYKNDDN

SEQ ID NO: 3316849 - protein, 5 aa, Plasmodium falciparum
IRDND

SEQ ID NO: 3316850 - protein, 8 aa, Plasmodium falciparum
IREEANKK

SEQ ID NO: 3316851 - protein, 5 aa, Plasmodium falciparum
IREEN

SEQ ID NO: 3316852 - protein, 6 aa, Plasmodium falciparum
IREGQT

SEQ ID NO: 3316853 - protein, 4 aa, Plasmodium falciparum
IRES

SEQ ID NO: 3316854 - protein, 4 aa, Plasmodium falciparum
IRET

SEQ ID NO: 3316855 - protein, 5 aa, Plasmodium falciparum
IRETE

SEQ ID NO: 3316856 - protein, 10 aa, Plasmodium falciparum
IRGNNKHPNS

SEQ ID NO: 3316857 - protein, 9 aa, Plasmodium falciparum
IRKEDPKVQ

SEQ ID NO: 3316858 - protein, 19 aa, Plasmodium falciparum
IRKNRNNLKDEKDVSNKNI

SEQ ID NO: 3316859 - protein, 9 aa, Plasmodium falciparum
IRKSDEKEI

SEQ ID NO: 3316860 - protein, 4 aa, Plasmodium falciparum
IRKY

SEQ ID NO: 3316861 - protein, 11 aa, Plasmodium falciparum
IRNASSENEKD

SEQ ID NO: 3316862 - protein, 8 aa, Plasmodium falciparum
IRNDENAD

SEQ ID NO: 3316863 - protein, 10 aa, Plasmodium falciparum
IRNEKNEEKY

SEQ ID NO: 3316864 - protein, 9 aa, Plasmodium falciparum
IRNKENLKA

SEQ ID NO: 3316865 - protein, 8 aa, Plasmodium falciparum
IRNKKSDI

SEQ ID NO: 3316866 - protein, 21 aa, Plasmodium falciparum
IRNNDNNNNNMDNNNNNMDNN

SEQ ID NO: 3316867 - protein, 13 aa, Plasmodium falciparum
IRNNNNNNYDNSV

SEQ ID NO: 3316868 - protein, 6 aa, Plasmodium falciparum
IRNPNN

SEQ ID NO: 3316869 - protein, 18 aa, Plasmodium falciparum
IRNRNYKKNKKDEERNIR

SEQ ID NO: 3316870 - protein, 9 aa, Plasmodium falciparum
IRNSNYPPT

SEQ ID NO: 3316871 - protein, 14 aa, Plasmodium falciparum
IRNYNNENKVEYDD

SEQ ID NO: 3316872 - protein, 22 aa, Plasmodium falciparum
IRPPSPPPIYDKNGSRINTREA

SEQ ID NO: 3316873 - protein, 5 aa, Plasmodium falciparum
IRPRD

SEQ ID NO: 3316874 - protein, 5 aa, Plasmodium falciparum
IRPTR

SEQ ID NO: 3316875 - protein, 7 aa, Plasmodium falciparum
IRQKDEE

SEQ ID NO: 3316876 - protein, 6 aa, Plasmodium falciparum
IRQNIN

SEQ ID NO: 3316877 - protein, 15 aa, Plasmodium falciparum
IRQNPEKESKDTKNV

SEQ ID NO: 3316878 - protein, 5 aa, Plasmodium falciparum
IRQRD

SEQ ID NO: 3316879 - protein, 5 aa, Plasmodium falciparum
IRREE

SEQ ID NO: 3316880 - protein, 17 aa, Plasmodium falciparum
IRRKTPKMKKKKTNNTL

SEQ ID NO: 3316881 - protein, 4 aa, Plasmodium falciparum
IRSG

SEQ ID NO: 3316882 - protein, 5 aa, Plasmodium falciparum
IRSGH

SEQ ID NO: 3316883 - protein, 8 aa, Plasmodium falciparum
IRSNTTTV

SEQ ID NO: 3316884 - protein, 9 aa, Plasmodium falciparum
IRSQEKNVE

SEQ ID NO: 3316885 - protein, 5 aa, Plasmodium falciparum
IRSRE

SEQ ID NO: 3316886 - protein, 12 aa, Plasmodium falciparum
IRSSDYKNIEDE

SEQ ID NO: 3316887 - protein, 6 aa, Plasmodium falciparum
IRSSGG

SEQ ID NO: 3316888 - protein, 6 aa, Plasmodium falciparum
IRSSSF

SEQ ID NO: 3316889 - protein, 8 aa, Plasmodium falciparum
IRSSTKPV

SEQ ID NO: 3316890 - protein, 10 aa, Plasmodium falciparum
IRTDTYPSIN

SEQ ID NO: 3316891 - protein, 6 aa, Plasmodium falciparum
IRTGEN

SEQ ID NO: 3316892 - protein, 8 aa, Plasmodium falciparum
IRTNSSSY

SEQ ID NO: 3316893 - protein, 12 aa, Plasmodium falciparum
IRTRNKQQKRSK

SEQ ID NO: 3316894 - protein, 11 aa, Plasmodium falciparum
IRTSKGKHNDY

SEQ ID NO: 3316895 - protein, 14 aa, Plasmodium falciparum
IRTTPTKQTSYDYE

SEQ ID NO: 3316896 - protein, 7 aa, Plasmodium falciparum
IRVPSQK

SEQ ID NO: 3316897 - protein, 5 aa, Plasmodium falciparum
IRYDE

SEQ ID NO: 3316898 - protein, 5 aa, Plasmodium falciparum
ISAED

SEQ ID NO: 3316899 - protein, 10 aa, Plasmodium falciparum
ISAISEQKNS

SEQ ID NO: 3316900 - protein, 4 aa, Plasmodium falciparum
ISAN

SEQ ID NO: 3316901 - protein, 5 aa, Plasmodium falciparum
ISAQR

SEQ ID NO: 3316902 - protein, 9 aa, Plasmodium falciparum
ISASASSHN

SEQ ID NO: 3316903 - protein, 8 aa, Plasmodium falciparum
ISASGPNA

SEQ ID NO: 3316904 - protein, 9 aa, Plasmodium falciparum
ISASKEKRI

SEQ ID NO: 3316905 - protein, 15 aa, Plasmodium falciparum
ISASNNDESCSFIVM

SEQ ID NO: 3316906 - protein, 17 aa, Plasmodium falciparum
ISATPRSERKMKKPENY

SEQ ID NO: 3316907 - protein, 5 aa, Plasmodium falciparum
ISDAA

SEQ ID NO: 3316908 - protein, 15 aa, Plasmodium falciparum
ISDDNKTKVSEQQHD

SEQ ID NO: 3316909 - protein, 4 aa, Plasmodium falciparum
ISDE

SEQ ID NO: 3316910 - protein, 17 aa, Plasmodium falciparum
ISDEEINKKYPKKNKSF

SEQ ID NO: 3316911 - protein, 70 aa, Plasmodium falciparum
ISDEEKKEKLNISPNNSNNENVKEEDCNIEDNKSDQSNNNTISHNDDDDEEEEEEEEEEEDEDATKESNI

SEQ ID NO: 3316912 - protein, 11 aa, Plasmodium falciparum
ISDEQKKALDK

SEQ ID NO: 3316913 - protein, 6 aa, Plasmodium falciparum
ISDGKD

SEQ ID NO: 3316914 - protein, 7 aa, Plasmodium falciparum
ISDITEE

SEQ ID NO: 3316915 - protein, 9 aa, Plasmodium falciparum
ISDKKIKKL

SEQ ID NO: 3316916 - protein, 8 aa, Plasmodium falciparum
ISDKKNSI

SEQ ID NO: 3316917 - protein, 56 aa, Plasmodium falciparum
ISDNSNESDTIKNGKNRNKKKNKNKHDKEEKYYTSKHSDKEKDYSRKKKKRDTNES

SEQ ID NO: 3316918 - protein, 5 aa, Plasmodium falciparum
ISDNT

SEQ ID NO: 3316919 - protein, 11 aa, Plasmodium falciparum
ISDPDQATQYS

SEQ ID NO: 3316920 - protein, 20 aa, Plasmodium falciparum
ISDPSTSQNDTSNVNAQSEK

SEQ ID NO: 3316921 - protein, 5 aa, Plasmodium falciparum
ISDQN

SEQ ID NO: 3316922 - protein, 5 aa, Plasmodium falciparum
ISDSS

SEQ ID NO: 3316923 - protein, 6 aa, Plasmodium falciparum
ISEDDG

SEQ ID NO: 3316924 - protein, 5 aa, Plasmodium falciparum
ISEDE

SEQ ID NO: 3316925 - protein, 8 aa, Plasmodium falciparum
ISEDKEKR

SEQ ID NO: 3316926 - protein, 12 aa, Plasmodium falciparum
ISEDKNERRGER

SEQ ID NO: 3316927 - protein, 11 aa, Plasmodium falciparum
ISEDVSSINKE

SEQ ID NO: 3316928 - protein, 6 aa, Plasmodium falciparum
ISEEAK

SEQ ID NO: 3316929 - protein, 11 aa, Plasmodium falciparum
ISEEEKKYGEQ

SEQ ID NO: 3316930 - protein, 6 aa, Plasmodium falciparum
ISEEKD

SEQ ID NO: 3316931 - protein, 12 aa, Plasmodium falciparum
ISEEQKNNGNQY

SEQ ID NO: 3316932 - protein, 13 aa, Plasmodium falciparum
ISEESNNNCPSKE

SEQ ID NO: 3316933 - protein, 10 aa, Plasmodium falciparum
ISEGNKKNEI

SEQ ID NO: 3316934 - protein, 5 aa, Plasmodium falciparum
ISEKA

SEQ ID NO: 3316935 - protein, 9 aa, Plasmodium falciparum
ISEKENEQK

SEQ ID NO: 3316936 - protein, 7 aa, Plasmodium falciparum
ISEKRDE

SEQ ID NO: 3316937 - protein, 4 aa, Plasmodium falciparum
ISEM

SEQ ID NO: 3316938 - protein, 14 aa, Plasmodium falciparum
ISEMESSKKKKKSN

SEQ ID NO: 3316939 - protein, 27 aa, Plasmodium falciparum
ISENDDKKNELNELNDNNNNNNNNNNI

SEQ ID NO: 3316940 - protein, 24 aa, Plasmodium falciparum
ISENELDNTSDEATEKDEKDQVDE

SEQ ID NO: 3316941 - protein, 9 aa, Plasmodium falciparum
ISENNIKRN

SEQ ID NO: 3316942 - protein, 8 aa, Plasmodium falciparum
ISENNNKI

SEQ ID NO: 3316943 - protein, 7 aa, Plasmodium falciparum
ISENYKN

SEQ ID NO: 3316944 - protein, 10 aa, Plasmodium falciparum
ISEPKESKLT

SEQ ID NO: 3316945 - protein, 6 aa, Plasmodium falciparum
ISEPSK

SEQ ID NO: 3316946 - protein, 4 aa, Plasmodium falciparum
ISEQ

SEQ ID NO: 3316947 - protein, 10 aa, Plasmodium falciparum
ISEQKAEKLK

SEQ ID NO: 3316948 - protein, 6 aa, Plasmodium falciparum
ISEQQN

SEQ ID NO: 3316949 - protein, 6 aa, Plasmodium falciparum
ISERNA

SEQ ID NO: 3316950 - protein, 25 aa, Plasmodium falciparum
ISESHNDHNTNNQPINDRNNKKNYF

SEQ ID NO: 3316951 - protein, 7 aa, Plasmodium falciparum
ISETKEI

SEQ ID NO: 3316952 - protein, 17 aa, Plasmodium falciparum
ISEYEANKDKKEEDLKE

SEQ ID NO: 3316953 - protein, 31 aa, Plasmodium falciparum
ISGDDEKDQYTNLRKTDKNYSLNNTTDNKNK

SEQ ID NO: 3316954 - protein, 18 aa, Plasmodium falciparum
ISGDKNKKRNKNRSKTNY

SEQ ID NO: 3316955 - protein, 9 aa, Plasmodium falciparum
ISGEEHIES

SEQ ID NO: 3316956 - protein, 12 aa, Plasmodium falciparum
ISGINSKDTTLN

SEQ ID NO: 3316957 - protein, 9 aa, Plasmodium falciparum
ISGNDRRST

SEQ ID NO: 3316958 - protein, 8 aa, Plasmodium falciparum
ISGNENAL

SEQ ID NO: 3316959 - protein, 9 aa, Plasmodium falciparum
ISGNTNSGY

SEQ ID NO: 3316960 - protein, 25 aa, Plasmodium falciparum
ISHEKEDEKRKKSDHRDLNETEKKN

SEQ ID NO: 3316961 - protein, 11 aa, Plasmodium falciparum
ISHGSKENNNI

SEQ ID NO: 3316962 - protein, 31 aa, Plasmodium falciparum
ISIGNGSKINDKSVTSINTDESTTKVQAESN

SEQ ID NO: 3316963 - protein, 10 aa, Plasmodium falciparum
ISIPQKANDS

SEQ ID NO: 3316964 - protein, 7 aa, Plasmodium falciparum
ISKAKDG

SEQ ID NO: 3316965 - protein, 28 aa, Plasmodium falciparum
ISKDSYTNNKKKNSYTLKTESVKSFVSR

SEQ ID NO: 3316966 - protein, 7 aa, Plasmodium falciparum
ISKDTNK

SEQ ID NO: 3316967 - protein, 5 aa, Plasmodium falciparum
ISKEI

SEQ ID NO: 3316968 - protein, 12 aa, Plasmodium falciparum
ISKEKEKQKQKQ

SEQ ID NO: 3316969 - protein, 10 aa, Plasmodium falciparum
ISKENKKKMN

SEQ ID NO: 3316970 - protein, 8 aa, Plasmodium falciparum
ISKERNKA

SEQ ID NO: 3316971 - protein, 10 aa, Plasmodium falciparum
ISKGSPPRAK

SEQ ID NO: 3316972 - protein, 12 aa, Plasmodium falciparum
ISKISPDSFPKS

SEQ ID NO: 3316973 - protein, 10 aa, Plasmodium falciparum
ISKKAQGLKN

SEQ ID NO: 3316974 - protein, 26 aa, Plasmodium falciparum
ISKKSYNEKINNQENNNNNNNKNNNI

SEQ ID NO: 3316975 - protein, 7 aa, Plasmodium falciparum
ISKNEKK

SEQ ID NO: 3316976 - protein, 17 aa, Plasmodium falciparum
ISKNESKTHTKKIPAPK

SEQ ID NO: 3316977 - protein, 8 aa, Plasmodium falciparum
ISKNGKKI

SEQ ID NO: 3316978 - protein, 17 aa, Plasmodium falciparum
ISKNINDSSITHSKETT

SEQ ID NO: 3316979 - protein, 13 aa, Plasmodium falciparum
ISKNITKKQKKCN

SEQ ID NO: 3316980 - protein, 6 aa, Plasmodium falciparum
ISKPDS

SEQ ID NO: 3316981 - protein, 73 aa, Plasmodium falciparum
ISKRQQQKGKEHKEDEHKKEQHKKEEHKEDEHKKEEHKENEHKKEEHKEEEHKEEEHKEEEHKEEEHKEDEHQ

SEQ ID NO: 3316982 - protein, 16 aa, Plasmodium falciparum
ISKTNKTKKTKKTKKK

SEQ ID NO: 3316983 - protein, 6 aa, Plasmodium falciparum
ISKTPL

SEQ ID NO: 3316984 - protein, 8 aa, Plasmodium falciparum
ISKTPNNN

SEQ ID NO: 3316985 - protein, 44 aa, Plasmodium falciparum
ISLSNNGNVGSTPVVNKNNNNNNNNNNNNSNNNNYSAVSSGAYH

SEQ ID NO: 3316986 - protein, 10 aa, Plasmodium falciparum
ISNAKPSLSV

SEQ ID NO: 3316987 - protein, 13 aa, Plasmodium falciparum
ISNASKLSKHPHM

SEQ ID NO: 3316988 - protein, 5 aa, Plasmodium falciparum
ISNDD

SEQ ID NO: 3316989 - protein, 12 aa, Plasmodium falciparum
ISNDEKGKNIPC

SEQ ID NO: 3316990 - protein, 8 aa, Plasmodium falciparum
ISNDEQIK

SEQ ID NO: 3316991 - protein, 7 aa, Plasmodium falciparum
ISNDEVK

SEQ ID NO: 3316992 - protein, 9 aa, Plasmodium falciparum
ISNDGESFN

SEQ ID NO: 3316993 - protein, 14 aa, Plasmodium falciparum
ISNDKKEDNTPSAC

SEQ ID NO: 3316994 - protein, 13 aa, Plasmodium falciparum
ISNDKSNDISTDL

SEQ ID NO: 3316995 - protein, 14 aa, Plasmodium falciparum
ISNDNDKAKNNSQN

SEQ ID NO: 3316996 - protein, 12 aa, Plasmodium falciparum
ISNDNKKVYNED

SEQ ID NO: 3316997 - protein, 8 aa, Plasmodium falciparum
ISNDPKRN

SEQ ID NO: 3316998 - protein, 8 aa, Plasmodium falciparum
ISNDQNVT

SEQ ID NO: 3316999 - protein, 10 aa, Plasmodium falciparum
ISNDRKDIAP

SEQ ID NO: 3317000 - protein, 5 aa, Plasmodium falciparum
ISNDT

SEQ ID NO: 3317001 - protein, 6 aa, Plasmodium falciparum
ISNDTK

SEQ ID NO: 3317002 - protein, 8 aa, Plasmodium falciparum
ISNEGSNL

SEQ ID NO: 3317003 - protein, 54 aa, Plasmodium falciparum
ISNENKQSGDNNKLEKEKNDKNEIYEKNDKNEIYEKNDKNEKNDKNEKNEKNEI

SEQ ID NO: 3317004 - protein, 8 aa, Plasmodium falciparum
ISNEQNNK

SEQ ID NO: 3317005 - protein, 11 aa, Plasmodium falciparum
ISNEQQKKKPS

SEQ ID NO: 3317006 - protein, 22 aa, Plasmodium falciparum
ISNETRKRTRNYSNSSNSYNLN

SEQ ID NO: 3317007 - protein, 8 aa, Plasmodium falciparum
ISNETSEE

SEQ ID NO: 3317008 - protein, 4 aa, Plasmodium falciparum
ISNG

SEQ ID NO: 3317009 - protein, 19 aa, Plasmodium falciparum
ISNGNNNNDNDNNNNNNNI

SEQ ID NO: 3317010 - protein, 8 aa, Plasmodium falciparum
ISNGSNIP

SEQ ID NO: 3317011 - protein, 7 aa, Plasmodium falciparum
ISNINNE

SEQ ID NO: 3317012 - protein, 11 aa, Plasmodium falciparum
ISNKEKKKKVD

SEQ ID NO: 3317013 - protein, 17 aa, Plasmodium falciparum
ISNKNDMTKNAVDKSNL

SEQ ID NO: 3317014 - protein, 5 aa, Plasmodium falciparum
ISNKQ

SEQ ID NO: 3317015 - protein, 8 aa, Plasmodium falciparum
ISNKSRSK

SEQ ID NO: 3317016 - protein, 5 aa, Plasmodium falciparum
ISNLN

SEQ ID NO: 3317017 - protein, 6 aa, Plasmodium falciparum
ISNNHN

SEQ ID NO: 3317018 - protein, 19 aa, Plasmodium falciparum
ISNNKKNIKDNSFQDGKQK

SEQ ID NO: 3317019 - protein, 8 aa, Plasmodium falciparum
ISNNKNKG

SEQ ID NO: 3317020 - protein, 5 aa, Plasmodium falciparum
ISNNN

SEQ ID NO: 3317021 - protein, 10 aa, Plasmodium falciparum
ISNNNKIHEE

SEQ ID NO: 3317022 - protein, 21 aa, Plasmodium falciparum
ISNNNNNNNYNYNNNNYNNNN

SEQ ID NO: 3317023 - protein, 10 aa, Plasmodium falciparum
ISNNNNNSQQ

SEQ ID NO: 3317024 - protein, 11 aa, Plasmodium falciparum
ISNNNSNINNN

SEQ ID NO: 3317025 - protein, 7 aa, Plasmodium falciparum
ISNNNST

SEQ ID NO: 3317026 - protein, 65 aa, Plasmodium falciparum
ISNNTLNNNTSGSEMPQNNSPNELQSEMKSTNGIDDNSNISENKINESSSNQNNIGENSIAEENN

SEQ ID NO: 3317027 - protein, 19 aa, Plasmodium falciparum
ISNNTNDQEDHNTNDKNHI

SEQ ID NO: 3317028 - protein, 42 aa, Plasmodium falciparum
ISNNTNNLNYEREKNNNYEREKNNNYEREKNNNYEREKNNNY

SEQ ID NO: 3317029 - protein, 9 aa, Plasmodium falciparum
ISNQDSSKR

SEQ ID NO: 3317030 - protein, 7 aa, Plasmodium falciparum
ISNSEKS

SEQ ID NO: 3317031 - protein, 6 aa, Plasmodium falciparum
ISNSKR

SEQ ID NO: 3317032 - protein, 7 aa, Plasmodium falciparum
ISNSNDP

SEQ ID NO: 3317033 - protein, 8 aa, Plasmodium falciparum
ISNSNPKL

SEQ ID NO: 3317034 - protein, 9 aa, Plasmodium falciparum
ISNSNSSEL

SEQ ID NO: 3317035 - protein, 9 aa, Plasmodium falciparum
ISNSNTLNN

SEQ ID NO: 3317036 - protein, 5 aa, Plasmodium falciparum
ISNSS

SEQ ID NO: 3317037 - protein, 28 aa, Plasmodium falciparum
ISNSSYDSSYSESTMSSNNFSNSSDTPI

SEQ ID NO: 3317038 - protein, 5 aa, Plasmodium falciparum
ISNTN

SEQ ID NO: 3317039 - protein, 10 aa, Plasmodium falciparum
ISNTSGNTNN

SEQ ID NO: 3317040 - protein, 17 aa, Plasmodium falciparum
ISNTSKKKNQDVTDSKD

SEQ ID NO: 3317041 - protein, 4 aa, Plasmodium falciparum
ISNY

SEQ ID NO: 3317042 - protein, 16 aa, Plasmodium falciparum
ISNYHKKDKKKKAIDE

SEQ ID NO: 3317043 - protein, 6 aa, Plasmodium falciparum
ISNYKG

SEQ ID NO: 3317044 - protein, 15 aa, Plasmodium falciparum
ISNYSNNNSNSNSNI

SEQ ID NO: 3317045 - protein, 5 aa, Plasmodium falciparum
ISPDC

SEQ ID NO: 3317046 - protein, 5 aa, Plasmodium falciparum
ISPDG

SEQ ID NO: 3317047 - protein, 7 aa, Plasmodium falciparum
ISPDPNI

SEQ ID NO: 3317048 - protein, 17 aa, Plasmodium falciparum
ISPEQHKKGNRKKKINT

SEQ ID NO: 3317049 - protein, 4 aa, Plasmodium falciparum
ISPG

SEQ ID NO: 3317050 - protein, 5 aa, Plasmodium falciparum
ISPGL

SEQ ID NO: 3317051 - protein, 5 aa, Plasmodium falciparum
ISPKD

SEQ ID NO: 3317052 - protein, 14 aa, Plasmodium falciparum
ISPKEEKSLNKEEI

SEQ ID NO: 3317053 - protein, 4 aa, Plasmodium falciparum
ISPN

SEQ ID NO: 3317054 - protein, 30 aa, Plasmodium falciparum
ISPNRIENERNHDNNNREESSCSSSDESSN

SEQ ID NO: 3317055 - protein, 6 aa, Plasmodium falciparum
ISPSLE

SEQ ID NO: 3317056 - protein, 10 aa, Plasmodium falciparum
ISPSYHTNNN

SEQ ID NO: 3317057 - protein, 6 aa, Plasmodium falciparum
ISPTDE

SEQ ID NO: 3317058 - protein, 6 aa, Plasmodium falciparum
ISQEDV

SEQ ID NO: 3317059 - protein, 5 aa, Plasmodium falciparum
ISQEK

SEQ ID NO: 3317060 - protein, 7 aa, Plasmodium falciparum
ISQESSK

SEQ ID NO: 3317061 - protein, 6 aa, Plasmodium falciparum
ISQKYY

SEQ ID NO: 3317062 - protein, 4 aa, Plasmodium falciparum
ISQN

SEQ ID NO: 3317063 - protein, 11 aa, Plasmodium falciparum
ISQNETNDTIE

SEQ ID NO: 3317064 - protein, 10 aa, Plasmodium falciparum
ISQNKLDHEK

SEQ ID NO: 3317065 - protein, 6 aa, Plasmodium falciparum
ISQNNK

SEQ ID NO: 3317066 - protein, 5 aa, Plasmodium falciparum
ISQNS

SEQ ID NO: 3317067 - protein, 4 aa, Plasmodium falciparum
ISQP

SEQ ID NO: 3317068 - protein, 4 aa, Plasmodium falciparum
ISQS

SEQ ID NO: 3317069 - protein, 4 aa, Plasmodium falciparum
ISQY

SEQ ID NO: 3317070 - protein, 4 aa, Plasmodium falciparum
ISRD

SEQ ID NO: 3317071 - protein, 6 aa, Plasmodium falciparum
ISRDVS

SEQ ID NO: 3317072 - protein, 11 aa, Plasmodium falciparum
ISREEKNKYNS

SEQ ID NO: 3317073 - protein, 11 aa, Plasmodium falciparum
ISREKKCKENE

SEQ ID NO: 3317074 - protein, 6 aa, Plasmodium falciparum
ISRKGN

SEQ ID NO: 3317075 - protein, 16 aa, Plasmodium falciparum
ISRKKKKKYSSNSKSN

SEQ ID NO: 3317076 - protein, 26 aa, Plasmodium falciparum
ISRKSSSKMYNKENKEYEQEKETFDQ

SEQ ID NO: 3317077 - protein, 4 aa, Plasmodium falciparum
ISRN

SEQ ID NO: 3317078 - protein, 10 aa, Plasmodium falciparum
ISRSSSCNNS

SEQ ID NO: 3317079 - protein, 6 aa, Plasmodium falciparum
ISRTTD

SEQ ID NO: 3317080 - protein, 12 aa, Plasmodium falciparum
ISRYKEKNKLNK

SEQ ID NO: 3317081 - protein, 15 aa, Plasmodium falciparum
ISSAKENIIRSLLSG

SEQ ID NO: 3317082 - protein, 19 aa, Plasmodium falciparum
ISSDEDDKPPEKKKERIIK

SEQ ID NO: 3317083 - protein, 11 aa, Plasmodium falciparum
ISSDGRVGSTA

SEQ ID NO: 3317084 - protein, 5 aa, Plasmodium falciparum
ISSDQ

SEQ ID NO: 3317085 - protein, 14 aa, Plasmodium falciparum
ISSDSNNSEFKKKS

SEQ ID NO: 3317086 - protein, 13 aa, Plasmodium falciparum
ISSEGEKKKDIKQ

SEQ ID NO: 3317087 - protein, 10 aa, Plasmodium falciparum
ISSEIKTDNI

SEQ ID NO: 3317088 - protein, 7 aa, Plasmodium falciparum
ISSEKEK

SEQ ID NO: 3317089 - protein, 8 aa, Plasmodium falciparum
ISSEKKSK

SEQ ID NO: 3317090 - protein, 11 aa, Plasmodium falciparum
ISSENSTKLED

SEQ ID NO: 3317091 - protein, 4 aa, Plasmodium falciparum
ISSF

SEQ ID NO: 3317092 - protein, 5 aa, Plasmodium falciparum
ISSGD

SEQ ID NO: 3317093 - protein, 5 aa, Plasmodium falciparum
ISSGK

SEQ ID NO: 3317094 - protein, 9 aa, Plasmodium falciparum
ISSGNTNTS

SEQ ID NO: 3317095 - protein, 4 aa, Plasmodium falciparum
ISSI

SEQ ID NO: 3317096 - protein, 4 aa, Plasmodium falciparum
ISSK

SEQ ID NO: 3317097 - protein, 10 aa, Plasmodium falciparum
ISSKGFTSKG

SEQ ID NO: 3317098 - protein, 26 aa, Plasmodium falciparum
ISSKKRKEKINYQDEEEFKDQQGYSS

SEQ ID NO: 3317099 - protein, 5 aa, Plasmodium falciparum
ISSKN

SEQ ID NO: 3317100 - protein, 14 aa, Plasmodium falciparum
ISSKNKKNINDKNY

SEQ ID NO: 3317101 - protein, 6 aa, Plasmodium falciparum
ISSKNN

SEQ ID NO: 3317102 - protein, 20 aa, Plasmodium falciparum
ISSKQKGKNNLTNYTTHSSE

SEQ ID NO: 3317103 - protein, 11 aa, Plasmodium falciparum
ISSKRKKDKRN

SEQ ID NO: 3317104 - protein, 4 aa, Plasmodium falciparum
ISSL

SEQ ID NO: 3317105 - protein, 18 aa, Plasmodium falciparum
ISSNCTNNNNNNNNLENL

SEQ ID NO: 3317106 - protein, 6 aa, Plasmodium falciparum
ISSNDI

SEQ ID NO: 3317107 - protein, 11 aa, Plasmodium falciparum
ISSNDNNTSFN

SEQ ID NO: 3317108 - protein, 10 aa, Plasmodium falciparum
ISSNLENNKP

SEQ ID NO: 3317109 - protein, 9 aa, Plasmodium falciparum
ISSNNEKNC

SEQ ID NO: 3317110 - protein, 13 aa, Plasmodium falciparum
ISSNNMNNQSVGD

SEQ ID NO: 3317111 - protein, 9 aa, Plasmodium falciparum
ISSNNNNNN

SEQ ID NO: 3317112 - protein, 17 aa, Plasmodium falciparum
ISSNNNNNNNNNKNNYE

SEQ ID NO: 3317113 - protein, 14 aa, Plasmodium falciparum
ISSNNSSKNSEQVR

SEQ ID NO: 3317114 - protein, 9 aa, Plasmodium falciparum
ISSPPKENK

SEQ ID NO: 3317115 - protein, 11 aa, Plasmodium falciparum
ISSPTHQQINR

SEQ ID NO: 3317116 - protein, 22 aa, Plasmodium falciparum
ISSQKDTYNNISSQKDTYNNIS

SEQ ID NO: 3317117 - protein, 17 aa, Plasmodium falciparum
ISSQTSPNINNNCTTKY

SEQ ID NO: 3317118 - protein, 15 aa, Plasmodium falciparum
ISSSDDDNKKKLNPH

SEQ ID NO: 3317119 - protein, 8 aa, Plasmodium falciparum
ISSSDPDE

SEQ ID NO: 3317120 - protein, 5 aa, Plasmodium falciparum
ISSSE

SEQ ID NO: 3317121 - protein, 11 aa, Plasmodium falciparum
ISSSKRDNSVK

SEQ ID NO: 3317122 - protein, 8 aa, Plasmodium falciparum
ISSSNKSK

SEQ ID NO: 3317123 - protein, 13 aa, Plasmodium falciparum
ISSSNNTQTRPSI

SEQ ID NO: 3317124 - protein, 9 aa, Plasmodium falciparum
ISSSNQEEK

SEQ ID NO: 3317125 - protein, 7 aa, Plasmodium falciparum
ISSSQNI

SEQ ID NO: 3317126 - protein, 14 aa, Plasmodium falciparum
ISSSSIYKSPSHSF

SEQ ID NO: 3317127 - protein, 15 aa, Plasmodium falciparum
ISSSSSCEENDENKN

SEQ ID NO: 3317128 - protein, 10 aa, Plasmodium falciparum
ISSSSSSSLN

SEQ ID NO: 3317129 - protein, 23 aa, Plasmodium falciparum
ISSSSSSSSSSSSSSSLSSSSSL

SEQ ID NO: 3317130 - protein, 9 aa, Plasmodium falciparum
ISSTKRKNF

SEQ ID NO: 3317131 - protein, 9 aa, Plasmodium falciparum
ISSTNKYES

SEQ ID NO: 3317132 - protein, 43 aa, Plasmodium falciparum
ISSTNNKKDNNNNNNDSNNNDSNNNDSNNNDSNDSNMQSNKSI

SEQ ID NO: 3317133 - protein, 13 aa, Plasmodium falciparum
ISSYGDNKQNNIL

SEQ ID NO: 3317134 - protein, 14 aa, Plasmodium falciparum
ISSYGNNLSHDNNM

SEQ ID NO: 3317135 - protein, 6 aa, Plasmodium falciparum
ISSYNN

SEQ ID NO: 3317136 - protein, 11 aa, Plasmodium falciparum
ISTAKSKEQIK

SEQ ID NO: 3317137 - protein, 15 aa, Plasmodium falciparum
ISTDFSQNKKNILNS

SEQ ID NO: 3317138 - protein, 8 aa, Plasmodium falciparum
ISTDPNNI

SEQ ID NO: 3317139 - protein, 12 aa, Plasmodium falciparum
ISTEDEAEKKSN

SEQ ID NO: 3317140 - protein, 11 aa, Plasmodium falciparum
ISTEKKTVDNQ

SEQ ID NO: 3317141 - protein, 10 aa, Plasmodium falciparum
ISTENNESTT

SEQ ID NO: 3317142 - protein, 10 aa, Plasmodium falciparum
ISTGGNNNQL

SEQ ID NO: 3317143 - protein, 9 aa, Plasmodium falciparum
ISTGKRRDL

SEQ ID NO: 3317144 - protein, 20 aa, Plasmodium falciparum
ISTGNSTGNSTECVKDGNKD

SEQ ID NO: 3317145 - protein, 6 aa, Plasmodium falciparum
ISTGNT

SEQ ID NO: 3317146 - protein, 7 aa, Plasmodium falciparum
ISTISDK

SEQ ID NO: 3317147 - protein, 4 aa, Plasmodium falciparum
ISTK

SEQ ID NO: 3317148 - protein, 5 aa, Plasmodium falciparum
ISTKE

SEQ ID NO: 3317149 - protein, 15 aa, Plasmodium falciparum
ISTKERKIYNNNNNN

SEQ ID NO: 3317150 - protein, 9 aa, Plasmodium falciparum
ISTKGKVGF

SEQ ID NO: 3317151 - protein, 6 aa, Plasmodium falciparum
ISTKRS

SEQ ID NO: 3317152 - protein, 4 aa, Plasmodium falciparum
ISTN

SEQ ID NO: 3317153 - protein, 12 aa, Plasmodium falciparum
ISTNDGDDHYKD

SEQ ID NO: 3317154 - protein, 12 aa, Plasmodium falciparum
ISTNDKNNAVRN

SEQ ID NO: 3317155 - protein, 11 aa, Plasmodium falciparum
ISTNDNKQSEI

SEQ ID NO: 3317156 - protein, 6 aa, Plasmodium falciparum
ISTNNI

SEQ ID NO: 3317157 - protein, 9 aa, Plasmodium falciparum
ISTNNSNEK

SEQ ID NO: 3317158 - protein, 163 aa, Plasmodium falciparum
ISTNRSQSKKEKDSNEDMYNDKKRNNYKSSSESKEKGDKYCKKDKYDKHDKYDKNGKYDKHDKYDKYNKYDKHDKYDKHNKYDKHDKYDKHDKYDKHDKYDKHDKYDKYNKYDKHDKYDKHNKYDKHNKYDKHDKYDKHDKYDKHDKYNKHDKHDRHDKYDKQ

SEQ ID NO: 3317159 - protein, 4 aa, Plasmodium falciparum
ISTQ

SEQ ID NO: 3317160 - protein, 14 aa, Plasmodium falciparum
ISTQQNKGDNTNVD

SEQ ID NO: 3317161 - protein, 14 aa, Plasmodium falciparum
ISTSDEQNDDSDCS

SEQ ID NO: 3317162 - protein, 14 aa, Plasmodium falciparum
ISTSGINNNTTSAT

SEQ ID NO: 3317163 - protein, 33 aa, Plasmodium falciparum
ISTSTTTNNNNNNNNNNNNNNINNNNNNEGSRS

SEQ ID NO: 3317164 - protein, 11 aa, Plasmodium falciparum
ISTTHKNDSNN

SEQ ID NO: 3317165 - protein, 4 aa, Plasmodium falciparum
ISTY

SEQ ID NO: 3317166 - protein, 6 aa, Plasmodium falciparum
ISTYEN

SEQ ID NO: 3317167 - protein, 23 aa, Plasmodium falciparum
ISVDSQNNDINKSPCENSQDRNH

SEQ ID NO: 3317168 - protein, 6 aa, Plasmodium falciparum
ISVNPN

SEQ ID NO: 3317169 - protein, 11 aa, Plasmodium falciparum
ISYNETNLSEN

SEQ ID NO: 3317170 - protein, 5 aa, Plasmodium falciparum
ITAEN

SEQ ID NO: 3317171 - protein, 8 aa, Plasmodium falciparum
ITAGDKNY

SEQ ID NO: 3317172 - protein, 4 aa, Plasmodium falciparum
ITAN

SEQ ID NO: 3317173 - protein, 25 aa, Plasmodium falciparum
ITANNNNDNNKNNDNDNNNNNNDNI

SEQ ID NO: 3317174 - protein, 5 aa, Plasmodium falciparum
ITAPE

SEQ ID NO: 3317175 - protein, 10 aa, Plasmodium falciparum
ITDDDKASKI

SEQ ID NO: 3317176 - protein, 20 aa, Plasmodium falciparum
ITDDGNNKSNSDSNINSRDN

SEQ ID NO: 3317177 - protein, 6 aa, Plasmodium falciparum
ITDDNT

SEQ ID NO: 3317178 - protein, 4 aa, Plasmodium falciparum
ITDE

SEQ ID NO: 3317179 - protein, 17 aa, Plasmodium falciparum
ITDGNNNNNNNNNNNIN

SEQ ID NO: 3317180 - protein, 6 aa, Plasmodium falciparum
ITDKNT

SEQ ID NO: 3317181 - protein, 4 aa, Plasmodium falciparum
ITDN

SEQ ID NO: 3317182 - protein, 16 aa, Plasmodium falciparum
ITDNKKNMDEEDTEQM

SEQ ID NO: 3317183 - protein, 5 aa, Plasmodium falciparum
ITDPE

SEQ ID NO: 3317184 - protein, 5 aa, Plasmodium falciparum
ITDRN

SEQ ID NO: 3317185 - protein, 7 aa, Plasmodium falciparum
ITDRSEY

SEQ ID NO: 3317186 - protein, 11 aa, Plasmodium falciparum
ITDTNTKPNIP

SEQ ID NO: 3317187 - protein, 10 aa, Plasmodium falciparum
ITDTQKLSAE

SEQ ID NO: 3317188 - protein, 5 aa, Plasmodium falciparum
ITDTT

SEQ ID NO: 3317189 - protein, 9 aa, Plasmodium falciparum
ITEDEGGKK

SEQ ID NO: 3317190 - protein, 11 aa, Plasmodium falciparum
ITEETTNEKEK

SEQ ID NO: 3317191 - protein, 11 aa, Plasmodium falciparum
ITEKKCDTYKD

SEQ ID NO: 3317192 - protein, 4 aa, Plasmodium falciparum
ITEN

SEQ ID NO: 3317193 - protein, 4 aa, Plasmodium falciparum
ITEQ

SEQ ID NO: 3317194 - protein, 6 aa, Plasmodium falciparum
ITETTN

SEQ ID NO: 3317195 - protein, 10 aa, Plasmodium falciparum
ITEYDGNNIS

SEQ ID NO: 3317196 - protein, 11 aa, Plasmodium falciparum
ITGDDKNIKVD

SEQ ID NO: 3317197 - protein, 8 aa, Plasmodium falciparum
ITGNTTKN

SEQ ID NO: 3317198 - protein, 9 aa, Plasmodium falciparum
ITGSKLQET

SEQ ID NO: 3317199 - protein, 16 aa, Plasmodium falciparum
ITHSPKKSVPSQPPTQ

SEQ ID NO: 3317200 - protein, 4 aa, Plasmodium falciparum
ITIE

SEQ ID NO: 3317201 - protein, 25 aa, Plasmodium falciparum
ITKDEKKDNDKDLLNEKENESSLNN

SEQ ID NO: 3317202 - protein, 8 aa, Plasmodium falciparum
ITKDGEAD

SEQ ID NO: 3317203 - protein, 10 aa, Plasmodium falciparum
ITKDNNNNIT

SEQ ID NO: 3317204 - protein, 4 aa, Plasmodium falciparum
ITKE

SEQ ID NO: 3317205 - protein, 5 aa, Plasmodium falciparum
ITKED

SEQ ID NO: 3317206 - protein, 9 aa, Plasmodium falciparum
ITKEEDDKY

SEQ ID NO: 3317207 - protein, 12 aa, Plasmodium falciparum
ITKENKKETTES

SEQ ID NO: 3317208 - protein, 14 aa, Plasmodium falciparum
ITKENQEDFQNTDI

SEQ ID NO: 3317209 - protein, 9 aa, Plasmodium falciparum
ITKESRNSK

SEQ ID NO: 3317210 - protein, 145 aa, Plasmodium falciparum
ITKGKKKGRKKKQTLENNGDNIKEDIKSSKKDKKKDNINDNNNDNNNDNNNDNNNDNNNDNNNDNNNDNNNNNNNNNNNNNNNNNNNHNNHNDNKNNQGDSKNEQEKKKKTRQYRKKSKITNDDNNEKIKQDNINSNNPKNDLKN

SEQ ID NO: 3317211 - protein, 16 aa, Plasmodium falciparum
ITKGTKGEADRSIPSL

SEQ ID NO: 3317212 - protein, 11 aa, Plasmodium falciparum
ITKKEIDKENY

SEQ ID NO: 3317213 - protein, 5 aa, Plasmodium falciparum
ITKKY

SEQ ID NO: 3317214 - protein, 10 aa, Plasmodium falciparum
ITKNDDDDEI

SEQ ID NO: 3317215 - protein, 6 aa, Plasmodium falciparum
ITKNKH

SEQ ID NO: 3317216 - protein, 10 aa, Plasmodium falciparum
ITKNKKKDEL

SEQ ID NO: 3317217 - protein, 16 aa, Plasmodium falciparum
ITKSGAPLQTGGDLKK

SEQ ID NO: 3317218 - protein, 12 aa, Plasmodium falciparum
ITKTEKNSPLMG

SEQ ID NO: 3317219 - protein, 9 aa, Plasmodium falciparum
ITKTNDSPI

SEQ ID NO: 3317220 - protein, 27 aa, Plasmodium falciparum
ITNDDNNEMKKENIGNNDNNNNNNNNS

SEQ ID NO: 3317221 - protein, 8 aa, Plasmodium falciparum
ITNDESKK

SEQ ID NO: 3317222 - protein, 5 aa, Plasmodium falciparum
ITNDG

SEQ ID NO: 3317223 - protein, 9 aa, Plasmodium falciparum
ITNDQKEQY

SEQ ID NO: 3317224 - protein, 16 aa, Plasmodium falciparum
ITNEENIETKKYQKET

SEQ ID NO: 3317225 - protein, 12 aa, Plasmodium falciparum
ITNEKTKVNTHD

SEQ ID NO: 3317226 - protein, 5 aa, Plasmodium falciparum
ITNEN

SEQ ID NO: 3317227 - protein, 98 aa, Plasmodium falciparum
ITNEQSNNESSPNKKKNKKKNKKKNKKKKKKKNVSCNNSRSSSQNNDDNDDNNDQNNNHNNNQNDQNNNQDNNQDNNQDNNQDNNQDNNQDNNQNDNH

SEQ ID NO: 3317228 - protein, 13 aa, Plasmodium falciparum
ITNIDDKNTKETI

SEQ ID NO: 3317229 - protein, 5 aa, Plasmodium falciparum
ITNKD

SEQ ID NO: 3317230 - protein, 63 aa, Plasmodium falciparum
ITNKDDNNNNNNNNNNNNDNNNNNNNNNNNSENVNKKKNKKKNKKKTNQVSTNAWTNDKNSNL

SEQ ID NO: 3317231 - protein, 10 aa, Plasmodium falciparum
ITNKEEDNEK

SEQ ID NO: 3317232 - protein, 8 aa, Plasmodium falciparum
ITNKEQDT

SEQ ID NO: 3317233 - protein, 5 aa, Plasmodium falciparum
ITNKN

SEQ ID NO: 3317234 - protein, 55 aa, Plasmodium falciparum
ITNKNNKDDNNNNNNDNNNDNNNNDNNNNINVEETKEQGNMKNSYNTKNNEEDTN

SEQ ID NO: 3317235 - protein, 10 aa, Plasmodium falciparum
ITNKNTSSDI

SEQ ID NO: 3317236 - protein, 12 aa, Plasmodium falciparum
ITNKSNSSKDIN

SEQ ID NO: 3317237 - protein, 4 aa, Plasmodium falciparum
ITNN

SEQ ID NO: 3317238 - protein, 11 aa, Plasmodium falciparum
ITNNATYNKEY

SEQ ID NO: 3317239 - protein, 30 aa, Plasmodium falciparum
ITNNNEKKNDEKFSSSTYKSYSDNDNNGVS

SEQ ID NO: 3317240 - protein, 10 aa, Plasmodium falciparum
ITNNNSNINL

SEQ ID NO: 3317241 - protein, 10 aa, Plasmodium falciparum
ITNNQHNNDA

SEQ ID NO: 3317242 - protein, 9 aa, Plasmodium falciparum
ITNNRDNDI

SEQ ID NO: 3317243 - protein, 31 aa, Plasmodium falciparum
ITNNSNNNNNNKNNNKISNNNKNNNISNNTN

SEQ ID NO: 3317244 - protein, 20 aa, Plasmodium falciparum
ITNNTNNTYNTNNTNDTYDN

SEQ ID NO: 3317245 - protein, 14 aa, Plasmodium falciparum
ITNNYNNNNNNNIP

SEQ ID NO: 3317246 - protein, 10 aa, Plasmodium falciparum
ITNPSNDSYY

SEQ ID NO: 3317247 - protein, 4 aa, Plasmodium falciparum
ITNQ

SEQ ID NO: 3317248 - protein, 5 aa, Plasmodium falciparum
ITNQG

SEQ ID NO: 3317249 - protein, 4 aa, Plasmodium falciparum
ITNS

SEQ ID NO: 3317250 - protein, 11 aa, Plasmodium falciparum
ITNSDNKSIID

SEQ ID NO: 3317251 - protein, 6 aa, Plasmodium falciparum
ITNSEE

SEQ ID NO: 3317252 - protein, 6 aa, Plasmodium falciparum
ITNSNN

SEQ ID NO: 3317253 - protein, 11 aa, Plasmodium falciparum
ITNSSGSKPCA

SEQ ID NO: 3317254 - protein, 13 aa, Plasmodium falciparum
ITNTSENSGPNKV

SEQ ID NO: 3317255 - protein, 5 aa, Plasmodium falciparum
ITPDA

SEQ ID NO: 3317256 - protein, 17 aa, Plasmodium falciparum
ITPEPGSPKNEDAVSEV

SEQ ID NO: 3317257 - protein, 8 aa, Plasmodium falciparum
ITPKEDSL

SEQ ID NO: 3317258 - protein, 14 aa, Plasmodium falciparum
ITPLPSNLNLMAGI

SEQ ID NO: 3317259 - protein, 4 aa, Plasmodium falciparum
ITPN

SEQ ID NO: 3317260 - protein, 15 aa, Plasmodium falciparum
ITPNGTTKDNIQNGL

SEQ ID NO: 3317261 - protein, 9 aa, Plasmodium falciparum
ITPNSSTKE

SEQ ID NO: 3317262 - protein, 9 aa, Plasmodium falciparum
ITPPINNNN

SEQ ID NO: 3317263 - protein, 11 aa, Plasmodium falciparum
ITPPNGDGTRA

SEQ ID NO: 3317264 - protein, 10 aa, Plasmodium falciparum
ITPPRDNGME

SEQ ID NO: 3317265 - protein, 9 aa, Plasmodium falciparum
ITPQTKESA

SEQ ID NO: 3317266 - protein, 11 aa, Plasmodium falciparum
ITPSNGNKNDI

SEQ ID NO: 3317267 - protein, 4 aa, Plasmodium falciparum
ITPT

SEQ ID NO: 3317268 - protein, 7 aa, Plasmodium falciparum
ITPVNKN

SEQ ID NO: 3317269 - protein, 12 aa, Plasmodium falciparum
ITPYPNNSLNSN

SEQ ID NO: 3317270 - protein, 10 aa, Plasmodium falciparum
ITQDNTNNVS

SEQ ID NO: 3317271 - protein, 14 aa, Plasmodium falciparum
ITQEKNKTRKEPNF

SEQ ID NO: 3317272 - protein, 16 aa, Plasmodium falciparum
ITQNKNDNNKENAYDD

SEQ ID NO: 3317273 - protein, 7 aa, Plasmodium falciparum
ITQNNSD

SEQ ID NO: 3317274 - protein, 4 aa, Plasmodium falciparum
ITQP

SEQ ID NO: 3317275 - protein, 8 aa, Plasmodium falciparum
ITQPPKYL

SEQ ID NO: 3317276 - protein, 47 aa, Plasmodium falciparum
ITQSNIEKKQEKEQIKNQADNQKDNQKDNQANNQKDNQQKNQNNKKI

SEQ ID NO: 3317277 - protein, 4 aa, Plasmodium falciparum
ITRG

SEQ ID NO: 3317278 - protein, 4 aa, Plasmodium falciparum
ITRK

SEQ ID NO: 3317279 - protein, 7 aa, Plasmodium falciparum
ITRTSSN

SEQ ID NO: 3317280 - protein, 5 aa, Plasmodium falciparum
ITSAH

SEQ ID NO: 3317281 - protein, 4 aa, Plasmodium falciparum
ITSD

SEQ ID NO: 3317282 - protein, 17 aa, Plasmodium falciparum
ITSDFPKNSNSYNNYDN

SEQ ID NO: 3317283 - protein, 15 aa, Plasmodium falciparum
ITSDNKNLKKSIEEK

SEQ ID NO: 3317284 - protein, 12 aa, Plasmodium falciparum
ITSDNNKTQNEC

SEQ ID NO: 3317285 - protein, 4 aa, Plasmodium falciparum
ITSE

SEQ ID NO: 3317286 - protein, 11 aa, Plasmodium falciparum
ITSENDEEIDN

SEQ ID NO: 3317287 - protein, 34 aa, Plasmodium falciparum
ITSEQAKRKSIYESQKSKQVSESKKRRLTSNLKS

SEQ ID NO: 3317288 - protein, 17 aa, Plasmodium falciparum
ITSEQGAYSNEKQGLQN

SEQ ID NO: 3317289 - protein, 6 aa, Plasmodium falciparum
ITSGND

SEQ ID NO: 3317290 - protein, 10 aa, Plasmodium falciparum
ITSGSPDSDD

SEQ ID NO: 3317291 - protein, 8 aa, Plasmodium falciparum
ITSGTGYD

SEQ ID NO: 3317292 - protein, 6 aa, Plasmodium falciparum
ITSKNN

SEQ ID NO: 3317293 - protein, 9 aa, Plasmodium falciparum
ITSNGSNNI

SEQ ID NO: 3317294 - protein, 23 aa, Plasmodium falciparum
ITSNKEKNVEEKKLNKGDAGKEI

SEQ ID NO: 3317295 - protein, 21 aa, Plasmodium falciparum
ITSNKNDIYNEENEDINNKNK

SEQ ID NO: 3317296 - protein, 10 aa, Plasmodium falciparum
ITSNNISNEY

SEQ ID NO: 3317297 - protein, 26 aa, Plasmodium falciparum
ITSNNRNNEEYEKEKEKDRNITNGNN

SEQ ID NO: 3317298 - protein, 9 aa, Plasmodium falciparum
ITSPNEEQY

SEQ ID NO: 3317299 - protein, 6 aa, Plasmodium falciparum
ITSQKK

SEQ ID NO: 3317300 - protein, 6 aa, Plasmodium falciparum
ITSQYP

SEQ ID NO: 3317301 - protein, 9 aa, Plasmodium falciparum
ITSSGTREN

SEQ ID NO: 3317302 - protein, 32 aa, Plasmodium falciparum
ITSTNNSKNEDEEEKEETEKNINKQNNNINNI

SEQ ID NO: 3317303 - protein, 6 aa, Plasmodium falciparum
ITSTNY

SEQ ID NO: 3317304 - protein, 15 aa, Plasmodium falciparum
ITTDYESSKNIREGK

SEQ ID NO: 3317305 - protein, 4 aa, Plasmodium falciparum
ITTE

SEQ ID NO: 3317306 - protein, 4 aa, Plasmodium falciparum
ITTN

SEQ ID NO: 3317307 - protein, 12 aa, Plasmodium falciparum
ITTNNNNTNVSA

SEQ ID NO: 3317308 - protein, 10 aa, Plasmodium falciparum
ITTNSKNMKN

SEQ ID NO: 3317309 - protein, 23 aa, Plasmodium falciparum
ITTNTNNTSATTTNTSVTTTPFN

SEQ ID NO: 3317310 - protein, 5 aa, Plasmodium falciparum
ITTPD

SEQ ID NO: 3317311 - protein, 17 aa, Plasmodium falciparum
ITTQNDKEYNNTGTTAT

SEQ ID NO: 3317312 - protein, 4 aa, Plasmodium falciparum
ITTS

SEQ ID NO: 3317313 - protein, 5 aa, Plasmodium falciparum
ITTSK

SEQ ID NO: 3317314 - protein, 15 aa, Plasmodium falciparum
ITTSSQKREKKENDI

SEQ ID NO: 3317315 - protein, 65 aa, Plasmodium falciparum
ITTSSSNNRDGNANRDGNANRDGNSNRDGNVNRDSDTNRDSDTNRDSDTYRDSDTNGDSDTYGDM

SEQ ID NO: 3317316 - protein, 11 aa, Plasmodium falciparum
ITTTKNGSITS

SEQ ID NO: 3317317 - protein, 27 aa, Plasmodium falciparum
ITTTNTNDNNNDNNNINNNNNNNNNNI

SEQ ID NO: 3317318 - protein, 10 aa, Plasmodium falciparum
ITYDSDNGKF

SEQ ID NO: 3317319 - protein, 10 aa, Plasmodium falciparum
ITYKKNNKNI

SEQ ID NO: 3317320 - protein, 14 aa, Plasmodium falciparum
ITYNNEKKNYDNIE

SEQ ID NO: 3317321 - protein, 64 aa, Plasmodium falciparum
ITYNSKKNKFTDKEQKESKHSLDSSNKNVSVKSKKKKKYEKNHKGISKRVQPTRNCTKKKINYK

SEQ ID NO: 3317322 - protein, 12 aa, Plasmodium falciparum
ITYTKNNESEEC

SEQ ID NO: 3317323 - protein, 9 aa, Plasmodium falciparum
IVGKNNTTI

SEQ ID NO: 3317324 - protein, 8 aa, Plasmodium falciparum
IVGSDQGD

SEQ ID NO: 3317325 - protein, 9 aa, Plasmodium falciparum
IVNNTNKIK

SEQ ID NO: 3317326 - protein, 6 aa, Plasmodium falciparum
IVPGGG

SEQ ID NO: 3317327 - protein, 11 aa, Plasmodium falciparum
IVSDDDEKYGY

SEQ ID NO: 3317328 - protein, 7 aa, Plasmodium falciparum
IVSESKH

SEQ ID NO: 3317329 - protein, 6 aa, Plasmodium falciparum
IVSPGG

SEQ ID NO: 3317330 - protein, 4 aa, Plasmodium falciparum
IYDA

SEQ ID NO: 3317331 - protein, 7 aa, Plasmodium falciparum
IYDDKNV

SEQ ID NO: 3317332 - protein, 26 aa, Plasmodium falciparum
IYDDNKKDDDNKIYGDNKKDDDNKIY

SEQ ID NO: 3317333 - protein, 4 aa, Plasmodium falciparum
IYDE

SEQ ID NO: 3317334 - protein, 11 aa, Plasmodium falciparum
IYDYTDEEKVQ

SEQ ID NO: 3317335 - protein, 4 aa, Plasmodium falciparum
IYEE

SEQ ID NO: 3317336 - protein, 5 aa, Plasmodium falciparum
IYEEK

SEQ ID NO: 3317337 - protein, 6 aa, Plasmodium falciparum
IYEENS

SEQ ID NO: 3317338 - protein, 5 aa, Plasmodium falciparum
IYGDN

SEQ ID NO: 3317339 - protein, 7 aa, Plasmodium falciparum
IYGSGKK

SEQ ID NO: 3317340 - protein, 6 aa, Plasmodium falciparum
IYGSNE

SEQ ID NO: 3317341 - protein, 11 aa, Plasmodium falciparum
IYKNEYPENNE

SEQ ID NO: 3317342 - protein, 15 aa, Plasmodium falciparum
IYKNNKNNESTVNTS

SEQ ID NO: 3317343 - protein, 4 aa, Plasmodium falciparum
IYKQ

SEQ ID NO: 3317344 - protein, 6 aa, Plasmodium falciparum
IYKSDE

SEQ ID NO: 3317345 - protein, 11 aa, Plasmodium falciparum
IYKSDESNSTC

SEQ ID NO: 3317346 - protein, 19 aa, Plasmodium falciparum
IYNDSTKADEVDEEENDKD

SEQ ID NO: 3317347 - protein, 22 aa, Plasmodium falciparum
IYNEEKEKKQHKKSNTKKEMKK

SEQ ID NO: 3317348 - protein, 4 aa, Plasmodium falciparum
IYNK

SEQ ID NO: 3317349 - protein, 5 aa, Plasmodium falciparum
IYNKK

SEQ ID NO: 3317350 - protein, 10 aa, Plasmodium falciparum
IYNKKNDETY

SEQ ID NO: 3317351 - protein, 4 aa, Plasmodium falciparum
IYNN

SEQ ID NO: 3317352 - protein, 5 aa, Plasmodium falciparum
IYNNN

SEQ ID NO: 3317353 - protein, 22 aa, Plasmodium falciparum
IYNNNDNNNNDNNNNNSDHNNN

SEQ ID NO: 3317354 - protein, 10 aa, Plasmodium falciparum
IYNNNNNNNN

SEQ ID NO: 3317355 - protein, 17 aa, Plasmodium falciparum
IYNSKENNVNKFVNNVY

SEQ ID NO: 3317356 - protein, 14 aa, Plasmodium falciparum
IYNSSKKKNADKHF

SEQ ID NO: 3317357 - protein, 5 aa, Plasmodium falciparum
IYNSY

SEQ ID NO: 3317358 - protein, 12 aa, Plasmodium falciparum
IYNTSEKKTKCA

SEQ ID NO: 3317359 - protein, 6 aa, Plasmodium falciparum
IYPPQG

SEQ ID NO: 3317360 - protein, 8 aa, Plasmodium falciparum
IYSDDNTY

SEQ ID NO: 3317361 - protein, 7 aa, Plasmodium falciparum
IYSESEK

SEQ ID NO: 3317362 - protein, 36 aa, Plasmodium falciparum
IYSGDNIHSGDNIYSGDNIDDDNIYDGDNINSGDNV

SEQ ID NO: 3317363 - protein, 4 aa, Plasmodium falciparum
IYSK

SEQ ID NO: 3317364 - protein, 11 aa, Plasmodium falciparum
IYSKNKHTDTH

SEQ ID NO: 3317365 - protein, 5 aa, Plasmodium falciparum
IYSNN

SEQ ID NO: 3317366 - protein, 5 aa, Plasmodium falciparum
IYSNR

SEQ ID NO: 3317367 - protein, 4 aa, Plasmodium falciparum
IYSR

SEQ ID NO: 3317368 - protein, 18 aa, Plasmodium falciparum
IYTEETNENNLNKDKIDQ

SEQ ID NO: 3317369 - protein, 27 aa, Plasmodium falciparum
IYTNEEREDEKEKNLKINDKTKKKDTN

SEQ ID NO: 3317370 - protein, 13 aa, Plasmodium falciparum
IYTNSNSKENISS

SEQ ID NO: 3317371 - protein, 5 aa, Plasmodium falciparum
IYTPK

SEQ ID NO: 3317372 - protein, 6 aa, Plasmodium falciparum
IYTPQN

SEQ ID NO: 3317373 - protein, 9 aa, Plasmodium falciparum
IYTSGTTTD

SEQ ID NO: 3317374 - protein, 10 aa, Plasmodium falciparum
KAAEEEQKAD

SEQ ID NO: 3317375 - protein, 7 aa, Plasmodium falciparum
KAAEGPL

SEQ ID NO: 3317376 - protein, 5 aa, Plasmodium falciparum
KAAGI

SEQ ID NO: 3317377 - protein, 8 aa, Plasmodium falciparum
KAANAGGV

SEQ ID NO: 3317378 - protein, 8 aa, Plasmodium falciparum
KAANTQKI

SEQ ID NO: 3317379 - protein, 6 aa, Plasmodium falciparum
KAAPGS

SEQ ID NO: 3317380 - protein, 5 aa, Plasmodium falciparum
KAASD

SEQ ID NO: 3317381 - protein, 17 aa, Plasmodium falciparum
KAATNINNNNTEDNKYN

SEQ ID NO: 3317382 - protein, 6 aa, Plasmodium falciparum
KACQEG

SEQ ID NO: 3317383 - protein, 4 aa, Plasmodium falciparum
KACS

SEQ ID NO: 3317384 - protein, 6 aa, Plasmodium falciparum
KACSNN

SEQ ID NO: 3317385 - protein, 5 aa, Plasmodium falciparum
KACTD

SEQ ID NO: 3317386 - protein, 4 aa, Plasmodium falciparum
KADA

SEQ ID NO: 3317387 - protein, 7 aa, Plasmodium falciparum
KADATAE

SEQ ID NO: 3317388 - protein, 11 aa, Plasmodium falciparum
KADDENNEKDK

SEQ ID NO: 3317389 - protein, 22 aa, Plasmodium falciparum
KADDSNVDNKATESTAVDSEAK

SEQ ID NO: 3317390 - protein, 5 aa, Plasmodium falciparum
KADET

SEQ ID NO: 3317391 - protein, 4 aa, Plasmodium falciparum
KADF

SEQ ID NO: 3317392 - protein, 4 aa, Plasmodium falciparum
KADG

SEQ ID NO: 3317393 - protein, 11 aa, Plasmodium falciparum
KADGTSSSNLS

SEQ ID NO: 3317394 - protein, 12 aa, Plasmodium falciparum
KADINNNKKEIH

SEQ ID NO: 3317395 - protein, 10 aa, Plasmodium falciparum
KADKGEAQVD

SEQ ID NO: 3317396 - protein, 11 aa, Plasmodium falciparum
KADKSNGENSY

SEQ ID NO: 3317397 - protein, 7 aa, Plasmodium falciparum
KADKYGK

SEQ ID NO: 3317398 - protein, 8 aa, Plasmodium falciparum
KADMNKAD

SEQ ID NO: 3317399 - protein, 7 aa, Plasmodium falciparum
KADNTIS

SEQ ID NO: 3317400 - protein, 10 aa, Plasmodium falciparum
KADRDESSPY

SEQ ID NO: 3317401 - protein, 6 aa, Plasmodium falciparum
KADYTQ

SEQ ID NO: 3317402 - protein, 8 aa, Plasmodium falciparum
KAEELKNL

SEQ ID NO: 3317403 - protein, 6 aa, Plasmodium falciparum
KAEKDN

SEQ ID NO: 3317404 - protein, 9 aa, Plasmodium falciparum
KAEKENPTV

SEQ ID NO: 3317405 - protein, 8 aa, Plasmodium falciparum
KAEKGQHI

SEQ ID NO: 3317406 - protein, 6 aa, Plasmodium falciparum
KAENPK

SEQ ID NO: 3317407 - protein, 19 aa, Plasmodium falciparum
KAEPKKPKMSIKRSNNKNF

SEQ ID NO: 3317408 - protein, 5 aa, Plasmodium falciparum
KAEQQ

SEQ ID NO: 3317409 - protein, 7 aa, Plasmodium falciparum
KAESQTN

SEQ ID NO: 3317410 - protein, 8 aa, Plasmodium falciparum
KAESSEQV

SEQ ID NO: 3317411 - protein, 8 aa, Plasmodium falciparum
KAEYEDTM

SEQ ID NO: 3317412 - protein, 6 aa, Plasmodium falciparum
KAEYET

SEQ ID NO: 3317413 - protein, 13 aa, Plasmodium falciparum
KAGDLKRNYPDVD

SEQ ID NO: 3317414 - protein, 4 aa, Plasmodium falciparum
KAGE

SEQ ID NO: 3317415 - protein, 5 aa, Plasmodium falciparum
KAGGV

SEQ ID NO: 3317416 - protein, 4 aa, Plasmodium falciparum
KAGI

SEQ ID NO: 3317417 - protein, 8 aa, Plasmodium falciparum
KAGKPKCA

SEQ ID NO: 3317418 - protein, 21 aa, Plasmodium falciparum
KAGKQGVEKKGTKENKEVDKI

SEQ ID NO: 3317419 - protein, 7 aa, Plasmodium falciparum
KAGQGKW

SEQ ID NO: 3317420 - protein, 8 aa, Plasmodium falciparum
KAHEENDK

SEQ ID NO: 3317421 - protein, 6 aa, Plasmodium falciparum
KAIKRE

SEQ ID NO: 3317422 - protein, 10 aa, Plasmodium falciparum
KAINEKKQSD

SEQ ID NO: 3317423 - protein, 7 aa, Plasmodium falciparum
KAIQNNI

SEQ ID NO: 3317424 - protein, 9 aa, Plasmodium falciparum
KAITTTSAL

SEQ ID NO: 3317425 - protein, 7 aa, Plasmodium falciparum
KAKAGDL

SEQ ID NO: 3317426 - protein, 8 aa, Plasmodium falciparum
KAKDLASR

SEQ ID NO: 3317427 - protein, 59 aa, Plasmodium falciparum
KAKDNNENKDNINKGDDNNNNNNNNIKEEINKKNDLSEEKNGNYKNYSNDKENDNSTYM

SEQ ID NO: 3317428 - protein, 9 aa, Plasmodium falciparum
KAKDTLPKG

SEQ ID NO: 3317429 - protein, 40 aa, Plasmodium falciparum
KAKEEKKKKKKKKNILPSDSSEDLDDDDDDLGLKRQEKRR

SEQ ID NO: 3317430 - protein, 7 aa, Plasmodium falciparum
KAKEIKE

SEQ ID NO: 3317431 - protein, 5 aa, Plasmodium falciparum
KAKEK

SEQ ID NO: 3317432 - protein, 5 aa, Plasmodium falciparum
KAKEV

SEQ ID NO: 3317433 - protein, 9 aa, Plasmodium falciparum
KAKGEPEES

SEQ ID NO: 3317434 - protein, 10 aa, Plasmodium falciparum
KAKGRGGYAS

SEQ ID NO: 3317435 - protein, 12 aa, Plasmodium falciparum
KAKKESSNSRKR

SEQ ID NO: 3317436 - protein, 17 aa, Plasmodium falciparum
KAKKKAKKNKNEDEDDD

SEQ ID NO: 3317437 - protein, 7 aa, Plasmodium falciparum
KAKKKKA

SEQ ID NO: 3317438 - protein, 10 aa, Plasmodium falciparum
KAKNKQKQNY

SEQ ID NO: 3317439 - protein, 14 aa, Plasmodium falciparum
KAKPIMNESRNNQK

SEQ ID NO: 3317440 - protein, 7 aa, Plasmodium falciparum
KAKSEEQ

SEQ ID NO: 3317441 - protein, 8 aa, Plasmodium falciparum
KAKSTGYD

SEQ ID NO: 3317442 - protein, 5 aa, Plasmodium falciparum
KAKTQ

SEQ ID NO: 3317443 - protein, 8 aa, Plasmodium falciparum
KAKVNYDK

SEQ ID NO: 3317444 - protein, 10 aa, Plasmodium falciparum
KAKYEKPTPI

SEQ ID NO: 3317445 - protein, 7 aa, Plasmodium falciparum
KALEETA

SEQ ID NO: 3317446 - protein, 8 aa, Plasmodium falciparum
KALENSKK

SEQ ID NO: 3317447 - protein, 6 aa, Plasmodium falciparum
KALEPV

SEQ ID NO: 3317448 - protein, 35 aa, Plasmodium falciparum
KALKNKQNHEKKEEEKYNNTQDEKEYDNDNEQGHE

SEQ ID NO: 3317449 - protein, 12 aa, Plasmodium falciparum
KALNGDQSEYGV

SEQ ID NO: 3317450 - protein, 24 aa, Plasmodium falciparum
KAMKGNDNNVKDQKKGKHEEDNKK

SEQ ID NO: 3317451 - protein, 18 aa, Plasmodium falciparum
KANAKQRAGRAGRTGPGK

SEQ ID NO: 3317452 - protein, 37 aa, Plasmodium falciparum
KANDNQKNKHNNSNNNNNNNHSGDHNNLKQAKSEQET

SEQ ID NO: 3317453 - protein, 21 aa, Plasmodium falciparum
KANECENPKEDVELGGDENPD

SEQ ID NO: 3317454 - protein, 27 aa, Plasmodium falciparum
KANEDTENNNNNNNNNNNNNNNNCKNN

SEQ ID NO: 3317455 - protein, 5 aa, Plasmodium falciparum
KANEK

SEQ ID NO: 3317456 - protein, 10 aa, Plasmodium falciparum
KANINPEENS

SEQ ID NO: 3317457 - protein, 7 aa, Plasmodium falciparum
KANKESE

SEQ ID NO: 3317458 - protein, 7 aa, Plasmodium falciparum
KANKKHF

SEQ ID NO: 3317459 - protein, 5 aa, Plasmodium falciparum
KANLN

SEQ ID NO: 3317460 - protein, 8 aa, Plasmodium falciparum
KANMKRKQ

SEQ ID NO: 3317461 - protein, 8 aa, Plasmodium falciparum
KANNLDDN

SEQ ID NO: 3317462 - protein, 9 aa, Plasmodium falciparum
KANNNDSDN

SEQ ID NO: 3317463 - protein, 5 aa, Plasmodium falciparum
KANPN

SEQ ID NO: 3317464 - protein, 16 aa, Plasmodium falciparum
KANQNNKELTKKYEEN

SEQ ID NO: 3317465 - protein, 4 aa, Plasmodium falciparum
KANS

SEQ ID NO: 3317466 - protein, 8 aa, Plasmodium falciparum
KANSINQK

SEQ ID NO: 3317467 - protein, 9 aa, Plasmodium falciparum
KANTPGCTK

SEQ ID NO: 3317468 - protein, 6 aa, Plasmodium falciparum
KANYKR

SEQ ID NO: 3317469 - protein, 4 aa, Plasmodium falciparum
KAPE

SEQ ID NO: 3317470 - protein, 6 aa, Plasmodium falciparum
KAPEDA

SEQ ID NO: 3317471 - protein, 7 aa, Plasmodium falciparum
KAPETSL

SEQ ID NO: 3317472 - protein, 4 aa, Plasmodium falciparum
KAPH

SEQ ID NO: 3317473 - protein, 16 aa, Plasmodium falciparum
KAPKSPKQQDKIPKPL

SEQ ID NO: 3317474 - protein, 15 aa, Plasmodium falciparum
KAPKSVKDGEKRKNE

SEQ ID NO: 3317475 - protein, 9 aa, Plasmodium falciparum
KAPPTRREE

SEQ ID NO: 3317476 - protein, 10 aa, Plasmodium falciparum
KAPQHTQSAK

SEQ ID NO: 3317477 - protein, 6 aa, Plasmodium falciparum
KAPRAI

SEQ ID NO: 3317478 - protein, 8 aa, Plasmodium falciparum
KAPSGYDN

SEQ ID NO: 3317479 - protein, 13 aa, Plasmodium falciparum
KAQENTDKQKNSI

SEQ ID NO: 3317480 - protein, 8 aa, Plasmodium falciparum
KAQGKTGP

SEQ ID NO: 3317481 - protein, 5 aa, Plasmodium falciparum
KAQKE

SEQ ID NO: 3317482 - protein, 14 aa, Plasmodium falciparum
KAQKGELECQPGKS

SEQ ID NO: 3317483 - protein, 8 aa, Plasmodium falciparum
KAQKIKDI

SEQ ID NO: 3317484 - protein, 15 aa, Plasmodium falciparum
KAQKKKEIQEKLKNE

SEQ ID NO: 3317485 - protein, 4 aa, Plasmodium falciparum
KAQQ

SEQ ID NO: 3317486 - protein, 6 aa, Plasmodium falciparum
KAREEI

SEQ ID NO: 3317487 - protein, 8 aa, Plasmodium falciparum
KARKGKNQ

SEQ ID NO: 3317488 - protein, 6 aa, Plasmodium falciparum
KARKYS

SEQ ID NO: 3317489 - protein, 7 aa, Plasmodium falciparum
KARRAAE

SEQ ID NO: 3317490 - protein, 7 aa, Plasmodium falciparum
KARSKKK

SEQ ID NO: 3317491 - protein, 19 aa, Plasmodium falciparum
KARYERENHSTNNNNYNNN

SEQ ID NO: 3317492 - protein, 17 aa, Plasmodium falciparum
KASAEQRAGRAGRTKPG

SEQ ID NO: 3317493 - protein, 11 aa, Plasmodium falciparum
KASAKASANYN

SEQ ID NO: 3317494 - protein, 8 aa, Plasmodium falciparum
KASFDDDN

SEQ ID NO: 3317495 - protein, 75 aa, Plasmodium falciparum
KASIKNYNKNVKNNNKKCDNTNDNKNDNKNDNTNDNKNDNKCEKTTKDYEAKQVNKTLKKNANSPNNSKGKKRTG

SEQ ID NO: 3317496 - protein, 10 aa, Plasmodium falciparum
KASNDGFEKD

SEQ ID NO: 3317497 - protein, 13 aa, Plasmodium falciparum
KASNHLKDKEKLN

SEQ ID NO: 3317498 - protein, 9 aa, Plasmodium falciparum
KASNLGKQE

SEQ ID NO: 3317499 - protein, 6 aa, Plasmodium falciparum
KASNPA

SEQ ID NO: 3317500 - protein, 7 aa, Plasmodium falciparum
KASNSCS

SEQ ID NO: 3317501 - protein, 13 aa, Plasmodium falciparum
KASPGVKRKAKEY

SEQ ID NO: 3317502 - protein, 39 aa, Plasmodium falciparum
KASPSKDNVTSNTKDKNESTPTANMNTTTTTSNNNNSSS

SEQ ID NO: 3317503 - protein, 37 aa, Plasmodium falciparum
KASQSNSTKQSKCEEDAQQEDEETTIEEENKKMKEVE

SEQ ID NO: 3317504 - protein, 11 aa, Plasmodium falciparum
KASQSSLTNSS

SEQ ID NO: 3317505 - protein, 4 aa, Plasmodium falciparum
KASR

SEQ ID NO: 3317506 - protein, 9 aa, Plasmodium falciparum
KASRAAGPL

SEQ ID NO: 3317507 - protein, 5 aa, Plasmodium falciparum
KASSR

SEQ ID NO: 3317508 - protein, 9 aa, Plasmodium falciparum
KASTLNKNI

SEQ ID NO: 3317509 - protein, 8 aa, Plasmodium falciparum
KATDTLPK

SEQ ID NO: 3317510 - protein, 4 aa, Plasmodium falciparum
KATI

SEQ ID NO: 3317511 - protein, 4 aa, Plasmodium falciparum
KATK

SEQ ID NO: 3317512 - protein, 7 aa, Plasmodium falciparum
KATKERY

SEQ ID NO: 3317513 - protein, 7 aa, Plasmodium falciparum
KATKKDF

SEQ ID NO: 3317514 - protein, 7 aa, Plasmodium falciparum
KATNENE

SEQ ID NO: 3317515 - protein, 8 aa, Plasmodium falciparum
KATNNEKN

SEQ ID NO: 3317516 - protein, 9 aa, Plasmodium falciparum
KATNQEDFN

SEQ ID NO: 3317517 - protein, 7 aa, Plasmodium falciparum
KATPFEG

SEQ ID NO: 3317518 - protein, 7 aa, Plasmodium falciparum
KAVEDAR

SEQ ID NO: 3317519 - protein, 11 aa, Plasmodium falciparum
KAVEPGNLGKR

SEQ ID NO: 3317520 - protein, 9 aa, Plasmodium falciparum
KAVKENPID

SEQ ID NO: 3317521 - protein, 30 aa, Plasmodium falciparum
KAVKKKKKREEKKAKSKKTANQAVINVAAE

SEQ ID NO: 3317522 - protein, 18 aa, Plasmodium falciparum
KAVSRQKQINSQKKKLKK

SEQ ID NO: 3317523 - protein, 5 aa, Plasmodium falciparum
KAWGK

SEQ ID NO: 3317524 - protein, 11 aa, Plasmodium falciparum
KAYDGNKTNNW

SEQ ID NO: 3317525 - protein, 57 aa, Plasmodium falciparum
KAYEERVKKEEEERKKKENEEKINEKNINENKENKGEVSLTKEEQEMQNENHTDVNQ

SEQ ID NO: 3317526 - protein, 6 aa, Plasmodium falciparum
KAYELK

SEQ ID NO: 3317527 - protein, 7 aa, Plasmodium falciparum
KAYETTT

SEQ ID NO: 3317528 - protein, 5 aa, Plasmodium falciparum
KAYGK

SEQ ID NO: 3317529 - protein, 13 aa, Plasmodium falciparum
KAYKNRKQYDNKY

SEQ ID NO: 3317530 - protein, 11 aa, Plasmodium falciparum
KAYKSKSDNEK

SEQ ID NO: 3317531 - protein, 11 aa, Plasmodium falciparum
KAYNNSNKNLS

SEQ ID NO: 3317532 - protein, 11 aa, Plasmodium falciparum
KAYSSSSPSPM

SEQ ID NO: 3317533 - protein, 5 aa, Plasmodium falciparum
KAYVD

SEQ ID NO: 3317534 - protein, 4 aa, Plasmodium falciparum
KAYY

SEQ ID NO: 3317535 - protein, 7 aa, Plasmodium falciparum
KCASNKC

SEQ ID NO: 3317536 - protein, 20 aa, Plasmodium falciparum
KCCSNNNNNDKCCSNNNNND

SEQ ID NO: 3317537 - protein, 5 aa, Plasmodium falciparum
KCDDA

SEQ ID NO: 3317538 - protein, 7 aa, Plasmodium falciparum
KCDDDHE

SEQ ID NO: 3317539 - protein, 105 aa, Plasmodium falciparum
KCDDNKYNKCDDNKYDKCDDNKYNKCDDNKYDTCDDNKYDTCDDNKYDTCDDNKYNKYDDDKYDTCDDNKYNKYDDDKYNKYDDDKYNKYDDDKYEKSRKKKKLN

SEQ ID NO: 3317540 - protein, 8 aa, Plasmodium falciparum
KCDDNNNN

SEQ ID NO: 3317541 - protein, 10 aa, Plasmodium falciparum
KCDEGNNSTN

SEQ ID NO: 3317542 - protein, 13 aa, Plasmodium falciparum
KCDEKKDYLKNEE

SEQ ID NO: 3317543 - protein, 6 aa, Plasmodium falciparum
KCDETL

SEQ ID NO: 3317544 - protein, 13 aa, Plasmodium falciparum
KCDIKDQDKLNPS

SEQ ID NO: 3317545 - protein, 5 aa, Plasmodium falciparum
KCDKQ

SEQ ID NO: 3317546 - protein, 42 aa, Plasmodium falciparum
KCDNDGNNLNNGNNLNNGNNLNNGNNLNNGNNLNNGNNLNNG

SEQ ID NO: 3317547 - protein, 19 aa, Plasmodium falciparum
KCDNNENDKDRKSNIYNST

SEQ ID NO: 3317548 - protein, 26 aa, Plasmodium falciparum
KCDNTQDDENSEQNQNYITNPSNGHY

SEQ ID NO: 3317549 - protein, 11 aa, Plasmodium falciparum
KCDQAKPYSNT

SEQ ID NO: 3317550 - protein, 6 aa, Plasmodium falciparum
KCDQNE

SEQ ID NO: 3317551 - protein, 7 aa, Plasmodium falciparum
KCDSNKY

SEQ ID NO: 3317552 - protein, 17 aa, Plasmodium falciparum
KCDTSSYDNTSNNIKTS

SEQ ID NO: 3317553 - protein, 12 aa, Plasmodium falciparum
KCDYNKNESYDH

SEQ ID NO: 3317554 - protein, 7 aa, Plasmodium falciparum
KCEENNQ

SEQ ID NO: 3317555 - protein, 9 aa, Plasmodium falciparum
KCEERANIN

SEQ ID NO: 3317556 - protein, 5 aa, Plasmodium falciparum
KCEEY

SEQ ID NO: 3317557 - protein, 8 aa, Plasmodium falciparum
KCEPNQQF

SEQ ID NO: 3317558 - protein, 4 aa, Plasmodium falciparum
KCEQ

SEQ ID NO: 3317559 - protein, 7 aa, Plasmodium falciparum
KCESESY

SEQ ID NO: 3317560 - protein, 5 aa, Plasmodium falciparum
KCETK

SEQ ID NO: 3317561 - protein, 5 aa, Plasmodium falciparum
KCGEG

SEQ ID NO: 3317562 - protein, 7 aa, Plasmodium falciparum
KCGNNSD

SEQ ID NO: 3317563 - protein, 5 aa, Plasmodium falciparum
KCGRR

SEQ ID NO: 3317564 - protein, 97 aa, Plasmodium falciparum
KCGSQSDGGVASKNDKKSEGTNNNNGKSQNDSQSSSQSDSQSSSQSSSQSGSQRGSQSDSQNESQSDSQSDSQSDSQSDSQSDNQSESDIQNDSSSE

SEQ ID NO: 3317565 - protein, 7 aa, Plasmodium falciparum
KCGSSTF

SEQ ID NO: 3317566 - protein, 5 aa, Plasmodium falciparum
KCGTQ

SEQ ID NO: 3317567 - protein, 8 aa, Plasmodium falciparum
KCIEEKEK

SEQ ID NO: 3317568 - protein, 7 aa, Plasmodium falciparum
KCINNNN

SEQ ID NO: 3317569 - protein, 12 aa, Plasmodium falciparum
KCKDDNKNTINQ

SEQ ID NO: 3317570 - protein, 7 aa, Plasmodium falciparum
KCKENSC

SEQ ID NO: 3317571 - protein, 12 aa, Plasmodium falciparum
KCKGKKKEHTIK

SEQ ID NO: 3317572 - protein, 5 aa, Plasmodium falciparum
KCKNN

SEQ ID NO: 3317573 - protein, 5 aa, Plasmodium falciparum
KCKNP

SEQ ID NO: 3317574 - protein, 6 aa, Plasmodium falciparum
KCMPNS

SEQ ID NO: 3317575 - protein, 11 aa, Plasmodium falciparum
KCNDDNNVNYK

SEQ ID NO: 3317576 - protein, 6 aa, Plasmodium falciparum
KCNDGL

SEQ ID NO: 3317577 - protein, 14 aa, Plasmodium falciparum
KCNEKKEEKEITKR

SEQ ID NO: 3317578 - protein, 5 aa, Plasmodium falciparum
KCNEP

SEQ ID NO: 3317579 - protein, 10 aa, Plasmodium falciparum
KCNESEDNKK

SEQ ID NO: 3317580 - protein, 6 aa, Plasmodium falciparum
KCNIPT

SEQ ID NO: 3317581 - protein, 19 aa, Plasmodium falciparum
KCNKKENINDTISNNNIKN

SEQ ID NO: 3317582 - protein, 13 aa, Plasmodium falciparum
KCNKSRKKKTLNK

SEQ ID NO: 3317583 - protein, 7 aa, Plasmodium falciparum
KCNNHNK

SEQ ID NO: 3317584 - protein, 34 aa, Plasmodium falciparum
KCNNSLDNKNPNNQNKANNKKKKKKKKNQTNKME

SEQ ID NO: 3317585 - protein, 7 aa, Plasmodium falciparum
KCNNTDL

SEQ ID NO: 3317586 - protein, 7 aa, Plasmodium falciparum
KCPPNED

SEQ ID NO: 3317587 - protein, 6 aa, Plasmodium falciparum
KCPSSS

SEQ ID NO: 3317588 - protein, 7 aa, Plasmodium falciparum
KCSDKGQ

SEQ ID NO: 3317589 - protein, 12 aa, Plasmodium falciparum
KCSEISKHQNTS

SEQ ID NO: 3317590 - protein, 7 aa, Plasmodium falciparum
KCSNKNK

SEQ ID NO: 3317591 - protein, 6 aa, Plasmodium falciparum
KCSNNM

SEQ ID NO: 3317592 - protein, 24 aa, Plasmodium falciparum
KCSNNMKNSTKNKMNTQTNNNKDM

SEQ ID NO: 3317593 - protein, 14 aa, Plasmodium falciparum
KCSNRYVSSKSDVH

SEQ ID NO: 3317594 - protein, 8 aa, Plasmodium falciparum
KCSSNNNN

SEQ ID NO: 3317595 - protein, 11 aa, Plasmodium falciparum
KCSSNSKIRGI

SEQ ID NO: 3317596 - protein, 5 aa, Plasmodium falciparum
KCSYN

SEQ ID NO: 3317597 - protein, 6 aa, Plasmodium falciparum
KCTEEE

SEQ ID NO: 3317598 - protein, 6 aa, Plasmodium falciparum
KCTTTT

SEQ ID NO: 3317599 - protein, 13 aa, Plasmodium falciparum
KCYQKGDDMKDGK

SEQ ID NO: 3317600 - protein, 17 aa, Plasmodium falciparum
KDADKNEYKPTGAEGQG

SEQ ID NO: 3317601 - protein, 5 aa, Plasmodium falciparum
KDAED

SEQ ID NO: 3317602 - protein, 8 aa, Plasmodium falciparum
KDAEQALK

SEQ ID NO: 3317603 - protein, 8 aa, Plasmodium falciparum
KDAGNENN

SEQ ID NO: 3317604 - protein, 9 aa, Plasmodium falciparum
KDAKQNIKD

SEQ ID NO: 3317605 - protein, 11 aa, Plasmodium falciparum
KDALEQEKTDE

SEQ ID NO: 3317606 - protein, 17 aa, Plasmodium falciparum
KDANHEKGYKNNYENNR

SEQ ID NO: 3317607 - protein, 8 aa, Plasmodium falciparum
KDANQLKV

SEQ ID NO: 3317608 - protein, 5 aa, Plasmodium falciparum
KDAPI

SEQ ID NO: 3317609 - protein, 4 aa, Plasmodium falciparum
KDAQ

SEQ ID NO: 3317610 - protein, 7 aa, Plasmodium falciparum
KDARHNN

SEQ ID NO: 3317611 - protein, 6 aa, Plasmodium falciparum
KDASEM

SEQ ID NO: 3317612 - protein, 22 aa, Plasmodium falciparum
KDASGKHNNRKNKYSENMKNKS

SEQ ID NO: 3317613 - protein, 15 aa, Plasmodium falciparum
KDASKKTKKENETTA

SEQ ID NO: 3317614 - protein, 14 aa, Plasmodium falciparum
KDASNKNYNFNDEE

SEQ ID NO: 3317615 - protein, 5 aa, Plasmodium falciparum
KDATK

SEQ ID NO: 3317616 - protein, 5 aa, Plasmodium falciparum
KDAVK

SEQ ID NO: 3317617 - protein, 34 aa, Plasmodium falciparum
KDDASGLSTRSENDNSNDKENQEEECADDESENE

SEQ ID NO: 3317618 - protein, 9 aa, Plasmodium falciparum
KDDDIPEEK

SEQ ID NO: 3317619 - protein, 15 aa, Plasmodium falciparum
KDDDNLSESKIDERT

SEQ ID NO: 3317620 - protein, 7 aa, Plasmodium falciparum
KDDDNTF

SEQ ID NO: 3317621 - protein, 6 aa, Plasmodium falciparum
KDDEIS

SEQ ID NO: 3317622 - protein, 6 aa, Plasmodium falciparum
KDDEKC

SEQ ID NO: 3317623 - protein, 11 aa, Plasmodium falciparum
KDDEKPSHNNN

SEQ ID NO: 3317624 - protein, 29 aa, Plasmodium falciparum
KDDENSTIATNNNDNNNDNNNDSSSYDKS

SEQ ID NO: 3317625 - protein, 5 aa, Plasmodium falciparum
KDDEP

SEQ ID NO: 3317626 - protein, 8 aa, Plasmodium falciparum
KDDGAQKM

SEQ ID NO: 3317627 - protein, 7 aa, Plasmodium falciparum
KDDGEIK

SEQ ID NO: 3317628 - protein, 14 aa, Plasmodium falciparum
KDDHHSSKNKSKKK

SEQ ID NO: 3317629 - protein, 10 aa, Plasmodium falciparum
KDDIKKDSSM

SEQ ID NO: 3317630 - protein, 8 aa, Plasmodium falciparum
KDDKGHFN

SEQ ID NO: 3317631 - protein, 14 aa, Plasmodium falciparum
KDDKKEETEYKENN

SEQ ID NO: 3317632 - protein, 10 aa, Plasmodium falciparum
KDDKKNNERV

SEQ ID NO: 3317633 - protein, 32 aa, Plasmodium falciparum
KDDKNDEISNNQEEKHYRESKNVSENIQEESI

SEQ ID NO: 3317634 - protein, 8 aa, Plasmodium falciparum
KDDKNNTL

SEQ ID NO: 3317635 - protein, 9 aa, Plasmodium falciparum
KDDKSHTFH

SEQ ID NO: 3317636 - protein, 8 aa, Plasmodium falciparum
KDDKYKGN

SEQ ID NO: 3317637 - protein, 4 aa, Plasmodium falciparum
KDDL

SEQ ID NO: 3317638 - protein, 12 aa, Plasmodium falciparum
KDDLKGDLKGDL

SEQ ID NO: 3317639 - protein, 22 aa, Plasmodium falciparum
KDDLPHNKKEEKYEHDTQGQKN

SEQ ID NO: 3317640 - protein, 6 aa, Plasmodium falciparum
KDDLTN

SEQ ID NO: 3317641 - protein, 6 aa, Plasmodium falciparum
KDDMEN

SEQ ID NO: 3317642 - protein, 18 aa, Plasmodium falciparum
KDDMNNSDDEESVDNSNK

SEQ ID NO: 3317643 - protein, 111 aa, Plasmodium falciparum
KDDNEDDEDDEDNEDDEDDDEDDEDNDDDYNDDEDNDDYNDDEDNDDEDDEDNDDEDNDDDDNYDDDNYDEDNDDDDNYDDDNYDDDNYDDDNYDDNYDDDKAKEESYEKK

SEQ ID NO: 3317644 - protein, 7 aa, Plasmodium falciparum
KDDNELT

SEQ ID NO: 3317645 - protein, 19 aa, Plasmodium falciparum
KDDNESFDNYPKESKDLSE

SEQ ID NO: 3317646 - protein, 13 aa, Plasmodium falciparum
KDDNIKKDNSMKE

SEQ ID NO: 3317647 - protein, 6 aa, Plasmodium falciparum
KDDNMS

SEQ ID NO: 3317648 - protein, 9 aa, Plasmodium falciparum
KDDNNTNED

SEQ ID NO: 3317649 - protein, 5 aa, Plasmodium falciparum
KDDNT

SEQ ID NO: 3317650 - protein, 7 aa, Plasmodium falciparum
KDDNTID

SEQ ID NO: 3317651 - protein, 7 aa, Plasmodium falciparum
KDDNVEK

SEQ ID NO: 3317652 - protein, 9 aa, Plasmodium falciparum
KDDPKETLK

SEQ ID NO: 3317653 - protein, 27 aa, Plasmodium falciparum
KDDPNKNQPNDKTKNKDNGNKEGESFN

SEQ ID NO: 3317654 - protein, 8 aa, Plasmodium falciparum
KDDPSKKK

SEQ ID NO: 3317655 - protein, 6 aa, Plasmodium falciparum
KDDQGK

SEQ ID NO: 3317656 - protein, 9 aa, Plasmodium falciparum
KDDQKNKNV

SEQ ID NO: 3317657 - protein, 9 aa, Plasmodium falciparum
KDDQNIRNK

SEQ ID NO: 3317658 - protein, 14 aa, Plasmodium falciparum
KDDQNLSKNNVRRY

SEQ ID NO: 3317659 - protein, 7 aa, Plasmodium falciparum
KDDQQMN

SEQ ID NO: 3317660 - protein, 7 aa, Plasmodium falciparum
KDDRDIT

SEQ ID NO: 3317661 - protein, 19 aa, Plasmodium falciparum
KDDRHKYNDRYNDKDNNKM

SEQ ID NO: 3317662 - protein, 4 aa, Plasmodium falciparum
KDDS

SEQ ID NO: 3317663 - protein, 8 aa, Plasmodium falciparum
KDDSDDID

SEQ ID NO: 3317664 - protein, 8 aa, Plasmodium falciparum
KDDSDNVK

SEQ ID NO: 3317665 - protein, 10 aa, Plasmodium falciparum
KDDSKGAISN

SEQ ID NO: 3317666 - protein, 35 aa, Plasmodium falciparum
KDDSNIEKKRKRGNHQKYEEVGNDINQKKRKDKES

SEQ ID NO: 3317667 - protein, 9 aa, Plasmodium falciparum
KDDSNMEEH

SEQ ID NO: 3317668 - protein, 19 aa, Plasmodium falciparum
KDDSNNNINNNNNNNNNIE

SEQ ID NO: 3317669 - protein, 8 aa, Plasmodium falciparum
KDDTIEND

SEQ ID NO: 3317670 - protein, 5 aa, Plasmodium falciparum
KDDTL

SEQ ID NO: 3317671 - protein, 8 aa, Plasmodium falciparum
KDDTLEKN

SEQ ID NO: 3317672 - protein, 5 aa, Plasmodium falciparum
KDDVK

SEQ ID NO: 3317673 - protein, 12 aa, Plasmodium falciparum
KDDVNKNKNTKS

SEQ ID NO: 3317674 - protein, 10 aa, Plasmodium falciparum
KDDVTKQNSL

SEQ ID NO: 3317675 - protein, 5 aa, Plasmodium falciparum
KDDYG

SEQ ID NO: 3317676 - protein, 35 aa, Plasmodium falciparum
KDEDDEDEEFVPNDNEDDDEDDELDDDLEDEDMED

SEQ ID NO: 3317677 - protein, 13 aa, Plasmodium falciparum
KDEDISEISPKKN

SEQ ID NO: 3317678 - protein, 10 aa, Plasmodium falciparum
KDEDKATDIL

SEQ ID NO: 3317679 - protein, 6 aa, Plasmodium falciparum
KDEDKS

SEQ ID NO: 3317680 - protein, 5 aa, Plasmodium falciparum
KDEDN

SEQ ID NO: 3317681 - protein, 8 aa, Plasmodium falciparum
KDEDNNVN

SEQ ID NO: 3317682 - protein, 4 aa, Plasmodium falciparum
KDEE

SEQ ID NO: 3317683 - protein, 6 aa, Plasmodium falciparum
KDEEEV

SEQ ID NO: 3317684 - protein, 8 aa, Plasmodium falciparum
KDEEFKNN

SEQ ID NO: 3317685 - protein, 8 aa, Plasmodium falciparum
KDEEITQN

SEQ ID NO: 3317686 - protein, 7 aa, Plasmodium falciparum
KDEEKEN

SEQ ID NO: 3317687 - protein, 14 aa, Plasmodium falciparum
KDEEKQKVRGSTYT

SEQ ID NO: 3317688 - protein, 7 aa, Plasmodium falciparum
KDEELNT

SEQ ID NO: 3317689 - protein, 7 aa, Plasmodium falciparum
KDEENNK

SEQ ID NO: 3317690 - protein, 10 aa, Plasmodium falciparum
KDEENRYADR

SEQ ID NO: 3317691 - protein, 11 aa, Plasmodium falciparum
KDEENTDEGHI

SEQ ID NO: 3317692 - protein, 11 aa, Plasmodium falciparum
KDEENVTNPDE

SEQ ID NO: 3317693 - protein, 14 aa, Plasmodium falciparum
KDEEQDQEDNEKYN

SEQ ID NO: 3317694 - protein, 8 aa, Plasmodium falciparum
KDEETNHN

SEQ ID NO: 3317695 - protein, 10 aa, Plasmodium falciparum
KDEETNNADF

SEQ ID NO: 3317696 - protein, 7 aa, Plasmodium falciparum
KDEEYIE

SEQ ID NO: 3317697 - protein, 12 aa, Plasmodium falciparum
KDEEYTDGLNEK

SEQ ID NO: 3317698 - protein, 8 aa, Plasmodium falciparum
KDEGKIKN

SEQ ID NO: 3317699 - protein, 5 aa, Plasmodium falciparum
KDEHK

SEQ ID NO: 3317700 - protein, 7 aa, Plasmodium falciparum
KDEHNNT

SEQ ID NO: 3317701 - protein, 12 aa, Plasmodium falciparum
KDEHSDDNNHSN

SEQ ID NO: 3317702 - protein, 12 aa, Plasmodium falciparum
KDEHSTNTESSY

SEQ ID NO: 3317703 - protein, 4 aa, Plasmodium falciparum
KDEI

SEQ ID NO: 3317704 - protein, 7 aa, Plasmodium falciparum
KDEIDKF

SEQ ID NO: 3317705 - protein, 5 aa, Plasmodium falciparum
KDEIE

SEQ ID NO: 3317706 - protein, 9 aa, Plasmodium falciparum
KDEKEKKEC

SEQ ID NO: 3317707 - protein, 22 aa, Plasmodium falciparum
KDEKESKLNSNNNNNNNNNNNV

SEQ ID NO: 3317708 - protein, 5 aa, Plasmodium falciparum
KDEKG

SEQ ID NO: 3317709 - protein, 7 aa, Plasmodium falciparum
KDEKGNL

SEQ ID NO: 3317710 - protein, 6 aa, Plasmodium falciparum
KDEKHS

SEQ ID NO: 3317711 - protein, 31 aa, Plasmodium falciparum
KDEKKKKDISSNNMNVSNSKNDVKKKNNDTI

SEQ ID NO: 3317712 - protein, 8 aa, Plasmodium falciparum
KDEKNETS

SEQ ID NO: 3317713 - protein, 16 aa, Plasmodium falciparum
KDEKNKNGLNGNKKKK

SEQ ID NO: 3317714 - protein, 9 aa, Plasmodium falciparum
KDEKNNDLS

SEQ ID NO: 3317715 - protein, 10 aa, Plasmodium falciparum
KDEKNTARNI

SEQ ID NO: 3317716 - protein, 9 aa, Plasmodium falciparum
KDEKNVQSH

SEQ ID NO: 3317717 - protein, 6 aa, Plasmodium falciparum
KDEKQK

SEQ ID NO: 3317718 - protein, 9 aa, Plasmodium falciparum
KDEKQNGDA

SEQ ID NO: 3317719 - protein, 17 aa, Plasmodium falciparum
KDEKRSNEKTEKCNTNI

SEQ ID NO: 3317720 - protein, 5 aa, Plasmodium falciparum
KDEKV

SEQ ID NO: 3317721 - protein, 5 aa, Plasmodium falciparum
KDEKY

SEQ ID NO: 3317722 - protein, 14 aa, Plasmodium falciparum
KDELKKKKSLSSTF

SEQ ID NO: 3317723 - protein, 8 aa, Plasmodium falciparum
KDELKPKA

SEQ ID NO: 3317724 - protein, 10 aa, Plasmodium falciparum
KDELNKDDKN

SEQ ID NO: 3317725 - protein, 7 aa, Plasmodium falciparum
KDEMEDE

SEQ ID NO: 3317726 - protein, 5 aa, Plasmodium falciparum
KDEMR

SEQ ID NO: 3317727 - protein, 5 aa, Plasmodium falciparum
KDENE

SEQ ID NO: 3317728 - protein, 8 aa, Plasmodium falciparum
KDENEKMN

SEQ ID NO: 3317729 - protein, 17 aa, Plasmodium falciparum
KDENENNSNITNQSTQG

SEQ ID NO: 3317730 - protein, 5 aa, Plasmodium falciparum
KDENG

SEQ ID NO: 3317731 - protein, 17 aa, Plasmodium falciparum
KDENGNSVPQSNTQNEL

SEQ ID NO: 3317732 - protein, 11 aa, Plasmodium falciparum
KDENHKKSIEK

SEQ ID NO: 3317733 - protein, 15 aa, Plasmodium falciparum
KDENKKDSCDDEDVT

SEQ ID NO: 3317734 - protein, 13 aa, Plasmodium falciparum
KDENNNNKEEFTK

SEQ ID NO: 3317735 - protein, 22 aa, Plasmodium falciparum
KDENNNNKNNVDNNNIENKKGN

SEQ ID NO: 3317736 - protein, 6 aa, Plasmodium falciparum
KDENNV

SEQ ID NO: 3317737 - protein, 12 aa, Plasmodium falciparum
KDENSKVNEDHN

SEQ ID NO: 3317738 - protein, 9 aa, Plasmodium falciparum
KDENVATKQ

SEQ ID NO: 3317739 - protein, 6 aa, Plasmodium falciparum
KDENVK

SEQ ID NO: 3317740 - protein, 8 aa, Plasmodium falciparum
KDENYENE

SEQ ID NO: 3317741 - protein, 11 aa, Plasmodium falciparum
KDEPNESMEYT

SEQ ID NO: 3317742 - protein, 7 aa, Plasmodium falciparum
KDEPTKE

SEQ ID NO: 3317743 - protein, 73 aa, Plasmodium falciparum
KDEQSSKKKEENSNDDNKPGDVKEPADDNKPSDKKQPDDDNKYSDKKQPDDDNKSSDKKQPADDNKDNAGSDN

SEQ ID NO: 3317744 - protein, 9 aa, Plasmodium falciparum
KDEREKLDK

SEQ ID NO: 3317745 - protein, 9 aa, Plasmodium falciparum
KDESDFPDL

SEQ ID NO: 3317746 - protein, 7 aa, Plasmodium falciparum
KDESENS

SEQ ID NO: 3317747 - protein, 14 aa, Plasmodium falciparum
KDESINEEKEEYTK

SEQ ID NO: 3317748 - protein, 15 aa, Plasmodium falciparum
KDESNDYTSSEDEFD

SEQ ID NO: 3317749 - protein, 11 aa, Plasmodium falciparum
KDESNKKEKNI

SEQ ID NO: 3317750 - protein, 9 aa, Plasmodium falciparum
KDESTNITK

SEQ ID NO: 3317751 - protein, 4 aa, Plasmodium falciparum
KDET

SEQ ID NO: 3317752 - protein, 81 aa, Plasmodium falciparum
KDETIKNETIKNETIKNETINNETINNETINNETINNETINNENVKKENLADNNNNKKNEVTNVDSNKQTNNNADNDEANA

SEQ ID NO: 3317753 - protein, 5 aa, Plasmodium falciparum
KDETL

SEQ ID NO: 3317754 - protein, 8 aa, Plasmodium falciparum
KDETLTPN

SEQ ID NO: 3317755 - protein, 7 aa, Plasmodium falciparum
KDETPVL

SEQ ID NO: 3317756 - protein, 15 aa, Plasmodium falciparum
KDETTNKDNKNNHQN

SEQ ID NO: 3317757 - protein, 6 aa, Plasmodium falciparum
KDETYG

SEQ ID NO: 3317758 - protein, 15 aa, Plasmodium falciparum
KDEVENKINDEIKDE

SEQ ID NO: 3317759 - protein, 14 aa, Plasmodium falciparum
KDEYDKKENNVSNI

SEQ ID NO: 3317760 - protein, 33 aa, Plasmodium falciparum
KDEYHKNNSTYDDKNSTYDDNTTEGGKTKKIGT

SEQ ID NO: 3317761 - protein, 8 aa, Plasmodium falciparum
KDEYKGCS

SEQ ID NO: 3317762 - protein, 12 aa, Plasmodium falciparum
KDEYPNPPIKSH

SEQ ID NO: 3317763 - protein, 7 aa, Plasmodium falciparum
KDEYSEE

SEQ ID NO: 3317764 - protein, 6 aa, Plasmodium falciparum
KDFAQN

SEQ ID NO: 3317765 - protein, 7 aa, Plasmodium falciparum
KDFDEDS

SEQ ID NO: 3317766 - protein, 8 aa, Plasmodium falciparum
KDFDEYKE

SEQ ID NO: 3317767 - protein, 7 aa, Plasmodium falciparum
KDFDSSD

SEQ ID NO: 3317768 - protein, 5 aa, Plasmodium falciparum
KDFEK

SEQ ID NO: 3317769 - protein, 45 aa, Plasmodium falciparum
KDFESNNKHDKHINNGDEEKNAHSSHSQNNKEKKLHSNDTEALRR

SEQ ID NO: 3317770 - protein, 5 aa, Plasmodium falciparum
KDFKK

SEQ ID NO: 3317771 - protein, 4 aa, Plasmodium falciparum
KDFN

SEQ ID NO: 3317772 - protein, 5 aa, Plasmodium falciparum
KDFTK

SEQ ID NO: 3317773 - protein, 5 aa, Plasmodium falciparum
KDFTT

SEQ ID NO: 3317774 - protein, 11 aa, Plasmodium falciparum
KDGDKKKEIYE

SEQ ID NO: 3317775 - protein, 25 aa, Plasmodium falciparum
KDGDKYNDSNNIDSNNNDSSSHIHG

SEQ ID NO: 3317776 - protein, 12 aa, Plasmodium falciparum
KDGENERNRSVS

SEQ ID NO: 3317777 - protein, 5 aa, Plasmodium falciparum
KDGEV

SEQ ID NO: 3317778 - protein, 6 aa, Plasmodium falciparum
KDGEYI

SEQ ID NO: 3317779 - protein, 5 aa, Plasmodium falciparum
KDGFD

SEQ ID NO: 3317780 - protein, 12 aa, Plasmodium falciparum
KDGIENKEFSEQ

SEQ ID NO: 3317781 - protein, 18 aa, Plasmodium falciparum
KDGILSSQNNLQNNNGSE

SEQ ID NO: 3317782 - protein, 9 aa, Plasmodium falciparum
KDGKDLQNH

SEQ ID NO: 3317783 - protein, 10 aa, Plasmodium falciparum
KDGKEKYPGW

SEQ ID NO: 3317784 - protein, 5 aa, Plasmodium falciparum
KDGKH

SEQ ID NO: 3317785 - protein, 103 aa, Plasmodium falciparum
KDGKINKDLKNDEKKKKNKNKKNKNKRKHDEDQHSEHSHQDQDEQEEKEKEKKKKKRKKDKKKKKKDKEREKRENNEAQNEDDQINDDLNGDVNEELNDDVDG

SEQ ID NO: 3317786 - protein, 8 aa, Plasmodium falciparum
KDGKNFKA

SEQ ID NO: 3317787 - protein, 19 aa, Plasmodium falciparum
KDGKPTQDEPTVCSGKNGT

SEQ ID NO: 3317788 - protein, 11 aa, Plasmodium falciparum
KDGKRNKRQRK

SEQ ID NO: 3317789 - protein, 40 aa, Plasmodium falciparum
KDGKVKKNGNIKNGNVDNDKLKNENLKNENLKNENLKNEN

SEQ ID NO: 3317790 - protein, 6 aa, Plasmodium falciparum
KDGLRR

SEQ ID NO: 3317791 - protein, 4 aa, Plasmodium falciparum
KDGN

SEQ ID NO: 3317792 - protein, 5 aa, Plasmodium falciparum
KDGNE

SEQ ID NO: 3317793 - protein, 19 aa, Plasmodium falciparum
KDGNNKDKELKDEDYGEYK

SEQ ID NO: 3317794 - protein, 24 aa, Plasmodium falciparum
KDGNTNRKRRNSYMGDEKRKERKS

SEQ ID NO: 3317795 - protein, 8 aa, Plasmodium falciparum
KDGPNGER

SEQ ID NO: 3317796 - protein, 10 aa, Plasmodium falciparum
KDGSGKISAN

SEQ ID NO: 3317797 - protein, 9 aa, Plasmodium falciparum
KDGSPLETQ

SEQ ID NO: 3317798 - protein, 27 aa, Plasmodium falciparum
KDGSPVEEGNTDGSATSTLNQDQPEHN

SEQ ID NO: 3317799 - protein, 6 aa, Plasmodium falciparum
KDGSYK

SEQ ID NO: 3317800 - protein, 6 aa, Plasmodium falciparum
KDGTGE

SEQ ID NO: 3317801 - protein, 7 aa, Plasmodium falciparum
KDGTIKK

SEQ ID NO: 3317802 - protein, 10 aa, Plasmodium falciparum
KDHDGNSSVS

SEQ ID NO: 3317803 - protein, 68 aa, Plasmodium falciparum
KDHDYKAGKITAKKDMKHKKKNFNNKAKKDKGIKNKQIGKKTSINNKRKASSKNSRKSKKMKKKHKHR

SEQ ID NO: 3317804 - protein, 9 aa, Plasmodium falciparum
KDHHNLSGK

SEQ ID NO: 3317805 - protein, 4 aa, Plasmodium falciparum
KDHK

SEQ ID NO: 3317806 - protein, 15 aa, Plasmodium falciparum
KDHNNNFKRENEEDR

SEQ ID NO: 3317807 - protein, 54 aa, Plasmodium falciparum
KDHNNQKDDGPKVQPDSNKKKKDKEKYRKNKDDDKEKDKNKEKNKKIKNKKKEQ

SEQ ID NO: 3317808 - protein, 8 aa, Plasmodium falciparum
KDHNSTKN

SEQ ID NO: 3317809 - protein, 7 aa, Plasmodium falciparum
KDHPGDI

SEQ ID NO: 3317810 - protein, 13 aa, Plasmodium falciparum
KDHPHKQSIDDEP

SEQ ID NO: 3317811 - protein, 6 aa, Plasmodium falciparum
KDHPKN

SEQ ID NO: 3317812 - protein, 6 aa, Plasmodium falciparum
KDHRTR

SEQ ID NO: 3317813 - protein, 5 aa, Plasmodium falciparum
KDHSL

SEQ ID NO: 3317814 - protein, 6 aa, Plasmodium falciparum
KDHVER

SEQ ID NO: 3317815 - protein, 6 aa, Plasmodium falciparum
KDHYER

SEQ ID NO: 3317816 - protein, 5 aa, Plasmodium falciparum
KDHYK

SEQ ID NO: 3317817 - protein, 13 aa, Plasmodium falciparum
KDIEDDNNYGMND

SEQ ID NO: 3317818 - protein, 19 aa, Plasmodium falciparum
KDIEEAQKENANNNNNNNN

SEQ ID NO: 3317819 - protein, 22 aa, Plasmodium falciparum
KDIEEEEEKKIQNKKDTEDPLN

SEQ ID NO: 3317820 - protein, 9 aa, Plasmodium falciparum
KDIEESARY

SEQ ID NO: 3317821 - protein, 26 aa, Plasmodium falciparum
KDIEKSKINKNVKSTDNKMDIDQDKE

SEQ ID NO: 3317822 - protein, 4 aa, Plasmodium falciparum
KDIF

SEQ ID NO: 3317823 - protein, 4 aa, Plasmodium falciparum
KDIG

SEQ ID NO: 3317824 - protein, 32 aa, Plasmodium falciparum
KDIGNDNKNLEGNMNNQTDKQMDNQKSDHITG

SEQ ID NO: 3317825 - protein, 16 aa, Plasmodium falciparum
KDIHTKKEDAVEEEKN

SEQ ID NO: 3317826 - protein, 51 aa, Plasmodium falciparum
KDIHTKQKDDNNNNNNNNNNNNNNNNSSSNVNGFNNNNNNSSSSSNVDGFN

SEQ ID NO: 3317827 - protein, 10 aa, Plasmodium falciparum
KDIKADEKMN

SEQ ID NO: 3317828 - protein, 15 aa, Plasmodium falciparum
KDIKEDNKNKPSTSI

SEQ ID NO: 3317829 - protein, 8 aa, Plasmodium falciparum
KDIKEQKE

SEQ ID NO: 3317830 - protein, 5 aa, Plasmodium falciparum
KDIKG

SEQ ID NO: 3317831 - protein, 61 aa, Plasmodium falciparum
KDIKNANIKEESHNLNSTKGNNKGTNNTYHNNNSIKSQQESDKLTSTSKGVKRSASNKFDD

SEQ ID NO: 3317832 - protein, 12 aa, Plasmodium falciparum
KDIKPQENNNMD

SEQ ID NO: 3317833 - protein, 14 aa, Plasmodium falciparum
KDIKRRKKKEHFNN

SEQ ID NO: 3317834 - protein, 6 aa, Plasmodium falciparum
KDINET

SEQ ID NO: 3317835 - protein, 26 aa, Plasmodium falciparum
KDINKKEQIEEQQEDNTLKEDNKNEE

SEQ ID NO: 3317836 - protein, 15 aa, Plasmodium falciparum
KDINKKRESVKIDSD

SEQ ID NO: 3317837 - protein, 7 aa, Plasmodium falciparum
KDINNDQ

SEQ ID NO: 3317838 - protein, 17 aa, Plasmodium falciparum
KDINNNNNNNNNNNITT

SEQ ID NO: 3317839 - protein, 9 aa, Plasmodium falciparum
KDIPEGGSK

SEQ ID NO: 3317840 - protein, 8 aa, Plasmodium falciparum
KDIPTNKS

SEQ ID NO: 3317841 - protein, 4 aa, Plasmodium falciparum
KDIQ

SEQ ID NO: 3317842 - protein, 19 aa, Plasmodium falciparum
KDIQEKSNFQENGQRNQTN

SEQ ID NO: 3317843 - protein, 8 aa, Plasmodium falciparum
KDIQKNKN

SEQ ID NO: 3317844 - protein, 4 aa, Plasmodium falciparum
KDIS

SEQ ID NO: 3317845 - protein, 16 aa, Plasmodium falciparum
KDITKDHTKDITNDIT

SEQ ID NO: 3317846 - protein, 5 aa, Plasmodium falciparum
KDIVD

SEQ ID NO: 3317847 - protein, 7 aa, Plasmodium falciparum
KDKAHEI

SEQ ID NO: 3317848 - protein, 6 aa, Plasmodium falciparum
KDKAKE

SEQ ID NO: 3317849 - protein, 6 aa, Plasmodium falciparum
KDKDCT

SEQ ID NO: 3317850 - protein, 5 aa, Plasmodium falciparum
KDKDE

SEQ ID NO: 3317851 - protein, 7 aa, Plasmodium falciparum
KDKDKYK

SEQ ID NO: 3317852 - protein, 13 aa, Plasmodium falciparum
KDKDPESTGGPIS

SEQ ID NO: 3317853 - protein, 11 aa, Plasmodium falciparum
KDKDSNYEEKK

SEQ ID NO: 3317854 - protein, 7 aa, Plasmodium falciparum
KDKDTLR

SEQ ID NO: 3317855 - protein, 18 aa, Plasmodium falciparum
KDKDTNLDYNNNNNNNNN

SEQ ID NO: 3317856 - protein, 23 aa, Plasmodium falciparum
KDKDVKKSNINNSNNNNNNTKSA

SEQ ID NO: 3317857 - protein, 8 aa, Plasmodium falciparum
KDKEEKEN

SEQ ID NO: 3317858 - protein, 9 aa, Plasmodium falciparum
KDKEEKENI

SEQ ID NO: 3317859 - protein, 7 aa, Plasmodium falciparum
KDKEENV

SEQ ID NO: 3317860 - protein, 7 aa, Plasmodium falciparum
KDKEIQN

SEQ ID NO: 3317861 - protein, 7 aa, Plasmodium falciparum
KDKEISL

SEQ ID NO: 3317862 - protein, 5 aa, Plasmodium falciparum
KDKEK

SEQ ID NO: 3317863 - protein, 149 aa, Plasmodium falciparum
KDKEKHRKEKTRDKDRERDKERDKDRDKDRDKDRDKDRDKDRDKDRDKERNKDKERNKEKDRHKDRNKDKNKNKYKTKSKMKSKRGGNYDDEEDYDSSTYSDRKKKVKNYDDEEYEDFSRGGNKYDNTVTSKNDDMKDATSEHDRYVYM

SEQ ID NO: 3317864 - protein, 6 aa, Plasmodium falciparum
KDKEKQ

SEQ ID NO: 3317865 - protein, 84 aa, Plasmodium falciparum
KDKENDNNEEENDEEENDEEENDEEENDEEENNEEENKEAQNNEEENNNGDNNNGDNNNNGDNNNNGDNNNNGDNNNNGDNNNN

SEQ ID NO: 3317866 - protein, 7 aa, Plasmodium falciparum
KDKENMR

SEQ ID NO: 3317867 - protein, 8 aa, Plasmodium falciparum
KDKENTTI

SEQ ID NO: 3317868 - protein, 11 aa, Plasmodium falciparum
KDKEQKDEHQI

SEQ ID NO: 3317869 - protein, 18 aa, Plasmodium falciparum
KDKESNKISNQYNTVSSG

SEQ ID NO: 3317870 - protein, 15 aa, Plasmodium falciparum
KDKETSLSPQKENIQ

SEQ ID NO: 3317871 - protein, 4 aa, Plasmodium falciparum
KDKG

SEQ ID NO: 3317872 - protein, 8 aa, Plasmodium falciparum
KDKGKNFS

SEQ ID NO: 3317873 - protein, 5 aa, Plasmodium falciparum
KDKHE

SEQ ID NO: 3317874 - protein, 5 aa, Plasmodium falciparum
KDKHL

SEQ ID NO: 3317875 - protein, 9 aa, Plasmodium falciparum
KDKHNNKSY

SEQ ID NO: 3317876 - protein, 5 aa, Plasmodium falciparum
KDKIK

SEQ ID NO: 3317877 - protein, 9 aa, Plasmodium falciparum
KDKINKDKA

SEQ ID NO: 3317878 - protein, 18 aa, Plasmodium falciparum
KDKINNNENNKMRQENNY

SEQ ID NO: 3317879 - protein, 19 aa, Plasmodium falciparum
KDKISTSHRDNNNNDSNNI

SEQ ID NO: 3317880 - protein, 8 aa, Plasmodium falciparum
KDKKDKGI

SEQ ID NO: 3317881 - protein, 11 aa, Plasmodium falciparum
KDKKDKSSMQT

SEQ ID NO: 3317882 - protein, 10 aa, Plasmodium falciparum
KDKKDNTKNV

SEQ ID NO: 3317883 - protein, 5 aa, Plasmodium falciparum
KDKKE

SEQ ID NO: 3317884 - protein, 10 aa, Plasmodium falciparum
KDKKEEEDIK

SEQ ID NO: 3317885 - protein, 10 aa, Plasmodium falciparum
KDKKEELKDI

SEQ ID NO: 3317886 - protein, 8 aa, Plasmodium falciparum
KDKKGEKS

SEQ ID NO: 3317887 - protein, 30 aa, Plasmodium falciparum
KDKKKEKVEESDLNNYSSSCSYDDKKKEKK

SEQ ID NO: 3317888 - protein, 7 aa, Plasmodium falciparum
KDKKKEN

SEQ ID NO: 3317889 - protein, 86 aa, Plasmodium falciparum
KDKKKKAKKKAEKNKAEKNKAEKNKAEKNKAEKNKAEKNKAEKNKAEINKTDTNKENTNNEDKNNEDKNNEDKNNEDKNNEEDRNK

SEQ ID NO: 3317890 - protein, 8 aa, Plasmodium falciparum
KDKKKKYM

SEQ ID NO: 3317891 - protein, 6 aa, Plasmodium falciparum
KDKKKL

SEQ ID NO: 3317892 - protein, 20 aa, Plasmodium falciparum
KDKKKVNDENNKISQKKKGY

SEQ ID NO: 3317893 - protein, 6 aa, Plasmodium falciparum
KDKKNI

SEQ ID NO: 3317894 - protein, 8 aa, Plasmodium falciparum
KDKKQKDL

SEQ ID NO: 3317895 - protein, 11 aa, Plasmodium falciparum
KDKKTVKKNKE

SEQ ID NO: 3317896 - protein, 19 aa, Plasmodium falciparum
KDKLEGKSKEDKKGDQQSD

SEQ ID NO: 3317897 - protein, 12 aa, Plasmodium falciparum
KDKLNKQHDPYR

SEQ ID NO: 3317898 - protein, 11 aa, Plasmodium falciparum
KDKMEKHPPGY

SEQ ID NO: 3317899 - protein, 4 aa, Plasmodium falciparum
KDKN

SEQ ID NO: 3317900 - protein, 13 aa, Plasmodium falciparum
KDKNDEANNLNNR

SEQ ID NO: 3317901 - protein, 9 aa, Plasmodium falciparum
KDKNDEKHH

SEQ ID NO: 3317902 - protein, 19 aa, Plasmodium falciparum
KDKNDINRSSKKKHENKTA

SEQ ID NO: 3317903 - protein, 13 aa, Plasmodium falciparum
KDKNDIRNISKEK

SEQ ID NO: 3317904 - protein, 9 aa, Plasmodium falciparum
KDKNDLKDN

SEQ ID NO: 3317905 - protein, 24 aa, Plasmodium falciparum
KDKNDNNEKLSSQQPFVSFFSFLS

SEQ ID NO: 3317906 - protein, 5 aa, Plasmodium falciparum
KDKNE

SEQ ID NO: 3317907 - protein, 19 aa, Plasmodium falciparum
KDKNEGVDKRIEQDKKSLS

SEQ ID NO: 3317908 - protein, 37 aa, Plasmodium falciparum
KDKNEKKNYEHVNANEKNGYLASEKNELTKNKVEEHT

SEQ ID NO: 3317909 - protein, 6 aa, Plasmodium falciparum
KDKNEY

SEQ ID NO: 3317910 - protein, 5 aa, Plasmodium falciparum
KDKNI

SEQ ID NO: 3317911 - protein, 8 aa, Plasmodium falciparum
KDKNIKSN

SEQ ID NO: 3317912 - protein, 9 aa, Plasmodium falciparum
KDKNKEEKL

SEQ ID NO: 3317913 - protein, 8 aa, Plasmodium falciparum
KDKNKGKR

SEQ ID NO: 3317914 - protein, 7 aa, Plasmodium falciparum
KDKNKKQ

SEQ ID NO: 3317915 - protein, 8 aa, Plasmodium falciparum
KDKNKKVK

SEQ ID NO: 3317916 - protein, 8 aa, Plasmodium falciparum
KDKNNDID

SEQ ID NO: 3317917 - protein, 6 aa, Plasmodium falciparum
KDKNNM

SEQ ID NO: 3317918 - protein, 19 aa, Plasmodium falciparum
KDKNNTEDDESMEPNNTNE

SEQ ID NO: 3317919 - protein, 6 aa, Plasmodium falciparum
KDKNTV

SEQ ID NO: 3317920 - protein, 8 aa, Plasmodium falciparum
KDKNVQDS

SEQ ID NO: 3317921 - protein, 13 aa, Plasmodium falciparum
KDKNVSKENKNHK

SEQ ID NO: 3317922 - protein, 7 aa, Plasmodium falciparum
KDKNYDT

SEQ ID NO: 3317923 - protein, 4 aa, Plasmodium falciparum
KDKP

SEQ ID NO: 3317924 - protein, 9 aa, Plasmodium falciparum
KDKPDTVTN

SEQ ID NO: 3317925 - protein, 8 aa, Plasmodium falciparum
KDKPKETT

SEQ ID NO: 3317926 - protein, 10 aa, Plasmodium falciparum
KDKQKNDEIA

SEQ ID NO: 3317927 - protein, 8 aa, Plasmodium falciparum
KDKQKYKN

SEQ ID NO: 3317928 - protein, 16 aa, Plasmodium falciparum
KDKQLNKNMNDENGIN

SEQ ID NO: 3317929 - protein, 7 aa, Plasmodium falciparum
KDKQMKN

SEQ ID NO: 3317930 - protein, 9 aa, Plasmodium falciparum
KDKQTTWGD

SEQ ID NO: 3317931 - protein, 120 aa, Plasmodium falciparum
KDKRENKTANYDDNKNGVHENKNGVHDNKNGVHENKNGVHDDNKNGVHDDNKNGVHDDNKNGVQDNNNYLQDNNNNYLQDNNNNYIQDNNNNYIQDNNNNYLQDNNNNNCIDDDKNCDNL

SEQ ID NO: 3317932 - protein, 8 aa, Plasmodium falciparum
KDKRPDKY

SEQ ID NO: 3317933 - protein, 28 aa, Plasmodium falciparum
KDKRSCDVKKKKKENSSYSNQSSSENMS

SEQ ID NO: 3317934 - protein, 9 aa, Plasmodium falciparum
KDKRYANNN

SEQ ID NO: 3317935 - protein, 6 aa, Plasmodium falciparum
KDKSHE

SEQ ID NO: 3317936 - protein, 6 aa, Plasmodium falciparum
KDKSIG

SEQ ID NO: 3317937 - protein, 9 aa, Plasmodium falciparum
KDKSKHKDI

SEQ ID NO: 3317938 - protein, 12 aa, Plasmodium falciparum
KDKSKRESYEDT

SEQ ID NO: 3317939 - protein, 5 aa, Plasmodium falciparum
KDKSM

SEQ ID NO: 3317940 - protein, 10 aa, Plasmodium falciparum
KDKSTGEKEI

SEQ ID NO: 3317941 - protein, 4 aa, Plasmodium falciparum
KDKT

SEQ ID NO: 3317942 - protein, 12 aa, Plasmodium falciparum
KDKTKNAGLKTT

SEQ ID NO: 3317943 - protein, 9 aa, Plasmodium falciparum
KDKTKNESI

SEQ ID NO: 3317944 - protein, 20 aa, Plasmodium falciparum
KDKTKTNKGMAGTTSTSLSN

SEQ ID NO: 3317945 - protein, 20 aa, Plasmodium falciparum
KDKTNSDGDNSSNDKIGDDV

SEQ ID NO: 3317946 - protein, 47 aa, Plasmodium falciparum
KDKTPEENINKETEEKNDKENIGDISSSKENTDINEEKKDDQQEEKQ

SEQ ID NO: 3317947 - protein, 10 aa, Plasmodium falciparum
KDKTSDNKFN

SEQ ID NO: 3317948 - protein, 4 aa, Plasmodium falciparum
KDKY

SEQ ID NO: 3317949 - protein, 12 aa, Plasmodium falciparum
KDKYADNKNKKA

SEQ ID NO: 3317950 - protein, 8 aa, Plasmodium falciparum
KDKYDEPY

SEQ ID NO: 3317951 - protein, 8 aa, Plasmodium falciparum
KDKYGGKA

SEQ ID NO: 3317952 - protein, 11 aa, Plasmodium falciparum
KDKYKKNDDKL

SEQ ID NO: 3317953 - protein, 6 aa, Plasmodium falciparum
KDKYLN

SEQ ID NO: 3317954 - protein, 25 aa, Plasmodium falciparum
KDKYNKKVSKKRSRKNSSRSNYYDE

SEQ ID NO: 3317955 - protein, 15 aa, Plasmodium falciparum
KDKYNKYDKYGKQNH

SEQ ID NO: 3317956 - protein, 8 aa, Plasmodium falciparum
KDKYNNNK

SEQ ID NO: 3317957 - protein, 13 aa, Plasmodium falciparum
KDKYNNNNNIDSN

SEQ ID NO: 3317958 - protein, 6 aa, Plasmodium falciparum
KDKYYK

SEQ ID NO: 3317959 - protein, 25 aa, Plasmodium falciparum
KDLDEDNNKNKNKHNINNNNNNNIK

SEQ ID NO: 3317960 - protein, 6 aa, Plasmodium falciparum
KDLEKE

SEQ ID NO: 3317961 - protein, 6 aa, Plasmodium falciparum
KDLGEI

SEQ ID NO: 3317962 - protein, 8 aa, Plasmodium falciparum
KDLGNTTN

SEQ ID NO: 3317963 - protein, 10 aa, Plasmodium falciparum
KDLGRNKKDI

SEQ ID NO: 3317964 - protein, 10 aa, Plasmodium falciparum
KDLKKCPNKP

SEQ ID NO: 3317965 - protein, 11 aa, Plasmodium falciparum
KDLKNSSSQVQ

SEQ ID NO: 3317966 - protein, 7 aa, Plasmodium falciparum
KDLPQKL

SEQ ID NO: 3317967 - protein, 4 aa, Plasmodium falciparum
KDLS

SEQ ID NO: 3317968 - protein, 12 aa, Plasmodium falciparum
KDLSKKKKNDIN

SEQ ID NO: 3317969 - protein, 49 aa, Plasmodium falciparum
KDLYGRNKSSKSISRDKSYNNKYGRKSIDGIKKNKQPSYRYDDKRDSHL

SEQ ID NO: 3317970 - protein, 6 aa, Plasmodium falciparum
KDMEKN

SEQ ID NO: 3317971 - protein, 5 aa, Plasmodium falciparum
KDMEN

SEQ ID NO: 3317972 - protein, 6 aa, Plasmodium falciparum
KDMGSY

SEQ ID NO: 3317973 - protein, 11 aa, Plasmodium falciparum
KDMKENKQYQE

SEQ ID NO: 3317974 - protein, 5 aa, Plasmodium falciparum
KDMKG

SEQ ID NO: 3317975 - protein, 5 aa, Plasmodium falciparum
KDMKK

SEQ ID NO: 3317976 - protein, 9 aa, Plasmodium falciparum
KDMSSNSAS

SEQ ID NO: 3317977 - protein, 5 aa, Plasmodium falciparum
KDMST

SEQ ID NO: 3317978 - protein, 15 aa, Plasmodium falciparum
KDMTNENEQNKKDID

SEQ ID NO: 3317979 - protein, 8 aa, Plasmodium falciparum
KDNAKLSD

SEQ ID NO: 3317980 - protein, 22 aa, Plasmodium falciparum
KDNCDDEEKDNCDDEDMNSNLS

SEQ ID NO: 3317981 - protein, 13 aa, Plasmodium falciparum
KDNDANDKNSKQI

SEQ ID NO: 3317982 - protein, 16 aa, Plasmodium falciparum
KDNDFNNKKNDPSNLE

SEQ ID NO: 3317983 - protein, 13 aa, Plasmodium falciparum
KDNDNVEKKTSNV

SEQ ID NO: 3317984 - protein, 23 aa, Plasmodium falciparum
KDNDRDNDNNDKYNDKYNNNNND

SEQ ID NO: 3317985 - protein, 12 aa, Plasmodium falciparum
KDNDTKDNEEPL

SEQ ID NO: 3317986 - protein, 5 aa, Plasmodium falciparum
KDNDY

SEQ ID NO: 3317987 - protein, 9 aa, Plasmodium falciparum
KDNEEGSKN

SEQ ID NO: 3317988 - protein, 8 aa, Plasmodium falciparum
KDNEEIKN

SEQ ID NO: 3317989 - protein, 9 aa, Plasmodium falciparum
KDNEEKDED

SEQ ID NO: 3317990 - protein, 7 aa, Plasmodium falciparum
KDNEESN

SEQ ID NO: 3317991 - protein, 5 aa, Plasmodium falciparum
KDNEI

SEQ ID NO: 3317992 - protein, 8 aa, Plasmodium falciparum
KDNEKNEQ

SEQ ID NO: 3317993 - protein, 8 aa, Plasmodium falciparum
KDNEKNKC

SEQ ID NO: 3317994 - protein, 7 aa, Plasmodium falciparum
KDNEKTL

SEQ ID NO: 3317995 - protein, 15 aa, Plasmodium falciparum
KDNENTLPTYSTSNN

SEQ ID NO: 3317996 - protein, 7 aa, Plasmodium falciparum
KDNENYK

SEQ ID NO: 3317997 - protein, 6 aa, Plasmodium falciparum
KDNESH

SEQ ID NO: 3317998 - protein, 8 aa, Plasmodium falciparum
KDNEYTNE

SEQ ID NO: 3317999 - protein, 7 aa, Plasmodium falciparum
KDNFKKS

SEQ ID NO: 3318000 - protein, 6 aa, Plasmodium falciparum
KDNGNI

SEQ ID NO: 3318001 - protein, 8 aa, Plasmodium falciparum
KDNHTNNL

SEQ ID NO: 3318002 - protein, 7 aa, Plasmodium falciparum
KDNIDKN

SEQ ID NO: 3318003 - protein, 6 aa, Plasmodium falciparum
KDNIGN

SEQ ID NO: 3318004 - protein, 11 aa, Plasmodium falciparum
KDNIKKRKSNL

SEQ ID NO: 3318005 - protein, 65 aa, Plasmodium falciparum
KDNIKSNDIKSNDIQSNDIKSNDIQSNDIQSNDKQSNDKQSNDIQSNDIQSNDKQSNDIKSSDNI

SEQ ID NO: 3318006 - protein, 10 aa, Plasmodium falciparum
KDNINDSRNI

SEQ ID NO: 3318007 - protein, 27 aa, Plasmodium falciparum
KDNINGHNKKQLKKGIDKKPSSSLDDY

SEQ ID NO: 3318008 - protein, 7 aa, Plasmodium falciparum
KDNINNE

SEQ ID NO: 3318009 - protein, 13 aa, Plasmodium falciparum
KDNINNSSSTQYG

SEQ ID NO: 3318010 - protein, 7 aa, Plasmodium falciparum
KDNIPNN

SEQ ID NO: 3318011 - protein, 5 aa, Plasmodium falciparum
KDNIQ

SEQ ID NO: 3318012 - protein, 5 aa, Plasmodium falciparum
KDNIT

SEQ ID NO: 3318013 - protein, 6 aa, Plasmodium falciparum
KDNKAT

SEQ ID NO: 3318014 - protein, 24 aa, Plasmodium falciparum
KDNKDDNVKKNKNNKSKFNKKEEA

SEQ ID NO: 3318015 - protein, 12 aa, Plasmodium falciparum
KDNKEDSSDDIN

SEQ ID NO: 3318016 - protein, 9 aa, Plasmodium falciparum
KDNKEKEKL

SEQ ID NO: 3318017 - protein, 9 aa, Plasmodium falciparum
KDNKENDMN

SEQ ID NO: 3318018 - protein, 13 aa, Plasmodium falciparum
KDNKFDNGTNHYP

SEQ ID NO: 3318019 - protein, 5 aa, Plasmodium falciparum
KDNKI

SEQ ID NO: 3318020 - protein, 6 aa, Plasmodium falciparum
KDNKIE

SEQ ID NO: 3318021 - protein, 14 aa, Plasmodium falciparum
KDNKKDEIKIERET

SEQ ID NO: 3318022 - protein, 18 aa, Plasmodium falciparum
KDNKKKKDHDNEDDVNSK

SEQ ID NO: 3318023 - protein, 10 aa, Plasmodium falciparum
KDNKKNSLDN

SEQ ID NO: 3318024 - protein, 7 aa, Plasmodium falciparum
KDNKKNY

SEQ ID NO: 3318025 - protein, 12 aa, Plasmodium falciparum
KDNKKRKCKREK

SEQ ID NO: 3318026 - protein, 7 aa, Plasmodium falciparum
KDNKLKD

SEQ ID NO: 3318027 - protein, 11 aa, Plasmodium falciparum
KDNKNEDSNNL

SEQ ID NO: 3318028 - protein, 10 aa, Plasmodium falciparum
KDNKNSSMDY

SEQ ID NO: 3318029 - protein, 8 aa, Plasmodium falciparum
KDNKRSDR

SEQ ID NO: 3318030 - protein, 5 aa, Plasmodium falciparum
KDNKT

SEQ ID NO: 3318031 - protein, 16 aa, Plasmodium falciparum
KDNKTIHENENDNNNL

SEQ ID NO: 3318032 - protein, 5 aa, Plasmodium falciparum
KDNLM

SEQ ID NO: 3318033 - protein, 8 aa, Plasmodium falciparum
KDNLPKNN

SEQ ID NO: 3318034 - protein, 7 aa, Plasmodium falciparum
KDNLSTH

SEQ ID NO: 3318035 - protein, 24 aa, Plasmodium falciparum
KDNMQNELSGDKSYNVNSENSQKE

SEQ ID NO: 3318036 - protein, 10 aa, Plasmodium falciparum
KDNMTKKGKK

SEQ ID NO: 3318037 - protein, 5 aa, Plasmodium falciparum
KDNND

SEQ ID NO: 3318038 - protein, 10 aa, Plasmodium falciparum
KDNNENEDLS

SEQ ID NO: 3318039 - protein, 7 aa, Plasmodium falciparum
KDNNGLN

SEQ ID NO: 3318040 - protein, 9 aa, Plasmodium falciparum
KDNNISNNI

SEQ ID NO: 3318041 - protein, 17 aa, Plasmodium falciparum
KDNNKEKEKDEETDLQD

SEQ ID NO: 3318042 - protein, 24 aa, Plasmodium falciparum
KDNNMENNDKTLNNNQNDISNKNN

SEQ ID NO: 3318043 - protein, 5 aa, Plasmodium falciparum
KDNNN

SEQ ID NO: 3318044 - protein, 6 aa, Plasmodium falciparum
KDNNNI

SEQ ID NO: 3318045 - protein, 7 aa, Plasmodium falciparum
KDNNNKK

SEQ ID NO: 3318046 - protein, 19 aa, Plasmodium falciparum
KDNNNKNNTSNNKTNNNNM

SEQ ID NO: 3318047 - protein, 7 aa, Plasmodium falciparum
KDNNNNK

SEQ ID NO: 3318048 - protein, 10 aa, Plasmodium falciparum
KDNNNNNETQ

SEQ ID NO: 3318049 - protein, 8 aa, Plasmodium falciparum
KDNNNNNK

SEQ ID NO: 3318050 - protein, 51 aa, Plasmodium falciparum
KDNNNNNNNEEEEKEKKKEKGEETEGEEVDEQGEIERNGEGNEKKEKDNKN

SEQ ID NO: 3318051 - protein, 12 aa, Plasmodium falciparum
KDNNNVSNNTPL

SEQ ID NO: 3318052 - protein, 16 aa, Plasmodium falciparum
KDNNNYNMDTNNNITN

SEQ ID NO: 3318053 - protein, 12 aa, Plasmodium falciparum
KDNNQTDGGNKD

SEQ ID NO: 3318054 - protein, 6 aa, Plasmodium falciparum
KDNNSL

SEQ ID NO: 3318055 - protein, 7 aa, Plasmodium falciparum
KDNNSNE

SEQ ID NO: 3318056 - protein, 8 aa, Plasmodium falciparum
KDNNSNNI

SEQ ID NO: 3318057 - protein, 17 aa, Plasmodium falciparum
KDNNSRKDMEKEMEKEM

SEQ ID NO: 3318058 - protein, 9 aa, Plasmodium falciparum
KDNNTNDNI

SEQ ID NO: 3318059 - protein, 9 aa, Plasmodium falciparum
KDNNYDNDY

SEQ ID NO: 3318060 - protein, 4 aa, Plasmodium falciparum
KDNP

SEQ ID NO: 3318061 - protein, 55 aa, Plasmodium falciparum
KDNPNINNNNNHNNTNNNNNNHNKSNNNNSTNSNRNDDDNINRQSTQENNSTVGN

SEQ ID NO: 3318062 - protein, 9 aa, Plasmodium falciparum
KDNQEDSEL

SEQ ID NO: 3318063 - protein, 22 aa, Plasmodium falciparum
KDNQEKSQNDNTNNDSGGKKKY

SEQ ID NO: 3318064 - protein, 9 aa, Plasmodium falciparum
KDNRKYNNC

SEQ ID NO: 3318065 - protein, 4 aa, Plasmodium falciparum
KDNS

SEQ ID NO: 3318066 - protein, 126 aa, Plasmodium falciparum
KDNSEKNSNSDQASKNADSDTDEEEEDDELKSEKEKEEDEKEYDEEGESDTNSKIDSDHKSDSDNKSDSDNKSDSDHKSDSDHKSDSDHKSDSDHKSDSDNKNDSDNKNDSDIDSDSESEMVSSNK

SEQ ID NO: 3318067 - protein, 7 aa, Plasmodium falciparum
KDNSELR

SEQ ID NO: 3318068 - protein, 14 aa, Plasmodium falciparum
KDNSGSTNVNSNNN

SEQ ID NO: 3318069 - protein, 18 aa, Plasmodium falciparum
KDNSIQINGKSSGKQNEE

SEQ ID NO: 3318070 - protein, 16 aa, Plasmodium falciparum
KDNSNGNNMENNRNIE

SEQ ID NO: 3318071 - protein, 10 aa, Plasmodium falciparum
KDNSTRSNDE

SEQ ID NO: 3318072 - protein, 5 aa, Plasmodium falciparum
KDNTI

SEQ ID NO: 3318073 - protein, 13 aa, Plasmodium falciparum
KDNTIQNSDINNT

SEQ ID NO: 3318074 - protein, 5 aa, Plasmodium falciparum
KDNTK

SEQ ID NO: 3318075 - protein, 6 aa, Plasmodium falciparum
KDNTNH

SEQ ID NO: 3318076 - protein, 6 aa, Plasmodium falciparum
KDNTNI

SEQ ID NO: 3318077 - protein, 6 aa, Plasmodium falciparum
KDNTPH

SEQ ID NO: 3318078 - protein, 15 aa, Plasmodium falciparum
KDNTRNDNNNNNNKY

SEQ ID NO: 3318079 - protein, 36 aa, Plasmodium falciparum
KDNTTSEQDQTKNDNNINNLSSGQENTINNEEEKKK

SEQ ID NO: 3318080 - protein, 14 aa, Plasmodium falciparum
KDNTYDKCRRSKKN

SEQ ID NO: 3318081 - protein, 33 aa, Plasmodium falciparum
KDNTYNLNKDNTNDEEKKDLKNVEGEKKNTYKK

SEQ ID NO: 3318082 - protein, 4 aa, Plasmodium falciparum
KDNV

SEQ ID NO: 3318083 - protein, 31 aa, Plasmodium falciparum
KDNVENNKMSNNTNKCNDTKTCNNTKTCNNT

SEQ ID NO: 3318084 - protein, 90 aa, Plasmodium falciparum
KDNVKDNVKDNVKDNMKDNMKDNMKNNMKDNMKDNMKNKMKDNTYDNTYDNTYDNTYDNTYDNTYDNTYDNTYDNTYDNTYDNTYDNTYD

SEQ ID NO: 3318085 - protein, 6 aa, Plasmodium falciparum
KDNVNN

SEQ ID NO: 3318086 - protein, 7 aa, Plasmodium falciparum
KDNVNYK

SEQ ID NO: 3318087 - protein, 22 aa, Plasmodium falciparum
KDNVSNESNSKCDDDKKENEDI

SEQ ID NO: 3318088 - protein, 7 aa, Plasmodium falciparum
KDNYHQR

SEQ ID NO: 3318089 - protein, 7 aa, Plasmodium falciparum
KDNYKND

SEQ ID NO: 3318090 - protein, 8 aa, Plasmodium falciparum
KDNYNNDN

SEQ ID NO: 3318091 - protein, 10 aa, Plasmodium falciparum
KDNYPSGQHK

SEQ ID NO: 3318092 - protein, 71 aa, Plasmodium falciparum
KDNYYDRDDHNDYHRDDHNDYDRDDHNDYDRDDHNNYHRDDHNNHHRDDNNNHHRDDHNNHHRDDNNNHHG

SEQ ID NO: 3318093 - protein, 7 aa, Plasmodium falciparum
KDNYYYK

SEQ ID NO: 3318094 - protein, 6 aa, Plasmodium falciparum
KDPEKF

SEQ ID NO: 3318095 - protein, 6 aa, Plasmodium falciparum
KDPENF

SEQ ID NO: 3318096 - protein, 6 aa, Plasmodium falciparum
KDPEYS

SEQ ID NO: 3318097 - protein, 4 aa, Plasmodium falciparum
KDPF

SEQ ID NO: 3318098 - protein, 6 aa, Plasmodium falciparum
KDPGKT

SEQ ID NO: 3318099 - protein, 5 aa, Plasmodium falciparum
KDPKT

SEQ ID NO: 3318100 - protein, 7 aa, Plasmodium falciparum
KDPLVDN

SEQ ID NO: 3318101 - protein, 4 aa, Plasmodium falciparum
KDPN

SEQ ID NO: 3318102 - protein, 6 aa, Plasmodium falciparum
KDPNIR

SEQ ID NO: 3318103 - protein, 11 aa, Plasmodium falciparum
KDPNTGETTLE

SEQ ID NO: 3318104 - protein, 9 aa, Plasmodium falciparum
KDPPEEINN

SEQ ID NO: 3318105 - protein, 7 aa, Plasmodium falciparum
KDPPKNW

SEQ ID NO: 3318106 - protein, 11 aa, Plasmodium falciparum
KDPSGNVQGPF

SEQ ID NO: 3318107 - protein, 4 aa, Plasmodium falciparum
KDPY

SEQ ID NO: 3318108 - protein, 9 aa, Plasmodium falciparum
KDQDNQENC

SEQ ID NO: 3318109 - protein, 102 aa, Plasmodium falciparum
KDQEKNEKNNDEKKKKKKKKKNVQVSDDDSTEFDDEEDDDNDDNDDNDDNDDNDDDDDNNNQENVQNYNSNKMKEIKKKNKSKSGNKKKNKSSNNANKKKNF

SEQ ID NO: 3318110 - protein, 9 aa, Plasmodium falciparum
KDQENIQGQ

SEQ ID NO: 3318111 - protein, 4 aa, Plasmodium falciparum
KDQH

SEQ ID NO: 3318112 - protein, 5 aa, Plasmodium falciparum
KDQIT

SEQ ID NO: 3318113 - protein, 19 aa, Plasmodium falciparum
KDQKESGLTKKEVNDDMNE

SEQ ID NO: 3318114 - protein, 5 aa, Plasmodium falciparum
KDQLS

SEQ ID NO: 3318115 - protein, 6 aa, Plasmodium falciparum
KDQLSL

SEQ ID NO: 3318116 - protein, 13 aa, Plasmodium falciparum
KDQNDEKCNNKKT

SEQ ID NO: 3318117 - protein, 16 aa, Plasmodium falciparum
KDQNESEYLSDDSDQH

SEQ ID NO: 3318118 - protein, 17 aa, Plasmodium falciparum
KDQNQFNEPNKNNLNNT

SEQ ID NO: 3318119 - protein, 5 aa, Plasmodium falciparum
KDQNV

SEQ ID NO: 3318120 - protein, 11 aa, Plasmodium falciparum
KDQQVKSVNSE

SEQ ID NO: 3318121 - protein, 27 aa, Plasmodium falciparum
KDQRSNENFQNEENHYSQQKLEKEKME

SEQ ID NO: 3318122 - protein, 16 aa, Plasmodium falciparum
KDQRTLNRSGNSSSEH

SEQ ID NO: 3318123 - protein, 4 aa, Plasmodium falciparum
KDQS

SEQ ID NO: 3318124 - protein, 11 aa, Plasmodium falciparum
KDQSNTDSTFN

SEQ ID NO: 3318125 - protein, 20 aa, Plasmodium falciparum
KDQSYEVQNQKDKNSKKKGS

SEQ ID NO: 3318126 - protein, 8 aa, Plasmodium falciparum
KDQSYNRN

SEQ ID NO: 3318127 - protein, 9 aa, Plasmodium falciparum
KDQTDEDDI

SEQ ID NO: 3318128 - protein, 8 aa, Plasmodium falciparum
KDQTDEKL

SEQ ID NO: 3318129 - protein, 5 aa, Plasmodium falciparum
KDQTG

SEQ ID NO: 3318130 - protein, 11 aa, Plasmodium falciparum
KDQYRGDGIAP

SEQ ID NO: 3318131 - protein, 13 aa, Plasmodium falciparum
KDRDKKSKQTNRL

SEQ ID NO: 3318132 - protein, 11 aa, Plasmodium falciparum
KDREDDEEKER

SEQ ID NO: 3318133 - protein, 7 aa, Plasmodium falciparum
KDREEIK

SEQ ID NO: 3318134 - protein, 13 aa, Plasmodium falciparum
KDRENQHQQHQQH

SEQ ID NO: 3318135 - protein, 4 aa, Plasmodium falciparum
KDRK

SEQ ID NO: 3318136 - protein, 7 aa, Plasmodium falciparum
KDRLGGD

SEQ ID NO: 3318137 - protein, 16 aa, Plasmodium falciparum
KDRNETDSKKKYSFKD

SEQ ID NO: 3318138 - protein, 5 aa, Plasmodium falciparum
KDRNN

SEQ ID NO: 3318139 - protein, 14 aa, Plasmodium falciparum
KDRNNDQNFSNRND

SEQ ID NO: 3318140 - protein, 17 aa, Plasmodium falciparum
KDRNNLNENNNNKSKEK

SEQ ID NO: 3318141 - protein, 4 aa, Plasmodium falciparum
KDRP

SEQ ID NO: 3318142 - protein, 9 aa, Plasmodium falciparum
KDRSRNYRD

SEQ ID NO: 3318143 - protein, 5 aa, Plasmodium falciparum
KDRTI

SEQ ID NO: 3318144 - protein, 10 aa, Plasmodium falciparum
KDRTSEIEEN

SEQ ID NO: 3318145 - protein, 5 aa, Plasmodium falciparum
KDRYD

SEQ ID NO: 3318146 - protein, 18 aa, Plasmodium falciparum
KDSAIQRSGRAGREAPGQ

SEQ ID NO: 3318147 - protein, 4 aa, Plasmodium falciparum
KDSC

SEQ ID NO: 3318148 - protein, 9 aa, Plasmodium falciparum
KDSDEGKKQ

SEQ ID NO: 3318149 - protein, 10 aa, Plasmodium falciparum
KDSDTKCRSN

SEQ ID NO: 3318150 - protein, 6 aa, Plasmodium falciparum
KDSEIN

SEQ ID NO: 3318151 - protein, 7 aa, Plasmodium falciparum
KDSETKE

SEQ ID NO: 3318152 - protein, 13 aa, Plasmodium falciparum
KDSFEEKKYTYGD

SEQ ID NO: 3318153 - protein, 5 aa, Plasmodium falciparum
KDSGI

SEQ ID NO: 3318154 - protein, 15 aa, Plasmodium falciparum
KDSHNENNNNNNIQL

SEQ ID NO: 3318155 - protein, 4 aa, Plasmodium falciparum
KDSI

SEQ ID NO: 3318156 - protein, 21 aa, Plasmodium falciparum
KDSIENKEKITNTEETKENMK

SEQ ID NO: 3318157 - protein, 9 aa, Plasmodium falciparum
KDSIQNEYP

SEQ ID NO: 3318158 - protein, 6 aa, Plasmodium falciparum
KDSITN

SEQ ID NO: 3318159 - protein, 6 aa, Plasmodium falciparum
KDSKDI

SEQ ID NO: 3318160 - protein, 32 aa, Plasmodium falciparum
KDSKEQTFDKNKKAYKENEESNINHETNDTSE

SEQ ID NO: 3318161 - protein, 5 aa, Plasmodium falciparum
KDSKG

SEQ ID NO: 3318162 - protein, 11 aa, Plasmodium falciparum
KDSKGERHGTA

SEQ ID NO: 3318163 - protein, 31 aa, Plasmodium falciparum
KDSKKENYNSPSLTSSYTSKSISLSKSTSHS

SEQ ID NO: 3318164 - protein, 6 aa, Plasmodium falciparum
KDSKKI

SEQ ID NO: 3318165 - protein, 7 aa, Plasmodium falciparum
KDSKKKN

SEQ ID NO: 3318166 - protein, 9 aa, Plasmodium falciparum
KDSKNNVEH

SEQ ID NO: 3318167 - protein, 9 aa, Plasmodium falciparum
KDSKRRKET

SEQ ID NO: 3318168 - protein, 5 aa, Plasmodium falciparum
KDSLF

SEQ ID NO: 3318169 - protein, 6 aa, Plasmodium falciparum
KDSLHS

SEQ ID NO: 3318170 - protein, 11 aa, Plasmodium falciparum
KDSLNKNPSNI

SEQ ID NO: 3318171 - protein, 30 aa, Plasmodium falciparum
KDSNDEDDSYDHSSINENKNNELKDKDDFI

SEQ ID NO: 3318172 - protein, 10 aa, Plasmodium falciparum
KDSNDNDHNT

SEQ ID NO: 3318173 - protein, 8 aa, Plasmodium falciparum
KDSNECGL

SEQ ID NO: 3318174 - protein, 6 aa, Plasmodium falciparum
KDSNEI

SEQ ID NO: 3318175 - protein, 8 aa, Plasmodium falciparum
KDSNESEI

SEQ ID NO: 3318176 - protein, 11 aa, Plasmodium falciparum
KDSNETTNTPL

SEQ ID NO: 3318177 - protein, 5 aa, Plasmodium falciparum
KDSNH

SEQ ID NO: 3318178 - protein, 8 aa, Plasmodium falciparum
KDSNIRND

SEQ ID NO: 3318179 - protein, 9 aa, Plasmodium falciparum
KDSNKINNI

SEQ ID NO: 3318180 - protein, 10 aa, Plasmodium falciparum
KDSNKNEIKQ

SEQ ID NO: 3318181 - protein, 7 aa, Plasmodium falciparum
KDSNLNP

SEQ ID NO: 3318182 - protein, 25 aa, Plasmodium falciparum
KDSNNKEHDETTDENINKKRKPSKK

SEQ ID NO: 3318183 - protein, 14 aa, Plasmodium falciparum
KDSPKKSRSGLQED

SEQ ID NO: 3318184 - protein, 6 aa, Plasmodium falciparum
KDSRIA

SEQ ID NO: 3318185 - protein, 22 aa, Plasmodium falciparum
KDSRKKYNDLNSNKNSKNDEIK

SEQ ID NO: 3318186 - protein, 8 aa, Plasmodium falciparum
KDSRQRNA

SEQ ID NO: 3318187 - protein, 5 aa, Plasmodium falciparum
KDSSI

SEQ ID NO: 3318188 - protein, 11 aa, Plasmodium falciparum
KDSSISPNSSY

SEQ ID NO: 3318189 - protein, 28 aa, Plasmodium falciparum
KDSSKRKKIHKSSQSDIYEEDKTIKKNK

SEQ ID NO: 3318190 - protein, 7 aa, Plasmodium falciparum
KDSSYKS

SEQ ID NO: 3318191 - protein, 7 aa, Plasmodium falciparum
KDSTNYE

SEQ ID NO: 3318192 - protein, 8 aa, Plasmodium falciparum
KDSTTKSN

SEQ ID NO: 3318193 - protein, 6 aa, Plasmodium falciparum
KDSVLG

SEQ ID NO: 3318194 - protein, 42 aa, Plasmodium falciparum
KDSVNQLKSEKKKDINDDNNNNDDNNNNDDNNNNNDDDNKIN

SEQ ID NO: 3318195 - protein, 8 aa, Plasmodium falciparum
KDSVTDEQ

SEQ ID NO: 3318196 - protein, 6 aa, Plasmodium falciparum
KDSYDL

SEQ ID NO: 3318197 - protein, 5 aa, Plasmodium falciparum
KDSYS

SEQ ID NO: 3318198 - protein, 4 aa, Plasmodium falciparum
KDTA

SEQ ID NO: 3318199 - protein, 22 aa, Plasmodium falciparum
KDTCNNTEDMSKRNKEKTTTQN

SEQ ID NO: 3318200 - protein, 4 aa, Plasmodium falciparum
KDTD

SEQ ID NO: 3318201 - protein, 8 aa, Plasmodium falciparum
KDTDEGKK

SEQ ID NO: 3318202 - protein, 8 aa, Plasmodium falciparum
KDTDSYED

SEQ ID NO: 3318203 - protein, 8 aa, Plasmodium falciparum
KDTDTEEE

SEQ ID NO: 3318204 - protein, 4 aa, Plasmodium falciparum
KDTE

SEQ ID NO: 3318205 - protein, 7 aa, Plasmodium falciparum
KDTENEK

SEQ ID NO: 3318206 - protein, 13 aa, Plasmodium falciparum
KDTENTKNEQTIK

SEQ ID NO: 3318207 - protein, 5 aa, Plasmodium falciparum
KDTFT

SEQ ID NO: 3318208 - protein, 7 aa, Plasmodium falciparum
KDTGKNI

SEQ ID NO: 3318209 - protein, 4 aa, Plasmodium falciparum
KDTI

SEQ ID NO: 3318210 - protein, 6 aa, Plasmodium falciparum
KDTKRT

SEQ ID NO: 3318211 - protein, 6 aa, Plasmodium falciparum
KDTLNR

SEQ ID NO: 3318212 - protein, 12 aa, Plasmodium falciparum
KDTLYKSSKNNI

SEQ ID NO: 3318213 - protein, 5 aa, Plasmodium falciparum
KDTMK

SEQ ID NO: 3318214 - protein, 6 aa, Plasmodium falciparum
KDTNEF

SEQ ID NO: 3318215 - protein, 6 aa, Plasmodium falciparum
KDTNHL

SEQ ID NO: 3318216 - protein, 17 aa, Plasmodium falciparum
KDTNISKRNIYLNRTLV

SEQ ID NO: 3318217 - protein, 14 aa, Plasmodium falciparum
KDTNKCDSSNCDKE

SEQ ID NO: 3318218 - protein, 13 aa, Plasmodium falciparum
KDTNKKKIKEENY

SEQ ID NO: 3318219 - protein, 7 aa, Plasmodium falciparum
KDTNKYE

SEQ ID NO: 3318220 - protein, 8 aa, Plasmodium falciparum
KDTNNHNN

SEQ ID NO: 3318221 - protein, 7 aa, Plasmodium falciparum
KDTNNNV

SEQ ID NO: 3318222 - protein, 18 aa, Plasmodium falciparum
KDTNSVEDIASSKDIQSV

SEQ ID NO: 3318223 - protein, 8 aa, Plasmodium falciparum
KDTPTRKY

SEQ ID NO: 3318224 - protein, 8 aa, Plasmodium falciparum
KDTQEDMK

SEQ ID NO: 3318225 - protein, 12 aa, Plasmodium falciparum
KDTQKFNKNSIN

SEQ ID NO: 3318226 - protein, 10 aa, Plasmodium falciparum
KDTQSNNSHI

SEQ ID NO: 3318227 - protein, 6 aa, Plasmodium falciparum
KDTRQN

SEQ ID NO: 3318228 - protein, 4 aa, Plasmodium falciparum
KDTS

SEQ ID NO: 3318229 - protein, 8 aa, Plasmodium falciparum
KDTSAINS

SEQ ID NO: 3318230 - protein, 5 aa, Plasmodium falciparum
KDTSI

SEQ ID NO: 3318231 - protein, 6 aa, Plasmodium falciparum
KDTSNP

SEQ ID NO: 3318232 - protein, 9 aa, Plasmodium falciparum
KDTSPDSDT

SEQ ID NO: 3318233 - protein, 15 aa, Plasmodium falciparum
KDTSSISNDYNNKKN

SEQ ID NO: 3318234 - protein, 6 aa, Plasmodium falciparum
KDTSTS

SEQ ID NO: 3318235 - protein, 4 aa, Plasmodium falciparum
KDTT

SEQ ID NO: 3318236 - protein, 7 aa, Plasmodium falciparum
KDTTNAN

SEQ ID NO: 3318237 - protein, 11 aa, Plasmodium falciparum
KDTTNNEYSLE

SEQ ID NO: 3318238 - protein, 56 aa, Plasmodium falciparum
KDTTQRENNNDNRNDNRNDNRNDNRNDNRNDNRNDNRNDNRNDNRNDNRNDNWNDN

SEQ ID NO: 3318239 - protein, 8 aa, Plasmodium falciparum
KDTYDYSR

SEQ ID NO: 3318240 - protein, 7 aa, Plasmodium falciparum
KDTYKNK

SEQ ID NO: 3318241 - protein, 4 aa, Plasmodium falciparum
KDVC

SEQ ID NO: 3318242 - protein, 5 aa, Plasmodium falciparum
KDVDD

SEQ ID NO: 3318243 - protein, 15 aa, Plasmodium falciparum
KDVDDNNNNSDDNED

SEQ ID NO: 3318244 - protein, 6 aa, Plasmodium falciparum
KDVDQK

SEQ ID NO: 3318245 - protein, 64 aa, Plasmodium falciparum
KDVEKKKDGEKNKDGEKNKDGEKNKDGEKNKDGEKKKDGEKKKDGEKEEGKNEEKENEEENKIK

SEQ ID NO: 3318246 - protein, 11 aa, Plasmodium falciparum
KDVEKKNKEPI

SEQ ID NO: 3318247 - protein, 6 aa, Plasmodium falciparum
KDVESP

SEQ ID NO: 3318248 - protein, 15 aa, Plasmodium falciparum
KDVGKEKKKNDKLNN

SEQ ID NO: 3318249 - protein, 8 aa, Plasmodium falciparum
KDVKGNLG

SEQ ID NO: 3318250 - protein, 16 aa, Plasmodium falciparum
KDVKKSKKEKDKIKAA

SEQ ID NO: 3318251 - protein, 34 aa, Plasmodium falciparum
KDVNDNKYDNKKKNNNNNNNKNNNNKNNNYSNSY

SEQ ID NO: 3318252 - protein, 9 aa, Plasmodium falciparum
KDVNDNNKS

SEQ ID NO: 3318253 - protein, 8 aa, Plasmodium falciparum
KDVNSSEE

SEQ ID NO: 3318254 - protein, 32 aa, Plasmodium falciparum
KDVNTKDEEKGDSFKNKEKLKSENDMDENNIT

SEQ ID NO: 3318255 - protein, 6 aa, Plasmodium falciparum
KDVQKD

SEQ ID NO: 3318256 - protein, 11 aa, Plasmodium falciparum
KDVQQNISNNT

SEQ ID NO: 3318257 - protein, 4 aa, Plasmodium falciparum
KDVR

SEQ ID NO: 3318258 - protein, 8 aa, Plasmodium falciparum
KDVSNHNL

SEQ ID NO: 3318259 - protein, 13 aa, Plasmodium falciparum
KDVSQDSLDTPEG

SEQ ID NO: 3318260 - protein, 10 aa, Plasmodium falciparum
KDVTDNEKKK

SEQ ID NO: 3318261 - protein, 17 aa, Plasmodium falciparum
KDVTEEELKTEAAKYGT

SEQ ID NO: 3318262 - protein, 7 aa, Plasmodium falciparum
KDVTTTE

SEQ ID NO: 3318263 - protein, 26 aa, Plasmodium falciparum
KDVTYNNYNNSRNTYNKDNTNYESPY

SEQ ID NO: 3318264 - protein, 31 aa, Plasmodium falciparum
KDYDYNKNTDVPSAESKNDQDINKDHTINGG

SEQ ID NO: 3318265 - protein, 9 aa, Plasmodium falciparum
KDYENKERE

SEQ ID NO: 3318266 - protein, 7 aa, Plasmodium falciparum
KDYGDKE

SEQ ID NO: 3318267 - protein, 6 aa, Plasmodium falciparum
KDYKNV

SEQ ID NO: 3318268 - protein, 14 aa, Plasmodium falciparum
KDYLKNKNDEGNNV

SEQ ID NO: 3318269 - protein, 4 aa, Plasmodium falciparum
KDYN

SEQ ID NO: 3318270 - protein, 12 aa, Plasmodium falciparum
KDYNDNKKDYVN

SEQ ID NO: 3318271 - protein, 7 aa, Plasmodium falciparum
KDYSDKI

SEQ ID NO: 3318272 - protein, 5 aa, Plasmodium falciparum
KDYSN

SEQ ID NO: 3318273 - protein, 6 aa, Plasmodium falciparum
KDYSNN

SEQ ID NO: 3318274 - protein, 9 aa, Plasmodium falciparum
KDYSTNENN

SEQ ID NO: 3318275 - protein, 6 aa, Plasmodium falciparum
KDYTDT

SEQ ID NO: 3318276 - protein, 6 aa, Plasmodium falciparum
KDYTTT

SEQ ID NO: 3318277 - protein, 6 aa, Plasmodium falciparum
KDYTYE

SEQ ID NO: 3318278 - protein, 8 aa, Plasmodium falciparum
KEAANEKR

SEQ ID NO: 3318279 - protein, 5 aa, Plasmodium falciparum
KEAAP

SEQ ID NO: 3318280 - protein, 5 aa, Plasmodium falciparum
KEADE

SEQ ID NO: 3318281 - protein, 5 aa, Plasmodium falciparum
KEAEE

SEQ ID NO: 3318282 - protein, 10 aa, Plasmodium falciparum
KEAEEKQKKV

SEQ ID NO: 3318283 - protein, 7 aa, Plasmodium falciparum
KEAEGYL

SEQ ID NO: 3318284 - protein, 7 aa, Plasmodium falciparum
KEAKKKA

SEQ ID NO: 3318285 - protein, 11 aa, Plasmodium falciparum
KEAKTSNTRHR

SEQ ID NO: 3318286 - protein, 13 aa, Plasmodium falciparum
KEALNKNITKDKK

SEQ ID NO: 3318287 - protein, 5 aa, Plasmodium falciparum
KEANI

SEQ ID NO: 3318288 - protein, 5 aa, Plasmodium falciparum
KEANK

SEQ ID NO: 3318289 - protein, 48 aa, Plasmodium falciparum
KEAPNNNNNKINNNKINNNKINNNKINNNKSNNNKSNNNNNCGSSANI

SEQ ID NO: 3318290 - protein, 8 aa, Plasmodium falciparum
KEAQSTGV

SEQ ID NO: 3318291 - protein, 8 aa, Plasmodium falciparum
KEARKKDK

SEQ ID NO: 3318292 - protein, 30 aa, Plasmodium falciparum
KEASSDKVSKESFNEEDNENNEKREKSDSW

SEQ ID NO: 3318293 - protein, 7 aa, Plasmodium falciparum
KEAYDEE

SEQ ID NO: 3318294 - protein, 6 aa, Plasmodium falciparum
KEAYES

SEQ ID NO: 3318295 - protein, 4 aa, Plasmodium falciparum
KECD

SEQ ID NO: 3318296 - protein, 4 aa, Plasmodium falciparum
KECE

SEQ ID NO: 3318297 - protein, 11 aa, Plasmodium falciparum
KECEEAAEEIN

SEQ ID NO: 3318298 - protein, 6 aa, Plasmodium falciparum
KECEHE

SEQ ID NO: 3318299 - protein, 5 aa, Plasmodium falciparum
KECEQ

SEQ ID NO: 3318300 - protein, 6 aa, Plasmodium falciparum
KECKNN

SEQ ID NO: 3318301 - protein, 6 aa, Plasmodium falciparum
KECNDN

SEQ ID NO: 3318302 - protein, 8 aa, Plasmodium falciparum
KECNNKCD

SEQ ID NO: 3318303 - protein, 5 aa, Plasmodium falciparum
KECSK

SEQ ID NO: 3318304 - protein, 6 aa, Plasmodium falciparum
KECTPQ

SEQ ID NO: 3318305 - protein, 4 aa, Plasmodium falciparum
KEDC

SEQ ID NO: 3318306 - protein, 23 aa, Plasmodium falciparum
KEDDDSKAKHETSEENTKSWRNN

SEQ ID NO: 3318307 - protein, 11 aa, Plasmodium falciparum
KEDDEKKASSF

SEQ ID NO: 3318308 - protein, 8 aa, Plasmodium falciparum
KEDDKKEP

SEQ ID NO: 3318309 - protein, 7 aa, Plasmodium falciparum
KEDDKNL

SEQ ID NO: 3318310 - protein, 11 aa, Plasmodium falciparum
KEDDKNNVNNN

SEQ ID NO: 3318311 - protein, 10 aa, Plasmodium falciparum
KEDDNKNNIR

SEQ ID NO: 3318312 - protein, 11 aa, Plasmodium falciparum
KEDDNNKPKIN

SEQ ID NO: 3318313 - protein, 12 aa, Plasmodium falciparum
KEDDSNNKRNKV

SEQ ID NO: 3318314 - protein, 19 aa, Plasmodium falciparum
KEDEDENKKQNINKFDNDK

SEQ ID NO: 3318315 - protein, 14 aa, Plasmodium falciparum
KEDEEEEKEVNNNK

SEQ ID NO: 3318316 - protein, 7 aa, Plasmodium falciparum
KEDEEQI

SEQ ID NO: 3318317 - protein, 9 aa, Plasmodium falciparum
KEDEGNNTP

SEQ ID NO: 3318318 - protein, 5 aa, Plasmodium falciparum
KEDEK

SEQ ID NO: 3318319 - protein, 14 aa, Plasmodium falciparum
KEDEKGLDVEETKN

SEQ ID NO: 3318320 - protein, 9 aa, Plasmodium falciparum
KEDENNVYT

SEQ ID NO: 3318321 - protein, 11 aa, Plasmodium falciparum
KEDEPGETKKC

SEQ ID NO: 3318322 - protein, 7 aa, Plasmodium falciparum
KEDEQCD

SEQ ID NO: 3318323 - protein, 14 aa, Plasmodium falciparum
KEDERNNVKEEITL

SEQ ID NO: 3318324 - protein, 8 aa, Plasmodium falciparum
KEDESNNK

SEQ ID NO: 3318325 - protein, 10 aa, Plasmodium falciparum
KEDESNSTIN

SEQ ID NO: 3318326 - protein, 5 aa, Plasmodium falciparum
KEDFD

SEQ ID NO: 3318327 - protein, 7 aa, Plasmodium falciparum
KEDGGLN

SEQ ID NO: 3318328 - protein, 12 aa, Plasmodium falciparum
KEDHTKESEEIQ

SEQ ID NO: 3318329 - protein, 94 aa, Plasmodium falciparum
KEDIEEEEEEEKEEEYEEEEEEEEYEEEEEEEEEEYEEEGLKTEEEKEEDNKEVEPEEELKEEDDKEVEPEEEKENEQKKEEQEENNLEAPSKT

SEQ ID NO: 3318330 - protein, 5 aa, Plasmodium falciparum
KEDIF

SEQ ID NO: 3318331 - protein, 5 aa, Plasmodium falciparum
KEDIH

SEQ ID NO: 3318332 - protein, 12 aa, Plasmodium falciparum
KEDIKKKEQCKK

SEQ ID NO: 3318333 - protein, 9 aa, Plasmodium falciparum
KEDINDDDV

SEQ ID NO: 3318334 - protein, 6 aa, Plasmodium falciparum
KEDIQD

SEQ ID NO: 3318335 - protein, 6 aa, Plasmodium falciparum
KEDIYE

SEQ ID NO: 3318336 - protein, 6 aa, Plasmodium falciparum
KEDKDN

SEQ ID NO: 3318337 - protein, 5 aa, Plasmodium falciparum
KEDKE

SEQ ID NO: 3318338 - protein, 7 aa, Plasmodium falciparum
KEDKEKA

SEQ ID NO: 3318339 - protein, 13 aa, Plasmodium falciparum
KEDKEKQNDTDSR

SEQ ID NO: 3318340 - protein, 8 aa, Plasmodium falciparum
KEDKELSK

SEQ ID NO: 3318341 - protein, 5 aa, Plasmodium falciparum
KEDKI

SEQ ID NO: 3318342 - protein, 8 aa, Plasmodium falciparum
KEDKKDFK

SEQ ID NO: 3318343 - protein, 24 aa, Plasmodium falciparum
KEDKKEDEEDEDEVEEEDDLKDAG

SEQ ID NO: 3318344 - protein, 5 aa, Plasmodium falciparum
KEDKN

SEQ ID NO: 3318345 - protein, 22 aa, Plasmodium falciparum
KEDKNDLDNKNYEDFNTTNTNK

SEQ ID NO: 3318346 - protein, 6 aa, Plasmodium falciparum
KEDKNK

SEQ ID NO: 3318347 - protein, 7 aa, Plasmodium falciparum
KEDKNSQ

SEQ ID NO: 3318348 - protein, 11 aa, Plasmodium falciparum
KEDKRKRRQEI

SEQ ID NO: 3318349 - protein, 7 aa, Plasmodium falciparum
KEDKRNM

SEQ ID NO: 3318350 - protein, 6 aa, Plasmodium falciparum
KEDKTL

SEQ ID NO: 3318351 - protein, 9 aa, Plasmodium falciparum
KEDKTNNGK

SEQ ID NO: 3318352 - protein, 9 aa, Plasmodium falciparum
KEDKVHPSD

SEQ ID NO: 3318353 - protein, 8 aa, Plasmodium falciparum
KEDKYNMD

SEQ ID NO: 3318354 - protein, 4 aa, Plasmodium falciparum
KEDL

SEQ ID NO: 3318355 - protein, 7 aa, Plasmodium falciparum
KEDLKPS

SEQ ID NO: 3318356 - protein, 5 aa, Plasmodium falciparum
KEDLL

SEQ ID NO: 3318357 - protein, 20 aa, Plasmodium falciparum
KEDNDLGKKKEETNKYNENY

SEQ ID NO: 3318358 - protein, 7 aa, Plasmodium falciparum
KEDNEKY

SEQ ID NO: 3318359 - protein, 13 aa, Plasmodium falciparum
KEDNETNGEENDM

SEQ ID NO: 3318360 - protein, 5 aa, Plasmodium falciparum
KEDNG

SEQ ID NO: 3318361 - protein, 9 aa, Plasmodium falciparum
KEDNKEEKE

SEQ ID NO: 3318362 - protein, 57 aa, Plasmodium falciparum
KEDNKKAINKGKKEDKGKKDDKKDDKLKNKINKKDLKYDNKSQKLDKHKKEEKYEKL

SEQ ID NO: 3318363 - protein, 16 aa, Plasmodium falciparum
KEDNKSKELKEQQNDI

SEQ ID NO: 3318364 - protein, 5 aa, Plasmodium falciparum
KEDNN

SEQ ID NO: 3318365 - protein, 13 aa, Plasmodium falciparum
KEDNNGTEKKLSE

SEQ ID NO: 3318366 - protein, 8 aa, Plasmodium falciparum
KEDNNKKL

SEQ ID NO: 3318367 - protein, 5 aa, Plasmodium falciparum
KEDNV

SEQ ID NO: 3318368 - protein, 35 aa, Plasmodium falciparum
KEDNYNKDDNYYKEDNFNKDDNFNKDDNYNKEDNY

SEQ ID NO: 3318369 - protein, 6 aa, Plasmodium falciparum
KEDPNE

SEQ ID NO: 3318370 - protein, 5 aa, Plasmodium falciparum
KEDPS

SEQ ID NO: 3318371 - protein, 11 aa, Plasmodium falciparum
KEDQDEEFKGS

SEQ ID NO: 3318372 - protein, 7 aa, Plasmodium falciparum
KEDQIGK

SEQ ID NO: 3318373 - protein, 5 aa, Plasmodium falciparum
KEDQQ

SEQ ID NO: 3318374 - protein, 6 aa, Plasmodium falciparum
KEDQVV

SEQ ID NO: 3318375 - protein, 4 aa, Plasmodium falciparum
KEDR

SEQ ID NO: 3318376 - protein, 4 aa, Plasmodium falciparum
KEDS

SEQ ID NO: 3318377 - protein, 8 aa, Plasmodium falciparum
KEDSDAVQ

SEQ ID NO: 3318378 - protein, 8 aa, Plasmodium falciparum
KEDSDFSD

SEQ ID NO: 3318379 - protein, 7 aa, Plasmodium falciparum
KEDSENM

SEQ ID NO: 3318380 - protein, 14 aa, Plasmodium falciparum
KEDSLKKIDNTTGG

SEQ ID NO: 3318381 - protein, 6 aa, Plasmodium falciparum
KEDSYG

SEQ ID NO: 3318382 - protein, 7 aa, Plasmodium falciparum
KEDTDHK

SEQ ID NO: 3318383 - protein, 6 aa, Plasmodium falciparum
KEDTDN

SEQ ID NO: 3318384 - protein, 7 aa, Plasmodium falciparum
KEDTNEK

SEQ ID NO: 3318385 - protein, 5 aa, Plasmodium falciparum
KEDTP

SEQ ID NO: 3318386 - protein, 17 aa, Plasmodium falciparum
KEDTQKEKATHTADNDL

SEQ ID NO: 3318387 - protein, 6 aa, Plasmodium falciparum
KEDVNK

SEQ ID NO: 3318388 - protein, 6 aa, Plasmodium falciparum
KEDYPN

SEQ ID NO: 3318389 - protein, 7 aa, Plasmodium falciparum
KEDYSKM

SEQ ID NO: 3318390 - protein, 8 aa, Plasmodium falciparum
KEEAEKYG

SEQ ID NO: 3318391 - protein, 4 aa, Plasmodium falciparum
KEEC

SEQ ID NO: 3318392 - protein, 14 aa, Plasmodium falciparum
KEECNKDDHVQEDN

SEQ ID NO: 3318393 - protein, 32 aa, Plasmodium falciparum
KEEDDKDDDNDDDEEEEKKKNKQEEEEGNKLQ

SEQ ID NO: 3318394 - protein, 5 aa, Plasmodium falciparum
KEEDE

SEQ ID NO: 3318395 - protein, 14 aa, Plasmodium falciparum
KEEDEENELKDEDR

SEQ ID NO: 3318396 - protein, 20 aa, Plasmodium falciparum
KEEDEKKKKNKKNEKSSSNI

SEQ ID NO: 3318397 - protein, 11 aa, Plasmodium falciparum
KEEDENNRREH

SEQ ID NO: 3318398 - protein, 9 aa, Plasmodium falciparum
KEEDGNIEE

SEQ ID NO: 3318399 - protein, 8 aa, Plasmodium falciparum
KEEDNKII

SEQ ID NO: 3318400 - protein, 5 aa, Plasmodium falciparum
KEEDY

SEQ ID NO: 3318401 - protein, 6 aa, Plasmodium falciparum
KEEDYS

SEQ ID NO: 3318402 - protein, 28 aa, Plasmodium falciparum
KEEEEEEKEKEKKEEEEEEEKKKKKEEL

SEQ ID NO: 3318403 - protein, 18 aa, Plasmodium falciparum
KEEEEEEKKKKEEKKKND

SEQ ID NO: 3318404 - protein, 9 aa, Plasmodium falciparum
KEEEEEELN

SEQ ID NO: 3318405 - protein, 8 aa, Plasmodium falciparum
KEEEEELE

SEQ ID NO: 3318406 - protein, 42 aa, Plasmodium falciparum
KEEEEQNGEQTKNDTKQNDQTEKNEKKKKSIINKSSTNDSYQ

SEQ ID NO: 3318407 - protein, 8 aa, Plasmodium falciparum
KEEEEQQQ

SEQ ID NO: 3318408 - protein, 8 aa, Plasmodium falciparum
KEEEGGSN

SEQ ID NO: 3318409 - protein, 14 aa, Plasmodium falciparum
KEEEGKKNYSYQKE

SEQ ID NO: 3318410 - protein, 5 aa, Plasmodium falciparum
KEEEI

SEQ ID NO: 3318411 - protein, 5 aa, Plasmodium falciparum
KEEEK

SEQ ID NO: 3318412 - protein, 10 aa, Plasmodium falciparum
KEEEKEVEDE

SEQ ID NO: 3318413 - protein, 8 aa, Plasmodium falciparum
KEEEKKKN

SEQ ID NO: 3318414 - protein, 10 aa, Plasmodium falciparum
KEEEKNNKES

SEQ ID NO: 3318415 - protein, 10 aa, Plasmodium falciparum
KEEEKRKKSV

SEQ ID NO: 3318416 - protein, 9 aa, Plasmodium falciparum
KEEEKRRKQ

SEQ ID NO: 3318417 - protein, 6 aa, Plasmodium falciparum
KEEEKT

SEQ ID NO: 3318418 - protein, 5 aa, Plasmodium falciparum
KEEEL

SEQ ID NO: 3318419 - protein, 5 aa, Plasmodium falciparum
KEEEN

SEQ ID NO: 3318420 - protein, 7 aa, Plasmodium falciparum
KEEENEK

SEQ ID NO: 3318421 - protein, 22 aa, Plasmodium falciparum
KEEENISKNNIKDNKRRNSLED

SEQ ID NO: 3318422 - protein, 8 aa, Plasmodium falciparum
KEEEQNEM

SEQ ID NO: 3318423 - protein, 7 aa, Plasmodium falciparum
KEEERKL

SEQ ID NO: 3318424 - protein, 8 aa, Plasmodium falciparum
KEEETYTT

SEQ ID NO: 3318425 - protein, 7 aa, Plasmodium falciparum
KEEEYTP

SEQ ID NO: 3318426 - protein, 4 aa, Plasmodium falciparum
KEEF

SEQ ID NO: 3318427 - protein, 5 aa, Plasmodium falciparum
KEEFD

SEQ ID NO: 3318428 - protein, 5 aa, Plasmodium falciparum
KEEFN

SEQ ID NO: 3318429 - protein, 5 aa, Plasmodium falciparum
KEEGD

SEQ ID NO: 3318430 - protein, 11 aa, Plasmodium falciparum
KEEGNEESQEN

SEQ ID NO: 3318431 - protein, 52 aa, Plasmodium falciparum
KEEGNEKKKKNINNDNINNNDNINNDNINNNDNINNDNINNDNINNNDNINN

SEQ ID NO: 3318432 - protein, 14 aa, Plasmodium falciparum
KEEGNNLGDNKNAD

SEQ ID NO: 3318433 - protein, 9 aa, Plasmodium falciparum
KEEGTPSYK

SEQ ID NO: 3318434 - protein, 8 aa, Plasmodium falciparum
KEEHDKNI

SEQ ID NO: 3318435 - protein, 15 aa, Plasmodium falciparum
KEEHEKNKNLAERLN

SEQ ID NO: 3318436 - protein, 6 aa, Plasmodium falciparum
KEEIEL

SEQ ID NO: 3318437 - protein, 7 aa, Plasmodium falciparum
KEEIKEI

SEQ ID NO: 3318438 - protein, 16 aa, Plasmodium falciparum
KEEIKKNETEKRQKNV

SEQ ID NO: 3318439 - protein, 28 aa, Plasmodium falciparum
KEEIQKKNSANSRDSSPSSCGSNKLSER

SEQ ID NO: 3318440 - protein, 18 aa, Plasmodium falciparum
KEEKDKEIKRKKDEFEST

SEQ ID NO: 3318441 - protein, 13 aa, Plasmodium falciparum
KEEKDKEKKKKDI

SEQ ID NO: 3318442 - protein, 10 aa, Plasmodium falciparum
KEEKEGQNDI

SEQ ID NO: 3318443 - protein, 16 aa, Plasmodium falciparum
KEEKEIDTDSSTEGDE

SEQ ID NO: 3318444 - protein, 10 aa, Plasmodium falciparum
KEEKEIKEQE

SEQ ID NO: 3318445 - protein, 13 aa, Plasmodium falciparum
KEEKEINNECSKD

SEQ ID NO: 3318446 - protein, 14 aa, Plasmodium falciparum
KEEKEKKEKKKEVL

SEQ ID NO: 3318447 - protein, 18 aa, Plasmodium falciparum
KEEKEKRKKQKQDEQQVK

SEQ ID NO: 3318448 - protein, 18 aa, Plasmodium falciparum
KEEKEMEKKRKKKKNYKN

SEQ ID NO: 3318449 - protein, 9 aa, Plasmodium falciparum
KEEKETQKM

SEQ ID NO: 3318450 - protein, 11 aa, Plasmodium falciparum
KEEKGNDNEKR

SEQ ID NO: 3318451 - protein, 13 aa, Plasmodium falciparum
KEEKHKKKTEAAE

SEQ ID NO: 3318452 - protein, 7 aa, Plasmodium falciparum
KEEKHNL

SEQ ID NO: 3318453 - protein, 5 aa, Plasmodium falciparum
KEEKK

SEQ ID NO: 3318454 - protein, 13 aa, Plasmodium falciparum
KEEKKADNKLGVD

SEQ ID NO: 3318455 - protein, 12 aa, Plasmodium falciparum
KEEKKENKKEIE

SEQ ID NO: 3318456 - protein, 10 aa, Plasmodium falciparum
KEEKKEYEEC

SEQ ID NO: 3318457 - protein, 11 aa, Plasmodium falciparum
KEEKKKEESED

SEQ ID NO: 3318458 - protein, 8 aa, Plasmodium falciparum
KEEKKMPP

SEQ ID NO: 3318459 - protein, 17 aa, Plasmodium falciparum
KEEKKQNITKEEEQSEM

SEQ ID NO: 3318460 - protein, 14 aa, Plasmodium falciparum
KEEKKRKGNNNHTH

SEQ ID NO: 3318461 - protein, 16 aa, Plasmodium falciparum
KEEKKRKQKTDNKEND

SEQ ID NO: 3318462 - protein, 10 aa, Plasmodium falciparum
KEEKKSQKYT

SEQ ID NO: 3318463 - protein, 9 aa, Plasmodium falciparum
KEEKNDEQT

SEQ ID NO: 3318464 - protein, 8 aa, Plasmodium falciparum
KEEKNEED

SEQ ID NO: 3318465 - protein, 12 aa, Plasmodium falciparum
KEEKNKKGDANV

SEQ ID NO: 3318466 - protein, 15 aa, Plasmodium falciparum
KEEKNKSSYNEKKDF

SEQ ID NO: 3318467 - protein, 6 aa, Plasmodium falciparum
KEEKNN

SEQ ID NO: 3318468 - protein, 9 aa, Plasmodium falciparum
KEEKNNKID

SEQ ID NO: 3318469 - protein, 10 aa, Plasmodium falciparum
KEEKRLEREN

SEQ ID NO: 3318470 - protein, 12 aa, Plasmodium falciparum
KEEKRTKENVED

SEQ ID NO: 3318471 - protein, 24 aa, Plasmodium falciparum
KEEKRTRRNNEKNHIDSTNKENEN

SEQ ID NO: 3318472 - protein, 6 aa, Plasmodium falciparum
KEEKTK

SEQ ID NO: 3318473 - protein, 10 aa, Plasmodium falciparum
KEEKTLNEKI

SEQ ID NO: 3318474 - protein, 10 aa, Plasmodium falciparum
KEEKTNITDV

SEQ ID NO: 3318475 - protein, 45 aa, Plasmodium falciparum
KEEKYKDDIHDEEKYKDDIHNEEKYKNDIHNEENKEGKPSSSFKT

SEQ ID NO: 3318476 - protein, 20 aa, Plasmodium falciparum
KEELDDEKISEYKDTNLTNN

SEQ ID NO: 3318477 - protein, 7 aa, Plasmodium falciparum
KEELEKK

SEQ ID NO: 3318478 - protein, 16 aa, Plasmodium falciparum
KEELEQKKNNLKSKNI

SEQ ID NO: 3318479 - protein, 17 aa, Plasmodium falciparum
KEELEYDKNNNTFKENH

SEQ ID NO: 3318480 - protein, 6 aa, Plasmodium falciparum
KEELNK

SEQ ID NO: 3318481 - protein, 12 aa, Plasmodium falciparum
KEELNKKRNVEE

SEQ ID NO: 3318482 - protein, 29 aa, Plasmodium falciparum
KEELSVKEEDSSEEKRELHEKNSENSSTS

SEQ ID NO: 3318483 - protein, 6 aa, Plasmodium falciparum
KEEMKQ

SEQ ID NO: 3318484 - protein, 5 aa, Plasmodium falciparum
KEEMN

SEQ ID NO: 3318485 - protein, 14 aa, Plasmodium falciparum
KEEMNDKESYDKKY

SEQ ID NO: 3318486 - protein, 4 aa, Plasmodium falciparum
KEEN

SEQ ID NO: 3318487 - protein, 28 aa, Plasmodium falciparum
KEENADKYKLKKDDQKEKVEKKAKTNVL

SEQ ID NO: 3318488 - protein, 8 aa, Plasmodium falciparum
KEENDDLK

SEQ ID NO: 3318489 - protein, 9 aa, Plasmodium falciparum
KEENDNKHE

SEQ ID NO: 3318490 - protein, 20 aa, Plasmodium falciparum
KEENEDKENKENSTHKDPDL

SEQ ID NO: 3318491 - protein, 7 aa, Plasmodium falciparum
KEENEED

SEQ ID NO: 3318492 - protein, 14 aa, Plasmodium falciparum
KEENEHENENSDVG

SEQ ID NO: 3318493 - protein, 13 aa, Plasmodium falciparum
KEENELKENDELY

SEQ ID NO: 3318494 - protein, 10 aa, Plasmodium falciparum
KEENHKRERE

SEQ ID NO: 3318495 - protein, 14 aa, Plasmodium falciparum
KEENIKNKNSVESI

SEQ ID NO: 3318496 - protein, 6 aa, Plasmodium falciparum
KEENIR

SEQ ID NO: 3318497 - protein, 6 aa, Plasmodium falciparum
KEENIS

SEQ ID NO: 3318498 - protein, 6 aa, Plasmodium falciparum
KEENKK

SEQ ID NO: 3318499 - protein, 9 aa, Plasmodium falciparum
KEENKNNKI

SEQ ID NO: 3318500 - protein, 9 aa, Plasmodium falciparum
KEENKNSYV

SEQ ID NO: 3318501 - protein, 7 aa, Plasmodium falciparum
KEENKTI

SEQ ID NO: 3318502 - protein, 7 aa, Plasmodium falciparum
KEENKYQ

SEQ ID NO: 3318503 - protein, 14 aa, Plasmodium falciparum
KEENNCNDDNLPTN

SEQ ID NO: 3318504 - protein, 11 aa, Plasmodium falciparum
KEENNKKKDHY

SEQ ID NO: 3318505 - protein, 8 aa, Plasmodium falciparum
KEENNLNK

SEQ ID NO: 3318506 - protein, 14 aa, Plasmodium falciparum
KEENNNELENKKGE

SEQ ID NO: 3318507 - protein, 9 aa, Plasmodium falciparum
KEENNNNDD

SEQ ID NO: 3318508 - protein, 6 aa, Plasmodium falciparum
KEENPY

SEQ ID NO: 3318509 - protein, 9 aa, Plasmodium falciparum
KEENQENKK

SEQ ID NO: 3318510 - protein, 12 aa, Plasmodium falciparum
KEENQKGVQSIK

SEQ ID NO: 3318511 - protein, 41 aa, Plasmodium falciparum
KEENTSTTKKGKKGNRKINATKNIEKKTPKKNSTVNRSNNK

SEQ ID NO: 3318512 - protein, 10 aa, Plasmodium falciparum
KEENTTKNDI

SEQ ID NO: 3318513 - protein, 5 aa, Plasmodium falciparum
KEENY

SEQ ID NO: 3318514 - protein, 17 aa, Plasmodium falciparum
KEENYKNKKFKLPRTSK

SEQ ID NO: 3318515 - protein, 24 aa, Plasmodium falciparum
KEEPGEKSLSSSTEGRSDFDQEQT

SEQ ID NO: 3318516 - protein, 18 aa, Plasmodium falciparum
KEEPNFSSKKRKKCGSLK

SEQ ID NO: 3318517 - protein, 5 aa, Plasmodium falciparum
KEEPV

SEQ ID NO: 3318518 - protein, 6 aa, Plasmodium falciparum
KEEQCN

SEQ ID NO: 3318519 - protein, 23 aa, Plasmodium falciparum
KEEQEEEQEGGKKKKNEEQNSKI

SEQ ID NO: 3318520 - protein, 10 aa, Plasmodium falciparum
KEEQEKEMKK

SEQ ID NO: 3318521 - protein, 6 aa, Plasmodium falciparum
KEEQIK

SEQ ID NO: 3318522 - protein, 7 aa, Plasmodium falciparum
KEEQKNC

SEQ ID NO: 3318523 - protein, 9 aa, Plasmodium falciparum
KEEQNGKKY

SEQ ID NO: 3318524 - protein, 9 aa, Plasmodium falciparum
KEEQTKENN

SEQ ID NO: 3318525 - protein, 6 aa, Plasmodium falciparum
KEEQVG

SEQ ID NO: 3318526 - protein, 25 aa, Plasmodium falciparum
KEERENTEKREKEEEEEKKQNALKK

SEQ ID NO: 3318527 - protein, 14 aa, Plasmodium falciparum
KEERETKDEKEKNI

SEQ ID NO: 3318528 - protein, 11 aa, Plasmodium falciparum
KEERQKKYSFN

SEQ ID NO: 3318529 - protein, 4 aa, Plasmodium falciparum
KEES

SEQ ID NO: 3318530 - protein, 18 aa, Plasmodium falciparum
KEESIETKTKKDVGTESV

SEQ ID NO: 3318531 - protein, 44 aa, Plasmodium falciparum
KEESKEAKTEGTNSNNIQSNENNTKPGNNKNSKKNKNKKNALNN

SEQ ID NO: 3318532 - protein, 6 aa, Plasmodium falciparum
KEESLS

SEQ ID NO: 3318533 - protein, 7 aa, Plasmodium falciparum
KEESTYS

SEQ ID NO: 3318534 - protein, 5 aa, Plasmodium falciparum
KEETI

SEQ ID NO: 3318535 - protein, 10 aa, Plasmodium falciparum
KEETKSNNID

SEQ ID NO: 3318536 - protein, 7 aa, Plasmodium falciparum
KEETLNS

SEQ ID NO: 3318537 - protein, 37 aa, Plasmodium falciparum
KEETNDDEANKENDQTYDNVTKSYKSSSNEKEDIVDN

SEQ ID NO: 3318538 - protein, 6 aa, Plasmodium falciparum
KEETNE

SEQ ID NO: 3318539 - protein, 13 aa, Plasmodium falciparum
KEETNKNKHKNDD

SEQ ID NO: 3318540 - protein, 11 aa, Plasmodium falciparum
KEETSDSNNKD

SEQ ID NO: 3318541 - protein, 5 aa, Plasmodium falciparum
KEETY

SEQ ID NO: 3318542 - protein, 9 aa, Plasmodium falciparum
KEEVENKSS

SEQ ID NO: 3318543 - protein, 7 aa, Plasmodium falciparum
KEEVESK

SEQ ID NO: 3318544 - protein, 14 aa, Plasmodium falciparum
KEEVGESKNNENNY

SEQ ID NO: 3318545 - protein, 9 aa, Plasmodium falciparum
KEEWDNNKG

SEQ ID NO: 3318546 - protein, 20 aa, Plasmodium falciparum
KEEWNDNTNEDWKNPIAAEE

SEQ ID NO: 3318547 - protein, 12 aa, Plasmodium falciparum
KEEWSSVKQDNK

SEQ ID NO: 3318548 - protein, 8 aa, Plasmodium falciparum
KEEYDNNT

SEQ ID NO: 3318549 - protein, 7 aa, Plasmodium falciparum
KEEYEDK

SEQ ID NO: 3318550 - protein, 6 aa, Plasmodium falciparum
KEEYEN

SEQ ID NO: 3318551 - protein, 67 aa, Plasmodium falciparum
KEEYKNEEISSSHESEKKYERKYNYEKEHKYKDKDKNKDVLTSGDIKKNSFKEEFKENSSKRKSYSV

SEQ ID NO: 3318552 - protein, 15 aa, Plasmodium falciparum
KEEYKNNKDKQKKIQ

SEQ ID NO: 3318553 - protein, 5 aa, Plasmodium falciparum
KEEYL

SEQ ID NO: 3318554 - protein, 8 aa, Plasmodium falciparum
KEEYNNTD

SEQ ID NO: 3318555 - protein, 9 aa, Plasmodium falciparum
KEEYSEENE

SEQ ID NO: 3318556 - protein, 8 aa, Plasmodium falciparum
KEEYSNKN

SEQ ID NO: 3318557 - protein, 4 aa, Plasmodium falciparum
KEFE

SEQ ID NO: 3318558 - protein, 12 aa, Plasmodium falciparum
KEFEKSSKENAI

SEQ ID NO: 3318559 - protein, 5 aa, Plasmodium falciparum
KEFKN

SEQ ID NO: 3318560 - protein, 6 aa, Plasmodium falciparum
KEFNDN

SEQ ID NO: 3318561 - protein, 14 aa, Plasmodium falciparum
KEFSTSKKKKKKNL

SEQ ID NO: 3318562 - protein, 5 aa, Plasmodium falciparum
KEFTS

SEQ ID NO: 3318563 - protein, 5 aa, Plasmodium falciparum
KEGAN

SEQ ID NO: 3318564 - protein, 5 aa, Plasmodium falciparum
KEGAS

SEQ ID NO: 3318565 - protein, 11 aa, Plasmodium falciparum
KEGEAKKRNNY

SEQ ID NO: 3318566 - protein, 19 aa, Plasmodium falciparum
KEGEKINKKVKKEVKKNPQ

SEQ ID NO: 3318567 - protein, 11 aa, Plasmodium falciparum
KEGETHKKDEL

SEQ ID NO: 3318568 - protein, 7 aa, Plasmodium falciparum
KEGGSKY

SEQ ID NO: 3318569 - protein, 4 aa, Plasmodium falciparum
KEGH

SEQ ID NO: 3318570 - protein, 8 aa, Plasmodium falciparum
KEGITETN

SEQ ID NO: 3318571 - protein, 10 aa, Plasmodium falciparum
KEGKDDSQEL

SEQ ID NO: 3318572 - protein, 12 aa, Plasmodium falciparum
KEGKDQKHAPTI

SEQ ID NO: 3318573 - protein, 7 aa, Plasmodium falciparum
KEGKEKI

SEQ ID NO: 3318574 - protein, 6 aa, Plasmodium falciparum
KEGKEY

SEQ ID NO: 3318575 - protein, 12 aa, Plasmodium falciparum
KEGKGKPGRKKK

SEQ ID NO: 3318576 - protein, 7 aa, Plasmodium falciparum
KEGKIGE

SEQ ID NO: 3318577 - protein, 29 aa, Plasmodium falciparum
KEGKKNSSNMANNNHYNNEKNSNNNYSNN

SEQ ID NO: 3318578 - protein, 11 aa, Plasmodium falciparum
KEGKKTDFSPY

SEQ ID NO: 3318579 - protein, 5 aa, Plasmodium falciparum
KEGKL

SEQ ID NO: 3318580 - protein, 16 aa, Plasmodium falciparum
KEGKNKKKQKKISNYK

SEQ ID NO: 3318581 - protein, 8 aa, Plasmodium falciparum
KEGKNNYS

SEQ ID NO: 3318582 - protein, 5 aa, Plasmodium falciparum
KEGKV

SEQ ID NO: 3318583 - protein, 6 aa, Plasmodium falciparum
KEGLEN

SEQ ID NO: 3318584 - protein, 7 aa, Plasmodium falciparum
KEGLENI

SEQ ID NO: 3318585 - protein, 5 aa, Plasmodium falciparum
KEGMS

SEQ ID NO: 3318586 - protein, 4 aa, Plasmodium falciparum
KEGN

SEQ ID NO: 3318587 - protein, 13 aa, Plasmodium falciparum
KEGNAKNSNKKNN

SEQ ID NO: 3318588 - protein, 11 aa, Plasmodium falciparum
KEGNKKQEKLN

SEQ ID NO: 3318589 - protein, 16 aa, Plasmodium falciparum
KEGNNNSNVGKNNLHG

SEQ ID NO: 3318590 - protein, 24 aa, Plasmodium falciparum
KEGNTNDIDTSRNNKSCENNSNNI

SEQ ID NO: 3318591 - protein, 13 aa, Plasmodium falciparum
KEGNYDKNKKHNK

SEQ ID NO: 3318592 - protein, 5 aa, Plasmodium falciparum
KEGPL

SEQ ID NO: 3318593 - protein, 4 aa, Plasmodium falciparum
KEGQ

SEQ ID NO: 3318594 - protein, 26 aa, Plasmodium falciparum
KEGQEEQEKKNKRYDNSDDKKGSEYE

SEQ ID NO: 3318595 - protein, 7 aa, Plasmodium falciparum
KEGRIRK

SEQ ID NO: 3318596 - protein, 8 aa, Plasmodium falciparum
KEGRSKGY

SEQ ID NO: 3318597 - protein, 13 aa, Plasmodium falciparum
KEGTKSPTASPRQ

SEQ ID NO: 3318598 - protein, 11 aa, Plasmodium falciparum
KEGTNSTNCNS

SEQ ID NO: 3318599 - protein, 15 aa, Plasmodium falciparum
KEGVSEKGIPHQENG

SEQ ID NO: 3318600 - protein, 30 aa, Plasmodium falciparum
KEGYNNKKKDNNKKKDNNNNNDDDDEKLNN

SEQ ID NO: 3318601 - protein, 6 aa, Plasmodium falciparum
KEGYTQ

SEQ ID NO: 3318602 - protein, 6 aa, Plasmodium falciparum
KEHDEK

SEQ ID NO: 3318603 - protein, 7 aa, Plasmodium falciparum
KEHEIKE

SEQ ID NO: 3318604 - protein, 6 aa, Plasmodium falciparum
KEHEKR

SEQ ID NO: 3318605 - protein, 8 aa, Plasmodium falciparum
KEHFSSSA

SEQ ID NO: 3318606 - protein, 7 aa, Plasmodium falciparum
KEHGTEL

SEQ ID NO: 3318607 - protein, 15 aa, Plasmodium falciparum
KEHHGYGEEEEGYDE

SEQ ID NO: 3318608 - protein, 20 aa, Plasmodium falciparum
KEHHHSNKHRHSKEHRHSKE

SEQ ID NO: 3318609 - protein, 4 aa, Plasmodium falciparum
KEHI

SEQ ID NO: 3318610 - protein, 13 aa, Plasmodium falciparum
KEHIKKNNSLDKS

SEQ ID NO: 3318611 - protein, 5 aa, Plasmodium falciparum
KEHIN

SEQ ID NO: 3318612 - protein, 7 aa, Plasmodium falciparum
KEHIPDR

SEQ ID NO: 3318613 - protein, 17 aa, Plasmodium falciparum
KEHKKKKKNSNIKSNVK

SEQ ID NO: 3318614 - protein, 12 aa, Plasmodium falciparum
KEHKSKIQNDNY

SEQ ID NO: 3318615 - protein, 13 aa, Plasmodium falciparum
KEHNEEKSSMTQN

SEQ ID NO: 3318616 - protein, 8 aa, Plasmodium falciparum
KEHNKKIY

SEQ ID NO: 3318617 - protein, 8 aa, Plasmodium falciparum
KEHNNTKD

SEQ ID NO: 3318618 - protein, 5 aa, Plasmodium falciparum
KEHNQ

SEQ ID NO: 3318619 - protein, 14 aa, Plasmodium falciparum
KEHNQISNNDYKKM

SEQ ID NO: 3318620 - protein, 11 aa, Plasmodium falciparum
KEHNQKEDKEN

SEQ ID NO: 3318621 - protein, 14 aa, Plasmodium falciparum
KEHNSNEKNYINTK

SEQ ID NO: 3318622 - protein, 7 aa, Plasmodium falciparum
KEHPSNK

SEQ ID NO: 3318623 - protein, 13 aa, Plasmodium falciparum
KEHSNDESIEESE

SEQ ID NO: 3318624 - protein, 6 aa, Plasmodium falciparum
KEHYES

SEQ ID NO: 3318625 - protein, 7 aa, Plasmodium falciparum
KEIAPKK

SEQ ID NO: 3318626 - protein, 6 aa, Plasmodium falciparum
KEIDKK

SEQ ID NO: 3318627 - protein, 5 aa, Plasmodium falciparum
KEIDT

SEQ ID NO: 3318628 - protein, 36 aa, Plasmodium falciparum
KEIEEDDDEEDDYEDDDLEEEEEDDKDDEEYYEEYD

SEQ ID NO: 3318629 - protein, 8 aa, Plasmodium falciparum
KEIEEDSK

SEQ ID NO: 3318630 - protein, 5 aa, Plasmodium falciparum
KEIEK

SEQ ID NO: 3318631 - protein, 8 aa, Plasmodium falciparum
KEIEKYKG

SEQ ID NO: 3318632 - protein, 6 aa, Plasmodium falciparum
KEIENN

SEQ ID NO: 3318633 - protein, 32 aa, Plasmodium falciparum
KEIEQKDKGDDKKTEKKDKDKKEKRKSNNDKY

SEQ ID NO: 3318634 - protein, 5 aa, Plasmodium falciparum
KEIGN

SEQ ID NO: 3318635 - protein, 6 aa, Plasmodium falciparum
KEIGSD

SEQ ID NO: 3318636 - protein, 4 aa, Plasmodium falciparum
KEII

SEQ ID NO: 3318637 - protein, 4 aa, Plasmodium falciparum
KEIK

SEQ ID NO: 3318638 - protein, 38 aa, Plasmodium falciparum
KEIKEEDQNGSNSKENDKKKKKNKKKKINNNDKKNELS

SEQ ID NO: 3318639 - protein, 8 aa, Plasmodium falciparum
KEIKEQND

SEQ ID NO: 3318640 - protein, 13 aa, Plasmodium falciparum
KEIKKEKKTGIKD

SEQ ID NO: 3318641 - protein, 21 aa, Plasmodium falciparum
KEIKKKTNKKADNKKGKNVNN

SEQ ID NO: 3318642 - protein, 5 aa, Plasmodium falciparum
KEIKN

SEQ ID NO: 3318643 - protein, 20 aa, Plasmodium falciparum
KEIKNSGVGSKRKKDKRGKK

SEQ ID NO: 3318644 - protein, 4 aa, Plasmodium falciparum
KEIM

SEQ ID NO: 3318645 - protein, 4 aa, Plasmodium falciparum
KEIN

SEQ ID NO: 3318646 - protein, 10 aa, Plasmodium falciparum
KEINANDDSL

SEQ ID NO: 3318647 - protein, 8 aa, Plasmodium falciparum
KEINEEHN

SEQ ID NO: 3318648 - protein, 9 aa, Plasmodium falciparum
KEINEINEK

SEQ ID NO: 3318649 - protein, 12 aa, Plasmodium falciparum
KEINENKEINEI

SEQ ID NO: 3318650 - protein, 13 aa, Plasmodium falciparum
KEINKGKISNNYK

SEQ ID NO: 3318651 - protein, 38 aa, Plasmodium falciparum
KEINKKNKKYKEGKKEKKNKKNKNNKKNKKNMKNIKNK

SEQ ID NO: 3318652 - protein, 6 aa, Plasmodium falciparum
KEINKP

SEQ ID NO: 3318653 - protein, 6 aa, Plasmodium falciparum
KEINNK

SEQ ID NO: 3318654 - protein, 9 aa, Plasmodium falciparum
KEIPKKGEC

SEQ ID NO: 3318655 - protein, 29 aa, Plasmodium falciparum
KEIQQNVDKENYQNGHCNNNTNNMESADH

SEQ ID NO: 3318656 - protein, 7 aa, Plasmodium falciparum
KEIQTDN

SEQ ID NO: 3318657 - protein, 7 aa, Plasmodium falciparum
KEISAQD

SEQ ID NO: 3318658 - protein, 64 aa, Plasmodium falciparum
KEISDNKEISDNKEISDNKEISDNKKISDNKEINDNKEINDNEKINDNKKINDNKDNNEKIEEK

SEQ ID NO: 3318659 - protein, 6 aa, Plasmodium falciparum
KEISLK

SEQ ID NO: 3318660 - protein, 23 aa, Plasmodium falciparum
KEISNNFDDSKKNVKGITNGDNK

SEQ ID NO: 3318661 - protein, 6 aa, Plasmodium falciparum
KEISTE

SEQ ID NO: 3318662 - protein, 13 aa, Plasmodium falciparum
KEISVKKNTKKEL

SEQ ID NO: 3318663 - protein, 6 aa, Plasmodium falciparum
KEITEE

SEQ ID NO: 3318664 - protein, 4 aa, Plasmodium falciparum
KEIV

SEQ ID NO: 3318665 - protein, 10 aa, Plasmodium falciparum
KEKADEELNQ

SEQ ID NO: 3318666 - protein, 8 aa, Plasmodium falciparum
KEKADKKN

SEQ ID NO: 3318667 - protein, 6 aa, Plasmodium falciparum
KEKADS

SEQ ID NO: 3318668 - protein, 14 aa, Plasmodium falciparum
KEKAENEKKTKNTH

SEQ ID NO: 3318669 - protein, 21 aa, Plasmodium falciparum
KEKAPKKTSINNEDITKNVNN

SEQ ID NO: 3318670 - protein, 4 aa, Plasmodium falciparum
KEKD

SEQ ID NO: 3318671 - protein, 7 aa, Plasmodium falciparum
KEKDDIE

SEQ ID NO: 3318672 - protein, 11 aa, Plasmodium falciparum
KEKDESSQNDT

SEQ ID NO: 3318673 - protein, 5 aa, Plasmodium falciparum
KEKDI

SEQ ID NO: 3318674 - protein, 8 aa, Plasmodium falciparum
KEKDKSLN

SEQ ID NO: 3318675 - protein, 8 aa, Plasmodium falciparum
KEKDLEEQ

SEQ ID NO: 3318676 - protein, 6 aa, Plasmodium falciparum
KEKDNL

SEQ ID NO: 3318677 - protein, 13 aa, Plasmodium falciparum
KEKDNNYESYDND

SEQ ID NO: 3318678 - protein, 11 aa, Plasmodium falciparum
KEKDQKNAQLD

SEQ ID NO: 3318679 - protein, 10 aa, Plasmodium falciparum
KEKDSSSPNN

SEQ ID NO: 3318680 - protein, 4 aa, Plasmodium falciparum
KEKE

SEQ ID NO: 3318681 - protein, 15 aa, Plasmodium falciparum
KEKECQNFDDKGGEF

SEQ ID NO: 3318682 - protein, 72 aa, Plasmodium falciparum
KEKEDDELEENAENEVSNDKHNMNNDEQNNSGGVNKMRSEQDHINDDDNNINSYDDESDVNFNNKKNDYKGK

SEQ ID NO: 3318683 - protein, 9 aa, Plasmodium falciparum
KEKEDKIKN

SEQ ID NO: 3318684 - protein, 17 aa, Plasmodium falciparum
KEKEEEKKNVQNGQNEY

SEQ ID NO: 3318685 - protein, 13 aa, Plasmodium falciparum
KEKEEELEKEKKR

SEQ ID NO: 3318686 - protein, 8 aa, Plasmodium falciparum
KEKEEKKK

SEQ ID NO: 3318687 - protein, 10 aa, Plasmodium falciparum
KEKEEKNHNI

SEQ ID NO: 3318688 - protein, 25 aa, Plasmodium falciparum
KEKEENDSEERERQREKYKNEKEHE

SEQ ID NO: 3318689 - protein, 8 aa, Plasmodium falciparum
KEKEENGK

SEQ ID NO: 3318690 - protein, 12 aa, Plasmodium falciparum
KEKEEQKSLKQK

SEQ ID NO: 3318691 - protein, 8 aa, Plasmodium falciparum
KEKEERLN

SEQ ID NO: 3318692 - protein, 7 aa, Plasmodium falciparum
KEKEERN

SEQ ID NO: 3318693 - protein, 19 aa, Plasmodium falciparum
KEKEETKDNEEEEKNGKIT

SEQ ID NO: 3318694 - protein, 7 aa, Plasmodium falciparum
KEKEEYD

SEQ ID NO: 3318695 - protein, 7 aa, Plasmodium falciparum
KEKEEYN

SEQ ID NO: 3318696 - protein, 5 aa, Plasmodium falciparum
KEKEH

SEQ ID NO: 3318697 - protein, 5 aa, Plasmodium falciparum
KEKEI

SEQ ID NO: 3318698 - protein, 6 aa, Plasmodium falciparum
KEKEID

SEQ ID NO: 3318699 - protein, 7 aa, Plasmodium falciparum
KEKEINE

SEQ ID NO: 3318700 - protein, 15 aa, Plasmodium falciparum
KEKEINNNPNLKNHK

SEQ ID NO: 3318701 - protein, 5 aa, Plasmodium falciparum
KEKEK

SEQ ID NO: 3318702 - protein, 38 aa, Plasmodium falciparum
KEKEKEKDNNIKHNTKHNSKHKNNNNNNNNNKEKPNDD

SEQ ID NO: 3318703 - protein, 49 aa, Plasmodium falciparum
KEKEKEKEKEKEKEKEKEKEKEKEKEKEKEKEKEKEKEKDKEKEKEKEE

SEQ ID NO: 3318704 - protein, 55 aa, Plasmodium falciparum
KEKEKEKEKHTQKHTQKHTQKNTQKQTQKGSEKETQKGIEKDTEKQTKNKSCNHS

SEQ ID NO: 3318705 - protein, 30 aa, Plasmodium falciparum
KEKEKEKEKSNFRNPENNKYSNKNNTSNTK

SEQ ID NO: 3318706 - protein, 8 aa, Plasmodium falciparum
KEKEKHDI

SEQ ID NO: 3318707 - protein, 6 aa, Plasmodium falciparum
KEKEKI

SEQ ID NO: 3318708 - protein, 11 aa, Plasmodium falciparum
KEKEKKKKIPA

SEQ ID NO: 3318709 - protein, 10 aa, Plasmodium falciparum
KEKEKMENTC

SEQ ID NO: 3318710 - protein, 15 aa, Plasmodium falciparum
KEKEKNNDTSSDDFE

SEQ ID NO: 3318711 - protein, 8 aa, Plasmodium falciparum
KEKEKTKN

SEQ ID NO: 3318712 - protein, 6 aa, Plasmodium falciparum
KEKEKY

SEQ ID NO: 3318713 - protein, 16 aa, Plasmodium falciparum
KEKEKYSHENKKENIL

SEQ ID NO: 3318714 - protein, 6 aa, Plasmodium falciparum
KEKELE

SEQ ID NO: 3318715 - protein, 6 aa, Plasmodium falciparum
KEKELK

SEQ ID NO: 3318716 - protein, 6 aa, Plasmodium falciparum
KEKEND

SEQ ID NO: 3318717 - protein, 9 aa, Plasmodium falciparum
KEKENEEYE

SEQ ID NO: 3318718 - protein, 8 aa, Plasmodium falciparum
KEKENISN

SEQ ID NO: 3318719 - protein, 7 aa, Plasmodium falciparum
KEKENTK

SEQ ID NO: 3318720 - protein, 7 aa, Plasmodium falciparum
KEKENYQ

SEQ ID NO: 3318721 - protein, 7 aa, Plasmodium falciparum
KEKENYS

SEQ ID NO: 3318722 - protein, 6 aa, Plasmodium falciparum
KEKERA

SEQ ID NO: 3318723 - protein, 30 aa, Plasmodium falciparum
KEKERKNKQNEKMAQQNVSKSNENAKQLEE

SEQ ID NO: 3318724 - protein, 8 aa, Plasmodium falciparum
KEKERYKE

SEQ ID NO: 3318725 - protein, 10 aa, Plasmodium falciparum
KEKESDKQEI

SEQ ID NO: 3318726 - protein, 8 aa, Plasmodium falciparum
KEKESISN

SEQ ID NO: 3318727 - protein, 12 aa, Plasmodium falciparum
KEKESKKKNGKK

SEQ ID NO: 3318728 - protein, 9 aa, Plasmodium falciparum
KEKESLKNE

SEQ ID NO: 3318729 - protein, 28 aa, Plasmodium falciparum
KEKETDDEKGTHEENEKENIKREDDHNT

SEQ ID NO: 3318730 - protein, 7 aa, Plasmodium falciparum
KEKETFK

SEQ ID NO: 3318731 - protein, 6 aa, Plasmodium falciparum
KEKEVN

SEQ ID NO: 3318732 - protein, 8 aa, Plasmodium falciparum
KEKEYNKR

SEQ ID NO: 3318733 - protein, 41 aa, Plasmodium falciparum
KEKEYTDIQRDKRKHKRSLSQKSDSYKKRPFNKRKTSIERS

SEQ ID NO: 3318734 - protein, 24 aa, Plasmodium falciparum
KEKFTTNKKLSNESIDKTESSNIK

SEQ ID NO: 3318735 - protein, 58 aa, Plasmodium falciparum
KEKGKKKEHTKYEEEQKQSKIKKNNIKQNNMKQNNIKQNNMKQNNIKQNDYVKEEPSI

SEQ ID NO: 3318736 - protein, 12 aa, Plasmodium falciparum
KEKGKKKKKRSS

SEQ ID NO: 3318737 - protein, 5 aa, Plasmodium falciparum
KEKGN

SEQ ID NO: 3318738 - protein, 7 aa, Plasmodium falciparum
KEKGTKT

SEQ ID NO: 3318739 - protein, 8 aa, Plasmodium falciparum
KEKGTNMQ

SEQ ID NO: 3318740 - protein, 13 aa, Plasmodium falciparum
KEKIDDENINDKD

SEQ ID NO: 3318741 - protein, 6 aa, Plasmodium falciparum
KEKIES

SEQ ID NO: 3318742 - protein, 13 aa, Plasmodium falciparum
KEKIKKKATTSKL

SEQ ID NO: 3318743 - protein, 9 aa, Plasmodium falciparum
KEKINETTT

SEQ ID NO: 3318744 - protein, 14 aa, Plasmodium falciparum
KEKIQKKKNETDDE

SEQ ID NO: 3318745 - protein, 8 aa, Plasmodium falciparum
KEKISNLN

SEQ ID NO: 3318746 - protein, 9 aa, Plasmodium falciparum
KEKITENSI

SEQ ID NO: 3318747 - protein, 12 aa, Plasmodium falciparum
KEKITNKIKERK

SEQ ID NO: 3318748 - protein, 9 aa, Plasmodium falciparum
KEKKAKKNI

SEQ ID NO: 3318749 - protein, 6 aa, Plasmodium falciparum
KEKKAT

SEQ ID NO: 3318750 - protein, 9 aa, Plasmodium falciparum
KEKKDENKI

SEQ ID NO: 3318751 - protein, 8 aa, Plasmodium falciparum
KEKKDRLN

SEQ ID NO: 3318752 - protein, 9 aa, Plasmodium falciparum
KEKKEDLEN

SEQ ID NO: 3318753 - protein, 48 aa, Plasmodium falciparum
KEKKEEEGEDDEENQRDRNKEEDQDEDKDDDKDKDKDKDKEEEEEKKR

SEQ ID NO: 3318754 - protein, 10 aa, Plasmodium falciparum
KEKKEGGGGN

SEQ ID NO: 3318755 - protein, 10 aa, Plasmodium falciparum
KEKKEKENDA

SEQ ID NO: 3318756 - protein, 11 aa, Plasmodium falciparum
KEKKEKKKKQE

SEQ ID NO: 3318757 - protein, 7 aa, Plasmodium falciparum
KEKKELT

SEQ ID NO: 3318758 - protein, 10 aa, Plasmodium falciparum
KEKKENMNNA

SEQ ID NO: 3318759 - protein, 8 aa, Plasmodium falciparum
KEKKETDK

SEQ ID NO: 3318760 - protein, 7 aa, Plasmodium falciparum
KEKKEYE

SEQ ID NO: 3318761 - protein, 17 aa, Plasmodium falciparum
KEKKFASSTKGTSIKSS

SEQ ID NO: 3318762 - protein, 5 aa, Plasmodium falciparum
KEKKI

SEQ ID NO: 3318763 - protein, 17 aa, Plasmodium falciparum
KEKKIEEKRKKQYEEEK

SEQ ID NO: 3318764 - protein, 9 aa, Plasmodium falciparum
KEKKIKPTI

SEQ ID NO: 3318765 - protein, 31 aa, Plasmodium falciparum
KEKKINNNNNNNNNNNNNNKNNMKDKENIPL

SEQ ID NO: 3318766 - protein, 9 aa, Plasmodium falciparum
KEKKITNYE

SEQ ID NO: 3318767 - protein, 5 aa, Plasmodium falciparum
KEKKK

SEQ ID NO: 3318768 - protein, 10 aa, Plasmodium falciparum
KEKKKDISYD

SEQ ID NO: 3318769 - protein, 11 aa, Plasmodium falciparum
KEKKKEKKKNK

SEQ ID NO: 3318770 - protein, 13 aa, Plasmodium falciparum
KEKKKEKKNINKN

SEQ ID NO: 3318771 - protein, 14 aa, Plasmodium falciparum
KEKKKKEVPKNDSN

SEQ ID NO: 3318772 - protein, 7 aa, Plasmodium falciparum
KEKKKKM

SEQ ID NO: 3318773 - protein, 12 aa, Plasmodium falciparum
KEKKKKNDDDYH

SEQ ID NO: 3318774 - protein, 62 aa, Plasmodium falciparum
KEKKKKNNKKKDRKKNVSSDSSQSDNKTVKDKKEKKKKEREQFKQKENHDNLNSASNEHVSY

SEQ ID NO: 3318775 - protein, 9 aa, Plasmodium falciparum
KEKKKMKKK

SEQ ID NO: 3318776 - protein, 9 aa, Plasmodium falciparum
KEKKKNARD

SEQ ID NO: 3318777 - protein, 10 aa, Plasmodium falciparum
KEKKKNNDII

SEQ ID NO: 3318778 - protein, 56 aa, Plasmodium falciparum
KEKKKNTKDKNTKDKNTKDKNTKDKNTKDKNTKDKNTKDKNTKDKNTNITKKNNSY

SEQ ID NO: 3318779 - protein, 17 aa, Plasmodium falciparum
KEKKKQEKSTEDPNSQH

SEQ ID NO: 3318780 - protein, 9 aa, Plasmodium falciparum
KEKKKTRYN

SEQ ID NO: 3318781 - protein, 7 aa, Plasmodium falciparum
KEKKKYA

SEQ ID NO: 3318782 - protein, 20 aa, Plasmodium falciparum
KEKKLQKEKLNKENQKREEI

SEQ ID NO: 3318783 - protein, 6 aa, Plasmodium falciparum
KEKKNE

SEQ ID NO: 3318784 - protein, 9 aa, Plasmodium falciparum
KEKKNEHKF

SEQ ID NO: 3318785 - protein, 20 aa, Plasmodium falciparum
KEKKNENDQDKSLKKENEKK

SEQ ID NO: 3318786 - protein, 32 aa, Plasmodium falciparum
KEKKNNNKVEINNSNKKKNETNTYKSNNVHKN

SEQ ID NO: 3318787 - protein, 10 aa, Plasmodium falciparum
KEKKNTLHTS

SEQ ID NO: 3318788 - protein, 16 aa, Plasmodium falciparum
KEKKNYGTNKLNTKDN

SEQ ID NO: 3318789 - protein, 10 aa, Plasmodium falciparum
KEKKQEKKTC

SEQ ID NO: 3318790 - protein, 5 aa, Plasmodium falciparum
KEKKS

SEQ ID NO: 3318791 - protein, 10 aa, Plasmodium falciparum
KEKKSDEQIT

SEQ ID NO: 3318792 - protein, 28 aa, Plasmodium falciparum
KEKKSDKLKDSNIDTDADGDYNASKRQY

SEQ ID NO: 3318793 - protein, 11 aa, Plasmodium falciparum
KEKKSFNEEDK

SEQ ID NO: 3318794 - protein, 6 aa, Plasmodium falciparum
KEKKSL

SEQ ID NO: 3318795 - protein, 6 aa, Plasmodium falciparum
KEKKSP

SEQ ID NO: 3318796 - protein, 9 aa, Plasmodium falciparum
KEKKSVNTI

SEQ ID NO: 3318797 - protein, 18 aa, Plasmodium falciparum
KEKKTLQKERKRNIKPTK

SEQ ID NO: 3318798 - protein, 7 aa, Plasmodium falciparum
KEKKTYE

SEQ ID NO: 3318799 - protein, 15 aa, Plasmodium falciparum
KEKKVNDVSSSHINN

SEQ ID NO: 3318800 - protein, 20 aa, Plasmodium falciparum
KEKLDKKKKKNKSVFPPDQL

SEQ ID NO: 3318801 - protein, 5 aa, Plasmodium falciparum
KEKLK

SEQ ID NO: 3318802 - protein, 7 aa, Plasmodium falciparum
KEKLRNN

SEQ ID NO: 3318803 - protein, 8 aa, Plasmodium falciparum
KEKLSKKG

SEQ ID NO: 3318804 - protein, 9 aa, Plasmodium falciparum
KEKMENEEN

SEQ ID NO: 3318805 - protein, 9 aa, Plasmodium falciparum
KEKMERNSK

SEQ ID NO: 3318806 - protein, 6 aa, Plasmodium falciparum
KEKMGG

SEQ ID NO: 3318807 - protein, 6 aa, Plasmodium falciparum
KEKMKE

SEQ ID NO: 3318808 - protein, 22 aa, Plasmodium falciparum
KEKMKNTDNIKKHENDKYNIKS

SEQ ID NO: 3318809 - protein, 4 aa, Plasmodium falciparum
KEKN

SEQ ID NO: 3318810 - protein, 8 aa, Plasmodium falciparum
KEKNEEND

SEQ ID NO: 3318811 - protein, 13 aa, Plasmodium falciparum
KEKNEGANRTNYY

SEQ ID NO: 3318812 - protein, 10 aa, Plasmodium falciparum
KEKNEQDVST

SEQ ID NO: 3318813 - protein, 9 aa, Plasmodium falciparum
KEKNETINS

SEQ ID NO: 3318814 - protein, 6 aa, Plasmodium falciparum
KEKNFN

SEQ ID NO: 3318815 - protein, 10 aa, Plasmodium falciparum
KEKNGGDKTY

SEQ ID NO: 3318816 - protein, 13 aa, Plasmodium falciparum
KEKNGSNDYTMEN

SEQ ID NO: 3318817 - protein, 66 aa, Plasmodium falciparum
KEKNIDDKENFGYKKDNNGENDKSDENDKSDENDKSDENDKSDENDKNYKNNENNNNDNNVEKDSF

SEQ ID NO: 3318818 - protein, 14 aa, Plasmodium falciparum
KEKNIKESQNKNRI

SEQ ID NO: 3318819 - protein, 6 aa, Plasmodium falciparum
KEKNIN

SEQ ID NO: 3318820 - protein, 60 aa, Plasmodium falciparum
KEKNKEKNLQNGINGTNEKGYISQTDDENCSDNKYGENQDYGSNDSDSKDGEDIDKDDSI

SEQ ID NO: 3318821 - protein, 19 aa, Plasmodium falciparum
KEKNKKQRKDHRIRNNEKK

SEQ ID NO: 3318822 - protein, 8 aa, Plasmodium falciparum
KEKNKNKA

SEQ ID NO: 3318823 - protein, 10 aa, Plasmodium falciparum
KEKNKNNNSI

SEQ ID NO: 3318824 - protein, 9 aa, Plasmodium falciparum
KEKNKTLEV

SEQ ID NO: 3318825 - protein, 20 aa, Plasmodium falciparum
KEKNKVKEKERKHEDEEYYN

SEQ ID NO: 3318826 - protein, 9 aa, Plasmodium falciparum
KEKNLNISS

SEQ ID NO: 3318827 - protein, 5 aa, Plasmodium falciparum
KEKNN

SEQ ID NO: 3318828 - protein, 8 aa, Plasmodium falciparum
KEKNNDID

SEQ ID NO: 3318829 - protein, 10 aa, Plasmodium falciparum
KEKNNEEKRN

SEQ ID NO: 3318830 - protein, 7 aa, Plasmodium falciparum
KEKNNEN

SEQ ID NO: 3318831 - protein, 8 aa, Plasmodium falciparum
KEKNNENL

SEQ ID NO: 3318832 - protein, 9 aa, Plasmodium falciparum
KEKNNGKLN

SEQ ID NO: 3318833 - protein, 20 aa, Plasmodium falciparum
KEKNPKSPKRIKTESSDDSI

SEQ ID NO: 3318834 - protein, 7 aa, Plasmodium falciparum
KEKNQWQ

SEQ ID NO: 3318835 - protein, 7 aa, Plasmodium falciparum
KEKNRDY

SEQ ID NO: 3318836 - protein, 7 aa, Plasmodium falciparum
KEKNRNE

SEQ ID NO: 3318837 - protein, 26 aa, Plasmodium falciparum
KEKNSLNKKGTSNNTTNSFSKGNNIK

SEQ ID NO: 3318838 - protein, 10 aa, Plasmodium falciparum
KEKNSSEKAV

SEQ ID NO: 3318839 - protein, 21 aa, Plasmodium falciparum
KEKNTEGNEETDNSNLKRKNE

SEQ ID NO: 3318840 - protein, 9 aa, Plasmodium falciparum
KEKNTLKSS

SEQ ID NO: 3318841 - protein, 5 aa, Plasmodium falciparum
KEKNV

SEQ ID NO: 3318842 - protein, 9 aa, Plasmodium falciparum
KEKNVDDKR

SEQ ID NO: 3318843 - protein, 14 aa, Plasmodium falciparum
KEKNVKKEHIKKEP

SEQ ID NO: 3318844 - protein, 6 aa, Plasmodium falciparum
KEKNVS

SEQ ID NO: 3318845 - protein, 5 aa, Plasmodium falciparum
KEKNY

SEQ ID NO: 3318846 - protein, 9 aa, Plasmodium falciparum
KEKNYKNKQ

SEQ ID NO: 3318847 - protein, 40 aa, Plasmodium falciparum
KEKPGDNKDNKYTHDQKKETIHKEEDDEDEKHSGSNKSTK

SEQ ID NO: 3318848 - protein, 14 aa, Plasmodium falciparum
KEKPTTKKNKGKSL

SEQ ID NO: 3318849 - protein, 13 aa, Plasmodium falciparum
KEKQKELKENQKK

SEQ ID NO: 3318850 - protein, 16 aa, Plasmodium falciparum
KEKQKTKNKDNNRLSD

SEQ ID NO: 3318851 - protein, 10 aa, Plasmodium falciparum
KEKQKYDEKK

SEQ ID NO: 3318852 - protein, 17 aa, Plasmodium falciparum
KEKQMEKKKKKEKKSIL

SEQ ID NO: 3318853 - protein, 8 aa, Plasmodium falciparum
KEKQNQQN

SEQ ID NO: 3318854 - protein, 6 aa, Plasmodium falciparum
KEKQNS

SEQ ID NO: 3318855 - protein, 7 aa, Plasmodium falciparum
KEKQNVD

SEQ ID NO: 3318856 - protein, 6 aa, Plasmodium falciparum
KEKQST

SEQ ID NO: 3318857 - protein, 4 aa, Plasmodium falciparum
KEKR

SEQ ID NO: 3318858 - protein, 8 aa, Plasmodium falciparum
KEKRDNEI

SEQ ID NO: 3318859 - protein, 5 aa, Plasmodium falciparum
KEKRE

SEQ ID NO: 3318860 - protein, 10 aa, Plasmodium falciparum
KEKRENEDID

SEQ ID NO: 3318861 - protein, 8 aa, Plasmodium falciparum
KEKRGDKI

SEQ ID NO: 3318862 - protein, 7 aa, Plasmodium falciparum
KEKRIKD

SEQ ID NO: 3318863 - protein, 25 aa, Plasmodium falciparum
KEKRKKRKKLNEKVKSEVKTNNIKN

SEQ ID NO: 3318864 - protein, 7 aa, Plasmodium falciparum
KEKRKMK

SEQ ID NO: 3318865 - protein, 9 aa, Plasmodium falciparum
KEKRKRKEI

SEQ ID NO: 3318866 - protein, 17 aa, Plasmodium falciparum
KEKRNDKIKPSGGNERI

SEQ ID NO: 3318867 - protein, 15 aa, Plasmodium falciparum
KEKRNKQNSSEPVKG

SEQ ID NO: 3318868 - protein, 6 aa, Plasmodium falciparum
KEKRNN

SEQ ID NO: 3318869 - protein, 9 aa, Plasmodium falciparum
KEKRSSKIP

SEQ ID NO: 3318870 - protein, 10 aa, Plasmodium falciparum
KEKRSSKTYI

SEQ ID NO: 3318871 - protein, 4 aa, Plasmodium falciparum
KEKS

SEQ ID NO: 3318872 - protein, 9 aa, Plasmodium falciparum
KEKSDMNNI

SEQ ID NO: 3318873 - protein, 11 aa, Plasmodium falciparum
KEKSEGEEEKK

SEQ ID NO: 3318874 - protein, 16 aa, Plasmodium falciparum
KEKSENSNESASQKGI

SEQ ID NO: 3318875 - protein, 6 aa, Plasmodium falciparum
KEKSKI

SEQ ID NO: 3318876 - protein, 21 aa, Plasmodium falciparum
KEKSKKDVHHNKEDDNTDKRE

SEQ ID NO: 3318877 - protein, 50 aa, Plasmodium falciparum
KEKSKNQKIKNNENQHNKKNNIGQNNINNNNNNNNSKNGGRNSKKGGDII

SEQ ID NO: 3318878 - protein, 7 aa, Plasmodium falciparum
KEKSPLN

SEQ ID NO: 3318879 - protein, 53 aa, Plasmodium falciparum
KEKSRNNNTKEDNLKNDSNNNNDNHNDNNNNNNNNDNNNNNDNNNDNSTEYYS

SEQ ID NO: 3318880 - protein, 9 aa, Plasmodium falciparum
KEKSSSEEM

SEQ ID NO: 3318881 - protein, 4 aa, Plasmodium falciparum
KEKT

SEQ ID NO: 3318882 - protein, 9 aa, Plasmodium falciparum
KEKTEIDDK

SEQ ID NO: 3318883 - protein, 8 aa, Plasmodium falciparum
KEKTGESL

SEQ ID NO: 3318884 - protein, 32 aa, Plasmodium falciparum
KEKTIKDKDKNKDEDKNKNKENDDNNKKHIGN

SEQ ID NO: 3318885 - protein, 12 aa, Plasmodium falciparum
KEKTNKHTTSNY

SEQ ID NO: 3318886 - protein, 7 aa, Plasmodium falciparum
KEKTNNR

SEQ ID NO: 3318887 - protein, 17 aa, Plasmodium falciparum
KEKTRTPLGKNRRRGST

SEQ ID NO: 3318888 - protein, 37 aa, Plasmodium falciparum
KEKTTTSQNQLKEKEKTQETKKHDENNKSNNNVVNSS

SEQ ID NO: 3318889 - protein, 66 aa, Plasmodium falciparum
KEKVKSEKAGFNKKNDSSDSDDEYKKSKGRKGTDKKPNNDKKKFDKSNDDKKKKKEKEVHKNNKEF

SEQ ID NO: 3318890 - protein, 4 aa, Plasmodium falciparum
KEKY

SEQ ID NO: 3318891 - protein, 8 aa, Plasmodium falciparum
KEKYDEYD

SEQ ID NO: 3318892 - protein, 14 aa, Plasmodium falciparum
KEKYDRNKEDVEER

SEQ ID NO: 3318893 - protein, 9 aa, Plasmodium falciparum
KEKYETDEN

SEQ ID NO: 3318894 - protein, 24 aa, Plasmodium falciparum
KEKYISKDATSNSFNKNKERDNNV

SEQ ID NO: 3318895 - protein, 7 aa, Plasmodium falciparum
KEKYKKK

SEQ ID NO: 3318896 - protein, 5 aa, Plasmodium falciparum
KEKYN

SEQ ID NO: 3318897 - protein, 7 aa, Plasmodium falciparum
KEKYNYD

SEQ ID NO: 3318898 - protein, 5 aa, Plasmodium falciparum
KEKYS

SEQ ID NO: 3318899 - protein, 6 aa, Plasmodium falciparum
KEKYSS

SEQ ID NO: 3318900 - protein, 9 aa, Plasmodium falciparum
KEKYTQSEK

SEQ ID NO: 3318901 - protein, 9 aa, Plasmodium falciparum
KELDEKENE

SEQ ID NO: 3318902 - protein, 7 aa, Plasmodium falciparum
KELDENN

SEQ ID NO: 3318903 - protein, 6 aa, Plasmodium falciparum
KELDMQ

SEQ ID NO: 3318904 - protein, 16 aa, Plasmodium falciparum
KELDNSSVKENGEHND

SEQ ID NO: 3318905 - protein, 12 aa, Plasmodium falciparum
KELDQSSNSSKA

SEQ ID NO: 3318906 - protein, 26 aa, Plasmodium falciparum
KELDTSNKQISNEYEEKLQNNENINE

SEQ ID NO: 3318907 - protein, 6 aa, Plasmodium falciparum
KELEDE

SEQ ID NO: 3318908 - protein, 5 aa, Plasmodium falciparum
KELEE

SEQ ID NO: 3318909 - protein, 7 aa, Plasmodium falciparum
KELEEEK

SEQ ID NO: 3318910 - protein, 5 aa, Plasmodium falciparum
KELEK

SEQ ID NO: 3318911 - protein, 13 aa, Plasmodium falciparum
KELEKLSQRSELE

SEQ ID NO: 3318912 - protein, 5 aa, Plasmodium falciparum
KELEN

SEQ ID NO: 3318913 - protein, 7 aa, Plasmodium falciparum
KELENDK

SEQ ID NO: 3318914 - protein, 33 aa, Plasmodium falciparum
KELENKDNNKKENIKDEEDPEAETNDKSNASNN

SEQ ID NO: 3318915 - protein, 15 aa, Plasmodium falciparum
KELENKKKEQVSNSQ

SEQ ID NO: 3318916 - protein, 12 aa, Plasmodium falciparum
KELENNDEKKSI

SEQ ID NO: 3318917 - protein, 10 aa, Plasmodium falciparum
KELENSNQVE

SEQ ID NO: 3318918 - protein, 8 aa, Plasmodium falciparum
KELERERR

SEQ ID NO: 3318919 - protein, 6 aa, Plasmodium falciparum
KELERK

SEQ ID NO: 3318920 - protein, 6 aa, Plasmodium falciparum
KELETT

SEQ ID NO: 3318921 - protein, 27 aa, Plasmodium falciparum
KELGKGIPSEKSSLNYNKNRTPNRQVE

SEQ ID NO: 3318922 - protein, 5 aa, Plasmodium falciparum
KELGV

SEQ ID NO: 3318923 - protein, 4 aa, Plasmodium falciparum
KELH

SEQ ID NO: 3318924 - protein, 5 aa, Plasmodium falciparum
KELKK

SEQ ID NO: 3318925 - protein, 31 aa, Plasmodium falciparum
KELKKEEFNKSVNNAKKKNRDTNNAETKKWG

SEQ ID NO: 3318926 - protein, 9 aa, Plasmodium falciparum
KELNDKQMS

SEQ ID NO: 3318927 - protein, 5 aa, Plasmodium falciparum
KELNE

SEQ ID NO: 3318928 - protein, 6 aa, Plasmodium falciparum
KELNEM

SEQ ID NO: 3318929 - protein, 16 aa, Plasmodium falciparum
KELNKNIDKSPNNNVL

SEQ ID NO: 3318930 - protein, 6 aa, Plasmodium falciparum
KELNNN

SEQ ID NO: 3318931 - protein, 8 aa, Plasmodium falciparum
KELNYENA

SEQ ID NO: 3318932 - protein, 11 aa, Plasmodium falciparum
KELPDDTNKIN

SEQ ID NO: 3318933 - protein, 6 aa, Plasmodium falciparum
KELQGY

SEQ ID NO: 3318934 - protein, 5 aa, Plasmodium falciparum
KELQN

SEQ ID NO: 3318935 - protein, 6 aa, Plasmodium falciparum
KELQNK

SEQ ID NO: 3318936 - protein, 12 aa, Plasmodium falciparum
KELQTKIKQVRK

SEQ ID NO: 3318937 - protein, 13 aa, Plasmodium falciparum
KELRQDNTTNKNE

SEQ ID NO: 3318938 - protein, 6 aa, Plasmodium falciparum
KELSVN

SEQ ID NO: 3318939 - protein, 11 aa, Plasmodium falciparum
KELTAKQKKHE

SEQ ID NO: 3318940 - protein, 6 aa, Plasmodium falciparum
KEMDES

SEQ ID NO: 3318941 - protein, 5 aa, Plasmodium falciparum
KEMDV

SEQ ID NO: 3318942 - protein, 4 aa, Plasmodium falciparum
KEMF

SEQ ID NO: 3318943 - protein, 43 aa, Plasmodium falciparum
KEMKGDIKKEENDKIDDNVKSVQEDEKNKTKEKIENDEELDNE

SEQ ID NO: 3318944 - protein, 6 aa, Plasmodium falciparum
KEMKKR

SEQ ID NO: 3318945 - protein, 7 aa, Plasmodium falciparum
KEMNSYN

SEQ ID NO: 3318946 - protein, 16 aa, Plasmodium falciparum
KEMQKQEIREFVKSLP

SEQ ID NO: 3318947 - protein, 11 aa, Plasmodium falciparum
KEMSTDDQDDV

SEQ ID NO: 3318948 - protein, 5 aa, Plasmodium falciparum
KENAI

SEQ ID NO: 3318949 - protein, 7 aa, Plasmodium falciparum
KENANGN

SEQ ID NO: 3318950 - protein, 5 aa, Plasmodium falciparum
KENAS

SEQ ID NO: 3318951 - protein, 6 aa, Plasmodium falciparum
KENCKK

SEQ ID NO: 3318952 - protein, 9 aa, Plasmodium falciparum
KENCKPKEK

SEQ ID NO: 3318953 - protein, 7 aa, Plasmodium falciparum
KENDASR

SEQ ID NO: 3318954 - protein, 8 aa, Plasmodium falciparum
KENDDHVD

SEQ ID NO: 3318955 - protein, 7 aa, Plasmodium falciparum
KENDDVD

SEQ ID NO: 3318956 - protein, 6 aa, Plasmodium falciparum
KENDED

SEQ ID NO: 3318957 - protein, 9 aa, Plasmodium falciparum
KENDEETVK

SEQ ID NO: 3318958 - protein, 18 aa, Plasmodium falciparum
KENDEGKLKERLQKLGLV

SEQ ID NO: 3318959 - protein, 9 aa, Plasmodium falciparum
KENDENKGL

SEQ ID NO: 3318960 - protein, 12 aa, Plasmodium falciparum
KENDEYKDPTYS

SEQ ID NO: 3318961 - protein, 6 aa, Plasmodium falciparum
KENDIN

SEQ ID NO: 3318962 - protein, 15 aa, Plasmodium falciparum
KENDKEKTSPGKKGM

SEQ ID NO: 3318963 - protein, 10 aa, Plasmodium falciparum
KENDKGSQED

SEQ ID NO: 3318964 - protein, 11 aa, Plasmodium falciparum
KENDKKQGNRG

SEQ ID NO: 3318965 - protein, 15 aa, Plasmodium falciparum
KENDLEKEKEKKKKK

SEQ ID NO: 3318966 - protein, 7 aa, Plasmodium falciparum
KENDLND

SEQ ID NO: 3318967 - protein, 6 aa, Plasmodium falciparum
KENDMD

SEQ ID NO: 3318968 - protein, 7 aa, Plasmodium falciparum
KENDNTF

SEQ ID NO: 3318969 - protein, 11 aa, Plasmodium falciparum
KENDNTPKNQY

SEQ ID NO: 3318970 - protein, 8 aa, Plasmodium falciparum
KENDPNYD

SEQ ID NO: 3318971 - protein, 8 aa, Plasmodium falciparum
KENDPSVQ

SEQ ID NO: 3318972 - protein, 15 aa, Plasmodium falciparum
KENDQNNTHYKQSTT

SEQ ID NO: 3318973 - protein, 7 aa, Plasmodium falciparum
KENDRSD

SEQ ID NO: 3318974 - protein, 9 aa, Plasmodium falciparum
KENDTNTND

SEQ ID NO: 3318975 - protein, 24 aa, Plasmodium falciparum
KENEDIKKKKTDNIYKSEKKSLRQ

SEQ ID NO: 3318976 - protein, 43 aa, Plasmodium falciparum
KENEDYDGDDNKSDDNESDDEDYDDRKDDNNDDYYDNEYKEKM

SEQ ID NO: 3318977 - protein, 9 aa, Plasmodium falciparum
KENEEEKAL

SEQ ID NO: 3318978 - protein, 9 aa, Plasmodium falciparum
KENEEKSLT

SEQ ID NO: 3318979 - protein, 8 aa, Plasmodium falciparum
KENEENNK

SEQ ID NO: 3318980 - protein, 7 aa, Plasmodium falciparum
KENEGRS

SEQ ID NO: 3318981 - protein, 5 aa, Plasmodium falciparum
KENEH

SEQ ID NO: 3318982 - protein, 5 aa, Plasmodium falciparum
KENEK

SEQ ID NO: 3318983 - protein, 6 aa, Plasmodium falciparum
KENEKI

SEQ ID NO: 3318984 - protein, 12 aa, Plasmodium falciparum
KENEKNKSDNKD

SEQ ID NO: 3318985 - protein, 15 aa, Plasmodium falciparum
KENELYRTNHKKKNH

SEQ ID NO: 3318986 - protein, 18 aa, Plasmodium falciparum
KENEMNENKNKKSVKEDG

SEQ ID NO: 3318987 - protein, 6 aa, Plasmodium falciparum
KENENI

SEQ ID NO: 3318988 - protein, 9 aa, Plasmodium falciparum
KENENKSTN

SEQ ID NO: 3318989 - protein, 6 aa, Plasmodium falciparum
KENENN

SEQ ID NO: 3318990 - protein, 7 aa, Plasmodium falciparum
KENENSS

SEQ ID NO: 3318991 - protein, 8 aa, Plasmodium falciparum
KENEPHYK

SEQ ID NO: 3318992 - protein, 11 aa, Plasmodium falciparum
KENEQNNDANE

SEQ ID NO: 3318993 - protein, 5 aa, Plasmodium falciparum
KENER

SEQ ID NO: 3318994 - protein, 13 aa, Plasmodium falciparum
KENESNEDEKTKK

SEQ ID NO: 3318995 - protein, 6 aa, Plasmodium falciparum
KENETD

SEQ ID NO: 3318996 - protein, 16 aa, Plasmodium falciparum
KENETNDNNMNDNKKT

SEQ ID NO: 3318997 - protein, 43 aa, Plasmodium falciparum
KENFENEKSGLAKKFDEENEKLQNEIGNEKRKLHKERDNFEEQ

SEQ ID NO: 3318998 - protein, 14 aa, Plasmodium falciparum
KENFNSQEKIKKKN

SEQ ID NO: 3318999 - protein, 28 aa, Plasmodium falciparum
KENFQNRQREIETNEYKTNHENNNNMDE

SEQ ID NO: 3319000 - protein, 6 aa, Plasmodium falciparum
KENGKW

SEQ ID NO: 3319001 - protein, 12 aa, Plasmodium falciparum
KENGNSNSSKEM

SEQ ID NO: 3319002 - protein, 18 aa, Plasmodium falciparum
KENGQNQNDINHKKEHDK

SEQ ID NO: 3319003 - protein, 6 aa, Plasmodium falciparum
KENGSI

SEQ ID NO: 3319004 - protein, 8 aa, Plasmodium falciparum
KENGVNTD

SEQ ID NO: 3319005 - protein, 7 aa, Plasmodium falciparum
KENGVTN

SEQ ID NO: 3319006 - protein, 13 aa, Plasmodium falciparum
KENHKKKGALKKK

SEQ ID NO: 3319007 - protein, 4 aa, Plasmodium falciparum
KENI

SEQ ID NO: 3319008 - protein, 12 aa, Plasmodium falciparum
KENIDGKKKSKY

SEQ ID NO: 3319009 - protein, 6 aa, Plasmodium falciparum
KENIDL

SEQ ID NO: 3319010 - protein, 21 aa, Plasmodium falciparum
KENIDTKKKKYSNKKKNHLPN

SEQ ID NO: 3319011 - protein, 6 aa, Plasmodium falciparum
KENIEE

SEQ ID NO: 3319012 - protein, 7 aa, Plasmodium falciparum
KENIESI

SEQ ID NO: 3319013 - protein, 7 aa, Plasmodium falciparum
KENIKKK

SEQ ID NO: 3319014 - protein, 6 aa, Plasmodium falciparum
KENINS

SEQ ID NO: 3319015 - protein, 9 aa, Plasmodium falciparum
KENIPKDED

SEQ ID NO: 3319016 - protein, 5 aa, Plasmodium falciparum
KENIQ

SEQ ID NO: 3319017 - protein, 7 aa, Plasmodium falciparum
KENISKE

SEQ ID NO: 3319018 - protein, 7 aa, Plasmodium falciparum
KENISKK

SEQ ID NO: 3319019 - protein, 13 aa, Plasmodium falciparum
KENISSNMNNNHN

SEQ ID NO: 3319020 - protein, 15 aa, Plasmodium falciparum
KENIYGDKKNKDNIY

SEQ ID NO: 3319021 - protein, 14 aa, Plasmodium falciparum
KENIYNDNDDMDNN

SEQ ID NO: 3319022 - protein, 4 aa, Plasmodium falciparum
KENK

SEQ ID NO: 3319023 - protein, 10 aa, Plasmodium falciparum
KENKCNNNYN

SEQ ID NO: 3319024 - protein, 9 aa, Plasmodium falciparum
KENKEETEI

SEQ ID NO: 3319025 - protein, 17 aa, Plasmodium falciparum
KENKETSKKSDNDNPMY

SEQ ID NO: 3319026 - protein, 19 aa, Plasmodium falciparum
KENKKIELEREKNNKKIIE

SEQ ID NO: 3319027 - protein, 7 aa, Plasmodium falciparum
KENKKKA

SEQ ID NO: 3319028 - protein, 10 aa, Plasmodium falciparum
KENKKKEQTL

SEQ ID NO: 3319029 - protein, 27 aa, Plasmodium falciparum
KENKKVKEPRKKQHKEIKDYNKEDNIN

SEQ ID NO: 3319030 - protein, 8 aa, Plasmodium falciparum
KENKLKEK

SEQ ID NO: 3319031 - protein, 6 aa, Plasmodium falciparum
KENKND

SEQ ID NO: 3319032 - protein, 25 aa, Plasmodium falciparum
KENKNEEKQNKKDIQNNESNSKVDE

SEQ ID NO: 3319033 - protein, 7 aa, Plasmodium falciparum
KENKNES

SEQ ID NO: 3319034 - protein, 8 aa, Plasmodium falciparum
KENKNIKS

SEQ ID NO: 3319035 - protein, 6 aa, Plasmodium falciparum
KENKNM

SEQ ID NO: 3319036 - protein, 18 aa, Plasmodium falciparum
KENKNNHKYNKSDYSEDS

SEQ ID NO: 3319037 - protein, 10 aa, Plasmodium falciparum
KENKQDYDNN

SEQ ID NO: 3319038 - protein, 7 aa, Plasmodium falciparum
KENKQKM

SEQ ID NO: 3319039 - protein, 5 aa, Plasmodium falciparum
KENKR

SEQ ID NO: 3319040 - protein, 17 aa, Plasmodium falciparum
KENKRHGKATITTPDET

SEQ ID NO: 3319041 - protein, 15 aa, Plasmodium falciparum
KENKRPDVDTNKNSI

SEQ ID NO: 3319042 - protein, 5 aa, Plasmodium falciparum
KENKY

SEQ ID NO: 3319043 - protein, 19 aa, Plasmodium falciparum
KENKYENDTMKKKKKKHYE

SEQ ID NO: 3319044 - protein, 4 aa, Plasmodium falciparum
KENL

SEQ ID NO: 3319045 - protein, 7 aa, Plasmodium falciparum
KENLENF

SEQ ID NO: 3319046 - protein, 10 aa, Plasmodium falciparum
KENMSNHTKE

SEQ ID NO: 3319047 - protein, 15 aa, Plasmodium falciparum
KENNDINNNNNNNIN

SEQ ID NO: 3319048 - protein, 11 aa, Plasmodium falciparum
KENNEIENRKK

SEQ ID NO: 3319049 - protein, 18 aa, Plasmodium falciparum
KENNESIESKKEKFTVPE

SEQ ID NO: 3319050 - protein, 6 aa, Plasmodium falciparum
KENNEY

SEQ ID NO: 3319051 - protein, 5 aa, Plasmodium falciparum
KENNG

SEQ ID NO: 3319052 - protein, 8 aa, Plasmodium falciparum
KENNGHNK

SEQ ID NO: 3319053 - protein, 28 aa, Plasmodium falciparum
KENNINNINNNNNNNINNNNNINNNNNI

SEQ ID NO: 3319054 - protein, 9 aa, Plasmodium falciparum
KENNISGTQ

SEQ ID NO: 3319055 - protein, 24 aa, Plasmodium falciparum
KENNISTSIRKKENGYGSTNETSE

SEQ ID NO: 3319056 - protein, 8 aa, Plasmodium falciparum
KENNKKNT

SEQ ID NO: 3319057 - protein, 7 aa, Plasmodium falciparum
KENNKNF

SEQ ID NO: 3319058 - protein, 14 aa, Plasmodium falciparum
KENNKNKEAHNNNC

SEQ ID NO: 3319059 - protein, 10 aa, Plasmodium falciparum
KENNKNMEGN

SEQ ID NO: 3319060 - protein, 11 aa, Plasmodium falciparum
KENNKSDNTNT

SEQ ID NO: 3319061 - protein, 8 aa, Plasmodium falciparum
KENNNDDG

SEQ ID NO: 3319062 - protein, 8 aa, Plasmodium falciparum
KENNNDSK

SEQ ID NO: 3319063 - protein, 10 aa, Plasmodium falciparum
KENNNKMESS

SEQ ID NO: 3319064 - protein, 13 aa, Plasmodium falciparum
KENNNNNNNNKCD

SEQ ID NO: 3319065 - protein, 20 aa, Plasmodium falciparum
KENNNNTNGSNSNNKNNSVV

SEQ ID NO: 3319066 - protein, 6 aa, Plasmodium falciparum
KENNQG

SEQ ID NO: 3319067 - protein, 5 aa, Plasmodium falciparum
KENNS

SEQ ID NO: 3319068 - protein, 9 aa, Plasmodium falciparum
KENNTDNNL

SEQ ID NO: 3319069 - protein, 8 aa, Plasmodium falciparum
KENNTNIN

SEQ ID NO: 3319070 - protein, 6 aa, Plasmodium falciparum
KENNYN

SEQ ID NO: 3319071 - protein, 7 aa, Plasmodium falciparum
KENPIDS

SEQ ID NO: 3319072 - protein, 7 aa, Plasmodium falciparum
KENPYDN

SEQ ID NO: 3319073 - protein, 4 aa, Plasmodium falciparum
KENQ

SEQ ID NO: 3319074 - protein, 8 aa, Plasmodium falciparum
KENQIEPV

SEQ ID NO: 3319075 - protein, 6 aa, Plasmodium falciparum
KENQKW

SEQ ID NO: 3319076 - protein, 16 aa, Plasmodium falciparum
KENQNRNRNQNRNQIQ

SEQ ID NO: 3319077 - protein, 13 aa, Plasmodium falciparum
KENQSSDNETFNN

SEQ ID NO: 3319078 - protein, 7 aa, Plasmodium falciparum
KENQSYS

SEQ ID NO: 3319079 - protein, 11 aa, Plasmodium falciparum
KENQTKASYTI

SEQ ID NO: 3319080 - protein, 7 aa, Plasmodium falciparum
KENRDKG

SEQ ID NO: 3319081 - protein, 6 aa, Plasmodium falciparum
KENRES

SEQ ID NO: 3319082 - protein, 6 aa, Plasmodium falciparum
KENRKI

SEQ ID NO: 3319083 - protein, 7 aa, Plasmodium falciparum
KENRNAD

SEQ ID NO: 3319084 - protein, 7 aa, Plasmodium falciparum
KENRNKV

SEQ ID NO: 3319085 - protein, 16 aa, Plasmodium falciparum
KENRQMNGKQLGDRTN

SEQ ID NO: 3319086 - protein, 4 aa, Plasmodium falciparum
KENS

SEQ ID NO: 3319087 - protein, 46 aa, Plasmodium falciparum
KENSLYDDDDDIHDENDHVNEKKKEIGAKNITQKGNNKDNKNNEEY

SEQ ID NO: 3319088 - protein, 8 aa, Plasmodium falciparum
KENSNARH

SEQ ID NO: 3319089 - protein, 19 aa, Plasmodium falciparum
KENSNCAEQKTKNKETNVL

SEQ ID NO: 3319090 - protein, 10 aa, Plasmodium falciparum
KENSNEYQSL

SEQ ID NO: 3319091 - protein, 5 aa, Plasmodium falciparum
KENSR

SEQ ID NO: 3319092 - protein, 9 aa, Plasmodium falciparum
KENSSKNSI

SEQ ID NO: 3319093 - protein, 7 aa, Plasmodium falciparum
KENSTKK

SEQ ID NO: 3319094 - protein, 6 aa, Plasmodium falciparum
KENSTS

SEQ ID NO: 3319095 - protein, 7 aa, Plasmodium falciparum
KENTELE

SEQ ID NO: 3319096 - protein, 7 aa, Plasmodium falciparum
KENTGSF

SEQ ID NO: 3319097 - protein, 28 aa, Plasmodium falciparum
KENTHNKGNEDNVNKNINDNISKNNITH

SEQ ID NO: 3319098 - protein, 14 aa, Plasmodium falciparum
KENTITLNNNSNNV

SEQ ID NO: 3319099 - protein, 6 aa, Plasmodium falciparum
KENTKN

SEQ ID NO: 3319100 - protein, 7 aa, Plasmodium falciparum
KENTKPK

SEQ ID NO: 3319101 - protein, 6 aa, Plasmodium falciparum
KENTNC

SEQ ID NO: 3319102 - protein, 12 aa, Plasmodium falciparum
KENTNSGDTQEA

SEQ ID NO: 3319103 - protein, 25 aa, Plasmodium falciparum
KENTQEENQNIHDEKKKSCEQNRNN

SEQ ID NO: 3319104 - protein, 10 aa, Plasmodium falciparum
KENTYDDSVS

SEQ ID NO: 3319105 - protein, 5 aa, Plasmodium falciparum
KENVD

SEQ ID NO: 3319106 - protein, 7 aa, Plasmodium falciparum
KENVEKS

SEQ ID NO: 3319107 - protein, 81 aa, Plasmodium falciparum
KENVGDNIKENVGDNIKENVGDNIKENVGDNIKENVGDNIKENVGDNIKENVGDNIKENVGDNDNVSNNSYTNYSNSNTYD

SEQ ID NO: 3319108 - protein, 20 aa, Plasmodium falciparum
KENVNNNINRNEEDPTINND

SEQ ID NO: 3319109 - protein, 6 aa, Plasmodium falciparum
KENVNP

SEQ ID NO: 3319110 - protein, 6 aa, Plasmodium falciparum
KENVQN

SEQ ID NO: 3319111 - protein, 18 aa, Plasmodium falciparum
KENVTDIDADKGSNNHMN

SEQ ID NO: 3319112 - protein, 6 aa, Plasmodium falciparum
KENVTS

SEQ ID NO: 3319113 - protein, 5 aa, Plasmodium falciparum
KENYD

SEQ ID NO: 3319114 - protein, 5 aa, Plasmodium falciparum
KENYE

SEQ ID NO: 3319115 - protein, 6 aa, Plasmodium falciparum
KENYEK

SEQ ID NO: 3319116 - protein, 7 aa, Plasmodium falciparum
KENYESD

SEQ ID NO: 3319117 - protein, 10 aa, Plasmodium falciparum
KENYGENDEY

SEQ ID NO: 3319118 - protein, 5 aa, Plasmodium falciparum
KENYI

SEQ ID NO: 3319119 - protein, 9 aa, Plasmodium falciparum
KENYKENDI

SEQ ID NO: 3319120 - protein, 8 aa, Plasmodium falciparum
KENYPLKT

SEQ ID NO: 3319121 - protein, 6 aa, Plasmodium falciparum
KENYQK

SEQ ID NO: 3319122 - protein, 6 aa, Plasmodium falciparum
KENYQY

SEQ ID NO: 3319123 - protein, 5 aa, Plasmodium falciparum
KENYS

SEQ ID NO: 3319124 - protein, 12 aa, Plasmodium falciparum
KENYSEKGGRFV

SEQ ID NO: 3319125 - protein, 12 aa, Plasmodium falciparum
KEPCKAINPDEA

SEQ ID NO: 3319126 - protein, 7 aa, Plasmodium falciparum
KEPDDGL

SEQ ID NO: 3319127 - protein, 17 aa, Plasmodium falciparum
KEPDEKRKNDKSSITCD

SEQ ID NO: 3319128 - protein, 7 aa, Plasmodium falciparum
KEPESDY

SEQ ID NO: 3319129 - protein, 5 aa, Plasmodium falciparum
KEPFP

SEQ ID NO: 3319130 - protein, 5 aa, Plasmodium falciparum
KEPIN

SEQ ID NO: 3319131 - protein, 5 aa, Plasmodium falciparum
KEPKI

SEQ ID NO: 3319132 - protein, 7 aa, Plasmodium falciparum
KEPKNNL

SEQ ID NO: 3319133 - protein, 9 aa, Plasmodium falciparum
KEPKRKGRK

SEQ ID NO: 3319134 - protein, 23 aa, Plasmodium falciparum
KEPKTNVDNQSENDCGDDSSYEY

SEQ ID NO: 3319135 - protein, 8 aa, Plasmodium falciparum
KEPLGKGT

SEQ ID NO: 3319136 - protein, 5 aa, Plasmodium falciparum
KEPNE

SEQ ID NO: 3319137 - protein, 7 aa, Plasmodium falciparum
KEPNKNL

SEQ ID NO: 3319138 - protein, 5 aa, Plasmodium falciparum
KEPRG

SEQ ID NO: 3319139 - protein, 4 aa, Plasmodium falciparum
KEPS

SEQ ID NO: 3319140 - protein, 6 aa, Plasmodium falciparum
KEPSAH

SEQ ID NO: 3319141 - protein, 6 aa, Plasmodium falciparum
KEPSIS

SEQ ID NO: 3319142 - protein, 6 aa, Plasmodium falciparum
KEPYAH

SEQ ID NO: 3319143 - protein, 12 aa, Plasmodium falciparum
KEPYDKAGAYSI

SEQ ID NO: 3319144 - protein, 7 aa, Plasmodium falciparum
KEPYNNN

SEQ ID NO: 3319145 - protein, 44 aa, Plasmodium falciparum
KEQADYTNNNNNNNNNNNSNNNNNNNNNNNNNNNNNNNNNNNIQ

SEQ ID NO: 3319146 - protein, 10 aa, Plasmodium falciparum
KEQDDNIQNN

SEQ ID NO: 3319147 - protein, 7 aa, Plasmodium falciparum
KEQDSFE

SEQ ID NO: 3319148 - protein, 6 aa, Plasmodium falciparum
KEQEDK

SEQ ID NO: 3319149 - protein, 14 aa, Plasmodium falciparum
KEQEEFPTNHNDND

SEQ ID NO: 3319150 - protein, 9 aa, Plasmodium falciparum
KEQENESSK

SEQ ID NO: 3319151 - protein, 17 aa, Plasmodium falciparum
KEQERVNNNNNNNNNNI

SEQ ID NO: 3319152 - protein, 5 aa, Plasmodium falciparum
KEQGI

SEQ ID NO: 3319153 - protein, 7 aa, Plasmodium falciparum
KEQGNSR

SEQ ID NO: 3319154 - protein, 4 aa, Plasmodium falciparum
KEQI

SEQ ID NO: 3319155 - protein, 6 aa, Plasmodium falciparum
KEQIDK

SEQ ID NO: 3319156 - protein, 5 aa, Plasmodium falciparum
KEQIE

SEQ ID NO: 3319157 - protein, 10 aa, Plasmodium falciparum
KEQIEKDKND

SEQ ID NO: 3319158 - protein, 5 aa, Plasmodium falciparum
KEQKD

SEQ ID NO: 3319159 - protein, 27 aa, Plasmodium falciparum
KEQKESINRNNNINKNEIDNKINNNNN

SEQ ID NO: 3319160 - protein, 7 aa, Plasmodium falciparum
KEQKEYD

SEQ ID NO: 3319161 - protein, 10 aa, Plasmodium falciparum
KEQKHTEDVQ

SEQ ID NO: 3319162 - protein, 35 aa, Plasmodium falciparum
KEQKKSEQLDDKVNKNNNASLTKKEKKNKKEENKI

SEQ ID NO: 3319163 - protein, 8 aa, Plasmodium falciparum
KEQKTEKN

SEQ ID NO: 3319164 - protein, 9 aa, Plasmodium falciparum
KEQLKDGTF

SEQ ID NO: 3319165 - protein, 17 aa, Plasmodium falciparum
KEQLKEERRLKKKKKLE

SEQ ID NO: 3319166 - protein, 4 aa, Plasmodium falciparum
KEQN

SEQ ID NO: 3319167 - protein, 7 aa, Plasmodium falciparum
KEQNDNM

SEQ ID NO: 3319168 - protein, 9 aa, Plasmodium falciparum
KEQNDTHQM

SEQ ID NO: 3319169 - protein, 9 aa, Plasmodium falciparum
KEQNEEKEI

SEQ ID NO: 3319170 - protein, 6 aa, Plasmodium falciparum
KEQNEH

SEQ ID NO: 3319171 - protein, 9 aa, Plasmodium falciparum
KEQNISSNS

SEQ ID NO: 3319172 - protein, 28 aa, Plasmodium falciparum
KEQNNNNNNNNSDNNNNNNNKSNVIGDY

SEQ ID NO: 3319173 - protein, 10 aa, Plasmodium falciparum
KEQNNSNDIL

SEQ ID NO: 3319174 - protein, 6 aa, Plasmodium falciparum
KEQPAG

SEQ ID NO: 3319175 - protein, 7 aa, Plasmodium falciparum
KEQPGLK

SEQ ID NO: 3319176 - protein, 13 aa, Plasmodium falciparum
KEQQKNDIQPIKN

SEQ ID NO: 3319177 - protein, 27 aa, Plasmodium falciparum
KEQQKNNSTPKNKRNQQGNISNKDGNI

SEQ ID NO: 3319178 - protein, 6 aa, Plasmodium falciparum
KEQQST

SEQ ID NO: 3319179 - protein, 8 aa, Plasmodium falciparum
KEQQTKEH

SEQ ID NO: 3319180 - protein, 4 aa, Plasmodium falciparum
KEQR

SEQ ID NO: 3319181 - protein, 13 aa, Plasmodium falciparum
KEQRNKKEVVNDS

SEQ ID NO: 3319182 - protein, 5 aa, Plasmodium falciparum
KEQST

SEQ ID NO: 3319183 - protein, 28 aa, Plasmodium falciparum
KEQTSNNITKEKKKEKMKKGKETKVKQK

SEQ ID NO: 3319184 - protein, 20 aa, Plasmodium falciparum
KEQTTYSEKNQKSCLNSDNE

SEQ ID NO: 3319185 - protein, 19 aa, Plasmodium falciparum
KEQYEENEYEDDQSNSEDL

SEQ ID NO: 3319186 - protein, 8 aa, Plasmodium falciparum
KERDDISY

SEQ ID NO: 3319187 - protein, 12 aa, Plasmodium falciparum
KERDEKDRTVDP

SEQ ID NO: 3319188 - protein, 15 aa, Plasmodium falciparum
KERDGNIKKKENEKI

SEQ ID NO: 3319189 - protein, 19 aa, Plasmodium falciparum
KERDKKNEQNIKKKKNPNV

SEQ ID NO: 3319190 - protein, 6 aa, Plasmodium falciparum
KEREAH

SEQ ID NO: 3319191 - protein, 12 aa, Plasmodium falciparum
KEREDPKEYSYS

SEQ ID NO: 3319192 - protein, 43 aa, Plasmodium falciparum
KEREEKKKKMENDKQKKMISSKEKEEEGEGEGEGERKKKKEHH

SEQ ID NO: 3319193 - protein, 8 aa, Plasmodium falciparum
KEREKEKL

SEQ ID NO: 3319194 - protein, 9 aa, Plasmodium falciparum
KERENNGTY

SEQ ID NO: 3319195 - protein, 9 aa, Plasmodium falciparum
KERENNINK

SEQ ID NO: 3319196 - protein, 7 aa, Plasmodium falciparum
KEREQKN

SEQ ID NO: 3319197 - protein, 9 aa, Plasmodium falciparum
KERGNYEET

SEQ ID NO: 3319198 - protein, 14 aa, Plasmodium falciparum
KERIDDNNKCEYDN

SEQ ID NO: 3319199 - protein, 4 aa, Plasmodium falciparum
KERK

SEQ ID NO: 3319200 - protein, 13 aa, Plasmodium falciparum
KERKASNDKEKDI

SEQ ID NO: 3319201 - protein, 8 aa, Plasmodium falciparum
KERKGEYL

SEQ ID NO: 3319202 - protein, 9 aa, Plasmodium falciparum
KERKIKNST

SEQ ID NO: 3319203 - protein, 21 aa, Plasmodium falciparum
KERKKEARKVHKDSLKAKKLR

SEQ ID NO: 3319204 - protein, 6 aa, Plasmodium falciparum
KERKKN

SEQ ID NO: 3319205 - protein, 6 aa, Plasmodium falciparum
KERKNN

SEQ ID NO: 3319206 - protein, 20 aa, Plasmodium falciparum
KERKNNENDGSEYAQKSSID

SEQ ID NO: 3319207 - protein, 20 aa, Plasmodium falciparum
KERLEKKKKNRNDSGVSSSE

SEQ ID NO: 3319208 - protein, 4 aa, Plasmodium falciparum
KERM

SEQ ID NO: 3319209 - protein, 25 aa, Plasmodium falciparum
KERMNNGKEENGEGVQTNVRNTNNN

SEQ ID NO: 3319210 - protein, 4 aa, Plasmodium falciparum
KERN

SEQ ID NO: 3319211 - protein, 8 aa, Plasmodium falciparum
KERNKELS

SEQ ID NO: 3319212 - protein, 11 aa, Plasmodium falciparum
KERNLTTHKDN

SEQ ID NO: 3319213 - protein, 15 aa, Plasmodium falciparum
KERNQKSPRKSSYNI

SEQ ID NO: 3319214 - protein, 24 aa, Plasmodium falciparum
KERNSIGNNKTVKVDEKKENSSIH

SEQ ID NO: 3319215 - protein, 12 aa, Plasmodium falciparum
KERNTSNNANVE

SEQ ID NO: 3319216 - protein, 7 aa, Plasmodium falciparum
KERQGTV

SEQ ID NO: 3319217 - protein, 31 aa, Plasmodium falciparum
KERQKKNKNKGKKKKSNLAYTSKKSQSEEFD

SEQ ID NO: 3319218 - protein, 8 aa, Plasmodium falciparum
KERQRDNI

SEQ ID NO: 3319219 - protein, 4 aa, Plasmodium falciparum
KERS

SEQ ID NO: 3319220 - protein, 12 aa, Plasmodium falciparum
KERYNNNQKRKS

SEQ ID NO: 3319221 - protein, 5 aa, Plasmodium falciparum
KESAK

SEQ ID NO: 3319222 - protein, 4 aa, Plasmodium falciparum
KESD

SEQ ID NO: 3319223 - protein, 10 aa, Plasmodium falciparum
KESDNNDNTS

SEQ ID NO: 3319224 - protein, 9 aa, Plasmodium falciparum
KESDSVYDK

SEQ ID NO: 3319225 - protein, 20 aa, Plasmodium falciparum
KESEEKNELQDDYNNEKKNE

SEQ ID NO: 3319226 - protein, 24 aa, Plasmodium falciparum
KESEKSLKNTNKNEVWNSTKTNRI

SEQ ID NO: 3319227 - protein, 6 aa, Plasmodium falciparum
KESEMK

SEQ ID NO: 3319228 - protein, 6 aa, Plasmodium falciparum
KESESI

SEQ ID NO: 3319229 - protein, 19 aa, Plasmodium falciparum
KESGDTPKREEDEQEANDV

SEQ ID NO: 3319230 - protein, 8 aa, Plasmodium falciparum
KESGEIKN

SEQ ID NO: 3319231 - protein, 7 aa, Plasmodium falciparum
KESGKYF

SEQ ID NO: 3319232 - protein, 5 aa, Plasmodium falciparum
KESGS

SEQ ID NO: 3319233 - protein, 4 aa, Plasmodium falciparum
KESI

SEQ ID NO: 3319234 - protein, 8 aa, Plasmodium falciparum
KESIPNKI

SEQ ID NO: 3319235 - protein, 14 aa, Plasmodium falciparum
KESITSEKEKLEKY

SEQ ID NO: 3319236 - protein, 8 aa, Plasmodium falciparum
KESKAGAL

SEQ ID NO: 3319237 - protein, 9 aa, Plasmodium falciparum
KESKINPDY

SEQ ID NO: 3319238 - protein, 6 aa, Plasmodium falciparum
KESKIY

SEQ ID NO: 3319239 - protein, 5 aa, Plasmodium falciparum
KESKK

SEQ ID NO: 3319240 - protein, 42 aa, Plasmodium falciparum
KESKLHKSDTFSSLPKSINESDELSTTTYSASSTNNKSINKY

SEQ ID NO: 3319241 - protein, 10 aa, Plasmodium falciparum
KESKNVKSGS

SEQ ID NO: 3319242 - protein, 18 aa, Plasmodium falciparum
KESKRAITSSKKRDDDNI

SEQ ID NO: 3319243 - protein, 10 aa, Plasmodium falciparum
KESKVCSRQE

SEQ ID NO: 3319244 - protein, 6 aa, Plasmodium falciparum
KESKYA

SEQ ID NO: 3319245 - protein, 8 aa, Plasmodium falciparum
KESLDGGN

SEQ ID NO: 3319246 - protein, 13 aa, Plasmodium falciparum
KESLNSNKDKYFS

SEQ ID NO: 3319247 - protein, 24 aa, Plasmodium falciparum
KESMKNKEHISNQSMEKKSPFPIE

SEQ ID NO: 3319248 - protein, 14 aa, Plasmodium falciparum
KESMNDDTANSEIT

SEQ ID NO: 3319249 - protein, 6 aa, Plasmodium falciparum
KESNAK

SEQ ID NO: 3319250 - protein, 12 aa, Plasmodium falciparum
KESNDGNTPHAS

SEQ ID NO: 3319251 - protein, 5 aa, Plasmodium falciparum
KESNE

SEQ ID NO: 3319252 - protein, 7 aa, Plasmodium falciparum
KESNEEI

SEQ ID NO: 3319253 - protein, 8 aa, Plasmodium falciparum
KESNENYG

SEQ ID NO: 3319254 - protein, 8 aa, Plasmodium falciparum
KESNKATS

SEQ ID NO: 3319255 - protein, 33 aa, Plasmodium falciparum
KESNNDSKNEKDIREEKEKKLPKNVSIPSNDNK

SEQ ID NO: 3319256 - protein, 14 aa, Plasmodium falciparum
KESNNLTDVENDNE

SEQ ID NO: 3319257 - protein, 10 aa, Plasmodium falciparum
KESNNPENNE

SEQ ID NO: 3319258 - protein, 5 aa, Plasmodium falciparum
KESNT

SEQ ID NO: 3319259 - protein, 8 aa, Plasmodium falciparum
KESPSVDE

SEQ ID NO: 3319260 - protein, 5 aa, Plasmodium falciparum
KESQD

SEQ ID NO: 3319261 - protein, 10 aa, Plasmodium falciparum
KESQRRQHKN

SEQ ID NO: 3319262 - protein, 7 aa, Plasmodium falciparum
KESQSEY

SEQ ID NO: 3319263 - protein, 30 aa, Plasmodium falciparum
KESRNKEDDLDSENLEEAKEKKKIKEEKKR

SEQ ID NO: 3319264 - protein, 5 aa, Plasmodium falciparum
KESSI

SEQ ID NO: 3319265 - protein, 15 aa, Plasmodium falciparum
KESSNINKDDVYNGN

SEQ ID NO: 3319266 - protein, 7 aa, Plasmodium falciparum
KESSSKL

SEQ ID NO: 3319267 - protein, 8 aa, Plasmodium falciparum
KESSSQSS

SEQ ID NO: 3319268 - protein, 12 aa, Plasmodium falciparum
KESTEKDRKKNY

SEQ ID NO: 3319269 - protein, 8 aa, Plasmodium falciparum
KESTKRAF

SEQ ID NO: 3319270 - protein, 7 aa, Plasmodium falciparum
KESTLNE

SEQ ID NO: 3319271 - protein, 8 aa, Plasmodium falciparum
KESTTDFD

SEQ ID NO: 3319272 - protein, 7 aa, Plasmodium falciparum
KESVKSY

SEQ ID NO: 3319273 - protein, 13 aa, Plasmodium falciparum
KETAKNDTQKKYT

SEQ ID NO: 3319274 - protein, 6 aa, Plasmodium falciparum
KETDLN

SEQ ID NO: 3319275 - protein, 23 aa, Plasmodium falciparum
KETDNSFSSNNRCDPNKPYAPDK

SEQ ID NO: 3319276 - protein, 5 aa, Plasmodium falciparum
KETEE

SEQ ID NO: 3319277 - protein, 6 aa, Plasmodium falciparum
KETEKT

SEQ ID NO: 3319278 - protein, 8 aa, Plasmodium falciparum
KETGAEGL

SEQ ID NO: 3319279 - protein, 7 aa, Plasmodium falciparum
KETGGDK

SEQ ID NO: 3319280 - protein, 11 aa, Plasmodium falciparum
KETHDKKDIST

SEQ ID NO: 3319281 - protein, 16 aa, Plasmodium falciparum
KETHNELNGNTKRNVS

SEQ ID NO: 3319282 - protein, 6 aa, Plasmodium falciparum
KETIND

SEQ ID NO: 3319283 - protein, 16 aa, Plasmodium falciparum
KETINKSKLSEQKNTK

SEQ ID NO: 3319284 - protein, 8 aa, Plasmodium falciparum
KETIRQNA

SEQ ID NO: 3319285 - protein, 4 aa, Plasmodium falciparum
KETK

SEQ ID NO: 3319286 - protein, 33 aa, Plasmodium falciparum
KETKAGRRASKELKNRRKKVRGTEKTKVSGAKK

SEQ ID NO: 3319287 - protein, 17 aa, Plasmodium falciparum
KETKGIENNLKDENKTK

SEQ ID NO: 3319288 - protein, 15 aa, Plasmodium falciparum
KETKKIDQQQGHAKG

SEQ ID NO: 3319289 - protein, 7 aa, Plasmodium falciparum
KETKKKI

SEQ ID NO: 3319290 - protein, 36 aa, Plasmodium falciparum
KETKKYKDVDETNEKNLSNNENKYEKEARSNHNKNE

SEQ ID NO: 3319291 - protein, 11 aa, Plasmodium falciparum
KETKRKEDEKR

SEQ ID NO: 3319292 - protein, 8 aa, Plasmodium falciparum
KETKRKGY

SEQ ID NO: 3319293 - protein, 4 aa, Plasmodium falciparum
KETL

SEQ ID NO: 3319294 - protein, 14 aa, Plasmodium falciparum
KETLDKDSKGNVFN

SEQ ID NO: 3319295 - protein, 7 aa, Plasmodium falciparum
KETLGGK

SEQ ID NO: 3319296 - protein, 4 aa, Plasmodium falciparum
KETN

SEQ ID NO: 3319297 - protein, 15 aa, Plasmodium falciparum
KETNCNKDENKKNMC

SEQ ID NO: 3319298 - protein, 5 aa, Plasmodium falciparum
KETNE

SEQ ID NO: 3319299 - protein, 10 aa, Plasmodium falciparum
KETNEHQDEN

SEQ ID NO: 3319300 - protein, 9 aa, Plasmodium falciparum
KETNEKSSC

SEQ ID NO: 3319301 - protein, 7 aa, Plasmodium falciparum
KETNENI

SEQ ID NO: 3319302 - protein, 9 aa, Plasmodium falciparum
KETNGNNNN

SEQ ID NO: 3319303 - protein, 7 aa, Plasmodium falciparum
KETNGVD

SEQ ID NO: 3319304 - protein, 9 aa, Plasmodium falciparum
KETNTASEP

SEQ ID NO: 3319305 - protein, 8 aa, Plasmodium falciparum
KETNTPKD

SEQ ID NO: 3319306 - protein, 5 aa, Plasmodium falciparum
KETPI

SEQ ID NO: 3319307 - protein, 49 aa, Plasmodium falciparum
KETPKDENEEEEENLDEGENVDKEKSVENKSEKSDNESIASDASDIKKN

SEQ ID NO: 3319308 - protein, 12 aa, Plasmodium falciparum
KETPSKNQGKNK

SEQ ID NO: 3319309 - protein, 6 aa, Plasmodium falciparum
KETPTL

SEQ ID NO: 3319310 - protein, 4 aa, Plasmodium falciparum
KETQ

SEQ ID NO: 3319311 - protein, 13 aa, Plasmodium falciparum
KETQEKGDNEQNV

SEQ ID NO: 3319312 - protein, 13 aa, Plasmodium falciparum
KETQNNKKPKKLL

SEQ ID NO: 3319313 - protein, 7 aa, Plasmodium falciparum
KETQNSK

SEQ ID NO: 3319314 - protein, 6 aa, Plasmodium falciparum
KETSDF

SEQ ID NO: 3319315 - protein, 34 aa, Plasmodium falciparum
KETSDHTNYKNGGNVKSDSNNNNNNNNNSSSCSN

SEQ ID NO: 3319316 - protein, 5 aa, Plasmodium falciparum
KETSI

SEQ ID NO: 3319317 - protein, 9 aa, Plasmodium falciparum
KETSKSNIP

SEQ ID NO: 3319318 - protein, 8 aa, Plasmodium falciparum
KETSSIKK

SEQ ID NO: 3319319 - protein, 6 aa, Plasmodium falciparum
KETTEF

SEQ ID NO: 3319320 - protein, 4 aa, Plasmodium falciparum
KETV

SEQ ID NO: 3319321 - protein, 6 aa, Plasmodium falciparum
KETVSK

SEQ ID NO: 3319322 - protein, 8 aa, Plasmodium falciparum
KETYNDDI

SEQ ID NO: 3319323 - protein, 6 aa, Plasmodium falciparum
KETYRT

SEQ ID NO: 3319324 - protein, 13 aa, Plasmodium falciparum
KEVDNNNNNNNNK

SEQ ID NO: 3319325 - protein, 14 aa, Plasmodium falciparum
KEVDNTKRNLNNRC

SEQ ID NO: 3319326 - protein, 13 aa, Plasmodium falciparum
KEVEDKINAAKEN

SEQ ID NO: 3319327 - protein, 13 aa, Plasmodium falciparum
KEVEKKATAEAVP

SEQ ID NO: 3319328 - protein, 18 aa, Plasmodium falciparum
KEVENEKDKEKEKAKEKV

SEQ ID NO: 3319329 - protein, 31 aa, Plasmodium falciparum
KEVHKNNHNNNYSRDDNINQNKSNNNKNYYT

SEQ ID NO: 3319330 - protein, 4 aa, Plasmodium falciparum
KEVK

SEQ ID NO: 3319331 - protein, 16 aa, Plasmodium falciparum
KEVKDDFNEASNSVEK

SEQ ID NO: 3319332 - protein, 23 aa, Plasmodium falciparum
KEVKDKNIDNNDYENKLKEKEDF

SEQ ID NO: 3319333 - protein, 14 aa, Plasmodium falciparum
KEVLSKKGSKKSNV

SEQ ID NO: 3319334 - protein, 16 aa, Plasmodium falciparum
KEVMNKNEKELNEKKN

SEQ ID NO: 3319335 - protein, 5 aa, Plasmodium falciparum
KEVNH

SEQ ID NO: 3319336 - protein, 13 aa, Plasmodium falciparum
KEVQSSLEDANKK

SEQ ID NO: 3319337 - protein, 8 aa, Plasmodium falciparum
KEVSSVDH

SEQ ID NO: 3319338 - protein, 4 aa, Plasmodium falciparum
KEVT

SEQ ID NO: 3319339 - protein, 15 aa, Plasmodium falciparum
KEVYNKDNENNNNNL

SEQ ID NO: 3319340 - protein, 22 aa, Plasmodium falciparum
KEWGSSNNQKDTEKKKKKEEFE

SEQ ID NO: 3319341 - protein, 7 aa, Plasmodium falciparum
KEYDGEE

SEQ ID NO: 3319342 - protein, 18 aa, Plasmodium falciparum
KEYDHKVTKNNKNTCNNN

SEQ ID NO: 3319343 - protein, 11 aa, Plasmodium falciparum
KEYDKDKGAAI

SEQ ID NO: 3319344 - protein, 25 aa, Plasmodium falciparum
KEYDKKGKEKGKEKENDREKKEEYN

SEQ ID NO: 3319345 - protein, 9 aa, Plasmodium falciparum
KEYEKKKKV

SEQ ID NO: 3319346 - protein, 7 aa, Plasmodium falciparum
KEYENND

SEQ ID NO: 3319347 - protein, 5 aa, Plasmodium falciparum
KEYET

SEQ ID NO: 3319348 - protein, 6 aa, Plasmodium falciparum
KEYEYK

SEQ ID NO: 3319349 - protein, 6 aa, Plasmodium falciparum
KEYGKD

SEQ ID NO: 3319350 - protein, 9 aa, Plasmodium falciparum
KEYHKKKTN

SEQ ID NO: 3319351 - protein, 6 aa, Plasmodium falciparum
KEYHNN

SEQ ID NO: 3319352 - protein, 4 aa, Plasmodium falciparum
KEYI

SEQ ID NO: 3319353 - protein, 7 aa, Plasmodium falciparum
KEYKADQ

SEQ ID NO: 3319354 - protein, 6 aa, Plasmodium falciparum
KEYKDE

SEQ ID NO: 3319355 - protein, 11 aa, Plasmodium falciparum
KEYKGGDFKQQ

SEQ ID NO: 3319356 - protein, 135 aa, Plasmodium falciparum
KEYKKKKKKNSDDSNTTDESSQDEDSKKKKKNKNKNKNKKYSDDTSSDETSDYDKSKKRKKKKKKRKYKHSSSSDESMSSSDNSSSKKNNKKKKRKKNSSSSMSSSSDSNEKKRHKKQKKSDNVNPFKLSSFFKM

SEQ ID NO: 3319357 - protein, 6 aa, Plasmodium falciparum
KEYKNT

SEQ ID NO: 3319358 - protein, 8 aa, Plasmodium falciparum
KEYKPQLS

SEQ ID NO: 3319359 - protein, 13 aa, Plasmodium falciparum
KEYKSSCKSNDIH

SEQ ID NO: 3319360 - protein, 5 aa, Plasmodium falciparum
KEYLK

SEQ ID NO: 3319361 - protein, 11 aa, Plasmodium falciparum
KEYNKNKLEDK

SEQ ID NO: 3319362 - protein, 5 aa, Plasmodium falciparum
KEYNS

SEQ ID NO: 3319363 - protein, 6 aa, Plasmodium falciparum
KEYNTS

SEQ ID NO: 3319364 - protein, 6 aa, Plasmodium falciparum
KEYRKK

SEQ ID NO: 3319365 - protein, 8 aa, Plasmodium falciparum
KEYRRDDY

SEQ ID NO: 3319366 - protein, 5 aa, Plasmodium falciparum
KEYSD

SEQ ID NO: 3319367 - protein, 6 aa, Plasmodium falciparum
KEYSDN

SEQ ID NO: 3319368 - protein, 10 aa, Plasmodium falciparum
KEYSEDKYKN

SEQ ID NO: 3319369 - protein, 5 aa, Plasmodium falciparum
KEYSF

SEQ ID NO: 3319370 - protein, 7 aa, Plasmodium falciparum
KEYSKDD

SEQ ID NO: 3319371 - protein, 8 aa, Plasmodium falciparum
KEYSKRKH

SEQ ID NO: 3319372 - protein, 8 aa, Plasmodium falciparum
KEYSNEEN

SEQ ID NO: 3319373 - protein, 10 aa, Plasmodium falciparum
KEYSQNHVKE

SEQ ID NO: 3319374 - protein, 7 aa, Plasmodium falciparum
KEYSSEI

SEQ ID NO: 3319375 - protein, 6 aa, Plasmodium falciparum
KEYTKS

SEQ ID NO: 3319376 - protein, 11 aa, Plasmodium falciparum
KEYTTHNDEKQ

SEQ ID NO: 3319377 - protein, 7 aa, Plasmodium falciparum
KEYYEDE

SEQ ID NO: 3319378 - protein, 15 aa, Plasmodium falciparum
KEYYSNASDFSGTSH

SEQ ID NO: 3319379 - protein, 10 aa, Plasmodium falciparum
KFANKKRKNQ

SEQ ID NO: 3319380 - protein, 7 aa, Plasmodium falciparum
KFDNKND

SEQ ID NO: 3319381 - protein, 15 aa, Plasmodium falciparum
KFDSPPHSCDEEDNI

SEQ ID NO: 3319382 - protein, 9 aa, Plasmodium falciparum
KFEDQTCNT

SEQ ID NO: 3319383 - protein, 7 aa, Plasmodium falciparum
KFEEDNQ

SEQ ID NO: 3319384 - protein, 5 aa, Plasmodium falciparum
KFEEN

SEQ ID NO: 3319385 - protein, 7 aa, Plasmodium falciparum
KFEKSND

SEQ ID NO: 3319386 - protein, 6 aa, Plasmodium falciparum
KFENDK

SEQ ID NO: 3319387 - protein, 5 aa, Plasmodium falciparum
KFENK

SEQ ID NO: 3319388 - protein, 6 aa, Plasmodium falciparum
KFENSH

SEQ ID NO: 3319389 - protein, 8 aa, Plasmodium falciparum
KFEQETKH

SEQ ID NO: 3319390 - protein, 4 aa, Plasmodium falciparum
KFES

SEQ ID NO: 3319391 - protein, 7 aa, Plasmodium falciparum
KFESEKY

SEQ ID NO: 3319392 - protein, 6 aa, Plasmodium falciparum
KFGADS

SEQ ID NO: 3319393 - protein, 6 aa, Plasmodium falciparum
KFGKNV

SEQ ID NO: 3319394 - protein, 10 aa, Plasmodium falciparum
KFGKQGQSKY

SEQ ID NO: 3319395 - protein, 13 aa, Plasmodium falciparum
KFKETRRKKRKQK

SEQ ID NO: 3319396 - protein, 13 aa, Plasmodium falciparum
KFKGQWKNDKANG

SEQ ID NO: 3319397 - protein, 30 aa, Plasmodium falciparum
KFKKSTDKSSVVKNKKKNSNSNNSKKKSMC

SEQ ID NO: 3319398 - protein, 19 aa, Plasmodium falciparum
KFKNEDGNNCKERKGNNKI

SEQ ID NO: 3319399 - protein, 5 aa, Plasmodium falciparum
KFKNT

SEQ ID NO: 3319400 - protein, 12 aa, Plasmodium falciparum
KFNDSRKSITEA

SEQ ID NO: 3319401 - protein, 17 aa, Plasmodium falciparum
KFNERKESLTRCSTNES

SEQ ID NO: 3319402 - protein, 6 aa, Plasmodium falciparum
KFNESS

SEQ ID NO: 3319403 - protein, 5 aa, Plasmodium falciparum
KFNGD

SEQ ID NO: 3319404 - protein, 15 aa, Plasmodium falciparum
KFNGSKNKQQEENLT

SEQ ID NO: 3319405 - protein, 16 aa, Plasmodium falciparum
KFNKEELEQFEKDILN

SEQ ID NO: 3319406 - protein, 13 aa, Plasmodium falciparum
KFNKKTKKQIKKN

SEQ ID NO: 3319407 - protein, 5 aa, Plasmodium falciparum
KFNNK

SEQ ID NO: 3319408 - protein, 15 aa, Plasmodium falciparum
KFNNNNNNNNKTTGY

SEQ ID NO: 3319409 - protein, 29 aa, Plasmodium falciparum
KFNNNNYDNNDEYKKSHPKNYQNIQNDNN

SEQ ID NO: 3319410 - protein, 5 aa, Plasmodium falciparum
KFNNS

SEQ ID NO: 3319411 - protein, 4 aa, Plasmodium falciparum
KFNR

SEQ ID NO: 3319412 - protein, 4 aa, Plasmodium falciparum
KFNS

SEQ ID NO: 3319413 - protein, 30 aa, Plasmodium falciparum
KFNTKKDKSNNEQVHDEDKNNTNNKKKKTL

SEQ ID NO: 3319414 - protein, 6 aa, Plasmodium falciparum
KFNTND

SEQ ID NO: 3319415 - protein, 9 aa, Plasmodium falciparum
KFPDNSQNK

SEQ ID NO: 3319416 - protein, 6 aa, Plasmodium falciparum
KFPGIN

SEQ ID NO: 3319417 - protein, 5 aa, Plasmodium falciparum
KFPGR

SEQ ID NO: 3319418 - protein, 9 aa, Plasmodium falciparum
KFPKSSDKK

SEQ ID NO: 3319419 - protein, 6 aa, Plasmodium falciparum
KFPPNT

SEQ ID NO: 3319420 - protein, 30 aa, Plasmodium falciparum
KFQDKSKQVTNKTNKSTNLNKTNYTNQQSV

SEQ ID NO: 3319421 - protein, 6 aa, Plasmodium falciparum
KFQETQ

SEQ ID NO: 3319422 - protein, 5 aa, Plasmodium falciparum
KFQNE

SEQ ID NO: 3319423 - protein, 4 aa, Plasmodium falciparum
KFQQ

SEQ ID NO: 3319424 - protein, 7 aa, Plasmodium falciparum
KFQTKDL

SEQ ID NO: 3319425 - protein, 12 aa, Plasmodium falciparum
KFRGGPSTSVDE

SEQ ID NO: 3319426 - protein, 10 aa, Plasmodium falciparum
KFRNNKQQGE

SEQ ID NO: 3319427 - protein, 4 aa, Plasmodium falciparum
KFSD

SEQ ID NO: 3319428 - protein, 6 aa, Plasmodium falciparum
KFSDNQ

SEQ ID NO: 3319429 - protein, 12 aa, Plasmodium falciparum
KFSDSNKDNTFV

SEQ ID NO: 3319430 - protein, 4 aa, Plasmodium falciparum
KFSI

SEQ ID NO: 3319431 - protein, 9 aa, Plasmodium falciparum
KFSKKDPNV

SEQ ID NO: 3319432 - protein, 9 aa, Plasmodium falciparum
KFSKSKKVH

SEQ ID NO: 3319433 - protein, 7 aa, Plasmodium falciparum
KFSNNNM

SEQ ID NO: 3319434 - protein, 11 aa, Plasmodium falciparum
KFSPSRKTGVE

SEQ ID NO: 3319435 - protein, 14 aa, Plasmodium falciparum
KFSPTQSPKSPTSV

SEQ ID NO: 3319436 - protein, 10 aa, Plasmodium falciparum
KFSQENDPVS

SEQ ID NO: 3319437 - protein, 5 aa, Plasmodium falciparum
KFSTS

SEQ ID NO: 3319438 - protein, 4 aa, Plasmodium falciparum
KFTE

SEQ ID NO: 3319439 - protein, 12 aa, Plasmodium falciparum
KFTEGSTPKPKQ

SEQ ID NO: 3319440 - protein, 9 aa, Plasmodium falciparum
KFTSSNNED

SEQ ID NO: 3319441 - protein, 4 aa, Plasmodium falciparum
KFYD

SEQ ID NO: 3319442 - protein, 6 aa, Plasmodium falciparum
KFYPSN

SEQ ID NO: 3319443 - protein, 6 aa, Plasmodium falciparum
KGADAS

SEQ ID NO: 3319444 - protein, 25 aa, Plasmodium falciparum
KGAGAEEDDENNSNLDNTNNENNIN

SEQ ID NO: 3319445 - protein, 6 aa, Plasmodium falciparum
KGAHEE

SEQ ID NO: 3319446 - protein, 5 aa, Plasmodium falciparum
KGAIN

SEQ ID NO: 3319447 - protein, 7 aa, Plasmodium falciparum
KGAITEK

SEQ ID NO: 3319448 - protein, 10 aa, Plasmodium falciparum
KGANNNPDQI

SEQ ID NO: 3319449 - protein, 12 aa, Plasmodium falciparum
KGANSNDSQRNY

SEQ ID NO: 3319450 - protein, 6 aa, Plasmodium falciparum
KGAPNK

SEQ ID NO: 3319451 - protein, 9 aa, Plasmodium falciparum
KGAQRMEES

SEQ ID NO: 3319452 - protein, 5 aa, Plasmodium falciparum
KGASV

SEQ ID NO: 3319453 - protein, 16 aa, Plasmodium falciparum
KGATTNESVSPSKLEQ

SEQ ID NO: 3319454 - protein, 9 aa, Plasmodium falciparum
KGCKDFTGE

SEQ ID NO: 3319455 - protein, 6 aa, Plasmodium falciparum
KGCRYE

SEQ ID NO: 3319456 - protein, 5 aa, Plasmodium falciparum
KGCTK

SEQ ID NO: 3319457 - protein, 6 aa, Plasmodium falciparum
KGDAPP

SEQ ID NO: 3319458 - protein, 11 aa, Plasmodium falciparum
KGDDKKKKKTK

SEQ ID NO: 3319459 - protein, 10 aa, Plasmodium falciparum
KGDDNKGGTM

SEQ ID NO: 3319460 - protein, 10 aa, Plasmodium falciparum
KGDDNNTNKV

SEQ ID NO: 3319461 - protein, 13 aa, Plasmodium falciparum
KGDDNYNDEDKNN

SEQ ID NO: 3319462 - protein, 5 aa, Plasmodium falciparum
KGDDT

SEQ ID NO: 3319463 - protein, 7 aa, Plasmodium falciparum
KGDEEHK

SEQ ID NO: 3319464 - protein, 16 aa, Plasmodium falciparum
KGDEGEENIPKKGNEV

SEQ ID NO: 3319465 - protein, 6 aa, Plasmodium falciparum
KGDFQD

SEQ ID NO: 3319466 - protein, 68 aa, Plasmodium falciparum
KGDGKDGDKKEDNDDKEEDDDKEEDNNKEEDNDKEEDNDKEEDNDNNDDNNDDNNDDNNDDGDDNDDN

SEQ ID NO: 3319467 - protein, 13 aa, Plasmodium falciparum
KGDGMENNNIPQL

SEQ ID NO: 3319468 - protein, 5 aa, Plasmodium falciparum
KGDID

SEQ ID NO: 3319469 - protein, 8 aa, Plasmodium falciparum
KGDIKNKE

SEQ ID NO: 3319470 - protein, 6 aa, Plasmodium falciparum
KGDKDR

SEQ ID NO: 3319471 - protein, 116 aa, Plasmodium falciparum
KGDKKSEDMKEDTPTRGENLQRGQNLQRGDNLQRGDNLQRGDNLQRGDNLQNGDNLQNGDNLQRGDNLQNGENLQSGENLQSGENLQSGENLQTRENLQSGENLQTRENLQSDENH

SEQ ID NO: 3319472 - protein, 48 aa, Plasmodium falciparum
KGDKSDKKNKSKSNADDKSKESPSTENEGQPTKSKRGAKSWMSFGKGK

SEQ ID NO: 3319473 - protein, 4 aa, Plasmodium falciparum
KGDL

SEQ ID NO: 3319474 - protein, 8 aa, Plasmodium falciparum
KGDLENYG

SEQ ID NO: 3319475 - protein, 4 aa, Plasmodium falciparum
KGDM

SEQ ID NO: 3319476 - protein, 72 aa, Plasmodium falciparum
KGDMNNKSLSAHNANNNNNNNNNGNGNSNKNTKNIKNNTNGTNSTTNSTNNANGNNNNNNNNNGNNNNYTGG

SEQ ID NO: 3319477 - protein, 4 aa, Plasmodium falciparum
KGDN

SEQ ID NO: 3319478 - protein, 12 aa, Plasmodium falciparum
KGDNEHKSGYEE

SEQ ID NO: 3319479 - protein, 6 aa, Plasmodium falciparum
KGDNHL

SEQ ID NO: 3319480 - protein, 7 aa, Plasmodium falciparum
KGDNKMK

SEQ ID NO: 3319481 - protein, 11 aa, Plasmodium falciparum
KGDNSGEQSKS

SEQ ID NO: 3319482 - protein, 6 aa, Plasmodium falciparum
KGDNTN

SEQ ID NO: 3319483 - protein, 5 aa, Plasmodium falciparum
KGDNV

SEQ ID NO: 3319484 - protein, 9 aa, Plasmodium falciparum
KGDQETNEF

SEQ ID NO: 3319485 - protein, 7 aa, Plasmodium falciparum
KGDQKHN

SEQ ID NO: 3319486 - protein, 12 aa, Plasmodium falciparum
KGDTRKNDEEEE

SEQ ID NO: 3319487 - protein, 4 aa, Plasmodium falciparum
KGDV

SEQ ID NO: 3319488 - protein, 54 aa, Plasmodium falciparum
KGDVKDKEDIEVGSKTKKKKSQSNNTTSSSSSNNWNNNLDGEGDKEKKNKTKVI

SEQ ID NO: 3319489 - protein, 7 aa, Plasmodium falciparum
KGDVSKS

SEQ ID NO: 3319490 - protein, 4 aa, Plasmodium falciparum
KGEC

SEQ ID NO: 3319491 - protein, 6 aa, Plasmodium falciparum
KGEDDK

SEQ ID NO: 3319492 - protein, 8 aa, Plasmodium falciparum
KGEDKDTK

SEQ ID NO: 3319493 - protein, 9 aa, Plasmodium falciparum
KGEDSYKQI

SEQ ID NO: 3319494 - protein, 9 aa, Plasmodium falciparum
KGEDTSDLD

SEQ ID NO: 3319495 - protein, 6 aa, Plasmodium falciparum
KGEEAN

SEQ ID NO: 3319496 - protein, 8 aa, Plasmodium falciparum
KGEEDKSV

SEQ ID NO: 3319497 - protein, 6 aa, Plasmodium falciparum
KGEEDL

SEQ ID NO: 3319498 - protein, 7 aa, Plasmodium falciparum
KGEEEDI

SEQ ID NO: 3319499 - protein, 5 aa, Plasmodium falciparum
KGEEH

SEQ ID NO: 3319500 - protein, 5 aa, Plasmodium falciparum
KGEEI

SEQ ID NO: 3319501 - protein, 11 aa, Plasmodium falciparum
KGEEIENNENA

SEQ ID NO: 3319502 - protein, 19 aa, Plasmodium falciparum
KGEEKNNDMPLKNDDKDTC

SEQ ID NO: 3319503 - protein, 5 aa, Plasmodium falciparum
KGEEL

SEQ ID NO: 3319504 - protein, 23 aa, Plasmodium falciparum
KGEENNKNVKKNTTKCNEQNNNK

SEQ ID NO: 3319505 - protein, 6 aa, Plasmodium falciparum
KGEEQY

SEQ ID NO: 3319506 - protein, 6 aa, Plasmodium falciparum
KGEFET

SEQ ID NO: 3319507 - protein, 7 aa, Plasmodium falciparum
KGEGLEN

SEQ ID NO: 3319508 - protein, 13 aa, Plasmodium falciparum
KGEGLGKDKQGIK

SEQ ID NO: 3319509 - protein, 9 aa, Plasmodium falciparum
KGEIAKKSE

SEQ ID NO: 3319510 - protein, 5 aa, Plasmodium falciparum
KGEIH

SEQ ID NO: 3319511 - protein, 16 aa, Plasmodium falciparum
KGEKAEKIEGKKKKVS

SEQ ID NO: 3319512 - protein, 6 aa, Plasmodium falciparum
KGEKEG

SEQ ID NO: 3319513 - protein, 17 aa, Plasmodium falciparum
KGEKKNPSDKKQSNEIS

SEQ ID NO: 3319514 - protein, 5 aa, Plasmodium falciparum
KGEKN

SEQ ID NO: 3319515 - protein, 11 aa, Plasmodium falciparum
KGELQNKCSEG

SEQ ID NO: 3319516 - protein, 21 aa, Plasmodium falciparum
KGENEEEEDSHIKKSNDKVKN

SEQ ID NO: 3319517 - protein, 23 aa, Plasmodium falciparum
KGENHYNNNNNNNNNECKYNNKR

SEQ ID NO: 3319518 - protein, 6 aa, Plasmodium falciparum
KGENIN

SEQ ID NO: 3319519 - protein, 6 aa, Plasmodium falciparum
KGEQFD

SEQ ID NO: 3319520 - protein, 35 aa, Plasmodium falciparum
KGESDTSAMSNSKRREIRRAKRKKEKELDEQDKLD

SEQ ID NO: 3319521 - protein, 5 aa, Plasmodium falciparum
KGESN

SEQ ID NO: 3319522 - protein, 10 aa, Plasmodium falciparum
KGESSGASNI

SEQ ID NO: 3319523 - protein, 9 aa, Plasmodium falciparum
KGETENFET

SEQ ID NO: 3319524 - protein, 22 aa, Plasmodium falciparum
KGETTGGEGSLKSPPSIKKDND

SEQ ID NO: 3319525 - protein, 6 aa, Plasmodium falciparum
KGEVHK

SEQ ID NO: 3319526 - protein, 18 aa, Plasmodium falciparum
KGFNEQDGSFLTPIWFHN

SEQ ID NO: 3319527 - protein, 10 aa, Plasmodium falciparum
KGFPEAKNDP

SEQ ID NO: 3319528 - protein, 10 aa, Plasmodium falciparum
KGGAVKQGPN

SEQ ID NO: 3319529 - protein, 7 aa, Plasmodium falciparum
KGGEDHS

SEQ ID NO: 3319530 - protein, 9 aa, Plasmodium falciparum
KGGEEKQKK

SEQ ID NO: 3319531 - protein, 9 aa, Plasmodium falciparum
KGGEPDITS

SEQ ID NO: 3319532 - protein, 8 aa, Plasmodium falciparum
KGGESTLK

SEQ ID NO: 3319533 - protein, 8 aa, Plasmodium falciparum
KGGGKDQA

SEQ ID NO: 3319534 - protein, 8 aa, Plasmodium falciparum
KGGGKIDA

SEQ ID NO: 3319535 - protein, 8 aa, Plasmodium falciparum
KGGGQTSQ

SEQ ID NO: 3319536 - protein, 4 aa, Plasmodium falciparum
KGGH

SEQ ID NO: 3319537 - protein, 4 aa, Plasmodium falciparum
KGGI

SEQ ID NO: 3319538 - protein, 10 aa, Plasmodium falciparum
KGGISDNPDC

SEQ ID NO: 3319539 - protein, 14 aa, Plasmodium falciparum
KGGKGGKGNYSYRT

SEQ ID NO: 3319540 - protein, 11 aa, Plasmodium falciparum
KGGKKRKASHD

SEQ ID NO: 3319541 - protein, 11 aa, Plasmodium falciparum
KGGNFNNTSGN

SEQ ID NO: 3319542 - protein, 52 aa, Plasmodium falciparum
KGGNNNNNNNNNNSGTYVKNKKSSKYDNKSYGGDGIPRKEMKKERSKKSQKL

SEQ ID NO: 3319543 - protein, 21 aa, Plasmodium falciparum
KGGNPDKIKESERKRYHDENN

SEQ ID NO: 3319544 - protein, 10 aa, Plasmodium falciparum
KGGPEKEKRF

SEQ ID NO: 3319545 - protein, 7 aa, Plasmodium falciparum
KGGQQIK

SEQ ID NO: 3319546 - protein, 4 aa, Plasmodium falciparum
KGGR

SEQ ID NO: 3319547 - protein, 5 aa, Plasmodium falciparum
KGGRP

SEQ ID NO: 3319548 - protein, 9 aa, Plasmodium falciparum
KGGSDGKPM

SEQ ID NO: 3319549 - protein, 17 aa, Plasmodium falciparum
KGGSIYDGDDQDSTNKP

SEQ ID NO: 3319550 - protein, 10 aa, Plasmodium falciparum
KGGVGKTTTS

SEQ ID NO: 3319551 - protein, 8 aa, Plasmodium falciparum
KGGVSQER

SEQ ID NO: 3319552 - protein, 15 aa, Plasmodium falciparum
KGGYGKNNKKAKKLS

SEQ ID NO: 3319553 - protein, 6 aa, Plasmodium falciparum
KGHEDT

SEQ ID NO: 3319554 - protein, 7 aa, Plasmodium falciparum
KGHGTKG

SEQ ID NO: 3319555 - protein, 8 aa, Plasmodium falciparum
KGHSAYKN

SEQ ID NO: 3319556 - protein, 5 aa, Plasmodium falciparum
KGHSI

SEQ ID NO: 3319557 - protein, 6 aa, Plasmodium falciparum
KGHTQN

SEQ ID NO: 3319558 - protein, 6 aa, Plasmodium falciparum
KGIDEN

SEQ ID NO: 3319559 - protein, 14 aa, Plasmodium falciparum
KGIEKKGDENVQPT

SEQ ID NO: 3319560 - protein, 6 aa, Plasmodium falciparum
KGIENE

SEQ ID NO: 3319561 - protein, 8 aa, Plasmodium falciparum
KGIETIEG

SEQ ID NO: 3319562 - protein, 8 aa, Plasmodium falciparum
KGIHTTGN

SEQ ID NO: 3319563 - protein, 11 aa, Plasmodium falciparum
KGIINGDEKNV

SEQ ID NO: 3319564 - protein, 23 aa, Plasmodium falciparum
KGIKDKVTKGAEKRGKSLKGNLS

SEQ ID NO: 3319565 - protein, 14 aa, Plasmodium falciparum
KGILENEDNKQLND

SEQ ID NO: 3319566 - protein, 26 aa, Plasmodium falciparum
KGINKGEKIKSNKKENKDNNNDSSTE

SEQ ID NO: 3319567 - protein, 17 aa, Plasmodium falciparum
KGINPDKPRCLAKTVTV

SEQ ID NO: 3319568 - protein, 11 aa, Plasmodium falciparum
KGISGGDKVST

SEQ ID NO: 3319569 - protein, 6 aa, Plasmodium falciparum
KGISTA

SEQ ID NO: 3319570 - protein, 20 aa, Plasmodium falciparum
KGKAFQPSFSSSIKEKTITN

SEQ ID NO: 3319571 - protein, 20 aa, Plasmodium falciparum
KGKCDDMKRKEDDKLSCSSV

SEQ ID NO: 3319572 - protein, 10 aa, Plasmodium falciparum
KGKDELKESI

SEQ ID NO: 3319573 - protein, 6 aa, Plasmodium falciparum
KGKDTK

SEQ ID NO: 3319574 - protein, 38 aa, Plasmodium falciparum
KGKDTKKYISSDNNNNNNNNNSNDSNNNNSNNSSNNSD

SEQ ID NO: 3319575 - protein, 4 aa, Plasmodium falciparum
KGKE

SEQ ID NO: 3319576 - protein, 14 aa, Plasmodium falciparum
KGKEEKNKKRNNSY

SEQ ID NO: 3319577 - protein, 18 aa, Plasmodium falciparum
KGKEENDTHDNNNNNNNI

SEQ ID NO: 3319578 - protein, 8 aa, Plasmodium falciparum
KGKEKKKV

SEQ ID NO: 3319579 - protein, 11 aa, Plasmodium falciparum
KGKENNYIDDN

SEQ ID NO: 3319580 - protein, 7 aa, Plasmodium falciparum
KGKGDQR

SEQ ID NO: 3319581 - protein, 16 aa, Plasmodium falciparum
KGKGKDTKKDSVRSTL

SEQ ID NO: 3319582 - protein, 12 aa, Plasmodium falciparum
KGKGLGKHENGD

SEQ ID NO: 3319583 - protein, 4 aa, Plasmodium falciparum
KGKI

SEQ ID NO: 3319584 - protein, 6 aa, Plasmodium falciparum
KGKIER

SEQ ID NO: 3319585 - protein, 12 aa, Plasmodium falciparum
KGKKELNKRTGE

SEQ ID NO: 3319586 - protein, 8 aa, Plasmodium falciparum
KGKKGFKK

SEQ ID NO: 3319587 - protein, 12 aa, Plasmodium falciparum
KGKKKKKNTNIM

SEQ ID NO: 3319588 - protein, 9 aa, Plasmodium falciparum
KGKKKRYIN

SEQ ID NO: 3319589 - protein, 10 aa, Plasmodium falciparum
KGKKKSFKNN

SEQ ID NO: 3319590 - protein, 49 aa, Plasmodium falciparum
KGKKNNSNNNNNDNNDNNDNNNSNNSNNNNNNNNNNSNEYTKRKNTHKK

SEQ ID NO: 3319591 - protein, 10 aa, Plasmodium falciparum
KGKKNTKTYQ

SEQ ID NO: 3319592 - protein, 8 aa, Plasmodium falciparum
KGKKQNNN

SEQ ID NO: 3319593 - protein, 6 aa, Plasmodium falciparum
KGKKRT

SEQ ID NO: 3319594 - protein, 27 aa, Plasmodium falciparum
KGKKSNSQSKLGKDTKIRGKSKTGEYI

SEQ ID NO: 3319595 - protein, 14 aa, Plasmodium falciparum
KGKLSQLKNGNQKT

SEQ ID NO: 3319596 - protein, 4 aa, Plasmodium falciparum
KGKN

SEQ ID NO: 3319597 - protein, 43 aa, Plasmodium falciparum
KGKNDIKKNNNKKNNNKNNNNKNNNNNNNKSSNMKKRNNNHDK

SEQ ID NO: 3319598 - protein, 7 aa, Plasmodium falciparum
KGKNDSK

SEQ ID NO: 3319599 - protein, 20 aa, Plasmodium falciparum
KGKNEVKKEKKKRNKNKYQD

SEQ ID NO: 3319600 - protein, 7 aa, Plasmodium falciparum
KGKNIPG

SEQ ID NO: 3319601 - protein, 6 aa, Plasmodium falciparum
KGKNKC

SEQ ID NO: 3319602 - protein, 137 aa, Plasmodium falciparum
KGKNKMNQSEINNSVSNMGNDTIKREDQHGKHSQHGKHDQHGKHDQHGKHDQHGKHDQHGKHDQHGKHDQHGKHDQHGKHDQHGKHDQHGKHDQHGKHDQHGKHDQHGKHNQHDQHDQHDQHGKHNQHDQHDQHDQH

SEQ ID NO: 3319603 - protein, 7 aa, Plasmodium falciparum
KGKNNVK

SEQ ID NO: 3319604 - protein, 9 aa, Plasmodium falciparum
KGKNPEKKS

SEQ ID NO: 3319605 - protein, 10 aa, Plasmodium falciparum
KGKNVTSNRR

SEQ ID NO: 3319606 - protein, 6 aa, Plasmodium falciparum
KGKNYY

SEQ ID NO: 3319607 - protein, 8 aa, Plasmodium falciparum
KGKQKNKS

SEQ ID NO: 3319608 - protein, 14 aa, Plasmodium falciparum
KGKRKRNDEEASVG

SEQ ID NO: 3319609 - protein, 5 aa, Plasmodium falciparum
KGKSG

SEQ ID NO: 3319610 - protein, 17 aa, Plasmodium falciparum
KGKSKTEKGEEQKKEQL

SEQ ID NO: 3319611 - protein, 8 aa, Plasmodium falciparum
KGKSPPFI

SEQ ID NO: 3319612 - protein, 36 aa, Plasmodium falciparum
KGKSYSGDEKINTSDNAKSCSGDEKVITSDNGKSYD

SEQ ID NO: 3319613 - protein, 8 aa, Plasmodium falciparum
KGKTADKS

SEQ ID NO: 3319614 - protein, 7 aa, Plasmodium falciparum
KGKTENI

SEQ ID NO: 3319615 - protein, 7 aa, Plasmodium falciparum
KGKTGLS

SEQ ID NO: 3319616 - protein, 13 aa, Plasmodium falciparum
KGKTKENSSKNKY

SEQ ID NO: 3319617 - protein, 29 aa, Plasmodium falciparum
KGKTNENYEHEQREGEKEEKQKENDTYGD

SEQ ID NO: 3319618 - protein, 10 aa, Plasmodium falciparum
KGKTNHKDNV

SEQ ID NO: 3319619 - protein, 12 aa, Plasmodium falciparum
KGKTQNINSNKK

SEQ ID NO: 3319620 - protein, 7 aa, Plasmodium falciparum
KGKTSSN

SEQ ID NO: 3319621 - protein, 6 aa, Plasmodium falciparum
KGKYDK

SEQ ID NO: 3319622 - protein, 6 aa, Plasmodium falciparum
KGKYEN

SEQ ID NO: 3319623 - protein, 15 aa, Plasmodium falciparum
KGKYGSNNNKQLDNN

SEQ ID NO: 3319624 - protein, 8 aa, Plasmodium falciparum
KGKYKQVN

SEQ ID NO: 3319625 - protein, 7 aa, Plasmodium falciparum
KGLDNEY

SEQ ID NO: 3319626 - protein, 14 aa, Plasmodium falciparum
KGLEENKGRKRRRI

SEQ ID NO: 3319627 - protein, 7 aa, Plasmodium falciparum
KGLETNE

SEQ ID NO: 3319628 - protein, 6 aa, Plasmodium falciparum
KGLGNE

SEQ ID NO: 3319629 - protein, 9 aa, Plasmodium falciparum
KGLIPQNDN

SEQ ID NO: 3319630 - protein, 22 aa, Plasmodium falciparum
KGLKKGSLKSKTRKSTSGSKFK

SEQ ID NO: 3319631 - protein, 4 aa, Plasmodium falciparum
KGLN

SEQ ID NO: 3319632 - protein, 31 aa, Plasmodium falciparum
KGLPASNENNNENKNDNNGNNNNSADGKGII

SEQ ID NO: 3319633 - protein, 8 aa, Plasmodium falciparum
KGLSNNAS

SEQ ID NO: 3319634 - protein, 17 aa, Plasmodium falciparum
KGMASDDSSNDGKKKSV

SEQ ID NO: 3319635 - protein, 5 aa, Plasmodium falciparum
KGMKK

SEQ ID NO: 3319636 - protein, 13 aa, Plasmodium falciparum
KGMNRNNSVTGNI

SEQ ID NO: 3319637 - protein, 11 aa, Plasmodium falciparum
KGMNSSTGGHK

SEQ ID NO: 3319638 - protein, 10 aa, Plasmodium falciparum
KGNAEGTKGT

SEQ ID NO: 3319639 - protein, 5 aa, Plasmodium falciparum
KGNAY

SEQ ID NO: 3319640 - protein, 5 aa, Plasmodium falciparum
KGNDI

SEQ ID NO: 3319641 - protein, 7 aa, Plasmodium falciparum
KGNDNIE

SEQ ID NO: 3319642 - protein, 14 aa, Plasmodium falciparum
KGNDTIKDGENYIP

SEQ ID NO: 3319643 - protein, 5 aa, Plasmodium falciparum
KGNEF

SEQ ID NO: 3319644 - protein, 6 aa, Plasmodium falciparum
KGNEIT

SEQ ID NO: 3319645 - protein, 7 aa, Plasmodium falciparum
KGNEKPL

SEQ ID NO: 3319646 - protein, 9 aa, Plasmodium falciparum
KGNENKNYK

SEQ ID NO: 3319647 - protein, 5 aa, Plasmodium falciparum
KGNEP

SEQ ID NO: 3319648 - protein, 7 aa, Plasmodium falciparum
KGNEQEK

SEQ ID NO: 3319649 - protein, 19 aa, Plasmodium falciparum
KGNEQNVKNTNNINEEDNI

SEQ ID NO: 3319650 - protein, 5 aa, Plasmodium falciparum
KGNES

SEQ ID NO: 3319651 - protein, 6 aa, Plasmodium falciparum
KGNGHN

SEQ ID NO: 3319652 - protein, 7 aa, Plasmodium falciparum
KGNGKGV

SEQ ID NO: 3319653 - protein, 6 aa, Plasmodium falciparum
KGNGTI

SEQ ID NO: 3319654 - protein, 4 aa, Plasmodium falciparum
KGNI

SEQ ID NO: 3319655 - protein, 5 aa, Plasmodium falciparum
KGNIK

SEQ ID NO: 3319656 - protein, 6 aa, Plasmodium falciparum
KGNIKQ

SEQ ID NO: 3319657 - protein, 7 aa, Plasmodium falciparum
KGNISEN

SEQ ID NO: 3319658 - protein, 10 aa, Plasmodium falciparum
KGNITKQQNQ

SEQ ID NO: 3319659 - protein, 6 aa, Plasmodium falciparum
KGNKDI

SEQ ID NO: 3319660 - protein, 9 aa, Plasmodium falciparum
KGNKKTPKY

SEQ ID NO: 3319661 - protein, 5 aa, Plasmodium falciparum
KGNKN

SEQ ID NO: 3319662 - protein, 7 aa, Plasmodium falciparum
KGNKPNM

SEQ ID NO: 3319663 - protein, 7 aa, Plasmodium falciparum
KGNKSAR

SEQ ID NO: 3319664 - protein, 6 aa, Plasmodium falciparum
KGNKSE

SEQ ID NO: 3319665 - protein, 13 aa, Plasmodium falciparum
KGNKTHDPIKTKQ

SEQ ID NO: 3319666 - protein, 9 aa, Plasmodium falciparum
KGNKYTSNV

SEQ ID NO: 3319667 - protein, 8 aa, Plasmodium falciparum
KGNLSNYD

SEQ ID NO: 3319668 - protein, 8 aa, Plasmodium falciparum
KGNMDAPK

SEQ ID NO: 3319669 - protein, 7 aa, Plasmodium falciparum
KGNMDDT

SEQ ID NO: 3319670 - protein, 5 aa, Plasmodium falciparum
KGNME

SEQ ID NO: 3319671 - protein, 7 aa, Plasmodium falciparum
KGNMNNV

SEQ ID NO: 3319672 - protein, 10 aa, Plasmodium falciparum
KGNMTNEQKL

SEQ ID NO: 3319673 - protein, 6 aa, Plasmodium falciparum
KGNNFE

SEQ ID NO: 3319674 - protein, 15 aa, Plasmodium falciparum
KGNNIPKQPNHSNDT

SEQ ID NO: 3319675 - protein, 16 aa, Plasmodium falciparum
KGNNKENNINNEKKKD

SEQ ID NO: 3319676 - protein, 32 aa, Plasmodium falciparum
KGNNKKNDGHTRNELNKGKLKETGTMNKSEMD

SEQ ID NO: 3319677 - protein, 47 aa, Plasmodium falciparum
KGNNKTRDRKPLGGNEDDTKEERERNEERNDEQQKERQAQNEYDGDY

SEQ ID NO: 3319678 - protein, 21 aa, Plasmodium falciparum
KGNNMNDTNNVDNMDDTNNMD

SEQ ID NO: 3319679 - protein, 9 aa, Plasmodium falciparum
KGNNNKRSK

SEQ ID NO: 3319680 - protein, 10 aa, Plasmodium falciparum
KGNNNPNECP

SEQ ID NO: 3319681 - protein, 8 aa, Plasmodium falciparum
KGNNSLKY

SEQ ID NO: 3319682 - protein, 5 aa, Plasmodium falciparum
KGNNT

SEQ ID NO: 3319683 - protein, 6 aa, Plasmodium falciparum
KGNREI

SEQ ID NO: 3319684 - protein, 14 aa, Plasmodium falciparum
KGNRKYTNGNTKVK

SEQ ID NO: 3319685 - protein, 6 aa, Plasmodium falciparum
KGNRSA

SEQ ID NO: 3319686 - protein, 12 aa, Plasmodium falciparum
KGNSRRRNSASR

SEQ ID NO: 3319687 - protein, 8 aa, Plasmodium falciparum
KGNSSSDM

SEQ ID NO: 3319688 - protein, 12 aa, Plasmodium falciparum
KGNSSSSSSSFS

SEQ ID NO: 3319689 - protein, 7 aa, Plasmodium falciparum
KGNSVRR

SEQ ID NO: 3319690 - protein, 7 aa, Plasmodium falciparum
KGNSYTD

SEQ ID NO: 3319691 - protein, 10 aa, Plasmodium falciparum
KGNTIKNNDE

SEQ ID NO: 3319692 - protein, 6 aa, Plasmodium falciparum
KGNVPK

SEQ ID NO: 3319693 - protein, 7 aa, Plasmodium falciparum
KGNVQNG

SEQ ID NO: 3319694 - protein, 5 aa, Plasmodium falciparum
KGNWP

SEQ ID NO: 3319695 - protein, 4 aa, Plasmodium falciparum
KGNY

SEQ ID NO: 3319696 - protein, 9 aa, Plasmodium falciparum
KGNYDGNTN

SEQ ID NO: 3319697 - protein, 6 aa, Plasmodium falciparum
KGNYGN

SEQ ID NO: 3319698 - protein, 8 aa, Plasmodium falciparum
KGNYPYDE

SEQ ID NO: 3319699 - protein, 12 aa, Plasmodium falciparum
KGNYYSSEENIN

SEQ ID NO: 3319700 - protein, 6 aa, Plasmodium falciparum
KGPEIR

SEQ ID NO: 3319701 - protein, 8 aa, Plasmodium falciparum
KGPISGRR

SEQ ID NO: 3319702 - protein, 9 aa, Plasmodium falciparum
KGPKKGREP

SEQ ID NO: 3319703 - protein, 5 aa, Plasmodium falciparum
KGPLD

SEQ ID NO: 3319704 - protein, 7 aa, Plasmodium falciparum
KGPLPNQ

SEQ ID NO: 3319705 - protein, 6 aa, Plasmodium falciparum
KGPPIQ

SEQ ID NO: 3319706 - protein, 8 aa, Plasmodium falciparum
KGPPKNVK

SEQ ID NO: 3319707 - protein, 6 aa, Plasmodium falciparum
KGPSSI

SEQ ID NO: 3319708 - protein, 5 aa, Plasmodium falciparum
KGPVR

SEQ ID NO: 3319709 - protein, 8 aa, Plasmodium falciparum
KGPVTTDN

SEQ ID NO: 3319710 - protein, 23 aa, Plasmodium falciparum
KGPWEEKETNKKEQNEEKQDLLN

SEQ ID NO: 3319711 - protein, 10 aa, Plasmodium falciparum
KGQAQYERAE

SEQ ID NO: 3319712 - protein, 5 aa, Plasmodium falciparum
KGQDS

SEQ ID NO: 3319713 - protein, 6 aa, Plasmodium falciparum
KGQEPH

SEQ ID NO: 3319714 - protein, 6 aa, Plasmodium falciparum
KGQKIQ

SEQ ID NO: 3319715 - protein, 8 aa, Plasmodium falciparum
KGQKNKER

SEQ ID NO: 3319716 - protein, 4 aa, Plasmodium falciparum
KGQL

SEQ ID NO: 3319717 - protein, 4 aa, Plasmodium falciparum
KGQN

SEQ ID NO: 3319718 - protein, 17 aa, Plasmodium falciparum
KGQNDAGVNDEAPTEKV

SEQ ID NO: 3319719 - protein, 7 aa, Plasmodium falciparum
KGQNENI

SEQ ID NO: 3319720 - protein, 6 aa, Plasmodium falciparum
KGQNIN

SEQ ID NO: 3319721 - protein, 52 aa, Plasmodium falciparum
KGQNNNTCSNKKMDDLSNDNNLSNDNDLSNDNLKSDTEREIKYPSKEKISKN

SEQ ID NO: 3319722 - protein, 5 aa, Plasmodium falciparum
KGQNY

SEQ ID NO: 3319723 - protein, 12 aa, Plasmodium falciparum
KGQTNKSKTYDN

SEQ ID NO: 3319724 - protein, 15 aa, Plasmodium falciparum
KGQTQLSNNQKKMNT

SEQ ID NO: 3319725 - protein, 5 aa, Plasmodium falciparum
KGRDK

SEQ ID NO: 3319726 - protein, 25 aa, Plasmodium falciparum
KGRDKVNDDDNNKNNIEKEKATNKY

SEQ ID NO: 3319727 - protein, 16 aa, Plasmodium falciparum
KGREEDNSKNKSTLSG

SEQ ID NO: 3319728 - protein, 8 aa, Plasmodium falciparum
KGRHRGNY

SEQ ID NO: 3319729 - protein, 8 aa, Plasmodium falciparum
KGRHSSNN

SEQ ID NO: 3319730 - protein, 18 aa, Plasmodium falciparum
KGRKFEKARGRRKSRAYK

SEQ ID NO: 3319731 - protein, 8 aa, Plasmodium falciparum
KGRNEESG

SEQ ID NO: 3319732 - protein, 7 aa, Plasmodium falciparum
KGRNESS

SEQ ID NO: 3319733 - protein, 12 aa, Plasmodium falciparum
KGRNKKLKNNEE

SEQ ID NO: 3319734 - protein, 8 aa, Plasmodium falciparum
KGRPNKIK

SEQ ID NO: 3319735 - protein, 7 aa, Plasmodium falciparum
KGRQQDD

SEQ ID NO: 3319736 - protein, 8 aa, Plasmodium falciparum
KGRSDPRH

SEQ ID NO: 3319737 - protein, 23 aa, Plasmodium falciparum
KGRSKSPSAPNINPTSLEKRNIN

SEQ ID NO: 3319738 - protein, 8 aa, Plasmodium falciparum
KGSAEEKE

SEQ ID NO: 3319739 - protein, 6 aa, Plasmodium falciparum
KGSCNP

SEQ ID NO: 3319740 - protein, 5 aa, Plasmodium falciparum
KGSDA

SEQ ID NO: 3319741 - protein, 8 aa, Plasmodium falciparum
KGSEDSIN

SEQ ID NO: 3319742 - protein, 9 aa, Plasmodium falciparum
KGSEEKFQN

SEQ ID NO: 3319743 - protein, 6 aa, Plasmodium falciparum
KGSEQN

SEQ ID NO: 3319744 - protein, 9 aa, Plasmodium falciparum
KGSETYTES

SEQ ID NO: 3319745 - protein, 6 aa, Plasmodium falciparum
KGSFEE

SEQ ID NO: 3319746 - protein, 7 aa, Plasmodium falciparum
KGSFNST

SEQ ID NO: 3319747 - protein, 8 aa, Plasmodium falciparum
KGSISEND

SEQ ID NO: 3319748 - protein, 13 aa, Plasmodium falciparum
KGSKISSLSERSS

SEQ ID NO: 3319749 - protein, 16 aa, Plasmodium falciparum
KGSKMAKKKKNKKGKT

SEQ ID NO: 3319750 - protein, 14 aa, Plasmodium falciparum
KGSKSIDTYNNQDI

SEQ ID NO: 3319751 - protein, 7 aa, Plasmodium falciparum
KGSNEGY

SEQ ID NO: 3319752 - protein, 4 aa, Plasmodium falciparum
KGSP

SEQ ID NO: 3319753 - protein, 9 aa, Plasmodium falciparum
KGSPDLKAA

SEQ ID NO: 3319754 - protein, 6 aa, Plasmodium falciparum
KGSPHV

SEQ ID NO: 3319755 - protein, 5 aa, Plasmodium falciparum
KGSRD

SEQ ID NO: 3319756 - protein, 6 aa, Plasmodium falciparum
KGSSDI

SEQ ID NO: 3319757 - protein, 7 aa, Plasmodium falciparum
KGSSKKK

SEQ ID NO: 3319758 - protein, 26 aa, Plasmodium falciparum
KGSTKEEEKEDNNREVGYKDDNNKIH

SEQ ID NO: 3319759 - protein, 9 aa, Plasmodium falciparum
KGSTNKRNS

SEQ ID NO: 3319760 - protein, 7 aa, Plasmodium falciparum
KGSTRAF

SEQ ID NO: 3319761 - protein, 8 aa, Plasmodium falciparum
KGSTTNSN

SEQ ID NO: 3319762 - protein, 6 aa, Plasmodium falciparum
KGSYGS

SEQ ID NO: 3319763 - protein, 5 aa, Plasmodium falciparum
KGSYP

SEQ ID NO: 3319764 - protein, 7 aa, Plasmodium falciparum
KGTDPLD

SEQ ID NO: 3319765 - protein, 7 aa, Plasmodium falciparum
KGTEIGQ

SEQ ID NO: 3319766 - protein, 8 aa, Plasmodium falciparum
KGTENNKP

SEQ ID NO: 3319767 - protein, 8 aa, Plasmodium falciparum
KGTERKDN

SEQ ID NO: 3319768 - protein, 12 aa, Plasmodium falciparum
KGTGKKNSSNIY

SEQ ID NO: 3319769 - protein, 5 aa, Plasmodium falciparum
KGTHA

SEQ ID NO: 3319770 - protein, 7 aa, Plasmodium falciparum
KGTHSGR

SEQ ID NO: 3319771 - protein, 6 aa, Plasmodium falciparum
KGTKPI

SEQ ID NO: 3319772 - protein, 11 aa, Plasmodium falciparum
KGTKSNDVPRT

SEQ ID NO: 3319773 - protein, 5 aa, Plasmodium falciparum
KGTMD

SEQ ID NO: 3319774 - protein, 13 aa, Plasmodium falciparum
KGTNDYKDLNKKN

SEQ ID NO: 3319775 - protein, 22 aa, Plasmodium falciparum
KGTNNNDINNTQGYGNQNEEKE

SEQ ID NO: 3319776 - protein, 8 aa, Plasmodium falciparum
KGTNQDTL

SEQ ID NO: 3319777 - protein, 5 aa, Plasmodium falciparum
KGTNY

SEQ ID NO: 3319778 - protein, 4 aa, Plasmodium falciparum
KGTQ

SEQ ID NO: 3319779 - protein, 7 aa, Plasmodium falciparum
KGTQIEN

SEQ ID NO: 3319780 - protein, 5 aa, Plasmodium falciparum
KGTSI

SEQ ID NO: 3319781 - protein, 7 aa, Plasmodium falciparum
KGTSKNK

SEQ ID NO: 3319782 - protein, 29 aa, Plasmodium falciparum
KGTTSNYNNYDNKYDNNNNNNNNNRSQKM

SEQ ID NO: 3319783 - protein, 5 aa, Plasmodium falciparum
KGTYA

SEQ ID NO: 3319784 - protein, 13 aa, Plasmodium falciparum
KGTYEHGKKSGIG

SEQ ID NO: 3319785 - protein, 10 aa, Plasmodium falciparum
KGVKHNTSVN

SEQ ID NO: 3319786 - protein, 11 aa, Plasmodium falciparum
KGVKIKKNKKK

SEQ ID NO: 3319787 - protein, 7 aa, Plasmodium falciparum
KGVNEKI

SEQ ID NO: 3319788 - protein, 5 aa, Plasmodium falciparum
KGVPQ

SEQ ID NO: 3319789 - protein, 7 aa, Plasmodium falciparum
KGVQEEE

SEQ ID NO: 3319790 - protein, 6 aa, Plasmodium falciparum
KGVRNN

SEQ ID NO: 3319791 - protein, 8 aa, Plasmodium falciparum
KGVSSGKL

SEQ ID NO: 3319792 - protein, 9 aa, Plasmodium falciparum
KGVSSNGLN

SEQ ID NO: 3319793 - protein, 7 aa, Plasmodium falciparum
KGVSSTA

SEQ ID NO: 3319794 - protein, 15 aa, Plasmodium falciparum
KGYDNNIEDKENYNN

SEQ ID NO: 3319795 - protein, 26 aa, Plasmodium falciparum
KGYGDDNKIGDDNKIGDDNKIGDDNN

SEQ ID NO: 3319796 - protein, 5 aa, Plasmodium falciparum
KGYGK

SEQ ID NO: 3319797 - protein, 6 aa, Plasmodium falciparum
KGYGNK

SEQ ID NO: 3319798 - protein, 10 aa, Plasmodium falciparum
KGYKENKDVY

SEQ ID NO: 3319799 - protein, 7 aa, Plasmodium falciparum
KGYKERK

SEQ ID NO: 3319800 - protein, 12 aa, Plasmodium falciparum
KGYKRKDETNEN

SEQ ID NO: 3319801 - protein, 14 aa, Plasmodium falciparum
KGYNNDTKKERFNT

SEQ ID NO: 3319802 - protein, 14 aa, Plasmodium falciparum
KGYRKEAKHSNSRY

SEQ ID NO: 3319803 - protein, 9 aa, Plasmodium falciparum
KGYRSQGNE

SEQ ID NO: 3319804 - protein, 32 aa, Plasmodium falciparum
KHADASKNNDNNSELNNSDYYSSKYDKERESI

SEQ ID NO: 3319805 - protein, 13 aa, Plasmodium falciparum
KHADEDDEEEEED

SEQ ID NO: 3319806 - protein, 6 aa, Plasmodium falciparum
KHAEGH

SEQ ID NO: 3319807 - protein, 8 aa, Plasmodium falciparum
KHATKRQK

SEQ ID NO: 3319808 - protein, 18 aa, Plasmodium falciparum
KHCNDKKKKKKKKRKGFN

SEQ ID NO: 3319809 - protein, 6 aa, Plasmodium falciparum
KHCNNN

SEQ ID NO: 3319810 - protein, 14 aa, Plasmodium falciparum
KHDDKYDDKYYDKY

SEQ ID NO: 3319811 - protein, 5 aa, Plasmodium falciparum
KHDDN

SEQ ID NO: 3319812 - protein, 6 aa, Plasmodium falciparum
KHDHDD

SEQ ID NO: 3319813 - protein, 13 aa, Plasmodium falciparum
KHDIEKKNEPYKG

SEQ ID NO: 3319814 - protein, 6 aa, Plasmodium falciparum
KHDISN

SEQ ID NO: 3319815 - protein, 9 aa, Plasmodium falciparum
KHDKKNKLP

SEQ ID NO: 3319816 - protein, 14 aa, Plasmodium falciparum
KHDNDQKKNYDNEL

SEQ ID NO: 3319817 - protein, 7 aa, Plasmodium falciparum
KHDNEKK

SEQ ID NO: 3319818 - protein, 7 aa, Plasmodium falciparum
KHDNTLK

SEQ ID NO: 3319819 - protein, 9 aa, Plasmodium falciparum
KHDPALNSK

SEQ ID NO: 3319820 - protein, 6 aa, Plasmodium falciparum
KHDPNL

SEQ ID NO: 3319821 - protein, 5 aa, Plasmodium falciparum
KHDPY

SEQ ID NO: 3319822 - protein, 5 aa, Plasmodium falciparum
KHDQS

SEQ ID NO: 3319823 - protein, 5 aa, Plasmodium falciparum
KHDSD

SEQ ID NO: 3319824 - protein, 9 aa, Plasmodium falciparum
KHDTRGKEL

SEQ ID NO: 3319825 - protein, 23 aa, Plasmodium falciparum
KHDYNKEHKSAYCKNGDDVNDEE

SEQ ID NO: 3319826 - protein, 6 aa, Plasmodium falciparum
KHEDEN

SEQ ID NO: 3319827 - protein, 6 aa, Plasmodium falciparum
KHEEAV

SEQ ID NO: 3319828 - protein, 5 aa, Plasmodium falciparum
KHEEN

SEQ ID NO: 3319829 - protein, 6 aa, Plasmodium falciparum
KHEHEH

SEQ ID NO: 3319830 - protein, 8 aa, Plasmodium falciparum
KHEHKKDE

SEQ ID NO: 3319831 - protein, 9 aa, Plasmodium falciparum
KHEKEQKEI

SEQ ID NO: 3319832 - protein, 11 aa, Plasmodium falciparum
KHEKPKKLNAK

SEQ ID NO: 3319833 - protein, 8 aa, Plasmodium falciparum
KHENKNNL

SEQ ID NO: 3319834 - protein, 14 aa, Plasmodium falciparum
KHENNEDDYRKDNT

SEQ ID NO: 3319835 - protein, 6 aa, Plasmodium falciparum
KHENTK

SEQ ID NO: 3319836 - protein, 8 aa, Plasmodium falciparum
KHENYNTS

SEQ ID NO: 3319837 - protein, 4 aa, Plasmodium falciparum
KHEP

SEQ ID NO: 3319838 - protein, 7 aa, Plasmodium falciparum
KHEQNNQ

SEQ ID NO: 3319839 - protein, 6 aa, Plasmodium falciparum
KHERKL

SEQ ID NO: 3319840 - protein, 14 aa, Plasmodium falciparum
KHESSDNEYDDDDK

SEQ ID NO: 3319841 - protein, 8 aa, Plasmodium falciparum
KHETEENK

SEQ ID NO: 3319842 - protein, 21 aa, Plasmodium falciparum
KHETEKKKKKNNKIKKKKGDL

SEQ ID NO: 3319843 - protein, 6 aa, Plasmodium falciparum
KHFSDN

SEQ ID NO: 3319844 - protein, 11 aa, Plasmodium falciparum
KHFTDDDNISS

SEQ ID NO: 3319845 - protein, 26 aa, Plasmodium falciparum
KHGHKYDDHKYDDHKYEDHKYERNEE

SEQ ID NO: 3319846 - protein, 6 aa, Plasmodium falciparum
KHGKGT

SEQ ID NO: 3319847 - protein, 5 aa, Plasmodium falciparum
KHGTH

SEQ ID NO: 3319848 - protein, 5 aa, Plasmodium falciparum
KHGYG

SEQ ID NO: 3319849 - protein, 15 aa, Plasmodium falciparum
KHHADGNHDKKKEGI

SEQ ID NO: 3319850 - protein, 14 aa, Plasmodium falciparum
KHHDEDNENVDDNK

SEQ ID NO: 3319851 - protein, 5 aa, Plasmodium falciparum
KHHDG

SEQ ID NO: 3319852 - protein, 60 aa, Plasmodium falciparum
KHHKYDKHDKHDKYDKHDKHDKHDKHDKHDKHDKHDKNDKHDKHDKHDKHDKHNKKYHSK

SEQ ID NO: 3319853 - protein, 6 aa, Plasmodium falciparum
KHHNNY

SEQ ID NO: 3319854 - protein, 19 aa, Plasmodium falciparum
KHHSNEKFTSKDKSNDKDL

SEQ ID NO: 3319855 - protein, 6 aa, Plasmodium falciparum
KHHTHN

SEQ ID NO: 3319856 - protein, 15 aa, Plasmodium falciparum
KHIDTNDLSDDENLD

SEQ ID NO: 3319857 - protein, 9 aa, Plasmodium falciparum
KHINEKPDE

SEQ ID NO: 3319858 - protein, 12 aa, Plasmodium falciparum
KHINKNEYNDEV

SEQ ID NO: 3319859 - protein, 21 aa, Plasmodium falciparum
KHINKSNKKKKNNISNEENEK

SEQ ID NO: 3319860 - protein, 7 aa, Plasmodium falciparum
KHINNEE

SEQ ID NO: 3319861 - protein, 5 aa, Plasmodium falciparum
KHISN

SEQ ID NO: 3319862 - protein, 7 aa, Plasmodium falciparum
KHISNNS

SEQ ID NO: 3319863 - protein, 7 aa, Plasmodium falciparum
KHKDDVE

SEQ ID NO: 3319864 - protein, 14 aa, Plasmodium falciparum
KHKDNDKEKHNGNK

SEQ ID NO: 3319865 - protein, 12 aa, Plasmodium falciparum
KHKEFNKKENKI

SEQ ID NO: 3319866 - protein, 7 aa, Plasmodium falciparum
KHKENNE

SEQ ID NO: 3319867 - protein, 10 aa, Plasmodium falciparum
KHKESKERGI

SEQ ID NO: 3319868 - protein, 28 aa, Plasmodium falciparum
KHKEVEISEEQGKLKQSSETKGRLKQPH

SEQ ID NO: 3319869 - protein, 4 aa, Plasmodium falciparum
KHKK

SEQ ID NO: 3319870 - protein, 10 aa, Plasmodium falciparum
KHKKKMGRRY

SEQ ID NO: 3319871 - protein, 30 aa, Plasmodium falciparum
KHKKNIEKQKDKKGKEKIKKNQQELNDDHN

SEQ ID NO: 3319872 - protein, 9 aa, Plasmodium falciparum
KHKKSNNIS

SEQ ID NO: 3319873 - protein, 4 aa, Plasmodium falciparum
KHKN

SEQ ID NO: 3319874 - protein, 14 aa, Plasmodium falciparum
KHKNDEKKKRKEKK

SEQ ID NO: 3319875 - protein, 10 aa, Plasmodium falciparum
KHKNDKNKKL

SEQ ID NO: 3319876 - protein, 15 aa, Plasmodium falciparum
KHKNEGTNKKGNRKY

SEQ ID NO: 3319877 - protein, 10 aa, Plasmodium falciparum
KHKNEHEQQY

SEQ ID NO: 3319878 - protein, 10 aa, Plasmodium falciparum
KHKNNDKPKG

SEQ ID NO: 3319879 - protein, 19 aa, Plasmodium falciparum
KHKNNKIPPPPSGPPPNNI

SEQ ID NO: 3319880 - protein, 39 aa, Plasmodium falciparum
KHKNSTSSKYSYSSYSEEKTSSRSYSRSSTSSNKHKRNT

SEQ ID NO: 3319881 - protein, 13 aa, Plasmodium falciparum
KHKQEDDREYKKS

SEQ ID NO: 3319882 - protein, 20 aa, Plasmodium falciparum
KHKRDNNNNYNDIQNENRDL

SEQ ID NO: 3319883 - protein, 10 aa, Plasmodium falciparum
KHKSQEGEIP

SEQ ID NO: 3319884 - protein, 6 aa, Plasmodium falciparum
KHLKSN

SEQ ID NO: 3319885 - protein, 13 aa, Plasmodium falciparum
KHMNDKTNGDMKN

SEQ ID NO: 3319886 - protein, 6 aa, Plasmodium falciparum
KHMNKN

SEQ ID NO: 3319887 - protein, 13 aa, Plasmodium falciparum
KHMTRTEKGDNYY

SEQ ID NO: 3319888 - protein, 10 aa, Plasmodium falciparum
KHNDDNPDFK

SEQ ID NO: 3319889 - protein, 15 aa, Plasmodium falciparum
KHNDEKSKKEAEEKF

SEQ ID NO: 3319890 - protein, 5 aa, Plasmodium falciparum
KHNDK

SEQ ID NO: 3319891 - protein, 10 aa, Plasmodium falciparum
KHNDKSDSDM

SEQ ID NO: 3319892 - protein, 7 aa, Plasmodium falciparum
KHNEDLV

SEQ ID NO: 3319893 - protein, 15 aa, Plasmodium falciparum
KHNGFKKEEHEGYNN

SEQ ID NO: 3319894 - protein, 15 aa, Plasmodium falciparum
KHNGNYNNFSNTNNN

SEQ ID NO: 3319895 - protein, 5 aa, Plasmodium falciparum
KHNKE

SEQ ID NO: 3319896 - protein, 20 aa, Plasmodium falciparum
KHNKGNTENYNKYDEREKSI

SEQ ID NO: 3319897 - protein, 15 aa, Plasmodium falciparum
KHNKKEKKRKRNNNY

SEQ ID NO: 3319898 - protein, 20 aa, Plasmodium falciparum
KHNKNISDEIETKEVSSPYE

SEQ ID NO: 3319899 - protein, 12 aa, Plasmodium falciparum
KHNNENNYKYSN

SEQ ID NO: 3319900 - protein, 6 aa, Plasmodium falciparum
KHNNMN

SEQ ID NO: 3319901 - protein, 26 aa, Plasmodium falciparum
KHNNNHDDADYDDDEDDDDDDDDAYY

SEQ ID NO: 3319902 - protein, 40 aa, Plasmodium falciparum
KHNNNNGDNNNANKKKNDQKNFNKDDSNIREYSKNNNITR

SEQ ID NO: 3319903 - protein, 11 aa, Plasmodium falciparum
KHNNNNNNIKH

SEQ ID NO: 3319904 - protein, 22 aa, Plasmodium falciparum
KHNNNNNNNNNTSQSKSLELTT

SEQ ID NO: 3319905 - protein, 8 aa, Plasmodium falciparum
KHNNNTCN

SEQ ID NO: 3319906 - protein, 7 aa, Plasmodium falciparum
KHNNTDI

SEQ ID NO: 3319907 - protein, 33 aa, Plasmodium falciparum
KHNNTYNNNNNNNNNNNNINNINNNNNNNNNNS

SEQ ID NO: 3319908 - protein, 14 aa, Plasmodium falciparum
KHNNYDNHNNIDGN

SEQ ID NO: 3319909 - protein, 10 aa, Plasmodium falciparum
KHNPNNIPKY

SEQ ID NO: 3319910 - protein, 23 aa, Plasmodium falciparum
KHNPQKVGKDHELNDEDVVQLVK

SEQ ID NO: 3319911 - protein, 6 aa, Plasmodium falciparum
KHNPRK

SEQ ID NO: 3319912 - protein, 15 aa, Plasmodium falciparum
KHNQKNGNFLTFQEN

SEQ ID NO: 3319913 - protein, 6 aa, Plasmodium falciparum
KHNRGH

SEQ ID NO: 3319914 - protein, 21 aa, Plasmodium falciparum
KHNSKNAGKAHHYDKDTYDDM

SEQ ID NO: 3319915 - protein, 6 aa, Plasmodium falciparum
KHNSND

SEQ ID NO: 3319916 - protein, 22 aa, Plasmodium falciparum
KHNSPNSKNNDNNNNNNNNDVI

SEQ ID NO: 3319917 - protein, 5 aa, Plasmodium falciparum
KHPCS

SEQ ID NO: 3319918 - protein, 8 aa, Plasmodium falciparum
KHPEPEKE

SEQ ID NO: 3319919 - protein, 5 aa, Plasmodium falciparum
KHPGA

SEQ ID NO: 3319920 - protein, 6 aa, Plasmodium falciparum
KHPKNC

SEQ ID NO: 3319921 - protein, 6 aa, Plasmodium falciparum
KHPKSI

SEQ ID NO: 3319922 - protein, 4 aa, Plasmodium falciparum
KHPS

SEQ ID NO: 3319923 - protein, 30 aa, Plasmodium falciparum
KHQNEYSNIKNEKNNVSKTNLNNNLNNDNV

SEQ ID NO: 3319924 - protein, 5 aa, Plasmodium falciparum
KHQNR

SEQ ID NO: 3319925 - protein, 13 aa, Plasmodium falciparum
KHQNYKNDKEKIN

SEQ ID NO: 3319926 - protein, 24 aa, Plasmodium falciparum
KHQTNGKKNNIKENDNNNNFYNED

SEQ ID NO: 3319927 - protein, 43 aa, Plasmodium falciparum
KHRKEEKKNEKKKKKKNSSSDSSSSYTKQDEDKDKKKRKYEKI

SEQ ID NO: 3319928 - protein, 4 aa, Plasmodium falciparum
KHRQ

SEQ ID NO: 3319929 - protein, 29 aa, Plasmodium falciparum
KHRRTEDSYEYRNDEHRTNDKKRKNEYDH

SEQ ID NO: 3319930 - protein, 10 aa, Plasmodium falciparum
KHSDLKKNKH

SEQ ID NO: 3319931 - protein, 5 aa, Plasmodium falciparum
KHSGN

SEQ ID NO: 3319932 - protein, 7 aa, Plasmodium falciparum
KHSGSSM

SEQ ID NO: 3319933 - protein, 4 aa, Plasmodium falciparum
KHSK

SEQ ID NO: 3319934 - protein, 7 aa, Plasmodium falciparum
KHSKDIG

SEQ ID NO: 3319935 - protein, 37 aa, Plasmodium falciparum
KHSKKKKKYKNEFGYESTDSCNSDELSNNVDSSYYEG

SEQ ID NO: 3319936 - protein, 36 aa, Plasmodium falciparum
KHSNEKNRKNISSIQNGNVNENVNENVNGNVNGNIN

SEQ ID NO: 3319937 - protein, 20 aa, Plasmodium falciparum
KHSNSNYKKNDEQSYNEKKN

SEQ ID NO: 3319938 - protein, 13 aa, Plasmodium falciparum
KHSQGDDNSLGKN

SEQ ID NO: 3319939 - protein, 6 aa, Plasmodium falciparum
KHSQYN

SEQ ID NO: 3319940 - protein, 15 aa, Plasmodium falciparum
KHSRNNEKNKNNNTR

SEQ ID NO: 3319941 - protein, 11 aa, Plasmodium falciparum
KHSTEHAKKIA

SEQ ID NO: 3319942 - protein, 31 aa, Plasmodium falciparum
KHSYSDNNDNIKNNIDKKKKKKNNSKKNISN

SEQ ID NO: 3319943 - protein, 4 aa, Plasmodium falciparum
KHTC

SEQ ID NO: 3319944 - protein, 7 aa, Plasmodium falciparum
KHTCSEN

SEQ ID NO: 3319945 - protein, 16 aa, Plasmodium falciparum
KHTEEQKNRMDTEEKY

SEQ ID NO: 3319946 - protein, 6 aa, Plasmodium falciparum
KHTGHE

SEQ ID NO: 3319947 - protein, 5 aa, Plasmodium falciparum
KHTHD

SEQ ID NO: 3319948 - protein, 4 aa, Plasmodium falciparum
KHTN

SEQ ID NO: 3319949 - protein, 17 aa, Plasmodium falciparum
KHTNDTQHFKENTSNAV

SEQ ID NO: 3319950 - protein, 6 aa, Plasmodium falciparum
KHTPKV

SEQ ID NO: 3319951 - protein, 8 aa, Plasmodium falciparum
KHTQTNKA

SEQ ID NO: 3319952 - protein, 14 aa, Plasmodium falciparum
KHTSSSNNNQSNKR

SEQ ID NO: 3319953 - protein, 28 aa, Plasmodium falciparum
KHTYSNVSSSDPSIENTRINDKGNDNAN

SEQ ID NO: 3319954 - protein, 11 aa, Plasmodium falciparum
KHVEKNKTNAL

SEQ ID NO: 3319955 - protein, 6 aa, Plasmodium falciparum
KHVNEV

SEQ ID NO: 3319956 - protein, 11 aa, Plasmodium falciparum
KHVPQKKNDNI

SEQ ID NO: 3319957 - protein, 28 aa, Plasmodium falciparum
KHVSDSDMNNNNNNNNNTNINYPSSHDK

SEQ ID NO: 3319958 - protein, 53 aa, Plasmodium falciparum
KHVSKSNSLELKKGKKGEKSKDKLSNNVSGKKGMNKEKEVVQSSSVRRNSSRY

SEQ ID NO: 3319959 - protein, 19 aa, Plasmodium falciparum
KHWTPPKGLHENNESGLET

SEQ ID NO: 3319960 - protein, 13 aa, Plasmodium falciparum
KHYKSSDKTSKYG

SEQ ID NO: 3319961 - protein, 23 aa, Plasmodium falciparum
KIAAERKLKKEQKKIREQKKKEQ

SEQ ID NO: 3319962 - protein, 13 aa, Plasmodium falciparum
KIANKRKGNMNKK

SEQ ID NO: 3319963 - protein, 7 aa, Plasmodium falciparum
KIASSSN

SEQ ID NO: 3319964 - protein, 11 aa, Plasmodium falciparum
KIATENAEKPI

SEQ ID NO: 3319965 - protein, 14 aa, Plasmodium falciparum
KICKNGKDNIEETS

SEQ ID NO: 3319966 - protein, 8 aa, Plasmodium falciparum
KIDAGGST

SEQ ID NO: 3319967 - protein, 17 aa, Plasmodium falciparum
KIDDKENNIHNDESGKN

SEQ ID NO: 3319968 - protein, 5 aa, Plasmodium falciparum
KIDDM

SEQ ID NO: 3319969 - protein, 4 aa, Plasmodium falciparum
KIDE

SEQ ID NO: 3319970 - protein, 7 aa, Plasmodium falciparum
KIDEEKA

SEQ ID NO: 3319971 - protein, 6 aa, Plasmodium falciparum
KIDENK

SEQ ID NO: 3319972 - protein, 40 aa, Plasmodium falciparum
KIDGNTPNNNKIDDNTSNNNKIDGNTPNNNKIDDNTLKDN

SEQ ID NO: 3319973 - protein, 4 aa, Plasmodium falciparum
KIDI

SEQ ID NO: 3319974 - protein, 8 aa, Plasmodium falciparum
KIDKGHHN

SEQ ID NO: 3319975 - protein, 5 aa, Plasmodium falciparum
KIDND

SEQ ID NO: 3319976 - protein, 85 aa, Plasmodium falciparum
KIDNKNEQKEINNEKNITNNDNIKNNDNIKNNDNIKNNDNIKNNDNIKNNDNIKNNDNIKNNNNIKNNDNIKNNDNIKNNDNIKN

SEQ ID NO: 3319977 - protein, 17 aa, Plasmodium falciparum
KIDNPSEINVESKEDTE

SEQ ID NO: 3319978 - protein, 7 aa, Plasmodium falciparum
KIDNRNK

SEQ ID NO: 3319979 - protein, 6 aa, Plasmodium falciparum
KIDPGK

SEQ ID NO: 3319980 - protein, 7 aa, Plasmodium falciparum
KIDPKNN

SEQ ID NO: 3319981 - protein, 9 aa, Plasmodium falciparum
KIDPSNNPY

SEQ ID NO: 3319982 - protein, 4 aa, Plasmodium falciparum
KIDR

SEQ ID NO: 3319983 - protein, 5 aa, Plasmodium falciparum
KIDRR

SEQ ID NO: 3319984 - protein, 19 aa, Plasmodium falciparum
KIDSTSDTISEYDSNKYTS

SEQ ID NO: 3319985 - protein, 5 aa, Plasmodium falciparum
KIDTC

SEQ ID NO: 3319986 - protein, 5 aa, Plasmodium falciparum
KIDTE

SEQ ID NO: 3319987 - protein, 7 aa, Plasmodium falciparum
KIDTEKK

SEQ ID NO: 3319988 - protein, 6 aa, Plasmodium falciparum
KIDTNI

SEQ ID NO: 3319989 - protein, 24 aa, Plasmodium falciparum
KIDTNNKLDTNNKLDTNNNINNNN

SEQ ID NO: 3319990 - protein, 23 aa, Plasmodium falciparum
KIDYTNNKKDSQGMEKKKDHTTN

SEQ ID NO: 3319991 - protein, 8 aa, Plasmodium falciparum
KIEAPDKK

SEQ ID NO: 3319992 - protein, 4 aa, Plasmodium falciparum
KIED

SEQ ID NO: 3319993 - protein, 11 aa, Plasmodium falciparum
KIEDAKSEEKI

SEQ ID NO: 3319994 - protein, 6 aa, Plasmodium falciparum
KIEDEE

SEQ ID NO: 3319995 - protein, 18 aa, Plasmodium falciparum
KIEDEKGEEQKAEEENVG

SEQ ID NO: 3319996 - protein, 7 aa, Plasmodium falciparum
KIEEDLK

SEQ ID NO: 3319997 - protein, 6 aa, Plasmodium falciparum
KIEEED

SEQ ID NO: 3319998 - protein, 7 aa, Plasmodium falciparum
KIEEERN

SEQ ID NO: 3319999 - protein, 7 aa, Plasmodium falciparum
KIEEIKN

SEQ ID NO: 3320000 - protein, 10 aa, Plasmodium falciparum
KIEEKNINDD

SEQ ID NO: 3320001 - protein, 8 aa, Plasmodium falciparum
KIEETTDM

SEQ ID NO: 3320002 - protein, 4 aa, Plasmodium falciparum
KIEF

SEQ ID NO: 3320003 - protein, 5 aa, Plasmodium falciparum
KIEGK

SEQ ID NO: 3320004 - protein, 4 aa, Plasmodium falciparum
KIEK

SEQ ID NO: 3320005 - protein, 9 aa, Plasmodium falciparum
KIEKAKNRS

SEQ ID NO: 3320006 - protein, 9 aa, Plasmodium falciparum
KIEKDISQN

SEQ ID NO: 3320007 - protein, 18 aa, Plasmodium falciparum
KIEKDKNENALNQNNRNQ

SEQ ID NO: 3320008 - protein, 9 aa, Plasmodium falciparum
KIEKEKKNF

SEQ ID NO: 3320009 - protein, 6 aa, Plasmodium falciparum
KIEKEN

SEQ ID NO: 3320010 - protein, 5 aa, Plasmodium falciparum
KIEKG

SEQ ID NO: 3320011 - protein, 10 aa, Plasmodium falciparum
KIEKNEDDPF

SEQ ID NO: 3320012 - protein, 4 aa, Plasmodium falciparum
KIEN

SEQ ID NO: 3320013 - protein, 13 aa, Plasmodium falciparum
KIENEASKYDDET

SEQ ID NO: 3320014 - protein, 6 aa, Plasmodium falciparum
KIENEK

SEQ ID NO: 3320015 - protein, 8 aa, Plasmodium falciparum
KIENKKKN

SEQ ID NO: 3320016 - protein, 17 aa, Plasmodium falciparum
KIENNRNKTIKDTKNIN

SEQ ID NO: 3320017 - protein, 5 aa, Plasmodium falciparum
KIENT

SEQ ID NO: 3320018 - protein, 7 aa, Plasmodium falciparum
KIEPNER

SEQ ID NO: 3320019 - protein, 10 aa, Plasmodium falciparum
KIEQEESNVD

SEQ ID NO: 3320020 - protein, 7 aa, Plasmodium falciparum
KIEQETE

SEQ ID NO: 3320021 - protein, 7 aa, Plasmodium falciparum
KIEQNKQ

SEQ ID NO: 3320022 - protein, 22 aa, Plasmodium falciparum
KIEQNNNNENNKNNKNNNNNEV

SEQ ID NO: 3320023 - protein, 9 aa, Plasmodium falciparum
KIEQNTKDE

SEQ ID NO: 3320024 - protein, 7 aa, Plasmodium falciparum
KIEQSEH

SEQ ID NO: 3320025 - protein, 12 aa, Plasmodium falciparum
KIEREKAYQERK

SEQ ID NO: 3320026 - protein, 6 aa, Plasmodium falciparum
KIESEN

SEQ ID NO: 3320027 - protein, 19 aa, Plasmodium falciparum
KIESTNNTNMENDNKNVRN

SEQ ID NO: 3320028 - protein, 7 aa, Plasmodium falciparum
KIETETS

SEQ ID NO: 3320029 - protein, 9 aa, Plasmodium falciparum
KIETKKTLG

SEQ ID NO: 3320030 - protein, 8 aa, Plasmodium falciparum
KIETRDTM

SEQ ID NO: 3320031 - protein, 8 aa, Plasmodium falciparum
KIGEENQN

SEQ ID NO: 3320032 - protein, 4 aa, Plasmodium falciparum
KIGK

SEQ ID NO: 3320033 - protein, 23 aa, Plasmodium falciparum
KIGKCEKRKKKKRRNNTNNSQNY

SEQ ID NO: 3320034 - protein, 6 aa, Plasmodium falciparum
KIGKGT

SEQ ID NO: 3320035 - protein, 8 aa, Plasmodium falciparum
KIGNKKNM

SEQ ID NO: 3320036 - protein, 49 aa, Plasmodium falciparum
KIGNVKKKEKQKKKKDNEDYSDDNNDNNNNYSSDHNNNNNNSSSDHNNN

SEQ ID NO: 3320037 - protein, 10 aa, Plasmodium falciparum
KIGSEKKKLK

SEQ ID NO: 3320038 - protein, 10 aa, Plasmodium falciparum
KIHDDDDKYI

SEQ ID NO: 3320039 - protein, 7 aa, Plasmodium falciparum
KIHSETK

SEQ ID NO: 3320040 - protein, 23 aa, Plasmodium falciparum
KIIPNNSDEHLSSDYDQKSLNYH

SEQ ID NO: 3320041 - protein, 12 aa, Plasmodium falciparum
KIKAVGGQCILV

SEQ ID NO: 3320042 - protein, 27 aa, Plasmodium falciparum
KIKDGSKKEKKKNKDKKDQKGSKTKMD

SEQ ID NO: 3320043 - protein, 5 aa, Plasmodium falciparum
KIKDI

SEQ ID NO: 3320044 - protein, 7 aa, Plasmodium falciparum
KIKDKEQ

SEQ ID NO: 3320045 - protein, 8 aa, Plasmodium falciparum
KIKDNKIN

SEQ ID NO: 3320046 - protein, 25 aa, Plasmodium falciparum
KIKDNTNKNKNNNHHNNNNNNNDYF

SEQ ID NO: 3320047 - protein, 9 aa, Plasmodium falciparum
KIKDQKENR

SEQ ID NO: 3320048 - protein, 8 aa, Plasmodium falciparum
KIKEEEEE

SEQ ID NO: 3320049 - protein, 5 aa, Plasmodium falciparum
KIKEH

SEQ ID NO: 3320050 - protein, 4 aa, Plasmodium falciparum
KIKK

SEQ ID NO: 3320051 - protein, 5 aa, Plasmodium falciparum
KIKKE

SEQ ID NO: 3320052 - protein, 6 aa, Plasmodium falciparum
KIKKGD

SEQ ID NO: 3320053 - protein, 8 aa, Plasmodium falciparum
KIKKGSKS

SEQ ID NO: 3320054 - protein, 7 aa, Plasmodium falciparum
KIKKGYK

SEQ ID NO: 3320055 - protein, 13 aa, Plasmodium falciparum
KIKKKKKKKKVQI

SEQ ID NO: 3320056 - protein, 9 aa, Plasmodium falciparum
KIKKKKKNL

SEQ ID NO: 3320057 - protein, 6 aa, Plasmodium falciparum
KIKKNQ

SEQ ID NO: 3320058 - protein, 8 aa, Plasmodium falciparum
KIKKNSTL

SEQ ID NO: 3320059 - protein, 78 aa, Plasmodium falciparum
KIKNAQQNGHVNNDKNDVDNNKNDDDNINTNNHNNNNHDNNNNNNNHDNNNNNNNHDNHNNNNNNHDNHNNNYNHNND

SEQ ID NO: 3320060 - protein, 7 aa, Plasmodium falciparum
KIKNGEH

SEQ ID NO: 3320061 - protein, 11 aa, Plasmodium falciparum
KIKNHSSEKKK

SEQ ID NO: 3320062 - protein, 5 aa, Plasmodium falciparum
KIKNK

SEQ ID NO: 3320063 - protein, 7 aa, Plasmodium falciparum
KIKNKEE

SEQ ID NO: 3320064 - protein, 10 aa, Plasmodium falciparum
KIKNNKHHHN

SEQ ID NO: 3320065 - protein, 16 aa, Plasmodium falciparum
KIKNNNNNNNKSNFKK

SEQ ID NO: 3320066 - protein, 48 aa, Plasmodium falciparum
KIKNNNNNNNNKNNSNSNNKNNSNNKNNSNSNNRSDINQTTTNTNNDL

SEQ ID NO: 3320067 - protein, 7 aa, Plasmodium falciparum
KIKNRRS

SEQ ID NO: 3320068 - protein, 4 aa, Plasmodium falciparum
KIKP

SEQ ID NO: 3320069 - protein, 5 aa, Plasmodium falciparum
KIKPI

SEQ ID NO: 3320070 - protein, 14 aa, Plasmodium falciparum
KIKPPSMDEQAEPS

SEQ ID NO: 3320071 - protein, 18 aa, Plasmodium falciparum
KIKQSNEEKVKGPTENYD

SEQ ID NO: 3320072 - protein, 149 aa, Plasmodium falciparum
KIKRRSRLKKREKGDEESEDDIKDKGGRNKKGGTRKGKMEVDDDGDDDDDGDDDDDDGDDDDDDGDDDDDDGDDDDDDGDDDDDDDDDDDDDGDDDDDDDDYNDDDNDDDNDDDNDDDNDDDYNDDDNDDDYNDDYNDDYNDDDESDDF

SEQ ID NO: 3320073 - protein, 5 aa, Plasmodium falciparum
KIKSE

SEQ ID NO: 3320074 - protein, 9 aa, Plasmodium falciparum
KIKSEEDYK

SEQ ID NO: 3320075 - protein, 19 aa, Plasmodium falciparum
KIKSEKNNKNDSDKEDKKF

SEQ ID NO: 3320076 - protein, 6 aa, Plasmodium falciparum
KIKSKR

SEQ ID NO: 3320077 - protein, 5 aa, Plasmodium falciparum
KIKSL

SEQ ID NO: 3320078 - protein, 8 aa, Plasmodium falciparum
KIKTPESE

SEQ ID NO: 3320079 - protein, 17 aa, Plasmodium falciparum
KIKTTKNGIKSNKRSSS

SEQ ID NO: 3320080 - protein, 12 aa, Plasmodium falciparum
KIKYSEKGNVSD

SEQ ID NO: 3320081 - protein, 7 aa, Plasmodium falciparum
KILDEEN

SEQ ID NO: 3320082 - protein, 14 aa, Plasmodium falciparum
KILSDDTKNIISDD

SEQ ID NO: 3320083 - protein, 32 aa, Plasmodium falciparum
KIMNPDNNNNNNNNNNNNNNNNNNNNNNNNNI

SEQ ID NO: 3320084 - protein, 6 aa, Plasmodium falciparum
KINATD

SEQ ID NO: 3320085 - protein, 7 aa, Plasmodium falciparum
KINDDNY

SEQ ID NO: 3320086 - protein, 7 aa, Plasmodium falciparum
KINDGTN

SEQ ID NO: 3320087 - protein, 5 aa, Plasmodium falciparum
KINDK

SEQ ID NO: 3320088 - protein, 21 aa, Plasmodium falciparum
KINDNKINDNNNNNNNNNHYD

SEQ ID NO: 3320089 - protein, 14 aa, Plasmodium falciparum
KINDNVNNVNDDHQ

SEQ ID NO: 3320090 - protein, 12 aa, Plasmodium falciparum
KINDSRKKSSDT

SEQ ID NO: 3320091 - protein, 7 aa, Plasmodium falciparum
KINDTPI

SEQ ID NO: 3320092 - protein, 4 aa, Plasmodium falciparum
KINE

SEQ ID NO: 3320093 - protein, 5 aa, Plasmodium falciparum
KINED

SEQ ID NO: 3320094 - protein, 12 aa, Plasmodium falciparum
KINEKEKNVENK

SEQ ID NO: 3320095 - protein, 15 aa, Plasmodium falciparum
KINEKKERSIGDEQD

SEQ ID NO: 3320096 - protein, 11 aa, Plasmodium falciparum
KINEKNTANIN

SEQ ID NO: 3320097 - protein, 8 aa, Plasmodium falciparum
KINENNNE

SEQ ID NO: 3320098 - protein, 6 aa, Plasmodium falciparum
KINENS

SEQ ID NO: 3320099 - protein, 58 aa, Plasmodium falciparum
KINEQENKHFEPNKNDNNNNNNNNNNNNKDNNNKDKNKNNYKKYDNNKYYNNNDNNIT

SEQ ID NO: 3320100 - protein, 6 aa, Plasmodium falciparum
KINEQN

SEQ ID NO: 3320101 - protein, 8 aa, Plasmodium falciparum
KINEQPNE

SEQ ID NO: 3320102 - protein, 16 aa, Plasmodium falciparum
KINEREKNWIKNHCSK

SEQ ID NO: 3320103 - protein, 4 aa, Plasmodium falciparum
KINK

SEQ ID NO: 3320104 - protein, 14 aa, Plasmodium falciparum
KINKERKKTNTDEI

SEQ ID NO: 3320105 - protein, 22 aa, Plasmodium falciparum
KINKKEKKIYKNNYNNDNIKEE

SEQ ID NO: 3320106 - protein, 6 aa, Plasmodium falciparum
KINKNK

SEQ ID NO: 3320107 - protein, 7 aa, Plasmodium falciparum
KINKNKE

SEQ ID NO: 3320108 - protein, 7 aa, Plasmodium falciparum
KINKNTN

SEQ ID NO: 3320109 - protein, 8 aa, Plasmodium falciparum
KINKQDNY

SEQ ID NO: 3320110 - protein, 5 aa, Plasmodium falciparum
KINND

SEQ ID NO: 3320111 - protein, 45 aa, Plasmodium falciparum
KINNDNNNDNNNDNNNDNNNNDNNNNNNNNNNNSDNNFSSNNNNL

SEQ ID NO: 3320112 - protein, 5 aa, Plasmodium falciparum
KINNE

SEQ ID NO: 3320113 - protein, 6 aa, Plasmodium falciparum
KINNEE

SEQ ID NO: 3320114 - protein, 6 aa, Plasmodium falciparum
KINNEK

SEQ ID NO: 3320115 - protein, 8 aa, Plasmodium falciparum
KINNENKT

SEQ ID NO: 3320116 - protein, 10 aa, Plasmodium falciparum
KINNKDNKEN

SEQ ID NO: 3320117 - protein, 7 aa, Plasmodium falciparum
KINNKTN

SEQ ID NO: 3320118 - protein, 5 aa, Plasmodium falciparum
KINNN

SEQ ID NO: 3320119 - protein, 18 aa, Plasmodium falciparum
KINNNNNDINDNNNNNIQ

SEQ ID NO: 3320120 - protein, 26 aa, Plasmodium falciparum
KINNNNNNKNNNDNNNNNNNDNDNIH

SEQ ID NO: 3320121 - protein, 12 aa, Plasmodium falciparum
KINNNSHQNSVN

SEQ ID NO: 3320122 - protein, 13 aa, Plasmodium falciparum
KINNQNKKNVNET

SEQ ID NO: 3320123 - protein, 8 aa, Plasmodium falciparum
KINNTDTF

SEQ ID NO: 3320124 - protein, 7 aa, Plasmodium falciparum
KINNYTE

SEQ ID NO: 3320125 - protein, 7 aa, Plasmodium falciparum
KINPKRK

SEQ ID NO: 3320126 - protein, 5 aa, Plasmodium falciparum
KINPN

SEQ ID NO: 3320127 - protein, 7 aa, Plasmodium falciparum
KINPSHE

SEQ ID NO: 3320128 - protein, 4 aa, Plasmodium falciparum
KINQ

SEQ ID NO: 3320129 - protein, 19 aa, Plasmodium falciparum
KINQDDNNTCSDKNTSSEW

SEQ ID NO: 3320130 - protein, 6 aa, Plasmodium falciparum
KINQNN

SEQ ID NO: 3320131 - protein, 10 aa, Plasmodium falciparum
KINRKNKEYN

SEQ ID NO: 3320132 - protein, 4 aa, Plasmodium falciparum
KINS

SEQ ID NO: 3320133 - protein, 8 aa, Plasmodium falciparum
KINSEKEI

SEQ ID NO: 3320134 - protein, 11 aa, Plasmodium falciparum
KINSEKEKGEK

SEQ ID NO: 3320135 - protein, 7 aa, Plasmodium falciparum
KINSEKN

SEQ ID NO: 3320136 - protein, 40 aa, Plasmodium falciparum
KINSIKEKKDNLKTSSNNSLNNHSSSNKGSSEQNGTNENL

SEQ ID NO: 3320137 - protein, 17 aa, Plasmodium falciparum
KINSKSNTHNDEEKNNS

SEQ ID NO: 3320138 - protein, 8 aa, Plasmodium falciparum
KINSLRSD

SEQ ID NO: 3320139 - protein, 13 aa, Plasmodium falciparum
KINSNSKNMNSND

SEQ ID NO: 3320140 - protein, 8 aa, Plasmodium falciparum
KINSTENE

SEQ ID NO: 3320141 - protein, 25 aa, Plasmodium falciparum
KINTDNNKNTTNSSTSNNNSKEKIV

SEQ ID NO: 3320142 - protein, 5 aa, Plasmodium falciparum
KINTE

SEQ ID NO: 3320143 - protein, 9 aa, Plasmodium falciparum
KINTGNNVH

SEQ ID NO: 3320144 - protein, 9 aa, Plasmodium falciparum
KINTKGSCD

SEQ ID NO: 3320145 - protein, 6 aa, Plasmodium falciparum
KINTTD

SEQ ID NO: 3320146 - protein, 8 aa, Plasmodium falciparum
KINTTTSI

SEQ ID NO: 3320147 - protein, 17 aa, Plasmodium falciparum
KIPDKKNKVYDDKQEKN

SEQ ID NO: 3320148 - protein, 6 aa, Plasmodium falciparum
KIPENS

SEQ ID NO: 3320149 - protein, 6 aa, Plasmodium falciparum
KIPESR

SEQ ID NO: 3320150 - protein, 8 aa, Plasmodium falciparum
KIPGGDIT

SEQ ID NO: 3320151 - protein, 8 aa, Plasmodium falciparum
KIPGTLST

SEQ ID NO: 3320152 - protein, 16 aa, Plasmodium falciparum
KIPKKNYDQQNKMKSN

SEQ ID NO: 3320153 - protein, 4 aa, Plasmodium falciparum
KIPL

SEQ ID NO: 3320154 - protein, 9 aa, Plasmodium falciparum
KIPLGNKNY

SEQ ID NO: 3320155 - protein, 5 aa, Plasmodium falciparum
KIPNK

SEQ ID NO: 3320156 - protein, 9 aa, Plasmodium falciparum
KIPNKSDIP

SEQ ID NO: 3320157 - protein, 7 aa, Plasmodium falciparum
KIPNNTS

SEQ ID NO: 3320158 - protein, 13 aa, Plasmodium falciparum
KIPNSFKQADSNN

SEQ ID NO: 3320159 - protein, 8 aa, Plasmodium falciparum
KIPPSSPK

SEQ ID NO: 3320160 - protein, 6 aa, Plasmodium falciparum
KIPQTK

SEQ ID NO: 3320161 - protein, 5 aa, Plasmodium falciparum
KIPRH

SEQ ID NO: 3320162 - protein, 4 aa, Plasmodium falciparum
KIPS

SEQ ID NO: 3320163 - protein, 6 aa, Plasmodium falciparum
KIPSYN

SEQ ID NO: 3320164 - protein, 5 aa, Plasmodium falciparum
KIPVE

SEQ ID NO: 3320165 - protein, 5 aa, Plasmodium falciparum
KIPYG

SEQ ID NO: 3320166 - protein, 7 aa, Plasmodium falciparum
KIQDNAD

SEQ ID NO: 3320167 - protein, 4 aa, Plasmodium falciparum
KIQE

SEQ ID NO: 3320168 - protein, 6 aa, Plasmodium falciparum
KIQEEK

SEQ ID NO: 3320169 - protein, 5 aa, Plasmodium falciparum
KIQEK

SEQ ID NO: 3320170 - protein, 6 aa, Plasmodium falciparum
KIQENG

SEQ ID NO: 3320171 - protein, 8 aa, Plasmodium falciparum
KIQESNEI

SEQ ID NO: 3320172 - protein, 7 aa, Plasmodium falciparum
KIQESSP

SEQ ID NO: 3320173 - protein, 13 aa, Plasmodium falciparum
KIQHEKSKKHKRR

SEQ ID NO: 3320174 - protein, 77 aa, Plasmodium falciparum
KIQKGKDDEYNEDGEYNEDDEYNEDGEYNEDDEYNVDDEYNEDDEYNVDDEYNENDEYNEDGEDNLSQDNDKVNNKN

SEQ ID NO: 3320175 - protein, 16 aa, Plasmodium falciparum
KIQNESFANTRRKARE

SEQ ID NO: 3320176 - protein, 6 aa, Plasmodium falciparum
KIQPNK

SEQ ID NO: 3320177 - protein, 32 aa, Plasmodium falciparum
KIQQDNGKKELPNGIPDGKPNDMSSEENEKKH

SEQ ID NO: 3320178 - protein, 9 aa, Plasmodium falciparum
KIQQNNEQN

SEQ ID NO: 3320179 - protein, 12 aa, Plasmodium falciparum
KIQRAKERRDQH

SEQ ID NO: 3320180 - protein, 8 aa, Plasmodium falciparum
KIQRDNEK

SEQ ID NO: 3320181 - protein, 11 aa, Plasmodium falciparum
KIQRSHTDNNI

SEQ ID NO: 3320182 - protein, 5 aa, Plasmodium falciparum
KIQTE

SEQ ID NO: 3320183 - protein, 12 aa, Plasmodium falciparum
KIRAGKGKMRNR

SEQ ID NO: 3320184 - protein, 6 aa, Plasmodium falciparum
KIRESA

SEQ ID NO: 3320185 - protein, 9 aa, Plasmodium falciparum
KIRGPPKKD

SEQ ID NO: 3320186 - protein, 8 aa, Plasmodium falciparum
KIRKEEKR

SEQ ID NO: 3320187 - protein, 41 aa, Plasmodium falciparum
KIRNDDDRNYNTDEDTHYGNNDDTYYDDESCDNKNDDSVNK

SEQ ID NO: 3320188 - protein, 6 aa, Plasmodium falciparum
KIRNDS

SEQ ID NO: 3320189 - protein, 4 aa, Plasmodium falciparum
KIRR

SEQ ID NO: 3320190 - protein, 5 aa, Plasmodium falciparum
KIRRK

SEQ ID NO: 3320191 - protein, 11 aa, Plasmodium falciparum
KIRRRERSKER

SEQ ID NO: 3320192 - protein, 13 aa, Plasmodium falciparum
KIRRYKKNDDLKN

SEQ ID NO: 3320193 - protein, 7 aa, Plasmodium falciparum
KIRTDKR

SEQ ID NO: 3320194 - protein, 19 aa, Plasmodium falciparum
KISDDKKKDDENESVDGKR

SEQ ID NO: 3320195 - protein, 10 aa, Plasmodium falciparum
KISDDQAGLN

SEQ ID NO: 3320196 - protein, 7 aa, Plasmodium falciparum
KISDENK

SEQ ID NO: 3320197 - protein, 17 aa, Plasmodium falciparum
KISDKNIKNVKEEQNVV

SEQ ID NO: 3320198 - protein, 8 aa, Plasmodium falciparum
KISDKQNN

SEQ ID NO: 3320199 - protein, 5 aa, Plasmodium falciparum
KISDS

SEQ ID NO: 3320200 - protein, 11 aa, Plasmodium falciparum
KISDSDKDELR

SEQ ID NO: 3320201 - protein, 5 aa, Plasmodium falciparum
KISEA

SEQ ID NO: 3320202 - protein, 16 aa, Plasmodium falciparum
KISEGKKLEGKIEYEK

SEQ ID NO: 3320203 - protein, 7 aa, Plasmodium falciparum
KISEGTY

SEQ ID NO: 3320204 - protein, 9 aa, Plasmodium falciparum
KISEKNKEL

SEQ ID NO: 3320205 - protein, 6 aa, Plasmodium falciparum
KISGDY

SEQ ID NO: 3320206 - protein, 28 aa, Plasmodium falciparum
KISGKKKNKSEKEKEKEKEKEKKDRHIE

SEQ ID NO: 3320207 - protein, 12 aa, Plasmodium falciparum
KISGKSKGNYKK

SEQ ID NO: 3320208 - protein, 7 aa, Plasmodium falciparum
KISHESV

SEQ ID NO: 3320209 - protein, 13 aa, Plasmodium falciparum
KISKDEIKTARTY

SEQ ID NO: 3320210 - protein, 12 aa, Plasmodium falciparum
KISKDNYEDLKE

SEQ ID NO: 3320211 - protein, 15 aa, Plasmodium falciparum
KISKKRSKVKHERNS

SEQ ID NO: 3320212 - protein, 4 aa, Plasmodium falciparum
KISN

SEQ ID NO: 3320213 - protein, 5 aa, Plasmodium falciparum
KISNA

SEQ ID NO: 3320214 - protein, 6 aa, Plasmodium falciparum
KISNEK

SEQ ID NO: 3320215 - protein, 7 aa, Plasmodium falciparum
KISNEKE

SEQ ID NO: 3320216 - protein, 10 aa, Plasmodium falciparum
KISNEKKDEC

SEQ ID NO: 3320217 - protein, 7 aa, Plasmodium falciparum
KISNEYK

SEQ ID NO: 3320218 - protein, 7 aa, Plasmodium falciparum
KISNHKD

SEQ ID NO: 3320219 - protein, 9 aa, Plasmodium falciparum
KISNNNNNN

SEQ ID NO: 3320220 - protein, 15 aa, Plasmodium falciparum
KISNNNNNNNNNKIN

SEQ ID NO: 3320221 - protein, 9 aa, Plasmodium falciparum
KISNTEKKN

SEQ ID NO: 3320222 - protein, 25 aa, Plasmodium falciparum
KISNTGKNEGNSKSDNIKKESRSRD

SEQ ID NO: 3320223 - protein, 5 aa, Plasmodium falciparum
KISRN

SEQ ID NO: 3320224 - protein, 13 aa, Plasmodium falciparum
KISSKKEASNYKS

SEQ ID NO: 3320225 - protein, 5 aa, Plasmodium falciparum
KISSR

SEQ ID NO: 3320226 - protein, 12 aa, Plasmodium falciparum
KISSSPPSFDKH

SEQ ID NO: 3320227 - protein, 9 aa, Plasmodium falciparum
KISYGSKDG

SEQ ID NO: 3320228 - protein, 6 aa, Plasmodium falciparum
KITDKE

SEQ ID NO: 3320229 - protein, 11 aa, Plasmodium falciparum
KITDKYNNKYR

SEQ ID NO: 3320230 - protein, 5 aa, Plasmodium falciparum
KITED

SEQ ID NO: 3320231 - protein, 13 aa, Plasmodium falciparum
KITEGDRNKGAYT

SEQ ID NO: 3320232 - protein, 6 aa, Plasmodium falciparum
KITEIN

SEQ ID NO: 3320233 - protein, 20 aa, Plasmodium falciparum
KITESKDLKKKKKKKNECDI

SEQ ID NO: 3320234 - protein, 9 aa, Plasmodium falciparum
KITGNEGKI

SEQ ID NO: 3320235 - protein, 34 aa, Plasmodium falciparum
KITKGSNNNNNDNNNNDNNNDNNNDNNNNNNYYD

SEQ ID NO: 3320236 - protein, 9 aa, Plasmodium falciparum
KITKKNEEH

SEQ ID NO: 3320237 - protein, 16 aa, Plasmodium falciparum
KITKKYKKKGKINKTQ

SEQ ID NO: 3320238 - protein, 5 aa, Plasmodium falciparum
KITKL

SEQ ID NO: 3320239 - protein, 31 aa, Plasmodium falciparum
KITKSKRKSIFPSDKKDSPTKLGYTRKRSKK

SEQ ID NO: 3320240 - protein, 6 aa, Plasmodium falciparum
KITKSV

SEQ ID NO: 3320241 - protein, 38 aa, Plasmodium falciparum
KITKSYKPTPFNNENNNNNNNNNNNNNNINISSSSSSK

SEQ ID NO: 3320242 - protein, 4 aa, Plasmodium falciparum
KITN

SEQ ID NO: 3320243 - protein, 16 aa, Plasmodium falciparum
KITNEYASASVQKKKR

SEQ ID NO: 3320244 - protein, 7 aa, Plasmodium falciparum
KITPHER

SEQ ID NO: 3320245 - protein, 7 aa, Plasmodium falciparum
KITPSIS

SEQ ID NO: 3320246 - protein, 6 aa, Plasmodium falciparum
KITSPK

SEQ ID NO: 3320247 - protein, 7 aa, Plasmodium falciparum
KITSQGS

SEQ ID NO: 3320248 - protein, 6 aa, Plasmodium falciparum
KITSSN

SEQ ID NO: 3320249 - protein, 6 aa, Plasmodium falciparum
KIVGYG

SEQ ID NO: 3320250 - protein, 6 aa, Plasmodium falciparum
KIVQNN

SEQ ID NO: 3320251 - protein, 5 aa, Plasmodium falciparum
KIYDE

SEQ ID NO: 3320252 - protein, 6 aa, Plasmodium falciparum
KIYEDE

SEQ ID NO: 3320253 - protein, 6 aa, Plasmodium falciparum
KIYEDN

SEQ ID NO: 3320254 - protein, 5 aa, Plasmodium falciparum
KIYNE

SEQ ID NO: 3320255 - protein, 40 aa, Plasmodium falciparum
KIYNNDDNTYDDNNYDDNNYDDNKYDDNNYDDKNDRDNYH

SEQ ID NO: 3320256 - protein, 11 aa, Plasmodium falciparum
KIYNNNNNNNN

SEQ ID NO: 3320257 - protein, 14 aa, Plasmodium falciparum
KIYNSDKKDSDKEI

SEQ ID NO: 3320258 - protein, 12 aa, Plasmodium falciparum
KIYQDNNLTSSC

SEQ ID NO: 3320259 - protein, 5 aa, Plasmodium falciparum
KIYSG

SEQ ID NO: 3320260 - protein, 17 aa, Plasmodium falciparum
KIYSSSEEEDIEDEEVK

SEQ ID NO: 3320261 - protein, 12 aa, Plasmodium falciparum
KIYTNSSNNNCN

SEQ ID NO: 3320262 - protein, 8 aa, Plasmodium falciparum
KKAATLGY

SEQ ID NO: 3320263 - protein, 7 aa, Plasmodium falciparum
KKADVNE

SEQ ID NO: 3320264 - protein, 8 aa, Plasmodium falciparum
KKAEENIK

SEQ ID NO: 3320265 - protein, 7 aa, Plasmodium falciparum
KKAERIE

SEQ ID NO: 3320266 - protein, 9 aa, Plasmodium falciparum
KKAFDESRN

SEQ ID NO: 3320267 - protein, 7 aa, Plasmodium falciparum
KKAGGYI

SEQ ID NO: 3320268 - protein, 7 aa, Plasmodium falciparum
KKAGTSA

SEQ ID NO: 3320269 - protein, 7 aa, Plasmodium falciparum
KKAIEEA

SEQ ID NO: 3320270 - protein, 7 aa, Plasmodium falciparum
KKAKEKV

SEQ ID NO: 3320271 - protein, 5 aa, Plasmodium falciparum
KKAKI

SEQ ID NO: 3320272 - protein, 7 aa, Plasmodium falciparum
KKAKTTK

SEQ ID NO: 3320273 - protein, 8 aa, Plasmodium falciparum
KKAKTTKK

SEQ ID NO: 3320274 - protein, 8 aa, Plasmodium falciparum
KKANNDNI

SEQ ID NO: 3320275 - protein, 18 aa, Plasmodium falciparum
KKAPQAKKPKDMLAKRPP

SEQ ID NO: 3320276 - protein, 8 aa, Plasmodium falciparum
KKAPTPDE

SEQ ID NO: 3320277 - protein, 20 aa, Plasmodium falciparum
KKAQDERKKIEEQEKKKINQ

SEQ ID NO: 3320278 - protein, 5 aa, Plasmodium falciparum
KKARD

SEQ ID NO: 3320279 - protein, 20 aa, Plasmodium falciparum
KKASEEKGKGKEDAHNNNNI

SEQ ID NO: 3320280 - protein, 14 aa, Plasmodium falciparum
KKASKNKKKLNWSG

SEQ ID NO: 3320281 - protein, 19 aa, Plasmodium falciparum
KKASLTTQSTSNNTNDGNI

SEQ ID NO: 3320282 - protein, 7 aa, Plasmodium falciparum
KKASVAA

SEQ ID NO: 3320283 - protein, 6 aa, Plasmodium falciparum
KKAWRT

SEQ ID NO: 3320284 - protein, 8 aa, Plasmodium falciparum
KKCDEEQE

SEQ ID NO: 3320285 - protein, 26 aa, Plasmodium falciparum
KKCDEESNYNNNNNNNNNNNNNNNVD

SEQ ID NO: 3320286 - protein, 7 aa, Plasmodium falciparum
KKCKDNN

SEQ ID NO: 3320287 - protein, 5 aa, Plasmodium falciparum
KKCKR

SEQ ID NO: 3320288 - protein, 19 aa, Plasmodium falciparum
KKCNSVDNKEIKNKNISKD

SEQ ID NO: 3320289 - protein, 8 aa, Plasmodium falciparum
KKCNYDKK

SEQ ID NO: 3320290 - protein, 21 aa, Plasmodium falciparum
KKCPNDNSADVQNNEKNNNLY

SEQ ID NO: 3320291 - protein, 5 aa, Plasmodium falciparum
KKCPQ

SEQ ID NO: 3320292 - protein, 8 aa, Plasmodium falciparum
KKCSNNAD

SEQ ID NO: 3320293 - protein, 4 aa, Plasmodium falciparum
KKDA

SEQ ID NO: 3320294 - protein, 9 aa, Plasmodium falciparum
KKDATSGSL

SEQ ID NO: 3320295 - protein, 7 aa, Plasmodium falciparum
KKDCNNI

SEQ ID NO: 3320296 - protein, 9 aa, Plasmodium falciparum
KKDDASSDI

SEQ ID NO: 3320297 - protein, 7 aa, Plasmodium falciparum
KKDDEDF

SEQ ID NO: 3320298 - protein, 13 aa, Plasmodium falciparum
KKDDEKREINKND

SEQ ID NO: 3320299 - protein, 8 aa, Plasmodium falciparum
KKDDEKVH

SEQ ID NO: 3320300 - protein, 5 aa, Plasmodium falciparum
KKDDF

SEQ ID NO: 3320301 - protein, 14 aa, Plasmodium falciparum
KKDDGKENKRDSIP

SEQ ID NO: 3320302 - protein, 23 aa, Plasmodium falciparum
KKDDKKGKKQKKDKNNKKESELI

SEQ ID NO: 3320303 - protein, 9 aa, Plasmodium falciparum
KKDDKYKGR

SEQ ID NO: 3320304 - protein, 9 aa, Plasmodium falciparum
KKDDNENND

SEQ ID NO: 3320305 - protein, 7 aa, Plasmodium falciparum
KKDDNIS

SEQ ID NO: 3320306 - protein, 6 aa, Plasmodium falciparum
KKDDNY

SEQ ID NO: 3320307 - protein, 10 aa, Plasmodium falciparum
KKDDVEIEET

SEQ ID NO: 3320308 - protein, 7 aa, Plasmodium falciparum
KKDEALE

SEQ ID NO: 3320309 - protein, 6 aa, Plasmodium falciparum
KKDEDD

SEQ ID NO: 3320310 - protein, 18 aa, Plasmodium falciparum
KKDEDKTSLDKKNKPQDI

SEQ ID NO: 3320311 - protein, 18 aa, Plasmodium falciparum
KKDEEQHNPYDNKNNKIK

SEQ ID NO: 3320312 - protein, 12 aa, Plasmodium falciparum
KKDEGEREKNNL

SEQ ID NO: 3320313 - protein, 6 aa, Plasmodium falciparum
KKDEID

SEQ ID NO: 3320314 - protein, 12 aa, Plasmodium falciparum
KKDEIERVAKAN

SEQ ID NO: 3320315 - protein, 11 aa, Plasmodium falciparum
KKDEKEKAKIR

SEQ ID NO: 3320316 - protein, 15 aa, Plasmodium falciparum
KKDEKYLDNQNNNMH

SEQ ID NO: 3320317 - protein, 12 aa, Plasmodium falciparum
KKDENDNKSYDS

SEQ ID NO: 3320318 - protein, 21 aa, Plasmodium falciparum
KKDENKKTNYINSEKEEEKNV

SEQ ID NO: 3320319 - protein, 8 aa, Plasmodium falciparum
KKDEPFQD

SEQ ID NO: 3320320 - protein, 9 aa, Plasmodium falciparum
KKDEQINNE

SEQ ID NO: 3320321 - protein, 6 aa, Plasmodium falciparum
KKDERI

SEQ ID NO: 3320322 - protein, 8 aa, Plasmodium falciparum
KKDESPVS

SEQ ID NO: 3320323 - protein, 16 aa, Plasmodium falciparum
KKDESSFKSMSSKSNM

SEQ ID NO: 3320324 - protein, 11 aa, Plasmodium falciparum
KKDESSSNDMA

SEQ ID NO: 3320325 - protein, 5 aa, Plasmodium falciparum
KKDEY

SEQ ID NO: 3320326 - protein, 7 aa, Plasmodium falciparum
KKDEYYK

SEQ ID NO: 3320327 - protein, 4 aa, Plasmodium falciparum
KKDG

SEQ ID NO: 3320328 - protein, 13 aa, Plasmodium falciparum
KKDGEKKKNYIND

SEQ ID NO: 3320329 - protein, 9 aa, Plasmodium falciparum
KKDGFPKSS

SEQ ID NO: 3320330 - protein, 5 aa, Plasmodium falciparum
KKDGK

SEQ ID NO: 3320331 - protein, 6 aa, Plasmodium falciparum
KKDGNE

SEQ ID NO: 3320332 - protein, 7 aa, Plasmodium falciparum
KKDHENE

SEQ ID NO: 3320333 - protein, 4 aa, Plasmodium falciparum
KKDI

SEQ ID NO: 3320334 - protein, 162 aa, Plasmodium falciparum
KKDIDKKKKREEEKKHKHKHKHKHNEKRKSKDKDKYKDKYKDKYKDKYKDKSKDKSKDKYKDKYKDKSKDKYKDKYKEKSKNKSKDESKDESKDESHRKKKKEHKSKDRRKHKKKEKKKKEKDKKNKHHSEESSSDTYNRNKTKNESDESSNEEGSSTSATS

SEQ ID NO: 3320335 - protein, 6 aa, Plasmodium falciparum
KKDINK

SEQ ID NO: 3320336 - protein, 12 aa, Plasmodium falciparum
KKDINKKKKYIN

SEQ ID NO: 3320337 - protein, 14 aa, Plasmodium falciparum
KKDIPDKKKKKIEI

SEQ ID NO: 3320338 - protein, 8 aa, Plasmodium falciparum
KKDITEKK

SEQ ID NO: 3320339 - protein, 8 aa, Plasmodium falciparum
KKDITNVS

SEQ ID NO: 3320340 - protein, 4 aa, Plasmodium falciparum
KKDK

SEQ ID NO: 3320341 - protein, 18 aa, Plasmodium falciparum
KKDKDSYKNSDNNKIDEE

SEQ ID NO: 3320342 - protein, 15 aa, Plasmodium falciparum
KKDKEQNKKMQNKKI

SEQ ID NO: 3320343 - protein, 8 aa, Plasmodium falciparum
KKDKHLQQ

SEQ ID NO: 3320344 - protein, 7 aa, Plasmodium falciparum
KKDKKEK

SEQ ID NO: 3320345 - protein, 7 aa, Plasmodium falciparum
KKDKKFD

SEQ ID NO: 3320346 - protein, 7 aa, Plasmodium falciparum
KKDKKKY

SEQ ID NO: 3320347 - protein, 9 aa, Plasmodium falciparum
KKDKLGEKI

SEQ ID NO: 3320348 - protein, 13 aa, Plasmodium falciparum
KKDKNNSSSYKKS

SEQ ID NO: 3320349 - protein, 7 aa, Plasmodium falciparum
KKDKPKW

SEQ ID NO: 3320350 - protein, 7 aa, Plasmodium falciparum
KKDKQLS

SEQ ID NO: 3320351 - protein, 13 aa, Plasmodium falciparum
KKDKSKDLEEQKK

SEQ ID NO: 3320352 - protein, 24 aa, Plasmodium falciparum
KKDKTQKKKGLSKKKKKNDEKTKL

SEQ ID NO: 3320353 - protein, 9 aa, Plasmodium falciparum
KKDKVDDHN

SEQ ID NO: 3320354 - protein, 8 aa, Plasmodium falciparum
KKDKVSKR

SEQ ID NO: 3320355 - protein, 8 aa, Plasmodium falciparum
KKDKWYPS

SEQ ID NO: 3320356 - protein, 16 aa, Plasmodium falciparum
KKDLNEENTQMANFIL

SEQ ID NO: 3320357 - protein, 7 aa, Plasmodium falciparum
KKDLNNE

SEQ ID NO: 3320358 - protein, 7 aa, Plasmodium falciparum
KKDLQKK

SEQ ID NO: 3320359 - protein, 24 aa, Plasmodium falciparum
KKDMDGKNINDECKTYKKNKYKDM

SEQ ID NO: 3320360 - protein, 11 aa, Plasmodium falciparum
KKDNDDDKTNY

SEQ ID NO: 3320361 - protein, 8 aa, Plasmodium falciparum
KKDNDEKI

SEQ ID NO: 3320362 - protein, 9 aa, Plasmodium falciparum
KKDNEEKHR

SEQ ID NO: 3320363 - protein, 7 aa, Plasmodium falciparum
KKDNEKL

SEQ ID NO: 3320364 - protein, 8 aa, Plasmodium falciparum
KKDNGKLN

SEQ ID NO: 3320365 - protein, 11 aa, Plasmodium falciparum
KKDNIKDNHTN

SEQ ID NO: 3320366 - protein, 6 aa, Plasmodium falciparum
KKDNIY

SEQ ID NO: 3320367 - protein, 6 aa, Plasmodium falciparum
KKDNKL

SEQ ID NO: 3320368 - protein, 6 aa, Plasmodium falciparum
KKDNKN

SEQ ID NO: 3320369 - protein, 18 aa, Plasmodium falciparum
KKDNKSDYENSEANEDNI

SEQ ID NO: 3320370 - protein, 9 aa, Plasmodium falciparum
KKDNNSSLH

SEQ ID NO: 3320371 - protein, 7 aa, Plasmodium falciparum
KKDNRTF

SEQ ID NO: 3320372 - protein, 9 aa, Plasmodium falciparum
KKDNTIKGN

SEQ ID NO: 3320373 - protein, 8 aa, Plasmodium falciparum
KKDNTKNE

SEQ ID NO: 3320374 - protein, 9 aa, Plasmodium falciparum
KKDNTQQYN

SEQ ID NO: 3320375 - protein, 5 aa, Plasmodium falciparum
KKDNV

SEQ ID NO: 3320376 - protein, 7 aa, Plasmodium falciparum
KKDNVKY

SEQ ID NO: 3320377 - protein, 7 aa, Plasmodium falciparum
KKDNYNQ

SEQ ID NO: 3320378 - protein, 7 aa, Plasmodium falciparum
KKDPFEY

SEQ ID NO: 3320379 - protein, 27 aa, Plasmodium falciparum
KKDPIKVKKNKNKGNHSRNKKKKKNYS

SEQ ID NO: 3320380 - protein, 4 aa, Plasmodium falciparum
KKDQ

SEQ ID NO: 3320381 - protein, 8 aa, Plasmodium falciparum
KKDQDNKE

SEQ ID NO: 3320382 - protein, 11 aa, Plasmodium falciparum
KKDQNVNCPSY

SEQ ID NO: 3320383 - protein, 5 aa, Plasmodium falciparum
KKDQR

SEQ ID NO: 3320384 - protein, 8 aa, Plasmodium falciparum
KKDQSSTS

SEQ ID NO: 3320385 - protein, 15 aa, Plasmodium falciparum
KKDQTSTNLSKNKQK

SEQ ID NO: 3320386 - protein, 7 aa, Plasmodium falciparum
KKDRANN

SEQ ID NO: 3320387 - protein, 7 aa, Plasmodium falciparum
KKDRKKI

SEQ ID NO: 3320388 - protein, 7 aa, Plasmodium falciparum
KKDRKNL

SEQ ID NO: 3320389 - protein, 8 aa, Plasmodium falciparum
KKDRKQYF

SEQ ID NO: 3320390 - protein, 8 aa, Plasmodium falciparum
KKDRNKNK

SEQ ID NO: 3320391 - protein, 5 aa, Plasmodium falciparum
KKDRY

SEQ ID NO: 3320392 - protein, 4 aa, Plasmodium falciparum
KKDS

SEQ ID NO: 3320393 - protein, 5 aa, Plasmodium falciparum
KKDSL

SEQ ID NO: 3320394 - protein, 14 aa, Plasmodium falciparum
KKDSLNEDDVKKNP

SEQ ID NO: 3320395 - protein, 11 aa, Plasmodium falciparum
KKDSNEENNSL

SEQ ID NO: 3320396 - protein, 10 aa, Plasmodium falciparum
KKDSNKKIDN

SEQ ID NO: 3320397 - protein, 8 aa, Plasmodium falciparum
KKDSNNQL

SEQ ID NO: 3320398 - protein, 70 aa, Plasmodium falciparum
KKDSSEKDKNVSSNKNNNNNKNNDNNKNDDNNKNNDNNKNNDNNKNNDNNKNNDNNNNDNNNNNNNSERD

SEQ ID NO: 3320399 - protein, 7 aa, Plasmodium falciparum
KKDSTYV

SEQ ID NO: 3320400 - protein, 7 aa, Plasmodium falciparum
KKDSYEK

SEQ ID NO: 3320401 - protein, 6 aa, Plasmodium falciparum
KKDTCK

SEQ ID NO: 3320402 - protein, 5 aa, Plasmodium falciparum
KKDTD

SEQ ID NO: 3320403 - protein, 14 aa, Plasmodium falciparum
KKDTDEEEKRRRER

SEQ ID NO: 3320404 - protein, 9 aa, Plasmodium falciparum
KKDTEEIDR

SEQ ID NO: 3320405 - protein, 25 aa, Plasmodium falciparum
KKDTITNENNNINHNNNNNNLTANN

SEQ ID NO: 3320406 - protein, 22 aa, Plasmodium falciparum
KKDTMAKKNALSSSNKTTKEVK

SEQ ID NO: 3320407 - protein, 39 aa, Plasmodium falciparum
KKDTNETDKTDEYNLDSNKKKKSFYQKKKTSNKEIEEPK

SEQ ID NO: 3320408 - protein, 10 aa, Plasmodium falciparum
KKDTNTPKFS

SEQ ID NO: 3320409 - protein, 8 aa, Plasmodium falciparum
KKDTQGQK

SEQ ID NO: 3320410 - protein, 56 aa, Plasmodium falciparum
KKDTRRNHSKSFSESRYDYSNKYNDRKKNYKNDKYDKKVKTNNKNHDSPYERNSVS

SEQ ID NO: 3320411 - protein, 7 aa, Plasmodium falciparum
KKDTYKE

SEQ ID NO: 3320412 - protein, 4 aa, Plasmodium falciparum
KKDV

SEQ ID NO: 3320413 - protein, 5 aa, Plasmodium falciparum
KKDVD

SEQ ID NO: 3320414 - protein, 14 aa, Plasmodium falciparum
KKDVDQVNKQMDDP

SEQ ID NO: 3320415 - protein, 7 aa, Plasmodium falciparum
KKDVPKR

SEQ ID NO: 3320416 - protein, 4 aa, Plasmodium falciparum
KKDY

SEQ ID NO: 3320417 - protein, 9 aa, Plasmodium falciparum
KKDYDINEP

SEQ ID NO: 3320418 - protein, 7 aa, Plasmodium falciparum
KKDYSNI

SEQ ID NO: 3320419 - protein, 26 aa, Plasmodium falciparum
KKDYTKKKEKLYTNDSEKENKKKKKM

SEQ ID NO: 3320420 - protein, 5 aa, Plasmodium falciparum
KKDYW

SEQ ID NO: 3320421 - protein, 7 aa, Plasmodium falciparum
KKEAFKK

SEQ ID NO: 3320422 - protein, 5 aa, Plasmodium falciparum
KKEAP

SEQ ID NO: 3320423 - protein, 18 aa, Plasmodium falciparum
KKEAPSITSQDSVESEEL

SEQ ID NO: 3320424 - protein, 6 aa, Plasmodium falciparum
KKEARI

SEQ ID NO: 3320425 - protein, 7 aa, Plasmodium falciparum
KKEARNK

SEQ ID NO: 3320426 - protein, 13 aa, Plasmodium falciparum
KKECDERKKRINS

SEQ ID NO: 3320427 - protein, 22 aa, Plasmodium falciparum
KKECSGENKHVAKNERSGENKC

SEQ ID NO: 3320428 - protein, 8 aa, Plasmodium falciparum
KKEDDEYN

SEQ ID NO: 3320429 - protein, 7 aa, Plasmodium falciparum
KKEDDSF

SEQ ID NO: 3320430 - protein, 16 aa, Plasmodium falciparum
KKEDEEEENLKKEGGD

SEQ ID NO: 3320431 - protein, 6 aa, Plasmodium falciparum
KKEDIQ

SEQ ID NO: 3320432 - protein, 24 aa, Plasmodium falciparum
KKEDKDEEKKYNSLSDSLKSENIK

SEQ ID NO: 3320433 - protein, 20 aa, Plasmodium falciparum
KKEDKDKGKDKDKEKKKLES

SEQ ID NO: 3320434 - protein, 7 aa, Plasmodium falciparum
KKEDKND

SEQ ID NO: 3320435 - protein, 64 aa, Plasmodium falciparum
KKEDMDDKHNEKKKKKDKNKIKDKNKNNNNNNNNNNNNNNNENSDEDNSHNNSNKDHNNKDNIN

SEQ ID NO: 3320436 - protein, 37 aa, Plasmodium falciparum
KKEDNTHINDTNDTNDTKSNNNNNNNNNSSSSNNNHV

SEQ ID NO: 3320437 - protein, 20 aa, Plasmodium falciparum
KKEDNWENNKINEDENNDNC

SEQ ID NO: 3320438 - protein, 7 aa, Plasmodium falciparum
KKEDQEK

SEQ ID NO: 3320439 - protein, 6 aa, Plasmodium falciparum
KKEDRL

SEQ ID NO: 3320440 - protein, 6 aa, Plasmodium falciparum
KKEDSN

SEQ ID NO: 3320441 - protein, 8 aa, Plasmodium falciparum
KKEDTGKT

SEQ ID NO: 3320442 - protein, 14 aa, Plasmodium falciparum
KKEDTTSKNKNEKN

SEQ ID NO: 3320443 - protein, 10 aa, Plasmodium falciparum
KKEDTTSPLH

SEQ ID NO: 3320444 - protein, 8 aa, Plasmodium falciparum
KKEDTYEY

SEQ ID NO: 3320445 - protein, 5 aa, Plasmodium falciparum
KKEDY

SEQ ID NO: 3320446 - protein, 5 aa, Plasmodium falciparum
KKEED

SEQ ID NO: 3320447 - protein, 36 aa, Plasmodium falciparum
KKEEDDSNNNESNNNNNNNNNSNNNNNNNDHINNAG

SEQ ID NO: 3320448 - protein, 8 aa, Plasmodium falciparum
KKEEDIKE

SEQ ID NO: 3320449 - protein, 17 aa, Plasmodium falciparum
KKEEDNQQNCQQEGSIG

SEQ ID NO: 3320450 - protein, 11 aa, Plasmodium falciparum
KKEEDTQRKIE

SEQ ID NO: 3320451 - protein, 9 aa, Plasmodium falciparum
KKEEEAKNN

SEQ ID NO: 3320452 - protein, 13 aa, Plasmodium falciparum
KKEEEKKKKEETG

SEQ ID NO: 3320453 - protein, 9 aa, Plasmodium falciparum
KKEEENQSN

SEQ ID NO: 3320454 - protein, 11 aa, Plasmodium falciparum
KKEEESTNNID

SEQ ID NO: 3320455 - protein, 15 aa, Plasmodium falciparum
KKEEEVTNTSTLNSS

SEQ ID NO: 3320456 - protein, 16 aa, Plasmodium falciparum
KKEEEYENIKKGEEKC

SEQ ID NO: 3320457 - protein, 82 aa, Plasmodium falciparum
KKEEEYENNKMSSEDEKNGDMSDDNMQSDDMANDNTQSDDMANDNTQSDDMANDNTPNDDMANDNTPNDDMANDNTSNDDMA

SEQ ID NO: 3320458 - protein, 8 aa, Plasmodium falciparum
KKEEIQDN

SEQ ID NO: 3320459 - protein, 7 aa, Plasmodium falciparum
KKEEIRN

SEQ ID NO: 3320460 - protein, 8 aa, Plasmodium falciparum
KKEEKDNI

SEQ ID NO: 3320461 - protein, 7 aa, Plasmodium falciparum
KKEEKKK

SEQ ID NO: 3320462 - protein, 9 aa, Plasmodium falciparum
KKEEKKKKK

SEQ ID NO: 3320463 - protein, 23 aa, Plasmodium falciparum
KKEEKKKSHEKDKKNKKDENINE

SEQ ID NO: 3320464 - protein, 15 aa, Plasmodium falciparum
KKEEKKNKYVTTNKT

SEQ ID NO: 3320465 - protein, 12 aa, Plasmodium falciparum
KKEEKNKNKESY

SEQ ID NO: 3320466 - protein, 8 aa, Plasmodium falciparum
KKEEKNNI

SEQ ID NO: 3320467 - protein, 28 aa, Plasmodium falciparum
KKEEKRLKNNNKKYSQTSTYSTKEHNEK

SEQ ID NO: 3320468 - protein, 16 aa, Plasmodium falciparum
KKEEKVSTSSSGYPGV

SEQ ID NO: 3320469 - protein, 5 aa, Plasmodium falciparum
KKEEM

SEQ ID NO: 3320470 - protein, 6 aa, Plasmodium falciparum
KKEEMG

SEQ ID NO: 3320471 - protein, 16 aa, Plasmodium falciparum
KKEEMNEDNLFFHDLL

SEQ ID NO: 3320472 - protein, 5 aa, Plasmodium falciparum
KKEEN

SEQ ID NO: 3320473 - protein, 9 aa, Plasmodium falciparum
KKEENEDSN

SEQ ID NO: 3320474 - protein, 16 aa, Plasmodium falciparum
KKEENKEKKKLSKKNK

SEQ ID NO: 3320475 - protein, 9 aa, Plasmodium falciparum
KKEENKETR

SEQ ID NO: 3320476 - protein, 10 aa, Plasmodium falciparum
KKEENKKKNL

SEQ ID NO: 3320477 - protein, 17 aa, Plasmodium falciparum
KKEENKSNDDNNNNVNE

SEQ ID NO: 3320478 - protein, 7 aa, Plasmodium falciparum
KKEEQIN

SEQ ID NO: 3320479 - protein, 13 aa, Plasmodium falciparum
KKEEQISSNDDSF

SEQ ID NO: 3320480 - protein, 10 aa, Plasmodium falciparum
KKEEQNEREH

SEQ ID NO: 3320481 - protein, 7 aa, Plasmodium falciparum
KKEEQTY

SEQ ID NO: 3320482 - protein, 69 aa, Plasmodium falciparum
KKEESDEDEDENEEKLKEHTKSEDKKVDTQQNENVKSENVNNENVKNENVNNENVKNENVNNENVNNEN

SEQ ID NO: 3320483 - protein, 6 aa, Plasmodium falciparum
KKEETL

SEQ ID NO: 3320484 - protein, 9 aa, Plasmodium falciparum
KKEETYKHD

SEQ ID NO: 3320485 - protein, 15 aa, Plasmodium falciparum
KKEEVSSQKNHLNSG

SEQ ID NO: 3320486 - protein, 7 aa, Plasmodium falciparum
KKEEVTN

SEQ ID NO: 3320487 - protein, 14 aa, Plasmodium falciparum
KKEEYDDCNNNNNN

SEQ ID NO: 3320488 - protein, 12 aa, Plasmodium falciparum
KKEGDSDKEKNK

SEQ ID NO: 3320489 - protein, 6 aa, Plasmodium falciparum
KKEGDT

SEQ ID NO: 3320490 - protein, 74 aa, Plasmodium falciparum
KKEGGKKNDGGKYKNDDKDEEDEDEEENEDENDDNNDNNNDNNNDNNNDNNNDNNNDNNNDNNNDDNNNYDDDE

SEQ ID NO: 3320491 - protein, 7 aa, Plasmodium falciparum
KKEGTKI

SEQ ID NO: 3320492 - protein, 11 aa, Plasmodium falciparum
KKEGYNPVKGK

SEQ ID NO: 3320493 - protein, 4 aa, Plasmodium falciparum
KKEH

SEQ ID NO: 3320494 - protein, 8 aa, Plasmodium falciparum
KKEHEKDL

SEQ ID NO: 3320495 - protein, 13 aa, Plasmodium falciparum
KKEHQHDNTYNQN

SEQ ID NO: 3320496 - protein, 8 aa, Plasmodium falciparum
KKEHQPFQ

SEQ ID NO: 3320497 - protein, 4 aa, Plasmodium falciparum
KKEI

SEQ ID NO: 3320498 - protein, 8 aa, Plasmodium falciparum
KKEIEDEK

SEQ ID NO: 3320499 - protein, 7 aa, Plasmodium falciparum
KKEIEEE

SEQ ID NO: 3320500 - protein, 14 aa, Plasmodium falciparum
KKEIEENKDINGNK

SEQ ID NO: 3320501 - protein, 10 aa, Plasmodium falciparum
KKEIKRNKRS

SEQ ID NO: 3320502 - protein, 5 aa, Plasmodium falciparum
KKEIN

SEQ ID NO: 3320503 - protein, 9 aa, Plasmodium falciparum
KKEINDKNT

SEQ ID NO: 3320504 - protein, 15 aa, Plasmodium falciparum
KKEINKSDMKKSKKT

SEQ ID NO: 3320505 - protein, 7 aa, Plasmodium falciparum
KKEINSL

SEQ ID NO: 3320506 - protein, 4 aa, Plasmodium falciparum
KKEK

SEQ ID NO: 3320507 - protein, 5 aa, Plasmodium falciparum
KKEKD

SEQ ID NO: 3320508 - protein, 8 aa, Plasmodium falciparum
KKEKDDDI

SEQ ID NO: 3320509 - protein, 26 aa, Plasmodium falciparum
KKEKDKNEKTAQNEQEENVSEKKEPF

SEQ ID NO: 3320510 - protein, 13 aa, Plasmodium falciparum
KKEKDKNNYDTSE

SEQ ID NO: 3320511 - protein, 10 aa, Plasmodium falciparum
KKEKDNNMNN

SEQ ID NO: 3320512 - protein, 9 aa, Plasmodium falciparum
KKEKDTPFE

SEQ ID NO: 3320513 - protein, 5 aa, Plasmodium falciparum
KKEKE

SEQ ID NO: 3320514 - protein, 11 aa, Plasmodium falciparum
KKEKEDDGLNT

SEQ ID NO: 3320515 - protein, 9 aa, Plasmodium falciparum
KKEKEELQN

SEQ ID NO: 3320516 - protein, 9 aa, Plasmodium falciparum
KKEKEEQEL

SEQ ID NO: 3320517 - protein, 10 aa, Plasmodium falciparum
KKEKEHAKKS

SEQ ID NO: 3320518 - protein, 6 aa, Plasmodium falciparum
KKEKEK

SEQ ID NO: 3320519 - protein, 11 aa, Plasmodium falciparum
KKEKEKKKNLQ

SEQ ID NO: 3320520 - protein, 7 aa, Plasmodium falciparum
KKEKENY

SEQ ID NO: 3320521 - protein, 9 aa, Plasmodium falciparum
KKEKEYNQY

SEQ ID NO: 3320522 - protein, 18 aa, Plasmodium falciparum
KKEKHDNKNSSINNNTNE

SEQ ID NO: 3320523 - protein, 5 aa, Plasmodium falciparum
KKEKI

SEQ ID NO: 3320524 - protein, 8 aa, Plasmodium falciparum
KKEKIEKG

SEQ ID NO: 3320525 - protein, 68 aa, Plasmodium falciparum
KKEKINKRKKKIKKKKNKIKNENNKIKNENNKIKNENNKIKNGNNNNNKNKNNNNNSNSINPNQNNHV

SEQ ID NO: 3320526 - protein, 5 aa, Plasmodium falciparum
KKEKK

SEQ ID NO: 3320527 - protein, 9 aa, Plasmodium falciparum
KKEKKDELV

SEQ ID NO: 3320528 - protein, 12 aa, Plasmodium falciparum
KKEKKEQKKEEI

SEQ ID NO: 3320529 - protein, 13 aa, Plasmodium falciparum
KKEKKGKAEKTEK

SEQ ID NO: 3320530 - protein, 10 aa, Plasmodium falciparum
KKEKKGLNKL

SEQ ID NO: 3320531 - protein, 9 aa, Plasmodium falciparum
KKEKKKKIP

SEQ ID NO: 3320532 - protein, 9 aa, Plasmodium falciparum
KKEKKKKKK

SEQ ID NO: 3320533 - protein, 23 aa, Plasmodium falciparum
KKEKKKKLKNKKNKKKNKENKNT

SEQ ID NO: 3320534 - protein, 13 aa, Plasmodium falciparum
KKEKKKLKEEKEL

SEQ ID NO: 3320535 - protein, 10 aa, Plasmodium falciparum
KKEKKKNRRM

SEQ ID NO: 3320536 - protein, 9 aa, Plasmodium falciparum
KKEKKKTKK

SEQ ID NO: 3320537 - protein, 17 aa, Plasmodium falciparum
KKEKKKYRKNDEHNDLN

SEQ ID NO: 3320538 - protein, 6 aa, Plasmodium falciparum
KKEKKQ

SEQ ID NO: 3320539 - protein, 9 aa, Plasmodium falciparum
KKEKKRKLK

SEQ ID NO: 3320540 - protein, 15 aa, Plasmodium falciparum
KKEKKRKRKESKRDI

SEQ ID NO: 3320541 - protein, 9 aa, Plasmodium falciparum
KKEKLRNEY

SEQ ID NO: 3320542 - protein, 8 aa, Plasmodium falciparum
KKEKMNDS

SEQ ID NO: 3320543 - protein, 8 aa, Plasmodium falciparum
KKEKNDEY

SEQ ID NO: 3320544 - protein, 9 aa, Plasmodium falciparum
KKEKNEKIE

SEQ ID NO: 3320545 - protein, 10 aa, Plasmodium falciparum
KKEKNKMNIN

SEQ ID NO: 3320546 - protein, 15 aa, Plasmodium falciparum
KKEKNKQSKKDKYKK

SEQ ID NO: 3320547 - protein, 9 aa, Plasmodium falciparum
KKEKNKSNC

SEQ ID NO: 3320548 - protein, 10 aa, Plasmodium falciparum
KKEKNNDVPE

SEQ ID NO: 3320549 - protein, 13 aa, Plasmodium falciparum
KKEKNNEDKKNKY

SEQ ID NO: 3320550 - protein, 13 aa, Plasmodium falciparum
KKEKNNNDNKNSK

SEQ ID NO: 3320551 - protein, 7 aa, Plasmodium falciparum
KKEKNYN

SEQ ID NO: 3320552 - protein, 7 aa, Plasmodium falciparum
KKEKQEL

SEQ ID NO: 3320553 - protein, 8 aa, Plasmodium falciparum
KKEKQNDI

SEQ ID NO: 3320554 - protein, 7 aa, Plasmodium falciparum
KKEKQNK

SEQ ID NO: 3320555 - protein, 8 aa, Plasmodium falciparum
KKEKQYKD

SEQ ID NO: 3320556 - protein, 9 aa, Plasmodium falciparum
KKEKRAQMG

SEQ ID NO: 3320557 - protein, 11 aa, Plasmodium falciparum
KKEKRKEEKIK

SEQ ID NO: 3320558 - protein, 13 aa, Plasmodium falciparum
KKEKSGDKKWEDT

SEQ ID NO: 3320559 - protein, 45 aa, Plasmodium falciparum
KKEKSNTPLSKNKLPDIGSPATNNVKETSLTSDKKKKKKNPYETS

SEQ ID NO: 3320560 - protein, 7 aa, Plasmodium falciparum
KKEKTKN

SEQ ID NO: 3320561 - protein, 9 aa, Plasmodium falciparum
KKEKTNEKI

SEQ ID NO: 3320562 - protein, 5 aa, Plasmodium falciparum
KKEKY

SEQ ID NO: 3320563 - protein, 18 aa, Plasmodium falciparum
KKEKYEKEMKERKEKNED

SEQ ID NO: 3320564 - protein, 4 aa, Plasmodium falciparum
KKEL

SEQ ID NO: 3320565 - protein, 9 aa, Plasmodium falciparum
KKELDEQSK

SEQ ID NO: 3320566 - protein, 8 aa, Plasmodium falciparum
KKELDKKV

SEQ ID NO: 3320567 - protein, 5 aa, Plasmodium falciparum
KKELE

SEQ ID NO: 3320568 - protein, 15 aa, Plasmodium falciparum
KKELEDEKKKNIEIS

SEQ ID NO: 3320569 - protein, 7 aa, Plasmodium falciparum
KKELEKK

SEQ ID NO: 3320570 - protein, 7 aa, Plasmodium falciparum
KKELELN

SEQ ID NO: 3320571 - protein, 6 aa, Plasmodium falciparum
KKELEN

SEQ ID NO: 3320572 - protein, 11 aa, Plasmodium falciparum
KKELNNDNNLN

SEQ ID NO: 3320573 - protein, 25 aa, Plasmodium falciparum
KKELSDEADNLNNIENNQNEKKQEN

SEQ ID NO: 3320574 - protein, 8 aa, Plasmodium falciparum
KKELTKEE

SEQ ID NO: 3320575 - protein, 9 aa, Plasmodium falciparum
KKELTTQSD

SEQ ID NO: 3320576 - protein, 4 aa, Plasmodium falciparum
KKEM

SEQ ID NO: 3320577 - protein, 6 aa, Plasmodium falciparum
KKEMND

SEQ ID NO: 3320578 - protein, 6 aa, Plasmodium falciparum
KKEMNI

SEQ ID NO: 3320579 - protein, 5 aa, Plasmodium falciparum
KKENA

SEQ ID NO: 3320580 - protein, 9 aa, Plasmodium falciparum
KKENAKKNH

SEQ ID NO: 3320581 - protein, 19 aa, Plasmodium falciparum
KKENDENNDNNTNNNNDKI

SEQ ID NO: 3320582 - protein, 7 aa, Plasmodium falciparum
KKENDNE

SEQ ID NO: 3320583 - protein, 16 aa, Plasmodium falciparum
KKENDQNKSDSLDKQK

SEQ ID NO: 3320584 - protein, 7 aa, Plasmodium falciparum
KKENDSL

SEQ ID NO: 3320585 - protein, 8 aa, Plasmodium falciparum
KKENEEIS

SEQ ID NO: 3320586 - protein, 8 aa, Plasmodium falciparum
KKENEKKY

SEQ ID NO: 3320587 - protein, 12 aa, Plasmodium falciparum
KKENEKLKDEIN

SEQ ID NO: 3320588 - protein, 6 aa, Plasmodium falciparum
KKENEL

SEQ ID NO: 3320589 - protein, 5 aa, Plasmodium falciparum
KKENF

SEQ ID NO: 3320590 - protein, 12 aa, Plasmodium falciparum
KKENGNKTNINS

SEQ ID NO: 3320591 - protein, 8 aa, Plasmodium falciparum
KKENKTKF

SEQ ID NO: 3320592 - protein, 5 aa, Plasmodium falciparum
KKENL

SEQ ID NO: 3320593 - protein, 8 aa, Plasmodium falciparum
KKENLKDE

SEQ ID NO: 3320594 - protein, 6 aa, Plasmodium falciparum
KKENLT

SEQ ID NO: 3320595 - protein, 12 aa, Plasmodium falciparum
KKENMKKNNTID

SEQ ID NO: 3320596 - protein, 65 aa, Plasmodium falciparum
KKENMKSGQNGKDDYNDDNNDDNNDDNNDDNNDDVNSDNNNNNSNNSSDDNSDDINDEEKTDEYY

SEQ ID NO: 3320597 - protein, 8 aa, Plasmodium falciparum
KKENMQKE

SEQ ID NO: 3320598 - protein, 50 aa, Plasmodium falciparum
KKENNENVNEENYSSKDKQKNIDNSKDIVQNEENMNKEQIKDNMKRKKKK

SEQ ID NO: 3320599 - protein, 11 aa, Plasmodium falciparum
KKENNKKNITQ

SEQ ID NO: 3320600 - protein, 6 aa, Plasmodium falciparum
KKENNM

SEQ ID NO: 3320601 - protein, 7 aa, Plasmodium falciparum
KKENNNI

SEQ ID NO: 3320602 - protein, 80 aa, Plasmodium falciparum
KKENNNNKKKENNDNKKKENNNNKKKENNNNKKKENNNNKKKENNNNKKKENNNNKKKENNNNKKKENNNKNNNNNNNNH

SEQ ID NO: 3320603 - protein, 18 aa, Plasmodium falciparum
KKENNNNNKSKKNDYSEN

SEQ ID NO: 3320604 - protein, 9 aa, Plasmodium falciparum
KKENNNNYN

SEQ ID NO: 3320605 - protein, 9 aa, Plasmodium falciparum
KKENNSYNH

SEQ ID NO: 3320606 - protein, 6 aa, Plasmodium falciparum
KKENNY

SEQ ID NO: 3320607 - protein, 7 aa, Plasmodium falciparum
KKENQQI

SEQ ID NO: 3320608 - protein, 5 aa, Plasmodium falciparum
KKENS

SEQ ID NO: 3320609 - protein, 9 aa, Plasmodium falciparum
KKENTQNDH

SEQ ID NO: 3320610 - protein, 5 aa, Plasmodium falciparum
KKENV

SEQ ID NO: 3320611 - protein, 16 aa, Plasmodium falciparum
KKENVDKLDDLLLIDS

SEQ ID NO: 3320612 - protein, 22 aa, Plasmodium falciparum
KKENVEKQKNHQNNKTSNNIYD

SEQ ID NO: 3320613 - protein, 14 aa, Plasmodium falciparum
KKENVGKTTELSNS

SEQ ID NO: 3320614 - protein, 6 aa, Plasmodium falciparum
KKENVT

SEQ ID NO: 3320615 - protein, 5 aa, Plasmodium falciparum
KKENY

SEQ ID NO: 3320616 - protein, 7 aa, Plasmodium falciparum
KKENYNG

SEQ ID NO: 3320617 - protein, 4 aa, Plasmodium falciparum
KKEP

SEQ ID NO: 3320618 - protein, 13 aa, Plasmodium falciparum
KKEPLKKTKTNLD

SEQ ID NO: 3320619 - protein, 9 aa, Plasmodium falciparum
KKEPYEDRL

SEQ ID NO: 3320620 - protein, 23 aa, Plasmodium falciparum
KKEQDEDEGDNDEEDKNSNNNYN

SEQ ID NO: 3320621 - protein, 6 aa, Plasmodium falciparum
KKEQDI

SEQ ID NO: 3320622 - protein, 18 aa, Plasmodium falciparum
KKEQDQKNEKDGKDDKRD

SEQ ID NO: 3320623 - protein, 27 aa, Plasmodium falciparum
KKEQENNDNVNDHEDKPTADVDTNKNK

SEQ ID NO: 3320624 - protein, 27 aa, Plasmodium falciparum
KKEQEQKEKGKGKGNKRELQKEKDKSY

SEQ ID NO: 3320625 - protein, 7 aa, Plasmodium falciparum
KKEQERC

SEQ ID NO: 3320626 - protein, 16 aa, Plasmodium falciparum
KKEQKDKNNLKNLPQK

SEQ ID NO: 3320627 - protein, 8 aa, Plasmodium falciparum
KKEQKSHL

SEQ ID NO: 3320628 - protein, 18 aa, Plasmodium falciparum
KKEQKYKIKEKDKIEEKY

SEQ ID NO: 3320629 - protein, 6 aa, Plasmodium falciparum
KKEQLK

SEQ ID NO: 3320630 - protein, 40 aa, Plasmodium falciparum
KKEQNRYDHEQNRYDHEQNQYDHEQNQYDHKQHPSEHETY

SEQ ID NO: 3320631 - protein, 14 aa, Plasmodium falciparum
KKEQQMGNSNTHVN

SEQ ID NO: 3320632 - protein, 12 aa, Plasmodium falciparum
KKEQRKKKKIFN

SEQ ID NO: 3320633 - protein, 9 aa, Plasmodium falciparum
KKEQTNQYN

SEQ ID NO: 3320634 - protein, 6 aa, Plasmodium falciparum
KKERAY

SEQ ID NO: 3320635 - protein, 9 aa, Plasmodium falciparum
KKERDNDKT

SEQ ID NO: 3320636 - protein, 7 aa, Plasmodium falciparum
KKEREEC

SEQ ID NO: 3320637 - protein, 6 aa, Plasmodium falciparum
KKEREN

SEQ ID NO: 3320638 - protein, 8 aa, Plasmodium falciparum
KKERKQRE

SEQ ID NO: 3320639 - protein, 11 aa, Plasmodium falciparum
KKERRKNSENG

SEQ ID NO: 3320640 - protein, 59 aa, Plasmodium falciparum
KKERSEKKRIEKEKIEKEGNEKGGNEKEGNEKGSNEKEGNEKEGNKKEGNDNDEQHEIN

SEQ ID NO: 3320641 - protein, 4 aa, Plasmodium falciparum
KKES

SEQ ID NO: 3320642 - protein, 28 aa, Plasmodium falciparum
KKESDGDIAEEKINNDKNNNKKEINNKQ

SEQ ID NO: 3320643 - protein, 5 aa, Plasmodium falciparum
KKESE

SEQ ID NO: 3320644 - protein, 14 aa, Plasmodium falciparum
KKESEKGKNKEIEK

SEQ ID NO: 3320645 - protein, 32 aa, Plasmodium falciparum
KKESGHEENKNVDKEYISDNQTNFNNDQEGVD

SEQ ID NO: 3320646 - protein, 8 aa, Plasmodium falciparum
KKESGIGN

SEQ ID NO: 3320647 - protein, 5 aa, Plasmodium falciparum
KKESI

SEQ ID NO: 3320648 - protein, 7 aa, Plasmodium falciparum
KKESITN

SEQ ID NO: 3320649 - protein, 6 aa, Plasmodium falciparum
KKESKN

SEQ ID NO: 3320650 - protein, 7 aa, Plasmodium falciparum
KKESLEN

SEQ ID NO: 3320651 - protein, 10 aa, Plasmodium falciparum
KKESNEHSKY

SEQ ID NO: 3320652 - protein, 10 aa, Plasmodium falciparum
KKESNNLNSE

SEQ ID NO: 3320653 - protein, 10 aa, Plasmodium falciparum
KKESNTKEIN

SEQ ID NO: 3320654 - protein, 11 aa, Plasmodium falciparum
KKESPQKSKKH

SEQ ID NO: 3320655 - protein, 4 aa, Plasmodium falciparum
KKET

SEQ ID NO: 3320656 - protein, 6 aa, Plasmodium falciparum
KKETAH

SEQ ID NO: 3320657 - protein, 69 aa, Plasmodium falciparum
KKETDKGNVNNNKNKDKNEQNNEKENNNENEHSNVNGHNNVNEHSNVNEHSNVNEHSNVNKHNNTNVHN

SEQ ID NO: 3320658 - protein, 8 aa, Plasmodium falciparum
KKETIKQE

SEQ ID NO: 3320659 - protein, 10 aa, Plasmodium falciparum
KKETKKQNVE

SEQ ID NO: 3320660 - protein, 11 aa, Plasmodium falciparum
KKETKRKDGSY

SEQ ID NO: 3320661 - protein, 7 aa, Plasmodium falciparum
KKETNES

SEQ ID NO: 3320662 - protein, 6 aa, Plasmodium falciparum
KKETNL

SEQ ID NO: 3320663 - protein, 6 aa, Plasmodium falciparum
KKETNT

SEQ ID NO: 3320664 - protein, 7 aa, Plasmodium falciparum
KKETNYQ

SEQ ID NO: 3320665 - protein, 10 aa, Plasmodium falciparum
KKETPSNINS

SEQ ID NO: 3320666 - protein, 5 aa, Plasmodium falciparum
KKETQ

SEQ ID NO: 3320667 - protein, 6 aa, Plasmodium falciparum
KKETSL

SEQ ID NO: 3320668 - protein, 10 aa, Plasmodium falciparum
KKETSNSTHK

SEQ ID NO: 3320669 - protein, 7 aa, Plasmodium falciparum
KKETSNY

SEQ ID NO: 3320670 - protein, 21 aa, Plasmodium falciparum
KKETTAKGEIVSEKKKTSKGS

SEQ ID NO: 3320671 - protein, 8 aa, Plasmodium falciparum
KKETTEIQ

SEQ ID NO: 3320672 - protein, 70 aa, Plasmodium falciparum
KKETTYNNNNNNNKNINHNNNNNKNINHNNNNHNNNHNNNHNNNHNNNHNNNHNNNHNNNHNNNNNHNND

SEQ ID NO: 3320673 - protein, 6 aa, Plasmodium falciparum
KKEVEK

SEQ ID NO: 3320674 - protein, 6 aa, Plasmodium falciparum
KKEVRN

SEQ ID NO: 3320675 - protein, 11 aa, Plasmodium falciparum
KKEVRNESDNN

SEQ ID NO: 3320676 - protein, 4 aa, Plasmodium falciparum
KKEY

SEQ ID NO: 3320677 - protein, 5 aa, Plasmodium falciparum
KKEYD

SEQ ID NO: 3320678 - protein, 5 aa, Plasmodium falciparum
KKEYE

SEQ ID NO: 3320679 - protein, 15 aa, Plasmodium falciparum
KKEYEEKNETSKDVD

SEQ ID NO: 3320680 - protein, 12 aa, Plasmodium falciparum
KKEYEKNNQLKM

SEQ ID NO: 3320681 - protein, 5 aa, Plasmodium falciparum
KKEYH

SEQ ID NO: 3320682 - protein, 6 aa, Plasmodium falciparum
KKEYKE

SEQ ID NO: 3320683 - protein, 7 aa, Plasmodium falciparum
KKEYKEK

SEQ ID NO: 3320684 - protein, 15 aa, Plasmodium falciparum
KKEYKQYNNEDDNKI

SEQ ID NO: 3320685 - protein, 6 aa, Plasmodium falciparum
KKEYKT

SEQ ID NO: 3320686 - protein, 8 aa, Plasmodium falciparum
KKEYNDFE

SEQ ID NO: 3320687 - protein, 8 aa, Plasmodium falciparum
KKEYSSSE

SEQ ID NO: 3320688 - protein, 14 aa, Plasmodium falciparum
KKEYTKKLNGQKNE

SEQ ID NO: 3320689 - protein, 7 aa, Plasmodium falciparum
KKFASDN

SEQ ID NO: 3320690 - protein, 12 aa, Plasmodium falciparum
KKFASKRPSTYR

SEQ ID NO: 3320691 - protein, 4 aa, Plasmodium falciparum
KKFD

SEQ ID NO: 3320692 - protein, 11 aa, Plasmodium falciparum
KKFDKNQKNNI

SEQ ID NO: 3320693 - protein, 7 aa, Plasmodium falciparum
KKFGAPV

SEQ ID NO: 3320694 - protein, 7 aa, Plasmodium falciparum
KKFGDSA

SEQ ID NO: 3320695 - protein, 4 aa, Plasmodium falciparum
KKFK

SEQ ID NO: 3320696 - protein, 9 aa, Plasmodium falciparum
KKFNKKERY

SEQ ID NO: 3320697 - protein, 5 aa, Plasmodium falciparum
KKFPP

SEQ ID NO: 3320698 - protein, 5 aa, Plasmodium falciparum
KKFQP

SEQ ID NO: 3320699 - protein, 8 aa, Plasmodium falciparum
KKFSSEYI

SEQ ID NO: 3320700 - protein, 16 aa, Plasmodium falciparum
KKFSVSENEDYKNSLT

SEQ ID NO: 3320701 - protein, 5 aa, Plasmodium falciparum
KKFTS

SEQ ID NO: 3320702 - protein, 7 aa, Plasmodium falciparum
KKFVGEN

SEQ ID NO: 3320703 - protein, 11 aa, Plasmodium falciparum
KKGAGKGKISS

SEQ ID NO: 3320704 - protein, 6 aa, Plasmodium falciparum
KKGANF

SEQ ID NO: 3320705 - protein, 4 aa, Plasmodium falciparum
KKGD

SEQ ID NO: 3320706 - protein, 7 aa, Plasmodium falciparum
KKGDKNF

SEQ ID NO: 3320707 - protein, 9 aa, Plasmodium falciparum
KKGDRNNSI

SEQ ID NO: 3320708 - protein, 20 aa, Plasmodium falciparum
KKGDTQNNHNNHNNNNNSNN

SEQ ID NO: 3320709 - protein, 8 aa, Plasmodium falciparum
KKGEEKIK

SEQ ID NO: 3320710 - protein, 8 aa, Plasmodium falciparum
KKGEHNSW

SEQ ID NO: 3320711 - protein, 11 aa, Plasmodium falciparum
KKGEKENSTGN

SEQ ID NO: 3320712 - protein, 7 aa, Plasmodium falciparum
KKGEKNQ

SEQ ID NO: 3320713 - protein, 12 aa, Plasmodium falciparum
KKGENNNHNNIT

SEQ ID NO: 3320714 - protein, 7 aa, Plasmodium falciparum
KKGEPNI

SEQ ID NO: 3320715 - protein, 11 aa, Plasmodium falciparum
KKGESEFRQSN

SEQ ID NO: 3320716 - protein, 9 aa, Plasmodium falciparum
KKGESEIPS

SEQ ID NO: 3320717 - protein, 20 aa, Plasmodium falciparum
KKGESNNVPHKEKHNNKKNY

SEQ ID NO: 3320718 - protein, 6 aa, Plasmodium falciparum
KKGESW

SEQ ID NO: 3320719 - protein, 4 aa, Plasmodium falciparum
KKGF

SEQ ID NO: 3320720 - protein, 7 aa, Plasmodium falciparum
KKGGDNI

SEQ ID NO: 3320721 - protein, 11 aa, Plasmodium falciparum
KKGGEGEKDTY

SEQ ID NO: 3320722 - protein, 7 aa, Plasmodium falciparum
KKGGQEN

SEQ ID NO: 3320723 - protein, 27 aa, Plasmodium falciparum
KKGGYEQHTEQNNEQNNEQNSEQNIEQ

SEQ ID NO: 3320724 - protein, 7 aa, Plasmodium falciparum
KKGHPEF

SEQ ID NO: 3320725 - protein, 4 aa, Plasmodium falciparum
KKGI

SEQ ID NO: 3320726 - protein, 12 aa, Plasmodium falciparum
KKGIEDKNKLNE

SEQ ID NO: 3320727 - protein, 8 aa, Plasmodium falciparum
KKGIENVK

SEQ ID NO: 3320728 - protein, 5 aa, Plasmodium falciparum
KKGIK

SEQ ID NO: 3320729 - protein, 18 aa, Plasmodium falciparum
KKGINNNDMSKNRNITNS

SEQ ID NO: 3320730 - protein, 5 aa, Plasmodium falciparum
KKGIT

SEQ ID NO: 3320731 - protein, 4 aa, Plasmodium falciparum
KKGK

SEQ ID NO: 3320732 - protein, 8 aa, Plasmodium falciparum
KKGKDFLD

SEQ ID NO: 3320733 - protein, 11 aa, Plasmodium falciparum
KKGKETKNGHT

SEQ ID NO: 3320734 - protein, 9 aa, Plasmodium falciparum
KKGKETYPQ

SEQ ID NO: 3320735 - protein, 7 aa, Plasmodium falciparum
KKGKGEK

SEQ ID NO: 3320736 - protein, 7 aa, Plasmodium falciparum
KKGKGEQ

SEQ ID NO: 3320737 - protein, 7 aa, Plasmodium falciparum
KKGKGLT

SEQ ID NO: 3320738 - protein, 9 aa, Plasmodium falciparum
KKGKIADGR

SEQ ID NO: 3320739 - protein, 6 aa, Plasmodium falciparum
KKGKKA

SEQ ID NO: 3320740 - protein, 7 aa, Plasmodium falciparum
KKGKKGI

SEQ ID NO: 3320741 - protein, 8 aa, Plasmodium falciparum
KKGKKKIS

SEQ ID NO: 3320742 - protein, 9 aa, Plasmodium falciparum
KKGKKKNMG

SEQ ID NO: 3320743 - protein, 18 aa, Plasmodium falciparum
KKGKKRKNSVNTSDKENM

SEQ ID NO: 3320744 - protein, 7 aa, Plasmodium falciparum
KKGKLKY

SEQ ID NO: 3320745 - protein, 21 aa, Plasmodium falciparum
KKGKNKNNNDTTNNRNNNNNN

SEQ ID NO: 3320746 - protein, 7 aa, Plasmodium falciparum
KKGKQKS

SEQ ID NO: 3320747 - protein, 10 aa, Plasmodium falciparum
KKGKSKSTVT

SEQ ID NO: 3320748 - protein, 5 aa, Plasmodium falciparum
KKGKT

SEQ ID NO: 3320749 - protein, 8 aa, Plasmodium falciparum
KKGKTAAA

SEQ ID NO: 3320750 - protein, 6 aa, Plasmodium falciparum
KKGKYT

SEQ ID NO: 3320751 - protein, 8 aa, Plasmodium falciparum
KKGLEEAN

SEQ ID NO: 3320752 - protein, 7 aa, Plasmodium falciparum
KKGLEKD

SEQ ID NO: 3320753 - protein, 13 aa, Plasmodium falciparum
KKGLGHLSNVEKE

SEQ ID NO: 3320754 - protein, 5 aa, Plasmodium falciparum
KKGLN

SEQ ID NO: 3320755 - protein, 4 aa, Plasmodium falciparum
KKGM

SEQ ID NO: 3320756 - protein, 12 aa, Plasmodium falciparum
KKGMNKVEEKNM

SEQ ID NO: 3320757 - protein, 7 aa, Plasmodium falciparum
KKGNCEN

SEQ ID NO: 3320758 - protein, 9 aa, Plasmodium falciparum
KKGNDIDYK

SEQ ID NO: 3320759 - protein, 11 aa, Plasmodium falciparum
KKGNDNEIKGQ

SEQ ID NO: 3320760 - protein, 12 aa, Plasmodium falciparum
KKGNEKNDFPYD

SEQ ID NO: 3320761 - protein, 10 aa, Plasmodium falciparum
KKGNESEYKI

SEQ ID NO: 3320762 - protein, 15 aa, Plasmodium falciparum
KKGNKNDTTTQEKQS

SEQ ID NO: 3320763 - protein, 19 aa, Plasmodium falciparum
KKGNLYNNNNNNNNNNNNK

SEQ ID NO: 3320764 - protein, 12 aa, Plasmodium falciparum
KKGNNINSTHNG

SEQ ID NO: 3320765 - protein, 7 aa, Plasmodium falciparum
KKGNNTR

SEQ ID NO: 3320766 - protein, 13 aa, Plasmodium falciparum
KKGNYCDNKNNNE

SEQ ID NO: 3320767 - protein, 7 aa, Plasmodium falciparum
KKGQEKL

SEQ ID NO: 3320768 - protein, 5 aa, Plasmodium falciparum
KKGQS

SEQ ID NO: 3320769 - protein, 10 aa, Plasmodium falciparum
KKGQTPSQIG

SEQ ID NO: 3320770 - protein, 8 aa, Plasmodium falciparum
KKGQYAYP

SEQ ID NO: 3320771 - protein, 8 aa, Plasmodium falciparum
KKGREGNS

SEQ ID NO: 3320772 - protein, 7 aa, Plasmodium falciparum
KKGRNEF

SEQ ID NO: 3320773 - protein, 7 aa, Plasmodium falciparum
KKGRTIN

SEQ ID NO: 3320774 - protein, 8 aa, Plasmodium falciparum
KKGSDRHK

SEQ ID NO: 3320775 - protein, 8 aa, Plasmodium falciparum
KKGSKKNY

SEQ ID NO: 3320776 - protein, 9 aa, Plasmodium falciparum
KKGTGKNKY

SEQ ID NO: 3320777 - protein, 8 aa, Plasmodium falciparum
KKGVKEKD

SEQ ID NO: 3320778 - protein, 4 aa, Plasmodium falciparum
KKGY

SEQ ID NO: 3320779 - protein, 7 aa, Plasmodium falciparum
KKGYNAA

SEQ ID NO: 3320780 - protein, 5 aa, Plasmodium falciparum
KKGYR

SEQ ID NO: 3320781 - protein, 10 aa, Plasmodium falciparum
KKGYSDGTYR

SEQ ID NO: 3320782 - protein, 4 aa, Plasmodium falciparum
KKHD

SEQ ID NO: 3320783 - protein, 7 aa, Plasmodium falciparum
KKHDEKY

SEQ ID NO: 3320784 - protein, 10 aa, Plasmodium falciparum
KKHDLSNNKM

SEQ ID NO: 3320785 - protein, 43 aa, Plasmodium falciparum
KKHEEDSSSTDNTNFSDIQDKDDLEYNESSEGDNGNYNESDDF

SEQ ID NO: 3320786 - protein, 14 aa, Plasmodium falciparum
KKHEHDDENSNDEI

SEQ ID NO: 3320787 - protein, 6 aa, Plasmodium falciparum
KKHEPT

SEQ ID NO: 3320788 - protein, 10 aa, Plasmodium falciparum
KKHERNQTNQ

SEQ ID NO: 3320789 - protein, 6 aa, Plasmodium falciparum
KKHGGY

SEQ ID NO: 3320790 - protein, 10 aa, Plasmodium falciparum
KKHGRGGQSA

SEQ ID NO: 3320791 - protein, 53 aa, Plasmodium falciparum
KKHIEGKEDCNSINEQKKEEKRKDAEYLEEKAKREKEYDEKIKKEKDDKEKEI

SEQ ID NO: 3320792 - protein, 13 aa, Plasmodium falciparum
KKHIQKKKKKKTV

SEQ ID NO: 3320793 - protein, 8 aa, Plasmodium falciparum
KKHKLPKD

SEQ ID NO: 3320794 - protein, 13 aa, Plasmodium falciparum
KKHKNGDENNIDN

SEQ ID NO: 3320795 - protein, 7 aa, Plasmodium falciparum
KKHKNNL

SEQ ID NO: 3320796 - protein, 6 aa, Plasmodium falciparum
KKHLEN

SEQ ID NO: 3320797 - protein, 5 aa, Plasmodium falciparum
KKHLS

SEQ ID NO: 3320798 - protein, 4 aa, Plasmodium falciparum
KKHN

SEQ ID NO: 3320799 - protein, 5 aa, Plasmodium falciparum
KKHNK

SEQ ID NO: 3320800 - protein, 21 aa, Plasmodium falciparum
KKHNTNVNNKKKSKNVQQETP

SEQ ID NO: 3320801 - protein, 5 aa, Plasmodium falciparum
KKHNY

SEQ ID NO: 3320802 - protein, 4 aa, Plasmodium falciparum
KKHQ

SEQ ID NO: 3320803 - protein, 6 aa, Plasmodium falciparum
KKHQNV

SEQ ID NO: 3320804 - protein, 8 aa, Plasmodium falciparum
KKHSEQTS

SEQ ID NO: 3320805 - protein, 9 aa, Plasmodium falciparum
KKHSTTKEA

SEQ ID NO: 3320806 - protein, 26 aa, Plasmodium falciparum
KKHTKKRKQDTNQNTNNISKKKNEQI

SEQ ID NO: 3320807 - protein, 6 aa, Plasmodium falciparum
KKHTYT

SEQ ID NO: 3320808 - protein, 6 aa, Plasmodium falciparum
KKHYND

SEQ ID NO: 3320809 - protein, 9 aa, Plasmodium falciparum
KKIAENVSD

SEQ ID NO: 3320810 - protein, 9 aa, Plasmodium falciparum
KKIASNKTF

SEQ ID NO: 3320811 - protein, 22 aa, Plasmodium falciparum
KKIDEDREKRNNHTKNTKEIHN

SEQ ID NO: 3320812 - protein, 6 aa, Plasmodium falciparum
KKIDEQ

SEQ ID NO: 3320813 - protein, 6 aa, Plasmodium falciparum
KKIDKK

SEQ ID NO: 3320814 - protein, 25 aa, Plasmodium falciparum
KKIDKKKVSKGKEKETENEETNIVT

SEQ ID NO: 3320815 - protein, 8 aa, Plasmodium falciparum
KKIDPEKI

SEQ ID NO: 3320816 - protein, 14 aa, Plasmodium falciparum
KKIDPTKSSDINIE

SEQ ID NO: 3320817 - protein, 25 aa, Plasmodium falciparum
KKIDTTNYENSNTLYNNQNNKAISS

SEQ ID NO: 3320818 - protein, 4 aa, Plasmodium falciparum
KKIE

SEQ ID NO: 3320819 - protein, 11 aa, Plasmodium falciparum
KKIEDDKHSKD

SEQ ID NO: 3320820 - protein, 9 aa, Plasmodium falciparum
KKIEEKESK

SEQ ID NO: 3320821 - protein, 5 aa, Plasmodium falciparum
KKIEG

SEQ ID NO: 3320822 - protein, 6 aa, Plasmodium falciparum
KKIEQE

SEQ ID NO: 3320823 - protein, 7 aa, Plasmodium falciparum
KKIEQTN

SEQ ID NO: 3320824 - protein, 14 aa, Plasmodium falciparum
KKIERKNTTTIATK

SEQ ID NO: 3320825 - protein, 18 aa, Plasmodium falciparum
KKIESSKANEGIKDSESA

SEQ ID NO: 3320826 - protein, 28 aa, Plasmodium falciparum
KKIETNKKDEEKKKKKKKKKKKKMEVNT

SEQ ID NO: 3320827 - protein, 13 aa, Plasmodium falciparum
KKIEYNNNVNDES

SEQ ID NO: 3320828 - protein, 5 aa, Plasmodium falciparum
KKIGG

SEQ ID NO: 3320829 - protein, 7 aa, Plasmodium falciparum
KKIGNNE

SEQ ID NO: 3320830 - protein, 7 aa, Plasmodium falciparum
KKIGPKT

SEQ ID NO: 3320831 - protein, 31 aa, Plasmodium falciparum
KKIHAPKNNNAQNNTINNNKDQKKKDHNHVD

SEQ ID NO: 3320832 - protein, 6 aa, Plasmodium falciparum
KKIHES

SEQ ID NO: 3320833 - protein, 6 aa, Plasmodium falciparum
KKIHGS

SEQ ID NO: 3320834 - protein, 4 aa, Plasmodium falciparum
KKII

SEQ ID NO: 3320835 - protein, 6 aa, Plasmodium falciparum
KKIINN

SEQ ID NO: 3320836 - protein, 4 aa, Plasmodium falciparum
KKIK

SEQ ID NO: 3320837 - protein, 6 aa, Plasmodium falciparum
KKIKAA

SEQ ID NO: 3320838 - protein, 25 aa, Plasmodium falciparum
KKIKDTKERKGEQLEDELKSSNKTL

SEQ ID NO: 3320839 - protein, 11 aa, Plasmodium falciparum
KKIKEEKEQKI

SEQ ID NO: 3320840 - protein, 10 aa, Plasmodium falciparum
KKIKEGDSQL

SEQ ID NO: 3320841 - protein, 8 aa, Plasmodium falciparum
KKIKEKKN

SEQ ID NO: 3320842 - protein, 6 aa, Plasmodium falciparum
KKIKEN

SEQ ID NO: 3320843 - protein, 6 aa, Plasmodium falciparum
KKIKES

SEQ ID NO: 3320844 - protein, 71 aa, Plasmodium falciparum
KKIKKDDINKKEDINKKDDINKKDNINKKNDINKKDDINKKDDINKKGDINKKDDINKKNNYNNNSNNNNV

SEQ ID NO: 3320845 - protein, 11 aa, Plasmodium falciparum
KKIKKEKHKTY

SEQ ID NO: 3320846 - protein, 42 aa, Plasmodium falciparum
KKIKKKKLKKTKKKKKNQNIKNQESSILSNSNDEQDDDKKLR

SEQ ID NO: 3320847 - protein, 11 aa, Plasmodium falciparum
KKIKKNKKFKN

SEQ ID NO: 3320848 - protein, 8 aa, Plasmodium falciparum
KKIKKSNN

SEQ ID NO: 3320849 - protein, 7 aa, Plasmodium falciparum
KKIKRKK

SEQ ID NO: 3320850 - protein, 5 aa, Plasmodium falciparum
KKIKS

SEQ ID NO: 3320851 - protein, 25 aa, Plasmodium falciparum
KKIKTKNNNNNNNNNNNNNNNNNNI

SEQ ID NO: 3320852 - protein, 7 aa, Plasmodium falciparum
KKIKYSN

SEQ ID NO: 3320853 - protein, 12 aa, Plasmodium falciparum
KKILETNNEPNY

SEQ ID NO: 3320854 - protein, 21 aa, Plasmodium falciparum
KKILNTSQKNSQKNEKEHDHT

SEQ ID NO: 3320855 - protein, 4 aa, Plasmodium falciparum
KKIN

SEQ ID NO: 3320856 - protein, 13 aa, Plasmodium falciparum
KKINDDDNNNISK

SEQ ID NO: 3320857 - protein, 11 aa, Plasmodium falciparum
KKINDEKKKNY

SEQ ID NO: 3320858 - protein, 30 aa, Plasmodium falciparum
KKINDGDEIKSRTSLKEEKEKKKETNTNNS

SEQ ID NO: 3320859 - protein, 6 aa, Plasmodium falciparum
KKINDS

SEQ ID NO: 3320860 - protein, 21 aa, Plasmodium falciparum
KKINETTSTTYDPKKSKEAQK

SEQ ID NO: 3320861 - protein, 6 aa, Plasmodium falciparum
KKINEY

SEQ ID NO: 3320862 - protein, 6 aa, Plasmodium falciparum
KKINKG

SEQ ID NO: 3320863 - protein, 19 aa, Plasmodium falciparum
KKINKKGYTNLSSMSTKDS

SEQ ID NO: 3320864 - protein, 7 aa, Plasmodium falciparum
KKINKNE

SEQ ID NO: 3320865 - protein, 9 aa, Plasmodium falciparum
KKINKNNIT

SEQ ID NO: 3320866 - protein, 5 aa, Plasmodium falciparum
KKINN

SEQ ID NO: 3320867 - protein, 6 aa, Plasmodium falciparum
KKINND

SEQ ID NO: 3320868 - protein, 15 aa, Plasmodium falciparum
KKINNEKEITKEKKK

SEQ ID NO: 3320869 - protein, 7 aa, Plasmodium falciparum
KKINNGT

SEQ ID NO: 3320870 - protein, 21 aa, Plasmodium falciparum
KKINNLNSQNIQRNNSMKETT

SEQ ID NO: 3320871 - protein, 14 aa, Plasmodium falciparum
KKINNNVENNKQHN

SEQ ID NO: 3320872 - protein, 6 aa, Plasmodium falciparum
KKINNS

SEQ ID NO: 3320873 - protein, 12 aa, Plasmodium falciparum
KKINSNYKNGDA

SEQ ID NO: 3320874 - protein, 5 aa, Plasmodium falciparum
KKINY

SEQ ID NO: 3320875 - protein, 7 aa, Plasmodium falciparum
KKIPKNK

SEQ ID NO: 3320876 - protein, 7 aa, Plasmodium falciparum
KKIPTKK

SEQ ID NO: 3320877 - protein, 6 aa, Plasmodium falciparum
KKIPTS

SEQ ID NO: 3320878 - protein, 9 aa, Plasmodium falciparum
KKIPTSHDK

SEQ ID NO: 3320879 - protein, 5 aa, Plasmodium falciparum
KKIPV

SEQ ID NO: 3320880 - protein, 15 aa, Plasmodium falciparum
KKIQEDSSTQNNETV

SEQ ID NO: 3320881 - protein, 43 aa, Plasmodium falciparum
KKIQENHKKKNNNHNNNHNNNNHNNNHNNNNHNNNHNNNNKNT

SEQ ID NO: 3320882 - protein, 8 aa, Plasmodium falciparum
KKIQTTYS

SEQ ID NO: 3320883 - protein, 4 aa, Plasmodium falciparum
KKIR

SEQ ID NO: 3320884 - protein, 15 aa, Plasmodium falciparum
KKIRGNNGGASAPYR

SEQ ID NO: 3320885 - protein, 6 aa, Plasmodium falciparum
KKIRQN

SEQ ID NO: 3320886 - protein, 4 aa, Plasmodium falciparum
KKIS

SEQ ID NO: 3320887 - protein, 6 aa, Plasmodium falciparum
KKISDK

SEQ ID NO: 3320888 - protein, 6 aa, Plasmodium falciparum
KKISEK

SEQ ID NO: 3320889 - protein, 31 aa, Plasmodium falciparum
KKISENVANTNNDKKEENNGNLNEKHKEQNI

SEQ ID NO: 3320890 - protein, 5 aa, Plasmodium falciparum
KKISK

SEQ ID NO: 3320891 - protein, 5 aa, Plasmodium falciparum
KKISL

SEQ ID NO: 3320892 - protein, 7 aa, Plasmodium falciparum
KKISSKT

SEQ ID NO: 3320893 - protein, 7 aa, Plasmodium falciparum
KKISYGR

SEQ ID NO: 3320894 - protein, 6 aa, Plasmodium falciparum
KKITAK

SEQ ID NO: 3320895 - protein, 6 aa, Plasmodium falciparum
KKITEK

SEQ ID NO: 3320896 - protein, 7 aa, Plasmodium falciparum
KKITKHS

SEQ ID NO: 3320897 - protein, 6 aa, Plasmodium falciparum
KKIYED

SEQ ID NO: 3320898 - protein, 15 aa, Plasmodium falciparum
KKIYNDEKEEGNKSN

SEQ ID NO: 3320899 - protein, 14 aa, Plasmodium falciparum
KKIYNDTNDHADNR

SEQ ID NO: 3320900 - protein, 20 aa, Plasmodium falciparum
KKIYNNNNNNNNNNNNNNSQ

SEQ ID NO: 3320901 - protein, 6 aa, Plasmodium falciparum
KKIYPS

SEQ ID NO: 3320902 - protein, 6 aa, Plasmodium falciparum
KKKAAK

SEQ ID NO: 3320903 - protein, 8 aa, Plasmodium falciparum
KKKAEEKL

SEQ ID NO: 3320904 - protein, 109 aa, Plasmodium falciparum
KKKAETKSDSDSDSDSDSDSDSDSDSDSDSDDDDDEEKDEKKETGKNKEEVTKKKEGAKANSDSDSDSDSDSDSDSDSDSDSDSDSDEAKEQKEDDKLKTNKGKSTHNL

SEQ ID NO: 3320905 - protein, 6 aa, Plasmodium falciparum
KKKAHE

SEQ ID NO: 3320906 - protein, 18 aa, Plasmodium falciparum
KKKAIKKKERKETTTTKK

SEQ ID NO: 3320907 - protein, 7 aa, Plasmodium falciparum
KKKAKKK

SEQ ID NO: 3320908 - protein, 10 aa, Plasmodium falciparum
KKKAYDDENE

SEQ ID NO: 3320909 - protein, 8 aa, Plasmodium falciparum
KKKCGTTT

SEQ ID NO: 3320910 - protein, 15 aa, Plasmodium falciparum
KKKDDHENKKEKINE

SEQ ID NO: 3320911 - protein, 8 aa, Plasmodium falciparum
KKKDDIED

SEQ ID NO: 3320912 - protein, 8 aa, Plasmodium falciparum
KKKDEEDL

SEQ ID NO: 3320913 - protein, 13 aa, Plasmodium falciparum
KKKDEPTKGKNGY

SEQ ID NO: 3320914 - protein, 11 aa, Plasmodium falciparum
KKKDESIKRNN

SEQ ID NO: 3320915 - protein, 8 aa, Plasmodium falciparum
KKKDGEND

SEQ ID NO: 3320916 - protein, 6 aa, Plasmodium falciparum
KKKDGI

SEQ ID NO: 3320917 - protein, 13 aa, Plasmodium falciparum
KKKDGRNNYNNGV

SEQ ID NO: 3320918 - protein, 7 aa, Plasmodium falciparum
KKKDHTY

SEQ ID NO: 3320919 - protein, 5 aa, Plasmodium falciparum
KKKDI

SEQ ID NO: 3320920 - protein, 9 aa, Plasmodium falciparum
KKKDIKKDM

SEQ ID NO: 3320921 - protein, 6 aa, Plasmodium falciparum
KKKDKD

SEQ ID NO: 3320922 - protein, 16 aa, Plasmodium falciparum
KKKDKEEKPKKSDVFP

SEQ ID NO: 3320923 - protein, 46 aa, Plasmodium falciparum
KKKDKNISTRKKRKYTSSLSSESYERRKDKKKKKEKYRNSESSYKS

SEQ ID NO: 3320924 - protein, 7 aa, Plasmodium falciparum
KKKDKSC

SEQ ID NO: 3320925 - protein, 52 aa, Plasmodium falciparum
KKKDKVDSSHHEKKKKTKKKKKTNNGRSSSFSDESSYNKEEEEGEEESNKKH

SEQ ID NO: 3320926 - protein, 8 aa, Plasmodium falciparum
KKKDLGKS

SEQ ID NO: 3320927 - protein, 5 aa, Plasmodium falciparum
KKKDN

SEQ ID NO: 3320928 - protein, 10 aa, Plasmodium falciparum
KKKDPQDNNY

SEQ ID NO: 3320929 - protein, 9 aa, Plasmodium falciparum
KKKDQEKIN

SEQ ID NO: 3320930 - protein, 14 aa, Plasmodium falciparum
KKKDQHNKKNNIKD

SEQ ID NO: 3320931 - protein, 9 aa, Plasmodium falciparum
KKKDQSEQI

SEQ ID NO: 3320932 - protein, 8 aa, Plasmodium falciparum
KKKDTTKN

SEQ ID NO: 3320933 - protein, 14 aa, Plasmodium falciparum
KKKDTVKNNSCQRK

SEQ ID NO: 3320934 - protein, 8 aa, Plasmodium falciparum
KKKECTYN

SEQ ID NO: 3320935 - protein, 18 aa, Plasmodium falciparum
KKKEDEKIEERKKDAENL

SEQ ID NO: 3320936 - protein, 9 aa, Plasmodium falciparum
KKKEDNEIN

SEQ ID NO: 3320937 - protein, 7 aa, Plasmodium falciparum
KKKEDTL

SEQ ID NO: 3320938 - protein, 59 aa, Plasmodium falciparum
KKKEEEEKRKRREEEEEEQKKRKEEEEEEQKKRKEEEEKIEKKKKEEEEEKRKKEEQEL

SEQ ID NO: 3320939 - protein, 19 aa, Plasmodium falciparum
KKKEEEGKEKYENEEKNNL

SEQ ID NO: 3320940 - protein, 9 aa, Plasmodium falciparum
KKKEEEKSY

SEQ ID NO: 3320941 - protein, 11 aa, Plasmodium falciparum
KKKEEKEKEEI

SEQ ID NO: 3320942 - protein, 8 aa, Plasmodium falciparum
KKKEEKNP

SEQ ID NO: 3320943 - protein, 13 aa, Plasmodium falciparum
KKKEEKYVESGGG

SEQ ID NO: 3320944 - protein, 21 aa, Plasmodium falciparum
KKKEENDIPEEDPYEEDNSRG

SEQ ID NO: 3320945 - protein, 10 aa, Plasmodium falciparum
KKKEENENKI

SEQ ID NO: 3320946 - protein, 41 aa, Plasmodium falciparum
KKKEEQEKNKYVNDKQNNKIKQEKFDKTSNTLQSKGNISSF

SEQ ID NO: 3320947 - protein, 12 aa, Plasmodium falciparum
KKKEEQKSDEKC

SEQ ID NO: 3320948 - protein, 17 aa, Plasmodium falciparum
KKKEERQIYEENGDDEL

SEQ ID NO: 3320949 - protein, 9 aa, Plasmodium falciparum
KKKEFGKKK

SEQ ID NO: 3320950 - protein, 14 aa, Plasmodium falciparum
KKKEFNGWFSLLLK

SEQ ID NO: 3320951 - protein, 19 aa, Plasmodium falciparum
KKKEFVKETEKEPKGKNMK

SEQ ID NO: 3320952 - protein, 9 aa, Plasmodium falciparum
KKKEGKDYF

SEQ ID NO: 3320953 - protein, 8 aa, Plasmodium falciparum
KKKEGKYL

SEQ ID NO: 3320954 - protein, 9 aa, Plasmodium falciparum
KKKEGYEKQ

SEQ ID NO: 3320955 - protein, 6 aa, Plasmodium falciparum
KKKEHL

SEQ ID NO: 3320956 - protein, 9 aa, Plasmodium falciparum
KKKEHNNSD

SEQ ID NO: 3320957 - protein, 9 aa, Plasmodium falciparum
KKKEHSSLQ

SEQ ID NO: 3320958 - protein, 7 aa, Plasmodium falciparum
KKKEIEE

SEQ ID NO: 3320959 - protein, 6 aa, Plasmodium falciparum
KKKEIG

SEQ ID NO: 3320960 - protein, 5 aa, Plasmodium falciparum
KKKEK

SEQ ID NO: 3320961 - protein, 6 aa, Plasmodium falciparum
KKKEKD

SEQ ID NO: 3320962 - protein, 20 aa, Plasmodium falciparum
KKKEKDNKEKDNKEKDNKEK

SEQ ID NO: 3320963 - protein, 51 aa, Plasmodium falciparum
KKKEKEKKKKKIKEKKKRKKKKGKKNKSDLTSESDLSSSYNSEDRSQSKRE

SEQ ID NO: 3320964 - protein, 7 aa, Plasmodium falciparum
KKKEKEL

SEQ ID NO: 3320965 - protein, 7 aa, Plasmodium falciparum
KKKEKIA

SEQ ID NO: 3320966 - protein, 9 aa, Plasmodium falciparum
KKKEKKTVD

SEQ ID NO: 3320967 - protein, 11 aa, Plasmodium falciparum
KKKEKNNIKYN

SEQ ID NO: 3320968 - protein, 8 aa, Plasmodium falciparum
KKKEKTKF

SEQ ID NO: 3320969 - protein, 8 aa, Plasmodium falciparum
KKKENECG

SEQ ID NO: 3320970 - protein, 6 aa, Plasmodium falciparum
KKKENK

SEQ ID NO: 3320971 - protein, 7 aa, Plasmodium falciparum
KKKENKI

SEQ ID NO: 3320972 - protein, 8 aa, Plasmodium falciparum
KKKENKIK

SEQ ID NO: 3320973 - protein, 7 aa, Plasmodium falciparum
KKKENMK

SEQ ID NO: 3320974 - protein, 7 aa, Plasmodium falciparum
KKKENNE

SEQ ID NO: 3320975 - protein, 6 aa, Plasmodium falciparum
KKKENV

SEQ ID NO: 3320976 - protein, 7 aa, Plasmodium falciparum
KKKENVN

SEQ ID NO: 3320977 - protein, 18 aa, Plasmodium falciparum
KKKENVNNISPDEPTKHM

SEQ ID NO: 3320978 - protein, 21 aa, Plasmodium falciparum
KKKEPKKNTKSIRRSQRKSYC

SEQ ID NO: 3320979 - protein, 7 aa, Plasmodium falciparum
KKKEQAM

SEQ ID NO: 3320980 - protein, 9 aa, Plasmodium falciparum
KKKEQQQAL

SEQ ID NO: 3320981 - protein, 13 aa, Plasmodium falciparum
KKKERAKGKGKEL

SEQ ID NO: 3320982 - protein, 9 aa, Plasmodium falciparum
KKKERDNEK

SEQ ID NO: 3320983 - protein, 13 aa, Plasmodium falciparum
KKKERLQKGRRNY

SEQ ID NO: 3320984 - protein, 11 aa, Plasmodium falciparum
KKKERNEHAPP

SEQ ID NO: 3320985 - protein, 7 aa, Plasmodium falciparum
KKKERPL

SEQ ID NO: 3320986 - protein, 15 aa, Plasmodium falciparum
KKKESAPKSDEKNDE

SEQ ID NO: 3320987 - protein, 12 aa, Plasmodium falciparum
KKKESKGYESHS

SEQ ID NO: 3320988 - protein, 8 aa, Plasmodium falciparum
KKKESKHN

SEQ ID NO: 3320989 - protein, 15 aa, Plasmodium falciparum
KKKESLENNDGADSI

SEQ ID NO: 3320990 - protein, 22 aa, Plasmodium falciparum
KKKETKDANEEGIDNKNDNVFS

SEQ ID NO: 3320991 - protein, 26 aa, Plasmodium falciparum
KKKEYFRNEKGDSNINVNNEKKKTNI

SEQ ID NO: 3320992 - protein, 6 aa, Plasmodium falciparum
KKKEYN

SEQ ID NO: 3320993 - protein, 7 aa, Plasmodium falciparum
KKKEYNK

SEQ ID NO: 3320994 - protein, 7 aa, Plasmodium falciparum
KKKEYYE

SEQ ID NO: 3320995 - protein, 9 aa, Plasmodium falciparum
KKKFKREKN

SEQ ID NO: 3320996 - protein, 9 aa, Plasmodium falciparum
KKKFQDKPF

SEQ ID NO: 3320997 - protein, 9 aa, Plasmodium falciparum
KKKGAQHNI

SEQ ID NO: 3320998 - protein, 9 aa, Plasmodium falciparum
KKKGHKRKI

SEQ ID NO: 3320999 - protein, 22 aa, Plasmodium falciparum
KKKGKNNQNKNVYDNTENNDTV

SEQ ID NO: 3321000 - protein, 8 aa, Plasmodium falciparum
KKKGKTKI

SEQ ID NO: 3321001 - protein, 6 aa, Plasmodium falciparum
KKKGLN

SEQ ID NO: 3321002 - protein, 8 aa, Plasmodium falciparum
KKKGTSQS

SEQ ID NO: 3321003 - protein, 7 aa, Plasmodium falciparum
KKKHASH

SEQ ID NO: 3321004 - protein, 63 aa, Plasmodium falciparum
KKKHSHHRSKNKKKHSHHHSKKEKHISNDTHKSDEKHRKYISSKKKKIKKEEKKKKKNYHSKK

SEQ ID NO: 3321005 - protein, 8 aa, Plasmodium falciparum
KKKHTKKS

SEQ ID NO: 3321006 - protein, 7 aa, Plasmodium falciparum
KKKHVSN

SEQ ID NO: 3321007 - protein, 6 aa, Plasmodium falciparum
KKKIAE

SEQ ID NO: 3321008 - protein, 7 aa, Plasmodium falciparum
KKKIEEY

SEQ ID NO: 3321009 - protein, 9 aa, Plasmodium falciparum
KKKIEKKKY

SEQ ID NO: 3321010 - protein, 5 aa, Plasmodium falciparum
KKKIF

SEQ ID NO: 3321011 - protein, 6 aa, Plasmodium falciparum
KKKIHA

SEQ ID NO: 3321012 - protein, 7 aa, Plasmodium falciparum
KKKIHNN

SEQ ID NO: 3321013 - protein, 5 aa, Plasmodium falciparum
KKKIK

SEQ ID NO: 3321014 - protein, 7 aa, Plasmodium falciparum
KKKIKDQ

SEQ ID NO: 3321015 - protein, 13 aa, Plasmodium falciparum
KKKIKKKKKEKKI

SEQ ID NO: 3321016 - protein, 9 aa, Plasmodium falciparum
KKKIKKQNE

SEQ ID NO: 3321017 - protein, 6 aa, Plasmodium falciparum
KKKIKQ

SEQ ID NO: 3321018 - protein, 7 aa, Plasmodium falciparum
KKKIKQA

SEQ ID NO: 3321019 - protein, 5 aa, Plasmodium falciparum
KKKIN

SEQ ID NO: 3321020 - protein, 16 aa, Plasmodium falciparum
KKKINKDQEDQSTRED

SEQ ID NO: 3321021 - protein, 5 aa, Plasmodium falciparum
KKKIQ

SEQ ID NO: 3321022 - protein, 10 aa, Plasmodium falciparum
KKKIQKPSEK

SEQ ID NO: 3321023 - protein, 9 aa, Plasmodium falciparum
KKKIQQETI

SEQ ID NO: 3321024 - protein, 12 aa, Plasmodium falciparum
KKKISEEKMEAA

SEQ ID NO: 3321025 - protein, 24 aa, Plasmodium falciparum
KKKISEKCDPTDDISDLENKVMMF

SEQ ID NO: 3321026 - protein, 9 aa, Plasmodium falciparum
KKKITKDEY

SEQ ID NO: 3321027 - protein, 8 aa, Plasmodium falciparum
KKKKATKQ

SEQ ID NO: 3321028 - protein, 17 aa, Plasmodium falciparum
KKKKCNHNNNSKRHRFE

SEQ ID NO: 3321029 - protein, 9 aa, Plasmodium falciparum
KKKKDARNF

SEQ ID NO: 3321030 - protein, 9 aa, Plasmodium falciparum
KKKKDENYS

SEQ ID NO: 3321031 - protein, 53 aa, Plasmodium falciparum
KKKKDITGKEKKIQKKSYADEQKDHPKDNINNKSNNNKNNNKNNNINNNNNQV

SEQ ID NO: 3321032 - protein, 125 aa, Plasmodium falciparum
KKKKDKENKSKSKKEKNNKNEKDDEMENKKEKNNKNEKDDEMENKKEKNNKNEKDDEMENKKEKNNKNEKDDEMENKKEKNNKNEKDDEMENKKEKNNKNEKDDEMENKKEKNNKNEKDDEIKEN

SEQ ID NO: 3321033 - protein, 7 aa, Plasmodium falciparum
KKKKDLT

SEQ ID NO: 3321034 - protein, 11 aa, Plasmodium falciparum
KKKKDQENDLE

SEQ ID NO: 3321035 - protein, 9 aa, Plasmodium falciparum
KKKKDQTSV

SEQ ID NO: 3321036 - protein, 155 aa, Plasmodium falciparum
KKKKDSKELDKTQNDESVIKDNGSKVEVKKRKEKDDKDDDKDDDDEDDDKDDDEDDDEDDDKDDDGDDDEDDDEDDDDDGEDDDDYNNNGDNTRINSKKEDNKISQNNYKHSNSNNLHDKNEKKDRKNNPEDDHITNNNYSNDVNRYAENKYNNE

SEQ ID NO: 3321037 - protein, 21 aa, Plasmodium falciparum
KKKKDTSKNETQEKNEEINKE

SEQ ID NO: 3321038 - protein, 9 aa, Plasmodium falciparum
KKKKDYVNE

SEQ ID NO: 3321039 - protein, 8 aa, Plasmodium falciparum
KKKKEAKD

SEQ ID NO: 3321040 - protein, 20 aa, Plasmodium falciparum
KKKKEEEERKLEEKNKSDTY

SEQ ID NO: 3321041 - protein, 34 aa, Plasmodium falciparum
KKKKEEKKGIKEKKNKKTKSKKKKVKNTKKIKDI

SEQ ID NO: 3321042 - protein, 12 aa, Plasmodium falciparum
KKKKEEKKKNPL

SEQ ID NO: 3321043 - protein, 7 aa, Plasmodium falciparum
KKKKEEL

SEQ ID NO: 3321044 - protein, 12 aa, Plasmodium falciparum
KKKKEENEGRNK

SEQ ID NO: 3321045 - protein, 11 aa, Plasmodium falciparum
KKKKEKENQHI

SEQ ID NO: 3321046 - protein, 70 aa, Plasmodium falciparum
KKKKEKGDKNKKKMHGKGDDDNNNTYDNNNNNNTYDNNNNNNTYDNNNNNNTYDNNNNNNTYDNNNDNGM

SEQ ID NO: 3321047 - protein, 17 aa, Plasmodium falciparum
KKKKEKKKKKKNNNNNK

SEQ ID NO: 3321048 - protein, 38 aa, Plasmodium falciparum
KKKKEKKKKKNKNKKKNKKKNNNNNNNNNNSDNSTRHF

SEQ ID NO: 3321049 - protein, 11 aa, Plasmodium falciparum
KKKKEKNKDKI

SEQ ID NO: 3321050 - protein, 14 aa, Plasmodium falciparum
KKKKEKSCPNSSNE

SEQ ID NO: 3321051 - protein, 7 aa, Plasmodium falciparum
KKKKELK

SEQ ID NO: 3321052 - protein, 15 aa, Plasmodium falciparum
KKKKELKLKAKQEKN

SEQ ID NO: 3321053 - protein, 17 aa, Plasmodium falciparum
KKKKENDMKEQEKEPII

SEQ ID NO: 3321054 - protein, 15 aa, Plasmodium falciparum
KKKKENTNVDEEKKK

SEQ ID NO: 3321055 - protein, 28 aa, Plasmodium falciparum
KKKKEQKKKEKKLKKELEKKKKSNRGHQ

SEQ ID NO: 3321056 - protein, 9 aa, Plasmodium falciparum
KKKKERNIL

SEQ ID NO: 3321057 - protein, 12 aa, Plasmodium falciparum
KKKKGKIRINLK

SEQ ID NO: 3321058 - protein, 13 aa, Plasmodium falciparum
KKKKGKNDPEQKK

SEQ ID NO: 3321059 - protein, 9 aa, Plasmodium falciparum
KKKKGKNVK

SEQ ID NO: 3321060 - protein, 10 aa, Plasmodium falciparum
KKKKGMHRSD

SEQ ID NO: 3321061 - protein, 7 aa, Plasmodium falciparum
KKKKGNI

SEQ ID NO: 3321062 - protein, 10 aa, Plasmodium falciparum
KKKKGRKPKV

SEQ ID NO: 3321063 - protein, 5 aa, Plasmodium falciparum
KKKKI

SEQ ID NO: 3321064 - protein, 8 aa, Plasmodium falciparum
KKKKIDNM

SEQ ID NO: 3321065 - protein, 6 aa, Plasmodium falciparum
KKKKIK

SEQ ID NO: 3321066 - protein, 19 aa, Plasmodium falciparum
KKKKINKRHDDSSSEISSH

SEQ ID NO: 3321067 - protein, 7 aa, Plasmodium falciparum
KKKKIQK

SEQ ID NO: 3321068 - protein, 7 aa, Plasmodium falciparum
KKKKIYD

SEQ ID NO: 3321069 - protein, 7 aa, Plasmodium falciparum
KKKKKAI

SEQ ID NO: 3321070 - protein, 15 aa, Plasmodium falciparum
KKKKKDEDTDSSYYK

SEQ ID NO: 3321071 - protein, 9 aa, Plasmodium falciparum
KKKKKDMKV

SEQ ID NO: 3321072 - protein, 43 aa, Plasmodium falciparum
KKKKKDPYGNNYNDEYVDSQSESSSGYNKKENIKSNNSNNKNN

SEQ ID NO: 3321073 - protein, 9 aa, Plasmodium falciparum
KKKKKDYDK

SEQ ID NO: 3321074 - protein, 18 aa, Plasmodium falciparum
KKKKKEELLQEKEKEKKK

SEQ ID NO: 3321075 - protein, 9 aa, Plasmodium falciparum
KKKKKEENE

SEQ ID NO: 3321076 - protein, 20 aa, Plasmodium falciparum
KKKKKEKKKKDSNKKSDTLE

SEQ ID NO: 3321077 - protein, 13 aa, Plasmodium falciparum
KKKKKEKKNISNK

SEQ ID NO: 3321078 - protein, 13 aa, Plasmodium falciparum
KKKKKEKKRKKEE

SEQ ID NO: 3321079 - protein, 10 aa, Plasmodium falciparum
KKKKKENEKI

SEQ ID NO: 3321080 - protein, 11 aa, Plasmodium falciparum
KKKKKESNNMS

SEQ ID NO: 3321081 - protein, 8 aa, Plasmodium falciparum
KKKKKHSS

SEQ ID NO: 3321082 - protein, 8 aa, Plasmodium falciparum
KKKKKIGP

SEQ ID NO: 3321083 - protein, 6 aa, Plasmodium falciparum
KKKKKK

SEQ ID NO: 3321084 - protein, 8 aa, Plasmodium falciparum
KKKKKKDI

SEQ ID NO: 3321085 - protein, 7 aa, Plasmodium falciparum
KKKKKKE

SEQ ID NO: 3321086 - protein, 9 aa, Plasmodium falciparum
KKKKKKEFK

SEQ ID NO: 3321087 - protein, 17 aa, Plasmodium falciparum
KKKKKKGKGKKKGKIED

SEQ ID NO: 3321088 - protein, 17 aa, Plasmodium falciparum
KKKKKKGKKKNIKQTDN

SEQ ID NO: 3321089 - protein, 16 aa, Plasmodium falciparum
KKKKKKKEKEKEKEYY

SEQ ID NO: 3321090 - protein, 9 aa, Plasmodium falciparum
KKKKKKKGL

SEQ ID NO: 3321091 - protein, 8 aa, Plasmodium falciparum
KKKKKKKK

SEQ ID NO: 3321092 - protein, 15 aa, Plasmodium falciparum
KKKKKKKKDEKGDDI

SEQ ID NO: 3321093 - protein, 20 aa, Plasmodium falciparum
KKKKKKKKDSKTNNKKKKKK

SEQ ID NO: 3321094 - protein, 13 aa, Plasmodium falciparum
KKKKKKKKEHYEE

SEQ ID NO: 3321095 - protein, 9 aa, Plasmodium falciparum
KKKKKKKKI

SEQ ID NO: 3321096 - protein, 22 aa, Plasmodium falciparum
KKKKKKKKKEILENKDSNIDNL

SEQ ID NO: 3321097 - protein, 12 aa, Plasmodium falciparum
KKKKKKKKKGYI

SEQ ID NO: 3321098 - protein, 12 aa, Plasmodium falciparum
KKKKKKKKKKKK

SEQ ID NO: 3321099 - protein, 17 aa, Plasmodium falciparum
KKKKKKKKKKKKKKEKK

SEQ ID NO: 3321100 - protein, 19 aa, Plasmodium falciparum
KKKKKKKKKKKKKKKKKKK

SEQ ID NO: 3321101 - protein, 17 aa, Plasmodium falciparum
KKKKKKKKKKKKRKKRR

SEQ ID NO: 3321102 - protein, 10 aa, Plasmodium falciparum
KKKKKKKKKL

SEQ ID NO: 3321103 - protein, 19 aa, Plasmodium falciparum
KKKKKKKKKNSQEKISNHQ

SEQ ID NO: 3321104 - protein, 32 aa, Plasmodium falciparum
KKKKKKKKKNVDVSGDKTKKIKNKKINKTENT

SEQ ID NO: 3321105 - protein, 12 aa, Plasmodium falciparum
KKKKKKKKNHQI

SEQ ID NO: 3321106 - protein, 12 aa, Plasmodium falciparum
KKKKKKKKTCIG

SEQ ID NO: 3321107 - protein, 14 aa, Plasmodium falciparum
KKKKKKKKTKKIKD

SEQ ID NO: 3321108 - protein, 10 aa, Plasmodium falciparum
KKKKKKKKYI

SEQ ID NO: 3321109 - protein, 11 aa, Plasmodium falciparum
KKKKKKKLKKK

SEQ ID NO: 3321110 - protein, 11 aa, Plasmodium falciparum
KKKKKKKNQHH

SEQ ID NO: 3321111 - protein, 18 aa, Plasmodium falciparum
KKKKKKKSMEQNTEQKFG

SEQ ID NO: 3321112 - protein, 28 aa, Plasmodium falciparum
KKKKKKKTALSNLTEEEKNKKKKNKKKN

SEQ ID NO: 3321113 - protein, 7 aa, Plasmodium falciparum
KKKKKKM

SEQ ID NO: 3321114 - protein, 11 aa, Plasmodium falciparum
KKKKKKNADIR

SEQ ID NO: 3321115 - protein, 62 aa, Plasmodium falciparum
KKKKKKNDDDVESQSSKVNQTKTKKNPKEKEKEKKKKKKFKCKNKSNITKMEEKNAGENSQI

SEQ ID NO: 3321116 - protein, 14 aa, Plasmodium falciparum
KKKKKKNDEVPKKY

SEQ ID NO: 3321117 - protein, 11 aa, Plasmodium falciparum
KKKKKKNETLK

SEQ ID NO: 3321118 - protein, 17 aa, Plasmodium falciparum
KKKKKKNNNNNNNNNNI

SEQ ID NO: 3321119 - protein, 21 aa, Plasmodium falciparum
KKKKKKNVTSPRPSSKEYERK

SEQ ID NO: 3321120 - protein, 10 aa, Plasmodium falciparum
KKKKKKNYEH

SEQ ID NO: 3321121 - protein, 23 aa, Plasmodium falciparum
KKKKKKRDYKNADGNNKTNANHN

SEQ ID NO: 3321122 - protein, 8 aa, Plasmodium falciparum
KKKKKKRI

SEQ ID NO: 3321123 - protein, 8 aa, Plasmodium falciparum
KKKKKKRQ

SEQ ID NO: 3321124 - protein, 9 aa, Plasmodium falciparum
KKKKKKTKK

SEQ ID NO: 3321125 - protein, 21 aa, Plasmodium falciparum
KKKKKKTKKKTKKKTNNTTIY

SEQ ID NO: 3321126 - protein, 12 aa, Plasmodium falciparum
KKKKKKVKKKIK

SEQ ID NO: 3321127 - protein, 6 aa, Plasmodium falciparum
KKKKKL

SEQ ID NO: 3321128 - protein, 12 aa, Plasmodium falciparum
KKKKKLKKFNDN

SEQ ID NO: 3321129 - protein, 8 aa, Plasmodium falciparum
KKKKKMKL

SEQ ID NO: 3321130 - protein, 14 aa, Plasmodium falciparum
KKKKKNANNNKLNN

SEQ ID NO: 3321131 - protein, 18 aa, Plasmodium falciparum
KKKKKNDVENSNNSYSED

SEQ ID NO: 3321132 - protein, 22 aa, Plasmodium falciparum
KKKKKNKGTSGHSKLPNVTPNT

SEQ ID NO: 3321133 - protein, 11 aa, Plasmodium falciparum
KKKKKNQYSEP

SEQ ID NO: 3321134 - protein, 20 aa, Plasmodium falciparum
KKKKKNSVSCSSSSSINIPE

SEQ ID NO: 3321135 - protein, 18 aa, Plasmodium falciparum
KKKKKNYEQVRQKFIKFK

SEQ ID NO: 3321136 - protein, 9 aa, Plasmodium falciparum
KKKKKNYNI

SEQ ID NO: 3321137 - protein, 13 aa, Plasmodium falciparum
KKKKKQKIKNKKH

SEQ ID NO: 3321138 - protein, 52 aa, Plasmodium falciparum
KKKKKRDSESSNNNDYNEEYDEDDDEQEEEEEEESLSKKKSKKKNSTTSPKV

SEQ ID NO: 3321139 - protein, 39 aa, Plasmodium falciparum
KKKKKRKKNFDNSNENVNRKVSNKETKKEQNKINDNQNK

SEQ ID NO: 3321140 - protein, 24 aa, Plasmodium falciparum
KKKKKRTENVEERKKSNMKRKESK

SEQ ID NO: 3321141 - protein, 7 aa, Plasmodium falciparum
KKKKKSD

SEQ ID NO: 3321142 - protein, 13 aa, Plasmodium falciparum
KKKKKSERLSRRP

SEQ ID NO: 3321143 - protein, 17 aa, Plasmodium falciparum
KKKKKSKKRKTCKRNNI

SEQ ID NO: 3321144 - protein, 85 aa, Plasmodium falciparum
KKKKKSNRDKKKNSFNQNNKKPNNYNFKGNNNRNDHNNRNDHNNRNDHNNRNDHNNRNDRNNRNNKNSFRNRSNSSRKFNNQRGR

SEQ ID NO: 3321145 - protein, 9 aa, Plasmodium falciparum
KKKKKSSSV

SEQ ID NO: 3321146 - protein, 8 aa, Plasmodium falciparum
KKKKKVEN

SEQ ID NO: 3321147 - protein, 8 aa, Plasmodium falciparum
KKKKKVSF

SEQ ID NO: 3321148 - protein, 6 aa, Plasmodium falciparum
KKKKKY

SEQ ID NO: 3321149 - protein, 5 aa, Plasmodium falciparum
KKKKL

SEQ ID NO: 3321150 - protein, 10 aa, Plasmodium falciparum
KKKKLDEENE

SEQ ID NO: 3321151 - protein, 7 aa, Plasmodium falciparum
KKKKLEK

SEQ ID NO: 3321152 - protein, 12 aa, Plasmodium falciparum
KKKKLNKQIEGD

SEQ ID NO: 3321153 - protein, 13 aa, Plasmodium falciparum
KKKKLNNIKKNIN

SEQ ID NO: 3321154 - protein, 14 aa, Plasmodium falciparum
KKKKMKNQNYEKDK

SEQ ID NO: 3321155 - protein, 9 aa, Plasmodium falciparum
KKKKNETQL

SEQ ID NO: 3321156 - protein, 25 aa, Plasmodium falciparum
KKKKNFEENNNTELNDSNIKKENNK

SEQ ID NO: 3321157 - protein, 8 aa, Plasmodium falciparum
KKKKNFTS

SEQ ID NO: 3321158 - protein, 13 aa, Plasmodium falciparum
KKKKNHKKKNANI

SEQ ID NO: 3321159 - protein, 12 aa, Plasmodium falciparum
KKKKNINTANYS

SEQ ID NO: 3321160 - protein, 7 aa, Plasmodium falciparum
KKKKNKK

SEQ ID NO: 3321161 - protein, 21 aa, Plasmodium falciparum
KKKKNKKKNKVSRGKRQREKK

SEQ ID NO: 3321162 - protein, 39 aa, Plasmodium falciparum
KKKKNKNKNKNKNKNTNINQSTKLPTEDNVEDFSMSSDE

SEQ ID NO: 3321163 - protein, 58 aa, Plasmodium falciparum
KKKKNKNKNNNKNKNKNNNKNKNKNKNKKKNKNKNNNKNNNKNKNKNNNKNKNKNNNN

SEQ ID NO: 3321164 - protein, 9 aa, Plasmodium falciparum
KKKKNKNVK

SEQ ID NO: 3321165 - protein, 15 aa, Plasmodium falciparum
KKKKNKRDNTMNSTK

SEQ ID NO: 3321166 - protein, 11 aa, Plasmodium falciparum
KKKKNKRKNLI

SEQ ID NO: 3321167 - protein, 6 aa, Plasmodium falciparum
KKKKNN

SEQ ID NO: 3321168 - protein, 14 aa, Plasmodium falciparum
KKKKNNDDISNGYN

SEQ ID NO: 3321169 - protein, 24 aa, Plasmodium falciparum
KKKKNNINSNNNNNNKMKKKKYNH

SEQ ID NO: 3321170 - protein, 18 aa, Plasmodium falciparum
KKKKNNKYKKNQKDEITI

SEQ ID NO: 3321171 - protein, 38 aa, Plasmodium falciparum
KKKKNNNANLKNEEKKQDDNFKNANNNIDNENTKEEMC

SEQ ID NO: 3321172 - protein, 15 aa, Plasmodium falciparum
KKKKNPFEDYKNEED

SEQ ID NO: 3321173 - protein, 89 aa, Plasmodium falciparum
KKKKNQKNGELNKKYSKKLSINKKNKKYEKHKKYEKHKKYEKHKKYEKNKKYEKNKKYEKNKKYEKNKKNEKNKKNEKNKKREKNKSGL

SEQ ID NO: 3321174 - protein, 12 aa, Plasmodium falciparum
KKKKNRQGYDVG

SEQ ID NO: 3321175 - protein, 9 aa, Plasmodium falciparum
KKKKNSKIK

SEQ ID NO: 3321176 - protein, 12 aa, Plasmodium falciparum
KKKKNSKSDNVD

SEQ ID NO: 3321177 - protein, 8 aa, Plasmodium falciparum
KKKKNSNY

SEQ ID NO: 3321178 - protein, 44 aa, Plasmodium falciparum
KKKKNSQNEEMNNDNKNNDNDDQDDEHNSKYNDCKRKHKSNSKI

SEQ ID NO: 3321179 - protein, 7 aa, Plasmodium falciparum
KKKKNTV

SEQ ID NO: 3321180 - protein, 16 aa, Plasmodium falciparum
KKKKNVESKNGYNSYT

SEQ ID NO: 3321181 - protein, 10 aa, Plasmodium falciparum
KKKKPKEYSG

SEQ ID NO: 3321182 - protein, 8 aa, Plasmodium falciparum
KKKKPSDL

SEQ ID NO: 3321183 - protein, 7 aa, Plasmodium falciparum
KKKKQKC

SEQ ID NO: 3321184 - protein, 12 aa, Plasmodium falciparum
KKKKQKKGNSNF

SEQ ID NO: 3321185 - protein, 14 aa, Plasmodium falciparum
KKKKQKNKNQVNEN

SEQ ID NO: 3321186 - protein, 5 aa, Plasmodium falciparum
KKKKR

SEQ ID NO: 3321187 - protein, 13 aa, Plasmodium falciparum
KKKKRKDYHSSSS

SEQ ID NO: 3321188 - protein, 7 aa, Plasmodium falciparum
KKKKRKE

SEQ ID NO: 3321189 - protein, 11 aa, Plasmodium falciparum
KKKKRKEFEEK

SEQ ID NO: 3321190 - protein, 11 aa, Plasmodium falciparum
KKKKRKKPKLN

SEQ ID NO: 3321191 - protein, 29 aa, Plasmodium falciparum
KKKKRKSSSKKYRSKDKDKVDKHDKKNVD

SEQ ID NO: 3321192 - protein, 8 aa, Plasmodium falciparum
KKKKRKTI

SEQ ID NO: 3321193 - protein, 9 aa, Plasmodium falciparum
KKKKRRRKK

SEQ ID NO: 3321194 - protein, 23 aa, Plasmodium falciparum
KKKKSHLGNNTFEKKNHKNTNLD

SEQ ID NO: 3321195 - protein, 9 aa, Plasmodium falciparum
KKKKSKNND

SEQ ID NO: 3321196 - protein, 9 aa, Plasmodium falciparum
KKKKSKSTY

SEQ ID NO: 3321197 - protein, 20 aa, Plasmodium falciparum
KKKKSLKEKDELNNMKEDNK

SEQ ID NO: 3321198 - protein, 10 aa, Plasmodium falciparum
KKKKSSEKDY

SEQ ID NO: 3321199 - protein, 8 aa, Plasmodium falciparum
KKKKSYHN

SEQ ID NO: 3321200 - protein, 8 aa, Plasmodium falciparum
KKKKTHTH

SEQ ID NO: 3321201 - protein, 20 aa, Plasmodium falciparum
KKKKTMKEQIQQKKKNNNIS

SEQ ID NO: 3321202 - protein, 15 aa, Plasmodium falciparum
KKKKTNKIQRKNTIK

SEQ ID NO: 3321203 - protein, 16 aa, Plasmodium falciparum
KKKKTQDKKKKEVVAD

SEQ ID NO: 3321204 - protein, 47 aa, Plasmodium falciparum
KKKKTRKFKEDEGNNSKKKKLKNKENINDNDKEKINSLDGNIEDERE

SEQ ID NO: 3321205 - protein, 9 aa, Plasmodium falciparum
KKKKTRNSI

SEQ ID NO: 3321206 - protein, 7 aa, Plasmodium falciparum
KKKKTSH

SEQ ID NO: 3321207 - protein, 11 aa, Plasmodium falciparum
KKKKTSNSKNV

SEQ ID NO: 3321208 - protein, 6 aa, Plasmodium falciparum
KKKKVK

SEQ ID NO: 3321209 - protein, 27 aa, Plasmodium falciparum
KKKKVKKKRDKKRERDGCGNDNDKELN

SEQ ID NO: 3321210 - protein, 8 aa, Plasmodium falciparum
KKKKWQNE

SEQ ID NO: 3321211 - protein, 5 aa, Plasmodium falciparum
KKKKY

SEQ ID NO: 3321212 - protein, 13 aa, Plasmodium falciparum
KKKKYDVNQKREI

SEQ ID NO: 3321213 - protein, 123 aa, Plasmodium falciparum
KKKKYEEKKRSYHKRNRNDDSDDNDHSDYNNHSDYNNHSDDNDHSDYNNHSDYNNHSDYNNHSDYNNHSDDNNHSDDNNHSDDSSDRKKKKKDKKEKKRKEKHKRDTNTLDDRIKNKKENSMT

SEQ ID NO: 3321214 - protein, 10 aa, Plasmodium falciparum
KKKKYEKQNI

SEQ ID NO: 3321215 - protein, 8 aa, Plasmodium falciparum
KKKKYEQN

SEQ ID NO: 3321216 - protein, 13 aa, Plasmodium falciparum
KKKKYKDPLPDRN

SEQ ID NO: 3321217 - protein, 23 aa, Plasmodium falciparum
KKKKYNHKNNNSHNKENKENTTN

SEQ ID NO: 3321218 - protein, 8 aa, Plasmodium falciparum
KKKKYNKK

SEQ ID NO: 3321219 - protein, 7 aa, Plasmodium falciparum
KKKKYVP

SEQ ID NO: 3321220 - protein, 7 aa, Plasmodium falciparum
KKKLDEE

SEQ ID NO: 3321221 - protein, 8 aa, Plasmodium falciparum
KKKLDGGK

SEQ ID NO: 3321222 - protein, 5 aa, Plasmodium falciparum
KKKLE

SEQ ID NO: 3321223 - protein, 6 aa, Plasmodium falciparum
KKKLNK

SEQ ID NO: 3321224 - protein, 17 aa, Plasmodium falciparum
KKKLSEIEKEENQIDKV

SEQ ID NO: 3321225 - protein, 11 aa, Plasmodium falciparum
KKKLSEKKNPS

SEQ ID NO: 3321226 - protein, 8 aa, Plasmodium falciparum
KKKLSTDS

SEQ ID NO: 3321227 - protein, 4 aa, Plasmodium falciparum
KKKM

SEQ ID NO: 3321228 - protein, 6 aa, Plasmodium falciparum
KKKMDE

SEQ ID NO: 3321229 - protein, 13 aa, Plasmodium falciparum
KKKMEEKENGLNN

SEQ ID NO: 3321230 - protein, 15 aa, Plasmodium falciparum
KKKMEEYNKKIKSIK

SEQ ID NO: 3321231 - protein, 7 aa, Plasmodium falciparum
KKKMEKV

SEQ ID NO: 3321232 - protein, 10 aa, Plasmodium falciparum
KKKMKKDNGY

SEQ ID NO: 3321233 - protein, 15 aa, Plasmodium falciparum
KKKMKKKKKKKESDL

SEQ ID NO: 3321234 - protein, 11 aa, Plasmodium falciparum
KKKMKNKDSEL

SEQ ID NO: 3321235 - protein, 11 aa, Plasmodium falciparum
KKKMKNNELTN

SEQ ID NO: 3321236 - protein, 5 aa, Plasmodium falciparum
KKKMN

SEQ ID NO: 3321237 - protein, 7 aa, Plasmodium falciparum
KKKMNKN

SEQ ID NO: 3321238 - protein, 10 aa, Plasmodium falciparum
KKKMNTGNQR

SEQ ID NO: 3321239 - protein, 30 aa, Plasmodium falciparum
KKKNAKKIKQNKKNSTLDEIEENTKEETTI

SEQ ID NO: 3321240 - protein, 6 aa, Plasmodium falciparum
KKKNDF

SEQ ID NO: 3321241 - protein, 7 aa, Plasmodium falciparum
KKKNDGI

SEQ ID NO: 3321242 - protein, 52 aa, Plasmodium falciparum
KKKNDINKNSKRNKNYESKSFNNKNEKIDDSNSDSNNNIDELKGNKNNNKKN

SEQ ID NO: 3321243 - protein, 6 aa, Plasmodium falciparum
KKKNDL

SEQ ID NO: 3321244 - protein, 18 aa, Plasmodium falciparum
KKKNDLSTKYENKDISQK

SEQ ID NO: 3321245 - protein, 7 aa, Plasmodium falciparum
KKKNDSC

SEQ ID NO: 3321246 - protein, 6 aa, Plasmodium falciparum
KKKNED

SEQ ID NO: 3321247 - protein, 9 aa, Plasmodium falciparum
KKKNEDNEY

SEQ ID NO: 3321248 - protein, 13 aa, Plasmodium falciparum
KKKNEEKEDCSKD

SEQ ID NO: 3321249 - protein, 10 aa, Plasmodium falciparum
KKKNEKDENN

SEQ ID NO: 3321250 - protein, 23 aa, Plasmodium falciparum
KKKNEKEEKEEKEEKKEDKINEK

SEQ ID NO: 3321251 - protein, 14 aa, Plasmodium falciparum
KKKNEKEKKKKKKN

SEQ ID NO: 3321252 - protein, 14 aa, Plasmodium falciparum
KKKNEKRKKKSYKN

SEQ ID NO: 3321253 - protein, 34 aa, Plasmodium falciparum
KKKNENNSSDKNDDINKNSSKHSNNKPEENVETK

SEQ ID NO: 3321254 - protein, 10 aa, Plasmodium falciparum
KKKNENYNRQ

SEQ ID NO: 3321255 - protein, 8 aa, Plasmodium falciparum
KKKNETDI

SEQ ID NO: 3321256 - protein, 9 aa, Plasmodium falciparum
KKKNGNDVT

SEQ ID NO: 3321257 - protein, 9 aa, Plasmodium falciparum
KKKNHKSSL

SEQ ID NO: 3321258 - protein, 7 aa, Plasmodium falciparum
KKKNIAL

SEQ ID NO: 3321259 - protein, 19 aa, Plasmodium falciparum
KKKNIENKKRINDQTDEEI

SEQ ID NO: 3321260 - protein, 7 aa, Plasmodium falciparum
KKKNIGR

SEQ ID NO: 3321261 - protein, 15 aa, Plasmodium falciparum
KKKNIQNDKNKNNEN

SEQ ID NO: 3321262 - protein, 6 aa, Plasmodium falciparum
KKKNIS

SEQ ID NO: 3321263 - protein, 8 aa, Plasmodium falciparum
KKKNISQN

SEQ ID NO: 3321264 - protein, 118 aa, Plasmodium falciparum
KKKNKADNSSYDEEDIKQDGQFSDSSNVQEERKKKKRDGSDQDDESDEKSESDDNKSGDDNQSSDDNQSSDDNKSSDDNKSSDDNQSSGDNKSSDDNKSSDDNKSSGDNKSEDDQNNY

SEQ ID NO: 3321265 - protein, 11 aa, Plasmodium falciparum
KKKNKDSFKNT

SEQ ID NO: 3321266 - protein, 9 aa, Plasmodium falciparum
KKKNKERKI

SEQ ID NO: 3321267 - protein, 18 aa, Plasmodium falciparum
KKKNKGSTLNDNNNNNKI

SEQ ID NO: 3321268 - protein, 6 aa, Plasmodium falciparum
KKKNKI

SEQ ID NO: 3321269 - protein, 7 aa, Plasmodium falciparum
KKKNKID

SEQ ID NO: 3321270 - protein, 7 aa, Plasmodium falciparum
KKKNKIN

SEQ ID NO: 3321271 - protein, 12 aa, Plasmodium falciparum
KKKNKINHNEDN

SEQ ID NO: 3321272 - protein, 6 aa, Plasmodium falciparum
KKKNKK

SEQ ID NO: 3321273 - protein, 10 aa, Plasmodium falciparum
KKKNKKNNNK

SEQ ID NO: 3321274 - protein, 8 aa, Plasmodium falciparum
KKKNKMND

SEQ ID NO: 3321275 - protein, 14 aa, Plasmodium falciparum
KKKNKNDKNKNHIN

SEQ ID NO: 3321276 - protein, 8 aa, Plasmodium falciparum
KKKNKNKY

SEQ ID NO: 3321277 - protein, 23 aa, Plasmodium falciparum
KKKNKNNKKSTSNSYSKNNSIKY

SEQ ID NO: 3321278 - protein, 7 aa, Plasmodium falciparum
KKKNKQN

SEQ ID NO: 3321279 - protein, 8 aa, Plasmodium falciparum
KKKNKQTN

SEQ ID NO: 3321280 - protein, 15 aa, Plasmodium falciparum
KKKNKTQENNNTSDK

SEQ ID NO: 3321281 - protein, 10 aa, Plasmodium falciparum
KKKNKYDDDQ

SEQ ID NO: 3321282 - protein, 8 aa, Plasmodium falciparum
KKKNLNDK

SEQ ID NO: 3321283 - protein, 7 aa, Plasmodium falciparum
KKKNMDQ

SEQ ID NO: 3321284 - protein, 5 aa, Plasmodium falciparum
KKKNN

SEQ ID NO: 3321285 - protein, 8 aa, Plasmodium falciparum
KKKNNEVL

SEQ ID NO: 3321286 - protein, 7 aa, Plasmodium falciparum
KKKNNFY

SEQ ID NO: 3321287 - protein, 7 aa, Plasmodium falciparum
KKKNNIK

SEQ ID NO: 3321288 - protein, 7 aa, Plasmodium falciparum
KKKNNIL

SEQ ID NO: 3321289 - protein, 7 aa, Plasmodium falciparum
KKKNNIN

SEQ ID NO: 3321290 - protein, 8 aa, Plasmodium falciparum
KKKNNINV

SEQ ID NO: 3321291 - protein, 7 aa, Plasmodium falciparum
KKKNNLN

SEQ ID NO: 3321292 - protein, 8 aa, Plasmodium falciparum
KKKNNNEV

SEQ ID NO: 3321293 - protein, 18 aa, Plasmodium falciparum
KKKNNNNNNINSTNNDNN

SEQ ID NO: 3321294 - protein, 11 aa, Plasmodium falciparum
KKKNNNNNNKI

SEQ ID NO: 3321295 - protein, 7 aa, Plasmodium falciparum
KKKNNPL

SEQ ID NO: 3321296 - protein, 9 aa, Plasmodium falciparum
KKKNNTNMN

SEQ ID NO: 3321297 - protein, 6 aa, Plasmodium falciparum
KKKNNV

SEQ ID NO: 3321298 - protein, 8 aa, Plasmodium falciparum
KKKNNYKD

SEQ ID NO: 3321299 - protein, 7 aa, Plasmodium falciparum
KKKNPSL

SEQ ID NO: 3321300 - protein, 20 aa, Plasmodium falciparum
KKKNPTSNEQANKNNDLETC

SEQ ID NO: 3321301 - protein, 9 aa, Plasmodium falciparum
KKKNQDEYD

SEQ ID NO: 3321302 - protein, 8 aa, Plasmodium falciparum
KKKNQNAE

SEQ ID NO: 3321303 - protein, 7 aa, Plasmodium falciparum
KKKNQSE

SEQ ID NO: 3321304 - protein, 114 aa, Plasmodium falciparum
KKKNRRYKKNANKRQRKGGENKMKSQKEEEKKMDSKKEEEKKMDSKKKEEKKMDSKKKEDKMGNQKKECKINNQKKERKTNNQTKERKTNNQTNENKTNNQTNENKTNNQTKEH

SEQ ID NO: 3321305 - protein, 9 aa, Plasmodium falciparum
KKKNRTCDK

SEQ ID NO: 3321306 - protein, 6 aa, Plasmodium falciparum
KKKNRY

SEQ ID NO: 3321307 - protein, 10 aa, Plasmodium falciparum
KKKNSHPYDE

SEQ ID NO: 3321308 - protein, 29 aa, Plasmodium falciparum
KKKNSKKSKKKKLDNKEDNVTEPNKKLQV

SEQ ID NO: 3321309 - protein, 8 aa, Plasmodium falciparum
KKKNSLNH

SEQ ID NO: 3321310 - protein, 15 aa, Plasmodium falciparum
KKKNSQKENNKKIST

SEQ ID NO: 3321311 - protein, 9 aa, Plasmodium falciparum
KKKNSRDIE

SEQ ID NO: 3321312 - protein, 8 aa, Plasmodium falciparum
KKKNTGNR

SEQ ID NO: 3321313 - protein, 7 aa, Plasmodium falciparum
KKKNTHT

SEQ ID NO: 3321314 - protein, 6 aa, Plasmodium falciparum
KKKNTI

SEQ ID NO: 3321315 - protein, 7 aa, Plasmodium falciparum
KKKNTLK

SEQ ID NO: 3321316 - protein, 62 aa, Plasmodium falciparum
KKKNTNNNNNNNNNNNNNNSNNNSNNNNNSSNNNNNNNNNNSGSNSNNNSLKGSKSNRPSVE

SEQ ID NO: 3321317 - protein, 9 aa, Plasmodium falciparum
KKKNTQQIN

SEQ ID NO: 3321318 - protein, 24 aa, Plasmodium falciparum
KKKNYHSSSQSNHSYDENKKDELS

SEQ ID NO: 3321319 - protein, 21 aa, Plasmodium falciparum
KKKNYSSSEMSKNSYSTCNTN

SEQ ID NO: 3321320 - protein, 4 aa, Plasmodium falciparum
KKKP

SEQ ID NO: 3321321 - protein, 8 aa, Plasmodium falciparum
KKKPEQVR

SEQ ID NO: 3321322 - protein, 8 aa, Plasmodium falciparum
KKKPFSKR

SEQ ID NO: 3321323 - protein, 12 aa, Plasmodium falciparum
KKKPKQPKNRKI

SEQ ID NO: 3321324 - protein, 10 aa, Plasmodium falciparum
KKKPKSVKKN

SEQ ID NO: 3321325 - protein, 5 aa, Plasmodium falciparum
KKKPL

SEQ ID NO: 3321326 - protein, 9 aa, Plasmodium falciparum
KKKPNEVKN

SEQ ID NO: 3321327 - protein, 6 aa, Plasmodium falciparum
KKKPSR

SEQ ID NO: 3321328 - protein, 7 aa, Plasmodium falciparum
KKKPSSI

SEQ ID NO: 3321329 - protein, 4 aa, Plasmodium falciparum
KKKQ

SEQ ID NO: 3321330 - protein, 6 aa, Plasmodium falciparum
KKKQED

SEQ ID NO: 3321331 - protein, 14 aa, Plasmodium falciparum
KKKQERTQQEEQKL

SEQ ID NO: 3321332 - protein, 21 aa, Plasmodium falciparum
KKKQESESKIKEKEQTKKEEM

SEQ ID NO: 3321333 - protein, 8 aa, Plasmodium falciparum
KKKQESLD

SEQ ID NO: 3321334 - protein, 8 aa, Plasmodium falciparum
KKKQETDS

SEQ ID NO: 3321335 - protein, 17 aa, Plasmodium falciparum
KKKQHDSTTSVGTSNMD

SEQ ID NO: 3321336 - protein, 6 aa, Plasmodium falciparum
KKKQKC

SEQ ID NO: 3321337 - protein, 15 aa, Plasmodium falciparum
KKKQLQEEKKKKENL

SEQ ID NO: 3321338 - protein, 10 aa, Plasmodium falciparum
KKKQLQYDNT

SEQ ID NO: 3321339 - protein, 8 aa, Plasmodium falciparum
KKKQNKRL

SEQ ID NO: 3321340 - protein, 8 aa, Plasmodium falciparum
KKKQNSKC

SEQ ID NO: 3321341 - protein, 9 aa, Plasmodium falciparum
KKKQNTPIK

SEQ ID NO: 3321342 - protein, 7 aa, Plasmodium falciparum
KKKQRED

SEQ ID NO: 3321343 - protein, 7 aa, Plasmodium falciparum
KKKQSTY

SEQ ID NO: 3321344 - protein, 13 aa, Plasmodium falciparum
KKKQTNTHNVQQN

SEQ ID NO: 3321345 - protein, 7 aa, Plasmodium falciparum
KKKQTYK

SEQ ID NO: 3321346 - protein, 8 aa, Plasmodium falciparum
KKKQVPSD

SEQ ID NO: 3321347 - protein, 8 aa, Plasmodium falciparum
KKKRDAEN

SEQ ID NO: 3321348 - protein, 21 aa, Plasmodium falciparum
KKKRDKSYTQDDDYNEEEEKK

SEQ ID NO: 3321349 - protein, 5 aa, Plasmodium falciparum
KKKRI

SEQ ID NO: 3321350 - protein, 13 aa, Plasmodium falciparum
KKKRISNNKKKCK

SEQ ID NO: 3321351 - protein, 6 aa, Plasmodium falciparum
KKKRKF

SEQ ID NO: 3321352 - protein, 24 aa, Plasmodium falciparum
KKKRKKKKKDNKKYNIKNKNESEE

SEQ ID NO: 3321353 - protein, 20 aa, Plasmodium falciparum
KKKRKKNNNNSYNTNSTGRY

SEQ ID NO: 3321354 - protein, 14 aa, Plasmodium falciparum
KKKRKKSGNNKKSD

SEQ ID NO: 3321355 - protein, 11 aa, Plasmodium falciparum
KKKRKNELRDK

SEQ ID NO: 3321356 - protein, 8 aa, Plasmodium falciparum
KKKRKNSF

SEQ ID NO: 3321357 - protein, 12 aa, Plasmodium falciparum
KKKRKRKEKINI

SEQ ID NO: 3321358 - protein, 19 aa, Plasmodium falciparum
KKKRKRKKKYNKDKINNSK

SEQ ID NO: 3321359 - protein, 6 aa, Plasmodium falciparum
KKKRKS

SEQ ID NO: 3321360 - protein, 20 aa, Plasmodium falciparum
KKKRKTDSDESPDENDQEER

SEQ ID NO: 3321361 - protein, 10 aa, Plasmodium falciparum
KKKRKYKKKH

SEQ ID NO: 3321362 - protein, 7 aa, Plasmodium falciparum
KKKRMSL

SEQ ID NO: 3321363 - protein, 6 aa, Plasmodium falciparum
KKKRNH

SEQ ID NO: 3321364 - protein, 10 aa, Plasmodium falciparum
KKKRNKESHH

SEQ ID NO: 3321365 - protein, 9 aa, Plasmodium falciparum
KKKRNNNNS

SEQ ID NO: 3321366 - protein, 8 aa, Plasmodium falciparum
KKKRRKYK

SEQ ID NO: 3321367 - protein, 9 aa, Plasmodium falciparum
KKKRTDKNE

SEQ ID NO: 3321368 - protein, 26 aa, Plasmodium falciparum
KKKRTRKRIKQNKIEKEMERERERER

SEQ ID NO: 3321369 - protein, 4 aa, Plasmodium falciparum
KKKS

SEQ ID NO: 3321370 - protein, 9 aa, Plasmodium falciparum
KKKSDHIRE

SEQ ID NO: 3321371 - protein, 9 aa, Plasmodium falciparum
KKKSDQEDI

SEQ ID NO: 3321372 - protein, 8 aa, Plasmodium falciparum
KKKSEDFT

SEQ ID NO: 3321373 - protein, 9 aa, Plasmodium falciparum
KKKSEDNKL

SEQ ID NO: 3321374 - protein, 6 aa, Plasmodium falciparum
KKKSEL

SEQ ID NO: 3321375 - protein, 8 aa, Plasmodium falciparum
KKKSETDD

SEQ ID NO: 3321376 - protein, 8 aa, Plasmodium falciparum
KKKSFNKK

SEQ ID NO: 3321377 - protein, 16 aa, Plasmodium falciparum
KKKSFNPKKNKKVSIE

SEQ ID NO: 3321378 - protein, 15 aa, Plasmodium falciparum
KKKSIEKKKTKKNVK

SEQ ID NO: 3321379 - protein, 6 aa, Plasmodium falciparum
KKKSIK

SEQ ID NO: 3321380 - protein, 15 aa, Plasmodium falciparum
KKKSINNEESIDSKS

SEQ ID NO: 3321381 - protein, 27 aa, Plasmodium falciparum
KKKSKKETKNTNHTNNKNNDNNNDNNI

SEQ ID NO: 3321382 - protein, 10 aa, Plasmodium falciparum
KKKSKKKKKK

SEQ ID NO: 3321383 - protein, 28 aa, Plasmodium falciparum
KKKSKNKINKTTSNDDINDIKNDKYDMD

SEQ ID NO: 3321384 - protein, 16 aa, Plasmodium falciparum
KKKSKYDIMLPNLDDD

SEQ ID NO: 3321385 - protein, 7 aa, Plasmodium falciparum
KKKSKYE

SEQ ID NO: 3321386 - protein, 8 aa, Plasmodium falciparum
KKKSLNVS

SEQ ID NO: 3321387 - protein, 5 aa, Plasmodium falciparum
KKKSN

SEQ ID NO: 3321388 - protein, 20 aa, Plasmodium falciparum
KKKSNPQKETNNTFSNNNDY

SEQ ID NO: 3321389 - protein, 15 aa, Plasmodium falciparum
KKKSNRKLKNSKKLN

SEQ ID NO: 3321390 - protein, 6 aa, Plasmodium falciparum
KKKSQL

SEQ ID NO: 3321391 - protein, 8 aa, Plasmodium falciparum
KKKSQNYY

SEQ ID NO: 3321392 - protein, 9 aa, Plasmodium falciparum
KKKSRNDQY

SEQ ID NO: 3321393 - protein, 7 aa, Plasmodium falciparum
KKKSSEN

SEQ ID NO: 3321394 - protein, 8 aa, Plasmodium falciparum
KKKSSGQL

SEQ ID NO: 3321395 - protein, 9 aa, Plasmodium falciparum
KKKSSNYNL

SEQ ID NO: 3321396 - protein, 13 aa, Plasmodium falciparum
KKKSSSSCSSTNY

SEQ ID NO: 3321397 - protein, 6 aa, Plasmodium falciparum
KKKSSY

SEQ ID NO: 3321398 - protein, 15 aa, Plasmodium falciparum
KKKSTKKAVPTASNN

SEQ ID NO: 3321399 - protein, 19 aa, Plasmodium falciparum
KKKTAEIKTGENNTENNKG

SEQ ID NO: 3321400 - protein, 37 aa, Plasmodium falciparum
KKKTANIKQEKGSNKKKENNNNVKNDPIKKKENINKI

SEQ ID NO: 3321401 - protein, 6 aa, Plasmodium falciparum
KKKTAV

SEQ ID NO: 3321402 - protein, 13 aa, Plasmodium falciparum
KKKTEKLKNTKES

SEQ ID NO: 3321403 - protein, 12 aa, Plasmodium falciparum
KKKTESGKEGNK

SEQ ID NO: 3321404 - protein, 7 aa, Plasmodium falciparum
KKKTEWE

SEQ ID NO: 3321405 - protein, 7 aa, Plasmodium falciparum
KKKTFAD

SEQ ID NO: 3321406 - protein, 7 aa, Plasmodium falciparum
KKKTGNI

SEQ ID NO: 3321407 - protein, 29 aa, Plasmodium falciparum
KKKTKEEEKEDKKFDQEKKKKKKKKEEDE

SEQ ID NO: 3321408 - protein, 12 aa, Plasmodium falciparum
KKKTKTKKKNNI

SEQ ID NO: 3321409 - protein, 6 aa, Plasmodium falciparum
KKKTLN

SEQ ID NO: 3321410 - protein, 7 aa, Plasmodium falciparum
KKKTNKW

SEQ ID NO: 3321411 - protein, 9 aa, Plasmodium falciparum
KKKTNNRIE

SEQ ID NO: 3321412 - protein, 15 aa, Plasmodium falciparum
KKKTNSKKGQDEYPN

SEQ ID NO: 3321413 - protein, 19 aa, Plasmodium falciparum
KKKTNSTDSYNKNNNIGND

SEQ ID NO: 3321414 - protein, 9 aa, Plasmodium falciparum
KKKTRRGTN

SEQ ID NO: 3321415 - protein, 17 aa, Plasmodium falciparum
KKKTTEESDEKNEFNTN

SEQ ID NO: 3321416 - protein, 7 aa, Plasmodium falciparum
KKKTTIH

SEQ ID NO: 3321417 - protein, 7 aa, Plasmodium falciparum
KKKTTNN

SEQ ID NO: 3321418 - protein, 20 aa, Plasmodium falciparum
KKKTYKMDKKNKKNPTNNTL

SEQ ID NO: 3321419 - protein, 14 aa, Plasmodium falciparum
KKKVETKKNKEQKY

SEQ ID NO: 3321420 - protein, 17 aa, Plasmodium falciparum
KKKVGRPRGASSNNKVI

SEQ ID NO: 3321421 - protein, 27 aa, Plasmodium falciparum
KKKVKKSKNSFKKEEEKQKKKNKKVKK

SEQ ID NO: 3321422 - protein, 11 aa, Plasmodium falciparum
KKKVKTQLNNN

SEQ ID NO: 3321423 - protein, 7 aa, Plasmodium falciparum
KKKVLDD

SEQ ID NO: 3321424 - protein, 9 aa, Plasmodium falciparum
KKKVNSLSG

SEQ ID NO: 3321425 - protein, 25 aa, Plasmodium falciparum
KKKVQEKKESVNNIKNDKSTENDNL

SEQ ID NO: 3321426 - protein, 4 aa, Plasmodium falciparum
KKKY

SEQ ID NO: 3321427 - protein, 11 aa, Plasmodium falciparum
KKKYEENKKNV

SEQ ID NO: 3321428 - protein, 20 aa, Plasmodium falciparum
KKKYFTHNNNNNNNNNQHHN

SEQ ID NO: 3321429 - protein, 7 aa, Plasmodium falciparum
KKKYGDI

SEQ ID NO: 3321430 - protein, 12 aa, Plasmodium falciparum
KKKYGNEGHESE

SEQ ID NO: 3321431 - protein, 6 aa, Plasmodium falciparum
KKKYIE

SEQ ID NO: 3321432 - protein, 8 aa, Plasmodium falciparum
KKKYKNKL

SEQ ID NO: 3321433 - protein, 9 aa, Plasmodium falciparum
KKKYMPPSS

SEQ ID NO: 3321434 - protein, 10 aa, Plasmodium falciparum
KKKYNNNNNN

SEQ ID NO: 3321435 - protein, 17 aa, Plasmodium falciparum
KKKYNNNNNNNNNNTKS

SEQ ID NO: 3321436 - protein, 11 aa, Plasmodium falciparum
KKKYQKRGGRK

SEQ ID NO: 3321437 - protein, 13 aa, Plasmodium falciparum
KKKYRKDKPWDNE

SEQ ID NO: 3321438 - protein, 10 aa, Plasmodium falciparum
KKKYRNDKTN

SEQ ID NO: 3321439 - protein, 18 aa, Plasmodium falciparum
KKKYSSRLSTKSKKNQKR

SEQ ID NO: 3321440 - protein, 8 aa, Plasmodium falciparum
KKKYTEKV

SEQ ID NO: 3321441 - protein, 5 aa, Plasmodium falciparum
KKKYV

SEQ ID NO: 3321442 - protein, 7 aa, Plasmodium falciparum
KKLASSS

SEQ ID NO: 3321443 - protein, 6 aa, Plasmodium falciparum
KKLDDS

SEQ ID NO: 3321444 - protein, 6 aa, Plasmodium falciparum
KKLDNT

SEQ ID NO: 3321445 - protein, 8 aa, Plasmodium falciparum
KKLEEEKN

SEQ ID NO: 3321446 - protein, 6 aa, Plasmodium falciparum
KKLEEY

SEQ ID NO: 3321447 - protein, 5 aa, Plasmodium falciparum
KKLEN

SEQ ID NO: 3321448 - protein, 8 aa, Plasmodium falciparum
KKLEPKKE

SEQ ID NO: 3321449 - protein, 62 aa, Plasmodium falciparum
KKLGHPKKKKTNHKGNNNNDGDNNGGHHNGGDNNNGDNNNGDNNNGDNNNGDNNNGDNNNNY

SEQ ID NO: 3321450 - protein, 16 aa, Plasmodium falciparum
KKLGTHKRGKAKREEI

SEQ ID NO: 3321451 - protein, 8 aa, Plasmodium falciparum
KKLKDDNN

SEQ ID NO: 3321452 - protein, 8 aa, Plasmodium falciparum
KKLKDRLN

SEQ ID NO: 3321453 - protein, 7 aa, Plasmodium falciparum
KKLKENK

SEQ ID NO: 3321454 - protein, 15 aa, Plasmodium falciparum
KKLKGKLAARAKKKG

SEQ ID NO: 3321455 - protein, 9 aa, Plasmodium falciparum
KKLKKGGKF

SEQ ID NO: 3321456 - protein, 5 aa, Plasmodium falciparum
KKLKN

SEQ ID NO: 3321457 - protein, 15 aa, Plasmodium falciparum
KKLKNGESNKNDDEI

SEQ ID NO: 3321458 - protein, 13 aa, Plasmodium falciparum
KKLKNNKCSNNNM

SEQ ID NO: 3321459 - protein, 26 aa, Plasmodium falciparum
KKLKNNSNNNNNNNNNNNNNNNEKIN

SEQ ID NO: 3321460 - protein, 10 aa, Plasmodium falciparum
KKLKQDETYQ

SEQ ID NO: 3321461 - protein, 6 aa, Plasmodium falciparum
KKLKRK

SEQ ID NO: 3321462 - protein, 9 aa, Plasmodium falciparum
KKLKSKNDD

SEQ ID NO: 3321463 - protein, 10 aa, Plasmodium falciparum
KKLKYKSPRQ

SEQ ID NO: 3321464 - protein, 6 aa, Plasmodium falciparum
KKLNDK

SEQ ID NO: 3321465 - protein, 9 aa, Plasmodium falciparum
KKLNDKKEC

SEQ ID NO: 3321466 - protein, 9 aa, Plasmodium falciparum
KKLNDPPDK

SEQ ID NO: 3321467 - protein, 6 aa, Plasmodium falciparum
KKLNNN

SEQ ID NO: 3321468 - protein, 5 aa, Plasmodium falciparum
KKLNR

SEQ ID NO: 3321469 - protein, 7 aa, Plasmodium falciparum
KKLPADV

SEQ ID NO: 3321470 - protein, 6 aa, Plasmodium falciparum
KKLPSL

SEQ ID NO: 3321471 - protein, 7 aa, Plasmodium falciparum
KKLQASL

SEQ ID NO: 3321472 - protein, 7 aa, Plasmodium falciparum
KKLQEQG

SEQ ID NO: 3321473 - protein, 10 aa, Plasmodium falciparum
KKLRDNLPTN

SEQ ID NO: 3321474 - protein, 7 aa, Plasmodium falciparum
KKLRKKV

SEQ ID NO: 3321475 - protein, 5 aa, Plasmodium falciparum
KKLSE

SEQ ID NO: 3321476 - protein, 7 aa, Plasmodium falciparum
KKLSKRA

SEQ ID NO: 3321477 - protein, 7 aa, Plasmodium falciparum
KKLSNNY

SEQ ID NO: 3321478 - protein, 20 aa, Plasmodium falciparum
KKLSNQKLSEDKKKEQNMDN

SEQ ID NO: 3321479 - protein, 9 aa, Plasmodium falciparum
KKLSQKSFS

SEQ ID NO: 3321480 - protein, 12 aa, Plasmodium falciparum
KKLSSDNNHIQN

SEQ ID NO: 3321481 - protein, 6 aa, Plasmodium falciparum
KKLSSH

SEQ ID NO: 3321482 - protein, 6 aa, Plasmodium falciparum
KKLSTQ

SEQ ID NO: 3321483 - protein, 6 aa, Plasmodium falciparum
KKLTEE

SEQ ID NO: 3321484 - protein, 63 aa, Plasmodium falciparum
KKLTNGDDKNNTNEHDNKNNTNDDDNKNNTNEDDNKNNTNEDDNKNNNTNDDDYDDEKWDGGN

SEQ ID NO: 3321485 - protein, 5 aa, Plasmodium falciparum
KKLTQ

SEQ ID NO: 3321486 - protein, 4 aa, Plasmodium falciparum
KKMD

SEQ ID NO: 3321487 - protein, 9 aa, Plasmodium falciparum
KKMDKENVN

SEQ ID NO: 3321488 - protein, 8 aa, Plasmodium falciparum
KKMDTKKD

SEQ ID NO: 3321489 - protein, 8 aa, Plasmodium falciparum
KKMDTKKN

SEQ ID NO: 3321490 - protein, 13 aa, Plasmodium falciparum
KKMEENKKKKIDK

SEQ ID NO: 3321491 - protein, 14 aa, Plasmodium falciparum
KKMEGGVKLPSSNE

SEQ ID NO: 3321492 - protein, 20 aa, Plasmodium falciparum
KKMEKKKSLKNKNLDHNNNV

SEQ ID NO: 3321493 - protein, 10 aa, Plasmodium falciparum
KKMENGNNEY

SEQ ID NO: 3321494 - protein, 10 aa, Plasmodium falciparum
KKMEQANKNY

SEQ ID NO: 3321495 - protein, 6 aa, Plasmodium falciparum
KKMETH

SEQ ID NO: 3321496 - protein, 48 aa, Plasmodium falciparum
KKMKDTSNISSSYHNKNNNYTNQESNKAIGAGAGAGAGAGSASASGGQ

SEQ ID NO: 3321497 - protein, 6 aa, Plasmodium falciparum
KKMKKK

SEQ ID NO: 3321498 - protein, 13 aa, Plasmodium falciparum
KKMKKKKGEKKKH

SEQ ID NO: 3321499 - protein, 9 aa, Plasmodium falciparum
KKMKKNEKM

SEQ ID NO: 3321500 - protein, 16 aa, Plasmodium falciparum
KKMKKNKKRKLKTNNN

SEQ ID NO: 3321501 - protein, 4 aa, Plasmodium falciparum
KKMN

SEQ ID NO: 3321502 - protein, 5 aa, Plasmodium falciparum
KKMNH

SEQ ID NO: 3321503 - protein, 12 aa, Plasmodium falciparum
KKMNKQNKQIDE

SEQ ID NO: 3321504 - protein, 5 aa, Plasmodium falciparum
KKMNQ

SEQ ID NO: 3321505 - protein, 6 aa, Plasmodium falciparum
KKMNSI

SEQ ID NO: 3321506 - protein, 6 aa, Plasmodium falciparum
KKMNSQ

SEQ ID NO: 3321507 - protein, 7 aa, Plasmodium falciparum
KKMNSST

SEQ ID NO: 3321508 - protein, 7 aa, Plasmodium falciparum
KKMTADE

SEQ ID NO: 3321509 - protein, 6 aa, Plasmodium falciparum
KKMTNE

SEQ ID NO: 3321510 - protein, 4 aa, Plasmodium falciparum
KKMV

SEQ ID NO: 3321511 - protein, 4 aa, Plasmodium falciparum
KKNA

SEQ ID NO: 3321512 - protein, 22 aa, Plasmodium falciparum
KKNANDKTENVYSKKGYKSKDD

SEQ ID NO: 3321513 - protein, 7 aa, Plasmodium falciparum
KKNANVF

SEQ ID NO: 3321514 - protein, 7 aa, Plasmodium falciparum
KKNAQGN

SEQ ID NO: 3321515 - protein, 14 aa, Plasmodium falciparum
KKNATCKEDEENKV

SEQ ID NO: 3321516 - protein, 14 aa, Plasmodium falciparum
KKNATNEINKTNEI

SEQ ID NO: 3321517 - protein, 12 aa, Plasmodium falciparum
KKNDDATQKNIP

SEQ ID NO: 3321518 - protein, 12 aa, Plasmodium falciparum
KKNDDNESKPTV

SEQ ID NO: 3321519 - protein, 16 aa, Plasmodium falciparum
KKNDEIDETEEIRKRE

SEQ ID NO: 3321520 - protein, 5 aa, Plasmodium falciparum
KKNDF

SEQ ID NO: 3321521 - protein, 18 aa, Plasmodium falciparum
KKNDFKKDYKKEDDDDHH

SEQ ID NO: 3321522 - protein, 8 aa, Plasmodium falciparum
KKNDGKSW

SEQ ID NO: 3321523 - protein, 5 aa, Plasmodium falciparum
KKNDI

SEQ ID NO: 3321524 - protein, 10 aa, Plasmodium falciparum
KKNDIKNDKN

SEQ ID NO: 3321525 - protein, 8 aa, Plasmodium falciparum
KKNDIKNE

SEQ ID NO: 3321526 - protein, 6 aa, Plasmodium falciparum
KKNDIS

SEQ ID NO: 3321527 - protein, 7 aa, Plasmodium falciparum
KKNDKDA

SEQ ID NO: 3321528 - protein, 8 aa, Plasmodium falciparum
KKNDKKDL

SEQ ID NO: 3321529 - protein, 32 aa, Plasmodium falciparum
KKNDKKKVNNKRNNENKSNDIKNDKKNNNIKH

SEQ ID NO: 3321530 - protein, 10 aa, Plasmodium falciparum
KKNDKYGKNL

SEQ ID NO: 3321531 - protein, 20 aa, Plasmodium falciparum
KKNDNSHTNRSYDKSENVSN

SEQ ID NO: 3321532 - protein, 8 aa, Plasmodium falciparum
KKNDPNSE

SEQ ID NO: 3321533 - protein, 6 aa, Plasmodium falciparum
KKNDQN

SEQ ID NO: 3321534 - protein, 20 aa, Plasmodium falciparum
KKNDSCGSSLSVSNKSDDDM

SEQ ID NO: 3321535 - protein, 10 aa, Plasmodium falciparum
KKNDSNVRSE

SEQ ID NO: 3321536 - protein, 7 aa, Plasmodium falciparum
KKNDTDC

SEQ ID NO: 3321537 - protein, 8 aa, Plasmodium falciparum
KKNDTMKQ

SEQ ID NO: 3321538 - protein, 30 aa, Plasmodium falciparum
KKNDTQNDTQNDTQNGTLENQETKEDHPNI

SEQ ID NO: 3321539 - protein, 8 aa, Plasmodium falciparum
KKNDTSYN

SEQ ID NO: 3321540 - protein, 5 aa, Plasmodium falciparum
KKNDV

SEQ ID NO: 3321541 - protein, 6 aa, Plasmodium falciparum
KKNDVS

SEQ ID NO: 3321542 - protein, 8 aa, Plasmodium falciparum
KKNDYNVN

SEQ ID NO: 3321543 - protein, 4 aa, Plasmodium falciparum
KKNE

SEQ ID NO: 3321544 - protein, 78 aa, Plasmodium falciparum
KKNEAKKEKNNKKKEKQKNKKNEKEKNKKKEKEKNKKKEKEKNKKKEKEKSKKKEKEKNKKKEKEKNKKKEKEKNNGD

SEQ ID NO: 3321545 - protein, 5 aa, Plasmodium falciparum
KKNED

SEQ ID NO: 3321546 - protein, 45 aa, Plasmodium falciparum
KKNEDEKDITKINSNNKNENIEKNNNDNNNNNNNTSNEVDKDDKE

SEQ ID NO: 3321547 - protein, 34 aa, Plasmodium falciparum
KKNEDGNKSKEINQNSDMNKSNEINKNKSYEKIK

SEQ ID NO: 3321548 - protein, 18 aa, Plasmodium falciparum
KKNEDKNKNNIGTSTQNR

SEQ ID NO: 3321549 - protein, 9 aa, Plasmodium falciparum
KKNEDNNFE

SEQ ID NO: 3321550 - protein, 8 aa, Plasmodium falciparum
KKNEDYYH

SEQ ID NO: 3321551 - protein, 5 aa, Plasmodium falciparum
KKNEE

SEQ ID NO: 3321552 - protein, 9 aa, Plasmodium falciparum
KKNEEDINK

SEQ ID NO: 3321553 - protein, 10 aa, Plasmodium falciparum
KKNEEEKRVN

SEQ ID NO: 3321554 - protein, 8 aa, Plasmodium falciparum
KKNEEGIL

SEQ ID NO: 3321555 - protein, 12 aa, Plasmodium falciparum
KKNEEKEHNNNL

SEQ ID NO: 3321556 - protein, 8 aa, Plasmodium falciparum
KKNEEKKN

SEQ ID NO: 3321557 - protein, 12 aa, Plasmodium falciparum
KKNEEKLRNSKN

SEQ ID NO: 3321558 - protein, 21 aa, Plasmodium falciparum
KKNEEKNENQKYRDRAEERRK

SEQ ID NO: 3321559 - protein, 8 aa, Plasmodium falciparum
KKNEENGC

SEQ ID NO: 3321560 - protein, 16 aa, Plasmodium falciparum
KKNEENYEQADEDEEK

SEQ ID NO: 3321561 - protein, 14 aa, Plasmodium falciparum
KKNEESTKKVKPQK

SEQ ID NO: 3321562 - protein, 114 aa, Plasmodium falciparum
KKNEGDKNKVYNGTADNNKVDNNKVDNNKVDNNKGDNNKVDNNKGDNNKVNNNKGDNNKVDNNKVDNNKVDNNKVDNNKVDNNKGDNNKVDNNKGDNNKVDNNKVNNNKVNNNK

SEQ ID NO: 3321563 - protein, 6 aa, Plasmodium falciparum
KKNEGE

SEQ ID NO: 3321564 - protein, 35 aa, Plasmodium falciparum
KKNEHKLNSNKSDIDKTRKSATISRDGSLRRNERK

SEQ ID NO: 3321565 - protein, 7 aa, Plasmodium falciparum
KKNEKDN

SEQ ID NO: 3321566 - protein, 9 aa, Plasmodium falciparum
KKNEKENKM

SEQ ID NO: 3321567 - protein, 6 aa, Plasmodium falciparum
KKNEKH

SEQ ID NO: 3321568 - protein, 6 aa, Plasmodium falciparum
KKNEKI

SEQ ID NO: 3321569 - protein, 7 aa, Plasmodium falciparum
KKNEKLK

SEQ ID NO: 3321570 - protein, 9 aa, Plasmodium falciparum
KKNEKNNNF

SEQ ID NO: 3321571 - protein, 7 aa, Plasmodium falciparum
KKNEKTL

SEQ ID NO: 3321572 - protein, 6 aa, Plasmodium falciparum
KKNEKY

SEQ ID NO: 3321573 - protein, 13 aa, Plasmodium falciparum
KKNEKYNNNNNNN

SEQ ID NO: 3321574 - protein, 5 aa, Plasmodium falciparum
KKNEM

SEQ ID NO: 3321575 - protein, 6 aa, Plasmodium falciparum
KKNENA

SEQ ID NO: 3321576 - protein, 6 aa, Plasmodium falciparum
KKNEND

SEQ ID NO: 3321577 - protein, 11 aa, Plasmodium falciparum
KKNENHHDKNP

SEQ ID NO: 3321578 - protein, 24 aa, Plasmodium falciparum
KKNENNDSNEFNNNNNINNNDNVN

SEQ ID NO: 3321579 - protein, 28 aa, Plasmodium falciparum
KKNENNKYSSCDEKYQNHKNHETDEGSN

SEQ ID NO: 3321580 - protein, 5 aa, Plasmodium falciparum
KKNEP

SEQ ID NO: 3321581 - protein, 6 aa, Plasmodium falciparum
KKNEPL

SEQ ID NO: 3321582 - protein, 7 aa, Plasmodium falciparum
KKNEQNV

SEQ ID NO: 3321583 - protein, 8 aa, Plasmodium falciparum
KKNEQRKL

SEQ ID NO: 3321584 - protein, 22 aa, Plasmodium falciparum
KKNETNSSSNDNISHNKTPMQS

SEQ ID NO: 3321585 - protein, 10 aa, Plasmodium falciparum
KKNETSSTKL

SEQ ID NO: 3321586 - protein, 7 aa, Plasmodium falciparum
KKNETYI

SEQ ID NO: 3321587 - protein, 8 aa, Plasmodium falciparum
KKNETYKK

SEQ ID NO: 3321588 - protein, 9 aa, Plasmodium falciparum
KKNEVNNTL

SEQ ID NO: 3321589 - protein, 10 aa, Plasmodium falciparum
KKNEYKKKKK

SEQ ID NO: 3321590 - protein, 4 aa, Plasmodium falciparum
KKNF

SEQ ID NO: 3321591 - protein, 9 aa, Plasmodium falciparum
KKNFEEETN

SEQ ID NO: 3321592 - protein, 5 aa, Plasmodium falciparum
KKNFQ

SEQ ID NO: 3321593 - protein, 22 aa, Plasmodium falciparum
KKNFTTDNGKHDNTKKKRPNGL

SEQ ID NO: 3321594 - protein, 10 aa, Plasmodium falciparum
KKNGEKMNKT

SEQ ID NO: 3321595 - protein, 15 aa, Plasmodium falciparum
KKNGGKDVSKNSKSL

SEQ ID NO: 3321596 - protein, 8 aa, Plasmodium falciparum
KKNGIKEV

SEQ ID NO: 3321597 - protein, 20 aa, Plasmodium falciparum
KKNGINGGNKNDETKQKSND

SEQ ID NO: 3321598 - protein, 10 aa, Plasmodium falciparum
KKNGKDEEEY

SEQ ID NO: 3321599 - protein, 11 aa, Plasmodium falciparum
KKNGNESEEYM

SEQ ID NO: 3321600 - protein, 8 aa, Plasmodium falciparum
KKNGNKYY

SEQ ID NO: 3321601 - protein, 5 aa, Plasmodium falciparum
KKNGS

SEQ ID NO: 3321602 - protein, 12 aa, Plasmodium falciparum
KKNHADNNNNNN

SEQ ID NO: 3321603 - protein, 19 aa, Plasmodium falciparum
KKNHEKDSVENEDYNTKKE

SEQ ID NO: 3321604 - protein, 29 aa, Plasmodium falciparum
KKNHKKNNDTNDTNDSNNNNNNNNISTEQ

SEQ ID NO: 3321605 - protein, 18 aa, Plasmodium falciparum
KKNHKKSNRNSKKKLRSC

SEQ ID NO: 3321606 - protein, 9 aa, Plasmodium falciparum
KKNHNEPTL

SEQ ID NO: 3321607 - protein, 11 aa, Plasmodium falciparum
KKNHNNDKENI

SEQ ID NO: 3321608 - protein, 6 aa, Plasmodium falciparum
KKNHPL

SEQ ID NO: 3321609 - protein, 7 aa, Plasmodium falciparum
KKNIDKS

SEQ ID NO: 3321610 - protein, 7 aa, Plasmodium falciparum
KKNIDNN

SEQ ID NO: 3321611 - protein, 22 aa, Plasmodium falciparum
KKNIEKNDTCNNNNDNNNDNNY

SEQ ID NO: 3321612 - protein, 5 aa, Plasmodium falciparum
KKNIK

SEQ ID NO: 3321613 - protein, 8 aa, Plasmodium falciparum
KKNIKDKQ

SEQ ID NO: 3321614 - protein, 8 aa, Plasmodium falciparum
KKNINANR

SEQ ID NO: 3321615 - protein, 13 aa, Plasmodium falciparum
KKNINQKKNEDEK

SEQ ID NO: 3321616 - protein, 20 aa, Plasmodium falciparum
KKNIPNGNRSIAEQDKTECK

SEQ ID NO: 3321617 - protein, 9 aa, Plasmodium falciparum
KKNIQNISS

SEQ ID NO: 3321618 - protein, 6 aa, Plasmodium falciparum
KKNIRN

SEQ ID NO: 3321619 - protein, 13 aa, Plasmodium falciparum
KKNISGCNTTTKL

SEQ ID NO: 3321620 - protein, 18 aa, Plasmodium falciparum
KKNISKVQGEDNNVGEAY

SEQ ID NO: 3321621 - protein, 13 aa, Plasmodium falciparum
KKNITASKNVPNK

SEQ ID NO: 3321622 - protein, 12 aa, Plasmodium falciparum
KKNITDKNNTLK

SEQ ID NO: 3321623 - protein, 5 aa, Plasmodium falciparum
KKNIY

SEQ ID NO: 3321624 - protein, 4 aa, Plasmodium falciparum
KKNK

SEQ ID NO: 3321625 - protein, 30 aa, Plasmodium falciparum
KKNKDEKYAFQDDKKDINVSEGKKDGNMQE

SEQ ID NO: 3321626 - protein, 50 aa, Plasmodium falciparum
KKNKDGGEYEKRNTSSYDNTESVQNTVGSEKEETENKNEETSNYNSNLNN

SEQ ID NO: 3321627 - protein, 7 aa, Plasmodium falciparum
KKNKDIF

SEQ ID NO: 3321628 - protein, 9 aa, Plasmodium falciparum
KKNKDTITL

SEQ ID NO: 3321629 - protein, 15 aa, Plasmodium falciparum
KKNKEFDKELKDRNK

SEQ ID NO: 3321630 - protein, 10 aa, Plasmodium falciparum
KKNKEKKNEI

SEQ ID NO: 3321631 - protein, 26 aa, Plasmodium falciparum
KKNKEKQLKEKETEERRNLDQERNRD

SEQ ID NO: 3321632 - protein, 15 aa, Plasmodium falciparum
KKNKETEKKVEDKYE

SEQ ID NO: 3321633 - protein, 13 aa, Plasmodium falciparum
KKNKGKHEKDTSN

SEQ ID NO: 3321634 - protein, 8 aa, Plasmodium falciparum
KKNKGKNI

SEQ ID NO: 3321635 - protein, 11 aa, Plasmodium falciparum
KKNKGNEKIKK

SEQ ID NO: 3321636 - protein, 28 aa, Plasmodium falciparum
KKNKINNINQESRKEQEMENEKNDSDDH

SEQ ID NO: 3321637 - protein, 7 aa, Plasmodium falciparum
KKNKIPD

SEQ ID NO: 3321638 - protein, 8 aa, Plasmodium falciparum
KKNKKFSY

SEQ ID NO: 3321639 - protein, 8 aa, Plasmodium falciparum
KKNKKKDH

SEQ ID NO: 3321640 - protein, 34 aa, Plasmodium falciparum
KKNKKKIKENENKNETGKEDEQKNEDENENTNGI

SEQ ID NO: 3321641 - protein, 9 aa, Plasmodium falciparum
KKNKKNEEY

SEQ ID NO: 3321642 - protein, 22 aa, Plasmodium falciparum
KKNKKNIKKDKKKTKDTDYEDT

SEQ ID NO: 3321643 - protein, 39 aa, Plasmodium falciparum
KKNKKNKNKNAKNNNTNSNNNNNNNNNNNNNNNNNNSNI

SEQ ID NO: 3321644 - protein, 10 aa, Plasmodium falciparum
KKNKKNNKEM

SEQ ID NO: 3321645 - protein, 11 aa, Plasmodium falciparum
KKNKKRKNGLD

SEQ ID NO: 3321646 - protein, 9 aa, Plasmodium falciparum
KKNKKTVED

SEQ ID NO: 3321647 - protein, 17 aa, Plasmodium falciparum
KKNKKYASGGRGGNGGD

SEQ ID NO: 3321648 - protein, 19 aa, Plasmodium falciparum
KKNKLNSELEENYENQQKK

SEQ ID NO: 3321649 - protein, 37 aa, Plasmodium falciparum
KKNKLTNKHEPSYPKHTATGDVSSSSHAYSRNDIQTK

SEQ ID NO: 3321650 - protein, 6 aa, Plasmodium falciparum
KKNKND

SEQ ID NO: 3321651 - protein, 16 aa, Plasmodium falciparum
KKNKNDSNSKKKLKNK

SEQ ID NO: 3321652 - protein, 7 aa, Plasmodium falciparum
KKNKNHL

SEQ ID NO: 3321653 - protein, 13 aa, Plasmodium falciparum
KKNKNKKKKNNKI

SEQ ID NO: 3321654 - protein, 7 aa, Plasmodium falciparum
KKNKNNI

SEQ ID NO: 3321655 - protein, 12 aa, Plasmodium falciparum
KKNKNNMHCSGK

SEQ ID NO: 3321656 - protein, 8 aa, Plasmodium falciparum
KKNKNNNL

SEQ ID NO: 3321657 - protein, 20 aa, Plasmodium falciparum
KKNKNNNNNNHESNEENQNS

SEQ ID NO: 3321658 - protein, 20 aa, Plasmodium falciparum
KKNKNNNNNNNKSKNKNETI

SEQ ID NO: 3321659 - protein, 10 aa, Plasmodium falciparum
KKNKNNRDSH

SEQ ID NO: 3321660 - protein, 7 aa, Plasmodium falciparum
KKNKNQI

SEQ ID NO: 3321661 - protein, 6 aa, Plasmodium falciparum
KKNKQE

SEQ ID NO: 3321662 - protein, 17 aa, Plasmodium falciparum
KKNKQTKKKKNINEPPY

SEQ ID NO: 3321663 - protein, 10 aa, Plasmodium falciparum
KKNKQYSKTI

SEQ ID NO: 3321664 - protein, 6 aa, Plasmodium falciparum
KKNKRI

SEQ ID NO: 3321665 - protein, 30 aa, Plasmodium falciparum
KKNKRKKTSDITNMNKEDSNLNENINNNSY

SEQ ID NO: 3321666 - protein, 30 aa, Plasmodium falciparum
KKNKRRSYDYSSNYDESDFSSTSSYYNERN

SEQ ID NO: 3321667 - protein, 7 aa, Plasmodium falciparum
KKNKSGL

SEQ ID NO: 3321668 - protein, 10 aa, Plasmodium falciparum
KKNKSKTREK

SEQ ID NO: 3321669 - protein, 14 aa, Plasmodium falciparum
KKNKSNIRTYMYIY

SEQ ID NO: 3321670 - protein, 8 aa, Plasmodium falciparum
KKNKSNNL

SEQ ID NO: 3321671 - protein, 20 aa, Plasmodium falciparum
KKNKSNNNSNNSNNKKKKKK

SEQ ID NO: 3321672 - protein, 12 aa, Plasmodium falciparum
KKNKSNSTQCSN

SEQ ID NO: 3321673 - protein, 10 aa, Plasmodium falciparum
KKNKSNTGQD

SEQ ID NO: 3321674 - protein, 16 aa, Plasmodium falciparum
KKNKSRQSYLSNRTDD

SEQ ID NO: 3321675 - protein, 31 aa, Plasmodium falciparum
KKNKTKKYSSNSENEMSNNTSEQSSYESYDS

SEQ ID NO: 3321676 - protein, 9 aa, Plasmodium falciparum
KKNKTKSYT

SEQ ID NO: 3321677 - protein, 12 aa, Plasmodium falciparum
KKNKTNSESEIK

SEQ ID NO: 3321678 - protein, 17 aa, Plasmodium falciparum
KKNKTTKEYIKLFKLFV

SEQ ID NO: 3321679 - protein, 7 aa, Plasmodium falciparum
KKNKYDE

SEQ ID NO: 3321680 - protein, 8 aa, Plasmodium falciparum
KKNKYQDN

SEQ ID NO: 3321681 - protein, 5 aa, Plasmodium falciparum
KKNLK

SEQ ID NO: 3321682 - protein, 10 aa, Plasmodium falciparum
KKNLKESEKI

SEQ ID NO: 3321683 - protein, 11 aa, Plasmodium falciparum
KKNLKKNSEIE

SEQ ID NO: 3321684 - protein, 13 aa, Plasmodium falciparum
KKNLNQKSAYDRN

SEQ ID NO: 3321685 - protein, 17 aa, Plasmodium falciparum
KKNLQKEEKKDKGKKKT

SEQ ID NO: 3321686 - protein, 10 aa, Plasmodium falciparum
KKNLSVKSKK

SEQ ID NO: 3321687 - protein, 6 aa, Plasmodium falciparum
KKNMEK

SEQ ID NO: 3321688 - protein, 13 aa, Plasmodium falciparum
KKNMQNEINKNSD

SEQ ID NO: 3321689 - protein, 4 aa, Plasmodium falciparum
KKNN

SEQ ID NO: 3321690 - protein, 44 aa, Plasmodium falciparum
KKNNDEQTKKDKHDIHEDKYDKNEKYGEDELDTHNNKKTGMQDE

SEQ ID NO: 3321691 - protein, 10 aa, Plasmodium falciparum
KKNNEEEQTK

SEQ ID NO: 3321692 - protein, 19 aa, Plasmodium falciparum
KKNNEEGNLNNDKENINSN

SEQ ID NO: 3321693 - protein, 7 aa, Plasmodium falciparum
KKNNEEK

SEQ ID NO: 3321694 - protein, 8 aa, Plasmodium falciparum
KKNNEGQF

SEQ ID NO: 3321695 - protein, 30 aa, Plasmodium falciparum
KKNNEKDDENNNIDCNNNDNNNDNNNDNNM

SEQ ID NO: 3321696 - protein, 12 aa, Plasmodium falciparum
KKNNENEQKMDD

SEQ ID NO: 3321697 - protein, 8 aa, Plasmodium falciparum
KKNNENNN

SEQ ID NO: 3321698 - protein, 5 aa, Plasmodium falciparum
KKNNF

SEQ ID NO: 3321699 - protein, 6 aa, Plasmodium falciparum
KKNNIQ

SEQ ID NO: 3321700 - protein, 9 aa, Plasmodium falciparum
KKNNKENKK

SEQ ID NO: 3321701 - protein, 9 aa, Plasmodium falciparum
KKNNKINHS

SEQ ID NO: 3321702 - protein, 27 aa, Plasmodium falciparum
KKNNKKNSNKNNSTLIDSNEKQKRHYN

SEQ ID NO: 3321703 - protein, 13 aa, Plasmodium falciparum
KKNNKNKKYNIKD

SEQ ID NO: 3321704 - protein, 34 aa, Plasmodium falciparum
KKNNKNNKNNKNNKKFNDNYNNNHNNNNSNDFEE

SEQ ID NO: 3321705 - protein, 34 aa, Plasmodium falciparum
KKNNKSAMLNDNKSKNEMKEKKGGDNIKREETTY

SEQ ID NO: 3321706 - protein, 11 aa, Plasmodium falciparum
KKNNKSKEEKI

SEQ ID NO: 3321707 - protein, 5 aa, Plasmodium falciparum
KKNNL

SEQ ID NO: 3321708 - protein, 8 aa, Plasmodium falciparum
KKNNLKKQ

SEQ ID NO: 3321709 - protein, 7 aa, Plasmodium falciparum
KKNNMEN

SEQ ID NO: 3321710 - protein, 14 aa, Plasmodium falciparum
KKNNMFPETDENKN

SEQ ID NO: 3321711 - protein, 7 aa, Plasmodium falciparum
KKNNNDK

SEQ ID NO: 3321712 - protein, 7 aa, Plasmodium falciparum
KKNNNIA

SEQ ID NO: 3321713 - protein, 18 aa, Plasmodium falciparum
KKNNNINDAKVNEDDINK

SEQ ID NO: 3321714 - protein, 8 aa, Plasmodium falciparum
KKNNNINI

SEQ ID NO: 3321715 - protein, 19 aa, Plasmodium falciparum
KKNNNKDITSENHDDRNKE

SEQ ID NO: 3321716 - protein, 21 aa, Plasmodium falciparum
KKNNNKKDQEKKYNDNNYEEE

SEQ ID NO: 3321717 - protein, 14 aa, Plasmodium falciparum
KKNNNKSNNIHSDN

SEQ ID NO: 3321718 - protein, 15 aa, Plasmodium falciparum
KKNNNNNNNDNVHVD

SEQ ID NO: 3321719 - protein, 19 aa, Plasmodium falciparum
KKNNNNNNNNNNYDAEQKN

SEQ ID NO: 3321720 - protein, 14 aa, Plasmodium falciparum
KKNNNNNSNNSNNI

SEQ ID NO: 3321721 - protein, 8 aa, Plasmodium falciparum
KKNNNTHD

SEQ ID NO: 3321722 - protein, 10 aa, Plasmodium falciparum
KKNNNTPTVA

SEQ ID NO: 3321723 - protein, 23 aa, Plasmodium falciparum
KKNNNYVNTSTNKKPYSLEDIFE

SEQ ID NO: 3321724 - protein, 5 aa, Plasmodium falciparum
KKNNP

SEQ ID NO: 3321725 - protein, 17 aa, Plasmodium falciparum
KKNNPKEDEKGTRRRRH

SEQ ID NO: 3321726 - protein, 9 aa, Plasmodium falciparum
KKNNQRNNE

SEQ ID NO: 3321727 - protein, 6 aa, Plasmodium falciparum
KKNNSE

SEQ ID NO: 3321728 - protein, 7 aa, Plasmodium falciparum
KKNNSPI

SEQ ID NO: 3321729 - protein, 11 aa, Plasmodium falciparum
KKNNSRKGPVT

SEQ ID NO: 3321730 - protein, 26 aa, Plasmodium falciparum
KKNNSTNVKGVKRNTKTRNQQSDTND

SEQ ID NO: 3321731 - protein, 8 aa, Plasmodium falciparum
KKNNSTPD

SEQ ID NO: 3321732 - protein, 9 aa, Plasmodium falciparum
KKNNSYDNN

SEQ ID NO: 3321733 - protein, 6 aa, Plasmodium falciparum
KKNNTF

SEQ ID NO: 3321734 - protein, 10 aa, Plasmodium falciparum
KKNNTSINKN

SEQ ID NO: 3321735 - protein, 6 aa, Plasmodium falciparum
KKNNVT

SEQ ID NO: 3321736 - protein, 5 aa, Plasmodium falciparum
KKNNY

SEQ ID NO: 3321737 - protein, 16 aa, Plasmodium falciparum
KKNNYLKEEDNKEKEI

SEQ ID NO: 3321738 - protein, 13 aa, Plasmodium falciparum
KKNPAQHGNNGNN

SEQ ID NO: 3321739 - protein, 9 aa, Plasmodium falciparum
KKNPKAARI

SEQ ID NO: 3321740 - protein, 8 aa, Plasmodium falciparum
KKNPKEDM

SEQ ID NO: 3321741 - protein, 6 aa, Plasmodium falciparum
KKNPKK

SEQ ID NO: 3321742 - protein, 14 aa, Plasmodium falciparum
KKNPSNDDIPKFIW

SEQ ID NO: 3321743 - protein, 21 aa, Plasmodium falciparum
KKNPSSKNKEVDNRIKNKKDN

SEQ ID NO: 3321744 - protein, 16 aa, Plasmodium falciparum
KKNPTDDNKNIESYNK

SEQ ID NO: 3321745 - protein, 4 aa, Plasmodium falciparum
KKNQ

SEQ ID NO: 3321746 - protein, 9 aa, Plasmodium falciparum
KKNQEEKED

SEQ ID NO: 3321747 - protein, 27 aa, Plasmodium falciparum
KKNQEEKENKEEQEKKTEELKDQQNEK

SEQ ID NO: 3321748 - protein, 20 aa, Plasmodium falciparum
KKNQKIKEKKNIKVPKGLTP

SEQ ID NO: 3321749 - protein, 12 aa, Plasmodium falciparum
KKNQKNFEKNPC

SEQ ID NO: 3321750 - protein, 7 aa, Plasmodium falciparum
KKNQLEK

SEQ ID NO: 3321751 - protein, 5 aa, Plasmodium falciparum
KKNQN

SEQ ID NO: 3321752 - protein, 8 aa, Plasmodium falciparum
KKNQQQNG

SEQ ID NO: 3321753 - protein, 7 aa, Plasmodium falciparum
KKNQSIK

SEQ ID NO: 3321754 - protein, 19 aa, Plasmodium falciparum
KKNRAYTENDNDTTSCSKE

SEQ ID NO: 3321755 - protein, 10 aa, Plasmodium falciparum
KKNRKKKEHS

SEQ ID NO: 3321756 - protein, 12 aa, Plasmodium falciparum
KKNRKNKNDDIN

SEQ ID NO: 3321757 - protein, 15 aa, Plasmodium falciparum
KKNRLNEKNKQKHSS

SEQ ID NO: 3321758 - protein, 11 aa, Plasmodium falciparum
KKNRNNNNSTL

SEQ ID NO: 3321759 - protein, 6 aa, Plasmodium falciparum
KKNRPL

SEQ ID NO: 3321760 - protein, 11 aa, Plasmodium falciparum
KKNRYEKENTV

SEQ ID NO: 3321761 - protein, 6 aa, Plasmodium falciparum
KKNSDK

SEQ ID NO: 3321762 - protein, 17 aa, Plasmodium falciparum
KKNSDNSYNNEEKTNLV

SEQ ID NO: 3321763 - protein, 7 aa, Plasmodium falciparum
KKNSEHV

SEQ ID NO: 3321764 - protein, 14 aa, Plasmodium falciparum
KKNSENNSTTNESD

SEQ ID NO: 3321765 - protein, 5 aa, Plasmodium falciparum
KKNSF

SEQ ID NO: 3321766 - protein, 8 aa, Plasmodium falciparum
KKNSKANL

SEQ ID NO: 3321767 - protein, 37 aa, Plasmodium falciparum
KKNSKQHQLEQQKEQKQNEEHNEEHNEEHNEEQKEER

SEQ ID NO: 3321768 - protein, 5 aa, Plasmodium falciparum
KKNSL

SEQ ID NO: 3321769 - protein, 15 aa, Plasmodium falciparum
KKNSLKEKNKTSNDH

SEQ ID NO: 3321770 - protein, 17 aa, Plasmodium falciparum
KKNSNDKRNVNNKDNIY

SEQ ID NO: 3321771 - protein, 15 aa, Plasmodium falciparum
KKNSNIYESKRDNSV

SEQ ID NO: 3321772 - protein, 20 aa, Plasmodium falciparum
KKNSNKSSLLETKQESYLDN

SEQ ID NO: 3321773 - protein, 8 aa, Plasmodium falciparum
KKNSNLSN

SEQ ID NO: 3321774 - protein, 15 aa, Plasmodium falciparum
KKNSNMNNVDNKRNT

SEQ ID NO: 3321775 - protein, 17 aa, Plasmodium falciparum
KKNSNNKENVSSLDNEN

SEQ ID NO: 3321776 - protein, 7 aa, Plasmodium falciparum
KKNSNRN

SEQ ID NO: 3321777 - protein, 8 aa, Plasmodium falciparum
KKNSNSKY

SEQ ID NO: 3321778 - protein, 9 aa, Plasmodium falciparum
KKNSQEIID

SEQ ID NO: 3321779 - protein, 7 aa, Plasmodium falciparum
KKNSSIN

SEQ ID NO: 3321780 - protein, 7 aa, Plasmodium falciparum
KKNSTIS

SEQ ID NO: 3321781 - protein, 9 aa, Plasmodium falciparum
KKNSTVNNN

SEQ ID NO: 3321782 - protein, 35 aa, Plasmodium falciparum
KKNSYETKEVKKRGRKKKKNLNESIDETNEQQTKY

SEQ ID NO: 3321783 - protein, 46 aa, Plasmodium falciparum
KKNSYNKNNNYNNKTNNMYDTNTYNKGYKNYKNKNHKTTPTEQYKK

SEQ ID NO: 3321784 - protein, 6 aa, Plasmodium falciparum
KKNSYQ

SEQ ID NO: 3321785 - protein, 4 aa, Plasmodium falciparum
KKNT

SEQ ID NO: 3321786 - protein, 8 aa, Plasmodium falciparum
KKNTCADK

SEQ ID NO: 3321787 - protein, 6 aa, Plasmodium falciparum
KKNTDF

SEQ ID NO: 3321788 - protein, 13 aa, Plasmodium falciparum
KKNTDNKKSSSSL

SEQ ID NO: 3321789 - protein, 8 aa, Plasmodium falciparum
KKNTEQKK

SEQ ID NO: 3321790 - protein, 16 aa, Plasmodium falciparum
KKNTHQEVNTSQRSLS

SEQ ID NO: 3321791 - protein, 10 aa, Plasmodium falciparum
KKNTKIKKKS

SEQ ID NO: 3321792 - protein, 36 aa, Plasmodium falciparum
KKNTNKKTTTSSNNVNNSKKRLRKADDLNSNELDNT

SEQ ID NO: 3321793 - protein, 6 aa, Plasmodium falciparum
KKNTNL

SEQ ID NO: 3321794 - protein, 7 aa, Plasmodium falciparum
KKNTNNH

SEQ ID NO: 3321795 - protein, 7 aa, Plasmodium falciparum
KKNTNVK

SEQ ID NO: 3321796 - protein, 8 aa, Plasmodium falciparum
KKNTPSII

SEQ ID NO: 3321797 - protein, 10 aa, Plasmodium falciparum
KKNTQGGGNI

SEQ ID NO: 3321798 - protein, 6 aa, Plasmodium falciparum
KKNTTF

SEQ ID NO: 3321799 - protein, 7 aa, Plasmodium falciparum
KKNTTNK

SEQ ID NO: 3321800 - protein, 8 aa, Plasmodium falciparum
KKNTTYTK

SEQ ID NO: 3321801 - protein, 10 aa, Plasmodium falciparum
KKNVDDSEIP

SEQ ID NO: 3321802 - protein, 7 aa, Plasmodium falciparum
KKNVDSI

SEQ ID NO: 3321803 - protein, 10 aa, Plasmodium falciparum
KKNVDTSGVS

SEQ ID NO: 3321804 - protein, 10 aa, Plasmodium falciparum
KKNVEEYKKN

SEQ ID NO: 3321805 - protein, 8 aa, Plasmodium falciparum
KKNVESGN

SEQ ID NO: 3321806 - protein, 14 aa, Plasmodium falciparum
KKNVKRTLENNTNH

SEQ ID NO: 3321807 - protein, 75 aa, Plasmodium falciparum
KKNVKSGKGSVSSSNKKLPKGLKNAAKKAGKKIDKKKEQANKKNNNNKNKNKNKNLSKGNNMKHNKKPAKKVVKK

SEQ ID NO: 3321808 - protein, 23 aa, Plasmodium falciparum
KKNVNGEGNNLDKKQKKYDNEYK

SEQ ID NO: 3321809 - protein, 53 aa, Plasmodium falciparum
KKNVSSKNLYEAQKKNNTSDVTNTKIEGVEKDKKEKESYEEKNDKMNTTSEEN

SEQ ID NO: 3321810 - protein, 13 aa, Plasmodium falciparum
KKNVTENNSSCNY

SEQ ID NO: 3321811 - protein, 4 aa, Plasmodium falciparum
KKNY

SEQ ID NO: 3321812 - protein, 5 aa, Plasmodium falciparum
KKNYA

SEQ ID NO: 3321813 - protein, 5 aa, Plasmodium falciparum
KKNYE

SEQ ID NO: 3321814 - protein, 12 aa, Plasmodium falciparum
KKNYENKHEINS

SEQ ID NO: 3321815 - protein, 51 aa, Plasmodium falciparum
KKNYHNYESDEETNKDESNNNNNNNNNNNNNNNKDSSSENLNKTHEQREKS

SEQ ID NO: 3321816 - protein, 5 aa, Plasmodium falciparum
KKNYI

SEQ ID NO: 3321817 - protein, 8 aa, Plasmodium falciparum
KKNYKDEL

SEQ ID NO: 3321818 - protein, 11 aa, Plasmodium falciparum
KKNYKKDGDDI

SEQ ID NO: 3321819 - protein, 24 aa, Plasmodium falciparum
KKNYMNNTNDKNINLNNSESYEEI

SEQ ID NO: 3321820 - protein, 12 aa, Plasmodium falciparum
KKNYNRKERGEI

SEQ ID NO: 3321821 - protein, 15 aa, Plasmodium falciparum
KKNYNRSKQLNKSYK

SEQ ID NO: 3321822 - protein, 11 aa, Plasmodium falciparum
KKNYNSSTRNN

SEQ ID NO: 3321823 - protein, 5 aa, Plasmodium falciparum
KKNYP

SEQ ID NO: 3321824 - protein, 31 aa, Plasmodium falciparum
KKNYPSNNNNNNNNNIYSSSNNNNNSSSHTL

SEQ ID NO: 3321825 - protein, 8 aa, Plasmodium falciparum
KKNYPTRN

SEQ ID NO: 3321826 - protein, 5 aa, Plasmodium falciparum
KKNYR

SEQ ID NO: 3321827 - protein, 13 aa, Plasmodium falciparum
KKNYSKSLSSENY

SEQ ID NO: 3321828 - protein, 7 aa, Plasmodium falciparum
KKNYTDE

SEQ ID NO: 3321829 - protein, 15 aa, Plasmodium falciparum
KKNYYDEEKKREEYN

SEQ ID NO: 3321830 - protein, 6 aa, Plasmodium falciparum
KKNYYR

SEQ ID NO: 3321831 - protein, 7 aa, Plasmodium falciparum
KKNYYTK

SEQ ID NO: 3321832 - protein, 23 aa, Plasmodium falciparum
KKPAKEILSNNNKKELNKNSNDL

SEQ ID NO: 3321833 - protein, 6 aa, Plasmodium falciparum
KKPCGI

SEQ ID NO: 3321834 - protein, 14 aa, Plasmodium falciparum
KKPCKKRLQNKNSL

SEQ ID NO: 3321835 - protein, 10 aa, Plasmodium falciparum
KKPCNESKEV

SEQ ID NO: 3321836 - protein, 56 aa, Plasmodium falciparum
KKPDEKVCSSNTDSQKKSDGTDDKSKKDGQGTDKTKGTNSDSKSKNNDDNKSNVQK

SEQ ID NO: 3321837 - protein, 9 aa, Plasmodium falciparum
KKPEAPLAR

SEQ ID NO: 3321838 - protein, 15 aa, Plasmodium falciparum
KKPEETNDKRENMTT

SEQ ID NO: 3321839 - protein, 6 aa, Plasmodium falciparum
KKPEGL

SEQ ID NO: 3321840 - protein, 9 aa, Plasmodium falciparum
KKPENRGNV

SEQ ID NO: 3321841 - protein, 14 aa, Plasmodium falciparum
KKPESYKTGEGHYQ

SEQ ID NO: 3321842 - protein, 10 aa, Plasmodium falciparum
KKPGRANTLK

SEQ ID NO: 3321843 - protein, 44 aa, Plasmodium falciparum
KKPHYAKKGEDDDDDDDDDDEDEEEDEEAGDRNQLEEQEKGERE

SEQ ID NO: 3321844 - protein, 28 aa, Plasmodium falciparum
KKPINNKGSDDKKKKENSNKGGGNHKND

SEQ ID NO: 3321845 - protein, 7 aa, Plasmodium falciparum
KKPINTT

SEQ ID NO: 3321846 - protein, 13 aa, Plasmodium falciparum
KKPKKIQWHDTLR

SEQ ID NO: 3321847 - protein, 14 aa, Plasmodium falciparum
KKPLTGPSNTLSKN

SEQ ID NO: 3321848 - protein, 10 aa, Plasmodium falciparum
KKPMKSTGKL

SEQ ID NO: 3321849 - protein, 6 aa, Plasmodium falciparum
KKPMNN

SEQ ID NO: 3321850 - protein, 7 aa, Plasmodium falciparum
KKPNDIY

SEQ ID NO: 3321851 - protein, 6 aa, Plasmodium falciparum
KKPNEL

SEQ ID NO: 3321852 - protein, 6 aa, Plasmodium falciparum
KKPNNF

SEQ ID NO: 3321853 - protein, 6 aa, Plasmodium falciparum
KKPNNK

SEQ ID NO: 3321854 - protein, 14 aa, Plasmodium falciparum
KKPNSKEEEEINQP

SEQ ID NO: 3321855 - protein, 7 aa, Plasmodium falciparum
KKPNVNR

SEQ ID NO: 3321856 - protein, 5 aa, Plasmodium falciparum
KKPPN

SEQ ID NO: 3321857 - protein, 6 aa, Plasmodium falciparum
KKPPVD

SEQ ID NO: 3321858 - protein, 5 aa, Plasmodium falciparum
KKPQK

SEQ ID NO: 3321859 - protein, 19 aa, Plasmodium falciparum
KKPRKKYERVKPRKSKNAM

SEQ ID NO: 3321860 - protein, 5 aa, Plasmodium falciparum
KKPRY

SEQ ID NO: 3321861 - protein, 8 aa, Plasmodium falciparum
KKPSGTIK

SEQ ID NO: 3321862 - protein, 6 aa, Plasmodium falciparum
KKPSRY

SEQ ID NO: 3321863 - protein, 6 aa, Plasmodium falciparum
KKPTKI

SEQ ID NO: 3321864 - protein, 6 aa, Plasmodium falciparum
KKPTKT

SEQ ID NO: 3321865 - protein, 4 aa, Plasmodium falciparum
KKPV

SEQ ID NO: 3321866 - protein, 12 aa, Plasmodium falciparum
KKPYDERPKSKN

SEQ ID NO: 3321867 - protein, 6 aa, Plasmodium falciparum
KKPYRA

SEQ ID NO: 3321868 - protein, 7 aa, Plasmodium falciparum
KKPYYYS

SEQ ID NO: 3321869 - protein, 37 aa, Plasmodium falciparum
KKQATKNDDNLSIQPRGKKINVDDDNDKNETKKKNKC

SEQ ID NO: 3321870 - protein, 18 aa, Plasmodium falciparum
KKQDNEQKDKIEKKTFKI

SEQ ID NO: 3321871 - protein, 7 aa, Plasmodium falciparum
KKQEALE

SEQ ID NO: 3321872 - protein, 9 aa, Plasmodium falciparum
KKQEEEEKR

SEQ ID NO: 3321873 - protein, 7 aa, Plasmodium falciparum
KKQEEKP

SEQ ID NO: 3321874 - protein, 7 aa, Plasmodium falciparum
KKQEERE

SEQ ID NO: 3321875 - protein, 6 aa, Plasmodium falciparum
KKQEKE

SEQ ID NO: 3321876 - protein, 16 aa, Plasmodium falciparum
KKQEKELANEKQGTVL

SEQ ID NO: 3321877 - protein, 8 aa, Plasmodium falciparum
KKQEKTKI

SEQ ID NO: 3321878 - protein, 7 aa, Plasmodium falciparum
KKQEKTV

SEQ ID NO: 3321879 - protein, 5 aa, Plasmodium falciparum
KKQEN

SEQ ID NO: 3321880 - protein, 8 aa, Plasmodium falciparum
KKQENEEH

SEQ ID NO: 3321881 - protein, 26 aa, Plasmodium falciparum
KKQEQKNSENIKEEDIPTEDMDKKEL

SEQ ID NO: 3321882 - protein, 9 aa, Plasmodium falciparum
KKQEQRNYN

SEQ ID NO: 3321883 - protein, 7 aa, Plasmodium falciparum
KKQESQK

SEQ ID NO: 3321884 - protein, 15 aa, Plasmodium falciparum
KKQFEDDKLNEEETA

SEQ ID NO: 3321885 - protein, 8 aa, Plasmodium falciparum
KKQFKKKK

SEQ ID NO: 3321886 - protein, 7 aa, Plasmodium falciparum
KKQFNGH

SEQ ID NO: 3321887 - protein, 11 aa, Plasmodium falciparum
KKQGIDEKVDR

SEQ ID NO: 3321888 - protein, 8 aa, Plasmodium falciparum
KKQGYEDS

SEQ ID NO: 3321889 - protein, 13 aa, Plasmodium falciparum
KKQHNKNSREVKT

SEQ ID NO: 3321890 - protein, 18 aa, Plasmodium falciparum
KKQHYSNNNNINKNDNTN

SEQ ID NO: 3321891 - protein, 13 aa, Plasmodium falciparum
KKQIYSNTIGKDK

SEQ ID NO: 3321892 - protein, 7 aa, Plasmodium falciparum
KKQKDNI

SEQ ID NO: 3321893 - protein, 20 aa, Plasmodium falciparum
KKQKEEELKKKKQKEKEKNR

SEQ ID NO: 3321894 - protein, 15 aa, Plasmodium falciparum
KKQKEKETNDLSSTD

SEQ ID NO: 3321895 - protein, 8 aa, Plasmodium falciparum
KKQKGGAG

SEQ ID NO: 3321896 - protein, 12 aa, Plasmodium falciparum
KKQKHDDEKDEG

SEQ ID NO: 3321897 - protein, 9 aa, Plasmodium falciparum
KKQKHKKEL

SEQ ID NO: 3321898 - protein, 12 aa, Plasmodium falciparum
KKQKINKENKKK

SEQ ID NO: 3321899 - protein, 19 aa, Plasmodium falciparum
KKQKKEKKKNKDDDNEENI

SEQ ID NO: 3321900 - protein, 13 aa, Plasmodium falciparum
KKQKKKKKKKRKI

SEQ ID NO: 3321901 - protein, 7 aa, Plasmodium falciparum
KKQKNNI

SEQ ID NO: 3321902 - protein, 59 aa, Plasmodium falciparum
KKQKNTTDNDDKNNNNNNENDSNNEEKDNITGDHNKNGEDENKVGSHNAYDNDQNNGYV

SEQ ID NO: 3321903 - protein, 14 aa, Plasmodium falciparum
KKQKNVQKTEQNNL

SEQ ID NO: 3321904 - protein, 11 aa, Plasmodium falciparum
KKQKPDTQEEF

SEQ ID NO: 3321905 - protein, 12 aa, Plasmodium falciparum
KKQKQKKNKKNV

SEQ ID NO: 3321906 - protein, 11 aa, Plasmodium falciparum
KKQKSQKKGNS

SEQ ID NO: 3321907 - protein, 18 aa, Plasmodium falciparum
KKQKTDNAVLSKKKKSKM

SEQ ID NO: 3321908 - protein, 6 aa, Plasmodium falciparum
KKQKTK

SEQ ID NO: 3321909 - protein, 7 aa, Plasmodium falciparum
KKQKYNE

SEQ ID NO: 3321910 - protein, 9 aa, Plasmodium falciparum
KKQLEERSS

SEQ ID NO: 3321911 - protein, 7 aa, Plasmodium falciparum
KKQLKYN

SEQ ID NO: 3321912 - protein, 7 aa, Plasmodium falciparum
KKQLTQA

SEQ ID NO: 3321913 - protein, 17 aa, Plasmodium falciparum
KKQMEKKTNTKSSYSSD

SEQ ID NO: 3321914 - protein, 8 aa, Plasmodium falciparum
KKQMNNNN

SEQ ID NO: 3321915 - protein, 7 aa, Plasmodium falciparum
KKQNCPD

SEQ ID NO: 3321916 - protein, 8 aa, Plasmodium falciparum
KKQNDSYR

SEQ ID NO: 3321917 - protein, 8 aa, Plasmodium falciparum
KKQNEELK

SEQ ID NO: 3321918 - protein, 7 aa, Plasmodium falciparum
KKQNESF

SEQ ID NO: 3321919 - protein, 6 aa, Plasmodium falciparum
KKQNFS

SEQ ID NO: 3321920 - protein, 7 aa, Plasmodium falciparum
KKQNHEY

SEQ ID NO: 3321921 - protein, 39 aa, Plasmodium falciparum
KKQNKTEDVEKDPYEDAKKNLKDMQEDEERRIQKRKEKK

SEQ ID NO: 3321922 - protein, 10 aa, Plasmodium falciparum
KKQNMNTTNN

SEQ ID NO: 3321923 - protein, 8 aa, Plasmodium falciparum
KKQNNLSK

SEQ ID NO: 3321924 - protein, 7 aa, Plasmodium falciparum
KKQNPLK

SEQ ID NO: 3321925 - protein, 7 aa, Plasmodium falciparum
KKQNVSN

SEQ ID NO: 3321926 - protein, 21 aa, Plasmodium falciparum
KKQPINNEEDINKNNNNNDNM

SEQ ID NO: 3321927 - protein, 17 aa, Plasmodium falciparum
KKQPNYIGTDNGENNIN

SEQ ID NO: 3321928 - protein, 6 aa, Plasmodium falciparum
KKQPPI

SEQ ID NO: 3321929 - protein, 8 aa, Plasmodium falciparum
KKQPTISP

SEQ ID NO: 3321930 - protein, 10 aa, Plasmodium falciparum
KKQQGEAKTS

SEQ ID NO: 3321931 - protein, 8 aa, Plasmodium falciparum
KKQQKDHD

SEQ ID NO: 3321932 - protein, 72 aa, Plasmodium falciparum
KKQQQQQQQQQQQQQQQQQQQQQQQQQQQQQQQQQQQQQQQQQQQQQQQQQQQQQQQQQQQQQQQQQQHNNN

SEQ ID NO: 3321933 - protein, 51 aa, Plasmodium falciparum
KKQRKRKRTRRKANDKPGNGQNNQDGQNDQDGQDGQDGQNNQDGQNNQDIK

SEQ ID NO: 3321934 - protein, 8 aa, Plasmodium falciparum
KKQSGRTV

SEQ ID NO: 3321935 - protein, 16 aa, Plasmodium falciparum
KKQSNDLKDKKLKTKR

SEQ ID NO: 3321936 - protein, 10 aa, Plasmodium falciparum
KKQSREKRKN

SEQ ID NO: 3321937 - protein, 7 aa, Plasmodium falciparum
KKQSSHL

SEQ ID NO: 3321938 - protein, 8 aa, Plasmodium falciparum
KKQSSNKT

SEQ ID NO: 3321939 - protein, 7 aa, Plasmodium falciparum
KKQSTDI

SEQ ID NO: 3321940 - protein, 5 aa, Plasmodium falciparum
KKQTL

SEQ ID NO: 3321941 - protein, 4 aa, Plasmodium falciparum
KKQV

SEQ ID NO: 3321942 - protein, 7 aa, Plasmodium falciparum
KKQVSFS

SEQ ID NO: 3321943 - protein, 6 aa, Plasmodium falciparum
KKQVTK

SEQ ID NO: 3321944 - protein, 8 aa, Plasmodium falciparum
KKRDEYEN

SEQ ID NO: 3321945 - protein, 8 aa, Plasmodium falciparum
KKRDKARL

SEQ ID NO: 3321946 - protein, 12 aa, Plasmodium falciparum
KKRDLPKNTYSK

SEQ ID NO: 3321947 - protein, 4 aa, Plasmodium falciparum
KKRE

SEQ ID NO: 3321948 - protein, 12 aa, Plasmodium falciparum
KKREDANKYTNN

SEQ ID NO: 3321949 - protein, 7 aa, Plasmodium falciparum
KKREELY

SEQ ID NO: 3321950 - protein, 6 aa, Plasmodium falciparum
KKREEQ

SEQ ID NO: 3321951 - protein, 13 aa, Plasmodium falciparum
KKREKIKNNEEEK

SEQ ID NO: 3321952 - protein, 15 aa, Plasmodium falciparum
KKREKRELQQKDSLK

SEQ ID NO: 3321953 - protein, 7 aa, Plasmodium falciparum
KKRENIK

SEQ ID NO: 3321954 - protein, 18 aa, Plasmodium falciparum
KKREQERKMERQQKRESL

SEQ ID NO: 3321955 - protein, 5 aa, Plasmodium falciparum
KKREY

SEQ ID NO: 3321956 - protein, 8 aa, Plasmodium falciparum
KKRFNNAD

SEQ ID NO: 3321957 - protein, 7 aa, Plasmodium falciparum
KKRGISE

SEQ ID NO: 3321958 - protein, 9 aa, Plasmodium falciparum
KKRGRGEQK

SEQ ID NO: 3321959 - protein, 26 aa, Plasmodium falciparum
KKRGRGRKRKRKNPLPNEKQTEGDNN

SEQ ID NO: 3321960 - protein, 10 aa, Plasmodium falciparum
KKRGRKKGSK

SEQ ID NO: 3321961 - protein, 105 aa, Plasmodium falciparum
KKRGSDLYNNSKKESANDYTNDNQMNNNTKNNNQLNNNIKNNNKLNNTTKNNNQSNNNTKNNTTKNNNQINKNYNKNTKLNEQVEQREKNANLSLKNNEEKQVEN

SEQ ID NO: 3321962 - protein, 7 aa, Plasmodium falciparum
KKRGVDK

SEQ ID NO: 3321963 - protein, 7 aa, Plasmodium falciparum
KKRIKSK

SEQ ID NO: 3321964 - protein, 7 aa, Plasmodium falciparum
KKRIQNS

SEQ ID NO: 3321965 - protein, 11 aa, Plasmodium falciparum
KKRIRKVSPYG

SEQ ID NO: 3321966 - protein, 5 aa, Plasmodium falciparum
KKRIY

SEQ ID NO: 3321967 - protein, 4 aa, Plasmodium falciparum
KKRK

SEQ ID NO: 3321968 - protein, 9 aa, Plasmodium falciparum
KKRKATEVT

SEQ ID NO: 3321969 - protein, 30 aa, Plasmodium falciparum
KKRKEKNKIQHSKNPEQLPIPEKKKIFVTE

SEQ ID NO: 3321970 - protein, 7 aa, Plasmodium falciparum
KKRKELE

SEQ ID NO: 3321971 - protein, 6 aa, Plasmodium falciparum
KKRKEN

SEQ ID NO: 3321972 - protein, 25 aa, Plasmodium falciparum
KKRKENREHNKNVDERSYKNADYNN

SEQ ID NO: 3321973 - protein, 9 aa, Plasmodium falciparum
KKRKGRCKD

SEQ ID NO: 3321974 - protein, 7 aa, Plasmodium falciparum
KKRKIDK

SEQ ID NO: 3321975 - protein, 19 aa, Plasmodium falciparum
KKRKKKISKEQNKNQHETF

SEQ ID NO: 3321976 - protein, 27 aa, Plasmodium falciparum
KKRKKKQNKLAGNKIKNNGKNEEVKQS

SEQ ID NO: 3321977 - protein, 9 aa, Plasmodium falciparum
KKRKKKRFN

SEQ ID NO: 3321978 - protein, 99 aa, Plasmodium falciparum
KKRKKKRNEKIKASDDKESDDKESDDKESDDKESDDNESDDKESEDNESYDKERDDNESDDNESDDNESDDNESDDNESDDNEKDDNENHEEDKSDSEL

SEQ ID NO: 3321979 - protein, 7 aa, Plasmodium falciparum
KKRKKMN

SEQ ID NO: 3321980 - protein, 23 aa, Plasmodium falciparum
KKRKKNKQHLTNGMKDTSKKKQK

SEQ ID NO: 3321981 - protein, 15 aa, Plasmodium falciparum
KKRKKNTELESNDKN

SEQ ID NO: 3321982 - protein, 9 aa, Plasmodium falciparum
KKRKKRDRK

SEQ ID NO: 3321983 - protein, 7 aa, Plasmodium falciparum
KKRKKRV

SEQ ID NO: 3321984 - protein, 7 aa, Plasmodium falciparum
KKRKNAK

SEQ ID NO: 3321985 - protein, 6 aa, Plasmodium falciparum
KKRKNC

SEQ ID NO: 3321986 - protein, 7 aa, Plasmodium falciparum
KKRKNMQ

SEQ ID NO: 3321987 - protein, 12 aa, Plasmodium falciparum
KKRKNSSTHGHI

SEQ ID NO: 3321988 - protein, 44 aa, Plasmodium falciparum
KKRKQKEKKKIKEKEKEKEKEKEKVKKKDKDKEKEKEKEKEKEI

SEQ ID NO: 3321989 - protein, 6 aa, Plasmodium falciparum
KKRKRD

SEQ ID NO: 3321990 - protein, 9 aa, Plasmodium falciparum
KKRKRKKKR

SEQ ID NO: 3321991 - protein, 14 aa, Plasmodium falciparum
KKRKRRDNHYTDDN

SEQ ID NO: 3321992 - protein, 7 aa, Plasmodium falciparum
KKRKRRK

SEQ ID NO: 3321993 - protein, 8 aa, Plasmodium falciparum
KKRKRRKY

SEQ ID NO: 3321994 - protein, 18 aa, Plasmodium falciparum
KKRKSELKYNENNKEKYN

SEQ ID NO: 3321995 - protein, 8 aa, Plasmodium falciparum
KKRKSFEQ

SEQ ID NO: 3321996 - protein, 90 aa, Plasmodium falciparum
KKRKTKKKKYIQNGRAGNNVEDNVDDNVEDNVGNNVDDNVEDNVGNNVDDNVDNNVDDNVKNRLSPKNNEKSNPRHKKKNTSKSPICDGR

SEQ ID NO: 3321997 - protein, 6 aa, Plasmodium falciparum
KKRKVK

SEQ ID NO: 3321998 - protein, 12 aa, Plasmodium falciparum
KKRLTGRAKKRQ

SEQ ID NO: 3321999 - protein, 6 aa, Plasmodium falciparum
KKRNDK

SEQ ID NO: 3322000 - protein, 9 aa, Plasmodium falciparum
KKRNDKNKE

SEQ ID NO: 3322001 - protein, 8 aa, Plasmodium falciparum
KKRNDLRQ

SEQ ID NO: 3322002 - protein, 10 aa, Plasmodium falciparum
KKRNDNTNMK

SEQ ID NO: 3322003 - protein, 10 aa, Plasmodium falciparum
KKRNDQLKTN

SEQ ID NO: 3322004 - protein, 15 aa, Plasmodium falciparum
KKRNHINKKNNDISY

SEQ ID NO: 3322005 - protein, 19 aa, Plasmodium falciparum
KKRNKKKFNCNNDNQINHD

SEQ ID NO: 3322006 - protein, 12 aa, Plasmodium falciparum
KKRNNSNNSSNN

SEQ ID NO: 3322007 - protein, 7 aa, Plasmodium falciparum
KKRNRDC

SEQ ID NO: 3322008 - protein, 15 aa, Plasmodium falciparum
KKRNRTKSKENNKCT

SEQ ID NO: 3322009 - protein, 7 aa, Plasmodium falciparum
KKRNSYD

SEQ ID NO: 3322010 - protein, 8 aa, Plasmodium falciparum
KKRNTRNS

SEQ ID NO: 3322011 - protein, 6 aa, Plasmodium falciparum
KKRNVS

SEQ ID NO: 3322012 - protein, 5 aa, Plasmodium falciparum
KKRPV

SEQ ID NO: 3322013 - protein, 12 aa, Plasmodium falciparum
KKRRCASEENKP

SEQ ID NO: 3322014 - protein, 6 aa, Plasmodium falciparum
KKRRKS

SEQ ID NO: 3322015 - protein, 13 aa, Plasmodium falciparum
KKRRNKLNEENEE

SEQ ID NO: 3322016 - protein, 6 aa, Plasmodium falciparum
KKRRQR

SEQ ID NO: 3322017 - protein, 4 aa, Plasmodium falciparum
KKRS

SEQ ID NO: 3322018 - protein, 10 aa, Plasmodium falciparum
KKRSEDDNSF

SEQ ID NO: 3322019 - protein, 7 aa, Plasmodium falciparum
KKRSEDK

SEQ ID NO: 3322020 - protein, 12 aa, Plasmodium falciparum
KKRSETDEKNNY

SEQ ID NO: 3322021 - protein, 26 aa, Plasmodium falciparum
KKRSFNKNDNKNVDGVNNNNYNNSPV

SEQ ID NO: 3322022 - protein, 11 aa, Plasmodium falciparum
KKRSGNSEKDQ

SEQ ID NO: 3322023 - protein, 5 aa, Plasmodium falciparum
KKRSN

SEQ ID NO: 3322024 - protein, 11 aa, Plasmodium falciparum
KKRTKLNDSSY

SEQ ID NO: 3322025 - protein, 11 aa, Plasmodium falciparum
KKRTLDTQQTE

SEQ ID NO: 3322026 - protein, 16 aa, Plasmodium falciparum
KKRTMNGTKDPIHKTP

SEQ ID NO: 3322027 - protein, 13 aa, Plasmodium falciparum
KKRTNKKDNIEDP

SEQ ID NO: 3322028 - protein, 6 aa, Plasmodium falciparum
KKRVDN

SEQ ID NO: 3322029 - protein, 6 aa, Plasmodium falciparum
KKRVKD

SEQ ID NO: 3322030 - protein, 7 aa, Plasmodium falciparum
KKSAFQG

SEQ ID NO: 3322031 - protein, 8 aa, Plasmodium falciparum
KKSAKPLV

SEQ ID NO: 3322032 - protein, 8 aa, Plasmodium falciparum
KKSANSIN

SEQ ID NO: 3322033 - protein, 7 aa, Plasmodium falciparum
KKSCQNE

SEQ ID NO: 3322034 - protein, 9 aa, Plasmodium falciparum
KKSDDRNNS

SEQ ID NO: 3322035 - protein, 16 aa, Plasmodium falciparum
KKSDENIKRRKSSHKY

SEQ ID NO: 3322036 - protein, 11 aa, Plasmodium falciparum
KKSDIDGTKVE

SEQ ID NO: 3322037 - protein, 10 aa, Plasmodium falciparum
KKSDKLKDHS

SEQ ID NO: 3322038 - protein, 5 aa, Plasmodium falciparum
KKSDN

SEQ ID NO: 3322039 - protein, 8 aa, Plasmodium falciparum
KKSDNIND

SEQ ID NO: 3322040 - protein, 33 aa, Plasmodium falciparum
KKSDSTYDNSLDKESSNEKKLSIDKGQYSNMDS

SEQ ID NO: 3322041 - protein, 4 aa, Plasmodium falciparum
KKSE

SEQ ID NO: 3322042 - protein, 8 aa, Plasmodium falciparum
KKSEEGRK

SEQ ID NO: 3322043 - protein, 8 aa, Plasmodium falciparum
KKSEENFE

SEQ ID NO: 3322044 - protein, 12 aa, Plasmodium falciparum
KKSEETNKQEKK

SEQ ID NO: 3322045 - protein, 5 aa, Plasmodium falciparum
KKSEH

SEQ ID NO: 3322046 - protein, 6 aa, Plasmodium falciparum
KKSEIS

SEQ ID NO: 3322047 - protein, 16 aa, Plasmodium falciparum
KKSEKGNNKDEEEETY

SEQ ID NO: 3322048 - protein, 10 aa, Plasmodium falciparum
KKSEKRKNKR

SEQ ID NO: 3322049 - protein, 8 aa, Plasmodium falciparum
KKSEKTSL

SEQ ID NO: 3322050 - protein, 7 aa, Plasmodium falciparum
KKSEREH

SEQ ID NO: 3322051 - protein, 7 aa, Plasmodium falciparum
KKSFEGA

SEQ ID NO: 3322052 - protein, 4 aa, Plasmodium falciparum
KKSG

SEQ ID NO: 3322053 - protein, 12 aa, Plasmodium falciparum
KKSGKQFSPPYQ

SEQ ID NO: 3322054 - protein, 5 aa, Plasmodium falciparum
KKSGL

SEQ ID NO: 3322055 - protein, 7 aa, Plasmodium falciparum
KKSGNGF

SEQ ID NO: 3322056 - protein, 19 aa, Plasmodium falciparum
KKSGNNKNNIDDLKSGKKN

SEQ ID NO: 3322057 - protein, 12 aa, Plasmodium falciparum
KKSHEQKDEQQR

SEQ ID NO: 3322058 - protein, 24 aa, Plasmodium falciparum
KKSHKKNKKKKKLKMKNKRNVKKR

SEQ ID NO: 3322059 - protein, 12 aa, Plasmodium falciparum
KKSHSLNNDKRD

SEQ ID NO: 3322060 - protein, 12 aa, Plasmodium falciparum
KKSIARNISEKN

SEQ ID NO: 3322061 - protein, 7 aa, Plasmodium falciparum
KKSIKEN

SEQ ID NO: 3322062 - protein, 38 aa, Plasmodium falciparum
KKSININNNDNNNNDDNNDNNNDNNNDNNNDNNNDNNN

SEQ ID NO: 3322063 - protein, 7 aa, Plasmodium falciparum
KKSISEV

SEQ ID NO: 3322064 - protein, 6 aa, Plasmodium falciparum
KKSITS

SEQ ID NO: 3322065 - protein, 8 aa, Plasmodium falciparum
KKSKDKQN

SEQ ID NO: 3322066 - protein, 7 aa, Plasmodium falciparum
KKSKDTK

SEQ ID NO: 3322067 - protein, 26 aa, Plasmodium falciparum
KKSKEKYKENLKTKNKKKVMEKIKNY

SEQ ID NO: 3322068 - protein, 7 aa, Plasmodium falciparum
KKSKGFI

SEQ ID NO: 3322069 - protein, 7 aa, Plasmodium falciparum
KKSKHKY

SEQ ID NO: 3322070 - protein, 18 aa, Plasmodium falciparum
KKSKKKKKTKNVKSKKWG

SEQ ID NO: 3322071 - protein, 12 aa, Plasmodium falciparum
KKSKKKKTKPKF

SEQ ID NO: 3322072 - protein, 13 aa, Plasmodium falciparum
KKSKLEPPPPSER

SEQ ID NO: 3322073 - protein, 16 aa, Plasmodium falciparum
KKSKNQYSNYPINEPE

SEQ ID NO: 3322074 - protein, 10 aa, Plasmodium falciparum
KKSKQKNNQL

SEQ ID NO: 3322075 - protein, 29 aa, Plasmodium falciparum
KKSKRGRRTGGASKNYKKELGEQKKKDGM

SEQ ID NO: 3322076 - protein, 14 aa, Plasmodium falciparum
KKSKRSTVKPIFWD

SEQ ID NO: 3322077 - protein, 10 aa, Plasmodium falciparum
KKSKTKNGNS

SEQ ID NO: 3322078 - protein, 9 aa, Plasmodium falciparum
KKSKTLNKL

SEQ ID NO: 3322079 - protein, 5 aa, Plasmodium falciparum
KKSKV

SEQ ID NO: 3322080 - protein, 8 aa, Plasmodium falciparum
KKSKYEIT

SEQ ID NO: 3322081 - protein, 16 aa, Plasmodium falciparum
KKSKYKSGNKERAEEM

SEQ ID NO: 3322082 - protein, 4 aa, Plasmodium falciparum
KKSL

SEQ ID NO: 3322083 - protein, 7 aa, Plasmodium falciparum
KKSLGEM

SEQ ID NO: 3322084 - protein, 39 aa, Plasmodium falciparum
KKSLKNEVKKNGHKYKDTTNPYISSTTDSSTSNESNYNI

SEQ ID NO: 3322085 - protein, 5 aa, Plasmodium falciparum
KKSLN

SEQ ID NO: 3322086 - protein, 7 aa, Plasmodium falciparum
KKSLNEE

SEQ ID NO: 3322087 - protein, 15 aa, Plasmodium falciparum
KKSMNEKINGLSEYC

SEQ ID NO: 3322088 - protein, 7 aa, Plasmodium falciparum
KKSMSGV

SEQ ID NO: 3322089 - protein, 13 aa, Plasmodium falciparum
KKSNDLKSVPYDD

SEQ ID NO: 3322090 - protein, 10 aa, Plasmodium falciparum
KKSNEHTKRK

SEQ ID NO: 3322091 - protein, 13 aa, Plasmodium falciparum
KKSNKHGKSKEVD

SEQ ID NO: 3322092 - protein, 6 aa, Plasmodium falciparum
KKSNKK

SEQ ID NO: 3322093 - protein, 6 aa, Plasmodium falciparum
KKSNKM

SEQ ID NO: 3322094 - protein, 13 aa, Plasmodium falciparum
KKSNLDEFYKTLS

SEQ ID NO: 3322095 - protein, 8 aa, Plasmodium falciparum
KKSNNMEE

SEQ ID NO: 3322096 - protein, 11 aa, Plasmodium falciparum
KKSNNNNNNNK

SEQ ID NO: 3322097 - protein, 7 aa, Plasmodium falciparum
KKSNNQD

SEQ ID NO: 3322098 - protein, 10 aa, Plasmodium falciparum
KKSNRNDEEE

SEQ ID NO: 3322099 - protein, 9 aa, Plasmodium falciparum
KKSNSGNYN

SEQ ID NO: 3322100 - protein, 5 aa, Plasmodium falciparum
KKSNV

SEQ ID NO: 3322101 - protein, 7 aa, Plasmodium falciparum
KKSPNEI

SEQ ID NO: 3322102 - protein, 24 aa, Plasmodium falciparum
KKSPNEQKETKEVKNEVKSGQHSS

SEQ ID NO: 3322103 - protein, 7 aa, Plasmodium falciparum
KKSPSLN

SEQ ID NO: 3322104 - protein, 16 aa, Plasmodium falciparum
KKSQDNVTVVLIKFLH

SEQ ID NO: 3322105 - protein, 5 aa, Plasmodium falciparum
KKSQI

SEQ ID NO: 3322106 - protein, 23 aa, Plasmodium falciparum
KKSQKSINNKNNVQIQKEKKYNS

SEQ ID NO: 3322107 - protein, 6 aa, Plasmodium falciparum
KKSQNF

SEQ ID NO: 3322108 - protein, 12 aa, Plasmodium falciparum
KKSQVEEDKKKI

SEQ ID NO: 3322109 - protein, 4 aa, Plasmodium falciparum
KKSR

SEQ ID NO: 3322110 - protein, 9 aa, Plasmodium falciparum
KKSRDGTEL

SEQ ID NO: 3322111 - protein, 6 aa, Plasmodium falciparum
KKSSCE

SEQ ID NO: 3322112 - protein, 12 aa, Plasmodium falciparum
KKSSDDKKCNYD

SEQ ID NO: 3322113 - protein, 7 aa, Plasmodium falciparum
KKSSDYN

SEQ ID NO: 3322114 - protein, 11 aa, Plasmodium falciparum
KKSSEKEIEQS

SEQ ID NO: 3322115 - protein, 8 aa, Plasmodium falciparum
KKSSHTSR

SEQ ID NO: 3322116 - protein, 7 aa, Plasmodium falciparum
KKSSKEP

SEQ ID NO: 3322117 - protein, 8 aa, Plasmodium falciparum
KKSSKNIS

SEQ ID NO: 3322118 - protein, 5 aa, Plasmodium falciparum
KKSSL

SEQ ID NO: 3322119 - protein, 6 aa, Plasmodium falciparum
KKSSLQ

SEQ ID NO: 3322120 - protein, 10 aa, Plasmodium falciparum
KKSSNDEFSS

SEQ ID NO: 3322121 - protein, 9 aa, Plasmodium falciparum
KKSSRSNKS

SEQ ID NO: 3322122 - protein, 5 aa, Plasmodium falciparum
KKSSS

SEQ ID NO: 3322123 - protein, 6 aa, Plasmodium falciparum
KKSSSI

SEQ ID NO: 3322124 - protein, 8 aa, Plasmodium falciparum
KKSSYEDT

SEQ ID NO: 3322125 - protein, 22 aa, Plasmodium falciparum
KKSSYSQEKKSKSKNRRSSTRK

SEQ ID NO: 3322126 - protein, 4 aa, Plasmodium falciparum
KKST

SEQ ID NO: 3322127 - protein, 7 aa, Plasmodium falciparum
KKSTCSN

SEQ ID NO: 3322128 - protein, 8 aa, Plasmodium falciparum
KKSTDDSF

SEQ ID NO: 3322129 - protein, 12 aa, Plasmodium falciparum
KKSTEENKQKNV

SEQ ID NO: 3322130 - protein, 5 aa, Plasmodium falciparum
KKSTF

SEQ ID NO: 3322131 - protein, 6 aa, Plasmodium falciparum
KKSTHI

SEQ ID NO: 3322132 - protein, 7 aa, Plasmodium falciparum
KKSTSIF

SEQ ID NO: 3322133 - protein, 11 aa, Plasmodium falciparum
KKSTSKNDATK

SEQ ID NO: 3322134 - protein, 9 aa, Plasmodium falciparum
KKSTTKQDI

SEQ ID NO: 3322135 - protein, 12 aa, Plasmodium falciparum
KKSTTSYENTYI

SEQ ID NO: 3322136 - protein, 17 aa, Plasmodium falciparum
KKSTTTKSSTRKSSYYY

SEQ ID NO: 3322137 - protein, 9 aa, Plasmodium falciparum
KKSTVKQKS

SEQ ID NO: 3322138 - protein, 4 aa, Plasmodium falciparum
KKSV

SEQ ID NO: 3322139 - protein, 5 aa, Plasmodium falciparum
KKSWK

SEQ ID NO: 3322140 - protein, 4 aa, Plasmodium falciparum
KKSY

SEQ ID NO: 3322141 - protein, 10 aa, Plasmodium falciparum
KKSYDNESSY

SEQ ID NO: 3322142 - protein, 14 aa, Plasmodium falciparum
KKSYFNKEATAKHT

SEQ ID NO: 3322143 - protein, 6 aa, Plasmodium falciparum
KKSYND

SEQ ID NO: 3322144 - protein, 8 aa, Plasmodium falciparum
KKSYNDMN

SEQ ID NO: 3322145 - protein, 6 aa, Plasmodium falciparum
KKSYPE

SEQ ID NO: 3322146 - protein, 17 aa, Plasmodium falciparum
KKSYSTKGYNTDRSQTM

SEQ ID NO: 3322147 - protein, 9 aa, Plasmodium falciparum
KKTCSTYKK

SEQ ID NO: 3322148 - protein, 5 aa, Plasmodium falciparum
KKTDE

SEQ ID NO: 3322149 - protein, 7 aa, Plasmodium falciparum
KKTDEEI

SEQ ID NO: 3322150 - protein, 8 aa, Plasmodium falciparum
KKTDEHEK

SEQ ID NO: 3322151 - protein, 6 aa, Plasmodium falciparum
KKTDKA

SEQ ID NO: 3322152 - protein, 7 aa, Plasmodium falciparum
KKTDNGF

SEQ ID NO: 3322153 - protein, 6 aa, Plasmodium falciparum
KKTDYT

SEQ ID NO: 3322154 - protein, 4 aa, Plasmodium falciparum
KKTE

SEQ ID NO: 3322155 - protein, 61 aa, Plasmodium falciparum
KKTEEDMKRNEKDNMNESNLTDSKNKKQNKGSDASFSSSDDTDDKLSSNKSELNYEENGMK

SEQ ID NO: 3322156 - protein, 6 aa, Plasmodium falciparum
KKTEIT

SEQ ID NO: 3322157 - protein, 17 aa, Plasmodium falciparum
KKTEKNIGTTSNRNVTK

SEQ ID NO: 3322158 - protein, 8 aa, Plasmodium falciparum
KKTEKTGY

SEQ ID NO: 3322159 - protein, 7 aa, Plasmodium falciparum
KKTENDV

SEQ ID NO: 3322160 - protein, 8 aa, Plasmodium falciparum
KKTEQNNS

SEQ ID NO: 3322161 - protein, 17 aa, Plasmodium falciparum
KKTERRDKTREKKALKA

SEQ ID NO: 3322162 - protein, 5 aa, Plasmodium falciparum
KKTFK

SEQ ID NO: 3322163 - protein, 9 aa, Plasmodium falciparum
KKTFKSSRD

SEQ ID NO: 3322164 - protein, 7 aa, Plasmodium falciparum
KKTFTHK

SEQ ID NO: 3322165 - protein, 6 aa, Plasmodium falciparum
KKTGEL

SEQ ID NO: 3322166 - protein, 66 aa, Plasmodium falciparum
KKTGIGESDDIKNGDSIKKSDSIKKSDSIKKSDSIKKSDSIKKSDSIKKSDSIKKSDSIKKSDDIK

SEQ ID NO: 3322167 - protein, 7 aa, Plasmodium falciparum
KKTGVKP

SEQ ID NO: 3322168 - protein, 4 aa, Plasmodium falciparum
KKTH

SEQ ID NO: 3322169 - protein, 9 aa, Plasmodium falciparum
KKTHGYNNN

SEQ ID NO: 3322170 - protein, 4 aa, Plasmodium falciparum
KKTI

SEQ ID NO: 3322171 - protein, 7 aa, Plasmodium falciparum
KKTIDAN

SEQ ID NO: 3322172 - protein, 9 aa, Plasmodium falciparum
KKTIESNNN

SEQ ID NO: 3322173 - protein, 5 aa, Plasmodium falciparum
KKTIN

SEQ ID NO: 3322174 - protein, 6 aa, Plasmodium falciparum
KKTIQS

SEQ ID NO: 3322175 - protein, 12 aa, Plasmodium falciparum
KKTISNNNNNNN

SEQ ID NO: 3322176 - protein, 8 aa, Plasmodium falciparum
KKTITRQE

SEQ ID NO: 3322177 - protein, 34 aa, Plasmodium falciparum
KKTKDINEDKRKTNFNNNEEDKEKDNKNKDNDID

SEQ ID NO: 3322178 - protein, 8 aa, Plasmodium falciparum
KKTKEKEF

SEQ ID NO: 3322179 - protein, 7 aa, Plasmodium falciparum
KKTKEKL

SEQ ID NO: 3322180 - protein, 10 aa, Plasmodium falciparum
KKTKENISNN

SEQ ID NO: 3322181 - protein, 8 aa, Plasmodium falciparum
KKTKKQNI

SEQ ID NO: 3322182 - protein, 28 aa, Plasmodium falciparum
KKTKKRKEKKRKEKKIKEKKRKKKIKRS

SEQ ID NO: 3322183 - protein, 17 aa, Plasmodium falciparum
KKTKNERDRMEYPEEPE

SEQ ID NO: 3322184 - protein, 8 aa, Plasmodium falciparum
KKTKRGPC

SEQ ID NO: 3322185 - protein, 15 aa, Plasmodium falciparum
KKTKRNIKNTPQSYS

SEQ ID NO: 3322186 - protein, 6 aa, Plasmodium falciparum
KKTKSI

SEQ ID NO: 3322187 - protein, 6 aa, Plasmodium falciparum
KKTKTY

SEQ ID NO: 3322188 - protein, 6 aa, Plasmodium falciparum
KKTKVK

SEQ ID NO: 3322189 - protein, 5 aa, Plasmodium falciparum
KKTLR

SEQ ID NO: 3322190 - protein, 5 aa, Plasmodium falciparum
KKTLT

SEQ ID NO: 3322191 - protein, 4 aa, Plasmodium falciparum
KKTM

SEQ ID NO: 3322192 - protein, 11 aa, Plasmodium falciparum
KKTNDTTNEKH

SEQ ID NO: 3322193 - protein, 6 aa, Plasmodium falciparum
KKTNEM

SEQ ID NO: 3322194 - protein, 12 aa, Plasmodium falciparum
KKTNENHNMHNS

SEQ ID NO: 3322195 - protein, 5 aa, Plasmodium falciparum
KKTNI

SEQ ID NO: 3322196 - protein, 5 aa, Plasmodium falciparum
KKTNK

SEQ ID NO: 3322197 - protein, 14 aa, Plasmodium falciparum
KKTNKKTKGKLRKN

SEQ ID NO: 3322198 - protein, 11 aa, Plasmodium falciparum
KKTNKRKKDSV

SEQ ID NO: 3322199 - protein, 21 aa, Plasmodium falciparum
KKTNKTANTNISKDSNNNNNV

SEQ ID NO: 3322200 - protein, 5 aa, Plasmodium falciparum
KKTNL

SEQ ID NO: 3322201 - protein, 8 aa, Plasmodium falciparum
KKTNNEEV

SEQ ID NO: 3322202 - protein, 7 aa, Plasmodium falciparum
KKTNNLQ

SEQ ID NO: 3322203 - protein, 9 aa, Plasmodium falciparum
KKTNNQYDQ

SEQ ID NO: 3322204 - protein, 6 aa, Plasmodium falciparum
KKTNNV

SEQ ID NO: 3322205 - protein, 6 aa, Plasmodium falciparum
KKTNNY

SEQ ID NO: 3322206 - protein, 8 aa, Plasmodium falciparum
KKTNNYDK

SEQ ID NO: 3322207 - protein, 19 aa, Plasmodium falciparum
KKTNQDLTYQQNDSTNKNI

SEQ ID NO: 3322208 - protein, 7 aa, Plasmodium falciparum
KKTNQKI

SEQ ID NO: 3322209 - protein, 8 aa, Plasmodium falciparum
KKTNTNNS

SEQ ID NO: 3322210 - protein, 43 aa, Plasmodium falciparum
KKTPLTQANSINEKDNNRKSSNHKALTKTKKNQNDNSFDLFQH

SEQ ID NO: 3322211 - protein, 5 aa, Plasmodium falciparum
KKTPN

SEQ ID NO: 3322212 - protein, 6 aa, Plasmodium falciparum
KKTPNK

SEQ ID NO: 3322213 - protein, 7 aa, Plasmodium falciparum
KKTQEKY

SEQ ID NO: 3322214 - protein, 5 aa, Plasmodium falciparum
KKTQI

SEQ ID NO: 3322215 - protein, 7 aa, Plasmodium falciparum
KKTQLKE

SEQ ID NO: 3322216 - protein, 13 aa, Plasmodium falciparum
KKTQQQREVQHME

SEQ ID NO: 3322217 - protein, 19 aa, Plasmodium falciparum
KKTRKGNKNEVKKNDIYQK

SEQ ID NO: 3322218 - protein, 5 aa, Plasmodium falciparum
KKTRL

SEQ ID NO: 3322219 - protein, 7 aa, Plasmodium falciparum
KKTRREL

SEQ ID NO: 3322220 - protein, 7 aa, Plasmodium falciparum
KKTSGTY

SEQ ID NO: 3322221 - protein, 7 aa, Plasmodium falciparum
KKTSIQS

SEQ ID NO: 3322222 - protein, 6 aa, Plasmodium falciparum
KKTSNL

SEQ ID NO: 3322223 - protein, 6 aa, Plasmodium falciparum
KKTSQY

SEQ ID NO: 3322224 - protein, 7 aa, Plasmodium falciparum
KKTSRVK

SEQ ID NO: 3322225 - protein, 8 aa, Plasmodium falciparum
KKTSTIME

SEQ ID NO: 3322226 - protein, 6 aa, Plasmodium falciparum
KKTTDY

SEQ ID NO: 3322227 - protein, 7 aa, Plasmodium falciparum
KKTTING

SEQ ID NO: 3322228 - protein, 15 aa, Plasmodium falciparum
KKTTKKRTTKNVSEQ

SEQ ID NO: 3322229 - protein, 5 aa, Plasmodium falciparum
KKTTL

SEQ ID NO: 3322230 - protein, 30 aa, Plasmodium falciparum
KKTTTKKRITRVSEESTTKVDTRESDEDDL

SEQ ID NO: 3322231 - protein, 14 aa, Plasmodium falciparum
KKTVNRAPKMDEDI

SEQ ID NO: 3322232 - protein, 12 aa, Plasmodium falciparum
KKTVTTSYSGKL

SEQ ID NO: 3322233 - protein, 8 aa, Plasmodium falciparum
KKTYNKND

SEQ ID NO: 3322234 - protein, 14 aa, Plasmodium falciparum
KKTYPSKNHLDENT

SEQ ID NO: 3322235 - protein, 9 aa, Plasmodium falciparum
KKVDEEKKE

SEQ ID NO: 3322236 - protein, 9 aa, Plasmodium falciparum
KKVDKSSNY

SEQ ID NO: 3322237 - protein, 7 aa, Plasmodium falciparum
KKVDNSN

SEQ ID NO: 3322238 - protein, 51 aa, Plasmodium falciparum
KKVDTSKNIDEQTSPKINNVNSNNNNNNNNNNNNNNNNNNNNNNNNSSNNF

SEQ ID NO: 3322239 - protein, 118 aa, Plasmodium falciparum
KKVEAGKENNDKNNDDDKNNDDNKNNDDDNKNNDDDNKNNDDDNKNNDDDKNNDDDKNNDDDKNNDDDNKNNDDDNKNNDDDKNNDDDKNNDDDKNNDDNKNNDDNNKNNNNDDDDDV

SEQ ID NO: 3322240 - protein, 6 aa, Plasmodium falciparum
KKVEEE

SEQ ID NO: 3322241 - protein, 9 aa, Plasmodium falciparum
KKVEESPDL

SEQ ID NO: 3322242 - protein, 17 aa, Plasmodium falciparum
KKVEKKKLSSIKSNRYK

SEQ ID NO: 3322243 - protein, 5 aa, Plasmodium falciparum
KKVEN

SEQ ID NO: 3322244 - protein, 5 aa, Plasmodium falciparum
KKVEP

SEQ ID NO: 3322245 - protein, 10 aa, Plasmodium falciparum
KKVEYNSTTN

SEQ ID NO: 3322246 - protein, 33 aa, Plasmodium falciparum
KKVGRDKTKEKNIKDKRDDKDKNSSYDSPYYSP

SEQ ID NO: 3322247 - protein, 4 aa, Plasmodium falciparum
KKVK

SEQ ID NO: 3322248 - protein, 7 aa, Plasmodium falciparum
KKVKKNK

SEQ ID NO: 3322249 - protein, 4 aa, Plasmodium falciparum
KKVL

SEQ ID NO: 3322250 - protein, 9 aa, Plasmodium falciparum
KKVNDKNYN

SEQ ID NO: 3322251 - protein, 8 aa, Plasmodium falciparum
KKVNEGRR

SEQ ID NO: 3322252 - protein, 17 aa, Plasmodium falciparum
KKVNKNKELKQAAAKKI

SEQ ID NO: 3322253 - protein, 5 aa, Plasmodium falciparum
KKVNN

SEQ ID NO: 3322254 - protein, 8 aa, Plasmodium falciparum
KKVNTTSD

SEQ ID NO: 3322255 - protein, 4 aa, Plasmodium falciparum
KKVP

SEQ ID NO: 3322256 - protein, 8 aa, Plasmodium falciparum
KKVPKSEL

SEQ ID NO: 3322257 - protein, 14 aa, Plasmodium falciparum
KKVQEKQKIEKDEI

SEQ ID NO: 3322258 - protein, 17 aa, Plasmodium falciparum
KKVQGSNKIKDKAGINK

SEQ ID NO: 3322259 - protein, 10 aa, Plasmodium falciparum
KKVQNKKKNI

SEQ ID NO: 3322260 - protein, 9 aa, Plasmodium falciparum
KKVQPNKNY

SEQ ID NO: 3322261 - protein, 9 aa, Plasmodium falciparum
KKVRSSNNS

SEQ ID NO: 3322262 - protein, 7 aa, Plasmodium falciparum
KKVSASS

SEQ ID NO: 3322263 - protein, 14 aa, Plasmodium falciparum
KKVSDRYYDIPTYF

SEQ ID NO: 3322264 - protein, 8 aa, Plasmodium falciparum
KKVSSATG

SEQ ID NO: 3322265 - protein, 15 aa, Plasmodium falciparum
KKVYEENYNNEDGNI

SEQ ID NO: 3322266 - protein, 9 aa, Plasmodium falciparum
KKWNKKNDN

SEQ ID NO: 3322267 - protein, 4 aa, Plasmodium falciparum
KKWT

SEQ ID NO: 3322268 - protein, 11 aa, Plasmodium falciparum
KKYAHEESSFN

SEQ ID NO: 3322269 - protein, 7 aa, Plasmodium falciparum
KKYAKKK

SEQ ID NO: 3322270 - protein, 7 aa, Plasmodium falciparum
KKYDDNK

SEQ ID NO: 3322271 - protein, 12 aa, Plasmodium falciparum
KKYDHDDGHHHK

SEQ ID NO: 3322272 - protein, 10 aa, Plasmodium falciparum
KKYDHSDGYH

SEQ ID NO: 3322273 - protein, 8 aa, Plasmodium falciparum
KKYDKKYD

SEQ ID NO: 3322274 - protein, 8 aa, Plasmodium falciparum
KKYDNDDE

SEQ ID NO: 3322275 - protein, 7 aa, Plasmodium falciparum
KKYDQTK

SEQ ID NO: 3322276 - protein, 10 aa, Plasmodium falciparum
KKYDRENKKG

SEQ ID NO: 3322277 - protein, 5 aa, Plasmodium falciparum
KKYEA

SEQ ID NO: 3322278 - protein, 6 aa, Plasmodium falciparum
KKYEDK

SEQ ID NO: 3322279 - protein, 7 aa, Plasmodium falciparum
KKYEGAY

SEQ ID NO: 3322280 - protein, 10 aa, Plasmodium falciparum
KKYEKTEDNL

SEQ ID NO: 3322281 - protein, 6 aa, Plasmodium falciparum
KKYELA

SEQ ID NO: 3322282 - protein, 12 aa, Plasmodium falciparum
KKYENDDDHHHK

SEQ ID NO: 3322283 - protein, 13 aa, Plasmodium falciparum
KKYENDDDHHHKY

SEQ ID NO: 3322284 - protein, 27 aa, Plasmodium falciparum
KKYENNNMNTYDSNQNYQKDYNNCNNK

SEQ ID NO: 3322285 - protein, 6 aa, Plasmodium falciparum
KKYEQE

SEQ ID NO: 3322286 - protein, 21 aa, Plasmodium falciparum
KKYEQNVNNSPNVKNNLNKSE

SEQ ID NO: 3322287 - protein, 12 aa, Plasmodium falciparum
KKYESLSKEDIK

SEQ ID NO: 3322288 - protein, 6 aa, Plasmodium falciparum
KKYESS

SEQ ID NO: 3322289 - protein, 7 aa, Plasmodium falciparum
KKYFEEN

SEQ ID NO: 3322290 - protein, 5 aa, Plasmodium falciparum
KKYFT

SEQ ID NO: 3322291 - protein, 22 aa, Plasmodium falciparum
KKYGDKDDKGNYIENNSSKEFS

SEQ ID NO: 3322292 - protein, 7 aa, Plasmodium falciparum
KKYISNS

SEQ ID NO: 3322293 - protein, 4 aa, Plasmodium falciparum
KKYK

SEQ ID NO: 3322294 - protein, 17 aa, Plasmodium falciparum
KKYKEEEQEDEKKRKKE

SEQ ID NO: 3322295 - protein, 9 aa, Plasmodium falciparum
KKYKEKLDE

SEQ ID NO: 3322296 - protein, 16 aa, Plasmodium falciparum
KKYKNKEMNNKDNKAI

SEQ ID NO: 3322297 - protein, 13 aa, Plasmodium falciparum
KKYKRENSFSSSS

SEQ ID NO: 3322298 - protein, 5 aa, Plasmodium falciparum
KKYLN

SEQ ID NO: 3322299 - protein, 11 aa, Plasmodium falciparum
KKYNDNTYNDN

SEQ ID NO: 3322300 - protein, 6 aa, Plasmodium falciparum
KKYNDQ

SEQ ID NO: 3322301 - protein, 5 aa, Plasmodium falciparum
KKYNN

SEQ ID NO: 3322302 - protein, 19 aa, Plasmodium falciparum
KKYNNNNKKYNNNNNNNNI

SEQ ID NO: 3322303 - protein, 53 aa, Plasmodium falciparum
KKYNPKKNVDKNNVDKNNIDKGNVDKSNVDKNNIDKGNVDKSNVDKSNVDKSN

SEQ ID NO: 3322304 - protein, 30 aa, Plasmodium falciparum
KKYNQTDKISSTHEEDKEQIVKNNNKDDIV

SEQ ID NO: 3322305 - protein, 5 aa, Plasmodium falciparum
KKYNS

SEQ ID NO: 3322306 - protein, 11 aa, Plasmodium falciparum
KKYNSDLGKGL

SEQ ID NO: 3322307 - protein, 8 aa, Plasmodium falciparum
KKYNYESN

SEQ ID NO: 3322308 - protein, 5 aa, Plasmodium falciparum
KKYPD

SEQ ID NO: 3322309 - protein, 7 aa, Plasmodium falciparum
KKYPFSN

SEQ ID NO: 3322310 - protein, 6 aa, Plasmodium falciparum
KKYPNH

SEQ ID NO: 3322311 - protein, 9 aa, Plasmodium falciparum
KKYPNNENM

SEQ ID NO: 3322312 - protein, 7 aa, Plasmodium falciparum
KKYPTDK

SEQ ID NO: 3322313 - protein, 14 aa, Plasmodium falciparum
KKYPYDDNKEDQSA

SEQ ID NO: 3322314 - protein, 11 aa, Plasmodium falciparum
KKYQEKKKKGI

SEQ ID NO: 3322315 - protein, 10 aa, Plasmodium falciparum
KKYQNNQNYV

SEQ ID NO: 3322316 - protein, 4 aa, Plasmodium falciparum
KKYS

SEQ ID NO: 3322317 - protein, 10 aa, Plasmodium falciparum
KKYSEESNQV

SEQ ID NO: 3322318 - protein, 8 aa, Plasmodium falciparum
KKYSKKKK

SEQ ID NO: 3322319 - protein, 11 aa, Plasmodium falciparum
KKYSNNVSTQS

SEQ ID NO: 3322320 - protein, 10 aa, Plasmodium falciparum
KKYSPNKDRD

SEQ ID NO: 3322321 - protein, 10 aa, Plasmodium falciparum
KKYSTTSIST

SEQ ID NO: 3322322 - protein, 4 aa, Plasmodium falciparum
KKYT

SEQ ID NO: 3322323 - protein, 9 aa, Plasmodium falciparum
KKYTESKGL

SEQ ID NO: 3322324 - protein, 6 aa, Plasmodium falciparum
KKYTNN

SEQ ID NO: 3322325 - protein, 19 aa, Plasmodium falciparum
KKYTSSIKSRDDQGVKIIS

SEQ ID NO: 3322326 - protein, 7 aa, Plasmodium falciparum
KKYTSTF

SEQ ID NO: 3322327 - protein, 8 aa, Plasmodium falciparum
KKYTYEKG

SEQ ID NO: 3322328 - protein, 4 aa, Plasmodium falciparum
KKYW

SEQ ID NO: 3322329 - protein, 45 aa, Plasmodium falciparum
KKYYNDDNIKTKENKKNKINNNYTNDDNNYDNNYDNNYDNNDGQN

SEQ ID NO: 3322330 - protein, 25 aa, Plasmodium falciparum
KKYYPSKSMDSDNNSLNNKRGYSHY

SEQ ID NO: 3322331 - protein, 8 aa, Plasmodium falciparum
KLATDSLK

SEQ ID NO: 3322332 - protein, 8 aa, Plasmodium falciparum
KLDEAPDS

SEQ ID NO: 3322333 - protein, 7 aa, Plasmodium falciparum
KLDEDDL

SEQ ID NO: 3322334 - protein, 8 aa, Plasmodium falciparum
KLDEENNM

SEQ ID NO: 3322335 - protein, 10 aa, Plasmodium falciparum
KLDKDTKTKK

SEQ ID NO: 3322336 - protein, 9 aa, Plasmodium falciparum
KLDKEEEKT

SEQ ID NO: 3322337 - protein, 14 aa, Plasmodium falciparum
KLDKELKKSSLDEW

SEQ ID NO: 3322338 - protein, 10 aa, Plasmodium falciparum
KLDKKKNEIH

SEQ ID NO: 3322339 - protein, 17 aa, Plasmodium falciparum
KLDKLDQYTDQKKKEKL

SEQ ID NO: 3322340 - protein, 6 aa, Plasmodium falciparum
KLDNDE

SEQ ID NO: 3322341 - protein, 23 aa, Plasmodium falciparum
KLDNEKKNKGDNIKLGNTKNKDN

SEQ ID NO: 3322342 - protein, 7 aa, Plasmodium falciparum
KLDNNYN

SEQ ID NO: 3322343 - protein, 10 aa, Plasmodium falciparum
KLDNYKKEDN

SEQ ID NO: 3322344 - protein, 5 aa, Plasmodium falciparum
KLDPG

SEQ ID NO: 3322345 - protein, 18 aa, Plasmodium falciparum
KLDQETENTEQNKKITTI

SEQ ID NO: 3322346 - protein, 8 aa, Plasmodium falciparum
KLDRGTKG

SEQ ID NO: 3322347 - protein, 6 aa, Plasmodium falciparum
KLDSNN

SEQ ID NO: 3322348 - protein, 9 aa, Plasmodium falciparum
KLDSQEKHS

SEQ ID NO: 3322349 - protein, 19 aa, Plasmodium falciparum
KLDTEKSEKVYSSNDEYYY

SEQ ID NO: 3322350 - protein, 10 aa, Plasmodium falciparum
KLDTGKQNVT

SEQ ID NO: 3322351 - protein, 6 aa, Plasmodium falciparum
KLEASK

SEQ ID NO: 3322352 - protein, 7 aa, Plasmodium falciparum
KLEDNKN

SEQ ID NO: 3322353 - protein, 8 aa, Plasmodium falciparum
KLEDQNVM

SEQ ID NO: 3322354 - protein, 15 aa, Plasmodium falciparum
KLEEDGNDNNIDNMN

SEQ ID NO: 3322355 - protein, 14 aa, Plasmodium falciparum
KLEEDTDESKNGNF

SEQ ID NO: 3322356 - protein, 8 aa, Plasmodium falciparum
KLEEEKKK

SEQ ID NO: 3322357 - protein, 14 aa, Plasmodium falciparum
KLEENKKRNEQARR

SEQ ID NO: 3322358 - protein, 7 aa, Plasmodium falciparum
KLEESSP

SEQ ID NO: 3322359 - protein, 12 aa, Plasmodium falciparum
KLEETNKEYTNL

SEQ ID NO: 3322360 - protein, 11 aa, Plasmodium falciparum
KLEGREINPER

SEQ ID NO: 3322361 - protein, 5 aa, Plasmodium falciparum
KLEGT

SEQ ID NO: 3322362 - protein, 6 aa, Plasmodium falciparum
KLEKEK

SEQ ID NO: 3322363 - protein, 16 aa, Plasmodium falciparum
KLEKEKKEELARKGEK

SEQ ID NO: 3322364 - protein, 10 aa, Plasmodium falciparum
KLEKEKKQND

SEQ ID NO: 3322365 - protein, 7 aa, Plasmodium falciparum
KLEKEKN

SEQ ID NO: 3322366 - protein, 10 aa, Plasmodium falciparum
KLEKENEKLQ

SEQ ID NO: 3322367 - protein, 5 aa, Plasmodium falciparum
KLEKG

SEQ ID NO: 3322368 - protein, 6 aa, Plasmodium falciparum
KLEKKK

SEQ ID NO: 3322369 - protein, 11 aa, Plasmodium falciparum
KLEKKKKDSFL

SEQ ID NO: 3322370 - protein, 8 aa, Plasmodium falciparum
KLENENNE

SEQ ID NO: 3322371 - protein, 7 aa, Plasmodium falciparum
KLENERR

SEQ ID NO: 3322372 - protein, 6 aa, Plasmodium falciparum
KLENNN

SEQ ID NO: 3322373 - protein, 9 aa, Plasmodium falciparum
KLENSQQNY

SEQ ID NO: 3322374 - protein, 6 aa, Plasmodium falciparum
KLEPNN

SEQ ID NO: 3322375 - protein, 8 aa, Plasmodium falciparum
KLESQNVD

SEQ ID NO: 3322376 - protein, 6 aa, Plasmodium falciparum
KLESSI

SEQ ID NO: 3322377 - protein, 5 aa, Plasmodium falciparum
KLETI

SEQ ID NO: 3322378 - protein, 12 aa, Plasmodium falciparum
KLETNNKSNIIN

SEQ ID NO: 3322379 - protein, 4 aa, Plasmodium falciparum
KLGA

SEQ ID NO: 3322380 - protein, 4 aa, Plasmodium falciparum
KLGD

SEQ ID NO: 3322381 - protein, 11 aa, Plasmodium falciparum
KLGDKNIKRQQ

SEQ ID NO: 3322382 - protein, 9 aa, Plasmodium falciparum
KLGGGTYGD

SEQ ID NO: 3322383 - protein, 6 aa, Plasmodium falciparum
KLGKET

SEQ ID NO: 3322384 - protein, 7 aa, Plasmodium falciparum
KLHNKDK

SEQ ID NO: 3322385 - protein, 14 aa, Plasmodium falciparum
KLHTEHNNNNNNNN

SEQ ID NO: 3322386 - protein, 5 aa, Plasmodium falciparum
KLINS

SEQ ID NO: 3322387 - protein, 16 aa, Plasmodium falciparum
KLISKEKKKKKISRKI

SEQ ID NO: 3322388 - protein, 17 aa, Plasmodium falciparum
KLKAAKKLKDSTNGEFT

SEQ ID NO: 3322389 - protein, 20 aa, Plasmodium falciparum
KLKCSKKEQNMEENNSQNKI

SEQ ID NO: 3322390 - protein, 13 aa, Plasmodium falciparum
KLKDEADKKERIK

SEQ ID NO: 3322391 - protein, 7 aa, Plasmodium falciparum
KLKDEKM

SEQ ID NO: 3322392 - protein, 17 aa, Plasmodium falciparum
KLKEDRNNNEDISTPKT

SEQ ID NO: 3322393 - protein, 10 aa, Plasmodium falciparum
KLKEKEEKEN

SEQ ID NO: 3322394 - protein, 6 aa, Plasmodium falciparum
KLKENN

SEQ ID NO: 3322395 - protein, 5 aa, Plasmodium falciparum
KLKER

SEQ ID NO: 3322396 - protein, 11 aa, Plasmodium falciparum
KLKESEKESYM

SEQ ID NO: 3322397 - protein, 20 aa, Plasmodium falciparum
KLKEVTEQKNEKGKEKEETI

SEQ ID NO: 3322398 - protein, 7 aa, Plasmodium falciparum
KLKGEYD

SEQ ID NO: 3322399 - protein, 6 aa, Plasmodium falciparum
KLKGSG

SEQ ID NO: 3322400 - protein, 4 aa, Plasmodium falciparum
KLKI

SEQ ID NO: 3322401 - protein, 19 aa, Plasmodium falciparum
KLKKKKKKIDQEELQNNES

SEQ ID NO: 3322402 - protein, 5 aa, Plasmodium falciparum
KLKKN

SEQ ID NO: 3322403 - protein, 14 aa, Plasmodium falciparum
KLKKNYKSNSCDEM

SEQ ID NO: 3322404 - protein, 6 aa, Plasmodium falciparum
KLKNDD

SEQ ID NO: 3322405 - protein, 25 aa, Plasmodium falciparum
KLKNEDENSDDQNYDDNTSDDDEIY

SEQ ID NO: 3322406 - protein, 10 aa, Plasmodium falciparum
KLKNEKDDVN

SEQ ID NO: 3322407 - protein, 8 aa, Plasmodium falciparum
KLKNEYKS

SEQ ID NO: 3322408 - protein, 7 aa, Plasmodium falciparum
KLKNGDS

SEQ ID NO: 3322409 - protein, 13 aa, Plasmodium falciparum
KLKNKSSNLTDNC

SEQ ID NO: 3322410 - protein, 10 aa, Plasmodium falciparum
KLKNTKDKSI

SEQ ID NO: 3322411 - protein, 14 aa, Plasmodium falciparum
KLKNTQRNIQNDKD

SEQ ID NO: 3322412 - protein, 7 aa, Plasmodium falciparum
KLKPPSK

SEQ ID NO: 3322413 - protein, 4 aa, Plasmodium falciparum
KLKQ

SEQ ID NO: 3322414 - protein, 30 aa, Plasmodium falciparum
KLKRKRQHGEVKEQNGKDKTLIKEEKSGEL

SEQ ID NO: 3322415 - protein, 22 aa, Plasmodium falciparum
KLKRNKKCGSNELHKKNTKEEM

SEQ ID NO: 3322416 - protein, 6 aa, Plasmodium falciparum
KLKRSD

SEQ ID NO: 3322417 - protein, 10 aa, Plasmodium falciparum
KLKSDENEEE

SEQ ID NO: 3322418 - protein, 7 aa, Plasmodium falciparum
KLKSEQK

SEQ ID NO: 3322419 - protein, 8 aa, Plasmodium falciparum
KLKSKKEK

SEQ ID NO: 3322420 - protein, 10 aa, Plasmodium falciparum
KLKSNYKNTC

SEQ ID NO: 3322421 - protein, 18 aa, Plasmodium falciparum
KLKSVKKNKNVQEEENDE

SEQ ID NO: 3322422 - protein, 7 aa, Plasmodium falciparum
KLKTNGN

SEQ ID NO: 3322423 - protein, 8 aa, Plasmodium falciparum
KLKTQEEI

SEQ ID NO: 3322424 - protein, 10 aa, Plasmodium falciparum
KLKTQLENKN

SEQ ID NO: 3322425 - protein, 5 aa, Plasmodium falciparum
KLLDG

SEQ ID NO: 3322426 - protein, 5 aa, Plasmodium falciparum
KLNAD

SEQ ID NO: 3322427 - protein, 10 aa, Plasmodium falciparum
KLNANGEKEL

SEQ ID NO: 3322428 - protein, 6 aa, Plasmodium falciparum
KLNDNK

SEQ ID NO: 3322429 - protein, 19 aa, Plasmodium falciparum
KLNDQKKEMRSNNNINNTK

SEQ ID NO: 3322430 - protein, 12 aa, Plasmodium falciparum
KLNEEENEKDKN

SEQ ID NO: 3322431 - protein, 9 aa, Plasmodium falciparum
KLNEKQKLK

SEQ ID NO: 3322432 - protein, 9 aa, Plasmodium falciparum
KLNENNYNQ

SEQ ID NO: 3322433 - protein, 6 aa, Plasmodium falciparum
KLNEQK

SEQ ID NO: 3322434 - protein, 11 aa, Plasmodium falciparum
KLNESYSNGKS

SEQ ID NO: 3322435 - protein, 45 aa, Plasmodium falciparum
KLNHNDNKDNMNNHKKNNDNKNRKKENYLKNSSYNNLSDDKKDHM

SEQ ID NO: 3322436 - protein, 11 aa, Plasmodium falciparum
KLNKDEKKNEI

SEQ ID NO: 3322437 - protein, 8 aa, Plasmodium falciparum
KLNKENEL

SEQ ID NO: 3322438 - protein, 11 aa, Plasmodium falciparum
KLNKKDKNKYK

SEQ ID NO: 3322439 - protein, 22 aa, Plasmodium falciparum
KLNKKNSNKINKSNSLNQTNEE

SEQ ID NO: 3322440 - protein, 15 aa, Plasmodium falciparum
KLNKTKEEKEEEKKM

SEQ ID NO: 3322441 - protein, 14 aa, Plasmodium falciparum
KLNNEGNVKKNKHI

SEQ ID NO: 3322442 - protein, 26 aa, Plasmodium falciparum
KLNNEKEHNINTNQTHNNNNNHPHSD

SEQ ID NO: 3322443 - protein, 38 aa, Plasmodium falciparum
KLNNMNDNKNMSSTTVSSSLSSSSLSTPLNKKNIEDDE

SEQ ID NO: 3322444 - protein, 6 aa, Plasmodium falciparum
KLNNNE

SEQ ID NO: 3322445 - protein, 9 aa, Plasmodium falciparum
KLNNNNNYT

SEQ ID NO: 3322446 - protein, 12 aa, Plasmodium falciparum
KLNNRNNNNIKK

SEQ ID NO: 3322447 - protein, 9 aa, Plasmodium falciparum
KLNNRNSDL

SEQ ID NO: 3322448 - protein, 7 aa, Plasmodium falciparum
KLNQGNK

SEQ ID NO: 3322449 - protein, 11 aa, Plasmodium falciparum
KLNRNEKQNDV

SEQ ID NO: 3322450 - protein, 7 aa, Plasmodium falciparum
KLNRTKY

SEQ ID NO: 3322451 - protein, 23 aa, Plasmodium falciparum
KLNSLKSDKLNSLKSDKINSLRS

SEQ ID NO: 3322452 - protein, 13 aa, Plasmodium falciparum
KLNSSSKQQDNST

SEQ ID NO: 3322453 - protein, 34 aa, Plasmodium falciparum
KLNTNKKDTIINNKDEDKKKREPEEKNNDTFQNE

SEQ ID NO: 3322454 - protein, 30 aa, Plasmodium falciparum
KLNYDEEDYSDEDINNNKNVDEENDDNEYE

SEQ ID NO: 3322455 - protein, 6 aa, Plasmodium falciparum
KLPAWS

SEQ ID NO: 3322456 - protein, 13 aa, Plasmodium falciparum
KLPDREKSSLPPG

SEQ ID NO: 3322457 - protein, 7 aa, Plasmodium falciparum
KLPEQIK

SEQ ID NO: 3322458 - protein, 10 aa, Plasmodium falciparum
KLPGGDEWNK

SEQ ID NO: 3322459 - protein, 13 aa, Plasmodium falciparum
KLPKEENNKNSTA

SEQ ID NO: 3322460 - protein, 9 aa, Plasmodium falciparum
KLPKQDREL

SEQ ID NO: 3322461 - protein, 14 aa, Plasmodium falciparum
KLPNLDNTNNNEAN

SEQ ID NO: 3322462 - protein, 27 aa, Plasmodium falciparum
KLPNSSSKKYKRDNRNFEDDNKENDLN

SEQ ID NO: 3322463 - protein, 4 aa, Plasmodium falciparum
KLPP

SEQ ID NO: 3322464 - protein, 5 aa, Plasmodium falciparum
KLPPK

SEQ ID NO: 3322465 - protein, 7 aa, Plasmodium falciparum
KLPQPDN

SEQ ID NO: 3322466 - protein, 7 aa, Plasmodium falciparum
KLPQPIR

SEQ ID NO: 3322467 - protein, 4 aa, Plasmodium falciparum
KLPR

SEQ ID NO: 3322468 - protein, 4 aa, Plasmodium falciparum
KLPS

SEQ ID NO: 3322469 - protein, 5 aa, Plasmodium falciparum
KLPSH

SEQ ID NO: 3322470 - protein, 12 aa, Plasmodium falciparum
KLPSKKSLKPYP

SEQ ID NO: 3322471 - protein, 12 aa, Plasmodium falciparum
KLPTKRSNGDNF

SEQ ID NO: 3322472 - protein, 9 aa, Plasmodium falciparum
KLPTPDVNN

SEQ ID NO: 3322473 - protein, 6 aa, Plasmodium falciparum
KLQEAT

SEQ ID NO: 3322474 - protein, 5 aa, Plasmodium falciparum
KLQEE

SEQ ID NO: 3322475 - protein, 12 aa, Plasmodium falciparum
KLQEEKKSLENT

SEQ ID NO: 3322476 - protein, 16 aa, Plasmodium falciparum
KLQEETKVAEDQYNEQ

SEQ ID NO: 3322477 - protein, 8 aa, Plasmodium falciparum
KLQEGNEP

SEQ ID NO: 3322478 - protein, 5 aa, Plasmodium falciparum
KLQGT

SEQ ID NO: 3322479 - protein, 4 aa, Plasmodium falciparum
KLQK

SEQ ID NO: 3322480 - protein, 7 aa, Plasmodium falciparum
KLQKGSD

SEQ ID NO: 3322481 - protein, 8 aa, Plasmodium falciparum
KLQKKKQK

SEQ ID NO: 3322482 - protein, 9 aa, Plasmodium falciparum
KLQNYNNKR

SEQ ID NO: 3322483 - protein, 9 aa, Plasmodium falciparum
KLREEKETY

SEQ ID NO: 3322484 - protein, 12 aa, Plasmodium falciparum
KLRENTGSLGYE

SEQ ID NO: 3322485 - protein, 8 aa, Plasmodium falciparum
KLREQNSD

SEQ ID NO: 3322486 - protein, 10 aa, Plasmodium falciparum
KLRERKKRTT

SEQ ID NO: 3322487 - protein, 21 aa, Plasmodium falciparum
KLRNSSSQSNNISDEKTENCC

SEQ ID NO: 3322488 - protein, 13 aa, Plasmodium falciparum
KLRQNNNSTEENI

SEQ ID NO: 3322489 - protein, 5 aa, Plasmodium falciparum
KLRRD

SEQ ID NO: 3322490 - protein, 29 aa, Plasmodium falciparum
KLSAGDSTFGKPTVRGSVTNDNLSDDGEI

SEQ ID NO: 3322491 - protein, 7 aa, Plasmodium falciparum
KLSEDKR

SEQ ID NO: 3322492 - protein, 11 aa, Plasmodium falciparum
KLSEEDTNINN

SEQ ID NO: 3322493 - protein, 9 aa, Plasmodium falciparum
KLSEEERKN

SEQ ID NO: 3322494 - protein, 8 aa, Plasmodium falciparum
KLSEESIK

SEQ ID NO: 3322495 - protein, 12 aa, Plasmodium falciparum
KLSEKKNKKNDL

SEQ ID NO: 3322496 - protein, 6 aa, Plasmodium falciparum
KLSEQD

SEQ ID NO: 3322497 - protein, 16 aa, Plasmodium falciparum
KLSESAENFDSLDNKN

SEQ ID NO: 3322498 - protein, 7 aa, Plasmodium falciparum
KLSESEK

SEQ ID NO: 3322499 - protein, 8 aa, Plasmodium falciparum
KLSGEQVK

SEQ ID NO: 3322500 - protein, 24 aa, Plasmodium falciparum
KLSGNNEQQNNSIPKSIQKPENCV

SEQ ID NO: 3322501 - protein, 6 aa, Plasmodium falciparum
KLSKAK

SEQ ID NO: 3322502 - protein, 6 aa, Plasmodium falciparum
KLSKNN

SEQ ID NO: 3322503 - protein, 13 aa, Plasmodium falciparum
KLSKNNNNDIDSL

SEQ ID NO: 3322504 - protein, 6 aa, Plasmodium falciparum
KLSKNT

SEQ ID NO: 3322505 - protein, 14 aa, Plasmodium falciparum
KLSKRDAPIFFTDI

SEQ ID NO: 3322506 - protein, 16 aa, Plasmodium falciparum
KLSNDTDNNSEDYPND

SEQ ID NO: 3322507 - protein, 7 aa, Plasmodium falciparum
KLSNEED

SEQ ID NO: 3322508 - protein, 7 aa, Plasmodium falciparum
KLSNESV

SEQ ID NO: 3322509 - protein, 10 aa, Plasmodium falciparum
KLSNNQNAKE

SEQ ID NO: 3322510 - protein, 32 aa, Plasmodium falciparum
KLSNPNNNVKAQQQGQQNKYNPNQKNDGQNNF

SEQ ID NO: 3322511 - protein, 4 aa, Plasmodium falciparum
KLSP

SEQ ID NO: 3322512 - protein, 12 aa, Plasmodium falciparum
KLSPEEAQKKAL

SEQ ID NO: 3322513 - protein, 6 aa, Plasmodium falciparum
KLSSDE

SEQ ID NO: 3322514 - protein, 10 aa, Plasmodium falciparum
KLSSDNYNIS

SEQ ID NO: 3322515 - protein, 8 aa, Plasmodium falciparum
KLSSEGKN

SEQ ID NO: 3322516 - protein, 12 aa, Plasmodium falciparum
KLSSEKPSSEKL

SEQ ID NO: 3322517 - protein, 7 aa, Plasmodium falciparum
KLSSLPN

SEQ ID NO: 3322518 - protein, 5 aa, Plasmodium falciparum
KLSSN

SEQ ID NO: 3322519 - protein, 10 aa, Plasmodium falciparum
KLSSYGTNSI

SEQ ID NO: 3322520 - protein, 43 aa, Plasmodium falciparum
KLSTKNSTNDSIKTPKKKSNNKNTKENNKKAPQKKTNDKLRRA

SEQ ID NO: 3322521 - protein, 15 aa, Plasmodium falciparum
KLSTTSDEVKNYSTN

SEQ ID NO: 3322522 - protein, 5 aa, Plasmodium falciparum
KLSYE

SEQ ID NO: 3322523 - protein, 4 aa, Plasmodium falciparum
KLTD

SEQ ID NO: 3322524 - protein, 6 aa, Plasmodium falciparum
KLTEEQ

SEQ ID NO: 3322525 - protein, 7 aa, Plasmodium falciparum
KLTEQPV

SEQ ID NO: 3322526 - protein, 28 aa, Plasmodium falciparum
KLTKENNNQVETDNLNGDVEKKKPWTHE

SEQ ID NO: 3322527 - protein, 15 aa, Plasmodium falciparum
KLTKSYKDDDKEEYI

SEQ ID NO: 3322528 - protein, 4 aa, Plasmodium falciparum
KLTN

SEQ ID NO: 3322529 - protein, 6 aa, Plasmodium falciparum
KLTNEE

SEQ ID NO: 3322530 - protein, 6 aa, Plasmodium falciparum
KLTNGE

SEQ ID NO: 3322531 - protein, 14 aa, Plasmodium falciparum
KLTNKAVSKYKSNK

SEQ ID NO: 3322532 - protein, 5 aa, Plasmodium falciparum
KLTPR

SEQ ID NO: 3322533 - protein, 5 aa, Plasmodium falciparum
KLTSE

SEQ ID NO: 3322534 - protein, 10 aa, Plasmodium falciparum
KLTSKDLDDE

SEQ ID NO: 3322535 - protein, 7 aa, Plasmodium falciparum
KLTTDDV

SEQ ID NO: 3322536 - protein, 21 aa, Plasmodium falciparum
KLTTNENKSNEADTLEKTNRN

SEQ ID NO: 3322537 - protein, 12 aa, Plasmodium falciparum
KLYNDKDPLADT

SEQ ID NO: 3322538 - protein, 6 aa, Plasmodium falciparum
KLYQNN

SEQ ID NO: 3322539 - protein, 25 aa, Plasmodium falciparum
KLYTSGLRSDTKEKYGEIPSSNKNH

SEQ ID NO: 3322540 - protein, 97 aa, Plasmodium falciparum
KMASRRSYNRRRKKKKYSDDEDEFDEEEYEGEDDDNSGDDDDDDDDNDDDDDDDDDNDDDDNDDDDNDDDDNDDDSGDDNDDDNDDDNDDDYTNDDN

SEQ ID NO: 3322541 - protein, 57 aa, Plasmodium falciparum
KMDDNKNNSSKDEEDTNNEDDTLEPDNSIHDNNNNNNNNNNNINNNINNNNNNNEYN

SEQ ID NO: 3322542 - protein, 4 aa, Plasmodium falciparum
KMDE

SEQ ID NO: 3322543 - protein, 29 aa, Plasmodium falciparum
KMDEQKKEINKNNEKGEFNEKGEDIKEKG

SEQ ID NO: 3322544 - protein, 8 aa, Plasmodium falciparum
KMDGGGNV

SEQ ID NO: 3322545 - protein, 6 aa, Plasmodium falciparum
KMDKER

SEQ ID NO: 3322546 - protein, 5 aa, Plasmodium falciparum
KMDNT

SEQ ID NO: 3322547 - protein, 16 aa, Plasmodium falciparum
KMDSSDKFKRTKETSY

SEQ ID NO: 3322548 - protein, 9 aa, Plasmodium falciparum
KMEDNTPKD

SEQ ID NO: 3322549 - protein, 5 aa, Plasmodium falciparum
KMEED

SEQ ID NO: 3322550 - protein, 25 aa, Plasmodium falciparum
KMEEEDTDKEKIKMEDEGVEREKNK

SEQ ID NO: 3322551 - protein, 46 aa, Plasmodium falciparum
KMEEEKKKKEEEKKKMEEEKKKMEEEKKKKEEEKKKREEEKKKEEM

SEQ ID NO: 3322552 - protein, 9 aa, Plasmodium falciparum
KMEEPKKDS

SEQ ID NO: 3322553 - protein, 56 aa, Plasmodium falciparum
KMEEQGTTQLKDNNINGGDDDDDDNDNDNDDNDDNDANNNDNNNDDGIKRTNSRSH

SEQ ID NO: 3322554 - protein, 8 aa, Plasmodium falciparum
KMEGGPPI

SEQ ID NO: 3322555 - protein, 8 aa, Plasmodium falciparum
KMEGGTYD

SEQ ID NO: 3322556 - protein, 6 aa, Plasmodium falciparum
KMEGKG

SEQ ID NO: 3322557 - protein, 7 aa, Plasmodium falciparum
KMEGTKD

SEQ ID NO: 3322558 - protein, 4 aa, Plasmodium falciparum
KMEK

SEQ ID NO: 3322559 - protein, 10 aa, Plasmodium falciparum
KMEKKENIEK

SEQ ID NO: 3322560 - protein, 7 aa, Plasmodium falciparum
KMEPQNY

SEQ ID NO: 3322561 - protein, 37 aa, Plasmodium falciparum
KMGKTKGNKEKGNKGKEEDKDKDKHKDKDKSKEKEKD

SEQ ID NO: 3322562 - protein, 9 aa, Plasmodium falciparum
KMGNDENRK

SEQ ID NO: 3322563 - protein, 6 aa, Plasmodium falciparum
KMGNNI

SEQ ID NO: 3322564 - protein, 7 aa, Plasmodium falciparum
KMGSEKN

SEQ ID NO: 3322565 - protein, 13 aa, Plasmodium falciparum
KMGSQDKNQNSNN

SEQ ID NO: 3322566 - protein, 6 aa, Plasmodium falciparum
KMGSTM

SEQ ID NO: 3322567 - protein, 9 aa, Plasmodium falciparum
KMGTENNNK

SEQ ID NO: 3322568 - protein, 32 aa, Plasmodium falciparum
KMGTGTTSNTAINTNTTTNTTTTNNNNNNNKL

SEQ ID NO: 3322569 - protein, 7 aa, Plasmodium falciparum
KMHESKS

SEQ ID NO: 3322570 - protein, 13 aa, Plasmodium falciparum
KMIKESKQKDNYN

SEQ ID NO: 3322571 - protein, 4 aa, Plasmodium falciparum
KMIP

SEQ ID NO: 3322572 - protein, 4 aa, Plasmodium falciparum
KMKD

SEQ ID NO: 3322573 - protein, 17 aa, Plasmodium falciparum
KMKEQENKLTYINNTAD

SEQ ID NO: 3322574 - protein, 12 aa, Plasmodium falciparum
KMKNENDKEEAN

SEQ ID NO: 3322575 - protein, 11 aa, Plasmodium falciparum
KMKNSKKNKYE

SEQ ID NO: 3322576 - protein, 5 aa, Plasmodium falciparum
KMKRR

SEQ ID NO: 3322577 - protein, 8 aa, Plasmodium falciparum
KMKTAKKN

SEQ ID NO: 3322578 - protein, 5 aa, Plasmodium falciparum
KMLKE

SEQ ID NO: 3322579 - protein, 10 aa, Plasmodium falciparum
KMNAGSYTPY

SEQ ID NO: 3322580 - protein, 11 aa, Plasmodium falciparum
KMNEDSKNNNL

SEQ ID NO: 3322581 - protein, 5 aa, Plasmodium falciparum
KMNEE

SEQ ID NO: 3322582 - protein, 7 aa, Plasmodium falciparum
KMNEKKK

SEQ ID NO: 3322583 - protein, 8 aa, Plasmodium falciparum
KMNENPSI

SEQ ID NO: 3322584 - protein, 10 aa, Plasmodium falciparum
KMNETSSNVE

SEQ ID NO: 3322585 - protein, 4 aa, Plasmodium falciparum
KMNI

SEQ ID NO: 3322586 - protein, 6 aa, Plasmodium falciparum
KMNKNK

SEQ ID NO: 3322587 - protein, 15 aa, Plasmodium falciparum
KMNNKIKNHKNNNMN

SEQ ID NO: 3322588 - protein, 10 aa, Plasmodium falciparum
KMNNKKEDKQ

SEQ ID NO: 3322589 - protein, 5 aa, Plasmodium falciparum
KMNNN

SEQ ID NO: 3322590 - protein, 7 aa, Plasmodium falciparum
KMNNNNN

SEQ ID NO: 3322591 - protein, 10 aa, Plasmodium falciparum
KMNNSEDPIK

SEQ ID NO: 3322592 - protein, 8 aa, Plasmodium falciparum
KMNNSNNL

SEQ ID NO: 3322593 - protein, 20 aa, Plasmodium falciparum
KMNNVNNKNFNKNMDNNNIT

SEQ ID NO: 3322594 - protein, 6 aa, Plasmodium falciparum
KMNPQF

SEQ ID NO: 3322595 - protein, 18 aa, Plasmodium falciparum
KMNPSNNKEENNTTTLHP

SEQ ID NO: 3322596 - protein, 5 aa, Plasmodium falciparum
KMNQE

SEQ ID NO: 3322597 - protein, 19 aa, Plasmodium falciparum
KMNQHSNNEMNQNSNNKMN

SEQ ID NO: 3322598 - protein, 5 aa, Plasmodium falciparum
KMNQN

SEQ ID NO: 3322599 - protein, 11 aa, Plasmodium falciparum
KMNQPKRYTTS

SEQ ID NO: 3322600 - protein, 4 aa, Plasmodium falciparum
KMNS

SEQ ID NO: 3322601 - protein, 98 aa, Plasmodium falciparum
KMNSTNSDHHYDDEDEEDDDDDEEDDDVDDDDDDDDEEEDDVDDDEEDDDDDDDEDDDDDDEDDEDDEDDENDDNENENDNENENDNDDDGENDQYRH

SEQ ID NO: 3322602 - protein, 12 aa, Plasmodium falciparum
KMNTNNRSIDER

SEQ ID NO: 3322603 - protein, 11 aa, Plasmodium falciparum
KMNTTDSINTS

SEQ ID NO: 3322604 - protein, 18 aa, Plasmodium falciparum
KMPNDEDQGDQDNIKREY

SEQ ID NO: 3322605 - protein, 8 aa, Plasmodium falciparum
KMPPVQNG

SEQ ID NO: 3322606 - protein, 6 aa, Plasmodium falciparum
KMQGRG

SEQ ID NO: 3322607 - protein, 6 aa, Plasmodium falciparum
KMRQED

SEQ ID NO: 3322608 - protein, 5 aa, Plasmodium falciparum
KMSDD

SEQ ID NO: 3322609 - protein, 9 aa, Plasmodium falciparum
KMSDNMSDK

SEQ ID NO: 3322610 - protein, 11 aa, Plasmodium falciparum
KMSKEKKKREN

SEQ ID NO: 3322611 - protein, 18 aa, Plasmodium falciparum
KMSKKTKNLERTSAKEFN

SEQ ID NO: 3322612 - protein, 21 aa, Plasmodium falciparum
KMSKSTKGRKPKDKNLSQPNV

SEQ ID NO: 3322613 - protein, 5 aa, Plasmodium falciparum
KMSQK

SEQ ID NO: 3322614 - protein, 9 aa, Plasmodium falciparum
KMSSENLSY

SEQ ID NO: 3322615 - protein, 5 aa, Plasmodium falciparum
KMSSS

SEQ ID NO: 3322616 - protein, 6 aa, Plasmodium falciparum
KMSTSN

SEQ ID NO: 3322617 - protein, 6 aa, Plasmodium falciparum
KMYDAD

SEQ ID NO: 3322618 - protein, 32 aa, Plasmodium falciparum
KMYDPNNDNNNNNNNNNDNNSNNNDNDNNDNH

SEQ ID NO: 3322619 - protein, 6 aa, Plasmodium falciparum
KMYEDR

SEQ ID NO: 3322620 - protein, 12 aa, Plasmodium falciparum
KMYKSNKLNRGN

SEQ ID NO: 3322621 - protein, 4 aa, Plasmodium falciparum
KMYN

SEQ ID NO: 3322622 - protein, 5 aa, Plasmodium falciparum
KMYRN

SEQ ID NO: 3322623 - protein, 5 aa, Plasmodium falciparum
KMYSN

SEQ ID NO: 3322624 - protein, 7 aa, Plasmodium falciparum
KNADESI

SEQ ID NO: 3322625 - protein, 7 aa, Plasmodium falciparum
KNADGVQ

SEQ ID NO: 3322626 - protein, 8 aa, Plasmodium falciparum
KNADVEKK

SEQ ID NO: 3322627 - protein, 10 aa, Plasmodium falciparum
KNAEGYDDTV

SEQ ID NO: 3322628 - protein, 12 aa, Plasmodium falciparum
KNAEKKKKNINK

SEQ ID NO: 3322629 - protein, 11 aa, Plasmodium falciparum
KNAENISPNTT

SEQ ID NO: 3322630 - protein, 7 aa, Plasmodium falciparum
KNAEQSN

SEQ ID NO: 3322631 - protein, 22 aa, Plasmodium falciparum
KNAEVKKKKNTLRKKKKKEKKN

SEQ ID NO: 3322632 - protein, 7 aa, Plasmodium falciparum
KNAFTND

SEQ ID NO: 3322633 - protein, 17 aa, Plasmodium falciparum
KNAGHKQTKNKNGEAKN

SEQ ID NO: 3322634 - protein, 4 aa, Plasmodium falciparum
KNAI

SEQ ID NO: 3322635 - protein, 6 aa, Plasmodium falciparum
KNAKNR

SEQ ID NO: 3322636 - protein, 9 aa, Plasmodium falciparum
KNAKYNPEQ

SEQ ID NO: 3322637 - protein, 8 aa, Plasmodium falciparum
KNALRQKQ

SEQ ID NO: 3322638 - protein, 13 aa, Plasmodium falciparum
KNANDKSTEKTKP

SEQ ID NO: 3322639 - protein, 8 aa, Plasmodium falciparum
KNANDPDN

SEQ ID NO: 3322640 - protein, 9 aa, Plasmodium falciparum
KNANINDTK

SEQ ID NO: 3322641 - protein, 10 aa, Plasmodium falciparum
KNANKKSLGN

SEQ ID NO: 3322642 - protein, 7 aa, Plasmodium falciparum
KNANKNV

SEQ ID NO: 3322643 - protein, 9 aa, Plasmodium falciparum
KNANNNNKY

SEQ ID NO: 3322644 - protein, 6 aa, Plasmodium falciparum
KNANRK

SEQ ID NO: 3322645 - protein, 9 aa, Plasmodium falciparum
KNANSTNKN

SEQ ID NO: 3322646 - protein, 7 aa, Plasmodium falciparum
KNAPIKP

SEQ ID NO: 3322647 - protein, 20 aa, Plasmodium falciparum
KNAPNNMSNNNNNNNNNNNV

SEQ ID NO: 3322648 - protein, 37 aa, Plasmodium falciparum
KNAQNERVTLEGGKKHHKSTREKKKNKRKRKNNNKIN

SEQ ID NO: 3322649 - protein, 5 aa, Plasmodium falciparum
KNARE

SEQ ID NO: 3322650 - protein, 6 aa, Plasmodium falciparum
KNARKR

SEQ ID NO: 3322651 - protein, 18 aa, Plasmodium falciparum
KNARSNNPYPNPMQFKKR

SEQ ID NO: 3322652 - protein, 19 aa, Plasmodium falciparum
KNASDIQNSDSKKKRKQEK

SEQ ID NO: 3322653 - protein, 10 aa, Plasmodium falciparum
KNASDKKSGI

SEQ ID NO: 3322654 - protein, 6 aa, Plasmodium falciparum
KNASKK

SEQ ID NO: 3322655 - protein, 17 aa, Plasmodium falciparum
KNASKKTNWNTYYIRME

SEQ ID NO: 3322656 - protein, 25 aa, Plasmodium falciparum
KNASSDNTNINNSMNSSMNSSMNTK

SEQ ID NO: 3322657 - protein, 7 aa, Plasmodium falciparum
KNASTNN

SEQ ID NO: 3322658 - protein, 10 aa, Plasmodium falciparum
KNATKSEQQK

SEQ ID NO: 3322659 - protein, 28 aa, Plasmodium falciparum
KNATPSKLNPLKNKTNKSSNNHRNNEGG

SEQ ID NO: 3322660 - protein, 5 aa, Plasmodium falciparum
KNATS

SEQ ID NO: 3322661 - protein, 21 aa, Plasmodium falciparum
KNATTTSNNNNNMKKNNNMNN

SEQ ID NO: 3322662 - protein, 6 aa, Plasmodium falciparum
KNAYRD

SEQ ID NO: 3322663 - protein, 9 aa, Plasmodium falciparum
KNCDDTGPL

SEQ ID NO: 3322664 - protein, 11 aa, Plasmodium falciparum
KNCDDTRRKRE

SEQ ID NO: 3322665 - protein, 26 aa, Plasmodium falciparum
KNCGNNNDNNNNNNNNNNNNNKCSNN

SEQ ID NO: 3322666 - protein, 5 aa, Plasmodium falciparum
KNCNT

SEQ ID NO: 3322667 - protein, 4 aa, Plasmodium falciparum
KNCP

SEQ ID NO: 3322668 - protein, 22 aa, Plasmodium falciparum
KNCPNDRDEEESFYEDDSSNEY

SEQ ID NO: 3322669 - protein, 6 aa, Plasmodium falciparum
KNCQDD

SEQ ID NO: 3322670 - protein, 7 aa, Plasmodium falciparum
KNCTQDN

SEQ ID NO: 3322671 - protein, 7 aa, Plasmodium falciparum
KNDANKM

SEQ ID NO: 3322672 - protein, 4 aa, Plasmodium falciparum
KNDD

SEQ ID NO: 3322673 - protein, 5 aa, Plasmodium falciparum
KNDDD

SEQ ID NO: 3322674 - protein, 16 aa, Plasmodium falciparum
KNDDDEDDGNNTDNSK

SEQ ID NO: 3322675 - protein, 17 aa, Plasmodium falciparum
KNDDEHVSQQGEESSYM

SEQ ID NO: 3322676 - protein, 16 aa, Plasmodium falciparum
KNDDFSLESTSNNFGS

SEQ ID NO: 3322677 - protein, 5 aa, Plasmodium falciparum
KNDDH

SEQ ID NO: 3322678 - protein, 6 aa, Plasmodium falciparum
KNDDIS

SEQ ID NO: 3322679 - protein, 12 aa, Plasmodium falciparum
KNDDKFNDHKDE

SEQ ID NO: 3322680 - protein, 7 aa, Plasmodium falciparum
KNDDKIK

SEQ ID NO: 3322681 - protein, 13 aa, Plasmodium falciparum
KNDDKNMNDIQSQ

SEQ ID NO: 3322682 - protein, 11 aa, Plasmodium falciparum
KNDDKTKCAHN

SEQ ID NO: 3322683 - protein, 7 aa, Plasmodium falciparum
KNDDKYE

SEQ ID NO: 3322684 - protein, 13 aa, Plasmodium falciparum
KNDDMDDDDNNNM

SEQ ID NO: 3322685 - protein, 59 aa, Plasmodium falciparum
KNDDMQDDKYETSKNSDQHNDNERNGNIYNNDDNNDDDNNDDDNNNNNNDNNNDEEEDN

SEQ ID NO: 3322686 - protein, 8 aa, Plasmodium falciparum
KNDDNCDT

SEQ ID NO: 3322687 - protein, 8 aa, Plasmodium falciparum
KNDDNGGN

SEQ ID NO: 3322688 - protein, 15 aa, Plasmodium falciparum
KNDDNIGISSKNNIQ

SEQ ID NO: 3322689 - protein, 13 aa, Plasmodium falciparum
KNDDNKKGNDNSI

SEQ ID NO: 3322690 - protein, 15 aa, Plasmodium falciparum
KNDDNNNNNNNKSNI

SEQ ID NO: 3322691 - protein, 15 aa, Plasmodium falciparum
KNDDQKNINKDETYK

SEQ ID NO: 3322692 - protein, 10 aa, Plasmodium falciparum
KNDDRSNVNP

SEQ ID NO: 3322693 - protein, 16 aa, Plasmodium falciparum
KNDDSTMSSSVEAAND

SEQ ID NO: 3322694 - protein, 42 aa, Plasmodium falciparum
KNDDVEGGSIKNEIKKKKTHINNNDNNNNNNNNNNNGNNNNI

SEQ ID NO: 3322695 - protein, 28 aa, Plasmodium falciparum
KNDEDDDDDDDNSVDAKYNNNNDDDNAI

SEQ ID NO: 3322696 - protein, 11 aa, Plasmodium falciparum
KNDEDNKDISD

SEQ ID NO: 3322697 - protein, 5 aa, Plasmodium falciparum
KNDEE

SEQ ID NO: 3322698 - protein, 6 aa, Plasmodium falciparum
KNDEEE

SEQ ID NO: 3322699 - protein, 29 aa, Plasmodium falciparum
KNDEEGEVEEEDENENEQQQQQQQYQSNL

SEQ ID NO: 3322700 - protein, 16 aa, Plasmodium falciparum
KNDEEGKVKKGTLNRI

SEQ ID NO: 3322701 - protein, 12 aa, Plasmodium falciparum
KNDEEKHNEEGQ

SEQ ID NO: 3322702 - protein, 10 aa, Plasmodium falciparum
KNDEENEDSQ

SEQ ID NO: 3322703 - protein, 8 aa, Plasmodium falciparum
KNDEENKT

SEQ ID NO: 3322704 - protein, 9 aa, Plasmodium falciparum
KNDEGHDNK

SEQ ID NO: 3322705 - protein, 7 aa, Plasmodium falciparum
KNDEGNK

SEQ ID NO: 3322706 - protein, 5 aa, Plasmodium falciparum
KNDEI

SEQ ID NO: 3322707 - protein, 6 aa, Plasmodium falciparum
KNDEIK

SEQ ID NO: 3322708 - protein, 5 aa, Plasmodium falciparum
KNDEK

SEQ ID NO: 3322709 - protein, 18 aa, Plasmodium falciparum
KNDEKDEEKNKKSNKINN

SEQ ID NO: 3322710 - protein, 8 aa, Plasmodium falciparum
KNDEKKFS

SEQ ID NO: 3322711 - protein, 7 aa, Plasmodium falciparum
KNDENAA

SEQ ID NO: 3322712 - protein, 8 aa, Plasmodium falciparum
KNDENASH

SEQ ID NO: 3322713 - protein, 23 aa, Plasmodium falciparum
KNDENKDGTKNKHMENKNNKVYN

SEQ ID NO: 3322714 - protein, 15 aa, Plasmodium falciparum
KNDENVSNKKKISAH

SEQ ID NO: 3322715 - protein, 6 aa, Plasmodium falciparum
KNDEPV

SEQ ID NO: 3322716 - protein, 9 aa, Plasmodium falciparum
KNDEQSKCA

SEQ ID NO: 3322717 - protein, 41 aa, Plasmodium falciparum
KNDESNKYNLSNKQHHNRYSNKTFEKDEKQKKDYYKKNNDK

SEQ ID NO: 3322718 - protein, 10 aa, Plasmodium falciparum
KNDETKRIYT

SEQ ID NO: 3322719 - protein, 94 aa, Plasmodium falciparum
KNDEVEKNDEVEKNDEVEKNDEVEKNDEVEKNDEVEKNDEVEKNDEVEKNDEVERNDEVERNDMAERNDMSERNDMAERNDMAEKNNDDVKVPE

SEQ ID NO: 3322720 - protein, 5 aa, Plasmodium falciparum
KNDEY

SEQ ID NO: 3322721 - protein, 7 aa, Plasmodium falciparum
KNDFNKD

SEQ ID NO: 3322722 - protein, 12 aa, Plasmodium falciparum
KNDFQKKKQDKN

SEQ ID NO: 3322723 - protein, 7 aa, Plasmodium falciparum
KNDGDNY

SEQ ID NO: 3322724 - protein, 37 aa, Plasmodium falciparum
KNDGLDKDALKEGKSNNTTNNNLDNNNNMERSNYQNN

SEQ ID NO: 3322725 - protein, 14 aa, Plasmodium falciparum
KNDGNVEKVETSGV

SEQ ID NO: 3322726 - protein, 5 aa, Plasmodium falciparum
KNDHK

SEQ ID NO: 3322727 - protein, 21 aa, Plasmodium falciparum
KNDHRKVEKNNIEENTNSQMC

SEQ ID NO: 3322728 - protein, 4 aa, Plasmodium falciparum
KNDI

SEQ ID NO: 3322729 - protein, 13 aa, Plasmodium falciparum
KNDIEKYDKSLFI

SEQ ID NO: 3322730 - protein, 7 aa, Plasmodium falciparum
KNDIENV

SEQ ID NO: 3322731 - protein, 5 aa, Plasmodium falciparum
KNDIK

SEQ ID NO: 3322732 - protein, 14 aa, Plasmodium falciparum
KNDIKSNKDNNLSD

SEQ ID NO: 3322733 - protein, 6 aa, Plasmodium falciparum
KNDINE

SEQ ID NO: 3322734 - protein, 7 aa, Plasmodium falciparum
KNDINKE

SEQ ID NO: 3322735 - protein, 13 aa, Plasmodium falciparum
KNDINNDNSINKN

SEQ ID NO: 3322736 - protein, 5 aa, Plasmodium falciparum
KNDIP

SEQ ID NO: 3322737 - protein, 14 aa, Plasmodium falciparum
KNDIPKQTENNKIN

SEQ ID NO: 3322738 - protein, 7 aa, Plasmodium falciparum
KNDIPNN

SEQ ID NO: 3322739 - protein, 6 aa, Plasmodium falciparum
KNDIQE

SEQ ID NO: 3322740 - protein, 33 aa, Plasmodium falciparum
KNDIQKNEHYNNGYNNKQNMSPSNNSLNDRNNN

SEQ ID NO: 3322741 - protein, 7 aa, Plasmodium falciparum
KNDISKD

SEQ ID NO: 3322742 - protein, 26 aa, Plasmodium falciparum
KNDISSETTKEEKNTEHKKEETEKKK

SEQ ID NO: 3322743 - protein, 6 aa, Plasmodium falciparum
KNDITN

SEQ ID NO: 3322744 - protein, 20 aa, Plasmodium falciparum
KNDITSNDIHSQKDDNEDYI

SEQ ID NO: 3322745 - protein, 8 aa, Plasmodium falciparum
KNDKAYQS

SEQ ID NO: 3322746 - protein, 7 aa, Plasmodium falciparum
KNDKDRF

SEQ ID NO: 3322747 - protein, 10 aa, Plasmodium falciparum
KNDKERLNDD

SEQ ID NO: 3322748 - protein, 9 aa, Plasmodium falciparum
KNDKESTQI

SEQ ID NO: 3322749 - protein, 11 aa, Plasmodium falciparum
KNDKIGEGNES

SEQ ID NO: 3322750 - protein, 6 aa, Plasmodium falciparum
KNDKIP

SEQ ID NO: 3322751 - protein, 9 aa, Plasmodium falciparum
KNDKKAKAI

SEQ ID NO: 3322752 - protein, 17 aa, Plasmodium falciparum
KNDKKEKKKKKKKQKKI

SEQ ID NO: 3322753 - protein, 12 aa, Plasmodium falciparum
KNDKKKNNDENI

SEQ ID NO: 3322754 - protein, 6 aa, Plasmodium falciparum
KNDKKN

SEQ ID NO: 3322755 - protein, 6 aa, Plasmodium falciparum
KNDKNI

SEQ ID NO: 3322756 - protein, 8 aa, Plasmodium falciparum
KNDKNKNI

SEQ ID NO: 3322757 - protein, 5 aa, Plasmodium falciparum
KNDKQ

SEQ ID NO: 3322758 - protein, 6 aa, Plasmodium falciparum
KNDKQT

SEQ ID NO: 3322759 - protein, 6 aa, Plasmodium falciparum
KNDKRK

SEQ ID NO: 3322760 - protein, 53 aa, Plasmodium falciparum
KNDKTKEKTNDKTNEKVSEKTNDKINDKINEKTNEKTNEKTNETNNNVPKKKV

SEQ ID NO: 3322761 - protein, 5 aa, Plasmodium falciparum
KNDLD

SEQ ID NO: 3322762 - protein, 9 aa, Plasmodium falciparum
KNDLRNSNQ

SEQ ID NO: 3322763 - protein, 6 aa, Plasmodium falciparum
KNDLSR

SEQ ID NO: 3322764 - protein, 5 aa, Plasmodium falciparum
KNDLY

SEQ ID NO: 3322765 - protein, 8 aa, Plasmodium falciparum
KNDMEKEK

SEQ ID NO: 3322766 - protein, 5 aa, Plasmodium falciparum
KNDMR

SEQ ID NO: 3322767 - protein, 5 aa, Plasmodium falciparum
KNDMV

SEQ ID NO: 3322768 - protein, 4 aa, Plasmodium falciparum
KNDN

SEQ ID NO: 3322769 - protein, 8 aa, Plasmodium falciparum
KNDNDFNN

SEQ ID NO: 3322770 - protein, 9 aa, Plasmodium falciparum
KNDNESKDI

SEQ ID NO: 3322771 - protein, 6 aa, Plasmodium falciparum
KNDNHK

SEQ ID NO: 3322772 - protein, 6 aa, Plasmodium falciparum
KNDNID

SEQ ID NO: 3322773 - protein, 15 aa, Plasmodium falciparum
KNDNKFNKNSSSSNI

SEQ ID NO: 3322774 - protein, 10 aa, Plasmodium falciparum
KNDNKKEKLS

SEQ ID NO: 3322775 - protein, 81 aa, Plasmodium falciparum
KNDNKNGDNKSDDDNKNGDDNKNGDDNKNGDDNKNGDDNKNGDDNKSGDDNKSDDDNKNGDDNKNGDDNKSDDDNKSDDGN

SEQ ID NO: 3322776 - protein, 26 aa, Plasmodium falciparum
KNDNKNIMKGSSNKSMKKNNKNSNKM

SEQ ID NO: 3322777 - protein, 18 aa, Plasmodium falciparum
KNDNKYDYDDNQNGFSTT

SEQ ID NO: 3322778 - protein, 7 aa, Plasmodium falciparum
KNDNLEN

SEQ ID NO: 3322779 - protein, 15 aa, Plasmodium falciparum
KNDNLSNKLKNNKNN

SEQ ID NO: 3322780 - protein, 6 aa, Plasmodium falciparum
KNDNMK

SEQ ID NO: 3322781 - protein, 38 aa, Plasmodium falciparum
KNDNNENNNNNNNNNNNNNNNNNNNNNNNNNNSSSSSF

SEQ ID NO: 3322782 - protein, 11 aa, Plasmodium falciparum
KNDNNHNNNNI

SEQ ID NO: 3322783 - protein, 8 aa, Plasmodium falciparum
KNDNNIDN

SEQ ID NO: 3322784 - protein, 7 aa, Plasmodium falciparum
KNDNNKY

SEQ ID NO: 3322785 - protein, 15 aa, Plasmodium falciparum
KNDNNNNNNNKNNTY

SEQ ID NO: 3322786 - protein, 16 aa, Plasmodium falciparum
KNDNNRNNDDYYDNSE

SEQ ID NO: 3322787 - protein, 15 aa, Plasmodium falciparum
KNDNNVDKKNNDENN

SEQ ID NO: 3322788 - protein, 20 aa, Plasmodium falciparum
KNDNRENQSYTSDLKEQRKV

SEQ ID NO: 3322789 - protein, 7 aa, Plasmodium falciparum
KNDNTQD

SEQ ID NO: 3322790 - protein, 26 aa, Plasmodium falciparum
KNDNYEHAEYSEQNCNDENDTENNYN

SEQ ID NO: 3322791 - protein, 6 aa, Plasmodium falciparum
KNDPCA

SEQ ID NO: 3322792 - protein, 7 aa, Plasmodium falciparum
KNDPIND

SEQ ID NO: 3322793 - protein, 7 aa, Plasmodium falciparum
KNDPNFK

SEQ ID NO: 3322794 - protein, 6 aa, Plasmodium falciparum
KNDPNI

SEQ ID NO: 3322795 - protein, 14 aa, Plasmodium falciparum
KNDPNIESADDART

SEQ ID NO: 3322796 - protein, 33 aa, Plasmodium falciparum
KNDQAHNNNNNNNNNTNNMTNGNISNNANSQNI

SEQ ID NO: 3322797 - protein, 6 aa, Plasmodium falciparum
KNDQCN

SEQ ID NO: 3322798 - protein, 7 aa, Plasmodium falciparum
KNDQDDL

SEQ ID NO: 3322799 - protein, 8 aa, Plasmodium falciparum
KNDQDYST

SEQ ID NO: 3322800 - protein, 5 aa, Plasmodium falciparum
KNDQK

SEQ ID NO: 3322801 - protein, 8 aa, Plasmodium falciparum
KNDQLSNV

SEQ ID NO: 3322802 - protein, 8 aa, Plasmodium falciparum
KNDQNKDN

SEQ ID NO: 3322803 - protein, 6 aa, Plasmodium falciparum
KNDQSM

SEQ ID NO: 3322804 - protein, 7 aa, Plasmodium falciparum
KNDQSNM

SEQ ID NO: 3322805 - protein, 5 aa, Plasmodium falciparum
KNDQT

SEQ ID NO: 3322806 - protein, 16 aa, Plasmodium falciparum
KNDQVMNKSGETSTGF

SEQ ID NO: 3322807 - protein, 28 aa, Plasmodium falciparum
KNDRKDKITINDSENNDISYNSEGDEVH

SEQ ID NO: 3322808 - protein, 7 aa, Plasmodium falciparum
KNDRNRM

SEQ ID NO: 3322809 - protein, 15 aa, Plasmodium falciparum
KNDRNVSYEEGKELA

SEQ ID NO: 3322810 - protein, 6 aa, Plasmodium falciparum
KNDSDI

SEQ ID NO: 3322811 - protein, 5 aa, Plasmodium falciparum
KNDSE

SEQ ID NO: 3322812 - protein, 5 aa, Plasmodium falciparum
KNDSI

SEQ ID NO: 3322813 - protein, 11 aa, Plasmodium falciparum
KNDSINKKNNF

SEQ ID NO: 3322814 - protein, 8 aa, Plasmodium falciparum
KNDSIYDG

SEQ ID NO: 3322815 - protein, 7 aa, Plasmodium falciparum
KNDSKDI

SEQ ID NO: 3322816 - protein, 11 aa, Plasmodium falciparum
KNDSLEEQMSN

SEQ ID NO: 3322817 - protein, 27 aa, Plasmodium falciparum
KNDSLGKKTKNDKNSNQDNAPEIDDNE

SEQ ID NO: 3322818 - protein, 7 aa, Plasmodium falciparum
KNDSNMC

SEQ ID NO: 3322819 - protein, 18 aa, Plasmodium falciparum
KNDSNSNSHSSNGSSKTL

SEQ ID NO: 3322820 - protein, 8 aa, Plasmodium falciparum
KNDSSEDS

SEQ ID NO: 3322821 - protein, 5 aa, Plasmodium falciparum
KNDSY

SEQ ID NO: 3322822 - protein, 11 aa, Plasmodium falciparum
KNDTENNKIKK

SEQ ID NO: 3322823 - protein, 11 aa, Plasmodium falciparum
KNDTHNNDITS

SEQ ID NO: 3322824 - protein, 6 aa, Plasmodium falciparum
KNDTIT

SEQ ID NO: 3322825 - protein, 21 aa, Plasmodium falciparum
KNDTKTGKQNDTNNVYDKENL

SEQ ID NO: 3322826 - protein, 9 aa, Plasmodium falciparum
KNDTQFNNY

SEQ ID NO: 3322827 - protein, 22 aa, Plasmodium falciparum
KNDTQYNENTKNEMNKKSPYTR

SEQ ID NO: 3322828 - protein, 5 aa, Plasmodium falciparum
KNDVD

SEQ ID NO: 3322829 - protein, 4 aa, Plasmodium falciparum
KNDW

SEQ ID NO: 3322830 - protein, 63 aa, Plasmodium falciparum
KNDYDDEQEADDEEEDDDDDDDYDNDDDDEYKEYENDNGNDNYDEADSDHNNYNNTNENYHDD

SEQ ID NO: 3322831 - protein, 10 aa, Plasmodium falciparum
KNDYDTTNLK

SEQ ID NO: 3322832 - protein, 19 aa, Plasmodium falciparum
KNDYKKEEMKKRGKQDISN

SEQ ID NO: 3322833 - protein, 7 aa, Plasmodium falciparum
KNDYNNL

SEQ ID NO: 3322834 - protein, 6 aa, Plasmodium falciparum
KNEAEN

SEQ ID NO: 3322835 - protein, 8 aa, Plasmodium falciparum
KNEANRIN

SEQ ID NO: 3322836 - protein, 5 aa, Plasmodium falciparum
KNEAS

SEQ ID NO: 3322837 - protein, 7 aa, Plasmodium falciparum
KNECEKE

SEQ ID NO: 3322838 - protein, 14 aa, Plasmodium falciparum
KNECKENKKSKYTQ

SEQ ID NO: 3322839 - protein, 13 aa, Plasmodium falciparum
KNECNNNQSMKDQ

SEQ ID NO: 3322840 - protein, 9 aa, Plasmodium falciparum
KNEDAKSNI

SEQ ID NO: 3322841 - protein, 7 aa, Plasmodium falciparum
KNEDDKL

SEQ ID NO: 3322842 - protein, 8 aa, Plasmodium falciparum
KNEDDVKP

SEQ ID NO: 3322843 - protein, 6 aa, Plasmodium falciparum
KNEDEE

SEQ ID NO: 3322844 - protein, 7 aa, Plasmodium falciparum
KNEDGEY

SEQ ID NO: 3322845 - protein, 7 aa, Plasmodium falciparum
KNEDGSI

SEQ ID NO: 3322846 - protein, 5 aa, Plasmodium falciparum
KNEDI

SEQ ID NO: 3322847 - protein, 26 aa, Plasmodium falciparum
KNEDIDNNNNNNDNNNDNDIYEKQSK

SEQ ID NO: 3322848 - protein, 6 aa, Plasmodium falciparum
KNEDIQ

SEQ ID NO: 3322849 - protein, 18 aa, Plasmodium falciparum
KNEDKNKGENLNEKQKNE

SEQ ID NO: 3322850 - protein, 20 aa, Plasmodium falciparum
KNEDNEKCHKNYNSKDNNNI

SEQ ID NO: 3322851 - protein, 19 aa, Plasmodium falciparum
KNEDNNDNNNDNNNDNYYN

SEQ ID NO: 3322852 - protein, 9 aa, Plasmodium falciparum
KNEDNSSKE

SEQ ID NO: 3322853 - protein, 7 aa, Plasmodium falciparum
KNEDPGY

SEQ ID NO: 3322854 - protein, 8 aa, Plasmodium falciparum
KNEDTANN

SEQ ID NO: 3322855 - protein, 7 aa, Plasmodium falciparum
KNEDTEK

SEQ ID NO: 3322856 - protein, 10 aa, Plasmodium falciparum
KNEEAKEKDF

SEQ ID NO: 3322857 - protein, 10 aa, Plasmodium falciparum
KNEEALKEEY

SEQ ID NO: 3322858 - protein, 14 aa, Plasmodium falciparum
KNEEDKKDSDKGKI

SEQ ID NO: 3322859 - protein, 10 aa, Plasmodium falciparum
KNEEDTFEGS

SEQ ID NO: 3322860 - protein, 22 aa, Plasmodium falciparum
KNEEEGYDDDTYTSERDKSMNE

SEQ ID NO: 3322861 - protein, 17 aa, Plasmodium falciparum
KNEEGKNSVSAYNGPEF

SEQ ID NO: 3322862 - protein, 7 aa, Plasmodium falciparum
KNEEIED

SEQ ID NO: 3322863 - protein, 27 aa, Plasmodium falciparum
KNEEISKMNEENQKVCTENKEKDNLLE

SEQ ID NO: 3322864 - protein, 14 aa, Plasmodium falciparum
KNEEKEKKRQEHLK

SEQ ID NO: 3322865 - protein, 20 aa, Plasmodium falciparum
KNEEKIKCPSSTKLGCSDGT

SEQ ID NO: 3322866 - protein, 10 aa, Plasmodium falciparum
KNEEKKEIND

SEQ ID NO: 3322867 - protein, 21 aa, Plasmodium falciparum
KNEEKQENKNNCLNEGEQQQG

SEQ ID NO: 3322868 - protein, 8 aa, Plasmodium falciparum
KNEEKTKT

SEQ ID NO: 3322869 - protein, 6 aa, Plasmodium falciparum
KNEELE

SEQ ID NO: 3322870 - protein, 6 aa, Plasmodium falciparum
KNEELN

SEQ ID NO: 3322871 - protein, 28 aa, Plasmodium falciparum
KNEELQNNNNNNKNNSNSNNNNNNNNNH

SEQ ID NO: 3322872 - protein, 7 aa, Plasmodium falciparum
KNEENAE

SEQ ID NO: 3322873 - protein, 8 aa, Plasmodium falciparum
KNEENDSK

SEQ ID NO: 3322874 - protein, 9 aa, Plasmodium falciparum
KNEENEQDK

SEQ ID NO: 3322875 - protein, 66 aa, Plasmodium falciparum
KNEENNKNKNDDDNKNDDDNKNDDDNNKNDDDNKNDDDDNKNDDDNKNDDDDNKNDDDDNNKNNIQ

SEQ ID NO: 3322876 - protein, 13 aa, Plasmodium falciparum
KNEENQEKKNKKK

SEQ ID NO: 3322877 - protein, 8 aa, Plasmodium falciparum
KNEENTHK

SEQ ID NO: 3322878 - protein, 7 aa, Plasmodium falciparum
KNEEQNI

SEQ ID NO: 3322879 - protein, 8 aa, Plasmodium falciparum
KNEEQYPT

SEQ ID NO: 3322880 - protein, 6 aa, Plasmodium falciparum
KNEERD

SEQ ID NO: 3322881 - protein, 10 aa, Plasmodium falciparum
KNEERERGKE

SEQ ID NO: 3322882 - protein, 9 aa, Plasmodium falciparum
KNEERNKSI

SEQ ID NO: 3322883 - protein, 5 aa, Plasmodium falciparum
KNEES

SEQ ID NO: 3322884 - protein, 7 aa, Plasmodium falciparum
KNEESSS

SEQ ID NO: 3322885 - protein, 14 aa, Plasmodium falciparum
KNEETKEKKKCAQN

SEQ ID NO: 3322886 - protein, 5 aa, Plasmodium falciparum
KNEEY

SEQ ID NO: 3322887 - protein, 7 aa, Plasmodium falciparum
KNEEYNN

SEQ ID NO: 3322888 - protein, 4 aa, Plasmodium falciparum
KNEG

SEQ ID NO: 3322889 - protein, 9 aa, Plasmodium falciparum
KNEGDQVSE

SEQ ID NO: 3322890 - protein, 8 aa, Plasmodium falciparum
KNEGIRKQ

SEQ ID NO: 3322891 - protein, 6 aa, Plasmodium falciparum
KNEGNM

SEQ ID NO: 3322892 - protein, 9 aa, Plasmodium falciparum
KNEGNYTNH

SEQ ID NO: 3322893 - protein, 8 aa, Plasmodium falciparum
KNEGYGKN

SEQ ID NO: 3322894 - protein, 4 aa, Plasmodium falciparum
KNEH

SEQ ID NO: 3322895 - protein, 8 aa, Plasmodium falciparum
KNEHGHEN

SEQ ID NO: 3322896 - protein, 22 aa, Plasmodium falciparum
KNEHHKTNKKSLKGGNERHEMK

SEQ ID NO: 3322897 - protein, 21 aa, Plasmodium falciparum
KNEHKEGNKSNTCKEQNYNIS

SEQ ID NO: 3322898 - protein, 12 aa, Plasmodium falciparum
KNEHLTKADTER

SEQ ID NO: 3322899 - protein, 12 aa, Plasmodium falciparum
KNEHNQNINNNY

SEQ ID NO: 3322900 - protein, 11 aa, Plasmodium falciparum
KNEHTKNYKNV

SEQ ID NO: 3322901 - protein, 4 aa, Plasmodium falciparum
KNEI

SEQ ID NO: 3322902 - protein, 65 aa, Plasmodium falciparum
KNEIKDEAKGEVKDEAKGEVKDEAKGEVKDEAKDEIKDEAKDEAKDEAKDEAKDEAKEEQEEDQL

SEQ ID NO: 3322903 - protein, 32 aa, Plasmodium falciparum
KNEIKKNNKLTNKKKENINKHKNEKQQQTLNV

SEQ ID NO: 3322904 - protein, 5 aa, Plasmodium falciparum
KNEIN

SEQ ID NO: 3322905 - protein, 21 aa, Plasmodium falciparum
KNEINEKNVNTTHNREKDTLN

SEQ ID NO: 3322906 - protein, 14 aa, Plasmodium falciparum
KNEINRKGSNNSNI

SEQ ID NO: 3322907 - protein, 7 aa, Plasmodium falciparum
KNEINTD

SEQ ID NO: 3322908 - protein, 7 aa, Plasmodium falciparum
KNEIQRK

SEQ ID NO: 3322909 - protein, 9 aa, Plasmodium falciparum
KNEKDIKTI

SEQ ID NO: 3322910 - protein, 6 aa, Plasmodium falciparum
KNEKDK

SEQ ID NO: 3322911 - protein, 13 aa, Plasmodium falciparum
KNEKDNEKNNNDE

SEQ ID NO: 3322912 - protein, 10 aa, Plasmodium falciparum
KNEKDNINEE

SEQ ID NO: 3322913 - protein, 9 aa, Plasmodium falciparum
KNEKDQVNN

SEQ ID NO: 3322914 - protein, 10 aa, Plasmodium falciparum
KNEKEEEKKT

SEQ ID NO: 3322915 - protein, 8 aa, Plasmodium falciparum
KNEKEHLN

SEQ ID NO: 3322916 - protein, 31 aa, Plasmodium falciparum
KNEKEHRKRTEGSSLGRSAVDYDGKKSNINE

SEQ ID NO: 3322917 - protein, 41 aa, Plasmodium falciparum
KNEKEKIEEMNSRKNNNYEKEEEEDDEEDIDGVDEDIKEKC

SEQ ID NO: 3322918 - protein, 11 aa, Plasmodium falciparum
KNEKEKKRDEL

SEQ ID NO: 3322919 - protein, 8 aa, Plasmodium falciparum
KNEKEKNI

SEQ ID NO: 3322920 - protein, 21 aa, Plasmodium falciparum
KNEKGSSSSNNNPSDNKTEAF

SEQ ID NO: 3322921 - protein, 8 aa, Plasmodium falciparum
KNEKKKDI

SEQ ID NO: 3322922 - protein, 22 aa, Plasmodium falciparum
KNEKKKKKKTNKQNGGNDKNEE

SEQ ID NO: 3322923 - protein, 8 aa, Plasmodium falciparum
KNEKKKNT

SEQ ID NO: 3322924 - protein, 9 aa, Plasmodium falciparum
KNEKKKREQ

SEQ ID NO: 3322925 - protein, 5 aa, Plasmodium falciparum
KNEKL

SEQ ID NO: 3322926 - protein, 8 aa, Plasmodium falciparum
KNEKNEEA

SEQ ID NO: 3322927 - protein, 58 aa, Plasmodium falciparum
KNEKNEKNVNEKKGENDEKNENEKKEENDEKNVNEKKDENDEKNENEKKDENDNNNNS

SEQ ID NO: 3322928 - protein, 9 aa, Plasmodium falciparum
KNEKNIYTS

SEQ ID NO: 3322929 - protein, 6 aa, Plasmodium falciparum
KNEKNK

SEQ ID NO: 3322930 - protein, 7 aa, Plasmodium falciparum
KNEKNMK

SEQ ID NO: 3322931 - protein, 14 aa, Plasmodium falciparum
KNEKNNIKRKKKCN

SEQ ID NO: 3322932 - protein, 27 aa, Plasmodium falciparum
KNEKNNPNYIGKQNNSSTEKNKKTTKN

SEQ ID NO: 3322933 - protein, 6 aa, Plasmodium falciparum
KNEKRC

SEQ ID NO: 3322934 - protein, 7 aa, Plasmodium falciparum
KNEKRNS

SEQ ID NO: 3322935 - protein, 100 aa, Plasmodium falciparum
KNEKSNDEMVEKNERKVDEEKGEDEQEIKAKENNNKEENQDNENNNKEENHDNENNNKEENQDNENNNKEENQDNENNNKEENQDNENNNKEENQKNENG

SEQ ID NO: 3322936 - protein, 17 aa, Plasmodium falciparum
KNEKSNKIGYPKNSNRK

SEQ ID NO: 3322937 - protein, 5 aa, Plasmodium falciparum
KNEKT

SEQ ID NO: 3322938 - protein, 6 aa, Plasmodium falciparum
KNEKTF

SEQ ID NO: 3322939 - protein, 8 aa, Plasmodium falciparum
KNEKTTIY

SEQ ID NO: 3322940 - protein, 5 aa, Plasmodium falciparum
KNEKY

SEQ ID NO: 3322941 - protein, 81 aa, Plasmodium falciparum
KNEKYEKNEKNDKYDKYEKYDKYENYDKYEKYDKYEKYDKYENYDKYEKYDKYEKYDKYEKYDKYEKYDKYEKNDDSRKDN

SEQ ID NO: 3322942 - protein, 6 aa, Plasmodium falciparum
KNELDA

SEQ ID NO: 3322943 - protein, 7 aa, Plasmodium falciparum
KNELDTQ

SEQ ID NO: 3322944 - protein, 6 aa, Plasmodium falciparum
KNELEE

SEQ ID NO: 3322945 - protein, 7 aa, Plasmodium falciparum
KNELIEE

SEQ ID NO: 3322946 - protein, 6 aa, Plasmodium falciparum
KNELNE

SEQ ID NO: 3322947 - protein, 6 aa, Plasmodium falciparum
KNELNK

SEQ ID NO: 3322948 - protein, 6 aa, Plasmodium falciparum
KNELNR

SEQ ID NO: 3322949 - protein, 9 aa, Plasmodium falciparum
KNELNSGKR

SEQ ID NO: 3322950 - protein, 7 aa, Plasmodium falciparum
KNELQKQ

SEQ ID NO: 3322951 - protein, 5 aa, Plasmodium falciparum
KNELS

SEQ ID NO: 3322952 - protein, 4 aa, Plasmodium falciparum
KNEM

SEQ ID NO: 3322953 - protein, 7 aa, Plasmodium falciparum
KNEMTTN

SEQ ID NO: 3322954 - protein, 25 aa, Plasmodium falciparum
KNENANIDDEYATNEEPSEFNVLTF

SEQ ID NO: 3322955 - protein, 16 aa, Plasmodium falciparum
KNENAPPSSASSALPS

SEQ ID NO: 3322956 - protein, 16 aa, Plasmodium falciparum
KNENCDNNQEHGNQNK

SEQ ID NO: 3322957 - protein, 10 aa, Plasmodium falciparum
KNENDEDEDI

SEQ ID NO: 3322958 - protein, 37 aa, Plasmodium falciparum
KNENDIENQNNPNMNNNNNNNNINTLNNKEESNVNNK

SEQ ID NO: 3322959 - protein, 8 aa, Plasmodium falciparum
KNENDQKK

SEQ ID NO: 3322960 - protein, 6 aa, Plasmodium falciparum
KNENDY

SEQ ID NO: 3322961 - protein, 8 aa, Plasmodium falciparum
KNENEKNE

SEQ ID NO: 3322962 - protein, 13 aa, Plasmodium falciparum
KNENEKNNMYENE

SEQ ID NO: 3322963 - protein, 29 aa, Plasmodium falciparum
KNENIKSENIKSENIKSENIKSENIKSEK

SEQ ID NO: 3322964 - protein, 6 aa, Plasmodium falciparum
KNENIS

SEQ ID NO: 3322965 - protein, 38 aa, Plasmodium falciparum
KNENKFSKKGNENLYNKKSDEKLSEAASYKKSKKSSYI

SEQ ID NO: 3322966 - protein, 6 aa, Plasmodium falciparum
KNENLE

SEQ ID NO: 3322967 - protein, 6 aa, Plasmodium falciparum
KNENMS

SEQ ID NO: 3322968 - protein, 5 aa, Plasmodium falciparum
KNENN

SEQ ID NO: 3322969 - protein, 7 aa, Plasmodium falciparum
KNENNGF

SEQ ID NO: 3322970 - protein, 8 aa, Plasmodium falciparum
KNENNKNN

SEQ ID NO: 3322971 - protein, 25 aa, Plasmodium falciparum
KNENNMLSNPQGDNYKISPKEHEKY

SEQ ID NO: 3322972 - protein, 6 aa, Plasmodium falciparum
KNENNN

SEQ ID NO: 3322973 - protein, 7 aa, Plasmodium falciparum
KNENNRK

SEQ ID NO: 3322974 - protein, 10 aa, Plasmodium falciparum
KNENNSRENY

SEQ ID NO: 3322975 - protein, 8 aa, Plasmodium falciparum
KNENNTDI

SEQ ID NO: 3322976 - protein, 24 aa, Plasmodium falciparum
KNENNVRKNDNDNKFEEDEEGLNN

SEQ ID NO: 3322977 - protein, 15 aa, Plasmodium falciparum
KNENNYNNGEEFNSN

SEQ ID NO: 3322978 - protein, 11 aa, Plasmodium falciparum
KNENSKDNNKE

SEQ ID NO: 3322979 - protein, 18 aa, Plasmodium falciparum
KNENTKKYKVEESQECDR

SEQ ID NO: 3322980 - protein, 19 aa, Plasmodium falciparum
KNENYDENISENNKKYGKR

SEQ ID NO: 3322981 - protein, 4 aa, Plasmodium falciparum
KNEP

SEQ ID NO: 3322982 - protein, 7 aa, Plasmodium falciparum
KNEPDYK

SEQ ID NO: 3322983 - protein, 6 aa, Plasmodium falciparum
KNEPSE

SEQ ID NO: 3322984 - protein, 7 aa, Plasmodium falciparum
KNEQDIE

SEQ ID NO: 3322985 - protein, 14 aa, Plasmodium falciparum
KNEQEEHKKHSSSL

SEQ ID NO: 3322986 - protein, 7 aa, Plasmodium falciparum
KNEQEQK

SEQ ID NO: 3322987 - protein, 23 aa, Plasmodium falciparum
KNEQIKEYKDKYQKNNTYQSEQN

SEQ ID NO: 3322988 - protein, 8 aa, Plasmodium falciparum
KNEQINEY

SEQ ID NO: 3322989 - protein, 22 aa, Plasmodium falciparum
KNEQINEYKDKYQKNNTYQREQ

SEQ ID NO: 3322990 - protein, 23 aa, Plasmodium falciparum
KNEQINEYKDKYQKNNTYQSEQN

SEQ ID NO: 3322991 - protein, 14 aa, Plasmodium falciparum
KNEQKNNNKLSTEG

SEQ ID NO: 3322992 - protein, 5 aa, Plasmodium falciparum
KNEQL

SEQ ID NO: 3322993 - protein, 8 aa, Plasmodium falciparum
KNEQLKNS

SEQ ID NO: 3322994 - protein, 6 aa, Plasmodium falciparum
KNEQLQ

SEQ ID NO: 3322995 - protein, 10 aa, Plasmodium falciparum
KNEQNENDHI

SEQ ID NO: 3322996 - protein, 12 aa, Plasmodium falciparum
KNEQRPIKSKND

SEQ ID NO: 3322997 - protein, 8 aa, Plasmodium falciparum
KNEQVDNE

SEQ ID NO: 3322998 - protein, 6 aa, Plasmodium falciparum
KNEQYN

SEQ ID NO: 3322999 - protein, 7 aa, Plasmodium falciparum
KNEREYN

SEQ ID NO: 3323000 - protein, 13 aa, Plasmodium falciparum
KNESEEQEEKENM

SEQ ID NO: 3323001 - protein, 18 aa, Plasmodium falciparum
KNESENNKYNKMNETNND

SEQ ID NO: 3323002 - protein, 6 aa, Plasmodium falciparum
KNESLS

SEQ ID NO: 3323003 - protein, 14 aa, Plasmodium falciparum
KNESNEDDKDTNKF

SEQ ID NO: 3323004 - protein, 8 aa, Plasmodium falciparum
KNESNEEG

SEQ ID NO: 3323005 - protein, 11 aa, Plasmodium falciparum
KNESNTNDRNN

SEQ ID NO: 3323006 - protein, 8 aa, Plasmodium falciparum
KNESTNYL

SEQ ID NO: 3323007 - protein, 5 aa, Plasmodium falciparum
KNETD

SEQ ID NO: 3323008 - protein, 25 aa, Plasmodium falciparum
KNETDQENNNNNNNNNNNNNNKNHY

SEQ ID NO: 3323009 - protein, 9 aa, Plasmodium falciparum
KNETEEDIE

SEQ ID NO: 3323010 - protein, 14 aa, Plasmodium falciparum
KNETENKTRNSTYN

SEQ ID NO: 3323011 - protein, 17 aa, Plasmodium falciparum
KNETFKKKGPNKNYTNG

SEQ ID NO: 3323012 - protein, 7 aa, Plasmodium falciparum
KNETHDL

SEQ ID NO: 3323013 - protein, 5 aa, Plasmodium falciparum
KNETI

SEQ ID NO: 3323014 - protein, 7 aa, Plasmodium falciparum
KNETKEK

SEQ ID NO: 3323015 - protein, 8 aa, Plasmodium falciparum
KNETKNCN

SEQ ID NO: 3323016 - protein, 5 aa, Plasmodium falciparum
KNETL

SEQ ID NO: 3323017 - protein, 36 aa, Plasmodium falciparum
KNETNNNNNNNNNNNNNNNNNNNNNNNNNNNNIYSP

SEQ ID NO: 3323018 - protein, 6 aa, Plasmodium falciparum
KNETNQ

SEQ ID NO: 3323019 - protein, 14 aa, Plasmodium falciparum
KNETQNNHNKNNIS

SEQ ID NO: 3323020 - protein, 46 aa, Plasmodium falciparum
KNETQSNNNNNNNNNNNNSNNNSNNSNNNSNNNNNNSNNNNNSSNN

SEQ ID NO: 3323021 - protein, 5 aa, Plasmodium falciparum
KNETT

SEQ ID NO: 3323022 - protein, 37 aa, Plasmodium falciparum
KNEVEGKNNLEGKNNVEGKNNVEGKNDVEGKNDVEEK

SEQ ID NO: 3323023 - protein, 7 aa, Plasmodium falciparum
KNEVEKI

SEQ ID NO: 3323024 - protein, 6 aa, Plasmodium falciparum
KNEVER

SEQ ID NO: 3323025 - protein, 9 aa, Plasmodium falciparum
KNEVPQENI

SEQ ID NO: 3323026 - protein, 10 aa, Plasmodium falciparum
KNEVQDTKDI

SEQ ID NO: 3323027 - protein, 7 aa, Plasmodium falciparum
KNEVQKE

SEQ ID NO: 3323028 - protein, 10 aa, Plasmodium falciparum
KNEVYNKTGH

SEQ ID NO: 3323029 - protein, 5 aa, Plasmodium falciparum
KNEYH

SEQ ID NO: 3323030 - protein, 10 aa, Plasmodium falciparum
KNEYKGPLGE

SEQ ID NO: 3323031 - protein, 5 aa, Plasmodium falciparum
KNEYN

SEQ ID NO: 3323032 - protein, 6 aa, Plasmodium falciparum
KNEYNE

SEQ ID NO: 3323033 - protein, 8 aa, Plasmodium falciparum
KNEYNKKK

SEQ ID NO: 3323034 - protein, 5 aa, Plasmodium falciparum
KNEYS

SEQ ID NO: 3323035 - protein, 7 aa, Plasmodium falciparum
KNEYSKE

SEQ ID NO: 3323036 - protein, 7 aa, Plasmodium falciparum
KNEYTKI

SEQ ID NO: 3323037 - protein, 11 aa, Plasmodium falciparum
KNFDKDYKEKE

SEQ ID NO: 3323038 - protein, 7 aa, Plasmodium falciparum
KNFEKEK

SEQ ID NO: 3323039 - protein, 5 aa, Plasmodium falciparum
KNFES

SEQ ID NO: 3323040 - protein, 15 aa, Plasmodium falciparum
KNFGESSDSESDLDS

SEQ ID NO: 3323041 - protein, 4 aa, Plasmodium falciparum
KNFH

SEQ ID NO: 3323042 - protein, 6 aa, Plasmodium falciparum
KNFKNK

SEQ ID NO: 3323043 - protein, 9 aa, Plasmodium falciparum
KNFPSPNEN

SEQ ID NO: 3323044 - protein, 7 aa, Plasmodium falciparum
KNFRKKN

SEQ ID NO: 3323045 - protein, 14 aa, Plasmodium falciparum
KNFSEQQEEQTDHN

SEQ ID NO: 3323046 - protein, 6 aa, Plasmodium falciparum
KNFTQK

SEQ ID NO: 3323047 - protein, 17 aa, Plasmodium falciparum
KNGDDDDDDDDKSVGKI

SEQ ID NO: 3323048 - protein, 23 aa, Plasmodium falciparum
KNGDDGNNNYGKSDNTNETNLND

SEQ ID NO: 3323049 - protein, 6 aa, Plasmodium falciparum
KNGDEN

SEQ ID NO: 3323050 - protein, 10 aa, Plasmodium falciparum
KNGDKKNKID

SEQ ID NO: 3323051 - protein, 7 aa, Plasmodium falciparum
KNGDQDF

SEQ ID NO: 3323052 - protein, 9 aa, Plasmodium falciparum
KNGDSENGG

SEQ ID NO: 3323053 - protein, 6 aa, Plasmodium falciparum
KNGDVY

SEQ ID NO: 3323054 - protein, 8 aa, Plasmodium falciparum
KNGDYEKS

SEQ ID NO: 3323055 - protein, 6 aa, Plasmodium falciparum
KNGEGI

SEQ ID NO: 3323056 - protein, 6 aa, Plasmodium falciparum
KNGELT

SEQ ID NO: 3323057 - protein, 5 aa, Plasmodium falciparum
KNGEN

SEQ ID NO: 3323058 - protein, 10 aa, Plasmodium falciparum
KNGENNSVNL

SEQ ID NO: 3323059 - protein, 11 aa, Plasmodium falciparum
KNGEPENPCGD

SEQ ID NO: 3323060 - protein, 8 aa, Plasmodium falciparum
KNGEPIDT

SEQ ID NO: 3323061 - protein, 8 aa, Plasmodium falciparum
KNGEQNSS

SEQ ID NO: 3323062 - protein, 6 aa, Plasmodium falciparum
KNGGVK

SEQ ID NO: 3323063 - protein, 6 aa, Plasmodium falciparum
KNGHEE

SEQ ID NO: 3323064 - protein, 13 aa, Plasmodium falciparum
KNGHGNKKDNSIS

SEQ ID NO: 3323065 - protein, 16 aa, Plasmodium falciparum
KNGIKTNKINNNNNNN

SEQ ID NO: 3323066 - protein, 13 aa, Plasmodium falciparum
KNGISNNENGNNE

SEQ ID NO: 3323067 - protein, 5 aa, Plasmodium falciparum
KNGIT

SEQ ID NO: 3323068 - protein, 9 aa, Plasmodium falciparum
KNGKGTNNT

SEQ ID NO: 3323069 - protein, 5 aa, Plasmodium falciparum
KNGKI

SEQ ID NO: 3323070 - protein, 15 aa, Plasmodium falciparum
KNGKKKNDDSEQAND

SEQ ID NO: 3323071 - protein, 10 aa, Plasmodium falciparum
KNGKSKLTEL

SEQ ID NO: 3323072 - protein, 8 aa, Plasmodium falciparum
KNGKSSKK

SEQ ID NO: 3323073 - protein, 6 aa, Plasmodium falciparum
KNGLDA

SEQ ID NO: 3323074 - protein, 8 aa, Plasmodium falciparum
KNGLKNTL

SEQ ID NO: 3323075 - protein, 7 aa, Plasmodium falciparum
KNGLNSK

SEQ ID NO: 3323076 - protein, 5 aa, Plasmodium falciparum
KNGMQ

SEQ ID NO: 3323077 - protein, 23 aa, Plasmodium falciparum
KNGNDDTNLSQEKKKRHGRNRNH

SEQ ID NO: 3323078 - protein, 8 aa, Plasmodium falciparum
KNGNDNMS

SEQ ID NO: 3323079 - protein, 8 aa, Plasmodium falciparum
KNGNHMNN

SEQ ID NO: 3323080 - protein, 5 aa, Plasmodium falciparum
KNGNI

SEQ ID NO: 3323081 - protein, 112 aa, Plasmodium falciparum
KNGNNNNDDDNSTDDNNNDDNKNNNDNKNNDDNKNNDDNDNNDNNNNNDNNNNNNNNNNNNNNNNNNNNSNGDNNNNNNNNNNGDNCNNNNDNHNNNDNNNSNNNNNNNHRI

SEQ ID NO: 3323082 - protein, 9 aa, Plasmodium falciparum
KNGNTDDYS

SEQ ID NO: 3323083 - protein, 18 aa, Plasmodium falciparum
KNGNTYTKHNYNNKDEYI

SEQ ID NO: 3323084 - protein, 8 aa, Plasmodium falciparum
KNGNVSHS

SEQ ID NO: 3323085 - protein, 7 aa, Plasmodium falciparum
KNGQHSQ

SEQ ID NO: 3323086 - protein, 9 aa, Plasmodium falciparum
KNGRGKSAI

SEQ ID NO: 3323087 - protein, 4 aa, Plasmodium falciparum
KNGS

SEQ ID NO: 3323088 - protein, 7 aa, Plasmodium falciparum
KNGSIDP

SEQ ID NO: 3323089 - protein, 9 aa, Plasmodium falciparum
KNGSKELND

SEQ ID NO: 3323090 - protein, 6 aa, Plasmodium falciparum
KNGSRL

SEQ ID NO: 3323091 - protein, 12 aa, Plasmodium falciparum
KNGSSSEDENLS

SEQ ID NO: 3323092 - protein, 7 aa, Plasmodium falciparum
KNGSVTM

SEQ ID NO: 3323093 - protein, 7 aa, Plasmodium falciparum
KNGTLNE

SEQ ID NO: 3323094 - protein, 5 aa, Plasmodium falciparum
KNGTM

SEQ ID NO: 3323095 - protein, 7 aa, Plasmodium falciparum
KNGTNRT

SEQ ID NO: 3323096 - protein, 13 aa, Plasmodium falciparum
KNGTNSDNQNSHY

SEQ ID NO: 3323097 - protein, 7 aa, Plasmodium falciparum
KNGTQLN

SEQ ID NO: 3323098 - protein, 7 aa, Plasmodium falciparum
KNGTSSN

SEQ ID NO: 3323099 - protein, 17 aa, Plasmodium falciparum
KNGVEQSEEKNKKDKNR

SEQ ID NO: 3323100 - protein, 13 aa, Plasmodium falciparum
KNGYRTDEINEND

SEQ ID NO: 3323101 - protein, 5 aa, Plasmodium falciparum
KNGYS

SEQ ID NO: 3323102 - protein, 5 aa, Plasmodium falciparum
KNGYW

SEQ ID NO: 3323103 - protein, 21 aa, Plasmodium falciparum
KNHASLSASKINNHDGEYDMT

SEQ ID NO: 3323104 - protein, 5 aa, Plasmodium falciparum
KNHDQ

SEQ ID NO: 3323105 - protein, 8 aa, Plasmodium falciparum
KNHDTPSP

SEQ ID NO: 3323106 - protein, 9 aa, Plasmodium falciparum
KNHEKSARH

SEQ ID NO: 3323107 - protein, 8 aa, Plasmodium falciparum
KNHINSSF

SEQ ID NO: 3323108 - protein, 4 aa, Plasmodium falciparum
KNHK

SEQ ID NO: 3323109 - protein, 35 aa, Plasmodium falciparum
KNHKISKNDDLGNNNIDNNNNNDDNNNSNNNNNNN

SEQ ID NO: 3323110 - protein, 14 aa, Plasmodium falciparum
KNHKMDDSKDNIKR

SEQ ID NO: 3323111 - protein, 14 aa, Plasmodium falciparum
KNHKYDSNKLKGYG

SEQ ID NO: 3323112 - protein, 6 aa, Plasmodium falciparum
KNHNDD

SEQ ID NO: 3323113 - protein, 9 aa, Plasmodium falciparum
KNHNLSNNK

SEQ ID NO: 3323114 - protein, 15 aa, Plasmodium falciparum
KNHQHRTRNKKFTNN

SEQ ID NO: 3323115 - protein, 12 aa, Plasmodium falciparum
KNHQTKAQNDIS

SEQ ID NO: 3323116 - protein, 8 aa, Plasmodium falciparum
KNHSEDIP

SEQ ID NO: 3323117 - protein, 9 aa, Plasmodium falciparum
KNHSPNEYR

SEQ ID NO: 3323118 - protein, 9 aa, Plasmodium falciparum
KNHSYNPNI

SEQ ID NO: 3323119 - protein, 20 aa, Plasmodium falciparum
KNHTKNALNNNEMKNSCKDN

SEQ ID NO: 3323120 - protein, 8 aa, Plasmodium falciparum
KNHTNNKN

SEQ ID NO: 3323121 - protein, 12 aa, Plasmodium falciparum
KNHVNKNKNENY

SEQ ID NO: 3323122 - protein, 8 aa, Plasmodium falciparum
KNHYTTCE

SEQ ID NO: 3323123 - protein, 14 aa, Plasmodium falciparum
KNIAGNKNTVEKSA

SEQ ID NO: 3323124 - protein, 51 aa, Plasmodium falciparum
KNIDDDEKEKNYKGDQSFNKKNDQKEGGKEEENYKNDEDMENLNEKQKHEI

SEQ ID NO: 3323125 - protein, 9 aa, Plasmodium falciparum
KNIDEENDY

SEQ ID NO: 3323126 - protein, 11 aa, Plasmodium falciparum
KNIDNKNENLN

SEQ ID NO: 3323127 - protein, 6 aa, Plasmodium falciparum
KNIDNL

SEQ ID NO: 3323128 - protein, 18 aa, Plasmodium falciparum
KNIDNNKNFDNNNNNIDN

SEQ ID NO: 3323129 - protein, 34 aa, Plasmodium falciparum
KNIDQGTNQHINQGTNQHINQGTNQHDTCDGPNY

SEQ ID NO: 3323130 - protein, 19 aa, Plasmodium falciparum
KNIDSNNTMNDLGNNQNSH

SEQ ID NO: 3323131 - protein, 25 aa, Plasmodium falciparum
KNIDSSDVKSANDTYSQKSEKNIHN

SEQ ID NO: 3323132 - protein, 6 aa, Plasmodium falciparum
KNIDTN

SEQ ID NO: 3323133 - protein, 4 aa, Plasmodium falciparum
KNIE

SEQ ID NO: 3323134 - protein, 16 aa, Plasmodium falciparum
KNIEEINNKKNNHIYT

SEQ ID NO: 3323135 - protein, 13 aa, Plasmodium falciparum
KNIEENVKNNYNS

SEQ ID NO: 3323136 - protein, 7 aa, Plasmodium falciparum
KNIEEQE

SEQ ID NO: 3323137 - protein, 6 aa, Plasmodium falciparum
KNIEEV

SEQ ID NO: 3323138 - protein, 5 aa, Plasmodium falciparum
KNIEK

SEQ ID NO: 3323139 - protein, 6 aa, Plasmodium falciparum
KNIEKD

SEQ ID NO: 3323140 - protein, 41 aa, Plasmodium falciparum
KNIENEENEKNEKNEKNEKNEENEKNEENEKNQKQANNHNE

SEQ ID NO: 3323141 - protein, 12 aa, Plasmodium falciparum
KNIENHVKSNDS

SEQ ID NO: 3323142 - protein, 6 aa, Plasmodium falciparum
KNIENN

SEQ ID NO: 3323143 - protein, 24 aa, Plasmodium falciparum
KNIENSKKNELSEGTTEKKNVSIE

SEQ ID NO: 3323144 - protein, 15 aa, Plasmodium falciparum
KNIENSNLNNAPNIN

SEQ ID NO: 3323145 - protein, 5 aa, Plasmodium falciparum
KNIEQ

SEQ ID NO: 3323146 - protein, 6 aa, Plasmodium falciparum
KNIETN

SEQ ID NO: 3323147 - protein, 6 aa, Plasmodium falciparum
KNIEYD

SEQ ID NO: 3323148 - protein, 12 aa, Plasmodium falciparum
KNIEYKDDKEEQ

SEQ ID NO: 3323149 - protein, 13 aa, Plasmodium falciparum
KNIEYNKNKEMSS

SEQ ID NO: 3323150 - protein, 16 aa, Plasmodium falciparum
KNIGESGNEKKRNNNF

SEQ ID NO: 3323151 - protein, 7 aa, Plasmodium falciparum
KNIGKKE

SEQ ID NO: 3323152 - protein, 14 aa, Plasmodium falciparum
KNIGNDNNKPYNED

SEQ ID NO: 3323153 - protein, 8 aa, Plasmodium falciparum
KNIHDEKR

SEQ ID NO: 3323154 - protein, 14 aa, Plasmodium falciparum
KNIHNNNKKKDKHI

SEQ ID NO: 3323155 - protein, 37 aa, Plasmodium falciparum
KNIHSDAEKNIHSDDDKNIHSDDEKNYDNDKSYNKLE

SEQ ID NO: 3323156 - protein, 15 aa, Plasmodium falciparum
KNIINDDTKNISNDD

SEQ ID NO: 3323157 - protein, 14 aa, Plasmodium falciparum
KNIINNNKKSDING

SEQ ID NO: 3323158 - protein, 7 aa, Plasmodium falciparum
KNIISDD

SEQ ID NO: 3323159 - protein, 8 aa, Plasmodium falciparum
KNIKEKEN

SEQ ID NO: 3323160 - protein, 7 aa, Plasmodium falciparum
KNIKGNS

SEQ ID NO: 3323161 - protein, 26 aa, Plasmodium falciparum
KNIKGVKEEDNDGGSGKEDNEPTQKS

SEQ ID NO: 3323162 - protein, 19 aa, Plasmodium falciparum
KNIKKDNEESDKKNNISDR

SEQ ID NO: 3323163 - protein, 9 aa, Plasmodium falciparum
KNIKKKKKN

SEQ ID NO: 3323164 - protein, 11 aa, Plasmodium falciparum
KNIKKNNSINN

SEQ ID NO: 3323165 - protein, 8 aa, Plasmodium falciparum
KNIKNKKN

SEQ ID NO: 3323166 - protein, 18 aa, Plasmodium falciparum
KNIKNTSETLNSFSESKQ

SEQ ID NO: 3323167 - protein, 6 aa, Plasmodium falciparum
KNIKPD

SEQ ID NO: 3323168 - protein, 17 aa, Plasmodium falciparum
KNIKQKKTDKKKKNKTD

SEQ ID NO: 3323169 - protein, 60 aa, Plasmodium falciparum
KNIKSNDDVNNNNIKSNDNDNIKSNDNDNIKSNDDNIKSNDNDNIKNNDVNNNNNNTFKS

SEQ ID NO: 3323170 - protein, 5 aa, Plasmodium falciparum
KNIKV

SEQ ID NO: 3323171 - protein, 6 aa, Plasmodium falciparum
KNILSS

SEQ ID NO: 3323172 - protein, 10 aa, Plasmodium falciparum
KNINATNDTC

SEQ ID NO: 3323173 - protein, 47 aa, Plasmodium falciparum
KNINDEKNINDEKNINDEKNINDEKNINDEKNINDQISNDGNIENER

SEQ ID NO: 3323174 - protein, 12 aa, Plasmodium falciparum
KNINDENCSTHN

SEQ ID NO: 3323175 - protein, 12 aa, Plasmodium falciparum
KNINDNNAGSFD

SEQ ID NO: 3323176 - protein, 7 aa, Plasmodium falciparum
KNINESD

SEQ ID NO: 3323177 - protein, 32 aa, Plasmodium falciparum
KNINHKKNVNNKNNIKNNNKTNNKNKINNKKN

SEQ ID NO: 3323178 - protein, 17 aa, Plasmodium falciparum
KNINKQEVTTQDANSSN

SEQ ID NO: 3323179 - protein, 6 aa, Plasmodium falciparum
KNINNE

SEQ ID NO: 3323180 - protein, 13 aa, Plasmodium falciparum
KNINNHSNNNSNI

SEQ ID NO: 3323181 - protein, 11 aa, Plasmodium falciparum
KNINNNEEYEN

SEQ ID NO: 3323182 - protein, 24 aa, Plasmodium falciparum
KNINNNINNNNNNNISSSCSSSEL

SEQ ID NO: 3323183 - protein, 7 aa, Plasmodium falciparum
KNINNNN

SEQ ID NO: 3323184 - protein, 12 aa, Plasmodium falciparum
KNINNRSQGTFS

SEQ ID NO: 3323185 - protein, 23 aa, Plasmodium falciparum
KNINPNDSNYRNSNFDNKDIYCQ

SEQ ID NO: 3323186 - protein, 7 aa, Plasmodium falciparum
KNINRNN

SEQ ID NO: 3323187 - protein, 6 aa, Plasmodium falciparum
KNINTN

SEQ ID NO: 3323188 - protein, 20 aa, Plasmodium falciparum
KNIPEDEEPNNISKQKIKGH

SEQ ID NO: 3323189 - protein, 24 aa, Plasmodium falciparum
KNIPHRNDNNTNNDHHNKNNMTNQ

SEQ ID NO: 3323190 - protein, 8 aa, Plasmodium falciparum
KNIPKNES

SEQ ID NO: 3323191 - protein, 11 aa, Plasmodium falciparum
KNIQDGNLSNN

SEQ ID NO: 3323192 - protein, 21 aa, Plasmodium falciparum
KNIQDYEKKKKKSENSDDDVN

SEQ ID NO: 3323193 - protein, 10 aa, Plasmodium falciparum
KNIQKNKQSY

SEQ ID NO: 3323194 - protein, 11 aa, Plasmodium falciparum
KNIQPNMQTNT

SEQ ID NO: 3323195 - protein, 10 aa, Plasmodium falciparum
KNIQQNEKEK

SEQ ID NO: 3323196 - protein, 16 aa, Plasmodium falciparum
KNIRAEKSNRNGPNGL

SEQ ID NO: 3323197 - protein, 7 aa, Plasmodium falciparum
KNIRTYN

SEQ ID NO: 3323198 - protein, 6 aa, Plasmodium falciparum
KNISDN

SEQ ID NO: 3323199 - protein, 13 aa, Plasmodium falciparum
KNISEDHNEKRDD

SEQ ID NO: 3323200 - protein, 9 aa, Plasmodium falciparum
KNISKKTKK

SEQ ID NO: 3323201 - protein, 12 aa, Plasmodium falciparum
KNISKNKNGTKR

SEQ ID NO: 3323202 - protein, 19 aa, Plasmodium falciparum
KNISKSNNQDKENEKNSLT

SEQ ID NO: 3323203 - protein, 7 aa, Plasmodium falciparum
KNISNDD

SEQ ID NO: 3323204 - protein, 7 aa, Plasmodium falciparum
KNISNGK

SEQ ID NO: 3323205 - protein, 22 aa, Plasmodium falciparum
KNISNNNINNSYNDEDKEVTYD

SEQ ID NO: 3323206 - protein, 17 aa, Plasmodium falciparum
KNISNNSVAKNTNNDPV

SEQ ID NO: 3323207 - protein, 10 aa, Plasmodium falciparum
KNISSDEKKY

SEQ ID NO: 3323208 - protein, 11 aa, Plasmodium falciparum
KNISSSVSDLN

SEQ ID NO: 3323209 - protein, 16 aa, Plasmodium falciparum
KNISTDINESYNNSEN

SEQ ID NO: 3323210 - protein, 9 aa, Plasmodium falciparum
KNISTNQKN

SEQ ID NO: 3323211 - protein, 4 aa, Plasmodium falciparum
KNIT

SEQ ID NO: 3323212 - protein, 6 aa, Plasmodium falciparum
KNITED

SEQ ID NO: 3323213 - protein, 6 aa, Plasmodium falciparum
KNITEE

SEQ ID NO: 3323214 - protein, 12 aa, Plasmodium falciparum
KNITEKEDDHKV

SEQ ID NO: 3323215 - protein, 5 aa, Plasmodium falciparum
KNITI

SEQ ID NO: 3323216 - protein, 12 aa, Plasmodium falciparum
KNITQGKENAYK

SEQ ID NO: 3323217 - protein, 12 aa, Plasmodium falciparum
KNITQKSFDENG

SEQ ID NO: 3323218 - protein, 8 aa, Plasmodium falciparum
KNITSDGN

SEQ ID NO: 3323219 - protein, 6 aa, Plasmodium falciparum
KNITSN

SEQ ID NO: 3323220 - protein, 7 aa, Plasmodium falciparum
KNITSSN

SEQ ID NO: 3323221 - protein, 6 aa, Plasmodium falciparum
KNITTN

SEQ ID NO: 3323222 - protein, 5 aa, Plasmodium falciparum
KNITY

SEQ ID NO: 3323223 - protein, 6 aa, Plasmodium falciparum
KNITYS

SEQ ID NO: 3323224 - protein, 19 aa, Plasmodium falciparum
KNIYDDDDNINGDKNIYDG

SEQ ID NO: 3323225 - protein, 10 aa, Plasmodium falciparum
KNIYETKGNI

SEQ ID NO: 3323226 - protein, 7 aa, Plasmodium falciparum
KNIYKDN

SEQ ID NO: 3323227 - protein, 42 aa, Plasmodium falciparum
KNIYKENNSNNNNMNSNNNMNNNNNMNSNNNMNSNNNNNNNI

SEQ ID NO: 3323228 - protein, 7 aa, Plasmodium falciparum
KNIYNNK

SEQ ID NO: 3323229 - protein, 7 aa, Plasmodium falciparum
KNIYPKK

SEQ ID NO: 3323230 - protein, 8 aa, Plasmodium falciparum
KNIYPNGN

SEQ ID NO: 3323231 - protein, 5 aa, Plasmodium falciparum
KNIYT

SEQ ID NO: 3323232 - protein, 14 aa, Plasmodium falciparum
KNKANEKKNINDPD

SEQ ID NO: 3323233 - protein, 4 aa, Plasmodium falciparum
KNKD

SEQ ID NO: 3323234 - protein, 8 aa, Plasmodium falciparum
KNKDDPAI

SEQ ID NO: 3323235 - protein, 9 aa, Plasmodium falciparum
KNKDEHTLN

SEQ ID NO: 3323236 - protein, 5 aa, Plasmodium falciparum
KNKDH

SEQ ID NO: 3323237 - protein, 18 aa, Plasmodium falciparum
KNKDHKDNEQNDEKRESK

SEQ ID NO: 3323238 - protein, 12 aa, Plasmodium falciparum
KNKDKGNSKDSV

SEQ ID NO: 3323239 - protein, 7 aa, Plasmodium falciparum
KNKDKIS

SEQ ID NO: 3323240 - protein, 7 aa, Plasmodium falciparum
KNKDLGG

SEQ ID NO: 3323241 - protein, 10 aa, Plasmodium falciparum
KNKDLSTKNA

SEQ ID NO: 3323242 - protein, 8 aa, Plasmodium falciparum
KNKDMENL

SEQ ID NO: 3323243 - protein, 7 aa, Plasmodium falciparum
KNKDNDE

SEQ ID NO: 3323244 - protein, 22 aa, Plasmodium falciparum
KNKDNKKNVQKNNIKNKKTHIK

SEQ ID NO: 3323245 - protein, 7 aa, Plasmodium falciparum
KNKDNMN

SEQ ID NO: 3323246 - protein, 20 aa, Plasmodium falciparum
KNKDNNKNDNLNMNESDSFK

SEQ ID NO: 3323247 - protein, 8 aa, Plasmodium falciparum
KNKDNNYN

SEQ ID NO: 3323248 - protein, 9 aa, Plasmodium falciparum
KNKDPNVED

SEQ ID NO: 3323249 - protein, 8 aa, Plasmodium falciparum
KNKDPNVN

SEQ ID NO: 3323250 - protein, 5 aa, Plasmodium falciparum
KNKDQ

SEQ ID NO: 3323251 - protein, 45 aa, Plasmodium falciparum
KNKDQDSDNNEEDNENNKNTDVDGDGDDDDDDNDDENDNDDENDY

SEQ ID NO: 3323252 - protein, 9 aa, Plasmodium falciparum
KNKDQEIKE

SEQ ID NO: 3323253 - protein, 8 aa, Plasmodium falciparum
KNKDQGKS

SEQ ID NO: 3323254 - protein, 11 aa, Plasmodium falciparum
KNKDQKDICPN

SEQ ID NO: 3323255 - protein, 12 aa, Plasmodium falciparum
KNKDQNSKKEIK

SEQ ID NO: 3323256 - protein, 54 aa, Plasmodium falciparum
KNKDTTTTSNNNNNNNNNNNNDNNNNNDNNNNSSSCSNNNNSSSSSSSYNNNCN

SEQ ID NO: 3323257 - protein, 6 aa, Plasmodium falciparum
KNKDTY

SEQ ID NO: 3323258 - protein, 9 aa, Plasmodium falciparum
KNKDYPKAI

SEQ ID NO: 3323259 - protein, 21 aa, Plasmodium falciparum
KNKEDIKKNDTTYTKQEDMEN

SEQ ID NO: 3323260 - protein, 29 aa, Plasmodium falciparum
KNKEDKNGEKKKKMKKNKEKKEEKKNKYI

SEQ ID NO: 3323261 - protein, 16 aa, Plasmodium falciparum
KNKEEAEKKTLQNLNE

SEQ ID NO: 3323262 - protein, 10 aa, Plasmodium falciparum
KNKEEIRNAE

SEQ ID NO: 3323263 - protein, 9 aa, Plasmodium falciparum
KNKEENKSN

SEQ ID NO: 3323264 - protein, 6 aa, Plasmodium falciparum
KNKEEQ

SEQ ID NO: 3323265 - protein, 11 aa, Plasmodium falciparum
KNKEESVKEPN

SEQ ID NO: 3323266 - protein, 14 aa, Plasmodium falciparum
KNKEGGGVSVDGGG

SEQ ID NO: 3323267 - protein, 8 aa, Plasmodium falciparum
KNKEGGKN

SEQ ID NO: 3323268 - protein, 6 aa, Plasmodium falciparum
KNKEHN

SEQ ID NO: 3323269 - protein, 11 aa, Plasmodium falciparum
KNKEHSVPSTI

SEQ ID NO: 3323270 - protein, 7 aa, Plasmodium falciparum
KNKEHSY

SEQ ID NO: 3323271 - protein, 5 aa, Plasmodium falciparum
KNKEI

SEQ ID NO: 3323272 - protein, 17 aa, Plasmodium falciparum
KNKEIKKDRKDKKKRKL

SEQ ID NO: 3323273 - protein, 5 aa, Plasmodium falciparum
KNKEK

SEQ ID NO: 3323274 - protein, 6 aa, Plasmodium falciparum
KNKEKK

SEQ ID NO: 3323275 - protein, 8 aa, Plasmodium falciparum
KNKEKKEG

SEQ ID NO: 3323276 - protein, 11 aa, Plasmodium falciparum
KNKEKNDSDSL

SEQ ID NO: 3323277 - protein, 24 aa, Plasmodium falciparum
KNKEKNKDNEIHHDNNTDQNEYSD

SEQ ID NO: 3323278 - protein, 24 aa, Plasmodium falciparum
KNKEKNNEKNNEKNNEKNDEKNEL

SEQ ID NO: 3323279 - protein, 13 aa, Plasmodium falciparum
KNKEKSLKEKENE

SEQ ID NO: 3323280 - protein, 6 aa, Plasmodium falciparum
KNKEKV

SEQ ID NO: 3323281 - protein, 7 aa, Plasmodium falciparum
KNKEKYS

SEQ ID NO: 3323282 - protein, 11 aa, Plasmodium falciparum
KNKELENKKTN

SEQ ID NO: 3323283 - protein, 7 aa, Plasmodium falciparum
KNKELSP

SEQ ID NO: 3323284 - protein, 5 aa, Plasmodium falciparum
KNKEN

SEQ ID NO: 3323285 - protein, 6 aa, Plasmodium falciparum
KNKENI

SEQ ID NO: 3323286 - protein, 7 aa, Plasmodium falciparum
KNKENKK

SEQ ID NO: 3323287 - protein, 6 aa, Plasmodium falciparum
KNKENV

SEQ ID NO: 3323288 - protein, 9 aa, Plasmodium falciparum
KNKENYSKN

SEQ ID NO: 3323289 - protein, 38 aa, Plasmodium falciparum
KNKEPKNKTKNPNNHTNKTELSNQKTHNFKTQQTEKKY

SEQ ID NO: 3323290 - protein, 9 aa, Plasmodium falciparum
KNKEQNKRY

SEQ ID NO: 3323291 - protein, 8 aa, Plasmodium falciparum
KNKESENE

SEQ ID NO: 3323292 - protein, 11 aa, Plasmodium falciparum
KNKESSKRGNH

SEQ ID NO: 3323293 - protein, 10 aa, Plasmodium falciparum
KNKETLNQTQ

SEQ ID NO: 3323294 - protein, 10 aa, Plasmodium falciparum
KNKEYEQENE

SEQ ID NO: 3323295 - protein, 8 aa, Plasmodium falciparum
KNKEYNSK

SEQ ID NO: 3323296 - protein, 21 aa, Plasmodium falciparum
KNKFEKRYKNTNRKSTKNISD

SEQ ID NO: 3323297 - protein, 5 aa, Plasmodium falciparum
KNKFQ

SEQ ID NO: 3323298 - protein, 14 aa, Plasmodium falciparum
KNKFSQNSMNQENY

SEQ ID NO: 3323299 - protein, 6 aa, Plasmodium falciparum
KNKFSS

SEQ ID NO: 3323300 - protein, 4 aa, Plasmodium falciparum
KNKG

SEQ ID NO: 3323301 - protein, 16 aa, Plasmodium falciparum
KNKGINNRPLKEAKSF

SEQ ID NO: 3323302 - protein, 16 aa, Plasmodium falciparum
KNKGNDKNKNDENISN

SEQ ID NO: 3323303 - protein, 7 aa, Plasmodium falciparum
KNKGNLN

SEQ ID NO: 3323304 - protein, 7 aa, Plasmodium falciparum
KNKGNYN

SEQ ID NO: 3323305 - protein, 8 aa, Plasmodium falciparum
KNKGTAYL

SEQ ID NO: 3323306 - protein, 6 aa, Plasmodium falciparum
KNKGTI

SEQ ID NO: 3323307 - protein, 7 aa, Plasmodium falciparum
KNKHEHN

SEQ ID NO: 3323308 - protein, 7 aa, Plasmodium falciparum
KNKHKEK

SEQ ID NO: 3323309 - protein, 6 aa, Plasmodium falciparum
KNKHNT

SEQ ID NO: 3323310 - protein, 9 aa, Plasmodium falciparum
KNKHRNNKK

SEQ ID NO: 3323311 - protein, 4 aa, Plasmodium falciparum
KNKI

SEQ ID NO: 3323312 - protein, 13 aa, Plasmodium falciparum
KNKIKGKKKQITK

SEQ ID NO: 3323313 - protein, 14 aa, Plasmodium falciparum
KNKIKKKNKNKTFQ

SEQ ID NO: 3323314 - protein, 6 aa, Plasmodium falciparum
KNKIKN

SEQ ID NO: 3323315 - protein, 14 aa, Plasmodium falciparum
KNKIKNERKEKTKK

SEQ ID NO: 3323316 - protein, 34 aa, Plasmodium falciparum
KNKIKNKSYTISSGHSSSNNNYNTNDLPNDNNIK

SEQ ID NO: 3323317 - protein, 5 aa, Plasmodium falciparum
KNKIN

SEQ ID NO: 3323318 - protein, 17 aa, Plasmodium falciparum
KNKINKKYNKKNKDNIF

SEQ ID NO: 3323319 - protein, 22 aa, Plasmodium falciparum
KNKINNEKVTQIKGDDINDDND

SEQ ID NO: 3323320 - protein, 10 aa, Plasmodium falciparum
KNKINNKDKM

SEQ ID NO: 3323321 - protein, 27 aa, Plasmodium falciparum
KNKINTEQKNKINTEQKKSEKQPSLNT

SEQ ID NO: 3323322 - protein, 9 aa, Plasmodium falciparum
KNKIQNETG

SEQ ID NO: 3323323 - protein, 11 aa, Plasmodium falciparum
KNKISKSNDIE

SEQ ID NO: 3323324 - protein, 25 aa, Plasmodium falciparum
KNKITDHENNLKEKNEKHNTLHEGN

SEQ ID NO: 3323325 - protein, 7 aa, Plasmodium falciparum
KNKITRE

SEQ ID NO: 3323326 - protein, 10 aa, Plasmodium falciparum
KNKKDETNKI

SEQ ID NO: 3323327 - protein, 10 aa, Plasmodium falciparum
KNKKDKKVKM

SEQ ID NO: 3323328 - protein, 12 aa, Plasmodium falciparum
KNKKDLKNNENI

SEQ ID NO: 3323329 - protein, 16 aa, Plasmodium falciparum
KNKKDNKKIDDSNKKD

SEQ ID NO: 3323330 - protein, 11 aa, Plasmodium falciparum
KNKKEKMKNST

SEQ ID NO: 3323331 - protein, 15 aa, Plasmodium falciparum
KNKKENNESNKSNID

SEQ ID NO: 3323332 - protein, 9 aa, Plasmodium falciparum
KNKKENSNF

SEQ ID NO: 3323333 - protein, 6 aa, Plasmodium falciparum
KNKKES

SEQ ID NO: 3323334 - protein, 10 aa, Plasmodium falciparum
KNKKGKNFNS

SEQ ID NO: 3323335 - protein, 8 aa, Plasmodium falciparum
KNKKGNKQ

SEQ ID NO: 3323336 - protein, 8 aa, Plasmodium falciparum
KNKKKCKI

SEQ ID NO: 3323337 - protein, 12 aa, Plasmodium falciparum
KNKKKDDTYELE

SEQ ID NO: 3323338 - protein, 17 aa, Plasmodium falciparum
KNKKKDTDENNKKEKKY

SEQ ID NO: 3323339 - protein, 9 aa, Plasmodium falciparum
KNKKKEKEI

SEQ ID NO: 3323340 - protein, 11 aa, Plasmodium falciparum
KNKKKHKRKCK

SEQ ID NO: 3323341 - protein, 11 aa, Plasmodium falciparum
KNKKKKKKKNH

SEQ ID NO: 3323342 - protein, 26 aa, Plasmodium falciparum
KNKKKKSKSNCRDKGYNNKSYKIKNN

SEQ ID NO: 3323343 - protein, 8 aa, Plasmodium falciparum
KNKKKKYV

SEQ ID NO: 3323344 - protein, 19 aa, Plasmodium falciparum
KNKKKQENIHTNKKDYSAK

SEQ ID NO: 3323345 - protein, 30 aa, Plasmodium falciparum
KNKKKRNHDFKDNKRKLKSNDINCKNTSDM

SEQ ID NO: 3323346 - protein, 9 aa, Plasmodium falciparum
KNKKKSDNK

SEQ ID NO: 3323347 - protein, 82 aa, Plasmodium falciparum
KNKKKSNMNEMNNNDDNNNDNNNDNNNNDNNDDNNDDNNNDNNDDNNNDNNNDNNNNNDNNNNNNNNNDSNNNCNNNNDYSS

SEQ ID NO: 3323348 - protein, 8 aa, Plasmodium falciparum
KNKKKSNN

SEQ ID NO: 3323349 - protein, 10 aa, Plasmodium falciparum
KNKKNEFKNN

SEQ ID NO: 3323350 - protein, 56 aa, Plasmodium falciparum
KNKKNEKMNKSSKYSINNNNNNNNISNKKNIRDNIKNKKDVNSNTLDDDDFEPPNV

SEQ ID NO: 3323351 - protein, 7 aa, Plasmodium falciparum
KNKKNEL

SEQ ID NO: 3323352 - protein, 15 aa, Plasmodium falciparum
KNKKNENGNENENEK

SEQ ID NO: 3323353 - protein, 6 aa, Plasmodium falciparum
KNKKNK

SEQ ID NO: 3323354 - protein, 11 aa, Plasmodium falciparum
KNKKNKDQKIN

SEQ ID NO: 3323355 - protein, 12 aa, Plasmodium falciparum
KNKKNKLNNNTK

SEQ ID NO: 3323356 - protein, 6 aa, Plasmodium falciparum
KNKKNT

SEQ ID NO: 3323357 - protein, 8 aa, Plasmodium falciparum
KNKKNTYE

SEQ ID NO: 3323358 - protein, 7 aa, Plasmodium falciparum
KNKKQKE

SEQ ID NO: 3323359 - protein, 19 aa, Plasmodium falciparum
KNKKRKGSDISDDNDESIE

SEQ ID NO: 3323360 - protein, 11 aa, Plasmodium falciparum
KNKKRKKSKNV

SEQ ID NO: 3323361 - protein, 33 aa, Plasmodium falciparum
KNKKRKRSYNYSKSNSSYSNSKSNSRSSYESDY

SEQ ID NO: 3323362 - protein, 40 aa, Plasmodium falciparum
KNKKRTLKNNNDDNKNKDDQCDDDNKNKDDQYDDDNKNKD

SEQ ID NO: 3323363 - protein, 6 aa, Plasmodium falciparum
KNKKRV

SEQ ID NO: 3323364 - protein, 5 aa, Plasmodium falciparum
KNKKT

SEQ ID NO: 3323365 - protein, 8 aa, Plasmodium falciparum
KNKKTAEE

SEQ ID NO: 3323366 - protein, 26 aa, Plasmodium falciparum
KNKKTKKTISKSNNNDNDDNNMKDEK

SEQ ID NO: 3323367 - protein, 10 aa, Plasmodium falciparum
KNKKTSNKKL

SEQ ID NO: 3323368 - protein, 8 aa, Plasmodium falciparum
KNKKTSSI

SEQ ID NO: 3323369 - protein, 6 aa, Plasmodium falciparum
KNKKYA

SEQ ID NO: 3323370 - protein, 9 aa, Plasmodium falciparum
KNKKYYKTT

SEQ ID NO: 3323371 - protein, 12 aa, Plasmodium falciparum
KNKLPMSNPQNR

SEQ ID NO: 3323372 - protein, 9 aa, Plasmodium falciparum
KNKLPTPTE

SEQ ID NO: 3323373 - protein, 10 aa, Plasmodium falciparum
KNKMERKDTN

SEQ ID NO: 3323374 - protein, 6 aa, Plasmodium falciparum
KNKMKE

SEQ ID NO: 3323375 - protein, 5 aa, Plasmodium falciparum
KNKMQ

SEQ ID NO: 3323376 - protein, 4 aa, Plasmodium falciparum
KNKN

SEQ ID NO: 3323377 - protein, 5 aa, Plasmodium falciparum
KNKND

SEQ ID NO: 3323378 - protein, 13 aa, Plasmodium falciparum
KNKNDDDKNKNNH

SEQ ID NO: 3323379 - protein, 7 aa, Plasmodium falciparum
KNKNDDI

SEQ ID NO: 3323380 - protein, 7 aa, Plasmodium falciparum
KNKNDNC

SEQ ID NO: 3323381 - protein, 9 aa, Plasmodium falciparum
KNKNDNIKN

SEQ ID NO: 3323382 - protein, 8 aa, Plasmodium falciparum
KNKNDNIS

SEQ ID NO: 3323383 - protein, 6 aa, Plasmodium falciparum
KNKNDY

SEQ ID NO: 3323384 - protein, 6 aa, Plasmodium falciparum
KNKNEE

SEQ ID NO: 3323385 - protein, 9 aa, Plasmodium falciparum
KNKNEITTQ

SEQ ID NO: 3323386 - protein, 12 aa, Plasmodium falciparum
KNKNEKTKDNGA

SEQ ID NO: 3323387 - protein, 7 aa, Plasmodium falciparum
KNKNENI

SEQ ID NO: 3323388 - protein, 34 aa, Plasmodium falciparum
KNKNENSRTKKVESLDDYKEENKNTPNKVDEEKK

SEQ ID NO: 3323389 - protein, 6 aa, Plasmodium falciparum
KNKNFE

SEQ ID NO: 3323390 - protein, 9 aa, Plasmodium falciparum
KNKNGGSLK

SEQ ID NO: 3323391 - protein, 20 aa, Plasmodium falciparum
KNKNHDNSFHNNDDVKNGEV

SEQ ID NO: 3323392 - protein, 8 aa, Plasmodium falciparum
KNKNHNQK

SEQ ID NO: 3323393 - protein, 8 aa, Plasmodium falciparum
KNKNINNK

SEQ ID NO: 3323394 - protein, 9 aa, Plasmodium falciparum
KNKNKKKKK

SEQ ID NO: 3323395 - protein, 29 aa, Plasmodium falciparum
KNKNKNKSKNVSDSTNENNHTNHNNNINK

SEQ ID NO: 3323396 - protein, 34 aa, Plasmodium falciparum
KNKNKNSNNNNNNNNNLKNKNKNNKRNRKGKKNI

SEQ ID NO: 3323397 - protein, 17 aa, Plasmodium falciparum
KNKNKPDENVNNNTQTL

SEQ ID NO: 3323398 - protein, 21 aa, Plasmodium falciparum
KNKNKSKNKISHDNTSKEYNY

SEQ ID NO: 3323399 - protein, 26 aa, Plasmodium falciparum
KNKNLQTEQLNNSDLNTKQKNKNHTL

SEQ ID NO: 3323400 - protein, 15 aa, Plasmodium falciparum
KNKNLSSYEEKKLDK

SEQ ID NO: 3323401 - protein, 6 aa, Plasmodium falciparum
KNKNMN

SEQ ID NO: 3323402 - protein, 5 aa, Plasmodium falciparum
KNKNN

SEQ ID NO: 3323403 - protein, 6 aa, Plasmodium falciparum
KNKNND

SEQ ID NO: 3323404 - protein, 18 aa, Plasmodium falciparum
KNKNNDKREDPSKNIHDK

SEQ ID NO: 3323405 - protein, 7 aa, Plasmodium falciparum
KNKNNEK

SEQ ID NO: 3323406 - protein, 9 aa, Plasmodium falciparum
KNKNNNEQS

SEQ ID NO: 3323407 - protein, 14 aa, Plasmodium falciparum
KNKNNNNNNNNNKI

SEQ ID NO: 3323408 - protein, 8 aa, Plasmodium falciparum
KNKNNSSF

SEQ ID NO: 3323409 - protein, 9 aa, Plasmodium falciparum
KNKNQKKIK

SEQ ID NO: 3323410 - protein, 9 aa, Plasmodium falciparum
KNKNQQDNY

SEQ ID NO: 3323411 - protein, 16 aa, Plasmodium falciparum
KNKNSHDQQNEEKNDD

SEQ ID NO: 3323412 - protein, 9 aa, Plasmodium falciparum
KNKNSNNKQ

SEQ ID NO: 3323413 - protein, 10 aa, Plasmodium falciparum
KNKNSNNNNI

SEQ ID NO: 3323414 - protein, 9 aa, Plasmodium falciparum
KNKNTPIKD

SEQ ID NO: 3323415 - protein, 48 aa, Plasmodium falciparum
KNKNTQGNSNHDNNNNNNNNNCNNSNSNSTCSSHSKNNLSYNNKGNGL

SEQ ID NO: 3323416 - protein, 9 aa, Plasmodium falciparum
KNKNTSSHH

SEQ ID NO: 3323417 - protein, 7 aa, Plasmodium falciparum
KNKNTTE

SEQ ID NO: 3323418 - protein, 6 aa, Plasmodium falciparum
KNKNVA

SEQ ID NO: 3323419 - protein, 6 aa, Plasmodium falciparum
KNKNVD

SEQ ID NO: 3323420 - protein, 15 aa, Plasmodium falciparum
KNKNYDNNDLDDTNS

SEQ ID NO: 3323421 - protein, 7 aa, Plasmodium falciparum
KNKNYER

SEQ ID NO: 3323422 - protein, 6 aa, Plasmodium falciparum
KNKNYI

SEQ ID NO: 3323423 - protein, 13 aa, Plasmodium falciparum
KNKPDSRNNTLES

SEQ ID NO: 3323424 - protein, 6 aa, Plasmodium falciparum
KNKPKT

SEQ ID NO: 3323425 - protein, 14 aa, Plasmodium falciparum
KNKPSHGNANSTKA

SEQ ID NO: 3323426 - protein, 7 aa, Plasmodium falciparum
KNKPTGH

SEQ ID NO: 3323427 - protein, 5 aa, Plasmodium falciparum
KNKPV

SEQ ID NO: 3323428 - protein, 4 aa, Plasmodium falciparum
KNKQ

SEQ ID NO: 3323429 - protein, 20 aa, Plasmodium falciparum
KNKQCNKKQNKERNDKDGNI

SEQ ID NO: 3323430 - protein, 8 aa, Plasmodium falciparum
KNKQGLTK

SEQ ID NO: 3323431 - protein, 14 aa, Plasmodium falciparum
KNKQIKAASSNSSQ

SEQ ID NO: 3323432 - protein, 7 aa, Plasmodium falciparum
KNKQIKH

SEQ ID NO: 3323433 - protein, 10 aa, Plasmodium falciparum
KNKQNTNELN

SEQ ID NO: 3323434 - protein, 8 aa, Plasmodium falciparum
KNKQPHIK

SEQ ID NO: 3323435 - protein, 6 aa, Plasmodium falciparum
KNKQSP

SEQ ID NO: 3323436 - protein, 18 aa, Plasmodium falciparum
KNKQTENKYFSNTAEFRK

SEQ ID NO: 3323437 - protein, 13 aa, Plasmodium falciparum
KNKQYEQVRKKKN

SEQ ID NO: 3323438 - protein, 7 aa, Plasmodium falciparum
KNKRDEI

SEQ ID NO: 3323439 - protein, 16 aa, Plasmodium falciparum
KNKREQNNEKEENETY

SEQ ID NO: 3323440 - protein, 15 aa, Plasmodium falciparum
KNKRETHKSTNGEED

SEQ ID NO: 3323441 - protein, 10 aa, Plasmodium falciparum
KNKRKENNKE

SEQ ID NO: 3323442 - protein, 12 aa, Plasmodium falciparum
KNKRNDKKEDIN

SEQ ID NO: 3323443 - protein, 9 aa, Plasmodium falciparum
KNKRNEALE

SEQ ID NO: 3323444 - protein, 14 aa, Plasmodium falciparum
KNKRQELKEQTNDL

SEQ ID NO: 3323445 - protein, 8 aa, Plasmodium falciparum
KNKRQLNG

SEQ ID NO: 3323446 - protein, 11 aa, Plasmodium falciparum
KNKRSTTISTY

SEQ ID NO: 3323447 - protein, 13 aa, Plasmodium falciparum
KNKRYENNDELPK

SEQ ID NO: 3323448 - protein, 4 aa, Plasmodium falciparum
KNKS

SEQ ID NO: 3323449 - protein, 6 aa, Plasmodium falciparum
KNKSCE

SEQ ID NO: 3323450 - protein, 11 aa, Plasmodium falciparum
KNKSDKKRDKS

SEQ ID NO: 3323451 - protein, 7 aa, Plasmodium falciparum
KNKSEES

SEQ ID NO: 3323452 - protein, 14 aa, Plasmodium falciparum
KNKSEKNKERETCE

SEQ ID NO: 3323453 - protein, 9 aa, Plasmodium falciparum
KNKSEQTAS

SEQ ID NO: 3323454 - protein, 9 aa, Plasmodium falciparum
KNKSEYSNE

SEQ ID NO: 3323455 - protein, 9 aa, Plasmodium falciparum
KNKSHDTKK

SEQ ID NO: 3323456 - protein, 10 aa, Plasmodium falciparum
KNKSHERSIS

SEQ ID NO: 3323457 - protein, 19 aa, Plasmodium falciparum
KNKSKNKNKLKHELKNLFF

SEQ ID NO: 3323458 - protein, 14 aa, Plasmodium falciparum
KNKSNEEKKKKLLD

SEQ ID NO: 3323459 - protein, 10 aa, Plasmodium falciparum
KNKSNERNYK

SEQ ID NO: 3323460 - protein, 6 aa, Plasmodium falciparum
KNKSNY

SEQ ID NO: 3323461 - protein, 22 aa, Plasmodium falciparum
KNKSPQKEKNKEEKQKKRNEEK

SEQ ID NO: 3323462 - protein, 16 aa, Plasmodium falciparum
KNKSQNNKTDESQNQN

SEQ ID NO: 3323463 - protein, 8 aa, Plasmodium falciparum
KNKSQPKY

SEQ ID NO: 3323464 - protein, 6 aa, Plasmodium falciparum
KNKSRN

SEQ ID NO: 3323465 - protein, 9 aa, Plasmodium falciparum
KNKSRNDKN

SEQ ID NO: 3323466 - protein, 9 aa, Plasmodium falciparum
KNKSSEQNI

SEQ ID NO: 3323467 - protein, 11 aa, Plasmodium falciparum
KNKSSHNKKDQ

SEQ ID NO: 3323468 - protein, 12 aa, Plasmodium falciparum
KNKSSIKSTQNY

SEQ ID NO: 3323469 - protein, 15 aa, Plasmodium falciparum
KNKSSNFSNSEKNNI

SEQ ID NO: 3323470 - protein, 7 aa, Plasmodium falciparum
KNKSTDL

SEQ ID NO: 3323471 - protein, 9 aa, Plasmodium falciparum
KNKSTTTDK

SEQ ID NO: 3323472 - protein, 7 aa, Plasmodium falciparum
KNKTAKL

SEQ ID NO: 3323473 - protein, 8 aa, Plasmodium falciparum
KNKTCTND

SEQ ID NO: 3323474 - protein, 12 aa, Plasmodium falciparum
KNKTDRIQNKTR

SEQ ID NO: 3323475 - protein, 9 aa, Plasmodium falciparum
KNKTEGVYN

SEQ ID NO: 3323476 - protein, 20 aa, Plasmodium falciparum
KNKTGMNTNENNNKNISNNN

SEQ ID NO: 3323477 - protein, 6 aa, Plasmodium falciparum
KNKTKK

SEQ ID NO: 3323478 - protein, 5 aa, Plasmodium falciparum
KNKTL

SEQ ID NO: 3323479 - protein, 16 aa, Plasmodium falciparum
KNKTLASLNSTNTKNT

SEQ ID NO: 3323480 - protein, 8 aa, Plasmodium falciparum
KNKTNDMS

SEQ ID NO: 3323481 - protein, 12 aa, Plasmodium falciparum
KNKTNEQKNEKL

SEQ ID NO: 3323482 - protein, 8 aa, Plasmodium falciparum
KNKTNGNL

SEQ ID NO: 3323483 - protein, 8 aa, Plasmodium falciparum
KNKTNYCD

SEQ ID NO: 3323484 - protein, 9 aa, Plasmodium falciparum
KNKTQKNNI

SEQ ID NO: 3323485 - protein, 7 aa, Plasmodium falciparum
KNKTSID

SEQ ID NO: 3323486 - protein, 8 aa, Plasmodium falciparum
KNKTSYNE

SEQ ID NO: 3323487 - protein, 8 aa, Plasmodium falciparum
KNKTYSYQ

SEQ ID NO: 3323488 - protein, 5 aa, Plasmodium falciparum
KNKVL

SEQ ID NO: 3323489 - protein, 15 aa, Plasmodium falciparum
KNKVSDKDDPKTRAN

SEQ ID NO: 3323490 - protein, 23 aa, Plasmodium falciparum
KNKWSSLSKKQLDDKSSYSPRTE

SEQ ID NO: 3323491 - protein, 4 aa, Plasmodium falciparum
KNKY

SEQ ID NO: 3323492 - protein, 21 aa, Plasmodium falciparum
KNKYKKKNVESRKKKKINKKK

SEQ ID NO: 3323493 - protein, 10 aa, Plasmodium falciparum
KNKYKSNDTF

SEQ ID NO: 3323494 - protein, 19 aa, Plasmodium falciparum
KNKYKTDNQKDKESSYRKY

SEQ ID NO: 3323495 - protein, 10 aa, Plasmodium falciparum
KNKYQEELKR

SEQ ID NO: 3323496 - protein, 15 aa, Plasmodium falciparum
KNKYQKNNTYQSEQN

SEQ ID NO: 3323497 - protein, 73 aa, Plasmodium falciparum
KNKYREKKKGRSQNSSNTKSDHSSNEKNYKKINDNNKYTSNDDDSSSNDSSNSNNGSNNYSDYSSTQKSRRNK

SEQ ID NO: 3323498 - protein, 13 aa, Plasmodium falciparum
KNKYYNNNTSENY

SEQ ID NO: 3323499 - protein, 8 aa, Plasmodium falciparum
KNLDEGNI

SEQ ID NO: 3323500 - protein, 4 aa, Plasmodium falciparum
KNLE

SEQ ID NO: 3323501 - protein, 7 aa, Plasmodium falciparum
KNLEEER

SEQ ID NO: 3323502 - protein, 5 aa, Plasmodium falciparum
KNLEN

SEQ ID NO: 3323503 - protein, 6 aa, Plasmodium falciparum
KNLERS

SEQ ID NO: 3323504 - protein, 6 aa, Plasmodium falciparum
KNLFNE

SEQ ID NO: 3323505 - protein, 14 aa, Plasmodium falciparum
KNLGGDNQERIRSR

SEQ ID NO: 3323506 - protein, 4 aa, Plasmodium falciparum
KNLK

SEQ ID NO: 3323507 - protein, 5 aa, Plasmodium falciparum
KNLKE

SEQ ID NO: 3323508 - protein, 33 aa, Plasmodium falciparum
KNLKKSNKKIIKKNKKKGKIKKNNSKENQPTTL

SEQ ID NO: 3323509 - protein, 12 aa, Plasmodium falciparum
KNLKNKKGKNEH

SEQ ID NO: 3323510 - protein, 7 aa, Plasmodium falciparum
KNLLDPS

SEQ ID NO: 3323511 - protein, 4 aa, Plasmodium falciparum
KNLN

SEQ ID NO: 3323512 - protein, 10 aa, Plasmodium falciparum
KNLNDYSNKT

SEQ ID NO: 3323513 - protein, 19 aa, Plasmodium falciparum
KNLNEEKHASQRIGKNEKE

SEQ ID NO: 3323514 - protein, 8 aa, Plasmodium falciparum
KNLNKERS

SEQ ID NO: 3323515 - protein, 19 aa, Plasmodium falciparum
KNLNKKKKSTKYKKKNKEL

SEQ ID NO: 3323516 - protein, 64 aa, Plasmodium falciparum
KNLNNNTKKDDSKKNNKHNTKNNKSDDETSSDNQNNSNSTVEDDDDENTVKNKKNVKVKKTARE

SEQ ID NO: 3323517 - protein, 6 aa, Plasmodium falciparum
KNLNNY

SEQ ID NO: 3323518 - protein, 28 aa, Plasmodium falciparum
KNLPREKKTNHTSDDSSISNKKNNNDKK

SEQ ID NO: 3323519 - protein, 8 aa, Plasmodium falciparum
KNLPSNLS

SEQ ID NO: 3323520 - protein, 25 aa, Plasmodium falciparum
KNLQHSDNEKNQKYLTTKSDKTTQH

SEQ ID NO: 3323521 - protein, 8 aa, Plasmodium falciparum
KNLQKGDM

SEQ ID NO: 3323522 - protein, 9 aa, Plasmodium falciparum
KNLQNSKSV

SEQ ID NO: 3323523 - protein, 7 aa, Plasmodium falciparum
KNLQQNK

SEQ ID NO: 3323524 - protein, 4 aa, Plasmodium falciparum
KNLS

SEQ ID NO: 3323525 - protein, 10 aa, Plasmodium falciparum
KNLSKRKKKL

SEQ ID NO: 3323526 - protein, 5 aa, Plasmodium falciparum
KNLSN

SEQ ID NO: 3323527 - protein, 7 aa, Plasmodium falciparum
KNLSRGD

SEQ ID NO: 3323528 - protein, 7 aa, Plasmodium falciparum
KNLSSED

SEQ ID NO: 3323529 - protein, 12 aa, Plasmodium falciparum
KNLSSGKNNNNI

SEQ ID NO: 3323530 - protein, 8 aa, Plasmodium falciparum
KNLTDSEV

SEQ ID NO: 3323531 - protein, 6 aa, Plasmodium falciparum
KNLTEE

SEQ ID NO: 3323532 - protein, 6 aa, Plasmodium falciparum
KNLTET

SEQ ID NO: 3323533 - protein, 5 aa, Plasmodium falciparum
KNLTH

SEQ ID NO: 3323534 - protein, 24 aa, Plasmodium falciparum
KNLTKRNKNKYKKNTKKKKKNIHS

SEQ ID NO: 3323535 - protein, 4 aa, Plasmodium falciparum
KNLV

SEQ ID NO: 3323536 - protein, 12 aa, Plasmodium falciparum
KNLYSDNNNNKH

SEQ ID NO: 3323537 - protein, 33 aa, Plasmodium falciparum
KNMDGSKSVNNTTASNISKSKNELEKKSSVNNN

SEQ ID NO: 3323538 - protein, 7 aa, Plasmodium falciparum
KNMDPHR

SEQ ID NO: 3323539 - protein, 7 aa, Plasmodium falciparum
KNMEEEN

SEQ ID NO: 3323540 - protein, 6 aa, Plasmodium falciparum
KNMEEK

SEQ ID NO: 3323541 - protein, 22 aa, Plasmodium falciparum
KNMENDKDINNEKENMEKEIER

SEQ ID NO: 3323542 - protein, 14 aa, Plasmodium falciparum
KNMENKKNAQKNYK

SEQ ID NO: 3323543 - protein, 11 aa, Plasmodium falciparum
KNMGKQRSQDY

SEQ ID NO: 3323544 - protein, 9 aa, Plasmodium falciparum
KNMGTLTET

SEQ ID NO: 3323545 - protein, 12 aa, Plasmodium falciparum
KNMHKTKEHNNI

SEQ ID NO: 3323546 - protein, 4 aa, Plasmodium falciparum
KNMK

SEQ ID NO: 3323547 - protein, 11 aa, Plasmodium falciparum
KNMKKKKNKYK

SEQ ID NO: 3323548 - protein, 5 aa, Plasmodium falciparum
KNMLP

SEQ ID NO: 3323549 - protein, 6 aa, Plasmodium falciparum
KNMNAH

SEQ ID NO: 3323550 - protein, 9 aa, Plasmodium falciparum
KNMNEQSDN

SEQ ID NO: 3323551 - protein, 5 aa, Plasmodium falciparum
KNMNK

SEQ ID NO: 3323552 - protein, 5 aa, Plasmodium falciparum
KNMNN

SEQ ID NO: 3323553 - protein, 16 aa, Plasmodium falciparum
KNMNSNKISDKHNMKS

SEQ ID NO: 3323554 - protein, 14 aa, Plasmodium falciparum
KNMNSSGKKKKMNA

SEQ ID NO: 3323555 - protein, 6 aa, Plasmodium falciparum
KNMNTN

SEQ ID NO: 3323556 - protein, 7 aa, Plasmodium falciparum
KNMNTSQ

SEQ ID NO: 3323557 - protein, 4 aa, Plasmodium falciparum
KNMP

SEQ ID NO: 3323558 - protein, 4 aa, Plasmodium falciparum
KNMQ

SEQ ID NO: 3323559 - protein, 13 aa, Plasmodium falciparum
KNMQNKKDEYNYS

SEQ ID NO: 3323560 - protein, 4 aa, Plasmodium falciparum
KNMS

SEQ ID NO: 3323561 - protein, 14 aa, Plasmodium falciparum
KNMSKNNNGSYNTS

SEQ ID NO: 3323562 - protein, 9 aa, Plasmodium falciparum
KNMSKSNQL

SEQ ID NO: 3323563 - protein, 7 aa, Plasmodium falciparum
KNMSSKN

SEQ ID NO: 3323564 - protein, 7 aa, Plasmodium falciparum
KNMTEKN

SEQ ID NO: 3323565 - protein, 6 aa, Plasmodium falciparum
KNMTNK

SEQ ID NO: 3323566 - protein, 4 aa, Plasmodium falciparum
KNNA

SEQ ID NO: 3323567 - protein, 10 aa, Plasmodium falciparum
KNNAHSQLRE

SEQ ID NO: 3323568 - protein, 7 aa, Plasmodium falciparum
KNNATNK

SEQ ID NO: 3323569 - protein, 14 aa, Plasmodium falciparum
KNNCNDNYNYNQNY

SEQ ID NO: 3323570 - protein, 4 aa, Plasmodium falciparum
KNND

SEQ ID NO: 3323571 - protein, 9 aa, Plasmodium falciparum
KNNDDDDDM

SEQ ID NO: 3323572 - protein, 88 aa, Plasmodium falciparum
KNNDDDDDNDDDNNDDDNNDDDNNDDDNNDDDDNDDDDNEDDDNNDNNNYDDDNNDDNNNNNNNIHTAEEYKDKSVATGNMNEENKKN

SEQ ID NO: 3323573 - protein, 45 aa, Plasmodium falciparum
KNNDDDDVDNDDVDDVDNDDDVDNDDDVDDDDIDDDDDNNKYNSN

SEQ ID NO: 3323574 - protein, 7 aa, Plasmodium falciparum
KNNDDEQ

SEQ ID NO: 3323575 - protein, 18 aa, Plasmodium falciparum
KNNDDEQNEYKNNEEYKE

SEQ ID NO: 3323576 - protein, 18 aa, Plasmodium falciparum
KNNDEQYKPCDKPGALGH

SEQ ID NO: 3323577 - protein, 6 aa, Plasmodium falciparum
KNNDFS

SEQ ID NO: 3323578 - protein, 49 aa, Plasmodium falciparum
KNNDHNNNNDNNNNDDNSKDHSNDHNSNDHNNDDDSNDDDSNDDDNNNY

SEQ ID NO: 3323579 - protein, 5 aa, Plasmodium falciparum
KNNDI

SEQ ID NO: 3323580 - protein, 27 aa, Plasmodium falciparum
KNNDISQNNDMSQNNDMSQNNDMSQNN

SEQ ID NO: 3323581 - protein, 5 aa, Plasmodium falciparum
KNNDK

SEQ ID NO: 3323582 - protein, 14 aa, Plasmodium falciparum
KNNDKEESIKNDVN

SEQ ID NO: 3323583 - protein, 9 aa, Plasmodium falciparum
KNNDKKKKD

SEQ ID NO: 3323584 - protein, 15 aa, Plasmodium falciparum
KNNDMDENNNKYGMN

SEQ ID NO: 3323585 - protein, 9 aa, Plasmodium falciparum
KNNDNDDEI

SEQ ID NO: 3323586 - protein, 7 aa, Plasmodium falciparum
KNNDNDN

SEQ ID NO: 3323587 - protein, 11 aa, Plasmodium falciparum
KNNDNDNNTGQ

SEQ ID NO: 3323588 - protein, 14 aa, Plasmodium falciparum
KNNDNENSQNFKDD

SEQ ID NO: 3323589 - protein, 7 aa, Plasmodium falciparum
KNNDNFN

SEQ ID NO: 3323590 - protein, 14 aa, Plasmodium falciparum
KNNDNNDNDNNNNN

SEQ ID NO: 3323591 - protein, 14 aa, Plasmodium falciparum
KNNDNPIDDDNPNN

SEQ ID NO: 3323592 - protein, 40 aa, Plasmodium falciparum
KNNDQNKEQKWEPSEENYEPASEKCETLDENYDQSGEKED

SEQ ID NO: 3323593 - protein, 8 aa, Plasmodium falciparum
KNNDTLNY

SEQ ID NO: 3323594 - protein, 6 aa, Plasmodium falciparum
KNNDTY

SEQ ID NO: 3323595 - protein, 6 aa, Plasmodium falciparum
KNNDVN

SEQ ID NO: 3323596 - protein, 5 aa, Plasmodium falciparum
KNNEE

SEQ ID NO: 3323597 - protein, 6 aa, Plasmodium falciparum
KNNEED

SEQ ID NO: 3323598 - protein, 8 aa, Plasmodium falciparum
KNNEEIKE

SEQ ID NO: 3323599 - protein, 11 aa, Plasmodium falciparum
KNNEETDENDD

SEQ ID NO: 3323600 - protein, 7 aa, Plasmodium falciparum
KNNEGDS

SEQ ID NO: 3323601 - protein, 8 aa, Plasmodium falciparum
KNNEIESL

SEQ ID NO: 3323602 - protein, 31 aa, Plasmodium falciparum
KNNEIKQKHKNDKINDKINDKENINENPLND

SEQ ID NO: 3323603 - protein, 8 aa, Plasmodium falciparum
KNNEINAD

SEQ ID NO: 3323604 - protein, 6 aa, Plasmodium falciparum
KNNEIR

SEQ ID NO: 3323605 - protein, 13 aa, Plasmodium falciparum
KNNEKARKKNYKK

SEQ ID NO: 3323606 - protein, 10 aa, Plasmodium falciparum
KNNEKENEEV

SEQ ID NO: 3323607 - protein, 8 aa, Plasmodium falciparum
KNNEKGTN

SEQ ID NO: 3323608 - protein, 38 aa, Plasmodium falciparum
KNNEKIKRNNTHDDDNNNNDNNDNNRNGRNYNSGVNKK

SEQ ID NO: 3323609 - protein, 13 aa, Plasmodium falciparum
KNNEKREDAIHKK

SEQ ID NO: 3323610 - protein, 18 aa, Plasmodium falciparum
KNNEMKNNEMKDNEMKDN

SEQ ID NO: 3323611 - protein, 8 aa, Plasmodium falciparum
KNNENDKK

SEQ ID NO: 3323612 - protein, 6 aa, Plasmodium falciparum
KNNENI

SEQ ID NO: 3323613 - protein, 16 aa, Plasmodium falciparum
KNNENKPDEHSNDKTL

SEQ ID NO: 3323614 - protein, 7 aa, Plasmodium falciparum
KNNENLK

SEQ ID NO: 3323615 - protein, 14 aa, Plasmodium falciparum
KNNENNNNNNNNKN

SEQ ID NO: 3323616 - protein, 8 aa, Plasmodium falciparum
KNNENSNS

SEQ ID NO: 3323617 - protein, 7 aa, Plasmodium falciparum
KNNENTK

SEQ ID NO: 3323618 - protein, 8 aa, Plasmodium falciparum
KNNEQEKK

SEQ ID NO: 3323619 - protein, 6 aa, Plasmodium falciparum
KNNEQK

SEQ ID NO: 3323620 - protein, 27 aa, Plasmodium falciparum
KNNESKRNIYDEKDDSHDDNDDGDNME

SEQ ID NO: 3323621 - protein, 7 aa, Plasmodium falciparum
KNNESTN

SEQ ID NO: 3323622 - protein, 13 aa, Plasmodium falciparum
KNNETIEKEKNDI

SEQ ID NO: 3323623 - protein, 12 aa, Plasmodium falciparum
KNNETISTNTSG

SEQ ID NO: 3323624 - protein, 6 aa, Plasmodium falciparum
KNNETL

SEQ ID NO: 3323625 - protein, 7 aa, Plasmodium falciparum
KNNETSY

SEQ ID NO: 3323626 - protein, 5 aa, Plasmodium falciparum
KNNEY

SEQ ID NO: 3323627 - protein, 10 aa, Plasmodium falciparum
KNNEYDTNET

SEQ ID NO: 3323628 - protein, 6 aa, Plasmodium falciparum
KNNEYG

SEQ ID NO: 3323629 - protein, 15 aa, Plasmodium falciparum
KNNFDNNNNNNINNY

SEQ ID NO: 3323630 - protein, 6 aa, Plasmodium falciparum
KNNFEL

SEQ ID NO: 3323631 - protein, 5 aa, Plasmodium falciparum
KNNFN

SEQ ID NO: 3323632 - protein, 6 aa, Plasmodium falciparum
KNNFSK

SEQ ID NO: 3323633 - protein, 11 aa, Plasmodium falciparum
KNNFSNECNNS

SEQ ID NO: 3323634 - protein, 6 aa, Plasmodium falciparum
KNNGDG

SEQ ID NO: 3323635 - protein, 7 aa, Plasmodium falciparum
KNNGDNV

SEQ ID NO: 3323636 - protein, 5 aa, Plasmodium falciparum
KNNGK

SEQ ID NO: 3323637 - protein, 10 aa, Plasmodium falciparum
KNNGKENNKH

SEQ ID NO: 3323638 - protein, 16 aa, Plasmodium falciparum
KNNGLKKSKEDVSKRK

SEQ ID NO: 3323639 - protein, 11 aa, Plasmodium falciparum
KNNGNLKIGDS

SEQ ID NO: 3323640 - protein, 58 aa, Plasmodium falciparum
KNNGNNNNNDNNDNNDNNYNDNNNNNNNNNNNNNNNNNNNNNNNNNNNNNNNHDNNNN

SEQ ID NO: 3323641 - protein, 9 aa, Plasmodium falciparum
KNNGNQYDA

SEQ ID NO: 3323642 - protein, 14 aa, Plasmodium falciparum
KNNGSINRNDSECS

SEQ ID NO: 3323643 - protein, 8 aa, Plasmodium falciparum
KNNGSNIM

SEQ ID NO: 3323644 - protein, 5 aa, Plasmodium falciparum
KNNGT

SEQ ID NO: 3323645 - protein, 10 aa, Plasmodium falciparum
KNNHEESNSG

SEQ ID NO: 3323646 - protein, 27 aa, Plasmodium falciparum
KNNHKNKHNNMNHNENSSRKNSNINKN

SEQ ID NO: 3323647 - protein, 11 aa, Plasmodium falciparum
KNNHKYENNEY

SEQ ID NO: 3323648 - protein, 23 aa, Plasmodium falciparum
KNNHTRKSKSYKSSYHEKSDNQK

SEQ ID NO: 3323649 - protein, 7 aa, Plasmodium falciparum
KNNIDKD

SEQ ID NO: 3323650 - protein, 12 aa, Plasmodium falciparum
KNNIDSNNYNGN

SEQ ID NO: 3323651 - protein, 6 aa, Plasmodium falciparum
KNNIEK

SEQ ID NO: 3323652 - protein, 13 aa, Plasmodium falciparum
KNNIERKNSKNGL

SEQ ID NO: 3323653 - protein, 9 aa, Plasmodium falciparum
KNNINDKKK

SEQ ID NO: 3323654 - protein, 16 aa, Plasmodium falciparum
KNNININSKNGNSNNL

SEQ ID NO: 3323655 - protein, 7 aa, Plasmodium falciparum
KNNINNL

SEQ ID NO: 3323656 - protein, 14 aa, Plasmodium falciparum
KNNINSSNNNINNN

SEQ ID NO: 3323657 - protein, 7 aa, Plasmodium falciparum
KNNIPKD

SEQ ID NO: 3323658 - protein, 8 aa, Plasmodium falciparum
KNNIPSSD

SEQ ID NO: 3323659 - protein, 15 aa, Plasmodium falciparum
KNNIPTNDKKGKNYL

SEQ ID NO: 3323660 - protein, 5 aa, Plasmodium falciparum
KNNIQ

SEQ ID NO: 3323661 - protein, 37 aa, Plasmodium falciparum
KNNISSDINTKNEDSISINSSNNEQVKNINSSPVSNN

SEQ ID NO: 3323662 - protein, 25 aa, Plasmodium falciparum
KNNISSKKEIKNNEDSDDQNDHDNE

SEQ ID NO: 3323663 - protein, 16 aa, Plasmodium falciparum
KNNITNVKAQKNNITN

SEQ ID NO: 3323664 - protein, 11 aa, Plasmodium falciparum
KNNIVNDNTSN

SEQ ID NO: 3323665 - protein, 6 aa, Plasmodium falciparum
KNNKCD

SEQ ID NO: 3323666 - protein, 8 aa, Plasmodium falciparum
KNNKEEYY

SEQ ID NO: 3323667 - protein, 14 aa, Plasmodium falciparum
KNNKEIEVKLVLNK

SEQ ID NO: 3323668 - protein, 9 aa, Plasmodium falciparum
KNNKEWNKA

SEQ ID NO: 3323669 - protein, 47 aa, Plasmodium falciparum
KNNKFNKTNNRNNNNNNNNNNKNNNNNDDGNINYQNTNEFKDNKKNM

SEQ ID NO: 3323670 - protein, 5 aa, Plasmodium falciparum
KNNKH

SEQ ID NO: 3323671 - protein, 6 aa, Plasmodium falciparum
KNNKIE

SEQ ID NO: 3323672 - protein, 6 aa, Plasmodium falciparum
KNNKIH

SEQ ID NO: 3323673 - protein, 6 aa, Plasmodium falciparum
KNNKIT

SEQ ID NO: 3323674 - protein, 8 aa, Plasmodium falciparum
KNNKKAKI

SEQ ID NO: 3323675 - protein, 9 aa, Plasmodium falciparum
KNNKKKKAH

SEQ ID NO: 3323676 - protein, 13 aa, Plasmodium falciparum
KNNKKKKKKKKKI

SEQ ID NO: 3323677 - protein, 8 aa, Plasmodium falciparum
KNNKKQGY

SEQ ID NO: 3323678 - protein, 6 aa, Plasmodium falciparum
KNNKMN

SEQ ID NO: 3323679 - protein, 52 aa, Plasmodium falciparum
KNNKNDDIKKNITNNNNNNNNKINNNNNNSDGDGDKGSYNSYNAKQKNRRRY

SEQ ID NO: 3323680 - protein, 13 aa, Plasmodium falciparum
KNNKNDSNESYDK

SEQ ID NO: 3323681 - protein, 26 aa, Plasmodium falciparum
KNNKNENEKENNNNNINNNNNCSNNC

SEQ ID NO: 3323682 - protein, 6 aa, Plasmodium falciparum
KNNKNI

SEQ ID NO: 3323683 - protein, 9 aa, Plasmodium falciparum
KNNKNKEEI

SEQ ID NO: 3323684 - protein, 8 aa, Plasmodium falciparum
KNNKNKGE

SEQ ID NO: 3323685 - protein, 8 aa, Plasmodium falciparum
KNNKNNDV

SEQ ID NO: 3323686 - protein, 10 aa, Plasmodium falciparum
KNNKNNKNFR

SEQ ID NO: 3323687 - protein, 10 aa, Plasmodium falciparum
KNNKNNSCEQ

SEQ ID NO: 3323688 - protein, 16 aa, Plasmodium falciparum
KNNKNNSNNKEQVEEK

SEQ ID NO: 3323689 - protein, 8 aa, Plasmodium falciparum
KNNKNNSV

SEQ ID NO: 3323690 - protein, 16 aa, Plasmodium falciparum
KNNKNTDKNNFNNNNN

SEQ ID NO: 3323691 - protein, 23 aa, Plasmodium falciparum
KNNKNVKYKSSNNSSTNNTNTFS

SEQ ID NO: 3323692 - protein, 6 aa, Plasmodium falciparum
KNNKQH

SEQ ID NO: 3323693 - protein, 70 aa, Plasmodium falciparum
KNNKQNNVTHKNNEDIKNDNSKDIKNDNSKDIKNDNSKDIKNDNSKDIKNDNSKEIQNNKSDEIQNNNNS

SEQ ID NO: 3323694 - protein, 22 aa, Plasmodium falciparum
KNNKQRNHFQGKEKKNTKDEVA

SEQ ID NO: 3323695 - protein, 11 aa, Plasmodium falciparum
KNNKRNKQMST

SEQ ID NO: 3323696 - protein, 9 aa, Plasmodium falciparum
KNNKRSIRS

SEQ ID NO: 3323697 - protein, 8 aa, Plasmodium falciparum
KNNKSNSY

SEQ ID NO: 3323698 - protein, 8 aa, Plasmodium falciparum
KNNKSSIY

SEQ ID NO: 3323699 - protein, 14 aa, Plasmodium falciparum
KNNKTDEKYSNPKN

SEQ ID NO: 3323700 - protein, 8 aa, Plasmodium falciparum
KNNKTKND

SEQ ID NO: 3323701 - protein, 8 aa, Plasmodium falciparum
KNNKTLEN

SEQ ID NO: 3323702 - protein, 5 aa, Plasmodium falciparum
KNNKY

SEQ ID NO: 3323703 - protein, 16 aa, Plasmodium falciparum
KNNKYNYENKNNYSYN

SEQ ID NO: 3323704 - protein, 7 aa, Plasmodium falciparum
KNNKYQN

SEQ ID NO: 3323705 - protein, 4 aa, Plasmodium falciparum
KNNL

SEQ ID NO: 3323706 - protein, 20 aa, Plasmodium falciparum
KNNLDVKEGDENVGKKETPK

SEQ ID NO: 3323707 - protein, 5 aa, Plasmodium falciparum
KNNLE

SEQ ID NO: 3323708 - protein, 9 aa, Plasmodium falciparum
KNNLEGTEE

SEQ ID NO: 3323709 - protein, 7 aa, Plasmodium falciparum
KNNLQEK

SEQ ID NO: 3323710 - protein, 7 aa, Plasmodium falciparum
KNNLQQS

SEQ ID NO: 3323711 - protein, 9 aa, Plasmodium falciparum
KNNLSTNKN

SEQ ID NO: 3323712 - protein, 27 aa, Plasmodium falciparum
KNNMCDDNKNNMCDKSKNNMCDDNKKE

SEQ ID NO: 3323713 - protein, 8 aa, Plasmodium falciparum
KNNMEDQN

SEQ ID NO: 3323714 - protein, 12 aa, Plasmodium falciparum
KNNMESIKKAME

SEQ ID NO: 3323715 - protein, 6 aa, Plasmodium falciparum
KNNMNE

SEQ ID NO: 3323716 - protein, 6 aa, Plasmodium falciparum
KNNMSQ

SEQ ID NO: 3323717 - protein, 15 aa, Plasmodium falciparum
KNNMYENEKNNMYEN

SEQ ID NO: 3323718 - protein, 5 aa, Plasmodium falciparum
KNNNC

SEQ ID NO: 3323719 - protein, 8 aa, Plasmodium falciparum
KNNNCNNV

SEQ ID NO: 3323720 - protein, 13 aa, Plasmodium falciparum
KNNNDAQSYKGIN

SEQ ID NO: 3323721 - protein, 16 aa, Plasmodium falciparum
KNNNDINRKNSNRHKN

SEQ ID NO: 3323722 - protein, 14 aa, Plasmodium falciparum
KNNNDLVQSIMELS

SEQ ID NO: 3323723 - protein, 14 aa, Plasmodium falciparum
KNNNDNNNNNDEDG

SEQ ID NO: 3323724 - protein, 9 aa, Plasmodium falciparum
KNNNEASNK

SEQ ID NO: 3323725 - protein, 8 aa, Plasmodium falciparum
KNNNEDIK

SEQ ID NO: 3323726 - protein, 8 aa, Plasmodium falciparum
KNNNEEKA

SEQ ID NO: 3323727 - protein, 11 aa, Plasmodium falciparum
KNNNEENDDTF

SEQ ID NO: 3323728 - protein, 7 aa, Plasmodium falciparum
KNNNEHA

SEQ ID NO: 3323729 - protein, 6 aa, Plasmodium falciparum
KNNNEN

SEQ ID NO: 3323730 - protein, 11 aa, Plasmodium falciparum
KNNNENIKPDN

SEQ ID NO: 3323731 - protein, 5 aa, Plasmodium falciparum
KNNNF

SEQ ID NO: 3323732 - protein, 19 aa, Plasmodium falciparum
KNNNGNVTNLENKSNHSNG

SEQ ID NO: 3323733 - protein, 5 aa, Plasmodium falciparum
KNNNH

SEQ ID NO: 3323734 - protein, 80 aa, Plasmodium falciparum
KNNNHLSDISQNSKEDSNKYKEKKKIKEKEKIKRKEKIDDEEYTENNIDDKNYTYNRDDEINDIESDNSSDNESIGPKPL

SEQ ID NO: 3323735 - protein, 8 aa, Plasmodium falciparum
KNNNHNNY

SEQ ID NO: 3323736 - protein, 6 aa, Plasmodium falciparum
KNNNIE

SEQ ID NO: 3323737 - protein, 16 aa, Plasmodium falciparum
KNNNINNNINNNNNNS

SEQ ID NO: 3323738 - protein, 41 aa, Plasmodium falciparum
KNNNIQTNNINDNTVNEKINNTSKKDMLNNTQNNNDSEKND

SEQ ID NO: 3323739 - protein, 36 aa, Plasmodium falciparum
KNNNISNISNNDLDKKDKTNMNTNKNEEKDNTFTNK

SEQ ID NO: 3323740 - protein, 6 aa, Plasmodium falciparum
KNNNKI

SEQ ID NO: 3323741 - protein, 7 aa, Plasmodium falciparum
KNNNKIS

SEQ ID NO: 3323742 - protein, 8 aa, Plasmodium falciparum
KNNNKKNN

SEQ ID NO: 3323743 - protein, 8 aa, Plasmodium falciparum
KNNNKSFG

SEQ ID NO: 3323744 - protein, 22 aa, Plasmodium falciparum
KNNNKYEHTNNNISTNTSNFKN

SEQ ID NO: 3323745 - protein, 12 aa, Plasmodium falciparum
KNNNKYSAAERN

SEQ ID NO: 3323746 - protein, 8 aa, Plasmodium falciparum
KNNNLENK

SEQ ID NO: 3323747 - protein, 6 aa, Plasmodium falciparum
KNNNLY

SEQ ID NO: 3323748 - protein, 7 aa, Plasmodium falciparum
KNNNMGD

SEQ ID NO: 3323749 - protein, 10 aa, Plasmodium falciparum
KNNNMNNNNN

SEQ ID NO: 3323750 - protein, 6 aa, Plasmodium falciparum
KNNNMT

SEQ ID NO: 3323751 - protein, 8 aa, Plasmodium falciparum
KNNNNDDI

SEQ ID NO: 3323752 - protein, 10 aa, Plasmodium falciparum
KNNNNDSNSE

SEQ ID NO: 3323753 - protein, 11 aa, Plasmodium falciparum
KNNNNKNNNIN

SEQ ID NO: 3323754 - protein, 17 aa, Plasmodium falciparum
KNNNNKNNNNNNKNNID

SEQ ID NO: 3323755 - protein, 7 aa, Plasmodium falciparum
KNNNNLQ

SEQ ID NO: 3323756 - protein, 14 aa, Plasmodium falciparum
KNNNNMENNNDSNI

SEQ ID NO: 3323757 - protein, 16 aa, Plasmodium falciparum
KNNNNMKNKNKNTNKR

SEQ ID NO: 3323758 - protein, 26 aa, Plasmodium falciparum
KNNNNNDDDDNNNNNNNNNNDNNDNN

SEQ ID NO: 3323759 - protein, 44 aa, Plasmodium falciparum
KNNNNNDNNNNNNDNNNNNNDNNNNNNNNNNNNNNNNNNNNNNG

SEQ ID NO: 3323760 - protein, 8 aa, Plasmodium falciparum
KNNNNNHH

SEQ ID NO: 3323761 - protein, 26 aa, Plasmodium falciparum
KNNNNNKENTSMNVKSGNSIYQNKND

SEQ ID NO: 3323762 - protein, 8 aa, Plasmodium falciparum
KNNNNNKY

SEQ ID NO: 3323763 - protein, 10 aa, Plasmodium falciparum
KNNNNNNFYN

SEQ ID NO: 3323764 - protein, 14 aa, Plasmodium falciparum
KNNNNNNNHNNNNA

SEQ ID NO: 3323765 - protein, 9 aa, Plasmodium falciparum
KNNNNNNNK

SEQ ID NO: 3323766 - protein, 17 aa, Plasmodium falciparum
KNNNNNNNKKNTNRTNS

SEQ ID NO: 3323767 - protein, 9 aa, Plasmodium falciparum
KNNNNNNNN

SEQ ID NO: 3323768 - protein, 14 aa, Plasmodium falciparum
KNNNNNNNNINENS

SEQ ID NO: 3323769 - protein, 34 aa, Plasmodium falciparum
KNNNNNNNNKNNNNNNNNNNNNYSSKGSIQRTNY

SEQ ID NO: 3323770 - protein, 18 aa, Plasmodium falciparum
KNNNNNNNNNNNNNLNNY

SEQ ID NO: 3323771 - protein, 15 aa, Plasmodium falciparum
KNNNNNNNNNNNNNN

SEQ ID NO: 3323772 - protein, 16 aa, Plasmodium falciparum
KNNNNNNNNNNNNNNY

SEQ ID NO: 3323773 - protein, 20 aa, Plasmodium falciparum
KNNNNNNNNNNSSSNNPFDN

SEQ ID NO: 3323774 - protein, 7 aa, Plasmodium falciparum
KNNNNSN

SEQ ID NO: 3323775 - protein, 21 aa, Plasmodium falciparum
KNNNNSNNSENKSLSKNLSST

SEQ ID NO: 3323776 - protein, 5 aa, Plasmodium falciparum
KNNNP

SEQ ID NO: 3323777 - protein, 30 aa, Plasmodium falciparum
KNNNPDNRSITKNNVQDMNESKDEKKKTVK

SEQ ID NO: 3323778 - protein, 27 aa, Plasmodium falciparum
KNNNPENMKNNFGNNKYYDNQGNNENN

SEQ ID NO: 3323779 - protein, 9 aa, Plasmodium falciparum
KNNNPPTPV

SEQ ID NO: 3323780 - protein, 5 aa, Plasmodium falciparum
KNNNQ

SEQ ID NO: 3323781 - protein, 10 aa, Plasmodium falciparum
KNNNRSFSNR

SEQ ID NO: 3323782 - protein, 14 aa, Plasmodium falciparum
KNNNSKKKTSTNIN

SEQ ID NO: 3323783 - protein, 10 aa, Plasmodium falciparum
KNNNSNKEKA

SEQ ID NO: 3323784 - protein, 9 aa, Plasmodium falciparum
KNNNSNKKD

SEQ ID NO: 3323785 - protein, 13 aa, Plasmodium falciparum
KNNNSNNQENYEN

SEQ ID NO: 3323786 - protein, 9 aa, Plasmodium falciparum
KNNNSSNTL

SEQ ID NO: 3323787 - protein, 47 aa, Plasmodium falciparum
KNNNSTNTGINNSSNNNNNNKKKNNNNNNNNNNNNNKNKNNNNNNNI

SEQ ID NO: 3323788 - protein, 12 aa, Plasmodium falciparum
KNNNSYDETKKD

SEQ ID NO: 3323789 - protein, 9 aa, Plasmodium falciparum
KNNNTGNLH

SEQ ID NO: 3323790 - protein, 11 aa, Plasmodium falciparum
KNNNTNGQEKD

SEQ ID NO: 3323791 - protein, 9 aa, Plasmodium falciparum
KNNNTNRNF

SEQ ID NO: 3323792 - protein, 7 aa, Plasmodium falciparum
KNNNTQY

SEQ ID NO: 3323793 - protein, 8 aa, Plasmodium falciparum
KNNNTSNK

SEQ ID NO: 3323794 - protein, 8 aa, Plasmodium falciparum
KNNNTYEK

SEQ ID NO: 3323795 - protein, 5 aa, Plasmodium falciparum
KNNNY

SEQ ID NO: 3323796 - protein, 7 aa, Plasmodium falciparum
KNNNYDN

SEQ ID NO: 3323797 - protein, 9 aa, Plasmodium falciparum
KNNNYNNYN

SEQ ID NO: 3323798 - protein, 7 aa, Plasmodium falciparum
KNNNYNR

SEQ ID NO: 3323799 - protein, 6 aa, Plasmodium falciparum
KNNPIT

SEQ ID NO: 3323800 - protein, 7 aa, Plasmodium falciparum
KNNPKCK

SEQ ID NO: 3323801 - protein, 5 aa, Plasmodium falciparum
KNNPL

SEQ ID NO: 3323802 - protein, 7 aa, Plasmodium falciparum
KNNPNQN

SEQ ID NO: 3323803 - protein, 17 aa, Plasmodium falciparum
KNNPSPPKETTEITRSR

SEQ ID NO: 3323804 - protein, 9 aa, Plasmodium falciparum
KNNPTHDNS

SEQ ID NO: 3323805 - protein, 6 aa, Plasmodium falciparum
KNNQEA

SEQ ID NO: 3323806 - protein, 10 aa, Plasmodium falciparum
KNNQEFKEKN

SEQ ID NO: 3323807 - protein, 6 aa, Plasmodium falciparum
KNNQGF

SEQ ID NO: 3323808 - protein, 6 aa, Plasmodium falciparum
KNNQHD

SEQ ID NO: 3323809 - protein, 56 aa, Plasmodium falciparum
KNNQKEDINKESLSKIENNNNNNNNKSDDNINVTTSNTEEQKENKENKNDNTNDNI

SEQ ID NO: 3323810 - protein, 6 aa, Plasmodium falciparum
KNNQLG

SEQ ID NO: 3323811 - protein, 5 aa, Plasmodium falciparum
KNNQN

SEQ ID NO: 3323812 - protein, 11 aa, Plasmodium falciparum
KNNQNLGTSSE

SEQ ID NO: 3323813 - protein, 8 aa, Plasmodium falciparum
KNNQNNNL

SEQ ID NO: 3323814 - protein, 13 aa, Plasmodium falciparum
KNNQNNYKSNQYV

SEQ ID NO: 3323815 - protein, 8 aa, Plasmodium falciparum
KNNQNYEN

SEQ ID NO: 3323816 - protein, 14 aa, Plasmodium falciparum
KNNQQKKKNSKTLN

SEQ ID NO: 3323817 - protein, 11 aa, Plasmodium falciparum
KNNQSSNKATS

SEQ ID NO: 3323818 - protein, 6 aa, Plasmodium falciparum
KNNQTL

SEQ ID NO: 3323819 - protein, 6 aa, Plasmodium falciparum
KNNQTN

SEQ ID NO: 3323820 - protein, 6 aa, Plasmodium falciparum
KNNQTY

SEQ ID NO: 3323821 - protein, 12 aa, Plasmodium falciparum
KNNRSNTNSELY

SEQ ID NO: 3323822 - protein, 7 aa, Plasmodium falciparum
KNNRSVK

SEQ ID NO: 3323823 - protein, 26 aa, Plasmodium falciparum
KNNSDKNSSDDNNIDINSNERRSKYS

SEQ ID NO: 3323824 - protein, 10 aa, Plasmodium falciparum
KNNSEGTITN

SEQ ID NO: 3323825 - protein, 12 aa, Plasmodium falciparum
KNNSIEKRTDTP

SEQ ID NO: 3323826 - protein, 8 aa, Plasmodium falciparum
KNNSIKYA

SEQ ID NO: 3323827 - protein, 36 aa, Plasmodium falciparum
KNNSKDEKKINKKKDAQGDKINIPDDNNNNNNNNKI

SEQ ID NO: 3323828 - protein, 11 aa, Plasmodium falciparum
KNNSKDTFNTY

SEQ ID NO: 3323829 - protein, 6 aa, Plasmodium falciparum
KNNSKN

SEQ ID NO: 3323830 - protein, 10 aa, Plasmodium falciparum
KNNSLDSNKY

SEQ ID NO: 3323831 - protein, 30 aa, Plasmodium falciparum
KNNSLETNITNDTNLDQQTDEQKKKENDEF

SEQ ID NO: 3323832 - protein, 8 aa, Plasmodium falciparum
KNNSNDNT

SEQ ID NO: 3323833 - protein, 6 aa, Plasmodium falciparum
KNNSNI

SEQ ID NO: 3323834 - protein, 18 aa, Plasmodium falciparum
KNNSNNEKNNNINSINDD

SEQ ID NO: 3323835 - protein, 19 aa, Plasmodium falciparum
KNNSNNNNNNNNKDIENEE

SEQ ID NO: 3323836 - protein, 9 aa, Plasmodium falciparum
KNNSNNNSN

SEQ ID NO: 3323837 - protein, 8 aa, Plasmodium falciparum
KNNSNNYS

SEQ ID NO: 3323838 - protein, 20 aa, Plasmodium falciparum
KNNSNSSNNNNLPYDKENVT

SEQ ID NO: 3323839 - protein, 7 aa, Plasmodium falciparum
KNNSRKE

SEQ ID NO: 3323840 - protein, 42 aa, Plasmodium falciparum
KNNSSDKSNESDEDDEEEEIECEGEGEDECEEERMINEINDI

SEQ ID NO: 3323841 - protein, 8 aa, Plasmodium falciparum
KNNSSINY

SEQ ID NO: 3323842 - protein, 11 aa, Plasmodium falciparum
KNNSSNNMNDS

SEQ ID NO: 3323843 - protein, 8 aa, Plasmodium falciparum
KNNSTNEN

SEQ ID NO: 3323844 - protein, 7 aa, Plasmodium falciparum
KNNSTNI

SEQ ID NO: 3323845 - protein, 9 aa, Plasmodium falciparum
KNNSTNNSI

SEQ ID NO: 3323846 - protein, 28 aa, Plasmodium falciparum
KNNSTYKSSEENDNHKKRNKKKKKKKQK

SEQ ID NO: 3323847 - protein, 10 aa, Plasmodium falciparum
KNNTDNDTVR

SEQ ID NO: 3323848 - protein, 9 aa, Plasmodium falciparum
KNNTDNFSE

SEQ ID NO: 3323849 - protein, 9 aa, Plasmodium falciparum
KNNTDTTST

SEQ ID NO: 3323850 - protein, 11 aa, Plasmodium falciparum
KNNTEKENSIK

SEQ ID NO: 3323851 - protein, 7 aa, Plasmodium falciparum
KNNTFDN

SEQ ID NO: 3323852 - protein, 16 aa, Plasmodium falciparum
KNNTLKEELKNNNNHY

SEQ ID NO: 3323853 - protein, 13 aa, Plasmodium falciparum
KNNTLQNRDDKIK

SEQ ID NO: 3323854 - protein, 8 aa, Plasmodium falciparum
KNNTNDIY

SEQ ID NO: 3323855 - protein, 6 aa, Plasmodium falciparum
KNNTNI

SEQ ID NO: 3323856 - protein, 15 aa, Plasmodium falciparum
KNNTNNKNKNNNNNI

SEQ ID NO: 3323857 - protein, 12 aa, Plasmodium falciparum
KNNTPDDNKKNI

SEQ ID NO: 3323858 - protein, 7 aa, Plasmodium falciparum
KNNTRDD

SEQ ID NO: 3323859 - protein, 7 aa, Plasmodium falciparum
KNNTTKY

SEQ ID NO: 3323860 - protein, 6 aa, Plasmodium falciparum
KNNVLT

SEQ ID NO: 3323861 - protein, 12 aa, Plasmodium falciparum
KNNVNDEYSYEN

SEQ ID NO: 3323862 - protein, 4 aa, Plasmodium falciparum
KNNY

SEQ ID NO: 3323863 - protein, 8 aa, Plasmodium falciparum
KNNYDDEK

SEQ ID NO: 3323864 - protein, 7 aa, Plasmodium falciparum
KNNYDEN

SEQ ID NO: 3323865 - protein, 14 aa, Plasmodium falciparum
KNNYDEVNSEYEEN

SEQ ID NO: 3323866 - protein, 8 aa, Plasmodium falciparum
KNNYDNNN

SEQ ID NO: 3323867 - protein, 6 aa, Plasmodium falciparum
KNNYEE

SEQ ID NO: 3323868 - protein, 14 aa, Plasmodium falciparum
KNNYPNNMKSSAHN

SEQ ID NO: 3323869 - protein, 5 aa, Plasmodium falciparum
KNNYS

SEQ ID NO: 3323870 - protein, 5 aa, Plasmodium falciparum
KNNYV

SEQ ID NO: 3323871 - protein, 6 aa, Plasmodium falciparum
KNPDSL

SEQ ID NO: 3323872 - protein, 7 aa, Plasmodium falciparum
KNPEENK

SEQ ID NO: 3323873 - protein, 8 aa, Plasmodium falciparum
KNPENNIN

SEQ ID NO: 3323874 - protein, 8 aa, Plasmodium falciparum
KNPEQTRD

SEQ ID NO: 3323875 - protein, 7 aa, Plasmodium falciparum
KNPFPSP

SEQ ID NO: 3323876 - protein, 7 aa, Plasmodium falciparum
KNPHRVK

SEQ ID NO: 3323877 - protein, 12 aa, Plasmodium falciparum
KNPIGEDSSSFN

SEQ ID NO: 3323878 - protein, 7 aa, Plasmodium falciparum
KNPIKNN

SEQ ID NO: 3323879 - protein, 7 aa, Plasmodium falciparum
KNPISDV

SEQ ID NO: 3323880 - protein, 14 aa, Plasmodium falciparum
KNPKEINKKKTKIV

SEQ ID NO: 3323881 - protein, 6 aa, Plasmodium falciparum
KNPKHI

SEQ ID NO: 3323882 - protein, 10 aa, Plasmodium falciparum
KNPKKDEDIY

SEQ ID NO: 3323883 - protein, 17 aa, Plasmodium falciparum
KNPKKRLGSGGTDAQEI

SEQ ID NO: 3323884 - protein, 5 aa, Plasmodium falciparum
KNPLP

SEQ ID NO: 3323885 - protein, 20 aa, Plasmodium falciparum
KNPLSYSNDKIGKKNSQDLE

SEQ ID NO: 3323886 - protein, 4 aa, Plasmodium falciparum
KNPN

SEQ ID NO: 3323887 - protein, 8 aa, Plasmodium falciparum
KNPNEEST

SEQ ID NO: 3323888 - protein, 11 aa, Plasmodium falciparum
KNPNEHSNPSK

SEQ ID NO: 3323889 - protein, 6 aa, Plasmodium falciparum
KNPNES

SEQ ID NO: 3323890 - protein, 6 aa, Plasmodium falciparum
KNPNYY

SEQ ID NO: 3323891 - protein, 7 aa, Plasmodium falciparum
KNPPAYK

SEQ ID NO: 3323892 - protein, 8 aa, Plasmodium falciparum
KNPPDESN

SEQ ID NO: 3323893 - protein, 11 aa, Plasmodium falciparum
KNPPKSENRWD

SEQ ID NO: 3323894 - protein, 7 aa, Plasmodium falciparum
KNPPKVV

SEQ ID NO: 3323895 - protein, 13 aa, Plasmodium falciparum
KNPPLLKKNEGST

SEQ ID NO: 3323896 - protein, 6 aa, Plasmodium falciparum
KNPPLS

SEQ ID NO: 3323897 - protein, 6 aa, Plasmodium falciparum
KNPQKK

SEQ ID NO: 3323898 - protein, 9 aa, Plasmodium falciparum
KNPQKRIDT

SEQ ID NO: 3323899 - protein, 10 aa, Plasmodium falciparum
KNPRPTRAEV

SEQ ID NO: 3323900 - protein, 16 aa, Plasmodium falciparum
KNPRRAHNEEDTFNSY

SEQ ID NO: 3323901 - protein, 7 aa, Plasmodium falciparum
KNPRTNE

SEQ ID NO: 3323902 - protein, 7 aa, Plasmodium falciparum
KNPSEKS

SEQ ID NO: 3323903 - protein, 8 aa, Plasmodium falciparum
KNPSPKRI

SEQ ID NO: 3323904 - protein, 6 aa, Plasmodium falciparum
KNPTLY

SEQ ID NO: 3323905 - protein, 8 aa, Plasmodium falciparum
KNPVTNQT

SEQ ID NO: 3323906 - protein, 6 aa, Plasmodium falciparum
KNPYKN

SEQ ID NO: 3323907 - protein, 9 aa, Plasmodium falciparum
KNPYNENSS

SEQ ID NO: 3323908 - protein, 8 aa, Plasmodium falciparum
KNPYPQKA

SEQ ID NO: 3323909 - protein, 7 aa, Plasmodium falciparum
KNQANRI

SEQ ID NO: 3323910 - protein, 16 aa, Plasmodium falciparum
KNQDEDEQDGKDLIEE

SEQ ID NO: 3323911 - protein, 6 aa, Plasmodium falciparum
KNQDER

SEQ ID NO: 3323912 - protein, 8 aa, Plasmodium falciparum
KNQDGQIN

SEQ ID NO: 3323913 - protein, 6 aa, Plasmodium falciparum
KNQDNL

SEQ ID NO: 3323914 - protein, 6 aa, Plasmodium falciparum
KNQEIK

SEQ ID NO: 3323915 - protein, 19 aa, Plasmodium falciparum
KNQEKTNDEINQDDTNANS

SEQ ID NO: 3323916 - protein, 8 aa, Plasmodium falciparum
KNQESNIN

SEQ ID NO: 3323917 - protein, 8 aa, Plasmodium falciparum
KNQGNSNY

SEQ ID NO: 3323918 - protein, 24 aa, Plasmodium falciparum
KNQGNTNNMTNNMSTKKSSKLSNT

SEQ ID NO: 3323919 - protein, 8 aa, Plasmodium falciparum
KNQITNSN

SEQ ID NO: 3323920 - protein, 8 aa, Plasmodium falciparum
KNQKDDAH

SEQ ID NO: 3323921 - protein, 12 aa, Plasmodium falciparum
KNQKEEEEDDKN

SEQ ID NO: 3323922 - protein, 14 aa, Plasmodium falciparum
KNQKGDKKNLSYDN

SEQ ID NO: 3323923 - protein, 15 aa, Plasmodium falciparum
KNQKKSEKNKKKRYI

SEQ ID NO: 3323924 - protein, 10 aa, Plasmodium falciparum
KNQKNGNINI

SEQ ID NO: 3323925 - protein, 7 aa, Plasmodium falciparum
KNQKNKN

SEQ ID NO: 3323926 - protein, 7 aa, Plasmodium falciparum
KNQKRKH

SEQ ID NO: 3323927 - protein, 6 aa, Plasmodium falciparum
KNQKYG

SEQ ID NO: 3323928 - protein, 4 aa, Plasmodium falciparum
KNQL

SEQ ID NO: 3323929 - protein, 5 aa, Plasmodium falciparum
KNQLN

SEQ ID NO: 3323930 - protein, 8 aa, Plasmodium falciparum
KNQMPNKI

SEQ ID NO: 3323931 - protein, 8 aa, Plasmodium falciparum
KNQNEKDI

SEQ ID NO: 3323932 - protein, 9 aa, Plasmodium falciparum
KNQNERCEE

SEQ ID NO: 3323933 - protein, 6 aa, Plasmodium falciparum
KNQNGI

SEQ ID NO: 3323934 - protein, 11 aa, Plasmodium falciparum
KNQNKNKYNTL

SEQ ID NO: 3323935 - protein, 6 aa, Plasmodium falciparum
KNQNKQ

SEQ ID NO: 3323936 - protein, 7 aa, Plasmodium falciparum
KNQNNQK

SEQ ID NO: 3323937 - protein, 7 aa, Plasmodium falciparum
KNQNRNY

SEQ ID NO: 3323938 - protein, 12 aa, Plasmodium falciparum
KNQNSLQSTNTK

SEQ ID NO: 3323939 - protein, 6 aa, Plasmodium falciparum
KNQNTH

SEQ ID NO: 3323940 - protein, 14 aa, Plasmodium falciparum
KNQNTPKKRNKCNF

SEQ ID NO: 3323941 - protein, 13 aa, Plasmodium falciparum
KNQNVKEEKINNT

SEQ ID NO: 3323942 - protein, 7 aa, Plasmodium falciparum
KNQPIQK

SEQ ID NO: 3323943 - protein, 32 aa, Plasmodium falciparum
KNQQATHKHSEEEEEQEEEKKKNKKTKKTNTF

SEQ ID NO: 3323944 - protein, 31 aa, Plasmodium falciparum
KNQQNENNNNNIQHNNNNNNIPSHKKNIDKA

SEQ ID NO: 3323945 - protein, 7 aa, Plasmodium falciparum
KNQQSLK

SEQ ID NO: 3323946 - protein, 10 aa, Plasmodium falciparum
KNQQSSHSQQ

SEQ ID NO: 3323947 - protein, 7 aa, Plasmodium falciparum
KNQRDSN

SEQ ID NO: 3323948 - protein, 6 aa, Plasmodium falciparum
KNQRLN

SEQ ID NO: 3323949 - protein, 5 aa, Plasmodium falciparum
KNQTK

SEQ ID NO: 3323950 - protein, 6 aa, Plasmodium falciparum
KNQTKL

SEQ ID NO: 3323951 - protein, 6 aa, Plasmodium falciparum
KNQTNE

SEQ ID NO: 3323952 - protein, 18 aa, Plasmodium falciparum
KNQTTNESSISKNNKVDS

SEQ ID NO: 3323953 - protein, 20 aa, Plasmodium falciparum
KNQVKDKKEILDNKKQEIKK

SEQ ID NO: 3323954 - protein, 11 aa, Plasmodium falciparum
KNQYHAKTEEN

SEQ ID NO: 3323955 - protein, 7 aa, Plasmodium falciparum
KNQYTHD

SEQ ID NO: 3323956 - protein, 21 aa, Plasmodium falciparum
KNRASGYEPKFPEETFRTPDG

SEQ ID NO: 3323957 - protein, 4 aa, Plasmodium falciparum
KNRD

SEQ ID NO: 3323958 - protein, 6 aa, Plasmodium falciparum
KNRDEG

SEQ ID NO: 3323959 - protein, 11 aa, Plasmodium falciparum
KNRDKEPQDKT

SEQ ID NO: 3323960 - protein, 5 aa, Plasmodium falciparum
KNREG

SEQ ID NO: 3323961 - protein, 20 aa, Plasmodium falciparum
KNRGNLKDPGVDSPYRNRTV

SEQ ID NO: 3323962 - protein, 5 aa, Plasmodium falciparum
KNRGT

SEQ ID NO: 3323963 - protein, 19 aa, Plasmodium falciparum
KNRHNKGKNSSTSNNTNNY

SEQ ID NO: 3323964 - protein, 8 aa, Plasmodium falciparum
KNRIDNSG

SEQ ID NO: 3323965 - protein, 4 aa, Plasmodium falciparum
KNRK

SEQ ID NO: 3323966 - protein, 7 aa, Plasmodium falciparum
KNRKDDK

SEQ ID NO: 3323967 - protein, 5 aa, Plasmodium falciparum
KNRKE

SEQ ID NO: 3323968 - protein, 17 aa, Plasmodium falciparum
KNRKMSPTRANKVSSRS

SEQ ID NO: 3323969 - protein, 9 aa, Plasmodium falciparum
KNRKNEEIK

SEQ ID NO: 3323970 - protein, 14 aa, Plasmodium falciparum
KNRKRMRSSQNNFQ

SEQ ID NO: 3323971 - protein, 6 aa, Plasmodium falciparum
KNRKVD

SEQ ID NO: 3323972 - protein, 23 aa, Plasmodium falciparum
KNRLRNTNEQKDNDKSNEYKNKT

SEQ ID NO: 3323973 - protein, 15 aa, Plasmodium falciparum
KNRNEKKKKNRKTDF

SEQ ID NO: 3323974 - protein, 7 aa, Plasmodium falciparum
KNRNENK

SEQ ID NO: 3323975 - protein, 6 aa, Plasmodium falciparum
KNRNFT

SEQ ID NO: 3323976 - protein, 12 aa, Plasmodium falciparum
KNRNKHNNNNIN

SEQ ID NO: 3323977 - protein, 57 aa, Plasmodium falciparum
KNRNMKNNANPHGSSNNNNNNNNNNNNNNTYYNSTYKNANERNHTNNNCRDDYSRNN

SEQ ID NO: 3323978 - protein, 15 aa, Plasmodium falciparum
KNRNNDNYKNDNNYY

SEQ ID NO: 3323979 - protein, 10 aa, Plasmodium falciparum
KNRNTSTTQS

SEQ ID NO: 3323980 - protein, 10 aa, Plasmodium falciparum
KNRNTTTEQE

SEQ ID NO: 3323981 - protein, 7 aa, Plasmodium falciparum
KNRQGEK

SEQ ID NO: 3323982 - protein, 5 aa, Plasmodium falciparum
KNRQK

SEQ ID NO: 3323983 - protein, 6 aa, Plasmodium falciparum
KNRRHP

SEQ ID NO: 3323984 - protein, 5 aa, Plasmodium falciparum
KNRRN

SEQ ID NO: 3323985 - protein, 5 aa, Plasmodium falciparum
KNRSF

SEQ ID NO: 3323986 - protein, 13 aa, Plasmodium falciparum
KNRSKFVDSMIMC

SEQ ID NO: 3323987 - protein, 6 aa, Plasmodium falciparum
KNRSSC

SEQ ID NO: 3323988 - protein, 8 aa, Plasmodium falciparum
KNRSSCYG

SEQ ID NO: 3323989 - protein, 5 aa, Plasmodium falciparum
KNRSY

SEQ ID NO: 3323990 - protein, 5 aa, Plasmodium falciparum
KNRVG

SEQ ID NO: 3323991 - protein, 10 aa, Plasmodium falciparum
KNRYNDEKMR

SEQ ID NO: 3323992 - protein, 8 aa, Plasmodium falciparum
KNRYTGEN

SEQ ID NO: 3323993 - protein, 6 aa, Plasmodium falciparum
KNSAHN

SEQ ID NO: 3323994 - protein, 7 aa, Plasmodium falciparum
KNSDDEI

SEQ ID NO: 3323995 - protein, 12 aa, Plasmodium falciparum
KNSDEDKISVKN

SEQ ID NO: 3323996 - protein, 7 aa, Plasmodium falciparum
KNSDEVL

SEQ ID NO: 3323997 - protein, 14 aa, Plasmodium falciparum
KNSDFNDNTNNSNN

SEQ ID NO: 3323998 - protein, 7 aa, Plasmodium falciparum
KNSDQNI

SEQ ID NO: 3323999 - protein, 10 aa, Plasmodium falciparum
KNSDQTDDIE

SEQ ID NO: 3324000 - protein, 6 aa, Plasmodium falciparum
KNSEDY

SEQ ID NO: 3324001 - protein, 5 aa, Plasmodium falciparum
KNSEE

SEQ ID NO: 3324002 - protein, 12 aa, Plasmodium falciparum
KNSEEKKSLKKK

SEQ ID NO: 3324003 - protein, 10 aa, Plasmodium falciparum
KNSEENYKER

SEQ ID NO: 3324004 - protein, 6 aa, Plasmodium falciparum
KNSEIN

SEQ ID NO: 3324005 - protein, 7 aa, Plasmodium falciparum
KNSEKNV

SEQ ID NO: 3324006 - protein, 6 aa, Plasmodium falciparum
KNSEKV

SEQ ID NO: 3324007 - protein, 9 aa, Plasmodium falciparum
KNSENGELA

SEQ ID NO: 3324008 - protein, 5 aa, Plasmodium falciparum
KNSFE

SEQ ID NO: 3324009 - protein, 28 aa, Plasmodium falciparum
KNSFNKNQGSYFSDSEYKTPNTKKSNEY

SEQ ID NO: 3324010 - protein, 8 aa, Plasmodium falciparum
KNSFSSEY

SEQ ID NO: 3324011 - protein, 4 aa, Plasmodium falciparum
KNSG

SEQ ID NO: 3324012 - protein, 12 aa, Plasmodium falciparum
KNSGADPSRTLP

SEQ ID NO: 3324013 - protein, 9 aa, Plasmodium falciparum
KNSGNHAKK

SEQ ID NO: 3324014 - protein, 7 aa, Plasmodium falciparum
KNSGNLN

SEQ ID NO: 3324015 - protein, 8 aa, Plasmodium falciparum
KNSGRNNV

SEQ ID NO: 3324016 - protein, 5 aa, Plasmodium falciparum
KNSGT

SEQ ID NO: 3324017 - protein, 8 aa, Plasmodium falciparum
KNSHNMKE

SEQ ID NO: 3324018 - protein, 6 aa, Plasmodium falciparum
KNSHSM

SEQ ID NO: 3324019 - protein, 10 aa, Plasmodium falciparum
KNSHTQNEQS

SEQ ID NO: 3324020 - protein, 6 aa, Plasmodium falciparum
KNSHTS

SEQ ID NO: 3324021 - protein, 25 aa, Plasmodium falciparum
KNSHYKRKKGNSHNKHNKSNSYNNY

SEQ ID NO: 3324022 - protein, 4 aa, Plasmodium falciparum
KNSI

SEQ ID NO: 3324023 - protein, 7 aa, Plasmodium falciparum
KNSIKDN

SEQ ID NO: 3324024 - protein, 36 aa, Plasmodium falciparum
KNSIKEKKKDMKTNNINNNNNNNEDKNKRRNKNKNK

SEQ ID NO: 3324025 - protein, 5 aa, Plasmodium falciparum
KNSIQ

SEQ ID NO: 3324026 - protein, 8 aa, Plasmodium falciparum
KNSISNEK

SEQ ID NO: 3324027 - protein, 5 aa, Plasmodium falciparum
KNSIV

SEQ ID NO: 3324028 - protein, 4 aa, Plasmodium falciparum
KNSK

SEQ ID NO: 3324029 - protein, 9 aa, Plasmodium falciparum
KNSKCDNRK

SEQ ID NO: 3324030 - protein, 11 aa, Plasmodium falciparum
KNSKCTNNTNC

SEQ ID NO: 3324031 - protein, 18 aa, Plasmodium falciparum
KNSKDGKKVGEKKKDKYN

SEQ ID NO: 3324032 - protein, 9 aa, Plasmodium falciparum
KNSKEKGII

SEQ ID NO: 3324033 - protein, 48 aa, Plasmodium falciparum
KNSKKEDINDEDDDDEEDDDDDDDDDDDDDDDDDDDDDDDDDDEDDED

SEQ ID NO: 3324034 - protein, 48 aa, Plasmodium falciparum
KNSKKKKNATINDDNNKSRNKKNKNIHNNNNNNNNNNISNYHSGDNNK

SEQ ID NO: 3324035 - protein, 9 aa, Plasmodium falciparum
KNSKLNEKY

SEQ ID NO: 3324036 - protein, 17 aa, Plasmodium falciparum
KNSKSDNVKNNEKIKGT

SEQ ID NO: 3324037 - protein, 6 aa, Plasmodium falciparum
KNSKSN

SEQ ID NO: 3324038 - protein, 6 aa, Plasmodium falciparum
KNSKVK

SEQ ID NO: 3324039 - protein, 7 aa, Plasmodium falciparum
KNSLEKK

SEQ ID NO: 3324040 - protein, 5 aa, Plasmodium falciparum
KNSLI

SEQ ID NO: 3324041 - protein, 7 aa, Plasmodium falciparum
KNSLSKD

SEQ ID NO: 3324042 - protein, 7 aa, Plasmodium falciparum
KNSMNDF

SEQ ID NO: 3324043 - protein, 29 aa, Plasmodium falciparum
KNSMNSNDDIQNSNNNNNNNNNNNMVNNP

SEQ ID NO: 3324044 - protein, 4 aa, Plasmodium falciparum
KNSN

SEQ ID NO: 3324045 - protein, 5 aa, Plasmodium falciparum
KNSNA

SEQ ID NO: 3324046 - protein, 13 aa, Plasmodium falciparum
KNSNDKNYLSQNE

SEQ ID NO: 3324047 - protein, 17 aa, Plasmodium falciparum
KNSNDNNLKKTKKNSII

SEQ ID NO: 3324048 - protein, 6 aa, Plasmodium falciparum
KNSNET

SEQ ID NO: 3324049 - protein, 9 aa, Plasmodium falciparum
KNSNHQKYE

SEQ ID NO: 3324050 - protein, 7 aa, Plasmodium falciparum
KNSNHTN

SEQ ID NO: 3324051 - protein, 5 aa, Plasmodium falciparum
KNSNI

SEQ ID NO: 3324052 - protein, 8 aa, Plasmodium falciparum
KNSNINDD

SEQ ID NO: 3324053 - protein, 7 aa, Plasmodium falciparum
KNSNINS

SEQ ID NO: 3324054 - protein, 9 aa, Plasmodium falciparum
KNSNKNNEN

SEQ ID NO: 3324055 - protein, 10 aa, Plasmodium falciparum
KNSNKSHKKT

SEQ ID NO: 3324056 - protein, 6 aa, Plasmodium falciparum
KNSNKY

SEQ ID NO: 3324057 - protein, 5 aa, Plasmodium falciparum
KNSNL

SEQ ID NO: 3324058 - protein, 23 aa, Plasmodium falciparum
KNSNNNDTVGNSSSTEDINKVPK

SEQ ID NO: 3324059 - protein, 17 aa, Plasmodium falciparum
KNSNNNNNNNKSNISNV

SEQ ID NO: 3324060 - protein, 63 aa, Plasmodium falciparum
KNSNNNNNNNKYNNNSNNSNNSNNNNNNNNNNNNNNNNSSNNNNNSNNNNNNNSINSHHSHNN

SEQ ID NO: 3324061 - protein, 22 aa, Plasmodium falciparum
KNSNNNNNNNKYSNHMKKSGNH

SEQ ID NO: 3324062 - protein, 11 aa, Plasmodium falciparum
KNSNQENINQN

SEQ ID NO: 3324063 - protein, 9 aa, Plasmodium falciparum
KNSPGDVSN

SEQ ID NO: 3324064 - protein, 7 aa, Plasmodium falciparum
KNSPKKH

SEQ ID NO: 3324065 - protein, 8 aa, Plasmodium falciparum
KNSPLNEL

SEQ ID NO: 3324066 - protein, 6 aa, Plasmodium falciparum
KNSPNL

SEQ ID NO: 3324067 - protein, 4 aa, Plasmodium falciparum
KNSQ

SEQ ID NO: 3324068 - protein, 8 aa, Plasmodium falciparum
KNSQAYRG

SEQ ID NO: 3324069 - protein, 29 aa, Plasmodium falciparum
KNSRKNKNNKTDADNTNGNNNNVNNTNAG

SEQ ID NO: 3324070 - protein, 32 aa, Plasmodium falciparum
KNSRSKSSYKKESYLDNSKDKNSSHESYENNI

SEQ ID NO: 3324071 - protein, 9 aa, Plasmodium falciparum
KNSRTKNYT

SEQ ID NO: 3324072 - protein, 4 aa, Plasmodium falciparum
KNSS

SEQ ID NO: 3324073 - protein, 9 aa, Plasmodium falciparum
KNSSEEKNA

SEQ ID NO: 3324074 - protein, 9 aa, Plasmodium falciparum
KNSSESVKE

SEQ ID NO: 3324075 - protein, 7 aa, Plasmodium falciparum
KNSSGII

SEQ ID NO: 3324076 - protein, 8 aa, Plasmodium falciparum
KNSSITNN

SEQ ID NO: 3324077 - protein, 7 aa, Plasmodium falciparum
KNSSKGT

SEQ ID NO: 3324078 - protein, 9 aa, Plasmodium falciparum
KNSSKNIKT

SEQ ID NO: 3324079 - protein, 20 aa, Plasmodium falciparum
KNSSKYSPQKLDEDKNAIKG

SEQ ID NO: 3324080 - protein, 6 aa, Plasmodium falciparum
KNSSLP

SEQ ID NO: 3324081 - protein, 6 aa, Plasmodium falciparum
KNSSNI

SEQ ID NO: 3324082 - protein, 12 aa, Plasmodium falciparum
KNSSNYNNSEGY

SEQ ID NO: 3324083 - protein, 6 aa, Plasmodium falciparum
KNSSSD

SEQ ID NO: 3324084 - protein, 8 aa, Plasmodium falciparum
KNSSVEEY

SEQ ID NO: 3324085 - protein, 4 aa, Plasmodium falciparum
KNST

SEQ ID NO: 3324086 - protein, 7 aa, Plasmodium falciparum
KNSTDIN

SEQ ID NO: 3324087 - protein, 7 aa, Plasmodium falciparum
KNSTDND

SEQ ID NO: 3324088 - protein, 10 aa, Plasmodium falciparum
KNSTEIKKKT

SEQ ID NO: 3324089 - protein, 8 aa, Plasmodium falciparum
KNSTRKHM

SEQ ID NO: 3324090 - protein, 5 aa, Plasmodium falciparum
KNSTT

SEQ ID NO: 3324091 - protein, 6 aa, Plasmodium falciparum
KNSTTE

SEQ ID NO: 3324092 - protein, 9 aa, Plasmodium falciparum
KNSTTNVNV

SEQ ID NO: 3324093 - protein, 14 aa, Plasmodium falciparum
KNSTTSQEKKEENI

SEQ ID NO: 3324094 - protein, 5 aa, Plasmodium falciparum
KNSTV

SEQ ID NO: 3324095 - protein, 4 aa, Plasmodium falciparum
KNSV

SEQ ID NO: 3324096 - protein, 12 aa, Plasmodium falciparum
KNSVEDSKENIN

SEQ ID NO: 3324097 - protein, 4 aa, Plasmodium falciparum
KNSW

SEQ ID NO: 3324098 - protein, 4 aa, Plasmodium falciparum
KNSY

SEQ ID NO: 3324099 - protein, 8 aa, Plasmodium falciparum
KNSYDTNS

SEQ ID NO: 3324100 - protein, 10 aa, Plasmodium falciparum
KNSYEDDKGK

SEQ ID NO: 3324101 - protein, 38 aa, Plasmodium falciparum
KNSYKRKNNNMNHDNYDNYDNYDNYDNYDNYDNEDDQD

SEQ ID NO: 3324102 - protein, 6 aa, Plasmodium falciparum
KNSYLE

SEQ ID NO: 3324103 - protein, 5 aa, Plasmodium falciparum
KNSYN

SEQ ID NO: 3324104 - protein, 8 aa, Plasmodium falciparum
KNSYNFDP

SEQ ID NO: 3324105 - protein, 6 aa, Plasmodium falciparum
KNSYNN

SEQ ID NO: 3324106 - protein, 6 aa, Plasmodium falciparum
KNSYPN

SEQ ID NO: 3324107 - protein, 7 aa, Plasmodium falciparum
KNSYPWS

SEQ ID NO: 3324108 - protein, 7 aa, Plasmodium falciparum
KNTAGMP

SEQ ID NO: 3324109 - protein, 24 aa, Plasmodium falciparum
KNTDEKEKEENGEKEGEEKGGSIK

SEQ ID NO: 3324110 - protein, 7 aa, Plasmodium falciparum
KNTDEND

SEQ ID NO: 3324111 - protein, 7 aa, Plasmodium falciparum
KNTDHID

SEQ ID NO: 3324112 - protein, 8 aa, Plasmodium falciparum
KNTDKEDI

SEQ ID NO: 3324113 - protein, 5 aa, Plasmodium falciparum
KNTDL

SEQ ID NO: 3324114 - protein, 18 aa, Plasmodium falciparum
KNTDQIEETTKNKLSKEF

SEQ ID NO: 3324115 - protein, 9 aa, Plasmodium falciparum
KNTDTNKKS

SEQ ID NO: 3324116 - protein, 4 aa, Plasmodium falciparum
KNTE

SEQ ID NO: 3324117 - protein, 12 aa, Plasmodium falciparum
KNTEDENNTSSS

SEQ ID NO: 3324118 - protein, 8 aa, Plasmodium falciparum
KNTEEDML

SEQ ID NO: 3324119 - protein, 9 aa, Plasmodium falciparum
KNTEEGKKY

SEQ ID NO: 3324120 - protein, 7 aa, Plasmodium falciparum
KNTEEMK

SEQ ID NO: 3324121 - protein, 8 aa, Plasmodium falciparum
KNTEGNKD

SEQ ID NO: 3324122 - protein, 6 aa, Plasmodium falciparum
KNTEQN

SEQ ID NO: 3324123 - protein, 32 aa, Plasmodium falciparum
KNTEQNLQKKHNKMSQVSKQSNNKNNKNNSHL

SEQ ID NO: 3324124 - protein, 22 aa, Plasmodium falciparum
KNTFNKNKEDDTDSKGQHNSDN

SEQ ID NO: 3324125 - protein, 7 aa, Plasmodium falciparum
KNTGGGC

SEQ ID NO: 3324126 - protein, 5 aa, Plasmodium falciparum
KNTGQ

SEQ ID NO: 3324127 - protein, 4 aa, Plasmodium falciparum
KNTH

SEQ ID NO: 3324128 - protein, 8 aa, Plasmodium falciparum
KNTHTGNI

SEQ ID NO: 3324129 - protein, 7 aa, Plasmodium falciparum
KNTHTPQ

SEQ ID NO: 3324130 - protein, 5 aa, Plasmodium falciparum
KNTID

SEQ ID NO: 3324131 - protein, 6 aa, Plasmodium falciparum
KNTIHE

SEQ ID NO: 3324132 - protein, 7 aa, Plasmodium falciparum
KNTINKN

SEQ ID NO: 3324133 - protein, 6 aa, Plasmodium falciparum
KNTKDI

SEQ ID NO: 3324134 - protein, 9 aa, Plasmodium falciparum
KNTKECNKK

SEQ ID NO: 3324135 - protein, 7 aa, Plasmodium falciparum
KNTKEDN

SEQ ID NO: 3324136 - protein, 22 aa, Plasmodium falciparum
KNTKGKGTKYKDKFNKNKTYDY

SEQ ID NO: 3324137 - protein, 10 aa, Plasmodium falciparum
KNTKNEIQNF

SEQ ID NO: 3324138 - protein, 6 aa, Plasmodium falciparum
KNTKNI

SEQ ID NO: 3324139 - protein, 6 aa, Plasmodium falciparum
KNTLEY

SEQ ID NO: 3324140 - protein, 10 aa, Plasmodium falciparum
KNTLKNNNYN

SEQ ID NO: 3324141 - protein, 5 aa, Plasmodium falciparum
KNTLP

SEQ ID NO: 3324142 - protein, 15 aa, Plasmodium falciparum
KNTNENTSKQSNDYK

SEQ ID NO: 3324143 - protein, 20 aa, Plasmodium falciparum
KNTNEVQNQNKQNYNGTQNN

SEQ ID NO: 3324144 - protein, 11 aa, Plasmodium falciparum
KNTNINKNDSY

SEQ ID NO: 3324145 - protein, 6 aa, Plasmodium falciparum
KNTNME

SEQ ID NO: 3324146 - protein, 6 aa, Plasmodium falciparum
KNTNNI

SEQ ID NO: 3324147 - protein, 17 aa, Plasmodium falciparum
KNTNNNETSNDTTPFKD

SEQ ID NO: 3324148 - protein, 13 aa, Plasmodium falciparum
KNTNNNQTNDETN

SEQ ID NO: 3324149 - protein, 7 aa, Plasmodium falciparum
KNTNQTC

SEQ ID NO: 3324150 - protein, 6 aa, Plasmodium falciparum
KNTNSL

SEQ ID NO: 3324151 - protein, 7 aa, Plasmodium falciparum
KNTNTTT

SEQ ID NO: 3324152 - protein, 7 aa, Plasmodium falciparum
KNTNVNR

SEQ ID NO: 3324153 - protein, 5 aa, Plasmodium falciparum
KNTNY

SEQ ID NO: 3324154 - protein, 10 aa, Plasmodium falciparum
KNTNYKKDNY

SEQ ID NO: 3324155 - protein, 4 aa, Plasmodium falciparum
KNTP

SEQ ID NO: 3324156 - protein, 7 aa, Plasmodium falciparum
KNTPDKW

SEQ ID NO: 3324157 - protein, 21 aa, Plasmodium falciparum
KNTPINNKKKETRLSQGKKNT

SEQ ID NO: 3324158 - protein, 6 aa, Plasmodium falciparum
KNTPKS

SEQ ID NO: 3324159 - protein, 8 aa, Plasmodium falciparum
KNTQHDND

SEQ ID NO: 3324160 - protein, 7 aa, Plasmodium falciparum
KNTQLNK

SEQ ID NO: 3324161 - protein, 8 aa, Plasmodium falciparum
KNTRLAKT

SEQ ID NO: 3324162 - protein, 5 aa, Plasmodium falciparum
KNTRR

SEQ ID NO: 3324163 - protein, 7 aa, Plasmodium falciparum
KNTSCEE

SEQ ID NO: 3324164 - protein, 7 aa, Plasmodium falciparum
KNTSETN

SEQ ID NO: 3324165 - protein, 5 aa, Plasmodium falciparum
KNTSH

SEQ ID NO: 3324166 - protein, 6 aa, Plasmodium falciparum
KNTSHT

SEQ ID NO: 3324167 - protein, 7 aa, Plasmodium falciparum
KNTSPNV

SEQ ID NO: 3324168 - protein, 7 aa, Plasmodium falciparum
KNTSTDN

SEQ ID NO: 3324169 - protein, 8 aa, Plasmodium falciparum
KNTTKYPL

SEQ ID NO: 3324170 - protein, 7 aa, Plasmodium falciparum
KNTTNKE

SEQ ID NO: 3324171 - protein, 7 aa, Plasmodium falciparum
KNTTSNF

SEQ ID NO: 3324172 - protein, 15 aa, Plasmodium falciparum
KNTTTKKKKKQTKLS

SEQ ID NO: 3324173 - protein, 14 aa, Plasmodium falciparum
KNTVSNNKNKFNTK

SEQ ID NO: 3324174 - protein, 4 aa, Plasmodium falciparum
KNTY

SEQ ID NO: 3324175 - protein, 6 aa, Plasmodium falciparum
KNTYAY

SEQ ID NO: 3324176 - protein, 7 aa, Plasmodium falciparum
KNTYDEG

SEQ ID NO: 3324177 - protein, 6 aa, Plasmodium falciparum
KNTYEE

SEQ ID NO: 3324178 - protein, 8 aa, Plasmodium falciparum
KNTYESKK

SEQ ID NO: 3324179 - protein, 4 aa, Plasmodium falciparum
KNVA

SEQ ID NO: 3324180 - protein, 11 aa, Plasmodium falciparum
KNVATQNNHDV

SEQ ID NO: 3324181 - protein, 15 aa, Plasmodium falciparum
KNVDDNNNNLKEENE

SEQ ID NO: 3324182 - protein, 5 aa, Plasmodium falciparum
KNVDE

SEQ ID NO: 3324183 - protein, 9 aa, Plasmodium falciparum
KNVDEDNET

SEQ ID NO: 3324184 - protein, 11 aa, Plasmodium falciparum
KNVDGKNTYNA

SEQ ID NO: 3324185 - protein, 25 aa, Plasmodium falciparum
KNVDHRESVSQEISTGYGKGISRGM

SEQ ID NO: 3324186 - protein, 26 aa, Plasmodium falciparum
KNVDTYSNNTKDINESNKSSVSGSIN

SEQ ID NO: 3324187 - protein, 4 aa, Plasmodium falciparum
KNVE

SEQ ID NO: 3324188 - protein, 6 aa, Plasmodium falciparum
KNVEDM

SEQ ID NO: 3324189 - protein, 13 aa, Plasmodium falciparum
KNVEDMKDAKNHD

SEQ ID NO: 3324190 - protein, 7 aa, Plasmodium falciparum
KNVEGGL

SEQ ID NO: 3324191 - protein, 5 aa, Plasmodium falciparum
KNVEK

SEQ ID NO: 3324192 - protein, 7 aa, Plasmodium falciparum
KNVEKKD

SEQ ID NO: 3324193 - protein, 7 aa, Plasmodium falciparum
KNVEKNN

SEQ ID NO: 3324194 - protein, 14 aa, Plasmodium falciparum
KNVENGKDKEEEME

SEQ ID NO: 3324195 - protein, 6 aa, Plasmodium falciparum
KNVENQ

SEQ ID NO: 3324196 - protein, 5 aa, Plasmodium falciparum
KNVEP

SEQ ID NO: 3324197 - protein, 10 aa, Plasmodium falciparum
KNVEPEDDFG

SEQ ID NO: 3324198 - protein, 18 aa, Plasmodium falciparum
KNVESPKKDNTLNGTGPN

SEQ ID NO: 3324199 - protein, 15 aa, Plasmodium falciparum
KNVGEQHHKGNEKED

SEQ ID NO: 3324200 - protein, 13 aa, Plasmodium falciparum
KNVGKSSSSDINH

SEQ ID NO: 3324201 - protein, 14 aa, Plasmodium falciparum
KNVGNSQKGKNRSL

SEQ ID NO: 3324202 - protein, 5 aa, Plasmodium falciparum
KNVGP

SEQ ID NO: 3324203 - protein, 7 aa, Plasmodium falciparum
KNVGPDE

SEQ ID NO: 3324204 - protein, 6 aa, Plasmodium falciparum
KNVIED

SEQ ID NO: 3324205 - protein, 5 aa, Plasmodium falciparum
KNVIN

SEQ ID NO: 3324206 - protein, 15 aa, Plasmodium falciparum
KNVINNENNVKNNKT

SEQ ID NO: 3324207 - protein, 11 aa, Plasmodium falciparum
KNVKDNKDNDF

SEQ ID NO: 3324208 - protein, 17 aa, Plasmodium falciparum
KNVKDRENIKKEEKQIN

SEQ ID NO: 3324209 - protein, 10 aa, Plasmodium falciparum
KNVKEKNPTI

SEQ ID NO: 3324210 - protein, 10 aa, Plasmodium falciparum
KNVKEQNNEH

SEQ ID NO: 3324211 - protein, 18 aa, Plasmodium falciparum
KNVKGDLTYAEKKPKDTS

SEQ ID NO: 3324212 - protein, 6 aa, Plasmodium falciparum
KNVKKT

SEQ ID NO: 3324213 - protein, 11 aa, Plasmodium falciparum
KNVKNKKKNGN

SEQ ID NO: 3324214 - protein, 17 aa, Plasmodium falciparum
KNVKSEKKKKKKNENLS

SEQ ID NO: 3324215 - protein, 7 aa, Plasmodium falciparum
KNVKSSV

SEQ ID NO: 3324216 - protein, 6 aa, Plasmodium falciparum
KNVNAN

SEQ ID NO: 3324217 - protein, 7 aa, Plasmodium falciparum
KNVNDDV

SEQ ID NO: 3324218 - protein, 12 aa, Plasmodium falciparum
KNVNEKKENINE

SEQ ID NO: 3324219 - protein, 13 aa, Plasmodium falciparum
KNVNGTNNTDDYR

SEQ ID NO: 3324220 - protein, 13 aa, Plasmodium falciparum
KNVNKINEENEEE

SEQ ID NO: 3324221 - protein, 21 aa, Plasmodium falciparum
KNVNNNNPLNNNNNNSNNNKT

SEQ ID NO: 3324222 - protein, 44 aa, Plasmodium falciparum
KNVNQNDSNMTEKNVSEEIQENKGENIQKNESRTIEKKEKTQKL

SEQ ID NO: 3324223 - protein, 7 aa, Plasmodium falciparum
KNVNSCN

SEQ ID NO: 3324224 - protein, 6 aa, Plasmodium falciparum
KNVNYD

SEQ ID NO: 3324225 - protein, 4 aa, Plasmodium falciparum
KNVP

SEQ ID NO: 3324226 - protein, 6 aa, Plasmodium falciparum
KNVPDE

SEQ ID NO: 3324227 - protein, 5 aa, Plasmodium falciparum
KNVPR

SEQ ID NO: 3324228 - protein, 9 aa, Plasmodium falciparum
KNVPSSNSA

SEQ ID NO: 3324229 - protein, 4 aa, Plasmodium falciparum
KNVQ

SEQ ID NO: 3324230 - protein, 8 aa, Plasmodium falciparum
KNVRGSEI

SEQ ID NO: 3324231 - protein, 31 aa, Plasmodium falciparum
KNVSKNNESKKKLSLKRKKDSTKRENQDDTT

SEQ ID NO: 3324232 - protein, 28 aa, Plasmodium falciparum
KNVSNDNDNDNDNNNNDNNNNNNINNNE

SEQ ID NO: 3324233 - protein, 13 aa, Plasmodium falciparum
KNVSNGQDIGATI

SEQ ID NO: 3324234 - protein, 7 aa, Plasmodium falciparum
KNVSNKS

SEQ ID NO: 3324235 - protein, 7 aa, Plasmodium falciparum
KNVSNNN

SEQ ID NO: 3324236 - protein, 12 aa, Plasmodium falciparum
KNVSSNNKNNIN

SEQ ID NO: 3324237 - protein, 5 aa, Plasmodium falciparum
KNVST

SEQ ID NO: 3324238 - protein, 4 aa, Plasmodium falciparum
KNVT

SEQ ID NO: 3324239 - protein, 6 aa, Plasmodium falciparum
KNVTKN

SEQ ID NO: 3324240 - protein, 8 aa, Plasmodium falciparum
KNVTKPVS

SEQ ID NO: 3324241 - protein, 5 aa, Plasmodium falciparum
KNVTN

SEQ ID NO: 3324242 - protein, 8 aa, Plasmodium falciparum
KNVTNVPN

SEQ ID NO: 3324243 - protein, 6 aa, Plasmodium falciparum
KNVTYE

SEQ ID NO: 3324244 - protein, 7 aa, Plasmodium falciparum
KNVYDNS

SEQ ID NO: 3324245 - protein, 23 aa, Plasmodium falciparum
KNVYGDDNKNIYGDDSKNIYGDD

SEQ ID NO: 3324246 - protein, 12 aa, Plasmodium falciparum
KNVYKNDKQNIS

SEQ ID NO: 3324247 - protein, 12 aa, Plasmodium falciparum
KNVYNNRASCDE

SEQ ID NO: 3324248 - protein, 4 aa, Plasmodium falciparum
KNYD

SEQ ID NO: 3324249 - protein, 11 aa, Plasmodium falciparum
KNYDKKSKNEL

SEQ ID NO: 3324250 - protein, 8 aa, Plasmodium falciparum
KNYDKNND

SEQ ID NO: 3324251 - protein, 18 aa, Plasmodium falciparum
KNYDKSKENAENKSDDIL

SEQ ID NO: 3324252 - protein, 6 aa, Plasmodium falciparum
KNYDNN

SEQ ID NO: 3324253 - protein, 41 aa, Plasmodium falciparum
KNYDNNDINNDNNNNDNNNNNDNNNNNNNNNNNNNNNNNQK

SEQ ID NO: 3324254 - protein, 7 aa, Plasmodium falciparum
KNYDSNK

SEQ ID NO: 3324255 - protein, 4 aa, Plasmodium falciparum
KNYE

SEQ ID NO: 3324256 - protein, 14 aa, Plasmodium falciparum
KNYEDSSKAGRKYK

SEQ ID NO: 3324257 - protein, 7 aa, Plasmodium falciparum
KNYEEDV

SEQ ID NO: 3324258 - protein, 102 aa, Plasmodium falciparum
KNYEEEEEEQQQNEREEQNEREEQNEREEQNEREEQNEREEQNEREEQNEREEQNEREEQNKTEEQNKTEEQNKTEEQNKTEEQNKTEEQNKTEEQNKEGQL

SEQ ID NO: 3324259 - protein, 7 aa, Plasmodium falciparum
KNYEESN

SEQ ID NO: 3324260 - protein, 7 aa, Plasmodium falciparum
KNYEHTE

SEQ ID NO: 3324261 - protein, 6 aa, Plasmodium falciparum
KNYEKD

SEQ ID NO: 3324262 - protein, 50 aa, Plasmodium falciparum
KNYEMNNNNNNDDDDDVNISNDNNGDVNISSDNNNNNNNNNNNNHSNYNN

SEQ ID NO: 3324263 - protein, 5 aa, Plasmodium falciparum
KNYEN

SEQ ID NO: 3324264 - protein, 7 aa, Plasmodium falciparum
KNYESIN

SEQ ID NO: 3324265 - protein, 20 aa, Plasmodium falciparum
KNYHKNGKQNYSKKYPRRSS

SEQ ID NO: 3324266 - protein, 4 aa, Plasmodium falciparum
KNYI

SEQ ID NO: 3324267 - protein, 6 aa, Plasmodium falciparum
KNYINE

SEQ ID NO: 3324268 - protein, 10 aa, Plasmodium falciparum
KNYKDTKKQE

SEQ ID NO: 3324269 - protein, 17 aa, Plasmodium falciparum
KNYKFKDNNKHSNSGLN

SEQ ID NO: 3324270 - protein, 6 aa, Plasmodium falciparum
KNYKGE

SEQ ID NO: 3324271 - protein, 8 aa, Plasmodium falciparum
KNYKNKEK

SEQ ID NO: 3324272 - protein, 7 aa, Plasmodium falciparum
KNYKNNH

SEQ ID NO: 3324273 - protein, 13 aa, Plasmodium falciparum
KNYKNNKNNKNFN

SEQ ID NO: 3324274 - protein, 11 aa, Plasmodium falciparum
KNYKNQYTEEK

SEQ ID NO: 3324275 - protein, 5 aa, Plasmodium falciparum
KNYKS

SEQ ID NO: 3324276 - protein, 7 aa, Plasmodium falciparum
KNYKTNV

SEQ ID NO: 3324277 - protein, 14 aa, Plasmodium falciparum
KNYNDKNKCISNKD

SEQ ID NO: 3324278 - protein, 8 aa, Plasmodium falciparum
KNYNEEDG

SEQ ID NO: 3324279 - protein, 7 aa, Plasmodium falciparum
KNYNEND

SEQ ID NO: 3324280 - protein, 19 aa, Plasmodium falciparum
KNYNKKENEIKCTDNKRKQ

SEQ ID NO: 3324281 - protein, 8 aa, Plasmodium falciparum
KNYNKNND

SEQ ID NO: 3324282 - protein, 13 aa, Plasmodium falciparum
KNYNLKDTVLNME

SEQ ID NO: 3324283 - protein, 5 aa, Plasmodium falciparum
KNYNM

SEQ ID NO: 3324284 - protein, 6 aa, Plasmodium falciparum
KNYNND

SEQ ID NO: 3324285 - protein, 22 aa, Plasmodium falciparum
KNYNNDAKSNISSDMKNSTSHE

SEQ ID NO: 3324286 - protein, 11 aa, Plasmodium falciparum
KNYNNDNINDN

SEQ ID NO: 3324287 - protein, 11 aa, Plasmodium falciparum
KNYNNKEENYI

SEQ ID NO: 3324288 - protein, 16 aa, Plasmodium falciparum
KNYNNRGKDKKEDTGL

SEQ ID NO: 3324289 - protein, 14 aa, Plasmodium falciparum
KNYNPKLDDHNNNR

SEQ ID NO: 3324290 - protein, 25 aa, Plasmodium falciparum
KNYNSNNDSMQNNNIKDKKEEKKKK

SEQ ID NO: 3324291 - protein, 9 aa, Plasmodium falciparum
KNYNTNNSN

SEQ ID NO: 3324292 - protein, 6 aa, Plasmodium falciparum
KNYQNN

SEQ ID NO: 3324293 - protein, 8 aa, Plasmodium falciparum
KNYRNKVE

SEQ ID NO: 3324294 - protein, 7 aa, Plasmodium falciparum
KNYRNSS

SEQ ID NO: 3324295 - protein, 8 aa, Plasmodium falciparum
KNYSENTN

SEQ ID NO: 3324296 - protein, 6 aa, Plasmodium falciparum
KNYSHY

SEQ ID NO: 3324297 - protein, 5 aa, Plasmodium falciparum
KNYSI

SEQ ID NO: 3324298 - protein, 15 aa, Plasmodium falciparum
KNYSINRNNCSNNNY

SEQ ID NO: 3324299 - protein, 6 aa, Plasmodium falciparum
KNYSNN

SEQ ID NO: 3324300 - protein, 8 aa, Plasmodium falciparum
KNYSQQKE

SEQ ID NO: 3324301 - protein, 8 aa, Plasmodium falciparum
KNYSSESF

SEQ ID NO: 3324302 - protein, 6 aa, Plasmodium falciparum
KNYSSQ

SEQ ID NO: 3324303 - protein, 12 aa, Plasmodium falciparum
KNYTENKNDNIG

SEQ ID NO: 3324304 - protein, 12 aa, Plasmodium falciparum
KNYTGARALTEK

SEQ ID NO: 3324305 - protein, 5 aa, Plasmodium falciparum
KNYTL

SEQ ID NO: 3324306 - protein, 7 aa, Plasmodium falciparum
KNYTNDE

SEQ ID NO: 3324307 - protein, 6 aa, Plasmodium falciparum
KNYTRN

SEQ ID NO: 3324308 - protein, 25 aa, Plasmodium falciparum
KNYTTNRKNDRVNNRTNNHTTYRNN

SEQ ID NO: 3324309 - protein, 17 aa, Plasmodium falciparum
KNYVDPASEDSSNSEIE

SEQ ID NO: 3324310 - protein, 14 aa, Plasmodium falciparum
KNYVKKKENLNNNI

SEQ ID NO: 3324311 - protein, 14 aa, Plasmodium falciparum
KNYYRNTPNNIGNK

SEQ ID NO: 3324312 - protein, 10 aa, Plasmodium falciparum
KNYYTSQKRK

SEQ ID NO: 3324313 - protein, 18 aa, Plasmodium falciparum
KPAGGPKPRDKNPDYDEA

SEQ ID NO: 3324314 - protein, 5 aa, Plasmodium falciparum
KPAKE

SEQ ID NO: 3324315 - protein, 4 aa, Plasmodium falciparum
KPAY

SEQ ID NO: 3324316 - protein, 10 aa, Plasmodium falciparum
KPDEKEEKLK

SEQ ID NO: 3324317 - protein, 4 aa, Plasmodium falciparum
KPDG

SEQ ID NO: 3324318 - protein, 5 aa, Plasmodium falciparum
KPDIT

SEQ ID NO: 3324319 - protein, 7 aa, Plasmodium falciparum
KPDKRKG

SEQ ID NO: 3324320 - protein, 4 aa, Plasmodium falciparum
KPDN

SEQ ID NO: 3324321 - protein, 7 aa, Plasmodium falciparum
KPDTLQS

SEQ ID NO: 3324322 - protein, 5 aa, Plasmodium falciparum
KPDYR

SEQ ID NO: 3324323 - protein, 4 aa, Plasmodium falciparum
KPEE

SEQ ID NO: 3324324 - protein, 8 aa, Plasmodium falciparum
KPEEGLNE

SEQ ID NO: 3324325 - protein, 8 aa, Plasmodium falciparum
KPEKNAKE

SEQ ID NO: 3324326 - protein, 6 aa, Plasmodium falciparum
KPELAK

SEQ ID NO: 3324327 - protein, 8 aa, Plasmodium falciparum
KPELTDYS

SEQ ID NO: 3324328 - protein, 7 aa, Plasmodium falciparum
KPENVEQ

SEQ ID NO: 3324329 - protein, 4 aa, Plasmodium falciparum
KPEQ

SEQ ID NO: 3324330 - protein, 6 aa, Plasmodium falciparum
KPEQEY

SEQ ID NO: 3324331 - protein, 7 aa, Plasmodium falciparum
KPEQNSM

SEQ ID NO: 3324332 - protein, 11 aa, Plasmodium falciparum
KPESKTDKKQR

SEQ ID NO: 3324333 - protein, 7 aa, Plasmodium falciparum
KPETAYG

SEQ ID NO: 3324334 - protein, 14 aa, Plasmodium falciparum
KPFEGKNEINKPSD

SEQ ID NO: 3324335 - protein, 5 aa, Plasmodium falciparum
KPFGK

SEQ ID NO: 3324336 - protein, 11 aa, Plasmodium falciparum
KPFHKESYNNN

SEQ ID NO: 3324337 - protein, 11 aa, Plasmodium falciparum
KPFNNNSEKGY

SEQ ID NO: 3324338 - protein, 6 aa, Plasmodium falciparum
KPFSEK

SEQ ID NO: 3324339 - protein, 4 aa, Plasmodium falciparum
KPGG

SEQ ID NO: 3324340 - protein, 4 aa, Plasmodium falciparum
KPGI

SEQ ID NO: 3324341 - protein, 7 aa, Plasmodium falciparum
KPGKSLD

SEQ ID NO: 3324342 - protein, 5 aa, Plasmodium falciparum
KPGQR

SEQ ID NO: 3324343 - protein, 5 aa, Plasmodium falciparum
KPGSV

SEQ ID NO: 3324344 - protein, 14 aa, Plasmodium falciparum
KPHDNKEKNNIIND

SEQ ID NO: 3324345 - protein, 10 aa, Plasmodium falciparum
KPHEDNSSNI

SEQ ID NO: 3324346 - protein, 6 aa, Plasmodium falciparum
KPHGHG

SEQ ID NO: 3324347 - protein, 6 aa, Plasmodium falciparum
KPHINS

SEQ ID NO: 3324348 - protein, 8 aa, Plasmodium falciparum
KPHKPRMS

SEQ ID NO: 3324349 - protein, 11 aa, Plasmodium falciparum
KPHLQTEEARI

SEQ ID NO: 3324350 - protein, 8 aa, Plasmodium falciparum
KPHNGNVA

SEQ ID NO: 3324351 - protein, 6 aa, Plasmodium falciparum
KPHNQT

SEQ ID NO: 3324352 - protein, 7 aa, Plasmodium falciparum
KPHQEDG

SEQ ID NO: 3324353 - protein, 7 aa, Plasmodium falciparum
KPHSNAY

SEQ ID NO: 3324354 - protein, 8 aa, Plasmodium falciparum
KPIEKNSG

SEQ ID NO: 3324355 - protein, 6 aa, Plasmodium falciparum
KPIENE

SEQ ID NO: 3324356 - protein, 4 aa, Plasmodium falciparum
KPIN

SEQ ID NO: 3324357 - protein, 19 aa, Plasmodium falciparum
KPINDDVNKTSGRLNEQTN

SEQ ID NO: 3324358 - protein, 8 aa, Plasmodium falciparum
KPINHNTP

SEQ ID NO: 3324359 - protein, 5 aa, Plasmodium falciparum
KPIPN

SEQ ID NO: 3324360 - protein, 5 aa, Plasmodium falciparum
KPIYH

SEQ ID NO: 3324361 - protein, 6 aa, Plasmodium falciparum
KPKDSI

SEQ ID NO: 3324362 - protein, 9 aa, Plasmodium falciparum
KPKDSKQLP

SEQ ID NO: 3324363 - protein, 6 aa, Plasmodium falciparum
KPKEIH

SEQ ID NO: 3324364 - protein, 23 aa, Plasmodium falciparum
KPKEKNEYDNTQKKTDNNLNEVS

SEQ ID NO: 3324365 - protein, 10 aa, Plasmodium falciparum
KPKEREKINY

SEQ ID NO: 3324366 - protein, 4 aa, Plasmodium falciparum
KPKF

SEQ ID NO: 3324367 - protein, 5 aa, Plasmodium falciparum
KPKFK

SEQ ID NO: 3324368 - protein, 9 aa, Plasmodium falciparum
KPKGQIPDY

SEQ ID NO: 3324369 - protein, 6 aa, Plasmodium falciparum
KPKIDS

SEQ ID NO: 3324370 - protein, 5 aa, Plasmodium falciparum
KPKIH

SEQ ID NO: 3324371 - protein, 10 aa, Plasmodium falciparum
KPKIPKEGTK

SEQ ID NO: 3324372 - protein, 7 aa, Plasmodium falciparum
KPKIPQP

SEQ ID NO: 3324373 - protein, 7 aa, Plasmodium falciparum
KPKKENQ

SEQ ID NO: 3324374 - protein, 7 aa, Plasmodium falciparum
KPKKSLY

SEQ ID NO: 3324375 - protein, 12 aa, Plasmodium falciparum
KPKNEDAHHRMT

SEQ ID NO: 3324376 - protein, 9 aa, Plasmodium falciparum
KPKNNFGND

SEQ ID NO: 3324377 - protein, 5 aa, Plasmodium falciparum
KPKNP

SEQ ID NO: 3324378 - protein, 7 aa, Plasmodium falciparum
KPKQEEL

SEQ ID NO: 3324379 - protein, 8 aa, Plasmodium falciparum
KPKRRRTK

SEQ ID NO: 3324380 - protein, 6 aa, Plasmodium falciparum
KPKSIE

SEQ ID NO: 3324381 - protein, 6 aa, Plasmodium falciparum
KPKSIL

SEQ ID NO: 3324382 - protein, 5 aa, Plasmodium falciparum
KPLEK

SEQ ID NO: 3324383 - protein, 4 aa, Plasmodium falciparum
KPLL

SEQ ID NO: 3324384 - protein, 15 aa, Plasmodium falciparum
KPLNNGAIIYNGNKL

SEQ ID NO: 3324385 - protein, 4 aa, Plasmodium falciparum
KPLP

SEQ ID NO: 3324386 - protein, 9 aa, Plasmodium falciparum
KPLTDDEED

SEQ ID NO: 3324387 - protein, 5 aa, Plasmodium falciparum
KPMES

SEQ ID NO: 3324388 - protein, 5 aa, Plasmodium falciparum
KPMIP

SEQ ID NO: 3324389 - protein, 7 aa, Plasmodium falciparum
KPMTNDK

SEQ ID NO: 3324390 - protein, 5 aa, Plasmodium falciparum
KPNDS

SEQ ID NO: 3324391 - protein, 26 aa, Plasmodium falciparum
KPNEDNVSEKNEEKYDKINEKQKENI

SEQ ID NO: 3324392 - protein, 7 aa, Plasmodium falciparum
KPNENNN

SEQ ID NO: 3324393 - protein, 6 aa, Plasmodium falciparum
KPNESL

SEQ ID NO: 3324394 - protein, 29 aa, Plasmodium falciparum
KPNESYSRKGSNESNNINNNNNNNNNKGM

SEQ ID NO: 3324395 - protein, 8 aa, Plasmodium falciparum
KPNEVKDR

SEQ ID NO: 3324396 - protein, 4 aa, Plasmodium falciparum
KPNI

SEQ ID NO: 3324397 - protein, 5 aa, Plasmodium falciparum
KPNIT

SEQ ID NO: 3324398 - protein, 11 aa, Plasmodium falciparum
KPNKDLSYTEG

SEQ ID NO: 3324399 - protein, 9 aa, Plasmodium falciparum
KPNKKDIED

SEQ ID NO: 3324400 - protein, 11 aa, Plasmodium falciparum
KPNKNTHYENK

SEQ ID NO: 3324401 - protein, 4 aa, Plasmodium falciparum
KPNL

SEQ ID NO: 3324402 - protein, 38 aa, Plasmodium falciparum
KPNNIENNEESNCDNNSVNKENSNGVKDASKEDETISD

SEQ ID NO: 3324403 - protein, 7 aa, Plasmodium falciparum
KPNNKIK

SEQ ID NO: 3324404 - protein, 7 aa, Plasmodium falciparum
KPNNQEF

SEQ ID NO: 3324405 - protein, 6 aa, Plasmodium falciparum
KPNNYI

SEQ ID NO: 3324406 - protein, 11 aa, Plasmodium falciparum
KPNPESNEDTE

SEQ ID NO: 3324407 - protein, 5 aa, Plasmodium falciparum
KPNPR

SEQ ID NO: 3324408 - protein, 8 aa, Plasmodium falciparum
KPNQKDNL

SEQ ID NO: 3324409 - protein, 5 aa, Plasmodium falciparum
KPNTD

SEQ ID NO: 3324410 - protein, 6 aa, Plasmodium falciparum
KPNTEN

SEQ ID NO: 3324411 - protein, 8 aa, Plasmodium falciparum
KPNTGKSS

SEQ ID NO: 3324412 - protein, 8 aa, Plasmodium falciparum
KPNTNSND

SEQ ID NO: 3324413 - protein, 4 aa, Plasmodium falciparum
KPNV

SEQ ID NO: 3324414 - protein, 5 aa, Plasmodium falciparum
KPPFK

SEQ ID NO: 3324415 - protein, 4 aa, Plasmodium falciparum
KPPI

SEQ ID NO: 3324416 - protein, 13 aa, Plasmodium falciparum
KPPIQEENKITDT

SEQ ID NO: 3324417 - protein, 9 aa, Plasmodium falciparum
KPPLASSSN

SEQ ID NO: 3324418 - protein, 5 aa, Plasmodium falciparum
KPPLC

SEQ ID NO: 3324419 - protein, 7 aa, Plasmodium falciparum
KPPLHPK

SEQ ID NO: 3324420 - protein, 4 aa, Plasmodium falciparum
KPPN

SEQ ID NO: 3324421 - protein, 10 aa, Plasmodium falciparum
KPPNDKVNKE

SEQ ID NO: 3324422 - protein, 20 aa, Plasmodium falciparum
KPPNHKNKKRISKNYSLSDE

SEQ ID NO: 3324423 - protein, 12 aa, Plasmodium falciparum
KPPSNDKNVTTP

SEQ ID NO: 3324424 - protein, 8 aa, Plasmodium falciparum
KPPYGPND

SEQ ID NO: 3324425 - protein, 15 aa, Plasmodium falciparum
KPQDNNKNKFPNKSY

SEQ ID NO: 3324426 - protein, 5 aa, Plasmodium falciparum
KPQIN

SEQ ID NO: 3324427 - protein, 8 aa, Plasmodium falciparum
KPQNHNAS

SEQ ID NO: 3324428 - protein, 5 aa, Plasmodium falciparum
KPQQY

SEQ ID NO: 3324429 - protein, 6 aa, Plasmodium falciparum
KPQTSE

SEQ ID NO: 3324430 - protein, 5 aa, Plasmodium falciparum
KPQVE

SEQ ID NO: 3324431 - protein, 5 aa, Plasmodium falciparum
KPQYK

SEQ ID NO: 3324432 - protein, 11 aa, Plasmodium falciparum
KPRDSTSEDDI

SEQ ID NO: 3324433 - protein, 8 aa, Plasmodium falciparum
KPRNKKEY

SEQ ID NO: 3324434 - protein, 10 aa, Plasmodium falciparum
KPRPITASSI

SEQ ID NO: 3324435 - protein, 9 aa, Plasmodium falciparum
KPRSRRKTK

SEQ ID NO: 3324436 - protein, 9 aa, Plasmodium falciparum
KPRSSREIS

SEQ ID NO: 3324437 - protein, 4 aa, Plasmodium falciparum
KPRY

SEQ ID NO: 3324438 - protein, 5 aa, Plasmodium falciparum
KPRYE

SEQ ID NO: 3324439 - protein, 8 aa, Plasmodium falciparum
KPSAIQQR

SEQ ID NO: 3324440 - protein, 5 aa, Plasmodium falciparum
KPSDD

SEQ ID NO: 3324441 - protein, 11 aa, Plasmodium falciparum
KPSEDYSDIGG

SEQ ID NO: 3324442 - protein, 14 aa, Plasmodium falciparum
KPSEKKKNKPQKTI

SEQ ID NO: 3324443 - protein, 5 aa, Plasmodium falciparum
KPSES

SEQ ID NO: 3324444 - protein, 7 aa, Plasmodium falciparum
KPSETLE

SEQ ID NO: 3324445 - protein, 4 aa, Plasmodium falciparum
KPSG

SEQ ID NO: 3324446 - protein, 6 aa, Plasmodium falciparum
KPSGNI

SEQ ID NO: 3324447 - protein, 14 aa, Plasmodium falciparum
KPSISYGNKNDEWE

SEQ ID NO: 3324448 - protein, 4 aa, Plasmodium falciparum
KPSK

SEQ ID NO: 3324449 - protein, 6 aa, Plasmodium falciparum
KPSKFE

SEQ ID NO: 3324450 - protein, 8 aa, Plasmodium falciparum
KPSKRHSH

SEQ ID NO: 3324451 - protein, 6 aa, Plasmodium falciparum
KPSKYN

SEQ ID NO: 3324452 - protein, 4 aa, Plasmodium falciparum
KPSL

SEQ ID NO: 3324453 - protein, 6 aa, Plasmodium falciparum
KPSNPE

SEQ ID NO: 3324454 - protein, 8 aa, Plasmodium falciparum
KPSNPSSH

SEQ ID NO: 3324455 - protein, 7 aa, Plasmodium falciparum
KPSPRSN

SEQ ID NO: 3324456 - protein, 4 aa, Plasmodium falciparum
KPSR

SEQ ID NO: 3324457 - protein, 9 aa, Plasmodium falciparum
KPSRSSSSS

SEQ ID NO: 3324458 - protein, 24 aa, Plasmodium falciparum
KPSSQLPKTKSPLQPSNGNDMPES

SEQ ID NO: 3324459 - protein, 22 aa, Plasmodium falciparum
KPSTPNIKDEYEKKTNDNNNME

SEQ ID NO: 3324460 - protein, 6 aa, Plasmodium falciparum
KPSVAS

SEQ ID NO: 3324461 - protein, 6 aa, Plasmodium falciparum
KPTAKL

SEQ ID NO: 3324462 - protein, 6 aa, Plasmodium falciparum
KPTEIQ

SEQ ID NO: 3324463 - protein, 7 aa, Plasmodium falciparum
KPTKEEV

SEQ ID NO: 3324464 - protein, 8 aa, Plasmodium falciparum
KPTLQDGK

SEQ ID NO: 3324465 - protein, 6 aa, Plasmodium falciparum
KPTNQN

SEQ ID NO: 3324466 - protein, 6 aa, Plasmodium falciparum
KPTRTK

SEQ ID NO: 3324467 - protein, 6 aa, Plasmodium falciparum
KPTSNL

SEQ ID NO: 3324468 - protein, 9 aa, Plasmodium falciparum
KPTTKSSTF

SEQ ID NO: 3324469 - protein, 5 aa, Plasmodium falciparum
KPVLP

SEQ ID NO: 3324470 - protein, 10 aa, Plasmodium falciparum
KPYERSNKEN

SEQ ID NO: 3324471 - protein, 8 aa, Plasmodium falciparum
KPYNEEES

SEQ ID NO: 3324472 - protein, 21 aa, Plasmodium falciparum
KPYNSDSDNQNNKEKDMEKNK

SEQ ID NO: 3324473 - protein, 6 aa, Plasmodium falciparum
KPYNSN

SEQ ID NO: 3324474 - protein, 5 aa, Plasmodium falciparum
KPYNV

SEQ ID NO: 3324475 - protein, 4 aa, Plasmodium falciparum
KPYS

SEQ ID NO: 3324476 - protein, 5 aa, Plasmodium falciparum
KPYYE

SEQ ID NO: 3324477 - protein, 6 aa, Plasmodium falciparum
KPYYKP

SEQ ID NO: 3324478 - protein, 17 aa, Plasmodium falciparum
KQAEEEKKKKKKESEKL

SEQ ID NO: 3324479 - protein, 9 aa, Plasmodium falciparum
KQAHTTPCP

SEQ ID NO: 3324480 - protein, 10 aa, Plasmodium falciparum
KQAIISGDDG

SEQ ID NO: 3324481 - protein, 18 aa, Plasmodium falciparum
KQANMYSNSNNSASISST

SEQ ID NO: 3324482 - protein, 16 aa, Plasmodium falciparum
KQAYEDASDTYDDTEV

SEQ ID NO: 3324483 - protein, 56 aa, Plasmodium falciparum
KQCNNDDDDDDIHDDNHDDNHDDDDIHDDNHDDDDIHDDNHDGDDIHDDNHDGDDI

SEQ ID NO: 3324484 - protein, 5 aa, Plasmodium falciparum
KQDAD

SEQ ID NO: 3324485 - protein, 14 aa, Plasmodium falciparum
KQDAEKNFTLRKLW

SEQ ID NO: 3324486 - protein, 22 aa, Plasmodium falciparum
KQDDVSCDDSSVNKDIRKNNYE

SEQ ID NO: 3324487 - protein, 14 aa, Plasmodium falciparum
KQDEDFRDNNNEYI

SEQ ID NO: 3324488 - protein, 6 aa, Plasmodium falciparum
KQDEKK

SEQ ID NO: 3324489 - protein, 6 aa, Plasmodium falciparum
KQDENI

SEQ ID NO: 3324490 - protein, 8 aa, Plasmodium falciparum
KQDETCKD

SEQ ID NO: 3324491 - protein, 9 aa, Plasmodium falciparum
KQDGGNSNV

SEQ ID NO: 3324492 - protein, 7 aa, Plasmodium falciparum
KQDGSHH

SEQ ID NO: 3324493 - protein, 10 aa, Plasmodium falciparum
KQDHDDSDDV

SEQ ID NO: 3324494 - protein, 4 aa, Plasmodium falciparum
KQDI

SEQ ID NO: 3324495 - protein, 5 aa, Plasmodium falciparum
KQDIE

SEQ ID NO: 3324496 - protein, 10 aa, Plasmodium falciparum
KQDKAERKKN

SEQ ID NO: 3324497 - protein, 7 aa, Plasmodium falciparum
KQDKKGC

SEQ ID NO: 3324498 - protein, 5 aa, Plasmodium falciparum
KQDKN

SEQ ID NO: 3324499 - protein, 10 aa, Plasmodium falciparum
KQDKNDAEHV

SEQ ID NO: 3324500 - protein, 18 aa, Plasmodium falciparum
KQDNIKEKPHISNSEKIE

SEQ ID NO: 3324501 - protein, 10 aa, Plasmodium falciparum
KQDNNKNKKR

SEQ ID NO: 3324502 - protein, 10 aa, Plasmodium falciparum
KQDNNQLNNS

SEQ ID NO: 3324503 - protein, 10 aa, Plasmodium falciparum
KQDNTTGATN

SEQ ID NO: 3324504 - protein, 10 aa, Plasmodium falciparum
KQDPKEGQDH

SEQ ID NO: 3324505 - protein, 15 aa, Plasmodium falciparum
KQDQNKNAPPQNNKQ

SEQ ID NO: 3324506 - protein, 13 aa, Plasmodium falciparum
KQDSQNKKKSIID

SEQ ID NO: 3324507 - protein, 4 aa, Plasmodium falciparum
KQDY

SEQ ID NO: 3324508 - protein, 14 aa, Plasmodium falciparum
KQDYGNNNNNSNNY

SEQ ID NO: 3324509 - protein, 7 aa, Plasmodium falciparum
KQEDTMS

SEQ ID NO: 3324510 - protein, 12 aa, Plasmodium falciparum
KQEEGEYVENDE

SEQ ID NO: 3324511 - protein, 8 aa, Plasmodium falciparum
KQEELKNK

SEQ ID NO: 3324512 - protein, 8 aa, Plasmodium falciparum
KQEGKYEK

SEQ ID NO: 3324513 - protein, 34 aa, Plasmodium falciparum
KQEHDQMKNEKYETNKKKGKGETEQLDDNISSDH

SEQ ID NO: 3324514 - protein, 6 aa, Plasmodium falciparum
KQEHQE

SEQ ID NO: 3324515 - protein, 7 aa, Plasmodium falciparum
KQEIQKR

SEQ ID NO: 3324516 - protein, 14 aa, Plasmodium falciparum
KQEKDEGNRNKELT

SEQ ID NO: 3324517 - protein, 20 aa, Plasmodium falciparum
KQEKDKEKKRKRQGKEKKKP

SEQ ID NO: 3324518 - protein, 27 aa, Plasmodium falciparum
KQEKEKEKEKEREKEKEREKEKEKEYD

SEQ ID NO: 3324519 - protein, 11 aa, Plasmodium falciparum
KQEKESNEQID

SEQ ID NO: 3324520 - protein, 40 aa, Plasmodium falciparum
KQEKKDEYDRSIKTENNESSAKLKDNMNNSKNNSQNLTNT

SEQ ID NO: 3324521 - protein, 8 aa, Plasmodium falciparum
KQEKNTKR

SEQ ID NO: 3324522 - protein, 8 aa, Plasmodium falciparum
KQEKRENN

SEQ ID NO: 3324523 - protein, 10 aa, Plasmodium falciparum
KQELSNKNIS

SEQ ID NO: 3324524 - protein, 5 aa, Plasmodium falciparum
KQENA

SEQ ID NO: 3324525 - protein, 8 aa, Plasmodium falciparum
KQENDIKN

SEQ ID NO: 3324526 - protein, 15 aa, Plasmodium falciparum
KQENDNKDEARGNDN

SEQ ID NO: 3324527 - protein, 9 aa, Plasmodium falciparum
KQENKNEDI

SEQ ID NO: 3324528 - protein, 8 aa, Plasmodium falciparum
KQENNNDE

SEQ ID NO: 3324529 - protein, 7 aa, Plasmodium falciparum
KQENNTN

SEQ ID NO: 3324530 - protein, 8 aa, Plasmodium falciparum
KQENYKQK

SEQ ID NO: 3324531 - protein, 14 aa, Plasmodium falciparum
KQEPTEAEKDETPL

SEQ ID NO: 3324532 - protein, 12 aa, Plasmodium falciparum
KQETKYTKEKNK

SEQ ID NO: 3324533 - protein, 4 aa, Plasmodium falciparum
KQEY

SEQ ID NO: 3324534 - protein, 6 aa, Plasmodium falciparum
KQEYDA

SEQ ID NO: 3324535 - protein, 9 aa, Plasmodium falciparum
KQEYNKSSI

SEQ ID NO: 3324536 - protein, 6 aa, Plasmodium falciparum
KQFDGY

SEQ ID NO: 3324537 - protein, 5 aa, Plasmodium falciparum
KQFSS

SEQ ID NO: 3324538 - protein, 6 aa, Plasmodium falciparum
KQFTNN

SEQ ID NO: 3324539 - protein, 8 aa, Plasmodium falciparum
KQGETPQS

SEQ ID NO: 3324540 - protein, 29 aa, Plasmodium falciparum
KQGGIENQSLEESKRKAKNIQQKDNTKNA

SEQ ID NO: 3324541 - protein, 8 aa, Plasmodium falciparum
KQGGPSII

SEQ ID NO: 3324542 - protein, 9 aa, Plasmodium falciparum
KQGGVTSTY

SEQ ID NO: 3324543 - protein, 9 aa, Plasmodium falciparum
KQGKNKLEK

SEQ ID NO: 3324544 - protein, 5 aa, Plasmodium falciparum
KQGNI

SEQ ID NO: 3324545 - protein, 8 aa, Plasmodium falciparum
KQGNINEE

SEQ ID NO: 3324546 - protein, 15 aa, Plasmodium falciparum
KQGSINQNSPNKNNS

SEQ ID NO: 3324547 - protein, 4 aa, Plasmodium falciparum
KQGY

SEQ ID NO: 3324548 - protein, 7 aa, Plasmodium falciparum
KQHDEQK

SEQ ID NO: 3324549 - protein, 6 aa, Plasmodium falciparum
KQHESY

SEQ ID NO: 3324550 - protein, 5 aa, Plasmodium falciparum
KQHGS

SEQ ID NO: 3324551 - protein, 6 aa, Plasmodium falciparum
KQHKKY

SEQ ID NO: 3324552 - protein, 9 aa, Plasmodium falciparum
KQHSNNNKH

SEQ ID NO: 3324553 - protein, 8 aa, Plasmodium falciparum
KQHSQEIK

SEQ ID NO: 3324554 - protein, 7 aa, Plasmodium falciparum
KQHTDNV

SEQ ID NO: 3324555 - protein, 4 aa, Plasmodium falciparum
KQHY

SEQ ID NO: 3324556 - protein, 17 aa, Plasmodium falciparum
KQIDQEKCNKKKEKKIM

SEQ ID NO: 3324557 - protein, 7 aa, Plasmodium falciparum
KQIDTNK

SEQ ID NO: 3324558 - protein, 11 aa, Plasmodium falciparum
KQIDTTNDEQK

SEQ ID NO: 3324559 - protein, 4 aa, Plasmodium falciparum
KQIE

SEQ ID NO: 3324560 - protein, 12 aa, Plasmodium falciparum
KQIGSNSNEDIK

SEQ ID NO: 3324561 - protein, 24 aa, Plasmodium falciparum
KQIKDDENNLSNNNNNNNNNNNNI

SEQ ID NO: 3324562 - protein, 8 aa, Plasmodium falciparum
KQIKNEYT

SEQ ID NO: 3324563 - protein, 6 aa, Plasmodium falciparum
KQIKVT

SEQ ID NO: 3324564 - protein, 25 aa, Plasmodium falciparum
KQINDNKDERKKKRTNMKKKKKKIN

SEQ ID NO: 3324565 - protein, 18 aa, Plasmodium falciparum
KQINDSEGDDSYTNDENT

SEQ ID NO: 3324566 - protein, 9 aa, Plasmodium falciparum
KQINEPDKD

SEQ ID NO: 3324567 - protein, 14 aa, Plasmodium falciparum
KQINTIDKSSEDWK

SEQ ID NO: 3324568 - protein, 17 aa, Plasmodium falciparum
KQIRDKYKKEKKSNPLK

SEQ ID NO: 3324569 - protein, 7 aa, Plasmodium falciparum
KQIYEND

SEQ ID NO: 3324570 - protein, 59 aa, Plasmodium falciparum
KQKAKQEKEKEKEKEKEKEKEKEKNEETNLDANEEQNNEAKNNEEKENSTKNENSANPE

SEQ ID NO: 3324571 - protein, 6 aa, Plasmodium falciparum
KQKDEI

SEQ ID NO: 3324572 - protein, 63 aa, Plasmodium falciparum
KQKDKETDKLNDKWNDKSYDKSYDKCNDKCNDKYNDKSYDKSYDKSYDKSNYKQKSKTNESKN

SEQ ID NO: 3324573 - protein, 8 aa, Plasmodium falciparum
KQKDKGDD

SEQ ID NO: 3324574 - protein, 27 aa, Plasmodium falciparum
KQKDKNKDKNKNKNKDKNKNKDKGKSI

SEQ ID NO: 3324575 - protein, 5 aa, Plasmodium falciparum
KQKDM

SEQ ID NO: 3324576 - protein, 8 aa, Plasmodium falciparum
KQKDSSCK

SEQ ID NO: 3324577 - protein, 7 aa, Plasmodium falciparum
KQKDTHN

SEQ ID NO: 3324578 - protein, 4 aa, Plasmodium falciparum
KQKE

SEQ ID NO: 3324579 - protein, 17 aa, Plasmodium falciparum
KQKEEKEFEEDDDDSYL

SEQ ID NO: 3324580 - protein, 8 aa, Plasmodium falciparum
KQKEETYV

SEQ ID NO: 3324581 - protein, 69 aa, Plasmodium falciparum
KQKEHKQSKEDKQSKEDKQSKEDKQSKEDKQNKEDKQKQNEEDKQNKQDKQNKQNKQDKEQKKKKKKEV

SEQ ID NO: 3324582 - protein, 13 aa, Plasmodium falciparum
KQKEINNNHSSID

SEQ ID NO: 3324583 - protein, 12 aa, Plasmodium falciparum
KQKEKDKKKIYH

SEQ ID NO: 3324584 - protein, 5 aa, Plasmodium falciparum
KQKEN

SEQ ID NO: 3324585 - protein, 8 aa, Plasmodium falciparum
KQKENPKD

SEQ ID NO: 3324586 - protein, 7 aa, Plasmodium falciparum
KQKEQKM

SEQ ID NO: 3324587 - protein, 9 aa, Plasmodium falciparum
KQKETNEEM

SEQ ID NO: 3324588 - protein, 6 aa, Plasmodium falciparum
KQKGHH

SEQ ID NO: 3324589 - protein, 20 aa, Plasmodium falciparum
KQKGKESSNNLNNNNNNNNN

SEQ ID NO: 3324590 - protein, 12 aa, Plasmodium falciparum
KQKGKLNNNPVD

SEQ ID NO: 3324591 - protein, 13 aa, Plasmodium falciparum
KQKGKRKNDRLGK

SEQ ID NO: 3324592 - protein, 8 aa, Plasmodium falciparum
KQKGYNKY

SEQ ID NO: 3324593 - protein, 7 aa, Plasmodium falciparum
KQKIESV

SEQ ID NO: 3324594 - protein, 5 aa, Plasmodium falciparum
KQKIN

SEQ ID NO: 3324595 - protein, 6 aa, Plasmodium falciparum
KQKIVS

SEQ ID NO: 3324596 - protein, 4 aa, Plasmodium falciparum
KQKK

SEQ ID NO: 3324597 - protein, 6 aa, Plasmodium falciparum
KQKKDK

SEQ ID NO: 3324598 - protein, 50 aa, Plasmodium falciparum
KQKKEQKKEQKKEQKNEQKNEQKNEQKNEQKYDQQNDQQNDQQDEQKYTN

SEQ ID NO: 3324599 - protein, 7 aa, Plasmodium falciparum
KQKKGKH

SEQ ID NO: 3324600 - protein, 11 aa, Plasmodium falciparum
KQKKKEKKKNN

SEQ ID NO: 3324601 - protein, 23 aa, Plasmodium falciparum
KQKKKKKKKDKKKKKKKKKNPLA

SEQ ID NO: 3324602 - protein, 34 aa, Plasmodium falciparum
KQKKKKQDRKKDQNKNKNRDHIKNQDKKLHQDGE

SEQ ID NO: 3324603 - protein, 8 aa, Plasmodium falciparum
KQKKKTEI

SEQ ID NO: 3324604 - protein, 8 aa, Plasmodium falciparum
KQKKLLKN

SEQ ID NO: 3324605 - protein, 10 aa, Plasmodium falciparum
KQKKQKKNMD

SEQ ID NO: 3324606 - protein, 16 aa, Plasmodium falciparum
KQKKQKMNKTNKKKKM

SEQ ID NO: 3324607 - protein, 6 aa, Plasmodium falciparum
KQKKQR

SEQ ID NO: 3324608 - protein, 8 aa, Plasmodium falciparum
KQKKRGNI

SEQ ID NO: 3324609 - protein, 20 aa, Plasmodium falciparum
KQKKRIKENSTRSKSDSENI

SEQ ID NO: 3324610 - protein, 32 aa, Plasmodium falciparum
KQKKRKETETATGTITQKQKHTKKKKLHGQTN

SEQ ID NO: 3324611 - protein, 77 aa, Plasmodium falciparum
KQKKSDTSFKNDKSNKSSSVREKQHDEYSKSNRSRDSKNRVSSAHNKKGGEDDFDKRNLSDTRRRSRSLASSKYSNE

SEQ ID NO: 3324612 - protein, 22 aa, Plasmodium falciparum
KQKMKEKKLNEEKSNEKLSRRK

SEQ ID NO: 3324613 - protein, 10 aa, Plasmodium falciparum
KQKMNKSTKG

SEQ ID NO: 3324614 - protein, 10 aa, Plasmodium falciparum
KQKNKKSLTI

SEQ ID NO: 3324615 - protein, 8 aa, Plasmodium falciparum
KQKNNKEY

SEQ ID NO: 3324616 - protein, 6 aa, Plasmodium falciparum
KQKNSN

SEQ ID NO: 3324617 - protein, 6 aa, Plasmodium falciparum
KQKNTI

SEQ ID NO: 3324618 - protein, 11 aa, Plasmodium falciparum
KQKPNDNKNNN

SEQ ID NO: 3324619 - protein, 8 aa, Plasmodium falciparum
KQKQGAQE

SEQ ID NO: 3324620 - protein, 10 aa, Plasmodium falciparum
KQKQKESSSS

SEQ ID NO: 3324621 - protein, 10 aa, Plasmodium falciparum
KQKQSENKIK

SEQ ID NO: 3324622 - protein, 7 aa, Plasmodium falciparum
KQKRKKI

SEQ ID NO: 3324623 - protein, 31 aa, Plasmodium falciparum
KQKRKKQTNLDNPNEIYNNKDNKQINQHRNQ

SEQ ID NO: 3324624 - protein, 22 aa, Plasmodium falciparum
KQKSEQAKMREKGASQTNGKSM

SEQ ID NO: 3324625 - protein, 8 aa, Plasmodium falciparum
KQKSGKNI

SEQ ID NO: 3324626 - protein, 5 aa, Plasmodium falciparum
KQKSN

SEQ ID NO: 3324627 - protein, 19 aa, Plasmodium falciparum
KQKSNEIKKKEKKKSSKLR

SEQ ID NO: 3324628 - protein, 7 aa, Plasmodium falciparum
KQKSNHG

SEQ ID NO: 3324629 - protein, 14 aa, Plasmodium falciparum
KQKSNKNIKDANYT

SEQ ID NO: 3324630 - protein, 29 aa, Plasmodium falciparum
KQKSNKNKSDNNNNNNNNNNNINRGDNNY

SEQ ID NO: 3324631 - protein, 8 aa, Plasmodium falciparum
KQKSNSYV

SEQ ID NO: 3324632 - protein, 6 aa, Plasmodium falciparum
KQKTLE

SEQ ID NO: 3324633 - protein, 7 aa, Plasmodium falciparum
KQKTNDL

SEQ ID NO: 3324634 - protein, 21 aa, Plasmodium falciparum
KQKTSTEDVTTSNENNENNQV

SEQ ID NO: 3324635 - protein, 5 aa, Plasmodium falciparum
KQKVN

SEQ ID NO: 3324636 - protein, 4 aa, Plasmodium falciparum
KQKY

SEQ ID NO: 3324637 - protein, 8 aa, Plasmodium falciparum
KQKYEDYS

SEQ ID NO: 3324638 - protein, 7 aa, Plasmodium falciparum
KQKYENN

SEQ ID NO: 3324639 - protein, 5 aa, Plasmodium falciparum
KQLED

SEQ ID NO: 3324640 - protein, 7 aa, Plasmodium falciparum
KQLEKEL

SEQ ID NO: 3324641 - protein, 8 aa, Plasmodium falciparum
KQLENTKR

SEQ ID NO: 3324642 - protein, 7 aa, Plasmodium falciparum
KQLINQN

SEQ ID NO: 3324643 - protein, 4 aa, Plasmodium falciparum
KQLL

SEQ ID NO: 3324644 - protein, 8 aa, Plasmodium falciparum
KQLNDKER

SEQ ID NO: 3324645 - protein, 7 aa, Plasmodium falciparum
KQLNEEY

SEQ ID NO: 3324646 - protein, 6 aa, Plasmodium falciparum
KQLNEQ

SEQ ID NO: 3324647 - protein, 24 aa, Plasmodium falciparum
KQLPFEGESNYRSDYGPKPLPELP

SEQ ID NO: 3324648 - protein, 5 aa, Plasmodium falciparum
KQNAA

SEQ ID NO: 3324649 - protein, 10 aa, Plasmodium falciparum
KQNADQSGRS

SEQ ID NO: 3324650 - protein, 6 aa, Plasmodium falciparum
KQNDDI

SEQ ID NO: 3324651 - protein, 5 aa, Plasmodium falciparum
KQNDI

SEQ ID NO: 3324652 - protein, 13 aa, Plasmodium falciparum
KQNDSEIKNEKNL

SEQ ID NO: 3324653 - protein, 5 aa, Plasmodium falciparum
KQNDV

SEQ ID NO: 3324654 - protein, 20 aa, Plasmodium falciparum
KQNELENDENKELERSGEVA

SEQ ID NO: 3324655 - protein, 8 aa, Plasmodium falciparum
KQNELKKN

SEQ ID NO: 3324656 - protein, 5 aa, Plasmodium falciparum
KQNEN

SEQ ID NO: 3324657 - protein, 18 aa, Plasmodium falciparum
KQNENIEESKKKATSRKK

SEQ ID NO: 3324658 - protein, 8 aa, Plasmodium falciparum
KQNENNDN

SEQ ID NO: 3324659 - protein, 10 aa, Plasmodium falciparum
KQNENQKNEI

SEQ ID NO: 3324660 - protein, 10 aa, Plasmodium falciparum
KQNETNEQEI

SEQ ID NO: 3324661 - protein, 6 aa, Plasmodium falciparum
KQNGDE

SEQ ID NO: 3324662 - protein, 6 aa, Plasmodium falciparum
KQNGDI

SEQ ID NO: 3324663 - protein, 21 aa, Plasmodium falciparum
KQNGEGKTCQKQYGKEENNEM

SEQ ID NO: 3324664 - protein, 6 aa, Plasmodium falciparum
KQNGKS

SEQ ID NO: 3324665 - protein, 14 aa, Plasmodium falciparum
KQNGNDKIPKGKDN

SEQ ID NO: 3324666 - protein, 22 aa, Plasmodium falciparum
KQNGNYKKENNMNSINDNTNKE

SEQ ID NO: 3324667 - protein, 9 aa, Plasmodium falciparum
KQNIGSNQH

SEQ ID NO: 3324668 - protein, 16 aa, Plasmodium falciparum
KQNIPSIDEKREENSR

SEQ ID NO: 3324669 - protein, 4 aa, Plasmodium falciparum
KQNK

SEQ ID NO: 3324670 - protein, 28 aa, Plasmodium falciparum
KQNKEESNDIKSEEENDYNCDNKKEDMD

SEQ ID NO: 3324671 - protein, 8 aa, Plasmodium falciparum
KQNKINEI

SEQ ID NO: 3324672 - protein, 15 aa, Plasmodium falciparum
KQNKKKKKDPLAPKR

SEQ ID NO: 3324673 - protein, 9 aa, Plasmodium falciparum
KQNKKKQNY

SEQ ID NO: 3324674 - protein, 11 aa, Plasmodium falciparum
KQNKKNEIGKK

SEQ ID NO: 3324675 - protein, 10 aa, Plasmodium falciparum
KQNKKSNVNF

SEQ ID NO: 3324676 - protein, 5 aa, Plasmodium falciparum
KQNKL

SEQ ID NO: 3324677 - protein, 27 aa, Plasmodium falciparum
KQNKMKNIKKGKIKKNDKTKKTATPKV

SEQ ID NO: 3324678 - protein, 7 aa, Plasmodium falciparum
KQNKNGI

SEQ ID NO: 3324679 - protein, 19 aa, Plasmodium falciparum
KQNKNKNHHDHDQNKNKKE

SEQ ID NO: 3324680 - protein, 11 aa, Plasmodium falciparum
KQNKSTQGNRI

SEQ ID NO: 3324681 - protein, 4 aa, Plasmodium falciparum
KQNL

SEQ ID NO: 3324682 - protein, 8 aa, Plasmodium falciparum
KQNLEQHK

SEQ ID NO: 3324683 - protein, 5 aa, Plasmodium falciparum
KQNLK

SEQ ID NO: 3324684 - protein, 6 aa, Plasmodium falciparum
KQNLLP

SEQ ID NO: 3324685 - protein, 6 aa, Plasmodium falciparum
KQNNDT

SEQ ID NO: 3324686 - protein, 9 aa, Plasmodium falciparum
KQNNENSNK

SEQ ID NO: 3324687 - protein, 5 aa, Plasmodium falciparum
KQNNI

SEQ ID NO: 3324688 - protein, 11 aa, Plasmodium falciparum
KQNNKDDNNNN

SEQ ID NO: 3324689 - protein, 6 aa, Plasmodium falciparum
KQNNKH

SEQ ID NO: 3324690 - protein, 5 aa, Plasmodium falciparum
KQNNL

SEQ ID NO: 3324691 - protein, 10 aa, Plasmodium falciparum
KQNNSKSQSS

SEQ ID NO: 3324692 - protein, 7 aa, Plasmodium falciparum
KQNNSSK

SEQ ID NO: 3324693 - protein, 14 aa, Plasmodium falciparum
KQNNTNNQGQEQNN

SEQ ID NO: 3324694 - protein, 22 aa, Plasmodium falciparum
KQNQNDLDSYKGNQKECKRSEV

SEQ ID NO: 3324695 - protein, 20 aa, Plasmodium falciparum
KQNQSNQNVNNKNNDDGWRN

SEQ ID NO: 3324696 - protein, 4 aa, Plasmodium falciparum
KQNR

SEQ ID NO: 3324697 - protein, 12 aa, Plasmodium falciparum
KQNRQDESTGAE

SEQ ID NO: 3324698 - protein, 7 aa, Plasmodium falciparum
KQNSDQI

SEQ ID NO: 3324699 - protein, 10 aa, Plasmodium falciparum
KQNSEEKCHN

SEQ ID NO: 3324700 - protein, 9 aa, Plasmodium falciparum
KQNSSNSFQ

SEQ ID NO: 3324701 - protein, 6 aa, Plasmodium falciparum
KQNTND

SEQ ID NO: 3324702 - protein, 45 aa, Plasmodium falciparum
KQNTNKSTSPTSRSLTSSPSSLSSSSSSISSSSSYRKERVTAQNE

SEQ ID NO: 3324703 - protein, 9 aa, Plasmodium falciparum
KQNTNRNEL

SEQ ID NO: 3324704 - protein, 6 aa, Plasmodium falciparum
KQNTNY

SEQ ID NO: 3324705 - protein, 6 aa, Plasmodium falciparum
KQNTTE

SEQ ID NO: 3324706 - protein, 9 aa, Plasmodium falciparum
KQNVDDNSY

SEQ ID NO: 3324707 - protein, 11 aa, Plasmodium falciparum
KQNVEEKQERT

SEQ ID NO: 3324708 - protein, 13 aa, Plasmodium falciparum
KQNYDSKSKQGIY

SEQ ID NO: 3324709 - protein, 32 aa, Plasmodium falciparum
KQPEGNKKSNTNQKKNEKDIHKNDNKNDNINN

SEQ ID NO: 3324710 - protein, 8 aa, Plasmodium falciparum
KQPELSKD

SEQ ID NO: 3324711 - protein, 5 aa, Plasmodium falciparum
KQPHH

SEQ ID NO: 3324712 - protein, 7 aa, Plasmodium falciparum
KQPLDKT

SEQ ID NO: 3324713 - protein, 9 aa, Plasmodium falciparum
KQPQTSYPC

SEQ ID NO: 3324714 - protein, 6 aa, Plasmodium falciparum
KQPSKF

SEQ ID NO: 3324715 - protein, 6 aa, Plasmodium falciparum
KQQDIN

SEQ ID NO: 3324716 - protein, 4 aa, Plasmodium falciparum
KQQK

SEQ ID NO: 3324717 - protein, 25 aa, Plasmodium falciparum
KQQKNKALNANINSKRNANGNNTSL

SEQ ID NO: 3324718 - protein, 6 aa, Plasmodium falciparum
KQQLAN

SEQ ID NO: 3324719 - protein, 7 aa, Plasmodium falciparum
KQQNDNN

SEQ ID NO: 3324720 - protein, 7 aa, Plasmodium falciparum
KQQNDQD

SEQ ID NO: 3324721 - protein, 9 aa, Plasmodium falciparum
KQQPPKNVP

SEQ ID NO: 3324722 - protein, 10 aa, Plasmodium falciparum
KQQQEQHNNN

SEQ ID NO: 3324723 - protein, 20 aa, Plasmodium falciparum
KQQQQKEALKNKQTPKKEEE

SEQ ID NO: 3324724 - protein, 29 aa, Plasmodium falciparum
KQQQQQQQEAYDDEDHQPEMEGGRVACAQ

SEQ ID NO: 3324725 - protein, 8 aa, Plasmodium falciparum
KQQSEYEL

SEQ ID NO: 3324726 - protein, 5 aa, Plasmodium falciparum
KQRDE

SEQ ID NO: 3324727 - protein, 9 aa, Plasmodium falciparum
KQRDKTKKY

SEQ ID NO: 3324728 - protein, 7 aa, Plasmodium falciparum
KQREKCN

SEQ ID NO: 3324729 - protein, 6 aa, Plasmodium falciparum
KQRKAP

SEQ ID NO: 3324730 - protein, 22 aa, Plasmodium falciparum
KQRLENKQRQNAKKFNNTNKYE

SEQ ID NO: 3324731 - protein, 5 aa, Plasmodium falciparum
KQRLK

SEQ ID NO: 3324732 - protein, 9 aa, Plasmodium falciparum
KQRRPYTNY

SEQ ID NO: 3324733 - protein, 15 aa, Plasmodium falciparum
KQRRRKRKTIQPRTR

SEQ ID NO: 3324734 - protein, 4 aa, Plasmodium falciparum
KQSD

SEQ ID NO: 3324735 - protein, 9 aa, Plasmodium falciparum
KQSGPEGKK

SEQ ID NO: 3324736 - protein, 6 aa, Plasmodium falciparum
KQSINR

SEQ ID NO: 3324737 - protein, 5 aa, Plasmodium falciparum
KQSKD

SEQ ID NO: 3324738 - protein, 14 aa, Plasmodium falciparum
KQSKEEIKNMENQQ

SEQ ID NO: 3324739 - protein, 14 aa, Plasmodium falciparum
KQSKEKKDGEEDKY

SEQ ID NO: 3324740 - protein, 16 aa, Plasmodium falciparum
KQSKNRNYYLEEIQCD

SEQ ID NO: 3324741 - protein, 9 aa, Plasmodium falciparum
KQSKREKEY

SEQ ID NO: 3324742 - protein, 7 aa, Plasmodium falciparum
KQSLEKK

SEQ ID NO: 3324743 - protein, 6 aa, Plasmodium falciparum
KQSLGI

SEQ ID NO: 3324744 - protein, 6 aa, Plasmodium falciparum
KQSMGG

SEQ ID NO: 3324745 - protein, 20 aa, Plasmodium falciparum
KQSNDDHNNKQRIDNSSYYD

SEQ ID NO: 3324746 - protein, 7 aa, Plasmodium falciparum
KQSNGTT

SEQ ID NO: 3324747 - protein, 8 aa, Plasmodium falciparum
KQSNQFPR

SEQ ID NO: 3324748 - protein, 6 aa, Plasmodium falciparum
KQSNQN

SEQ ID NO: 3324749 - protein, 13 aa, Plasmodium falciparum
KQSNQQGNQNGNH

SEQ ID NO: 3324750 - protein, 9 aa, Plasmodium falciparum
KQSQNIRPT

SEQ ID NO: 3324751 - protein, 6 aa, Plasmodium falciparum
KQSREH

SEQ ID NO: 3324752 - protein, 16 aa, Plasmodium falciparum
KQSSEKYSSKKKKHTF

SEQ ID NO: 3324753 - protein, 7 aa, Plasmodium falciparum
KQSSNYI

SEQ ID NO: 3324754 - protein, 12 aa, Plasmodium falciparum
KQSSTNSNNSQP

SEQ ID NO: 3324755 - protein, 5 aa, Plasmodium falciparum
KQSSY

SEQ ID NO: 3324756 - protein, 6 aa, Plasmodium falciparum
KQSTEN

SEQ ID NO: 3324757 - protein, 16 aa, Plasmodium falciparum
KQSTLSKNKKNEKDSY

SEQ ID NO: 3324758 - protein, 14 aa, Plasmodium falciparum
KQSTLSLKDKEQNA

SEQ ID NO: 3324759 - protein, 6 aa, Plasmodium falciparum
KQSTNQ

SEQ ID NO: 3324760 - protein, 12 aa, Plasmodium falciparum
KQSYQNKTNHQK

SEQ ID NO: 3324761 - protein, 5 aa, Plasmodium falciparum
KQTDN

SEQ ID NO: 3324762 - protein, 10 aa, Plasmodium falciparum
KQTDNINEED

SEQ ID NO: 3324763 - protein, 7 aa, Plasmodium falciparum
KQTDQTQ

SEQ ID NO: 3324764 - protein, 8 aa, Plasmodium falciparum
KQTEGDDL

SEQ ID NO: 3324765 - protein, 8 aa, Plasmodium falciparum
KQTENEQL

SEQ ID NO: 3324766 - protein, 8 aa, Plasmodium falciparum
KQTKDRKK

SEQ ID NO: 3324767 - protein, 23 aa, Plasmodium falciparum
KQTKISKNKISNIEDEQQEEPHN

SEQ ID NO: 3324768 - protein, 22 aa, Plasmodium falciparum
KQTKKEEEENNTKKKKKKKKKK

SEQ ID NO: 3324769 - protein, 12 aa, Plasmodium falciparum
KQTKKRINTHTN

SEQ ID NO: 3324770 - protein, 25 aa, Plasmodium falciparum
KQTKNKTIKQNKTISHNNNNNMRSS

SEQ ID NO: 3324771 - protein, 4 aa, Plasmodium falciparum
KQTL

SEQ ID NO: 3324772 - protein, 4 aa, Plasmodium falciparum
KQTN

SEQ ID NO: 3324773 - protein, 8 aa, Plasmodium falciparum
KQTNNQIT

SEQ ID NO: 3324774 - protein, 7 aa, Plasmodium falciparum
KQTNRQK

SEQ ID NO: 3324775 - protein, 9 aa, Plasmodium falciparum
KQTPSKRTK

SEQ ID NO: 3324776 - protein, 6 aa, Plasmodium falciparum
KQTQAT

SEQ ID NO: 3324777 - protein, 9 aa, Plasmodium falciparum
KQTRAGQRT

SEQ ID NO: 3324778 - protein, 5 aa, Plasmodium falciparum
KQTSE

SEQ ID NO: 3324779 - protein, 21 aa, Plasmodium falciparum
KQTSENKKKVLQNKNDDKYKD

SEQ ID NO: 3324780 - protein, 17 aa, Plasmodium falciparum
KQTSKVQQKDEKERIQD

SEQ ID NO: 3324781 - protein, 6 aa, Plasmodium falciparum
KQTSLG

SEQ ID NO: 3324782 - protein, 6 aa, Plasmodium falciparum
KQTSRL

SEQ ID NO: 3324783 - protein, 27 aa, Plasmodium falciparum
KQTSTEFNGTYKDSDGDSENTENEQKT

SEQ ID NO: 3324784 - protein, 18 aa, Plasmodium falciparum
KQTYNQKMKRENSKDNIN

SEQ ID NO: 3324785 - protein, 5 aa, Plasmodium falciparum
KQVDT

SEQ ID NO: 3324786 - protein, 21 aa, Plasmodium falciparum
KQVEVSDNEEAADKEEEVTDE

SEQ ID NO: 3324787 - protein, 9 aa, Plasmodium falciparum
KQVKNEKDI

SEQ ID NO: 3324788 - protein, 4 aa, Plasmodium falciparum
KQVN

SEQ ID NO: 3324789 - protein, 26 aa, Plasmodium falciparum
KQVNEKEENKIHSNKSNNEYNEQSND

SEQ ID NO: 3324790 - protein, 9 aa, Plasmodium falciparum
KQVNNNNYN

SEQ ID NO: 3324791 - protein, 10 aa, Plasmodium falciparum
KQYAQQDAEE

SEQ ID NO: 3324792 - protein, 23 aa, Plasmodium falciparum
KQYDDANKQNYNDKSKKNNKRKL

SEQ ID NO: 3324793 - protein, 12 aa, Plasmodium falciparum
KQYEKTKNEDDI

SEQ ID NO: 3324794 - protein, 6 aa, Plasmodium falciparum
KQYGNI

SEQ ID NO: 3324795 - protein, 7 aa, Plasmodium falciparum
KQYNDDK

SEQ ID NO: 3324796 - protein, 5 aa, Plasmodium falciparum
KQYNT

SEQ ID NO: 3324797 - protein, 8 aa, Plasmodium falciparum
KQYNTNRN

SEQ ID NO: 3324798 - protein, 5 aa, Plasmodium falciparum
KQYRE

SEQ ID NO: 3324799 - protein, 6 aa, Plasmodium falciparum
KQYRND

SEQ ID NO: 3324800 - protein, 6 aa, Plasmodium falciparum
KQYSPV

SEQ ID NO: 3324801 - protein, 9 aa, Plasmodium falciparum
KQYSRNNKK

SEQ ID NO: 3324802 - protein, 5 aa, Plasmodium falciparum
KQYTA

SEQ ID NO: 3324803 - protein, 36 aa, Plasmodium falciparum
KRAAGGLYNTKPGVETLPSDSMNDEFTQNNNNNNNN

SEQ ID NO: 3324804 - protein, 8 aa, Plasmodium falciparum
KRAATATA

SEQ ID NO: 3324805 - protein, 10 aa, Plasmodium falciparum
KRANAQKQNV

SEQ ID NO: 3324806 - protein, 16 aa, Plasmodium falciparum
KRASGTSNLQDTTTTN

SEQ ID NO: 3324807 - protein, 30 aa, Plasmodium falciparum
KRASSNNNNNFGNNNNFGNNNSCGNNNSCG

SEQ ID NO: 3324808 - protein, 5 aa, Plasmodium falciparum
KRCTG

SEQ ID NO: 3324809 - protein, 14 aa, Plasmodium falciparum
KRDDENESNDEVQN

SEQ ID NO: 3324810 - protein, 48 aa, Plasmodium falciparum
KRDDLTNINNKNGGNGENVENVENDQNVENDQNVENDQNVENNNMEKN

SEQ ID NO: 3324811 - protein, 7 aa, Plasmodium falciparum
KRDDSNR

SEQ ID NO: 3324812 - protein, 7 aa, Plasmodium falciparum
KRDEATD

SEQ ID NO: 3324813 - protein, 7 aa, Plasmodium falciparum
KRDEEDK

SEQ ID NO: 3324814 - protein, 12 aa, Plasmodium falciparum
KRDEGDNSHKYM

SEQ ID NO: 3324815 - protein, 5 aa, Plasmodium falciparum
KRDEN

SEQ ID NO: 3324816 - protein, 5 aa, Plasmodium falciparum
KRDEQ

SEQ ID NO: 3324817 - protein, 13 aa, Plasmodium falciparum
KRDETNHHTNNNS

SEQ ID NO: 3324818 - protein, 4 aa, Plasmodium falciparum
KRDG

SEQ ID NO: 3324819 - protein, 11 aa, Plasmodium falciparum
KRDGDYNGSTT

SEQ ID NO: 3324820 - protein, 18 aa, Plasmodium falciparum
KRDGNDWKEKSGGRCTRK

SEQ ID NO: 3324821 - protein, 7 aa, Plasmodium falciparum
KRDHSKE

SEQ ID NO: 3324822 - protein, 7 aa, Plasmodium falciparum
KRDKNKN

SEQ ID NO: 3324823 - protein, 6 aa, Plasmodium falciparum
KRDKPE

SEQ ID NO: 3324824 - protein, 14 aa, Plasmodium falciparum
KRDNHALDTQESQE

SEQ ID NO: 3324825 - protein, 14 aa, Plasmodium falciparum
KRDNKNEDNTDQQY

SEQ ID NO: 3324826 - protein, 12 aa, Plasmodium falciparum
KRDNKNHNKTYH

SEQ ID NO: 3324827 - protein, 18 aa, Plasmodium falciparum
KRDPPNINDTRAFPSLTS

SEQ ID NO: 3324828 - protein, 6 aa, Plasmodium falciparum
KRDRKH

SEQ ID NO: 3324829 - protein, 6 aa, Plasmodium falciparum
KRDRNK

SEQ ID NO: 3324830 - protein, 14 aa, Plasmodium falciparum
KRDSKYTGRKRKGR

SEQ ID NO: 3324831 - protein, 5 aa, Plasmodium falciparum
KRDTE

SEQ ID NO: 3324832 - protein, 10 aa, Plasmodium falciparum
KRDTKWTPYE

SEQ ID NO: 3324833 - protein, 6 aa, Plasmodium falciparum
KRDVTI

SEQ ID NO: 3324834 - protein, 6 aa, Plasmodium falciparum
KREALT

SEQ ID NO: 3324835 - protein, 7 aa, Plasmodium falciparum
KREAPEK

SEQ ID NO: 3324836 - protein, 6 aa, Plasmodium falciparum
KRECQE

SEQ ID NO: 3324837 - protein, 7 aa, Plasmodium falciparum
KRECSND

SEQ ID NO: 3324838 - protein, 9 aa, Plasmodium falciparum
KREDDEKKI

SEQ ID NO: 3324839 - protein, 6 aa, Plasmodium falciparum
KREDDI

SEQ ID NO: 3324840 - protein, 8 aa, Plasmodium falciparum
KREDDKNI

SEQ ID NO: 3324841 - protein, 16 aa, Plasmodium falciparum
KREDNNINENQNEYDN

SEQ ID NO: 3324842 - protein, 14 aa, Plasmodium falciparum
KREDNNNNNMDGEN

SEQ ID NO: 3324843 - protein, 11 aa, Plasmodium falciparum
KREDQNKNVNI

SEQ ID NO: 3324844 - protein, 8 aa, Plasmodium falciparum
KREDSLEE

SEQ ID NO: 3324845 - protein, 12 aa, Plasmodium falciparum
KREDTKKDNNIL

SEQ ID NO: 3324846 - protein, 4 aa, Plasmodium falciparum
KREE

SEQ ID NO: 3324847 - protein, 8 aa, Plasmodium falciparum
KREEAKRA

SEQ ID NO: 3324848 - protein, 12 aa, Plasmodium falciparum
KREEKYKRNTKK

SEQ ID NO: 3324849 - protein, 10 aa, Plasmodium falciparum
KREEPSQEDL

SEQ ID NO: 3324850 - protein, 9 aa, Plasmodium falciparum
KREERKYNY

SEQ ID NO: 3324851 - protein, 9 aa, Plasmodium falciparum
KREERTSKE

SEQ ID NO: 3324852 - protein, 7 aa, Plasmodium falciparum
KREESKR

SEQ ID NO: 3324853 - protein, 40 aa, Plasmodium falciparum
KREEYNNNNHNNNSNKINDNQNNDKTKGDDNYNTTNNNTN

SEQ ID NO: 3324854 - protein, 13 aa, Plasmodium falciparum
KREGQELSDKEQK

SEQ ID NO: 3324855 - protein, 8 aa, Plasmodium falciparum
KREGRGKF

SEQ ID NO: 3324856 - protein, 6 aa, Plasmodium falciparum
KREIER

SEQ ID NO: 3324857 - protein, 5 aa, Plasmodium falciparum
KREKE

SEQ ID NO: 3324858 - protein, 32 aa, Plasmodium falciparum
KREKEEKSDEMKDDKKDDKKNENTREKNNLDN

SEQ ID NO: 3324859 - protein, 6 aa, Plasmodium falciparum
KREKEV

SEQ ID NO: 3324860 - protein, 9 aa, Plasmodium falciparum
KREKGSVEV

SEQ ID NO: 3324861 - protein, 11 aa, Plasmodium falciparum
KREKKGKNENF

SEQ ID NO: 3324862 - protein, 12 aa, Plasmodium falciparum
KREKKLKNNECI

SEQ ID NO: 3324863 - protein, 9 aa, Plasmodium falciparum
KREKNKVSN

SEQ ID NO: 3324864 - protein, 7 aa, Plasmodium falciparum
KREKYND

SEQ ID NO: 3324865 - protein, 59 aa, Plasmodium falciparum
KREMKYKKKSEVKYKRKSKTKYRQKSKVKYKRKSKTKYRQKSKVKYRRKNNQDQNVSTN

SEQ ID NO: 3324866 - protein, 5 aa, Plasmodium falciparum
KRENA

SEQ ID NO: 3324867 - protein, 18 aa, Plasmodium falciparum
KRENNNDKKRLTYKNEKY

SEQ ID NO: 3324868 - protein, 8 aa, Plasmodium falciparum
KRENNNTI

SEQ ID NO: 3324869 - protein, 13 aa, Plasmodium falciparum
KRENNSNHSNDYN

SEQ ID NO: 3324870 - protein, 7 aa, Plasmodium falciparum
KRENQED

SEQ ID NO: 3324871 - protein, 11 aa, Plasmodium falciparum
KREPLSDDDKE

SEQ ID NO: 3324872 - protein, 6 aa, Plasmodium falciparum
KREQRL

SEQ ID NO: 3324873 - protein, 8 aa, Plasmodium falciparum
KREQYEDS

SEQ ID NO: 3324874 - protein, 9 aa, Plasmodium falciparum
KRERDNSEM

SEQ ID NO: 3324875 - protein, 10 aa, Plasmodium falciparum
KRERGSDNDC

SEQ ID NO: 3324876 - protein, 6 aa, Plasmodium falciparum
KRERYK

SEQ ID NO: 3324877 - protein, 4 aa, Plasmodium falciparum
KRES

SEQ ID NO: 3324878 - protein, 7 aa, Plasmodium falciparum
KRESKNI

SEQ ID NO: 3324879 - protein, 5 aa, Plasmodium falciparum
KRESL

SEQ ID NO: 3324880 - protein, 23 aa, Plasmodium falciparum
KRESNLSDKSDKPNINEQNNDVM

SEQ ID NO: 3324881 - protein, 7 aa, Plasmodium falciparum
KRETEQV

SEQ ID NO: 3324882 - protein, 5 aa, Plasmodium falciparum
KRETY

SEQ ID NO: 3324883 - protein, 4 aa, Plasmodium falciparum
KREY

SEQ ID NO: 3324884 - protein, 13 aa, Plasmodium falciparum
KRFGSNDSTNNND

SEQ ID NO: 3324885 - protein, 18 aa, Plasmodium falciparum
KRFRNKKKSNHPLKSDEN

SEQ ID NO: 3324886 - protein, 4 aa, Plasmodium falciparum
KRFS

SEQ ID NO: 3324887 - protein, 6 aa, Plasmodium falciparum
KRFSEE

SEQ ID NO: 3324888 - protein, 7 aa, Plasmodium falciparum
KRGAEFQ

SEQ ID NO: 3324889 - protein, 7 aa, Plasmodium falciparum
KRGATVD

SEQ ID NO: 3324890 - protein, 9 aa, Plasmodium falciparum
KRGDYTKLD

SEQ ID NO: 3324891 - protein, 4 aa, Plasmodium falciparum
KRGE

SEQ ID NO: 3324892 - protein, 5 aa, Plasmodium falciparum
KRGIT

SEQ ID NO: 3324893 - protein, 6 aa, Plasmodium falciparum
KRGKSG

SEQ ID NO: 3324894 - protein, 6 aa, Plasmodium falciparum
KRGNIN

SEQ ID NO: 3324895 - protein, 10 aa, Plasmodium falciparum
KRGNKRYSSM

SEQ ID NO: 3324896 - protein, 8 aa, Plasmodium falciparum
KRGNNNNI

SEQ ID NO: 3324897 - protein, 7 aa, Plasmodium falciparum
KRGQENT

SEQ ID NO: 3324898 - protein, 16 aa, Plasmodium falciparum
KRGRGRPPKRKLSEES

SEQ ID NO: 3324899 - protein, 17 aa, Plasmodium falciparum
KRGRKKKSEKKKRGRKK

SEQ ID NO: 3324900 - protein, 16 aa, Plasmodium falciparum
KRGRNKRRHIDEKKKN

SEQ ID NO: 3324901 - protein, 30 aa, Plasmodium falciparum
KRGSKNEERKSSSYKSYPKFNKGKRNDAFG

SEQ ID NO: 3324902 - protein, 10 aa, Plasmodium falciparum
KRGSKSIESV

SEQ ID NO: 3324903 - protein, 7 aa, Plasmodium falciparum
KRGTGKS

SEQ ID NO: 3324904 - protein, 15 aa, Plasmodium falciparum
KRGVQNKKNNYNKEN

SEQ ID NO: 3324905 - protein, 5 aa, Plasmodium falciparum
KRHDY

SEQ ID NO: 3324906 - protein, 8 aa, Plasmodium falciparum
KRHEAKKR

SEQ ID NO: 3324907 - protein, 13 aa, Plasmodium falciparum
KRHEERKEKETLK

SEQ ID NO: 3324908 - protein, 8 aa, Plasmodium falciparum
KRHGNGIY

SEQ ID NO: 3324909 - protein, 17 aa, Plasmodium falciparum
KRHKKSKAYIAAPDYQY

SEQ ID NO: 3324910 - protein, 5 aa, Plasmodium falciparum
KRHMN

SEQ ID NO: 3324911 - protein, 4 aa, Plasmodium falciparum
KRHN

SEQ ID NO: 3324912 - protein, 7 aa, Plasmodium falciparum
KRHNDDI

SEQ ID NO: 3324913 - protein, 8 aa, Plasmodium falciparum
KRHNELKS

SEQ ID NO: 3324914 - protein, 9 aa, Plasmodium falciparum
KRHNESNAF

SEQ ID NO: 3324915 - protein, 4 aa, Plasmodium falciparum
KRHS

SEQ ID NO: 3324916 - protein, 13 aa, Plasmodium falciparum
KRHTTNNNKKYNI

SEQ ID NO: 3324917 - protein, 5 aa, Plasmodium falciparum
KRIED

SEQ ID NO: 3324918 - protein, 6 aa, Plasmodium falciparum
KRIEEN

SEQ ID NO: 3324919 - protein, 4 aa, Plasmodium falciparum
KRIK

SEQ ID NO: 3324920 - protein, 53 aa, Plasmodium falciparum
KRIKEDEEKRKEKEKEREKQNEKEKQKQKEMEKKNKNKNDSLMSSSTTNNNSS

SEQ ID NO: 3324921 - protein, 11 aa, Plasmodium falciparum
KRIKEKKSNLI

SEQ ID NO: 3324922 - protein, 4 aa, Plasmodium falciparum
KRIM

SEQ ID NO: 3324923 - protein, 34 aa, Plasmodium falciparum
KRINADKSLGATTGGVNAADTQNGTTKSTGNNSV

SEQ ID NO: 3324924 - protein, 17 aa, Plasmodium falciparum
KRINEKDNDTDREDAAS

SEQ ID NO: 3324925 - protein, 8 aa, Plasmodium falciparum
KRIPRRGE

SEQ ID NO: 3324926 - protein, 5 aa, Plasmodium falciparum
KRIRD

SEQ ID NO: 3324927 - protein, 11 aa, Plasmodium falciparum
KRIRKKYSSSN

SEQ ID NO: 3324928 - protein, 6 aa, Plasmodium falciparum
KRIRPE

SEQ ID NO: 3324929 - protein, 11 aa, Plasmodium falciparum
KRKCTNRSYNN

SEQ ID NO: 3324930 - protein, 9 aa, Plasmodium falciparum
KRKDDEEQV

SEQ ID NO: 3324931 - protein, 7 aa, Plasmodium falciparum
KRKDDPM

SEQ ID NO: 3324932 - protein, 10 aa, Plasmodium falciparum
KRKDKNKIDH

SEQ ID NO: 3324933 - protein, 8 aa, Plasmodium falciparum
KRKEDDNI

SEQ ID NO: 3324934 - protein, 10 aa, Plasmodium falciparum
KRKEDTSQEI

SEQ ID NO: 3324935 - protein, 7 aa, Plasmodium falciparum
KRKEKEF

SEQ ID NO: 3324936 - protein, 11 aa, Plasmodium falciparum
KRKEKETQEKE

SEQ ID NO: 3324937 - protein, 6 aa, Plasmodium falciparum
KRKEKI

SEQ ID NO: 3324938 - protein, 6 aa, Plasmodium falciparum
KRKEKK

SEQ ID NO: 3324939 - protein, 14 aa, Plasmodium falciparum
KRKEKKKKKKPNRE

SEQ ID NO: 3324940 - protein, 13 aa, Plasmodium falciparum
KRKEKKKKQSDSV

SEQ ID NO: 3324941 - protein, 11 aa, Plasmodium falciparum
KRKEKKRGKKM

SEQ ID NO: 3324942 - protein, 5 aa, Plasmodium falciparum
KRKEN

SEQ ID NO: 3324943 - protein, 9 aa, Plasmodium falciparum
KRKEREERI

SEQ ID NO: 3324944 - protein, 21 aa, Plasmodium falciparum
KRKESPENVDKNIKGDKNIKN

SEQ ID NO: 3324945 - protein, 9 aa, Plasmodium falciparum
KRKEYKEKN

SEQ ID NO: 3324946 - protein, 4 aa, Plasmodium falciparum
KRKG

SEQ ID NO: 3324947 - protein, 15 aa, Plasmodium falciparum
KRKGDDSKKSQELDG

SEQ ID NO: 3324948 - protein, 10 aa, Plasmodium falciparum
KRKGGKSYNI

SEQ ID NO: 3324949 - protein, 13 aa, Plasmodium falciparum
KRKGKHSSSNNSY

SEQ ID NO: 3324950 - protein, 8 aa, Plasmodium falciparum
KRKGSSKT

SEQ ID NO: 3324951 - protein, 13 aa, Plasmodium falciparum
KRKGTKNARTNQK

SEQ ID NO: 3324952 - protein, 4 aa, Plasmodium falciparum
KRKI

SEQ ID NO: 3324953 - protein, 14 aa, Plasmodium falciparum
KRKIEYNEKQYSNA

SEQ ID NO: 3324954 - protein, 8 aa, Plasmodium falciparum
KRKKEKRD

SEQ ID NO: 3324955 - protein, 11 aa, Plasmodium falciparum
KRKKENNKKGI

SEQ ID NO: 3324956 - protein, 7 aa, Plasmodium falciparum
KRKKHYN

SEQ ID NO: 3324957 - protein, 28 aa, Plasmodium falciparum
KRKKKKKKIKIRGRKKKSIIKGRRKYKC

SEQ ID NO: 3324958 - protein, 49 aa, Plasmodium falciparum
KRKKKKKKKKKRKNYNNPNYPYSSSSSSSSSSSSSSSSSSFSSSSVSSY

SEQ ID NO: 3324959 - protein, 7 aa, Plasmodium falciparum
KRKKKTD

SEQ ID NO: 3324960 - protein, 10 aa, Plasmodium falciparum
KRKKKTKKKN

SEQ ID NO: 3324961 - protein, 7 aa, Plasmodium falciparum
KRKKNCN

SEQ ID NO: 3324962 - protein, 11 aa, Plasmodium falciparum
KRKKNRKDENL

SEQ ID NO: 3324963 - protein, 17 aa, Plasmodium falciparum
KRKKQGSNLVNSNNNMN

SEQ ID NO: 3324964 - protein, 19 aa, Plasmodium falciparum
KRKKSEKEKDKEKEKEASY

SEQ ID NO: 3324965 - protein, 12 aa, Plasmodium falciparum
KRKKSKDNVTRE

SEQ ID NO: 3324966 - protein, 16 aa, Plasmodium falciparum
KRKKSQTNNKNQESIK

SEQ ID NO: 3324967 - protein, 8 aa, Plasmodium falciparum
KRKKTLNK

SEQ ID NO: 3324968 - protein, 7 aa, Plasmodium falciparum
KRKKTQS

SEQ ID NO: 3324969 - protein, 14 aa, Plasmodium falciparum
KRKKTTSNINNRKN

SEQ ID NO: 3324970 - protein, 6 aa, Plasmodium falciparum
KRKKYD

SEQ ID NO: 3324971 - protein, 7 aa, Plasmodium falciparum
KRKLANK

SEQ ID NO: 3324972 - protein, 7 aa, Plasmodium falciparum
KRKLNNN

SEQ ID NO: 3324973 - protein, 7 aa, Plasmodium falciparum
KRKLTHN

SEQ ID NO: 3324974 - protein, 10 aa, Plasmodium falciparum
KRKMPKHNSQ

SEQ ID NO: 3324975 - protein, 5 aa, Plasmodium falciparum
KRKNA

SEQ ID NO: 3324976 - protein, 6 aa, Plasmodium falciparum
KRKNEK

SEQ ID NO: 3324977 - protein, 7 aa, Plasmodium falciparum
KRKNEKD

SEQ ID NO: 3324978 - protein, 7 aa, Plasmodium falciparum
KRKNENK

SEQ ID NO: 3324979 - protein, 10 aa, Plasmodium falciparum
KRKNHHDNNE

SEQ ID NO: 3324980 - protein, 69 aa, Plasmodium falciparum
KRKNKKEGKQNEDNDEEDEQDDEDVDEGDDEDEEDDDIEDEDTDDDENDEENDDDDDYDNECDEDEVHN

SEQ ID NO: 3324981 - protein, 10 aa, Plasmodium falciparum
KRKNKNEFDN

SEQ ID NO: 3324982 - protein, 12 aa, Plasmodium falciparum
KRKNKNVKSDKI

SEQ ID NO: 3324983 - protein, 19 aa, Plasmodium falciparum
KRKNKTQNTDKNIDDPKKD

SEQ ID NO: 3324984 - protein, 14 aa, Plasmodium falciparum
KRKNNNGKNKKIFD

SEQ ID NO: 3324985 - protein, 51 aa, Plasmodium falciparum
KRKNNNNNNKTEINKKVKKEKEKEKQSSNENFPKKKDEEKQPRKKKFQKKN

SEQ ID NO: 3324986 - protein, 17 aa, Plasmodium falciparum
KRKNNNNNNTKRNATSL

SEQ ID NO: 3324987 - protein, 9 aa, Plasmodium falciparum
KRKNNPNPH

SEQ ID NO: 3324988 - protein, 19 aa, Plasmodium falciparum
KRKNNTYEYKDDKDYTSYD

SEQ ID NO: 3324989 - protein, 26 aa, Plasmodium falciparum
KRKNRKDSKIKSSDDLSYNSNSDYIN

SEQ ID NO: 3324990 - protein, 12 aa, Plasmodium falciparum
KRKNRNQNKTKK

SEQ ID NO: 3324991 - protein, 10 aa, Plasmodium falciparum
KRKNSNIEDK

SEQ ID NO: 3324992 - protein, 23 aa, Plasmodium falciparum
KRKNSNISIEEKKNEKREKKCVA

SEQ ID NO: 3324993 - protein, 8 aa, Plasmodium falciparum
KRKNVPSY

SEQ ID NO: 3324994 - protein, 7 aa, Plasmodium falciparum
KRKNYHQ

SEQ ID NO: 3324995 - protein, 25 aa, Plasmodium falciparum
KRKNYIKSTDQENENNLKKKTKQNN

SEQ ID NO: 3324996 - protein, 8 aa, Plasmodium falciparum
KRKNYKNI

SEQ ID NO: 3324997 - protein, 19 aa, Plasmodium falciparum
KRKPEEKRKEEKEKEKLNQ

SEQ ID NO: 3324998 - protein, 14 aa, Plasmodium falciparum
KRKPIDRCEEGSNP

SEQ ID NO: 3324999 - protein, 8 aa, Plasmodium falciparum
KRKPNFNS

SEQ ID NO: 3325000 - protein, 31 aa, Plasmodium falciparum
KRKPYSSDSGIRSSHSMSRNSSYEEKKKKSI

SEQ ID NO: 3325001 - protein, 7 aa, Plasmodium falciparum
KRKQVEN

SEQ ID NO: 3325002 - protein, 6 aa, Plasmodium falciparum
KRKREK

SEQ ID NO: 3325003 - protein, 12 aa, Plasmodium falciparum
KRKRKKMEAQKS

SEQ ID NO: 3325004 - protein, 14 aa, Plasmodium falciparum
KRKRKRGKKKKKII

SEQ ID NO: 3325005 - protein, 14 aa, Plasmodium falciparum
KRKRKSPKNEHLEN

SEQ ID NO: 3325006 - protein, 6 aa, Plasmodium falciparum
KRKRNK

SEQ ID NO: 3325007 - protein, 4 aa, Plasmodium falciparum
KRKS

SEQ ID NO: 3325008 - protein, 5 aa, Plasmodium falciparum
KRKSD

SEQ ID NO: 3325009 - protein, 6 aa, Plasmodium falciparum
KRKSHN

SEQ ID NO: 3325010 - protein, 7 aa, Plasmodium falciparum
KRKSKCG

SEQ ID NO: 3325011 - protein, 7 aa, Plasmodium falciparum
KRKSKDD

SEQ ID NO: 3325012 - protein, 10 aa, Plasmodium falciparum
KRKSKPGSLY

SEQ ID NO: 3325013 - protein, 9 aa, Plasmodium falciparum
KRKSNNHHN

SEQ ID NO: 3325014 - protein, 6 aa, Plasmodium falciparum
KRKSSK

SEQ ID NO: 3325015 - protein, 20 aa, Plasmodium falciparum
KRKSSSISKDNHLKNEERVR

SEQ ID NO: 3325016 - protein, 19 aa, Plasmodium falciparum
KRKTETTPTTTQNKIGTLF

SEQ ID NO: 3325017 - protein, 7 aa, Plasmodium falciparum
KRKTKEL

SEQ ID NO: 3325018 - protein, 17 aa, Plasmodium falciparum
KRKTKRNINKNNEIQYD

SEQ ID NO: 3325019 - protein, 10 aa, Plasmodium falciparum
KRKTKYDKNE

SEQ ID NO: 3325020 - protein, 9 aa, Plasmodium falciparum
KRKTNQHKN

SEQ ID NO: 3325021 - protein, 8 aa, Plasmodium falciparum
KRKTSESC

SEQ ID NO: 3325022 - protein, 49 aa, Plasmodium falciparum
KRKTTTSMKNKNTNLKEAQSPSGKRKVKSVGSRRESLSAPISKKDNLKR

SEQ ID NO: 3325023 - protein, 5 aa, Plasmodium falciparum
KRKTV

SEQ ID NO: 3325024 - protein, 6 aa, Plasmodium falciparum
KRKTVD

SEQ ID NO: 3325025 - protein, 6 aa, Plasmodium falciparum
KRKTVS

SEQ ID NO: 3325026 - protein, 4 aa, Plasmodium falciparum
KRKV

SEQ ID NO: 3325027 - protein, 6 aa, Plasmodium falciparum
KRKVQE

SEQ ID NO: 3325028 - protein, 7 aa, Plasmodium falciparum
KRKYKNK

SEQ ID NO: 3325029 - protein, 6 aa, Plasmodium falciparum
KRLDAN

SEQ ID NO: 3325030 - protein, 28 aa, Plasmodium falciparum
KRLEKGEIKNAKRSKKMKNTSVKNDDMI

SEQ ID NO: 3325031 - protein, 5 aa, Plasmodium falciparum
KRLGA

SEQ ID NO: 3325032 - protein, 10 aa, Plasmodium falciparum
KRLKKRKRSF

SEQ ID NO: 3325033 - protein, 14 aa, Plasmodium falciparum
KRLNENSKYVDYNN

SEQ ID NO: 3325034 - protein, 6 aa, Plasmodium falciparum
KRLSEK

SEQ ID NO: 3325035 - protein, 13 aa, Plasmodium falciparum
KRLSNSNISVNEN

SEQ ID NO: 3325036 - protein, 4 aa, Plasmodium falciparum
KRMH

SEQ ID NO: 3325037 - protein, 13 aa, Plasmodium falciparum
KRMRTPSSSYDSS

SEQ ID NO: 3325038 - protein, 7 aa, Plasmodium falciparum
KRMTDEE

SEQ ID NO: 3325039 - protein, 10 aa, Plasmodium falciparum
KRNDEEKYTN

SEQ ID NO: 3325040 - protein, 9 aa, Plasmodium falciparum
KRNDESNIY

SEQ ID NO: 3325041 - protein, 6 aa, Plasmodium falciparum
KRNDNN

SEQ ID NO: 3325042 - protein, 8 aa, Plasmodium falciparum
KRNDNNIY

SEQ ID NO: 3325043 - protein, 8 aa, Plasmodium falciparum
KRNDPNIY

SEQ ID NO: 3325044 - protein, 15 aa, Plasmodium falciparum
KRNEAAEDDDNDNQN

SEQ ID NO: 3325045 - protein, 14 aa, Plasmodium falciparum
KRNEEKAEKGETLD

SEQ ID NO: 3325046 - protein, 6 aa, Plasmodium falciparum
KRNEHF

SEQ ID NO: 3325047 - protein, 10 aa, Plasmodium falciparum
KRNENHNNIE

SEQ ID NO: 3325048 - protein, 4 aa, Plasmodium falciparum
KRNG

SEQ ID NO: 3325049 - protein, 71 aa, Plasmodium falciparum
KRNGDPRNYGDIKNGDNIKNGDNNKNGDNIKNGDNIKNGDNIKNGDNIKNGDNIKNGDNIKNGDNIKNGDD

SEQ ID NO: 3325050 - protein, 5 aa, Plasmodium falciparum
KRNGK

SEQ ID NO: 3325051 - protein, 6 aa, Plasmodium falciparum
KRNGKK

SEQ ID NO: 3325052 - protein, 11 aa, Plasmodium falciparum
KRNGKKKKKMI

SEQ ID NO: 3325053 - protein, 6 aa, Plasmodium falciparum
KRNHSE

SEQ ID NO: 3325054 - protein, 4 aa, Plasmodium falciparum
KRNI

SEQ ID NO: 3325055 - protein, 8 aa, Plasmodium falciparum
KRNIKKDS

SEQ ID NO: 3325056 - protein, 5 aa, Plasmodium falciparum
KRNIQ

SEQ ID NO: 3325057 - protein, 11 aa, Plasmodium falciparum
KRNIQQNEEKH

SEQ ID NO: 3325058 - protein, 11 aa, Plasmodium falciparum
KRNKENNTCSP

SEQ ID NO: 3325059 - protein, 45 aa, Plasmodium falciparum
KRNKEQLNKQGTNGSMNGGTNGSRDGGTNGGTNGNMNGNKDKYQM

SEQ ID NO: 3325060 - protein, 6 aa, Plasmodium falciparum
KRNKIK

SEQ ID NO: 3325061 - protein, 19 aa, Plasmodium falciparum
KRNKKEESIWETSNTYAIN

SEQ ID NO: 3325062 - protein, 8 aa, Plasmodium falciparum
KRNKQQPI

SEQ ID NO: 3325063 - protein, 14 aa, Plasmodium falciparum
KRNKRKKKKKRQKK

SEQ ID NO: 3325064 - protein, 9 aa, Plasmodium falciparum
KRNKYIQTQ

SEQ ID NO: 3325065 - protein, 5 aa, Plasmodium falciparum
KRNLN

SEQ ID NO: 3325066 - protein, 5 aa, Plasmodium falciparum
KRNMD

SEQ ID NO: 3325067 - protein, 5 aa, Plasmodium falciparum
KRNND

SEQ ID NO: 3325068 - protein, 8 aa, Plasmodium falciparum
KRNNEKIK

SEQ ID NO: 3325069 - protein, 6 aa, Plasmodium falciparum
KRNNFS

SEQ ID NO: 3325070 - protein, 7 aa, Plasmodium falciparum
KRNNIST

SEQ ID NO: 3325071 - protein, 10 aa, Plasmodium falciparum
KRNNKDLQQK

SEQ ID NO: 3325072 - protein, 12 aa, Plasmodium falciparum
KRNNKKKSTRFK

SEQ ID NO: 3325073 - protein, 12 aa, Plasmodium falciparum
KRNNKKRNKKKE

SEQ ID NO: 3325074 - protein, 19 aa, Plasmodium falciparum
KRNNKRDKDTFEKRQDNNN

SEQ ID NO: 3325075 - protein, 7 aa, Plasmodium falciparum
KRNNKTE

SEQ ID NO: 3325076 - protein, 22 aa, Plasmodium falciparum
KRNNNDDQHSMDSHNEDENNER

SEQ ID NO: 3325077 - protein, 7 aa, Plasmodium falciparum
KRNNNHE

SEQ ID NO: 3325078 - protein, 7 aa, Plasmodium falciparum
KRNNQDC

SEQ ID NO: 3325079 - protein, 7 aa, Plasmodium falciparum
KRNNRRK

SEQ ID NO: 3325080 - protein, 7 aa, Plasmodium falciparum
KRNNTNA

SEQ ID NO: 3325081 - protein, 6 aa, Plasmodium falciparum
KRNPHK

SEQ ID NO: 3325082 - protein, 7 aa, Plasmodium falciparum
KRNPNKK

SEQ ID NO: 3325083 - protein, 4 aa, Plasmodium falciparum
KRNR

SEQ ID NO: 3325084 - protein, 41 aa, Plasmodium falciparum
KRNRDEDNGKDNHKDNHKDNHKDNHKDNHKDNDKDNDRDNL

SEQ ID NO: 3325085 - protein, 11 aa, Plasmodium falciparum
KRNSKSNKAEC

SEQ ID NO: 3325086 - protein, 18 aa, Plasmodium falciparum
KRNSLGSNKTSDNTINNN

SEQ ID NO: 3325087 - protein, 11 aa, Plasmodium falciparum
KRNSNKFDNAY

SEQ ID NO: 3325088 - protein, 9 aa, Plasmodium falciparum
KRNSPPTSY

SEQ ID NO: 3325089 - protein, 6 aa, Plasmodium falciparum
KRNSSK

SEQ ID NO: 3325090 - protein, 6 aa, Plasmodium falciparum
KRNSYK

SEQ ID NO: 3325091 - protein, 4 aa, Plasmodium falciparum
KRNT

SEQ ID NO: 3325092 - protein, 5 aa, Plasmodium falciparum
KRNTL

SEQ ID NO: 3325093 - protein, 9 aa, Plasmodium falciparum
KRNTRTYNS

SEQ ID NO: 3325094 - protein, 12 aa, Plasmodium falciparum
KRNVMNEKGNNF

SEQ ID NO: 3325095 - protein, 5 aa, Plasmodium falciparum
KRNYA

SEQ ID NO: 3325096 - protein, 18 aa, Plasmodium falciparum
KRNYDKDKKNEEINEKYN

SEQ ID NO: 3325097 - protein, 5 aa, Plasmodium falciparum
KRNYE

SEQ ID NO: 3325098 - protein, 13 aa, Plasmodium falciparum
KRNYEEKFKKTAE

SEQ ID NO: 3325099 - protein, 7 aa, Plasmodium falciparum
KRNYNNN

SEQ ID NO: 3325100 - protein, 9 aa, Plasmodium falciparum
KRNYSSECE

SEQ ID NO: 3325101 - protein, 14 aa, Plasmodium falciparum
KRPFPNDKKKELSN

SEQ ID NO: 3325102 - protein, 8 aa, Plasmodium falciparum
KRPHNSEQ

SEQ ID NO: 3325103 - protein, 12 aa, Plasmodium falciparum
KRPKKDDINENR

SEQ ID NO: 3325104 - protein, 7 aa, Plasmodium falciparum
KRPKSMK

SEQ ID NO: 3325105 - protein, 5 aa, Plasmodium falciparum
KRPLR

SEQ ID NO: 3325106 - protein, 6 aa, Plasmodium falciparum
KRPRIG

SEQ ID NO: 3325107 - protein, 12 aa, Plasmodium falciparum
KRPSKENSNSSL

SEQ ID NO: 3325108 - protein, 6 aa, Plasmodium falciparum
KRPSKN

SEQ ID NO: 3325109 - protein, 5 aa, Plasmodium falciparum
KRPTH

SEQ ID NO: 3325110 - protein, 6 aa, Plasmodium falciparum
KRPYNY

SEQ ID NO: 3325111 - protein, 6 aa, Plasmodium falciparum
KRQAKN

SEQ ID NO: 3325112 - protein, 4 aa, Plasmodium falciparum
KRQK

SEQ ID NO: 3325113 - protein, 6 aa, Plasmodium falciparum
KRQKAT

SEQ ID NO: 3325114 - protein, 8 aa, Plasmodium falciparum
KRQKDKKK

SEQ ID NO: 3325115 - protein, 19 aa, Plasmodium falciparum
KRQKRKNKILNSSNDSNWS

SEQ ID NO: 3325116 - protein, 11 aa, Plasmodium falciparum
KRQKTKKKTNI

SEQ ID NO: 3325117 - protein, 4 aa, Plasmodium falciparum
KRQN

SEQ ID NO: 3325118 - protein, 7 aa, Plasmodium falciparum
KRQNDMA

SEQ ID NO: 3325119 - protein, 14 aa, Plasmodium falciparum
KRQNQTKSTCYAQT

SEQ ID NO: 3325120 - protein, 26 aa, Plasmodium falciparum
KRQRKIGASIEKKKRQVEKSFKTTSH

SEQ ID NO: 3325121 - protein, 14 aa, Plasmodium falciparum
KRQSCSATTNYCNC

SEQ ID NO: 3325122 - protein, 6 aa, Plasmodium falciparum
KRQSKN

SEQ ID NO: 3325123 - protein, 20 aa, Plasmodium falciparum
KRQTQTNNFNNNEQSQVNTN

SEQ ID NO: 3325124 - protein, 10 aa, Plasmodium falciparum
KRQVEKNGTL

SEQ ID NO: 3325125 - protein, 6 aa, Plasmodium falciparum
KRRDSP

SEQ ID NO: 3325126 - protein, 11 aa, Plasmodium falciparum
KRREDREKEKQ

SEQ ID NO: 3325127 - protein, 21 aa, Plasmodium falciparum
KRREEKMKEQTNISKKQDNVY

SEQ ID NO: 3325128 - protein, 6 aa, Plasmodium falciparum
KRREHE

SEQ ID NO: 3325129 - protein, 12 aa, Plasmodium falciparum
KRRGRKRQTEDI

SEQ ID NO: 3325130 - protein, 12 aa, Plasmodium falciparum
KRRIKTKKFFPC

SEQ ID NO: 3325131 - protein, 6 aa, Plasmodium falciparum
KRRIPD

SEQ ID NO: 3325132 - protein, 14 aa, Plasmodium falciparum
KRRKGKTYKNSNIQ

SEQ ID NO: 3325133 - protein, 18 aa, Plasmodium falciparum
KRRKNGNSKRAKSNNLSN

SEQ ID NO: 3325134 - protein, 9 aa, Plasmodium falciparum
KRRKQNKKV

SEQ ID NO: 3325135 - protein, 11 aa, Plasmodium falciparum
KRRKRENSRST

SEQ ID NO: 3325136 - protein, 49 aa, Plasmodium falciparum
KRRKRKNLTDDDNYNDDNYNDDNYNDGDKDNDGDKDNNNDNNNNNNQNN

SEQ ID NO: 3325137 - protein, 10 aa, Plasmodium falciparum
KRRKYSPTIQ

SEQ ID NO: 3325138 - protein, 14 aa, Plasmodium falciparum
KRRLNSPYNKKDES

SEQ ID NO: 3325139 - protein, 26 aa, Plasmodium falciparum
KRRNITKKESSNVKSRGSNSKKKKNL

SEQ ID NO: 3325140 - protein, 10 aa, Plasmodium falciparum
KRRNTTGTGR

SEQ ID NO: 3325141 - protein, 11 aa, Plasmodium falciparum
KRRNTTNRGTT

SEQ ID NO: 3325142 - protein, 7 aa, Plasmodium falciparum
KRRPTNN

SEQ ID NO: 3325143 - protein, 15 aa, Plasmodium falciparum
KRRRGSTLNSNSSSV

SEQ ID NO: 3325144 - protein, 25 aa, Plasmodium falciparum
KRRRKDEKERDRERERERERERERR

SEQ ID NO: 3325145 - protein, 31 aa, Plasmodium falciparum
KRRRNVDDKNETNSNADERDKDDDRYGRKQV

SEQ ID NO: 3325146 - protein, 16 aa, Plasmodium falciparum
KRRRRKKKKKKKRTIS

SEQ ID NO: 3325147 - protein, 7 aa, Plasmodium falciparum
KRRSGDK

SEQ ID NO: 3325148 - protein, 17 aa, Plasmodium falciparum
KRRTAETAYNKKSSRSH

SEQ ID NO: 3325149 - protein, 13 aa, Plasmodium falciparum
KRSAGGKRDATAG

SEQ ID NO: 3325150 - protein, 18 aa, Plasmodium falciparum
KRSAVGQVGRDENNNIVQ

SEQ ID NO: 3325151 - protein, 19 aa, Plasmodium falciparum
KRSDENDEEIYPYVSVSFK

SEQ ID NO: 3325152 - protein, 5 aa, Plasmodium falciparum
KRSDN

SEQ ID NO: 3325153 - protein, 23 aa, Plasmodium falciparum
KRSDNSKGKYFDERKEEEYDEEE

SEQ ID NO: 3325154 - protein, 9 aa, Plasmodium falciparum
KRSEDESVK

SEQ ID NO: 3325155 - protein, 35 aa, Plasmodium falciparum
KRSESKERKKEKKEKKEKKEKKENKDNNEEKNIDI

SEQ ID NO: 3325156 - protein, 4 aa, Plasmodium falciparum
KRSG

SEQ ID NO: 3325157 - protein, 15 aa, Plasmodium falciparum
KRSGGAGGQSVNKNE

SEQ ID NO: 3325158 - protein, 8 aa, Plasmodium falciparum
KRSGKKKE

SEQ ID NO: 3325159 - protein, 9 aa, Plasmodium falciparum
KRSGPSIKN

SEQ ID NO: 3325160 - protein, 4 aa, Plasmodium falciparum
KRSH

SEQ ID NO: 3325161 - protein, 7 aa, Plasmodium falciparum
KRSKEKN

SEQ ID NO: 3325162 - protein, 10 aa, Plasmodium falciparum
KRSKENSGFY

SEQ ID NO: 3325163 - protein, 8 aa, Plasmodium falciparum
KRSKNEDI

SEQ ID NO: 3325164 - protein, 9 aa, Plasmodium falciparum
KRSKPVGTI

SEQ ID NO: 3325165 - protein, 10 aa, Plasmodium falciparum
KRSKTPIRKE

SEQ ID NO: 3325166 - protein, 5 aa, Plasmodium falciparum
KRSND

SEQ ID NO: 3325167 - protein, 21 aa, Plasmodium falciparum
KRSNYQVNNEDISNNTTYEKE

SEQ ID NO: 3325168 - protein, 14 aa, Plasmodium falciparum
KRSPKGNNKYNMDN

SEQ ID NO: 3325169 - protein, 6 aa, Plasmodium falciparum
KRSRTT

SEQ ID NO: 3325170 - protein, 19 aa, Plasmodium falciparum
KRSSEEERKKRKESQKDHI

SEQ ID NO: 3325171 - protein, 26 aa, Plasmodium falciparum
KRSSKDHKMKRKRGREEDDNKYSSDS

SEQ ID NO: 3325172 - protein, 8 aa, Plasmodium falciparum
KRSSQKEY

SEQ ID NO: 3325173 - protein, 6 aa, Plasmodium falciparum
KRSTEM

SEQ ID NO: 3325174 - protein, 7 aa, Plasmodium falciparum
KRSTPAR

SEQ ID NO: 3325175 - protein, 13 aa, Plasmodium falciparum
KRSVEKKEYHSSC

SEQ ID NO: 3325176 - protein, 7 aa, Plasmodium falciparum
KRSVSSF

SEQ ID NO: 3325177 - protein, 7 aa, Plasmodium falciparum
KRSVTTI

SEQ ID NO: 3325178 - protein, 16 aa, Plasmodium falciparum
KRSYHDSPMNDSPNTT

SEQ ID NO: 3325179 - protein, 16 aa, Plasmodium falciparum
KRSYNKKNYNKITYND

SEQ ID NO: 3325180 - protein, 5 aa, Plasmodium falciparum
KRTDI

SEQ ID NO: 3325181 - protein, 6 aa, Plasmodium falciparum
KRTFDS

SEQ ID NO: 3325182 - protein, 5 aa, Plasmodium falciparum
KRTIE

SEQ ID NO: 3325183 - protein, 7 aa, Plasmodium falciparum
KRTITPN

SEQ ID NO: 3325184 - protein, 24 aa, Plasmodium falciparum
KRTKKKKKKKKRKTKETKRKKRTL

SEQ ID NO: 3325185 - protein, 12 aa, Plasmodium falciparum
KRTLKGDGHDDV

SEQ ID NO: 3325186 - protein, 11 aa, Plasmodium falciparum
KRTLRKDKEQY

SEQ ID NO: 3325187 - protein, 9 aa, Plasmodium falciparum
KRTLSSREI

SEQ ID NO: 3325188 - protein, 29 aa, Plasmodium falciparum
KRTNKRGRKKKRKSNEEEEEEEKKKKNNM

SEQ ID NO: 3325189 - protein, 8 aa, Plasmodium falciparum
KRTPDGPL

SEQ ID NO: 3325190 - protein, 5 aa, Plasmodium falciparum
KRTPE

SEQ ID NO: 3325191 - protein, 17 aa, Plasmodium falciparum
KRTRRLQKKRRKMRQRS

SEQ ID NO: 3325192 - protein, 8 aa, Plasmodium falciparum
KRTSYNKM

SEQ ID NO: 3325193 - protein, 6 aa, Plasmodium falciparum
KRTTYE

SEQ ID NO: 3325194 - protein, 4 aa, Plasmodium falciparum
KRTY

SEQ ID NO: 3325195 - protein, 4 aa, Plasmodium falciparum
KRVE

SEQ ID NO: 3325196 - protein, 7 aa, Plasmodium falciparum
KRVEEGR

SEQ ID NO: 3325197 - protein, 7 aa, Plasmodium falciparum
KRVNTNT

SEQ ID NO: 3325198 - protein, 60 aa, Plasmodium falciparum
KRVQKGREKESEQKCDKEEKKKKRQKKEKKHKVKKKNEKNEKNEKNEKNEKNEKYKSENI

SEQ ID NO: 3325199 - protein, 12 aa, Plasmodium falciparum
KRVSEGKNDSCS

SEQ ID NO: 3325200 - protein, 14 aa, Plasmodium falciparum
KRVSKDGGPDMGRK

SEQ ID NO: 3325201 - protein, 8 aa, Plasmodium falciparum
KRVSSKNN

SEQ ID NO: 3325202 - protein, 5 aa, Plasmodium falciparum
KRVTK

SEQ ID NO: 3325203 - protein, 13 aa, Plasmodium falciparum
KRYENEKEVKEDD

SEQ ID NO: 3325204 - protein, 8 aa, Plasmodium falciparum
KRYGHDYE

SEQ ID NO: 3325205 - protein, 12 aa, Plasmodium falciparum
KRYHPDDMDLSF

SEQ ID NO: 3325206 - protein, 4 aa, Plasmodium falciparum
KRYL

SEQ ID NO: 3325207 - protein, 7 aa, Plasmodium falciparum
KRYSEDG

SEQ ID NO: 3325208 - protein, 6 aa, Plasmodium falciparum
KRYSSF

SEQ ID NO: 3325209 - protein, 7 aa, Plasmodium falciparum
KRYTEKL

SEQ ID NO: 3325210 - protein, 12 aa, Plasmodium falciparum
KSAAKNDSMSNN

SEQ ID NO: 3325211 - protein, 7 aa, Plasmodium falciparum
KSADMAT

SEQ ID NO: 3325212 - protein, 8 aa, Plasmodium falciparum
KSAEDENI

SEQ ID NO: 3325213 - protein, 6 aa, Plasmodium falciparum
KSAEDY

SEQ ID NO: 3325214 - protein, 10 aa, Plasmodium falciparum
KSAEGSVASD

SEQ ID NO: 3325215 - protein, 6 aa, Plasmodium falciparum
KSAESF

SEQ ID NO: 3325216 - protein, 6 aa, Plasmodium falciparum
KSAGEA

SEQ ID NO: 3325217 - protein, 81 aa, Plasmodium falciparum
KSAGEKKKKIEEKDNPQEIKENGKINKAEKPTKKNKTEKKDKVTKKDKTSKKDKNNTTDRVKKSSSNIQNDNVNKKDDALT

SEQ ID NO: 3325218 - protein, 7 aa, Plasmodium falciparum
KSAGGCS

SEQ ID NO: 3325219 - protein, 6 aa, Plasmodium falciparum
KSAHPD

SEQ ID NO: 3325220 - protein, 10 aa, Plasmodium falciparum
KSAKKFSKQA

SEQ ID NO: 3325221 - protein, 32 aa, Plasmodium falciparum
KSANNDNNTSQSSKQNIQSSYESYNNNSINYE

SEQ ID NO: 3325222 - protein, 11 aa, Plasmodium falciparum
KSAQGSKEQDA

SEQ ID NO: 3325223 - protein, 9 aa, Plasmodium falciparum
KSAQQQYNN

SEQ ID NO: 3325224 - protein, 7 aa, Plasmodium falciparum
KSASANM

SEQ ID NO: 3325225 - protein, 16 aa, Plasmodium falciparum
KSASAYKGPSEYSEYN

SEQ ID NO: 3325226 - protein, 48 aa, Plasmodium falciparum
KSASDESTEEKSDEEEVEEDENDKDDVEEEEEDDVQEDEDEEEDDDER

SEQ ID NO: 3325227 - protein, 11 aa, Plasmodium falciparum
KSASHHNDDLE

SEQ ID NO: 3325228 - protein, 7 aa, Plasmodium falciparum
KSASNSV

SEQ ID NO: 3325229 - protein, 18 aa, Plasmodium falciparum
KSATYNNISKNEKENKKN

SEQ ID NO: 3325230 - protein, 4 aa, Plasmodium falciparum
KSAY

SEQ ID NO: 3325231 - protein, 7 aa, Plasmodium falciparum
KSAYQNH

SEQ ID NO: 3325232 - protein, 9 aa, Plasmodium falciparum
KSCNSGGKC

SEQ ID NO: 3325233 - protein, 5 aa, Plasmodium falciparum
KSCSN

SEQ ID NO: 3325234 - protein, 7 aa, Plasmodium falciparum
KSDAAYE

SEQ ID NO: 3325235 - protein, 7 aa, Plasmodium falciparum
KSDADKL

SEQ ID NO: 3325236 - protein, 9 aa, Plasmodium falciparum
KSDAHNNEE

SEQ ID NO: 3325237 - protein, 15 aa, Plasmodium falciparum
KSDAKGTGKKSCSHK

SEQ ID NO: 3325238 - protein, 5 aa, Plasmodium falciparum
KSDCS

SEQ ID NO: 3325239 - protein, 5 aa, Plasmodium falciparum
KSDCT

SEQ ID NO: 3325240 - protein, 15 aa, Plasmodium falciparum
KSDDDLENEDHDENV

SEQ ID NO: 3325241 - protein, 7 aa, Plasmodium falciparum
KSDDGTS

SEQ ID NO: 3325242 - protein, 10 aa, Plasmodium falciparum
KSDDHKMSDQ

SEQ ID NO: 3325243 - protein, 16 aa, Plasmodium falciparum
KSDDIMSDDSGNNVDD

SEQ ID NO: 3325244 - protein, 8 aa, Plasmodium falciparum
KSDDISPQ

SEQ ID NO: 3325245 - protein, 11 aa, Plasmodium falciparum
KSDDMKREKIK

SEQ ID NO: 3325246 - protein, 41 aa, Plasmodium falciparum
KSDDSVNKSNDCDNKNDDGVNKNDHCDNKNDHCDNKNDHCD

SEQ ID NO: 3325247 - protein, 5 aa, Plasmodium falciparum
KSDDV

SEQ ID NO: 3325248 - protein, 10 aa, Plasmodium falciparum
KSDEEESNVT

SEQ ID NO: 3325249 - protein, 7 aa, Plasmodium falciparum
KSDEEKS

SEQ ID NO: 3325250 - protein, 15 aa, Plasmodium falciparum
KSDEENKSDDMNNDN

SEQ ID NO: 3325251 - protein, 50 aa, Plasmodium falciparum
KSDEKKKSEKGKKKKKTQKSKKSDDTNEGKNKIDEQKKGKELKENKDNMK

SEQ ID NO: 3325252 - protein, 13 aa, Plasmodium falciparum
KSDEKQSNMNNVQ

SEQ ID NO: 3325253 - protein, 22 aa, Plasmodium falciparum
KSDEQNNSDNNKKVGVEKKKKK

SEQ ID NO: 3325254 - protein, 15 aa, Plasmodium falciparum
KSDETVKSDETVKND

SEQ ID NO: 3325255 - protein, 5 aa, Plasmodium falciparum
KSDGF

SEQ ID NO: 3325256 - protein, 5 aa, Plasmodium falciparum
KSDGK

SEQ ID NO: 3325257 - protein, 5 aa, Plasmodium falciparum
KSDGS

SEQ ID NO: 3325258 - protein, 7 aa, Plasmodium falciparum
KSDGSDI

SEQ ID NO: 3325259 - protein, 7 aa, Plasmodium falciparum
KSDGSQF

SEQ ID NO: 3325260 - protein, 7 aa, Plasmodium falciparum
KSDHEYE

SEQ ID NO: 3325261 - protein, 6 aa, Plasmodium falciparum
KSDHKR

SEQ ID NO: 3325262 - protein, 4 aa, Plasmodium falciparum
KSDI

SEQ ID NO: 3325263 - protein, 5 aa, Plasmodium falciparum
KSDIG

SEQ ID NO: 3325264 - protein, 12 aa, Plasmodium falciparum
KSDIHAKRDGTF

SEQ ID NO: 3325265 - protein, 5 aa, Plasmodium falciparum
KSDKC

SEQ ID NO: 3325266 - protein, 6 aa, Plasmodium falciparum
KSDKGI

SEQ ID NO: 3325267 - protein, 8 aa, Plasmodium falciparum
KSDKINDY

SEQ ID NO: 3325268 - protein, 9 aa, Plasmodium falciparum
KSDKINDYD

SEQ ID NO: 3325269 - protein, 25 aa, Plasmodium falciparum
KSDKKYEKENGNVNKLNDEKKEKLE

SEQ ID NO: 3325270 - protein, 8 aa, Plasmodium falciparum
KSDKSYHG

SEQ ID NO: 3325271 - protein, 7 aa, Plasmodium falciparum
KSDLADE

SEQ ID NO: 3325272 - protein, 6 aa, Plasmodium falciparum
KSDLGN

SEQ ID NO: 3325273 - protein, 25 aa, Plasmodium falciparum
KSDLTDFSKSSSFDKSKGDANLNEK

SEQ ID NO: 3325274 - protein, 4 aa, Plasmodium falciparum
KSDM

SEQ ID NO: 3325275 - protein, 5 aa, Plasmodium falciparum
KSDND

SEQ ID NO: 3325276 - protein, 41 aa, Plasmodium falciparum
KSDNNNDDDDDNNNDDDNNDDDNNNDDNNNEDNNNNDDNNM

SEQ ID NO: 3325277 - protein, 14 aa, Plasmodium falciparum
KSDNNNNNNNNNNI

SEQ ID NO: 3325278 - protein, 5 aa, Plasmodium falciparum
KSDNQ

SEQ ID NO: 3325279 - protein, 5 aa, Plasmodium falciparum
KSDNV

SEQ ID NO: 3325280 - protein, 7 aa, Plasmodium falciparum
KSDNVDN

SEQ ID NO: 3325281 - protein, 8 aa, Plasmodium falciparum
KSDQGKEE

SEQ ID NO: 3325282 - protein, 6 aa, Plasmodium falciparum
KSDRDK

SEQ ID NO: 3325283 - protein, 7 aa, Plasmodium falciparum
KSDRKSK

SEQ ID NO: 3325284 - protein, 6 aa, Plasmodium falciparum
KSDSKK

SEQ ID NO: 3325285 - protein, 8 aa, Plasmodium falciparum
KSDSNQNL

SEQ ID NO: 3325286 - protein, 9 aa, Plasmodium falciparum
KSDSQKVST

SEQ ID NO: 3325287 - protein, 6 aa, Plasmodium falciparum
KSDSQY

SEQ ID NO: 3325288 - protein, 6 aa, Plasmodium falciparum
KSDTEF

SEQ ID NO: 3325289 - protein, 7 aa, Plasmodium falciparum
KSDTYSN

SEQ ID NO: 3325290 - protein, 9 aa, Plasmodium falciparum
KSDVNVTTN

SEQ ID NO: 3325291 - protein, 6 aa, Plasmodium falciparum
KSDYEN

SEQ ID NO: 3325292 - protein, 5 aa, Plasmodium falciparum
KSDYN

SEQ ID NO: 3325293 - protein, 19 aa, Plasmodium falciparum
KSDYSREDKNDLSSSVKSL

SEQ ID NO: 3325294 - protein, 10 aa, Plasmodium falciparum
KSDYTEDKNY

SEQ ID NO: 3325295 - protein, 10 aa, Plasmodium falciparum
KSEDKEEKQN

SEQ ID NO: 3325296 - protein, 112 aa, Plasmodium falciparum
KSEDKNEHIREGGNEQKREDKYDRKREDKYDRKREDNYDRKRDDNYDRKRDDKHDRKKDDKYDRKRDNNYDRKRDNNYDRKKDDKYDRKRDDNYDHKKDDKYDYKKDDKYEH

SEQ ID NO: 3325297 - protein, 6 aa, Plasmodium falciparum
KSEDNS

SEQ ID NO: 3325298 - protein, 9 aa, Plasmodium falciparum
KSEDTLDNK

SEQ ID NO: 3325299 - protein, 6 aa, Plasmodium falciparum
KSEDTR

SEQ ID NO: 3325300 - protein, 4 aa, Plasmodium falciparum
KSEE

SEQ ID NO: 3325301 - protein, 5 aa, Plasmodium falciparum
KSEEE

SEQ ID NO: 3325302 - protein, 12 aa, Plasmodium falciparum
KSEEENDEENID

SEQ ID NO: 3325303 - protein, 8 aa, Plasmodium falciparum
KSEEEQNF

SEQ ID NO: 3325304 - protein, 5 aa, Plasmodium falciparum
KSEEL

SEQ ID NO: 3325305 - protein, 9 aa, Plasmodium falciparum
KSEENDKAI

SEQ ID NO: 3325306 - protein, 6 aa, Plasmodium falciparum
KSEENL

SEQ ID NO: 3325307 - protein, 7 aa, Plasmodium falciparum
KSEENLQ

SEQ ID NO: 3325308 - protein, 16 aa, Plasmodium falciparum
KSEEYEESSVKGDTKD

SEQ ID NO: 3325309 - protein, 7 aa, Plasmodium falciparum
KSEEYKG

SEQ ID NO: 3325310 - protein, 5 aa, Plasmodium falciparum
KSEFD

SEQ ID NO: 3325311 - protein, 15 aa, Plasmodium falciparum
KSEGEKFGGANFTST

SEQ ID NO: 3325312 - protein, 15 aa, Plasmodium falciparum
KSEGEVKANGKYLQK

SEQ ID NO: 3325313 - protein, 7 aa, Plasmodium falciparum
KSEGNYK

SEQ ID NO: 3325314 - protein, 13 aa, Plasmodium falciparum
KSEHVHKNTQEMN

SEQ ID NO: 3325315 - protein, 7 aa, Plasmodium falciparum
KSEIQPN

SEQ ID NO: 3325316 - protein, 5 aa, Plasmodium falciparum
KSEIR

SEQ ID NO: 3325317 - protein, 4 aa, Plasmodium falciparum
KSEK

SEQ ID NO: 3325318 - protein, 6 aa, Plasmodium falciparum
KSEKCD

SEQ ID NO: 3325319 - protein, 7 aa, Plasmodium falciparum
KSEKEKI

SEQ ID NO: 3325320 - protein, 6 aa, Plasmodium falciparum
KSEKEL

SEQ ID NO: 3325321 - protein, 7 aa, Plasmodium falciparum
KSEKERN

SEQ ID NO: 3325322 - protein, 6 aa, Plasmodium falciparum
KSEKGV

SEQ ID NO: 3325323 - protein, 8 aa, Plasmodium falciparum
KSEKKKPY

SEQ ID NO: 3325324 - protein, 10 aa, Plasmodium falciparum
KSEKNKSKCS

SEQ ID NO: 3325325 - protein, 7 aa, Plasmodium falciparum
KSEKVYD

SEQ ID NO: 3325326 - protein, 8 aa, Plasmodium falciparum
KSEKYKNN

SEQ ID NO: 3325327 - protein, 4 aa, Plasmodium falciparum
KSEL

SEQ ID NO: 3325328 - protein, 6 aa, Plasmodium falciparum
KSELSN

SEQ ID NO: 3325329 - protein, 4 aa, Plasmodium falciparum
KSEM

SEQ ID NO: 3325330 - protein, 15 aa, Plasmodium falciparum
KSEMTKKRKDNNNMY

SEQ ID NO: 3325331 - protein, 7 aa, Plasmodium falciparum
KSENDPY

SEQ ID NO: 3325332 - protein, 7 aa, Plasmodium falciparum
KSENESE

SEQ ID NO: 3325333 - protein, 7 aa, Plasmodium falciparum
KSENKNR

SEQ ID NO: 3325334 - protein, 10 aa, Plasmodium falciparum
KSENNKMDEE

SEQ ID NO: 3325335 - protein, 6 aa, Plasmodium falciparum
KSEPFV

SEQ ID NO: 3325336 - protein, 7 aa, Plasmodium falciparum
KSEPIGK

SEQ ID NO: 3325337 - protein, 6 aa, Plasmodium falciparum
KSEQED

SEQ ID NO: 3325338 - protein, 6 aa, Plasmodium falciparum
KSEQEL

SEQ ID NO: 3325339 - protein, 10 aa, Plasmodium falciparum
KSEQNQKTAL

SEQ ID NO: 3325340 - protein, 5 aa, Plasmodium falciparum
KSEQY

SEQ ID NO: 3325341 - protein, 9 aa, Plasmodium falciparum
KSERQTQHG

SEQ ID NO: 3325342 - protein, 27 aa, Plasmodium falciparum
KSERSNKKENEEENNSDDDDDNDSYNS

SEQ ID NO: 3325343 - protein, 6 aa, Plasmodium falciparum
KSESEI

SEQ ID NO: 3325344 - protein, 12 aa, Plasmodium falciparum
KSETGESKEEID

SEQ ID NO: 3325345 - protein, 59 aa, Plasmodium falciparum
KSETKTDLQIKGNDKKVVKGSKCDNKNDQNVNNDNINNDNINNDKINNDNINNDNINNN

SEQ ID NO: 3325346 - protein, 6 aa, Plasmodium falciparum
KSETQI

SEQ ID NO: 3325347 - protein, 7 aa, Plasmodium falciparum
KSETYAE

SEQ ID NO: 3325348 - protein, 6 aa, Plasmodium falciparum
KSEVET

SEQ ID NO: 3325349 - protein, 13 aa, Plasmodium falciparum
KSEVETDGSNAFG

SEQ ID NO: 3325350 - protein, 7 aa, Plasmodium falciparum
KSEYDKS

SEQ ID NO: 3325351 - protein, 6 aa, Plasmodium falciparum
KSEYDS

SEQ ID NO: 3325352 - protein, 8 aa, Plasmodium falciparum
KSEYTTSI

SEQ ID NO: 3325353 - protein, 12 aa, Plasmodium falciparum
KSFEDNDEEEQI

SEQ ID NO: 3325354 - protein, 6 aa, Plasmodium falciparum
KSFFSQ

SEQ ID NO: 3325355 - protein, 12 aa, Plasmodium falciparum
KSFKTNKTLPNR

SEQ ID NO: 3325356 - protein, 8 aa, Plasmodium falciparum
KSFNEQEN

SEQ ID NO: 3325357 - protein, 12 aa, Plasmodium falciparum
KSFNGKSAEFNK

SEQ ID NO: 3325358 - protein, 7 aa, Plasmodium falciparum
KSFPSKS

SEQ ID NO: 3325359 - protein, 7 aa, Plasmodium falciparum
KSFRSST

SEQ ID NO: 3325360 - protein, 5 aa, Plasmodium falciparum
KSFSG

SEQ ID NO: 3325361 - protein, 20 aa, Plasmodium falciparum
KSGDAKDSKDATNQEQNGVA

SEQ ID NO: 3325362 - protein, 7 aa, Plasmodium falciparum
KSGDYKN

SEQ ID NO: 3325363 - protein, 25 aa, Plasmodium falciparum
KSGEEKREKEDAAAGVPRSQNTSTI

SEQ ID NO: 3325364 - protein, 16 aa, Plasmodium falciparum
KSGEHHNKGTKANKVK

SEQ ID NO: 3325365 - protein, 6 aa, Plasmodium falciparum
KSGELT

SEQ ID NO: 3325366 - protein, 9 aa, Plasmodium falciparum
KSGEPSSYQ

SEQ ID NO: 3325367 - protein, 5 aa, Plasmodium falciparum
KSGGC

SEQ ID NO: 3325368 - protein, 7 aa, Plasmodium falciparum
KSGGIKE

SEQ ID NO: 3325369 - protein, 5 aa, Plasmodium falciparum
KSGIP

SEQ ID NO: 3325370 - protein, 8 aa, Plasmodium falciparum
KSGKDITK

SEQ ID NO: 3325371 - protein, 27 aa, Plasmodium falciparum
KSGKGGNPNYKKQRSKKLKGEGYGGHG

SEQ ID NO: 3325372 - protein, 21 aa, Plasmodium falciparum
KSGKKKKNNNNNNNNNNKEID

SEQ ID NO: 3325373 - protein, 11 aa, Plasmodium falciparum
KSGKNKNLGGG

SEQ ID NO: 3325374 - protein, 7 aa, Plasmodium falciparum
KSGKRNN

SEQ ID NO: 3325375 - protein, 6 aa, Plasmodium falciparum
KSGKYV

SEQ ID NO: 3325376 - protein, 6 aa, Plasmodium falciparum
KSGMGK

SEQ ID NO: 3325377 - protein, 13 aa, Plasmodium falciparum
KSGMHQKSKNSNL

SEQ ID NO: 3325378 - protein, 9 aa, Plasmodium falciparum
KSGNEEDTH

SEQ ID NO: 3325379 - protein, 6 aa, Plasmodium falciparum
KSGNFN

SEQ ID NO: 3325380 - protein, 23 aa, Plasmodium falciparum
KSGNGKNGKNEKNEKEKKHEDTK

SEQ ID NO: 3325381 - protein, 8 aa, Plasmodium falciparum
KSGNINST

SEQ ID NO: 3325382 - protein, 6 aa, Plasmodium falciparum
KSGNIR

SEQ ID NO: 3325383 - protein, 9 aa, Plasmodium falciparum
KSGNLKKKK

SEQ ID NO: 3325384 - protein, 5 aa, Plasmodium falciparum
KSGNP

SEQ ID NO: 3325385 - protein, 6 aa, Plasmodium falciparum
KSGNSI

SEQ ID NO: 3325386 - protein, 8 aa, Plasmodium falciparum
KSGNYDKN

SEQ ID NO: 3325387 - protein, 19 aa, Plasmodium falciparum
KSGNYLPPPPTPENEGNSC

SEQ ID NO: 3325388 - protein, 4 aa, Plasmodium falciparum
KSGP

SEQ ID NO: 3325389 - protein, 8 aa, Plasmodium falciparum
KSGPNNKQ

SEQ ID NO: 3325390 - protein, 6 aa, Plasmodium falciparum
KSGQKN

SEQ ID NO: 3325391 - protein, 5 aa, Plasmodium falciparum
KSGQR

SEQ ID NO: 3325392 - protein, 7 aa, Plasmodium falciparum
KSGSATV

SEQ ID NO: 3325393 - protein, 9 aa, Plasmodium falciparum
KSGSFKKPY

SEQ ID NO: 3325394 - protein, 7 aa, Plasmodium falciparum
KSGSISN

SEQ ID NO: 3325395 - protein, 9 aa, Plasmodium falciparum
KSGSNDPMD

SEQ ID NO: 3325396 - protein, 9 aa, Plasmodium falciparum
KSGSNLNIK

SEQ ID NO: 3325397 - protein, 6 aa, Plasmodium falciparum
KSGTFV

SEQ ID NO: 3325398 - protein, 7 aa, Plasmodium falciparum
KSGTLDD

SEQ ID NO: 3325399 - protein, 42 aa, Plasmodium falciparum
KSGTNKIKRKNTSNKINENNKNEEPINNNKKKNKKNKKHNNI

SEQ ID NO: 3325400 - protein, 5 aa, Plasmodium falciparum
KSGTV

SEQ ID NO: 3325401 - protein, 5 aa, Plasmodium falciparum
KSGVS

SEQ ID NO: 3325402 - protein, 5 aa, Plasmodium falciparum
KSGYS

SEQ ID NO: 3325403 - protein, 6 aa, Plasmodium falciparum
KSHAVN

SEQ ID NO: 3325404 - protein, 6 aa, Plasmodium falciparum
KSHEEM

SEQ ID NO: 3325405 - protein, 9 aa, Plasmodium falciparum
KSHGNEKIE

SEQ ID NO: 3325406 - protein, 6 aa, Plasmodium falciparum
KSHIEK

SEQ ID NO: 3325407 - protein, 8 aa, Plasmodium falciparum
KSHKKGFK

SEQ ID NO: 3325408 - protein, 18 aa, Plasmodium falciparum
KSHKNHNNNNDNNNYNNN

SEQ ID NO: 3325409 - protein, 18 aa, Plasmodium falciparum
KSHNRSILPPSRDTFRDG

SEQ ID NO: 3325410 - protein, 10 aa, Plasmodium falciparum
KSHNSTPPGV

SEQ ID NO: 3325411 - protein, 5 aa, Plasmodium falciparum
KSHPF

SEQ ID NO: 3325412 - protein, 9 aa, Plasmodium falciparum
KSHSNLQRG

SEQ ID NO: 3325413 - protein, 7 aa, Plasmodium falciparum
KSHTQRM

SEQ ID NO: 3325414 - protein, 14 aa, Plasmodium falciparum
KSIDDVSDEYGNRD

SEQ ID NO: 3325415 - protein, 6 aa, Plasmodium falciparum
KSIDEE

SEQ ID NO: 3325416 - protein, 6 aa, Plasmodium falciparum
KSIDTD

SEQ ID NO: 3325417 - protein, 6 aa, Plasmodium falciparum
KSIEEN

SEQ ID NO: 3325418 - protein, 13 aa, Plasmodium falciparum
KSIEENNGYNSDS

SEQ ID NO: 3325419 - protein, 6 aa, Plasmodium falciparum
KSIEEV

SEQ ID NO: 3325420 - protein, 6 aa, Plasmodium falciparum
KSIEKI

SEQ ID NO: 3325421 - protein, 15 aa, Plasmodium falciparum
KSIHNNKPNVSTNNN

SEQ ID NO: 3325422 - protein, 13 aa, Plasmodium falciparum
KSIKGYDKQKEHL

SEQ ID NO: 3325423 - protein, 10 aa, Plasmodium falciparum
KSIKKTEDYI

SEQ ID NO: 3325424 - protein, 7 aa, Plasmodium falciparum
KSIKNYN

SEQ ID NO: 3325425 - protein, 10 aa, Plasmodium falciparum
KSIKPSNIEK

SEQ ID NO: 3325426 - protein, 5 aa, Plasmodium falciparum
KSIKS

SEQ ID NO: 3325427 - protein, 10 aa, Plasmodium falciparum
KSIKSGNESL

SEQ ID NO: 3325428 - protein, 4 aa, Plasmodium falciparum
KSIM

SEQ ID NO: 3325429 - protein, 14 aa, Plasmodium falciparum
KSINKNSKNKKKTL

SEQ ID NO: 3325430 - protein, 26 aa, Plasmodium falciparum
KSINNKYNNNNNNNNNNNNNLESENH

SEQ ID NO: 3325431 - protein, 5 aa, Plasmodium falciparum
KSINS

SEQ ID NO: 3325432 - protein, 5 aa, Plasmodium falciparum
KSINY

SEQ ID NO: 3325433 - protein, 4 aa, Plasmodium falciparum
KSIP

SEQ ID NO: 3325434 - protein, 8 aa, Plasmodium falciparum
KSIPGTKL

SEQ ID NO: 3325435 - protein, 6 aa, Plasmodium falciparum
KSIPNY

SEQ ID NO: 3325436 - protein, 13 aa, Plasmodium falciparum
KSIQDNKNKTKYI

SEQ ID NO: 3325437 - protein, 5 aa, Plasmodium falciparum
KSIQQ

SEQ ID NO: 3325438 - protein, 8 aa, Plasmodium falciparum
KSIQTTTN

SEQ ID NO: 3325439 - protein, 12 aa, Plasmodium falciparum
KSISNKNPGNSY

SEQ ID NO: 3325440 - protein, 14 aa, Plasmodium falciparum
KSISQKKENNIQSV

SEQ ID NO: 3325441 - protein, 4 aa, Plasmodium falciparum
KSIT

SEQ ID NO: 3325442 - protein, 8 aa, Plasmodium falciparum
KSITGKDI

SEQ ID NO: 3325443 - protein, 6 aa, Plasmodium falciparum
KSITHD

SEQ ID NO: 3325444 - protein, 6 aa, Plasmodium falciparum
KSITKT

SEQ ID NO: 3325445 - protein, 8 aa, Plasmodium falciparum
KSIYNNSN

SEQ ID NO: 3325446 - protein, 6 aa, Plasmodium falciparum
KSIYSR

SEQ ID NO: 3325447 - protein, 6 aa, Plasmodium falciparum
KSKDDA

SEQ ID NO: 3325448 - protein, 70 aa, Plasmodium falciparum
KSKDEKKKADDKTEDKGEKKDAKDQEQNDDKDQTNDNNMNEKDTNDKKEKNNETNSPNKTELKKGEEGKV

SEQ ID NO: 3325449 - protein, 7 aa, Plasmodium falciparum
KSKDELY

SEQ ID NO: 3325450 - protein, 16 aa, Plasmodium falciparum
KSKDEVDANNNSVNKG

SEQ ID NO: 3325451 - protein, 11 aa, Plasmodium falciparum
KSKDKLDNDNL

SEQ ID NO: 3325452 - protein, 7 aa, Plasmodium falciparum
KSKDKVY

SEQ ID NO: 3325453 - protein, 9 aa, Plasmodium falciparum
KSKDNNNKL

SEQ ID NO: 3325454 - protein, 10 aa, Plasmodium falciparum
KSKEETDENC

SEQ ID NO: 3325455 - protein, 13 aa, Plasmodium falciparum
KSKEETNKTNEQV

SEQ ID NO: 3325456 - protein, 12 aa, Plasmodium falciparum
KSKEGNEEKNNM

SEQ ID NO: 3325457 - protein, 5 aa, Plasmodium falciparum
KSKEH

SEQ ID NO: 3325458 - protein, 9 aa, Plasmodium falciparum
KSKEKEKVH

SEQ ID NO: 3325459 - protein, 29 aa, Plasmodium falciparum
KSKEKIKDKENQINVEKNEEKDLKKKDDE

SEQ ID NO: 3325460 - protein, 8 aa, Plasmodium falciparum
KSKEKSQH

SEQ ID NO: 3325461 - protein, 9 aa, Plasmodium falciparum
KSKELDKKQ

SEQ ID NO: 3325462 - protein, 8 aa, Plasmodium falciparum
KSKELESV

SEQ ID NO: 3325463 - protein, 14 aa, Plasmodium falciparum
KSKENENGTCMPPR

SEQ ID NO: 3325464 - protein, 8 aa, Plasmodium falciparum
KSKENNEI

SEQ ID NO: 3325465 - protein, 7 aa, Plasmodium falciparum
KSKEQKY

SEQ ID NO: 3325466 - protein, 8 aa, Plasmodium falciparum
KSKESKLI

SEQ ID NO: 3325467 - protein, 9 aa, Plasmodium falciparum
KSKESLDNK

SEQ ID NO: 3325468 - protein, 13 aa, Plasmodium falciparum
KSKETKNNSWKDK

SEQ ID NO: 3325469 - protein, 10 aa, Plasmodium falciparum
KSKETLDNED

SEQ ID NO: 3325470 - protein, 6 aa, Plasmodium falciparum
KSKEYD

SEQ ID NO: 3325471 - protein, 6 aa, Plasmodium falciparum
KSKEYI

SEQ ID NO: 3325472 - protein, 8 aa, Plasmodium falciparum
KSKGAKRI

SEQ ID NO: 3325473 - protein, 7 aa, Plasmodium falciparum
KSKGEEK

SEQ ID NO: 3325474 - protein, 8 aa, Plasmodium falciparum
KSKGEPIE

SEQ ID NO: 3325475 - protein, 14 aa, Plasmodium falciparum
KSKGHEKKEVYTSN

SEQ ID NO: 3325476 - protein, 9 aa, Plasmodium falciparum
KSKGKNELD

SEQ ID NO: 3325477 - protein, 14 aa, Plasmodium falciparum
KSKGKNTNNEKDDD

SEQ ID NO: 3325478 - protein, 36 aa, Plasmodium falciparum
KSKGNADTHNNLTNKKSPLENEEDEMQEEYDEDNDD

SEQ ID NO: 3325479 - protein, 6 aa, Plasmodium falciparum
KSKGNP

SEQ ID NO: 3325480 - protein, 4 aa, Plasmodium falciparum
KSKH

SEQ ID NO: 3325481 - protein, 39 aa, Plasmodium falciparum
KSKHEENSPDGDSYKINNNEKEKSKEKLKKDQKKKSKEI

SEQ ID NO: 3325482 - protein, 5 aa, Plasmodium falciparum
KSKHF

SEQ ID NO: 3325483 - protein, 5 aa, Plasmodium falciparum
KSKHL

SEQ ID NO: 3325484 - protein, 5 aa, Plasmodium falciparum
KSKHT

SEQ ID NO: 3325485 - protein, 12 aa, Plasmodium falciparum
KSKIDKIKTNFS

SEQ ID NO: 3325486 - protein, 22 aa, Plasmodium falciparum
KSKIKSAKNDSNTSSGTSITEV

SEQ ID NO: 3325487 - protein, 9 aa, Plasmodium falciparum
KSKISYNDN

SEQ ID NO: 3325488 - protein, 13 aa, Plasmodium falciparum
KSKKGEKNKNEEE

SEQ ID NO: 3325489 - protein, 13 aa, Plasmodium falciparum
KSKKKKGKSILDI

SEQ ID NO: 3325490 - protein, 14 aa, Plasmodium falciparum
KSKKKKKNNTITTN

SEQ ID NO: 3325491 - protein, 19 aa, Plasmodium falciparum
KSKKKNKKIYTDEKDTLHN

SEQ ID NO: 3325492 - protein, 7 aa, Plasmodium falciparum
KSKKNKE

SEQ ID NO: 3325493 - protein, 40 aa, Plasmodium falciparum
KSKKNNNNNNNNISSSSRNNSNNLNSKNEILGSQNSTNSV

SEQ ID NO: 3325494 - protein, 8 aa, Plasmodium falciparum
KSKKPFDE

SEQ ID NO: 3325495 - protein, 7 aa, Plasmodium falciparum
KSKKRLN

SEQ ID NO: 3325496 - protein, 31 aa, Plasmodium falciparum
KSKKSKKPAEKNNKKNSFTPNNLNKKGSRNI

SEQ ID NO: 3325497 - protein, 14 aa, Plasmodium falciparum
KSKKVKQNNDQDNH

SEQ ID NO: 3325498 - protein, 7 aa, Plasmodium falciparum
KSKKYKA

SEQ ID NO: 3325499 - protein, 4 aa, Plasmodium falciparum
KSKL

SEQ ID NO: 3325500 - protein, 15 aa, Plasmodium falciparum
KSKLENSNDNPEEKY

SEQ ID NO: 3325501 - protein, 9 aa, Plasmodium falciparum
KSKLPERKT

SEQ ID NO: 3325502 - protein, 7 aa, Plasmodium falciparum
KSKNDEL

SEQ ID NO: 3325503 - protein, 5 aa, Plasmodium falciparum
KSKNE

SEQ ID NO: 3325504 - protein, 10 aa, Plasmodium falciparum
KSKNEDINNY

SEQ ID NO: 3325505 - protein, 17 aa, Plasmodium falciparum
KSKNEYNTINDNNNNNN

SEQ ID NO: 3325506 - protein, 5 aa, Plasmodium falciparum
KSKNF

SEQ ID NO: 3325507 - protein, 9 aa, Plasmodium falciparum
KSKNKEKYY

SEQ ID NO: 3325508 - protein, 47 aa, Plasmodium falciparum
KSKNKKNDNSNNIEDKTNTPNKTNTQNKSNTQNKSNTPNKINADISK

SEQ ID NO: 3325509 - protein, 7 aa, Plasmodium falciparum
KSKNRKN

SEQ ID NO: 3325510 - protein, 4 aa, Plasmodium falciparum
KSKP

SEQ ID NO: 3325511 - protein, 9 aa, Plasmodium falciparum
KSKQENDNF

SEQ ID NO: 3325512 - protein, 10 aa, Plasmodium falciparum
KSKQNGEKKN

SEQ ID NO: 3325513 - protein, 7 aa, Plasmodium falciparum
KSKQNKE

SEQ ID NO: 3325514 - protein, 12 aa, Plasmodium falciparum
KSKQTKKNEHNN

SEQ ID NO: 3325515 - protein, 7 aa, Plasmodium falciparum
KSKQYSH

SEQ ID NO: 3325516 - protein, 4 aa, Plasmodium falciparum
KSKR

SEQ ID NO: 3325517 - protein, 6 aa, Plasmodium falciparum
KSKRDN

SEQ ID NO: 3325518 - protein, 28 aa, Plasmodium falciparum
KSKRGDIGKNKYNNNNKNNNSSNNNNNN

SEQ ID NO: 3325519 - protein, 8 aa, Plasmodium falciparum
KSKRNTHS

SEQ ID NO: 3325520 - protein, 8 aa, Plasmodium falciparum
KSKSDSYK

SEQ ID NO: 3325521 - protein, 7 aa, Plasmodium falciparum
KSKSEVS

SEQ ID NO: 3325522 - protein, 10 aa, Plasmodium falciparum
KSKSGSTKKI

SEQ ID NO: 3325523 - protein, 9 aa, Plasmodium falciparum
KSKSLQDDM

SEQ ID NO: 3325524 - protein, 8 aa, Plasmodium falciparum
KSKSNYQD

SEQ ID NO: 3325525 - protein, 9 aa, Plasmodium falciparum
KSKTKKNTV

SEQ ID NO: 3325526 - protein, 8 aa, Plasmodium falciparum
KSKTKSSD

SEQ ID NO: 3325527 - protein, 28 aa, Plasmodium falciparum
KSKTNENVKTPKMTKRNSDNTTGRGDQK

SEQ ID NO: 3325528 - protein, 7 aa, Plasmodium falciparum
KSKTNKN

SEQ ID NO: 3325529 - protein, 35 aa, Plasmodium falciparum
KSKTNKSSSSSSYSYKHKNKKNEKNKKRKSYPSIS

SEQ ID NO: 3325530 - protein, 54 aa, Plasmodium falciparum
KSKVNKDNKENKENKENRDNDKKNKNNNNKKNYNNSKKKKNANNKGTNKNHEQE

SEQ ID NO: 3325531 - protein, 14 aa, Plasmodium falciparum
KSKVYDKNNPYDDK

SEQ ID NO: 3325532 - protein, 14 aa, Plasmodium falciparum
KSKYEDKNKCNNNI

SEQ ID NO: 3325533 - protein, 12 aa, Plasmodium falciparum
KSKYYNQKSSLN

SEQ ID NO: 3325534 - protein, 5 aa, Plasmodium falciparum
KSLAK

SEQ ID NO: 3325535 - protein, 7 aa, Plasmodium falciparum
KSLDGGD

SEQ ID NO: 3325536 - protein, 5 aa, Plasmodium falciparum
KSLDN

SEQ ID NO: 3325537 - protein, 7 aa, Plasmodium falciparum
KSLDTTY

SEQ ID NO: 3325538 - protein, 8 aa, Plasmodium falciparum
KSLGNPTF

SEQ ID NO: 3325539 - protein, 12 aa, Plasmodium falciparum
KSLKEQNEEELK

SEQ ID NO: 3325540 - protein, 14 aa, Plasmodium falciparum
KSLKKKKNDEHNIN

SEQ ID NO: 3325541 - protein, 13 aa, Plasmodium falciparum
KSLKNKKENLTNT

SEQ ID NO: 3325542 - protein, 14 aa, Plasmodium falciparum
KSLNEDHKNSEQLD

SEQ ID NO: 3325543 - protein, 5 aa, Plasmodium falciparum
KSLNI

SEQ ID NO: 3325544 - protein, 14 aa, Plasmodium falciparum
KSLNKNKGNIDEKK

SEQ ID NO: 3325545 - protein, 6 aa, Plasmodium falciparum
KSLNNI

SEQ ID NO: 3325546 - protein, 15 aa, Plasmodium falciparum
KSLNNSLDKKNVQQS

SEQ ID NO: 3325547 - protein, 10 aa, Plasmodium falciparum
KSLNPSSKFE

SEQ ID NO: 3325548 - protein, 23 aa, Plasmodium falciparum
KSLPFEGETNYRSEFGPKPLPEL

SEQ ID NO: 3325549 - protein, 24 aa, Plasmodium falciparum
KSLPFEGETNYRSEFGPKPLPELP

SEQ ID NO: 3325550 - protein, 7 aa, Plasmodium falciparum
KSLPPQL

SEQ ID NO: 3325551 - protein, 4 aa, Plasmodium falciparum
KSLQ

SEQ ID NO: 3325552 - protein, 5 aa, Plasmodium falciparum
KSLQT

SEQ ID NO: 3325553 - protein, 6 aa, Plasmodium falciparum
KSLRGK

SEQ ID NO: 3325554 - protein, 22 aa, Plasmodium falciparum
KSLSNSKKNIKGMEENKNKNSS

SEQ ID NO: 3325555 - protein, 6 aa, Plasmodium falciparum
KSLTEK

SEQ ID NO: 3325556 - protein, 10 aa, Plasmodium falciparum
KSLTGSSYSE

SEQ ID NO: 3325557 - protein, 6 aa, Plasmodium falciparum
KSLTKE

SEQ ID NO: 3325558 - protein, 8 aa, Plasmodium falciparum
KSLTNEKQ

SEQ ID NO: 3325559 - protein, 12 aa, Plasmodium falciparum
KSMKEKKPATAK

SEQ ID NO: 3325560 - protein, 17 aa, Plasmodium falciparum
KSMLENRKRKTEKKEEN

SEQ ID NO: 3325561 - protein, 4 aa, Plasmodium falciparum
KSMN

SEQ ID NO: 3325562 - protein, 11 aa, Plasmodium falciparum
KSMNSDDKIDQ

SEQ ID NO: 3325563 - protein, 5 aa, Plasmodium falciparum
KSMQE

SEQ ID NO: 3325564 - protein, 6 aa, Plasmodium falciparum
KSMSHN

SEQ ID NO: 3325565 - protein, 21 aa, Plasmodium falciparum
KSMSNRNNMPASLDDTPSEYK

SEQ ID NO: 3325566 - protein, 5 aa, Plasmodium falciparum
KSMTK

SEQ ID NO: 3325567 - protein, 7 aa, Plasmodium falciparum
KSNAEKK

SEQ ID NO: 3325568 - protein, 6 aa, Plasmodium falciparum
KSNCKK

SEQ ID NO: 3325569 - protein, 4 aa, Plasmodium falciparum
KSND

SEQ ID NO: 3325570 - protein, 13 aa, Plasmodium falciparum
KSNDQNKNDDINN

SEQ ID NO: 3325571 - protein, 8 aa, Plasmodium falciparum
KSNDQQDM

SEQ ID NO: 3325572 - protein, 8 aa, Plasmodium falciparum
KSNEDDNK

SEQ ID NO: 3325573 - protein, 17 aa, Plasmodium falciparum
KSNEEKNDEDDDGSNNV

SEQ ID NO: 3325574 - protein, 12 aa, Plasmodium falciparum
KSNEHNDNNEIS

SEQ ID NO: 3325575 - protein, 6 aa, Plasmodium falciparum
KSNEIT

SEQ ID NO: 3325576 - protein, 7 aa, Plasmodium falciparum
KSNEKEF

SEQ ID NO: 3325577 - protein, 6 aa, Plasmodium falciparum
KSNEKL

SEQ ID NO: 3325578 - protein, 6 aa, Plasmodium falciparum
KSNEKT

SEQ ID NO: 3325579 - protein, 17 aa, Plasmodium falciparum
KSNELKNQQNESNEKTF

SEQ ID NO: 3325580 - protein, 8 aa, Plasmodium falciparum
KSNENLQN

SEQ ID NO: 3325581 - protein, 8 aa, Plasmodium falciparum
KSNESVPK

SEQ ID NO: 3325582 - protein, 13 aa, Plasmodium falciparum
KSNETNENHTNNY

SEQ ID NO: 3325583 - protein, 9 aa, Plasmodium falciparum
KSNETYKEY

SEQ ID NO: 3325584 - protein, 6 aa, Plasmodium falciparum
KSNGPR

SEQ ID NO: 3325585 - protein, 6 aa, Plasmodium falciparum
KSNHNT

SEQ ID NO: 3325586 - protein, 4 aa, Plasmodium falciparum
KSNI

SEQ ID NO: 3325587 - protein, 27 aa, Plasmodium falciparum
KSNINVQNEDSQPFYNNENESEHTNSF

SEQ ID NO: 3325588 - protein, 15 aa, Plasmodium falciparum
KSNISNNDIKENKSN

SEQ ID NO: 3325589 - protein, 11 aa, Plasmodium falciparum
KSNIVNKKEEK

SEQ ID NO: 3325590 - protein, 22 aa, Plasmodium falciparum
KSNIYATKDETSEKLRKVLKSI

SEQ ID NO: 3325591 - protein, 16 aa, Plasmodium falciparum
KSNKCNKNNEGNINNT

SEQ ID NO: 3325592 - protein, 34 aa, Plasmodium falciparum
KSNKDDNNNINNKKNNNQKCDTKNLNNSKTNKAN

SEQ ID NO: 3325593 - protein, 15 aa, Plasmodium falciparum
KSNKELKREKKREKK

SEQ ID NO: 3325594 - protein, 8 aa, Plasmodium falciparum
KSNKGRGQ

SEQ ID NO: 3325595 - protein, 10 aa, Plasmodium falciparum
KSNKKKKKKF

SEQ ID NO: 3325596 - protein, 8 aa, Plasmodium falciparum
KSNKKKYH

SEQ ID NO: 3325597 - protein, 6 aa, Plasmodium falciparum
KSNKNG

SEQ ID NO: 3325598 - protein, 8 aa, Plasmodium falciparum
KSNKQQGY

SEQ ID NO: 3325599 - protein, 6 aa, Plasmodium falciparum
KSNKRK

SEQ ID NO: 3325600 - protein, 10 aa, Plasmodium falciparum
KSNKSDELHS

SEQ ID NO: 3325601 - protein, 13 aa, Plasmodium falciparum
KSNKSQNKNNRVY

SEQ ID NO: 3325602 - protein, 4 aa, Plasmodium falciparum
KSNL

SEQ ID NO: 3325603 - protein, 5 aa, Plasmodium falciparum
KSNLK

SEQ ID NO: 3325604 - protein, 35 aa, Plasmodium falciparum
KSNLKKSAIQKEYEKDIESNTEKKKKTYHNSEPSY

SEQ ID NO: 3325605 - protein, 6 aa, Plasmodium falciparum
KSNLQK

SEQ ID NO: 3325606 - protein, 10 aa, Plasmodium falciparum
KSNMNDKSNN

SEQ ID NO: 3325607 - protein, 10 aa, Plasmodium falciparum
KSNMNDPNSN

SEQ ID NO: 3325608 - protein, 6 aa, Plasmodium falciparum
KSNMNK

SEQ ID NO: 3325609 - protein, 7 aa, Plasmodium falciparum
KSNNDMN

SEQ ID NO: 3325610 - protein, 8 aa, Plasmodium falciparum
KSNNDSDD

SEQ ID NO: 3325611 - protein, 7 aa, Plasmodium falciparum
KSNNDTI

SEQ ID NO: 3325612 - protein, 17 aa, Plasmodium falciparum
KSNNEKQEENKTSLLPN

SEQ ID NO: 3325613 - protein, 8 aa, Plasmodium falciparum
KSNNFSTN

SEQ ID NO: 3325614 - protein, 14 aa, Plasmodium falciparum
KSNNGDNNKKELDK

SEQ ID NO: 3325615 - protein, 13 aa, Plasmodium falciparum
KSNNKIKGNNKTN

SEQ ID NO: 3325616 - protein, 12 aa, Plasmodium falciparum
KSNNKKKNDKVD

SEQ ID NO: 3325617 - protein, 8 aa, Plasmodium falciparum
KSNNLDEK

SEQ ID NO: 3325618 - protein, 16 aa, Plasmodium falciparum
KSNNLENKEDNNINEK

SEQ ID NO: 3325619 - protein, 6 aa, Plasmodium falciparum
KSNNNL

SEQ ID NO: 3325620 - protein, 7 aa, Plasmodium falciparum
KSNNNNA

SEQ ID NO: 3325621 - protein, 11 aa, Plasmodium falciparum
KSNNNNNNNMN

SEQ ID NO: 3325622 - protein, 13 aa, Plasmodium falciparum
KSNNNNNNNNNNY

SEQ ID NO: 3325623 - protein, 8 aa, Plasmodium falciparum
KSNNNNYS

SEQ ID NO: 3325624 - protein, 6 aa, Plasmodium falciparum
KSNNNT

SEQ ID NO: 3325625 - protein, 8 aa, Plasmodium falciparum
KSNNPSSI

SEQ ID NO: 3325626 - protein, 10 aa, Plasmodium falciparum
KSNNSKPEHI

SEQ ID NO: 3325627 - protein, 7 aa, Plasmodium falciparum
KSNNSLK

SEQ ID NO: 3325628 - protein, 7 aa, Plasmodium falciparum
KSNNTEH

SEQ ID NO: 3325629 - protein, 6 aa, Plasmodium falciparum
KSNNYY

SEQ ID NO: 3325630 - protein, 10 aa, Plasmodium falciparum
KSNPLDNTKV

SEQ ID NO: 3325631 - protein, 12 aa, Plasmodium falciparum
KSNPNGKSEYNI

SEQ ID NO: 3325632 - protein, 7 aa, Plasmodium falciparum
KSNQAND

SEQ ID NO: 3325633 - protein, 17 aa, Plasmodium falciparum
KSNQIYTKKKTKEQELY

SEQ ID NO: 3325634 - protein, 30 aa, Plasmodium falciparum
KSNQNEDKTYYNKQQCNNKNNMNKNYNNND

SEQ ID NO: 3325635 - protein, 6 aa, Plasmodium falciparum
KSNQNM

SEQ ID NO: 3325636 - protein, 8 aa, Plasmodium falciparum
KSNRKNIA

SEQ ID NO: 3325637 - protein, 5 aa, Plasmodium falciparum
KSNRL

SEQ ID NO: 3325638 - protein, 12 aa, Plasmodium falciparum
KSNRNPGKCKSF

SEQ ID NO: 3325639 - protein, 6 aa, Plasmodium falciparum
KSNRNQ

SEQ ID NO: 3325640 - protein, 4 aa, Plasmodium falciparum
KSNS

SEQ ID NO: 3325641 - protein, 9 aa, Plasmodium falciparum
KSNSFCNNN

SEQ ID NO: 3325642 - protein, 21 aa, Plasmodium falciparum
KSNSHNNNNNMNAPNEQKNTN

SEQ ID NO: 3325643 - protein, 6 aa, Plasmodium falciparum
KSNSNQ

SEQ ID NO: 3325644 - protein, 12 aa, Plasmodium falciparum
KSNSRNNSSNSS

SEQ ID NO: 3325645 - protein, 11 aa, Plasmodium falciparum
KSNSRYGSYSR

SEQ ID NO: 3325646 - protein, 6 aa, Plasmodium falciparum
KSNSTI

SEQ ID NO: 3325647 - protein, 11 aa, Plasmodium falciparum
KSNSVKNNIPK

SEQ ID NO: 3325648 - protein, 8 aa, Plasmodium falciparum
KSNSYEKD

SEQ ID NO: 3325649 - protein, 4 aa, Plasmodium falciparum
KSNT

SEQ ID NO: 3325650 - protein, 7 aa, Plasmodium falciparum
KSNTCSN

SEQ ID NO: 3325651 - protein, 7 aa, Plasmodium falciparum
KSNTNKC

SEQ ID NO: 3325652 - protein, 18 aa, Plasmodium falciparum
KSNTNKNEKNNNNNNNNN

SEQ ID NO: 3325653 - protein, 5 aa, Plasmodium falciparum
KSNTQ

SEQ ID NO: 3325654 - protein, 7 aa, Plasmodium falciparum
KSNTYDN

SEQ ID NO: 3325655 - protein, 35 aa, Plasmodium falciparum
KSNTYKDNNTNTTNQYNNNNNNNNNNNNNKNDDQL

SEQ ID NO: 3325656 - protein, 6 aa, Plasmodium falciparum
KSNVDM

SEQ ID NO: 3325657 - protein, 7 aa, Plasmodium falciparum
KSNVKNV

SEQ ID NO: 3325658 - protein, 125 aa, Plasmodium falciparum
KSNVKSKTQSTQSKTHSTQSKTQSTQSKTHSSQSKTHSSQSKTHSSQSKTQSTQSKTQSTQSKTQSTQRKTQSTQSKTHSTQSKTQSTQSKTHSTQSKTKSTQSKTKSTQSKSDKKDLKENIKTK

SEQ ID NO: 3325659 - protein, 6 aa, Plasmodium falciparum
KSNWEK

SEQ ID NO: 3325660 - protein, 4 aa, Plasmodium falciparum
KSNY

SEQ ID NO: 3325661 - protein, 5 aa, Plasmodium falciparum
KSNYD

SEQ ID NO: 3325662 - protein, 7 aa, Plasmodium falciparum
KSNYDNI

SEQ ID NO: 3325663 - protein, 6 aa, Plasmodium falciparum
KSNYEN

SEQ ID NO: 3325664 - protein, 11 aa, Plasmodium falciparum
KSNYNSNQSIS

SEQ ID NO: 3325665 - protein, 6 aa, Plasmodium falciparum
KSNYNT

SEQ ID NO: 3325666 - protein, 7 aa, Plasmodium falciparum
KSPAPAR

SEQ ID NO: 3325667 - protein, 6 aa, Plasmodium falciparum
KSPCDT

SEQ ID NO: 3325668 - protein, 9 aa, Plasmodium falciparum
KSPDNKRSQ

SEQ ID NO: 3325669 - protein, 5 aa, Plasmodium falciparum
KSPEE

SEQ ID NO: 3325670 - protein, 12 aa, Plasmodium falciparum
KSPETKTDPVNN

SEQ ID NO: 3325671 - protein, 4 aa, Plasmodium falciparum
KSPH

SEQ ID NO: 3325672 - protein, 8 aa, Plasmodium falciparum
KSPHCNNQ

SEQ ID NO: 3325673 - protein, 9 aa, Plasmodium falciparum
KSPINKSSS

SEQ ID NO: 3325674 - protein, 8 aa, Plasmodium falciparum
KSPKHNSY

SEQ ID NO: 3325675 - protein, 5 aa, Plasmodium falciparum
KSPKL

SEQ ID NO: 3325676 - protein, 6 aa, Plasmodium falciparum
KSPKNI

SEQ ID NO: 3325677 - protein, 7 aa, Plasmodium falciparum
KSPMNET

SEQ ID NO: 3325678 - protein, 7 aa, Plasmodium falciparum
KSPNKHN

SEQ ID NO: 3325679 - protein, 10 aa, Plasmodium falciparum
KSPNNLNDYT

SEQ ID NO: 3325680 - protein, 6 aa, Plasmodium falciparum
KSPNVK

SEQ ID NO: 3325681 - protein, 7 aa, Plasmodium falciparum
KSPPFTI

SEQ ID NO: 3325682 - protein, 9 aa, Plasmodium falciparum
KSPQDDEHT

SEQ ID NO: 3325683 - protein, 6 aa, Plasmodium falciparum
KSPQPI

SEQ ID NO: 3325684 - protein, 7 aa, Plasmodium falciparum
KSPRGVG

SEQ ID NO: 3325685 - protein, 5 aa, Plasmodium falciparum
KSPRR

SEQ ID NO: 3325686 - protein, 7 aa, Plasmodium falciparum
KSPSAIK

SEQ ID NO: 3325687 - protein, 6 aa, Plasmodium falciparum
KSPSFT

SEQ ID NO: 3325688 - protein, 6 aa, Plasmodium falciparum
KSPYEE

SEQ ID NO: 3325689 - protein, 11 aa, Plasmodium falciparum
KSPYKLNSSEM

SEQ ID NO: 3325690 - protein, 8 aa, Plasmodium falciparum
KSPYRKLS

SEQ ID NO: 3325691 - protein, 12 aa, Plasmodium falciparum
KSQDDEVGDGTT

SEQ ID NO: 3325692 - protein, 13 aa, Plasmodium falciparum
KSQDGEKNTKVAK

SEQ ID NO: 3325693 - protein, 21 aa, Plasmodium falciparum
KSQDGNKVHNSQDDMDNEEKS

SEQ ID NO: 3325694 - protein, 7 aa, Plasmodium falciparum
KSQDGTC

SEQ ID NO: 3325695 - protein, 10 aa, Plasmodium falciparum
KSQDITRQDD

SEQ ID NO: 3325696 - protein, 12 aa, Plasmodium falciparum
KSQDNEIGDGTT

SEQ ID NO: 3325697 - protein, 8 aa, Plasmodium falciparum
KSQENSLK

SEQ ID NO: 3325698 - protein, 9 aa, Plasmodium falciparum
KSQGKQGMK

SEQ ID NO: 3325699 - protein, 27 aa, Plasmodium falciparum
KSQGNHNIDQDKRNNQKRNLKSGLKNK

SEQ ID NO: 3325700 - protein, 28 aa, Plasmodium falciparum
KSQGQKNEKSLKKRQKNMQTKKDKSRMK

SEQ ID NO: 3325701 - protein, 4 aa, Plasmodium falciparum
KSQI

SEQ ID NO: 3325702 - protein, 6 aa, Plasmodium falciparum
KSQKEY

SEQ ID NO: 3325703 - protein, 12 aa, Plasmodium falciparum
KSQKKKNLEDLF

SEQ ID NO: 3325704 - protein, 6 aa, Plasmodium falciparum
KSQKNT

SEQ ID NO: 3325705 - protein, 6 aa, Plasmodium falciparum
KSQKQF

SEQ ID NO: 3325706 - protein, 12 aa, Plasmodium falciparum
KSQLKAGTANQD

SEQ ID NO: 3325707 - protein, 4 aa, Plasmodium falciparum
KSQM

SEQ ID NO: 3325708 - protein, 5 aa, Plasmodium falciparum
KSQNA

SEQ ID NO: 3325709 - protein, 6 aa, Plasmodium falciparum
KSQNNS

SEQ ID NO: 3325710 - protein, 6 aa, Plasmodium falciparum
KSQNSQ

SEQ ID NO: 3325711 - protein, 11 aa, Plasmodium falciparum
KSQPSNKSNRN

SEQ ID NO: 3325712 - protein, 9 aa, Plasmodium falciparum
KSQQESGKE

SEQ ID NO: 3325713 - protein, 16 aa, Plasmodium falciparum
KSQRASLSTSQNDVEQ

SEQ ID NO: 3325714 - protein, 6 aa, Plasmodium falciparum
KSQTRN

SEQ ID NO: 3325715 - protein, 8 aa, Plasmodium falciparum
KSQTYNKN

SEQ ID NO: 3325716 - protein, 5 aa, Plasmodium falciparum
KSQYF

SEQ ID NO: 3325717 - protein, 6 aa, Plasmodium falciparum
KSRDAQ

SEQ ID NO: 3325718 - protein, 5 aa, Plasmodium falciparum
KSRDI

SEQ ID NO: 3325719 - protein, 8 aa, Plasmodium falciparum
KSRDNSEN

SEQ ID NO: 3325720 - protein, 7 aa, Plasmodium falciparum
KSRENCT

SEQ ID NO: 3325721 - protein, 10 aa, Plasmodium falciparum
KSRESLDNKD

SEQ ID NO: 3325722 - protein, 8 aa, Plasmodium falciparum
KSRESVPS

SEQ ID NO: 3325723 - protein, 26 aa, Plasmodium falciparum
KSRKNNKNSKISNNNKKDGNNIKSNK

SEQ ID NO: 3325724 - protein, 8 aa, Plasmodium falciparum
KSRKNNTS

SEQ ID NO: 3325725 - protein, 11 aa, Plasmodium falciparum
KSRKRKRFKDE

SEQ ID NO: 3325726 - protein, 22 aa, Plasmodium falciparum
KSRNDLKKKKIGGNNDKDDSLS

SEQ ID NO: 3325727 - protein, 11 aa, Plasmodium falciparum
KSRNIKKRRKP

SEQ ID NO: 3325728 - protein, 9 aa, Plasmodium falciparum
KSRNKINKN

SEQ ID NO: 3325729 - protein, 20 aa, Plasmodium falciparum
KSRPSSSSHLNENHDKKSEN

SEQ ID NO: 3325730 - protein, 5 aa, Plasmodium falciparum
KSRPT

SEQ ID NO: 3325731 - protein, 10 aa, Plasmodium falciparum
KSRQPNEDTV

SEQ ID NO: 3325732 - protein, 8 aa, Plasmodium falciparum
KSRQSTAH

SEQ ID NO: 3325733 - protein, 11 aa, Plasmodium falciparum
KSRRENKLKEE

SEQ ID NO: 3325734 - protein, 19 aa, Plasmodium falciparum
KSRRKAYGTPSAKDSIYGE

SEQ ID NO: 3325735 - protein, 11 aa, Plasmodium falciparum
KSRRNSPLSTK

SEQ ID NO: 3325736 - protein, 11 aa, Plasmodium falciparum
KSRSSKDHIGD

SEQ ID NO: 3325737 - protein, 4 aa, Plasmodium falciparum
KSSD

SEQ ID NO: 3325738 - protein, 7 aa, Plasmodium falciparum
KSSDGEI

SEQ ID NO: 3325739 - protein, 6 aa, Plasmodium falciparum
KSSDQL

SEQ ID NO: 3325740 - protein, 8 aa, Plasmodium falciparum
KSSEKSKV

SEQ ID NO: 3325741 - protein, 10 aa, Plasmodium falciparum
KSSENDENNL

SEQ ID NO: 3325742 - protein, 6 aa, Plasmodium falciparum
KSSENI

SEQ ID NO: 3325743 - protein, 7 aa, Plasmodium falciparum
KSSEPYV

SEQ ID NO: 3325744 - protein, 5 aa, Plasmodium falciparum
KSSES

SEQ ID NO: 3325745 - protein, 6 aa, Plasmodium falciparum
KSSESD

SEQ ID NO: 3325746 - protein, 9 aa, Plasmodium falciparum
KSSESLKED

SEQ ID NO: 3325747 - protein, 18 aa, Plasmodium falciparum
KSSFNDTLNNKNSPSRLN

SEQ ID NO: 3325748 - protein, 7 aa, Plasmodium falciparum
KSSFSNN

SEQ ID NO: 3325749 - protein, 8 aa, Plasmodium falciparum
KSSGGKIS

SEQ ID NO: 3325750 - protein, 11 aa, Plasmodium falciparum
KSSGKDMKGET

SEQ ID NO: 3325751 - protein, 11 aa, Plasmodium falciparum
KSSHIKKDNKN

SEQ ID NO: 3325752 - protein, 8 aa, Plasmodium falciparum
KSSIEKEK

SEQ ID NO: 3325753 - protein, 8 aa, Plasmodium falciparum
KSSISPDS

SEQ ID NO: 3325754 - protein, 18 aa, Plasmodium falciparum
KSSKGGEERSHVDSNKTY

SEQ ID NO: 3325755 - protein, 12 aa, Plasmodium falciparum
KSSKGHNDTYTY

SEQ ID NO: 3325756 - protein, 10 aa, Plasmodium falciparum
KSSKHQSDEL

SEQ ID NO: 3325757 - protein, 8 aa, Plasmodium falciparum
KSSKKIKN

SEQ ID NO: 3325758 - protein, 43 aa, Plasmodium falciparum
KSSKKKKKKDKKNSECENIKGEENSVGKENDNYEEEKKNINMN

SEQ ID NO: 3325759 - protein, 7 aa, Plasmodium falciparum
KSSKNMS

SEQ ID NO: 3325760 - protein, 7 aa, Plasmodium falciparum
KSSKTLK

SEQ ID NO: 3325761 - protein, 8 aa, Plasmodium falciparum
KSSKYTKE

SEQ ID NO: 3325762 - protein, 13 aa, Plasmodium falciparum
KSSKYYKEKKDSF

SEQ ID NO: 3325763 - protein, 24 aa, Plasmodium falciparum
KSSLESEKKEESDNSYNTNDYNDC

SEQ ID NO: 3325764 - protein, 6 aa, Plasmodium falciparum
KSSLQL

SEQ ID NO: 3325765 - protein, 34 aa, Plasmodium falciparum
KSSNDSTMDKDHVDNKDVNNEKTLDSSNEPVQSN

SEQ ID NO: 3325766 - protein, 6 aa, Plasmodium falciparum
KSSNEF

SEQ ID NO: 3325767 - protein, 6 aa, Plasmodium falciparum
KSSNEL

SEQ ID NO: 3325768 - protein, 8 aa, Plasmodium falciparum
KSSNIRRE

SEQ ID NO: 3325769 - protein, 9 aa, Plasmodium falciparum
KSSNKEISR

SEQ ID NO: 3325770 - protein, 9 aa, Plasmodium falciparum
KSSNNAGVT

SEQ ID NO: 3325771 - protein, 7 aa, Plasmodium falciparum
KSSNNNI

SEQ ID NO: 3325772 - protein, 22 aa, Plasmodium falciparum
KSSNNNNINENKNKNNNDNISE

SEQ ID NO: 3325773 - protein, 13 aa, Plasmodium falciparum
KSSNNSNNENVYS

SEQ ID NO: 3325774 - protein, 6 aa, Plasmodium falciparum
KSSNSD

SEQ ID NO: 3325775 - protein, 6 aa, Plasmodium falciparum
KSSPNV

SEQ ID NO: 3325776 - protein, 6 aa, Plasmodium falciparum
KSSPQG

SEQ ID NO: 3325777 - protein, 6 aa, Plasmodium falciparum
KSSQDI

SEQ ID NO: 3325778 - protein, 8 aa, Plasmodium falciparum
KSSQDNFD

SEQ ID NO: 3325779 - protein, 6 aa, Plasmodium falciparum
KSSQEN

SEQ ID NO: 3325780 - protein, 5 aa, Plasmodium falciparum
KSSQH

SEQ ID NO: 3325781 - protein, 8 aa, Plasmodium falciparum
KSSQNVSS

SEQ ID NO: 3325782 - protein, 11 aa, Plasmodium falciparum
KSSQSINKNDT

SEQ ID NO: 3325783 - protein, 21 aa, Plasmodium falciparum
KSSQVGKKKKEKKKKKNYYTY

SEQ ID NO: 3325784 - protein, 9 aa, Plasmodium falciparum
KSSRNTNLD

SEQ ID NO: 3325785 - protein, 5 aa, Plasmodium falciparum
KSSSI

SEQ ID NO: 3325786 - protein, 9 aa, Plasmodium falciparum
KSSSLSPTT

SEQ ID NO: 3325787 - protein, 36 aa, Plasmodium falciparum
KSSSNDYESSKNNISNNINSSINSNINNNNANSGYK

SEQ ID NO: 3325788 - protein, 13 aa, Plasmodium falciparum
KSSSNNSQDTMKN

SEQ ID NO: 3325789 - protein, 18 aa, Plasmodium falciparum
KSSTGSSSSRLDGNPKLD

SEQ ID NO: 3325790 - protein, 6 aa, Plasmodium falciparum
KSSTIN

SEQ ID NO: 3325791 - protein, 8 aa, Plasmodium falciparum
KSSTLDES

SEQ ID NO: 3325792 - protein, 15 aa, Plasmodium falciparum
KSSTNYKNDDPSTNY

SEQ ID NO: 3325793 - protein, 7 aa, Plasmodium falciparum
KSSTSYN

SEQ ID NO: 3325794 - protein, 10 aa, Plasmodium falciparum
KSSVDNQNAN

SEQ ID NO: 3325795 - protein, 11 aa, Plasmodium falciparum
KSSYDKNEEDK

SEQ ID NO: 3325796 - protein, 7 aa, Plasmodium falciparum
KSSYEKG

SEQ ID NO: 3325797 - protein, 6 aa, Plasmodium falciparum
KSSYKK

SEQ ID NO: 3325798 - protein, 6 aa, Plasmodium falciparum
KSTDEK

SEQ ID NO: 3325799 - protein, 16 aa, Plasmodium falciparum
KSTDISGINKRTKRKY

SEQ ID NO: 3325800 - protein, 6 aa, Plasmodium falciparum
KSTDTF

SEQ ID NO: 3325801 - protein, 8 aa, Plasmodium falciparum
KSTEEGEL

SEQ ID NO: 3325802 - protein, 14 aa, Plasmodium falciparum
KSTENEEDDDNYED

SEQ ID NO: 3325803 - protein, 6 aa, Plasmodium falciparum
KSTEQF

SEQ ID NO: 3325804 - protein, 13 aa, Plasmodium falciparum
KSTETLKDDNGLP

SEQ ID NO: 3325805 - protein, 4 aa, Plasmodium falciparum
KSTG

SEQ ID NO: 3325806 - protein, 5 aa, Plasmodium falciparum
KSTHT

SEQ ID NO: 3325807 - protein, 21 aa, Plasmodium falciparum
KSTISKQKKGKNEGNTKTHKD

SEQ ID NO: 3325808 - protein, 8 aa, Plasmodium falciparum
KSTLENEK

SEQ ID NO: 3325809 - protein, 7 aa, Plasmodium falciparum
KSTLKNE

SEQ ID NO: 3325810 - protein, 11 aa, Plasmodium falciparum
KSTLNSNKQID

SEQ ID NO: 3325811 - protein, 4 aa, Plasmodium falciparum
KSTN

SEQ ID NO: 3325812 - protein, 6 aa, Plasmodium falciparum
KSTNDY

SEQ ID NO: 3325813 - protein, 8 aa, Plasmodium falciparum
KSTNNISQ

SEQ ID NO: 3325814 - protein, 8 aa, Plasmodium falciparum
KSTNSINT

SEQ ID NO: 3325815 - protein, 10 aa, Plasmodium falciparum
KSTNSLSSYK

SEQ ID NO: 3325816 - protein, 5 aa, Plasmodium falciparum
KSTNY

SEQ ID NO: 3325817 - protein, 6 aa, Plasmodium falciparum
KSTNYN

SEQ ID NO: 3325818 - protein, 6 aa, Plasmodium falciparum
KSTQDD

SEQ ID NO: 3325819 - protein, 8 aa, Plasmodium falciparum
KSTSELNK

SEQ ID NO: 3325820 - protein, 14 aa, Plasmodium falciparum
KSTSGSKGLNDEGA

SEQ ID NO: 3325821 - protein, 16 aa, Plasmodium falciparum
KSTSLKDPSRTKNNNY

SEQ ID NO: 3325822 - protein, 10 aa, Plasmodium falciparum
KSTSNENTHM

SEQ ID NO: 3325823 - protein, 6 aa, Plasmodium falciparum
KSTSSS

SEQ ID NO: 3325824 - protein, 8 aa, Plasmodium falciparum
KSTTESNI

SEQ ID NO: 3325825 - protein, 11 aa, Plasmodium falciparum
KSTTHLNNTDN

SEQ ID NO: 3325826 - protein, 7 aa, Plasmodium falciparum
KSTTLNT

SEQ ID NO: 3325827 - protein, 7 aa, Plasmodium falciparum
KSTVTYN

SEQ ID NO: 3325828 - protein, 4 aa, Plasmodium falciparum
KSTY

SEQ ID NO: 3325829 - protein, 6 aa, Plasmodium falciparum
KSTYQK

SEQ ID NO: 3325830 - protein, 6 aa, Plasmodium falciparum
KSTYSR

SEQ ID NO: 3325831 - protein, 7 aa, Plasmodium falciparum
KSVASSL

SEQ ID NO: 3325832 - protein, 29 aa, Plasmodium falciparum
KSVCGSSKASIQNISSEQKNVEKMVIAGN

SEQ ID NO: 3325833 - protein, 11 aa, Plasmodium falciparum
KSVDEKDKDDY

SEQ ID NO: 3325834 - protein, 6 aa, Plasmodium falciparum
KSVEKT

SEQ ID NO: 3325835 - protein, 9 aa, Plasmodium falciparum
KSVKDKQNI

SEQ ID NO: 3325836 - protein, 13 aa, Plasmodium falciparum
KSVKNKNTYDLNE

SEQ ID NO: 3325837 - protein, 10 aa, Plasmodium falciparum
KSVKSNDVYS

SEQ ID NO: 3325838 - protein, 4 aa, Plasmodium falciparum
KSVL

SEQ ID NO: 3325839 - protein, 16 aa, Plasmodium falciparum
KSVNEKKKKKPYYEEE

SEQ ID NO: 3325840 - protein, 6 aa, Plasmodium falciparum
KSVNKP

SEQ ID NO: 3325841 - protein, 13 aa, Plasmodium falciparum
KSVPNALPKRNDP

SEQ ID NO: 3325842 - protein, 4 aa, Plasmodium falciparum
KSVS

SEQ ID NO: 3325843 - protein, 5 aa, Plasmodium falciparum
KSVSH

SEQ ID NO: 3325844 - protein, 17 aa, Plasmodium falciparum
KSVSSKINKYGDEHTNV

SEQ ID NO: 3325845 - protein, 21 aa, Plasmodium falciparum
KSVSTNNQSIENNNEHQFNDD

SEQ ID NO: 3325846 - protein, 15 aa, Plasmodium falciparum
KSVSVSENETIKNDN

SEQ ID NO: 3325847 - protein, 9 aa, Plasmodium falciparum
KSWTRTDDE

SEQ ID NO: 3325848 - protein, 7 aa, Plasmodium falciparum
KSYAEKP

SEQ ID NO: 3325849 - protein, 7 aa, Plasmodium falciparum
KSYDDKS

SEQ ID NO: 3325850 - protein, 7 aa, Plasmodium falciparum
KSYDDPN

SEQ ID NO: 3325851 - protein, 17 aa, Plasmodium falciparum
KSYEEKINQAKKQLSDS

SEQ ID NO: 3325852 - protein, 13 aa, Plasmodium falciparum
KSYGLSKNVSNSD

SEQ ID NO: 3325853 - protein, 11 aa, Plasmodium falciparum
KSYGNKSGISD

SEQ ID NO: 3325854 - protein, 7 aa, Plasmodium falciparum
KSYGNTQ

SEQ ID NO: 3325855 - protein, 22 aa, Plasmodium falciparum
KSYGREHNINDEQKISSNINEE

SEQ ID NO: 3325856 - protein, 5 aa, Plasmodium falciparum
KSYID

SEQ ID NO: 3325857 - protein, 11 aa, Plasmodium falciparum
KSYISDSEENI

SEQ ID NO: 3325858 - protein, 4 aa, Plasmodium falciparum
KSYK

SEQ ID NO: 3325859 - protein, 12 aa, Plasmodium falciparum
KSYKHKDSKIND

SEQ ID NO: 3325860 - protein, 12 aa, Plasmodium falciparum
KSYKNKTEKKDH

SEQ ID NO: 3325861 - protein, 7 aa, Plasmodium falciparum
KSYKNSS

SEQ ID NO: 3325862 - protein, 8 aa, Plasmodium falciparum
KSYNEDNK

SEQ ID NO: 3325863 - protein, 6 aa, Plasmodium falciparum
KSYNEL

SEQ ID NO: 3325864 - protein, 23 aa, Plasmodium falciparum
KSYNSSSNKKNSIPCNSSNGNDI

SEQ ID NO: 3325865 - protein, 4 aa, Plasmodium falciparum
KSYP

SEQ ID NO: 3325866 - protein, 5 aa, Plasmodium falciparum
KSYPK

SEQ ID NO: 3325867 - protein, 6 aa, Plasmodium falciparum
KSYQKN

SEQ ID NO: 3325868 - protein, 12 aa, Plasmodium falciparum
KSYQNNGNNNYI

SEQ ID NO: 3325869 - protein, 23 aa, Plasmodium falciparum
KSYREEKNTNYHRTDDNKNYHHT

SEQ ID NO: 3325870 - protein, 8 aa, Plasmodium falciparum
KSYRTSKK

SEQ ID NO: 3325871 - protein, 7 aa, Plasmodium falciparum
KSYSDDE

SEQ ID NO: 3325872 - protein, 16 aa, Plasmodium falciparum
KSYSDKNVKRKKEGKI

SEQ ID NO: 3325873 - protein, 7 aa, Plasmodium falciparum
KSYSDND

SEQ ID NO: 3325874 - protein, 7 aa, Plasmodium falciparum
KSYSKSE

SEQ ID NO: 3325875 - protein, 8 aa, Plasmodium falciparum
KSYSNNEI

SEQ ID NO: 3325876 - protein, 8 aa, Plasmodium falciparum
KSYSNNSA

SEQ ID NO: 3325877 - protein, 20 aa, Plasmodium falciparum
KSYSSSSANYNYDEKQKKDI

SEQ ID NO: 3325878 - protein, 19 aa, Plasmodium falciparum
KSYSSTTNEEQEKDKREYG

SEQ ID NO: 3325879 - protein, 73 aa, Plasmodium falciparum
KSYTNDEDNKSNYNNNSDDNNNNSDDNNKYSDDNNKYSDDSNEYSDDSNNNNNNNNKYSDDSNKYSDDNNKYN

SEQ ID NO: 3325880 - protein, 8 aa, Plasmodium falciparum
KSYTNELQ

SEQ ID NO: 3325881 - protein, 5 aa, Plasmodium falciparum
KSYVK

SEQ ID NO: 3325882 - protein, 8 aa, Plasmodium falciparum
KTAAEERS

SEQ ID NO: 3325883 - protein, 9 aa, Plasmodium falciparum
KTAEQKKQK

SEQ ID NO: 3325884 - protein, 7 aa, Plasmodium falciparum
KTAETGY

SEQ ID NO: 3325885 - protein, 7 aa, Plasmodium falciparum
KTAKSGY

SEQ ID NO: 3325886 - protein, 5 aa, Plasmodium falciparum
KTAND

SEQ ID NO: 3325887 - protein, 7 aa, Plasmodium falciparum
KTANKIK

SEQ ID NO: 3325888 - protein, 7 aa, Plasmodium falciparum
KTAQSIY

SEQ ID NO: 3325889 - protein, 5 aa, Plasmodium falciparum
KTARI

SEQ ID NO: 3325890 - protein, 6 aa, Plasmodium falciparum
KTARSI

SEQ ID NO: 3325891 - protein, 5 aa, Plasmodium falciparum
KTASK

SEQ ID NO: 3325892 - protein, 5 aa, Plasmodium falciparum
KTCKD

SEQ ID NO: 3325893 - protein, 21 aa, Plasmodium falciparum
KTCSNTSASSVKKYDKKEQSL

SEQ ID NO: 3325894 - protein, 10 aa, Plasmodium falciparum
KTDDDISKQQ

SEQ ID NO: 3325895 - protein, 7 aa, Plasmodium falciparum
KTDDIEK

SEQ ID NO: 3325896 - protein, 7 aa, Plasmodium falciparum
KTDDITN

SEQ ID NO: 3325897 - protein, 14 aa, Plasmodium falciparum
KTDDMKNRENIKDN

SEQ ID NO: 3325898 - protein, 5 aa, Plasmodium falciparum
KTDDN

SEQ ID NO: 3325899 - protein, 6 aa, Plasmodium falciparum
KTDEDY

SEQ ID NO: 3325900 - protein, 39 aa, Plasmodium falciparum
KTDEEDKDDDDNDNDDEDVRIEPKDRNENDSENINHNDE

SEQ ID NO: 3325901 - protein, 8 aa, Plasmodium falciparum
KTDEHSKW

SEQ ID NO: 3325902 - protein, 7 aa, Plasmodium falciparum
KTDEYSH

SEQ ID NO: 3325903 - protein, 8 aa, Plasmodium falciparum
KTDHPKYL

SEQ ID NO: 3325904 - protein, 4 aa, Plasmodium falciparum
KTDI

SEQ ID NO: 3325905 - protein, 10 aa, Plasmodium falciparum
KTDKNDTKHT

SEQ ID NO: 3325906 - protein, 8 aa, Plasmodium falciparum
KTDKQIEE

SEQ ID NO: 3325907 - protein, 5 aa, Plasmodium falciparum
KTDLG

SEQ ID NO: 3325908 - protein, 5 aa, Plasmodium falciparum
KTDMD

SEQ ID NO: 3325909 - protein, 4 aa, Plasmodium falciparum
KTDN

SEQ ID NO: 3325910 - protein, 18 aa, Plasmodium falciparum
KTDNNSNNNNNNMPYKEN

SEQ ID NO: 3325911 - protein, 10 aa, Plasmodium falciparum
KTDNSIQDET

SEQ ID NO: 3325912 - protein, 11 aa, Plasmodium falciparum
KTDNSPFNKQD

SEQ ID NO: 3325913 - protein, 4 aa, Plasmodium falciparum
KTDQ

SEQ ID NO: 3325914 - protein, 7 aa, Plasmodium falciparum
KTDRPLN

SEQ ID NO: 3325915 - protein, 4 aa, Plasmodium falciparum
KTDS

SEQ ID NO: 3325916 - protein, 4 aa, Plasmodium falciparum
KTDT

SEQ ID NO: 3325917 - protein, 6 aa, Plasmodium falciparum
KTDTHT

SEQ ID NO: 3325918 - protein, 42 aa, Plasmodium falciparum
KTDTNNNNNNEEEDEEEDEEEEEDGRKTKDVGQVSKERTDTL

SEQ ID NO: 3325919 - protein, 4 aa, Plasmodium falciparum
KTED

SEQ ID NO: 3325920 - protein, 8 aa, Plasmodium falciparum
KTEDNQLR

SEQ ID NO: 3325921 - protein, 5 aa, Plasmodium falciparum
KTEDS

SEQ ID NO: 3325922 - protein, 13 aa, Plasmodium falciparum
KTEDVTKTKGNEF

SEQ ID NO: 3325923 - protein, 4 aa, Plasmodium falciparum
KTEE

SEQ ID NO: 3325924 - protein, 20 aa, Plasmodium falciparum
KTEEEKRKNLKNKQNDLDEI

SEQ ID NO: 3325925 - protein, 7 aa, Plasmodium falciparum
KTEEERK

SEQ ID NO: 3325926 - protein, 10 aa, Plasmodium falciparum
KTEEESSKDM

SEQ ID NO: 3325927 - protein, 7 aa, Plasmodium falciparum
KTEEEYE

SEQ ID NO: 3325928 - protein, 55 aa, Plasmodium falciparum
KTEEGDTSKRKQKNMSDKKNKKEKRKKKKDKKNDNDNEEENDNEEDQEEDEKQDI

SEQ ID NO: 3325929 - protein, 8 aa, Plasmodium falciparum
KTEEKKKE

SEQ ID NO: 3325930 - protein, 5 aa, Plasmodium falciparum
KTEEL

SEQ ID NO: 3325931 - protein, 5 aa, Plasmodium falciparum
KTEEM

SEQ ID NO: 3325932 - protein, 11 aa, Plasmodium falciparum
KTEEVEKKNPN

SEQ ID NO: 3325933 - protein, 6 aa, Plasmodium falciparum
KTEGGI

SEQ ID NO: 3325934 - protein, 12 aa, Plasmodium falciparum
KTEGNAKKLKQN

SEQ ID NO: 3325935 - protein, 6 aa, Plasmodium falciparum
KTEGSS

SEQ ID NO: 3325936 - protein, 8 aa, Plasmodium falciparum
KTEHKEQI

SEQ ID NO: 3325937 - protein, 4 aa, Plasmodium falciparum
KTEK

SEQ ID NO: 3325938 - protein, 9 aa, Plasmodium falciparum
KTEKEEKNL

SEQ ID NO: 3325939 - protein, 8 aa, Plasmodium falciparum
KTEKNNKR

SEQ ID NO: 3325940 - protein, 19 aa, Plasmodium falciparum
KTEKNVNTNAEDNVHEEKN

SEQ ID NO: 3325941 - protein, 10 aa, Plasmodium falciparum
KTEKSKKKNK

SEQ ID NO: 3325942 - protein, 5 aa, Plasmodium falciparum
KTEME

SEQ ID NO: 3325943 - protein, 13 aa, Plasmodium falciparum
KTEMREKKKPEII

SEQ ID NO: 3325944 - protein, 4 aa, Plasmodium falciparum
KTEN

SEQ ID NO: 3325945 - protein, 6 aa, Plasmodium falciparum
KTENAK

SEQ ID NO: 3325946 - protein, 5 aa, Plasmodium falciparum
KTENE

SEQ ID NO: 3325947 - protein, 14 aa, Plasmodium falciparum
KTENEKLKQELSEK

SEQ ID NO: 3325948 - protein, 12 aa, Plasmodium falciparum
KTENNNNKFNNS

SEQ ID NO: 3325949 - protein, 6 aa, Plasmodium falciparum
KTENPE

SEQ ID NO: 3325950 - protein, 21 aa, Plasmodium falciparum
KTENTNDINEEVRNEQKRESI

SEQ ID NO: 3325951 - protein, 17 aa, Plasmodium falciparum
KTEPCPTQNNQSTPKAQ

SEQ ID NO: 3325952 - protein, 27 aa, Plasmodium falciparum
KTEQKKKNNNLSTLEKDKRSYSQGDNE

SEQ ID NO: 3325953 - protein, 43 aa, Plasmodium falciparum
KTESKTINEESNDDNKYGNNKYDNNDNINNNDNNDNHINNNNN

SEQ ID NO: 3325954 - protein, 5 aa, Plasmodium falciparum
KTESL

SEQ ID NO: 3325955 - protein, 6 aa, Plasmodium falciparum
KTETKL

SEQ ID NO: 3325956 - protein, 5 aa, Plasmodium falciparum
KTETL

SEQ ID NO: 3325957 - protein, 6 aa, Plasmodium falciparum
KTETTI

SEQ ID NO: 3325958 - protein, 11 aa, Plasmodium falciparum
KTEVEKKKEIN

SEQ ID NO: 3325959 - protein, 13 aa, Plasmodium falciparum
KTFDDNNNLTDNT

SEQ ID NO: 3325960 - protein, 12 aa, Plasmodium falciparum
KTFKSKTPLDEA

SEQ ID NO: 3325961 - protein, 8 aa, Plasmodium falciparum
KTFNKKTN

SEQ ID NO: 3325962 - protein, 4 aa, Plasmodium falciparum
KTFP

SEQ ID NO: 3325963 - protein, 7 aa, Plasmodium falciparum
KTGDNNM

SEQ ID NO: 3325964 - protein, 8 aa, Plasmodium falciparum
KTGEDKND

SEQ ID NO: 3325965 - protein, 7 aa, Plasmodium falciparum
KTGEEDE

SEQ ID NO: 3325966 - protein, 7 aa, Plasmodium falciparum
KTGEENI

SEQ ID NO: 3325967 - protein, 11 aa, Plasmodium falciparum
KTGEESKYRND

SEQ ID NO: 3325968 - protein, 17 aa, Plasmodium falciparum
KTGGGSLDNNNTSHQPM

SEQ ID NO: 3325969 - protein, 16 aa, Plasmodium falciparum
KTGGKMDDITVSCAMV

SEQ ID NO: 3325970 - protein, 10 aa, Plasmodium falciparum
KTGGSLAALK

SEQ ID NO: 3325971 - protein, 11 aa, Plasmodium falciparum
KTGHSGTLDPK

SEQ ID NO: 3325972 - protein, 13 aa, Plasmodium falciparum
KTGKEITNDKNLH

SEQ ID NO: 3325973 - protein, 17 aa, Plasmodium falciparum
KTGKETYKELTKRKNEE

SEQ ID NO: 3325974 - protein, 9 aa, Plasmodium falciparum
KTGNEESNY

SEQ ID NO: 3325975 - protein, 6 aa, Plasmodium falciparum
KTGNGY

SEQ ID NO: 3325976 - protein, 4 aa, Plasmodium falciparum
KTGP

SEQ ID NO: 3325977 - protein, 5 aa, Plasmodium falciparum
KTGRG

SEQ ID NO: 3325978 - protein, 5 aa, Plasmodium falciparum
KTGRH

SEQ ID NO: 3325979 - protein, 7 aa, Plasmodium falciparum
KTGSGKS

SEQ ID NO: 3325980 - protein, 4 aa, Plasmodium falciparum
KTGT

SEQ ID NO: 3325981 - protein, 6 aa, Plasmodium falciparum
KTGVEE

SEQ ID NO: 3325982 - protein, 6 aa, Plasmodium falciparum
KTGYTC

SEQ ID NO: 3325983 - protein, 4 aa, Plasmodium falciparum
KTHD

SEQ ID NO: 3325984 - protein, 10 aa, Plasmodium falciparum
KTHGESNTNL

SEQ ID NO: 3325985 - protein, 8 aa, Plasmodium falciparum
KTHHEGDS

SEQ ID NO: 3325986 - protein, 11 aa, Plasmodium falciparum
KTHKNKNSENF

SEQ ID NO: 3325987 - protein, 15 aa, Plasmodium falciparum
KTHSLEGTGNEKNSY

SEQ ID NO: 3325988 - protein, 7 aa, Plasmodium falciparum
KTHTKKQ

SEQ ID NO: 3325989 - protein, 7 aa, Plasmodium falciparum
KTIDTTN

SEQ ID NO: 3325990 - protein, 4 aa, Plasmodium falciparum
KTIE

SEQ ID NO: 3325991 - protein, 13 aa, Plasmodium falciparum
KTIEDSPNNENEI

SEQ ID NO: 3325992 - protein, 18 aa, Plasmodium falciparum
KTIEKGEKRDHHKNEELK

SEQ ID NO: 3325993 - protein, 7 aa, Plasmodium falciparum
KTIENER

SEQ ID NO: 3325994 - protein, 10 aa, Plasmodium falciparum
KTIGTKEEEE

SEQ ID NO: 3325995 - protein, 14 aa, Plasmodium falciparum
KTIKKDDNTKPALN

SEQ ID NO: 3325996 - protein, 11 aa, Plasmodium falciparum
KTIKNDNSSRF

SEQ ID NO: 3325997 - protein, 15 aa, Plasmodium falciparum
KTIKNNKNNEHNNNF

SEQ ID NO: 3325998 - protein, 6 aa, Plasmodium falciparum
KTINDK

SEQ ID NO: 3325999 - protein, 7 aa, Plasmodium falciparum
KTINDNS

SEQ ID NO: 3326000 - protein, 11 aa, Plasmodium falciparum
KTINNNKNNQR

SEQ ID NO: 3326001 - protein, 5 aa, Plasmodium falciparum
KTIRE

SEQ ID NO: 3326002 - protein, 11 aa, Plasmodium falciparum
KTIRNNNSSRF

SEQ ID NO: 3326003 - protein, 4 aa, Plasmodium falciparum
KTIS

SEQ ID NO: 3326004 - protein, 7 aa, Plasmodium falciparum
KTISGKA

SEQ ID NO: 3326005 - protein, 5 aa, Plasmodium falciparum
KTISS

SEQ ID NO: 3326006 - protein, 5 aa, Plasmodium falciparum
KTITE

SEQ ID NO: 3326007 - protein, 38 aa, Plasmodium falciparum
KTITNTSSDDHSGSLSSSSSSSSSISSSNYDDEAYDNV

SEQ ID NO: 3326008 - protein, 6 aa, Plasmodium falciparum
KTKAFN

SEQ ID NO: 3326009 - protein, 9 aa, Plasmodium falciparum
KTKAGMNTT

SEQ ID NO: 3326010 - protein, 8 aa, Plasmodium falciparum
KTKAGTPY

SEQ ID NO: 3326011 - protein, 11 aa, Plasmodium falciparum
KTKDDQSLSSA

SEQ ID NO: 3326012 - protein, 9 aa, Plasmodium falciparum
KTKDEDVST

SEQ ID NO: 3326013 - protein, 10 aa, Plasmodium falciparum
KTKDRELANS

SEQ ID NO: 3326014 - protein, 4 aa, Plasmodium falciparum
KTKE

SEQ ID NO: 3326015 - protein, 6 aa, Plasmodium falciparum
KTKEDH

SEQ ID NO: 3326016 - protein, 122 aa, Plasmodium falciparum
KTKEEEEEQEEEEEEEEEEEEKEEEKDEYEENDDIEEEEDDDDEDEKEEINKKKKKKKKKKKERHIKDEQNKDKYGKDKNVKDKNVKDKNVKDKNVKDKNVKDKNVKDKNVKDKNVKDKNVK

SEQ ID NO: 3326017 - protein, 11 aa, Plasmodium falciparum
KTKEEKVDEEN

SEQ ID NO: 3326018 - protein, 7 aa, Plasmodium falciparum
KTKEESY

SEQ ID NO: 3326019 - protein, 8 aa, Plasmodium falciparum
KTKEKKGI

SEQ ID NO: 3326020 - protein, 7 aa, Plasmodium falciparum
KTKEKKI

SEQ ID NO: 3326021 - protein, 58 aa, Plasmodium falciparum
KTKEQTHHTNNNINGNYNNDEHIEEEGKAKTKQNKTKNSIIEEKKKKTKKKKDEESHN

SEQ ID NO: 3326022 - protein, 6 aa, Plasmodium falciparum
KTKERV

SEQ ID NO: 3326023 - protein, 8 aa, Plasmodium falciparum
KTKEVYNN

SEQ ID NO: 3326024 - protein, 15 aa, Plasmodium falciparum
KTKEYFDSRSIQYYG

SEQ ID NO: 3326025 - protein, 6 aa, Plasmodium falciparum
KTKFGE

SEQ ID NO: 3326026 - protein, 8 aa, Plasmodium falciparum
KTKGEKEN

SEQ ID NO: 3326027 - protein, 6 aa, Plasmodium falciparum
KTKGGE

SEQ ID NO: 3326028 - protein, 6 aa, Plasmodium falciparum
KTKGNE

SEQ ID NO: 3326029 - protein, 9 aa, Plasmodium falciparum
KTKGTQPGF

SEQ ID NO: 3326030 - protein, 4 aa, Plasmodium falciparum
KTKH

SEQ ID NO: 3326031 - protein, 4 aa, Plasmodium falciparum
KTKI

SEQ ID NO: 3326032 - protein, 5 aa, Plasmodium falciparum
KTKIE

SEQ ID NO: 3326033 - protein, 15 aa, Plasmodium falciparum
KTKIEDNKDIKENEN

SEQ ID NO: 3326034 - protein, 12 aa, Plasmodium falciparum
KTKIEKEDEISK

SEQ ID NO: 3326035 - protein, 6 aa, Plasmodium falciparum
KTKIQE

SEQ ID NO: 3326036 - protein, 7 aa, Plasmodium falciparum
KTKITDN

SEQ ID NO: 3326037 - protein, 14 aa, Plasmodium falciparum
KTKKAASIDPVEPD

SEQ ID NO: 3326038 - protein, 8 aa, Plasmodium falciparum
KTKKADHY

SEQ ID NO: 3326039 - protein, 10 aa, Plasmodium falciparum
KTKKDSINPS

SEQ ID NO: 3326040 - protein, 10 aa, Plasmodium falciparum
KTKKEKGQKE

SEQ ID NO: 3326041 - protein, 19 aa, Plasmodium falciparum
KTKKGTSKDAQVQTNEEEL

SEQ ID NO: 3326042 - protein, 21 aa, Plasmodium falciparum
KTKKKDRKKERSISVVREKVN

SEQ ID NO: 3326043 - protein, 12 aa, Plasmodium falciparum
KTKKKKNYPCNN

SEQ ID NO: 3326044 - protein, 12 aa, Plasmodium falciparum
KTKKKQKEKISK

SEQ ID NO: 3326045 - protein, 18 aa, Plasmodium falciparum
KTKKQTDQIYDNNNNNNN

SEQ ID NO: 3326046 - protein, 14 aa, Plasmodium falciparum
KTKKWSKNQQEGYK

SEQ ID NO: 3326047 - protein, 8 aa, Plasmodium falciparum
KTKKYSGA

SEQ ID NO: 3326048 - protein, 6 aa, Plasmodium falciparum
KTKLEK

SEQ ID NO: 3326049 - protein, 9 aa, Plasmodium falciparum
KTKNESSYE

SEQ ID NO: 3326050 - protein, 7 aa, Plasmodium falciparum
KTKNGIN

SEQ ID NO: 3326051 - protein, 18 aa, Plasmodium falciparum
KTKNGYSTTLNNEENISN

SEQ ID NO: 3326052 - protein, 11 aa, Plasmodium falciparum
KTKNKKNKTDL

SEQ ID NO: 3326053 - protein, 30 aa, Plasmodium falciparum
KTKNLKGKKGPISKNKNDKNEKDANDNVNN

SEQ ID NO: 3326054 - protein, 6 aa, Plasmodium falciparum
KTKNNE

SEQ ID NO: 3326055 - protein, 9 aa, Plasmodium falciparum
KTKNNPINT

SEQ ID NO: 3326056 - protein, 7 aa, Plasmodium falciparum
KTKNPSK

SEQ ID NO: 3326057 - protein, 6 aa, Plasmodium falciparum
KTKNRF

SEQ ID NO: 3326058 - protein, 14 aa, Plasmodium falciparum
KTKNTSTQEIDGDT

SEQ ID NO: 3326059 - protein, 12 aa, Plasmodium falciparum
KTKNVAQQKEKK

SEQ ID NO: 3326060 - protein, 8 aa, Plasmodium falciparum
KTKPQNAS

SEQ ID NO: 3326061 - protein, 9 aa, Plasmodium falciparum
KTKQRELEK

SEQ ID NO: 3326062 - protein, 6 aa, Plasmodium falciparum
KTKRAH

SEQ ID NO: 3326063 - protein, 8 aa, Plasmodium falciparum
KTKRDMEE

SEQ ID NO: 3326064 - protein, 5 aa, Plasmodium falciparum
KTKRI

SEQ ID NO: 3326065 - protein, 8 aa, Plasmodium falciparum
KTKRISKK

SEQ ID NO: 3326066 - protein, 39 aa, Plasmodium falciparum
KTKRRVKKKTTDETENNNVENNEANGDSNANAASGKSQK

SEQ ID NO: 3326067 - protein, 7 aa, Plasmodium falciparum
KTKSDIS

SEQ ID NO: 3326068 - protein, 8 aa, Plasmodium falciparum
KTKSDNSV

SEQ ID NO: 3326069 - protein, 10 aa, Plasmodium falciparum
KTKSENNQNY

SEQ ID NO: 3326070 - protein, 36 aa, Plasmodium falciparum
KTKSIVNSNNNNKKKKKKKNKNKKKTNKKKNMQKSK

SEQ ID NO: 3326071 - protein, 8 aa, Plasmodium falciparum
KTKSNKDI

SEQ ID NO: 3326072 - protein, 5 aa, Plasmodium falciparum
KTKSR

SEQ ID NO: 3326073 - protein, 12 aa, Plasmodium falciparum
KTKSSDHDDNIT

SEQ ID NO: 3326074 - protein, 6 aa, Plasmodium falciparum
KTKSTN

SEQ ID NO: 3326075 - protein, 7 aa, Plasmodium falciparum
KTKTNIS

SEQ ID NO: 3326076 - protein, 8 aa, Plasmodium falciparum
KTKTNNTI

SEQ ID NO: 3326077 - protein, 11 aa, Plasmodium falciparum
KTKTRKDTYNK

SEQ ID NO: 3326078 - protein, 11 aa, Plasmodium falciparum
KTKVDKTNGMM

SEQ ID NO: 3326079 - protein, 4 aa, Plasmodium falciparum
KTKY

SEQ ID NO: 3326080 - protein, 10 aa, Plasmodium falciparum
KTKYKNNNKN

SEQ ID NO: 3326081 - protein, 12 aa, Plasmodium falciparum
KTLAEKDLEAEE

SEQ ID NO: 3326082 - protein, 6 aa, Plasmodium falciparum
KTLDAQ

SEQ ID NO: 3326083 - protein, 19 aa, Plasmodium falciparum
KTLDGQKDNQKNNKEELSN

SEQ ID NO: 3326084 - protein, 8 aa, Plasmodium falciparum
KTLDPNDK

SEQ ID NO: 3326085 - protein, 11 aa, Plasmodium falciparum
KTLEQREKEYN

SEQ ID NO: 3326086 - protein, 4 aa, Plasmodium falciparum
KTLG

SEQ ID NO: 3326087 - protein, 7 aa, Plasmodium falciparum
KTLKNTQ

SEQ ID NO: 3326088 - protein, 8 aa, Plasmodium falciparum
KTLKSKRT

SEQ ID NO: 3326089 - protein, 5 aa, Plasmodium falciparum
KTLKV

SEQ ID NO: 3326090 - protein, 13 aa, Plasmodium falciparum
KTLKYEENKDTNK

SEQ ID NO: 3326091 - protein, 9 aa, Plasmodium falciparum
KTLNSTNKT

SEQ ID NO: 3326092 - protein, 4 aa, Plasmodium falciparum
KTLP

SEQ ID NO: 3326093 - protein, 12 aa, Plasmodium falciparum
KTLPNKEKKKKR

SEQ ID NO: 3326094 - protein, 7 aa, Plasmodium falciparum
KTLPSTQ

SEQ ID NO: 3326095 - protein, 6 aa, Plasmodium falciparum
KTLRDT

SEQ ID NO: 3326096 - protein, 10 aa, Plasmodium falciparum
KTLSSSSYTN

SEQ ID NO: 3326097 - protein, 6 aa, Plasmodium falciparum
KTLTEE

SEQ ID NO: 3326098 - protein, 28 aa, Plasmodium falciparum
KTLTSNKDAGDKKNTKKVNKNDNKGNKE

SEQ ID NO: 3326099 - protein, 21 aa, Plasmodium falciparum
KTLTSQQQPTPVPNTERTEDN

SEQ ID NO: 3326100 - protein, 17 aa, Plasmodium falciparum
KTMEGSNYSFNGVPVNQ

SEQ ID NO: 3326101 - protein, 6 aa, Plasmodium falciparum
KTMENE

SEQ ID NO: 3326102 - protein, 30 aa, Plasmodium falciparum
KTMNEKNSSNNKNINPDTCNTSTQTDEVKQ

SEQ ID NO: 3326103 - protein, 5 aa, Plasmodium falciparum
KTMNP

SEQ ID NO: 3326104 - protein, 12 aa, Plasmodium falciparum
KTMQGRRKKQED

SEQ ID NO: 3326105 - protein, 6 aa, Plasmodium falciparum
KTMTTD

SEQ ID NO: 3326106 - protein, 4 aa, Plasmodium falciparum
KTND

SEQ ID NO: 3326107 - protein, 6 aa, Plasmodium falciparum
KTNDEK

SEQ ID NO: 3326108 - protein, 8 aa, Plasmodium falciparum
KTNDENNT

SEQ ID NO: 3326109 - protein, 24 aa, Plasmodium falciparum
KTNDENQIASTEIPQELSNDSPCL

SEQ ID NO: 3326110 - protein, 6 aa, Plasmodium falciparum
KTNDGV

SEQ ID NO: 3326111 - protein, 11 aa, Plasmodium falciparum
KTNDKEQKQLE

SEQ ID NO: 3326112 - protein, 37 aa, Plasmodium falciparum
KTNDLSNDEKYKKKKKKDKNVQNNNNIYNKNEKKTLG

SEQ ID NO: 3326113 - protein, 15 aa, Plasmodium falciparum
KTNDTNNNNNNNNNM

SEQ ID NO: 3326114 - protein, 5 aa, Plasmodium falciparum
KTNDY

SEQ ID NO: 3326115 - protein, 4 aa, Plasmodium falciparum
KTNE

SEQ ID NO: 3326116 - protein, 7 aa, Plasmodium falciparum
KTNEEEL

SEQ ID NO: 3326117 - protein, 6 aa, Plasmodium falciparum
KTNEGF

SEQ ID NO: 3326118 - protein, 12 aa, Plasmodium falciparum
KTNEHNKKSRDI

SEQ ID NO: 3326119 - protein, 10 aa, Plasmodium falciparum
KTNEKIPNSC

SEQ ID NO: 3326120 - protein, 6 aa, Plasmodium falciparum
KTNEKL

SEQ ID NO: 3326121 - protein, 12 aa, Plasmodium falciparum
KTNELNKGSNPF

SEQ ID NO: 3326122 - protein, 6 aa, Plasmodium falciparum
KTNEQL

SEQ ID NO: 3326123 - protein, 7 aa, Plasmodium falciparum
KTNEQMN

SEQ ID NO: 3326124 - protein, 6 aa, Plasmodium falciparum
KTNETN

SEQ ID NO: 3326125 - protein, 7 aa, Plasmodium falciparum
KTNETNN

SEQ ID NO: 3326126 - protein, 9 aa, Plasmodium falciparum
KTNFENESK

SEQ ID NO: 3326127 - protein, 17 aa, Plasmodium falciparum
KTNFGKPEWDNNSVEEK

SEQ ID NO: 3326128 - protein, 8 aa, Plasmodium falciparum
KTNGKKSS

SEQ ID NO: 3326129 - protein, 8 aa, Plasmodium falciparum
KTNGNIPE

SEQ ID NO: 3326130 - protein, 18 aa, Plasmodium falciparum
KTNHEKENKKKSDKSYYN

SEQ ID NO: 3326131 - protein, 4 aa, Plasmodium falciparum
KTNI

SEQ ID NO: 3326132 - protein, 24 aa, Plasmodium falciparum
KTNIENAHKENNDEIKNKNIPNKN

SEQ ID NO: 3326133 - protein, 6 aa, Plasmodium falciparum
KTNIKQ

SEQ ID NO: 3326134 - protein, 12 aa, Plasmodium falciparum
KTNKDIKNKIPK

SEQ ID NO: 3326135 - protein, 9 aa, Plasmodium falciparum
KTNKESNDL

SEQ ID NO: 3326136 - protein, 7 aa, Plasmodium falciparum
KTNKFND

SEQ ID NO: 3326137 - protein, 10 aa, Plasmodium falciparum
KTNKHDKPIE

SEQ ID NO: 3326138 - protein, 19 aa, Plasmodium falciparum
KTNKINNSNCNNNKDSDSN

SEQ ID NO: 3326139 - protein, 5 aa, Plasmodium falciparum
KTNKK

SEQ ID NO: 3326140 - protein, 5 aa, Plasmodium falciparum
KTNKN

SEQ ID NO: 3326141 - protein, 9 aa, Plasmodium falciparum
KTNKNKEDH

SEQ ID NO: 3326142 - protein, 6 aa, Plasmodium falciparum
KTNKNV

SEQ ID NO: 3326143 - protein, 7 aa, Plasmodium falciparum
KTNKQTF

SEQ ID NO: 3326144 - protein, 8 aa, Plasmodium falciparum
KTNKRSSE

SEQ ID NO: 3326145 - protein, 7 aa, Plasmodium falciparum
KTNKSEI

SEQ ID NO: 3326146 - protein, 16 aa, Plasmodium falciparum
KTNKVKTSNKNTVNNK

SEQ ID NO: 3326147 - protein, 8 aa, Plasmodium falciparum
KTNLKEKS

SEQ ID NO: 3326148 - protein, 5 aa, Plasmodium falciparum
KTNLN

SEQ ID NO: 3326149 - protein, 10 aa, Plasmodium falciparum
KTNLSKAETQ

SEQ ID NO: 3326150 - protein, 9 aa, Plasmodium falciparum
KTNMSNDNK

SEQ ID NO: 3326151 - protein, 12 aa, Plasmodium falciparum
KTNNDTNSIKDL

SEQ ID NO: 3326152 - protein, 11 aa, Plasmodium falciparum
KTNNEEDTINH

SEQ ID NO: 3326153 - protein, 11 aa, Plasmodium falciparum
KTNNEEEQKVD

SEQ ID NO: 3326154 - protein, 6 aa, Plasmodium falciparum
KTNNFP

SEQ ID NO: 3326155 - protein, 7 aa, Plasmodium falciparum
KTNNIKN

SEQ ID NO: 3326156 - protein, 7 aa, Plasmodium falciparum
KTNNINN

SEQ ID NO: 3326157 - protein, 11 aa, Plasmodium falciparum
KTNNKKRKRNI

SEQ ID NO: 3326158 - protein, 6 aa, Plasmodium falciparum
KTNNMN

SEQ ID NO: 3326159 - protein, 17 aa, Plasmodium falciparum
KTNNNIKNVDDNYNQKN

SEQ ID NO: 3326160 - protein, 6 aa, Plasmodium falciparum
KTNNPN

SEQ ID NO: 3326161 - protein, 21 aa, Plasmodium falciparum
KTNNPPEDSEVYRENSSDVEK

SEQ ID NO: 3326162 - protein, 6 aa, Plasmodium falciparum
KTNNSY

SEQ ID NO: 3326163 - protein, 7 aa, Plasmodium falciparum
KTNNTLT

SEQ ID NO: 3326164 - protein, 7 aa, Plasmodium falciparum
KTNPLKE

SEQ ID NO: 3326165 - protein, 8 aa, Plasmodium falciparum
KTNPNEEK

SEQ ID NO: 3326166 - protein, 25 aa, Plasmodium falciparum
KTNQKNREYSNSSLSSLSDAVTNNK

SEQ ID NO: 3326167 - protein, 10 aa, Plasmodium falciparum
KTNQPDNENM

SEQ ID NO: 3326168 - protein, 9 aa, Plasmodium falciparum
KTNQPNITN

SEQ ID NO: 3326169 - protein, 72 aa, Plasmodium falciparum
KTNQTNQTNQKKKKNQTNQTNQTNQTNQTNQTNQTNQTNQTNQTNQTNQTNQTNQTNQTNQTNQTNDKKEED

SEQ ID NO: 3326170 - protein, 6 aa, Plasmodium falciparum
KTNRKE

SEQ ID NO: 3326171 - protein, 15 aa, Plasmodium falciparum
KTNRTKKNKKLSNKL

SEQ ID NO: 3326172 - protein, 12 aa, Plasmodium falciparum
KTNRTKKSKKLY

SEQ ID NO: 3326173 - protein, 17 aa, Plasmodium falciparum
KTNRTYYPSNGYSNGYS

SEQ ID NO: 3326174 - protein, 6 aa, Plasmodium falciparum
KTNSDD

SEQ ID NO: 3326175 - protein, 6 aa, Plasmodium falciparum
KTNSKA

SEQ ID NO: 3326176 - protein, 7 aa, Plasmodium falciparum
KTNSMEN

SEQ ID NO: 3326177 - protein, 6 aa, Plasmodium falciparum
KTNSMN

SEQ ID NO: 3326178 - protein, 5 aa, Plasmodium falciparum
KTNTF

SEQ ID NO: 3326179 - protein, 13 aa, Plasmodium falciparum
KTNTGIENTKPTI

SEQ ID NO: 3326180 - protein, 10 aa, Plasmodium falciparum
KTNTHDEKYK

SEQ ID NO: 3326181 - protein, 10 aa, Plasmodium falciparum
KTNTQENEKN

SEQ ID NO: 3326182 - protein, 7 aa, Plasmodium falciparum
KTNTTNH

SEQ ID NO: 3326183 - protein, 4 aa, Plasmodium falciparum
KTNV

SEQ ID NO: 3326184 - protein, 49 aa, Plasmodium falciparum
KTNVESNKHDHNISSNNQMSTNQNQSSTQKNKNSYNSNKEQDTHTSNCN

SEQ ID NO: 3326185 - protein, 14 aa, Plasmodium falciparum
KTNYDNGYNNGSTK

SEQ ID NO: 3326186 - protein, 18 aa, Plasmodium falciparum
KTNYKKKSVPIKSRSSSY

SEQ ID NO: 3326187 - protein, 13 aa, Plasmodium falciparum
KTNYSSNKKREDY

SEQ ID NO: 3326188 - protein, 5 aa, Plasmodium falciparum
KTPEI

SEQ ID NO: 3326189 - protein, 6 aa, Plasmodium falciparum
KTPENN

SEQ ID NO: 3326190 - protein, 5 aa, Plasmodium falciparum
KTPFH

SEQ ID NO: 3326191 - protein, 5 aa, Plasmodium falciparum
KTPIN

SEQ ID NO: 3326192 - protein, 7 aa, Plasmodium falciparum
KTPLTKE

SEQ ID NO: 3326193 - protein, 13 aa, Plasmodium falciparum
KTPNNDKSLVKTG

SEQ ID NO: 3326194 - protein, 7 aa, Plasmodium falciparum
KTPPSCS

SEQ ID NO: 3326195 - protein, 6 aa, Plasmodium falciparum
KTPPYE

SEQ ID NO: 3326196 - protein, 6 aa, Plasmodium falciparum
KTPQEN

SEQ ID NO: 3326197 - protein, 19 aa, Plasmodium falciparum
KTPQSNSDGYIPQCSDDKG

SEQ ID NO: 3326198 - protein, 4 aa, Plasmodium falciparum
KTPR

SEQ ID NO: 3326199 - protein, 58 aa, Plasmodium falciparum
KTPRRNASNNKKKKINNKSKDDVIESKANTENTNNDDNNDDDNNKNNNNNNNNNNENY

SEQ ID NO: 3326200 - protein, 14 aa, Plasmodium falciparum
KTPSEEKNIDKNEE

SEQ ID NO: 3326201 - protein, 6 aa, Plasmodium falciparum
KTPSTT

SEQ ID NO: 3326202 - protein, 13 aa, Plasmodium falciparum
KTPSYNKNRKENM

SEQ ID NO: 3326203 - protein, 4 aa, Plasmodium falciparum
KTPT

SEQ ID NO: 3326204 - protein, 6 aa, Plasmodium falciparum
KTPTKD

SEQ ID NO: 3326205 - protein, 5 aa, Plasmodium falciparum
KTPTN

SEQ ID NO: 3326206 - protein, 5 aa, Plasmodium falciparum
KTPYI

SEQ ID NO: 3326207 - protein, 16 aa, Plasmodium falciparum
KTQDNKNVHEKNEEPK

SEQ ID NO: 3326208 - protein, 5 aa, Plasmodium falciparum
KTQFS

SEQ ID NO: 3326209 - protein, 24 aa, Plasmodium falciparum
KTQITNNNNNNNDNYINNNNNNNN

SEQ ID NO: 3326210 - protein, 4 aa, Plasmodium falciparum
KTQK

SEQ ID NO: 3326211 - protein, 41 aa, Plasmodium falciparum
KTQKENNLNGNKNADVTHGSTSQDRQINNEDHKNVNNTQIN

SEQ ID NO: 3326212 - protein, 6 aa, Plasmodium falciparum
KTQKGV

SEQ ID NO: 3326213 - protein, 5 aa, Plasmodium falciparum
KTQKI

SEQ ID NO: 3326214 - protein, 7 aa, Plasmodium falciparum
KTQKTGS

SEQ ID NO: 3326215 - protein, 5 aa, Plasmodium falciparum
KTQNI

SEQ ID NO: 3326216 - protein, 5 aa, Plasmodium falciparum
KTQNN

SEQ ID NO: 3326217 - protein, 4 aa, Plasmodium falciparum
KTQP

SEQ ID NO: 3326218 - protein, 5 aa, Plasmodium falciparum
KTQPK

SEQ ID NO: 3326219 - protein, 9 aa, Plasmodium falciparum
KTQSSKNMR

SEQ ID NO: 3326220 - protein, 5 aa, Plasmodium falciparum
KTQTL

SEQ ID NO: 3326221 - protein, 17 aa, Plasmodium falciparum
KTQVNSKKTTNISNDKR

SEQ ID NO: 3326222 - protein, 38 aa, Plasmodium falciparum
KTRDKASKDDDNNNNNNKNDGNNKNDDDHHKNNDDSVE

SEQ ID NO: 3326223 - protein, 7 aa, Plasmodium falciparum
KTRFGPT

SEQ ID NO: 3326224 - protein, 5 aa, Plasmodium falciparum
KTRGE

SEQ ID NO: 3326225 - protein, 4 aa, Plasmodium falciparum
KTRI

SEQ ID NO: 3326226 - protein, 13 aa, Plasmodium falciparum
KTRKFNISSFNED

SEQ ID NO: 3326227 - protein, 6 aa, Plasmodium falciparum
KTRPFT

SEQ ID NO: 3326228 - protein, 78 aa, Plasmodium falciparum
KTRRGNEENEENGKNEENGKNEKNEENGKNEKNEENGKNEKNEKNEENGKNGKNGKNEKNEENGKNEQNEEDKVDKEY

SEQ ID NO: 3326229 - protein, 18 aa, Plasmodium falciparum
KTRSGGSQYGSNKSGGQL

SEQ ID NO: 3326230 - protein, 6 aa, Plasmodium falciparum
KTSATN

SEQ ID NO: 3326231 - protein, 4 aa, Plasmodium falciparum
KTSC

SEQ ID NO: 3326232 - protein, 7 aa, Plasmodium falciparum
KTSDANI

SEQ ID NO: 3326233 - protein, 14 aa, Plasmodium falciparum
KTSDGRNKERFGTT

SEQ ID NO: 3326234 - protein, 5 aa, Plasmodium falciparum
KTSDK

SEQ ID NO: 3326235 - protein, 6 aa, Plasmodium falciparum
KTSDPC

SEQ ID NO: 3326236 - protein, 5 aa, Plasmodium falciparum
KTSEF

SEQ ID NO: 3326237 - protein, 8 aa, Plasmodium falciparum
KTSEKLNN

SEQ ID NO: 3326238 - protein, 5 aa, Plasmodium falciparum
KTSEL

SEQ ID NO: 3326239 - protein, 15 aa, Plasmodium falciparum
KTSENYNISNNNNKC

SEQ ID NO: 3326240 - protein, 7 aa, Plasmodium falciparum
KTSETGY

SEQ ID NO: 3326241 - protein, 6 aa, Plasmodium falciparum
KTSGNM

SEQ ID NO: 3326242 - protein, 4 aa, Plasmodium falciparum
KTSI

SEQ ID NO: 3326243 - protein, 28 aa, Plasmodium falciparum
KTSKKYKNKKNKIKNNNNNNNNNNSSRS

SEQ ID NO: 3326244 - protein, 9 aa, Plasmodium falciparum
KTSKNEEDA

SEQ ID NO: 3326245 - protein, 6 aa, Plasmodium falciparum
KTSKVN

SEQ ID NO: 3326246 - protein, 8 aa, Plasmodium falciparum
KTSLDNDH

SEQ ID NO: 3326247 - protein, 4 aa, Plasmodium falciparum
KTSM

SEQ ID NO: 3326248 - protein, 4 aa, Plasmodium falciparum
KTSN

SEQ ID NO: 3326249 - protein, 17 aa, Plasmodium falciparum
KTSNNNNNNSYNNYNNY

SEQ ID NO: 3326250 - protein, 6 aa, Plasmodium falciparum
KTSNTH

SEQ ID NO: 3326251 - protein, 4 aa, Plasmodium falciparum
KTSP

SEQ ID NO: 3326252 - protein, 10 aa, Plasmodium falciparum
KTSQLENSNN

SEQ ID NO: 3326253 - protein, 26 aa, Plasmodium falciparum
KTSRHRKRKSLNSQSSKITDFFKKTM

SEQ ID NO: 3326254 - protein, 6 aa, Plasmodium falciparum
KTSSGI

SEQ ID NO: 3326255 - protein, 15 aa, Plasmodium falciparum
KTSSGKVPVNATPGA

SEQ ID NO: 3326256 - protein, 5 aa, Plasmodium falciparum
KTSSM

SEQ ID NO: 3326257 - protein, 11 aa, Plasmodium falciparum
KTSTSKSTSII

SEQ ID NO: 3326258 - protein, 13 aa, Plasmodium falciparum
KTSTTKNNSNNYH

SEQ ID NO: 3326259 - protein, 9 aa, Plasmodium falciparum
KTSTTNINN

SEQ ID NO: 3326260 - protein, 36 aa, Plasmodium falciparum
KTSVPNEDENNTNTINKTKNIESPNNNSLNNSESNV

SEQ ID NO: 3326261 - protein, 50 aa, Plasmodium falciparum
KTSVQETSKSIKNHNVTTGRKETKGTIQKKDTITSSKTNKNKELHEKNVD

SEQ ID NO: 3326262 - protein, 7 aa, Plasmodium falciparum
KTSVQNK

SEQ ID NO: 3326263 - protein, 8 aa, Plasmodium falciparum
KTSYSKKN

SEQ ID NO: 3326264 - protein, 9 aa, Plasmodium falciparum
KTSYSTKKR

SEQ ID NO: 3326265 - protein, 7 aa, Plasmodium falciparum
KTTDEIN

SEQ ID NO: 3326266 - protein, 17 aa, Plasmodium falciparum
KTTDHENDKDKKIDKEG

SEQ ID NO: 3326267 - protein, 17 aa, Plasmodium falciparum
KTTDNTYTNTDNKTHVS

SEQ ID NO: 3326268 - protein, 27 aa, Plasmodium falciparum
KTTEKTDEKTDEKEDDKEKQKTSEENK

SEQ ID NO: 3326269 - protein, 6 aa, Plasmodium falciparum
KTTHKK

SEQ ID NO: 3326270 - protein, 5 aa, Plasmodium falciparum
KTTIS

SEQ ID NO: 3326271 - protein, 10 aa, Plasmodium falciparum
KTTISNNNKS

SEQ ID NO: 3326272 - protein, 4 aa, Plasmodium falciparum
KTTK

SEQ ID NO: 3326273 - protein, 6 aa, Plasmodium falciparum
KTTKES

SEQ ID NO: 3326274 - protein, 12 aa, Plasmodium falciparum
KTTKKENDETNN

SEQ ID NO: 3326275 - protein, 9 aa, Plasmodium falciparum
KTTKTKKEL

SEQ ID NO: 3326276 - protein, 4 aa, Plasmodium falciparum
KTTM

SEQ ID NO: 3326277 - protein, 4 aa, Plasmodium falciparum
KTTN

SEQ ID NO: 3326278 - protein, 8 aa, Plasmodium falciparum
KTTNITSE

SEQ ID NO: 3326279 - protein, 11 aa, Plasmodium falciparum
KTTPLPENTNE

SEQ ID NO: 3326280 - protein, 26 aa, Plasmodium falciparum
KTTRDKNETLEEKKERKKAVKEAQRL

SEQ ID NO: 3326281 - protein, 6 aa, Plasmodium falciparum
KTTSGF

SEQ ID NO: 3326282 - protein, 7 aa, Plasmodium falciparum
KTTSSIN

SEQ ID NO: 3326283 - protein, 5 aa, Plasmodium falciparum
KTTVY

SEQ ID NO: 3326284 - protein, 6 aa, Plasmodium falciparum
KTVEGN

SEQ ID NO: 3326285 - protein, 10 aa, Plasmodium falciparum
KTVKKNKKKI

SEQ ID NO: 3326286 - protein, 22 aa, Plasmodium falciparum
KTVPENKTSNEQKEQPEENSAV

SEQ ID NO: 3326287 - protein, 6 aa, Plasmodium falciparum
KTVPSQ

SEQ ID NO: 3326288 - protein, 12 aa, Plasmodium falciparum
KTVRKGTSTSIK

SEQ ID NO: 3326289 - protein, 5 aa, Plasmodium falciparum
KTVSG

SEQ ID NO: 3326290 - protein, 8 aa, Plasmodium falciparum
KTVSPKLK

SEQ ID NO: 3326291 - protein, 7 aa, Plasmodium falciparum
KTVSSSI

SEQ ID NO: 3326292 - protein, 7 aa, Plasmodium falciparum
KTVSTPN

SEQ ID NO: 3326293 - protein, 22 aa, Plasmodium falciparum
KTVYESQNETISNTDAKSSERL

SEQ ID NO: 3326294 - protein, 8 aa, Plasmodium falciparum
KTWEKPKE

SEQ ID NO: 3326295 - protein, 58 aa, Plasmodium falciparum
KTWTDEKKEPNTNNTNRGNKNGKNINTSSKKDNDQLNKNIKEERSKGQIKNERNNKIE

SEQ ID NO: 3326296 - protein, 10 aa, Plasmodium falciparum
KTYDNMNKSN

SEQ ID NO: 3326297 - protein, 5 aa, Plasmodium falciparum
KTYEE

SEQ ID NO: 3326298 - protein, 15 aa, Plasmodium falciparum
KTYEIESEKYGKSIS

SEQ ID NO: 3326299 - protein, 5 aa, Plasmodium falciparum
KTYGN

SEQ ID NO: 3326300 - protein, 7 aa, Plasmodium falciparum
KTYNDPD

SEQ ID NO: 3326301 - protein, 7 aa, Plasmodium falciparum
KTYNNKT

SEQ ID NO: 3326302 - protein, 7 aa, Plasmodium falciparum
KTYNYEN

SEQ ID NO: 3326303 - protein, 7 aa, Plasmodium falciparum
KTYPNSE

SEQ ID NO: 3326304 - protein, 7 aa, Plasmodium falciparum
KTYPYDD

SEQ ID NO: 3326305 - protein, 14 aa, Plasmodium falciparum
KTYQYKNESIKNEI

SEQ ID NO: 3326306 - protein, 8 aa, Plasmodium falciparum
KTYSNEYE

SEQ ID NO: 3326307 - protein, 6 aa, Plasmodium falciparum
KTYSSG

SEQ ID NO: 3326308 - protein, 13 aa, Plasmodium falciparum
KTYSTKKNRVSSR

SEQ ID NO: 3326309 - protein, 4 aa, Plasmodium falciparum
KTYT

SEQ ID NO: 3326310 - protein, 7 aa, Plasmodium falciparum
KTYTNKL

SEQ ID NO: 3326311 - protein, 5 aa, Plasmodium falciparum
KTYTQ

SEQ ID NO: 3326312 - protein, 8 aa, Plasmodium falciparum
KTYTQDDH

SEQ ID NO: 3326313 - protein, 5 aa, Plasmodium falciparum
KTYYE

SEQ ID NO: 3326314 - protein, 5 aa, Plasmodium falciparum
KTYYH

SEQ ID NO: 3326315 - protein, 6 aa, Plasmodium falciparum
KVAKRR

SEQ ID NO: 3326316 - protein, 8 aa, Plasmodium falciparum
KVAPSDIE

SEQ ID NO: 3326317 - protein, 11 aa, Plasmodium falciparum
KVDANNNPDMQ

SEQ ID NO: 3326318 - protein, 4 aa, Plasmodium falciparum
KVDD

SEQ ID NO: 3326319 - protein, 24 aa, Plasmodium falciparum
KVDDKEHIHDENKKNSSDDYKNNT

SEQ ID NO: 3326320 - protein, 24 aa, Plasmodium falciparum
KVDDNNKKTIPSVNNKEDSNNKIG

SEQ ID NO: 3326321 - protein, 7 aa, Plasmodium falciparum
KVDEEKK

SEQ ID NO: 3326322 - protein, 10 aa, Plasmodium falciparum
KVDENFTKNN

SEQ ID NO: 3326323 - protein, 5 aa, Plasmodium falciparum
KVDGD

SEQ ID NO: 3326324 - protein, 5 aa, Plasmodium falciparum
KVDHK

SEQ ID NO: 3326325 - protein, 4 aa, Plasmodium falciparum
KVDN

SEQ ID NO: 3326326 - protein, 6 aa, Plasmodium falciparum
KVDNED

SEQ ID NO: 3326327 - protein, 12 aa, Plasmodium falciparum
KVDNSNNNPTNN

SEQ ID NO: 3326328 - protein, 13 aa, Plasmodium falciparum
KVDPIKEDSNNRV

SEQ ID NO: 3326329 - protein, 8 aa, Plasmodium falciparum
KVDRNNNE

SEQ ID NO: 3326330 - protein, 13 aa, Plasmodium falciparum
KVEDEKKEFKKKS

SEQ ID NO: 3326331 - protein, 15 aa, Plasmodium falciparum
KVEDQKNKKDISSTN

SEQ ID NO: 3326332 - protein, 13 aa, Plasmodium falciparum
KVEEDEKNNNIQV

SEQ ID NO: 3326333 - protein, 25 aa, Plasmodium falciparum
KVEEKKKEVEKPIKPKEQSFDKSRR

SEQ ID NO: 3326334 - protein, 6 aa, Plasmodium falciparum
KVEEKN

SEQ ID NO: 3326335 - protein, 57 aa, Plasmodium falciparum
KVEEKNKKKRHVNKKKKKKKYDIKKDDDNKKDDDNKKDDDNKKDGDNKKDDDNKIYG

SEQ ID NO: 3326336 - protein, 6 aa, Plasmodium falciparum
KVEENK

SEQ ID NO: 3326337 - protein, 6 aa, Plasmodium falciparum
KVEGNI

SEQ ID NO: 3326338 - protein, 15 aa, Plasmodium falciparum
KVEKDKDKDHNNSTN

SEQ ID NO: 3326339 - protein, 34 aa, Plasmodium falciparum
KVENEGDTTKVGEVQKGVSETQKKEVGNKAIEKD

SEQ ID NO: 3326340 - protein, 10 aa, Plasmodium falciparum
KVENEKNNLI

SEQ ID NO: 3326341 - protein, 25 aa, Plasmodium falciparum
KVENKEEKKINDSTYVKEEGKKCRD

SEQ ID NO: 3326342 - protein, 18 aa, Plasmodium falciparum
KVENNSKKIDNPNNNNNM

SEQ ID NO: 3326343 - protein, 8 aa, Plasmodium falciparum
KVEPKSEQ

SEQ ID NO: 3326344 - protein, 45 aa, Plasmodium falciparum
KVEPNEYNKEENEKNKKYNNNDNNNNNNENNKNAKYDIEKEEENI

SEQ ID NO: 3326345 - protein, 13 aa, Plasmodium falciparum
KVEQDDGKYNKSI

SEQ ID NO: 3326346 - protein, 25 aa, Plasmodium falciparum
KVETNKGNKKKNKTNNNNNNNNNVL

SEQ ID NO: 3326347 - protein, 4 aa, Plasmodium falciparum
KVGD

SEQ ID NO: 3326348 - protein, 32 aa, Plasmodium falciparum
KVGDDDDDNNNNNNNNKSDDSKTNDDNKIKKN

SEQ ID NO: 3326349 - protein, 6 aa, Plasmodium falciparum
KVGEER

SEQ ID NO: 3326350 - protein, 5 aa, Plasmodium falciparum
KVGIS

SEQ ID NO: 3326351 - protein, 15 aa, Plasmodium falciparum
KVGKEGTITVTEGKT

SEQ ID NO: 3326352 - protein, 8 aa, Plasmodium falciparum
KVGNALNA

SEQ ID NO: 3326353 - protein, 7 aa, Plasmodium falciparum
KVGNSNR

SEQ ID NO: 3326354 - protein, 4 aa, Plasmodium falciparum
KVGS

SEQ ID NO: 3326355 - protein, 5 aa, Plasmodium falciparum
KVHGD

SEQ ID NO: 3326356 - protein, 16 aa, Plasmodium falciparum
KVHGKGTLTYSKGDKY

SEQ ID NO: 3326357 - protein, 21 aa, Plasmodium falciparum
KVKAAKVKGGVSNKQKLKSKK

SEQ ID NO: 3326358 - protein, 5 aa, Plasmodium falciparum
KVKDN

SEQ ID NO: 3326359 - protein, 10 aa, Plasmodium falciparum
KVKEGNTESN

SEQ ID NO: 3326360 - protein, 31 aa, Plasmodium falciparum
KVKENNNKKVKEDNNKKVKEDNNKKIKEDNK

SEQ ID NO: 3326361 - protein, 60 aa, Plasmodium falciparum
KVKGNNIQQGNIHEKQDSNVNTQEDLKKENKNITKNTTNNNYSDNNNNNDDDDDDDDDDD

SEQ ID NO: 3326362 - protein, 10 aa, Plasmodium falciparum
KVKKGSRGGW

SEQ ID NO: 3326363 - protein, 29 aa, Plasmodium falciparum
KVKKKKVSNNKKKNSASSNDGYNEQNYDT

SEQ ID NO: 3326364 - protein, 4 aa, Plasmodium falciparum
KVKN

SEQ ID NO: 3326365 - protein, 6 aa, Plasmodium falciparum
KVKNDQ

SEQ ID NO: 3326366 - protein, 14 aa, Plasmodium falciparum
KVKNEKEDIDKHQP

SEQ ID NO: 3326367 - protein, 16 aa, Plasmodium falciparum
KVKNPNDTVKILRENF

SEQ ID NO: 3326368 - protein, 8 aa, Plasmodium falciparum
KVKQQDGE

SEQ ID NO: 3326369 - protein, 4 aa, Plasmodium falciparum
KVKR

SEQ ID NO: 3326370 - protein, 10 aa, Plasmodium falciparum
KVKSGKNSVA

SEQ ID NO: 3326371 - protein, 8 aa, Plasmodium falciparum
KVKSKADE

SEQ ID NO: 3326372 - protein, 16 aa, Plasmodium falciparum
KVKSSESSSHDQSSEE

SEQ ID NO: 3326373 - protein, 18 aa, Plasmodium falciparum
KVKTTSAHTSSSNSQDNL

SEQ ID NO: 3326374 - protein, 5 aa, Plasmodium falciparum
KVNDG

SEQ ID NO: 3326375 - protein, 6 aa, Plasmodium falciparum
KVNDPT

SEQ ID NO: 3326376 - protein, 8 aa, Plasmodium falciparum
KVNEDQTN

SEQ ID NO: 3326377 - protein, 8 aa, Plasmodium falciparum
KVNEEKRP

SEQ ID NO: 3326378 - protein, 11 aa, Plasmodium falciparum
KVNEKSETEIE

SEQ ID NO: 3326379 - protein, 6 aa, Plasmodium falciparum
KVNEQG

SEQ ID NO: 3326380 - protein, 34 aa, Plasmodium falciparum
KVNGDTNSSINENYNNNDNNNNNSTTTTNNNNNN

SEQ ID NO: 3326381 - protein, 4 aa, Plasmodium falciparum
KVNK

SEQ ID NO: 3326382 - protein, 9 aa, Plasmodium falciparum
KVNKNDKVN

SEQ ID NO: 3326383 - protein, 10 aa, Plasmodium falciparum
KVNKNINDEI

SEQ ID NO: 3326384 - protein, 10 aa, Plasmodium falciparum
KVNKRRKQNP

SEQ ID NO: 3326385 - protein, 6 aa, Plasmodium falciparum
KVNKSL

SEQ ID NO: 3326386 - protein, 8 aa, Plasmodium falciparum
KVNNEKNK

SEQ ID NO: 3326387 - protein, 12 aa, Plasmodium falciparum
KVNNKNNDNKIQ

SEQ ID NO: 3326388 - protein, 18 aa, Plasmodium falciparum
KVNNNNNNNNNNKQQLYR

SEQ ID NO: 3326389 - protein, 13 aa, Plasmodium falciparum
KVNNSSFSKGKMG

SEQ ID NO: 3326390 - protein, 8 aa, Plasmodium falciparum
KVNNTNDI

SEQ ID NO: 3326391 - protein, 6 aa, Plasmodium falciparum
KVNPSV

SEQ ID NO: 3326392 - protein, 8 aa, Plasmodium falciparum
KVNPTGDI

SEQ ID NO: 3326393 - protein, 10 aa, Plasmodium falciparum
KVNQENKTDM

SEQ ID NO: 3326394 - protein, 8 aa, Plasmodium falciparum
KVNSKDMN

SEQ ID NO: 3326395 - protein, 13 aa, Plasmodium falciparum
KVNSKNKENNNNH

SEQ ID NO: 3326396 - protein, 13 aa, Plasmodium falciparum
KVNSSSEKSDPCD

SEQ ID NO: 3326397 - protein, 6 aa, Plasmodium falciparum
KVNSTI

SEQ ID NO: 3326398 - protein, 7 aa, Plasmodium falciparum
KVNTKNV

SEQ ID NO: 3326399 - protein, 4 aa, Plasmodium falciparum
KVNV

SEQ ID NO: 3326400 - protein, 8 aa, Plasmodium falciparum
KVPKNEDI

SEQ ID NO: 3326401 - protein, 4 aa, Plasmodium falciparum
KVPS

SEQ ID NO: 3326402 - protein, 6 aa, Plasmodium falciparum
KVPSEN

SEQ ID NO: 3326403 - protein, 6 aa, Plasmodium falciparum
KVPSKY

SEQ ID NO: 3326404 - protein, 6 aa, Plasmodium falciparum
KVPSSE

SEQ ID NO: 3326405 - protein, 6 aa, Plasmodium falciparum
KVPTGI

SEQ ID NO: 3326406 - protein, 7 aa, Plasmodium falciparum
KVQEDPL

SEQ ID NO: 3326407 - protein, 6 aa, Plasmodium falciparum
KVQGIT

SEQ ID NO: 3326408 - protein, 30 aa, Plasmodium falciparum
KVQNADEIEENKEKKNIVNDEKEKAKQKKL

SEQ ID NO: 3326409 - protein, 9 aa, Plasmodium falciparum
KVQNATKEN

SEQ ID NO: 3326410 - protein, 11 aa, Plasmodium falciparum
KVQNLDNKNTM

SEQ ID NO: 3326411 - protein, 49 aa, Plasmodium falciparum
KVQNSKKNKINKNNNNNNNNDDGNNTVTYDEDKIDEGQNLSSDEKKKTS

SEQ ID NO: 3326412 - protein, 8 aa, Plasmodium falciparum
KVRAGKQY

SEQ ID NO: 3326413 - protein, 20 aa, Plasmodium falciparum
KVREENNNEEKKENITNNDN

SEQ ID NO: 3326414 - protein, 13 aa, Plasmodium falciparum
KVRKPNEEKHLKK

SEQ ID NO: 3326415 - protein, 12 aa, Plasmodium falciparum
KVSEDTGSTRTK

SEQ ID NO: 3326416 - protein, 21 aa, Plasmodium falciparum
KVSERNKNKIEKINDTNSKII

SEQ ID NO: 3326417 - protein, 14 aa, Plasmodium falciparum
KVSFDEPKAPVNKL

SEQ ID NO: 3326418 - protein, 6 aa, Plasmodium falciparum
KVSGGL

SEQ ID NO: 3326419 - protein, 5 aa, Plasmodium falciparum
KVSIT

SEQ ID NO: 3326420 - protein, 5 aa, Plasmodium falciparum
KVSKL

SEQ ID NO: 3326421 - protein, 47 aa, Plasmodium falciparum
KVSKNSKTEYASDIASNADMNTAEDYDMTNGSINEDGQGKRKRKKIS

SEQ ID NO: 3326422 - protein, 10 aa, Plasmodium falciparum
KVSNLSNDIS

SEQ ID NO: 3326423 - protein, 7 aa, Plasmodium falciparum
KVSQEID

SEQ ID NO: 3326424 - protein, 7 aa, Plasmodium falciparum
KVSQRRD

SEQ ID NO: 3326425 - protein, 6 aa, Plasmodium falciparum
KVSSYK

SEQ ID NO: 3326426 - protein, 21 aa, Plasmodium falciparum
KVSTKKNNKLKQLTKAGKDLE

SEQ ID NO: 3326427 - protein, 6 aa, Plasmodium falciparum
KVSYND

SEQ ID NO: 3326428 - protein, 13 aa, Plasmodium falciparum
KVTNGKPVNLKSG

SEQ ID NO: 3326429 - protein, 56 aa, Plasmodium falciparum
KVTSEGLSDTQPNVTQSVSSSTHTPGSLDSTMSTEQHSSVSQSSLPTESSSETLNK

SEQ ID NO: 3326430 - protein, 6 aa, Plasmodium falciparum
KVTTQR

SEQ ID NO: 3326431 - protein, 13 aa, Plasmodium falciparum
KVVKSKKELPRKK

SEQ ID NO: 3326432 - protein, 11 aa, Plasmodium falciparum
KVVNNTPVNNT

SEQ ID NO: 3326433 - protein, 6 aa, Plasmodium falciparum
KVWPDN

SEQ ID NO: 3326434 - protein, 14 aa, Plasmodium falciparum
KVYKESDKISNYNY

SEQ ID NO: 3326435 - protein, 4 aa, Plasmodium falciparum
KVYQ

SEQ ID NO: 3326436 - protein, 5 aa, Plasmodium falciparum
KWDEN

SEQ ID NO: 3326437 - protein, 4 aa, Plasmodium falciparum
KWEN

SEQ ID NO: 3326438 - protein, 5 aa, Plasmodium falciparum
KWGGS

SEQ ID NO: 3326439 - protein, 7 aa, Plasmodium falciparum
KWGTGKI

SEQ ID NO: 3326440 - protein, 10 aa, Plasmodium falciparum
KWNNKKNKSF

SEQ ID NO: 3326441 - protein, 20 aa, Plasmodium falciparum
KWRPRDKRGQISDSPYPSSE

SEQ ID NO: 3326442 - protein, 7 aa, Plasmodium falciparum
KWSNDGA

SEQ ID NO: 3326443 - protein, 5 aa, Plasmodium falciparum
KWTNE

SEQ ID NO: 3326444 - protein, 5 aa, Plasmodium falciparum
KYADD

SEQ ID NO: 3326445 - protein, 16 aa, Plasmodium falciparum
KYADGTIDTNKRLSKE

SEQ ID NO: 3326446 - protein, 8 aa, Plasmodium falciparum
KYANNKSN

SEQ ID NO: 3326447 - protein, 21 aa, Plasmodium falciparum
KYANQDNQKETSSSDTSSDDD

SEQ ID NO: 3326448 - protein, 4 aa, Plasmodium falciparum
KYAP

SEQ ID NO: 3326449 - protein, 15 aa, Plasmodium falciparum
KYAPREESKSNETYS

SEQ ID NO: 3326450 - protein, 5 aa, Plasmodium falciparum
KYAPY

SEQ ID NO: 3326451 - protein, 7 aa, Plasmodium falciparum
KYASDNV

SEQ ID NO: 3326452 - protein, 6 aa, Plasmodium falciparum
KYASPI

SEQ ID NO: 3326453 - protein, 4 aa, Plasmodium falciparum
KYAT

SEQ ID NO: 3326454 - protein, 7 aa, Plasmodium falciparum
KYCNDEN

SEQ ID NO: 3326455 - protein, 21 aa, Plasmodium falciparum
KYCSSPEKNERPKKDTNIYST

SEQ ID NO: 3326456 - protein, 8 aa, Plasmodium falciparum
KYDARRDE

SEQ ID NO: 3326457 - protein, 8 aa, Plasmodium falciparum
KYDATNLK

SEQ ID NO: 3326458 - protein, 12 aa, Plasmodium falciparum
KYDDDDNNKETN

SEQ ID NO: 3326459 - protein, 12 aa, Plasmodium falciparum
KYDDENNLTQNG

SEQ ID NO: 3326460 - protein, 6 aa, Plasmodium falciparum
KYDDLQ

SEQ ID NO: 3326461 - protein, 11 aa, Plasmodium falciparum
KYDDQNAKEKF

SEQ ID NO: 3326462 - protein, 8 aa, Plasmodium falciparum
KYDEGKGR

SEQ ID NO: 3326463 - protein, 5 aa, Plasmodium falciparum
KYDEK

SEQ ID NO: 3326464 - protein, 8 aa, Plasmodium falciparum
KYDEKNNS

SEQ ID NO: 3326465 - protein, 9 aa, Plasmodium falciparum
KYDETDNNM

SEQ ID NO: 3326466 - protein, 6 aa, Plasmodium falciparum
KYDGLK

SEQ ID NO: 3326467 - protein, 12 aa, Plasmodium falciparum
KYDHNDKDKIEH

SEQ ID NO: 3326468 - protein, 4 aa, Plasmodium falciparum
KYDK

SEQ ID NO: 3326469 - protein, 8 aa, Plasmodium falciparum
KYDKEQED

SEQ ID NO: 3326470 - protein, 6 aa, Plasmodium falciparum
KYDKGE

SEQ ID NO: 3326471 - protein, 50 aa, Plasmodium falciparum
KYDKKESNSNDENKNDRGNEKDRKNNSDIENNSDSEYINDKEKDRKKRKH

SEQ ID NO: 3326472 - protein, 7 aa, Plasmodium falciparum
KYDKKYD

SEQ ID NO: 3326473 - protein, 9 aa, Plasmodium falciparum
KYDKNKTTF

SEQ ID NO: 3326474 - protein, 19 aa, Plasmodium falciparum
KYDKNNVDNKKDVNTSDTK

SEQ ID NO: 3326475 - protein, 5 aa, Plasmodium falciparum
KYDKY

SEQ ID NO: 3326476 - protein, 28 aa, Plasmodium falciparum
KYDKYDKYEKYEKYDKYEKYDKYEKYDR

SEQ ID NO: 3326477 - protein, 10 aa, Plasmodium falciparum
KYDNDNKRNY

SEQ ID NO: 3326478 - protein, 5 aa, Plasmodium falciparum
KYDNI

SEQ ID NO: 3326479 - protein, 7 aa, Plasmodium falciparum
KYDNKVS

SEQ ID NO: 3326480 - protein, 7 aa, Plasmodium falciparum
KYDNNHN

SEQ ID NO: 3326481 - protein, 4 aa, Plasmodium falciparum
KYDQ

SEQ ID NO: 3326482 - protein, 7 aa, Plasmodium falciparum
KYDSETG

SEQ ID NO: 3326483 - protein, 62 aa, Plasmodium falciparum
KYDSKEKQNKEKSTSEKQTGKKLASEKNNEEKLTNGKINEDKLNNEKNNEDKLNNNRELSDE

SEQ ID NO: 3326484 - protein, 11 aa, Plasmodium falciparum
KYDSNKINNMD

SEQ ID NO: 3326485 - protein, 55 aa, Plasmodium falciparum
KYDSTYEKKYDRSYDKKYDKSYDKKYDSSYEKKYDSAYEKKYDSSYEKKYDSAYE

SEQ ID NO: 3326486 - protein, 11 aa, Plasmodium falciparum
KYDTDGKNYNV

SEQ ID NO: 3326487 - protein, 6 aa, Plasmodium falciparum
KYDTNY

SEQ ID NO: 3326488 - protein, 36 aa, Plasmodium falciparum
KYDYNDDDNDDKDDDDDNDDNDNDNDDNDDDDNEYT

SEQ ID NO: 3326489 - protein, 4 aa, Plasmodium falciparum
KYED

SEQ ID NO: 3326490 - protein, 12 aa, Plasmodium falciparum
KYEDNDSNTDYT

SEQ ID NO: 3326491 - protein, 11 aa, Plasmodium falciparum
KYEDNNKNDGK

SEQ ID NO: 3326492 - protein, 57 aa, Plasmodium falciparum
KYEDQEEDENDAEEPDEDHDQEEEEEEDDDEEDDEEADDEVDDEKEIDTYDENDDNI

SEQ ID NO: 3326493 - protein, 12 aa, Plasmodium falciparum
KYEDSNSSDDYK

SEQ ID NO: 3326494 - protein, 6 aa, Plasmodium falciparum
KYEEDK

SEQ ID NO: 3326495 - protein, 8 aa, Plasmodium falciparum
KYEEEGEK

SEQ ID NO: 3326496 - protein, 8 aa, Plasmodium falciparum
KYEEEHGP

SEQ ID NO: 3326497 - protein, 20 aa, Plasmodium falciparum
KYEEERNNMKNEEDKSDGDD

SEQ ID NO: 3326498 - protein, 6 aa, Plasmodium falciparum
KYEEES

SEQ ID NO: 3326499 - protein, 10 aa, Plasmodium falciparum
KYEEKSKTPF

SEQ ID NO: 3326500 - protein, 38 aa, Plasmodium falciparum
KYEEQKRKTEKEKEKEKVKEKENVKESEKEKEKQNSNY

SEQ ID NO: 3326501 - protein, 6 aa, Plasmodium falciparum
KYEESI

SEQ ID NO: 3326502 - protein, 6 aa, Plasmodium falciparum
KYEESY

SEQ ID NO: 3326503 - protein, 5 aa, Plasmodium falciparum
KYEIN

SEQ ID NO: 3326504 - protein, 17 aa, Plasmodium falciparum
KYEKDSSSTNPAKINHP

SEQ ID NO: 3326505 - protein, 5 aa, Plasmodium falciparum
KYEKE

SEQ ID NO: 3326506 - protein, 5 aa, Plasmodium falciparum
KYEKN

SEQ ID NO: 3326507 - protein, 8 aa, Plasmodium falciparum
KYEKNDEH

SEQ ID NO: 3326508 - protein, 9 aa, Plasmodium falciparum
KYEKPDTHK

SEQ ID NO: 3326509 - protein, 12 aa, Plasmodium falciparum
KYEKPEEENEQI

SEQ ID NO: 3326510 - protein, 6 aa, Plasmodium falciparum
KYEKQK

SEQ ID NO: 3326511 - protein, 7 aa, Plasmodium falciparum
KYEKTKT

SEQ ID NO: 3326512 - protein, 24 aa, Plasmodium falciparum
KYEKTSNNYKKYKRKNKKSRKRYE

SEQ ID NO: 3326513 - protein, 13 aa, Plasmodium falciparum
KYENENKNMHTNN

SEQ ID NO: 3326514 - protein, 5 aa, Plasmodium falciparum
KYENN

SEQ ID NO: 3326515 - protein, 6 aa, Plasmodium falciparum
KYENNI

SEQ ID NO: 3326516 - protein, 14 aa, Plasmodium falciparum
KYENNNNEYNNDKY

SEQ ID NO: 3326517 - protein, 5 aa, Plasmodium falciparum
KYENR

SEQ ID NO: 3326518 - protein, 11 aa, Plasmodium falciparum
KYENRKMTTDN

SEQ ID NO: 3326519 - protein, 17 aa, Plasmodium falciparum
KYENTDENEQHLAITNE

SEQ ID NO: 3326520 - protein, 9 aa, Plasmodium falciparum
KYEQDNDDS

SEQ ID NO: 3326521 - protein, 22 aa, Plasmodium falciparum
KYEQNNHGVNNISEKKRNSHVN

SEQ ID NO: 3326522 - protein, 6 aa, Plasmodium falciparum
KYEQTK

SEQ ID NO: 3326523 - protein, 14 aa, Plasmodium falciparum
KYERPRGQHKPGIR

SEQ ID NO: 3326524 - protein, 25 aa, Plasmodium falciparum
KYERSDTKGSVRPKTHYNDNNKNNN

SEQ ID NO: 3326525 - protein, 8 aa, Plasmodium falciparum
KYESKKRL

SEQ ID NO: 3326526 - protein, 32 aa, Plasmodium falciparum
KYESSNEDNKSYSNKSDRENDMYSSNNNNMSN

SEQ ID NO: 3326527 - protein, 4 aa, Plasmodium falciparum
KYET

SEQ ID NO: 3326528 - protein, 12 aa, Plasmodium falciparum
KYEYKKNSWTKK

SEQ ID NO: 3326529 - protein, 7 aa, Plasmodium falciparum
KYEYKND

SEQ ID NO: 3326530 - protein, 5 aa, Plasmodium falciparum
KYEYN

SEQ ID NO: 3326531 - protein, 13 aa, Plasmodium falciparum
KYGDKKLPTLFRN

SEQ ID NO: 3326532 - protein, 7 aa, Plasmodium falciparum
KYGGIQE

SEQ ID NO: 3326533 - protein, 6 aa, Plasmodium falciparum
KYGGTS

SEQ ID NO: 3326534 - protein, 15 aa, Plasmodium falciparum
KYGKDHSINDSNDEP

SEQ ID NO: 3326535 - protein, 5 aa, Plasmodium falciparum
KYGKH

SEQ ID NO: 3326536 - protein, 8 aa, Plasmodium falciparum
KYGKSENY

SEQ ID NO: 3326537 - protein, 10 aa, Plasmodium falciparum
KYGNDKAKLR

SEQ ID NO: 3326538 - protein, 30 aa, Plasmodium falciparum
KYGNQKENKTKNKISNNINEKKNKKLKRQN

SEQ ID NO: 3326539 - protein, 10 aa, Plasmodium falciparum
KYGPIAQEPI

SEQ ID NO: 3326540 - protein, 6 aa, Plasmodium falciparum
KYGPKH

SEQ ID NO: 3326541 - protein, 14 aa, Plasmodium falciparum
KYGRENKEKSPRYN

SEQ ID NO: 3326542 - protein, 11 aa, Plasmodium falciparum
KYGRGGANNEH

SEQ ID NO: 3326543 - protein, 25 aa, Plasmodium falciparum
KYGRGKTGVQKRDERNKFYDEDRPK

SEQ ID NO: 3326544 - protein, 11 aa, Plasmodium falciparum
KYGSTIKNDAT

SEQ ID NO: 3326545 - protein, 6 aa, Plasmodium falciparum
KYGVEE

SEQ ID NO: 3326546 - protein, 6 aa, Plasmodium falciparum
KYHGYT

SEQ ID NO: 3326547 - protein, 13 aa, Plasmodium falciparum
KYHKKNNPYADSK

SEQ ID NO: 3326548 - protein, 11 aa, Plasmodium falciparum
KYHNNNKNKFE

SEQ ID NO: 3326549 - protein, 11 aa, Plasmodium falciparum
KYHPENQINTT

SEQ ID NO: 3326550 - protein, 5 aa, Plasmodium falciparum
KYHPG

SEQ ID NO: 3326551 - protein, 11 aa, Plasmodium falciparum
KYHPPDGTNNS

SEQ ID NO: 3326552 - protein, 10 aa, Plasmodium falciparum
KYHPQNDSNY

SEQ ID NO: 3326553 - protein, 4 aa, Plasmodium falciparum
KYHY

SEQ ID NO: 3326554 - protein, 4 aa, Plasmodium falciparum
KYIE

SEQ ID NO: 3326555 - protein, 18 aa, Plasmodium falciparum
KYIENTSSERNKGYRSYS

SEQ ID NO: 3326556 - protein, 15 aa, Plasmodium falciparum
KYINKNKNGTRKNEI

SEQ ID NO: 3326557 - protein, 13 aa, Plasmodium falciparum
KYISNNNNINGNS

SEQ ID NO: 3326558 - protein, 4 aa, Plasmodium falciparum
KYKD

SEQ ID NO: 3326559 - protein, 15 aa, Plasmodium falciparum
KYKEDNNTNNNNINE

SEQ ID NO: 3326560 - protein, 8 aa, Plasmodium falciparum
KYKEEEEK

SEQ ID NO: 3326561 - protein, 7 aa, Plasmodium falciparum
KYKEQKC

SEQ ID NO: 3326562 - protein, 5 aa, Plasmodium falciparum
KYKER

SEQ ID NO: 3326563 - protein, 9 aa, Plasmodium falciparum
KYKETHKDT

SEQ ID NO: 3326564 - protein, 7 aa, Plasmodium falciparum
KYKEVSN

SEQ ID NO: 3326565 - protein, 56 aa, Plasmodium falciparum
KYKEYNKTKRNTNNSKENTNNSKEDINNSKEDINNSKEDTNNNNCSDNNMNTSSYN

SEQ ID NO: 3326566 - protein, 16 aa, Plasmodium falciparum
KYKGKYHNQKEKLQNA

SEQ ID NO: 3326567 - protein, 7 aa, Plasmodium falciparum
KYKGRNS

SEQ ID NO: 3326568 - protein, 8 aa, Plasmodium falciparum
KYKGSKKE

SEQ ID NO: 3326569 - protein, 7 aa, Plasmodium falciparum
KYKGVDN

SEQ ID NO: 3326570 - protein, 9 aa, Plasmodium falciparum
KYKIDSSTY

SEQ ID NO: 3326571 - protein, 15 aa, Plasmodium falciparum
KYKKDKRKKYPTSCS

SEQ ID NO: 3326572 - protein, 33 aa, Plasmodium falciparum
KYKKDNQTQEDDTSSNKIQSKDKPKQNEKTKFK

SEQ ID NO: 3326573 - protein, 8 aa, Plasmodium falciparum
KYKKEQND

SEQ ID NO: 3326574 - protein, 10 aa, Plasmodium falciparum
KYKKNNSNNI

SEQ ID NO: 3326575 - protein, 6 aa, Plasmodium falciparum
KYKKPT

SEQ ID NO: 3326576 - protein, 5 aa, Plasmodium falciparum
KYKLN

SEQ ID NO: 3326577 - protein, 18 aa, Plasmodium falciparum
KYKNDHNTNQYNNTNVNN

SEQ ID NO: 3326578 - protein, 8 aa, Plasmodium falciparum
KYKNDYSN

SEQ ID NO: 3326579 - protein, 6 aa, Plasmodium falciparum
KYKNGE

SEQ ID NO: 3326580 - protein, 5 aa, Plasmodium falciparum
KYKNH

SEQ ID NO: 3326581 - protein, 6 aa, Plasmodium falciparum
KYKNIN

SEQ ID NO: 3326582 - protein, 9 aa, Plasmodium falciparum
KYKNKENVV

SEQ ID NO: 3326583 - protein, 10 aa, Plasmodium falciparum
KYKNKTQNEH

SEQ ID NO: 3326584 - protein, 5 aa, Plasmodium falciparum
KYKNN

SEQ ID NO: 3326585 - protein, 7 aa, Plasmodium falciparum
KYKNNKD

SEQ ID NO: 3326586 - protein, 11 aa, Plasmodium falciparum
KYKPKKETSKL

SEQ ID NO: 3326587 - protein, 6 aa, Plasmodium falciparum
KYKSEE

SEQ ID NO: 3326588 - protein, 6 aa, Plasmodium falciparum
KYKSEQ

SEQ ID NO: 3326589 - protein, 47 aa, Plasmodium falciparum
KYKSNDDSNNNDNSNNNDDSNNNEDSNNEDSTNNDSNNNNNTEERHP

SEQ ID NO: 3326590 - protein, 11 aa, Plasmodium falciparum
KYKSSNDKSNN

SEQ ID NO: 3326591 - protein, 5 aa, Plasmodium falciparum
KYKSV

SEQ ID NO: 3326592 - protein, 4 aa, Plasmodium falciparum
KYKT

SEQ ID NO: 3326593 - protein, 7 aa, Plasmodium falciparum
KYKTPDN

SEQ ID NO: 3326594 - protein, 4 aa, Plasmodium falciparum
KYLE

SEQ ID NO: 3326595 - protein, 27 aa, Plasmodium falciparum
KYLTTTNNKENDNTQNNINNNNNNNNN

SEQ ID NO: 3326596 - protein, 13 aa, Plasmodium falciparum
KYMENNENKENII

SEQ ID NO: 3326597 - protein, 8 aa, Plasmodium falciparum
KYNDEDKQ

SEQ ID NO: 3326598 - protein, 9 aa, Plasmodium falciparum
KYNDENNQI

SEQ ID NO: 3326599 - protein, 5 aa, Plasmodium falciparum
KYNDG

SEQ ID NO: 3326600 - protein, 12 aa, Plasmodium falciparum
KYNDGDNGTTVR

SEQ ID NO: 3326601 - protein, 6 aa, Plasmodium falciparum
KYNDKY

SEQ ID NO: 3326602 - protein, 10 aa, Plasmodium falciparum
KYNDNNKFSD

SEQ ID NO: 3326603 - protein, 10 aa, Plasmodium falciparum
KYNDSNKKNI

SEQ ID NO: 3326604 - protein, 5 aa, Plasmodium falciparum
KYNEE

SEQ ID NO: 3326605 - protein, 8 aa, Plasmodium falciparum
KYNEEDNK

SEQ ID NO: 3326606 - protein, 19 aa, Plasmodium falciparum
KYNEHNKYNEHNKYNKYNE

SEQ ID NO: 3326607 - protein, 5 aa, Plasmodium falciparum
KYNEI

SEQ ID NO: 3326608 - protein, 6 aa, Plasmodium falciparum
KYNENV

SEQ ID NO: 3326609 - protein, 13 aa, Plasmodium falciparum
KYNGSDIKNNDSF

SEQ ID NO: 3326610 - protein, 7 aa, Plasmodium falciparum
KYNISND

SEQ ID NO: 3326611 - protein, 4 aa, Plasmodium falciparum
KYNK

SEQ ID NO: 3326612 - protein, 9 aa, Plasmodium falciparum
KYNKDENAL

SEQ ID NO: 3326613 - protein, 8 aa, Plasmodium falciparum
KYNKEDMS

SEQ ID NO: 3326614 - protein, 12 aa, Plasmodium falciparum
KYNKEENKNGEF

SEQ ID NO: 3326615 - protein, 11 aa, Plasmodium falciparum
KYNKHGKEQNL

SEQ ID NO: 3326616 - protein, 17 aa, Plasmodium falciparum
KYNKKENKGKVLSNEPI

SEQ ID NO: 3326617 - protein, 6 aa, Plasmodium falciparum
KYNKNI

SEQ ID NO: 3326618 - protein, 8 aa, Plasmodium falciparum
KYNKSDKR

SEQ ID NO: 3326619 - protein, 5 aa, Plasmodium falciparum
KYNMS

SEQ ID NO: 3326620 - protein, 10 aa, Plasmodium falciparum
KYNMSPETND

SEQ ID NO: 3326621 - protein, 4 aa, Plasmodium falciparum
KYNN

SEQ ID NO: 3326622 - protein, 22 aa, Plasmodium falciparum
KYNNDDNNSDNNNDNNNDNNNN

SEQ ID NO: 3326623 - protein, 9 aa, Plasmodium falciparum
KYNNENNIK

SEQ ID NO: 3326624 - protein, 12 aa, Plasmodium falciparum
KYNNGDITSRNI

SEQ ID NO: 3326625 - protein, 7 aa, Plasmodium falciparum
KYNNHNN

SEQ ID NO: 3326626 - protein, 5 aa, Plasmodium falciparum
KYNNK

SEQ ID NO: 3326627 - protein, 7 aa, Plasmodium falciparum
KYNNKNE

SEQ ID NO: 3326628 - protein, 7 aa, Plasmodium falciparum
KYNNNAS

SEQ ID NO: 3326629 - protein, 57 aa, Plasmodium falciparum
KYNNNGNDDNNNDNNNDNDNNDNDNNNNDNNNNNNNNNNDNNNNNHYYNNNNNSNGQ

SEQ ID NO: 3326630 - protein, 14 aa, Plasmodium falciparum
KYNNNNDQNKSDDN

SEQ ID NO: 3326631 - protein, 14 aa, Plasmodium falciparum
KYNNNNNNNNNKDH

SEQ ID NO: 3326632 - protein, 12 aa, Plasmodium falciparum
KYNNNTTDTNNN

SEQ ID NO: 3326633 - protein, 7 aa, Plasmodium falciparum
KYNNSKD

SEQ ID NO: 3326634 - protein, 11 aa, Plasmodium falciparum
KYNNSYEDENY

SEQ ID NO: 3326635 - protein, 14 aa, Plasmodium falciparum
KYNNTIDGKTEMNS

SEQ ID NO: 3326636 - protein, 8 aa, Plasmodium falciparum
KYNPSNNN

SEQ ID NO: 3326637 - protein, 43 aa, Plasmodium falciparum
KYNRPSEEDELYKSKKRRNVSISRSSSSSTRYRKEKYEKTEDE

SEQ ID NO: 3326638 - protein, 14 aa, Plasmodium falciparum
KYNRRSNKKIRHKE

SEQ ID NO: 3326639 - protein, 31 aa, Plasmodium falciparum
KYNSDEEEDKKSSYSKDSESKKNQKTIYRDK

SEQ ID NO: 3326640 - protein, 18 aa, Plasmodium falciparum
KYNSENTSYNTSENNNTF

SEQ ID NO: 3326641 - protein, 10 aa, Plasmodium falciparum
KYNSMRSGVE

SEQ ID NO: 3326642 - protein, 7 aa, Plasmodium falciparum
KYNSQDN

SEQ ID NO: 3326643 - protein, 7 aa, Plasmodium falciparum
KYNSRDY

SEQ ID NO: 3326644 - protein, 12 aa, Plasmodium falciparum
KYNSSSTDFENN

SEQ ID NO: 3326645 - protein, 5 aa, Plasmodium falciparum
KYNST

SEQ ID NO: 3326646 - protein, 6 aa, Plasmodium falciparum
KYNTHQ

SEQ ID NO: 3326647 - protein, 19 aa, Plasmodium falciparum
KYNTTNQYNNNNNNNNNSN

SEQ ID NO: 3326648 - protein, 5 aa, Plasmodium falciparum
KYNYD

SEQ ID NO: 3326649 - protein, 15 aa, Plasmodium falciparum
KYPCNNNENNNKSKF

SEQ ID NO: 3326650 - protein, 6 aa, Plasmodium falciparum
KYPDEA

SEQ ID NO: 3326651 - protein, 9 aa, Plasmodium falciparum
KYPDEKRKK

SEQ ID NO: 3326652 - protein, 7 aa, Plasmodium falciparum
KYPDKLP

SEQ ID NO: 3326653 - protein, 21 aa, Plasmodium falciparum
KYPEDIEKDAYDDETKKKKID

SEQ ID NO: 3326654 - protein, 5 aa, Plasmodium falciparum
KYPET

SEQ ID NO: 3326655 - protein, 7 aa, Plasmodium falciparum
KYPKDNN

SEQ ID NO: 3326656 - protein, 10 aa, Plasmodium falciparum
KYPKSIKQNE

SEQ ID NO: 3326657 - protein, 4 aa, Plasmodium falciparum
KYPN

SEQ ID NO: 3326658 - protein, 5 aa, Plasmodium falciparum
KYPQY

SEQ ID NO: 3326659 - protein, 9 aa, Plasmodium falciparum
KYPRSRSLT

SEQ ID NO: 3326660 - protein, 5 aa, Plasmodium falciparum
KYPSL

SEQ ID NO: 3326661 - protein, 15 aa, Plasmodium falciparum
KYPSPNNTNMKNNEN

SEQ ID NO: 3326662 - protein, 4 aa, Plasmodium falciparum
KYPT

SEQ ID NO: 3326663 - protein, 5 aa, Plasmodium falciparum
KYQDG

SEQ ID NO: 3326664 - protein, 5 aa, Plasmodium falciparum
KYQFG

SEQ ID NO: 3326665 - protein, 5 aa, Plasmodium falciparum
KYQFK

SEQ ID NO: 3326666 - protein, 8 aa, Plasmodium falciparum
KYQGESEK

SEQ ID NO: 3326667 - protein, 11 aa, Plasmodium falciparum
KYQGSGHADTS

SEQ ID NO: 3326668 - protein, 4 aa, Plasmodium falciparum
KYQK

SEQ ID NO: 3326669 - protein, 13 aa, Plasmodium falciparum
KYQKNTQKSSKRA

SEQ ID NO: 3326670 - protein, 18 aa, Plasmodium falciparum
KYQKPRKGKMNDKAHPPI

SEQ ID NO: 3326671 - protein, 4 aa, Plasmodium falciparum
KYQY

SEQ ID NO: 3326672 - protein, 5 aa, Plasmodium falciparum
KYQYI

SEQ ID NO: 3326673 - protein, 7 aa, Plasmodium falciparum
KYRDDAV

SEQ ID NO: 3326674 - protein, 5 aa, Plasmodium falciparum
KYRDH

SEQ ID NO: 3326675 - protein, 30 aa, Plasmodium falciparum
KYRDRNHDRSLSRRSREYRNNTSRYRDKRR

SEQ ID NO: 3326676 - protein, 13 aa, Plasmodium falciparum
KYREDEKKRNLNE

SEQ ID NO: 3326677 - protein, 12 aa, Plasmodium falciparum
KYRKENNEKQKM

SEQ ID NO: 3326678 - protein, 11 aa, Plasmodium falciparum
KYRKQNSNKDI

SEQ ID NO: 3326679 - protein, 12 aa, Plasmodium falciparum
KYRNITSEDEEM

SEQ ID NO: 3326680 - protein, 6 aa, Plasmodium falciparum
KYRNSN

SEQ ID NO: 3326681 - protein, 8 aa, Plasmodium falciparum
KYRTKAAD

SEQ ID NO: 3326682 - protein, 4 aa, Plasmodium falciparum
KYSD

SEQ ID NO: 3326683 - protein, 6 aa, Plasmodium falciparum
KYSDDI

SEQ ID NO: 3326684 - protein, 6 aa, Plasmodium falciparum
KYSDKE

SEQ ID NO: 3326685 - protein, 5 aa, Plasmodium falciparum
KYSEN

SEQ ID NO: 3326686 - protein, 6 aa, Plasmodium falciparum
KYSGCP

SEQ ID NO: 3326687 - protein, 7 aa, Plasmodium falciparum
KYSHTNN

SEQ ID NO: 3326688 - protein, 4 aa, Plasmodium falciparum
KYSK

SEQ ID NO: 3326689 - protein, 17 aa, Plasmodium falciparum
KYSKKEDILNEKNQNEY

SEQ ID NO: 3326690 - protein, 9 aa, Plasmodium falciparum
KYSKYSKEN

SEQ ID NO: 3326691 - protein, 5 aa, Plasmodium falciparum
KYSND

SEQ ID NO: 3326692 - protein, 10 aa, Plasmodium falciparum
KYSNDENNYK

SEQ ID NO: 3326693 - protein, 7 aa, Plasmodium falciparum
KYSNSSY

SEQ ID NO: 3326694 - protein, 7 aa, Plasmodium falciparum
KYSPFQQ

SEQ ID NO: 3326695 - protein, 7 aa, Plasmodium falciparum
KYSPTKE

SEQ ID NO: 3326696 - protein, 6 aa, Plasmodium falciparum
KYSQDE

SEQ ID NO: 3326697 - protein, 6 aa, Plasmodium falciparum
KYSQTS

SEQ ID NO: 3326698 - protein, 12 aa, Plasmodium falciparum
KYSRAGYVPPSH

SEQ ID NO: 3326699 - protein, 7 aa, Plasmodium falciparum
KYSREGP

SEQ ID NO: 3326700 - protein, 5 aa, Plasmodium falciparum
KYSRR

SEQ ID NO: 3326701 - protein, 12 aa, Plasmodium falciparum
KYSSDNHKETEK

SEQ ID NO: 3326702 - protein, 12 aa, Plasmodium falciparum
KYSSNEPKNNTY

SEQ ID NO: 3326703 - protein, 33 aa, Plasmodium falciparum
KYSSRSHSRSRRRKHSSKHSSHYKSHNNHRDRS

SEQ ID NO: 3326704 - protein, 8 aa, Plasmodium falciparum
KYSSYSHK

SEQ ID NO: 3326705 - protein, 7 aa, Plasmodium falciparum
KYSTNGY

SEQ ID NO: 3326706 - protein, 5 aa, Plasmodium falciparum
KYSTT

SEQ ID NO: 3326707 - protein, 5 aa, Plasmodium falciparum
KYSWP

SEQ ID NO: 3326708 - protein, 19 aa, Plasmodium falciparum
KYSYDNKGLKYDSTEIDSN

SEQ ID NO: 3326709 - protein, 11 aa, Plasmodium falciparum
KYTDEGKRSPQ

SEQ ID NO: 3326710 - protein, 7 aa, Plasmodium falciparum
KYTDNDN

SEQ ID NO: 3326711 - protein, 12 aa, Plasmodium falciparum
KYTDSSTTISNI

SEQ ID NO: 3326712 - protein, 7 aa, Plasmodium falciparum
KYTEKKS

SEQ ID NO: 3326713 - protein, 12 aa, Plasmodium falciparum
KYTHEKNYKNDN

SEQ ID NO: 3326714 - protein, 4 aa, Plasmodium falciparum
KYTI

SEQ ID NO: 3326715 - protein, 12 aa, Plasmodium falciparum
KYTNDKKNKKDI

SEQ ID NO: 3326716 - protein, 18 aa, Plasmodium falciparum
KYTNDLGSVSEGYTSTYN

SEQ ID NO: 3326717 - protein, 31 aa, Plasmodium falciparum
KYTNETKRKKLQNQISNKQINEKERNDEKTK

SEQ ID NO: 3326718 - protein, 18 aa, Plasmodium falciparum
KYTNKNKDTEEENSNSDI

SEQ ID NO: 3326719 - protein, 10 aa, Plasmodium falciparum
KYTPGKKEDI

SEQ ID NO: 3326720 - protein, 7 aa, Plasmodium falciparum
KYTQNQS

SEQ ID NO: 3326721 - protein, 5 aa, Plasmodium falciparum
KYTRE

SEQ ID NO: 3326722 - protein, 15 aa, Plasmodium falciparum
KYTRNRTNDKSDVQL

SEQ ID NO: 3326723 - protein, 5 aa, Plasmodium falciparum
KYTSI

SEQ ID NO: 3326724 - protein, 6 aa, Plasmodium falciparum
KYTSNK

SEQ ID NO: 3326725 - protein, 12 aa, Plasmodium falciparum
KYTSSYDSLDDS

SEQ ID NO: 3326726 - protein, 43 aa, Plasmodium falciparum
KYVDSKKKKNNDPSNVDTNKKNNNNNNNNDNNVESTKEKEQNG

SEQ ID NO: 3326727 - protein, 10 aa, Plasmodium falciparum
KYYDSENSIS

SEQ ID NO: 3326728 - protein, 18 aa, Plasmodium falciparum
KYYEEEKYYEEEKYYEEE

SEQ ID NO: 3326729 - protein, 4 aa, Plasmodium falciparum
KYYG

SEQ ID NO: 3326730 - protein, 6 aa, Plasmodium falciparum
KYYKGD

SEQ ID NO: 3326731 - protein, 6 aa, Plasmodium falciparum
KYYPTK

SEQ ID NO: 3326732 - protein, 5 aa, Plasmodium falciparum
KYYQS

SEQ ID NO: 3326733 - protein, 23 aa, Plasmodium falciparum
KYYRTDERDRSRYKRRSTSSSLH

SEQ ID NO: 3326734 - protein, 5 aa, Plasmodium falciparum
LADKK

SEQ ID NO: 3326735 - protein, 13 aa, Plasmodium falciparum
LAEKKQPKKTNPL

SEQ ID NO: 3326736 - protein, 9 aa, Plasmodium falciparum
LAGPKKEAK

SEQ ID NO: 3326737 - protein, 19 aa, Plasmodium falciparum
LAKKEKKKKLKEKYGNNEV

SEQ ID NO: 3326738 - protein, 15 aa, Plasmodium falciparum
LAKKSEKSNTPSHHS

SEQ ID NO: 3326739 - protein, 5 aa, Plasmodium falciparum
LAKSD

SEQ ID NO: 3326740 - protein, 6 aa, Plasmodium falciparum
LAKSKE

SEQ ID NO: 3326741 - protein, 5 aa, Plasmodium falciparum
LANLK

SEQ ID NO: 3326742 - protein, 4 aa, Plasmodium falciparum
LANR

SEQ ID NO: 3326743 - protein, 28 aa, Plasmodium falciparum
LAPKVKPGKKGQDKKDTTSGSTTESSEK

SEQ ID NO: 3326744 - protein, 5 aa, Plasmodium falciparum
LAPNH

SEQ ID NO: 3326745 - protein, 5 aa, Plasmodium falciparum
LAPSS

SEQ ID NO: 3326746 - protein, 9 aa, Plasmodium falciparum
LAQKRKESI

SEQ ID NO: 3326747 - protein, 10 aa, Plasmodium falciparum
LAQPSKTEYA

SEQ ID NO: 3326748 - protein, 10 aa, Plasmodium falciparum
LARYNSDKRV

SEQ ID NO: 3326749 - protein, 6 aa, Plasmodium falciparum
LASSGA

SEQ ID NO: 3326750 - protein, 4 aa, Plasmodium falciparum
LATT

SEQ ID NO: 3326751 - protein, 11 aa, Plasmodium falciparum
LATTSSQLDNI

SEQ ID NO: 3326752 - protein, 24 aa, Plasmodium falciparum
LCDKDEKKSDLQSESEKLKQDENN

SEQ ID NO: 3326753 - protein, 4 aa, Plasmodium falciparum
LCEG

SEQ ID NO: 3326754 - protein, 4 aa, Plasmodium falciparum
LCEQ

SEQ ID NO: 3326755 - protein, 6 aa, Plasmodium falciparum
LCEQRR

SEQ ID NO: 3326756 - protein, 10 aa, Plasmodium falciparum
LCPTKKDSKA

SEQ ID NO: 3326757 - protein, 4 aa, Plasmodium falciparum
LDAE

SEQ ID NO: 3326758 - protein, 7 aa, Plasmodium falciparum
LDANSSS

SEQ ID NO: 3326759 - protein, 18 aa, Plasmodium falciparum
LDDDESKFSSSNSDTTKS

SEQ ID NO: 3326760 - protein, 5 aa, Plasmodium falciparum
LDDEF

SEQ ID NO: 3326761 - protein, 8 aa, Plasmodium falciparum
LDDEKKEV

SEQ ID NO: 3326762 - protein, 14 aa, Plasmodium falciparum
LDDEKNENNENNDY

SEQ ID NO: 3326763 - protein, 8 aa, Plasmodium falciparum
LDDGASTI

SEQ ID NO: 3326764 - protein, 16 aa, Plasmodium falciparum
LDDKDNMKNNKKDDNN

SEQ ID NO: 3326765 - protein, 6 aa, Plasmodium falciparum
LDDKKR

SEQ ID NO: 3326766 - protein, 106 aa, Plasmodium falciparum
LDDKNKKDKIKKDKKDEKKDEKKDEKKDEKKDEKKDEKRDEKKDEKRDEKKDEKKDEKKDEKKDEKKDDKKDKIKKDKKEDKKDKKSEKKDDKKTKKNIIKNSKGK

SEQ ID NO: 3326767 - protein, 9 aa, Plasmodium falciparum
LDDKNSKQA

SEQ ID NO: 3326768 - protein, 6 aa, Plasmodium falciparum
LDDKRK

SEQ ID NO: 3326769 - protein, 83 aa, Plasmodium falciparum
LDDNNNDDNNNNNNDDNNNNNYDDTNNNNDNDNNNNNNDNNNNNNNHNHNNHNNHNNHNNNIDKQTNYKNQKNHSKKKKKKLT

SEQ ID NO: 3326770 - protein, 8 aa, Plasmodium falciparum
LDDQSYTN

SEQ ID NO: 3326771 - protein, 9 aa, Plasmodium falciparum
LDDSIPKNN

SEQ ID NO: 3326772 - protein, 20 aa, Plasmodium falciparum
LDDSNKKKKNNDNNNNNNNV

SEQ ID NO: 3326773 - protein, 22 aa, Plasmodium falciparum
LDDTNNKLNEIKTNTSTEDHQE

SEQ ID NO: 3326774 - protein, 9 aa, Plasmodium falciparum
LDDTNTNRI

SEQ ID NO: 3326775 - protein, 4 aa, Plasmodium falciparum
LDEA

SEQ ID NO: 3326776 - protein, 26 aa, Plasmodium falciparum
LDEDNNDINNEKNENYNDIKNKRSNF

SEQ ID NO: 3326777 - protein, 11 aa, Plasmodium falciparum
LDEDQSESNNK

SEQ ID NO: 3326778 - protein, 14 aa, Plasmodium falciparum
LDEEEKKKEKKKKK

SEQ ID NO: 3326779 - protein, 9 aa, Plasmodium falciparum
LDEEEKKNK

SEQ ID NO: 3326780 - protein, 76 aa, Plasmodium falciparum
LDEEESIKSNEDESIKSNEEESIKSNEDESIKSDEDESIKSDEDNQSENSIEYESGESQDYESDKSHRKKRKYNET

SEQ ID NO: 3326781 - protein, 9 aa, Plasmodium falciparum
LDEENEDDM

SEQ ID NO: 3326782 - protein, 7 aa, Plasmodium falciparum
LDEENKN

SEQ ID NO: 3326783 - protein, 6 aa, Plasmodium falciparum
LDEESY

SEQ ID NO: 3326784 - protein, 5 aa, Plasmodium falciparum
LDEET

SEQ ID NO: 3326785 - protein, 7 aa, Plasmodium falciparum
LDEETKW

SEQ ID NO: 3326786 - protein, 9 aa, Plasmodium falciparum
LDEKEKKKN

SEQ ID NO: 3326787 - protein, 7 aa, Plasmodium falciparum
LDEKKNK

SEQ ID NO: 3326788 - protein, 9 aa, Plasmodium falciparum
LDENKKGCG

SEQ ID NO: 3326789 - protein, 17 aa, Plasmodium falciparum
LDENTSDYDEKKKNRKK

SEQ ID NO: 3326790 - protein, 4 aa, Plasmodium falciparum
LDEQ

SEQ ID NO: 3326791 - protein, 21 aa, Plasmodium falciparum
LDESDEEEYVADDDDDEEDYV

SEQ ID NO: 3326792 - protein, 9 aa, Plasmodium falciparum
LDESDKRQS

SEQ ID NO: 3326793 - protein, 7 aa, Plasmodium falciparum
LDESENM

SEQ ID NO: 3326794 - protein, 7 aa, Plasmodium falciparum
LDESNAK

SEQ ID NO: 3326795 - protein, 9 aa, Plasmodium falciparum
LDESNPCND

SEQ ID NO: 3326796 - protein, 8 aa, Plasmodium falciparum
LDETEKLE

SEQ ID NO: 3326797 - protein, 6 aa, Plasmodium falciparum
LDGEGY

SEQ ID NO: 3326798 - protein, 6 aa, Plasmodium falciparum
LDGGNV

SEQ ID NO: 3326799 - protein, 5 aa, Plasmodium falciparum
LDGKQ

SEQ ID NO: 3326800 - protein, 5 aa, Plasmodium falciparum
LDGQS

SEQ ID NO: 3326801 - protein, 8 aa, Plasmodium falciparum
LDGTAKLR

SEQ ID NO: 3326802 - protein, 19 aa, Plasmodium falciparum
LDGTLRPNKVKENMKEESC

SEQ ID NO: 3326803 - protein, 6 aa, Plasmodium falciparum
LDGTPK

SEQ ID NO: 3326804 - protein, 16 aa, Plasmodium falciparum
LDHTSSVEKKKKNINC

SEQ ID NO: 3326805 - protein, 4 aa, Plasmodium falciparum
LDIK

SEQ ID NO: 3326806 - protein, 13 aa, Plasmodium falciparum
LDKDKKQKELEEK

SEQ ID NO: 3326807 - protein, 48 aa, Plasmodium falciparum
LDKEDLDKEDYDIDTKETEGVNKDEKSNKRKQDALDNTNDMDLKKTKL

SEQ ID NO: 3326808 - protein, 6 aa, Plasmodium falciparum
LDKEEI

SEQ ID NO: 3326809 - protein, 7 aa, Plasmodium falciparum
LDKENKQ

SEQ ID NO: 3326810 - protein, 6 aa, Plasmodium falciparum
LDKNDN

SEQ ID NO: 3326811 - protein, 11 aa, Plasmodium falciparum
LDKNNENNTEK

SEQ ID NO: 3326812 - protein, 18 aa, Plasmodium falciparum
LDKNSELRRKESPSRKPG

SEQ ID NO: 3326813 - protein, 20 aa, Plasmodium falciparum
LDKNTNEYNNTITNTNTNIN

SEQ ID NO: 3326814 - protein, 9 aa, Plasmodium falciparum
LDKPERTLQ

SEQ ID NO: 3326815 - protein, 7 aa, Plasmodium falciparum
LDKRKRK

SEQ ID NO: 3326816 - protein, 14 aa, Plasmodium falciparum
LDNDDVDNNNTNKW

SEQ ID NO: 3326817 - protein, 5 aa, Plasmodium falciparum
LDNES

SEQ ID NO: 3326818 - protein, 11 aa, Plasmodium falciparum
LDNKNSDKDEI

SEQ ID NO: 3326819 - protein, 6 aa, Plasmodium falciparum
LDNNNN

SEQ ID NO: 3326820 - protein, 23 aa, Plasmodium falciparum
LDNNNNNDNNNERKTTTNTNESN

SEQ ID NO: 3326821 - protein, 9 aa, Plasmodium falciparum
LDNNSNDNK

SEQ ID NO: 3326822 - protein, 22 aa, Plasmodium falciparum
LDNNSTETKNNQENKKLTEEEK

SEQ ID NO: 3326823 - protein, 13 aa, Plasmodium falciparum
LDNPNKNDKENNI

SEQ ID NO: 3326824 - protein, 11 aa, Plasmodium falciparum
LDNRNKDENNL

SEQ ID NO: 3326825 - protein, 8 aa, Plasmodium falciparum
LDNSNKLD

SEQ ID NO: 3326826 - protein, 8 aa, Plasmodium falciparum
LDNSSTNK

SEQ ID NO: 3326827 - protein, 5 aa, Plasmodium falciparum
LDNTT

SEQ ID NO: 3326828 - protein, 4 aa, Plasmodium falciparum
LDNV

SEQ ID NO: 3326829 - protein, 5 aa, Plasmodium falciparum
LDNVK

SEQ ID NO: 3326830 - protein, 7 aa, Plasmodium falciparum
LDPAKAI

SEQ ID NO: 3326831 - protein, 6 aa, Plasmodium falciparum
LDPNEE

SEQ ID NO: 3326832 - protein, 16 aa, Plasmodium falciparum
LDPNKDNKDNNNINNN

SEQ ID NO: 3326833 - protein, 16 aa, Plasmodium falciparum
LDPQKYPLSKKNHGKE

SEQ ID NO: 3326834 - protein, 9 aa, Plasmodium falciparum
LDPRKQDKS

SEQ ID NO: 3326835 - protein, 5 aa, Plasmodium falciparum
LDPSR

SEQ ID NO: 3326836 - protein, 4 aa, Plasmodium falciparum
LDPY

SEQ ID NO: 3326837 - protein, 10 aa, Plasmodium falciparum
LDQQEDNTST

SEQ ID NO: 3326838 - protein, 10 aa, Plasmodium falciparum
LDQTSEDNTI

SEQ ID NO: 3326839 - protein, 11 aa, Plasmodium falciparum
LDRNEQTYDDT

SEQ ID NO: 3326840 - protein, 24 aa, Plasmodium falciparum
LDSEKKNKSMNIEEGARKMKTNTT

SEQ ID NO: 3326841 - protein, 9 aa, Plasmodium falciparum
LDSKKKKGY

SEQ ID NO: 3326842 - protein, 18 aa, Plasmodium falciparum
LDSKTRTVNNEMRNKDEE

SEQ ID NO: 3326843 - protein, 5 aa, Plasmodium falciparum
LDSNI

SEQ ID NO: 3326844 - protein, 13 aa, Plasmodium falciparum
LDSNKKKPNPVSL

SEQ ID NO: 3326845 - protein, 6 aa, Plasmodium falciparum
LDSNNM

SEQ ID NO: 3326846 - protein, 10 aa, Plasmodium falciparum
LDSNNNKCEE

SEQ ID NO: 3326847 - protein, 8 aa, Plasmodium falciparum
LDSNNSMS

SEQ ID NO: 3326848 - protein, 12 aa, Plasmodium falciparum
LDSPYDDDSESL

SEQ ID NO: 3326849 - protein, 10 aa, Plasmodium falciparum
LDSSDNSDEI

SEQ ID NO: 3326850 - protein, 36 aa, Plasmodium falciparum
LDSSEAPTNDKSTVNSAPPVNTTNNTDETNNRNNFE

SEQ ID NO: 3326851 - protein, 8 aa, Plasmodium falciparum
LDSSKDNM

SEQ ID NO: 3326852 - protein, 9 aa, Plasmodium falciparum
LDSSNKKSV

SEQ ID NO: 3326853 - protein, 16 aa, Plasmodium falciparum
LDTEKIKDSEKIGGKI

SEQ ID NO: 3326854 - protein, 12 aa, Plasmodium falciparum
LDTHNDNNNNNH

SEQ ID NO: 3326855 - protein, 6 aa, Plasmodium falciparum
LDTNQK

SEQ ID NO: 3326856 - protein, 18 aa, Plasmodium falciparum
LDTRRKGSFNSNTEGDQM

SEQ ID NO: 3326857 - protein, 11 aa, Plasmodium falciparum
LDTSDNKKVQS

SEQ ID NO: 3326858 - protein, 10 aa, Plasmodium falciparum
LDTSKDTQDI

SEQ ID NO: 3326859 - protein, 11 aa, Plasmodium falciparum
LDTSSNSQEQY

SEQ ID NO: 3326860 - protein, 6 aa, Plasmodium falciparum
LDTTYT

SEQ ID NO: 3326861 - protein, 9 aa, Plasmodium falciparum
LDVKPPPVK

SEQ ID NO: 3326862 - protein, 12 aa, Plasmodium falciparum
LDYPNTNNNYNN

SEQ ID NO: 3326863 - protein, 10 aa, Plasmodium falciparum
LEAESGAQIS

SEQ ID NO: 3326864 - protein, 38 aa, Plasmodium falciparum
LEAESHKKSRNDDDSSGEYGSVQDENDVNKKKSKDNIS

SEQ ID NO: 3326865 - protein, 6 aa, Plasmodium falciparum
LEAESY

SEQ ID NO: 3326866 - protein, 5 aa, Plasmodium falciparum
LECRE

SEQ ID NO: 3326867 - protein, 7 aa, Plasmodium falciparum
LEDDANQ

SEQ ID NO: 3326868 - protein, 5 aa, Plasmodium falciparum
LEDDN

SEQ ID NO: 3326869 - protein, 15 aa, Plasmodium falciparum
LEDDNNKDVSRDNNK

SEQ ID NO: 3326870 - protein, 5 aa, Plasmodium falciparum
LEDEK

SEQ ID NO: 3326871 - protein, 10 aa, Plasmodium falciparum
LEDESKNAGW

SEQ ID NO: 3326872 - protein, 7 aa, Plasmodium falciparum
LEDETLE

SEQ ID NO: 3326873 - protein, 16 aa, Plasmodium falciparum
LEDGEEEQEEEEEEKK

SEQ ID NO: 3326874 - protein, 6 aa, Plasmodium falciparum
LEDKDN

SEQ ID NO: 3326875 - protein, 36 aa, Plasmodium falciparum
LEDKKKKNSKKKKYAKEQEQTNNEKLKDKEKERKKK

SEQ ID NO: 3326876 - protein, 74 aa, Plasmodium falciparum
LEDKNQHNNNNNNNDDDDDGVDIQADTSTNVADQNNNSVPTNLKENEEESLNDQNENKDEETSQDENITDEKKK

SEQ ID NO: 3326877 - protein, 9 aa, Plasmodium falciparum
LEDNKRGAY

SEQ ID NO: 3326878 - protein, 10 aa, Plasmodium falciparum
LEDNNSKENF

SEQ ID NO: 3326879 - protein, 9 aa, Plasmodium falciparum
LEDQGNNTI

SEQ ID NO: 3326880 - protein, 7 aa, Plasmodium falciparum
LEDQNQD

SEQ ID NO: 3326881 - protein, 9 aa, Plasmodium falciparum
LEDRGDKNN

SEQ ID NO: 3326882 - protein, 10 aa, Plasmodium falciparum
LEDSNKNHYK

SEQ ID NO: 3326883 - protein, 21 aa, Plasmodium falciparum
LEDSNTISDDDDASSLPPRKK

SEQ ID NO: 3326884 - protein, 47 aa, Plasmodium falciparum
LEDTESYYDRKKKNSHKYKEINNSNNNNNNNNNNNDDNNSKKHIDPH

SEQ ID NO: 3326885 - protein, 5 aa, Plasmodium falciparum
LEDTS

SEQ ID NO: 3326886 - protein, 6 aa, Plasmodium falciparum
LEEDKN

SEQ ID NO: 3326887 - protein, 9 aa, Plasmodium falciparum
LEEDNEYKG

SEQ ID NO: 3326888 - protein, 18 aa, Plasmodium falciparum
LEEDQESDTFENSKTLKQ

SEQ ID NO: 3326889 - protein, 34 aa, Plasmodium falciparum
LEEDSEEMERNTNNNKINYDKNNNDEKNNNTDCT

SEQ ID NO: 3326890 - protein, 4 aa, Plasmodium falciparum
LEEE

SEQ ID NO: 3326891 - protein, 11 aa, Plasmodium falciparum
LEEEEKKRLEE

SEQ ID NO: 3326892 - protein, 7 aa, Plasmodium falciparum
LEEEKNV

SEQ ID NO: 3326893 - protein, 6 aa, Plasmodium falciparum
LEEESK

SEQ ID NO: 3326894 - protein, 5 aa, Plasmodium falciparum
LEEET

SEQ ID NO: 3326895 - protein, 9 aa, Plasmodium falciparum
LEEGKKKEL

SEQ ID NO: 3326896 - protein, 5 aa, Plasmodium falciparum
LEEGL

SEQ ID NO: 3326897 - protein, 6 aa, Plasmodium falciparum
LEEKEK

SEQ ID NO: 3326898 - protein, 11 aa, Plasmodium falciparum
LEEKKEKKKEY

SEQ ID NO: 3326899 - protein, 8 aa, Plasmodium falciparum
LEEKKKES

SEQ ID NO: 3326900 - protein, 5 aa, Plasmodium falciparum
LEEKN

SEQ ID NO: 3326901 - protein, 7 aa, Plasmodium falciparum
LEEKQGN

SEQ ID NO: 3326902 - protein, 14 aa, Plasmodium falciparum
LEEKSNKKENIGNP

SEQ ID NO: 3326903 - protein, 20 aa, Plasmodium falciparum
LEEMSASGTSYLNRSEASNM

SEQ ID NO: 3326904 - protein, 7 aa, Plasmodium falciparum
LEENKKK

SEQ ID NO: 3326905 - protein, 15 aa, Plasmodium falciparum
LEENNENKNKDNIDY

SEQ ID NO: 3326906 - protein, 8 aa, Plasmodium falciparum
LEENNKEI

SEQ ID NO: 3326907 - protein, 11 aa, Plasmodium falciparum
LEENYNKQNGH

SEQ ID NO: 3326908 - protein, 12 aa, Plasmodium falciparum
LEERKKKTSKNS

SEQ ID NO: 3326909 - protein, 5 aa, Plasmodium falciparum
LEERN

SEQ ID NO: 3326910 - protein, 5 aa, Plasmodium falciparum
LEERQ

SEQ ID NO: 3326911 - protein, 5 aa, Plasmodium falciparum
LEESN

SEQ ID NO: 3326912 - protein, 9 aa, Plasmodium falciparum
LEETGINKD

SEQ ID NO: 3326913 - protein, 8 aa, Plasmodium falciparum
LEETSDEN

SEQ ID NO: 3326914 - protein, 33 aa, Plasmodium falciparum
LEGEEDDTKNTENDPNVEDDEEENDKKNNIDDK

SEQ ID NO: 3326915 - protein, 7 aa, Plasmodium falciparum
LEGETSV

SEQ ID NO: 3326916 - protein, 5 aa, Plasmodium falciparum
LEGHT

SEQ ID NO: 3326917 - protein, 13 aa, Plasmodium falciparum
LEGKKNNVGTEKN

SEQ ID NO: 3326918 - protein, 7 aa, Plasmodium falciparum
LEGNQKF

SEQ ID NO: 3326919 - protein, 6 aa, Plasmodium falciparum
LEGPTT

SEQ ID NO: 3326920 - protein, 5 aa, Plasmodium falciparum
LEGQN

SEQ ID NO: 3326921 - protein, 27 aa, Plasmodium falciparum
LEGSGNNDIVEENGVKKKKKKKKNINK

SEQ ID NO: 3326922 - protein, 13 aa, Plasmodium falciparum
LEGTKNKQDGSFS

SEQ ID NO: 3326923 - protein, 6 aa, Plasmodium falciparum
LEGYNE

SEQ ID NO: 3326924 - protein, 6 aa, Plasmodium falciparum
LEHNES

SEQ ID NO: 3326925 - protein, 20 aa, Plasmodium falciparum
LEINKEREKGEEKKKNMYNN

SEQ ID NO: 3326926 - protein, 4 aa, Plasmodium falciparum
LEKD

SEQ ID NO: 3326927 - protein, 7 aa, Plasmodium falciparum
LEKDEKK

SEQ ID NO: 3326928 - protein, 11 aa, Plasmodium falciparum
LEKDKDEYISR

SEQ ID NO: 3326929 - protein, 6 aa, Plasmodium falciparum
LEKDKE

SEQ ID NO: 3326930 - protein, 5 aa, Plasmodium falciparum
LEKEE

SEQ ID NO: 3326931 - protein, 14 aa, Plasmodium falciparum
LEKEETSEASNEST

SEQ ID NO: 3326932 - protein, 8 aa, Plasmodium falciparum
LEKEKDNL

SEQ ID NO: 3326933 - protein, 7 aa, Plasmodium falciparum
LEKEKEI

SEQ ID NO: 3326934 - protein, 26 aa, Plasmodium falciparum
LEKEKEKEKEKYKQKKNNNNNNNIKS

SEQ ID NO: 3326935 - protein, 8 aa, Plasmodium falciparum
LEKEQDKV

SEQ ID NO: 3326936 - protein, 5 aa, Plasmodium falciparum
LEKER

SEQ ID NO: 3326937 - protein, 6 aa, Plasmodium falciparum
LEKKEI

SEQ ID NO: 3326938 - protein, 9 aa, Plasmodium falciparum
LEKKENDAL

SEQ ID NO: 3326939 - protein, 14 aa, Plasmodium falciparum
LEKKESMKKDDNAK

SEQ ID NO: 3326940 - protein, 12 aa, Plasmodium falciparum
LEKKKGNEKYNE

SEQ ID NO: 3326941 - protein, 8 aa, Plasmodium falciparum
LEKKKNQE

SEQ ID NO: 3326942 - protein, 7 aa, Plasmodium falciparum
LEKKNDE

SEQ ID NO: 3326943 - protein, 21 aa, Plasmodium falciparum
LEKKNDHKEELEKKKINNGSN

SEQ ID NO: 3326944 - protein, 9 aa, Plasmodium falciparum
LEKKNKEED

SEQ ID NO: 3326945 - protein, 8 aa, Plasmodium falciparum
LEKKSNNT

SEQ ID NO: 3326946 - protein, 6 aa, Plasmodium falciparum
LEKMNE

SEQ ID NO: 3326947 - protein, 10 aa, Plasmodium falciparum
LEKNEEFKNE

SEQ ID NO: 3326948 - protein, 8 aa, Plasmodium falciparum
LEKNGDDN

SEQ ID NO: 3326949 - protein, 11 aa, Plasmodium falciparum
LEKNKKEMKNE

SEQ ID NO: 3326950 - protein, 8 aa, Plasmodium falciparum
LEKNPNKW

SEQ ID NO: 3326951 - protein, 8 aa, Plasmodium falciparum
LEKQNNDD

SEQ ID NO: 3326952 - protein, 10 aa, Plasmodium falciparum
LEKQQNYQIE

SEQ ID NO: 3326953 - protein, 45 aa, Plasmodium falciparum
LEKREEVNKQNNGFTNSNEQNSTYNSDDNSYNNSDESSDDNSDYC

SEQ ID NO: 3326954 - protein, 7 aa, Plasmodium falciparum
LEKSEKD

SEQ ID NO: 3326955 - protein, 11 aa, Plasmodium falciparum
LEKSGKKRRQK

SEQ ID NO: 3326956 - protein, 16 aa, Plasmodium falciparum
LEKSKEEAINQNEEYN

SEQ ID NO: 3326957 - protein, 8 aa, Plasmodium falciparum
LEKSPYDV

SEQ ID NO: 3326958 - protein, 4 aa, Plasmodium falciparum
LELE

SEQ ID NO: 3326959 - protein, 11 aa, Plasmodium falciparum
LELNNNKKNYD

SEQ ID NO: 3326960 - protein, 8 aa, Plasmodium falciparum
LENDEKKE

SEQ ID NO: 3326961 - protein, 9 aa, Plasmodium falciparum
LENDEYGEH

SEQ ID NO: 3326962 - protein, 4 aa, Plasmodium falciparum
LENE

SEQ ID NO: 3326963 - protein, 24 aa, Plasmodium falciparum
LENEEIKKQNKEDANENNKSQIRE

SEQ ID NO: 3326964 - protein, 6 aa, Plasmodium falciparum
LENEER

SEQ ID NO: 3326965 - protein, 8 aa, Plasmodium falciparum
LENEKKDN

SEQ ID NO: 3326966 - protein, 11 aa, Plasmodium falciparum
LENEKKKKLKS

SEQ ID NO: 3326967 - protein, 5 aa, Plasmodium falciparum
LENEN

SEQ ID NO: 3326968 - protein, 6 aa, Plasmodium falciparum
LENENY

SEQ ID NO: 3326969 - protein, 23 aa, Plasmodium falciparum
LENESDNEYKESNSSSNLSDNTY

SEQ ID NO: 3326970 - protein, 63 aa, Plasmodium falciparum
LENKDNKKEGKNTNSSKVKKRYHTSSDENDRNNDNTSSEEERTKSRKKKHKNDNSDKKNENRV

SEQ ID NO: 3326971 - protein, 20 aa, Plasmodium falciparum
LENKSDKQFNDMSKEDQEIT

SEQ ID NO: 3326972 - protein, 19 aa, Plasmodium falciparum
LENKSDYTESSSNDNCKYG

SEQ ID NO: 3326973 - protein, 11 aa, Plasmodium falciparum
LENKTSFSSKY

SEQ ID NO: 3326974 - protein, 4 aa, Plasmodium falciparum
LENN

SEQ ID NO: 3326975 - protein, 10 aa, Plasmodium falciparum
LENNANTKNL

SEQ ID NO: 3326976 - protein, 7 aa, Plasmodium falciparum
LENNKNS

SEQ ID NO: 3326977 - protein, 10 aa, Plasmodium falciparum
LENNKNTNNY

SEQ ID NO: 3326978 - protein, 21 aa, Plasmodium falciparum
LENNKQKYKKKKKIENSPEDI

SEQ ID NO: 3326979 - protein, 6 aa, Plasmodium falciparum
LENNQK

SEQ ID NO: 3326980 - protein, 9 aa, Plasmodium falciparum
LENNTNESL

SEQ ID NO: 3326981 - protein, 18 aa, Plasmodium falciparum
LENNTNNNNNNNNNENSH

SEQ ID NO: 3326982 - protein, 7 aa, Plasmodium falciparum
LENPSDA

SEQ ID NO: 3326983 - protein, 17 aa, Plasmodium falciparum
LENQKETEHLSKNNDFK

SEQ ID NO: 3326984 - protein, 9 aa, Plasmodium falciparum
LENQKNKEI

SEQ ID NO: 3326985 - protein, 4 aa, Plasmodium falciparum
LENS

SEQ ID NO: 3326986 - protein, 20 aa, Plasmodium falciparum
LENSPDKLKGQKQNDTNEVK

SEQ ID NO: 3326987 - protein, 12 aa, Plasmodium falciparum
LENSTGSPMNSF

SEQ ID NO: 3326988 - protein, 11 aa, Plasmodium falciparum
LENTYRNTYKK

SEQ ID NO: 3326989 - protein, 4 aa, Plasmodium falciparum
LENV

SEQ ID NO: 3326990 - protein, 13 aa, Plasmodium falciparum
LENVENSTLGSEY

SEQ ID NO: 3326991 - protein, 4 aa, Plasmodium falciparum
LENY

SEQ ID NO: 3326992 - protein, 8 aa, Plasmodium falciparum
LEPEKEFS

SEQ ID NO: 3326993 - protein, 7 aa, Plasmodium falciparum
LEPKTHN

SEQ ID NO: 3326994 - protein, 4 aa, Plasmodium falciparum
LEPP

SEQ ID NO: 3326995 - protein, 9 aa, Plasmodium falciparum
LEPPKNSSY

SEQ ID NO: 3326996 - protein, 5 aa, Plasmodium falciparum
LEPRE

SEQ ID NO: 3326997 - protein, 22 aa, Plasmodium falciparum
LEQKHSDKSLQIENNDNTNNFT

SEQ ID NO: 3326998 - protein, 5 aa, Plasmodium falciparum
LEQKK

SEQ ID NO: 3326999 - protein, 10 aa, Plasmodium falciparum
LEQNENTNEF

SEQ ID NO: 3327000 - protein, 15 aa, Plasmodium falciparum
LEQNNDDDKNDENDE

SEQ ID NO: 3327001 - protein, 29 aa, Plasmodium falciparum
LEQTNNQNVNKKKQHSSNYTSSDDNSNFK

SEQ ID NO: 3327002 - protein, 13 aa, Plasmodium falciparum
LERDEDKHDAPPV

SEQ ID NO: 3327003 - protein, 8 aa, Plasmodium falciparum
LEREEAQK

SEQ ID NO: 3327004 - protein, 6 aa, Plasmodium falciparum
LEREEK

SEQ ID NO: 3327005 - protein, 11 aa, Plasmodium falciparum
LERENEDINQL

SEQ ID NO: 3327006 - protein, 10 aa, Plasmodium falciparum
LERENLKNEA

SEQ ID NO: 3327007 - protein, 4 aa, Plasmodium falciparum
LERK

SEQ ID NO: 3327008 - protein, 5 aa, Plasmodium falciparum
LERNN

SEQ ID NO: 3327009 - protein, 8 aa, Plasmodium falciparum
LERNNSEI

SEQ ID NO: 3327010 - protein, 7 aa, Plasmodium falciparum
LERQKSN

SEQ ID NO: 3327011 - protein, 27 aa, Plasmodium falciparum
LERSNSDIYSESQKFDNASDKLETGTQ

SEQ ID NO: 3327012 - protein, 9 aa, Plasmodium falciparum
LERTKETIE

SEQ ID NO: 3327013 - protein, 5 aa, Plasmodium falciparum
LERTR

SEQ ID NO: 3327014 - protein, 5 aa, Plasmodium falciparum
LESAA

SEQ ID NO: 3327015 - protein, 8 aa, Plasmodium falciparum
LESDDEKE

SEQ ID NO: 3327016 - protein, 9 aa, Plasmodium falciparum
LESEKEKSN

SEQ ID NO: 3327017 - protein, 10 aa, Plasmodium falciparum
LESEKGRGRS

SEQ ID NO: 3327018 - protein, 6 aa, Plasmodium falciparum
LESEQS

SEQ ID NO: 3327019 - protein, 7 aa, Plasmodium falciparum
LESGEEE

SEQ ID NO: 3327020 - protein, 6 aa, Plasmodium falciparum
LESGTK

SEQ ID NO: 3327021 - protein, 13 aa, Plasmodium falciparum
LESGVPYDPSKLM

SEQ ID NO: 3327022 - protein, 6 aa, Plasmodium falciparum
LESHAR

SEQ ID NO: 3327023 - protein, 11 aa, Plasmodium falciparum
LESHNTSNENY

SEQ ID NO: 3327024 - protein, 4 aa, Plasmodium falciparum
LESK

SEQ ID NO: 3327025 - protein, 6 aa, Plasmodium falciparum
LESKNS

SEQ ID NO: 3327026 - protein, 30 aa, Plasmodium falciparum
LESNERKSKLLNKGKNVSSQKINSKMNNTN

SEQ ID NO: 3327027 - protein, 5 aa, Plasmodium falciparum
LESNT

SEQ ID NO: 3327028 - protein, 22 aa, Plasmodium falciparum
LESPNASKYKSSIPIQQDGTCN

SEQ ID NO: 3327029 - protein, 7 aa, Plasmodium falciparum
LESPSGS

SEQ ID NO: 3327030 - protein, 9 aa, Plasmodium falciparum
LESQKDYNS

SEQ ID NO: 3327031 - protein, 11 aa, Plasmodium falciparum
LESQRNKQTLV

SEQ ID NO: 3327032 - protein, 7 aa, Plasmodium falciparum
LESSTED

SEQ ID NO: 3327033 - protein, 8 aa, Plasmodium falciparum
LESTEKKY

SEQ ID NO: 3327034 - protein, 4 aa, Plasmodium falciparum
LESV

SEQ ID NO: 3327035 - protein, 39 aa, Plasmodium falciparum
LESVNTDNHGTELEESDSSSGSKVSNETTNSGDSDDSKK

SEQ ID NO: 3327036 - protein, 7 aa, Plasmodium falciparum
LETKNET

SEQ ID NO: 3327037 - protein, 6 aa, Plasmodium falciparum
LETPPI

SEQ ID NO: 3327038 - protein, 4 aa, Plasmodium falciparum
LETQ

SEQ ID NO: 3327039 - protein, 63 aa, Plasmodium falciparum
LETSSNEKGNNSSKKNKKKNKKKKNINKKGNSNNNNNENNENIDNNENIDNNENIDSNNNNQL

SEQ ID NO: 3327040 - protein, 6 aa, Plasmodium falciparum
LETTKN

SEQ ID NO: 3327041 - protein, 6 aa, Plasmodium falciparum
LFSDES

SEQ ID NO: 3327042 - protein, 13 aa, Plasmodium falciparum
LGATYGPSQKEMN

SEQ ID NO: 3327043 - protein, 13 aa, Plasmodium falciparum
LGATYGTRQKEMN

SEQ ID NO: 3327044 - protein, 11 aa, Plasmodium falciparum
LGDDDEDEDNY

SEQ ID NO: 3327045 - protein, 8 aa, Plasmodium falciparum
LGDKRGST

SEQ ID NO: 3327046 - protein, 8 aa, Plasmodium falciparum
LGDTSGSV

SEQ ID NO: 3327047 - protein, 6 aa, Plasmodium falciparum
LGEDTP

SEQ ID NO: 3327048 - protein, 9 aa, Plasmodium falciparum
LGEEENELK

SEQ ID NO: 3327049 - protein, 4 aa, Plasmodium falciparum
LGEG

SEQ ID NO: 3327050 - protein, 4 aa, Plasmodium falciparum
LGEK

SEQ ID NO: 3327051 - protein, 19 aa, Plasmodium falciparum
LGEKEKAPFEKKAQEDKLR

SEQ ID NO: 3327052 - protein, 9 aa, Plasmodium falciparum
LGEKNTDGR

SEQ ID NO: 3327053 - protein, 9 aa, Plasmodium falciparum
LGENLSDDE

SEQ ID NO: 3327054 - protein, 7 aa, Plasmodium falciparum
LGENNNN

SEQ ID NO: 3327055 - protein, 4 aa, Plasmodium falciparum
LGEP

SEQ ID NO: 3327056 - protein, 14 aa, Plasmodium falciparum
LGEPEENKEINVQG

SEQ ID NO: 3327057 - protein, 6 aa, Plasmodium falciparum
LGESKQ

SEQ ID NO: 3327058 - protein, 7 aa, Plasmodium falciparum
LGETKNH

SEQ ID NO: 3327059 - protein, 8 aa, Plasmodium falciparum
LGETLTDE

SEQ ID NO: 3327060 - protein, 10 aa, Plasmodium falciparum
LGGGTGSGLG

SEQ ID NO: 3327061 - protein, 9 aa, Plasmodium falciparum
LGGGTGSGM

SEQ ID NO: 3327062 - protein, 4 aa, Plasmodium falciparum
LGGK

SEQ ID NO: 3327063 - protein, 5 aa, Plasmodium falciparum
LGGNC

SEQ ID NO: 3327064 - protein, 6 aa, Plasmodium falciparum
LGGPNQ

SEQ ID NO: 3327065 - protein, 16 aa, Plasmodium falciparum
LGGRDVTKETSPSSKS

SEQ ID NO: 3327066 - protein, 5 aa, Plasmodium falciparum
LGGYD

SEQ ID NO: 3327067 - protein, 14 aa, Plasmodium falciparum
LGKDSAYIHLYKRL

SEQ ID NO: 3327068 - protein, 6 aa, Plasmodium falciparum
LGKESD

SEQ ID NO: 3327069 - protein, 26 aa, Plasmodium falciparum
LGKGGKGKTGSGKTKKAPLSRASRAG

SEQ ID NO: 3327070 - protein, 4 aa, Plasmodium falciparum
LGKN

SEQ ID NO: 3327071 - protein, 5 aa, Plasmodium falciparum
LGKNI

SEQ ID NO: 3327072 - protein, 26 aa, Plasmodium falciparum
LGKNKNRDTPLKTKQHGDSLDNKTEL

SEQ ID NO: 3327073 - protein, 8 aa, Plasmodium falciparum
LGKPNKDE

SEQ ID NO: 3327074 - protein, 14 aa, Plasmodium falciparum
LGKRKKEKKKKKKI

SEQ ID NO: 3327075 - protein, 8 aa, Plasmodium falciparum
LGKTDYET

SEQ ID NO: 3327076 - protein, 5 aa, Plasmodium falciparum
LGNDN

SEQ ID NO: 3327077 - protein, 10 aa, Plasmodium falciparum
LGNKDTREGI

SEQ ID NO: 3327078 - protein, 23 aa, Plasmodium falciparum
LGNNNFNNNSNNNNNNNNNNAFP

SEQ ID NO: 3327079 - protein, 20 aa, Plasmodium falciparum
LGNNNNNNINVSNNEAENIE

SEQ ID NO: 3327080 - protein, 11 aa, Plasmodium falciparum
LGNSAKNSKIH

SEQ ID NO: 3327081 - protein, 11 aa, Plasmodium falciparum
LGNVRNDKTVS

SEQ ID NO: 3327082 - protein, 22 aa, Plasmodium falciparum
LGPINTENQKEQKVEREEENNI

SEQ ID NO: 3327083 - protein, 6 aa, Plasmodium falciparum
LGPKGR

SEQ ID NO: 3327084 - protein, 60 aa, Plasmodium falciparum
LGPKQNSKSALSSKPGVKSSLSSKPGVKSSLSSKPGVKSALSSKPGVKSALSSKPGAKSV

SEQ ID NO: 3327085 - protein, 8 aa, Plasmodium falciparum
LGPNQHKS

SEQ ID NO: 3327086 - protein, 6 aa, Plasmodium falciparum
LGPQSS

SEQ ID NO: 3327087 - protein, 8 aa, Plasmodium falciparum
LGPTTTDN

SEQ ID NO: 3327088 - protein, 5 aa, Plasmodium falciparum
LGQGT

SEQ ID NO: 3327089 - protein, 13 aa, Plasmodium falciparum
LGQNNNEGNTNMK

SEQ ID NO: 3327090 - protein, 8 aa, Plasmodium falciparum
LGQSERQE

SEQ ID NO: 3327091 - protein, 6 aa, Plasmodium falciparum
LGRDNN

SEQ ID NO: 3327092 - protein, 10 aa, Plasmodium falciparum
LGRENNPSLF

SEQ ID NO: 3327093 - protein, 12 aa, Plasmodium falciparum
LGRGGTPGVSSG

SEQ ID NO: 3327094 - protein, 5 aa, Plasmodium falciparum
LGRYK

SEQ ID NO: 3327095 - protein, 4 aa, Plasmodium falciparum
LGSA

SEQ ID NO: 3327096 - protein, 5 aa, Plasmodium falciparum
LGSEN

SEQ ID NO: 3327097 - protein, 8 aa, Plasmodium falciparum
LGSISQSI

SEQ ID NO: 3327098 - protein, 4 aa, Plasmodium falciparum
LGSK

SEQ ID NO: 3327099 - protein, 7 aa, Plasmodium falciparum
LGSKDRK

SEQ ID NO: 3327100 - protein, 29 aa, Plasmodium falciparum
LGSKDSQDLQKGKNLRSHKPKYYDDEDDE

SEQ ID NO: 3327101 - protein, 11 aa, Plasmodium falciparum
LGSQGKHAGRD

SEQ ID NO: 3327102 - protein, 16 aa, Plasmodium falciparum
LGSRNDPRSSTTSASA

SEQ ID NO: 3327103 - protein, 14 aa, Plasmodium falciparum
LGSRPSKRKEGNVE

SEQ ID NO: 3327104 - protein, 10 aa, Plasmodium falciparum
LGSRSGSSYI

SEQ ID NO: 3327105 - protein, 9 aa, Plasmodium falciparum
LGSSEQDPY

SEQ ID NO: 3327106 - protein, 6 aa, Plasmodium falciparum
LGSSGN

SEQ ID NO: 3327107 - protein, 47 aa, Plasmodium falciparum
LGSTKEEEKMEDEEKMEEEKVDEEKMEEEKVDEEKMEDEKVEEKMEE

SEQ ID NO: 3327108 - protein, 7 aa, Plasmodium falciparum
LGSTNQV

SEQ ID NO: 3327109 - protein, 10 aa, Plasmodium falciparum
LGSTSGTNNN

SEQ ID NO: 3327110 - protein, 9 aa, Plasmodium falciparum
LGTASNIKS

SEQ ID NO: 3327111 - protein, 27 aa, Plasmodium falciparum
LGTEKEGSPDSHDSSKEKLNLNDNSKW

SEQ ID NO: 3327112 - protein, 4 aa, Plasmodium falciparum
LGTG

SEQ ID NO: 3327113 - protein, 10 aa, Plasmodium falciparum
LGTGSGGPYA

SEQ ID NO: 3327114 - protein, 5 aa, Plasmodium falciparum
LGTKF

SEQ ID NO: 3327115 - protein, 4 aa, Plasmodium falciparum
LGTL

SEQ ID NO: 3327116 - protein, 7 aa, Plasmodium falciparum
LGTNNSN

SEQ ID NO: 3327117 - protein, 8 aa, Plasmodium falciparum
LGTSTDRE

SEQ ID NO: 3327118 - protein, 6 aa, Plasmodium falciparum
LGVNSK

SEQ ID NO: 3327119 - protein, 6 aa, Plasmodium falciparum
LGVSND

SEQ ID NO: 3327120 - protein, 21 aa, Plasmodium falciparum
LHDSKQEELEAKKRKRAQQLE

SEQ ID NO: 3327121 - protein, 4 aa, Plasmodium falciparum
LHEQ

SEQ ID NO: 3327122 - protein, 14 aa, Plasmodium falciparum
LHESPGNTYDSNDE

SEQ ID NO: 3327123 - protein, 9 aa, Plasmodium falciparum
LHKDEKSFN

SEQ ID NO: 3327124 - protein, 16 aa, Plasmodium falciparum
LHKNEEEHEKGSPNNI

SEQ ID NO: 3327125 - protein, 23 aa, Plasmodium falciparum
LHLSSTKQKLNNNNNNNNNNNNN

SEQ ID NO: 3327126 - protein, 11 aa, Plasmodium falciparum
LHNEQVENRDV

SEQ ID NO: 3327127 - protein, 21 aa, Plasmodium falciparum
LHNNNNNNNNNNYNNNNYNNY

SEQ ID NO: 3327128 - protein, 10 aa, Plasmodium falciparum
LHNSSYTSYE

SEQ ID NO: 3327129 - protein, 7 aa, Plasmodium falciparum
LHPTSDD

SEQ ID NO: 3327130 - protein, 12 aa, Plasmodium falciparum
LHTQDSKNNQNN

SEQ ID NO: 3327131 - protein, 8 aa, Plasmodium falciparum
LHTTTSTL

SEQ ID NO: 3327132 - protein, 10 aa, Plasmodium falciparum
LIAPTPDSQN

SEQ ID NO: 3327133 - protein, 5 aa, Plasmodium falciparum
LIEEE

SEQ ID NO: 3327134 - protein, 10 aa, Plasmodium falciparum
LIEENKNNEH

SEQ ID NO: 3327135 - protein, 34 aa, Plasmodium falciparum
LIGDDSKSRQDSNFDSDASSKNNESYGDSDSSYN

SEQ ID NO: 3327136 - protein, 27 aa, Plasmodium falciparum
LIKNNNNNNNNNNDNNNNNNNDNNNYN

SEQ ID NO: 3327137 - protein, 17 aa, Plasmodium falciparum
LINEKKNKKNKKNSYDD

SEQ ID NO: 3327138 - protein, 4 aa, Plasmodium falciparum
LING

SEQ ID NO: 3327139 - protein, 7 aa, Plasmodium falciparum
LISTSDD

SEQ ID NO: 3327140 - protein, 4 aa, Plasmodium falciparum
LITE

SEQ ID NO: 3327141 - protein, 4 aa, Plasmodium falciparum
LKAN

SEQ ID NO: 3327142 - protein, 7 aa, Plasmodium falciparum
LKATKIK

SEQ ID NO: 3327143 - protein, 16 aa, Plasmodium falciparum
LKDDEERKEKHENENN

SEQ ID NO: 3327144 - protein, 6 aa, Plasmodium falciparum
LKDDER

SEQ ID NO: 3327145 - protein, 5 aa, Plasmodium falciparum
LKDDT

SEQ ID NO: 3327146 - protein, 10 aa, Plasmodium falciparum
LKDEEGNDIN

SEQ ID NO: 3327147 - protein, 19 aa, Plasmodium falciparum
LKDEEKKIQEEEKKLNEEL

SEQ ID NO: 3327148 - protein, 8 aa, Plasmodium falciparum
LKDENDKL

SEQ ID NO: 3327149 - protein, 7 aa, Plasmodium falciparum
LKDENNK

SEQ ID NO: 3327150 - protein, 14 aa, Plasmodium falciparum
LKDIEDKEKQIEEH

SEQ ID NO: 3327151 - protein, 10 aa, Plasmodium falciparum
LKDKDKNFEQ

SEQ ID NO: 3327152 - protein, 9 aa, Plasmodium falciparum
LKDKEDNIK

SEQ ID NO: 3327153 - protein, 11 aa, Plasmodium falciparum
LKDKGKKENIG

SEQ ID NO: 3327154 - protein, 9 aa, Plasmodium falciparum
LKDKKNKMK

SEQ ID NO: 3327155 - protein, 4 aa, Plasmodium falciparum
LKDN

SEQ ID NO: 3327156 - protein, 29 aa, Plasmodium falciparum
LKDNHNKNDYNTKNDISCERNNNSVKTEH

SEQ ID NO: 3327157 - protein, 4 aa, Plasmodium falciparum
LKDS

SEQ ID NO: 3327158 - protein, 54 aa, Plasmodium falciparum
LKDTSYSKETSKNMDEEKVTGNNNTCENKNVGQNDDTLNNNNNNNINSVNNNNN

SEQ ID NO: 3327159 - protein, 8 aa, Plasmodium falciparum
LKEATELT

SEQ ID NO: 3327160 - protein, 9 aa, Plasmodium falciparum
LKEAYSDKK

SEQ ID NO: 3327161 - protein, 13 aa, Plasmodium falciparum
LKEDEKGKAEIPQ

SEQ ID NO: 3327162 - protein, 13 aa, Plasmodium falciparum
LKEDEKKKTKKKL

SEQ ID NO: 3327163 - protein, 12 aa, Plasmodium falciparum
LKEDEKLKVKEK

SEQ ID NO: 3327164 - protein, 14 aa, Plasmodium falciparum
LKEDERKKSENDLK

SEQ ID NO: 3327165 - protein, 8 aa, Plasmodium falciparum
LKEDKNEF

SEQ ID NO: 3327166 - protein, 12 aa, Plasmodium falciparum
LKEEEKKEKSHI

SEQ ID NO: 3327167 - protein, 189 aa, Plasmodium falciparum
LKEEERIKEEERIKEKKRTKEEKRLKEEERIKEKKKLKEQERLKEEQRLRQEERLKEEERLKEEERLKEEERLKEEERLKEEERLKEEERLKEEERLKEEERLKEEERLKEEERLKEEERLKEEERLKEEERLKEEERLKEEERLKEEERLKEEERLKEEERLKEEERLKEEERLKEEERLKEEARIKE

SEQ ID NO: 3327168 - protein, 223 aa, Plasmodium falciparum
LKEEERLKEEERLKEEERLKEEERLKEEERLKEEERLKEEERIKEEERLREEERLKEEERLKEEERLKEEERLKEEERLKEEERLKEEERLKEEERLKEEERLKEEERLKEEERLKEEERLKEEERLKEEERLKEEERLKEEERLKEEERLKEEERLKEEERLKEEERLKEEERLKEEERLKEEERLKEEARIKEEKLKEEERLKEEERLKEEARIKEEKLKE

SEQ ID NO: 3327169 - protein, 11 aa, Plasmodium falciparum
LKEEGVKDEGG

SEQ ID NO: 3327170 - protein, 11 aa, Plasmodium falciparum
LKEEHSKETIK

SEQ ID NO: 3327171 - protein, 8 aa, Plasmodium falciparum
LKEEKEKR

SEQ ID NO: 3327172 - protein, 31 aa, Plasmodium falciparum
LKEEKKKEVKTNIQPKDNNNNNNNNNNNNNN

SEQ ID NO: 3327173 - protein, 21 aa, Plasmodium falciparum
LKEEKKKNKSIKNFNNENKHI

SEQ ID NO: 3327174 - protein, 14 aa, Plasmodium falciparum
LKEEYENNKNKSIQ

SEQ ID NO: 3327175 - protein, 8 aa, Plasmodium falciparum
LKEKDKKI

SEQ ID NO: 3327176 - protein, 21 aa, Plasmodium falciparum
LKEKIGDKEEKKDLTSKIKKN

SEQ ID NO: 3327177 - protein, 12 aa, Plasmodium falciparum
LKEKKDNQGKDL

SEQ ID NO: 3327178 - protein, 19 aa, Plasmodium falciparum
LKEKKKRNLVEEGKQSKTT

SEQ ID NO: 3327179 - protein, 32 aa, Plasmodium falciparum
LKEKKNLKNDIKTGELAKGGNSTNINKNIPQK

SEQ ID NO: 3327180 - protein, 11 aa, Plasmodium falciparum
LKEKNERYKSR

SEQ ID NO: 3327181 - protein, 12 aa, Plasmodium falciparum
LKEKNQNDSIEP

SEQ ID NO: 3327182 - protein, 7 aa, Plasmodium falciparum
LKEKNSD

SEQ ID NO: 3327183 - protein, 5 aa, Plasmodium falciparum
LKEKQ

SEQ ID NO: 3327184 - protein, 7 aa, Plasmodium falciparum
LKEKTNT

SEQ ID NO: 3327185 - protein, 9 aa, Plasmodium falciparum
LKENKDKKG

SEQ ID NO: 3327186 - protein, 9 aa, Plasmodium falciparum
LKENKEKSS

SEQ ID NO: 3327187 - protein, 6 aa, Plasmodium falciparum
LKENKG

SEQ ID NO: 3327188 - protein, 7 aa, Plasmodium falciparum
LKENNGL

SEQ ID NO: 3327189 - protein, 33 aa, Plasmodium falciparum
LKENNNKESEDENKQDNVGTEKKECDCSEKEKY

SEQ ID NO: 3327190 - protein, 11 aa, Plasmodium falciparum
LKENNNKKNDN

SEQ ID NO: 3327191 - protein, 9 aa, Plasmodium falciparum
LKENNPNIS

SEQ ID NO: 3327192 - protein, 21 aa, Plasmodium falciparum
LKENTNKDNTNKENTNKDNTN

SEQ ID NO: 3327193 - protein, 7 aa, Plasmodium falciparum
LKEPTNS

SEQ ID NO: 3327194 - protein, 12 aa, Plasmodium falciparum
LKEQEKHLQNSH

SEQ ID NO: 3327195 - protein, 10 aa, Plasmodium falciparum
LKEQNEDKIN

SEQ ID NO: 3327196 - protein, 7 aa, Plasmodium falciparum
LKEQNEE

SEQ ID NO: 3327197 - protein, 4 aa, Plasmodium falciparum
LKER

SEQ ID NO: 3327198 - protein, 7 aa, Plasmodium falciparum
LKEREKS

SEQ ID NO: 3327199 - protein, 11 aa, Plasmodium falciparum
LKESEKAEEDM

SEQ ID NO: 3327200 - protein, 5 aa, Plasmodium falciparum
LKESI

SEQ ID NO: 3327201 - protein, 17 aa, Plasmodium falciparum
LKESNNNNTNNVNNNED

SEQ ID NO: 3327202 - protein, 7 aa, Plasmodium falciparum
LKESQNT

SEQ ID NO: 3327203 - protein, 8 aa, Plasmodium falciparum
LKETDKEY

SEQ ID NO: 3327204 - protein, 5 aa, Plasmodium falciparum
LKETG

SEQ ID NO: 3327205 - protein, 8 aa, Plasmodium falciparum
LKETGKDV

SEQ ID NO: 3327206 - protein, 13 aa, Plasmodium falciparum
LKETQKKNHKNNT

SEQ ID NO: 3327207 - protein, 4 aa, Plasmodium falciparum
LKEY

SEQ ID NO: 3327208 - protein, 14 aa, Plasmodium falciparum
LKGDGEKNIHEGGD

SEQ ID NO: 3327209 - protein, 7 aa, Plasmodium falciparum
LKGETPS

SEQ ID NO: 3327210 - protein, 9 aa, Plasmodium falciparum
LKGKEGRLR

SEQ ID NO: 3327211 - protein, 19 aa, Plasmodium falciparum
LKGKKEEEDIKKNDSFKGN

SEQ ID NO: 3327212 - protein, 14 aa, Plasmodium falciparum
LKGKKKKKKEKQKK

SEQ ID NO: 3327213 - protein, 9 aa, Plasmodium falciparum
LKGKNNNVE

SEQ ID NO: 3327214 - protein, 8 aa, Plasmodium falciparum
LKGNENEL

SEQ ID NO: 3327215 - protein, 13 aa, Plasmodium falciparum
LKGNHKDGNIREE

SEQ ID NO: 3327216 - protein, 8 aa, Plasmodium falciparum
LKGPGGKP

SEQ ID NO: 3327217 - protein, 7 aa, Plasmodium falciparum
LKGSNEK

SEQ ID NO: 3327218 - protein, 23 aa, Plasmodium falciparum
LKGSSDDEHKKKHRKIINNRKML

SEQ ID NO: 3327219 - protein, 9 aa, Plasmodium falciparum
LKGSSTDKT

SEQ ID NO: 3327220 - protein, 6 aa, Plasmodium falciparum
LKGTNI

SEQ ID NO: 3327221 - protein, 17 aa, Plasmodium falciparum
LKGTNNDSKNKEKGNLK

SEQ ID NO: 3327222 - protein, 13 aa, Plasmodium falciparum
LKHEKNKSKRDNI

SEQ ID NO: 3327223 - protein, 36 aa, Plasmodium falciparum
LKHKNDDDNKKKRQKRYNTPGIHSDNSTSQRSSNKY

SEQ ID NO: 3327224 - protein, 5 aa, Plasmodium falciparum
LKHNN

SEQ ID NO: 3327225 - protein, 7 aa, Plasmodium falciparum
LKIEKSG

SEQ ID NO: 3327226 - protein, 7 aa, Plasmodium falciparum
LKKDEKM

SEQ ID NO: 3327227 - protein, 11 aa, Plasmodium falciparum
LKKDKEENTNL

SEQ ID NO: 3327228 - protein, 34 aa, Plasmodium falciparum
LKKDKKAKKRIEKKKKNISRTKYSKSKPFKFRRK

SEQ ID NO: 3327229 - protein, 7 aa, Plasmodium falciparum
LKKDQEN

SEQ ID NO: 3327230 - protein, 42 aa, Plasmodium falciparum
LKKEEEKPKGNPYYTSDHDEDQTDLENKNDQNKKLTNKQSNY

SEQ ID NO: 3327231 - protein, 11 aa, Plasmodium falciparum
LKKEEKNKNKN

SEQ ID NO: 3327232 - protein, 12 aa, Plasmodium falciparum
LKKEKKIKKRKR

SEQ ID NO: 3327233 - protein, 7 aa, Plasmodium falciparum
LKKEKNL

SEQ ID NO: 3327234 - protein, 25 aa, Plasmodium falciparum
LKKEKQKLKSLKSKKKKKDTLSDED

SEQ ID NO: 3327235 - protein, 7 aa, Plasmodium falciparum
LKKENSF

SEQ ID NO: 3327236 - protein, 41 aa, Plasmodium falciparum
LKKEVPSDNTKKNEDKNKNNDNNNNNNNNNTNSSGNNNYEE

SEQ ID NO: 3327237 - protein, 4 aa, Plasmodium falciparum
LKKG

SEQ ID NO: 3327238 - protein, 6 aa, Plasmodium falciparum
LKKGEN

SEQ ID NO: 3327239 - protein, 19 aa, Plasmodium falciparum
LKKGETEKLEGENIEVEEE

SEQ ID NO: 3327240 - protein, 10 aa, Plasmodium falciparum
LKKGGKAYFG

SEQ ID NO: 3327241 - protein, 11 aa, Plasmodium falciparum
LKKGKEISNDK

SEQ ID NO: 3327242 - protein, 41 aa, Plasmodium falciparum
LKKGPKKNYGKKSGNINGGGDINGGGDINGEGNVNKDGYIN

SEQ ID NO: 3327243 - protein, 10 aa, Plasmodium falciparum
LKKGSDHSTG

SEQ ID NO: 3327244 - protein, 4 aa, Plasmodium falciparum
LKKI

SEQ ID NO: 3327245 - protein, 11 aa, Plasmodium falciparum
LKKIENKNNDY

SEQ ID NO: 3327246 - protein, 4 aa, Plasmodium falciparum
LKKK

SEQ ID NO: 3327247 - protein, 8 aa, Plasmodium falciparum
LKKKDRSY

SEQ ID NO: 3327248 - protein, 6 aa, Plasmodium falciparum
LKKKGC

SEQ ID NO: 3327249 - protein, 10 aa, Plasmodium falciparum
LKKKKKKKNI

SEQ ID NO: 3327250 - protein, 9 aa, Plasmodium falciparum
LKKKKKKLS

SEQ ID NO: 3327251 - protein, 33 aa, Plasmodium falciparum
LKKKKKNQANNNNSEYTEKQYESNSSDSDSDIS

SEQ ID NO: 3327252 - protein, 11 aa, Plasmodium falciparum
LKKKKNNKGSL

SEQ ID NO: 3327253 - protein, 9 aa, Plasmodium falciparum
LKKKKSSDI

SEQ ID NO: 3327254 - protein, 14 aa, Plasmodium falciparum
LKKKMDEVANQGKA

SEQ ID NO: 3327255 - protein, 6 aa, Plasmodium falciparum
LKKKSN

SEQ ID NO: 3327256 - protein, 12 aa, Plasmodium falciparum
LKKNDEEKENEI

SEQ ID NO: 3327257 - protein, 22 aa, Plasmodium falciparum
LKKNEDQENQKKDKRENQGSHL

SEQ ID NO: 3327258 - protein, 8 aa, Plasmodium falciparum
LKKNKRKI

SEQ ID NO: 3327259 - protein, 5 aa, Plasmodium falciparum
LKKNL

SEQ ID NO: 3327260 - protein, 17 aa, Plasmodium falciparum
LKKNNQRKKDEFTRLLQ

SEQ ID NO: 3327261 - protein, 8 aa, Plasmodium falciparum
LKKQKEKK

SEQ ID NO: 3327262 - protein, 5 aa, Plasmodium falciparum
LKKQN

SEQ ID NO: 3327263 - protein, 8 aa, Plasmodium falciparum
LKKQNNID

SEQ ID NO: 3327264 - protein, 5 aa, Plasmodium falciparum
LKKRN

SEQ ID NO: 3327265 - protein, 6 aa, Plasmodium falciparum
LKKSKN

SEQ ID NO: 3327266 - protein, 7 aa, Plasmodium falciparum
LKKSNGE

SEQ ID NO: 3327267 - protein, 14 aa, Plasmodium falciparum
LKKSNNNLNEDLRK

SEQ ID NO: 3327268 - protein, 22 aa, Plasmodium falciparum
LKKSSKSAKKLQQRTQANKQEL

SEQ ID NO: 3327269 - protein, 12 aa, Plasmodium falciparum
LKKSSSSDGIKK

SEQ ID NO: 3327270 - protein, 9 aa, Plasmodium falciparum
LKKYNNEIS

SEQ ID NO: 3327271 - protein, 8 aa, Plasmodium falciparum
LKNAEQNY

SEQ ID NO: 3327272 - protein, 22 aa, Plasmodium falciparum
LKNASAKDFQNDSESGTESEAE

SEQ ID NO: 3327273 - protein, 6 aa, Plasmodium falciparum
LKNDDI

SEQ ID NO: 3327274 - protein, 15 aa, Plasmodium falciparum
LKNDDNNISYENEKN

SEQ ID NO: 3327275 - protein, 8 aa, Plasmodium falciparum
LKNDEKKN

SEQ ID NO: 3327276 - protein, 9 aa, Plasmodium falciparum
LKNDGNELY

SEQ ID NO: 3327277 - protein, 10 aa, Plasmodium falciparum
LKNDKTKTYT

SEQ ID NO: 3327278 - protein, 52 aa, Plasmodium falciparum
LKNDNLNNNTCDSDKKKTNKREVKRKSKVINDNKIDNENKNTKRKKKTNGDV

SEQ ID NO: 3327279 - protein, 14 aa, Plasmodium falciparum
LKNDNNKTENFVLK

SEQ ID NO: 3327280 - protein, 9 aa, Plasmodium falciparum
LKNDNTNNK

SEQ ID NO: 3327281 - protein, 6 aa, Plasmodium falciparum
LKNDQN

SEQ ID NO: 3327282 - protein, 9 aa, Plasmodium falciparum
LKNDSDDIV

SEQ ID NO: 3327283 - protein, 13 aa, Plasmodium falciparum
LKNDSKTTIYDEG

SEQ ID NO: 3327284 - protein, 4 aa, Plasmodium falciparum
LKNE

SEQ ID NO: 3327285 - protein, 5 aa, Plasmodium falciparum
LKNEA

SEQ ID NO: 3327286 - protein, 5 aa, Plasmodium falciparum
LKNEE

SEQ ID NO: 3327287 - protein, 5 aa, Plasmodium falciparum
LKNEH

SEQ ID NO: 3327288 - protein, 21 aa, Plasmodium falciparum
LKNEKDNIENNMSEENDETLN

SEQ ID NO: 3327289 - protein, 8 aa, Plasmodium falciparum
LKNEKREN

SEQ ID NO: 3327290 - protein, 9 aa, Plasmodium falciparum
LKNENQDIY

SEQ ID NO: 3327291 - protein, 31 aa, Plasmodium falciparum
LKNETNSNNNSNSNNNNKSNNNNGNNNSSNN

SEQ ID NO: 3327292 - protein, 9 aa, Plasmodium falciparum
LKNGKDNNN

SEQ ID NO: 3327293 - protein, 5 aa, Plasmodium falciparum
LKNIQ

SEQ ID NO: 3327294 - protein, 12 aa, Plasmodium falciparum
LKNKELEKNIEH

SEQ ID NO: 3327295 - protein, 10 aa, Plasmodium falciparum
LKNKKKVSYN

SEQ ID NO: 3327296 - protein, 24 aa, Plasmodium falciparum
LKNKKNKKGNDEEDQEEQKKKLQS

SEQ ID NO: 3327297 - protein, 16 aa, Plasmodium falciparum
LKNKNDNKIKKYNTND

SEQ ID NO: 3327298 - protein, 11 aa, Plasmodium falciparum
LKNKNKSKSVQ

SEQ ID NO: 3327299 - protein, 7 aa, Plasmodium falciparum
LKNKNSL

SEQ ID NO: 3327300 - protein, 7 aa, Plasmodium falciparum
LKNKNSN

SEQ ID NO: 3327301 - protein, 9 aa, Plasmodium falciparum
LKNKQKDHE

SEQ ID NO: 3327302 - protein, 5 aa, Plasmodium falciparum
LKNKS

SEQ ID NO: 3327303 - protein, 27 aa, Plasmodium falciparum
LKNKSKGQKVEKDTYSEDDDNNKSNNV

SEQ ID NO: 3327304 - protein, 12 aa, Plasmodium falciparum
LKNKSKTDNTDY

SEQ ID NO: 3327305 - protein, 29 aa, Plasmodium falciparum
LKNKSNGKNSTKNFKENLNKNEKEDKNIA

SEQ ID NO: 3327306 - protein, 16 aa, Plasmodium falciparum
LKNKTDKCNKGYNDKV

SEQ ID NO: 3327307 - protein, 4 aa, Plasmodium falciparum
LKNN

SEQ ID NO: 3327308 - protein, 9 aa, Plasmodium falciparum
LKNNDKQVS

SEQ ID NO: 3327309 - protein, 8 aa, Plasmodium falciparum
LKNNEKQL

SEQ ID NO: 3327310 - protein, 5 aa, Plasmodium falciparum
LKNNK

SEQ ID NO: 3327311 - protein, 8 aa, Plasmodium falciparum
LKNNKGKA

SEQ ID NO: 3327312 - protein, 42 aa, Plasmodium falciparum
LKNNNGNKCTYEKGEEKNKNFCSQSRNNSLTSFRNKNDKNIK

SEQ ID NO: 3327313 - protein, 14 aa, Plasmodium falciparum
LKNNNNEDEEGNEN

SEQ ID NO: 3327314 - protein, 11 aa, Plasmodium falciparum
LKNNPKSTSFI

SEQ ID NO: 3327315 - protein, 6 aa, Plasmodium falciparum
LKNNQS

SEQ ID NO: 3327316 - protein, 8 aa, Plasmodium falciparum
LKNNTHEN

SEQ ID NO: 3327317 - protein, 10 aa, Plasmodium falciparum
LKNNVSDKDQ

SEQ ID NO: 3327318 - protein, 15 aa, Plasmodium falciparum
LKNQEKTLEQERAEK

SEQ ID NO: 3327319 - protein, 7 aa, Plasmodium falciparum
LKNRQSK

SEQ ID NO: 3327320 - protein, 9 aa, Plasmodium falciparum
LKNSDQSKE

SEQ ID NO: 3327321 - protein, 13 aa, Plasmodium falciparum
LKNSSIPNNVPGY

SEQ ID NO: 3327322 - protein, 7 aa, Plasmodium falciparum
LKNTNND

SEQ ID NO: 3327323 - protein, 24 aa, Plasmodium falciparum
LKNTNQFNQSSKHNPNMSQGSSAN

SEQ ID NO: 3327324 - protein, 6 aa, Plasmodium falciparum
LKNTSK

SEQ ID NO: 3327325 - protein, 17 aa, Plasmodium falciparum
LKNTYHNNNYNKNNHQN

SEQ ID NO: 3327326 - protein, 4 aa, Plasmodium falciparum
LKNY

SEQ ID NO: 3327327 - protein, 6 aa, Plasmodium falciparum
LKNYDN

SEQ ID NO: 3327328 - protein, 4 aa, Plasmodium falciparum
LKPD

SEQ ID NO: 3327329 - protein, 7 aa, Plasmodium falciparum
LKPKSTT

SEQ ID NO: 3327330 - protein, 7 aa, Plasmodium falciparum
LKPNEGY

SEQ ID NO: 3327331 - protein, 6 aa, Plasmodium falciparum
LKPNLG

SEQ ID NO: 3327332 - protein, 7 aa, Plasmodium falciparum
LKPQKKN

SEQ ID NO: 3327333 - protein, 5 aa, Plasmodium falciparum
LKPQR

SEQ ID NO: 3327334 - protein, 5 aa, Plasmodium falciparum
LKPRG

SEQ ID NO: 3327335 - protein, 9 aa, Plasmodium falciparum
LKPTSQKED

SEQ ID NO: 3327336 - protein, 6 aa, Plasmodium falciparum
LKQDNE

SEQ ID NO: 3327337 - protein, 4 aa, Plasmodium falciparum
LKQE

SEQ ID NO: 3327338 - protein, 11 aa, Plasmodium falciparum
LKQKKKKEEYP

SEQ ID NO: 3327339 - protein, 15 aa, Plasmodium falciparum
LKQKKKKHHNVGKNS

SEQ ID NO: 3327340 - protein, 10 aa, Plasmodium falciparum
LKQKKNKEIK

SEQ ID NO: 3327341 - protein, 14 aa, Plasmodium falciparum
LKQRDSATAPNVGD

SEQ ID NO: 3327342 - protein, 9 aa, Plasmodium falciparum
LKQTNEYQN

SEQ ID NO: 3327343 - protein, 5 aa, Plasmodium falciparum
LKREK

SEQ ID NO: 3327344 - protein, 7 aa, Plasmodium falciparum
LKREQNS

SEQ ID NO: 3327345 - protein, 9 aa, Plasmodium falciparum
LKRNESPRF

SEQ ID NO: 3327346 - protein, 9 aa, Plasmodium falciparum
LKRNKKEID

SEQ ID NO: 3327347 - protein, 6 aa, Plasmodium falciparum
LKRQEA

SEQ ID NO: 3327348 - protein, 6 aa, Plasmodium falciparum
LKRSTD

SEQ ID NO: 3327349 - protein, 23 aa, Plasmodium falciparum
LKRTDSKDTDDVDKEDGDGNLYN

SEQ ID NO: 3327350 - protein, 9 aa, Plasmodium falciparum
LKSDHPKRK

SEQ ID NO: 3327351 - protein, 7 aa, Plasmodium falciparum
LKSDKEY

SEQ ID NO: 3327352 - protein, 8 aa, Plasmodium falciparum
LKSDNKNN

SEQ ID NO: 3327353 - protein, 8 aa, Plasmodium falciparum
LKSEDNRY

SEQ ID NO: 3327354 - protein, 7 aa, Plasmodium falciparum
LKSEKSY

SEQ ID NO: 3327355 - protein, 10 aa, Plasmodium falciparum
LKSGDTDEAP

SEQ ID NO: 3327356 - protein, 9 aa, Plasmodium falciparum
LKSGDTNKY

SEQ ID NO: 3327357 - protein, 7 aa, Plasmodium falciparum
LKSGTNH

SEQ ID NO: 3327358 - protein, 27 aa, Plasmodium falciparum
LKSKENNVFSSEEDFEEDEQDEELNEE

SEQ ID NO: 3327359 - protein, 11 aa, Plasmodium falciparum
LKSKNKKKEVK

SEQ ID NO: 3327360 - protein, 10 aa, Plasmodium falciparum
LKSMNETKIQ

SEQ ID NO: 3327361 - protein, 4 aa, Plasmodium falciparum
LKSN

SEQ ID NO: 3327362 - protein, 8 aa, Plasmodium falciparum
LKSNDPDQ

SEQ ID NO: 3327363 - protein, 5 aa, Plasmodium falciparum
LKSNL

SEQ ID NO: 3327364 - protein, 4 aa, Plasmodium falciparum
LKSP

SEQ ID NO: 3327365 - protein, 9 aa, Plasmodium falciparum
LKSRNEKEE

SEQ ID NO: 3327366 - protein, 4 aa, Plasmodium falciparum
LKSS

SEQ ID NO: 3327367 - protein, 11 aa, Plasmodium falciparum
LKSSEEVGEHT

SEQ ID NO: 3327368 - protein, 31 aa, Plasmodium falciparum
LKSSHADNSNEIVTKGKKKKNTNKKKKINNI

SEQ ID NO: 3327369 - protein, 5 aa, Plasmodium falciparum
LKSSK

SEQ ID NO: 3327370 - protein, 6 aa, Plasmodium falciparum
LKSSKK

SEQ ID NO: 3327371 - protein, 5 aa, Plasmodium falciparum
LKSTS

SEQ ID NO: 3327372 - protein, 6 aa, Plasmodium falciparum
LKSTTS

SEQ ID NO: 3327373 - protein, 4 aa, Plasmodium falciparum
LKSY

SEQ ID NO: 3327374 - protein, 10 aa, Plasmodium falciparum
LKSYNKKRNE

SEQ ID NO: 3327375 - protein, 16 aa, Plasmodium falciparum
LKTDDSTNADSNNTTI

SEQ ID NO: 3327376 - protein, 14 aa, Plasmodium falciparum
LKTEKNIYSKERKN

SEQ ID NO: 3327377 - protein, 7 aa, Plasmodium falciparum
LKTGQTK

SEQ ID NO: 3327378 - protein, 8 aa, Plasmodium falciparum
LKTKNEEN

SEQ ID NO: 3327379 - protein, 10 aa, Plasmodium falciparum
LKTKQGNDIA

SEQ ID NO: 3327380 - protein, 8 aa, Plasmodium falciparum
LKTNCGNS

SEQ ID NO: 3327381 - protein, 5 aa, Plasmodium falciparum
LKTND

SEQ ID NO: 3327382 - protein, 6 aa, Plasmodium falciparum
LKTPQC

SEQ ID NO: 3327383 - protein, 16 aa, Plasmodium falciparum
LKTSENDASLSKENKV

SEQ ID NO: 3327384 - protein, 5 aa, Plasmodium falciparum
LKTSK

SEQ ID NO: 3327385 - protein, 10 aa, Plasmodium falciparum
LKTSKETKHN

SEQ ID NO: 3327386 - protein, 7 aa, Plasmodium falciparum
LKTSSDT

SEQ ID NO: 3327387 - protein, 6 aa, Plasmodium falciparum
LKYGDG

SEQ ID NO: 3327388 - protein, 10 aa, Plasmodium falciparum
LKYGKGGQAY

SEQ ID NO: 3327389 - protein, 24 aa, Plasmodium falciparum
LKYNNSINNNDSTIDNGTNSSNHI

SEQ ID NO: 3327390 - protein, 37 aa, Plasmodium falciparum
LKYSDDENEEQSYNKKNKKKKKKNSNDNDNDNENENF

SEQ ID NO: 3327391 - protein, 6 aa, Plasmodium falciparum
LLEDEN

SEQ ID NO: 3327392 - protein, 30 aa, Plasmodium falciparum
LLEDSDSEQEYNTSNSNNTSCNISEEENDI

SEQ ID NO: 3327393 - protein, 4 aa, Plasmodium falciparum
LLER

SEQ ID NO: 3327394 - protein, 11 aa, Plasmodium falciparum
LLETPESDNLD

SEQ ID NO: 3327395 - protein, 11 aa, Plasmodium falciparum
LLGTSNNNNVS

SEQ ID NO: 3327396 - protein, 18 aa, Plasmodium falciparum
LLKDDERDKHKCKNRSKE

SEQ ID NO: 3327397 - protein, 9 aa, Plasmodium falciparum
LLKDKSNEF

SEQ ID NO: 3327398 - protein, 10 aa, Plasmodium falciparum
LLKGEGKNIG

SEQ ID NO: 3327399 - protein, 10 aa, Plasmodium falciparum
LLKNNNNSFH

SEQ ID NO: 3327400 - protein, 10 aa, Plasmodium falciparum
LLNDGSSTIQ

SEQ ID NO: 3327401 - protein, 4 aa, Plasmodium falciparum
LLNN

SEQ ID NO: 3327402 - protein, 13 aa, Plasmodium falciparum
LLNNNNNNTIKRG

SEQ ID NO: 3327403 - protein, 11 aa, Plasmodium falciparum
LLNNNTNHTNI

SEQ ID NO: 3327404 - protein, 4 aa, Plasmodium falciparum
LLNS

SEQ ID NO: 3327405 - protein, 9 aa, Plasmodium falciparum
LLNSTPDNH

SEQ ID NO: 3327406 - protein, 12 aa, Plasmodium falciparum
LLTGEKKMRKKS

SEQ ID NO: 3327407 - protein, 10 aa, Plasmodium falciparum
LLTSSDKENI

SEQ ID NO: 3327408 - protein, 38 aa, Plasmodium falciparum
LMDNDGERNNSNNNIGSNYKKKKLEKKSFEDNKKKTRI

SEQ ID NO: 3327409 - protein, 8 aa, Plasmodium falciparum
LMNSTNSD

SEQ ID NO: 3327410 - protein, 11 aa, Plasmodium falciparum
LNADEEEGKND

SEQ ID NO: 3327411 - protein, 12 aa, Plasmodium falciparum
LNADSEGLSGNH

SEQ ID NO: 3327412 - protein, 7 aa, Plasmodium falciparum
LNAREKS

SEQ ID NO: 3327413 - protein, 7 aa, Plasmodium falciparum
LNAREPK

SEQ ID NO: 3327414 - protein, 13 aa, Plasmodium falciparum
LNASNHHNNQANN

SEQ ID NO: 3327415 - protein, 14 aa, Plasmodium falciparum
LNCKNGEEGQDDYT

SEQ ID NO: 3327416 - protein, 8 aa, Plasmodium falciparum
LNDANQNL

SEQ ID NO: 3327417 - protein, 4 aa, Plasmodium falciparum
LNDD

SEQ ID NO: 3327418 - protein, 6 aa, Plasmodium falciparum
LNDDDD

SEQ ID NO: 3327419 - protein, 13 aa, Plasmodium falciparum
LNDDDNNHNNNNN

SEQ ID NO: 3327420 - protein, 12 aa, Plasmodium falciparum
LNDDESNNKSVN

SEQ ID NO: 3327421 - protein, 13 aa, Plasmodium falciparum
LNDDGSSDGNDTD

SEQ ID NO: 3327422 - protein, 20 aa, Plasmodium falciparum
LNDDNTKDDASNYNYEESAE

SEQ ID NO: 3327423 - protein, 7 aa, Plasmodium falciparum
LNDEEEN

SEQ ID NO: 3327424 - protein, 7 aa, Plasmodium falciparum
LNDEEKK

SEQ ID NO: 3327425 - protein, 10 aa, Plasmodium falciparum
LNDEKNDVHN

SEQ ID NO: 3327426 - protein, 30 aa, Plasmodium falciparum
LNDEKNDVHNLNDEKNVQNLNGEKNEVQNL

SEQ ID NO: 3327427 - protein, 5 aa, Plasmodium falciparum
LNDEN

SEQ ID NO: 3327428 - protein, 13 aa, Plasmodium falciparum
LNDESNLKDPADN

SEQ ID NO: 3327429 - protein, 4 aa, Plasmodium falciparum
LNDG

SEQ ID NO: 3327430 - protein, 20 aa, Plasmodium falciparum
LNDHKEKSFKKRNESNEGEY

SEQ ID NO: 3327431 - protein, 9 aa, Plasmodium falciparum
LNDKEKDNI

SEQ ID NO: 3327432 - protein, 10 aa, Plasmodium falciparum
LNDKQNEERM

SEQ ID NO: 3327433 - protein, 6 aa, Plasmodium falciparum
LNDNEN

SEQ ID NO: 3327434 - protein, 5 aa, Plasmodium falciparum
LNDNN

SEQ ID NO: 3327435 - protein, 44 aa, Plasmodium falciparum
LNDNNINNDQYSDEHENNSNQSNLSSCSHNDNNSDTNSVDSDTS

SEQ ID NO: 3327436 - protein, 28 aa, Plasmodium falciparum
LNDNNNNNNNNNNNNNNNNNNNNNNNDV

SEQ ID NO: 3327437 - protein, 7 aa, Plasmodium falciparum
LNDNSCD

SEQ ID NO: 3327438 - protein, 5 aa, Plasmodium falciparum
LNDNV

SEQ ID NO: 3327439 - protein, 9 aa, Plasmodium falciparum
LNDPGDGLK

SEQ ID NO: 3327440 - protein, 7 aa, Plasmodium falciparum
LNDPKKN

SEQ ID NO: 3327441 - protein, 8 aa, Plasmodium falciparum
LNDQNGDN

SEQ ID NO: 3327442 - protein, 11 aa, Plasmodium falciparum
LNDQSNEHKYE

SEQ ID NO: 3327443 - protein, 11 aa, Plasmodium falciparum
LNDRNDKANLK

SEQ ID NO: 3327444 - protein, 6 aa, Plasmodium falciparum
LNDSTN

SEQ ID NO: 3327445 - protein, 21 aa, Plasmodium falciparum
LNDSTQTKELNEGKSNNGKAE

SEQ ID NO: 3327446 - protein, 9 aa, Plasmodium falciparum
LNDTNDSEH

SEQ ID NO: 3327447 - protein, 11 aa, Plasmodium falciparum
LNDYDEKNTSY

SEQ ID NO: 3327448 - protein, 4 aa, Plasmodium falciparum
LNEA

SEQ ID NO: 3327449 - protein, 13 aa, Plasmodium falciparum
LNEDEDEEAEQQH

SEQ ID NO: 3327450 - protein, 5 aa, Plasmodium falciparum
LNEDN

SEQ ID NO: 3327451 - protein, 9 aa, Plasmodium falciparum
LNEDTTNNN

SEQ ID NO: 3327452 - protein, 6 aa, Plasmodium falciparum
LNEEDE

SEQ ID NO: 3327453 - protein, 16 aa, Plasmodium falciparum
LNEEDELQGSQKVDEK

SEQ ID NO: 3327454 - protein, 21 aa, Plasmodium falciparum
LNEEEEKKKKKRKKKKSPTII

SEQ ID NO: 3327455 - protein, 10 aa, Plasmodium falciparum
LNEEEKDNEE

SEQ ID NO: 3327456 - protein, 5 aa, Plasmodium falciparum
LNEEG

SEQ ID NO: 3327457 - protein, 8 aa, Plasmodium falciparum
LNEEKDGF

SEQ ID NO: 3327458 - protein, 18 aa, Plasmodium falciparum
LNEEKKNNNMNSSNNNLN

SEQ ID NO: 3327459 - protein, 9 aa, Plasmodium falciparum
LNEENEHKV

SEQ ID NO: 3327460 - protein, 17 aa, Plasmodium falciparum
LNEENKSCEKTKERKKQ

SEQ ID NO: 3327461 - protein, 12 aa, Plasmodium falciparum
LNEEQNDAKSVT

SEQ ID NO: 3327462 - protein, 6 aa, Plasmodium falciparum
LNEERK

SEQ ID NO: 3327463 - protein, 10 aa, Plasmodium falciparum
LNEESASSIS

SEQ ID NO: 3327464 - protein, 10 aa, Plasmodium falciparum
LNEESDENNN

SEQ ID NO: 3327465 - protein, 7 aa, Plasmodium falciparum
LNEETNL

SEQ ID NO: 3327466 - protein, 6 aa, Plasmodium falciparum
LNEHEL

SEQ ID NO: 3327467 - protein, 5 aa, Plasmodium falciparum
LNEKE

SEQ ID NO: 3327468 - protein, 6 aa, Plasmodium falciparum
LNEKEK

SEQ ID NO: 3327469 - protein, 12 aa, Plasmodium falciparum
LNEKEKSPPLDN

SEQ ID NO: 3327470 - protein, 12 aa, Plasmodium falciparum
LNEKKNNSKEEV

SEQ ID NO: 3327471 - protein, 10 aa, Plasmodium falciparum
LNEKNKEEEI

SEQ ID NO: 3327472 - protein, 7 aa, Plasmodium falciparum
LNEKNNK

SEQ ID NO: 3327473 - protein, 7 aa, Plasmodium falciparum
LNEKNSY

SEQ ID NO: 3327474 - protein, 52 aa, Plasmodium falciparum
LNEKQKDNDNNDDGDDDGNNEKENLDEQNEHMENNTYNNNNNNNNNNNTKHK

SEQ ID NO: 3327475 - protein, 9 aa, Plasmodium falciparum
LNEKTHGSC

SEQ ID NO: 3327476 - protein, 4 aa, Plasmodium falciparum
LNEN

SEQ ID NO: 3327477 - protein, 14 aa, Plasmodium falciparum
LNENLKDPNVSRKT

SEQ ID NO: 3327478 - protein, 12 aa, Plasmodium falciparum
LNENNDKNKHGD

SEQ ID NO: 3327479 - protein, 5 aa, Plasmodium falciparum
LNEQL

SEQ ID NO: 3327480 - protein, 7 aa, Plasmodium falciparum
LNEQNEH

SEQ ID NO: 3327481 - protein, 8 aa, Plasmodium falciparum
LNEQNEHK

SEQ ID NO: 3327482 - protein, 15 aa, Plasmodium falciparum
LNEQNEIKKNNQNFN

SEQ ID NO: 3327483 - protein, 4 aa, Plasmodium falciparum
LNES

SEQ ID NO: 3327484 - protein, 117 aa, Plasmodium falciparum
LNESDDKDEDDEDDDEEDDEEDDDEEDDEEDDDEEDDEEDDDEEDDNDDDNDDDNNNNNDNNNDNNNDNNNDNNNNNNNNNNDNNNNNNNNNNNNNNNDDNNNNNNDDNNNDGVNTC

SEQ ID NO: 3327485 - protein, 11 aa, Plasmodium falciparum
LNESDDSHDIN

SEQ ID NO: 3327486 - protein, 16 aa, Plasmodium falciparum
LNESNKTSKNSSNSNK

SEQ ID NO: 3327487 - protein, 6 aa, Plasmodium falciparum
LNESNS

SEQ ID NO: 3327488 - protein, 11 aa, Plasmodium falciparum
LNESSNDEDTL

SEQ ID NO: 3327489 - protein, 7 aa, Plasmodium falciparum
LNETNNN

SEQ ID NO: 3327490 - protein, 6 aa, Plasmodium falciparum
LNGDNK

SEQ ID NO: 3327491 - protein, 15 aa, Plasmodium falciparum
LNGEEKNSINTTNYK

SEQ ID NO: 3327492 - protein, 11 aa, Plasmodium falciparum
LNGEGDKLNVQ

SEQ ID NO: 3327493 - protein, 8 aa, Plasmodium falciparum
LNGEPFNE

SEQ ID NO: 3327494 - protein, 18 aa, Plasmodium falciparum
LNGERKRKRRKKKEQENL

SEQ ID NO: 3327495 - protein, 5 aa, Plasmodium falciparum
LNGHT

SEQ ID NO: 3327496 - protein, 11 aa, Plasmodium falciparum
LNGKKTLEGCT

SEQ ID NO: 3327497 - protein, 5 aa, Plasmodium falciparum
LNGKN

SEQ ID NO: 3327498 - protein, 4 aa, Plasmodium falciparum
LNGN

SEQ ID NO: 3327499 - protein, 12 aa, Plasmodium falciparum
LNGNDKNEHNNK

SEQ ID NO: 3327500 - protein, 6 aa, Plasmodium falciparum
LNGNKI

SEQ ID NO: 3327501 - protein, 13 aa, Plasmodium falciparum
LNGNKSNSYDNSE

SEQ ID NO: 3327502 - protein, 6 aa, Plasmodium falciparum
LNGQKE

SEQ ID NO: 3327503 - protein, 12 aa, Plasmodium falciparum
LNHNNNENISEQ

SEQ ID NO: 3327504 - protein, 27 aa, Plasmodium falciparum
LNHNNTKKNKGKKNNQIKQRNAQKDSN

SEQ ID NO: 3327505 - protein, 6 aa, Plasmodium falciparum
LNIPSG

SEQ ID NO: 3327506 - protein, 14 aa, Plasmodium falciparum
LNIPSKKDKPQINN

SEQ ID NO: 3327507 - protein, 11 aa, Plasmodium falciparum
LNISGNKNDID

SEQ ID NO: 3327508 - protein, 14 aa, Plasmodium falciparum
LNKDEKSNELEGEG

SEQ ID NO: 3327509 - protein, 15 aa, Plasmodium falciparum
LNKDPPTNCSAGPIG

SEQ ID NO: 3327510 - protein, 4 aa, Plasmodium falciparum
LNKE

SEQ ID NO: 3327511 - protein, 8 aa, Plasmodium falciparum
LNKEDAKK

SEQ ID NO: 3327512 - protein, 5 aa, Plasmodium falciparum
LNKEE

SEQ ID NO: 3327513 - protein, 9 aa, Plasmodium falciparum
LNKETKKNL

SEQ ID NO: 3327514 - protein, 6 aa, Plasmodium falciparum
LNKGEL

SEQ ID NO: 3327515 - protein, 9 aa, Plasmodium falciparum
LNKGGKGTF

SEQ ID NO: 3327516 - protein, 24 aa, Plasmodium falciparum
LNKGKNDDHKKNKDNDEGINNNTT

SEQ ID NO: 3327517 - protein, 17 aa, Plasmodium falciparum
LNKKDDYHNEEKDSINN

SEQ ID NO: 3327518 - protein, 5 aa, Plasmodium falciparum
LNKKG

SEQ ID NO: 3327519 - protein, 33 aa, Plasmodium falciparum
LNKKGEEKGEKNKEEEKKENEMPSEDLKNPSEL

SEQ ID NO: 3327520 - protein, 11 aa, Plasmodium falciparum
LNKKKKKDVTN

SEQ ID NO: 3327521 - protein, 19 aa, Plasmodium falciparum
LNKKNKEISVSKPKDVTEY

SEQ ID NO: 3327522 - protein, 5 aa, Plasmodium falciparum
LNKKS

SEQ ID NO: 3327523 - protein, 4 aa, Plasmodium falciparum
LNKN

SEQ ID NO: 3327524 - protein, 9 aa, Plasmodium falciparum
LNKNEEQNY

SEQ ID NO: 3327525 - protein, 10 aa, Plasmodium falciparum
LNKNEGKNLT

SEQ ID NO: 3327526 - protein, 9 aa, Plasmodium falciparum
LNKNEKKKL

SEQ ID NO: 3327527 - protein, 39 aa, Plasmodium falciparum
LNKNKNKNKKGKKNKNQNKYNNDISDNNDNNSENEEKQY

SEQ ID NO: 3327528 - protein, 5 aa, Plasmodium falciparum
LNKNN

SEQ ID NO: 3327529 - protein, 51 aa, Plasmodium falciparum
LNKNNNNNNNNNNNNNNNEYINEEKKDNINEKNDISKDKKIQSNNETQKEP

SEQ ID NO: 3327530 - protein, 8 aa, Plasmodium falciparum
LNKNQNDE

SEQ ID NO: 3327531 - protein, 9 aa, Plasmodium falciparum
LNKPQNSSI

SEQ ID NO: 3327532 - protein, 11 aa, Plasmodium falciparum
LNKQHSSEKKK

SEQ ID NO: 3327533 - protein, 7 aa, Plasmodium falciparum
LNKQSEN

SEQ ID NO: 3327534 - protein, 8 aa, Plasmodium falciparum
LNKSENYS

SEQ ID NO: 3327535 - protein, 14 aa, Plasmodium falciparum
LNKSETAKKYGEEQ

SEQ ID NO: 3327536 - protein, 11 aa, Plasmodium falciparum
LNKSGESVQEN

SEQ ID NO: 3327537 - protein, 10 aa, Plasmodium falciparum
LNKSNSGSGL

SEQ ID NO: 3327538 - protein, 6 aa, Plasmodium falciparum
LNKSTV

SEQ ID NO: 3327539 - protein, 5 aa, Plasmodium falciparum
LNKTN

SEQ ID NO: 3327540 - protein, 21 aa, Plasmodium falciparum
LNKTNDNDAENEKKTDNQTIG

SEQ ID NO: 3327541 - protein, 21 aa, Plasmodium falciparum
LNKTNKSIDEKKENKTKKNVI

SEQ ID NO: 3327542 - protein, 11 aa, Plasmodium falciparum
LNKTPSKSLSK

SEQ ID NO: 3327543 - protein, 10 aa, Plasmodium falciparum
LNKTRNDNNL

SEQ ID NO: 3327544 - protein, 6 aa, Plasmodium falciparum
LNKYEN

SEQ ID NO: 3327545 - protein, 17 aa, Plasmodium falciparum
LNLPSNKKVGSDDLNTT

SEQ ID NO: 3327546 - protein, 7 aa, Plasmodium falciparum
LNNDDPN

SEQ ID NO: 3327547 - protein, 10 aa, Plasmodium falciparum
LNNDEDQAHK

SEQ ID NO: 3327548 - protein, 12 aa, Plasmodium falciparum
LNNDEKKRNRRG

SEQ ID NO: 3327549 - protein, 15 aa, Plasmodium falciparum
LNNDGGKKNKEMQKC

SEQ ID NO: 3327550 - protein, 7 aa, Plasmodium falciparum
LNNDGKK

SEQ ID NO: 3327551 - protein, 35 aa, Plasmodium falciparum
LNNEDDNNNNNNNNNNNNNNNIEGNESFQNREEEN

SEQ ID NO: 3327552 - protein, 19 aa, Plasmodium falciparum
LNNEGDERKNVDKENNNMD

SEQ ID NO: 3327553 - protein, 17 aa, Plasmodium falciparum
LNNEKEKNINKKMEENV

SEQ ID NO: 3327554 - protein, 8 aa, Plasmodium falciparum
LNNEKGQN

SEQ ID NO: 3327555 - protein, 11 aa, Plasmodium falciparum
LNNEKGTLNSK

SEQ ID NO: 3327556 - protein, 6 aa, Plasmodium falciparum
LNNEKK

SEQ ID NO: 3327557 - protein, 5 aa, Plasmodium falciparum
LNNEN

SEQ ID NO: 3327558 - protein, 6 aa, Plasmodium falciparum
LNNENE

SEQ ID NO: 3327559 - protein, 51 aa, Plasmodium falciparum
LNNENGKINDKSKKCKNINNNNNNNNNNNNNNNNNNNNNNNSSSSSSGKVD

SEQ ID NO: 3327560 - protein, 11 aa, Plasmodium falciparum
LNNENSVDEKQ

SEQ ID NO: 3327561 - protein, 5 aa, Plasmodium falciparum
LNNER

SEQ ID NO: 3327562 - protein, 5 aa, Plasmodium falciparum
LNNEV

SEQ ID NO: 3327563 - protein, 5 aa, Plasmodium falciparum
LNNGS

SEQ ID NO: 3327564 - protein, 5 aa, Plasmodium falciparum
LNNKE

SEQ ID NO: 3327565 - protein, 8 aa, Plasmodium falciparum
LNNKKKEH

SEQ ID NO: 3327566 - protein, 10 aa, Plasmodium falciparum
LNNKNEQDIL

SEQ ID NO: 3327567 - protein, 10 aa, Plasmodium falciparum
LNNKNTLKEG

SEQ ID NO: 3327568 - protein, 15 aa, Plasmodium falciparum
LNNKNVSNNNNNDIH

SEQ ID NO: 3327569 - protein, 9 aa, Plasmodium falciparum
LNNKQMKKH

SEQ ID NO: 3327570 - protein, 45 aa, Plasmodium falciparum
LNNKTDVDATEKIKTKEKQNKEKNDKKKKKNKTNNNNNNNNNNKE

SEQ ID NO: 3327571 - protein, 12 aa, Plasmodium falciparum
LNNLKKSENINN

SEQ ID NO: 3327572 - protein, 4 aa, Plasmodium falciparum
LNNN

SEQ ID NO: 3327573 - protein, 8 aa, Plasmodium falciparum
LNNNDKEN

SEQ ID NO: 3327574 - protein, 36 aa, Plasmodium falciparum
LNNNDNKNMNTISDDTNTINERNAKNKKKKKNYQNN

SEQ ID NO: 3327575 - protein, 9 aa, Plasmodium falciparum
LNNNDNNNN

SEQ ID NO: 3327576 - protein, 33 aa, Plasmodium falciparum
LNNNDNSININNNNNNNTINSSNNNSNDGLNQN

SEQ ID NO: 3327577 - protein, 10 aa, Plasmodium falciparum
LNNNDSKEDY

SEQ ID NO: 3327578 - protein, 28 aa, Plasmodium falciparum
LNNNEKEKYYKDRDKNKIKKNNIKDKHV

SEQ ID NO: 3327579 - protein, 8 aa, Plasmodium falciparum
LNNNKDDT

SEQ ID NO: 3327580 - protein, 16 aa, Plasmodium falciparum
LNNNKNLNEMNRGEEY

SEQ ID NO: 3327581 - protein, 9 aa, Plasmodium falciparum
LNNNKSPNI

SEQ ID NO: 3327582 - protein, 43 aa, Plasmodium falciparum
LNNNNDNNNDNNNDNYDNNNDNNNDNYDNNNNNNNNNNNNNNC

SEQ ID NO: 3327583 - protein, 15 aa, Plasmodium falciparum
LNNNNEKKQKDNNSK

SEQ ID NO: 3327584 - protein, 6 aa, Plasmodium falciparum
LNNNNN

SEQ ID NO: 3327585 - protein, 19 aa, Plasmodium falciparum
LNNNNNDNNKINVKEEDQI

SEQ ID NO: 3327586 - protein, 18 aa, Plasmodium falciparum
LNNNNNDSGNNKGDTEID

SEQ ID NO: 3327587 - protein, 10 aa, Plasmodium falciparum
LNNNNNINNN

SEQ ID NO: 3327588 - protein, 22 aa, Plasmodium falciparum
LNNNNNMSTTKHSNMEVSSQGY

SEQ ID NO: 3327589 - protein, 9 aa, Plasmodium falciparum
LNNNNNNCY

SEQ ID NO: 3327590 - protein, 10 aa, Plasmodium falciparum
LNNNNNNING

SEQ ID NO: 3327591 - protein, 19 aa, Plasmodium falciparum
LNNNNNNNNNENQNDQNGQ

SEQ ID NO: 3327592 - protein, 24 aa, Plasmodium falciparum
LNNNNNNNNNNKSDGEENNKKNFS

SEQ ID NO: 3327593 - protein, 10 aa, Plasmodium falciparum
LNNNQSTNDI

SEQ ID NO: 3327594 - protein, 7 aa, Plasmodium falciparum
LNNNSSR

SEQ ID NO: 3327595 - protein, 8 aa, Plasmodium falciparum
LNNNTSSM

SEQ ID NO: 3327596 - protein, 13 aa, Plasmodium falciparum
LNNPKTDDSYDYP

SEQ ID NO: 3327597 - protein, 6 aa, Plasmodium falciparum
LNNQSN

SEQ ID NO: 3327598 - protein, 7 aa, Plasmodium falciparum
LNNQTGV

SEQ ID NO: 3327599 - protein, 4 aa, Plasmodium falciparum
LNNS

SEQ ID NO: 3327600 - protein, 9 aa, Plasmodium falciparum
LNNSGEATL

SEQ ID NO: 3327601 - protein, 11 aa, Plasmodium falciparum
LNNSKKANQLK

SEQ ID NO: 3327602 - protein, 21 aa, Plasmodium falciparum
LNNSKVGNINNDDKINTNEKK

SEQ ID NO: 3327603 - protein, 5 aa, Plasmodium falciparum
LNNSY

SEQ ID NO: 3327604 - protein, 4 aa, Plasmodium falciparum
LNNT

SEQ ID NO: 3327605 - protein, 13 aa, Plasmodium falciparum
LNNTNSGSNTFSN

SEQ ID NO: 3327606 - protein, 8 aa, Plasmodium falciparum
LNNTPNHD

SEQ ID NO: 3327607 - protein, 23 aa, Plasmodium falciparum
LNNTQEANNISYNNKKDITNDIQ

SEQ ID NO: 3327608 - protein, 9 aa, Plasmodium falciparum
LNNTSERNN

SEQ ID NO: 3327609 - protein, 4 aa, Plasmodium falciparum
LNNY

SEQ ID NO: 3327610 - protein, 6 aa, Plasmodium falciparum
LNNYTN

SEQ ID NO: 3327611 - protein, 6 aa, Plasmodium falciparum
LNPEEY

SEQ ID NO: 3327612 - protein, 16 aa, Plasmodium falciparum
LNPKDITNRKTPNRIT

SEQ ID NO: 3327613 - protein, 4 aa, Plasmodium falciparum
LNPN

SEQ ID NO: 3327614 - protein, 6 aa, Plasmodium falciparum
LNPNKN

SEQ ID NO: 3327615 - protein, 20 aa, Plasmodium falciparum
LNPNNGNNNNNNNNNNNSYY

SEQ ID NO: 3327616 - protein, 6 aa, Plasmodium falciparum
LNPNTT

SEQ ID NO: 3327617 - protein, 5 aa, Plasmodium falciparum
LNPSD

SEQ ID NO: 3327618 - protein, 34 aa, Plasmodium falciparum
LNPSVDDTLKKKEDYNNDNNNVDNMNNSNNQSDS

SEQ ID NO: 3327619 - protein, 5 aa, Plasmodium falciparum
LNPSY

SEQ ID NO: 3327620 - protein, 5 aa, Plasmodium falciparum
LNPTE

SEQ ID NO: 3327621 - protein, 11 aa, Plasmodium falciparum
LNPVDEDNTKK

SEQ ID NO: 3327622 - protein, 4 aa, Plasmodium falciparum
LNPY

SEQ ID NO: 3327623 - protein, 18 aa, Plasmodium falciparum
LNPYNERQEYEEEITNDN

SEQ ID NO: 3327624 - protein, 7 aa, Plasmodium falciparum
LNQAKDE

SEQ ID NO: 3327625 - protein, 7 aa, Plasmodium falciparum
LNQDAND

SEQ ID NO: 3327626 - protein, 19 aa, Plasmodium falciparum
LNQEKAHTYKDALRAAEIT

SEQ ID NO: 3327627 - protein, 11 aa, Plasmodium falciparum
LNQERKNNKNL

SEQ ID NO: 3327628 - protein, 11 aa, Plasmodium falciparum
LNQKQKQEHMR

SEQ ID NO: 3327629 - protein, 4 aa, Plasmodium falciparum
LNQN

SEQ ID NO: 3327630 - protein, 9 aa, Plasmodium falciparum
LNQNESKNI

SEQ ID NO: 3327631 - protein, 4 aa, Plasmodium falciparum
LNQS

SEQ ID NO: 3327632 - protein, 13 aa, Plasmodium falciparum
LNQSGNENENENK

SEQ ID NO: 3327633 - protein, 8 aa, Plasmodium falciparum
LNQSKKYE

SEQ ID NO: 3327634 - protein, 8 aa, Plasmodium falciparum
LNQSQREE

SEQ ID NO: 3327635 - protein, 4 aa, Plasmodium falciparum
LNQT

SEQ ID NO: 3327636 - protein, 10 aa, Plasmodium falciparum
LNQTKDKLKN

SEQ ID NO: 3327637 - protein, 6 aa, Plasmodium falciparum
LNQTNP

SEQ ID NO: 3327638 - protein, 11 aa, Plasmodium falciparum
LNQTSKKNNLD

SEQ ID NO: 3327639 - protein, 4 aa, Plasmodium falciparum
LNRK

SEQ ID NO: 3327640 - protein, 9 aa, Plasmodium falciparum
LNRKSEELN

SEQ ID NO: 3327641 - protein, 4 aa, Plasmodium falciparum
LNRS

SEQ ID NO: 3327642 - protein, 5 aa, Plasmodium falciparum
LNRTN

SEQ ID NO: 3327643 - protein, 11 aa, Plasmodium falciparum
LNSAKENNKQE

SEQ ID NO: 3327644 - protein, 8 aa, Plasmodium falciparum
LNSDEGYE

SEQ ID NO: 3327645 - protein, 15 aa, Plasmodium falciparum
LNSDNKNGRNKIKTH

SEQ ID NO: 3327646 - protein, 5 aa, Plasmodium falciparum
LNSDQ

SEQ ID NO: 3327647 - protein, 18 aa, Plasmodium falciparum
LNSDTKERKSSKKISNYS

SEQ ID NO: 3327648 - protein, 13 aa, Plasmodium falciparum
LNSEKSSNKSFNG

SEQ ID NO: 3327649 - protein, 8 aa, Plasmodium falciparum
LNSETSSF

SEQ ID NO: 3327650 - protein, 12 aa, Plasmodium falciparum
LNSGENPEQKDN

SEQ ID NO: 3327651 - protein, 6 aa, Plasmodium falciparum
LNSGNE

SEQ ID NO: 3327652 - protein, 13 aa, Plasmodium falciparum
LNSGNEQKDLSDE

SEQ ID NO: 3327653 - protein, 7 aa, Plasmodium falciparum
LNSKGTD

SEQ ID NO: 3327654 - protein, 4 aa, Plasmodium falciparum
LNSN

SEQ ID NO: 3327655 - protein, 14 aa, Plasmodium falciparum
LNSNDIKKRKKRKK

SEQ ID NO: 3327656 - protein, 5 aa, Plasmodium falciparum
LNSNN

SEQ ID NO: 3327657 - protein, 6 aa, Plasmodium falciparum
LNSNNI

SEQ ID NO: 3327658 - protein, 11 aa, Plasmodium falciparum
LNSNNNNKRPL

SEQ ID NO: 3327659 - protein, 19 aa, Plasmodium falciparum
LNSNNTSRNYVNSSNSLKS

SEQ ID NO: 3327660 - protein, 16 aa, Plasmodium falciparum
LNSNTKGRKKKANIIE

SEQ ID NO: 3327661 - protein, 10 aa, Plasmodium falciparum
LNSNTPPATP

SEQ ID NO: 3327662 - protein, 32 aa, Plasmodium falciparum
LNSNTTSKRKYSRNKNKKRDSVRQYELRSRRK

SEQ ID NO: 3327663 - protein, 4 aa, Plasmodium falciparum
LNSP

SEQ ID NO: 3327664 - protein, 14 aa, Plasmodium falciparum
LNSQDFSSNTNYKD

SEQ ID NO: 3327665 - protein, 12 aa, Plasmodium falciparum
LNSQQDNNNINN

SEQ ID NO: 3327666 - protein, 4 aa, Plasmodium falciparum
LNSR

SEQ ID NO: 3327667 - protein, 20 aa, Plasmodium falciparum
LNSSGNVPYGKKKNSTNPRS

SEQ ID NO: 3327668 - protein, 31 aa, Plasmodium falciparum
LNSSHVENSLKEDENINEKKKKKKKKKTKNV

SEQ ID NO: 3327669 - protein, 14 aa, Plasmodium falciparum
LNSSKKDNNFDEQT

SEQ ID NO: 3327670 - protein, 9 aa, Plasmodium falciparum
LNSSNGNAY

SEQ ID NO: 3327671 - protein, 18 aa, Plasmodium falciparum
LNSSNNQLNDDNYNASKN

SEQ ID NO: 3327672 - protein, 33 aa, Plasmodium falciparum
LNSSSSSSSLSSYSSLSNPSDDSCFSNKQNQNN

SEQ ID NO: 3327673 - protein, 10 aa, Plasmodium falciparum
LNSSTGTNEY

SEQ ID NO: 3327674 - protein, 5 aa, Plasmodium falciparum
LNSTC

SEQ ID NO: 3327675 - protein, 17 aa, Plasmodium falciparum
LNSTKKQKQKEKTKKEI

SEQ ID NO: 3327676 - protein, 8 aa, Plasmodium falciparum
LNSTKQNN

SEQ ID NO: 3327677 - protein, 9 aa, Plasmodium falciparum
LNTDHNKNI

SEQ ID NO: 3327678 - protein, 5 aa, Plasmodium falciparum
LNTDI

SEQ ID NO: 3327679 - protein, 7 aa, Plasmodium falciparum
LNTDSHD

SEQ ID NO: 3327680 - protein, 8 aa, Plasmodium falciparum
LNTEKEDI

SEQ ID NO: 3327681 - protein, 10 aa, Plasmodium falciparum
LNTEKENYNH

SEQ ID NO: 3327682 - protein, 5 aa, Plasmodium falciparum
LNTEN

SEQ ID NO: 3327683 - protein, 21 aa, Plasmodium falciparum
LNTENPNTQNKDETQNNEEVQ

SEQ ID NO: 3327684 - protein, 5 aa, Plasmodium falciparum
LNTGG

SEQ ID NO: 3327685 - protein, 12 aa, Plasmodium falciparum
LNTHAKSKKDIN

SEQ ID NO: 3327686 - protein, 5 aa, Plasmodium falciparum
LNTHP

SEQ ID NO: 3327687 - protein, 10 aa, Plasmodium falciparum
LNTKHSENID

SEQ ID NO: 3327688 - protein, 11 aa, Plasmodium falciparum
LNTKNHENKDA

SEQ ID NO: 3327689 - protein, 4 aa, Plasmodium falciparum
LNTN

SEQ ID NO: 3327690 - protein, 10 aa, Plasmodium falciparum
LNTNEDGKQL

SEQ ID NO: 3327691 - protein, 14 aa, Plasmodium falciparum
LNTNKKERKTFSDF

SEQ ID NO: 3327692 - protein, 6 aa, Plasmodium falciparum
LNTNQN

SEQ ID NO: 3327693 - protein, 7 aa, Plasmodium falciparum
LNTPGHA

SEQ ID NO: 3327694 - protein, 14 aa, Plasmodium falciparum
LNTPPNNINNTNNI

SEQ ID NO: 3327695 - protein, 6 aa, Plasmodium falciparum
LNTPRS

SEQ ID NO: 3327696 - protein, 5 aa, Plasmodium falciparum
LNTQQ

SEQ ID NO: 3327697 - protein, 7 aa, Plasmodium falciparum
LNTQRKW

SEQ ID NO: 3327698 - protein, 4 aa, Plasmodium falciparum
LNTR

SEQ ID NO: 3327699 - protein, 4 aa, Plasmodium falciparum
LNTS

SEQ ID NO: 3327700 - protein, 11 aa, Plasmodium falciparum
LNTSSESSIQE

SEQ ID NO: 3327701 - protein, 9 aa, Plasmodium falciparum
LNTSSSEGL

SEQ ID NO: 3327702 - protein, 77 aa, Plasmodium falciparum
LNTSYDNNSPTDSTYKSEEESSSSGDKNHRNNKYDSDKIKHEKKKKKKSIMTDEERNVDSNKRSFEKKESELNENGL

SEQ ID NO: 3327703 - protein, 27 aa, Plasmodium falciparum
LNTTNNINTGSNHHTNNITTNNNDLPT

SEQ ID NO: 3327704 - protein, 7 aa, Plasmodium falciparum
LNTTSEK

SEQ ID NO: 3327705 - protein, 18 aa, Plasmodium falciparum
LNTVSHSTSKQKAKQSKK

SEQ ID NO: 3327706 - protein, 15 aa, Plasmodium falciparum
LNTYKNKKSQDNNTL

SEQ ID NO: 3327707 - protein, 12 aa, Plasmodium falciparum
LNYNTKKNNEYS

SEQ ID NO: 3327708 - protein, 13 aa, Plasmodium falciparum
LNYSSDATNNMDD

SEQ ID NO: 3327709 - protein, 11 aa, Plasmodium falciparum
LNYSSYSSNSI

SEQ ID NO: 3327710 - protein, 12 aa, Plasmodium falciparum
LNYTNKKTPLIN

SEQ ID NO: 3327711 - protein, 4 aa, Plasmodium falciparum
LPAD

SEQ ID NO: 3327712 - protein, 29 aa, Plasmodium falciparum
LPAEKEEEEEEKLEKSKDKKDLDKIESKK

SEQ ID NO: 3327713 - protein, 11 aa, Plasmodium falciparum
LPAGKPSHRHE

SEQ ID NO: 3327714 - protein, 9 aa, Plasmodium falciparum
LPAKNRSNN

SEQ ID NO: 3327715 - protein, 6 aa, Plasmodium falciparum
LPDENN

SEQ ID NO: 3327716 - protein, 14 aa, Plasmodium falciparum
LPDNTKFGMKLYLK

SEQ ID NO: 3327717 - protein, 12 aa, Plasmodium falciparum
LPDPEKAKNEEE

SEQ ID NO: 3327718 - protein, 12 aa, Plasmodium falciparum
LPDPPPGKSRDI

SEQ ID NO: 3327719 - protein, 5 aa, Plasmodium falciparum
LPDRK

SEQ ID NO: 3327720 - protein, 15 aa, Plasmodium falciparum
LPDSPINNTYNNNNN

SEQ ID NO: 3327721 - protein, 4 aa, Plasmodium falciparum
LPEK

SEQ ID NO: 3327722 - protein, 13 aa, Plasmodium falciparum
LPEKYDEDIEKNH

SEQ ID NO: 3327723 - protein, 8 aa, Plasmodium falciparum
LPENEERK

SEQ ID NO: 3327724 - protein, 6 aa, Plasmodium falciparum
LPEQNN

SEQ ID NO: 3327725 - protein, 6 aa, Plasmodium falciparum
LPEQTY

SEQ ID NO: 3327726 - protein, 21 aa, Plasmodium falciparum
LPFEGESNYRSEFGPKPLPEL

SEQ ID NO: 3327727 - protein, 4 aa, Plasmodium falciparum
LPFN

SEQ ID NO: 3327728 - protein, 11 aa, Plasmodium falciparum
LPGEPDSKSSA

SEQ ID NO: 3327729 - protein, 4 aa, Plasmodium falciparum
LPGG

SEQ ID NO: 3327730 - protein, 10 aa, Plasmodium falciparum
LPGGAAPEME

SEQ ID NO: 3327731 - protein, 8 aa, Plasmodium falciparum
LPGGGSTE

SEQ ID NO: 3327732 - protein, 5 aa, Plasmodium falciparum
LPGKK

SEQ ID NO: 3327733 - protein, 11 aa, Plasmodium falciparum
LPGNEKYNNID

SEQ ID NO: 3327734 - protein, 10 aa, Plasmodium falciparum
LPGNLAPSQS

SEQ ID NO: 3327735 - protein, 25 aa, Plasmodium falciparum
LPHNNNNKKNNNNNNNNNNNNDNIY

SEQ ID NO: 3327736 - protein, 12 aa, Plasmodium falciparum
LPKAPTGRRPIG

SEQ ID NO: 3327737 - protein, 5 aa, Plasmodium falciparum
LPKDY

SEQ ID NO: 3327738 - protein, 8 aa, Plasmodium falciparum
LPKEPPYS

SEQ ID NO: 3327739 - protein, 5 aa, Plasmodium falciparum
LPKGR

SEQ ID NO: 3327740 - protein, 85 aa, Plasmodium falciparum
LPKGSKRYVPTQEEVERRNAEINRKKYEDDSNDSEELEEESNKSEQSDVSINDENLSKEKNDQNEEEQNDEPTNKNSEEESIEND

SEQ ID NO: 3327741 - protein, 4 aa, Plasmodium falciparum
LPKK

SEQ ID NO: 3327742 - protein, 12 aa, Plasmodium falciparum
LPKKKNKDDKLS

SEQ ID NO: 3327743 - protein, 26 aa, Plasmodium falciparum
LPKKMEQNNAVESKEAEINSFYKFYK

SEQ ID NO: 3327744 - protein, 8 aa, Plasmodium falciparum
LPKNEKKD

SEQ ID NO: 3327745 - protein, 5 aa, Plasmodium falciparum
LPKNK

SEQ ID NO: 3327746 - protein, 11 aa, Plasmodium falciparum
LPKNSKINKKN

SEQ ID NO: 3327747 - protein, 6 aa, Plasmodium falciparum
LPKNTL

SEQ ID NO: 3327748 - protein, 4 aa, Plasmodium falciparum
LPKQ

SEQ ID NO: 3327749 - protein, 10 aa, Plasmodium falciparum
LPKQARDNLD

SEQ ID NO: 3327750 - protein, 10 aa, Plasmodium falciparum
LPKSAAERNK

SEQ ID NO: 3327751 - protein, 9 aa, Plasmodium falciparum
LPKSNEQDM

SEQ ID NO: 3327752 - protein, 15 aa, Plasmodium falciparum
LPKSNNENKQKQTEI

SEQ ID NO: 3327753 - protein, 4 aa, Plasmodium falciparum
LPKT

SEQ ID NO: 3327754 - protein, 8 aa, Plasmodium falciparum
LPLKNEKN

SEQ ID NO: 3327755 - protein, 5 aa, Plasmodium falciparum
LPNDK

SEQ ID NO: 3327756 - protein, 11 aa, Plasmodium falciparum
LPNEDNNKLDD

SEQ ID NO: 3327757 - protein, 8 aa, Plasmodium falciparum
LPNEGEKK

SEQ ID NO: 3327758 - protein, 22 aa, Plasmodium falciparum
LPNENNNISNNNEIKNEGNMEN

SEQ ID NO: 3327759 - protein, 13 aa, Plasmodium falciparum
LPNGQKIKQEEIY

SEQ ID NO: 3327760 - protein, 5 aa, Plasmodium falciparum
LPNKK

SEQ ID NO: 3327761 - protein, 12 aa, Plasmodium falciparum
LPNKNANKVNTM

SEQ ID NO: 3327762 - protein, 4 aa, Plasmodium falciparum
LPNN

SEQ ID NO: 3327763 - protein, 9 aa, Plasmodium falciparum
LPNNKNKYE

SEQ ID NO: 3327764 - protein, 9 aa, Plasmodium falciparum
LPNNKPLSV

SEQ ID NO: 3327765 - protein, 9 aa, Plasmodium falciparum
LPNNKTNEY

SEQ ID NO: 3327766 - protein, 6 aa, Plasmodium falciparum
LPNNNN

SEQ ID NO: 3327767 - protein, 21 aa, Plasmodium falciparum
LPNNQTNNNGNPEESSLTYNN

SEQ ID NO: 3327768 - protein, 20 aa, Plasmodium falciparum
LPNNSNSTFDDKEKTETNNR

SEQ ID NO: 3327769 - protein, 10 aa, Plasmodium falciparum
LPNPDTKTKR

SEQ ID NO: 3327770 - protein, 8 aa, Plasmodium falciparum
LPNPPTAA

SEQ ID NO: 3327771 - protein, 18 aa, Plasmodium falciparum
LPNSEAKNDLKMLHKKLN

SEQ ID NO: 3327772 - protein, 9 aa, Plasmodium falciparum
LPNTTNGNV

SEQ ID NO: 3327773 - protein, 4 aa, Plasmodium falciparum
LPNY

SEQ ID NO: 3327774 - protein, 6 aa, Plasmodium falciparum
LPPAQQ

SEQ ID NO: 3327775 - protein, 12 aa, Plasmodium falciparum
LPPDGKTYPENA

SEQ ID NO: 3327776 - protein, 9 aa, Plasmodium falciparum
LPPDSKKKQ

SEQ ID NO: 3327777 - protein, 4 aa, Plasmodium falciparum
LPPG

SEQ ID NO: 3327778 - protein, 6 aa, Plasmodium falciparum
LPPKKN

SEQ ID NO: 3327779 - protein, 15 aa, Plasmodium falciparum
LPPLNEKQKQTDDIE

SEQ ID NO: 3327780 - protein, 7 aa, Plasmodium falciparum
LPPLPKE

SEQ ID NO: 3327781 - protein, 18 aa, Plasmodium falciparum
LPPNETLKTNYKEKKKIN

SEQ ID NO: 3327782 - protein, 5 aa, Plasmodium falciparum
LPPPI

SEQ ID NO: 3327783 - protein, 11 aa, Plasmodium falciparum
LPPPPWDENGP

SEQ ID NO: 3327784 - protein, 4 aa, Plasmodium falciparum
LPPS

SEQ ID NO: 3327785 - protein, 7 aa, Plasmodium falciparum
LPPTGGL

SEQ ID NO: 3327786 - protein, 7 aa, Plasmodium falciparum
LPPYSNS

SEQ ID NO: 3327787 - protein, 12 aa, Plasmodium falciparum
LPQEKNDDKKRE

SEQ ID NO: 3327788 - protein, 5 aa, Plasmodium falciparum
LPQKD

SEQ ID NO: 3327789 - protein, 7 aa, Plasmodium falciparum
LPQNNGA

SEQ ID NO: 3327790 - protein, 4 aa, Plasmodium falciparum
LPQQ

SEQ ID NO: 3327791 - protein, 6 aa, Plasmodium falciparum
LPQSSE

SEQ ID NO: 3327792 - protein, 7 aa, Plasmodium falciparum
LPQSVKP

SEQ ID NO: 3327793 - protein, 35 aa, Plasmodium falciparum
LPQTNKNVSNNKNVINGNNDYQNNLTDEYKNSTQH

SEQ ID NO: 3327794 - protein, 7 aa, Plasmodium falciparum
LPQYDSN

SEQ ID NO: 3327795 - protein, 5 aa, Plasmodium falciparum
LPRYE

SEQ ID NO: 3327796 - protein, 6 aa, Plasmodium falciparum
LPSDDL

SEQ ID NO: 3327797 - protein, 11 aa, Plasmodium falciparum
LPSENKKEKNI

SEQ ID NO: 3327798 - protein, 5 aa, Plasmodium falciparum
LPSET

SEQ ID NO: 3327799 - protein, 12 aa, Plasmodium falciparum
LPSHQPTINNNT

SEQ ID NO: 3327800 - protein, 19 aa, Plasmodium falciparum
LPSINNNNNNNNQSGNTNI

SEQ ID NO: 3327801 - protein, 14 aa, Plasmodium falciparum
LPSKEKIRTKDNLR

SEQ ID NO: 3327802 - protein, 5 aa, Plasmodium falciparum
LPSKK

SEQ ID NO: 3327803 - protein, 15 aa, Plasmodium falciparum
LPSKKKKKKRTTEDI

SEQ ID NO: 3327804 - protein, 4 aa, Plasmodium falciparum
LPSN

SEQ ID NO: 3327805 - protein, 6 aa, Plasmodium falciparum
LPSNNT

SEQ ID NO: 3327806 - protein, 5 aa, Plasmodium falciparum
LPSPG

SEQ ID NO: 3327807 - protein, 6 aa, Plasmodium falciparum
LPSPKK

SEQ ID NO: 3327808 - protein, 15 aa, Plasmodium falciparum
LPSRSSTNKAKKTMN

SEQ ID NO: 3327809 - protein, 9 aa, Plasmodium falciparum
LPSSQMQKQ

SEQ ID NO: 3327810 - protein, 11 aa, Plasmodium falciparum
LPSTYSKLGNP

SEQ ID NO: 3327811 - protein, 11 aa, Plasmodium falciparum
LPSVGPTTAGS

SEQ ID NO: 3327812 - protein, 24 aa, Plasmodium falciparum
LPTDAYRKQQKKKEKKKKKKEKAL

SEQ ID NO: 3327813 - protein, 7 aa, Plasmodium falciparum
LPTEKYP

SEQ ID NO: 3327814 - protein, 7 aa, Plasmodium falciparum
LPTNSKS

SEQ ID NO: 3327815 - protein, 9 aa, Plasmodium falciparum
LPTPDKYDT

SEQ ID NO: 3327816 - protein, 11 aa, Plasmodium falciparum
LPTSGYSNTSK

SEQ ID NO: 3327817 - protein, 12 aa, Plasmodium falciparum
LPTTDTGTDNSY

SEQ ID NO: 3327818 - protein, 12 aa, Plasmodium falciparum
LPVTPDEPHHNN

SEQ ID NO: 3327819 - protein, 8 aa, Plasmodium falciparum
LQDDEDND

SEQ ID NO: 3327820 - protein, 11 aa, Plasmodium falciparum
LQDDKTKKKPI

SEQ ID NO: 3327821 - protein, 8 aa, Plasmodium falciparum
LQDEEKKK

SEQ ID NO: 3327822 - protein, 17 aa, Plasmodium falciparum
LQDGNEYNLQDKNNDNI

SEQ ID NO: 3327823 - protein, 8 aa, Plasmodium falciparum
LQDKPDVG

SEQ ID NO: 3327824 - protein, 7 aa, Plasmodium falciparum
LQDKSTN

SEQ ID NO: 3327825 - protein, 9 aa, Plasmodium falciparum
LQDNEDHDM

SEQ ID NO: 3327826 - protein, 12 aa, Plasmodium falciparum
LQDRKQKGKYSG

SEQ ID NO: 3327827 - protein, 19 aa, Plasmodium falciparum
LQDSTGSKIQISSREDGLN

SEQ ID NO: 3327828 - protein, 7 aa, Plasmodium falciparum
LQEDKNK

SEQ ID NO: 3327829 - protein, 6 aa, Plasmodium falciparum
LQEENY

SEQ ID NO: 3327830 - protein, 4 aa, Plasmodium falciparum
LQEQ

SEQ ID NO: 3327831 - protein, 12 aa, Plasmodium falciparum
LQEQEKNKPLYE

SEQ ID NO: 3327832 - protein, 9 aa, Plasmodium falciparum
LQESDEKIN

SEQ ID NO: 3327833 - protein, 5 aa, Plasmodium falciparum
LQGCT

SEQ ID NO: 3327834 - protein, 16 aa, Plasmodium falciparum
LQGLEKDDNVQSEEHY

SEQ ID NO: 3327835 - protein, 8 aa, Plasmodium falciparum
LQGTKSIT

SEQ ID NO: 3327836 - protein, 4 aa, Plasmodium falciparum
LQHR

SEQ ID NO: 3327837 - protein, 6 aa, Plasmodium falciparum
LQKDTN

SEQ ID NO: 3327838 - protein, 10 aa, Plasmodium falciparum
LQKEKEDEED

SEQ ID NO: 3327839 - protein, 8 aa, Plasmodium falciparum
LQKKEKGY

SEQ ID NO: 3327840 - protein, 19 aa, Plasmodium falciparum
LQKKKKGANENEDKKNGVL

SEQ ID NO: 3327841 - protein, 4 aa, Plasmodium falciparum
LQKN

SEQ ID NO: 3327842 - protein, 8 aa, Plasmodium falciparum
LQKNPNKK

SEQ ID NO: 3327843 - protein, 7 aa, Plasmodium falciparum
LQKNSGL

SEQ ID NO: 3327844 - protein, 10 aa, Plasmodium falciparum
LQKQKKDKID

SEQ ID NO: 3327845 - protein, 11 aa, Plasmodium falciparum
LQKTEYKEKDL

SEQ ID NO: 3327846 - protein, 7 aa, Plasmodium falciparum
LQKTYSQ

SEQ ID NO: 3327847 - protein, 14 aa, Plasmodium falciparum
LQNAEKKSNDKISR

SEQ ID NO: 3327848 - protein, 4 aa, Plasmodium falciparum
LQND

SEQ ID NO: 3327849 - protein, 10 aa, Plasmodium falciparum
LQNDKNKQNV

SEQ ID NO: 3327850 - protein, 6 aa, Plasmodium falciparum
LQNEEN

SEQ ID NO: 3327851 - protein, 7 aa, Plasmodium falciparum
LQNEKND

SEQ ID NO: 3327852 - protein, 12 aa, Plasmodium falciparum
LQNEQKEYKKKN

SEQ ID NO: 3327853 - protein, 6 aa, Plasmodium falciparum
LQNEQN

SEQ ID NO: 3327854 - protein, 7 aa, Plasmodium falciparum
LQNKEDE

SEQ ID NO: 3327855 - protein, 9 aa, Plasmodium falciparum
LQNKEDEKI

SEQ ID NO: 3327856 - protein, 4 aa, Plasmodium falciparum
LQNN

SEQ ID NO: 3327857 - protein, 16 aa, Plasmodium falciparum
LQNNEKQNYSNKKNNL

SEQ ID NO: 3327858 - protein, 23 aa, Plasmodium falciparum
LQNNNNNNNNDMKGNNMKQNGYM

SEQ ID NO: 3327859 - protein, 9 aa, Plasmodium falciparum
LQNNRNDKL

SEQ ID NO: 3327860 - protein, 13 aa, Plasmodium falciparum
LQNNSKKDEDISF

SEQ ID NO: 3327861 - protein, 21 aa, Plasmodium falciparum
LQNSDGKNTFCGEKKKKNSFT

SEQ ID NO: 3327862 - protein, 13 aa, Plasmodium falciparum
LQNSNEKKKKEKS

SEQ ID NO: 3327863 - protein, 9 aa, Plasmodium falciparum
LQNSRKNIK

SEQ ID NO: 3327864 - protein, 14 aa, Plasmodium falciparum
LQNSYQEKNNKLNE

SEQ ID NO: 3327865 - protein, 21 aa, Plasmodium falciparum
LQNVTSEKNMTYTSKSNHDSF

SEQ ID NO: 3327866 - protein, 6 aa, Plasmodium falciparum
LQPLSG

SEQ ID NO: 3327867 - protein, 9 aa, Plasmodium falciparum
LQQPEYEPS

SEQ ID NO: 3327868 - protein, 5 aa, Plasmodium falciparum
LQQSE

SEQ ID NO: 3327869 - protein, 6 aa, Plasmodium falciparum
LQSEQN

SEQ ID NO: 3327870 - protein, 5 aa, Plasmodium falciparum
LQTDE

SEQ ID NO: 3327871 - protein, 11 aa, Plasmodium falciparum
LQTNKKRNLTN

SEQ ID NO: 3327872 - protein, 9 aa, Plasmodium falciparum
LQTTDDKTL

SEQ ID NO: 3327873 - protein, 8 aa, Plasmodium falciparum
LQTTRNTE

SEQ ID NO: 3327874 - protein, 4 aa, Plasmodium falciparum
LRAN

SEQ ID NO: 3327875 - protein, 9 aa, Plasmodium falciparum
LRANAGKLD

SEQ ID NO: 3327876 - protein, 7 aa, Plasmodium falciparum
LRDDESY

SEQ ID NO: 3327877 - protein, 9 aa, Plasmodium falciparum
LRDKRGKYH

SEQ ID NO: 3327878 - protein, 11 aa, Plasmodium falciparum
LRDNNGNNNNI

SEQ ID NO: 3327879 - protein, 5 aa, Plasmodium falciparum
LRDNS

SEQ ID NO: 3327880 - protein, 4 aa, Plasmodium falciparum
LRDR

SEQ ID NO: 3327881 - protein, 4 aa, Plasmodium falciparum
LRDT

SEQ ID NO: 3327882 - protein, 5 aa, Plasmodium falciparum
LREKE

SEQ ID NO: 3327883 - protein, 8 aa, Plasmodium falciparum
LREKPQRK

SEQ ID NO: 3327884 - protein, 5 aa, Plasmodium falciparum
LRESQ

SEQ ID NO: 3327885 - protein, 14 aa, Plasmodium falciparum
LRETYGAQNTSGGI

SEQ ID NO: 3327886 - protein, 25 aa, Plasmodium falciparum
LRETYGAQNTSGGIYGAQNTSGGIY

SEQ ID NO: 3327887 - protein, 169 aa, Plasmodium falciparum
LRETYGAQNTSSGTYQPQNTSSGTYQPQNTSSGTYRPQNTSSGTYQPQNTSSGAYQPQNTSSGTYQPQNTSSGTYQPQNTSSGTYQPQNTSSGTYQPQNTSSGTYQPQNTSSGTYQPQNTSSGTYQPQNTSSGTYQPQNTSSGTYQPQNTSSGTYQPQNTSSGIYGTQN

SEQ ID NO: 3327888 - protein, 13 aa, Plasmodium falciparum
LRGDNNIKDSSNK

SEQ ID NO: 3327889 - protein, 24 aa, Plasmodium falciparum
LRGEDGKYANKNYQANISEEKEKI

SEQ ID NO: 3327890 - protein, 8 aa, Plasmodium falciparum
LRGSPVSV

SEQ ID NO: 3327891 - protein, 5 aa, Plasmodium falciparum
LRKAR

SEQ ID NO: 3327892 - protein, 6 aa, Plasmodium falciparum
LRKEKS

SEQ ID NO: 3327893 - protein, 10 aa, Plasmodium falciparum
LRKGTLGTDH

SEQ ID NO: 3327894 - protein, 11 aa, Plasmodium falciparum
LRKNEEENKND

SEQ ID NO: 3327895 - protein, 11 aa, Plasmodium falciparum
LRKSKKMPVEK

SEQ ID NO: 3327896 - protein, 19 aa, Plasmodium falciparum
LRKTKKEKQENNQSTDGFS

SEQ ID NO: 3327897 - protein, 9 aa, Plasmodium falciparum
LRNEEKDEL

SEQ ID NO: 3327898 - protein, 8 aa, Plasmodium falciparum
LRNKKDSN

SEQ ID NO: 3327899 - protein, 89 aa, Plasmodium falciparum
LRNKQDDDDKINYGDNKNNYGDNKNNYGDNNNNYGDYNNNYDDNRSNYDDDKSNYDDDKSNYDDDKSNYDDDKSNYDDDKSNYDDDNKY

SEQ ID NO: 3327900 - protein, 21 aa, Plasmodium falciparum
LRNKSCSKENLKSNSTQIQNN

SEQ ID NO: 3327901 - protein, 7 aa, Plasmodium falciparum
LRNNDGP

SEQ ID NO: 3327902 - protein, 9 aa, Plasmodium falciparum
LRNNESYSK

SEQ ID NO: 3327903 - protein, 7 aa, Plasmodium falciparum
LRNQEKE

SEQ ID NO: 3327904 - protein, 6 aa, Plasmodium falciparum
LRNRGN

SEQ ID NO: 3327905 - protein, 8 aa, Plasmodium falciparum
LRPTSEQL

SEQ ID NO: 3327906 - protein, 17 aa, Plasmodium falciparum
LRRNKNKTNNMNNTNNM

SEQ ID NO: 3327907 - protein, 7 aa, Plasmodium falciparum
LRRRGGK

SEQ ID NO: 3327908 - protein, 8 aa, Plasmodium falciparum
LRRSKSKK

SEQ ID NO: 3327909 - protein, 4 aa, Plasmodium falciparum
LRSN

SEQ ID NO: 3327910 - protein, 9 aa, Plasmodium falciparum
LRSNSSNVS

SEQ ID NO: 3327911 - protein, 17 aa, Plasmodium falciparum
LRSQKKKENHIISFENF

SEQ ID NO: 3327912 - protein, 12 aa, Plasmodium falciparum
LRSRARKKGLEG

SEQ ID NO: 3327913 - protein, 16 aa, Plasmodium falciparum
LRTNEKRNSKNEKSVI

SEQ ID NO: 3327914 - protein, 5 aa, Plasmodium falciparum
LRYND

SEQ ID NO: 3327915 - protein, 9 aa, Plasmodium falciparum
LSAKEKKNL

SEQ ID NO: 3327916 - protein, 10 aa, Plasmodium falciparum
LSAKSRPSIR

SEQ ID NO: 3327917 - protein, 7 aa, Plasmodium falciparum
LSANNEA

SEQ ID NO: 3327918 - protein, 67 aa, Plasmodium falciparum
LSANNKNKSSDNSNIHKSNNKNEEEKNKKNKRSANDLYDTKRANADHDDNINNKKKIKNENARKPTF

SEQ ID NO: 3327919 - protein, 7 aa, Plasmodium falciparum
LSDDEKN

SEQ ID NO: 3327920 - protein, 12 aa, Plasmodium falciparum
LSDDGKSIDRTN

SEQ ID NO: 3327921 - protein, 17 aa, Plasmodium falciparum
LSDDNNNNNMIDENNKK

SEQ ID NO: 3327922 - protein, 12 aa, Plasmodium falciparum
LSDEKETTKNIS

SEQ ID NO: 3327923 - protein, 20 aa, Plasmodium falciparum
LSDEKKKKKFPHKQTNSNRQ

SEQ ID NO: 3327924 - protein, 8 aa, Plasmodium falciparum
LSDEKKKN

SEQ ID NO: 3327925 - protein, 6 aa, Plasmodium falciparum
LSDEKN

SEQ ID NO: 3327926 - protein, 16 aa, Plasmodium falciparum
LSDENSKKKSRWERNA

SEQ ID NO: 3327927 - protein, 6 aa, Plasmodium falciparum
LSDGPS

SEQ ID NO: 3327928 - protein, 9 aa, Plasmodium falciparum
LSDGSPADG

SEQ ID NO: 3327929 - protein, 7 aa, Plasmodium falciparum
LSDHQGE

SEQ ID NO: 3327930 - protein, 19 aa, Plasmodium falciparum
LSDISKDEVTQKTTKDIGS

SEQ ID NO: 3327931 - protein, 4 aa, Plasmodium falciparum
LSDK

SEQ ID NO: 3327932 - protein, 5 aa, Plasmodium falciparum
LSDKG

SEQ ID NO: 3327933 - protein, 11 aa, Plasmodium falciparum
LSDKKARSNSL

SEQ ID NO: 3327934 - protein, 19 aa, Plasmodium falciparum
LSDLSEERKNYKNKKPHDI

SEQ ID NO: 3327935 - protein, 9 aa, Plasmodium falciparum
LSDNISNNI

SEQ ID NO: 3327936 - protein, 11 aa, Plasmodium falciparum
LSDNKKESNFC

SEQ ID NO: 3327937 - protein, 11 aa, Plasmodium falciparum
LSDNNESEDDD

SEQ ID NO: 3327938 - protein, 8 aa, Plasmodium falciparum
LSDPNNEN

SEQ ID NO: 3327939 - protein, 5 aa, Plasmodium falciparum
LSDPR

SEQ ID NO: 3327940 - protein, 7 aa, Plasmodium falciparum
LSDPSEL

SEQ ID NO: 3327941 - protein, 8 aa, Plasmodium falciparum
LSDQNNMN

SEQ ID NO: 3327942 - protein, 6 aa, Plasmodium falciparum
LSDREK

SEQ ID NO: 3327943 - protein, 8 aa, Plasmodium falciparum
LSDSKRKK

SEQ ID NO: 3327944 - protein, 9 aa, Plasmodium falciparum
LSDSQREEQ

SEQ ID NO: 3327945 - protein, 5 aa, Plasmodium falciparum
LSDTD

SEQ ID NO: 3327946 - protein, 26 aa, Plasmodium falciparum
LSDTKDREEKYNEPTYKPNNDEENEI

SEQ ID NO: 3327947 - protein, 8 aa, Plasmodium falciparum
LSDTNNIQ

SEQ ID NO: 3327948 - protein, 29 aa, Plasmodium falciparum
LSDTRENEKHALQEGDEDLEEEEEEGFGV

SEQ ID NO: 3327949 - protein, 11 aa, Plasmodium falciparum
LSDTSKAKHMH

SEQ ID NO: 3327950 - protein, 23 aa, Plasmodium falciparum
LSDYNEEINKSSDEEKEVSQTNS

SEQ ID NO: 3327951 - protein, 18 aa, Plasmodium falciparum
LSDYSHKELSKAKKELKN

SEQ ID NO: 3327952 - protein, 4 aa, Plasmodium falciparum
LSEA

SEQ ID NO: 3327953 - protein, 15 aa, Plasmodium falciparum
LSEEDKRKKNNELPD

SEQ ID NO: 3327954 - protein, 10 aa, Plasmodium falciparum
LSEEENKKLE

SEQ ID NO: 3327955 - protein, 5 aa, Plasmodium falciparum
LSEEW

SEQ ID NO: 3327956 - protein, 4 aa, Plasmodium falciparum
LSEG

SEQ ID NO: 3327957 - protein, 12 aa, Plasmodium falciparum
LSEGENEKRSEE

SEQ ID NO: 3327958 - protein, 14 aa, Plasmodium falciparum
LSEGGKKKKNVKNV

SEQ ID NO: 3327959 - protein, 6 aa, Plasmodium falciparum
LSEGVD

SEQ ID NO: 3327960 - protein, 9 aa, Plasmodium falciparum
LSEHSSNKL

SEQ ID NO: 3327961 - protein, 4 aa, Plasmodium falciparum
LSEK

SEQ ID NO: 3327962 - protein, 10 aa, Plasmodium falciparum
LSEKGEEEAI

SEQ ID NO: 3327963 - protein, 9 aa, Plasmodium falciparum
LSEKKQLEK

SEQ ID NO: 3327964 - protein, 8 aa, Plasmodium falciparum
LSEKNGTG

SEQ ID NO: 3327965 - protein, 7 aa, Plasmodium falciparum
LSEKNKE

SEQ ID NO: 3327966 - protein, 26 aa, Plasmodium falciparum
LSEKSKEEKKNGSLNNRTDIKNKKGI

SEQ ID NO: 3327967 - protein, 7 aa, Plasmodium falciparum
LSEKTND

SEQ ID NO: 3327968 - protein, 13 aa, Plasmodium falciparum
LSELEKKKKDSDI

SEQ ID NO: 3327969 - protein, 8 aa, Plasmodium falciparum
LSEMNKSN

SEQ ID NO: 3327970 - protein, 4 aa, Plasmodium falciparum
LSEN

SEQ ID NO: 3327971 - protein, 6 aa, Plasmodium falciparum
LSENDE

SEQ ID NO: 3327972 - protein, 7 aa, Plasmodium falciparum
LSENDHN

SEQ ID NO: 3327973 - protein, 26 aa, Plasmodium falciparum
LSENKNLNDISDDNKTSTREEKNEHD

SEQ ID NO: 3327974 - protein, 21 aa, Plasmodium falciparum
LSENTDSDSEHSTKKENAPLI

SEQ ID NO: 3327975 - protein, 6 aa, Plasmodium falciparum
LSEQDK

SEQ ID NO: 3327976 - protein, 12 aa, Plasmodium falciparum
LSEQGGENITDL

SEQ ID NO: 3327977 - protein, 6 aa, Plasmodium falciparum
LSEQIE

SEQ ID NO: 3327978 - protein, 12 aa, Plasmodium falciparum
LSERSQSEITRR

SEQ ID NO: 3327979 - protein, 19 aa, Plasmodium falciparum
LSESHVRKTGKKKKLIKDR

SEQ ID NO: 3327980 - protein, 22 aa, Plasmodium falciparum
LSETNKSANNTTTNNNNNNNNI

SEQ ID NO: 3327981 - protein, 10 aa, Plasmodium falciparum
LSGAKEKPVA

SEQ ID NO: 3327982 - protein, 7 aa, Plasmodium falciparum
LSGDTHA

SEQ ID NO: 3327983 - protein, 8 aa, Plasmodium falciparum
LSGGEKSI

SEQ ID NO: 3327984 - protein, 8 aa, Plasmodium falciparum
LSGGEKTL

SEQ ID NO: 3327985 - protein, 8 aa, Plasmodium falciparum
LSGGERST

SEQ ID NO: 3327986 - protein, 20 aa, Plasmodium falciparum
LSGGGDNKYSTNRKPEDDEK

SEQ ID NO: 3327987 - protein, 11 aa, Plasmodium falciparum
LSGLKTPLSGL

SEQ ID NO: 3327988 - protein, 4 aa, Plasmodium falciparum
LSGN

SEQ ID NO: 3327989 - protein, 25 aa, Plasmodium falciparum
LSGNNNMNNASPRSKPGSGSVSVSG

SEQ ID NO: 3327990 - protein, 5 aa, Plasmodium falciparum
LSGNV

SEQ ID NO: 3327991 - protein, 9 aa, Plasmodium falciparum
LSGPKRPHD

SEQ ID NO: 3327992 - protein, 16 aa, Plasmodium falciparum
LSHKEYNEKENHQDFE

SEQ ID NO: 3327993 - protein, 36 aa, Plasmodium falciparum
LSHSSSFNSCSSNTTTSNDGNKTHSNKNNSSKYKNK

SEQ ID NO: 3327994 - protein, 6 aa, Plasmodium falciparum
LSIEKK

SEQ ID NO: 3327995 - protein, 5 aa, Plasmodium falciparum
LSIPK

SEQ ID NO: 3327996 - protein, 13 aa, Plasmodium falciparum
LSKDDHKNHDTSE

SEQ ID NO: 3327997 - protein, 5 aa, Plasmodium falciparum
LSKDE

SEQ ID NO: 3327998 - protein, 10 aa, Plasmodium falciparum
LSKDQMSDEN

SEQ ID NO: 3327999 - protein, 109 aa, Plasmodium falciparum
LSKDTKKEKGKKKNKDNKNNTENKDNKDNKDNKDNKNNTENKDNKDNKNNIDNKNDKENNNNKGNKENNNNKGNIENNNNKGNKENNNNKANTDNKNNKDNKEKDKSNI

SEQ ID NO: 3328000 - protein, 8 aa, Plasmodium falciparum
LSKEETVT

SEQ ID NO: 3328001 - protein, 11 aa, Plasmodium falciparum
LSKEKNNKQSY

SEQ ID NO: 3328002 - protein, 18 aa, Plasmodium falciparum
LSKERKNKFKSSKGQHNI

SEQ ID NO: 3328003 - protein, 6 aa, Plasmodium falciparum
LSKEST

SEQ ID NO: 3328004 - protein, 8 aa, Plasmodium falciparum
LSKGERKK

SEQ ID NO: 3328005 - protein, 28 aa, Plasmodium falciparum
LSKIDSSRGSIKKSSSNSMDSSYNPNMK

SEQ ID NO: 3328006 - protein, 9 aa, Plasmodium falciparum
LSKKNEDMK

SEQ ID NO: 3328007 - protein, 54 aa, Plasmodium falciparum
LSKKNHNYSENTLNDHKSNSSDIHSNNNNNKNNYDNNNNYDNNNNMSEKNMPSN

SEQ ID NO: 3328008 - protein, 9 aa, Plasmodium falciparum
LSKKNNIPT

SEQ ID NO: 3328009 - protein, 4 aa, Plasmodium falciparum
LSKN

SEQ ID NO: 3328010 - protein, 9 aa, Plasmodium falciparum
LSKNESTSN

SEQ ID NO: 3328011 - protein, 5 aa, Plasmodium falciparum
LSKNG

SEQ ID NO: 3328012 - protein, 10 aa, Plasmodium falciparum
LSKNGEDNWE

SEQ ID NO: 3328013 - protein, 13 aa, Plasmodium falciparum
LSKNNKLTKKQQR

SEQ ID NO: 3328014 - protein, 6 aa, Plasmodium falciparum
LSKNQS

SEQ ID NO: 3328015 - protein, 8 aa, Plasmodium falciparum
LSKNTDNI

SEQ ID NO: 3328016 - protein, 13 aa, Plasmodium falciparum
LSKNTNEKCVNTS

SEQ ID NO: 3328017 - protein, 11 aa, Plasmodium falciparum
LSKNTNHSNKQ

SEQ ID NO: 3328018 - protein, 9 aa, Plasmodium falciparum
LSKNYSNGS

SEQ ID NO: 3328019 - protein, 4 aa, Plasmodium falciparum
LSKP

SEQ ID NO: 3328020 - protein, 8 aa, Plasmodium falciparum
LSKRQEPE

SEQ ID NO: 3328021 - protein, 5 aa, Plasmodium falciparum
LSKRT

SEQ ID NO: 3328022 - protein, 9 aa, Plasmodium falciparum
LSKSASSEF

SEQ ID NO: 3328023 - protein, 11 aa, Plasmodium falciparum
LSKSRNSITNK

SEQ ID NO: 3328024 - protein, 18 aa, Plasmodium falciparum
LSKTDSGMSIQSNNNLSN

SEQ ID NO: 3328025 - protein, 6 aa, Plasmodium falciparum
LSKTSS

SEQ ID NO: 3328026 - protein, 8 aa, Plasmodium falciparum
LSKTSTKK

SEQ ID NO: 3328027 - protein, 16 aa, Plasmodium falciparum
LSKYETKTKKENLNHK

SEQ ID NO: 3328028 - protein, 9 aa, Plasmodium falciparum
LSLEEEDKS

SEQ ID NO: 3328029 - protein, 8 aa, Plasmodium falciparum
LSLPSNES

SEQ ID NO: 3328030 - protein, 6 aa, Plasmodium falciparum
LSLTNN

SEQ ID NO: 3328031 - protein, 5 aa, Plasmodium falciparum
LSNDE

SEQ ID NO: 3328032 - protein, 19 aa, Plasmodium falciparum
LSNDLKNTLKEKEKIQENY

SEQ ID NO: 3328033 - protein, 13 aa, Plasmodium falciparum
LSNDTYKHKDQDI

SEQ ID NO: 3328034 - protein, 7 aa, Plasmodium falciparum
LSNEEEA

SEQ ID NO: 3328035 - protein, 10 aa, Plasmodium falciparum
LSNEKNNKIS

SEQ ID NO: 3328036 - protein, 15 aa, Plasmodium falciparum
LSNEKNNLSSKEKEN

SEQ ID NO: 3328037 - protein, 26 aa, Plasmodium falciparum
LSNERKKNEENDVNNDMERNNKIEDK

SEQ ID NO: 3328038 - protein, 11 aa, Plasmodium falciparum
LSNGTSHSTND

SEQ ID NO: 3328039 - protein, 6 aa, Plasmodium falciparum
LSNKGT

SEQ ID NO: 3328040 - protein, 14 aa, Plasmodium falciparum
LSNKKGNKNNNQHN

SEQ ID NO: 3328041 - protein, 14 aa, Plasmodium falciparum
LSNKKTKKKKNEDV

SEQ ID NO: 3328042 - protein, 11 aa, Plasmodium falciparum
LSNKSKNNTIK

SEQ ID NO: 3328043 - protein, 23 aa, Plasmodium falciparum
LSNKTKKRDQIKKRSEQKNEENK

SEQ ID NO: 3328044 - protein, 7 aa, Plasmodium falciparum
LSNNDQH

SEQ ID NO: 3328045 - protein, 11 aa, Plasmodium falciparum
LSNNEKKRKEN

SEQ ID NO: 3328046 - protein, 7 aa, Plasmodium falciparum
LSNNKSE

SEQ ID NO: 3328047 - protein, 10 aa, Plasmodium falciparum
LSNNNANKQY

SEQ ID NO: 3328048 - protein, 8 aa, Plasmodium falciparum
LSNNNKKT

SEQ ID NO: 3328049 - protein, 19 aa, Plasmodium falciparum
LSNNNNNNNINSNNLSSSS

SEQ ID NO: 3328050 - protein, 9 aa, Plasmodium falciparum
LSNNNNNSH

SEQ ID NO: 3328051 - protein, 6 aa, Plasmodium falciparum
LSNNTS

SEQ ID NO: 3328052 - protein, 4 aa, Plasmodium falciparum
LSNQ

SEQ ID NO: 3328053 - protein, 6 aa, Plasmodium falciparum
LSNQNI

SEQ ID NO: 3328054 - protein, 6 aa, Plasmodium falciparum
LSNRDD

SEQ ID NO: 3328055 - protein, 16 aa, Plasmodium falciparum
LSNRNEKHGLEQNTLE

SEQ ID NO: 3328056 - protein, 9 aa, Plasmodium falciparum
LSNSKDHNS

SEQ ID NO: 3328057 - protein, 6 aa, Plasmodium falciparum
LSNSND

SEQ ID NO: 3328058 - protein, 27 aa, Plasmodium falciparum
LSNSSRKRSNGLKKRNLNSNKSSTYLN

SEQ ID NO: 3328059 - protein, 17 aa, Plasmodium falciparum
LSNTQQSPFSKTTNNTF

SEQ ID NO: 3328060 - protein, 17 aa, Plasmodium falciparum
LSNTSNEMNDEIPKNDQ

SEQ ID NO: 3328061 - protein, 14 aa, Plasmodium falciparum
LSPAQKAPYEKKAQ

SEQ ID NO: 3328062 - protein, 17 aa, Plasmodium falciparum
LSPINPSDHISIAAEVE

SEQ ID NO: 3328063 - protein, 99 aa, Plasmodium falciparum
LSPKDNHKSEDNHKGINNHKGINNHKSISNHKSISNHKSISNHKSISNHKSISNHKGKNNHKSKDNHKSKNNHKSKDNHKSKDNHDSDKNEEDIENDED

SEQ ID NO: 3328064 - protein, 7 aa, Plasmodium falciparum
LSPKDTR

SEQ ID NO: 3328065 - protein, 11 aa, Plasmodium falciparum
LSPKKNTQMEK

SEQ ID NO: 3328066 - protein, 10 aa, Plasmodium falciparum
LSPKNKEKYD

SEQ ID NO: 3328067 - protein, 6 aa, Plasmodium falciparum
LSPLRK

SEQ ID NO: 3328068 - protein, 10 aa, Plasmodium falciparum
LSPNENDQLS

SEQ ID NO: 3328069 - protein, 10 aa, Plasmodium falciparum
LSPNNSSLTT

SEQ ID NO: 3328070 - protein, 11 aa, Plasmodium falciparum
LSPNRGKTTAS

SEQ ID NO: 3328071 - protein, 4 aa, Plasmodium falciparum
LSPP

SEQ ID NO: 3328072 - protein, 6 aa, Plasmodium falciparum
LSPTSS

SEQ ID NO: 3328073 - protein, 14 aa, Plasmodium falciparum
LSQEEIEKRERRRE

SEQ ID NO: 3328074 - protein, 6 aa, Plasmodium falciparum
LSQESV

SEQ ID NO: 3328075 - protein, 8 aa, Plasmodium falciparum
LSQITSAT

SEQ ID NO: 3328076 - protein, 18 aa, Plasmodium falciparum
LSQKSIENDNKIKNYDSN

SEQ ID NO: 3328077 - protein, 4 aa, Plasmodium falciparum
LSQR

SEQ ID NO: 3328078 - protein, 5 aa, Plasmodium falciparum
LSQYN

SEQ ID NO: 3328079 - protein, 14 aa, Plasmodium falciparum
LSREKKKNKDTYEN

SEQ ID NO: 3328080 - protein, 20 aa, Plasmodium falciparum
LSREKKKTQKKQKKDSTDVH

SEQ ID NO: 3328081 - protein, 4 aa, Plasmodium falciparum
LSRN

SEQ ID NO: 3328082 - protein, 7 aa, Plasmodium falciparum
LSRNENS

SEQ ID NO: 3328083 - protein, 4 aa, Plasmodium falciparum
LSRP

SEQ ID NO: 3328084 - protein, 35 aa, Plasmodium falciparum
LSRPGSRDMNRGNNTSAQNYSGSLGQHQSNKSGGF

SEQ ID NO: 3328085 - protein, 14 aa, Plasmodium falciparum
LSRSSALASKATGY

SEQ ID NO: 3328086 - protein, 10 aa, Plasmodium falciparum
LSSDEKYNYY

SEQ ID NO: 3328087 - protein, 12 aa, Plasmodium falciparum
LSSDKRKGNLYG

SEQ ID NO: 3328088 - protein, 5 aa, Plasmodium falciparum
LSSDR

SEQ ID NO: 3328089 - protein, 4 aa, Plasmodium falciparum
LSSE

SEQ ID NO: 3328090 - protein, 7 aa, Plasmodium falciparum
LSSEEDQ

SEQ ID NO: 3328091 - protein, 8 aa, Plasmodium falciparum
LSSEQQSK

SEQ ID NO: 3328092 - protein, 8 aa, Plasmodium falciparum
LSSESELT

SEQ ID NO: 3328093 - protein, 9 aa, Plasmodium falciparum
LSSFSPTNQ

SEQ ID NO: 3328094 - protein, 19 aa, Plasmodium falciparum
LSSGHDNNMDNEFDNPEED

SEQ ID NO: 3328095 - protein, 8 aa, Plasmodium falciparum
LSSGTKYE

SEQ ID NO: 3328096 - protein, 34 aa, Plasmodium falciparum
LSSHNNDDTINNDNDDNNDDNNDDNNIDNNDNNI

SEQ ID NO: 3328097 - protein, 19 aa, Plasmodium falciparum
LSSIEDEEKFEEREPKRSE

SEQ ID NO: 3328098 - protein, 6 aa, Plasmodium falciparum
LSSKND

SEQ ID NO: 3328099 - protein, 5 aa, Plasmodium falciparum
LSSKT

SEQ ID NO: 3328100 - protein, 8 aa, Plasmodium falciparum
LSSKTQTE

SEQ ID NO: 3328101 - protein, 5 aa, Plasmodium falciparum
LSSNE

SEQ ID NO: 3328102 - protein, 16 aa, Plasmodium falciparum
LSSNNEPTNNNNITSV

SEQ ID NO: 3328103 - protein, 8 aa, Plasmodium falciparum
LSSPESVK

SEQ ID NO: 3328104 - protein, 7 aa, Plasmodium falciparum
LSSPIKE

SEQ ID NO: 3328105 - protein, 5 aa, Plasmodium falciparum
LSSPL

SEQ ID NO: 3328106 - protein, 6 aa, Plasmodium falciparum
LSSPRF

SEQ ID NO: 3328107 - protein, 7 aa, Plasmodium falciparum
LSSPSNA

SEQ ID NO: 3328108 - protein, 10 aa, Plasmodium falciparum
LSSQDSDNNV

SEQ ID NO: 3328109 - protein, 23 aa, Plasmodium falciparum
LSSQHNEKENQLKENLRDSTKRK

SEQ ID NO: 3328110 - protein, 7 aa, Plasmodium falciparum
LSSQIKN

SEQ ID NO: 3328111 - protein, 4 aa, Plasmodium falciparum
LSSS

SEQ ID NO: 3328112 - protein, 9 aa, Plasmodium falciparum
LSSSAQATI

SEQ ID NO: 3328113 - protein, 27 aa, Plasmodium falciparum
LSSSCSKNINEEYDKEEEEAEEGLKGN

SEQ ID NO: 3328114 - protein, 13 aa, Plasmodium falciparum
LSSSPKTKKKNIV

SEQ ID NO: 3328115 - protein, 14 aa, Plasmodium falciparum
LSSSSDDENKLDEE

SEQ ID NO: 3328116 - protein, 4 aa, Plasmodium falciparum
LSST

SEQ ID NO: 3328117 - protein, 7 aa, Plasmodium falciparum
LSSTNTK

SEQ ID NO: 3328118 - protein, 15 aa, Plasmodium falciparum
LSSVNNDKINENNIN

SEQ ID NO: 3328119 - protein, 4 aa, Plasmodium falciparum
LSSY

SEQ ID NO: 3328120 - protein, 11 aa, Plasmodium falciparum
LSTDKKNIKNK

SEQ ID NO: 3328121 - protein, 21 aa, Plasmodium falciparum
LSTDQSKEENKKSNNSQKNEA

SEQ ID NO: 3328122 - protein, 7 aa, Plasmodium falciparum
LSTEENK

SEQ ID NO: 3328123 - protein, 6 aa, Plasmodium falciparum
LSTEGK

SEQ ID NO: 3328124 - protein, 5 aa, Plasmodium falciparum
LSTHA

SEQ ID NO: 3328125 - protein, 14 aa, Plasmodium falciparum
LSTHSGKLEEQNNT

SEQ ID NO: 3328126 - protein, 4 aa, Plasmodium falciparum
LSTK

SEQ ID NO: 3328127 - protein, 17 aa, Plasmodium falciparum
LSTKHSYDNNTNDDEKY

SEQ ID NO: 3328128 - protein, 11 aa, Plasmodium falciparum
LSTLKKKTGYM

SEQ ID NO: 3328129 - protein, 10 aa, Plasmodium falciparum
LSTNKSNTEF

SEQ ID NO: 3328130 - protein, 9 aa, Plasmodium falciparum
LSTNNSTNY

SEQ ID NO: 3328131 - protein, 6 aa, Plasmodium falciparum
LSTNNY

SEQ ID NO: 3328132 - protein, 5 aa, Plasmodium falciparum
LSTPR

SEQ ID NO: 3328133 - protein, 4 aa, Plasmodium falciparum
LSTQ

SEQ ID NO: 3328134 - protein, 5 aa, Plasmodium falciparum
LSTSN

SEQ ID NO: 3328135 - protein, 6 aa, Plasmodium falciparum
LSTSRK

SEQ ID NO: 3328136 - protein, 4 aa, Plasmodium falciparum
LSTY

SEQ ID NO: 3328137 - protein, 11 aa, Plasmodium falciparum
LSTYNKSNRKT

SEQ ID NO: 3328138 - protein, 6 aa, Plasmodium falciparum
LSVEPN

SEQ ID NO: 3328139 - protein, 6 aa, Plasmodium falciparum
LSVPSS

SEQ ID NO: 3328140 - protein, 10 aa, Plasmodium falciparum
LSYDGNNNSV

SEQ ID NO: 3328141 - protein, 25 aa, Plasmodium falciparum
LSYDNNNNNNNMDRERSYSSDESEA

SEQ ID NO: 3328142 - protein, 6 aa, Plasmodium falciparum
LSYESK

SEQ ID NO: 3328143 - protein, 16 aa, Plasmodium falciparum
LSYETQKDDDEEGEKY

SEQ ID NO: 3328144 - protein, 6 aa, Plasmodium falciparum
LSYNDK

SEQ ID NO: 3328145 - protein, 5 aa, Plasmodium falciparum
LSYNN

SEQ ID NO: 3328146 - protein, 4 aa, Plasmodium falciparum
LSYS

SEQ ID NO: 3328147 - protein, 10 aa, Plasmodium falciparum
LTDDEHIKEK

SEQ ID NO: 3328148 - protein, 4 aa, Plasmodium falciparum
LTDE

SEQ ID NO: 3328149 - protein, 7 aa, Plasmodium falciparum
LTDGHNK

SEQ ID NO: 3328150 - protein, 17 aa, Plasmodium falciparum
LTDHNKSDITNSESYNS

SEQ ID NO: 3328151 - protein, 4 aa, Plasmodium falciparum
LTDK

SEQ ID NO: 3328152 - protein, 10 aa, Plasmodium falciparum
LTDNSSKGNL

SEQ ID NO: 3328153 - protein, 8 aa, Plasmodium falciparum
LTDQQKNN

SEQ ID NO: 3328154 - protein, 8 aa, Plasmodium falciparum
LTDRTSEN

SEQ ID NO: 3328155 - protein, 7 aa, Plasmodium falciparum
LTDSQKE

SEQ ID NO: 3328156 - protein, 5 aa, Plasmodium falciparum
LTDTD

SEQ ID NO: 3328157 - protein, 38 aa, Plasmodium falciparum
LTDTNNEQKNENIENVKGSTNNDEPSNSHDQKNEQTKG

SEQ ID NO: 3328158 - protein, 7 aa, Plasmodium falciparum
LTEADTL

SEQ ID NO: 3328159 - protein, 5 aa, Plasmodium falciparum
LTEAK

SEQ ID NO: 3328160 - protein, 5 aa, Plasmodium falciparum
LTEDD

SEQ ID NO: 3328161 - protein, 4 aa, Plasmodium falciparum
LTEE

SEQ ID NO: 3328162 - protein, 15 aa, Plasmodium falciparum
LTEEDETKRKVTYEQ

SEQ ID NO: 3328163 - protein, 89 aa, Plasmodium falciparum
LTEEEGHEELDEKGNKKVRKRKESTQENKIGKKGKNINKVKKGENNDDKDQSEDDNKRNDKNVQRKKKKDISNNNNDDDEEKENDDDNI

SEQ ID NO: 3328164 - protein, 15 aa, Plasmodium falciparum
LTEEEKKEYDEKREK

SEQ ID NO: 3328165 - protein, 8 aa, Plasmodium falciparum
LTEENEER

SEQ ID NO: 3328166 - protein, 12 aa, Plasmodium falciparum
LTEETKPIYDNK

SEQ ID NO: 3328167 - protein, 5 aa, Plasmodium falciparum
LTENE

SEQ ID NO: 3328168 - protein, 85 aa, Plasmodium falciparum
LTENTNKKNNLGDNNRIDEDTTKKDQTYDKGKKEQKNEPKQEQKKEPKQEPKQEPKQEQKYEQKQEQKHEQKHEQKHEQKHEQKI

SEQ ID NO: 3328169 - protein, 19 aa, Plasmodium falciparum
LTEQDKTQKDEKEDKNETD

SEQ ID NO: 3328170 - protein, 8 aa, Plasmodium falciparum
LTEQNDTA

SEQ ID NO: 3328171 - protein, 9 aa, Plasmodium falciparum
LTEQTNEDN

SEQ ID NO: 3328172 - protein, 7 aa, Plasmodium falciparum
LTEQTSA

SEQ ID NO: 3328173 - protein, 9 aa, Plasmodium falciparum
LTERNPYTG

SEQ ID NO: 3328174 - protein, 6 aa, Plasmodium falciparum
LTETGG

SEQ ID NO: 3328175 - protein, 7 aa, Plasmodium falciparum
LTETGGG

SEQ ID NO: 3328176 - protein, 6 aa, Plasmodium falciparum
LTETTG

SEQ ID NO: 3328177 - protein, 34 aa, Plasmodium falciparum
LTGDNTAASQVDGTTGQSQNGEAASNGPTDPVES

SEQ ID NO: 3328178 - protein, 104 aa, Plasmodium falciparum
LTGEHKKGKKKNTKHRNNDNDNGNGNGNGNGNGNGNGNGNGNGNGNGNGNGNGNGNGNGNGNGNGNGNGNGNGNDNNNNNIKDNNFEYEKKDENYFSSDTNTTF

SEQ ID NO: 3328179 - protein, 5 aa, Plasmodium falciparum
LTGGG

SEQ ID NO: 3328180 - protein, 4 aa, Plasmodium falciparum
LTGK

SEQ ID NO: 3328181 - protein, 11 aa, Plasmodium falciparum
LTGNSDNKEEI

SEQ ID NO: 3328182 - protein, 9 aa, Plasmodium falciparum
LTGNSPEHS

SEQ ID NO: 3328183 - protein, 25 aa, Plasmodium falciparum
LTGTKNTIRRRRSSTKKLGRKGLSA

SEQ ID NO: 3328184 - protein, 22 aa, Plasmodium falciparum
LTHKSSEQYPQPNLSDEDPPIS

SEQ ID NO: 3328185 - protein, 13 aa, Plasmodium falciparum
LTKENNKQQMQIH

SEQ ID NO: 3328186 - protein, 11 aa, Plasmodium falciparum
LTKKTKKGQPV

SEQ ID NO: 3328187 - protein, 19 aa, Plasmodium falciparum
LTKNEKDINNDNDAEHEKN

SEQ ID NO: 3328188 - protein, 5 aa, Plasmodium falciparum
LTKQQ

SEQ ID NO: 3328189 - protein, 14 aa, Plasmodium falciparum
LTKSENSISEYEKG

SEQ ID NO: 3328190 - protein, 5 aa, Plasmodium falciparum
LTKSF

SEQ ID NO: 3328191 - protein, 13 aa, Plasmodium falciparum
LTKSKNKKKKKKK

SEQ ID NO: 3328192 - protein, 7 aa, Plasmodium falciparum
LTKTQNI

SEQ ID NO: 3328193 - protein, 9 aa, Plasmodium falciparum
LTKTRKKND

SEQ ID NO: 3328194 - protein, 12 aa, Plasmodium falciparum
LTNAQRSGLNQI

SEQ ID NO: 3328195 - protein, 11 aa, Plasmodium falciparum
LTNDDKNKNII

SEQ ID NO: 3328196 - protein, 7 aa, Plasmodium falciparum
LTNDEKK

SEQ ID NO: 3328197 - protein, 5 aa, Plasmodium falciparum
LTNED

SEQ ID NO: 3328198 - protein, 6 aa, Plasmodium falciparum
LTNEDK

SEQ ID NO: 3328199 - protein, 6 aa, Plasmodium falciparum
LTNEEK

SEQ ID NO: 3328200 - protein, 17 aa, Plasmodium falciparum
LTNEKKKKAKKKKRNKI

SEQ ID NO: 3328201 - protein, 14 aa, Plasmodium falciparum
LTNETSSQKEENAS

SEQ ID NO: 3328202 - protein, 7 aa, Plasmodium falciparum
LTNKEEK

SEQ ID NO: 3328203 - protein, 9 aa, Plasmodium falciparum
LTNKEGEYK

SEQ ID NO: 3328204 - protein, 9 aa, Plasmodium falciparum
LTNKGSPTD

SEQ ID NO: 3328205 - protein, 7 aa, Plasmodium falciparum
LTNKKKQ

SEQ ID NO: 3328206 - protein, 27 aa, Plasmodium falciparum
LTNKSKKNKEAEKNKKNETNISPNSDI

SEQ ID NO: 3328207 - protein, 9 aa, Plasmodium falciparum
LTNKSNDFK

SEQ ID NO: 3328208 - protein, 4 aa, Plasmodium falciparum
LTNN

SEQ ID NO: 3328209 - protein, 7 aa, Plasmodium falciparum
LTNNDKK

SEQ ID NO: 3328210 - protein, 15 aa, Plasmodium falciparum
LTNNEGASKIKNRNK

SEQ ID NO: 3328211 - protein, 14 aa, Plasmodium falciparum
LTNNNRKNYRSNDP

SEQ ID NO: 3328212 - protein, 12 aa, Plasmodium falciparum
LTNQKGKEINPN

SEQ ID NO: 3328213 - protein, 7 aa, Plasmodium falciparum
LTNRGKD

SEQ ID NO: 3328214 - protein, 29 aa, Plasmodium falciparum
LTNSDLAKSELTNSELAQSDLSKPSSVQS

SEQ ID NO: 3328215 - protein, 5 aa, Plasmodium falciparum
LTNTG

SEQ ID NO: 3328216 - protein, 8 aa, Plasmodium falciparum
LTNTNSIS

SEQ ID NO: 3328217 - protein, 6 aa, Plasmodium falciparum
LTNTSV

SEQ ID NO: 3328218 - protein, 6 aa, Plasmodium falciparum
LTPDQI

SEQ ID NO: 3328219 - protein, 44 aa, Plasmodium falciparum
LTPEEKQKLNRPPTDPFKEKKEDQVSQQQKQATDASIKKNEKVK

SEQ ID NO: 3328220 - protein, 9 aa, Plasmodium falciparum
LTPGHPENH

SEQ ID NO: 3328221 - protein, 11 aa, Plasmodium falciparum
LTPGKNARGFR

SEQ ID NO: 3328222 - protein, 4 aa, Plasmodium falciparum
LTPK

SEQ ID NO: 3328223 - protein, 12 aa, Plasmodium falciparum
LTPNTYQKKKKN

SEQ ID NO: 3328224 - protein, 4 aa, Plasmodium falciparum
LTPQ

SEQ ID NO: 3328225 - protein, 6 aa, Plasmodium falciparum
LTPSNG

SEQ ID NO: 3328226 - protein, 19 aa, Plasmodium falciparum
LTPSPSKKDSVKKNPRNDE

SEQ ID NO: 3328227 - protein, 6 aa, Plasmodium falciparum
LTPTNE

SEQ ID NO: 3328228 - protein, 4 aa, Plasmodium falciparum
LTQA

SEQ ID NO: 3328229 - protein, 8 aa, Plasmodium falciparum
LTQENKEE

SEQ ID NO: 3328230 - protein, 14 aa, Plasmodium falciparum
LTQNSKDNRKKKND

SEQ ID NO: 3328231 - protein, 13 aa, Plasmodium falciparum
LTQTIQPKNVNNN

SEQ ID NO: 3328232 - protein, 11 aa, Plasmodium falciparum
LTRGDKTNISQ

SEQ ID NO: 3328233 - protein, 84 aa, Plasmodium falciparum
LTRSTRNNGNNNNNNNNNNNNRSSINNRSSNNNRSSNNNSSSNNNNSSNNNRSSNNNSSSNNRSGHRLTRGGNKIERTSNSDDE

SEQ ID NO: 3328234 - protein, 10 aa, Plasmodium falciparum
LTSAGKKYRG

SEQ ID NO: 3328235 - protein, 9 aa, Plasmodium falciparum
LTSASDKPI

SEQ ID NO: 3328236 - protein, 42 aa, Plasmodium falciparum
LTSEKNKESLKKDKRKKKEKKNNDVDDINEEEDEEGNDEDTM

SEQ ID NO: 3328237 - protein, 4 aa, Plasmodium falciparum
LTSK

SEQ ID NO: 3328238 - protein, 4 aa, Plasmodium falciparum
LTSN

SEQ ID NO: 3328239 - protein, 5 aa, Plasmodium falciparum
LTSND

SEQ ID NO: 3328240 - protein, 7 aa, Plasmodium falciparum
LTSNGNN

SEQ ID NO: 3328241 - protein, 8 aa, Plasmodium falciparum
LTSNKKEN

SEQ ID NO: 3328242 - protein, 5 aa, Plasmodium falciparum
LTSNY

SEQ ID NO: 3328243 - protein, 16 aa, Plasmodium falciparum
LTSSHERSRSRERRRR

SEQ ID NO: 3328244 - protein, 6 aa, Plasmodium falciparum
LTSSSQ

SEQ ID NO: 3328245 - protein, 12 aa, Plasmodium falciparum
LTSTGNTTGAGG

SEQ ID NO: 3328246 - protein, 6 aa, Plasmodium falciparum
LTSTLN

SEQ ID NO: 3328247 - protein, 9 aa, Plasmodium falciparum
LTTGGRDNK

SEQ ID NO: 3328248 - protein, 4 aa, Plasmodium falciparum
LTTK

SEQ ID NO: 3328249 - protein, 21 aa, Plasmodium falciparum
LTTNETYNSGTYNSGSYNNTS

SEQ ID NO: 3328250 - protein, 19 aa, Plasmodium falciparum
LTTNNKSIYGEYKNTNKYE

SEQ ID NO: 3328251 - protein, 4 aa, Plasmodium falciparum
LTTS

SEQ ID NO: 3328252 - protein, 6 aa, Plasmodium falciparum
LTTSPA

SEQ ID NO: 3328253 - protein, 9 aa, Plasmodium falciparum
LTTSSSNRV

SEQ ID NO: 3328254 - protein, 8 aa, Plasmodium falciparum
LTTTTTTT

SEQ ID NO: 3328255 - protein, 6 aa, Plasmodium falciparum
LTVQEE

SEQ ID NO: 3328256 - protein, 4 aa, Plasmodium falciparum
LTYP

SEQ ID NO: 3328257 - protein, 4 aa, Plasmodium falciparum
LVEE

SEQ ID NO: 3328258 - protein, 5 aa, Plasmodium falciparum
LVENN

SEQ ID NO: 3328259 - protein, 10 aa, Plasmodium falciparum
LVKESKEKKD

SEQ ID NO: 3328260 - protein, 11 aa, Plasmodium falciparum
LVNDGNNDDND

SEQ ID NO: 3328261 - protein, 4 aa, Plasmodium falciparum
LVNE

SEQ ID NO: 3328262 - protein, 39 aa, Plasmodium falciparum
LVNNNHNDNYTDDNTYDQKEKAKEKAKEKEKAKEKEKAK

SEQ ID NO: 3328263 - protein, 8 aa, Plasmodium falciparum
LVPGTTNR

SEQ ID NO: 3328264 - protein, 19 aa, Plasmodium falciparum
LYAQKNKKSKDEIKNKVSS

SEQ ID NO: 3328265 - protein, 12 aa, Plasmodium falciparum
LYDDNKSDKYNI

SEQ ID NO: 3328266 - protein, 4 aa, Plasmodium falciparum
LYDG

SEQ ID NO: 3328267 - protein, 18 aa, Plasmodium falciparum
LYDKQNDDVSNEDANRNV

SEQ ID NO: 3328268 - protein, 14 aa, Plasmodium falciparum
LYEDKNTKISIRES

SEQ ID NO: 3328269 - protein, 10 aa, Plasmodium falciparum
LYGKNEKKND

SEQ ID NO: 3328270 - protein, 5 aa, Plasmodium falciparum
LYGNQ

SEQ ID NO: 3328271 - protein, 18 aa, Plasmodium falciparum
LYGSNQEDETSTNNNMNN

SEQ ID NO: 3328272 - protein, 8 aa, Plasmodium falciparum
LYGTNGEN

SEQ ID NO: 3328273 - protein, 5 aa, Plasmodium falciparum
LYKEG

SEQ ID NO: 3328274 - protein, 9 aa, Plasmodium falciparum
LYKPDTTKS

SEQ ID NO: 3328275 - protein, 18 aa, Plasmodium falciparum
LYNNNNNNNNNNNNNNIS

SEQ ID NO: 3328276 - protein, 8 aa, Plasmodium falciparum
LYNNSSKH

SEQ ID NO: 3328277 - protein, 8 aa, Plasmodium falciparum
LYNREENK

SEQ ID NO: 3328278 - protein, 11 aa, Plasmodium falciparum
LYNSKQQEDYN

SEQ ID NO: 3328279 - protein, 10 aa, Plasmodium falciparum
LYNSNDKHQS

SEQ ID NO: 3328280 - protein, 14 aa, Plasmodium falciparum
LYPEEGYKTPNKTK

SEQ ID NO: 3328281 - protein, 4 aa, Plasmodium falciparum
LYPP

SEQ ID NO: 3328282 - protein, 63 aa, Plasmodium falciparum
LYSDNNSPLISNNNNNNNSNNNNNNNNNNSSDNSNNNSNSSNNSISSNANPTNNDCNDNYQEN

SEQ ID NO: 3328283 - protein, 15 aa, Plasmodium falciparum
LYSEKEDQEHRKSVK

SEQ ID NO: 3328284 - protein, 8 aa, Plasmodium falciparum
LYSPSIKE

SEQ ID NO: 3328285 - protein, 6 aa, Plasmodium falciparum
LYSRKE

SEQ ID NO: 3328286 - protein, 38 aa, Plasmodium falciparum
LYTNDKQKKKDETNKDIYKNNDKKNIPRNSKNNNENYH

SEQ ID NO: 3328287 - protein, 9 aa, Plasmodium falciparum
LYTNEEYKK

SEQ ID NO: 3328288 - protein, 4 aa, Plasmodium falciparum
MAED

SEQ ID NO: 3328289 - protein, 20 aa, Plasmodium falciparum
MAEKKKAEEEAKQKLLKAKK

SEQ ID NO: 3328290 - protein, 22 aa, Plasmodium falciparum
MAKGDSNKNVNKVEDNDNKKEN

SEQ ID NO: 3328291 - protein, 12 aa, Plasmodium falciparum
MAPQPSISSPNN

SEQ ID NO: 3328292 - protein, 10 aa, Plasmodium falciparum
MARNNSSFNN

SEQ ID NO: 3328293 - protein, 4 aa, Plasmodium falciparum
MCDD

SEQ ID NO: 3328294 - protein, 13 aa, Plasmodium falciparum
MCDDTNKRYDDTN

SEQ ID NO: 3328295 - protein, 12 aa, Plasmodium falciparum
MDDDDEDGHDKN

SEQ ID NO: 3328296 - protein, 25 aa, Plasmodium falciparum
MDDDDSDYEMDENEKYDDQDGLEEI

SEQ ID NO: 3328297 - protein, 8 aa, Plasmodium falciparum
MDDDEEKN

SEQ ID NO: 3328298 - protein, 13 aa, Plasmodium falciparum
MDDEKKKKSEEIN

SEQ ID NO: 3328299 - protein, 5 aa, Plasmodium falciparum
MDDFN

SEQ ID NO: 3328300 - protein, 5 aa, Plasmodium falciparum
MDDFT

SEQ ID NO: 3328301 - protein, 10 aa, Plasmodium falciparum
MDDISSYDEK

SEQ ID NO: 3328302 - protein, 4 aa, Plasmodium falciparum
MDDM

SEQ ID NO: 3328303 - protein, 12 aa, Plasmodium falciparum
MDDPSARNTNYG

SEQ ID NO: 3328304 - protein, 5 aa, Plasmodium falciparum
MDDSA

SEQ ID NO: 3328305 - protein, 5 aa, Plasmodium falciparum
MDDSY

SEQ ID NO: 3328306 - protein, 40 aa, Plasmodium falciparum
MDDTMDGTMDGTVDGTMDGTVDGTMDGTVDGTMDGTMDGT

SEQ ID NO: 3328307 - protein, 11 aa, Plasmodium falciparum
MDEETINKKVS

SEQ ID NO: 3328308 - protein, 5 aa, Plasmodium falciparum
MDEKD

SEQ ID NO: 3328309 - protein, 9 aa, Plasmodium falciparum
MDEKDENRY

SEQ ID NO: 3328310 - protein, 42 aa, Plasmodium falciparum
MDENKNKNNDDNNKNNDNNNKYNNHNNKYNNHNNNHNNQYSN

SEQ ID NO: 3328311 - protein, 8 aa, Plasmodium falciparum
MDENQERE

SEQ ID NO: 3328312 - protein, 10 aa, Plasmodium falciparum
MDEQKEDDNI

SEQ ID NO: 3328313 - protein, 13 aa, Plasmodium falciparum
MDETNNNSMDPQQ

SEQ ID NO: 3328314 - protein, 7 aa, Plasmodium falciparum
MDGEISQ

SEQ ID NO: 3328315 - protein, 102 aa, Plasmodium falciparum
MDGEKNNDEVKNNDEVKNNDVVKNNDEVKNNDVVKNNDEVKNNDDIKNKDDIKNNDDIKNNDDIKNNDEVKNNDEVKNNDDVKNNDNIKNNDDIKNNDDIKN

SEQ ID NO: 3328316 - protein, 13 aa, Plasmodium falciparum
MDGNANDNKIENE

SEQ ID NO: 3328317 - protein, 6 aa, Plasmodium falciparum
MDGTGG

SEQ ID NO: 3328318 - protein, 6 aa, Plasmodium falciparum
MDIEEK

SEQ ID NO: 3328319 - protein, 37 aa, Plasmodium falciparum
MDINTKNNTKNNTKNNNNNNNNNNNNNSNNINSNNNL

SEQ ID NO: 3328320 - protein, 9 aa, Plasmodium falciparum
MDKDKNNSF

SEQ ID NO: 3328321 - protein, 11 aa, Plasmodium falciparum
MDKENNNVNSD

SEQ ID NO: 3328322 - protein, 4 aa, Plasmodium falciparum
MDKN

SEQ ID NO: 3328323 - protein, 8 aa, Plasmodium falciparum
MDKNNANN

SEQ ID NO: 3328324 - protein, 8 aa, Plasmodium falciparum
MDKNNDDI

SEQ ID NO: 3328325 - protein, 10 aa, Plasmodium falciparum
MDKNNNGTIS

SEQ ID NO: 3328326 - protein, 8 aa, Plasmodium falciparum
MDKNYDNY

SEQ ID NO: 3328327 - protein, 21 aa, Plasmodium falciparum
MDKPPPHNINNNNSNNNNNNN

SEQ ID NO: 3328328 - protein, 4 aa, Plasmodium falciparum
MDKQ

SEQ ID NO: 3328329 - protein, 46 aa, Plasmodium falciparum
MDKQKYDSYSSDNKKSNHSKSSSDSYNNSSDEFNNDIDDADDSKKS

SEQ ID NO: 3328330 - protein, 33 aa, Plasmodium falciparum
MDKQSNGSTHNEHEKTQKKKNKKKNNDDDEKNN

SEQ ID NO: 3328331 - protein, 7 aa, Plasmodium falciparum
MDKRRSV

SEQ ID NO: 3328332 - protein, 11 aa, Plasmodium falciparum
MDMTKDESDRF

SEQ ID NO: 3328333 - protein, 15 aa, Plasmodium falciparum
MDNDDNYWSSDDDSI

SEQ ID NO: 3328334 - protein, 10 aa, Plasmodium falciparum
MDNEEESRRI

SEQ ID NO: 3328335 - protein, 21 aa, Plasmodium falciparum
MDNETNGTNYKNYKNKNNMSE

SEQ ID NO: 3328336 - protein, 9 aa, Plasmodium falciparum
MDNGTDSVD

SEQ ID NO: 3328337 - protein, 5 aa, Plasmodium falciparum
MDNIT

SEQ ID NO: 3328338 - protein, 4 aa, Plasmodium falciparum
MDNK

SEQ ID NO: 3328339 - protein, 16 aa, Plasmodium falciparum
MDNNDQENSTQNEPKK

SEQ ID NO: 3328340 - protein, 12 aa, Plasmodium falciparum
MDNNNNNNNNNN

SEQ ID NO: 3328341 - protein, 12 aa, Plasmodium falciparum
MDNNSIDSDNNK

SEQ ID NO: 3328342 - protein, 8 aa, Plasmodium falciparum
MDNNSKMD

SEQ ID NO: 3328343 - protein, 23 aa, Plasmodium falciparum
MDNNVNNNYSNNYPGSGNNGLNN

SEQ ID NO: 3328344 - protein, 27 aa, Plasmodium falciparum
MDNSNNEDEEMDEEEDEQEEEEEEVEG

SEQ ID NO: 3328345 - protein, 61 aa, Plasmodium falciparum
MDNTDNMNNRGNMNNRDNINNRDNMNNSNNMDNKDNMNNKDNINNKDNMNNKDNINNKDNI

SEQ ID NO: 3328346 - protein, 25 aa, Plasmodium falciparum
MDNTNGNNNNNNNNTNAVNNNINGD

SEQ ID NO: 3328347 - protein, 6 aa, Plasmodium falciparum
MDNTSD

SEQ ID NO: 3328348 - protein, 9 aa, Plasmodium falciparum
MDNTSMNKN

SEQ ID NO: 3328349 - protein, 110 aa, Plasmodium falciparum
MDNVDGGDDNDDDEDDGDYNDDDDNDDDDNDDDNDDDNDNDDDEDNDEDEDNDDDDGDDNDDDNDDNNDDDNDNDDQTLNEPLSDNNSCRTYNSDDENEKTDDTTKLNEE

SEQ ID NO: 3328350 - protein, 12 aa, Plasmodium falciparum
MDPDNSDNPNIN

SEQ ID NO: 3328351 - protein, 4 aa, Plasmodium falciparum
MDPI

SEQ ID NO: 3328352 - protein, 6 aa, Plasmodium falciparum
MDQKDR

SEQ ID NO: 3328353 - protein, 5 aa, Plasmodium falciparum
MDQKN

SEQ ID NO: 3328354 - protein, 7 aa, Plasmodium falciparum
MDQNKNM

SEQ ID NO: 3328355 - protein, 5 aa, Plasmodium falciparum
MDSIN

SEQ ID NO: 3328356 - protein, 15 aa, Plasmodium falciparum
MDSNNNNNHNNNMNN

SEQ ID NO: 3328357 - protein, 5 aa, Plasmodium falciparum
MDSPN

SEQ ID NO: 3328358 - protein, 4 aa, Plasmodium falciparum
MDSS

SEQ ID NO: 3328359 - protein, 7 aa, Plasmodium falciparum
MDSSNGY

SEQ ID NO: 3328360 - protein, 9 aa, Plasmodium falciparum
MDSSSMNND

SEQ ID NO: 3328361 - protein, 5 aa, Plasmodium falciparum
MDTNE

SEQ ID NO: 3328362 - protein, 6 aa, Plasmodium falciparum
MDTQTS

SEQ ID NO: 3328363 - protein, 15 aa, Plasmodium falciparum
MEAENKRQQKLDRKK

SEQ ID NO: 3328364 - protein, 11 aa, Plasmodium falciparum
MEDDQSSTTIN

SEQ ID NO: 3328365 - protein, 12 aa, Plasmodium falciparum
MEDKNNKDIDEV

SEQ ID NO: 3328366 - protein, 13 aa, Plasmodium falciparum
MEDNKTTKKLGAL

SEQ ID NO: 3328367 - protein, 12 aa, Plasmodium falciparum
MEDNTQNNTQNM

SEQ ID NO: 3328368 - protein, 9 aa, Plasmodium falciparum
MEEDDEELE

SEQ ID NO: 3328369 - protein, 7 aa, Plasmodium falciparum
MEEDNDK

SEQ ID NO: 3328370 - protein, 10 aa, Plasmodium falciparum
MEEEKEREKL

SEQ ID NO: 3328371 - protein, 7 aa, Plasmodium falciparum
MEEKENK

SEQ ID NO: 3328372 - protein, 13 aa, Plasmodium falciparum
MEEKKKKGNNNNF

SEQ ID NO: 3328373 - protein, 12 aa, Plasmodium falciparum
MEEKRPGDVAPH

SEQ ID NO: 3328374 - protein, 32 aa, Plasmodium falciparum
MEENENNINNRKDEYDKNDYTLEKDDNNKNSS

SEQ ID NO: 3328375 - protein, 7 aa, Plasmodium falciparum
MEETKEM

SEQ ID NO: 3328376 - protein, 11 aa, Plasmodium falciparum
MEGEQDTTVDT

SEQ ID NO: 3328377 - protein, 27 aa, Plasmodium falciparum
MEGGRRGGGGKTTSDVTTTNSYEKDEN

SEQ ID NO: 3328378 - protein, 12 aa, Plasmodium falciparum
MEKAKEKECEAE

SEQ ID NO: 3328379 - protein, 5 aa, Plasmodium falciparum
MEKDN

SEQ ID NO: 3328380 - protein, 34 aa, Plasmodium falciparum
MEKDNNNNNNNDNNNNNNNNNNNNNNNNNSSSSI

SEQ ID NO: 3328381 - protein, 4 aa, Plasmodium falciparum
MEKE

SEQ ID NO: 3328382 - protein, 22 aa, Plasmodium falciparum
MEKERQMNHNKQRTNNNTNETP

SEQ ID NO: 3328383 - protein, 5 aa, Plasmodium falciparum
MEKHD

SEQ ID NO: 3328384 - protein, 6 aa, Plasmodium falciparum
MEKHKK

SEQ ID NO: 3328385 - protein, 18 aa, Plasmodium falciparum
MEKKEKKKKKKKKTQINS

SEQ ID NO: 3328386 - protein, 42 aa, Plasmodium falciparum
MEKKKEDDDNNNNNNNNNNNNNNNNNNKSNNHINNKSNSNIH

SEQ ID NO: 3328387 - protein, 7 aa, Plasmodium falciparum
MEKKKQE

SEQ ID NO: 3328388 - protein, 16 aa, Plasmodium falciparum
MEKKNDENLSIGSGPV

SEQ ID NO: 3328389 - protein, 11 aa, Plasmodium falciparum
MEKKNDKYEDD

SEQ ID NO: 3328390 - protein, 14 aa, Plasmodium falciparum
MEKNNNIIQGILYI

SEQ ID NO: 3328391 - protein, 5 aa, Plasmodium falciparum
MEKNY

SEQ ID NO: 3328392 - protein, 12 aa, Plasmodium falciparum
MEKQAEAERRKR

SEQ ID NO: 3328393 - protein, 4 aa, Plasmodium falciparum
MENE

SEQ ID NO: 3328394 - protein, 10 aa, Plasmodium falciparum
MENHKPDASS

SEQ ID NO: 3328395 - protein, 6 aa, Plasmodium falciparum
MENKEN

SEQ ID NO: 3328396 - protein, 4 aa, Plasmodium falciparum
MENQ

SEQ ID NO: 3328397 - protein, 25 aa, Plasmodium falciparum
MENSERTKDTNCEYNKKKKDEDDEE

SEQ ID NO: 3328398 - protein, 6 aa, Plasmodium falciparum
MENTKE

SEQ ID NO: 3328399 - protein, 30 aa, Plasmodium falciparum
MENTKEKRKRKQRQKQKQKQTKFESDNCDK

SEQ ID NO: 3328400 - protein, 84 aa, Plasmodium falciparum
MENTNGDGDTTNEDDNNINGDDNNINGDDNNINGDDNNINGDENSINGYENNINGDENNINGDDNNINGDDNNINGDENSINGY

SEQ ID NO: 3328401 - protein, 4 aa, Plasmodium falciparum
MEQD

SEQ ID NO: 3328402 - protein, 7 aa, Plasmodium falciparum
MEREKQK

SEQ ID NO: 3328403 - protein, 24 aa, Plasmodium falciparum
MERKKKEEARKKLEEISKAQRERD

SEQ ID NO: 3328404 - protein, 10 aa, Plasmodium falciparum
MERSQATSGF

SEQ ID NO: 3328405 - protein, 16 aa, Plasmodium falciparum
MESHQEDKEDAVQKIN

SEQ ID NO: 3328406 - protein, 12 aa, Plasmodium falciparum
METHNKKDSYNK

SEQ ID NO: 3328407 - protein, 8 aa, Plasmodium falciparum
METKENPS

SEQ ID NO: 3328408 - protein, 4 aa, Plasmodium falciparum
METP

SEQ ID NO: 3328409 - protein, 27 aa, Plasmodium falciparum
METSKYGSVNKKIEEHKNEIDKGRNEL

SEQ ID NO: 3328410 - protein, 21 aa, Plasmodium falciparum
MFSSADGQGNFEEMESSKEIT

SEQ ID NO: 3328411 - protein, 7 aa, Plasmodium falciparum
MGDGEND

SEQ ID NO: 3328412 - protein, 27 aa, Plasmodium falciparum
MGDINNDEENLQISDKKKNKVDEHDKH

SEQ ID NO: 3328413 - protein, 8 aa, Plasmodium falciparum
MGDPNTQV

SEQ ID NO: 3328414 - protein, 14 aa, Plasmodium falciparum
MGDQRINNENMDKQ

SEQ ID NO: 3328415 - protein, 6 aa, Plasmodium falciparum
MGEGNM

SEQ ID NO: 3328416 - protein, 7 aa, Plasmodium falciparum
MGGDEEH

SEQ ID NO: 3328417 - protein, 6 aa, Plasmodium falciparum
MGGTNP

SEQ ID NO: 3328418 - protein, 15 aa, Plasmodium falciparum
MGKKETNNDFKKSNH

SEQ ID NO: 3328419 - protein, 32 aa, Plasmodium falciparum
MGKSTDDSKNVYGDDNKNVYGDDNKNVYGDDS

SEQ ID NO: 3328420 - protein, 16 aa, Plasmodium falciparum
MGNNNQLENKNKNNNN

SEQ ID NO: 3328421 - protein, 9 aa, Plasmodium falciparum
MGNNNSPRM

SEQ ID NO: 3328422 - protein, 10 aa, Plasmodium falciparum
MGNPSNNQHA

SEQ ID NO: 3328423 - protein, 7 aa, Plasmodium falciparum
MGNSKVN

SEQ ID NO: 3328424 - protein, 9 aa, Plasmodium falciparum
MGNSPSSYM

SEQ ID NO: 3328425 - protein, 20 aa, Plasmodium falciparum
MGSARKEKALSKKAKKREKL

SEQ ID NO: 3328426 - protein, 14 aa, Plasmodium falciparum
MGSDTMNNAPHPYK

SEQ ID NO: 3328427 - protein, 11 aa, Plasmodium falciparum
MGSSNVKTRLD

SEQ ID NO: 3328428 - protein, 10 aa, Plasmodium falciparum
MGSYNQKSYN

SEQ ID NO: 3328429 - protein, 11 aa, Plasmodium falciparum
MGTSNGNTNGN

SEQ ID NO: 3328430 - protein, 6 aa, Plasmodium falciparum
MGYPNS

SEQ ID NO: 3328431 - protein, 34 aa, Plasmodium falciparum
MHDKSTNNNNNNIDNNNNNIDNNNNNNNNNINNH

SEQ ID NO: 3328432 - protein, 16 aa, Plasmodium falciparum
MHNNNNNNNNDSSNIN

SEQ ID NO: 3328433 - protein, 24 aa, Plasmodium falciparum
MHRTNGSSHQDDEIDEDDESTNHN

SEQ ID NO: 3328434 - protein, 12 aa, Plasmodium falciparum
MIEDQSNKNTNE

SEQ ID NO: 3328435 - protein, 9 aa, Plasmodium falciparum
MIENDDPRI

SEQ ID NO: 3328436 - protein, 13 aa, Plasmodium falciparum
MIESGSKKRRIGK

SEQ ID NO: 3328437 - protein, 4 aa, Plasmodium falciparum
MIND

SEQ ID NO: 3328438 - protein, 15 aa, Plasmodium falciparum
MINGKKKEKKKNSVH

SEQ ID NO: 3328439 - protein, 10 aa, Plasmodium falciparum
MKAGSSKARE

SEQ ID NO: 3328440 - protein, 76 aa, Plasmodium falciparum
MKCDKQNKIKKSTNKNYENNKNYENHKNYENNKYYENNKNYENNKNYENNKNYDNNNNDKSFIPSEKSESDIESDY

SEQ ID NO: 3328441 - protein, 14 aa, Plasmodium falciparum
MKDCQNNNNPNKYV

SEQ ID NO: 3328442 - protein, 4 aa, Plasmodium falciparum
MKDD

SEQ ID NO: 3328443 - protein, 15 aa, Plasmodium falciparum
MKDDDYDESLKTKNY

SEQ ID NO: 3328444 - protein, 34 aa, Plasmodium falciparum
MKDEENKVKVPDDHDDVNNNKINKDKDKDKDKDI

SEQ ID NO: 3328445 - protein, 16 aa, Plasmodium falciparum
MKDEKEESNKDDSSDD

SEQ ID NO: 3328446 - protein, 15 aa, Plasmodium falciparum
MKDKYEKETNKNVEL

SEQ ID NO: 3328447 - protein, 6 aa, Plasmodium falciparum
MKDNKI

SEQ ID NO: 3328448 - protein, 7 aa, Plasmodium falciparum
MKDSPNK

SEQ ID NO: 3328449 - protein, 6 aa, Plasmodium falciparum
MKDTRD

SEQ ID NO: 3328450 - protein, 9 aa, Plasmodium falciparum
MKEDFDKDT

SEQ ID NO: 3328451 - protein, 9 aa, Plasmodium falciparum
MKEEETNKK

SEQ ID NO: 3328452 - protein, 128 aa, Plasmodium falciparum
MKEEGKKEQKKKYDEKDDDDEKDDDDDEKDDDDDEKDDDDDEKDDDDDEKDDDDDEKDDDDDEKDDDDDEKDDDDDEKDDDDDEKDDDDDEKDDDDDEKDDDDDDEKDDDDDDEKGYDNDYDNHNDYH

SEQ ID NO: 3328453 - protein, 7 aa, Plasmodium falciparum
MKEEKND

SEQ ID NO: 3328454 - protein, 9 aa, Plasmodium falciparum
MKEKEHEIN

SEQ ID NO: 3328455 - protein, 11 aa, Plasmodium falciparum
MKEKSKDEKDI

SEQ ID NO: 3328456 - protein, 11 aa, Plasmodium falciparum
MKENDDNHNNI

SEQ ID NO: 3328457 - protein, 12 aa, Plasmodium falciparum
MKENNDYKETIN

SEQ ID NO: 3328458 - protein, 23 aa, Plasmodium falciparum
MKENSSKETNITNENQNGEDYSN

SEQ ID NO: 3328459 - protein, 9 aa, Plasmodium falciparum
MKEPTRDRN

SEQ ID NO: 3328460 - protein, 7 aa, Plasmodium falciparum
MKEQEKE

SEQ ID NO: 3328461 - protein, 7 aa, Plasmodium falciparum
MKEQPLK

SEQ ID NO: 3328462 - protein, 15 aa, Plasmodium falciparum
MKESNYTNNNKNDKG

SEQ ID NO: 3328463 - protein, 10 aa, Plasmodium falciparum
MKEYSTKDSI

SEQ ID NO: 3328464 - protein, 8 aa, Plasmodium falciparum
MKGGSGVR

SEQ ID NO: 3328465 - protein, 10 aa, Plasmodium falciparum
MKGNNVNDHK

SEQ ID NO: 3328466 - protein, 19 aa, Plasmodium falciparum
MKGNSENLSTNNNPNLTGK

SEQ ID NO: 3328467 - protein, 8 aa, Plasmodium falciparum
MKGSNTIS

SEQ ID NO: 3328468 - protein, 6 aa, Plasmodium falciparum
MKGSYN

SEQ ID NO: 3328469 - protein, 7 aa, Plasmodium falciparum
MKGTNME

SEQ ID NO: 3328470 - protein, 11 aa, Plasmodium falciparum
MKKEKEDIKEK

SEQ ID NO: 3328471 - protein, 10 aa, Plasmodium falciparum
MKKENDHKDC

SEQ ID NO: 3328472 - protein, 8 aa, Plasmodium falciparum
MKKENKSK

SEQ ID NO: 3328473 - protein, 9 aa, Plasmodium falciparum
MKKETNELE

SEQ ID NO: 3328474 - protein, 11 aa, Plasmodium falciparum
MKKGKNKLNNN

SEQ ID NO: 3328475 - protein, 10 aa, Plasmodium falciparum
MKKGTQRKTQ

SEQ ID NO: 3328476 - protein, 23 aa, Plasmodium falciparum
MKKKGNKTNRDDMNNNVRNNEKY

SEQ ID NO: 3328477 - protein, 12 aa, Plasmodium falciparum
MKKKKKKEINAY

SEQ ID NO: 3328478 - protein, 50 aa, Plasmodium falciparum
MKKKKKNYNLSDDENEDNNNNNNNNNNNNNNNNNNNNNTNISSKKKDAFS

SEQ ID NO: 3328479 - protein, 5 aa, Plasmodium falciparum
MKKND

SEQ ID NO: 3328480 - protein, 12 aa, Plasmodium falciparum
MKKNKNSTQGYY

SEQ ID NO: 3328481 - protein, 7 aa, Plasmodium falciparum
MKKRNED

SEQ ID NO: 3328482 - protein, 11 aa, Plasmodium falciparum
MKKRNEKLNEE

SEQ ID NO: 3328483 - protein, 13 aa, Plasmodium falciparum
MKKSKSSDKYKEA

SEQ ID NO: 3328484 - protein, 10 aa, Plasmodium falciparum
MKKSKTKYEG

SEQ ID NO: 3328485 - protein, 5 aa, Plasmodium falciparum
MKKTK

SEQ ID NO: 3328486 - protein, 17 aa, Plasmodium falciparum
MKKTNQQDNNQMDSSTN

SEQ ID NO: 3328487 - protein, 8 aa, Plasmodium falciparum
MKNARETL

SEQ ID NO: 3328488 - protein, 4 aa, Plasmodium falciparum
MKND

SEQ ID NO: 3328489 - protein, 8 aa, Plasmodium falciparum
MKNDERNN

SEQ ID NO: 3328490 - protein, 8 aa, Plasmodium falciparum
MKNEEHHN

SEQ ID NO: 3328491 - protein, 13 aa, Plasmodium falciparum
MKNENKKAKEETT

SEQ ID NO: 3328492 - protein, 8 aa, Plasmodium falciparum
MKNGGMND

SEQ ID NO: 3328493 - protein, 12 aa, Plasmodium falciparum
MKNGGSDENFNK

SEQ ID NO: 3328494 - protein, 64 aa, Plasmodium falciparum
MKNGTMHNNSNNSNNNSNSNNNNNNNSNNNNNNNSNNSLKHKAQQKNNNEGKEKVKRRRKNPFS

SEQ ID NO: 3328495 - protein, 13 aa, Plasmodium falciparum
MKNKGSKNDFQQQ

SEQ ID NO: 3328496 - protein, 11 aa, Plasmodium falciparum
MKNKTKASNNY

SEQ ID NO: 3328497 - protein, 20 aa, Plasmodium falciparum
MKNNDEDEKYEGDINEGDMK

SEQ ID NO: 3328498 - protein, 24 aa, Plasmodium falciparum
MKNNDKKDTPNKGSAGKRTPSKKL

SEQ ID NO: 3328499 - protein, 5 aa, Plasmodium falciparum
MKNNF

SEQ ID NO: 3328500 - protein, 10 aa, Plasmodium falciparum
MKNNNSSNNK

SEQ ID NO: 3328501 - protein, 6 aa, Plasmodium falciparum
MKNNSE

SEQ ID NO: 3328502 - protein, 9 aa, Plasmodium falciparum
MKNNYNENN

SEQ ID NO: 3328503 - protein, 12 aa, Plasmodium falciparum
MKNSPKKSNQLD

SEQ ID NO: 3328504 - protein, 8 aa, Plasmodium falciparum
MKNTNQVD

SEQ ID NO: 3328505 - protein, 11 aa, Plasmodium falciparum
MKPKRRRRKTK

SEQ ID NO: 3328506 - protein, 6 aa, Plasmodium falciparum
MKPSDI

SEQ ID NO: 3328507 - protein, 7 aa, Plasmodium falciparum
MKQGQTE

SEQ ID NO: 3328508 - protein, 9 aa, Plasmodium falciparum
MKQKKIDDM

SEQ ID NO: 3328509 - protein, 19 aa, Plasmodium falciparum
MKQNNNNNNNYNNNNNRNL

SEQ ID NO: 3328510 - protein, 9 aa, Plasmodium falciparum
MKQQNNVDS

SEQ ID NO: 3328511 - protein, 26 aa, Plasmodium falciparum
MKQQSGARTENNGEKKNATNNINNND

SEQ ID NO: 3328512 - protein, 7 aa, Plasmodium falciparum
MKQRNTE

SEQ ID NO: 3328513 - protein, 12 aa, Plasmodium falciparum
MKREEENRRIQK

SEQ ID NO: 3328514 - protein, 41 aa, Plasmodium falciparum
MKREESCKNGHIGDNERSGDINTNDDKNNADNNDDVDGEKI

SEQ ID NO: 3328515 - protein, 13 aa, Plasmodium falciparum
MKRGEGSVSYGDN

SEQ ID NO: 3328516 - protein, 95 aa, Plasmodium falciparum
MKRRDRERERDRDRDRDRDRDRDRDRDRDRDRDRDRDREREKDKDRDRDHDRYRDRERDRYRDRERERRKDREREREREREKERIRRENERERLR

SEQ ID NO: 3328517 - protein, 6 aa, Plasmodium falciparum
MKRSEN

SEQ ID NO: 3328518 - protein, 6 aa, Plasmodium falciparum
MKRSNS

SEQ ID NO: 3328519 - protein, 11 aa, Plasmodium falciparum
MKSDQNEEKNK

SEQ ID NO: 3328520 - protein, 6 aa, Plasmodium falciparum
MKSGNN

SEQ ID NO: 3328521 - protein, 12 aa, Plasmodium falciparum
MKSKEKKLKNTT

SEQ ID NO: 3328522 - protein, 4 aa, Plasmodium falciparum
MKSS

SEQ ID NO: 3328523 - protein, 11 aa, Plasmodium falciparum
MKSSKGMNKNH

SEQ ID NO: 3328524 - protein, 7 aa, Plasmodium falciparum
MKSSKKG

SEQ ID NO: 3328525 - protein, 16 aa, Plasmodium falciparum
MKSSNKTNNENKTTFG

SEQ ID NO: 3328526 - protein, 9 aa, Plasmodium falciparum
MKSSTKGIL

SEQ ID NO: 3328527 - protein, 8 aa, Plasmodium falciparum
MKSTDQSN

SEQ ID NO: 3328528 - protein, 4 aa, Plasmodium falciparum
MKTE

SEQ ID NO: 3328529 - protein, 15 aa, Plasmodium falciparum
MKTHNETKNNDKMDE

SEQ ID NO: 3328530 - protein, 4 aa, Plasmodium falciparum
MKTK

SEQ ID NO: 3328531 - protein, 13 aa, Plasmodium falciparum
MKTPNSKNSKHTF

SEQ ID NO: 3328532 - protein, 5 aa, Plasmodium falciparum
MKTPS

SEQ ID NO: 3328533 - protein, 17 aa, Plasmodium falciparum
MKTSEQSSDIEKSYELP

SEQ ID NO: 3328534 - protein, 5 aa, Plasmodium falciparum
MKYDK

SEQ ID NO: 3328535 - protein, 4 aa, Plasmodium falciparum
MMDE

SEQ ID NO: 3328536 - protein, 36 aa, Plasmodium falciparum
MMPTEGETTNSKNNSKNNSKRNISPNNTQNNTTSTN

SEQ ID NO: 3328537 - protein, 21 aa, Plasmodium falciparum
MMSPNKRNIPDCNNSTTDNSR

SEQ ID NO: 3328538 - protein, 57 aa, Plasmodium falciparum
MNDDDSSSYGDDTSDEEDDDDEEDEDVEVDNKTLDSDKLKDEENKIPDAAVEVQEPV

SEQ ID NO: 3328539 - protein, 12 aa, Plasmodium falciparum
MNDDNDNNYVEE

SEQ ID NO: 3328540 - protein, 8 aa, Plasmodium falciparum
MNDEEYSN

SEQ ID NO: 3328541 - protein, 9 aa, Plasmodium falciparum
MNDENQRKE

SEQ ID NO: 3328542 - protein, 11 aa, Plasmodium falciparum
MNDGDKNKTNL

SEQ ID NO: 3328543 - protein, 12 aa, Plasmodium falciparum
MNDGHNNMNKGH

SEQ ID NO: 3328544 - protein, 4 aa, Plasmodium falciparum
MNDH

SEQ ID NO: 3328545 - protein, 28 aa, Plasmodium falciparum
MNDKEKTDNVNSKNDDNNGKNNIKDNGK

SEQ ID NO: 3328546 - protein, 9 aa, Plasmodium falciparum
MNDKGSSYE

SEQ ID NO: 3328547 - protein, 13 aa, Plasmodium falciparum
MNDKSKSVEHNNC

SEQ ID NO: 3328548 - protein, 14 aa, Plasmodium falciparum
MNDNDENGEKLGEA

SEQ ID NO: 3328549 - protein, 18 aa, Plasmodium falciparum
MNDNKKEKNIKNNENKIN

SEQ ID NO: 3328550 - protein, 12 aa, Plasmodium falciparum
MNDQQRKDTKNI

SEQ ID NO: 3328551 - protein, 7 aa, Plasmodium falciparum
MNDSKGK

SEQ ID NO: 3328552 - protein, 14 aa, Plasmodium falciparum
MNDTDENSSNSVED

SEQ ID NO: 3328553 - protein, 6 aa, Plasmodium falciparum
MNEDTN

SEQ ID NO: 3328554 - protein, 4 aa, Plasmodium falciparum
MNEE

SEQ ID NO: 3328555 - protein, 15 aa, Plasmodium falciparum
MNEEGRINNTNNDEI

SEQ ID NO: 3328556 - protein, 13 aa, Plasmodium falciparum
MNEEKSGNSEKQI

SEQ ID NO: 3328557 - protein, 8 aa, Plasmodium falciparum
MNEENERI

SEQ ID NO: 3328558 - protein, 10 aa, Plasmodium falciparum
MNEENNNKIE

SEQ ID NO: 3328559 - protein, 10 aa, Plasmodium falciparum
MNEESKGNEM

SEQ ID NO: 3328560 - protein, 9 aa, Plasmodium falciparum
MNEKEEEIK

SEQ ID NO: 3328561 - protein, 6 aa, Plasmodium falciparum
MNEKKK

SEQ ID NO: 3328562 - protein, 5 aa, Plasmodium falciparum
MNENK

SEQ ID NO: 3328563 - protein, 7 aa, Plasmodium falciparum
MNENNNE

SEQ ID NO: 3328564 - protein, 21 aa, Plasmodium falciparum
MNEQNNNYQMNKNQNSKNNYL

SEQ ID NO: 3328565 - protein, 11 aa, Plasmodium falciparum
MNESKTSDNTI

SEQ ID NO: 3328566 - protein, 7 aa, Plasmodium falciparum
MNESNNS

SEQ ID NO: 3328567 - protein, 22 aa, Plasmodium falciparum
MNESSTQTSTETSSKSSKDTSL

SEQ ID NO: 3328568 - protein, 5 aa, Plasmodium falciparum
MNETI

SEQ ID NO: 3328569 - protein, 5 aa, Plasmodium falciparum
MNGGN

SEQ ID NO: 3328570 - protein, 6 aa, Plasmodium falciparum
MNGGNV

SEQ ID NO: 3328571 - protein, 4 aa, Plasmodium falciparum
MNGK

SEQ ID NO: 3328572 - protein, 158 aa, Plasmodium falciparum
MNGNEMSDDDINDDNKDDNKDDNKDDNKDDNKDEISDDNINDNINDDNINDDDINDDDINDDDINDDDINDDDINDDDINDDDINDDDINDDDISDDNISDDNISDDNISDDNISDDNISDDNISDDNISDDNISDDDVNRKRKNNEIETNDNNKDNT

SEQ ID NO: 3328573 - protein, 21 aa, Plasmodium falciparum
MNGNNNNNNNYNNDRYNNSRN

SEQ ID NO: 3328574 - protein, 9 aa, Plasmodium falciparum
MNGSEIDGS

SEQ ID NO: 3328575 - protein, 20 aa, Plasmodium falciparum
MNGTDEMGNEEDMGSEENME

SEQ ID NO: 3328576 - protein, 17 aa, Plasmodium falciparum
MNISNGQNLNESPKMDM

SEQ ID NO: 3328577 - protein, 5 aa, Plasmodium falciparum
MNKDK

SEQ ID NO: 3328578 - protein, 14 aa, Plasmodium falciparum
MNKEDNKSNADEKE

SEQ ID NO: 3328579 - protein, 5 aa, Plasmodium falciparum
MNKEE

SEQ ID NO: 3328580 - protein, 11 aa, Plasmodium falciparum
MNKENNEKEDH

SEQ ID NO: 3328581 - protein, 12 aa, Plasmodium falciparum
MNKERMDDGKKV

SEQ ID NO: 3328582 - protein, 8 aa, Plasmodium falciparum
MNKESNQF

SEQ ID NO: 3328583 - protein, 19 aa, Plasmodium falciparum
MNKKHKKKKKMKQNKLDED

SEQ ID NO: 3328584 - protein, 14 aa, Plasmodium falciparum
MNKKKIKPNDKDDD

SEQ ID NO: 3328585 - protein, 9 aa, Plasmodium falciparum
MNKKKKNVY

SEQ ID NO: 3328586 - protein, 9 aa, Plasmodium falciparum
MNKKKSKQI

SEQ ID NO: 3328587 - protein, 5 aa, Plasmodium falciparum
MNKNG

SEQ ID NO: 3328588 - protein, 14 aa, Plasmodium falciparum
MNKQNEDLKNKRDS

SEQ ID NO: 3328589 - protein, 8 aa, Plasmodium falciparum
MNKQNSKH

SEQ ID NO: 3328590 - protein, 17 aa, Plasmodium falciparum
MNKQTENTQDKEDDRYS

SEQ ID NO: 3328591 - protein, 7 aa, Plasmodium falciparum
MNKQTTH

SEQ ID NO: 3328592 - protein, 6 aa, Plasmodium falciparum
MNKSDI

SEQ ID NO: 3328593 - protein, 18 aa, Plasmodium falciparum
MNKSEGDEKYCSKTKNKS

SEQ ID NO: 3328594 - protein, 14 aa, Plasmodium falciparum
MNKSGKSIKEQDSS

SEQ ID NO: 3328595 - protein, 9 aa, Plasmodium falciparum
MNKTNYTKN

SEQ ID NO: 3328596 - protein, 11 aa, Plasmodium falciparum
MNLPTSDEQKK

SEQ ID NO: 3328597 - protein, 8 aa, Plasmodium falciparum
MNMSGNEN

SEQ ID NO: 3328598 - protein, 7 aa, Plasmodium falciparum
MNNDEDI

SEQ ID NO: 3328599 - protein, 11 aa, Plasmodium falciparum
MNNDKDTYKYG

SEQ ID NO: 3328600 - protein, 21 aa, Plasmodium falciparum
MNNDNNNNNNNNNNNITYNQQ

SEQ ID NO: 3328601 - protein, 27 aa, Plasmodium falciparum
MNNDNVNNKKQKWDEATCKKEENNEDN

SEQ ID NO: 3328602 - protein, 16 aa, Plasmodium falciparum
MNNEKKETKKKYNNKM

SEQ ID NO: 3328603 - protein, 14 aa, Plasmodium falciparum
MNNEKKNDEEKEKN

SEQ ID NO: 3328604 - protein, 10 aa, Plasmodium falciparum
MNNEKTNEHT

SEQ ID NO: 3328605 - protein, 22 aa, Plasmodium falciparum
MNNEKYKDNKINNNQNKNKKQC

SEQ ID NO: 3328606 - protein, 9 aa, Plasmodium falciparum
MNNENSGSF

SEQ ID NO: 3328607 - protein, 7 aa, Plasmodium falciparum
MNNESHN

SEQ ID NO: 3328608 - protein, 26 aa, Plasmodium falciparum
MNNHQENKKEEDKDKEKEKEKKMNEK

SEQ ID NO: 3328609 - protein, 12 aa, Plasmodium falciparum
MNNKTNVNNYDD

SEQ ID NO: 3328610 - protein, 39 aa, Plasmodium falciparum
MNNNDNNNDNNNDNNNDNNNNNNDNYYYSSSSSKNNNYY

SEQ ID NO: 3328611 - protein, 12 aa, Plasmodium falciparum
MNNNEEDDIKER

SEQ ID NO: 3328612 - protein, 11 aa, Plasmodium falciparum
MNNNENENENE

SEQ ID NO: 3328613 - protein, 10 aa, Plasmodium falciparum
MNNNGTTNGL

SEQ ID NO: 3328614 - protein, 32 aa, Plasmodium falciparum
MNNNHNNNNNNNNNNNNNNNNNSNNNNNNNNN

SEQ ID NO: 3328615 - protein, 9 aa, Plasmodium falciparum
MNNNHPNNN

SEQ ID NO: 3328616 - protein, 12 aa, Plasmodium falciparum
MNNNIKEKQQQH

SEQ ID NO: 3328617 - protein, 8 aa, Plasmodium falciparum
MNNNKSDV

SEQ ID NO: 3328618 - protein, 27 aa, Plasmodium falciparum
MNNNNNDDVDNNDMNNNIDNNNIDNNN

SEQ ID NO: 3328619 - protein, 11 aa, Plasmodium falciparum
MNNNNNNKFNE

SEQ ID NO: 3328620 - protein, 9 aa, Plasmodium falciparum
MNNNNNNNN

SEQ ID NO: 3328621 - protein, 15 aa, Plasmodium falciparum
MNNNNNNNNCDEDVN

SEQ ID NO: 3328622 - protein, 22 aa, Plasmodium falciparum
MNNNNNNNNNNDNMNNNNDNMI

SEQ ID NO: 3328623 - protein, 32 aa, Plasmodium falciparum
MNNNNNNNNNNNINNSNNSNNSKNIPPKGMPK

SEQ ID NO: 3328624 - protein, 33 aa, Plasmodium falciparum
MNNNNNNNNNVNNNNNNVSNNNNNNVSNNNNNN

SEQ ID NO: 3328625 - protein, 12 aa, Plasmodium falciparum
MNNNNNNNNSGS

SEQ ID NO: 3328626 - protein, 17 aa, Plasmodium falciparum
MNNNNNNNNTMNPTYPS

SEQ ID NO: 3328627 - protein, 12 aa, Plasmodium falciparum
MNNNNNNNNYNN

SEQ ID NO: 3328628 - protein, 23 aa, Plasmodium falciparum
MNNNNNNNSNNNNNSNNSNSNYM

SEQ ID NO: 3328629 - protein, 10 aa, Plasmodium falciparum
MNNNNNNSNE

SEQ ID NO: 3328630 - protein, 9 aa, Plasmodium falciparum
MNNNREQYC

SEQ ID NO: 3328631 - protein, 6 aa, Plasmodium falciparum
MNNPMD

SEQ ID NO: 3328632 - protein, 7 aa, Plasmodium falciparum
MNNPNNA

SEQ ID NO: 3328633 - protein, 8 aa, Plasmodium falciparum
MNNPTINT

SEQ ID NO: 3328634 - protein, 15 aa, Plasmodium falciparum
MNNSEGHNEVSSSTA

SEQ ID NO: 3328635 - protein, 14 aa, Plasmodium falciparum
MNNSMNNSMNNNMN

SEQ ID NO: 3328636 - protein, 11 aa, Plasmodium falciparum
MNNSNNGDNNT

SEQ ID NO: 3328637 - protein, 35 aa, Plasmodium falciparum
MNNSNNQNNTTAPCSNEHMSSNNNNNNNKNKNSNM

SEQ ID NO: 3328638 - protein, 7 aa, Plasmodium falciparum
MNNSNTI

SEQ ID NO: 3328639 - protein, 6 aa, Plasmodium falciparum
MNNSSE

SEQ ID NO: 3328640 - protein, 41 aa, Plasmodium falciparum
MNNSTHNVGSSNGGAGGYNNRDDNKLRENYTHSNDDNINHT

SEQ ID NO: 3328641 - protein, 17 aa, Plasmodium falciparum
MNNSTPSITSNGNKKSF

SEQ ID NO: 3328642 - protein, 21 aa, Plasmodium falciparum
MNNSTQQYNNENSESPYGEAR

SEQ ID NO: 3328643 - protein, 17 aa, Plasmodium falciparum
MNNSTSSIQPPPSVPPT

SEQ ID NO: 3328644 - protein, 15 aa, Plasmodium falciparum
MNNTFNSNRNKYGIE

SEQ ID NO: 3328645 - protein, 12 aa, Plasmodium falciparum
MNNTKKNSCTSS

SEQ ID NO: 3328646 - protein, 5 aa, Plasmodium falciparum
MNNTN

SEQ ID NO: 3328647 - protein, 28 aa, Plasmodium falciparum
MNNTNFSQGSTNYGSNYNSENFQGNNNM

SEQ ID NO: 3328648 - protein, 29 aa, Plasmodium falciparum
MNNTNNMNNTNNMNNTNNMNNMNNNEHDD

SEQ ID NO: 3328649 - protein, 8 aa, Plasmodium falciparum
MNNTQNDI

SEQ ID NO: 3328650 - protein, 5 aa, Plasmodium falciparum
MNPFN

SEQ ID NO: 3328651 - protein, 11 aa, Plasmodium falciparum
MNPKGNKNEDG

SEQ ID NO: 3328652 - protein, 4 aa, Plasmodium falciparum
MNPN

SEQ ID NO: 3328653 - protein, 7 aa, Plasmodium falciparum
MNPNDEY

SEQ ID NO: 3328654 - protein, 12 aa, Plasmodium falciparum
MNPNNDERRNTS

SEQ ID NO: 3328655 - protein, 7 aa, Plasmodium falciparum
MNPNNIR

SEQ ID NO: 3328656 - protein, 24 aa, Plasmodium falciparum
MNPNNNNNNNNNNNNNNKKKEKLS

SEQ ID NO: 3328657 - protein, 4 aa, Plasmodium falciparum
MNPQ

SEQ ID NO: 3328658 - protein, 5 aa, Plasmodium falciparum
MNPRY

SEQ ID NO: 3328659 - protein, 6 aa, Plasmodium falciparum
MNPSKT

SEQ ID NO: 3328660 - protein, 12 aa, Plasmodium falciparum
MNPTDSEANNPL

SEQ ID NO: 3328661 - protein, 12 aa, Plasmodium falciparum
MNPYSKKKINNL

SEQ ID NO: 3328662 - protein, 12 aa, Plasmodium falciparum
MNQDNLKQDTEE

SEQ ID NO: 3328663 - protein, 11 aa, Plasmodium falciparum
MNQEKNNENHS

SEQ ID NO: 3328664 - protein, 8 aa, Plasmodium falciparum
MNQSMNQS

SEQ ID NO: 3328665 - protein, 5 aa, Plasmodium falciparum
MNQSN

SEQ ID NO: 3328666 - protein, 4 aa, Plasmodium falciparum
MNRE

SEQ ID NO: 3328667 - protein, 68 aa, Plasmodium falciparum
MNRERERKKKKRNKDRKKKERSEKKYSNSEMHDTSNESYTNSDTYDNTVTSTNIETNMESERKKYQHE

SEQ ID NO: 3328668 - protein, 34 aa, Plasmodium falciparum
MNRKKQQQQQQQQQQQQNDDEEEPIYSDKNTDTL

SEQ ID NO: 3328669 - protein, 9 aa, Plasmodium falciparum
MNRPPGPKE

SEQ ID NO: 3328670 - protein, 15 aa, Plasmodium falciparum
MNRSGENVTKDQCKN

SEQ ID NO: 3328671 - protein, 18 aa, Plasmodium falciparum
MNRSSNFSKYPNDDMSNG

SEQ ID NO: 3328672 - protein, 4 aa, Plasmodium falciparum
MNSA

SEQ ID NO: 3328673 - protein, 10 aa, Plasmodium falciparum
MNSGKNQNRN

SEQ ID NO: 3328674 - protein, 20 aa, Plasmodium falciparum
MNSGYNNNMNNKNNNNNNMN

SEQ ID NO: 3328675 - protein, 13 aa, Plasmodium falciparum
MNSHNNNNNNNIN

SEQ ID NO: 3328676 - protein, 10 aa, Plasmodium falciparum
MNSNDDDVNN

SEQ ID NO: 3328677 - protein, 14 aa, Plasmodium falciparum
MNSNDEKPTTSTEN

SEQ ID NO: 3328678 - protein, 21 aa, Plasmodium falciparum
MNSNNMNSNNINSNNINSNSI

SEQ ID NO: 3328679 - protein, 34 aa, Plasmodium falciparum
MNSNNNDNNDKSYNNDKSYNNDNNYNNDNSYDKS

SEQ ID NO: 3328680 - protein, 15 aa, Plasmodium falciparum
MNSPPSKNESNKKKD

SEQ ID NO: 3328681 - protein, 7 aa, Plasmodium falciparum
MNSPSIM

SEQ ID NO: 3328682 - protein, 14 aa, Plasmodium falciparum
MNSQYNKRNNSHVK

SEQ ID NO: 3328683 - protein, 18 aa, Plasmodium falciparum
MNSRSSIATTTKNYPTSN

SEQ ID NO: 3328684 - protein, 11 aa, Plasmodium falciparum
MNSSDGKQSND

SEQ ID NO: 3328685 - protein, 10 aa, Plasmodium falciparum
MNSSGENETN

SEQ ID NO: 3328686 - protein, 7 aa, Plasmodium falciparum
MNSSNNK

SEQ ID NO: 3328687 - protein, 40 aa, Plasmodium falciparum
MNSSNRNGSSIHNGSSIHNGSSIHNGSSSHHNGSSHNSSC

SEQ ID NO: 3328688 - protein, 10 aa, Plasmodium falciparum
MNSSNSDNGD

SEQ ID NO: 3328689 - protein, 10 aa, Plasmodium falciparum
MNSTCDDKDT

SEQ ID NO: 3328690 - protein, 9 aa, Plasmodium falciparum
MNSTNNKSS

SEQ ID NO: 3328691 - protein, 13 aa, Plasmodium falciparum
MNSTSPTNNTSSD

SEQ ID NO: 3328692 - protein, 13 aa, Plasmodium falciparum
MNTDMNTDVNTDV

SEQ ID NO: 3328693 - protein, 6 aa, Plasmodium falciparum
MNTEQN

SEQ ID NO: 3328694 - protein, 6 aa, Plasmodium falciparum
MNTESN

SEQ ID NO: 3328695 - protein, 17 aa, Plasmodium falciparum
MNTNSRQATNNQPYDYN

SEQ ID NO: 3328696 - protein, 4 aa, Plasmodium falciparum
MNTP

SEQ ID NO: 3328697 - protein, 10 aa, Plasmodium falciparum
MNTSEENHHQ

SEQ ID NO: 3328698 - protein, 6 aa, Plasmodium falciparum
MNVNKT

SEQ ID NO: 3328699 - protein, 4 aa, Plasmodium falciparum
MNYT

SEQ ID NO: 3328700 - protein, 9 aa, Plasmodium falciparum
MPADSGYPA

SEQ ID NO: 3328701 - protein, 6 aa, Plasmodium falciparum
MPNGSN

SEQ ID NO: 3328702 - protein, 10 aa, Plasmodium falciparum
MPNNEKENKF

SEQ ID NO: 3328703 - protein, 5 aa, Plasmodium falciparum
MPNNL

SEQ ID NO: 3328704 - protein, 6 aa, Plasmodium falciparum
MPNNNN

SEQ ID NO: 3328705 - protein, 10 aa, Plasmodium falciparum
MPNPNNKTEE

SEQ ID NO: 3328706 - protein, 4 aa, Plasmodium falciparum
MPPI

SEQ ID NO: 3328707 - protein, 39 aa, Plasmodium falciparum
MPPSFSHPNNNNNNNNNNNINNNNNNSGMMPPRPSQYSN

SEQ ID NO: 3328708 - protein, 6 aa, Plasmodium falciparum
MPPSVE

SEQ ID NO: 3328709 - protein, 5 aa, Plasmodium falciparum
MPSDK

SEQ ID NO: 3328710 - protein, 15 aa, Plasmodium falciparum
MPSPNSNMKNNQNTT

SEQ ID NO: 3328711 - protein, 4 aa, Plasmodium falciparum
MPSR

SEQ ID NO: 3328712 - protein, 5 aa, Plasmodium falciparum
MPTLN

SEQ ID NO: 3328713 - protein, 7 aa, Plasmodium falciparum
MPTSNSV

SEQ ID NO: 3328714 - protein, 10 aa, Plasmodium falciparum
MPTYKDPFKK

SEQ ID NO: 3328715 - protein, 5 aa, Plasmodium falciparum
MQDSI

SEQ ID NO: 3328716 - protein, 32 aa, Plasmodium falciparum
MQERDEERQTMKKDSSIPKRTQLSKKKEHNNN

SEQ ID NO: 3328717 - protein, 7 aa, Plasmodium falciparum
MQESSKK

SEQ ID NO: 3328718 - protein, 5 aa, Plasmodium falciparum
MQGGY

SEQ ID NO: 3328719 - protein, 10 aa, Plasmodium falciparum
MQGSSDQSLN

SEQ ID NO: 3328720 - protein, 41 aa, Plasmodium falciparum
MQKNNNMEKNNNMQKNNNIQKNNNMEKNNNIQKNNNMDKGI

SEQ ID NO: 3328721 - protein, 12 aa, Plasmodium falciparum
MQKSTSNKYTIE

SEQ ID NO: 3328722 - protein, 4 aa, Plasmodium falciparum
MQND

SEQ ID NO: 3328723 - protein, 5 aa, Plasmodium falciparum
MQNDE

SEQ ID NO: 3328724 - protein, 5 aa, Plasmodium falciparum
MQNNE

SEQ ID NO: 3328725 - protein, 5 aa, Plasmodium falciparum
MQPTD

SEQ ID NO: 3328726 - protein, 9 aa, Plasmodium falciparum
MQSDNHNDD

SEQ ID NO: 3328727 - protein, 10 aa, Plasmodium falciparum
MQSEENGNNC

SEQ ID NO: 3328728 - protein, 10 aa, Plasmodium falciparum
MQSEKQSNNY

SEQ ID NO: 3328729 - protein, 111 aa, Plasmodium falciparum
MQSKKNKKLSQSNQTTNTKKHEQAPQIDKQTNKNEEDKENQPKNEVHAETDVTKNETQEKEEQQQEKKKDKQEENQELNQTEKEQEKEQEKEQEKEQEKEQEKEQEKQSNE

SEQ ID NO: 3328730 - protein, 11 aa, Plasmodium falciparum
MRENQKVGNKN

SEQ ID NO: 3328731 - protein, 10 aa, Plasmodium falciparum
MRKKSSKNSF

SEQ ID NO: 3328732 - protein, 12 aa, Plasmodium falciparum
MRKSSKKKINKL

SEQ ID NO: 3328733 - protein, 4 aa, Plasmodium falciparum
MRKT

SEQ ID NO: 3328734 - protein, 6 aa, Plasmodium falciparum
MRKTTY

SEQ ID NO: 3328735 - protein, 7 aa, Plasmodium falciparum
MRNGKKD

SEQ ID NO: 3328736 - protein, 15 aa, Plasmodium falciparum
MRNPSNKDSTRENEP

SEQ ID NO: 3328737 - protein, 9 aa, Plasmodium falciparum
MRQEGSKNI

SEQ ID NO: 3328738 - protein, 4 aa, Plasmodium falciparum
MRSE

SEQ ID NO: 3328739 - protein, 22 aa, Plasmodium falciparum
MRSNKKNAHEGDMNNDGEDDRY

SEQ ID NO: 3328740 - protein, 5 aa, Plasmodium falciparum
MRSSH

SEQ ID NO: 3328741 - protein, 7 aa, Plasmodium falciparum
MRSTEQK

SEQ ID NO: 3328742 - protein, 17 aa, Plasmodium falciparum
MRTNNNNNNDSSCSSNN

SEQ ID NO: 3328743 - protein, 13 aa, Plasmodium falciparum
MRTRGAERSANRN

SEQ ID NO: 3328744 - protein, 16 aa, Plasmodium falciparum
MSAEKRGQELKNNKSI

SEQ ID NO: 3328745 - protein, 37 aa, Plasmodium falciparum
MSDDDSSDMSNISNNEDQQKDLDEENEDDNDDNKPIY

SEQ ID NO: 3328746 - protein, 12 aa, Plasmodium falciparum
MSDDKKKKRYDS

SEQ ID NO: 3328747 - protein, 5 aa, Plasmodium falciparum
MSDKI

SEQ ID NO: 3328748 - protein, 11 aa, Plasmodium falciparum
MSDNDKKEITT

SEQ ID NO: 3328749 - protein, 27 aa, Plasmodium falciparum
MSDVDNVSEPESYDKDINGKDNTNRIK

SEQ ID NO: 3328750 - protein, 14 aa, Plasmodium falciparum
MSEDKDSNSSLDVQ

SEQ ID NO: 3328751 - protein, 12 aa, Plasmodium falciparum
MSEERKEMDEPR

SEQ ID NO: 3328752 - protein, 20 aa, Plasmodium falciparum
MSEKKKKNCRMKKNDKEKEN

SEQ ID NO: 3328753 - protein, 31 aa, Plasmodium falciparum
MSENKNANENANENENNYVSNDNSLSNYNDM

SEQ ID NO: 3328754 - protein, 20 aa, Plasmodium falciparum
MSENTKSIQSLEGETQDDIN

SEQ ID NO: 3328755 - protein, 4 aa, Plasmodium falciparum
MSGD

SEQ ID NO: 3328756 - protein, 5 aa, Plasmodium falciparum
MSGEK

SEQ ID NO: 3328757 - protein, 52 aa, Plasmodium falciparum
MSGNENMNMSGNENMNMSGNENMNMSGNENMNMSGNENMNMSGNENMNMSGN

SEQ ID NO: 3328758 - protein, 48 aa, Plasmodium falciparum
MSGRAKTKKEEQEEQQEEQQEHPEGEQNDDNVENEKNDPNDDSHNNDV

SEQ ID NO: 3328759 - protein, 18 aa, Plasmodium falciparum
MSKDDEKKVQNNNEDKDV

SEQ ID NO: 3328760 - protein, 6 aa, Plasmodium falciparum
MSKENL

SEQ ID NO: 3328761 - protein, 8 aa, Plasmodium falciparum
MSKKAQNK

SEQ ID NO: 3328762 - protein, 8 aa, Plasmodium falciparum
MSKKENEI

SEQ ID NO: 3328763 - protein, 9 aa, Plasmodium falciparum
MSKNISKEA

SEQ ID NO: 3328764 - protein, 6 aa, Plasmodium falciparum
MSKQST

SEQ ID NO: 3328765 - protein, 12 aa, Plasmodium falciparum
MSKSEKVDEEQF

SEQ ID NO: 3328766 - protein, 5 aa, Plasmodium falciparum
MSLDE

SEQ ID NO: 3328767 - protein, 19 aa, Plasmodium falciparum
MSNANNNNNNVSSSSSSLF

SEQ ID NO: 3328768 - protein, 10 aa, Plasmodium falciparum
MSNDERKNNL

SEQ ID NO: 3328769 - protein, 5 aa, Plasmodium falciparum
MSNEK

SEQ ID NO: 3328770 - protein, 8 aa, Plasmodium falciparum
MSNENKNV

SEQ ID NO: 3328771 - protein, 12 aa, Plasmodium falciparum
MSNKTNKEKTHH

SEQ ID NO: 3328772 - protein, 8 aa, Plasmodium falciparum
MSNNDKND

SEQ ID NO: 3328773 - protein, 47 aa, Plasmodium falciparum
MSNNNNDNNDNNNNNNNNNNNNNNNNNSNNNSSNNNNNNLSTNYQEV

SEQ ID NO: 3328774 - protein, 7 aa, Plasmodium falciparum
MSNNNNN

SEQ ID NO: 3328775 - protein, 10 aa, Plasmodium falciparum
MSNQINDGNI

SEQ ID NO: 3328776 - protein, 17 aa, Plasmodium falciparum
MSNTPNNTSDKKTKIES

SEQ ID NO: 3328777 - protein, 19 aa, Plasmodium falciparum
MSNYEDHDNKYKARNNSSN

SEQ ID NO: 3328778 - protein, 4 aa, Plasmodium falciparum
MSPS

SEQ ID NO: 3328779 - protein, 7 aa, Plasmodium falciparum
MSPSFSD

SEQ ID NO: 3328780 - protein, 7 aa, Plasmodium falciparum
MSPSSMN

SEQ ID NO: 3328781 - protein, 10 aa, Plasmodium falciparum
MSPTSKDINN

SEQ ID NO: 3328782 - protein, 79 aa, Plasmodium falciparum
MSQEGGGQEDDDEDVDMDDDDEDVDMDDEDEDVDMDDEDEDVDMDDEDEDVDMDDEDEDVDMDDEDEDVDMDDEDEDVD

SEQ ID NO: 3328783 - protein, 10 aa, Plasmodium falciparum
MSQGSSTNNM

SEQ ID NO: 3328784 - protein, 8 aa, Plasmodium falciparum
MSQKEKRQ

SEQ ID NO: 3328785 - protein, 6 aa, Plasmodium falciparum
MSQKKR

SEQ ID NO: 3328786 - protein, 7 aa, Plasmodium falciparum
MSQSERD

SEQ ID NO: 3328787 - protein, 6 aa, Plasmodium falciparum
MSRNSS

SEQ ID NO: 3328788 - protein, 7 aa, Plasmodium falciparum
MSSASHK

SEQ ID NO: 3328789 - protein, 38 aa, Plasmodium falciparum
MSSDQNDQNDHNDQNDHSDQNDQNDHNDQNDHSDQNYE

SEQ ID NO: 3328790 - protein, 15 aa, Plasmodium falciparum
MSSGINGTKNMSSGI

SEQ ID NO: 3328791 - protein, 4 aa, Plasmodium falciparum
MSSI

SEQ ID NO: 3328792 - protein, 5 aa, Plasmodium falciparum
MSSNE

SEQ ID NO: 3328793 - protein, 10 aa, Plasmodium falciparum
MSSNNNSEIV

SEQ ID NO: 3328794 - protein, 6 aa, Plasmodium falciparum
MSSPVT

SEQ ID NO: 3328795 - protein, 5 aa, Plasmodium falciparum
MSSQV

SEQ ID NO: 3328796 - protein, 13 aa, Plasmodium falciparum
MSSTDESENKEEE

SEQ ID NO: 3328797 - protein, 8 aa, Plasmodium falciparum
MSSYYKNE

SEQ ID NO: 3328798 - protein, 4 aa, Plasmodium falciparum
MSTK

SEQ ID NO: 3328799 - protein, 28 aa, Plasmodium falciparum
MSTKYASSNEYNKKKEEGAYYSDSSKNI

SEQ ID NO: 3328800 - protein, 12 aa, Plasmodium falciparum
MSTNNKENCTLN

SEQ ID NO: 3328801 - protein, 12 aa, Plasmodium falciparum
MSTQNSSENFSS

SEQ ID NO: 3328802 - protein, 25 aa, Plasmodium falciparum
MSTTQDEEETGPNTINTTNYAEAGG

SEQ ID NO: 3328803 - protein, 13 aa, Plasmodium falciparum
MSVDDGMDEQKKE

SEQ ID NO: 3328804 - protein, 24 aa, Plasmodium falciparum
MTAEPGRKKRKKDVLERKKKNLNK

SEQ ID NO: 3328805 - protein, 6 aa, Plasmodium falciparum
MTDKDR

SEQ ID NO: 3328806 - protein, 11 aa, Plasmodium falciparum
MTEEEKSVQSN

SEQ ID NO: 3328807 - protein, 5 aa, Plasmodium falciparum
MTEKE

SEQ ID NO: 3328808 - protein, 15 aa, Plasmodium falciparum
MTEKSKKKKDSKKMK

SEQ ID NO: 3328809 - protein, 4 aa, Plasmodium falciparum
MTEN

SEQ ID NO: 3328810 - protein, 4 aa, Plasmodium falciparum
MTER

SEQ ID NO: 3328811 - protein, 7 aa, Plasmodium falciparum
MTGSGDG

SEQ ID NO: 3328812 - protein, 10 aa, Plasmodium falciparum
MTKKKKNESI

SEQ ID NO: 3328813 - protein, 13 aa, Plasmodium falciparum
MTKMNNKNNYTKD

SEQ ID NO: 3328814 - protein, 9 aa, Plasmodium falciparum
MTKNDTTNV

SEQ ID NO: 3328815 - protein, 8 aa, Plasmodium falciparum
MTKTSEEL

SEQ ID NO: 3328816 - protein, 4 aa, Plasmodium falciparum
MTND

SEQ ID NO: 3328817 - protein, 10 aa, Plasmodium falciparum
MTNDEKNNTY

SEQ ID NO: 3328818 - protein, 18 aa, Plasmodium falciparum
MTNEKDDNKNDIKESDDN

SEQ ID NO: 3328819 - protein, 20 aa, Plasmodium falciparum
MTNKKQQITIQSSGGLSKEE

SEQ ID NO: 3328820 - protein, 16 aa, Plasmodium falciparum
MTNLDDDKRNGNNNDE

SEQ ID NO: 3328821 - protein, 11 aa, Plasmodium falciparum
MTNNDDKEDTC

SEQ ID NO: 3328822 - protein, 48 aa, Plasmodium falciparum
MTNNNNNNNNNNNNNNNNNNNNNNNNNNNNNNNNNNNNNNNSNNNNDY

SEQ ID NO: 3328823 - protein, 18 aa, Plasmodium falciparum
MTNNVTSSITNNMTSSMT

SEQ ID NO: 3328824 - protein, 9 aa, Plasmodium falciparum
MTNPPNYGY

SEQ ID NO: 3328825 - protein, 11 aa, Plasmodium falciparum
MTNQNDLNKNN

SEQ ID NO: 3328826 - protein, 4 aa, Plasmodium falciparum
MTNR

SEQ ID NO: 3328827 - protein, 13 aa, Plasmodium falciparum
MTQENNIDKANMG

SEQ ID NO: 3328828 - protein, 4 aa, Plasmodium falciparum
MTQN

SEQ ID NO: 3328829 - protein, 4 aa, Plasmodium falciparum
MTRG

SEQ ID NO: 3328830 - protein, 8 aa, Plasmodium falciparum
MTSENKEK

SEQ ID NO: 3328831 - protein, 26 aa, Plasmodium falciparum
MTSNSEQYDNNNYDDANNNNNNNNFR

SEQ ID NO: 3328832 - protein, 10 aa, Plasmodium falciparum
MTSQDTYDNT

SEQ ID NO: 3328833 - protein, 18 aa, Plasmodium falciparum
MTSSEQTKHKSDNEKNIS

SEQ ID NO: 3328834 - protein, 8 aa, Plasmodium falciparum
MTTAAQQS

SEQ ID NO: 3328835 - protein, 6 aa, Plasmodium falciparum
MTTEGE

SEQ ID NO: 3328836 - protein, 23 aa, Plasmodium falciparum
MTTIKNKKNGENKKVKKNVQKVK

SEQ ID NO: 3328837 - protein, 10 aa, Plasmodium falciparum
MTTKEDIQGD

SEQ ID NO: 3328838 - protein, 4 aa, Plasmodium falciparum
MTTN

SEQ ID NO: 3328839 - protein, 9 aa, Plasmodium falciparum
MVDTNKGKR

SEQ ID NO: 3328840 - protein, 20 aa, Plasmodium falciparum
MVKENNDDTIKTSEEDKLKE

SEQ ID NO: 3328841 - protein, 8 aa, Plasmodium falciparum
MVNSTNNI

SEQ ID NO: 3328842 - protein, 9 aa, Plasmodium falciparum
MYDDKNNYG

SEQ ID NO: 3328843 - protein, 65 aa, Plasmodium falciparum
MYENNGDNNHNISDDKARDGGSSPTSSAKKTKYNLSDDNNNNNNNNINNVSTNYNNTSDGSTFGN

SEQ ID NO: 3328844 - protein, 19 aa, Plasmodium falciparum
MYEPPSSSYVKEDNDNNNQ

SEQ ID NO: 3328845 - protein, 10 aa, Plasmodium falciparum
MYKDKSKDMY

SEQ ID NO: 3328846 - protein, 6 aa, Plasmodium falciparum
MYNDRD

SEQ ID NO: 3328847 - protein, 15 aa, Plasmodium falciparum
MYNSDKEKNLNDKGS

SEQ ID NO: 3328848 - protein, 19 aa, Plasmodium falciparum
MYQNQKQKQVEKITSEENM

SEQ ID NO: 3328849 - protein, 10 aa, Plasmodium falciparum
NAANNNNNNN

SEQ ID NO: 3328850 - protein, 6 aa, Plasmodium falciparum
NAAPEL

SEQ ID NO: 3328851 - protein, 13 aa, Plasmodium falciparum
NAARDNKKSRITP

SEQ ID NO: 3328852 - protein, 15 aa, Plasmodium falciparum
NADEKGSNIHHKDET

SEQ ID NO: 3328853 - protein, 6 aa, Plasmodium falciparum
NADENC

SEQ ID NO: 3328854 - protein, 8 aa, Plasmodium falciparum
NADGAEKP

SEQ ID NO: 3328855 - protein, 4 aa, Plasmodium falciparum
NADH

SEQ ID NO: 3328856 - protein, 9 aa, Plasmodium falciparum
NADHEENNN

SEQ ID NO: 3328857 - protein, 6 aa, Plasmodium falciparum
NADKKY

SEQ ID NO: 3328858 - protein, 15 aa, Plasmodium falciparum
NADKNASELNSSAYT

SEQ ID NO: 3328859 - protein, 10 aa, Plasmodium falciparum
NADKNNQKYD

SEQ ID NO: 3328860 - protein, 7 aa, Plasmodium falciparum
NADKPSE

SEQ ID NO: 3328861 - protein, 8 aa, Plasmodium falciparum
NADMETKD

SEQ ID NO: 3328862 - protein, 8 aa, Plasmodium falciparum
NADNAKKA

SEQ ID NO: 3328863 - protein, 19 aa, Plasmodium falciparum
NADNLNNADNLNNADNYPL

SEQ ID NO: 3328864 - protein, 8 aa, Plasmodium falciparum
NADNRNVS

SEQ ID NO: 3328865 - protein, 4 aa, Plasmodium falciparum
NADQ

SEQ ID NO: 3328866 - protein, 5 aa, Plasmodium falciparum
NADQN

SEQ ID NO: 3328867 - protein, 11 aa, Plasmodium falciparum
NADQNKNYDKF

SEQ ID NO: 3328868 - protein, 16 aa, Plasmodium falciparum
NADQQEEEKEDSNFKN

SEQ ID NO: 3328869 - protein, 19 aa, Plasmodium falciparum
NADTDKNKNKNTKKLSQEL

SEQ ID NO: 3328870 - protein, 6 aa, Plasmodium falciparum
NAEDEK

SEQ ID NO: 3328871 - protein, 5 aa, Plasmodium falciparum
NAEDH

SEQ ID NO: 3328872 - protein, 5 aa, Plasmodium falciparum
NAEDI

SEQ ID NO: 3328873 - protein, 9 aa, Plasmodium falciparum
NAEDRDKLV

SEQ ID NO: 3328874 - protein, 6 aa, Plasmodium falciparum
NAEDRN

SEQ ID NO: 3328875 - protein, 13 aa, Plasmodium falciparum
NAEEEKNDTKKSK

SEQ ID NO: 3328876 - protein, 8 aa, Plasmodium falciparum
NAEENTMK

SEQ ID NO: 3328877 - protein, 10 aa, Plasmodium falciparum
NAEESYNNKE

SEQ ID NO: 3328878 - protein, 10 aa, Plasmodium falciparum
NAEKEGEKGI

SEQ ID NO: 3328879 - protein, 10 aa, Plasmodium falciparum
NAEKEQENNM

SEQ ID NO: 3328880 - protein, 9 aa, Plasmodium falciparum
NAEKEYEKL

SEQ ID NO: 3328881 - protein, 6 aa, Plasmodium falciparum
NAEKYN

SEQ ID NO: 3328882 - protein, 19 aa, Plasmodium falciparum
NAENGGKGLNNNQVGYNGK

SEQ ID NO: 3328883 - protein, 7 aa, Plasmodium falciparum
NAENKIN

SEQ ID NO: 3328884 - protein, 11 aa, Plasmodium falciparum
NAENKKKINNI

SEQ ID NO: 3328885 - protein, 13 aa, Plasmodium falciparum
NAENNTIDESKDY

SEQ ID NO: 3328886 - protein, 96 aa, Plasmodium falciparum
NAEQINDEQINDEQINDEKINDEQINDEKINDEQINDEKINDEQINDEKINDEQINDEKINDEQINDEKINDEQINDEQINDEQINDDNISNKPEL

SEQ ID NO: 3328887 - protein, 4 aa, Plasmodium falciparum
NAES

SEQ ID NO: 3328888 - protein, 20 aa, Plasmodium falciparum
NAETKEKVPRRRGRKKKLEK

SEQ ID NO: 3328889 - protein, 7 aa, Plasmodium falciparum
NAETVNR

SEQ ID NO: 3328890 - protein, 6 aa, Plasmodium falciparum
NAFKSN

SEQ ID NO: 3328891 - protein, 4 aa, Plasmodium falciparum
NAFS

SEQ ID NO: 3328892 - protein, 7 aa, Plasmodium falciparum
NAGEVTQ

SEQ ID NO: 3328893 - protein, 6 aa, Plasmodium falciparum
NAGGPG

SEQ ID NO: 3328894 - protein, 11 aa, Plasmodium falciparum
NAGKGKGKGKE

SEQ ID NO: 3328895 - protein, 5 aa, Plasmodium falciparum
NAGKT

SEQ ID NO: 3328896 - protein, 9 aa, Plasmodium falciparum
NAGPNTNSS

SEQ ID NO: 3328897 - protein, 7 aa, Plasmodium falciparum
NAGQQKN

SEQ ID NO: 3328898 - protein, 5 aa, Plasmodium falciparum
NAGSE

SEQ ID NO: 3328899 - protein, 4 aa, Plasmodium falciparum
NAGY

SEQ ID NO: 3328900 - protein, 7 aa, Plasmodium falciparum
NAGYDST

SEQ ID NO: 3328901 - protein, 7 aa, Plasmodium falciparum
NAGYNTT

SEQ ID NO: 3328902 - protein, 4 aa, Plasmodium falciparum
NAHK

SEQ ID NO: 3328903 - protein, 15 aa, Plasmodium falciparum
NAHQNKGEKSQNYNI

SEQ ID NO: 3328904 - protein, 17 aa, Plasmodium falciparum
NAIKKNDSNKKESNKNN

SEQ ID NO: 3328905 - protein, 16 aa, Plasmodium falciparum
NAINSEKGNDIKNGNN

SEQ ID NO: 3328906 - protein, 11 aa, Plasmodium falciparum
NAISSGNEYRE

SEQ ID NO: 3328907 - protein, 17 aa, Plasmodium falciparum
NAKAQKSEEVKKSVESV

SEQ ID NO: 3328908 - protein, 6 aa, Plasmodium falciparum
NAKAVG

SEQ ID NO: 3328909 - protein, 4 aa, Plasmodium falciparum
NAKD

SEQ ID NO: 3328910 - protein, 7 aa, Plasmodium falciparum
NAKDNNR

SEQ ID NO: 3328911 - protein, 6 aa, Plasmodium falciparum
NAKEKI

SEQ ID NO: 3328912 - protein, 10 aa, Plasmodium falciparum
NAKEQNKGKS

SEQ ID NO: 3328913 - protein, 10 aa, Plasmodium falciparum
NAKESESSHN

SEQ ID NO: 3328914 - protein, 36 aa, Plasmodium falciparum
NAKGTNKTNKTNETNGIDNNNDDNNDNNNDDNNDNI

SEQ ID NO: 3328915 - protein, 8 aa, Plasmodium falciparum
NAKKEKSL

SEQ ID NO: 3328916 - protein, 6 aa, Plasmodium falciparum
NAKKKN

SEQ ID NO: 3328917 - protein, 6 aa, Plasmodium falciparum
NAKNKE

SEQ ID NO: 3328918 - protein, 20 aa, Plasmodium falciparum
NAKNNNHNNNNNDKFKGNPF

SEQ ID NO: 3328919 - protein, 10 aa, Plasmodium falciparum
NAKNQTTNFT

SEQ ID NO: 3328920 - protein, 7 aa, Plasmodium falciparum
NAKPKDI

SEQ ID NO: 3328921 - protein, 5 aa, Plasmodium falciparum
NAKRT

SEQ ID NO: 3328922 - protein, 21 aa, Plasmodium falciparum
NAKSRKVEKDEKYKNISSSNY

SEQ ID NO: 3328923 - protein, 7 aa, Plasmodium falciparum
NAKSSNE

SEQ ID NO: 3328924 - protein, 12 aa, Plasmodium falciparum
NAKSVNSLNGDN

SEQ ID NO: 3328925 - protein, 4 aa, Plasmodium falciparum
NAKT

SEQ ID NO: 3328926 - protein, 6 aa, Plasmodium falciparum
NAKTHD

SEQ ID NO: 3328927 - protein, 25 aa, Plasmodium falciparum
NAKTKTPASSTNYNLNSNNENDNTS

SEQ ID NO: 3328928 - protein, 6 aa, Plasmodium falciparum
NAKTSL

SEQ ID NO: 3328929 - protein, 41 aa, Plasmodium falciparum
NAKYNPKNNFNDNYTKNNDNYKTSLNTKTPSQRKGTFDEKY

SEQ ID NO: 3328930 - protein, 14 aa, Plasmodium falciparum
NALENNDEQAQEIR

SEQ ID NO: 3328931 - protein, 4 aa, Plasmodium falciparum
NALN

SEQ ID NO: 3328932 - protein, 10 aa, Plasmodium falciparum
NALSSDNETP

SEQ ID NO: 3328933 - protein, 35 aa, Plasmodium falciparum
NANDIKSDIKNDNQNDSQKDSQKDSQKDCQNDSQN

SEQ ID NO: 3328934 - protein, 7 aa, Plasmodium falciparum
NANENEA

SEQ ID NO: 3328935 - protein, 38 aa, Plasmodium falciparum
NANENENEEEQQKYEGGGHYYDDEDSYSENLEHSSSSL

SEQ ID NO: 3328936 - protein, 14 aa, Plasmodium falciparum
NANEQVDEQEEDEE

SEQ ID NO: 3328937 - protein, 7 aa, Plasmodium falciparum
NANETIT

SEQ ID NO: 3328938 - protein, 5 aa, Plasmodium falciparum
NANKN

SEQ ID NO: 3328939 - protein, 52 aa, Plasmodium falciparum
NANKSYSTNNNPSPNDNLNKGNVKNKKKSKKNKNNNNDSNNNNDNNNNNIMN

SEQ ID NO: 3328940 - protein, 9 aa, Plasmodium falciparum
NANNDPTSN

SEQ ID NO: 3328941 - protein, 13 aa, Plasmodium falciparum
NANNENERTKNLP

SEQ ID NO: 3328942 - protein, 8 aa, Plasmodium falciparum
NANNENNF

SEQ ID NO: 3328943 - protein, 7 aa, Plasmodium falciparum
NANNESL

SEQ ID NO: 3328944 - protein, 5 aa, Plasmodium falciparum
NANNI

SEQ ID NO: 3328945 - protein, 35 aa, Plasmodium falciparum
NANNKENTNSPYNNTSHDRVNNNNNNNKYNNNYNK

SEQ ID NO: 3328946 - protein, 7 aa, Plasmodium falciparum
NANNNMK

SEQ ID NO: 3328947 - protein, 22 aa, Plasmodium falciparum
NANNNNNNDNSNLNNNNNNVRY

SEQ ID NO: 3328948 - protein, 7 aa, Plasmodium falciparum
NANNNNT

SEQ ID NO: 3328949 - protein, 11 aa, Plasmodium falciparum
NANNNYPKTPD

SEQ ID NO: 3328950 - protein, 6 aa, Plasmodium falciparum
NANPRH

SEQ ID NO: 3328951 - protein, 8 aa, Plasmodium falciparum
NANPTVGE

SEQ ID NO: 3328952 - protein, 7 aa, Plasmodium falciparum
NANQGYR

SEQ ID NO: 3328953 - protein, 15 aa, Plasmodium falciparum
NANTNTNANTNANTN

SEQ ID NO: 3328954 - protein, 10 aa, Plasmodium falciparum
NANTSNPTSL

SEQ ID NO: 3328955 - protein, 5 aa, Plasmodium falciparum
NAPCE

SEQ ID NO: 3328956 - protein, 5 aa, Plasmodium falciparum
NAPFS

SEQ ID NO: 3328957 - protein, 6 aa, Plasmodium falciparum
NAPKGA

SEQ ID NO: 3328958 - protein, 4 aa, Plasmodium falciparum
NAPL

SEQ ID NO: 3328959 - protein, 7 aa, Plasmodium falciparum
NAPSPGY

SEQ ID NO: 3328960 - protein, 6 aa, Plasmodium falciparum
NAPTNV

SEQ ID NO: 3328961 - protein, 134 aa, Plasmodium falciparum
NAQDSVTTQEPITAQETVTDQEPITTEEPLTTQETVTTQEPIATQETVTEQESITTQEPVTAQEPVTTQELTETQEPTATQESIATQESTLTQESTLTQESTLTQEPTTTQELTTTQEHDDEKKASEGDNHSLS

SEQ ID NO: 3328962 - protein, 101 aa, Plasmodium falciparum
NAQDSVTTQEPITAQETVTEQEPITTEEPLTTQETVTTQETVTTQEPITTQETVTAQEPVTAQEPVTTQELTETQEPTATQESIATQEHADEKKASEGDNI

SEQ ID NO: 3328963 - protein, 8 aa, Plasmodium falciparum
NAQGFNND

SEQ ID NO: 3328964 - protein, 7 aa, Plasmodium falciparum
NAQHSTQ

SEQ ID NO: 3328965 - protein, 36 aa, Plasmodium falciparum
NAQKEKEKEKENKISNIKEKQTPKDNNANKNDNINK

SEQ ID NO: 3328966 - protein, 6 aa, Plasmodium falciparum
NAQKKT

SEQ ID NO: 3328967 - protein, 8 aa, Plasmodium falciparum
NAQNKTTL

SEQ ID NO: 3328968 - protein, 10 aa, Plasmodium falciparum
NAQNTQPITN

SEQ ID NO: 3328969 - protein, 5 aa, Plasmodium falciparum
NAQNV

SEQ ID NO: 3328970 - protein, 19 aa, Plasmodium falciparum
NAQQEREYNKSQSPFDDDE

SEQ ID NO: 3328971 - protein, 14 aa, Plasmodium falciparum
NAQSNNMYDSYGKE

SEQ ID NO: 3328972 - protein, 6 aa, Plasmodium falciparum
NARAKE

SEQ ID NO: 3328973 - protein, 4 aa, Plasmodium falciparum
NARE

SEQ ID NO: 3328974 - protein, 5 aa, Plasmodium falciparum
NARGS

SEQ ID NO: 3328975 - protein, 7 aa, Plasmodium falciparum
NARKENI

SEQ ID NO: 3328976 - protein, 12 aa, Plasmodium falciparum
NARKNNKDKPSL

SEQ ID NO: 3328977 - protein, 9 aa, Plasmodium falciparum
NARNNNNDH

SEQ ID NO: 3328978 - protein, 14 aa, Plasmodium falciparum
NARQNYNKTNEKIK

SEQ ID NO: 3328979 - protein, 4 aa, Plasmodium falciparum
NASA

SEQ ID NO: 3328980 - protein, 5 aa, Plasmodium falciparum
NASDA

SEQ ID NO: 3328981 - protein, 7 aa, Plasmodium falciparum
NASDDQN

SEQ ID NO: 3328982 - protein, 11 aa, Plasmodium falciparum
NASDEVNNKPM

SEQ ID NO: 3328983 - protein, 20 aa, Plasmodium falciparum
NASEKVKNSAAYVGPSNNEH

SEQ ID NO: 3328984 - protein, 22 aa, Plasmodium falciparum
NASKGKKTKNKKTSQNKKNDIC

SEQ ID NO: 3328985 - protein, 5 aa, Plasmodium falciparum
NASKI

SEQ ID NO: 3328986 - protein, 6 aa, Plasmodium falciparum
NASKYY

SEQ ID NO: 3328987 - protein, 6 aa, Plasmodium falciparum
NASNYE

SEQ ID NO: 3328988 - protein, 7 aa, Plasmodium falciparum
NASQEEE

SEQ ID NO: 3328989 - protein, 9 aa, Plasmodium falciparum
NASSEISNK

SEQ ID NO: 3328990 - protein, 9 aa, Plasmodium falciparum
NASSGGSEL

SEQ ID NO: 3328991 - protein, 10 aa, Plasmodium falciparum
NASSSSSENG

SEQ ID NO: 3328992 - protein, 15 aa, Plasmodium falciparum
NASTNDNNTSSDYTT

SEQ ID NO: 3328993 - protein, 6 aa, Plasmodium falciparum
NASYNA

SEQ ID NO: 3328994 - protein, 13 aa, Plasmodium falciparum
NASYSHTSSYNKH

SEQ ID NO: 3328995 - protein, 9 aa, Plasmodium falciparum
NATDSAKAH

SEQ ID NO: 3328996 - protein, 8 aa, Plasmodium falciparum
NATDYEKP

SEQ ID NO: 3328997 - protein, 6 aa, Plasmodium falciparum
NATEIT

SEQ ID NO: 3328998 - protein, 4 aa, Plasmodium falciparum
NATK

SEQ ID NO: 3328999 - protein, 7 aa, Plasmodium falciparum
NATNEQK

SEQ ID NO: 3329000 - protein, 8 aa, Plasmodium falciparum
NATNNSHV

SEQ ID NO: 3329001 - protein, 16 aa, Plasmodium falciparum
NATNREDNKNKERNLS

SEQ ID NO: 3329002 - protein, 4 aa, Plasmodium falciparum
NATS

SEQ ID NO: 3329003 - protein, 15 aa, Plasmodium falciparum
NATSASSVSANNNIS

SEQ ID NO: 3329004 - protein, 12 aa, Plasmodium falciparum
NATSDDDNELET

SEQ ID NO: 3329005 - protein, 26 aa, Plasmodium falciparum
NATTQKDTNTLHNTAKQRKKQLQNRL

SEQ ID NO: 3329006 - protein, 11 aa, Plasmodium falciparum
NAVPGDSIGEE

SEQ ID NO: 3329007 - protein, 25 aa, Plasmodium falciparum
NAVPKEVDNNCENDKNVHNKESCRN

SEQ ID NO: 3329008 - protein, 7 aa, Plasmodium falciparum
NAVRNNP

SEQ ID NO: 3329009 - protein, 10 aa, Plasmodium falciparum
NAVSKPNDAD

SEQ ID NO: 3329010 - protein, 12 aa, Plasmodium falciparum
NAVTKSKENMEN

SEQ ID NO: 3329011 - protein, 6 aa, Plasmodium falciparum
NAYEYE

SEQ ID NO: 3329012 - protein, 28 aa, Plasmodium falciparum
NAYGNRMSNPNNYLNSNGNNNNNNNGYG

SEQ ID NO: 3329013 - protein, 4 aa, Plasmodium falciparum
NAYH

SEQ ID NO: 3329014 - protein, 4 aa, Plasmodium falciparum
NAYK

SEQ ID NO: 3329015 - protein, 6 aa, Plasmodium falciparum
NAYNQN

SEQ ID NO: 3329016 - protein, 6 aa, Plasmodium falciparum
NAYPPH

SEQ ID NO: 3329017 - protein, 5 aa, Plasmodium falciparum
NAYRT

SEQ ID NO: 3329018 - protein, 8 aa, Plasmodium falciparum
NAYTKKSS

SEQ ID NO: 3329019 - protein, 4 aa, Plasmodium falciparum
NCAP

SEQ ID NO: 3329020 - protein, 21 aa, Plasmodium falciparum
NCDDQTEQKEVHEQNSQNEEK

SEQ ID NO: 3329021 - protein, 13 aa, Plasmodium falciparum
NCDEKKKKTNFQN

SEQ ID NO: 3329022 - protein, 5 aa, Plasmodium falciparum
NCDIS

SEQ ID NO: 3329023 - protein, 4 aa, Plasmodium falciparum
NCDN

SEQ ID NO: 3329024 - protein, 5 aa, Plasmodium falciparum
NCDNK

SEQ ID NO: 3329025 - protein, 12 aa, Plasmodium falciparum
NCDNNKNKLNKN

SEQ ID NO: 3329026 - protein, 7 aa, Plasmodium falciparum
NCEDNKA

SEQ ID NO: 3329027 - protein, 12 aa, Plasmodium falciparum
NCEYTDVDETSN

SEQ ID NO: 3329028 - protein, 5 aa, Plasmodium falciparum
NCGKS

SEQ ID NO: 3329029 - protein, 26 aa, Plasmodium falciparum
NCHNNNNNNNNNNNNKNNNNNNKSCG

SEQ ID NO: 3329030 - protein, 5 aa, Plasmodium falciparum
NCHSN

SEQ ID NO: 3329031 - protein, 6 aa, Plasmodium falciparum
NCHTNN

SEQ ID NO: 3329032 - protein, 10 aa, Plasmodium falciparum
NCKDNNNLNY

SEQ ID NO: 3329033 - protein, 12 aa, Plasmodium falciparum
NCKEENNYQNSL

SEQ ID NO: 3329034 - protein, 22 aa, Plasmodium falciparum
NCKKDDKKKQCSFNGNNKKEKL

SEQ ID NO: 3329035 - protein, 8 aa, Plasmodium falciparum
NCKNDEDY

SEQ ID NO: 3329036 - protein, 5 aa, Plasmodium falciparum
NCKNG

SEQ ID NO: 3329037 - protein, 7 aa, Plasmodium falciparum
NCKNSYD

SEQ ID NO: 3329038 - protein, 14 aa, Plasmodium falciparum
NCKSDNDNNMNNTN

SEQ ID NO: 3329039 - protein, 37 aa, Plasmodium falciparum
NCKSDVSNIEENDKKNVKKSDTQNEDSEKKSTGTSNG

SEQ ID NO: 3329040 - protein, 6 aa, Plasmodium falciparum
NCNGIN

SEQ ID NO: 3329041 - protein, 13 aa, Plasmodium falciparum
NCNGSGKKPGTNL

SEQ ID NO: 3329042 - protein, 18 aa, Plasmodium falciparum
NCNKNKNEKNDNEGENIE

SEQ ID NO: 3329043 - protein, 5 aa, Plasmodium falciparum
NCNNN

SEQ ID NO: 3329044 - protein, 8 aa, Plasmodium falciparum
NCNNNNKM

SEQ ID NO: 3329045 - protein, 24 aa, Plasmodium falciparum
NCNQQTNEQLNNNTDIPPYKNNER

SEQ ID NO: 3329046 - protein, 6 aa, Plasmodium falciparum
NCNSGN

SEQ ID NO: 3329047 - protein, 17 aa, Plasmodium falciparum
NCNTSPSNTRKKNKINK

SEQ ID NO: 3329048 - protein, 14 aa, Plasmodium falciparum
NCPDTKENNTNEDN

SEQ ID NO: 3329049 - protein, 10 aa, Plasmodium falciparum
NCPEEREGHT

SEQ ID NO: 3329050 - protein, 20 aa, Plasmodium falciparum
NCPNTKTNTCNNNDHHNDDS

SEQ ID NO: 3329051 - protein, 5 aa, Plasmodium falciparum
NCPRP

SEQ ID NO: 3329052 - protein, 6 aa, Plasmodium falciparum
NCPSDN

SEQ ID NO: 3329053 - protein, 12 aa, Plasmodium falciparum
NCSDSRKKEYSH

SEQ ID NO: 3329054 - protein, 4 aa, Plasmodium falciparum
NCSE

SEQ ID NO: 3329055 - protein, 5 aa, Plasmodium falciparum
NCSEE

SEQ ID NO: 3329056 - protein, 10 aa, Plasmodium falciparum
NCSEKDTSLI

SEQ ID NO: 3329057 - protein, 10 aa, Plasmodium falciparum
NCSESDNMKH

SEQ ID NO: 3329058 - protein, 5 aa, Plasmodium falciparum
NCSGA

SEQ ID NO: 3329059 - protein, 6 aa, Plasmodium falciparum
NCSGEH

SEQ ID NO: 3329060 - protein, 31 aa, Plasmodium falciparum
NCSGNNKNFNKDADKNYMNGSGENKSFNKDV

SEQ ID NO: 3329061 - protein, 6 aa, Plasmodium falciparum
NCSQDN

SEQ ID NO: 3329062 - protein, 8 aa, Plasmodium falciparum
NCSQEERD

SEQ ID NO: 3329063 - protein, 8 aa, Plasmodium falciparum
NCSQKTEA

SEQ ID NO: 3329064 - protein, 5 aa, Plasmodium falciparum
NCSSR

SEQ ID NO: 3329065 - protein, 5 aa, Plasmodium falciparum
NCSYT

SEQ ID NO: 3329066 - protein, 8 aa, Plasmodium falciparum
NCTENNKH

SEQ ID NO: 3329067 - protein, 11 aa, Plasmodium falciparum
NCTGDSQNGIK

SEQ ID NO: 3329068 - protein, 24 aa, Plasmodium falciparum
NCTKEEKKKKNEAKEEEETEKNIN

SEQ ID NO: 3329069 - protein, 5 aa, Plasmodium falciparum
NCTQR

SEQ ID NO: 3329070 - protein, 14 aa, Plasmodium falciparum
NCTRKCKNNRAEEQ

SEQ ID NO: 3329071 - protein, 4 aa, Plasmodium falciparum
NCTS

SEQ ID NO: 3329072 - protein, 14 aa, Plasmodium falciparum
NCTSYKDQRYSSQQ

SEQ ID NO: 3329073 - protein, 7 aa, Plasmodium falciparum
NCTTDEV

SEQ ID NO: 3329074 - protein, 35 aa, Plasmodium falciparum
NCTTPTTSCSASNNNKRDSMENERSSSKNQGNYKS

SEQ ID NO: 3329075 - protein, 18 aa, Plasmodium falciparum
NCVGSTTNGPNKKNNKIY

SEQ ID NO: 3329076 - protein, 8 aa, Plasmodium falciparum
NCYSSASK

SEQ ID NO: 3329077 - protein, 20 aa, Plasmodium falciparum
NDACSNNDTCSNNDTLSNTE

SEQ ID NO: 3329078 - protein, 23 aa, Plasmodium falciparum
NDADGKNNTNNDKREENEEQTSH

SEQ ID NO: 3329079 - protein, 6 aa, Plasmodium falciparum
NDAEKE

SEQ ID NO: 3329080 - protein, 105 aa, Plasmodium falciparum
NDAEKIDNEKINDEKNDAEQINDEKNDDEKNDDEKNDDEKNDAEQINDEKNDDEKNDDEKNDDEKNDDEKINDEKNDDEKNDDEKNDDEKNDDEKIDAEQINDEQ

SEQ ID NO: 3329081 - protein, 8 aa, Plasmodium falciparum
NDAESEDN

SEQ ID NO: 3329082 - protein, 13 aa, Plasmodium falciparum
NDAIKKKENINKI

SEQ ID NO: 3329083 - protein, 6 aa, Plasmodium falciparum
NDAKDK

SEQ ID NO: 3329084 - protein, 5 aa, Plasmodium falciparum
NDAKR

SEQ ID NO: 3329085 - protein, 6 aa, Plasmodium falciparum
NDAPDY

SEQ ID NO: 3329086 - protein, 13 aa, Plasmodium falciparum
NDAQRNNYPPNNV

SEQ ID NO: 3329087 - protein, 9 aa, Plasmodium falciparum
NDATQYAKK

SEQ ID NO: 3329088 - protein, 8 aa, Plasmodium falciparum
NDAYKQSA

SEQ ID NO: 3329089 - protein, 7 aa, Plasmodium falciparum
NDCDDNK

SEQ ID NO: 3329090 - protein, 4 aa, Plasmodium falciparum
NDCK

SEQ ID NO: 3329091 - protein, 5 aa, Plasmodium falciparum
NDCNN

SEQ ID NO: 3329092 - protein, 4 aa, Plasmodium falciparum
NDCQ

SEQ ID NO: 3329093 - protein, 10 aa, Plasmodium falciparum
NDCSEENKEI

SEQ ID NO: 3329094 - protein, 4 aa, Plasmodium falciparum
NDDD

SEQ ID NO: 3329095 - protein, 5 aa, Plasmodium falciparum
NDDDD

SEQ ID NO: 3329096 - protein, 12 aa, Plasmodium falciparum
NDDDDYGDHQNE

SEQ ID NO: 3329097 - protein, 5 aa, Plasmodium falciparum
NDDDE

SEQ ID NO: 3329098 - protein, 8 aa, Plasmodium falciparum
NDDDEKKN

SEQ ID NO: 3329099 - protein, 26 aa, Plasmodium falciparum
NDDDEKKTFHDKKDDMENNTQETKTN

SEQ ID NO: 3329100 - protein, 18 aa, Plasmodium falciparum
NDDDEKNNTEENDKLTKR

SEQ ID NO: 3329101 - protein, 29 aa, Plasmodium falciparum
NDDDEKQNFSKREDTVLEEKNKSNNTYEQ

SEQ ID NO: 3329102 - protein, 17 aa, Plasmodium falciparum
NDDDENKNDENNNNDDD

SEQ ID NO: 3329103 - protein, 9 aa, Plasmodium falciparum
NDDDINEKK

SEQ ID NO: 3329104 - protein, 51 aa, Plasmodium falciparum
NDDDNDDDDNNDDNDDNNDDNDDNNDDDDNNNDGDDDNNNNNDDDNNKNDI

SEQ ID NO: 3329105 - protein, 6 aa, Plasmodium falciparum
NDDDNN

SEQ ID NO: 3329106 - protein, 15 aa, Plasmodium falciparum
NDDDNNNNNNNNNIV

SEQ ID NO: 3329107 - protein, 19 aa, Plasmodium falciparum
NDDDNYEDREGYSKYDKEQ

SEQ ID NO: 3329108 - protein, 7 aa, Plasmodium falciparum
NDDDNYN

SEQ ID NO: 3329109 - protein, 10 aa, Plasmodium falciparum
NDDDNYYKGE

SEQ ID NO: 3329110 - protein, 5 aa, Plasmodium falciparum
NDDDQ

SEQ ID NO: 3329111 - protein, 14 aa, Plasmodium falciparum
NDDDQEEEQEYSSN

SEQ ID NO: 3329112 - protein, 6 aa, Plasmodium falciparum
NDDDSD

SEQ ID NO: 3329113 - protein, 17 aa, Plasmodium falciparum
NDDDSGSAKIFLCFVYL

SEQ ID NO: 3329114 - protein, 5 aa, Plasmodium falciparum
NDDDV

SEQ ID NO: 3329115 - protein, 4 aa, Plasmodium falciparum
NDDE

SEQ ID NO: 3329116 - protein, 5 aa, Plasmodium falciparum
NDDEA

SEQ ID NO: 3329117 - protein, 8 aa, Plasmodium falciparum
NDDEDDRD

SEQ ID NO: 3329118 - protein, 9 aa, Plasmodium falciparum
NDDEDEDEG

SEQ ID NO: 3329119 - protein, 13 aa, Plasmodium falciparum
NDDEEKEKMDSNY

SEQ ID NO: 3329120 - protein, 32 aa, Plasmodium falciparum
NDDEHYDIDDNDDNGDNGDNSHNDDNDDEHYD

SEQ ID NO: 3329121 - protein, 5 aa, Plasmodium falciparum
NDDEI

SEQ ID NO: 3329122 - protein, 8 aa, Plasmodium falciparum
NDDEKNKI

SEQ ID NO: 3329123 - protein, 7 aa, Plasmodium falciparum
NDDENLT

SEQ ID NO: 3329124 - protein, 8 aa, Plasmodium falciparum
NDDEVRDR

SEQ ID NO: 3329125 - protein, 14 aa, Plasmodium falciparum
NDDEYDDNHNDQVK

SEQ ID NO: 3329126 - protein, 6 aa, Plasmodium falciparum
NDDFTS

SEQ ID NO: 3329127 - protein, 6 aa, Plasmodium falciparum
NDDGTY

SEQ ID NO: 3329128 - protein, 18 aa, Plasmodium falciparum
NDDGYNNYGSDQKIRSEK

SEQ ID NO: 3329129 - protein, 12 aa, Plasmodium falciparum
NDDHKHTQSNNI

SEQ ID NO: 3329130 - protein, 9 aa, Plasmodium falciparum
NDDHRNQEE

SEQ ID NO: 3329131 - protein, 5 aa, Plasmodium falciparum
NDDIH

SEQ ID NO: 3329132 - protein, 6 aa, Plasmodium falciparum
NDDINN

SEQ ID NO: 3329133 - protein, 5 aa, Plasmodium falciparum
NDDIS

SEQ ID NO: 3329134 - protein, 7 aa, Plasmodium falciparum
NDDISST

SEQ ID NO: 3329135 - protein, 5 aa, Plasmodium falciparum
NDDIT

SEQ ID NO: 3329136 - protein, 9 aa, Plasmodium falciparum
NDDITTIQG

SEQ ID NO: 3329137 - protein, 7 aa, Plasmodium falciparum
NDDIYSN

SEQ ID NO: 3329138 - protein, 4 aa, Plasmodium falciparum
NDDK

SEQ ID NO: 3329139 - protein, 6 aa, Plasmodium falciparum
NDDKEK

SEQ ID NO: 3329140 - protein, 9 aa, Plasmodium falciparum
NDDKEKDKL

SEQ ID NO: 3329141 - protein, 9 aa, Plasmodium falciparum
NDDKENEPY

SEQ ID NO: 3329142 - protein, 9 aa, Plasmodium falciparum
NDDKISKSQ

SEQ ID NO: 3329143 - protein, 23 aa, Plasmodium falciparum
NDDKKKKKSDSKRKDRNSKKKIN

SEQ ID NO: 3329144 - protein, 9 aa, Plasmodium falciparum
NDDKKKKPI

SEQ ID NO: 3329145 - protein, 53 aa, Plasmodium falciparum
NDDKLKKKKKKKKKEKKQKVQDGSADEKKDKDDSLNKQKEQNDDDKKNAHEVD

SEQ ID NO: 3329146 - protein, 29 aa, Plasmodium falciparum
NDDKNITSSTDSKNSSSSNFNKNITSSNF

SEQ ID NO: 3329147 - protein, 9 aa, Plasmodium falciparum
NDDKNNNEI

SEQ ID NO: 3329148 - protein, 6 aa, Plasmodium falciparum
NDDKRD

SEQ ID NO: 3329149 - protein, 6 aa, Plasmodium falciparum
NDDKYN

SEQ ID NO: 3329150 - protein, 8 aa, Plasmodium falciparum
NDDKYNEM

SEQ ID NO: 3329151 - protein, 7 aa, Plasmodium falciparum
NDDLNET

SEQ ID NO: 3329152 - protein, 5 aa, Plasmodium falciparum
NDDLR

SEQ ID NO: 3329153 - protein, 62 aa, Plasmodium falciparum
NDDMGNYNNDDNNNDDDDNNNNDDDKNNNGEDENNNGEDKHNIDEDKHNNGEDKDLNKSRYN

SEQ ID NO: 3329154 - protein, 5 aa, Plasmodium falciparum
NDDMK

SEQ ID NO: 3329155 - protein, 4 aa, Plasmodium falciparum
NDDN

SEQ ID NO: 3329156 - protein, 17 aa, Plasmodium falciparum
NDDNDDNDNDDDNDDVD

SEQ ID NO: 3329157 - protein, 14 aa, Plasmodium falciparum
NDDNDKNNKNGYDK

SEQ ID NO: 3329158 - protein, 10 aa, Plasmodium falciparum
NDDNDNNNMN

SEQ ID NO: 3329159 - protein, 10 aa, Plasmodium falciparum
NDDNEIDNND

SEQ ID NO: 3329160 - protein, 9 aa, Plasmodium falciparum
NDDNGSDNM

SEQ ID NO: 3329161 - protein, 12 aa, Plasmodium falciparum
NDDNIDDTGHKK

SEQ ID NO: 3329162 - protein, 26 aa, Plasmodium falciparum
NDDNINNKDKNKNNNNNNNNNDNNNL

SEQ ID NO: 3329163 - protein, 10 aa, Plasmodium falciparum
NDDNKQETES

SEQ ID NO: 3329164 - protein, 42 aa, Plasmodium falciparum
NDDNNDDNNDEDNNNNNNNNDEDNNNNNNNNNDEDNNNNNNL

SEQ ID NO: 3329165 - protein, 9 aa, Plasmodium falciparum
NDDNNEKSY

SEQ ID NO: 3329166 - protein, 17 aa, Plasmodium falciparum
NDDNNNLQTNNRNNNIT

SEQ ID NO: 3329167 - protein, 15 aa, Plasmodium falciparum
NDDNNNNDNSNNNNI

SEQ ID NO: 3329168 - protein, 33 aa, Plasmodium falciparum
NDDNNNNNNNNKWKENQNNITNHPNSVNSSSTK

SEQ ID NO: 3329169 - protein, 6 aa, Plasmodium falciparum
NDDNQE

SEQ ID NO: 3329170 - protein, 6 aa, Plasmodium falciparum
NDDNQT

SEQ ID NO: 3329171 - protein, 7 aa, Plasmodium falciparum
NDDNRNS

SEQ ID NO: 3329172 - protein, 6 aa, Plasmodium falciparum
NDDNTK

SEQ ID NO: 3329173 - protein, 5 aa, Plasmodium falciparum
NDDNY

SEQ ID NO: 3329174 - protein, 6 aa, Plasmodium falciparum
NDDNYN

SEQ ID NO: 3329175 - protein, 10 aa, Plasmodium falciparum
NDDPNTNNNI

SEQ ID NO: 3329176 - protein, 6 aa, Plasmodium falciparum
NDDPNV

SEQ ID NO: 3329177 - protein, 5 aa, Plasmodium falciparum
NDDQI

SEQ ID NO: 3329178 - protein, 7 aa, Plasmodium falciparum
NDDQKEA

SEQ ID NO: 3329179 - protein, 42 aa, Plasmodium falciparum
NDDQKMSDDTKINDDQKKCDDTKKDDDESESEKSTDEEDTED

SEQ ID NO: 3329180 - protein, 5 aa, Plasmodium falciparum
NDDRK

SEQ ID NO: 3329181 - protein, 6 aa, Plasmodium falciparum
NDDRYK

SEQ ID NO: 3329182 - protein, 4 aa, Plasmodium falciparum
NDDS

SEQ ID NO: 3329183 - protein, 7 aa, Plasmodium falciparum
NDDSGLN

SEQ ID NO: 3329184 - protein, 5 aa, Plasmodium falciparum
NDDSL

SEQ ID NO: 3329185 - protein, 8 aa, Plasmodium falciparum
NDDSLNYS

SEQ ID NO: 3329186 - protein, 25 aa, Plasmodium falciparum
NDDSSIKKKNNSSECLDEQKKKTYK

SEQ ID NO: 3329187 - protein, 17 aa, Plasmodium falciparum
NDDSSNDITKQSNLSSI

SEQ ID NO: 3329188 - protein, 8 aa, Plasmodium falciparum
NDDSSYDS

SEQ ID NO: 3329189 - protein, 6 aa, Plasmodium falciparum
NDDTAE

SEQ ID NO: 3329190 - protein, 8 aa, Plasmodium falciparum
NDDTHNND

SEQ ID NO: 3329191 - protein, 8 aa, Plasmodium falciparum
NDDTSSVI

SEQ ID NO: 3329192 - protein, 6 aa, Plasmodium falciparum
NDDTTI

SEQ ID NO: 3329193 - protein, 19 aa, Plasmodium falciparum
NDDVHSKDEKKKKKKKKES

SEQ ID NO: 3329194 - protein, 5 aa, Plasmodium falciparum
NDDVN

SEQ ID NO: 3329195 - protein, 4 aa, Plasmodium falciparum
NDDY

SEQ ID NO: 3329196 - protein, 14 aa, Plasmodium falciparum
NDDYASSNFDDETS

SEQ ID NO: 3329197 - protein, 10 aa, Plasmodium falciparum
NDEAKTMDPK

SEQ ID NO: 3329198 - protein, 5 aa, Plasmodium falciparum
NDEDC

SEQ ID NO: 3329199 - protein, 26 aa, Plasmodium falciparum
NDEDDDGEDDDGDDNNDYDDDNDEYG

SEQ ID NO: 3329200 - protein, 9 aa, Plasmodium falciparum
NDEDDENEK

SEQ ID NO: 3329201 - protein, 8 aa, Plasmodium falciparum
NDEDEYKE

SEQ ID NO: 3329202 - protein, 38 aa, Plasmodium falciparum
NDEDIKDNNNADINSRNKHKNKKNNNDNFNKDDDGQLQ

SEQ ID NO: 3329203 - protein, 9 aa, Plasmodium falciparum
NDEDKKEEM

SEQ ID NO: 3329204 - protein, 8 aa, Plasmodium falciparum
NDEDKYKY

SEQ ID NO: 3329205 - protein, 7 aa, Plasmodium falciparum
NDEDNKN

SEQ ID NO: 3329206 - protein, 8 aa, Plasmodium falciparum
NDEDRQNK

SEQ ID NO: 3329207 - protein, 6 aa, Plasmodium falciparum
NDEEEK

SEQ ID NO: 3329208 - protein, 6 aa, Plasmodium falciparum
NDEEGI

SEQ ID NO: 3329209 - protein, 7 aa, Plasmodium falciparum
NDEEGSK

SEQ ID NO: 3329210 - protein, 5 aa, Plasmodium falciparum
NDEEK

SEQ ID NO: 3329211 - protein, 11 aa, Plasmodium falciparum
NDEEKGKTNIF

SEQ ID NO: 3329212 - protein, 12 aa, Plasmodium falciparum
NDEEKKSNIPNE

SEQ ID NO: 3329213 - protein, 6 aa, Plasmodium falciparum
NDEEKL

SEQ ID NO: 3329214 - protein, 6 aa, Plasmodium falciparum
NDEEKN

SEQ ID NO: 3329215 - protein, 7 aa, Plasmodium falciparum
NDEEKYI

SEQ ID NO: 3329216 - protein, 8 aa, Plasmodium falciparum
NDEENKKE

SEQ ID NO: 3329217 - protein, 11 aa, Plasmodium falciparum
NDEENKNSYNV

SEQ ID NO: 3329218 - protein, 6 aa, Plasmodium falciparum
NDEENM

SEQ ID NO: 3329219 - protein, 19 aa, Plasmodium falciparum
NDEENMKSNEYKNKKNRSM

SEQ ID NO: 3329220 - protein, 14 aa, Plasmodium falciparum
NDEENNKPSDKNVD

SEQ ID NO: 3329221 - protein, 13 aa, Plasmodium falciparum
NDEENNKTLERSG

SEQ ID NO: 3329222 - protein, 5 aa, Plasmodium falciparum
NDEET

SEQ ID NO: 3329223 - protein, 6 aa, Plasmodium falciparum
NDEEVR

SEQ ID NO: 3329224 - protein, 6 aa, Plasmodium falciparum
NDEEYA

SEQ ID NO: 3329225 - protein, 6 aa, Plasmodium falciparum
NDEGIK

SEQ ID NO: 3329226 - protein, 7 aa, Plasmodium falciparum
NDEGKKM

SEQ ID NO: 3329227 - protein, 11 aa, Plasmodium falciparum
NDEGNLTRTGR

SEQ ID NO: 3329228 - protein, 7 aa, Plasmodium falciparum
NDEGSYG

SEQ ID NO: 3329229 - protein, 12 aa, Plasmodium falciparum
NDEGVDTNINNK

SEQ ID NO: 3329230 - protein, 22 aa, Plasmodium falciparum
NDEGVNDINEDELGNINFEDTK

SEQ ID NO: 3329231 - protein, 12 aa, Plasmodium falciparum
NDEGYDKRPDNI

SEQ ID NO: 3329232 - protein, 6 aa, Plasmodium falciparum
NDEHDM

SEQ ID NO: 3329233 - protein, 14 aa, Plasmodium falciparum
NDEHEQPEIKFENA

SEQ ID NO: 3329234 - protein, 7 aa, Plasmodium falciparum
NDEHGEK

SEQ ID NO: 3329235 - protein, 5 aa, Plasmodium falciparum
NDEHN

SEQ ID NO: 3329236 - protein, 5 aa, Plasmodium falciparum
NDEII

SEQ ID NO: 3329237 - protein, 5 aa, Plasmodium falciparum
NDEIN

SEQ ID NO: 3329238 - protein, 9 aa, Plasmodium falciparum
NDEINDEDT

SEQ ID NO: 3329239 - protein, 7 aa, Plasmodium falciparum
NDEINND

SEQ ID NO: 3329240 - protein, 5 aa, Plasmodium falciparum
NDEIT

SEQ ID NO: 3329241 - protein, 4 aa, Plasmodium falciparum
NDEK

SEQ ID NO: 3329242 - protein, 7 aa, Plasmodium falciparum
NDEKAFP

SEQ ID NO: 3329243 - protein, 10 aa, Plasmodium falciparum
NDEKDEEDCT

SEQ ID NO: 3329244 - protein, 11 aa, Plasmodium falciparum
NDEKDNMKQEI

SEQ ID NO: 3329245 - protein, 20 aa, Plasmodium falciparum
NDEKEKKERRKTDDEHINNK

SEQ ID NO: 3329246 - protein, 9 aa, Plasmodium falciparum
NDEKEYNNI

SEQ ID NO: 3329247 - protein, 32 aa, Plasmodium falciparum
NDEKGDMEKTTVEKTQNERSEKSNITEERNDK

SEQ ID NO: 3329248 - protein, 12 aa, Plasmodium falciparum
NDEKIKRREINK

SEQ ID NO: 3329249 - protein, 9 aa, Plasmodium falciparum
NDEKKKIKN

SEQ ID NO: 3329250 - protein, 6 aa, Plasmodium falciparum
NDEKKM

SEQ ID NO: 3329251 - protein, 9 aa, Plasmodium falciparum
NDEKNGDCD

SEQ ID NO: 3329252 - protein, 17 aa, Plasmodium falciparum
NDEKNGDVNLNGNTNNE

SEQ ID NO: 3329253 - protein, 10 aa, Plasmodium falciparum
NDEKNNLDKI

SEQ ID NO: 3329254 - protein, 9 aa, Plasmodium falciparum
NDEKPNNEK

SEQ ID NO: 3329255 - protein, 8 aa, Plasmodium falciparum
NDEKRNNF

SEQ ID NO: 3329256 - protein, 8 aa, Plasmodium falciparum
NDEKSEHT

SEQ ID NO: 3329257 - protein, 5 aa, Plasmodium falciparum
NDEKV

SEQ ID NO: 3329258 - protein, 9 aa, Plasmodium falciparum
NDELDYDNE

SEQ ID NO: 3329259 - protein, 7 aa, Plasmodium falciparum
NDELNSS

SEQ ID NO: 3329260 - protein, 8 aa, Plasmodium falciparum
NDELQAND

SEQ ID NO: 3329261 - protein, 8 aa, Plasmodium falciparum
NDELTNKE

SEQ ID NO: 3329262 - protein, 16 aa, Plasmodium falciparum
NDEMNEKLNKEQKINN

SEQ ID NO: 3329263 - protein, 6 aa, Plasmodium falciparum
NDEMRK

SEQ ID NO: 3329264 - protein, 7 aa, Plasmodium falciparum
NDENEIK

SEQ ID NO: 3329265 - protein, 17 aa, Plasmodium falciparum
NDENEMKKYSKSSRRNN

SEQ ID NO: 3329266 - protein, 6 aa, Plasmodium falciparum
NDENFE

SEQ ID NO: 3329267 - protein, 24 aa, Plasmodium falciparum
NDENGDVKKDALNNNEQQNNSDYD

SEQ ID NO: 3329268 - protein, 7 aa, Plasmodium falciparum
NDENGNK

SEQ ID NO: 3329269 - protein, 37 aa, Plasmodium falciparum
NDENGNKLGDNDENGNKLGDNDENGNKLGDNGIPSKI

SEQ ID NO: 3329270 - protein, 6 aa, Plasmodium falciparum
NDENIT

SEQ ID NO: 3329271 - protein, 5 aa, Plasmodium falciparum
NDENK

SEQ ID NO: 3329272 - protein, 8 aa, Plasmodium falciparum
NDENKEKS

SEQ ID NO: 3329273 - protein, 11 aa, Plasmodium falciparum
NDENNNKGNED

SEQ ID NO: 3329274 - protein, 8 aa, Plasmodium falciparum
NDENNNNI

SEQ ID NO: 3329275 - protein, 24 aa, Plasmodium falciparum
NDENNNNNNNNNNANYKNMENPPF

SEQ ID NO: 3329276 - protein, 8 aa, Plasmodium falciparum
NDENRQKG

SEQ ID NO: 3329277 - protein, 12 aa, Plasmodium falciparum
NDENTKNRNKNF

SEQ ID NO: 3329278 - protein, 8 aa, Plasmodium falciparum
NDENTNEG

SEQ ID NO: 3329279 - protein, 10 aa, Plasmodium falciparum
NDENYNTNQP

SEQ ID NO: 3329280 - protein, 7 aa, Plasmodium falciparum
NDEPSNN

SEQ ID NO: 3329281 - protein, 7 aa, Plasmodium falciparum
NDEQAGK

SEQ ID NO: 3329282 - protein, 5 aa, Plasmodium falciparum
NDEQK

SEQ ID NO: 3329283 - protein, 8 aa, Plasmodium falciparum
NDEQKNTK

SEQ ID NO: 3329284 - protein, 8 aa, Plasmodium falciparum
NDEQVNEN

SEQ ID NO: 3329285 - protein, 18 aa, Plasmodium falciparum
NDERGNNKSMSKHEKNNH

SEQ ID NO: 3329286 - protein, 57 aa, Plasmodium falciparum
NDERKKKHNQPDISNNNNNDNNNNNNDNNNNNNNNNNNNNNNNNNNNNNNNSSSSSC

SEQ ID NO: 3329287 - protein, 6 aa, Plasmodium falciparum
NDERKN

SEQ ID NO: 3329288 - protein, 22 aa, Plasmodium falciparum
NDERQKNKIAQKPKEDDNNTNL

SEQ ID NO: 3329289 - protein, 8 aa, Plasmodium falciparum
NDERQNNS

SEQ ID NO: 3329290 - protein, 12 aa, Plasmodium falciparum
NDERRKNSMDRY

SEQ ID NO: 3329291 - protein, 19 aa, Plasmodium falciparum
NDERRKPENSDDDDDDDHH

SEQ ID NO: 3329292 - protein, 11 aa, Plasmodium falciparum
NDESDKESNNF

SEQ ID NO: 3329293 - protein, 6 aa, Plasmodium falciparum
NDESIE

SEQ ID NO: 3329294 - protein, 16 aa, Plasmodium falciparum
NDESKLNQSKNQSNSY

SEQ ID NO: 3329295 - protein, 7 aa, Plasmodium falciparum
NDESNYI

SEQ ID NO: 3329296 - protein, 43 aa, Plasmodium falciparum
NDETIKNEEHNKNIDTNKNDEKNEKQEESITNDDLSNKHQNVI

SEQ ID NO: 3329297 - protein, 8 aa, Plasmodium falciparum
NDETKEEA

SEQ ID NO: 3329298 - protein, 7 aa, Plasmodium falciparum
NDETKPL

SEQ ID NO: 3329299 - protein, 9 aa, Plasmodium falciparum
NDETSKPGE

SEQ ID NO: 3329300 - protein, 4 aa, Plasmodium falciparum
NDEW

SEQ ID NO: 3329301 - protein, 27 aa, Plasmodium falciparum
NDEYCNKENSNNNNNNNNNNNNNLDTQ

SEQ ID NO: 3329302 - protein, 26 aa, Plasmodium falciparum
NDEYDNNNNNNNNDNNNNNDYSDNDK

SEQ ID NO: 3329303 - protein, 7 aa, Plasmodium falciparum
NDEYEKE

SEQ ID NO: 3329304 - protein, 12 aa, Plasmodium falciparum
NDFEKKKKTNFY

SEQ ID NO: 3329305 - protein, 22 aa, Plasmodium falciparum
NDFNESNLDTNNSNNKTHVIIE

SEQ ID NO: 3329306 - protein, 14 aa, Plasmodium falciparum
NDFNSTPSNIEPVN

SEQ ID NO: 3329307 - protein, 19 aa, Plasmodium falciparum
NDFPNNKSCEENNSPKHIT

SEQ ID NO: 3329308 - protein, 6 aa, Plasmodium falciparum
NDFQDS

SEQ ID NO: 3329309 - protein, 9 aa, Plasmodium falciparum
NDFSSYTTQ

SEQ ID NO: 3329310 - protein, 21 aa, Plasmodium falciparum
NDGDEEEEEEHTNNDHNGKRD

SEQ ID NO: 3329311 - protein, 7 aa, Plasmodium falciparum
NDGDMTP

SEQ ID NO: 3329312 - protein, 7 aa, Plasmodium falciparum
NDGEITT

SEQ ID NO: 3329313 - protein, 33 aa, Plasmodium falciparum
NDGESSGDEERYRTKSECSDDLKEEDEEKAEKK

SEQ ID NO: 3329314 - protein, 4 aa, Plasmodium falciparum
NDGI

SEQ ID NO: 3329315 - protein, 4 aa, Plasmodium falciparum
NDGK

SEQ ID NO: 3329316 - protein, 13 aa, Plasmodium falciparum
NDGNEKNKNNHTD

SEQ ID NO: 3329317 - protein, 7 aa, Plasmodium falciparum
NDGNVKS

SEQ ID NO: 3329318 - protein, 5 aa, Plasmodium falciparum
NDGNY

SEQ ID NO: 3329319 - protein, 4 aa, Plasmodium falciparum
NDGS

SEQ ID NO: 3329320 - protein, 8 aa, Plasmodium falciparum
NDGTIDPI

SEQ ID NO: 3329321 - protein, 6 aa, Plasmodium falciparum
NDGTKV

SEQ ID NO: 3329322 - protein, 11 aa, Plasmodium falciparum
NDGTSINKKGE

SEQ ID NO: 3329323 - protein, 6 aa, Plasmodium falciparum
NDGYNN

SEQ ID NO: 3329324 - protein, 7 aa, Plasmodium falciparum
NDHDENL

SEQ ID NO: 3329325 - protein, 4 aa, Plasmodium falciparum
NDHE

SEQ ID NO: 3329326 - protein, 21 aa, Plasmodium falciparum
NDHEEHSDDNLDNADDENAIQ

SEQ ID NO: 3329327 - protein, 15 aa, Plasmodium falciparum
NDHHEDDKIEKQNYD

SEQ ID NO: 3329328 - protein, 13 aa, Plasmodium falciparum
NDHHENDNINNSH

SEQ ID NO: 3329329 - protein, 12 aa, Plasmodium falciparum
NDHHNNKKKIYR

SEQ ID NO: 3329330 - protein, 8 aa, Plasmodium falciparum
NDHHPNGK

SEQ ID NO: 3329331 - protein, 12 aa, Plasmodium falciparum
NDHKKDDDNIRN

SEQ ID NO: 3329332 - protein, 15 aa, Plasmodium falciparum
NDHKNNHNNNNNDNV

SEQ ID NO: 3329333 - protein, 16 aa, Plasmodium falciparum
NDHKPNDPKEKERIKK

SEQ ID NO: 3329334 - protein, 17 aa, Plasmodium falciparum
NDHKTNDKSVQEKKKEH

SEQ ID NO: 3329335 - protein, 4 aa, Plasmodium falciparum
NDHN

SEQ ID NO: 3329336 - protein, 12 aa, Plasmodium falciparum
NDHNDGNIYNNR

SEQ ID NO: 3329337 - protein, 8 aa, Plasmodium falciparum
NDHNDKND

SEQ ID NO: 3329338 - protein, 21 aa, Plasmodium falciparum
NDHNKKTKKRKYSSDPKGTKK

SEQ ID NO: 3329339 - protein, 5 aa, Plasmodium falciparum
NDHNN

SEQ ID NO: 3329340 - protein, 19 aa, Plasmodium falciparum
NDHNNIKKKKKKKKKKKKQ

SEQ ID NO: 3329341 - protein, 14 aa, Plasmodium falciparum
NDHNNNNINNNNNN

SEQ ID NO: 3329342 - protein, 6 aa, Plasmodium falciparum
NDHPHI

SEQ ID NO: 3329343 - protein, 11 aa, Plasmodium falciparum
NDHPKNSNQKI

SEQ ID NO: 3329344 - protein, 9 aa, Plasmodium falciparum
NDHQEYNSY

SEQ ID NO: 3329345 - protein, 6 aa, Plasmodium falciparum
NDHTNI

SEQ ID NO: 3329346 - protein, 30 aa, Plasmodium falciparum
NDHTNKKNYNKKNNITNTYNDHNNKDEFKN

SEQ ID NO: 3329347 - protein, 11 aa, Plasmodium falciparum
NDHTTNSSIPH

SEQ ID NO: 3329348 - protein, 62 aa, Plasmodium falciparum
NDHVETNDHVETNDHVETNDHVETNDHVETNDHIKGNDNVEKNDHVETNDHIKGNDNVEKNY

SEQ ID NO: 3329349 - protein, 8 aa, Plasmodium falciparum
NDIDDDDE

SEQ ID NO: 3329350 - protein, 7 aa, Plasmodium falciparum
NDIDDET

SEQ ID NO: 3329351 - protein, 6 aa, Plasmodium falciparum
NDIDNV

SEQ ID NO: 3329352 - protein, 8 aa, Plasmodium falciparum
NDIEEDKE

SEQ ID NO: 3329353 - protein, 27 aa, Plasmodium falciparum
NDIEEPKDKYKGPTSNSIVGSNNTTEV

SEQ ID NO: 3329354 - protein, 8 aa, Plasmodium falciparum
NDIEGNTE

SEQ ID NO: 3329355 - protein, 5 aa, Plasmodium falciparum
NDIEQ

SEQ ID NO: 3329356 - protein, 5 aa, Plasmodium falciparum
NDIES

SEQ ID NO: 3329357 - protein, 4 aa, Plasmodium falciparum
NDIK

SEQ ID NO: 3329358 - protein, 24 aa, Plasmodium falciparum
NDIKENTSEEENKSITKNINEEET

SEQ ID NO: 3329359 - protein, 13 aa, Plasmodium falciparum
NDILSNDKNQLQK

SEQ ID NO: 3329360 - protein, 7 aa, Plasmodium falciparum
NDINDNI

SEQ ID NO: 3329361 - protein, 11 aa, Plasmodium falciparum
NDINEKKKIGE

SEQ ID NO: 3329362 - protein, 15 aa, Plasmodium falciparum
NDINNNKSNSINNND

SEQ ID NO: 3329363 - protein, 9 aa, Plasmodium falciparum
NDINQTEED

SEQ ID NO: 3329364 - protein, 6 aa, Plasmodium falciparum
NDINTS

SEQ ID NO: 3329365 - protein, 4 aa, Plasmodium falciparum
NDIP

SEQ ID NO: 3329366 - protein, 6 aa, Plasmodium falciparum
NDIPNE

SEQ ID NO: 3329367 - protein, 6 aa, Plasmodium falciparum
NDIPNN

SEQ ID NO: 3329368 - protein, 22 aa, Plasmodium falciparum
NDIPTNTTTTTNNNNNNNNNID

SEQ ID NO: 3329369 - protein, 12 aa, Plasmodium falciparum
NDIQKNNNMDES

SEQ ID NO: 3329370 - protein, 8 aa, Plasmodium falciparum
NDIQNEKE

SEQ ID NO: 3329371 - protein, 14 aa, Plasmodium falciparum
NDIQRNKKKRKFSS

SEQ ID NO: 3329372 - protein, 4 aa, Plasmodium falciparum
NDIS

SEQ ID NO: 3329373 - protein, 9 aa, Plasmodium falciparum
NDISDDTGK

SEQ ID NO: 3329374 - protein, 6 aa, Plasmodium falciparum
NDISDK

SEQ ID NO: 3329375 - protein, 25 aa, Plasmodium falciparum
NDISHSNNNNDDDHDDNNNDNNNNI

SEQ ID NO: 3329376 - protein, 18 aa, Plasmodium falciparum
NDISNYDDCNNNNNNNNL

SEQ ID NO: 3329377 - protein, 6 aa, Plasmodium falciparum
NDISTN

SEQ ID NO: 3329378 - protein, 7 aa, Plasmodium falciparum
NDITEKD

SEQ ID NO: 3329379 - protein, 16 aa, Plasmodium falciparum
NDITNDKINDKINENI

SEQ ID NO: 3329380 - protein, 6 aa, Plasmodium falciparum
NDITPH

SEQ ID NO: 3329381 - protein, 5 aa, Plasmodium falciparum
NDITQ

SEQ ID NO: 3329382 - protein, 13 aa, Plasmodium falciparum
NDIYDNKDKTLRK

SEQ ID NO: 3329383 - protein, 12 aa, Plasmodium falciparum
NDIYEDSKSTTC

SEQ ID NO: 3329384 - protein, 14 aa, Plasmodium falciparum
NDIYNNDDSSVPYS

SEQ ID NO: 3329385 - protein, 8 aa, Plasmodium falciparum
NDIYNTEN

SEQ ID NO: 3329386 - protein, 10 aa, Plasmodium falciparum
NDKCDTNDID

SEQ ID NO: 3329387 - protein, 9 aa, Plasmodium falciparum
NDKDDNTIN

SEQ ID NO: 3329388 - protein, 8 aa, Plasmodium falciparum
NDKDDNVY

SEQ ID NO: 3329389 - protein, 7 aa, Plasmodium falciparum
NDKDEYT

SEQ ID NO: 3329390 - protein, 5 aa, Plasmodium falciparum
NDKDI

SEQ ID NO: 3329391 - protein, 25 aa, Plasmodium falciparum
NDKDIESKVREEDGKKSEKKNNDLI

SEQ ID NO: 3329392 - protein, 10 aa, Plasmodium falciparum
NDKDNKNYSI

SEQ ID NO: 3329393 - protein, 11 aa, Plasmodium falciparum
NDKDNKQNAGD

SEQ ID NO: 3329394 - protein, 5 aa, Plasmodium falciparum
NDKDQ

SEQ ID NO: 3329395 - protein, 6 aa, Plasmodium falciparum
NDKDSI

SEQ ID NO: 3329396 - protein, 8 aa, Plasmodium falciparum
NDKDSYIT

SEQ ID NO: 3329397 - protein, 19 aa, Plasmodium falciparum
NDKDTNNNNDHKNNHNNNN

SEQ ID NO: 3329398 - protein, 18 aa, Plasmodium falciparum
NDKEEEEEEKQKIGQEST

SEQ ID NO: 3329399 - protein, 7 aa, Plasmodium falciparum
NDKEEYK

SEQ ID NO: 3329400 - protein, 5 aa, Plasmodium falciparum
NDKEK

SEQ ID NO: 3329401 - protein, 11 aa, Plasmodium falciparum
NDKEKTEIKKD

SEQ ID NO: 3329402 - protein, 17 aa, Plasmodium falciparum
NDKERSKEKKKINNYDK

SEQ ID NO: 3329403 - protein, 9 aa, Plasmodium falciparum
NDKESNSSG

SEQ ID NO: 3329404 - protein, 6 aa, Plasmodium falciparum
NDKETK

SEQ ID NO: 3329405 - protein, 81 aa, Plasmodium falciparum
NDKETKEKKNEIEIEEEKKNKIEIEEEKKNKIEIEEEKKNKIEIEEEKKKKIEIEEEKKKKIEMEEEKNKIDDEKKNTYAN

SEQ ID NO: 3329406 - protein, 4 aa, Plasmodium falciparum
NDKF

SEQ ID NO: 3329407 - protein, 10 aa, Plasmodium falciparum
NDKGRLSKDD

SEQ ID NO: 3329408 - protein, 22 aa, Plasmodium falciparum
NDKGYINKNDEYVKEEKQYEDI

SEQ ID NO: 3329409 - protein, 6 aa, Plasmodium falciparum
NDKHHS

SEQ ID NO: 3329410 - protein, 8 aa, Plasmodium falciparum
NDKHNNYT

SEQ ID NO: 3329411 - protein, 12 aa, Plasmodium falciparum
NDKHTEKEQNDI

SEQ ID NO: 3329412 - protein, 10 aa, Plasmodium falciparum
NDKIKKKENG

SEQ ID NO: 3329413 - protein, 9 aa, Plasmodium falciparum
NDKINKSQT

SEQ ID NO: 3329414 - protein, 9 aa, Plasmodium falciparum
NDKISKADT

SEQ ID NO: 3329415 - protein, 31 aa, Plasmodium falciparum
NDKITNQKYEKRDLKDEVKQNNRLAALVLKS

SEQ ID NO: 3329416 - protein, 12 aa, Plasmodium falciparum
NDKKDNNEEQNE

SEQ ID NO: 3329417 - protein, 7 aa, Plasmodium falciparum
NDKKEFS

SEQ ID NO: 3329418 - protein, 9 aa, Plasmodium falciparum
NDKKEKTIN

SEQ ID NO: 3329419 - protein, 9 aa, Plasmodium falciparum
NDKKGNNMD

SEQ ID NO: 3329420 - protein, 9 aa, Plasmodium falciparum
NDKKHRKRA

SEQ ID NO: 3329421 - protein, 108 aa, Plasmodium falciparum
NDKKKDDDSYKKKDDDSYKKKEDDKKSSKKYERKNDSTYENRKNHEKKDDEHSKNDKNNNNNNNNNNNKRYEHKSYDEEKSKKKLKTYDKYDEKRYSRKRSSDNRSDY

SEQ ID NO: 3329422 - protein, 11 aa, Plasmodium falciparum
NDKKKEDTEKL

SEQ ID NO: 3329423 - protein, 15 aa, Plasmodium falciparum
NDKKKELKSNDNGID

SEQ ID NO: 3329424 - protein, 29 aa, Plasmodium falciparum
NDKKKKNNMNKNSCTKKLEKKKTASRQIK

SEQ ID NO: 3329425 - protein, 8 aa, Plasmodium falciparum
NDKKKNIS

SEQ ID NO: 3329426 - protein, 11 aa, Plasmodium falciparum
NDKKKNSDKNL

SEQ ID NO: 3329427 - protein, 8 aa, Plasmodium falciparum
NDKKNYNQ

SEQ ID NO: 3329428 - protein, 5 aa, Plasmodium falciparum
NDKKQ

SEQ ID NO: 3329429 - protein, 14 aa, Plasmodium falciparum
NDKKQESEESRMDG

SEQ ID NO: 3329430 - protein, 13 aa, Plasmodium falciparum
NDKKRKIQETPKT

SEQ ID NO: 3329431 - protein, 15 aa, Plasmodium falciparum
NDKKRTRSSRTTRKR

SEQ ID NO: 3329432 - protein, 8 aa, Plasmodium falciparum
NDKKTNIS

SEQ ID NO: 3329433 - protein, 25 aa, Plasmodium falciparum
NDKLEKEKNGGGGVVSSSSSSPTTG

SEQ ID NO: 3329434 - protein, 5 aa, Plasmodium falciparum
NDKLN

SEQ ID NO: 3329435 - protein, 14 aa, Plasmodium falciparum
NDKNDDDNTSNREH

SEQ ID NO: 3329436 - protein, 7 aa, Plasmodium falciparum
NDKNDIK

SEQ ID NO: 3329437 - protein, 8 aa, Plasmodium falciparum
NDKNDTNK

SEQ ID NO: 3329438 - protein, 13 aa, Plasmodium falciparum
NDKNEEAQRHTND

SEQ ID NO: 3329439 - protein, 12 aa, Plasmodium falciparum
NDKNEELNKEDG

SEQ ID NO: 3329440 - protein, 24 aa, Plasmodium falciparum
NDKNENKKKREESKIKGLSDNNMS

SEQ ID NO: 3329441 - protein, 13 aa, Plasmodium falciparum
NDKNGNNDDYYED

SEQ ID NO: 3329442 - protein, 23 aa, Plasmodium falciparum
NDKNIKGNNNKKRKKGKENMNNR

SEQ ID NO: 3329443 - protein, 68 aa, Plasmodium falciparum
NDKNIKSDHNIKGDNNIKSDHNINRNNNKNKKTPLNKPINKKERQKSPKNYSLKSTEKSNKKEDKNYC

SEQ ID NO: 3329444 - protein, 8 aa, Plasmodium falciparum
NDKNIKSK

SEQ ID NO: 3329445 - protein, 9 aa, Plasmodium falciparum
NDKNKKGIN

SEQ ID NO: 3329446 - protein, 51 aa, Plasmodium falciparum
NDKNKNSNQKNKNINNNNNMNNNNVNNNNVNNNNVNNNNGNYIKKKDKNKK

SEQ ID NO: 3329447 - protein, 10 aa, Plasmodium falciparum
NDKNNKNKNN

SEQ ID NO: 3329448 - protein, 6 aa, Plasmodium falciparum
NDKNQI

SEQ ID NO: 3329449 - protein, 6 aa, Plasmodium falciparum
NDKNRK

SEQ ID NO: 3329450 - protein, 9 aa, Plasmodium falciparum
NDKNRSESL

SEQ ID NO: 3329451 - protein, 7 aa, Plasmodium falciparum
NDKNSCI

SEQ ID NO: 3329452 - protein, 8 aa, Plasmodium falciparum
NDKNSNEY

SEQ ID NO: 3329453 - protein, 5 aa, Plasmodium falciparum
NDKNV

SEQ ID NO: 3329454 - protein, 8 aa, Plasmodium falciparum
NDKNVTSK

SEQ ID NO: 3329455 - protein, 6 aa, Plasmodium falciparum
NDKNYL

SEQ ID NO: 3329456 - protein, 9 aa, Plasmodium falciparum
NDKPRSSQN

SEQ ID NO: 3329457 - protein, 9 aa, Plasmodium falciparum
NDKQAFEGE

SEQ ID NO: 3329458 - protein, 10 aa, Plasmodium falciparum
NDKQQDQNNT

SEQ ID NO: 3329459 - protein, 8 aa, Plasmodium falciparum
NDKQQEPN

SEQ ID NO: 3329460 - protein, 17 aa, Plasmodium falciparum
NDKQVQETNSLKKDNKD

SEQ ID NO: 3329461 - protein, 8 aa, Plasmodium falciparum
NDKRHGKG

SEQ ID NO: 3329462 - protein, 11 aa, Plasmodium falciparum
NDKRYKKKKNR

SEQ ID NO: 3329463 - protein, 8 aa, Plasmodium falciparum
NDKSDLKD

SEQ ID NO: 3329464 - protein, 16 aa, Plasmodium falciparum
NDKSDQNEKHDNEKDN

SEQ ID NO: 3329465 - protein, 9 aa, Plasmodium falciparum
NDKSIEGIS

SEQ ID NO: 3329466 - protein, 8 aa, Plasmodium falciparum
NDKSNEEL

SEQ ID NO: 3329467 - protein, 17 aa, Plasmodium falciparum
NDKSNNNKIVKSKNNKI

SEQ ID NO: 3329468 - protein, 11 aa, Plasmodium falciparum
NDKTNDNINSN

SEQ ID NO: 3329469 - protein, 5 aa, Plasmodium falciparum
NDKTY

SEQ ID NO: 3329470 - protein, 21 aa, Plasmodium falciparum
NDKVGDKNKKLSNNNNNNGND

SEQ ID NO: 3329471 - protein, 17 aa, Plasmodium falciparum
NDKVSYSKSGIKENRGI

SEQ ID NO: 3329472 - protein, 4 aa, Plasmodium falciparum
NDKY

SEQ ID NO: 3329473 - protein, 9 aa, Plasmodium falciparum
NDKYEKNKL

SEQ ID NO: 3329474 - protein, 8 aa, Plasmodium falciparum
NDKYIESN

SEQ ID NO: 3329475 - protein, 7 aa, Plasmodium falciparum
NDKYQDK

SEQ ID NO: 3329476 - protein, 5 aa, Plasmodium falciparum
NDKYS

SEQ ID NO: 3329477 - protein, 7 aa, Plasmodium falciparum
NDLAKRG

SEQ ID NO: 3329478 - protein, 14 aa, Plasmodium falciparum
NDLDEKKKIEEEYN

SEQ ID NO: 3329479 - protein, 10 aa, Plasmodium falciparum
NDLDKKSKKE

SEQ ID NO: 3329480 - protein, 12 aa, Plasmodium falciparum
NDLENSNNLSQP

SEQ ID NO: 3329481 - protein, 8 aa, Plasmodium falciparum
NDLGSLGE

SEQ ID NO: 3329482 - protein, 4 aa, Plasmodium falciparum
NDLH

SEQ ID NO: 3329483 - protein, 6 aa, Plasmodium falciparum
NDLKDE

SEQ ID NO: 3329484 - protein, 4 aa, Plasmodium falciparum
NDLN

SEQ ID NO: 3329485 - protein, 5 aa, Plasmodium falciparum
NDLNN

SEQ ID NO: 3329486 - protein, 12 aa, Plasmodium falciparum
NDLNNNNSNIDL

SEQ ID NO: 3329487 - protein, 13 aa, Plasmodium falciparum
NDLNNSDDEFNSA

SEQ ID NO: 3329488 - protein, 8 aa, Plasmodium falciparum
NDLNSYEK

SEQ ID NO: 3329489 - protein, 6 aa, Plasmodium falciparum
NDLNTN

SEQ ID NO: 3329490 - protein, 10 aa, Plasmodium falciparum
NDLPESNDKI

SEQ ID NO: 3329491 - protein, 6 aa, Plasmodium falciparum
NDLRKN

SEQ ID NO: 3329492 - protein, 4 aa, Plasmodium falciparum
NDLS

SEQ ID NO: 3329493 - protein, 13 aa, Plasmodium falciparum
NDLSKEKAITENI

SEQ ID NO: 3329494 - protein, 22 aa, Plasmodium falciparum
NDLSNDPNDGSLKENRKNEPSF

SEQ ID NO: 3329495 - protein, 12 aa, Plasmodium falciparum
NDLSNNNNNING

SEQ ID NO: 3329496 - protein, 5 aa, Plasmodium falciparum
NDLSS

SEQ ID NO: 3329497 - protein, 10 aa, Plasmodium falciparum
NDLSTNDVEK

SEQ ID NO: 3329498 - protein, 9 aa, Plasmodium falciparum
NDLTNQGNI

SEQ ID NO: 3329499 - protein, 5 aa, Plasmodium falciparum
NDMDN

SEQ ID NO: 3329500 - protein, 18 aa, Plasmodium falciparum
NDMEQNKIAEGSKANDVA

SEQ ID NO: 3329501 - protein, 17 aa, Plasmodium falciparum
NDMGSDLGNNNNYNNDD

SEQ ID NO: 3329502 - protein, 19 aa, Plasmodium falciparum
NDMKKKKKLVGKSSNTNEN

SEQ ID NO: 3329503 - protein, 16 aa, Plasmodium falciparum
NDMKNNTIGEDNNNNM

SEQ ID NO: 3329504 - protein, 5 aa, Plasmodium falciparum
NDMKP

SEQ ID NO: 3329505 - protein, 5 aa, Plasmodium falciparum
NDMND

SEQ ID NO: 3329506 - protein, 6 aa, Plasmodium falciparum
NDMNEN

SEQ ID NO: 3329507 - protein, 5 aa, Plasmodium falciparum
NDMNN

SEQ ID NO: 3329508 - protein, 7 aa, Plasmodium falciparum
NDMNNEK

SEQ ID NO: 3329509 - protein, 9 aa, Plasmodium falciparum
NDMNSSSTI

SEQ ID NO: 3329510 - protein, 8 aa, Plasmodium falciparum
NDMPNSKK

SEQ ID NO: 3329511 - protein, 8 aa, Plasmodium falciparum
NDMQSKNK

SEQ ID NO: 3329512 - protein, 53 aa, Plasmodium falciparum
NDMSDENKQSGDENKQSGDENKQSGDENKQSGDENKQTNNDIKQSDNDIKQSD

SEQ ID NO: 3329513 - protein, 31 aa, Plasmodium falciparum
NDMSQNNDMSQNNDMSQNNDMSQNNDMSQNN

SEQ ID NO: 3329514 - protein, 26 aa, Plasmodium falciparum
NDMSQNNDMSQNNDMSQNNNTPHKKH

SEQ ID NO: 3329515 - protein, 6 aa, Plasmodium falciparum
NDMYEK

SEQ ID NO: 3329516 - protein, 20 aa, Plasmodium falciparum
NDNASKKKNNNFDNNNDNDM

SEQ ID NO: 3329517 - protein, 5 aa, Plasmodium falciparum
NDNDD

SEQ ID NO: 3329518 - protein, 8 aa, Plasmodium falciparum
NDNDEEHN

SEQ ID NO: 3329519 - protein, 8 aa, Plasmodium falciparum
NDNDEMKR

SEQ ID NO: 3329520 - protein, 13 aa, Plasmodium falciparum
NDNDNEKEEMVKE

SEQ ID NO: 3329521 - protein, 11 aa, Plasmodium falciparum
NDNDNTSETSK

SEQ ID NO: 3329522 - protein, 7 aa, Plasmodium falciparum
NDNDVNK

SEQ ID NO: 3329523 - protein, 56 aa, Plasmodium falciparum
NDNDVNSEKKKKKKKKKKGKKLNAKKKNLQEESNTTEQTSSLSKDSNSNKDSEENV

SEQ ID NO: 3329524 - protein, 10 aa, Plasmodium falciparum
NDNEANKNPF

SEQ ID NO: 3329525 - protein, 5 aa, Plasmodium falciparum
NDNED

SEQ ID NO: 3329526 - protein, 9 aa, Plasmodium falciparum
NDNEGEKNV

SEQ ID NO: 3329527 - protein, 9 aa, Plasmodium falciparum
NDNEKKEGQ

SEQ ID NO: 3329528 - protein, 17 aa, Plasmodium falciparum
NDNEKKNDKNYKNDTND

SEQ ID NO: 3329529 - protein, 8 aa, Plasmodium falciparum
NDNEKRDL

SEQ ID NO: 3329530 - protein, 6 aa, Plasmodium falciparum
NDNENG

SEQ ID NO: 3329531 - protein, 8 aa, Plasmodium falciparum
NDNENNEN

SEQ ID NO: 3329532 - protein, 9 aa, Plasmodium falciparum
NDNENTNYK

SEQ ID NO: 3329533 - protein, 20 aa, Plasmodium falciparum
NDNENYDNENNNNENNNEHN

SEQ ID NO: 3329534 - protein, 76 aa, Plasmodium falciparum
NDNEREVNKKKKKKKKSTDGNHKNDDHNDDNDDDNDDDDNDDDNNDDDNNDDNDDDNNDDDNNDDDNNDDNDDDNI

SEQ ID NO: 3329535 - protein, 6 aa, Plasmodium falciparum
NDNEVD

SEQ ID NO: 3329536 - protein, 5 aa, Plasmodium falciparum
NDNEY

SEQ ID NO: 3329537 - protein, 4 aa, Plasmodium falciparum
NDNF

SEQ ID NO: 3329538 - protein, 5 aa, Plasmodium falciparum
NDNFE

SEQ ID NO: 3329539 - protein, 12 aa, Plasmodium falciparum
NDNFKKQVNEEY

SEQ ID NO: 3329540 - protein, 9 aa, Plasmodium falciparum
NDNFNNKSS

SEQ ID NO: 3329541 - protein, 5 aa, Plasmodium falciparum
NDNGD

SEQ ID NO: 3329542 - protein, 6 aa, Plasmodium falciparum
NDNGNG

SEQ ID NO: 3329543 - protein, 7 aa, Plasmodium falciparum
NDNGNKK

SEQ ID NO: 3329544 - protein, 11 aa, Plasmodium falciparum
NDNGNNKDNNM

SEQ ID NO: 3329545 - protein, 8 aa, Plasmodium falciparum
NDNGNTMK

SEQ ID NO: 3329546 - protein, 12 aa, Plasmodium falciparum
NDNGYSSYNDPN

SEQ ID NO: 3329547 - protein, 6 aa, Plasmodium falciparum
NDNHLN

SEQ ID NO: 3329548 - protein, 4 aa, Plasmodium falciparum
NDNI

SEQ ID NO: 3329549 - protein, 7 aa, Plasmodium falciparum
NDNIGKK

SEQ ID NO: 3329550 - protein, 5 aa, Plasmodium falciparum
NDNII

SEQ ID NO: 3329551 - protein, 106 aa, Plasmodium falciparum
NDNIKNDNIKNDNIKNDNMRSDNIKNDNIKNDNIKNDNIKNENIKNENTKNENMKNDSMNGSINGKGGNNNPNKNNSNNNNNIKSNDNENNDNNNKMNRQSNCSNV

SEQ ID NO: 3329552 - protein, 9 aa, Plasmodium falciparum
NDNINKNEH

SEQ ID NO: 3329553 - protein, 8 aa, Plasmodium falciparum
NDNINNAN

SEQ ID NO: 3329554 - protein, 13 aa, Plasmodium falciparum
NDNINNDNINNDH

SEQ ID NO: 3329555 - protein, 10 aa, Plasmodium falciparum
NDNINNLGET

SEQ ID NO: 3329556 - protein, 14 aa, Plasmodium falciparum
NDNINNNDNNSTFP

SEQ ID NO: 3329557 - protein, 10 aa, Plasmodium falciparum
NDNINSNNID

SEQ ID NO: 3329558 - protein, 14 aa, Plasmodium falciparum
NDNKDNSTKPSGDV

SEQ ID NO: 3329559 - protein, 6 aa, Plasmodium falciparum
NDNKER

SEQ ID NO: 3329560 - protein, 7 aa, Plasmodium falciparum
NDNKEYN

SEQ ID NO: 3329561 - protein, 18 aa, Plasmodium falciparum
NDNKGKKKIDKDKDNHNI

SEQ ID NO: 3329562 - protein, 16 aa, Plasmodium falciparum
NDNKIKEKKEKQNKKK

SEQ ID NO: 3329563 - protein, 13 aa, Plasmodium falciparum
NDNKINDNINDNK

SEQ ID NO: 3329564 - protein, 44 aa, Plasmodium falciparum
NDNKKEEHNHYNKKEEHNNYNKKEEHNNYNKKDEHNNYNKKEEH

SEQ ID NO: 3329565 - protein, 10 aa, Plasmodium falciparum
NDNKKIGKEE

SEQ ID NO: 3329566 - protein, 200 aa, Plasmodium falciparum
NDNKKNDTINDKNNNNNMKNDKPEDECTKKKDINNSNNKNYSSNDNINNGNNKNYNGNNKNYNGNNKNYNGNNKNYNGNNKNCNGNNKNCNGNNKNYNGNNKNCNGNNKNYNSNNKNYNSKHNSNKGHSKDHNNGHSKDHNNGHSKDHNNGHSKDHNNGHSKDHNNGHSKDHNNGHSKDHNNGHNDDHNNDHNNNNDSFK

SEQ ID NO: 3329567 - protein, 8 aa, Plasmodium falciparum
NDNKLENE

SEQ ID NO: 3329568 - protein, 10 aa, Plasmodium falciparum
NDNKNHNSSC

SEQ ID NO: 3329569 - protein, 6 aa, Plasmodium falciparum
NDNKNI

SEQ ID NO: 3329570 - protein, 6 aa, Plasmodium falciparum
NDNKNM

SEQ ID NO: 3329571 - protein, 17 aa, Plasmodium falciparum
NDNKNNDNIGSNKNNEM

SEQ ID NO: 3329572 - protein, 7 aa, Plasmodium falciparum
NDNKNNK

SEQ ID NO: 3329573 - protein, 10 aa, Plasmodium falciparum
NDNKNNMGDN

SEQ ID NO: 3329574 - protein, 6 aa, Plasmodium falciparum
NDNKNY

SEQ ID NO: 3329575 - protein, 6 aa, Plasmodium falciparum
NDNKSY

SEQ ID NO: 3329576 - protein, 8 aa, Plasmodium falciparum
NDNKTINK

SEQ ID NO: 3329577 - protein, 7 aa, Plasmodium falciparum
NDNKTYH

SEQ ID NO: 3329578 - protein, 4 aa, Plasmodium falciparum
NDNL

SEQ ID NO: 3329579 - protein, 16 aa, Plasmodium falciparum
NDNLKSDVHNNKKNKY

SEQ ID NO: 3329580 - protein, 15 aa, Plasmodium falciparum
NDNMNEDDNNNNNYY

SEQ ID NO: 3329581 - protein, 30 aa, Plasmodium falciparum
NDNNDENDDTNGNMNEDDEYKNATDYTEED

SEQ ID NO: 3329582 - protein, 10 aa, Plasmodium falciparum
NDNNDNVQNK

SEQ ID NO: 3329583 - protein, 12 aa, Plasmodium falciparum
NDNNEDNNKKDK

SEQ ID NO: 3329584 - protein, 8 aa, Plasmodium falciparum
NDNNEKCT

SEQ ID NO: 3329585 - protein, 10 aa, Plasmodium falciparum
NDNNEKKKRK

SEQ ID NO: 3329586 - protein, 12 aa, Plasmodium falciparum
NDNNFKNSKQKR

SEQ ID NO: 3329587 - protein, 8 aa, Plasmodium falciparum
NDNNHNNT

SEQ ID NO: 3329588 - protein, 5 aa, Plasmodium falciparum
NDNNI

SEQ ID NO: 3329589 - protein, 6 aa, Plasmodium falciparum
NDNNIE

SEQ ID NO: 3329590 - protein, 16 aa, Plasmodium falciparum
NDNNKCTEKMPGESKQ

SEQ ID NO: 3329591 - protein, 9 aa, Plasmodium falciparum
NDNNKLPDG

SEQ ID NO: 3329592 - protein, 9 aa, Plasmodium falciparum
NDNNKNDDI

SEQ ID NO: 3329593 - protein, 11 aa, Plasmodium falciparum
NDNNKNNDNDI

SEQ ID NO: 3329594 - protein, 16 aa, Plasmodium falciparum
NDNNLNTNVQTNNDNV

SEQ ID NO: 3329595 - protein, 24 aa, Plasmodium falciparum
NDNNMDNDSSDNNNNNNVKIPKNS

SEQ ID NO: 3329596 - protein, 6 aa, Plasmodium falciparum
NDNNMN

SEQ ID NO: 3329597 - protein, 9 aa, Plasmodium falciparum
NDNNNDNIH

SEQ ID NO: 3329598 - protein, 11 aa, Plasmodium falciparum
NDNNNDNNNDN

SEQ ID NO: 3329599 - protein, 8 aa, Plasmodium falciparum
NDNNNHNK

SEQ ID NO: 3329600 - protein, 6 aa, Plasmodium falciparum
NDNNNN

SEQ ID NO: 3329601 - protein, 16 aa, Plasmodium falciparum
NDNNNNNKKKKKYKTY

SEQ ID NO: 3329602 - protein, 10 aa, Plasmodium falciparum
NDNNNNNNDN

SEQ ID NO: 3329603 - protein, 9 aa, Plasmodium falciparum
NDNNNNNNN

SEQ ID NO: 3329604 - protein, 13 aa, Plasmodium falciparum
NDNNNNNNNIRDT

SEQ ID NO: 3329605 - protein, 14 aa, Plasmodium falciparum
NDNNNNNNNKENNI

SEQ ID NO: 3329606 - protein, 10 aa, Plasmodium falciparum
NDNNNNNNNM

SEQ ID NO: 3329607 - protein, 19 aa, Plasmodium falciparum
NDNNNNNNNNDSNNDNINH

SEQ ID NO: 3329608 - protein, 11 aa, Plasmodium falciparum
NDNNNNNNNNI

SEQ ID NO: 3329609 - protein, 26 aa, Plasmodium falciparum
NDNNNNNNNNNNNNNNNKNNSNNNYE

SEQ ID NO: 3329610 - protein, 33 aa, Plasmodium falciparum
NDNNNNNNNNSNNNNNNNNNNNVVGGKNNNDDI

SEQ ID NO: 3329611 - protein, 14 aa, Plasmodium falciparum
NDNNNNNNNNSNNY

SEQ ID NO: 3329612 - protein, 7 aa, Plasmodium falciparum
NDNNNSK

SEQ ID NO: 3329613 - protein, 21 aa, Plasmodium falciparum
NDNNPKDEEKSVKKIETSQNI

SEQ ID NO: 3329614 - protein, 13 aa, Plasmodium falciparum
NDNNPQKKYNNTY

SEQ ID NO: 3329615 - protein, 12 aa, Plasmodium falciparum
NDNNQNEESQHN

SEQ ID NO: 3329616 - protein, 24 aa, Plasmodium falciparum
NDNNQNNAWPKKKDNYSSPQKSNT

SEQ ID NO: 3329617 - protein, 8 aa, Plasmodium falciparum
NDNNSTNN

SEQ ID NO: 3329618 - protein, 8 aa, Plasmodium falciparum
NDNNTKQM

SEQ ID NO: 3329619 - protein, 9 aa, Plasmodium falciparum
NDNNYNDNI

SEQ ID NO: 3329620 - protein, 8 aa, Plasmodium falciparum
NDNNYYNN

SEQ ID NO: 3329621 - protein, 7 aa, Plasmodium falciparum
NDNPNGC

SEQ ID NO: 3329622 - protein, 6 aa, Plasmodium falciparum
NDNQCV

SEQ ID NO: 3329623 - protein, 7 aa, Plasmodium falciparum
NDNQENN

SEQ ID NO: 3329624 - protein, 8 aa, Plasmodium falciparum
NDNQFGDL

SEQ ID NO: 3329625 - protein, 8 aa, Plasmodium falciparum
NDNRNNSN

SEQ ID NO: 3329626 - protein, 19 aa, Plasmodium falciparum
NDNRTRESFKKNDRGEYID

SEQ ID NO: 3329627 - protein, 9 aa, Plasmodium falciparum
NDNRYNSPN

SEQ ID NO: 3329628 - protein, 8 aa, Plasmodium falciparum
NDNSCKSY

SEQ ID NO: 3329629 - protein, 23 aa, Plasmodium falciparum
NDNSEIKKKKKRKKKKKKKEKHN

SEQ ID NO: 3329630 - protein, 15 aa, Plasmodium falciparum
NDNSITNMEKSPNNI

SEQ ID NO: 3329631 - protein, 12 aa, Plasmodium falciparum
NDNSKNSNNSFC

SEQ ID NO: 3329632 - protein, 8 aa, Plasmodium falciparum
NDNSLEDV

SEQ ID NO: 3329633 - protein, 5 aa, Plasmodium falciparum
NDNSN

SEQ ID NO: 3329634 - protein, 7 aa, Plasmodium falciparum
NDNSSGG

SEQ ID NO: 3329635 - protein, 8 aa, Plasmodium falciparum
NDNSSSCD

SEQ ID NO: 3329636 - protein, 13 aa, Plasmodium falciparum
NDNSTNQQVHGKK

SEQ ID NO: 3329637 - protein, 9 aa, Plasmodium falciparum
NDNSYNNQI

SEQ ID NO: 3329638 - protein, 6 aa, Plasmodium falciparum
NDNTEI

SEQ ID NO: 3329639 - protein, 8 aa, Plasmodium falciparum
NDNTENLD

SEQ ID NO: 3329640 - protein, 37 aa, Plasmodium falciparum
NDNTINKKHNNNNNNNNDNNDNNNDNNNNNNNDSSSM

SEQ ID NO: 3329641 - protein, 13 aa, Plasmodium falciparum
NDNTKGSLSNNFN

SEQ ID NO: 3329642 - protein, 11 aa, Plasmodium falciparum
NDNTKNGYGTL

SEQ ID NO: 3329643 - protein, 16 aa, Plasmodium falciparum
NDNTNCNSNSNSNSEY

SEQ ID NO: 3329644 - protein, 6 aa, Plasmodium falciparum
NDNTNI

SEQ ID NO: 3329645 - protein, 12 aa, Plasmodium falciparum
NDNTRKENNYYY

SEQ ID NO: 3329646 - protein, 6 aa, Plasmodium falciparum
NDNTSC

SEQ ID NO: 3329647 - protein, 7 aa, Plasmodium falciparum
NDNTSVQ

SEQ ID NO: 3329648 - protein, 9 aa, Plasmodium falciparum
NDNTTYGNI

SEQ ID NO: 3329649 - protein, 8 aa, Plasmodium falciparum
NDNTYNDN

SEQ ID NO: 3329650 - protein, 11 aa, Plasmodium falciparum
NDNVDKKKSKY

SEQ ID NO: 3329651 - protein, 8 aa, Plasmodium falciparum
NDNVGENN

SEQ ID NO: 3329652 - protein, 6 aa, Plasmodium falciparum
NDNVRK

SEQ ID NO: 3329653 - protein, 11 aa, Plasmodium falciparum
NDNVSDHEHAG

SEQ ID NO: 3329654 - protein, 5 aa, Plasmodium falciparum
NDNYM

SEQ ID NO: 3329655 - protein, 14 aa, Plasmodium falciparum
NDNYNNNNNNNNNS

SEQ ID NO: 3329656 - protein, 8 aa, Plasmodium falciparum
NDNYRSRA

SEQ ID NO: 3329657 - protein, 14 aa, Plasmodium falciparum
NDNYTNNYEENYKN

SEQ ID NO: 3329658 - protein, 6 aa, Plasmodium falciparum
NDNYYN

SEQ ID NO: 3329659 - protein, 7 aa, Plasmodium falciparum
NDPDADR

SEQ ID NO: 3329660 - protein, 6 aa, Plasmodium falciparum
NDPDFE

SEQ ID NO: 3329661 - protein, 4 aa, Plasmodium falciparum
NDPF

SEQ ID NO: 3329662 - protein, 4 aa, Plasmodium falciparum
NDPI

SEQ ID NO: 3329663 - protein, 15 aa, Plasmodium falciparum
NDPITGTKTKDECSE

SEQ ID NO: 3329664 - protein, 6 aa, Plasmodium falciparum
NDPKEL

SEQ ID NO: 3329665 - protein, 6 aa, Plasmodium falciparum
NDPKKA

SEQ ID NO: 3329666 - protein, 4 aa, Plasmodium falciparum
NDPN

SEQ ID NO: 3329667 - protein, 8 aa, Plasmodium falciparum
NDPNKRDE

SEQ ID NO: 3329668 - protein, 15 aa, Plasmodium falciparum
NDPNKTNLSNTRMVY

SEQ ID NO: 3329669 - protein, 5 aa, Plasmodium falciparum
NDPNQ

SEQ ID NO: 3329670 - protein, 13 aa, Plasmodium falciparum
NDPNTSSPANPEA

SEQ ID NO: 3329671 - protein, 7 aa, Plasmodium falciparum
NDPNVDD

SEQ ID NO: 3329672 - protein, 20 aa, Plasmodium falciparum
NDPNVTSENDNTVSNNESTV

SEQ ID NO: 3329673 - protein, 6 aa, Plasmodium falciparum
NDPNYA

SEQ ID NO: 3329674 - protein, 12 aa, Plasmodium falciparum
NDPNYEQKVPEQ

SEQ ID NO: 3329675 - protein, 19 aa, Plasmodium falciparum
NDPPNNNNNNNNNNNNNMN

SEQ ID NO: 3329676 - protein, 16 aa, Plasmodium falciparum
NDPQLKSYKEENSNYP

SEQ ID NO: 3329677 - protein, 12 aa, Plasmodium falciparum
NDPQRQEKEDSK

SEQ ID NO: 3329678 - protein, 4 aa, Plasmodium falciparum
NDPS

SEQ ID NO: 3329679 - protein, 16 aa, Plasmodium falciparum
NDPSDPNQKNNLNNNI

SEQ ID NO: 3329680 - protein, 6 aa, Plasmodium falciparum
NDPSKG

SEQ ID NO: 3329681 - protein, 7 aa, Plasmodium falciparum
NDPSKKY

SEQ ID NO: 3329682 - protein, 6 aa, Plasmodium falciparum
NDPSNN

SEQ ID NO: 3329683 - protein, 6 aa, Plasmodium falciparum
NDPTSR

SEQ ID NO: 3329684 - protein, 4 aa, Plasmodium falciparum
NDPV

SEQ ID NO: 3329685 - protein, 12 aa, Plasmodium falciparum
NDPVDTNNDDTT

SEQ ID NO: 3329686 - protein, 4 aa, Plasmodium falciparum
NDPY

SEQ ID NO: 3329687 - protein, 9 aa, Plasmodium falciparum
NDPYDEKEK

SEQ ID NO: 3329688 - protein, 5 aa, Plasmodium falciparum
NDPYQ

SEQ ID NO: 3329689 - protein, 5 aa, Plasmodium falciparum
NDQAE

SEQ ID NO: 3329690 - protein, 7 aa, Plasmodium falciparum
NDQCDNE

SEQ ID NO: 3329691 - protein, 7 aa, Plasmodium falciparum
NDQCPNS

SEQ ID NO: 3329692 - protein, 8 aa, Plasmodium falciparum
NDQDNDNL

SEQ ID NO: 3329693 - protein, 4 aa, Plasmodium falciparum
NDQE

SEQ ID NO: 3329694 - protein, 11 aa, Plasmodium falciparum
NDQEEKNRKEI

SEQ ID NO: 3329695 - protein, 6 aa, Plasmodium falciparum
NDQEKD

SEQ ID NO: 3329696 - protein, 19 aa, Plasmodium falciparum
NDQENEKTFSHQTSEQRSL

SEQ ID NO: 3329697 - protein, 15 aa, Plasmodium falciparum
NDQERNQEEGSTNCS

SEQ ID NO: 3329698 - protein, 23 aa, Plasmodium falciparum
NDQGHDKNKCSHNINNSTPESIV

SEQ ID NO: 3329699 - protein, 9 aa, Plasmodium falciparum
NDQGNNNMN

SEQ ID NO: 3329700 - protein, 15 aa, Plasmodium falciparum
NDQHNNRKNSYSLEK

SEQ ID NO: 3329701 - protein, 7 aa, Plasmodium falciparum
NDQIPDW

SEQ ID NO: 3329702 - protein, 7 aa, Plasmodium falciparum
NDQIQNN

SEQ ID NO: 3329703 - protein, 7 aa, Plasmodium falciparum
NDQKDDL

SEQ ID NO: 3329704 - protein, 18 aa, Plasmodium falciparum
NDQKDNIKELKNQKQEKQ

SEQ ID NO: 3329705 - protein, 10 aa, Plasmodium falciparum
NDQNEEPYQH

SEQ ID NO: 3329706 - protein, 9 aa, Plasmodium falciparum
NDQNEQNKH

SEQ ID NO: 3329707 - protein, 9 aa, Plasmodium falciparum
NDQNEQPYQ

SEQ ID NO: 3329708 - protein, 7 aa, Plasmodium falciparum
NDQNREE

SEQ ID NO: 3329709 - protein, 4 aa, Plasmodium falciparum
NDQS

SEQ ID NO: 3329710 - protein, 8 aa, Plasmodium falciparum
NDQSDQIT

SEQ ID NO: 3329711 - protein, 6 aa, Plasmodium falciparum
NDQSKI

SEQ ID NO: 3329712 - protein, 19 aa, Plasmodium falciparum
NDQSLNKTSASIVSPDSMG

SEQ ID NO: 3329713 - protein, 8 aa, Plasmodium falciparum
NDQSREDV

SEQ ID NO: 3329714 - protein, 7 aa, Plasmodium falciparum
NDQSTGT

SEQ ID NO: 3329715 - protein, 7 aa, Plasmodium falciparum
NDQSYNI

SEQ ID NO: 3329716 - protein, 5 aa, Plasmodium falciparum
NDQTN

SEQ ID NO: 3329717 - protein, 15 aa, Plasmodium falciparum
NDQVNSQNDDDRFEK

SEQ ID NO: 3329718 - protein, 8 aa, Plasmodium falciparum
NDQYNNDS

SEQ ID NO: 3329719 - protein, 10 aa, Plasmodium falciparum
NDRERIDDAR

SEQ ID NO: 3329720 - protein, 8 aa, Plasmodium falciparum
NDRESEIS

SEQ ID NO: 3329721 - protein, 4 aa, Plasmodium falciparum
NDRI

SEQ ID NO: 3329722 - protein, 4 aa, Plasmodium falciparum
NDRL

SEQ ID NO: 3329723 - protein, 4 aa, Plasmodium falciparum
NDRN

SEQ ID NO: 3329724 - protein, 85 aa, Plasmodium falciparum
NDRNDFTQSDTNSELSDNEEKKDEKHVKTDNNTKGNPNSINKNNYTNDNDRNLDNNKNDPSNNKRNVKNNNKKNNIQENMPKKSD

SEQ ID NO: 3329725 - protein, 11 aa, Plasmodium falciparum
NDRNDNESENI

SEQ ID NO: 3329726 - protein, 9 aa, Plasmodium falciparum
NDRSANNRN

SEQ ID NO: 3329727 - protein, 5 aa, Plasmodium falciparum
NDRSK

SEQ ID NO: 3329728 - protein, 9 aa, Plasmodium falciparum
NDSDDDHNN

SEQ ID NO: 3329729 - protein, 18 aa, Plasmodium falciparum
NDSDNTDKDAINSDHSDA

SEQ ID NO: 3329730 - protein, 10 aa, Plasmodium falciparum
NDSDTNDAGC

SEQ ID NO: 3329731 - protein, 17 aa, Plasmodium falciparum
NDSEDSKIHNADNINKS

SEQ ID NO: 3329732 - protein, 15 aa, Plasmodium falciparum
NDSFKNDDNKNVNLS

SEQ ID NO: 3329733 - protein, 4 aa, Plasmodium falciparum
NDSG

SEQ ID NO: 3329734 - protein, 6 aa, Plasmodium falciparum
NDSHKD

SEQ ID NO: 3329735 - protein, 6 aa, Plasmodium falciparum
NDSHKT

SEQ ID NO: 3329736 - protein, 6 aa, Plasmodium falciparum
NDSIDE

SEQ ID NO: 3329737 - protein, 7 aa, Plasmodium falciparum
NDSIEQK

SEQ ID NO: 3329738 - protein, 8 aa, Plasmodium falciparum
NDSINPPK

SEQ ID NO: 3329739 - protein, 15 aa, Plasmodium falciparum
NDSINRSPNEDHHGY

SEQ ID NO: 3329740 - protein, 9 aa, Plasmodium falciparum
NDSKDHAEA

SEQ ID NO: 3329741 - protein, 7 aa, Plasmodium falciparum
NDSKDSK

SEQ ID NO: 3329742 - protein, 8 aa, Plasmodium falciparum
NDSKFGGE

SEQ ID NO: 3329743 - protein, 16 aa, Plasmodium falciparum
NDSKIQNNNNMSDENN

SEQ ID NO: 3329744 - protein, 5 aa, Plasmodium falciparum
NDSLK

SEQ ID NO: 3329745 - protein, 20 aa, Plasmodium falciparum
NDSLNNDSLNNDSLNNDSLN

SEQ ID NO: 3329746 - protein, 5 aa, Plasmodium falciparum
NDSMK

SEQ ID NO: 3329747 - protein, 13 aa, Plasmodium falciparum
NDSNDAQNKRGSW

SEQ ID NO: 3329748 - protein, 9 aa, Plasmodium falciparum
NDSNDTHAL

SEQ ID NO: 3329749 - protein, 15 aa, Plasmodium falciparum
NDSNINKKELETSNN

SEQ ID NO: 3329750 - protein, 10 aa, Plasmodium falciparum
NDSNKIQNDK

SEQ ID NO: 3329751 - protein, 13 aa, Plasmodium falciparum
NDSNKTYDESSTC

SEQ ID NO: 3329752 - protein, 9 aa, Plasmodium falciparum
NDSNNKNNI

SEQ ID NO: 3329753 - protein, 25 aa, Plasmodium falciparum
NDSNNNNNNNNHHHSNNNLHSNNNF

SEQ ID NO: 3329754 - protein, 29 aa, Plasmodium falciparum
NDSNTDNSYECNKKGAAAISTNVNNTTTE

SEQ ID NO: 3329755 - protein, 7 aa, Plasmodium falciparum
NDSNTNL

SEQ ID NO: 3329756 - protein, 47 aa, Plasmodium falciparum
NDSNTYNNRSKDKNDFSPCSNNNNNNDNNNYNYNNNNYNNNNDNNNM

SEQ ID NO: 3329757 - protein, 4 aa, Plasmodium falciparum
NDSQ

SEQ ID NO: 3329758 - protein, 63 aa, Plasmodium falciparum
NDSQCNNKNEYNNDDDDNNNDDDDNNNDDDNNNNDDNNNDDNNNDDDNNNNNNNNNNNSFSNN

SEQ ID NO: 3329759 - protein, 17 aa, Plasmodium falciparum
NDSQDNIPYDNTKQKKS

SEQ ID NO: 3329760 - protein, 17 aa, Plasmodium falciparum
NDSQENIPYDNTKQKKS

SEQ ID NO: 3329761 - protein, 8 aa, Plasmodium falciparum
NDSQNDFD

SEQ ID NO: 3329762 - protein, 12 aa, Plasmodium falciparum
NDSRNSSHASPS

SEQ ID NO: 3329763 - protein, 6 aa, Plasmodium falciparum
NDSSIM

SEQ ID NO: 3329764 - protein, 9 aa, Plasmodium falciparum
NDSSLDEKT

SEQ ID NO: 3329765 - protein, 10 aa, Plasmodium falciparum
NDSSRNNDKG

SEQ ID NO: 3329766 - protein, 6 aa, Plasmodium falciparum
NDSTLQ

SEQ ID NO: 3329767 - protein, 8 aa, Plasmodium falciparum
NDSTNNSL

SEQ ID NO: 3329768 - protein, 8 aa, Plasmodium falciparum
NDSTNRYM

SEQ ID NO: 3329769 - protein, 8 aa, Plasmodium falciparum
NDSTQINI

SEQ ID NO: 3329770 - protein, 11 aa, Plasmodium falciparum
NDSVIDSDNHS

SEQ ID NO: 3329771 - protein, 30 aa, Plasmodium falciparum
NDSVKDNINEELENNETSCKSSKLNDVTHN

SEQ ID NO: 3329772 - protein, 7 aa, Plasmodium falciparum
NDSVQKA

SEQ ID NO: 3329773 - protein, 10 aa, Plasmodium falciparum
NDSVSNSSDY

SEQ ID NO: 3329774 - protein, 10 aa, Plasmodium falciparum
NDSYANNSNI

SEQ ID NO: 3329775 - protein, 63 aa, Plasmodium falciparum
NDSYDDNSGMINEKKKKKEKQKQNEKEKEKEKEKEKEKKKQNEKEKEKEKQNEKQTNKQMNKQ

SEQ ID NO: 3329776 - protein, 27 aa, Plasmodium falciparum
NDTANNIDDNNNNNNNNNNTFNDNNDI

SEQ ID NO: 3329777 - protein, 7 aa, Plasmodium falciparum
NDTDEGI

SEQ ID NO: 3329778 - protein, 16 aa, Plasmodium falciparum
NDTDKRKRKKIYIHYS

SEQ ID NO: 3329779 - protein, 6 aa, Plasmodium falciparum
NDTDTP

SEQ ID NO: 3329780 - protein, 7 aa, Plasmodium falciparum
NDTENSM

SEQ ID NO: 3329781 - protein, 4 aa, Plasmodium falciparum
NDTF

SEQ ID NO: 3329782 - protein, 9 aa, Plasmodium falciparum
NDTFNNKNN

SEQ ID NO: 3329783 - protein, 14 aa, Plasmodium falciparum
NDTFNSNSLGRNYT

SEQ ID NO: 3329784 - protein, 4 aa, Plasmodium falciparum
NDTH

SEQ ID NO: 3329785 - protein, 5 aa, Plasmodium falciparum
NDTHR

SEQ ID NO: 3329786 - protein, 5 aa, Plasmodium falciparum
NDTIN

SEQ ID NO: 3329787 - protein, 15 aa, Plasmodium falciparum
NDTINSNTQNSSYFS

SEQ ID NO: 3329788 - protein, 10 aa, Plasmodium falciparum
NDTIQTKDNY

SEQ ID NO: 3329789 - protein, 4 aa, Plasmodium falciparum
NDTK

SEQ ID NO: 3329790 - protein, 7 aa, Plasmodium falciparum
NDTKEGN

SEQ ID NO: 3329791 - protein, 23 aa, Plasmodium falciparum
NDTKIDENNNNTHIDDKDYNKNN

SEQ ID NO: 3329792 - protein, 10 aa, Plasmodium falciparum
NDTKKNTKIN

SEQ ID NO: 3329793 - protein, 11 aa, Plasmodium falciparum
NDTKKREDINT

SEQ ID NO: 3329794 - protein, 10 aa, Plasmodium falciparum
NDTKTENDEN

SEQ ID NO: 3329795 - protein, 38 aa, Plasmodium falciparum
NDTLDDDKKSSNKCNISSSLNNSEFSYPNNKMSSNHSI

SEQ ID NO: 3329796 - protein, 21 aa, Plasmodium falciparum
NDTLDEKHKKNNADVENEETN

SEQ ID NO: 3329797 - protein, 5 aa, Plasmodium falciparum
NDTLN

SEQ ID NO: 3329798 - protein, 6 aa, Plasmodium falciparum
NDTNAK

SEQ ID NO: 3329799 - protein, 6 aa, Plasmodium falciparum
NDTNEF

SEQ ID NO: 3329800 - protein, 6 aa, Plasmodium falciparum
NDTNIT

SEQ ID NO: 3329801 - protein, 11 aa, Plasmodium falciparum
NDTNKDINNHR

SEQ ID NO: 3329802 - protein, 10 aa, Plasmodium falciparum
NDTNKSYPTS

SEQ ID NO: 3329803 - protein, 5 aa, Plasmodium falciparum
NDTNM

SEQ ID NO: 3329804 - protein, 13 aa, Plasmodium falciparum
NDTNNNEKKISNV

SEQ ID NO: 3329805 - protein, 8 aa, Plasmodium falciparum
NDTNNQTN

SEQ ID NO: 3329806 - protein, 11 aa, Plasmodium falciparum
NDTNNTNNTNI

SEQ ID NO: 3329807 - protein, 13 aa, Plasmodium falciparum
NDTNQKNNKVSSI

SEQ ID NO: 3329808 - protein, 11 aa, Plasmodium falciparum
NDTNVENISNN

SEQ ID NO: 3329809 - protein, 18 aa, Plasmodium falciparum
NDTNVSLESNASNKTNQI

SEQ ID NO: 3329810 - protein, 6 aa, Plasmodium falciparum
NDTQIN

SEQ ID NO: 3329811 - protein, 5 aa, Plasmodium falciparum
NDTQM

SEQ ID NO: 3329812 - protein, 8 aa, Plasmodium falciparum
NDTQNRKK

SEQ ID NO: 3329813 - protein, 13 aa, Plasmodium falciparum
NDTSENIKNETND

SEQ ID NO: 3329814 - protein, 14 aa, Plasmodium falciparum
NDTSFDNKEENKVL

SEQ ID NO: 3329815 - protein, 22 aa, Plasmodium falciparum
NDTSGTCNNTSSTCNNNNTSGI

SEQ ID NO: 3329816 - protein, 42 aa, Plasmodium falciparum
NDTSINNNNNNNNNNNNNIGNTIGTQHKNKNKQNANDQKNIP

SEQ ID NO: 3329817 - protein, 8 aa, Plasmodium falciparum
NDTSNEKK

SEQ ID NO: 3329818 - protein, 11 aa, Plasmodium falciparum
NDTSQSSYNNN

SEQ ID NO: 3329819 - protein, 8 aa, Plasmodium falciparum
NDTSRKDS

SEQ ID NO: 3329820 - protein, 6 aa, Plasmodium falciparum
NDTSYY

SEQ ID NO: 3329821 - protein, 8 aa, Plasmodium falciparum
NDTTKDVK

SEQ ID NO: 3329822 - protein, 9 aa, Plasmodium falciparum
NDTTNKSYG

SEQ ID NO: 3329823 - protein, 9 aa, Plasmodium falciparum
NDTTSNDVV

SEQ ID NO: 3329824 - protein, 12 aa, Plasmodium falciparum
NDTTTKHKSFSN

SEQ ID NO: 3329825 - protein, 6 aa, Plasmodium falciparum
NDTVAD

SEQ ID NO: 3329826 - protein, 4 aa, Plasmodium falciparum
NDTY

SEQ ID NO: 3329827 - protein, 15 aa, Plasmodium falciparum
NDTYDDDDNKNLSEN

SEQ ID NO: 3329828 - protein, 47 aa, Plasmodium falciparum
NDTYKNTEISKKNDEESISKTKNEYEQYNNNENNKNTEERNHNKKHE

SEQ ID NO: 3329829 - protein, 6 aa, Plasmodium falciparum
NDTYNT

SEQ ID NO: 3329830 - protein, 26 aa, Plasmodium falciparum
NDTYTNSNYDESTMQTDGNYKAQKNL

SEQ ID NO: 3329831 - protein, 4 aa, Plasmodium falciparum
NDVA

SEQ ID NO: 3329832 - protein, 41 aa, Plasmodium falciparum
NDVDDDVDNDVDDDVDNDVDDDVDNDDDVDDDVYDDDDNDV

SEQ ID NO: 3329833 - protein, 4 aa, Plasmodium falciparum
NDVE

SEQ ID NO: 3329834 - protein, 10 aa, Plasmodium falciparum
NDVEGKKEKH

SEQ ID NO: 3329835 - protein, 14 aa, Plasmodium falciparum
NDVKGDEENEEIEE

SEQ ID NO: 3329836 - protein, 8 aa, Plasmodium falciparum
NDVKSGNN

SEQ ID NO: 3329837 - protein, 4 aa, Plasmodium falciparum
NDVL

SEQ ID NO: 3329838 - protein, 6 aa, Plasmodium falciparum
NDVNEK

SEQ ID NO: 3329839 - protein, 17 aa, Plasmodium falciparum
NDVNENLSNNNTNIEKP

SEQ ID NO: 3329840 - protein, 13 aa, Plasmodium falciparum
NDVNKNSDIIILD

SEQ ID NO: 3329841 - protein, 6 aa, Plasmodium falciparum
NDVPEE

SEQ ID NO: 3329842 - protein, 20 aa, Plasmodium falciparum
NDVQSDHKNNNVKKKEDTNV

SEQ ID NO: 3329843 - protein, 6 aa, Plasmodium falciparum
NDVSKE

SEQ ID NO: 3329844 - protein, 17 aa, Plasmodium falciparum
NDVTNKKKLNDNYKSNS

SEQ ID NO: 3329845 - protein, 46 aa, Plasmodium falciparum
NDVTNNKKETSNEINKDSNNICKNNDQENDTNNNNNNNNNNNSNSA

SEQ ID NO: 3329846 - protein, 16 aa, Plasmodium falciparum
NDVTQGDMNKGFNKVA

SEQ ID NO: 3329847 - protein, 16 aa, Plasmodium falciparum
NDVYPNSEEPITKEDK

SEQ ID NO: 3329848 - protein, 6 aa, Plasmodium falciparum
NDWSDE

SEQ ID NO: 3329849 - protein, 19 aa, Plasmodium falciparum
NDYDNENDCNNNEREGSVH

SEQ ID NO: 3329850 - protein, 7 aa, Plasmodium falciparum
NDYDNNL

SEQ ID NO: 3329851 - protein, 11 aa, Plasmodium falciparum
NDYDPSKYTKQ

SEQ ID NO: 3329852 - protein, 6 aa, Plasmodium falciparum
NDYEND

SEQ ID NO: 3329853 - protein, 11 aa, Plasmodium falciparum
NDYENNREHNE

SEQ ID NO: 3329854 - protein, 8 aa, Plasmodium falciparum
NDYESKNN

SEQ ID NO: 3329855 - protein, 7 aa, Plasmodium falciparum
NDYGDDE

SEQ ID NO: 3329856 - protein, 4 aa, Plasmodium falciparum
NDYK

SEQ ID NO: 3329857 - protein, 4 aa, Plasmodium falciparum
NDYN

SEQ ID NO: 3329858 - protein, 7 aa, Plasmodium falciparum
NDYNDDI

SEQ ID NO: 3329859 - protein, 21 aa, Plasmodium falciparum
NDYNSGNNKTNCNNNNNNNIP

SEQ ID NO: 3329860 - protein, 7 aa, Plasmodium falciparum
NDYPDER

SEQ ID NO: 3329861 - protein, 6 aa, Plasmodium falciparum
NDYPTS

SEQ ID NO: 3329862 - protein, 17 aa, Plasmodium falciparum
NDYQNEKDNKQIEQQNY

SEQ ID NO: 3329863 - protein, 5 aa, Plasmodium falciparum
NDYRS

SEQ ID NO: 3329864 - protein, 116 aa, Plasmodium falciparum
NDYSPKYKKRRRYSNESGLSDRDRSRSRRYSKSSNSSNKRNNKYESHSQSLSDNRNSYRNRSKGKKRSGYKGKRSYSSYENQNDDVSRSRSDHGSRSGDRSYRKKKNKNESSSDVL

SEQ ID NO: 3329865 - protein, 19 aa, Plasmodium falciparum
NDYTDGNTTISTNNSSCTL

SEQ ID NO: 3329866 - protein, 6 aa, Plasmodium falciparum
NDYTNI

SEQ ID NO: 3329867 - protein, 6 aa, Plasmodium falciparum
NDYYEK

SEQ ID NO: 3329868 - protein, 14 aa, Plasmodium falciparum
NEAADSTADQNPDK

SEQ ID NO: 3329869 - protein, 9 aa, Plasmodium falciparum
NEANKEKEN

SEQ ID NO: 3329870 - protein, 6 aa, Plasmodium falciparum
NEANNR

SEQ ID NO: 3329871 - protein, 7 aa, Plasmodium falciparum
NEAPNTF

SEQ ID NO: 3329872 - protein, 10 aa, Plasmodium falciparum
NEAPRDRKKV

SEQ ID NO: 3329873 - protein, 5 aa, Plasmodium falciparum
NEATN

SEQ ID NO: 3329874 - protein, 19 aa, Plasmodium falciparum
NECDYEEDYDNGEDYYDDE

SEQ ID NO: 3329875 - protein, 13 aa, Plasmodium falciparum
NECEQRDNNSVVS

SEQ ID NO: 3329876 - protein, 9 aa, Plasmodium falciparum
NECKDSISE

SEQ ID NO: 3329877 - protein, 17 aa, Plasmodium falciparum
NECNNNGVELDEDSNYQ

SEQ ID NO: 3329878 - protein, 8 aa, Plasmodium falciparum
NECPYDQN

SEQ ID NO: 3329879 - protein, 69 aa, Plasmodium falciparum
NECSGENKYTAKNECSGENKYTAKNECSGENKYTAKNECSGENKYTAKNECSAENKRVAKNDCSGEEVP

SEQ ID NO: 3329880 - protein, 10 aa, Plasmodium falciparum
NECSKKEDYY

SEQ ID NO: 3329881 - protein, 8 aa, Plasmodium falciparum
NEDATPEN

SEQ ID NO: 3329882 - protein, 14 aa, Plasmodium falciparum
NEDDEYDEMEQEDY

SEQ ID NO: 3329883 - protein, 6 aa, Plasmodium falciparum
NEDDIP

SEQ ID NO: 3329884 - protein, 10 aa, Plasmodium falciparum
NEDDKGSVTY

SEQ ID NO: 3329885 - protein, 9 aa, Plasmodium falciparum
NEDDSKKKK

SEQ ID NO: 3329886 - protein, 6 aa, Plasmodium falciparum
NEDDTL

SEQ ID NO: 3329887 - protein, 9 aa, Plasmodium falciparum
NEDDTSKGH

SEQ ID NO: 3329888 - protein, 8 aa, Plasmodium falciparum
NEDEEDYD

SEQ ID NO: 3329889 - protein, 7 aa, Plasmodium falciparum
NEDEGKG

SEQ ID NO: 3329890 - protein, 8 aa, Plasmodium falciparum
NEDEKGEK

SEQ ID NO: 3329891 - protein, 10 aa, Plasmodium falciparum
NEDEKKNNDI

SEQ ID NO: 3329892 - protein, 23 aa, Plasmodium falciparum
NEDEKNKNTNDKKTTKGESSKDI

SEQ ID NO: 3329893 - protein, 8 aa, Plasmodium falciparum
NEDEQKEL

SEQ ID NO: 3329894 - protein, 8 aa, Plasmodium falciparum
NEDGPIKG

SEQ ID NO: 3329895 - protein, 8 aa, Plasmodium falciparum
NEDGQEYI

SEQ ID NO: 3329896 - protein, 8 aa, Plasmodium falciparum
NEDGSNIN

SEQ ID NO: 3329897 - protein, 8 aa, Plasmodium falciparum
NEDGTVEE

SEQ ID NO: 3329898 - protein, 4 aa, Plasmodium falciparum
NEDH

SEQ ID NO: 3329899 - protein, 8 aa, Plasmodium falciparum
NEDIDDTE

SEQ ID NO: 3329900 - protein, 20 aa, Plasmodium falciparum
NEDIEEKKNVNNSSNTNNVD

SEQ ID NO: 3329901 - protein, 13 aa, Plasmodium falciparum
NEDIKNNNYKKEE

SEQ ID NO: 3329902 - protein, 8 aa, Plasmodium falciparum
NEDITPIE

SEQ ID NO: 3329903 - protein, 5 aa, Plasmodium falciparum
NEDKE

SEQ ID NO: 3329904 - protein, 9 aa, Plasmodium falciparum
NEDKFSSDT

SEQ ID NO: 3329905 - protein, 19 aa, Plasmodium falciparum
NEDKIDKNEIGYQKPLDEK

SEQ ID NO: 3329906 - protein, 12 aa, Plasmodium falciparum
NEDKINRDQRNY

SEQ ID NO: 3329907 - protein, 14 aa, Plasmodium falciparum
NEDKKNNIKHTPNI

SEQ ID NO: 3329908 - protein, 9 aa, Plasmodium falciparum
NEDKKQLNI

SEQ ID NO: 3329909 - protein, 8 aa, Plasmodium falciparum
NEDKNTTI

SEQ ID NO: 3329910 - protein, 6 aa, Plasmodium falciparum
NEDKQI

SEQ ID NO: 3329911 - protein, 9 aa, Plasmodium falciparum
NEDKRKKYQ

SEQ ID NO: 3329912 - protein, 10 aa, Plasmodium falciparum
NEDKTEFTNS

SEQ ID NO: 3329913 - protein, 4 aa, Plasmodium falciparum
NEDL

SEQ ID NO: 3329914 - protein, 7 aa, Plasmodium falciparum
NEDMKNE

SEQ ID NO: 3329915 - protein, 6 aa, Plasmodium falciparum
NEDMSG

SEQ ID NO: 3329916 - protein, 9 aa, Plasmodium falciparum
NEDNEDKKY

SEQ ID NO: 3329917 - protein, 78 aa, Plasmodium falciparum
NEDNENNGYNQNNEYDQNNEYDQNNEYDQNNEYDQNNEYDQNNDYNQNNDYNQNNDYNQNNDYNQNNDYNQNNDYNLN

SEQ ID NO: 3329918 - protein, 22 aa, Plasmodium falciparum
NEDNFTNKNNLTSSYDSTNIGN

SEQ ID NO: 3329919 - protein, 5 aa, Plasmodium falciparum
NEDNI

SEQ ID NO: 3329920 - protein, 14 aa, Plasmodium falciparum
NEDNITDVNKDNQE

SEQ ID NO: 3329921 - protein, 6 aa, Plasmodium falciparum
NEDNKI

SEQ ID NO: 3329922 - protein, 14 aa, Plasmodium falciparum
NEDNKKNNTNTLNN

SEQ ID NO: 3329923 - protein, 5 aa, Plasmodium falciparum
NEDNM

SEQ ID NO: 3329924 - protein, 25 aa, Plasmodium falciparum
NEDNNNNNNDSNIKKKVDGDNNTND

SEQ ID NO: 3329925 - protein, 7 aa, Plasmodium falciparum
NEDNYID

SEQ ID NO: 3329926 - protein, 6 aa, Plasmodium falciparum
NEDPNF

SEQ ID NO: 3329927 - protein, 5 aa, Plasmodium falciparum
NEDQK

SEQ ID NO: 3329928 - protein, 8 aa, Plasmodium falciparum
NEDQKGKD

SEQ ID NO: 3329929 - protein, 24 aa, Plasmodium falciparum
NEDRNKNDSSIKEMNKSNDNNHNN

SEQ ID NO: 3329930 - protein, 8 aa, Plasmodium falciparum
NEDRSEPL

SEQ ID NO: 3329931 - protein, 17 aa, Plasmodium falciparum
NEDSEKEKTETQEESLN

SEQ ID NO: 3329932 - protein, 7 aa, Plasmodium falciparum
NEDSKNY

SEQ ID NO: 3329933 - protein, 4 aa, Plasmodium falciparum
NEDT

SEQ ID NO: 3329934 - protein, 8 aa, Plasmodium falciparum
NEDTFNDG

SEQ ID NO: 3329935 - protein, 9 aa, Plasmodium falciparum
NEDTKINNV

SEQ ID NO: 3329936 - protein, 16 aa, Plasmodium falciparum
NEDTLKYSNDSTQSNV

SEQ ID NO: 3329937 - protein, 10 aa, Plasmodium falciparum
NEDTNNENKS

SEQ ID NO: 3329938 - protein, 6 aa, Plasmodium falciparum
NEDVEN

SEQ ID NO: 3329939 - protein, 8 aa, Plasmodium falciparum
NEDVKEKE

SEQ ID NO: 3329940 - protein, 9 aa, Plasmodium falciparum
NEDVNSSNC

SEQ ID NO: 3329941 - protein, 7 aa, Plasmodium falciparum
NEDVTPK

SEQ ID NO: 3329942 - protein, 11 aa, Plasmodium falciparum
NEDYEPNKPND

SEQ ID NO: 3329943 - protein, 13 aa, Plasmodium falciparum
NEDYKKKSMNSLN

SEQ ID NO: 3329944 - protein, 13 aa, Plasmodium falciparum
NEDYNNNKVEDNN

SEQ ID NO: 3329945 - protein, 4 aa, Plasmodium falciparum
NEEA

SEQ ID NO: 3329946 - protein, 6 aa, Plasmodium falciparum
NEEADH

SEQ ID NO: 3329947 - protein, 10 aa, Plasmodium falciparum
NEEAEEMRQS

SEQ ID NO: 3329948 - protein, 8 aa, Plasmodium falciparum
NEEATYNN

SEQ ID NO: 3329949 - protein, 4 aa, Plasmodium falciparum
NEED

SEQ ID NO: 3329950 - protein, 14 aa, Plasmodium falciparum
NEEDHNDDNSSELH

SEQ ID NO: 3329951 - protein, 8 aa, Plasmodium falciparum
NEEDHTYN

SEQ ID NO: 3329952 - protein, 34 aa, Plasmodium falciparum
NEEDKDDEEDDEEEDKEDDEDEEDEKNESTTNSI

SEQ ID NO: 3329953 - protein, 10 aa, Plasmodium falciparum
NEEDKNKIEE

SEQ ID NO: 3329954 - protein, 7 aa, Plasmodium falciparum
NEEDKTI

SEQ ID NO: 3329955 - protein, 8 aa, Plasmodium falciparum
NEEDPYDI

SEQ ID NO: 3329956 - protein, 21 aa, Plasmodium falciparum
NEEDRKEEGMMSQKDNENMYN

SEQ ID NO: 3329957 - protein, 5 aa, Plasmodium falciparum
NEEDS

SEQ ID NO: 3329958 - protein, 97 aa, Plasmodium falciparum
NEEDSNMNGNVNGNMNGNVNGNMNGNVNGNVNGNMNGNMNGNMNGNVNGNMNGNMNGNMNGNMNGNVNGNVNGNVNGNVNGNVNGNVNGNVNGNINE

SEQ ID NO: 3329959 - protein, 10 aa, Plasmodium falciparum
NEEDSPTKIL

SEQ ID NO: 3329960 - protein, 5 aa, Plasmodium falciparum
NEEDV

SEQ ID NO: 3329961 - protein, 6 aa, Plasmodium falciparum
NEEDYA

SEQ ID NO: 3329962 - protein, 8 aa, Plasmodium falciparum
NEEEDNIN

SEQ ID NO: 3329963 - protein, 6 aa, Plasmodium falciparum
NEEEEE

SEQ ID NO: 3329964 - protein, 13 aa, Plasmodium falciparum
NEEEEEEEEEHNL

SEQ ID NO: 3329965 - protein, 32 aa, Plasmodium falciparum
NEEEEKEENKQTNMEKRKKGRKKKKTEDIQSD

SEQ ID NO: 3329966 - protein, 8 aa, Plasmodium falciparum
NEEEENIN

SEQ ID NO: 3329967 - protein, 7 aa, Plasmodium falciparum
NEEEEQM

SEQ ID NO: 3329968 - protein, 54 aa, Plasmodium falciparum
NEEEHEKEQEREHKSEKEGEKNKNEKGGEKNKSEKGGEKNKSEKGGEKNKSDDL

SEQ ID NO: 3329969 - protein, 5 aa, Plasmodium falciparum
NEEEI

SEQ ID NO: 3329970 - protein, 15 aa, Plasmodium falciparum
NEEEKKDEEKKYRYD

SEQ ID NO: 3329971 - protein, 7 aa, Plasmodium falciparum
NEEEKKE

SEQ ID NO: 3329972 - protein, 27 aa, Plasmodium falciparum
NEEEKKNNQEKDDKHAQGQNEKNKNDI

SEQ ID NO: 3329973 - protein, 5 aa, Plasmodium falciparum
NEEEL

SEQ ID NO: 3329974 - protein, 5 aa, Plasmodium falciparum
NEEEN

SEQ ID NO: 3329975 - protein, 8 aa, Plasmodium falciparum
NEEENDEY

SEQ ID NO: 3329976 - protein, 7 aa, Plasmodium falciparum
NEEENEK

SEQ ID NO: 3329977 - protein, 19 aa, Plasmodium falciparum
NEEENGNKMEENESTNEEI

SEQ ID NO: 3329978 - protein, 48 aa, Plasmodium falciparum
NEEENKKDDEDNKNGDNKGDNYNKGDNYNKEDNYNKVDNYNKGDNYNI

SEQ ID NO: 3329979 - protein, 8 aa, Plasmodium falciparum
NEEENKLG

SEQ ID NO: 3329980 - protein, 9 aa, Plasmodium falciparum
NEEEQKEVN

SEQ ID NO: 3329981 - protein, 5 aa, Plasmodium falciparum
NEEER

SEQ ID NO: 3329982 - protein, 9 aa, Plasmodium falciparum
NEEETHQAN

SEQ ID NO: 3329983 - protein, 5 aa, Plasmodium falciparum
NEEEY

SEQ ID NO: 3329984 - protein, 6 aa, Plasmodium falciparum
NEEEYK

SEQ ID NO: 3329985 - protein, 6 aa, Plasmodium falciparum
NEEEYN

SEQ ID NO: 3329986 - protein, 4 aa, Plasmodium falciparum
NEEF

SEQ ID NO: 3329987 - protein, 7 aa, Plasmodium falciparum
NEEFEEL

SEQ ID NO: 3329988 - protein, 7 aa, Plasmodium falciparum
NEEFESH

SEQ ID NO: 3329989 - protein, 19 aa, Plasmodium falciparum
NEEFNSSNEETTIKSSNEN

SEQ ID NO: 3329990 - protein, 5 aa, Plasmodium falciparum
NEEFR

SEQ ID NO: 3329991 - protein, 8 aa, Plasmodium falciparum
NEEGEKRK

SEQ ID NO: 3329992 - protein, 7 aa, Plasmodium falciparum
NEEGERK

SEQ ID NO: 3329993 - protein, 12 aa, Plasmodium falciparum
NEEGGRKNPFSS

SEQ ID NO: 3329994 - protein, 8 aa, Plasmodium falciparum
NEEGKLNY

SEQ ID NO: 3329995 - protein, 13 aa, Plasmodium falciparum
NEEGYYDKRPYEY

SEQ ID NO: 3329996 - protein, 4 aa, Plasmodium falciparum
NEEH

SEQ ID NO: 3329997 - protein, 11 aa, Plasmodium falciparum
NEEHDDINEQN

SEQ ID NO: 3329998 - protein, 5 aa, Plasmodium falciparum
NEEHH

SEQ ID NO: 3329999 - protein, 7 aa, Plasmodium falciparum
NEEHNNH

SEQ ID NO: 3330000 - protein, 13 aa, Plasmodium falciparum
NEEIEKNNNYNNK

SEQ ID NO: 3330001 - protein, 5 aa, Plasmodium falciparum
NEEIS

SEQ ID NO: 3330002 - protein, 4 aa, Plasmodium falciparum
NEEK

SEQ ID NO: 3330003 - protein, 5 aa, Plasmodium falciparum
NEEKD

SEQ ID NO: 3330004 - protein, 13 aa, Plasmodium falciparum
NEEKEKEEEKESN

SEQ ID NO: 3330005 - protein, 20 aa, Plasmodium falciparum
NEEKEKKEEPRKNQKIESEE

SEQ ID NO: 3330006 - protein, 11 aa, Plasmodium falciparum
NEEKEKRNEQD

SEQ ID NO: 3330007 - protein, 8 aa, Plasmodium falciparum
NEEKGHNN

SEQ ID NO: 3330008 - protein, 14 aa, Plasmodium falciparum
NEEKGKNKKTNQHI

SEQ ID NO: 3330009 - protein, 9 aa, Plasmodium falciparum
NEEKKKRKE

SEQ ID NO: 3330010 - protein, 9 aa, Plasmodium falciparum
NEEKKNSPF

SEQ ID NO: 3330011 - protein, 9 aa, Plasmodium falciparum
NEEKKYEEI

SEQ ID NO: 3330012 - protein, 5 aa, Plasmodium falciparum
NEEKL

SEQ ID NO: 3330013 - protein, 6 aa, Plasmodium falciparum
NEEKLA

SEQ ID NO: 3330014 - protein, 8 aa, Plasmodium falciparum
NEEKLKEK

SEQ ID NO: 3330015 - protein, 5 aa, Plasmodium falciparum
NEEKN

SEQ ID NO: 3330016 - protein, 9 aa, Plasmodium falciparum
NEEKNGENR

SEQ ID NO: 3330017 - protein, 21 aa, Plasmodium falciparum
NEEKNHKRNSINTKDEKQSSV

SEQ ID NO: 3330018 - protein, 19 aa, Plasmodium falciparum
NEEKNKCLEEENNKMENEK

SEQ ID NO: 3330019 - protein, 9 aa, Plasmodium falciparum
NEEKNKDIN

SEQ ID NO: 3330020 - protein, 20 aa, Plasmodium falciparum
NEEKNNNQKEEENRDKKINH

SEQ ID NO: 3330021 - protein, 12 aa, Plasmodium falciparum
NEEKPSPLQEPY

SEQ ID NO: 3330022 - protein, 23 aa, Plasmodium falciparum
NEEKSGDEEEKSIEKKNGEKNKI

SEQ ID NO: 3330023 - protein, 10 aa, Plasmodium falciparum
NEEKTNKSSC

SEQ ID NO: 3330024 - protein, 4 aa, Plasmodium falciparum
NEEL

SEQ ID NO: 3330025 - protein, 24 aa, Plasmodium falciparum
NEELENENDDEDKSDEERKDNNDI

SEQ ID NO: 3330026 - protein, 19 aa, Plasmodium falciparum
NEELPKSTIASEVPNHNSN

SEQ ID NO: 3330027 - protein, 4 aa, Plasmodium falciparum
NEEM

SEQ ID NO: 3330028 - protein, 12 aa, Plasmodium falciparum
NEEMKKYNENST

SEQ ID NO: 3330029 - protein, 11 aa, Plasmodium falciparum
NEEMSSNNDQN

SEQ ID NO: 3330030 - protein, 5 aa, Plasmodium falciparum
NEEND

SEQ ID NO: 3330031 - protein, 8 aa, Plasmodium falciparum
NEENDYPQ

SEQ ID NO: 3330032 - protein, 5 aa, Plasmodium falciparum
NEENE

SEQ ID NO: 3330033 - protein, 9 aa, Plasmodium falciparum
NEENENNDN

SEQ ID NO: 3330034 - protein, 25 aa, Plasmodium falciparum
NEENERASCTSQNDEDDEKKKKKKN

SEQ ID NO: 3330035 - protein, 6 aa, Plasmodium falciparum
NEENIE

SEQ ID NO: 3330036 - protein, 5 aa, Plasmodium falciparum
NEENK

SEQ ID NO: 3330037 - protein, 9 aa, Plasmodium falciparum
NEENKNYSH

SEQ ID NO: 3330038 - protein, 12 aa, Plasmodium falciparum
NEENKYGNDDRH

SEQ ID NO: 3330039 - protein, 42 aa, Plasmodium falciparum
NEENNEENNEENNEENNEENNEENNKENNKEYNNDNNNDNYS

SEQ ID NO: 3330040 - protein, 10 aa, Plasmodium falciparum
NEENNETNNI

SEQ ID NO: 3330041 - protein, 15 aa, Plasmodium falciparum
NEENNKNNKSNKSEV

SEQ ID NO: 3330042 - protein, 8 aa, Plasmodium falciparum
NEENNSKI

SEQ ID NO: 3330043 - protein, 29 aa, Plasmodium falciparum
NEENNTKENICDEDKNKKSKKKKKKKKKI

SEQ ID NO: 3330044 - protein, 7 aa, Plasmodium falciparum
NEENQKD

SEQ ID NO: 3330045 - protein, 8 aa, Plasmodium falciparum
NEENRQIN

SEQ ID NO: 3330046 - protein, 12 aa, Plasmodium falciparum
NEENSTNSNSYK

SEQ ID NO: 3330047 - protein, 14 aa, Plasmodium falciparum
NEENVENKKEENDK

SEQ ID NO: 3330048 - protein, 19 aa, Plasmodium falciparum
NEENVNEQINKEHKKNEKM

SEQ ID NO: 3330049 - protein, 16 aa, Plasmodium falciparum
NEEPYDKSLNNSHTTY

SEQ ID NO: 3330050 - protein, 4 aa, Plasmodium falciparum
NEEQ

SEQ ID NO: 3330051 - protein, 19 aa, Plasmodium falciparum
NEEQKSGYIKKGGEEFNTY

SEQ ID NO: 3330052 - protein, 11 aa, Plasmodium falciparum
NEEQKYKKTED

SEQ ID NO: 3330053 - protein, 8 aa, Plasmodium falciparum
NEEQNYDV

SEQ ID NO: 3330054 - protein, 4 aa, Plasmodium falciparum
NEER

SEQ ID NO: 3330055 - protein, 6 aa, Plasmodium falciparum
NEERIE

SEQ ID NO: 3330056 - protein, 11 aa, Plasmodium falciparum
NEERKEKETLK

SEQ ID NO: 3330057 - protein, 7 aa, Plasmodium falciparum
NEERQQN

SEQ ID NO: 3330058 - protein, 15 aa, Plasmodium falciparum
NEERVGKDVSNQISD

SEQ ID NO: 3330059 - protein, 7 aa, Plasmodium falciparum
NEERVNK

SEQ ID NO: 3330060 - protein, 14 aa, Plasmodium falciparum
NEESDEKKKENDTI

SEQ ID NO: 3330061 - protein, 7 aa, Plasmodium falciparum
NEESDSH

SEQ ID NO: 3330062 - protein, 10 aa, Plasmodium falciparum
NEESEKYKKN

SEQ ID NO: 3330063 - protein, 5 aa, Plasmodium falciparum
NEESI

SEQ ID NO: 3330064 - protein, 9 aa, Plasmodium falciparum
NEESINEEN

SEQ ID NO: 3330065 - protein, 6 aa, Plasmodium falciparum
NEESKD

SEQ ID NO: 3330066 - protein, 11 aa, Plasmodium falciparum
NEESLKTNEEI

SEQ ID NO: 3330067 - protein, 12 aa, Plasmodium falciparum
NEESPNNTEGEK

SEQ ID NO: 3330068 - protein, 8 aa, Plasmodium falciparum
NEESTQND

SEQ ID NO: 3330069 - protein, 5 aa, Plasmodium falciparum
NEESY

SEQ ID NO: 3330070 - protein, 4 aa, Plasmodium falciparum
NEET

SEQ ID NO: 3330071 - protein, 12 aa, Plasmodium falciparum
NEETDKLEAEQP

SEQ ID NO: 3330072 - protein, 6 aa, Plasmodium falciparum
NEETER

SEQ ID NO: 3330073 - protein, 7 aa, Plasmodium falciparum
NEETIHD

SEQ ID NO: 3330074 - protein, 13 aa, Plasmodium falciparum
NEETINEKDDEIM

SEQ ID NO: 3330075 - protein, 8 aa, Plasmodium falciparum
NEETKKDT

SEQ ID NO: 3330076 - protein, 18 aa, Plasmodium falciparum
NEETKKQIQDNNENIDNT

SEQ ID NO: 3330077 - protein, 7 aa, Plasmodium falciparum
NEETNNN

SEQ ID NO: 3330078 - protein, 6 aa, Plasmodium falciparum
NEETTI

SEQ ID NO: 3330079 - protein, 10 aa, Plasmodium falciparum
NEETVENHRN

SEQ ID NO: 3330080 - protein, 5 aa, Plasmodium falciparum
NEEVA

SEQ ID NO: 3330081 - protein, 13 aa, Plasmodium falciparum
NEEVDKENEYDEN

SEQ ID NO: 3330082 - protein, 13 aa, Plasmodium falciparum
NEEVKKKKKYKNT

SEQ ID NO: 3330083 - protein, 10 aa, Plasmodium falciparum
NEEVNTKNNY

SEQ ID NO: 3330084 - protein, 10 aa, Plasmodium falciparum
NEEYENYSNN

SEQ ID NO: 3330085 - protein, 23 aa, Plasmodium falciparum
NEEYETQNDNMKKNNNNNNNNNV

SEQ ID NO: 3330086 - protein, 5 aa, Plasmodium falciparum
NEEYK

SEQ ID NO: 3330087 - protein, 5 aa, Plasmodium falciparum
NEEYN

SEQ ID NO: 3330088 - protein, 8 aa, Plasmodium falciparum
NEEYSGAG

SEQ ID NO: 3330089 - protein, 13 aa, Plasmodium falciparum
NEEYTKKKEEYDQ

SEQ ID NO: 3330090 - protein, 9 aa, Plasmodium falciparum
NEFAESNNY

SEQ ID NO: 3330091 - protein, 13 aa, Plasmodium falciparum
NEFDDNKGRNSNL

SEQ ID NO: 3330092 - protein, 9 aa, Plasmodium falciparum
NEFDKNKER

SEQ ID NO: 3330093 - protein, 5 aa, Plasmodium falciparum
NEFEE

SEQ ID NO: 3330094 - protein, 6 aa, Plasmodium falciparum
NEFGGN

SEQ ID NO: 3330095 - protein, 4 aa, Plasmodium falciparum
NEFN

SEQ ID NO: 3330096 - protein, 9 aa, Plasmodium falciparum
NEFNESKDN

SEQ ID NO: 3330097 - protein, 37 aa, Plasmodium falciparum
NEFPKGNKRNVPNNTKDKEDINNDNNNNNNNNKNNIN

SEQ ID NO: 3330098 - protein, 21 aa, Plasmodium falciparum
NEFSDMKDNKNDGKVNENSGE

SEQ ID NO: 3330099 - protein, 7 aa, Plasmodium falciparum
NEGAERT

SEQ ID NO: 3330100 - protein, 9 aa, Plasmodium falciparum
NEGDDDTKR

SEQ ID NO: 3330101 - protein, 6 aa, Plasmodium falciparum
NEGDND

SEQ ID NO: 3330102 - protein, 25 aa, Plasmodium falciparum
NEGDNDKIEDTNKNDDISNNSEVTN

SEQ ID NO: 3330103 - protein, 14 aa, Plasmodium falciparum
NEGDTSDDGDNQIN

SEQ ID NO: 3330104 - protein, 7 aa, Plasmodium falciparum
NEGENVI

SEQ ID NO: 3330105 - protein, 5 aa, Plasmodium falciparum
NEGFK

SEQ ID NO: 3330106 - protein, 4 aa, Plasmodium falciparum
NEGG

SEQ ID NO: 3330107 - protein, 8 aa, Plasmodium falciparum
NEGGNNVD

SEQ ID NO: 3330108 - protein, 10 aa, Plasmodium falciparum
NEGIPTPEDL

SEQ ID NO: 3330109 - protein, 4 aa, Plasmodium falciparum
NEGK

SEQ ID NO: 3330110 - protein, 6 aa, Plasmodium falciparum
NEGKNH

SEQ ID NO: 3330111 - protein, 23 aa, Plasmodium falciparum
NEGKNKEQNKDGDKKKVKKLNYD

SEQ ID NO: 3330112 - protein, 6 aa, Plasmodium falciparum
NEGKNP

SEQ ID NO: 3330113 - protein, 8 aa, Plasmodium falciparum
NEGKSKGY

SEQ ID NO: 3330114 - protein, 8 aa, Plasmodium falciparum
NEGKSLGV

SEQ ID NO: 3330115 - protein, 5 aa, Plasmodium falciparum
NEGMN

SEQ ID NO: 3330116 - protein, 6 aa, Plasmodium falciparum
NEGNAR

SEQ ID NO: 3330117 - protein, 31 aa, Plasmodium falciparum
NEGNENHHQTNNNHSDSTNNEEKNNIESSNT

SEQ ID NO: 3330118 - protein, 12 aa, Plasmodium falciparum
NEGNKISDNNIY

SEQ ID NO: 3330119 - protein, 11 aa, Plasmodium falciparum
NEGNKKNKIEK

SEQ ID NO: 3330120 - protein, 8 aa, Plasmodium falciparum
NEGNLTDI

SEQ ID NO: 3330121 - protein, 7 aa, Plasmodium falciparum
NEGNNNM

SEQ ID NO: 3330122 - protein, 41 aa, Plasmodium falciparum
NEGNYYKKDPYHNNSSNNNNNTTGTNKKNNYYNNRSMPYKD

SEQ ID NO: 3330123 - protein, 6 aa, Plasmodium falciparum
NEGQSI

SEQ ID NO: 3330124 - protein, 8 aa, Plasmodium falciparum
NEGSINDI

SEQ ID NO: 3330125 - protein, 10 aa, Plasmodium falciparum
NEGSSKKTPY

SEQ ID NO: 3330126 - protein, 10 aa, Plasmodium falciparum
NEGSTNKNNS

SEQ ID NO: 3330127 - protein, 4 aa, Plasmodium falciparum
NEGT

SEQ ID NO: 3330128 - protein, 9 aa, Plasmodium falciparum
NEGTNNMNR

SEQ ID NO: 3330129 - protein, 6 aa, Plasmodium falciparum
NEGVDI

SEQ ID NO: 3330130 - protein, 10 aa, Plasmodium falciparum
NEHDIKKKRK

SEQ ID NO: 3330131 - protein, 59 aa, Plasmodium falciparum
NEHEKEDEHQYKRKDEKEDEHQYKRKDEKEDEHQYKRENEKEDEHQYKREDEKEDEHQY

SEQ ID NO: 3330132 - protein, 33 aa, Plasmodium falciparum
NEHGEDINKNEHSDDNNKNEHGDDNNKNEHGDY

SEQ ID NO: 3330133 - protein, 6 aa, Plasmodium falciparum
NEHHHD

SEQ ID NO: 3330134 - protein, 7 aa, Plasmodium falciparum
NEHHTNQ

SEQ ID NO: 3330135 - protein, 7 aa, Plasmodium falciparum
NEHKANE

SEQ ID NO: 3330136 - protein, 12 aa, Plasmodium falciparum
NEHKNNKNSALE

SEQ ID NO: 3330137 - protein, 7 aa, Plasmodium falciparum
NEHKQNK

SEQ ID NO: 3330138 - protein, 10 aa, Plasmodium falciparum
NEHNKKQKEA

SEQ ID NO: 3330139 - protein, 7 aa, Plasmodium falciparum
NEHNNNN

SEQ ID NO: 3330140 - protein, 17 aa, Plasmodium falciparum
NEHNNNPVGGTNKLSDK

SEQ ID NO: 3330141 - protein, 13 aa, Plasmodium falciparum
NEHNTNKRKKKSV

SEQ ID NO: 3330142 - protein, 5 aa, Plasmodium falciparum
NEHNY

SEQ ID NO: 3330143 - protein, 15 aa, Plasmodium falciparum
NEHREYGDDDDDDFN

SEQ ID NO: 3330144 - protein, 17 aa, Plasmodium falciparum
NEHSENGNNSKHTNSDI

SEQ ID NO: 3330145 - protein, 67 aa, Plasmodium falciparum
NEHSKENKENEKNETNEKNATNETNEKNEKNETNETNETNQTNQTNQTNQTNQTNQTNQTNETNQTN

SEQ ID NO: 3330146 - protein, 6 aa, Plasmodium falciparum
NEHTNN

SEQ ID NO: 3330147 - protein, 12 aa, Plasmodium falciparum
NEIAKKDNKNKL

SEQ ID NO: 3330148 - protein, 13 aa, Plasmodium falciparum
NEIDENRKIKKKE

SEQ ID NO: 3330149 - protein, 6 aa, Plasmodium falciparum
NEIDST

SEQ ID NO: 3330150 - protein, 4 aa, Plasmodium falciparum
NEIE

SEQ ID NO: 3330151 - protein, 8 aa, Plasmodium falciparum
NEIEDTNK

SEQ ID NO: 3330152 - protein, 6 aa, Plasmodium falciparum
NEIEEK

SEQ ID NO: 3330153 - protein, 6 aa, Plasmodium falciparum
NEIEKK

SEQ ID NO: 3330154 - protein, 8 aa, Plasmodium falciparum
NEIEKSER

SEQ ID NO: 3330155 - protein, 9 aa, Plasmodium falciparum
NEIEPRSNK

SEQ ID NO: 3330156 - protein, 6 aa, Plasmodium falciparum
NEIGGI

SEQ ID NO: 3330157 - protein, 5 aa, Plasmodium falciparum
NEIGN

SEQ ID NO: 3330158 - protein, 8 aa, Plasmodium falciparum
NEIKPNEH

SEQ ID NO: 3330159 - protein, 4 aa, Plasmodium falciparum
NEIN

SEQ ID NO: 3330160 - protein, 20 aa, Plasmodium falciparum
NEINEEIKEREKKKEKEKEE

SEQ ID NO: 3330161 - protein, 7 aa, Plasmodium falciparum
NEINEKK

SEQ ID NO: 3330162 - protein, 7 aa, Plasmodium falciparum
NEINPQK

SEQ ID NO: 3330163 - protein, 6 aa, Plasmodium falciparum
NEINQN

SEQ ID NO: 3330164 - protein, 7 aa, Plasmodium falciparum
NEINSDD

SEQ ID NO: 3330165 - protein, 15 aa, Plasmodium falciparum
NEIPEVDKEKDSDGI

SEQ ID NO: 3330166 - protein, 6 aa, Plasmodium falciparum
NEIPGL

SEQ ID NO: 3330167 - protein, 6 aa, Plasmodium falciparum
NEIQEK

SEQ ID NO: 3330168 - protein, 10 aa, Plasmodium falciparum
NEIQKDDNDI

SEQ ID NO: 3330169 - protein, 24 aa, Plasmodium falciparum
NEIRKSTNNNYNNINRDKRNTHRS

SEQ ID NO: 3330170 - protein, 5 aa, Plasmodium falciparum
NEISK

SEQ ID NO: 3330171 - protein, 15 aa, Plasmodium falciparum
NEISSSEKEQRQNNI

SEQ ID NO: 3330172 - protein, 22 aa, Plasmodium falciparum
NEISTDNTYEYTNDEYNEDIDD

SEQ ID NO: 3330173 - protein, 12 aa, Plasmodium falciparum
NEITDINNKDNS

SEQ ID NO: 3330174 - protein, 13 aa, Plasmodium falciparum
NEITNEKSYRKGK

SEQ ID NO: 3330175 - protein, 4 aa, Plasmodium falciparum
NEKA

SEQ ID NO: 3330176 - protein, 8 aa, Plasmodium falciparum
NEKALEKN

SEQ ID NO: 3330177 - protein, 5 aa, Plasmodium falciparum
NEKDD

SEQ ID NO: 3330178 - protein, 7 aa, Plasmodium falciparum
NEKDDRK

SEQ ID NO: 3330179 - protein, 5 aa, Plasmodium falciparum
NEKDK

SEQ ID NO: 3330180 - protein, 63 aa, Plasmodium falciparum
NEKDKDKDKGKGKEKNKNNNKQNNDRDKNNNEENNNNEDNNKDNNNNNNNNNNNNNNNNNNNK

SEQ ID NO: 3330181 - protein, 6 aa, Plasmodium falciparum
NEKDKG

SEQ ID NO: 3330182 - protein, 16 aa, Plasmodium falciparum
NEKDKKNDNNNSNNVV

SEQ ID NO: 3330183 - protein, 16 aa, Plasmodium falciparum
NEKDKNINKEKNKKQM

SEQ ID NO: 3330184 - protein, 21 aa, Plasmodium falciparum
NEKDNSDVTEYKENSSNSYDK

SEQ ID NO: 3330185 - protein, 9 aa, Plasmodium falciparum
NEKDPTSNK

SEQ ID NO: 3330186 - protein, 17 aa, Plasmodium falciparum
NEKDQIDQQQEQKENIN

SEQ ID NO: 3330187 - protein, 16 aa, Plasmodium falciparum
NEKDTKKKKKKQEGNC

SEQ ID NO: 3330188 - protein, 26 aa, Plasmodium falciparum
NEKDTTKNKRKDISTNEDEKDRKKKK

SEQ ID NO: 3330189 - protein, 8 aa, Plasmodium falciparum
NEKDVDQL

SEQ ID NO: 3330190 - protein, 15 aa, Plasmodium falciparum
NEKDVNEKNNENVEN

SEQ ID NO: 3330191 - protein, 4 aa, Plasmodium falciparum
NEKE

SEQ ID NO: 3330192 - protein, 5 aa, Plasmodium falciparum
NEKEA

SEQ ID NO: 3330193 - protein, 15 aa, Plasmodium falciparum
NEKEENADKNEPNNL

SEQ ID NO: 3330194 - protein, 8 aa, Plasmodium falciparum
NEKEENEK

SEQ ID NO: 3330195 - protein, 10 aa, Plasmodium falciparum
NEKEENEKRN

SEQ ID NO: 3330196 - protein, 7 aa, Plasmodium falciparum
NEKEGIG

SEQ ID NO: 3330197 - protein, 15 aa, Plasmodium falciparum
NEKEGMGKSKERKGY

SEQ ID NO: 3330198 - protein, 6 aa, Plasmodium falciparum
NEKEGV

SEQ ID NO: 3330199 - protein, 6 aa, Plasmodium falciparum
NEKEIN

SEQ ID NO: 3330200 - protein, 6 aa, Plasmodium falciparum
NEKEIQ

SEQ ID NO: 3330201 - protein, 5 aa, Plasmodium falciparum
NEKEK

SEQ ID NO: 3330202 - protein, 10 aa, Plasmodium falciparum
NEKEKEDDNY

SEQ ID NO: 3330203 - protein, 8 aa, Plasmodium falciparum
NEKEKEDN

SEQ ID NO: 3330204 - protein, 36 aa, Plasmodium falciparum
NEKEKEKEKKKGKNKKKKNYMNDANNNNNNNNNNEK

SEQ ID NO: 3330205 - protein, 8 aa, Plasmodium falciparum
NEKEKENI

SEQ ID NO: 3330206 - protein, 16 aa, Plasmodium falciparum
NEKEKETNNENTSNVN

SEQ ID NO: 3330207 - protein, 11 aa, Plasmodium falciparum
NEKEKNDINNE

SEQ ID NO: 3330208 - protein, 6 aa, Plasmodium falciparum
NEKELE

SEQ ID NO: 3330209 - protein, 5 aa, Plasmodium falciparum
NEKEM

SEQ ID NO: 3330210 - protein, 5 aa, Plasmodium falciparum
NEKEN

SEQ ID NO: 3330211 - protein, 9 aa, Plasmodium falciparum
NEKENDDLY

SEQ ID NO: 3330212 - protein, 9 aa, Plasmodium falciparum
NEKENDEFE

SEQ ID NO: 3330213 - protein, 6 aa, Plasmodium falciparum
NEKENE

SEQ ID NO: 3330214 - protein, 7 aa, Plasmodium falciparum
NEKENES

SEQ ID NO: 3330215 - protein, 11 aa, Plasmodium falciparum
NEKENKYNDQD

SEQ ID NO: 3330216 - protein, 9 aa, Plasmodium falciparum
NEKENSYKY

SEQ ID NO: 3330217 - protein, 11 aa, Plasmodium falciparum
NEKENVTSNKN

SEQ ID NO: 3330218 - protein, 20 aa, Plasmodium falciparum
NEKENYKSMDNSTNSIEEDE

SEQ ID NO: 3330219 - protein, 8 aa, Plasmodium falciparum
NEKERQKK

SEQ ID NO: 3330220 - protein, 15 aa, Plasmodium falciparum
NEKETGNMKQGNESK

SEQ ID NO: 3330221 - protein, 7 aa, Plasmodium falciparum
NEKETIR

SEQ ID NO: 3330222 - protein, 7 aa, Plasmodium falciparum
NEKETTD

SEQ ID NO: 3330223 - protein, 20 aa, Plasmodium falciparum
NEKETYKEQNNNNNNDDDDN

SEQ ID NO: 3330224 - protein, 5 aa, Plasmodium falciparum
NEKEY

SEQ ID NO: 3330225 - protein, 14 aa, Plasmodium falciparum
NEKEYKEKLQEMSE

SEQ ID NO: 3330226 - protein, 14 aa, Plasmodium falciparum
NEKFSGYAQTRNLA

SEQ ID NO: 3330227 - protein, 18 aa, Plasmodium falciparum
NEKGGNENTKKKNKNTTS

SEQ ID NO: 3330228 - protein, 7 aa, Plasmodium falciparum
NEKGKEL

SEQ ID NO: 3330229 - protein, 50 aa, Plasmodium falciparum
NEKGMEKGMEKGMEKGMEKGMEKGMEKGMEKGMEKGMEKGMEKGMEKGME

SEQ ID NO: 3330230 - protein, 9 aa, Plasmodium falciparum
NEKGNTIKN

SEQ ID NO: 3330231 - protein, 24 aa, Plasmodium falciparum
NEKGNYNNKKKKKQKNEHKKEANF

SEQ ID NO: 3330232 - protein, 9 aa, Plasmodium falciparum
NEKGSVKKI

SEQ ID NO: 3330233 - protein, 10 aa, Plasmodium falciparum
NEKGTYKSNN

SEQ ID NO: 3330234 - protein, 4 aa, Plasmodium falciparum
NEKH

SEQ ID NO: 3330235 - protein, 5 aa, Plasmodium falciparum
NEKHI

SEQ ID NO: 3330236 - protein, 12 aa, Plasmodium falciparum
NEKHQNDDEDIK

SEQ ID NO: 3330237 - protein, 6 aa, Plasmodium falciparum
NEKIDK

SEQ ID NO: 3330238 - protein, 6 aa, Plasmodium falciparum
NEKIEA

SEQ ID NO: 3330239 - protein, 5 aa, Plasmodium falciparum
NEKIN

SEQ ID NO: 3330240 - protein, 13 aa, Plasmodium falciparum
NEKINNTLSDDDI

SEQ ID NO: 3330241 - protein, 7 aa, Plasmodium falciparum
NEKINTN

SEQ ID NO: 3330242 - protein, 13 aa, Plasmodium falciparum
NEKIRKTNNSNKI

SEQ ID NO: 3330243 - protein, 5 aa, Plasmodium falciparum
NEKKD

SEQ ID NO: 3330244 - protein, 8 aa, Plasmodium falciparum
NEKKDKRF

SEQ ID NO: 3330245 - protein, 6 aa, Plasmodium falciparum
NEKKDM

SEQ ID NO: 3330246 - protein, 7 aa, Plasmodium falciparum
NEKKDPV

SEQ ID NO: 3330247 - protein, 6 aa, Plasmodium falciparum
NEKKEI

SEQ ID NO: 3330248 - protein, 11 aa, Plasmodium falciparum
NEKKEKEKKME

SEQ ID NO: 3330249 - protein, 10 aa, Plasmodium falciparum
NEKKENDKFD

SEQ ID NO: 3330250 - protein, 8 aa, Plasmodium falciparum
NEKKIKQT

SEQ ID NO: 3330251 - protein, 6 aa, Plasmodium falciparum
NEKKIY

SEQ ID NO: 3330252 - protein, 5 aa, Plasmodium falciparum
NEKKK

SEQ ID NO: 3330253 - protein, 7 aa, Plasmodium falciparum
NEKKKGN

SEQ ID NO: 3330254 - protein, 9 aa, Plasmodium falciparum
NEKKKISDE

SEQ ID NO: 3330255 - protein, 9 aa, Plasmodium falciparum
NEKKKKMKS

SEQ ID NO: 3330256 - protein, 11 aa, Plasmodium falciparum
NEKKKKVQAVS

SEQ ID NO: 3330257 - protein, 6 aa, Plasmodium falciparum
NEKKKN

SEQ ID NO: 3330258 - protein, 10 aa, Plasmodium falciparum
NEKKKNANNI

SEQ ID NO: 3330259 - protein, 10 aa, Plasmodium falciparum
NEKKKNNITI

SEQ ID NO: 3330260 - protein, 10 aa, Plasmodium falciparum
NEKKKSNNTF

SEQ ID NO: 3330261 - protein, 9 aa, Plasmodium falciparum
NEKKKTTPC

SEQ ID NO: 3330262 - protein, 6 aa, Plasmodium falciparum
NEKKKV

SEQ ID NO: 3330263 - protein, 13 aa, Plasmodium falciparum
NEKKLEKNSIEKK

SEQ ID NO: 3330264 - protein, 11 aa, Plasmodium falciparum
NEKKMKKKKEM

SEQ ID NO: 3330265 - protein, 5 aa, Plasmodium falciparum
NEKKN

SEQ ID NO: 3330266 - protein, 14 aa, Plasmodium falciparum
NEKKNKQKKEKKYN

SEQ ID NO: 3330267 - protein, 9 aa, Plasmodium falciparum
NEKKNSSKN

SEQ ID NO: 3330268 - protein, 5 aa, Plasmodium falciparum
NEKKR

SEQ ID NO: 3330269 - protein, 5 aa, Plasmodium falciparum
NEKKS

SEQ ID NO: 3330270 - protein, 9 aa, Plasmodium falciparum
NEKKSKSIA

SEQ ID NO: 3330271 - protein, 16 aa, Plasmodium falciparum
NEKKTNEQKDKQIEKQ

SEQ ID NO: 3330272 - protein, 9 aa, Plasmodium falciparum
NEKKTNVDI

SEQ ID NO: 3330273 - protein, 5 aa, Plasmodium falciparum
NEKKV

SEQ ID NO: 3330274 - protein, 26 aa, Plasmodium falciparum
NEKLNAQTSGTYKRSLQTQKGSEDDN

SEQ ID NO: 3330275 - protein, 7 aa, Plasmodium falciparum
NEKMSMS

SEQ ID NO: 3330276 - protein, 5 aa, Plasmodium falciparum
NEKNE

SEQ ID NO: 3330277 - protein, 7 aa, Plasmodium falciparum
NEKNEDK

SEQ ID NO: 3330278 - protein, 6 aa, Plasmodium falciparum
NEKNEE

SEQ ID NO: 3330279 - protein, 9 aa, Plasmodium falciparum
NEKNEKEKC

SEQ ID NO: 3330280 - protein, 8 aa, Plasmodium falciparum
NEKNEKNG

SEQ ID NO: 3330281 - protein, 6 aa, Plasmodium falciparum
NEKNGF

SEQ ID NO: 3330282 - protein, 13 aa, Plasmodium falciparum
NEKNGKKDHMNDS

SEQ ID NO: 3330283 - protein, 5 aa, Plasmodium falciparum
NEKNI

SEQ ID NO: 3330284 - protein, 9 aa, Plasmodium falciparum
NEKNIANES

SEQ ID NO: 3330285 - protein, 11 aa, Plasmodium falciparum
NEKNKEESPKY

SEQ ID NO: 3330286 - protein, 8 aa, Plasmodium falciparum
NEKNKENK

SEQ ID NO: 3330287 - protein, 10 aa, Plasmodium falciparum
NEKNKKINVP

SEQ ID NO: 3330288 - protein, 10 aa, Plasmodium falciparum
NEKNKQNDSS

SEQ ID NO: 3330289 - protein, 9 aa, Plasmodium falciparum
NEKNKRTSE

SEQ ID NO: 3330290 - protein, 13 aa, Plasmodium falciparum
NEKNKTKKKCNLK

SEQ ID NO: 3330291 - protein, 6 aa, Plasmodium falciparum
NEKNLY

SEQ ID NO: 3330292 - protein, 8 aa, Plasmodium falciparum
NEKNMNAE

SEQ ID NO: 3330293 - protein, 11 aa, Plasmodium falciparum
NEKNNDDKNMS

SEQ ID NO: 3330294 - protein, 26 aa, Plasmodium falciparum
NEKNNHASDNNNQMKKKKKKSSIDKR

SEQ ID NO: 3330295 - protein, 6 aa, Plasmodium falciparum
NEKNNI

SEQ ID NO: 3330296 - protein, 11 aa, Plasmodium falciparum
NEKNPKEYDNK

SEQ ID NO: 3330297 - protein, 5 aa, Plasmodium falciparum
NEKNQ

SEQ ID NO: 3330298 - protein, 5 aa, Plasmodium falciparum
NEKNS

SEQ ID NO: 3330299 - protein, 8 aa, Plasmodium falciparum
NEKNTPLK

SEQ ID NO: 3330300 - protein, 8 aa, Plasmodium falciparum
NEKNVESL

SEQ ID NO: 3330301 - protein, 8 aa, Plasmodium falciparum
NEKNYKDT

SEQ ID NO: 3330302 - protein, 6 aa, Plasmodium falciparum
NEKQKK

SEQ ID NO: 3330303 - protein, 30 aa, Plasmodium falciparum
NEKQKKKNDPKNDKIDEGQVPNKELSQNNE

SEQ ID NO: 3330304 - protein, 19 aa, Plasmodium falciparum
NEKQNEANNFGPNEQTPEY

SEQ ID NO: 3330305 - protein, 10 aa, Plasmodium falciparum
NEKQNEELEK

SEQ ID NO: 3330306 - protein, 11 aa, Plasmodium falciparum
NEKQQKIDEQD

SEQ ID NO: 3330307 - protein, 4 aa, Plasmodium falciparum
NEKR

SEQ ID NO: 3330308 - protein, 7 aa, Plasmodium falciparum
NEKRGMG

SEQ ID NO: 3330309 - protein, 5 aa, Plasmodium falciparum
NEKRK

SEQ ID NO: 3330310 - protein, 17 aa, Plasmodium falciparum
NEKRKMKRKKKRRRRRK

SEQ ID NO: 3330311 - protein, 15 aa, Plasmodium falciparum
NEKRKYYENNAHNDT

SEQ ID NO: 3330312 - protein, 8 aa, Plasmodium falciparum
NEKRNISK

SEQ ID NO: 3330313 - protein, 6 aa, Plasmodium falciparum
NEKRNN

SEQ ID NO: 3330314 - protein, 6 aa, Plasmodium falciparum
NEKRPN

SEQ ID NO: 3330315 - protein, 5 aa, Plasmodium falciparum
NEKRS

SEQ ID NO: 3330316 - protein, 5 aa, Plasmodium falciparum
NEKSE

SEQ ID NO: 3330317 - protein, 13 aa, Plasmodium falciparum
NEKSKKAKEATYV

SEQ ID NO: 3330318 - protein, 18 aa, Plasmodium falciparum
NEKSNMIENSETHDYTEK

SEQ ID NO: 3330319 - protein, 8 aa, Plasmodium falciparum
NEKSQSKK

SEQ ID NO: 3330320 - protein, 9 aa, Plasmodium falciparum
NEKSSEREK

SEQ ID NO: 3330321 - protein, 9 aa, Plasmodium falciparum
NEKSSSSFF

SEQ ID NO: 3330322 - protein, 7 aa, Plasmodium falciparum
NEKSTDV

SEQ ID NO: 3330323 - protein, 6 aa, Plasmodium falciparum
NEKSTN

SEQ ID NO: 3330324 - protein, 7 aa, Plasmodium falciparum
NEKTETE

SEQ ID NO: 3330325 - protein, 11 aa, Plasmodium falciparum
NEKTNNKTKLR

SEQ ID NO: 3330326 - protein, 6 aa, Plasmodium falciparum
NEKTPY

SEQ ID NO: 3330327 - protein, 42 aa, Plasmodium falciparum
NEKTQNFKSNLSTDNNNNNNNNNNNNNNNNNNNNNNNNNHTN

SEQ ID NO: 3330328 - protein, 20 aa, Plasmodium falciparum
NEKVEKKDNNQEESSIENNN

SEQ ID NO: 3330329 - protein, 17 aa, Plasmodium falciparum
NEKVESINKSKSKYENI

SEQ ID NO: 3330330 - protein, 16 aa, Plasmodium falciparum
NEKVETGAYDENGEKV

SEQ ID NO: 3330331 - protein, 7 aa, Plasmodium falciparum
NEKVKNG

SEQ ID NO: 3330332 - protein, 4 aa, Plasmodium falciparum
NEKY

SEQ ID NO: 3330333 - protein, 11 aa, Plasmodium falciparum
NEKYAASNEKL

SEQ ID NO: 3330334 - protein, 5 aa, Plasmodium falciparum
NEKYD

SEQ ID NO: 3330335 - protein, 22 aa, Plasmodium falciparum
NEKYHHTNKTHNNNNNNDDDNN

SEQ ID NO: 3330336 - protein, 5 aa, Plasmodium falciparum
NEKYK

SEQ ID NO: 3330337 - protein, 36 aa, Plasmodium falciparum
NEKYKNDENDKNDGNDKNDKNDGNDKNDKNNGKDDR

SEQ ID NO: 3330338 - protein, 10 aa, Plasmodium falciparum
NEKYKSKYNL

SEQ ID NO: 3330339 - protein, 9 aa, Plasmodium falciparum
NEKYRKEKE

SEQ ID NO: 3330340 - protein, 24 aa, Plasmodium falciparum
NEKYSNNRYGSHSNKTWNESNNVN

SEQ ID NO: 3330341 - protein, 6 aa, Plasmodium falciparum
NELDKT

SEQ ID NO: 3330342 - protein, 6 aa, Plasmodium falciparum
NELEPD

SEQ ID NO: 3330343 - protein, 6 aa, Plasmodium falciparum
NELEQN

SEQ ID NO: 3330344 - protein, 4 aa, Plasmodium falciparum
NELG

SEQ ID NO: 3330345 - protein, 5 aa, Plasmodium falciparum
NELKE

SEQ ID NO: 3330346 - protein, 9 aa, Plasmodium falciparum
NELKEKNEE

SEQ ID NO: 3330347 - protein, 12 aa, Plasmodium falciparum
NELKESEKNNND

SEQ ID NO: 3330348 - protein, 6 aa, Plasmodium falciparum
NELKGD

SEQ ID NO: 3330349 - protein, 10 aa, Plasmodium falciparum
NELKNRRRNI

SEQ ID NO: 3330350 - protein, 12 aa, Plasmodium falciparum
NELKRKNDEYEK

SEQ ID NO: 3330351 - protein, 24 aa, Plasmodium falciparum
NELNENKKKRKKDNSNGEKTQEDN

SEQ ID NO: 3330352 - protein, 7 aa, Plasmodium falciparum
NELNENN

SEQ ID NO: 3330353 - protein, 17 aa, Plasmodium falciparum
NELNNKTDDNINNDNNK

SEQ ID NO: 3330354 - protein, 15 aa, Plasmodium falciparum
NELNNNNSVSMSEGD

SEQ ID NO: 3330355 - protein, 18 aa, Plasmodium falciparum
NELNNNRVEDGKEKKIDE

SEQ ID NO: 3330356 - protein, 4 aa, Plasmodium falciparum
NELP

SEQ ID NO: 3330357 - protein, 10 aa, Plasmodium falciparum
NELPFNPEQN

SEQ ID NO: 3330358 - protein, 7 aa, Plasmodium falciparum
NELPGKP

SEQ ID NO: 3330359 - protein, 4 aa, Plasmodium falciparum
NELQ

SEQ ID NO: 3330360 - protein, 11 aa, Plasmodium falciparum
NELQKKKNESD

SEQ ID NO: 3330361 - protein, 8 aa, Plasmodium falciparum
NELQPGPS

SEQ ID NO: 3330362 - protein, 10 aa, Plasmodium falciparum
NELRDGNNSK

SEQ ID NO: 3330363 - protein, 14 aa, Plasmodium falciparum
NELSKNSHNNNNIN

SEQ ID NO: 3330364 - protein, 8 aa, Plasmodium falciparum
NELSQEEI

SEQ ID NO: 3330365 - protein, 15 aa, Plasmodium falciparum
NELSRNSYTSSTYSK

SEQ ID NO: 3330366 - protein, 9 aa, Plasmodium falciparum
NELSSGYQN

SEQ ID NO: 3330367 - protein, 9 aa, Plasmodium falciparum
NELTANKNI

SEQ ID NO: 3330368 - protein, 7 aa, Plasmodium falciparum
NELTNDK

SEQ ID NO: 3330369 - protein, 8 aa, Plasmodium falciparum
NEMAGDNQ

SEQ ID NO: 3330370 - protein, 8 aa, Plasmodium falciparum
NEMDQKES

SEQ ID NO: 3330371 - protein, 30 aa, Plasmodium falciparum
NEMEKNDEEEKNDEKKKNDEMNNKQNRQEN

SEQ ID NO: 3330372 - protein, 8 aa, Plasmodium falciparum
NEMKKTSE

SEQ ID NO: 3330373 - protein, 4 aa, Plasmodium falciparum
NEMN

SEQ ID NO: 3330374 - protein, 6 aa, Plasmodium falciparum
NEMNKN

SEQ ID NO: 3330375 - protein, 16 aa, Plasmodium falciparum
NEMNTNDNNLTNSGAK

SEQ ID NO: 3330376 - protein, 6 aa, Plasmodium falciparum
NEMTGL

SEQ ID NO: 3330377 - protein, 86 aa, Plasmodium falciparum
NEMYKNNDEMNKNNDEMNKNNNEMNKNNDETNKNNDETNKNNDEMNKNNNEMYKNNDEMNKNNDENVKKRYNENNTNATPKKFKRR

SEQ ID NO: 3330378 - protein, 7 aa, Plasmodium falciparum
NENADME

SEQ ID NO: 3330379 - protein, 6 aa, Plasmodium falciparum
NENAEL

SEQ ID NO: 3330380 - protein, 5 aa, Plasmodium falciparum
NENAK

SEQ ID NO: 3330381 - protein, 21 aa, Plasmodium falciparum
NENANNPKYTVGQGEGNKMKE

SEQ ID NO: 3330382 - protein, 10 aa, Plasmodium falciparum
NENARKLDSS

SEQ ID NO: 3330383 - protein, 99 aa, Plasmodium falciparum
NENDDNKNKNDDNKNKNDDNKNKNDDNKKKNNDNKNKNDDNKKKNNDNKNKNDDNKKKNNDNKNKNNDNKNKNNDNKNNNDDNKNKNNDNKNNNNSNKY

SEQ ID NO: 3330384 - protein, 9 aa, Plasmodium falciparum
NENDDTNKS

SEQ ID NO: 3330385 - protein, 9 aa, Plasmodium falciparum
NENDETPEH

SEQ ID NO: 3330386 - protein, 9 aa, Plasmodium falciparum
NENDEYDEL

SEQ ID NO: 3330387 - protein, 5 aa, Plasmodium falciparum
NENDK

SEQ ID NO: 3330388 - protein, 9 aa, Plasmodium falciparum
NENDKEKYV

SEQ ID NO: 3330389 - protein, 38 aa, Plasmodium falciparum
NENDKINNNDRINNNDKINNNDNINNKKKSSKRTGIPL

SEQ ID NO: 3330390 - protein, 10 aa, Plasmodium falciparum
NENDKKENYK

SEQ ID NO: 3330391 - protein, 13 aa, Plasmodium falciparum
NENDKKNKIKISS

SEQ ID NO: 3330392 - protein, 8 aa, Plasmodium falciparum
NENDKNDH

SEQ ID NO: 3330393 - protein, 19 aa, Plasmodium falciparum
NENDKSNMLSNSEKLKNKK

SEQ ID NO: 3330394 - protein, 5 aa, Plasmodium falciparum
NENDM

SEQ ID NO: 3330395 - protein, 11 aa, Plasmodium falciparum
NENDNYEDEQQ

SEQ ID NO: 3330396 - protein, 6 aa, Plasmodium falciparum
NENDSN

SEQ ID NO: 3330397 - protein, 21 aa, Plasmodium falciparum
NENDTQTKNLYNQKNKTNHNE

SEQ ID NO: 3330398 - protein, 4 aa, Plasmodium falciparum
NENE

SEQ ID NO: 3330399 - protein, 10 aa, Plasmodium falciparum
NENEDHSFDD

SEQ ID NO: 3330400 - protein, 15 aa, Plasmodium falciparum
NENEHNENRSFSTST

SEQ ID NO: 3330401 - protein, 6 aa, Plasmodium falciparum
NENEIN

SEQ ID NO: 3330402 - protein, 8 aa, Plasmodium falciparum
NENEKEGL

SEQ ID NO: 3330403 - protein, 9 aa, Plasmodium falciparum
NENEKKEIG

SEQ ID NO: 3330404 - protein, 7 aa, Plasmodium falciparum
NENEKKK

SEQ ID NO: 3330405 - protein, 10 aa, Plasmodium falciparum
NENEKKKQNA

SEQ ID NO: 3330406 - protein, 9 aa, Plasmodium falciparum
NENEKYRNN

SEQ ID NO: 3330407 - protein, 14 aa, Plasmodium falciparum
NENENENKNYHTGG

SEQ ID NO: 3330408 - protein, 10 aa, Plasmodium falciparum
NENEQKENNL

SEQ ID NO: 3330409 - protein, 19 aa, Plasmodium falciparum
NENESKDIGTVNSSKNSCK

SEQ ID NO: 3330410 - protein, 6 aa, Plasmodium falciparum
NENESL

SEQ ID NO: 3330411 - protein, 22 aa, Plasmodium falciparum
NENEYRNDDKQDNTNSFGNNNN

SEQ ID NO: 3330412 - protein, 8 aa, Plasmodium falciparum
NENGGAGV

SEQ ID NO: 3330413 - protein, 7 aa, Plasmodium falciparum
NENGNVK

SEQ ID NO: 3330414 - protein, 7 aa, Plasmodium falciparum
NENGSKE

SEQ ID NO: 3330415 - protein, 13 aa, Plasmodium falciparum
NENGYNNNKNKTF

SEQ ID NO: 3330416 - protein, 13 aa, Plasmodium falciparum
NENHSKKKKKISV

SEQ ID NO: 3330417 - protein, 14 aa, Plasmodium falciparum
NENHTMKSQESSQV

SEQ ID NO: 3330418 - protein, 4 aa, Plasmodium falciparum
NENI

SEQ ID NO: 3330419 - protein, 9 aa, Plasmodium falciparum
NENIDDEFE

SEQ ID NO: 3330420 - protein, 13 aa, Plasmodium falciparum
NENIENKKRIEGT

SEQ ID NO: 3330421 - protein, 8 aa, Plasmodium falciparum
NENIGKKI

SEQ ID NO: 3330422 - protein, 9 aa, Plasmodium falciparum
NENIKNNEL

SEQ ID NO: 3330423 - protein, 13 aa, Plasmodium falciparum
NENINKSKSNHKL

SEQ ID NO: 3330424 - protein, 35 aa, Plasmodium falciparum
NENINNEKIKNENIKNEKIKNENIKNKKIKNEKTI

SEQ ID NO: 3330425 - protein, 12 aa, Plasmodium falciparum
NENINNNSEGND

SEQ ID NO: 3330426 - protein, 4 aa, Plasmodium falciparum
NENK

SEQ ID NO: 3330427 - protein, 5 aa, Plasmodium falciparum
NENKD

SEQ ID NO: 3330428 - protein, 20 aa, Plasmodium falciparum
NENKDISNKDKEHVSHQNEH

SEQ ID NO: 3330429 - protein, 8 aa, Plasmodium falciparum
NENKEDEL

SEQ ID NO: 3330430 - protein, 8 aa, Plasmodium falciparum
NENKKKKM

SEQ ID NO: 3330431 - protein, 11 aa, Plasmodium falciparum
NENKKSNLPYQ

SEQ ID NO: 3330432 - protein, 8 aa, Plasmodium falciparum
NENKNEDA

SEQ ID NO: 3330433 - protein, 9 aa, Plasmodium falciparum
NENKNETYM

SEQ ID NO: 3330434 - protein, 9 aa, Plasmodium falciparum
NENKNSGAI

SEQ ID NO: 3330435 - protein, 12 aa, Plasmodium falciparum
NENKNSRKKKKK

SEQ ID NO: 3330436 - protein, 24 aa, Plasmodium falciparum
NENKSNSLSSELSNSDDDTDDENI

SEQ ID NO: 3330437 - protein, 19 aa, Plasmodium falciparum
NENKTNDIKKVKNENENIN

SEQ ID NO: 3330438 - protein, 7 aa, Plasmodium falciparum
NENLQKE

SEQ ID NO: 3330439 - protein, 5 aa, Plasmodium falciparum
NENMN

SEQ ID NO: 3330440 - protein, 7 aa, Plasmodium falciparum
NENMNKA

SEQ ID NO: 3330441 - protein, 19 aa, Plasmodium falciparum
NENMTKYNTKKKKKKNNSN

SEQ ID NO: 3330442 - protein, 5 aa, Plasmodium falciparum
NENNA

SEQ ID NO: 3330443 - protein, 7 aa, Plasmodium falciparum
NENNCKQ

SEQ ID NO: 3330444 - protein, 26 aa, Plasmodium falciparum
NENNDNNENNHNNNNNNNNNNNNSYD

SEQ ID NO: 3330445 - protein, 15 aa, Plasmodium falciparum
NENNDRDKNNDNINN

SEQ ID NO: 3330446 - protein, 8 aa, Plasmodium falciparum
NENNDTRN

SEQ ID NO: 3330447 - protein, 9 aa, Plasmodium falciparum
NENNIDEKL

SEQ ID NO: 3330448 - protein, 9 aa, Plasmodium falciparum
NENNIKDAC

SEQ ID NO: 3330449 - protein, 5 aa, Plasmodium falciparum
NENNK

SEQ ID NO: 3330450 - protein, 11 aa, Plasmodium falciparum
NENNKEEDELN

SEQ ID NO: 3330451 - protein, 47 aa, Plasmodium falciparum
NENNKFDENVKANDAYTNDQNVQDNNNNNSNSNSYNYERNRRTTRKK

SEQ ID NO: 3330452 - protein, 10 aa, Plasmodium falciparum
NENNKKEKDN

SEQ ID NO: 3330453 - protein, 7 aa, Plasmodium falciparum
NENNKMN

SEQ ID NO: 3330454 - protein, 21 aa, Plasmodium falciparum
NENNKNKEDVNNNIKKQNKIN

SEQ ID NO: 3330455 - protein, 12 aa, Plasmodium falciparum
NENNKNLNENNG

SEQ ID NO: 3330456 - protein, 11 aa, Plasmodium falciparum
NENNKSDINYA

SEQ ID NO: 3330457 - protein, 13 aa, Plasmodium falciparum
NENNKYKNSNKCN

SEQ ID NO: 3330458 - protein, 7 aa, Plasmodium falciparum
NENNNIN

SEQ ID NO: 3330459 - protein, 15 aa, Plasmodium falciparum
NENNNKNDMCQEKEK

SEQ ID NO: 3330460 - protein, 9 aa, Plasmodium falciparum
NENNNNNDK

SEQ ID NO: 3330461 - protein, 12 aa, Plasmodium falciparum
NENNNNNDKNSI

SEQ ID NO: 3330462 - protein, 35 aa, Plasmodium falciparum
NENNNNNNINNINENNNNNNINNINENNNNNNNNV

SEQ ID NO: 3330463 - protein, 13 aa, Plasmodium falciparum
NENNNNNNNNNNY

SEQ ID NO: 3330464 - protein, 11 aa, Plasmodium falciparum
NENNNNNNNYD

SEQ ID NO: 3330465 - protein, 12 aa, Plasmodium falciparum
NENNNNNSSNNK

SEQ ID NO: 3330466 - protein, 7 aa, Plasmodium falciparum
NENNPKN

SEQ ID NO: 3330467 - protein, 21 aa, Plasmodium falciparum
NENNQNVQKGDHNNEKDNNGL

SEQ ID NO: 3330468 - protein, 6 aa, Plasmodium falciparum
NENNTK

SEQ ID NO: 3330469 - protein, 10 aa, Plasmodium falciparum
NENNTQYNSF

SEQ ID NO: 3330470 - protein, 5 aa, Plasmodium falciparum
NENNY

SEQ ID NO: 3330471 - protein, 129 aa, Plasmodium falciparum
NENPDDFKDDRKKDMDDDEDDEDNEEDDEEEEEDEEEQEDQDDDNEDEKDQDDDEDGKGKKKLSSKTKSKKGKEKKEEKEDYDDDNDEEKEDEADDDNDDDDDDSDDWSYSEDDNYASDEEDDKTKNAM

SEQ ID NO: 3330472 - protein, 26 aa, Plasmodium falciparum
NENPHNNNNNYNNNNYNNNNYNNKDV

SEQ ID NO: 3330473 - protein, 6 aa, Plasmodium falciparum
NENPKE

SEQ ID NO: 3330474 - protein, 5 aa, Plasmodium falciparum
NENPM

SEQ ID NO: 3330475 - protein, 8 aa, Plasmodium falciparum
NENPNSIS

SEQ ID NO: 3330476 - protein, 9 aa, Plasmodium falciparum
NENPPFTTN

SEQ ID NO: 3330477 - protein, 4 aa, Plasmodium falciparum
NENQ

SEQ ID NO: 3330478 - protein, 5 aa, Plasmodium falciparum
NENQI

SEQ ID NO: 3330479 - protein, 5 aa, Plasmodium falciparum
NENQQ

SEQ ID NO: 3330480 - protein, 12 aa, Plasmodium falciparum
NENREKRFSTNN

SEQ ID NO: 3330481 - protein, 6 aa, Plasmodium falciparum
NENRKK

SEQ ID NO: 3330482 - protein, 10 aa, Plasmodium falciparum
NENRKKGRFH

SEQ ID NO: 3330483 - protein, 5 aa, Plasmodium falciparum
NENRN

SEQ ID NO: 3330484 - protein, 11 aa, Plasmodium falciparum
NENRNNINNIN

SEQ ID NO: 3330485 - protein, 4 aa, Plasmodium falciparum
NENS

SEQ ID NO: 3330486 - protein, 8 aa, Plasmodium falciparum
NENSDKVT

SEQ ID NO: 3330487 - protein, 8 aa, Plasmodium falciparum
NENSEKEI

SEQ ID NO: 3330488 - protein, 5 aa, Plasmodium falciparum
NENSH

SEQ ID NO: 3330489 - protein, 6 aa, Plasmodium falciparum
NENSLV

SEQ ID NO: 3330490 - protein, 7 aa, Plasmodium falciparum
NENSSIN

SEQ ID NO: 3330491 - protein, 6 aa, Plasmodium falciparum
NENSYL

SEQ ID NO: 3330492 - protein, 24 aa, Plasmodium falciparum
NENTHNTKHDQKNEHVDDNKTNKI

SEQ ID NO: 3330493 - protein, 14 aa, Plasmodium falciparum
NENTIDDNGNDTNY

SEQ ID NO: 3330494 - protein, 26 aa, Plasmodium falciparum
NENTLKNANIEDNLNKDTKSEDYKKD

SEQ ID NO: 3330495 - protein, 5 aa, Plasmodium falciparum
NENTN

SEQ ID NO: 3330496 - protein, 50 aa, Plasmodium falciparum
NENTNKLDNSNNNNNNNKNKKDSVSANGSNKNNCNTSSSNNRSRHVPNNN

SEQ ID NO: 3330497 - protein, 12 aa, Plasmodium falciparum
NENTNKNSLQHS

SEQ ID NO: 3330498 - protein, 10 aa, Plasmodium falciparum
NENTTNQNSY

SEQ ID NO: 3330499 - protein, 4 aa, Plasmodium falciparum
NENV

SEQ ID NO: 3330500 - protein, 9 aa, Plasmodium falciparum
NENVEDEKN

SEQ ID NO: 3330501 - protein, 6 aa, Plasmodium falciparum
NENVKT

SEQ ID NO: 3330502 - protein, 5 aa, Plasmodium falciparum
NENVN

SEQ ID NO: 3330503 - protein, 54 aa, Plasmodium falciparum
NENVNDKIDENVNDKINENVNDKIDENVNDKINENVNDKIDENVNDKINENVND

SEQ ID NO: 3330504 - protein, 18 aa, Plasmodium falciparum
NENVNENNKNQYSNEEPD

SEQ ID NO: 3330505 - protein, 30 aa, Plasmodium falciparum
NENVNKSNLRKGLSTNNSENGIKSLKDEDE

SEQ ID NO: 3330506 - protein, 4 aa, Plasmodium falciparum
NENY

SEQ ID NO: 3330507 - protein, 5 aa, Plasmodium falciparum
NENYE

SEQ ID NO: 3330508 - protein, 28 aa, Plasmodium falciparum
NENYEEDNDYINNNETRKNGNDSDIDYG

SEQ ID NO: 3330509 - protein, 7 aa, Plasmodium falciparum
NENYPVS

SEQ ID NO: 3330510 - protein, 19 aa, Plasmodium falciparum
NENYRSESEAESESTNDSV

SEQ ID NO: 3330511 - protein, 14 aa, Plasmodium falciparum
NENYSNKKNENSDS

SEQ ID NO: 3330512 - protein, 9 aa, Plasmodium falciparum
NENYSNNPI

SEQ ID NO: 3330513 - protein, 28 aa, Plasmodium falciparum
NENYTTTPPNQIYNNNNNKNNNNNNNNY

SEQ ID NO: 3330514 - protein, 8 aa, Plasmodium falciparum
NEPEKSVL

SEQ ID NO: 3330515 - protein, 4 aa, Plasmodium falciparum
NEPF

SEQ ID NO: 3330516 - protein, 11 aa, Plasmodium falciparum
NEPKDENNNVP

SEQ ID NO: 3330517 - protein, 5 aa, Plasmodium falciparum
NEPKE

SEQ ID NO: 3330518 - protein, 11 aa, Plasmodium falciparum
NEPKMSSDNLK

SEQ ID NO: 3330519 - protein, 7 aa, Plasmodium falciparum
NEPLTNE

SEQ ID NO: 3330520 - protein, 5 aa, Plasmodium falciparum
NEPMT

SEQ ID NO: 3330521 - protein, 6 aa, Plasmodium falciparum
NEPNKE

SEQ ID NO: 3330522 - protein, 9 aa, Plasmodium falciparum
NEPNKTDEQ

SEQ ID NO: 3330523 - protein, 9 aa, Plasmodium falciparum
NEPNNNKTI

SEQ ID NO: 3330524 - protein, 5 aa, Plasmodium falciparum
NEPNS

SEQ ID NO: 3330525 - protein, 8 aa, Plasmodium falciparum
NEPPGARA

SEQ ID NO: 3330526 - protein, 11 aa, Plasmodium falciparum
NEPSFSSTNTN

SEQ ID NO: 3330527 - protein, 6 aa, Plasmodium falciparum
NEPSVD

SEQ ID NO: 3330528 - protein, 15 aa, Plasmodium falciparum
NEPTAKEKKIKEEKT

SEQ ID NO: 3330529 - protein, 118 aa, Plasmodium falciparum
NEPVDHSKNESVDHSKNESVDHSKNESVDHSKNESEDHSKNEPVDHSKNESEDHSKNEPVDHSKNEPVDHSKNESVDHSKNESVDHSKNEPVDHSKNEPVDHSKNEPVDHSKNNSKDC

SEQ ID NO: 3330530 - protein, 11 aa, Plasmodium falciparum
NEPVGEKSRPI

SEQ ID NO: 3330531 - protein, 13 aa, Plasmodium falciparum
NEPYDSINEPYDN

SEQ ID NO: 3330532 - protein, 5 aa, Plasmodium falciparum
NEPYK

SEQ ID NO: 3330533 - protein, 6 aa, Plasmodium falciparum
NEQADE

SEQ ID NO: 3330534 - protein, 4 aa, Plasmodium falciparum
NEQD

SEQ ID NO: 3330535 - protein, 9 aa, Plasmodium falciparum
NEQDDKNKD

SEQ ID NO: 3330536 - protein, 6 aa, Plasmodium falciparum
NEQDEY

SEQ ID NO: 3330537 - protein, 10 aa, Plasmodium falciparum
NEQDKERGSR

SEQ ID NO: 3330538 - protein, 5 aa, Plasmodium falciparum
NEQDR

SEQ ID NO: 3330539 - protein, 5 aa, Plasmodium falciparum
NEQEE

SEQ ID NO: 3330540 - protein, 6 aa, Plasmodium falciparum
NEQEED

SEQ ID NO: 3330541 - protein, 7 aa, Plasmodium falciparum
NEQEEDI

SEQ ID NO: 3330542 - protein, 21 aa, Plasmodium falciparum
NEQENDNNNNNNNNNNNNNVE

SEQ ID NO: 3330543 - protein, 10 aa, Plasmodium falciparum
NEQENINKKN

SEQ ID NO: 3330544 - protein, 6 aa, Plasmodium falciparum
NEQEQN

SEQ ID NO: 3330545 - protein, 8 aa, Plasmodium falciparum
NEQETSSS

SEQ ID NO: 3330546 - protein, 14 aa, Plasmodium falciparum
NEQEYVDERSANYS

SEQ ID NO: 3330547 - protein, 4 aa, Plasmodium falciparum
NEQF

SEQ ID NO: 3330548 - protein, 13 aa, Plasmodium falciparum
NEQFSNKNNIKTC

SEQ ID NO: 3330549 - protein, 8 aa, Plasmodium falciparum
NEQGKTHN

SEQ ID NO: 3330550 - protein, 20 aa, Plasmodium falciparum
NEQHKKSKIEDKWNENSHVR

SEQ ID NO: 3330551 - protein, 8 aa, Plasmodium falciparum
NEQHTKNN

SEQ ID NO: 3330552 - protein, 4 aa, Plasmodium falciparum
NEQI

SEQ ID NO: 3330553 - protein, 5 aa, Plasmodium falciparum
NEQIE

SEQ ID NO: 3330554 - protein, 7 aa, Plasmodium falciparum
NEQIKKK

SEQ ID NO: 3330555 - protein, 6 aa, Plasmodium falciparum
NEQITE

SEQ ID NO: 3330556 - protein, 4 aa, Plasmodium falciparum
NEQK

SEQ ID NO: 3330557 - protein, 6 aa, Plasmodium falciparum
NEQKDE

SEQ ID NO: 3330558 - protein, 5 aa, Plasmodium falciparum
NEQKE

SEQ ID NO: 3330559 - protein, 11 aa, Plasmodium falciparum
NEQKEKSSNDI

SEQ ID NO: 3330560 - protein, 11 aa, Plasmodium falciparum
NEQKNDTNVYN

SEQ ID NO: 3330561 - protein, 11 aa, Plasmodium falciparum
NEQKQNSPNTI

SEQ ID NO: 3330562 - protein, 24 aa, Plasmodium falciparum
NEQLQKKKQMDDDEENYDEDDEIG

SEQ ID NO: 3330563 - protein, 10 aa, Plasmodium falciparum
NEQLTDNEIQ

SEQ ID NO: 3330564 - protein, 9 aa, Plasmodium falciparum
NEQNEDENR

SEQ ID NO: 3330565 - protein, 8 aa, Plasmodium falciparum
NEQNEKEN

SEQ ID NO: 3330566 - protein, 16 aa, Plasmodium falciparum
NEQNEKKQKKKEGEYY

SEQ ID NO: 3330567 - protein, 11 aa, Plasmodium falciparum
NEQNELVQNSN

SEQ ID NO: 3330568 - protein, 6 aa, Plasmodium falciparum
NEQNIN

SEQ ID NO: 3330569 - protein, 12 aa, Plasmodium falciparum
NEQNKEKEKTSH

SEQ ID NO: 3330570 - protein, 11 aa, Plasmodium falciparum
NEQNKKKGKKR

SEQ ID NO: 3330571 - protein, 6 aa, Plasmodium falciparum
NEQNKT

SEQ ID NO: 3330572 - protein, 5 aa, Plasmodium falciparum
NEQNN

SEQ ID NO: 3330573 - protein, 10 aa, Plasmodium falciparum
NEQNNMGSNN

SEQ ID NO: 3330574 - protein, 8 aa, Plasmodium falciparum
NEQNNSNI

SEQ ID NO: 3330575 - protein, 7 aa, Plasmodium falciparum
NEQNNYD

SEQ ID NO: 3330576 - protein, 12 aa, Plasmodium falciparum
NEQNVEDGEEFE

SEQ ID NO: 3330577 - protein, 8 aa, Plasmodium falciparum
NEQPGYGK

SEQ ID NO: 3330578 - protein, 27 aa, Plasmodium falciparum
NEQPNKARKNLNHHQNKNTNNDNNNAC

SEQ ID NO: 3330579 - protein, 42 aa, Plasmodium falciparum
NEQPPQALESEVKKGKVETESTTNQTMDTQNKQVQNKNEENI

SEQ ID NO: 3330580 - protein, 4 aa, Plasmodium falciparum
NEQQ

SEQ ID NO: 3330581 - protein, 9 aa, Plasmodium falciparum
NEQQENKDH

SEQ ID NO: 3330582 - protein, 5 aa, Plasmodium falciparum
NEQQH

SEQ ID NO: 3330583 - protein, 8 aa, Plasmodium falciparum
NEQQTSTL

SEQ ID NO: 3330584 - protein, 64 aa, Plasmodium falciparum
NEQSDDNDDNDNNDDNDNNDDNDDDNNDDNNNDVNNNNVNNNDVNNDDVNNDGEKRNNISYDKN

SEQ ID NO: 3330585 - protein, 12 aa, Plasmodium falciparum
NEQSEDNLNNNI

SEQ ID NO: 3330586 - protein, 31 aa, Plasmodium falciparum
NEQTANDYSDTEVDNNMNDNKYEKESMNKKK

SEQ ID NO: 3330587 - protein, 7 aa, Plasmodium falciparum
NEQTSGE

SEQ ID NO: 3330588 - protein, 12 aa, Plasmodium falciparum
NEQTSYPSNDDI

SEQ ID NO: 3330589 - protein, 4 aa, Plasmodium falciparum
NEQY

SEQ ID NO: 3330590 - protein, 17 aa, Plasmodium falciparum
NEQYDKKKKKKMGDEQY

SEQ ID NO: 3330591 - protein, 6 aa, Plasmodium falciparum
NEQYSS

SEQ ID NO: 3330592 - protein, 13 aa, Plasmodium falciparum
NERDDEKEDEKMN

SEQ ID NO: 3330593 - protein, 8 aa, Plasmodium falciparum
NERDGNVH

SEQ ID NO: 3330594 - protein, 47 aa, Plasmodium falciparum
NERDTNNNNMKNGENEKNEKNEKNEKNEKNEKNEKNEKNEKNEKNMK

SEQ ID NO: 3330595 - protein, 6 aa, Plasmodium falciparum
NEREMN

SEQ ID NO: 3330596 - protein, 4 aa, Plasmodium falciparum
NERI

SEQ ID NO: 3330597 - protein, 5 aa, Plasmodium falciparum
NERIS

SEQ ID NO: 3330598 - protein, 4 aa, Plasmodium falciparum
NERK

SEQ ID NO: 3330599 - protein, 10 aa, Plasmodium falciparum
NERKKKTEVN

SEQ ID NO: 3330600 - protein, 5 aa, Plasmodium falciparum
NERKN

SEQ ID NO: 3330601 - protein, 29 aa, Plasmodium falciparum
NERKNKKSKEVKNKKKMEKKNKVEKEKQN

SEQ ID NO: 3330602 - protein, 5 aa, Plasmodium falciparum
NERKR

SEQ ID NO: 3330603 - protein, 7 aa, Plasmodium falciparum
NERKRRR

SEQ ID NO: 3330604 - protein, 8 aa, Plasmodium falciparum
NERKYEQS

SEQ ID NO: 3330605 - protein, 9 aa, Plasmodium falciparum
NERNEISNG

SEQ ID NO: 3330606 - protein, 6 aa, Plasmodium falciparum
NERNIS

SEQ ID NO: 3330607 - protein, 8 aa, Plasmodium falciparum
NERNKIKN

SEQ ID NO: 3330608 - protein, 27 aa, Plasmodium falciparum
NERNKRKREKTKCTDEKNDQGKDNTHE

SEQ ID NO: 3330609 - protein, 5 aa, Plasmodium falciparum
NERNM

SEQ ID NO: 3330610 - protein, 5 aa, Plasmodium falciparum
NERNN

SEQ ID NO: 3330611 - protein, 4 aa, Plasmodium falciparum
NERQ

SEQ ID NO: 3330612 - protein, 6 aa, Plasmodium falciparum
NERQNI

SEQ ID NO: 3330613 - protein, 9 aa, Plasmodium falciparum
NERRLTNNM

SEQ ID NO: 3330614 - protein, 6 aa, Plasmodium falciparum
NERTKN

SEQ ID NO: 3330615 - protein, 7 aa, Plasmodium falciparum
NERTRNN

SEQ ID NO: 3330616 - protein, 14 aa, Plasmodium falciparum
NERTSEKLNEHENY

SEQ ID NO: 3330617 - protein, 4 aa, Plasmodium falciparum
NERV

SEQ ID NO: 3330618 - protein, 5 aa, Plasmodium falciparum
NERYK

SEQ ID NO: 3330619 - protein, 6 aa, Plasmodium falciparum
NESAKN

SEQ ID NO: 3330620 - protein, 14 aa, Plasmodium falciparum
NESANKFSSSDEKI

SEQ ID NO: 3330621 - protein, 4 aa, Plasmodium falciparum
NESD

SEQ ID NO: 3330622 - protein, 5 aa, Plasmodium falciparum
NESDN

SEQ ID NO: 3330623 - protein, 10 aa, Plasmodium falciparum
NESDNDSKDY

SEQ ID NO: 3330624 - protein, 9 aa, Plasmodium falciparum
NESDYSDKQ

SEQ ID NO: 3330625 - protein, 11 aa, Plasmodium falciparum
NESEDTANNVS

SEQ ID NO: 3330626 - protein, 8 aa, Plasmodium falciparum
NESEEIAQ

SEQ ID NO: 3330627 - protein, 7 aa, Plasmodium falciparum
NESEKKY

SEQ ID NO: 3330628 - protein, 10 aa, Plasmodium falciparum
NESEKNNFRT

SEQ ID NO: 3330629 - protein, 6 aa, Plasmodium falciparum
NESEQD

SEQ ID NO: 3330630 - protein, 8 aa, Plasmodium falciparum
NESEQDRV

SEQ ID NO: 3330631 - protein, 6 aa, Plasmodium falciparum
NESFDT

SEQ ID NO: 3330632 - protein, 20 aa, Plasmodium falciparum
NESFEPPNWNNTEKKEISNK

SEQ ID NO: 3330633 - protein, 6 aa, Plasmodium falciparum
NESGDE

SEQ ID NO: 3330634 - protein, 11 aa, Plasmodium falciparum
NESGKTKYPVS

SEQ ID NO: 3330635 - protein, 4 aa, Plasmodium falciparum
NESI

SEQ ID NO: 3330636 - protein, 7 aa, Plasmodium falciparum
NESIEGV

SEQ ID NO: 3330637 - protein, 71 aa, Plasmodium falciparum
NESIESSNNDINGKQKEHIKKGNSENQDVDPDTNPDAVPDDDDDDDNSNDESEYESSQMDSEKNKGSIKNS

SEQ ID NO: 3330638 - protein, 12 aa, Plasmodium falciparum
NESIKTENENMT

SEQ ID NO: 3330639 - protein, 8 aa, Plasmodium falciparum
NESINTNE

SEQ ID NO: 3330640 - protein, 15 aa, Plasmodium falciparum
NESIRKKEENKKYTH

SEQ ID NO: 3330641 - protein, 11 aa, Plasmodium falciparum
NESKEDSQGRQ

SEQ ID NO: 3330642 - protein, 7 aa, Plasmodium falciparum
NESKEKI

SEQ ID NO: 3330643 - protein, 33 aa, Plasmodium falciparum
NESKNKSTYVSSNKNSHHINNNNNNNNNKSNNL

SEQ ID NO: 3330644 - protein, 11 aa, Plasmodium falciparum
NESKSKYAFTQ

SEQ ID NO: 3330645 - protein, 9 aa, Plasmodium falciparum
NESLEKKNE

SEQ ID NO: 3330646 - protein, 5 aa, Plasmodium falciparum
NESLK

SEQ ID NO: 3330647 - protein, 19 aa, Plasmodium falciparum
NESNEENVKRDLSKKEADI

SEQ ID NO: 3330648 - protein, 8 aa, Plasmodium falciparum
NESNHDNK

SEQ ID NO: 3330649 - protein, 16 aa, Plasmodium falciparum
NESNIGESNIDESNMG

SEQ ID NO: 3330650 - protein, 7 aa, Plasmodium falciparum
NESNINA

SEQ ID NO: 3330651 - protein, 5 aa, Plasmodium falciparum
NESPE

SEQ ID NO: 3330652 - protein, 6 aa, Plasmodium falciparum
NESPQW

SEQ ID NO: 3330653 - protein, 5 aa, Plasmodium falciparum
NESQP

SEQ ID NO: 3330654 - protein, 5 aa, Plasmodium falciparum
NESRS

SEQ ID NO: 3330655 - protein, 4 aa, Plasmodium falciparum
NESS

SEQ ID NO: 3330656 - protein, 6 aa, Plasmodium falciparum
NESSCY

SEQ ID NO: 3330657 - protein, 33 aa, Plasmodium falciparum
NESSDSEKDDNNNNNNNNNDNTYYNNNNEREKK

SEQ ID NO: 3330658 - protein, 6 aa, Plasmodium falciparum
NESSFG

SEQ ID NO: 3330659 - protein, 10 aa, Plasmodium falciparum
NESSSSYAIK

SEQ ID NO: 3330660 - protein, 10 aa, Plasmodium falciparum
NESSYGNHNN

SEQ ID NO: 3330661 - protein, 4 aa, Plasmodium falciparum
NEST

SEQ ID NO: 3330662 - protein, 8 aa, Plasmodium falciparum
NESTNSYN

SEQ ID NO: 3330663 - protein, 40 aa, Plasmodium falciparum
NESTTKEKDMNDTNSNNNNNNNNNNSDDDAEKKNENIEDM

SEQ ID NO: 3330664 - protein, 7 aa, Plasmodium falciparum
NESVETN

SEQ ID NO: 3330665 - protein, 5 aa, Plasmodium falciparum
NESYG

SEQ ID NO: 3330666 - protein, 14 aa, Plasmodium falciparum
NESYKNDDNVDHSN

SEQ ID NO: 3330667 - protein, 6 aa, Plasmodium falciparum
NESYND

SEQ ID NO: 3330668 - protein, 4 aa, Plasmodium falciparum
NETA

SEQ ID NO: 3330669 - protein, 4 aa, Plasmodium falciparum
NETD

SEQ ID NO: 3330670 - protein, 12 aa, Plasmodium falciparum
NETENINDSTTE

SEQ ID NO: 3330671 - protein, 5 aa, Plasmodium falciparum
NETGE

SEQ ID NO: 3330672 - protein, 6 aa, Plasmodium falciparum
NETGGS

SEQ ID NO: 3330673 - protein, 6 aa, Plasmodium falciparum
NETHST

SEQ ID NO: 3330674 - protein, 5 aa, Plasmodium falciparum
NETIE

SEQ ID NO: 3330675 - protein, 4 aa, Plasmodium falciparum
NETK

SEQ ID NO: 3330676 - protein, 17 aa, Plasmodium falciparum
NETKEENKEGNKSNDIE

SEQ ID NO: 3330677 - protein, 27 aa, Plasmodium falciparum
NETKFSESKGNNKNKKFKSEDSNKLEE

SEQ ID NO: 3330678 - protein, 12 aa, Plasmodium falciparum
NETKKETQNEIS

SEQ ID NO: 3330679 - protein, 25 aa, Plasmodium falciparum
NETKNDLDNKYKSKDNDKNKTENCN

SEQ ID NO: 3330680 - protein, 8 aa, Plasmodium falciparum
NETKNYND

SEQ ID NO: 3330681 - protein, 19 aa, Plasmodium falciparum
NETKSSEHNHKSKSKIEDN

SEQ ID NO: 3330682 - protein, 41 aa, Plasmodium falciparum
NETKYDNNNNNNNNNNNNNNNSNNNNKNNNKNNNKNSSYNN

SEQ ID NO: 3330683 - protein, 9 aa, Plasmodium falciparum
NETKYSNEN

SEQ ID NO: 3330684 - protein, 13 aa, Plasmodium falciparum
NETNIPEKNEEIN

SEQ ID NO: 3330685 - protein, 13 aa, Plasmodium falciparum
NETNKDDKENVNN

SEQ ID NO: 3330686 - protein, 6 aa, Plasmodium falciparum
NETNKT

SEQ ID NO: 3330687 - protein, 6 aa, Plasmodium falciparum
NETNYN

SEQ ID NO: 3330688 - protein, 11 aa, Plasmodium falciparum
NETPTQTNEIT

SEQ ID NO: 3330689 - protein, 5 aa, Plasmodium falciparum
NETQE

SEQ ID NO: 3330690 - protein, 16 aa, Plasmodium falciparum
NETQNTQQYQSQDQND

SEQ ID NO: 3330691 - protein, 6 aa, Plasmodium falciparum
NETSPK

SEQ ID NO: 3330692 - protein, 6 aa, Plasmodium falciparum
NETSTK

SEQ ID NO: 3330693 - protein, 12 aa, Plasmodium falciparum
NETTNSSNTVVS

SEQ ID NO: 3330694 - protein, 36 aa, Plasmodium falciparum
NETVHENAATKNDKENDKTENKTSEVNGKNKTHTIN

SEQ ID NO: 3330695 - protein, 5 aa, Plasmodium falciparum
NETVK

SEQ ID NO: 3330696 - protein, 5 aa, Plasmodium falciparum
NETVQ

SEQ ID NO: 3330697 - protein, 14 aa, Plasmodium falciparum
NETYENNNIYPGDD

SEQ ID NO: 3330698 - protein, 14 aa, Plasmodium falciparum
NETYKNNKKKKRKN

SEQ ID NO: 3330699 - protein, 5 aa, Plasmodium falciparum
NETYP

SEQ ID NO: 3330700 - protein, 49 aa, Plasmodium falciparum
NETYTKNHNNNNNNNNNNNNNNNNKKNSYGNYNNTNDNDYNKTKKKKKN

SEQ ID NO: 3330701 - protein, 23 aa, Plasmodium falciparum
NEVEEYGRNNKLDKKKKKKKKNL

SEQ ID NO: 3330702 - protein, 10 aa, Plasmodium falciparum
NEVENKKKLT

SEQ ID NO: 3330703 - protein, 10 aa, Plasmodium falciparum
NEVERNENIG

SEQ ID NO: 3330704 - protein, 4 aa, Plasmodium falciparum
NEVG

SEQ ID NO: 3330705 - protein, 6 aa, Plasmodium falciparum
NEVGTS

SEQ ID NO: 3330706 - protein, 7 aa, Plasmodium falciparum
NEVKKDN

SEQ ID NO: 3330707 - protein, 12 aa, Plasmodium falciparum
NEVNNKNLSSNK

SEQ ID NO: 3330708 - protein, 4 aa, Plasmodium falciparum
NEVQ

SEQ ID NO: 3330709 - protein, 5 aa, Plasmodium falciparum
NEVRT

SEQ ID NO: 3330710 - protein, 5 aa, Plasmodium falciparum
NEVSS

SEQ ID NO: 3330711 - protein, 4 aa, Plasmodium falciparum
NEVT

SEQ ID NO: 3330712 - protein, 6 aa, Plasmodium falciparum
NEVTEK

SEQ ID NO: 3330713 - protein, 6 aa, Plasmodium falciparum
NEVTEN

SEQ ID NO: 3330714 - protein, 16 aa, Plasmodium falciparum
NEYASSYSEKNTNINE

SEQ ID NO: 3330715 - protein, 5 aa, Plasmodium falciparum
NEYDD

SEQ ID NO: 3330716 - protein, 6 aa, Plasmodium falciparum
NEYDEK

SEQ ID NO: 3330717 - protein, 14 aa, Plasmodium falciparum
NEYDNNNNNNNREK

SEQ ID NO: 3330718 - protein, 13 aa, Plasmodium falciparum
NEYEDSDLDEEIE

SEQ ID NO: 3330719 - protein, 13 aa, Plasmodium falciparum
NEYENKRNNNKIE

SEQ ID NO: 3330720 - protein, 12 aa, Plasmodium falciparum
NEYESDDTDENI

SEQ ID NO: 3330721 - protein, 5 aa, Plasmodium falciparum
NEYGK

SEQ ID NO: 3330722 - protein, 6 aa, Plasmodium falciparum
NEYISS

SEQ ID NO: 3330723 - protein, 11 aa, Plasmodium falciparum
NEYKKDDDDFN

SEQ ID NO: 3330724 - protein, 10 aa, Plasmodium falciparum
NEYKNKSTDL

SEQ ID NO: 3330725 - protein, 7 aa, Plasmodium falciparum
NEYKPNV

SEQ ID NO: 3330726 - protein, 4 aa, Plasmodium falciparum
NEYN

SEQ ID NO: 3330727 - protein, 19 aa, Plasmodium falciparum
NEYNDTSNTNDTNNTNNTN

SEQ ID NO: 3330728 - protein, 10 aa, Plasmodium falciparum
NEYNEDNYDS

SEQ ID NO: 3330729 - protein, 6 aa, Plasmodium falciparum
NEYNEE

SEQ ID NO: 3330730 - protein, 6 aa, Plasmodium falciparum
NEYNFN

SEQ ID NO: 3330731 - protein, 5 aa, Plasmodium falciparum
NEYNK

SEQ ID NO: 3330732 - protein, 6 aa, Plasmodium falciparum
NEYNND

SEQ ID NO: 3330733 - protein, 7 aa, Plasmodium falciparum
NEYNNKF

SEQ ID NO: 3330734 - protein, 14 aa, Plasmodium falciparum
NEYNNKSNDQNIND

SEQ ID NO: 3330735 - protein, 10 aa, Plasmodium falciparum
NEYNNLEKKK

SEQ ID NO: 3330736 - protein, 16 aa, Plasmodium falciparum
NEYNNNNNKNNNLSGP

SEQ ID NO: 3330737 - protein, 5 aa, Plasmodium falciparum
NEYPY

SEQ ID NO: 3330738 - protein, 4 aa, Plasmodium falciparum
NEYQ

SEQ ID NO: 3330739 - protein, 6 aa, Plasmodium falciparum
NEYQEL

SEQ ID NO: 3330740 - protein, 9 aa, Plasmodium falciparum
NEYQRKDKL

SEQ ID NO: 3330741 - protein, 10 aa, Plasmodium falciparum
NEYRKSKIRA

SEQ ID NO: 3330742 - protein, 4 aa, Plasmodium falciparum
NEYS

SEQ ID NO: 3330743 - protein, 5 aa, Plasmodium falciparum
NEYSE

SEQ ID NO: 3330744 - protein, 6 aa, Plasmodium falciparum
NEYSEK

SEQ ID NO: 3330745 - protein, 9 aa, Plasmodium falciparum
NEYSNNINN

SEQ ID NO: 3330746 - protein, 4 aa, Plasmodium falciparum
NEYT

SEQ ID NO: 3330747 - protein, 7 aa, Plasmodium falciparum
NEYTEAN

SEQ ID NO: 3330748 - protein, 5 aa, Plasmodium falciparum
NEYTK

SEQ ID NO: 3330749 - protein, 6 aa, Plasmodium falciparum
NEYTNE

SEQ ID NO: 3330750 - protein, 9 aa, Plasmodium falciparum
NEYTNGHTN

SEQ ID NO: 3330751 - protein, 6 aa, Plasmodium falciparum
NEYTTS

SEQ ID NO: 3330752 - protein, 8 aa, Plasmodium falciparum
NEYTTTPV

SEQ ID NO: 3330753 - protein, 4 aa, Plasmodium falciparum
NEYW

SEQ ID NO: 3330754 - protein, 14 aa, Plasmodium falciparum
NFDDDDDDEDIQDI

SEQ ID NO: 3330755 - protein, 7 aa, Plasmodium falciparum
NFDEEPD

SEQ ID NO: 3330756 - protein, 5 aa, Plasmodium falciparum
NFDGN

SEQ ID NO: 3330757 - protein, 23 aa, Plasmodium falciparum
NFDNSTNNKSFKYNNRNNIKNDH

SEQ ID NO: 3330758 - protein, 11 aa, Plasmodium falciparum
NFDNTKDIKSD

SEQ ID NO: 3330759 - protein, 14 aa, Plasmodium falciparum
NFDPFPDKSSLTEC

SEQ ID NO: 3330760 - protein, 4 aa, Plasmodium falciparum
NFDQ

SEQ ID NO: 3330761 - protein, 5 aa, Plasmodium falciparum
NFDSK

SEQ ID NO: 3330762 - protein, 9 aa, Plasmodium falciparum
NFDTNNSQN

SEQ ID NO: 3330763 - protein, 13 aa, Plasmodium falciparum
NFEDDNDNNHYNN

SEQ ID NO: 3330764 - protein, 4 aa, Plasmodium falciparum
NFEE

SEQ ID NO: 3330765 - protein, 14 aa, Plasmodium falciparum
NFEENDKENEDNQY

SEQ ID NO: 3330766 - protein, 6 aa, Plasmodium falciparum
NFEKER

SEQ ID NO: 3330767 - protein, 5 aa, Plasmodium falciparum
NFEPS

SEQ ID NO: 3330768 - protein, 4 aa, Plasmodium falciparum
NFEQ

SEQ ID NO: 3330769 - protein, 29 aa, Plasmodium falciparum
NFERKKEEKKDTHGGNKMGNYGDKNWEDN

SEQ ID NO: 3330770 - protein, 11 aa, Plasmodium falciparum
NFERQSKGEKI

SEQ ID NO: 3330771 - protein, 4 aa, Plasmodium falciparum
NFES

SEQ ID NO: 3330772 - protein, 5 aa, Plasmodium falciparum
NFGEK

SEQ ID NO: 3330773 - protein, 4 aa, Plasmodium falciparum
NFGG

SEQ ID NO: 3330774 - protein, 5 aa, Plasmodium falciparum
NFGKN

SEQ ID NO: 3330775 - protein, 37 aa, Plasmodium falciparum
NFGNEKDEHTNESYNEENNINQKKDYISQSNSSHNSY

SEQ ID NO: 3330776 - protein, 15 aa, Plasmodium falciparum
NFGSESNSSSSNYDN

SEQ ID NO: 3330777 - protein, 7 aa, Plasmodium falciparum
NFGSNPQ

SEQ ID NO: 3330778 - protein, 11 aa, Plasmodium falciparum
NFGSSSTESGP

SEQ ID NO: 3330779 - protein, 17 aa, Plasmodium falciparum
NFHNGRDNFKGRTGSFG

SEQ ID NO: 3330780 - protein, 67 aa, Plasmodium falciparum
NFHQPNNTDPVKVQRGRKSSKNINISQQNNKDDTYGNSHKNQNSENNINTTKKNNHSYTTNIDNNQN

SEQ ID NO: 3330781 - protein, 5 aa, Plasmodium falciparum
NFIES

SEQ ID NO: 3330782 - protein, 4 aa, Plasmodium falciparum
NFIK

SEQ ID NO: 3330783 - protein, 8 aa, Plasmodium falciparum
NFKDDNKS

SEQ ID NO: 3330784 - protein, 9 aa, Plasmodium falciparum
NFKEKEEND

SEQ ID NO: 3330785 - protein, 6 aa, Plasmodium falciparum
NFKEND

SEQ ID NO: 3330786 - protein, 12 aa, Plasmodium falciparum
NFKESTDEGTYD

SEQ ID NO: 3330787 - protein, 37 aa, Plasmodium falciparum
NFKKKKKKKIKEEEERKKKEEEEERKKKEEDNEQNHE

SEQ ID NO: 3330788 - protein, 4 aa, Plasmodium falciparum
NFKP

SEQ ID NO: 3330789 - protein, 10 aa, Plasmodium falciparum
NFNDEENNQI

SEQ ID NO: 3330790 - protein, 12 aa, Plasmodium falciparum
NFNENDDENEES

SEQ ID NO: 3330791 - protein, 6 aa, Plasmodium falciparum
NFNENK

SEQ ID NO: 3330792 - protein, 23 aa, Plasmodium falciparum
NFNHNNKNKEINDNNSNVTTNTN

SEQ ID NO: 3330793 - protein, 5 aa, Plasmodium falciparum
NFNNN

SEQ ID NO: 3330794 - protein, 13 aa, Plasmodium falciparum
NFNNNNKLPSSNY

SEQ ID NO: 3330795 - protein, 5 aa, Plasmodium falciparum
NFNNS

SEQ ID NO: 3330796 - protein, 10 aa, Plasmodium falciparum
NFNNSDMNNN

SEQ ID NO: 3330797 - protein, 5 aa, Plasmodium falciparum
NFNSK

SEQ ID NO: 3330798 - protein, 6 aa, Plasmodium falciparum
NFNTDS

SEQ ID NO: 3330799 - protein, 12 aa, Plasmodium falciparum
NFNTSKKEFENR

SEQ ID NO: 3330800 - protein, 4 aa, Plasmodium falciparum
NFPN

SEQ ID NO: 3330801 - protein, 5 aa, Plasmodium falciparum
NFPND

SEQ ID NO: 3330802 - protein, 7 aa, Plasmodium falciparum
NFPNNNL

SEQ ID NO: 3330803 - protein, 7 aa, Plasmodium falciparum
NFPPNNF

SEQ ID NO: 3330804 - protein, 4 aa, Plasmodium falciparum
NFPT

SEQ ID NO: 3330805 - protein, 5 aa, Plasmodium falciparum
NFQGI

SEQ ID NO: 3330806 - protein, 9 aa, Plasmodium falciparum
NFQNKDKSF

SEQ ID NO: 3330807 - protein, 6 aa, Plasmodium falciparum
NFQPNG

SEQ ID NO: 3330808 - protein, 12 aa, Plasmodium falciparum
NFQRNEDDHHHK

SEQ ID NO: 3330809 - protein, 4 aa, Plasmodium falciparum
NFQT

SEQ ID NO: 3330810 - protein, 9 aa, Plasmodium falciparum
NFRKDTSKR

SEQ ID NO: 3330811 - protein, 4 aa, Plasmodium falciparum
NFSD

SEQ ID NO: 3330812 - protein, 17 aa, Plasmodium falciparum
NFSDKNKKANPFKGTKN

SEQ ID NO: 3330813 - protein, 21 aa, Plasmodium falciparum
NFSDKNKNHSSSKQKGNSNPL

SEQ ID NO: 3330814 - protein, 10 aa, Plasmodium falciparum
NFSDKTNNNK

SEQ ID NO: 3330815 - protein, 7 aa, Plasmodium falciparum
NFSDTGN

SEQ ID NO: 3330816 - protein, 11 aa, Plasmodium falciparum
NFSGSNNNHYG

SEQ ID NO: 3330817 - protein, 11 aa, Plasmodium falciparum
NFSNDNKHKSN

SEQ ID NO: 3330818 - protein, 8 aa, Plasmodium falciparum
NFSNGNNL

SEQ ID NO: 3330819 - protein, 13 aa, Plasmodium falciparum
NFSPSSKEQDSNY

SEQ ID NO: 3330820 - protein, 11 aa, Plasmodium falciparum
NFSSESSDSYY

SEQ ID NO: 3330821 - protein, 11 aa, Plasmodium falciparum
NFSSNDSPTAY

SEQ ID NO: 3330822 - protein, 10 aa, Plasmodium falciparum
NFSSQNGENN

SEQ ID NO: 3330823 - protein, 7 aa, Plasmodium falciparum
NFSTHDE

SEQ ID NO: 3330824 - protein, 7 aa, Plasmodium falciparum
NFSTPKE

SEQ ID NO: 3330825 - protein, 9 aa, Plasmodium falciparum
NFSTSSKKC

SEQ ID NO: 3330826 - protein, 4 aa, Plasmodium falciparum
NFTK

SEQ ID NO: 3330827 - protein, 11 aa, Plasmodium falciparum
NFTNKKEKKWS

SEQ ID NO: 3330828 - protein, 5 aa, Plasmodium falciparum
NFTSK

SEQ ID NO: 3330829 - protein, 14 aa, Plasmodium falciparum
NFYEDSKKKKNIYS

SEQ ID NO: 3330830 - protein, 9 aa, Plasmodium falciparum
NGACAGEKI

SEQ ID NO: 3330831 - protein, 9 aa, Plasmodium falciparum
NGAGDFNRD

SEQ ID NO: 3330832 - protein, 7 aa, Plasmodium falciparum
NGAGKST

SEQ ID NO: 3330833 - protein, 9 aa, Plasmodium falciparum
NGANNNTGL

SEQ ID NO: 3330834 - protein, 6 aa, Plasmodium falciparum
NGCGKT

SEQ ID NO: 3330835 - protein, 6 aa, Plasmodium falciparum
NGCSHK

SEQ ID NO: 3330836 - protein, 7 aa, Plasmodium falciparum
NGDEEKL

SEQ ID NO: 3330837 - protein, 4 aa, Plasmodium falciparum
NGDG

SEQ ID NO: 3330838 - protein, 14 aa, Plasmodium falciparum
NGDGEVNKNYNHEK

SEQ ID NO: 3330839 - protein, 19 aa, Plasmodium falciparum
NGDGKEKLKMDDSKNYKDN

SEQ ID NO: 3330840 - protein, 4 aa, Plasmodium falciparum
NGDI

SEQ ID NO: 3330841 - protein, 7 aa, Plasmodium falciparum
NGDITKE

SEQ ID NO: 3330842 - protein, 5 aa, Plasmodium falciparum
NGDKK

SEQ ID NO: 3330843 - protein, 6 aa, Plasmodium falciparum
NGDKKN

SEQ ID NO: 3330844 - protein, 11 aa, Plasmodium falciparum
NGDKPKEKKCK

SEQ ID NO: 3330845 - protein, 8 aa, Plasmodium falciparum
NGDLDNSN

SEQ ID NO: 3330846 - protein, 4 aa, Plasmodium falciparum
NGDN

SEQ ID NO: 3330847 - protein, 5 aa, Plasmodium falciparum
NGDNI

SEQ ID NO: 3330848 - protein, 24 aa, Plasmodium falciparum
NGDNINGDNINGDNINGDNINGDN

SEQ ID NO: 3330849 - protein, 18 aa, Plasmodium falciparum
NGDNLDTVNNEKKSDALD

SEQ ID NO: 3330850 - protein, 5 aa, Plasmodium falciparum
NGDNN

SEQ ID NO: 3330851 - protein, 16 aa, Plasmodium falciparum
NGDPDNSNEEKNGEYI

SEQ ID NO: 3330852 - protein, 5 aa, Plasmodium falciparum
NGDQS

SEQ ID NO: 3330853 - protein, 4 aa, Plasmodium falciparum
NGDS

SEQ ID NO: 3330854 - protein, 19 aa, Plasmodium falciparum
NGDSIDNSISNSKGNINNN

SEQ ID NO: 3330855 - protein, 6 aa, Plasmodium falciparum
NGDSIS

SEQ ID NO: 3330856 - protein, 13 aa, Plasmodium falciparum
NGDSKMNNSKNNY

SEQ ID NO: 3330857 - protein, 19 aa, Plasmodium falciparum
NGDTKDDLSLPKDTEGNLD

SEQ ID NO: 3330858 - protein, 4 aa, Plasmodium falciparum
NGED

SEQ ID NO: 3330859 - protein, 7 aa, Plasmodium falciparum
NGEEEQK

SEQ ID NO: 3330860 - protein, 6 aa, Plasmodium falciparum
NGEEKY

SEQ ID NO: 3330861 - protein, 15 aa, Plasmodium falciparum
NGEENNKKKKKKNIV

SEQ ID NO: 3330862 - protein, 6 aa, Plasmodium falciparum
NGEENR

SEQ ID NO: 3330863 - protein, 7 aa, Plasmodium falciparum
NGEESEI

SEQ ID NO: 3330864 - protein, 11 aa, Plasmodium falciparum
NGEHIKEKNEE

SEQ ID NO: 3330865 - protein, 5 aa, Plasmodium falciparum
NGEIN

SEQ ID NO: 3330866 - protein, 17 aa, Plasmodium falciparum
NGEINENPNEKREDEVP

SEQ ID NO: 3330867 - protein, 9 aa, Plasmodium falciparum
NGEKNKKNV

SEQ ID NO: 3330868 - protein, 5 aa, Plasmodium falciparum
NGEMN

SEQ ID NO: 3330869 - protein, 6 aa, Plasmodium falciparum
NGENID

SEQ ID NO: 3330870 - protein, 44 aa, Plasmodium falciparum
NGERNSNDSEEKEKEEKEDYNENTYNNMNTDNNTSNSNDDNEQI

SEQ ID NO: 3330871 - protein, 13 aa, Plasmodium falciparum
NGESDDERNEAGR

SEQ ID NO: 3330872 - protein, 10 aa, Plasmodium falciparum
NGESKEKKVR

SEQ ID NO: 3330873 - protein, 8 aa, Plasmodium falciparum
NGETLSKN

SEQ ID NO: 3330874 - protein, 6 aa, Plasmodium falciparum
NGETTS

SEQ ID NO: 3330875 - protein, 5 aa, Plasmodium falciparum
NGETY

SEQ ID NO: 3330876 - protein, 8 aa, Plasmodium falciparum
NGEYISSP

SEQ ID NO: 3330877 - protein, 26 aa, Plasmodium falciparum
NGFEYNNNNNNNNNTLRKNPKNYDNN

SEQ ID NO: 3330878 - protein, 12 aa, Plasmodium falciparum
NGFQARKLLTTL

SEQ ID NO: 3330879 - protein, 8 aa, Plasmodium falciparum
NGGDPHIN

SEQ ID NO: 3330880 - protein, 10 aa, Plasmodium falciparum
NGGGNNIYSN

SEQ ID NO: 3330881 - protein, 6 aa, Plasmodium falciparum
NGGKGI

SEQ ID NO: 3330882 - protein, 65 aa, Plasmodium falciparum
NGGNKNDDDDDDGDGDGDGDDDDGDDDGDSDDDDDGDDDDDDDGDGDDDDDGDDDDDDDDDSKKY

SEQ ID NO: 3330883 - protein, 6 aa, Plasmodium falciparum
NGGNSM

SEQ ID NO: 3330884 - protein, 5 aa, Plasmodium falciparum
NGGPN

SEQ ID NO: 3330885 - protein, 5 aa, Plasmodium falciparum
NGGTI

SEQ ID NO: 3330886 - protein, 23 aa, Plasmodium falciparum
NGHNKNNDDNKNNDDNKNNDDNI

SEQ ID NO: 3330887 - protein, 9 aa, Plasmodium falciparum
NGHNNNDNI

SEQ ID NO: 3330888 - protein, 48 aa, Plasmodium falciparum
NGHNNNNNDDDDNGDHSDNNNEKNNKFYKNNDGSSVSSSSSVSSSSSF

SEQ ID NO: 3330889 - protein, 6 aa, Plasmodium falciparum
NGHNNY

SEQ ID NO: 3330890 - protein, 8 aa, Plasmodium falciparum
NGHNSIDD

SEQ ID NO: 3330891 - protein, 9 aa, Plasmodium falciparum
NGHPKSSYT

SEQ ID NO: 3330892 - protein, 14 aa, Plasmodium falciparum
NGIDNNNNNNNNIN

SEQ ID NO: 3330893 - protein, 5 aa, Plasmodium falciparum
NGIET

SEQ ID NO: 3330894 - protein, 6 aa, Plasmodium falciparum
NGIGKS

SEQ ID NO: 3330895 - protein, 7 aa, Plasmodium falciparum
NGIGKST

SEQ ID NO: 3330896 - protein, 11 aa, Plasmodium falciparum
NGIGTRDTKRN

SEQ ID NO: 3330897 - protein, 4 aa, Plasmodium falciparum
NGIH

SEQ ID NO: 3330898 - protein, 13 aa, Plasmodium falciparum
NGIHTNKENEYNN

SEQ ID NO: 3330899 - protein, 34 aa, Plasmodium falciparum
NGINNNNNNNNNNNNNNNNNNNYYGDNNSYHNNS

SEQ ID NO: 3330900 - protein, 5 aa, Plasmodium falciparum
NGIRG

SEQ ID NO: 3330901 - protein, 7 aa, Plasmodium falciparum
NGISTTD

SEQ ID NO: 3330902 - protein, 5 aa, Plasmodium falciparum
NGITT

SEQ ID NO: 3330903 - protein, 5 aa, Plasmodium falciparum
NGKAD

SEQ ID NO: 3330904 - protein, 9 aa, Plasmodium falciparum
NGKDKGDNY

SEQ ID NO: 3330905 - protein, 12 aa, Plasmodium falciparum
NGKDKKEENKIH

SEQ ID NO: 3330906 - protein, 10 aa, Plasmodium falciparum
NGKDRNDNLE

SEQ ID NO: 3330907 - protein, 9 aa, Plasmodium falciparum
NGKDVKNNL

SEQ ID NO: 3330908 - protein, 4 aa, Plasmodium falciparum
NGKE

SEQ ID NO: 3330909 - protein, 5 aa, Plasmodium falciparum
NGKED

SEQ ID NO: 3330910 - protein, 26 aa, Plasmodium falciparum
NGKELKSHKNIKEEKGGIEKTDTTNI

SEQ ID NO: 3330911 - protein, 14 aa, Plasmodium falciparum
NGKEPEFTNKTPSF

SEQ ID NO: 3330912 - protein, 7 aa, Plasmodium falciparum
NGKFKTK

SEQ ID NO: 3330913 - protein, 18 aa, Plasmodium falciparum
NGKFNKDENIKNASQSSL

SEQ ID NO: 3330914 - protein, 8 aa, Plasmodium falciparum
NGKGEMPN

SEQ ID NO: 3330915 - protein, 15 aa, Plasmodium falciparum
NGKGHTENEQDENNY

SEQ ID NO: 3330916 - protein, 6 aa, Plasmodium falciparum
NGKGKH

SEQ ID NO: 3330917 - protein, 20 aa, Plasmodium falciparum
NGKGSTKNDVEENKKDINTH

SEQ ID NO: 3330918 - protein, 4 aa, Plasmodium falciparum
NGKI

SEQ ID NO: 3330919 - protein, 5 aa, Plasmodium falciparum
NGKIN

SEQ ID NO: 3330920 - protein, 6 aa, Plasmodium falciparum
NGKISV

SEQ ID NO: 3330921 - protein, 5 aa, Plasmodium falciparum
NGKKD

SEQ ID NO: 3330922 - protein, 10 aa, Plasmodium falciparum
NGKKDDSLNK

SEQ ID NO: 3330923 - protein, 5 aa, Plasmodium falciparum
NGKKE

SEQ ID NO: 3330924 - protein, 5 aa, Plasmodium falciparum
NGKKK

SEQ ID NO: 3330925 - protein, 8 aa, Plasmodium falciparum
NGKKKGIG

SEQ ID NO: 3330926 - protein, 11 aa, Plasmodium falciparum
NGKKSKRRKNH

SEQ ID NO: 3330927 - protein, 13 aa, Plasmodium falciparum
NGKKTCGKQKCKG

SEQ ID NO: 3330928 - protein, 24 aa, Plasmodium falciparum
NGKLKEKETNMEKKEADADKKGSL

SEQ ID NO: 3330929 - protein, 5 aa, Plasmodium falciparum
NGKLN

SEQ ID NO: 3330930 - protein, 28 aa, Plasmodium falciparum
NGKLQKVDGRKKRRYHKSKNTQSINTGE

SEQ ID NO: 3330931 - protein, 4 aa, Plasmodium falciparum
NGKN

SEQ ID NO: 3330932 - protein, 8 aa, Plasmodium falciparum
NGKNEEAN

SEQ ID NO: 3330933 - protein, 22 aa, Plasmodium falciparum
NGKNEKKNLKNEMKKNKKSTKL

SEQ ID NO: 3330934 - protein, 15 aa, Plasmodium falciparum
NGKNENKAQQNEVNK

SEQ ID NO: 3330935 - protein, 6 aa, Plasmodium falciparum
NGKNEY

SEQ ID NO: 3330936 - protein, 6 aa, Plasmodium falciparum
NGKNFE

SEQ ID NO: 3330937 - protein, 53 aa, Plasmodium falciparum
NGKNGEDPNVNDDEPLTNKYKNKTHNNNSNNNKISSSNNKLHNNNSNSSNMKK

SEQ ID NO: 3330938 - protein, 8 aa, Plasmodium falciparum
NGKNKNKM

SEQ ID NO: 3330939 - protein, 10 aa, Plasmodium falciparum
NGKNLKEKKG

SEQ ID NO: 3330940 - protein, 5 aa, Plasmodium falciparum
NGKNT

SEQ ID NO: 3330941 - protein, 7 aa, Plasmodium falciparum
NGKNYKG

SEQ ID NO: 3330942 - protein, 7 aa, Plasmodium falciparum
NGKQEKR

SEQ ID NO: 3330943 - protein, 9 aa, Plasmodium falciparum
NGKQTNLRG

SEQ ID NO: 3330944 - protein, 16 aa, Plasmodium falciparum
NGKRKEDHNEDSYNNS

SEQ ID NO: 3330945 - protein, 8 aa, Plasmodium falciparum
NGKSFKND

SEQ ID NO: 3330946 - protein, 5 aa, Plasmodium falciparum
NGKST

SEQ ID NO: 3330947 - protein, 5 aa, Plasmodium falciparum
NGKTQ

SEQ ID NO: 3330948 - protein, 6 aa, Plasmodium falciparum
NGKVHK

SEQ ID NO: 3330949 - protein, 29 aa, Plasmodium falciparum
NGKVQKKGAAHNKENENEEKNKNNKNNYI

SEQ ID NO: 3330950 - protein, 4 aa, Plasmodium falciparum
NGKY

SEQ ID NO: 3330951 - protein, 6 aa, Plasmodium falciparum
NGKYEE

SEQ ID NO: 3330952 - protein, 8 aa, Plasmodium falciparum
NGKYKKNN

SEQ ID NO: 3330953 - protein, 5 aa, Plasmodium falciparum
NGKYN

SEQ ID NO: 3330954 - protein, 16 aa, Plasmodium falciparum
NGLEDEEQNCTNGYDK

SEQ ID NO: 3330955 - protein, 8 aa, Plasmodium falciparum
NGLGGKNN

SEQ ID NO: 3330956 - protein, 8 aa, Plasmodium falciparum
NGLGTRDD

SEQ ID NO: 3330957 - protein, 12 aa, Plasmodium falciparum
NGLKKEKQSGEK

SEQ ID NO: 3330958 - protein, 7 aa, Plasmodium falciparum
NGLKPSE

SEQ ID NO: 3330959 - protein, 4 aa, Plasmodium falciparum
NGLN

SEQ ID NO: 3330960 - protein, 46 aa, Plasmodium falciparum
NGLPLSEHSSNENNITNKMNTNKNNNKNRNNNANNNYNNQDNTLNC

SEQ ID NO: 3330961 - protein, 9 aa, Plasmodium falciparum
NGLSENNKT

SEQ ID NO: 3330962 - protein, 117 aa, Plasmodium falciparum
NGLSPRNSTARSEDKDDKNNDNTKDDNIKDDNIKDDNIKDDNIKDDNIKDDNIKDDNIKDDNTKDDNIKDDNIKDDNTKDDNIKDDNIKDDNIKDDNTINDNKNNDNKNNDNNNNDN

SEQ ID NO: 3330963 - protein, 5 aa, Plasmodium falciparum
NGLSR

SEQ ID NO: 3330964 - protein, 14 aa, Plasmodium falciparum
NGLSTSNEEEIEKQ

SEQ ID NO: 3330965 - protein, 26 aa, Plasmodium falciparum
NGMENSTNQNMYQNNNNNNNNSNGES

SEQ ID NO: 3330966 - protein, 17 aa, Plasmodium falciparum
NGNCEVKNKPDGNCGKN

SEQ ID NO: 3330967 - protein, 32 aa, Plasmodium falciparum
NGNDHINGNDHINGNDHINGNDHINGNDHING

SEQ ID NO: 3330968 - protein, 5 aa, Plasmodium falciparum
NGNDK

SEQ ID NO: 3330969 - protein, 14 aa, Plasmodium falciparum
NGNDSDTNKFNKYD

SEQ ID NO: 3330970 - protein, 7 aa, Plasmodium falciparum
NGNIGYN

SEQ ID NO: 3330971 - protein, 26 aa, Plasmodium falciparum
NGNIQNEKKNEGKQNNKKKTNNIPQP

SEQ ID NO: 3330972 - protein, 14 aa, Plasmodium falciparum
NGNIQNNSSNYYNK

SEQ ID NO: 3330973 - protein, 9 aa, Plasmodium falciparum
NGNISESDY

SEQ ID NO: 3330974 - protein, 4 aa, Plasmodium falciparum
NGNK

SEQ ID NO: 3330975 - protein, 14 aa, Plasmodium falciparum
NGNKDKEKENDMKN

SEQ ID NO: 3330976 - protein, 10 aa, Plasmodium falciparum
NGNKKNDHTY

SEQ ID NO: 3330977 - protein, 10 aa, Plasmodium falciparum
NGNKNKSISR

SEQ ID NO: 3330978 - protein, 9 aa, Plasmodium falciparum
NGNKNLEKE

SEQ ID NO: 3330979 - protein, 9 aa, Plasmodium falciparum
NGNKNRSDY

SEQ ID NO: 3330980 - protein, 7 aa, Plasmodium falciparum
NGNKSPV

SEQ ID NO: 3330981 - protein, 9 aa, Plasmodium falciparum
NGNKYDNNN

SEQ ID NO: 3330982 - protein, 12 aa, Plasmodium falciparum
NGNKYNNNRQEH

SEQ ID NO: 3330983 - protein, 8 aa, Plasmodium falciparum
NGNLEDEQ

SEQ ID NO: 3330984 - protein, 7 aa, Plasmodium falciparum
NGNLPNN

SEQ ID NO: 3330985 - protein, 5 aa, Plasmodium falciparum
NGNMN

SEQ ID NO: 3330986 - protein, 17 aa, Plasmodium falciparum
NGNNDSNNKKKKKKKKL

SEQ ID NO: 3330987 - protein, 13 aa, Plasmodium falciparum
NGNNEKNKMSEKY

SEQ ID NO: 3330988 - protein, 7 aa, Plasmodium falciparum
NGNNEQV

SEQ ID NO: 3330989 - protein, 7 aa, Plasmodium falciparum
NGNNFNK

SEQ ID NO: 3330990 - protein, 6 aa, Plasmodium falciparum
NGNNIK

SEQ ID NO: 3330991 - protein, 8 aa, Plasmodium falciparum
NGNNLNNG

SEQ ID NO: 3330992 - protein, 20 aa, Plasmodium falciparum
NGNNLNNGNNLNNGNNLNNG

SEQ ID NO: 3330993 - protein, 21 aa, Plasmodium falciparum
NGNNNINNNSNNNNLQSLNNQ

SEQ ID NO: 3330994 - protein, 7 aa, Plasmodium falciparum
NGNNNMN

SEQ ID NO: 3330995 - protein, 42 aa, Plasmodium falciparum
NGNNNNINSNNNNNNNNNNSNNNNNSNNNNNNSSSSTTFSNS

SEQ ID NO: 3330996 - protein, 14 aa, Plasmodium falciparum
NGNNNNKNSNNNQY

SEQ ID NO: 3330997 - protein, 9 aa, Plasmodium falciparum
NGNNNNNYD

SEQ ID NO: 3330998 - protein, 45 aa, Plasmodium falciparum
NGNNSAIGNTNMNNSSNRNNNNNNNNHNNNNIKSNTVNNNNNNNV

SEQ ID NO: 3330999 - protein, 11 aa, Plasmodium falciparum
NGNNSGQPPCN

SEQ ID NO: 3331000 - protein, 8 aa, Plasmodium falciparum
NGNNTTYS

SEQ ID NO: 3331001 - protein, 22 aa, Plasmodium falciparum
NGNPSEDTNNLNDKEKKSDGII

SEQ ID NO: 3331002 - protein, 12 aa, Plasmodium falciparum
NGNQVNEEENQS

SEQ ID NO: 3331003 - protein, 5 aa, Plasmodium falciparum
NGNSR

SEQ ID NO: 3331004 - protein, 8 aa, Plasmodium falciparum
NGNTEPRG

SEQ ID NO: 3331005 - protein, 5 aa, Plasmodium falciparum
NGNTF

SEQ ID NO: 3331006 - protein, 6 aa, Plasmodium falciparum
NGNTHK

SEQ ID NO: 3331007 - protein, 16 aa, Plasmodium falciparum
NGNTSECEKSQDSDDE

SEQ ID NO: 3331008 - protein, 5 aa, Plasmodium falciparum
NGNVK

SEQ ID NO: 3331009 - protein, 11 aa, Plasmodium falciparum
NGNVNDTNKEE

SEQ ID NO: 3331010 - protein, 7 aa, Plasmodium falciparum
NGNVSNN

SEQ ID NO: 3331011 - protein, 5 aa, Plasmodium falciparum
NGNYY

SEQ ID NO: 3331012 - protein, 8 aa, Plasmodium falciparum
NGPGDPKK

SEQ ID NO: 3331013 - protein, 8 aa, Plasmodium falciparum
NGPKDTYI

SEQ ID NO: 3331014 - protein, 4 aa, Plasmodium falciparum
NGPM

SEQ ID NO: 3331015 - protein, 6 aa, Plasmodium falciparum
NGPNIY

SEQ ID NO: 3331016 - protein, 5 aa, Plasmodium falciparum
NGPRY

SEQ ID NO: 3331017 - protein, 12 aa, Plasmodium falciparum
NGPSDVSHGSTW

SEQ ID NO: 3331018 - protein, 9 aa, Plasmodium falciparum
NGPSPKDQG

SEQ ID NO: 3331019 - protein, 7 aa, Plasmodium falciparum
NGPTAKY

SEQ ID NO: 3331020 - protein, 7 aa, Plasmodium falciparum
NGPYSST

SEQ ID NO: 3331021 - protein, 7 aa, Plasmodium falciparum
NGPYTEQ

SEQ ID NO: 3331022 - protein, 7 aa, Plasmodium falciparum
NGQNSCK

SEQ ID NO: 3331023 - protein, 13 aa, Plasmodium falciparum
NGQNVSEQNDISN

SEQ ID NO: 3331024 - protein, 13 aa, Plasmodium falciparum
NGQRKEKKNETHH

SEQ ID NO: 3331025 - protein, 8 aa, Plasmodium falciparum
NGQSNDKF

SEQ ID NO: 3331026 - protein, 7 aa, Plasmodium falciparum
NGQTTRP

SEQ ID NO: 3331027 - protein, 6 aa, Plasmodium falciparum
NGQYDD

SEQ ID NO: 3331028 - protein, 6 aa, Plasmodium falciparum
NGRSRS

SEQ ID NO: 3331029 - protein, 14 aa, Plasmodium falciparum
NGRYKEKGNEKYEN

SEQ ID NO: 3331030 - protein, 4 aa, Plasmodium falciparum
NGSF

SEQ ID NO: 3331031 - protein, 7 aa, Plasmodium falciparum
NGSFDPV

SEQ ID NO: 3331032 - protein, 8 aa, Plasmodium falciparum
NGSFNSKA

SEQ ID NO: 3331033 - protein, 9 aa, Plasmodium falciparum
NGSGKDYGL

SEQ ID NO: 3331034 - protein, 7 aa, Plasmodium falciparum
NGSGKTT

SEQ ID NO: 3331035 - protein, 19 aa, Plasmodium falciparum
NGSGNVKAGVAGDDAPRSV

SEQ ID NO: 3331036 - protein, 12 aa, Plasmodium falciparum
NGSHNLNNNSHK

SEQ ID NO: 3331037 - protein, 12 aa, Plasmodium falciparum
NGSHPNEKRHSL

SEQ ID NO: 3331038 - protein, 14 aa, Plasmodium falciparum
NGSIESNQPNERNT

SEQ ID NO: 3331039 - protein, 68 aa, Plasmodium falciparum
NGSINDKINDNNKENIRDNNNDNTYDNNNDNTYDNNNDNTHDNNNDNTYDNNNDNTYDNNNDNTYNNN

SEQ ID NO: 3331040 - protein, 9 aa, Plasmodium falciparum
NGSINQSEE

SEQ ID NO: 3331041 - protein, 8 aa, Plasmodium falciparum
NGSIPSSS

SEQ ID NO: 3331042 - protein, 25 aa, Plasmodium falciparum
NGSIQKKKEENELENNKKLNHKNNL

SEQ ID NO: 3331043 - protein, 7 aa, Plasmodium falciparum
NGSKIKE

SEQ ID NO: 3331044 - protein, 7 aa, Plasmodium falciparum
NGSKYNV

SEQ ID NO: 3331045 - protein, 4 aa, Plasmodium falciparum
NGSM

SEQ ID NO: 3331046 - protein, 25 aa, Plasmodium falciparum
NGSNDKVEDNVRQNEGEKNNMNELK

SEQ ID NO: 3331047 - protein, 8 aa, Plasmodium falciparum
NGSNGNTK

SEQ ID NO: 3331048 - protein, 5 aa, Plasmodium falciparum
NGSNK

SEQ ID NO: 3331049 - protein, 5 aa, Plasmodium falciparum
NGSNN

SEQ ID NO: 3331050 - protein, 9 aa, Plasmodium falciparum
NGSNNTNDM

SEQ ID NO: 3331051 - protein, 7 aa, Plasmodium falciparum
NGSNRNK

SEQ ID NO: 3331052 - protein, 4 aa, Plasmodium falciparum
NGSP

SEQ ID NO: 3331053 - protein, 7 aa, Plasmodium falciparum
NGSPLTT

SEQ ID NO: 3331054 - protein, 6 aa, Plasmodium falciparum
NGSPSI

SEQ ID NO: 3331055 - protein, 6 aa, Plasmodium falciparum
NGSRKY

SEQ ID NO: 3331056 - protein, 23 aa, Plasmodium falciparum
NGSSKVDEEDKNIYNSKNNNNNM

SEQ ID NO: 3331057 - protein, 6 aa, Plasmodium falciparum
NGSSVD

SEQ ID NO: 3331058 - protein, 10 aa, Plasmodium falciparum
NGSTAKTKTD

SEQ ID NO: 3331059 - protein, 5 aa, Plasmodium falciparum
NGSTN

SEQ ID NO: 3331060 - protein, 6 aa, Plasmodium falciparum
NGSTPD

SEQ ID NO: 3331061 - protein, 7 aa, Plasmodium falciparum
NGSVNTN

SEQ ID NO: 3331062 - protein, 6 aa, Plasmodium falciparum
NGSYDD

SEQ ID NO: 3331063 - protein, 14 aa, Plasmodium falciparum
NGSYEDWRLDELII

SEQ ID NO: 3331064 - protein, 12 aa, Plasmodium falciparum
NGSYNPITGCFN

SEQ ID NO: 3331065 - protein, 88 aa, Plasmodium falciparum
NGTCNSVGDKETEKNNEKNNEKNNEKNNEKNNEKNNEKNNEKNNEKNNEENNEGNNEENNEENNEENNEENNDIEKNDIKDNNSGQVK

SEQ ID NO: 3331066 - protein, 5 aa, Plasmodium falciparum
NGTDL

SEQ ID NO: 3331067 - protein, 5 aa, Plasmodium falciparum
NGTDY

SEQ ID NO: 3331068 - protein, 5 aa, Plasmodium falciparum
NGTEA

SEQ ID NO: 3331069 - protein, 10 aa, Plasmodium falciparum
NGTEEPPDYK

SEQ ID NO: 3331070 - protein, 5 aa, Plasmodium falciparum
NGTGK

SEQ ID NO: 3331071 - protein, 5 aa, Plasmodium falciparum
NGTKI

SEQ ID NO: 3331072 - protein, 5 aa, Plasmodium falciparum
NGTKY

SEQ ID NO: 3331073 - protein, 5 aa, Plasmodium falciparum
NGTLD

SEQ ID NO: 3331074 - protein, 14 aa, Plasmodium falciparum
NGTNLNTTNNNTHT

SEQ ID NO: 3331075 - protein, 7 aa, Plasmodium falciparum
NGTNSRP

SEQ ID NO: 3331076 - protein, 5 aa, Plasmodium falciparum
NGTPV

SEQ ID NO: 3331077 - protein, 50 aa, Plasmodium falciparum
NGTQNNNEKEETLRSPKKDANSNKELKNEKSQKENMNNNQSSNKKSVTDA

SEQ ID NO: 3331078 - protein, 5 aa, Plasmodium falciparum
NGTRK

SEQ ID NO: 3331079 - protein, 8 aa, Plasmodium falciparum
NGTSEKQH

SEQ ID NO: 3331080 - protein, 5 aa, Plasmodium falciparum
NGTSM

SEQ ID NO: 3331081 - protein, 31 aa, Plasmodium falciparum
NGTSSSSSSVGGKRQTRRTRSISSDDNGYES

SEQ ID NO: 3331082 - protein, 7 aa, Plasmodium falciparum
NGTTEDA

SEQ ID NO: 3331083 - protein, 16 aa, Plasmodium falciparum
NGTYDENETYGQNATN

SEQ ID NO: 3331084 - protein, 11 aa, Plasmodium falciparum
NGTYDENETYN

SEQ ID NO: 3331085 - protein, 10 aa, Plasmodium falciparum
NGVDKNGNNI

SEQ ID NO: 3331086 - protein, 19 aa, Plasmodium falciparum
NGVNDKASHAYNNRKTNRN

SEQ ID NO: 3331087 - protein, 7 aa, Plasmodium falciparum
NGVTDKC

SEQ ID NO: 3331088 - protein, 6 aa, Plasmodium falciparum
NGYATT

SEQ ID NO: 3331089 - protein, 6 aa, Plasmodium falciparum
NGYDSS

SEQ ID NO: 3331090 - protein, 6 aa, Plasmodium falciparum
NGYDSY

SEQ ID NO: 3331091 - protein, 11 aa, Plasmodium falciparum
NGYEENDNNTL

SEQ ID NO: 3331092 - protein, 6 aa, Plasmodium falciparum
NGYEHN

SEQ ID NO: 3331093 - protein, 4 aa, Plasmodium falciparum
NGYG

SEQ ID NO: 3331094 - protein, 14 aa, Plasmodium falciparum
NGYGEQNEVYNKKE

SEQ ID NO: 3331095 - protein, 5 aa, Plasmodium falciparum
NGYNN

SEQ ID NO: 3331096 - protein, 6 aa, Plasmodium falciparum
NGYNND

SEQ ID NO: 3331097 - protein, 10 aa, Plasmodium falciparum
NGYSKKEYEN

SEQ ID NO: 3331098 - protein, 41 aa, Plasmodium falciparum
NGYSSSSYKFNQSNEDDRTKTTERRRQNEDDRTKTTDRRTS

SEQ ID NO: 3331099 - protein, 7 aa, Plasmodium falciparum
NGYSTNK

SEQ ID NO: 3331100 - protein, 12 aa, Plasmodium falciparum
NGYTNNKSSYIS

SEQ ID NO: 3331101 - protein, 5 aa, Plasmodium falciparum
NGYYK

SEQ ID NO: 3331102 - protein, 46 aa, Plasmodium falciparum
NGYYSSGNDSFSSISSSSDDEEESDDESDSDNDNEEEKNESASGYM

SEQ ID NO: 3331103 - protein, 14 aa, Plasmodium falciparum
NHCNNKNTLKENDR

SEQ ID NO: 3331104 - protein, 16 aa, Plasmodium falciparum
NHDAKRATSNNNNINN

SEQ ID NO: 3331105 - protein, 5 aa, Plasmodium falciparum
NHDEK

SEQ ID NO: 3331106 - protein, 5 aa, Plasmodium falciparum
NHDEN

SEQ ID NO: 3331107 - protein, 19 aa, Plasmodium falciparum
NHDIAKEENVNGDNDVKKC

SEQ ID NO: 3331108 - protein, 11 aa, Plasmodium falciparum
NHDKENENNRS

SEQ ID NO: 3331109 - protein, 12 aa, Plasmodium falciparum
NHDNDDSNIKTN

SEQ ID NO: 3331110 - protein, 21 aa, Plasmodium falciparum
NHDNISDDENRGTHKKKKNEL

SEQ ID NO: 3331111 - protein, 20 aa, Plasmodium falciparum
NHDNNNNNNNNNGYKIEEKP

SEQ ID NO: 3331112 - protein, 8 aa, Plasmodium falciparum
NHDQNNAP

SEQ ID NO: 3331113 - protein, 9 aa, Plasmodium falciparum
NHDSKEEQS

SEQ ID NO: 3331114 - protein, 5 aa, Plasmodium falciparum
NHDSP

SEQ ID NO: 3331115 - protein, 9 aa, Plasmodium falciparum
NHDSSSGSC

SEQ ID NO: 3331116 - protein, 11 aa, Plasmodium falciparum
NHEERNKDNKY

SEQ ID NO: 3331117 - protein, 115 aa, Plasmodium falciparum
NHEGSNDSTDNKYNGNNNYNGHNNHHGDSDHNADNNYNDNNYLNPSGRNNNSSNNDGGNDDESTDDNDENDKEEDEEKDEENEEKDEENEEENDEENDEENYKKDNEEDYNQHKN

SEQ ID NO: 3331118 - protein, 26 aa, Plasmodium falciparum
NHEKGSDPSYNLNTKNTKNVTNTNDQ

SEQ ID NO: 3331119 - protein, 5 aa, Plasmodium falciparum
NHEKK

SEQ ID NO: 3331120 - protein, 9 aa, Plasmodium falciparum
NHENNKNKG

SEQ ID NO: 3331121 - protein, 13 aa, Plasmodium falciparum
NHEQTKKNITNEK

SEQ ID NO: 3331122 - protein, 12 aa, Plasmodium falciparum
NHERKKSLPVEP

SEQ ID NO: 3331123 - protein, 9 aa, Plasmodium falciparum
NHESEKKLY

SEQ ID NO: 3331124 - protein, 8 aa, Plasmodium falciparum
NHESNTNQ

SEQ ID NO: 3331125 - protein, 7 aa, Plasmodium falciparum
NHESVSP

SEQ ID NO: 3331126 - protein, 21 aa, Plasmodium falciparum
NHETNNKYQGPHKRKSHLFTN

SEQ ID NO: 3331127 - protein, 6 aa, Plasmodium falciparum
NHGDCN

SEQ ID NO: 3331128 - protein, 11 aa, Plasmodium falciparum
NHGHNHNNNHN

SEQ ID NO: 3331129 - protein, 8 aa, Plasmodium falciparum
NHGKEELR

SEQ ID NO: 3331130 - protein, 5 aa, Plasmodium falciparum
NHGPY

SEQ ID NO: 3331131 - protein, 5 aa, Plasmodium falciparum
NHGSK

SEQ ID NO: 3331132 - protein, 11 aa, Plasmodium falciparum
NHGTEDDDNFS

SEQ ID NO: 3331133 - protein, 12 aa, Plasmodium falciparum
NHHDDDKDEYYS

SEQ ID NO: 3331134 - protein, 24 aa, Plasmodium falciparum
NHHDINNTNDNNKVDLNNTNNNNK

SEQ ID NO: 3331135 - protein, 8 aa, Plasmodium falciparum
NHHEDTQK

SEQ ID NO: 3331136 - protein, 13 aa, Plasmodium falciparum
NHHNNNINSYSNN

SEQ ID NO: 3331137 - protein, 18 aa, Plasmodium falciparum
NHHPNEPSSDKHPNTSEY

SEQ ID NO: 3331138 - protein, 13 aa, Plasmodium falciparum
NHHQKKKNKIVQK

SEQ ID NO: 3331139 - protein, 35 aa, Plasmodium falciparum
NHHSNKSDKSSRKEHHSRYGSSSTTREKAVSSNNT

SEQ ID NO: 3331140 - protein, 5 aa, Plasmodium falciparum
NHHTN

SEQ ID NO: 3331141 - protein, 9 aa, Plasmodium falciparum
NHIDKDGKI

SEQ ID NO: 3331142 - protein, 8 aa, Plasmodium falciparum
NHIGQDKS

SEQ ID NO: 3331143 - protein, 5 aa, Plasmodium falciparum
NHIKN

SEQ ID NO: 3331144 - protein, 5 aa, Plasmodium falciparum
NHIKT

SEQ ID NO: 3331145 - protein, 4 aa, Plasmodium falciparum
NHIN

SEQ ID NO: 3331146 - protein, 21 aa, Plasmodium falciparum
NHISDDKQDNEKKDTKLKRKK

SEQ ID NO: 3331147 - protein, 12 aa, Plasmodium falciparum
NHISRKQQNNNI

SEQ ID NO: 3331148 - protein, 5 aa, Plasmodium falciparum
NHISS

SEQ ID NO: 3331149 - protein, 14 aa, Plasmodium falciparum
NHKDENINKTNDIC

SEQ ID NO: 3331150 - protein, 15 aa, Plasmodium falciparum
NHKDKNLHKNEMKDG

SEQ ID NO: 3331151 - protein, 17 aa, Plasmodium falciparum
NHKDNNDNNKDATHNNN

SEQ ID NO: 3331152 - protein, 8 aa, Plasmodium falciparum
NHKDQYNM

SEQ ID NO: 3331153 - protein, 14 aa, Plasmodium falciparum
NHKENSHYLIEDGK

SEQ ID NO: 3331154 - protein, 9 aa, Plasmodium falciparum
NHKEPISNN

SEQ ID NO: 3331155 - protein, 7 aa, Plasmodium falciparum
NHKEYSY

SEQ ID NO: 3331156 - protein, 18 aa, Plasmodium falciparum
NHKKDKKKYYSDDSYHSE

SEQ ID NO: 3331157 - protein, 11 aa, Plasmodium falciparum
NHKKDQKKKNH

SEQ ID NO: 3331158 - protein, 10 aa, Plasmodium falciparum
NHKKNHNKNI

SEQ ID NO: 3331159 - protein, 10 aa, Plasmodium falciparum
NHKKPSQDKH

SEQ ID NO: 3331160 - protein, 40 aa, Plasmodium falciparum
NHKKSNNLSNNQKDISEQHDNSQESSDDASTIRSDESSDI

SEQ ID NO: 3331161 - protein, 4 aa, Plasmodium falciparum
NHKL

SEQ ID NO: 3331162 - protein, 7 aa, Plasmodium falciparum
NHKNDNK

SEQ ID NO: 3331163 - protein, 13 aa, Plasmodium falciparum
NHKNNLKDGINKE

SEQ ID NO: 3331164 - protein, 6 aa, Plasmodium falciparum
NHKNNN

SEQ ID NO: 3331165 - protein, 11 aa, Plasmodium falciparum
NHKNRENFNEC

SEQ ID NO: 3331166 - protein, 6 aa, Plasmodium falciparum
NHKPKE

SEQ ID NO: 3331167 - protein, 5 aa, Plasmodium falciparum
NHKPT

SEQ ID NO: 3331168 - protein, 4 aa, Plasmodium falciparum
NHKQ

SEQ ID NO: 3331169 - protein, 7 aa, Plasmodium falciparum
NHKQDKN

SEQ ID NO: 3331170 - protein, 11 aa, Plasmodium falciparum
NHKQEEKNKTN

SEQ ID NO: 3331171 - protein, 5 aa, Plasmodium falciparum
NHKSR

SEQ ID NO: 3331172 - protein, 8 aa, Plasmodium falciparum
NHKTNESI

SEQ ID NO: 3331173 - protein, 7 aa, Plasmodium falciparum
NHKTRQY

SEQ ID NO: 3331174 - protein, 9 aa, Plasmodium falciparum
NHKYNSHPQ

SEQ ID NO: 3331175 - protein, 20 aa, Plasmodium falciparum
NHLDEEEKCKKENINDNNLN

SEQ ID NO: 3331176 - protein, 9 aa, Plasmodium falciparum
NHLNEKDRN

SEQ ID NO: 3331177 - protein, 4 aa, Plasmodium falciparum
NHLS

SEQ ID NO: 3331178 - protein, 4 aa, Plasmodium falciparum
NHLT

SEQ ID NO: 3331179 - protein, 7 aa, Plasmodium falciparum
NHMNSNN

SEQ ID NO: 3331180 - protein, 47 aa, Plasmodium falciparum
NHNGNKNKNNIDIDNKNENYQNNNAEQGQKEEIDENVTDEQQDDEDM

SEQ ID NO: 3331181 - protein, 8 aa, Plasmodium falciparum
NHNKKGYT

SEQ ID NO: 3331182 - protein, 12 aa, Plasmodium falciparum
NHNKNDDVNNHD

SEQ ID NO: 3331183 - protein, 6 aa, Plasmodium falciparum
NHNKNN

SEQ ID NO: 3331184 - protein, 4 aa, Plasmodium falciparum
NHNN

SEQ ID NO: 3331185 - protein, 14 aa, Plasmodium falciparum
NHNNHNNRIQDKLP

SEQ ID NO: 3331186 - protein, 30 aa, Plasmodium falciparum
NHNNKNNNYNMNNKSSFNNNINNSHNNGSV

SEQ ID NO: 3331187 - protein, 11 aa, Plasmodium falciparum
NHNNKNYNSDN

SEQ ID NO: 3331188 - protein, 12 aa, Plasmodium falciparum
NHNNNCEDKDND

SEQ ID NO: 3331189 - protein, 7 aa, Plasmodium falciparum
NHNNNDS

SEQ ID NO: 3331190 - protein, 14 aa, Plasmodium falciparum
NHNNNHNNKNNNHI

SEQ ID NO: 3331191 - protein, 6 aa, Plasmodium falciparum
NHNNNN

SEQ ID NO: 3331192 - protein, 32 aa, Plasmodium falciparum
NHNNNNKKDDNKNDDNKNDDNENDDNNNNHNN

SEQ ID NO: 3331193 - protein, 9 aa, Plasmodium falciparum
NHNNNNKYN

SEQ ID NO: 3331194 - protein, 7 aa, Plasmodium falciparum
NHNNNNN

SEQ ID NO: 3331195 - protein, 13 aa, Plasmodium falciparum
NHNNNNNNNNKDK

SEQ ID NO: 3331196 - protein, 11 aa, Plasmodium falciparum
NHNNNNNNNNM

SEQ ID NO: 3331197 - protein, 19 aa, Plasmodium falciparum
NHNNNNNNNNNKSSNNNLN

SEQ ID NO: 3331198 - protein, 15 aa, Plasmodium falciparum
NHNNNNNNNNNNCSN

SEQ ID NO: 3331199 - protein, 28 aa, Plasmodium falciparum
NHNNNNNNNNNNNNNNNNNNNNNNNNSY

SEQ ID NO: 3331200 - protein, 8 aa, Plasmodium falciparum
NHNNNPHY

SEQ ID NO: 3331201 - protein, 11 aa, Plasmodium falciparum
NHNNNYHENEE

SEQ ID NO: 3331202 - protein, 7 aa, Plasmodium falciparum
NHNNSIN

SEQ ID NO: 3331203 - protein, 8 aa, Plasmodium falciparum
NHNNTNDT

SEQ ID NO: 3331204 - protein, 21 aa, Plasmodium falciparum
NHNNYNNNNNNNNNNYNNNTR

SEQ ID NO: 3331205 - protein, 9 aa, Plasmodium falciparum
NHNQSPRNT

SEQ ID NO: 3331206 - protein, 33 aa, Plasmodium falciparum
NHNRDYDNKNVNKYSDGIKDNSCYNKNEESSKM

SEQ ID NO: 3331207 - protein, 5 aa, Plasmodium falciparum
NHNRS

SEQ ID NO: 3331208 - protein, 8 aa, Plasmodium falciparum
NHNSNMNT

SEQ ID NO: 3331209 - protein, 6 aa, Plasmodium falciparum
NHNSSS

SEQ ID NO: 3331210 - protein, 30 aa, Plasmodium falciparum
NHNTDDINHNDDNNDDNNNNNNNNNNLEEQ

SEQ ID NO: 3331211 - protein, 11 aa, Plasmodium falciparum
NHNVTKENKEV

SEQ ID NO: 3331212 - protein, 6 aa, Plasmodium falciparum
NHPGNH

SEQ ID NO: 3331213 - protein, 4 aa, Plasmodium falciparum
NHPI

SEQ ID NO: 3331214 - protein, 4 aa, Plasmodium falciparum
NHPK

SEQ ID NO: 3331215 - protein, 16 aa, Plasmodium falciparum
NHPNDDTISSKEKEKF

SEQ ID NO: 3331216 - protein, 6 aa, Plasmodium falciparum
NHPSEN

SEQ ID NO: 3331217 - protein, 12 aa, Plasmodium falciparum
NHPTNHKEKQIQ

SEQ ID NO: 3331218 - protein, 4 aa, Plasmodium falciparum
NHQE

SEQ ID NO: 3331219 - protein, 13 aa, Plasmodium falciparum
NHQGNNKALPPLP

SEQ ID NO: 3331220 - protein, 5 aa, Plasmodium falciparum
NHQKE

SEQ ID NO: 3331221 - protein, 6 aa, Plasmodium falciparum
NHQKNM

SEQ ID NO: 3331222 - protein, 4 aa, Plasmodium falciparum
NHQR

SEQ ID NO: 3331223 - protein, 6 aa, Plasmodium falciparum
NHQRNK

SEQ ID NO: 3331224 - protein, 6 aa, Plasmodium falciparum
NHQTVN

SEQ ID NO: 3331225 - protein, 16 aa, Plasmodium falciparum
NHRQNDITKKENDEEN

SEQ ID NO: 3331226 - protein, 13 aa, Plasmodium falciparum
NHRSNTKNKRPLS

SEQ ID NO: 3331227 - protein, 4 aa, Plasmodium falciparum
NHSE

SEQ ID NO: 3331228 - protein, 10 aa, Plasmodium falciparum
NHSGNTNSNN

SEQ ID NO: 3331229 - protein, 31 aa, Plasmodium falciparum
NHSKGVQKKNDDTDKNNITSACENEENKKSS

SEQ ID NO: 3331230 - protein, 29 aa, Plasmodium falciparum
NHSNHNNHNNHNNHNNHSNHSNHNNRNHN

SEQ ID NO: 3331231 - protein, 8 aa, Plasmodium falciparum
NHSNNFES

SEQ ID NO: 3331232 - protein, 16 aa, Plasmodium falciparum
NHSNNHKRSNNNYPGN

SEQ ID NO: 3331233 - protein, 33 aa, Plasmodium falciparum
NHSNNHNNHSNNHNNHSNNHNNHSNNHNNHNNH

SEQ ID NO: 3331234 - protein, 12 aa, Plasmodium falciparum
NHSNNNERGNKK

SEQ ID NO: 3331235 - protein, 10 aa, Plasmodium falciparum
NHSNNNNDNN

SEQ ID NO: 3331236 - protein, 10 aa, Plasmodium falciparum
NHSNNNNNNN

SEQ ID NO: 3331237 - protein, 9 aa, Plasmodium falciparum
NHSNTTNAH

SEQ ID NO: 3331238 - protein, 6 aa, Plasmodium falciparum
NHSQNN

SEQ ID NO: 3331239 - protein, 9 aa, Plasmodium falciparum
NHSSCSTDA

SEQ ID NO: 3331240 - protein, 97 aa, Plasmodium falciparum
NHSSDNQNCHSSDNQNCHSSDNQNCHSSDNQNCHSSDNQNCDSNACNKKDEEKKRKKKKIKKKNKMKNKSNNKSKNKRETKSKKISNNNNNDNMNNQ

SEQ ID NO: 3331241 - protein, 12 aa, Plasmodium falciparum
NHSSGSYHNAQK

SEQ ID NO: 3331242 - protein, 71 aa, Plasmodium falciparum
NHSVSKENDYHQISDDDNDDNNDDNNDDNNDDNNDDHNDDHNDDHNNDHNDDHNNDDDNIDDDNNNKKKEK

SEQ ID NO: 3331243 - protein, 13 aa, Plasmodium falciparum
NHTEKNKRNGSEY

SEQ ID NO: 3331244 - protein, 7 aa, Plasmodium falciparum
NHTKNTL

SEQ ID NO: 3331245 - protein, 8 aa, Plasmodium falciparum
NHTKNTTF

SEQ ID NO: 3331246 - protein, 17 aa, Plasmodium falciparum
NHTNDENNDVYKNNENR

SEQ ID NO: 3331247 - protein, 5 aa, Plasmodium falciparum
NHTNI

SEQ ID NO: 3331248 - protein, 11 aa, Plasmodium falciparum
NHTNKKTSIIS

SEQ ID NO: 3331249 - protein, 17 aa, Plasmodium falciparum
NHTNNDREDYNIENNNN

SEQ ID NO: 3331250 - protein, 8 aa, Plasmodium falciparum
NHTNNNND

SEQ ID NO: 3331251 - protein, 7 aa, Plasmodium falciparum
NHTNPQN

SEQ ID NO: 3331252 - protein, 8 aa, Plasmodium falciparum
NHTSGEQL

SEQ ID NO: 3331253 - protein, 17 aa, Plasmodium falciparum
NHTSNENTNHTNNITND

SEQ ID NO: 3331254 - protein, 6 aa, Plasmodium falciparum
NHVDDK

SEQ ID NO: 3331255 - protein, 4 aa, Plasmodium falciparum
NHVQ

SEQ ID NO: 3331256 - protein, 4 aa, Plasmodium falciparum
NHYD

SEQ ID NO: 3331257 - protein, 6 aa, Plasmodium falciparum
NHYDNN

SEQ ID NO: 3331258 - protein, 46 aa, Plasmodium falciparum
NHYEDGNDLNNMDTNNNNNNNNNGSNSNNSNNSNSSNNNNNKNKNL

SEQ ID NO: 3331259 - protein, 21 aa, Plasmodium falciparum
NHYKRNNEEEEEEEEEENEYI

SEQ ID NO: 3331260 - protein, 11 aa, Plasmodium falciparum
NHYNKKDSDSN

SEQ ID NO: 3331261 - protein, 9 aa, Plasmodium falciparum
NHYSNDPRL

SEQ ID NO: 3331262 - protein, 26 aa, Plasmodium falciparum
NHYSTDHKKPSFLNPENSKEHIESDI

SEQ ID NO: 3331263 - protein, 28 aa, Plasmodium falciparum
NHYTEKTKTDLNHSEYDKGIKDEHTNSN

SEQ ID NO: 3331264 - protein, 4 aa, Plasmodium falciparum
NIAP

SEQ ID NO: 3331265 - protein, 40 aa, Plasmodium falciparum
NIAPTNKNNKNYDDDNNKNNKYDDDDNNNNNNNNINNDDD

SEQ ID NO: 3331266 - protein, 9 aa, Plasmodium falciparum
NIASKNKKK

SEQ ID NO: 3331267 - protein, 7 aa, Plasmodium falciparum
NIATNKK

SEQ ID NO: 3331268 - protein, 13 aa, Plasmodium falciparum
NIDDEKMNVDDEK

SEQ ID NO: 3331269 - protein, 20 aa, Plasmodium falciparum
NIDDKQKENNQNDSTYDHTY

SEQ ID NO: 3331270 - protein, 7 aa, Plasmodium falciparum
NIDDNEE

SEQ ID NO: 3331271 - protein, 14 aa, Plasmodium falciparum
NIDDNNNNNNNNNE

SEQ ID NO: 3331272 - protein, 9 aa, Plasmodium falciparum
NIDDSDDDV

SEQ ID NO: 3331273 - protein, 6 aa, Plasmodium falciparum
NIDEGN

SEQ ID NO: 3331274 - protein, 11 aa, Plasmodium falciparum
NIDENDVTKQD

SEQ ID NO: 3331275 - protein, 6 aa, Plasmodium falciparum
NIDENK

SEQ ID NO: 3331276 - protein, 7 aa, Plasmodium falciparum
NIDETGI

SEQ ID NO: 3331277 - protein, 5 aa, Plasmodium falciparum
NIDGE

SEQ ID NO: 3331278 - protein, 8 aa, Plasmodium falciparum
NIDGEYGN

SEQ ID NO: 3331279 - protein, 5 aa, Plasmodium falciparum
NIDGR

SEQ ID NO: 3331280 - protein, 4 aa, Plasmodium falciparum
NIDK

SEQ ID NO: 3331281 - protein, 13 aa, Plasmodium falciparum
NIDKDKNNDINND

SEQ ID NO: 3331282 - protein, 39 aa, Plasmodium falciparum
NIDNGDNEMKQEKKTNNYINNNDNNNDNNNDNNNDNNNN

SEQ ID NO: 3331283 - protein, 6 aa, Plasmodium falciparum
NIDNNT

SEQ ID NO: 3331284 - protein, 8 aa, Plasmodium falciparum
NIDNSKER

SEQ ID NO: 3331285 - protein, 5 aa, Plasmodium falciparum
NIDPN

SEQ ID NO: 3331286 - protein, 11 aa, Plasmodium falciparum
NIDPSRYSDND

SEQ ID NO: 3331287 - protein, 6 aa, Plasmodium falciparum
NIDSDN

SEQ ID NO: 3331288 - protein, 15 aa, Plasmodium falciparum
NIDSKNNKSSYNNNV

SEQ ID NO: 3331289 - protein, 15 aa, Plasmodium falciparum
NIDSNNKSIHNTSNG

SEQ ID NO: 3331290 - protein, 4 aa, Plasmodium falciparum
NIDT

SEQ ID NO: 3331291 - protein, 8 aa, Plasmodium falciparum
NIDTNDNT

SEQ ID NO: 3331292 - protein, 5 aa, Plasmodium falciparum
NIDTP

SEQ ID NO: 3331293 - protein, 5 aa, Plasmodium falciparum
NIDYN

SEQ ID NO: 3331294 - protein, 10 aa, Plasmodium falciparum
NIEDNEKTIN

SEQ ID NO: 3331295 - protein, 13 aa, Plasmodium falciparum
NIEDTNSSYNTDE

SEQ ID NO: 3331296 - protein, 11 aa, Plasmodium falciparum
NIEEEKGFKKD

SEQ ID NO: 3331297 - protein, 8 aa, Plasmodium falciparum
NIEEENNI

SEQ ID NO: 3331298 - protein, 15 aa, Plasmodium falciparum
NIEEESNIAQDNNGI

SEQ ID NO: 3331299 - protein, 4 aa, Plasmodium falciparum
NIEG

SEQ ID NO: 3331300 - protein, 24 aa, Plasmodium falciparum
NIEGDQVKQNEQNHDDDDVINENE

SEQ ID NO: 3331301 - protein, 4 aa, Plasmodium falciparum
NIEK

SEQ ID NO: 3331302 - protein, 10 aa, Plasmodium falciparum
NIEKDQNTYP

SEQ ID NO: 3331303 - protein, 6 aa, Plasmodium falciparum
NIEKED

SEQ ID NO: 3331304 - protein, 10 aa, Plasmodium falciparum
NIEKENMSND

SEQ ID NO: 3331305 - protein, 15 aa, Plasmodium falciparum
NIEKEQGKNKKENEE

SEQ ID NO: 3331306 - protein, 31 aa, Plasmodium falciparum
NIEKNEKVNKNDDNKNDDDKNDDDKNEEPLK

SEQ ID NO: 3331307 - protein, 6 aa, Plasmodium falciparum
NIEKPT

SEQ ID NO: 3331308 - protein, 7 aa, Plasmodium falciparum
NIEKREG

SEQ ID NO: 3331309 - protein, 19 aa, Plasmodium falciparum
NIENDENIKPDMKKNKEKV

SEQ ID NO: 3331310 - protein, 18 aa, Plasmodium falciparum
NIENEEEEEEREGEEAER

SEQ ID NO: 3331311 - protein, 11 aa, Plasmodium falciparum
NIENEEKHENL

SEQ ID NO: 3331312 - protein, 13 aa, Plasmodium falciparum
NIENKTKKELELK

SEQ ID NO: 3331313 - protein, 5 aa, Plasmodium falciparum
NIENN

SEQ ID NO: 3331314 - protein, 6 aa, Plasmodium falciparum
NIENSN

SEQ ID NO: 3331315 - protein, 13 aa, Plasmodium falciparum
NIENSSSQSFNNK

SEQ ID NO: 3331316 - protein, 18 aa, Plasmodium falciparum
NIENSSSSTHSSSEKQCT

SEQ ID NO: 3331317 - protein, 19 aa, Plasmodium falciparum
NIEQESVTTEQQLTTQEPV

SEQ ID NO: 3331318 - protein, 7 aa, Plasmodium falciparum
NIEQKKK

SEQ ID NO: 3331319 - protein, 15 aa, Plasmodium falciparum
NIERDRDRDRDRDRY

SEQ ID NO: 3331320 - protein, 5 aa, Plasmodium falciparum
NIERG

SEQ ID NO: 3331321 - protein, 18 aa, Plasmodium falciparum
NIETNKNNDIHNNDNNLD

SEQ ID NO: 3331322 - protein, 6 aa, Plasmodium falciparum
NIETSD

SEQ ID NO: 3331323 - protein, 7 aa, Plasmodium falciparum
NIEVEEE

SEQ ID NO: 3331324 - protein, 9 aa, Plasmodium falciparum
NIEVEEEKN

SEQ ID NO: 3331325 - protein, 7 aa, Plasmodium falciparum
NIEYNEE

SEQ ID NO: 3331326 - protein, 5 aa, Plasmodium falciparum
NIFSD

SEQ ID NO: 3331327 - protein, 9 aa, Plasmodium falciparum
NIGESTNGN

SEQ ID NO: 3331328 - protein, 4 aa, Plasmodium falciparum
NIGG

SEQ ID NO: 3331329 - protein, 18 aa, Plasmodium falciparum
NIGHDSQKRIKHKEDNKI

SEQ ID NO: 3331330 - protein, 26 aa, Plasmodium falciparum
NIGKGDNEEPKNTNEKNQKCGKDNIN

SEQ ID NO: 3331331 - protein, 7 aa, Plasmodium falciparum
NIGKNET

SEQ ID NO: 3331332 - protein, 13 aa, Plasmodium falciparum
NIGNNDSSWHDQY

SEQ ID NO: 3331333 - protein, 25 aa, Plasmodium falciparum
NIGNNGGSTTSSHNNKKKKKNVTFS

SEQ ID NO: 3331334 - protein, 11 aa, Plasmodium falciparum
NIGSSHNDRDP

SEQ ID NO: 3331335 - protein, 5 aa, Plasmodium falciparum
NIGTN

SEQ ID NO: 3331336 - protein, 15 aa, Plasmodium falciparum
NIGVSKNKNKNKNKQ

SEQ ID NO: 3331337 - protein, 13 aa, Plasmodium falciparum
NIHDKNKKENHTI

SEQ ID NO: 3331338 - protein, 5 aa, Plasmodium falciparum
NIHDS

SEQ ID NO: 3331339 - protein, 8 aa, Plasmodium falciparum
NIHETSNS

SEQ ID NO: 3331340 - protein, 8 aa, Plasmodium falciparum
NIHGENSP

SEQ ID NO: 3331341 - protein, 30 aa, Plasmodium falciparum
NIHGNNNVHGNNNVHGNNNVHGNNNVHGNN

SEQ ID NO: 3331342 - protein, 10 aa, Plasmodium falciparum
NIHKNDNNDK

SEQ ID NO: 3331343 - protein, 25 aa, Plasmodium falciparum
NIHNDSHDDNNDDSVNDSNDDTNNV

SEQ ID NO: 3331344 - protein, 11 aa, Plasmodium falciparum
NIHNTKEGSVH

SEQ ID NO: 3331345 - protein, 29 aa, Plasmodium falciparum
NIHPNNISDDNNDEYKHYDENNKTEEKNH

SEQ ID NO: 3331346 - protein, 5 aa, Plasmodium falciparum
NIIKP

SEQ ID NO: 3331347 - protein, 9 aa, Plasmodium falciparum
NIIKPEDDK

SEQ ID NO: 3331348 - protein, 6 aa, Plasmodium falciparum
NIISND

SEQ ID NO: 3331349 - protein, 5 aa, Plasmodium falciparum
NIISS

SEQ ID NO: 3331350 - protein, 8 aa, Plasmodium falciparum
NIKDEEEK

SEQ ID NO: 3331351 - protein, 5 aa, Plasmodium falciparum
NIKDN

SEQ ID NO: 3331352 - protein, 7 aa, Plasmodium falciparum
NIKDNNK

SEQ ID NO: 3331353 - protein, 10 aa, Plasmodium falciparum
NIKDNNYNKD

SEQ ID NO: 3331354 - protein, 17 aa, Plasmodium falciparum
NIKDQDLNTYGARRGND

SEQ ID NO: 3331355 - protein, 8 aa, Plasmodium falciparum
NIKDTNAL

SEQ ID NO: 3331356 - protein, 13 aa, Plasmodium falciparum
NIKDTNKGEKDKV

SEQ ID NO: 3331357 - protein, 4 aa, Plasmodium falciparum
NIKE

SEQ ID NO: 3331358 - protein, 6 aa, Plasmodium falciparum
NIKEED

SEQ ID NO: 3331359 - protein, 7 aa, Plasmodium falciparum
NIKEEDD

SEQ ID NO: 3331360 - protein, 10 aa, Plasmodium falciparum
NIKEEDDKES

SEQ ID NO: 3331361 - protein, 11 aa, Plasmodium falciparum
NIKEEEKGSLK

SEQ ID NO: 3331362 - protein, 12 aa, Plasmodium falciparum
NIKEGEQNIKKK

SEQ ID NO: 3331363 - protein, 17 aa, Plasmodium falciparum
NIKENKKNKSIKPSSKQ

SEQ ID NO: 3331364 - protein, 13 aa, Plasmodium falciparum
NIKENSNVKENNE

SEQ ID NO: 3331365 - protein, 8 aa, Plasmodium falciparum
NIKENTEK

SEQ ID NO: 3331366 - protein, 25 aa, Plasmodium falciparum
NIKENTNNYTNDYTNDYTNDYTNDN

SEQ ID NO: 3331367 - protein, 7 aa, Plasmodium falciparum
NIKEQGY

SEQ ID NO: 3331368 - protein, 12 aa, Plasmodium falciparum
NIKEYNKGKNNN

SEQ ID NO: 3331369 - protein, 57 aa, Plasmodium falciparum
NIKGEDNIKGEDNIKGEDNIKGEDNIKGEDNIKGEDNIKGEDNIKGEDNIKGKDNIK

SEQ ID NO: 3331370 - protein, 15 aa, Plasmodium falciparum
NIKGTDKKDEESNQY

SEQ ID NO: 3331371 - protein, 5 aa, Plasmodium falciparum
NIKHN

SEQ ID NO: 3331372 - protein, 12 aa, Plasmodium falciparum
NIKKEDNHIDSE

SEQ ID NO: 3331373 - protein, 7 aa, Plasmodium falciparum
NIKKEDS

SEQ ID NO: 3331374 - protein, 9 aa, Plasmodium falciparum
NIKKEGENN

SEQ ID NO: 3331375 - protein, 13 aa, Plasmodium falciparum
NIKKEKIKNPSKR

SEQ ID NO: 3331376 - protein, 45 aa, Plasmodium falciparum
NIKKEKNYELKGNSTINNNNNNNNNNNNNNNNNNNSSSSNNNDNN

SEQ ID NO: 3331377 - protein, 7 aa, Plasmodium falciparum
NIKKENK

SEQ ID NO: 3331378 - protein, 9 aa, Plasmodium falciparum
NIKKENTEI

SEQ ID NO: 3331379 - protein, 9 aa, Plasmodium falciparum
NIKKESELN

SEQ ID NO: 3331380 - protein, 7 aa, Plasmodium falciparum
NIKKESY

SEQ ID NO: 3331381 - protein, 6 aa, Plasmodium falciparum
NIKKGD

SEQ ID NO: 3331382 - protein, 17 aa, Plasmodium falciparum
NIKKKNDKKGKKKLNIN

SEQ ID NO: 3331383 - protein, 22 aa, Plasmodium falciparum
NIKKKSKKKNKNNKDKDNTQMD

SEQ ID NO: 3331384 - protein, 7 aa, Plasmodium falciparum
NIKKPNV

SEQ ID NO: 3331385 - protein, 8 aa, Plasmodium falciparum
NIKKPTQI

SEQ ID NO: 3331386 - protein, 11 aa, Plasmodium falciparum
NIKKSNNEKYT

SEQ ID NO: 3331387 - protein, 10 aa, Plasmodium falciparum
NIKNDNEYNH

SEQ ID NO: 3331388 - protein, 12 aa, Plasmodium falciparum
NIKNDNQKINDD

SEQ ID NO: 3331389 - protein, 38 aa, Plasmodium falciparum
NIKNDTKEYIETKNDNIQSAINNSNDNLDSISNKNSKL

SEQ ID NO: 3331390 - protein, 5 aa, Plasmodium falciparum
NIKNE

SEQ ID NO: 3331391 - protein, 6 aa, Plasmodium falciparum
NIKNEK

SEQ ID NO: 3331392 - protein, 27 aa, Plasmodium falciparum
NIKNEKDGIDEEDIDEEDIEEEEEPSY

SEQ ID NO: 3331393 - protein, 48 aa, Plasmodium falciparum
NIKNEQKDQNDEEKNKKMDKKEADHDQQQDEEEKEQEEEYDDDTKLDG

SEQ ID NO: 3331394 - protein, 10 aa, Plasmodium falciparum
NIKNKDKPYI

SEQ ID NO: 3331395 - protein, 28 aa, Plasmodium falciparum
NIKNKEQEYTDQSTQKNNNTCSKKGDSI

SEQ ID NO: 3331396 - protein, 13 aa, Plasmodium falciparum
NIKNNDSVHREDK

SEQ ID NO: 3331397 - protein, 8 aa, Plasmodium falciparum
NIKNSDQN

SEQ ID NO: 3331398 - protein, 6 aa, Plasmodium falciparum
NIKNSE

SEQ ID NO: 3331399 - protein, 11 aa, Plasmodium falciparum
NIKNSGSQNLE

SEQ ID NO: 3331400 - protein, 6 aa, Plasmodium falciparum
NIKNSS

SEQ ID NO: 3331401 - protein, 6 aa, Plasmodium falciparum
NIKPEE

SEQ ID NO: 3331402 - protein, 7 aa, Plasmodium falciparum
NIKPQTT

SEQ ID NO: 3331403 - protein, 4 aa, Plasmodium falciparum
NIKQ

SEQ ID NO: 3331404 - protein, 9 aa, Plasmodium falciparum
NIKQDQGAN

SEQ ID NO: 3331405 - protein, 8 aa, Plasmodium falciparum
NIKQNDCD

SEQ ID NO: 3331406 - protein, 5 aa, Plasmodium falciparum
NIKQR

SEQ ID NO: 3331407 - protein, 5 aa, Plasmodium falciparum
NIKRN

SEQ ID NO: 3331408 - protein, 10 aa, Plasmodium falciparum
NIKSHSQSSI

SEQ ID NO: 3331409 - protein, 17 aa, Plasmodium falciparum
NIKSKKKKNRRDRSENC

SEQ ID NO: 3331410 - protein, 9 aa, Plasmodium falciparum
NIKSKNKDV

SEQ ID NO: 3331411 - protein, 9 aa, Plasmodium falciparum
NIKSNDELH

SEQ ID NO: 3331412 - protein, 18 aa, Plasmodium falciparum
NIKSNDPIKNNSNNSYNN

SEQ ID NO: 3331413 - protein, 11 aa, Plasmodium falciparum
NIKSNSSSYCS

SEQ ID NO: 3331414 - protein, 6 aa, Plasmodium falciparum
NIKSSN

SEQ ID NO: 3331415 - protein, 38 aa, Plasmodium falciparum
NIKSTDRKSNNTKRNSSKYNGLEERDDEDNSNNNNNMN

SEQ ID NO: 3331416 - protein, 6 aa, Plasmodium falciparum
NIKSTH

SEQ ID NO: 3331417 - protein, 14 aa, Plasmodium falciparum
NIKTTTTERNNSIN

SEQ ID NO: 3331418 - protein, 4 aa, Plasmodium falciparum
NILK

SEQ ID NO: 3331419 - protein, 5 aa, Plasmodium falciparum
NILNG

SEQ ID NO: 3331420 - protein, 5 aa, Plasmodium falciparum
NINDD

SEQ ID NO: 3331421 - protein, 7 aa, Plasmodium falciparum
NINDDDV

SEQ ID NO: 3331422 - protein, 13 aa, Plasmodium falciparum
NINDDENTGGGIY

SEQ ID NO: 3331423 - protein, 29 aa, Plasmodium falciparum
NINDDNISKSRKKKKKKGIKKKIKNNSNL

SEQ ID NO: 3331424 - protein, 19 aa, Plasmodium falciparum
NINDDYKDKSDQKRNNRDI

SEQ ID NO: 3331425 - protein, 9 aa, Plasmodium falciparum
NINDEKDNI

SEQ ID NO: 3331426 - protein, 7 aa, Plasmodium falciparum
NINDNIN

SEQ ID NO: 3331427 - protein, 11 aa, Plasmodium falciparum
NINDNINDNIN

SEQ ID NO: 3331428 - protein, 87 aa, Plasmodium falciparum
NINDNMNKDEHVEEKKKQKKKKKEKEKKEEKEKKEDHEKGKDKDKKEDHEKGKDKDKKEDHEKGKDKEKDKDKDINNEQYNTSEQPI

SEQ ID NO: 3331429 - protein, 6 aa, Plasmodium falciparum
NINDNV

SEQ ID NO: 3331430 - protein, 7 aa, Plasmodium falciparum
NINDNYT

SEQ ID NO: 3331431 - protein, 7 aa, Plasmodium falciparum
NINDPEK

SEQ ID NO: 3331432 - protein, 11 aa, Plasmodium falciparum
NINDSKKEERW

SEQ ID NO: 3331433 - protein, 57 aa, Plasmodium falciparum
NINDTNKINNVDDNKIDDDNKIDDDNKNGEDNKIDDDNKNGEDNKNGDDNNNKECGN

SEQ ID NO: 3331434 - protein, 6 aa, Plasmodium falciparum
NINDTS

SEQ ID NO: 3331435 - protein, 11 aa, Plasmodium falciparum
NINEDTHNYTD

SEQ ID NO: 3331436 - protein, 10 aa, Plasmodium falciparum
NINEDTSSKD

SEQ ID NO: 3331437 - protein, 14 aa, Plasmodium falciparum
NINEEKEKNKEEDK

SEQ ID NO: 3331438 - protein, 7 aa, Plasmodium falciparum
NINEEND

SEQ ID NO: 3331439 - protein, 10 aa, Plasmodium falciparum
NINEENKQNL

SEQ ID NO: 3331440 - protein, 6 aa, Plasmodium falciparum
NINEHN

SEQ ID NO: 3331441 - protein, 5 aa, Plasmodium falciparum
NINEN

SEQ ID NO: 3331442 - protein, 8 aa, Plasmodium falciparum
NINEQNNI

SEQ ID NO: 3331443 - protein, 10 aa, Plasmodium falciparum
NINESQGSDI

SEQ ID NO: 3331444 - protein, 7 aa, Plasmodium falciparum
NINESYN

SEQ ID NO: 3331445 - protein, 8 aa, Plasmodium falciparum
NINETDNI

SEQ ID NO: 3331446 - protein, 15 aa, Plasmodium falciparum
NINETKRNTVSTEDD

SEQ ID NO: 3331447 - protein, 14 aa, Plasmodium falciparum
NINFDNKKDNNSHE

SEQ ID NO: 3331448 - protein, 22 aa, Plasmodium falciparum
NINGEDYKNTDMNNEKRKDQNI

SEQ ID NO: 3331449 - protein, 5 aa, Plasmodium falciparum
NINGK

SEQ ID NO: 3331450 - protein, 13 aa, Plasmodium falciparum
NINGKNTTNINNS

SEQ ID NO: 3331451 - protein, 50 aa, Plasmodium falciparum
NINGNNNINGNNNINGNNNINGNNNINGNNNNSNNNNNSSSNKSNSNNIY

SEQ ID NO: 3331452 - protein, 17 aa, Plasmodium falciparum
NINGNVNNKKYSDKTTH

SEQ ID NO: 3331453 - protein, 5 aa, Plasmodium falciparum
NINIP

SEQ ID NO: 3331454 - protein, 4 aa, Plasmodium falciparum
NINK

SEQ ID NO: 3331455 - protein, 15 aa, Plasmodium falciparum
NINKDNVKNKPIRRT

SEQ ID NO: 3331456 - protein, 9 aa, Plasmodium falciparum
NINKEDDHN

SEQ ID NO: 3331457 - protein, 6 aa, Plasmodium falciparum
NINKEK

SEQ ID NO: 3331458 - protein, 6 aa, Plasmodium falciparum
NINKGN

SEQ ID NO: 3331459 - protein, 12 aa, Plasmodium falciparum
NINKKKEKTFPN

SEQ ID NO: 3331460 - protein, 10 aa, Plasmodium falciparum
NINKKNYEQV

SEQ ID NO: 3331461 - protein, 7 aa, Plasmodium falciparum
NINKNDN

SEQ ID NO: 3331462 - protein, 12 aa, Plasmodium falciparum
NINKNDSSSNHE

SEQ ID NO: 3331463 - protein, 85 aa, Plasmodium falciparum
NINKNENNKIDSINNNDNINNNENINNNDSINNNDNINNNDNINNNENINNNENINNNDNINNNDNINNNDNINNNDNINNSNRP

SEQ ID NO: 3331464 - protein, 30 aa, Plasmodium falciparum
NINKNNDDNHYNGSVTNKNNDDHKNGSSDN

SEQ ID NO: 3331465 - protein, 25 aa, Plasmodium falciparum
NINKNNHSSNIENEKYNDSQNNTHI

SEQ ID NO: 3331466 - protein, 6 aa, Plasmodium falciparum
NINKQE

SEQ ID NO: 3331467 - protein, 16 aa, Plasmodium falciparum
NINKSNKDTESNPNKS

SEQ ID NO: 3331468 - protein, 18 aa, Plasmodium falciparum
NINKSNTRSTNNNVKNYY

SEQ ID NO: 3331469 - protein, 17 aa, Plasmodium falciparum
NINKTDENEEKKTLNNN

SEQ ID NO: 3331470 - protein, 12 aa, Plasmodium falciparum
NINNDDNKNNNF

SEQ ID NO: 3331471 - protein, 36 aa, Plasmodium falciparum
NINNDDSTNISDNTNISDNTNISDNTNISDNTNISD

SEQ ID NO: 3331472 - protein, 6 aa, Plasmodium falciparum
NINNDE

SEQ ID NO: 3331473 - protein, 22 aa, Plasmodium falciparum
NINNDNKNNEHFKESKNNNSIS

SEQ ID NO: 3331474 - protein, 52 aa, Plasmodium falciparum
NINNEDTNNDETIDYDEEGEEEKKNVTNNINDNTNVDESKYEDTLKDEKGNV

SEQ ID NO: 3331475 - protein, 15 aa, Plasmodium falciparum
NINNENKKKKNNKEI

SEQ ID NO: 3331476 - protein, 7 aa, Plasmodium falciparum
NINNESN

SEQ ID NO: 3331477 - protein, 13 aa, Plasmodium falciparum
NINNGNNKEEQKK

SEQ ID NO: 3331478 - protein, 5 aa, Plasmodium falciparum
NINNI

SEQ ID NO: 3331479 - protein, 7 aa, Plasmodium falciparum
NINNKSN

SEQ ID NO: 3331480 - protein, 56 aa, Plasmodium falciparum
NINNNDNINNNDNINNNDNINNNDNINNNINNNNNNNNNDDDEIYKPGDDENSNKM

SEQ ID NO: 3331481 - protein, 25 aa, Plasmodium falciparum
NINNNEKKCSDENNYSNEKNYSNEK

SEQ ID NO: 3331482 - protein, 22 aa, Plasmodium falciparum
NINNNNDNNDDDNNNNDDDYYR

SEQ ID NO: 3331483 - protein, 7 aa, Plasmodium falciparum
NINNNNN

SEQ ID NO: 3331484 - protein, 12 aa, Plasmodium falciparum
NINNNNNDIHNN

SEQ ID NO: 3331485 - protein, 20 aa, Plasmodium falciparum
NINNNNNINNHRNDEEGTTN

SEQ ID NO: 3331486 - protein, 9 aa, Plasmodium falciparum
NINNNNNNN

SEQ ID NO: 3331487 - protein, 14 aa, Plasmodium falciparum
NINNNNNNNDNNLN

SEQ ID NO: 3331488 - protein, 21 aa, Plasmodium falciparum
NINNNNNNNNNINNINSNNNF

SEQ ID NO: 3331489 - protein, 26 aa, Plasmodium falciparum
NINNNNNNNNNNNNNNNNNNNNNNCT

SEQ ID NO: 3331490 - protein, 35 aa, Plasmodium falciparum
NINNNNNNNNNNNNNNNNNNNNNNNNNMDEPLDSS

SEQ ID NO: 3331491 - protein, 19 aa, Plasmodium falciparum
NINNNNNNNNNNNNNTNDD

SEQ ID NO: 3331492 - protein, 12 aa, Plasmodium falciparum
NINNNNNNNNSN

SEQ ID NO: 3331493 - protein, 10 aa, Plasmodium falciparum
NINNNNNNSL

SEQ ID NO: 3331494 - protein, 10 aa, Plasmodium falciparum
NINNNSISGE

SEQ ID NO: 3331495 - protein, 16 aa, Plasmodium falciparum
NINNNSNDNSYNNNEK

SEQ ID NO: 3331496 - protein, 26 aa, Plasmodium falciparum
NINNQYNQNNSNDNPKHVQEHTNQIN

SEQ ID NO: 3331497 - protein, 11 aa, Plasmodium falciparum
NINNSCSNNYG

SEQ ID NO: 3331498 - protein, 6 aa, Plasmodium falciparum
NINNSN

SEQ ID NO: 3331499 - protein, 8 aa, Plasmodium falciparum
NINNSNLE

SEQ ID NO: 3331500 - protein, 10 aa, Plasmodium falciparum
NINNSTEIKK

SEQ ID NO: 3331501 - protein, 9 aa, Plasmodium falciparum
NINNTNSVN

SEQ ID NO: 3331502 - protein, 8 aa, Plasmodium falciparum
NINPGNSL

SEQ ID NO: 3331503 - protein, 11 aa, Plasmodium falciparum
NINPKREDSSF

SEQ ID NO: 3331504 - protein, 13 aa, Plasmodium falciparum
NINPNDKENNDMC

SEQ ID NO: 3331505 - protein, 12 aa, Plasmodium falciparum
NINQDDNNVNNI

SEQ ID NO: 3331506 - protein, 9 aa, Plasmodium falciparum
NINQRTDNY

SEQ ID NO: 3331507 - protein, 7 aa, Plasmodium falciparum
NINQSKD

SEQ ID NO: 3331508 - protein, 4 aa, Plasmodium falciparum
NINS

SEQ ID NO: 3331509 - protein, 6 aa, Plasmodium falciparum
NINSEY

SEQ ID NO: 3331510 - protein, 9 aa, Plasmodium falciparum
NINSKNDYN

SEQ ID NO: 3331511 - protein, 6 aa, Plasmodium falciparum
NINSNN

SEQ ID NO: 3331512 - protein, 10 aa, Plasmodium falciparum
NINSNNNTVV

SEQ ID NO: 3331513 - protein, 5 aa, Plasmodium falciparum
NINSP

SEQ ID NO: 3331514 - protein, 30 aa, Plasmodium falciparum
NINSSNINNVNSNSSHIKDEERKSSSINNN

SEQ ID NO: 3331515 - protein, 11 aa, Plasmodium falciparum
NINSSSNNYSL

SEQ ID NO: 3331516 - protein, 23 aa, Plasmodium falciparum
NINSSTSLDTSTNDQKNKSYIKD

SEQ ID NO: 3331517 - protein, 4 aa, Plasmodium falciparum
NINT

SEQ ID NO: 3331518 - protein, 54 aa, Plasmodium falciparum
NINTDDMDDTNNNNNKNNDDKNNDDNNNDDNKNDDNRVDNNHNNDDNNNNVEEK

SEQ ID NO: 3331519 - protein, 5 aa, Plasmodium falciparum
NINTN

SEQ ID NO: 3331520 - protein, 11 aa, Plasmodium falciparum
NINTNDNHNMN

SEQ ID NO: 3331521 - protein, 22 aa, Plasmodium falciparum
NINTNKEEIEDEKDKNNKNINK

SEQ ID NO: 3331522 - protein, 23 aa, Plasmodium falciparum
NINTNTNNYSNNNNYSNNNGDNY

SEQ ID NO: 3331523 - protein, 6 aa, Plasmodium falciparum
NINTVK

SEQ ID NO: 3331524 - protein, 7 aa, Plasmodium falciparum
NINTYTN

SEQ ID NO: 3331525 - protein, 4 aa, Plasmodium falciparum
NINV

SEQ ID NO: 3331526 - protein, 13 aa, Plasmodium falciparum
NINYEEKKDNYPI

SEQ ID NO: 3331527 - protein, 12 aa, Plasmodium falciparum
NINYNKRKDEQD

SEQ ID NO: 3331528 - protein, 12 aa, Plasmodium falciparum
NIPASNKYNEGG

SEQ ID NO: 3331529 - protein, 6 aa, Plasmodium falciparum
NIPDKK

SEQ ID NO: 3331530 - protein, 25 aa, Plasmodium falciparum
NIPDSNNNTTTSNNNNNNNNNNNKI

SEQ ID NO: 3331531 - protein, 5 aa, Plasmodium falciparum
NIPEP

SEQ ID NO: 3331532 - protein, 11 aa, Plasmodium falciparum
NIPETSPSGNY

SEQ ID NO: 3331533 - protein, 5 aa, Plasmodium falciparum
NIPGP

SEQ ID NO: 3331534 - protein, 5 aa, Plasmodium falciparum
NIPKG

SEQ ID NO: 3331535 - protein, 7 aa, Plasmodium falciparum
NIPKKKK

SEQ ID NO: 3331536 - protein, 12 aa, Plasmodium falciparum
NIPKLQNPKTTE

SEQ ID NO: 3331537 - protein, 7 aa, Plasmodium falciparum
NIPKYDY

SEQ ID NO: 3331538 - protein, 5 aa, Plasmodium falciparum
NIPND

SEQ ID NO: 3331539 - protein, 15 aa, Plasmodium falciparum
NIPNEEEEEKKNPYL

SEQ ID NO: 3331540 - protein, 11 aa, Plasmodium falciparum
NIPNETTLNSS

SEQ ID NO: 3331541 - protein, 7 aa, Plasmodium falciparum
NIPNNNM

SEQ ID NO: 3331542 - protein, 10 aa, Plasmodium falciparum
NIPNYNSPEH

SEQ ID NO: 3331543 - protein, 4 aa, Plasmodium falciparum
NIPQ

SEQ ID NO: 3331544 - protein, 6 aa, Plasmodium falciparum
NIPQGY

SEQ ID NO: 3331545 - protein, 7 aa, Plasmodium falciparum
NIPRKNE

SEQ ID NO: 3331546 - protein, 19 aa, Plasmodium falciparum
NIPSENNNIGELNKTNNNM

SEQ ID NO: 3331547 - protein, 5 aa, Plasmodium falciparum
NIPSK

SEQ ID NO: 3331548 - protein, 5 aa, Plasmodium falciparum
NIPSL

SEQ ID NO: 3331549 - protein, 5 aa, Plasmodium falciparum
NIPSN

SEQ ID NO: 3331550 - protein, 15 aa, Plasmodium falciparum
NIPSNHNKNKKKESI

SEQ ID NO: 3331551 - protein, 12 aa, Plasmodium falciparum
NIPSNNSNNEFK

SEQ ID NO: 3331552 - protein, 6 aa, Plasmodium falciparum
NIPTTN

SEQ ID NO: 3331553 - protein, 82 aa, Plasmodium falciparum
NIPTTNNYDNTRNNYDITTNNYDNTTNNYDITTNNDDNTRNNYDNTTNNYDITTNNDDNTTNNISPDHGNETYESGETNKMD

SEQ ID NO: 3331554 - protein, 5 aa, Plasmodium falciparum
NIPYD

SEQ ID NO: 3331555 - protein, 11 aa, Plasmodium falciparum
NIPYDNTKQNS

SEQ ID NO: 3331556 - protein, 10 aa, Plasmodium falciparum
NIQDKKKQKD

SEQ ID NO: 3331557 - protein, 16 aa, Plasmodium falciparum
NIQDNQNVEDNQNSPC

SEQ ID NO: 3331558 - protein, 4 aa, Plasmodium falciparum
NIQE

SEQ ID NO: 3331559 - protein, 11 aa, Plasmodium falciparum
NIQGSNNQQMN

SEQ ID NO: 3331560 - protein, 4 aa, Plasmodium falciparum
NIQK

SEQ ID NO: 3331561 - protein, 4 aa, Plasmodium falciparum
NIQN

SEQ ID NO: 3331562 - protein, 12 aa, Plasmodium falciparum
NIQNDDKKYKED

SEQ ID NO: 3331563 - protein, 13 aa, Plasmodium falciparum
NIQNDNNNNNNNN

SEQ ID NO: 3331564 - protein, 17 aa, Plasmodium falciparum
NIQNEGNGFNNNKNNND

SEQ ID NO: 3331565 - protein, 10 aa, Plasmodium falciparum
NIQNENTNIN

SEQ ID NO: 3331566 - protein, 14 aa, Plasmodium falciparum
NIQNNTSTNTTATN

SEQ ID NO: 3331567 - protein, 10 aa, Plasmodium falciparum
NIQQNENKKY

SEQ ID NO: 3331568 - protein, 12 aa, Plasmodium falciparum
NIQSNHKKENNI

SEQ ID NO: 3331569 - protein, 13 aa, Plasmodium falciparum
NIQSNKLQSNNIQ

SEQ ID NO: 3331570 - protein, 7 aa, Plasmodium falciparum
NIQTNDN

SEQ ID NO: 3331571 - protein, 28 aa, Plasmodium falciparum
NIQTNKNNSEENKTTNHAKKNESLSSYT

SEQ ID NO: 3331572 - protein, 7 aa, Plasmodium falciparum
NIRDQQN

SEQ ID NO: 3331573 - protein, 4 aa, Plasmodium falciparum
NIRE

SEQ ID NO: 3331574 - protein, 6 aa, Plasmodium falciparum
NIREDQ

SEQ ID NO: 3331575 - protein, 11 aa, Plasmodium falciparum
NIREDTSNIPV

SEQ ID NO: 3331576 - protein, 29 aa, Plasmodium falciparum
NIREEGKEEEEKKKKKNSSISEDIDKDNN

SEQ ID NO: 3331577 - protein, 7 aa, Plasmodium falciparum
NIREKDN

SEQ ID NO: 3331578 - protein, 27 aa, Plasmodium falciparum
NIRKQKRKKNKKKTTLSDNEKATSDLS

SEQ ID NO: 3331579 - protein, 46 aa, Plasmodium falciparum
NIRNDEKEESSDNNNCDDDNDNNNDDDDNNNQSDSIPNNSENFNYD

SEQ ID NO: 3331580 - protein, 12 aa, Plasmodium falciparum
NIRNSQEEVYEK

SEQ ID NO: 3331581 - protein, 4 aa, Plasmodium falciparum
NIRS

SEQ ID NO: 3331582 - protein, 6 aa, Plasmodium falciparum
NIRSNN

SEQ ID NO: 3331583 - protein, 5 aa, Plasmodium falciparum
NIRTY

SEQ ID NO: 3331584 - protein, 6 aa, Plasmodium falciparum
NIRTYN

SEQ ID NO: 3331585 - protein, 6 aa, Plasmodium falciparum
NISDDK

SEQ ID NO: 3331586 - protein, 12 aa, Plasmodium falciparum
NISDDNINKENS

SEQ ID NO: 3331587 - protein, 12 aa, Plasmodium falciparum
NISDDQKYNNNY

SEQ ID NO: 3331588 - protein, 10 aa, Plasmodium falciparum
NISDQEKTLL

SEQ ID NO: 3331589 - protein, 6 aa, Plasmodium falciparum
NISDTE

SEQ ID NO: 3331590 - protein, 5 aa, Plasmodium falciparum
NISEE

SEQ ID NO: 3331591 - protein, 14 aa, Plasmodium falciparum
NISEEHNKTENINS

SEQ ID NO: 3331592 - protein, 6 aa, Plasmodium falciparum
NISEEK

SEQ ID NO: 3331593 - protein, 10 aa, Plasmodium falciparum
NISEGKQKKI

SEQ ID NO: 3331594 - protein, 10 aa, Plasmodium falciparum
NISEKSTGTL

SEQ ID NO: 3331595 - protein, 7 aa, Plasmodium falciparum
NISENKD

SEQ ID NO: 3331596 - protein, 13 aa, Plasmodium falciparum
NISEQEGNINKTS

SEQ ID NO: 3331597 - protein, 5 aa, Plasmodium falciparum
NISES

SEQ ID NO: 3331598 - protein, 7 aa, Plasmodium falciparum
NISGGNE

SEQ ID NO: 3331599 - protein, 6 aa, Plasmodium falciparum
NISKEK

SEQ ID NO: 3331600 - protein, 13 aa, Plasmodium falciparum
NISKENENANGHI

SEQ ID NO: 3331601 - protein, 35 aa, Plasmodium falciparum
NISKEQNNLENTNDDIKSNQYKNNVTDNKNNDCTN

SEQ ID NO: 3331602 - protein, 5 aa, Plasmodium falciparum
NISKN

SEQ ID NO: 3331603 - protein, 8 aa, Plasmodium falciparum
NISKPGRG

SEQ ID NO: 3331604 - protein, 4 aa, Plasmodium falciparum
NISN

SEQ ID NO: 3331605 - protein, 5 aa, Plasmodium falciparum
NISND

SEQ ID NO: 3331606 - protein, 47 aa, Plasmodium falciparum
NISNDKENKRKKANEKDEEMNKDDYDNKENNNNGADNIKGQFKKGSN

SEQ ID NO: 3331607 - protein, 8 aa, Plasmodium falciparum
NISNEEKK

SEQ ID NO: 3331608 - protein, 7 aa, Plasmodium falciparum
NISNEHK

SEQ ID NO: 3331609 - protein, 20 aa, Plasmodium falciparum
NISNKNENNNKKNNTCDGYD

SEQ ID NO: 3331610 - protein, 14 aa, Plasmodium falciparum
NISNKSNEENFEES

SEQ ID NO: 3331611 - protein, 6 aa, Plasmodium falciparum
NISNPK

SEQ ID NO: 3331612 - protein, 8 aa, Plasmodium falciparum
NISNTSTE

SEQ ID NO: 3331613 - protein, 6 aa, Plasmodium falciparum
NISPEN

SEQ ID NO: 3331614 - protein, 6 aa, Plasmodium falciparum
NISPHS

SEQ ID NO: 3331615 - protein, 12 aa, Plasmodium falciparum
NISPQSTSSSLD

SEQ ID NO: 3331616 - protein, 35 aa, Plasmodium falciparum
NISPTYNQQLNKDQDKMTKNQQQHISEHTKQNDES

SEQ ID NO: 3331617 - protein, 8 aa, Plasmodium falciparum
NISPVNTK

SEQ ID NO: 3331618 - protein, 10 aa, Plasmodium falciparum
NISQKKKEYD

SEQ ID NO: 3331619 - protein, 15 aa, Plasmodium falciparum
NISQNDHNKKKQDKN

SEQ ID NO: 3331620 - protein, 7 aa, Plasmodium falciparum
NISRESK

SEQ ID NO: 3331621 - protein, 5 aa, Plasmodium falciparum
NISRN

SEQ ID NO: 3331622 - protein, 13 aa, Plasmodium falciparum
NISSHKKKEIKTT

SEQ ID NO: 3331623 - protein, 12 aa, Plasmodium falciparum
NISSSNSAISNN

SEQ ID NO: 3331624 - protein, 25 aa, Plasmodium falciparum
NISSYQSNQRNKKGTNDDNNLDNEN

SEQ ID NO: 3331625 - protein, 7 aa, Plasmodium falciparum
NISTDNY

SEQ ID NO: 3331626 - protein, 6 aa, Plasmodium falciparum
NISTEN

SEQ ID NO: 3331627 - protein, 7 aa, Plasmodium falciparum
NISTNEG

SEQ ID NO: 3331628 - protein, 8 aa, Plasmodium falciparum
NISTNHNK

SEQ ID NO: 3331629 - protein, 28 aa, Plasmodium falciparum
NISTNTNNSSNVNHQQNCDRTDDDTLHK

SEQ ID NO: 3331630 - protein, 7 aa, Plasmodium falciparum
NISTSYN

SEQ ID NO: 3331631 - protein, 16 aa, Plasmodium falciparum
NISYESNKDSSSEENT

SEQ ID NO: 3331632 - protein, 4 aa, Plasmodium falciparum
NITD

SEQ ID NO: 3331633 - protein, 7 aa, Plasmodium falciparum
NITDGYN

SEQ ID NO: 3331634 - protein, 12 aa, Plasmodium falciparum
NITDKKNKESKE

SEQ ID NO: 3331635 - protein, 7 aa, Plasmodium falciparum
NITDKQE

SEQ ID NO: 3331636 - protein, 4 aa, Plasmodium falciparum
NITE

SEQ ID NO: 3331637 - protein, 10 aa, Plasmodium falciparum
NITEEDDKKR

SEQ ID NO: 3331638 - protein, 21 aa, Plasmodium falciparum
NITEGKEGEVQKISRKGSFSI

SEQ ID NO: 3331639 - protein, 10 aa, Plasmodium falciparum
NITESKEIGS

SEQ ID NO: 3331640 - protein, 10 aa, Plasmodium falciparum
NITKKKNSKL

SEQ ID NO: 3331641 - protein, 4 aa, Plasmodium falciparum
NITN

SEQ ID NO: 3331642 - protein, 6 aa, Plasmodium falciparum
NITNDD

SEQ ID NO: 3331643 - protein, 13 aa, Plasmodium falciparum
NITNEYKKDEYKE

SEQ ID NO: 3331644 - protein, 31 aa, Plasmodium falciparum
NITNNDDITNNNNITNNNNITNNNNITNDGH

SEQ ID NO: 3331645 - protein, 9 aa, Plasmodium falciparum
NITNNDKNK

SEQ ID NO: 3331646 - protein, 7 aa, Plasmodium falciparum
NITNNNV

SEQ ID NO: 3331647 - protein, 16 aa, Plasmodium falciparum
NITNSMSTNTQGKKTL

SEQ ID NO: 3331648 - protein, 5 aa, Plasmodium falciparum
NITPK

SEQ ID NO: 3331649 - protein, 7 aa, Plasmodium falciparum
NITPNNC

SEQ ID NO: 3331650 - protein, 19 aa, Plasmodium falciparum
NITPQNEKDTYNESANKSL

SEQ ID NO: 3331651 - protein, 10 aa, Plasmodium falciparum
NITPSNCNTD

SEQ ID NO: 3331652 - protein, 10 aa, Plasmodium falciparum
NITPSTTNNI

SEQ ID NO: 3331653 - protein, 5 aa, Plasmodium falciparum
NITSG

SEQ ID NO: 3331654 - protein, 17 aa, Plasmodium falciparum
NITSSSKVDGEYSTTYH

SEQ ID NO: 3331655 - protein, 5 aa, Plasmodium falciparum
NITST

SEQ ID NO: 3331656 - protein, 17 aa, Plasmodium falciparum
NITSTSTDTCAKNKEQI

SEQ ID NO: 3331657 - protein, 7 aa, Plasmodium falciparum
NITTNEK

SEQ ID NO: 3331658 - protein, 31 aa, Plasmodium falciparum
NITTNLNNNSKCNEVEEREEDKDAEKETNPN

SEQ ID NO: 3331659 - protein, 29 aa, Plasmodium falciparum
NITTQNGNIPHHNDNNNNNNNNDDDTNKI

SEQ ID NO: 3331660 - protein, 9 aa, Plasmodium falciparum
NIVETSSEN

SEQ ID NO: 3331661 - protein, 5 aa, Plasmodium falciparum
NIVTN

SEQ ID NO: 3331662 - protein, 4 aa, Plasmodium falciparum
NIYD

SEQ ID NO: 3331663 - protein, 45 aa, Plasmodium falciparum
NIYEPNSQNSPNSQKLPNSQNLSNSQNLPNSPNLPNSQNLPNSPN

SEQ ID NO: 3331664 - protein, 7 aa, Plasmodium falciparum
NIYEQGE

SEQ ID NO: 3331665 - protein, 7 aa, Plasmodium falciparum
NIYNGKK

SEQ ID NO: 3331666 - protein, 8 aa, Plasmodium falciparum
NIYNNSNK

SEQ ID NO: 3331667 - protein, 6 aa, Plasmodium falciparum
NIYNNT

SEQ ID NO: 3331668 - protein, 5 aa, Plasmodium falciparum
NIYNR

SEQ ID NO: 3331669 - protein, 23 aa, Plasmodium falciparum
NIYSDKDDVSNNSFTNDQKYYEK

SEQ ID NO: 3331670 - protein, 10 aa, Plasmodium falciparum
NIYSDPNMGT

SEQ ID NO: 3331671 - protein, 8 aa, Plasmodium falciparum
NIYSNDNN

SEQ ID NO: 3331672 - protein, 15 aa, Plasmodium falciparum
NKACQTNQSNYDDGK

SEQ ID NO: 3331673 - protein, 7 aa, Plasmodium falciparum
NKADEQD

SEQ ID NO: 3331674 - protein, 4 aa, Plasmodium falciparum
NKAE

SEQ ID NO: 3331675 - protein, 8 aa, Plasmodium falciparum
NKAEHKNL

SEQ ID NO: 3331676 - protein, 7 aa, Plasmodium falciparum
NKAGKKG

SEQ ID NO: 3331677 - protein, 21 aa, Plasmodium falciparum
NKAKKGIGGIPADADKNTIKE

SEQ ID NO: 3331678 - protein, 7 aa, Plasmodium falciparum
NKAKPTF

SEQ ID NO: 3331679 - protein, 5 aa, Plasmodium falciparum
NKAKS

SEQ ID NO: 3331680 - protein, 6 aa, Plasmodium falciparum
NKALNK

SEQ ID NO: 3331681 - protein, 10 aa, Plasmodium falciparum
NKANNSNTQH

SEQ ID NO: 3331682 - protein, 4 aa, Plasmodium falciparum
NKAP

SEQ ID NO: 3331683 - protein, 7 aa, Plasmodium falciparum
NKAQPSK

SEQ ID NO: 3331684 - protein, 14 aa, Plasmodium falciparum
NKARTQNDNNWGNN

SEQ ID NO: 3331685 - protein, 6 aa, Plasmodium falciparum
NKATDL

SEQ ID NO: 3331686 - protein, 30 aa, Plasmodium falciparum
NKATEHEEKKNITSKENRLNKNKQNDISNP

SEQ ID NO: 3331687 - protein, 10 aa, Plasmodium falciparum
NKATQDKRSF

SEQ ID NO: 3331688 - protein, 20 aa, Plasmodium falciparum
NKCKENEDSFQDRKNNLYDE

SEQ ID NO: 3331689 - protein, 23 aa, Plasmodium falciparum
NKCNDQNNNQNSNDNLNNEQTNC

SEQ ID NO: 3331690 - protein, 20 aa, Plasmodium falciparum
NKCNNNNNNNNNNSYSYSSN

SEQ ID NO: 3331691 - protein, 5 aa, Plasmodium falciparum
NKCSD

SEQ ID NO: 3331692 - protein, 14 aa, Plasmodium falciparum
NKCTKNKTLNRPSV

SEQ ID NO: 3331693 - protein, 5 aa, Plasmodium falciparum
NKCTN

SEQ ID NO: 3331694 - protein, 19 aa, Plasmodium falciparum
NKCTNSPLGNSTMNNNDIN

SEQ ID NO: 3331695 - protein, 10 aa, Plasmodium falciparum
NKDATGNFTS

SEQ ID NO: 3331696 - protein, 10 aa, Plasmodium falciparum
NKDDDQRRRE

SEQ ID NO: 3331697 - protein, 9 aa, Plasmodium falciparum
NKDDELNES

SEQ ID NO: 3331698 - protein, 25 aa, Plasmodium falciparum
NKDDKDKPSIFGSPSNKDDKDKATI

SEQ ID NO: 3331699 - protein, 6 aa, Plasmodium falciparum
NKDDNF

SEQ ID NO: 3331700 - protein, 18 aa, Plasmodium falciparum
NKDDNKKKIKNNPSEKNQ

SEQ ID NO: 3331701 - protein, 31 aa, Plasmodium falciparum
NKDDNNNNNNNNNNNERGNRNATHNKSRNIK

SEQ ID NO: 3331702 - protein, 8 aa, Plasmodium falciparum
NKDDNNNV

SEQ ID NO: 3331703 - protein, 8 aa, Plasmodium falciparum
NKDDQINN

SEQ ID NO: 3331704 - protein, 24 aa, Plasmodium falciparum
NKDDTNNNRNITNNHDDHNGSNNN

SEQ ID NO: 3331705 - protein, 11 aa, Plasmodium falciparum
NKDDTQKGNEI

SEQ ID NO: 3331706 - protein, 5 aa, Plasmodium falciparum
NKDEE

SEQ ID NO: 3331707 - protein, 7 aa, Plasmodium falciparum
NKDEEKN

SEQ ID NO: 3331708 - protein, 9 aa, Plasmodium falciparum
NKDERDKKK

SEQ ID NO: 3331709 - protein, 20 aa, Plasmodium falciparum
NKDESNENNMNNNNLNNNDN

SEQ ID NO: 3331710 - protein, 16 aa, Plasmodium falciparum
NKDEVEKRRKETTQET

SEQ ID NO: 3331711 - protein, 4 aa, Plasmodium falciparum
NKDG

SEQ ID NO: 3331712 - protein, 7 aa, Plasmodium falciparum
NKDGDTA

SEQ ID NO: 3331713 - protein, 7 aa, Plasmodium falciparum
NKDGISN

SEQ ID NO: 3331714 - protein, 6 aa, Plasmodium falciparum
NKDGSI

SEQ ID NO: 3331715 - protein, 8 aa, Plasmodium falciparum
NKDGSVNN

SEQ ID NO: 3331716 - protein, 4 aa, Plasmodium falciparum
NKDH

SEQ ID NO: 3331717 - protein, 13 aa, Plasmodium falciparum
NKDHNNNNNLKEK

SEQ ID NO: 3331718 - protein, 7 aa, Plasmodium falciparum
NKDIDKN

SEQ ID NO: 3331719 - protein, 7 aa, Plasmodium falciparum
NKDIEEE

SEQ ID NO: 3331720 - protein, 5 aa, Plasmodium falciparum
NKDIK

SEQ ID NO: 3331721 - protein, 5 aa, Plasmodium falciparum
NKDIN

SEQ ID NO: 3331722 - protein, 12 aa, Plasmodium falciparum
NKDISKSNEHID

SEQ ID NO: 3331723 - protein, 5 aa, Plasmodium falciparum
NKDIT

SEQ ID NO: 3331724 - protein, 20 aa, Plasmodium falciparum
NKDIYNNNNNNNNNNNNNNN

SEQ ID NO: 3331725 - protein, 4 aa, Plasmodium falciparum
NKDK

SEQ ID NO: 3331726 - protein, 20 aa, Plasmodium falciparum
NKDKEKDNNDEDLQEKYNKS

SEQ ID NO: 3331727 - protein, 10 aa, Plasmodium falciparum
NKDKIKTNVD

SEQ ID NO: 3331728 - protein, 12 aa, Plasmodium falciparum
NKDKKEDNRNPW

SEQ ID NO: 3331729 - protein, 6 aa, Plasmodium falciparum
NKDKLN

SEQ ID NO: 3331730 - protein, 11 aa, Plasmodium falciparum
NKDKNIQKQNN

SEQ ID NO: 3331731 - protein, 7 aa, Plasmodium falciparum
NKDKNKE

SEQ ID NO: 3331732 - protein, 17 aa, Plasmodium falciparum
NKDKNKKNNNLNNNNGI

SEQ ID NO: 3331733 - protein, 6 aa, Plasmodium falciparum
NKDKSF

SEQ ID NO: 3331734 - protein, 5 aa, Plasmodium falciparum
NKDKT

SEQ ID NO: 3331735 - protein, 12 aa, Plasmodium falciparum
NKDKTNNKKSYD

SEQ ID NO: 3331736 - protein, 8 aa, Plasmodium falciparum
NKDKTYLS

SEQ ID NO: 3331737 - protein, 8 aa, Plasmodium falciparum
NKDKYSDD

SEQ ID NO: 3331738 - protein, 7 aa, Plasmodium falciparum
NKDLNSQ

SEQ ID NO: 3331739 - protein, 29 aa, Plasmodium falciparum
NKDMNNDVNNEINKDMNNGYNENTGNHDE

SEQ ID NO: 3331740 - protein, 8 aa, Plasmodium falciparum
NKDNDNIS

SEQ ID NO: 3331741 - protein, 5 aa, Plasmodium falciparum
NKDNE

SEQ ID NO: 3331742 - protein, 24 aa, Plasmodium falciparum
NKDNFEEDNFSQDNELSDISSKDN

SEQ ID NO: 3331743 - protein, 5 aa, Plasmodium falciparum
NKDNI

SEQ ID NO: 3331744 - protein, 11 aa, Plasmodium falciparum
NKDNKQNNNEN

SEQ ID NO: 3331745 - protein, 5 aa, Plasmodium falciparum
NKDNN

SEQ ID NO: 3331746 - protein, 8 aa, Plasmodium falciparum
NKDNNEDN

SEQ ID NO: 3331747 - protein, 10 aa, Plasmodium falciparum
NKDNVNNNDN

SEQ ID NO: 3331748 - protein, 25 aa, Plasmodium falciparum
NKDNYDNNNNNNNNNNHNKKNNIDN

SEQ ID NO: 3331749 - protein, 45 aa, Plasmodium falciparum
NKDNYDNNQYNNCDNNQYNNHDNNQYNNHDNNYDNNQYNNHDNNQ

SEQ ID NO: 3331750 - protein, 8 aa, Plasmodium falciparum
NKDPSRKN

SEQ ID NO: 3331751 - protein, 7 aa, Plasmodium falciparum
NKDQEEI

SEQ ID NO: 3331752 - protein, 7 aa, Plasmodium falciparum
NKDQGVN

SEQ ID NO: 3331753 - protein, 8 aa, Plasmodium falciparum
NKDQMNRS

SEQ ID NO: 3331754 - protein, 8 aa, Plasmodium falciparum
NKDRNNKH

SEQ ID NO: 3331755 - protein, 4 aa, Plasmodium falciparum
NKDS

SEQ ID NO: 3331756 - protein, 28 aa, Plasmodium falciparum
NKDSDSDYNKNENRENHNERDDNNYDNM

SEQ ID NO: 3331757 - protein, 10 aa, Plasmodium falciparum
NKDSETLNSE

SEQ ID NO: 3331758 - protein, 7 aa, Plasmodium falciparum
NKDSHNY

SEQ ID NO: 3331759 - protein, 44 aa, Plasmodium falciparum
NKDSSSVDNNKNNNNKNNNNKNNNNENNNKNNKNNNNDSFSKDN

SEQ ID NO: 3331760 - protein, 5 aa, Plasmodium falciparum
NKDST

SEQ ID NO: 3331761 - protein, 8 aa, Plasmodium falciparum
NKDSTKEM

SEQ ID NO: 3331762 - protein, 9 aa, Plasmodium falciparum
NKDSTKNVR

SEQ ID NO: 3331763 - protein, 10 aa, Plasmodium falciparum
NKDSVKDTHH

SEQ ID NO: 3331764 - protein, 4 aa, Plasmodium falciparum
NKDT

SEQ ID NO: 3331765 - protein, 6 aa, Plasmodium falciparum
NKDTKA

SEQ ID NO: 3331766 - protein, 7 aa, Plasmodium falciparum
NKDTNLN

SEQ ID NO: 3331767 - protein, 11 aa, Plasmodium falciparum
NKDTNLVDKTD

SEQ ID NO: 3331768 - protein, 15 aa, Plasmodium falciparum
NKDTNMSSLNTSENT

SEQ ID NO: 3331769 - protein, 7 aa, Plasmodium falciparum
NKDTNSI

SEQ ID NO: 3331770 - protein, 6 aa, Plasmodium falciparum
NKDTNV

SEQ ID NO: 3331771 - protein, 5 aa, Plasmodium falciparum
NKDTQ

SEQ ID NO: 3331772 - protein, 7 aa, Plasmodium falciparum
NKDTYDC

SEQ ID NO: 3331773 - protein, 18 aa, Plasmodium falciparum
NKDTYKNEEKKKKKNTFN

SEQ ID NO: 3331774 - protein, 7 aa, Plasmodium falciparum
NKDYEGK

SEQ ID NO: 3331775 - protein, 7 aa, Plasmodium falciparum
NKDYYNH

SEQ ID NO: 3331776 - protein, 14 aa, Plasmodium falciparum
NKECSENKNKYEST

SEQ ID NO: 3331777 - protein, 22 aa, Plasmodium falciparum
NKEDAEGNSTQARMNNKDSTDN

SEQ ID NO: 3331778 - protein, 5 aa, Plasmodium falciparum
NKEDD

SEQ ID NO: 3331779 - protein, 11 aa, Plasmodium falciparum
NKEDDEDYNKK

SEQ ID NO: 3331780 - protein, 25 aa, Plasmodium falciparum
NKEDDNKKVEENYNNDDNNKDDPFH

SEQ ID NO: 3331781 - protein, 9 aa, Plasmodium falciparum
NKEDDRKKI

SEQ ID NO: 3331782 - protein, 23 aa, Plasmodium falciparum
NKEDKDDTGGGGGGGSRGGGGGG

SEQ ID NO: 3331783 - protein, 7 aa, Plasmodium falciparum
NKEDKVT

SEQ ID NO: 3331784 - protein, 17 aa, Plasmodium falciparum
NKEDNDNKNKICNRKGS

SEQ ID NO: 3331785 - protein, 30 aa, Plasmodium falciparum
NKEDNDSTKTFYETTENELTDENESAQSNN

SEQ ID NO: 3331786 - protein, 6 aa, Plasmodium falciparum
NKEDNI

SEQ ID NO: 3331787 - protein, 14 aa, Plasmodium falciparum
NKEDNTIDDDTNEG

SEQ ID NO: 3331788 - protein, 69 aa, Plasmodium falciparum
NKEDQYESVSQKGKCSNENIKDENEIKNNDTNNNENNNNENNNNENNNNENNNETIVSNEDQKIKEEKT

SEQ ID NO: 3331789 - protein, 39 aa, Plasmodium falciparum
NKEDSTENKNEEPHKVSQDDDLKQNEQKDNQEKNHTQNC

SEQ ID NO: 3331790 - protein, 5 aa, Plasmodium falciparum
NKEDY

SEQ ID NO: 3331791 - protein, 8 aa, Plasmodium falciparum
NKEDYNKT

SEQ ID NO: 3331792 - protein, 4 aa, Plasmodium falciparum
NKEE

SEQ ID NO: 3331793 - protein, 11 aa, Plasmodium falciparum
NKEEDNGNEKY

SEQ ID NO: 3331794 - protein, 8 aa, Plasmodium falciparum
NKEEDYNN

SEQ ID NO: 3331795 - protein, 7 aa, Plasmodium falciparum
NKEEEEE

SEQ ID NO: 3331796 - protein, 6 aa, Plasmodium falciparum
NKEEEI

SEQ ID NO: 3331797 - protein, 7 aa, Plasmodium falciparum
NKEEENN

SEQ ID NO: 3331798 - protein, 8 aa, Plasmodium falciparum
NKEEEYKD

SEQ ID NO: 3331799 - protein, 8 aa, Plasmodium falciparum
NKEEEYQE

SEQ ID NO: 3331800 - protein, 7 aa, Plasmodium falciparum
NKEEGNI

SEQ ID NO: 3331801 - protein, 13 aa, Plasmodium falciparum
NKEEHDKNIPDRN

SEQ ID NO: 3331802 - protein, 7 aa, Plasmodium falciparum
NKEEKKK

SEQ ID NO: 3331803 - protein, 15 aa, Plasmodium falciparum
NKEEKKNNKGKNNLN

SEQ ID NO: 3331804 - protein, 7 aa, Plasmodium falciparum
NKEEKNL

SEQ ID NO: 3331805 - protein, 10 aa, Plasmodium falciparum
NKEEKSIRRK

SEQ ID NO: 3331806 - protein, 7 aa, Plasmodium falciparum
NKEENEE

SEQ ID NO: 3331807 - protein, 9 aa, Plasmodium falciparum
NKEENKSNI

SEQ ID NO: 3331808 - protein, 6 aa, Plasmodium falciparum
NKEENN

SEQ ID NO: 3331809 - protein, 33 aa, Plasmodium falciparum
NKEENNKKEDDEKHFDDNTNEQKKNVDNGEYNE

SEQ ID NO: 3331810 - protein, 10 aa, Plasmodium falciparum
NKEENNNENS

SEQ ID NO: 3331811 - protein, 38 aa, Plasmodium falciparum
NKEENSKLNHKNKYNYTKKNNLSNNTHIKEKDKIDNKG

SEQ ID NO: 3331812 - protein, 34 aa, Plasmodium falciparum
NKEENYDYEDSNDDNYNENDDYNNNNNNNNNDSY

SEQ ID NO: 3331813 - protein, 8 aa, Plasmodium falciparum
NKEEQNKL

SEQ ID NO: 3331814 - protein, 7 aa, Plasmodium falciparum
NKEEQQN

SEQ ID NO: 3331815 - protein, 14 aa, Plasmodium falciparum
NKEEQYDDVSDNIN

SEQ ID NO: 3331816 - protein, 34 aa, Plasmodium falciparum
NKEESDSTENENSMDINASKKKSWNELTDKQQHD

SEQ ID NO: 3331817 - protein, 7 aa, Plasmodium falciparum
NKEEWEK

SEQ ID NO: 3331818 - protein, 4 aa, Plasmodium falciparum
NKEG

SEQ ID NO: 3331819 - protein, 6 aa, Plasmodium falciparum
NKEGEI

SEQ ID NO: 3331820 - protein, 11 aa, Plasmodium falciparum
NKEGNKNTNDQ

SEQ ID NO: 3331821 - protein, 6 aa, Plasmodium falciparum
NKEGNL

SEQ ID NO: 3331822 - protein, 8 aa, Plasmodium falciparum
NKEGNNMK

SEQ ID NO: 3331823 - protein, 10 aa, Plasmodium falciparum
NKEHEDNNKY

SEQ ID NO: 3331824 - protein, 15 aa, Plasmodium falciparum
NKEIASTESYKKNTK

SEQ ID NO: 3331825 - protein, 14 aa, Plasmodium falciparum
NKEIKSDKYQSSKV

SEQ ID NO: 3331826 - protein, 5 aa, Plasmodium falciparum
NKEIN

SEQ ID NO: 3331827 - protein, 49 aa, Plasmodium falciparum
NKEINENSNGKEINNNSNGKEINNNSNGKEINNNSNGKEINNNSNGKEI

SEQ ID NO: 3331828 - protein, 18 aa, Plasmodium falciparum
NKEINNYHDNNNHDDNIG

SEQ ID NO: 3331829 - protein, 7 aa, Plasmodium falciparum
NKEITDK

SEQ ID NO: 3331830 - protein, 6 aa, Plasmodium falciparum
NKEIYE

SEQ ID NO: 3331831 - protein, 8 aa, Plasmodium falciparum
NKEKAEVT

SEQ ID NO: 3331832 - protein, 6 aa, Plasmodium falciparum
NKEKCK

SEQ ID NO: 3331833 - protein, 5 aa, Plasmodium falciparum
NKEKD

SEQ ID NO: 3331834 - protein, 9 aa, Plasmodium falciparum
NKEKDKDKE

SEQ ID NO: 3331835 - protein, 8 aa, Plasmodium falciparum
NKEKDNTY

SEQ ID NO: 3331836 - protein, 11 aa, Plasmodium falciparum
NKEKDRKQQQM

SEQ ID NO: 3331837 - protein, 37 aa, Plasmodium falciparum
NKEKDVSKKRKAQLKDEYDNISRSKENINNSKKIKNE

SEQ ID NO: 3331838 - protein, 10 aa, Plasmodium falciparum
NKEKEEKERR

SEQ ID NO: 3331839 - protein, 9 aa, Plasmodium falciparum
NKEKEELNT

SEQ ID NO: 3331840 - protein, 9 aa, Plasmodium falciparum
NKEKEINKT

SEQ ID NO: 3331841 - protein, 15 aa, Plasmodium falciparum
NKEKEKEKEKEIKAN

SEQ ID NO: 3331842 - protein, 10 aa, Plasmodium falciparum
NKEKENKEKI

SEQ ID NO: 3331843 - protein, 17 aa, Plasmodium falciparum
NKEKEQIEKNKQELDKE

SEQ ID NO: 3331844 - protein, 23 aa, Plasmodium falciparum
NKEKEQLKEKEETLKNEKEKVKQ

SEQ ID NO: 3331845 - protein, 5 aa, Plasmodium falciparum
NKEKI

SEQ ID NO: 3331846 - protein, 8 aa, Plasmodium falciparum
NKEKKDEF

SEQ ID NO: 3331847 - protein, 19 aa, Plasmodium falciparum
NKEKKKRSRNEGSKETKMN

SEQ ID NO: 3331848 - protein, 9 aa, Plasmodium falciparum
NKEKKLNEH

SEQ ID NO: 3331849 - protein, 12 aa, Plasmodium falciparum
NKEKNDNKNNLE

SEQ ID NO: 3331850 - protein, 15 aa, Plasmodium falciparum
NKEKNEKENEKENKI

SEQ ID NO: 3331851 - protein, 8 aa, Plasmodium falciparum
NKEKNGNL

SEQ ID NO: 3331852 - protein, 19 aa, Plasmodium falciparum
NKEKNKQLKDEKKKDKESC

SEQ ID NO: 3331853 - protein, 9 aa, Plasmodium falciparum
NKEKQDFPN

SEQ ID NO: 3331854 - protein, 8 aa, Plasmodium falciparum
NKEKQGNE

SEQ ID NO: 3331855 - protein, 9 aa, Plasmodium falciparum
NKEKQNQEI

SEQ ID NO: 3331856 - protein, 18 aa, Plasmodium falciparum
NKEKRKYHPKEEKENFDR

SEQ ID NO: 3331857 - protein, 6 aa, Plasmodium falciparum
NKEKSD

SEQ ID NO: 3331858 - protein, 8 aa, Plasmodium falciparum
NKEKSSNT

SEQ ID NO: 3331859 - protein, 161 aa, Plasmodium falciparum
NKEKYRDRNDHKKPYYDENKSDRSRNSSDNNEKMRKKGKNKKHMKRYTSSKSVSKSSNTSINRSSDRSRDRSSDRSSDKSSDRSRDRSSDRSSDRSSDRSSNRSSNRSSDRSSDRSINRSSDKSINRSSDRSSSRSNNPSDSFNNKSESSEKIKRDKREKI

SEQ ID NO: 3331860 - protein, 8 aa, Plasmodium falciparum
NKEKYSNI

SEQ ID NO: 3331861 - protein, 4 aa, Plasmodium falciparum
NKEL

SEQ ID NO: 3331862 - protein, 27 aa, Plasmodium falciparum
NKELQYRENDSKQKGNQSKDEINKSSD

SEQ ID NO: 3331863 - protein, 13 aa, Plasmodium falciparum
NKELSEGNKELEK

SEQ ID NO: 3331864 - protein, 8 aa, Plasmodium falciparum
NKELSQEK

SEQ ID NO: 3331865 - protein, 6 aa, Plasmodium falciparum
NKEMHD

SEQ ID NO: 3331866 - protein, 6 aa, Plasmodium falciparum
NKEMNT

SEQ ID NO: 3331867 - protein, 5 aa, Plasmodium falciparum
NKEMP

SEQ ID NO: 3331868 - protein, 8 aa, Plasmodium falciparum
NKEMSDDA

SEQ ID NO: 3331869 - protein, 14 aa, Plasmodium falciparum
NKENEIPKNENSNP

SEQ ID NO: 3331870 - protein, 6 aa, Plasmodium falciparum
NKENEK

SEQ ID NO: 3331871 - protein, 13 aa, Plasmodium falciparum
NKENEKVPLQSTK

SEQ ID NO: 3331872 - protein, 9 aa, Plasmodium falciparum
NKENEKYDK

SEQ ID NO: 3331873 - protein, 43 aa, Plasmodium falciparum
NKENENEKENENEKENENENEKENENENENIKNNKNNKNNCDN

SEQ ID NO: 3331874 - protein, 9 aa, Plasmodium falciparum
NKENENEND

SEQ ID NO: 3331875 - protein, 19 aa, Plasmodium falciparum
NKENENHKHNNEYNNVNNN

SEQ ID NO: 3331876 - protein, 9 aa, Plasmodium falciparum
NKENEQDLP

SEQ ID NO: 3331877 - protein, 5 aa, Plasmodium falciparum
NKENF

SEQ ID NO: 3331878 - protein, 6 aa, Plasmodium falciparum
NKENGK

SEQ ID NO: 3331879 - protein, 9 aa, Plasmodium falciparum
NKENHKNKL

SEQ ID NO: 3331880 - protein, 8 aa, Plasmodium falciparum
NKENISKN

SEQ ID NO: 3331881 - protein, 44 aa, Plasmodium falciparum
NKENKEDEQNKENKKDEQNKEDEQNKQNKEDEQNKQNKDKKNIV

SEQ ID NO: 3331882 - protein, 6 aa, Plasmodium falciparum
NKENKN

SEQ ID NO: 3331883 - protein, 6 aa, Plasmodium falciparum
NKENLT

SEQ ID NO: 3331884 - protein, 7 aa, Plasmodium falciparum
NKENNII

SEQ ID NO: 3331885 - protein, 88 aa, Plasmodium falciparum
NKENNININGNNNDNINGNNNDNSNGNNNDNSNGNNNDNNSDNNNNNINGNNNDNNNDNNNDNNNDNNNDNNNDNNNDNNNNNNSCND

SEQ ID NO: 3331886 - protein, 11 aa, Plasmodium falciparum
NKENQKEKINK

SEQ ID NO: 3331887 - protein, 5 aa, Plasmodium falciparum
NKENS

SEQ ID NO: 3331888 - protein, 22 aa, Plasmodium falciparum
NKENTNKKINTDDLKNSEINDE

SEQ ID NO: 3331889 - protein, 10 aa, Plasmodium falciparum
NKENTTDPYH

SEQ ID NO: 3331890 - protein, 5 aa, Plasmodium falciparum
NKEPN

SEQ ID NO: 3331891 - protein, 12 aa, Plasmodium falciparum
NKEPNEEPKKKG

SEQ ID NO: 3331892 - protein, 4 aa, Plasmodium falciparum
NKEQ

SEQ ID NO: 3331893 - protein, 6 aa, Plasmodium falciparum
NKEQCS

SEQ ID NO: 3331894 - protein, 8 aa, Plasmodium falciparum
NKEQEETV

SEQ ID NO: 3331895 - protein, 7 aa, Plasmodium falciparum
NKEQESI

SEQ ID NO: 3331896 - protein, 7 aa, Plasmodium falciparum
NKEQINN

SEQ ID NO: 3331897 - protein, 10 aa, Plasmodium falciparum
NKEQKDKNIH

SEQ ID NO: 3331898 - protein, 8 aa, Plasmodium falciparum
NKEQNNLN

SEQ ID NO: 3331899 - protein, 6 aa, Plasmodium falciparum
NKEQYA

SEQ ID NO: 3331900 - protein, 10 aa, Plasmodium falciparum
NKEREKEEKI

SEQ ID NO: 3331901 - protein, 35 aa, Plasmodium falciparum
NKERKEESNSNHKKKNLKNKGQKKLDSNEKDMPEF

SEQ ID NO: 3331902 - protein, 14 aa, Plasmodium falciparum
NKERTETPNERVGG

SEQ ID NO: 3331903 - protein, 6 aa, Plasmodium falciparum
NKESED

SEQ ID NO: 3331904 - protein, 7 aa, Plasmodium falciparum
NKESEKC

SEQ ID NO: 3331905 - protein, 17 aa, Plasmodium falciparum
NKESEYSNQMKNKYKEK

SEQ ID NO: 3331906 - protein, 5 aa, Plasmodium falciparum
NKESF

SEQ ID NO: 3331907 - protein, 8 aa, Plasmodium falciparum
NKESGKYK

SEQ ID NO: 3331908 - protein, 6 aa, Plasmodium falciparum
NKESIN

SEQ ID NO: 3331909 - protein, 10 aa, Plasmodium falciparum
NKESIPKEYK

SEQ ID NO: 3331910 - protein, 8 aa, Plasmodium falciparum
NKESMEEQ

SEQ ID NO: 3331911 - protein, 8 aa, Plasmodium falciparum
NKESNGTL

SEQ ID NO: 3331912 - protein, 9 aa, Plasmodium falciparum
NKESNISNT

SEQ ID NO: 3331913 - protein, 23 aa, Plasmodium falciparum
NKESNITPEASNDDNIKSNTISD

SEQ ID NO: 3331914 - protein, 9 aa, Plasmodium falciparum
NKESNTNDA

SEQ ID NO: 3331915 - protein, 14 aa, Plasmodium falciparum
NKESYGYNNSSNCI

SEQ ID NO: 3331916 - protein, 11 aa, Plasmodium falciparum
NKESYRNSTSD

SEQ ID NO: 3331917 - protein, 9 aa, Plasmodium falciparum
NKESYTYTH

SEQ ID NO: 3331918 - protein, 7 aa, Plasmodium falciparum
NKETASY

SEQ ID NO: 3331919 - protein, 8 aa, Plasmodium falciparum
NKETEEKK

SEQ ID NO: 3331920 - protein, 8 aa, Plasmodium falciparum
NKETENMN

SEQ ID NO: 3331921 - protein, 5 aa, Plasmodium falciparum
NKETI

SEQ ID NO: 3331922 - protein, 16 aa, Plasmodium falciparum
NKETKNWNKKEEHDHN

SEQ ID NO: 3331923 - protein, 20 aa, Plasmodium falciparum
NKETQNENAHEGDIESREKY

SEQ ID NO: 3331924 - protein, 10 aa, Plasmodium falciparum
NKETSNPMKN

SEQ ID NO: 3331925 - protein, 8 aa, Plasmodium falciparum
NKETVENQ

SEQ ID NO: 3331926 - protein, 7 aa, Plasmodium falciparum
NKETYDS

SEQ ID NO: 3331927 - protein, 7 aa, Plasmodium falciparum
NKETYNY

SEQ ID NO: 3331928 - protein, 5 aa, Plasmodium falciparum
NKEYE

SEQ ID NO: 3331929 - protein, 10 aa, Plasmodium falciparum
NKEYEKNNIK

SEQ ID NO: 3331930 - protein, 12 aa, Plasmodium falciparum
NKEYEKNQLQDK

SEQ ID NO: 3331931 - protein, 16 aa, Plasmodium falciparum
NKEYFKNKSDDDQNNI

SEQ ID NO: 3331932 - protein, 5 aa, Plasmodium falciparum
NKEYG

SEQ ID NO: 3331933 - protein, 5 aa, Plasmodium falciparum
NKEYL

SEQ ID NO: 3331934 - protein, 15 aa, Plasmodium falciparum
NKEYNKEDVKEKLHE

SEQ ID NO: 3331935 - protein, 7 aa, Plasmodium falciparum
NKEYNPY

SEQ ID NO: 3331936 - protein, 13 aa, Plasmodium falciparum
NKEYTQDNILSHF

SEQ ID NO: 3331937 - protein, 18 aa, Plasmodium falciparum
NKEYTQENNDDNKRNLEK

SEQ ID NO: 3331938 - protein, 13 aa, Plasmodium falciparum
NKFEGKSDFSDEN

SEQ ID NO: 3331939 - protein, 13 aa, Plasmodium falciparum
NKFNENKGDPINI

SEQ ID NO: 3331940 - protein, 10 aa, Plasmodium falciparum
NKFNERSDTP

SEQ ID NO: 3331941 - protein, 7 aa, Plasmodium falciparum
NKFNESD

SEQ ID NO: 3331942 - protein, 6 aa, Plasmodium falciparum
NKFNSD

SEQ ID NO: 3331943 - protein, 5 aa, Plasmodium falciparum
NKFNT

SEQ ID NO: 3331944 - protein, 7 aa, Plasmodium falciparum
NKFPSVS

SEQ ID NO: 3331945 - protein, 6 aa, Plasmodium falciparum
NKFTES

SEQ ID NO: 3331946 - protein, 9 aa, Plasmodium falciparum
NKGDDYNDY

SEQ ID NO: 3331947 - protein, 16 aa, Plasmodium falciparum
NKGDINNTKNLHASNK

SEQ ID NO: 3331948 - protein, 6 aa, Plasmodium falciparum
NKGDNK

SEQ ID NO: 3331949 - protein, 17 aa, Plasmodium falciparum
NKGDNLYNDNNINKDDN

SEQ ID NO: 3331950 - protein, 17 aa, Plasmodium falciparum
NKGDQKKKKLNEQDNSY

SEQ ID NO: 3331951 - protein, 8 aa, Plasmodium falciparum
NKGDSLND

SEQ ID NO: 3331952 - protein, 8 aa, Plasmodium falciparum
NKGDSVGG

SEQ ID NO: 3331953 - protein, 6 aa, Plasmodium falciparum
NKGELS

SEQ ID NO: 3331954 - protein, 6 aa, Plasmodium falciparum
NKGEND

SEQ ID NO: 3331955 - protein, 8 aa, Plasmodium falciparum
NKGENNYD

SEQ ID NO: 3331956 - protein, 9 aa, Plasmodium falciparum
NKGESSNNK

SEQ ID NO: 3331957 - protein, 8 aa, Plasmodium falciparum
NKGGADGL

SEQ ID NO: 3331958 - protein, 15 aa, Plasmodium falciparum
NKGGPRNNVNNSEHM

SEQ ID NO: 3331959 - protein, 18 aa, Plasmodium falciparum
NKGGPTLNGNNSSKNKIV

SEQ ID NO: 3331960 - protein, 7 aa, Plasmodium falciparum
NKGHNSS

SEQ ID NO: 3331961 - protein, 4 aa, Plasmodium falciparum
NKGI

SEQ ID NO: 3331962 - protein, 8 aa, Plasmodium falciparum
NKGIGQNV

SEQ ID NO: 3331963 - protein, 14 aa, Plasmodium falciparum
NKGISDKEEQPNKL

SEQ ID NO: 3331964 - protein, 10 aa, Plasmodium falciparum
NKGITDMNNT

SEQ ID NO: 3331965 - protein, 9 aa, Plasmodium falciparum
NKGIYNNNN

SEQ ID NO: 3331966 - protein, 9 aa, Plasmodium falciparum
NKGKHETHF

SEQ ID NO: 3331967 - protein, 6 aa, Plasmodium falciparum
NKGKNI

SEQ ID NO: 3331968 - protein, 15 aa, Plasmodium falciparum
NKGKNVEEKTGSNKV

SEQ ID NO: 3331969 - protein, 10 aa, Plasmodium falciparum
NKGKPNTNGS

SEQ ID NO: 3331970 - protein, 7 aa, Plasmodium falciparum
NKGKYKP

SEQ ID NO: 3331971 - protein, 24 aa, Plasmodium falciparum
NKGKYYPQRSTSMSSNYKYNTKGG

SEQ ID NO: 3331972 - protein, 5 aa, Plasmodium falciparum
NKGMI

SEQ ID NO: 3331973 - protein, 5 aa, Plasmodium falciparum
NKGND

SEQ ID NO: 3331974 - protein, 13 aa, Plasmodium falciparum
NKGNDKKKQTNQI

SEQ ID NO: 3331975 - protein, 5 aa, Plasmodium falciparum
NKGNE

SEQ ID NO: 3331976 - protein, 8 aa, Plasmodium falciparum
NKGNELDV

SEQ ID NO: 3331977 - protein, 8 aa, Plasmodium falciparum
NKGNGKKK

SEQ ID NO: 3331978 - protein, 14 aa, Plasmodium falciparum
NKGNGQEKKEAEKL

SEQ ID NO: 3331979 - protein, 7 aa, Plasmodium falciparum
NKGNHMD

SEQ ID NO: 3331980 - protein, 5 aa, Plasmodium falciparum
NKGNI

SEQ ID NO: 3331981 - protein, 8 aa, Plasmodium falciparum
NKGNNENF

SEQ ID NO: 3331982 - protein, 27 aa, Plasmodium falciparum
NKGNQHYDNSDNSSVEDKEIHSRGYAS

SEQ ID NO: 3331983 - protein, 18 aa, Plasmodium falciparum
NKGNSIQNKDGTNKKTIE

SEQ ID NO: 3331984 - protein, 10 aa, Plasmodium falciparum
NKGNSNNNNN

SEQ ID NO: 3331985 - protein, 15 aa, Plasmodium falciparum
NKGNTNFKKNNSSNI

SEQ ID NO: 3331986 - protein, 13 aa, Plasmodium falciparum
NKGPKKEVEEKNA

SEQ ID NO: 3331987 - protein, 8 aa, Plasmodium falciparum
NKGPTNIN

SEQ ID NO: 3331988 - protein, 9 aa, Plasmodium falciparum
NKGQAHKNS

SEQ ID NO: 3331989 - protein, 6 aa, Plasmodium falciparum
NKGQDF

SEQ ID NO: 3331990 - protein, 6 aa, Plasmodium falciparum
NKGRSD

SEQ ID NO: 3331991 - protein, 7 aa, Plasmodium falciparum
NKGSCGG

SEQ ID NO: 3331992 - protein, 6 aa, Plasmodium falciparum
NKGSEV

SEQ ID NO: 3331993 - protein, 18 aa, Plasmodium falciparum
NKGSNDSYSSNSIKEDEK

SEQ ID NO: 3331994 - protein, 18 aa, Plasmodium falciparum
NKGSNINKADDQTNNRIE

SEQ ID NO: 3331995 - protein, 7 aa, Plasmodium falciparum
NKGSTHS

SEQ ID NO: 3331996 - protein, 12 aa, Plasmodium falciparum
NKGSVAKKEVKE

SEQ ID NO: 3331997 - protein, 10 aa, Plasmodium falciparum
NKGTARDAKW

SEQ ID NO: 3331998 - protein, 4 aa, Plasmodium falciparum
NKGY

SEQ ID NO: 3331999 - protein, 5 aa, Plasmodium falciparum
NKGYE

SEQ ID NO: 3332000 - protein, 24 aa, Plasmodium falciparum
NKGYNKSSINKKYENNINKNNKDK

SEQ ID NO: 3332001 - protein, 6 aa, Plasmodium falciparum
NKGYNN

SEQ ID NO: 3332002 - protein, 4 aa, Plasmodium falciparum
NKHC

SEQ ID NO: 3332003 - protein, 6 aa, Plasmodium falciparum
NKHDKN

SEQ ID NO: 3332004 - protein, 89 aa, Plasmodium falciparum
NKHDNTGNDRNEHNGDYKSNPESNNKNNLKSNNKSDQNNNIRNYSKNNSKSDNKNDSINDKIESKENNNKPCYKKQSSSHRSQKSQSII

SEQ ID NO: 3332005 - protein, 6 aa, Plasmodium falciparum
NKHEDK

SEQ ID NO: 3332006 - protein, 23 aa, Plasmodium falciparum
NKHEKQKGKERHKQNGYSKDKKK

SEQ ID NO: 3332007 - protein, 7 aa, Plasmodium falciparum
NKHENKI

SEQ ID NO: 3332008 - protein, 19 aa, Plasmodium falciparum
NKHGKKKTVYTNKNNELDN

SEQ ID NO: 3332009 - protein, 7 aa, Plasmodium falciparum
NKHGNED

SEQ ID NO: 3332010 - protein, 24 aa, Plasmodium falciparum
NKHGRSKKNKREKETKKRRSTTRH

SEQ ID NO: 3332011 - protein, 16 aa, Plasmodium falciparum
NKHINNSNHHNQHYDE

SEQ ID NO: 3332012 - protein, 10 aa, Plasmodium falciparum
NKHKKNEDIE

SEQ ID NO: 3332013 - protein, 95 aa, Plasmodium falciparum
NKHKKYSSSKMDKKKDSYYKEQSNKYKEKRKYDESSQDTYDKKRKRKRKKKKYDYEREEEKYNRYDERRDSSYYTSNYSEDSSKREGGKKEKEDL

SEQ ID NO: 3332014 - protein, 6 aa, Plasmodium falciparum
NKHKRD

SEQ ID NO: 3332015 - protein, 9 aa, Plasmodium falciparum
NKHKRKSVH

SEQ ID NO: 3332016 - protein, 16 aa, Plasmodium falciparum
NKHLTNKTQSDKKEQV

SEQ ID NO: 3332017 - protein, 6 aa, Plasmodium falciparum
NKHMNN

SEQ ID NO: 3332018 - protein, 13 aa, Plasmodium falciparum
NKHNDGDKIDEQM

SEQ ID NO: 3332019 - protein, 14 aa, Plasmodium falciparum
NKHNIEKKKNQGSK

SEQ ID NO: 3332020 - protein, 13 aa, Plasmodium falciparum
NKHNNESKGEFNY

SEQ ID NO: 3332021 - protein, 7 aa, Plasmodium falciparum
NKHNNIN

SEQ ID NO: 3332022 - protein, 6 aa, Plasmodium falciparum
NKHNNN

SEQ ID NO: 3332023 - protein, 14 aa, Plasmodium falciparum
NKHNNNDKGEKSCE

SEQ ID NO: 3332024 - protein, 7 aa, Plasmodium falciparum
NKHNNNK

SEQ ID NO: 3332025 - protein, 38 aa, Plasmodium falciparum
NKHNNNNNNNSNNINSNNINSNNINNNNNKRKNTNNKT

SEQ ID NO: 3332026 - protein, 7 aa, Plasmodium falciparum
NKHNSDI

SEQ ID NO: 3332027 - protein, 11 aa, Plasmodium falciparum
NKHNSSSKKNQ

SEQ ID NO: 3332028 - protein, 18 aa, Plasmodium falciparum
NKHNYNKKKKKKKKYYYS

SEQ ID NO: 3332029 - protein, 5 aa, Plasmodium falciparum
NKHSE

SEQ ID NO: 3332030 - protein, 6 aa, Plasmodium falciparum
NKHSYH

SEQ ID NO: 3332031 - protein, 12 aa, Plasmodium falciparum
NKHSYNSSDEYK

SEQ ID NO: 3332032 - protein, 16 aa, Plasmodium falciparum
NKHTIKKKKKKHHNNK

SEQ ID NO: 3332033 - protein, 6 aa, Plasmodium falciparum
NKHTLE

SEQ ID NO: 3332034 - protein, 7 aa, Plasmodium falciparum
NKHTSED

SEQ ID NO: 3332035 - protein, 9 aa, Plasmodium falciparum
NKHYNDRKS

SEQ ID NO: 3332036 - protein, 4 aa, Plasmodium falciparum
NKID

SEQ ID NO: 3332037 - protein, 6 aa, Plasmodium falciparum
NKIDNN

SEQ ID NO: 3332038 - protein, 7 aa, Plasmodium falciparum
NKIDQGD

SEQ ID NO: 3332039 - protein, 7 aa, Plasmodium falciparum
NKIEDDV

SEQ ID NO: 3332040 - protein, 6 aa, Plasmodium falciparum
NKIEED

SEQ ID NO: 3332041 - protein, 22 aa, Plasmodium falciparum
NKIEEKKNIEETTENKNNTVGK

SEQ ID NO: 3332042 - protein, 11 aa, Plasmodium falciparum
NKIEHENTQNY

SEQ ID NO: 3332043 - protein, 5 aa, Plasmodium falciparum
NKIEK

SEQ ID NO: 3332044 - protein, 11 aa, Plasmodium falciparum
NKIEKENGNDD

SEQ ID NO: 3332045 - protein, 15 aa, Plasmodium falciparum
NKIENTKLNSKKKYS

SEQ ID NO: 3332046 - protein, 10 aa, Plasmodium falciparum
NKIETQSINS

SEQ ID NO: 3332047 - protein, 6 aa, Plasmodium falciparum
NKIETY

SEQ ID NO: 3332048 - protein, 4 aa, Plasmodium falciparum
NKIG

SEQ ID NO: 3332049 - protein, 8 aa, Plasmodium falciparum
NKIGDNNM

SEQ ID NO: 3332050 - protein, 6 aa, Plasmodium falciparum
NKIGDT

SEQ ID NO: 3332051 - protein, 6 aa, Plasmodium falciparum
NKIHEK

SEQ ID NO: 3332052 - protein, 18 aa, Plasmodium falciparum
NKIHNSQVTSHKEGDLKN

SEQ ID NO: 3332053 - protein, 7 aa, Plasmodium falciparum
NKIKDEE

SEQ ID NO: 3332054 - protein, 12 aa, Plasmodium falciparum
NKIKKKKKTEFS

SEQ ID NO: 3332055 - protein, 4 aa, Plasmodium falciparum
NKIN

SEQ ID NO: 3332056 - protein, 6 aa, Plasmodium falciparum
NKINDN

SEQ ID NO: 3332057 - protein, 11 aa, Plasmodium falciparum
NKINENKNDIK

SEQ ID NO: 3332058 - protein, 29 aa, Plasmodium falciparum
NKINENNTIQYGQKTKGNKIGNHKTNIKE

SEQ ID NO: 3332059 - protein, 21 aa, Plasmodium falciparum
NKINKKDNKYIKKKNSKKTKN

SEQ ID NO: 3332060 - protein, 10 aa, Plasmodium falciparum
NKINKNDGNY

SEQ ID NO: 3332061 - protein, 12 aa, Plasmodium falciparum
NKINKNSKENYM

SEQ ID NO: 3332062 - protein, 11 aa, Plasmodium falciparum
NKINNANNNVQ

SEQ ID NO: 3332063 - protein, 7 aa, Plasmodium falciparum
NKINNNE

SEQ ID NO: 3332064 - protein, 14 aa, Plasmodium falciparum
NKINNNNNNNKSYS

SEQ ID NO: 3332065 - protein, 7 aa, Plasmodium falciparum
NKINNNS

SEQ ID NO: 3332066 - protein, 8 aa, Plasmodium falciparum
NKINNPDN

SEQ ID NO: 3332067 - protein, 40 aa, Plasmodium falciparum
NKINQKENDNENEKENEKENEDKDENDEKEKHKEDNISNA

SEQ ID NO: 3332068 - protein, 6 aa, Plasmodium falciparum
NKINQN

SEQ ID NO: 3332069 - protein, 9 aa, Plasmodium falciparum
NKINTNNSD

SEQ ID NO: 3332070 - protein, 5 aa, Plasmodium falciparum
NKIPN

SEQ ID NO: 3332071 - protein, 6 aa, Plasmodium falciparum
NKIPND

SEQ ID NO: 3332072 - protein, 5 aa, Plasmodium falciparum
NKIQK

SEQ ID NO: 3332073 - protein, 7 aa, Plasmodium falciparum
NKIQKSD

SEQ ID NO: 3332074 - protein, 15 aa, Plasmodium falciparum
NKIQNKVDDNKTKKQ

SEQ ID NO: 3332075 - protein, 4 aa, Plasmodium falciparum
NKIR

SEQ ID NO: 3332076 - protein, 10 aa, Plasmodium falciparum
NKIRQDYGRE

SEQ ID NO: 3332077 - protein, 8 aa, Plasmodium falciparum
NKISGNEK

SEQ ID NO: 3332078 - protein, 8 aa, Plasmodium falciparum
NKISKQTN

SEQ ID NO: 3332079 - protein, 8 aa, Plasmodium falciparum
NKISSDDQ

SEQ ID NO: 3332080 - protein, 8 aa, Plasmodium falciparum
NKITDKNK

SEQ ID NO: 3332081 - protein, 7 aa, Plasmodium falciparum
NKITEKD

SEQ ID NO: 3332082 - protein, 16 aa, Plasmodium falciparum
NKITKKKYELDKDSLD

SEQ ID NO: 3332083 - protein, 7 aa, Plasmodium falciparum
NKITKNM

SEQ ID NO: 3332084 - protein, 11 aa, Plasmodium falciparum
NKITNKECEEL

SEQ ID NO: 3332085 - protein, 7 aa, Plasmodium falciparum
NKITNTN

SEQ ID NO: 3332086 - protein, 18 aa, Plasmodium falciparum
NKIYSSNDYKSNKQDNYY

SEQ ID NO: 3332087 - protein, 9 aa, Plasmodium falciparum
NKKCGTNNS

SEQ ID NO: 3332088 - protein, 5 aa, Plasmodium falciparum
NKKCN

SEQ ID NO: 3332089 - protein, 5 aa, Plasmodium falciparum
NKKCV

SEQ ID NO: 3332090 - protein, 31 aa, Plasmodium falciparum
NKKDANRGEDNNMEENDDVKENTIEGNDDVK

SEQ ID NO: 3332091 - protein, 10 aa, Plasmodium falciparum
NKKDDYDDDN

SEQ ID NO: 3332092 - protein, 7 aa, Plasmodium falciparum
NKKDEEY

SEQ ID NO: 3332093 - protein, 54 aa, Plasmodium falciparum
NKKDEHEDKNQYHDHQGKQQQQQQQQQQQQQQQQQQQHHNNNNISHTKNNYYNN

SEQ ID NO: 3332094 - protein, 9 aa, Plasmodium falciparum
NKKDEPEKS

SEQ ID NO: 3332095 - protein, 16 aa, Plasmodium falciparum
NKKDIENNTPIKNKDK

SEQ ID NO: 3332096 - protein, 8 aa, Plasmodium falciparum
NKKDINDN

SEQ ID NO: 3332097 - protein, 6 aa, Plasmodium falciparum
NKKDKL

SEQ ID NO: 3332098 - protein, 5 aa, Plasmodium falciparum
NKKDL

SEQ ID NO: 3332099 - protein, 7 aa, Plasmodium falciparum
NKKDMNT

SEQ ID NO: 3332100 - protein, 5 aa, Plasmodium falciparum
NKKDN

SEQ ID NO: 3332101 - protein, 7 aa, Plasmodium falciparum
NKKDQLK

SEQ ID NO: 3332102 - protein, 26 aa, Plasmodium falciparum
NKKDSSNKNDNSSNQGDKKLSDRKNG

SEQ ID NO: 3332103 - protein, 6 aa, Plasmodium falciparum
NKKDTE

SEQ ID NO: 3332104 - protein, 7 aa, Plasmodium falciparum
NKKDTNN

SEQ ID NO: 3332105 - protein, 5 aa, Plasmodium falciparum
NKKEE

SEQ ID NO: 3332106 - protein, 18 aa, Plasmodium falciparum
NKKEEDVKEKINSRKRKS

SEQ ID NO: 3332107 - protein, 11 aa, Plasmodium falciparum
NKKEEEEEKNM

SEQ ID NO: 3332108 - protein, 8 aa, Plasmodium falciparum
NKKEEKIS

SEQ ID NO: 3332109 - protein, 6 aa, Plasmodium falciparum
NKKEEN

SEQ ID NO: 3332110 - protein, 7 aa, Plasmodium falciparum
NKKEERH

SEQ ID NO: 3332111 - protein, 8 aa, Plasmodium falciparum
NKKEESCC

SEQ ID NO: 3332112 - protein, 5 aa, Plasmodium falciparum
NKKEI

SEQ ID NO: 3332113 - protein, 7 aa, Plasmodium falciparum
NKKEIQK

SEQ ID NO: 3332114 - protein, 9 aa, Plasmodium falciparum
NKKEKEEYY

SEQ ID NO: 3332115 - protein, 7 aa, Plasmodium falciparum
NKKEKKC

SEQ ID NO: 3332116 - protein, 9 aa, Plasmodium falciparum
NKKEKKNIN

SEQ ID NO: 3332117 - protein, 12 aa, Plasmodium falciparum
NKKEKKSESALS

SEQ ID NO: 3332118 - protein, 8 aa, Plasmodium falciparum
NKKEKLKG

SEQ ID NO: 3332119 - protein, 9 aa, Plasmodium falciparum
NKKEKLNNN

SEQ ID NO: 3332120 - protein, 18 aa, Plasmodium falciparum
NKKEKNINEQGEKNEHSK

SEQ ID NO: 3332121 - protein, 9 aa, Plasmodium falciparum
NKKEKRKIP

SEQ ID NO: 3332122 - protein, 10 aa, Plasmodium falciparum
NKKENDETEI

SEQ ID NO: 3332123 - protein, 8 aa, Plasmodium falciparum
NKKENEDI

SEQ ID NO: 3332124 - protein, 8 aa, Plasmodium falciparum
NKKENEKH

SEQ ID NO: 3332125 - protein, 11 aa, Plasmodium falciparum
NKKENKNSKIQ

SEQ ID NO: 3332126 - protein, 10 aa, Plasmodium falciparum
NKKENKYKND

SEQ ID NO: 3332127 - protein, 12 aa, Plasmodium falciparum
NKKENTQKHTYS

SEQ ID NO: 3332128 - protein, 10 aa, Plasmodium falciparum
NKKEQEADQL

SEQ ID NO: 3332129 - protein, 14 aa, Plasmodium falciparum
NKKEQEEEIEEQKK

SEQ ID NO: 3332130 - protein, 16 aa, Plasmodium falciparum
NKKESKQNAQINNSKE

SEQ ID NO: 3332131 - protein, 11 aa, Plasmodium falciparum
NKKESNNITKE

SEQ ID NO: 3332132 - protein, 8 aa, Plasmodium falciparum
NKKETKNI

SEQ ID NO: 3332133 - protein, 7 aa, Plasmodium falciparum
NKKETLN

SEQ ID NO: 3332134 - protein, 9 aa, Plasmodium falciparum
NKKETNEDK

SEQ ID NO: 3332135 - protein, 8 aa, Plasmodium falciparum
NKKETNNI

SEQ ID NO: 3332136 - protein, 11 aa, Plasmodium falciparum
NKKFKTRSGTT

SEQ ID NO: 3332137 - protein, 6 aa, Plasmodium falciparum
NKKFQK

SEQ ID NO: 3332138 - protein, 4 aa, Plasmodium falciparum
NKKG

SEQ ID NO: 3332139 - protein, 7 aa, Plasmodium falciparum
NKKGEKR

SEQ ID NO: 3332140 - protein, 8 aa, Plasmodium falciparum
NKKGGRYN

SEQ ID NO: 3332141 - protein, 16 aa, Plasmodium falciparum
NKKGIKNGNMNKSDKM

SEQ ID NO: 3332142 - protein, 7 aa, Plasmodium falciparum
NKKGKEK

SEQ ID NO: 3332143 - protein, 7 aa, Plasmodium falciparum
NKKGNDA

SEQ ID NO: 3332144 - protein, 22 aa, Plasmodium falciparum
NKKGNEKNKANKNIDDSEIESD

SEQ ID NO: 3332145 - protein, 10 aa, Plasmodium falciparum
NKKGNITQRD

SEQ ID NO: 3332146 - protein, 9 aa, Plasmodium falciparum
NKKGPFPSS

SEQ ID NO: 3332147 - protein, 9 aa, Plasmodium falciparum
NKKGSDEIK

SEQ ID NO: 3332148 - protein, 20 aa, Plasmodium falciparum
NKKGSKKNNNNNNNNNNKRK

SEQ ID NO: 3332149 - protein, 8 aa, Plasmodium falciparum
NKKGSTIH

SEQ ID NO: 3332150 - protein, 8 aa, Plasmodium falciparum
NKKGVEDV

SEQ ID NO: 3332151 - protein, 7 aa, Plasmodium falciparum
NKKGYYS

SEQ ID NO: 3332152 - protein, 4 aa, Plasmodium falciparum
NKKH

SEQ ID NO: 3332153 - protein, 8 aa, Plasmodium falciparum
NKKHSAQN

SEQ ID NO: 3332154 - protein, 4 aa, Plasmodium falciparum
NKKI

SEQ ID NO: 3332155 - protein, 5 aa, Plasmodium falciparum
NKKID

SEQ ID NO: 3332156 - protein, 14 aa, Plasmodium falciparum
NKKIKNQVEEYKNK

SEQ ID NO: 3332157 - protein, 13 aa, Plasmodium falciparum
NKKILEKTETTVN

SEQ ID NO: 3332158 - protein, 8 aa, Plasmodium falciparum
NKKINDDN

SEQ ID NO: 3332159 - protein, 20 aa, Plasmodium falciparum
NKKINNNNYSNSRSSSRDPK

SEQ ID NO: 3332160 - protein, 13 aa, Plasmodium falciparum
NKKIQKKASKTEN

SEQ ID NO: 3332161 - protein, 5 aa, Plasmodium falciparum
NKKIS

SEQ ID NO: 3332162 - protein, 6 aa, Plasmodium falciparum
NKKISS

SEQ ID NO: 3332163 - protein, 9 aa, Plasmodium falciparum
NKKKCTTTN

SEQ ID NO: 3332164 - protein, 5 aa, Plasmodium falciparum
NKKKD

SEQ ID NO: 3332165 - protein, 12 aa, Plasmodium falciparum
NKKKDPETFKKR

SEQ ID NO: 3332166 - protein, 8 aa, Plasmodium falciparum
NKKKEDDI

SEQ ID NO: 3332167 - protein, 8 aa, Plasmodium falciparum
NKKKEDDL

SEQ ID NO: 3332168 - protein, 17 aa, Plasmodium falciparum
NKKKEDKKEEICSEKRN

SEQ ID NO: 3332169 - protein, 9 aa, Plasmodium falciparum
NKKKEEEDV

SEQ ID NO: 3332170 - protein, 18 aa, Plasmodium falciparum
NKKKEESKENDTNKSEKP

SEQ ID NO: 3332171 - protein, 10 aa, Plasmodium falciparum
NKKKEGPPFF

SEQ ID NO: 3332172 - protein, 14 aa, Plasmodium falciparum
NKKKEKKDEDINEK

SEQ ID NO: 3332173 - protein, 10 aa, Plasmodium falciparum
NKKKEKREDI

SEQ ID NO: 3332174 - protein, 9 aa, Plasmodium falciparum
NKKKENHSN

SEQ ID NO: 3332175 - protein, 35 aa, Plasmodium falciparum
NKKKEQDNINKNNITNNKQESNNINEKSTDDSKKF

SEQ ID NO: 3332176 - protein, 9 aa, Plasmodium falciparum
NKKKESKIK

SEQ ID NO: 3332177 - protein, 11 aa, Plasmodium falciparum
NKKKETDKADD

SEQ ID NO: 3332178 - protein, 10 aa, Plasmodium falciparum
NKKKETPIYP

SEQ ID NO: 3332179 - protein, 10 aa, Plasmodium falciparum
NKKKGYIDET

SEQ ID NO: 3332180 - protein, 10 aa, Plasmodium falciparum
NKKKHNKSMR

SEQ ID NO: 3332181 - protein, 5 aa, Plasmodium falciparum
NKKKI

SEQ ID NO: 3332182 - protein, 8 aa, Plasmodium falciparum
NKKKIAKN

SEQ ID NO: 3332183 - protein, 18 aa, Plasmodium falciparum
NKKKIDNELDDDDNNEYR

SEQ ID NO: 3332184 - protein, 13 aa, Plasmodium falciparum
NKKKIKKKKINNE

SEQ ID NO: 3332185 - protein, 8 aa, Plasmodium falciparum
NKKKIKNI

SEQ ID NO: 3332186 - protein, 10 aa, Plasmodium falciparum
NKKKKEHTNF

SEQ ID NO: 3332187 - protein, 9 aa, Plasmodium falciparum
NKKKKEKKK

SEQ ID NO: 3332188 - protein, 9 aa, Plasmodium falciparum
NKKKKIKEE

SEQ ID NO: 3332189 - protein, 9 aa, Plasmodium falciparum
NKKKKKELE

SEQ ID NO: 3332190 - protein, 11 aa, Plasmodium falciparum
NKKKKKGHPLP

SEQ ID NO: 3332191 - protein, 21 aa, Plasmodium falciparum
NKKKKKKKKKKKNKNKNNKMN

SEQ ID NO: 3332192 - protein, 21 aa, Plasmodium falciparum
NKKKKKKKNGTQNNDSDDEHV

SEQ ID NO: 3332193 - protein, 12 aa, Plasmodium falciparum
NKKKKKKKTYME

SEQ ID NO: 3332194 - protein, 12 aa, Plasmodium falciparum
NKKKKKKNDYGN

SEQ ID NO: 3332195 - protein, 8 aa, Plasmodium falciparum
NKKKKLPY

SEQ ID NO: 3332196 - protein, 10 aa, Plasmodium falciparum
NKKKKPNKMI

SEQ ID NO: 3332197 - protein, 15 aa, Plasmodium falciparum
NKKKKRGRKRKEEKN

SEQ ID NO: 3332198 - protein, 15 aa, Plasmodium falciparum
NKKKKRRRRSSTGIF

SEQ ID NO: 3332199 - protein, 9 aa, Plasmodium falciparum
NKKKNETAH

SEQ ID NO: 3332200 - protein, 7 aa, Plasmodium falciparum
NKKKNGC

SEQ ID NO: 3332201 - protein, 6 aa, Plasmodium falciparum
NKKKNI

SEQ ID NO: 3332202 - protein, 16 aa, Plasmodium falciparum
NKKKNKKIKKIESNKY

SEQ ID NO: 3332203 - protein, 18 aa, Plasmodium falciparum
NKKKNKNDNTSKEDYDNI

SEQ ID NO: 3332204 - protein, 10 aa, Plasmodium falciparum
NKKKNSHSLV

SEQ ID NO: 3332205 - protein, 7 aa, Plasmodium falciparum
NKKKNTM

SEQ ID NO: 3332206 - protein, 38 aa, Plasmodium falciparum
NKKKNTQDKSTGAKKKQGNNKKDDNNNNNNNDADNQHA

SEQ ID NO: 3332207 - protein, 9 aa, Plasmodium falciparum
NKKKNTSYH

SEQ ID NO: 3332208 - protein, 7 aa, Plasmodium falciparum
NKKKNYK

SEQ ID NO: 3332209 - protein, 33 aa, Plasmodium falciparum
NKKKPDKQKEAKAKKKTKKDDVVSKNWKKCFKY

SEQ ID NO: 3332210 - protein, 9 aa, Plasmodium falciparum
NKKKPRLTL

SEQ ID NO: 3332211 - protein, 7 aa, Plasmodium falciparum
NKKKQHN

SEQ ID NO: 3332212 - protein, 7 aa, Plasmodium falciparum
NKKKQIS

SEQ ID NO: 3332213 - protein, 22 aa, Plasmodium falciparum
NKKKQKKKKKNKKINKNKKKYA

SEQ ID NO: 3332214 - protein, 9 aa, Plasmodium falciparum
NKKKQKKRS

SEQ ID NO: 3332215 - protein, 15 aa, Plasmodium falciparum
NKKKQNKNKNKNKNL

SEQ ID NO: 3332216 - protein, 29 aa, Plasmodium falciparum
NKKKQQIEQEHEHEQDQEINKKQENNDND

SEQ ID NO: 3332217 - protein, 5 aa, Plasmodium falciparum
NKKKR

SEQ ID NO: 3332218 - protein, 10 aa, Plasmodium falciparum
NKKKRDDDFP

SEQ ID NO: 3332219 - protein, 7 aa, Plasmodium falciparum
NKKKRDN

SEQ ID NO: 3332220 - protein, 9 aa, Plasmodium falciparum
NKKKREKKE

SEQ ID NO: 3332221 - protein, 8 aa, Plasmodium falciparum
NKKKSDLN

SEQ ID NO: 3332222 - protein, 7 aa, Plasmodium falciparum
NKKKSQS

SEQ ID NO: 3332223 - protein, 23 aa, Plasmodium falciparum
NKKKTSNNKKNICDKDPPNNKKN

SEQ ID NO: 3332224 - protein, 7 aa, Plasmodium falciparum
NKKKYEN

SEQ ID NO: 3332225 - protein, 13 aa, Plasmodium falciparum
NKKKYKSKKKEKL

SEQ ID NO: 3332226 - protein, 4 aa, Plasmodium falciparum
NKKL

SEQ ID NO: 3332227 - protein, 9 aa, Plasmodium falciparum
NKKLDNHKN

SEQ ID NO: 3332228 - protein, 9 aa, Plasmodium falciparum
NKKLHNNNN

SEQ ID NO: 3332229 - protein, 7 aa, Plasmodium falciparum
NKKLKNK

SEQ ID NO: 3332230 - protein, 10 aa, Plasmodium falciparum
NKKLNDSSQN

SEQ ID NO: 3332231 - protein, 7 aa, Plasmodium falciparum
NKKLPNI

SEQ ID NO: 3332232 - protein, 14 aa, Plasmodium falciparum
NKKMKSSSKDYKNY

SEQ ID NO: 3332233 - protein, 6 aa, Plasmodium falciparum
NKKMNT

SEQ ID NO: 3332234 - protein, 4 aa, Plasmodium falciparum
NKKN

SEQ ID NO: 3332235 - protein, 6 aa, Plasmodium falciparum
NKKNAL

SEQ ID NO: 3332236 - protein, 61 aa, Plasmodium falciparum
NKKNDDQQDDHHNDDNNNKNDDQQDDRHNDDNNNNKQNDDHPDNHHNDDNNNNKQNDDHPV

SEQ ID NO: 3332237 - protein, 16 aa, Plasmodium falciparum
NKKNDEQKGDNNTKEQ

SEQ ID NO: 3332238 - protein, 7 aa, Plasmodium falciparum
NKKNDKI

SEQ ID NO: 3332239 - protein, 8 aa, Plasmodium falciparum
NKKNDSVM

SEQ ID NO: 3332240 - protein, 7 aa, Plasmodium falciparum
NKKNEKD

SEQ ID NO: 3332241 - protein, 18 aa, Plasmodium falciparum
NKKNEKKKKNEKINEEIK

SEQ ID NO: 3332242 - protein, 6 aa, Plasmodium falciparum
NKKNEL

SEQ ID NO: 3332243 - protein, 7 aa, Plasmodium falciparum
NKKNENV

SEQ ID NO: 3332244 - protein, 21 aa, Plasmodium falciparum
NKKNERDVKNDTNKDAINNNN

SEQ ID NO: 3332245 - protein, 23 aa, Plasmodium falciparum
NKKNFGGKGTSGKIKIKNWKRWK

SEQ ID NO: 3332246 - protein, 5 aa, Plasmodium falciparum
NKKNG

SEQ ID NO: 3332247 - protein, 17 aa, Plasmodium falciparum
NKKNHEKGKYNKVNQNG

SEQ ID NO: 3332248 - protein, 7 aa, Plasmodium falciparum
NKKNIKY

SEQ ID NO: 3332249 - protein, 15 aa, Plasmodium falciparum
NKKNKDTISESNTFQ

SEQ ID NO: 3332250 - protein, 25 aa, Plasmodium falciparum
NKKNKEQKNKNKNKKNNKNKNKHNK

SEQ ID NO: 3332251 - protein, 9 aa, Plasmodium falciparum
NKKNKKEKM

SEQ ID NO: 3332252 - protein, 22 aa, Plasmodium falciparum
NKKNKRYKKNSSAYSHNKSDDI

SEQ ID NO: 3332253 - protein, 27 aa, Plasmodium falciparum
NKKNKYRKNKYKNDDSKKIKNTKSVDT

SEQ ID NO: 3332254 - protein, 12 aa, Plasmodium falciparum
NKKNMKSNMNPS

SEQ ID NO: 3332255 - protein, 7 aa, Plasmodium falciparum
NKKNNDM

SEQ ID NO: 3332256 - protein, 7 aa, Plasmodium falciparum
NKKNNDQ

SEQ ID NO: 3332257 - protein, 19 aa, Plasmodium falciparum
NKKNNEKDTIKKKKKSGTI

SEQ ID NO: 3332258 - protein, 18 aa, Plasmodium falciparum
NKKNNESVFTNGSSNINS

SEQ ID NO: 3332259 - protein, 7 aa, Plasmodium falciparum
NKKNNKD

SEQ ID NO: 3332260 - protein, 7 aa, Plasmodium falciparum
NKKNNKM

SEQ ID NO: 3332261 - protein, 6 aa, Plasmodium falciparum
NKKNNL

SEQ ID NO: 3332262 - protein, 25 aa, Plasmodium falciparum
NKKNNNDDTDNIHNNNNNNNNNNNV

SEQ ID NO: 3332263 - protein, 17 aa, Plasmodium falciparum
NKKNNNEENDESKIQTN

SEQ ID NO: 3332264 - protein, 8 aa, Plasmodium falciparum
NKKNNNEY

SEQ ID NO: 3332265 - protein, 14 aa, Plasmodium falciparum
NKKNNNKVNNFSEK

SEQ ID NO: 3332266 - protein, 6 aa, Plasmodium falciparum
NKKNNY

SEQ ID NO: 3332267 - protein, 27 aa, Plasmodium falciparum
NKKNQQGKGKNEKAKKNYNKNNKGAEF

SEQ ID NO: 3332268 - protein, 41 aa, Plasmodium falciparum
NKKNQTEQKLKDQQEDKVYNNGNHEQQNDAEHKKNDDSIIQ

SEQ ID NO: 3332269 - protein, 6 aa, Plasmodium falciparum
NKKNQV

SEQ ID NO: 3332270 - protein, 12 aa, Plasmodium falciparum
NKKNRKKRERVT

SEQ ID NO: 3332271 - protein, 9 aa, Plasmodium falciparum
NKKNSKNYH

SEQ ID NO: 3332272 - protein, 8 aa, Plasmodium falciparum
NKKNSLNE

SEQ ID NO: 3332273 - protein, 8 aa, Plasmodium falciparum
NKKNSNGI

SEQ ID NO: 3332274 - protein, 8 aa, Plasmodium falciparum
NKKNSNLS

SEQ ID NO: 3332275 - protein, 7 aa, Plasmodium falciparum
NKKNSNV

SEQ ID NO: 3332276 - protein, 8 aa, Plasmodium falciparum
NKKNSNVT

SEQ ID NO: 3332277 - protein, 22 aa, Plasmodium falciparum
NKKNTDTKARGKEKEKEKEKTM

SEQ ID NO: 3332278 - protein, 8 aa, Plasmodium falciparum
NKKNTNYP

SEQ ID NO: 3332279 - protein, 7 aa, Plasmodium falciparum
NKKNVPD

SEQ ID NO: 3332280 - protein, 26 aa, Plasmodium falciparum
NKKNVQKKDDSDKDGSISNDDNESIK

SEQ ID NO: 3332281 - protein, 9 aa, Plasmodium falciparum
NKKNYEYTV

SEQ ID NO: 3332282 - protein, 8 aa, Plasmodium falciparum
NKKNYKNE

SEQ ID NO: 3332283 - protein, 21 aa, Plasmodium falciparum
NKKNYNNNDDDDDDDYDNDHF

SEQ ID NO: 3332284 - protein, 7 aa, Plasmodium falciparum
NKKPADE

SEQ ID NO: 3332285 - protein, 19 aa, Plasmodium falciparum
NKKPKEDKAENIQNGNTNN

SEQ ID NO: 3332286 - protein, 11 aa, Plasmodium falciparum
NKKPKENESEE

SEQ ID NO: 3332287 - protein, 13 aa, Plasmodium falciparum
NKKPSYGSESTNE

SEQ ID NO: 3332288 - protein, 4 aa, Plasmodium falciparum
NKKQ

SEQ ID NO: 3332289 - protein, 9 aa, Plasmodium falciparum
NKKQEINYT

SEQ ID NO: 3332290 - protein, 13 aa, Plasmodium falciparum
NKKQGKNRKTKKK

SEQ ID NO: 3332291 - protein, 7 aa, Plasmodium falciparum
NKKQHHR

SEQ ID NO: 3332292 - protein, 13 aa, Plasmodium falciparum
NKKQKEKAAKKMT

SEQ ID NO: 3332293 - protein, 14 aa, Plasmodium falciparum
NKKQKTNTSSYPSG

SEQ ID NO: 3332294 - protein, 9 aa, Plasmodium falciparum
NKKQNDNVN

SEQ ID NO: 3332295 - protein, 6 aa, Plasmodium falciparum
NKKQTI

SEQ ID NO: 3332296 - protein, 25 aa, Plasmodium falciparum
NKKQYENSEKEKNEKNVENKKNTEY

SEQ ID NO: 3332297 - protein, 8 aa, Plasmodium falciparum
NKKRATNL

SEQ ID NO: 3332298 - protein, 9 aa, Plasmodium falciparum
NKKRDERLS

SEQ ID NO: 3332299 - protein, 24 aa, Plasmodium falciparum
NKKRDKEYISDSNKSGFSNKGSYY

SEQ ID NO: 3332300 - protein, 6 aa, Plasmodium falciparum
NKKREK

SEQ ID NO: 3332301 - protein, 10 aa, Plasmodium falciparum
NKKREYTRKY

SEQ ID NO: 3332302 - protein, 26 aa, Plasmodium falciparum
NKKRKLNENDTTTKCPEKKKVKKKKK

SEQ ID NO: 3332303 - protein, 9 aa, Plasmodium falciparum
NKKRKNTKN

SEQ ID NO: 3332304 - protein, 18 aa, Plasmodium falciparum
NKKRKQNVVQKKNTSNHE

SEQ ID NO: 3332305 - protein, 13 aa, Plasmodium falciparum
NKKRKSSSNYDIS

SEQ ID NO: 3332306 - protein, 18 aa, Plasmodium falciparum
NKKRKTTSYSMQKEEDPK

SEQ ID NO: 3332307 - protein, 6 aa, Plasmodium falciparum
NKKRKV

SEQ ID NO: 3332308 - protein, 14 aa, Plasmodium falciparum
NKKRNENKNHKDIN

SEQ ID NO: 3332309 - protein, 8 aa, Plasmodium falciparum
NKKRNNLK

SEQ ID NO: 3332310 - protein, 18 aa, Plasmodium falciparum
NKKRNRKKSLNNVDEESM

SEQ ID NO: 3332311 - protein, 9 aa, Plasmodium falciparum
NKKRNTPTL

SEQ ID NO: 3332312 - protein, 9 aa, Plasmodium falciparum
NKKRRKEKI

SEQ ID NO: 3332313 - protein, 16 aa, Plasmodium falciparum
NKKRRKRRSKNSTKYE

SEQ ID NO: 3332314 - protein, 6 aa, Plasmodium falciparum
NKKSAI

SEQ ID NO: 3332315 - protein, 23 aa, Plasmodium falciparum
NKKSDSKIISSDNELGEENEEEE

SEQ ID NO: 3332316 - protein, 10 aa, Plasmodium falciparum
NKKSDSNIAQ

SEQ ID NO: 3332317 - protein, 9 aa, Plasmodium falciparum
NKKSEIDNT

SEQ ID NO: 3332318 - protein, 12 aa, Plasmodium falciparum
NKKSEKPKTNDV

SEQ ID NO: 3332319 - protein, 33 aa, Plasmodium falciparum
NKKSGYKNNIKKKKKKSIKENNGNEQNKGNGTL

SEQ ID NO: 3332320 - protein, 6 aa, Plasmodium falciparum
NKKSKK

SEQ ID NO: 3332321 - protein, 15 aa, Plasmodium falciparum
NKKSKKKKKNEVTQL

SEQ ID NO: 3332322 - protein, 29 aa, Plasmodium falciparum
NKKSKKNKKNKKKNKIKTNNNKGTKKPIK

SEQ ID NO: 3332323 - protein, 12 aa, Plasmodium falciparum
NKKSLEKKSKSI

SEQ ID NO: 3332324 - protein, 14 aa, Plasmodium falciparum
NKKSNLDSSNLNEI

SEQ ID NO: 3332325 - protein, 11 aa, Plasmodium falciparum
NKKSQDDKAIK

SEQ ID NO: 3332326 - protein, 11 aa, Plasmodium falciparum
NKKSRDEYNHD

SEQ ID NO: 3332327 - protein, 9 aa, Plasmodium falciparum
NKKSRSKEL

SEQ ID NO: 3332328 - protein, 6 aa, Plasmodium falciparum
NKKSSI

SEQ ID NO: 3332329 - protein, 9 aa, Plasmodium falciparum
NKKSSKYLD

SEQ ID NO: 3332330 - protein, 8 aa, Plasmodium falciparum
NKKSTNVL

SEQ ID NO: 3332331 - protein, 6 aa, Plasmodium falciparum
NKKSYY

SEQ ID NO: 3332332 - protein, 20 aa, Plasmodium falciparum
NKKTDHQSNIEYEDEANNSC

SEQ ID NO: 3332333 - protein, 19 aa, Plasmodium falciparum
NKKTGEVSKDISFLHKKLY

SEQ ID NO: 3332334 - protein, 8 aa, Plasmodium falciparum
NKKTKITK

SEQ ID NO: 3332335 - protein, 9 aa, Plasmodium falciparum
NKKTKSREY

SEQ ID NO: 3332336 - protein, 12 aa, Plasmodium falciparum
NKKTNEIKKTTS

SEQ ID NO: 3332337 - protein, 11 aa, Plasmodium falciparum
NKKTNLDPQTS

SEQ ID NO: 3332338 - protein, 10 aa, Plasmodium falciparum
NKKTNVSPTN

SEQ ID NO: 3332339 - protein, 9 aa, Plasmodium falciparum
NKKTPHNSD

SEQ ID NO: 3332340 - protein, 4 aa, Plasmodium falciparum
NKKV

SEQ ID NO: 3332341 - protein, 5 aa, Plasmodium falciparum
NKKVG

SEQ ID NO: 3332342 - protein, 16 aa, Plasmodium falciparum
NKKVKTDNDDNNDKKI

SEQ ID NO: 3332343 - protein, 7 aa, Plasmodium falciparum
NKKVPSM

SEQ ID NO: 3332344 - protein, 4 aa, Plasmodium falciparum
NKKY

SEQ ID NO: 3332345 - protein, 6 aa, Plasmodium falciparum
NKKYDG

SEQ ID NO: 3332346 - protein, 7 aa, Plasmodium falciparum
NKKYKEA

SEQ ID NO: 3332347 - protein, 6 aa, Plasmodium falciparum
NKKYKM

SEQ ID NO: 3332348 - protein, 23 aa, Plasmodium falciparum
NKKYNEDQNHGTVDEEEDKSFDK

SEQ ID NO: 3332349 - protein, 21 aa, Plasmodium falciparum
NKKYNNSNNNSNNNNRNSSIP

SEQ ID NO: 3332350 - protein, 5 aa, Plasmodium falciparum
NKLCD

SEQ ID NO: 3332351 - protein, 10 aa, Plasmodium falciparum
NKLDEKKDDY

SEQ ID NO: 3332352 - protein, 5 aa, Plasmodium falciparum
NKLEA

SEQ ID NO: 3332353 - protein, 33 aa, Plasmodium falciparum
NKLGEEKNKEKKKKLKKATVEDSTATKGQHTTD

SEQ ID NO: 3332354 - protein, 9 aa, Plasmodium falciparum
NKLGNTSHY

SEQ ID NO: 3332355 - protein, 8 aa, Plasmodium falciparum
NKLKEENE

SEQ ID NO: 3332356 - protein, 39 aa, Plasmodium falciparum
NKLKGNEKNSDSNDKEKSGACDDGANIGKDNNNDVNNED

SEQ ID NO: 3332357 - protein, 22 aa, Plasmodium falciparum
NKLKKDNEKGIDENIKETSTCT

SEQ ID NO: 3332358 - protein, 45 aa, Plasmodium falciparum
NKLKKKSEINQNKENENENENNSQSDNNTTKQHIQDEQGTEQKKS

SEQ ID NO: 3332359 - protein, 5 aa, Plasmodium falciparum
NKLKN

SEQ ID NO: 3332360 - protein, 10 aa, Plasmodium falciparum
NKLKSKKDEL

SEQ ID NO: 3332361 - protein, 6 aa, Plasmodium falciparum
NKLNKK

SEQ ID NO: 3332362 - protein, 19 aa, Plasmodium falciparum
NKLNKKDGRNKNNYDDSSY

SEQ ID NO: 3332363 - protein, 5 aa, Plasmodium falciparum
NKLNN

SEQ ID NO: 3332364 - protein, 8 aa, Plasmodium falciparum
NKLNNNDD

SEQ ID NO: 3332365 - protein, 9 aa, Plasmodium falciparum
NKLNNNMKK

SEQ ID NO: 3332366 - protein, 45 aa, Plasmodium falciparum
NKLNSEKKKSLENDIEKDKIKDKEKEKEKEKDKEKENDKAKKDKK

SEQ ID NO: 3332367 - protein, 18 aa, Plasmodium falciparum
NKLNSNDARRNFMENTTN

SEQ ID NO: 3332368 - protein, 15 aa, Plasmodium falciparum
NKLNTKKNGNINNDY

SEQ ID NO: 3332369 - protein, 13 aa, Plasmodium falciparum
NKLNTNGNEENTE

SEQ ID NO: 3332370 - protein, 11 aa, Plasmodium falciparum
NKLPNSSKGTK

SEQ ID NO: 3332371 - protein, 8 aa, Plasmodium falciparum
NKLQNEHN

SEQ ID NO: 3332372 - protein, 6 aa, Plasmodium falciparum
NKLRDR

SEQ ID NO: 3332373 - protein, 16 aa, Plasmodium falciparum
NKLSENKTSTKKKTSS

SEQ ID NO: 3332374 - protein, 18 aa, Plasmodium falciparum
NKLSKNKKGGEDDNGLNN

SEQ ID NO: 3332375 - protein, 5 aa, Plasmodium falciparum
NKLSP

SEQ ID NO: 3332376 - protein, 8 aa, Plasmodium falciparum
NKLTCNDK

SEQ ID NO: 3332377 - protein, 13 aa, Plasmodium falciparum
NKLTKNKSSLENC

SEQ ID NO: 3332378 - protein, 8 aa, Plasmodium falciparum
NKLTNEED

SEQ ID NO: 3332379 - protein, 8 aa, Plasmodium falciparum
NKLTNEQN

SEQ ID NO: 3332380 - protein, 5 aa, Plasmodium falciparum
NKLTS

SEQ ID NO: 3332381 - protein, 7 aa, Plasmodium falciparum
NKLYSDD

SEQ ID NO: 3332382 - protein, 16 aa, Plasmodium falciparum
NKLYSDDNKLYSDDNI

SEQ ID NO: 3332383 - protein, 12 aa, Plasmodium falciparum
NKMADGKSKDNM

SEQ ID NO: 3332384 - protein, 4 aa, Plasmodium falciparum
NKMD

SEQ ID NO: 3332385 - protein, 40 aa, Plasmodium falciparum
NKMDNDKKNKSDEISENITSSGDKQNSVPDQSENQSKSHS

SEQ ID NO: 3332386 - protein, 8 aa, Plasmodium falciparum
NKMDNNDK

SEQ ID NO: 3332387 - protein, 4 aa, Plasmodium falciparum
NKME

SEQ ID NO: 3332388 - protein, 17 aa, Plasmodium falciparum
NKMEPKKNNQLDDTDMK

SEQ ID NO: 3332389 - protein, 8 aa, Plasmodium falciparum
NKMGNNNS

SEQ ID NO: 3332390 - protein, 16 aa, Plasmodium falciparum
NKMGTDTSSFDTETHT

SEQ ID NO: 3332391 - protein, 4 aa, Plasmodium falciparum
NKMK

SEQ ID NO: 3332392 - protein, 313 aa, Plasmodium falciparum
NKMKKKKNGKDRKNSFAEETKKTIQKKSNVKEKKRKKELKKNKKVTSDENVRNAEDEEEEEDEDEEEEEEDEEEEEEEEDEEEEDEEDEEEEDEEDEEEEDEEDEDEEDEEDEDEEDEEDEDEEDEEENDDNGNDDGEENDDNEKDDDDEEKDDEEENDDDEENDDDENDDDVENDDNENDDDEENNDNENDDDVENDDDVENDDDEENDDDEENDDDEENDDDEENDDDVENDDDEENDDDEENDDDEENDDDEENDDDEENDDNEENDDNEENDDNEENDDNENDDDEENDDNDDVNEINSEKNKKSARKS

SEQ ID NO: 3332393 - protein, 5 aa, Plasmodium falciparum
NKMKN

SEQ ID NO: 3332394 - protein, 64 aa, Plasmodium falciparum
NKMKNKENKTNKTNKTNEANKANETNETNETIENSASSPTEGKKKKNSLNESEEANEKKEDINY

SEQ ID NO: 3332395 - protein, 6 aa, Plasmodium falciparum
NKMKNN

SEQ ID NO: 3332396 - protein, 10 aa, Plasmodium falciparum
NKMKTNKTYI

SEQ ID NO: 3332397 - protein, 9 aa, Plasmodium falciparum
NKMNEDDKN

SEQ ID NO: 3332398 - protein, 12 aa, Plasmodium falciparum
NKMNEENENTPV

SEQ ID NO: 3332399 - protein, 22 aa, Plasmodium falciparum
NKMNNDTNNSYYNNNNYNNNNN

SEQ ID NO: 3332400 - protein, 6 aa, Plasmodium falciparum
NKMNNM

SEQ ID NO: 3332401 - protein, 8 aa, Plasmodium falciparum
NKMPPPKK

SEQ ID NO: 3332402 - protein, 11 aa, Plasmodium falciparum
NKMSKKEREKL

SEQ ID NO: 3332403 - protein, 12 aa, Plasmodium falciparum
NKMTDDKSKDNM

SEQ ID NO: 3332404 - protein, 4 aa, Plasmodium falciparum
NKMY

SEQ ID NO: 3332405 - protein, 13 aa, Plasmodium falciparum
NKMYSSSYSTTKK

SEQ ID NO: 3332406 - protein, 7 aa, Plasmodium falciparum
NKNAAEV

SEQ ID NO: 3332407 - protein, 7 aa, Plasmodium falciparum
NKNAEKN

SEQ ID NO: 3332408 - protein, 5 aa, Plasmodium falciparum
NKNAI

SEQ ID NO: 3332409 - protein, 10 aa, Plasmodium falciparum
NKNASHNNKV

SEQ ID NO: 3332410 - protein, 9 aa, Plasmodium falciparum
NKNASIAKK

SEQ ID NO: 3332411 - protein, 12 aa, Plasmodium falciparum
NKNASQNNKESD

SEQ ID NO: 3332412 - protein, 10 aa, Plasmodium falciparum
NKNAYNNNNK

SEQ ID NO: 3332413 - protein, 14 aa, Plasmodium falciparum
NKNCNFSKEEDKYK

SEQ ID NO: 3332414 - protein, 5 aa, Plasmodium falciparum
NKNCS

SEQ ID NO: 3332415 - protein, 4 aa, Plasmodium falciparum
NKND

SEQ ID NO: 3332416 - protein, 7 aa, Plasmodium falciparum
NKNDARE

SEQ ID NO: 3332417 - protein, 8 aa, Plasmodium falciparum
NKNDDGMN

SEQ ID NO: 3332418 - protein, 16 aa, Plasmodium falciparum
NKNDDKDNILDNENRE

SEQ ID NO: 3332419 - protein, 7 aa, Plasmodium falciparum
NKNDDLQ

SEQ ID NO: 3332420 - protein, 7 aa, Plasmodium falciparum
NKNDDMI

SEQ ID NO: 3332421 - protein, 24 aa, Plasmodium falciparum
NKNDDNKNDDNKNDDDDNNNNYKN

SEQ ID NO: 3332422 - protein, 12 aa, Plasmodium falciparum
NKNDDQKNNNKM

SEQ ID NO: 3332423 - protein, 11 aa, Plasmodium falciparum
NKNDDTGHNYN

SEQ ID NO: 3332424 - protein, 7 aa, Plasmodium falciparum
NKNDDTN

SEQ ID NO: 3332425 - protein, 6 aa, Plasmodium falciparum
NKNDEI

SEQ ID NO: 3332426 - protein, 15 aa, Plasmodium falciparum
NKNDFNKNAQDESFQ

SEQ ID NO: 3332427 - protein, 7 aa, Plasmodium falciparum
NKNDGMK

SEQ ID NO: 3332428 - protein, 11 aa, Plasmodium falciparum
NKNDGSRNTSY

SEQ ID NO: 3332429 - protein, 10 aa, Plasmodium falciparum
NKNDHNKQVN

SEQ ID NO: 3332430 - protein, 7 aa, Plasmodium falciparum
NKNDHSF

SEQ ID NO: 3332431 - protein, 7 aa, Plasmodium falciparum
NKNDHSV

SEQ ID NO: 3332432 - protein, 7 aa, Plasmodium falciparum
NKNDINM

SEQ ID NO: 3332433 - protein, 7 aa, Plasmodium falciparum
NKNDISN

SEQ ID NO: 3332434 - protein, 5 aa, Plasmodium falciparum
NKNDK

SEQ ID NO: 3332435 - protein, 11 aa, Plasmodium falciparum
NKNDKDDKDLY

SEQ ID NO: 3332436 - protein, 9 aa, Plasmodium falciparum
NKNDKEIRR

SEQ ID NO: 3332437 - protein, 12 aa, Plasmodium falciparum
NKNDKSKNNNNN

SEQ ID NO: 3332438 - protein, 8 aa, Plasmodium falciparum
NKNDLEEH

SEQ ID NO: 3332439 - protein, 9 aa, Plasmodium falciparum
NKNDMNSSS

SEQ ID NO: 3332440 - protein, 7 aa, Plasmodium falciparum
NKNDNDI

SEQ ID NO: 3332441 - protein, 8 aa, Plasmodium falciparum
NKNDNHYN

SEQ ID NO: 3332442 - protein, 7 aa, Plasmodium falciparum
NKNDNKK

SEQ ID NO: 3332443 - protein, 6 aa, Plasmodium falciparum
NKNDPN

SEQ ID NO: 3332444 - protein, 9 aa, Plasmodium falciparum
NKNDPYKNI

SEQ ID NO: 3332445 - protein, 16 aa, Plasmodium falciparum
NKNDSKENMNEDSKKK

SEQ ID NO: 3332446 - protein, 7 aa, Plasmodium falciparum
NKNDSVE

SEQ ID NO: 3332447 - protein, 25 aa, Plasmodium falciparum
NKNDTQDNSHHHNNSNKCNEDQQDV

SEQ ID NO: 3332448 - protein, 8 aa, Plasmodium falciparum
NKNDVNES

SEQ ID NO: 3332449 - protein, 30 aa, Plasmodium falciparum
NKNEANKKNNNKISNNKKKIESERLRTPDG

SEQ ID NO: 3332450 - protein, 6 aa, Plasmodium falciparum
NKNEDA

SEQ ID NO: 3332451 - protein, 13 aa, Plasmodium falciparum
NKNEDENNIPYNS

SEQ ID NO: 3332452 - protein, 9 aa, Plasmodium falciparum
NKNEDKDKK

SEQ ID NO: 3332453 - protein, 23 aa, Plasmodium falciparum
NKNEDQEINEQNKSVLNTNKDAH

SEQ ID NO: 3332454 - protein, 5 aa, Plasmodium falciparum
NKNEE

SEQ ID NO: 3332455 - protein, 8 aa, Plasmodium falciparum
NKNEEEKR

SEQ ID NO: 3332456 - protein, 16 aa, Plasmodium falciparum
NKNEEENVKHKKENPT

SEQ ID NO: 3332457 - protein, 7 aa, Plasmodium falciparum
NKNEEKV

SEQ ID NO: 3332458 - protein, 8 aa, Plasmodium falciparum
NKNEEQEN

SEQ ID NO: 3332459 - protein, 7 aa, Plasmodium falciparum
NKNEERE

SEQ ID NO: 3332460 - protein, 10 aa, Plasmodium falciparum
NKNEESMNER

SEQ ID NO: 3332461 - protein, 9 aa, Plasmodium falciparum
NKNEETNKY

SEQ ID NO: 3332462 - protein, 20 aa, Plasmodium falciparum
NKNEGYYNKGNKTKKENLVS

SEQ ID NO: 3332463 - protein, 8 aa, Plasmodium falciparum
NKNEHDID

SEQ ID NO: 3332464 - protein, 14 aa, Plasmodium falciparum
NKNEHETSLNRNNS

SEQ ID NO: 3332465 - protein, 11 aa, Plasmodium falciparum
NKNEHTNNANN

SEQ ID NO: 3332466 - protein, 11 aa, Plasmodium falciparum
NKNEISENNNV

SEQ ID NO: 3332467 - protein, 7 aa, Plasmodium falciparum
NKNEIYN

SEQ ID NO: 3332468 - protein, 25 aa, Plasmodium falciparum
NKNEKDSHFKNNDNNITHNNNNNDN

SEQ ID NO: 3332469 - protein, 14 aa, Plasmodium falciparum
NKNEKNKMKRNTIT

SEQ ID NO: 3332470 - protein, 7 aa, Plasmodium falciparum
NKNELEK

SEQ ID NO: 3332471 - protein, 9 aa, Plasmodium falciparum
NKNENEDIN

SEQ ID NO: 3332472 - protein, 10 aa, Plasmodium falciparum
NKNENIEEKS

SEQ ID NO: 3332473 - protein, 7 aa, Plasmodium falciparum
NKNENIN

SEQ ID NO: 3332474 - protein, 19 aa, Plasmodium falciparum
NKNENKKIQEKGQNGENCE

SEQ ID NO: 3332475 - protein, 8 aa, Plasmodium falciparum
NKNENKNI

SEQ ID NO: 3332476 - protein, 6 aa, Plasmodium falciparum
NKNENN

SEQ ID NO: 3332477 - protein, 5 aa, Plasmodium falciparum
NKNEQ

SEQ ID NO: 3332478 - protein, 12 aa, Plasmodium falciparum
NKNESKKKNKPK

SEQ ID NO: 3332479 - protein, 24 aa, Plasmodium falciparum
NKNESNIYENTDNTLSGISNEGEE

SEQ ID NO: 3332480 - protein, 6 aa, Plasmodium falciparum
NKNESW

SEQ ID NO: 3332481 - protein, 11 aa, Plasmodium falciparum
NKNETTQQDEE

SEQ ID NO: 3332482 - protein, 6 aa, Plasmodium falciparum
NKNEYC

SEQ ID NO: 3332483 - protein, 8 aa, Plasmodium falciparum
NKNEYKRI

SEQ ID NO: 3332484 - protein, 18 aa, Plasmodium falciparum
NKNEYNQNNIEDEKMNEQ

SEQ ID NO: 3332485 - protein, 8 aa, Plasmodium falciparum
NKNEYSKN

SEQ ID NO: 3332486 - protein, 6 aa, Plasmodium falciparum
NKNFEK

SEQ ID NO: 3332487 - protein, 8 aa, Plasmodium falciparum
NKNFNNNK

SEQ ID NO: 3332488 - protein, 9 aa, Plasmodium falciparum
NKNFSSQNK

SEQ ID NO: 3332489 - protein, 4 aa, Plasmodium falciparum
NKNG

SEQ ID NO: 3332490 - protein, 11 aa, Plasmodium falciparum
NKNGAYSIPRD

SEQ ID NO: 3332491 - protein, 6 aa, Plasmodium falciparum
NKNGIR

SEQ ID NO: 3332492 - protein, 6 aa, Plasmodium falciparum
NKNGKD

SEQ ID NO: 3332493 - protein, 16 aa, Plasmodium falciparum
NKNGKEKDDNNNNKKK

SEQ ID NO: 3332494 - protein, 41 aa, Plasmodium falciparum
NKNGKSIQNGNDKKSNNNGNESNNNNNNNNFNNNNSGPQKL

SEQ ID NO: 3332495 - protein, 27 aa, Plasmodium falciparum
NKNGLNETLTQQRNNNNNNNNNNDDDV

SEQ ID NO: 3332496 - protein, 6 aa, Plasmodium falciparum
NKNGNN

SEQ ID NO: 3332497 - protein, 8 aa, Plasmodium falciparum
NKNGNNNI

SEQ ID NO: 3332498 - protein, 104 aa, Plasmodium falciparum
NKNGSSRRKRNNEIKNKKHEEGKDKEDKNLNDKDMEKTNVEENDIEEENITEENITEENVTEENITEENVTEENITEENITEENVTEENEDKNSDDKNVEERNC

SEQ ID NO: 3332499 - protein, 7 aa, Plasmodium falciparum
NKNGTNI

SEQ ID NO: 3332500 - protein, 8 aa, Plasmodium falciparum
NKNGVRGK

SEQ ID NO: 3332501 - protein, 9 aa, Plasmodium falciparum
NKNHHKSGK

SEQ ID NO: 3332502 - protein, 16 aa, Plasmodium falciparum
NKNHNLKNNNSSTIQN

SEQ ID NO: 3332503 - protein, 11 aa, Plasmodium falciparum
NKNHQNDYHKN

SEQ ID NO: 3332504 - protein, 5 aa, Plasmodium falciparum
NKNID

SEQ ID NO: 3332505 - protein, 8 aa, Plasmodium falciparum
NKNIKEEE

SEQ ID NO: 3332506 - protein, 41 aa, Plasmodium falciparum
NKNINDNKKNNKKKNNNNNNNNNSYNNNYNNSYNYSHRGKR

SEQ ID NO: 3332507 - protein, 8 aa, Plasmodium falciparum
NKNINDSN

SEQ ID NO: 3332508 - protein, 7 aa, Plasmodium falciparum
NKNINEN

SEQ ID NO: 3332509 - protein, 8 aa, Plasmodium falciparum
NKNINISN

SEQ ID NO: 3332510 - protein, 8 aa, Plasmodium falciparum
NKNINKKN

SEQ ID NO: 3332511 - protein, 68 aa, Plasmodium falciparum
NKNINNEEDEKNIDKKKSMNKKKRKKKKKRVNNYNNNNNINNNNNNNSNNKKKSNLVKDKKNSSTSTC

SEQ ID NO: 3332512 - protein, 95 aa, Plasmodium falciparum
NKNINNKNINDENINNKNINDENINDENINDENINDENINDENINDENINDENINDENINDENINDENINDENINDENINDENINDENIKNKSAN

SEQ ID NO: 3332513 - protein, 11 aa, Plasmodium falciparum
NKNINYKGENN

SEQ ID NO: 3332514 - protein, 7 aa, Plasmodium falciparum
NKNIQQK

SEQ ID NO: 3332515 - protein, 13 aa, Plasmodium falciparum
NKNISENKKTSNI

SEQ ID NO: 3332516 - protein, 25 aa, Plasmodium falciparum
NKNISTSTLDRKKKKKKDEEKNKVH

SEQ ID NO: 3332517 - protein, 7 aa, Plasmodium falciparum
NKNITDI

SEQ ID NO: 3332518 - protein, 9 aa, Plasmodium falciparum
NKNITSSNF

SEQ ID NO: 3332519 - protein, 8 aa, Plasmodium falciparum
NKNKDNPN

SEQ ID NO: 3332520 - protein, 7 aa, Plasmodium falciparum
NKNKDNY

SEQ ID NO: 3332521 - protein, 7 aa, Plasmodium falciparum
NKNKEDH

SEQ ID NO: 3332522 - protein, 9 aa, Plasmodium falciparum
NKNKENNKR

SEQ ID NO: 3332523 - protein, 10 aa, Plasmodium falciparum
NKNKENTTLN

SEQ ID NO: 3332524 - protein, 13 aa, Plasmodium falciparum
NKNKESQEQKGGR

SEQ ID NO: 3332525 - protein, 5 aa, Plasmodium falciparum
NKNKF

SEQ ID NO: 3332526 - protein, 26 aa, Plasmodium falciparum
NKNKGKDNQTNEIKKDIKDKEKNTEM

SEQ ID NO: 3332527 - protein, 11 aa, Plasmodium falciparum
NKNKGRNKYND

SEQ ID NO: 3332528 - protein, 8 aa, Plasmodium falciparum
NKNKGTKF

SEQ ID NO: 3332529 - protein, 7 aa, Plasmodium falciparum
NKNKHNI

SEQ ID NO: 3332530 - protein, 11 aa, Plasmodium falciparum
NKNKKHKNSKI

SEQ ID NO: 3332531 - protein, 11 aa, Plasmodium falciparum
NKNKKIDSDNE

SEQ ID NO: 3332532 - protein, 7 aa, Plasmodium falciparum
NKNKKKI

SEQ ID NO: 3332533 - protein, 28 aa, Plasmodium falciparum
NKNKKNNKKKNNNNKNDQLGNHNNFSSS

SEQ ID NO: 3332534 - protein, 6 aa, Plasmodium falciparum
NKNKNI

SEQ ID NO: 3332535 - protein, 21 aa, Plasmodium falciparum
NKNKNKIKNKNKNKNKNKKTQ

SEQ ID NO: 3332536 - protein, 12 aa, Plasmodium falciparum
NKNKNKKNKNIK

SEQ ID NO: 3332537 - protein, 8 aa, Plasmodium falciparum
NKNKNNKL

SEQ ID NO: 3332538 - protein, 20 aa, Plasmodium falciparum
NKNKNNSNISKDIKNEDISN

SEQ ID NO: 3332539 - protein, 25 aa, Plasmodium falciparum
NKNKNSNTTFPNSEENKTNKNHSNN

SEQ ID NO: 3332540 - protein, 12 aa, Plasmodium falciparum
NKNKNTDANYSH

SEQ ID NO: 3332541 - protein, 6 aa, Plasmodium falciparum
NKNKNV

SEQ ID NO: 3332542 - protein, 10 aa, Plasmodium falciparum
NKNKPNDESI

SEQ ID NO: 3332543 - protein, 11 aa, Plasmodium falciparum
NKNKPQKEKTI

SEQ ID NO: 3332544 - protein, 9 aa, Plasmodium falciparum
NKNKQNKIK

SEQ ID NO: 3332545 - protein, 8 aa, Plasmodium falciparum
NKNKQRKA

SEQ ID NO: 3332546 - protein, 5 aa, Plasmodium falciparum
NKNKS

SEQ ID NO: 3332547 - protein, 13 aa, Plasmodium falciparum
NKNKSNNNNNNNI

SEQ ID NO: 3332548 - protein, 7 aa, Plasmodium falciparum
NKNKSSY

SEQ ID NO: 3332549 - protein, 11 aa, Plasmodium falciparum
NKNKSTTTNEF

SEQ ID NO: 3332550 - protein, 10 aa, Plasmodium falciparum
NKNKTARRKT

SEQ ID NO: 3332551 - protein, 9 aa, Plasmodium falciparum
NKNKTKEEK

SEQ ID NO: 3332552 - protein, 5 aa, Plasmodium falciparum
NKNKW

SEQ ID NO: 3332553 - protein, 5 aa, Plasmodium falciparum
NKNKY

SEQ ID NO: 3332554 - protein, 12 aa, Plasmodium falciparum
NKNKYDNSSSNN

SEQ ID NO: 3332555 - protein, 10 aa, Plasmodium falciparum
NKNKYDTSKI

SEQ ID NO: 3332556 - protein, 6 aa, Plasmodium falciparum
NKNKYT

SEQ ID NO: 3332557 - protein, 32 aa, Plasmodium falciparum
NKNLDNEHQEGKQEYNNKNNDNDNNNNNNNNN

SEQ ID NO: 3332558 - protein, 5 aa, Plasmodium falciparum
NKNLE

SEQ ID NO: 3332559 - protein, 7 aa, Plasmodium falciparum
NKNLEDN

SEQ ID NO: 3332560 - protein, 9 aa, Plasmodium falciparum
NKNLKNGPS

SEQ ID NO: 3332561 - protein, 8 aa, Plasmodium falciparum
NKNLQSKV

SEQ ID NO: 3332562 - protein, 9 aa, Plasmodium falciparum
NKNLQTNNK

SEQ ID NO: 3332563 - protein, 5 aa, Plasmodium falciparum
NKNLR

SEQ ID NO: 3332564 - protein, 4 aa, Plasmodium falciparum
NKNM

SEQ ID NO: 3332565 - protein, 9 aa, Plasmodium falciparum
NKNMDEDGN

SEQ ID NO: 3332566 - protein, 10 aa, Plasmodium falciparum
NKNMDSPTIR

SEQ ID NO: 3332567 - protein, 5 aa, Plasmodium falciparum
NKNME

SEQ ID NO: 3332568 - protein, 16 aa, Plasmodium falciparum
NKNMNNNNNNNNSNNN

SEQ ID NO: 3332569 - protein, 10 aa, Plasmodium falciparum
NKNMNNSYNT

SEQ ID NO: 3332570 - protein, 8 aa, Plasmodium falciparum
NKNMSKTQ

SEQ ID NO: 3332571 - protein, 8 aa, Plasmodium falciparum
NKNMTENN

SEQ ID NO: 3332572 - protein, 8 aa, Plasmodium falciparum
NKNMTNPS

SEQ ID NO: 3332573 - protein, 4 aa, Plasmodium falciparum
NKNN

SEQ ID NO: 3332574 - protein, 7 aa, Plasmodium falciparum
NKNNAFK

SEQ ID NO: 3332575 - protein, 8 aa, Plasmodium falciparum
NKNNAKTL

SEQ ID NO: 3332576 - protein, 12 aa, Plasmodium falciparum
NKNNDDDKSFYD

SEQ ID NO: 3332577 - protein, 9 aa, Plasmodium falciparum
NKNNDIAQE

SEQ ID NO: 3332578 - protein, 7 aa, Plasmodium falciparum
NKNNDIS

SEQ ID NO: 3332579 - protein, 8 aa, Plasmodium falciparum
NKNNDKKT

SEQ ID NO: 3332580 - protein, 7 aa, Plasmodium falciparum
NKNNDKN

SEQ ID NO: 3332581 - protein, 11 aa, Plasmodium falciparum
NKNNDKNKENT

SEQ ID NO: 3332582 - protein, 6 aa, Plasmodium falciparum
NKNNDL

SEQ ID NO: 3332583 - protein, 49 aa, Plasmodium falciparum
NKNNDNNNDDNNYDDNKNDDDNNNDDNNNNDDNNNNDDNNNNDDNNNGY

SEQ ID NO: 3332584 - protein, 13 aa, Plasmodium falciparum
NKNNDSNNNDDYD

SEQ ID NO: 3332585 - protein, 9 aa, Plasmodium falciparum
NKNNDTTYI

SEQ ID NO: 3332586 - protein, 8 aa, Plasmodium falciparum
NKNNEDIS

SEQ ID NO: 3332587 - protein, 12 aa, Plasmodium falciparum
NKNNEHNNENLK

SEQ ID NO: 3332588 - protein, 7 aa, Plasmodium falciparum
NKNNEKN

SEQ ID NO: 3332589 - protein, 9 aa, Plasmodium falciparum
NKNNEKNNS

SEQ ID NO: 3332590 - protein, 36 aa, Plasmodium falciparum
NKNNEPIDKEEYNSKSKLNLKNKESFSKPSKMDFSC

SEQ ID NO: 3332591 - protein, 8 aa, Plasmodium falciparum
NKNNESKI

SEQ ID NO: 3332592 - protein, 29 aa, Plasmodium falciparum
NKNNETRKTKQMRKGDKKKRIKKESISGK

SEQ ID NO: 3332593 - protein, 9 aa, Plasmodium falciparum
NKNNHPKDN

SEQ ID NO: 3332594 - protein, 8 aa, Plasmodium falciparum
NKNNIGTY

SEQ ID NO: 3332595 - protein, 11 aa, Plasmodium falciparum
NKNNKETSKGN

SEQ ID NO: 3332596 - protein, 17 aa, Plasmodium falciparum
NKNNKGDQSGDDTNNDI

SEQ ID NO: 3332597 - protein, 7 aa, Plasmodium falciparum
NKNNKIH

SEQ ID NO: 3332598 - protein, 27 aa, Plasmodium falciparum
NKNNKKNNNNNKKNNNNNNNNNNENNV

SEQ ID NO: 3332599 - protein, 6 aa, Plasmodium falciparum
NKNNKR

SEQ ID NO: 3332600 - protein, 10 aa, Plasmodium falciparum
NKNNKSDENA

SEQ ID NO: 3332601 - protein, 11 aa, Plasmodium falciparum
NKNNKSISDAV

SEQ ID NO: 3332602 - protein, 11 aa, Plasmodium falciparum
NKNNKSNITTR

SEQ ID NO: 3332603 - protein, 35 aa, Plasmodium falciparum
NKNNLKNNNNYNDNRNNNNNNKNNINNNNNNNCCS

SEQ ID NO: 3332604 - protein, 6 aa, Plasmodium falciparum
NKNNLN

SEQ ID NO: 3332605 - protein, 7 aa, Plasmodium falciparum
NKNNLND

SEQ ID NO: 3332606 - protein, 8 aa, Plasmodium falciparum
NKNNMEDD

SEQ ID NO: 3332607 - protein, 17 aa, Plasmodium falciparum
NKNNMNGMENNEKNNIL

SEQ ID NO: 3332608 - protein, 8 aa, Plasmodium falciparum
NKNNMNKD

SEQ ID NO: 3332609 - protein, 5 aa, Plasmodium falciparum
NKNNN

SEQ ID NO: 3332610 - protein, 10 aa, Plasmodium falciparum
NKNNNHDDQD

SEQ ID NO: 3332611 - protein, 7 aa, Plasmodium falciparum
NKNNNIN

SEQ ID NO: 3332612 - protein, 8 aa, Plasmodium falciparum
NKNNNIND

SEQ ID NO: 3332613 - protein, 17 aa, Plasmodium falciparum
NKNNNKTTKKKKNTKTL

SEQ ID NO: 3332614 - protein, 46 aa, Plasmodium falciparum
NKNNNMNKNNNMNKNNNMNKNNNMNNNNNSISNNISNNNISNNNHS

SEQ ID NO: 3332615 - protein, 19 aa, Plasmodium falciparum
NKNNNNNINQTNTKSTDTN

SEQ ID NO: 3332616 - protein, 13 aa, Plasmodium falciparum
NKNNNNNNNDNCN

SEQ ID NO: 3332617 - protein, 13 aa, Plasmodium falciparum
NKNNNNNNNINNN

SEQ ID NO: 3332618 - protein, 22 aa, Plasmodium falciparum
NKNNNNNNNNNNNNKCESAVNS

SEQ ID NO: 3332619 - protein, 17 aa, Plasmodium falciparum
NKNNNNNNNNNNNNNNN

SEQ ID NO: 3332620 - protein, 27 aa, Plasmodium falciparum
NKNNNNNNNNNNNNNNNDDDDVDNNTC

SEQ ID NO: 3332621 - protein, 40 aa, Plasmodium falciparum
NKNNNNNNNNNNNNNSNNSSNNNYYNNSDVPNEPQNNEKI

SEQ ID NO: 3332622 - protein, 9 aa, Plasmodium falciparum
NKNNNNNNV

SEQ ID NO: 3332623 - protein, 16 aa, Plasmodium falciparum
NKNNNNNSDNNYNTDD

SEQ ID NO: 3332624 - protein, 9 aa, Plasmodium falciparum
NKNNNTFDQ

SEQ ID NO: 3332625 - protein, 8 aa, Plasmodium falciparum
NKNNPDNL

SEQ ID NO: 3332626 - protein, 9 aa, Plasmodium falciparum
NKNNPHNND

SEQ ID NO: 3332627 - protein, 12 aa, Plasmodium falciparum
NKNNQHDDYDKN

SEQ ID NO: 3332628 - protein, 13 aa, Plasmodium falciparum
NKNNQNNQNYQHN

SEQ ID NO: 3332629 - protein, 13 aa, Plasmodium falciparum
NKNNRKNKKSEHP

SEQ ID NO: 3332630 - protein, 7 aa, Plasmodium falciparum
NKNNSNL

SEQ ID NO: 3332631 - protein, 11 aa, Plasmodium falciparum
NKNNSSSYKED

SEQ ID NO: 3332632 - protein, 10 aa, Plasmodium falciparum
NKNNSTDAKN

SEQ ID NO: 3332633 - protein, 6 aa, Plasmodium falciparum
NKNNSV

SEQ ID NO: 3332634 - protein, 22 aa, Plasmodium falciparum
NKNNSVTNKNNNISDKNQHNNN

SEQ ID NO: 3332635 - protein, 7 aa, Plasmodium falciparum
NKNNSYD

SEQ ID NO: 3332636 - protein, 8 aa, Plasmodium falciparum
NKNNTIHN

SEQ ID NO: 3332637 - protein, 9 aa, Plasmodium falciparum
NKNNTNNMN

SEQ ID NO: 3332638 - protein, 12 aa, Plasmodium falciparum
NKNNTNNNEKKK

SEQ ID NO: 3332639 - protein, 6 aa, Plasmodium falciparum
NKNNTV

SEQ ID NO: 3332640 - protein, 7 aa, Plasmodium falciparum
NKNNVDA

SEQ ID NO: 3332641 - protein, 10 aa, Plasmodium falciparum
NKNNYSGSKN

SEQ ID NO: 3332642 - protein, 5 aa, Plasmodium falciparum
NKNPK

SEQ ID NO: 3332643 - protein, 8 aa, Plasmodium falciparum
NKNPKKHY

SEQ ID NO: 3332644 - protein, 8 aa, Plasmodium falciparum
NKNPNSVV

SEQ ID NO: 3332645 - protein, 18 aa, Plasmodium falciparum
NKNPNTSTPRKRNNNNNE

SEQ ID NO: 3332646 - protein, 16 aa, Plasmodium falciparum
NKNPQNENVKKKYPQK

SEQ ID NO: 3332647 - protein, 5 aa, Plasmodium falciparum
NKNPY

SEQ ID NO: 3332648 - protein, 5 aa, Plasmodium falciparum
NKNQK

SEQ ID NO: 3332649 - protein, 7 aa, Plasmodium falciparum
NKNQKHI

SEQ ID NO: 3332650 - protein, 13 aa, Plasmodium falciparum
NKNQKREDYHNNN

SEQ ID NO: 3332651 - protein, 11 aa, Plasmodium falciparum
NKNQNHHNDNH

SEQ ID NO: 3332652 - protein, 9 aa, Plasmodium falciparum
NKNQSTSTF

SEQ ID NO: 3332653 - protein, 14 aa, Plasmodium falciparum
NKNREEKIKEQEKR

SEQ ID NO: 3332654 - protein, 11 aa, Plasmodium falciparum
NKNRKNALKGK

SEQ ID NO: 3332655 - protein, 6 aa, Plasmodium falciparum
NKNRME

SEQ ID NO: 3332656 - protein, 7 aa, Plasmodium falciparum
NKNRPSV

SEQ ID NO: 3332657 - protein, 8 aa, Plasmodium falciparum
NKNSCDNK

SEQ ID NO: 3332658 - protein, 8 aa, Plasmodium falciparum
NKNSCDTA

SEQ ID NO: 3332659 - protein, 20 aa, Plasmodium falciparum
NKNSDDHNDDHNDDDKDKME

SEQ ID NO: 3332660 - protein, 10 aa, Plasmodium falciparum
NKNSFTGFGD

SEQ ID NO: 3332661 - protein, 8 aa, Plasmodium falciparum
NKNSGYSI

SEQ ID NO: 3332662 - protein, 5 aa, Plasmodium falciparum
NKNSI

SEQ ID NO: 3332663 - protein, 5 aa, Plasmodium falciparum
NKNSK

SEQ ID NO: 3332664 - protein, 15 aa, Plasmodium falciparum
NKNSKKDNGEENKGK

SEQ ID NO: 3332665 - protein, 15 aa, Plasmodium falciparum
NKNSLSGDKKGMSQS

SEQ ID NO: 3332666 - protein, 14 aa, Plasmodium falciparum
NKNSNNKIKTISDE

SEQ ID NO: 3332667 - protein, 20 aa, Plasmodium falciparum
NKNSNNNNNNNKICSSNNNV

SEQ ID NO: 3332668 - protein, 9 aa, Plasmodium falciparum
NKNSNTYND

SEQ ID NO: 3332669 - protein, 21 aa, Plasmodium falciparum
NKNSQGHSDGKNNNNNNGNNI

SEQ ID NO: 3332670 - protein, 29 aa, Plasmodium falciparum
NKNSQKEDNIVNNNNDNNDDDEEEEEEEE

SEQ ID NO: 3332671 - protein, 7 aa, Plasmodium falciparum
NKNSQQK

SEQ ID NO: 3332672 - protein, 5 aa, Plasmodium falciparum
NKNSS

SEQ ID NO: 3332673 - protein, 15 aa, Plasmodium falciparum
NKNSSSNKKKQMKKM

SEQ ID NO: 3332674 - protein, 7 aa, Plasmodium falciparum
NKNSSST

SEQ ID NO: 3332675 - protein, 17 aa, Plasmodium falciparum
NKNSTNTNEKEKECHND

SEQ ID NO: 3332676 - protein, 31 aa, Plasmodium falciparum
NKNSVNESSKKKKKKKHAGNKSNSISPRSNV

SEQ ID NO: 3332677 - protein, 20 aa, Plasmodium falciparum
NKNSYNNKLREEKRKKKKKK

SEQ ID NO: 3332678 - protein, 20 aa, Plasmodium falciparum
NKNTDDDLNNNNNDKSSTDH

SEQ ID NO: 3332679 - protein, 5 aa, Plasmodium falciparum
NKNTE

SEQ ID NO: 3332680 - protein, 9 aa, Plasmodium falciparum
NKNTEEEEK

SEQ ID NO: 3332681 - protein, 9 aa, Plasmodium falciparum
NKNTGRQLN

SEQ ID NO: 3332682 - protein, 9 aa, Plasmodium falciparum
NKNTKEDIQ

SEQ ID NO: 3332683 - protein, 13 aa, Plasmodium falciparum
NKNTKNKNKNNNY

SEQ ID NO: 3332684 - protein, 7 aa, Plasmodium falciparum
NKNTLNN

SEQ ID NO: 3332685 - protein, 7 aa, Plasmodium falciparum
NKNTLPG

SEQ ID NO: 3332686 - protein, 10 aa, Plasmodium falciparum
NKNTNKKKNM

SEQ ID NO: 3332687 - protein, 7 aa, Plasmodium falciparum
NKNTNKN

SEQ ID NO: 3332688 - protein, 12 aa, Plasmodium falciparum
NKNTNLNDEMDS

SEQ ID NO: 3332689 - protein, 8 aa, Plasmodium falciparum
NKNTRQQN

SEQ ID NO: 3332690 - protein, 6 aa, Plasmodium falciparum
NKNTSE

SEQ ID NO: 3332691 - protein, 6 aa, Plasmodium falciparum
NKNTSL

SEQ ID NO: 3332692 - protein, 7 aa, Plasmodium falciparum
NKNTYND

SEQ ID NO: 3332693 - protein, 5 aa, Plasmodium falciparum
NKNVD

SEQ ID NO: 3332694 - protein, 13 aa, Plasmodium falciparum
NKNVEKIDENTSM

SEQ ID NO: 3332695 - protein, 8 aa, Plasmodium falciparum
NKNVGDAN

SEQ ID NO: 3332696 - protein, 8 aa, Plasmodium falciparum
NKNVKNKK

SEQ ID NO: 3332697 - protein, 8 aa, Plasmodium falciparum
NKNVQSNK

SEQ ID NO: 3332698 - protein, 13 aa, Plasmodium falciparum
NKNVSDNNENINN

SEQ ID NO: 3332699 - protein, 11 aa, Plasmodium falciparum
NKNVYDEKRSL

SEQ ID NO: 3332700 - protein, 4 aa, Plasmodium falciparum
NKNY

SEQ ID NO: 3332701 - protein, 6 aa, Plasmodium falciparum
NKNYDK

SEQ ID NO: 3332702 - protein, 13 aa, Plasmodium falciparum
NKNYDTDQNKKNK

SEQ ID NO: 3332703 - protein, 9 aa, Plasmodium falciparum
NKNYEGRNS

SEQ ID NO: 3332704 - protein, 7 aa, Plasmodium falciparum
NKNYEIN

SEQ ID NO: 3332705 - protein, 17 aa, Plasmodium falciparum
NKNYEKNLKNESVKNDN

SEQ ID NO: 3332706 - protein, 22 aa, Plasmodium falciparum
NKNYNKKKKKKRSSKSKQKRET

SEQ ID NO: 3332707 - protein, 7 aa, Plasmodium falciparum
NKNYPYG

SEQ ID NO: 3332708 - protein, 13 aa, Plasmodium falciparum
NKNYQTISPNNNL

SEQ ID NO: 3332709 - protein, 9 aa, Plasmodium falciparum
NKNYRKNSA

SEQ ID NO: 3332710 - protein, 15 aa, Plasmodium falciparum
NKNYRNEEEKKKNQI

SEQ ID NO: 3332711 - protein, 8 aa, Plasmodium falciparum
NKNYTSSS

SEQ ID NO: 3332712 - protein, 7 aa, Plasmodium falciparum
NKNYTTT

SEQ ID NO: 3332713 - protein, 6 aa, Plasmodium falciparum
NKNYVT

SEQ ID NO: 3332714 - protein, 5 aa, Plasmodium falciparum
NKNYY

SEQ ID NO: 3332715 - protein, 17 aa, Plasmodium falciparum
NKPAKKSLLSNAEKQKK

SEQ ID NO: 3332716 - protein, 6 aa, Plasmodium falciparum
NKPDMQ

SEQ ID NO: 3332717 - protein, 7 aa, Plasmodium falciparum
NKPDNIN

SEQ ID NO: 3332718 - protein, 8 aa, Plasmodium falciparum
NKPEDGTK

SEQ ID NO: 3332719 - protein, 13 aa, Plasmodium falciparum
NKPEENTNDKRTS

SEQ ID NO: 3332720 - protein, 10 aa, Plasmodium falciparum
NKPEKGRSLH

SEQ ID NO: 3332721 - protein, 22 aa, Plasmodium falciparum
NKPFKADDKNTIKEKNNKITEK

SEQ ID NO: 3332722 - protein, 13 aa, Plasmodium falciparum
NKPFKDNTLSNKK

SEQ ID NO: 3332723 - protein, 9 aa, Plasmodium falciparum
NKPGEDIET

SEQ ID NO: 3332724 - protein, 4 aa, Plasmodium falciparum
NKPI

SEQ ID NO: 3332725 - protein, 7 aa, Plasmodium falciparum
NKPIEYN

SEQ ID NO: 3332726 - protein, 33 aa, Plasmodium falciparum
NKPINKPINKPINKPINKPINKPINKPINKPIN

SEQ ID NO: 3332727 - protein, 7 aa, Plasmodium falciparum
NKPINNP

SEQ ID NO: 3332728 - protein, 8 aa, Plasmodium falciparum
NKPKNALP

SEQ ID NO: 3332729 - protein, 13 aa, Plasmodium falciparum
NKPLDGTDGNPKL

SEQ ID NO: 3332730 - protein, 7 aa, Plasmodium falciparum
NKPNNSL

SEQ ID NO: 3332731 - protein, 8 aa, Plasmodium falciparum
NKPNYNDN

SEQ ID NO: 3332732 - protein, 14 aa, Plasmodium falciparum
NKPPCGDDQKEDSE

SEQ ID NO: 3332733 - protein, 9 aa, Plasmodium falciparum
NKPPPGVED

SEQ ID NO: 3332734 - protein, 8 aa, Plasmodium falciparum
NKPPQPDM

SEQ ID NO: 3332735 - protein, 5 aa, Plasmodium falciparum
NKPQI

SEQ ID NO: 3332736 - protein, 8 aa, Plasmodium falciparum
NKPRAATI

SEQ ID NO: 3332737 - protein, 19 aa, Plasmodium falciparum
NKPRNVGSFDKNEKNIGTS

SEQ ID NO: 3332738 - protein, 15 aa, Plasmodium falciparum
NKPSEEERCTTCSGE

SEQ ID NO: 3332739 - protein, 7 aa, Plasmodium falciparum
NKPSIDK

SEQ ID NO: 3332740 - protein, 6 aa, Plasmodium falciparum
NKPSSC

SEQ ID NO: 3332741 - protein, 8 aa, Plasmodium falciparum
NKPSSGTK

SEQ ID NO: 3332742 - protein, 7 aa, Plasmodium falciparum
NKPSSLN

SEQ ID NO: 3332743 - protein, 20 aa, Plasmodium falciparum
NKPSTNKNNTKHDDIKQSSE

SEQ ID NO: 3332744 - protein, 10 aa, Plasmodium falciparum
NKPTSYDNKV

SEQ ID NO: 3332745 - protein, 15 aa, Plasmodium falciparum
NKPTYNKNDFSQDEE

SEQ ID NO: 3332746 - protein, 8 aa, Plasmodium falciparum
NKPVSEPR

SEQ ID NO: 3332747 - protein, 8 aa, Plasmodium falciparum
NKPYPKSR

SEQ ID NO: 3332748 - protein, 9 aa, Plasmodium falciparum
NKQDKARNE

SEQ ID NO: 3332749 - protein, 9 aa, Plasmodium falciparum
NKQDNNEYE

SEQ ID NO: 3332750 - protein, 10 aa, Plasmodium falciparum
NKQEHSRGLQ

SEQ ID NO: 3332751 - protein, 7 aa, Plasmodium falciparum
NKQERDD

SEQ ID NO: 3332752 - protein, 4 aa, Plasmodium falciparum
NKQF

SEQ ID NO: 3332753 - protein, 8 aa, Plasmodium falciparum
NKQGDDNN

SEQ ID NO: 3332754 - protein, 8 aa, Plasmodium falciparum
NKQGDENN

SEQ ID NO: 3332755 - protein, 6 aa, Plasmodium falciparum
NKQIEP

SEQ ID NO: 3332756 - protein, 12 aa, Plasmodium falciparum
NKQITNNENKKD

SEQ ID NO: 3332757 - protein, 4 aa, Plasmodium falciparum
NKQK

SEQ ID NO: 3332758 - protein, 19 aa, Plasmodium falciparum
NKQKELQKQKDKEEELKNQ

SEQ ID NO: 3332759 - protein, 8 aa, Plasmodium falciparum
NKQKIKDS

SEQ ID NO: 3332760 - protein, 13 aa, Plasmodium falciparum
NKQKKKGKVEDNN

SEQ ID NO: 3332761 - protein, 10 aa, Plasmodium falciparum
NKQKRKSEKV

SEQ ID NO: 3332762 - protein, 10 aa, Plasmodium falciparum
NKQKYNNTPY

SEQ ID NO: 3332763 - protein, 4 aa, Plasmodium falciparum
NKQN

SEQ ID NO: 3332764 - protein, 12 aa, Plasmodium falciparum
NKQNANKITRDD

SEQ ID NO: 3332765 - protein, 10 aa, Plasmodium falciparum
NKQNDEKDNM

SEQ ID NO: 3332766 - protein, 9 aa, Plasmodium falciparum
NKQNEEVST

SEQ ID NO: 3332767 - protein, 7 aa, Plasmodium falciparum
NKQNINK

SEQ ID NO: 3332768 - protein, 20 aa, Plasmodium falciparum
NKQNNNMNNIKDKKKKNNIM

SEQ ID NO: 3332769 - protein, 8 aa, Plasmodium falciparum
NKQNNNNS

SEQ ID NO: 3332770 - protein, 12 aa, Plasmodium falciparum
NKQNQDIQKSSR

SEQ ID NO: 3332771 - protein, 19 aa, Plasmodium falciparum
NKQNQTTTKDNIQQNDNVK

SEQ ID NO: 3332772 - protein, 17 aa, Plasmodium falciparum
NKQPFDNKKKDKKGFKV

SEQ ID NO: 3332773 - protein, 8 aa, Plasmodium falciparum
NKQPYSIN

SEQ ID NO: 3332774 - protein, 9 aa, Plasmodium falciparum
NKQQECKEN

SEQ ID NO: 3332775 - protein, 9 aa, Plasmodium falciparum
NKQQEKNMK

SEQ ID NO: 3332776 - protein, 14 aa, Plasmodium falciparum
NKQQNAASQANQMN

SEQ ID NO: 3332777 - protein, 4 aa, Plasmodium falciparum
NKQS

SEQ ID NO: 3332778 - protein, 10 aa, Plasmodium falciparum
NKQSDKKTMT

SEQ ID NO: 3332779 - protein, 9 aa, Plasmodium falciparum
NKQSDRTGV

SEQ ID NO: 3332780 - protein, 17 aa, Plasmodium falciparum
NKQSELSDSESDSSKDS

SEQ ID NO: 3332781 - protein, 10 aa, Plasmodium falciparum
NKQSKSTQTN

SEQ ID NO: 3332782 - protein, 6 aa, Plasmodium falciparum
NKQSND

SEQ ID NO: 3332783 - protein, 8 aa, Plasmodium falciparum
NKQSTNPF

SEQ ID NO: 3332784 - protein, 13 aa, Plasmodium falciparum
NKQTCNNLNEQNK

SEQ ID NO: 3332785 - protein, 10 aa, Plasmodium falciparum
NKQTNKSNED

SEQ ID NO: 3332786 - protein, 7 aa, Plasmodium falciparum
NKQTNSE

SEQ ID NO: 3332787 - protein, 6 aa, Plasmodium falciparum
NKQTYK

SEQ ID NO: 3332788 - protein, 11 aa, Plasmodium falciparum
NKQYDEKRDNI

SEQ ID NO: 3332789 - protein, 5 aa, Plasmodium falciparum
NKQYN

SEQ ID NO: 3332790 - protein, 8 aa, Plasmodium falciparum
NKQYSQQN

SEQ ID NO: 3332791 - protein, 6 aa, Plasmodium falciparum
NKRDDE

SEQ ID NO: 3332792 - protein, 8 aa, Plasmodium falciparum
NKRDDIRN

SEQ ID NO: 3332793 - protein, 7 aa, Plasmodium falciparum
NKRDDTN

SEQ ID NO: 3332794 - protein, 4 aa, Plasmodium falciparum
NKRE

SEQ ID NO: 3332795 - protein, 13 aa, Plasmodium falciparum
NKREEEKEKANIK

SEQ ID NO: 3332796 - protein, 11 aa, Plasmodium falciparum
NKREEETKGSS

SEQ ID NO: 3332797 - protein, 7 aa, Plasmodium falciparum
NKREKDI

SEQ ID NO: 3332798 - protein, 12 aa, Plasmodium falciparum
NKREKNDSCSDD

SEQ ID NO: 3332799 - protein, 14 aa, Plasmodium falciparum
NKREKSCNNNEENN

SEQ ID NO: 3332800 - protein, 9 aa, Plasmodium falciparum
NKREPRKVS

SEQ ID NO: 3332801 - protein, 5 aa, Plasmodium falciparum
NKREQ

SEQ ID NO: 3332802 - protein, 5 aa, Plasmodium falciparum
NKRGK

SEQ ID NO: 3332803 - protein, 16 aa, Plasmodium falciparum
NKRGSNNTSTNNNTTH

SEQ ID NO: 3332804 - protein, 4 aa, Plasmodium falciparum
NKRI

SEQ ID NO: 3332805 - protein, 14 aa, Plasmodium falciparum
NKRIEEDSDKNIIN

SEQ ID NO: 3332806 - protein, 23 aa, Plasmodium falciparum
NKRIKGNEDYGIADNSEDAVEGM

SEQ ID NO: 3332807 - protein, 21 aa, Plasmodium falciparum
NKRISKKDKNLKENQKKKIKR

SEQ ID NO: 3332808 - protein, 12 aa, Plasmodium falciparum
NKRKDEEHINND

SEQ ID NO: 3332809 - protein, 73 aa, Plasmodium falciparum
NKRKDKKKKVISDDDDDDDDDENSNDDNKSEDNNNDDNNNDDNKDITKNDNNGNFSDNNNNNNNINDDQNDDN

SEQ ID NO: 3332810 - protein, 8 aa, Plasmodium falciparum
NKRKDLES

SEQ ID NO: 3332811 - protein, 10 aa, Plasmodium falciparum
NKRKENLQRH

SEQ ID NO: 3332812 - protein, 12 aa, Plasmodium falciparum
NKRKESNKNMKR

SEQ ID NO: 3332813 - protein, 14 aa, Plasmodium falciparum
NKRKINNKDIRGTN

SEQ ID NO: 3332814 - protein, 12 aa, Plasmodium falciparum
NKRKKQEQKNNI

SEQ ID NO: 3332815 - protein, 8 aa, Plasmodium falciparum
NKRKLEKK

SEQ ID NO: 3332816 - protein, 7 aa, Plasmodium falciparum
NKRKNEK

SEQ ID NO: 3332817 - protein, 22 aa, Plasmodium falciparum
NKRKNESISDNNLHTKSDNKYD

SEQ ID NO: 3332818 - protein, 6 aa, Plasmodium falciparum
NKRKNI

SEQ ID NO: 3332819 - protein, 9 aa, Plasmodium falciparum
NKRKNNNIH

SEQ ID NO: 3332820 - protein, 10 aa, Plasmodium falciparum
NKRKQYEEKI

SEQ ID NO: 3332821 - protein, 9 aa, Plasmodium falciparum
NKRKRRKKK

SEQ ID NO: 3332822 - protein, 6 aa, Plasmodium falciparum
NKRKSI

SEQ ID NO: 3332823 - protein, 21 aa, Plasmodium falciparum
NKRKYSNYNTYNNNDNYNNKD

SEQ ID NO: 3332824 - protein, 4 aa, Plasmodium falciparum
NKRL

SEQ ID NO: 3332825 - protein, 15 aa, Plasmodium falciparum
NKRLPQPNEGEVYSN

SEQ ID NO: 3332826 - protein, 27 aa, Plasmodium falciparum
NKRMSNKYNENYYSDSSNDKYSTRYSK

SEQ ID NO: 3332827 - protein, 4 aa, Plasmodium falciparum
NKRN

SEQ ID NO: 3332828 - protein, 9 aa, Plasmodium falciparum
NKRNANKKK

SEQ ID NO: 3332829 - protein, 11 aa, Plasmodium falciparum
NKRNDDSSMNN

SEQ ID NO: 3332830 - protein, 7 aa, Plasmodium falciparum
NKRNHNH

SEQ ID NO: 3332831 - protein, 16 aa, Plasmodium falciparum
NKRNKRNKRNKRSSKD

SEQ ID NO: 3332832 - protein, 8 aa, Plasmodium falciparum
NKRNNEEK

SEQ ID NO: 3332833 - protein, 8 aa, Plasmodium falciparum
NKRNNNDE

SEQ ID NO: 3332834 - protein, 8 aa, Plasmodium falciparum
NKRNNQLN

SEQ ID NO: 3332835 - protein, 8 aa, Plasmodium falciparum
NKRNNRDL

SEQ ID NO: 3332836 - protein, 21 aa, Plasmodium falciparum
NKRNRSFETVSNSKNKHKISK

SEQ ID NO: 3332837 - protein, 34 aa, Plasmodium falciparum
NKRNSSSKNNRNSSSKNNRNSSNKNNRNSSKEYF

SEQ ID NO: 3332838 - protein, 9 aa, Plasmodium falciparum
NKRNTAYKK

SEQ ID NO: 3332839 - protein, 5 aa, Plasmodium falciparum
NKRPM

SEQ ID NO: 3332840 - protein, 7 aa, Plasmodium falciparum
NKRPNNI

SEQ ID NO: 3332841 - protein, 8 aa, Plasmodium falciparum
NKRQKRST

SEQ ID NO: 3332842 - protein, 24 aa, Plasmodium falciparum
NKRRKVDDKEHDETFNDKSKNTFE

SEQ ID NO: 3332843 - protein, 8 aa, Plasmodium falciparum
NKRRNEKM

SEQ ID NO: 3332844 - protein, 7 aa, Plasmodium falciparum
NKRRPCQ

SEQ ID NO: 3332845 - protein, 8 aa, Plasmodium falciparum
NKRRPQLS

SEQ ID NO: 3332846 - protein, 8 aa, Plasmodium falciparum
NKRSGNEI

SEQ ID NO: 3332847 - protein, 6 aa, Plasmodium falciparum
NKRSLS

SEQ ID NO: 3332848 - protein, 26 aa, Plasmodium falciparum
NKRSRDVGSNQNCDHNNNSRGGGGGK

SEQ ID NO: 3332849 - protein, 9 aa, Plasmodium falciparum
NKRSTNTSL

SEQ ID NO: 3332850 - protein, 15 aa, Plasmodium falciparum
NKRSTSLDNKKKNKV

SEQ ID NO: 3332851 - protein, 11 aa, Plasmodium falciparum
NKRTPSEEKKN

SEQ ID NO: 3332852 - protein, 60 aa, Plasmodium falciparum
NKRTTENIRSPSNSNNNKKKKKEQNDSTGKNSKEECNNNEDDDDDNNKNNFNNNNSNNVR

SEQ ID NO: 3332853 - protein, 7 aa, Plasmodium falciparum
NKRVQEA

SEQ ID NO: 3332854 - protein, 7 aa, Plasmodium falciparum
NKRYDHH

SEQ ID NO: 3332855 - protein, 20 aa, Plasmodium falciparum
NKRYDNNSVSCRNEENEITS

SEQ ID NO: 3332856 - protein, 6 aa, Plasmodium falciparum
NKSANS

SEQ ID NO: 3332857 - protein, 8 aa, Plasmodium falciparum
NKSDENKL

SEQ ID NO: 3332858 - protein, 20 aa, Plasmodium falciparum
NKSDITQQHNYGDKASTHYN

SEQ ID NO: 3332859 - protein, 8 aa, Plasmodium falciparum
NKSDKNKN

SEQ ID NO: 3332860 - protein, 16 aa, Plasmodium falciparum
NKSDNTSNKKKEKDKW

SEQ ID NO: 3332861 - protein, 11 aa, Plasmodium falciparum
NKSDYGNLQND

SEQ ID NO: 3332862 - protein, 4 aa, Plasmodium falciparum
NKSE

SEQ ID NO: 3332863 - protein, 25 aa, Plasmodium falciparum
NKSEDINKPGDINNSDDVNNPDDIN

SEQ ID NO: 3332864 - protein, 6 aa, Plasmodium falciparum
NKSEEE

SEQ ID NO: 3332865 - protein, 7 aa, Plasmodium falciparum
NKSEHRH

SEQ ID NO: 3332866 - protein, 18 aa, Plasmodium falciparum
NKSEIDDKNNIKTATQNE

SEQ ID NO: 3332867 - protein, 17 aa, Plasmodium falciparum
NKSEKKNQHNNDNNNND

SEQ ID NO: 3332868 - protein, 6 aa, Plasmodium falciparum
NKSENL

SEQ ID NO: 3332869 - protein, 6 aa, Plasmodium falciparum
NKSEQN

SEQ ID NO: 3332870 - protein, 16 aa, Plasmodium falciparum
NKSESLNSQSSTNSAH

SEQ ID NO: 3332871 - protein, 6 aa, Plasmodium falciparum
NKSEVK

SEQ ID NO: 3332872 - protein, 19 aa, Plasmodium falciparum
NKSEVSSDNNNNNNNNNNK

SEQ ID NO: 3332873 - protein, 9 aa, Plasmodium falciparum
NKSEYGNNE

SEQ ID NO: 3332874 - protein, 8 aa, Plasmodium falciparum
NKSFKNVN

SEQ ID NO: 3332875 - protein, 8 aa, Plasmodium falciparum
NKSFNNSN

SEQ ID NO: 3332876 - protein, 6 aa, Plasmodium falciparum
NKSFYS

SEQ ID NO: 3332877 - protein, 8 aa, Plasmodium falciparum
NKSGATYS

SEQ ID NO: 3332878 - protein, 9 aa, Plasmodium falciparum
NKSGENTKY

SEQ ID NO: 3332879 - protein, 9 aa, Plasmodium falciparum
NKSGGDEKS

SEQ ID NO: 3332880 - protein, 6 aa, Plasmodium falciparum
NKSGGY

SEQ ID NO: 3332881 - protein, 7 aa, Plasmodium falciparum
NKSGKNN

SEQ ID NO: 3332882 - protein, 9 aa, Plasmodium falciparum
NKSGKTADY

SEQ ID NO: 3332883 - protein, 17 aa, Plasmodium falciparum
NKSGSSRFSGRETATRV

SEQ ID NO: 3332884 - protein, 4 aa, Plasmodium falciparum
NKSH

SEQ ID NO: 3332885 - protein, 5 aa, Plasmodium falciparum
NKSHD

SEQ ID NO: 3332886 - protein, 14 aa, Plasmodium falciparum
NKSHEEEKKNEKIN

SEQ ID NO: 3332887 - protein, 6 aa, Plasmodium falciparum
NKSHEK

SEQ ID NO: 3332888 - protein, 5 aa, Plasmodium falciparum
NKSHI

SEQ ID NO: 3332889 - protein, 6 aa, Plasmodium falciparum
NKSHNK

SEQ ID NO: 3332890 - protein, 16 aa, Plasmodium falciparum
NKSHNNDQYVGGQKDN

SEQ ID NO: 3332891 - protein, 19 aa, Plasmodium falciparum
NKSIKNSQDKIKTSTQNVM

SEQ ID NO: 3332892 - protein, 5 aa, Plasmodium falciparum
NKSIN

SEQ ID NO: 3332893 - protein, 6 aa, Plasmodium falciparum
NKSISN

SEQ ID NO: 3332894 - protein, 4 aa, Plasmodium falciparum
NKSK

SEQ ID NO: 3332895 - protein, 16 aa, Plasmodium falciparum
NKSKAQSKGSKQNTQY

SEQ ID NO: 3332896 - protein, 8 aa, Plasmodium falciparum
NKSKEDKI

SEQ ID NO: 3332897 - protein, 10 aa, Plasmodium falciparum
NKSKEELTNN

SEQ ID NO: 3332898 - protein, 5 aa, Plasmodium falciparum
NKSKF

SEQ ID NO: 3332899 - protein, 10 aa, Plasmodium falciparum
NKSKITNTLK

SEQ ID NO: 3332900 - protein, 41 aa, Plasmodium falciparum
NKSKKKSETVKKKNKSNSDSKKKENDVKNLKSTPQCSSDES

SEQ ID NO: 3332901 - protein, 12 aa, Plasmodium falciparum
NKSKKNKNITND

SEQ ID NO: 3332902 - protein, 10 aa, Plasmodium falciparum
NKSKKTEITD

SEQ ID NO: 3332903 - protein, 6 aa, Plasmodium falciparum
NKSKNY

SEQ ID NO: 3332904 - protein, 16 aa, Plasmodium falciparum
NKSKTEANKNNGITQR

SEQ ID NO: 3332905 - protein, 9 aa, Plasmodium falciparum
NKSKTMSTT

SEQ ID NO: 3332906 - protein, 9 aa, Plasmodium falciparum
NKSKTNIQQ

SEQ ID NO: 3332907 - protein, 4 aa, Plasmodium falciparum
NKSN

SEQ ID NO: 3332908 - protein, 24 aa, Plasmodium falciparum
NKSNDCETTYKSEEKKNKKNVEKN

SEQ ID NO: 3332909 - protein, 8 aa, Plasmodium falciparum
NKSNDEDT

SEQ ID NO: 3332910 - protein, 8 aa, Plasmodium falciparum
NKSNDNNI

SEQ ID NO: 3332911 - protein, 8 aa, Plasmodium falciparum
NKSNEECN

SEQ ID NO: 3332912 - protein, 15 aa, Plasmodium falciparum
NKSNENDEQKVEPQK

SEQ ID NO: 3332913 - protein, 8 aa, Plasmodium falciparum
NKSNENGK

SEQ ID NO: 3332914 - protein, 30 aa, Plasmodium falciparum
NKSNEQNELNESNEVNKEHDSYESNKTHDI

SEQ ID NO: 3332915 - protein, 11 aa, Plasmodium falciparum
NKSNESNKNDI

SEQ ID NO: 3332916 - protein, 68 aa, Plasmodium falciparum
NKSNHINKNDSIDQKEQLNDEDISTADENNNMNSNNNNNNNNNNNNNNNNNNNNNNNNNNNNNNNNSV

SEQ ID NO: 3332917 - protein, 5 aa, Plasmodium falciparum
NKSNI

SEQ ID NO: 3332918 - protein, 24 aa, Plasmodium falciparum
NKSNINNNSNNNNNNNNNSNSNTC

SEQ ID NO: 3332919 - protein, 8 aa, Plasmodium falciparum
NKSNKDNI

SEQ ID NO: 3332920 - protein, 23 aa, Plasmodium falciparum
NKSNKKNKTIKNVNDNNNNNNVH

SEQ ID NO: 3332921 - protein, 8 aa, Plasmodium falciparum
NKSNKMEN

SEQ ID NO: 3332922 - protein, 6 aa, Plasmodium falciparum
NKSNNK

SEQ ID NO: 3332923 - protein, 12 aa, Plasmodium falciparum
NKSNNKEKNKHV

SEQ ID NO: 3332924 - protein, 8 aa, Plasmodium falciparum
NKSNNNND

SEQ ID NO: 3332925 - protein, 14 aa, Plasmodium falciparum
NKSNNTNAVENRGS

SEQ ID NO: 3332926 - protein, 9 aa, Plasmodium falciparum
NKSNQQYIK

SEQ ID NO: 3332927 - protein, 23 aa, Plasmodium falciparum
NKSNQSSKIKGGKKKKNKNDYNN

SEQ ID NO: 3332928 - protein, 7 aa, Plasmodium falciparum
NKSNRNN

SEQ ID NO: 3332929 - protein, 29 aa, Plasmodium falciparum
NKSNSCPLNKKNEKKQDIIDDKKKNKLHD

SEQ ID NO: 3332930 - protein, 7 aa, Plasmodium falciparum
NKSNSGL

SEQ ID NO: 3332931 - protein, 7 aa, Plasmodium falciparum
NKSNSTI

SEQ ID NO: 3332932 - protein, 17 aa, Plasmodium falciparum
NKSNTNQQKNGMGSQNN

SEQ ID NO: 3332933 - protein, 6 aa, Plasmodium falciparum
NKSNTT

SEQ ID NO: 3332934 - protein, 10 aa, Plasmodium falciparum
NKSPSKLNKN

SEQ ID NO: 3332935 - protein, 14 aa, Plasmodium falciparum
NKSPYTKQNSINNT

SEQ ID NO: 3332936 - protein, 4 aa, Plasmodium falciparum
NKSQ

SEQ ID NO: 3332937 - protein, 9 aa, Plasmodium falciparum
NKSQEEHKK

SEQ ID NO: 3332938 - protein, 9 aa, Plasmodium falciparum
NKSQEGAQF

SEQ ID NO: 3332939 - protein, 14 aa, Plasmodium falciparum
NKSQGTHGNDSTMN

SEQ ID NO: 3332940 - protein, 15 aa, Plasmodium falciparum
NKSQHETINKGKTNI

SEQ ID NO: 3332941 - protein, 20 aa, Plasmodium falciparum
NKSQLEKKIQDDNKINEKIT

SEQ ID NO: 3332942 - protein, 9 aa, Plasmodium falciparum
NKSQNKKEK

SEQ ID NO: 3332943 - protein, 8 aa, Plasmodium falciparum
NKSQVDNS

SEQ ID NO: 3332944 - protein, 7 aa, Plasmodium falciparum
NKSRKDE

SEQ ID NO: 3332945 - protein, 21 aa, Plasmodium falciparum
NKSRQKYNKIERKKKKNASSL

SEQ ID NO: 3332946 - protein, 10 aa, Plasmodium falciparum
NKSRSNKGEA

SEQ ID NO: 3332947 - protein, 11 aa, Plasmodium falciparum
NKSSEKKDSEL

SEQ ID NO: 3332948 - protein, 7 aa, Plasmodium falciparum
NKSSEKY

SEQ ID NO: 3332949 - protein, 10 aa, Plasmodium falciparum
NKSSEQNHDE

SEQ ID NO: 3332950 - protein, 7 aa, Plasmodium falciparum
NKSSERI

SEQ ID NO: 3332951 - protein, 14 aa, Plasmodium falciparum
NKSSFLKESSDSFM

SEQ ID NO: 3332952 - protein, 8 aa, Plasmodium falciparum
NKSSHDIN

SEQ ID NO: 3332953 - protein, 8 aa, Plasmodium falciparum
NKSSSIHN

SEQ ID NO: 3332954 - protein, 23 aa, Plasmodium falciparum
NKSSTSFDKTKKEQNNNMNGGGT

SEQ ID NO: 3332955 - protein, 10 aa, Plasmodium falciparum
NKSSTSNTMV

SEQ ID NO: 3332956 - protein, 7 aa, Plasmodium falciparum
NKSSYKN

SEQ ID NO: 3332957 - protein, 7 aa, Plasmodium falciparum
NKSTDNI

SEQ ID NO: 3332958 - protein, 5 aa, Plasmodium falciparum
NKSTG

SEQ ID NO: 3332959 - protein, 6 aa, Plasmodium falciparum
NKSTIN

SEQ ID NO: 3332960 - protein, 6 aa, Plasmodium falciparum
NKSTKL

SEQ ID NO: 3332961 - protein, 6 aa, Plasmodium falciparum
NKSTLP

SEQ ID NO: 3332962 - protein, 6 aa, Plasmodium falciparum
NKSTNI

SEQ ID NO: 3332963 - protein, 9 aa, Plasmodium falciparum
NKSTNNDAC

SEQ ID NO: 3332964 - protein, 8 aa, Plasmodium falciparum
NKSTYNNI

SEQ ID NO: 3332965 - protein, 5 aa, Plasmodium falciparum
NKSVG

SEQ ID NO: 3332966 - protein, 22 aa, Plasmodium falciparum
NKSVKNSKKTKKIKLNDNSNKS

SEQ ID NO: 3332967 - protein, 5 aa, Plasmodium falciparum
NKSYD

SEQ ID NO: 3332968 - protein, 10 aa, Plasmodium falciparum
NKSYEENRRK

SEQ ID NO: 3332969 - protein, 14 aa, Plasmodium falciparum
NKSYELDKSSNSSI

SEQ ID NO: 3332970 - protein, 15 aa, Plasmodium falciparum
NKSYNHNNYSDHDTN

SEQ ID NO: 3332971 - protein, 7 aa, Plasmodium falciparum
NKSYNYS

SEQ ID NO: 3332972 - protein, 12 aa, Plasmodium falciparum
NKSYSSSPEDNL

SEQ ID NO: 3332973 - protein, 8 aa, Plasmodium falciparum
NKTALNTS

SEQ ID NO: 3332974 - protein, 4 aa, Plasmodium falciparum
NKTD

SEQ ID NO: 3332975 - protein, 6 aa, Plasmodium falciparum
NKTDDF

SEQ ID NO: 3332976 - protein, 9 aa, Plasmodium falciparum
NKTDGSNFN

SEQ ID NO: 3332977 - protein, 15 aa, Plasmodium falciparum
NKTDHTNDSKKDMCP

SEQ ID NO: 3332978 - protein, 11 aa, Plasmodium falciparum
NKTDKKKENIE

SEQ ID NO: 3332979 - protein, 39 aa, Plasmodium falciparum
NKTDNKTDNQTDNQTNNQTDNQTDNQTNNQTNNQTNNKI

SEQ ID NO: 3332980 - protein, 8 aa, Plasmodium falciparum
NKTDNRDI

SEQ ID NO: 3332981 - protein, 8 aa, Plasmodium falciparum
NKTDNVTN

SEQ ID NO: 3332982 - protein, 4 aa, Plasmodium falciparum
NKTE

SEQ ID NO: 3332983 - protein, 26 aa, Plasmodium falciparum
NKTEAGTDHITTSNNNNDGHGDDHGD

SEQ ID NO: 3332984 - protein, 39 aa, Plasmodium falciparum
NKTEGNSNNHMDNKNNMDNKKNMDNKNNMDNNNNMDNKK

SEQ ID NO: 3332985 - protein, 34 aa, Plasmodium falciparum
NKTEIENTGSKSIPNDSNEGANNKVDKNDGNENV

SEQ ID NO: 3332986 - protein, 14 aa, Plasmodium falciparum
NKTEINKDIDPNSI

SEQ ID NO: 3332987 - protein, 15 aa, Plasmodium falciparum
NKTENVKGFKKNDEL

SEQ ID NO: 3332988 - protein, 5 aa, Plasmodium falciparum
NKTEQ

SEQ ID NO: 3332989 - protein, 14 aa, Plasmodium falciparum
NKTEQNKDNGHIEN

SEQ ID NO: 3332990 - protein, 6 aa, Plasmodium falciparum
NKTESI

SEQ ID NO: 3332991 - protein, 8 aa, Plasmodium falciparum
NKTETKNN

SEQ ID NO: 3332992 - protein, 8 aa, Plasmodium falciparum
NKTEVSTL

SEQ ID NO: 3332993 - protein, 5 aa, Plasmodium falciparum
NKTFN

SEQ ID NO: 3332994 - protein, 5 aa, Plasmodium falciparum
NKTGC

SEQ ID NO: 3332995 - protein, 9 aa, Plasmodium falciparum
NKTGKISKE

SEQ ID NO: 3332996 - protein, 6 aa, Plasmodium falciparum
NKTGNI

SEQ ID NO: 3332997 - protein, 6 aa, Plasmodium falciparum
NKTIEE

SEQ ID NO: 3332998 - protein, 6 aa, Plasmodium falciparum
NKTIEN

SEQ ID NO: 3332999 - protein, 14 aa, Plasmodium falciparum
NKTIKEDSPNTRFN

SEQ ID NO: 3333000 - protein, 7 aa, Plasmodium falciparum
NKTKCEE

SEQ ID NO: 3333001 - protein, 8 aa, Plasmodium falciparum
NKTKDGYF

SEQ ID NO: 3333002 - protein, 10 aa, Plasmodium falciparum
NKTKDKEHHS

SEQ ID NO: 3333003 - protein, 8 aa, Plasmodium falciparum
NKTKGHTR

SEQ ID NO: 3333004 - protein, 6 aa, Plasmodium falciparum
NKTKKD

SEQ ID NO: 3333005 - protein, 46 aa, Plasmodium falciparum
NKTKKHNNNNNNNINGGNNNNNNNINGGNNNNNNNINGGNNNNSNN

SEQ ID NO: 3333006 - protein, 20 aa, Plasmodium falciparum
NKTKKRSSITDNTENKNKRK

SEQ ID NO: 3333007 - protein, 7 aa, Plasmodium falciparum
NKTKNHK

SEQ ID NO: 3333008 - protein, 34 aa, Plasmodium falciparum
NKTKNYKKNNYHNEQEKRNQHNNNHEKKKVTRNR

SEQ ID NO: 3333009 - protein, 7 aa, Plasmodium falciparum
NKTKPLG

SEQ ID NO: 3333010 - protein, 11 aa, Plasmodium falciparum
NKTKRSSTNLQ

SEQ ID NO: 3333011 - protein, 4 aa, Plasmodium falciparum
NKTM

SEQ ID NO: 3333012 - protein, 7 aa, Plasmodium falciparum
NKTMENN

SEQ ID NO: 3333013 - protein, 10 aa, Plasmodium falciparum
NKTMTDDEYN

SEQ ID NO: 3333014 - protein, 4 aa, Plasmodium falciparum
NKTN

SEQ ID NO: 3333015 - protein, 12 aa, Plasmodium falciparum
NKTNDDTNFKQE

SEQ ID NO: 3333016 - protein, 8 aa, Plasmodium falciparum
NKTNDRER

SEQ ID NO: 3333017 - protein, 11 aa, Plasmodium falciparum
NKTNGDIKKNK

SEQ ID NO: 3333018 - protein, 13 aa, Plasmodium falciparum
NKTNKINKTNETN

SEQ ID NO: 3333019 - protein, 16 aa, Plasmodium falciparum
NKTNKNKNKNDDNKNY

SEQ ID NO: 3333020 - protein, 19 aa, Plasmodium falciparum
NKTNMKEDLKTTKKEFDDT

SEQ ID NO: 3333021 - protein, 9 aa, Plasmodium falciparum
NKTNNNNND

SEQ ID NO: 3333022 - protein, 16 aa, Plasmodium falciparum
NKTNNNNNNNNKKSAI

SEQ ID NO: 3333023 - protein, 13 aa, Plasmodium falciparum
NKTNNNTQKKKHL

SEQ ID NO: 3333024 - protein, 31 aa, Plasmodium falciparum
NKTNNQNIPNKAHNPNNSSNMNTTKKSYGTS

SEQ ID NO: 3333025 - protein, 11 aa, Plasmodium falciparum
NKTNNSSNRNI

SEQ ID NO: 3333026 - protein, 8 aa, Plasmodium falciparum
NKTNNVNN

SEQ ID NO: 3333027 - protein, 9 aa, Plasmodium falciparum
NKTNNYDKR

SEQ ID NO: 3333028 - protein, 59 aa, Plasmodium falciparum
NKTNQGISKKRNSYNKKNVPTIKENNNNKNNNHKINNNNNNKNNNNNNNKNNNKCANHN

SEQ ID NO: 3333029 - protein, 38 aa, Plasmodium falciparum
NKTNSNKTNNNKTNNNNGNNNNGNNNNNNNNNNNDINS

SEQ ID NO: 3333030 - protein, 21 aa, Plasmodium falciparum
NKTNTNKSKNRSRKRKRINSK

SEQ ID NO: 3333031 - protein, 10 aa, Plasmodium falciparum
NKTNTQNPTE

SEQ ID NO: 3333032 - protein, 8 aa, Plasmodium falciparum
NKTNYEDL

SEQ ID NO: 3333033 - protein, 5 aa, Plasmodium falciparum
NKTPI

SEQ ID NO: 3333034 - protein, 7 aa, Plasmodium falciparum
NKTPPKG

SEQ ID NO: 3333035 - protein, 21 aa, Plasmodium falciparum
NKTPTQTEIGQENYKKEGNYF

SEQ ID NO: 3333036 - protein, 11 aa, Plasmodium falciparum
NKTQKDSSKRI

SEQ ID NO: 3333037 - protein, 30 aa, Plasmodium falciparum
NKTQNTIKTEQQTYEQKSDINHDSNSGHQQ

SEQ ID NO: 3333038 - protein, 6 aa, Plasmodium falciparum
NKTQRT

SEQ ID NO: 3333039 - protein, 8 aa, Plasmodium falciparum
NKTRKKKR

SEQ ID NO: 3333040 - protein, 6 aa, Plasmodium falciparum
NKTRRR

SEQ ID NO: 3333041 - protein, 11 aa, Plasmodium falciparum
NKTRSDGNVGS

SEQ ID NO: 3333042 - protein, 7 aa, Plasmodium falciparum
NKTSEAT

SEQ ID NO: 3333043 - protein, 12 aa, Plasmodium falciparum
NKTSFEKDKENI

SEQ ID NO: 3333044 - protein, 25 aa, Plasmodium falciparum
NKTSKTNQNNNNNNDNNNDNNNGDI

SEQ ID NO: 3333045 - protein, 8 aa, Plasmodium falciparum
NKTSNENV

SEQ ID NO: 3333046 - protein, 12 aa, Plasmodium falciparum
NKTSQKKNIHTH

SEQ ID NO: 3333047 - protein, 8 aa, Plasmodium falciparum
NKTSTYTN

SEQ ID NO: 3333048 - protein, 16 aa, Plasmodium falciparum
NKTTKRNITSSNQKGK

SEQ ID NO: 3333049 - protein, 12 aa, Plasmodium falciparum
NKTTKTKFPEDK

SEQ ID NO: 3333050 - protein, 12 aa, Plasmodium falciparum
NKTTNNAPEHKN

SEQ ID NO: 3333051 - protein, 75 aa, Plasmodium falciparum
NKTTSQKTSIKNDSKNDSKNDSKNDSKNDSKNDSKNDHKNDHKNDHKNDHKNDRKTCSKSIDKKKRNDEKEKKDI

SEQ ID NO: 3333052 - protein, 7 aa, Plasmodium falciparum
NKTYNSD

SEQ ID NO: 3333053 - protein, 4 aa, Plasmodium falciparum
NKVD

SEQ ID NO: 3333054 - protein, 7 aa, Plasmodium falciparum
NKVDEEN

SEQ ID NO: 3333055 - protein, 11 aa, Plasmodium falciparum
NKVDEKKNNDV

SEQ ID NO: 3333056 - protein, 6 aa, Plasmodium falciparum
NKVDKS

SEQ ID NO: 3333057 - protein, 12 aa, Plasmodium falciparum
NKVEDNKLKEYT

SEQ ID NO: 3333058 - protein, 46 aa, Plasmodium falciparum
NKVGDGKGHKQNEINNNVPEKRKSGDDKSGVDSKNKNEKENLGSNK

SEQ ID NO: 3333059 - protein, 7 aa, Plasmodium falciparum
NKVGDQK

SEQ ID NO: 3333060 - protein, 25 aa, Plasmodium falciparum
NKVGNKKNTHDNNYNNYNNNSANAS

SEQ ID NO: 3333061 - protein, 45 aa, Plasmodium falciparum
NKVHDNKHDDNKHDDNKNDDNKNDDNKDGDNKNGDNNNKHSVKSY

SEQ ID NO: 3333062 - protein, 41 aa, Plasmodium falciparum
NKVKEQKENKRKKKKVKKEEERKFSDNEKKNFSDEEKQWND

SEQ ID NO: 3333063 - protein, 21 aa, Plasmodium falciparum
NKVKTDENDPINNDNLNNTRN

SEQ ID NO: 3333064 - protein, 4 aa, Plasmodium falciparum
NKVN

SEQ ID NO: 3333065 - protein, 6 aa, Plasmodium falciparum
NKVNES

SEQ ID NO: 3333066 - protein, 13 aa, Plasmodium falciparum
NKVNNKNGNYTNE

SEQ ID NO: 3333067 - protein, 8 aa, Plasmodium falciparum
NKVNTSNT

SEQ ID NO: 3333068 - protein, 5 aa, Plasmodium falciparum
NKVNY

SEQ ID NO: 3333069 - protein, 17 aa, Plasmodium falciparum
NKVQPKNNKEENQNQFT

SEQ ID NO: 3333070 - protein, 7 aa, Plasmodium falciparum
NKVQTST

SEQ ID NO: 3333071 - protein, 4 aa, Plasmodium falciparum
NKVR

SEQ ID NO: 3333072 - protein, 13 aa, Plasmodium falciparum
NKVSNNDFDDEKD

SEQ ID NO: 3333073 - protein, 16 aa, Plasmodium falciparum
NKVSNNNSNSNISNNN

SEQ ID NO: 3333074 - protein, 31 aa, Plasmodium falciparum
NKVSSNYKQNKNNSNDNNNNNNHNNKKKKYA

SEQ ID NO: 3333075 - protein, 9 aa, Plasmodium falciparum
NKVTDSTDG

SEQ ID NO: 3333076 - protein, 12 aa, Plasmodium falciparum
NKVTNNNSLNSN

SEQ ID NO: 3333077 - protein, 12 aa, Plasmodium falciparum
NKWKPKDKREHI

SEQ ID NO: 3333078 - protein, 4 aa, Plasmodium falciparum
NKWP

SEQ ID NO: 3333079 - protein, 14 aa, Plasmodium falciparum
NKWTSDQYDKKNDN

SEQ ID NO: 3333080 - protein, 13 aa, Plasmodium falciparum
NKYAESQQNFEES

SEQ ID NO: 3333081 - protein, 58 aa, Plasmodium falciparum
NKYDDKYDDKYDDKYDDKYDDKYDDKYDDKYDDKYDDKYDDNYDDKYDYGEEEHRQEY

SEQ ID NO: 3333082 - protein, 22 aa, Plasmodium falciparum
NKYDDNMDSSDKSSCNKNSCDN

SEQ ID NO: 3333083 - protein, 8 aa, Plasmodium falciparum
NKYDEEKE

SEQ ID NO: 3333084 - protein, 19 aa, Plasmodium falciparum
NKYDGKRDDFYNDKSDHIN

SEQ ID NO: 3333085 - protein, 28 aa, Plasmodium falciparum
NKYDKDDGTIKHKKGNKIISSDDKFDED

SEQ ID NO: 3333086 - protein, 6 aa, Plasmodium falciparum
NKYDKK

SEQ ID NO: 3333087 - protein, 6 aa, Plasmodium falciparum
NKYDNN

SEQ ID NO: 3333088 - protein, 22 aa, Plasmodium falciparum
NKYDNNINNKYNKHDENKQYTN

SEQ ID NO: 3333089 - protein, 12 aa, Plasmodium falciparum
NKYDNNKKNDYN

SEQ ID NO: 3333090 - protein, 23 aa, Plasmodium falciparum
NKYEANESSNKYDEKGKSKHRGS

SEQ ID NO: 3333091 - protein, 13 aa, Plasmodium falciparum
NKYEANKAVGEMR

SEQ ID NO: 3333092 - protein, 10 aa, Plasmodium falciparum
NKYEDNKNHV

SEQ ID NO: 3333093 - protein, 5 aa, Plasmodium falciparum
NKYEG

SEQ ID NO: 3333094 - protein, 16 aa, Plasmodium falciparum
NKYEGSTSPSNDYNKY

SEQ ID NO: 3333095 - protein, 17 aa, Plasmodium falciparum
NKYEKACESNLSNNSSF

SEQ ID NO: 3333096 - protein, 11 aa, Plasmodium falciparum
NKYEKKKEKYN

SEQ ID NO: 3333097 - protein, 95 aa, Plasmodium falciparum
NKYENENEIQNGKQNGKQNGKQNGKQNGKQNGKQNGKQNEIQNGKQNEIQNEIQDGKQNGKQNEIQNEIQNGKQNEKPNDNQNQKHHNENLTNNA

SEQ ID NO: 3333098 - protein, 16 aa, Plasmodium falciparum
NKYESKGFSASSLNNK

SEQ ID NO: 3333099 - protein, 20 aa, Plasmodium falciparum
NKYETNESKKINYKENSQGH

SEQ ID NO: 3333100 - protein, 5 aa, Plasmodium falciparum
NKYGA

SEQ ID NO: 3333101 - protein, 6 aa, Plasmodium falciparum
NKYGGR

SEQ ID NO: 3333102 - protein, 9 aa, Plasmodium falciparum
NKYHKRNKK

SEQ ID NO: 3333103 - protein, 6 aa, Plasmodium falciparum
NKYIPN

SEQ ID NO: 3333104 - protein, 62 aa, Plasmodium falciparum
NKYKDNKYKDNKYDVNKYKDNKYDVNKYDDNKHGDNKHGHNKYNDNKYNDNKHGDNKYNDKH

SEQ ID NO: 3333105 - protein, 13 aa, Plasmodium falciparum
NKYKKGNKKVITN

SEQ ID NO: 3333106 - protein, 6 aa, Plasmodium falciparum
NKYKKS

SEQ ID NO: 3333107 - protein, 7 aa, Plasmodium falciparum
NKYKNEY

SEQ ID NO: 3333108 - protein, 38 aa, Plasmodium falciparum
NKYKNNNNNNNNKNNSNNNNNNSNNNKNNSNNSCSSTI

SEQ ID NO: 3333109 - protein, 24 aa, Plasmodium falciparum
NKYKSKKKKYMRRRKKKEDKSVVK

SEQ ID NO: 3333110 - protein, 20 aa, Plasmodium falciparum
NKYLEKNKTKSMDSNNKIQK

SEQ ID NO: 3333111 - protein, 32 aa, Plasmodium falciparum
NKYLSSNSRLYSKNDKLGNHSKSNISRNISNS

SEQ ID NO: 3333112 - protein, 4 aa, Plasmodium falciparum
NKYN

SEQ ID NO: 3333113 - protein, 6 aa, Plasmodium falciparum
NKYNAQ

SEQ ID NO: 3333114 - protein, 13 aa, Plasmodium falciparum
NKYNEKRSNRNVD

SEQ ID NO: 3333115 - protein, 5 aa, Plasmodium falciparum
NKYNH

SEQ ID NO: 3333116 - protein, 5 aa, Plasmodium falciparum
NKYNN

SEQ ID NO: 3333117 - protein, 7 aa, Plasmodium falciparum
NKYNNDK

SEQ ID NO: 3333118 - protein, 6 aa, Plasmodium falciparum
NKYNNN

SEQ ID NO: 3333119 - protein, 35 aa, Plasmodium falciparum
NKYNNNNKNNDNNNNNNNNNNNNNNNNNNNNNNYN

SEQ ID NO: 3333120 - protein, 12 aa, Plasmodium falciparum
NKYNNNNNEDKT

SEQ ID NO: 3333121 - protein, 16 aa, Plasmodium falciparum
NKYNNNNSNNSNNNNI

SEQ ID NO: 3333122 - protein, 10 aa, Plasmodium falciparum
NKYNPSSHHN

SEQ ID NO: 3333123 - protein, 6 aa, Plasmodium falciparum
NKYNSS

SEQ ID NO: 3333124 - protein, 7 aa, Plasmodium falciparum
NKYNTHQ

SEQ ID NO: 3333125 - protein, 39 aa, Plasmodium falciparum
NKYNTYNDYNNKNNTYNDYNNKYNTYNDYNNKNNTYNDC

SEQ ID NO: 3333126 - protein, 8 aa, Plasmodium falciparum
NKYPHEGA

SEQ ID NO: 3333127 - protein, 13 aa, Plasmodium falciparum
NKYQIDEKKKKKI

SEQ ID NO: 3333128 - protein, 11 aa, Plasmodium falciparum
NKYQNEQDEDI

SEQ ID NO: 3333129 - protein, 6 aa, Plasmodium falciparum
NKYQNV

SEQ ID NO: 3333130 - protein, 8 aa, Plasmodium falciparum
NKYSEGYP

SEQ ID NO: 3333131 - protein, 23 aa, Plasmodium falciparum
NKYSNNNNNNNRMNDEVNSDNNY

SEQ ID NO: 3333132 - protein, 14 aa, Plasmodium falciparum
NKYSPDGRYSPSNL

SEQ ID NO: 3333133 - protein, 20 aa, Plasmodium falciparum
NKYSPEDGYNLEGNKKEEMD

SEQ ID NO: 3333134 - protein, 7 aa, Plasmodium falciparum
NKYSPQY

SEQ ID NO: 3333135 - protein, 6 aa, Plasmodium falciparum
NKYSRT

SEQ ID NO: 3333136 - protein, 11 aa, Plasmodium falciparum
NKYSSEDDHNY

SEQ ID NO: 3333137 - protein, 10 aa, Plasmodium falciparum
NKYSSNKHIT

SEQ ID NO: 3333138 - protein, 5 aa, Plasmodium falciparum
NKYST

SEQ ID NO: 3333139 - protein, 10 aa, Plasmodium falciparum
NKYSTMQNNK

SEQ ID NO: 3333140 - protein, 9 aa, Plasmodium falciparum
NKYTDDDTS

SEQ ID NO: 3333141 - protein, 48 aa, Plasmodium falciparum
NKYTHRTNNKKKKSNINNNNVNNNNVNNNNVNNNNVNNNNHNNNNNYN

SEQ ID NO: 3333142 - protein, 5 aa, Plasmodium falciparum
NKYTN

SEQ ID NO: 3333143 - protein, 18 aa, Plasmodium falciparum
NKYTSNMNNQYDNKDSSY

SEQ ID NO: 3333144 - protein, 4 aa, Plasmodium falciparum
NKYY

SEQ ID NO: 3333145 - protein, 5 aa, Plasmodium falciparum
NKYYQ

SEQ ID NO: 3333146 - protein, 10 aa, Plasmodium falciparum
NLAESTTKNE

SEQ ID NO: 3333147 - protein, 6 aa, Plasmodium falciparum
NLAPTT

SEQ ID NO: 3333148 - protein, 5 aa, Plasmodium falciparum
NLCNT

SEQ ID NO: 3333149 - protein, 4 aa, Plasmodium falciparum
NLCS

SEQ ID NO: 3333150 - protein, 14 aa, Plasmodium falciparum
NLDDDTKKQYDQAY

SEQ ID NO: 3333151 - protein, 11 aa, Plasmodium falciparum
NLDDTTNNYEG

SEQ ID NO: 3333152 - protein, 11 aa, Plasmodium falciparum
NLDEETTNIKN

SEQ ID NO: 3333153 - protein, 14 aa, Plasmodium falciparum
NLDGGNNKGLKKYN

SEQ ID NO: 3333154 - protein, 14 aa, Plasmodium falciparum
NLDHKKEKNERNMK

SEQ ID NO: 3333155 - protein, 5 aa, Plasmodium falciparum
NLDHN

SEQ ID NO: 3333156 - protein, 5 aa, Plasmodium falciparum
NLDKG

SEQ ID NO: 3333157 - protein, 14 aa, Plasmodium falciparum
NLDNNNENKSLYED

SEQ ID NO: 3333158 - protein, 9 aa, Plasmodium falciparum
NLDNNSEDI

SEQ ID NO: 3333159 - protein, 24 aa, Plasmodium falciparum
NLDNTSDDVSSSEGRNKDASQQKC

SEQ ID NO: 3333160 - protein, 17 aa, Plasmodium falciparum
NLDSTNPEQNKNLRSVS

SEQ ID NO: 3333161 - protein, 6 aa, Plasmodium falciparum
NLEDKN

SEQ ID NO: 3333162 - protein, 7 aa, Plasmodium falciparum
NLEEARK

SEQ ID NO: 3333163 - protein, 9 aa, Plasmodium falciparum
NLEEDENQD

SEQ ID NO: 3333164 - protein, 10 aa, Plasmodium falciparum
NLEEENTKNE

SEQ ID NO: 3333165 - protein, 10 aa, Plasmodium falciparum
NLEEKKKGSI

SEQ ID NO: 3333166 - protein, 9 aa, Plasmodium falciparum
NLEELKKPN

SEQ ID NO: 3333167 - protein, 7 aa, Plasmodium falciparum
NLEENED

SEQ ID NO: 3333168 - protein, 12 aa, Plasmodium falciparum
NLEETRSYPNND

SEQ ID NO: 3333169 - protein, 6 aa, Plasmodium falciparum
NLEGAS

SEQ ID NO: 3333170 - protein, 9 aa, Plasmodium falciparum
NLEGDENNI

SEQ ID NO: 3333171 - protein, 23 aa, Plasmodium falciparum
NLEGNQGFNKKPEKNKNTKGNVY

SEQ ID NO: 3333172 - protein, 4 aa, Plasmodium falciparum
NLEK

SEQ ID NO: 3333173 - protein, 11 aa, Plasmodium falciparum
NLEKDNKNNEK

SEQ ID NO: 3333174 - protein, 11 aa, Plasmodium falciparum
NLEKEKKQLQE

SEQ ID NO: 3333175 - protein, 8 aa, Plasmodium falciparum
NLEKKKNQ

SEQ ID NO: 3333176 - protein, 6 aa, Plasmodium falciparum
NLEKNA

SEQ ID NO: 3333177 - protein, 4 aa, Plasmodium falciparum
NLEN

SEQ ID NO: 3333178 - protein, 12 aa, Plasmodium falciparum
NLENKDKSIIND

SEQ ID NO: 3333179 - protein, 29 aa, Plasmodium falciparum
NLENKTSEQESQQQDEQEENQESNVESKE

SEQ ID NO: 3333180 - protein, 14 aa, Plasmodium falciparum
NLENNKNGDYGDKD

SEQ ID NO: 3333181 - protein, 8 aa, Plasmodium falciparum
NLENNSTN

SEQ ID NO: 3333182 - protein, 6 aa, Plasmodium falciparum
NLENRN

SEQ ID NO: 3333183 - protein, 5 aa, Plasmodium falciparum
NLENT

SEQ ID NO: 3333184 - protein, 5 aa, Plasmodium falciparum
NLENY

SEQ ID NO: 3333185 - protein, 5 aa, Plasmodium falciparum
NLEPY

SEQ ID NO: 3333186 - protein, 9 aa, Plasmodium falciparum
NLERRKKKK

SEQ ID NO: 3333187 - protein, 55 aa, Plasmodium falciparum
NLESNEKNTKNKLCNNDNNNNNNNKGKNTKYNTLDRKNNKNKQINDTINKEPENI

SEQ ID NO: 3333188 - protein, 8 aa, Plasmodium falciparum
NLESVESN

SEQ ID NO: 3333189 - protein, 5 aa, Plasmodium falciparum
NLETT

SEQ ID NO: 3333190 - protein, 5 aa, Plasmodium falciparum
NLGDN

SEQ ID NO: 3333191 - protein, 12 aa, Plasmodium falciparum
NLGDNNNSSNDM

SEQ ID NO: 3333192 - protein, 14 aa, Plasmodium falciparum
NLGDNQDRKNYDDI

SEQ ID NO: 3333193 - protein, 4 aa, Plasmodium falciparum
NLGG

SEQ ID NO: 3333194 - protein, 11 aa, Plasmodium falciparum
NLGNKDDYNKL

SEQ ID NO: 3333195 - protein, 7 aa, Plasmodium falciparum
NLGPKGS

SEQ ID NO: 3333196 - protein, 44 aa, Plasmodium falciparum
NLGPKKQPPMQNKELTKNANMNQPEEPNDNSAKDDTPNENQNHE

SEQ ID NO: 3333197 - protein, 4 aa, Plasmodium falciparum
NLGR

SEQ ID NO: 3333198 - protein, 6 aa, Plasmodium falciparum
NLGSSI

SEQ ID NO: 3333199 - protein, 16 aa, Plasmodium falciparum
NLGTGEFTTTKAGTPY

SEQ ID NO: 3333200 - protein, 13 aa, Plasmodium falciparum
NLHKNKKKHKNHI

SEQ ID NO: 3333201 - protein, 11 aa, Plasmodium falciparum
NLHPEDDENCT

SEQ ID NO: 3333202 - protein, 7 aa, Plasmodium falciparum
NLHPQRQ

SEQ ID NO: 3333203 - protein, 7 aa, Plasmodium falciparum
NLISDDT

SEQ ID NO: 3333204 - protein, 6 aa, Plasmodium falciparum
NLKAEK

SEQ ID NO: 3333205 - protein, 10 aa, Plasmodium falciparum
NLKDGKKGSI

SEQ ID NO: 3333206 - protein, 9 aa, Plasmodium falciparum
NLKEEEKYK

SEQ ID NO: 3333207 - protein, 7 aa, Plasmodium falciparum
NLKEGKD

SEQ ID NO: 3333208 - protein, 8 aa, Plasmodium falciparum
NLKEKKKK

SEQ ID NO: 3333209 - protein, 16 aa, Plasmodium falciparum
NLKENNKFTPAKVASN

SEQ ID NO: 3333210 - protein, 13 aa, Plasmodium falciparum
NLKENQEVETNVQ

SEQ ID NO: 3333211 - protein, 4 aa, Plasmodium falciparum
NLKK

SEQ ID NO: 3333212 - protein, 22 aa, Plasmodium falciparum
NLKKEQNTTCSKKKKKRTSTPF

SEQ ID NO: 3333213 - protein, 6 aa, Plasmodium falciparum
NLKKKN

SEQ ID NO: 3333214 - protein, 32 aa, Plasmodium falciparum
NLKLNEEKENGELKNNIDNDNIQDNNQMKTQH

SEQ ID NO: 3333215 - protein, 6 aa, Plasmodium falciparum
NLKNNE

SEQ ID NO: 3333216 - protein, 9 aa, Plasmodium falciparum
NLKNNNKTH

SEQ ID NO: 3333217 - protein, 11 aa, Plasmodium falciparum
NLKNTDDKKEL

SEQ ID NO: 3333218 - protein, 15 aa, Plasmodium falciparum
NLKSNNNDEKNCRSG

SEQ ID NO: 3333219 - protein, 9 aa, Plasmodium falciparum
NLKSQEQEI

SEQ ID NO: 3333220 - protein, 8 aa, Plasmodium falciparum
NLKTDEIN

SEQ ID NO: 3333221 - protein, 10 aa, Plasmodium falciparum
NLKTNEKKTV

SEQ ID NO: 3333222 - protein, 6 aa, Plasmodium falciparum
NLKYDE

SEQ ID NO: 3333223 - protein, 6 aa, Plasmodium falciparum
NLKYSK

SEQ ID NO: 3333224 - protein, 4 aa, Plasmodium falciparum
NLNA

SEQ ID NO: 3333225 - protein, 23 aa, Plasmodium falciparum
NLNDDEEEEEEEEEEEEEENDDY

SEQ ID NO: 3333226 - protein, 8 aa, Plasmodium falciparum
NLNDEYNN

SEQ ID NO: 3333227 - protein, 28 aa, Plasmodium falciparum
NLNDNTNDYPNDYPNDYPNDNTKDEEKN

SEQ ID NO: 3333228 - protein, 12 aa, Plasmodium falciparum
NLNDPPKVNNNE

SEQ ID NO: 3333229 - protein, 11 aa, Plasmodium falciparum
NLNDSDNVRPI

SEQ ID NO: 3333230 - protein, 8 aa, Plasmodium falciparum
NLNEKNDA

SEQ ID NO: 3333231 - protein, 9 aa, Plasmodium falciparum
NLNEKTNTI

SEQ ID NO: 3333232 - protein, 17 aa, Plasmodium falciparum
NLNEQNENQSSDKNVSI

SEQ ID NO: 3333233 - protein, 8 aa, Plasmodium falciparum
NLNESGKN

SEQ ID NO: 3333234 - protein, 11 aa, Plasmodium falciparum
NLNESGNSIEE

SEQ ID NO: 3333235 - protein, 11 aa, Plasmodium falciparum
NLNGNNSNNMN

SEQ ID NO: 3333236 - protein, 16 aa, Plasmodium falciparum
NLNGREQNNYDEERKA

SEQ ID NO: 3333237 - protein, 11 aa, Plasmodium falciparum
NLNGSGEKNFN

SEQ ID NO: 3333238 - protein, 5 aa, Plasmodium falciparum
NLNKA

SEQ ID NO: 3333239 - protein, 7 aa, Plasmodium falciparum
NLNKEEN

SEQ ID NO: 3333240 - protein, 9 aa, Plasmodium falciparum
NLNKSNNSL

SEQ ID NO: 3333241 - protein, 4 aa, Plasmodium falciparum
NLNL

SEQ ID NO: 3333242 - protein, 10 aa, Plasmodium falciparum
NLNNDKVDES

SEQ ID NO: 3333243 - protein, 5 aa, Plasmodium falciparum
NLNNE

SEQ ID NO: 3333244 - protein, 6 aa, Plasmodium falciparum
NLNNEN

SEQ ID NO: 3333245 - protein, 5 aa, Plasmodium falciparum
NLNNK

SEQ ID NO: 3333246 - protein, 13 aa, Plasmodium falciparum
NLNNKTTNTNVEN

SEQ ID NO: 3333247 - protein, 57 aa, Plasmodium falciparum
NLNNNNNNNNNNNHNNNNNNNNFDHNNRNSYKKSNYATDNSNNNNNNLNNNNNMSGT

SEQ ID NO: 3333248 - protein, 6 aa, Plasmodium falciparum
NLNNNQ

SEQ ID NO: 3333249 - protein, 9 aa, Plasmodium falciparum
NLNNPTDYN

SEQ ID NO: 3333250 - protein, 5 aa, Plasmodium falciparum
NLNNR

SEQ ID NO: 3333251 - protein, 5 aa, Plasmodium falciparum
NLNNT

SEQ ID NO: 3333252 - protein, 10 aa, Plasmodium falciparum
NLNPNKENSL

SEQ ID NO: 3333253 - protein, 10 aa, Plasmodium falciparum
NLNQGNNKSI

SEQ ID NO: 3333254 - protein, 6 aa, Plasmodium falciparum
NLNQHH

SEQ ID NO: 3333255 - protein, 10 aa, Plasmodium falciparum
NLNREDAKKR

SEQ ID NO: 3333256 - protein, 9 aa, Plasmodium falciparum
NLNREDAQK

SEQ ID NO: 3333257 - protein, 8 aa, Plasmodium falciparum
NLNSSNKN

SEQ ID NO: 3333258 - protein, 10 aa, Plasmodium falciparum
NLNTNENNVY

SEQ ID NO: 3333259 - protein, 7 aa, Plasmodium falciparum
NLNTNNK

SEQ ID NO: 3333260 - protein, 6 aa, Plasmodium falciparum
NLNTSN

SEQ ID NO: 3333261 - protein, 4 aa, Plasmodium falciparum
NLNY

SEQ ID NO: 3333262 - protein, 9 aa, Plasmodium falciparum
NLPDNKNNM

SEQ ID NO: 3333263 - protein, 14 aa, Plasmodium falciparum
NLPEDERKKYEEQA

SEQ ID NO: 3333264 - protein, 6 aa, Plasmodium falciparum
NLPEIG

SEQ ID NO: 3333265 - protein, 9 aa, Plasmodium falciparum
NLPGNSKIN

SEQ ID NO: 3333266 - protein, 7 aa, Plasmodium falciparum
NLPKSTH

SEQ ID NO: 3333267 - protein, 5 aa, Plasmodium falciparum
NLPNM

SEQ ID NO: 3333268 - protein, 27 aa, Plasmodium falciparum
NLPPPNPSVMNPSKPVGSTYGSISGGY

SEQ ID NO: 3333269 - protein, 5 aa, Plasmodium falciparum
NLPQE

SEQ ID NO: 3333270 - protein, 4 aa, Plasmodium falciparum
NLPS

SEQ ID NO: 3333271 - protein, 6 aa, Plasmodium falciparum
NLPSNG

SEQ ID NO: 3333272 - protein, 5 aa, Plasmodium falciparum
NLPYN

SEQ ID NO: 3333273 - protein, 9 aa, Plasmodium falciparum
NLQDGSIEY

SEQ ID NO: 3333274 - protein, 6 aa, Plasmodium falciparum
NLQDNE

SEQ ID NO: 3333275 - protein, 6 aa, Plasmodium falciparum
NLQDNK

SEQ ID NO: 3333276 - protein, 9 aa, Plasmodium falciparum
NLQKNKEDV

SEQ ID NO: 3333277 - protein, 6 aa, Plasmodium falciparum
NLQNPN

SEQ ID NO: 3333278 - protein, 33 aa, Plasmodium falciparum
NLQNQDKKEEDKTKNNDQRADENKTTQNKEDYQ

SEQ ID NO: 3333279 - protein, 20 aa, Plasmodium falciparum
NLQPEKEDEDNQLGEKPKDE

SEQ ID NO: 3333280 - protein, 27 aa, Plasmodium falciparum
NLQPSNDNKAKSNTYRKNKYTKKNNKF

SEQ ID NO: 3333281 - protein, 11 aa, Plasmodium falciparum
NLQPTTDMSTY

SEQ ID NO: 3333282 - protein, 7 aa, Plasmodium falciparum
NLQTNKD

SEQ ID NO: 3333283 - protein, 7 aa, Plasmodium falciparum
NLQYDNK

SEQ ID NO: 3333284 - protein, 12 aa, Plasmodium falciparum
NLQYTRKEKNIQ

SEQ ID NO: 3333285 - protein, 11 aa, Plasmodium falciparum
NLRHTDDEKDK

SEQ ID NO: 3333286 - protein, 10 aa, Plasmodium falciparum
NLRKKSKQKD

SEQ ID NO: 3333287 - protein, 4 aa, Plasmodium falciparum
NLRN

SEQ ID NO: 3333288 - protein, 13 aa, Plasmodium falciparum
NLRPKSPPRNNPN

SEQ ID NO: 3333289 - protein, 7 aa, Plasmodium falciparum
NLRPTAS

SEQ ID NO: 3333290 - protein, 7 aa, Plasmodium falciparum
NLRSDNN

SEQ ID NO: 3333291 - protein, 8 aa, Plasmodium falciparum
NLSDDTSK

SEQ ID NO: 3333292 - protein, 41 aa, Plasmodium falciparum
NLSDEDDNKNDKEQTSNYESLSDDNVSDQGKNKEKHDKKNI

SEQ ID NO: 3333293 - protein, 11 aa, Plasmodium falciparum
NLSDPSDFNES

SEQ ID NO: 3333294 - protein, 8 aa, Plasmodium falciparum
NLSEEEVQ

SEQ ID NO: 3333295 - protein, 37 aa, Plasmodium falciparum
NLSEGIKNEISEKNMENNNNNDNNKNSSALNEEQVQS

SEQ ID NO: 3333296 - protein, 6 aa, Plasmodium falciparum
NLSENL

SEQ ID NO: 3333297 - protein, 5 aa, Plasmodium falciparum
NLSEY

SEQ ID NO: 3333298 - protein, 6 aa, Plasmodium falciparum
NLSKDI

SEQ ID NO: 3333299 - protein, 12 aa, Plasmodium falciparum
NLSKKKKKKKNK

SEQ ID NO: 3333300 - protein, 17 aa, Plasmodium falciparum
NLSKKRDTRKFSDDTNI

SEQ ID NO: 3333301 - protein, 8 aa, Plasmodium falciparum
NLSKNSDD

SEQ ID NO: 3333302 - protein, 6 aa, Plasmodium falciparum
NLSNNI

SEQ ID NO: 3333303 - protein, 26 aa, Plasmodium falciparum
NLSNPNNTTDNNNNNNNNNANPGNNL

SEQ ID NO: 3333304 - protein, 14 aa, Plasmodium falciparum
NLSNSNDKCVNSKN

SEQ ID NO: 3333305 - protein, 12 aa, Plasmodium falciparum
NLSNSNNHNNNN

SEQ ID NO: 3333306 - protein, 13 aa, Plasmodium falciparum
NLSNSNSQITEMT

SEQ ID NO: 3333307 - protein, 4 aa, Plasmodium falciparum
NLSP

SEQ ID NO: 3333308 - protein, 8 aa, Plasmodium falciparum
NLSPNHGE

SEQ ID NO: 3333309 - protein, 8 aa, Plasmodium falciparum
NLSPRKEK

SEQ ID NO: 3333310 - protein, 7 aa, Plasmodium falciparum
NLSQQNV

SEQ ID NO: 3333311 - protein, 5 aa, Plasmodium falciparum
NLSQY

SEQ ID NO: 3333312 - protein, 4 aa, Plasmodium falciparum
NLSS

SEQ ID NO: 3333313 - protein, 6 aa, Plasmodium falciparum
NLSSNN

SEQ ID NO: 3333314 - protein, 6 aa, Plasmodium falciparum
NLSSQT

SEQ ID NO: 3333315 - protein, 9 aa, Plasmodium falciparum
NLSTNKNDN

SEQ ID NO: 3333316 - protein, 19 aa, Plasmodium falciparum
NLSTTSNKNNNKHNSSHNY

SEQ ID NO: 3333317 - protein, 5 aa, Plasmodium falciparum
NLTAV

SEQ ID NO: 3333318 - protein, 10 aa, Plasmodium falciparum
NLTEEEKKEK

SEQ ID NO: 3333319 - protein, 5 aa, Plasmodium falciparum
NLTEK

SEQ ID NO: 3333320 - protein, 8 aa, Plasmodium falciparum
NLTENEKE

SEQ ID NO: 3333321 - protein, 12 aa, Plasmodium falciparum
NLTGSSSSSSLV

SEQ ID NO: 3333322 - protein, 13 aa, Plasmodium falciparum
NLTHKRTEQISDN

SEQ ID NO: 3333323 - protein, 11 aa, Plasmodium falciparum
NLTKRKEVTNE

SEQ ID NO: 3333324 - protein, 4 aa, Plasmodium falciparum
NLTN

SEQ ID NO: 3333325 - protein, 5 aa, Plasmodium falciparum
NLTNT

SEQ ID NO: 3333326 - protein, 5 aa, Plasmodium falciparum
NLTPK

SEQ ID NO: 3333327 - protein, 5 aa, Plasmodium falciparum
NLTSN

SEQ ID NO: 3333328 - protein, 4 aa, Plasmodium falciparum
NLVD

SEQ ID NO: 3333329 - protein, 7 aa, Plasmodium falciparum
NLYEKKD

SEQ ID NO: 3333330 - protein, 13 aa, Plasmodium falciparum
NLYNNNNNNTSGT

SEQ ID NO: 3333331 - protein, 52 aa, Plasmodium falciparum
NLYSPNKVTSINNNKMDQKNKNHKGNNKSSNNNNNNNNNNNNSCSSSSNNSM

SEQ ID NO: 3333332 - protein, 4 aa, Plasmodium falciparum
NMAS

SEQ ID NO: 3333333 - protein, 18 aa, Plasmodium falciparum
NMDASNNYNQGDISGNNN

SEQ ID NO: 3333334 - protein, 7 aa, Plasmodium falciparum
NMDDDDK

SEQ ID NO: 3333335 - protein, 10 aa, Plasmodium falciparum
NMDDDNNKSS

SEQ ID NO: 3333336 - protein, 13 aa, Plasmodium falciparum
NMDDETADEINDD

SEQ ID NO: 3333337 - protein, 5 aa, Plasmodium falciparum
NMDDT

SEQ ID NO: 3333338 - protein, 11 aa, Plasmodium falciparum
NMDDTSSNNEV

SEQ ID NO: 3333339 - protein, 12 aa, Plasmodium falciparum
NMDEEKKTNESL

SEQ ID NO: 3333340 - protein, 8 aa, Plasmodium falciparum
NMDEENNT

SEQ ID NO: 3333341 - protein, 10 aa, Plasmodium falciparum
NMDENNKDTK

SEQ ID NO: 3333342 - protein, 8 aa, Plasmodium falciparum
NMDKDKDN

SEQ ID NO: 3333343 - protein, 12 aa, Plasmodium falciparum
NMDKGSNAKKTN

SEQ ID NO: 3333344 - protein, 14 aa, Plasmodium falciparum
NMDKSNMKEENDDI

SEQ ID NO: 3333345 - protein, 7 aa, Plasmodium falciparum
NMDNNGS

SEQ ID NO: 3333346 - protein, 11 aa, Plasmodium falciparum
NMDNNKNINYN

SEQ ID NO: 3333347 - protein, 55 aa, Plasmodium falciparum
NMDSDNNIDSDNNFDSDNNIDSDNNIDSDNNIDSNNNFDSNNKDKMNEKHDTETR

SEQ ID NO: 3333348 - protein, 32 aa, Plasmodium falciparum
NMDSNKGNTYVDEEPIDSTKNNRNDNISNKNV

SEQ ID NO: 3333349 - protein, 8 aa, Plasmodium falciparum
NMDTESVK

SEQ ID NO: 3333350 - protein, 6 aa, Plasmodium falciparum
NMDTSE

SEQ ID NO: 3333351 - protein, 21 aa, Plasmodium falciparum
NMDVDNDDNNNNYNNVSTDEG

SEQ ID NO: 3333352 - protein, 6 aa, Plasmodium falciparum
NMEAER

SEQ ID NO: 3333353 - protein, 13 aa, Plasmodium falciparum
NMEDDNKKDYMND

SEQ ID NO: 3333354 - protein, 14 aa, Plasmodium falciparum
NMEEEQRDYNNSSQ

SEQ ID NO: 3333355 - protein, 16 aa, Plasmodium falciparum
NMEENRSYSNNDNASK

SEQ ID NO: 3333356 - protein, 21 aa, Plasmodium falciparum
NMEEYSSSQLNDENQCENKRV

SEQ ID NO: 3333357 - protein, 4 aa, Plasmodium falciparum
NMEG

SEQ ID NO: 3333358 - protein, 4 aa, Plasmodium falciparum
NMEN

SEQ ID NO: 3333359 - protein, 7 aa, Plasmodium falciparum
NMENDMN

SEQ ID NO: 3333360 - protein, 10 aa, Plasmodium falciparum
NMGEGKENHG

SEQ ID NO: 3333361 - protein, 5 aa, Plasmodium falciparum
NMGGD

SEQ ID NO: 3333362 - protein, 26 aa, Plasmodium falciparum
NMGNANNNNNNNAVNTNFNNNNNNGN

SEQ ID NO: 3333363 - protein, 5 aa, Plasmodium falciparum
NMGPE

SEQ ID NO: 3333364 - protein, 12 aa, Plasmodium falciparum
NMGPNEKNNEYI

SEQ ID NO: 3333365 - protein, 16 aa, Plasmodium falciparum
NMGSNPSNLNNNMNNN

SEQ ID NO: 3333366 - protein, 10 aa, Plasmodium falciparum
NMHNNNCRNT

SEQ ID NO: 3333367 - protein, 21 aa, Plasmodium falciparum
NMHNNNNNNNNIYNSSNNYNG

SEQ ID NO: 3333368 - protein, 6 aa, Plasmodium falciparum
NMHNTN

SEQ ID NO: 3333369 - protein, 4 aa, Plasmodium falciparum
NMIN

SEQ ID NO: 3333370 - protein, 16 aa, Plasmodium falciparum
NMKDGKNLDSLNDDIG

SEQ ID NO: 3333371 - protein, 7 aa, Plasmodium falciparum
NMKEKNE

SEQ ID NO: 3333372 - protein, 6 aa, Plasmodium falciparum
NMKENE

SEQ ID NO: 3333373 - protein, 8 aa, Plasmodium falciparum
NMKEPNDD

SEQ ID NO: 3333374 - protein, 8 aa, Plasmodium falciparum
NMKETNDE

SEQ ID NO: 3333375 - protein, 10 aa, Plasmodium falciparum
NMKKDEKKNM

SEQ ID NO: 3333376 - protein, 17 aa, Plasmodium falciparum
NMKKKADKLNQEYDEKN

SEQ ID NO: 3333377 - protein, 14 aa, Plasmodium falciparum
NMKKNKKKTIKNKR

SEQ ID NO: 3333378 - protein, 20 aa, Plasmodium falciparum
NMKNENYDNNNNNNNKNNTC

SEQ ID NO: 3333379 - protein, 18 aa, Plasmodium falciparum
NMKNSNKKISSNDPEEAQ

SEQ ID NO: 3333380 - protein, 8 aa, Plasmodium falciparum
NMKNTNQF

SEQ ID NO: 3333381 - protein, 4 aa, Plasmodium falciparum
NMLT

SEQ ID NO: 3333382 - protein, 4 aa, Plasmodium falciparum
NMND

SEQ ID NO: 3333383 - protein, 33 aa, Plasmodium falciparum
NMNDEKDQDKKKKKENKNKKSKKKKNDNNNVDG

SEQ ID NO: 3333384 - protein, 13 aa, Plasmodium falciparum
NMNDNMNDNMNDN

SEQ ID NO: 3333385 - protein, 7 aa, Plasmodium falciparum
NMNDNNM

SEQ ID NO: 3333386 - protein, 16 aa, Plasmodium falciparum
NMNDQNGNNNNNNNNI

SEQ ID NO: 3333387 - protein, 25 aa, Plasmodium falciparum
NMNDSTSDYEEDRESDNSSVSSPHS

SEQ ID NO: 3333388 - protein, 11 aa, Plasmodium falciparum
NMNEPTTELNR

SEQ ID NO: 3333389 - protein, 5 aa, Plasmodium falciparum
NMNGN

SEQ ID NO: 3333390 - protein, 8 aa, Plasmodium falciparum
NMNGTENN

SEQ ID NO: 3333391 - protein, 6 aa, Plasmodium falciparum
NMNKDE

SEQ ID NO: 3333392 - protein, 42 aa, Plasmodium falciparum
NMNKENKENKEKEKNLDETNKTHQTHQTHQTIQSNQSNQSNG

SEQ ID NO: 3333393 - protein, 10 aa, Plasmodium falciparum
NMNKKEHKEV

SEQ ID NO: 3333394 - protein, 76 aa, Plasmodium falciparum
NMNKKKIGKDSTINNNNNNNNNTGNNEAINEDVNNENRADDNVKTVEGENHEKKEGGNKNEKKDEEKRNDEGNHSN

SEQ ID NO: 3333395 - protein, 11 aa, Plasmodium falciparum
NMNKSGESEIA

SEQ ID NO: 3333396 - protein, 7 aa, Plasmodium falciparum
NMNKSGP

SEQ ID NO: 3333397 - protein, 4 aa, Plasmodium falciparum
NMNM

SEQ ID NO: 3333398 - protein, 7 aa, Plasmodium falciparum
NMNNDDN

SEQ ID NO: 3333399 - protein, 39 aa, Plasmodium falciparum
NMNNDNDNKCGDNECGDNKCGDNECGDNKCGDNKCGDNY

SEQ ID NO: 3333400 - protein, 21 aa, Plasmodium falciparum
NMNNENNYDEQINEDENINGY

SEQ ID NO: 3333401 - protein, 9 aa, Plasmodium falciparum
NMNNGNGYY

SEQ ID NO: 3333402 - protein, 5 aa, Plasmodium falciparum
NMNNN

SEQ ID NO: 3333403 - protein, 9 aa, Plasmodium falciparum
NMNNNNNNI

SEQ ID NO: 3333404 - protein, 24 aa, Plasmodium falciparum
NMNNNNNNNNNNNNNNNNSNISDD

SEQ ID NO: 3333405 - protein, 14 aa, Plasmodium falciparum
NMNNNNNNSNSNSF

SEQ ID NO: 3333406 - protein, 5 aa, Plasmodium falciparum
NMNNS

SEQ ID NO: 3333407 - protein, 39 aa, Plasmodium falciparum
NMNNSEYTNNHNNNHNNNHNNINSNDHNDDNLKNNNQCN

SEQ ID NO: 3333408 - protein, 16 aa, Plasmodium falciparum
NMNNTNNNNNNNNNIN

SEQ ID NO: 3333409 - protein, 6 aa, Plasmodium falciparum
NMNPGE

SEQ ID NO: 3333410 - protein, 4 aa, Plasmodium falciparum
NMNS

SEQ ID NO: 3333411 - protein, 384 aa, Plasmodium falciparum
NMNSDKDEKDDDDDEKDDDDDEKDDDDDEKDDDDDEKDDDDGEKDDDDDEKDDDDDEKDDDDDEKDDDDDEKDDDDDEKHDDDDEKDDNDDEKYDDDDEKDDNDDENDDEKYDDDDENDDEKYDDDDENDDKDDDENDDEKDDDEKDDDENDDNEDDDENDDKDDDEDDDENDDNEDDNEDDDENDDDENDDNEDDDENDDKDDDDNDDNEDDDENDDDEDDDENDDNEDDDENDDKDDDDNDDDEDDDENDDNEDDDENDDNEDDDENDDDEDDDENDDENDDDEDDDENDDDEDDDENDDKDDDDNDDDDYNDDDYNDDDYNDDDYNDDDYNDDDYNEDDYNDDDYNEDDYNDDDYNEDDYNDDDYNNNNNNDNNLKNNYSL

SEQ ID NO: 3333412 - protein, 29 aa, Plasmodium falciparum
NMNSKGNTERYNNNINNNNNNNNNNSSYN

SEQ ID NO: 3333413 - protein, 13 aa, Plasmodium falciparum
NMNSNELERKDND

SEQ ID NO: 3333414 - protein, 18 aa, Plasmodium falciparum
NMNSNKKTNDNNKNLNNE

SEQ ID NO: 3333415 - protein, 19 aa, Plasmodium falciparum
NMNSNNNNNNNNNSSSNES

SEQ ID NO: 3333416 - protein, 15 aa, Plasmodium falciparum
NMNSNNSYNIKGGDN

SEQ ID NO: 3333417 - protein, 7 aa, Plasmodium falciparum
NMNSNTT

SEQ ID NO: 3333418 - protein, 5 aa, Plasmodium falciparum
NMNSQ

SEQ ID NO: 3333419 - protein, 8 aa, Plasmodium falciparum
NMNSTNNI

SEQ ID NO: 3333420 - protein, 13 aa, Plasmodium falciparum
NMNSTTRQNNNNI

SEQ ID NO: 3333421 - protein, 15 aa, Plasmodium falciparum
NMNTKKENNKSEKKC

SEQ ID NO: 3333422 - protein, 26 aa, Plasmodium falciparum
NMNTKNDQNYLNPSEYSEQARNNDNT

SEQ ID NO: 3333423 - protein, 5 aa, Plasmodium falciparum
NMNTR

SEQ ID NO: 3333424 - protein, 7 aa, Plasmodium falciparum
NMNVNEN

SEQ ID NO: 3333425 - protein, 12 aa, Plasmodium falciparum
NMNYSSDNSYVD

SEQ ID NO: 3333426 - protein, 5 aa, Plasmodium falciparum
NMPGE

SEQ ID NO: 3333427 - protein, 4 aa, Plasmodium falciparum
NMPQ

SEQ ID NO: 3333428 - protein, 19 aa, Plasmodium falciparum
NMPRDSDYPIGSNRDEGTE

SEQ ID NO: 3333429 - protein, 5 aa, Plasmodium falciparum
NMPST

SEQ ID NO: 3333430 - protein, 11 aa, Plasmodium falciparum
NMPYSHKENND

SEQ ID NO: 3333431 - protein, 11 aa, Plasmodium falciparum
NMQKEPYKNNK

SEQ ID NO: 3333432 - protein, 12 aa, Plasmodium falciparum
NMRSSTNKETLD

SEQ ID NO: 3333433 - protein, 5 aa, Plasmodium falciparum
NMSDH

SEQ ID NO: 3333434 - protein, 11 aa, Plasmodium falciparum
NMSGLGKGTAM

SEQ ID NO: 3333435 - protein, 16 aa, Plasmodium falciparum
NMSKEEEQKKENHQIN

SEQ ID NO: 3333436 - protein, 7 aa, Plasmodium falciparum
NMSNENT

SEQ ID NO: 3333437 - protein, 8 aa, Plasmodium falciparum
NMSNGNLG

SEQ ID NO: 3333438 - protein, 13 aa, Plasmodium falciparum
NMSNHDKKNDQVL

SEQ ID NO: 3333439 - protein, 11 aa, Plasmodium falciparum
NMSNNNSSNNN

SEQ ID NO: 3333440 - protein, 11 aa, Plasmodium falciparum
NMSNSDYKNNF

SEQ ID NO: 3333441 - protein, 7 aa, Plasmodium falciparum
NMSPDTL

SEQ ID NO: 3333442 - protein, 8 aa, Plasmodium falciparum
NMSQNMSK

SEQ ID NO: 3333443 - protein, 22 aa, Plasmodium falciparum
NMSRNDPSNDIQNNSNNGPKRM

SEQ ID NO: 3333444 - protein, 11 aa, Plasmodium falciparum
NMSSDENENMN

SEQ ID NO: 3333445 - protein, 6 aa, Plasmodium falciparum
NMSSEK

SEQ ID NO: 3333446 - protein, 8 aa, Plasmodium falciparum
NMSSGELK

SEQ ID NO: 3333447 - protein, 8 aa, Plasmodium falciparum
NMSSNEND

SEQ ID NO: 3333448 - protein, 9 aa, Plasmodium falciparum
NMSSNMSSN

SEQ ID NO: 3333449 - protein, 14 aa, Plasmodium falciparum
NMSSSDEVKNRHVE

SEQ ID NO: 3333450 - protein, 17 aa, Plasmodium falciparum
NMSSYSKINKNANIKYK

SEQ ID NO: 3333451 - protein, 7 aa, Plasmodium falciparum
NMSTENS

SEQ ID NO: 3333452 - protein, 5 aa, Plasmodium falciparum
NMSTG

SEQ ID NO: 3333453 - protein, 9 aa, Plasmodium falciparum
NMSTSSKKY

SEQ ID NO: 3333454 - protein, 11 aa, Plasmodium falciparum
NMTDSKEVPKS

SEQ ID NO: 3333455 - protein, 5 aa, Plasmodium falciparum
NMTKD

SEQ ID NO: 3333456 - protein, 13 aa, Plasmodium falciparum
NMTKNEDSDNNYN

SEQ ID NO: 3333457 - protein, 7 aa, Plasmodium falciparum
NMTNGQE

SEQ ID NO: 3333458 - protein, 8 aa, Plasmodium falciparum
NMTPDKCS

SEQ ID NO: 3333459 - protein, 16 aa, Plasmodium falciparum
NMTQHNKKFSHSYSRN

SEQ ID NO: 3333460 - protein, 22 aa, Plasmodium falciparum
NMTTTNGSINYSSNNNNNNNIE

SEQ ID NO: 3333461 - protein, 24 aa, Plasmodium falciparum
NMVKGKGSNAKGRRRKRKKNMNEC

SEQ ID NO: 3333462 - protein, 14 aa, Plasmodium falciparum
NMVPYSDDKDKDKI

SEQ ID NO: 3333463 - protein, 5 aa, Plasmodium falciparum
NMYEQ

SEQ ID NO: 3333464 - protein, 6 aa, Plasmodium falciparum
NNADDN

SEQ ID NO: 3333465 - protein, 9 aa, Plasmodium falciparum
NNADEFSAS

SEQ ID NO: 3333466 - protein, 15 aa, Plasmodium falciparum
NNADHNKCSDNSSDY

SEQ ID NO: 3333467 - protein, 9 aa, Plasmodium falciparum
NNAEKRGRR

SEQ ID NO: 3333468 - protein, 5 aa, Plasmodium falciparum
NNAET

SEQ ID NO: 3333469 - protein, 7 aa, Plasmodium falciparum
NNAETIN

SEQ ID NO: 3333470 - protein, 5 aa, Plasmodium falciparum
NNAEV

SEQ ID NO: 3333471 - protein, 8 aa, Plasmodium falciparum
NNAGNKDV

SEQ ID NO: 3333472 - protein, 10 aa, Plasmodium falciparum
NNAGNNLNGE

SEQ ID NO: 3333473 - protein, 4 aa, Plasmodium falciparum
NNAH

SEQ ID NO: 3333474 - protein, 9 aa, Plasmodium falciparum
NNANGNYNN

SEQ ID NO: 3333475 - protein, 29 aa, Plasmodium falciparum
NNANLSKARSRVSYSSQNKRRCSSGINKN

SEQ ID NO: 3333476 - protein, 5 aa, Plasmodium falciparum
NNANN

SEQ ID NO: 3333477 - protein, 31 aa, Plasmodium falciparum
NNANNINNADNINNADNINNADNINNEDNIN

SEQ ID NO: 3333478 - protein, 8 aa, Plasmodium falciparum
NNANNNKL

SEQ ID NO: 3333479 - protein, 6 aa, Plasmodium falciparum
NNANNT

SEQ ID NO: 3333480 - protein, 6 aa, Plasmodium falciparum
NNANSG

SEQ ID NO: 3333481 - protein, 10 aa, Plasmodium falciparum
NNAPATSTNI

SEQ ID NO: 3333482 - protein, 24 aa, Plasmodium falciparum
NNAQQGAQQEQPNNENKAEENKDN

SEQ ID NO: 3333483 - protein, 5 aa, Plasmodium falciparum
NNASK

SEQ ID NO: 3333484 - protein, 6 aa, Plasmodium falciparum
NNASKK

SEQ ID NO: 3333485 - protein, 17 aa, Plasmodium falciparum
NNASLNESNDEENEDEY

SEQ ID NO: 3333486 - protein, 12 aa, Plasmodium falciparum
NNASNNSLNLQS

SEQ ID NO: 3333487 - protein, 9 aa, Plasmodium falciparum
NNASPATVS

SEQ ID NO: 3333488 - protein, 5 aa, Plasmodium falciparum
NNASV

SEQ ID NO: 3333489 - protein, 4 aa, Plasmodium falciparum
NNAT

SEQ ID NO: 3333490 - protein, 6 aa, Plasmodium falciparum
NNAVDY

SEQ ID NO: 3333491 - protein, 17 aa, Plasmodium falciparum
NNAYPNDPFNNANNSLP

SEQ ID NO: 3333492 - protein, 13 aa, Plasmodium falciparum
NNCADEKGIHENY

SEQ ID NO: 3333493 - protein, 4 aa, Plasmodium falciparum
NNCD

SEQ ID NO: 3333494 - protein, 17 aa, Plasmodium falciparum
NNCDTSHNNNNNSIHGD

SEQ ID NO: 3333495 - protein, 14 aa, Plasmodium falciparum
NNCNSNNNNNNNNM

SEQ ID NO: 3333496 - protein, 7 aa, Plasmodium falciparum
NNCSDKN

SEQ ID NO: 3333497 - protein, 7 aa, Plasmodium falciparum
NNCSSKC

SEQ ID NO: 3333498 - protein, 6 aa, Plasmodium falciparum
NNCTNT

SEQ ID NO: 3333499 - protein, 8 aa, Plasmodium falciparum
NNDCRPNS

SEQ ID NO: 3333500 - protein, 4 aa, Plasmodium falciparum
NNDD

SEQ ID NO: 3333501 - protein, 17 aa, Plasmodium falciparum
NNDDDDNMYNSDKQNRL

SEQ ID NO: 3333502 - protein, 26 aa, Plasmodium falciparum
NNDDDKMINSTDHRKSASNNIHNGKR

SEQ ID NO: 3333503 - protein, 7 aa, Plasmodium falciparum
NNDDDYK

SEQ ID NO: 3333504 - protein, 28 aa, Plasmodium falciparum
NNDDEEGANNSLDGSKENVKEYNKHDDH

SEQ ID NO: 3333505 - protein, 11 aa, Plasmodium falciparum
NNDDEKDENKL

SEQ ID NO: 3333506 - protein, 5 aa, Plasmodium falciparum
NNDDH

SEQ ID NO: 3333507 - protein, 5 aa, Plasmodium falciparum
NNDDI

SEQ ID NO: 3333508 - protein, 8 aa, Plasmodium falciparum
NNDDINDP

SEQ ID NO: 3333509 - protein, 105 aa, Plasmodium falciparum
NNDDKKKKKKKKKKKSKNNNNDDNEKNGNQDVKDEEDGDDEEDEDDDDDDEDDDDEEDDDDEDDDDDEEDDDEEDDENDNEKKNKKKNKKNKKKNKKKDNKKPNV

SEQ ID NO: 3333510 - protein, 5 aa, Plasmodium falciparum
NNDDL

SEQ ID NO: 3333511 - protein, 47 aa, Plasmodium falciparum
NNDDNDDNDDNDENNGDNNNNNDDNNNNNDDNNNKNNDDDNNNTYEL

SEQ ID NO: 3333512 - protein, 30 aa, Plasmodium falciparum
NNDDNDDNNDNNNDNNNDNNNNNYFDDSKK

SEQ ID NO: 3333513 - protein, 34 aa, Plasmodium falciparum
NNDDNNDNNNNNNNNNNNNNNNNNNNDDDDNKSY

SEQ ID NO: 3333514 - protein, 16 aa, Plasmodium falciparum
NNDDNNNDEDDDDDDE

SEQ ID NO: 3333515 - protein, 8 aa, Plasmodium falciparum
NNDDNNRY

SEQ ID NO: 3333516 - protein, 7 aa, Plasmodium falciparum
NNDDNSS

SEQ ID NO: 3333517 - protein, 32 aa, Plasmodium falciparum
NNDDNVQYEDNGPYINQSNNNNNNNNKDNKFD

SEQ ID NO: 3333518 - protein, 7 aa, Plasmodium falciparum
NNDDPIN

SEQ ID NO: 3333519 - protein, 8 aa, Plasmodium falciparum
NNDDQDKY

SEQ ID NO: 3333520 - protein, 56 aa, Plasmodium falciparum
NNDDSKTKGSNNDVADVNSKDGNKLKKGIEEENPDASLNTKDEEDNNASTTGSNNI

SEQ ID NO: 3333521 - protein, 7 aa, Plasmodium falciparum
NNDDTND

SEQ ID NO: 3333522 - protein, 7 aa, Plasmodium falciparum
NNDEAEN

SEQ ID NO: 3333523 - protein, 5 aa, Plasmodium falciparum
NNDEE

SEQ ID NO: 3333524 - protein, 6 aa, Plasmodium falciparum
NNDEEE

SEQ ID NO: 3333525 - protein, 14 aa, Plasmodium falciparum
NNDEEKEKKTSDKL

SEQ ID NO: 3333526 - protein, 7 aa, Plasmodium falciparum
NNDEEKI

SEQ ID NO: 3333527 - protein, 7 aa, Plasmodium falciparum
NNDEETS

SEQ ID NO: 3333528 - protein, 10 aa, Plasmodium falciparum
NNDEGKHMES

SEQ ID NO: 3333529 - protein, 5 aa, Plasmodium falciparum
NNDEI

SEQ ID NO: 3333530 - protein, 8 aa, Plasmodium falciparum
NNDEKEKV

SEQ ID NO: 3333531 - protein, 6 aa, Plasmodium falciparum
NNDEKK

SEQ ID NO: 3333532 - protein, 9 aa, Plasmodium falciparum
NNDEKKNTK

SEQ ID NO: 3333533 - protein, 6 aa, Plasmodium falciparum
NNDEKL

SEQ ID NO: 3333534 - protein, 10 aa, Plasmodium falciparum
NNDENKKKLK

SEQ ID NO: 3333535 - protein, 22 aa, Plasmodium falciparum
NNDEQNKKNNDTNVETQNDSSV

SEQ ID NO: 3333536 - protein, 21 aa, Plasmodium falciparum
NNDERYNQENEKEKNYTENKE

SEQ ID NO: 3333537 - protein, 57 aa, Plasmodium falciparum
NNDETFDSRSKHSGDEEDEGYDKSDIKEENNNIKKKHNSKKKEKRKDGHKNKDTNID

SEQ ID NO: 3333538 - protein, 4 aa, Plasmodium falciparum
NNDF

SEQ ID NO: 3333539 - protein, 9 aa, Plasmodium falciparum
NNDGDQSYE

SEQ ID NO: 3333540 - protein, 39 aa, Plasmodium falciparum
NNDGEENHVDQEGHGHGHRSRHRQRQRRQQEDEDNHRSI

SEQ ID NO: 3333541 - protein, 5 aa, Plasmodium falciparum
NNDGK

SEQ ID NO: 3333542 - protein, 6 aa, Plasmodium falciparum
NNDGQN

SEQ ID NO: 3333543 - protein, 5 aa, Plasmodium falciparum
NNDHI

SEQ ID NO: 3333544 - protein, 9 aa, Plasmodium falciparum
NNDHNNNNI

SEQ ID NO: 3333545 - protein, 5 aa, Plasmodium falciparum
NNDHS

SEQ ID NO: 3333546 - protein, 5 aa, Plasmodium falciparum
NNDHY

SEQ ID NO: 3333547 - protein, 6 aa, Plasmodium falciparum
NNDIDE

SEQ ID NO: 3333548 - protein, 28 aa, Plasmodium falciparum
NNDIDEDDDEERDDEEGANYYKEDEEEK

SEQ ID NO: 3333549 - protein, 5 aa, Plasmodium falciparum
NNDIE

SEQ ID NO: 3333550 - protein, 6 aa, Plasmodium falciparum
NNDIET

SEQ ID NO: 3333551 - protein, 16 aa, Plasmodium falciparum
NNDIKNNNIKNNNTRF

SEQ ID NO: 3333552 - protein, 8 aa, Plasmodium falciparum
NNDINEKS

SEQ ID NO: 3333553 - protein, 26 aa, Plasmodium falciparum
NNDIQKENDINKKNKKKHKKKKKQSI

SEQ ID NO: 3333554 - protein, 4 aa, Plasmodium falciparum
NNDK

SEQ ID NO: 3333555 - protein, 22 aa, Plasmodium falciparum
NNDKCDDNNKCDDNDKCDEKTA

SEQ ID NO: 3333556 - protein, 9 aa, Plasmodium falciparum
NNDKDELTV

SEQ ID NO: 3333557 - protein, 10 aa, Plasmodium falciparum
NNDKDGKYQY

SEQ ID NO: 3333558 - protein, 25 aa, Plasmodium falciparum
NNDKEDNVETKKDLEEEKKKKKKKK

SEQ ID NO: 3333559 - protein, 18 aa, Plasmodium falciparum
NNDKEHIRSNSSNEESFT

SEQ ID NO: 3333560 - protein, 21 aa, Plasmodium falciparum
NNDKEQNSHNQLSSPKKYNNN

SEQ ID NO: 3333561 - protein, 11 aa, Plasmodium falciparum
NNDKESKENNI

SEQ ID NO: 3333562 - protein, 5 aa, Plasmodium falciparum
NNDKK

SEQ ID NO: 3333563 - protein, 7 aa, Plasmodium falciparum
NNDKKDH

SEQ ID NO: 3333564 - protein, 34 aa, Plasmodium falciparum
NNDKKKKDDIDNDEEKEEKKNQSDDKNNVKYSNK

SEQ ID NO: 3333565 - protein, 9 aa, Plasmodium falciparum
NNDKNDTNV

SEQ ID NO: 3333566 - protein, 12 aa, Plasmodium falciparum
NNDKRDDENGMA

SEQ ID NO: 3333567 - protein, 6 aa, Plasmodium falciparum
NNDKSN

SEQ ID NO: 3333568 - protein, 8 aa, Plasmodium falciparum
NNDKTAKH

SEQ ID NO: 3333569 - protein, 11 aa, Plasmodium falciparum
NNDKTNEDHTR

SEQ ID NO: 3333570 - protein, 6 aa, Plasmodium falciparum
NNDKVI

SEQ ID NO: 3333571 - protein, 6 aa, Plasmodium falciparum
NNDKVN

SEQ ID NO: 3333572 - protein, 9 aa, Plasmodium falciparum
NNDKYDEDQ

SEQ ID NO: 3333573 - protein, 15 aa, Plasmodium falciparum
NNDLADKKDHSDKIE

SEQ ID NO: 3333574 - protein, 9 aa, Plasmodium falciparum
NNDLEKNEN

SEQ ID NO: 3333575 - protein, 7 aa, Plasmodium falciparum
NNDLNQD

SEQ ID NO: 3333576 - protein, 13 aa, Plasmodium falciparum
NNDLSEDSDDYNN

SEQ ID NO: 3333577 - protein, 5 aa, Plasmodium falciparum
NNDME

SEQ ID NO: 3333578 - protein, 20 aa, Plasmodium falciparum
NNDNDDDKNQYEEDSNAHLT

SEQ ID NO: 3333579 - protein, 13 aa, Plasmodium falciparum
NNDNDKKQNSYDI

SEQ ID NO: 3333580 - protein, 7 aa, Plasmodium falciparum
NNDNDNL

SEQ ID NO: 3333581 - protein, 21 aa, Plasmodium falciparum
NNDNDSSKNNNNNNNNRNENE

SEQ ID NO: 3333582 - protein, 9 aa, Plasmodium falciparum
NNDNEKYDN

SEQ ID NO: 3333583 - protein, 7 aa, Plasmodium falciparum
NNDNFKT

SEQ ID NO: 3333584 - protein, 34 aa, Plasmodium falciparum
NNDNIDNDKHIEKKKKDENYNEYKKNNKSSTVDH

SEQ ID NO: 3333585 - protein, 8 aa, Plasmodium falciparum
NNDNINGN

SEQ ID NO: 3333586 - protein, 8 aa, Plasmodium falciparum
NNDNINKE

SEQ ID NO: 3333587 - protein, 9 aa, Plasmodium falciparum
NNDNINNDN

SEQ ID NO: 3333588 - protein, 14 aa, Plasmodium falciparum
NNDNINNDNINNDD

SEQ ID NO: 3333589 - protein, 18 aa, Plasmodium falciparum
NNDNINNDNINNHGEEYH

SEQ ID NO: 3333590 - protein, 5 aa, Plasmodium falciparum
NNDNK

SEQ ID NO: 3333591 - protein, 37 aa, Plasmodium falciparum
NNDNKNNDNINNNNNLNNSTYNNMNSHNNNNNNNNNN

SEQ ID NO: 3333592 - protein, 16 aa, Plasmodium falciparum
NNDNMNTYNNNNNNIL

SEQ ID NO: 3333593 - protein, 10 aa, Plasmodium falciparum
NNDNNDSEIS

SEQ ID NO: 3333594 - protein, 19 aa, Plasmodium falciparum
NNDNNEKENVSHNEHTDIE

SEQ ID NO: 3333595 - protein, 8 aa, Plasmodium falciparum
NNDNNEKN

SEQ ID NO: 3333596 - protein, 6 aa, Plasmodium falciparum
NNDNNI

SEQ ID NO: 3333597 - protein, 16 aa, Plasmodium falciparum
NNDNNNDNDNIDNHNN

SEQ ID NO: 3333598 - protein, 89 aa, Plasmodium falciparum
NNDNNNENNNNNNNNENNNNNISNNNNNISNNNNNNISNNNNNSSNNNNNNCSNNNNSSSNNNNSSSNNKNNNLNSNLNSNNNNNIYQD

SEQ ID NO: 3333599 - protein, 10 aa, Plasmodium falciparum
NNDNNNNMNY

SEQ ID NO: 3333600 - protein, 11 aa, Plasmodium falciparum
NNDNNNNNKVR

SEQ ID NO: 3333601 - protein, 10 aa, Plasmodium falciparum
NNDNNNNNNN

SEQ ID NO: 3333602 - protein, 28 aa, Plasmodium falciparum
NNDNNNNNNNNNNIGDSKLRKKRGESFN

SEQ ID NO: 3333603 - protein, 14 aa, Plasmodium falciparum
NNDNNYNNNNKNEH

SEQ ID NO: 3333604 - protein, 43 aa, Plasmodium falciparum
NNDNPKRDSNNNSNNNNNNNINNNNSNSHSNSFSNSQDDADDD

SEQ ID NO: 3333605 - protein, 9 aa, Plasmodium falciparum
NNDNQEEKK

SEQ ID NO: 3333606 - protein, 6 aa, Plasmodium falciparum
NNDNQF

SEQ ID NO: 3333607 - protein, 9 aa, Plasmodium falciparum
NNDNRNDKN

SEQ ID NO: 3333608 - protein, 23 aa, Plasmodium falciparum
NNDNSHRAKRSLNDDTNDSKKQK

SEQ ID NO: 3333609 - protein, 6 aa, Plasmodium falciparum
NNDNSY

SEQ ID NO: 3333610 - protein, 9 aa, Plasmodium falciparum
NNDNTEKEI

SEQ ID NO: 3333611 - protein, 62 aa, Plasmodium falciparum
NNDNTIVSNNDNEDNSNHTTNNNEQDKDDKNNNMKTEGNHSKFSKQHGNMNTRNKNNDKNNF

SEQ ID NO: 3333612 - protein, 28 aa, Plasmodium falciparum
NNDNTNGNINSYTNDDIHNNGSLQGYEQ

SEQ ID NO: 3333613 - protein, 26 aa, Plasmodium falciparum
NNDNTNMDTTTKNNNNMNNNNNMNNN

SEQ ID NO: 3333614 - protein, 9 aa, Plasmodium falciparum
NNDNTNSKV

SEQ ID NO: 3333615 - protein, 6 aa, Plasmodium falciparum
NNDNTS

SEQ ID NO: 3333616 - protein, 20 aa, Plasmodium falciparum
NNDNYSSQSCNEKRERYSNY

SEQ ID NO: 3333617 - protein, 17 aa, Plasmodium falciparum
NNDPNNNNNNNNNPSIT

SEQ ID NO: 3333618 - protein, 6 aa, Plasmodium falciparum
NNDQEI

SEQ ID NO: 3333619 - protein, 12 aa, Plasmodium falciparum
NNDQKKEEKEAL

SEQ ID NO: 3333620 - protein, 35 aa, Plasmodium falciparum
NNDQREDQHVKQQQKDNININDNNDDNDDNDNIRD

SEQ ID NO: 3333621 - protein, 8 aa, Plasmodium falciparum
NNDQTNHT

SEQ ID NO: 3333622 - protein, 9 aa, Plasmodium falciparum
NNDQYTNSD

SEQ ID NO: 3333623 - protein, 18 aa, Plasmodium falciparum
NNDRDGLKNMDDEEGYDN

SEQ ID NO: 3333624 - protein, 19 aa, Plasmodium falciparum
NNDRNKNNHVSNNKSNKPI

SEQ ID NO: 3333625 - protein, 8 aa, Plasmodium falciparum
NNDRTKKK

SEQ ID NO: 3333626 - protein, 8 aa, Plasmodium falciparum
NNDSGEDI

SEQ ID NO: 3333627 - protein, 9 aa, Plasmodium falciparum
NNDSGPKFT

SEQ ID NO: 3333628 - protein, 16 aa, Plasmodium falciparum
NNDSLDKKKNNNEQKK

SEQ ID NO: 3333629 - protein, 42 aa, Plasmodium falciparum
NNDSNLSNDEEEHSVDDEGSINNDNDNNDNNDNKKEKKKGYE

SEQ ID NO: 3333630 - protein, 8 aa, Plasmodium falciparum
NNDSNMNS

SEQ ID NO: 3333631 - protein, 28 aa, Plasmodium falciparum
NNDSNNSSNNISRCNSRDESNEKYTTYN

SEQ ID NO: 3333632 - protein, 18 aa, Plasmodium falciparum
NNDSNTKNDETVKKSNMD

SEQ ID NO: 3333633 - protein, 7 aa, Plasmodium falciparum
NNDSNVK

SEQ ID NO: 3333634 - protein, 5 aa, Plasmodium falciparum
NNDSP

SEQ ID NO: 3333635 - protein, 7 aa, Plasmodium falciparum
NNDSRNF

SEQ ID NO: 3333636 - protein, 7 aa, Plasmodium falciparum
NNDSSLN

SEQ ID NO: 3333637 - protein, 14 aa, Plasmodium falciparum
NNDSSSKKSSSATL

SEQ ID NO: 3333638 - protein, 14 aa, Plasmodium falciparum
NNDSTTKNTTNETS

SEQ ID NO: 3333639 - protein, 6 aa, Plasmodium falciparum
NNDSYN

SEQ ID NO: 3333640 - protein, 4 aa, Plasmodium falciparum
NNDT

SEQ ID NO: 3333641 - protein, 9 aa, Plasmodium falciparum
NNDTDDTSF

SEQ ID NO: 3333642 - protein, 10 aa, Plasmodium falciparum
NNDTERNEMN

SEQ ID NO: 3333643 - protein, 6 aa, Plasmodium falciparum
NNDTID

SEQ ID NO: 3333644 - protein, 8 aa, Plasmodium falciparum
NNDTKEDE

SEQ ID NO: 3333645 - protein, 12 aa, Plasmodium falciparum
NNDTKKENCESC

SEQ ID NO: 3333646 - protein, 24 aa, Plasmodium falciparum
NNDTKKENCESCKKEKNETQEESL

SEQ ID NO: 3333647 - protein, 7 aa, Plasmodium falciparum
NNDTKNM

SEQ ID NO: 3333648 - protein, 5 aa, Plasmodium falciparum
NNDTN

SEQ ID NO: 3333649 - protein, 17 aa, Plasmodium falciparum
NNDTNISNNINGEANDH

SEQ ID NO: 3333650 - protein, 10 aa, Plasmodium falciparum
NNDTNYNNNN

SEQ ID NO: 3333651 - protein, 12 aa, Plasmodium falciparum
NNDTSLKENRYN

SEQ ID NO: 3333652 - protein, 8 aa, Plasmodium falciparum
NNDTSQIK

SEQ ID NO: 3333653 - protein, 7 aa, Plasmodium falciparum
NNDVENI

SEQ ID NO: 3333654 - protein, 6 aa, Plasmodium falciparum
NNDVGT

SEQ ID NO: 3333655 - protein, 7 aa, Plasmodium falciparum
NNDVNQK

SEQ ID NO: 3333656 - protein, 13 aa, Plasmodium falciparum
NNDVSQNNSVEEI

SEQ ID NO: 3333657 - protein, 25 aa, Plasmodium falciparum
NNDYANNVNNNNNNNNGNNNNYYNN

SEQ ID NO: 3333658 - protein, 5 aa, Plasmodium falciparum
NNDYE

SEQ ID NO: 3333659 - protein, 6 aa, Plasmodium falciparum
NNDYGK

SEQ ID NO: 3333660 - protein, 6 aa, Plasmodium falciparum
NNDYNE

SEQ ID NO: 3333661 - protein, 50 aa, Plasmodium falciparum
NNDYNNDYNNDYNNDYNNDYNNDYNNDYNNNYYNNTKGQEGQKQGKIGNG

SEQ ID NO: 3333662 - protein, 6 aa, Plasmodium falciparum
NNDYRS

SEQ ID NO: 3333663 - protein, 9 aa, Plasmodium falciparum
NNDYSNNNN

SEQ ID NO: 3333664 - protein, 5 aa, Plasmodium falciparum
NNEAA

SEQ ID NO: 3333665 - protein, 7 aa, Plasmodium falciparum
NNEASSK

SEQ ID NO: 3333666 - protein, 4 aa, Plasmodium falciparum
NNEC

SEQ ID NO: 3333667 - protein, 6 aa, Plasmodium falciparum
NNECSK

SEQ ID NO: 3333668 - protein, 6 aa, Plasmodium falciparum
NNEDCK

SEQ ID NO: 3333669 - protein, 7 aa, Plasmodium falciparum
NNEDDEI

SEQ ID NO: 3333670 - protein, 9 aa, Plasmodium falciparum
NNEDDNVEN

SEQ ID NO: 3333671 - protein, 9 aa, Plasmodium falciparum
NNEDDQNEL

SEQ ID NO: 3333672 - protein, 12 aa, Plasmodium falciparum
NNEDEKKEENSF

SEQ ID NO: 3333673 - protein, 7 aa, Plasmodium falciparum
NNEDEKN

SEQ ID NO: 3333674 - protein, 9 aa, Plasmodium falciparum
NNEDGSTVI

SEQ ID NO: 3333675 - protein, 6 aa, Plasmodium falciparum
NNEDIE

SEQ ID NO: 3333676 - protein, 16 aa, Plasmodium falciparum
NNEDIKDISEGTMNKE

SEQ ID NO: 3333677 - protein, 10 aa, Plasmodium falciparum
NNEDKFYEEQ

SEQ ID NO: 3333678 - protein, 7 aa, Plasmodium falciparum
NNEDLKD

SEQ ID NO: 3333679 - protein, 5 aa, Plasmodium falciparum
NNEDN

SEQ ID NO: 3333680 - protein, 6 aa, Plasmodium falciparum
NNEDND

SEQ ID NO: 3333681 - protein, 9 aa, Plasmodium falciparum
NNEDNEKPP

SEQ ID NO: 3333682 - protein, 37 aa, Plasmodium falciparum
NNEDNFNNQPTNNYSNDNMNTYSSEHIGNNDPTIDDN

SEQ ID NO: 3333683 - protein, 29 aa, Plasmodium falciparum
NNEDNNNNNNNNINNNNNNNINNNNINNN

SEQ ID NO: 3333684 - protein, 17 aa, Plasmodium falciparum
NNEDNSGYSTDESEKEA

SEQ ID NO: 3333685 - protein, 25 aa, Plasmodium falciparum
NNEDSKKSSNSDNNENDENNNNNND

SEQ ID NO: 3333686 - protein, 23 aa, Plasmodium falciparum
NNEDTTHNKNKEINKNKNEYKQR

SEQ ID NO: 3333687 - protein, 7 aa, Plasmodium falciparum
NNEDYET

SEQ ID NO: 3333688 - protein, 12 aa, Plasmodium falciparum
NNEDYYNNESRN

SEQ ID NO: 3333689 - protein, 4 aa, Plasmodium falciparum
NNEE

SEQ ID NO: 3333690 - protein, 36 aa, Plasmodium falciparum
NNEEADNNKNNNNIDSNHQYGDNNINNNNNNNITGE

SEQ ID NO: 3333691 - protein, 19 aa, Plasmodium falciparum
NNEECVNNKDKKNDRDTNI

SEQ ID NO: 3333692 - protein, 8 aa, Plasmodium falciparum
NNEEDNVQ

SEQ ID NO: 3333693 - protein, 50 aa, Plasmodium falciparum
NNEEDVDNDGNVYKDNKEEEEEDEEEEEEEEEEEEDEEDEEDNDDDDHHH

SEQ ID NO: 3333694 - protein, 15 aa, Plasmodium falciparum
NNEEEKKRPYRREKE

SEQ ID NO: 3333695 - protein, 7 aa, Plasmodium falciparum
NNEEENN

SEQ ID NO: 3333696 - protein, 20 aa, Plasmodium falciparum
NNEEEQKIKNNNHIQSTDKQ

SEQ ID NO: 3333697 - protein, 7 aa, Plasmodium falciparum
NNEEESM

SEQ ID NO: 3333698 - protein, 7 aa, Plasmodium falciparum
NNEEEYR

SEQ ID NO: 3333699 - protein, 6 aa, Plasmodium falciparum
NNEEGA

SEQ ID NO: 3333700 - protein, 6 aa, Plasmodium falciparum
NNEEGN

SEQ ID NO: 3333701 - protein, 6 aa, Plasmodium falciparum
NNEEHV

SEQ ID NO: 3333702 - protein, 7 aa, Plasmodium falciparum
NNEEIEK

SEQ ID NO: 3333703 - protein, 5 aa, Plasmodium falciparum
NNEEK

SEQ ID NO: 3333704 - protein, 17 aa, Plasmodium falciparum
NNEEKDETKQTNNSSDN

SEQ ID NO: 3333705 - protein, 15 aa, Plasmodium falciparum
NNEEKNKNKEKEKEI

SEQ ID NO: 3333706 - protein, 6 aa, Plasmodium falciparum
NNEELN

SEQ ID NO: 3333707 - protein, 6 aa, Plasmodium falciparum
NNEELS

SEQ ID NO: 3333708 - protein, 35 aa, Plasmodium falciparum
NNEENEENEINEENEINQQDKQDIQNVQDKPNEQK

SEQ ID NO: 3333709 - protein, 13 aa, Plasmodium falciparum
NNEENIKRNEQKE

SEQ ID NO: 3333710 - protein, 11 aa, Plasmodium falciparum
NNEENKDKNYF

SEQ ID NO: 3333711 - protein, 7 aa, Plasmodium falciparum
NNEENNL

SEQ ID NO: 3333712 - protein, 7 aa, Plasmodium falciparum
NNEENTS

SEQ ID NO: 3333713 - protein, 9 aa, Plasmodium falciparum
NNEEQDNNN

SEQ ID NO: 3333714 - protein, 7 aa, Plasmodium falciparum
NNEERRN

SEQ ID NO: 3333715 - protein, 19 aa, Plasmodium falciparum
NNEESNTQKNLEKAVNRRK

SEQ ID NO: 3333716 - protein, 12 aa, Plasmodium falciparum
NNEEYDNKENYD

SEQ ID NO: 3333717 - protein, 5 aa, Plasmodium falciparum
NNEGD

SEQ ID NO: 3333718 - protein, 10 aa, Plasmodium falciparum
NNEGESNQDI

SEQ ID NO: 3333719 - protein, 7 aa, Plasmodium falciparum
NNEGPLK

SEQ ID NO: 3333720 - protein, 7 aa, Plasmodium falciparum
NNEGTIG

SEQ ID NO: 3333721 - protein, 7 aa, Plasmodium falciparum
NNEGTKR

SEQ ID NO: 3333722 - protein, 4 aa, Plasmodium falciparum
NNEH

SEQ ID NO: 3333723 - protein, 19 aa, Plasmodium falciparum
NNEHKSCGDISKNYTGNKI

SEQ ID NO: 3333724 - protein, 10 aa, Plasmodium falciparum
NNEHNKEPLK

SEQ ID NO: 3333725 - protein, 11 aa, Plasmodium falciparum
NNEHSEKNNHN

SEQ ID NO: 3333726 - protein, 53 aa, Plasmodium falciparum
NNEHTEENYKPPSINNNNNNNNNNDNNNNDNNNNNNDNNNNDYNDFNEKTSLN

SEQ ID NO: 3333727 - protein, 8 aa, Plasmodium falciparum
NNEHTENY

SEQ ID NO: 3333728 - protein, 8 aa, Plasmodium falciparum
NNEHTKKQ

SEQ ID NO: 3333729 - protein, 5 aa, Plasmodium falciparum
NNEIE

SEQ ID NO: 3333730 - protein, 6 aa, Plasmodium falciparum
NNEIEN

SEQ ID NO: 3333731 - protein, 14 aa, Plasmodium falciparum
NNEIPNNNSNNHNN

SEQ ID NO: 3333732 - protein, 7 aa, Plasmodium falciparum
NNEISRY

SEQ ID NO: 3333733 - protein, 4 aa, Plasmodium falciparum
NNEK

SEQ ID NO: 3333734 - protein, 7 aa, Plasmodium falciparum
NNEKCNV

SEQ ID NO: 3333735 - protein, 10 aa, Plasmodium falciparum
NNEKDKKEVE

SEQ ID NO: 3333736 - protein, 12 aa, Plasmodium falciparum
NNEKDKKKLHGN

SEQ ID NO: 3333737 - protein, 6 aa, Plasmodium falciparum
NNEKDM

SEQ ID NO: 3333738 - protein, 7 aa, Plasmodium falciparum
NNEKDVR

SEQ ID NO: 3333739 - protein, 8 aa, Plasmodium falciparum
NNEKEKHD

SEQ ID NO: 3333740 - protein, 7 aa, Plasmodium falciparum
NNEKEKM

SEQ ID NO: 3333741 - protein, 9 aa, Plasmodium falciparum
NNEKEKNID

SEQ ID NO: 3333742 - protein, 7 aa, Plasmodium falciparum
NNEKIAS

SEQ ID NO: 3333743 - protein, 8 aa, Plasmodium falciparum
NNEKINKN

SEQ ID NO: 3333744 - protein, 7 aa, Plasmodium falciparum
NNEKINN

SEQ ID NO: 3333745 - protein, 14 aa, Plasmodium falciparum
NNEKIQQDKKYEQV

SEQ ID NO: 3333746 - protein, 11 aa, Plasmodium falciparum
NNEKKERSKDD

SEQ ID NO: 3333747 - protein, 21 aa, Plasmodium falciparum
NNEKKGKEKEKEEKKNNMNKN

SEQ ID NO: 3333748 - protein, 31 aa, Plasmodium falciparum
NNEKKGKKNKHEKNVQKKNTHEHEQKSTEVN

SEQ ID NO: 3333749 - protein, 10 aa, Plasmodium falciparum
NNEKKKNFTT

SEQ ID NO: 3333750 - protein, 10 aa, Plasmodium falciparum
NNEKKNTNEL

SEQ ID NO: 3333751 - protein, 10 aa, Plasmodium falciparum
NNEKKTKKKT

SEQ ID NO: 3333752 - protein, 5 aa, Plasmodium falciparum
NNEKL

SEQ ID NO: 3333753 - protein, 5 aa, Plasmodium falciparum
NNEKN

SEQ ID NO: 3333754 - protein, 11 aa, Plasmodium falciparum
NNEKNDLSNEE

SEQ ID NO: 3333755 - protein, 8 aa, Plasmodium falciparum
NNEKNISY

SEQ ID NO: 3333756 - protein, 6 aa, Plasmodium falciparum
NNEKNP

SEQ ID NO: 3333757 - protein, 37 aa, Plasmodium falciparum
NNEKRGELQKKEGNKQINEGKKNTKINRKKKTNENNI

SEQ ID NO: 3333758 - protein, 45 aa, Plasmodium falciparum
NNEKRVHDSEDEEYDEFGRKKKKKIKTEDYEKKEKRYSEDSRINN

SEQ ID NO: 3333759 - protein, 7 aa, Plasmodium falciparum
NNEKSKD

SEQ ID NO: 3333760 - protein, 11 aa, Plasmodium falciparum
NNEKSKKCQKP

SEQ ID NO: 3333761 - protein, 6 aa, Plasmodium falciparum
NNEKSM

SEQ ID NO: 3333762 - protein, 12 aa, Plasmodium falciparum
NNEKTEKNNTSL

SEQ ID NO: 3333763 - protein, 8 aa, Plasmodium falciparum
NNEKTSPF

SEQ ID NO: 3333764 - protein, 7 aa, Plasmodium falciparum
NNEKYNS

SEQ ID NO: 3333765 - protein, 6 aa, Plasmodium falciparum
NNELNN

SEQ ID NO: 3333766 - protein, 21 aa, Plasmodium falciparum
NNELYENNEDSYDENSRNKNY

SEQ ID NO: 3333767 - protein, 4 aa, Plasmodium falciparum
NNEM

SEQ ID NO: 3333768 - protein, 60 aa, Plasmodium falciparum
NNEMKSEVQEKKKNNKKENKNNKNNCKEKDQEENKISNEKHINKKEKNKNAGEDDEEDVT

SEQ ID NO: 3333769 - protein, 5 aa, Plasmodium falciparum
NNEMS

SEQ ID NO: 3333770 - protein, 6 aa, Plasmodium falciparum
NNENAK

SEQ ID NO: 3333771 - protein, 10 aa, Plasmodium falciparum
NNENDSMKKE

SEQ ID NO: 3333772 - protein, 7 aa, Plasmodium falciparum
NNENEKS

SEQ ID NO: 3333773 - protein, 43 aa, Plasmodium falciparum
NNENENNNSSSNGDSDDDSNDDSDNNSYDNSDYYTDDDKPIDE

SEQ ID NO: 3333774 - protein, 5 aa, Plasmodium falciparum
NNENI

SEQ ID NO: 3333775 - protein, 10 aa, Plasmodium falciparum
NNENKEINQK

SEQ ID NO: 3333776 - protein, 20 aa, Plasmodium falciparum
NNENKGISNVESYEKNVNEK

SEQ ID NO: 3333777 - protein, 10 aa, Plasmodium falciparum
NNENKSNKSY

SEQ ID NO: 3333778 - protein, 13 aa, Plasmodium falciparum
NNENNDNVSSAGG

SEQ ID NO: 3333779 - protein, 19 aa, Plasmodium falciparum
NNENNEKIKSSYNNEDDEY

SEQ ID NO: 3333780 - protein, 10 aa, Plasmodium falciparum
NNENNKNKQY

SEQ ID NO: 3333781 - protein, 6 aa, Plasmodium falciparum
NNENNM

SEQ ID NO: 3333782 - protein, 8 aa, Plasmodium falciparum
NNENNMNP

SEQ ID NO: 3333783 - protein, 10 aa, Plasmodium falciparum
NNENNNFREG

SEQ ID NO: 3333784 - protein, 8 aa, Plasmodium falciparum
NNENNNNN

SEQ ID NO: 3333785 - protein, 10 aa, Plasmodium falciparum
NNENNNNNNV

SEQ ID NO: 3333786 - protein, 8 aa, Plasmodium falciparum
NNENPDNG

SEQ ID NO: 3333787 - protein, 10 aa, Plasmodium falciparum
NNENQDNVNN

SEQ ID NO: 3333788 - protein, 9 aa, Plasmodium falciparum
NNENSIEKS

SEQ ID NO: 3333789 - protein, 25 aa, Plasmodium falciparum
NNENSNDESDGGNNKAKGIDKGKKM

SEQ ID NO: 3333790 - protein, 5 aa, Plasmodium falciparum
NNENT

SEQ ID NO: 3333791 - protein, 7 aa, Plasmodium falciparum
NNENVDN

SEQ ID NO: 3333792 - protein, 14 aa, Plasmodium falciparum
NNENVNKNHSNSSF

SEQ ID NO: 3333793 - protein, 23 aa, Plasmodium falciparum
NNENVNSNNNFDSSNANNNQLEE

SEQ ID NO: 3333794 - protein, 27 aa, Plasmodium falciparum
NNENYDNCQNNDNCQNNDNCQNNDNYN

SEQ ID NO: 3333795 - protein, 5 aa, Plasmodium falciparum
NNEPI

SEQ ID NO: 3333796 - protein, 8 aa, Plasmodium falciparum
NNEPKEHI

SEQ ID NO: 3333797 - protein, 7 aa, Plasmodium falciparum
NNEPKYS

SEQ ID NO: 3333798 - protein, 11 aa, Plasmodium falciparum
NNEPNDTGNFY

SEQ ID NO: 3333799 - protein, 4 aa, Plasmodium falciparum
NNEQ

SEQ ID NO: 3333800 - protein, 10 aa, Plasmodium falciparum
NNEQAKTRKG

SEQ ID NO: 3333801 - protein, 17 aa, Plasmodium falciparum
NNEQDNTSLSSQEKKLS

SEQ ID NO: 3333802 - protein, 8 aa, Plasmodium falciparum
NNEQDRNE

SEQ ID NO: 3333803 - protein, 7 aa, Plasmodium falciparum
NNEQENI

SEQ ID NO: 3333804 - protein, 13 aa, Plasmodium falciparum
NNEQKKIDTTTIT

SEQ ID NO: 3333805 - protein, 13 aa, Plasmodium falciparum
NNEQNVKEKKKKN

SEQ ID NO: 3333806 - protein, 4 aa, Plasmodium falciparum
NNER

SEQ ID NO: 3333807 - protein, 13 aa, Plasmodium falciparum
NNERDNEDSLENN

SEQ ID NO: 3333808 - protein, 22 aa, Plasmodium falciparum
NNERDNNNKIYNNNNNNEDDHN

SEQ ID NO: 3333809 - protein, 7 aa, Plasmodium falciparum
NNERKKK

SEQ ID NO: 3333810 - protein, 6 aa, Plasmodium falciparum
NNERKQ

SEQ ID NO: 3333811 - protein, 13 aa, Plasmodium falciparum
NNERKYENNAENI

SEQ ID NO: 3333812 - protein, 5 aa, Plasmodium falciparum
NNERN

SEQ ID NO: 3333813 - protein, 10 aa, Plasmodium falciparum
NNERNHSEDE

SEQ ID NO: 3333814 - protein, 15 aa, Plasmodium falciparum
NNERNNSKGKSTRIE

SEQ ID NO: 3333815 - protein, 9 aa, Plasmodium falciparum
NNERNREFK

SEQ ID NO: 3333816 - protein, 6 aa, Plasmodium falciparum
NNERNS

SEQ ID NO: 3333817 - protein, 6 aa, Plasmodium falciparum
NNERNV

SEQ ID NO: 3333818 - protein, 15 aa, Plasmodium falciparum
NNESGAGGAGGPNDI

SEQ ID NO: 3333819 - protein, 11 aa, Plasmodium falciparum
NNESKKSKNNI

SEQ ID NO: 3333820 - protein, 9 aa, Plasmodium falciparum
NNESKNTYN

SEQ ID NO: 3333821 - protein, 10 aa, Plasmodium falciparum
NNESNDFPGS

SEQ ID NO: 3333822 - protein, 19 aa, Plasmodium falciparum
NNESNEINKKKVEKKRKRN

SEQ ID NO: 3333823 - protein, 9 aa, Plasmodium falciparum
NNESNNSNV

SEQ ID NO: 3333824 - protein, 11 aa, Plasmodium falciparum
NNESNTANPNQ

SEQ ID NO: 3333825 - protein, 18 aa, Plasmodium falciparum
NNESNTYMNGKKKEENEI

SEQ ID NO: 3333826 - protein, 7 aa, Plasmodium falciparum
NNESPND

SEQ ID NO: 3333827 - protein, 15 aa, Plasmodium falciparum
NNESTDLRNYSNEQE

SEQ ID NO: 3333828 - protein, 6 aa, Plasmodium falciparum
NNESYE

SEQ ID NO: 3333829 - protein, 26 aa, Plasmodium falciparum
NNETDNADISRDNNNNISSNNNTNYF

SEQ ID NO: 3333830 - protein, 10 aa, Plasmodium falciparum
NNETDSIQEN

SEQ ID NO: 3333831 - protein, 7 aa, Plasmodium falciparum
NNETKNV

SEQ ID NO: 3333832 - protein, 5 aa, Plasmodium falciparum
NNETM

SEQ ID NO: 3333833 - protein, 5 aa, Plasmodium falciparum
NNETN

SEQ ID NO: 3333834 - protein, 10 aa, Plasmodium falciparum
NNETNKSHET

SEQ ID NO: 3333835 - protein, 22 aa, Plasmodium falciparum
NNETNNTQNNIAHSEKNKYPFD

SEQ ID NO: 3333836 - protein, 6 aa, Plasmodium falciparum
NNETNY

SEQ ID NO: 3333837 - protein, 14 aa, Plasmodium falciparum
NNEVEDNKSKDSNI

SEQ ID NO: 3333838 - protein, 13 aa, Plasmodium falciparum
NNEVNKNDTNVTC

SEQ ID NO: 3333839 - protein, 4 aa, Plasmodium falciparum
NNEY

SEQ ID NO: 3333840 - protein, 10 aa, Plasmodium falciparum
NNEYDENGIN

SEQ ID NO: 3333841 - protein, 5 aa, Plasmodium falciparum
NNEYK

SEQ ID NO: 3333842 - protein, 14 aa, Plasmodium falciparum
NNEYNQNDEKVENI

SEQ ID NO: 3333843 - protein, 10 aa, Plasmodium falciparum
NNEYTSKNNY

SEQ ID NO: 3333844 - protein, 7 aa, Plasmodium falciparum
NNEYTST

SEQ ID NO: 3333845 - protein, 32 aa, Plasmodium falciparum
NNFDDQKSEKKKSDNINNDKYYSNKPIQSTSY

SEQ ID NO: 3333846 - protein, 10 aa, Plasmodium falciparum
NNFDQNGCKN

SEQ ID NO: 3333847 - protein, 11 aa, Plasmodium falciparum
NNFKDNDADEV

SEQ ID NO: 3333848 - protein, 11 aa, Plasmodium falciparum
NNFKNDDKKID

SEQ ID NO: 3333849 - protein, 13 aa, Plasmodium falciparum
NNFKTKKKNTHSI

SEQ ID NO: 3333850 - protein, 13 aa, Plasmodium falciparum
NNFNEEKNKLNVG

SEQ ID NO: 3333851 - protein, 5 aa, Plasmodium falciparum
NNFNG

SEQ ID NO: 3333852 - protein, 22 aa, Plasmodium falciparum
NNFNKTSKEMNKTKMTKEKNAK

SEQ ID NO: 3333853 - protein, 18 aa, Plasmodium falciparum
NNFNNNNNNMGAENNNKT

SEQ ID NO: 3333854 - protein, 6 aa, Plasmodium falciparum
NNFNNR

SEQ ID NO: 3333855 - protein, 6 aa, Plasmodium falciparum
NNFNNS

SEQ ID NO: 3333856 - protein, 23 aa, Plasmodium falciparum
NNFNSSMTNSINSNVSTNSQSNV

SEQ ID NO: 3333857 - protein, 32 aa, Plasmodium falciparum
NNFPNDDKNLREKKYSSNYNYEKKKKNNEINK

SEQ ID NO: 3333858 - protein, 6 aa, Plasmodium falciparum
NNFPST

SEQ ID NO: 3333859 - protein, 6 aa, Plasmodium falciparum
NNFSEN

SEQ ID NO: 3333860 - protein, 9 aa, Plasmodium falciparum
NNFSNQNKD

SEQ ID NO: 3333861 - protein, 6 aa, Plasmodium falciparum
NNFTNK

SEQ ID NO: 3333862 - protein, 31 aa, Plasmodium falciparum
NNFTNQNDLNTNITNNNNNNSNNNNNNIYDK

SEQ ID NO: 3333863 - protein, 24 aa, Plasmodium falciparum
NNGAIKDMNNTNSLNNNNINNNNN

SEQ ID NO: 3333864 - protein, 7 aa, Plasmodium falciparum
NNGCGGG

SEQ ID NO: 3333865 - protein, 32 aa, Plasmodium falciparum
NNGDAQADNGNNNVNNNLKGNMKGNNLNSNNI

SEQ ID NO: 3333866 - protein, 6 aa, Plasmodium falciparum
NNGDKA

SEQ ID NO: 3333867 - protein, 7 aa, Plasmodium falciparum
NNGDNQY

SEQ ID NO: 3333868 - protein, 12 aa, Plasmodium falciparum
NNGEENKNGNKF

SEQ ID NO: 3333869 - protein, 9 aa, Plasmodium falciparum
NNGETKYVD

SEQ ID NO: 3333870 - protein, 9 aa, Plasmodium falciparum
NNGFPDENY

SEQ ID NO: 3333871 - protein, 13 aa, Plasmodium falciparum
NNGGDFKEYPSSS

SEQ ID NO: 3333872 - protein, 8 aa, Plasmodium falciparum
NNGGEIDM

SEQ ID NO: 3333873 - protein, 12 aa, Plasmodium falciparum
NNGHKKHNEPIG

SEQ ID NO: 3333874 - protein, 9 aa, Plasmodium falciparum
NNGHNDNLD

SEQ ID NO: 3333875 - protein, 15 aa, Plasmodium falciparum
NNGHNIGDEYSDESY

SEQ ID NO: 3333876 - protein, 19 aa, Plasmodium falciparum
NNGHTNNNINNNHNNNGNA

SEQ ID NO: 3333877 - protein, 47 aa, Plasmodium falciparum
NNGIEKKEENNVNNKLNNNNNNNSKHKKNDKLKEKLQKNEDTHTHKK

SEQ ID NO: 3333878 - protein, 35 aa, Plasmodium falciparum
NNGINNNGMNNNGMNNNSMNNNCSNNNNGKKRIHS

SEQ ID NO: 3333879 - protein, 8 aa, Plasmodium falciparum
NNGKDIRT

SEQ ID NO: 3333880 - protein, 8 aa, Plasmodium falciparum
NNGKEKKS

SEQ ID NO: 3333881 - protein, 19 aa, Plasmodium falciparum
NNGKSNGNLNVQQSDNAHN

SEQ ID NO: 3333882 - protein, 4 aa, Plasmodium falciparum
NNGL

SEQ ID NO: 3333883 - protein, 15 aa, Plasmodium falciparum
NNGLGSSMNSYNEAY

SEQ ID NO: 3333884 - protein, 5 aa, Plasmodium falciparum
NNGLR

SEQ ID NO: 3333885 - protein, 11 aa, Plasmodium falciparum
NNGMAGEKATL

SEQ ID NO: 3333886 - protein, 10 aa, Plasmodium falciparum
NNGNEEEGLI

SEQ ID NO: 3333887 - protein, 8 aa, Plasmodium falciparum
NNGNHSDK

SEQ ID NO: 3333888 - protein, 7 aa, Plasmodium falciparum
NNGNKMT

SEQ ID NO: 3333889 - protein, 14 aa, Plasmodium falciparum
NNGNMEHNTNATSN

SEQ ID NO: 3333890 - protein, 5 aa, Plasmodium falciparum
NNGNP

SEQ ID NO: 3333891 - protein, 11 aa, Plasmodium falciparum
NNGNTNENMNT

SEQ ID NO: 3333892 - protein, 9 aa, Plasmodium falciparum
NNGPNTNGS

SEQ ID NO: 3333893 - protein, 17 aa, Plasmodium falciparum
NNGQYEDNYNNSYNNNN

SEQ ID NO: 3333894 - protein, 8 aa, Plasmodium falciparum
NNGSGKST

SEQ ID NO: 3333895 - protein, 5 aa, Plasmodium falciparum
NNGSI

SEQ ID NO: 3333896 - protein, 9 aa, Plasmodium falciparum
NNGSSDDNE

SEQ ID NO: 3333897 - protein, 8 aa, Plasmodium falciparum
NNGSSKSL

SEQ ID NO: 3333898 - protein, 7 aa, Plasmodium falciparum
NNGSTQD

SEQ ID NO: 3333899 - protein, 13 aa, Plasmodium falciparum
NNGTNETPKRTHR

SEQ ID NO: 3333900 - protein, 9 aa, Plasmodium falciparum
NNGTPFKED

SEQ ID NO: 3333901 - protein, 9 aa, Plasmodium falciparum
NNGTSINNE

SEQ ID NO: 3333902 - protein, 4 aa, Plasmodium falciparum
NNGV

SEQ ID NO: 3333903 - protein, 6 aa, Plasmodium falciparum
NNGWRN

SEQ ID NO: 3333904 - protein, 4 aa, Plasmodium falciparum
NNGY

SEQ ID NO: 3333905 - protein, 6 aa, Plasmodium falciparum
NNGYNN

SEQ ID NO: 3333906 - protein, 4 aa, Plasmodium falciparum
NNHC

SEQ ID NO: 3333907 - protein, 9 aa, Plasmodium falciparum
NNHDENNKD

SEQ ID NO: 3333908 - protein, 7 aa, Plasmodium falciparum
NNHDKKI

SEQ ID NO: 3333909 - protein, 7 aa, Plasmodium falciparum
NNHDNNN

SEQ ID NO: 3333910 - protein, 4 aa, Plasmodium falciparum
NNHE

SEQ ID NO: 3333911 - protein, 33 aa, Plasmodium falciparum
NNHGDKYGSNTTYHNNNSDNNNNNNNNNNNNMY

SEQ ID NO: 3333912 - protein, 5 aa, Plasmodium falciparum
NNHHN

SEQ ID NO: 3333913 - protein, 19 aa, Plasmodium falciparum
NNHHNNNNNNNNNNNNNCN

SEQ ID NO: 3333914 - protein, 8 aa, Plasmodium falciparum
NNHHSVDN

SEQ ID NO: 3333915 - protein, 4 aa, Plasmodium falciparum
NNHI

SEQ ID NO: 3333916 - protein, 5 aa, Plasmodium falciparum
NNHID

SEQ ID NO: 3333917 - protein, 33 aa, Plasmodium falciparum
NNHIDGDKNNIYETNNYSDSEKNKSSDTEKNKL

SEQ ID NO: 3333918 - protein, 12 aa, Plasmodium falciparum
NNHKEKNNQTDI

SEQ ID NO: 3333919 - protein, 6 aa, Plasmodium falciparum
NNHKSK

SEQ ID NO: 3333920 - protein, 5 aa, Plasmodium falciparum
NNHND

SEQ ID NO: 3333921 - protein, 14 aa, Plasmodium falciparum
NNHNDDANSSESII

SEQ ID NO: 3333922 - protein, 6 aa, Plasmodium falciparum
NNHNEN

SEQ ID NO: 3333923 - protein, 59 aa, Plasmodium falciparum
NNHNIKDDEKKNITDEKNITEDEKNITDDEKKNITDDEKKNITDDEKKNITDDEKNITD

SEQ ID NO: 3333924 - protein, 10 aa, Plasmodium falciparum
NNHNNDNNES

SEQ ID NO: 3333925 - protein, 13 aa, Plasmodium falciparum
NNHNNEDKKNPKE

SEQ ID NO: 3333926 - protein, 10 aa, Plasmodium falciparum
NNHNNHNNNN

SEQ ID NO: 3333927 - protein, 10 aa, Plasmodium falciparum
NNHNNHSNHN

SEQ ID NO: 3333928 - protein, 8 aa, Plasmodium falciparum
NNHNNNNE

SEQ ID NO: 3333929 - protein, 11 aa, Plasmodium falciparum
NNHNNNNNNNM

SEQ ID NO: 3333930 - protein, 26 aa, Plasmodium falciparum
NNHNNNTEDFSDDDLDEKNDEMSSRT

SEQ ID NO: 3333931 - protein, 7 aa, Plasmodium falciparum
NNHNNYI

SEQ ID NO: 3333932 - protein, 13 aa, Plasmodium falciparum
NNHNRKMDNNSNI

SEQ ID NO: 3333933 - protein, 8 aa, Plasmodium falciparum
NNHNSATK

SEQ ID NO: 3333934 - protein, 7 aa, Plasmodium falciparum
NNHNSSE

SEQ ID NO: 3333935 - protein, 8 aa, Plasmodium falciparum
NNHNTHRA

SEQ ID NO: 3333936 - protein, 4 aa, Plasmodium falciparum
NNHP

SEQ ID NO: 3333937 - protein, 9 aa, Plasmodium falciparum
NNHPNNNTL

SEQ ID NO: 3333938 - protein, 6 aa, Plasmodium falciparum
NNHPTD

SEQ ID NO: 3333939 - protein, 25 aa, Plasmodium falciparum
NNHQKQNDEQEHLPKDENGKEEDNI

SEQ ID NO: 3333940 - protein, 12 aa, Plasmodium falciparum
NNHQQKREETLK

SEQ ID NO: 3333941 - protein, 11 aa, Plasmodium falciparum
NNHSNTKHDYH

SEQ ID NO: 3333942 - protein, 8 aa, Plasmodium falciparum
NNHTNNNM

SEQ ID NO: 3333943 - protein, 16 aa, Plasmodium falciparum
NNHTSTSNTTNSSDNS

SEQ ID NO: 3333944 - protein, 7 aa, Plasmodium falciparum
NNHVDTN

SEQ ID NO: 3333945 - protein, 13 aa, Plasmodium falciparum
NNHVNNNSNHMND

SEQ ID NO: 3333946 - protein, 8 aa, Plasmodium falciparum
NNHYNNNS

SEQ ID NO: 3333947 - protein, 19 aa, Plasmodium falciparum
NNIDANNNNNNNNNNNNNI

SEQ ID NO: 3333948 - protein, 14 aa, Plasmodium falciparum
NNIDDDEHTKKKET

SEQ ID NO: 3333949 - protein, 15 aa, Plasmodium falciparum
NNIDEKLKSNKTYES

SEQ ID NO: 3333950 - protein, 5 aa, Plasmodium falciparum
NNIDK

SEQ ID NO: 3333951 - protein, 5 aa, Plasmodium falciparum
NNIDN

SEQ ID NO: 3333952 - protein, 12 aa, Plasmodium falciparum
NNIDNIKGKTNV

SEQ ID NO: 3333953 - protein, 13 aa, Plasmodium falciparum
NNIDNMNDNNIDN

SEQ ID NO: 3333954 - protein, 6 aa, Plasmodium falciparum
NNIDRN

SEQ ID NO: 3333955 - protein, 8 aa, Plasmodium falciparum
NNIDSNKS

SEQ ID NO: 3333956 - protein, 9 aa, Plasmodium falciparum
NNIDSSNSL

SEQ ID NO: 3333957 - protein, 8 aa, Plasmodium falciparum
NNIDTNDH

SEQ ID NO: 3333958 - protein, 4 aa, Plasmodium falciparum
NNIE

SEQ ID NO: 3333959 - protein, 5 aa, Plasmodium falciparum
NNIED

SEQ ID NO: 3333960 - protein, 13 aa, Plasmodium falciparum
NNIEEKDTSSFEH

SEQ ID NO: 3333961 - protein, 8 aa, Plasmodium falciparum
NNIEKGDN

SEQ ID NO: 3333962 - protein, 11 aa, Plasmodium falciparum
NNIENNDNNNN

SEQ ID NO: 3333963 - protein, 36 aa, Plasmodium falciparum
NNIENNKSNNSKSDNHEDNNNKSVNHEDNNNKNNYD

SEQ ID NO: 3333964 - protein, 11 aa, Plasmodium falciparum
NNIENNTQNTT

SEQ ID NO: 3333965 - protein, 7 aa, Plasmodium falciparum
NNIERKE

SEQ ID NO: 3333966 - protein, 4 aa, Plasmodium falciparum
NNIG

SEQ ID NO: 3333967 - protein, 13 aa, Plasmodium falciparum
NNIGEGSPEGANN

SEQ ID NO: 3333968 - protein, 14 aa, Plasmodium falciparum
NNIHDGNNIHDGNN

SEQ ID NO: 3333969 - protein, 20 aa, Plasmodium falciparum
NNIHKTTENIGNIKSNNNYI

SEQ ID NO: 3333970 - protein, 15 aa, Plasmodium falciparum
NNIHNNDSNNPDCTH

SEQ ID NO: 3333971 - protein, 6 aa, Plasmodium falciparum
NNIHNS

SEQ ID NO: 3333972 - protein, 5 aa, Plasmodium falciparum
NNIIN

SEQ ID NO: 3333973 - protein, 11 aa, Plasmodium falciparum
NNIKDEDVQNV

SEQ ID NO: 3333974 - protein, 7 aa, Plasmodium falciparum
NNIKDEN

SEQ ID NO: 3333975 - protein, 38 aa, Plasmodium falciparum
NNIKDGNNNINDDNNNNNINDDNNNNNINDDDNNYDDN

SEQ ID NO: 3333976 - protein, 40 aa, Plasmodium falciparum
NNIKDNDDDHNNIKDNDDDHNNIKDNNDDHNNIKDNNNYT

SEQ ID NO: 3333977 - protein, 68 aa, Plasmodium falciparum
NNIKDNNIKDNNIKDNNINEDRHYDDNYKDDNYKDENNCDGNNYDNNNNNDNNNYNDNYNENNNNYYY

SEQ ID NO: 3333978 - protein, 17 aa, Plasmodium falciparum
NNIKEEEDVTLPNEQSD

SEQ ID NO: 3333979 - protein, 58 aa, Plasmodium falciparum
NNIKENVGDNIKENVGDNIKENVGDNIKENVGDNIKENVGDNIKENVGDNIKENVGDN

SEQ ID NO: 3333980 - protein, 44 aa, Plasmodium falciparum
NNIKEQNKGMDDSNSNDDNKNNNNNDDYDDNDDDDNNIHTQNEM

SEQ ID NO: 3333981 - protein, 23 aa, Plasmodium falciparum
NNIKGNDTYDDDIKNGEGVNNNN

SEQ ID NO: 3333982 - protein, 8 aa, Plasmodium falciparum
NNIKKGVN

SEQ ID NO: 3333983 - protein, 6 aa, Plasmodium falciparum
NNIKKK

SEQ ID NO: 3333984 - protein, 6 aa, Plasmodium falciparum
NNIKNE

SEQ ID NO: 3333985 - protein, 10 aa, Plasmodium falciparum
NNIKNKLEEK

SEQ ID NO: 3333986 - protein, 20 aa, Plasmodium falciparum
NNIKNNDHHTRGSQKITDNY

SEQ ID NO: 3333987 - protein, 7 aa, Plasmodium falciparum
NNIKRKA

SEQ ID NO: 3333988 - protein, 11 aa, Plasmodium falciparum
NNIKRSYGSNN

SEQ ID NO: 3333989 - protein, 10 aa, Plasmodium falciparum
NNIKRTPYNS

SEQ ID NO: 3333990 - protein, 5 aa, Plasmodium falciparum
NNIKS

SEQ ID NO: 3333991 - protein, 8 aa, Plasmodium falciparum
NNIKSNRN

SEQ ID NO: 3333992 - protein, 5 aa, Plasmodium falciparum
NNIKT

SEQ ID NO: 3333993 - protein, 6 aa, Plasmodium falciparum
NNIKTS

SEQ ID NO: 3333994 - protein, 13 aa, Plasmodium falciparum
NNIKYGRDNNFDD

SEQ ID NO: 3333995 - protein, 5 aa, Plasmodium falciparum
NNIND

SEQ ID NO: 3333996 - protein, 13 aa, Plasmodium falciparum
NNINDDNKNKNMQ

SEQ ID NO: 3333997 - protein, 11 aa, Plasmodium falciparum
NNINDDNNNNN

SEQ ID NO: 3333998 - protein, 12 aa, Plasmodium falciparum
NNINDEKSIDEI

SEQ ID NO: 3333999 - protein, 13 aa, Plasmodium falciparum
NNINDNNNNNNNN

SEQ ID NO: 3334000 - protein, 8 aa, Plasmodium falciparum
NNINDSSV

SEQ ID NO: 3334001 - protein, 5 aa, Plasmodium falciparum
NNINE

SEQ ID NO: 3334002 - protein, 27 aa, Plasmodium falciparum
NNINEDENNKENIKRDDTNEEYNQNDN

SEQ ID NO: 3334003 - protein, 99 aa, Plasmodium falciparum
NNINEDKANEKNNNYKNDDDDNNDNNIKKKRSKKNKKTDGDNVDDDDNDDDDESSNDSEYDGNKRKDDHHKDDNDDDNNNNNNNNNNNNNNSYSNKNNN

SEQ ID NO: 3334004 - protein, 9 aa, Plasmodium falciparum
NNINEEKNK

SEQ ID NO: 3334005 - protein, 8 aa, Plasmodium falciparum
NNINENKE

SEQ ID NO: 3334006 - protein, 20 aa, Plasmodium falciparum
NNINENTNGVNNNKNNKEEL

SEQ ID NO: 3334007 - protein, 20 aa, Plasmodium falciparum
NNINEYDEEYDEEEEIEQDD

SEQ ID NO: 3334008 - protein, 52 aa, Plasmodium falciparum
NNINGDDTSGGDDTSSGDDTSSGDDTSGDDTNGDDTSSGDDTYNDDTNEHSC

SEQ ID NO: 3334009 - protein, 6 aa, Plasmodium falciparum
NNINGN

SEQ ID NO: 3334010 - protein, 8 aa, Plasmodium falciparum
NNINGNIN

SEQ ID NO: 3334011 - protein, 13 aa, Plasmodium falciparum
NNINKNNQDKNPF

SEQ ID NO: 3334012 - protein, 10 aa, Plasmodium falciparum
NNINKSDQKT

SEQ ID NO: 3334013 - protein, 6 aa, Plasmodium falciparum
NNINND

SEQ ID NO: 3334014 - protein, 67 aa, Plasmodium falciparum
NNINNDDNNDDNNDNNNDNNNDNNNDDNNDDNNDNNNDDNNDDNNDNNNDDNNNDNNNNNDNNNNNH

SEQ ID NO: 3334015 - protein, 13 aa, Plasmodium falciparum
NNINNDEDNNLPN

SEQ ID NO: 3334016 - protein, 28 aa, Plasmodium falciparum
NNINNDNNIYSDNNINNDNNINNDNNIN

SEQ ID NO: 3334017 - protein, 16 aa, Plasmodium falciparum
NNINNHSNNSNDNNHH

SEQ ID NO: 3334018 - protein, 13 aa, Plasmodium falciparum
NNINNINENNNNH

SEQ ID NO: 3334019 - protein, 13 aa, Plasmodium falciparum
NNINNINNNNNIN

SEQ ID NO: 3334020 - protein, 6 aa, Plasmodium falciparum
NNINNK

SEQ ID NO: 3334021 - protein, 6 aa, Plasmodium falciparum
NNINNN

SEQ ID NO: 3334022 - protein, 24 aa, Plasmodium falciparum
NNINNNDNNNNNNNNNNNNNNNNN

SEQ ID NO: 3334023 - protein, 7 aa, Plasmodium falciparum
NNINNNN

SEQ ID NO: 3334024 - protein, 11 aa, Plasmodium falciparum
NNINNNNKIEE

SEQ ID NO: 3334025 - protein, 19 aa, Plasmodium falciparum
NNINNNNNINNNNNNNCLS

SEQ ID NO: 3334026 - protein, 18 aa, Plasmodium falciparum
NNINNNNNMNDNNNNNIL

SEQ ID NO: 3334027 - protein, 13 aa, Plasmodium falciparum
NNINNNNNNNKNN

SEQ ID NO: 3334028 - protein, 20 aa, Plasmodium falciparum
NNINNNNNNNNNNNNNSNNV

SEQ ID NO: 3334029 - protein, 19 aa, Plasmodium falciparum
NNINNNNNNNNNNNSVPYN

SEQ ID NO: 3334030 - protein, 13 aa, Plasmodium falciparum
NNINNNNNNSTIY

SEQ ID NO: 3334031 - protein, 13 aa, Plasmodium falciparum
NNINNNNNNYSTH

SEQ ID NO: 3334032 - protein, 28 aa, Plasmodium falciparum
NNINNNYNNNINNNYNNNINNNYNNNIN

SEQ ID NO: 3334033 - protein, 12 aa, Plasmodium falciparum
NNINNSNFQNKE

SEQ ID NO: 3334034 - protein, 6 aa, Plasmodium falciparum
NNINNY

SEQ ID NO: 3334035 - protein, 13 aa, Plasmodium falciparum
NNINNYNKKENNQ

SEQ ID NO: 3334036 - protein, 5 aa, Plasmodium falciparum
NNINQ

SEQ ID NO: 3334037 - protein, 80 aa, Plasmodium falciparum
NNINRNNNNYNGNINKNNNNIHGNRNSNNIHGNRNSNNIHGNRNSNNIHSNRNSNNTHSNRNSNNTHSNRNSNNSNRNNY

SEQ ID NO: 3334038 - protein, 30 aa, Plasmodium falciparum
NNINRQNDINRQNDINSQNSVGSQNNRNHK

SEQ ID NO: 3334039 - protein, 18 aa, Plasmodium falciparum
NNINSNINSNINNNINSN

SEQ ID NO: 3334040 - protein, 96 aa, Plasmodium falciparum
NNINSNNNNINSHNNNMNNNNDNMNNMNNNNNNINNMNNNNNNINNMNNNNNNINNMNNNNNNMNNMNNNNNNINNNNNNNNHNNNSSNGKNMDTA

SEQ ID NO: 3334041 - protein, 19 aa, Plasmodium falciparum
NNINSSSNNNYNNDYDIDE

SEQ ID NO: 3334042 - protein, 16 aa, Plasmodium falciparum
NNINSTSNISSSSNAS

SEQ ID NO: 3334043 - protein, 5 aa, Plasmodium falciparum
NNINT

SEQ ID NO: 3334044 - protein, 11 aa, Plasmodium falciparum
NNINTKKSGWD

SEQ ID NO: 3334045 - protein, 8 aa, Plasmodium falciparum
NNINTNAS

SEQ ID NO: 3334046 - protein, 15 aa, Plasmodium falciparum
NNINVDEEEEKKKKN

SEQ ID NO: 3334047 - protein, 8 aa, Plasmodium falciparum
NNINVKNN

SEQ ID NO: 3334048 - protein, 9 aa, Plasmodium falciparum
NNIPDENEQ

SEQ ID NO: 3334049 - protein, 15 aa, Plasmodium falciparum
NNIPLDNNTYNSNKN

SEQ ID NO: 3334050 - protein, 5 aa, Plasmodium falciparum
NNIPM

SEQ ID NO: 3334051 - protein, 6 aa, Plasmodium falciparum
NNIPNS

SEQ ID NO: 3334052 - protein, 35 aa, Plasmodium falciparum
NNIPPENIPNSSQNNDNKTENERLNHKREQKNHVD

SEQ ID NO: 3334053 - protein, 12 aa, Plasmodium falciparum
NNIPPPPDTDIN

SEQ ID NO: 3334054 - protein, 6 aa, Plasmodium falciparum
NNIPSN

SEQ ID NO: 3334055 - protein, 19 aa, Plasmodium falciparum
NNIPSNKNKMYQNKKNSTY

SEQ ID NO: 3334056 - protein, 9 aa, Plasmodium falciparum
NNIQEGKQT

SEQ ID NO: 3334057 - protein, 12 aa, Plasmodium falciparum
NNIQEQENKDEL

SEQ ID NO: 3334058 - protein, 11 aa, Plasmodium falciparum
NNIQKISKQKK

SEQ ID NO: 3334059 - protein, 12 aa, Plasmodium falciparum
NNIQKTKSCEDN

SEQ ID NO: 3334060 - protein, 7 aa, Plasmodium falciparum
NNIQNDK

SEQ ID NO: 3334061 - protein, 10 aa, Plasmodium falciparum
NNIQNENSKY

SEQ ID NO: 3334062 - protein, 9 aa, Plasmodium falciparum
NNIQNNNNL

SEQ ID NO: 3334063 - protein, 6 aa, Plasmodium falciparum
NNIQNS

SEQ ID NO: 3334064 - protein, 8 aa, Plasmodium falciparum
NNIQPKNG

SEQ ID NO: 3334065 - protein, 11 aa, Plasmodium falciparum
NNIQQSNHSYN

SEQ ID NO: 3334066 - protein, 8 aa, Plasmodium falciparum
NNIQSNNT

SEQ ID NO: 3334067 - protein, 8 aa, Plasmodium falciparum
NNIQSTKG

SEQ ID NO: 3334068 - protein, 5 aa, Plasmodium falciparum
NNIQY

SEQ ID NO: 3334069 - protein, 7 aa, Plasmodium falciparum
NNIRDKN

SEQ ID NO: 3334070 - protein, 6 aa, Plasmodium falciparum
NNIRSD

SEQ ID NO: 3334071 - protein, 7 aa, Plasmodium falciparum
NNIRTNE

SEQ ID NO: 3334072 - protein, 6 aa, Plasmodium falciparum
NNISDE

SEQ ID NO: 3334073 - protein, 8 aa, Plasmodium falciparum
NNISEEAK

SEQ ID NO: 3334074 - protein, 17 aa, Plasmodium falciparum
NNISEKREASNDNETYI

SEQ ID NO: 3334075 - protein, 7 aa, Plasmodium falciparum
NNISHEK

SEQ ID NO: 3334076 - protein, 83 aa, Plasmodium falciparum
NNISNDNSNNISNDQSNNISNDNSNNISNDQSNNISNDNSNNISNDQSNNISNDQSNNISNDQSNNISNDQSNNISNDQWGDN

SEQ ID NO: 3334077 - protein, 19 aa, Plasmodium falciparum
NNISNENNYNDDDSYDEDN

SEQ ID NO: 3334078 - protein, 15 aa, Plasmodium falciparum
NNISNKNYDGKNNED

SEQ ID NO: 3334079 - protein, 18 aa, Plasmodium falciparum
NNISNNISNNMNSNINNN

SEQ ID NO: 3334080 - protein, 8 aa, Plasmodium falciparum
NNISNPNL

SEQ ID NO: 3334081 - protein, 7 aa, Plasmodium falciparum
NNISNPY

SEQ ID NO: 3334082 - protein, 7 aa, Plasmodium falciparum
NNISPEH

SEQ ID NO: 3334083 - protein, 8 aa, Plasmodium falciparum
NNISSTAN

SEQ ID NO: 3334084 - protein, 7 aa, Plasmodium falciparum
NNISTDT

SEQ ID NO: 3334085 - protein, 22 aa, Plasmodium falciparum
NNISTNGKYQSYHSKSTTNLNS

SEQ ID NO: 3334086 - protein, 21 aa, Plasmodium falciparum
NNISTNNKEKERKNNHKRSDN

SEQ ID NO: 3334087 - protein, 7 aa, Plasmodium falciparum
NNITKNP

SEQ ID NO: 3334088 - protein, 25 aa, Plasmodium falciparum
NNITPKGHVDNKDTYNLNSRSNSCY

SEQ ID NO: 3334089 - protein, 7 aa, Plasmodium falciparum
NNITVSN

SEQ ID NO: 3334090 - protein, 47 aa, Plasmodium falciparum
NNIYDDNNKNDDNNKNDDNNKNDDDNNNNNNNNNNNNNNNNNNSSSI

SEQ ID NO: 3334091 - protein, 7 aa, Plasmodium falciparum
NNIYDEG

SEQ ID NO: 3334092 - protein, 45 aa, Plasmodium falciparum
NNKADNENNNNNNNNNNTYSNSNDSNCNDSNCNDSNSNNDDNNVE

SEQ ID NO: 3334093 - protein, 11 aa, Plasmodium falciparum
NNKCDEEEHSR

SEQ ID NO: 3334094 - protein, 10 aa, Plasmodium falciparum
NNKCQNVEDG

SEQ ID NO: 3334095 - protein, 11 aa, Plasmodium falciparum
NNKCSSTAAYS

SEQ ID NO: 3334096 - protein, 4 aa, Plasmodium falciparum
NNKD

SEQ ID NO: 3334097 - protein, 10 aa, Plasmodium falciparum
NNKDDITKEI

SEQ ID NO: 3334098 - protein, 9 aa, Plasmodium falciparum
NNKDHDIQK

SEQ ID NO: 3334099 - protein, 19 aa, Plasmodium falciparum
NNKDIKNENRDLRKSPYDH

SEQ ID NO: 3334100 - protein, 9 aa, Plasmodium falciparum
NNKDKAQDI

SEQ ID NO: 3334101 - protein, 8 aa, Plasmodium falciparum
NNKDPNSG

SEQ ID NO: 3334102 - protein, 9 aa, Plasmodium falciparum
NNKDQKKKI

SEQ ID NO: 3334103 - protein, 9 aa, Plasmodium falciparum
NNKDRNNLN

SEQ ID NO: 3334104 - protein, 8 aa, Plasmodium falciparum
NNKDRQNI

SEQ ID NO: 3334105 - protein, 8 aa, Plasmodium falciparum
NNKDYRKC

SEQ ID NO: 3334106 - protein, 4 aa, Plasmodium falciparum
NNKE

SEQ ID NO: 3334107 - protein, 8 aa, Plasmodium falciparum
NNKEDEEF

SEQ ID NO: 3334108 - protein, 10 aa, Plasmodium falciparum
NNKEEDEKKL

SEQ ID NO: 3334109 - protein, 8 aa, Plasmodium falciparum
NNKEEEQQ

SEQ ID NO: 3334110 - protein, 30 aa, Plasmodium falciparum
NNKEENQQRNNLRQNYNTNKVSNSIYKPIY

SEQ ID NO: 3334111 - protein, 8 aa, Plasmodium falciparum
NNKEEQNN

SEQ ID NO: 3334112 - protein, 5 aa, Plasmodium falciparum
NNKEI

SEQ ID NO: 3334113 - protein, 89 aa, Plasmodium falciparum
NNKEIEENEEKKDKNDNQYYDNENINNDNNKYNDNEHINNDNNKYNDNNKYNDNENINNDKNKYYDNENINNDKNKYNDNENINNDNNN

SEQ ID NO: 3334114 - protein, 8 aa, Plasmodium falciparum
NNKEIKGS

SEQ ID NO: 3334115 - protein, 16 aa, Plasmodium falciparum
NNKEIYDQNNDTINQN

SEQ ID NO: 3334116 - protein, 5 aa, Plasmodium falciparum
NNKEK

SEQ ID NO: 3334117 - protein, 33 aa, Plasmodium falciparum
NNKEKEKKGNDLFSPTSSSIENNNNDNNKESSD

SEQ ID NO: 3334118 - protein, 7 aa, Plasmodium falciparum
NNKEKHN

SEQ ID NO: 3334119 - protein, 108 aa, Plasmodium falciparum
NNKEKITTKGNKNDHVGDSKDGNKNDHVGDSKDGNKNDHVGDSKEDNKNDHVGDSKEDNKNDHVGDSKDNNKNDHVGDSKDNNKNDHVGDSKDNNKNDHVGDSKEDNT

SEQ ID NO: 3334120 - protein, 11 aa, Plasmodium falciparum
NNKEKKKKKIK

SEQ ID NO: 3334121 - protein, 39 aa, Plasmodium falciparum
NNKEKNKNKLKDKNKTNKINKRKKPNHSKTNDNDQTEIY

SEQ ID NO: 3334122 - protein, 8 aa, Plasmodium falciparum
NNKEKQNE

SEQ ID NO: 3334123 - protein, 5 aa, Plasmodium falciparum
NNKEN

SEQ ID NO: 3334124 - protein, 9 aa, Plasmodium falciparum
NNKENDKSK

SEQ ID NO: 3334125 - protein, 6 aa, Plasmodium falciparum
NNKETS

SEQ ID NO: 3334126 - protein, 8 aa, Plasmodium falciparum
NNKETSLK

SEQ ID NO: 3334127 - protein, 6 aa, Plasmodium falciparum
NNKFNT

SEQ ID NO: 3334128 - protein, 18 aa, Plasmodium falciparum
NNKGDDETKSAEHTTNPS

SEQ ID NO: 3334129 - protein, 7 aa, Plasmodium falciparum
NNKGKES

SEQ ID NO: 3334130 - protein, 11 aa, Plasmodium falciparum
NNKGKKKKSDI

SEQ ID NO: 3334131 - protein, 18 aa, Plasmodium falciparum
NNKGLKKEVEEKEHKRHS

SEQ ID NO: 3334132 - protein, 25 aa, Plasmodium falciparum
NNKGNEQSGGRKRRRTKNKNNANVE

SEQ ID NO: 3334133 - protein, 12 aa, Plasmodium falciparum
NNKGNHPKEDVN

SEQ ID NO: 3334134 - protein, 15 aa, Plasmodium falciparum
NNKGNIRKNDSEKYW

SEQ ID NO: 3334135 - protein, 5 aa, Plasmodium falciparum
NNKGV

SEQ ID NO: 3334136 - protein, 6 aa, Plasmodium falciparum
NNKGVN

SEQ ID NO: 3334137 - protein, 7 aa, Plasmodium falciparum
NNKGYNI

SEQ ID NO: 3334138 - protein, 34 aa, Plasmodium falciparum
NNKHCNSEKRLNQEKKENVDLGDHTKEQTNKSRK

SEQ ID NO: 3334139 - protein, 6 aa, Plasmodium falciparum
NNKHES

SEQ ID NO: 3334140 - protein, 8 aa, Plasmodium falciparum
NNKHNDNS

SEQ ID NO: 3334141 - protein, 10 aa, Plasmodium falciparum
NNKHNNNDSC

SEQ ID NO: 3334142 - protein, 4 aa, Plasmodium falciparum
NNKI

SEQ ID NO: 3334143 - protein, 11 aa, Plasmodium falciparum
NNKIEKDDIND

SEQ ID NO: 3334144 - protein, 7 aa, Plasmodium falciparum
NNKIKNP

SEQ ID NO: 3334145 - protein, 9 aa, Plasmodium falciparum
NNKIKNSSH

SEQ ID NO: 3334146 - protein, 13 aa, Plasmodium falciparum
NNKINQNKNNKIM

SEQ ID NO: 3334147 - protein, 33 aa, Plasmodium falciparum
NNKISKSNIAQANNSDDNYPSDYNKKKKNQNAV

SEQ ID NO: 3334148 - protein, 11 aa, Plasmodium falciparum
NNKISRSPYDI

SEQ ID NO: 3334149 - protein, 24 aa, Plasmodium falciparum
NNKKDKYTKTIEANTSNRNSYDQV

SEQ ID NO: 3334150 - protein, 53 aa, Plasmodium falciparum
NNKKDNDKKEKKKEKKNEQPKKKESVVTKPKAVGENDTKKIENKDIENKNVTP

SEQ ID NO: 3334151 - protein, 9 aa, Plasmodium falciparum
NNKKDNGME

SEQ ID NO: 3334152 - protein, 19 aa, Plasmodium falciparum
NNKKDNRERKKEKKDKEKE

SEQ ID NO: 3334153 - protein, 12 aa, Plasmodium falciparum
NNKKDTKKENKE

SEQ ID NO: 3334154 - protein, 9 aa, Plasmodium falciparum
NNKKEDNNN

SEQ ID NO: 3334155 - protein, 5 aa, Plasmodium falciparum
NNKKG

SEQ ID NO: 3334156 - protein, 32 aa, Plasmodium falciparum
NNKKGYNDVPNNSSHNNNNNNNNNNKQNNSYL

SEQ ID NO: 3334157 - protein, 7 aa, Plasmodium falciparum
NNKKKER

SEQ ID NO: 3334158 - protein, 13 aa, Plasmodium falciparum
NNKKKKKDTRKDE

SEQ ID NO: 3334159 - protein, 48 aa, Plasmodium falciparum
NNKKKKKKKDDHDDDNDDNNDDNNDDNNDDNNDDNNDDNNDDNNDDNV

SEQ ID NO: 3334160 - protein, 11 aa, Plasmodium falciparum
NNKKKKKKKKK

SEQ ID NO: 3334161 - protein, 11 aa, Plasmodium falciparum
NNKKKNKTNHK

SEQ ID NO: 3334162 - protein, 69 aa, Plasmodium falciparum
NNKKKNNDGDNKSQEDDDGNKKKNNDGDNKSQEDDDGNKKKNNDGDNKSQEDDYGNKKKNNDDDDDDSY

SEQ ID NO: 3334163 - protein, 15 aa, Plasmodium falciparum
NNKKKNNKKVKQNNK

SEQ ID NO: 3334164 - protein, 12 aa, Plasmodium falciparum
NNKKKNYNTKNN

SEQ ID NO: 3334165 - protein, 6 aa, Plasmodium falciparum
NNKKKV

SEQ ID NO: 3334166 - protein, 6 aa, Plasmodium falciparum
NNKKLR

SEQ ID NO: 3334167 - protein, 5 aa, Plasmodium falciparum
NNKKN

SEQ ID NO: 3334168 - protein, 8 aa, Plasmodium falciparum
NNKKNGKG

SEQ ID NO: 3334169 - protein, 9 aa, Plasmodium falciparum
NNKKNKKEK

SEQ ID NO: 3334170 - protein, 12 aa, Plasmodium falciparum
NNKKNKKNSKKQ

SEQ ID NO: 3334171 - protein, 32 aa, Plasmodium falciparum
NNKKNKNNNTNNNNNNNNNNNNNNNKKILSRS

SEQ ID NO: 3334172 - protein, 7 aa, Plasmodium falciparum
NNKKNLG

SEQ ID NO: 3334173 - protein, 10 aa, Plasmodium falciparum
NNKKNNNNNN

SEQ ID NO: 3334174 - protein, 7 aa, Plasmodium falciparum
NNKKNNY

SEQ ID NO: 3334175 - protein, 9 aa, Plasmodium falciparum
NNKKQKINN

SEQ ID NO: 3334176 - protein, 9 aa, Plasmodium falciparum
NNKKQTSKI

SEQ ID NO: 3334177 - protein, 7 aa, Plasmodium falciparum
NNKKSNM

SEQ ID NO: 3334178 - protein, 24 aa, Plasmodium falciparum
NNKKTNNDYQNRNIKNDNSIPDSS

SEQ ID NO: 3334179 - protein, 16 aa, Plasmodium falciparum
NNKKTTNPKNDNTPHY

SEQ ID NO: 3334180 - protein, 9 aa, Plasmodium falciparum
NNKKVKENK

SEQ ID NO: 3334181 - protein, 12 aa, Plasmodium falciparum
NNKKVKNKNKNK

SEQ ID NO: 3334182 - protein, 9 aa, Plasmodium falciparum
NNKKVNTLR

SEQ ID NO: 3334183 - protein, 38 aa, Plasmodium falciparum
NNKKYSTEHTQSIDNNNITSKRLNNKKTATDKAQSTSR

SEQ ID NO: 3334184 - protein, 7 aa, Plasmodium falciparum
NNKLGRT

SEQ ID NO: 3334185 - protein, 8 aa, Plasmodium falciparum
NNKLNDKK

SEQ ID NO: 3334186 - protein, 32 aa, Plasmodium falciparum
NNKLNPDLTNNDINDNNINDNNNDNNDNNNIN

SEQ ID NO: 3334187 - protein, 13 aa, Plasmodium falciparum
NNKLSNTSNNLST

SEQ ID NO: 3334188 - protein, 7 aa, Plasmodium falciparum
NNKMGEY

SEQ ID NO: 3334189 - protein, 5 aa, Plasmodium falciparum
NNKMN

SEQ ID NO: 3334190 - protein, 14 aa, Plasmodium falciparum
NNKMSDNKRGHKTF

SEQ ID NO: 3334191 - protein, 10 aa, Plasmodium falciparum
NNKNAPISNY

SEQ ID NO: 3334192 - protein, 40 aa, Plasmodium falciparum
NNKNDDNKNMNSESKNIKNERKRKSQNNNIAQNKNQGFPN

SEQ ID NO: 3334193 - protein, 8 aa, Plasmodium falciparum
NNKNDDYN

SEQ ID NO: 3334194 - protein, 10 aa, Plasmodium falciparum
NNKNDEDNKT

SEQ ID NO: 3334195 - protein, 23 aa, Plasmodium falciparum
NNKNDKDKKTKKTLPYKKQNSLE

SEQ ID NO: 3334196 - protein, 9 aa, Plasmodium falciparum
NNKNDNQKK

SEQ ID NO: 3334197 - protein, 13 aa, Plasmodium falciparum
NNKNDSKENNNIN

SEQ ID NO: 3334198 - protein, 6 aa, Plasmodium falciparum
NNKNDY

SEQ ID NO: 3334199 - protein, 6 aa, Plasmodium falciparum
NNKNEE

SEQ ID NO: 3334200 - protein, 14 aa, Plasmodium falciparum
NNKNEEHKNKKEYL

SEQ ID NO: 3334201 - protein, 9 aa, Plasmodium falciparum
NNKNEEQNV

SEQ ID NO: 3334202 - protein, 10 aa, Plasmodium falciparum
NNKNEKNHIT

SEQ ID NO: 3334203 - protein, 19 aa, Plasmodium falciparum
NNKNELCDNKNTKDYTENT

SEQ ID NO: 3334204 - protein, 8 aa, Plasmodium falciparum
NNKNENKN

SEQ ID NO: 3334205 - protein, 7 aa, Plasmodium falciparum
NNKNFDN

SEQ ID NO: 3334206 - protein, 28 aa, Plasmodium falciparum
NNKNFNTNPKDKKEKRENIYTIFEKNLF

SEQ ID NO: 3334207 - protein, 8 aa, Plasmodium falciparum
NNKNGDEI

SEQ ID NO: 3334208 - protein, 7 aa, Plasmodium falciparum
NNKNGSS

SEQ ID NO: 3334209 - protein, 28 aa, Plasmodium falciparum
NNKNHSHTNNNKKEKKKKSNLSSSYKNT

SEQ ID NO: 3334210 - protein, 8 aa, Plasmodium falciparum
NNKNIKKN

SEQ ID NO: 3334211 - protein, 11 aa, Plasmodium falciparum
NNKNINNTSNI

SEQ ID NO: 3334212 - protein, 10 aa, Plasmodium falciparum
NNKNKENNYY

SEQ ID NO: 3334213 - protein, 19 aa, Plasmodium falciparum
NNKNKEQKQNEEKENNEVN

SEQ ID NO: 3334214 - protein, 7 aa, Plasmodium falciparum
NNKNKER

SEQ ID NO: 3334215 - protein, 6 aa, Plasmodium falciparum
NNKNKK

SEQ ID NO: 3334216 - protein, 13 aa, Plasmodium falciparum
NNKNKKGSCNNEN

SEQ ID NO: 3334217 - protein, 11 aa, Plasmodium falciparum
NNKNKKKLSYN

SEQ ID NO: 3334218 - protein, 10 aa, Plasmodium falciparum
NNKNKLSCDN

SEQ ID NO: 3334219 - protein, 6 aa, Plasmodium falciparum
NNKNNC

SEQ ID NO: 3334220 - protein, 37 aa, Plasmodium falciparum
NNKNNENKNTGKKNNNDDNNNNNNNNNNTNGGSSNCY

SEQ ID NO: 3334221 - protein, 51 aa, Plasmodium falciparum
NNKNNGDDNKNNGDDNNKNNGDDNKNNGDDNKNNGDDNKNNGDNNYNGDDN

SEQ ID NO: 3334222 - protein, 10 aa, Plasmodium falciparum
NNKNNGDNYM

SEQ ID NO: 3334223 - protein, 9 aa, Plasmodium falciparum
NNKNNINPI

SEQ ID NO: 3334224 - protein, 8 aa, Plasmodium falciparum
NNKNNKNN

SEQ ID NO: 3334225 - protein, 10 aa, Plasmodium falciparum
NNKNNKNYNN

SEQ ID NO: 3334226 - protein, 6 aa, Plasmodium falciparum
NNKNNL

SEQ ID NO: 3334227 - protein, 11 aa, Plasmodium falciparum
NNKNNLNIEEK

SEQ ID NO: 3334228 - protein, 32 aa, Plasmodium falciparum
NNKNNNNNINNNNNNNNCRNNNCSNNSDDENI

SEQ ID NO: 3334229 - protein, 10 aa, Plasmodium falciparum
NNKNNSEKKY

SEQ ID NO: 3334230 - protein, 25 aa, Plasmodium falciparum
NNKNSNTNDDHNNNNNNNKNKSSTS

SEQ ID NO: 3334231 - protein, 8 aa, Plasmodium falciparum
NNKPEHKH

SEQ ID NO: 3334232 - protein, 5 aa, Plasmodium falciparum
NNKPF

SEQ ID NO: 3334233 - protein, 5 aa, Plasmodium falciparum
NNKPS

SEQ ID NO: 3334234 - protein, 16 aa, Plasmodium falciparum
NNKPTELNANTGLPEF

SEQ ID NO: 3334235 - protein, 5 aa, Plasmodium falciparum
NNKQD

SEQ ID NO: 3334236 - protein, 28 aa, Plasmodium falciparum
NNKQDINSNSCSSSSSSNNNNNNNNSLK

SEQ ID NO: 3334237 - protein, 5 aa, Plasmodium falciparum
NNKQE

SEQ ID NO: 3334238 - protein, 8 aa, Plasmodium falciparum
NNKQEINN

SEQ ID NO: 3334239 - protein, 10 aa, Plasmodium falciparum
NNKQKKDYPY

SEQ ID NO: 3334240 - protein, 12 aa, Plasmodium falciparum
NNKQKRQKNKTV

SEQ ID NO: 3334241 - protein, 16 aa, Plasmodium falciparum
NNKQNGINPYQSDDQK

SEQ ID NO: 3334242 - protein, 6 aa, Plasmodium falciparum
NNKQSL

SEQ ID NO: 3334243 - protein, 6 aa, Plasmodium falciparum
NNKQSN

SEQ ID NO: 3334244 - protein, 8 aa, Plasmodium falciparum
NNKQSVQG

SEQ ID NO: 3334245 - protein, 6 aa, Plasmodium falciparum
NNKQYG

SEQ ID NO: 3334246 - protein, 8 aa, Plasmodium falciparum
NNKREYKG

SEQ ID NO: 3334247 - protein, 5 aa, Plasmodium falciparum
NNKRI

SEQ ID NO: 3334248 - protein, 107 aa, Plasmodium falciparum
NNKRKGNDNKMDDSGDINDKYNTYSDNTYSDNTYSDNTYSDNTYRDNTYSDNTYRDNTYRDNTYRDNTYSDNTYRDNTYSDNTYRDNTYSDNTYRDNTYSDNTHNYN

SEQ ID NO: 3334249 - protein, 20 aa, Plasmodium falciparum
NNKRKLNEINNETNEKLNPN

SEQ ID NO: 3334250 - protein, 18 aa, Plasmodium falciparum
NNKRKNDNNNDDISEHDA

SEQ ID NO: 3334251 - protein, 8 aa, Plasmodium falciparum
NNKRLQEV

SEQ ID NO: 3334252 - protein, 7 aa, Plasmodium falciparum
NNKRNEE

SEQ ID NO: 3334253 - protein, 9 aa, Plasmodium falciparum
NNKRSVSTN

SEQ ID NO: 3334254 - protein, 13 aa, Plasmodium falciparum
NNKSDDGKKSNVN

SEQ ID NO: 3334255 - protein, 8 aa, Plasmodium falciparum
NNKSDDRT

SEQ ID NO: 3334256 - protein, 21 aa, Plasmodium falciparum
NNKSGKSRSIKSRSHFSGDNE

SEQ ID NO: 3334257 - protein, 14 aa, Plasmodium falciparum
NNKSISNNNNTNTY

SEQ ID NO: 3334258 - protein, 10 aa, Plasmodium falciparum
NNKSKSYNKT

SEQ ID NO: 3334259 - protein, 43 aa, Plasmodium falciparum
NNKSNDNNNNNNNNDNNNNNNNNNNNNNNNNNNSNNNNNNNYN

SEQ ID NO: 3334260 - protein, 17 aa, Plasmodium falciparum
NNKSNKLSSRIKKSQSF

SEQ ID NO: 3334261 - protein, 27 aa, Plasmodium falciparum
NNKSNNNKDHNNDHNNNNNDDGDGEDI

SEQ ID NO: 3334262 - protein, 7 aa, Plasmodium falciparum
NNKSNTK

SEQ ID NO: 3334263 - protein, 8 aa, Plasmodium falciparum
NNKSPNNI

SEQ ID NO: 3334264 - protein, 9 aa, Plasmodium falciparum
NNKSRKPKE

SEQ ID NO: 3334265 - protein, 7 aa, Plasmodium falciparum
NNKSRND

SEQ ID NO: 3334266 - protein, 12 aa, Plasmodium falciparum
NNKSSHTNNEKG

SEQ ID NO: 3334267 - protein, 7 aa, Plasmodium falciparum
NNKSTKI

SEQ ID NO: 3334268 - protein, 27 aa, Plasmodium falciparum
NNKSYDNEYDHSDNSNDRKNFKNGKKK

SEQ ID NO: 3334269 - protein, 9 aa, Plasmodium falciparum
NNKTATNSI

SEQ ID NO: 3334270 - protein, 5 aa, Plasmodium falciparum
NNKTE

SEQ ID NO: 3334271 - protein, 9 aa, Plasmodium falciparum
NNKTGKENY

SEQ ID NO: 3334272 - protein, 6 aa, Plasmodium falciparum
NNKTMK

SEQ ID NO: 3334273 - protein, 25 aa, Plasmodium falciparum
NNKTNKKENRNKKNIQMKEKQNDKI

SEQ ID NO: 3334274 - protein, 8 aa, Plasmodium falciparum
NNKTNNIF

SEQ ID NO: 3334275 - protein, 13 aa, Plasmodium falciparum
NNKTNQHFNNTSN

SEQ ID NO: 3334276 - protein, 9 aa, Plasmodium falciparum
NNKTNTYDN

SEQ ID NO: 3334277 - protein, 6 aa, Plasmodium falciparum
NNKTSL

SEQ ID NO: 3334278 - protein, 6 aa, Plasmodium falciparum
NNKTVS

SEQ ID NO: 3334279 - protein, 4 aa, Plasmodium falciparum
NNKV

SEQ ID NO: 3334280 - protein, 18 aa, Plasmodium falciparum
NNKVNDKNKNNKRNPNRY

SEQ ID NO: 3334281 - protein, 72 aa, Plasmodium falciparum
NNKYDDEERRHHSDYSSDMDRKSRKKEKKRTHSKYDHKKKKEKRNYSSDSKHSFTSSEYSVQNKKEEHDKKK

SEQ ID NO: 3334282 - protein, 33 aa, Plasmodium falciparum
NNKYDYKKKGYEKERRNRTTYEEENDKDYEIEG

SEQ ID NO: 3334283 - protein, 9 aa, Plasmodium falciparum
NNKYEPQRY

SEQ ID NO: 3334284 - protein, 16 aa, Plasmodium falciparum
NNKYKEIKEKNKLSKS

SEQ ID NO: 3334285 - protein, 12 aa, Plasmodium falciparum
NNKYNGSQNNSH

SEQ ID NO: 3334286 - protein, 17 aa, Plasmodium falciparum
NNKYNNDKNNRNNKYNN

SEQ ID NO: 3334287 - protein, 9 aa, Plasmodium falciparum
NNKYPNSND

SEQ ID NO: 3334288 - protein, 7 aa, Plasmodium falciparum
NNKYSYN

SEQ ID NO: 3334289 - protein, 10 aa, Plasmodium falciparum
NNLDNKNNNM

SEQ ID NO: 3334290 - protein, 9 aa, Plasmodium falciparum
NNLDNNRDD

SEQ ID NO: 3334291 - protein, 5 aa, Plasmodium falciparum
NNLDQ

SEQ ID NO: 3334292 - protein, 11 aa, Plasmodium falciparum
NNLDSNNISST

SEQ ID NO: 3334293 - protein, 5 aa, Plasmodium falciparum
NNLEE

SEQ ID NO: 3334294 - protein, 19 aa, Plasmodium falciparum
NNLEEDEKKDTSNNEKNKN

SEQ ID NO: 3334295 - protein, 6 aa, Plasmodium falciparum
NNLEEY

SEQ ID NO: 3334296 - protein, 18 aa, Plasmodium falciparum
NNLEEYKNNKSDDEIDNV

SEQ ID NO: 3334297 - protein, 10 aa, Plasmodium falciparum
NNLENDPLYP

SEQ ID NO: 3334298 - protein, 7 aa, Plasmodium falciparum
NNLGRKK

SEQ ID NO: 3334299 - protein, 64 aa, Plasmodium falciparum
NNLGTDSTKNNFGVTPSLDSTKNNFGVTPSLDSTKNNFGVTPSLDSTKNNFGVTPSLDSTKNNF

SEQ ID NO: 3334300 - protein, 14 aa, Plasmodium falciparum
NNLGTKNLEENEGF

SEQ ID NO: 3334301 - protein, 4 aa, Plasmodium falciparum
NNLH

SEQ ID NO: 3334302 - protein, 4 aa, Plasmodium falciparum
NNLK

SEQ ID NO: 3334303 - protein, 14 aa, Plasmodium falciparum
NNLKKKKKKKKIET

SEQ ID NO: 3334304 - protein, 14 aa, Plasmodium falciparum
NNLKNKNQTKSFHT

SEQ ID NO: 3334305 - protein, 12 aa, Plasmodium falciparum
NNLKNNKDIERK

SEQ ID NO: 3334306 - protein, 6 aa, Plasmodium falciparum
NNLKTE

SEQ ID NO: 3334307 - protein, 4 aa, Plasmodium falciparum
NNLN

SEQ ID NO: 3334308 - protein, 6 aa, Plasmodium falciparum
NNLNAD

SEQ ID NO: 3334309 - protein, 10 aa, Plasmodium falciparum
NNLNDEKDDH

SEQ ID NO: 3334310 - protein, 11 aa, Plasmodium falciparum
NNLNEKKEIKT

SEQ ID NO: 3334311 - protein, 7 aa, Plasmodium falciparum
NNLNENK

SEQ ID NO: 3334312 - protein, 18 aa, Plasmodium falciparum
NNLNGTKDKEKKKKKKKK

SEQ ID NO: 3334313 - protein, 19 aa, Plasmodium falciparum
NNLNKEDKDLNEMNESNQR

SEQ ID NO: 3334314 - protein, 5 aa, Plasmodium falciparum
NNLNN

SEQ ID NO: 3334315 - protein, 9 aa, Plasmodium falciparum
NNLNNKRDI

SEQ ID NO: 3334316 - protein, 31 aa, Plasmodium falciparum
NNLNNNNNLNNNNNLNSNNNLNSNNNLNNNN

SEQ ID NO: 3334317 - protein, 11 aa, Plasmodium falciparum
NNLNNSGNSEQ

SEQ ID NO: 3334318 - protein, 11 aa, Plasmodium falciparum
NNLNQKNNTYN

SEQ ID NO: 3334319 - protein, 10 aa, Plasmodium falciparum
NNLNSHSQSV

SEQ ID NO: 3334320 - protein, 6 aa, Plasmodium falciparum
NNLNSN

SEQ ID NO: 3334321 - protein, 5 aa, Plasmodium falciparum
NNLNT

SEQ ID NO: 3334322 - protein, 10 aa, Plasmodium falciparum
NNLPKPEPLT

SEQ ID NO: 3334323 - protein, 5 aa, Plasmodium falciparum
NNLPQ

SEQ ID NO: 3334324 - protein, 10 aa, Plasmodium falciparum
NNLPSATQKR

SEQ ID NO: 3334325 - protein, 22 aa, Plasmodium falciparum
NNLQKKSQNNIYNRDENRQAKN

SEQ ID NO: 3334326 - protein, 21 aa, Plasmodium falciparum
NNLQKNADSNNSNGSRKDGIY

SEQ ID NO: 3334327 - protein, 6 aa, Plasmodium falciparum
NNLQTI

SEQ ID NO: 3334328 - protein, 10 aa, Plasmodium falciparum
NNLRDSKNNY

SEQ ID NO: 3334329 - protein, 11 aa, Plasmodium falciparum
NNLRKKKKNIH

SEQ ID NO: 3334330 - protein, 4 aa, Plasmodium falciparum
NNLS

SEQ ID NO: 3334331 - protein, 14 aa, Plasmodium falciparum
NNLSEKKRKEDMYT

SEQ ID NO: 3334332 - protein, 11 aa, Plasmodium falciparum
NNLSENQENNK

SEQ ID NO: 3334333 - protein, 6 aa, Plasmodium falciparum
NNLSGN

SEQ ID NO: 3334334 - protein, 9 aa, Plasmodium falciparum
NNLSKENQI

SEQ ID NO: 3334335 - protein, 17 aa, Plasmodium falciparum
NNLSKKKKNKSNKFNKN

SEQ ID NO: 3334336 - protein, 5 aa, Plasmodium falciparum
NNLSN

SEQ ID NO: 3334337 - protein, 7 aa, Plasmodium falciparum
NNLSNVS

SEQ ID NO: 3334338 - protein, 7 aa, Plasmodium falciparum
NNLSRAG

SEQ ID NO: 3334339 - protein, 18 aa, Plasmodium falciparum
NNLSSHNNNNNNNNYSKG

SEQ ID NO: 3334340 - protein, 19 aa, Plasmodium falciparum
NNLSSNTKQKKKSNKKNTL

SEQ ID NO: 3334341 - protein, 10 aa, Plasmodium falciparum
NNLSTNTPLN

SEQ ID NO: 3334342 - protein, 24 aa, Plasmodium falciparum
NNLSTTDKSYSTNIEDKKGNMKKR

SEQ ID NO: 3334343 - protein, 12 aa, Plasmodium falciparum
NNLSTYSNSSTI

SEQ ID NO: 3334344 - protein, 6 aa, Plasmodium falciparum
NNLTNE

SEQ ID NO: 3334345 - protein, 19 aa, Plasmodium falciparum
NNLTSEKKRYNNRNKSYNN

SEQ ID NO: 3334346 - protein, 10 aa, Plasmodium falciparum
NNMAKNEEIE

SEQ ID NO: 3334347 - protein, 4 aa, Plasmodium falciparum
NNMD

SEQ ID NO: 3334348 - protein, 13 aa, Plasmodium falciparum
NNMDEEKKSSTDI

SEQ ID NO: 3334349 - protein, 26 aa, Plasmodium falciparum
NNMDEPIEEENTYYDKEYKNKTENTN

SEQ ID NO: 3334350 - protein, 16 aa, Plasmodium falciparum
NNMDGDDHDDNNNNNK

SEQ ID NO: 3334351 - protein, 13 aa, Plasmodium falciparum
NNMDGKNNYSYDN

SEQ ID NO: 3334352 - protein, 7 aa, Plasmodium falciparum
NNMDKDK

SEQ ID NO: 3334353 - protein, 16 aa, Plasmodium falciparum
NNMDKNNNNNNNNNNN

SEQ ID NO: 3334354 - protein, 8 aa, Plasmodium falciparum
NNMDNDNN

SEQ ID NO: 3334355 - protein, 6 aa, Plasmodium falciparum
NNMDNK

SEQ ID NO: 3334356 - protein, 5 aa, Plasmodium falciparum
NNMED

SEQ ID NO: 3334357 - protein, 8 aa, Plasmodium falciparum
NNMEENKN

SEQ ID NO: 3334358 - protein, 8 aa, Plasmodium falciparum
NNMEQEKK

SEQ ID NO: 3334359 - protein, 7 aa, Plasmodium falciparum
NNMGEDN

SEQ ID NO: 3334360 - protein, 16 aa, Plasmodium falciparum
NNMGNMENKKNVKNVK

SEQ ID NO: 3334361 - protein, 16 aa, Plasmodium falciparum
NNMGNNNMGNSKGNIS

SEQ ID NO: 3334362 - protein, 14 aa, Plasmodium falciparum
NNMGQANGKISPSL

SEQ ID NO: 3334363 - protein, 4 aa, Plasmodium falciparum
NNMK

SEQ ID NO: 3334364 - protein, 36 aa, Plasmodium falciparum
NNMKDEKESNTHKRNNNTHSTLTGDDKTVRGNNKNI

SEQ ID NO: 3334365 - protein, 9 aa, Plasmodium falciparum
NNMKGNNTM

SEQ ID NO: 3334366 - protein, 43 aa, Plasmodium falciparum
NNMKGPEGETSNTQAKSMKNQNWNNEKSVNNKGTISKDEKKLN

SEQ ID NO: 3334367 - protein, 26 aa, Plasmodium falciparum
NNMKKKNKKNIKNKKNLKNNKNEENI

SEQ ID NO: 3334368 - protein, 6 aa, Plasmodium falciparum
NNMKSS

SEQ ID NO: 3334369 - protein, 11 aa, Plasmodium falciparum
NNMNDNNSGEH

SEQ ID NO: 3334370 - protein, 13 aa, Plasmodium falciparum
NNMNDQGKSIPDI

SEQ ID NO: 3334371 - protein, 18 aa, Plasmodium falciparum
NNMNEEDKHYESDDKTYY

SEQ ID NO: 3334372 - protein, 9 aa, Plasmodium falciparum
NNMNEGNNS

SEQ ID NO: 3334373 - protein, 38 aa, Plasmodium falciparum
NNMNGDDDDDDDDDDDDDNNNNNNNNNNNNNNNMGDED

SEQ ID NO: 3334374 - protein, 13 aa, Plasmodium falciparum
NNMNNNNNNNNNL

SEQ ID NO: 3334375 - protein, 17 aa, Plasmodium falciparum
NNMNNNPSGFTKTSEQF

SEQ ID NO: 3334376 - protein, 19 aa, Plasmodium falciparum
NNMNNNSGTNINTNANTNN

SEQ ID NO: 3334377 - protein, 14 aa, Plasmodium falciparum
NNMNNNTTNINNNN

SEQ ID NO: 3334378 - protein, 19 aa, Plasmodium falciparum
NNMNNTNNNVDDMSGNPLK

SEQ ID NO: 3334379 - protein, 7 aa, Plasmodium falciparum
NNMNNTP

SEQ ID NO: 3334380 - protein, 7 aa, Plasmodium falciparum
NNMNSNM

SEQ ID NO: 3334381 - protein, 24 aa, Plasmodium falciparum
NNMNSNNMNSNNMNSNNMNSNNNH

SEQ ID NO: 3334382 - protein, 11 aa, Plasmodium falciparum
NNMNSNSNNYN

SEQ ID NO: 3334383 - protein, 7 aa, Plasmodium falciparum
NNMNTNN

SEQ ID NO: 3334384 - protein, 8 aa, Plasmodium falciparum
NNMPPANA

SEQ ID NO: 3334385 - protein, 6 aa, Plasmodium falciparum
NNMPYE

SEQ ID NO: 3334386 - protein, 11 aa, Plasmodium falciparum
NNMQKEKENEI

SEQ ID NO: 3334387 - protein, 7 aa, Plasmodium falciparum
NNMQNRN

SEQ ID NO: 3334388 - protein, 5 aa, Plasmodium falciparum
NNMRN

SEQ ID NO: 3334389 - protein, 4 aa, Plasmodium falciparum
NNMS

SEQ ID NO: 3334390 - protein, 14 aa, Plasmodium falciparum
NNMSNHPSDDDYTY

SEQ ID NO: 3334391 - protein, 8 aa, Plasmodium falciparum
NNMSNNEK

SEQ ID NO: 3334392 - protein, 15 aa, Plasmodium falciparum
NNMSNTSKSSNNGDI

SEQ ID NO: 3334393 - protein, 18 aa, Plasmodium falciparum
NNMSQNIKEEGNYNDECD

SEQ ID NO: 3334394 - protein, 5 aa, Plasmodium falciparum
NNMSS

SEQ ID NO: 3334395 - protein, 4 aa, Plasmodium falciparum
NNMY

SEQ ID NO: 3334396 - protein, 6 aa, Plasmodium falciparum
NNMYDD

SEQ ID NO: 3334397 - protein, 4 aa, Plasmodium falciparum
NNNA

SEQ ID NO: 3334398 - protein, 7 aa, Plasmodium falciparum
NNNADSV

SEQ ID NO: 3334399 - protein, 5 aa, Plasmodium falciparum
NNNAK

SEQ ID NO: 3334400 - protein, 6 aa, Plasmodium falciparum
NNNAKN

SEQ ID NO: 3334401 - protein, 10 aa, Plasmodium falciparum
NNNAPNNEHT

SEQ ID NO: 3334402 - protein, 26 aa, Plasmodium falciparum
NNNASSVDNGDKELKEDDLTDQEEED

SEQ ID NO: 3334403 - protein, 23 aa, Plasmodium falciparum
NNNATEKSNTTSSKLKKKHSCKG

SEQ ID NO: 3334404 - protein, 5 aa, Plasmodium falciparum
NNNCE

SEQ ID NO: 3334405 - protein, 17 aa, Plasmodium falciparum
NNNCSNNNNNNNNCDDS

SEQ ID NO: 3334406 - protein, 5 aa, Plasmodium falciparum
NNNDA

SEQ ID NO: 3334407 - protein, 9 aa, Plasmodium falciparum
NNNDDDKTN

SEQ ID NO: 3334408 - protein, 9 aa, Plasmodium falciparum
NNNDDDTDC

SEQ ID NO: 3334409 - protein, 9 aa, Plasmodium falciparum
NNNDDEPME

SEQ ID NO: 3334410 - protein, 55 aa, Plasmodium falciparum
NNNDDNDDNNDDNNNDDNNNDNNDDNNDNNNNDDNNNDNNNDDNNNSNSINNSNN

SEQ ID NO: 3334411 - protein, 11 aa, Plasmodium falciparum
NNNDDNNNDNN

SEQ ID NO: 3334412 - protein, 10 aa, Plasmodium falciparum
NNNDDNNNKN

SEQ ID NO: 3334413 - protein, 19 aa, Plasmodium falciparum
NNNDDNNNNMYDSSSSSNH

SEQ ID NO: 3334414 - protein, 6 aa, Plasmodium falciparum
NNNDDS

SEQ ID NO: 3334415 - protein, 5 aa, Plasmodium falciparum
NNNDE

SEQ ID NO: 3334416 - protein, 10 aa, Plasmodium falciparum
NNNDEDKGKN

SEQ ID NO: 3334417 - protein, 34 aa, Plasmodium falciparum
NNNDEDTNGYIKSPNDLTYNTDSSINEGKQNEDI

SEQ ID NO: 3334418 - protein, 10 aa, Plasmodium falciparum
NNNDEGNNKS

SEQ ID NO: 3334419 - protein, 30 aa, Plasmodium falciparum
NNNDEKIKHDKYNNTSKNVEEIKDKNDEYK

SEQ ID NO: 3334420 - protein, 6 aa, Plasmodium falciparum
NNNDEQ

SEQ ID NO: 3334421 - protein, 10 aa, Plasmodium falciparum
NNNDEQHNNV

SEQ ID NO: 3334422 - protein, 13 aa, Plasmodium falciparum
NNNDHIKKNSNEY

SEQ ID NO: 3334423 - protein, 6 aa, Plasmodium falciparum
NNNDHV

SEQ ID NO: 3334424 - protein, 17 aa, Plasmodium falciparum
NNNDKDIYNNTNNNDKH

SEQ ID NO: 3334425 - protein, 8 aa, Plasmodium falciparum
NNNDKKEN

SEQ ID NO: 3334426 - protein, 26 aa, Plasmodium falciparum
NNNDKKGSVKEKNKNGEENKPGNTKD

SEQ ID NO: 3334427 - protein, 10 aa, Plasmodium falciparum
NNNDKKISPE

SEQ ID NO: 3334428 - protein, 70 aa, Plasmodium falciparum
NNNDKSKNVRNDDEDDDDDEDDDEEDDEDKNESSNYNNNKKKKTNTSSRNSSNNNSSNKNKNNKSGNDIH

SEQ ID NO: 3334429 - protein, 5 aa, Plasmodium falciparum
NNNDN

SEQ ID NO: 3334430 - protein, 28 aa, Plasmodium falciparum
NNNDNDDDNNNDDNNNNDDNNNNNNNDN

SEQ ID NO: 3334431 - protein, 21 aa, Plasmodium falciparum
NNNDNDDNNNNYDDDDDDDNI

SEQ ID NO: 3334432 - protein, 26 aa, Plasmodium falciparum
NNNDNDNNNDNNNDNNNDNNNGDNNN

SEQ ID NO: 3334433 - protein, 8 aa, Plasmodium falciparum
NNNDNIKN

SEQ ID NO: 3334434 - protein, 15 aa, Plasmodium falciparum
NNNDNILTSNSGSDD

SEQ ID NO: 3334435 - protein, 16 aa, Plasmodium falciparum
NNNDNKTNETHADDMK

SEQ ID NO: 3334436 - protein, 21 aa, Plasmodium falciparum
NNNDNLSNNSLSTYNNMNDED

SEQ ID NO: 3334437 - protein, 13 aa, Plasmodium falciparum
NNNDNMNNNNNMK

SEQ ID NO: 3334438 - protein, 57 aa, Plasmodium falciparum
NNNDNNDKNNNAHSNNIHNNNKHNNNAHNNNTHNNNAHNNNTHNNNTNNTTKHLSNQ

SEQ ID NO: 3334439 - protein, 25 aa, Plasmodium falciparum
NNNDNNDNDNNIDGNDNNNDGNDNN

SEQ ID NO: 3334440 - protein, 14 aa, Plasmodium falciparum
NNNDNNNDNNNNNN

SEQ ID NO: 3334441 - protein, 41 aa, Plasmodium falciparum
NNNDNNNDNNNTQQLQHNNNSDHVEDGLDTKEKREDPHDEH

SEQ ID NO: 3334442 - protein, 9 aa, Plasmodium falciparum
NNNDNNNNM

SEQ ID NO: 3334443 - protein, 16 aa, Plasmodium falciparum
NNNDNNNNNSNNNNKY

SEQ ID NO: 3334444 - protein, 19 aa, Plasmodium falciparum
NNNDNQQNEYCTSNEQNNM

SEQ ID NO: 3334445 - protein, 7 aa, Plasmodium falciparum
NNNDNSI

SEQ ID NO: 3334446 - protein, 7 aa, Plasmodium falciparum
NNNDNVN

SEQ ID NO: 3334447 - protein, 5 aa, Plasmodium falciparum
NNNDQ

SEQ ID NO: 3334448 - protein, 6 aa, Plasmodium falciparum
NNNDQI

SEQ ID NO: 3334449 - protein, 6 aa, Plasmodium falciparum
NNNDQN

SEQ ID NO: 3334450 - protein, 25 aa, Plasmodium falciparum
NNNDSNNNNNNNNNNNNSSSNDPSM

SEQ ID NO: 3334451 - protein, 19 aa, Plasmodium falciparum
NNNDSNSNSNSNNCDHNNN

SEQ ID NO: 3334452 - protein, 8 aa, Plasmodium falciparum
NNNDSTNV

SEQ ID NO: 3334453 - protein, 14 aa, Plasmodium falciparum
NNNDSTNVERDNNN

SEQ ID NO: 3334454 - protein, 6 aa, Plasmodium falciparum
NNNDTI

SEQ ID NO: 3334455 - protein, 8 aa, Plasmodium falciparum
NNNDYSSD

SEQ ID NO: 3334456 - protein, 9 aa, Plasmodium falciparum
NNNEDIKTK

SEQ ID NO: 3334457 - protein, 13 aa, Plasmodium falciparum
NNNEDNNYNSMNR

SEQ ID NO: 3334458 - protein, 55 aa, Plasmodium falciparum
NNNEEEKGENQKKKKKKKEKKNIEEKNNSTFYNNNNNNNNNNNSSSNNNKMKEYK

SEQ ID NO: 3334459 - protein, 13 aa, Plasmodium falciparum
NNNEEKENGPHKN

SEQ ID NO: 3334460 - protein, 8 aa, Plasmodium falciparum
NNNEENHQ

SEQ ID NO: 3334461 - protein, 8 aa, Plasmodium falciparum
NNNEGTYY

SEQ ID NO: 3334462 - protein, 10 aa, Plasmodium falciparum
NNNEHMNKEN

SEQ ID NO: 3334463 - protein, 7 aa, Plasmodium falciparum
NNNEITK

SEQ ID NO: 3334464 - protein, 17 aa, Plasmodium falciparum
NNNEKEKTLQDGKDNNK

SEQ ID NO: 3334465 - protein, 13 aa, Plasmodium falciparum
NNNEKMNSSDHNL

SEQ ID NO: 3334466 - protein, 9 aa, Plasmodium falciparum
NNNEKNSDV

SEQ ID NO: 3334467 - protein, 7 aa, Plasmodium falciparum
NNNEKRG

SEQ ID NO: 3334468 - protein, 14 aa, Plasmodium falciparum
NNNEKTKQNGPSGS

SEQ ID NO: 3334469 - protein, 17 aa, Plasmodium falciparum
NNNENENENNNNTNEHN

SEQ ID NO: 3334470 - protein, 6 aa, Plasmodium falciparum
NNNENI

SEQ ID NO: 3334471 - protein, 11 aa, Plasmodium falciparum
NNNENNENKTE

SEQ ID NO: 3334472 - protein, 13 aa, Plasmodium falciparum
NNNENNKKNTKVC

SEQ ID NO: 3334473 - protein, 9 aa, Plasmodium falciparum
NNNENVEKD

SEQ ID NO: 3334474 - protein, 8 aa, Plasmodium falciparum
NNNEQEKI

SEQ ID NO: 3334475 - protein, 15 aa, Plasmodium falciparum
NNNESNTKNNEKRKS

SEQ ID NO: 3334476 - protein, 6 aa, Plasmodium falciparum
NNNETL

SEQ ID NO: 3334477 - protein, 13 aa, Plasmodium falciparum
NNNETNNKCNDYH

SEQ ID NO: 3334478 - protein, 10 aa, Plasmodium falciparum
NNNETNNTNK

SEQ ID NO: 3334479 - protein, 10 aa, Plasmodium falciparum
NNNETYKKKK

SEQ ID NO: 3334480 - protein, 75 aa, Plasmodium falciparum
NNNEVDNNEIDNNKVDNNEIDNNKVDNNEIDNNKVDNNEIDNNKVDNNEIDNNKVDNNEIDNDKVDNISQDKSEI

SEQ ID NO: 3334481 - protein, 7 aa, Plasmodium falciparum
NNNEVNK

SEQ ID NO: 3334482 - protein, 20 aa, Plasmodium falciparum
NNNEYNKSVEKQENDDNKNY

SEQ ID NO: 3334483 - protein, 9 aa, Plasmodium falciparum
NNNFGEGQD

SEQ ID NO: 3334484 - protein, 7 aa, Plasmodium falciparum
NNNFNHN

SEQ ID NO: 3334485 - protein, 4 aa, Plasmodium falciparum
NNNG

SEQ ID NO: 3334486 - protein, 8 aa, Plasmodium falciparum
NNNGAATL

SEQ ID NO: 3334487 - protein, 9 aa, Plasmodium falciparum
NNNGANNFN

SEQ ID NO: 3334488 - protein, 6 aa, Plasmodium falciparum
NNNGDM

SEQ ID NO: 3334489 - protein, 13 aa, Plasmodium falciparum
NNNGGDDDGDYNS

SEQ ID NO: 3334490 - protein, 15 aa, Plasmodium falciparum
NNNGIQNIGTNDNIN

SEQ ID NO: 3334491 - protein, 5 aa, Plasmodium falciparum
NNNGK

SEQ ID NO: 3334492 - protein, 12 aa, Plasmodium falciparum
NNNGKGDNEGIN

SEQ ID NO: 3334493 - protein, 8 aa, Plasmodium falciparum
NNNGKNKM

SEQ ID NO: 3334494 - protein, 7 aa, Plasmodium falciparum
NNNGNLN

SEQ ID NO: 3334495 - protein, 8 aa, Plasmodium falciparum
NNNGNSNY

SEQ ID NO: 3334496 - protein, 13 aa, Plasmodium falciparum
NNNGRNHNNSGSI

SEQ ID NO: 3334497 - protein, 9 aa, Plasmodium falciparum
NNNGSDGDN

SEQ ID NO: 3334498 - protein, 15 aa, Plasmodium falciparum
NNNGTSSQSTNPKHL

SEQ ID NO: 3334499 - protein, 7 aa, Plasmodium falciparum
NNNGYNP

SEQ ID NO: 3334500 - protein, 10 aa, Plasmodium falciparum
NNNGYNSEKA

SEQ ID NO: 3334501 - protein, 16 aa, Plasmodium falciparum
NNNHDKKNNLNNKYGE

SEQ ID NO: 3334502 - protein, 8 aa, Plasmodium falciparum
NNNHENNS

SEQ ID NO: 3334503 - protein, 5 aa, Plasmodium falciparum
NNNHG

SEQ ID NO: 3334504 - protein, 8 aa, Plasmodium falciparum
NNNHINSN

SEQ ID NO: 3334505 - protein, 5 aa, Plasmodium falciparum
NNNHK

SEQ ID NO: 3334506 - protein, 7 aa, Plasmodium falciparum
NNNHKTK

SEQ ID NO: 3334507 - protein, 9 aa, Plasmodium falciparum
NNNHNDDNI

SEQ ID NO: 3334508 - protein, 24 aa, Plasmodium falciparum
NNNHNDHHDNNKWEHPQDTHQNDE

SEQ ID NO: 3334509 - protein, 8 aa, Plasmodium falciparum
NNNHNEAN

SEQ ID NO: 3334510 - protein, 7 aa, Plasmodium falciparum
NNNHNNN

SEQ ID NO: 3334511 - protein, 24 aa, Plasmodium falciparum
NNNHNNNNNNNNNNDDDCNSDDNR

SEQ ID NO: 3334512 - protein, 13 aa, Plasmodium falciparum
NNNHNNNNNNNYY

SEQ ID NO: 3334513 - protein, 15 aa, Plasmodium falciparum
NNNHNSSSGSSAIAP

SEQ ID NO: 3334514 - protein, 12 aa, Plasmodium falciparum
NNNHPTKNYQKE

SEQ ID NO: 3334515 - protein, 6 aa, Plasmodium falciparum
NNNHSS

SEQ ID NO: 3334516 - protein, 7 aa, Plasmodium falciparum
NNNHTNV

SEQ ID NO: 3334517 - protein, 17 aa, Plasmodium falciparum
NNNHYNNSYNNSSNNYY

SEQ ID NO: 3334518 - protein, 19 aa, Plasmodium falciparum
NNNIDDDNNDQHSKLSDYD

SEQ ID NO: 3334519 - protein, 18 aa, Plasmodium falciparum
NNNIDNNNDNNNNNNNNN

SEQ ID NO: 3334520 - protein, 7 aa, Plasmodium falciparum
NNNIDNR

SEQ ID NO: 3334521 - protein, 5 aa, Plasmodium falciparum
NNNIE

SEQ ID NO: 3334522 - protein, 25 aa, Plasmodium falciparum
NNNIGDSHQDNHSRNTTSTNITKDQ

SEQ ID NO: 3334523 - protein, 12 aa, Plasmodium falciparum
NNNIGGTTSNPY

SEQ ID NO: 3334524 - protein, 6 aa, Plasmodium falciparum
NNNIGT

SEQ ID NO: 3334525 - protein, 5 aa, Plasmodium falciparum
NNNIK

SEQ ID NO: 3334526 - protein, 6 aa, Plasmodium falciparum
NNNIKG

SEQ ID NO: 3334527 - protein, 21 aa, Plasmodium falciparum
NNNIKNNRDNNKHTKNNRADY

SEQ ID NO: 3334528 - protein, 14 aa, Plasmodium falciparum
NNNINEKDDIPKSI

SEQ ID NO: 3334529 - protein, 57 aa, Plasmodium falciparum
NNNINGSASTSTRHDNNIENNNMKKEEEANYGNNSHNKNKNEEKIKNGKDEPSKRIT

SEQ ID NO: 3334530 - protein, 9 aa, Plasmodium falciparum
NNNINKRHN

SEQ ID NO: 3334531 - protein, 19 aa, Plasmodium falciparum
NNNINNDNNNTNKRDTRRN

SEQ ID NO: 3334532 - protein, 7 aa, Plasmodium falciparum
NNNINNN

SEQ ID NO: 3334533 - protein, 19 aa, Plasmodium falciparum
NNNINNNDNNINSSSSVND

SEQ ID NO: 3334534 - protein, 9 aa, Plasmodium falciparum
NNNINNNNK

SEQ ID NO: 3334535 - protein, 50 aa, Plasmodium falciparum
NNNINNNNNINNNNNINNNNNINNYNNSNNSNGVAGADEHNNINSHNNQN

SEQ ID NO: 3334536 - protein, 15 aa, Plasmodium falciparum
NNNINNNNNISNNNN

SEQ ID NO: 3334537 - protein, 14 aa, Plasmodium falciparum
NNNINNNNNNNKNN

SEQ ID NO: 3334538 - protein, 15 aa, Plasmodium falciparum
NNNINNNNNNNNNKH

SEQ ID NO: 3334539 - protein, 10 aa, Plasmodium falciparum
NNNINNRTGT

SEQ ID NO: 3334540 - protein, 6 aa, Plasmodium falciparum
NNNINS

SEQ ID NO: 3334541 - protein, 12 aa, Plasmodium falciparum
NNNIPDSSRNVQ

SEQ ID NO: 3334542 - protein, 11 aa, Plasmodium falciparum
NNNIQNNSKNE

SEQ ID NO: 3334543 - protein, 10 aa, Plasmodium falciparum
NNNISKNEYY

SEQ ID NO: 3334544 - protein, 13 aa, Plasmodium falciparum
NNNISNEKHNVNN

SEQ ID NO: 3334545 - protein, 15 aa, Plasmodium falciparum
NNNISSEKIGDPAIS

SEQ ID NO: 3334546 - protein, 9 aa, Plasmodium falciparum
NNNITDDEK

SEQ ID NO: 3334547 - protein, 8 aa, Plasmodium falciparum
NNNITSNN

SEQ ID NO: 3334548 - protein, 8 aa, Plasmodium falciparum
NNNITSSQ

SEQ ID NO: 3334549 - protein, 11 aa, Plasmodium falciparum
NNNITSSSPIM

SEQ ID NO: 3334550 - protein, 13 aa, Plasmodium falciparum
NNNIYDDDNNNNN

SEQ ID NO: 3334551 - protein, 4 aa, Plasmodium falciparum
NNNK

SEQ ID NO: 3334552 - protein, 15 aa, Plasmodium falciparum
NNNKCKKEKYNEKEK

SEQ ID NO: 3334553 - protein, 32 aa, Plasmodium falciparum
NNNKCVDNNNNKCVDNNNNKSVENNNNQCVDN

SEQ ID NO: 3334554 - protein, 14 aa, Plasmodium falciparum
NNNKDKKNTLKDKE

SEQ ID NO: 3334555 - protein, 59 aa, Plasmodium falciparum
NNNKEETSEKEENSKNEKFNRSNKASQSDSYEENAEYSQSDGITNTESNFENSQKEREG

SEQ ID NO: 3334556 - protein, 8 aa, Plasmodium falciparum
NNNKEKGI

SEQ ID NO: 3334557 - protein, 10 aa, Plasmodium falciparum
NNNKGDNKEI

SEQ ID NO: 3334558 - protein, 9 aa, Plasmodium falciparum
NNNKGINNY

SEQ ID NO: 3334559 - protein, 14 aa, Plasmodium falciparum
NNNKIEDNKEKVDD

SEQ ID NO: 3334560 - protein, 47 aa, Plasmodium falciparum
NNNKIKNIDEKEKKDKTNKTNKTNQTNQTNQTNQTNQTNKKGGDTYI

SEQ ID NO: 3334561 - protein, 5 aa, Plasmodium falciparum
NNNKK

SEQ ID NO: 3334562 - protein, 15 aa, Plasmodium falciparum
NNNKKEENPIKNKND

SEQ ID NO: 3334563 - protein, 13 aa, Plasmodium falciparum
NNNKKEKNKRNDN

SEQ ID NO: 3334564 - protein, 19 aa, Plasmodium falciparum
NNNKKITKRGRAKKNSTIN

SEQ ID NO: 3334565 - protein, 9 aa, Plasmodium falciparum
NNNKKKKNL

SEQ ID NO: 3334566 - protein, 18 aa, Plasmodium falciparum
NNNKKKSTTGTSKDSTRK

SEQ ID NO: 3334567 - protein, 17 aa, Plasmodium falciparum
NNNKKKYKYKNNSLDKY

SEQ ID NO: 3334568 - protein, 11 aa, Plasmodium falciparum
NNNKKNNKNLV

SEQ ID NO: 3334569 - protein, 7 aa, Plasmodium falciparum
NNNKNFT

SEQ ID NO: 3334570 - protein, 8 aa, Plasmodium falciparum
NNNKNKNN

SEQ ID NO: 3334571 - protein, 38 aa, Plasmodium falciparum
NNNKNKNNITKEQEMKDNDFNPNELNDEQINDNKKMED

SEQ ID NO: 3334572 - protein, 30 aa, Plasmodium falciparum
NNNKNNGHNNFDERNSDNNINDNINSNDDN

SEQ ID NO: 3334573 - protein, 9 aa, Plasmodium falciparum
NNNKNNINS

SEQ ID NO: 3334574 - protein, 20 aa, Plasmodium falciparum
NNNKNNNMDYNNDHNNDHNN

SEQ ID NO: 3334575 - protein, 24 aa, Plasmodium falciparum
NNNKNNNNNKNNNNNNNNNNNSNV

SEQ ID NO: 3334576 - protein, 11 aa, Plasmodium falciparum
NNNKNNNNPIS

SEQ ID NO: 3334577 - protein, 10 aa, Plasmodium falciparum
NNNKNNNVED

SEQ ID NO: 3334578 - protein, 18 aa, Plasmodium falciparum
NNNKNNYSYNNNKSINEN

SEQ ID NO: 3334579 - protein, 10 aa, Plasmodium falciparum
NNNKNSTCSA

SEQ ID NO: 3334580 - protein, 11 aa, Plasmodium falciparum
NNNKQNDTYSQ

SEQ ID NO: 3334581 - protein, 9 aa, Plasmodium falciparum
NNNKQNNNS

SEQ ID NO: 3334582 - protein, 9 aa, Plasmodium falciparum
NNNKSCDNT

SEQ ID NO: 3334583 - protein, 6 aa, Plasmodium falciparum
NNNKSI

SEQ ID NO: 3334584 - protein, 7 aa, Plasmodium falciparum
NNNKSLK

SEQ ID NO: 3334585 - protein, 7 aa, Plasmodium falciparum
NNNKSQL

SEQ ID NO: 3334586 - protein, 8 aa, Plasmodium falciparum
NNNKSSTI

SEQ ID NO: 3334587 - protein, 26 aa, Plasmodium falciparum
NNNKSTNINNNNNNNNNNSNNNYSEN

SEQ ID NO: 3334588 - protein, 7 aa, Plasmodium falciparum
NNNKTHM

SEQ ID NO: 3334589 - protein, 11 aa, Plasmodium falciparum
NNNKYGKRNET

SEQ ID NO: 3334590 - protein, 15 aa, Plasmodium falciparum
NNNKYYNNHSNDLRN

SEQ ID NO: 3334591 - protein, 7 aa, Plasmodium falciparum
NNNLNSH

SEQ ID NO: 3334592 - protein, 14 aa, Plasmodium falciparum
NNNLQDNKNNYHTD

SEQ ID NO: 3334593 - protein, 8 aa, Plasmodium falciparum
NNNLQNSN

SEQ ID NO: 3334594 - protein, 8 aa, Plasmodium falciparum
NNNLQSTH

SEQ ID NO: 3334595 - protein, 5 aa, Plasmodium falciparum
NNNLR

SEQ ID NO: 3334596 - protein, 12 aa, Plasmodium falciparum
NNNLSKKTNYEK

SEQ ID NO: 3334597 - protein, 8 aa, Plasmodium falciparum
NNNLSNSQ

SEQ ID NO: 3334598 - protein, 8 aa, Plasmodium falciparum
NNNLSSRK

SEQ ID NO: 3334599 - protein, 16 aa, Plasmodium falciparum
NNNLYNDSNIKNKEPN

SEQ ID NO: 3334600 - protein, 7 aa, Plasmodium falciparum
NNNMDEK

SEQ ID NO: 3334601 - protein, 38 aa, Plasmodium falciparum
NNNMGNMNSNNNNLNNNNNNNNNNNNNNNNNSNNSNSI

SEQ ID NO: 3334602 - protein, 8 aa, Plasmodium falciparum
NNNMKDNT

SEQ ID NO: 3334603 - protein, 5 aa, Plasmodium falciparum
NNNMN

SEQ ID NO: 3334604 - protein, 6 aa, Plasmodium falciparum
NNNMNN

SEQ ID NO: 3334605 - protein, 9 aa, Plasmodium falciparum
NNNMNRNNS

SEQ ID NO: 3334606 - protein, 7 aa, Plasmodium falciparum
NNNMQDE

SEQ ID NO: 3334607 - protein, 38 aa, Plasmodium falciparum
NNNMSNNNIPNNNMPNNNVPNNNMPNNNVPNNNMPNNN

SEQ ID NO: 3334608 - protein, 10 aa, Plasmodium falciparum
NNNMSSSKRH

SEQ ID NO: 3334609 - protein, 13 aa, Plasmodium falciparum
NNNNAGNEKNEEN

SEQ ID NO: 3334610 - protein, 16 aa, Plasmodium falciparum
NNNNCDNNNCDNNNRD

SEQ ID NO: 3334611 - protein, 8 aa, Plasmodium falciparum
NNNNCNGY

SEQ ID NO: 3334612 - protein, 5 aa, Plasmodium falciparum
NNNND

SEQ ID NO: 3334613 - protein, 10 aa, Plasmodium falciparum
NNNNDDDDDY

SEQ ID NO: 3334614 - protein, 13 aa, Plasmodium falciparum
NNNNDDDNDNDND

SEQ ID NO: 3334615 - protein, 18 aa, Plasmodium falciparum
NNNNDDEKKKKNKEDTSY

SEQ ID NO: 3334616 - protein, 48 aa, Plasmodium falciparum
NNNNDDNNGDNNGDNNGDNNDDNNGDNNNDNNGDNNGDNNGDNNGDNN

SEQ ID NO: 3334617 - protein, 16 aa, Plasmodium falciparum
NNNNDHGGQDINSSPY

SEQ ID NO: 3334618 - protein, 13 aa, Plasmodium falciparum
NNNNDIQKDNKKK

SEQ ID NO: 3334619 - protein, 39 aa, Plasmodium falciparum
NNNNDKHNNNDDNNNDDNNNDDNNNDDNNNNNNNNKEEV

SEQ ID NO: 3334620 - protein, 7 aa, Plasmodium falciparum
NNNNDKK

SEQ ID NO: 3334621 - protein, 7 aa, Plasmodium falciparum
NNNNDKN

SEQ ID NO: 3334622 - protein, 16 aa, Plasmodium falciparum
NNNNDKSIGKEEEHNK

SEQ ID NO: 3334623 - protein, 27 aa, Plasmodium falciparum
NNNNDNDANNDSNDNNNNNNNNNNSNI

SEQ ID NO: 3334624 - protein, 9 aa, Plasmodium falciparum
NNNNDNNLV

SEQ ID NO: 3334625 - protein, 21 aa, Plasmodium falciparum
NNNNDNNNDNDNNNNNNNITN

SEQ ID NO: 3334626 - protein, 16 aa, Plasmodium falciparum
NNNNDNNNDNNNDNNI

SEQ ID NO: 3334627 - protein, 15 aa, Plasmodium falciparum
NNNNDNNNISSDNIP

SEQ ID NO: 3334628 - protein, 41 aa, Plasmodium falciparum
NNNNDNNNNNDINDNNNNNNNHNNNNNHNNNNNNNNNNGSY

SEQ ID NO: 3334629 - protein, 14 aa, Plasmodium falciparum
NNNNDNNNNNNDKS

SEQ ID NO: 3334630 - protein, 12 aa, Plasmodium falciparum
NNNNDNNTVKGK

SEQ ID NO: 3334631 - protein, 7 aa, Plasmodium falciparum
NNNNDRN

SEQ ID NO: 3334632 - protein, 34 aa, Plasmodium falciparum
NNNNDSNDDNNNDDNNNDNNNNDNASNNNNDTNN

SEQ ID NO: 3334633 - protein, 11 aa, Plasmodium falciparum
NNNNDSNNNNM

SEQ ID NO: 3334634 - protein, 10 aa, Plasmodium falciparum
NNNNEETKLE

SEQ ID NO: 3334635 - protein, 15 aa, Plasmodium falciparum
NNNNEINNNCNNNYD

SEQ ID NO: 3334636 - protein, 6 aa, Plasmodium falciparum
NNNNEK

SEQ ID NO: 3334637 - protein, 20 aa, Plasmodium falciparum
NNNNEKEKDKEKEKEKEKEN

SEQ ID NO: 3334638 - protein, 13 aa, Plasmodium falciparum
NNNNEKKEKEKRK

SEQ ID NO: 3334639 - protein, 10 aa, Plasmodium falciparum
NNNNENNNVA

SEQ ID NO: 3334640 - protein, 7 aa, Plasmodium falciparum
NNNNESI

SEQ ID NO: 3334641 - protein, 9 aa, Plasmodium falciparum
NNNNESITQ

SEQ ID NO: 3334642 - protein, 17 aa, Plasmodium falciparum
NNNNEYATINDKTDNNH

SEQ ID NO: 3334643 - protein, 7 aa, Plasmodium falciparum
NNNNFNN

SEQ ID NO: 3334644 - protein, 7 aa, Plasmodium falciparum
NNNNGSL

SEQ ID NO: 3334645 - protein, 19 aa, Plasmodium falciparum
NNNNGSNILGQDRKKNGHI

SEQ ID NO: 3334646 - protein, 10 aa, Plasmodium falciparum
NNNNHNNNNL

SEQ ID NO: 3334647 - protein, 40 aa, Plasmodium falciparum
NNNNIDGDNNNNNNIGDNNNNIDGDNNNNNNIGDNNNNID

SEQ ID NO: 3334648 - protein, 21 aa, Plasmodium falciparum
NNNNIENNKNGFNDDNINEDK

SEQ ID NO: 3334649 - protein, 14 aa, Plasmodium falciparum
NNNNIKKNNEYKCT

SEQ ID NO: 3334650 - protein, 6 aa, Plasmodium falciparum
NNNNIN

SEQ ID NO: 3334651 - protein, 16 aa, Plasmodium falciparum
NNNNINNNNINNNNNI

SEQ ID NO: 3334652 - protein, 16 aa, Plasmodium falciparum
NNNNINNNNNNNNYDN

SEQ ID NO: 3334653 - protein, 19 aa, Plasmodium falciparum
NNNNINNNNNNSNISSSAN

SEQ ID NO: 3334654 - protein, 9 aa, Plasmodium falciparum
NNNNINNSI

SEQ ID NO: 3334655 - protein, 20 aa, Plasmodium falciparum
NNNNINNSYNNINNKDVNNN

SEQ ID NO: 3334656 - protein, 12 aa, Plasmodium falciparum
NNNNINNSYNSY

SEQ ID NO: 3334657 - protein, 20 aa, Plasmodium falciparum
NNNNIQINDKGKSKNSNCNI

SEQ ID NO: 3334658 - protein, 6 aa, Plasmodium falciparum
NNNNIS

SEQ ID NO: 3334659 - protein, 19 aa, Plasmodium falciparum
NNNNISNGEKEKNKSGPIY

SEQ ID NO: 3334660 - protein, 14 aa, Plasmodium falciparum
NNNNISNKECDHNK

SEQ ID NO: 3334661 - protein, 13 aa, Plasmodium falciparum
NNNNISNTMNGRK

SEQ ID NO: 3334662 - protein, 11 aa, Plasmodium falciparum
NNNNISSSEHM

SEQ ID NO: 3334663 - protein, 6 aa, Plasmodium falciparum
NNNNIY

SEQ ID NO: 3334664 - protein, 19 aa, Plasmodium falciparum
NNNNIYNDNNYNDNNYNDN

SEQ ID NO: 3334665 - protein, 5 aa, Plasmodium falciparum
NNNNK

SEQ ID NO: 3334666 - protein, 17 aa, Plasmodium falciparum
NNNNKDCSYGKDTLSDS

SEQ ID NO: 3334667 - protein, 12 aa, Plasmodium falciparum
NNNNKDSDNINS

SEQ ID NO: 3334668 - protein, 16 aa, Plasmodium falciparum
NNNNKEEDDVEDDVER

SEQ ID NO: 3334669 - protein, 12 aa, Plasmodium falciparum
NNNNKEEENPVD

SEQ ID NO: 3334670 - protein, 10 aa, Plasmodium falciparum
NNNNKEEQTN

SEQ ID NO: 3334671 - protein, 8 aa, Plasmodium falciparum
NNNNKENV

SEQ ID NO: 3334672 - protein, 11 aa, Plasmodium falciparum
NNNNKGDKNAI

SEQ ID NO: 3334673 - protein, 11 aa, Plasmodium falciparum
NNNNKGGAMRG

SEQ ID NO: 3334674 - protein, 10 aa, Plasmodium falciparum
NNNNKIEEKE

SEQ ID NO: 3334675 - protein, 6 aa, Plasmodium falciparum
NNNNKK

SEQ ID NO: 3334676 - protein, 9 aa, Plasmodium falciparum
NNNNKKHKH

SEQ ID NO: 3334677 - protein, 8 aa, Plasmodium falciparum
NNNNKKKK

SEQ ID NO: 3334678 - protein, 25 aa, Plasmodium falciparum
NNNNKKKKQHTHTNTRTQKGCMDQS

SEQ ID NO: 3334679 - protein, 14 aa, Plasmodium falciparum
NNNNKKKNKEKKTN

SEQ ID NO: 3334680 - protein, 20 aa, Plasmodium falciparum
NNNNKKKNNNNNKNNNKNNK

SEQ ID NO: 3334681 - protein, 21 aa, Plasmodium falciparum
NNNNKKNKNKKNNNNNNNGGI

SEQ ID NO: 3334682 - protein, 24 aa, Plasmodium falciparum
NNNNKKNNNNNNDEGLEKNTGKFY

SEQ ID NO: 3334683 - protein, 8 aa, Plasmodium falciparum
NNNNKKYN

SEQ ID NO: 3334684 - protein, 12 aa, Plasmodium falciparum
NNNNKNENNGYD

SEQ ID NO: 3334685 - protein, 9 aa, Plasmodium falciparum
NNNNKNKNI

SEQ ID NO: 3334686 - protein, 10 aa, Plasmodium falciparum
NNNNKNNDMG

SEQ ID NO: 3334687 - protein, 19 aa, Plasmodium falciparum
NNNNKNNKYNNQQGNTSGL

SEQ ID NO: 3334688 - protein, 37 aa, Plasmodium falciparum
NNNNKNNNNINNDNNNNNNNNNKGDDQVKKDKEIKEY

SEQ ID NO: 3334689 - protein, 9 aa, Plasmodium falciparum
NNNNKNYEQ

SEQ ID NO: 3334690 - protein, 12 aa, Plasmodium falciparum
NNNNKPWKNTKW

SEQ ID NO: 3334691 - protein, 16 aa, Plasmodium falciparum
NNNNKVSKKKSTLSTY

SEQ ID NO: 3334692 - protein, 34 aa, Plasmodium falciparum
NNNNKYDNNCNNNNKYDNNCNNNNKYDNNCNNNK

SEQ ID NO: 3334693 - protein, 14 aa, Plasmodium falciparum
NNNNKYKKEDNKTQ

SEQ ID NO: 3334694 - protein, 11 aa, Plasmodium falciparum
NNNNKYVNDES

SEQ ID NO: 3334695 - protein, 16 aa, Plasmodium falciparum
NNNNLEEGDTNRSHVP

SEQ ID NO: 3334696 - protein, 8 aa, Plasmodium falciparum
NNNNLNNN

SEQ ID NO: 3334697 - protein, 7 aa, Plasmodium falciparum
NNNNMAG

SEQ ID NO: 3334698 - protein, 6 aa, Plasmodium falciparum
NNNNMD

SEQ ID NO: 3334699 - protein, 13 aa, Plasmodium falciparum
NNNNMEEEEEDQY

SEQ ID NO: 3334700 - protein, 6 aa, Plasmodium falciparum
NNNNMK

SEQ ID NO: 3334701 - protein, 12 aa, Plasmodium falciparum
NNNNMKRYNSST

SEQ ID NO: 3334702 - protein, 11 aa, Plasmodium falciparum
NNNNMNDNNNN

SEQ ID NO: 3334703 - protein, 19 aa, Plasmodium falciparum
NNNNMNGKQNDDDDDDDED

SEQ ID NO: 3334704 - protein, 7 aa, Plasmodium falciparum
NNNNMRN

SEQ ID NO: 3334705 - protein, 8 aa, Plasmodium falciparum
NNNNNAVV

SEQ ID NO: 3334706 - protein, 8 aa, Plasmodium falciparum
NNNNNCEV

SEQ ID NO: 3334707 - protein, 16 aa, Plasmodium falciparum
NNNNNCSNNPSSSNNI

SEQ ID NO: 3334708 - protein, 13 aa, Plasmodium falciparum
NNNNNDDDDRGSL

SEQ ID NO: 3334709 - protein, 11 aa, Plasmodium falciparum
NNNNNDDEQMN

SEQ ID NO: 3334710 - protein, 20 aa, Plasmodium falciparum
NNNNNDNNNDNNNDNNNNSH

SEQ ID NO: 3334711 - protein, 18 aa, Plasmodium falciparum
NNNNNDNNNNNNNNNNMN

SEQ ID NO: 3334712 - protein, 11 aa, Plasmodium falciparum
NNNNNDNYSNN

SEQ ID NO: 3334713 - protein, 9 aa, Plasmodium falciparum
NNNNNDSEI

SEQ ID NO: 3334714 - protein, 15 aa, Plasmodium falciparum
NNNNNDSNNNNNNND

SEQ ID NO: 3334715 - protein, 10 aa, Plasmodium falciparum
NNNNNEESHE

SEQ ID NO: 3334716 - protein, 17 aa, Plasmodium falciparum
NNNNNEIDLNEKSSNNL

SEQ ID NO: 3334717 - protein, 9 aa, Plasmodium falciparum
NNNNNGDNM

SEQ ID NO: 3334718 - protein, 17 aa, Plasmodium falciparum
NNNNNGIQNGSSINEGV

SEQ ID NO: 3334719 - protein, 17 aa, Plasmodium falciparum
NNNNNIHGSNNNTNTTM

SEQ ID NO: 3334720 - protein, 14 aa, Plasmodium falciparum
NNNNNIKHDEHTKL

SEQ ID NO: 3334721 - protein, 14 aa, Plasmodium falciparum
NNNNNIKKKNNNDI

SEQ ID NO: 3334722 - protein, 7 aa, Plasmodium falciparum
NNNNNIN

SEQ ID NO: 3334723 - protein, 8 aa, Plasmodium falciparum
NNNNNINE

SEQ ID NO: 3334724 - protein, 8 aa, Plasmodium falciparum
NNNNNINI

SEQ ID NO: 3334725 - protein, 20 aa, Plasmodium falciparum
NNNNNINNIEEDSKNNSNDI

SEQ ID NO: 3334726 - protein, 20 aa, Plasmodium falciparum
NNNNNINNNNNCGTGYQQPK

SEQ ID NO: 3334727 - protein, 34 aa, Plasmodium falciparum
NNNNNINRNNNINNYSNNYSNNYSKNYSNNYSNN

SEQ ID NO: 3334728 - protein, 19 aa, Plasmodium falciparum
NNNNNINSNNNYSSDGRYE

SEQ ID NO: 3334729 - protein, 23 aa, Plasmodium falciparum
NNNNNINTTTNNNNNNNNNMHDN

SEQ ID NO: 3334730 - protein, 15 aa, Plasmodium falciparum
NNNNNISNNNMNNNM

SEQ ID NO: 3334731 - protein, 31 aa, Plasmodium falciparum
NNNNNISNTSNNNCNNNSCGSSSSYNNKTND

SEQ ID NO: 3334732 - protein, 7 aa, Plasmodium falciparum
NNNNNKK

SEQ ID NO: 3334733 - protein, 9 aa, Plasmodium falciparum
NNNNNKKKD

SEQ ID NO: 3334734 - protein, 15 aa, Plasmodium falciparum
NNNNNKKKNNNNNVH

SEQ ID NO: 3334735 - protein, 16 aa, Plasmodium falciparum
NNNNNKNAHSNKSNTM

SEQ ID NO: 3334736 - protein, 15 aa, Plasmodium falciparum
NNNNNKNNNKNNIYN

SEQ ID NO: 3334737 - protein, 15 aa, Plasmodium falciparum
NNNNNKNNNKNNYNN

SEQ ID NO: 3334738 - protein, 11 aa, Plasmodium falciparum
NNNNNKNNRIH

SEQ ID NO: 3334739 - protein, 28 aa, Plasmodium falciparum
NNNNNKSDMDYNSNMDNNNNNNNNNNNN

SEQ ID NO: 3334740 - protein, 9 aa, Plasmodium falciparum
NNNNNKSIA

SEQ ID NO: 3334741 - protein, 12 aa, Plasmodium falciparum
NNNNNKSNKGQY

SEQ ID NO: 3334742 - protein, 17 aa, Plasmodium falciparum
NNNNNKTNQHNTQSNSF

SEQ ID NO: 3334743 - protein, 6 aa, Plasmodium falciparum
NNNNNL

SEQ ID NO: 3334744 - protein, 12 aa, Plasmodium falciparum
NNNNNLNNYSNT

SEQ ID NO: 3334745 - protein, 6 aa, Plasmodium falciparum
NNNNNM

SEQ ID NO: 3334746 - protein, 47 aa, Plasmodium falciparum
NNNNNMNSAVNNNSSNGNNMKNENSENKNVADNNDSLNNNKNNNNNI

SEQ ID NO: 3334747 - protein, 23 aa, Plasmodium falciparum
NNNNNMNSNPTSSVTSKKNENNN

SEQ ID NO: 3334748 - protein, 7 aa, Plasmodium falciparum
NNNNNNC

SEQ ID NO: 3334749 - protein, 9 aa, Plasmodium falciparum
NNNNNNDDN

SEQ ID NO: 3334750 - protein, 21 aa, Plasmodium falciparum
NNNNNNDEYSSYNSDNRHNDG

SEQ ID NO: 3334751 - protein, 9 aa, Plasmodium falciparum
NNNNNNDLD

SEQ ID NO: 3334752 - protein, 13 aa, Plasmodium falciparum
NNNNNNDMEYSND

SEQ ID NO: 3334753 - protein, 20 aa, Plasmodium falciparum
NNNNNNDNDNNNKDNSPVNR

SEQ ID NO: 3334754 - protein, 9 aa, Plasmodium falciparum
NNNNNNDNI

SEQ ID NO: 3334755 - protein, 23 aa, Plasmodium falciparum
NNNNNNDNNDNNNNDNNNNNNNN

SEQ ID NO: 3334756 - protein, 19 aa, Plasmodium falciparum
NNNNNNDNNNNNNKSNSNY

SEQ ID NO: 3334757 - protein, 29 aa, Plasmodium falciparum
NNNNNNDNNSSNNNNNNNNINSGTHNVNN

SEQ ID NO: 3334758 - protein, 8 aa, Plasmodium falciparum
NNNNNNDS

SEQ ID NO: 3334759 - protein, 10 aa, Plasmodium falciparum
NNNNNNDYNN

SEQ ID NO: 3334760 - protein, 22 aa, Plasmodium falciparum
NNNNNNEEEEEEEKNIKEYPNN

SEQ ID NO: 3334761 - protein, 37 aa, Plasmodium falciparum
NNNNNNEHNNEHNNEHNNEHNNEHNNEHNNEHNNEHN

SEQ ID NO: 3334762 - protein, 69 aa, Plasmodium falciparum
NNNNNNEKDQNADQYQDQNKNHKQDQRQDQNKSHKQDQLHDQNQNQGQLHDQNQNQGQLHDQNQNQGQL

SEQ ID NO: 3334763 - protein, 10 aa, Plasmodium falciparum
NNNNNNENNI

SEQ ID NO: 3334764 - protein, 11 aa, Plasmodium falciparum
NNNNNNERNNL

SEQ ID NO: 3334765 - protein, 9 aa, Plasmodium falciparum
NNNNNNGDM

SEQ ID NO: 3334766 - protein, 19 aa, Plasmodium falciparum
NNNNNNHNSNNNSNNDNNR

SEQ ID NO: 3334767 - protein, 10 aa, Plasmodium falciparum
NNNNNNIGDI

SEQ ID NO: 3334768 - protein, 35 aa, Plasmodium falciparum
NNNNNNIISNNKNEASFNTDNINTNSGREEEKISN

SEQ ID NO: 3334769 - protein, 10 aa, Plasmodium falciparum
NNNNNNIKEE

SEQ ID NO: 3334770 - protein, 8 aa, Plasmodium falciparum
NNNNNNIN

SEQ ID NO: 3334771 - protein, 9 aa, Plasmodium falciparum
NNNNNNINN

SEQ ID NO: 3334772 - protein, 23 aa, Plasmodium falciparum
NNNNNNINNNNNNNNNNNNNNNN

SEQ ID NO: 3334773 - protein, 25 aa, Plasmodium falciparum
NNNNNNINSSNVNQQYGSRNEPTLN

SEQ ID NO: 3334774 - protein, 12 aa, Plasmodium falciparum
NNNNNNISNENI

SEQ ID NO: 3334775 - protein, 16 aa, Plasmodium falciparum
NNNNNNITKSHEETSV

SEQ ID NO: 3334776 - protein, 16 aa, Plasmodium falciparum
NNNNNNITSNRNNINN

SEQ ID NO: 3334777 - protein, 16 aa, Plasmodium falciparum
NNNNNNIYDNNNSNNY

SEQ ID NO: 3334778 - protein, 7 aa, Plasmodium falciparum
NNNNNNK

SEQ ID NO: 3334779 - protein, 18 aa, Plasmodium falciparum
NNNNNNKATNKKDYSSYL

SEQ ID NO: 3334780 - protein, 13 aa, Plasmodium falciparum
NNNNNNKESIQST

SEQ ID NO: 3334781 - protein, 20 aa, Plasmodium falciparum
NNNNNNKNNHYKDTHKNGYY

SEQ ID NO: 3334782 - protein, 11 aa, Plasmodium falciparum
NNNNNNKNTYY

SEQ ID NO: 3334783 - protein, 8 aa, Plasmodium falciparum
NNNNNNMN

SEQ ID NO: 3334784 - protein, 17 aa, Plasmodium falciparum
NNNNNNNDDDNEEESNN

SEQ ID NO: 3334785 - protein, 10 aa, Plasmodium falciparum
NNNNNNNDLY

SEQ ID NO: 3334786 - protein, 10 aa, Plasmodium falciparum
NNNNNNNDND

SEQ ID NO: 3334787 - protein, 18 aa, Plasmodium falciparum
NNNNNNNDNNDNKDELLN

SEQ ID NO: 3334788 - protein, 46 aa, Plasmodium falciparum
NNNNNNNDNNNDNNNDNNNDNNNDNNNDNNNENNNDNNNFNNYSDE

SEQ ID NO: 3334789 - protein, 15 aa, Plasmodium falciparum
NNNNNNNDNVYQNKS

SEQ ID NO: 3334790 - protein, 10 aa, Plasmodium falciparum
NNNNNNNDTT

SEQ ID NO: 3334791 - protein, 13 aa, Plasmodium falciparum
NNNNNNNEGTKKN

SEQ ID NO: 3334792 - protein, 39 aa, Plasmodium falciparum
NNNNNNNEKNNEKNNEKNNENNNENNNEKNNEKNNEKNN

SEQ ID NO: 3334793 - protein, 10 aa, Plasmodium falciparum
NNNNNNNIDE

SEQ ID NO: 3334794 - protein, 9 aa, Plasmodium falciparum
NNNNNNNIH

SEQ ID NO: 3334795 - protein, 17 aa, Plasmodium falciparum
NNNNNNNIISSSSSTSH

SEQ ID NO: 3334796 - protein, 14 aa, Plasmodium falciparum
NNNNNNNIQSKNKN

SEQ ID NO: 3334797 - protein, 18 aa, Plasmodium falciparum
NNNNNNNIYDKSKKNNFN

SEQ ID NO: 3334798 - protein, 9 aa, Plasmodium falciparum
NNNNNNNKH

SEQ ID NO: 3334799 - protein, 9 aa, Plasmodium falciparum
NNNNNNNKL

SEQ ID NO: 3334800 - protein, 12 aa, Plasmodium falciparum
NNNNNNNKLKNY

SEQ ID NO: 3334801 - protein, 23 aa, Plasmodium falciparum
NNNNNNNKNNKKNNNYNNNNTPV

SEQ ID NO: 3334802 - protein, 17 aa, Plasmodium falciparum
NNNNNNNKNNNEYSNDR

SEQ ID NO: 3334803 - protein, 13 aa, Plasmodium falciparum
NNNNNNNKNNNYD

SEQ ID NO: 3334804 - protein, 11 aa, Plasmodium falciparum
NNNNNNNKTAN

SEQ ID NO: 3334805 - protein, 13 aa, Plasmodium falciparum
NNNNNNNLTNPTS

SEQ ID NO: 3334806 - protein, 10 aa, Plasmodium falciparum
NNNNNNNMDN

SEQ ID NO: 3334807 - protein, 9 aa, Plasmodium falciparum
NNNNNNNMK

SEQ ID NO: 3334808 - protein, 19 aa, Plasmodium falciparum
NNNNNNNMNNSNHNNNNNN

SEQ ID NO: 3334809 - protein, 17 aa, Plasmodium falciparum
NNNNNNNMSNVNKSTNG

SEQ ID NO: 3334810 - protein, 17 aa, Plasmodium falciparum
NNNNNNNNANLDKSPYD

SEQ ID NO: 3334811 - protein, 9 aa, Plasmodium falciparum
NNNNNNNNC

SEQ ID NO: 3334812 - protein, 9 aa, Plasmodium falciparum
NNNNNNNND

SEQ ID NO: 3334813 - protein, 19 aa, Plasmodium falciparum
NNNNNNNNDHHHDNDGEEY

SEQ ID NO: 3334814 - protein, 27 aa, Plasmodium falciparum
NNNNNNNNDNDNKNEENLKNYKDFYDD

SEQ ID NO: 3334815 - protein, 14 aa, Plasmodium falciparum
NNNNNNNNDNNIYN

SEQ ID NO: 3334816 - protein, 13 aa, Plasmodium falciparum
NNNNNNNNDNNNN

SEQ ID NO: 3334817 - protein, 16 aa, Plasmodium falciparum
NNNNNNNNDNNNNNNN

SEQ ID NO: 3334818 - protein, 27 aa, Plasmodium falciparum
NNNNNNNNDSSNNSSNNNNNSNNSSNI

SEQ ID NO: 3334819 - protein, 11 aa, Plasmodium falciparum
NNNNNNNNEKI

SEQ ID NO: 3334820 - protein, 9 aa, Plasmodium falciparum
NNNNNNNNF

SEQ ID NO: 3334821 - protein, 11 aa, Plasmodium falciparum
NNNNNNNNHNH

SEQ ID NO: 3334822 - protein, 9 aa, Plasmodium falciparum
NNNNNNNNI

SEQ ID NO: 3334823 - protein, 10 aa, Plasmodium falciparum
NNNNNNNNIH

SEQ ID NO: 3334824 - protein, 39 aa, Plasmodium falciparum
NNNNNNNNIKRNNNYMNNNNNNNINNNNGRMEKPRYKPP

SEQ ID NO: 3334825 - protein, 13 aa, Plasmodium falciparum
NNNNNNNNINQKE

SEQ ID NO: 3334826 - protein, 9 aa, Plasmodium falciparum
NNNNNNNNK

SEQ ID NO: 3334827 - protein, 14 aa, Plasmodium falciparum
NNNNNNNNKNKNNY

SEQ ID NO: 3334828 - protein, 14 aa, Plasmodium falciparum
NNNNNNNNKNNITH

SEQ ID NO: 3334829 - protein, 21 aa, Plasmodium falciparum
NNNNNNNNKNNSNNNKSCSNI

SEQ ID NO: 3334830 - protein, 22 aa, Plasmodium falciparum
NNNNNNNNKTSSSNNQINTNYS

SEQ ID NO: 3334831 - protein, 17 aa, Plasmodium falciparum
NNNNNNNNKYANINSSD

SEQ ID NO: 3334832 - protein, 17 aa, Plasmodium falciparum
NNNNNNNNLNNSTDYQQ

SEQ ID NO: 3334833 - protein, 9 aa, Plasmodium falciparum
NNNNNNNNM

SEQ ID NO: 3334834 - protein, 10 aa, Plasmodium falciparum
NNNNNNNNMN

SEQ ID NO: 3334835 - protein, 10 aa, Plasmodium falciparum
NNNNNNNNND

SEQ ID NO: 3334836 - protein, 23 aa, Plasmodium falciparum
NNNNNNNNNDNKDNNNNSNKYDG

SEQ ID NO: 3334837 - protein, 12 aa, Plasmodium falciparum
NNNNNNNNNDNN

SEQ ID NO: 3334838 - protein, 48 aa, Plasmodium falciparum
NNNNNNNNNDNNNNNNNNNNNNNDNNDNNNNDNNDNNNNNNNNKNCEK

SEQ ID NO: 3334839 - protein, 20 aa, Plasmodium falciparum
NNNNNNNNNEEDEEEKRIER

SEQ ID NO: 3334840 - protein, 20 aa, Plasmodium falciparum
NNNNNNNNNINNNNNNNINN

SEQ ID NO: 3334841 - protein, 16 aa, Plasmodium falciparum
NNNNNNNNNIYKGNEN

SEQ ID NO: 3334842 - protein, 17 aa, Plasmodium falciparum
NNNNNNNNNKINSSNSL

SEQ ID NO: 3334843 - protein, 33 aa, Plasmodium falciparum
NNNNNNNNNKLGGIKENDMKGDESKMTSSSGDY

SEQ ID NO: 3334844 - protein, 13 aa, Plasmodium falciparum
NNNNNNNNNKNNL

SEQ ID NO: 3334845 - protein, 18 aa, Plasmodium falciparum
NNNNNNNNNKYSNNEINS

SEQ ID NO: 3334846 - protein, 18 aa, Plasmodium falciparum
NNNNNNNNNMGNNSNNNH

SEQ ID NO: 3334847 - protein, 30 aa, Plasmodium falciparum
NNNNNNNNNNDKNDNHYNDEKKKLHEKNEE

SEQ ID NO: 3334848 - protein, 11 aa, Plasmodium falciparum
NNNNNNNNNNF

SEQ ID NO: 3334849 - protein, 15 aa, Plasmodium falciparum
NNNNNNNNNNINSGN

SEQ ID NO: 3334850 - protein, 35 aa, Plasmodium falciparum
NNNNNNNNNNINTNKKKKIKKIKKNTNNNEEGDDV

SEQ ID NO: 3334851 - protein, 16 aa, Plasmodium falciparum
NNNNNNNNNNISDELQ

SEQ ID NO: 3334852 - protein, 14 aa, Plasmodium falciparum
NNNNNNNNNNKNNI

SEQ ID NO: 3334853 - protein, 21 aa, Plasmodium falciparum
NNNNNNNNNNLNATKKNNTIN

SEQ ID NO: 3334854 - protein, 12 aa, Plasmodium falciparum
NNNNNNNNNNMN

SEQ ID NO: 3334855 - protein, 13 aa, Plasmodium falciparum
NNNNNNNNNNMNS

SEQ ID NO: 3334856 - protein, 12 aa, Plasmodium falciparum
NNNNNNNNNNMY

SEQ ID NO: 3334857 - protein, 19 aa, Plasmodium falciparum
NNNNNNNNNNNATTSTSTF

SEQ ID NO: 3334858 - protein, 17 aa, Plasmodium falciparum
NNNNNNNNNNNDDTSNN

SEQ ID NO: 3334859 - protein, 15 aa, Plasmodium falciparum
NNNNNNNNNNNGSVN

SEQ ID NO: 3334860 - protein, 12 aa, Plasmodium falciparum
NNNNNNNNNNNI

SEQ ID NO: 3334861 - protein, 24 aa, Plasmodium falciparum
NNNNNNNNNNNNCNNSSNSNSNSN

SEQ ID NO: 3334862 - protein, 18 aa, Plasmodium falciparum
NNNNNNNNNNNNDDDNKI

SEQ ID NO: 3334863 - protein, 14 aa, Plasmodium falciparum
NNNNNNNNNNNNDN

SEQ ID NO: 3334864 - protein, 21 aa, Plasmodium falciparum
NNNNNNNNNNNNFKRDNESSL

SEQ ID NO: 3334865 - protein, 21 aa, Plasmodium falciparum
NNNNNNNNNNNNHNSDNIHNS

SEQ ID NO: 3334866 - protein, 13 aa, Plasmodium falciparum
NNNNNNNNNNNNI

SEQ ID NO: 3334867 - protein, 13 aa, Plasmodium falciparum
NNNNNNNNNNNNK

SEQ ID NO: 3334868 - protein, 20 aa, Plasmodium falciparum
NNNNNNNNNNNNKNDKEKPY

SEQ ID NO: 3334869 - protein, 16 aa, Plasmodium falciparum
NNNNNNNNNNNNNDKS

SEQ ID NO: 3334870 - protein, 21 aa, Plasmodium falciparum
NNNNNNNNNNNNNDNNNNISN

SEQ ID NO: 3334871 - protein, 39 aa, Plasmodium falciparum
NNNNNNNNNNNNNHNNNNNNNNNHNNNNNNNNGDNKNNN

SEQ ID NO: 3334872 - protein, 17 aa, Plasmodium falciparum
NNNNNNNNNNNNNNDIY

SEQ ID NO: 3334873 - protein, 28 aa, Plasmodium falciparum
NNNNNNNNNNNNNNNNINNNINNNNNNF

SEQ ID NO: 3334874 - protein, 23 aa, Plasmodium falciparum
NNNNNNNNNNNNNNNNNDNNDGD

SEQ ID NO: 3334875 - protein, 18 aa, Plasmodium falciparum
NNNNNNNNNNNNNNNNNN

SEQ ID NO: 3334876 - protein, 39 aa, Plasmodium falciparum
NNNNNNNNNNNNNNNNNNISNNINNSNNSGNNNDASTSF

SEQ ID NO: 3334877 - protein, 53 aa, Plasmodium falciparum
NNNNNNNNNNNNNNNNNNKLNKKKKKKKNSITTNINKKNNNKINRSNNINNSY

SEQ ID NO: 3334878 - protein, 22 aa, Plasmodium falciparum
NNNNNNNNNNNNNNNNNNNNNI

SEQ ID NO: 3334879 - protein, 30 aa, Plasmodium falciparum
NNNNNNNNNNNNNNNNNNNNNNNNNNNNNN

SEQ ID NO: 3334880 - protein, 42 aa, Plasmodium falciparum
NNNNNNNNNNNNNNNNNNNNNNNNNNNNNNNNNVTTKPNKEA

SEQ ID NO: 3334881 - protein, 42 aa, Plasmodium falciparum
NNNNNNNNNNNNNNNNNNNNNNNNNNNYNSSCSSSSNKATNI

SEQ ID NO: 3334882 - protein, 35 aa, Plasmodium falciparum
NNNNNNNNNNNNNNNNNNNNNNNNNNSNNNNKIES

SEQ ID NO: 3334883 - protein, 22 aa, Plasmodium falciparum
NNNNNNNNNNNNNNNNNNNSMN

SEQ ID NO: 3334884 - protein, 42 aa, Plasmodium falciparum
NNNNNNNNNNNNNNNNNSNNNNNNSNNNNNNSNNNNNNNEEI

SEQ ID NO: 3334885 - protein, 20 aa, Plasmodium falciparum
NNNNNNNNNNNNNNNNSEHI

SEQ ID NO: 3334886 - protein, 18 aa, Plasmodium falciparum
NNNNNNNNNNNNNNNNVE

SEQ ID NO: 3334887 - protein, 18 aa, Plasmodium falciparum
NNNNNNNNNNNNNNNSFR

SEQ ID NO: 3334888 - protein, 16 aa, Plasmodium falciparum
NNNNNNNNNNNNNNNT

SEQ ID NO: 3334889 - protein, 20 aa, Plasmodium falciparum
NNNNNNNNNNNNNNRRGSLY

SEQ ID NO: 3334890 - protein, 15 aa, Plasmodium falciparum
NNNNNNNNNNNNNNY

SEQ ID NO: 3334891 - protein, 29 aa, Plasmodium falciparum
NNNNNNNNNNNNNQKKGTCGEDALNEEQK

SEQ ID NO: 3334892 - protein, 22 aa, Plasmodium falciparum
NNNNNNNNNNNNSHNNHLPQPN

SEQ ID NO: 3334893 - protein, 20 aa, Plasmodium falciparum
NNNNNNNNNNNNSNNSNNSN

SEQ ID NO: 3334894 - protein, 27 aa, Plasmodium falciparum
NNNNNNNNNNNSNNNNNNSFSNDDNKL

SEQ ID NO: 3334895 - protein, 18 aa, Plasmodium falciparum
NNNNNNNNNNNSNRPGGA

SEQ ID NO: 3334896 - protein, 63 aa, Plasmodium falciparum
NNNNNNNNNNNTGMNKGQDKGANTGESNNNNNNNNNNNNNSSSISSSSAVPNVNESSKNTSVY

SEQ ID NO: 3334897 - protein, 21 aa, Plasmodium falciparum
NNNNNNNNNNNTYNNNDHSVN

SEQ ID NO: 3334898 - protein, 23 aa, Plasmodium falciparum
NNNNNNNNNNNVNNNYSGNPNLD

SEQ ID NO: 3334899 - protein, 12 aa, Plasmodium falciparum
NNNNNNNNNNNY

SEQ ID NO: 3334900 - protein, 46 aa, Plasmodium falciparum
NNNNNNNNNNNYNNNNNYNNNNNYNNNNNYNNNNNYNNNSNKEDDA

SEQ ID NO: 3334901 - protein, 21 aa, Plasmodium falciparum
NNNNNNNNNNQHHHQNNNSNI

SEQ ID NO: 3334902 - protein, 23 aa, Plasmodium falciparum
NNNNNNNNNNSNSNNNNNNNNIG

SEQ ID NO: 3334903 - protein, 31 aa, Plasmodium falciparum
NNNNNNNNNSINNSNNEYTGNNYNNNNKGNH

SEQ ID NO: 3334904 - protein, 27 aa, Plasmodium falciparum
NNNNNNNNNSNSNDNNNNNKKNNSDKV

SEQ ID NO: 3334905 - protein, 14 aa, Plasmodium falciparum
NNNNNNNNNSSNIT

SEQ ID NO: 3334906 - protein, 13 aa, Plasmodium falciparum
NNNNNNNNNSSSV

SEQ ID NO: 3334907 - protein, 14 aa, Plasmodium falciparum
NNNNNNNNNTHNSI

SEQ ID NO: 3334908 - protein, 10 aa, Plasmodium falciparum
NNNNNNNNNV

SEQ ID NO: 3334909 - protein, 10 aa, Plasmodium falciparum
NNNNNNNNNY

SEQ ID NO: 3334910 - protein, 12 aa, Plasmodium falciparum
NNNNNNNNNYNN

SEQ ID NO: 3334911 - protein, 20 aa, Plasmodium falciparum
NNNNNNNNPFNNNKGPFSNY

SEQ ID NO: 3334912 - protein, 18 aa, Plasmodium falciparum
NNNNNNNNQHTISAQENS

SEQ ID NO: 3334913 - protein, 15 aa, Plasmodium falciparum
NNNNNNNNREVYNEE

SEQ ID NO: 3334914 - protein, 13 aa, Plasmodium falciparum
NNNNNNNNRGQNK

SEQ ID NO: 3334915 - protein, 15 aa, Plasmodium falciparum
NNNNNNNNRKSNNNI

SEQ ID NO: 3334916 - protein, 22 aa, Plasmodium falciparum
NNNNNNNNRNNSSSSYRHTNQS

SEQ ID NO: 3334917 - protein, 11 aa, Plasmodium falciparum
NNNNNNNNSIS

SEQ ID NO: 3334918 - protein, 44 aa, Plasmodium falciparum
NNNNNNNNSKSNYSDSKKVTPNSNSNSNSNSSSSSNSSSSNNNH

SEQ ID NO: 3334919 - protein, 10 aa, Plasmodium falciparum
NNNNNNNNSN

SEQ ID NO: 3334920 - protein, 12 aa, Plasmodium falciparum
NNNNNNNNSNIN

SEQ ID NO: 3334921 - protein, 16 aa, Plasmodium falciparum
NNNNNNNNSNNNNGGI

SEQ ID NO: 3334922 - protein, 33 aa, Plasmodium falciparum
NNNNNNNNSNNNNNNNNNISNNISNNKDCDEYD

SEQ ID NO: 3334923 - protein, 11 aa, Plasmodium falciparum
NNNNNNNNSNT

SEQ ID NO: 3334924 - protein, 15 aa, Plasmodium falciparum
NNNNNNNNSSSGSNI

SEQ ID NO: 3334925 - protein, 15 aa, Plasmodium falciparum
NNNNNNNNSSSNECL

SEQ ID NO: 3334926 - protein, 10 aa, Plasmodium falciparum
NNNNNNNNTM

SEQ ID NO: 3334927 - protein, 11 aa, Plasmodium falciparum
NNNNNNNNTSY

SEQ ID NO: 3334928 - protein, 17 aa, Plasmodium falciparum
NNNNNNNNVDNSKEEEN

SEQ ID NO: 3334929 - protein, 11 aa, Plasmodium falciparum
NNNNNNNNVYS

SEQ ID NO: 3334930 - protein, 17 aa, Plasmodium falciparum
NNNNNNNNYNNNYNNER

SEQ ID NO: 3334931 - protein, 17 aa, Plasmodium falciparum
NNNNNNNNYNNNYNNNN

SEQ ID NO: 3334932 - protein, 23 aa, Plasmodium falciparum
NNNNNNNNYNPKKSPNSANSIEK

SEQ ID NO: 3334933 - protein, 10 aa, Plasmodium falciparum
NNNNNNNNYY

SEQ ID NO: 3334934 - protein, 24 aa, Plasmodium falciparum
NNNNNNNRNRKEMHKRKKKNSLYQ

SEQ ID NO: 3334935 - protein, 9 aa, Plasmodium falciparum
NNNNNNNSF

SEQ ID NO: 3334936 - protein, 11 aa, Plasmodium falciparum
NNNNNNNSNIN

SEQ ID NO: 3334937 - protein, 17 aa, Plasmodium falciparum
NNNNNNNSNNMNSSNMN

SEQ ID NO: 3334938 - protein, 13 aa, Plasmodium falciparum
NNNNNNNSNNNHI

SEQ ID NO: 3334939 - protein, 16 aa, Plasmodium falciparum
NNNNNNNSNNNNSNNY

SEQ ID NO: 3334940 - protein, 17 aa, Plasmodium falciparum
NNNNNNNSNSSNNNNND

SEQ ID NO: 3334941 - protein, 13 aa, Plasmodium falciparum
NNNNNNNSSSGGG

SEQ ID NO: 3334942 - protein, 18 aa, Plasmodium falciparum
NNNNNNNVNSINNNNNSY

SEQ ID NO: 3334943 - protein, 9 aa, Plasmodium falciparum
NNNNNNNYI

SEQ ID NO: 3334944 - protein, 32 aa, Plasmodium falciparum
NNNNNNNYNNNKKDDKRIDSRGSHNKSNNSNY

SEQ ID NO: 3334945 - protein, 14 aa, Plasmodium falciparum
NNNNNNPSCNDDEQ

SEQ ID NO: 3334946 - protein, 9 aa, Plasmodium falciparum
NNNNNNPSY

SEQ ID NO: 3334947 - protein, 8 aa, Plasmodium falciparum
NNNNNNQD

SEQ ID NO: 3334948 - protein, 38 aa, Plasmodium falciparum
NNNNNNQNDMNQNNVNQNNVNQNNINQNNINQNNVNQN

SEQ ID NO: 3334949 - protein, 9 aa, Plasmodium falciparum
NNNNNNQYV

SEQ ID NO: 3334950 - protein, 9 aa, Plasmodium falciparum
NNNNNNRKK

SEQ ID NO: 3334951 - protein, 12 aa, Plasmodium falciparum
NNNNNNRNSGSI

SEQ ID NO: 3334952 - protein, 8 aa, Plasmodium falciparum
NNNNNNRS

SEQ ID NO: 3334953 - protein, 15 aa, Plasmodium falciparum
NNNNNNRSYTNYTNN

SEQ ID NO: 3334954 - protein, 11 aa, Plasmodium falciparum
NNNNNNSDVGT

SEQ ID NO: 3334955 - protein, 8 aa, Plasmodium falciparum
NNNNNNSN

SEQ ID NO: 3334956 - protein, 25 aa, Plasmodium falciparum
NNNNNNSNAYEHNNKYDQYNNTYDY

SEQ ID NO: 3334957 - protein, 18 aa, Plasmodium falciparum
NNNNNNSNINNNKSGANI

SEQ ID NO: 3334958 - protein, 18 aa, Plasmodium falciparum
NNNNNNSNNLNDDNINNN

SEQ ID NO: 3334959 - protein, 53 aa, Plasmodium falciparum
NNNNNNSNNNNNSNNNNNSNNNNNSNRNHNNNNNNNNNHNNNNNNNNNNNHNS

SEQ ID NO: 3334960 - protein, 46 aa, Plasmodium falciparum
NNNNNNSNNSSNNNNNNNNNSNNNNSNNNNSNNNNNSNNNSSYYGA

SEQ ID NO: 3334961 - protein, 11 aa, Plasmodium falciparum
NNNNNNSNSNY

SEQ ID NO: 3334962 - protein, 30 aa, Plasmodium falciparum
NNNNNNSSNNNSTNFGYNEDPQKKDNHNNF

SEQ ID NO: 3334963 - protein, 8 aa, Plasmodium falciparum
NNNNNNTY

SEQ ID NO: 3334964 - protein, 7 aa, Plasmodium falciparum
NNNNNNV

SEQ ID NO: 3334965 - protein, 10 aa, Plasmodium falciparum
NNNNNNVDNS

SEQ ID NO: 3334966 - protein, 13 aa, Plasmodium falciparum
NNNNNNVKENITN

SEQ ID NO: 3334967 - protein, 17 aa, Plasmodium falciparum
NNNNNNVNNNNNNELSN

SEQ ID NO: 3334968 - protein, 46 aa, Plasmodium falciparum
NNNNNNYNGPYNNNYNGPYNNNYNDPYNNNNYNDPYNNNNYNDPYN

SEQ ID NO: 3334969 - protein, 12 aa, Plasmodium falciparum
NNNNNNYNNNNN

SEQ ID NO: 3334970 - protein, 19 aa, Plasmodium falciparum
NNNNNNYTNNNNSNNNCTN

SEQ ID NO: 3334971 - protein, 49 aa, Plasmodium falciparum
NNNNNQRNNNNNNNGNNNNDNNNNNNINNNNSNGNNNNNSSSNNNSPWK

SEQ ID NO: 3334972 - protein, 11 aa, Plasmodium falciparum
NNNNNRNNNFN

SEQ ID NO: 3334973 - protein, 6 aa, Plasmodium falciparum
NNNNNS

SEQ ID NO: 3334974 - protein, 15 aa, Plasmodium falciparum
NNNNNSDNNESTNDN

SEQ ID NO: 3334975 - protein, 23 aa, Plasmodium falciparum
NNNNNSIELNEDNNKNDYVKGTD

SEQ ID NO: 3334976 - protein, 51 aa, Plasmodium falciparum
NNNNNSNDNNNNSIDNNNNSIDNNNNSIDNNNNSIDNNNNSINNNNNSIDN

SEQ ID NO: 3334977 - protein, 50 aa, Plasmodium falciparum
NNNNNSNEDLKNANEFKNNDSLNGEEINNNDLNNTNFQKSDKNIKDQNSN

SEQ ID NO: 3334978 - protein, 9 aa, Plasmodium falciparum
NNNNNSNIM

SEQ ID NO: 3334979 - protein, 10 aa, Plasmodium falciparum
NNNNNSNNIN

SEQ ID NO: 3334980 - protein, 9 aa, Plasmodium falciparum
NNNNNSNNM

SEQ ID NO: 3334981 - protein, 18 aa, Plasmodium falciparum
NNNNNSNNNNNGNSNNNF

SEQ ID NO: 3334982 - protein, 9 aa, Plasmodium falciparum
NNNNNSNSC

SEQ ID NO: 3334983 - protein, 21 aa, Plasmodium falciparum
NNNNNSNSGNNDSNNNNQSNI

SEQ ID NO: 3334984 - protein, 13 aa, Plasmodium falciparum
NNNNNSNSKKDDF

SEQ ID NO: 3334985 - protein, 29 aa, Plasmodium falciparum
NNNNNSNSNNNNNSNSNSNSNSNYNYNRE

SEQ ID NO: 3334986 - protein, 9 aa, Plasmodium falciparum
NNNNNSPFA

SEQ ID NO: 3334987 - protein, 24 aa, Plasmodium falciparum
NNNNNSSSSSNNNMSGIPSVNSNI

SEQ ID NO: 3334988 - protein, 18 aa, Plasmodium falciparum
NNNNNSTHNNINNNDQNY

SEQ ID NO: 3334989 - protein, 7 aa, Plasmodium falciparum
NNNNNVE

SEQ ID NO: 3334990 - protein, 8 aa, Plasmodium falciparum
NNNNNVNN

SEQ ID NO: 3334991 - protein, 6 aa, Plasmodium falciparum
NNNNNY

SEQ ID NO: 3334992 - protein, 13 aa, Plasmodium falciparum
NNNNNYIKENTKN

SEQ ID NO: 3334993 - protein, 47 aa, Plasmodium falciparum
NNNNNYNNYNSNNNRNKNQNNNNNNNNNMNNMNNSNNNINNNNNYYK

SEQ ID NO: 3334994 - protein, 8 aa, Plasmodium falciparum
NNNNPNNY

SEQ ID NO: 3334995 - protein, 8 aa, Plasmodium falciparum
NNNNPSEE

SEQ ID NO: 3334996 - protein, 9 aa, Plasmodium falciparum
NNNNPYSKN

SEQ ID NO: 3334997 - protein, 7 aa, Plasmodium falciparum
NNNNQLK

SEQ ID NO: 3334998 - protein, 6 aa, Plasmodium falciparum
NNNNQM

SEQ ID NO: 3334999 - protein, 17 aa, Plasmodium falciparum
NNNNQNIKKRKYTKNDS

SEQ ID NO: 3335000 - protein, 7 aa, Plasmodium falciparum
NNNNQQY

SEQ ID NO: 3335001 - protein, 15 aa, Plasmodium falciparum
NNNNRNDKKKKKKKI

SEQ ID NO: 3335002 - protein, 20 aa, Plasmodium falciparum
NNNNRPHNLNKNEKPRTNYT

SEQ ID NO: 3335003 - protein, 5 aa, Plasmodium falciparum
NNNNS

SEQ ID NO: 3335004 - protein, 9 aa, Plasmodium falciparum
NNNNSKGVG

SEQ ID NO: 3335005 - protein, 8 aa, Plasmodium falciparum
NNNNSNNK

SEQ ID NO: 3335006 - protein, 8 aa, Plasmodium falciparum
NNNNSNNM

SEQ ID NO: 3335007 - protein, 10 aa, Plasmodium falciparum
NNNNSNNNNI

SEQ ID NO: 3335008 - protein, 13 aa, Plasmodium falciparum
NNNNSNNNNNNYN

SEQ ID NO: 3335009 - protein, 13 aa, Plasmodium falciparum
NNNNSNNNRSGGI

SEQ ID NO: 3335010 - protein, 22 aa, Plasmodium falciparum
NNNNSSDNNDDEYQSANSPVES

SEQ ID NO: 3335011 - protein, 15 aa, Plasmodium falciparum
NNNNSSSSVMNGDKN

SEQ ID NO: 3335012 - protein, 90 aa, Plasmodium falciparum
NNNNSTNYNGSNYNGSNYNGSNYNGSNYNGNGNNTSNNNNYYGNNYNNNNNNNNNNNNNNNNNNNNNNNSSSSSSGSAAGIKNNYPNNDV

SEQ ID NO: 3335013 - protein, 7 aa, Plasmodium falciparum
NNNNSYH

SEQ ID NO: 3335014 - protein, 8 aa, Plasmodium falciparum
NNNNTDIY

SEQ ID NO: 3335015 - protein, 6 aa, Plasmodium falciparum
NNNNTI

SEQ ID NO: 3335016 - protein, 6 aa, Plasmodium falciparum
NNNNTK

SEQ ID NO: 3335017 - protein, 8 aa, Plasmodium falciparum
NNNNTKEY

SEQ ID NO: 3335018 - protein, 53 aa, Plasmodium falciparum
NNNNTLENKNVGDMENTDDDDDDDEKEYASEDGHNKNNNTNSYKKKEKKMNTL

SEQ ID NO: 3335019 - protein, 7 aa, Plasmodium falciparum
NNNNTLK

SEQ ID NO: 3335020 - protein, 17 aa, Plasmodium falciparum
NNNNTNENQSADNTLND

SEQ ID NO: 3335021 - protein, 11 aa, Plasmodium falciparum
NNNNTNKYSSK

SEQ ID NO: 3335022 - protein, 9 aa, Plasmodium falciparum
NNNNTNMGH

SEQ ID NO: 3335023 - protein, 8 aa, Plasmodium falciparum
NNNNTQMN

SEQ ID NO: 3335024 - protein, 23 aa, Plasmodium falciparum
NNNNTSNPDTTNNTRKDGEETSM

SEQ ID NO: 3335025 - protein, 9 aa, Plasmodium falciparum
NNNNTYQDV

SEQ ID NO: 3335026 - protein, 21 aa, Plasmodium falciparum
NNNNVENTNVTENNNHEKYEV

SEQ ID NO: 3335027 - protein, 42 aa, Plasmodium falciparum
NNNNVKQNHHDNNNNDNNNNKNNSEGGNKNMDDSNKNNDINK

SEQ ID NO: 3335028 - protein, 56 aa, Plasmodium falciparum
NNNNYDNNNYGDNNNYDDNNNYGDNNNYDDNNNYGDNNNYDDNNNYNNNSKSNIHN

SEQ ID NO: 3335029 - protein, 14 aa, Plasmodium falciparum
NNNNYGDRDDHGDD

SEQ ID NO: 3335030 - protein, 6 aa, Plasmodium falciparum
NNNNYK

SEQ ID NO: 3335031 - protein, 8 aa, Plasmodium falciparum
NNNNYKED

SEQ ID NO: 3335032 - protein, 6 aa, Plasmodium falciparum
NNNNYN

SEQ ID NO: 3335033 - protein, 9 aa, Plasmodium falciparum
NNNNYPHQD

SEQ ID NO: 3335034 - protein, 16 aa, Plasmodium falciparum
NNNNYYNDDENKKKHP

SEQ ID NO: 3335035 - protein, 11 aa, Plasmodium falciparum
NNNNYYSTYGH

SEQ ID NO: 3335036 - protein, 13 aa, Plasmodium falciparum
NNNPFNNNKYNNN

SEQ ID NO: 3335037 - protein, 8 aa, Plasmodium falciparum
NNNPKKGS

SEQ ID NO: 3335038 - protein, 16 aa, Plasmodium falciparum
NNNPKKKSLKQNGKSN

SEQ ID NO: 3335039 - protein, 11 aa, Plasmodium falciparum
NNNPNVDHEKR

SEQ ID NO: 3335040 - protein, 7 aa, Plasmodium falciparum
NNNPSGV

SEQ ID NO: 3335041 - protein, 8 aa, Plasmodium falciparum
NNNPSNVT

SEQ ID NO: 3335042 - protein, 19 aa, Plasmodium falciparum
NNNPYNKPPPPPPGAPPQS

SEQ ID NO: 3335043 - protein, 4 aa, Plasmodium falciparum
NNNQ

SEQ ID NO: 3335044 - protein, 9 aa, Plasmodium falciparum
NNNQDDNVT

SEQ ID NO: 3335045 - protein, 5 aa, Plasmodium falciparum
NNNQE

SEQ ID NO: 3335046 - protein, 11 aa, Plasmodium falciparum
NNNQEDKKRVN

SEQ ID NO: 3335047 - protein, 10 aa, Plasmodium falciparum
NNNQEQKENL

SEQ ID NO: 3335048 - protein, 20 aa, Plasmodium falciparum
NNNQNNNNNNNNNNNNNNQI

SEQ ID NO: 3335049 - protein, 10 aa, Plasmodium falciparum
NNNQNNNSLN

SEQ ID NO: 3335050 - protein, 8 aa, Plasmodium falciparum
NNNQNNPN

SEQ ID NO: 3335051 - protein, 18 aa, Plasmodium falciparum
NNNQNYTNQNNNNITNQN

SEQ ID NO: 3335052 - protein, 8 aa, Plasmodium falciparum
NNNQPTNN

SEQ ID NO: 3335053 - protein, 8 aa, Plasmodium falciparum
NNNQQNVN

SEQ ID NO: 3335054 - protein, 19 aa, Plasmodium falciparum
NNNQTQNNGMSQNSFTSNH

SEQ ID NO: 3335055 - protein, 4 aa, Plasmodium falciparum
NNNR

SEQ ID NO: 3335056 - protein, 6 aa, Plasmodium falciparum
NNNRNM

SEQ ID NO: 3335057 - protein, 5 aa, Plasmodium falciparum
NNNRY

SEQ ID NO: 3335058 - protein, 19 aa, Plasmodium falciparum
NNNRYSAYPDYNNSYGNYQ

SEQ ID NO: 3335059 - protein, 7 aa, Plasmodium falciparum
NNNSCEK

SEQ ID NO: 3335060 - protein, 6 aa, Plasmodium falciparum
NNNSCG

SEQ ID NO: 3335061 - protein, 24 aa, Plasmodium falciparum
NNNSCGNNNSCGNNNNFGNNKNCS

SEQ ID NO: 3335062 - protein, 7 aa, Plasmodium falciparum
NNNSCTN

SEQ ID NO: 3335063 - protein, 5 aa, Plasmodium falciparum
NNNSD

SEQ ID NO: 3335064 - protein, 31 aa, Plasmodium falciparum
NNNSDLNNNNTAATSNNNTHNNNNNNNSNYN

SEQ ID NO: 3335065 - protein, 17 aa, Plasmodium falciparum
NNNSEKNTVSRFINEMN

SEQ ID NO: 3335066 - protein, 11 aa, Plasmodium falciparum
NNNSENPTGRE

SEQ ID NO: 3335067 - protein, 6 aa, Plasmodium falciparum
NNNSFN

SEQ ID NO: 3335068 - protein, 5 aa, Plasmodium falciparum
NNNSG

SEQ ID NO: 3335069 - protein, 21 aa, Plasmodium falciparum
NNNSHDDTTSNNLQKSGTFRS

SEQ ID NO: 3335070 - protein, 13 aa, Plasmodium falciparum
NNNSHGDDSITYD

SEQ ID NO: 3335071 - protein, 16 aa, Plasmodium falciparum
NNNSHINNSSHNPHSN

SEQ ID NO: 3335072 - protein, 18 aa, Plasmodium falciparum
NNNSIDDNNSNNRTDSYE

SEQ ID NO: 3335073 - protein, 17 aa, Plasmodium falciparum
NNNSKAHVSNKSKKYDK

SEQ ID NO: 3335074 - protein, 10 aa, Plasmodium falciparum
NNNSKGTYES

SEQ ID NO: 3335075 - protein, 6 aa, Plasmodium falciparum
NNNSKW

SEQ ID NO: 3335076 - protein, 9 aa, Plasmodium falciparum
NNNSLQTNN

SEQ ID NO: 3335077 - protein, 6 aa, Plasmodium falciparum
NNNSMS

SEQ ID NO: 3335078 - protein, 5 aa, Plasmodium falciparum
NNNSN

SEQ ID NO: 3335079 - protein, 22 aa, Plasmodium falciparum
NNNSNAPFTYNTNNNDNIYSNN

SEQ ID NO: 3335080 - protein, 8 aa, Plasmodium falciparum
NNNSNEYV

SEQ ID NO: 3335081 - protein, 6 aa, Plasmodium falciparum
NNNSNI

SEQ ID NO: 3335082 - protein, 50 aa, Plasmodium falciparum
NNNSNKNKNNNNNNINSNNNNNNNNNNNNNSNNNNDNNNNNDVQSNEKTI

SEQ ID NO: 3335083 - protein, 13 aa, Plasmodium falciparum
NNNSNKYNKYNKK

SEQ ID NO: 3335084 - protein, 6 aa, Plasmodium falciparum
NNNSNL

SEQ ID NO: 3335085 - protein, 6 aa, Plasmodium falciparum
NNNSNN

SEQ ID NO: 3335086 - protein, 15 aa, Plasmodium falciparum
NNNSNNFSNTNPSYL

SEQ ID NO: 3335087 - protein, 10 aa, Plasmodium falciparum
NNNSNNKNNI

SEQ ID NO: 3335088 - protein, 10 aa, Plasmodium falciparum
NNNSNNNKYY

SEQ ID NO: 3335089 - protein, 11 aa, Plasmodium falciparum
NNNSNNNNNNN

SEQ ID NO: 3335090 - protein, 28 aa, Plasmodium falciparum
NNNSNNNNSSSSNNNLYKSNKEAKNHNE

SEQ ID NO: 3335091 - protein, 9 aa, Plasmodium falciparum
NNNSNNQNN

SEQ ID NO: 3335092 - protein, 9 aa, Plasmodium falciparum
NNNSNNSNN

SEQ ID NO: 3335093 - protein, 6 aa, Plasmodium falciparum
NNNSNS

SEQ ID NO: 3335094 - protein, 8 aa, Plasmodium falciparum
NNNSNSNI

SEQ ID NO: 3335095 - protein, 8 aa, Plasmodium falciparum
NNNSNTNV

SEQ ID NO: 3335096 - protein, 8 aa, Plasmodium falciparum
NNNSNTPL

SEQ ID NO: 3335097 - protein, 6 aa, Plasmodium falciparum
NNNSNV

SEQ ID NO: 3335098 - protein, 15 aa, Plasmodium falciparum
NNNSNVDEGYNEDIT

SEQ ID NO: 3335099 - protein, 5 aa, Plasmodium falciparum
NNNSP

SEQ ID NO: 3335100 - protein, 7 aa, Plasmodium falciparum
NNNSPYN

SEQ ID NO: 3335101 - protein, 5 aa, Plasmodium falciparum
NNNSS

SEQ ID NO: 3335102 - protein, 9 aa, Plasmodium falciparum
NNNSSGPLS

SEQ ID NO: 3335103 - protein, 39 aa, Plasmodium falciparum
NNNSSNNNTNNSNNTNNTNNSNNSSSSSNNNNTSSATYN

SEQ ID NO: 3335104 - protein, 12 aa, Plasmodium falciparum
NNNSSRHSSKGG

SEQ ID NO: 3335105 - protein, 23 aa, Plasmodium falciparum
NNNSSSNNNNNNNSSGISNNYHD

SEQ ID NO: 3335106 - protein, 9 aa, Plasmodium falciparum
NNNSSVFRT

SEQ ID NO: 3335107 - protein, 8 aa, Plasmodium falciparum
NNNSSYNV

SEQ ID NO: 3335108 - protein, 14 aa, Plasmodium falciparum
NNNSTLSNNNHSKQ

SEQ ID NO: 3335109 - protein, 67 aa, Plasmodium falciparum
NNNSTNSSNNNNNNKKNENENENNENNNNINNNNNDNNNNNNDNNNNNNDNNNNNNDNNNNNNNNNN

SEQ ID NO: 3335110 - protein, 11 aa, Plasmodium falciparum
NNNSTSENEGN

SEQ ID NO: 3335111 - protein, 6 aa, Plasmodium falciparum
NNNSYN

SEQ ID NO: 3335112 - protein, 16 aa, Plasmodium falciparum
NNNSYNKKSDKYVGGY

SEQ ID NO: 3335113 - protein, 16 aa, Plasmodium falciparum
NNNSYNNNNNNNEEND

SEQ ID NO: 3335114 - protein, 18 aa, Plasmodium falciparum
NNNSYYETYGNKGSINND

SEQ ID NO: 3335115 - protein, 6 aa, Plasmodium falciparum
NNNTAK

SEQ ID NO: 3335116 - protein, 18 aa, Plasmodium falciparum
NNNTANYNNQNNANAPIN

SEQ ID NO: 3335117 - protein, 18 aa, Plasmodium falciparum
NNNTAPSTGRESSNNEDM

SEQ ID NO: 3335118 - protein, 26 aa, Plasmodium falciparum
NNNTCNNNNNNGNSSSSNIVSSPQYE

SEQ ID NO: 3335119 - protein, 10 aa, Plasmodium falciparum
NNNTEKSTHH

SEQ ID NO: 3335120 - protein, 6 aa, Plasmodium falciparum
NNNTEN

SEQ ID NO: 3335121 - protein, 37 aa, Plasmodium falciparum
NNNTENNNKNNNKNNNTENNNKNNFDNNNNNNNINNY

SEQ ID NO: 3335122 - protein, 9 aa, Plasmodium falciparum
NNNTIDGTS

SEQ ID NO: 3335123 - protein, 28 aa, Plasmodium falciparum
NNNTINNNYEEQKENKEEYINTPKAKNN

SEQ ID NO: 3335124 - protein, 7 aa, Plasmodium falciparum
NNNTITK

SEQ ID NO: 3335125 - protein, 6 aa, Plasmodium falciparum
NNNTKD

SEQ ID NO: 3335126 - protein, 9 aa, Plasmodium falciparum
NNNTKSTSA

SEQ ID NO: 3335127 - protein, 7 aa, Plasmodium falciparum
NNNTLEN

SEQ ID NO: 3335128 - protein, 18 aa, Plasmodium falciparum
NNNTLSKDEVTKSSSKIN

SEQ ID NO: 3335129 - protein, 6 aa, Plasmodium falciparum
NNNTND

SEQ ID NO: 3335130 - protein, 32 aa, Plasmodium falciparum
NNNTNGHHNNMNKKNSYDYNTDYNSKVSMNDS

SEQ ID NO: 3335131 - protein, 6 aa, Plasmodium falciparum
NNNTNH

SEQ ID NO: 3335132 - protein, 19 aa, Plasmodium falciparum
NNNTNISSTNMTGSSLNSP

SEQ ID NO: 3335133 - protein, 9 aa, Plasmodium falciparum
NNNTNNKSR

SEQ ID NO: 3335134 - protein, 7 aa, Plasmodium falciparum
NNNTNNL

SEQ ID NO: 3335135 - protein, 11 aa, Plasmodium falciparum
NNNTNNNHPNP

SEQ ID NO: 3335136 - protein, 16 aa, Plasmodium falciparum
NNNTNNNLKGKNKKKI

SEQ ID NO: 3335137 - protein, 36 aa, Plasmodium falciparum
NNNTNNNNNNNNNNNNNNNNNNNNNNNGNNNNHCSH

SEQ ID NO: 3335138 - protein, 17 aa, Plasmodium falciparum
NNNTNNTNQIKKSTNKF

SEQ ID NO: 3335139 - protein, 50 aa, Plasmodium falciparum
NNNTNQMKGPPGQMNEPPGQMNGPPSQMNGPPSQMNGPPSQITVPPTPPA

SEQ ID NO: 3335140 - protein, 8 aa, Plasmodium falciparum
NNNTPSTD

SEQ ID NO: 3335141 - protein, 17 aa, Plasmodium falciparum
NNNTQEKKKKSNKNETE

SEQ ID NO: 3335142 - protein, 10 aa, Plasmodium falciparum
NNNTSFEKAP

SEQ ID NO: 3335143 - protein, 11 aa, Plasmodium falciparum
NNNTSKNKTVN

SEQ ID NO: 3335144 - protein, 15 aa, Plasmodium falciparum
NNNTTELRKFPPVYF

SEQ ID NO: 3335145 - protein, 19 aa, Plasmodium falciparum
NNNTTESERNRRSTHINNN

SEQ ID NO: 3335146 - protein, 9 aa, Plasmodium falciparum
NNNTTNDNL

SEQ ID NO: 3335147 - protein, 25 aa, Plasmodium falciparum
NNNTTNNNNINEFNKDNKNTNMSSN

SEQ ID NO: 3335148 - protein, 12 aa, Plasmodium falciparum
NNNTTTDNIATN

SEQ ID NO: 3335149 - protein, 15 aa, Plasmodium falciparum
NNNTTTLNHSNSTTF

SEQ ID NO: 3335150 - protein, 6 aa, Plasmodium falciparum
NNNTTY

SEQ ID NO: 3335151 - protein, 7 aa, Plasmodium falciparum
NNNTYKP

SEQ ID NO: 3335152 - protein, 44 aa, Plasmodium falciparum
NNNTYNNNDYTNDDNHSSKVYSSDCEKNTNHNKKTEDKYDQENN

SEQ ID NO: 3335153 - protein, 77 aa, Plasmodium falciparum
NNNTYNNNTYNNNTYNNTYNNTYKDEYNNTYNNNDEAGQGNGDKDGYQDGYHDGDQNGDKDGDQNGDQNGDKEGYQD

SEQ ID NO: 3335154 - protein, 11 aa, Plasmodium falciparum
NNNVDDDNNKN

SEQ ID NO: 3335155 - protein, 8 aa, Plasmodium falciparum
NNNVDENN

SEQ ID NO: 3335156 - protein, 56 aa, Plasmodium falciparum
NNNVEKNNNDEKKNNDEKKNNDEKKNNDEKKNNDEKKNNDEKKNNDEKNNDDNNNI

SEQ ID NO: 3335157 - protein, 35 aa, Plasmodium falciparum
NNNVESTNNINSEQDYSDMYPSSRDENIKRNEEEI

SEQ ID NO: 3335158 - protein, 12 aa, Plasmodium falciparum
NNNVKGKNNSKY

SEQ ID NO: 3335159 - protein, 5 aa, Plasmodium falciparum
NNNVN

SEQ ID NO: 3335160 - protein, 10 aa, Plasmodium falciparum
NNNVNNNENT

SEQ ID NO: 3335161 - protein, 8 aa, Plasmodium falciparum
NNNVNNNN

SEQ ID NO: 3335162 - protein, 9 aa, Plasmodium falciparum
NNNVRNNNV

SEQ ID NO: 3335163 - protein, 19 aa, Plasmodium falciparum
NNNVSNATPNITNPTNSKM

SEQ ID NO: 3335164 - protein, 6 aa, Plasmodium falciparum
NNNVTN

SEQ ID NO: 3335165 - protein, 6 aa, Plasmodium falciparum
NNNYDK

SEQ ID NO: 3335166 - protein, 7 aa, Plasmodium falciparum
NNNYDQD

SEQ ID NO: 3335167 - protein, 5 aa, Plasmodium falciparum
NNNYE

SEQ ID NO: 3335168 - protein, 15 aa, Plasmodium falciparum
NNNYEENAKGDIEND

SEQ ID NO: 3335169 - protein, 8 aa, Plasmodium falciparum
NNNYGDNN

SEQ ID NO: 3335170 - protein, 10 aa, Plasmodium falciparum
NNNYGGSSNI

SEQ ID NO: 3335171 - protein, 7 aa, Plasmodium falciparum
NNNYGND

SEQ ID NO: 3335172 - protein, 16 aa, Plasmodium falciparum
NNNYHNNNSNNKDAKK

SEQ ID NO: 3335173 - protein, 5 aa, Plasmodium falciparum
NNNYI

SEQ ID NO: 3335174 - protein, 25 aa, Plasmodium falciparum
NNNYNDGDRNYEENHSDYTKGDDTI

SEQ ID NO: 3335175 - protein, 7 aa, Plasmodium falciparum
NNNYNNN

SEQ ID NO: 3335176 - protein, 9 aa, Plasmodium falciparum
NNNYNNNDY

SEQ ID NO: 3335177 - protein, 18 aa, Plasmodium falciparum
NNNYNNNNNNDNNQTSTH

SEQ ID NO: 3335178 - protein, 12 aa, Plasmodium falciparum
NNNYSDEKYNDN

SEQ ID NO: 3335179 - protein, 7 aa, Plasmodium falciparum
NNNYTNT

SEQ ID NO: 3335180 - protein, 8 aa, Plasmodium falciparum
NNNYTNTR

SEQ ID NO: 3335181 - protein, 5 aa, Plasmodium falciparum
NNNYY

SEQ ID NO: 3335182 - protein, 6 aa, Plasmodium falciparum
NNPALL

SEQ ID NO: 3335183 - protein, 13 aa, Plasmodium falciparum
NNPASKVKPGTVM

SEQ ID NO: 3335184 - protein, 4 aa, Plasmodium falciparum
NNPD

SEQ ID NO: 3335185 - protein, 5 aa, Plasmodium falciparum
NNPDD

SEQ ID NO: 3335186 - protein, 6 aa, Plasmodium falciparum
NNPDEE

SEQ ID NO: 3335187 - protein, 8 aa, Plasmodium falciparum
NNPDINPE

SEQ ID NO: 3335188 - protein, 35 aa, Plasmodium falciparum
NNPDNDRNDPNEEMKKKKKKIKINNNNNNIESEAT

SEQ ID NO: 3335189 - protein, 5 aa, Plasmodium falciparum
NNPEE

SEQ ID NO: 3335190 - protein, 7 aa, Plasmodium falciparum
NNPEHEG

SEQ ID NO: 3335191 - protein, 5 aa, Plasmodium falciparum
NNPEI

SEQ ID NO: 3335192 - protein, 7 aa, Plasmodium falciparum
NNPELQD

SEQ ID NO: 3335193 - protein, 7 aa, Plasmodium falciparum
NNPENID

SEQ ID NO: 3335194 - protein, 6 aa, Plasmodium falciparum
NNPEQY

SEQ ID NO: 3335195 - protein, 7 aa, Plasmodium falciparum
NNPEQYY

SEQ ID NO: 3335196 - protein, 4 aa, Plasmodium falciparum
NNPF

SEQ ID NO: 3335197 - protein, 6 aa, Plasmodium falciparum
NNPFDE

SEQ ID NO: 3335198 - protein, 5 aa, Plasmodium falciparum
NNPFK

SEQ ID NO: 3335199 - protein, 4 aa, Plasmodium falciparum
NNPI

SEQ ID NO: 3335200 - protein, 50 aa, Plasmodium falciparum
NNPIQKGHKKNNHHHNNKNNNHNNNNNNNNHNNNNNNNNTWENKKNEKYM

SEQ ID NO: 3335201 - protein, 4 aa, Plasmodium falciparum
NNPK

SEQ ID NO: 3335202 - protein, 5 aa, Plasmodium falciparum
NNPKI

SEQ ID NO: 3335203 - protein, 6 aa, Plasmodium falciparum
NNPKID

SEQ ID NO: 3335204 - protein, 9 aa, Plasmodium falciparum
NNPKSNEGL

SEQ ID NO: 3335205 - protein, 12 aa, Plasmodium falciparum
NNPLNEKKSTNN

SEQ ID NO: 3335206 - protein, 5 aa, Plasmodium falciparum
NNPND

SEQ ID NO: 3335207 - protein, 9 aa, Plasmodium falciparum
NNPNDNCEK

SEQ ID NO: 3335208 - protein, 15 aa, Plasmodium falciparum
NNPNINGKENTVDGD

SEQ ID NO: 3335209 - protein, 10 aa, Plasmodium falciparum
NNPNMNDTNN

SEQ ID NO: 3335210 - protein, 16 aa, Plasmodium falciparum
NNPNNEETDINSNTKK

SEQ ID NO: 3335211 - protein, 7 aa, Plasmodium falciparum
NNPNNHS

SEQ ID NO: 3335212 - protein, 20 aa, Plasmodium falciparum
NNPNNNNDDKIKKKKKKIHK

SEQ ID NO: 3335213 - protein, 7 aa, Plasmodium falciparum
NNPNNNS

SEQ ID NO: 3335214 - protein, 5 aa, Plasmodium falciparum
NNPPE

SEQ ID NO: 3335215 - protein, 8 aa, Plasmodium falciparum
NNPPENNK

SEQ ID NO: 3335216 - protein, 12 aa, Plasmodium falciparum
NNPPKLSAQTYS

SEQ ID NO: 3335217 - protein, 6 aa, Plasmodium falciparum
NNPPTS

SEQ ID NO: 3335218 - protein, 4 aa, Plasmodium falciparum
NNPQ

SEQ ID NO: 3335219 - protein, 7 aa, Plasmodium falciparum
NNPQEMK

SEQ ID NO: 3335220 - protein, 6 aa, Plasmodium falciparum
NNPRRT

SEQ ID NO: 3335221 - protein, 4 aa, Plasmodium falciparum
NNPS

SEQ ID NO: 3335222 - protein, 6 aa, Plasmodium falciparum
NNPSCE

SEQ ID NO: 3335223 - protein, 9 aa, Plasmodium falciparum
NNPSEEDSL

SEQ ID NO: 3335224 - protein, 5 aa, Plasmodium falciparum
NNPSF

SEQ ID NO: 3335225 - protein, 12 aa, Plasmodium falciparum
NNPSKGVNPDEA

SEQ ID NO: 3335226 - protein, 6 aa, Plasmodium falciparum
NNPSLN

SEQ ID NO: 3335227 - protein, 6 aa, Plasmodium falciparum
NNPSNI

SEQ ID NO: 3335228 - protein, 20 aa, Plasmodium falciparum
NNPSVENYTSNENNIEPYDN

SEQ ID NO: 3335229 - protein, 5 aa, Plasmodium falciparum
NNPTE

SEQ ID NO: 3335230 - protein, 6 aa, Plasmodium falciparum
NNPTLS

SEQ ID NO: 3335231 - protein, 5 aa, Plasmodium falciparum
NNPTN

SEQ ID NO: 3335232 - protein, 19 aa, Plasmodium falciparum
NNPTNNRGIYGSNESINNN

SEQ ID NO: 3335233 - protein, 9 aa, Plasmodium falciparum
NNPTTRRKS

SEQ ID NO: 3335234 - protein, 5 aa, Plasmodium falciparum
NNPVH

SEQ ID NO: 3335235 - protein, 14 aa, Plasmodium falciparum
NNPYDNKTRKINQT

SEQ ID NO: 3335236 - protein, 8 aa, Plasmodium falciparum
NNPYSSEN

SEQ ID NO: 3335237 - protein, 4 aa, Plasmodium falciparum
NNQA

SEQ ID NO: 3335238 - protein, 7 aa, Plasmodium falciparum
NNQDAQY

SEQ ID NO: 3335239 - protein, 11 aa, Plasmodium falciparum
NNQDDNKYNSN

SEQ ID NO: 3335240 - protein, 6 aa, Plasmodium falciparum
NNQDFN

SEQ ID NO: 3335241 - protein, 6 aa, Plasmodium falciparum
NNQDIN

SEQ ID NO: 3335242 - protein, 9 aa, Plasmodium falciparum
NNQDKYDNM

SEQ ID NO: 3335243 - protein, 38 aa, Plasmodium falciparum
NNQDVDKKIDEHNKKDEKSDPNKICSNEQNDITNNNTY

SEQ ID NO: 3335244 - protein, 29 aa, Plasmodium falciparum
NNQEENKQIELSNDKENQNQNQNENQNKR

SEQ ID NO: 3335245 - protein, 5 aa, Plasmodium falciparum
NNQEK

SEQ ID NO: 3335246 - protein, 5 aa, Plasmodium falciparum
NNQEN

SEQ ID NO: 3335247 - protein, 21 aa, Plasmodium falciparum
NNQENGTNNNDMNVNDQNNYS

SEQ ID NO: 3335248 - protein, 7 aa, Plasmodium falciparum
NNQEPKV

SEQ ID NO: 3335249 - protein, 6 aa, Plasmodium falciparum
NNQEVK

SEQ ID NO: 3335250 - protein, 7 aa, Plasmodium falciparum
NNQEVQR

SEQ ID NO: 3335251 - protein, 23 aa, Plasmodium falciparum
NNQFDGEKQIPKKNDTSNQNDDI

SEQ ID NO: 3335252 - protein, 19 aa, Plasmodium falciparum
NNQGNGDNSHVNNNYNSNA

SEQ ID NO: 3335253 - protein, 6 aa, Plasmodium falciparum
NNQGYD

SEQ ID NO: 3335254 - protein, 6 aa, Plasmodium falciparum
NNQHNK

SEQ ID NO: 3335255 - protein, 14 aa, Plasmodium falciparum
NNQHNNNSSGVGNS

SEQ ID NO: 3335256 - protein, 6 aa, Plasmodium falciparum
NNQHYN

SEQ ID NO: 3335257 - protein, 8 aa, Plasmodium falciparum
NNQIPKNK

SEQ ID NO: 3335258 - protein, 5 aa, Plasmodium falciparum
NNQIY

SEQ ID NO: 3335259 - protein, 4 aa, Plasmodium falciparum
NNQK

SEQ ID NO: 3335260 - protein, 9 aa, Plasmodium falciparum
NNQKDLNKK

SEQ ID NO: 3335261 - protein, 11 aa, Plasmodium falciparum
NNQKEKNDDNE

SEQ ID NO: 3335262 - protein, 6 aa, Plasmodium falciparum
NNQKEW

SEQ ID NO: 3335263 - protein, 34 aa, Plasmodium falciparum
NNQKEYNKKGALKKSHSVNKSKQASNQKNNKNVM

SEQ ID NO: 3335264 - protein, 9 aa, Plasmodium falciparum
NNQKNNKKC

SEQ ID NO: 3335265 - protein, 8 aa, Plasmodium falciparum
NNQKRDLS

SEQ ID NO: 3335266 - protein, 4 aa, Plasmodium falciparum
NNQN

SEQ ID NO: 3335267 - protein, 24 aa, Plasmodium falciparum
NNQNDDIDNNNNNNNNNNNCDNPY

SEQ ID NO: 3335268 - protein, 7 aa, Plasmodium falciparum
NNQNEHL

SEQ ID NO: 3335269 - protein, 7 aa, Plasmodium falciparum
NNQNENS

SEQ ID NO: 3335270 - protein, 7 aa, Plasmodium falciparum
NNQNENV

SEQ ID NO: 3335271 - protein, 8 aa, Plasmodium falciparum
NNQNGNED

SEQ ID NO: 3335272 - protein, 5 aa, Plasmodium falciparum
NNQNN

SEQ ID NO: 3335273 - protein, 6 aa, Plasmodium falciparum
NNQNNE

SEQ ID NO: 3335274 - protein, 11 aa, Plasmodium falciparum
NNQNNEADSNK

SEQ ID NO: 3335275 - protein, 10 aa, Plasmodium falciparum
NNQNNFKSPS

SEQ ID NO: 3335276 - protein, 7 aa, Plasmodium falciparum
NNQNNHN

SEQ ID NO: 3335277 - protein, 10 aa, Plasmodium falciparum
NNQNQSGSNN

SEQ ID NO: 3335278 - protein, 10 aa, Plasmodium falciparum
NNQNSYNNIS

SEQ ID NO: 3335279 - protein, 6 aa, Plasmodium falciparum
NNQPID

SEQ ID NO: 3335280 - protein, 14 aa, Plasmodium falciparum
NNQPNNVNKNVSTN

SEQ ID NO: 3335281 - protein, 4 aa, Plasmodium falciparum
NNQQ

SEQ ID NO: 3335282 - protein, 27 aa, Plasmodium falciparum
NNQQNDMNNNNQNNQNNMNNNNNNNNG

SEQ ID NO: 3335283 - protein, 8 aa, Plasmodium falciparum
NNQQVGGS

SEQ ID NO: 3335284 - protein, 4 aa, Plasmodium falciparum
NNQR

SEQ ID NO: 3335285 - protein, 12 aa, Plasmodium falciparum
NNQRRDRSSFYE

SEQ ID NO: 3335286 - protein, 12 aa, Plasmodium falciparum
NNQSKEKDANTV

SEQ ID NO: 3335287 - protein, 30 aa, Plasmodium falciparum
NNQSNENNGFNNNNDNNNDNNNNNNNNNRY

SEQ ID NO: 3335288 - protein, 6 aa, Plasmodium falciparum
NNQTND

SEQ ID NO: 3335289 - protein, 6 aa, Plasmodium falciparum
NNQTQQ

SEQ ID NO: 3335290 - protein, 18 aa, Plasmodium falciparum
NNQTVSDISKEKEKLDYP

SEQ ID NO: 3335291 - protein, 8 aa, Plasmodium falciparum
NNQTYNNM

SEQ ID NO: 3335292 - protein, 44 aa, Plasmodium falciparum
NNQVNHKNNVNTSDNINNVNTSNTHENKEEEKKNTIIDKEENKA

SEQ ID NO: 3335293 - protein, 4 aa, Plasmodium falciparum
NNQY

SEQ ID NO: 3335294 - protein, 9 aa, Plasmodium falciparum
NNQYTTNEK

SEQ ID NO: 3335295 - protein, 9 aa, Plasmodium falciparum
NNRAITQKG

SEQ ID NO: 3335296 - protein, 5 aa, Plasmodium falciparum
NNRAN

SEQ ID NO: 3335297 - protein, 8 aa, Plasmodium falciparum
NNRANRNM

SEQ ID NO: 3335298 - protein, 20 aa, Plasmodium falciparum
NNRAQNDDDDDDYNNNEKNK

SEQ ID NO: 3335299 - protein, 10 aa, Plasmodium falciparum
NNRDENNQNI

SEQ ID NO: 3335300 - protein, 7 aa, Plasmodium falciparum
NNRDTID

SEQ ID NO: 3335301 - protein, 11 aa, Plasmodium falciparum
NNREADPNENT

SEQ ID NO: 3335302 - protein, 7 aa, Plasmodium falciparum
NNREETY

SEQ ID NO: 3335303 - protein, 5 aa, Plasmodium falciparum
NNREI

SEQ ID NO: 3335304 - protein, 45 aa, Plasmodium falciparum
NNREKEEKEEKEKKEEKEKKVEKEKKVEKEKKVEKEENKLNDNLS

SEQ ID NO: 3335305 - protein, 15 aa, Plasmodium falciparum
NNRFPGSKNEFNPEQ

SEQ ID NO: 3335306 - protein, 13 aa, Plasmodium falciparum
NNRINNNNNNDNI

SEQ ID NO: 3335307 - protein, 8 aa, Plasmodium falciparum
NNRKNNEI

SEQ ID NO: 3335308 - protein, 29 aa, Plasmodium falciparum
NNRKRKKKHMNKKQIDDDDNDDNNDDNYY

SEQ ID NO: 3335309 - protein, 8 aa, Plasmodium falciparum
NNRKTDES

SEQ ID NO: 3335310 - protein, 4 aa, Plasmodium falciparum
NNRM

SEQ ID NO: 3335311 - protein, 13 aa, Plasmodium falciparum
NNRMEDEDNDDYE

SEQ ID NO: 3335312 - protein, 5 aa, Plasmodium falciparum
NNRND

SEQ ID NO: 3335313 - protein, 16 aa, Plasmodium falciparum
NNRNDKVESDSTIDNM

SEQ ID NO: 3335314 - protein, 7 aa, Plasmodium falciparum
NNRNDSV

SEQ ID NO: 3335315 - protein, 9 aa, Plasmodium falciparum
NNRNEKKRI

SEQ ID NO: 3335316 - protein, 8 aa, Plasmodium falciparum
NNRNGYEN

SEQ ID NO: 3335317 - protein, 17 aa, Plasmodium falciparum
NNRNNEEGSNNDINTSN

SEQ ID NO: 3335318 - protein, 6 aa, Plasmodium falciparum
NNRNNV

SEQ ID NO: 3335319 - protein, 7 aa, Plasmodium falciparum
NNRNRNM

SEQ ID NO: 3335320 - protein, 8 aa, Plasmodium falciparum
NNRNTNNN

SEQ ID NO: 3335321 - protein, 5 aa, Plasmodium falciparum
NNRNV

SEQ ID NO: 3335322 - protein, 4 aa, Plasmodium falciparum
NNRP

SEQ ID NO: 3335323 - protein, 47 aa, Plasmodium falciparum
NNRREKKKKESKDNTKKLKNGEKKSSKYKKIKSRKKEKENEKNTKNL

SEQ ID NO: 3335324 - protein, 6 aa, Plasmodium falciparum
NNRRIN

SEQ ID NO: 3335325 - protein, 8 aa, Plasmodium falciparum
NNRRSTNE

SEQ ID NO: 3335326 - protein, 7 aa, Plasmodium falciparum
NNRSTYN

SEQ ID NO: 3335327 - protein, 10 aa, Plasmodium falciparum
NNRTNERKSN

SEQ ID NO: 3335328 - protein, 5 aa, Plasmodium falciparum
NNRTQ

SEQ ID NO: 3335329 - protein, 24 aa, Plasmodium falciparum
NNRTYPSNDDKDKHNHNNHNNYTK

SEQ ID NO: 3335330 - protein, 9 aa, Plasmodium falciparum
NNRYNNNDT

SEQ ID NO: 3335331 - protein, 9 aa, Plasmodium falciparum
NNRYQTNKT

SEQ ID NO: 3335332 - protein, 4 aa, Plasmodium falciparum
NNSA

SEQ ID NO: 3335333 - protein, 9 aa, Plasmodium falciparum
NNSALNKDV

SEQ ID NO: 3335334 - protein, 6 aa, Plasmodium falciparum
NNSANY

SEQ ID NO: 3335335 - protein, 19 aa, Plasmodium falciparum
NNSATTTSTTTTTTATTHN

SEQ ID NO: 3335336 - protein, 7 aa, Plasmodium falciparum
NNSAYNN

SEQ ID NO: 3335337 - protein, 6 aa, Plasmodium falciparum
NNSAYT

SEQ ID NO: 3335338 - protein, 14 aa, Plasmodium falciparum
NNSCDKKDGNVDEH

SEQ ID NO: 3335339 - protein, 8 aa, Plasmodium falciparum
NNSDANIH

SEQ ID NO: 3335340 - protein, 35 aa, Plasmodium falciparum
NNSDINNGYNNNDNNNNNNNNNNNNNNNNSSSNND

SEQ ID NO: 3335341 - protein, 21 aa, Plasmodium falciparum
NNSDKTNMHNNNNSNGNNLKG

SEQ ID NO: 3335342 - protein, 6 aa, Plasmodium falciparum
NNSDNN

SEQ ID NO: 3335343 - protein, 7 aa, Plasmodium falciparum
NNSDQHN

SEQ ID NO: 3335344 - protein, 6 aa, Plasmodium falciparum
NNSDTK

SEQ ID NO: 3335345 - protein, 5 aa, Plasmodium falciparum
NNSDV

SEQ ID NO: 3335346 - protein, 6 aa, Plasmodium falciparum
NNSDVK

SEQ ID NO: 3335347 - protein, 4 aa, Plasmodium falciparum
NNSE

SEQ ID NO: 3335348 - protein, 10 aa, Plasmodium falciparum
NNSEDKKLPT

SEQ ID NO: 3335349 - protein, 7 aa, Plasmodium falciparum
NNSEDPD

SEQ ID NO: 3335350 - protein, 7 aa, Plasmodium falciparum
NNSEGLG

SEQ ID NO: 3335351 - protein, 9 aa, Plasmodium falciparum
NNSEGNNPV

SEQ ID NO: 3335352 - protein, 5 aa, Plasmodium falciparum
NNSEH

SEQ ID NO: 3335353 - protein, 6 aa, Plasmodium falciparum
NNSEKD

SEQ ID NO: 3335354 - protein, 8 aa, Plasmodium falciparum
NNSEKDVS

SEQ ID NO: 3335355 - protein, 16 aa, Plasmodium falciparum
NNSEKEGNMKRSNADK

SEQ ID NO: 3335356 - protein, 5 aa, Plasmodium falciparum
NNSEN

SEQ ID NO: 3335357 - protein, 12 aa, Plasmodium falciparum
NNSENISENSNE

SEQ ID NO: 3335358 - protein, 11 aa, Plasmodium falciparum
NNSENSNGPFH

SEQ ID NO: 3335359 - protein, 10 aa, Plasmodium falciparum
NNSEYNNKNY

SEQ ID NO: 3335360 - protein, 17 aa, Plasmodium falciparum
NNSEYSYNSDEEDDKVS

SEQ ID NO: 3335361 - protein, 14 aa, Plasmodium falciparum
NNSFEGKDTNKKNC

SEQ ID NO: 3335362 - protein, 5 aa, Plasmodium falciparum
NNSGM

SEQ ID NO: 3335363 - protein, 5 aa, Plasmodium falciparum
NNSGN

SEQ ID NO: 3335364 - protein, 26 aa, Plasmodium falciparum
NNSGNNSSNNNSSNNNSSNNRNNNIR

SEQ ID NO: 3335365 - protein, 9 aa, Plasmodium falciparum
NNSGSNNNI

SEQ ID NO: 3335366 - protein, 7 aa, Plasmodium falciparum
NNSHSKY

SEQ ID NO: 3335367 - protein, 20 aa, Plasmodium falciparum
NNSHTNNNSNYNSNSNNNSH

SEQ ID NO: 3335368 - protein, 5 aa, Plasmodium falciparum
NNSIN

SEQ ID NO: 3335369 - protein, 9 aa, Plasmodium falciparum
NNSIQEKND

SEQ ID NO: 3335370 - protein, 5 aa, Plasmodium falciparum
NNSIS

SEQ ID NO: 3335371 - protein, 12 aa, Plasmodium falciparum
NNSISEGYNGKG

SEQ ID NO: 3335372 - protein, 9 aa, Plasmodium falciparum
NNSISENIQ

SEQ ID NO: 3335373 - protein, 11 aa, Plasmodium falciparum
NNSISKSNNNY

SEQ ID NO: 3335374 - protein, 13 aa, Plasmodium falciparum
NNSKKNKKKREKI

SEQ ID NO: 3335375 - protein, 10 aa, Plasmodium falciparum
NNSKNERNMS

SEQ ID NO: 3335376 - protein, 10 aa, Plasmodium falciparum
NNSKNLSNPY

SEQ ID NO: 3335377 - protein, 4 aa, Plasmodium falciparum
NNSL

SEQ ID NO: 3335378 - protein, 10 aa, Plasmodium falciparum
NNSLDEEKQK

SEQ ID NO: 3335379 - protein, 16 aa, Plasmodium falciparum
NNSLENKKKKNSLQNY

SEQ ID NO: 3335380 - protein, 9 aa, Plasmodium falciparum
NNSLGQYTQ

SEQ ID NO: 3335381 - protein, 14 aa, Plasmodium falciparum
NNSLKNADHKKYTD

SEQ ID NO: 3335382 - protein, 13 aa, Plasmodium falciparum
NNSLNDNKKNEHI

SEQ ID NO: 3335383 - protein, 11 aa, Plasmodium falciparum
NNSLSNNMSKG

SEQ ID NO: 3335384 - protein, 6 aa, Plasmodium falciparum
NNSLTD

SEQ ID NO: 3335385 - protein, 14 aa, Plasmodium falciparum
NNSMDKSKHSSKEK

SEQ ID NO: 3335386 - protein, 21 aa, Plasmodium falciparum
NNSMDNSDNMASNSTASCSVN

SEQ ID NO: 3335387 - protein, 4 aa, Plasmodium falciparum
NNSN

SEQ ID NO: 3335388 - protein, 32 aa, Plasmodium falciparum
NNSNDINNIKSKEEKNKNNCISQQNGKMEKEK

SEQ ID NO: 3335389 - protein, 6 aa, Plasmodium falciparum
NNSNDT

SEQ ID NO: 3335390 - protein, 6 aa, Plasmodium falciparum
NNSNED

SEQ ID NO: 3335391 - protein, 10 aa, Plasmodium falciparum
NNSNEDHNQM

SEQ ID NO: 3335392 - protein, 8 aa, Plasmodium falciparum
NNSNEDNI

SEQ ID NO: 3335393 - protein, 8 aa, Plasmodium falciparum
NNSNEEYK

SEQ ID NO: 3335394 - protein, 19 aa, Plasmodium falciparum
NNSNENSVQDKKSVEEHNI

SEQ ID NO: 3335395 - protein, 17 aa, Plasmodium falciparum
NNSNEYNHNIGKDKKLE

SEQ ID NO: 3335396 - protein, 8 aa, Plasmodium falciparum
NNSNGNMD

SEQ ID NO: 3335397 - protein, 6 aa, Plasmodium falciparum
NNSNIK

SEQ ID NO: 3335398 - protein, 13 aa, Plasmodium falciparum
NNSNISVNKNEKQ

SEQ ID NO: 3335399 - protein, 9 aa, Plasmodium falciparum
NNSNKEKTN

SEQ ID NO: 3335400 - protein, 7 aa, Plasmodium falciparum
NNSNMDE

SEQ ID NO: 3335401 - protein, 12 aa, Plasmodium falciparum
NNSNNGSSNNYY

SEQ ID NO: 3335402 - protein, 9 aa, Plasmodium falciparum
NNSNNGTHH

SEQ ID NO: 3335403 - protein, 7 aa, Plasmodium falciparum
NNSNNHN

SEQ ID NO: 3335404 - protein, 12 aa, Plasmodium falciparum
NNSNNKNTDYQN

SEQ ID NO: 3335405 - protein, 7 aa, Plasmodium falciparum
NNSNNLN

SEQ ID NO: 3335406 - protein, 9 aa, Plasmodium falciparum
NNSNNMEKV

SEQ ID NO: 3335407 - protein, 21 aa, Plasmodium falciparum
NNSNNNNNNNNNNNNNSIDNS

SEQ ID NO: 3335408 - protein, 16 aa, Plasmodium falciparum
NNSNNNNNNRNSSGFS

SEQ ID NO: 3335409 - protein, 21 aa, Plasmodium falciparum
NNSNNNNYDKDEQMENQNDHN

SEQ ID NO: 3335410 - protein, 10 aa, Plasmodium falciparum
NNSNNNQIND

SEQ ID NO: 3335411 - protein, 11 aa, Plasmodium falciparum
NNSNNNYSASQ

SEQ ID NO: 3335412 - protein, 6 aa, Plasmodium falciparum
NNSNNS

SEQ ID NO: 3335413 - protein, 15 aa, Plasmodium falciparum
NNSNNSISNNENVET

SEQ ID NO: 3335414 - protein, 9 aa, Plasmodium falciparum
NNSNNSNNV

SEQ ID NO: 3335415 - protein, 7 aa, Plasmodium falciparum
NNSNNTS

SEQ ID NO: 3335416 - protein, 8 aa, Plasmodium falciparum
NNSNQEDI

SEQ ID NO: 3335417 - protein, 24 aa, Plasmodium falciparum
NNSNSIDNIDNRDGLDNPNNSNIS

SEQ ID NO: 3335418 - protein, 24 aa, Plasmodium falciparum
NNSNSNINNNSNSNSNSNSNNNNN

SEQ ID NO: 3335419 - protein, 9 aa, Plasmodium falciparum
NNSNSNPII

SEQ ID NO: 3335420 - protein, 17 aa, Plasmodium falciparum
NNSNTHSKITDTDPTHN

SEQ ID NO: 3335421 - protein, 14 aa, Plasmodium falciparum
NNSNVNEKKRNRSV

SEQ ID NO: 3335422 - protein, 11 aa, Plasmodium falciparum
NNSNYDNNYYN

SEQ ID NO: 3335423 - protein, 32 aa, Plasmodium falciparum
NNSNYKYENPNNYYQPKYNNNLNNETNENNTT

SEQ ID NO: 3335424 - protein, 13 aa, Plasmodium falciparum
NNSPEKPARHTNN

SEQ ID NO: 3335425 - protein, 16 aa, Plasmodium falciparum
NNSPGNEAYNKNSRAY

SEQ ID NO: 3335426 - protein, 13 aa, Plasmodium falciparum
NNSPKDLDNKRSN

SEQ ID NO: 3335427 - protein, 5 aa, Plasmodium falciparum
NNSPL

SEQ ID NO: 3335428 - protein, 11 aa, Plasmodium falciparum
NNSPLKDPIKS

SEQ ID NO: 3335429 - protein, 5 aa, Plasmodium falciparum
NNSPN

SEQ ID NO: 3335430 - protein, 19 aa, Plasmodium falciparum
NNSPPSPSSSLSSPPHPPH

SEQ ID NO: 3335431 - protein, 7 aa, Plasmodium falciparum
NNSPSIE

SEQ ID NO: 3335432 - protein, 7 aa, Plasmodium falciparum
NNSPTFK

SEQ ID NO: 3335433 - protein, 4 aa, Plasmodium falciparum
NNSQ

SEQ ID NO: 3335434 - protein, 5 aa, Plasmodium falciparum
NNSQD

SEQ ID NO: 3335435 - protein, 16 aa, Plasmodium falciparum
NNSQNHMNKNKNVSEN

SEQ ID NO: 3335436 - protein, 7 aa, Plasmodium falciparum
NNSQNNN

SEQ ID NO: 3335437 - protein, 10 aa, Plasmodium falciparum
NNSQNSTVGN

SEQ ID NO: 3335438 - protein, 7 aa, Plasmodium falciparum
NNSQSNY

SEQ ID NO: 3335439 - protein, 7 aa, Plasmodium falciparum
NNSRIRT

SEQ ID NO: 3335440 - protein, 14 aa, Plasmodium falciparum
NNSRNLNNSSSFGR

SEQ ID NO: 3335441 - protein, 4 aa, Plasmodium falciparum
NNSS

SEQ ID NO: 3335442 - protein, 7 aa, Plasmodium falciparum
NNSSDNI

SEQ ID NO: 3335443 - protein, 8 aa, Plasmodium falciparum
NNSSEKQI

SEQ ID NO: 3335444 - protein, 7 aa, Plasmodium falciparum
NNSSGEI

SEQ ID NO: 3335445 - protein, 16 aa, Plasmodium falciparum
NNSSHQKKKDSHEIKQ

SEQ ID NO: 3335446 - protein, 6 aa, Plasmodium falciparum
NNSSHV

SEQ ID NO: 3335447 - protein, 18 aa, Plasmodium falciparum
NNSSKTNIQDEKDKNTIK

SEQ ID NO: 3335448 - protein, 12 aa, Plasmodium falciparum
NNSSNDDKIEEC

SEQ ID NO: 3335449 - protein, 7 aa, Plasmodium falciparum
NNSSNDL

SEQ ID NO: 3335450 - protein, 21 aa, Plasmodium falciparum
NNSSNNIEKENPPKDKHYDNN

SEQ ID NO: 3335451 - protein, 16 aa, Plasmodium falciparum
NNSSNNNNNNQTNTQN

SEQ ID NO: 3335452 - protein, 10 aa, Plasmodium falciparum
NNSSNNNSNN

SEQ ID NO: 3335453 - protein, 17 aa, Plasmodium falciparum
NNSSNSSNENNNNDENV

SEQ ID NO: 3335454 - protein, 21 aa, Plasmodium falciparum
NNSSNYSNDKKVAGDIKKDDC

SEQ ID NO: 3335455 - protein, 15 aa, Plasmodium falciparum
NNSSQENEQKRKEQL

SEQ ID NO: 3335456 - protein, 14 aa, Plasmodium falciparum
NNSSSNNNNNNNIY

SEQ ID NO: 3335457 - protein, 14 aa, Plasmodium falciparum
NNSSTDNNKSTPET

SEQ ID NO: 3335458 - protein, 6 aa, Plasmodium falciparum
NNSSVN

SEQ ID NO: 3335459 - protein, 19 aa, Plasmodium falciparum
NNSSVNSSSKNVNHSTDTI

SEQ ID NO: 3335460 - protein, 25 aa, Plasmodium falciparum
NNSSVSNLKSKKHKLKKKKKKNISM

SEQ ID NO: 3335461 - protein, 7 aa, Plasmodium falciparum
NNSSYDK

SEQ ID NO: 3335462 - protein, 10 aa, Plasmodium falciparum
NNSSYEPIKN

SEQ ID NO: 3335463 - protein, 18 aa, Plasmodium falciparum
NNSSYNKQPNNLGASNYP

SEQ ID NO: 3335464 - protein, 6 aa, Plasmodium falciparum
NNSTLT

SEQ ID NO: 3335465 - protein, 6 aa, Plasmodium falciparum
NNSTND

SEQ ID NO: 3335466 - protein, 9 aa, Plasmodium falciparum
NNSTNNNLY

SEQ ID NO: 3335467 - protein, 19 aa, Plasmodium falciparum
NNSTNNNNNNNNNNISNSR

SEQ ID NO: 3335468 - protein, 83 aa, Plasmodium falciparum
NNSTNTNKENINENNKSCENNKSCENSKSCENNKSCENSKSCENNKSCENSKSCENNNDNQNNCTCNDKNKPIKDLNNQDKTD

SEQ ID NO: 3335469 - protein, 8 aa, Plasmodium falciparum
NNSTRKYK

SEQ ID NO: 3335470 - protein, 7 aa, Plasmodium falciparum
NNSTSIS

SEQ ID NO: 3335471 - protein, 4 aa, Plasmodium falciparum
NNSY

SEQ ID NO: 3335472 - protein, 25 aa, Plasmodium falciparum
NNSYANNSKTYKKNTQQKKNLQSSN

SEQ ID NO: 3335473 - protein, 5 aa, Plasmodium falciparum
NNSYY

SEQ ID NO: 3335474 - protein, 9 aa, Plasmodium falciparum
NNTANNNYN

SEQ ID NO: 3335475 - protein, 4 aa, Plasmodium falciparum
NNTC

SEQ ID NO: 3335476 - protein, 5 aa, Plasmodium falciparum
NNTCD

SEQ ID NO: 3335477 - protein, 6 aa, Plasmodium falciparum
NNTCKE

SEQ ID NO: 3335478 - protein, 11 aa, Plasmodium falciparum
NNTCNYNNEPN

SEQ ID NO: 3335479 - protein, 8 aa, Plasmodium falciparum
NNTCTSTN

SEQ ID NO: 3335480 - protein, 12 aa, Plasmodium falciparum
NNTDEKDQNLNN

SEQ ID NO: 3335481 - protein, 7 aa, Plasmodium falciparum
NNTDEKM

SEQ ID NO: 3335482 - protein, 7 aa, Plasmodium falciparum
NNTDEQV

SEQ ID NO: 3335483 - protein, 7 aa, Plasmodium falciparum
NNTDNID

SEQ ID NO: 3335484 - protein, 9 aa, Plasmodium falciparum
NNTDNKNKN

SEQ ID NO: 3335485 - protein, 11 aa, Plasmodium falciparum
NNTDNTDGNTD

SEQ ID NO: 3335486 - protein, 8 aa, Plasmodium falciparum
NNTDQKKY

SEQ ID NO: 3335487 - protein, 6 aa, Plasmodium falciparum
NNTDSD

SEQ ID NO: 3335488 - protein, 8 aa, Plasmodium falciparum
NNTDTQYS

SEQ ID NO: 3335489 - protein, 4 aa, Plasmodium falciparum
NNTE

SEQ ID NO: 3335490 - protein, 8 aa, Plasmodium falciparum
NNTEESGY

SEQ ID NO: 3335491 - protein, 11 aa, Plasmodium falciparum
NNTEGSKNNYI

SEQ ID NO: 3335492 - protein, 7 aa, Plasmodium falciparum
NNTEIPD

SEQ ID NO: 3335493 - protein, 6 aa, Plasmodium falciparum
NNTENI

SEQ ID NO: 3335494 - protein, 6 aa, Plasmodium falciparum
NNTENL

SEQ ID NO: 3335495 - protein, 11 aa, Plasmodium falciparum
NNTESSKKELK

SEQ ID NO: 3335496 - protein, 8 aa, Plasmodium falciparum
NNTEVSNN

SEQ ID NO: 3335497 - protein, 6 aa, Plasmodium falciparum
NNTFKN

SEQ ID NO: 3335498 - protein, 18 aa, Plasmodium falciparum
NNTFQSNDNMHSKGTNIR

SEQ ID NO: 3335499 - protein, 6 aa, Plasmodium falciparum
NNTGEM

SEQ ID NO: 3335500 - protein, 7 aa, Plasmodium falciparum
NNTGNQN

SEQ ID NO: 3335501 - protein, 24 aa, Plasmodium falciparum
NNTHGTKGKDKSTNIISSNKNDKL

SEQ ID NO: 3335502 - protein, 6 aa, Plasmodium falciparum
NNTHPC

SEQ ID NO: 3335503 - protein, 6 aa, Plasmodium falciparum
NNTHSL

SEQ ID NO: 3335504 - protein, 5 aa, Plasmodium falciparum
NNTIN

SEQ ID NO: 3335505 - protein, 5 aa, Plasmodium falciparum
NNTIS

SEQ ID NO: 3335506 - protein, 14 aa, Plasmodium falciparum
NNTKDKKEKNNGEL

SEQ ID NO: 3335507 - protein, 20 aa, Plasmodium falciparum
NNTKEHKNFKNTTDVKQPAS

SEQ ID NO: 3335508 - protein, 8 aa, Plasmodium falciparum
NNTKEQRI

SEQ ID NO: 3335509 - protein, 10 aa, Plasmodium falciparum
NNTKKNNYQG

SEQ ID NO: 3335510 - protein, 9 aa, Plasmodium falciparum
NNTKMNNDN

SEQ ID NO: 3335511 - protein, 17 aa, Plasmodium falciparum
NNTKNKNNNYNITEDDD

SEQ ID NO: 3335512 - protein, 5 aa, Plasmodium falciparum
NNTKS

SEQ ID NO: 3335513 - protein, 6 aa, Plasmodium falciparum
NNTKYN

SEQ ID NO: 3335514 - protein, 4 aa, Plasmodium falciparum
NNTL

SEQ ID NO: 3335515 - protein, 6 aa, Plasmodium falciparum
NNTLDT

SEQ ID NO: 3335516 - protein, 26 aa, Plasmodium falciparum
NNTLNNNKKKKKKKKKKKKKSYSVEG

SEQ ID NO: 3335517 - protein, 7 aa, Plasmodium falciparum
NNTLNSI

SEQ ID NO: 3335518 - protein, 5 aa, Plasmodium falciparum
NNTLQ

SEQ ID NO: 3335519 - protein, 16 aa, Plasmodium falciparum
NNTLTNNNEVKQNNEY

SEQ ID NO: 3335520 - protein, 7 aa, Plasmodium falciparum
NNTNCQH

SEQ ID NO: 3335521 - protein, 7 aa, Plasmodium falciparum
NNTNDEV

SEQ ID NO: 3335522 - protein, 11 aa, Plasmodium falciparum
NNTNDLNSTKS

SEQ ID NO: 3335523 - protein, 10 aa, Plasmodium falciparum
NNTNERNKYN

SEQ ID NO: 3335524 - protein, 18 aa, Plasmodium falciparum
NNTNHHDYNNNKKKKKMK

SEQ ID NO: 3335525 - protein, 6 aa, Plasmodium falciparum
NNTNHI

SEQ ID NO: 3335526 - protein, 5 aa, Plasmodium falciparum
NNTNI

SEQ ID NO: 3335527 - protein, 6 aa, Plasmodium falciparum
NNTNIN

SEQ ID NO: 3335528 - protein, 25 aa, Plasmodium falciparum
NNTNKDKKKMNYTNKDKEDNKNNNF

SEQ ID NO: 3335529 - protein, 6 aa, Plasmodium falciparum
NNTNKN

SEQ ID NO: 3335530 - protein, 10 aa, Plasmodium falciparum
NNTNKNISNI

SEQ ID NO: 3335531 - protein, 8 aa, Plasmodium falciparum
NNTNKNST

SEQ ID NO: 3335532 - protein, 6 aa, Plasmodium falciparum
NNTNMN

SEQ ID NO: 3335533 - protein, 5 aa, Plasmodium falciparum
NNTNN

SEQ ID NO: 3335534 - protein, 9 aa, Plasmodium falciparum
NNTNNDNTY

SEQ ID NO: 3335535 - protein, 10 aa, Plasmodium falciparum
NNTNNEEQKY

SEQ ID NO: 3335536 - protein, 8 aa, Plasmodium falciparum
NNTNNFNN

SEQ ID NO: 3335537 - protein, 6 aa, Plasmodium falciparum
NNTNNK

SEQ ID NO: 3335538 - protein, 44 aa, Plasmodium falciparum
NNTNNMNNTNNTNNINNTNNINNTNNMNNTNNTNNTNNTNNMNN

SEQ ID NO: 3335539 - protein, 7 aa, Plasmodium falciparum
NNTNNNE

SEQ ID NO: 3335540 - protein, 15 aa, Plasmodium falciparum
NNTNNNIDNNNNNDN

SEQ ID NO: 3335541 - protein, 14 aa, Plasmodium falciparum
NNTNNNNNNNNNNN

SEQ ID NO: 3335542 - protein, 17 aa, Plasmodium falciparum
NNTNNNNNSNNNNNNNK

SEQ ID NO: 3335543 - protein, 6 aa, Plasmodium falciparum
NNTNNP

SEQ ID NO: 3335544 - protein, 10 aa, Plasmodium falciparum
NNTNNSNPFN

SEQ ID NO: 3335545 - protein, 9 aa, Plasmodium falciparum
NNTNQNQIP

SEQ ID NO: 3335546 - protein, 5 aa, Plasmodium falciparum
NNTNS

SEQ ID NO: 3335547 - protein, 11 aa, Plasmodium falciparum
NNTNSKSTQDY

SEQ ID NO: 3335548 - protein, 7 aa, Plasmodium falciparum
NNTNTLR

SEQ ID NO: 3335549 - protein, 12 aa, Plasmodium falciparum
NNTNVSNNSINE

SEQ ID NO: 3335550 - protein, 6 aa, Plasmodium falciparum
NNTPEL

SEQ ID NO: 3335551 - protein, 10 aa, Plasmodium falciparum
NNTPGSNNNN

SEQ ID NO: 3335552 - protein, 15 aa, Plasmodium falciparum
NNTPSNYMNNPENNN

SEQ ID NO: 3335553 - protein, 20 aa, Plasmodium falciparum
NNTPTDQNKKEYEEESSGFN

SEQ ID NO: 3335554 - protein, 18 aa, Plasmodium falciparum
NNTPYINSTPNYNNNGGE

SEQ ID NO: 3335555 - protein, 8 aa, Plasmodium falciparum
NNTQKRDV

SEQ ID NO: 3335556 - protein, 8 aa, Plasmodium falciparum
NNTQKVDD

SEQ ID NO: 3335557 - protein, 29 aa, Plasmodium falciparum
NNTQNDDIYNNNNNNQLDPNKNHKNNYND

SEQ ID NO: 3335558 - protein, 8 aa, Plasmodium falciparum
NNTQPEQV

SEQ ID NO: 3335559 - protein, 7 aa, Plasmodium falciparum
NNTQQNY

SEQ ID NO: 3335560 - protein, 5 aa, Plasmodium falciparum
NNTRE

SEQ ID NO: 3335561 - protein, 6 aa, Plasmodium falciparum
NNTSDI

SEQ ID NO: 3335562 - protein, 7 aa, Plasmodium falciparum
NNTSIEE

SEQ ID NO: 3335563 - protein, 6 aa, Plasmodium falciparum
NNTSKQ

SEQ ID NO: 3335564 - protein, 10 aa, Plasmodium falciparum
NNTSNENVTN

SEQ ID NO: 3335565 - protein, 8 aa, Plasmodium falciparum
NNTSNNNI

SEQ ID NO: 3335566 - protein, 10 aa, Plasmodium falciparum
NNTSNNQNIN

SEQ ID NO: 3335567 - protein, 8 aa, Plasmodium falciparum
NNTSNTEM

SEQ ID NO: 3335568 - protein, 6 aa, Plasmodium falciparum
NNTSNY

SEQ ID NO: 3335569 - protein, 13 aa, Plasmodium falciparum
NNTSQNRDVTEDG

SEQ ID NO: 3335570 - protein, 24 aa, Plasmodium falciparum
NNTSSSHHNNNAHGNNNEDEDSDE

SEQ ID NO: 3335571 - protein, 29 aa, Plasmodium falciparum
NNTSTKSNNDLKKNENVNENNPDRSFRDS

SEQ ID NO: 3335572 - protein, 10 aa, Plasmodium falciparum
NNTSTNVEDE

SEQ ID NO: 3335573 - protein, 8 aa, Plasmodium falciparum
NNTSYDQN

SEQ ID NO: 3335574 - protein, 23 aa, Plasmodium falciparum
NNTTDNVNKKENHLSPKECNNNN

SEQ ID NO: 3335575 - protein, 6 aa, Plasmodium falciparum
NNTTDQ

SEQ ID NO: 3335576 - protein, 7 aa, Plasmodium falciparum
NNTTEGL

SEQ ID NO: 3335577 - protein, 12 aa, Plasmodium falciparum
NNTTGENSSNNL

SEQ ID NO: 3335578 - protein, 12 aa, Plasmodium falciparum
NNTTKKYIKKKT

SEQ ID NO: 3335579 - protein, 9 aa, Plasmodium falciparum
NNTTNLNNT

SEQ ID NO: 3335580 - protein, 9 aa, Plasmodium falciparum
NNTTNNNMN

SEQ ID NO: 3335581 - protein, 24 aa, Plasmodium falciparum
NNTTTNNTHTNTNETSSQNTNSNH

SEQ ID NO: 3335582 - protein, 14 aa, Plasmodium falciparum
NNTTTQETNQLSRD

SEQ ID NO: 3335583 - protein, 23 aa, Plasmodium falciparum
NNTTTTKNNDNNNDNNNNNNNNN

SEQ ID NO: 3335584 - protein, 106 aa, Plasmodium falciparum
NNTTYSNASNSNNSTRRSRDSDNEKEGSRKKSKNYKNEEEYRQSINNNNNNNNNNNNEDRRNSNTSCSHKYNNNTDNAPNRNPSDVVNNNESNEEQRNTTKRQSTV

SEQ ID NO: 3335585 - protein, 17 aa, Plasmodium falciparum
NNTVNSNNTRLGSNNNA

SEQ ID NO: 3335586 - protein, 14 aa, Plasmodium falciparum
NNTVPENDNNEIYK

SEQ ID NO: 3335587 - protein, 12 aa, Plasmodium falciparum
NNTYKKDNRNIK

SEQ ID NO: 3335588 - protein, 7 aa, Plasmodium falciparum
NNTYKQK

SEQ ID NO: 3335589 - protein, 20 aa, Plasmodium falciparum
NNTYKTNDHKYDEAENSSSL

SEQ ID NO: 3335590 - protein, 5 aa, Plasmodium falciparum
NNTYQ

SEQ ID NO: 3335591 - protein, 7 aa, Plasmodium falciparum
NNTYSNN

SEQ ID NO: 3335592 - protein, 8 aa, Plasmodium falciparum
NNVDDDDD

SEQ ID NO: 3335593 - protein, 18 aa, Plasmodium falciparum
NNVDEKKKKVDEQNNNID

SEQ ID NO: 3335594 - protein, 16 aa, Plasmodium falciparum
NNVDEKKSDNKGKDII

SEQ ID NO: 3335595 - protein, 10 aa, Plasmodium falciparum
NNVDENEFPN

SEQ ID NO: 3335596 - protein, 12 aa, Plasmodium falciparum
NNVDEQNNNMDE

SEQ ID NO: 3335597 - protein, 8 aa, Plasmodium falciparum
NNVDNEKM

SEQ ID NO: 3335598 - protein, 19 aa, Plasmodium falciparum
NNVDNNVNNNNVKSSGVEK

SEQ ID NO: 3335599 - protein, 10 aa, Plasmodium falciparum
NNVDNNVNNV

SEQ ID NO: 3335600 - protein, 6 aa, Plasmodium falciparum
NNVDSS

SEQ ID NO: 3335601 - protein, 7 aa, Plasmodium falciparum
NNVDTSK

SEQ ID NO: 3335602 - protein, 12 aa, Plasmodium falciparum
NNVEDKKNEEIE

SEQ ID NO: 3335603 - protein, 12 aa, Plasmodium falciparum
NNVEKSNNDNLK

SEQ ID NO: 3335604 - protein, 8 aa, Plasmodium falciparum
NNVENNNM

SEQ ID NO: 3335605 - protein, 6 aa, Plasmodium falciparum
NNVGQK

SEQ ID NO: 3335606 - protein, 10 aa, Plasmodium falciparum
NNVKENDDME

SEQ ID NO: 3335607 - protein, 9 aa, Plasmodium falciparum
NNVKENNNI

SEQ ID NO: 3335608 - protein, 10 aa, Plasmodium falciparum
NNVKKETNNI

SEQ ID NO: 3335609 - protein, 18 aa, Plasmodium falciparum
NNVKNGKNKIKKDNQQKM

SEQ ID NO: 3335610 - protein, 9 aa, Plasmodium falciparum
NNVKNNDNN

SEQ ID NO: 3335611 - protein, 14 aa, Plasmodium falciparum
NNVLSNSEKNISQY

SEQ ID NO: 3335612 - protein, 10 aa, Plasmodium falciparum
NNVNDSSNTQ

SEQ ID NO: 3335613 - protein, 11 aa, Plasmodium falciparum
NNVNESDKVNN

SEQ ID NO: 3335614 - protein, 10 aa, Plasmodium falciparum
NNVNESPEKV

SEQ ID NO: 3335615 - protein, 30 aa, Plasmodium falciparum
NNVNNDHTNIKEANNNNNRKSEHSEKNKDV

SEQ ID NO: 3335616 - protein, 10 aa, Plasmodium falciparum
NNVNNDQYKN

SEQ ID NO: 3335617 - protein, 10 aa, Plasmodium falciparum
NNVNNKETNI

SEQ ID NO: 3335618 - protein, 9 aa, Plasmodium falciparum
NNVNNNNYG

SEQ ID NO: 3335619 - protein, 50 aa, Plasmodium falciparum
NNVNNSNDHINNNNNNNNNDDDKINNNNNDDDNINNNNNNDDNINNNNNN

SEQ ID NO: 3335620 - protein, 10 aa, Plasmodium falciparum
NNVNNSTNVN

SEQ ID NO: 3335621 - protein, 8 aa, Plasmodium falciparum
NNVNNTNK

SEQ ID NO: 3335622 - protein, 21 aa, Plasmodium falciparum
NNVNPDESEKVGSTDINSLND

SEQ ID NO: 3335623 - protein, 6 aa, Plasmodium falciparum
NNVNSM

SEQ ID NO: 3335624 - protein, 8 aa, Plasmodium falciparum
NNVNSNAH

SEQ ID NO: 3335625 - protein, 4 aa, Plasmodium falciparum
NNVP

SEQ ID NO: 3335626 - protein, 6 aa, Plasmodium falciparum
NNVPFK

SEQ ID NO: 3335627 - protein, 5 aa, Plasmodium falciparum
NNVPS

SEQ ID NO: 3335628 - protein, 5 aa, Plasmodium falciparum
NNVPY

SEQ ID NO: 3335629 - protein, 5 aa, Plasmodium falciparum
NNVQG

SEQ ID NO: 3335630 - protein, 4 aa, Plasmodium falciparum
NNVR

SEQ ID NO: 3335631 - protein, 4 aa, Plasmodium falciparum
NNVS

SEQ ID NO: 3335632 - protein, 13 aa, Plasmodium falciparum
NNVSKNDSNNINR

SEQ ID NO: 3335633 - protein, 5 aa, Plasmodium falciparum
NNVSN

SEQ ID NO: 3335634 - protein, 7 aa, Plasmodium falciparum
NNVSNNN

SEQ ID NO: 3335635 - protein, 7 aa, Plasmodium falciparum
NNVSNNQ

SEQ ID NO: 3335636 - protein, 7 aa, Plasmodium falciparum
NNVSNNT

SEQ ID NO: 3335637 - protein, 7 aa, Plasmodium falciparum
NNVSTNN

SEQ ID NO: 3335638 - protein, 11 aa, Plasmodium falciparum
NNVTKKGSEMY

SEQ ID NO: 3335639 - protein, 8 aa, Plasmodium falciparum
NNVTKRQR

SEQ ID NO: 3335640 - protein, 13 aa, Plasmodium falciparum
NNVTTTQDDDTYQ

SEQ ID NO: 3335641 - protein, 24 aa, Plasmodium falciparum
NNVVENKSKEYNISDNGINDSCDY

SEQ ID NO: 3335642 - protein, 4 aa, Plasmodium falciparum
NNVY

SEQ ID NO: 3335643 - protein, 4 aa, Plasmodium falciparum
NNYD

SEQ ID NO: 3335644 - protein, 6 aa, Plasmodium falciparum
NNYDDD

SEQ ID NO: 3335645 - protein, 10 aa, Plasmodium falciparum
NNYDDNNKYY

SEQ ID NO: 3335646 - protein, 8 aa, Plasmodium falciparum
NNYDGNRN

SEQ ID NO: 3335647 - protein, 22 aa, Plasmodium falciparum
NNYDKEENKLYDTNKKQDKNKI

SEQ ID NO: 3335648 - protein, 11 aa, Plasmodium falciparum
NNYDNKNDQLD

SEQ ID NO: 3335649 - protein, 6 aa, Plasmodium falciparum
NNYDNN

SEQ ID NO: 3335650 - protein, 7 aa, Plasmodium falciparum
NNYDNNG

SEQ ID NO: 3335651 - protein, 19 aa, Plasmodium falciparum
NNYDNNNNNNNISNNNNNI

SEQ ID NO: 3335652 - protein, 12 aa, Plasmodium falciparum
NNYDNNNNNNNN

SEQ ID NO: 3335653 - protein, 20 aa, Plasmodium falciparum
NNYDTTTNYNNNYNDNNYDN

SEQ ID NO: 3335654 - protein, 8 aa, Plasmodium falciparum
NNYEEDKY

SEQ ID NO: 3335655 - protein, 6 aa, Plasmodium falciparum
NNYEEE

SEQ ID NO: 3335656 - protein, 5 aa, Plasmodium falciparum
NNYEK

SEQ ID NO: 3335657 - protein, 8 aa, Plasmodium falciparum
NNYEKGKN

SEQ ID NO: 3335658 - protein, 5 aa, Plasmodium falciparum
NNYEP

SEQ ID NO: 3335659 - protein, 9 aa, Plasmodium falciparum
NNYGNHKKN

SEQ ID NO: 3335660 - protein, 8 aa, Plasmodium falciparum
NNYGNYNN

SEQ ID NO: 3335661 - protein, 20 aa, Plasmodium falciparum
NNYHNNNNINNSSSSRGEKW

SEQ ID NO: 3335662 - protein, 8 aa, Plasmodium falciparum
NNYISSCG

SEQ ID NO: 3335663 - protein, 4 aa, Plasmodium falciparum
NNYK

SEQ ID NO: 3335664 - protein, 19 aa, Plasmodium falciparum
NNYKASNNTLQKKKNNNFD

SEQ ID NO: 3335665 - protein, 30 aa, Plasmodium falciparum
NNYKFKNNNQKKPITEKNEYDTEKKEEKPK

SEQ ID NO: 3335666 - protein, 9 aa, Plasmodium falciparum
NNYKNDKNY

SEQ ID NO: 3335667 - protein, 10 aa, Plasmodium falciparum
NNYKNDPNAF

SEQ ID NO: 3335668 - protein, 12 aa, Plasmodium falciparum
NNYKNKNGHHNI

SEQ ID NO: 3335669 - protein, 8 aa, Plasmodium falciparum
NNYKPNEK

SEQ ID NO: 3335670 - protein, 5 aa, Plasmodium falciparum
NNYKQ

SEQ ID NO: 3335671 - protein, 10 aa, Plasmodium falciparum
NNYKSNNDEY

SEQ ID NO: 3335672 - protein, 6 aa, Plasmodium falciparum
NNYKTL

SEQ ID NO: 3335673 - protein, 4 aa, Plasmodium falciparum
NNYN

SEQ ID NO: 3335674 - protein, 48 aa, Plasmodium falciparum
NNYNDDNNYSDDNNYNDDNNYSDDNYYNDDNYYNEDNYYNDNKSVGGG

SEQ ID NO: 3335675 - protein, 13 aa, Plasmodium falciparum
NNYNENTSSNNNL

SEQ ID NO: 3335676 - protein, 6 aa, Plasmodium falciparum
NNYNKN

SEQ ID NO: 3335677 - protein, 11 aa, Plasmodium falciparum
NNYNNENKTEY

SEQ ID NO: 3335678 - protein, 9 aa, Plasmodium falciparum
NNYNNKNNY

SEQ ID NO: 3335679 - protein, 11 aa, Plasmodium falciparum
NNYNNNAKNVN

SEQ ID NO: 3335680 - protein, 20 aa, Plasmodium falciparum
NNYNNNNHNRNSNSNVNKNE

SEQ ID NO: 3335681 - protein, 8 aa, Plasmodium falciparum
NNYNNNNN

SEQ ID NO: 3335682 - protein, 12 aa, Plasmodium falciparum
NNYNNNNNNINN

SEQ ID NO: 3335683 - protein, 10 aa, Plasmodium falciparum
NNYNNNSTST

SEQ ID NO: 3335684 - protein, 8 aa, Plasmodium falciparum
NNYNNSDN

SEQ ID NO: 3335685 - protein, 6 aa, Plasmodium falciparum
NNYNNY

SEQ ID NO: 3335686 - protein, 15 aa, Plasmodium falciparum
NNYNNYNNNNNNGPY

SEQ ID NO: 3335687 - protein, 15 aa, Plasmodium falciparum
NNYNNYNNYNNYNNY

SEQ ID NO: 3335688 - protein, 7 aa, Plasmodium falciparum
NNYNTDG

SEQ ID NO: 3335689 - protein, 10 aa, Plasmodium falciparum
NNYNTKNKDN

SEQ ID NO: 3335690 - protein, 4 aa, Plasmodium falciparum
NNYP

SEQ ID NO: 3335691 - protein, 15 aa, Plasmodium falciparum
NNYPDGNSDDYYDDD

SEQ ID NO: 3335692 - protein, 5 aa, Plasmodium falciparum
NNYPL

SEQ ID NO: 3335693 - protein, 7 aa, Plasmodium falciparum
NNYPNNI

SEQ ID NO: 3335694 - protein, 18 aa, Plasmodium falciparum
NNYPNSEQQHNKQFTDTS

SEQ ID NO: 3335695 - protein, 14 aa, Plasmodium falciparum
NNYPNSSNNNLNNK

SEQ ID NO: 3335696 - protein, 7 aa, Plasmodium falciparum
NNYPRQV

SEQ ID NO: 3335697 - protein, 4 aa, Plasmodium falciparum
NNYQ

SEQ ID NO: 3335698 - protein, 4 aa, Plasmodium falciparum
NNYR

SEQ ID NO: 3335699 - protein, 13 aa, Plasmodium falciparum
NNYREGKNSLKGN

SEQ ID NO: 3335700 - protein, 4 aa, Plasmodium falciparum
NNYS

SEQ ID NO: 3335701 - protein, 6 aa, Plasmodium falciparum
NNYSCG

SEQ ID NO: 3335702 - protein, 6 aa, Plasmodium falciparum
NNYSEN

SEQ ID NO: 3335703 - protein, 13 aa, Plasmodium falciparum
NNYSESNTNDKNF

SEQ ID NO: 3335704 - protein, 6 aa, Plasmodium falciparum
NNYSGS

SEQ ID NO: 3335705 - protein, 9 aa, Plasmodium falciparum
NNYSKDEHD

SEQ ID NO: 3335706 - protein, 14 aa, Plasmodium falciparum
NNYSNESSNNFTNN

SEQ ID NO: 3335707 - protein, 162 aa, Plasmodium falciparum
NNYSNNNSSSNSSRSYNESKKSSKDENNNNDNDNRDNNNNNNNNNNNNGNNANNGNNGNNGNNNNNNNNGNNGNNGNNNNEGNDNNDDNKNNDENKNNNKEVSDDKDKDEHDEKGSNENKNLSHNNNNNNNNNGSSSNNNNNLNGDNKKNEGNKKNETSSIK

SEQ ID NO: 3335708 - protein, 20 aa, Plasmodium falciparum
NNYSNNSSTNYSSDYSFSRN

SEQ ID NO: 3335709 - protein, 13 aa, Plasmodium falciparum
NNYSNQNNISNNN

SEQ ID NO: 3335710 - protein, 7 aa, Plasmodium falciparum
NNYSNSS

SEQ ID NO: 3335711 - protein, 14 aa, Plasmodium falciparum
NNYSRNIQNSTERY

SEQ ID NO: 3335712 - protein, 16 aa, Plasmodium falciparum
NNYSTTADNFASNQTP

SEQ ID NO: 3335713 - protein, 4 aa, Plasmodium falciparum
NNYT

SEQ ID NO: 3335714 - protein, 12 aa, Plasmodium falciparum
NNYTKKNNYNKK

SEQ ID NO: 3335715 - protein, 19 aa, Plasmodium falciparum
NNYTKNSLENNDSKNKENY

SEQ ID NO: 3335716 - protein, 5 aa, Plasmodium falciparum
NNYTN

SEQ ID NO: 3335717 - protein, 6 aa, Plasmodium falciparum
NNYTPA

SEQ ID NO: 3335718 - protein, 6 aa, Plasmodium falciparum
NNYTQQ

SEQ ID NO: 3335719 - protein, 18 aa, Plasmodium falciparum
NNYVKEKKKTQKNSKTRI

SEQ ID NO: 3335720 - protein, 6 aa, Plasmodium falciparum
NNYYND

SEQ ID NO: 3335721 - protein, 8 aa, Plasmodium falciparum
NNYYNSDN

SEQ ID NO: 3335722 - protein, 5 aa, Plasmodium falciparum
NPAAR

SEQ ID NO: 3335723 - protein, 5 aa, Plasmodium falciparum
NPADA

SEQ ID NO: 3335724 - protein, 8 aa, Plasmodium falciparum
NPADEIPK

SEQ ID NO: 3335725 - protein, 9 aa, Plasmodium falciparum
NPANQSYSI

SEQ ID NO: 3335726 - protein, 6 aa, Plasmodium falciparum
NPAPPV

SEQ ID NO: 3335727 - protein, 6 aa, Plasmodium falciparum
NPCEKN

SEQ ID NO: 3335728 - protein, 4 aa, Plasmodium falciparum
NPDA

SEQ ID NO: 3335729 - protein, 9 aa, Plasmodium falciparum
NPDDATIGH

SEQ ID NO: 3335730 - protein, 5 aa, Plasmodium falciparum
NPDDI

SEQ ID NO: 3335731 - protein, 6 aa, Plasmodium falciparum
NPDDNI

SEQ ID NO: 3335732 - protein, 7 aa, Plasmodium falciparum
NPDDTIG

SEQ ID NO: 3335733 - protein, 4 aa, Plasmodium falciparum
NPDE

SEQ ID NO: 3335734 - protein, 36 aa, Plasmodium falciparum
NPDEEEKKKKKKKKEDKCDNKLKDKSNESSNINSKD

SEQ ID NO: 3335735 - protein, 10 aa, Plasmodium falciparum
NPDKDKSEQI

SEQ ID NO: 3335736 - protein, 4 aa, Plasmodium falciparum
NPDN

SEQ ID NO: 3335737 - protein, 8 aa, Plasmodium falciparum
NPDNVDPD

SEQ ID NO: 3335738 - protein, 18 aa, Plasmodium falciparum
NPDSANSFSGSTHINNSN

SEQ ID NO: 3335739 - protein, 7 aa, Plasmodium falciparum
NPDYEPR

SEQ ID NO: 3335740 - protein, 4 aa, Plasmodium falciparum
NPEA

SEQ ID NO: 3335741 - protein, 5 aa, Plasmodium falciparum
NPEEF

SEQ ID NO: 3335742 - protein, 10 aa, Plasmodium falciparum
NPEEKKKNEF

SEQ ID NO: 3335743 - protein, 4 aa, Plasmodium falciparum
NPEK

SEQ ID NO: 3335744 - protein, 6 aa, Plasmodium falciparum
NPENEY

SEQ ID NO: 3335745 - protein, 8 aa, Plasmodium falciparum
NPENKSTL

SEQ ID NO: 3335746 - protein, 8 aa, Plasmodium falciparum
NPEQVKKG

SEQ ID NO: 3335747 - protein, 11 aa, Plasmodium falciparum
NPERKQKKIPY

SEQ ID NO: 3335748 - protein, 6 aa, Plasmodium falciparum
NPESAL

SEQ ID NO: 3335749 - protein, 6 aa, Plasmodium falciparum
NPEWEN

SEQ ID NO: 3335750 - protein, 4 aa, Plasmodium falciparum
NPFG

SEQ ID NO: 3335751 - protein, 5 aa, Plasmodium falciparum
NPFGD

SEQ ID NO: 3335752 - protein, 10 aa, Plasmodium falciparum
NPFKGEYKHN

SEQ ID NO: 3335753 - protein, 4 aa, Plasmodium falciparum
NPFN

SEQ ID NO: 3335754 - protein, 8 aa, Plasmodium falciparum
NPFPEDED

SEQ ID NO: 3335755 - protein, 9 aa, Plasmodium falciparum
NPFRGSSHA

SEQ ID NO: 3335756 - protein, 5 aa, Plasmodium falciparum
NPGDE

SEQ ID NO: 3335757 - protein, 4 aa, Plasmodium falciparum
NPGE

SEQ ID NO: 3335758 - protein, 5 aa, Plasmodium falciparum
NPGGN

SEQ ID NO: 3335759 - protein, 8 aa, Plasmodium falciparum
NPGNLPSY

SEQ ID NO: 3335760 - protein, 7 aa, Plasmodium falciparum
NPHANRY

SEQ ID NO: 3335761 - protein, 9 aa, Plasmodium falciparum
NPHEGDKAS

SEQ ID NO: 3335762 - protein, 8 aa, Plasmodium falciparum
NPHKCDQK

SEQ ID NO: 3335763 - protein, 11 aa, Plasmodium falciparum
NPHNDRQAEDR

SEQ ID NO: 3335764 - protein, 4 aa, Plasmodium falciparum
NPHQ

SEQ ID NO: 3335765 - protein, 5 aa, Plasmodium falciparum
NPHTP

SEQ ID NO: 3335766 - protein, 7 aa, Plasmodium falciparum
NPHVNDT

SEQ ID NO: 3335767 - protein, 7 aa, Plasmodium falciparum
NPHYQPE

SEQ ID NO: 3335768 - protein, 4 aa, Plasmodium falciparum
NPIH

SEQ ID NO: 3335769 - protein, 16 aa, Plasmodium falciparum
NPIKKEDNVYNTNSNK

SEQ ID NO: 3335770 - protein, 5 aa, Plasmodium falciparum
NPIKN

SEQ ID NO: 3335771 - protein, 4 aa, Plasmodium falciparum
NPIN

SEQ ID NO: 3335772 - protein, 6 aa, Plasmodium falciparum
NPINGY

SEQ ID NO: 3335773 - protein, 8 aa, Plasmodium falciparum
NPINNISN

SEQ ID NO: 3335774 - protein, 7 aa, Plasmodium falciparum
NPINNQN

SEQ ID NO: 3335775 - protein, 4 aa, Plasmodium falciparum
NPIS

SEQ ID NO: 3335776 - protein, 5 aa, Plasmodium falciparum
NPITN

SEQ ID NO: 3335777 - protein, 8 aa, Plasmodium falciparum
NPITSGTK

SEQ ID NO: 3335778 - protein, 9 aa, Plasmodium falciparum
NPIYEGKTN

SEQ ID NO: 3335779 - protein, 8 aa, Plasmodium falciparum
NPIYSPKA

SEQ ID NO: 3335780 - protein, 7 aa, Plasmodium falciparum
NPKGLEA

SEQ ID NO: 3335781 - protein, 41 aa, Plasmodium falciparum
NPKGNQKNEENEKNEENEKNEENEKNEENEKNEENEKNEDY

SEQ ID NO: 3335782 - protein, 7 aa, Plasmodium falciparum
NPKKRPT

SEQ ID NO: 3335783 - protein, 9 aa, Plasmodium falciparum
NPKKRPTAE

SEQ ID NO: 3335784 - protein, 11 aa, Plasmodium falciparum
NPKLQNNSSDM

SEQ ID NO: 3335785 - protein, 11 aa, Plasmodium falciparum
NPKNDDIKEDE

SEQ ID NO: 3335786 - protein, 5 aa, Plasmodium falciparum
NPKNN

SEQ ID NO: 3335787 - protein, 8 aa, Plasmodium falciparum
NPKNSDEY

SEQ ID NO: 3335788 - protein, 5 aa, Plasmodium falciparum
NPKNT

SEQ ID NO: 3335789 - protein, 9 aa, Plasmodium falciparum
NPKRKKNYE

SEQ ID NO: 3335790 - protein, 17 aa, Plasmodium falciparum
NPKSAEKTIQKRNGKKF

SEQ ID NO: 3335791 - protein, 15 aa, Plasmodium falciparum
NPKVPSITSRTKSYT

SEQ ID NO: 3335792 - protein, 7 aa, Plasmodium falciparum
NPKYYNT

SEQ ID NO: 3335793 - protein, 6 aa, Plasmodium falciparum
NPLGEY

SEQ ID NO: 3335794 - protein, 9 aa, Plasmodium falciparum
NPLGNPMGN

SEQ ID NO: 3335795 - protein, 13 aa, Plasmodium falciparum
NPLNEQNDNKSNN

SEQ ID NO: 3335796 - protein, 8 aa, Plasmodium falciparum
NPLSEDSQ

SEQ ID NO: 3335797 - protein, 6 aa, Plasmodium falciparum
NPLSNS

SEQ ID NO: 3335798 - protein, 4 aa, Plasmodium falciparum
NPND

SEQ ID NO: 3335799 - protein, 6 aa, Plasmodium falciparum
NPNDLS

SEQ ID NO: 3335800 - protein, 7 aa, Plasmodium falciparum
NPNDPSS

SEQ ID NO: 3335801 - protein, 8 aa, Plasmodium falciparum
NPNDRITA

SEQ ID NO: 3335802 - protein, 7 aa, Plasmodium falciparum
NPNDSSS

SEQ ID NO: 3335803 - protein, 6 aa, Plasmodium falciparum
NPNEAI

SEQ ID NO: 3335804 - protein, 7 aa, Plasmodium falciparum
NPNELAQ

SEQ ID NO: 3335805 - protein, 7 aa, Plasmodium falciparum
NPNENEA

SEQ ID NO: 3335806 - protein, 9 aa, Plasmodium falciparum
NPNENNKNV

SEQ ID NO: 3335807 - protein, 4 aa, Plasmodium falciparum
NPNI

SEQ ID NO: 3335808 - protein, 42 aa, Plasmodium falciparum
NPNINDPKKAFQSIGSTSTTNNNHVNNNNNNNISTDGKTSTG

SEQ ID NO: 3335809 - protein, 7 aa, Plasmodium falciparum
NPNIPNY

SEQ ID NO: 3335810 - protein, 4 aa, Plasmodium falciparum
NPNK

SEQ ID NO: 3335811 - protein, 8 aa, Plasmodium falciparum
NPNKHDKM

SEQ ID NO: 3335812 - protein, 5 aa, Plasmodium falciparum
NPNKK

SEQ ID NO: 3335813 - protein, 4 aa, Plasmodium falciparum
NPNN

SEQ ID NO: 3335814 - protein, 46 aa, Plasmodium falciparum
NPNNENVGLNDNNNNNNNNSNNSNNNNNNNNNNNNNNNSSSSNAGV

SEQ ID NO: 3335815 - protein, 47 aa, Plasmodium falciparum
NPNNHNNNNNNNNNNNINSNNSNNNSNNNNNNNNNNNNNNNNNNNNN

SEQ ID NO: 3335816 - protein, 15 aa, Plasmodium falciparum
NPNNPENLRDSNDKS

SEQ ID NO: 3335817 - protein, 7 aa, Plasmodium falciparum
NPNNSNS

SEQ ID NO: 3335818 - protein, 7 aa, Plasmodium falciparum
NPNNYEP

SEQ ID NO: 3335819 - protein, 8 aa, Plasmodium falciparum
NPNNYTAN

SEQ ID NO: 3335820 - protein, 6 aa, Plasmodium falciparum
NPNPFM

SEQ ID NO: 3335821 - protein, 7 aa, Plasmodium falciparum
NPNQSTQ

SEQ ID NO: 3335822 - protein, 5 aa, Plasmodium falciparum
NPNRA

SEQ ID NO: 3335823 - protein, 7 aa, Plasmodium falciparum
NPNSNNN

SEQ ID NO: 3335824 - protein, 5 aa, Plasmodium falciparum
NPNTA

SEQ ID NO: 3335825 - protein, 13 aa, Plasmodium falciparum
NPNTFTPSNIPPN

SEQ ID NO: 3335826 - protein, 7 aa, Plasmodium falciparum
NPNVNQK

SEQ ID NO: 3335827 - protein, 8 aa, Plasmodium falciparum
NPNYANKN

SEQ ID NO: 3335828 - protein, 8 aa, Plasmodium falciparum
NPNYKKTK

SEQ ID NO: 3335829 - protein, 7 aa, Plasmodium falciparum
NPNYTLN

SEQ ID NO: 3335830 - protein, 6 aa, Plasmodium falciparum
NPPDYK

SEQ ID NO: 3335831 - protein, 6 aa, Plasmodium falciparum
NPPELK

SEQ ID NO: 3335832 - protein, 13 aa, Plasmodium falciparum
NPPFANPDGPFEK

SEQ ID NO: 3335833 - protein, 7 aa, Plasmodium falciparum
NPPFTTP

SEQ ID NO: 3335834 - protein, 4 aa, Plasmodium falciparum
NPPI

SEQ ID NO: 3335835 - protein, 4 aa, Plasmodium falciparum
NPPK

SEQ ID NO: 3335836 - protein, 6 aa, Plasmodium falciparum
NPPRNY

SEQ ID NO: 3335837 - protein, 23 aa, Plasmodium falciparum
NPQADSYKSLQERNNDIKEKTNF

SEQ ID NO: 3335838 - protein, 6 aa, Plasmodium falciparum
NPQALP

SEQ ID NO: 3335839 - protein, 6 aa, Plasmodium falciparum
NPQETK

SEQ ID NO: 3335840 - protein, 5 aa, Plasmodium falciparum
NPQGP

SEQ ID NO: 3335841 - protein, 5 aa, Plasmodium falciparum
NPQNC

SEQ ID NO: 3335842 - protein, 5 aa, Plasmodium falciparum
NPQRL

SEQ ID NO: 3335843 - protein, 6 aa, Plasmodium falciparum
NPQSNL

SEQ ID NO: 3335844 - protein, 5 aa, Plasmodium falciparum
NPQTG

SEQ ID NO: 3335845 - protein, 8 aa, Plasmodium falciparum
NPQTGYPI

SEQ ID NO: 3335846 - protein, 12 aa, Plasmodium falciparum
NPREKKSFDKLP

SEQ ID NO: 3335847 - protein, 4 aa, Plasmodium falciparum
NPRG

SEQ ID NO: 3335848 - protein, 6 aa, Plasmodium falciparum
NPRGYE

SEQ ID NO: 3335849 - protein, 4 aa, Plasmodium falciparum
NPRQ

SEQ ID NO: 3335850 - protein, 12 aa, Plasmodium falciparum
NPRTHTNGDKDI

SEQ ID NO: 3335851 - protein, 5 aa, Plasmodium falciparum
NPRVE

SEQ ID NO: 3335852 - protein, 6 aa, Plasmodium falciparum
NPSCND

SEQ ID NO: 3335853 - protein, 6 aa, Plasmodium falciparum
NPSDIT

SEQ ID NO: 3335854 - protein, 7 aa, Plasmodium falciparum
NPSDLEK

SEQ ID NO: 3335855 - protein, 10 aa, Plasmodium falciparum
NPSDNSTNTN

SEQ ID NO: 3335856 - protein, 6 aa, Plasmodium falciparum
NPSEPP

SEQ ID NO: 3335857 - protein, 16 aa, Plasmodium falciparum
NPSETKKNDSLKMNQE

SEQ ID NO: 3335858 - protein, 5 aa, Plasmodium falciparum
NPSEY

SEQ ID NO: 3335859 - protein, 16 aa, Plasmodium falciparum
NPSFGSYDDSQDTTYQ

SEQ ID NO: 3335860 - protein, 26 aa, Plasmodium falciparum
NPSHSENNFSKNNRDENINEEKSKYQ

SEQ ID NO: 3335861 - protein, 6 aa, Plasmodium falciparum
NPSIDK

SEQ ID NO: 3335862 - protein, 7 aa, Plasmodium falciparum
NPSKHKD

SEQ ID NO: 3335863 - protein, 9 aa, Plasmodium falciparum
NPSLNSNNY

SEQ ID NO: 3335864 - protein, 4 aa, Plasmodium falciparum
NPSN

SEQ ID NO: 3335865 - protein, 9 aa, Plasmodium falciparum
NPSNTRNDN

SEQ ID NO: 3335866 - protein, 9 aa, Plasmodium falciparum
NPSQKKQKI

SEQ ID NO: 3335867 - protein, 13 aa, Plasmodium falciparum
NPSRTSFQESNNT

SEQ ID NO: 3335868 - protein, 8 aa, Plasmodium falciparum
NPSTDKSQ

SEQ ID NO: 3335869 - protein, 21 aa, Plasmodium falciparum
NPSTTHNSLSGSTFGTSSNES

SEQ ID NO: 3335870 - protein, 6 aa, Plasmodium falciparum
NPTDNM

SEQ ID NO: 3335871 - protein, 6 aa, Plasmodium falciparum
NPTEVD

SEQ ID NO: 3335872 - protein, 6 aa, Plasmodium falciparum
NPTFQQ

SEQ ID NO: 3335873 - protein, 6 aa, Plasmodium falciparum
NPTKKR

SEQ ID NO: 3335874 - protein, 22 aa, Plasmodium falciparum
NPTKNKSEQHNVQEKDIRKKTL

SEQ ID NO: 3335875 - protein, 15 aa, Plasmodium falciparum
NPTLSLDNESNNDAS

SEQ ID NO: 3335876 - protein, 10 aa, Plasmodium falciparum
NPTNDLSEEE

SEQ ID NO: 3335877 - protein, 5 aa, Plasmodium falciparum
NPTNK

SEQ ID NO: 3335878 - protein, 5 aa, Plasmodium falciparum
NPTRI

SEQ ID NO: 3335879 - protein, 16 aa, Plasmodium falciparum
NPTSKAYKENASDALD

SEQ ID NO: 3335880 - protein, 5 aa, Plasmodium falciparum
NPTTL

SEQ ID NO: 3335881 - protein, 12 aa, Plasmodium falciparum
NPTTNTSSYKQH

SEQ ID NO: 3335882 - protein, 5 aa, Plasmodium falciparum
NPTYN

SEQ ID NO: 3335883 - protein, 8 aa, Plasmodium falciparum
NPTYNGKK

SEQ ID NO: 3335884 - protein, 6 aa, Plasmodium falciparum
NPTYQN

SEQ ID NO: 3335885 - protein, 7 aa, Plasmodium falciparum
NPVGQHG

SEQ ID NO: 3335886 - protein, 9 aa, Plasmodium falciparum
NPVQKTKGE

SEQ ID NO: 3335887 - protein, 43 aa, Plasmodium falciparum
NPVSNKNKEENCQSRDSSKRRNSVSKSSKNVTRPVDNNKKNVE

SEQ ID NO: 3335888 - protein, 7 aa, Plasmodium falciparum
NPVTTGD

SEQ ID NO: 3335889 - protein, 9 aa, Plasmodium falciparum
NPYADSENP

SEQ ID NO: 3335890 - protein, 6 aa, Plasmodium falciparum
NPYDRK

SEQ ID NO: 3335891 - protein, 5 aa, Plasmodium falciparum
NPYEE

SEQ ID NO: 3335892 - protein, 6 aa, Plasmodium falciparum
NPYETE

SEQ ID NO: 3335893 - protein, 14 aa, Plasmodium falciparum
NPYKYKTQKPSVDN

SEQ ID NO: 3335894 - protein, 14 aa, Plasmodium falciparum
NPYNEQSSKIAENN

SEQ ID NO: 3335895 - protein, 16 aa, Plasmodium falciparum
NPYNNNDEEKQNSDVL

SEQ ID NO: 3335896 - protein, 15 aa, Plasmodium falciparum
NPYNNNNNNNCGSSN

SEQ ID NO: 3335897 - protein, 11 aa, Plasmodium falciparum
NPYNSNPENNI

SEQ ID NO: 3335898 - protein, 6 aa, Plasmodium falciparum
NPYNSS

SEQ ID NO: 3335899 - protein, 4 aa, Plasmodium falciparum
NPYQ

SEQ ID NO: 3335900 - protein, 10 aa, Plasmodium falciparum
NPYTDKRTHS

SEQ ID NO: 3335901 - protein, 11 aa, Plasmodium falciparum
NQAAKNNMTPK

SEQ ID NO: 3335902 - protein, 10 aa, Plasmodium falciparum
NQANNNENKY

SEQ ID NO: 3335903 - protein, 7 aa, Plasmodium falciparum
NQANSTY

SEQ ID NO: 3335904 - protein, 12 aa, Plasmodium falciparum
NQDDDEETKELR

SEQ ID NO: 3335905 - protein, 10 aa, Plasmodium falciparum
NQDEKNKTEN

SEQ ID NO: 3335906 - protein, 11 aa, Plasmodium falciparum
NQDENNNISPL

SEQ ID NO: 3335907 - protein, 4 aa, Plasmodium falciparum
NQDI

SEQ ID NO: 3335908 - protein, 14 aa, Plasmodium falciparum
NQDIENKKEKYETY

SEQ ID NO: 3335909 - protein, 14 aa, Plasmodium falciparum
NQDINNKNKKNINS

SEQ ID NO: 3335910 - protein, 18 aa, Plasmodium falciparum
NQDISTKNYDEKGTYENN

SEQ ID NO: 3335911 - protein, 10 aa, Plasmodium falciparum
NQDKEKKKNT

SEQ ID NO: 3335912 - protein, 11 aa, Plasmodium falciparum
NQDKGKRYDDD

SEQ ID NO: 3335913 - protein, 10 aa, Plasmodium falciparum
NQDKQNNDEY

SEQ ID NO: 3335914 - protein, 10 aa, Plasmodium falciparum
NQDNDDDNII

SEQ ID NO: 3335915 - protein, 28 aa, Plasmodium falciparum
NQDNHNNKDMYPSNNNKNNSYKKKKNVK

SEQ ID NO: 3335916 - protein, 20 aa, Plasmodium falciparum
NQDNIYDQGNIKKNEEEITK

SEQ ID NO: 3335917 - protein, 6 aa, Plasmodium falciparum
NQDNNL

SEQ ID NO: 3335918 - protein, 14 aa, Plasmodium falciparum
NQDSYSTNEEPLSN

SEQ ID NO: 3335919 - protein, 10 aa, Plasmodium falciparum
NQDVSNNNNN

SEQ ID NO: 3335920 - protein, 13 aa, Plasmodium falciparum
NQDYEKNIDQKEK

SEQ ID NO: 3335921 - protein, 14 aa, Plasmodium falciparum
NQEDISKDENGNPA

SEQ ID NO: 3335922 - protein, 4 aa, Plasmodium falciparum
NQEE

SEQ ID NO: 3335923 - protein, 11 aa, Plasmodium falciparum
NQEEQKNITKA

SEQ ID NO: 3335924 - protein, 10 aa, Plasmodium falciparum
NQEEQKRDDM

SEQ ID NO: 3335925 - protein, 14 aa, Plasmodium falciparum
NQEHNQNNDEDDKS

SEQ ID NO: 3335926 - protein, 4 aa, Plasmodium falciparum
NQEI

SEQ ID NO: 3335927 - protein, 27 aa, Plasmodium falciparum
NQEKEKKNELYKKNGNNKNLENGSRPN

SEQ ID NO: 3335928 - protein, 5 aa, Plasmodium falciparum
NQEKI

SEQ ID NO: 3335929 - protein, 11 aa, Plasmodium falciparum
NQEKKKNKKNK

SEQ ID NO: 3335930 - protein, 10 aa, Plasmodium falciparum
NQEKKTNEDE

SEQ ID NO: 3335931 - protein, 5 aa, Plasmodium falciparum
NQEKL

SEQ ID NO: 3335932 - protein, 5 aa, Plasmodium falciparum
NQENA

SEQ ID NO: 3335933 - protein, 5 aa, Plasmodium falciparum
NQEND

SEQ ID NO: 3335934 - protein, 8 aa, Plasmodium falciparum
NQENEEND

SEQ ID NO: 3335935 - protein, 28 aa, Plasmodium falciparum
NQENKETNKNTLDNVSSTNTTENKPAKK

SEQ ID NO: 3335936 - protein, 65 aa, Plasmodium falciparum
NQENKNGEISQGVSQGVSQGVSQGVSQGVSQGVSQGVSQGVSQDVSKDISQDVSQDISQGVSQDI

SEQ ID NO: 3335937 - protein, 10 aa, Plasmodium falciparum
NQENNTIKNN

SEQ ID NO: 3335938 - protein, 21 aa, Plasmodium falciparum
NQENNTKNEITDKKDKDKHTK

SEQ ID NO: 3335939 - protein, 6 aa, Plasmodium falciparum
NQENSV

SEQ ID NO: 3335940 - protein, 7 aa, Plasmodium falciparum
NQENTDL

SEQ ID NO: 3335941 - protein, 11 aa, Plasmodium falciparum
NQENVNTPKDK

SEQ ID NO: 3335942 - protein, 10 aa, Plasmodium falciparum
NQEQLENNSN

SEQ ID NO: 3335943 - protein, 9 aa, Plasmodium falciparum
NQERNSTND

SEQ ID NO: 3335944 - protein, 58 aa, Plasmodium falciparum
NQETITEEKNKNANENSNEIETNKYNKKEELTNNRDGDGDDDDNIKNDKDEKDEKEET

SEQ ID NO: 3335945 - protein, 7 aa, Plasmodium falciparum
NQFEGKP

SEQ ID NO: 3335946 - protein, 19 aa, Plasmodium falciparum
NQFEKKKKKSFEEKKERQK

SEQ ID NO: 3335947 - protein, 5 aa, Plasmodium falciparum
NQFKN

SEQ ID NO: 3335948 - protein, 22 aa, Plasmodium falciparum
NQGESKKEEKKDRYYRRDKDKK

SEQ ID NO: 3335949 - protein, 17 aa, Plasmodium falciparum
NQGGNVDSHEQEQEEIN

SEQ ID NO: 3335950 - protein, 5 aa, Plasmodium falciparum
NQGHT

SEQ ID NO: 3335951 - protein, 15 aa, Plasmodium falciparum
NQGKMEDTKETYEEY

SEQ ID NO: 3335952 - protein, 12 aa, Plasmodium falciparum
NQGNEASNSYNT

SEQ ID NO: 3335953 - protein, 6 aa, Plasmodium falciparum
NQGNEN

SEQ ID NO: 3335954 - protein, 8 aa, Plasmodium falciparum
NQGQPYRN

SEQ ID NO: 3335955 - protein, 4 aa, Plasmodium falciparum
NQGY

SEQ ID NO: 3335956 - protein, 5 aa, Plasmodium falciparum
NQHKY

SEQ ID NO: 3335957 - protein, 6 aa, Plasmodium falciparum
NQHMKS

SEQ ID NO: 3335958 - protein, 8 aa, Plasmodium falciparum
NQHNQGYN

SEQ ID NO: 3335959 - protein, 19 aa, Plasmodium falciparum
NQHNQYRNNNKMDKTKCVN

SEQ ID NO: 3335960 - protein, 5 aa, Plasmodium falciparum
NQHQE

SEQ ID NO: 3335961 - protein, 14 aa, Plasmodium falciparum
NQHQNKDSSEYNEN

SEQ ID NO: 3335962 - protein, 8 aa, Plasmodium falciparum
NQHSDNKN

SEQ ID NO: 3335963 - protein, 9 aa, Plasmodium falciparum
NQHSPKKKI

SEQ ID NO: 3335964 - protein, 10 aa, Plasmodium falciparum
NQHTAALDNT

SEQ ID NO: 3335965 - protein, 23 aa, Plasmodium falciparum
NQIDDDYDGDEDIKQDKENNNMN

SEQ ID NO: 3335966 - protein, 7 aa, Plasmodium falciparum
NQIDEDS

SEQ ID NO: 3335967 - protein, 5 aa, Plasmodium falciparum
NQIDP

SEQ ID NO: 3335968 - protein, 4 aa, Plasmodium falciparum
NQIE

SEQ ID NO: 3335969 - protein, 12 aa, Plasmodium falciparum
NQIKDDENQKEN

SEQ ID NO: 3335970 - protein, 11 aa, Plasmodium falciparum
NQIKQKQDVTV

SEQ ID NO: 3335971 - protein, 11 aa, Plasmodium falciparum
NQINDDNNQIN

SEQ ID NO: 3335972 - protein, 15 aa, Plasmodium falciparum
NQINKNEKNNVDENN

SEQ ID NO: 3335973 - protein, 7 aa, Plasmodium falciparum
NQINKTN

SEQ ID NO: 3335974 - protein, 5 aa, Plasmodium falciparum
NQINN

SEQ ID NO: 3335975 - protein, 6 aa, Plasmodium falciparum
NQINNN

SEQ ID NO: 3335976 - protein, 11 aa, Plasmodium falciparum
NQINNNNNNNI

SEQ ID NO: 3335977 - protein, 39 aa, Plasmodium falciparum
NQIQPNTSQNTASSTSSSVTGKADTNNINNASQNNQNNY

SEQ ID NO: 3335978 - protein, 19 aa, Plasmodium falciparum
NQISDKDDIIDENRKYEES

SEQ ID NO: 3335979 - protein, 5 aa, Plasmodium falciparum
NQITE

SEQ ID NO: 3335980 - protein, 10 aa, Plasmodium falciparum
NQKDENNCHD

SEQ ID NO: 3335981 - protein, 6 aa, Plasmodium falciparum
NQKDFD

SEQ ID NO: 3335982 - protein, 13 aa, Plasmodium falciparum
NQKDGNFFPSNGN

SEQ ID NO: 3335983 - protein, 9 aa, Plasmodium falciparum
NQKDNNVEY

SEQ ID NO: 3335984 - protein, 6 aa, Plasmodium falciparum
NQKDVS

SEQ ID NO: 3335985 - protein, 9 aa, Plasmodium falciparum
NQKEEHDGK

SEQ ID NO: 3335986 - protein, 18 aa, Plasmodium falciparum
NQKEGNQLKSENNNEKGY

SEQ ID NO: 3335987 - protein, 63 aa, Plasmodium falciparum
NQKEKEKKKKKKKKNDDDDDDDDDDDNDNNNNNNNNNNNNNNNNDNNNNNNNDNNNDNNNNYF

SEQ ID NO: 3335988 - protein, 83 aa, Plasmodium falciparum
NQKEKTTQMENDKEKEKEKEKEKEKEKEKEKEKEKEKEKEIEKNNEIEKDKEKEKLDDNKTTPTLNEKESTTQTKDESVSKDE

SEQ ID NO: 3335989 - protein, 5 aa, Plasmodium falciparum
NQKEP

SEQ ID NO: 3335990 - protein, 8 aa, Plasmodium falciparum
NQKEQEGE

SEQ ID NO: 3335991 - protein, 9 aa, Plasmodium falciparum
NQKEQIKNV

SEQ ID NO: 3335992 - protein, 10 aa, Plasmodium falciparum
NQKEVTPKYT

SEQ ID NO: 3335993 - protein, 9 aa, Plasmodium falciparum
NQKGNDNNI

SEQ ID NO: 3335994 - protein, 7 aa, Plasmodium falciparum
NQKIESG

SEQ ID NO: 3335995 - protein, 8 aa, Plasmodium falciparum
NQKKEENV

SEQ ID NO: 3335996 - protein, 6 aa, Plasmodium falciparum
NQKKEN

SEQ ID NO: 3335997 - protein, 21 aa, Plasmodium falciparum
NQKKGTNPNTENDHHNENASI

SEQ ID NO: 3335998 - protein, 59 aa, Plasmodium falciparum
NQKKKNNNDNNNNNDKNNNDNNNNDHNNDNNNDKNNDNNNNDNNNNDNNNDNNNDDNNI

SEQ ID NO: 3335999 - protein, 8 aa, Plasmodium falciparum
NQKKLQKK

SEQ ID NO: 3336000 - protein, 9 aa, Plasmodium falciparum
NQKKNDIDK

SEQ ID NO: 3336001 - protein, 8 aa, Plasmodium falciparum
NQKKNEDL

SEQ ID NO: 3336002 - protein, 25 aa, Plasmodium falciparum
NQKKNKEEQQQKNKPTKKNSSSSSC

SEQ ID NO: 3336003 - protein, 7 aa, Plasmodium falciparum
NQKKQIE

SEQ ID NO: 3336004 - protein, 10 aa, Plasmodium falciparum
NQKKRKDNYK

SEQ ID NO: 3336005 - protein, 24 aa, Plasmodium falciparum
NQKKRNDKMNEKKKKKKEKKKDDY

SEQ ID NO: 3336006 - protein, 5 aa, Plasmodium falciparum
NQKKT

SEQ ID NO: 3336007 - protein, 7 aa, Plasmodium falciparum
NQKNEHT

SEQ ID NO: 3336008 - protein, 16 aa, Plasmodium falciparum
NQKNGNDDKYDNNKME

SEQ ID NO: 3336009 - protein, 6 aa, Plasmodium falciparum
NQKNIP

SEQ ID NO: 3336010 - protein, 7 aa, Plasmodium falciparum
NQKNKRH

SEQ ID NO: 3336011 - protein, 4 aa, Plasmodium falciparum
NQKR

SEQ ID NO: 3336012 - protein, 14 aa, Plasmodium falciparum
NQKSDIKKKTEELN

SEQ ID NO: 3336013 - protein, 9 aa, Plasmodium falciparum
NQKTDKKDL

SEQ ID NO: 3336014 - protein, 6 aa, Plasmodium falciparum
NQKTKN

SEQ ID NO: 3336015 - protein, 5 aa, Plasmodium falciparum
NQKYA

SEQ ID NO: 3336016 - protein, 5 aa, Plasmodium falciparum
NQKYE

SEQ ID NO: 3336017 - protein, 6 aa, Plasmodium falciparum
NQKYEK

SEQ ID NO: 3336018 - protein, 5 aa, Plasmodium falciparum
NQKYS

SEQ ID NO: 3336019 - protein, 9 aa, Plasmodium falciparum
NQKYSNEKY

SEQ ID NO: 3336020 - protein, 11 aa, Plasmodium falciparum
NQLKDQNENLQ

SEQ ID NO: 3336021 - protein, 4 aa, Plasmodium falciparum
NQLN

SEQ ID NO: 3336022 - protein, 5 aa, Plasmodium falciparum
NQLRY

SEQ ID NO: 3336023 - protein, 4 aa, Plasmodium falciparum
NQLS

SEQ ID NO: 3336024 - protein, 29 aa, Plasmodium falciparum
NQLSNKKEKDKERKKKNKDPNVSKNSPFF

SEQ ID NO: 3336025 - protein, 15 aa, Plasmodium falciparum
NQMAGDNQISEGSNQ

SEQ ID NO: 3336026 - protein, 12 aa, Plasmodium falciparum
NQMDSYDSRNYG

SEQ ID NO: 3336027 - protein, 11 aa, Plasmodium falciparum
NQMKNKKEEII

SEQ ID NO: 3336028 - protein, 4 aa, Plasmodium falciparum
NQMN

SEQ ID NO: 3336029 - protein, 24 aa, Plasmodium falciparum
NQMYDDTNKRYDDTNKRYDDTNKM

SEQ ID NO: 3336030 - protein, 19 aa, Plasmodium falciparum
NQMYDDTNKRYDNINQNTY

SEQ ID NO: 3336031 - protein, 13 aa, Plasmodium falciparum
NQNASNQQINQSY

SEQ ID NO: 3336032 - protein, 4 aa, Plasmodium falciparum
NQND

SEQ ID NO: 3336033 - protein, 8 aa, Plasmodium falciparum
NQNDHNNS

SEQ ID NO: 3336034 - protein, 26 aa, Plasmodium falciparum
NQNDHQNDDEKYNQHEVNNNNDDDHH

SEQ ID NO: 3336035 - protein, 8 aa, Plasmodium falciparum
NQNDHTSM

SEQ ID NO: 3336036 - protein, 7 aa, Plasmodium falciparum
NQNDQNT

SEQ ID NO: 3336037 - protein, 31 aa, Plasmodium falciparum
NQNEDHDMEQDTHYDDDDDNNNNNDKYDQKT

SEQ ID NO: 3336038 - protein, 30 aa, Plasmodium falciparum
NQNEEDSSTKKLNSTSKIKRANKGKTKKKN

SEQ ID NO: 3336039 - protein, 6 aa, Plasmodium falciparum
NQNEEE

SEQ ID NO: 3336040 - protein, 5 aa, Plasmodium falciparum
NQNEH

SEQ ID NO: 3336041 - protein, 8 aa, Plasmodium falciparum
NQNENHTN

SEQ ID NO: 3336042 - protein, 13 aa, Plasmodium falciparum
NQNENVVASGNSN

SEQ ID NO: 3336043 - protein, 8 aa, Plasmodium falciparum
NQNEQDTY

SEQ ID NO: 3336044 - protein, 7 aa, Plasmodium falciparum
NQNERYK

SEQ ID NO: 3336045 - protein, 18 aa, Plasmodium falciparum
NQNGDDIKCSKSNKTNNI

SEQ ID NO: 3336046 - protein, 26 aa, Plasmodium falciparum
NQNGEIDETNTIKDEIKDKSKHEEEE

SEQ ID NO: 3336047 - protein, 8 aa, Plasmodium falciparum
NQNGNNFS

SEQ ID NO: 3336048 - protein, 6 aa, Plasmodium falciparum
NQNGTL

SEQ ID NO: 3336049 - protein, 5 aa, Plasmodium falciparum
NQNGV

SEQ ID NO: 3336050 - protein, 6 aa, Plasmodium falciparum
NQNHDN

SEQ ID NO: 3336051 - protein, 4 aa, Plasmodium falciparum
NQNI

SEQ ID NO: 3336052 - protein, 9 aa, Plasmodium falciparum
NQNIKENNT

SEQ ID NO: 3336053 - protein, 9 aa, Plasmodium falciparum
NQNKPNAQL

SEQ ID NO: 3336054 - protein, 5 aa, Plasmodium falciparum
NQNKQ

SEQ ID NO: 3336055 - protein, 6 aa, Plasmodium falciparum
NQNKQY

SEQ ID NO: 3336056 - protein, 6 aa, Plasmodium falciparum
NQNLDE

SEQ ID NO: 3336057 - protein, 5 aa, Plasmodium falciparum
NQNLS

SEQ ID NO: 3336058 - protein, 5 aa, Plasmodium falciparum
NQNND

SEQ ID NO: 3336059 - protein, 40 aa, Plasmodium falciparum
NQNNDHKYQNNTKEEDPKNKKKEQNKEQNKEQNKEQKEIY

SEQ ID NO: 3336060 - protein, 5 aa, Plasmodium falciparum
NQNNF

SEQ ID NO: 3336061 - protein, 6 aa, Plasmodium falciparum
NQNNIN

SEQ ID NO: 3336062 - protein, 6 aa, Plasmodium falciparum
NQNNIS

SEQ ID NO: 3336063 - protein, 16 aa, Plasmodium falciparum
NQNNKEDNHNNKTNSM

SEQ ID NO: 3336064 - protein, 9 aa, Plasmodium falciparum
NQNNKKNNN

SEQ ID NO: 3336065 - protein, 21 aa, Plasmodium falciparum
NQNNLKDKEKEKENGQQHSQE

SEQ ID NO: 3336066 - protein, 5 aa, Plasmodium falciparum
NQNNN

SEQ ID NO: 3336067 - protein, 11 aa, Plasmodium falciparum
NQNNNKYSYTS

SEQ ID NO: 3336068 - protein, 6 aa, Plasmodium falciparum
NQNNNN

SEQ ID NO: 3336069 - protein, 16 aa, Plasmodium falciparum
NQNNNNSINNHNANNY

SEQ ID NO: 3336070 - protein, 10 aa, Plasmodium falciparum
NQNNQNDDAY

SEQ ID NO: 3336071 - protein, 5 aa, Plasmodium falciparum
NQNNR

SEQ ID NO: 3336072 - protein, 8 aa, Plasmodium falciparum
NQNNRNDS

SEQ ID NO: 3336073 - protein, 7 aa, Plasmodium falciparum
NQNNVSD

SEQ ID NO: 3336074 - protein, 6 aa, Plasmodium falciparum
NQNPLN

SEQ ID NO: 3336075 - protein, 10 aa, Plasmodium falciparum
NQNPQTNHDG

SEQ ID NO: 3336076 - protein, 6 aa, Plasmodium falciparum
NQNQNI

SEQ ID NO: 3336077 - protein, 4 aa, Plasmodium falciparum
NQNR

SEQ ID NO: 3336078 - protein, 15 aa, Plasmodium falciparum
NQNRGTSKGRNISKN

SEQ ID NO: 3336079 - protein, 16 aa, Plasmodium falciparum
NQNRLKNKSVKKQQTV

SEQ ID NO: 3336080 - protein, 5 aa, Plasmodium falciparum
NQNSI

SEQ ID NO: 3336081 - protein, 9 aa, Plasmodium falciparum
NQNSINNYT

SEQ ID NO: 3336082 - protein, 8 aa, Plasmodium falciparum
NQNSSSQP

SEQ ID NO: 3336083 - protein, 5 aa, Plasmodium falciparum
NQNST

SEQ ID NO: 3336084 - protein, 7 aa, Plasmodium falciparum
NQNTKHP

SEQ ID NO: 3336085 - protein, 7 aa, Plasmodium falciparum
NQNTNNF

SEQ ID NO: 3336086 - protein, 8 aa, Plasmodium falciparum
NQNTQTLN

SEQ ID NO: 3336087 - protein, 14 aa, Plasmodium falciparum
NQNVNDNEEKKNIY

SEQ ID NO: 3336088 - protein, 17 aa, Plasmodium falciparum
NQNVTTNSSNIYILNDV

SEQ ID NO: 3336089 - protein, 7 aa, Plasmodium falciparum
NQNYDKN

SEQ ID NO: 3336090 - protein, 8 aa, Plasmodium falciparum
NQNYGPYD

SEQ ID NO: 3336091 - protein, 11 aa, Plasmodium falciparum
NQPIGGKKRKN

SEQ ID NO: 3336092 - protein, 5 aa, Plasmodium falciparum
NQPLN

SEQ ID NO: 3336093 - protein, 43 aa, Plasmodium falciparum
NQPNTYDRKQNYKTLRNNKRRNNNRSTKYKKCDDNFNKEESIK

SEQ ID NO: 3336094 - protein, 14 aa, Plasmodium falciparum
NQPSNDKKKKEITD

SEQ ID NO: 3336095 - protein, 4 aa, Plasmodium falciparum
NQPT

SEQ ID NO: 3336096 - protein, 10 aa, Plasmodium falciparum
NQQDDRNAYV

SEQ ID NO: 3336097 - protein, 13 aa, Plasmodium falciparum
NQQDNSNDNSDVN

SEQ ID NO: 3336098 - protein, 15 aa, Plasmodium falciparum
NQQDQSDDDNKIKVD

SEQ ID NO: 3336099 - protein, 7 aa, Plasmodium falciparum
NQQEDIN

SEQ ID NO: 3336100 - protein, 10 aa, Plasmodium falciparum
NQQGNDQQHL

SEQ ID NO: 3336101 - protein, 5 aa, Plasmodium falciparum
NQQHN

SEQ ID NO: 3336102 - protein, 4 aa, Plasmodium falciparum
NQQI

SEQ ID NO: 3336103 - protein, 6 aa, Plasmodium falciparum
NQQKIK

SEQ ID NO: 3336104 - protein, 9 aa, Plasmodium falciparum
NQQKKIPGW

SEQ ID NO: 3336105 - protein, 7 aa, Plasmodium falciparum
NQQMNNN

SEQ ID NO: 3336106 - protein, 4 aa, Plasmodium falciparum
NQQN

SEQ ID NO: 3336107 - protein, 19 aa, Plasmodium falciparum
NQQNEEKNKHTKDNPNSKD

SEQ ID NO: 3336108 - protein, 18 aa, Plasmodium falciparum
NQQNLSDDEKKNIPDIKS

SEQ ID NO: 3336109 - protein, 8 aa, Plasmodium falciparum
NQQNNLEN

SEQ ID NO: 3336110 - protein, 19 aa, Plasmodium falciparum
NQQNQRYQNKKENINDHTN

SEQ ID NO: 3336111 - protein, 6 aa, Plasmodium falciparum
NQQNRN

SEQ ID NO: 3336112 - protein, 8 aa, Plasmodium falciparum
NQQQNISN

SEQ ID NO: 3336113 - protein, 16 aa, Plasmodium falciparum
NQQQTEEAAEELEEDE

SEQ ID NO: 3336114 - protein, 7 aa, Plasmodium falciparum
NQQSKHH

SEQ ID NO: 3336115 - protein, 7 aa, Plasmodium falciparum
NQQTDIN

SEQ ID NO: 3336116 - protein, 4 aa, Plasmodium falciparum
NQRI

SEQ ID NO: 3336117 - protein, 4 aa, Plasmodium falciparum
NQRM

SEQ ID NO: 3336118 - protein, 10 aa, Plasmodium falciparum
NQRNKDSSNN

SEQ ID NO: 3336119 - protein, 6 aa, Plasmodium falciparum
NQRTSV

SEQ ID NO: 3336120 - protein, 5 aa, Plasmodium falciparum
NQSDE

SEQ ID NO: 3336121 - protein, 5 aa, Plasmodium falciparum
NQSDG

SEQ ID NO: 3336122 - protein, 14 aa, Plasmodium falciparum
NQSDKRVSNKGNSY

SEQ ID NO: 3336123 - protein, 10 aa, Plasmodium falciparum
NQSDNEDNNI

SEQ ID NO: 3336124 - protein, 12 aa, Plasmodium falciparum
NQSEDEEHEIMV

SEQ ID NO: 3336125 - protein, 12 aa, Plasmodium falciparum
NQSEQKMYKSRC

SEQ ID NO: 3336126 - protein, 4 aa, Plasmodium falciparum
NQSI

SEQ ID NO: 3336127 - protein, 13 aa, Plasmodium falciparum
NQSKNDPQATSYK

SEQ ID NO: 3336128 - protein, 26 aa, Plasmodium falciparum
NQSKNNNTINNNVNNNNTINNNVNNT

SEQ ID NO: 3336129 - protein, 8 aa, Plasmodium falciparum
NQSNAGSQ

SEQ ID NO: 3336130 - protein, 5 aa, Plasmodium falciparum
NQSNE

SEQ ID NO: 3336131 - protein, 19 aa, Plasmodium falciparum
NQSNKNKTLKNRHNNNNNN

SEQ ID NO: 3336132 - protein, 10 aa, Plasmodium falciparum
NQSNNNNSNI

SEQ ID NO: 3336133 - protein, 5 aa, Plasmodium falciparum
NQSNQ

SEQ ID NO: 3336134 - protein, 8 aa, Plasmodium falciparum
NQSPQNSH

SEQ ID NO: 3336135 - protein, 15 aa, Plasmodium falciparum
NQSPRTEEKKIGTKK

SEQ ID NO: 3336136 - protein, 10 aa, Plasmodium falciparum
NQSRNQETNH

SEQ ID NO: 3336137 - protein, 9 aa, Plasmodium falciparum
NQSSMNTSV

SEQ ID NO: 3336138 - protein, 13 aa, Plasmodium falciparum
NQSTKKKKKKKIK

SEQ ID NO: 3336139 - protein, 5 aa, Plasmodium falciparum
NQSYN

SEQ ID NO: 3336140 - protein, 17 aa, Plasmodium falciparum
NQTAETEEYNEKEKDIS

SEQ ID NO: 3336141 - protein, 16 aa, Plasmodium falciparum
NQTEENINNSEYTNKK

SEQ ID NO: 3336142 - protein, 18 aa, Plasmodium falciparum
NQTEENQVQNKNRERDNI

SEQ ID NO: 3336143 - protein, 7 aa, Plasmodium falciparum
NQTGPKH

SEQ ID NO: 3336144 - protein, 14 aa, Plasmodium falciparum
NQTHNELSNETKNN

SEQ ID NO: 3336145 - protein, 7 aa, Plasmodium falciparum
NQTHTEN

SEQ ID NO: 3336146 - protein, 6 aa, Plasmodium falciparum
NQTIDG

SEQ ID NO: 3336147 - protein, 5 aa, Plasmodium falciparum
NQTIR

SEQ ID NO: 3336148 - protein, 17 aa, Plasmodium falciparum
NQTKDYKEKKRVSDASD

SEQ ID NO: 3336149 - protein, 11 aa, Plasmodium falciparum
NQTKSKHIEKA

SEQ ID NO: 3336150 - protein, 7 aa, Plasmodium falciparum
NQTKTND

SEQ ID NO: 3336151 - protein, 5 aa, Plasmodium falciparum
NQTLN

SEQ ID NO: 3336152 - protein, 9 aa, Plasmodium falciparum
NQTNNDLNN

SEQ ID NO: 3336153 - protein, 13 aa, Plasmodium falciparum
NQTNQSDNLKELG

SEQ ID NO: 3336154 - protein, 11 aa, Plasmodium falciparum
NQTNSETTLSG

SEQ ID NO: 3336155 - protein, 13 aa, Plasmodium falciparum
NQTNYKNDNNYSS

SEQ ID NO: 3336156 - protein, 15 aa, Plasmodium falciparum
NQTQDNEEERKNSQF

SEQ ID NO: 3336157 - protein, 6 aa, Plasmodium falciparum
NQTTKL

SEQ ID NO: 3336158 - protein, 119 aa, Plasmodium falciparum
NQVDEQEKKKKLNKKNKNKNKNDEGDISDHHKEDNHSETDNNDSEKKESNTEDDNIDSEQNSSINMNNSNDDSQNSSNSESNNNDDNDSNNSNEKKKGKKENNNLKEKKNKSKNKNKKK

SEQ ID NO: 3336159 - protein, 13 aa, Plasmodium falciparum
NQVSGAGLASEED

SEQ ID NO: 3336160 - protein, 10 aa, Plasmodium falciparum
NQYEGQPKYQ

SEQ ID NO: 3336161 - protein, 17 aa, Plasmodium falciparum
NQYESKGYKKKTSSRKR

SEQ ID NO: 3336162 - protein, 13 aa, Plasmodium falciparum
NQYKNKNENYQNK

SEQ ID NO: 3336163 - protein, 4 aa, Plasmodium falciparum
NQYN

SEQ ID NO: 3336164 - protein, 5 aa, Plasmodium falciparum
NQYNR

SEQ ID NO: 3336165 - protein, 5 aa, Plasmodium falciparum
NQYPS

SEQ ID NO: 3336166 - protein, 7 aa, Plasmodium falciparum
NQYTDEG

SEQ ID NO: 3336167 - protein, 6 aa, Plasmodium falciparum
NQYTES

SEQ ID NO: 3336168 - protein, 8 aa, Plasmodium falciparum
NQYTNNNS

SEQ ID NO: 3336169 - protein, 15 aa, Plasmodium falciparum
NRADIKRKGNFDEEN

SEQ ID NO: 3336170 - protein, 5 aa, Plasmodium falciparum
NRAKN

SEQ ID NO: 3336171 - protein, 5 aa, Plasmodium falciparum
NRAPS

SEQ ID NO: 3336172 - protein, 6 aa, Plasmodium falciparum
NRCDEK

SEQ ID NO: 3336173 - protein, 9 aa, Plasmodium falciparum
NRCDNTCDN

SEQ ID NO: 3336174 - protein, 8 aa, Plasmodium falciparum
NRCEDNKK

SEQ ID NO: 3336175 - protein, 4 aa, Plasmodium falciparum
NRDF

SEQ ID NO: 3336176 - protein, 4 aa, Plasmodium falciparum
NRDG

SEQ ID NO: 3336177 - protein, 4 aa, Plasmodium falciparum
NRDI

SEQ ID NO: 3336178 - protein, 6 aa, Plasmodium falciparum
NRDKNK

SEQ ID NO: 3336179 - protein, 6 aa, Plasmodium falciparum
NRDKSY

SEQ ID NO: 3336180 - protein, 9 aa, Plasmodium falciparum
NRDKTNDQV

SEQ ID NO: 3336181 - protein, 5 aa, Plasmodium falciparum
NRDLK

SEQ ID NO: 3336182 - protein, 24 aa, Plasmodium falciparum
NRDNKDKSKYKNIYSSSSSGNNVV

SEQ ID NO: 3336183 - protein, 18 aa, Plasmodium falciparum
NRDNNNNNELPNNQNTNQ

SEQ ID NO: 3336184 - protein, 71 aa, Plasmodium falciparum
NRDSTYDTNYDNNKNDDNNKNNHDNNKNNHDNNKNNHDNNKNGDNNKNDHDNNKNGDNNNYDDNKMDQGHD

SEQ ID NO: 3336185 - protein, 10 aa, Plasmodium falciparum
NRDTSSAKNL

SEQ ID NO: 3336186 - protein, 15 aa, Plasmodium falciparum
NRDVDGDDYGDGHTN

SEQ ID NO: 3336187 - protein, 5 aa, Plasmodium falciparum
NRDYY

SEQ ID NO: 3336188 - protein, 15 aa, Plasmodium falciparum
NREEEKKRKKREKEL

SEQ ID NO: 3336189 - protein, 14 aa, Plasmodium falciparum
NREELKKENYSKST

SEQ ID NO: 3336190 - protein, 9 aa, Plasmodium falciparum
NREGNDENM

SEQ ID NO: 3336191 - protein, 7 aa, Plasmodium falciparum
NREGYEL

SEQ ID NO: 3336192 - protein, 4 aa, Plasmodium falciparum
NREI

SEQ ID NO: 3336193 - protein, 9 aa, Plasmodium falciparum
NREKDENNY

SEQ ID NO: 3336194 - protein, 11 aa, Plasmodium falciparum
NREKKNKDHHD

SEQ ID NO: 3336195 - protein, 6 aa, Plasmodium falciparum
NREKKV

SEQ ID NO: 3336196 - protein, 13 aa, Plasmodium falciparum
NRENVESRTPNEG

SEQ ID NO: 3336197 - protein, 34 aa, Plasmodium falciparum
NREPRSNVENETNEMSNSYGKFTKNRDLKNSDKI

SEQ ID NO: 3336198 - protein, 8 aa, Plasmodium falciparum
NRERRRKL

SEQ ID NO: 3336199 - protein, 4 aa, Plasmodium falciparum
NRES

SEQ ID NO: 3336200 - protein, 8 aa, Plasmodium falciparum
NRESAKQE

SEQ ID NO: 3336201 - protein, 8 aa, Plasmodium falciparum
NRFRSQSK

SEQ ID NO: 3336202 - protein, 11 aa, Plasmodium falciparum
NRFSNESEAEC

SEQ ID NO: 3336203 - protein, 12 aa, Plasmodium falciparum
NRGEEYTKNEEI

SEQ ID NO: 3336204 - protein, 12 aa, Plasmodium falciparum
NRGGGGGGEKEV

SEQ ID NO: 3336205 - protein, 7 aa, Plasmodium falciparum
NRGNNFT

SEQ ID NO: 3336206 - protein, 8 aa, Plasmodium falciparum
NRGQNGIS

SEQ ID NO: 3336207 - protein, 4 aa, Plasmodium falciparum
NRGS

SEQ ID NO: 3336208 - protein, 18 aa, Plasmodium falciparum
NRGSNNIQSYDDRNQNKQ

SEQ ID NO: 3336209 - protein, 12 aa, Plasmodium falciparum
NRGYGKDGDLTS

SEQ ID NO: 3336210 - protein, 17 aa, Plasmodium falciparum
NRHNSNEASTNRQPFPQ

SEQ ID NO: 3336211 - protein, 21 aa, Plasmodium falciparum
NRHRENNYEGHRNEEHRREAY

SEQ ID NO: 3336212 - protein, 24 aa, Plasmodium falciparum
NRIKEKEKKKDDNDDEKKKEKELN

SEQ ID NO: 3336213 - protein, 5 aa, Plasmodium falciparum
NRIKH

SEQ ID NO: 3336214 - protein, 14 aa, Plasmodium falciparum
NRINENNVKSPHYY

SEQ ID NO: 3336215 - protein, 4 aa, Plasmodium falciparum
NRKD

SEQ ID NO: 3336216 - protein, 9 aa, Plasmodium falciparum
NRKDDKSKI

SEQ ID NO: 3336217 - protein, 11 aa, Plasmodium falciparum
NRKDGKIKKKE

SEQ ID NO: 3336218 - protein, 7 aa, Plasmodium falciparum
NRKDSNI

SEQ ID NO: 3336219 - protein, 4 aa, Plasmodium falciparum
NRKE

SEQ ID NO: 3336220 - protein, 26 aa, Plasmodium falciparum
NRKEKKNFEETNQKGEKDKSELYTKD

SEQ ID NO: 3336221 - protein, 7 aa, Plasmodium falciparum
NRKENDE

SEQ ID NO: 3336222 - protein, 9 aa, Plasmodium falciparum
NRKETISNE

SEQ ID NO: 3336223 - protein, 25 aa, Plasmodium falciparum
NRKGKNNEYDNYHNNNDEMTRKEIS

SEQ ID NO: 3336224 - protein, 6 aa, Plasmodium falciparum
NRKGSF

SEQ ID NO: 3336225 - protein, 8 aa, Plasmodium falciparum
NRKGSNSL

SEQ ID NO: 3336226 - protein, 10 aa, Plasmodium falciparum
NRKHDGHGPE

SEQ ID NO: 3336227 - protein, 17 aa, Plasmodium falciparum
NRKITTKEKKIKEPKQT

SEQ ID NO: 3336228 - protein, 32 aa, Plasmodium falciparum
NRKKKKKKKYSDKKGKNILSSKNRKNQEKNIK

SEQ ID NO: 3336229 - protein, 7 aa, Plasmodium falciparum
NRKKNNM

SEQ ID NO: 3336230 - protein, 5 aa, Plasmodium falciparum
NRKKS

SEQ ID NO: 3336231 - protein, 10 aa, Plasmodium falciparum
NRKKSKKRMK

SEQ ID NO: 3336232 - protein, 8 aa, Plasmodium falciparum
NRKKSSYE

SEQ ID NO: 3336233 - protein, 41 aa, Plasmodium falciparum
NRKKTEDIKDGEDKEKQEEEEKKTNEENTKKENDNSNDSSL

SEQ ID NO: 3336234 - protein, 6 aa, Plasmodium falciparum
NRKNEI

SEQ ID NO: 3336235 - protein, 8 aa, Plasmodium falciparum
NRKNIEEQ

SEQ ID NO: 3336236 - protein, 24 aa, Plasmodium falciparum
NRKNNKNKTKNNANNNKSECINDG

SEQ ID NO: 3336237 - protein, 10 aa, Plasmodium falciparum
NRKNSMNNNM

SEQ ID NO: 3336238 - protein, 17 aa, Plasmodium falciparum
NRKNTSINNDKNNYTNE

SEQ ID NO: 3336239 - protein, 8 aa, Plasmodium falciparum
NRKNVENR

SEQ ID NO: 3336240 - protein, 13 aa, Plasmodium falciparum
NRKQDISSSNNLS

SEQ ID NO: 3336241 - protein, 8 aa, Plasmodium falciparum
NRKRCNND

SEQ ID NO: 3336242 - protein, 6 aa, Plasmodium falciparum
NRKREI

SEQ ID NO: 3336243 - protein, 13 aa, Plasmodium falciparum
NRKRKNKIKSSYK

SEQ ID NO: 3336244 - protein, 4 aa, Plasmodium falciparum
NRKY

SEQ ID NO: 3336245 - protein, 21 aa, Plasmodium falciparum
NRLENNNYNNNNNNNNSISGE

SEQ ID NO: 3336246 - protein, 16 aa, Plasmodium falciparum
NRLNKKTDHIEQADVN

SEQ ID NO: 3336247 - protein, 9 aa, Plasmodium falciparum
NRMNEQEKH

SEQ ID NO: 3336248 - protein, 30 aa, Plasmodium falciparum
NRNDDNHNSDNNKKKKEINNNNDNNNNNNV

SEQ ID NO: 3336249 - protein, 14 aa, Plasmodium falciparum
NRNDEKGWEQNENV

SEQ ID NO: 3336250 - protein, 6 aa, Plasmodium falciparum
NRNDLN

SEQ ID NO: 3336251 - protein, 19 aa, Plasmodium falciparum
NRNDPPDNKENKSKCVDDD

SEQ ID NO: 3336252 - protein, 15 aa, Plasmodium falciparum
NRNDQNNDCKENYTN

SEQ ID NO: 3336253 - protein, 19 aa, Plasmodium falciparum
NRNDSSQNNSINKEKNENY

SEQ ID NO: 3336254 - protein, 4 aa, Plasmodium falciparum
NRNE

SEQ ID NO: 3336255 - protein, 7 aa, Plasmodium falciparum
NRNEDKL

SEQ ID NO: 3336256 - protein, 6 aa, Plasmodium falciparum
NRNEEI

SEQ ID NO: 3336257 - protein, 6 aa, Plasmodium falciparum
NRNEKW

SEQ ID NO: 3336258 - protein, 7 aa, Plasmodium falciparum
NRNENND

SEQ ID NO: 3336259 - protein, 8 aa, Plasmodium falciparum
NRNEPNYD

SEQ ID NO: 3336260 - protein, 8 aa, Plasmodium falciparum
NRNERYNN

SEQ ID NO: 3336261 - protein, 6 aa, Plasmodium falciparum
NRNFNE

SEQ ID NO: 3336262 - protein, 7 aa, Plasmodium falciparum
NRNHNDS

SEQ ID NO: 3336263 - protein, 22 aa, Plasmodium falciparum
NRNHSNNSQKRSRNNNQINENP

SEQ ID NO: 3336264 - protein, 8 aa, Plasmodium falciparum
NRNKGTQK

SEQ ID NO: 3336265 - protein, 5 aa, Plasmodium falciparum
NRNKK

SEQ ID NO: 3336266 - protein, 9 aa, Plasmodium falciparum
NRNKKNESC

SEQ ID NO: 3336267 - protein, 11 aa, Plasmodium falciparum
NRNKRRQKRGL

SEQ ID NO: 3336268 - protein, 11 aa, Plasmodium falciparum
NRNKSCNSKYV

SEQ ID NO: 3336269 - protein, 22 aa, Plasmodium falciparum
NRNKSSVKSYRGNGSNKMGRKS

SEQ ID NO: 3336270 - protein, 15 aa, Plasmodium falciparum
NRNKYNNKEKKRKRL

SEQ ID NO: 3336271 - protein, 6 aa, Plasmodium falciparum
NRNLNN

SEQ ID NO: 3336272 - protein, 56 aa, Plasmodium falciparum
NRNMDEKIETNNNNDNHSDNHSDNHNDNHSDNHNDNHSDNHNDNHSDNHNGNHNND

SEQ ID NO: 3336273 - protein, 6 aa, Plasmodium falciparum
NRNNDL

SEQ ID NO: 3336274 - protein, 10 aa, Plasmodium falciparum
NRNNEENGVD

SEQ ID NO: 3336275 - protein, 7 aa, Plasmodium falciparum
NRNNENV

SEQ ID NO: 3336276 - protein, 12 aa, Plasmodium falciparum
NRNNGDEVNNSD

SEQ ID NO: 3336277 - protein, 13 aa, Plasmodium falciparum
NRNNKNVKKKNDI

SEQ ID NO: 3336278 - protein, 5 aa, Plasmodium falciparum
NRNNL

SEQ ID NO: 3336279 - protein, 8 aa, Plasmodium falciparum
NRNNLSNA

SEQ ID NO: 3336280 - protein, 8 aa, Plasmodium falciparum
NRNNNQNF

SEQ ID NO: 3336281 - protein, 13 aa, Plasmodium falciparum
NRNNNYSDEESTY

SEQ ID NO: 3336282 - protein, 7 aa, Plasmodium falciparum
NRNNSIE

SEQ ID NO: 3336283 - protein, 11 aa, Plasmodium falciparum
NRNNTDDNYPD

SEQ ID NO: 3336284 - protein, 19 aa, Plasmodium falciparum
NRNNVSELPNTNNKSHNNM

SEQ ID NO: 3336285 - protein, 8 aa, Plasmodium falciparum
NRNNYNST

SEQ ID NO: 3336286 - protein, 6 aa, Plasmodium falciparum
NRNQGK

SEQ ID NO: 3336287 - protein, 8 aa, Plasmodium falciparum
NRNRASGD

SEQ ID NO: 3336288 - protein, 5 aa, Plasmodium falciparum
NRNRR

SEQ ID NO: 3336289 - protein, 7 aa, Plasmodium falciparum
NRNRVNS

SEQ ID NO: 3336290 - protein, 18 aa, Plasmodium falciparum
NRNSEKNNNVNNDMNNDI

SEQ ID NO: 3336291 - protein, 8 aa, Plasmodium falciparum
NRNSNGTN

SEQ ID NO: 3336292 - protein, 18 aa, Plasmodium falciparum
NRNTKNSNNNNYNNNNSN

SEQ ID NO: 3336293 - protein, 10 aa, Plasmodium falciparum
NRNVSNEQHG

SEQ ID NO: 3336294 - protein, 36 aa, Plasmodium falciparum
NRNYNTAKDNNKEKNKLKYESNKKTEMDDRRNSVGV

SEQ ID NO: 3336295 - protein, 9 aa, Plasmodium falciparum
NRNYTKEEI

SEQ ID NO: 3336296 - protein, 5 aa, Plasmodium falciparum
NRPDG

SEQ ID NO: 3336297 - protein, 5 aa, Plasmodium falciparum
NRPDI

SEQ ID NO: 3336298 - protein, 5 aa, Plasmodium falciparum
NRPDL

SEQ ID NO: 3336299 - protein, 5 aa, Plasmodium falciparum
NRPDM

SEQ ID NO: 3336300 - protein, 7 aa, Plasmodium falciparum
NRPDTLD

SEQ ID NO: 3336301 - protein, 5 aa, Plasmodium falciparum
NRPEL

SEQ ID NO: 3336302 - protein, 12 aa, Plasmodium falciparum
NRPHRKRKEKKK

SEQ ID NO: 3336303 - protein, 15 aa, Plasmodium falciparum
NRQDNNGDNKENHKN

SEQ ID NO: 3336304 - protein, 25 aa, Plasmodium falciparum
NRQEDQSSIYSSRNNHLNNSNNNDN

SEQ ID NO: 3336305 - protein, 7 aa, Plasmodium falciparum
NRQHSQS

SEQ ID NO: 3336306 - protein, 42 aa, Plasmodium falciparum
NRQKKKKRGRGDKCSGKGIRDKHKHRKSGRPNSRTFESGRTP

SEQ ID NO: 3336307 - protein, 10 aa, Plasmodium falciparum
NRQKQGKGND

SEQ ID NO: 3336308 - protein, 8 aa, Plasmodium falciparum
NRQNEKYE

SEQ ID NO: 3336309 - protein, 6 aa, Plasmodium falciparum
NRQNSE

SEQ ID NO: 3336310 - protein, 8 aa, Plasmodium falciparum
NRQNSIDP

SEQ ID NO: 3336311 - protein, 5 aa, Plasmodium falciparum
NRQQN

SEQ ID NO: 3336312 - protein, 7 aa, Plasmodium falciparum
NRREKAK

SEQ ID NO: 3336313 - protein, 7 aa, Plasmodium falciparum
NRRGRDD

SEQ ID NO: 3336314 - protein, 11 aa, Plasmodium falciparum
NRRKKSESISN

SEQ ID NO: 3336315 - protein, 7 aa, Plasmodium falciparum
NRRKSNA

SEQ ID NO: 3336316 - protein, 5 aa, Plasmodium falciparum
NRRNF

SEQ ID NO: 3336317 - protein, 7 aa, Plasmodium falciparum
NRRTKSA

SEQ ID NO: 3336318 - protein, 9 aa, Plasmodium falciparum
NRSDLDNEI

SEQ ID NO: 3336319 - protein, 5 aa, Plasmodium falciparum
NRSFG

SEQ ID NO: 3336320 - protein, 5 aa, Plasmodium falciparum
NRSIN

SEQ ID NO: 3336321 - protein, 6 aa, Plasmodium falciparum
NRSKKK

SEQ ID NO: 3336322 - protein, 10 aa, Plasmodium falciparum
NRSKSSSYIK

SEQ ID NO: 3336323 - protein, 4 aa, Plasmodium falciparum
NRSM

SEQ ID NO: 3336324 - protein, 16 aa, Plasmodium falciparum
NRSNNGNYYNQNNNVE

SEQ ID NO: 3336325 - protein, 10 aa, Plasmodium falciparum
NRSNTTVSNV

SEQ ID NO: 3336326 - protein, 7 aa, Plasmodium falciparum
NRSPELI

SEQ ID NO: 3336327 - protein, 5 aa, Plasmodium falciparum
NRSPG

SEQ ID NO: 3336328 - protein, 4 aa, Plasmodium falciparum
NRSR

SEQ ID NO: 3336329 - protein, 16 aa, Plasmodium falciparum
NRSRNSKNSSLLNYLD

SEQ ID NO: 3336330 - protein, 8 aa, Plasmodium falciparum
NRSSDEYI

SEQ ID NO: 3336331 - protein, 72 aa, Plasmodium falciparum
NRSSKNKYDENDFNNHKKDKGDDEEYEDDDEENDDGYDEDGGGSYKYNNNNSKDDNTFNKKNYHSSGNVNNT

SEQ ID NO: 3336332 - protein, 6 aa, Plasmodium falciparum
NRSTNN

SEQ ID NO: 3336333 - protein, 7 aa, Plasmodium falciparum
NRSYSNY

SEQ ID NO: 3336334 - protein, 9 aa, Plasmodium falciparum
NRTDKPGDI

SEQ ID NO: 3336335 - protein, 8 aa, Plasmodium falciparum
NRTDVYNP

SEQ ID NO: 3336336 - protein, 9 aa, Plasmodium falciparum
NRTIDDNNK

SEQ ID NO: 3336337 - protein, 6 aa, Plasmodium falciparum
NRTKEH

SEQ ID NO: 3336338 - protein, 9 aa, Plasmodium falciparum
NRTQGETTF

SEQ ID NO: 3336339 - protein, 4 aa, Plasmodium falciparum
NRTS

SEQ ID NO: 3336340 - protein, 7 aa, Plasmodium falciparum
NRTSNNH

SEQ ID NO: 3336341 - protein, 15 aa, Plasmodium falciparum
NRTSNNKKNKSNNKI

SEQ ID NO: 3336342 - protein, 9 aa, Plasmodium falciparum
NRTTKENND

SEQ ID NO: 3336343 - protein, 4 aa, Plasmodium falciparum
NRTV

SEQ ID NO: 3336344 - protein, 6 aa, Plasmodium falciparum
NRTYNE

SEQ ID NO: 3336345 - protein, 7 aa, Plasmodium falciparum
NRYDDYT

SEQ ID NO: 3336346 - protein, 5 aa, Plasmodium falciparum
NRYKD

SEQ ID NO: 3336347 - protein, 6 aa, Plasmodium falciparum
NRYNDS

SEQ ID NO: 3336348 - protein, 17 aa, Plasmodium falciparum
NRYNNNKRNIRNTNDGL

SEQ ID NO: 3336349 - protein, 11 aa, Plasmodium falciparum
NRYRNDMDPLG

SEQ ID NO: 3336350 - protein, 10 aa, Plasmodium falciparum
NRYSTTKPLN

SEQ ID NO: 3336351 - protein, 6 aa, Plasmodium falciparum
NRYTTY

SEQ ID NO: 3336352 - protein, 28 aa, Plasmodium falciparum
NSAATTTGTISTSYNGMTTNNMNNKNSN

SEQ ID NO: 3336353 - protein, 4 aa, Plasmodium falciparum
NSAG

SEQ ID NO: 3336354 - protein, 5 aa, Plasmodium falciparum
NSAGT

SEQ ID NO: 3336355 - protein, 6 aa, Plasmodium falciparum
NSANNI

SEQ ID NO: 3336356 - protein, 8 aa, Plasmodium falciparum
NSANTIDQ

SEQ ID NO: 3336357 - protein, 8 aa, Plasmodium falciparum
NSASAIRK

SEQ ID NO: 3336358 - protein, 13 aa, Plasmodium falciparum
NSASSQSGHKTPI

SEQ ID NO: 3336359 - protein, 7 aa, Plasmodium falciparum
NSCANTY

SEQ ID NO: 3336360 - protein, 28 aa, Plasmodium falciparum
NSCDDKKNQVNSNEKNIKNNSKQHLNNE

SEQ ID NO: 3336361 - protein, 11 aa, Plasmodium falciparum
NSCDNTQNKET

SEQ ID NO: 3336362 - protein, 6 aa, Plasmodium falciparum
NSCEGI

SEQ ID NO: 3336363 - protein, 4 aa, Plasmodium falciparum
NSCK

SEQ ID NO: 3336364 - protein, 9 aa, Plasmodium falciparum
NSCNDHNKV

SEQ ID NO: 3336365 - protein, 13 aa, Plasmodium falciparum
NSCNTLKSESRND

SEQ ID NO: 3336366 - protein, 4 aa, Plasmodium falciparum
NSCP

SEQ ID NO: 3336367 - protein, 7 aa, Plasmodium falciparum
NSCSYEE

SEQ ID NO: 3336368 - protein, 8 aa, Plasmodium falciparum
NSCTNNDD

SEQ ID NO: 3336369 - protein, 7 aa, Plasmodium falciparum
NSCTSSN

SEQ ID NO: 3336370 - protein, 25 aa, Plasmodium falciparum
NSDAGQDSENEFSPTKRTRAPRGRR

SEQ ID NO: 3336371 - protein, 8 aa, Plasmodium falciparum
NSDAKKNK

SEQ ID NO: 3336372 - protein, 4 aa, Plasmodium falciparum
NSDD

SEQ ID NO: 3336373 - protein, 9 aa, Plasmodium falciparum
NSDDCNETA

SEQ ID NO: 3336374 - protein, 6 aa, Plasmodium falciparum
NSDDHN

SEQ ID NO: 3336375 - protein, 10 aa, Plasmodium falciparum
NSDDKKEGNI

SEQ ID NO: 3336376 - protein, 12 aa, Plasmodium falciparum
NSDDNKNNVSKN

SEQ ID NO: 3336377 - protein, 17 aa, Plasmodium falciparum
NSDDNYNSEDNEYNNGN

SEQ ID NO: 3336378 - protein, 27 aa, Plasmodium falciparum
NSDDSNNTPYLNGQEKNEETEEGNDLK

SEQ ID NO: 3336379 - protein, 9 aa, Plasmodium falciparum
NSDDTKNNI

SEQ ID NO: 3336380 - protein, 5 aa, Plasmodium falciparum
NSDDY

SEQ ID NO: 3336381 - protein, 4 aa, Plasmodium falciparum
NSDE

SEQ ID NO: 3336382 - protein, 10 aa, Plasmodium falciparum
NSDECDGEKN

SEQ ID NO: 3336383 - protein, 9 aa, Plasmodium falciparum
NSDEENDSY

SEQ ID NO: 3336384 - protein, 7 aa, Plasmodium falciparum
NSDELNK

SEQ ID NO: 3336385 - protein, 11 aa, Plasmodium falciparum
NSDENKKKLHD

SEQ ID NO: 3336386 - protein, 7 aa, Plasmodium falciparum
NSDEQRY

SEQ ID NO: 3336387 - protein, 5 aa, Plasmodium falciparum
NSDEW

SEQ ID NO: 3336388 - protein, 5 aa, Plasmodium falciparum
NSDFN

SEQ ID NO: 3336389 - protein, 16 aa, Plasmodium falciparum
NSDGDLYEKSQKSLKQ

SEQ ID NO: 3336390 - protein, 56 aa, Plasmodium falciparum
NSDGDNSGDDNSDGDGSDDDDSDGDGSDDDDSDDDNSDDDNSDDDDSDDDNKNVKI

SEQ ID NO: 3336391 - protein, 10 aa, Plasmodium falciparum
NSDGKEDTTD

SEQ ID NO: 3336392 - protein, 4 aa, Plasmodium falciparum
NSDI

SEQ ID NO: 3336393 - protein, 11 aa, Plasmodium falciparum
NSDIKKGTIEK

SEQ ID NO: 3336394 - protein, 13 aa, Plasmodium falciparum
NSDISNKKFPPKL

SEQ ID NO: 3336395 - protein, 10 aa, Plasmodium falciparum
NSDKIKSSHI

SEQ ID NO: 3336396 - protein, 14 aa, Plasmodium falciparum
NSDKNENDKKYRSL

SEQ ID NO: 3336397 - protein, 6 aa, Plasmodium falciparum
NSDKPI

SEQ ID NO: 3336398 - protein, 13 aa, Plasmodium falciparum
NSDKPNLNGKKSV

SEQ ID NO: 3336399 - protein, 4 aa, Plasmodium falciparum
NSDL

SEQ ID NO: 3336400 - protein, 5 aa, Plasmodium falciparum
NSDNE

SEQ ID NO: 3336401 - protein, 31 aa, Plasmodium falciparum
NSDNEDNKLKNNNNEKKKKEKVEDEKQSNDI

SEQ ID NO: 3336402 - protein, 19 aa, Plasmodium falciparum
NSDNGNGGTFEKKQNKINK

SEQ ID NO: 3336403 - protein, 6 aa, Plasmodium falciparum
NSDNKL

SEQ ID NO: 3336404 - protein, 10 aa, Plasmodium falciparum
NSDNKNKISH

SEQ ID NO: 3336405 - protein, 5 aa, Plasmodium falciparum
NSDNN

SEQ ID NO: 3336406 - protein, 22 aa, Plasmodium falciparum
NSDNNKCKMESNSENNKGAEKI

SEQ ID NO: 3336407 - protein, 20 aa, Plasmodium falciparum
NSDNNKSNKKTNGLSPKKNT

SEQ ID NO: 3336408 - protein, 10 aa, Plasmodium falciparum
NSDNNSENVY

SEQ ID NO: 3336409 - protein, 11 aa, Plasmodium falciparum
NSDNPNNSNNS

SEQ ID NO: 3336410 - protein, 31 aa, Plasmodium falciparum
NSDNSAHSKKIKGAPSRFSNTNNGRKKRRRR

SEQ ID NO: 3336411 - protein, 21 aa, Plasmodium falciparum
NSDNSKDRKDTNEDTVMEDST

SEQ ID NO: 3336412 - protein, 7 aa, Plasmodium falciparum
NSDNTYK

SEQ ID NO: 3336413 - protein, 6 aa, Plasmodium falciparum
NSDNYK

SEQ ID NO: 3336414 - protein, 13 aa, Plasmodium falciparum
NSDPNKEKKNDDI

SEQ ID NO: 3336415 - protein, 10 aa, Plasmodium falciparum
NSDQSQGRQR

SEQ ID NO: 3336416 - protein, 13 aa, Plasmodium falciparum
NSDRNKRNSSITV

SEQ ID NO: 3336417 - protein, 8 aa, Plasmodium falciparum
NSDSEEKP

SEQ ID NO: 3336418 - protein, 9 aa, Plasmodium falciparum
NSDSNNNVS

SEQ ID NO: 3336419 - protein, 4 aa, Plasmodium falciparum
NSDT

SEQ ID NO: 3336420 - protein, 44 aa, Plasmodium falciparum
NSDTNSTDNDDNNDRHITDNDNYKYDYEDQKNENKNTKDIDEEK

SEQ ID NO: 3336421 - protein, 5 aa, Plasmodium falciparum
NSDTS

SEQ ID NO: 3336422 - protein, 12 aa, Plasmodium falciparum
NSDVSNNSISRN

SEQ ID NO: 3336423 - protein, 10 aa, Plasmodium falciparum
NSDYTNEEEL

SEQ ID NO: 3336424 - protein, 10 aa, Plasmodium falciparum
NSEADNGHVH

SEQ ID NO: 3336425 - protein, 5 aa, Plasmodium falciparum
NSECS

SEQ ID NO: 3336426 - protein, 8 aa, Plasmodium falciparum
NSEDERTA

SEQ ID NO: 3336427 - protein, 8 aa, Plasmodium falciparum
NSEDSSNA

SEQ ID NO: 3336428 - protein, 9 aa, Plasmodium falciparum
NSEDYSNQT

SEQ ID NO: 3336429 - protein, 17 aa, Plasmodium falciparum
NSEEAYDNQGDTKNDVI

SEQ ID NO: 3336430 - protein, 9 aa, Plasmodium falciparum
NSEEFEDTT

SEQ ID NO: 3336431 - protein, 9 aa, Plasmodium falciparum
NSEEKQKAE

SEQ ID NO: 3336432 - protein, 6 aa, Plasmodium falciparum
NSEENL

SEQ ID NO: 3336433 - protein, 4 aa, Plasmodium falciparum
NSEG

SEQ ID NO: 3336434 - protein, 6 aa, Plasmodium falciparum
NSEGDL

SEQ ID NO: 3336435 - protein, 10 aa, Plasmodium falciparum
NSEHNDLKNQ

SEQ ID NO: 3336436 - protein, 5 aa, Plasmodium falciparum
NSEIE

SEQ ID NO: 3336437 - protein, 5 aa, Plasmodium falciparum
NSEKF

SEQ ID NO: 3336438 - protein, 13 aa, Plasmodium falciparum
NSEKKKKKKKSFY

SEQ ID NO: 3336439 - protein, 17 aa, Plasmodium falciparum
NSEKKRKIDNSREEYSD

SEQ ID NO: 3336440 - protein, 17 aa, Plasmodium falciparum
NSEKQKDELPKKNSSNN

SEQ ID NO: 3336441 - protein, 15 aa, Plasmodium falciparum
NSEKSVGKKKYDDSD

SEQ ID NO: 3336442 - protein, 8 aa, Plasmodium falciparum
NSEKYNNQ

SEQ ID NO: 3336443 - protein, 5 aa, Plasmodium falciparum
NSELS

SEQ ID NO: 3336444 - protein, 12 aa, Plasmodium falciparum
NSEMKKNKKKKK

SEQ ID NO: 3336445 - protein, 5 aa, Plasmodium falciparum
NSEMQ

SEQ ID NO: 3336446 - protein, 5 aa, Plasmodium falciparum
NSENI

SEQ ID NO: 3336447 - protein, 6 aa, Plasmodium falciparum
NSENIY

SEQ ID NO: 3336448 - protein, 30 aa, Plasmodium falciparum
NSENNDHGKYNNYDDGEDNNNNNKKEQIVK

SEQ ID NO: 3336449 - protein, 11 aa, Plasmodium falciparum
NSENNITRKNS

SEQ ID NO: 3336450 - protein, 15 aa, Plasmodium falciparum
NSENSCINNNENEEM

SEQ ID NO: 3336451 - protein, 8 aa, Plasmodium falciparum
NSENSNDI

SEQ ID NO: 3336452 - protein, 6 aa, Plasmodium falciparum
NSEPGS

SEQ ID NO: 3336453 - protein, 4 aa, Plasmodium falciparum
NSEQ

SEQ ID NO: 3336454 - protein, 15 aa, Plasmodium falciparum
NSEQINSSKTQKGLK

SEQ ID NO: 3336455 - protein, 7 aa, Plasmodium falciparum
NSEQSES

SEQ ID NO: 3336456 - protein, 15 aa, Plasmodium falciparum
NSEQTIGDNKNGIKK

SEQ ID NO: 3336457 - protein, 7 aa, Plasmodium falciparum
NSERQSN

SEQ ID NO: 3336458 - protein, 5 aa, Plasmodium falciparum
NSESD

SEQ ID NO: 3336459 - protein, 5 aa, Plasmodium falciparum
NSESE

SEQ ID NO: 3336460 - protein, 7 aa, Plasmodium falciparum
NSESFNE

SEQ ID NO: 3336461 - protein, 5 aa, Plasmodium falciparum
NSESY

SEQ ID NO: 3336462 - protein, 6 aa, Plasmodium falciparum
NSETND

SEQ ID NO: 3336463 - protein, 11 aa, Plasmodium falciparum
NSETNKDDSYT

SEQ ID NO: 3336464 - protein, 6 aa, Plasmodium falciparum
NSETQY

SEQ ID NO: 3336465 - protein, 4 aa, Plasmodium falciparum
NSEW

SEQ ID NO: 3336466 - protein, 4 aa, Plasmodium falciparum
NSEY

SEQ ID NO: 3336467 - protein, 5 aa, Plasmodium falciparum
NSEYD

SEQ ID NO: 3336468 - protein, 14 aa, Plasmodium falciparum
NSEYNSDYSFDSDN

SEQ ID NO: 3336469 - protein, 8 aa, Plasmodium falciparum
NSFDNNNE

SEQ ID NO: 3336470 - protein, 8 aa, Plasmodium falciparum
NSFDRSEA

SEQ ID NO: 3336471 - protein, 19 aa, Plasmodium falciparum
NSFDSSNDEKKSKNGNKIY

SEQ ID NO: 3336472 - protein, 5 aa, Plasmodium falciparum
NSFEH

SEQ ID NO: 3336473 - protein, 8 aa, Plasmodium falciparum
NSFEKEKN

SEQ ID NO: 3336474 - protein, 7 aa, Plasmodium falciparum
NSFEKRN

SEQ ID NO: 3336475 - protein, 6 aa, Plasmodium falciparum
NSFESY

SEQ ID NO: 3336476 - protein, 7 aa, Plasmodium falciparum
NSFGNNK

SEQ ID NO: 3336477 - protein, 9 aa, Plasmodium falciparum
NSFGTGEKK

SEQ ID NO: 3336478 - protein, 14 aa, Plasmodium falciparum
NSFNEESKSEEGKI

SEQ ID NO: 3336479 - protein, 6 aa, Plasmodium falciparum
NSFNKT

SEQ ID NO: 3336480 - protein, 12 aa, Plasmodium falciparum
NSFNNQNNTIHQ

SEQ ID NO: 3336481 - protein, 4 aa, Plasmodium falciparum
NSFS

SEQ ID NO: 3336482 - protein, 5 aa, Plasmodium falciparum
NSFSD

SEQ ID NO: 3336483 - protein, 8 aa, Plasmodium falciparum
NSFSDEEE

SEQ ID NO: 3336484 - protein, 4 aa, Plasmodium falciparum
NSFT

SEQ ID NO: 3336485 - protein, 5 aa, Plasmodium falciparum
NSFYP

SEQ ID NO: 3336486 - protein, 4 aa, Plasmodium falciparum
NSGC

SEQ ID NO: 3336487 - protein, 5 aa, Plasmodium falciparum
NSGDN

SEQ ID NO: 3336488 - protein, 10 aa, Plasmodium falciparum
NSGGTKKNKY

SEQ ID NO: 3336489 - protein, 5 aa, Plasmodium falciparum
NSGIA

SEQ ID NO: 3336490 - protein, 6 aa, Plasmodium falciparum
NSGIPY

SEQ ID NO: 3336491 - protein, 4 aa, Plasmodium falciparum
NSGK

SEQ ID NO: 3336492 - protein, 7 aa, Plasmodium falciparum
NSGKGYN

SEQ ID NO: 3336493 - protein, 6 aa, Plasmodium falciparum
NSGKTA

SEQ ID NO: 3336494 - protein, 7 aa, Plasmodium falciparum
NSGKTIN

SEQ ID NO: 3336495 - protein, 7 aa, Plasmodium falciparum
NSGKTSL

SEQ ID NO: 3336496 - protein, 7 aa, Plasmodium falciparum
NSGKYEQ

SEQ ID NO: 3336497 - protein, 8 aa, Plasmodium falciparum
NSGNKNND

SEQ ID NO: 3336498 - protein, 4 aa, Plasmodium falciparum
NSGQ

SEQ ID NO: 3336499 - protein, 17 aa, Plasmodium falciparum
NSGQQKNNNNNNNKKEQ

SEQ ID NO: 3336500 - protein, 5 aa, Plasmodium falciparum
NSGSE

SEQ ID NO: 3336501 - protein, 26 aa, Plasmodium falciparum
NSGSEEEESNDDDDYNNNKDEKKEKL

SEQ ID NO: 3336502 - protein, 8 aa, Plasmodium falciparum
NSGSGKSF

SEQ ID NO: 3336503 - protein, 8 aa, Plasmodium falciparum
NSGSKNET

SEQ ID NO: 3336504 - protein, 13 aa, Plasmodium falciparum
NSGSNNSSSNNMN

SEQ ID NO: 3336505 - protein, 9 aa, Plasmodium falciparum
NSGSPRTSV

SEQ ID NO: 3336506 - protein, 8 aa, Plasmodium falciparum
NSGTLSSQ

SEQ ID NO: 3336507 - protein, 11 aa, Plasmodium falciparum
NSGTSPNNKTY

SEQ ID NO: 3336508 - protein, 5 aa, Plasmodium falciparum
NSGYE

SEQ ID NO: 3336509 - protein, 11 aa, Plasmodium falciparum
NSGYNKNEEGN

SEQ ID NO: 3336510 - protein, 10 aa, Plasmodium falciparum
NSHDKKKEDL

SEQ ID NO: 3336511 - protein, 5 aa, Plasmodium falciparum
NSHEP

SEQ ID NO: 3336512 - protein, 4 aa, Plasmodium falciparum
NSHG

SEQ ID NO: 3336513 - protein, 6 aa, Plasmodium falciparum
NSHHEN

SEQ ID NO: 3336514 - protein, 5 aa, Plasmodium falciparum
NSHIS

SEQ ID NO: 3336515 - protein, 14 aa, Plasmodium falciparum
NSHKNYSNNNKYNE

SEQ ID NO: 3336516 - protein, 12 aa, Plasmodium falciparum
NSHLNKDSNRIY

SEQ ID NO: 3336517 - protein, 15 aa, Plasmodium falciparum
NSHNENVNKSVDQNI

SEQ ID NO: 3336518 - protein, 6 aa, Plasmodium falciparum
NSHNKT

SEQ ID NO: 3336519 - protein, 8 aa, Plasmodium falciparum
NSHNNHRM

SEQ ID NO: 3336520 - protein, 8 aa, Plasmodium falciparum
NSHPTDMT

SEQ ID NO: 3336521 - protein, 4 aa, Plasmodium falciparum
NSHQ

SEQ ID NO: 3336522 - protein, 6 aa, Plasmodium falciparum
NSHSNN

SEQ ID NO: 3336523 - protein, 8 aa, Plasmodium falciparum
NSHSTKKC

SEQ ID NO: 3336524 - protein, 4 aa, Plasmodium falciparum
NSHT

SEQ ID NO: 3336525 - protein, 8 aa, Plasmodium falciparum
NSHTNNNI

SEQ ID NO: 3336526 - protein, 12 aa, Plasmodium falciparum
NSHVDDEQNCNS

SEQ ID NO: 3336527 - protein, 15 aa, Plasmodium falciparum
NSIDAPTQDNENKIN

SEQ ID NO: 3336528 - protein, 5 aa, Plasmodium falciparum
NSIDD

SEQ ID NO: 3336529 - protein, 5 aa, Plasmodium falciparum
NSIDE

SEQ ID NO: 3336530 - protein, 19 aa, Plasmodium falciparum
NSIDQPKENLPTNTSNTKN

SEQ ID NO: 3336531 - protein, 4 aa, Plasmodium falciparum
NSIE

SEQ ID NO: 3336532 - protein, 13 aa, Plasmodium falciparum
NSIEDKKLNESYN

SEQ ID NO: 3336533 - protein, 12 aa, Plasmodium falciparum
NSIEKNETKKNY

SEQ ID NO: 3336534 - protein, 17 aa, Plasmodium falciparum
NSIEPREEVKKNDIKEN

SEQ ID NO: 3336535 - protein, 7 aa, Plasmodium falciparum
NSIGDDL

SEQ ID NO: 3336536 - protein, 8 aa, Plasmodium falciparum
NSIGHPSP

SEQ ID NO: 3336537 - protein, 15 aa, Plasmodium falciparum
NSIHNNNNSNNSDDH

SEQ ID NO: 3336538 - protein, 7 aa, Plasmodium falciparum
NSIKDDE

SEQ ID NO: 3336539 - protein, 5 aa, Plasmodium falciparum
NSIKE

SEQ ID NO: 3336540 - protein, 10 aa, Plasmodium falciparum
NSIKENEEAY

SEQ ID NO: 3336541 - protein, 19 aa, Plasmodium falciparum
NSIKGKKRKHDSITKDNDI

SEQ ID NO: 3336542 - protein, 17 aa, Plasmodium falciparum
NSIKNEPNNKKNKNRND

SEQ ID NO: 3336543 - protein, 6 aa, Plasmodium falciparum
NSIKNG

SEQ ID NO: 3336544 - protein, 8 aa, Plasmodium falciparum
NSIKNNDK

SEQ ID NO: 3336545 - protein, 16 aa, Plasmodium falciparum
NSIKNNSSMEQNENNI

SEQ ID NO: 3336546 - protein, 5 aa, Plasmodium falciparum
NSIKP

SEQ ID NO: 3336547 - protein, 12 aa, Plasmodium falciparum
NSIKYTKSSYKN

SEQ ID NO: 3336548 - protein, 12 aa, Plasmodium falciparum
NSINNADEYNKE

SEQ ID NO: 3336549 - protein, 9 aa, Plasmodium falciparum
NSINNEQDK

SEQ ID NO: 3336550 - protein, 7 aa, Plasmodium falciparum
NSINNNN

SEQ ID NO: 3336551 - protein, 58 aa, Plasmodium falciparum
NSINNNNVNGNHKNINDDNNINDNNINDNNINDNNINDNNINDNNNNNNNNNNNNNYC

SEQ ID NO: 3336552 - protein, 8 aa, Plasmodium falciparum
NSINNSYK

SEQ ID NO: 3336553 - protein, 5 aa, Plasmodium falciparum
NSINR

SEQ ID NO: 3336554 - protein, 4 aa, Plasmodium falciparum
NSIP

SEQ ID NO: 3336555 - protein, 17 aa, Plasmodium falciparum
NSIPEKYSKSKQSIGNY

SEQ ID NO: 3336556 - protein, 5 aa, Plasmodium falciparum
NSIPP

SEQ ID NO: 3336557 - protein, 18 aa, Plasmodium falciparum
NSIPPRKIETKPKLPSKF

SEQ ID NO: 3336558 - protein, 4 aa, Plasmodium falciparum
NSIQ

SEQ ID NO: 3336559 - protein, 5 aa, Plasmodium falciparum
NSISK

SEQ ID NO: 3336560 - protein, 7 aa, Plasmodium falciparum
NSISSGN

SEQ ID NO: 3336561 - protein, 9 aa, Plasmodium falciparum
NSISSNNLH

SEQ ID NO: 3336562 - protein, 5 aa, Plasmodium falciparum
NSIST

SEQ ID NO: 3336563 - protein, 6 aa, Plasmodium falciparum
NSITEQ

SEQ ID NO: 3336564 - protein, 5 aa, Plasmodium falciparum
NSITP

SEQ ID NO: 3336565 - protein, 73 aa, Plasmodium falciparum
NSIYTNSNQNEDNISYNNNNINNDNISSSSISKNSNNTKNSSFNETKNINDDKIKYDDKNVYDDKNINDDKNI

SEQ ID NO: 3336566 - protein, 5 aa, Plasmodium falciparum
NSKDD

SEQ ID NO: 3336567 - protein, 8 aa, Plasmodium falciparum
NSKDENGI

SEQ ID NO: 3336568 - protein, 6 aa, Plasmodium falciparum
NSKDID

SEQ ID NO: 3336569 - protein, 27 aa, Plasmodium falciparum
NSKDNNSDNYDDEDELNKKNIRTQKQY

SEQ ID NO: 3336570 - protein, 9 aa, Plasmodium falciparum
NSKDNSTCT

SEQ ID NO: 3336571 - protein, 8 aa, Plasmodium falciparum
NSKDNTKM

SEQ ID NO: 3336572 - protein, 26 aa, Plasmodium falciparum
NSKDTNKSGMTNNNNNNNNINNINNN

SEQ ID NO: 3336573 - protein, 9 aa, Plasmodium falciparum
NSKEAQAAK

SEQ ID NO: 3336574 - protein, 17 aa, Plasmodium falciparum
NSKEDKINGSSSNKDEL

SEQ ID NO: 3336575 - protein, 16 aa, Plasmodium falciparum
NSKEKKQLKDDIDTYT

SEQ ID NO: 3336576 - protein, 16 aa, Plasmodium falciparum
NSKEKTKKKKKNIINN

SEQ ID NO: 3336577 - protein, 7 aa, Plasmodium falciparum
NSKENYK

SEQ ID NO: 3336578 - protein, 7 aa, Plasmodium falciparum
NSKENYN

SEQ ID NO: 3336579 - protein, 9 aa, Plasmodium falciparum
NSKETNKNL

SEQ ID NO: 3336580 - protein, 15 aa, Plasmodium falciparum
NSKEYEKYDRNNNDK

SEQ ID NO: 3336581 - protein, 4 aa, Plasmodium falciparum
NSKF

SEQ ID NO: 3336582 - protein, 8 aa, Plasmodium falciparum
NSKGIQNG

SEQ ID NO: 3336583 - protein, 6 aa, Plasmodium falciparum
NSKGKL

SEQ ID NO: 3336584 - protein, 7 aa, Plasmodium falciparum
NSKGWTN

SEQ ID NO: 3336585 - protein, 8 aa, Plasmodium falciparum
NSKHKRDN

SEQ ID NO: 3336586 - protein, 31 aa, Plasmodium falciparum
NSKHSNNDGKDKGEEQGKEKSKQSKCNKKDD

SEQ ID NO: 3336587 - protein, 22 aa, Plasmodium falciparum
NSKIIKKSTSKTKNNKKKKGSV

SEQ ID NO: 3336588 - protein, 6 aa, Plasmodium falciparum
NSKITD

SEQ ID NO: 3336589 - protein, 4 aa, Plasmodium falciparum
NSKK

SEQ ID NO: 3336590 - protein, 14 aa, Plasmodium falciparum
NSKKEKDPKNNEEV

SEQ ID NO: 3336591 - protein, 7 aa, Plasmodium falciparum
NSKKENN

SEQ ID NO: 3336592 - protein, 15 aa, Plasmodium falciparum
NSKKGNSNNNDMNES

SEQ ID NO: 3336593 - protein, 19 aa, Plasmodium falciparum
NSKKKKKKNRTDKENGHIK

SEQ ID NO: 3336594 - protein, 8 aa, Plasmodium falciparum
NSKKLSKK

SEQ ID NO: 3336595 - protein, 13 aa, Plasmodium falciparum
NSKKNNTSNLTPN

SEQ ID NO: 3336596 - protein, 21 aa, Plasmodium falciparum
NSKKRNIEKITSPTKIPKTEL

SEQ ID NO: 3336597 - protein, 35 aa, Plasmodium falciparum
NSKKSKKKKHANVDVSKDDKESKRKRGNNNKLNNE

SEQ ID NO: 3336598 - protein, 8 aa, Plasmodium falciparum
NSKKSMED

SEQ ID NO: 3336599 - protein, 15 aa, Plasmodium falciparum
NSKLRSTGNNMNDNY

SEQ ID NO: 3336600 - protein, 4 aa, Plasmodium falciparum
NSKN

SEQ ID NO: 3336601 - protein, 10 aa, Plasmodium falciparum
NSKNEKISTE

SEQ ID NO: 3336602 - protein, 9 aa, Plasmodium falciparum
NSKNEYDNY

SEQ ID NO: 3336603 - protein, 6 aa, Plasmodium falciparum
NSKNIQ

SEQ ID NO: 3336604 - protein, 6 aa, Plasmodium falciparum
NSKNNA

SEQ ID NO: 3336605 - protein, 18 aa, Plasmodium falciparum
NSKNNEVLKSKNKKNNNY

SEQ ID NO: 3336606 - protein, 6 aa, Plasmodium falciparum
NSKNNN

SEQ ID NO: 3336607 - protein, 11 aa, Plasmodium falciparum
NSKNNNLSGSN

SEQ ID NO: 3336608 - protein, 22 aa, Plasmodium falciparum
NSKNNNSHNNDNHDDDNNNNIN

SEQ ID NO: 3336609 - protein, 8 aa, Plasmodium falciparum
NSKNNNYY

SEQ ID NO: 3336610 - protein, 6 aa, Plasmodium falciparum
NSKNSD

SEQ ID NO: 3336611 - protein, 11 aa, Plasmodium falciparum
NSKRCKNKYKD

SEQ ID NO: 3336612 - protein, 5 aa, Plasmodium falciparum
NSKRE

SEQ ID NO: 3336613 - protein, 17 aa, Plasmodium falciparum
NSKRGKKNKNKNKIKHK

SEQ ID NO: 3336614 - protein, 9 aa, Plasmodium falciparum
NSKRNNKYK

SEQ ID NO: 3336615 - protein, 6 aa, Plasmodium falciparum
NSKSDD

SEQ ID NO: 3336616 - protein, 19 aa, Plasmodium falciparum
NSKSELSKSESSKCKSSNW

SEQ ID NO: 3336617 - protein, 9 aa, Plasmodium falciparum
NSKSMYDTK

SEQ ID NO: 3336618 - protein, 19 aa, Plasmodium falciparum
NSKSTFQVGSSNQVNSDRS

SEQ ID NO: 3336619 - protein, 6 aa, Plasmodium falciparum
NSKTDF

SEQ ID NO: 3336620 - protein, 7 aa, Plasmodium falciparum
NSKTSEY

SEQ ID NO: 3336621 - protein, 11 aa, Plasmodium falciparum
NSKTSNNNEGC

SEQ ID NO: 3336622 - protein, 14 aa, Plasmodium falciparum
NSKVSRKESRDLQE

SEQ ID NO: 3336623 - protein, 7 aa, Plasmodium falciparum
NSLADKN

SEQ ID NO: 3336624 - protein, 5 aa, Plasmodium falciparum
NSLDD

SEQ ID NO: 3336625 - protein, 5 aa, Plasmodium falciparum
NSLDS

SEQ ID NO: 3336626 - protein, 4 aa, Plasmodium falciparum
NSLE

SEQ ID NO: 3336627 - protein, 5 aa, Plasmodium falciparum
NSLEE

SEQ ID NO: 3336628 - protein, 10 aa, Plasmodium falciparum
NSLEEKNEEL

SEQ ID NO: 3336629 - protein, 9 aa, Plasmodium falciparum
NSLEKNDSD

SEQ ID NO: 3336630 - protein, 17 aa, Plasmodium falciparum
NSLHSKYDKTKTTKITN

SEQ ID NO: 3336631 - protein, 8 aa, Plasmodium falciparum
NSLKGQIK

SEQ ID NO: 3336632 - protein, 5 aa, Plasmodium falciparum
NSLKK

SEQ ID NO: 3336633 - protein, 16 aa, Plasmodium falciparum
NSLKNSSHLDKNTIKE

SEQ ID NO: 3336634 - protein, 5 aa, Plasmodium falciparum
NSLKS

SEQ ID NO: 3336635 - protein, 7 aa, Plasmodium falciparum
NSLKSRE

SEQ ID NO: 3336636 - protein, 12 aa, Plasmodium falciparum
NSLNSFKSEEYN

SEQ ID NO: 3336637 - protein, 12 aa, Plasmodium falciparum
NSLNTNDNDKIE

SEQ ID NO: 3336638 - protein, 9 aa, Plasmodium falciparum
NSLPQKNDY

SEQ ID NO: 3336639 - protein, 7 aa, Plasmodium falciparum
NSLQEEK

SEQ ID NO: 3336640 - protein, 6 aa, Plasmodium falciparum
NSLQES

SEQ ID NO: 3336641 - protein, 14 aa, Plasmodium falciparum
NSLSDKMENDISSV

SEQ ID NO: 3336642 - protein, 13 aa, Plasmodium falciparum
NSLTNKRESITRS

SEQ ID NO: 3336643 - protein, 5 aa, Plasmodium falciparum
NSLYN

SEQ ID NO: 3336644 - protein, 5 aa, Plasmodium falciparum
NSMID

SEQ ID NO: 3336645 - protein, 6 aa, Plasmodium falciparum
NSMKKN

SEQ ID NO: 3336646 - protein, 9 aa, Plasmodium falciparum
NSMNDSENY

SEQ ID NO: 3336647 - protein, 6 aa, Plasmodium falciparum
NSMNEK

SEQ ID NO: 3336648 - protein, 17 aa, Plasmodium falciparum
NSMNEKNKEQQNEEANT

SEQ ID NO: 3336649 - protein, 30 aa, Plasmodium falciparum
NSMNSSNNHFREGSNVNSCTEENTGANNKE

SEQ ID NO: 3336650 - protein, 6 aa, Plasmodium falciparum
NSMNTN

SEQ ID NO: 3336651 - protein, 18 aa, Plasmodium falciparum
NSMPKNLKKEDSDSYTNN

SEQ ID NO: 3336652 - protein, 10 aa, Plasmodium falciparum
NSMRTSNLDN

SEQ ID NO: 3336653 - protein, 67 aa, Plasmodium falciparum
NSMSSGNDGKAKNNKSNNKNKNGTNTSTNNNNNVNNSNHNNKHSNNSNSNSNSKNNNNNNNNNNNRI

SEQ ID NO: 3336654 - protein, 5 aa, Plasmodium falciparum
NSMTS

SEQ ID NO: 3336655 - protein, 4 aa, Plasmodium falciparum
NSNA

SEQ ID NO: 3336656 - protein, 5 aa, Plasmodium falciparum
NSNAG

SEQ ID NO: 3336657 - protein, 8 aa, Plasmodium falciparum
NSNANIEG

SEQ ID NO: 3336658 - protein, 13 aa, Plasmodium falciparum
NSNCSNKNSFNNK

SEQ ID NO: 3336659 - protein, 8 aa, Plasmodium falciparum
NSNDATSS

SEQ ID NO: 3336660 - protein, 38 aa, Plasmodium falciparum
NSNDDLKDGIKNERDRKFQDNTNNIHNKGNYNNKSTTC

SEQ ID NO: 3336661 - protein, 23 aa, Plasmodium falciparum
NSNDDNMKKKKKKKDQDEEEMVG

SEQ ID NO: 3336662 - protein, 17 aa, Plasmodium falciparum
NSNDIKKKKNNNNKKFS

SEQ ID NO: 3336663 - protein, 7 aa, Plasmodium falciparum
NSNDIND

SEQ ID NO: 3336664 - protein, 5 aa, Plasmodium falciparum
NSNDL

SEQ ID NO: 3336665 - protein, 5 aa, Plasmodium falciparum
NSNDN

SEQ ID NO: 3336666 - protein, 26 aa, Plasmodium falciparum
NSNDNNNNNNNNDNNNNDNNKNNINE

SEQ ID NO: 3336667 - protein, 17 aa, Plasmodium falciparum
NSNDNYNENIKKSSVVK

SEQ ID NO: 3336668 - protein, 10 aa, Plasmodium falciparum
NSNDQGQKKI

SEQ ID NO: 3336669 - protein, 6 aa, Plasmodium falciparum
NSNDRY

SEQ ID NO: 3336670 - protein, 13 aa, Plasmodium falciparum
NSNDSSDDLKKKI

SEQ ID NO: 3336671 - protein, 8 aa, Plasmodium falciparum
NSNDVRKK

SEQ ID NO: 3336672 - protein, 65 aa, Plasmodium falciparum
NSNDYSNDNDINNENNNNNDHNNENNNNNDHNNDHNNDHNNDNNNNNNNNDHNNNSDNSNDNNNV

SEQ ID NO: 3336673 - protein, 9 aa, Plasmodium falciparum
NSNDYTNTN

SEQ ID NO: 3336674 - protein, 4 aa, Plasmodium falciparum
NSNE

SEQ ID NO: 3336675 - protein, 8 aa, Plasmodium falciparum
NSNECNNK

SEQ ID NO: 3336676 - protein, 5 aa, Plasmodium falciparum
NSNEE

SEQ ID NO: 3336677 - protein, 10 aa, Plasmodium falciparum
NSNEENNNYD

SEQ ID NO: 3336678 - protein, 12 aa, Plasmodium falciparum
NSNEENTEEKIN

SEQ ID NO: 3336679 - protein, 11 aa, Plasmodium falciparum
NSNEKYTEPTS

SEQ ID NO: 3336680 - protein, 7 aa, Plasmodium falciparum
NSNENVK

SEQ ID NO: 3336681 - protein, 18 aa, Plasmodium falciparum
NSNEQNYNDHNKNNNPYN

SEQ ID NO: 3336682 - protein, 5 aa, Plasmodium falciparum
NSNEY

SEQ ID NO: 3336683 - protein, 8 aa, Plasmodium falciparum
NSNEYSST

SEQ ID NO: 3336684 - protein, 7 aa, Plasmodium falciparum
NSNGERR

SEQ ID NO: 3336685 - protein, 24 aa, Plasmodium falciparum
NSNGEYKMNEKNKNIPFNNSSTNY

SEQ ID NO: 3336686 - protein, 13 aa, Plasmodium falciparum
NSNGINKKHDEQY

SEQ ID NO: 3336687 - protein, 8 aa, Plasmodium falciparum
NSNGNKNH

SEQ ID NO: 3336688 - protein, 9 aa, Plasmodium falciparum
NSNGNNSTY

SEQ ID NO: 3336689 - protein, 18 aa, Plasmodium falciparum
NSNHHNNDDNNDESNDNM

SEQ ID NO: 3336690 - protein, 12 aa, Plasmodium falciparum
NSNHHSTERSHN

SEQ ID NO: 3336691 - protein, 12 aa, Plasmodium falciparum
NSNHNQKEGNSY

SEQ ID NO: 3336692 - protein, 19 aa, Plasmodium falciparum
NSNIDQNESSNKKTKNAND

SEQ ID NO: 3336693 - protein, 6 aa, Plasmodium falciparum
NSNIEK

SEQ ID NO: 3336694 - protein, 5 aa, Plasmodium falciparum
NSNIK

SEQ ID NO: 3336695 - protein, 5 aa, Plasmodium falciparum
NSNIN

SEQ ID NO: 3336696 - protein, 6 aa, Plasmodium falciparum
NSNIND

SEQ ID NO: 3336697 - protein, 15 aa, Plasmodium falciparum
NSNINEQKKNERKDC

SEQ ID NO: 3336698 - protein, 5 aa, Plasmodium falciparum
NSNIP

SEQ ID NO: 3336699 - protein, 6 aa, Plasmodium falciparum
NSNITN

SEQ ID NO: 3336700 - protein, 4 aa, Plasmodium falciparum
NSNK

SEQ ID NO: 3336701 - protein, 5 aa, Plasmodium falciparum
NSNKE

SEQ ID NO: 3336702 - protein, 6 aa, Plasmodium falciparum
NSNKFK

SEQ ID NO: 3336703 - protein, 5 aa, Plasmodium falciparum
NSNKH

SEQ ID NO: 3336704 - protein, 10 aa, Plasmodium falciparum
NSNKIKGNNM

SEQ ID NO: 3336705 - protein, 12 aa, Plasmodium falciparum
NSNKITKKNINQ

SEQ ID NO: 3336706 - protein, 8 aa, Plasmodium falciparum
NSNKKKIK

SEQ ID NO: 3336707 - protein, 8 aa, Plasmodium falciparum
NSNKKNQQ

SEQ ID NO: 3336708 - protein, 34 aa, Plasmodium falciparum
NSNKLSKEKSTRSIESSKEKNENVFEGTSGKLNT

SEQ ID NO: 3336709 - protein, 18 aa, Plasmodium falciparum
NSNKNKIRNLTGGHKNNE

SEQ ID NO: 3336710 - protein, 5 aa, Plasmodium falciparum
NSNKS

SEQ ID NO: 3336711 - protein, 8 aa, Plasmodium falciparum
NSNKSYCD

SEQ ID NO: 3336712 - protein, 7 aa, Plasmodium falciparum
NSNKTFE

SEQ ID NO: 3336713 - protein, 26 aa, Plasmodium falciparum
NSNLENNDHHNNNNNNNNKLSNDSNI

SEQ ID NO: 3336714 - protein, 15 aa, Plasmodium falciparum
NSNLESYENMGNENY

SEQ ID NO: 3336715 - protein, 13 aa, Plasmodium falciparum
NSNMNNPNNNSKY

SEQ ID NO: 3336716 - protein, 33 aa, Plasmodium falciparum
NSNNEKEKKKSNLKSNGQVNNINNKKGSDLSKN

SEQ ID NO: 3336717 - protein, 18 aa, Plasmodium falciparum
NSNNENMYDDNKNKSNVL

SEQ ID NO: 3336718 - protein, 9 aa, Plasmodium falciparum
NSNNGSRNY

SEQ ID NO: 3336719 - protein, 15 aa, Plasmodium falciparum
NSNNHNNCKGTRDKK

SEQ ID NO: 3336720 - protein, 14 aa, Plasmodium falciparum
NSNNIDGHNNANLE

SEQ ID NO: 3336721 - protein, 6 aa, Plasmodium falciparum
NSNNIS

SEQ ID NO: 3336722 - protein, 6 aa, Plasmodium falciparum
NSNNLR

SEQ ID NO: 3336723 - protein, 8 aa, Plasmodium falciparum
NSNNLRNR

SEQ ID NO: 3336724 - protein, 5 aa, Plasmodium falciparum
NSNNM

SEQ ID NO: 3336725 - protein, 6 aa, Plasmodium falciparum
NSNNMN

SEQ ID NO: 3336726 - protein, 43 aa, Plasmodium falciparum
NSNNMNDNNFDPTNSNNNNNNNNNNNNNNNNGNNNNNGNNNTM

SEQ ID NO: 3336727 - protein, 15 aa, Plasmodium falciparum
NSNNMNSNNMNSNNM

SEQ ID NO: 3336728 - protein, 13 aa, Plasmodium falciparum
NSNNMSSEIPSSF

SEQ ID NO: 3336729 - protein, 5 aa, Plasmodium falciparum
NSNNN

SEQ ID NO: 3336730 - protein, 12 aa, Plasmodium falciparum
NSNNNENDNSSF

SEQ ID NO: 3336731 - protein, 28 aa, Plasmodium falciparum
NSNNNNNNDNNNNNDNNNNDNNNNNNNN

SEQ ID NO: 3336732 - protein, 13 aa, Plasmodium falciparum
NSNNNNNNINGNI

SEQ ID NO: 3336733 - protein, 53 aa, Plasmodium falciparum
NSNNNNNNNIDHNNNNNIDNNNNNNIDNNNNNNIDNNNNNNIDHNNNNNIDHN

SEQ ID NO: 3336734 - protein, 10 aa, Plasmodium falciparum
NSNNNNNNNN

SEQ ID NO: 3336735 - protein, 11 aa, Plasmodium falciparum
NSNNNNNNNNI

SEQ ID NO: 3336736 - protein, 21 aa, Plasmodium falciparum
NSNNNNNNNNINDNVGTSINT

SEQ ID NO: 3336737 - protein, 38 aa, Plasmodium falciparum
NSNNNNNNNNKNNNNNNNNKNNNNNKNNNNNNNNNNDC

SEQ ID NO: 3336738 - protein, 13 aa, Plasmodium falciparum
NSNNNNNNNNNNN

SEQ ID NO: 3336739 - protein, 14 aa, Plasmodium falciparum
NSNNNNNNNNNNNI

SEQ ID NO: 3336740 - protein, 20 aa, Plasmodium falciparum
NSNNNNNNNNNNNNNNNNND

SEQ ID NO: 3336741 - protein, 19 aa, Plasmodium falciparum
NSNNNNNNNNNSNSNNNID

SEQ ID NO: 3336742 - protein, 13 aa, Plasmodium falciparum
NSNNNNNNNYNNN

SEQ ID NO: 3336743 - protein, 10 aa, Plasmodium falciparum
NSNNNNNNSI

SEQ ID NO: 3336744 - protein, 10 aa, Plasmodium falciparum
NSNNNNNNTC

SEQ ID NO: 3336745 - protein, 8 aa, Plasmodium falciparum
NSNNNQDT

SEQ ID NO: 3336746 - protein, 6 aa, Plasmodium falciparum
NSNNSC

SEQ ID NO: 3336747 - protein, 11 aa, Plasmodium falciparum
NSNNSDIKSDN

SEQ ID NO: 3336748 - protein, 30 aa, Plasmodium falciparum
NSNNSSSNSNNNNINSSSSSSNNNNNNVHQ

SEQ ID NO: 3336749 - protein, 10 aa, Plasmodium falciparum
NSNNTSTNDI

SEQ ID NO: 3336750 - protein, 22 aa, Plasmodium falciparum
NSNNVDNNKENVNNKKNKQMNL

SEQ ID NO: 3336751 - protein, 17 aa, Plasmodium falciparum
NSNNVNNSNNTGNSQNL

SEQ ID NO: 3336752 - protein, 8 aa, Plasmodium falciparum
NSNNYSYD

SEQ ID NO: 3336753 - protein, 4 aa, Plasmodium falciparum
NSNP

SEQ ID NO: 3336754 - protein, 23 aa, Plasmodium falciparum
NSNPLESNNNGSTTTTTTTTSIK

SEQ ID NO: 3336755 - protein, 8 aa, Plasmodium falciparum
NSNQESNQ

SEQ ID NO: 3336756 - protein, 9 aa, Plasmodium falciparum
NSNQKNQQH

SEQ ID NO: 3336757 - protein, 7 aa, Plasmodium falciparum
NSNRKKN

SEQ ID NO: 3336758 - protein, 9 aa, Plasmodium falciparum
NSNRNMQND

SEQ ID NO: 3336759 - protein, 5 aa, Plasmodium falciparum
NSNRS

SEQ ID NO: 3336760 - protein, 8 aa, Plasmodium falciparum
NSNSENSL

SEQ ID NO: 3336761 - protein, 6 aa, Plasmodium falciparum
NSNSGL

SEQ ID NO: 3336762 - protein, 6 aa, Plasmodium falciparum
NSNSIK

SEQ ID NO: 3336763 - protein, 6 aa, Plasmodium falciparum
NSNSIN

SEQ ID NO: 3336764 - protein, 10 aa, Plasmodium falciparum
NSNSNINNND

SEQ ID NO: 3336765 - protein, 10 aa, Plasmodium falciparum
NSNSNSNDKF

SEQ ID NO: 3336766 - protein, 26 aa, Plasmodium falciparum
NSNSNTNNNNNNNNNNNHNYYNNRNN

SEQ ID NO: 3336767 - protein, 10 aa, Plasmodium falciparum
NSNSSNDENI

SEQ ID NO: 3336768 - protein, 22 aa, Plasmodium falciparum
NSNSSNSSNHINNNVDSNKRNE

SEQ ID NO: 3336769 - protein, 30 aa, Plasmodium falciparum
NSNSSSSSEDATSGKLQYTESDDEGSDEYC

SEQ ID NO: 3336770 - protein, 6 aa, Plasmodium falciparum
NSNSTI

SEQ ID NO: 3336771 - protein, 8 aa, Plasmodium falciparum
NSNSTNET

SEQ ID NO: 3336772 - protein, 4 aa, Plasmodium falciparum
NSNT

SEQ ID NO: 3336773 - protein, 5 aa, Plasmodium falciparum
NSNTE

SEQ ID NO: 3336774 - protein, 14 aa, Plasmodium falciparum
NSNTINNNTNMNST

SEQ ID NO: 3336775 - protein, 10 aa, Plasmodium falciparum
NSNTISEGGV

SEQ ID NO: 3336776 - protein, 14 aa, Plasmodium falciparum
NSNTKEEDGEYQNN

SEQ ID NO: 3336777 - protein, 5 aa, Plasmodium falciparum
NSNTL

SEQ ID NO: 3336778 - protein, 6 aa, Plasmodium falciparum
NSNTLN

SEQ ID NO: 3336779 - protein, 7 aa, Plasmodium falciparum
NSNTNER

SEQ ID NO: 3336780 - protein, 10 aa, Plasmodium falciparum
NSNTNKKHTS

SEQ ID NO: 3336781 - protein, 8 aa, Plasmodium falciparum
NSNTNNES

SEQ ID NO: 3336782 - protein, 58 aa, Plasmodium falciparum
NSNVGIKKNDNKSDHINDNDDNKNDNKSDHINDNDDNKNDNKNDHINDNSNNNKYNNN

SEQ ID NO: 3336783 - protein, 18 aa, Plasmodium falciparum
NSNVKRKKVSTSYERNDD

SEQ ID NO: 3336784 - protein, 10 aa, Plasmodium falciparum
NSNYKEVTSN

SEQ ID NO: 3336785 - protein, 22 aa, Plasmodium falciparum
NSNYNGFNNENSNTTTNEQNDS

SEQ ID NO: 3336786 - protein, 7 aa, Plasmodium falciparum
NSNYNKK

SEQ ID NO: 3336787 - protein, 6 aa, Plasmodium falciparum
NSNYNN

SEQ ID NO: 3336788 - protein, 56 aa, Plasmodium falciparum
NSNYQDDKQETNKEKHEQKIEEKYNEQNIQTNNQTKKPHNNNNNNNNNNSKKKTQK

SEQ ID NO: 3336789 - protein, 48 aa, Plasmodium falciparum
NSNYYSSSNNNNNNNNNNNTLVNSNNNNNNNDTNSVSTNEISDINNET

SEQ ID NO: 3336790 - protein, 6 aa, Plasmodium falciparum
NSPDDY

SEQ ID NO: 3336791 - protein, 9 aa, Plasmodium falciparum
NSPEGSLPI

SEQ ID NO: 3336792 - protein, 6 aa, Plasmodium falciparum
NSPFHE

SEQ ID NO: 3336793 - protein, 7 aa, Plasmodium falciparum
NSPIGND

SEQ ID NO: 3336794 - protein, 19 aa, Plasmodium falciparum
NSPIKSPTNTPIRSPSSPI

SEQ ID NO: 3336795 - protein, 10 aa, Plasmodium falciparum
NSPIQEEKNN

SEQ ID NO: 3336796 - protein, 32 aa, Plasmodium falciparum
NSPKEKKKKKNLKNDHISNEKKKKDEYEYETY

SEQ ID NO: 3336797 - protein, 14 aa, Plasmodium falciparum
NSPKKPKKSTIDEK

SEQ ID NO: 3336798 - protein, 6 aa, Plasmodium falciparum
NSPKKT

SEQ ID NO: 3336799 - protein, 5 aa, Plasmodium falciparum
NSPKM

SEQ ID NO: 3336800 - protein, 7 aa, Plasmodium falciparum
NSPLSLN

SEQ ID NO: 3336801 - protein, 5 aa, Plasmodium falciparum
NSPNN

SEQ ID NO: 3336802 - protein, 7 aa, Plasmodium falciparum
NSPNSED

SEQ ID NO: 3336803 - protein, 14 aa, Plasmodium falciparum
NSPNSTSSDSDGNG

SEQ ID NO: 3336804 - protein, 6 aa, Plasmodium falciparum
NSPRTS

SEQ ID NO: 3336805 - protein, 5 aa, Plasmodium falciparum
NSPSF

SEQ ID NO: 3336806 - protein, 7 aa, Plasmodium falciparum
NSPSSDL

SEQ ID NO: 3336807 - protein, 5 aa, Plasmodium falciparum
NSPSY

SEQ ID NO: 3336808 - protein, 4 aa, Plasmodium falciparum
NSPT

SEQ ID NO: 3336809 - protein, 14 aa, Plasmodium falciparum
NSPTDRNIKENRNK

SEQ ID NO: 3336810 - protein, 11 aa, Plasmodium falciparum
NSPTYKNSNNM

SEQ ID NO: 3336811 - protein, 5 aa, Plasmodium falciparum
NSPYH

SEQ ID NO: 3336812 - protein, 5 aa, Plasmodium falciparum
NSPYI

SEQ ID NO: 3336813 - protein, 7 aa, Plasmodium falciparum
NSPYSRN

SEQ ID NO: 3336814 - protein, 14 aa, Plasmodium falciparum
NSQAAKKASDKYKD

SEQ ID NO: 3336815 - protein, 7 aa, Plasmodium falciparum
NSQDEGK

SEQ ID NO: 3336816 - protein, 10 aa, Plasmodium falciparum
NSQDYSYDNN

SEQ ID NO: 3336817 - protein, 4 aa, Plasmodium falciparum
NSQE

SEQ ID NO: 3336818 - protein, 22 aa, Plasmodium falciparum
NSQENKHSSFEHEKTKSSKKSF

SEQ ID NO: 3336819 - protein, 9 aa, Plasmodium falciparum
NSQENTGVQ

SEQ ID NO: 3336820 - protein, 8 aa, Plasmodium falciparum
NSQETHND

SEQ ID NO: 3336821 - protein, 5 aa, Plasmodium falciparum
NSQEY

SEQ ID NO: 3336822 - protein, 6 aa, Plasmodium falciparum
NSQHSN

SEQ ID NO: 3336823 - protein, 19 aa, Plasmodium falciparum
NSQITSTNNMNNNNNNVNI

SEQ ID NO: 3336824 - protein, 4 aa, Plasmodium falciparum
NSQK

SEQ ID NO: 3336825 - protein, 8 aa, Plasmodium falciparum
NSQKLTEE

SEQ ID NO: 3336826 - protein, 29 aa, Plasmodium falciparum
NSQLNNNNDNNSDNNNDNNNDNNNSDNCN

SEQ ID NO: 3336827 - protein, 10 aa, Plasmodium falciparum
NSQNDESSRS

SEQ ID NO: 3336828 - protein, 6 aa, Plasmodium falciparum
NSQNEK

SEQ ID NO: 3336829 - protein, 12 aa, Plasmodium falciparum
NSQNKKGAYNIN

SEQ ID NO: 3336830 - protein, 11 aa, Plasmodium falciparum
NSQNKNTDNMT

SEQ ID NO: 3336831 - protein, 8 aa, Plasmodium falciparum
NSQNNNER

SEQ ID NO: 3336832 - protein, 8 aa, Plasmodium falciparum
NSQNNPNV

SEQ ID NO: 3336833 - protein, 8 aa, Plasmodium falciparum
NSQNRKNK

SEQ ID NO: 3336834 - protein, 9 aa, Plasmodium falciparum
NSQPSDDYS

SEQ ID NO: 3336835 - protein, 7 aa, Plasmodium falciparum
NSQQFNT

SEQ ID NO: 3336836 - protein, 11 aa, Plasmodium falciparum
NSQSKNKENNL

SEQ ID NO: 3336837 - protein, 7 aa, Plasmodium falciparum
NSQTNND

SEQ ID NO: 3336838 - protein, 10 aa, Plasmodium falciparum
NSQYDSENSN

SEQ ID NO: 3336839 - protein, 12 aa, Plasmodium falciparum
NSRDNEKNEDIS

SEQ ID NO: 3336840 - protein, 14 aa, Plasmodium falciparum
NSRDTPNNNMNPQE

SEQ ID NO: 3336841 - protein, 5 aa, Plasmodium falciparum
NSREE

SEQ ID NO: 3336842 - protein, 6 aa, Plasmodium falciparum
NSRENI

SEQ ID NO: 3336843 - protein, 8 aa, Plasmodium falciparum
NSRENVSS

SEQ ID NO: 3336844 - protein, 4 aa, Plasmodium falciparum
NSRI

SEQ ID NO: 3336845 - protein, 5 aa, Plasmodium falciparum
NSRKH

SEQ ID NO: 3336846 - protein, 7 aa, Plasmodium falciparum
NSRLSNE

SEQ ID NO: 3336847 - protein, 7 aa, Plasmodium falciparum
NSRNDYH

SEQ ID NO: 3336848 - protein, 18 aa, Plasmodium falciparum
NSRNRYNTRSSNINRDHL

SEQ ID NO: 3336849 - protein, 10 aa, Plasmodium falciparum
NSRNSRNSSL

SEQ ID NO: 3336850 - protein, 10 aa, Plasmodium falciparum
NSRNTTCPDC

SEQ ID NO: 3336851 - protein, 5 aa, Plasmodium falciparum
NSRRG

SEQ ID NO: 3336852 - protein, 9 aa, Plasmodium falciparum
NSRSRTIDD

SEQ ID NO: 3336853 - protein, 4 aa, Plasmodium falciparum
NSRT

SEQ ID NO: 3336854 - protein, 13 aa, Plasmodium falciparum
NSRTKKKETLLND

SEQ ID NO: 3336855 - protein, 14 aa, Plasmodium falciparum
NSRTRSPSTCSADG

SEQ ID NO: 3336856 - protein, 25 aa, Plasmodium falciparum
NSRVNTNNSAYRGKNNNMQNEKNNY

SEQ ID NO: 3336857 - protein, 18 aa, Plasmodium falciparum
NSRVSNDDTNKEKRKKLK

SEQ ID NO: 3336858 - protein, 24 aa, Plasmodium falciparum
NSRYNYNNHDDNEYDNNFRGKDNN

SEQ ID NO: 3336859 - protein, 4 aa, Plasmodium falciparum
NSSA

SEQ ID NO: 3336860 - protein, 11 aa, Plasmodium falciparum
NSSAENNSSLQ

SEQ ID NO: 3336861 - protein, 7 aa, Plasmodium falciparum
NSSAGHE

SEQ ID NO: 3336862 - protein, 7 aa, Plasmodium falciparum
NSSASNN

SEQ ID NO: 3336863 - protein, 4 aa, Plasmodium falciparum
NSSC

SEQ ID NO: 3336864 - protein, 6 aa, Plasmodium falciparum
NSSDAI

SEQ ID NO: 3336865 - protein, 58 aa, Plasmodium falciparum
NSSDANTANYNQDKNENTSEVNDYSKEDIEGDENLKSSKGKQENNTKSSSDKDENTID

SEQ ID NO: 3336866 - protein, 5 aa, Plasmodium falciparum
NSSDD

SEQ ID NO: 3336867 - protein, 22 aa, Plasmodium falciparum
NSSDDSMNSDSDINEKDIEENT

SEQ ID NO: 3336868 - protein, 14 aa, Plasmodium falciparum
NSSDLTKKKKKNHE

SEQ ID NO: 3336869 - protein, 8 aa, Plasmodium falciparum
NSSDPIDK

SEQ ID NO: 3336870 - protein, 13 aa, Plasmodium falciparum
NSSDQKKTKNKIK

SEQ ID NO: 3336871 - protein, 5 aa, Plasmodium falciparum
NSSDT

SEQ ID NO: 3336872 - protein, 38 aa, Plasmodium falciparum
NSSEDEAEEQVNNEYNDQKEKGKRNSKNNQQDDQTCDD

SEQ ID NO: 3336873 - protein, 17 aa, Plasmodium falciparum
NSSEERQNASKEEDNEL

SEQ ID NO: 3336874 - protein, 7 aa, Plasmodium falciparum
NSSEHNN

SEQ ID NO: 3336875 - protein, 7 aa, Plasmodium falciparum
NSSENLA

SEQ ID NO: 3336876 - protein, 8 aa, Plasmodium falciparum
NSSENSNL

SEQ ID NO: 3336877 - protein, 9 aa, Plasmodium falciparum
NSSERASDT

SEQ ID NO: 3336878 - protein, 4 aa, Plasmodium falciparum
NSSF

SEQ ID NO: 3336879 - protein, 27 aa, Plasmodium falciparum
NSSFANNSNEKSLEKEKNKNPNENGSL

SEQ ID NO: 3336880 - protein, 5 aa, Plasmodium falciparum
NSSFP

SEQ ID NO: 3336881 - protein, 6 aa, Plasmodium falciparum
NSSFPP

SEQ ID NO: 3336882 - protein, 29 aa, Plasmodium falciparum
NSSFSKEDANNACTNNNNNNNTSSGTSNS

SEQ ID NO: 3336883 - protein, 13 aa, Plasmodium falciparum
NSSGEKKEEIGNS

SEQ ID NO: 3336884 - protein, 7 aa, Plasmodium falciparum
NSSGPRG

SEQ ID NO: 3336885 - protein, 4 aa, Plasmodium falciparum
NSSH

SEQ ID NO: 3336886 - protein, 13 aa, Plasmodium falciparum
NSSHKKTRNRNNF

SEQ ID NO: 3336887 - protein, 8 aa, Plasmodium falciparum
NSSHNNNH

SEQ ID NO: 3336888 - protein, 14 aa, Plasmodium falciparum
NSSHPLSSNEETFR

SEQ ID NO: 3336889 - protein, 8 aa, Plasmodium falciparum
NSSHSGSI

SEQ ID NO: 3336890 - protein, 5 aa, Plasmodium falciparum
NSSHV

SEQ ID NO: 3336891 - protein, 9 aa, Plasmodium falciparum
NSSINSQNN

SEQ ID NO: 3336892 - protein, 33 aa, Plasmodium falciparum
NSSINSSINNSINSSINNSINNSIDNSINNSIN

SEQ ID NO: 3336893 - protein, 11 aa, Plasmodium falciparum
NSSINYSPNCD

SEQ ID NO: 3336894 - protein, 11 aa, Plasmodium falciparum
NSSISNNSEEI

SEQ ID NO: 3336895 - protein, 7 aa, Plasmodium falciparum
NSSISNV

SEQ ID NO: 3336896 - protein, 29 aa, Plasmodium falciparum
NSSISSNNKLKNNNNINNNNINNNINNNN

SEQ ID NO: 3336897 - protein, 9 aa, Plasmodium falciparum
NSSKENNKY

SEQ ID NO: 3336898 - protein, 6 aa, Plasmodium falciparum
NSSKGW

SEQ ID NO: 3336899 - protein, 9 aa, Plasmodium falciparum
NSSKINENN

SEQ ID NO: 3336900 - protein, 5 aa, Plasmodium falciparum
NSSKM

SEQ ID NO: 3336901 - protein, 9 aa, Plasmodium falciparum
NSSKPHQSL

SEQ ID NO: 3336902 - protein, 6 aa, Plasmodium falciparum
NSSKQV

SEQ ID NO: 3336903 - protein, 42 aa, Plasmodium falciparum
NSSKSGGSNNNSGNNNNNNNNNISNNNNNNNSNNNGNVNGGN

SEQ ID NO: 3336904 - protein, 9 aa, Plasmodium falciparum
NSSKTNQED

SEQ ID NO: 3336905 - protein, 18 aa, Plasmodium falciparum
NSSMEQNKNLNEKNHSNF

SEQ ID NO: 3336906 - protein, 5 aa, Plasmodium falciparum
NSSMY

SEQ ID NO: 3336907 - protein, 4 aa, Plasmodium falciparum
NSSN

SEQ ID NO: 3336908 - protein, 8 aa, Plasmodium falciparum
NSSNANNE

SEQ ID NO: 3336909 - protein, 5 aa, Plasmodium falciparum
NSSNH

SEQ ID NO: 3336910 - protein, 20 aa, Plasmodium falciparum
NSSNKNKHNYTSKKNKNNMG

SEQ ID NO: 3336911 - protein, 46 aa, Plasmodium falciparum
NSSNNKNQNGTGNISKKETNKKEVTKTLAKSSSNCTTTTTSSNYKY

SEQ ID NO: 3336912 - protein, 8 aa, Plasmodium falciparum
NSSNNLSD

SEQ ID NO: 3336913 - protein, 6 aa, Plasmodium falciparum
NSSNNN

SEQ ID NO: 3336914 - protein, 10 aa, Plasmodium falciparum
NSSNNNNKKK

SEQ ID NO: 3336915 - protein, 10 aa, Plasmodium falciparum
NSSNNSKNQH

SEQ ID NO: 3336916 - protein, 7 aa, Plasmodium falciparum
NSSNSSS

SEQ ID NO: 3336917 - protein, 21 aa, Plasmodium falciparum
NSSNVSNDKNNLKNRRNENNM

SEQ ID NO: 3336918 - protein, 26 aa, Plasmodium falciparum
NSSPHKGGTKCEPNEGSTTPSRNDGI

SEQ ID NO: 3336919 - protein, 23 aa, Plasmodium falciparum
NSSPLSYNNNKTKIDESDKNGSL

SEQ ID NO: 3336920 - protein, 7 aa, Plasmodium falciparum
NSSPQNT

SEQ ID NO: 3336921 - protein, 9 aa, Plasmodium falciparum
NSSQEINNS

SEQ ID NO: 3336922 - protein, 25 aa, Plasmodium falciparum
NSSQNDTNNQNISNREYNSSIDNTN

SEQ ID NO: 3336923 - protein, 9 aa, Plasmodium falciparum
NSSQNINDI

SEQ ID NO: 3336924 - protein, 6 aa, Plasmodium falciparum
NSSRNN

SEQ ID NO: 3336925 - protein, 8 aa, Plasmodium falciparum
NSSRRNEN

SEQ ID NO: 3336926 - protein, 81 aa, Plasmodium falciparum
NSSRRRRNHSKTINHKKKNKKYSKWDNTKEGNKLDDPLNKKDGKKEKRKNKNYGKDNSLSESEINENSDDNIDDSDYSTNF

SEQ ID NO: 3336927 - protein, 11 aa, Plasmodium falciparum
NSSSENSRHGS

SEQ ID NO: 3336928 - protein, 14 aa, Plasmodium falciparum
NSSSESIEHSQDMD

SEQ ID NO: 3336929 - protein, 6 aa, Plasmodium falciparum
NSSSFQ

SEQ ID NO: 3336930 - protein, 5 aa, Plasmodium falciparum
NSSSL

SEQ ID NO: 3336931 - protein, 29 aa, Plasmodium falciparum
NSSSNDENDCTNNEENIVNDDQEELTDDK

SEQ ID NO: 3336932 - protein, 9 aa, Plasmodium falciparum
NSSSNNKMN

SEQ ID NO: 3336933 - protein, 9 aa, Plasmodium falciparum
NSSSNPHNT

SEQ ID NO: 3336934 - protein, 15 aa, Plasmodium falciparum
NSSSRSSSSSSSIHN

SEQ ID NO: 3336935 - protein, 8 aa, Plasmodium falciparum
NSSSSSDI

SEQ ID NO: 3336936 - protein, 7 aa, Plasmodium falciparum
NSSSTHT

SEQ ID NO: 3336937 - protein, 7 aa, Plasmodium falciparum
NSSSTSS

SEQ ID NO: 3336938 - protein, 6 aa, Plasmodium falciparum
NSSTFK

SEQ ID NO: 3336939 - protein, 5 aa, Plasmodium falciparum
NSSTG

SEQ ID NO: 3336940 - protein, 8 aa, Plasmodium falciparum
NSSTKNRK

SEQ ID NO: 3336941 - protein, 11 aa, Plasmodium falciparum
NSSTNQNNNMN

SEQ ID NO: 3336942 - protein, 8 aa, Plasmodium falciparum
NSSTPTNG

SEQ ID NO: 3336943 - protein, 11 aa, Plasmodium falciparum
NSSTSPDNSDI

SEQ ID NO: 3336944 - protein, 19 aa, Plasmodium falciparum
NSSTYKNNDKIGDNNNSNK

SEQ ID NO: 3336945 - protein, 8 aa, Plasmodium falciparum
NSSVASSK

SEQ ID NO: 3336946 - protein, 15 aa, Plasmodium falciparum
NSSVEDGNDNNHDKN

SEQ ID NO: 3336947 - protein, 14 aa, Plasmodium falciparum
NSSVENLDGKNKLN

SEQ ID NO: 3336948 - protein, 11 aa, Plasmodium falciparum
NSSVSKKTLNE

SEQ ID NO: 3336949 - protein, 10 aa, Plasmodium falciparum
NSSVSKNKTF

SEQ ID NO: 3336950 - protein, 7 aa, Plasmodium falciparum
NSSYKKR

SEQ ID NO: 3336951 - protein, 15 aa, Plasmodium falciparum
NSSYNINQKGNSKVN

SEQ ID NO: 3336952 - protein, 17 aa, Plasmodium falciparum
NSSYTKKYSKLNKSYND

SEQ ID NO: 3336953 - protein, 4 aa, Plasmodium falciparum
NSTC

SEQ ID NO: 3336954 - protein, 14 aa, Plasmodium falciparum
NSTCSDEDNSDESI

SEQ ID NO: 3336955 - protein, 10 aa, Plasmodium falciparum
NSTDTGGAST

SEQ ID NO: 3336956 - protein, 16 aa, Plasmodium falciparum
NSTEDEYKKEEENETV

SEQ ID NO: 3336957 - protein, 6 aa, Plasmodium falciparum
NSTEDF

SEQ ID NO: 3336958 - protein, 7 aa, Plasmodium falciparum
NSTEPYI

SEQ ID NO: 3336959 - protein, 5 aa, Plasmodium falciparum
NSTFD

SEQ ID NO: 3336960 - protein, 6 aa, Plasmodium falciparum
NSTFYD

SEQ ID NO: 3336961 - protein, 11 aa, Plasmodium falciparum
NSTGGNNNNWY

SEQ ID NO: 3336962 - protein, 7 aa, Plasmodium falciparum
NSTGLGK

SEQ ID NO: 3336963 - protein, 6 aa, Plasmodium falciparum
NSTGNY

SEQ ID NO: 3336964 - protein, 5 aa, Plasmodium falciparum
NSTGP

SEQ ID NO: 3336965 - protein, 8 aa, Plasmodium falciparum
NSTHEKNC

SEQ ID NO: 3336966 - protein, 8 aa, Plasmodium falciparum
NSTHTHPR

SEQ ID NO: 3336967 - protein, 4 aa, Plasmodium falciparum
NSTI

SEQ ID NO: 3336968 - protein, 6 aa, Plasmodium falciparum
NSTIDE

SEQ ID NO: 3336969 - protein, 5 aa, Plasmodium falciparum
NSTIN

SEQ ID NO: 3336970 - protein, 11 aa, Plasmodium falciparum
NSTKDQLDDDI

SEQ ID NO: 3336971 - protein, 11 aa, Plasmodium falciparum
NSTKIDGKEYT

SEQ ID NO: 3336972 - protein, 13 aa, Plasmodium falciparum
NSTKQKNKTKKTS

SEQ ID NO: 3336973 - protein, 8 aa, Plasmodium falciparum
NSTKSRAS

SEQ ID NO: 3336974 - protein, 4 aa, Plasmodium falciparum
NSTL

SEQ ID NO: 3336975 - protein, 8 aa, Plasmodium falciparum
NSTLEESK

SEQ ID NO: 3336976 - protein, 7 aa, Plasmodium falciparum
NSTLSSN

SEQ ID NO: 3336977 - protein, 12 aa, Plasmodium falciparum
NSTLSSNTINNN

SEQ ID NO: 3336978 - protein, 7 aa, Plasmodium falciparum
NSTNNMS

SEQ ID NO: 3336979 - protein, 10 aa, Plasmodium falciparum
NSTNNNGTGV

SEQ ID NO: 3336980 - protein, 10 aa, Plasmodium falciparum
NSTNNNSYNK

SEQ ID NO: 3336981 - protein, 14 aa, Plasmodium falciparum
NSTNNSNNEKDEND

SEQ ID NO: 3336982 - protein, 8 aa, Plasmodium falciparum
NSTPIETI

SEQ ID NO: 3336983 - protein, 6 aa, Plasmodium falciparum
NSTPRA

SEQ ID NO: 3336984 - protein, 7 aa, Plasmodium falciparum
NSTPSSA

SEQ ID NO: 3336985 - protein, 6 aa, Plasmodium falciparum
NSTPVQ

SEQ ID NO: 3336986 - protein, 8 aa, Plasmodium falciparum
NSTQGEKH

SEQ ID NO: 3336987 - protein, 5 aa, Plasmodium falciparum
NSTQH

SEQ ID NO: 3336988 - protein, 13 aa, Plasmodium falciparum
NSTQKNKKRSSKI

SEQ ID NO: 3336989 - protein, 4 aa, Plasmodium falciparum
NSTS

SEQ ID NO: 3336990 - protein, 14 aa, Plasmodium falciparum
NSTSDDLKVKEESD

SEQ ID NO: 3336991 - protein, 33 aa, Plasmodium falciparum
NSTSPPTSQAFPNPWASKNTKNKNSINNKNNYN

SEQ ID NO: 3336992 - protein, 15 aa, Plasmodium falciparum
NSTSPSNNDSNVTKE

SEQ ID NO: 3336993 - protein, 18 aa, Plasmodium falciparum
NSTSYYNDDDNDDSKNKN

SEQ ID NO: 3336994 - protein, 9 aa, Plasmodium falciparum
NSTTSEQNL

SEQ ID NO: 3336995 - protein, 13 aa, Plasmodium falciparum
NSTTYENQRKKKR

SEQ ID NO: 3336996 - protein, 7 aa, Plasmodium falciparum
NSTYENI

SEQ ID NO: 3336997 - protein, 5 aa, Plasmodium falciparum
NSTYK

SEQ ID NO: 3336998 - protein, 5 aa, Plasmodium falciparum
NSTYN

SEQ ID NO: 3336999 - protein, 11 aa, Plasmodium falciparum
NSTYNKNNDEY

SEQ ID NO: 3337000 - protein, 13 aa, Plasmodium falciparum
NSVDDNEYEPSSN

SEQ ID NO: 3337001 - protein, 8 aa, Plasmodium falciparum
NSVDNNEK

SEQ ID NO: 3337002 - protein, 34 aa, Plasmodium falciparum
NSVDSDTSNIDDESDSCEQNEDEENYSSVHEQEE

SEQ ID NO: 3337003 - protein, 7 aa, Plasmodium falciparum
NSVDSTT

SEQ ID NO: 3337004 - protein, 6 aa, Plasmodium falciparum
NSVGNN

SEQ ID NO: 3337005 - protein, 5 aa, Plasmodium falciparum
NSVHN

SEQ ID NO: 3337006 - protein, 4 aa, Plasmodium falciparum
NSVK

SEQ ID NO: 3337007 - protein, 8 aa, Plasmodium falciparum
NSVKNDED

SEQ ID NO: 3337008 - protein, 16 aa, Plasmodium falciparum
NSVKTTNKRDKEEKLQ

SEQ ID NO: 3337009 - protein, 4 aa, Plasmodium falciparum
NSVN

SEQ ID NO: 3337010 - protein, 18 aa, Plasmodium falciparum
NSVQRNNNIKKNNSSNEI

SEQ ID NO: 3337011 - protein, 9 aa, Plasmodium falciparum
NSVSNHNSS

SEQ ID NO: 3337012 - protein, 10 aa, Plasmodium falciparum
NSVSNNPHNI

SEQ ID NO: 3337013 - protein, 7 aa, Plasmodium falciparum
NSVSNNV

SEQ ID NO: 3337014 - protein, 6 aa, Plasmodium falciparum
NSVSSN

SEQ ID NO: 3337015 - protein, 10 aa, Plasmodium falciparum
NSVSSYKEDN

SEQ ID NO: 3337016 - protein, 6 aa, Plasmodium falciparum
NSVTSD

SEQ ID NO: 3337017 - protein, 7 aa, Plasmodium falciparum
NSVVGNN

SEQ ID NO: 3337018 - protein, 7 aa, Plasmodium falciparum
NSYATYK

SEQ ID NO: 3337019 - protein, 4 aa, Plasmodium falciparum
NSYD

SEQ ID NO: 3337020 - protein, 11 aa, Plasmodium falciparum
NSYDEEDDYFD

SEQ ID NO: 3337021 - protein, 6 aa, Plasmodium falciparum
NSYDIT

SEQ ID NO: 3337022 - protein, 10 aa, Plasmodium falciparum
NSYDKNTNTH

SEQ ID NO: 3337023 - protein, 13 aa, Plasmodium falciparum
NSYDNNNNNNNNN

SEQ ID NO: 3337024 - protein, 13 aa, Plasmodium falciparum
NSYDTSSKQNYKE

SEQ ID NO: 3337025 - protein, 4 aa, Plasmodium falciparum
NSYE

SEQ ID NO: 3337026 - protein, 23 aa, Plasmodium falciparum
NSYGNINKTHTTNNAVPPPPNVT

SEQ ID NO: 3337027 - protein, 8 aa, Plasmodium falciparum
NSYGREKY

SEQ ID NO: 3337028 - protein, 4 aa, Plasmodium falciparum
NSYI

SEQ ID NO: 3337029 - protein, 6 aa, Plasmodium falciparum
NSYIGN

SEQ ID NO: 3337030 - protein, 5 aa, Plasmodium falciparum
NSYLD

SEQ ID NO: 3337031 - protein, 24 aa, Plasmodium falciparum
NSYNEGRTIPNNSYSGKNSYNNNM

SEQ ID NO: 3337032 - protein, 5 aa, Plasmodium falciparum
NSYNK

SEQ ID NO: 3337033 - protein, 5 aa, Plasmodium falciparum
NSYNN

SEQ ID NO: 3337034 - protein, 10 aa, Plasmodium falciparum
NSYNNNEDDL

SEQ ID NO: 3337035 - protein, 11 aa, Plasmodium falciparum
NSYNNNNNNNI

SEQ ID NO: 3337036 - protein, 22 aa, Plasmodium falciparum
NSYNNPNLKETESEDKKTPDVV

SEQ ID NO: 3337037 - protein, 8 aa, Plasmodium falciparum
NSYNNSEY

SEQ ID NO: 3337038 - protein, 38 aa, Plasmodium falciparum
NSYNQQNNNTLYNEQNNAEQNSSNTYNYNKNSETYNKN

SEQ ID NO: 3337039 - protein, 22 aa, Plasmodium falciparum
NSYNSSSIKNKIEKEMERINFK

SEQ ID NO: 3337040 - protein, 5 aa, Plasmodium falciparum
NSYNV

SEQ ID NO: 3337041 - protein, 4 aa, Plasmodium falciparum
NSYP

SEQ ID NO: 3337042 - protein, 14 aa, Plasmodium falciparum
NSYPYDDEKLSNDE

SEQ ID NO: 3337043 - protein, 22 aa, Plasmodium falciparum
NSYQHNKDIEREKREKNQKNSL

SEQ ID NO: 3337044 - protein, 22 aa, Plasmodium falciparum
NSYQNKNKINDDKDKEKEKPEQ

SEQ ID NO: 3337045 - protein, 11 aa, Plasmodium falciparum
NSYQTDEDYEN

SEQ ID NO: 3337046 - protein, 7 aa, Plasmodium falciparum
NSYRPGD

SEQ ID NO: 3337047 - protein, 8 aa, Plasmodium falciparum
NSYSDDER

SEQ ID NO: 3337048 - protein, 7 aa, Plasmodium falciparum
NSYSDNI

SEQ ID NO: 3337049 - protein, 15 aa, Plasmodium falciparum
NSYSFGKDKKKNNID

SEQ ID NO: 3337050 - protein, 19 aa, Plasmodium falciparum
NSYSGYSSHTSVSVNQDML

SEQ ID NO: 3337051 - protein, 15 aa, Plasmodium falciparum
NSYSLNSDNNNDHMQ

SEQ ID NO: 3337052 - protein, 9 aa, Plasmodium falciparum
NSYSSNINN

SEQ ID NO: 3337053 - protein, 6 aa, Plasmodium falciparum
NSYSST

SEQ ID NO: 3337054 - protein, 10 aa, Plasmodium falciparum
NSYTNEQVPG

SEQ ID NO: 3337055 - protein, 7 aa, Plasmodium falciparum
NSYTNND

SEQ ID NO: 3337056 - protein, 6 aa, Plasmodium falciparum
NSYTNS

SEQ ID NO: 3337057 - protein, 22 aa, Plasmodium falciparum
NSYTSSSGGEFSSYSSGEENFK

SEQ ID NO: 3337058 - protein, 4 aa, Plasmodium falciparum
NSYY

SEQ ID NO: 3337059 - protein, 45 aa, Plasmodium falciparum
NTADKNITTNNNNNNNSNNNNSNNNNSNNNNSNNDCVNNEETNFK

SEQ ID NO: 3337060 - protein, 9 aa, Plasmodium falciparum
NTAKHNKKV

SEQ ID NO: 3337061 - protein, 5 aa, Plasmodium falciparum
NTAKS

SEQ ID NO: 3337062 - protein, 6 aa, Plasmodium falciparum
NTANNT

SEQ ID NO: 3337063 - protein, 13 aa, Plasmodium falciparum
NTANNTATSTGVA

SEQ ID NO: 3337064 - protein, 5 aa, Plasmodium falciparum
NTATS

SEQ ID NO: 3337065 - protein, 5 aa, Plasmodium falciparum
NTAYS

SEQ ID NO: 3337066 - protein, 13 aa, Plasmodium falciparum
NTCDEKNSPDTFN

SEQ ID NO: 3337067 - protein, 9 aa, Plasmodium falciparum
NTCKSKNKI

SEQ ID NO: 3337068 - protein, 12 aa, Plasmodium falciparum
NTCNNNTCNSSC

SEQ ID NO: 3337069 - protein, 11 aa, Plasmodium falciparum
NTCNNQKIEEK

SEQ ID NO: 3337070 - protein, 13 aa, Plasmodium falciparum
NTCQQKEKKKLND

SEQ ID NO: 3337071 - protein, 5 aa, Plasmodium falciparum
NTCSN

SEQ ID NO: 3337072 - protein, 5 aa, Plasmodium falciparum
NTCTS

SEQ ID NO: 3337073 - protein, 15 aa, Plasmodium falciparum
NTDCPNNNSNHDKKI

SEQ ID NO: 3337074 - protein, 4 aa, Plasmodium falciparum
NTDD

SEQ ID NO: 3337075 - protein, 8 aa, Plasmodium falciparum
NTDDTQKV

SEQ ID NO: 3337076 - protein, 7 aa, Plasmodium falciparum
NTDDTYD

SEQ ID NO: 3337077 - protein, 4 aa, Plasmodium falciparum
NTDE

SEQ ID NO: 3337078 - protein, 6 aa, Plasmodium falciparum
NTDESL

SEQ ID NO: 3337079 - protein, 11 aa, Plasmodium falciparum
NTDETNKENKK

SEQ ID NO: 3337080 - protein, 8 aa, Plasmodium falciparum
NTDHKNFN

SEQ ID NO: 3337081 - protein, 4 aa, Plasmodium falciparum
NTDI

SEQ ID NO: 3337082 - protein, 14 aa, Plasmodium falciparum
NTDISKNNLKKRKI

SEQ ID NO: 3337083 - protein, 19 aa, Plasmodium falciparum
NTDISNKNNCEEKSDELKN

SEQ ID NO: 3337084 - protein, 6 aa, Plasmodium falciparum
NTDKEL

SEQ ID NO: 3337085 - protein, 9 aa, Plasmodium falciparum
NTDKGNNNK

SEQ ID NO: 3337086 - protein, 9 aa, Plasmodium falciparum
NTDKKGKKD

SEQ ID NO: 3337087 - protein, 7 aa, Plasmodium falciparum
NTDKTKS

SEQ ID NO: 3337088 - protein, 6 aa, Plasmodium falciparum
NTDMEN

SEQ ID NO: 3337089 - protein, 56 aa, Plasmodium falciparum
NTDNNENVDNNGNVDSNENVDSNENVDSNENVDNNENVDSNENVDNNENMDRNDNM

SEQ ID NO: 3337090 - protein, 5 aa, Plasmodium falciparum
NTDNP

SEQ ID NO: 3337091 - protein, 13 aa, Plasmodium falciparum
NTDPKHTKIENDD

SEQ ID NO: 3337092 - protein, 7 aa, Plasmodium falciparum
NTDPSQN

SEQ ID NO: 3337093 - protein, 11 aa, Plasmodium falciparum
NTDTGGSIRTP

SEQ ID NO: 3337094 - protein, 20 aa, Plasmodium falciparum
NTDVDKSDESPLSEQNAEID

SEQ ID NO: 3337095 - protein, 5 aa, Plasmodium falciparum
NTDVG

SEQ ID NO: 3337096 - protein, 7 aa, Plasmodium falciparum
NTDVTNI

SEQ ID NO: 3337097 - protein, 7 aa, Plasmodium falciparum
NTEDENK

SEQ ID NO: 3337098 - protein, 8 aa, Plasmodium falciparum
NTEDSNAN

SEQ ID NO: 3337099 - protein, 6 aa, Plasmodium falciparum
NTEDSP

SEQ ID NO: 3337100 - protein, 9 aa, Plasmodium falciparum
NTEEEENKE

SEQ ID NO: 3337101 - protein, 5 aa, Plasmodium falciparum
NTEEN

SEQ ID NO: 3337102 - protein, 7 aa, Plasmodium falciparum
NTEGKEC

SEQ ID NO: 3337103 - protein, 21 aa, Plasmodium falciparum
NTEGNNNKNNNNNNNNEHGEH

SEQ ID NO: 3337104 - protein, 17 aa, Plasmodium falciparum
NTEGYNSRRNLQNKNTR

SEQ ID NO: 3337105 - protein, 7 aa, Plasmodium falciparum
NTEHEKY

SEQ ID NO: 3337106 - protein, 24 aa, Plasmodium falciparum
NTEHTDHEKDRKSVSFEQEKSELI

SEQ ID NO: 3337107 - protein, 7 aa, Plasmodium falciparum
NTEIAKK

SEQ ID NO: 3337108 - protein, 59 aa, Plasmodium falciparum
NTEKAKSKSKSVEINKNSKAINKSKNNDNKNKYKTKNKSKNVNISTDHTNNNNNNNNYK

SEQ ID NO: 3337109 - protein, 10 aa, Plasmodium falciparum
NTEKKEKKNV

SEQ ID NO: 3337110 - protein, 10 aa, Plasmodium falciparum
NTEKKKKIGK

SEQ ID NO: 3337111 - protein, 13 aa, Plasmodium falciparum
NTEKKKKKSVYSK

SEQ ID NO: 3337112 - protein, 6 aa, Plasmodium falciparum
NTEKNI

SEQ ID NO: 3337113 - protein, 6 aa, Plasmodium falciparum
NTEKNN

SEQ ID NO: 3337114 - protein, 4 aa, Plasmodium falciparum
NTEN

SEQ ID NO: 3337115 - protein, 6 aa, Plasmodium falciparum
NTENAN

SEQ ID NO: 3337116 - protein, 7 aa, Plasmodium falciparum
NTENDIR

SEQ ID NO: 3337117 - protein, 10 aa, Plasmodium falciparum
NTENDNKTIT

SEQ ID NO: 3337118 - protein, 5 aa, Plasmodium falciparum
NTENK

SEQ ID NO: 3337119 - protein, 6 aa, Plasmodium falciparum
NTENNN

SEQ ID NO: 3337120 - protein, 6 aa, Plasmodium falciparum
NTEPYS

SEQ ID NO: 3337121 - protein, 14 aa, Plasmodium falciparum
NTEQRKTANRKAKH

SEQ ID NO: 3337122 - protein, 4 aa, Plasmodium falciparum
NTES

SEQ ID NO: 3337123 - protein, 7 aa, Plasmodium falciparum
NTESDHR

SEQ ID NO: 3337124 - protein, 9 aa, Plasmodium falciparum
NTESINEEN

SEQ ID NO: 3337125 - protein, 9 aa, Plasmodium falciparum
NTESSNDPL

SEQ ID NO: 3337126 - protein, 4 aa, Plasmodium falciparum
NTET

SEQ ID NO: 3337127 - protein, 12 aa, Plasmodium falciparum
NTETEDITSNGI

SEQ ID NO: 3337128 - protein, 13 aa, Plasmodium falciparum
NTETQNNNNNNKD

SEQ ID NO: 3337129 - protein, 8 aa, Plasmodium falciparum
NTFEEEKT

SEQ ID NO: 3337130 - protein, 12 aa, Plasmodium falciparum
NTFEKKKKSHLG

SEQ ID NO: 3337131 - protein, 9 aa, Plasmodium falciparum
NTFKENNDN

SEQ ID NO: 3337132 - protein, 14 aa, Plasmodium falciparum
NTFKKENTNIMSRD

SEQ ID NO: 3337133 - protein, 13 aa, Plasmodium falciparum
NTFLPTSNKVDEN

SEQ ID NO: 3337134 - protein, 14 aa, Plasmodium falciparum
NTFSTKNKQNNNYH

SEQ ID NO: 3337135 - protein, 4 aa, Plasmodium falciparum
NTFT

SEQ ID NO: 3337136 - protein, 14 aa, Plasmodium falciparum
NTGANNGANNGVEE

SEQ ID NO: 3337137 - protein, 6 aa, Plasmodium falciparum
NTGECN

SEQ ID NO: 3337138 - protein, 4 aa, Plasmodium falciparum
NTGG

SEQ ID NO: 3337139 - protein, 19 aa, Plasmodium falciparum
NTGGTNNSLIGTTTNTSFS

SEQ ID NO: 3337140 - protein, 29 aa, Plasmodium falciparum
NTGHKNSGSVSNSRSDSISGSNNLNDMND

SEQ ID NO: 3337141 - protein, 7 aa, Plasmodium falciparum
NTGHSKG

SEQ ID NO: 3337142 - protein, 10 aa, Plasmodium falciparum
NTGKQLKKNN

SEQ ID NO: 3337143 - protein, 10 aa, Plasmodium falciparum
NTGLNSSTDI

SEQ ID NO: 3337144 - protein, 11 aa, Plasmodium falciparum
NTGNDENNNRN

SEQ ID NO: 3337145 - protein, 7 aa, Plasmodium falciparum
NTGNEFP

SEQ ID NO: 3337146 - protein, 7 aa, Plasmodium falciparum
NTGPNTN

SEQ ID NO: 3337147 - protein, 6 aa, Plasmodium falciparum
NTGRYH

SEQ ID NO: 3337148 - protein, 4 aa, Plasmodium falciparum
NTGY

SEQ ID NO: 3337149 - protein, 4 aa, Plasmodium falciparum
NTHE

SEQ ID NO: 3337150 - protein, 33 aa, Plasmodium falciparum
NTHHTNDHHNNTHHTSDHHNNTHHNNNKNNGKL

SEQ ID NO: 3337151 - protein, 18 aa, Plasmodium falciparum
NTHMNNNKNNNNNNNKNN

SEQ ID NO: 3337152 - protein, 5 aa, Plasmodium falciparum
NTHNK

SEQ ID NO: 3337153 - protein, 12 aa, Plasmodium falciparum
NTHNNNNNNIKK

SEQ ID NO: 3337154 - protein, 14 aa, Plasmodium falciparum
NTHNNNNNNNNINS

SEQ ID NO: 3337155 - protein, 43 aa, Plasmodium falciparum
NTHSNKENKNDNHNNNSNNSNNSSRSNNHNNNNNSNNNYANSY

SEQ ID NO: 3337156 - protein, 11 aa, Plasmodium falciparum
NTHTKKNDEKK

SEQ ID NO: 3337157 - protein, 10 aa, Plasmodium falciparum
NTHYNNQSTH

SEQ ID NO: 3337158 - protein, 4 aa, Plasmodium falciparum
NTID

SEQ ID NO: 3337159 - protein, 13 aa, Plasmodium falciparum
NTIDKDKDKDYDS

SEQ ID NO: 3337160 - protein, 9 aa, Plasmodium falciparum
NTIDNENNK

SEQ ID NO: 3337161 - protein, 6 aa, Plasmodium falciparum
NTIDTN

SEQ ID NO: 3337162 - protein, 17 aa, Plasmodium falciparum
NTIEDSHREEVKSSRKD

SEQ ID NO: 3337163 - protein, 5 aa, Plasmodium falciparum
NTIGN

SEQ ID NO: 3337164 - protein, 19 aa, Plasmodium falciparum
NTIGNTNNNRYSTRNNTAA

SEQ ID NO: 3337165 - protein, 19 aa, Plasmodium falciparum
NTIKEEQNEITNKRPKNLY

SEQ ID NO: 3337166 - protein, 11 aa, Plasmodium falciparum
NTIKEKKEYYK

SEQ ID NO: 3337167 - protein, 18 aa, Plasmodium falciparum
NTIKNEDNKKRKSIVTTT

SEQ ID NO: 3337168 - protein, 4 aa, Plasmodium falciparum
NTIN

SEQ ID NO: 3337169 - protein, 16 aa, Plasmodium falciparum
NTINGKKNGTKYITGG

SEQ ID NO: 3337170 - protein, 11 aa, Plasmodium falciparum
NTINNNKTENV

SEQ ID NO: 3337171 - protein, 10 aa, Plasmodium falciparum
NTINNNNNNF

SEQ ID NO: 3337172 - protein, 14 aa, Plasmodium falciparum
NTINNNTINNNTVN

SEQ ID NO: 3337173 - protein, 13 aa, Plasmodium falciparum
NTINNTNNTNNIN

SEQ ID NO: 3337174 - protein, 7 aa, Plasmodium falciparum
NTINPSN

SEQ ID NO: 3337175 - protein, 6 aa, Plasmodium falciparum
NTIPDK

SEQ ID NO: 3337176 - protein, 10 aa, Plasmodium falciparum
NTIPDNVTDE

SEQ ID NO: 3337177 - protein, 9 aa, Plasmodium falciparum
NTIPKKEEI

SEQ ID NO: 3337178 - protein, 5 aa, Plasmodium falciparum
NTIPS

SEQ ID NO: 3337179 - protein, 4 aa, Plasmodium falciparum
NTIQ

SEQ ID NO: 3337180 - protein, 4 aa, Plasmodium falciparum
NTIS

SEQ ID NO: 3337181 - protein, 11 aa, Plasmodium falciparum
NTISEENISKG

SEQ ID NO: 3337182 - protein, 9 aa, Plasmodium falciparum
NTISKDDNT

SEQ ID NO: 3337183 - protein, 14 aa, Plasmodium falciparum
NTISNKKKFDSNQK

SEQ ID NO: 3337184 - protein, 45 aa, Plasmodium falciparum
NTITANEANETNEANEANKSNLTNEANKSNVTNLTNEANKSNVTN

SEQ ID NO: 3337185 - protein, 23 aa, Plasmodium falciparum
NTITNPSSSILTQSEETLKNKKR

SEQ ID NO: 3337186 - protein, 15 aa, Plasmodium falciparum
NTKDDKENITNVSSN

SEQ ID NO: 3337187 - protein, 5 aa, Plasmodium falciparum
NTKDE

SEQ ID NO: 3337188 - protein, 16 aa, Plasmodium falciparum
NTKDHVDDKFHKTENM

SEQ ID NO: 3337189 - protein, 40 aa, Plasmodium falciparum
NTKDNDVTSNLSDRLKDDNNNDNNNDNNNNDDEINESSNN

SEQ ID NO: 3337190 - protein, 4 aa, Plasmodium falciparum
NTKE

SEQ ID NO: 3337191 - protein, 128 aa, Plasmodium falciparum
NTKEDNNMNGDNINGDNNNNHNNINGDNNNNHNNINGDNNNNNHNNINGDNNNNHNNINGDNNNNNHNNINGDNNNNHNNINGDNNNNHNNSHNNNSHNNNNKAENSLGQPLNEKNINDPINKHRNSQ

SEQ ID NO: 3337192 - protein, 5 aa, Plasmodium falciparum
NTKEE

SEQ ID NO: 3337193 - protein, 6 aa, Plasmodium falciparum
NTKEED

SEQ ID NO: 3337194 - protein, 7 aa, Plasmodium falciparum
NTKEEES

SEQ ID NO: 3337195 - protein, 7 aa, Plasmodium falciparum
NTKEEHV

SEQ ID NO: 3337196 - protein, 7 aa, Plasmodium falciparum
NTKEEKY

SEQ ID NO: 3337197 - protein, 11 aa, Plasmodium falciparum
NTKEKESIPDA

SEQ ID NO: 3337198 - protein, 13 aa, Plasmodium falciparum
NTKEKNYISEESN

SEQ ID NO: 3337199 - protein, 9 aa, Plasmodium falciparum
NTKELNKPT

SEQ ID NO: 3337200 - protein, 12 aa, Plasmodium falciparum
NTKERNKVKDNI

SEQ ID NO: 3337201 - protein, 12 aa, Plasmodium falciparum
NTKESNKFIEEE

SEQ ID NO: 3337202 - protein, 9 aa, Plasmodium falciparum
NTKESYKMN

SEQ ID NO: 3337203 - protein, 5 aa, Plasmodium falciparum
NTKHT

SEQ ID NO: 3337204 - protein, 4 aa, Plasmodium falciparum
NTKK

SEQ ID NO: 3337205 - protein, 10 aa, Plasmodium falciparum
NTKKDKNEPL

SEQ ID NO: 3337206 - protein, 12 aa, Plasmodium falciparum
NTKKDREDDTEY

SEQ ID NO: 3337207 - protein, 15 aa, Plasmodium falciparum
NTKKGVTQKGADNLN

SEQ ID NO: 3337208 - protein, 9 aa, Plasmodium falciparum
NTKKLKREK

SEQ ID NO: 3337209 - protein, 6 aa, Plasmodium falciparum
NTKKNI

SEQ ID NO: 3337210 - protein, 27 aa, Plasmodium falciparum
NTKKNKDNNDNNNNNNNNNNNNNNNNY

SEQ ID NO: 3337211 - protein, 10 aa, Plasmodium falciparum
NTKKNRYSNN

SEQ ID NO: 3337212 - protein, 25 aa, Plasmodium falciparum
NTKKRGSKFDGTYRNDDENDVERSY

SEQ ID NO: 3337213 - protein, 4 aa, Plasmodium falciparum
NTKN

SEQ ID NO: 3337214 - protein, 8 aa, Plasmodium falciparum
NTKNEISN

SEQ ID NO: 3337215 - protein, 8 aa, Plasmodium falciparum
NTKNENKI

SEQ ID NO: 3337216 - protein, 7 aa, Plasmodium falciparum
NTKNESD

SEQ ID NO: 3337217 - protein, 14 aa, Plasmodium falciparum
NTKNFKKNKKINNI

SEQ ID NO: 3337218 - protein, 7 aa, Plasmodium falciparum
NTKNIQE

SEQ ID NO: 3337219 - protein, 5 aa, Plasmodium falciparum
NTKNK

SEQ ID NO: 3337220 - protein, 24 aa, Plasmodium falciparum
NTKNKDKDKDEDIHNNDKKKGNYS

SEQ ID NO: 3337221 - protein, 10 aa, Plasmodium falciparum
NTKNPYQNIS

SEQ ID NO: 3337222 - protein, 24 aa, Plasmodium falciparum
NTKNQNVKDKNEYLNKTKKKKEQN

SEQ ID NO: 3337223 - protein, 7 aa, Plasmodium falciparum
NTKNSHS

SEQ ID NO: 3337224 - protein, 7 aa, Plasmodium falciparum
NTKPINK

SEQ ID NO: 3337225 - protein, 39 aa, Plasmodium falciparum
NTKPIRKKDTNIQKNNKTSLKKKETKPNNNAQEEKNNDI

SEQ ID NO: 3337226 - protein, 7 aa, Plasmodium falciparum
NTKQDHI

SEQ ID NO: 3337227 - protein, 12 aa, Plasmodium falciparum
NTKQKTQDGQIS

SEQ ID NO: 3337228 - protein, 8 aa, Plasmodium falciparum
NTKQNDYD

SEQ ID NO: 3337229 - protein, 13 aa, Plasmodium falciparum
NTKREEGRKTQLS

SEQ ID NO: 3337230 - protein, 4 aa, Plasmodium falciparum
NTKS

SEQ ID NO: 3337231 - protein, 7 aa, Plasmodium falciparum
NTKSDIG

SEQ ID NO: 3337232 - protein, 9 aa, Plasmodium falciparum
NTKSKYKGD

SEQ ID NO: 3337233 - protein, 7 aa, Plasmodium falciparum
NTKSLQD

SEQ ID NO: 3337234 - protein, 6 aa, Plasmodium falciparum
NTKSNK

SEQ ID NO: 3337235 - protein, 5 aa, Plasmodium falciparum
NTKTA

SEQ ID NO: 3337236 - protein, 40 aa, Plasmodium falciparum
NTKTEQNDEVKSKRKTKKNPTKTNSSKVPKSKTENNGEKK

SEQ ID NO: 3337237 - protein, 22 aa, Plasmodium falciparum
NTKTKSRKRKKEKDQIDNVLKR

SEQ ID NO: 3337238 - protein, 10 aa, Plasmodium falciparum
NTKVSTNNNE

SEQ ID NO: 3337239 - protein, 11 aa, Plasmodium falciparum
NTKWNESQYDN

SEQ ID NO: 3337240 - protein, 25 aa, Plasmodium falciparum
NTKYDDETGEKDKNETKTKNKQDTL

SEQ ID NO: 3337241 - protein, 11 aa, Plasmodium falciparum
NTLANDNKDEM

SEQ ID NO: 3337242 - protein, 5 aa, Plasmodium falciparum
NTLDS

SEQ ID NO: 3337243 - protein, 11 aa, Plasmodium falciparum
NTLENDNSDDI

SEQ ID NO: 3337244 - protein, 9 aa, Plasmodium falciparum
NTLESNEKK

SEQ ID NO: 3337245 - protein, 7 aa, Plasmodium falciparum
NTLGNPH

SEQ ID NO: 3337246 - protein, 136 aa, Plasmodium falciparum
NTLKNSLSNGISKRKKNLENNEDDETNVGRNDEDDDDEDDEDDEDEEEDDDEEDEDDEEDDEDDDDEEEEDEEDEDEEGEDEDDEEDEEEEEEEDEEGEDVENKKKGGDKKKNKRSLDNKSDGPLKKSKIDDEGQF

SEQ ID NO: 3337247 - protein, 5 aa, Plasmodium falciparum
NTLNE

SEQ ID NO: 3337248 - protein, 11 aa, Plasmodium falciparum
NTLNNENMNSL

SEQ ID NO: 3337249 - protein, 5 aa, Plasmodium falciparum
NTLNR

SEQ ID NO: 3337250 - protein, 5 aa, Plasmodium falciparum
NTLNY

SEQ ID NO: 3337251 - protein, 8 aa, Plasmodium falciparum
NTLPSTKE

SEQ ID NO: 3337252 - protein, 19 aa, Plasmodium falciparum
NTLQQKEEEQYKNHEEKEK

SEQ ID NO: 3337253 - protein, 6 aa, Plasmodium falciparum
NTLRSK

SEQ ID NO: 3337254 - protein, 10 aa, Plasmodium falciparum
NTLSNKDNFS

SEQ ID NO: 3337255 - protein, 18 aa, Plasmodium falciparum
NTLSNTANTFGSTTNTSN

SEQ ID NO: 3337256 - protein, 37 aa, Plasmodium falciparum
NTLSQYSNTSVENGKYKYENKYQGNIRNTSKDVYNEN

SEQ ID NO: 3337257 - protein, 29 aa, Plasmodium falciparum
NTLSSYENTLSDNNESMNSAHDNKKKGIN

SEQ ID NO: 3337258 - protein, 23 aa, Plasmodium falciparum
NTLTSQEKKMEEKDFWENLKYAN

SEQ ID NO: 3337259 - protein, 17 aa, Plasmodium falciparum
NTLTSSFDDNSYNKGKR

SEQ ID NO: 3337260 - protein, 7 aa, Plasmodium falciparum
NTMKSPV

SEQ ID NO: 3337261 - protein, 10 aa, Plasmodium falciparum
NTMNGTKTNN

SEQ ID NO: 3337262 - protein, 56 aa, Plasmodium falciparum
NTMNNNNNDNNNNNNNNNNNNNNNNNNNNNNNNNNNNNNNNNNNNNNNNNNNNSWS

SEQ ID NO: 3337263 - protein, 13 aa, Plasmodium falciparum
NTNCNNDNVRRKK

SEQ ID NO: 3337264 - protein, 7 aa, Plasmodium falciparum
NTNDDEV

SEQ ID NO: 3337265 - protein, 5 aa, Plasmodium falciparum
NTNDE

SEQ ID NO: 3337266 - protein, 6 aa, Plasmodium falciparum
NTNDGH

SEQ ID NO: 3337267 - protein, 11 aa, Plasmodium falciparum
NTNDGKNQTNG

SEQ ID NO: 3337268 - protein, 5 aa, Plasmodium falciparum
NTNDH

SEQ ID NO: 3337269 - protein, 7 aa, Plasmodium falciparum
NTNDHSN

SEQ ID NO: 3337270 - protein, 8 aa, Plasmodium falciparum
NTNDQKVN

SEQ ID NO: 3337271 - protein, 4 aa, Plasmodium falciparum
NTNE

SEQ ID NO: 3337272 - protein, 8 aa, Plasmodium falciparum
NTNEEDIS

SEQ ID NO: 3337273 - protein, 9 aa, Plasmodium falciparum
NTNEEDSRN

SEQ ID NO: 3337274 - protein, 13 aa, Plasmodium falciparum
NTNEEGNKNKYDN

SEQ ID NO: 3337275 - protein, 9 aa, Plasmodium falciparum
NTNEKLEKE

SEQ ID NO: 3337276 - protein, 6 aa, Plasmodium falciparum
NTNEKP

SEQ ID NO: 3337277 - protein, 5 aa, Plasmodium falciparum
NTNEL

SEQ ID NO: 3337278 - protein, 9 aa, Plasmodium falciparum
NTNENEYSE

SEQ ID NO: 3337279 - protein, 68 aa, Plasmodium falciparum
NTNENIDEEEDAEEDDEDDEEDEEEDEEEDEDEDNDDNDNGDNSDDDDDDNNDNNDDNNSGKKNSDRN

SEQ ID NO: 3337280 - protein, 10 aa, Plasmodium falciparum
NTNETEEAKN

SEQ ID NO: 3337281 - protein, 4 aa, Plasmodium falciparum
NTNF

SEQ ID NO: 3337282 - protein, 12 aa, Plasmodium falciparum
NTNFDSNNEHLN

SEQ ID NO: 3337283 - protein, 8 aa, Plasmodium falciparum
NTNGSYEN

SEQ ID NO: 3337284 - protein, 6 aa, Plasmodium falciparum
NTNHMN

SEQ ID NO: 3337285 - protein, 4 aa, Plasmodium falciparum
NTNI

SEQ ID NO: 3337286 - protein, 7 aa, Plasmodium falciparum
NTNIDDH

SEQ ID NO: 3337287 - protein, 8 aa, Plasmodium falciparum
NTNIGEES

SEQ ID NO: 3337288 - protein, 20 aa, Plasmodium falciparum
NTNIKPTKKHGKNKKSEYSP

SEQ ID NO: 3337289 - protein, 5 aa, Plasmodium falciparum
NTNIS

SEQ ID NO: 3337290 - protein, 5 aa, Plasmodium falciparum
NTNIT

SEQ ID NO: 3337291 - protein, 9 aa, Plasmodium falciparum
NTNKGIEDN

SEQ ID NO: 3337292 - protein, 57 aa, Plasmodium falciparum
NTNKGNETLNETINKDNKKEKIIKENNNNNNNISNNNNKKNNLEHDHNKNKHYKKNS

SEQ ID NO: 3337293 - protein, 15 aa, Plasmodium falciparum
NTNKHRDQNNEQDDI

SEQ ID NO: 3337294 - protein, 11 aa, Plasmodium falciparum
NTNKKRIASYN

SEQ ID NO: 3337295 - protein, 9 aa, Plasmodium falciparum
NTNKNIKSV

SEQ ID NO: 3337296 - protein, 12 aa, Plasmodium falciparum
NTNKNNDHYNNN

SEQ ID NO: 3337297 - protein, 8 aa, Plasmodium falciparum
NTNKNNMN

SEQ ID NO: 3337298 - protein, 7 aa, Plasmodium falciparum
NTNKNNS

SEQ ID NO: 3337299 - protein, 8 aa, Plasmodium falciparum
NTNKPLNP

SEQ ID NO: 3337300 - protein, 5 aa, Plasmodium falciparum
NTNKV

SEQ ID NO: 3337301 - protein, 4 aa, Plasmodium falciparum
NTNL

SEQ ID NO: 3337302 - protein, 6 aa, Plasmodium falciparum
NTNLET

SEQ ID NO: 3337303 - protein, 7 aa, Plasmodium falciparum
NTNLGST

SEQ ID NO: 3337304 - protein, 10 aa, Plasmodium falciparum
NTNLNNQNKD

SEQ ID NO: 3337305 - protein, 7 aa, Plasmodium falciparum
NTNLSEK

SEQ ID NO: 3337306 - protein, 4 aa, Plasmodium falciparum
NTNN

SEQ ID NO: 3337307 - protein, 21 aa, Plasmodium falciparum
NTNNDDTSTLNAQDTSDQHDN

SEQ ID NO: 3337308 - protein, 10 aa, Plasmodium falciparum
NTNNENKNNK

SEQ ID NO: 3337309 - protein, 21 aa, Plasmodium falciparum
NTNNEYDSNYEEQKYNTNDDN

SEQ ID NO: 3337310 - protein, 21 aa, Plasmodium falciparum
NTNNGNNSSMYNNTNNEDNNE

SEQ ID NO: 3337311 - protein, 29 aa, Plasmodium falciparum
NTNNIDNTNNIDNTNNIDNTNNIDNTNNI

SEQ ID NO: 3337312 - protein, 8 aa, Plasmodium falciparum
NTNNIKNT

SEQ ID NO: 3337313 - protein, 13 aa, Plasmodium falciparum
NTNNINDIEENNK

SEQ ID NO: 3337314 - protein, 5 aa, Plasmodium falciparum
NTNNK

SEQ ID NO: 3337315 - protein, 6 aa, Plasmodium falciparum
NTNNKD

SEQ ID NO: 3337316 - protein, 9 aa, Plasmodium falciparum
NTNNKKNDI

SEQ ID NO: 3337317 - protein, 12 aa, Plasmodium falciparum
NTNNKNKMQSYE

SEQ ID NO: 3337318 - protein, 9 aa, Plasmodium falciparum
NTNNLDNKN

SEQ ID NO: 3337319 - protein, 8 aa, Plasmodium falciparum
NTNNNLSN

SEQ ID NO: 3337320 - protein, 14 aa, Plasmodium falciparum
NTNNNMDNKNNSHI

SEQ ID NO: 3337321 - protein, 18 aa, Plasmodium falciparum
NTNNNNNNNNNDNNDNIY

SEQ ID NO: 3337322 - protein, 12 aa, Plasmodium falciparum
NTNNNNNNNNNI

SEQ ID NO: 3337323 - protein, 134 aa, Plasmodium falciparum
NTNNNNNNNNNNNNNNSINNSSKNEVSQKNGKDNENKNENENEDKNKNEDEDKNKNDDHNNKKEDDNDDNNNNSSNNNNNSNNSSNNNSNNNSNNNSNNNNSNNSNNNNNNTNRNMSSNNNRNNNNTNESSGNN

SEQ ID NO: 3337324 - protein, 134 aa, Plasmodium falciparum
NTNNPPNTDNNNNNNNNADNRNNDNDNNNTNNNNNNNNNNNNNGGSNNSSGSTNNNGGNNSANNHTNNNNNNNNNNNNNSNNNSNNNNSNNNNNNNSNNNSNNNNHSSSSNNAPNSSHANNNHSNDNNINNNYR

SEQ ID NO: 3337325 - protein, 5 aa, Plasmodium falciparum
NTNNT

SEQ ID NO: 3337326 - protein, 7 aa, Plasmodium falciparum
NTNNTNI

SEQ ID NO: 3337327 - protein, 47 aa, Plasmodium falciparum
NTNNTNNTNNANNANNANNTNNTNNANNANNTNNTNNANNTNNTNNA

SEQ ID NO: 3337328 - protein, 6 aa, Plasmodium falciparum
NTNPYN

SEQ ID NO: 3337329 - protein, 6 aa, Plasmodium falciparum
NTNQEV

SEQ ID NO: 3337330 - protein, 6 aa, Plasmodium falciparum
NTNQIN

SEQ ID NO: 3337331 - protein, 6 aa, Plasmodium falciparum
NTNQLT

SEQ ID NO: 3337332 - protein, 13 aa, Plasmodium falciparum
NTNQNTSNINNQT

SEQ ID NO: 3337333 - protein, 5 aa, Plasmodium falciparum
NTNQP

SEQ ID NO: 3337334 - protein, 10 aa, Plasmodium falciparum
NTNQQERAIQ

SEQ ID NO: 3337335 - protein, 8 aa, Plasmodium falciparum
NTNQTKKN

SEQ ID NO: 3337336 - protein, 5 aa, Plasmodium falciparum
NTNRA

SEQ ID NO: 3337337 - protein, 10 aa, Plasmodium falciparum
NTNRSNEYYS

SEQ ID NO: 3337338 - protein, 6 aa, Plasmodium falciparum
NTNRSP

SEQ ID NO: 3337339 - protein, 34 aa, Plasmodium falciparum
NTNSDINNNKMDENEHNNGNGNSNDNDNGNGNGN

SEQ ID NO: 3337340 - protein, 13 aa, Plasmodium falciparum
NTNSIKRNYESNN

SEQ ID NO: 3337341 - protein, 6 aa, Plasmodium falciparum
NTNSKE

SEQ ID NO: 3337342 - protein, 9 aa, Plasmodium falciparum
NTNSNNNMF

SEQ ID NO: 3337343 - protein, 35 aa, Plasmodium falciparum
NTNSNSNTNSNSNTNSNSNDHFKEAKDEGNNNPVD

SEQ ID NO: 3337344 - protein, 11 aa, Plasmodium falciparum
NTNSVKEKKND

SEQ ID NO: 3337345 - protein, 16 aa, Plasmodium falciparum
NTNTEQNKSKITRKNT

SEQ ID NO: 3337346 - protein, 5 aa, Plasmodium falciparum
NTNTI

SEQ ID NO: 3337347 - protein, 13 aa, Plasmodium falciparum
NTNTLNNNNNNNN

SEQ ID NO: 3337348 - protein, 15 aa, Plasmodium falciparum
NTNTQTQNASNNSNN

SEQ ID NO: 3337349 - protein, 4 aa, Plasmodium falciparum
NTNV

SEQ ID NO: 3337350 - protein, 26 aa, Plasmodium falciparum
NTNVNSSIQSLEDKRKDKTHKNTRNY

SEQ ID NO: 3337351 - protein, 10 aa, Plasmodium falciparum
NTNVQNSDFG

SEQ ID NO: 3337352 - protein, 11 aa, Plasmodium falciparum
NTNVRQKSESH

SEQ ID NO: 3337353 - protein, 21 aa, Plasmodium falciparum
NTNVSDTLENNNNDNNNNNNM

SEQ ID NO: 3337354 - protein, 6 aa, Plasmodium falciparum
NTNYDE

SEQ ID NO: 3337355 - protein, 17 aa, Plasmodium falciparum
NTNYEDDDENNENSEGI

SEQ ID NO: 3337356 - protein, 40 aa, Plasmodium falciparum
NTNYKNNNKKKIKYNNNDDNNDNGDNDDDNNNDNNDNNNN

SEQ ID NO: 3337357 - protein, 5 aa, Plasmodium falciparum
NTPDV

SEQ ID NO: 3337358 - protein, 7 aa, Plasmodium falciparum
NTPEYIN

SEQ ID NO: 3337359 - protein, 4 aa, Plasmodium falciparum
NTPF

SEQ ID NO: 3337360 - protein, 8 aa, Plasmodium falciparum
NTPGSTMT

SEQ ID NO: 3337361 - protein, 4 aa, Plasmodium falciparum
NTPK

SEQ ID NO: 3337362 - protein, 12 aa, Plasmodium falciparum
NTPLKGKNNANL

SEQ ID NO: 3337363 - protein, 13 aa, Plasmodium falciparum
NTPLSASNVSGYN

SEQ ID NO: 3337364 - protein, 4 aa, Plasmodium falciparum
NTPN

SEQ ID NO: 3337365 - protein, 5 aa, Plasmodium falciparum
NTPND

SEQ ID NO: 3337366 - protein, 10 aa, Plasmodium falciparum
NTPNYKNLQE

SEQ ID NO: 3337367 - protein, 6 aa, Plasmodium falciparum
NTPRHE

SEQ ID NO: 3337368 - protein, 7 aa, Plasmodium falciparum
NTPSNKN

SEQ ID NO: 3337369 - protein, 32 aa, Plasmodium falciparum
NTPSQKVSEKRNNNNNNNNVLGDKNKNKNNDE

SEQ ID NO: 3337370 - protein, 6 aa, Plasmodium falciparum
NTPTDV

SEQ ID NO: 3337371 - protein, 7 aa, Plasmodium falciparum
NTPTENL

SEQ ID NO: 3337372 - protein, 5 aa, Plasmodium falciparum
NTPTL

SEQ ID NO: 3337373 - protein, 6 aa, Plasmodium falciparum
NTPTSV

SEQ ID NO: 3337374 - protein, 5 aa, Plasmodium falciparum
NTPTV

SEQ ID NO: 3337375 - protein, 5 aa, Plasmodium falciparum
NTPVH

SEQ ID NO: 3337376 - protein, 5 aa, Plasmodium falciparum
NTPWS

SEQ ID NO: 3337377 - protein, 8 aa, Plasmodium falciparum
NTQEKSPN

SEQ ID NO: 3337378 - protein, 6 aa, Plasmodium falciparum
NTQEND

SEQ ID NO: 3337379 - protein, 13 aa, Plasmodium falciparum
NTQESAQRKKLDD

SEQ ID NO: 3337380 - protein, 5 aa, Plasmodium falciparum
NTQFH

SEQ ID NO: 3337381 - protein, 14 aa, Plasmodium falciparum
NTQGANKYNKKNNI

SEQ ID NO: 3337382 - protein, 10 aa, Plasmodium falciparum
NTQGGDNNIT

SEQ ID NO: 3337383 - protein, 9 aa, Plasmodium falciparum
NTQGSNNIY

SEQ ID NO: 3337384 - protein, 4 aa, Plasmodium falciparum
NTQH

SEQ ID NO: 3337385 - protein, 4 aa, Plasmodium falciparum
NTQI

SEQ ID NO: 3337386 - protein, 8 aa, Plasmodium falciparum
NTQIKQRD

SEQ ID NO: 3337387 - protein, 5 aa, Plasmodium falciparum
NTQKD

SEQ ID NO: 3337388 - protein, 5 aa, Plasmodium falciparum
NTQKK

SEQ ID NO: 3337389 - protein, 25 aa, Plasmodium falciparum
NTQKKDNNNNNNNNNNNNNNNNNVH

SEQ ID NO: 3337390 - protein, 9 aa, Plasmodium falciparum
NTQKKIPEL

SEQ ID NO: 3337391 - protein, 17 aa, Plasmodium falciparum
NTQKKNMDTEREDEINE

SEQ ID NO: 3337392 - protein, 7 aa, Plasmodium falciparum
NTQKSPH

SEQ ID NO: 3337393 - protein, 4 aa, Plasmodium falciparum
NTQL

SEQ ID NO: 3337394 - protein, 4 aa, Plasmodium falciparum
NTQM

SEQ ID NO: 3337395 - protein, 4 aa, Plasmodium falciparum
NTQN

SEQ ID NO: 3337396 - protein, 5 aa, Plasmodium falciparum
NTQNC

SEQ ID NO: 3337397 - protein, 23 aa, Plasmodium falciparum
NTQNDLNKNNMNNNNNNNNNSNS

SEQ ID NO: 3337398 - protein, 12 aa, Plasmodium falciparum
NTQNNKDDINNN

SEQ ID NO: 3337399 - protein, 11 aa, Plasmodium falciparum
NTQNNNDADTM

SEQ ID NO: 3337400 - protein, 8 aa, Plasmodium falciparum
NTQNNSVS

SEQ ID NO: 3337401 - protein, 9 aa, Plasmodium falciparum
NTQNQIYQP

SEQ ID NO: 3337402 - protein, 9 aa, Plasmodium falciparum
NTQNTIQTN

SEQ ID NO: 3337403 - protein, 5 aa, Plasmodium falciparum
NTQPN

SEQ ID NO: 3337404 - protein, 6 aa, Plasmodium falciparum
NTQQNL

SEQ ID NO: 3337405 - protein, 8 aa, Plasmodium falciparum
NTQSNSCH

SEQ ID NO: 3337406 - protein, 31 aa, Plasmodium falciparum
NTQSTKDEISNKRNIKSDLNNNNNNNNNNNN

SEQ ID NO: 3337407 - protein, 5 aa, Plasmodium falciparum
NTQVS

SEQ ID NO: 3337408 - protein, 15 aa, Plasmodium falciparum
NTQYQQQNNYNNRNY

SEQ ID NO: 3337409 - protein, 6 aa, Plasmodium falciparum
NTREES

SEQ ID NO: 3337410 - protein, 15 aa, Plasmodium falciparum
NTRENEKKKEKQNNL

SEQ ID NO: 3337411 - protein, 4 aa, Plasmodium falciparum
NTRG

SEQ ID NO: 3337412 - protein, 6 aa, Plasmodium falciparum
NTRKNH

SEQ ID NO: 3337413 - protein, 4 aa, Plasmodium falciparum
NTRL

SEQ ID NO: 3337414 - protein, 6 aa, Plasmodium falciparum
NTRNNA

SEQ ID NO: 3337415 - protein, 6 aa, Plasmodium falciparum
NTRNSQ

SEQ ID NO: 3337416 - protein, 4 aa, Plasmodium falciparum
NTRQ

SEQ ID NO: 3337417 - protein, 7 aa, Plasmodium falciparum
NTRRGNN

SEQ ID NO: 3337418 - protein, 6 aa, Plasmodium falciparum
NTRTLT

SEQ ID NO: 3337419 - protein, 9 aa, Plasmodium falciparum
NTSAKDELH

SEQ ID NO: 3337420 - protein, 21 aa, Plasmodium falciparum
NTSAKKRKCSDNASVSTNEEN

SEQ ID NO: 3337421 - protein, 4 aa, Plasmodium falciparum
NTSD

SEQ ID NO: 3337422 - protein, 11 aa, Plasmodium falciparum
NTSDEEIGNNK

SEQ ID NO: 3337423 - protein, 11 aa, Plasmodium falciparum
NTSDYEKEKLQ

SEQ ID NO: 3337424 - protein, 27 aa, Plasmodium falciparum
NTSEHTHNNNYSDKKKTSVQKTSRNPI

SEQ ID NO: 3337425 - protein, 7 aa, Plasmodium falciparum
NTSEKMS

SEQ ID NO: 3337426 - protein, 20 aa, Plasmodium falciparum
NTSERKKKKSCESRGSNITN

SEQ ID NO: 3337427 - protein, 37 aa, Plasmodium falciparum
NTSEVQQDHDKNQDNINNCNNKNNGDNINNCNNKNNC

SEQ ID NO: 3337428 - protein, 31 aa, Plasmodium falciparum
NTSGIKNNDQNMDNMNQKGKSNKNSNKYNFD

SEQ ID NO: 3337429 - protein, 7 aa, Plasmodium falciparum
NTSGRNR

SEQ ID NO: 3337430 - protein, 4 aa, Plasmodium falciparum
NTSI

SEQ ID NO: 3337431 - protein, 11 aa, Plasmodium falciparum
NTSISKDKYKA

SEQ ID NO: 3337432 - protein, 8 aa, Plasmodium falciparum
NTSITPKE

SEQ ID NO: 3337433 - protein, 12 aa, Plasmodium falciparum
NTSKAAEYSKGE

SEQ ID NO: 3337434 - protein, 14 aa, Plasmodium falciparum
NTSKNNKKRDDYYN

SEQ ID NO: 3337435 - protein, 38 aa, Plasmodium falciparum
NTSKNTSSNNYYTDKKQNDRKKQEDSNKNNEYYNRKKK

SEQ ID NO: 3337436 - protein, 15 aa, Plasmodium falciparum
NTSLNEELSKQKRKN

SEQ ID NO: 3337437 - protein, 5 aa, Plasmodium falciparum
NTSND

SEQ ID NO: 3337438 - protein, 9 aa, Plasmodium falciparum
NTSNDNNYF

SEQ ID NO: 3337439 - protein, 13 aa, Plasmodium falciparum
NTSNKKKKNTMLN

SEQ ID NO: 3337440 - protein, 7 aa, Plasmodium falciparum
NTSNMNN

SEQ ID NO: 3337441 - protein, 6 aa, Plasmodium falciparum
NTSNSN

SEQ ID NO: 3337442 - protein, 13 aa, Plasmodium falciparum
NTSNSSENQINSS

SEQ ID NO: 3337443 - protein, 6 aa, Plasmodium falciparum
NTSNVS

SEQ ID NO: 3337444 - protein, 48 aa, Plasmodium falciparum
NTSNVSKKENQNDDNKKKKKNKKYQNIKNEKNSMKGKKKGEKKKKKGN

SEQ ID NO: 3337445 - protein, 6 aa, Plasmodium falciparum
NTSPIT

SEQ ID NO: 3337446 - protein, 7 aa, Plasmodium falciparum
NTSPKND

SEQ ID NO: 3337447 - protein, 6 aa, Plasmodium falciparum
NTSPLK

SEQ ID NO: 3337448 - protein, 26 aa, Plasmodium falciparum
NTSPNNNNNNNNNNNNNNNNYNNYNN

SEQ ID NO: 3337449 - protein, 13 aa, Plasmodium falciparum
NTSQENNSNDEDF

SEQ ID NO: 3337450 - protein, 9 aa, Plasmodium falciparum
NTSQNTEKQ

SEQ ID NO: 3337451 - protein, 5 aa, Plasmodium falciparum
NTSSC

SEQ ID NO: 3337452 - protein, 5 aa, Plasmodium falciparum
NTSSD

SEQ ID NO: 3337453 - protein, 8 aa, Plasmodium falciparum
NTSSEKQR

SEQ ID NO: 3337454 - protein, 9 aa, Plasmodium falciparum
NTSSKNIKD

SEQ ID NO: 3337455 - protein, 13 aa, Plasmodium falciparum
NTSSQGNKINTYD

SEQ ID NO: 3337456 - protein, 27 aa, Plasmodium falciparum
NTSSRKFGAQNMSGGTYQAQNTSGGMY

SEQ ID NO: 3337457 - protein, 10 aa, Plasmodium falciparum
NTSSSSLLSN

SEQ ID NO: 3337458 - protein, 8 aa, Plasmodium falciparum
NTSTDKIK

SEQ ID NO: 3337459 - protein, 8 aa, Plasmodium falciparum
NTSTKRKN

SEQ ID NO: 3337460 - protein, 17 aa, Plasmodium falciparum
NTSTLNKNKNKKKNKKN

SEQ ID NO: 3337461 - protein, 8 aa, Plasmodium falciparum
NTSTNSFD

SEQ ID NO: 3337462 - protein, 6 aa, Plasmodium falciparum
NTSTNT

SEQ ID NO: 3337463 - protein, 7 aa, Plasmodium falciparum
NTSTNTN

SEQ ID NO: 3337464 - protein, 33 aa, Plasmodium falciparum
NTSTNTNINSNTNSNTNTNINSNINTDVNTNIN

SEQ ID NO: 3337465 - protein, 4 aa, Plasmodium falciparum
NTSV

SEQ ID NO: 3337466 - protein, 9 aa, Plasmodium falciparum
NTSVPQEEL

SEQ ID NO: 3337467 - protein, 6 aa, Plasmodium falciparum
NTSVSS

SEQ ID NO: 3337468 - protein, 31 aa, Plasmodium falciparum
NTSVSSYSSFNSNQKENNNSIYNSSDEQKSV

SEQ ID NO: 3337469 - protein, 9 aa, Plasmodium falciparum
NTSYEKASE

SEQ ID NO: 3337470 - protein, 10 aa, Plasmodium falciparum
NTSYNNNENI

SEQ ID NO: 3337471 - protein, 17 aa, Plasmodium falciparum
NTSYNNPYNNNANYYKS

SEQ ID NO: 3337472 - protein, 5 aa, Plasmodium falciparum
NTSYP

SEQ ID NO: 3337473 - protein, 7 aa, Plasmodium falciparum
NTTDING

SEQ ID NO: 3337474 - protein, 41 aa, Plasmodium falciparum
NTTDKQVQMNNNNNSNNNNNNNNNSNNNNNSNNNNNNNNNY

SEQ ID NO: 3337475 - protein, 6 aa, Plasmodium falciparum
NTTDMK

SEQ ID NO: 3337476 - protein, 44 aa, Plasmodium falciparum
NTTDNNLKKEKDDEEEEEREQEREQEREQENEEKRGEKKSTENV

SEQ ID NO: 3337477 - protein, 10 aa, Plasmodium falciparum
NTTDNPIQPI

SEQ ID NO: 3337478 - protein, 14 aa, Plasmodium falciparum
NTTFNYNDNKNNSV

SEQ ID NO: 3337479 - protein, 32 aa, Plasmodium falciparum
NTTHNEKGKRTRRKSSDKNMKAPKLTKEEEEE

SEQ ID NO: 3337480 - protein, 8 aa, Plasmodium falciparum
NTTHNKRS

SEQ ID NO: 3337481 - protein, 4 aa, Plasmodium falciparum
NTTK

SEQ ID NO: 3337482 - protein, 23 aa, Plasmodium falciparum
NTTKNKNSYDHYKNENDIETKNQ

SEQ ID NO: 3337483 - protein, 22 aa, Plasmodium falciparum
NTTKNNIEDYKSEKEYNNNTKK

SEQ ID NO: 3337484 - protein, 9 aa, Plasmodium falciparum
NTTKNNNNF

SEQ ID NO: 3337485 - protein, 5 aa, Plasmodium falciparum
NTTKQ

SEQ ID NO: 3337486 - protein, 4 aa, Plasmodium falciparum
NTTL

SEQ ID NO: 3337487 - protein, 7 aa, Plasmodium falciparum
NTTMKSE

SEQ ID NO: 3337488 - protein, 4 aa, Plasmodium falciparum
NTTN

SEQ ID NO: 3337489 - protein, 14 aa, Plasmodium falciparum
NTTNDMNNKNDHVG

SEQ ID NO: 3337490 - protein, 30 aa, Plasmodium falciparum
NTTNENTTTNITTTQNKMNEKKKKKNETQL

SEQ ID NO: 3337491 - protein, 25 aa, Plasmodium falciparum
NTTNIIPENNKNDDNNKGDNKKNDH

SEQ ID NO: 3337492 - protein, 22 aa, Plasmodium falciparum
NTTNKYSKKINNDENGNTNEPI

SEQ ID NO: 3337493 - protein, 7 aa, Plasmodium falciparum
NTTNMYK

SEQ ID NO: 3337494 - protein, 6 aa, Plasmodium falciparum
NTTNSE

SEQ ID NO: 3337495 - protein, 8 aa, Plasmodium falciparum
NTTNSGLG

SEQ ID NO: 3337496 - protein, 14 aa, Plasmodium falciparum
NTTNYNQKENSFNQ

SEQ ID NO: 3337497 - protein, 13 aa, Plasmodium falciparum
NTTPNNDNRKNEQ

SEQ ID NO: 3337498 - protein, 7 aa, Plasmodium falciparum
NTTQSDN

SEQ ID NO: 3337499 - protein, 9 aa, Plasmodium falciparum
NTTRDQYPL

SEQ ID NO: 3337500 - protein, 5 aa, Plasmodium falciparum
NTTRR

SEQ ID NO: 3337501 - protein, 6 aa, Plasmodium falciparum
NTTSNI

SEQ ID NO: 3337502 - protein, 7 aa, Plasmodium falciparum
NTTSPLT

SEQ ID NO: 3337503 - protein, 11 aa, Plasmodium falciparum
NTTSTQNSYSS

SEQ ID NO: 3337504 - protein, 8 aa, Plasmodium falciparum
NTTTGTRD

SEQ ID NO: 3337505 - protein, 49 aa, Plasmodium falciparum
NTTTTTTTTTTNNNNNNNCNNNNNNNCNNNNNNNNNNNCNNNNCNNNNC

SEQ ID NO: 3337506 - protein, 16 aa, Plasmodium falciparum
NTTVENNETENDKSQN

SEQ ID NO: 3337507 - protein, 17 aa, Plasmodium falciparum
NTTVGTNKKKTPTNINT

SEQ ID NO: 3337508 - protein, 4 aa, Plasmodium falciparum
NTTY

SEQ ID NO: 3337509 - protein, 29 aa, Plasmodium falciparum
NTTYDDQNITEQSNHIKRENEHTPYKNDD

SEQ ID NO: 3337510 - protein, 5 aa, Plasmodium falciparum
NTTYQ

SEQ ID NO: 3337511 - protein, 15 aa, Plasmodium falciparum
NTVANNKKELTEKEK

SEQ ID NO: 3337512 - protein, 4 aa, Plasmodium falciparum
NTVE

SEQ ID NO: 3337513 - protein, 23 aa, Plasmodium falciparum
NTVNENNNNNKIEKNNLTTSTIN

SEQ ID NO: 3337514 - protein, 6 aa, Plasmodium falciparum
NTVNVK

SEQ ID NO: 3337515 - protein, 4 aa, Plasmodium falciparum
NTVP

SEQ ID NO: 3337516 - protein, 20 aa, Plasmodium falciparum
NTVSEECTYSTNERTKKKKL

SEQ ID NO: 3337517 - protein, 5 aa, Plasmodium falciparum
NTVSS

SEQ ID NO: 3337518 - protein, 5 aa, Plasmodium falciparum
NTVYD

SEQ ID NO: 3337519 - protein, 19 aa, Plasmodium falciparum
NTWKKTSNIQSVEENNKHD

SEQ ID NO: 3337520 - protein, 5 aa, Plasmodium falciparum
NTWNN

SEQ ID NO: 3337521 - protein, 11 aa, Plasmodium falciparum
NTWNPTVSNDG

SEQ ID NO: 3337522 - protein, 6 aa, Plasmodium falciparum
NTYDKS

SEQ ID NO: 3337523 - protein, 13 aa, Plasmodium falciparum
NTYDNNKNQTNDY

SEQ ID NO: 3337524 - protein, 4 aa, Plasmodium falciparum
NTYE

SEQ ID NO: 3337525 - protein, 10 aa, Plasmodium falciparum
NTYEGSNIPE

SEQ ID NO: 3337526 - protein, 7 aa, Plasmodium falciparum
NTYEGTG

SEQ ID NO: 3337527 - protein, 6 aa, Plasmodium falciparum
NTYEKE

SEQ ID NO: 3337528 - protein, 7 aa, Plasmodium falciparum
NTYEKGN

SEQ ID NO: 3337529 - protein, 13 aa, Plasmodium falciparum
NTYEKQKEDSEHC

SEQ ID NO: 3337530 - protein, 6 aa, Plasmodium falciparum
NTYEPF

SEQ ID NO: 3337531 - protein, 13 aa, Plasmodium falciparum
NTYEQGSDYRRKD

SEQ ID NO: 3337532 - protein, 9 aa, Plasmodium falciparum
NTYGKNKPF

SEQ ID NO: 3337533 - protein, 9 aa, Plasmodium falciparum
NTYKNSGDS

SEQ ID NO: 3337534 - protein, 7 aa, Plasmodium falciparum
NTYKPPD

SEQ ID NO: 3337535 - protein, 10 aa, Plasmodium falciparum
NTYNDNDNNN

SEQ ID NO: 3337536 - protein, 5 aa, Plasmodium falciparum
NTYNE

SEQ ID NO: 3337537 - protein, 29 aa, Plasmodium falciparum
NTYNKQRKENSFYENSSNLSQNTEEYSSN

SEQ ID NO: 3337538 - protein, 17 aa, Plasmodium falciparum
NTYNNNNNNNERIEKNN

SEQ ID NO: 3337539 - protein, 38 aa, Plasmodium falciparum
NTYNNSNNSNINKNDNYNKSENSNNNNDNKKGESQPNF

SEQ ID NO: 3337540 - protein, 6 aa, Plasmodium falciparum
NTYPTN

SEQ ID NO: 3337541 - protein, 6 aa, Plasmodium falciparum
NTYQTQ

SEQ ID NO: 3337542 - protein, 7 aa, Plasmodium falciparum
NTYSDND

SEQ ID NO: 3337543 - protein, 15 aa, Plasmodium falciparum
NTYSDNNINKKSIEK

SEQ ID NO: 3337544 - protein, 11 aa, Plasmodium falciparum
NTYSKDNVSDN

SEQ ID NO: 3337545 - protein, 20 aa, Plasmodium falciparum
NTYSNKNNDNQSDNNNNNHM

SEQ ID NO: 3337546 - protein, 11 aa, Plasmodium falciparum
NTYSRNSMKDS

SEQ ID NO: 3337547 - protein, 10 aa, Plasmodium falciparum
NTYSYDEDSN

SEQ ID NO: 3337548 - protein, 4 aa, Plasmodium falciparum
NTYT

SEQ ID NO: 3337549 - protein, 19 aa, Plasmodium falciparum
NTYTKGNNKKSGDQPNMTD

SEQ ID NO: 3337550 - protein, 8 aa, Plasmodium falciparum
NTYTSTCN

SEQ ID NO: 3337551 - protein, 4 aa, Plasmodium falciparum
NTYY

SEQ ID NO: 3337552 - protein, 10 aa, Plasmodium falciparum
NVADNKQTTI

SEQ ID NO: 3337553 - protein, 8 aa, Plasmodium falciparum
NVADNVRN

SEQ ID NO: 3337554 - protein, 6 aa, Plasmodium falciparum
NVAGQR

SEQ ID NO: 3337555 - protein, 4 aa, Plasmodium falciparum
NVCR

SEQ ID NO: 3337556 - protein, 7 aa, Plasmodium falciparum
NVDADND

SEQ ID NO: 3337557 - protein, 4 aa, Plasmodium falciparum
NVDD

SEQ ID NO: 3337558 - protein, 5 aa, Plasmodium falciparum
NVDDD

SEQ ID NO: 3337559 - protein, 20 aa, Plasmodium falciparum
NVDDEEGSSDNSEDNDSSDF

SEQ ID NO: 3337560 - protein, 6 aa, Plasmodium falciparum
NVDDKL

SEQ ID NO: 3337561 - protein, 5 aa, Plasmodium falciparum
NVDEK

SEQ ID NO: 3337562 - protein, 7 aa, Plasmodium falciparum
NVDENKL

SEQ ID NO: 3337563 - protein, 5 aa, Plasmodium falciparum
NVDGK

SEQ ID NO: 3337564 - protein, 7 aa, Plasmodium falciparum
NVDHTNE

SEQ ID NO: 3337565 - protein, 13 aa, Plasmodium falciparum
NVDKEPKVKRNQT

SEQ ID NO: 3337566 - protein, 26 aa, Plasmodium falciparum
NVDKKNNNNNKANDKKKWKNDNHDNN

SEQ ID NO: 3337567 - protein, 9 aa, Plasmodium falciparum
NVDNKKSCD

SEQ ID NO: 3337568 - protein, 9 aa, Plasmodium falciparum
NVDNKNNKY

SEQ ID NO: 3337569 - protein, 27 aa, Plasmodium falciparum
NVDNNENNYDNNENNYDNNENHYDNND

SEQ ID NO: 3337570 - protein, 13 aa, Plasmodium falciparum
NVDNNNNNNNNNN

SEQ ID NO: 3337571 - protein, 58 aa, Plasmodium falciparum
NVDNTNNVDNTDKLDNTDNLDNTNNVDNTNNVDNTNNVDNTNNMNNNNNMNRDDKDQS

SEQ ID NO: 3337572 - protein, 15 aa, Plasmodium falciparum
NVDPTKRAGELTTEE

SEQ ID NO: 3337573 - protein, 11 aa, Plasmodium falciparum
NVDQDNEEKNL

SEQ ID NO: 3337574 - protein, 4 aa, Plasmodium falciparum
NVDS

SEQ ID NO: 3337575 - protein, 7 aa, Plasmodium falciparum
NVDSNIT

SEQ ID NO: 3337576 - protein, 8 aa, Plasmodium falciparum
NVDTEKKK

SEQ ID NO: 3337577 - protein, 12 aa, Plasmodium falciparum
NVDTKKKSVEKN

SEQ ID NO: 3337578 - protein, 106 aa, Plasmodium falciparum
NVDYEDDNVEGEDDNIEDEDDNIEDEDDNIEDEDDNIEVEDDNVDDEDDNVDDEDDNIDDEDDNVDDEDDNVDDEDDNVDDEDDNVDDEDDHISDEDYKDDKEDNY

SEQ ID NO: 3337579 - protein, 9 aa, Plasmodium falciparum
NVEDENMKS

SEQ ID NO: 3337580 - protein, 14 aa, Plasmodium falciparum
NVEEENNLTRNKGN

SEQ ID NO: 3337581 - protein, 10 aa, Plasmodium falciparum
NVEEHNNSQY

SEQ ID NO: 3337582 - protein, 13 aa, Plasmodium falciparum
NVEEKQEGIQDTL

SEQ ID NO: 3337583 - protein, 10 aa, Plasmodium falciparum
NVEESENESL

SEQ ID NO: 3337584 - protein, 7 aa, Plasmodium falciparum
NVEGTTY

SEQ ID NO: 3337585 - protein, 15 aa, Plasmodium falciparum
NVEGYDDTNTIDDKT

SEQ ID NO: 3337586 - protein, 6 aa, Plasmodium falciparum
NVEHNK

SEQ ID NO: 3337587 - protein, 10 aa, Plasmodium falciparum
NVEKKKKKNV

SEQ ID NO: 3337588 - protein, 10 aa, Plasmodium falciparum
NVEKSEGQKA

SEQ ID NO: 3337589 - protein, 5 aa, Plasmodium falciparum
NVEND

SEQ ID NO: 3337590 - protein, 14 aa, Plasmodium falciparum
NVENKKPFKNEPLK

SEQ ID NO: 3337591 - protein, 6 aa, Plasmodium falciparum
NVENSF

SEQ ID NO: 3337592 - protein, 13 aa, Plasmodium falciparum
NVENTRKNALSEG

SEQ ID NO: 3337593 - protein, 24 aa, Plasmodium falciparum
NVEPYDSESDDESFQNNKINDNRQ

SEQ ID NO: 3337594 - protein, 6 aa, Plasmodium falciparum
NVEQDN

SEQ ID NO: 3337595 - protein, 39 aa, Plasmodium falciparum
NVEQHKYNNDVDEDKYKNDVDQDKYKNDVDQDKYNNNMD

SEQ ID NO: 3337596 - protein, 9 aa, Plasmodium falciparum
NVEQNVEQN

SEQ ID NO: 3337597 - protein, 4 aa, Plasmodium falciparum
NVES

SEQ ID NO: 3337598 - protein, 7 aa, Plasmodium falciparum
NVESNKN

SEQ ID NO: 3337599 - protein, 5 aa, Plasmodium falciparum
NVFGN

SEQ ID NO: 3337600 - protein, 9 aa, Plasmodium falciparum
NVGEDINND

SEQ ID NO: 3337601 - protein, 13 aa, Plasmodium falciparum
NVGEHSSKQHENQ

SEQ ID NO: 3337602 - protein, 24 aa, Plasmodium falciparum
NVGETKEYSDVDEQEGHEEEEEEI

SEQ ID NO: 3337603 - protein, 10 aa, Plasmodium falciparum
NVGGAGNNNL

SEQ ID NO: 3337604 - protein, 16 aa, Plasmodium falciparum
NVGIETEYKKNSTENL

SEQ ID NO: 3337605 - protein, 6 aa, Plasmodium falciparum
NVGKSS

SEQ ID NO: 3337606 - protein, 4 aa, Plasmodium falciparum
NVGM

SEQ ID NO: 3337607 - protein, 5 aa, Plasmodium falciparum
NVGMK

SEQ ID NO: 3337608 - protein, 13 aa, Plasmodium falciparum
NVGQANYSSSKAG

SEQ ID NO: 3337609 - protein, 5 aa, Plasmodium falciparum
NVGSG

SEQ ID NO: 3337610 - protein, 9 aa, Plasmodium falciparum
NVGSVAAGG

SEQ ID NO: 3337611 - protein, 17 aa, Plasmodium falciparum
NVGTKEKGNQNDNEKKK

SEQ ID NO: 3337612 - protein, 13 aa, Plasmodium falciparum
NVGTNSDGNIDID

SEQ ID NO: 3337613 - protein, 11 aa, Plasmodium falciparum
NVGTRNVNDQD

SEQ ID NO: 3337614 - protein, 4 aa, Plasmodium falciparum
NVHD

SEQ ID NO: 3337615 - protein, 10 aa, Plasmodium falciparum
NVHEGKKGSR

SEQ ID NO: 3337616 - protein, 4 aa, Plasmodium falciparum
NVHN

SEQ ID NO: 3337617 - protein, 57 aa, Plasmodium falciparum
NVHNDDNVNNDDNVNNDDNVNNDDNVNNDDNKNNDDNVNNDDTKNNNINSGDVEQND

SEQ ID NO: 3337618 - protein, 12 aa, Plasmodium falciparum
NVHPNFSKNQPN

SEQ ID NO: 3337619 - protein, 24 aa, Plasmodium falciparum
NVKDDGNNSSENEVGGNNDVSSLN

SEQ ID NO: 3337620 - protein, 5 aa, Plasmodium falciparum
NVKDE

SEQ ID NO: 3337621 - protein, 8 aa, Plasmodium falciparum
NVKDEKNN

SEQ ID NO: 3337622 - protein, 8 aa, Plasmodium falciparum
NVKDPQNI

SEQ ID NO: 3337623 - protein, 7 aa, Plasmodium falciparum
NVKGDDN

SEQ ID NO: 3337624 - protein, 17 aa, Plasmodium falciparum
NVKGKDNKDVEGDPPNL

SEQ ID NO: 3337625 - protein, 8 aa, Plasmodium falciparum
NVKGSSDT

SEQ ID NO: 3337626 - protein, 5 aa, Plasmodium falciparum
NVKHT

SEQ ID NO: 3337627 - protein, 10 aa, Plasmodium falciparum
NVKIERNRDN

SEQ ID NO: 3337628 - protein, 4 aa, Plasmodium falciparum
NVKK

SEQ ID NO: 3337629 - protein, 8 aa, Plasmodium falciparum
NVKKKKIP

SEQ ID NO: 3337630 - protein, 21 aa, Plasmodium falciparum
NVKKNQLNGDDDNISNSGDMT

SEQ ID NO: 3337631 - protein, 8 aa, Plasmodium falciparum
NVKKSSSI

SEQ ID NO: 3337632 - protein, 12 aa, Plasmodium falciparum
NVKNDNNDNAKK

SEQ ID NO: 3337633 - protein, 11 aa, Plasmodium falciparum
NVKNGTYNEDK

SEQ ID NO: 3337634 - protein, 19 aa, Plasmodium falciparum
NVKNNDDEKTYIDNEGDNI

SEQ ID NO: 3337635 - protein, 38 aa, Plasmodium falciparum
NVKNTHDKNNNNNNNNNNNKNNNNNNNNKNNNNNNNND

SEQ ID NO: 3337636 - protein, 10 aa, Plasmodium falciparum
NVKPQNQQYG

SEQ ID NO: 3337637 - protein, 13 aa, Plasmodium falciparum
NVKQELKQKAKNV

SEQ ID NO: 3337638 - protein, 4 aa, Plasmodium falciparum
NVKS

SEQ ID NO: 3337639 - protein, 15 aa, Plasmodium falciparum
NVKSENASLKSASAH

SEQ ID NO: 3337640 - protein, 7 aa, Plasmodium falciparum
NVKSIQD

SEQ ID NO: 3337641 - protein, 9 aa, Plasmodium falciparum
NVKSSQSYV

SEQ ID NO: 3337642 - protein, 8 aa, Plasmodium falciparum
NVKTTEKK

SEQ ID NO: 3337643 - protein, 4 aa, Plasmodium falciparum
NVND

SEQ ID NO: 3337644 - protein, 22 aa, Plasmodium falciparum
NVNDDGDDDEDDDDDEYGEGTH

SEQ ID NO: 3337645 - protein, 52 aa, Plasmodium falciparum
NVNDDIDEHEESENNHDQNNNEEINEHNQNDDNPIHNDNTNANNDDDDDNNI

SEQ ID NO: 3337646 - protein, 5 aa, Plasmodium falciparum
NVNDN

SEQ ID NO: 3337647 - protein, 209 aa, Plasmodium falciparum
NVNDNNNDDDDNNNDDDDNNNDDDDNNNDDDDNNNDDDDNNNDDDDNNNDDDDNNNDDDDNNNDDDDNNNDDDDNNNDDDDNNNDDDDNNNDDDDNNNDDDDNNNDDDDNNNDDDDNNNDDDDNNNDDDDNNNDDDDNNNDDDDNNNDDDDNNNDDDDNNNDDDDNNNDDDDNNNDDDDNNNDDDDNNNDDDDNNNHNNNHNNNHNNNY

SEQ ID NO: 3337648 - protein, 8 aa, Plasmodium falciparum
NVNENNSS

SEQ ID NO: 3337649 - protein, 7 aa, Plasmodium falciparum
NVNENNV

SEQ ID NO: 3337650 - protein, 6 aa, Plasmodium falciparum
NVNEQI

SEQ ID NO: 3337651 - protein, 21 aa, Plasmodium falciparum
NVNGANEDEDQIDDESKSENI

SEQ ID NO: 3337652 - protein, 7 aa, Plasmodium falciparum
NVNGGNQ

SEQ ID NO: 3337653 - protein, 10 aa, Plasmodium falciparum
NVNGNVNDNI

SEQ ID NO: 3337654 - protein, 8 aa, Plasmodium falciparum
NVNGPNNN

SEQ ID NO: 3337655 - protein, 4 aa, Plasmodium falciparum
NVNK

SEQ ID NO: 3337656 - protein, 6 aa, Plasmodium falciparum
NVNKER

SEQ ID NO: 3337657 - protein, 6 aa, Plasmodium falciparum
NVNKNI

SEQ ID NO: 3337658 - protein, 53 aa, Plasmodium falciparum
NVNKNNNGRYGNVGRAQASTTQGNEKKVHGTNDNAEYTTHNRGRNSTTTNFTN

SEQ ID NO: 3337659 - protein, 10 aa, Plasmodium falciparum
NVNKYKEEEN

SEQ ID NO: 3337660 - protein, 4 aa, Plasmodium falciparum
NVNN

SEQ ID NO: 3337661 - protein, 7 aa, Plasmodium falciparum
NVNNENL

SEQ ID NO: 3337662 - protein, 11 aa, Plasmodium falciparum
NVNNKNKKKNF

SEQ ID NO: 3337663 - protein, 10 aa, Plasmodium falciparum
NVNNKNNTHD

SEQ ID NO: 3337664 - protein, 19 aa, Plasmodium falciparum
NVNNNDNINNDALNNPNDY

SEQ ID NO: 3337665 - protein, 12 aa, Plasmodium falciparum
NVNNNNNKESCD

SEQ ID NO: 3337666 - protein, 13 aa, Plasmodium falciparum
NVNNNNNNIKEDG

SEQ ID NO: 3337667 - protein, 30 aa, Plasmodium falciparum
NVNNNNNNNNNNKLYDEQNTKQEDNSKEYN

SEQ ID NO: 3337668 - protein, 53 aa, Plasmodium falciparum
NVNNNVNDNVNNNVNDNVNNNVNNNVNDNVNNNVNDNVNNNVNDNVNNNANDN

SEQ ID NO: 3337669 - protein, 7 aa, Plasmodium falciparum
NVNNQGD

SEQ ID NO: 3337670 - protein, 29 aa, Plasmodium falciparum
NVNNSNDQDINNNNNNNNSNNNKEEQNNL

SEQ ID NO: 3337671 - protein, 13 aa, Plasmodium falciparum
NVNNTNNKIGNIT

SEQ ID NO: 3337672 - protein, 27 aa, Plasmodium falciparum
NVNPAVNDQNGNNKKITSNPQSISSHQ

SEQ ID NO: 3337673 - protein, 6 aa, Plasmodium falciparum
NVNQEN

SEQ ID NO: 3337674 - protein, 14 aa, Plasmodium falciparum
NVNQNSFFQSIKMN

SEQ ID NO: 3337675 - protein, 31 aa, Plasmodium falciparum
NVNSENGSNVEIKEGDEKDHIQENDKDETNV

SEQ ID NO: 3337676 - protein, 22 aa, Plasmodium falciparum
NVNSINNSNMNSINNSNMNSNS

SEQ ID NO: 3337677 - protein, 6 aa, Plasmodium falciparum
NVNSNN

SEQ ID NO: 3337678 - protein, 5 aa, Plasmodium falciparum
NVNTG

SEQ ID NO: 3337679 - protein, 15 aa, Plasmodium falciparum
NVNTINKNNKKERNY

SEQ ID NO: 3337680 - protein, 7 aa, Plasmodium falciparum
NVNTKSS

SEQ ID NO: 3337681 - protein, 15 aa, Plasmodium falciparum
NVNTNDKCNVPNNNN

SEQ ID NO: 3337682 - protein, 36 aa, Plasmodium falciparum
NVNTNEDLNTCQEKTKEKNHKSDNNPHEHTTNIDNN

SEQ ID NO: 3337683 - protein, 15 aa, Plasmodium falciparum
NVNVNKKKEESQEYV

SEQ ID NO: 3337684 - protein, 16 aa, Plasmodium falciparum
NVNVTKDTSHKNINNN

SEQ ID NO: 3337685 - protein, 8 aa, Plasmodium falciparum
NVNYSTTN

SEQ ID NO: 3337686 - protein, 4 aa, Plasmodium falciparum
NVPE

SEQ ID NO: 3337687 - protein, 6 aa, Plasmodium falciparum
NVPEAT

SEQ ID NO: 3337688 - protein, 7 aa, Plasmodium falciparum
NVPESNY

SEQ ID NO: 3337689 - protein, 4 aa, Plasmodium falciparum
NVPI

SEQ ID NO: 3337690 - protein, 5 aa, Plasmodium falciparum
NVPIK

SEQ ID NO: 3337691 - protein, 5 aa, Plasmodium falciparum
NVPKP

SEQ ID NO: 3337692 - protein, 34 aa, Plasmodium falciparum
NVPKVSNSAASPSPSPSIPFNNNRGSKIGNSTYN

SEQ ID NO: 3337693 - protein, 15 aa, Plasmodium falciparum
NVPLNKDDTSNTENQ

SEQ ID NO: 3337694 - protein, 11 aa, Plasmodium falciparum
NVPNEEDNNMT

SEQ ID NO: 3337695 - protein, 10 aa, Plasmodium falciparum
NVPNKERQNV

SEQ ID NO: 3337696 - protein, 4 aa, Plasmodium falciparum
NVPP

SEQ ID NO: 3337697 - protein, 8 aa, Plasmodium falciparum
NVPPEIST

SEQ ID NO: 3337698 - protein, 7 aa, Plasmodium falciparum
NVPSKKR

SEQ ID NO: 3337699 - protein, 6 aa, Plasmodium falciparum
NVQANN

SEQ ID NO: 3337700 - protein, 10 aa, Plasmodium falciparum
NVQDNSKYNL

SEQ ID NO: 3337701 - protein, 18 aa, Plasmodium falciparum
NVQKENGTYNKEKYNNNI

SEQ ID NO: 3337702 - protein, 11 aa, Plasmodium falciparum
NVQKNESASFQ

SEQ ID NO: 3337703 - protein, 7 aa, Plasmodium falciparum
NVQKNKE

SEQ ID NO: 3337704 - protein, 21 aa, Plasmodium falciparum
NVQNDQTNNDINDDKNVNVNN

SEQ ID NO: 3337705 - protein, 20 aa, Plasmodium falciparum
NVQNEQNEQNEQNEQNEQNE

SEQ ID NO: 3337706 - protein, 5 aa, Plasmodium falciparum
NVQNG

SEQ ID NO: 3337707 - protein, 10 aa, Plasmodium falciparum
NVQNGNEPNM

SEQ ID NO: 3337708 - protein, 12 aa, Plasmodium falciparum
NVQNGPEQVRQK

SEQ ID NO: 3337709 - protein, 15 aa, Plasmodium falciparum
NVQNGQNGQNGQNIN

SEQ ID NO: 3337710 - protein, 7 aa, Plasmodium falciparum
NVQNNEE

SEQ ID NO: 3337711 - protein, 6 aa, Plasmodium falciparum
NVQNNN

SEQ ID NO: 3337712 - protein, 12 aa, Plasmodium falciparum
NVQNTSQKNIPR

SEQ ID NO: 3337713 - protein, 6 aa, Plasmodium falciparum
NVQPKD

SEQ ID NO: 3337714 - protein, 25 aa, Plasmodium falciparum
NVQQNGEQYVQQNGEQYVQQNGEQY

SEQ ID NO: 3337715 - protein, 4 aa, Plasmodium falciparum
NVRN

SEQ ID NO: 3337716 - protein, 13 aa, Plasmodium falciparum
NVRNNTNSYSNDS

SEQ ID NO: 3337717 - protein, 17 aa, Plasmodium falciparum
NVRSNNDLNKKVSTPLS

SEQ ID NO: 3337718 - protein, 8 aa, Plasmodium falciparum
NVSDEKAD

SEQ ID NO: 3337719 - protein, 11 aa, Plasmodium falciparum
NVSDENEKKLK

SEQ ID NO: 3337720 - protein, 7 aa, Plasmodium falciparum
NVSDGNS

SEQ ID NO: 3337721 - protein, 7 aa, Plasmodium falciparum
NVSEDEI

SEQ ID NO: 3337722 - protein, 6 aa, Plasmodium falciparum
NVSEDN

SEQ ID NO: 3337723 - protein, 7 aa, Plasmodium falciparum
NVSETST

SEQ ID NO: 3337724 - protein, 5 aa, Plasmodium falciparum
NVSGN

SEQ ID NO: 3337725 - protein, 19 aa, Plasmodium falciparum
NVSGNNNSNSINSNNINSN

SEQ ID NO: 3337726 - protein, 12 aa, Plasmodium falciparum
NVSHPYNDTLDD

SEQ ID NO: 3337727 - protein, 4 aa, Plasmodium falciparum
NVSI

SEQ ID NO: 3337728 - protein, 11 aa, Plasmodium falciparum
NVSKDKPINAQ

SEQ ID NO: 3337729 - protein, 6 aa, Plasmodium falciparum
NVSKEE

SEQ ID NO: 3337730 - protein, 13 aa, Plasmodium falciparum
NVSLEKDSTKSNI

SEQ ID NO: 3337731 - protein, 5 aa, Plasmodium falciparum
NVSLQ

SEQ ID NO: 3337732 - protein, 10 aa, Plasmodium falciparum
NVSNKKNINN

SEQ ID NO: 3337733 - protein, 12 aa, Plasmodium falciparum
NVSNKKNNKIKM

SEQ ID NO: 3337734 - protein, 5 aa, Plasmodium falciparum
NVSNN

SEQ ID NO: 3337735 - protein, 11 aa, Plasmodium falciparum
NVSNNEENKIN

SEQ ID NO: 3337736 - protein, 47 aa, Plasmodium falciparum
NVSNNNDNNNMSINSNNKNNNNNNNNNNNNNNNNNNSNNSNDYPKAL

SEQ ID NO: 3337737 - protein, 7 aa, Plasmodium falciparum
NVSNNNN

SEQ ID NO: 3337738 - protein, 7 aa, Plasmodium falciparum
NVSNNSS

SEQ ID NO: 3337739 - protein, 8 aa, Plasmodium falciparum
NVSNPTGE

SEQ ID NO: 3337740 - protein, 11 aa, Plasmodium falciparum
NVSNVGDNKSD

SEQ ID NO: 3337741 - protein, 6 aa, Plasmodium falciparum
NVSPPA

SEQ ID NO: 3337742 - protein, 15 aa, Plasmodium falciparum
NVSQNNKTNEYPPEN

SEQ ID NO: 3337743 - protein, 6 aa, Plasmodium falciparum
NVSRVN

SEQ ID NO: 3337744 - protein, 4 aa, Plasmodium falciparum
NVSS

SEQ ID NO: 3337745 - protein, 7 aa, Plasmodium falciparum
NVSSNEE

SEQ ID NO: 3337746 - protein, 7 aa, Plasmodium falciparum
NVSSNPD

SEQ ID NO: 3337747 - protein, 8 aa, Plasmodium falciparum
NVSSNSDH

SEQ ID NO: 3337748 - protein, 7 aa, Plasmodium falciparum
NVSSNSR

SEQ ID NO: 3337749 - protein, 7 aa, Plasmodium falciparum
NVSSTTK

SEQ ID NO: 3337750 - protein, 27 aa, Plasmodium falciparum
NVSTRNIQNRYKDKQSVLNNEKKELRN

SEQ ID NO: 3337751 - protein, 15 aa, Plasmodium falciparum
NVSVDKSRKSSRSNI

SEQ ID NO: 3337752 - protein, 6 aa, Plasmodium falciparum
NVSYEY

SEQ ID NO: 3337753 - protein, 11 aa, Plasmodium falciparum
NVTDNKKGSII

SEQ ID NO: 3337754 - protein, 9 aa, Plasmodium falciparum
NVTDTQTKK

SEQ ID NO: 3337755 - protein, 4 aa, Plasmodium falciparum
NVTE

SEQ ID NO: 3337756 - protein, 20 aa, Plasmodium falciparum
NVTEDEYENKINNEKGENLM

SEQ ID NO: 3337757 - protein, 4 aa, Plasmodium falciparum
NVTN

SEQ ID NO: 3337758 - protein, 5 aa, Plasmodium falciparum
NVTNN

SEQ ID NO: 3337759 - protein, 6 aa, Plasmodium falciparum
NVTNNS

SEQ ID NO: 3337760 - protein, 7 aa, Plasmodium falciparum
NVTPNSD

SEQ ID NO: 3337761 - protein, 15 aa, Plasmodium falciparum
NVTQGGHHEKGDDIN

SEQ ID NO: 3337762 - protein, 5 aa, Plasmodium falciparum
NVTSK

SEQ ID NO: 3337763 - protein, 28 aa, Plasmodium falciparum
NVTSNQKHNNIYTNKDDNTNYDNTNYDN

SEQ ID NO: 3337764 - protein, 14 aa, Plasmodium falciparum
NVTSTTNKNNNNKK

SEQ ID NO: 3337765 - protein, 6 aa, Plasmodium falciparum
NVTTGP

SEQ ID NO: 3337766 - protein, 9 aa, Plasmodium falciparum
NVTVTNDGA

SEQ ID NO: 3337767 - protein, 7 aa, Plasmodium falciparum
NVTYEET

SEQ ID NO: 3337768 - protein, 5 aa, Plasmodium falciparum
NVVDP

SEQ ID NO: 3337769 - protein, 23 aa, Plasmodium falciparum
NVVEENRKNDNTDNLPEDDNNNC

SEQ ID NO: 3337770 - protein, 12 aa, Plasmodium falciparum
NVYKNKKDARMK

SEQ ID NO: 3337771 - protein, 11 aa, Plasmodium falciparum
NVYNNGTRKDS

SEQ ID NO: 3337772 - protein, 25 aa, Plasmodium falciparum
NVYPNDSRRISTNNISRSESRSSKV

SEQ ID NO: 3337773 - protein, 37 aa, Plasmodium falciparum
NVYSDGSNQVVENKDEKDEEQKCDYSNVGNNNQMDNT

SEQ ID NO: 3337774 - protein, 5 aa, Plasmodium falciparum
NVYSP

SEQ ID NO: 3337775 - protein, 6 aa, Plasmodium falciparum
NWASRQ

SEQ ID NO: 3337776 - protein, 16 aa, Plasmodium falciparum
NWESSKDNCNETPRDD

SEQ ID NO: 3337777 - protein, 8 aa, Plasmodium falciparum
NWNNKNDI

SEQ ID NO: 3337778 - protein, 7 aa, Plasmodium falciparum
NWPSDYP

SEQ ID NO: 3337779 - protein, 5 aa, Plasmodium falciparum
NWSSS

SEQ ID NO: 3337780 - protein, 11 aa, Plasmodium falciparum
NYADDKKIEKP

SEQ ID NO: 3337781 - protein, 7 aa, Plasmodium falciparum
NYANNNT

SEQ ID NO: 3337782 - protein, 6 aa, Plasmodium falciparum
NYAYEN

SEQ ID NO: 3337783 - protein, 6 aa, Plasmodium falciparum
NYDDYN

SEQ ID NO: 3337784 - protein, 6 aa, Plasmodium falciparum
NYDENI

SEQ ID NO: 3337785 - protein, 17 aa, Plasmodium falciparum
NYDETIDKSEIRKNEQT

SEQ ID NO: 3337786 - protein, 6 aa, Plasmodium falciparum
NYDKEK

SEQ ID NO: 3337787 - protein, 9 aa, Plasmodium falciparum
NYDKENKEH

SEQ ID NO: 3337788 - protein, 6 aa, Plasmodium falciparum
NYDKKN

SEQ ID NO: 3337789 - protein, 6 aa, Plasmodium falciparum
NYDKQN

SEQ ID NO: 3337790 - protein, 45 aa, Plasmodium falciparum
NYDKQSSDDKKCNYDKQSSDDKQSSDDKQSSDDKQSSDDKKCNYD

SEQ ID NO: 3337791 - protein, 42 aa, Plasmodium falciparum
NYDKQSSDDKQSSDDKQSSDDKQSSDDKKCNYDKQTSDDTQV

SEQ ID NO: 3337792 - protein, 9 aa, Plasmodium falciparum
NYDKTTPIQ

SEQ ID NO: 3337793 - protein, 5 aa, Plasmodium falciparum
NYDND

SEQ ID NO: 3337794 - protein, 8 aa, Plasmodium falciparum
NYDNENTS

SEQ ID NO: 3337795 - protein, 20 aa, Plasmodium falciparum
NYDNIEKKNYDNNDGNNNNY

SEQ ID NO: 3337796 - protein, 6 aa, Plasmodium falciparum
NYDNKT

SEQ ID NO: 3337797 - protein, 11 aa, Plasmodium falciparum
NYDNNEDELSS

SEQ ID NO: 3337798 - protein, 18 aa, Plasmodium falciparum
NYDNNNNNNNNNSNNLYS

SEQ ID NO: 3337799 - protein, 11 aa, Plasmodium falciparum
NYDNTENAQNI

SEQ ID NO: 3337800 - protein, 115 aa, Plasmodium falciparum
NYDNTKSSNPNNNANNNLNNKKFNNETQIKSNPHSDTRMNNAGTTNNSSNPPSKPQASTNNNKSVNNNMKESDNFKKPTGGEATIKTTSNVSTNNTTNDHARKTNINNSNVSNAQ

SEQ ID NO: 3337801 - protein, 31 aa, Plasmodium falciparum
NYDNTKYYNNNNNTNDYDKKDNNVGKRKYSR

SEQ ID NO: 3337802 - protein, 12 aa, Plasmodium falciparum
NYDNTNTEENIT

SEQ ID NO: 3337803 - protein, 18 aa, Plasmodium falciparum
NYDNYDKYDNYDKYDGYD

SEQ ID NO: 3337804 - protein, 26 aa, Plasmodium falciparum
NYDNYSDKSGKSYVSNKNDEDKKKQS

SEQ ID NO: 3337805 - protein, 11 aa, Plasmodium falciparum
NYDQGNNRNVT

SEQ ID NO: 3337806 - protein, 20 aa, Plasmodium falciparum
NYDQHDDKTYKYEPKKSSNH

SEQ ID NO: 3337807 - protein, 7 aa, Plasmodium falciparum
NYDSFQK

SEQ ID NO: 3337808 - protein, 5 aa, Plasmodium falciparum
NYDYS

SEQ ID NO: 3337809 - protein, 25 aa, Plasmodium falciparum
NYEDEDPGHYEEDDNNKNEKLNENN

SEQ ID NO: 3337810 - protein, 10 aa, Plasmodium falciparum
NYEDKNKSNY

SEQ ID NO: 3337811 - protein, 5 aa, Plasmodium falciparum
NYEDP

SEQ ID NO: 3337812 - protein, 4 aa, Plasmodium falciparum
NYEE

SEQ ID NO: 3337813 - protein, 11 aa, Plasmodium falciparum
NYEEEKKQKQK

SEQ ID NO: 3337814 - protein, 18 aa, Plasmodium falciparum
NYEEGRGYDIDEQNDYNI

SEQ ID NO: 3337815 - protein, 9 aa, Plasmodium falciparum
NYEENNKEN

SEQ ID NO: 3337816 - protein, 13 aa, Plasmodium falciparum
NYEERKKTDGNVN

SEQ ID NO: 3337817 - protein, 17 aa, Plasmodium falciparum
NYEESKNEYEKEQVNNI

SEQ ID NO: 3337818 - protein, 28 aa, Plasmodium falciparum
NYEHNYDNNNNNNNDSQTSHSNDISNNL

SEQ ID NO: 3337819 - protein, 13 aa, Plasmodium falciparum
NYEHTQDTRLSPQ

SEQ ID NO: 3337820 - protein, 15 aa, Plasmodium falciparum
NYEKDKNEVNDYGKN

SEQ ID NO: 3337821 - protein, 6 aa, Plasmodium falciparum
NYEKTV

SEQ ID NO: 3337822 - protein, 4 aa, Plasmodium falciparum
NYEN

SEQ ID NO: 3337823 - protein, 9 aa, Plasmodium falciparum
NYENGELEN

SEQ ID NO: 3337824 - protein, 7 aa, Plasmodium falciparum
NYENGQK

SEQ ID NO: 3337825 - protein, 8 aa, Plasmodium falciparum
NYENTDEQ

SEQ ID NO: 3337826 - protein, 6 aa, Plasmodium falciparum
NYENTL

SEQ ID NO: 3337827 - protein, 43 aa, Plasmodium falciparum
NYENYENHDNYENYENYDNYENHKNYENHKNYENHKNYENHKN

SEQ ID NO: 3337828 - protein, 9 aa, Plasmodium falciparum
NYEQKTQNN

SEQ ID NO: 3337829 - protein, 4 aa, Plasmodium falciparum
NYER

SEQ ID NO: 3337830 - protein, 5 aa, Plasmodium falciparum
NYESD

SEQ ID NO: 3337831 - protein, 22 aa, Plasmodium falciparum
NYESNNNCSNSNLSKDKEKDRN

SEQ ID NO: 3337832 - protein, 19 aa, Plasmodium falciparum
NYESSLKNNMNDSVNNVEA

SEQ ID NO: 3337833 - protein, 5 aa, Plasmodium falciparum
NYETN

SEQ ID NO: 3337834 - protein, 5 aa, Plasmodium falciparum
NYETR

SEQ ID NO: 3337835 - protein, 27 aa, Plasmodium falciparum
NYFSDEESNDEEKVGEKIDKKKKKGLS

SEQ ID NO: 3337836 - protein, 10 aa, Plasmodium falciparum
NYGDAQRGNA

SEQ ID NO: 3337837 - protein, 13 aa, Plasmodium falciparum
NYGEKDKGKTNDY

SEQ ID NO: 3337838 - protein, 6 aa, Plasmodium falciparum
NYGGNN

SEQ ID NO: 3337839 - protein, 8 aa, Plasmodium falciparum
NYGNEDKT

SEQ ID NO: 3337840 - protein, 5 aa, Plasmodium falciparum
NYGNN

SEQ ID NO: 3337841 - protein, 14 aa, Plasmodium falciparum
NYGNSSSSNNMFFG

SEQ ID NO: 3337842 - protein, 7 aa, Plasmodium falciparum
NYGSKDF

SEQ ID NO: 3337843 - protein, 31 aa, Plasmodium falciparum
NYGSTNQKEQKKRVQANSKVSTNMKEDNKAN

SEQ ID NO: 3337844 - protein, 4 aa, Plasmodium falciparum
NYHD

SEQ ID NO: 3337845 - protein, 4 aa, Plasmodium falciparum
NYHH

SEQ ID NO: 3337846 - protein, 14 aa, Plasmodium falciparum
NYHKENKSKRKKKI

SEQ ID NO: 3337847 - protein, 7 aa, Plasmodium falciparum
NYHKTDE

SEQ ID NO: 3337848 - protein, 12 aa, Plasmodium falciparum
NYHNKQNNNHMD

SEQ ID NO: 3337849 - protein, 10 aa, Plasmodium falciparum
NYHNRRDGYG

SEQ ID NO: 3337850 - protein, 13 aa, Plasmodium falciparum
NYIETNDDVDDNK

SEQ ID NO: 3337851 - protein, 5 aa, Plasmodium falciparum
NYINN

SEQ ID NO: 3337852 - protein, 26 aa, Plasmodium falciparum
NYINNEQKKQKTSTLENKNYNEEVKE

SEQ ID NO: 3337853 - protein, 8 aa, Plasmodium falciparum
NYINTQSS

SEQ ID NO: 3337854 - protein, 12 aa, Plasmodium falciparum
NYIPSKEGSNKY

SEQ ID NO: 3337855 - protein, 4 aa, Plasmodium falciparum
NYIT

SEQ ID NO: 3337856 - protein, 11 aa, Plasmodium falciparum
NYKDDENTFQR

SEQ ID NO: 3337857 - protein, 8 aa, Plasmodium falciparum
NYKDTKNY

SEQ ID NO: 3337858 - protein, 4 aa, Plasmodium falciparum
NYKE

SEQ ID NO: 3337859 - protein, 9 aa, Plasmodium falciparum
NYKEENISN

SEQ ID NO: 3337860 - protein, 19 aa, Plasmodium falciparum
NYKEERNQQMNKNNNIKER

SEQ ID NO: 3337861 - protein, 14 aa, Plasmodium falciparum
NYKEKKNKYQSNKK

SEQ ID NO: 3337862 - protein, 9 aa, Plasmodium falciparum
NYKENDGIG

SEQ ID NO: 3337863 - protein, 10 aa, Plasmodium falciparum
NYKGANNKEF

SEQ ID NO: 3337864 - protein, 24 aa, Plasmodium falciparum
NYKHSTSENHTNTIEQTNEKKENG

SEQ ID NO: 3337865 - protein, 14 aa, Plasmodium falciparum
NYKKDESNTGNKMS

SEQ ID NO: 3337866 - protein, 32 aa, Plasmodium falciparum
NYKKEKSDFVNNKSDDNTNNNKNNDDDDDNKI

SEQ ID NO: 3337867 - protein, 8 aa, Plasmodium falciparum
NYKKNESL

SEQ ID NO: 3337868 - protein, 13 aa, Plasmodium falciparum
NYKKSKKKSSIGN

SEQ ID NO: 3337869 - protein, 12 aa, Plasmodium falciparum
NYKKSTNSKNNS

SEQ ID NO: 3337870 - protein, 7 aa, Plasmodium falciparum
NYKKYEK

SEQ ID NO: 3337871 - protein, 5 aa, Plasmodium falciparum
NYKND

SEQ ID NO: 3337872 - protein, 24 aa, Plasmodium falciparum
NYKNGKKYNNNDDDDNNNISDDSD

SEQ ID NO: 3337873 - protein, 8 aa, Plasmodium falciparum
NYKNNTSN

SEQ ID NO: 3337874 - protein, 13 aa, Plasmodium falciparum
NYKNNYQQTESIE

SEQ ID NO: 3337875 - protein, 7 aa, Plasmodium falciparum
NYKNPKK

SEQ ID NO: 3337876 - protein, 10 aa, Plasmodium falciparum
NYKNYNNNNI

SEQ ID NO: 3337877 - protein, 6 aa, Plasmodium falciparum
NYKPKP

SEQ ID NO: 3337878 - protein, 9 aa, Plasmodium falciparum
NYKSKIDEL

SEQ ID NO: 3337879 - protein, 8 aa, Plasmodium falciparum
NYKSRKTR

SEQ ID NO: 3337880 - protein, 50 aa, Plasmodium falciparum
NYKYDEKKKDRKMDNNNNNNNKNNNNNKNEINKNNNNNKNEINKNNNNNN

SEQ ID NO: 3337881 - protein, 14 aa, Plasmodium falciparum
NYKYSKNRKASNDE

SEQ ID NO: 3337882 - protein, 4 aa, Plasmodium falciparum
NYLD

SEQ ID NO: 3337883 - protein, 6 aa, Plasmodium falciparum
NYLPAP

SEQ ID NO: 3337884 - protein, 15 aa, Plasmodium falciparum
NYMNGSGDNKNFNND

SEQ ID NO: 3337885 - protein, 16 aa, Plasmodium falciparum
NYMNGSGENKSFNKDV

SEQ ID NO: 3337886 - protein, 5 aa, Plasmodium falciparum
NYMQE

SEQ ID NO: 3337887 - protein, 15 aa, Plasmodium falciparum
NYNASYGKKEGHNRR

SEQ ID NO: 3337888 - protein, 4 aa, Plasmodium falciparum
NYND

SEQ ID NO: 3337889 - protein, 5 aa, Plasmodium falciparum
NYNDE

SEQ ID NO: 3337890 - protein, 9 aa, Plasmodium falciparum
NYNDEDKNN

SEQ ID NO: 3337891 - protein, 7 aa, Plasmodium falciparum
NYNDGDD

SEQ ID NO: 3337892 - protein, 5 aa, Plasmodium falciparum
NYNDH

SEQ ID NO: 3337893 - protein, 10 aa, Plasmodium falciparum
NYNDKNNDYL

SEQ ID NO: 3337894 - protein, 20 aa, Plasmodium falciparum
NYNDKTINNDHNNNNNNIYN

SEQ ID NO: 3337895 - protein, 19 aa, Plasmodium falciparum
NYNDNNYNNSNNKGMGNKY

SEQ ID NO: 3337896 - protein, 13 aa, Plasmodium falciparum
NYNDQKSNNSTDK

SEQ ID NO: 3337897 - protein, 4 aa, Plasmodium falciparum
NYNE

SEQ ID NO: 3337898 - protein, 11 aa, Plasmodium falciparum
NYNEDERNDNT

SEQ ID NO: 3337899 - protein, 6 aa, Plasmodium falciparum
NYNEDV

SEQ ID NO: 3337900 - protein, 6 aa, Plasmodium falciparum
NYNENN

SEQ ID NO: 3337901 - protein, 7 aa, Plasmodium falciparum
NYNGDNN

SEQ ID NO: 3337902 - protein, 4 aa, Plasmodium falciparum
NYNH

SEQ ID NO: 3337903 - protein, 26 aa, Plasmodium falciparum
NYNHNNNNSNNNNSNNNNNNNNNNTY

SEQ ID NO: 3337904 - protein, 16 aa, Plasmodium falciparum
NYNINSDNVGGDSSNK

SEQ ID NO: 3337905 - protein, 13 aa, Plasmodium falciparum
NYNKAEDNSKFNE

SEQ ID NO: 3337906 - protein, 51 aa, Plasmodium falciparum
NYNKENNYEYDETKKYNNNNNNNDDDDDDDDNIHSNNKTEQTDSKDTQNTK

SEQ ID NO: 3337907 - protein, 7 aa, Plasmodium falciparum
NYNKESS

SEQ ID NO: 3337908 - protein, 14 aa, Plasmodium falciparum
NYNKMGKYNNRNSY

SEQ ID NO: 3337909 - protein, 9 aa, Plasmodium falciparum
NYNKQSDDY

SEQ ID NO: 3337910 - protein, 16 aa, Plasmodium falciparum
NYNKTRKPKNEGRKGE

SEQ ID NO: 3337911 - protein, 9 aa, Plasmodium falciparum
NYNKYNNNN

SEQ ID NO: 3337912 - protein, 5 aa, Plasmodium falciparum
NYNMS

SEQ ID NO: 3337913 - protein, 4 aa, Plasmodium falciparum
NYNN

SEQ ID NO: 3337914 - protein, 5 aa, Plasmodium falciparum
NYNNA

SEQ ID NO: 3337915 - protein, 9 aa, Plasmodium falciparum
NYNNDNNDY

SEQ ID NO: 3337916 - protein, 10 aa, Plasmodium falciparum
NYNNDNTQNN

SEQ ID NO: 3337917 - protein, 5 aa, Plasmodium falciparum
NYNNE

SEQ ID NO: 3337918 - protein, 9 aa, Plasmodium falciparum
NYNNEENNM

SEQ ID NO: 3337919 - protein, 9 aa, Plasmodium falciparum
NYNNEKNEC

SEQ ID NO: 3337920 - protein, 12 aa, Plasmodium falciparum
NYNNEMNKKEPF

SEQ ID NO: 3337921 - protein, 5 aa, Plasmodium falciparum
NYNNG

SEQ ID NO: 3337922 - protein, 46 aa, Plasmodium falciparum
NYNNIDNNNDNINNKDNINDNINNNNNNNNNNINNNNNNNNNNYRT

SEQ ID NO: 3337923 - protein, 5 aa, Plasmodium falciparum
NYNNN

SEQ ID NO: 3337924 - protein, 24 aa, Plasmodium falciparum
NYNNNDDDDDNNNNNNDDDDDDNN

SEQ ID NO: 3337925 - protein, 10 aa, Plasmodium falciparum
NYNNNMESNT

SEQ ID NO: 3337926 - protein, 6 aa, Plasmodium falciparum
NYNNNN

SEQ ID NO: 3337927 - protein, 7 aa, Plasmodium falciparum
NYNNNNN

SEQ ID NO: 3337928 - protein, 23 aa, Plasmodium falciparum
NYNNNNNDNNNNINNNNNINNNN

SEQ ID NO: 3337929 - protein, 10 aa, Plasmodium falciparum
NYNNNNNNNK

SEQ ID NO: 3337930 - protein, 26 aa, Plasmodium falciparum
NYNNNNNNNNNNNNNDDNTKDQPKLT

SEQ ID NO: 3337931 - protein, 13 aa, Plasmodium falciparum
NYNNNNNNNNNNV

SEQ ID NO: 3337932 - protein, 18 aa, Plasmodium falciparum
NYNNNQNNNNNNNNNNYK

SEQ ID NO: 3337933 - protein, 6 aa, Plasmodium falciparum
NYNNQS

SEQ ID NO: 3337934 - protein, 8 aa, Plasmodium falciparum
NYNNSSLP

SEQ ID NO: 3337935 - protein, 13 aa, Plasmodium falciparum
NYNNYENKKMNSK

SEQ ID NO: 3337936 - protein, 12 aa, Plasmodium falciparum
NYNNYNSNEPFN

SEQ ID NO: 3337937 - protein, 5 aa, Plasmodium falciparum
NYNPN

SEQ ID NO: 3337938 - protein, 23 aa, Plasmodium falciparum
NYNQYDHKNSNDSYTRNERRNSL

SEQ ID NO: 3337939 - protein, 9 aa, Plasmodium falciparum
NYNRNGVNS

SEQ ID NO: 3337940 - protein, 29 aa, Plasmodium falciparum
NYNRPLNDNSNNISKDDIKEKKNNNINST

SEQ ID NO: 3337941 - protein, 102 aa, Plasmodium falciparum
NYNRRNSRSFSPRDRRTRGEGNMKDYDRYKKKEHEHKNTQEHIDNEQKKQNEDEISNYENKTNDEHKTNEESYKRSIEGSTKNENLKNDKVTKSASKSFDKP

SEQ ID NO: 3337942 - protein, 16 aa, Plasmodium falciparum
NYNSEYKNNPFDNEHG

SEQ ID NO: 3337943 - protein, 13 aa, Plasmodium falciparum
NYNSLNEANNENL

SEQ ID NO: 3337944 - protein, 10 aa, Plasmodium falciparum
NYNYNSTSSL

SEQ ID NO: 3337945 - protein, 14 aa, Plasmodium falciparum
NYPDKNNSNNKSSI

SEQ ID NO: 3337946 - protein, 11 aa, Plasmodium falciparum
NYPDNPSEYDK

SEQ ID NO: 3337947 - protein, 9 aa, Plasmodium falciparum
NYPDSPPTV

SEQ ID NO: 3337948 - protein, 5 aa, Plasmodium falciparum
NYPEN

SEQ ID NO: 3337949 - protein, 32 aa, Plasmodium falciparum
NYPKDYNEDKMNNNNNNNKNRDRHNYHTGDRN

SEQ ID NO: 3337950 - protein, 11 aa, Plasmodium falciparum
NYPKPNYSNNN

SEQ ID NO: 3337951 - protein, 4 aa, Plasmodium falciparum
NYPN

SEQ ID NO: 3337952 - protein, 11 aa, Plasmodium falciparum
NYPNERTRNSL

SEQ ID NO: 3337953 - protein, 5 aa, Plasmodium falciparum
NYPNN

SEQ ID NO: 3337954 - protein, 6 aa, Plasmodium falciparum
NYPNSL

SEQ ID NO: 3337955 - protein, 17 aa, Plasmodium falciparum
NYPNTQNNDNTYKSNKQ

SEQ ID NO: 3337956 - protein, 6 aa, Plasmodium falciparum
NYPPKH

SEQ ID NO: 3337957 - protein, 4 aa, Plasmodium falciparum
NYPS

SEQ ID NO: 3337958 - protein, 6 aa, Plasmodium falciparum
NYPSYN

SEQ ID NO: 3337959 - protein, 4 aa, Plasmodium falciparum
NYPY

SEQ ID NO: 3337960 - protein, 12 aa, Plasmodium falciparum
NYPYNDDSDVQL

SEQ ID NO: 3337961 - protein, 15 aa, Plasmodium falciparum
NYQDTTKNNNNNNNI

SEQ ID NO: 3337962 - protein, 14 aa, Plasmodium falciparum
NYQKKKKERKNKGS

SEQ ID NO: 3337963 - protein, 25 aa, Plasmodium falciparum
NYQNDEENKKKDIKIGTHQNNTQNI

SEQ ID NO: 3337964 - protein, 13 aa, Plasmodium falciparum
NYQNLSNNEEEKE

SEQ ID NO: 3337965 - protein, 12 aa, Plasmodium falciparum
NYQNNKNSKKMN

SEQ ID NO: 3337966 - protein, 6 aa, Plasmodium falciparum
NYQPNT

SEQ ID NO: 3337967 - protein, 5 aa, Plasmodium falciparum
NYQQD

SEQ ID NO: 3337968 - protein, 4 aa, Plasmodium falciparum
NYQS

SEQ ID NO: 3337969 - protein, 4 aa, Plasmodium falciparum
NYQT

SEQ ID NO: 3337970 - protein, 5 aa, Plasmodium falciparum
NYQTK

SEQ ID NO: 3337971 - protein, 34 aa, Plasmodium falciparum
NYREEKNRRNDNKGFEEDSKRFSESNKNQDHTYN

SEQ ID NO: 3337972 - protein, 4 aa, Plasmodium falciparum
NYRN

SEQ ID NO: 3337973 - protein, 5 aa, Plasmodium falciparum
NYRNK

SEQ ID NO: 3337974 - protein, 8 aa, Plasmodium falciparum
NYRNNTPK

SEQ ID NO: 3337975 - protein, 4 aa, Plasmodium falciparum
NYRS

SEQ ID NO: 3337976 - protein, 23 aa, Plasmodium falciparum
NYRTNKNSKENYYNEKDENKNNI

SEQ ID NO: 3337977 - protein, 9 aa, Plasmodium falciparum
NYSDNEKEK

SEQ ID NO: 3337978 - protein, 10 aa, Plasmodium falciparum
NYSDNNENDS

SEQ ID NO: 3337979 - protein, 7 aa, Plasmodium falciparum
NYSENTA

SEQ ID NO: 3337980 - protein, 16 aa, Plasmodium falciparum
NYSESKKSSQTISRKK

SEQ ID NO: 3337981 - protein, 7 aa, Plasmodium falciparum
NYSKKSF

SEQ ID NO: 3337982 - protein, 5 aa, Plasmodium falciparum
NYSNN

SEQ ID NO: 3337983 - protein, 12 aa, Plasmodium falciparum
NYSNNNNNNNIN

SEQ ID NO: 3337984 - protein, 27 aa, Plasmodium falciparum
NYSNNNNNNNNNNNNNNNNNNNKFQST

SEQ ID NO: 3337985 - protein, 17 aa, Plasmodium falciparum
NYSNNNNNNNYNNDELD

SEQ ID NO: 3337986 - protein, 15 aa, Plasmodium falciparum
NYSPPNFSNESIERR

SEQ ID NO: 3337987 - protein, 12 aa, Plasmodium falciparum
NYSRNAAKSVES

SEQ ID NO: 3337988 - protein, 6 aa, Plasmodium falciparum
NYSRNN

SEQ ID NO: 3337989 - protein, 18 aa, Plasmodium falciparum
NYSRREKNKKHNKGSEKK

SEQ ID NO: 3337990 - protein, 5 aa, Plasmodium falciparum
NYSRY

SEQ ID NO: 3337991 - protein, 4 aa, Plasmodium falciparum
NYSS

SEQ ID NO: 3337992 - protein, 45 aa, Plasmodium falciparum
NYSSNYKSSNYYKYSSKGSFYKDTKTSSKQNDKDKQEPKSEIQTI

SEQ ID NO: 3337993 - protein, 10 aa, Plasmodium falciparum
NYSSSEDNNN

SEQ ID NO: 3337994 - protein, 9 aa, Plasmodium falciparum
NYSSTNSQQ

SEQ ID NO: 3337995 - protein, 16 aa, Plasmodium falciparum
NYSTLNNKTTNDESTK

SEQ ID NO: 3337996 - protein, 6 aa, Plasmodium falciparum
NYSTNT

SEQ ID NO: 3337997 - protein, 11 aa, Plasmodium falciparum
NYSTPDTNTIN

SEQ ID NO: 3337998 - protein, 10 aa, Plasmodium falciparum
NYSTSEEGDN

SEQ ID NO: 3337999 - protein, 4 aa, Plasmodium falciparum
NYSY

SEQ ID NO: 3338000 - protein, 14 aa, Plasmodium falciparum
NYSYPNSINPSNQI

SEQ ID NO: 3338001 - protein, 6 aa, Plasmodium falciparum
NYSYQT

SEQ ID NO: 3338002 - protein, 17 aa, Plasmodium falciparum
NYTEDDVTSNPSNDFDN

SEQ ID NO: 3338003 - protein, 5 aa, Plasmodium falciparum
NYTEK

SEQ ID NO: 3338004 - protein, 8 aa, Plasmodium falciparum
NYTEKEGG

SEQ ID NO: 3338005 - protein, 6 aa, Plasmodium falciparum
NYTENV

SEQ ID NO: 3338006 - protein, 20 aa, Plasmodium falciparum
NYTKEDKKDSILKYVKKNEN

SEQ ID NO: 3338007 - protein, 6 aa, Plasmodium falciparum
NYTNDE

SEQ ID NO: 3338008 - protein, 6 aa, Plasmodium falciparum
NYTNYD

SEQ ID NO: 3338009 - protein, 5 aa, Plasmodium falciparum
NYTSD

SEQ ID NO: 3338010 - protein, 21 aa, Plasmodium falciparum
NYTSKSGKKNNKKNKEDKDDN

SEQ ID NO: 3338011 - protein, 7 aa, Plasmodium falciparum
NYTSPNN

SEQ ID NO: 3338012 - protein, 17 aa, Plasmodium falciparum
NYTSSYNYTSEDSNDYS

SEQ ID NO: 3338013 - protein, 4 aa, Plasmodium falciparum
NYTT

SEQ ID NO: 3338014 - protein, 22 aa, Plasmodium falciparum
NYTTDCDKKKKKKKEDNKKGKD

SEQ ID NO: 3338015 - protein, 5 aa, Plasmodium falciparum
NYTTP

SEQ ID NO: 3338016 - protein, 6 aa, Plasmodium falciparum
NYVERA

SEQ ID NO: 3338017 - protein, 8 aa, Plasmodium falciparum
NYVKSEKE

SEQ ID NO: 3338018 - protein, 12 aa, Plasmodium falciparum
NYVSRKKEDDLQ

SEQ ID NO: 3338019 - protein, 4 aa, Plasmodium falciparum
NYYD

SEQ ID NO: 3338020 - protein, 6 aa, Plasmodium falciparum
NYYDSD

SEQ ID NO: 3338021 - protein, 4 aa, Plasmodium falciparum
NYYN

SEQ ID NO: 3338022 - protein, 21 aa, Plasmodium falciparum
NYYNKTGEDYKSDKENYSPTR

SEQ ID NO: 3338023 - protein, 12 aa, Plasmodium falciparum
NYYNNTDDAIES

SEQ ID NO: 3338024 - protein, 7 aa, Plasmodium falciparum
NYYNSSC

SEQ ID NO: 3338025 - protein, 12 aa, Plasmodium falciparum
NYYNSSKKGKLS

SEQ ID NO: 3338026 - protein, 9 aa, Plasmodium falciparum
NYYSSTKDN

SEQ ID NO: 3338027 - protein, 56 aa, Plasmodium falciparum
NYYSTEKYNNNNNDNNNNNDNNNNNDNNNNNDNNNNINNNNNKKKNKNNNNNNNNY

SEQ ID NO: 3338028 - protein, 7 aa, Plasmodium falciparum
PAEESTH

SEQ ID NO: 3338029 - protein, 9 aa, Plasmodium falciparum
PAERITSED

SEQ ID NO: 3338030 - protein, 4 aa, Plasmodium falciparum
PAEW

SEQ ID NO: 3338031 - protein, 15 aa, Plasmodium falciparum
PAGPAGTGKTETTKD

SEQ ID NO: 3338032 - protein, 5 aa, Plasmodium falciparum
PAGQN

SEQ ID NO: 3338033 - protein, 7 aa, Plasmodium falciparum
PAGSRGA

SEQ ID NO: 3338034 - protein, 6 aa, Plasmodium falciparum
PAILNS

SEQ ID NO: 3338035 - protein, 5 aa, Plasmodium falciparum
PAKYE

SEQ ID NO: 3338036 - protein, 16 aa, Plasmodium falciparum
PALKSSKKYKILQNRI

SEQ ID NO: 3338037 - protein, 9 aa, Plasmodium falciparum
PALTTRGCK

SEQ ID NO: 3338038 - protein, 4 aa, Plasmodium falciparum
PALY

SEQ ID NO: 3338039 - protein, 4 aa, Plasmodium falciparum
PANI

SEQ ID NO: 3338040 - protein, 4 aa, Plasmodium falciparum
PANT

SEQ ID NO: 3338041 - protein, 4 aa, Plasmodium falciparum
PAPS

SEQ ID NO: 3338042 - protein, 7 aa, Plasmodium falciparum
PAPSNSI

SEQ ID NO: 3338043 - protein, 4 aa, Plasmodium falciparum
PAPV

SEQ ID NO: 3338044 - protein, 6 aa, Plasmodium falciparum
PAQNEK

SEQ ID NO: 3338045 - protein, 7 aa, Plasmodium falciparum
PAQSGKT

SEQ ID NO: 3338046 - protein, 6 aa, Plasmodium falciparum
PASPDT

SEQ ID NO: 3338047 - protein, 10 aa, Plasmodium falciparum
PASTGAAKAV

SEQ ID NO: 3338048 - protein, 4 aa, Plasmodium falciparum
PATL

SEQ ID NO: 3338049 - protein, 6 aa, Plasmodium falciparum
PAVDEN

SEQ ID NO: 3338050 - protein, 4 aa, Plasmodium falciparum
PAYD

SEQ ID NO: 3338051 - protein, 20 aa, Plasmodium falciparum
PCDDISSSENIDNKEISSQQ

SEQ ID NO: 3338052 - protein, 5 aa, Plasmodium falciparum
PCDNQ

SEQ ID NO: 3338053 - protein, 4 aa, Plasmodium falciparum
PCEK

SEQ ID NO: 3338054 - protein, 12 aa, Plasmodium falciparum
PCEKRSTDTVDN

SEQ ID NO: 3338055 - protein, 7 aa, Plasmodium falciparum
PCSTDTH

SEQ ID NO: 3338056 - protein, 13 aa, Plasmodium falciparum
PCSVPAGRAPRQR

SEQ ID NO: 3338057 - protein, 5 aa, Plasmodium falciparum
PCTKT

SEQ ID NO: 3338058 - protein, 10 aa, Plasmodium falciparum
PDASEELEEI

SEQ ID NO: 3338059 - protein, 11 aa, Plasmodium falciparum
PDCGGEPHGEI

SEQ ID NO: 3338060 - protein, 9 aa, Plasmodium falciparum
PDDDEEEHS

SEQ ID NO: 3338061 - protein, 6 aa, Plasmodium falciparum
PDDDGS

SEQ ID NO: 3338062 - protein, 12 aa, Plasmodium falciparum
PDDDNNNYSSGK

SEQ ID NO: 3338063 - protein, 10 aa, Plasmodium falciparum
PDDENENSSL

SEQ ID NO: 3338064 - protein, 4 aa, Plasmodium falciparum
PDDF

SEQ ID NO: 3338065 - protein, 7 aa, Plasmodium falciparum
PDDFDNE

SEQ ID NO: 3338066 - protein, 20 aa, Plasmodium falciparum
PDDMDNDMDNNVDNDMDNNV

SEQ ID NO: 3338067 - protein, 9 aa, Plasmodium falciparum
PDDNVQSTL

SEQ ID NO: 3338068 - protein, 5 aa, Plasmodium falciparum
PDDRC

SEQ ID NO: 3338069 - protein, 5 aa, Plasmodium falciparum
PDDVN

SEQ ID NO: 3338070 - protein, 5 aa, Plasmodium falciparum
PDEIN

SEQ ID NO: 3338071 - protein, 4 aa, Plasmodium falciparum
PDEK

SEQ ID NO: 3338072 - protein, 6 aa, Plasmodium falciparum
PDEKDI

SEQ ID NO: 3338073 - protein, 8 aa, Plasmodium falciparum
PDETADNI

SEQ ID NO: 3338074 - protein, 4 aa, Plasmodium falciparum
PDEV

SEQ ID NO: 3338075 - protein, 5 aa, Plasmodium falciparum
PDFDA

SEQ ID NO: 3338076 - protein, 4 aa, Plasmodium falciparum
PDGG

SEQ ID NO: 3338077 - protein, 5 aa, Plasmodium falciparum
PDGGI

SEQ ID NO: 3338078 - protein, 7 aa, Plasmodium falciparum
PDGKSKN

SEQ ID NO: 3338079 - protein, 83 aa, Plasmodium falciparum
PDGRDKNEEGEKKEGDPKKEGDPKNEGDPKKEGDQKKEGDQKKEGDQNKMDNQNKMDDQNKMDDKQNKVQGVYKESKSTTLVD

SEQ ID NO: 3338080 - protein, 7 aa, Plasmodium falciparum
PDGSGKT

SEQ ID NO: 3338081 - protein, 6 aa, Plasmodium falciparum
PDGSYT

SEQ ID NO: 3338082 - protein, 5 aa, Plasmodium falciparum
PDGTL

SEQ ID NO: 3338083 - protein, 12 aa, Plasmodium falciparum
PDHTHSSKLSKN

SEQ ID NO: 3338084 - protein, 10 aa, Plasmodium falciparum
PDINNEENVG

SEQ ID NO: 3338085 - protein, 9 aa, Plasmodium falciparum
PDINSKGSI

SEQ ID NO: 3338086 - protein, 5 aa, Plasmodium falciparum
PDITN

SEQ ID NO: 3338087 - protein, 8 aa, Plasmodium falciparum
PDKDAEKV

SEQ ID NO: 3338088 - protein, 5 aa, Plasmodium falciparum
PDKEK

SEQ ID NO: 3338089 - protein, 10 aa, Plasmodium falciparum
PDKEKKTLTI

SEQ ID NO: 3338090 - protein, 10 aa, Plasmodium falciparum
PDKGGDPEKF

SEQ ID NO: 3338091 - protein, 8 aa, Plasmodium falciparum
PDKGPNTI

SEQ ID NO: 3338092 - protein, 6 aa, Plasmodium falciparum
PDKGPP

SEQ ID NO: 3338093 - protein, 12 aa, Plasmodium falciparum
PDKKNDGTYDSL

SEQ ID NO: 3338094 - protein, 5 aa, Plasmodium falciparum
PDKMN

SEQ ID NO: 3338095 - protein, 9 aa, Plasmodium falciparum
PDKNAQNVE

SEQ ID NO: 3338096 - protein, 24 aa, Plasmodium falciparum
PDKNNKVSSINESSGIYSGQAGRV

SEQ ID NO: 3338097 - protein, 14 aa, Plasmodium falciparum
PDKNPNNKAEATER

SEQ ID NO: 3338098 - protein, 7 aa, Plasmodium falciparum
PDKPNTY

SEQ ID NO: 3338099 - protein, 7 aa, Plasmodium falciparum
PDKSSSD

SEQ ID NO: 3338100 - protein, 5 aa, Plasmodium falciparum
PDLQE

SEQ ID NO: 3338101 - protein, 14 aa, Plasmodium falciparum
PDLTKETDSLTSDK

SEQ ID NO: 3338102 - protein, 4 aa, Plasmodium falciparum
PDMD

SEQ ID NO: 3338103 - protein, 11 aa, Plasmodium falciparum
PDNENKFGLDE

SEQ ID NO: 3338104 - protein, 4 aa, Plasmodium falciparum
PDNI

SEQ ID NO: 3338105 - protein, 5 aa, Plasmodium falciparum
PDNIE

SEQ ID NO: 3338106 - protein, 4 aa, Plasmodium falciparum
PDNL

SEQ ID NO: 3338107 - protein, 5 aa, Plasmodium falciparum
PDNNL

SEQ ID NO: 3338108 - protein, 15 aa, Plasmodium falciparum
PDNNTKEIYNENTKS

SEQ ID NO: 3338109 - protein, 8 aa, Plasmodium falciparum
PDNSLDKT

SEQ ID NO: 3338110 - protein, 7 aa, Plasmodium falciparum
PDPSNNL

SEQ ID NO: 3338111 - protein, 10 aa, Plasmodium falciparum
PDQKNNNLGN

SEQ ID NO: 3338112 - protein, 9 aa, Plasmodium falciparum
PDRKSFEDH

SEQ ID NO: 3338113 - protein, 15 aa, Plasmodium falciparum
PDRNPNNRKESEQKF

SEQ ID NO: 3338114 - protein, 5 aa, Plasmodium falciparum
PDRSQ

SEQ ID NO: 3338115 - protein, 16 aa, Plasmodium falciparum
PDSASSFSSISEDSSD

SEQ ID NO: 3338116 - protein, 10 aa, Plasmodium falciparum
PDSKAVSDYN

SEQ ID NO: 3338117 - protein, 5 aa, Plasmodium falciparum
PDSKQ

SEQ ID NO: 3338118 - protein, 5 aa, Plasmodium falciparum
PDSVT

SEQ ID NO: 3338119 - protein, 5 aa, Plasmodium falciparum
PDTNG

SEQ ID NO: 3338120 - protein, 11 aa, Plasmodium falciparum
PDYIQPEQKRN

SEQ ID NO: 3338121 - protein, 11 aa, Plasmodium falciparum
PDYKPSESRKL

SEQ ID NO: 3338122 - protein, 5 aa, Plasmodium falciparum
PDYPF

SEQ ID NO: 3338123 - protein, 4 aa, Plasmodium falciparum
PEAI

SEQ ID NO: 3338124 - protein, 8 aa, Plasmodium falciparum
PECLPNTT

SEQ ID NO: 3338125 - protein, 4 aa, Plasmodium falciparum
PEDI

SEQ ID NO: 3338126 - protein, 11 aa, Plasmodium falciparum
PEDRKKEAEKY

SEQ ID NO: 3338127 - protein, 5 aa, Plasmodium falciparum
PEDSV

SEQ ID NO: 3338128 - protein, 5 aa, Plasmodium falciparum
PEDSY

SEQ ID NO: 3338129 - protein, 7 aa, Plasmodium falciparum
PEEDEHM

SEQ ID NO: 3338130 - protein, 10 aa, Plasmodium falciparum
PEEDKEDKNI

SEQ ID NO: 3338131 - protein, 7 aa, Plasmodium falciparum
PEEEKEI

SEQ ID NO: 3338132 - protein, 25 aa, Plasmodium falciparum
PEEESYGDEKQKYNNKSKQKKKKKR

SEQ ID NO: 3338133 - protein, 8 aa, Plasmodium falciparum
PEENKRNN

SEQ ID NO: 3338134 - protein, 8 aa, Plasmodium falciparum
PEENPEYF

SEQ ID NO: 3338135 - protein, 5 aa, Plasmodium falciparum
PEEPV

SEQ ID NO: 3338136 - protein, 4 aa, Plasmodium falciparum
PEET

SEQ ID NO: 3338137 - protein, 7 aa, Plasmodium falciparum
PEEVDET

SEQ ID NO: 3338138 - protein, 5 aa, Plasmodium falciparum
PEGKG

SEQ ID NO: 3338139 - protein, 10 aa, Plasmodium falciparum
PEGNNGPEDT

SEQ ID NO: 3338140 - protein, 18 aa, Plasmodium falciparum
PEHEQSEEIKPSKEDTNI

SEQ ID NO: 3338141 - protein, 5 aa, Plasmodium falciparum
PEIGR

SEQ ID NO: 3338142 - protein, 11 aa, Plasmodium falciparum
PEIKQKIDDGT

SEQ ID NO: 3338143 - protein, 6 aa, Plasmodium falciparum
PEIPID

SEQ ID NO: 3338144 - protein, 19 aa, Plasmodium falciparum
PEIQDADNDSSNENDTNSC

SEQ ID NO: 3338145 - protein, 12 aa, Plasmodium falciparum
PEISGEKENYEN

SEQ ID NO: 3338146 - protein, 4 aa, Plasmodium falciparum
PEKE

SEQ ID NO: 3338147 - protein, 8 aa, Plasmodium falciparum
PEKEGNRN

SEQ ID NO: 3338148 - protein, 14 aa, Plasmodium falciparum
PEKEINGWGENDRG

SEQ ID NO: 3338149 - protein, 8 aa, Plasmodium falciparum
PEKGTVSF

SEQ ID NO: 3338150 - protein, 5 aa, Plasmodium falciparum
PEKIK

SEQ ID NO: 3338151 - protein, 32 aa, Plasmodium falciparum
PEKINNNDTNNNKSTTLKNKKLKKGKQTKNVN

SEQ ID NO: 3338152 - protein, 6 aa, Plasmodium falciparum
PEKKED

SEQ ID NO: 3338153 - protein, 9 aa, Plasmodium falciparum
PEKKNTDEN

SEQ ID NO: 3338154 - protein, 8 aa, Plasmodium falciparum
PEKNESFE

SEQ ID NO: 3338155 - protein, 7 aa, Plasmodium falciparum
PEKNYTD

SEQ ID NO: 3338156 - protein, 5 aa, Plasmodium falciparum
PEKSI

SEQ ID NO: 3338157 - protein, 6 aa, Plasmodium falciparum
PEKSYE

SEQ ID NO: 3338158 - protein, 6 aa, Plasmodium falciparum
PEKVDE

SEQ ID NO: 3338159 - protein, 4 aa, Plasmodium falciparum
PEKY

SEQ ID NO: 3338160 - protein, 8 aa, Plasmodium falciparum
PEKYRDNK

SEQ ID NO: 3338161 - protein, 4 aa, Plasmodium falciparum
PELD

SEQ ID NO: 3338162 - protein, 7 aa, Plasmodium falciparum
PELSSNK

SEQ ID NO: 3338163 - protein, 5 aa, Plasmodium falciparum
PENED

SEQ ID NO: 3338164 - protein, 5 aa, Plasmodium falciparum
PENEI

SEQ ID NO: 3338165 - protein, 4 aa, Plasmodium falciparum
PENG

SEQ ID NO: 3338166 - protein, 9 aa, Plasmodium falciparum
PENGGRRLN

SEQ ID NO: 3338167 - protein, 20 aa, Plasmodium falciparum
PENHKNLTNDTKSDFSSNEN

SEQ ID NO: 3338168 - protein, 22 aa, Plasmodium falciparum
PENINTGEKNVSVQGGEECNEN

SEQ ID NO: 3338169 - protein, 11 aa, Plasmodium falciparum
PENISKNDEEH

SEQ ID NO: 3338170 - protein, 10 aa, Plasmodium falciparum
PENKEEKKIR

SEQ ID NO: 3338171 - protein, 7 aa, Plasmodium falciparum
PENKNVG

SEQ ID NO: 3338172 - protein, 22 aa, Plasmodium falciparum
PENLTNKNNNKIQINDKDDNYE

SEQ ID NO: 3338173 - protein, 5 aa, Plasmodium falciparum
PENNS

SEQ ID NO: 3338174 - protein, 7 aa, Plasmodium falciparum
PENNSPN

SEQ ID NO: 3338175 - protein, 5 aa, Plasmodium falciparum
PENPR

SEQ ID NO: 3338176 - protein, 6 aa, Plasmodium falciparum
PENSDS

SEQ ID NO: 3338177 - protein, 5 aa, Plasmodium falciparum
PENSR

SEQ ID NO: 3338178 - protein, 10 aa, Plasmodium falciparum
PEPDKEPDND

SEQ ID NO: 3338179 - protein, 7 aa, Plasmodium falciparum
PEPGSKM

SEQ ID NO: 3338180 - protein, 5 aa, Plasmodium falciparum
PEPPM

SEQ ID NO: 3338181 - protein, 13 aa, Plasmodium falciparum
PEPRGERYNEENS

SEQ ID NO: 3338182 - protein, 20 aa, Plasmodium falciparum
PEQKKKRGRLNSKKKNIQKC

SEQ ID NO: 3338183 - protein, 19 aa, Plasmodium falciparum
PEQKQQKEEKHPKQQHNNI

SEQ ID NO: 3338184 - protein, 7 aa, Plasmodium falciparum
PEQKRKN

SEQ ID NO: 3338185 - protein, 7 aa, Plasmodium falciparum
PEQNGDN

SEQ ID NO: 3338186 - protein, 7 aa, Plasmodium falciparum
PEQPENA

SEQ ID NO: 3338187 - protein, 17 aa, Plasmodium falciparum
PEQTDALTKEKIFNQIY

SEQ ID NO: 3338188 - protein, 10 aa, Plasmodium falciparum
PEQTNKYSKS

SEQ ID NO: 3338189 - protein, 4 aa, Plasmodium falciparum
PEQV

SEQ ID NO: 3338190 - protein, 10 aa, Plasmodium falciparum
PERKEAAIDT

SEQ ID NO: 3338191 - protein, 5 aa, Plasmodium falciparum
PERKN

SEQ ID NO: 3338192 - protein, 7 aa, Plasmodium falciparum
PERSTNK

SEQ ID NO: 3338193 - protein, 16 aa, Plasmodium falciparum
PESDGPLPSIKLRSQK

SEQ ID NO: 3338194 - protein, 5 aa, Plasmodium falciparum
PESEG

SEQ ID NO: 3338195 - protein, 4 aa, Plasmodium falciparum
PESI

SEQ ID NO: 3338196 - protein, 4 aa, Plasmodium falciparum
PEST

SEQ ID NO: 3338197 - protein, 4 aa, Plasmodium falciparum
PESV

SEQ ID NO: 3338198 - protein, 11 aa, Plasmodium falciparum
PETTVNESTED

SEQ ID NO: 3338199 - protein, 5 aa, Plasmodium falciparum
PEYKS

SEQ ID NO: 3338200 - protein, 11 aa, Plasmodium falciparum
PEYNNSTEEPH

SEQ ID NO: 3338201 - protein, 14 aa, Plasmodium falciparum
PEYSDNKKKNNDEI

SEQ ID NO: 3338202 - protein, 7 aa, Plasmodium falciparum
PEYSPKE

SEQ ID NO: 3338203 - protein, 35 aa, Plasmodium falciparum
PFAASQGKVGPAGLGPGAGLPRGQHGQPHGTQLGA

SEQ ID NO: 3338204 - protein, 11 aa, Plasmodium falciparum
PFDKKNEEQIE

SEQ ID NO: 3338205 - protein, 5 aa, Plasmodium falciparum
PFDNT

SEQ ID NO: 3338206 - protein, 34 aa, Plasmodium falciparum
PFDQQQNELNESSEYESSSEDDDASQNNQNKMSS

SEQ ID NO: 3338207 - protein, 8 aa, Plasmodium falciparum
PFDSNKNS

SEQ ID NO: 3338208 - protein, 9 aa, Plasmodium falciparum
PFENNEENE

SEQ ID NO: 3338209 - protein, 9 aa, Plasmodium falciparum
PFGGQNDQD

SEQ ID NO: 3338210 - protein, 5 aa, Plasmodium falciparum
PFGRS

SEQ ID NO: 3338211 - protein, 4 aa, Plasmodium falciparum
PFGS

SEQ ID NO: 3338212 - protein, 4 aa, Plasmodium falciparum
PFHN

SEQ ID NO: 3338213 - protein, 10 aa, Plasmodium falciparum
PFKKEKEKKD

SEQ ID NO: 3338214 - protein, 10 aa, Plasmodium falciparum
PFNGKNNDEI

SEQ ID NO: 3338215 - protein, 5 aa, Plasmodium falciparum
PFNYP

SEQ ID NO: 3338216 - protein, 15 aa, Plasmodium falciparum
PFPNYTPDNEERQKK

SEQ ID NO: 3338217 - protein, 7 aa, Plasmodium falciparum
PFPPATA

SEQ ID NO: 3338218 - protein, 4 aa, Plasmodium falciparum
PFPV

SEQ ID NO: 3338219 - protein, 4 aa, Plasmodium falciparum
PFRG

SEQ ID NO: 3338220 - protein, 5 aa, Plasmodium falciparum
PFSGY

SEQ ID NO: 3338221 - protein, 5 aa, Plasmodium falciparum
PFSPT

SEQ ID NO: 3338222 - protein, 5 aa, Plasmodium falciparum
PFTQT

SEQ ID NO: 3338223 - protein, 15 aa, Plasmodium falciparum
PFTTSSYNEENEKVS

SEQ ID NO: 3338224 - protein, 18 aa, Plasmodium falciparum
PGARYPKKANNGARPDCR

SEQ ID NO: 3338225 - protein, 4 aa, Plasmodium falciparum
PGCQ

SEQ ID NO: 3338226 - protein, 4 aa, Plasmodium falciparum
PGCV

SEQ ID NO: 3338227 - protein, 8 aa, Plasmodium falciparum
PGDAHEKE

SEQ ID NO: 3338228 - protein, 4 aa, Plasmodium falciparum
PGDH

SEQ ID NO: 3338229 - protein, 8 aa, Plasmodium falciparum
PGDKVKGE

SEQ ID NO: 3338230 - protein, 9 aa, Plasmodium falciparum
PGDNKNKNL

SEQ ID NO: 3338231 - protein, 21 aa, Plasmodium falciparum
PGEHKQKENSTNEYSSKDINS

SEQ ID NO: 3338232 - protein, 11 aa, Plasmodium falciparum
PGELRPAKPVG

SEQ ID NO: 3338233 - protein, 5 aa, Plasmodium falciparum
PGENE

SEQ ID NO: 3338234 - protein, 8 aa, Plasmodium falciparum
PGENSRYK

SEQ ID NO: 3338235 - protein, 8 aa, Plasmodium falciparum
PGESVYGE

SEQ ID NO: 3338236 - protein, 12 aa, Plasmodium falciparum
PGFDPSNKVQQL

SEQ ID NO: 3338237 - protein, 5 aa, Plasmodium falciparum
PGFGE

SEQ ID NO: 3338238 - protein, 12 aa, Plasmodium falciparum
PGFNNADNQNLS

SEQ ID NO: 3338239 - protein, 6 aa, Plasmodium falciparum
PGGPKF

SEQ ID NO: 3338240 - protein, 9 aa, Plasmodium falciparum
PGGQQGPSG

SEQ ID NO: 3338241 - protein, 5 aa, Plasmodium falciparum
PGGSI

SEQ ID NO: 3338242 - protein, 6 aa, Plasmodium falciparum
PGHTST

SEQ ID NO: 3338243 - protein, 4 aa, Plasmodium falciparum
PGIK

SEQ ID NO: 3338244 - protein, 6 aa, Plasmodium falciparum
PGIQSN

SEQ ID NO: 3338245 - protein, 8 aa, Plasmodium falciparum
PGIRTSEK

SEQ ID NO: 3338246 - protein, 10 aa, Plasmodium falciparum
PGKENGPVKI

SEQ ID NO: 3338247 - protein, 9 aa, Plasmodium falciparum
PGKHPGNCA

SEQ ID NO: 3338248 - protein, 4 aa, Plasmodium falciparum
PGKL

SEQ ID NO: 3338249 - protein, 12 aa, Plasmodium falciparum
PGKSDEIKISDD

SEQ ID NO: 3338250 - protein, 9 aa, Plasmodium falciparum
PGKSKKGEL

SEQ ID NO: 3338251 - protein, 7 aa, Plasmodium falciparum
PGKSQAL

SEQ ID NO: 3338252 - protein, 5 aa, Plasmodium falciparum
PGLGK

SEQ ID NO: 3338253 - protein, 6 aa, Plasmodium falciparum
PGLGKS

SEQ ID NO: 3338254 - protein, 9 aa, Plasmodium falciparum
PGLNKAGKF

SEQ ID NO: 3338255 - protein, 4 aa, Plasmodium falciparum
PGNE

SEQ ID NO: 3338256 - protein, 5 aa, Plasmodium falciparum
PGNEE

SEQ ID NO: 3338257 - protein, 5 aa, Plasmodium falciparum
PGNEK

SEQ ID NO: 3338258 - protein, 5 aa, Plasmodium falciparum
PGNEN

SEQ ID NO: 3338259 - protein, 5 aa, Plasmodium falciparum
PGNER

SEQ ID NO: 3338260 - protein, 12 aa, Plasmodium falciparum
PGNKDDDVPPNV

SEQ ID NO: 3338261 - protein, 7 aa, Plasmodium falciparum
PGNKSAW

SEQ ID NO: 3338262 - protein, 9 aa, Plasmodium falciparum
PGNNGGDGL

SEQ ID NO: 3338263 - protein, 10 aa, Plasmodium falciparum
PGPTGMDPSH

SEQ ID NO: 3338264 - protein, 4 aa, Plasmodium falciparum
PGRG

SEQ ID NO: 3338265 - protein, 7 aa, Plasmodium falciparum
PGSATRQ

SEQ ID NO: 3338266 - protein, 8 aa, Plasmodium falciparum
PGSELSDD

SEQ ID NO: 3338267 - protein, 11 aa, Plasmodium falciparum
PGSGKGTQSLN

SEQ ID NO: 3338268 - protein, 7 aa, Plasmodium falciparum
PGSNNDG

SEQ ID NO: 3338269 - protein, 6 aa, Plasmodium falciparum
PGSPKY

SEQ ID NO: 3338270 - protein, 13 aa, Plasmodium falciparum
PGSRAIDVGSGSG

SEQ ID NO: 3338271 - protein, 18 aa, Plasmodium falciparum
PGSTKKYRSQKKSGKARM

SEQ ID NO: 3338272 - protein, 14 aa, Plasmodium falciparum
PGSVGDGVGNHPNS

SEQ ID NO: 3338273 - protein, 4 aa, Plasmodium falciparum
PGSW

SEQ ID NO: 3338274 - protein, 6 aa, Plasmodium falciparum
PGTDTW

SEQ ID NO: 3338275 - protein, 6 aa, Plasmodium falciparum
PGTGDI

SEQ ID NO: 3338276 - protein, 6 aa, Plasmodium falciparum
PGVAKS

SEQ ID NO: 3338277 - protein, 15 aa, Plasmodium falciparum
PGVPKNDINNNNDDI

SEQ ID NO: 3338278 - protein, 8 aa, Plasmodium falciparum
PGVTTDEI

SEQ ID NO: 3338279 - protein, 6 aa, Plasmodium falciparum
PHEDAK

SEQ ID NO: 3338280 - protein, 5 aa, Plasmodium falciparum
PHEGG

SEQ ID NO: 3338281 - protein, 11 aa, Plasmodium falciparum
PHEKGKLNEKK

SEQ ID NO: 3338282 - protein, 6 aa, Plasmodium falciparum
PHERTH

SEQ ID NO: 3338283 - protein, 9 aa, Plasmodium falciparum
PHESQQAGL

SEQ ID NO: 3338284 - protein, 5 aa, Plasmodium falciparum
PHGSL

SEQ ID NO: 3338285 - protein, 5 aa, Plasmodium falciparum
PHNVS

SEQ ID NO: 3338286 - protein, 6 aa, Plasmodium falciparum
PHNYNK

SEQ ID NO: 3338287 - protein, 6 aa, Plasmodium falciparum
PHNYPE

SEQ ID NO: 3338288 - protein, 8 aa, Plasmodium falciparum
PHPNEESR

SEQ ID NO: 3338289 - protein, 6 aa, Plasmodium falciparum
PHPQNC

SEQ ID NO: 3338290 - protein, 7 aa, Plasmodium falciparum
PHPTQPE

SEQ ID NO: 3338291 - protein, 5 aa, Plasmodium falciparum
PHRYR

SEQ ID NO: 3338292 - protein, 15 aa, Plasmodium falciparum
PHSDNNNNNNNNNRI

SEQ ID NO: 3338293 - protein, 5 aa, Plasmodium falciparum
PHSEG

SEQ ID NO: 3338294 - protein, 10 aa, Plasmodium falciparum
PHSTNNTNLQ

SEQ ID NO: 3338295 - protein, 10 aa, Plasmodium falciparum
PHTNEQTEKG

SEQ ID NO: 3338296 - protein, 7 aa, Plasmodium falciparum
PHTSNKI

SEQ ID NO: 3338297 - protein, 15 aa, Plasmodium falciparum
PIDNNENEKNREGDM

SEQ ID NO: 3338298 - protein, 12 aa, Plasmodium falciparum
PIDQNESTLNKT

SEQ ID NO: 3338299 - protein, 7 aa, Plasmodium falciparum
PIEKEKE

SEQ ID NO: 3338300 - protein, 10 aa, Plasmodium falciparum
PIEKNNNMNP

SEQ ID NO: 3338301 - protein, 5 aa, Plasmodium falciparum
PIGGG

SEQ ID NO: 3338302 - protein, 6 aa, Plasmodium falciparum
PIGPPK

SEQ ID NO: 3338303 - protein, 4 aa, Plasmodium falciparum
PIGT

SEQ ID NO: 3338304 - protein, 15 aa, Plasmodium falciparum
PIKEKDEDEKNSPEH

SEQ ID NO: 3338305 - protein, 5 aa, Plasmodium falciparum
PIKPG

SEQ ID NO: 3338306 - protein, 12 aa, Plasmodium falciparum
PIKRDDEEKLDE

SEQ ID NO: 3338307 - protein, 7 aa, Plasmodium falciparum
PIKSKSP

SEQ ID NO: 3338308 - protein, 6 aa, Plasmodium falciparum
PIKTKE

SEQ ID NO: 3338309 - protein, 9 aa, Plasmodium falciparum
PINDTKKNN

SEQ ID NO: 3338310 - protein, 5 aa, Plasmodium falciparum
PINEQ

SEQ ID NO: 3338311 - protein, 7 aa, Plasmodium falciparum
PINGYNE

SEQ ID NO: 3338312 - protein, 10 aa, Plasmodium falciparum
PINNSVQGNI

SEQ ID NO: 3338313 - protein, 9 aa, Plasmodium falciparum
PINNTSSNI

SEQ ID NO: 3338314 - protein, 4 aa, Plasmodium falciparum
PINR

SEQ ID NO: 3338315 - protein, 4 aa, Plasmodium falciparum
PINS

SEQ ID NO: 3338316 - protein, 7 aa, Plasmodium falciparum
PINTDEK

SEQ ID NO: 3338317 - protein, 9 aa, Plasmodium falciparum
PIPETNQTN

SEQ ID NO: 3338318 - protein, 4 aa, Plasmodium falciparum
PIQG

SEQ ID NO: 3338319 - protein, 4 aa, Plasmodium falciparum
PIQS

SEQ ID NO: 3338320 - protein, 9 aa, Plasmodium falciparum
PISEPTPAA

SEQ ID NO: 3338321 - protein, 8 aa, Plasmodium falciparum
PISKNKEG

SEQ ID NO: 3338322 - protein, 21 aa, Plasmodium falciparum
PISNDKEKKKKKKKKKKKKNC

SEQ ID NO: 3338323 - protein, 8 aa, Plasmodium falciparum
PISNNSYD

SEQ ID NO: 3338324 - protein, 13 aa, Plasmodium falciparum
PISQKKNKNAAIN

SEQ ID NO: 3338325 - protein, 4 aa, Plasmodium falciparum
PISR

SEQ ID NO: 3338326 - protein, 4 aa, Plasmodium falciparum
PISS

SEQ ID NO: 3338327 - protein, 9 aa, Plasmodium falciparum
PITNEYEEK

SEQ ID NO: 3338328 - protein, 14 aa, Plasmodium falciparum
PIYNNTENSYSRST

SEQ ID NO: 3338329 - protein, 7 aa, Plasmodium falciparum
PKAHKAR

SEQ ID NO: 3338330 - protein, 7 aa, Plasmodium falciparum
PKANEAK

SEQ ID NO: 3338331 - protein, 10 aa, Plasmodium falciparum
PKDDKNKSFG

SEQ ID NO: 3338332 - protein, 5 aa, Plasmodium falciparum
PKDGL

SEQ ID NO: 3338333 - protein, 4 aa, Plasmodium falciparum
PKDK

SEQ ID NO: 3338334 - protein, 6 aa, Plasmodium falciparum
PKDLQN

SEQ ID NO: 3338335 - protein, 5 aa, Plasmodium falciparum
PKDRD

SEQ ID NO: 3338336 - protein, 7 aa, Plasmodium falciparum
PKDRESL

SEQ ID NO: 3338337 - protein, 7 aa, Plasmodium falciparum
PKDSHDT

SEQ ID NO: 3338338 - protein, 7 aa, Plasmodium falciparum
PKDSSKV

SEQ ID NO: 3338339 - protein, 13 aa, Plasmodium falciparum
PKDSYDENKKLDD

SEQ ID NO: 3338340 - protein, 11 aa, Plasmodium falciparum
PKEARPKTDPL

SEQ ID NO: 3338341 - protein, 7 aa, Plasmodium falciparum
PKEEKTK

SEQ ID NO: 3338342 - protein, 7 aa, Plasmodium falciparum
PKEEMKN

SEQ ID NO: 3338343 - protein, 8 aa, Plasmodium falciparum
PKEERQDK

SEQ ID NO: 3338344 - protein, 7 aa, Plasmodium falciparum
PKEETRV

SEQ ID NO: 3338345 - protein, 4 aa, Plasmodium falciparum
PKEG

SEQ ID NO: 3338346 - protein, 4 aa, Plasmodium falciparum
PKEI

SEQ ID NO: 3338347 - protein, 11 aa, Plasmodium falciparum
PKEKRENISSV

SEQ ID NO: 3338348 - protein, 4 aa, Plasmodium falciparum
PKEL

SEQ ID NO: 3338349 - protein, 4 aa, Plasmodium falciparum
PKEN

SEQ ID NO: 3338350 - protein, 38 aa, Plasmodium falciparum
PKENDKKKEDALSNTKDNNISKENKGDKNEKNINNNEE

SEQ ID NO: 3338351 - protein, 13 aa, Plasmodium falciparum
PKENIPSKYGENR

SEQ ID NO: 3338352 - protein, 5 aa, Plasmodium falciparum
PKENT

SEQ ID NO: 3338353 - protein, 7 aa, Plasmodium falciparum
PKERSTC

SEQ ID NO: 3338354 - protein, 9 aa, Plasmodium falciparum
PKESNSCQH

SEQ ID NO: 3338355 - protein, 10 aa, Plasmodium falciparum
PKETQKGSIN

SEQ ID NO: 3338356 - protein, 4 aa, Plasmodium falciparum
PKEY

SEQ ID NO: 3338357 - protein, 10 aa, Plasmodium falciparum
PKEYKKEKDL

SEQ ID NO: 3338358 - protein, 88 aa, Plasmodium falciparum
PKGDSSEKNKTKKIKKKKLDGINGKGGDDNDIEDKEVEDNEVDDDNDVEDNDVDDDNDVEDNEVDDDNDDDNDVDVDNDVEDNDDMDN

SEQ ID NO: 3338359 - protein, 10 aa, Plasmodium falciparum
PKGGMKTSKK

SEQ ID NO: 3338360 - protein, 7 aa, Plasmodium falciparum
PKGIDKD

SEQ ID NO: 3338361 - protein, 8 aa, Plasmodium falciparum
PKGKNYNS

SEQ ID NO: 3338362 - protein, 18 aa, Plasmodium falciparum
PKGQGSKYLKSASKGDLP

SEQ ID NO: 3338363 - protein, 13 aa, Plasmodium falciparum
PKGRITPLNGPDI

SEQ ID NO: 3338364 - protein, 4 aa, Plasmodium falciparum
PKGS

SEQ ID NO: 3338365 - protein, 8 aa, Plasmodium falciparum
PKGSSSLK

SEQ ID NO: 3338366 - protein, 4 aa, Plasmodium falciparum
PKGT

SEQ ID NO: 3338367 - protein, 8 aa, Plasmodium falciparum
PKGTPDEA

SEQ ID NO: 3338368 - protein, 5 aa, Plasmodium falciparum
PKGYA

SEQ ID NO: 3338369 - protein, 20 aa, Plasmodium falciparum
PKHSTSHHNYTSDDSSYSSI

SEQ ID NO: 3338370 - protein, 16 aa, Plasmodium falciparum
PKHYSSKNKDNNLNDK

SEQ ID NO: 3338371 - protein, 17 aa, Plasmodium falciparum
PKIKKKKKKKKKKKPNL

SEQ ID NO: 3338372 - protein, 7 aa, Plasmodium falciparum
PKINDEK

SEQ ID NO: 3338373 - protein, 5 aa, Plasmodium falciparum
PKKDL

SEQ ID NO: 3338374 - protein, 16 aa, Plasmodium falciparum
PKKEKTNLVVSKGRYI

SEQ ID NO: 3338375 - protein, 30 aa, Plasmodium falciparum
PKKEKVSSKDIEQKNNLKKKESKGFNKSKI

SEQ ID NO: 3338376 - protein, 10 aa, Plasmodium falciparum
PKKESASDID

SEQ ID NO: 3338377 - protein, 6 aa, Plasmodium falciparum
PKKIKR

SEQ ID NO: 3338378 - protein, 18 aa, Plasmodium falciparum
PKKKQKKNEKDDQEDVDD

SEQ ID NO: 3338379 - protein, 8 aa, Plasmodium falciparum
PKKLSNDM

SEQ ID NO: 3338380 - protein, 4 aa, Plasmodium falciparum
PKKN

SEQ ID NO: 3338381 - protein, 10 aa, Plasmodium falciparum
PKKNDIDKNA

SEQ ID NO: 3338382 - protein, 6 aa, Plasmodium falciparum
PKKNKP

SEQ ID NO: 3338383 - protein, 9 aa, Plasmodium falciparum
PKKNNDQNS

SEQ ID NO: 3338384 - protein, 9 aa, Plasmodium falciparum
PKKNSDVEE

SEQ ID NO: 3338385 - protein, 5 aa, Plasmodium falciparum
PKKRG

SEQ ID NO: 3338386 - protein, 12 aa, Plasmodium falciparum
PKKRKGKNKNES

SEQ ID NO: 3338387 - protein, 6 aa, Plasmodium falciparum
PKKRQT

SEQ ID NO: 3338388 - protein, 8 aa, Plasmodium falciparum
PKKSSIGQ

SEQ ID NO: 3338389 - protein, 17 aa, Plasmodium falciparum
PKKSYKRREESGEINNE

SEQ ID NO: 3338390 - protein, 6 aa, Plasmodium falciparum
PKKTNL

SEQ ID NO: 3338391 - protein, 5 aa, Plasmodium falciparum
PKKYR

SEQ ID NO: 3338392 - protein, 11 aa, Plasmodium falciparum
PKLENTQNYQK

SEQ ID NO: 3338393 - protein, 5 aa, Plasmodium falciparum
PKMDS

SEQ ID NO: 3338394 - protein, 17 aa, Plasmodium falciparum
PKMPGRKKSRAMKQWSK

SEQ ID NO: 3338395 - protein, 7 aa, Plasmodium falciparum
PKNAEEI

SEQ ID NO: 3338396 - protein, 5 aa, Plasmodium falciparum
PKNCL

SEQ ID NO: 3338397 - protein, 17 aa, Plasmodium falciparum
PKNCLPETTSVNESTED

SEQ ID NO: 3338398 - protein, 9 aa, Plasmodium falciparum
PKNDNNNIN

SEQ ID NO: 3338399 - protein, 6 aa, Plasmodium falciparum
PKNEKK

SEQ ID NO: 3338400 - protein, 4 aa, Plasmodium falciparum
PKNF

SEQ ID NO: 3338401 - protein, 4 aa, Plasmodium falciparum
PKNG

SEQ ID NO: 3338402 - protein, 6 aa, Plasmodium falciparum
PKNIDE

SEQ ID NO: 3338403 - protein, 6 aa, Plasmodium falciparum
PKNIYS

SEQ ID NO: 3338404 - protein, 8 aa, Plasmodium falciparum
PKNLSPKA

SEQ ID NO: 3338405 - protein, 31 aa, Plasmodium falciparum
PKNNDSTENNNQNDNNNNNNNNNSKNLKSFD

SEQ ID NO: 3338406 - protein, 5 aa, Plasmodium falciparum
PKNNF

SEQ ID NO: 3338407 - protein, 8 aa, Plasmodium falciparum
PKNNISNS

SEQ ID NO: 3338408 - protein, 16 aa, Plasmodium falciparum
PKNNKIKNKELTKRGT

SEQ ID NO: 3338409 - protein, 16 aa, Plasmodium falciparum
PKNNNINNTNENNNLN

SEQ ID NO: 3338410 - protein, 8 aa, Plasmodium falciparum
PKNNNPTN

SEQ ID NO: 3338411 - protein, 6 aa, Plasmodium falciparum
PKNNTK

SEQ ID NO: 3338412 - protein, 7 aa, Plasmodium falciparum
PKNSIEE

SEQ ID NO: 3338413 - protein, 10 aa, Plasmodium falciparum
PKNSSSKKAF

SEQ ID NO: 3338414 - protein, 11 aa, Plasmodium falciparum
PKNSTDTYEDR

SEQ ID NO: 3338415 - protein, 4 aa, Plasmodium falciparum
PKNT

SEQ ID NO: 3338416 - protein, 4 aa, Plasmodium falciparum
PKPD

SEQ ID NO: 3338417 - protein, 16 aa, Plasmodium falciparum
PKPDNLSKENKNKNNI

SEQ ID NO: 3338418 - protein, 4 aa, Plasmodium falciparum
PKPH

SEQ ID NO: 3338419 - protein, 7 aa, Plasmodium falciparum
PKPLPFE

SEQ ID NO: 3338420 - protein, 29 aa, Plasmodium falciparum
PKPLPFEGESNYRSEFGPKPLPELPPRHE

SEQ ID NO: 3338421 - protein, 6 aa, Plasmodium falciparum
PKPNIN

SEQ ID NO: 3338422 - protein, 7 aa, Plasmodium falciparum
PKQALSS

SEQ ID NO: 3338423 - protein, 6 aa, Plasmodium falciparum
PKQIPK

SEQ ID NO: 3338424 - protein, 4 aa, Plasmodium falciparum
PKQL

SEQ ID NO: 3338425 - protein, 5 aa, Plasmodium falciparum
PKQLS

SEQ ID NO: 3338426 - protein, 7 aa, Plasmodium falciparum
PKQNNSY

SEQ ID NO: 3338427 - protein, 5 aa, Plasmodium falciparum
PKQYY

SEQ ID NO: 3338428 - protein, 4 aa, Plasmodium falciparum
PKRE

SEQ ID NO: 3338429 - protein, 12 aa, Plasmodium falciparum
PKREYQETCGSN

SEQ ID NO: 3338430 - protein, 6 aa, Plasmodium falciparum
PKRNTV

SEQ ID NO: 3338431 - protein, 17 aa, Plasmodium falciparum
PKRRKQENKSNESPNTV

SEQ ID NO: 3338432 - protein, 20 aa, Plasmodium falciparum
PKSETKIKQKCETNDIETSS

SEQ ID NO: 3338433 - protein, 8 aa, Plasmodium falciparum
PKSKKQNA

SEQ ID NO: 3338434 - protein, 9 aa, Plasmodium falciparum
PKSLNGGNG

SEQ ID NO: 3338435 - protein, 4 aa, Plasmodium falciparum
PKSN

SEQ ID NO: 3338436 - protein, 6 aa, Plasmodium falciparum
PKSQTQ

SEQ ID NO: 3338437 - protein, 8 aa, Plasmodium falciparum
PKSSTVSF

SEQ ID NO: 3338438 - protein, 5 aa, Plasmodium falciparum
PKTDV

SEQ ID NO: 3338439 - protein, 7 aa, Plasmodium falciparum
PKTHTPN

SEQ ID NO: 3338440 - protein, 4 aa, Plasmodium falciparum
PKTK

SEQ ID NO: 3338441 - protein, 6 aa, Plasmodium falciparum
PKTNNA

SEQ ID NO: 3338442 - protein, 9 aa, Plasmodium falciparum
PKTNNTDKC

SEQ ID NO: 3338443 - protein, 19 aa, Plasmodium falciparum
PKTPPEMKKEKNNNEYNEN

SEQ ID NO: 3338444 - protein, 11 aa, Plasmodium falciparum
PKTPPNSNNND

SEQ ID NO: 3338445 - protein, 7 aa, Plasmodium falciparum
PKTRSGK

SEQ ID NO: 3338446 - protein, 4 aa, Plasmodium falciparum
PKTS

SEQ ID NO: 3338447 - protein, 6 aa, Plasmodium falciparum
PKTSEI

SEQ ID NO: 3338448 - protein, 9 aa, Plasmodium falciparum
PKTSKDAER

SEQ ID NO: 3338449 - protein, 7 aa, Plasmodium falciparum
PKTTTKS

SEQ ID NO: 3338450 - protein, 6 aa, Plasmodium falciparum
PKTVRQ

SEQ ID NO: 3338451 - protein, 8 aa, Plasmodium falciparum
PKVENDNV

SEQ ID NO: 3338452 - protein, 10 aa, Plasmodium falciparum
PKVKNTNDNI

SEQ ID NO: 3338453 - protein, 24 aa, Plasmodium falciparum
PKVRRKSSEHGTFHNSSPKKKNRD

SEQ ID NO: 3338454 - protein, 6 aa, Plasmodium falciparum
PKYEDK

SEQ ID NO: 3338455 - protein, 7 aa, Plasmodium falciparum
PKYESGV

SEQ ID NO: 3338456 - protein, 6 aa, Plasmodium falciparum
PKYGRY

SEQ ID NO: 3338457 - protein, 10 aa, Plasmodium falciparum
PKYINNKKDN

SEQ ID NO: 3338458 - protein, 10 aa, Plasmodium falciparum
PKYKDNTKCY

SEQ ID NO: 3338459 - protein, 12 aa, Plasmodium falciparum
PKYKNQKNDEDF

SEQ ID NO: 3338460 - protein, 8 aa, Plasmodium falciparum
PKYSKNTP

SEQ ID NO: 3338461 - protein, 14 aa, Plasmodium falciparum
PKYTPKDAPGATRN

SEQ ID NO: 3338462 - protein, 18 aa, Plasmodium falciparum
PKYTSTSSLNKVNGNNNI

SEQ ID NO: 3338463 - protein, 7 aa, Plasmodium falciparum
PLDATKK

SEQ ID NO: 3338464 - protein, 4 aa, Plasmodium falciparum
PLDI

SEQ ID NO: 3338465 - protein, 6 aa, Plasmodium falciparum
PLDSTS

SEQ ID NO: 3338466 - protein, 17 aa, Plasmodium falciparum
PLEEIGAGESLAKNGES

SEQ ID NO: 3338467 - protein, 27 aa, Plasmodium falciparum
PLEESRKSSLTSYKNKTPSKNVNSKSQ

SEQ ID NO: 3338468 - protein, 7 aa, Plasmodium falciparum
PLGKNNS

SEQ ID NO: 3338469 - protein, 5 aa, Plasmodium falciparum
PLGSQ

SEQ ID NO: 3338470 - protein, 12 aa, Plasmodium falciparum
PLKAAKKGPVEL

SEQ ID NO: 3338471 - protein, 5 aa, Plasmodium falciparum
PLKEQ

SEQ ID NO: 3338472 - protein, 13 aa, Plasmodium falciparum
PLKKEDDKNKEQK

SEQ ID NO: 3338473 - protein, 4 aa, Plasmodium falciparum
PLNC

SEQ ID NO: 3338474 - protein, 5 aa, Plasmodium falciparum
PLNEE

SEQ ID NO: 3338475 - protein, 18 aa, Plasmodium falciparum
PLNNNDDTSDINTNNNSK

SEQ ID NO: 3338476 - protein, 11 aa, Plasmodium falciparum
PLNNSNNCDSV

SEQ ID NO: 3338477 - protein, 10 aa, Plasmodium falciparum
PLNPKGNRER

SEQ ID NO: 3338478 - protein, 10 aa, Plasmodium falciparum
PLNPKTNREK

SEQ ID NO: 3338479 - protein, 10 aa, Plasmodium falciparum
PLNPQKNKEK

SEQ ID NO: 3338480 - protein, 4 aa, Plasmodium falciparum
PLPD

SEQ ID NO: 3338481 - protein, 4 aa, Plasmodium falciparum
PLPE

SEQ ID NO: 3338482 - protein, 6 aa, Plasmodium falciparum
PLSDED

SEQ ID NO: 3338483 - protein, 6 aa, Plasmodium falciparum
PLSEKE

SEQ ID NO: 3338484 - protein, 8 aa, Plasmodium falciparum
PLSGSAAN

SEQ ID NO: 3338485 - protein, 28 aa, Plasmodium falciparum
PLSKKGPSTFSKTSASALNKKKKKTLSK

SEQ ID NO: 3338486 - protein, 14 aa, Plasmodium falciparum
PLSNNSDLSNVSNM

SEQ ID NO: 3338487 - protein, 5 aa, Plasmodium falciparum
PLSPQ

SEQ ID NO: 3338488 - protein, 4 aa, Plasmodium falciparum
PLSR

SEQ ID NO: 3338489 - protein, 10 aa, Plasmodium falciparum
PLSSLENNES

SEQ ID NO: 3338490 - protein, 7 aa, Plasmodium falciparum
PLTESEA

SEQ ID NO: 3338491 - protein, 4 aa, Plasmodium falciparum
PLVP

SEQ ID NO: 3338492 - protein, 5 aa, Plasmodium falciparum
PLYDD

SEQ ID NO: 3338493 - protein, 7 aa, Plasmodium falciparum
PMAPTPN

SEQ ID NO: 3338494 - protein, 4 aa, Plasmodium falciparum
PMDK

SEQ ID NO: 3338495 - protein, 17 aa, Plasmodium falciparum
PMENNEKNEKYSQENYP

SEQ ID NO: 3338496 - protein, 4 aa, Plasmodium falciparum
PMEP

SEQ ID NO: 3338497 - protein, 5 aa, Plasmodium falciparum
PMKPS

SEQ ID NO: 3338498 - protein, 11 aa, Plasmodium falciparum
PMNNNNSQQFN

SEQ ID NO: 3338499 - protein, 8 aa, Plasmodium falciparum
PMNQSNQI

SEQ ID NO: 3338500 - protein, 10 aa, Plasmodium falciparum
PMNYNNGKWG

SEQ ID NO: 3338501 - protein, 17 aa, Plasmodium falciparum
PMPDEKRKRKRGGKRYR

SEQ ID NO: 3338502 - protein, 11 aa, Plasmodium falciparum
PMSNDQKNNIL

SEQ ID NO: 3338503 - protein, 23 aa, Plasmodium falciparum
PMSTEQKKDFSLSSHEKKDVTTL

SEQ ID NO: 3338504 - protein, 27 aa, Plasmodium falciparum
PNADKNKENIKQNNEKTDHNEDAIGGS

SEQ ID NO: 3338505 - protein, 9 aa, Plasmodium falciparum
PNADSPLNC

SEQ ID NO: 3338506 - protein, 6 aa, Plasmodium falciparum
PNAEET

SEQ ID NO: 3338507 - protein, 6 aa, Plasmodium falciparum
PNAKKT

SEQ ID NO: 3338508 - protein, 6 aa, Plasmodium falciparum
PNASKL

SEQ ID NO: 3338509 - protein, 10 aa, Plasmodium falciparum
PNASSSVNVD

SEQ ID NO: 3338510 - protein, 4 aa, Plasmodium falciparum
PNDA

SEQ ID NO: 3338511 - protein, 5 aa, Plasmodium falciparum
PNDDE

SEQ ID NO: 3338512 - protein, 9 aa, Plasmodium falciparum
PNDDNENIS

SEQ ID NO: 3338513 - protein, 4 aa, Plasmodium falciparum
PNDF

SEQ ID NO: 3338514 - protein, 7 aa, Plasmodium falciparum
PNDGGPD

SEQ ID NO: 3338515 - protein, 4 aa, Plasmodium falciparum
PNDI

SEQ ID NO: 3338516 - protein, 18 aa, Plasmodium falciparum
PNDKLKKEKRKKKHKNLN

SEQ ID NO: 3338517 - protein, 10 aa, Plasmodium falciparum
PNDMSTTNTH

SEQ ID NO: 3338518 - protein, 5 aa, Plasmodium falciparum
PNDNN

SEQ ID NO: 3338519 - protein, 10 aa, Plasmodium falciparum
PNDNTTNEAE

SEQ ID NO: 3338520 - protein, 7 aa, Plasmodium falciparum
PNDNVNY

SEQ ID NO: 3338521 - protein, 4 aa, Plasmodium falciparum
PNDP

SEQ ID NO: 3338522 - protein, 6 aa, Plasmodium falciparum
PNDQDK

SEQ ID NO: 3338523 - protein, 15 aa, Plasmodium falciparum
PNDQNGWTKSPRGAG

SEQ ID NO: 3338524 - protein, 47 aa, Plasmodium falciparum
PNDSNNNYNDDDNNNSHKNNKNNNNNNNKDDDDESNNSNDNEEENEE

SEQ ID NO: 3338525 - protein, 4 aa, Plasmodium falciparum
PNDT

SEQ ID NO: 3338526 - protein, 7 aa, Plasmodium falciparum
PNDTGKI

SEQ ID NO: 3338527 - protein, 5 aa, Plasmodium falciparum
PNDYG

SEQ ID NO: 3338528 - protein, 5 aa, Plasmodium falciparum
PNDYK

SEQ ID NO: 3338529 - protein, 5 aa, Plasmodium falciparum
PNEDI

SEQ ID NO: 3338530 - protein, 10 aa, Plasmodium falciparum
PNEDKNNTYI

SEQ ID NO: 3338531 - protein, 12 aa, Plasmodium falciparum
PNEEDKNQKNLQ

SEQ ID NO: 3338532 - protein, 52 aa, Plasmodium falciparum
PNEEENMKQGKTKNSNNKNNNNKNNKNKNNNNNNNNNNLESITKNKNNSQYI

SEQ ID NO: 3338533 - protein, 7 aa, Plasmodium falciparum
PNEEKEY

SEQ ID NO: 3338534 - protein, 7 aa, Plasmodium falciparum
PNEEKYK

SEQ ID NO: 3338535 - protein, 12 aa, Plasmodium falciparum
PNEEQKSNTNDS

SEQ ID NO: 3338536 - protein, 4 aa, Plasmodium falciparum
PNEI

SEQ ID NO: 3338537 - protein, 6 aa, Plasmodium falciparum
PNEISN

SEQ ID NO: 3338538 - protein, 4 aa, Plasmodium falciparum
PNEK

SEQ ID NO: 3338539 - protein, 13 aa, Plasmodium falciparum
PNEKKDEKKKEYY

SEQ ID NO: 3338540 - protein, 9 aa, Plasmodium falciparum
PNEKSIKKN

SEQ ID NO: 3338541 - protein, 12 aa, Plasmodium falciparum
PNEKYGKKNIPD

SEQ ID NO: 3338542 - protein, 5 aa, Plasmodium falciparum
PNEND

SEQ ID NO: 3338543 - protein, 11 aa, Plasmodium falciparum
PNENGDNNNSM

SEQ ID NO: 3338544 - protein, 7 aa, Plasmodium falciparum
PNENKKP

SEQ ID NO: 3338545 - protein, 7 aa, Plasmodium falciparum
PNENKSN

SEQ ID NO: 3338546 - protein, 11 aa, Plasmodium falciparum
PNENNKSVSNN

SEQ ID NO: 3338547 - protein, 10 aa, Plasmodium falciparum
PNENNNNESS

SEQ ID NO: 3338548 - protein, 11 aa, Plasmodium falciparum
PNENNPIEVES

SEQ ID NO: 3338549 - protein, 6 aa, Plasmodium falciparum
PNENNW

SEQ ID NO: 3338550 - protein, 5 aa, Plasmodium falciparum
PNEQG

SEQ ID NO: 3338551 - protein, 6 aa, Plasmodium falciparum
PNEQMT

SEQ ID NO: 3338552 - protein, 6 aa, Plasmodium falciparum
PNESGD

SEQ ID NO: 3338553 - protein, 16 aa, Plasmodium falciparum
PNESNEQDKAQNEDVD

SEQ ID NO: 3338554 - protein, 13 aa, Plasmodium falciparum
PNETKEKNNFNPK

SEQ ID NO: 3338555 - protein, 7 aa, Plasmodium falciparum
PNETNEL

SEQ ID NO: 3338556 - protein, 50 aa, Plasmodium falciparum
PNEYNSNKYHPNEYNPNKYHPNEYHPNEYRSNEYHPNQYNTNKHMDATSN

SEQ ID NO: 3338557 - protein, 8 aa, Plasmodium falciparum
PNEYRRPD

SEQ ID NO: 3338558 - protein, 4 aa, Plasmodium falciparum
PNFM

SEQ ID NO: 3338559 - protein, 116 aa, Plasmodium falciparum
PNGDEQNHENKKQEDNNNNNDDNNNKNKNNDDDNNNNNNNNNNNNDNNNKNNHNNDNNNNDNNNKNNHNNNNNDNHKNNSNNKAKGKNMGKGKKQTPNRMNNTKNVQNGKNTKNIN

SEQ ID NO: 3338560 - protein, 6 aa, Plasmodium falciparum
PNGEMP

SEQ ID NO: 3338561 - protein, 9 aa, Plasmodium falciparum
PNGGPNNNM

SEQ ID NO: 3338562 - protein, 10 aa, Plasmodium falciparum
PNGINNEEKP

SEQ ID NO: 3338563 - protein, 13 aa, Plasmodium falciparum
PNGKYIASSSKDK

SEQ ID NO: 3338564 - protein, 6 aa, Plasmodium falciparum
PNGSII

SEQ ID NO: 3338565 - protein, 10 aa, Plasmodium falciparum
PNGSTSKANL

SEQ ID NO: 3338566 - protein, 7 aa, Plasmodium falciparum
PNGSYSC

SEQ ID NO: 3338567 - protein, 8 aa, Plasmodium falciparum
PNGTAYEG

SEQ ID NO: 3338568 - protein, 7 aa, Plasmodium falciparum
PNGVKPT

SEQ ID NO: 3338569 - protein, 7 aa, Plasmodium falciparum
PNGYNKT

SEQ ID NO: 3338570 - protein, 10 aa, Plasmodium falciparum
PNHNNSPIPI

SEQ ID NO: 3338571 - protein, 5 aa, Plasmodium falciparum
PNHPF

SEQ ID NO: 3338572 - protein, 13 aa, Plasmodium falciparum
PNHPNNTNTNINT

SEQ ID NO: 3338573 - protein, 24 aa, Plasmodium falciparum
PNHSNDMKNAPPDDTNDDHENDNN

SEQ ID NO: 3338574 - protein, 6 aa, Plasmodium falciparum
PNIDDE

SEQ ID NO: 3338575 - protein, 4 aa, Plasmodium falciparum
PNIE

SEQ ID NO: 3338576 - protein, 29 aa, Plasmodium falciparum
PNIEESNDTKISKKEKNNNNKKKKRNYPL

SEQ ID NO: 3338577 - protein, 4 aa, Plasmodium falciparum
PNIK

SEQ ID NO: 3338578 - protein, 10 aa, Plasmodium falciparum
PNIKNSPDYP

SEQ ID NO: 3338579 - protein, 6 aa, Plasmodium falciparum
PNIPKI

SEQ ID NO: 3338580 - protein, 12 aa, Plasmodium falciparum
PNIPSPPSLPNN

SEQ ID NO: 3338581 - protein, 5 aa, Plasmodium falciparum
PNITE

SEQ ID NO: 3338582 - protein, 7 aa, Plasmodium falciparum
PNITSGR

SEQ ID NO: 3338583 - protein, 28 aa, Plasmodium falciparum
PNKDADNQNDVYNNNNNNNNNNNNNNNI

SEQ ID NO: 3338584 - protein, 12 aa, Plasmodium falciparum
PNKDKDSIEKEA

SEQ ID NO: 3338585 - protein, 6 aa, Plasmodium falciparum
PNKEEF

SEQ ID NO: 3338586 - protein, 12 aa, Plasmodium falciparum
PNKEEKKKSNET

SEQ ID NO: 3338587 - protein, 6 aa, Plasmodium falciparum
PNKEGR

SEQ ID NO: 3338588 - protein, 5 aa, Plasmodium falciparum
PNKEV

SEQ ID NO: 3338589 - protein, 11 aa, Plasmodium falciparum
PNKKDNYKNKN

SEQ ID NO: 3338590 - protein, 7 aa, Plasmodium falciparum
PNKKENT

SEQ ID NO: 3338591 - protein, 11 aa, Plasmodium falciparum
PNKKSSSGTCK

SEQ ID NO: 3338592 - protein, 12 aa, Plasmodium falciparum
PNKKSVTLPKDN

SEQ ID NO: 3338593 - protein, 52 aa, Plasmodium falciparum
PNKNKNDLSEDDHTQHTDFQSDDNSKEGSYNFSESDKEEYRNNKKKEKHGIK

SEQ ID NO: 3338594 - protein, 9 aa, Plasmodium falciparum
PNKPYDNNN

SEQ ID NO: 3338595 - protein, 12 aa, Plasmodium falciparum
PNKRKELNSGDN

SEQ ID NO: 3338596 - protein, 22 aa, Plasmodium falciparum
PNKSNLNNTQNINKSPSYEKDK

SEQ ID NO: 3338597 - protein, 8 aa, Plasmodium falciparum
PNKSNTEN

SEQ ID NO: 3338598 - protein, 4 aa, Plasmodium falciparum
PNKT

SEQ ID NO: 3338599 - protein, 19 aa, Plasmodium falciparum
PNKTTEDKKNGGDPQNDIN

SEQ ID NO: 3338600 - protein, 7 aa, Plasmodium falciparum
PNKTTNN

SEQ ID NO: 3338601 - protein, 10 aa, Plasmodium falciparum
PNKVEGTEVT

SEQ ID NO: 3338602 - protein, 28 aa, Plasmodium falciparum
PNKYKNDQKYKHNEVEESSSSLNSDEKY

SEQ ID NO: 3338603 - protein, 6 aa, Plasmodium falciparum
PNLDNS

SEQ ID NO: 3338604 - protein, 10 aa, Plasmodium falciparum
PNLDSTKNNF

SEQ ID NO: 3338605 - protein, 8 aa, Plasmodium falciparum
PNLKGQAR

SEQ ID NO: 3338606 - protein, 4 aa, Plasmodium falciparum
PNLP

SEQ ID NO: 3338607 - protein, 6 aa, Plasmodium falciparum
PNLPRN

SEQ ID NO: 3338608 - protein, 7 aa, Plasmodium falciparum
PNMGGKS

SEQ ID NO: 3338609 - protein, 10 aa, Plasmodium falciparum
PNMGGKSTYI

SEQ ID NO: 3338610 - protein, 4 aa, Plasmodium falciparum
PNMP

SEQ ID NO: 3338611 - protein, 9 aa, Plasmodium falciparum
PNMSDPSND

SEQ ID NO: 3338612 - protein, 9 aa, Plasmodium falciparum
PNMSTTSSM

SEQ ID NO: 3338613 - protein, 4 aa, Plasmodium falciparum
PNNA

SEQ ID NO: 3338614 - protein, 8 aa, Plasmodium falciparum
PNNATSTI

SEQ ID NO: 3338615 - protein, 4 aa, Plasmodium falciparum
PNNC

SEQ ID NO: 3338616 - protein, 10 aa, Plasmodium falciparum
PNNEDEQKDI

SEQ ID NO: 3338617 - protein, 7 aa, Plasmodium falciparum
PNNEEEK

SEQ ID NO: 3338618 - protein, 5 aa, Plasmodium falciparum
PNNIN

SEQ ID NO: 3338619 - protein, 4 aa, Plasmodium falciparum
PNNK

SEQ ID NO: 3338620 - protein, 21 aa, Plasmodium falciparum
PNNKNYTYNNYRNEEKNRIRN

SEQ ID NO: 3338621 - protein, 7 aa, Plasmodium falciparum
PNNKTHN

SEQ ID NO: 3338622 - protein, 4 aa, Plasmodium falciparum
PNNN

SEQ ID NO: 3338623 - protein, 9 aa, Plasmodium falciparum
PNNNDYQDK

SEQ ID NO: 3338624 - protein, 19 aa, Plasmodium falciparum
PNNNHLKGHDTSRYSDSTS

SEQ ID NO: 3338625 - protein, 7 aa, Plasmodium falciparum
PNNNPMS

SEQ ID NO: 3338626 - protein, 23 aa, Plasmodium falciparum
PNNNQQASKKEKRHRSLSKFYNM

SEQ ID NO: 3338627 - protein, 5 aa, Plasmodium falciparum
PNNNS

SEQ ID NO: 3338628 - protein, 5 aa, Plasmodium falciparum
PNNNV

SEQ ID NO: 3338629 - protein, 4 aa, Plasmodium falciparum
PNNQ

SEQ ID NO: 3338630 - protein, 5 aa, Plasmodium falciparum
PNNQK

SEQ ID NO: 3338631 - protein, 5 aa, Plasmodium falciparum
PNNQY

SEQ ID NO: 3338632 - protein, 4 aa, Plasmodium falciparum
PNNS

SEQ ID NO: 3338633 - protein, 7 aa, Plasmodium falciparum
PNNSGKT

SEQ ID NO: 3338634 - protein, 59 aa, Plasmodium falciparum
PNNSNNSNNSNNSNNSNNSNNSNNSNNSNNSNNSNNSNNSNNSNNSNNSNNSNNSNNLN

SEQ ID NO: 3338635 - protein, 9 aa, Plasmodium falciparum
PNNSNSKNI

SEQ ID NO: 3338636 - protein, 8 aa, Plasmodium falciparum
PNNSSPQD

SEQ ID NO: 3338637 - protein, 8 aa, Plasmodium falciparum
PNNSYKKN

SEQ ID NO: 3338638 - protein, 5 aa, Plasmodium falciparum
PNNTN

SEQ ID NO: 3338639 - protein, 6 aa, Plasmodium falciparum
PNNTPN

SEQ ID NO: 3338640 - protein, 14 aa, Plasmodium falciparum
PNNYNPPPPPPGTL

SEQ ID NO: 3338641 - protein, 4 aa, Plasmodium falciparum
PNPD

SEQ ID NO: 3338642 - protein, 9 aa, Plasmodium falciparum
PNPLPGPQP

SEQ ID NO: 3338643 - protein, 4 aa, Plasmodium falciparum
PNPN

SEQ ID NO: 3338644 - protein, 7 aa, Plasmodium falciparum
PNPNYSP

SEQ ID NO: 3338645 - protein, 9 aa, Plasmodium falciparum
PNPQTNVKQ

SEQ ID NO: 3338646 - protein, 11 aa, Plasmodium falciparum
PNPSDPLNSDA

SEQ ID NO: 3338647 - protein, 20 aa, Plasmodium falciparum
PNQAEKIEVEKKKKRNSHDE

SEQ ID NO: 3338648 - protein, 7 aa, Plasmodium falciparum
PNQEKQA

SEQ ID NO: 3338649 - protein, 7 aa, Plasmodium falciparum
PNQFPKE

SEQ ID NO: 3338650 - protein, 19 aa, Plasmodium falciparum
PNQNEEMTADEKSGIHPGN

SEQ ID NO: 3338651 - protein, 6 aa, Plasmodium falciparum
PNQNND

SEQ ID NO: 3338652 - protein, 7 aa, Plasmodium falciparum
PNQRITA

SEQ ID NO: 3338653 - protein, 14 aa, Plasmodium falciparum
PNRFDSNKKKTINI

SEQ ID NO: 3338654 - protein, 14 aa, Plasmodium falciparum
PNRKNMIVKKNFNL

SEQ ID NO: 3338655 - protein, 42 aa, Plasmodium falciparum
PNRSRQYNNRSANNKGNMGANKQYNNKNNNNNNNKKKTNSNV

SEQ ID NO: 3338656 - protein, 7 aa, Plasmodium falciparum
PNSAKSK

SEQ ID NO: 3338657 - protein, 5 aa, Plasmodium falciparum
PNSRE

SEQ ID NO: 3338658 - protein, 7 aa, Plasmodium falciparum
PNSRGTA

SEQ ID NO: 3338659 - protein, 14 aa, Plasmodium falciparum
PNSSHLATGSGDNT

SEQ ID NO: 3338660 - protein, 9 aa, Plasmodium falciparum
PNSSRGGYN

SEQ ID NO: 3338661 - protein, 21 aa, Plasmodium falciparum
PNSTDVLNGQKEQETSPGDSM

SEQ ID NO: 3338662 - protein, 9 aa, Plasmodium falciparum
PNSTEVSGV

SEQ ID NO: 3338663 - protein, 8 aa, Plasmodium falciparum
PNSTGSDI

SEQ ID NO: 3338664 - protein, 34 aa, Plasmodium falciparum
PNSTNSSSTNKGTRGNNNNGNKKSSNDSDAESFN

SEQ ID NO: 3338665 - protein, 4 aa, Plasmodium falciparum
PNSW

SEQ ID NO: 3338666 - protein, 4 aa, Plasmodium falciparum
PNTI

SEQ ID NO: 3338667 - protein, 12 aa, Plasmodium falciparum
PNTLSNGNNSNV

SEQ ID NO: 3338668 - protein, 7 aa, Plasmodium falciparum
PNTPNDF

SEQ ID NO: 3338669 - protein, 5 aa, Plasmodium falciparum
PNTPV

SEQ ID NO: 3338670 - protein, 8 aa, Plasmodium falciparum
PNTSESES

SEQ ID NO: 3338671 - protein, 7 aa, Plasmodium falciparum
PNTTTTI

SEQ ID NO: 3338672 - protein, 5 aa, Plasmodium falciparum
PNVGK

SEQ ID NO: 3338673 - protein, 6 aa, Plasmodium falciparum
PNVNNK

SEQ ID NO: 3338674 - protein, 13 aa, Plasmodium falciparum
PNVPYNNNNNYNY

SEQ ID NO: 3338675 - protein, 10 aa, Plasmodium falciparum
PNVSNNTGTI

SEQ ID NO: 3338676 - protein, 4 aa, Plasmodium falciparum
PNVT

SEQ ID NO: 3338677 - protein, 16 aa, Plasmodium falciparum
PNYAKSNSNIDGPTIE

SEQ ID NO: 3338678 - protein, 13 aa, Plasmodium falciparum
PNYAQNRSDYGEE

SEQ ID NO: 3338679 - protein, 4 aa, Plasmodium falciparum
PNYD

SEQ ID NO: 3338680 - protein, 13 aa, Plasmodium falciparum
PNYNNNSNNYGKN

SEQ ID NO: 3338681 - protein, 8 aa, Plasmodium falciparum
PNYPETVQ

SEQ ID NO: 3338682 - protein, 4 aa, Plasmodium falciparum
PNYS

SEQ ID NO: 3338683 - protein, 11 aa, Plasmodium falciparum
PNYSNKKNIRN

SEQ ID NO: 3338684 - protein, 6 aa, Plasmodium falciparum
PPAPET

SEQ ID NO: 3338685 - protein, 8 aa, Plasmodium falciparum
PPAPRGVP

SEQ ID NO: 3338686 - protein, 5 aa, Plasmodium falciparum
PPDFD

SEQ ID NO: 3338687 - protein, 10 aa, Plasmodium falciparum
PPDNAKTPDN

SEQ ID NO: 3338688 - protein, 9 aa, Plasmodium falciparum
PPDPKPQTK

SEQ ID NO: 3338689 - protein, 4 aa, Plasmodium falciparum
PPEC

SEQ ID NO: 3338690 - protein, 4 aa, Plasmodium falciparum
PPEF

SEQ ID NO: 3338691 - protein, 5 aa, Plasmodium falciparum
PPEGW

SEQ ID NO: 3338692 - protein, 5 aa, Plasmodium falciparum
PPENL

SEQ ID NO: 3338693 - protein, 5 aa, Plasmodium falciparum
PPEPN

SEQ ID NO: 3338694 - protein, 11 aa, Plasmodium falciparum
PPESKRIERKE

SEQ ID NO: 3338695 - protein, 8 aa, Plasmodium falciparum
PPETTDDE

SEQ ID NO: 3338696 - protein, 9 aa, Plasmodium falciparum
PPFKSNNSN

SEQ ID NO: 3338697 - protein, 8 aa, Plasmodium falciparum
PPFNGSNE

SEQ ID NO: 3338698 - protein, 12 aa, Plasmodium falciparum
PPFSNTQQLNRE

SEQ ID NO: 3338699 - protein, 8 aa, Plasmodium falciparum
PPFSPDTS

SEQ ID NO: 3338700 - protein, 5 aa, Plasmodium falciparum
PPGCQ

SEQ ID NO: 3338701 - protein, 5 aa, Plasmodium falciparum
PPGCS

SEQ ID NO: 3338702 - protein, 8 aa, Plasmodium falciparum
PPGREAYP

SEQ ID NO: 3338703 - protein, 8 aa, Plasmodium falciparum
PPGSGKTM

SEQ ID NO: 3338704 - protein, 7 aa, Plasmodium falciparum
PPGTGKT

SEQ ID NO: 3338705 - protein, 10 aa, Plasmodium falciparum
PPGTGKTSAI

SEQ ID NO: 3338706 - protein, 5 aa, Plasmodium falciparum
PPGTN

SEQ ID NO: 3338707 - protein, 8 aa, Plasmodium falciparum
PPHEGEVN

SEQ ID NO: 3338708 - protein, 4 aa, Plasmodium falciparum
PPIN

SEQ ID NO: 3338709 - protein, 11 aa, Plasmodium falciparum
PPINQSSRFGN

SEQ ID NO: 3338710 - protein, 4 aa, Plasmodium falciparum
PPIP

SEQ ID NO: 3338711 - protein, 6 aa, Plasmodium falciparum
PPIPPI

SEQ ID NO: 3338712 - protein, 4 aa, Plasmodium falciparum
PPIS

SEQ ID NO: 3338713 - protein, 8 aa, Plasmodium falciparum
PPKEETKV

SEQ ID NO: 3338714 - protein, 16 aa, Plasmodium falciparum
PPKHTYYEQNNKTSNY

SEQ ID NO: 3338715 - protein, 5 aa, Plasmodium falciparum
PPKKS

SEQ ID NO: 3338716 - protein, 5 aa, Plasmodium falciparum
PPKNS

SEQ ID NO: 3338717 - protein, 11 aa, Plasmodium falciparum
PPKQDNDLKNE

SEQ ID NO: 3338718 - protein, 10 aa, Plasmodium falciparum
PPKYSDENDI

SEQ ID NO: 3338719 - protein, 4 aa, Plasmodium falciparum
PPLA

SEQ ID NO: 3338720 - protein, 5 aa, Plasmodium falciparum
PPLPL

SEQ ID NO: 3338721 - protein, 5 aa, Plasmodium falciparum
PPMPP

SEQ ID NO: 3338722 - protein, 4 aa, Plasmodium falciparum
PPNA

SEQ ID NO: 3338723 - protein, 5 aa, Plasmodium falciparum
PPNDA

SEQ ID NO: 3338724 - protein, 7 aa, Plasmodium falciparum
PPNEETY

SEQ ID NO: 3338725 - protein, 65 aa, Plasmodium falciparum
PPNETIKNNTRGQRNNDTDNVRNNNNNDNDNKNNDNKNNDNDNNNNNNTRRRNNYYDNNSYNNPS

SEQ ID NO: 3338726 - protein, 12 aa, Plasmodium falciparum
PPNPHQPTSSNY

SEQ ID NO: 3338727 - protein, 8 aa, Plasmodium falciparum
PPNSTEEK

SEQ ID NO: 3338728 - protein, 4 aa, Plasmodium falciparum
PPNT

SEQ ID NO: 3338729 - protein, 7 aa, Plasmodium falciparum
PPNTTRK

SEQ ID NO: 3338730 - protein, 4 aa, Plasmodium falciparum
PPNV

SEQ ID NO: 3338731 - protein, 8 aa, Plasmodium falciparum
PPNYTYDP

SEQ ID NO: 3338732 - protein, 4 aa, Plasmodium falciparum
PPPA

SEQ ID NO: 3338733 - protein, 6 aa, Plasmodium falciparum
PPPDYD

SEQ ID NO: 3338734 - protein, 6 aa, Plasmodium falciparum
PPPIPP

SEQ ID NO: 3338735 - protein, 5 aa, Plasmodium falciparum
PPPLY

SEQ ID NO: 3338736 - protein, 4 aa, Plasmodium falciparum
PPPN

SEQ ID NO: 3338737 - protein, 7 aa, Plasmodium falciparum
PPPPPKM

SEQ ID NO: 3338738 - protein, 21 aa, Plasmodium falciparum
PPPPPTFKPPPPPPPKEKNKI

SEQ ID NO: 3338739 - protein, 6 aa, Plasmodium falciparum
PPPQTI

SEQ ID NO: 3338740 - protein, 4 aa, Plasmodium falciparum
PPPY

SEQ ID NO: 3338741 - protein, 4 aa, Plasmodium falciparum
PPQD

SEQ ID NO: 3338742 - protein, 4 aa, Plasmodium falciparum
PPQN

SEQ ID NO: 3338743 - protein, 4 aa, Plasmodium falciparum
PPQP

SEQ ID NO: 3338744 - protein, 7 aa, Plasmodium falciparum
PPRKGFK

SEQ ID NO: 3338745 - protein, 6 aa, Plasmodium falciparum
PPRVTN

SEQ ID NO: 3338746 - protein, 5 aa, Plasmodium falciparum
PPSAH

SEQ ID NO: 3338747 - protein, 4 aa, Plasmodium falciparum
PPSI

SEQ ID NO: 3338748 - protein, 5 aa, Plasmodium falciparum
PPSIQ

SEQ ID NO: 3338749 - protein, 4 aa, Plasmodium falciparum
PPSR

SEQ ID NO: 3338750 - protein, 7 aa, Plasmodium falciparum
PPTEDFP

SEQ ID NO: 3338751 - protein, 7 aa, Plasmodium falciparum
PPTNVEE

SEQ ID NO: 3338752 - protein, 5 aa, Plasmodium falciparum
PPTYK

SEQ ID NO: 3338753 - protein, 4 aa, Plasmodium falciparum
PPVV

SEQ ID NO: 3338754 - protein, 4 aa, Plasmodium falciparum
PPYE

SEQ ID NO: 3338755 - protein, 4 aa, Plasmodium falciparum
PPYP

SEQ ID NO: 3338756 - protein, 5 aa, Plasmodium falciparum
PPYYG

SEQ ID NO: 3338757 - protein, 5 aa, Plasmodium falciparum
PQDDQ

SEQ ID NO: 3338758 - protein, 10 aa, Plasmodium falciparum
PQDNSDDNKS

SEQ ID NO: 3338759 - protein, 7 aa, Plasmodium falciparum
PQDYQNE

SEQ ID NO: 3338760 - protein, 10 aa, Plasmodium falciparum
PQEKKKYGNM

SEQ ID NO: 3338761 - protein, 5 aa, Plasmodium falciparum
PQEKY

SEQ ID NO: 3338762 - protein, 4 aa, Plasmodium falciparum
PQGI

SEQ ID NO: 3338763 - protein, 11 aa, Plasmodium falciparum
PQGNADNKDSA

SEQ ID NO: 3338764 - protein, 4 aa, Plasmodium falciparum
PQHD

SEQ ID NO: 3338765 - protein, 8 aa, Plasmodium falciparum
PQHTTSMD

SEQ ID NO: 3338766 - protein, 4 aa, Plasmodium falciparum
PQII

SEQ ID NO: 3338767 - protein, 5 aa, Plasmodium falciparum
PQINT

SEQ ID NO: 3338768 - protein, 8 aa, Plasmodium falciparum
PQKENNKM

SEQ ID NO: 3338769 - protein, 17 aa, Plasmodium falciparum
PQKIQSDKSELSEIEQT

SEQ ID NO: 3338770 - protein, 7 aa, Plasmodium falciparum
PQKKKVD

SEQ ID NO: 3338771 - protein, 9 aa, Plasmodium falciparum
PQKKTGDVP

SEQ ID NO: 3338772 - protein, 18 aa, Plasmodium falciparum
PQKNDEDSNTSSDDEDMN

SEQ ID NO: 3338773 - protein, 8 aa, Plasmodium falciparum
PQKPNGKV

SEQ ID NO: 3338774 - protein, 10 aa, Plasmodium falciparum
PQKSNTNHKS

SEQ ID NO: 3338775 - protein, 5 aa, Plasmodium falciparum
PQLPP

SEQ ID NO: 3338776 - protein, 7 aa, Plasmodium falciparum
PQMPNSG

SEQ ID NO: 3338777 - protein, 5 aa, Plasmodium falciparum
PQNGK

SEQ ID NO: 3338778 - protein, 9 aa, Plasmodium falciparum
PQNNNNNNN

SEQ ID NO: 3338779 - protein, 5 aa, Plasmodium falciparum
PQNNT

SEQ ID NO: 3338780 - protein, 4 aa, Plasmodium falciparum
PQNS

SEQ ID NO: 3338781 - protein, 5 aa, Plasmodium falciparum
PQNSN

SEQ ID NO: 3338782 - protein, 4 aa, Plasmodium falciparum
PQNV

SEQ ID NO: 3338783 - protein, 14 aa, Plasmodium falciparum
PQPLNPAYKNDTDI

SEQ ID NO: 3338784 - protein, 4 aa, Plasmodium falciparum
PQPP

SEQ ID NO: 3338785 - protein, 5 aa, Plasmodium falciparum
PQPSD

SEQ ID NO: 3338786 - protein, 15 aa, Plasmodium falciparum
PQREGGKNNLHGNQV

SEQ ID NO: 3338787 - protein, 9 aa, Plasmodium falciparum
PQRPKEKDI

SEQ ID NO: 3338788 - protein, 8 aa, Plasmodium falciparum
PQSKYKQE

SEQ ID NO: 3338789 - protein, 9 aa, Plasmodium falciparum
PQSSRNKSL

SEQ ID NO: 3338790 - protein, 13 aa, Plasmodium falciparum
PQTHDKQKCKENF

SEQ ID NO: 3338791 - protein, 6 aa, Plasmodium falciparum
PQTSGG

SEQ ID NO: 3338792 - protein, 10 aa, Plasmodium falciparum
PQTSRTPSPF

SEQ ID NO: 3338793 - protein, 6 aa, Plasmodium falciparum
PQTVSE

SEQ ID NO: 3338794 - protein, 7 aa, Plasmodium falciparum
PQTYTTK

SEQ ID NO: 3338795 - protein, 5 aa, Plasmodium falciparum
PQYEN

SEQ ID NO: 3338796 - protein, 21 aa, Plasmodium falciparum
PQYNNSKKKPYDGDKNKKKYM

SEQ ID NO: 3338797 - protein, 6 aa, Plasmodium falciparum
PRAEKT

SEQ ID NO: 3338798 - protein, 5 aa, Plasmodium falciparum
PRANE

SEQ ID NO: 3338799 - protein, 8 aa, Plasmodium falciparum
PRDPYTPF

SEQ ID NO: 3338800 - protein, 11 aa, Plasmodium falciparum
PRDRGEGQSTE

SEQ ID NO: 3338801 - protein, 11 aa, Plasmodium falciparum
PRDTKNDSAYE

SEQ ID NO: 3338802 - protein, 6 aa, Plasmodium falciparum
PREAEV

SEQ ID NO: 3338803 - protein, 9 aa, Plasmodium falciparum
PREKSKSEY

SEQ ID NO: 3338804 - protein, 30 aa, Plasmodium falciparum
PRENGQYKNNNNKKKPENNHRKASGLYKNV

SEQ ID NO: 3338805 - protein, 15 aa, Plasmodium falciparum
PRGIYTSGKGSSSVG

SEQ ID NO: 3338806 - protein, 15 aa, Plasmodium falciparum
PRGVGTKDETSKKNG

SEQ ID NO: 3338807 - protein, 8 aa, Plasmodium falciparum
PRHPLSNN

SEQ ID NO: 3338808 - protein, 7 aa, Plasmodium falciparum
PRKENKN

SEQ ID NO: 3338809 - protein, 5 aa, Plasmodium falciparum
PRKGC

SEQ ID NO: 3338810 - protein, 7 aa, Plasmodium falciparum
PRKKPLD

SEQ ID NO: 3338811 - protein, 15 aa, Plasmodium falciparum
PRKSIDERKDTECQT

SEQ ID NO: 3338812 - protein, 7 aa, Plasmodium falciparum
PRKTHRG

SEQ ID NO: 3338813 - protein, 8 aa, Plasmodium falciparum
PRKTRAKD

SEQ ID NO: 3338814 - protein, 5 aa, Plasmodium falciparum
PRMRS

SEQ ID NO: 3338815 - protein, 6 aa, Plasmodium falciparum
PRMSSS

SEQ ID NO: 3338816 - protein, 5 aa, Plasmodium falciparum
PRNLN

SEQ ID NO: 3338817 - protein, 9 aa, Plasmodium falciparum
PRNNEPRRI

SEQ ID NO: 3338818 - protein, 5 aa, Plasmodium falciparum
PRNNK

SEQ ID NO: 3338819 - protein, 5 aa, Plasmodium falciparum
PRNPY

SEQ ID NO: 3338820 - protein, 9 aa, Plasmodium falciparum
PRNRSNKEK

SEQ ID NO: 3338821 - protein, 11 aa, Plasmodium falciparum
PRNYDDEKNEE

SEQ ID NO: 3338822 - protein, 4 aa, Plasmodium falciparum
PRSE

SEQ ID NO: 3338823 - protein, 7 aa, Plasmodium falciparum
PRSENQQ

SEQ ID NO: 3338824 - protein, 12 aa, Plasmodium falciparum
PRSFNNKRTDNI

SEQ ID NO: 3338825 - protein, 18 aa, Plasmodium falciparum
PRSNNLKDNDHNNTNYSN

SEQ ID NO: 3338826 - protein, 4 aa, Plasmodium falciparum
PRSP

SEQ ID NO: 3338827 - protein, 13 aa, Plasmodium falciparum
PRTDAQSVKESAY

SEQ ID NO: 3338828 - protein, 6 aa, Plasmodium falciparum
PRTRHE

SEQ ID NO: 3338829 - protein, 4 aa, Plasmodium falciparum
PRVE

SEQ ID NO: 3338830 - protein, 12 aa, Plasmodium falciparum
PRVNRRSDFPRN

SEQ ID NO: 3338831 - protein, 7 aa, Plasmodium falciparum
PSAIQQR

SEQ ID NO: 3338832 - protein, 10 aa, Plasmodium falciparum
PSASYDNRNK

SEQ ID NO: 3338833 - protein, 6 aa, Plasmodium falciparum
PSCGKS

SEQ ID NO: 3338834 - protein, 14 aa, Plasmodium falciparum
PSDEEDNKNRRASQ

SEQ ID NO: 3338835 - protein, 8 aa, Plasmodium falciparum
PSDEKNRN

SEQ ID NO: 3338836 - protein, 8 aa, Plasmodium falciparum
PSDELTSE

SEQ ID NO: 3338837 - protein, 7 aa, Plasmodium falciparum
PSDEPQD

SEQ ID NO: 3338838 - protein, 4 aa, Plasmodium falciparum
PSDI

SEQ ID NO: 3338839 - protein, 7 aa, Plasmodium falciparum
PSDKAEC

SEQ ID NO: 3338840 - protein, 4 aa, Plasmodium falciparum
PSDL

SEQ ID NO: 3338841 - protein, 13 aa, Plasmodium falciparum
PSDNENSDVNTDD

SEQ ID NO: 3338842 - protein, 8 aa, Plasmodium falciparum
PSDNEPQP

SEQ ID NO: 3338843 - protein, 6 aa, Plasmodium falciparum
PSDNNR

SEQ ID NO: 3338844 - protein, 8 aa, Plasmodium falciparum
PSDNSDNV

SEQ ID NO: 3338845 - protein, 6 aa, Plasmodium falciparum
PSDQAT

SEQ ID NO: 3338846 - protein, 5 aa, Plasmodium falciparum
PSDSE

SEQ ID NO: 3338847 - protein, 21 aa, Plasmodium falciparum
PSDSQTKEDYNYDKYRKNEDI

SEQ ID NO: 3338848 - protein, 6 aa, Plasmodium falciparum
PSDTNK

SEQ ID NO: 3338849 - protein, 7 aa, Plasmodium falciparum
PSDVTEN

SEQ ID NO: 3338850 - protein, 5 aa, Plasmodium falciparum
PSEAY

SEQ ID NO: 3338851 - protein, 10 aa, Plasmodium falciparum
PSEDINENGG

SEQ ID NO: 3338852 - protein, 7 aa, Plasmodium falciparum
PSEDQLR

SEQ ID NO: 3338853 - protein, 4 aa, Plasmodium falciparum
PSEE

SEQ ID NO: 3338854 - protein, 10 aa, Plasmodium falciparum
PSEEKHKTNE

SEQ ID NO: 3338855 - protein, 24 aa, Plasmodium falciparum
PSEKTKEEDYDQIEENPLDTLPQE

SEQ ID NO: 3338856 - protein, 7 aa, Plasmodium falciparum
PSERNND

SEQ ID NO: 3338857 - protein, 7 aa, Plasmodium falciparum
PSESDSS

SEQ ID NO: 3338858 - protein, 7 aa, Plasmodium falciparum
PSESKQV

SEQ ID NO: 3338859 - protein, 14 aa, Plasmodium falciparum
PSETAGRYVTYRLV

SEQ ID NO: 3338860 - protein, 8 aa, Plasmodium falciparum
PSETKNKN

SEQ ID NO: 3338861 - protein, 5 aa, Plasmodium falciparum
PSFPS

SEQ ID NO: 3338862 - protein, 7 aa, Plasmodium falciparum
PSGASTG

SEQ ID NO: 3338863 - protein, 5 aa, Plasmodium falciparum
PSGEE

SEQ ID NO: 3338864 - protein, 4 aa, Plasmodium falciparum
PSGK

SEQ ID NO: 3338865 - protein, 4 aa, Plasmodium falciparum
PSGL

SEQ ID NO: 3338866 - protein, 10 aa, Plasmodium falciparum
PSGLSEANKI

SEQ ID NO: 3338867 - protein, 4 aa, Plasmodium falciparum
PSGM

SEQ ID NO: 3338868 - protein, 5 aa, Plasmodium falciparum
PSGTE

SEQ ID NO: 3338869 - protein, 11 aa, Plasmodium falciparum
PSGTINDNNNN

SEQ ID NO: 3338870 - protein, 9 aa, Plasmodium falciparum
PSGTRLAST

SEQ ID NO: 3338871 - protein, 5 aa, Plasmodium falciparum
PSGVH

SEQ ID NO: 3338872 - protein, 13 aa, Plasmodium falciparum
PSHKGKKCTDNNY

SEQ ID NO: 3338873 - protein, 11 aa, Plasmodium falciparum
PSIEDSQKINT

SEQ ID NO: 3338874 - protein, 8 aa, Plasmodium falciparum
PSIGPTRK

SEQ ID NO: 3338875 - protein, 8 aa, Plasmodium falciparum
PSIKTKGT

SEQ ID NO: 3338876 - protein, 16 aa, Plasmodium falciparum
PSINNNNNNNKRKDTM

SEQ ID NO: 3338877 - protein, 7 aa, Plasmodium falciparum
PSKDDDT

SEQ ID NO: 3338878 - protein, 11 aa, Plasmodium falciparum
PSKDNTSKLDT

SEQ ID NO: 3338879 - protein, 6 aa, Plasmodium falciparum
PSKEDI

SEQ ID NO: 3338880 - protein, 7 aa, Plasmodium falciparum
PSKETTL

SEQ ID NO: 3338881 - protein, 19 aa, Plasmodium falciparum
PSKHPHGGGTSKKHTKRPK

SEQ ID NO: 3338882 - protein, 4 aa, Plasmodium falciparum
PSKI

SEQ ID NO: 3338883 - protein, 9 aa, Plasmodium falciparum
PSKKGGSQY

SEQ ID NO: 3338884 - protein, 15 aa, Plasmodium falciparum
PSKKGGYRYETGGTL

SEQ ID NO: 3338885 - protein, 6 aa, Plasmodium falciparum
PSKKTS

SEQ ID NO: 3338886 - protein, 11 aa, Plasmodium falciparum
PSKNENNLNEH

SEQ ID NO: 3338887 - protein, 16 aa, Plasmodium falciparum
PSKNPLDNCPTDQNKD

SEQ ID NO: 3338888 - protein, 4 aa, Plasmodium falciparum
PSKR

SEQ ID NO: 3338889 - protein, 14 aa, Plasmodium falciparum
PSKRDTPSSDTPMN

SEQ ID NO: 3338890 - protein, 25 aa, Plasmodium falciparum
PSKRDTQSGDIPSDDTPRNKFTDNE

SEQ ID NO: 3338891 - protein, 11 aa, Plasmodium falciparum
PSKSNKSYFSS

SEQ ID NO: 3338892 - protein, 7 aa, Plasmodium falciparum
PSKYKTK

SEQ ID NO: 3338893 - protein, 5 aa, Plasmodium falciparum
PSLDE

SEQ ID NO: 3338894 - protein, 4 aa, Plasmodium falciparum
PSLE

SEQ ID NO: 3338895 - protein, 4 aa, Plasmodium falciparum
PSLK

SEQ ID NO: 3338896 - protein, 8 aa, Plasmodium falciparum
PSLNPNNE

SEQ ID NO: 3338897 - protein, 4 aa, Plasmodium falciparum
PSMS

SEQ ID NO: 3338898 - protein, 6 aa, Plasmodium falciparum
PSMSNE

SEQ ID NO: 3338899 - protein, 13 aa, Plasmodium falciparum
PSMTTNPLATQHG

SEQ ID NO: 3338900 - protein, 10 aa, Plasmodium falciparum
PSNDDNNQIN

SEQ ID NO: 3338901 - protein, 19 aa, Plasmodium falciparum
PSNDKEQQKQSTQYNHNKH

SEQ ID NO: 3338902 - protein, 52 aa, Plasmodium falciparum
PSNENNNNNNNNNNNNNNNNNNNNNNNNNNNNNNNNNDCDTKYDANINSKCN

SEQ ID NO: 3338903 - protein, 14 aa, Plasmodium falciparum
PSNGNNNNNNNNNN

SEQ ID NO: 3338904 - protein, 5 aa, Plasmodium falciparum
PSNHK

SEQ ID NO: 3338905 - protein, 4 aa, Plasmodium falciparum
PSNI

SEQ ID NO: 3338906 - protein, 6 aa, Plasmodium falciparum
PSNIRN

SEQ ID NO: 3338907 - protein, 17 aa, Plasmodium falciparum
PSNKDNREISRTSTTVS

SEQ ID NO: 3338908 - protein, 10 aa, Plasmodium falciparum
PSNKSNDTLD

SEQ ID NO: 3338909 - protein, 5 aa, Plasmodium falciparum
PSNNF

SEQ ID NO: 3338910 - protein, 7 aa, Plasmodium falciparum
PSNNTEV

SEQ ID NO: 3338911 - protein, 7 aa, Plasmodium falciparum
PSNSINN

SEQ ID NO: 3338912 - protein, 12 aa, Plasmodium falciparum
PSNTSYNSKGIK

SEQ ID NO: 3338913 - protein, 6 aa, Plasmodium falciparum
PSNYDN

SEQ ID NO: 3338914 - protein, 5 aa, Plasmodium falciparum
PSNYK

SEQ ID NO: 3338915 - protein, 9 aa, Plasmodium falciparum
PSNYNSTEN

SEQ ID NO: 3338916 - protein, 9 aa, Plasmodium falciparum
PSPADAQKY

SEQ ID NO: 3338917 - protein, 7 aa, Plasmodium falciparum
PSPGATT

SEQ ID NO: 3338918 - protein, 7 aa, Plasmodium falciparum
PSPIRPS

SEQ ID NO: 3338919 - protein, 11 aa, Plasmodium falciparum
PSPLDNAKNKT

SEQ ID NO: 3338920 - protein, 4 aa, Plasmodium falciparum
PSPN

SEQ ID NO: 3338921 - protein, 6 aa, Plasmodium falciparum
PSPNQK

SEQ ID NO: 3338922 - protein, 6 aa, Plasmodium falciparum
PSPNVY

SEQ ID NO: 3338923 - protein, 6 aa, Plasmodium falciparum
PSQEEL

SEQ ID NO: 3338924 - protein, 11 aa, Plasmodium falciparum
PSQIKKTTKAL

SEQ ID NO: 3338925 - protein, 4 aa, Plasmodium falciparum
PSQN

SEQ ID NO: 3338926 - protein, 7 aa, Plasmodium falciparum
PSQNYDT

SEQ ID NO: 3338927 - protein, 5 aa, Plasmodium falciparum
PSQSY

SEQ ID NO: 3338928 - protein, 6 aa, Plasmodium falciparum
PSRENN

SEQ ID NO: 3338929 - protein, 11 aa, Plasmodium falciparum
PSRKTRNSKNE

SEQ ID NO: 3338930 - protein, 11 aa, Plasmodium falciparum
PSRSTKRPTSY

SEQ ID NO: 3338931 - protein, 4 aa, Plasmodium falciparum
PSRY

SEQ ID NO: 3338932 - protein, 11 aa, Plasmodium falciparum
PSSASNGNSKY

SEQ ID NO: 3338933 - protein, 8 aa, Plasmodium falciparum
PSSCSNDK

SEQ ID NO: 3338934 - protein, 6 aa, Plasmodium falciparum
PSSEIT

SEQ ID NO: 3338935 - protein, 6 aa, Plasmodium falciparum
PSSGNK

SEQ ID NO: 3338936 - protein, 7 aa, Plasmodium falciparum
PSSGPVN

SEQ ID NO: 3338937 - protein, 8 aa, Plasmodium falciparum
PSSKTYDM

SEQ ID NO: 3338938 - protein, 5 aa, Plasmodium falciparum
PSSLQ

SEQ ID NO: 3338939 - protein, 8 aa, Plasmodium falciparum
PSSNDVPK

SEQ ID NO: 3338940 - protein, 7 aa, Plasmodium falciparum
PSSNQIY

SEQ ID NO: 3338941 - protein, 8 aa, Plasmodium falciparum
PSSQGTKW

SEQ ID NO: 3338942 - protein, 5 aa, Plasmodium falciparum
PSSQK

SEQ ID NO: 3338943 - protein, 21 aa, Plasmodium falciparum
PSSQNDYSNERNNVENNKNEQ

SEQ ID NO: 3338944 - protein, 6 aa, Plasmodium falciparum
PSSSHD

SEQ ID NO: 3338945 - protein, 4 aa, Plasmodium falciparum
PSST

SEQ ID NO: 3338946 - protein, 6 aa, Plasmodium falciparum
PSSVNT

SEQ ID NO: 3338947 - protein, 4 aa, Plasmodium falciparum
PSSY

SEQ ID NO: 3338948 - protein, 15 aa, Plasmodium falciparum
PSSYVNGAGKNMDSA

SEQ ID NO: 3338949 - protein, 6 aa, Plasmodium falciparum
PSTCNY

SEQ ID NO: 3338950 - protein, 4 aa, Plasmodium falciparum
PSTD

SEQ ID NO: 3338951 - protein, 7 aa, Plasmodium falciparum
PSTKKEE

SEQ ID NO: 3338952 - protein, 13 aa, Plasmodium falciparum
PSTKSRRRYAQKN

SEQ ID NO: 3338953 - protein, 10 aa, Plasmodium falciparum
PSTNNINNNV

SEQ ID NO: 3338954 - protein, 8 aa, Plasmodium falciparum
PSTPVSNN

SEQ ID NO: 3338955 - protein, 47 aa, Plasmodium falciparum
PSTSNSTLSSQQVSTSPTKISSQADIKDDTTCNSQKKTNIPSNEDLT

SEQ ID NO: 3338956 - protein, 9 aa, Plasmodium falciparum
PSTSQNRSN

SEQ ID NO: 3338957 - protein, 5 aa, Plasmodium falciparum
PSVAK

SEQ ID NO: 3338958 - protein, 9 aa, Plasmodium falciparum
PSVDEENKS

SEQ ID NO: 3338959 - protein, 10 aa, Plasmodium falciparum
PSVNHSATPN

SEQ ID NO: 3338960 - protein, 4 aa, Plasmodium falciparum
PSVR

SEQ ID NO: 3338961 - protein, 6 aa, Plasmodium falciparum
PSYEET

SEQ ID NO: 3338962 - protein, 14 aa, Plasmodium falciparum
PSYNENNTNNNNNK

SEQ ID NO: 3338963 - protein, 22 aa, Plasmodium falciparum
PSYSDKSFSNTTNNTKGCNTSN

SEQ ID NO: 3338964 - protein, 14 aa, Plasmodium falciparum
PSYSPTSPTYNANN

SEQ ID NO: 3338965 - protein, 11 aa, Plasmodium falciparum
PSYTQKDQQNN

SEQ ID NO: 3338966 - protein, 29 aa, Plasmodium falciparum
PSYTTSNNNNNNNNNNNNNNNNNSNNNNN

SEQ ID NO: 3338967 - protein, 5 aa, Plasmodium falciparum
PSYYP

SEQ ID NO: 3338968 - protein, 5 aa, Plasmodium falciparum
PTAIT

SEQ ID NO: 3338969 - protein, 9 aa, Plasmodium falciparum
PTALERGAK

SEQ ID NO: 3338970 - protein, 8 aa, Plasmodium falciparum
PTASTSQI

SEQ ID NO: 3338971 - protein, 4 aa, Plasmodium falciparum
PTDE

SEQ ID NO: 3338972 - protein, 6 aa, Plasmodium falciparum
PTDGYL

SEQ ID NO: 3338973 - protein, 6 aa, Plasmodium falciparum
PTDIST

SEQ ID NO: 3338974 - protein, 10 aa, Plasmodium falciparum
PTDPTIPPNE

SEQ ID NO: 3338975 - protein, 4 aa, Plasmodium falciparum
PTED

SEQ ID NO: 3338976 - protein, 7 aa, Plasmodium falciparum
PTEDGTD

SEQ ID NO: 3338977 - protein, 8 aa, Plasmodium falciparum
PTEEEQNV

SEQ ID NO: 3338978 - protein, 5 aa, Plasmodium falciparum
PTEET

SEQ ID NO: 3338979 - protein, 4 aa, Plasmodium falciparum
PTEG

SEQ ID NO: 3338980 - protein, 6 aa, Plasmodium falciparum
PTEGYY

SEQ ID NO: 3338981 - protein, 9 aa, Plasmodium falciparum
PTEPSYDDE

SEQ ID NO: 3338982 - protein, 8 aa, Plasmodium falciparum
PTEYDENY

SEQ ID NO: 3338983 - protein, 6 aa, Plasmodium falciparum
PTFGNY

SEQ ID NO: 3338984 - protein, 4 aa, Plasmodium falciparum
PTGD

SEQ ID NO: 3338985 - protein, 8 aa, Plasmodium falciparum
PTGSGKTN

SEQ ID NO: 3338986 - protein, 6 aa, Plasmodium falciparum
PTGTGK

SEQ ID NO: 3338987 - protein, 6 aa, Plasmodium falciparum
PTIEND

SEQ ID NO: 3338988 - protein, 4 aa, Plasmodium falciparum
PTIS

SEQ ID NO: 3338989 - protein, 8 aa, Plasmodium falciparum
PTKAEAAK

SEQ ID NO: 3338990 - protein, 10 aa, Plasmodium falciparum
PTKARTAEKH

SEQ ID NO: 3338991 - protein, 4 aa, Plasmodium falciparum
PTKE

SEQ ID NO: 3338992 - protein, 8 aa, Plasmodium falciparum
PTKGNIND

SEQ ID NO: 3338993 - protein, 9 aa, Plasmodium falciparum
PTKNSNNIS

SEQ ID NO: 3338994 - protein, 6 aa, Plasmodium falciparum
PTKNYN

SEQ ID NO: 3338995 - protein, 39 aa, Plasmodium falciparum
PTKTNKNVSTINNQNNEEDMKQKEKDVNEQTVEKKEDNN

SEQ ID NO: 3338996 - protein, 6 aa, Plasmodium falciparum
PTLDNP

SEQ ID NO: 3338997 - protein, 6 aa, Plasmodium falciparum
PTLIPN

SEQ ID NO: 3338998 - protein, 4 aa, Plasmodium falciparum
PTLT

SEQ ID NO: 3338999 - protein, 4 aa, Plasmodium falciparum
PTNC

SEQ ID NO: 3339000 - protein, 12 aa, Plasmodium falciparum
PTNDQDGDKKKN

SEQ ID NO: 3339001 - protein, 4 aa, Plasmodium falciparum
PTNI

SEQ ID NO: 3339002 - protein, 6 aa, Plasmodium falciparum
PTNIEN

SEQ ID NO: 3339003 - protein, 10 aa, Plasmodium falciparum
PTNKKRPQME

SEQ ID NO: 3339004 - protein, 5 aa, Plasmodium falciparum
PTNKN

SEQ ID NO: 3339005 - protein, 11 aa, Plasmodium falciparum
PTNTNGNYYRD

SEQ ID NO: 3339006 - protein, 6 aa, Plasmodium falciparum
PTNVGQ

SEQ ID NO: 3339007 - protein, 16 aa, Plasmodium falciparum
PTNVSNNTNVKKNEYT

SEQ ID NO: 3339008 - protein, 4 aa, Plasmodium falciparum
PTNY

SEQ ID NO: 3339009 - protein, 9 aa, Plasmodium falciparum
PTPDPKKEI

SEQ ID NO: 3339010 - protein, 5 aa, Plasmodium falciparum
PTPID

SEQ ID NO: 3339011 - protein, 5 aa, Plasmodium falciparum
PTPIE

SEQ ID NO: 3339012 - protein, 11 aa, Plasmodium falciparum
PTPPPQLPHTG

SEQ ID NO: 3339013 - protein, 10 aa, Plasmodium falciparum
PTPTKLPSRY

SEQ ID NO: 3339014 - protein, 4 aa, Plasmodium falciparum
PTQA

SEQ ID NO: 3339015 - protein, 22 aa, Plasmodium falciparum
PTQEDDSIKSKGRSSLAPRRKM

SEQ ID NO: 3339016 - protein, 7 aa, Plasmodium falciparum
PTQEKQQ

SEQ ID NO: 3339017 - protein, 4 aa, Plasmodium falciparum
PTQI

SEQ ID NO: 3339018 - protein, 4 aa, Plasmodium falciparum
PTQK

SEQ ID NO: 3339019 - protein, 12 aa, Plasmodium falciparum
PTRKLNKEEEND

SEQ ID NO: 3339020 - protein, 12 aa, Plasmodium falciparum
PTRNPNNRPENN

SEQ ID NO: 3339021 - protein, 6 aa, Plasmodium falciparum
PTSDKG

SEQ ID NO: 3339022 - protein, 4 aa, Plasmodium falciparum
PTSE

SEQ ID NO: 3339023 - protein, 7 aa, Plasmodium falciparum
PTSEAKE

SEQ ID NO: 3339024 - protein, 7 aa, Plasmodium falciparum
PTSGGKT

SEQ ID NO: 3339025 - protein, 15 aa, Plasmodium falciparum
PTSKEEKKSKTNNNM

SEQ ID NO: 3339026 - protein, 5 aa, Plasmodium falciparum
PTSKI

SEQ ID NO: 3339027 - protein, 6 aa, Plasmodium falciparum
PTSNAQ

SEQ ID NO: 3339028 - protein, 11 aa, Plasmodium falciparum
PTSNLKSEDDA

SEQ ID NO: 3339029 - protein, 5 aa, Plasmodium falciparum
PTSPE

SEQ ID NO: 3339030 - protein, 33 aa, Plasmodium falciparum
PTSQTNNSKQITNTDSQTIQQNTNSDHHDNKNM

SEQ ID NO: 3339031 - protein, 7 aa, Plasmodium falciparum
PTSYQKG

SEQ ID NO: 3339032 - protein, 7 aa, Plasmodium falciparum
PTTGEKF

SEQ ID NO: 3339033 - protein, 4 aa, Plasmodium falciparum
PTTN

SEQ ID NO: 3339034 - protein, 15 aa, Plasmodium falciparum
PTVYDSSSKDDYEIS

SEQ ID NO: 3339035 - protein, 9 aa, Plasmodium falciparum
PTYEKNERT

SEQ ID NO: 3339036 - protein, 5 aa, Plasmodium falciparum
PTYIP

SEQ ID NO: 3339037 - protein, 7 aa, Plasmodium falciparum
PVAPPPN

SEQ ID NO: 3339038 - protein, 5 aa, Plasmodium falciparum
PVDEK

SEQ ID NO: 3339039 - protein, 5 aa, Plasmodium falciparum
PVDID

SEQ ID NO: 3339040 - protein, 7 aa, Plasmodium falciparum
PVDTKPN

SEQ ID NO: 3339041 - protein, 8 aa, Plasmodium falciparum
PVEGKKKT

SEQ ID NO: 3339042 - protein, 5 aa, Plasmodium falciparum
PVHPG

SEQ ID NO: 3339043 - protein, 8 aa, Plasmodium falciparum
PVHQNGTL

SEQ ID NO: 3339044 - protein, 4 aa, Plasmodium falciparum
PVNE

SEQ ID NO: 3339045 - protein, 7 aa, Plasmodium falciparum
PVNTKRY

SEQ ID NO: 3339046 - protein, 6 aa, Plasmodium falciparum
PVNTSN

SEQ ID NO: 3339047 - protein, 4 aa, Plasmodium falciparum
PVQS

SEQ ID NO: 3339048 - protein, 16 aa, Plasmodium falciparum
PVSNKSRRNKNQNANS

SEQ ID NO: 3339049 - protein, 5 aa, Plasmodium falciparum
PVSPL

SEQ ID NO: 3339050 - protein, 6 aa, Plasmodium falciparum
PVSPNN

SEQ ID NO: 3339051 - protein, 5 aa, Plasmodium falciparum
PVTGS

SEQ ID NO: 3339052 - protein, 6 aa, Plasmodium falciparum
PVTKTP

SEQ ID NO: 3339053 - protein, 7 aa, Plasmodium falciparum
PVTTQEP

SEQ ID NO: 3339054 - protein, 5 aa, Plasmodium falciparum
PVYDK

SEQ ID NO: 3339055 - protein, 5 aa, Plasmodium falciparum
PYAKN

SEQ ID NO: 3339056 - protein, 4 aa, Plasmodium falciparum
PYAN

SEQ ID NO: 3339057 - protein, 10 aa, Plasmodium falciparum
PYANLKPKTY

SEQ ID NO: 3339058 - protein, 20 aa, Plasmodium falciparum
PYDEEERKKLPEPNTKESEK

SEQ ID NO: 3339059 - protein, 12 aa, Plasmodium falciparum
PYDEINKKNAEN

SEQ ID NO: 3339060 - protein, 4 aa, Plasmodium falciparum
PYDN

SEQ ID NO: 3339061 - protein, 10 aa, Plasmodium falciparum
PYDNKKSRNI

SEQ ID NO: 3339062 - protein, 66 aa, Plasmodium falciparum
PYEGTSNEKNTTNNNNNYNNNNNNRNNNRSNNRSNNRNNNRNNNRSNNRNNNRNNNRNNNSSKSPL

SEQ ID NO: 3339063 - protein, 7 aa, Plasmodium falciparum
PYEKKER

SEQ ID NO: 3339064 - protein, 10 aa, Plasmodium falciparum
PYEKKNPNYN

SEQ ID NO: 3339065 - protein, 11 aa, Plasmodium falciparum
PYETKKQVREN

SEQ ID NO: 3339066 - protein, 13 aa, Plasmodium falciparum
PYFEGEKKRNSKY

SEQ ID NO: 3339067 - protein, 12 aa, Plasmodium falciparum
PYFPDEKNPPCK

SEQ ID NO: 3339068 - protein, 5 aa, Plasmodium falciparum
PYGNN

SEQ ID NO: 3339069 - protein, 140 aa, Plasmodium falciparum
PYGRRSRDRDRERDRDRERDRERDRERDRDRERDRERERDRDRDRDRERDRNRERDRDRERDRERDRNRERDRDRDRDRDRDRDRDRDRDRDRDRDRDRDREKERKRDKDKDKENDKSKDADQKKHKLDTEELRVEKKKK

SEQ ID NO: 3339070 - protein, 4 aa, Plasmodium falciparum
PYGS

SEQ ID NO: 3339071 - protein, 4 aa, Plasmodium falciparum
PYHN

SEQ ID NO: 3339072 - protein, 5 aa, Plasmodium falciparum
PYKDK

SEQ ID NO: 3339073 - protein, 23 aa, Plasmodium falciparum
PYKEGNNNNNNNNNNNNNNNNKN

SEQ ID NO: 3339074 - protein, 32 aa, Plasmodium falciparum
PYKKNTNYKNRKENKKENKKENKKENKNNKKK

SEQ ID NO: 3339075 - protein, 7 aa, Plasmodium falciparum
PYKPKTR

SEQ ID NO: 3339076 - protein, 4 aa, Plasmodium falciparum
PYKT

SEQ ID NO: 3339077 - protein, 6 aa, Plasmodium falciparum
PYMPPE

SEQ ID NO: 3339078 - protein, 5 aa, Plasmodium falciparum
PYNDF

SEQ ID NO: 3339079 - protein, 13 aa, Plasmodium falciparum
PYNDVTKANKTTR

SEQ ID NO: 3339080 - protein, 6 aa, Plasmodium falciparum
PYNDYS

SEQ ID NO: 3339081 - protein, 9 aa, Plasmodium falciparum
PYNEKEKGS

SEQ ID NO: 3339082 - protein, 11 aa, Plasmodium falciparum
PYNENENENIN

SEQ ID NO: 3339083 - protein, 8 aa, Plasmodium falciparum
PYNESEHT

SEQ ID NO: 3339084 - protein, 18 aa, Plasmodium falciparum
PYNGSKITTTKHAYLNNI

SEQ ID NO: 3339085 - protein, 35 aa, Plasmodium falciparum
PYNKNDNNYNPYNKPHYNDKENDAYYEKNDDYNNA

SEQ ID NO: 3339086 - protein, 11 aa, Plasmodium falciparum
PYNNNNKKNNV

SEQ ID NO: 3339087 - protein, 19 aa, Plasmodium falciparum
PYNNNNNNYNNNNNNNNNK

SEQ ID NO: 3339088 - protein, 13 aa, Plasmodium falciparum
PYNNYESNETTDM

SEQ ID NO: 3339089 - protein, 4 aa, Plasmodium falciparum
PYNS

SEQ ID NO: 3339090 - protein, 6 aa, Plasmodium falciparum
PYNSRA

SEQ ID NO: 3339091 - protein, 5 aa, Plasmodium falciparum
PYNTN

SEQ ID NO: 3339092 - protein, 7 aa, Plasmodium falciparum
PYPESSK

SEQ ID NO: 3339093 - protein, 6 aa, Plasmodium falciparum
PYPSKS

SEQ ID NO: 3339094 - protein, 7 aa, Plasmodium falciparum
PYQRSGS

SEQ ID NO: 3339095 - protein, 10 aa, Plasmodium falciparum
PYRARDSRTR

SEQ ID NO: 3339096 - protein, 6 aa, Plasmodium falciparum
PYSEEY

SEQ ID NO: 3339097 - protein, 5 aa, Plasmodium falciparum
PYSLR

SEQ ID NO: 3339098 - protein, 30 aa, Plasmodium falciparum
PYSLSEKNELPKKEEGSTKKAENKNMDRKS

SEQ ID NO: 3339099 - protein, 8 aa, Plasmodium falciparum
PYSPPTKK

SEQ ID NO: 3339100 - protein, 5 aa, Plasmodium falciparum
PYTNR

SEQ ID NO: 3339101 - protein, 5 aa, Plasmodium falciparum
PYYEE

SEQ ID NO: 3339102 - protein, 4 aa, Plasmodium falciparum
PYYG

SEQ ID NO: 3339103 - protein, 8 aa, Plasmodium falciparum
PYYGGETA

SEQ ID NO: 3339104 - protein, 4 aa, Plasmodium falciparum
PYYN

SEQ ID NO: 3339105 - protein, 12 aa, Plasmodium falciparum
PYYNETMSSQNN

SEQ ID NO: 3339106 - protein, 11 aa, Plasmodium falciparum
PYYQDEGRFSN

SEQ ID NO: 3339107 - protein, 7 aa, Plasmodium falciparum
QAAGQAY

SEQ ID NO: 3339108 - protein, 4 aa, Plasmodium falciparum
QAAQ

SEQ ID NO: 3339109 - protein, 8 aa, Plasmodium falciparum
QAAQQQAV

SEQ ID NO: 3339110 - protein, 4 aa, Plasmodium falciparum
QADA

SEQ ID NO: 3339111 - protein, 6 aa, Plasmodium falciparum
QAEDDD

SEQ ID NO: 3339112 - protein, 6 aa, Plasmodium falciparum
QAEETV

SEQ ID NO: 3339113 - protein, 12 aa, Plasmodium falciparum
QAEGENEAQAEM

SEQ ID NO: 3339114 - protein, 5 aa, Plasmodium falciparum
QAFDA

SEQ ID NO: 3339115 - protein, 10 aa, Plasmodium falciparum
QAGDNKEQQK

SEQ ID NO: 3339116 - protein, 7 aa, Plasmodium falciparum
QAGNTVS

SEQ ID NO: 3339117 - protein, 17 aa, Plasmodium falciparum
QAKANEDKNKKNEELPN

SEQ ID NO: 3339118 - protein, 8 aa, Plasmodium falciparum
QAKDDKSG

SEQ ID NO: 3339119 - protein, 7 aa, Plasmodium falciparum
QAKDKTY

SEQ ID NO: 3339120 - protein, 17 aa, Plasmodium falciparum
QAKINNKKLTTATNMAN

SEQ ID NO: 3339121 - protein, 8 aa, Plasmodium falciparum
QALPDSDF

SEQ ID NO: 3339122 - protein, 30 aa, Plasmodium falciparum
QALTTTNNNNNNNNNDNNNDDNNNNNNGNH

SEQ ID NO: 3339123 - protein, 9 aa, Plasmodium falciparum
QANAESRNL

SEQ ID NO: 3339124 - protein, 6 aa, Plasmodium falciparum
QANEQG

SEQ ID NO: 3339125 - protein, 18 aa, Plasmodium falciparum
QANESSNNEENKKSFKNE

SEQ ID NO: 3339126 - protein, 4 aa, Plasmodium falciparum
QANH

SEQ ID NO: 3339127 - protein, 4 aa, Plasmodium falciparum
QANI

SEQ ID NO: 3339128 - protein, 16 aa, Plasmodium falciparum
QANKSTYRNNENNYNK

SEQ ID NO: 3339129 - protein, 5 aa, Plasmodium falciparum
QANNI

SEQ ID NO: 3339130 - protein, 5 aa, Plasmodium falciparum
QANNR

SEQ ID NO: 3339131 - protein, 5 aa, Plasmodium falciparum
QAPGA

SEQ ID NO: 3339132 - protein, 8 aa, Plasmodium falciparum
QAQTGTGK

SEQ ID NO: 3339133 - protein, 9 aa, Plasmodium falciparum
QAREAADDD

SEQ ID NO: 3339134 - protein, 23 aa, Plasmodium falciparum
QARERKNVEVKGGKSQLKANKEA

SEQ ID NO: 3339135 - protein, 7 aa, Plasmodium falciparum
QASSAKP

SEQ ID NO: 3339136 - protein, 4 aa, Plasmodium falciparum
QAST

SEQ ID NO: 3339137 - protein, 7 aa, Plasmodium falciparum
QATEEAA

SEQ ID NO: 3339138 - protein, 11 aa, Plasmodium falciparum
QAYNPQYNGPS

SEQ ID NO: 3339139 - protein, 13 aa, Plasmodium falciparum
QCCNEEKNQADVS

SEQ ID NO: 3339140 - protein, 15 aa, Plasmodium falciparum
QCDDKKKKKKKKKKQ

SEQ ID NO: 3339141 - protein, 12 aa, Plasmodium falciparum
QCEESNADARSC

SEQ ID NO: 3339142 - protein, 14 aa, Plasmodium falciparum
QCEKSNADARANEK

SEQ ID NO: 3339143 - protein, 9 aa, Plasmodium falciparum
QCNGRGTKT

SEQ ID NO: 3339144 - protein, 21 aa, Plasmodium falciparum
QCNVNTKEKNNLDNKKSFPSN

SEQ ID NO: 3339145 - protein, 6 aa, Plasmodium falciparum
QCRGTS

SEQ ID NO: 3339146 - protein, 8 aa, Plasmodium falciparum
QCTEETKQ

SEQ ID NO: 3339147 - protein, 51 aa, Plasmodium falciparum
QDDENYNNNNNNISNNNNNPNDEQNTSENEDHNNDGDNNNEDDDEENDELE

SEQ ID NO: 3339148 - protein, 14 aa, Plasmodium falciparum
QDDESDNSKEKEFD

SEQ ID NO: 3339149 - protein, 7 aa, Plasmodium falciparum
QDDFNPN

SEQ ID NO: 3339150 - protein, 6 aa, Plasmodium falciparum
QDDGKY

SEQ ID NO: 3339151 - protein, 4 aa, Plasmodium falciparum
QDDK

SEQ ID NO: 3339152 - protein, 35 aa, Plasmodium falciparum
QDDKEKKGYNNNSKSTFKNKNREKGGNKNVKKDLT

SEQ ID NO: 3339153 - protein, 6 aa, Plasmodium falciparum
QDDMQE

SEQ ID NO: 3339154 - protein, 22 aa, Plasmodium falciparum
QDDNNDEDNNNNSYTDDNSSIS

SEQ ID NO: 3339155 - protein, 10 aa, Plasmodium falciparum
QDDSNEHNEY

SEQ ID NO: 3339156 - protein, 6 aa, Plasmodium falciparum
QDDTNI

SEQ ID NO: 3339157 - protein, 7 aa, Plasmodium falciparum
QDDTQKI

SEQ ID NO: 3339158 - protein, 19 aa, Plasmodium falciparum
QDEANNEDNNNNNNNNNNN

SEQ ID NO: 3339159 - protein, 4 aa, Plasmodium falciparum
QDED

SEQ ID NO: 3339160 - protein, 8 aa, Plasmodium falciparum
QDEDPHDQ

SEQ ID NO: 3339161 - protein, 10 aa, Plasmodium falciparum
QDEDSKESLT

SEQ ID NO: 3339162 - protein, 4 aa, Plasmodium falciparum
QDEE

SEQ ID NO: 3339163 - protein, 45 aa, Plasmodium falciparum
QDEEDNERDVHDPEQNADENQEDVDQQQDSNENEEDEDQEENDND

SEQ ID NO: 3339164 - protein, 10 aa, Plasmodium falciparum
QDEENFKNNE

SEQ ID NO: 3339165 - protein, 20 aa, Plasmodium falciparum
QDEESEQRDMNNHKTGTIKK

SEQ ID NO: 3339166 - protein, 13 aa, Plasmodium falciparum
QDEGDSISHNSYN

SEQ ID NO: 3339167 - protein, 13 aa, Plasmodium falciparum
QDEMSSSASSTYS

SEQ ID NO: 3339168 - protein, 14 aa, Plasmodium falciparum
QDENDKLYKNEQKI

SEQ ID NO: 3339169 - protein, 9 aa, Plasmodium falciparum
QDENNKQNN

SEQ ID NO: 3339170 - protein, 10 aa, Plasmodium falciparum
QDESNEGEVE

SEQ ID NO: 3339171 - protein, 36 aa, Plasmodium falciparum
QDESSSEDENNINEKNINEKNINEKNINEKNINEKN

SEQ ID NO: 3339172 - protein, 23 aa, Plasmodium falciparum
QDEYHSKDEQIQTSKDEEDTKPF

SEQ ID NO: 3339173 - protein, 4 aa, Plasmodium falciparum
QDFK

SEQ ID NO: 3339174 - protein, 5 aa, Plasmodium falciparum
QDFND

SEQ ID NO: 3339175 - protein, 5 aa, Plasmodium falciparum
QDGDI

SEQ ID NO: 3339176 - protein, 7 aa, Plasmodium falciparum
QDGDMGT

SEQ ID NO: 3339177 - protein, 10 aa, Plasmodium falciparum
QDGHNNTSYI

SEQ ID NO: 3339178 - protein, 11 aa, Plasmodium falciparum
QDGNNIEKGET

SEQ ID NO: 3339179 - protein, 5 aa, Plasmodium falciparum
QDGSY

SEQ ID NO: 3339180 - protein, 14 aa, Plasmodium falciparum
QDGTDGSSTIENND

SEQ ID NO: 3339181 - protein, 11 aa, Plasmodium falciparum
QDHNTNSSAEK

SEQ ID NO: 3339182 - protein, 12 aa, Plasmodium falciparum
QDIDNNNNDDTY

SEQ ID NO: 3339183 - protein, 6 aa, Plasmodium falciparum
QDIDRK

SEQ ID NO: 3339184 - protein, 53 aa, Plasmodium falciparum
QDIKRKSTKHYEKENFNNTHKGKNKNEKDEEQSEEEKEKKNVQKKETQNFNPS

SEQ ID NO: 3339185 - protein, 6 aa, Plasmodium falciparum
QDIKSY

SEQ ID NO: 3339186 - protein, 11 aa, Plasmodium falciparum
QDIKTNSKNLK

SEQ ID NO: 3339187 - protein, 6 aa, Plasmodium falciparum
QDINQE

SEQ ID NO: 3339188 - protein, 6 aa, Plasmodium falciparum
QDITNT

SEQ ID NO: 3339189 - protein, 7 aa, Plasmodium falciparum
QDKDKKG

SEQ ID NO: 3339190 - protein, 10 aa, Plasmodium falciparum
QDKDSECNNR

SEQ ID NO: 3339191 - protein, 4 aa, Plasmodium falciparum
QDKE

SEQ ID NO: 3339192 - protein, 15 aa, Plasmodium falciparum
QDKESTKTRKSNNDI

SEQ ID NO: 3339193 - protein, 4 aa, Plasmodium falciparum
QDKG

SEQ ID NO: 3339194 - protein, 8 aa, Plasmodium falciparum
QDKINNDQ

SEQ ID NO: 3339195 - protein, 8 aa, Plasmodium falciparum
QDKKKGKL

SEQ ID NO: 3339196 - protein, 7 aa, Plasmodium falciparum
QDKNGGN

SEQ ID NO: 3339197 - protein, 6 aa, Plasmodium falciparum
QDKSNH

SEQ ID NO: 3339198 - protein, 5 aa, Plasmodium falciparum
QDLDS

SEQ ID NO: 3339199 - protein, 4 aa, Plasmodium falciparum
QDLE

SEQ ID NO: 3339200 - protein, 14 aa, Plasmodium falciparum
QDLKKKKKKNEITD

SEQ ID NO: 3339201 - protein, 8 aa, Plasmodium falciparum
QDLPGESI

SEQ ID NO: 3339202 - protein, 6 aa, Plasmodium falciparum
QDLPNA

SEQ ID NO: 3339203 - protein, 5 aa, Plasmodium falciparum
QDLSE

SEQ ID NO: 3339204 - protein, 14 aa, Plasmodium falciparum
QDMASDEKKNERKK

SEQ ID NO: 3339205 - protein, 4 aa, Plasmodium falciparum
QDME

SEQ ID NO: 3339206 - protein, 11 aa, Plasmodium falciparum
QDMKKKKKNYM

SEQ ID NO: 3339207 - protein, 6 aa, Plasmodium falciparum
QDMKKN

SEQ ID NO: 3339208 - protein, 15 aa, Plasmodium falciparum
QDMNSSNSTPRDNQK

SEQ ID NO: 3339209 - protein, 5 aa, Plasmodium falciparum
QDNAI

SEQ ID NO: 3339210 - protein, 21 aa, Plasmodium falciparum
QDNDDDDKHKYDNTMPKLPKG

SEQ ID NO: 3339211 - protein, 8 aa, Plasmodium falciparum
QDNDSVYN

SEQ ID NO: 3339212 - protein, 6 aa, Plasmodium falciparum
QDNEEN

SEQ ID NO: 3339213 - protein, 14 aa, Plasmodium falciparum
QDNIKTEKKIKQEF

SEQ ID NO: 3339214 - protein, 10 aa, Plasmodium falciparum
QDNKCGDGTT

SEQ ID NO: 3339215 - protein, 25 aa, Plasmodium falciparum
QDNKNIKNNNQQQNDNHVNNDEDHY

SEQ ID NO: 3339216 - protein, 5 aa, Plasmodium falciparum
QDNLN

SEQ ID NO: 3339217 - protein, 4 aa, Plasmodium falciparum
QDNN

SEQ ID NO: 3339218 - protein, 13 aa, Plasmodium falciparum
QDNNNNENNNNNI

SEQ ID NO: 3339219 - protein, 58 aa, Plasmodium falciparum
QDNNQNDEKSDDDNDEDNNDEDNNDEDNNNDEDNNNDDDNNNDDDNNNDDNNNAQNVQ

SEQ ID NO: 3339220 - protein, 4 aa, Plasmodium falciparum
QDNQ

SEQ ID NO: 3339221 - protein, 15 aa, Plasmodium falciparum
QDNQEKEKNRKEKQL

SEQ ID NO: 3339222 - protein, 10 aa, Plasmodium falciparum
QDNQNRPRGD

SEQ ID NO: 3339223 - protein, 14 aa, Plasmodium falciparum
QDNQQKKNENTINQ

SEQ ID NO: 3339224 - protein, 5 aa, Plasmodium falciparum
QDNRL

SEQ ID NO: 3339225 - protein, 5 aa, Plasmodium falciparum
QDNRY

SEQ ID NO: 3339226 - protein, 11 aa, Plasmodium falciparum
QDNSDNEDAKY

SEQ ID NO: 3339227 - protein, 13 aa, Plasmodium falciparum
QDNTFNSVNSNKI

SEQ ID NO: 3339228 - protein, 11 aa, Plasmodium falciparum
QDNYSVDEQNH

SEQ ID NO: 3339229 - protein, 6 aa, Plasmodium falciparum
QDPQYK

SEQ ID NO: 3339230 - protein, 10 aa, Plasmodium falciparum
QDQESSTYGN

SEQ ID NO: 3339231 - protein, 10 aa, Plasmodium falciparum
QDQEVGDGTT

SEQ ID NO: 3339232 - protein, 11 aa, Plasmodium falciparum
QDQKDKGINPY

SEQ ID NO: 3339233 - protein, 8 aa, Plasmodium falciparum
QDQNGTIP

SEQ ID NO: 3339234 - protein, 9 aa, Plasmodium falciparum
QDSEPQKKY

SEQ ID NO: 3339235 - protein, 4 aa, Plasmodium falciparum
QDSI

SEQ ID NO: 3339236 - protein, 4 aa, Plasmodium falciparum
QDST

SEQ ID NO: 3339237 - protein, 4 aa, Plasmodium falciparum
QDTG

SEQ ID NO: 3339238 - protein, 5 aa, Plasmodium falciparum
QDTIH

SEQ ID NO: 3339239 - protein, 15 aa, Plasmodium falciparum
QDTNTQNDTNENSST

SEQ ID NO: 3339240 - protein, 14 aa, Plasmodium falciparum
QDTRKNKKNKIKKK

SEQ ID NO: 3339241 - protein, 13 aa, Plasmodium falciparum
QDTRSSKEKDAEK

SEQ ID NO: 3339242 - protein, 5 aa, Plasmodium falciparum
QDTSN

SEQ ID NO: 3339243 - protein, 5 aa, Plasmodium falciparum
QDTTA

SEQ ID NO: 3339244 - protein, 7 aa, Plasmodium falciparum
QDTTNIP

SEQ ID NO: 3339245 - protein, 12 aa, Plasmodium falciparum
QDVDSDKMNQED

SEQ ID NO: 3339246 - protein, 6 aa, Plasmodium falciparum
QDVEKD

SEQ ID NO: 3339247 - protein, 8 aa, Plasmodium falciparum
QDVNKNEN

SEQ ID NO: 3339248 - protein, 7 aa, Plasmodium falciparum
QDYHDNK

SEQ ID NO: 3339249 - protein, 8 aa, Plasmodium falciparum
QDYQEEGE

SEQ ID NO: 3339250 - protein, 7 aa, Plasmodium falciparum
QEAGLSD

SEQ ID NO: 3339251 - protein, 5 aa, Plasmodium falciparum
QEDDK

SEQ ID NO: 3339252 - protein, 28 aa, Plasmodium falciparum
QEDDQKGNYVTNQDDNLAQEKKETHSED

SEQ ID NO: 3339253 - protein, 11 aa, Plasmodium falciparum
QEDEQDEKNVA

SEQ ID NO: 3339254 - protein, 7 aa, Plasmodium falciparum
QEDGNNR

SEQ ID NO: 3339255 - protein, 16 aa, Plasmodium falciparum
QEDHFNQNDDKNNNMN

SEQ ID NO: 3339256 - protein, 13 aa, Plasmodium falciparum
QEDKEKESLSKDM

SEQ ID NO: 3339257 - protein, 9 aa, Plasmodium falciparum
QEDNIQKYE

SEQ ID NO: 3339258 - protein, 14 aa, Plasmodium falciparum
QEDNNYTKNSNMSY

SEQ ID NO: 3339259 - protein, 16 aa, Plasmodium falciparum
QEDVSKPWEENGNKNI

SEQ ID NO: 3339260 - protein, 8 aa, Plasmodium falciparum
QEEANKAV

SEQ ID NO: 3339261 - protein, 9 aa, Plasmodium falciparum
QEEDNDKYK

SEQ ID NO: 3339262 - protein, 4 aa, Plasmodium falciparum
QEEE

SEQ ID NO: 3339263 - protein, 9 aa, Plasmodium falciparum
QEEEDEEVN

SEQ ID NO: 3339264 - protein, 11 aa, Plasmodium falciparum
QEEENKKGIGI

SEQ ID NO: 3339265 - protein, 7 aa, Plasmodium falciparum
QEEERER

SEQ ID NO: 3339266 - protein, 35 aa, Plasmodium falciparum
QEEERRNPIEDKSRNDEDDLESTQNNENAYFNTFF

SEQ ID NO: 3339267 - protein, 17 aa, Plasmodium falciparum
QEEHNLNTNNNSKMKTN

SEQ ID NO: 3339268 - protein, 19 aa, Plasmodium falciparum
QEEINEKKNYNKNNNDSNK

SEQ ID NO: 3339269 - protein, 9 aa, Plasmodium falciparum
QEEKNDTNK

SEQ ID NO: 3339270 - protein, 12 aa, Plasmodium falciparum
QEEKNISTNEDN

SEQ ID NO: 3339271 - protein, 6 aa, Plasmodium falciparum
QEENDN

SEQ ID NO: 3339272 - protein, 7 aa, Plasmodium falciparum
QEENDYK

SEQ ID NO: 3339273 - protein, 49 aa, Plasmodium falciparum
QEENNKTEISKVSENVQAQYASNNELNNNQKEGKPKNKDDDFDILLQAL

SEQ ID NO: 3339274 - protein, 9 aa, Plasmodium falciparum
QEENYNDGD

SEQ ID NO: 3339275 - protein, 10 aa, Plasmodium falciparum
QEERNSREQM

SEQ ID NO: 3339276 - protein, 8 aa, Plasmodium falciparum
QEESKKTD

SEQ ID NO: 3339277 - protein, 12 aa, Plasmodium falciparum
QEETSKKTNLES

SEQ ID NO: 3339278 - protein, 48 aa, Plasmodium falciparum
QEEYNKNKEPNNINSNDNNNKNDDNNNNNNKNVDGNNNNNNNINSNDK

SEQ ID NO: 3339279 - protein, 9 aa, Plasmodium falciparum
QEEYTKKSD

SEQ ID NO: 3339280 - protein, 9 aa, Plasmodium falciparum
QEFKEEEED

SEQ ID NO: 3339281 - protein, 9 aa, Plasmodium falciparum
QEGDSDMKR

SEQ ID NO: 3339282 - protein, 8 aa, Plasmodium falciparum
QEGKKNHN

SEQ ID NO: 3339283 - protein, 8 aa, Plasmodium falciparum
QEGKNTTT

SEQ ID NO: 3339284 - protein, 5 aa, Plasmodium falciparum
QEGNH

SEQ ID NO: 3339285 - protein, 4 aa, Plasmodium falciparum
QEHI

SEQ ID NO: 3339286 - protein, 8 aa, Plasmodium falciparum
QEHMNGNN

SEQ ID NO: 3339287 - protein, 6 aa, Plasmodium falciparum
QEHNKN

SEQ ID NO: 3339288 - protein, 12 aa, Plasmodium falciparum
QEHNKSSFNNSN

SEQ ID NO: 3339289 - protein, 36 aa, Plasmodium falciparum
QEHNNTNVAQETKGGKKKKKKNVDRNQNNLKEDNLN

SEQ ID NO: 3339290 - protein, 6 aa, Plasmodium falciparum
QEHPTY

SEQ ID NO: 3339291 - protein, 4 aa, Plasmodium falciparum
QEHS

SEQ ID NO: 3339292 - protein, 10 aa, Plasmodium falciparum
QEHTNEEANA

SEQ ID NO: 3339293 - protein, 8 aa, Plasmodium falciparum
QEIKNKKE

SEQ ID NO: 3339294 - protein, 13 aa, Plasmodium falciparum
QEIKQNTKDTLSN

SEQ ID NO: 3339295 - protein, 18 aa, Plasmodium falciparum
QEIKTNDAPRGSKQENLS

SEQ ID NO: 3339296 - protein, 5 aa, Plasmodium falciparum
QEISD

SEQ ID NO: 3339297 - protein, 8 aa, Plasmodium falciparum
QEISDDSE

SEQ ID NO: 3339298 - protein, 15 aa, Plasmodium falciparum
QEITKHEKNIKEKNK

SEQ ID NO: 3339299 - protein, 10 aa, Plasmodium falciparum
QEKCDMNEEN

SEQ ID NO: 3339300 - protein, 8 aa, Plasmodium falciparum
QEKDIGNK

SEQ ID NO: 3339301 - protein, 6 aa, Plasmodium falciparum
QEKDNI

SEQ ID NO: 3339302 - protein, 12 aa, Plasmodium falciparum
QEKDSTLSREGD

SEQ ID NO: 3339303 - protein, 11 aa, Plasmodium falciparum
QEKEADCFPNN

SEQ ID NO: 3339304 - protein, 7 aa, Plasmodium falciparum
QEKEESL

SEQ ID NO: 3339305 - protein, 10 aa, Plasmodium falciparum
QEKEIQEKEE

SEQ ID NO: 3339306 - protein, 17 aa, Plasmodium falciparum
QEKEKINETENKQNDDE

SEQ ID NO: 3339307 - protein, 9 aa, Plasmodium falciparum
QEKERTKYK

SEQ ID NO: 3339308 - protein, 17 aa, Plasmodium falciparum
QEKIKQSNSCNEEQNKV

SEQ ID NO: 3339309 - protein, 5 aa, Plasmodium falciparum
QEKIN

SEQ ID NO: 3339310 - protein, 23 aa, Plasmodium falciparum
QEKKENKEINKGDINNDNEEIEN

SEQ ID NO: 3339311 - protein, 10 aa, Plasmodium falciparum
QEKKRTPLKY

SEQ ID NO: 3339312 - protein, 5 aa, Plasmodium falciparum
QEKLK

SEQ ID NO: 3339313 - protein, 11 aa, Plasmodium falciparum
QEKMSKSDENS

SEQ ID NO: 3339314 - protein, 7 aa, Plasmodium falciparum
QEKNEKI

SEQ ID NO: 3339315 - protein, 8 aa, Plasmodium falciparum
QEKNIKKK

SEQ ID NO: 3339316 - protein, 18 aa, Plasmodium falciparum
QEKNQKTPKKNDKKNDTL

SEQ ID NO: 3339317 - protein, 7 aa, Plasmodium falciparum
QEKNQNN

SEQ ID NO: 3339318 - protein, 9 aa, Plasmodium falciparum
QEKNSQSLV

SEQ ID NO: 3339319 - protein, 13 aa, Plasmodium falciparum
QEKNTKKAEIVYS

SEQ ID NO: 3339320 - protein, 9 aa, Plasmodium falciparum
QEKNYTQNE

SEQ ID NO: 3339321 - protein, 6 aa, Plasmodium falciparum
QEKPTR

SEQ ID NO: 3339322 - protein, 15 aa, Plasmodium falciparum
QEKQENKNNYENTQN

SEQ ID NO: 3339323 - protein, 35 aa, Plasmodium falciparum
QEKRKKGKKEERKPQKKKKKKRNNDQNSAHNEENM

SEQ ID NO: 3339324 - protein, 13 aa, Plasmodium falciparum
QEKRKKKKNRGKS

SEQ ID NO: 3339325 - protein, 8 aa, Plasmodium falciparum
QEKRKTSN

SEQ ID NO: 3339326 - protein, 5 aa, Plasmodium falciparum
QEKRN

SEQ ID NO: 3339327 - protein, 8 aa, Plasmodium falciparum
QEKSSEDD

SEQ ID NO: 3339328 - protein, 5 aa, Plasmodium falciparum
QEKTW

SEQ ID NO: 3339329 - protein, 8 aa, Plasmodium falciparum
QEKYKDIK

SEQ ID NO: 3339330 - protein, 23 aa, Plasmodium falciparum
QELEKEEEEEEEEGGGKGDNKNM

SEQ ID NO: 3339331 - protein, 10 aa, Plasmodium falciparum
QELKNNKENK

SEQ ID NO: 3339332 - protein, 6 aa, Plasmodium falciparum
QELQDR

SEQ ID NO: 3339333 - protein, 7 aa, Plasmodium falciparum
QELSDEN

SEQ ID NO: 3339334 - protein, 6 aa, Plasmodium falciparum
QENAQG

SEQ ID NO: 3339335 - protein, 49 aa, Plasmodium falciparum
QENDKEKKDQGNESVDDEKDYEKETNNNVEEDPEKDSKEQGKRKSKEKI

SEQ ID NO: 3339336 - protein, 9 aa, Plasmodium falciparum
QENDTNREH

SEQ ID NO: 3339337 - protein, 5 aa, Plasmodium falciparum
QENEE

SEQ ID NO: 3339338 - protein, 21 aa, Plasmodium falciparum
QENEKFNNTSSCYKNKDKENN

SEQ ID NO: 3339339 - protein, 13 aa, Plasmodium falciparum
QENEKKKKHKKSY

SEQ ID NO: 3339340 - protein, 12 aa, Plasmodium falciparum
QENETKLKKGDI

SEQ ID NO: 3339341 - protein, 15 aa, Plasmodium falciparum
QENEVQNKEIEEKDG

SEQ ID NO: 3339342 - protein, 5 aa, Plasmodium falciparum
QENIG

SEQ ID NO: 3339343 - protein, 9 aa, Plasmodium falciparum
QENIKREDK

SEQ ID NO: 3339344 - protein, 18 aa, Plasmodium falciparum
QENKEKEKPKNANDKADP

SEQ ID NO: 3339345 - protein, 11 aa, Plasmodium falciparum
QENKEKKKKEK

SEQ ID NO: 3339346 - protein, 9 aa, Plasmodium falciparum
QENKETEGE

SEQ ID NO: 3339347 - protein, 16 aa, Plasmodium falciparum
QENKRNKNKSSQNEEH

SEQ ID NO: 3339348 - protein, 7 aa, Plasmodium falciparum
QENKRNM

SEQ ID NO: 3339349 - protein, 5 aa, Plasmodium falciparum
QENKV

SEQ ID NO: 3339350 - protein, 7 aa, Plasmodium falciparum
QENLSQS

SEQ ID NO: 3339351 - protein, 5 aa, Plasmodium falciparum
QENME

SEQ ID NO: 3339352 - protein, 7 aa, Plasmodium falciparum
QENNDNV

SEQ ID NO: 3339353 - protein, 7 aa, Plasmodium falciparum
QENNDVR

SEQ ID NO: 3339354 - protein, 10 aa, Plasmodium falciparum
QENNEHEKNY

SEQ ID NO: 3339355 - protein, 21 aa, Plasmodium falciparum
QENNENENKEKYRKNQGSSLR

SEQ ID NO: 3339356 - protein, 9 aa, Plasmodium falciparum
QENNNINNN

SEQ ID NO: 3339357 - protein, 20 aa, Plasmodium falciparum
QENNNNEETQKKRKKKKQIP

SEQ ID NO: 3339358 - protein, 7 aa, Plasmodium falciparum
QENNTYD

SEQ ID NO: 3339359 - protein, 8 aa, Plasmodium falciparum
QENQEMKT

SEQ ID NO: 3339360 - protein, 9 aa, Plasmodium falciparum
QENQENEQN

SEQ ID NO: 3339361 - protein, 11 aa, Plasmodium falciparum
QENQKDDKINI

SEQ ID NO: 3339362 - protein, 10 aa, Plasmodium falciparum
QENRKNDNGF

SEQ ID NO: 3339363 - protein, 7 aa, Plasmodium falciparum
QENRSMD

SEQ ID NO: 3339364 - protein, 7 aa, Plasmodium falciparum
QENRYKQ

SEQ ID NO: 3339365 - protein, 21 aa, Plasmodium falciparum
QENSKDNITSSNYIEVTDPWK

SEQ ID NO: 3339366 - protein, 30 aa, Plasmodium falciparum
QENSPNISRHAKKKKKNKQIDTSPTKKEKN

SEQ ID NO: 3339367 - protein, 6 aa, Plasmodium falciparum
QEPPRS

SEQ ID NO: 3339368 - protein, 5 aa, Plasmodium falciparum
QEPQR

SEQ ID NO: 3339369 - protein, 9 aa, Plasmodium falciparum
QEPSKDENV

SEQ ID NO: 3339370 - protein, 16 aa, Plasmodium falciparum
QEPTISHNKNNNNNIL

SEQ ID NO: 3339371 - protein, 7 aa, Plasmodium falciparum
QEQEGAH

SEQ ID NO: 3339372 - protein, 8 aa, Plasmodium falciparum
QEQESKFN

SEQ ID NO: 3339373 - protein, 5 aa, Plasmodium falciparum
QEQKP

SEQ ID NO: 3339374 - protein, 16 aa, Plasmodium falciparum
QEQTNAQKKKREHSGK

SEQ ID NO: 3339375 - protein, 28 aa, Plasmodium falciparum
QEREKEEEEKKRNYNISNNNNNNNYNKY

SEQ ID NO: 3339376 - protein, 21 aa, Plasmodium falciparum
QERKKKKEREGDDENINDDMN

SEQ ID NO: 3339377 - protein, 21 aa, Plasmodium falciparum
QERKKLRKRKRQEKEREKQDK

SEQ ID NO: 3339378 - protein, 7 aa, Plasmodium falciparum
QERNNGI

SEQ ID NO: 3339379 - protein, 5 aa, Plasmodium falciparum
QERNS

SEQ ID NO: 3339380 - protein, 5 aa, Plasmodium falciparum
QERQH

SEQ ID NO: 3339381 - protein, 13 aa, Plasmodium falciparum
QERSSSDHANRNF

SEQ ID NO: 3339382 - protein, 10 aa, Plasmodium falciparum
QERTSSVKQK

SEQ ID NO: 3339383 - protein, 6 aa, Plasmodium falciparum
QESEKH

SEQ ID NO: 3339384 - protein, 11 aa, Plasmodium falciparum
QESEKKNVGNV

SEQ ID NO: 3339385 - protein, 14 aa, Plasmodium falciparum
QESESLDEEDDSYD

SEQ ID NO: 3339386 - protein, 8 aa, Plasmodium falciparum
QESGTSNI

SEQ ID NO: 3339387 - protein, 14 aa, Plasmodium falciparum
QESLNKKGMGNSYK

SEQ ID NO: 3339388 - protein, 4 aa, Plasmodium falciparum
QESM

SEQ ID NO: 3339389 - protein, 12 aa, Plasmodium falciparum
QESMNNLSNNEA

SEQ ID NO: 3339390 - protein, 18 aa, Plasmodium falciparum
QESRELNDNEKREDNKVN

SEQ ID NO: 3339391 - protein, 7 aa, Plasmodium falciparum
QESSKLH

SEQ ID NO: 3339392 - protein, 5 aa, Plasmodium falciparum
QESVE

SEQ ID NO: 3339393 - protein, 27 aa, Plasmodium falciparum
QESVNEQRNNQSISRSQLNKNEKGVQD

SEQ ID NO: 3339394 - protein, 8 aa, Plasmodium falciparum
QESVNSAS

SEQ ID NO: 3339395 - protein, 9 aa, Plasmodium falciparum
QESVPQGES

SEQ ID NO: 3339396 - protein, 5 aa, Plasmodium falciparum
QETAE

SEQ ID NO: 3339397 - protein, 9 aa, Plasmodium falciparum
QETDKNDLS

SEQ ID NO: 3339398 - protein, 12 aa, Plasmodium falciparum
QETEDTHHEKSL

SEQ ID NO: 3339399 - protein, 7 aa, Plasmodium falciparum
QETERKT

SEQ ID NO: 3339400 - protein, 4 aa, Plasmodium falciparum
QETF

SEQ ID NO: 3339401 - protein, 19 aa, Plasmodium falciparum
QETGGDVNSAVTRLLERGF

SEQ ID NO: 3339402 - protein, 8 aa, Plasmodium falciparum
QETHKQGG

SEQ ID NO: 3339403 - protein, 8 aa, Plasmodium falciparum
QETKHDVP

SEQ ID NO: 3339404 - protein, 7 aa, Plasmodium falciparum
QETKQKK

SEQ ID NO: 3339405 - protein, 20 aa, Plasmodium falciparum
QETKSIRKSPSSNCSHNSQE

SEQ ID NO: 3339406 - protein, 7 aa, Plasmodium falciparum
QETLSNK

SEQ ID NO: 3339407 - protein, 4 aa, Plasmodium falciparum
QETM

SEQ ID NO: 3339408 - protein, 8 aa, Plasmodium falciparum
QETNKENL

SEQ ID NO: 3339409 - protein, 5 aa, Plasmodium falciparum
QETNN

SEQ ID NO: 3339410 - protein, 5 aa, Plasmodium falciparum
QETQE

SEQ ID NO: 3339411 - protein, 13 aa, Plasmodium falciparum
QETQNKFEQQKRD

SEQ ID NO: 3339412 - protein, 9 aa, Plasmodium falciparum
QETVSDRAS

SEQ ID NO: 3339413 - protein, 11 aa, Plasmodium falciparum
QEVECEDSKGN

SEQ ID NO: 3339414 - protein, 9 aa, Plasmodium falciparum
QEVKDSGNP

SEQ ID NO: 3339415 - protein, 21 aa, Plasmodium falciparum
QEVNEDTGPVNEQSDDDNNNN

SEQ ID NO: 3339416 - protein, 5 aa, Plasmodium falciparum
QEYDN

SEQ ID NO: 3339417 - protein, 12 aa, Plasmodium falciparum
QEYEENNKNKSN

SEQ ID NO: 3339418 - protein, 15 aa, Plasmodium falciparum
QEYEQKRKRDEALRK

SEQ ID NO: 3339419 - protein, 4 aa, Plasmodium falciparum
QEYK

SEQ ID NO: 3339420 - protein, 6 aa, Plasmodium falciparum
QEYKAT

SEQ ID NO: 3339421 - protein, 10 aa, Plasmodium falciparum
QEYPNSRDGA

SEQ ID NO: 3339422 - protein, 8 aa, Plasmodium falciparum
QEYRSSTK

SEQ ID NO: 3339423 - protein, 6 aa, Plasmodium falciparum
QEYSEQ

SEQ ID NO: 3339424 - protein, 13 aa, Plasmodium falciparum
QFDDDDDFNEEDY

SEQ ID NO: 3339425 - protein, 5 aa, Plasmodium falciparum
QFDKN

SEQ ID NO: 3339426 - protein, 6 aa, Plasmodium falciparum
QFDRNN

SEQ ID NO: 3339427 - protein, 7 aa, Plasmodium falciparum
QFDSNKK

SEQ ID NO: 3339428 - protein, 6 aa, Plasmodium falciparum
QFNNKK

SEQ ID NO: 3339429 - protein, 7 aa, Plasmodium falciparum
QFNSSSR

SEQ ID NO: 3339430 - protein, 12 aa, Plasmodium falciparum
QFPNSEENFHNE

SEQ ID NO: 3339431 - protein, 5 aa, Plasmodium falciparum
QFTPN

SEQ ID NO: 3339432 - protein, 9 aa, Plasmodium falciparum
QGAEASKEV

SEQ ID NO: 3339433 - protein, 17 aa, Plasmodium falciparum
QGDKINQNNTYNNSYNS

SEQ ID NO: 3339434 - protein, 18 aa, Plasmodium falciparum
QGDLKSNNHENKNDVEDN

SEQ ID NO: 3339435 - protein, 5 aa, Plasmodium falciparum
QGDNK

SEQ ID NO: 3339436 - protein, 6 aa, Plasmodium falciparum
QGDQAD

SEQ ID NO: 3339437 - protein, 14 aa, Plasmodium falciparum
QGDQTEEKSKDEGL

SEQ ID NO: 3339438 - protein, 4 aa, Plasmodium falciparum
QGDY

SEQ ID NO: 3339439 - protein, 9 aa, Plasmodium falciparum
QGEESDPNF

SEQ ID NO: 3339440 - protein, 4 aa, Plasmodium falciparum
QGEG

SEQ ID NO: 3339441 - protein, 4 aa, Plasmodium falciparum
QGEK

SEQ ID NO: 3339442 - protein, 7 aa, Plasmodium falciparum
QGEKEKL

SEQ ID NO: 3339443 - protein, 5 aa, Plasmodium falciparum
QGEKG

SEQ ID NO: 3339444 - protein, 10 aa, Plasmodium falciparum
QGEKKTFHPE

SEQ ID NO: 3339445 - protein, 15 aa, Plasmodium falciparum
QGGDPTNTGKGGQSI

SEQ ID NO: 3339446 - protein, 9 aa, Plasmodium falciparum
QGGENLEER

SEQ ID NO: 3339447 - protein, 5 aa, Plasmodium falciparum
QGGLT

SEQ ID NO: 3339448 - protein, 8 aa, Plasmodium falciparum
QGGPHNNK

SEQ ID NO: 3339449 - protein, 4 aa, Plasmodium falciparum
QGGV

SEQ ID NO: 3339450 - protein, 5 aa, Plasmodium falciparum
QGHKV

SEQ ID NO: 3339451 - protein, 10 aa, Plasmodium falciparum
QGHNQNYNHT

SEQ ID NO: 3339452 - protein, 13 aa, Plasmodium falciparum
QGIDSDDGENYEN

SEQ ID NO: 3339453 - protein, 5 aa, Plasmodium falciparum
QGINS

SEQ ID NO: 3339454 - protein, 15 aa, Plasmodium falciparum
QGISPHSKESSKDKT

SEQ ID NO: 3339455 - protein, 25 aa, Plasmodium falciparum
QGKINESNEDHNLNKNKDSHIDNNI

SEQ ID NO: 3339456 - protein, 19 aa, Plasmodium falciparum
QGKKKLKKDVEKQKKEIEK

SEQ ID NO: 3339457 - protein, 8 aa, Plasmodium falciparum
QGKKNLQQ

SEQ ID NO: 3339458 - protein, 11 aa, Plasmodium falciparum
QGKNNKNDNIS

SEQ ID NO: 3339459 - protein, 15 aa, Plasmodium falciparum
QGKVIENSEGFRTTP

SEQ ID NO: 3339460 - protein, 5 aa, Plasmodium falciparum
QGKYI

SEQ ID NO: 3339461 - protein, 4 aa, Plasmodium falciparum
QGLN

SEQ ID NO: 3339462 - protein, 4 aa, Plasmodium falciparum
QGND

SEQ ID NO: 3339463 - protein, 5 aa, Plasmodium falciparum
QGNDV

SEQ ID NO: 3339464 - protein, 21 aa, Plasmodium falciparum
QGNIDTEDKPKDNQQDKTNNI

SEQ ID NO: 3339465 - protein, 13 aa, Plasmodium falciparum
QGNMHSQKTVQEK

SEQ ID NO: 3339466 - protein, 5 aa, Plasmodium falciparum
QGNMN

SEQ ID NO: 3339467 - protein, 5 aa, Plasmodium falciparum
QGNNK

SEQ ID NO: 3339468 - protein, 18 aa, Plasmodium falciparum
QGNNNSTSMNINDPSEHY

SEQ ID NO: 3339469 - protein, 66 aa, Plasmodium falciparum
QGNNNTNIKKKNNNKKNNNNKKNNNNKKNNNNNNDNNNDNNNNDNNNNNDNNNNNDNNNNNSSSDF

SEQ ID NO: 3339470 - protein, 10 aa, Plasmodium falciparum
QGNNTMPQPF

SEQ ID NO: 3339471 - protein, 10 aa, Plasmodium falciparum
QGNQSDEKDI

SEQ ID NO: 3339472 - protein, 10 aa, Plasmodium falciparum
QGNYKTNNIG

SEQ ID NO: 3339473 - protein, 9 aa, Plasmodium falciparum
QGPPGTGKT

SEQ ID NO: 3339474 - protein, 10 aa, Plasmodium falciparum
QGPPGTGKTT

SEQ ID NO: 3339475 - protein, 16 aa, Plasmodium falciparum
QGQNKNISTTYGAPNK

SEQ ID NO: 3339476 - protein, 7 aa, Plasmodium falciparum
QGRKKDE

SEQ ID NO: 3339477 - protein, 10 aa, Plasmodium falciparum
QGSEHGEDTC

SEQ ID NO: 3339478 - protein, 9 aa, Plasmodium falciparum
QGSIDTSGK

SEQ ID NO: 3339479 - protein, 8 aa, Plasmodium falciparum
QGSKKEKL

SEQ ID NO: 3339480 - protein, 10 aa, Plasmodium falciparum
QGSTNTSNNL

SEQ ID NO: 3339481 - protein, 7 aa, Plasmodium falciparum
QGSYSSK

SEQ ID NO: 3339482 - protein, 20 aa, Plasmodium falciparum
QGTADNNSNVDSSNNSYSNN

SEQ ID NO: 3339483 - protein, 33 aa, Plasmodium falciparum
QGTEDLKNSKNEINNDDIKDDEEHEQDIDSDDM

SEQ ID NO: 3339484 - protein, 6 aa, Plasmodium falciparum
QGTEKL

SEQ ID NO: 3339485 - protein, 5 aa, Plasmodium falciparum
QGTEL

SEQ ID NO: 3339486 - protein, 13 aa, Plasmodium falciparum
QGTFPSGNEKSTD

SEQ ID NO: 3339487 - protein, 6 aa, Plasmodium falciparum
QGTKEL

SEQ ID NO: 3339488 - protein, 4 aa, Plasmodium falciparum
QGTS

SEQ ID NO: 3339489 - protein, 14 aa, Plasmodium falciparum
QGTYQKNNAEENDL

SEQ ID NO: 3339490 - protein, 4 aa, Plasmodium falciparum
QGVS

SEQ ID NO: 3339491 - protein, 11 aa, Plasmodium falciparum
QGYDPQDSSVN

SEQ ID NO: 3339492 - protein, 4 aa, Plasmodium falciparum
QHDE

SEQ ID NO: 3339493 - protein, 4 aa, Plasmodium falciparum
QHDN

SEQ ID NO: 3339494 - protein, 10 aa, Plasmodium falciparum
QHDREKKKKK

SEQ ID NO: 3339495 - protein, 7 aa, Plasmodium falciparum
QHEEEKK

SEQ ID NO: 3339496 - protein, 21 aa, Plasmodium falciparum
QHEETSDKNSPSNNYSNYNNR

SEQ ID NO: 3339497 - protein, 31 aa, Plasmodium falciparum
QHEQKEKKDEKKDEKKDEKKDEKKEEKKEEI

SEQ ID NO: 3339498 - protein, 4 aa, Plasmodium falciparum
QHGT

SEQ ID NO: 3339499 - protein, 4 aa, Plasmodium falciparum
QHIN

SEQ ID NO: 3339500 - protein, 9 aa, Plasmodium falciparum
QHKESTNPY

SEQ ID NO: 3339501 - protein, 6 aa, Plasmodium falciparum
QHKKTY

SEQ ID NO: 3339502 - protein, 10 aa, Plasmodium falciparum
QHKSEQLNND

SEQ ID NO: 3339503 - protein, 5 aa, Plasmodium falciparum
QHNNI

SEQ ID NO: 3339504 - protein, 39 aa, Plasmodium falciparum
QHNNNNNNNNKDAKNDDKSDDNNNNNNNNNNNSISDNHN

SEQ ID NO: 3339505 - protein, 6 aa, Plasmodium falciparum
QHNNQG

SEQ ID NO: 3339506 - protein, 5 aa, Plasmodium falciparum
QHPNS

SEQ ID NO: 3339507 - protein, 7 aa, Plasmodium falciparum
QHPYSKT

SEQ ID NO: 3339508 - protein, 12 aa, Plasmodium falciparum
QHQSSKKNNLSS

SEQ ID NO: 3339509 - protein, 5 aa, Plasmodium falciparum
QHRNE

SEQ ID NO: 3339510 - protein, 6 aa, Plasmodium falciparum
QHSKEE

SEQ ID NO: 3339511 - protein, 5 aa, Plasmodium falciparum
QHSNQ

SEQ ID NO: 3339512 - protein, 4 aa, Plasmodium falciparum
QHTE

SEQ ID NO: 3339513 - protein, 4 aa, Plasmodium falciparum
QHTK

SEQ ID NO: 3339514 - protein, 20 aa, Plasmodium falciparum
QHTKTTGRRGRTVGVAKKKG

SEQ ID NO: 3339515 - protein, 11 aa, Plasmodium falciparum
QHTYNDNNNYN

SEQ ID NO: 3339516 - protein, 11 aa, Plasmodium falciparum
QICKNEKNSNH

SEQ ID NO: 3339517 - protein, 15 aa, Plasmodium falciparum
QIDERKKEEEEEQNK

SEQ ID NO: 3339518 - protein, 17 aa, Plasmodium falciparum
QIDKENKEMKNKPKNIS

SEQ ID NO: 3339519 - protein, 22 aa, Plasmodium falciparum
QIDKGDDDKSIRVNEKNNAEYI

SEQ ID NO: 3339520 - protein, 5 aa, Plasmodium falciparum
QIDSL

SEQ ID NO: 3339521 - protein, 9 aa, Plasmodium falciparum
QIDSPDQTF

SEQ ID NO: 3339522 - protein, 26 aa, Plasmodium falciparum
QIDTNEENENLNSNKNKSNRTIKTNQ

SEQ ID NO: 3339523 - protein, 9 aa, Plasmodium falciparum
QIEATTKKN

SEQ ID NO: 3339524 - protein, 60 aa, Plasmodium falciparum
QIEDSSDNNNNNNNNNNNDSSNNNSSNNNSNCVDRSDNKSYNDKDDSNSLKNKKSGDQLS

SEQ ID NO: 3339525 - protein, 16 aa, Plasmodium falciparum
QIEEEGEEGKELGSQT

SEQ ID NO: 3339526 - protein, 14 aa, Plasmodium falciparum
QIEENKNKEDNNKT

SEQ ID NO: 3339527 - protein, 8 aa, Plasmodium falciparum
QIEEQENN

SEQ ID NO: 3339528 - protein, 11 aa, Plasmodium falciparum
QIEKDKEEKKN

SEQ ID NO: 3339529 - protein, 9 aa, Plasmodium falciparum
QIEKKKNNA

SEQ ID NO: 3339530 - protein, 4 aa, Plasmodium falciparum
QIEN

SEQ ID NO: 3339531 - protein, 8 aa, Plasmodium falciparum
QIESTNKI

SEQ ID NO: 3339532 - protein, 7 aa, Plasmodium falciparum
QIGKGNH

SEQ ID NO: 3339533 - protein, 8 aa, Plasmodium falciparum
QIKDENNN

SEQ ID NO: 3339534 - protein, 4 aa, Plasmodium falciparum
QIKE

SEQ ID NO: 3339535 - protein, 52 aa, Plasmodium falciparum
QIKKQEHKNEKKKKNKNLNKKHNQNNTNNSDNSFHNSDNNINQNGNYTNNSD

SEQ ID NO: 3339536 - protein, 5 aa, Plasmodium falciparum
QIKNG

SEQ ID NO: 3339537 - protein, 9 aa, Plasmodium falciparum
QIKSDEKKS

SEQ ID NO: 3339538 - protein, 16 aa, Plasmodium falciparum
QIKTGAPCRSERNAKY

SEQ ID NO: 3339539 - protein, 4 aa, Plasmodium falciparum
QIND

SEQ ID NO: 3339540 - protein, 54 aa, Plasmodium falciparum
QINEKDNMKNDNNDNNDSNDNDDNDNNDYNDDNKNIEKKSKKKRKKEKENIDEN

SEQ ID NO: 3339541 - protein, 6 aa, Plasmodium falciparum
QINETE

SEQ ID NO: 3339542 - protein, 6 aa, Plasmodium falciparum
QINGSG

SEQ ID NO: 3339543 - protein, 29 aa, Plasmodium falciparum
QINKKKNKKNKKNKKEGKSVTKEMNETSN

SEQ ID NO: 3339544 - protein, 9 aa, Plasmodium falciparum
QINKNRDDI

SEQ ID NO: 3339545 - protein, 16 aa, Plasmodium falciparum
QINNNNNNNDNNNNDI

SEQ ID NO: 3339546 - protein, 5 aa, Plasmodium falciparum
QINRD

SEQ ID NO: 3339547 - protein, 7 aa, Plasmodium falciparum
QINSNNE

SEQ ID NO: 3339548 - protein, 13 aa, Plasmodium falciparum
QINSRQNKERCSA

SEQ ID NO: 3339549 - protein, 4 aa, Plasmodium falciparum
QIPN

SEQ ID NO: 3339550 - protein, 4 aa, Plasmodium falciparum
QIQK

SEQ ID NO: 3339551 - protein, 11 aa, Plasmodium falciparum
QIQKNKSLDPF

SEQ ID NO: 3339552 - protein, 15 aa, Plasmodium falciparum
QIQPNTNTSVQKRKT

SEQ ID NO: 3339553 - protein, 10 aa, Plasmodium falciparum
QIRDNNKASV

SEQ ID NO: 3339554 - protein, 10 aa, Plasmodium falciparum
QISESDPSIA

SEQ ID NO: 3339555 - protein, 9 aa, Plasmodium falciparum
QISNKEDSI

SEQ ID NO: 3339556 - protein, 13 aa, Plasmodium falciparum
QISPEEEEEEIEE

SEQ ID NO: 3339557 - protein, 5 aa, Plasmodium falciparum
QISSD

SEQ ID NO: 3339558 - protein, 6 aa, Plasmodium falciparum
QISSPS

SEQ ID NO: 3339559 - protein, 7 aa, Plasmodium falciparum
QITPNDE

SEQ ID NO: 3339560 - protein, 5 aa, Plasmodium falciparum
QIYEK

SEQ ID NO: 3339561 - protein, 12 aa, Plasmodium falciparum
QKADADKSDKTV

SEQ ID NO: 3339562 - protein, 4 aa, Plasmodium falciparum
QKAE

SEQ ID NO: 3339563 - protein, 8 aa, Plasmodium falciparum
QKANKKNI

SEQ ID NO: 3339564 - protein, 6 aa, Plasmodium falciparum
QKANNR

SEQ ID NO: 3339565 - protein, 5 aa, Plasmodium falciparum
QKAQD

SEQ ID NO: 3339566 - protein, 5 aa, Plasmodium falciparum
QKAQE

SEQ ID NO: 3339567 - protein, 10 aa, Plasmodium falciparum
QKASASGGYP

SEQ ID NO: 3339568 - protein, 17 aa, Plasmodium falciparum
QKCEGEKYEGKRKNKYT

SEQ ID NO: 3339569 - protein, 11 aa, Plasmodium falciparum
QKCKNKNKSII

SEQ ID NO: 3339570 - protein, 10 aa, Plasmodium falciparum
QKCSSDGDAE

SEQ ID NO: 3339571 - protein, 12 aa, Plasmodium falciparum
QKCTSSKENIED

SEQ ID NO: 3339572 - protein, 9 aa, Plasmodium falciparum
QKDASDKEV

SEQ ID NO: 3339573 - protein, 4 aa, Plasmodium falciparum
QKDD

SEQ ID NO: 3339574 - protein, 10 aa, Plasmodium falciparum
QKDDKDDDIN

SEQ ID NO: 3339575 - protein, 71 aa, Plasmodium falciparum
QKDDNEIDHRKTSKNSNDNLKKSQNINDGMKTANSSIKNDTKDEEEYKKSIKSKNNKNNRNNDDDYMKEED

SEQ ID NO: 3339576 - protein, 25 aa, Plasmodium falciparum
QKDDNNDNNNNNNNNKNAYGDIKGK

SEQ ID NO: 3339577 - protein, 5 aa, Plasmodium falciparum
QKDDS

SEQ ID NO: 3339578 - protein, 18 aa, Plasmodium falciparum
QKDDSAKNTMNDSSDTQV

SEQ ID NO: 3339579 - protein, 9 aa, Plasmodium falciparum
QKDDSNNIM

SEQ ID NO: 3339580 - protein, 8 aa, Plasmodium falciparum
QKDEKDIP

SEQ ID NO: 3339581 - protein, 11 aa, Plasmodium falciparum
QKDGKHKKGKN

SEQ ID NO: 3339582 - protein, 14 aa, Plasmodium falciparum
QKDISTNNEQNQTY

SEQ ID NO: 3339583 - protein, 7 aa, Plasmodium falciparum
QKDKDCV

SEQ ID NO: 3339584 - protein, 9 aa, Plasmodium falciparum
QKDKKNGKH

SEQ ID NO: 3339585 - protein, 6 aa, Plasmodium falciparum
QKDNCT

SEQ ID NO: 3339586 - protein, 8 aa, Plasmodium falciparum
QKDNINEA

SEQ ID NO: 3339587 - protein, 9 aa, Plasmodium falciparum
QKDNNFDPY

SEQ ID NO: 3339588 - protein, 10 aa, Plasmodium falciparum
QKDNNNYNNH

SEQ ID NO: 3339589 - protein, 6 aa, Plasmodium falciparum
QKDNPS

SEQ ID NO: 3339590 - protein, 7 aa, Plasmodium falciparum
QKDPNHI

SEQ ID NO: 3339591 - protein, 9 aa, Plasmodium falciparum
QKDQEDQHV

SEQ ID NO: 3339592 - protein, 6 aa, Plasmodium falciparum
QKDQEL

SEQ ID NO: 3339593 - protein, 13 aa, Plasmodium falciparum
QKDREKGDTEAAQ

SEQ ID NO: 3339594 - protein, 25 aa, Plasmodium falciparum
QKDSHLAKDKNDNNKSNNNNNNNNN

SEQ ID NO: 3339595 - protein, 10 aa, Plasmodium falciparum
QKDSKDDDPI

SEQ ID NO: 3339596 - protein, 5 aa, Plasmodium falciparum
QKDSY

SEQ ID NO: 3339597 - protein, 24 aa, Plasmodium falciparum
QKDTNNKYNENNNDHNINGNGRKK

SEQ ID NO: 3339598 - protein, 7 aa, Plasmodium falciparum
QKDVEDD

SEQ ID NO: 3339599 - protein, 7 aa, Plasmodium falciparum
QKDVQNK

SEQ ID NO: 3339600 - protein, 4 aa, Plasmodium falciparum
QKEC

SEQ ID NO: 3339601 - protein, 5 aa, Plasmodium falciparum
QKECL

SEQ ID NO: 3339602 - protein, 12 aa, Plasmodium falciparum
QKEDDKKNKNIN

SEQ ID NO: 3339603 - protein, 10 aa, Plasmodium falciparum
QKEDEKNISK

SEQ ID NO: 3339604 - protein, 35 aa, Plasmodium falciparum
QKEDRKRKDKKKKGHSSDKEEKYNKKEKTKEKSSN

SEQ ID NO: 3339605 - protein, 19 aa, Plasmodium falciparum
QKEDTNNNPFHDKTDKGTI

SEQ ID NO: 3339606 - protein, 5 aa, Plasmodium falciparum
QKEED

SEQ ID NO: 3339607 - protein, 18 aa, Plasmodium falciparum
QKEEEKNNINEQNGENVN

SEQ ID NO: 3339608 - protein, 10 aa, Plasmodium falciparum
QKEEELSQKR

SEQ ID NO: 3339609 - protein, 7 aa, Plasmodium falciparum
QKEEEWK

SEQ ID NO: 3339610 - protein, 7 aa, Plasmodium falciparum
QKEEGTI

SEQ ID NO: 3339611 - protein, 6 aa, Plasmodium falciparum
QKEEIE

SEQ ID NO: 3339612 - protein, 5 aa, Plasmodium falciparum
QKEEL

SEQ ID NO: 3339613 - protein, 30 aa, Plasmodium falciparum
QKEENEKEKKEQIKENDNHHNGDDTNKMGH

SEQ ID NO: 3339614 - protein, 8 aa, Plasmodium falciparum
QKEENIKD

SEQ ID NO: 3339615 - protein, 12 aa, Plasmodium falciparum
QKEENSQIYVYI

SEQ ID NO: 3339616 - protein, 8 aa, Plasmodium falciparum
QKEENVSE

SEQ ID NO: 3339617 - protein, 7 aa, Plasmodium falciparum
QKEESLD

SEQ ID NO: 3339618 - protein, 14 aa, Plasmodium falciparum
QKEFEKQKEKYEKE

SEQ ID NO: 3339619 - protein, 14 aa, Plasmodium falciparum
QKEGERQNSMNESK

SEQ ID NO: 3339620 - protein, 19 aa, Plasmodium falciparum
QKEGNKNQINDDNDDENNS

SEQ ID NO: 3339621 - protein, 4 aa, Plasmodium falciparum
QKEK

SEQ ID NO: 3339622 - protein, 15 aa, Plasmodium falciparum
QKEKDRGDEESNRDI

SEQ ID NO: 3339623 - protein, 7 aa, Plasmodium falciparum
QKEKEQY

SEQ ID NO: 3339624 - protein, 11 aa, Plasmodium falciparum
QKEKKKEKYIS

SEQ ID NO: 3339625 - protein, 9 aa, Plasmodium falciparum
QKEKKKKSI

SEQ ID NO: 3339626 - protein, 7 aa, Plasmodium falciparum
QKEKNDF

SEQ ID NO: 3339627 - protein, 9 aa, Plasmodium falciparum
QKEKYPGSL

SEQ ID NO: 3339628 - protein, 4 aa, Plasmodium falciparum
QKEL

SEQ ID NO: 3339629 - protein, 6 aa, Plasmodium falciparum
QKELEQ

SEQ ID NO: 3339630 - protein, 10 aa, Plasmodium falciparum
QKELKNGDKS

SEQ ID NO: 3339631 - protein, 12 aa, Plasmodium falciparum
QKELTNYTNNNK

SEQ ID NO: 3339632 - protein, 17 aa, Plasmodium falciparum
QKENEKHLNKSGTSQNC

SEQ ID NO: 3339633 - protein, 9 aa, Plasmodium falciparum
QKENGNKKK

SEQ ID NO: 3339634 - protein, 6 aa, Plasmodium falciparum
QKENIP

SEQ ID NO: 3339635 - protein, 45 aa, Plasmodium falciparum
QKENKKIKNKNKTKKKNDQEEKEEEDEDDEDEEDDDEEEEEEIQK

SEQ ID NO: 3339636 - protein, 26 aa, Plasmodium falciparum
QKENYQKNDKKNDKKNDKKDNENEEE

SEQ ID NO: 3339637 - protein, 12 aa, Plasmodium falciparum
QKEPVHKNNKKD

SEQ ID NO: 3339638 - protein, 50 aa, Plasmodium falciparum
QKEREKRKQRKMEQDQNGEEQYDDEEHEEEGEDDNDDEYDRQNNEQEDHF

SEQ ID NO: 3339639 - protein, 6 aa, Plasmodium falciparum
QKEREY

SEQ ID NO: 3339640 - protein, 8 aa, Plasmodium falciparum
QKERPPDA

SEQ ID NO: 3339641 - protein, 6 aa, Plasmodium falciparum
QKERYT

SEQ ID NO: 3339642 - protein, 8 aa, Plasmodium falciparum
QKESESLI

SEQ ID NO: 3339643 - protein, 7 aa, Plasmodium falciparum
QKETNTS

SEQ ID NO: 3339644 - protein, 17 aa, Plasmodium falciparum
QKEVEADVNESKTSQDR

SEQ ID NO: 3339645 - protein, 6 aa, Plasmodium falciparum
QKEYHD

SEQ ID NO: 3339646 - protein, 7 aa, Plasmodium falciparum
QKEYKNN

SEQ ID NO: 3339647 - protein, 10 aa, Plasmodium falciparum
QKEYNTNQYN

SEQ ID NO: 3339648 - protein, 6 aa, Plasmodium falciparum
QKFNNR

SEQ ID NO: 3339649 - protein, 11 aa, Plasmodium falciparum
QKGDRYDKNEE

SEQ ID NO: 3339650 - protein, 20 aa, Plasmodium falciparum
QKGEGNYKKNNKNDNDDNIS

SEQ ID NO: 3339651 - protein, 10 aa, Plasmodium falciparum
QKGEHKKNKN

SEQ ID NO: 3339652 - protein, 11 aa, Plasmodium falciparum
QKGEKTSTNPI

SEQ ID NO: 3339653 - protein, 14 aa, Plasmodium falciparum
QKGEQEKMENEKAE

SEQ ID NO: 3339654 - protein, 21 aa, Plasmodium falciparum
QKGGNNNNTTTTTTTTSNMGD

SEQ ID NO: 3339655 - protein, 14 aa, Plasmodium falciparum
QKGGPREDSTRIGS

SEQ ID NO: 3339656 - protein, 6 aa, Plasmodium falciparum
QKGGRR

SEQ ID NO: 3339657 - protein, 6 aa, Plasmodium falciparum
QKGHGK

SEQ ID NO: 3339658 - protein, 24 aa, Plasmodium falciparum
QKGKEKDAYNNNNNSSNNNHNKAG

SEQ ID NO: 3339659 - protein, 8 aa, Plasmodium falciparum
QKGKRSTG

SEQ ID NO: 3339660 - protein, 4 aa, Plasmodium falciparum
QKGL

SEQ ID NO: 3339661 - protein, 4 aa, Plasmodium falciparum
QKGM

SEQ ID NO: 3339662 - protein, 6 aa, Plasmodium falciparum
QKGNKN

SEQ ID NO: 3339663 - protein, 10 aa, Plasmodium falciparum
QKGNKYEENN

SEQ ID NO: 3339664 - protein, 6 aa, Plasmodium falciparum
QKGNNN

SEQ ID NO: 3339665 - protein, 16 aa, Plasmodium falciparum
QKGPLDTLSQKNNKIY

SEQ ID NO: 3339666 - protein, 8 aa, Plasmodium falciparum
QKGRGTPP

SEQ ID NO: 3339667 - protein, 18 aa, Plasmodium falciparum
QKGRKKKLGNINDEKTSN

SEQ ID NO: 3339668 - protein, 6 aa, Plasmodium falciparum
QKGSQE

SEQ ID NO: 3339669 - protein, 5 aa, Plasmodium falciparum
QKGSS

SEQ ID NO: 3339670 - protein, 4 aa, Plasmodium falciparum
QKGT

SEQ ID NO: 3339671 - protein, 4 aa, Plasmodium falciparum
QKGY

SEQ ID NO: 3339672 - protein, 5 aa, Plasmodium falciparum
QKHEE

SEQ ID NO: 3339673 - protein, 7 aa, Plasmodium falciparum
QKHMKER

SEQ ID NO: 3339674 - protein, 14 aa, Plasmodium falciparum
QKHREKEKKKSIEN

SEQ ID NO: 3339675 - protein, 9 aa, Plasmodium falciparum
QKIDTEKEE

SEQ ID NO: 3339676 - protein, 5 aa, Plasmodium falciparum
QKIKK

SEQ ID NO: 3339677 - protein, 6 aa, Plasmodium falciparum
QKINED

SEQ ID NO: 3339678 - protein, 16 aa, Plasmodium falciparum
QKINSGKEDANNDNLN

SEQ ID NO: 3339679 - protein, 8 aa, Plasmodium falciparum
QKINTNDN

SEQ ID NO: 3339680 - protein, 12 aa, Plasmodium falciparum
QKISNSSTIDEI

SEQ ID NO: 3339681 - protein, 23 aa, Plasmodium falciparum
QKITDNNNNSNNNNNNNNSFNDE

SEQ ID NO: 3339682 - protein, 8 aa, Plasmodium falciparum
QKKAREAA

SEQ ID NO: 3339683 - protein, 32 aa, Plasmodium falciparum
QKKDDDEIKTEKDHKEEEQEIYNTKEEPQYYS

SEQ ID NO: 3339684 - protein, 6 aa, Plasmodium falciparum
QKKDDS

SEQ ID NO: 3339685 - protein, 8 aa, Plasmodium falciparum
QKKDQHDK

SEQ ID NO: 3339686 - protein, 7 aa, Plasmodium falciparum
QKKDSFP

SEQ ID NO: 3339687 - protein, 10 aa, Plasmodium falciparum
QKKDTLENSL

SEQ ID NO: 3339688 - protein, 8 aa, Plasmodium falciparum
QKKDVKKA

SEQ ID NO: 3339689 - protein, 4 aa, Plasmodium falciparum
QKKE

SEQ ID NO: 3339690 - protein, 5 aa, Plasmodium falciparum
QKKED

SEQ ID NO: 3339691 - protein, 8 aa, Plasmodium falciparum
QKKEENEK

SEQ ID NO: 3339692 - protein, 8 aa, Plasmodium falciparum
QKKEETNL

SEQ ID NO: 3339693 - protein, 20 aa, Plasmodium falciparum
QKKEKEKEKEKKKKKKKNIT

SEQ ID NO: 3339694 - protein, 5 aa, Plasmodium falciparum
QKKEL

SEQ ID NO: 3339695 - protein, 9 aa, Plasmodium falciparum
QKKENQLND

SEQ ID NO: 3339696 - protein, 33 aa, Plasmodium falciparum
QKKEQNNKNNIDVKKESKLSKEYNNVDEEKKKN

SEQ ID NO: 3339697 - protein, 8 aa, Plasmodium falciparum
QKKGQKYR

SEQ ID NO: 3339698 - protein, 7 aa, Plasmodium falciparum
QKKHYNA

SEQ ID NO: 3339699 - protein, 4 aa, Plasmodium falciparum
QKKI

SEQ ID NO: 3339700 - protein, 29 aa, Plasmodium falciparum
QKKIESDKKKKNKFEKYGKYGKNEKYRGK

SEQ ID NO: 3339701 - protein, 6 aa, Plasmodium falciparum
QKKIKN

SEQ ID NO: 3339702 - protein, 7 aa, Plasmodium falciparum
QKKINEE

SEQ ID NO: 3339703 - protein, 4 aa, Plasmodium falciparum
QKKK

SEQ ID NO: 3339704 - protein, 77 aa, Plasmodium falciparum
QKKKDKKNKKQTENHENNENYENNEYGKNNEYGKNNEYGKNNEYGKNNEYGKNNEYGKNNEYGKNNEYGKNNVHNDD

SEQ ID NO: 3339705 - protein, 8 aa, Plasmodium falciparum
QKKKGNIS

SEQ ID NO: 3339706 - protein, 8 aa, Plasmodium falciparum
QKKKIKKN

SEQ ID NO: 3339707 - protein, 9 aa, Plasmodium falciparum
QKKKIQNNN

SEQ ID NO: 3339708 - protein, 10 aa, Plasmodium falciparum
QKKKKNEKNI

SEQ ID NO: 3339709 - protein, 8 aa, Plasmodium falciparum
QKKKNEKY

SEQ ID NO: 3339710 - protein, 12 aa, Plasmodium falciparum
QKKKNISKNNDN

SEQ ID NO: 3339711 - protein, 20 aa, Plasmodium falciparum
QKKKNNNKINTETNSRCTTY

SEQ ID NO: 3339712 - protein, 11 aa, Plasmodium falciparum
QKKKNYNNEYN

SEQ ID NO: 3339713 - protein, 12 aa, Plasmodium falciparum
QKKKQNEINQNG

SEQ ID NO: 3339714 - protein, 9 aa, Plasmodium falciparum
QKKKQNGIP

SEQ ID NO: 3339715 - protein, 8 aa, Plasmodium falciparum
QKKKREKM

SEQ ID NO: 3339716 - protein, 15 aa, Plasmodium falciparum
QKKKRQQRKFNKRDY

SEQ ID NO: 3339717 - protein, 9 aa, Plasmodium falciparum
QKKKTHPSN

SEQ ID NO: 3339718 - protein, 9 aa, Plasmodium falciparum
QKKKYKKKR

SEQ ID NO: 3339719 - protein, 11 aa, Plasmodium falciparum
QKKLKKKNENV

SEQ ID NO: 3339720 - protein, 23 aa, Plasmodium falciparum
QKKLNESKRYDSSFNTNNEEGNF

SEQ ID NO: 3339721 - protein, 31 aa, Plasmodium falciparum
QKKNDEIENVDNPHKEEITKRTKKEDKSTQY

SEQ ID NO: 3339722 - protein, 23 aa, Plasmodium falciparum
QKKNEDNISQGKGSYQSSKGSYY

SEQ ID NO: 3339723 - protein, 13 aa, Plasmodium falciparum
QKKNEENGSVHER

SEQ ID NO: 3339724 - protein, 19 aa, Plasmodium falciparum
QKKNENETKNKNKNKNEDI

SEQ ID NO: 3339725 - protein, 23 aa, Plasmodium falciparum
QKKNETNKKETNGKISKNNINSS

SEQ ID NO: 3339726 - protein, 6 aa, Plasmodium falciparum
QKKNKF

SEQ ID NO: 3339727 - protein, 22 aa, Plasmodium falciparum
QKKNKKNKINNKDMNEGDNNIA

SEQ ID NO: 3339728 - protein, 23 aa, Plasmodium falciparum
QKKNKTNSSNNLNTSNVNKKTYK

SEQ ID NO: 3339729 - protein, 9 aa, Plasmodium falciparum
QKKNNCASS

SEQ ID NO: 3339730 - protein, 28 aa, Plasmodium falciparum
QKKNNDDIIRPNDEKQKKKKNLNDVEEG

SEQ ID NO: 3339731 - protein, 10 aa, Plasmodium falciparum
QKKNNDDVDE

SEQ ID NO: 3339732 - protein, 7 aa, Plasmodium falciparum
QKKNNNK

SEQ ID NO: 3339733 - protein, 8 aa, Plasmodium falciparum
QKKNPENL

SEQ ID NO: 3339734 - protein, 18 aa, Plasmodium falciparum
QKKNRQEEIREERRGNNN

SEQ ID NO: 3339735 - protein, 7 aa, Plasmodium falciparum
QKKNSEK

SEQ ID NO: 3339736 - protein, 8 aa, Plasmodium falciparum
QKKNSQNK

SEQ ID NO: 3339737 - protein, 16 aa, Plasmodium falciparum
QKKNVPGGFQDNTSQM

SEQ ID NO: 3339738 - protein, 6 aa, Plasmodium falciparum
QKKPHT

SEQ ID NO: 3339739 - protein, 7 aa, Plasmodium falciparum
QKKPKKA

SEQ ID NO: 3339740 - protein, 27 aa, Plasmodium falciparum
QKKRKYKSGREQKDYEGYENDKGEYHY

SEQ ID NO: 3339741 - protein, 9 aa, Plasmodium falciparum
QKKRNNPLQ

SEQ ID NO: 3339742 - protein, 11 aa, Plasmodium falciparum
QKKSNENNNNH

SEQ ID NO: 3339743 - protein, 6 aa, Plasmodium falciparum
QKKSNI

SEQ ID NO: 3339744 - protein, 13 aa, Plasmodium falciparum
QKKSNKTNTHTKN

SEQ ID NO: 3339745 - protein, 8 aa, Plasmodium falciparum
QKKSNRRL

SEQ ID NO: 3339746 - protein, 5 aa, Plasmodium falciparum
QKKSQ

SEQ ID NO: 3339747 - protein, 13 aa, Plasmodium falciparum
QKKTDEEKKENNI

SEQ ID NO: 3339748 - protein, 7 aa, Plasmodium falciparum
QKKTEEG

SEQ ID NO: 3339749 - protein, 10 aa, Plasmodium falciparum
QKKTKKNDGF

SEQ ID NO: 3339750 - protein, 7 aa, Plasmodium falciparum
QKKYNKN

SEQ ID NO: 3339751 - protein, 5 aa, Plasmodium falciparum
QKKYP

SEQ ID NO: 3339752 - protein, 10 aa, Plasmodium falciparum
QKLEDSSKKI

SEQ ID NO: 3339753 - protein, 14 aa, Plasmodium falciparum
QKLEKKQSLKKNDD

SEQ ID NO: 3339754 - protein, 5 aa, Plasmodium falciparum
QKLGE

SEQ ID NO: 3339755 - protein, 5 aa, Plasmodium falciparum
QKLGT

SEQ ID NO: 3339756 - protein, 7 aa, Plasmodium falciparum
QKLNEEI

SEQ ID NO: 3339757 - protein, 4 aa, Plasmodium falciparum
QKLQ

SEQ ID NO: 3339758 - protein, 6 aa, Plasmodium falciparum
QKLSKS

SEQ ID NO: 3339759 - protein, 8 aa, Plasmodium falciparum
QKLSSNNK

SEQ ID NO: 3339760 - protein, 226 aa, Plasmodium falciparum
QKMKGEKEKEEKTEKKEEKTEKKENMTEEKENMTEKKENMTEKKENMTEKKENMTAEKENMTAEKENMTAEKENMTEEKENMTEEKEKMTEEKEQVTEKEKEKMTEEKENMTEKKENMTEEKEQITEEKEQITEEKEQMTEEKEQITEEKEQITEEKEQITEEKEQITEEKEQITEEKEQITEEKEQITEEKEQITEEKEQITEEKENMTEKKENMTDEKEQMKDQ

SEQ ID NO: 3339761 - protein, 10 aa, Plasmodium falciparum
QKMKNKENEL

SEQ ID NO: 3339762 - protein, 7 aa, Plasmodium falciparum
QKMKNNE

SEQ ID NO: 3339763 - protein, 4 aa, Plasmodium falciparum
QKMN

SEQ ID NO: 3339764 - protein, 23 aa, Plasmodium falciparum
QKMSNRKNIKSRDNNNNNNNKMK

SEQ ID NO: 3339765 - protein, 5 aa, Plasmodium falciparum
QKNDI

SEQ ID NO: 3339766 - protein, 22 aa, Plasmodium falciparum
QKNDKGKKKKKSASTNKKCSDN

SEQ ID NO: 3339767 - protein, 17 aa, Plasmodium falciparum
QKNDNEKKKELKEKANL

SEQ ID NO: 3339768 - protein, 9 aa, Plasmodium falciparum
QKNDQEKNY

SEQ ID NO: 3339769 - protein, 8 aa, Plasmodium falciparum
QKNDSIQN

SEQ ID NO: 3339770 - protein, 23 aa, Plasmodium falciparum
QKNEDEELKETTLASSEDNNAIQ

SEQ ID NO: 3339771 - protein, 12 aa, Plasmodium falciparum
QKNEELEKSKES

SEQ ID NO: 3339772 - protein, 7 aa, Plasmodium falciparum
QKNEEND

SEQ ID NO: 3339773 - protein, 7 aa, Plasmodium falciparum
QKNEGLS

SEQ ID NO: 3339774 - protein, 15 aa, Plasmodium falciparum
QKNEKKKKKRKKQNF

SEQ ID NO: 3339775 - protein, 11 aa, Plasmodium falciparum
QKNEKTNENDN

SEQ ID NO: 3339776 - protein, 5 aa, Plasmodium falciparum
QKNEP

SEQ ID NO: 3339777 - protein, 10 aa, Plasmodium falciparum
QKNESAKYSP

SEQ ID NO: 3339778 - protein, 26 aa, Plasmodium falciparum
QKNHKNNISNNNNKKDDDDDDQSVYS

SEQ ID NO: 3339779 - protein, 15 aa, Plasmodium falciparum
QKNHSGMKNKSDSYD

SEQ ID NO: 3339780 - protein, 9 aa, Plasmodium falciparum
QKNIEENEK

SEQ ID NO: 3339781 - protein, 6 aa, Plasmodium falciparum
QKNINQ

SEQ ID NO: 3339782 - protein, 8 aa, Plasmodium falciparum
QKNKEDRY

SEQ ID NO: 3339783 - protein, 6 aa, Plasmodium falciparum
QKNKIS

SEQ ID NO: 3339784 - protein, 58 aa, Plasmodium falciparum
QKNKKGKKCNYTYASSDSKDGDNQDDKDKREELEPGGEQQAQEQEQELEQDDQEDDLD

SEQ ID NO: 3339785 - protein, 17 aa, Plasmodium falciparum
QKNKKKDKTQDKQQKGN

SEQ ID NO: 3339786 - protein, 6 aa, Plasmodium falciparum
QKNKKW

SEQ ID NO: 3339787 - protein, 19 aa, Plasmodium falciparum
QKNKNKKYNEQNERYNKES

SEQ ID NO: 3339788 - protein, 10 aa, Plasmodium falciparum
QKNKNQNVPQ

SEQ ID NO: 3339789 - protein, 5 aa, Plasmodium falciparum
QKNKS

SEQ ID NO: 3339790 - protein, 13 aa, Plasmodium falciparum
QKNKVNSLEKNTE

SEQ ID NO: 3339791 - protein, 8 aa, Plasmodium falciparum
QKNNDELN

SEQ ID NO: 3339792 - protein, 8 aa, Plasmodium falciparum
QKNNFNSN

SEQ ID NO: 3339793 - protein, 11 aa, Plasmodium falciparum
QKNNKNKKLND

SEQ ID NO: 3339794 - protein, 17 aa, Plasmodium falciparum
QKNNMNNEELSEQNYND

SEQ ID NO: 3339795 - protein, 9 aa, Plasmodium falciparum
QKNNNDNNN

SEQ ID NO: 3339796 - protein, 15 aa, Plasmodium falciparum
QKNNPKIDNHEEQDS

SEQ ID NO: 3339797 - protein, 8 aa, Plasmodium falciparum
QKNNVTNS

SEQ ID NO: 3339798 - protein, 8 aa, Plasmodium falciparum
QKNNYKGP

SEQ ID NO: 3339799 - protein, 6 aa, Plasmodium falciparum
QKNNYN

SEQ ID NO: 3339800 - protein, 4 aa, Plasmodium falciparum
QKNP

SEQ ID NO: 3339801 - protein, 6 aa, Plasmodium falciparum
QKNPSS

SEQ ID NO: 3339802 - protein, 5 aa, Plasmodium falciparum
QKNQL

SEQ ID NO: 3339803 - protein, 7 aa, Plasmodium falciparum
QKNRNKK

SEQ ID NO: 3339804 - protein, 10 aa, Plasmodium falciparum
QKNRNYSNSN

SEQ ID NO: 3339805 - protein, 28 aa, Plasmodium falciparum
QKNRTDKKKKKNEVNDTIPSTSEGENNI

SEQ ID NO: 3339806 - protein, 4 aa, Plasmodium falciparum
QKNS

SEQ ID NO: 3339807 - protein, 10 aa, Plasmodium falciparum
QKNSDDNTSV

SEQ ID NO: 3339808 - protein, 17 aa, Plasmodium falciparum
QKNSGQNMNKTMTNNNS

SEQ ID NO: 3339809 - protein, 13 aa, Plasmodium falciparum
QKNSSKHEKNRYD

SEQ ID NO: 3339810 - protein, 16 aa, Plasmodium falciparum
QKNTKDINKNSNDVNA

SEQ ID NO: 3339811 - protein, 9 aa, Plasmodium falciparum
QKNTNNSYN

SEQ ID NO: 3339812 - protein, 4 aa, Plasmodium falciparum
QKNV

SEQ ID NO: 3339813 - protein, 10 aa, Plasmodium falciparum
QKNVADKKNV

SEQ ID NO: 3339814 - protein, 6 aa, Plasmodium falciparum
QKNVRS

SEQ ID NO: 3339815 - protein, 6 aa, Plasmodium falciparum
QKNYDN

SEQ ID NO: 3339816 - protein, 8 aa, Plasmodium falciparum
QKNYDTLD

SEQ ID NO: 3339817 - protein, 24 aa, Plasmodium falciparum
QKNYGDYQNEKYKKDIKNNSNNVN

SEQ ID NO: 3339818 - protein, 8 aa, Plasmodium falciparum
QKNYGNIN

SEQ ID NO: 3339819 - protein, 9 aa, Plasmodium falciparum
QKNYTNDMD

SEQ ID NO: 3339820 - protein, 4 aa, Plasmodium falciparum
QKPN

SEQ ID NO: 3339821 - protein, 7 aa, Plasmodium falciparum
QKPSEIE

SEQ ID NO: 3339822 - protein, 9 aa, Plasmodium falciparum
QKPTKKDNL

SEQ ID NO: 3339823 - protein, 8 aa, Plasmodium falciparum
QKPVTPSN

SEQ ID NO: 3339824 - protein, 13 aa, Plasmodium falciparum
QKQDPKTKMESKE

SEQ ID NO: 3339825 - protein, 39 aa, Plasmodium falciparum
QKQEDENKKKEENKKKEENKTTDGGKTTDGGKTTDEGKI

SEQ ID NO: 3339826 - protein, 6 aa, Plasmodium falciparum
QKQEEL

SEQ ID NO: 3339827 - protein, 12 aa, Plasmodium falciparum
QKQEQDKKEDNK

SEQ ID NO: 3339828 - protein, 7 aa, Plasmodium falciparum
QKQIGGG

SEQ ID NO: 3339829 - protein, 5 aa, Plasmodium falciparum
QKQIQ

SEQ ID NO: 3339830 - protein, 9 aa, Plasmodium falciparum
QKQKNIGGK

SEQ ID NO: 3339831 - protein, 13 aa, Plasmodium falciparum
QKQKNNNKNNNIQ

SEQ ID NO: 3339832 - protein, 12 aa, Plasmodium falciparum
QKQKREIQQMQN

SEQ ID NO: 3339833 - protein, 4 aa, Plasmodium falciparum
QKQM

SEQ ID NO: 3339834 - protein, 5 aa, Plasmodium falciparum
QKQRA

SEQ ID NO: 3339835 - protein, 17 aa, Plasmodium falciparum
QKQSSHTSQYSNNPNLQ

SEQ ID NO: 3339836 - protein, 9 aa, Plasmodium falciparum
QKQSSSTSF

SEQ ID NO: 3339837 - protein, 10 aa, Plasmodium falciparum
QKQTNKSQET

SEQ ID NO: 3339838 - protein, 5 aa, Plasmodium falciparum
QKQVK

SEQ ID NO: 3339839 - protein, 5 aa, Plasmodium falciparum
QKRED

SEQ ID NO: 3339840 - protein, 8 aa, Plasmodium falciparum
QKRETKNR

SEQ ID NO: 3339841 - protein, 7 aa, Plasmodium falciparum
QKREYNE

SEQ ID NO: 3339842 - protein, 10 aa, Plasmodium falciparum
QKRISENPEY

SEQ ID NO: 3339843 - protein, 10 aa, Plasmodium falciparum
QKRISSNENL

SEQ ID NO: 3339844 - protein, 8 aa, Plasmodium falciparum
QKRKEKDK

SEQ ID NO: 3339845 - protein, 14 aa, Plasmodium falciparum
QKRKEQAKNYHNQV

SEQ ID NO: 3339846 - protein, 10 aa, Plasmodium falciparum
QKRKEQLEEY

SEQ ID NO: 3339847 - protein, 6 aa, Plasmodium falciparum
QKRKNN

SEQ ID NO: 3339848 - protein, 5 aa, Plasmodium falciparum
QKRKQ

SEQ ID NO: 3339849 - protein, 7 aa, Plasmodium falciparum
QKRKREN

SEQ ID NO: 3339850 - protein, 10 aa, Plasmodium falciparum
QKRNKKDNVN

SEQ ID NO: 3339851 - protein, 6 aa, Plasmodium falciparum
QKRQTH

SEQ ID NO: 3339852 - protein, 7 aa, Plasmodium falciparum
QKRSLEN

SEQ ID NO: 3339853 - protein, 11 aa, Plasmodium falciparum
QKSADGKLSGS

SEQ ID NO: 3339854 - protein, 5 aa, Plasmodium falciparum
QKSCD

SEQ ID NO: 3339855 - protein, 8 aa, Plasmodium falciparum
QKSDKRSM

SEQ ID NO: 3339856 - protein, 10 aa, Plasmodium falciparum
QKSEEIENEK

SEQ ID NO: 3339857 - protein, 9 aa, Plasmodium falciparum
QKSGAKTIE

SEQ ID NO: 3339858 - protein, 6 aa, Plasmodium falciparum
QKSGNM

SEQ ID NO: 3339859 - protein, 6 aa, Plasmodium falciparum
QKSKDR

SEQ ID NO: 3339860 - protein, 5 aa, Plasmodium falciparum
QKSKF

SEQ ID NO: 3339861 - protein, 22 aa, Plasmodium falciparum
QKSKKGVKKNSMQKDNKNVKKN

SEQ ID NO: 3339862 - protein, 14 aa, Plasmodium falciparum
QKSKPKPKKNYNNN

SEQ ID NO: 3339863 - protein, 20 aa, Plasmodium falciparum
QKSLHPEGVEADKKLNSNYN

SEQ ID NO: 3339864 - protein, 9 aa, Plasmodium falciparum
QKSNENNSE

SEQ ID NO: 3339865 - protein, 8 aa, Plasmodium falciparum
QKSNMQPN

SEQ ID NO: 3339866 - protein, 15 aa, Plasmodium falciparum
QKSNTSDVLSSEPVN

SEQ ID NO: 3339867 - protein, 11 aa, Plasmodium falciparum
QKSQDTSHSKT

SEQ ID NO: 3339868 - protein, 6 aa, Plasmodium falciparum
QKSRRK

SEQ ID NO: 3339869 - protein, 4 aa, Plasmodium falciparum
QKSS

SEQ ID NO: 3339870 - protein, 8 aa, Plasmodium falciparum
QKTDEHDN

SEQ ID NO: 3339871 - protein, 22 aa, Plasmodium falciparum
QKTDERPNSSNITSNISKGNKW

SEQ ID NO: 3339872 - protein, 10 aa, Plasmodium falciparum
QKTEDNNNND

SEQ ID NO: 3339873 - protein, 5 aa, Plasmodium falciparum
QKTEM

SEQ ID NO: 3339874 - protein, 24 aa, Plasmodium falciparum
QKTENYDNQNNQINDNNNDNQVNN

SEQ ID NO: 3339875 - protein, 4 aa, Plasmodium falciparum
QKTG

SEQ ID NO: 3339876 - protein, 4 aa, Plasmodium falciparum
QKTH

SEQ ID NO: 3339877 - protein, 11 aa, Plasmodium falciparum
QKTKENIKRAS

SEQ ID NO: 3339878 - protein, 13 aa, Plasmodium falciparum
QKTKQKLKLKPQM

SEQ ID NO: 3339879 - protein, 6 aa, Plasmodium falciparum
QKTNVS

SEQ ID NO: 3339880 - protein, 10 aa, Plasmodium falciparum
QKTPKNEQGG

SEQ ID NO: 3339881 - protein, 8 aa, Plasmodium falciparum
QKTTRAKK

SEQ ID NO: 3339882 - protein, 10 aa, Plasmodium falciparum
QKTVDAAQKE

SEQ ID NO: 3339883 - protein, 14 aa, Plasmodium falciparum
QKTVNEKKNQLKNK

SEQ ID NO: 3339884 - protein, 49 aa, Plasmodium falciparum
QKVDTNNDNDNDNDNDNNNNNNNNSDKYEEKNKSNEEKKKQVDKNDIPE

SEQ ID NO: 3339885 - protein, 5 aa, Plasmodium falciparum
QKVHS

SEQ ID NO: 3339886 - protein, 6 aa, Plasmodium falciparum
QKVNEQ

SEQ ID NO: 3339887 - protein, 6 aa, Plasmodium falciparum
QKVNKN

SEQ ID NO: 3339888 - protein, 9 aa, Plasmodium falciparum
QKVQNNQMN

SEQ ID NO: 3339889 - protein, 4 aa, Plasmodium falciparum
QKVV

SEQ ID NO: 3339890 - protein, 7 aa, Plasmodium falciparum
QKWAGTG

SEQ ID NO: 3339891 - protein, 6 aa, Plasmodium falciparum
QKYASS

SEQ ID NO: 3339892 - protein, 4 aa, Plasmodium falciparum
QKYE

SEQ ID NO: 3339893 - protein, 43 aa, Plasmodium falciparum
QKYEDSKKKNVNNQNNVNTTGGLSNNNLDKTKKYIKDKKTNVI

SEQ ID NO: 3339894 - protein, 12 aa, Plasmodium falciparum
QKYKESNSYYED

SEQ ID NO: 3339895 - protein, 4 aa, Plasmodium falciparum
QKYM

SEQ ID NO: 3339896 - protein, 5 aa, Plasmodium falciparum
QKYNE

SEQ ID NO: 3339897 - protein, 6 aa, Plasmodium falciparum
QKYTNK

SEQ ID NO: 3339898 - protein, 17 aa, Plasmodium falciparum
QLAGKDEYEAKQKEAES

SEQ ID NO: 3339899 - protein, 9 aa, Plasmodium falciparum
QLANNSNVY

SEQ ID NO: 3339900 - protein, 9 aa, Plasmodium falciparum
QLDQKNNEI

SEQ ID NO: 3339901 - protein, 10 aa, Plasmodium falciparum
QLDSDNKNLE

SEQ ID NO: 3339902 - protein, 4 aa, Plasmodium falciparum
QLDT

SEQ ID NO: 3339903 - protein, 6 aa, Plasmodium falciparum
QLDTSE

SEQ ID NO: 3339904 - protein, 8 aa, Plasmodium falciparum
QLEAPTPS

SEQ ID NO: 3339905 - protein, 30 aa, Plasmodium falciparum
QLEEEEKNKKKKKFNKGMKHNDEKSELTKE

SEQ ID NO: 3339906 - protein, 11 aa, Plasmodium falciparum
QLEEKEKEKRI

SEQ ID NO: 3339907 - protein, 12 aa, Plasmodium falciparum
QLEEKTKQYNDL

SEQ ID NO: 3339908 - protein, 10 aa, Plasmodium falciparum
QLEGDDEEED

SEQ ID NO: 3339909 - protein, 12 aa, Plasmodium falciparum
QLEKEKKNVEGN

SEQ ID NO: 3339910 - protein, 4 aa, Plasmodium falciparum
QLER

SEQ ID NO: 3339911 - protein, 12 aa, Plasmodium falciparum
QLESQQERYSDT

SEQ ID NO: 3339912 - protein, 13 aa, Plasmodium falciparum
QLETEEHKKKEEI

SEQ ID NO: 3339913 - protein, 5 aa, Plasmodium falciparum
QLGDN

SEQ ID NO: 3339914 - protein, 9 aa, Plasmodium falciparum
QLGGSKTSA

SEQ ID NO: 3339915 - protein, 22 aa, Plasmodium falciparum
QLISNKSKKSEDDAEEEQKEEV

SEQ ID NO: 3339916 - protein, 5 aa, Plasmodium falciparum
QLKDS

SEQ ID NO: 3339917 - protein, 16 aa, Plasmodium falciparum
QLKEQGVSLYGIQLDL

SEQ ID NO: 3339918 - protein, 9 aa, Plasmodium falciparum
QLKNKKKNS

SEQ ID NO: 3339919 - protein, 23 aa, Plasmodium falciparum
QLKSEAKMENKEKAKEKRRREDI

SEQ ID NO: 3339920 - protein, 11 aa, Plasmodium falciparum
QLLPSEGNTIK

SEQ ID NO: 3339921 - protein, 6 aa, Plasmodium falciparum
QLNDEK

SEQ ID NO: 3339922 - protein, 5 aa, Plasmodium falciparum
QLNEE

SEQ ID NO: 3339923 - protein, 12 aa, Plasmodium falciparum
QLNEGRATESGL

SEQ ID NO: 3339924 - protein, 5 aa, Plasmodium falciparum
QLNEY

SEQ ID NO: 3339925 - protein, 8 aa, Plasmodium falciparum
QLNQEDDE

SEQ ID NO: 3339926 - protein, 7 aa, Plasmodium falciparum
QLPKESK

SEQ ID NO: 3339927 - protein, 5 aa, Plasmodium falciparum
QLQDN

SEQ ID NO: 3339928 - protein, 22 aa, Plasmodium falciparum
QLQENKNKNEENKTKTVSFSPT

SEQ ID NO: 3339929 - protein, 4 aa, Plasmodium falciparum
QLQS

SEQ ID NO: 3339930 - protein, 9 aa, Plasmodium falciparum
QLSPKQKAA

SEQ ID NO: 3339931 - protein, 10 aa, Plasmodium falciparum
QLSSNDNTNV

SEQ ID NO: 3339932 - protein, 37 aa, Plasmodium falciparum
QLTKENDNNNNDNNDNNNNDNNNDNNNNDDDKDKDNN

SEQ ID NO: 3339933 - protein, 9 aa, Plasmodium falciparum
QLTNKNEQL

SEQ ID NO: 3339934 - protein, 18 aa, Plasmodium falciparum
QLTNNNKNEQNDNSFANK

SEQ ID NO: 3339935 - protein, 5 aa, Plasmodium falciparum
QLTPT

SEQ ID NO: 3339936 - protein, 7 aa, Plasmodium falciparum
QLTTQGN

SEQ ID NO: 3339937 - protein, 4 aa, Plasmodium falciparum
QLVQ

SEQ ID NO: 3339938 - protein, 10 aa, Plasmodium falciparum
QMDDNNNNKV

SEQ ID NO: 3339939 - protein, 22 aa, Plasmodium falciparum
QMDNQQEKINEKINESENVNEN

SEQ ID NO: 3339940 - protein, 14 aa, Plasmodium falciparum
QMEKNKENQTTHKR

SEQ ID NO: 3339941 - protein, 13 aa, Plasmodium falciparum
QMGNKDEKYNNEK

SEQ ID NO: 3339942 - protein, 5 aa, Plasmodium falciparum
QMHDT

SEQ ID NO: 3339943 - protein, 10 aa, Plasmodium falciparum
QMKNENKNCN

SEQ ID NO: 3339944 - protein, 10 aa, Plasmodium falciparum
QMKREKEQTV

SEQ ID NO: 3339945 - protein, 8 aa, Plasmodium falciparum
QMNDEHRD

SEQ ID NO: 3339946 - protein, 26 aa, Plasmodium falciparum
QMNDNLSKSSNEKGNRSVYKRFMLLN

SEQ ID NO: 3339947 - protein, 11 aa, Plasmodium falciparum
QMNENKNNQDK

SEQ ID NO: 3339948 - protein, 7 aa, Plasmodium falciparum
QMNGTNN

SEQ ID NO: 3339949 - protein, 4 aa, Plasmodium falciparum
QMNK

SEQ ID NO: 3339950 - protein, 11 aa, Plasmodium falciparum
QMNKKEASASI

SEQ ID NO: 3339951 - protein, 4 aa, Plasmodium falciparum
QMNN

SEQ ID NO: 3339952 - protein, 12 aa, Plasmodium falciparum
QMNNSNGKGCEV

SEQ ID NO: 3339953 - protein, 7 aa, Plasmodium falciparum
QMNNTQT

SEQ ID NO: 3339954 - protein, 9 aa, Plasmodium falciparum
QMRKSGKNK

SEQ ID NO: 3339955 - protein, 5 aa, Plasmodium falciparum
QMSES

SEQ ID NO: 3339956 - protein, 56 aa, Plasmodium falciparum
QMSKGKKVADASHNDDDVDDYDDDDYNNNEDDYNNNNEDDNINNNSEGGTKRDETY

SEQ ID NO: 3339957 - protein, 12 aa, Plasmodium falciparum
QMSNNNKRMSNT

SEQ ID NO: 3339958 - protein, 4 aa, Plasmodium falciparum
QMTN

SEQ ID NO: 3339959 - protein, 4 aa, Plasmodium falciparum
QNAD

SEQ ID NO: 3339960 - protein, 14 aa, Plasmodium falciparum
QNADEEGTKKRESI

SEQ ID NO: 3339961 - protein, 25 aa, Plasmodium falciparum
QNADSADSIRRTKGHTFNKQANRRT

SEQ ID NO: 3339962 - protein, 14 aa, Plasmodium falciparum
QNAEGDTNLMFKRA

SEQ ID NO: 3339963 - protein, 7 aa, Plasmodium falciparum
QNAHTNE

SEQ ID NO: 3339964 - protein, 11 aa, Plasmodium falciparum
QNASLKREETN

SEQ ID NO: 3339965 - protein, 7 aa, Plasmodium falciparum
QNAYQNE

SEQ ID NO: 3339966 - protein, 6 aa, Plasmodium falciparum
QNDDEA

SEQ ID NO: 3339967 - protein, 10 aa, Plasmodium falciparum
QNDDKDTINY

SEQ ID NO: 3339968 - protein, 11 aa, Plasmodium falciparum
QNDDKEHFTSG

SEQ ID NO: 3339969 - protein, 14 aa, Plasmodium falciparum
QNDDNNKKNDDNYN

SEQ ID NO: 3339970 - protein, 7 aa, Plasmodium falciparum
QNDEIKK

SEQ ID NO: 3339971 - protein, 9 aa, Plasmodium falciparum
QNDENIKNN

SEQ ID NO: 3339972 - protein, 25 aa, Plasmodium falciparum
QNDESNNNNNNFSGYNNSGDDNSQY

SEQ ID NO: 3339973 - protein, 10 aa, Plasmodium falciparum
QNDGDDNSQV

SEQ ID NO: 3339974 - protein, 15 aa, Plasmodium falciparum
QNDGQSKNTDRNRVG

SEQ ID NO: 3339975 - protein, 8 aa, Plasmodium falciparum
QNDHNKED

SEQ ID NO: 3339976 - protein, 42 aa, Plasmodium falciparum
QNDHQNDHQNDHQNDHQNHYQNNHQNDHQNDHQNDHQNDHQN

SEQ ID NO: 3339977 - protein, 8 aa, Plasmodium falciparum
QNDHTDSD

SEQ ID NO: 3339978 - protein, 11 aa, Plasmodium falciparum
QNDKKKTNINS

SEQ ID NO: 3339979 - protein, 5 aa, Plasmodium falciparum
QNDKL

SEQ ID NO: 3339980 - protein, 12 aa, Plasmodium falciparum
QNDKTKQTYTSH

SEQ ID NO: 3339981 - protein, 34 aa, Plasmodium falciparum
QNDLNNNKSYEKNENKKELSSNRNKNKLDNKNAF

SEQ ID NO: 3339982 - protein, 14 aa, Plasmodium falciparum
QNDNDEKYDDEKKR

SEQ ID NO: 3339983 - protein, 11 aa, Plasmodium falciparum
QNDNIKNKEKN

SEQ ID NO: 3339984 - protein, 15 aa, Plasmodium falciparum
QNDNKSKIEKNKKET

SEQ ID NO: 3339985 - protein, 5 aa, Plasmodium falciparum
QNDNN

SEQ ID NO: 3339986 - protein, 9 aa, Plasmodium falciparum
QNDNNKKGL

SEQ ID NO: 3339987 - protein, 25 aa, Plasmodium falciparum
QNDNVHTKQEYKEKSQMDSQNNSSI

SEQ ID NO: 3339988 - protein, 6 aa, Plasmodium falciparum
QNDPLK

SEQ ID NO: 3339989 - protein, 5 aa, Plasmodium falciparum
QNDPV

SEQ ID NO: 3339990 - protein, 6 aa, Plasmodium falciparum
QNDPYN

SEQ ID NO: 3339991 - protein, 8 aa, Plasmodium falciparum
QNDQLTSH

SEQ ID NO: 3339992 - protein, 5 aa, Plasmodium falciparum
QNDQM

SEQ ID NO: 3339993 - protein, 7 aa, Plasmodium falciparum
QNDRRNR

SEQ ID NO: 3339994 - protein, 10 aa, Plasmodium falciparum
QNDSDTNYSK

SEQ ID NO: 3339995 - protein, 5 aa, Plasmodium falciparum
QNDTN

SEQ ID NO: 3339996 - protein, 29 aa, Plasmodium falciparum
QNDTNPNLTREKNTEKLEREKKNDEDDTH

SEQ ID NO: 3339997 - protein, 12 aa, Plasmodium falciparum
QNEAAGRGGSEL

SEQ ID NO: 3339998 - protein, 5 aa, Plasmodium falciparum
QNECD

SEQ ID NO: 3339999 - protein, 7 aa, Plasmodium falciparum
QNECDQQ

SEQ ID NO: 3340000 - protein, 4 aa, Plasmodium falciparum
QNED

SEQ ID NO: 3340001 - protein, 12 aa, Plasmodium falciparum
QNEDELNDEPGN

SEQ ID NO: 3340002 - protein, 4 aa, Plasmodium falciparum
QNEE

SEQ ID NO: 3340003 - protein, 15 aa, Plasmodium falciparum
QNEEGKNILSYYSTE

SEQ ID NO: 3340004 - protein, 6 aa, Plasmodium falciparum
QNEEHA

SEQ ID NO: 3340005 - protein, 7 aa, Plasmodium falciparum
QNEEKDY

SEQ ID NO: 3340006 - protein, 6 aa, Plasmodium falciparum
QNEENE

SEQ ID NO: 3340007 - protein, 15 aa, Plasmodium falciparum
QNEENVSKKKEEEKL

SEQ ID NO: 3340008 - protein, 9 aa, Plasmodium falciparum
QNEEQVKEQ

SEQ ID NO: 3340009 - protein, 13 aa, Plasmodium falciparum
QNEEREKKNKEAL

SEQ ID NO: 3340010 - protein, 16 aa, Plasmodium falciparum
QNEERKKLEDTKDNYD

SEQ ID NO: 3340011 - protein, 8 aa, Plasmodium falciparum
QNEETQNV

SEQ ID NO: 3340012 - protein, 14 aa, Plasmodium falciparum
QNEETTLGNLTKNE

SEQ ID NO: 3340013 - protein, 7 aa, Plasmodium falciparum
QNEGNER

SEQ ID NO: 3340014 - protein, 24 aa, Plasmodium falciparum
QNEGNKKTEEQEDQTKTKDEQSND

SEQ ID NO: 3340015 - protein, 4 aa, Plasmodium falciparum
QNEH

SEQ ID NO: 3340016 - protein, 6 aa, Plasmodium falciparum
QNEHNN

SEQ ID NO: 3340017 - protein, 21 aa, Plasmodium falciparum
QNEHTQKKENLQESLKGDEHI

SEQ ID NO: 3340018 - protein, 4 aa, Plasmodium falciparum
QNEI

SEQ ID NO: 3340019 - protein, 6 aa, Plasmodium falciparum
QNEINQ

SEQ ID NO: 3340020 - protein, 7 aa, Plasmodium falciparum
QNEIPNE

SEQ ID NO: 3340021 - protein, 4 aa, Plasmodium falciparum
QNEK

SEQ ID NO: 3340022 - protein, 17 aa, Plasmodium falciparum
QNEKEEIHKNKKQNRNI

SEQ ID NO: 3340023 - protein, 67 aa, Plasmodium falciparum
QNEKEITASEEEEGEGEGEREGEEEEEKKKKTGEDKNADESKEENEDEEKKEDNEEDDNKTDHPKVE

SEQ ID NO: 3340024 - protein, 20 aa, Plasmodium falciparum
QNEKETLKRTSDKNMESNKM

SEQ ID NO: 3340025 - protein, 18 aa, Plasmodium falciparum
QNEKNITKHNNNMNSNNM

SEQ ID NO: 3340026 - protein, 10 aa, Plasmodium falciparum
QNEKPNATNE

SEQ ID NO: 3340027 - protein, 8 aa, Plasmodium falciparum
QNEKRKKT

SEQ ID NO: 3340028 - protein, 117 aa, Plasmodium falciparum
QNEKRSDNYSDYSSDKQGDINVKNNNADNNNNNNSNNNNNNNSNNNDNHNNDNNNNDNNSNGNNNNNNNNNNNNNNNNNNNNNNNNNNNSNNDNGDNNRNNDNDDNDEGKKKGDDHV

SEQ ID NO: 3340029 - protein, 21 aa, Plasmodium falciparum
QNEKSEKSSRTERRTPNEPNQ

SEQ ID NO: 3340030 - protein, 38 aa, Plasmodium falciparum
QNEKSYENTKKKKKKNDIIEDGNNINSKYKKNKYKDGD

SEQ ID NO: 3340031 - protein, 10 aa, Plasmodium falciparum
QNEKYGNVSP

SEQ ID NO: 3340032 - protein, 4 aa, Plasmodium falciparum
QNEL

SEQ ID NO: 3340033 - protein, 9 aa, Plasmodium falciparum
QNELNKKEK

SEQ ID NO: 3340034 - protein, 6 aa, Plasmodium falciparum
QNENIG

SEQ ID NO: 3340035 - protein, 5 aa, Plasmodium falciparum
QNENL

SEQ ID NO: 3340036 - protein, 11 aa, Plasmodium falciparum
QNENNNISKED

SEQ ID NO: 3340037 - protein, 34 aa, Plasmodium falciparum
QNEQENTNSSSNSSSNSDKEIQKDKEEYKKGENN

SEQ ID NO: 3340038 - protein, 7 aa, Plasmodium falciparum
QNEQEQI

SEQ ID NO: 3340039 - protein, 11 aa, Plasmodium falciparum
QNEREKYGTDE

SEQ ID NO: 3340040 - protein, 34 aa, Plasmodium falciparum
QNESDSENYDDENGDINSEEQNDITDEGKKSVVD

SEQ ID NO: 3340041 - protein, 7 aa, Plasmodium falciparum
QNESEQH

SEQ ID NO: 3340042 - protein, 10 aa, Plasmodium falciparum
QNESPESRKR

SEQ ID NO: 3340043 - protein, 4 aa, Plasmodium falciparum
QNET

SEQ ID NO: 3340044 - protein, 5 aa, Plasmodium falciparum
QNEVD

SEQ ID NO: 3340045 - protein, 7 aa, Plasmodium falciparum
QNEVEKK

SEQ ID NO: 3340046 - protein, 6 aa, Plasmodium falciparum
QNEYPN

SEQ ID NO: 3340047 - protein, 4 aa, Plasmodium falciparum
QNFP

SEQ ID NO: 3340048 - protein, 4 aa, Plasmodium falciparum
QNFS

SEQ ID NO: 3340049 - protein, 20 aa, Plasmodium falciparum
QNFSSQENTYKNTDNIKTPC

SEQ ID NO: 3340050 - protein, 12 aa, Plasmodium falciparum
QNGDDNNNIHNN

SEQ ID NO: 3340051 - protein, 5 aa, Plasmodium falciparum
QNGEE

SEQ ID NO: 3340052 - protein, 5 aa, Plasmodium falciparum
QNGEG

SEQ ID NO: 3340053 - protein, 12 aa, Plasmodium falciparum
QNGGDQKEMHED

SEQ ID NO: 3340054 - protein, 5 aa, Plasmodium falciparum
QNGGY

SEQ ID NO: 3340055 - protein, 7 aa, Plasmodium falciparum
QNGHNAK

SEQ ID NO: 3340056 - protein, 8 aa, Plasmodium falciparum
QNGINNMN

SEQ ID NO: 3340057 - protein, 5 aa, Plasmodium falciparum
QNGNV

SEQ ID NO: 3340058 - protein, 7 aa, Plasmodium falciparum
QNGSCSK

SEQ ID NO: 3340059 - protein, 19 aa, Plasmodium falciparum
QNGSDEIVQNGSDEIIQNG

SEQ ID NO: 3340060 - protein, 8 aa, Plasmodium falciparum
QNGSGKST

SEQ ID NO: 3340061 - protein, 6 aa, Plasmodium falciparum
QNGVTG

SEQ ID NO: 3340062 - protein, 4 aa, Plasmodium falciparum
QNGY

SEQ ID NO: 3340063 - protein, 7 aa, Plasmodium falciparum
QNHNGTH

SEQ ID NO: 3340064 - protein, 13 aa, Plasmodium falciparum
QNHTKTNNTNQHK

SEQ ID NO: 3340065 - protein, 4 aa, Plasmodium falciparum
QNIE

SEQ ID NO: 3340066 - protein, 6 aa, Plasmodium falciparum
QNIESD

SEQ ID NO: 3340067 - protein, 28 aa, Plasmodium falciparum
QNIGQNVGKNVGKNIGKNVEKNIGPDIK

SEQ ID NO: 3340068 - protein, 4 aa, Plasmodium falciparum
QNIH

SEQ ID NO: 3340069 - protein, 38 aa, Plasmodium falciparum
QNIKSGKYQRNIPQNDDNDHNDDDSEIKEVKKDKTKID

SEQ ID NO: 3340070 - protein, 4 aa, Plasmodium falciparum
QNIL

SEQ ID NO: 3340071 - protein, 6 aa, Plasmodium falciparum
QNINNL

SEQ ID NO: 3340072 - protein, 5 aa, Plasmodium falciparum
QNINQ

SEQ ID NO: 3340073 - protein, 13 aa, Plasmodium falciparum
QNINSKPSSITKK

SEQ ID NO: 3340074 - protein, 8 aa, Plasmodium falciparum
QNINTSSK

SEQ ID NO: 3340075 - protein, 4 aa, Plasmodium falciparum
QNIP

SEQ ID NO: 3340076 - protein, 10 aa, Plasmodium falciparum
QNIQTKQHSY

SEQ ID NO: 3340077 - protein, 8 aa, Plasmodium falciparum
QNISESER

SEQ ID NO: 3340078 - protein, 10 aa, Plasmodium falciparum
QNKCSEQMEG

SEQ ID NO: 3340079 - protein, 8 aa, Plasmodium falciparum
QNKDAQEE

SEQ ID NO: 3340080 - protein, 10 aa, Plasmodium falciparum
QNKDDAKKNL

SEQ ID NO: 3340081 - protein, 10 aa, Plasmodium falciparum
QNKDDDQNER

SEQ ID NO: 3340082 - protein, 7 aa, Plasmodium falciparum
QNKDENN

SEQ ID NO: 3340083 - protein, 8 aa, Plasmodium falciparum
QNKDKKIE

SEQ ID NO: 3340084 - protein, 36 aa, Plasmodium falciparum
QNKDNINDENYNDENYNDENYNDKNYNDNDYISGNE

SEQ ID NO: 3340085 - protein, 4 aa, Plasmodium falciparum
QNKE

SEQ ID NO: 3340086 - protein, 5 aa, Plasmodium falciparum
QNKEE

SEQ ID NO: 3340087 - protein, 13 aa, Plasmodium falciparum
QNKEEEIQRNERN

SEQ ID NO: 3340088 - protein, 96 aa, Plasmodium falciparum
QNKEEEKYQNKEQENQGQIEKNKTKEHDENKTQEHDENKTQEHDENKTQEHDENKTHVQEENETNVQTQNELHEQTSNETNVQAPNETNVQTQNEL

SEQ ID NO: 3340089 - protein, 6 aa, Plasmodium falciparum
QNKEEK

SEQ ID NO: 3340090 - protein, 19 aa, Plasmodium falciparum
QNKEISRNQHISKDSQINS

SEQ ID NO: 3340091 - protein, 11 aa, Plasmodium falciparum
QNKESTFPSED

SEQ ID NO: 3340092 - protein, 15 aa, Plasmodium falciparum
QNKGNTKNDKEQNDN

SEQ ID NO: 3340093 - protein, 22 aa, Plasmodium falciparum
QNKGQTKKVDEMDTSKKEGIKD

SEQ ID NO: 3340094 - protein, 11 aa, Plasmodium falciparum
QNKGRQNQVEK

SEQ ID NO: 3340095 - protein, 5 aa, Plasmodium falciparum
QNKGV

SEQ ID NO: 3340096 - protein, 4 aa, Plasmodium falciparum
QNKI

SEQ ID NO: 3340097 - protein, 5 aa, Plasmodium falciparum
QNKIK

SEQ ID NO: 3340098 - protein, 5 aa, Plasmodium falciparum
QNKKC

SEQ ID NO: 3340099 - protein, 19 aa, Plasmodium falciparum
QNKKDSNTNTNRKGYSTHR

SEQ ID NO: 3340100 - protein, 9 aa, Plasmodium falciparum
QNKKEERTN

SEQ ID NO: 3340101 - protein, 7 aa, Plasmodium falciparum
QNKKGVI

SEQ ID NO: 3340102 - protein, 11 aa, Plasmodium falciparum
QNKKKANTLEK

SEQ ID NO: 3340103 - protein, 10 aa, Plasmodium falciparum
QNKKKGLSDC

SEQ ID NO: 3340104 - protein, 11 aa, Plasmodium falciparum
QNKKKRKKDTF

SEQ ID NO: 3340105 - protein, 6 aa, Plasmodium falciparum
QNKKRK

SEQ ID NO: 3340106 - protein, 13 aa, Plasmodium falciparum
QNKKRLEAQRNEL

SEQ ID NO: 3340107 - protein, 7 aa, Plasmodium falciparum
QNKKYDV

SEQ ID NO: 3340108 - protein, 11 aa, Plasmodium falciparum
QNKKYSNSTIV

SEQ ID NO: 3340109 - protein, 9 aa, Plasmodium falciparum
QNKLSKEKA

SEQ ID NO: 3340110 - protein, 11 aa, Plasmodium falciparum
QNKMNSQSYKK

SEQ ID NO: 3340111 - protein, 4 aa, Plasmodium falciparum
QNKN

SEQ ID NO: 3340112 - protein, 9 aa, Plasmodium falciparum
QNKNDEYDN

SEQ ID NO: 3340113 - protein, 6 aa, Plasmodium falciparum
QNKNDN

SEQ ID NO: 3340114 - protein, 7 aa, Plasmodium falciparum
QNKNEKR

SEQ ID NO: 3340115 - protein, 9 aa, Plasmodium falciparum
QNKNENTEI

SEQ ID NO: 3340116 - protein, 5 aa, Plasmodium falciparum
QNKNF

SEQ ID NO: 3340117 - protein, 18 aa, Plasmodium falciparum
QNKNHPYNISNKNNSNIY

SEQ ID NO: 3340118 - protein, 7 aa, Plasmodium falciparum
QNKNIQD

SEQ ID NO: 3340119 - protein, 11 aa, Plasmodium falciparum
QNKNKKKKNQA

SEQ ID NO: 3340120 - protein, 9 aa, Plasmodium falciparum
QNKNNATDF

SEQ ID NO: 3340121 - protein, 10 aa, Plasmodium falciparum
QNKNNNNNIS

SEQ ID NO: 3340122 - protein, 44 aa, Plasmodium falciparum
QNKNNSKSNNNKSNNNNNNNNNNNNNNNNNNNNNNNNNNNNNCD

SEQ ID NO: 3340123 - protein, 5 aa, Plasmodium falciparum
QNKNV

SEQ ID NO: 3340124 - protein, 8 aa, Plasmodium falciparum
QNKPTGEG

SEQ ID NO: 3340125 - protein, 11 aa, Plasmodium falciparum
QNKQDKNIQKQ

SEQ ID NO: 3340126 - protein, 35 aa, Plasmodium falciparum
QNKQHDNNNNNNNNNNNTPDKRLENSNDNHEDNHH

SEQ ID NO: 3340127 - protein, 7 aa, Plasmodium falciparum
QNKQLSY

SEQ ID NO: 3340128 - protein, 7 aa, Plasmodium falciparum
QNKQNKV

SEQ ID NO: 3340129 - protein, 10 aa, Plasmodium falciparum
QNKRRKDEHI

SEQ ID NO: 3340130 - protein, 6 aa, Plasmodium falciparum
QNKSDE

SEQ ID NO: 3340131 - protein, 6 aa, Plasmodium falciparum
QNKSEC

SEQ ID NO: 3340132 - protein, 6 aa, Plasmodium falciparum
QNKSIN

SEQ ID NO: 3340133 - protein, 5 aa, Plasmodium falciparum
QNKSK

SEQ ID NO: 3340134 - protein, 9 aa, Plasmodium falciparum
QNKSKKNKE

SEQ ID NO: 3340135 - protein, 7 aa, Plasmodium falciparum
QNKSNLS

SEQ ID NO: 3340136 - protein, 22 aa, Plasmodium falciparum
QNKSNPKNNNIYNNTDQQMNKD

SEQ ID NO: 3340137 - protein, 20 aa, Plasmodium falciparum
QNKTSKQLNNTKNDNNYNND

SEQ ID NO: 3340138 - protein, 7 aa, Plasmodium falciparum
QNKTSNM

SEQ ID NO: 3340139 - protein, 8 aa, Plasmodium falciparum
QNKYEAYK

SEQ ID NO: 3340140 - protein, 8 aa, Plasmodium falciparum
QNKYNKKE

SEQ ID NO: 3340141 - protein, 8 aa, Plasmodium falciparum
QNKYNNEN

SEQ ID NO: 3340142 - protein, 10 aa, Plasmodium falciparum
QNLANEPPPG

SEQ ID NO: 3340143 - protein, 6 aa, Plasmodium falciparum
QNLDKN

SEQ ID NO: 3340144 - protein, 13 aa, Plasmodium falciparum
QNLEDNLKNNEDI

SEQ ID NO: 3340145 - protein, 85 aa, Plasmodium falciparum
QNLGNNKSCNSRSSKKESIKKQKSNSELGIKKNTKKSLGIKKEEEKKKQISKRKSNELKEKNNLKEGKKKYVEKKSRTVKDETKL

SEQ ID NO: 3340146 - protein, 11 aa, Plasmodium falciparum
QNLKNTAPIKQ

SEQ ID NO: 3340147 - protein, 5 aa, Plasmodium falciparum
QNLNT

SEQ ID NO: 3340148 - protein, 7 aa, Plasmodium falciparum
QNLPNHE

SEQ ID NO: 3340149 - protein, 12 aa, Plasmodium falciparum
QNLQSEKKTPIL

SEQ ID NO: 3340150 - protein, 13 aa, Plasmodium falciparum
QNLSIPQELHYIH

SEQ ID NO: 3340151 - protein, 8 aa, Plasmodium falciparum
QNLSNAEK

SEQ ID NO: 3340152 - protein, 5 aa, Plasmodium falciparum
QNLSP

SEQ ID NO: 3340153 - protein, 11 aa, Plasmodium falciparum
QNMDDNNNNMD

SEQ ID NO: 3340154 - protein, 8 aa, Plasmodium falciparum
QNMNEQNN

SEQ ID NO: 3340155 - protein, 12 aa, Plasmodium falciparum
QNMSKKKKKNSF

SEQ ID NO: 3340156 - protein, 8 aa, Plasmodium falciparum
QNNADEHT

SEQ ID NO: 3340157 - protein, 30 aa, Plasmodium falciparum
QNNDDGMRKYKDTQLNELTKKTKDTYENSN

SEQ ID NO: 3340158 - protein, 6 aa, Plasmodium falciparum
QNNDED

SEQ ID NO: 3340159 - protein, 8 aa, Plasmodium falciparum
QNNDKISS

SEQ ID NO: 3340160 - protein, 14 aa, Plasmodium falciparum
QNNDKLKEDKLDEG

SEQ ID NO: 3340161 - protein, 12 aa, Plasmodium falciparum
QNNDNNNNNNNN

SEQ ID NO: 3340162 - protein, 8 aa, Plasmodium falciparum
QNNDSSSY

SEQ ID NO: 3340163 - protein, 13 aa, Plasmodium falciparum
QNNDTEDSKQPYY

SEQ ID NO: 3340164 - protein, 4 aa, Plasmodium falciparum
QNNE

SEQ ID NO: 3340165 - protein, 12 aa, Plasmodium falciparum
QNNEEQQPNQEE

SEQ ID NO: 3340166 - protein, 9 aa, Plasmodium falciparum
QNNEETEKH

SEQ ID NO: 3340167 - protein, 13 aa, Plasmodium falciparum
QNNEITDNQQKKK

SEQ ID NO: 3340168 - protein, 8 aa, Plasmodium falciparum
QNNENTIN

SEQ ID NO: 3340169 - protein, 6 aa, Plasmodium falciparum
QNNEVS

SEQ ID NO: 3340170 - protein, 13 aa, Plasmodium falciparum
QNNGNNDNKEKNM

SEQ ID NO: 3340171 - protein, 4 aa, Plasmodium falciparum
QNNH

SEQ ID NO: 3340172 - protein, 10 aa, Plasmodium falciparum
QNNHGYNNGY

SEQ ID NO: 3340173 - protein, 9 aa, Plasmodium falciparum
QNNHSSYDE

SEQ ID NO: 3340174 - protein, 4 aa, Plasmodium falciparum
QNNI

SEQ ID NO: 3340175 - protein, 5 aa, Plasmodium falciparum
QNNIS

SEQ ID NO: 3340176 - protein, 33 aa, Plasmodium falciparum
QNNISNNKIYNDNKSERDKYTERGSREVKYNTS

SEQ ID NO: 3340177 - protein, 7 aa, Plasmodium falciparum
QNNKDTL

SEQ ID NO: 3340178 - protein, 14 aa, Plasmodium falciparum
QNNKGKKKGMIKNS

SEQ ID NO: 3340179 - protein, 8 aa, Plasmodium falciparum
QNNKIPND

SEQ ID NO: 3340180 - protein, 10 aa, Plasmodium falciparum
QNNKITDKKE

SEQ ID NO: 3340181 - protein, 7 aa, Plasmodium falciparum
QNNKKNN

SEQ ID NO: 3340182 - protein, 8 aa, Plasmodium falciparum
QNNKNEEH

SEQ ID NO: 3340183 - protein, 16 aa, Plasmodium falciparum
QNNKNKDNNNKSEINR

SEQ ID NO: 3340184 - protein, 37 aa, Plasmodium falciparum
QNNKNNNKSINNNNDNKSINNNNDNKRINNNNIHDNN

SEQ ID NO: 3340185 - protein, 5 aa, Plasmodium falciparum
QNNLS

SEQ ID NO: 3340186 - protein, 14 aa, Plasmodium falciparum
QNNNEEKKKEEANY

SEQ ID NO: 3340187 - protein, 7 aa, Plasmodium falciparum
QNNNENH

SEQ ID NO: 3340188 - protein, 5 aa, Plasmodium falciparum
QNNNF

SEQ ID NO: 3340189 - protein, 5 aa, Plasmodium falciparum
QNNNH

SEQ ID NO: 3340190 - protein, 6 aa, Plasmodium falciparum
QNNNHN

SEQ ID NO: 3340191 - protein, 10 aa, Plasmodium falciparum
QNNNIHDEEN

SEQ ID NO: 3340192 - protein, 9 aa, Plasmodium falciparum
QNNNKRQLN

SEQ ID NO: 3340193 - protein, 6 aa, Plasmodium falciparum
QNNNLK

SEQ ID NO: 3340194 - protein, 8 aa, Plasmodium falciparum
QNNNNCAY

SEQ ID NO: 3340195 - protein, 25 aa, Plasmodium falciparum
QNNNNNKQTNQNNNLQQEQEGKTNN

SEQ ID NO: 3340196 - protein, 9 aa, Plasmodium falciparum
QNNNNNNNM

SEQ ID NO: 3340197 - protein, 7 aa, Plasmodium falciparum
QNNNNTY

SEQ ID NO: 3340198 - protein, 30 aa, Plasmodium falciparum
QNNNNVKHNKDITTRQIDSKENQKSTKKQN

SEQ ID NO: 3340199 - protein, 17 aa, Plasmodium falciparum
QNNNPNNVNNNNNNNNM

SEQ ID NO: 3340200 - protein, 10 aa, Plasmodium falciparum
QNNNSKTCGN

SEQ ID NO: 3340201 - protein, 8 aa, Plasmodium falciparum
QNNNSNNN

SEQ ID NO: 3340202 - protein, 5 aa, Plasmodium falciparum
QNNNY

SEQ ID NO: 3340203 - protein, 20 aa, Plasmodium falciparum
QNNPKDEINEKTESTSNISD

SEQ ID NO: 3340204 - protein, 11 aa, Plasmodium falciparum
QNNQDEKHEDN

SEQ ID NO: 3340205 - protein, 5 aa, Plasmodium falciparum
QNNQS

SEQ ID NO: 3340206 - protein, 16 aa, Plasmodium falciparum
QNNQTNKNVDNYQNNN

SEQ ID NO: 3340207 - protein, 6 aa, Plasmodium falciparum
QNNREN

SEQ ID NO: 3340208 - protein, 5 aa, Plasmodium falciparum
QNNRN

SEQ ID NO: 3340209 - protein, 8 aa, Plasmodium falciparum
QNNRSTKF

SEQ ID NO: 3340210 - protein, 14 aa, Plasmodium falciparum
QNNSEDITKKNISE

SEQ ID NO: 3340211 - protein, 6 aa, Plasmodium falciparum
QNNSIQ

SEQ ID NO: 3340212 - protein, 10 aa, Plasmodium falciparum
QNNSNKYIKK

SEQ ID NO: 3340213 - protein, 10 aa, Plasmodium falciparum
QNNSNNNVNK

SEQ ID NO: 3340214 - protein, 8 aa, Plasmodium falciparum
QNNSPLSR

SEQ ID NO: 3340215 - protein, 11 aa, Plasmodium falciparum
QNNSPNHFHSQ

SEQ ID NO: 3340216 - protein, 21 aa, Plasmodium falciparum
QNNSYNNSTDYPEFSKDSNID

SEQ ID NO: 3340217 - protein, 24 aa, Plasmodium falciparum
QNNSYREKYGSYYNNNDISNSNNN

SEQ ID NO: 3340218 - protein, 6 aa, Plasmodium falciparum
QNNTNL

SEQ ID NO: 3340219 - protein, 4 aa, Plasmodium falciparum
QNNV

SEQ ID NO: 3340220 - protein, 9 aa, Plasmodium falciparum
QNNVEESRN

SEQ ID NO: 3340221 - protein, 18 aa, Plasmodium falciparum
QNNVEKKNLSKNKAQTLN

SEQ ID NO: 3340222 - protein, 6 aa, Plasmodium falciparum
QNNVQD

SEQ ID NO: 3340223 - protein, 7 aa, Plasmodium falciparum
QNNYGET

SEQ ID NO: 3340224 - protein, 6 aa, Plasmodium falciparum
QNNYNQ

SEQ ID NO: 3340225 - protein, 17 aa, Plasmodium falciparum
QNPDPNTLKNSENGIPN

SEQ ID NO: 3340226 - protein, 5 aa, Plasmodium falciparum
QNPIH

SEQ ID NO: 3340227 - protein, 5 aa, Plasmodium falciparum
QNPKS

SEQ ID NO: 3340228 - protein, 16 aa, Plasmodium falciparum
QNPNSKAFNNTNQDLQ

SEQ ID NO: 3340229 - protein, 4 aa, Plasmodium falciparum
QNPP

SEQ ID NO: 3340230 - protein, 6 aa, Plasmodium falciparum
QNPPHA

SEQ ID NO: 3340231 - protein, 19 aa, Plasmodium falciparum
QNPPHNNANQAKGLPPGVP

SEQ ID NO: 3340232 - protein, 5 aa, Plasmodium falciparum
QNPQA

SEQ ID NO: 3340233 - protein, 7 aa, Plasmodium falciparum
QNQANKH

SEQ ID NO: 3340234 - protein, 46 aa, Plasmodium falciparum
QNQEAEDDKNNNNNDNNNDNHNDNNNENNNENNNDNNNENNNDINN

SEQ ID NO: 3340235 - protein, 11 aa, Plasmodium falciparum
QNQEKDTDTNN

SEQ ID NO: 3340236 - protein, 6 aa, Plasmodium falciparum
QNQGIE

SEQ ID NO: 3340237 - protein, 8 aa, Plasmodium falciparum
QNQGSEKM

SEQ ID NO: 3340238 - protein, 10 aa, Plasmodium falciparum
QNQKNNEQNI

SEQ ID NO: 3340239 - protein, 7 aa, Plasmodium falciparum
QNQNNNT

SEQ ID NO: 3340240 - protein, 7 aa, Plasmodium falciparum
QNQNNYE

SEQ ID NO: 3340241 - protein, 5 aa, Plasmodium falciparum
QNQPN

SEQ ID NO: 3340242 - protein, 7 aa, Plasmodium falciparum
QNQQPVD

SEQ ID NO: 3340243 - protein, 5 aa, Plasmodium falciparum
QNQRL

SEQ ID NO: 3340244 - protein, 16 aa, Plasmodium falciparum
QNQSKLKKNAVDNSLQ

SEQ ID NO: 3340245 - protein, 10 aa, Plasmodium falciparum
QNQSKPVESK

SEQ ID NO: 3340246 - protein, 7 aa, Plasmodium falciparum
QNQSRDK

SEQ ID NO: 3340247 - protein, 8 aa, Plasmodium falciparum
QNQTYEEY

SEQ ID NO: 3340248 - protein, 13 aa, Plasmodium falciparum
QNRDKKKDEIREN

SEQ ID NO: 3340249 - protein, 8 aa, Plasmodium falciparum
QNRDKNIK

SEQ ID NO: 3340250 - protein, 6 aa, Plasmodium falciparum
QNREDT

SEQ ID NO: 3340251 - protein, 16 aa, Plasmodium falciparum
QNRKAHKNGIKKPKKH

SEQ ID NO: 3340252 - protein, 5 aa, Plasmodium falciparum
QNRNT

SEQ ID NO: 3340253 - protein, 7 aa, Plasmodium falciparum
QNRSREK

SEQ ID NO: 3340254 - protein, 4 aa, Plasmodium falciparum
QNSD

SEQ ID NO: 3340255 - protein, 10 aa, Plasmodium falciparum
QNSDDYDSDI

SEQ ID NO: 3340256 - protein, 14 aa, Plasmodium falciparum
QNSDVQKEKKELKT

SEQ ID NO: 3340257 - protein, 4 aa, Plasmodium falciparum
QNSE

SEQ ID NO: 3340258 - protein, 4 aa, Plasmodium falciparum
QNSH

SEQ ID NO: 3340259 - protein, 20 aa, Plasmodium falciparum
QNSISTDNIKEKNTSKQNAH

SEQ ID NO: 3340260 - protein, 8 aa, Plasmodium falciparum
QNSITPNH

SEQ ID NO: 3340261 - protein, 10 aa, Plasmodium falciparum
QNSKKENNQI

SEQ ID NO: 3340262 - protein, 6 aa, Plasmodium falciparum
QNSKLN

SEQ ID NO: 3340263 - protein, 4 aa, Plasmodium falciparum
QNSL

SEQ ID NO: 3340264 - protein, 5 aa, Plasmodium falciparum
QNSLP

SEQ ID NO: 3340265 - protein, 4 aa, Plasmodium falciparum
QNSM

SEQ ID NO: 3340266 - protein, 5 aa, Plasmodium falciparum
QNSND

SEQ ID NO: 3340267 - protein, 11 aa, Plasmodium falciparum
QNSNSDKPHGD

SEQ ID NO: 3340268 - protein, 9 aa, Plasmodium falciparum
QNSNTNNQI

SEQ ID NO: 3340269 - protein, 6 aa, Plasmodium falciparum
QNSPNL

SEQ ID NO: 3340270 - protein, 8 aa, Plasmodium falciparum
QNSQNQNN

SEQ ID NO: 3340271 - protein, 6 aa, Plasmodium falciparum
QNSSDI

SEQ ID NO: 3340272 - protein, 13 aa, Plasmodium falciparum
QNSSNSLKNSNFD

SEQ ID NO: 3340273 - protein, 9 aa, Plasmodium falciparum
QNSVNNNNN

SEQ ID NO: 3340274 - protein, 6 aa, Plasmodium falciparum
QNTEEI

SEQ ID NO: 3340275 - protein, 8 aa, Plasmodium falciparum
QNTEHDTH

SEQ ID NO: 3340276 - protein, 10 aa, Plasmodium falciparum
QNTEKKNKER

SEQ ID NO: 3340277 - protein, 8 aa, Plasmodium falciparum
QNTEKVEE

SEQ ID NO: 3340278 - protein, 6 aa, Plasmodium falciparum
QNTEQK

SEQ ID NO: 3340279 - protein, 18 aa, Plasmodium falciparum
QNTFNNPNKYHHMKNKIN

SEQ ID NO: 3340280 - protein, 18 aa, Plasmodium falciparum
QNTKEKKNSNHSINDQGN

SEQ ID NO: 3340281 - protein, 6 aa, Plasmodium falciparum
QNTKEV

SEQ ID NO: 3340282 - protein, 16 aa, Plasmodium falciparum
QNTKTDKEEKKDDLNT

SEQ ID NO: 3340283 - protein, 5 aa, Plasmodium falciparum
QNTKY

SEQ ID NO: 3340284 - protein, 4 aa, Plasmodium falciparum
QNTN

SEQ ID NO: 3340285 - protein, 14 aa, Plasmodium falciparum
QNTNENLSNGNEER

SEQ ID NO: 3340286 - protein, 11 aa, Plasmodium falciparum
QNTNKKEVQEV

SEQ ID NO: 3340287 - protein, 14 aa, Plasmodium falciparum
QNTNNKNNDNMNKN

SEQ ID NO: 3340288 - protein, 8 aa, Plasmodium falciparum
QNTPKEGE

SEQ ID NO: 3340289 - protein, 8 aa, Plasmodium falciparum
QNTPYDDS

SEQ ID NO: 3340290 - protein, 47 aa, Plasmodium falciparum
QNTQIDNNKGKKTTNTMEKNKKNRDKKHSKKRKTKQNYKYKKENQNI

SEQ ID NO: 3340291 - protein, 10 aa, Plasmodium falciparum
QNTSKNLSQS

SEQ ID NO: 3340292 - protein, 14 aa, Plasmodium falciparum
QNTSPLTGKDGKHI

SEQ ID NO: 3340293 - protein, 24 aa, Plasmodium falciparum
QNTSSDSDGESRTRKRKTRESYEN

SEQ ID NO: 3340294 - protein, 7 aa, Plasmodium falciparum
QNTTNKN

SEQ ID NO: 3340295 - protein, 9 aa, Plasmodium falciparum
QNTTNNKQF

SEQ ID NO: 3340296 - protein, 13 aa, Plasmodium falciparum
QNTTYEAASSKLS

SEQ ID NO: 3340297 - protein, 5 aa, Plasmodium falciparum
QNTYD

SEQ ID NO: 3340298 - protein, 6 aa, Plasmodium falciparum
QNTYEK

SEQ ID NO: 3340299 - protein, 10 aa, Plasmodium falciparum
QNTYNNDENR

SEQ ID NO: 3340300 - protein, 20 aa, Plasmodium falciparum
QNVDKNINNNNNNPNKNVES

SEQ ID NO: 3340301 - protein, 7 aa, Plasmodium falciparum
QNVEDQG

SEQ ID NO: 3340302 - protein, 6 aa, Plasmodium falciparum
QNVEGK

SEQ ID NO: 3340303 - protein, 29 aa, Plasmodium falciparum
QNVEQNVEQNVEQKAEQNSNNESIKTNTV

SEQ ID NO: 3340304 - protein, 4 aa, Plasmodium falciparum
QNVH

SEQ ID NO: 3340305 - protein, 16 aa, Plasmodium falciparum
QNVHESNQKKNDFYEE

SEQ ID NO: 3340306 - protein, 26 aa, Plasmodium falciparum
QNVITEKGKTNTRDDDNSKGNNNDEI

SEQ ID NO: 3340307 - protein, 4 aa, Plasmodium falciparum
QNVL

SEQ ID NO: 3340308 - protein, 16 aa, Plasmodium falciparum
QNVNKKKNINNEKEFS

SEQ ID NO: 3340309 - protein, 6 aa, Plasmodium falciparum
QNVNRT

SEQ ID NO: 3340310 - protein, 6 aa, Plasmodium falciparum
QNVPHN

SEQ ID NO: 3340311 - protein, 13 aa, Plasmodium falciparum
QNVQGDNNCTTPR

SEQ ID NO: 3340312 - protein, 7 aa, Plasmodium falciparum
QNVQQNE

SEQ ID NO: 3340313 - protein, 8 aa, Plasmodium falciparum
QNVQSEKN

SEQ ID NO: 3340314 - protein, 24 aa, Plasmodium falciparum
QNVRDQNDTTPHHNNENQNEQGNL

SEQ ID NO: 3340315 - protein, 6 aa, Plasmodium falciparum
QNVSQY

SEQ ID NO: 3340316 - protein, 7 aa, Plasmodium falciparum
QNVYNDN

SEQ ID NO: 3340317 - protein, 4 aa, Plasmodium falciparum
QNYD

SEQ ID NO: 3340318 - protein, 4 aa, Plasmodium falciparum
QNYE

SEQ ID NO: 3340319 - protein, 4 aa, Plasmodium falciparum
QNYF

SEQ ID NO: 3340320 - protein, 28 aa, Plasmodium falciparum
QNYGSNNNSSLEKNNMKENDIYSKEASK

SEQ ID NO: 3340321 - protein, 6 aa, Plasmodium falciparum
QNYKSV

SEQ ID NO: 3340322 - protein, 19 aa, Plasmodium falciparum
QNYNKKNNNNDKKKEDNIA

SEQ ID NO: 3340323 - protein, 24 aa, Plasmodium falciparum
QNYNKNNNISLETEEDFSKKNLEK

SEQ ID NO: 3340324 - protein, 50 aa, Plasmodium falciparum
QNYNQNEDDYNDDDYNDDNYNDDDYNDDDDNDDNDDDNDDDNNNEEEKHE

SEQ ID NO: 3340325 - protein, 5 aa, Plasmodium falciparum
QNYQD

SEQ ID NO: 3340326 - protein, 28 aa, Plasmodium falciparum
QNYYEKKNNFKDDDNNNSSDYSSYDSDE

SEQ ID NO: 3340327 - protein, 4 aa, Plasmodium falciparum
QPDD

SEQ ID NO: 3340328 - protein, 9 aa, Plasmodium falciparum
QPDGQMPSD

SEQ ID NO: 3340329 - protein, 17 aa, Plasmodium falciparum
QPDGQMPSDKASRANDD

SEQ ID NO: 3340330 - protein, 13 aa, Plasmodium falciparum
QPDNEQPTQEINP

SEQ ID NO: 3340331 - protein, 13 aa, Plasmodium falciparum
QPDNNKNTSNIQN

SEQ ID NO: 3340332 - protein, 15 aa, Plasmodium falciparum
QPEDNLDDAHSNYSS

SEQ ID NO: 3340333 - protein, 6 aa, Plasmodium falciparum
QPEDYQ

SEQ ID NO: 3340334 - protein, 7 aa, Plasmodium falciparum
QPEQNNA

SEQ ID NO: 3340335 - protein, 4 aa, Plasmodium falciparum
QPGI

SEQ ID NO: 3340336 - protein, 4 aa, Plasmodium falciparum
QPHD

SEQ ID NO: 3340337 - protein, 7 aa, Plasmodium falciparum
QPKIEGN

SEQ ID NO: 3340338 - protein, 6 aa, Plasmodium falciparum
QPKNDE

SEQ ID NO: 3340339 - protein, 4 aa, Plasmodium falciparum
QPKV

SEQ ID NO: 3340340 - protein, 4 aa, Plasmodium falciparum
QPKY

SEQ ID NO: 3340341 - protein, 6 aa, Plasmodium falciparum
QPNKER

SEQ ID NO: 3340342 - protein, 5 aa, Plasmodium falciparum
QPNMS

SEQ ID NO: 3340343 - protein, 5 aa, Plasmodium falciparum
QPNQK

SEQ ID NO: 3340344 - protein, 5 aa, Plasmodium falciparum
QPNTP

SEQ ID NO: 3340345 - protein, 5 aa, Plasmodium falciparum
QPPHN

SEQ ID NO: 3340346 - protein, 4 aa, Plasmodium falciparum
QPPI

SEQ ID NO: 3340347 - protein, 9 aa, Plasmodium falciparum
QPPKPQPNL

SEQ ID NO: 3340348 - protein, 5 aa, Plasmodium falciparum
QPPSN

SEQ ID NO: 3340349 - protein, 10 aa, Plasmodium falciparum
QPPTKPLGRP

SEQ ID NO: 3340350 - protein, 5 aa, Plasmodium falciparum
QPSDI

SEQ ID NO: 3340351 - protein, 12 aa, Plasmodium falciparum
QPSDKNSSWSEE

SEQ ID NO: 3340352 - protein, 4 aa, Plasmodium falciparum
QPSI

SEQ ID NO: 3340353 - protein, 10 aa, Plasmodium falciparum
QPSRSYEQQP

SEQ ID NO: 3340354 - protein, 11 aa, Plasmodium falciparum
QPTEGRSRDGG

SEQ ID NO: 3340355 - protein, 18 aa, Plasmodium falciparum
QPTGSPPPSSLSTTSPIA

SEQ ID NO: 3340356 - protein, 22 aa, Plasmodium falciparum
QPTKMNQNNDITPNERKGKKKQ

SEQ ID NO: 3340357 - protein, 4 aa, Plasmodium falciparum
QPTL

SEQ ID NO: 3340358 - protein, 4 aa, Plasmodium falciparum
QPTN

SEQ ID NO: 3340359 - protein, 6 aa, Plasmodium falciparum
QPTPNN

SEQ ID NO: 3340360 - protein, 20 aa, Plasmodium falciparum
QPTVRTSSTIEKSNTSPHYL

SEQ ID NO: 3340361 - protein, 6 aa, Plasmodium falciparum
QPTYNS

SEQ ID NO: 3340362 - protein, 5 aa, Plasmodium falciparum
QPVDD

SEQ ID NO: 3340363 - protein, 7 aa, Plasmodium falciparum
QPVNNQS

SEQ ID NO: 3340364 - protein, 10 aa, Plasmodium falciparum
QPYGQSDTPG

SEQ ID NO: 3340365 - protein, 23 aa, Plasmodium falciparum
QPYNKNNDNHHANDKEDNVHNGT

SEQ ID NO: 3340366 - protein, 8 aa, Plasmodium falciparum
QPYTRQNQ

SEQ ID NO: 3340367 - protein, 4 aa, Plasmodium falciparum
QQAA

SEQ ID NO: 3340368 - protein, 4 aa, Plasmodium falciparum
QQAE

SEQ ID NO: 3340369 - protein, 9 aa, Plasmodium falciparum
QQATAQGIS

SEQ ID NO: 3340370 - protein, 10 aa, Plasmodium falciparum
QQCEQKKENI

SEQ ID NO: 3340371 - protein, 9 aa, Plasmodium falciparum
QQCNDNNNN

SEQ ID NO: 3340372 - protein, 15 aa, Plasmodium falciparum
QQDDNVSHANHTRST

SEQ ID NO: 3340373 - protein, 12 aa, Plasmodium falciparum
QQDIGLDDDTFD

SEQ ID NO: 3340374 - protein, 7 aa, Plasmodium falciparum
QQDKIND

SEQ ID NO: 3340375 - protein, 6 aa, Plasmodium falciparum
QQDMTQ

SEQ ID NO: 3340376 - protein, 8 aa, Plasmodium falciparum
QQDNFDQD

SEQ ID NO: 3340377 - protein, 10 aa, Plasmodium falciparum
QQDNNESQEI

SEQ ID NO: 3340378 - protein, 5 aa, Plasmodium falciparum
QQDSN

SEQ ID NO: 3340379 - protein, 13 aa, Plasmodium falciparum
QQEAKQKANGILV

SEQ ID NO: 3340380 - protein, 18 aa, Plasmodium falciparum
QQEDADSNNNNNNNNNNL

SEQ ID NO: 3340381 - protein, 5 aa, Plasmodium falciparum
QQEDD

SEQ ID NO: 3340382 - protein, 10 aa, Plasmodium falciparum
QQEDKEENIK

SEQ ID NO: 3340383 - protein, 30 aa, Plasmodium falciparum
QQEDVLSSGRGRRTRTGTRTSTRTSTRRDM

SEQ ID NO: 3340384 - protein, 7 aa, Plasmodium falciparum
QQEECEN

SEQ ID NO: 3340385 - protein, 16 aa, Plasmodium falciparum
QQEENEHDKGNEEKTL

SEQ ID NO: 3340386 - protein, 16 aa, Plasmodium falciparum
QQEENNNKINEHDPTY

SEQ ID NO: 3340387 - protein, 10 aa, Plasmodium falciparum
QQEKNNLDNL

SEQ ID NO: 3340388 - protein, 10 aa, Plasmodium falciparum
QQEKTKYTSQ

SEQ ID NO: 3340389 - protein, 45 aa, Plasmodium falciparum
QQENKKQDETKINHNNDNNDNNDNNDNNDNNINNNNNNQKGGQGN

SEQ ID NO: 3340390 - protein, 8 aa, Plasmodium falciparum
QQHPSRDL

SEQ ID NO: 3340391 - protein, 6 aa, Plasmodium falciparum
QQINKD

SEQ ID NO: 3340392 - protein, 9 aa, Plasmodium falciparum
QQKDDKKEM

SEQ ID NO: 3340393 - protein, 24 aa, Plasmodium falciparum
QQKDDLKTKNEFSDQGSHDSSIQQ

SEQ ID NO: 3340394 - protein, 23 aa, Plasmodium falciparum
QQKDSHHNSTIGRNHEKRKKKIN

SEQ ID NO: 3340395 - protein, 8 aa, Plasmodium falciparum
QQKEVSNA

SEQ ID NO: 3340396 - protein, 8 aa, Plasmodium falciparum
QQKKENNF

SEQ ID NO: 3340397 - protein, 7 aa, Plasmodium falciparum
QQKKGDI

SEQ ID NO: 3340398 - protein, 8 aa, Plasmodium falciparum
QQKKKNDS

SEQ ID NO: 3340399 - protein, 14 aa, Plasmodium falciparum
QQKKLKRKDKNYDK

SEQ ID NO: 3340400 - protein, 9 aa, Plasmodium falciparum
QQKNASSFN

SEQ ID NO: 3340401 - protein, 9 aa, Plasmodium falciparum
QQKNYNNNN

SEQ ID NO: 3340402 - protein, 9 aa, Plasmodium falciparum
QQKRPSTKW

SEQ ID NO: 3340403 - protein, 14 aa, Plasmodium falciparum
QQKTKKETYFAQKE

SEQ ID NO: 3340404 - protein, 4 aa, Plasmodium falciparum
QQKY

SEQ ID NO: 3340405 - protein, 4 aa, Plasmodium falciparum
QQLK

SEQ ID NO: 3340406 - protein, 19 aa, Plasmodium falciparum
QQNDANNNDHKKGNLQEDH

SEQ ID NO: 3340407 - protein, 28 aa, Plasmodium falciparum
QQNDMSSPNNNNNNNNSNNNNNNIGGGI

SEQ ID NO: 3340408 - protein, 40 aa, Plasmodium falciparum
QQNEEKKKKKKNFQSDISEKKEKSKADLQKSESKNNNLKK

SEQ ID NO: 3340409 - protein, 23 aa, Plasmodium falciparum
QQNELTKDEKKAIRKSKKMKKKK

SEQ ID NO: 3340410 - protein, 10 aa, Plasmodium falciparum
QQNENDKKNI

SEQ ID NO: 3340411 - protein, 7 aa, Plasmodium falciparum
QQNENNY

SEQ ID NO: 3340412 - protein, 6 aa, Plasmodium falciparum
QQNFNN

SEQ ID NO: 3340413 - protein, 6 aa, Plasmodium falciparum
QQNHNP

SEQ ID NO: 3340414 - protein, 4 aa, Plasmodium falciparum
QQNI

SEQ ID NO: 3340415 - protein, 8 aa, Plasmodium falciparum
QQNKEDQD

SEQ ID NO: 3340416 - protein, 11 aa, Plasmodium falciparum
QQNKINNSTEN

SEQ ID NO: 3340417 - protein, 6 aa, Plasmodium falciparum
QQNNNI

SEQ ID NO: 3340418 - protein, 24 aa, Plasmodium falciparum
QQNNTYNKNDHSDDNNKNKGKTTL

SEQ ID NO: 3340419 - protein, 7 aa, Plasmodium falciparum
QQNNYNN

SEQ ID NO: 3340420 - protein, 7 aa, Plasmodium falciparum
QQNQESK

SEQ ID NO: 3340421 - protein, 12 aa, Plasmodium falciparum
QQNRENGNISRS

SEQ ID NO: 3340422 - protein, 4 aa, Plasmodium falciparum
QQNV

SEQ ID NO: 3340423 - protein, 23 aa, Plasmodium falciparum
QQQEDLNKEKENIEKEKEQIEKR

SEQ ID NO: 3340424 - protein, 4 aa, Plasmodium falciparum
QQQK

SEQ ID NO: 3340425 - protein, 13 aa, Plasmodium falciparum
QQQKRKSQDNKAV

SEQ ID NO: 3340426 - protein, 5 aa, Plasmodium falciparum
QQQNN

SEQ ID NO: 3340427 - protein, 8 aa, Plasmodium falciparum
QQQNNESY

SEQ ID NO: 3340428 - protein, 11 aa, Plasmodium falciparum
QQQNVQPKQRQ

SEQ ID NO: 3340429 - protein, 14 aa, Plasmodium falciparum
QQQQQQQQQQQTHH

SEQ ID NO: 3340430 - protein, 15 aa, Plasmodium falciparum
QQQTTTYLNSSKNNI

SEQ ID NO: 3340431 - protein, 32 aa, Plasmodium falciparum
QQRARKSKGTSRKNERENYYNDGDNDDDDDIS

SEQ ID NO: 3340432 - protein, 73 aa, Plasmodium falciparum
QQRDNDVNEEEEEEEEEEEEEEEEEEEEEEEEEEEEEDEDDDDDDDDDDDDDDDDDDDDYDDDDEYDEDDFNE

SEQ ID NO: 3340433 - protein, 6 aa, Plasmodium falciparum
QQREKE

SEQ ID NO: 3340434 - protein, 7 aa, Plasmodium falciparum
QQRINDK

SEQ ID NO: 3340435 - protein, 7 aa, Plasmodium falciparum
QQRKERE

SEQ ID NO: 3340436 - protein, 24 aa, Plasmodium falciparum
QQRKEREIKSEIKNEKEKDGIKQE

SEQ ID NO: 3340437 - protein, 13 aa, Plasmodium falciparum
QQRLAEKQEDEKR

SEQ ID NO: 3340438 - protein, 13 aa, Plasmodium falciparum
QQRNGRKSVTTVQ

SEQ ID NO: 3340439 - protein, 9 aa, Plasmodium falciparum
QQSDNSKEH

SEQ ID NO: 3340440 - protein, 7 aa, Plasmodium falciparum
QQSDSQF

SEQ ID NO: 3340441 - protein, 9 aa, Plasmodium falciparum
QQSGAGNNW

SEQ ID NO: 3340442 - protein, 7 aa, Plasmodium falciparum
QQSGDKE

SEQ ID NO: 3340443 - protein, 28 aa, Plasmodium falciparum
QQSLDDNAKISHPVSNDEARNNSIYEPT

SEQ ID NO: 3340444 - protein, 6 aa, Plasmodium falciparum
QQSNEL

SEQ ID NO: 3340445 - protein, 6 aa, Plasmodium falciparum
QQTEEP

SEQ ID NO: 3340446 - protein, 14 aa, Plasmodium falciparum
QQTIESNQNNNNMY

SEQ ID NO: 3340447 - protein, 5 aa, Plasmodium falciparum
QQTIN

SEQ ID NO: 3340448 - protein, 49 aa, Plasmodium falciparum
QQTKGNIKKKKKNDEQEEEEKEKEEEKEKEEEKEKEKEKVEEKEKEKVE

SEQ ID NO: 3340449 - protein, 6 aa, Plasmodium falciparum
QQTKHT

SEQ ID NO: 3340450 - protein, 7 aa, Plasmodium falciparum
QQTPGGH

SEQ ID NO: 3340451 - protein, 5 aa, Plasmodium falciparum
QQTVN

SEQ ID NO: 3340452 - protein, 4 aa, Plasmodium falciparum
QQVN

SEQ ID NO: 3340453 - protein, 8 aa, Plasmodium falciparum
QQYEQNDI

SEQ ID NO: 3340454 - protein, 10 aa, Plasmodium falciparum
QQYESNPEKI

SEQ ID NO: 3340455 - protein, 11 aa, Plasmodium falciparum
QRAQPGYDPNT

SEQ ID NO: 3340456 - protein, 13 aa, Plasmodium falciparum
QRDADEADVETSF

SEQ ID NO: 3340457 - protein, 11 aa, Plasmodium falciparum
QRDANGRNKGY

SEQ ID NO: 3340458 - protein, 13 aa, Plasmodium falciparum
QRDCKNEKKEEIN

SEQ ID NO: 3340459 - protein, 13 aa, Plasmodium falciparum
QRDEKEKKNHNEN

SEQ ID NO: 3340460 - protein, 10 aa, Plasmodium falciparum
QRDKKDFSEH

SEQ ID NO: 3340461 - protein, 9 aa, Plasmodium falciparum
QRDNGNYVT

SEQ ID NO: 3340462 - protein, 8 aa, Plasmodium falciparum
QRDNKYSD

SEQ ID NO: 3340463 - protein, 5 aa, Plasmodium falciparum
QRECQ

SEQ ID NO: 3340464 - protein, 20 aa, Plasmodium falciparum
QREEKKKKGQYLNNSTNVNT

SEQ ID NO: 3340465 - protein, 5 aa, Plasmodium falciparum
QREET

SEQ ID NO: 3340466 - protein, 6 aa, Plasmodium falciparum
QREHDS

SEQ ID NO: 3340467 - protein, 13 aa, Plasmodium falciparum
QREKDEQVQKKED

SEQ ID NO: 3340468 - protein, 11 aa, Plasmodium falciparum
QREKKKRYAQI

SEQ ID NO: 3340469 - protein, 4 aa, Plasmodium falciparum
QREM

SEQ ID NO: 3340470 - protein, 8 aa, Plasmodium falciparum
QRENEKKE

SEQ ID NO: 3340471 - protein, 8 aa, Plasmodium falciparum
QRGCGPNA

SEQ ID NO: 3340472 - protein, 17 aa, Plasmodium falciparum
QRGEENNNNTTKNNKDN

SEQ ID NO: 3340473 - protein, 6 aa, Plasmodium falciparum
QRGTRL

SEQ ID NO: 3340474 - protein, 12 aa, Plasmodium falciparum
QRINENNSISKK

SEQ ID NO: 3340475 - protein, 9 aa, Plasmodium falciparum
QRKCEESKT

SEQ ID NO: 3340476 - protein, 6 aa, Plasmodium falciparum
QRKEDS

SEQ ID NO: 3340477 - protein, 8 aa, Plasmodium falciparum
QRKEGMTR

SEQ ID NO: 3340478 - protein, 12 aa, Plasmodium falciparum
QRKGEGKSYSYK

SEQ ID NO: 3340479 - protein, 11 aa, Plasmodium falciparum
QRKKDEAKEEL

SEQ ID NO: 3340480 - protein, 8 aa, Plasmodium falciparum
QRKKEEEK

SEQ ID NO: 3340481 - protein, 22 aa, Plasmodium falciparum
QRKKYEKEYNEISKEKDIEEKK

SEQ ID NO: 3340482 - protein, 5 aa, Plasmodium falciparum
QRKNN

SEQ ID NO: 3340483 - protein, 9 aa, Plasmodium falciparum
QRKNRGKNM

SEQ ID NO: 3340484 - protein, 4 aa, Plasmodium falciparum
QRKS

SEQ ID NO: 3340485 - protein, 18 aa, Plasmodium falciparum
QRMEKEKRMSKNKKSSDW

SEQ ID NO: 3340486 - protein, 5 aa, Plasmodium falciparum
QRNDY

SEQ ID NO: 3340487 - protein, 8 aa, Plasmodium falciparum
QRNEENER

SEQ ID NO: 3340488 - protein, 13 aa, Plasmodium falciparum
QRNEQNVENKTNV

SEQ ID NO: 3340489 - protein, 26 aa, Plasmodium falciparum
QRNESRSSTRSYMDEDGKSNCATSTE

SEQ ID NO: 3340490 - protein, 5 aa, Plasmodium falciparum
QRNFE

SEQ ID NO: 3340491 - protein, 11 aa, Plasmodium falciparum
QRNGSLKYDEG

SEQ ID NO: 3340492 - protein, 5 aa, Plasmodium falciparum
QRNLK

SEQ ID NO: 3340493 - protein, 7 aa, Plasmodium falciparum
QRNNDTY

SEQ ID NO: 3340494 - protein, 8 aa, Plasmodium falciparum
QRNNKNRL

SEQ ID NO: 3340495 - protein, 8 aa, Plasmodium falciparum
QRNNNNYI

SEQ ID NO: 3340496 - protein, 8 aa, Plasmodium falciparum
QRNNTNVY

SEQ ID NO: 3340497 - protein, 7 aa, Plasmodium falciparum
QRNPSTN

SEQ ID NO: 3340498 - protein, 6 aa, Plasmodium falciparum
QRNQHE

SEQ ID NO: 3340499 - protein, 7 aa, Plasmodium falciparum
QRNRRKV

SEQ ID NO: 3340500 - protein, 13 aa, Plasmodium falciparum
QRNSNNSNLTNDR

SEQ ID NO: 3340501 - protein, 7 aa, Plasmodium falciparum
QRNTESL

SEQ ID NO: 3340502 - protein, 17 aa, Plasmodium falciparum
QRQEQNMEEYEDGNNTI

SEQ ID NO: 3340503 - protein, 5 aa, Plasmodium falciparum
QRQGD

SEQ ID NO: 3340504 - protein, 11 aa, Plasmodium falciparum
QRQQNNESHNT

SEQ ID NO: 3340505 - protein, 6 aa, Plasmodium falciparum
QRQTNQ

SEQ ID NO: 3340506 - protein, 5 aa, Plasmodium falciparum
QRRAI

SEQ ID NO: 3340507 - protein, 5 aa, Plasmodium falciparum
QRRTS

SEQ ID NO: 3340508 - protein, 6 aa, Plasmodium falciparum
QRSEAY

SEQ ID NO: 3340509 - protein, 5 aa, Plasmodium falciparum
QRSNI

SEQ ID NO: 3340510 - protein, 14 aa, Plasmodium falciparum
QRTDGWKPYPEVSD

SEQ ID NO: 3340511 - protein, 16 aa, Plasmodium falciparum
QRTKQKKKHNHEKSRN

SEQ ID NO: 3340512 - protein, 6 aa, Plasmodium falciparum
QRTSEQ

SEQ ID NO: 3340513 - protein, 8 aa, Plasmodium falciparum
QRYKGSDK

SEQ ID NO: 3340514 - protein, 7 aa, Plasmodium falciparum
QRYSEKT

SEQ ID NO: 3340515 - protein, 7 aa, Plasmodium falciparum
QSAKNKI

SEQ ID NO: 3340516 - protein, 7 aa, Plasmodium falciparum
QSAKSSY

SEQ ID NO: 3340517 - protein, 37 aa, Plasmodium falciparum
QSDDEEEDEDDDEKLSTDDSDENISAKDIKDEKIQQY

SEQ ID NO: 3340518 - protein, 9 aa, Plasmodium falciparum
QSDDNKNKH

SEQ ID NO: 3340519 - protein, 12 aa, Plasmodium falciparum
QSDENNLDTTEY

SEQ ID NO: 3340520 - protein, 7 aa, Plasmodium falciparum
QSDGSGI

SEQ ID NO: 3340521 - protein, 5 aa, Plasmodium falciparum
QSDIY

SEQ ID NO: 3340522 - protein, 6 aa, Plasmodium falciparum
QSDKSD

SEQ ID NO: 3340523 - protein, 5 aa, Plasmodium falciparum
QSDQD

SEQ ID NO: 3340524 - protein, 5 aa, Plasmodium falciparum
QSDSS

SEQ ID NO: 3340525 - protein, 12 aa, Plasmodium falciparum
QSDTKKNNMNDH

SEQ ID NO: 3340526 - protein, 8 aa, Plasmodium falciparum
QSDTMNES

SEQ ID NO: 3340527 - protein, 5 aa, Plasmodium falciparum
QSEAK

SEQ ID NO: 3340528 - protein, 8 aa, Plasmodium falciparum
QSEDLDND

SEQ ID NO: 3340529 - protein, 31 aa, Plasmodium falciparum
QSEDLNNDPMNQQDYDKKYTYSKEKSESNIS

SEQ ID NO: 3340530 - protein, 6 aa, Plasmodium falciparum
QSEDME

SEQ ID NO: 3340531 - protein, 14 aa, Plasmodium falciparum
QSEDTSRNDSNPLY

SEQ ID NO: 3340532 - protein, 18 aa, Plasmodium falciparum
QSEEAGEKGDLNKATSFN

SEQ ID NO: 3340533 - protein, 9 aa, Plasmodium falciparum
QSEGERESE

SEQ ID NO: 3340534 - protein, 4 aa, Plasmodium falciparum
QSEK

SEQ ID NO: 3340535 - protein, 17 aa, Plasmodium falciparum
QSELQNKNIEDYSQDHE

SEQ ID NO: 3340536 - protein, 15 aa, Plasmodium falciparum
QSELSKRSSVRRSED

SEQ ID NO: 3340537 - protein, 5 aa, Plasmodium falciparum
QSELT

SEQ ID NO: 3340538 - protein, 17 aa, Plasmodium falciparum
QSENKTIQNNEKKKENN

SEQ ID NO: 3340539 - protein, 17 aa, Plasmodium falciparum
QSERKEGKKNKRATHKI

SEQ ID NO: 3340540 - protein, 5 aa, Plasmodium falciparum
QSERR

SEQ ID NO: 3340541 - protein, 9 aa, Plasmodium falciparum
QSESNSELN

SEQ ID NO: 3340542 - protein, 8 aa, Plasmodium falciparum
QSETENES

SEQ ID NO: 3340543 - protein, 6 aa, Plasmodium falciparum
QSFENT

SEQ ID NO: 3340544 - protein, 4 aa, Plasmodium falciparum
QSFQ

SEQ ID NO: 3340545 - protein, 12 aa, Plasmodium falciparum
QSFSPLEKKGKY

SEQ ID NO: 3340546 - protein, 23 aa, Plasmodium falciparum
QSFTDDDQPYISNSHDKEKNQEC

SEQ ID NO: 3340547 - protein, 5 aa, Plasmodium falciparum
QSGDV

SEQ ID NO: 3340548 - protein, 8 aa, Plasmodium falciparum
QSGENQYT

SEQ ID NO: 3340549 - protein, 4 aa, Plasmodium falciparum
QSGL

SEQ ID NO: 3340550 - protein, 5 aa, Plasmodium falciparum
QSGNN

SEQ ID NO: 3340551 - protein, 7 aa, Plasmodium falciparum
QSGNSVS

SEQ ID NO: 3340552 - protein, 9 aa, Plasmodium falciparum
QSHGLSDGF

SEQ ID NO: 3340553 - protein, 12 aa, Plasmodium falciparum
QSHGLSEASRNE

SEQ ID NO: 3340554 - protein, 12 aa, Plasmodium falciparum
QSHGLSEGSRNQ

SEQ ID NO: 3340555 - protein, 134 aa, Plasmodium falciparum
QSHRGINNKKYNDNNEVDNNEVDNNEVDNNEVDNNEVDNNEVDNNEVDNNEVDNNEVDNNEVDNNEVDNNEEHNNEEHNNEEHNNEEDNNEEDNNEEHNNEEDNNEEHNNEEDNNEEDNNEEHNNEKDNNSYNK

SEQ ID NO: 3340556 - protein, 27 aa, Plasmodium falciparum
QSIADNNNNNNNNNNNINNTQSGTEQR

SEQ ID NO: 3340557 - protein, 71 aa, Plasmodium falciparum
QSIEDQSTNDQSIEDQSTNDQSIEDQSTNDQSIEDQSTNDQSINEQSTNDQPPNEQPPNEQPPNEESTEDQ

SEQ ID NO: 3340558 - protein, 6 aa, Plasmodium falciparum
QSIEKK

SEQ ID NO: 3340559 - protein, 9 aa, Plasmodium falciparum
QSIGEPATQ

SEQ ID NO: 3340560 - protein, 7 aa, Plasmodium falciparum
QSINEYN

SEQ ID NO: 3340561 - protein, 24 aa, Plasmodium falciparum
QSINKLSKNEQTTQTDINRNTSRM

SEQ ID NO: 3340562 - protein, 9 aa, Plasmodium falciparum
QSINNGTYT

SEQ ID NO: 3340563 - protein, 4 aa, Plasmodium falciparum
QSIY

SEQ ID NO: 3340564 - protein, 4 aa, Plasmodium falciparum
QSKA

SEQ ID NO: 3340565 - protein, 29 aa, Plasmodium falciparum
QSKCTNGNYKSPLSHEKNEDDYPETKDSY

SEQ ID NO: 3340566 - protein, 9 aa, Plasmodium falciparum
QSKDAERLQ

SEQ ID NO: 3340567 - protein, 17 aa, Plasmodium falciparum
QSKDNIRRYTSGSKEGK

SEQ ID NO: 3340568 - protein, 14 aa, Plasmodium falciparum
QSKEDNDGNNGEDI

SEQ ID NO: 3340569 - protein, 14 aa, Plasmodium falciparum
QSKENYYETNKYPN

SEQ ID NO: 3340570 - protein, 9 aa, Plasmodium falciparum
QSKEQNNVK

SEQ ID NO: 3340571 - protein, 5 aa, Plasmodium falciparum
QSKGG

SEQ ID NO: 3340572 - protein, 21 aa, Plasmodium falciparum
QSKGKDNENATSRNNTNDNMN

SEQ ID NO: 3340573 - protein, 41 aa, Plasmodium falciparum
QSKHNANEKTSNMKNNNKLYEEEDVEDEVADDNKTDNENNY

SEQ ID NO: 3340574 - protein, 13 aa, Plasmodium falciparum
QSKKLKKKQCCSI

SEQ ID NO: 3340575 - protein, 14 aa, Plasmodium falciparum
QSKMDDKKKIKKKN

SEQ ID NO: 3340576 - protein, 8 aa, Plasmodium falciparum
QSKNKKRN

SEQ ID NO: 3340577 - protein, 7 aa, Plasmodium falciparum
QSKNNIG

SEQ ID NO: 3340578 - protein, 9 aa, Plasmodium falciparum
QSKNQDNNI

SEQ ID NO: 3340579 - protein, 7 aa, Plasmodium falciparum
QSKPLKK

SEQ ID NO: 3340580 - protein, 17 aa, Plasmodium falciparum
QSKQQNKQQHQRQGGKG

SEQ ID NO: 3340581 - protein, 9 aa, Plasmodium falciparum
QSKSQDRKE

SEQ ID NO: 3340582 - protein, 7 aa, Plasmodium falciparum
QSLPPKR

SEQ ID NO: 3340583 - protein, 10 aa, Plasmodium falciparum
QSMGKTNDHT

SEQ ID NO: 3340584 - protein, 5 aa, Plasmodium falciparum
QSMTS

SEQ ID NO: 3340585 - protein, 9 aa, Plasmodium falciparum
QSNAQQVDH

SEQ ID NO: 3340586 - protein, 6 aa, Plasmodium falciparum
QSNDVY

SEQ ID NO: 3340587 - protein, 7 aa, Plasmodium falciparum
QSNDYDV

SEQ ID NO: 3340588 - protein, 15 aa, Plasmodium falciparum
QSNEEKKKFQSHGYK

SEQ ID NO: 3340589 - protein, 22 aa, Plasmodium falciparum
QSNHSNKSDWSIKKSNNNNNNQ

SEQ ID NO: 3340590 - protein, 9 aa, Plasmodium falciparum
QSNINTENT

SEQ ID NO: 3340591 - protein, 15 aa, Plasmodium falciparum
QSNKKNFDKARKGDE

SEQ ID NO: 3340592 - protein, 15 aa, Plasmodium falciparum
QSNKNEKVKELIKRF

SEQ ID NO: 3340593 - protein, 10 aa, Plasmodium falciparum
QSNKYENNND

SEQ ID NO: 3340594 - protein, 7 aa, Plasmodium falciparum
QSNMKEN

SEQ ID NO: 3340595 - protein, 6 aa, Plasmodium falciparum
QSNNKN

SEQ ID NO: 3340596 - protein, 7 aa, Plasmodium falciparum
QSNNSNL

SEQ ID NO: 3340597 - protein, 6 aa, Plasmodium falciparum
QSNQEQ

SEQ ID NO: 3340598 - protein, 7 aa, Plasmodium falciparum
QSNRKKK

SEQ ID NO: 3340599 - protein, 9 aa, Plasmodium falciparum
QSNRNSNIS

SEQ ID NO: 3340600 - protein, 8 aa, Plasmodium falciparum
QSNSKYEN

SEQ ID NO: 3340601 - protein, 8 aa, Plasmodium falciparum
QSNSNFPF

SEQ ID NO: 3340602 - protein, 11 aa, Plasmodium falciparum
QSNSNKYDKNN

SEQ ID NO: 3340603 - protein, 11 aa, Plasmodium falciparum
QSNSSSQNENY

SEQ ID NO: 3340604 - protein, 15 aa, Plasmodium falciparum
QSNTYDNKNYPCDQT

SEQ ID NO: 3340605 - protein, 5 aa, Plasmodium falciparum
QSNYL

SEQ ID NO: 3340606 - protein, 5 aa, Plasmodium falciparum
QSPDD

SEQ ID NO: 3340607 - protein, 22 aa, Plasmodium falciparum
QSPERSAVHNNNNNNNNNNSNN

SEQ ID NO: 3340608 - protein, 5 aa, Plasmodium falciparum
QSPHV

SEQ ID NO: 3340609 - protein, 5 aa, Plasmodium falciparum
QSPIR

SEQ ID NO: 3340610 - protein, 15 aa, Plasmodium falciparum
QSPKHIKAKNDDNYM

SEQ ID NO: 3340611 - protein, 15 aa, Plasmodium falciparum
QSPKKLTNNKHTNSY

SEQ ID NO: 3340612 - protein, 9 aa, Plasmodium falciparum
QSPQEYGES

SEQ ID NO: 3340613 - protein, 5 aa, Plasmodium falciparum
QSPQY

SEQ ID NO: 3340614 - protein, 26 aa, Plasmodium falciparum
QSPRLKNDKTYNNSNNNNNNNNNNSS

SEQ ID NO: 3340615 - protein, 6 aa, Plasmodium falciparum
QSPYST

SEQ ID NO: 3340616 - protein, 7 aa, Plasmodium falciparum
QSQDKMS

SEQ ID NO: 3340617 - protein, 10 aa, Plasmodium falciparum
QSQDKNDKLS

SEQ ID NO: 3340618 - protein, 4 aa, Plasmodium falciparum
QSQE

SEQ ID NO: 3340619 - protein, 10 aa, Plasmodium falciparum
QSQKIDSYND

SEQ ID NO: 3340620 - protein, 4 aa, Plasmodium falciparum
QSQN

SEQ ID NO: 3340621 - protein, 13 aa, Plasmodium falciparum
QSQNYKDAKKQER

SEQ ID NO: 3340622 - protein, 9 aa, Plasmodium falciparum
QSQPNPALK

SEQ ID NO: 3340623 - protein, 10 aa, Plasmodium falciparum
QSRDAKTAAE

SEQ ID NO: 3340624 - protein, 5 aa, Plasmodium falciparum
QSRIH

SEQ ID NO: 3340625 - protein, 10 aa, Plasmodium falciparum
QSRNSSDQNI

SEQ ID NO: 3340626 - protein, 28 aa, Plasmodium falciparum
QSRSGVTSIATSRKTQNRDSNKASENSI

SEQ ID NO: 3340627 - protein, 6 aa, Plasmodium falciparum
QSRTTN

SEQ ID NO: 3340628 - protein, 4 aa, Plasmodium falciparum
QSSD

SEQ ID NO: 3340629 - protein, 17 aa, Plasmodium falciparum
QSSDESDEIEKGTSKKS

SEQ ID NO: 3340630 - protein, 14 aa, Plasmodium falciparum
QSSDSHSTCSYESE

SEQ ID NO: 3340631 - protein, 10 aa, Plasmodium falciparum
QSSEEWEPQN

SEQ ID NO: 3340632 - protein, 9 aa, Plasmodium falciparum
QSSKKKNKI

SEQ ID NO: 3340633 - protein, 25 aa, Plasmodium falciparum
QSSNNIDNNEVTEDNYKSDINNNKN

SEQ ID NO: 3340634 - protein, 78 aa, Plasmodium falciparum
QSSQELNYNKQNKKGEKNEEGDENNKGDENEEGDKNKEGDENNKGGENNKGDENNKGDKNKVGDKKNIRNDKNADTDF

SEQ ID NO: 3340635 - protein, 5 aa, Plasmodium falciparum
QSSQM

SEQ ID NO: 3340636 - protein, 9 aa, Plasmodium falciparum
QSSRSKGLA

SEQ ID NO: 3340637 - protein, 9 aa, Plasmodium falciparum
QSSSSMKRE

SEQ ID NO: 3340638 - protein, 11 aa, Plasmodium falciparum
QSSTESSYNSL

SEQ ID NO: 3340639 - protein, 6 aa, Plasmodium falciparum
QSSTPL

SEQ ID NO: 3340640 - protein, 15 aa, Plasmodium falciparum
QSSVKSQNNASGENF

SEQ ID NO: 3340641 - protein, 4 aa, Plasmodium falciparum
QSSY

SEQ ID NO: 3340642 - protein, 7 aa, Plasmodium falciparum
QSTASNG

SEQ ID NO: 3340643 - protein, 5 aa, Plasmodium falciparum
QSTEY

SEQ ID NO: 3340644 - protein, 4 aa, Plasmodium falciparum
QSTK

SEQ ID NO: 3340645 - protein, 95 aa, Plasmodium falciparum
QSTKTQQHKVKQQDNVEQQDNVKQQDNVKQQDNVKQQDNVEQQDNVKQQDNVKQQDNVKQQDNVKQQDNVKQQDNVKQQDNVKQQDEEQNNDDIN

SEQ ID NO: 3340646 - protein, 15 aa, Plasmodium falciparum
QSTLRNESKEEINSI

SEQ ID NO: 3340647 - protein, 9 aa, Plasmodium falciparum
QSTNEARTI

SEQ ID NO: 3340648 - protein, 9 aa, Plasmodium falciparum
QSTNNTTYP

SEQ ID NO: 3340649 - protein, 13 aa, Plasmodium falciparum
QSTQKTNNVHEQD

SEQ ID NO: 3340650 - protein, 12 aa, Plasmodium falciparum
QSTSNKSLNGAY

SEQ ID NO: 3340651 - protein, 4 aa, Plasmodium falciparum
QSTV

SEQ ID NO: 3340652 - protein, 5 aa, Plasmodium falciparum
QSTVG

SEQ ID NO: 3340653 - protein, 31 aa, Plasmodium falciparum
QSTYSYDKRERKKYTNRDRDKRRDTKSSSIS

SEQ ID NO: 3340654 - protein, 6 aa, Plasmodium falciparum
QSVGKT

SEQ ID NO: 3340655 - protein, 4 aa, Plasmodium falciparum
QSVI

SEQ ID NO: 3340656 - protein, 10 aa, Plasmodium falciparum
QSVKQTMNQS

SEQ ID NO: 3340657 - protein, 5 aa, Plasmodium falciparum
QSVNF

SEQ ID NO: 3340658 - protein, 26 aa, Plasmodium falciparum
QSVQNGLSKDNNNNNNNNNDNIINND

SEQ ID NO: 3340659 - protein, 9 aa, Plasmodium falciparum
QSVTEPLDT

SEQ ID NO: 3340660 - protein, 6 aa, Plasmodium falciparum
QSVTKG

SEQ ID NO: 3340661 - protein, 22 aa, Plasmodium falciparum
QSYDADNIDNEKNHKKELSRKN

SEQ ID NO: 3340662 - protein, 9 aa, Plasmodium falciparum
QSYDTQSIP

SEQ ID NO: 3340663 - protein, 5 aa, Plasmodium falciparum
QSYID

SEQ ID NO: 3340664 - protein, 8 aa, Plasmodium falciparum
QSYNGSKG

SEQ ID NO: 3340665 - protein, 7 aa, Plasmodium falciparum
QSYSDIT

SEQ ID NO: 3340666 - protein, 9 aa, Plasmodium falciparum
QSYTKNDDS

SEQ ID NO: 3340667 - protein, 6 aa, Plasmodium falciparum
QTAITK

SEQ ID NO: 3340668 - protein, 10 aa, Plasmodium falciparum
QTAPKLKGRI

SEQ ID NO: 3340669 - protein, 5 aa, Plasmodium falciparum
QTDEN

SEQ ID NO: 3340670 - protein, 4 aa, Plasmodium falciparum
QTDI

SEQ ID NO: 3340671 - protein, 5 aa, Plasmodium falciparum
QTDLE

SEQ ID NO: 3340672 - protein, 6 aa, Plasmodium falciparum
QTDNGR

SEQ ID NO: 3340673 - protein, 4 aa, Plasmodium falciparum
QTEE

SEQ ID NO: 3340674 - protein, 7 aa, Plasmodium falciparum
QTEEARA

SEQ ID NO: 3340675 - protein, 7 aa, Plasmodium falciparum
QTEEQIN

SEQ ID NO: 3340676 - protein, 4 aa, Plasmodium falciparum
QTEI

SEQ ID NO: 3340677 - protein, 7 aa, Plasmodium falciparum
QTEKDNQ

SEQ ID NO: 3340678 - protein, 8 aa, Plasmodium falciparum
QTEKNNLQ

SEQ ID NO: 3340679 - protein, 6 aa, Plasmodium falciparum
QTENTF

SEQ ID NO: 3340680 - protein, 7 aa, Plasmodium falciparum
QTEQTNT

SEQ ID NO: 3340681 - protein, 13 aa, Plasmodium falciparum
QTETEDKKKKAEI

SEQ ID NO: 3340682 - protein, 5 aa, Plasmodium falciparum
QTFNN

SEQ ID NO: 3340683 - protein, 33 aa, Plasmodium falciparum
QTGDTNTKNSYRHNNNNNNNNSNNSNNNNNQYD

SEQ ID NO: 3340684 - protein, 5 aa, Plasmodium falciparum
QTGEA

SEQ ID NO: 3340685 - protein, 7 aa, Plasmodium falciparum
QTGLGRT

SEQ ID NO: 3340686 - protein, 5 aa, Plasmodium falciparum
QTGNE

SEQ ID NO: 3340687 - protein, 6 aa, Plasmodium falciparum
QTGSGK

SEQ ID NO: 3340688 - protein, 7 aa, Plasmodium falciparum
QTGSGKT

SEQ ID NO: 3340689 - protein, 9 aa, Plasmodium falciparum
QTGSGKTAG

SEQ ID NO: 3340690 - protein, 8 aa, Plasmodium falciparum
QTGSGKTH

SEQ ID NO: 3340691 - protein, 6 aa, Plasmodium falciparum
QTGSSI

SEQ ID NO: 3340692 - protein, 9 aa, Plasmodium falciparum
QTGTGKTYT

SEQ ID NO: 3340693 - protein, 6 aa, Plasmodium falciparum
QTGVDE

SEQ ID NO: 3340694 - protein, 9 aa, Plasmodium falciparum
QTHNYQNNN

SEQ ID NO: 3340695 - protein, 9 aa, Plasmodium falciparum
QTIEENKNV

SEQ ID NO: 3340696 - protein, 5 aa, Plasmodium falciparum
QTIEQ

SEQ ID NO: 3340697 - protein, 4 aa, Plasmodium falciparum
QTII

SEQ ID NO: 3340698 - protein, 23 aa, Plasmodium falciparum
QTIKKGESYIKSSNTNKEPPKSI

SEQ ID NO: 3340699 - protein, 7 aa, Plasmodium falciparum
QTINKES

SEQ ID NO: 3340700 - protein, 6 aa, Plasmodium falciparum
QTKDKN

SEQ ID NO: 3340701 - protein, 4 aa, Plasmodium falciparum
QTKH

SEQ ID NO: 3340702 - protein, 9 aa, Plasmodium falciparum
QTKKTNKNT

SEQ ID NO: 3340703 - protein, 41 aa, Plasmodium falciparum
QTKSQNDDFSYEDEEEMNRNNKKNTRSSVSESEGQHSEKEF

SEQ ID NO: 3340704 - protein, 9 aa, Plasmodium falciparum
QTKSYNDHT

SEQ ID NO: 3340705 - protein, 5 aa, Plasmodium falciparum
QTKWN

SEQ ID NO: 3340706 - protein, 37 aa, Plasmodium falciparum
QTKYEPKKERRKRRSLNTSTISDANNTDLGKNSKRNI

SEQ ID NO: 3340707 - protein, 4 aa, Plasmodium falciparum
QTND

SEQ ID NO: 3340708 - protein, 6 aa, Plasmodium falciparum
QTNDLE

SEQ ID NO: 3340709 - protein, 10 aa, Plasmodium falciparum
QTNDNKESDI

SEQ ID NO: 3340710 - protein, 33 aa, Plasmodium falciparum
QTNDQGERQDERNIDHEDEPVSSNTEDDHEEND

SEQ ID NO: 3340711 - protein, 7 aa, Plasmodium falciparum
QTNENIK

SEQ ID NO: 3340712 - protein, 14 aa, Plasmodium falciparum
QTNESEDIRKNNDN

SEQ ID NO: 3340713 - protein, 6 aa, Plasmodium falciparum
QTNGVN

SEQ ID NO: 3340714 - protein, 9 aa, Plasmodium falciparum
QTNINSSKY

SEQ ID NO: 3340715 - protein, 4 aa, Plasmodium falciparum
QTNK

SEQ ID NO: 3340716 - protein, 10 aa, Plasmodium falciparum
QTNKTAKDLK

SEQ ID NO: 3340717 - protein, 9 aa, Plasmodium falciparum
QTNKTQENN

SEQ ID NO: 3340718 - protein, 21 aa, Plasmodium falciparum
QTNNDNMKRENNNMNNYGYDD

SEQ ID NO: 3340719 - protein, 36 aa, Plasmodium falciparum
QTNNDNNNNNNNNNNNNDNNNDNNNDNSYNNKSDNM

SEQ ID NO: 3340720 - protein, 11 aa, Plasmodium falciparum
QTNNKDDNIKI

SEQ ID NO: 3340721 - protein, 8 aa, Plasmodium falciparum
QTNNTQLS

SEQ ID NO: 3340722 - protein, 28 aa, Plasmodium falciparum
QTNQMNQTNQMNQTNQMNQTNQMNQTNQ

SEQ ID NO: 3340723 - protein, 21 aa, Plasmodium falciparum
QTNTEEDTNNSEELPSLSSEE

SEQ ID NO: 3340724 - protein, 15 aa, Plasmodium falciparum
QTNTETTNDKKKNIC

SEQ ID NO: 3340725 - protein, 7 aa, Plasmodium falciparum
QTNTSIS

SEQ ID NO: 3340726 - protein, 5 aa, Plasmodium falciparum
QTNYD

SEQ ID NO: 3340727 - protein, 10 aa, Plasmodium falciparum
QTPGKFYPEK

SEQ ID NO: 3340728 - protein, 5 aa, Plasmodium falciparum
QTPHL

SEQ ID NO: 3340729 - protein, 10 aa, Plasmodium falciparum
QTPKKPNSGL

SEQ ID NO: 3340730 - protein, 11 aa, Plasmodium falciparum
QTPKKSNVGSY

SEQ ID NO: 3340731 - protein, 35 aa, Plasmodium falciparum
QTPNTHQNNNSNNSNNGNNSNNNNNNGYNNSQGLY

SEQ ID NO: 3340732 - protein, 7 aa, Plasmodium falciparum
QTPPGLQ

SEQ ID NO: 3340733 - protein, 4 aa, Plasmodium falciparum
QTQN

SEQ ID NO: 3340734 - protein, 6 aa, Plasmodium falciparum
QTQNFN

SEQ ID NO: 3340735 - protein, 10 aa, Plasmodium falciparum
QTQNNINTQE

SEQ ID NO: 3340736 - protein, 7 aa, Plasmodium falciparum
QTQPTNL

SEQ ID NO: 3340737 - protein, 7 aa, Plasmodium falciparum
QTQPTNT

SEQ ID NO: 3340738 - protein, 7 aa, Plasmodium falciparum
QTQTGNY

SEQ ID NO: 3340739 - protein, 13 aa, Plasmodium falciparum
QTRKDEQKDITGR

SEQ ID NO: 3340740 - protein, 7 aa, Plasmodium falciparum
QTRKENT

SEQ ID NO: 3340741 - protein, 5 aa, Plasmodium falciparum
QTSAN

SEQ ID NO: 3340742 - protein, 19 aa, Plasmodium falciparum
QTSCNDKDDDNLESEKKTF

SEQ ID NO: 3340743 - protein, 9 aa, Plasmodium falciparum
QTSDYNNVD

SEQ ID NO: 3340744 - protein, 7 aa, Plasmodium falciparum
QTSGGKV

SEQ ID NO: 3340745 - protein, 7 aa, Plasmodium falciparum
QTSKKKV

SEQ ID NO: 3340746 - protein, 7 aa, Plasmodium falciparum
QTSKQYE

SEQ ID NO: 3340747 - protein, 20 aa, Plasmodium falciparum
QTSNINKNNINQDDDDHNSK

SEQ ID NO: 3340748 - protein, 28 aa, Plasmodium falciparum
QTSNNNDNNDVNNNKSKPYDDEKGNVSK

SEQ ID NO: 3340749 - protein, 7 aa, Plasmodium falciparum
QTSQNGI

SEQ ID NO: 3340750 - protein, 4 aa, Plasmodium falciparum
QTST

SEQ ID NO: 3340751 - protein, 6 aa, Plasmodium falciparum
QTSTKS

SEQ ID NO: 3340752 - protein, 6 aa, Plasmodium falciparum
QTSTQF

SEQ ID NO: 3340753 - protein, 8 aa, Plasmodium falciparum
QTSTQSLK

SEQ ID NO: 3340754 - protein, 5 aa, Plasmodium falciparum
QTTAP

SEQ ID NO: 3340755 - protein, 7 aa, Plasmodium falciparum
QTTHKNT

SEQ ID NO: 3340756 - protein, 15 aa, Plasmodium falciparum
QTTNGGFNGRAEKLT

SEQ ID NO: 3340757 - protein, 29 aa, Plasmodium falciparum
QTVAGNNKKSEIKNGEKNEKSNNHNNNDN

SEQ ID NO: 3340758 - protein, 11 aa, Plasmodium falciparum
QTVMGDNTQTV

SEQ ID NO: 3340759 - protein, 6 aa, Plasmodium falciparum
QTVNTL

SEQ ID NO: 3340760 - protein, 6 aa, Plasmodium falciparum
QTVPRS

SEQ ID NO: 3340761 - protein, 6 aa, Plasmodium falciparum
QTVPTS

SEQ ID NO: 3340762 - protein, 11 aa, Plasmodium falciparum
QTYEDSQDGPP

SEQ ID NO: 3340763 - protein, 28 aa, Plasmodium falciparum
QTYNNGNNNNDDNNNNDNNNNDNNYNYE

SEQ ID NO: 3340764 - protein, 14 aa, Plasmodium falciparum
QTYNNKAKKKIYTY

SEQ ID NO: 3340765 - protein, 23 aa, Plasmodium falciparum
QTYNSPQLNHNTQSYKSISSSTN

SEQ ID NO: 3340766 - protein, 14 aa, Plasmodium falciparum
QVDNEKKLTISEQS

SEQ ID NO: 3340767 - protein, 18 aa, Plasmodium falciparum
QVDNNNNNNNNNNNLGSA

SEQ ID NO: 3340768 - protein, 8 aa, Plasmodium falciparum
QVDNNSNI

SEQ ID NO: 3340769 - protein, 8 aa, Plasmodium falciparum
QVDPSTSL

SEQ ID NO: 3340770 - protein, 4 aa, Plasmodium falciparum
QVDQ

SEQ ID NO: 3340771 - protein, 6 aa, Plasmodium falciparum
QVDQKQ

SEQ ID NO: 3340772 - protein, 6 aa, Plasmodium falciparum
QVEDPY

SEQ ID NO: 3340773 - protein, 12 aa, Plasmodium falciparum
QVEEKGKSENKS

SEQ ID NO: 3340774 - protein, 12 aa, Plasmodium falciparum
QVEEKKGEKTET

SEQ ID NO: 3340775 - protein, 8 aa, Plasmodium falciparum
QVEENNMD

SEQ ID NO: 3340776 - protein, 9 aa, Plasmodium falciparum
QVGNEKGEV

SEQ ID NO: 3340777 - protein, 12 aa, Plasmodium falciparum
QVKDVEPPPAKP

SEQ ID NO: 3340778 - protein, 5 aa, Plasmodium falciparum
QVKQE

SEQ ID NO: 3340779 - protein, 16 aa, Plasmodium falciparum
QVNESSAPASNYKGGG

SEQ ID NO: 3340780 - protein, 15 aa, Plasmodium falciparum
QVNKGKNKIDEQNDQ

SEQ ID NO: 3340781 - protein, 8 aa, Plasmodium falciparum
QVNNNAQE

SEQ ID NO: 3340782 - protein, 15 aa, Plasmodium falciparum
QVNNTSKYNEKDSVD

SEQ ID NO: 3340783 - protein, 5 aa, Plasmodium falciparum
QVNRN

SEQ ID NO: 3340784 - protein, 15 aa, Plasmodium falciparum
QVNSQNEIANNNSVQ

SEQ ID NO: 3340785 - protein, 16 aa, Plasmodium falciparum
QVPEGGAEKKDHNNNK

SEQ ID NO: 3340786 - protein, 4 aa, Plasmodium falciparum
QVQV

SEQ ID NO: 3340787 - protein, 7 aa, Plasmodium falciparum
QVRGRGG

SEQ ID NO: 3340788 - protein, 7 aa, Plasmodium falciparum
QVSEGKT

SEQ ID NO: 3340789 - protein, 16 aa, Plasmodium falciparum
QVSKNDLDEILKQKST

SEQ ID NO: 3340790 - protein, 16 aa, Plasmodium falciparum
QVSNDDNMDDDNNHYD

SEQ ID NO: 3340791 - protein, 11 aa, Plasmodium falciparum
QVTRTSDVRPE

SEQ ID NO: 3340792 - protein, 8 aa, Plasmodium falciparum
QVYSAEEQ

SEQ ID NO: 3340793 - protein, 9 aa, Plasmodium falciparum
QWDEPKYTS

SEQ ID NO: 3340794 - protein, 9 aa, Plasmodium falciparum
QWETEKQKE

SEQ ID NO: 3340795 - protein, 19 aa, Plasmodium falciparum
QWNKDNDGGDIPNDNKTLN

SEQ ID NO: 3340796 - protein, 10 aa, Plasmodium falciparum
QWNNKKDKNM

SEQ ID NO: 3340797 - protein, 6 aa, Plasmodium falciparum
QWRNEN

SEQ ID NO: 3340798 - protein, 12 aa, Plasmodium falciparum
QYAENKVRKTNA

SEQ ID NO: 3340799 - protein, 6 aa, Plasmodium falciparum
QYASSS

SEQ ID NO: 3340800 - protein, 26 aa, Plasmodium falciparum
QYDDSNKNKNKIEDKRKDNKSNNNQH

SEQ ID NO: 3340801 - protein, 11 aa, Plasmodium falciparum
QYDEKKKPLFE

SEQ ID NO: 3340802 - protein, 7 aa, Plasmodium falciparum
QYDKDNK

SEQ ID NO: 3340803 - protein, 33 aa, Plasmodium falciparum
QYDKEANDKYNNNNDDDDDKIKQTNDNKSNHEH

SEQ ID NO: 3340804 - protein, 9 aa, Plasmodium falciparum
QYDKKNNVS

SEQ ID NO: 3340805 - protein, 15 aa, Plasmodium falciparum
QYDKRSEQKNKNVQH

SEQ ID NO: 3340806 - protein, 10 aa, Plasmodium falciparum
QYDNTTNNTF

SEQ ID NO: 3340807 - protein, 5 aa, Plasmodium falciparum
QYEDQ

SEQ ID NO: 3340808 - protein, 5 aa, Plasmodium falciparum
QYEEE

SEQ ID NO: 3340809 - protein, 8 aa, Plasmodium falciparum
QYEEEENE

SEQ ID NO: 3340810 - protein, 16 aa, Plasmodium falciparum
QYEEERKKDEQNIKTE

SEQ ID NO: 3340811 - protein, 6 aa, Plasmodium falciparum
QYESDN

SEQ ID NO: 3340812 - protein, 6 aa, Plasmodium falciparum
QYGETT

SEQ ID NO: 3340813 - protein, 25 aa, Plasmodium falciparum
QYHNSREHPMTNDPYNTENRQDGNH

SEQ ID NO: 3340814 - protein, 7 aa, Plasmodium falciparum
QYKENKQ

SEQ ID NO: 3340815 - protein, 5 aa, Plasmodium falciparum
QYKES

SEQ ID NO: 3340816 - protein, 4 aa, Plasmodium falciparum
QYKN

SEQ ID NO: 3340817 - protein, 95 aa, Plasmodium falciparum
QYKTSNKSDDNKRNNNNNHFDDDNKRNNNNNHFDDDNKRNNNNNHFDDDNKRNNNNNHFDDDNKRNNNNNHFDDDNKRNNNNNHFDDDNKNKCDD

SEQ ID NO: 3340818 - protein, 7 aa, Plasmodium falciparum
QYLESEK

SEQ ID NO: 3340819 - protein, 8 aa, Plasmodium falciparum
QYNDEKQN

SEQ ID NO: 3340820 - protein, 18 aa, Plasmodium falciparum
QYNDNKKHPEHDKEDNII

SEQ ID NO: 3340821 - protein, 6 aa, Plasmodium falciparum
QYNEHN

SEQ ID NO: 3340822 - protein, 85 aa, Plasmodium falciparum
QYNENNGDEEDGDDEEDGDDEEDGDDEDDDDEEDDDDEDGDDQNDKGENIENNINDEDNKSEEINHKNNNCNNNKNNNCSNNKNT

SEQ ID NO: 3340823 - protein, 17 aa, Plasmodium falciparum
QYNHNKNNKTTKSNEIT

SEQ ID NO: 3340824 - protein, 7 aa, Plasmodium falciparum
QYNIPRN

SEQ ID NO: 3340825 - protein, 5 aa, Plasmodium falciparum
QYNNE

SEQ ID NO: 3340826 - protein, 9 aa, Plasmodium falciparum
QYNNNESEL

SEQ ID NO: 3340827 - protein, 8 aa, Plasmodium falciparum
QYNNNGKQ

SEQ ID NO: 3340828 - protein, 49 aa, Plasmodium falciparum
QYNNNNDNNNNNNNNNNNNNNNNNNNNNNNNNNNNNNNNNNNNNLKGNM

SEQ ID NO: 3340829 - protein, 7 aa, Plasmodium falciparum
QYNNTNK

SEQ ID NO: 3340830 - protein, 6 aa, Plasmodium falciparum
QYNPEQ

SEQ ID NO: 3340831 - protein, 7 aa, Plasmodium falciparum
QYNQNDP

SEQ ID NO: 3340832 - protein, 21 aa, Plasmodium falciparum
QYQDATAEEEGEFEEEEGDVE

SEQ ID NO: 3340833 - protein, 26 aa, Plasmodium falciparum
QYRRSQEKHADQKKDVDGINEKQNDF

SEQ ID NO: 3340834 - protein, 15 aa, Plasmodium falciparum
QYSDAYKKKSDESKL

SEQ ID NO: 3340835 - protein, 5 aa, Plasmodium falciparum
QYSIP

SEQ ID NO: 3340836 - protein, 10 aa, Plasmodium falciparum
QYSSYEPVKN

SEQ ID NO: 3340837 - protein, 9 aa, Plasmodium falciparum
QYTNDDEHI

SEQ ID NO: 3340838 - protein, 5 aa, Plasmodium falciparum
QYTQN

SEQ ID NO: 3340839 - protein, 18 aa, Plasmodium falciparum
QYTQNKQNKEYNDKHGDN

SEQ ID NO: 3340840 - protein, 26 aa, Plasmodium falciparum
QYTSEEYTSEEYTSEGYTNEGYTNEQ

SEQ ID NO: 3340841 - protein, 11 aa, Plasmodium falciparum
QYTSKKGNNLC

SEQ ID NO: 3340842 - protein, 23 aa, Plasmodium falciparum
QYYPSHQQQQQQHQQQQQQQQQQ

SEQ ID NO: 3340843 - protein, 5 aa, Plasmodium falciparum
RAARH

SEQ ID NO: 3340844 - protein, 14 aa, Plasmodium falciparum
RADDNQGVENEQSK

SEQ ID NO: 3340845 - protein, 201 aa, Plasmodium falciparum
RADDVDVDTNQVGGEKLEEEKLEEEKLEEEKLEEEKLEEEKLEEEKLEEEKLEEEKLEDENVEDENVEEEKLEEEKLEEEKLEEEKLEEEKLEDEKLQEENMENKQIEDEKLEDEQIENEKLEDEQIENEKLEDEQIEDEKLEDEQIEDEKLEDEQIEDEKLEDEQIEDEKLEEENMENKEIEDEKLRNEQNLSNEYNNTA

SEQ ID NO: 3340846 - protein, 6 aa, Plasmodium falciparum
RADEYE

SEQ ID NO: 3340847 - protein, 6 aa, Plasmodium falciparum
RADGPG

SEQ ID NO: 3340848 - protein, 6 aa, Plasmodium falciparum
RADTLD

SEQ ID NO: 3340849 - protein, 7 aa, Plasmodium falciparum
RAEEEDV

SEQ ID NO: 3340850 - protein, 10 aa, Plasmodium falciparum
RAESNNKETL

SEQ ID NO: 3340851 - protein, 9 aa, Plasmodium falciparum
RAGRRGLDD

SEQ ID NO: 3340852 - protein, 7 aa, Plasmodium falciparum
RAGRSKI

SEQ ID NO: 3340853 - protein, 4 aa, Plasmodium falciparum
RAGY

SEQ ID NO: 3340854 - protein, 8 aa, Plasmodium falciparum
RAHEDTRD

SEQ ID NO: 3340855 - protein, 10 aa, Plasmodium falciparum
RAKARNVYDP

SEQ ID NO: 3340856 - protein, 6 aa, Plasmodium falciparum
RAKDEH

SEQ ID NO: 3340857 - protein, 4 aa, Plasmodium falciparum
RAKE

SEQ ID NO: 3340858 - protein, 17 aa, Plasmodium falciparum
RAKEEEDQEQEQEQDAI

SEQ ID NO: 3340859 - protein, 6 aa, Plasmodium falciparum
RAKNNL

SEQ ID NO: 3340860 - protein, 13 aa, Plasmodium falciparum
RAKRTLSSSTQAT

SEQ ID NO: 3340861 - protein, 40 aa, Plasmodium falciparum
RAMERQEEMEREREREWERERERKRRKELERERRKEMERR

SEQ ID NO: 3340862 - protein, 9 aa, Plasmodium falciparum
RANDIKGEP

SEQ ID NO: 3340863 - protein, 7 aa, Plasmodium falciparum
RANEGYE

SEQ ID NO: 3340864 - protein, 6 aa, Plasmodium falciparum
RANKNI

SEQ ID NO: 3340865 - protein, 27 aa, Plasmodium falciparum
RANQQNNKAKNENTQTGGSSSSISSNS

SEQ ID NO: 3340866 - protein, 7 aa, Plasmodium falciparum
RANYGTG

SEQ ID NO: 3340867 - protein, 4 aa, Plasmodium falciparum
RAPP

SEQ ID NO: 3340868 - protein, 4 aa, Plasmodium falciparum
RAPS

SEQ ID NO: 3340869 - protein, 5 aa, Plasmodium falciparum
RAQDV

SEQ ID NO: 3340870 - protein, 13 aa, Plasmodium falciparum
RAQGPDGALSGSK

SEQ ID NO: 3340871 - protein, 5 aa, Plasmodium falciparum
RAQGT

SEQ ID NO: 3340872 - protein, 5 aa, Plasmodium falciparum
RAQNS

SEQ ID NO: 3340873 - protein, 6 aa, Plasmodium falciparum
RAQRAK

SEQ ID NO: 3340874 - protein, 21 aa, Plasmodium falciparum
RARGEEEGEEEGRGRVRKKKN

SEQ ID NO: 3340875 - protein, 5 aa, Plasmodium falciparum
RARKY

SEQ ID NO: 3340876 - protein, 6 aa, Plasmodium falciparum
RARQSK

SEQ ID NO: 3340877 - protein, 5 aa, Plasmodium falciparum
RASAH

SEQ ID NO: 3340878 - protein, 7 aa, Plasmodium falciparum
RASALTP

SEQ ID NO: 3340879 - protein, 4 aa, Plasmodium falciparum
RASM

SEQ ID NO: 3340880 - protein, 9 aa, Plasmodium falciparum
RASPGSDQT

SEQ ID NO: 3340881 - protein, 6 aa, Plasmodium falciparum
RASQAM

SEQ ID NO: 3340882 - protein, 7 aa, Plasmodium falciparum
RASYSPG

SEQ ID NO: 3340883 - protein, 7 aa, Plasmodium falciparum
RATLTQE

SEQ ID NO: 3340884 - protein, 16 aa, Plasmodium falciparum
RATTVPHDSKNKDNDK

SEQ ID NO: 3340885 - protein, 24 aa, Plasmodium falciparum
RAVATSNRNTRNSNALTSDGEETM

SEQ ID NO: 3340886 - protein, 4 aa, Plasmodium falciparum
RAWP

SEQ ID NO: 3340887 - protein, 13 aa, Plasmodium falciparum
RAWSSSESSDSGE

SEQ ID NO: 3340888 - protein, 5 aa, Plasmodium falciparum
RCASN

SEQ ID NO: 3340889 - protein, 4 aa, Plasmodium falciparum
RCED

SEQ ID NO: 3340890 - protein, 24 aa, Plasmodium falciparum
RCEEEDEKNKINENTVPMTNDEKK

SEQ ID NO: 3340891 - protein, 5 aa, Plasmodium falciparum
RCEKA

SEQ ID NO: 3340892 - protein, 4 aa, Plasmodium falciparum
RCGK

SEQ ID NO: 3340893 - protein, 26 aa, Plasmodium falciparum
RCNGIDSNVNKKRSYINENNNNNNYS

SEQ ID NO: 3340894 - protein, 13 aa, Plasmodium falciparum
RCPKTSEGKANDQ

SEQ ID NO: 3340895 - protein, 10 aa, Plasmodium falciparum
RCSSGASEQI

SEQ ID NO: 3340896 - protein, 7 aa, Plasmodium falciparum
RCSSGQK

SEQ ID NO: 3340897 - protein, 7 aa, Plasmodium falciparum
RDAEKTT

SEQ ID NO: 3340898 - protein, 6 aa, Plasmodium falciparum
RDAERM

SEQ ID NO: 3340899 - protein, 28 aa, Plasmodium falciparum
RDDDSNDMDEDNIKDDNNSNSNSHNNNN

SEQ ID NO: 3340900 - protein, 10 aa, Plasmodium falciparum
RDDEEKMING

SEQ ID NO: 3340901 - protein, 17 aa, Plasmodium falciparum
RDDEYEENENVNGERTS

SEQ ID NO: 3340902 - protein, 7 aa, Plasmodium falciparum
RDDHSSS

SEQ ID NO: 3340903 - protein, 9 aa, Plasmodium falciparum
RDDKNNEME

SEQ ID NO: 3340904 - protein, 22 aa, Plasmodium falciparum
RDDNEDNKSEVDDSKYKKSTRS

SEQ ID NO: 3340905 - protein, 17 aa, Plasmodium falciparum
RDDNKANTQNEDVTTNN

SEQ ID NO: 3340906 - protein, 20 aa, Plasmodium falciparum
RDDNNNNNNNNNNNNNSKKD

SEQ ID NO: 3340907 - protein, 7 aa, Plasmodium falciparum
RDDQNVN

SEQ ID NO: 3340908 - protein, 15 aa, Plasmodium falciparum
RDDTDSLKKGNDNIS

SEQ ID NO: 3340909 - protein, 7 aa, Plasmodium falciparum
RDDTNMD

SEQ ID NO: 3340910 - protein, 12 aa, Plasmodium falciparum
RDDYYDDGPQTI

SEQ ID NO: 3340911 - protein, 6 aa, Plasmodium falciparum
RDEAIS

SEQ ID NO: 3340912 - protein, 8 aa, Plasmodium falciparum
RDEDGKEE

SEQ ID NO: 3340913 - protein, 6 aa, Plasmodium falciparum
RDEDQT

SEQ ID NO: 3340914 - protein, 16 aa, Plasmodium falciparum
RDEEERNKKNNKGNNV

SEQ ID NO: 3340915 - protein, 10 aa, Plasmodium falciparum
RDEGYSLEQN

SEQ ID NO: 3340916 - protein, 4 aa, Plasmodium falciparum
RDEK

SEQ ID NO: 3340917 - protein, 9 aa, Plasmodium falciparum
RDEKEQSKG

SEQ ID NO: 3340918 - protein, 16 aa, Plasmodium falciparum
RDEKYKDEKINNNNNM

SEQ ID NO: 3340919 - protein, 10 aa, Plasmodium falciparum
RDEKYKKKEN

SEQ ID NO: 3340920 - protein, 10 aa, Plasmodium falciparum
RDELKKEKNN

SEQ ID NO: 3340921 - protein, 8 aa, Plasmodium falciparum
RDEPSMNR

SEQ ID NO: 3340922 - protein, 7 aa, Plasmodium falciparum
RDEQKRN

SEQ ID NO: 3340923 - protein, 22 aa, Plasmodium falciparum
RDERDERDEQVEKVEQDEQEQN

SEQ ID NO: 3340924 - protein, 11 aa, Plasmodium falciparum
RDESETGVQGN

SEQ ID NO: 3340925 - protein, 5 aa, Plasmodium falciparum
RDEYN

SEQ ID NO: 3340926 - protein, 6 aa, Plasmodium falciparum
RDEYTK

SEQ ID NO: 3340927 - protein, 12 aa, Plasmodium falciparum
RDFTKSNNDKIS

SEQ ID NO: 3340928 - protein, 6 aa, Plasmodium falciparum
RDGANV

SEQ ID NO: 3340929 - protein, 8 aa, Plasmodium falciparum
RDGGSGGK

SEQ ID NO: 3340930 - protein, 8 aa, Plasmodium falciparum
RDGTDQDY

SEQ ID NO: 3340931 - protein, 5 aa, Plasmodium falciparum
RDGTY

SEQ ID NO: 3340932 - protein, 7 aa, Plasmodium falciparum
RDHEQAK

SEQ ID NO: 3340933 - protein, 8 aa, Plasmodium falciparum
RDINNEED

SEQ ID NO: 3340934 - protein, 25 aa, Plasmodium falciparum
RDINSSTTATSNTLSTVSKKKRKDA

SEQ ID NO: 3340935 - protein, 14 aa, Plasmodium falciparum
RDIQDDKKNNLNNP

SEQ ID NO: 3340936 - protein, 4 aa, Plasmodium falciparum
RDKE

SEQ ID NO: 3340937 - protein, 8 aa, Plasmodium falciparum
RDKEGDNI

SEQ ID NO: 3340938 - protein, 8 aa, Plasmodium falciparum
RDKKEITE

SEQ ID NO: 3340939 - protein, 8 aa, Plasmodium falciparum
RDKKKANK

SEQ ID NO: 3340940 - protein, 9 aa, Plasmodium falciparum
RDKKNNIRI

SEQ ID NO: 3340941 - protein, 7 aa, Plasmodium falciparum
RDKKNPN

SEQ ID NO: 3340942 - protein, 6 aa, Plasmodium falciparum
RDKLDD

SEQ ID NO: 3340943 - protein, 8 aa, Plasmodium falciparum
RDKLKNEE

SEQ ID NO: 3340944 - protein, 7 aa, Plasmodium falciparum
RDKNKNN

SEQ ID NO: 3340945 - protein, 10 aa, Plasmodium falciparum
RDKNNIAENT

SEQ ID NO: 3340946 - protein, 8 aa, Plasmodium falciparum
RDKNNPRE

SEQ ID NO: 3340947 - protein, 8 aa, Plasmodium falciparum
RDKPTDHD

SEQ ID NO: 3340948 - protein, 20 aa, Plasmodium falciparum
RDKRKRVDHKKESKSSEDYE

SEQ ID NO: 3340949 - protein, 10 aa, Plasmodium falciparum
RDKSFSKNNL

SEQ ID NO: 3340950 - protein, 10 aa, Plasmodium falciparum
RDKSSRDNPP

SEQ ID NO: 3340951 - protein, 5 aa, Plasmodium falciparum
RDKTE

SEQ ID NO: 3340952 - protein, 7 aa, Plasmodium falciparum
RDKYTGD

SEQ ID NO: 3340953 - protein, 5 aa, Plasmodium falciparum
RDLEN

SEQ ID NO: 3340954 - protein, 17 aa, Plasmodium falciparum
RDMKKKKKSDLIKNKEG

SEQ ID NO: 3340955 - protein, 11 aa, Plasmodium falciparum
RDMNENNSNTY

SEQ ID NO: 3340956 - protein, 21 aa, Plasmodium falciparum
RDMSTDMSTDISNGLTEDTSN

SEQ ID NO: 3340957 - protein, 6 aa, Plasmodium falciparum
RDNADS

SEQ ID NO: 3340958 - protein, 10 aa, Plasmodium falciparum
RDNDKSRYLG

SEQ ID NO: 3340959 - protein, 5 aa, Plasmodium falciparum
RDNEE

SEQ ID NO: 3340960 - protein, 10 aa, Plasmodium falciparum
RDNGKGSKIK

SEQ ID NO: 3340961 - protein, 4 aa, Plasmodium falciparum
RDNI

SEQ ID NO: 3340962 - protein, 4 aa, Plasmodium falciparum
RDNL

SEQ ID NO: 3340963 - protein, 5 aa, Plasmodium falciparum
RDNLK

SEQ ID NO: 3340964 - protein, 7 aa, Plasmodium falciparum
RDNLTKK

SEQ ID NO: 3340965 - protein, 9 aa, Plasmodium falciparum
RDNNLTNNY

SEQ ID NO: 3340966 - protein, 11 aa, Plasmodium falciparum
RDNNYNNNDDS

SEQ ID NO: 3340967 - protein, 5 aa, Plasmodium falciparum
RDNTN

SEQ ID NO: 3340968 - protein, 9 aa, Plasmodium falciparum
RDNTSSLSY

SEQ ID NO: 3340969 - protein, 32 aa, Plasmodium falciparum
RDNYENNNKWNNNIKGNNSNEYNYKKENNNNN

SEQ ID NO: 3340970 - protein, 5 aa, Plasmodium falciparum
RDNYS

SEQ ID NO: 3340971 - protein, 9 aa, Plasmodium falciparum
RDPDQGDTV

SEQ ID NO: 3340972 - protein, 6 aa, Plasmodium falciparum
RDPNGL

SEQ ID NO: 3340973 - protein, 12 aa, Plasmodium falciparum
RDPNRKQDHFDK

SEQ ID NO: 3340974 - protein, 9 aa, Plasmodium falciparum
RDPSNYRPR

SEQ ID NO: 3340975 - protein, 5 aa, Plasmodium falciparum
RDQFE

SEQ ID NO: 3340976 - protein, 17 aa, Plasmodium falciparum
RDQGNYFKSETRKSLSS

SEQ ID NO: 3340977 - protein, 6 aa, Plasmodium falciparum
RDQNGE

SEQ ID NO: 3340978 - protein, 5 aa, Plasmodium falciparum
RDQQY

SEQ ID NO: 3340979 - protein, 59 aa, Plasmodium falciparum
RDQRDDKLEDKLEDKLEDKLEDKLDDKLEDKLEDKLEDKLEDKLDNQLDDNELESKEHS

SEQ ID NO: 3340980 - protein, 5 aa, Plasmodium falciparum
RDQYT

SEQ ID NO: 3340981 - protein, 9 aa, Plasmodium falciparum
RDRDHDLNS

SEQ ID NO: 3340982 - protein, 6 aa, Plasmodium falciparum
RDRNNA

SEQ ID NO: 3340983 - protein, 9 aa, Plasmodium falciparum
RDRSGLGYG

SEQ ID NO: 3340984 - protein, 7 aa, Plasmodium falciparum
RDRSSLI

SEQ ID NO: 3340985 - protein, 5 aa, Plasmodium falciparum
RDSFN

SEQ ID NO: 3340986 - protein, 6 aa, Plasmodium falciparum
RDSKKV

SEQ ID NO: 3340987 - protein, 12 aa, Plasmodium falciparum
RDSKNDKENDTI

SEQ ID NO: 3340988 - protein, 11 aa, Plasmodium falciparum
RDSSNNIKHEE

SEQ ID NO: 3340989 - protein, 23 aa, Plasmodium falciparum
RDSTSTEETATKRKNHNKEDNYM

SEQ ID NO: 3340990 - protein, 6 aa, Plasmodium falciparum
RDTAEK

SEQ ID NO: 3340991 - protein, 15 aa, Plasmodium falciparum
RDTAKRELKLSLSYL

SEQ ID NO: 3340992 - protein, 16 aa, Plasmodium falciparum
RDTENSTLYSSSRDTT

SEQ ID NO: 3340993 - protein, 4 aa, Plasmodium falciparum
RDTG

SEQ ID NO: 3340994 - protein, 6 aa, Plasmodium falciparum
RDTINE

SEQ ID NO: 3340995 - protein, 10 aa, Plasmodium falciparum
RDTKETNKKL

SEQ ID NO: 3340996 - protein, 5 aa, Plasmodium falciparum
RDTNI

SEQ ID NO: 3340997 - protein, 6 aa, Plasmodium falciparum
RDTNNY

SEQ ID NO: 3340998 - protein, 7 aa, Plasmodium falciparum
RDTQQGY

SEQ ID NO: 3340999 - protein, 7 aa, Plasmodium falciparum
RDTQVNH

SEQ ID NO: 3341000 - protein, 21 aa, Plasmodium falciparum
RDTRTNQNLNSNKMNRNNNSQ

SEQ ID NO: 3341001 - protein, 5 aa, Plasmodium falciparum
RDTTD

SEQ ID NO: 3341002 - protein, 8 aa, Plasmodium falciparum
RDTTKEGA

SEQ ID NO: 3341003 - protein, 9 aa, Plasmodium falciparum
RDTTKRTDL

SEQ ID NO: 3341004 - protein, 10 aa, Plasmodium falciparum
RDTYEQAKKE

SEQ ID NO: 3341005 - protein, 12 aa, Plasmodium falciparum
RDVDQGEEKSME

SEQ ID NO: 3341006 - protein, 9 aa, Plasmodium falciparum
RDVNNNKFN

SEQ ID NO: 3341007 - protein, 7 aa, Plasmodium falciparum
RDVPNKN

SEQ ID NO: 3341008 - protein, 8 aa, Plasmodium falciparum
RDWAQSKT

SEQ ID NO: 3341009 - protein, 4 aa, Plasmodium falciparum
RDYS

SEQ ID NO: 3341010 - protein, 16 aa, Plasmodium falciparum
READKNNKKFIKKQKR

SEQ ID NO: 3341011 - protein, 4 aa, Plasmodium falciparum
REAE

SEQ ID NO: 3341012 - protein, 5 aa, Plasmodium falciparum
REAEA

SEQ ID NO: 3341013 - protein, 12 aa, Plasmodium falciparum
REAEKLSKNLNG

SEQ ID NO: 3341014 - protein, 18 aa, Plasmodium falciparum
REAELDDEDEEEEERRRN

SEQ ID NO: 3341015 - protein, 5 aa, Plasmodium falciparum
REASY

SEQ ID NO: 3341016 - protein, 7 aa, Plasmodium falciparum
REAYRNE

SEQ ID NO: 3341017 - protein, 8 aa, Plasmodium falciparum
RECGQLPP

SEQ ID NO: 3341018 - protein, 8 aa, Plasmodium falciparum
REDDNEDV

SEQ ID NO: 3341019 - protein, 4 aa, Plasmodium falciparum
REDE

SEQ ID NO: 3341020 - protein, 10 aa, Plasmodium falciparum
REDEYKHKEN

SEQ ID NO: 3341021 - protein, 6 aa, Plasmodium falciparum
REDEYN

SEQ ID NO: 3341022 - protein, 4 aa, Plasmodium falciparum
REDI

SEQ ID NO: 3341023 - protein, 7 aa, Plasmodium falciparum
REDIENE

SEQ ID NO: 3341024 - protein, 12 aa, Plasmodium falciparum
REDIKNKDFQKE

SEQ ID NO: 3341025 - protein, 16 aa, Plasmodium falciparum
REDKEKADEMNVDGKN

SEQ ID NO: 3341026 - protein, 10 aa, Plasmodium falciparum
REDKKDGTQK

SEQ ID NO: 3341027 - protein, 14 aa, Plasmodium falciparum
REDMNKNDEERRYR

SEQ ID NO: 3341028 - protein, 7 aa, Plasmodium falciparum
REDNDIS

SEQ ID NO: 3341029 - protein, 12 aa, Plasmodium falciparum
REDNNTAPYNSG

SEQ ID NO: 3341030 - protein, 44 aa, Plasmodium falciparum
REDNSGLKKNAKNEDKKSGDEEEEEEEEEEDEENNKNKEANNRT

SEQ ID NO: 3341031 - protein, 16 aa, Plasmodium falciparum
REDNVKSKDNETDSYY

SEQ ID NO: 3341032 - protein, 6 aa, Plasmodium falciparum
REDSKL

SEQ ID NO: 3341033 - protein, 18 aa, Plasmodium falciparum
REDTISEKRDEKNVNRGD

SEQ ID NO: 3341034 - protein, 6 aa, Plasmodium falciparum
REDYTK

SEQ ID NO: 3341035 - protein, 6 aa, Plasmodium falciparum
REECGY

SEQ ID NO: 3341036 - protein, 5 aa, Plasmodium falciparum
REEDE

SEQ ID NO: 3341037 - protein, 6 aa, Plasmodium falciparum
REEDKD

SEQ ID NO: 3341038 - protein, 4 aa, Plasmodium falciparum
REEE

SEQ ID NO: 3341039 - protein, 36 aa, Plasmodium falciparum
REEETQVETKKKYKTTYSNYQKSSSVEKKKLDESSF

SEQ ID NO: 3341040 - protein, 10 aa, Plasmodium falciparum
REEGNNKSEG

SEQ ID NO: 3341041 - protein, 20 aa, Plasmodium falciparum
REEGVNQKHAQKKLKKKNTI

SEQ ID NO: 3341042 - protein, 21 aa, Plasmodium falciparum
REEKEKNDAYMKEEGEEYDEE

SEQ ID NO: 3341043 - protein, 6 aa, Plasmodium falciparum
REEKNK

SEQ ID NO: 3341044 - protein, 5 aa, Plasmodium falciparum
REEKS

SEQ ID NO: 3341045 - protein, 11 aa, Plasmodium falciparum
REENEKRLNEE

SEQ ID NO: 3341046 - protein, 6 aa, Plasmodium falciparum
REENNK

SEQ ID NO: 3341047 - protein, 6 aa, Plasmodium falciparum
REENNN

SEQ ID NO: 3341048 - protein, 12 aa, Plasmodium falciparum
REEPNNSQEIKN

SEQ ID NO: 3341049 - protein, 6 aa, Plasmodium falciparum
REEREN

SEQ ID NO: 3341050 - protein, 8 aa, Plasmodium falciparum
REERESWQ

SEQ ID NO: 3341051 - protein, 7 aa, Plasmodium falciparum
REEYKNN

SEQ ID NO: 3341052 - protein, 175 aa, Plasmodium falciparum
REGGEDNKEGDEDNKEGDEDNKEGDEHNKEDDKDNKENDENNDEGDENNDEGDEDNDEDDEDNDEDDEDNDEGDEGNDKGDEYNDEGDENNDEGDEDNDEDDEDNDEDDEDNDEGDEGNDKGDEYNDEGDEYNDEGDEYNDEGDEYNDEGDEYNDEGDEYNDEDDNDMNNNDKNN

SEQ ID NO: 3341053 - protein, 9 aa, Plasmodium falciparum
REGIDDRRR

SEQ ID NO: 3341054 - protein, 6 aa, Plasmodium falciparum
REGKTD

SEQ ID NO: 3341055 - protein, 16 aa, Plasmodium falciparum
REHANKYNATDITQGD

SEQ ID NO: 3341056 - protein, 4 aa, Plasmodium falciparum
REHD

SEQ ID NO: 3341057 - protein, 10 aa, Plasmodium falciparum
REHEEEKYSK

SEQ ID NO: 3341058 - protein, 8 aa, Plasmodium falciparum
REHGNYHK

SEQ ID NO: 3341059 - protein, 4 aa, Plasmodium falciparum
REHL

SEQ ID NO: 3341060 - protein, 4 aa, Plasmodium falciparum
REID

SEQ ID NO: 3341061 - protein, 6 aa, Plasmodium falciparum
REIDSE

SEQ ID NO: 3341062 - protein, 12 aa, Plasmodium falciparum
REIKKEKYQNEY

SEQ ID NO: 3341063 - protein, 7 aa, Plasmodium falciparum
REKDKEL

SEQ ID NO: 3341064 - protein, 16 aa, Plasmodium falciparum
REKEEKKSKEDSHYNY

SEQ ID NO: 3341065 - protein, 6 aa, Plasmodium falciparum
REKEIK

SEQ ID NO: 3341066 - protein, 84 aa, Plasmodium falciparum
REKEKEKLYKKGSIKANEKDHTKDNTKSNTNEKSKDNASDNTKDHTKDITEDHTKDITKDHTKDITEDHTKDITKDHTKDITKD

SEQ ID NO: 3341067 - protein, 7 aa, Plasmodium falciparum
REKENRY

SEQ ID NO: 3341068 - protein, 25 aa, Plasmodium falciparum
REKESKQKNENKDQLDNKDNSSYTN

SEQ ID NO: 3341069 - protein, 4 aa, Plasmodium falciparum
REKI

SEQ ID NO: 3341070 - protein, 15 aa, Plasmodium falciparum
REKIERSKKDGNMRD

SEQ ID NO: 3341071 - protein, 6 aa, Plasmodium falciparum
REKIKE

SEQ ID NO: 3341072 - protein, 10 aa, Plasmodium falciparum
REKKLKEEEI

SEQ ID NO: 3341073 - protein, 9 aa, Plasmodium falciparum
REKKNDMST

SEQ ID NO: 3341074 - protein, 4 aa, Plasmodium falciparum
REKM

SEQ ID NO: 3341075 - protein, 9 aa, Plasmodium falciparum
REKNEEQKT

SEQ ID NO: 3341076 - protein, 13 aa, Plasmodium falciparum
REKNEHKKEKEKQ

SEQ ID NO: 3341077 - protein, 9 aa, Plasmodium falciparum
REKNETLKK

SEQ ID NO: 3341078 - protein, 8 aa, Plasmodium falciparum
REKNGEDN

SEQ ID NO: 3341079 - protein, 8 aa, Plasmodium falciparum
REKNNSQY

SEQ ID NO: 3341080 - protein, 6 aa, Plasmodium falciparum
REKQRI

SEQ ID NO: 3341081 - protein, 37 aa, Plasmodium falciparum
REKQSMKKPLKEKPAIENENSGANEQEVKTLLLDVVD

SEQ ID NO: 3341082 - protein, 7 aa, Plasmodium falciparum
REKQTKI

SEQ ID NO: 3341083 - protein, 8 aa, Plasmodium falciparum
REKSEHSN

SEQ ID NO: 3341084 - protein, 9 aa, Plasmodium falciparum
REKSSEEQL

SEQ ID NO: 3341085 - protein, 5 aa, Plasmodium falciparum
REKTY

SEQ ID NO: 3341086 - protein, 8 aa, Plasmodium falciparum
REKYNKEN

SEQ ID NO: 3341087 - protein, 15 aa, Plasmodium falciparum
RELERERREKIREER

SEQ ID NO: 3341088 - protein, 11 aa, Plasmodium falciparum
RELGERESSQY

SEQ ID NO: 3341089 - protein, 6 aa, Plasmodium falciparum
RELKRD

SEQ ID NO: 3341090 - protein, 165 aa, Plasmodium falciparum
RELNSDDDKKSKKKRSYSASPGSAYKSSSRELKSQDKSNDRLSESKKSYKSQSASVRYNSTEEKKSDDETVKPKRGGRGNAKNTGKNKNTKGSKKGAKTEENHDSKSVSNDRNKSDKSEEKEKPEVVSKDEEDKKTGGAEVKPKRGRRGRKKANAADENANGNVS

SEQ ID NO: 3341091 - protein, 6 aa, Plasmodium falciparum
RELQNE

SEQ ID NO: 3341092 - protein, 7 aa, Plasmodium falciparum
RELQQTL

SEQ ID NO: 3341093 - protein, 12 aa, Plasmodium falciparum
REMENDENEENV

SEQ ID NO: 3341094 - protein, 4 aa, Plasmodium falciparum
REMK

SEQ ID NO: 3341095 - protein, 4 aa, Plasmodium falciparum
REMN

SEQ ID NO: 3341096 - protein, 7 aa, Plasmodium falciparum
RENAKNT

SEQ ID NO: 3341097 - protein, 6 aa, Plasmodium falciparum
RENDID

SEQ ID NO: 3341098 - protein, 5 aa, Plasmodium falciparum
RENDQ

SEQ ID NO: 3341099 - protein, 17 aa, Plasmodium falciparum
RENEEKYFKPAKNNNDE

SEQ ID NO: 3341100 - protein, 9 aa, Plasmodium falciparum
RENEGKSPH

SEQ ID NO: 3341101 - protein, 57 aa, Plasmodium falciparum
RENEKEDDEVEEEEENEENEDGEDDEEEDDEEKDDEEDGEEDGEDDEEDGEDDEEDD

SEQ ID NO: 3341102 - protein, 13 aa, Plasmodium falciparum
RENELNKKEEELK

SEQ ID NO: 3341103 - protein, 7 aa, Plasmodium falciparum
RENENNY

SEQ ID NO: 3341104 - protein, 7 aa, Plasmodium falciparum
RENESMP

SEQ ID NO: 3341105 - protein, 14 aa, Plasmodium falciparum
RENGRYNARGGGRG

SEQ ID NO: 3341106 - protein, 15 aa, Plasmodium falciparum
RENIYNDNSNIENKN

SEQ ID NO: 3341107 - protein, 6 aa, Plasmodium falciparum
RENKIE

SEQ ID NO: 3341108 - protein, 5 aa, Plasmodium falciparum
RENKN

SEQ ID NO: 3341109 - protein, 9 aa, Plasmodium falciparum
RENKNHKKI

SEQ ID NO: 3341110 - protein, 22 aa, Plasmodium falciparum
RENKNLNENNSDDNKKVNKKNG

SEQ ID NO: 3341111 - protein, 19 aa, Plasmodium falciparum
RENKYSNNKDNKGEQINTQ

SEQ ID NO: 3341112 - protein, 10 aa, Plasmodium falciparum
RENNEESTKH

SEQ ID NO: 3341113 - protein, 6 aa, Plasmodium falciparum
RENNEF

SEQ ID NO: 3341114 - protein, 8 aa, Plasmodium falciparum
RENNKDTL

SEQ ID NO: 3341115 - protein, 13 aa, Plasmodium falciparum
RENNSKYEHTPPG

SEQ ID NO: 3341116 - protein, 6 aa, Plasmodium falciparum
RENQIK

SEQ ID NO: 3341117 - protein, 5 aa, Plasmodium falciparum
RENQY

SEQ ID NO: 3341118 - protein, 6 aa, Plasmodium falciparum
RENRND

SEQ ID NO: 3341119 - protein, 5 aa, Plasmodium falciparum
RENSP

SEQ ID NO: 3341120 - protein, 6 aa, Plasmodium falciparum
RENTGV

SEQ ID NO: 3341121 - protein, 5 aa, Plasmodium falciparum
RENVE

SEQ ID NO: 3341122 - protein, 5 aa, Plasmodium falciparum
RENYS

SEQ ID NO: 3341123 - protein, 7 aa, Plasmodium falciparum
RENYTET

SEQ ID NO: 3341124 - protein, 14 aa, Plasmodium falciparum
REPIEEQKKYADEN

SEQ ID NO: 3341125 - protein, 20 aa, Plasmodium falciparum
REPKKNKTNINADKSSLENK

SEQ ID NO: 3341126 - protein, 4 aa, Plasmodium falciparum
REPQ

SEQ ID NO: 3341127 - protein, 18 aa, Plasmodium falciparum
REPSNNTNEQKEQSHKYD

SEQ ID NO: 3341128 - protein, 11 aa, Plasmodium falciparum
REQKKLKNEID

SEQ ID NO: 3341129 - protein, 9 aa, Plasmodium falciparum
REQNRFGEG

SEQ ID NO: 3341130 - protein, 4 aa, Plasmodium falciparum
REQQ

SEQ ID NO: 3341131 - protein, 17 aa, Plasmodium falciparum
REQQQNYKNGIKNKNNG

SEQ ID NO: 3341132 - protein, 9 aa, Plasmodium falciparum
REQRKKNNF

SEQ ID NO: 3341133 - protein, 18 aa, Plasmodium falciparum
REQRRVRKETAKHVNPSQ

SEQ ID NO: 3341134 - protein, 30 aa, Plasmodium falciparum
REREMERNRERERDMDREREREINRNRESL

SEQ ID NO: 3341135 - protein, 9 aa, Plasmodium falciparum
REREQERRK

SEQ ID NO: 3341136 - protein, 10 aa, Plasmodium falciparum
RERKKREEEF

SEQ ID NO: 3341137 - protein, 9 aa, Plasmodium falciparum
RERKKRKEE

SEQ ID NO: 3341138 - protein, 4 aa, Plasmodium falciparum
RERN

SEQ ID NO: 3341139 - protein, 5 aa, Plasmodium falciparum
RERNK

SEQ ID NO: 3341140 - protein, 9 aa, Plasmodium falciparum
RERQKKRDE

SEQ ID NO: 3341141 - protein, 6 aa, Plasmodium falciparum
RERRRS

SEQ ID NO: 3341142 - protein, 13 aa, Plasmodium falciparum
RERSRSKNTSNIN

SEQ ID NO: 3341143 - protein, 5 aa, Plasmodium falciparum
RESDT

SEQ ID NO: 3341144 - protein, 5 aa, Plasmodium falciparum
RESES

SEQ ID NO: 3341145 - protein, 29 aa, Plasmodium falciparum
RESESATPGGNKYDNKSDDTCDDKKDSYD

SEQ ID NO: 3341146 - protein, 4 aa, Plasmodium falciparum
RESG

SEQ ID NO: 3341147 - protein, 9 aa, Plasmodium falciparum
RESKDNTAE

SEQ ID NO: 3341148 - protein, 9 aa, Plasmodium falciparum
RESKREKNL

SEQ ID NO: 3341149 - protein, 5 aa, Plasmodium falciparum
RESQS

SEQ ID NO: 3341150 - protein, 8 aa, Plasmodium falciparum
RESRPTWD

SEQ ID NO: 3341151 - protein, 7 aa, Plasmodium falciparum
RETDKLQ

SEQ ID NO: 3341152 - protein, 4 aa, Plasmodium falciparum
RETE

SEQ ID NO: 3341153 - protein, 6 aa, Plasmodium falciparum
RETEKN

SEQ ID NO: 3341154 - protein, 4 aa, Plasmodium falciparum
RETI

SEQ ID NO: 3341155 - protein, 11 aa, Plasmodium falciparum
RETISTESTVT

SEQ ID NO: 3341156 - protein, 8 aa, Plasmodium falciparum
RETKPTSF

SEQ ID NO: 3341157 - protein, 13 aa, Plasmodium falciparum
RETNIKNDNKNEK

SEQ ID NO: 3341158 - protein, 6 aa, Plasmodium falciparum
RETPKG

SEQ ID NO: 3341159 - protein, 33 aa, Plasmodium falciparum
RETQKSKNKIKTKKKNNNNNNNNNYDDDDEGVD

SEQ ID NO: 3341160 - protein, 8 aa, Plasmodium falciparum
RETQKSYT

SEQ ID NO: 3341161 - protein, 10 aa, Plasmodium falciparum
RETSRKPDEI

SEQ ID NO: 3341162 - protein, 4 aa, Plasmodium falciparum
REVK

SEQ ID NO: 3341163 - protein, 13 aa, Plasmodium falciparum
REVKEGQATYNNE

SEQ ID NO: 3341164 - protein, 16 aa, Plasmodium falciparum
REYGENKNKLKEYNDS

SEQ ID NO: 3341165 - protein, 4 aa, Plasmodium falciparum
REYK

SEQ ID NO: 3341166 - protein, 7 aa, Plasmodium falciparum
REYMPNN

SEQ ID NO: 3341167 - protein, 7 aa, Plasmodium falciparum
REYSNKF

SEQ ID NO: 3341168 - protein, 18 aa, Plasmodium falciparum
REYSSRTNDEITNGSTDY

SEQ ID NO: 3341169 - protein, 12 aa, Plasmodium falciparum
RFDGRKEKQYEE

SEQ ID NO: 3341170 - protein, 14 aa, Plasmodium falciparum
RFDQTADQEGRVKQ

SEQ ID NO: 3341171 - protein, 13 aa, Plasmodium falciparum
RFKNKDKNKEGKI

SEQ ID NO: 3341172 - protein, 6 aa, Plasmodium falciparum
RFKSER

SEQ ID NO: 3341173 - protein, 9 aa, Plasmodium falciparum
RFKSTDKNV

SEQ ID NO: 3341174 - protein, 4 aa, Plasmodium falciparum
RFNS

SEQ ID NO: 3341175 - protein, 7 aa, Plasmodium falciparum
RFPPTKR

SEQ ID NO: 3341176 - protein, 6 aa, Plasmodium falciparum
RFRPDQ

SEQ ID NO: 3341177 - protein, 13 aa, Plasmodium falciparum
RFSDSRSGQCTNR

SEQ ID NO: 3341178 - protein, 5 aa, Plasmodium falciparum
RFSKN

SEQ ID NO: 3341179 - protein, 7 aa, Plasmodium falciparum
RGANEAV

SEQ ID NO: 3341180 - protein, 231 aa, Plasmodium falciparum
RGDKGGSQNGDDSYRRHDDHHDGTHRDRSEMRDRRDWSGRDRDRDRERDRDRDRDREHRRDRDRDRERDRDRDRERDRDRDRERDRDRDREHRRDRDRDRERDRDRDRERDRDRDRERDRDRDREHRRDRDRDRERDRDRDRERDRDRDRERDRDRDRERDRDRDRERERDRDRDRDRDIKRSDRDHKKDRDDKLDRDSRRRERSGKPENEKKRENDISKRNGTTEERTKN

SEQ ID NO: 3341181 - protein, 15 aa, Plasmodium falciparum
RGDKKERTQKKKNDL

SEQ ID NO: 3341182 - protein, 19 aa, Plasmodium falciparum
RGDKKKTQKKEKKKTNIQE

SEQ ID NO: 3341183 - protein, 35 aa, Plasmodium falciparum
RGDKNDKKSKNEKKPSLEGVKQNAEEQKEQPADSH

SEQ ID NO: 3341184 - protein, 9 aa, Plasmodium falciparum
RGDRKKRVK

SEQ ID NO: 3341185 - protein, 9 aa, Plasmodium falciparum
RGEDERENE

SEQ ID NO: 3341186 - protein, 17 aa, Plasmodium falciparum
RGEEGEISSPKERNIPK

SEQ ID NO: 3341187 - protein, 6 aa, Plasmodium falciparum
RGEEIN

SEQ ID NO: 3341188 - protein, 8 aa, Plasmodium falciparum
RGEHPKQG

SEQ ID NO: 3341189 - protein, 9 aa, Plasmodium falciparum
RGEKGLKSL

SEQ ID NO: 3341190 - protein, 4 aa, Plasmodium falciparum
RGEN

SEQ ID NO: 3341191 - protein, 10 aa, Plasmodium falciparum
RGENKEEIEY

SEQ ID NO: 3341192 - protein, 5 aa, Plasmodium falciparum
RGFPN

SEQ ID NO: 3341193 - protein, 4 aa, Plasmodium falciparum
RGGA

SEQ ID NO: 3341194 - protein, 9 aa, Plasmodium falciparum
RGGDPDEFS

SEQ ID NO: 3341195 - protein, 6 aa, Plasmodium falciparum
RGGGHA

SEQ ID NO: 3341196 - protein, 5 aa, Plasmodium falciparum
RGGHK

SEQ ID NO: 3341197 - protein, 10 aa, Plasmodium falciparum
RGGKATYHGP

SEQ ID NO: 3341198 - protein, 6 aa, Plasmodium falciparum
RGGVEG

SEQ ID NO: 3341199 - protein, 7 aa, Plasmodium falciparum
RGHDSDV

SEQ ID NO: 3341200 - protein, 6 aa, Plasmodium falciparum
RGHESD

SEQ ID NO: 3341201 - protein, 13 aa, Plasmodium falciparum
RGHVSAGHGRVGK

SEQ ID NO: 3341202 - protein, 9 aa, Plasmodium falciparum
RGISKKAKS

SEQ ID NO: 3341203 - protein, 8 aa, Plasmodium falciparum
RGKDNSLN

SEQ ID NO: 3341204 - protein, 16 aa, Plasmodium falciparum
RGKENRNQGEVEKQNI

SEQ ID NO: 3341205 - protein, 10 aa, Plasmodium falciparum
RGKKKSYEED

SEQ ID NO: 3341206 - protein, 7 aa, Plasmodium falciparum
RGKREQY

SEQ ID NO: 3341207 - protein, 10 aa, Plasmodium falciparum
RGLPSHGKKN

SEQ ID NO: 3341208 - protein, 11 aa, Plasmodium falciparum
RGLTRDKRATI

SEQ ID NO: 3341209 - protein, 8 aa, Plasmodium falciparum
RGMSTRNT

SEQ ID NO: 3341210 - protein, 9 aa, Plasmodium falciparum
RGNDGVGAT

SEQ ID NO: 3341211 - protein, 8 aa, Plasmodium falciparum
RGNIDEPG

SEQ ID NO: 3341212 - protein, 20 aa, Plasmodium falciparum
RGNKNDKKNKKEKKSSLESV

SEQ ID NO: 3341213 - protein, 37 aa, Plasmodium falciparum
RGNKNDKKSKNEKKSSLESVKQNADEQKEQPTDSQIS

SEQ ID NO: 3341214 - protein, 37 aa, Plasmodium falciparum
RGNKNDKKSKNEKQPSLESVKQNADEQKEQPTDSQIS

SEQ ID NO: 3341215 - protein, 14 aa, Plasmodium falciparum
RGNKRDNKNDSKSG

SEQ ID NO: 3341216 - protein, 13 aa, Plasmodium falciparum
RGNKRKEGKIKSN

SEQ ID NO: 3341217 - protein, 17 aa, Plasmodium falciparum
RGNNTNEEKAYPPISDA

SEQ ID NO: 3341218 - protein, 13 aa, Plasmodium falciparum
RGNVGSSSTGVND

SEQ ID NO: 3341219 - protein, 13 aa, Plasmodium falciparum
RGPELPIKGKSKE

SEQ ID NO: 3341220 - protein, 5 aa, Plasmodium falciparum
RGPPR

SEQ ID NO: 3341221 - protein, 6 aa, Plasmodium falciparum
RGPRSS

SEQ ID NO: 3341222 - protein, 10 aa, Plasmodium falciparum
RGPTVGASRE

SEQ ID NO: 3341223 - protein, 11 aa, Plasmodium falciparum
RGQIKAKTGAE

SEQ ID NO: 3341224 - protein, 38 aa, Plasmodium falciparum
RGQKIGQEKKHKKKDENKKKNKKNKNKNNNNSNNINNK

SEQ ID NO: 3341225 - protein, 5 aa, Plasmodium falciparum
RGQLK

SEQ ID NO: 3341226 - protein, 6 aa, Plasmodium falciparum
RGQNSY

SEQ ID NO: 3341227 - protein, 4 aa, Plasmodium falciparum
RGQT

SEQ ID NO: 3341228 - protein, 13 aa, Plasmodium falciparum
RGRKGKNKKDDDY

SEQ ID NO: 3341229 - protein, 7 aa, Plasmodium falciparum
RGRKGLD

SEQ ID NO: 3341230 - protein, 5 aa, Plasmodium falciparum
RGRNY

SEQ ID NO: 3341231 - protein, 5 aa, Plasmodium falciparum
RGRSN

SEQ ID NO: 3341232 - protein, 10 aa, Plasmodium falciparum
RGRVPRSNDP

SEQ ID NO: 3341233 - protein, 8 aa, Plasmodium falciparum
RGSDSPID

SEQ ID NO: 3341234 - protein, 7 aa, Plasmodium falciparum
RGSINDE

SEQ ID NO: 3341235 - protein, 6 aa, Plasmodium falciparum
RGSKEI

SEQ ID NO: 3341236 - protein, 13 aa, Plasmodium falciparum
RGSLKKKQTKEKF

SEQ ID NO: 3341237 - protein, 4 aa, Plasmodium falciparum
RGSQ

SEQ ID NO: 3341238 - protein, 4 aa, Plasmodium falciparum
RGSR

SEQ ID NO: 3341239 - protein, 4 aa, Plasmodium falciparum
RGSS

SEQ ID NO: 3341240 - protein, 10 aa, Plasmodium falciparum
RGSTDTHKDG

SEQ ID NO: 3341241 - protein, 8 aa, Plasmodium falciparum
RGSTNKIK

SEQ ID NO: 3341242 - protein, 6 aa, Plasmodium falciparum
RGSYIT

SEQ ID NO: 3341243 - protein, 17 aa, Plasmodium falciparum
RGTASGVSSSNVVGGTV

SEQ ID NO: 3341244 - protein, 6 aa, Plasmodium falciparum
RGTKNA

SEQ ID NO: 3341245 - protein, 6 aa, Plasmodium falciparum
RGTMTE

SEQ ID NO: 3341246 - protein, 7 aa, Plasmodium falciparum
RGTNGIS

SEQ ID NO: 3341247 - protein, 13 aa, Plasmodium falciparum
RGTRPGKNVNLTE

SEQ ID NO: 3341248 - protein, 7 aa, Plasmodium falciparum
RGTSTYE

SEQ ID NO: 3341249 - protein, 8 aa, Plasmodium falciparum
RGVEEKKR

SEQ ID NO: 3341250 - protein, 7 aa, Plasmodium falciparum
RGVKTNE

SEQ ID NO: 3341251 - protein, 10 aa, Plasmodium falciparum
RGYDETLSNR

SEQ ID NO: 3341252 - protein, 11 aa, Plasmodium falciparum
RGYEDNNTNIR

SEQ ID NO: 3341253 - protein, 4 aa, Plasmodium falciparum
RGYN

SEQ ID NO: 3341254 - protein, 7 aa, Plasmodium falciparum
RHDHTKQ

SEQ ID NO: 3341255 - protein, 23 aa, Plasmodium falciparum
RHDNPENSTQGNVNSNQNNDVNN

SEQ ID NO: 3341256 - protein, 17 aa, Plasmodium falciparum
RHDNYNDSSSSTGQKDG

SEQ ID NO: 3341257 - protein, 5 aa, Plasmodium falciparum
RHEET

SEQ ID NO: 3341258 - protein, 4 aa, Plasmodium falciparum
RHES

SEQ ID NO: 3341259 - protein, 18 aa, Plasmodium falciparum
RHGKPGIGATHSSRFIPL

SEQ ID NO: 3341260 - protein, 42 aa, Plasmodium falciparum
RHHNNNNNNNNNNNNNNNNNNNNNNNNNNNNNNNNNSGVNDF

SEQ ID NO: 3341261 - protein, 4 aa, Plasmodium falciparum
RHIK

SEQ ID NO: 3341262 - protein, 35 aa, Plasmodium falciparum
RHKDHKRNVDNNYNERIKREKKEEFGSSSSYSTDY

SEQ ID NO: 3341263 - protein, 74 aa, Plasmodium falciparum
RHKEKRKSLTTKKYDKKEKHKRKSDHRDKHRRRENHSRHREKEKDKKSHKRRHKHSYDKYSSRSRSYSTSSSTD

SEQ ID NO: 3341264 - protein, 4 aa, Plasmodium falciparum
RHNG

SEQ ID NO: 3341265 - protein, 47 aa, Plasmodium falciparum
RHNKDERYNNEQDPKTEPQSNINYDKDNNSGRKRNSIDSSRDRKYRK

SEQ ID NO: 3341266 - protein, 8 aa, Plasmodium falciparum
RHNNNDNN

SEQ ID NO: 3341267 - protein, 8 aa, Plasmodium falciparum
RHPPGNEI

SEQ ID NO: 3341268 - protein, 7 aa, Plasmodium falciparum
RHPPPKH

SEQ ID NO: 3341269 - protein, 27 aa, Plasmodium falciparum
RHRDNNKNDNKNNNDDNNNIDKTTSNL

SEQ ID NO: 3341270 - protein, 35 aa, Plasmodium falciparum
RHRRRDSHRHRHDDRRRSRSRDKYRHDDRHRSRRR

SEQ ID NO: 3341271 - protein, 16 aa, Plasmodium falciparum
RHRRRNPRKRGRRCSS

SEQ ID NO: 3341272 - protein, 4 aa, Plasmodium falciparum
RHSN

SEQ ID NO: 3341273 - protein, 12 aa, Plasmodium falciparum
RHSNSNNNTIND

SEQ ID NO: 3341274 - protein, 5 aa, Plasmodium falciparum
RHSTR

SEQ ID NO: 3341275 - protein, 30 aa, Plasmodium falciparum
RHTENKDNISDINNNNNNNNSSSNNNNISN

SEQ ID NO: 3341276 - protein, 8 aa, Plasmodium falciparum
RHTQNGTV

SEQ ID NO: 3341277 - protein, 17 aa, Plasmodium falciparum
RIAREKKKQLMNNRVKI

SEQ ID NO: 3341278 - protein, 5 aa, Plasmodium falciparum
RIEKR

SEQ ID NO: 3341279 - protein, 7 aa, Plasmodium falciparum
RIEPEGG

SEQ ID NO: 3341280 - protein, 6 aa, Plasmodium falciparum
RIEPNE

SEQ ID NO: 3341281 - protein, 11 aa, Plasmodium falciparum
RIESNGKTGYE

SEQ ID NO: 3341282 - protein, 6 aa, Plasmodium falciparum
RIETKT

SEQ ID NO: 3341283 - protein, 5 aa, Plasmodium falciparum
RIGKY

SEQ ID NO: 3341284 - protein, 4 aa, Plasmodium falciparum
RIHK

SEQ ID NO: 3341285 - protein, 9 aa, Plasmodium falciparum
RIKEDRGKT

SEQ ID NO: 3341286 - protein, 21 aa, Plasmodium falciparum
RIKKGDVGTTTWTKSTTEGHP

SEQ ID NO: 3341287 - protein, 7 aa, Plasmodium falciparum
RIKNQEG

SEQ ID NO: 3341288 - protein, 8 aa, Plasmodium falciparum
RIKREGTI

SEQ ID NO: 3341289 - protein, 6 aa, Plasmodium falciparum
RIKRKE

SEQ ID NO: 3341290 - protein, 37 aa, Plasmodium falciparum
RINETKNINENINNSKNISEMSETNNKMDNMETRKNT

SEQ ID NO: 3341291 - protein, 5 aa, Plasmodium falciparum
RINGL

SEQ ID NO: 3341292 - protein, 54 aa, Plasmodium falciparum
RINNSEEETNINDDNNDDNNGDYDDDNNSDDDDDNDDNNNNDDNNNDDDEDVDD

SEQ ID NO: 3341293 - protein, 9 aa, Plasmodium falciparum
RINNSNDTT

SEQ ID NO: 3341294 - protein, 4 aa, Plasmodium falciparum
RINQ

SEQ ID NO: 3341295 - protein, 4 aa, Plasmodium falciparum
RINS

SEQ ID NO: 3341296 - protein, 19 aa, Plasmodium falciparum
RINSKKSNYSNIGENEKYK

SEQ ID NO: 3341297 - protein, 15 aa, Plasmodium falciparum
RINSNTGKKVNQKNL

SEQ ID NO: 3341298 - protein, 4 aa, Plasmodium falciparum
RINT

SEQ ID NO: 3341299 - protein, 10 aa, Plasmodium falciparum
RIPKEKKKTK

SEQ ID NO: 3341300 - protein, 6 aa, Plasmodium falciparum
RIPMTD

SEQ ID NO: 3341301 - protein, 34 aa, Plasmodium falciparum
RIPTEKDDELKTEEDNRKNSKEGKIEERHHSDEN

SEQ ID NO: 3341302 - protein, 13 aa, Plasmodium falciparum
RIQKEQKNEYARE

SEQ ID NO: 3341303 - protein, 43 aa, Plasmodium falciparum
RIQTEKNNSNHDKKDNHNSSCSTSNNNMNKINKNSKSNDEKVN

SEQ ID NO: 3341304 - protein, 11 aa, Plasmodium falciparum
RIRKSGETTIR

SEQ ID NO: 3341305 - protein, 6 aa, Plasmodium falciparum
RISEDE

SEQ ID NO: 3341306 - protein, 10 aa, Plasmodium falciparum
RISESKNNNY

SEQ ID NO: 3341307 - protein, 26 aa, Plasmodium falciparum
RISHKQDDYKYADNYRSKFNNKSYEE

SEQ ID NO: 3341308 - protein, 9 aa, Plasmodium falciparum
RISQGSKKK

SEQ ID NO: 3341309 - protein, 4 aa, Plasmodium falciparum
RISS

SEQ ID NO: 3341310 - protein, 5 aa, Plasmodium falciparum
RISSD

SEQ ID NO: 3341311 - protein, 7 aa, Plasmodium falciparum
RKADNEE

SEQ ID NO: 3341312 - protein, 7 aa, Plasmodium falciparum
RKAKSTI

SEQ ID NO: 3341313 - protein, 8 aa, Plasmodium falciparum
RKASYGSY

SEQ ID NO: 3341314 - protein, 5 aa, Plasmodium falciparum
RKATS

SEQ ID NO: 3341315 - protein, 4 aa, Plasmodium falciparum
RKAV

SEQ ID NO: 3341316 - protein, 11 aa, Plasmodium falciparum
RKDEDKKKARI

SEQ ID NO: 3341317 - protein, 10 aa, Plasmodium falciparum
RKDENKENNL

SEQ ID NO: 3341318 - protein, 8 aa, Plasmodium falciparum
RKDEYKEP

SEQ ID NO: 3341319 - protein, 8 aa, Plasmodium falciparum
RKDHTTNE

SEQ ID NO: 3341320 - protein, 17 aa, Plasmodium falciparum
RKDIEKYTNEGDGNMNT

SEQ ID NO: 3341321 - protein, 10 aa, Plasmodium falciparum
RKDIHQKNNK

SEQ ID NO: 3341322 - protein, 30 aa, Plasmodium falciparum
RKDKKDKKASLGSVKETYEKETQTEEQEPY

SEQ ID NO: 3341323 - protein, 24 aa, Plasmodium falciparum
RKDKNKTKNGTMRNRKKYKNDSNR

SEQ ID NO: 3341324 - protein, 7 aa, Plasmodium falciparum
RKDKQTA

SEQ ID NO: 3341325 - protein, 6 aa, Plasmodium falciparum
RKDNFE

SEQ ID NO: 3341326 - protein, 5 aa, Plasmodium falciparum
RKDNH

SEQ ID NO: 3341327 - protein, 9 aa, Plasmodium falciparum
RKDNKELKN

SEQ ID NO: 3341328 - protein, 70 aa, Plasmodium falciparum
RKDNNKIPDGSMSSTHSSKDKVKGKKNKKYSYEESNSISSDKYNNKEKKGSSKRSREKKKEWSSSDNSSV

SEQ ID NO: 3341329 - protein, 8 aa, Plasmodium falciparum
RKDNQQTF

SEQ ID NO: 3341330 - protein, 5 aa, Plasmodium falciparum
RKDPH

SEQ ID NO: 3341331 - protein, 13 aa, Plasmodium falciparum
RKDPPTDANTNAN

SEQ ID NO: 3341332 - protein, 6 aa, Plasmodium falciparum
RKDSDD

SEQ ID NO: 3341333 - protein, 5 aa, Plasmodium falciparum
RKDSF

SEQ ID NO: 3341334 - protein, 14 aa, Plasmodium falciparum
RKDSIRSINTENNS

SEQ ID NO: 3341335 - protein, 10 aa, Plasmodium falciparum
RKDSSDPNPL

SEQ ID NO: 3341336 - protein, 8 aa, Plasmodium falciparum
RKDTNDEL

SEQ ID NO: 3341337 - protein, 6 aa, Plasmodium falciparum
RKEASR

SEQ ID NO: 3341338 - protein, 9 aa, Plasmodium falciparum
RKEDFSNDD

SEQ ID NO: 3341339 - protein, 19 aa, Plasmodium falciparum
RKEEEEEEEEEQDEECSEN

SEQ ID NO: 3341340 - protein, 5 aa, Plasmodium falciparum
RKEEK

SEQ ID NO: 3341341 - protein, 8 aa, Plasmodium falciparum
RKEESSIS

SEQ ID NO: 3341342 - protein, 5 aa, Plasmodium falciparum
RKEET

SEQ ID NO: 3341343 - protein, 5 aa, Plasmodium falciparum
RKEHN

SEQ ID NO: 3341344 - protein, 19 aa, Plasmodium falciparum
RKEHNKKNSYDNNNKNKMD

SEQ ID NO: 3341345 - protein, 8 aa, Plasmodium falciparum
RKEKEEKF

SEQ ID NO: 3341346 - protein, 9 aa, Plasmodium falciparum
RKEKPDFTN

SEQ ID NO: 3341347 - protein, 5 aa, Plasmodium falciparum
RKEKS

SEQ ID NO: 3341348 - protein, 5 aa, Plasmodium falciparum
RKEKT

SEQ ID NO: 3341349 - protein, 10 aa, Plasmodium falciparum
RKEKTDTHAG

SEQ ID NO: 3341350 - protein, 4 aa, Plasmodium falciparum
RKEL

SEQ ID NO: 3341351 - protein, 41 aa, Plasmodium falciparum
RKENADKKNNENNETESQHDNSNDSSDKKFYKTNKKYKDPF

SEQ ID NO: 3341352 - protein, 6 aa, Plasmodium falciparum
RKENDQ

SEQ ID NO: 3341353 - protein, 7 aa, Plasmodium falciparum
RKENPNI

SEQ ID NO: 3341354 - protein, 13 aa, Plasmodium falciparum
RKENSEREEDKSI

SEQ ID NO: 3341355 - protein, 16 aa, Plasmodium falciparum
RKENSTNNEFLKNLSN

SEQ ID NO: 3341356 - protein, 6 aa, Plasmodium falciparum
RKEPYE

SEQ ID NO: 3341357 - protein, 4 aa, Plasmodium falciparum
RKEQ

SEQ ID NO: 3341358 - protein, 6 aa, Plasmodium falciparum
RKEQSK

SEQ ID NO: 3341359 - protein, 4 aa, Plasmodium falciparum
RKER

SEQ ID NO: 3341360 - protein, 16 aa, Plasmodium falciparum
RKERFDENNTTDGNLP

SEQ ID NO: 3341361 - protein, 12 aa, Plasmodium falciparum
RKESDRKELRNT

SEQ ID NO: 3341362 - protein, 5 aa, Plasmodium falciparum
RKESE

SEQ ID NO: 3341363 - protein, 9 aa, Plasmodium falciparum
RKESESKVE

SEQ ID NO: 3341364 - protein, 8 aa, Plasmodium falciparum
RKESHKEL

SEQ ID NO: 3341365 - protein, 20 aa, Plasmodium falciparum
RKESRGAHARDDFPERDDKN

SEQ ID NO: 3341366 - protein, 13 aa, Plasmodium falciparum
RKESSDSNSKENI

SEQ ID NO: 3341367 - protein, 12 aa, Plasmodium falciparum
RKETKKKQKMQK

SEQ ID NO: 3341368 - protein, 12 aa, Plasmodium falciparum
RKETNDENRDDQ

SEQ ID NO: 3341369 - protein, 5 aa, Plasmodium falciparum
RKETY

SEQ ID NO: 3341370 - protein, 11 aa, Plasmodium falciparum
RKEVNPSNVST

SEQ ID NO: 3341371 - protein, 8 aa, Plasmodium falciparum
RKEYDPFK

SEQ ID NO: 3341372 - protein, 8 aa, Plasmodium falciparum
RKEYEDKI

SEQ ID NO: 3341373 - protein, 20 aa, Plasmodium falciparum
RKEYEEKEKKEIKKKAAQDL

SEQ ID NO: 3341374 - protein, 23 aa, Plasmodium falciparum
RKEYVSPPFEKNKDKFKKNTKFK

SEQ ID NO: 3341375 - protein, 19 aa, Plasmodium falciparum
RKFEEDNYETSTANISCDS

SEQ ID NO: 3341376 - protein, 5 aa, Plasmodium falciparum
RKFGT

SEQ ID NO: 3341377 - protein, 20 aa, Plasmodium falciparum
RKFNDTQKKGTYKDEKDYDN

SEQ ID NO: 3341378 - protein, 6 aa, Plasmodium falciparum
RKGDKE

SEQ ID NO: 3341379 - protein, 6 aa, Plasmodium falciparum
RKGEGM

SEQ ID NO: 3341380 - protein, 4 aa, Plasmodium falciparum
RKGF

SEQ ID NO: 3341381 - protein, 87 aa, Plasmodium falciparum
RKGGKSKNGDEGQAVGNNGEKEEKEEHKGEAEEDDEDGEDDEDDEDDEDGEDDEDDEDGEDGEDDEDDEDGEDGEDDDDDEKGDNIK

SEQ ID NO: 3341382 - protein, 13 aa, Plasmodium falciparum
RKGKTKNHRNNKG

SEQ ID NO: 3341383 - protein, 17 aa, Plasmodium falciparum
RKGLQEEKKNISNGENI

SEQ ID NO: 3341384 - protein, 14 aa, Plasmodium falciparum
RKGNDNNEEDQFSE

SEQ ID NO: 3341385 - protein, 8 aa, Plasmodium falciparum
RKGNKDHE

SEQ ID NO: 3341386 - protein, 11 aa, Plasmodium falciparum
RKGNKGSSTNW

SEQ ID NO: 3341387 - protein, 9 aa, Plasmodium falciparum
RKGNNQNKQ

SEQ ID NO: 3341388 - protein, 4 aa, Plasmodium falciparum
RKGR

SEQ ID NO: 3341389 - protein, 30 aa, Plasmodium falciparum
RKGRGRGGGGKHGRTPRRRSKTYKYHEIRP

SEQ ID NO: 3341390 - protein, 5 aa, Plasmodium falciparum
RKGRH

SEQ ID NO: 3341391 - protein, 5 aa, Plasmodium falciparum
RKGSA

SEQ ID NO: 3341392 - protein, 8 aa, Plasmodium falciparum
RKGSTYEG

SEQ ID NO: 3341393 - protein, 6 aa, Plasmodium falciparum
RKHEEE

SEQ ID NO: 3341394 - protein, 12 aa, Plasmodium falciparum
RKHGRSKSMPNI

SEQ ID NO: 3341395 - protein, 5 aa, Plasmodium falciparum
RKHKD

SEQ ID NO: 3341396 - protein, 23 aa, Plasmodium falciparum
RKHKTKKDKDKDNGKDSDYYDEE

SEQ ID NO: 3341397 - protein, 5 aa, Plasmodium falciparum
RKHNP

SEQ ID NO: 3341398 - protein, 5 aa, Plasmodium falciparum
RKHSK

SEQ ID NO: 3341399 - protein, 6 aa, Plasmodium falciparum
RKHSNG

SEQ ID NO: 3341400 - protein, 4 aa, Plasmodium falciparum
RKID

SEQ ID NO: 3341401 - protein, 97 aa, Plasmodium falciparum
RKIEQANANGHHKMKEENKSVDNEKNEDGIKSVDNEKNEDGIKSVDDEKNLDDEKNLDDEKNKDDEKNKDDEKNKDDEKNKDDEKNKDDEKKSLDNF

SEQ ID NO: 3341402 - protein, 9 aa, Plasmodium falciparum
RKIKDSKRK

SEQ ID NO: 3341403 - protein, 11 aa, Plasmodium falciparum
RKIKKRKKEEC

SEQ ID NO: 3341404 - protein, 5 aa, Plasmodium falciparum
RKINE

SEQ ID NO: 3341405 - protein, 26 aa, Plasmodium falciparum
RKINSNEEIDQSDNANKKIKKNDEND

SEQ ID NO: 3341406 - protein, 14 aa, Plasmodium falciparum
RKINSTMNNTNKNG

SEQ ID NO: 3341407 - protein, 4 aa, Plasmodium falciparum
RKIS

SEQ ID NO: 3341408 - protein, 7 aa, Plasmodium falciparum
RKITDTK

SEQ ID NO: 3341409 - protein, 13 aa, Plasmodium falciparum
RKITPTFETPSGI

SEQ ID NO: 3341410 - protein, 4 aa, Plasmodium falciparum
RKKC

SEQ ID NO: 3341411 - protein, 4 aa, Plasmodium falciparum
RKKD

SEQ ID NO: 3341412 - protein, 6 aa, Plasmodium falciparum
RKKDCI

SEQ ID NO: 3341413 - protein, 41 aa, Plasmodium falciparum
RKKDEQDEQVENEKRQDYENVKRKQEENSSLDNLDNNEKEI

SEQ ID NO: 3341414 - protein, 13 aa, Plasmodium falciparum
RKKDGKLRTRKTG

SEQ ID NO: 3341415 - protein, 9 aa, Plasmodium falciparum
RKKDNAENY

SEQ ID NO: 3341416 - protein, 7 aa, Plasmodium falciparum
RKKDNHV

SEQ ID NO: 3341417 - protein, 15 aa, Plasmodium falciparum
RKKDQYDKGENASNN

SEQ ID NO: 3341418 - protein, 7 aa, Plasmodium falciparum
RKKDSDI

SEQ ID NO: 3341419 - protein, 6 aa, Plasmodium falciparum
RKKEED

SEQ ID NO: 3341420 - protein, 20 aa, Plasmodium falciparum
RKKEESRRSERSHRKSSIDD

SEQ ID NO: 3341421 - protein, 7 aa, Plasmodium falciparum
RKKEGLT

SEQ ID NO: 3341422 - protein, 25 aa, Plasmodium falciparum
RKKEKEKKKEKEKTNEQYNRDDKKR

SEQ ID NO: 3341423 - protein, 8 aa, Plasmodium falciparum
RKKEKKTL

SEQ ID NO: 3341424 - protein, 69 aa, Plasmodium falciparum
RKKENQNQNQHQNQHQNQHQNQHQNQHQNQHQNQHQNQHQNQHQNQHQNQHQNQHQNQHQNQHQNQKDT

SEQ ID NO: 3341425 - protein, 6 aa, Plasmodium falciparum
RKKGET

SEQ ID NO: 3341426 - protein, 18 aa, Plasmodium falciparum
RKKGNDNTNSDTSSSSCY

SEQ ID NO: 3341427 - protein, 20 aa, Plasmodium falciparum
RKKGNQKDMKSDKNDEVIFL

SEQ ID NO: 3341428 - protein, 25 aa, Plasmodium falciparum
RKKHRFKENDSENNNITKKKSFDEK

SEQ ID NO: 3341429 - protein, 12 aa, Plasmodium falciparum
RKKIKKNDTNKE

SEQ ID NO: 3341430 - protein, 17 aa, Plasmodium falciparum
RKKIKKNSKHESFKPTK

SEQ ID NO: 3341431 - protein, 24 aa, Plasmodium falciparum
RKKINNTNTNINKEGQEDNEHNHF

SEQ ID NO: 3341432 - protein, 10 aa, Plasmodium falciparum
RKKKEDTNKY

SEQ ID NO: 3341433 - protein, 7 aa, Plasmodium falciparum
RKKKEMR

SEQ ID NO: 3341434 - protein, 20 aa, Plasmodium falciparum
RKKKGDKEIDNEKKKDNIQK

SEQ ID NO: 3341435 - protein, 10 aa, Plasmodium falciparum
RKKKGDSNNN

SEQ ID NO: 3341436 - protein, 8 aa, Plasmodium falciparum
RKKKGEKI

SEQ ID NO: 3341437 - protein, 54 aa, Plasmodium falciparum
RKKKGKGKDKGKDKTEENHMNDTKNNSKNNSKKNNNNNNHNDNTNYSSSNDEDD

SEQ ID NO: 3341438 - protein, 9 aa, Plasmodium falciparum
RKKKKKDNK

SEQ ID NO: 3341439 - protein, 8 aa, Plasmodium falciparum
RKKKKKKK

SEQ ID NO: 3341440 - protein, 18 aa, Plasmodium falciparum
RKKKKKKKKKKKRIDISV

SEQ ID NO: 3341441 - protein, 20 aa, Plasmodium falciparum
RKKKKKKKMDSKRKYVKMLI

SEQ ID NO: 3341442 - protein, 11 aa, Plasmodium falciparum
RKKKKKKKNIH

SEQ ID NO: 3341443 - protein, 15 aa, Plasmodium falciparum
RKKKKKKNCLRKCHF

SEQ ID NO: 3341444 - protein, 7 aa, Plasmodium falciparum
RKKKKKS

SEQ ID NO: 3341445 - protein, 52 aa, Plasmodium falciparum
RKKKKTNMSNNKNNEKNEKNGNNDVINNDNNDVNNDDNNISNISSNNDVLQN

SEQ ID NO: 3341446 - protein, 41 aa, Plasmodium falciparum
RKKKNARGKYKNNDNEDNNDIDGNEKNIGNEKDKENYEEKI

SEQ ID NO: 3341447 - protein, 10 aa, Plasmodium falciparum
RKKKNENDEV

SEQ ID NO: 3341448 - protein, 13 aa, Plasmodium falciparum
RKKKNIDYSKSRA

SEQ ID NO: 3341449 - protein, 9 aa, Plasmodium falciparum
RKKKNINSS

SEQ ID NO: 3341450 - protein, 10 aa, Plasmodium falciparum
RKKKNKKHYH

SEQ ID NO: 3341451 - protein, 7 aa, Plasmodium falciparum
RKKKPLK

SEQ ID NO: 3341452 - protein, 13 aa, Plasmodium falciparum
RKKKQKKKKKKYH

SEQ ID NO: 3341453 - protein, 14 aa, Plasmodium falciparum
RKKKQKKLENYSST

SEQ ID NO: 3341454 - protein, 14 aa, Plasmodium falciparum
RKKKRVNGKINKEK

SEQ ID NO: 3341455 - protein, 25 aa, Plasmodium falciparum
RKKKSNSKKEKGKYCKKKIKMVYEN

SEQ ID NO: 3341456 - protein, 22 aa, Plasmodium falciparum
RKKKTEKKKNNYNNVESERGGI

SEQ ID NO: 3341457 - protein, 6 aa, Plasmodium falciparum
RKKKTN

SEQ ID NO: 3341458 - protein, 4 aa, Plasmodium falciparum
RKKL

SEQ ID NO: 3341459 - protein, 11 aa, Plasmodium falciparum
RKKLDDDEEDK

SEQ ID NO: 3341460 - protein, 6 aa, Plasmodium falciparum
RKKLGR

SEQ ID NO: 3341461 - protein, 7 aa, Plasmodium falciparum
RKKNELY

SEQ ID NO: 3341462 - protein, 6 aa, Plasmodium falciparum
RKKNEY

SEQ ID NO: 3341463 - protein, 6 aa, Plasmodium falciparum
RKKNGN

SEQ ID NO: 3341464 - protein, 7 aa, Plasmodium falciparum
RKKNKVS

SEQ ID NO: 3341465 - protein, 15 aa, Plasmodium falciparum
RKKNLGKTNNTTPIS

SEQ ID NO: 3341466 - protein, 16 aa, Plasmodium falciparum
RKKNNNNNNNNINDDC

SEQ ID NO: 3341467 - protein, 6 aa, Plasmodium falciparum
RKKNNT

SEQ ID NO: 3341468 - protein, 11 aa, Plasmodium falciparum
RKKNPGDNPEN

SEQ ID NO: 3341469 - protein, 9 aa, Plasmodium falciparum
RKKNTKSIT

SEQ ID NO: 3341470 - protein, 7 aa, Plasmodium falciparum
RKKNYTQ

SEQ ID NO: 3341471 - protein, 14 aa, Plasmodium falciparum
RKKQSKSNKSLENI

SEQ ID NO: 3341472 - protein, 7 aa, Plasmodium falciparum
RKKRKKK

SEQ ID NO: 3341473 - protein, 9 aa, Plasmodium falciparum
RKKRKNREP

SEQ ID NO: 3341474 - protein, 6 aa, Plasmodium falciparum
RKKRNN

SEQ ID NO: 3341475 - protein, 9 aa, Plasmodium falciparum
RKKRNRNSE

SEQ ID NO: 3341476 - protein, 8 aa, Plasmodium falciparum
RKKRQNQL

SEQ ID NO: 3341477 - protein, 8 aa, Plasmodium falciparum
RKKRRANH

SEQ ID NO: 3341478 - protein, 10 aa, Plasmodium falciparum
RKKSEKNNLN

SEQ ID NO: 3341479 - protein, 8 aa, Plasmodium falciparum
RKKSKQEN

SEQ ID NO: 3341480 - protein, 9 aa, Plasmodium falciparum
RKKSSRGNR

SEQ ID NO: 3341481 - protein, 9 aa, Plasmodium falciparum
RKKSTSEIA

SEQ ID NO: 3341482 - protein, 19 aa, Plasmodium falciparum
RKKTNLSKLDSNKNKAQKI

SEQ ID NO: 3341483 - protein, 6 aa, Plasmodium falciparum
RKKYEA

SEQ ID NO: 3341484 - protein, 7 aa, Plasmodium falciparum
RKKYEQY

SEQ ID NO: 3341485 - protein, 19 aa, Plasmodium falciparum
RKKYNNDKENKKNKKKSFT

SEQ ID NO: 3341486 - protein, 45 aa, Plasmodium falciparum
RKKYVTKEKVNEKDMKGDNNEKDMEYDNNKKDMEYDQDEKDMEYD

SEQ ID NO: 3341487 - protein, 7 aa, Plasmodium falciparum
RKLKESR

SEQ ID NO: 3341488 - protein, 5 aa, Plasmodium falciparum
RKLNE

SEQ ID NO: 3341489 - protein, 20 aa, Plasmodium falciparum
RKLRSYSTDSMEDKKNDKIS

SEQ ID NO: 3341490 - protein, 6 aa, Plasmodium falciparum
RKLSPG

SEQ ID NO: 3341491 - protein, 7 aa, Plasmodium falciparum
RKMASEV

SEQ ID NO: 3341492 - protein, 8 aa, Plasmodium falciparum
RKMENEDK

SEQ ID NO: 3341493 - protein, 10 aa, Plasmodium falciparum
RKMNENTSSR

SEQ ID NO: 3341494 - protein, 6 aa, Plasmodium falciparum
RKMTED

SEQ ID NO: 3341495 - protein, 11 aa, Plasmodium falciparum
RKNDKSRFNKE

SEQ ID NO: 3341496 - protein, 6 aa, Plasmodium falciparum
RKNDND

SEQ ID NO: 3341497 - protein, 16 aa, Plasmodium falciparum
RKNDNQEKKKKKRKIN

SEQ ID NO: 3341498 - protein, 19 aa, Plasmodium falciparum
RKNDSTSNVSNISEENQGN

SEQ ID NO: 3341499 - protein, 15 aa, Plasmodium falciparum
RKNEDLGEQEESEDI

SEQ ID NO: 3341500 - protein, 6 aa, Plasmodium falciparum
RKNEIQ

SEQ ID NO: 3341501 - protein, 9 aa, Plasmodium falciparum
RKNEKKKIT

SEQ ID NO: 3341502 - protein, 19 aa, Plasmodium falciparum
RKNEKKKMELQKNNQTNIS

SEQ ID NO: 3341503 - protein, 9 aa, Plasmodium falciparum
RKNEKNEPQ

SEQ ID NO: 3341504 - protein, 26 aa, Plasmodium falciparum
RKNENNNNLNKKDISENKEYENNKDK

SEQ ID NO: 3341505 - protein, 15 aa, Plasmodium falciparum
RKNEQHDESIKSTNP

SEQ ID NO: 3341506 - protein, 52 aa, Plasmodium falciparum
RKNEQQKQKQKQGRDGGGDGDVGGDGDVGGDGDVGGDAGGDDDVGGDDDYDY

SEQ ID NO: 3341507 - protein, 6 aa, Plasmodium falciparum
RKNETL

SEQ ID NO: 3341508 - protein, 9 aa, Plasmodium falciparum
RKNEYGKDD

SEQ ID NO: 3341509 - protein, 9 aa, Plasmodium falciparum
RKNEYTDEN

SEQ ID NO: 3341510 - protein, 6 aa, Plasmodium falciparum
RKNHSR

SEQ ID NO: 3341511 - protein, 51 aa, Plasmodium falciparum
RKNINRRNDKNYYGRNEKSGEKLKNQKKKSTYDSKTKTKISDENEYTEREE

SEQ ID NO: 3341512 - protein, 5 aa, Plasmodium falciparum
RKNIY

SEQ ID NO: 3341513 - protein, 11 aa, Plasmodium falciparum
RKNKDGDNYNK

SEQ ID NO: 3341514 - protein, 13 aa, Plasmodium falciparum
RKNKKDPHAPKRS

SEQ ID NO: 3341515 - protein, 10 aa, Plasmodium falciparum
RKNKLKEDMS

SEQ ID NO: 3341516 - protein, 36 aa, Plasmodium falciparum
RKNKPKKNSENSNKKKKKKNYTNQQAKKDKSNNNII

SEQ ID NO: 3341517 - protein, 8 aa, Plasmodium falciparum
RKNKQSEF

SEQ ID NO: 3341518 - protein, 69 aa, Plasmodium falciparum
RKNKTEGNIKNNPQKNNSKNTSVLDSKKNLKSQKLNKKLNKSNQTKQNITDNKKSNNNSTHSKKKKKIM

SEQ ID NO: 3341519 - protein, 6 aa, Plasmodium falciparum
RKNLDL

SEQ ID NO: 3341520 - protein, 4 aa, Plasmodium falciparum
RKNM

SEQ ID NO: 3341521 - protein, 6 aa, Plasmodium falciparum
RKNMEQ

SEQ ID NO: 3341522 - protein, 9 aa, Plasmodium falciparum
RKNNESQLD

SEQ ID NO: 3341523 - protein, 10 aa, Plasmodium falciparum
RKNNHNDDTH

SEQ ID NO: 3341524 - protein, 10 aa, Plasmodium falciparum
RKNNNPRDEV

SEQ ID NO: 3341525 - protein, 13 aa, Plasmodium falciparum
RKNNPSEDNYNTN

SEQ ID NO: 3341526 - protein, 9 aa, Plasmodium falciparum
RKNNQNENN

SEQ ID NO: 3341527 - protein, 9 aa, Plasmodium falciparum
RKNNSSDLL

SEQ ID NO: 3341528 - protein, 17 aa, Plasmodium falciparum
RKNPKKITKKYSNESKL

SEQ ID NO: 3341529 - protein, 33 aa, Plasmodium falciparum
RKNQNDLETLEGPQNISNKNSMNNEDIKSNTNN

SEQ ID NO: 3341530 - protein, 20 aa, Plasmodium falciparum
RKNQTNDQNNKSKDDEINEE

SEQ ID NO: 3341531 - protein, 4 aa, Plasmodium falciparum
RKNR

SEQ ID NO: 3341532 - protein, 14 aa, Plasmodium falciparum
RKNRGKDLSKNSRA

SEQ ID NO: 3341533 - protein, 10 aa, Plasmodium falciparum
RKNRNEDNKE

SEQ ID NO: 3341534 - protein, 7 aa, Plasmodium falciparum
RKNSNNE

SEQ ID NO: 3341535 - protein, 25 aa, Plasmodium falciparum
RKNTAVYDKNKNTSLNNYGQQQKKI

SEQ ID NO: 3341536 - protein, 11 aa, Plasmodium falciparum
RKNTDNSKELN

SEQ ID NO: 3341537 - protein, 19 aa, Plasmodium falciparum
RKNTYDLSDTYKKDQIKDK

SEQ ID NO: 3341538 - protein, 5 aa, Plasmodium falciparum
RKNYD

SEQ ID NO: 3341539 - protein, 5 aa, Plasmodium falciparum
RKNYY

SEQ ID NO: 3341540 - protein, 4 aa, Plasmodium falciparum
RKPD

SEQ ID NO: 3341541 - protein, 6 aa, Plasmodium falciparum
RKPDTT

SEQ ID NO: 3341542 - protein, 7 aa, Plasmodium falciparum
RKPEKTV

SEQ ID NO: 3341543 - protein, 9 aa, Plasmodium falciparum
RKPEQAAEE

SEQ ID NO: 3341544 - protein, 13 aa, Plasmodium falciparum
RKPERNQYSPSLE

SEQ ID NO: 3341545 - protein, 7 aa, Plasmodium falciparum
RKPGEEI

SEQ ID NO: 3341546 - protein, 6 aa, Plasmodium falciparum
RKPKGF

SEQ ID NO: 3341547 - protein, 24 aa, Plasmodium falciparum
RKPKNPVNTSSNTNDSTNNESSYE

SEQ ID NO: 3341548 - protein, 43 aa, Plasmodium falciparum
RKPKVETKEIKETKAESVTSEKKNNHKNNNNNNNNNNNNSNHH

SEQ ID NO: 3341549 - protein, 5 aa, Plasmodium falciparum
RKPNR

SEQ ID NO: 3341550 - protein, 5 aa, Plasmodium falciparum
RKPRG

SEQ ID NO: 3341551 - protein, 5 aa, Plasmodium falciparum
RKPRS

SEQ ID NO: 3341552 - protein, 9 aa, Plasmodium falciparum
RKPSPFRSG

SEQ ID NO: 3341553 - protein, 6 aa, Plasmodium falciparum
RKQDEN

SEQ ID NO: 3341554 - protein, 9 aa, Plasmodium falciparum
RKQEEENKN

SEQ ID NO: 3341555 - protein, 14 aa, Plasmodium falciparum
RKQEENQQKWDNEK

SEQ ID NO: 3341556 - protein, 116 aa, Plasmodium falciparum
RKQEKINHNAKHNEQGSINNAKHNEQGSINNAKHNEQDSINNAKQNEQDSINNAKHNEQDSINNAKHNEQDSINNAKHNEDDSLNNAKHNEDDSLNNAKQNEEDSLNNAKQNEEDI

SEQ ID NO: 3341557 - protein, 6 aa, Plasmodium falciparum
RKQGGG

SEQ ID NO: 3341558 - protein, 32 aa, Plasmodium falciparum
RKQGPSSMKKKKKKKKLSSDEESEGGDISDSS

SEQ ID NO: 3341559 - protein, 4 aa, Plasmodium falciparum
RKQL

SEQ ID NO: 3341560 - protein, 8 aa, Plasmodium falciparum
RKQNEEAK

SEQ ID NO: 3341561 - protein, 28 aa, Plasmodium falciparum
RKQNKGKNKRNEERRRRDMDGENNEDME

SEQ ID NO: 3341562 - protein, 8 aa, Plasmodium falciparum
RKQNQLKT

SEQ ID NO: 3341563 - protein, 21 aa, Plasmodium falciparum
RKQQDDYSKMNDKNEEKDKKY

SEQ ID NO: 3341564 - protein, 8 aa, Plasmodium falciparum
RKQTKGVE

SEQ ID NO: 3341565 - protein, 9 aa, Plasmodium falciparum
RKRDEIGEN

SEQ ID NO: 3341566 - protein, 14 aa, Plasmodium falciparum
RKRDRSSEYKIKGS

SEQ ID NO: 3341567 - protein, 9 aa, Plasmodium falciparum
RKREEHVED

SEQ ID NO: 3341568 - protein, 6 aa, Plasmodium falciparum
RKREEI

SEQ ID NO: 3341569 - protein, 44 aa, Plasmodium falciparum
RKREEKKKRRNNSYPSSNSYNSNTENDSNYRKEKIKKKKDEKEL

SEQ ID NO: 3341570 - protein, 12 aa, Plasmodium falciparum
RKREKKKRYLER

SEQ ID NO: 3341571 - protein, 9 aa, Plasmodium falciparum
RKRENEKLN

SEQ ID NO: 3341572 - protein, 9 aa, Plasmodium falciparum
RKRIEDAGG

SEQ ID NO: 3341573 - protein, 7 aa, Plasmodium falciparum
RKRIEDR

SEQ ID NO: 3341574 - protein, 11 aa, Plasmodium falciparum
RKRIGEETKIR

SEQ ID NO: 3341575 - protein, 15 aa, Plasmodium falciparum
RKRKEANKKSNSLNG

SEQ ID NO: 3341576 - protein, 7 aa, Plasmodium falciparum
RKRKEQS

SEQ ID NO: 3341577 - protein, 10 aa, Plasmodium falciparum
RKRKINGKTE

SEQ ID NO: 3341578 - protein, 17 aa, Plasmodium falciparum
RKRKKGSDSDDDDDDIE

SEQ ID NO: 3341579 - protein, 9 aa, Plasmodium falciparum
RKRKKTIEE

SEQ ID NO: 3341580 - protein, 5 aa, Plasmodium falciparum
RKRKR

SEQ ID NO: 3341581 - protein, 9 aa, Plasmodium falciparum
RKRKRKNNF

SEQ ID NO: 3341582 - protein, 12 aa, Plasmodium falciparum
RKRNEDEDSKEK

SEQ ID NO: 3341583 - protein, 11 aa, Plasmodium falciparum
RKRNNKNKTYP

SEQ ID NO: 3341584 - protein, 6 aa, Plasmodium falciparum
RKRNNN

SEQ ID NO: 3341585 - protein, 7 aa, Plasmodium falciparum
RKRQEEI

SEQ ID NO: 3341586 - protein, 5 aa, Plasmodium falciparum
RKRQN

SEQ ID NO: 3341587 - protein, 6 aa, Plasmodium falciparum
RKRRGT

SEQ ID NO: 3341588 - protein, 7 aa, Plasmodium falciparum
RKRRKKY

SEQ ID NO: 3341589 - protein, 6 aa, Plasmodium falciparum
RKRRSY

SEQ ID NO: 3341590 - protein, 6 aa, Plasmodium falciparum
RKRSKK

SEQ ID NO: 3341591 - protein, 14 aa, Plasmodium falciparum
RKRTVSSNSTRNNS

SEQ ID NO: 3341592 - protein, 7 aa, Plasmodium falciparum
RKRVSGN

SEQ ID NO: 3341593 - protein, 8 aa, Plasmodium falciparum
RKSDEESV

SEQ ID NO: 3341594 - protein, 8 aa, Plasmodium falciparum
RKSDKHKA

SEQ ID NO: 3341595 - protein, 12 aa, Plasmodium falciparum
RKSEFEKKKNEL

SEQ ID NO: 3341596 - protein, 7 aa, Plasmodium falciparum
RKSEKIE

SEQ ID NO: 3341597 - protein, 18 aa, Plasmodium falciparum
RKSGDSDFPYSDANKNSG

SEQ ID NO: 3341598 - protein, 8 aa, Plasmodium falciparum
RKSHSKSH

SEQ ID NO: 3341599 - protein, 18 aa, Plasmodium falciparum
RKSKKNCEPGEKPNPVPT

SEQ ID NO: 3341600 - protein, 10 aa, Plasmodium falciparum
RKSKQNSEGW

SEQ ID NO: 3341601 - protein, 8 aa, Plasmodium falciparum
RKSKTTTI

SEQ ID NO: 3341602 - protein, 27 aa, Plasmodium falciparum
RKSLPNASRLRKNEERDRGVLSRILRK

SEQ ID NO: 3341603 - protein, 5 aa, Plasmodium falciparum
RKSLS

SEQ ID NO: 3341604 - protein, 5 aa, Plasmodium falciparum
RKSMV

SEQ ID NO: 3341605 - protein, 43 aa, Plasmodium falciparum
RKSNKASTQNCDPDKINTHNNDDNINNKNDYINNKNKNDYNNI

SEQ ID NO: 3341606 - protein, 9 aa, Plasmodium falciparum
RKSNNKIKG

SEQ ID NO: 3341607 - protein, 9 aa, Plasmodium falciparum
RKSNPTKAK

SEQ ID NO: 3341608 - protein, 25 aa, Plasmodium falciparum
RKSNSNNNNNNNNISSSSSSSSKKN

SEQ ID NO: 3341609 - protein, 11 aa, Plasmodium falciparum
RKSPCGEGTNT

SEQ ID NO: 3341610 - protein, 7 aa, Plasmodium falciparum
RKSSYEY

SEQ ID NO: 3341611 - protein, 10 aa, Plasmodium falciparum
RKSYASNKNN

SEQ ID NO: 3341612 - protein, 5 aa, Plasmodium falciparum
RKSYK

SEQ ID NO: 3341613 - protein, 20 aa, Plasmodium falciparum
RKTDDHEHYRDSKKNKRDYL

SEQ ID NO: 3341614 - protein, 5 aa, Plasmodium falciparum
RKTDG

SEQ ID NO: 3341615 - protein, 9 aa, Plasmodium falciparum
RKTDNYNNS

SEQ ID NO: 3341616 - protein, 9 aa, Plasmodium falciparum
RKTEGPKPA

SEQ ID NO: 3341617 - protein, 35 aa, Plasmodium falciparum
RKTENEEIKDDKNLTEENKVEKKEPEDENKNKDNI

SEQ ID NO: 3341618 - protein, 11 aa, Plasmodium falciparum
RKTEWNKEEEE

SEQ ID NO: 3341619 - protein, 4 aa, Plasmodium falciparum
RKTI

SEQ ID NO: 3341620 - protein, 6 aa, Plasmodium falciparum
RKTKEE

SEQ ID NO: 3341621 - protein, 27 aa, Plasmodium falciparum
RKTKKKDKNNNWQNNSFQNNSSESNNQ

SEQ ID NO: 3341622 - protein, 4 aa, Plasmodium falciparum
RKTL

SEQ ID NO: 3341623 - protein, 18 aa, Plasmodium falciparum
RKTLPQYKPVNENRKSLQ

SEQ ID NO: 3341624 - protein, 17 aa, Plasmodium falciparum
RKTLSGNKLSKEEIHKT

SEQ ID NO: 3341625 - protein, 9 aa, Plasmodium falciparum
RKTPDVNEN

SEQ ID NO: 3341626 - protein, 6 aa, Plasmodium falciparum
RKTPNI

SEQ ID NO: 3341627 - protein, 9 aa, Plasmodium falciparum
RKTRKTFKS

SEQ ID NO: 3341628 - protein, 11 aa, Plasmodium falciparum
RKTRRSRKNKN

SEQ ID NO: 3341629 - protein, 63 aa, Plasmodium falciparum
RKTSKNSNDISKRKKKTITKTKKKTKKQKKKQKKTKTKIKNKNKTNKHKDNKGNNHFNDNEND

SEQ ID NO: 3341630 - protein, 28 aa, Plasmodium falciparum
RKTSTESEDDDVTKNIQKKRKEKKEDIN

SEQ ID NO: 3341631 - protein, 11 aa, Plasmodium falciparum
RKTYRSKKRKK

SEQ ID NO: 3341632 - protein, 14 aa, Plasmodium falciparum
RKVEEENEENSKIV

SEQ ID NO: 3341633 - protein, 4 aa, Plasmodium falciparum
RKVL

SEQ ID NO: 3341634 - protein, 9 aa, Plasmodium falciparum
RKVNNNTDN

SEQ ID NO: 3341635 - protein, 7 aa, Plasmodium falciparum
RKVNTDV

SEQ ID NO: 3341636 - protein, 17 aa, Plasmodium falciparum
RKVSTNLSRTSNARNRG

SEQ ID NO: 3341637 - protein, 14 aa, Plasmodium falciparum
RKVTQSKNAPSSIE

SEQ ID NO: 3341638 - protein, 4 aa, Plasmodium falciparum
RKYD

SEQ ID NO: 3341639 - protein, 18 aa, Plasmodium falciparum
RKYDPDYNTSDEKNIKRK

SEQ ID NO: 3341640 - protein, 7 aa, Plasmodium falciparum
RKYDSLK

SEQ ID NO: 3341641 - protein, 4 aa, Plasmodium falciparum
RKYE

SEQ ID NO: 3341642 - protein, 5 aa, Plasmodium falciparum
RKYEE

SEQ ID NO: 3341643 - protein, 12 aa, Plasmodium falciparum
RKYHGEQNVNDN

SEQ ID NO: 3341644 - protein, 7 aa, Plasmodium falciparum
RKYKNKS

SEQ ID NO: 3341645 - protein, 13 aa, Plasmodium falciparum
RKYRSENPKKGGK

SEQ ID NO: 3341646 - protein, 6 aa, Plasmodium falciparum
RKYSDG

SEQ ID NO: 3341647 - protein, 11 aa, Plasmodium falciparum
RKYSNPQNSDH

SEQ ID NO: 3341648 - protein, 48 aa, Plasmodium falciparum
RKYSRDNHVSSSMESDDYDKYDEEKYKNKRREKYKTYRKDTNYKRRHY

SEQ ID NO: 3341649 - protein, 4 aa, Plasmodium falciparum
RKYY

SEQ ID NO: 3341650 - protein, 21 aa, Plasmodium falciparum
RLANTKGKKAKRKAREKQLEQ

SEQ ID NO: 3341651 - protein, 12 aa, Plasmodium falciparum
RLDDKVKEGMDK

SEQ ID NO: 3341652 - protein, 8 aa, Plasmodium falciparum
RLDEQARG

SEQ ID NO: 3341653 - protein, 8 aa, Plasmodium falciparum
RLDTNDME

SEQ ID NO: 3341654 - protein, 13 aa, Plasmodium falciparum
RLEDDPATPNAYE

SEQ ID NO: 3341655 - protein, 4 aa, Plasmodium falciparum
RLEK

SEQ ID NO: 3341656 - protein, 4 aa, Plasmodium falciparum
RLEN

SEQ ID NO: 3341657 - protein, 20 aa, Plasmodium falciparum
RLEREKKERVEREKKGKMER

SEQ ID NO: 3341658 - protein, 4 aa, Plasmodium falciparum
RLGG

SEQ ID NO: 3341659 - protein, 12 aa, Plasmodium falciparum
RLGKSHSQSFSP

SEQ ID NO: 3341660 - protein, 9 aa, Plasmodium falciparum
RLKEEEKER

SEQ ID NO: 3341661 - protein, 14 aa, Plasmodium falciparum
RLKEEEKKKKENEK

SEQ ID NO: 3341662 - protein, 7 aa, Plasmodium falciparum
RLKEKGE

SEQ ID NO: 3341663 - protein, 8 aa, Plasmodium falciparum
RLKERERK

SEQ ID NO: 3341664 - protein, 9 aa, Plasmodium falciparum
RLKKNKENI

SEQ ID NO: 3341665 - protein, 7 aa, Plasmodium falciparum
RLKNEKT

SEQ ID NO: 3341666 - protein, 4 aa, Plasmodium falciparum
RLNE

SEQ ID NO: 3341667 - protein, 16 aa, Plasmodium falciparum
RLNTNNSRLNKESIDK

SEQ ID NO: 3341668 - protein, 9 aa, Plasmodium falciparum
RLPEKSETT

SEQ ID NO: 3341669 - protein, 4 aa, Plasmodium falciparum
RLPN

SEQ ID NO: 3341670 - protein, 5 aa, Plasmodium falciparum
RLQTG

SEQ ID NO: 3341671 - protein, 4 aa, Plasmodium falciparum
RLRE

SEQ ID NO: 3341672 - protein, 12 aa, Plasmodium falciparum
RLREKERLKQER

SEQ ID NO: 3341673 - protein, 5 aa, Plasmodium falciparum
RLRTL

SEQ ID NO: 3341674 - protein, 30 aa, Plasmodium falciparum
RLSDNEKDSLSNEFNDNKKTDDVQEKEKIE

SEQ ID NO: 3341675 - protein, 12 aa, Plasmodium falciparum
RLSNNNSDYAQR

SEQ ID NO: 3341676 - protein, 7 aa, Plasmodium falciparum
RLSRSSY

SEQ ID NO: 3341677 - protein, 9 aa, Plasmodium falciparum
RLSSSGSTT

SEQ ID NO: 3341678 - protein, 7 aa, Plasmodium falciparum
RLSTNDK

SEQ ID NO: 3341679 - protein, 23 aa, Plasmodium falciparum
RMDTNRNNNNDKNNDKNNDKVND

SEQ ID NO: 3341680 - protein, 17 aa, Plasmodium falciparum
RMEGKNDEYGDSINDDV

SEQ ID NO: 3341681 - protein, 11 aa, Plasmodium falciparum
RMGDDDSRGDI

SEQ ID NO: 3341682 - protein, 5 aa, Plasmodium falciparum
RMKNE

SEQ ID NO: 3341683 - protein, 6 aa, Plasmodium falciparum
RMKNNK

SEQ ID NO: 3341684 - protein, 5 aa, Plasmodium falciparum
RMNPG

SEQ ID NO: 3341685 - protein, 5 aa, Plasmodium falciparum
RMRSS

SEQ ID NO: 3341686 - protein, 4 aa, Plasmodium falciparum
RMSK

SEQ ID NO: 3341687 - protein, 4 aa, Plasmodium falciparum
RMSS

SEQ ID NO: 3341688 - protein, 7 aa, Plasmodium falciparum
RMTGESS

SEQ ID NO: 3341689 - protein, 7 aa, Plasmodium falciparum
RNAEQIN

SEQ ID NO: 3341690 - protein, 6 aa, Plasmodium falciparum
RNAKGY

SEQ ID NO: 3341691 - protein, 10 aa, Plasmodium falciparum
RNAQKGSVDD

SEQ ID NO: 3341692 - protein, 5 aa, Plasmodium falciparum
RNASV

SEQ ID NO: 3341693 - protein, 8 aa, Plasmodium falciparum
RNATTNDI

SEQ ID NO: 3341694 - protein, 12 aa, Plasmodium falciparum
RNCKTKKRKTNN

SEQ ID NO: 3341695 - protein, 8 aa, Plasmodium falciparum
RNDAGKTC

SEQ ID NO: 3341696 - protein, 13 aa, Plasmodium falciparum
RNDDKKKNDMDTN

SEQ ID NO: 3341697 - protein, 9 aa, Plasmodium falciparum
RNDDNSNNN

SEQ ID NO: 3341698 - protein, 5 aa, Plasmodium falciparum
RNDDV

SEQ ID NO: 3341699 - protein, 4 aa, Plasmodium falciparum
RNDE

SEQ ID NO: 3341700 - protein, 4 aa, Plasmodium falciparum
RNDF

SEQ ID NO: 3341701 - protein, 4 aa, Plasmodium falciparum
RNDI

SEQ ID NO: 3341702 - protein, 9 aa, Plasmodium falciparum
RNDKDTNIK

SEQ ID NO: 3341703 - protein, 5 aa, Plasmodium falciparum
RNDKL

SEQ ID NO: 3341704 - protein, 9 aa, Plasmodium falciparum
RNDKNIEKK

SEQ ID NO: 3341705 - protein, 8 aa, Plasmodium falciparum
RNDLDNKK

SEQ ID NO: 3341706 - protein, 5 aa, Plasmodium falciparum
RNDLY

SEQ ID NO: 3341707 - protein, 4 aa, Plasmodium falciparum
RNDM

SEQ ID NO: 3341708 - protein, 7 aa, Plasmodium falciparum
RNDNISP

SEQ ID NO: 3341709 - protein, 6 aa, Plasmodium falciparum
RNDNLQ

SEQ ID NO: 3341710 - protein, 8 aa, Plasmodium falciparum
RNDNNATN

SEQ ID NO: 3341711 - protein, 7 aa, Plasmodium falciparum
RNDNNNV

SEQ ID NO: 3341712 - protein, 13 aa, Plasmodium falciparum
RNDNNSNKQNISL

SEQ ID NO: 3341713 - protein, 17 aa, Plasmodium falciparum
RNDQNKNNNMNNDTDSN

SEQ ID NO: 3341714 - protein, 7 aa, Plasmodium falciparum
RNDTHKK

SEQ ID NO: 3341715 - protein, 8 aa, Plasmodium falciparum
RNDTSTYN

SEQ ID NO: 3341716 - protein, 16 aa, Plasmodium falciparum
RNDYNNNIEDETYDNN

SEQ ID NO: 3341717 - protein, 9 aa, Plasmodium falciparum
RNEDNNTYA

SEQ ID NO: 3341718 - protein, 8 aa, Plasmodium falciparum
RNEEGSTL

SEQ ID NO: 3341719 - protein, 7 aa, Plasmodium falciparum
RNEENEK

SEQ ID NO: 3341720 - protein, 15 aa, Plasmodium falciparum
RNEENKNKRSNNDNI

SEQ ID NO: 3341721 - protein, 7 aa, Plasmodium falciparum
RNEENMD

SEQ ID NO: 3341722 - protein, 6 aa, Plasmodium falciparum
RNEENQ

SEQ ID NO: 3341723 - protein, 10 aa, Plasmodium falciparum
RNEERSNKYK

SEQ ID NO: 3341724 - protein, 4 aa, Plasmodium falciparum
RNEG

SEQ ID NO: 3341725 - protein, 9 aa, Plasmodium falciparum
RNEGGTNLT

SEQ ID NO: 3341726 - protein, 4 aa, Plasmodium falciparum
RNEH

SEQ ID NO: 3341727 - protein, 18 aa, Plasmodium falciparum
RNEHENNNNIKKKDNIEN

SEQ ID NO: 3341728 - protein, 6 aa, Plasmodium falciparum
RNEHSN

SEQ ID NO: 3341729 - protein, 11 aa, Plasmodium falciparum
RNEKEENYTNS

SEQ ID NO: 3341730 - protein, 9 aa, Plasmodium falciparum
RNEKEKEKK

SEQ ID NO: 3341731 - protein, 9 aa, Plasmodium falciparum
RNEKKMERN

SEQ ID NO: 3341732 - protein, 10 aa, Plasmodium falciparum
RNEKNDDYYK

SEQ ID NO: 3341733 - protein, 6 aa, Plasmodium falciparum
RNEKNN

SEQ ID NO: 3341734 - protein, 14 aa, Plasmodium falciparum
RNEKNVSREKYKDI

SEQ ID NO: 3341735 - protein, 16 aa, Plasmodium falciparum
RNEKQNNEENKRRDYH

SEQ ID NO: 3341736 - protein, 9 aa, Plasmodium falciparum
RNENDEDNY

SEQ ID NO: 3341737 - protein, 7 aa, Plasmodium falciparum
RNENDSS

SEQ ID NO: 3341738 - protein, 11 aa, Plasmodium falciparum
RNENQEYKDNV

SEQ ID NO: 3341739 - protein, 9 aa, Plasmodium falciparum
RNENTQNNN

SEQ ID NO: 3341740 - protein, 6 aa, Plasmodium falciparum
RNEQEN

SEQ ID NO: 3341741 - protein, 8 aa, Plasmodium falciparum
RNEQLSDA

SEQ ID NO: 3341742 - protein, 7 aa, Plasmodium falciparum
RNEQMDN

SEQ ID NO: 3341743 - protein, 11 aa, Plasmodium falciparum
RNESSKNISNV

SEQ ID NO: 3341744 - protein, 7 aa, Plasmodium falciparum
RNETKEI

SEQ ID NO: 3341745 - protein, 15 aa, Plasmodium falciparum
RNETPSSFNEKTKNI

SEQ ID NO: 3341746 - protein, 4 aa, Plasmodium falciparum
RNEY

SEQ ID NO: 3341747 - protein, 9 aa, Plasmodium falciparum
RNEYSGDES

SEQ ID NO: 3341748 - protein, 6 aa, Plasmodium falciparum
RNFEAA

SEQ ID NO: 3341749 - protein, 6 aa, Plasmodium falciparum
RNFSSN

SEQ ID NO: 3341750 - protein, 4 aa, Plasmodium falciparum
RNGD

SEQ ID NO: 3341751 - protein, 7 aa, Plasmodium falciparum
RNGDEKD

SEQ ID NO: 3341752 - protein, 5 aa, Plasmodium falciparum
RNGEG

SEQ ID NO: 3341753 - protein, 18 aa, Plasmodium falciparum
RNGENMKEGDEKKKEIDI

SEQ ID NO: 3341754 - protein, 6 aa, Plasmodium falciparum
RNGKNE

SEQ ID NO: 3341755 - protein, 11 aa, Plasmodium falciparum
RNGNKKNENNI

SEQ ID NO: 3341756 - protein, 35 aa, Plasmodium falciparum
RNGNTGNGNKNKTNGSKGVKGEYEKKKETNGHDDY

SEQ ID NO: 3341757 - protein, 24 aa, Plasmodium falciparum
RNGTIQKPKSDEYINKQKKKSKDI

SEQ ID NO: 3341758 - protein, 4 aa, Plasmodium falciparum
RNHF

SEQ ID NO: 3341759 - protein, 7 aa, Plasmodium falciparum
RNHHDNN

SEQ ID NO: 3341760 - protein, 5 aa, Plasmodium falciparum
RNHNK

SEQ ID NO: 3341761 - protein, 4 aa, Plasmodium falciparum
RNHT

SEQ ID NO: 3341762 - protein, 15 aa, Plasmodium falciparum
RNHTTTLTKDNSNNY

SEQ ID NO: 3341763 - protein, 13 aa, Plasmodium falciparum
RNIEKEKKKKKCK

SEQ ID NO: 3341764 - protein, 6 aa, Plasmodium falciparum
RNIKEG

SEQ ID NO: 3341765 - protein, 4 aa, Plasmodium falciparum
RNIN

SEQ ID NO: 3341766 - protein, 8 aa, Plasmodium falciparum
RNINSESL

SEQ ID NO: 3341767 - protein, 23 aa, Plasmodium falciparum
RNINTNSVGSDKTYTDTNKSSIS

SEQ ID NO: 3341768 - protein, 6 aa, Plasmodium falciparum
RNIPGF

SEQ ID NO: 3341769 - protein, 7 aa, Plasmodium falciparum
RNISNSN

SEQ ID NO: 3341770 - protein, 8 aa, Plasmodium falciparum
RNISSDSL

SEQ ID NO: 3341771 - protein, 7 aa, Plasmodium falciparum
RNITNEK

SEQ ID NO: 3341772 - protein, 17 aa, Plasmodium falciparum
RNKADYARLDENDEPPI

SEQ ID NO: 3341773 - protein, 7 aa, Plasmodium falciparum
RNKDMDQ

SEQ ID NO: 3341774 - protein, 16 aa, Plasmodium falciparum
RNKDPLKEMFQRFFEK

SEQ ID NO: 3341775 - protein, 9 aa, Plasmodium falciparum
RNKDTNKYS

SEQ ID NO: 3341776 - protein, 4 aa, Plasmodium falciparum
RNKE

SEQ ID NO: 3341777 - protein, 9 aa, Plasmodium falciparum
RNKEGKNKK

SEQ ID NO: 3341778 - protein, 6 aa, Plasmodium falciparum
RNKEIV

SEQ ID NO: 3341779 - protein, 13 aa, Plasmodium falciparum
RNKENTKTTISPY

SEQ ID NO: 3341780 - protein, 6 aa, Plasmodium falciparum
RNKGEN

SEQ ID NO: 3341781 - protein, 9 aa, Plasmodium falciparum
RNKGNKKND

SEQ ID NO: 3341782 - protein, 7 aa, Plasmodium falciparum
RNKKAIE

SEQ ID NO: 3341783 - protein, 14 aa, Plasmodium falciparum
RNKKDKRKGSYEGK

SEQ ID NO: 3341784 - protein, 12 aa, Plasmodium falciparum
RNKKDKVKQNEH

SEQ ID NO: 3341785 - protein, 12 aa, Plasmodium falciparum
RNKKENSQFDDS

SEQ ID NO: 3341786 - protein, 9 aa, Plasmodium falciparum
RNKKKEDAL

SEQ ID NO: 3341787 - protein, 10 aa, Plasmodium falciparum
RNKKKEDDMD

SEQ ID NO: 3341788 - protein, 10 aa, Plasmodium falciparum
RNKKKEDDVD

SEQ ID NO: 3341789 - protein, 56 aa, Plasmodium falciparum
RNKKKEKSKRKSVSPMNKNKTKNKNKNKNNNNNKNNNNNKNNNNNNNNNKNNHHND

SEQ ID NO: 3341790 - protein, 9 aa, Plasmodium falciparum
RNKKNAEDL

SEQ ID NO: 3341791 - protein, 11 aa, Plasmodium falciparum
RNKKNEKYNIR

SEQ ID NO: 3341792 - protein, 13 aa, Plasmodium falciparum
RNKKNKKKKKIIK

SEQ ID NO: 3341793 - protein, 6 aa, Plasmodium falciparum
RNKKNQ

SEQ ID NO: 3341794 - protein, 16 aa, Plasmodium falciparum
RNKKQNKNYNNSNNDK

SEQ ID NO: 3341795 - protein, 6 aa, Plasmodium falciparum
RNKKTD

SEQ ID NO: 3341796 - protein, 19 aa, Plasmodium falciparum
RNKKTKLYKTSTNKGNTKR

SEQ ID NO: 3341797 - protein, 4 aa, Plasmodium falciparum
RNKN

SEQ ID NO: 3341798 - protein, 11 aa, Plasmodium falciparum
RNKNHNKEEDM

SEQ ID NO: 3341799 - protein, 8 aa, Plasmodium falciparum
RNKNKKKY

SEQ ID NO: 3341800 - protein, 11 aa, Plasmodium falciparum
RNKNKSTNLNA

SEQ ID NO: 3341801 - protein, 12 aa, Plasmodium falciparum
RNKNKTNNNISS

SEQ ID NO: 3341802 - protein, 6 aa, Plasmodium falciparum
RNKNNE

SEQ ID NO: 3341803 - protein, 8 aa, Plasmodium falciparum
RNKNNNKQ

SEQ ID NO: 3341804 - protein, 87 aa, Plasmodium falciparum
RNKPNESNESNEPNESNEPNEPNEPNEPNEPNEPNESNKPNESNVPNESNVPNESNESNVPNESNESNVPNEPNVPNENNESNEKNM

SEQ ID NO: 3341805 - protein, 5 aa, Plasmodium falciparum
RNKRK

SEQ ID NO: 3341806 - protein, 34 aa, Plasmodium falciparum
RNKRNSKNDNMEKHKNDVTKNENDITKNENDEII

SEQ ID NO: 3341807 - protein, 4 aa, Plasmodium falciparum
RNKS

SEQ ID NO: 3341808 - protein, 7 aa, Plasmodium falciparum
RNKSERE

SEQ ID NO: 3341809 - protein, 8 aa, Plasmodium falciparum
RNKTIDKK

SEQ ID NO: 3341810 - protein, 10 aa, Plasmodium falciparum
RNKTTQASTV

SEQ ID NO: 3341811 - protein, 15 aa, Plasmodium falciparum
RNKVKSSRSDYSEDN

SEQ ID NO: 3341812 - protein, 8 aa, Plasmodium falciparum
RNKYKPQN

SEQ ID NO: 3341813 - protein, 9 aa, Plasmodium falciparum
RNKYNINEK

SEQ ID NO: 3341814 - protein, 8 aa, Plasmodium falciparum
RNLDTENN

SEQ ID NO: 3341815 - protein, 5 aa, Plasmodium falciparum
RNLGD

SEQ ID NO: 3341816 - protein, 12 aa, Plasmodium falciparum
RNLKNRSSVQTT

SEQ ID NO: 3341817 - protein, 5 aa, Plasmodium falciparum
RNLKP

SEQ ID NO: 3341818 - protein, 7 aa, Plasmodium falciparum
RNMKNKN

SEQ ID NO: 3341819 - protein, 4 aa, Plasmodium falciparum
RNMN

SEQ ID NO: 3341820 - protein, 11 aa, Plasmodium falciparum
RNMNKDNTKKD

SEQ ID NO: 3341821 - protein, 9 aa, Plasmodium falciparum
RNNAPESAR

SEQ ID NO: 3341822 - protein, 7 aa, Plasmodium falciparum
RNNCKKN

SEQ ID NO: 3341823 - protein, 10 aa, Plasmodium falciparum
RNNDKNKSNY

SEQ ID NO: 3341824 - protein, 9 aa, Plasmodium falciparum
RNNEHDKNA

SEQ ID NO: 3341825 - protein, 14 aa, Plasmodium falciparum
RNNENERRKRQKSR

SEQ ID NO: 3341826 - protein, 12 aa, Plasmodium falciparum
RNNERERSSSCL

SEQ ID NO: 3341827 - protein, 11 aa, Plasmodium falciparum
RNNEYNSNNIE

SEQ ID NO: 3341828 - protein, 7 aa, Plasmodium falciparum
RNNGKKL

SEQ ID NO: 3341829 - protein, 5 aa, Plasmodium falciparum
RNNHN

SEQ ID NO: 3341830 - protein, 10 aa, Plasmodium falciparum
RNNHQNNDHP

SEQ ID NO: 3341831 - protein, 4 aa, Plasmodium falciparum
RNNI

SEQ ID NO: 3341832 - protein, 5 aa, Plasmodium falciparum
RNNIN

SEQ ID NO: 3341833 - protein, 9 aa, Plasmodium falciparum
RNNITDDSS

SEQ ID NO: 3341834 - protein, 6 aa, Plasmodium falciparum
RNNKED

SEQ ID NO: 3341835 - protein, 10 aa, Plasmodium falciparum
RNNKEECDTH

SEQ ID NO: 3341836 - protein, 92 aa, Plasmodium falciparum
RNNKENEEEGYDGDDNNKDGDDNNNDGDDNNDGDDNNNDGDDNNNDGDDKNYYGDDKNYYGDDNNHYGDDNNHYGDDNNHYGEEKKVKEKDK

SEQ ID NO: 3341837 - protein, 5 aa, Plasmodium falciparum
RNNKK

SEQ ID NO: 3341838 - protein, 7 aa, Plasmodium falciparum
RNNKKEN

SEQ ID NO: 3341839 - protein, 9 aa, Plasmodium falciparum
RNNKKKTDM

SEQ ID NO: 3341840 - protein, 16 aa, Plasmodium falciparum
RNNKKTKIETTQRRRY

SEQ ID NO: 3341841 - protein, 15 aa, Plasmodium falciparum
RNNKNNVSRQGYDDN

SEQ ID NO: 3341842 - protein, 9 aa, Plasmodium falciparum
RNNKNSSSP

SEQ ID NO: 3341843 - protein, 10 aa, Plasmodium falciparum
RNNKNVYDEK

SEQ ID NO: 3341844 - protein, 10 aa, Plasmodium falciparum
RNNKQNRDEY

SEQ ID NO: 3341845 - protein, 9 aa, Plasmodium falciparum
RNNKSNTNI

SEQ ID NO: 3341846 - protein, 21 aa, Plasmodium falciparum
RNNNDPNRKEKPKECDKYNKD

SEQ ID NO: 3341847 - protein, 6 aa, Plasmodium falciparum
RNNNEK

SEQ ID NO: 3341848 - protein, 6 aa, Plasmodium falciparum
RNNNKI

SEQ ID NO: 3341849 - protein, 9 aa, Plasmodium falciparum
RNNNNNFSN

SEQ ID NO: 3341850 - protein, 15 aa, Plasmodium falciparum
RNNNNNNIDNNNNNI

SEQ ID NO: 3341851 - protein, 7 aa, Plasmodium falciparum
RNNQYRG

SEQ ID NO: 3341852 - protein, 12 aa, Plasmodium falciparum
RNNRKSSNDITN

SEQ ID NO: 3341853 - protein, 17 aa, Plasmodium falciparum
RNNRNQNMNKNVKNESV

SEQ ID NO: 3341854 - protein, 26 aa, Plasmodium falciparum
RNNRNTINSVTKSNYDMSDGDNYEKG

SEQ ID NO: 3341855 - protein, 11 aa, Plasmodium falciparum
RNNSENVTESM

SEQ ID NO: 3341856 - protein, 27 aa, Plasmodium falciparum
RNNSHSSESVSLNENRGENLPKGDENE

SEQ ID NO: 3341857 - protein, 18 aa, Plasmodium falciparum
RNNSNEEKKKKKVGTPEE

SEQ ID NO: 3341858 - protein, 18 aa, Plasmodium falciparum
RNNSNSNINNSNSNIQTD

SEQ ID NO: 3341859 - protein, 7 aa, Plasmodium falciparum
RNNSNYH

SEQ ID NO: 3341860 - protein, 7 aa, Plasmodium falciparum
RNNSTLG

SEQ ID NO: 3341861 - protein, 8 aa, Plasmodium falciparum
RNNSTNDR

SEQ ID NO: 3341862 - protein, 11 aa, Plasmodium falciparum
RNNTLNEENNL

SEQ ID NO: 3341863 - protein, 6 aa, Plasmodium falciparum
RNNTNA

SEQ ID NO: 3341864 - protein, 6 aa, Plasmodium falciparum
RNNTSK

SEQ ID NO: 3341865 - protein, 7 aa, Plasmodium falciparum
RNNTSRD

SEQ ID NO: 3341866 - protein, 4 aa, Plasmodium falciparum
RNNV

SEQ ID NO: 3341867 - protein, 10 aa, Plasmodium falciparum
RNNYHNNNEN

SEQ ID NO: 3341868 - protein, 12 aa, Plasmodium falciparum
RNNYNNQNDFQN

SEQ ID NO: 3341869 - protein, 6 aa, Plasmodium falciparum
RNPDNN

SEQ ID NO: 3341870 - protein, 7 aa, Plasmodium falciparum
RNPGIDQ

SEQ ID NO: 3341871 - protein, 7 aa, Plasmodium falciparum
RNPNKNE

SEQ ID NO: 3341872 - protein, 4 aa, Plasmodium falciparum
RNPP

SEQ ID NO: 3341873 - protein, 18 aa, Plasmodium falciparum
RNPSFEKKKKKNNNNWNK

SEQ ID NO: 3341874 - protein, 9 aa, Plasmodium falciparum
RNPTNNYNN

SEQ ID NO: 3341875 - protein, 8 aa, Plasmodium falciparum
RNPYGSTK

SEQ ID NO: 3341876 - protein, 5 aa, Plasmodium falciparum
RNPYK

SEQ ID NO: 3341877 - protein, 11 aa, Plasmodium falciparum
RNQGNKKSSNI

SEQ ID NO: 3341878 - protein, 13 aa, Plasmodium falciparum
RNQKNDMTTHPTN

SEQ ID NO: 3341879 - protein, 6 aa, Plasmodium falciparum
RNQKNE

SEQ ID NO: 3341880 - protein, 26 aa, Plasmodium falciparum
RNQNKRQQSNISNSNQDTLLSTSSKY

SEQ ID NO: 3341881 - protein, 47 aa, Plasmodium falciparum
RNQQEDEKCRYQDEGEKYRYQDEGEKYRYQDEGEKYPYDDKDEKYQY

SEQ ID NO: 3341882 - protein, 27 aa, Plasmodium falciparum
RNQRKEEKDQSKYEKIKERSRSENECN

SEQ ID NO: 3341883 - protein, 6 aa, Plasmodium falciparum
RNQSEY

SEQ ID NO: 3341884 - protein, 14 aa, Plasmodium falciparum
RNRELQQQRGIITE

SEQ ID NO: 3341885 - protein, 5 aa, Plasmodium falciparum
RNRKC

SEQ ID NO: 3341886 - protein, 7 aa, Plasmodium falciparum
RNRNKNN

SEQ ID NO: 3341887 - protein, 19 aa, Plasmodium falciparum
RNRNNNRNNNRNNNSNSNS

SEQ ID NO: 3341888 - protein, 33 aa, Plasmodium falciparum
RNRRKSGDKISGNEISGNEISGNEISGNKISGK

SEQ ID NO: 3341889 - protein, 6 aa, Plasmodium falciparum
RNRSDQ

SEQ ID NO: 3341890 - protein, 5 aa, Plasmodium falciparum
RNRSM

SEQ ID NO: 3341891 - protein, 5 aa, Plasmodium falciparum
RNRYS

SEQ ID NO: 3341892 - protein, 4 aa, Plasmodium falciparum
RNSD

SEQ ID NO: 3341893 - protein, 20 aa, Plasmodium falciparum
RNSDDENGKDKDNEKNDVSL

SEQ ID NO: 3341894 - protein, 8 aa, Plasmodium falciparum
RNSDTIKH

SEQ ID NO: 3341895 - protein, 8 aa, Plasmodium falciparum
RNSEKELE

SEQ ID NO: 3341896 - protein, 9 aa, Plasmodium falciparum
RNSENEKNM

SEQ ID NO: 3341897 - protein, 13 aa, Plasmodium falciparum
RNSFNNSSNLQHT

SEQ ID NO: 3341898 - protein, 101 aa, Plasmodium falciparum
RNSISKGTSRRHNHNNNNNNNNNNNNNNNNNNNNNNNNNNNNNNNNNNNNNNNNNNNNNNNNNNNNNNNNNNNNNNNNNNNNNNNNNNNNNNNNNNNDDDY

SEQ ID NO: 3341899 - protein, 12 aa, Plasmodium falciparum
RNSKHKTSPARS

SEQ ID NO: 3341900 - protein, 5 aa, Plasmodium falciparum
RNSKN

SEQ ID NO: 3341901 - protein, 6 aa, Plasmodium falciparum
RNSNSI

SEQ ID NO: 3341902 - protein, 19 aa, Plasmodium falciparum
RNSNVKDEDKIKNTEKQSY

SEQ ID NO: 3341903 - protein, 7 aa, Plasmodium falciparum
RNSRKNH

SEQ ID NO: 3341904 - protein, 6 aa, Plasmodium falciparum
RNSRSL

SEQ ID NO: 3341905 - protein, 15 aa, Plasmodium falciparum
RNSSDGQNKHLEPGV

SEQ ID NO: 3341906 - protein, 6 aa, Plasmodium falciparum
RNSSIN

SEQ ID NO: 3341907 - protein, 10 aa, Plasmodium falciparum
RNSSKTKNKI

SEQ ID NO: 3341908 - protein, 9 aa, Plasmodium falciparum
RNSTSFEKT

SEQ ID NO: 3341909 - protein, 6 aa, Plasmodium falciparum
RNSVNA

SEQ ID NO: 3341910 - protein, 4 aa, Plasmodium falciparum
RNSY

SEQ ID NO: 3341911 - protein, 6 aa, Plasmodium falciparum
RNTDKR

SEQ ID NO: 3341912 - protein, 4 aa, Plasmodium falciparum
RNTE

SEQ ID NO: 3341913 - protein, 10 aa, Plasmodium falciparum
RNTEDGVDNY

SEQ ID NO: 3341914 - protein, 9 aa, Plasmodium falciparum
RNTENQEQI

SEQ ID NO: 3341915 - protein, 9 aa, Plasmodium falciparum
RNTERVKRN

SEQ ID NO: 3341916 - protein, 4 aa, Plasmodium falciparum
RNTI

SEQ ID NO: 3341917 - protein, 8 aa, Plasmodium falciparum
RNTKKEKI

SEQ ID NO: 3341918 - protein, 5 aa, Plasmodium falciparum
RNTMN

SEQ ID NO: 3341919 - protein, 10 aa, Plasmodium falciparum
RNTNRTPRRK

SEQ ID NO: 3341920 - protein, 5 aa, Plasmodium falciparum
RNTQH

SEQ ID NO: 3341921 - protein, 12 aa, Plasmodium falciparum
RNTSKKKRLTKR

SEQ ID NO: 3341922 - protein, 10 aa, Plasmodium falciparum
RNTSSNKCNS

SEQ ID NO: 3341923 - protein, 8 aa, Plasmodium falciparum
RNTSSSSI

SEQ ID NO: 3341924 - protein, 7 aa, Plasmodium falciparum
RNTSTLK

SEQ ID NO: 3341925 - protein, 7 aa, Plasmodium falciparum
RNTYPTD

SEQ ID NO: 3341926 - protein, 15 aa, Plasmodium falciparum
RNVEKNKKFESKDNN

SEQ ID NO: 3341927 - protein, 6 aa, Plasmodium falciparum
RNVGKT

SEQ ID NO: 3341928 - protein, 6 aa, Plasmodium falciparum
RNVGYN

SEQ ID NO: 3341929 - protein, 8 aa, Plasmodium falciparum
RNVKQAED

SEQ ID NO: 3341930 - protein, 16 aa, Plasmodium falciparum
RNVKSGKKKKKESTTS

SEQ ID NO: 3341931 - protein, 27 aa, Plasmodium falciparum
RNVNGNINGNINGNVNGNINGNVNPNM

SEQ ID NO: 3341932 - protein, 6 aa, Plasmodium falciparum
RNVNNE

SEQ ID NO: 3341933 - protein, 6 aa, Plasmodium falciparum
RNVQRK

SEQ ID NO: 3341934 - protein, 19 aa, Plasmodium falciparum
RNVSKNNKRGRKRGRRGRK

SEQ ID NO: 3341935 - protein, 14 aa, Plasmodium falciparum
RNVSKYNSSNYHEK

SEQ ID NO: 3341936 - protein, 6 aa, Plasmodium falciparum
RNVSNN

SEQ ID NO: 3341937 - protein, 16 aa, Plasmodium falciparum
RNVSSSSKDDKININN

SEQ ID NO: 3341938 - protein, 6 aa, Plasmodium falciparum
RNVSYE

SEQ ID NO: 3341939 - protein, 23 aa, Plasmodium falciparum
RNYANNSNEKNVKINKKNESSLN

SEQ ID NO: 3341940 - protein, 4 aa, Plasmodium falciparum
RNYD

SEQ ID NO: 3341941 - protein, 29 aa, Plasmodium falciparum
RNYDNKNDDDYVKNDDDYVKDDDGCVKND

SEQ ID NO: 3341942 - protein, 8 aa, Plasmodium falciparum
RNYGEEHN

SEQ ID NO: 3341943 - protein, 7 aa, Plasmodium falciparum
RNYNDKQ

SEQ ID NO: 3341944 - protein, 9 aa, Plasmodium falciparum
RNYNKNNTT

SEQ ID NO: 3341945 - protein, 8 aa, Plasmodium falciparum
RNYNPSYN

SEQ ID NO: 3341946 - protein, 5 aa, Plasmodium falciparum
RNYNS

SEQ ID NO: 3341947 - protein, 8 aa, Plasmodium falciparum
RNYTKEKI

SEQ ID NO: 3341948 - protein, 8 aa, Plasmodium falciparum
RNYTTESF

SEQ ID NO: 3341949 - protein, 4 aa, Plasmodium falciparum
RNYY

SEQ ID NO: 3341950 - protein, 17 aa, Plasmodium falciparum
RPADNYRARRKNRTVAR

SEQ ID NO: 3341951 - protein, 9 aa, Plasmodium falciparum
RPDGLRNEK

SEQ ID NO: 3341952 - protein, 8 aa, Plasmodium falciparum
RPDKYGNN

SEQ ID NO: 3341953 - protein, 11 aa, Plasmodium falciparum
RPDNNDDESGK

SEQ ID NO: 3341954 - protein, 4 aa, Plasmodium falciparum
RPDR

SEQ ID NO: 3341955 - protein, 4 aa, Plasmodium falciparum
RPDV

SEQ ID NO: 3341956 - protein, 4 aa, Plasmodium falciparum
RPEG

SEQ ID NO: 3341957 - protein, 8 aa, Plasmodium falciparum
RPENKESH

SEQ ID NO: 3341958 - protein, 5 aa, Plasmodium falciparum
RPEWA

SEQ ID NO: 3341959 - protein, 5 aa, Plasmodium falciparum
RPFKS

SEQ ID NO: 3341960 - protein, 7 aa, Plasmodium falciparum
RPGAGGQ

SEQ ID NO: 3341961 - protein, 6 aa, Plasmodium falciparum
RPGHGD

SEQ ID NO: 3341962 - protein, 4 aa, Plasmodium falciparum
RPGK

SEQ ID NO: 3341963 - protein, 11 aa, Plasmodium falciparum
RPITQKDSLSN

SEQ ID NO: 3341964 - protein, 7 aa, Plasmodium falciparum
RPKHNND

SEQ ID NO: 3341965 - protein, 7 aa, Plasmodium falciparum
RPKKKEK

SEQ ID NO: 3341966 - protein, 13 aa, Plasmodium falciparum
RPKLEEDETTVNR

SEQ ID NO: 3341967 - protein, 11 aa, Plasmodium falciparum
RPKNEKGNDIN

SEQ ID NO: 3341968 - protein, 5 aa, Plasmodium falciparum
RPKNI

SEQ ID NO: 3341969 - protein, 5 aa, Plasmodium falciparum
RPKNL

SEQ ID NO: 3341970 - protein, 6 aa, Plasmodium falciparum
RPKNPG

SEQ ID NO: 3341971 - protein, 12 aa, Plasmodium falciparum
RPKQNHEEKVST

SEQ ID NO: 3341972 - protein, 13 aa, Plasmodium falciparum
RPKRIKNSPAPIK

SEQ ID NO: 3341973 - protein, 9 aa, Plasmodium falciparum
RPKSIGKNT

SEQ ID NO: 3341974 - protein, 5 aa, Plasmodium falciparum
RPKTH

SEQ ID NO: 3341975 - protein, 4 aa, Plasmodium falciparum
RPLS

SEQ ID NO: 3341976 - protein, 5 aa, Plasmodium falciparum
RPNDK

SEQ ID NO: 3341977 - protein, 6 aa, Plasmodium falciparum
RPNGSY

SEQ ID NO: 3341978 - protein, 8 aa, Plasmodium falciparum
RPNHNQNN

SEQ ID NO: 3341979 - protein, 6 aa, Plasmodium falciparum
RPNKSF

SEQ ID NO: 3341980 - protein, 4 aa, Plasmodium falciparum
RPNV

SEQ ID NO: 3341981 - protein, 12 aa, Plasmodium falciparum
RPPFGSTNEERE

SEQ ID NO: 3341982 - protein, 12 aa, Plasmodium falciparum
RPPKGDKKTNIS

SEQ ID NO: 3341983 - protein, 4 aa, Plasmodium falciparum
RPPL

SEQ ID NO: 3341984 - protein, 5 aa, Plasmodium falciparum
RPPMY

SEQ ID NO: 3341985 - protein, 4 aa, Plasmodium falciparum
RPPQ

SEQ ID NO: 3341986 - protein, 4 aa, Plasmodium falciparum
RPQE

SEQ ID NO: 3341987 - protein, 5 aa, Plasmodium falciparum
RPQED

SEQ ID NO: 3341988 - protein, 15 aa, Plasmodium falciparum
RPQPQYRTDRDENDN

SEQ ID NO: 3341989 - protein, 8 aa, Plasmodium falciparum
RPQQGPSI

SEQ ID NO: 3341990 - protein, 6 aa, Plasmodium falciparum
RPQYES

SEQ ID NO: 3341991 - protein, 4 aa, Plasmodium falciparum
RPRK

SEQ ID NO: 3341992 - protein, 13 aa, Plasmodium falciparum
RPRKKGERKRKSV

SEQ ID NO: 3341993 - protein, 16 aa, Plasmodium falciparum
RPSKPVNVKTSSDEEN

SEQ ID NO: 3341994 - protein, 4 aa, Plasmodium falciparum
RPSN

SEQ ID NO: 3341995 - protein, 10 aa, Plasmodium falciparum
RPSNSDPSLL

SEQ ID NO: 3341996 - protein, 10 aa, Plasmodium falciparum
RPSQTLTEKK

SEQ ID NO: 3341997 - protein, 5 aa, Plasmodium falciparum
RPSQY

SEQ ID NO: 3341998 - protein, 7 aa, Plasmodium falciparum
RPTEEEI

SEQ ID NO: 3341999 - protein, 5 aa, Plasmodium falciparum
RPTGN

SEQ ID NO: 3342000 - protein, 8 aa, Plasmodium falciparum
RPTKENNL

SEQ ID NO: 3342001 - protein, 8 aa, Plasmodium falciparum
RPTKKASE

SEQ ID NO: 3342002 - protein, 5 aa, Plasmodium falciparum
RPTKN

SEQ ID NO: 3342003 - protein, 4 aa, Plasmodium falciparum
RPTN

SEQ ID NO: 3342004 - protein, 4 aa, Plasmodium falciparum
RPTP

SEQ ID NO: 3342005 - protein, 4 aa, Plasmodium falciparum
RPTY

SEQ ID NO: 3342006 - protein, 5 aa, Plasmodium falciparum
RPVSD

SEQ ID NO: 3342007 - protein, 7 aa, Plasmodium falciparum
RPYPNQS

SEQ ID NO: 3342008 - protein, 5 aa, Plasmodium falciparum
RQAAL

SEQ ID NO: 3342009 - protein, 9 aa, Plasmodium falciparum
RQDDDKASN

SEQ ID NO: 3342010 - protein, 5 aa, Plasmodium falciparum
RQDEI

SEQ ID NO: 3342011 - protein, 7 aa, Plasmodium falciparum
RQDPYGL

SEQ ID NO: 3342012 - protein, 10 aa, Plasmodium falciparum
RQEAEKAGAR

SEQ ID NO: 3342013 - protein, 10 aa, Plasmodium falciparum
RQEKAQSTNN

SEQ ID NO: 3342014 - protein, 6 aa, Plasmodium falciparum
RQESVS

SEQ ID NO: 3342015 - protein, 7 aa, Plasmodium falciparum
RQGNNNM

SEQ ID NO: 3342016 - protein, 6 aa, Plasmodium falciparum
RQGSGT

SEQ ID NO: 3342017 - protein, 6 aa, Plasmodium falciparum
RQHELK

SEQ ID NO: 3342018 - protein, 9 aa, Plasmodium falciparum
RQHQAGSDS

SEQ ID NO: 3342019 - protein, 11 aa, Plasmodium falciparum
RQHSVKEKNNI

SEQ ID NO: 3342020 - protein, 8 aa, Plasmodium falciparum
RQIKQGRL

SEQ ID NO: 3342021 - protein, 5 aa, Plasmodium falciparum
RQKDS

SEQ ID NO: 3342022 - protein, 8 aa, Plasmodium falciparum
RQKEDENI

SEQ ID NO: 3342023 - protein, 11 aa, Plasmodium falciparum
RQKEKDITKER

SEQ ID NO: 3342024 - protein, 8 aa, Plasmodium falciparum
RQKENNNI

SEQ ID NO: 3342025 - protein, 8 aa, Plasmodium falciparum
RQKKEDLE

SEQ ID NO: 3342026 - protein, 13 aa, Plasmodium falciparum
RQKKKKKKKKRKN

SEQ ID NO: 3342027 - protein, 12 aa, Plasmodium falciparum
RQKKKNPSIEKK

SEQ ID NO: 3342028 - protein, 5 aa, Plasmodium falciparum
RQKKL

SEQ ID NO: 3342029 - protein, 4 aa, Plasmodium falciparum
RQKS

SEQ ID NO: 3342030 - protein, 9 aa, Plasmodium falciparum
RQKSYEKNF

SEQ ID NO: 3342031 - protein, 7 aa, Plasmodium falciparum
RQKTGSV

SEQ ID NO: 3342032 - protein, 5 aa, Plasmodium falciparum
RQKTL

SEQ ID NO: 3342033 - protein, 7 aa, Plasmodium falciparum
RQNEELK

SEQ ID NO: 3342034 - protein, 8 aa, Plasmodium falciparum
RQNGESDA

SEQ ID NO: 3342035 - protein, 13 aa, Plasmodium falciparum
RQNKDENSKHSQE

SEQ ID NO: 3342036 - protein, 13 aa, Plasmodium falciparum
RQNKGSKYEEITT

SEQ ID NO: 3342037 - protein, 8 aa, Plasmodium falciparum
RQNKQKKT

SEQ ID NO: 3342038 - protein, 12 aa, Plasmodium falciparum
RQNNVKKNSEYM

SEQ ID NO: 3342039 - protein, 7 aa, Plasmodium falciparum
RQNPKNC

SEQ ID NO: 3342040 - protein, 21 aa, Plasmodium falciparum
RQNQQEKVEKKGEKKKKKKNL

SEQ ID NO: 3342041 - protein, 6 aa, Plasmodium falciparum
RQNSNP

SEQ ID NO: 3342042 - protein, 14 aa, Plasmodium falciparum
RQNTDNDHDENTYD

SEQ ID NO: 3342043 - protein, 24 aa, Plasmodium falciparum
RQPKSNKINDSDNSSDDSEKDLDN

SEQ ID NO: 3342044 - protein, 11 aa, Plasmodium falciparum
RQPSSDNANNS

SEQ ID NO: 3342045 - protein, 13 aa, Plasmodium falciparum
RQPTEGRSKEGGL

SEQ ID NO: 3342046 - protein, 12 aa, Plasmodium falciparum
RQQEEHEQNEEE

SEQ ID NO: 3342047 - protein, 48 aa, Plasmodium falciparum
RQQEKKLNSNKSAESNDKKKKKNEENNTEKVNKVTTNVPKRNDTLEED

SEQ ID NO: 3342048 - protein, 8 aa, Plasmodium falciparum
RQRGTQTV

SEQ ID NO: 3342049 - protein, 6 aa, Plasmodium falciparum
RQSQNN

SEQ ID NO: 3342050 - protein, 9 aa, Plasmodium falciparum
RQTDRGAKS

SEQ ID NO: 3342051 - protein, 7 aa, Plasmodium falciparum
RQTGKTA

SEQ ID NO: 3342052 - protein, 23 aa, Plasmodium falciparum
RQTKGRKKTFYDSNNVGNSGSTD

SEQ ID NO: 3342053 - protein, 8 aa, Plasmodium falciparum
RQTNNNRV

SEQ ID NO: 3342054 - protein, 4 aa, Plasmodium falciparum
RQTR

SEQ ID NO: 3342055 - protein, 13 aa, Plasmodium falciparum
RQVSSSVNSSKSL

SEQ ID NO: 3342056 - protein, 6 aa, Plasmodium falciparum
RRAGKK

SEQ ID NO: 3342057 - protein, 9 aa, Plasmodium falciparum
RRDKRGSSY

SEQ ID NO: 3342058 - protein, 4 aa, Plasmodium falciparum
RRDN

SEQ ID NO: 3342059 - protein, 5 aa, Plasmodium falciparum
RRDPY

SEQ ID NO: 3342060 - protein, 6 aa, Plasmodium falciparum
RRDRKT

SEQ ID NO: 3342061 - protein, 10 aa, Plasmodium falciparum
RRDTLSSREI

SEQ ID NO: 3342062 - protein, 9 aa, Plasmodium falciparum
RREEGKIDS

SEQ ID NO: 3342063 - protein, 33 aa, Plasmodium falciparum
RREKKKNKKKSKEKIKKKKKTLQDGKHIGNTND

SEQ ID NO: 3342064 - protein, 4 aa, Plasmodium falciparum
RREQ

SEQ ID NO: 3342065 - protein, 5 aa, Plasmodium falciparum
RRGEK

SEQ ID NO: 3342066 - protein, 9 aa, Plasmodium falciparum
RRGGGEFRR

SEQ ID NO: 3342067 - protein, 12 aa, Plasmodium falciparum
RRGNAATITSND

SEQ ID NO: 3342068 - protein, 5 aa, Plasmodium falciparum
RRGRK

SEQ ID NO: 3342069 - protein, 104 aa, Plasmodium falciparum
RRGRNSHSNNSYETSSEEHNDKSSSDEHRRRRRDRNRDRERDRDRERDRDRERDRDRERDRDRERDRDRDRDRDRDRERRSIREERSGRDDKYDRRKKRRHSNL

SEQ ID NO: 3342070 - protein, 10 aa, Plasmodium falciparum
RRGRPPGSTK

SEQ ID NO: 3342071 - protein, 14 aa, Plasmodium falciparum
RRGRRRKKDIEQYS

SEQ ID NO: 3342072 - protein, 8 aa, Plasmodium falciparum
RRGYSPDA

SEQ ID NO: 3342073 - protein, 32 aa, Plasmodium falciparum
RRHEKKKKLKKSKNKKHKNNEKKNEKRDNSPY

SEQ ID NO: 3342074 - protein, 10 aa, Plasmodium falciparum
RRKANGGTPI

SEQ ID NO: 3342075 - protein, 4 aa, Plasmodium falciparum
RRKF

SEQ ID NO: 3342076 - protein, 8 aa, Plasmodium falciparum
RRKGLSED

SEQ ID NO: 3342077 - protein, 17 aa, Plasmodium falciparum
RRKGSEEKQKKDKKDEI

SEQ ID NO: 3342078 - protein, 8 aa, Plasmodium falciparum
RRKIEKNN

SEQ ID NO: 3342079 - protein, 6 aa, Plasmodium falciparum
RRKINK

SEQ ID NO: 3342080 - protein, 11 aa, Plasmodium falciparum
RRKKKDNNKEY

SEQ ID NO: 3342081 - protein, 8 aa, Plasmodium falciparum
RRKKKNDD

SEQ ID NO: 3342082 - protein, 5 aa, Plasmodium falciparum
RRKMT

SEQ ID NO: 3342083 - protein, 13 aa, Plasmodium falciparum
RRKNDSAENSNEC

SEQ ID NO: 3342084 - protein, 10 aa, Plasmodium falciparum
RRKNKKKKKK

SEQ ID NO: 3342085 - protein, 12 aa, Plasmodium falciparum
RRKNRSEESLTK

SEQ ID NO: 3342086 - protein, 8 aa, Plasmodium falciparum
RRKRKKRN

SEQ ID NO: 3342087 - protein, 7 aa, Plasmodium falciparum
RRKSPDT

SEQ ID NO: 3342088 - protein, 19 aa, Plasmodium falciparum
RRKTLDDIGKDGVKDKEDG

SEQ ID NO: 3342089 - protein, 16 aa, Plasmodium falciparum
RRKTNNNNINEPIDDE

SEQ ID NO: 3342090 - protein, 20 aa, Plasmodium falciparum
RRKYSKKEFEDYQKEKTSEK

SEQ ID NO: 3342091 - protein, 5 aa, Plasmodium falciparum
RRNDN

SEQ ID NO: 3342092 - protein, 4 aa, Plasmodium falciparum
RRNI

SEQ ID NO: 3342093 - protein, 6 aa, Plasmodium falciparum
RRNKEI

SEQ ID NO: 3342094 - protein, 4 aa, Plasmodium falciparum
RRNL

SEQ ID NO: 3342095 - protein, 4 aa, Plasmodium falciparum
RRNM

SEQ ID NO: 3342096 - protein, 10 aa, Plasmodium falciparum
RRNNKDKSKA

SEQ ID NO: 3342097 - protein, 20 aa, Plasmodium falciparum
RRNNMNSNTCGKNKDDNNIK

SEQ ID NO: 3342098 - protein, 15 aa, Plasmodium falciparum
RRNNRNHQINTPNQL

SEQ ID NO: 3342099 - protein, 5 aa, Plasmodium falciparum
RRNPE

SEQ ID NO: 3342100 - protein, 10 aa, Plasmodium falciparum
RRNPNDAKLY

SEQ ID NO: 3342101 - protein, 7 aa, Plasmodium falciparum
RRNPVPK

SEQ ID NO: 3342102 - protein, 6 aa, Plasmodium falciparum
RRNRNS

SEQ ID NO: 3342103 - protein, 7 aa, Plasmodium falciparum
RRNYDDE

SEQ ID NO: 3342104 - protein, 8 aa, Plasmodium falciparum
RRPQRKAA

SEQ ID NO: 3342105 - protein, 4 aa, Plasmodium falciparum
RRPT

SEQ ID NO: 3342106 - protein, 6 aa, Plasmodium falciparum
RRPVSN

SEQ ID NO: 3342107 - protein, 8 aa, Plasmodium falciparum
RRQDKNDA

SEQ ID NO: 3342108 - protein, 7 aa, Plasmodium falciparum
RRQEAQR

SEQ ID NO: 3342109 - protein, 5 aa, Plasmodium falciparum
RRQEQ

SEQ ID NO: 3342110 - protein, 6 aa, Plasmodium falciparum
RRQNRP

SEQ ID NO: 3342111 - protein, 14 aa, Plasmodium falciparum
RRRDRSRDDRDRNY

SEQ ID NO: 3342112 - protein, 11 aa, Plasmodium falciparum
RRREGKTDYRA

SEQ ID NO: 3342113 - protein, 13 aa, Plasmodium falciparum
RRRGKNDNEGEKR

SEQ ID NO: 3342114 - protein, 25 aa, Plasmodium falciparum
RRRGPRKSQITTSNKKINKSELAGG

SEQ ID NO: 3342115 - protein, 10 aa, Plasmodium falciparum
RRRGRPKASE

SEQ ID NO: 3342116 - protein, 20 aa, Plasmodium falciparum
RRRIRSRRRRRRRQRPEEVG

SEQ ID NO: 3342117 - protein, 15 aa, Plasmodium falciparum
RRRKNNYNNKSHGKY

SEQ ID NO: 3342118 - protein, 13 aa, Plasmodium falciparum
RRRKSQEEMNSND

SEQ ID NO: 3342119 - protein, 4 aa, Plasmodium falciparum
RRRN

SEQ ID NO: 3342120 - protein, 18 aa, Plasmodium falciparum
RRRNKNSLAHNNEQEMEE

SEQ ID NO: 3342121 - protein, 18 aa, Plasmodium falciparum
RRRNQKKKLKDSSNYKSD

SEQ ID NO: 3342122 - protein, 11 aa, Plasmodium falciparum
RRRPTYSPTAR

SEQ ID NO: 3342123 - protein, 5 aa, Plasmodium falciparum
RRRQE

SEQ ID NO: 3342124 - protein, 6 aa, Plasmodium falciparum
RRRRKK

SEQ ID NO: 3342125 - protein, 7 aa, Plasmodium falciparum
RRRSENC

SEQ ID NO: 3342126 - protein, 5 aa, Plasmodium falciparum
RRRSS

SEQ ID NO: 3342127 - protein, 82 aa, Plasmodium falciparum
RRSKNIKEKNHHSKEKDKKDQDVKGKNKADDNIKRKEKGDDEIKRKDKPLDDIKEKEQIKYEAKNKDHKMKEEISEGKENLK

SEQ ID NO: 3342128 - protein, 9 aa, Plasmodium falciparum
RRSKSRGSG

SEQ ID NO: 3342129 - protein, 9 aa, Plasmodium falciparum
RRSNSDNLN

SEQ ID NO: 3342130 - protein, 11 aa, Plasmodium falciparum
RRSRSRSPRRI

SEQ ID NO: 3342131 - protein, 13 aa, Plasmodium falciparum
RRSRYKDSRDRNK

SEQ ID NO: 3342132 - protein, 14 aa, Plasmodium falciparum
RRSSRHKKSSERYH

SEQ ID NO: 3342133 - protein, 27 aa, Plasmodium falciparum
RRSYSDSSSKDSEMNSYSSKEEDDYID

SEQ ID NO: 3342134 - protein, 19 aa, Plasmodium falciparum
RRTRRRSKISKTHKVTKED

SEQ ID NO: 3342135 - protein, 6 aa, Plasmodium falciparum
RRVSPK

SEQ ID NO: 3342136 - protein, 7 aa, Plasmodium falciparum
RSADEGS

SEQ ID NO: 3342137 - protein, 6 aa, Plasmodium falciparum
RSCSQP

SEQ ID NO: 3342138 - protein, 13 aa, Plasmodium falciparum
RSCTSSQNTYDEE

SEQ ID NO: 3342139 - protein, 7 aa, Plasmodium falciparum
RSDDEKE

SEQ ID NO: 3342140 - protein, 14 aa, Plasmodium falciparum
RSDDNNDNSSSSDS

SEQ ID NO: 3342141 - protein, 4 aa, Plasmodium falciparum
RSDH

SEQ ID NO: 3342142 - protein, 6 aa, Plasmodium falciparum
RSDKLG

SEQ ID NO: 3342143 - protein, 26 aa, Plasmodium falciparum
RSDKLNSLKSDKLNSLKSDKINSLRS

SEQ ID NO: 3342144 - protein, 4 aa, Plasmodium falciparum
RSDL

SEQ ID NO: 3342145 - protein, 5 aa, Plasmodium falciparum
RSDLM

SEQ ID NO: 3342146 - protein, 7 aa, Plasmodium falciparum
RSDTKNI

SEQ ID NO: 3342147 - protein, 7 aa, Plasmodium falciparum
RSEAENK

SEQ ID NO: 3342148 - protein, 5 aa, Plasmodium falciparum
RSEAS

SEQ ID NO: 3342149 - protein, 8 aa, Plasmodium falciparum
RSEGEENY

SEQ ID NO: 3342150 - protein, 7 aa, Plasmodium falciparum
RSEHEPE

SEQ ID NO: 3342151 - protein, 8 aa, Plasmodium falciparum
RSEKEQQN

SEQ ID NO: 3342152 - protein, 17 aa, Plasmodium falciparum
RSEKEYNNNNSDKVENK

SEQ ID NO: 3342153 - protein, 15 aa, Plasmodium falciparum
RSEKKTLKEKKNEMN

SEQ ID NO: 3342154 - protein, 7 aa, Plasmodium falciparum
RSELKNE

SEQ ID NO: 3342155 - protein, 4 aa, Plasmodium falciparum
RSEM

SEQ ID NO: 3342156 - protein, 11 aa, Plasmodium falciparum
RSENGLDEEES

SEQ ID NO: 3342157 - protein, 4 aa, Plasmodium falciparum
RSER

SEQ ID NO: 3342158 - protein, 10 aa, Plasmodium falciparum
RSERTRSKLQ

SEQ ID NO: 3342159 - protein, 4 aa, Plasmodium falciparum
RSET

SEQ ID NO: 3342160 - protein, 35 aa, Plasmodium falciparum
RSFAKSKEDERNKSEEDLSEDDKNKDYSSASESNF

SEQ ID NO: 3342161 - protein, 14 aa, Plasmodium falciparum
RSFKRKSIDEQEDY

SEQ ID NO: 3342162 - protein, 7 aa, Plasmodium falciparum
RSGATFS

SEQ ID NO: 3342163 - protein, 6 aa, Plasmodium falciparum
RSGDYD

SEQ ID NO: 3342164 - protein, 6 aa, Plasmodium falciparum
RSGETE

SEQ ID NO: 3342165 - protein, 5 aa, Plasmodium falciparum
RSGGF

SEQ ID NO: 3342166 - protein, 12 aa, Plasmodium falciparum
RSGGKGGQNVNK

SEQ ID NO: 3342167 - protein, 9 aa, Plasmodium falciparum
RSGGKSYIS

SEQ ID NO: 3342168 - protein, 19 aa, Plasmodium falciparum
RSGGLRKPQKVTNDPESIN

SEQ ID NO: 3342169 - protein, 9 aa, Plasmodium falciparum
RSGKSTQSK

SEQ ID NO: 3342170 - protein, 15 aa, Plasmodium falciparum
RSGPLDNSQNVSQSN

SEQ ID NO: 3342171 - protein, 15 aa, Plasmodium falciparum
RSGRDLTNMSKKRSN

SEQ ID NO: 3342172 - protein, 5 aa, Plasmodium falciparum
RSGRY

SEQ ID NO: 3342173 - protein, 10 aa, Plasmodium falciparum
RSGTDDEEQV

SEQ ID NO: 3342174 - protein, 8 aa, Plasmodium falciparum
RSINPDEA

SEQ ID NO: 3342175 - protein, 14 aa, Plasmodium falciparum
RSISPEQVEDQQND

SEQ ID NO: 3342176 - protein, 5 aa, Plasmodium falciparum
RSISS

SEQ ID NO: 3342177 - protein, 71 aa, Plasmodium falciparum
RSISSDEEHYSKNKKRTKRRKSRHNIDKDSYSSSSNSTHRRRNRKSSSSNNTRKDDNNSIQKKRKKSKWDT

SEQ ID NO: 3342178 - protein, 8 aa, Plasmodium falciparum
RSITDNND

SEQ ID NO: 3342179 - protein, 19 aa, Plasmodium falciparum
RSITKENNKMNSSFPKSTP

SEQ ID NO: 3342180 - protein, 8 aa, Plasmodium falciparum
RSKDNQSL

SEQ ID NO: 3342181 - protein, 7 aa, Plasmodium falciparum
RSKECKA

SEQ ID NO: 3342182 - protein, 10 aa, Plasmodium falciparum
RSKEETSENI

SEQ ID NO: 3342183 - protein, 5 aa, Plasmodium falciparum
RSKEN

SEQ ID NO: 3342184 - protein, 11 aa, Plasmodium falciparum
RSKEPKKPKKI

SEQ ID NO: 3342185 - protein, 10 aa, Plasmodium falciparum
RSKGEANSEW

SEQ ID NO: 3342186 - protein, 15 aa, Plasmodium falciparum
RSKKKSVDKDIKGSN

SEQ ID NO: 3342187 - protein, 8 aa, Plasmodium falciparum
RSKKRYND

SEQ ID NO: 3342188 - protein, 8 aa, Plasmodium falciparum
RSKNNSNK

SEQ ID NO: 3342189 - protein, 4 aa, Plasmodium falciparum
RSKQ

SEQ ID NO: 3342190 - protein, 9 aa, Plasmodium falciparum
RSKRERNKY

SEQ ID NO: 3342191 - protein, 15 aa, Plasmodium falciparum
RSKRINNDEEGDEDD

SEQ ID NO: 3342192 - protein, 8 aa, Plasmodium falciparum
RSKSESSI

SEQ ID NO: 3342193 - protein, 12 aa, Plasmodium falciparum
RSKSFEERNSRV

SEQ ID NO: 3342194 - protein, 7 aa, Plasmodium falciparum
RSKSNNN

SEQ ID NO: 3342195 - protein, 4 aa, Plasmodium falciparum
RSKT

SEQ ID NO: 3342196 - protein, 6 aa, Plasmodium falciparum
RSKTMN

SEQ ID NO: 3342197 - protein, 22 aa, Plasmodium falciparum
RSLDHEKDYKYSRNNKDDNYHN

SEQ ID NO: 3342198 - protein, 7 aa, Plasmodium falciparum
RSLDSST

SEQ ID NO: 3342199 - protein, 10 aa, Plasmodium falciparum
RSLECNPNEA

SEQ ID NO: 3342200 - protein, 23 aa, Plasmodium falciparum
RSMQGQNNNNITRNMNNSNNTYN

SEQ ID NO: 3342201 - protein, 9 aa, Plasmodium falciparum
RSNDNTSNF

SEQ ID NO: 3342202 - protein, 6 aa, Plasmodium falciparum
RSNENG

SEQ ID NO: 3342203 - protein, 5 aa, Plasmodium falciparum
RSNER

SEQ ID NO: 3342204 - protein, 12 aa, Plasmodium falciparum
RSNFTRDDNSIK

SEQ ID NO: 3342205 - protein, 4 aa, Plasmodium falciparum
RSNI

SEQ ID NO: 3342206 - protein, 7 aa, Plasmodium falciparum
RSNIKKS

SEQ ID NO: 3342207 - protein, 30 aa, Plasmodium falciparum
RSNISAEDNNRNAQLEKEKDEDVRRDDEEN

SEQ ID NO: 3342208 - protein, 6 aa, Plasmodium falciparum
RSNKNS

SEQ ID NO: 3342209 - protein, 29 aa, Plasmodium falciparum
RSNNKTQCSEQKNKGIAVGREDNKKNTNS

SEQ ID NO: 3342210 - protein, 11 aa, Plasmodium falciparum
RSNNMENNNEQ

SEQ ID NO: 3342211 - protein, 9 aa, Plasmodium falciparum
RSNNNKIAK

SEQ ID NO: 3342212 - protein, 8 aa, Plasmodium falciparum
RSNNYDNS

SEQ ID NO: 3342213 - protein, 20 aa, Plasmodium falciparum
RSNSGSVKKIKNENDQKEIK

SEQ ID NO: 3342214 - protein, 9 aa, Plasmodium falciparum
RSNSYTDTS

SEQ ID NO: 3342215 - protein, 9 aa, Plasmodium falciparum
RSNTTPENL

SEQ ID NO: 3342216 - protein, 10 aa, Plasmodium falciparum
RSNVSTYKNN

SEQ ID NO: 3342217 - protein, 4 aa, Plasmodium falciparum
RSNY

SEQ ID NO: 3342218 - protein, 5 aa, Plasmodium falciparum
RSNYK

SEQ ID NO: 3342219 - protein, 30 aa, Plasmodium falciparum
RSNYKKNSSRDELNNDTYNKYYDDSNDVRK

SEQ ID NO: 3342220 - protein, 6 aa, Plasmodium falciparum
RSPDGA

SEQ ID NO: 3342221 - protein, 7 aa, Plasmodium falciparum
RSPDPSM

SEQ ID NO: 3342222 - protein, 8 aa, Plasmodium falciparum
RSPDTENL

SEQ ID NO: 3342223 - protein, 6 aa, Plasmodium falciparum
RSPKWR

SEQ ID NO: 3342224 - protein, 4 aa, Plasmodium falciparum
RSPL

SEQ ID NO: 3342225 - protein, 7 aa, Plasmodium falciparum
RSPLQSN

SEQ ID NO: 3342226 - protein, 4 aa, Plasmodium falciparum
RSPN

SEQ ID NO: 3342227 - protein, 10 aa, Plasmodium falciparum
RSPSGCKRTK

SEQ ID NO: 3342228 - protein, 12 aa, Plasmodium falciparum
RSQDEEVGDGTT

SEQ ID NO: 3342229 - protein, 16 aa, Plasmodium falciparum
RSQENIQNKVNTKWSN

SEQ ID NO: 3342230 - protein, 5 aa, Plasmodium falciparum
RSQIE

SEQ ID NO: 3342231 - protein, 6 aa, Plasmodium falciparum
RSQKND

SEQ ID NO: 3342232 - protein, 9 aa, Plasmodium falciparum
RSQRNQDPN

SEQ ID NO: 3342233 - protein, 5 aa, Plasmodium falciparum
RSQSC

SEQ ID NO: 3342234 - protein, 8 aa, Plasmodium falciparum
RSQSDNLY

SEQ ID NO: 3342235 - protein, 5 aa, Plasmodium falciparum
RSQYA

SEQ ID NO: 3342236 - protein, 10 aa, Plasmodium falciparum
RSQYNNNNHC

SEQ ID NO: 3342237 - protein, 5 aa, Plasmodium falciparum
RSRLS

SEQ ID NO: 3342238 - protein, 7 aa, Plasmodium falciparum
RSSAKKV

SEQ ID NO: 3342239 - protein, 7 aa, Plasmodium falciparum
RSSAQSI

SEQ ID NO: 3342240 - protein, 7 aa, Plasmodium falciparum
RSSDEKL

SEQ ID NO: 3342241 - protein, 6 aa, Plasmodium falciparum
RSSEFR

SEQ ID NO: 3342242 - protein, 8 aa, Plasmodium falciparum
RSSESTKD

SEQ ID NO: 3342243 - protein, 6 aa, Plasmodium falciparum
RSSGAA

SEQ ID NO: 3342244 - protein, 7 aa, Plasmodium falciparum
RSSHHKN

SEQ ID NO: 3342245 - protein, 7 aa, Plasmodium falciparum
RSSITKK

SEQ ID NO: 3342246 - protein, 15 aa, Plasmodium falciparum
RSSKDDPNTCDNPEG

SEQ ID NO: 3342247 - protein, 14 aa, Plasmodium falciparum
RSSKLNDNLKGGSL

SEQ ID NO: 3342248 - protein, 21 aa, Plasmodium falciparum
RSSKRNDKTKQNSTVKDASKN

SEQ ID NO: 3342249 - protein, 14 aa, Plasmodium falciparum
RSSLKSNKNTYKKS

SEQ ID NO: 3342250 - protein, 7 aa, Plasmodium falciparum
RSSLPSE

SEQ ID NO: 3342251 - protein, 4 aa, Plasmodium falciparum
RSSN

SEQ ID NO: 3342252 - protein, 6 aa, Plasmodium falciparum
RSSNKR

SEQ ID NO: 3342253 - protein, 13 aa, Plasmodium falciparum
RSSSGSFSEKSDF

SEQ ID NO: 3342254 - protein, 6 aa, Plasmodium falciparum
RSSSNT

SEQ ID NO: 3342255 - protein, 4 aa, Plasmodium falciparum
RSST

SEQ ID NO: 3342256 - protein, 7 aa, Plasmodium falciparum
RSSTHNE

SEQ ID NO: 3342257 - protein, 17 aa, Plasmodium falciparum
RSSTRITNAPGGNSSVS

SEQ ID NO: 3342258 - protein, 23 aa, Plasmodium falciparum
RSSVESIGEEKDMKADVKKNDIN

SEQ ID NO: 3342259 - protein, 15 aa, Plasmodium falciparum
RSTADIKKGKTISQA

SEQ ID NO: 3342260 - protein, 9 aa, Plasmodium falciparum
RSTDDFNGA

SEQ ID NO: 3342261 - protein, 5 aa, Plasmodium falciparum
RSTEQ

SEQ ID NO: 3342262 - protein, 6 aa, Plasmodium falciparum
RSTFPK

SEQ ID NO: 3342263 - protein, 7 aa, Plasmodium falciparum
RSTINGD

SEQ ID NO: 3342264 - protein, 19 aa, Plasmodium falciparum
RSTKDIDEDNYNNEETKNI

SEQ ID NO: 3342265 - protein, 9 aa, Plasmodium falciparum
RSTNENTTH

SEQ ID NO: 3342266 - protein, 11 aa, Plasmodium falciparum
RSTSNSSTINT

SEQ ID NO: 3342267 - protein, 44 aa, Plasmodium falciparum
RSTSRRASRHEKRNENYKSKYNHSNDDYSDETRNSSKHSRKEHV

SEQ ID NO: 3342268 - protein, 10 aa, Plasmodium falciparum
RSTSTPNMTR

SEQ ID NO: 3342269 - protein, 9 aa, Plasmodium falciparum
RSVSGSKSI

SEQ ID NO: 3342270 - protein, 9 aa, Plasmodium falciparum
RSYNKNDET

SEQ ID NO: 3342271 - protein, 5 aa, Plasmodium falciparum
RSYPS

SEQ ID NO: 3342272 - protein, 13 aa, Plasmodium falciparum
RSYRESNKTHNDD

SEQ ID NO: 3342273 - protein, 14 aa, Plasmodium falciparum
RSYRRRKKKNDINN

SEQ ID NO: 3342274 - protein, 11 aa, Plasmodium falciparum
RSYTPNVTNRA

SEQ ID NO: 3342275 - protein, 5 aa, Plasmodium falciparum
RSYYD

SEQ ID NO: 3342276 - protein, 13 aa, Plasmodium falciparum
RTAGLQGSPSLEE

SEQ ID NO: 3342277 - protein, 9 aa, Plasmodium falciparum
RTARSNKKG

SEQ ID NO: 3342278 - protein, 6 aa, Plasmodium falciparum
RTDDSS

SEQ ID NO: 3342279 - protein, 12 aa, Plasmodium falciparum
RTDENIKNYEGP

SEQ ID NO: 3342280 - protein, 6 aa, Plasmodium falciparum
RTDESE

SEQ ID NO: 3342281 - protein, 9 aa, Plasmodium falciparum
RTDKGGNDY

SEQ ID NO: 3342282 - protein, 9 aa, Plasmodium falciparum
RTDKRDKPL

SEQ ID NO: 3342283 - protein, 16 aa, Plasmodium falciparum
RTEKLKKRKKKNKDTA

SEQ ID NO: 3342284 - protein, 15 aa, Plasmodium falciparum
RTERSNSQNRYDKNG

SEQ ID NO: 3342285 - protein, 24 aa, Plasmodium falciparum
RTESKHDRTYKTPKKYNKKLRNNS

SEQ ID NO: 3342286 - protein, 19 aa, Plasmodium falciparum
RTETNDKKTVKNKHSTNKI

SEQ ID NO: 3342287 - protein, 6 aa, Plasmodium falciparum
RTFEDS

SEQ ID NO: 3342288 - protein, 18 aa, Plasmodium falciparum
RTFSNKSRTMRTKNRYKN

SEQ ID NO: 3342289 - protein, 13 aa, Plasmodium falciparum
RTGAKNELGEKEG

SEQ ID NO: 3342290 - protein, 4 aa, Plasmodium falciparum
RTGK

SEQ ID NO: 3342291 - protein, 4 aa, Plasmodium falciparum
RTGN

SEQ ID NO: 3342292 - protein, 7 aa, Plasmodium falciparum
RTGNRGT

SEQ ID NO: 3342293 - protein, 10 aa, Plasmodium falciparum
RTGQKQKGSI

SEQ ID NO: 3342294 - protein, 10 aa, Plasmodium falciparum
RTGRAGKKGK

SEQ ID NO: 3342295 - protein, 7 aa, Plasmodium falciparum
RTGRAGN

SEQ ID NO: 3342296 - protein, 10 aa, Plasmodium falciparum
RTGRAGSHGA

SEQ ID NO: 3342297 - protein, 9 aa, Plasmodium falciparum
RTGRCGKTG

SEQ ID NO: 3342298 - protein, 8 aa, Plasmodium falciparum
RTGRSNNI

SEQ ID NO: 3342299 - protein, 7 aa, Plasmodium falciparum
RTGSTKT

SEQ ID NO: 3342300 - protein, 4 aa, Plasmodium falciparum
RTHK

SEQ ID NO: 3342301 - protein, 4 aa, Plasmodium falciparum
RTHL

SEQ ID NO: 3342302 - protein, 16 aa, Plasmodium falciparum
RTHSNDRSNDSNTRTI

SEQ ID NO: 3342303 - protein, 6 aa, Plasmodium falciparum
RTHTSG

SEQ ID NO: 3342304 - protein, 43 aa, Plasmodium falciparum
RTIKREETNEDDVTRNTDQYDHKNGDTNDNNNNNNDDGDSHNV

SEQ ID NO: 3342305 - protein, 5 aa, Plasmodium falciparum
RTISQ

SEQ ID NO: 3342306 - protein, 6 aa, Plasmodium falciparum
RTKDEV

SEQ ID NO: 3342307 - protein, 7 aa, Plasmodium falciparum
RTKDGKI

SEQ ID NO: 3342308 - protein, 8 aa, Plasmodium falciparum
RTKEEKGI

SEQ ID NO: 3342309 - protein, 4 aa, Plasmodium falciparum
RTKH

SEQ ID NO: 3342310 - protein, 9 aa, Plasmodium falciparum
RTKKKKKNI

SEQ ID NO: 3342311 - protein, 13 aa, Plasmodium falciparum
RTKKKKNWESPER

SEQ ID NO: 3342312 - protein, 13 aa, Plasmodium falciparum
RTKKKSKISNAGN

SEQ ID NO: 3342313 - protein, 8 aa, Plasmodium falciparum
RTKKSMGA

SEQ ID NO: 3342314 - protein, 5 aa, Plasmodium falciparum
RTKNP

SEQ ID NO: 3342315 - protein, 7 aa, Plasmodium falciparum
RTKPGLT

SEQ ID NO: 3342316 - protein, 7 aa, Plasmodium falciparum
RTKRRMG

SEQ ID NO: 3342317 - protein, 6 aa, Plasmodium falciparum
RTKSYD

SEQ ID NO: 3342318 - protein, 6 aa, Plasmodium falciparum
RTKYTP

SEQ ID NO: 3342319 - protein, 4 aa, Plasmodium falciparum
RTLE

SEQ ID NO: 3342320 - protein, 6 aa, Plasmodium falciparum
RTLEKD

SEQ ID NO: 3342321 - protein, 14 aa, Plasmodium falciparum
RTLNGSKKNKKKKI

SEQ ID NO: 3342322 - protein, 6 aa, Plasmodium falciparum
RTNEFQ

SEQ ID NO: 3342323 - protein, 5 aa, Plasmodium falciparum
RTNES

SEQ ID NO: 3342324 - protein, 6 aa, Plasmodium falciparum
RTNIPN

SEQ ID NO: 3342325 - protein, 13 aa, Plasmodium falciparum
RTNKAKVSKIPGC

SEQ ID NO: 3342326 - protein, 7 aa, Plasmodium falciparum
RTNNENN

SEQ ID NO: 3342327 - protein, 17 aa, Plasmodium falciparum
RTNNKSDILNNNTNNSY

SEQ ID NO: 3342328 - protein, 5 aa, Plasmodium falciparum
RTNNT

SEQ ID NO: 3342329 - protein, 33 aa, Plasmodium falciparum
RTNNVSPKKKKKKINKNMNNNNNEYENSTDLKN

SEQ ID NO: 3342330 - protein, 4 aa, Plasmodium falciparum
RTNS

SEQ ID NO: 3342331 - protein, 8 aa, Plasmodium falciparum
RTPKQTKK

SEQ ID NO: 3342332 - protein, 7 aa, Plasmodium falciparum
RTPNFSG

SEQ ID NO: 3342333 - protein, 9 aa, Plasmodium falciparum
RTPQESNAD

SEQ ID NO: 3342334 - protein, 8 aa, Plasmodium falciparum
RTQAPKEK

SEQ ID NO: 3342335 - protein, 18 aa, Plasmodium falciparum
RTQDSPPLGFDTKDELYY

SEQ ID NO: 3342336 - protein, 8 aa, Plasmodium falciparum
RTQKGTRE

SEQ ID NO: 3342337 - protein, 11 aa, Plasmodium falciparum
RTQRYEKNTKY

SEQ ID NO: 3342338 - protein, 4 aa, Plasmodium falciparum
RTRG

SEQ ID NO: 3342339 - protein, 8 aa, Plasmodium falciparum
RTRKESLK

SEQ ID NO: 3342340 - protein, 6 aa, Plasmodium falciparum
RTRKNG

SEQ ID NO: 3342341 - protein, 8 aa, Plasmodium falciparum
RTRKREKT

SEQ ID NO: 3342342 - protein, 4 aa, Plasmodium falciparum
RTRY

SEQ ID NO: 3342343 - protein, 6 aa, Plasmodium falciparum
RTSDDR

SEQ ID NO: 3342344 - protein, 8 aa, Plasmodium falciparum
RTSDGKEV

SEQ ID NO: 3342345 - protein, 4 aa, Plasmodium falciparum
RTSE

SEQ ID NO: 3342346 - protein, 6 aa, Plasmodium falciparum
RTSKSN

SEQ ID NO: 3342347 - protein, 13 aa, Plasmodium falciparum
RTSNDSNKSINSD

SEQ ID NO: 3342348 - protein, 11 aa, Plasmodium falciparum
RTSNNNETSER

SEQ ID NO: 3342349 - protein, 4 aa, Plasmodium falciparum
RTSR

SEQ ID NO: 3342350 - protein, 11 aa, Plasmodium falciparum
RTSREQKENEL

SEQ ID NO: 3342351 - protein, 8 aa, Plasmodium falciparum
RTSTSSHL

SEQ ID NO: 3342352 - protein, 11 aa, Plasmodium falciparum
RTTENENEEMT

SEQ ID NO: 3342353 - protein, 8 aa, Plasmodium falciparum
RTTFRNNK

SEQ ID NO: 3342354 - protein, 18 aa, Plasmodium falciparum
RTTSQLNEKKSNNKEVVD

SEQ ID NO: 3342355 - protein, 9 aa, Plasmodium falciparum
RTTTNDVGY

SEQ ID NO: 3342356 - protein, 6 aa, Plasmodium falciparum
RTTTPN

SEQ ID NO: 3342357 - protein, 35 aa, Plasmodium falciparum
RTTTRENENVKNKNNSNNMKDINRNGTKIGDTCEE

SEQ ID NO: 3342358 - protein, 7 aa, Plasmodium falciparum
RTVEGKK

SEQ ID NO: 3342359 - protein, 7 aa, Plasmodium falciparum
RTVPESP

SEQ ID NO: 3342360 - protein, 12 aa, Plasmodium falciparum
RTVPETKREDHT

SEQ ID NO: 3342361 - protein, 6 aa, Plasmodium falciparum
RTVPNK

SEQ ID NO: 3342362 - protein, 11 aa, Plasmodium falciparum
RTYNDGEIQDA

SEQ ID NO: 3342363 - protein, 5 aa, Plasmodium falciparum
RTYNS

SEQ ID NO: 3342364 - protein, 18 aa, Plasmodium falciparum
RTYSNDNYKNNMNNRRSC

SEQ ID NO: 3342365 - protein, 8 aa, Plasmodium falciparum
RTYTNNRN

SEQ ID NO: 3342366 - protein, 4 aa, Plasmodium falciparum
RVDE

SEQ ID NO: 3342367 - protein, 4 aa, Plasmodium falciparum
RVKK

SEQ ID NO: 3342368 - protein, 8 aa, Plasmodium falciparum
RVKTDEMK

SEQ ID NO: 3342369 - protein, 36 aa, Plasmodium falciparum
RVNKNGNNQNEYDHNDDEEMYDERNGNKNDDSENQK

SEQ ID NO: 3342370 - protein, 19 aa, Plasmodium falciparum
RVNNGNIKEEHQDENIYTE

SEQ ID NO: 3342371 - protein, 18 aa, Plasmodium falciparum
RVNNNGRKKGNHKGKDIN

SEQ ID NO: 3342372 - protein, 10 aa, Plasmodium falciparum
RVNNVKENGR

SEQ ID NO: 3342373 - protein, 14 aa, Plasmodium falciparum
RVPGGGTHRAGQGA

SEQ ID NO: 3342374 - protein, 11 aa, Plasmodium falciparum
RVPSAASQTGL

SEQ ID NO: 3342375 - protein, 6 aa, Plasmodium falciparum
RVRNAD

SEQ ID NO: 3342376 - protein, 9 aa, Plasmodium falciparum
RVRTNNKEE

SEQ ID NO: 3342377 - protein, 10 aa, Plasmodium falciparum
RVSGKNVKAN

SEQ ID NO: 3342378 - protein, 12 aa, Plasmodium falciparum
RVSRTDKGVSAR

SEQ ID NO: 3342379 - protein, 6 aa, Plasmodium falciparum
RWPSKN

SEQ ID NO: 3342380 - protein, 11 aa, Plasmodium falciparum
RYDEKKENINI

SEQ ID NO: 3342381 - protein, 28 aa, Plasmodium falciparum
RYDNNGNVKYGNKKYNGNEKYDNNDNNK

SEQ ID NO: 3342382 - protein, 21 aa, Plasmodium falciparum
RYDRGDNLQQNHKRYDIDFPS

SEQ ID NO: 3342383 - protein, 17 aa, Plasmodium falciparum
RYDSNSPIKNSKNNSNN

SEQ ID NO: 3342384 - protein, 5 aa, Plasmodium falciparum
RYDSP

SEQ ID NO: 3342385 - protein, 7 aa, Plasmodium falciparum
RYDTMDK

SEQ ID NO: 3342386 - protein, 7 aa, Plasmodium falciparum
RYEENSD

SEQ ID NO: 3342387 - protein, 4 aa, Plasmodium falciparum
RYEK

SEQ ID NO: 3342388 - protein, 20 aa, Plasmodium falciparum
RYENKSTGTKKKKNHTKQNE

SEQ ID NO: 3342389 - protein, 11 aa, Plasmodium falciparum
RYENTSDDEDI

SEQ ID NO: 3342390 - protein, 22 aa, Plasmodium falciparum
RYGDKNEPSHINNNNNNEEYNN

SEQ ID NO: 3342391 - protein, 12 aa, Plasmodium falciparum
RYGNKKGKNLND

SEQ ID NO: 3342392 - protein, 83 aa, Plasmodium falciparum
RYHATNEDHNSDNNNNDNNNNNNNDDNNNNNDDNNNNNDDNNNNNDDNNNNNDDNNNNNNDDNNNNNNNDNNNNNNNDNNNND

SEQ ID NO: 3342393 - protein, 4 aa, Plasmodium falciparum
RYKE

SEQ ID NO: 3342394 - protein, 17 aa, Plasmodium falciparum
RYKKGYATTNSNNYYNN

SEQ ID NO: 3342395 - protein, 23 aa, Plasmodium falciparum
RYKKHKKNKTQNDEPSSKSNKIG

SEQ ID NO: 3342396 - protein, 12 aa, Plasmodium falciparum
RYKSSNNVRIFS

SEQ ID NO: 3342397 - protein, 6 aa, Plasmodium falciparum
RYNEQS

SEQ ID NO: 3342398 - protein, 29 aa, Plasmodium falciparum
RYNGGGENIDRYNGGGENIDRYNGGGENI

SEQ ID NO: 3342399 - protein, 11 aa, Plasmodium falciparum
RYNKKNTKSDV

SEQ ID NO: 3342400 - protein, 18 aa, Plasmodium falciparum
RYNNEKSINEQDKKGDDF

SEQ ID NO: 3342401 - protein, 5 aa, Plasmodium falciparum
RYNNN

SEQ ID NO: 3342402 - protein, 16 aa, Plasmodium falciparum
RYNSKDGTRCRAGTLN

SEQ ID NO: 3342403 - protein, 7 aa, Plasmodium falciparum
RYNSNNV

SEQ ID NO: 3342404 - protein, 8 aa, Plasmodium falciparum
RYNSYESQ

SEQ ID NO: 3342405 - protein, 5 aa, Plasmodium falciparum
RYNTE

SEQ ID NO: 3342406 - protein, 5 aa, Plasmodium falciparum
RYNTN

SEQ ID NO: 3342407 - protein, 5 aa, Plasmodium falciparum
RYQEK

SEQ ID NO: 3342408 - protein, 8 aa, Plasmodium falciparum
RYRSGSSF

SEQ ID NO: 3342409 - protein, 9 aa, Plasmodium falciparum
RYSNNKSEH

SEQ ID NO: 3342410 - protein, 4 aa, Plasmodium falciparum
RYTK

SEQ ID NO: 3342411 - protein, 6 aa, Plasmodium falciparum
RYTKEE

SEQ ID NO: 3342412 - protein, 9 aa, Plasmodium falciparum
RYTSEDNKS

SEQ ID NO: 3342413 - protein, 30 aa, Plasmodium falciparum
RYYASNKSSVVSTYPNSNNYYHNNKSDSYY

SEQ ID NO: 3342414 - protein, 88 aa, Plasmodium falciparum
RYYDNKKCDDNKKCVDNKKCDDNKKCVDNKKCDDNKKCDDNKKCVDNKKCDDNKKCVDNKKCDDNKKCDDNKKCVDNKKCDDNKKCVD

SEQ ID NO: 3342415 - protein, 6 aa, Plasmodium falciparum
SAAFAP

SEQ ID NO: 3342416 - protein, 5 aa, Plasmodium falciparum
SAANN

SEQ ID NO: 3342417 - protein, 5 aa, Plasmodium falciparum
SAAQI

SEQ ID NO: 3342418 - protein, 13 aa, Plasmodium falciparum
SACGNVSSNSYKG

SEQ ID NO: 3342419 - protein, 7 aa, Plasmodium falciparum
SADDPLE

SEQ ID NO: 3342420 - protein, 8 aa, Plasmodium falciparum
SADEKNIS

SEQ ID NO: 3342421 - protein, 6 aa, Plasmodium falciparum
SADEPS

SEQ ID NO: 3342422 - protein, 5 aa, Plasmodium falciparum
SADEY

SEQ ID NO: 3342423 - protein, 4 aa, Plasmodium falciparum
SADK

SEQ ID NO: 3342424 - protein, 10 aa, Plasmodium falciparum
SADKNTGEED

SEQ ID NO: 3342425 - protein, 25 aa, Plasmodium falciparum
SADLSESNCTSLKEENDIKKNSYGN

SEQ ID NO: 3342426 - protein, 14 aa, Plasmodium falciparum
SADNHSVNQNDHEH

SEQ ID NO: 3342427 - protein, 7 aa, Plasmodium falciparum
SADNKGN

SEQ ID NO: 3342428 - protein, 14 aa, Plasmodium falciparum
SADPHNKNKQHVGS

SEQ ID NO: 3342429 - protein, 28 aa, Plasmodium falciparum
SADRNNMKSVNGSTYNNNNNNNNINNNI

SEQ ID NO: 3342430 - protein, 11 aa, Plasmodium falciparum
SAEECNNNNNN

SEQ ID NO: 3342431 - protein, 27 aa, Plasmodium falciparum
SAENEKENENNNNYGKVDSKCSETSFH

SEQ ID NO: 3342432 - protein, 12 aa, Plasmodium falciparum
SAENVSTDSSYF

SEQ ID NO: 3342433 - protein, 16 aa, Plasmodium falciparum
SAFSSDNISYNNNSSI

SEQ ID NO: 3342434 - protein, 4 aa, Plasmodium falciparum
SAGA

SEQ ID NO: 3342435 - protein, 6 aa, Plasmodium falciparum
SAGYEG

SEQ ID NO: 3342436 - protein, 4 aa, Plasmodium falciparum
SAHK

SEQ ID NO: 3342437 - protein, 6 aa, Plasmodium falciparum
SAHNNK

SEQ ID NO: 3342438 - protein, 7 aa, Plasmodium falciparum
SAISKKS

SEQ ID NO: 3342439 - protein, 6 aa, Plasmodium falciparum
SAISNR

SEQ ID NO: 3342440 - protein, 6 aa, Plasmodium falciparum
SAKAGH

SEQ ID NO: 3342441 - protein, 8 aa, Plasmodium falciparum
SAKDATNV

SEQ ID NO: 3342442 - protein, 14 aa, Plasmodium falciparum
SAKISSSIKTNYEK

SEQ ID NO: 3342443 - protein, 14 aa, Plasmodium falciparum
SAKNISKKKIRDNT

SEQ ID NO: 3342444 - protein, 8 aa, Plasmodium falciparum
SAKNLTDE

SEQ ID NO: 3342445 - protein, 6 aa, Plasmodium falciparum
SAKPRN

SEQ ID NO: 3342446 - protein, 27 aa, Plasmodium falciparum
SAKPYNRNLSRKEKKKIRKSLKKDNKK

SEQ ID NO: 3342447 - protein, 4 aa, Plasmodium falciparum
SAKQ

SEQ ID NO: 3342448 - protein, 11 aa, Plasmodium falciparum
SAKSSISLPSN

SEQ ID NO: 3342449 - protein, 8 aa, Plasmodium falciparum
SAKTAKNV

SEQ ID NO: 3342450 - protein, 8 aa, Plasmodium falciparum
SAKTGQNV

SEQ ID NO: 3342451 - protein, 10 aa, Plasmodium falciparum
SAKVAKESKD

SEQ ID NO: 3342452 - protein, 13 aa, Plasmodium falciparum
SALDDDDDDDDDD

SEQ ID NO: 3342453 - protein, 7 aa, Plasmodium falciparum
SANEAQK

SEQ ID NO: 3342454 - protein, 10 aa, Plasmodium falciparum
SANENDDDKF

SEQ ID NO: 3342455 - protein, 8 aa, Plasmodium falciparum
SANGDKNI

SEQ ID NO: 3342456 - protein, 4 aa, Plasmodium falciparum
SANK

SEQ ID NO: 3342457 - protein, 7 aa, Plasmodium falciparum
SANKTNH

SEQ ID NO: 3342458 - protein, 15 aa, Plasmodium falciparum
SANNIQAYTSRNKRV

SEQ ID NO: 3342459 - protein, 16 aa, Plasmodium falciparum
SANNKNEIDDKDYYGN

SEQ ID NO: 3342460 - protein, 26 aa, Plasmodium falciparum
SANNNNNNNNKNNNNSSSNNNISSNN

SEQ ID NO: 3342461 - protein, 6 aa, Plasmodium falciparum
SANRTV

SEQ ID NO: 3342462 - protein, 9 aa, Plasmodium falciparum
SANSSHINS

SEQ ID NO: 3342463 - protein, 16 aa, Plasmodium falciparum
SANVDKKKKKHLRKKT

SEQ ID NO: 3342464 - protein, 14 aa, Plasmodium falciparum
SANYVNGQSFSNND

SEQ ID NO: 3342465 - protein, 17 aa, Plasmodium falciparum
SAPETKQDTKIIPNKEK

SEQ ID NO: 3342466 - protein, 4 aa, Plasmodium falciparum
SAPI

SEQ ID NO: 3342467 - protein, 12 aa, Plasmodium falciparum
SAPNNNNNNNME

SEQ ID NO: 3342468 - protein, 8 aa, Plasmodium falciparum
SAQGQDIT

SEQ ID NO: 3342469 - protein, 7 aa, Plasmodium falciparum
SAQKVSK

SEQ ID NO: 3342470 - protein, 10 aa, Plasmodium falciparum
SAQNSNNNFS

SEQ ID NO: 3342471 - protein, 7 aa, Plasmodium falciparum
SARAQAD

SEQ ID NO: 3342472 - protein, 35 aa, Plasmodium falciparum
SARSDVSRKSEVSRRSNVTNKLSDRENEKNEETKL

SEQ ID NO: 3342473 - protein, 7 aa, Plasmodium falciparum
SARTDQG

SEQ ID NO: 3342474 - protein, 7 aa, Plasmodium falciparum
SASDASP

SEQ ID NO: 3342475 - protein, 19 aa, Plasmodium falciparum
SASDINKNVNNDNSNLPNV

SEQ ID NO: 3342476 - protein, 9 aa, Plasmodium falciparum
SASDISENE

SEQ ID NO: 3342477 - protein, 5 aa, Plasmodium falciparum
SASEL

SEQ ID NO: 3342478 - protein, 5 aa, Plasmodium falciparum
SASFN

SEQ ID NO: 3342479 - protein, 8 aa, Plasmodium falciparum
SASINREK

SEQ ID NO: 3342480 - protein, 4 aa, Plasmodium falciparum
SASK

SEQ ID NO: 3342481 - protein, 9 aa, Plasmodium falciparum
SASKDSSND

SEQ ID NO: 3342482 - protein, 6 aa, Plasmodium falciparum
SASNES

SEQ ID NO: 3342483 - protein, 5 aa, Plasmodium falciparum
SASNN

SEQ ID NO: 3342484 - protein, 5 aa, Plasmodium falciparum
SASRD

SEQ ID NO: 3342485 - protein, 7 aa, Plasmodium falciparum
SASSNNY

SEQ ID NO: 3342486 - protein, 7 aa, Plasmodium falciparum
SASTDFS

SEQ ID NO: 3342487 - protein, 12 aa, Plasmodium falciparum
SASTDKKCKNNF

SEQ ID NO: 3342488 - protein, 7 aa, Plasmodium falciparum
SASYDVS

SEQ ID NO: 3342489 - protein, 14 aa, Plasmodium falciparum
SATDEQASTMKDKG

SEQ ID NO: 3342490 - protein, 8 aa, Plasmodium falciparum
SATEPSYT

SEQ ID NO: 3342491 - protein, 10 aa, Plasmodium falciparum
SATEQDDERI

SEQ ID NO: 3342492 - protein, 7 aa, Plasmodium falciparum
SATHDNI

SEQ ID NO: 3342493 - protein, 13 aa, Plasmodium falciparum
SATKARKELSGRK

SEQ ID NO: 3342494 - protein, 7 aa, Plasmodium falciparum
SATKNIG

SEQ ID NO: 3342495 - protein, 7 aa, Plasmodium falciparum
SATKTHL

SEQ ID NO: 3342496 - protein, 6 aa, Plasmodium falciparum
SATTAE

SEQ ID NO: 3342497 - protein, 5 aa, Plasmodium falciparum
SATTI

SEQ ID NO: 3342498 - protein, 9 aa, Plasmodium falciparum
SAVETAESI

SEQ ID NO: 3342499 - protein, 6 aa, Plasmodium falciparum
SAVPSA

SEQ ID NO: 3342500 - protein, 12 aa, Plasmodium falciparum
SAYEDKTNNTTM

SEQ ID NO: 3342501 - protein, 6 aa, Plasmodium falciparum
SAYEDN

SEQ ID NO: 3342502 - protein, 5 aa, Plasmodium falciparum
SAYGS

SEQ ID NO: 3342503 - protein, 10 aa, Plasmodium falciparum
SAYNEEEQKE

SEQ ID NO: 3342504 - protein, 12 aa, Plasmodium falciparum
SAYQKDNDNTVE

SEQ ID NO: 3342505 - protein, 6 aa, Plasmodium falciparum
SAYRSN

SEQ ID NO: 3342506 - protein, 29 aa, Plasmodium falciparum
SAYRSPKYEKGYDDNKSVNKKKMNSNNMG

SEQ ID NO: 3342507 - protein, 9 aa, Plasmodium falciparum
SCDDNISNH

SEQ ID NO: 3342508 - protein, 6 aa, Plasmodium falciparum
SCDGTN

SEQ ID NO: 3342509 - protein, 5 aa, Plasmodium falciparum
SCDHP

SEQ ID NO: 3342510 - protein, 4 aa, Plasmodium falciparum
SCDK

SEQ ID NO: 3342511 - protein, 10 aa, Plasmodium falciparum
SCDNKKNKDY

SEQ ID NO: 3342512 - protein, 7 aa, Plasmodium falciparum
SCDNQNG

SEQ ID NO: 3342513 - protein, 8 aa, Plasmodium falciparum
SCDRKEDF

SEQ ID NO: 3342514 - protein, 10 aa, Plasmodium falciparum
SCDRKNREWE

SEQ ID NO: 3342515 - protein, 7 aa, Plasmodium falciparum
SCDRSND

SEQ ID NO: 3342516 - protein, 11 aa, Plasmodium falciparum
SCDTPKDTKLE

SEQ ID NO: 3342517 - protein, 12 aa, Plasmodium falciparum
SCEENEHKRQKE

SEQ ID NO: 3342518 - protein, 12 aa, Plasmodium falciparum
SCEENKETYRKN

SEQ ID NO: 3342519 - protein, 13 aa, Plasmodium falciparum
SCEHNNDGSKKYN

SEQ ID NO: 3342520 - protein, 5 aa, Plasmodium falciparum
SCEKS

SEQ ID NO: 3342521 - protein, 10 aa, Plasmodium falciparum
SCEKTNVDDN

SEQ ID NO: 3342522 - protein, 12 aa, Plasmodium falciparum
SCENNNPSPNVI

SEQ ID NO: 3342523 - protein, 6 aa, Plasmodium falciparum
SCENQY

SEQ ID NO: 3342524 - protein, 9 aa, Plasmodium falciparum
SCEPDNKVT

SEQ ID NO: 3342525 - protein, 6 aa, Plasmodium falciparum
SCESNS

SEQ ID NO: 3342526 - protein, 7 aa, Plasmodium falciparum
SCGGNDN

SEQ ID NO: 3342527 - protein, 4 aa, Plasmodium falciparum
SCGN

SEQ ID NO: 3342528 - protein, 7 aa, Plasmodium falciparum
SCGTGTS

SEQ ID NO: 3342529 - protein, 9 aa, Plasmodium falciparum
SCGYPSAKK

SEQ ID NO: 3342530 - protein, 12 aa, Plasmodium falciparum
SCKESRKEELEK

SEQ ID NO: 3342531 - protein, 17 aa, Plasmodium falciparum
SCKKRSRCDVGDKNDND

SEQ ID NO: 3342532 - protein, 8 aa, Plasmodium falciparum
SCKREKST

SEQ ID NO: 3342533 - protein, 5 aa, Plasmodium falciparum
SCKSS

SEQ ID NO: 3342534 - protein, 9 aa, Plasmodium falciparum
SCNNNYSNK

SEQ ID NO: 3342535 - protein, 9 aa, Plasmodium falciparum
SCNNPKDAH

SEQ ID NO: 3342536 - protein, 7 aa, Plasmodium falciparum
SCNRGDE

SEQ ID NO: 3342537 - protein, 10 aa, Plasmodium falciparum
SCNSSNNSVQ

SEQ ID NO: 3342538 - protein, 7 aa, Plasmodium falciparum
SCNYSDE

SEQ ID NO: 3342539 - protein, 5 aa, Plasmodium falciparum
SCQGK

SEQ ID NO: 3342540 - protein, 5 aa, Plasmodium falciparum
SCRKK

SEQ ID NO: 3342541 - protein, 5 aa, Plasmodium falciparum
SCSDG

SEQ ID NO: 3342542 - protein, 6 aa, Plasmodium falciparum
SCSDSN

SEQ ID NO: 3342543 - protein, 7 aa, Plasmodium falciparum
SCSEEKK

SEQ ID NO: 3342544 - protein, 19 aa, Plasmodium falciparum
SCSEKEDNISKYDEEKLPS

SEQ ID NO: 3342545 - protein, 13 aa, Plasmodium falciparum
SCSESNLSSEGNV

SEQ ID NO: 3342546 - protein, 5 aa, Plasmodium falciparum
SCSLT

SEQ ID NO: 3342547 - protein, 16 aa, Plasmodium falciparum
SCSNNIKRHNNSLTNY

SEQ ID NO: 3342548 - protein, 12 aa, Plasmodium falciparum
SCSPSGCASRNK

SEQ ID NO: 3342549 - protein, 5 aa, Plasmodium falciparum
SCSSN

SEQ ID NO: 3342550 - protein, 8 aa, Plasmodium falciparum
SCSSSTIA

SEQ ID NO: 3342551 - protein, 10 aa, Plasmodium falciparum
SCTNQSGGSF

SEQ ID NO: 3342552 - protein, 6 aa, Plasmodium falciparum
SCTNTK

SEQ ID NO: 3342553 - protein, 12 aa, Plasmodium falciparum
SCTPDEMNMDIK

SEQ ID NO: 3342554 - protein, 11 aa, Plasmodium falciparum
SCTPNDQISTC

SEQ ID NO: 3342555 - protein, 7 aa, Plasmodium falciparum
SCTSNGP

SEQ ID NO: 3342556 - protein, 6 aa, Plasmodium falciparum
SDADEQ

SEQ ID NO: 3342557 - protein, 40 aa, Plasmodium falciparum
SDAKSKENQNKNIKRYDDKKKNGDKKKCKNKNINKSNRGI

SEQ ID NO: 3342558 - protein, 5 aa, Plasmodium falciparum
SDALY

SEQ ID NO: 3342559 - protein, 6 aa, Plasmodium falciparum
SDASDF

SEQ ID NO: 3342560 - protein, 11 aa, Plasmodium falciparum
SDASDSTINDV

SEQ ID NO: 3342561 - protein, 8 aa, Plasmodium falciparum
SDCEGGGE

SEQ ID NO: 3342562 - protein, 35 aa, Plasmodium falciparum
SDDDEGDEGSNEEEEEKSVSNDKEENNNLKNETYG

SEQ ID NO: 3342563 - protein, 8 aa, Plasmodium falciparum
SDDDEGKC

SEQ ID NO: 3342564 - protein, 24 aa, Plasmodium falciparum
SDDDQENIEENEEGQKMKKSEQRY

SEQ ID NO: 3342565 - protein, 40 aa, Plasmodium falciparum
SDDDSDDESDFESDDEDDDYEDDDYEDDAEEEEKDDMNEK

SEQ ID NO: 3342566 - protein, 6 aa, Plasmodium falciparum
SDDEDE

SEQ ID NO: 3342567 - protein, 21 aa, Plasmodium falciparum
SDDEDSHMSYNNDTKRENSIG

SEQ ID NO: 3342568 - protein, 29 aa, Plasmodium falciparum
SDDEEKQNDSSNHIKGKDEKKKKNKSRYK

SEQ ID NO: 3342569 - protein, 49 aa, Plasmodium falciparum
SDDEESNDDSEQINTDNISKNVQDNANPDLDPNKNVQENFEENTDNNIE

SEQ ID NO: 3342570 - protein, 150 aa, Plasmodium falciparum
SDDEGDKKNVSKQNDDDEDDDDNGDDDDNEDDDDNEDDDNGDDDDNEDDDNGDDDDNEDDNYDDEDNDNYENEDDDNYANEDDDNYENDDDDNYENDDDDNYENDDDNYENDDDDNYENGDDDNDNDHNDDNNDEEKYSCHDDKNEHTNN

SEQ ID NO: 3342571 - protein, 5 aa, Plasmodium falciparum
SDDEK

SEQ ID NO: 3342572 - protein, 26 aa, Plasmodium falciparum
SDDEKSNSTVENDKNEEHNEDTLSNE

SEQ ID NO: 3342573 - protein, 8 aa, Plasmodium falciparum
SDDENNKK

SEQ ID NO: 3342574 - protein, 9 aa, Plasmodium falciparum
SDDESDVDK

SEQ ID NO: 3342575 - protein, 39 aa, Plasmodium falciparum
SDDEWKKKKKKKKEEEGNIQQDDKKRNEKNVQQKNSSSS

SEQ ID NO: 3342576 - protein, 5 aa, Plasmodium falciparum
SDDGT

SEQ ID NO: 3342577 - protein, 12 aa, Plasmodium falciparum
SDDGTVRQYDTR

SEQ ID NO: 3342578 - protein, 6 aa, Plasmodium falciparum
SDDITL

SEQ ID NO: 3342579 - protein, 4 aa, Plasmodium falciparum
SDDK

SEQ ID NO: 3342580 - protein, 29 aa, Plasmodium falciparum
SDDKDHISKNKNNNTSKNNNNNNNNNNVM

SEQ ID NO: 3342581 - protein, 10 aa, Plasmodium falciparum
SDDKNNVDKN

SEQ ID NO: 3342582 - protein, 6 aa, Plasmodium falciparum
SDDKTI

SEQ ID NO: 3342583 - protein, 36 aa, Plasmodium falciparum
SDDMKTNVSKNNITGVKENKVDKTNVEYDKKGDDGV

SEQ ID NO: 3342584 - protein, 31 aa, Plasmodium falciparum
SDDMNTKQQKKEDNEESYEKSKINSLSNKNN

SEQ ID NO: 3342585 - protein, 9 aa, Plasmodium falciparum
SDDNDEDYY

SEQ ID NO: 3342586 - protein, 80 aa, Plasmodium falciparum
SDDNEEEDISEDDDGDDEEEDDEEADAEEADDEDGDDEDGDDEEGDDEYGENEDGDDNNNNNNNNNNSVRRKKKKKGNQI

SEQ ID NO: 3342587 - protein, 6 aa, Plasmodium falciparum
SDDNIL

SEQ ID NO: 3342588 - protein, 11 aa, Plasmodium falciparum
SDDNNDDDKEI

SEQ ID NO: 3342589 - protein, 11 aa, Plasmodium falciparum
SDDNNEECNNK

SEQ ID NO: 3342590 - protein, 31 aa, Plasmodium falciparum
SDDNNNYDDDDDMYSDDNNKHYNDEDDNYDS

SEQ ID NO: 3342591 - protein, 24 aa, Plasmodium falciparum
SDDNSEEEIENKDLNESPKNEPDI

SEQ ID NO: 3342592 - protein, 6 aa, Plasmodium falciparum
SDDNYV

SEQ ID NO: 3342593 - protein, 7 aa, Plasmodium falciparum
SDDPDNV

SEQ ID NO: 3342594 - protein, 25 aa, Plasmodium falciparum
SDDPNDYDQNNYDQNNYDQNNYDQN

SEQ ID NO: 3342595 - protein, 5 aa, Plasmodium falciparum
SDDQT

SEQ ID NO: 3342596 - protein, 4 aa, Plasmodium falciparum
SDDS

SEQ ID NO: 3342597 - protein, 10 aa, Plasmodium falciparum
SDDSEGNDKI

SEQ ID NO: 3342598 - protein, 12 aa, Plasmodium falciparum
SDDSKKERQGLE

SEQ ID NO: 3342599 - protein, 10 aa, Plasmodium falciparum
SDDSKNSDIE

SEQ ID NO: 3342600 - protein, 70 aa, Plasmodium falciparum
SDDSNYNNNNNNISDDNNNNNISDDYNNNNISDDDDSNNSDSSYDNTMSDHSDMKKKKKKKKKKKKKSEF

SEQ ID NO: 3342601 - protein, 8 aa, Plasmodium falciparum
SDDSSSIK

SEQ ID NO: 3342602 - protein, 4 aa, Plasmodium falciparum
SDDT

SEQ ID NO: 3342603 - protein, 6 aa, Plasmodium falciparum
SDDTTG

SEQ ID NO: 3342604 - protein, 4 aa, Plasmodium falciparum
SDDY

SEQ ID NO: 3342605 - protein, 5 aa, Plasmodium falciparum
SDDYD

SEQ ID NO: 3342606 - protein, 6 aa, Plasmodium falciparum
SDEASG

SEQ ID NO: 3342607 - protein, 20 aa, Plasmodium falciparum
SDEDALNSKGVKPIYTQEER

SEQ ID NO: 3342608 - protein, 55 aa, Plasmodium falciparum
SDEDDDEDDDDDDDDDDDDDDKEQEPKQQSDKHGDHQYDNKKSNSDNDVDSLETT

SEQ ID NO: 3342609 - protein, 8 aa, Plasmodium falciparum
SDEDEHVK

SEQ ID NO: 3342610 - protein, 9 aa, Plasmodium falciparum
SDEDEKNKD

SEQ ID NO: 3342611 - protein, 18 aa, Plasmodium falciparum
SDEDNIISDKSEKETEEK

SEQ ID NO: 3342612 - protein, 13 aa, Plasmodium falciparum
SDEDSDKDNDTII

SEQ ID NO: 3342613 - protein, 7 aa, Plasmodium falciparum
SDEEDED

SEQ ID NO: 3342614 - protein, 60 aa, Plasmodium falciparum
SDEEDEEEDYSDDDSSDDDSSDDDSSDDDSSDDDSSDDDSDDDSNDDADHDSKKYSEDDD

SEQ ID NO: 3342615 - protein, 10 aa, Plasmodium falciparum
SDEEDENADI

SEQ ID NO: 3342616 - protein, 18 aa, Plasmodium falciparum
SDEEEEEEEDNEDDDVDD

SEQ ID NO: 3342617 - protein, 14 aa, Plasmodium falciparum
SDEEEEEEYEEDNT

SEQ ID NO: 3342618 - protein, 40 aa, Plasmodium falciparum
SDEEEYASNSYDNIEDDDDEEEVDNDEEGLEDPPSSDNMS

SEQ ID NO: 3342619 - protein, 6 aa, Plasmodium falciparum
SDEEGD

SEQ ID NO: 3342620 - protein, 8 aa, Plasmodium falciparum
SDEEKENK

SEQ ID NO: 3342621 - protein, 13 aa, Plasmodium falciparum
SDEEKLKKQKYNE

SEQ ID NO: 3342622 - protein, 7 aa, Plasmodium falciparum
SDEEKRK

SEQ ID NO: 3342623 - protein, 8 aa, Plasmodium falciparum
SDEERDKK

SEQ ID NO: 3342624 - protein, 212 aa, Plasmodium falciparum
SDEERSDNRDERRNQKRHTRRSDNIKSSENRRSKRGERYSNRRSSTHRKSTDEEYDEEIESSYRTDDVTSESDESRIEKRREHRSESKYGRRSIRKSERSSEKSSKRGYDNKSNDKIHEKNSERSNESRYERIDSKRSGRSIRKSEKGSEKNSEKSSKKSSDKKSERRSGRKSESKSENRRESTRRESRRSRRYSRKSDTESDDDNNSEYSN

SEQ ID NO: 3342625 - protein, 24 aa, Plasmodium falciparum
SDEESQSVKQMSNKKKKKKKKKKI

SEQ ID NO: 3342626 - protein, 8 aa, Plasmodium falciparum
SDEETNSL

SEQ ID NO: 3342627 - protein, 8 aa, Plasmodium falciparum
SDEGDSNE

SEQ ID NO: 3342628 - protein, 5 aa, Plasmodium falciparum
SDEGL

SEQ ID NO: 3342629 - protein, 14 aa, Plasmodium falciparum
SDEHCKKGSDKNLN

SEQ ID NO: 3342630 - protein, 5 aa, Plasmodium falciparum
SDEHE

SEQ ID NO: 3342631 - protein, 9 aa, Plasmodium falciparum
SDEHNEKSD

SEQ ID NO: 3342632 - protein, 40 aa, Plasmodium falciparum
SDEHSRRSEHKKEDVERHPKEKRSLSNSSQAKRSSSNCYS

SEQ ID NO: 3342633 - protein, 6 aa, Plasmodium falciparum
SDEIDK

SEQ ID NO: 3342634 - protein, 7 aa, Plasmodium falciparum
SDEITKE

SEQ ID NO: 3342635 - protein, 5 aa, Plasmodium falciparum
SDEKA

SEQ ID NO: 3342636 - protein, 10 aa, Plasmodium falciparum
SDEKGNRKIE

SEQ ID NO: 3342637 - protein, 16 aa, Plasmodium falciparum
SDEKKEKIEKKDKKME

SEQ ID NO: 3342638 - protein, 9 aa, Plasmodium falciparum
SDEKKYNKS

SEQ ID NO: 3342639 - protein, 10 aa, Plasmodium falciparum
SDEKNNMVSR

SEQ ID NO: 3342640 - protein, 6 aa, Plasmodium falciparum
SDEKTK

SEQ ID NO: 3342641 - protein, 6 aa, Plasmodium falciparum
SDELNG

SEQ ID NO: 3342642 - protein, 22 aa, Plasmodium falciparum
SDELNKDDKKNNSPKSENDNIV

SEQ ID NO: 3342643 - protein, 4 aa, Plasmodium falciparum
SDEN

SEQ ID NO: 3342644 - protein, 9 aa, Plasmodium falciparum
SDENENNKV

SEQ ID NO: 3342645 - protein, 12 aa, Plasmodium falciparum
SDENHKKKKTNH

SEQ ID NO: 3342646 - protein, 14 aa, Plasmodium falciparum
SDENINENKEKYHK

SEQ ID NO: 3342647 - protein, 30 aa, Plasmodium falciparum
SDENKVNKKIPKKKKTKNKYKNDMKKKNVQ

SEQ ID NO: 3342648 - protein, 22 aa, Plasmodium falciparum
SDENNLQNNVPHGRRKRKVSKD

SEQ ID NO: 3342649 - protein, 9 aa, Plasmodium falciparum
SDENYDSSN

SEQ ID NO: 3342650 - protein, 10 aa, Plasmodium falciparum
SDEPNRLSKN

SEQ ID NO: 3342651 - protein, 7 aa, Plasmodium falciparum
SDEPTSY

SEQ ID NO: 3342652 - protein, 8 aa, Plasmodium falciparum
SDEQKKEW

SEQ ID NO: 3342653 - protein, 6 aa, Plasmodium falciparum
SDESEI

SEQ ID NO: 3342654 - protein, 17 aa, Plasmodium falciparum
SDESFTNNSSEVSMTNN

SEQ ID NO: 3342655 - protein, 10 aa, Plasmodium falciparum
SDESKAYNTY

SEQ ID NO: 3342656 - protein, 6 aa, Plasmodium falciparum
SDESQD

SEQ ID NO: 3342657 - protein, 25 aa, Plasmodium falciparum
SDESSENDKREKKKYIKENKKNIEN

SEQ ID NO: 3342658 - protein, 19 aa, Plasmodium falciparum
SDETLSSSSLSTCSNESHK

SEQ ID NO: 3342659 - protein, 5 aa, Plasmodium falciparum
SDETY

SEQ ID NO: 3342660 - protein, 6 aa, Plasmodium falciparum
SDEYNN

SEQ ID NO: 3342661 - protein, 8 aa, Plasmodium falciparum
SDEYRKKV

SEQ ID NO: 3342662 - protein, 39 aa, Plasmodium falciparum
SDEYSESDTSPNNSTNESYDTNSIHNKRKKNKKNTYNDI

SEQ ID NO: 3342663 - protein, 29 aa, Plasmodium falciparum
SDFDDDEDNEEDEEEEVDDDEQNKRGARR

SEQ ID NO: 3342664 - protein, 4 aa, Plasmodium falciparum
SDFN

SEQ ID NO: 3342665 - protein, 7 aa, Plasmodium falciparum
SDFNNEN

SEQ ID NO: 3342666 - protein, 5 aa, Plasmodium falciparum
SDFNQ

SEQ ID NO: 3342667 - protein, 9 aa, Plasmodium falciparum
SDGAPDITG

SEQ ID NO: 3342668 - protein, 8 aa, Plasmodium falciparum
SDGDDNNF

SEQ ID NO: 3342669 - protein, 6 aa, Plasmodium falciparum
SDGEKN

SEQ ID NO: 3342670 - protein, 24 aa, Plasmodium falciparum
SDGISKKSHGKRNISTSKVQKGNK

SEQ ID NO: 3342671 - protein, 13 aa, Plasmodium falciparum
SDGISNDEANLKN

SEQ ID NO: 3342672 - protein, 8 aa, Plasmodium falciparum
SDGKYIAS

SEQ ID NO: 3342673 - protein, 4 aa, Plasmodium falciparum
SDGL

SEQ ID NO: 3342674 - protein, 28 aa, Plasmodium falciparum
SDGNLSKDNINKNNDTINNNNNSNNNGN

SEQ ID NO: 3342675 - protein, 11 aa, Plasmodium falciparum
SDGNNRKTHEE

SEQ ID NO: 3342676 - protein, 6 aa, Plasmodium falciparum
SDGRES

SEQ ID NO: 3342677 - protein, 7 aa, Plasmodium falciparum
SDGSTKY

SEQ ID NO: 3342678 - protein, 5 aa, Plasmodium falciparum
SDGTR

SEQ ID NO: 3342679 - protein, 10 aa, Plasmodium falciparum
SDGYNEQNEQ

SEQ ID NO: 3342680 - protein, 17 aa, Plasmodium falciparum
SDHHDDKSNGNNEEPVE

SEQ ID NO: 3342681 - protein, 4 aa, Plasmodium falciparum
SDHL

SEQ ID NO: 3342682 - protein, 5 aa, Plasmodium falciparum
SDHMT

SEQ ID NO: 3342683 - protein, 7 aa, Plasmodium falciparum
SDHNNNL

SEQ ID NO: 3342684 - protein, 23 aa, Plasmodium falciparum
SDHNTKEPNNDRNKKKDSKEDLE

SEQ ID NO: 3342685 - protein, 31 aa, Plasmodium falciparum
SDHSCNDKKGKEKNEYNNNNNNDDDDDEHDI

SEQ ID NO: 3342686 - protein, 23 aa, Plasmodium falciparum
SDHSNSDTAQSVDTFDNSSASHF

SEQ ID NO: 3342687 - protein, 6 aa, Plasmodium falciparum
SDHTPL

SEQ ID NO: 3342688 - protein, 18 aa, Plasmodium falciparum
SDHYSSSDFSEKSSHDTD

SEQ ID NO: 3342689 - protein, 10 aa, Plasmodium falciparum
SDIDDENSVS

SEQ ID NO: 3342690 - protein, 5 aa, Plasmodium falciparum
SDIDE

SEQ ID NO: 3342691 - protein, 4 aa, Plasmodium falciparum
SDIE

SEQ ID NO: 3342692 - protein, 15 aa, Plasmodium falciparum
SDIEERNEKKKKNEK

SEQ ID NO: 3342693 - protein, 10 aa, Plasmodium falciparum
SDIEKGSYKY

SEQ ID NO: 3342694 - protein, 6 aa, Plasmodium falciparum
SDIKEI

SEQ ID NO: 3342695 - protein, 11 aa, Plasmodium falciparum
SDIKEIENSPL

SEQ ID NO: 3342696 - protein, 5 aa, Plasmodium falciparum
SDIKS

SEQ ID NO: 3342697 - protein, 16 aa, Plasmodium falciparum
SDINCSESNIKKPLKT

SEQ ID NO: 3342698 - protein, 47 aa, Plasmodium falciparum
SDINKNGRDKKKKTKKEKKKEKREHLKEKRKKKRPEEKKRKKEKKRE

SEQ ID NO: 3342699 - protein, 11 aa, Plasmodium falciparum
SDINKNNAQGN

SEQ ID NO: 3342700 - protein, 15 aa, Plasmodium falciparum
SDINNNNNNNNNDYN

SEQ ID NO: 3342701 - protein, 8 aa, Plasmodium falciparum
SDIPPSLH

SEQ ID NO: 3342702 - protein, 5 aa, Plasmodium falciparum
SDIPS

SEQ ID NO: 3342703 - protein, 6 aa, Plasmodium falciparum
SDIRRE

SEQ ID NO: 3342704 - protein, 8 aa, Plasmodium falciparum
SDISDTEV

SEQ ID NO: 3342705 - protein, 9 aa, Plasmodium falciparum
SDISKNSNK

SEQ ID NO: 3342706 - protein, 14 aa, Plasmodium falciparum
SDISNKGDEKNAYK

SEQ ID NO: 3342707 - protein, 6 aa, Plasmodium falciparum
SDISNQ

SEQ ID NO: 3342708 - protein, 7 aa, Plasmodium falciparum
SDITEEN

SEQ ID NO: 3342709 - protein, 7 aa, Plasmodium falciparum
SDITNGT

SEQ ID NO: 3342710 - protein, 12 aa, Plasmodium falciparum
SDITSSESEYEE

SEQ ID NO: 3342711 - protein, 8 aa, Plasmodium falciparum
SDKAAVDI

SEQ ID NO: 3342712 - protein, 6 aa, Plasmodium falciparum
SDKAKD

SEQ ID NO: 3342713 - protein, 16 aa, Plasmodium falciparum
SDKCDNEKITKNKNNI

SEQ ID NO: 3342714 - protein, 9 aa, Plasmodium falciparum
SDKDKKENI

SEQ ID NO: 3342715 - protein, 7 aa, Plasmodium falciparum
SDKDNDV

SEQ ID NO: 3342716 - protein, 11 aa, Plasmodium falciparum
SDKEEDEKKNV

SEQ ID NO: 3342717 - protein, 6 aa, Plasmodium falciparum
SDKEEE

SEQ ID NO: 3342718 - protein, 5 aa, Plasmodium falciparum
SDKEK

SEQ ID NO: 3342719 - protein, 10 aa, Plasmodium falciparum
SDKESESGNI

SEQ ID NO: 3342720 - protein, 4 aa, Plasmodium falciparum
SDKF

SEQ ID NO: 3342721 - protein, 4 aa, Plasmodium falciparum
SDKI

SEQ ID NO: 3342722 - protein, 6 aa, Plasmodium falciparum
SDKIKS

SEQ ID NO: 3342723 - protein, 10 aa, Plasmodium falciparum
SDKINDYDNI

SEQ ID NO: 3342724 - protein, 8 aa, Plasmodium falciparum
SDKINNND

SEQ ID NO: 3342725 - protein, 15 aa, Plasmodium falciparum
SDKINSLKSDRLNSL

SEQ ID NO: 3342726 - protein, 37 aa, Plasmodium falciparum
SDKKKKKKKKELDDVEKEGQPKMGVGNDDNINGDKNI

SEQ ID NO: 3342727 - protein, 31 aa, Plasmodium falciparum
SDKKKKKKKKKNVDESSDNKKKKKKKSTSSI

SEQ ID NO: 3342728 - protein, 9 aa, Plasmodium falciparum
SDKKKRKEL

SEQ ID NO: 3342729 - protein, 8 aa, Plasmodium falciparum
SDKKLYDN

SEQ ID NO: 3342730 - protein, 16 aa, Plasmodium falciparum
SDKKNDKHENTKRNYN

SEQ ID NO: 3342731 - protein, 10 aa, Plasmodium falciparum
SDKLNQNQQT

SEQ ID NO: 3342732 - protein, 4 aa, Plasmodium falciparum
SDKN

SEQ ID NO: 3342733 - protein, 10 aa, Plasmodium falciparum
SDKNEKTENN

SEQ ID NO: 3342734 - protein, 6 aa, Plasmodium falciparum
SDKNNF

SEQ ID NO: 3342735 - protein, 20 aa, Plasmodium falciparum
SDKNNNSSLSSRSEKSQSEE

SEQ ID NO: 3342736 - protein, 9 aa, Plasmodium falciparum
SDKNNVNNM

SEQ ID NO: 3342737 - protein, 9 aa, Plasmodium falciparum
SDKNTKEIN

SEQ ID NO: 3342738 - protein, 7 aa, Plasmodium falciparum
SDKNYPN

SEQ ID NO: 3342739 - protein, 9 aa, Plasmodium falciparum
SDKPITKEE

SEQ ID NO: 3342740 - protein, 13 aa, Plasmodium falciparum
SDKQKENKSDGVS

SEQ ID NO: 3342741 - protein, 4 aa, Plasmodium falciparum
SDKR

SEQ ID NO: 3342742 - protein, 8 aa, Plasmodium falciparum
SDKSDNSL

SEQ ID NO: 3342743 - protein, 7 aa, Plasmodium falciparum
SDKSKDI

SEQ ID NO: 3342744 - protein, 9 aa, Plasmodium falciparum
SDKSKKNHK

SEQ ID NO: 3342745 - protein, 8 aa, Plasmodium falciparum
SDKSYNNN

SEQ ID NO: 3342746 - protein, 28 aa, Plasmodium falciparum
SDKTENNVNNNNNNNNNNDNTNYDNQKN

SEQ ID NO: 3342747 - protein, 8 aa, Plasmodium falciparum
SDKTGSMS

SEQ ID NO: 3342748 - protein, 24 aa, Plasmodium falciparum
SDKTNNNTYDEDELKNNKNKKYKN

SEQ ID NO: 3342749 - protein, 39 aa, Plasmodium falciparum
SDKYEQKENMNNIEKKNENNLLSKPDKQEIYQKTNPNEK

SEQ ID NO: 3342750 - protein, 8 aa, Plasmodium falciparum
SDKYKSNK

SEQ ID NO: 3342751 - protein, 22 aa, Plasmodium falciparum
SDLDDENNKSDGSSLNSNDSTA

SEQ ID NO: 3342752 - protein, 15 aa, Plasmodium falciparum
SDLDIRNERNEKDKV

SEQ ID NO: 3342753 - protein, 6 aa, Plasmodium falciparum
SDLDKA

SEQ ID NO: 3342754 - protein, 8 aa, Plasmodium falciparum
SDLGNSMN

SEQ ID NO: 3342755 - protein, 5 aa, Plasmodium falciparum
SDLHK

SEQ ID NO: 3342756 - protein, 12 aa, Plasmodium falciparum
SDLNSNDKDTTI

SEQ ID NO: 3342757 - protein, 5 aa, Plasmodium falciparum
SDLNT

SEQ ID NO: 3342758 - protein, 24 aa, Plasmodium falciparum
SDLPSSNIDEGSCKGCKASDTSSE

SEQ ID NO: 3342759 - protein, 6 aa, Plasmodium falciparum
SDLSKR

SEQ ID NO: 3342760 - protein, 5 aa, Plasmodium falciparum
SDLTN

SEQ ID NO: 3342761 - protein, 4 aa, Plasmodium falciparum
SDME

SEQ ID NO: 3342762 - protein, 8 aa, Plasmodium falciparum
SDMGKNKQ

SEQ ID NO: 3342763 - protein, 7 aa, Plasmodium falciparum
SDMKNDK

SEQ ID NO: 3342764 - protein, 9 aa, Plasmodium falciparum
SDMNPKSSK

SEQ ID NO: 3342765 - protein, 6 aa, Plasmodium falciparum
SDMSPN

SEQ ID NO: 3342766 - protein, 22 aa, Plasmodium falciparum
SDNDMAKNNVENNDMANNNMEN

SEQ ID NO: 3342767 - protein, 37 aa, Plasmodium falciparum
SDNDNNESKDINSNEDEEITDDIKDTNSNNNDNINHN

SEQ ID NO: 3342768 - protein, 7 aa, Plasmodium falciparum
SDNEDEA

SEQ ID NO: 3342769 - protein, 12 aa, Plasmodium falciparum
SDNEINKMDTGS

SEQ ID NO: 3342770 - protein, 4 aa, Plasmodium falciparum
SDNG

SEQ ID NO: 3342771 - protein, 13 aa, Plasmodium falciparum
SDNGGRKKGPNSK

SEQ ID NO: 3342772 - protein, 6 aa, Plasmodium falciparum
SDNGSR

SEQ ID NO: 3342773 - protein, 4 aa, Plasmodium falciparum
SDNH

SEQ ID NO: 3342774 - protein, 9 aa, Plasmodium falciparum
SDNIKNENN

SEQ ID NO: 3342775 - protein, 36 aa, Plasmodium falciparum
SDNINNITNNTNSNVTCEENKELNKDVNTNEETSQI

SEQ ID NO: 3342776 - protein, 4 aa, Plasmodium falciparum
SDNK

SEQ ID NO: 3342777 - protein, 10 aa, Plasmodium falciparum
SDNKENFDKS

SEQ ID NO: 3342778 - protein, 11 aa, Plasmodium falciparum
SDNKENKNRVK

SEQ ID NO: 3342779 - protein, 5 aa, Plasmodium falciparum
SDNKG

SEQ ID NO: 3342780 - protein, 7 aa, Plasmodium falciparum
SDNKQKL

SEQ ID NO: 3342781 - protein, 12 aa, Plasmodium falciparum
SDNKSKKTNEQV

SEQ ID NO: 3342782 - protein, 7 aa, Plasmodium falciparum
SDNLDKD

SEQ ID NO: 3342783 - protein, 13 aa, Plasmodium falciparum
SDNLENNKKENFH

SEQ ID NO: 3342784 - protein, 37 aa, Plasmodium falciparum
SDNLNNNNNNNEDDGVNVDSGINNNSKYNTDDSDIKY

SEQ ID NO: 3342785 - protein, 4 aa, Plasmodium falciparum
SDNM

SEQ ID NO: 3342786 - protein, 8 aa, Plasmodium falciparum
SDNNENVD

SEQ ID NO: 3342787 - protein, 7 aa, Plasmodium falciparum
SDNNEPN

SEQ ID NO: 3342788 - protein, 5 aa, Plasmodium falciparum
SDNNK

SEQ ID NO: 3342789 - protein, 11 aa, Plasmodium falciparum
SDNNLNGTYPN

SEQ ID NO: 3342790 - protein, 8 aa, Plasmodium falciparum
SDNNLSAH

SEQ ID NO: 3342791 - protein, 9 aa, Plasmodium falciparum
SDNNNKLGN

SEQ ID NO: 3342792 - protein, 13 aa, Plasmodium falciparum
SDNNNKNNTYNDC

SEQ ID NO: 3342793 - protein, 23 aa, Plasmodium falciparum
SDNNNNNKSNRNNNNSNNNNSNN

SEQ ID NO: 3342794 - protein, 30 aa, Plasmodium falciparum
SDNSDIKKNPFDNGQDNYNDHYNNNTAYEN

SEQ ID NO: 3342795 - protein, 17 aa, Plasmodium falciparum
SDNSEKEKLKKRNEINK

SEQ ID NO: 3342796 - protein, 11 aa, Plasmodium falciparum
SDNSKRAKSNE

SEQ ID NO: 3342797 - protein, 10 aa, Plasmodium falciparum
SDNSNINNSG

SEQ ID NO: 3342798 - protein, 30 aa, Plasmodium falciparum
SDNSNSNNNSNNNNNNNNNNNNTNSSSSNG

SEQ ID NO: 3342799 - protein, 10 aa, Plasmodium falciparum
SDNSPTKKGV

SEQ ID NO: 3342800 - protein, 6 aa, Plasmodium falciparum
SDNTES

SEQ ID NO: 3342801 - protein, 5 aa, Plasmodium falciparum
SDNTI

SEQ ID NO: 3342802 - protein, 7 aa, Plasmodium falciparum
SDNTYYN

SEQ ID NO: 3342803 - protein, 4 aa, Plasmodium falciparum
SDNY

SEQ ID NO: 3342804 - protein, 19 aa, Plasmodium falciparum
SDNYDDAEDRITGGRNGFG

SEQ ID NO: 3342805 - protein, 8 aa, Plasmodium falciparum
SDNYNNNN

SEQ ID NO: 3342806 - protein, 5 aa, Plasmodium falciparum
SDPGA

SEQ ID NO: 3342807 - protein, 27 aa, Plasmodium falciparum
SDPKKKEFYDKTGMTDDSNYQNHSSNF

SEQ ID NO: 3342808 - protein, 12 aa, Plasmodium falciparum
SDPNPNSPANQE

SEQ ID NO: 3342809 - protein, 12 aa, Plasmodium falciparum
SDPQPDDPQDAE

SEQ ID NO: 3342810 - protein, 8 aa, Plasmodium falciparum
SDPRGSEG

SEQ ID NO: 3342811 - protein, 7 aa, Plasmodium falciparum
SDPSGKF

SEQ ID NO: 3342812 - protein, 6 aa, Plasmodium falciparum
SDPTNM

SEQ ID NO: 3342813 - protein, 4 aa, Plasmodium falciparum
SDPY

SEQ ID NO: 3342814 - protein, 34 aa, Plasmodium falciparum
SDPYMNNDNSHSQYSNSYETENDNLSSENPNVDD

SEQ ID NO: 3342815 - protein, 34 aa, Plasmodium falciparum
SDQEYSNKRSKCDNEYSKQSTLSIDNNESENVQE

SEQ ID NO: 3342816 - protein, 6 aa, Plasmodium falciparum
SDQHNT

SEQ ID NO: 3342817 - protein, 26 aa, Plasmodium falciparum
SDQIEKEMRKKKKKKRKKKDNNINQC

SEQ ID NO: 3342818 - protein, 26 aa, Plasmodium falciparum
SDQKDEEEYSHSSNRSEDEDEERTID

SEQ ID NO: 3342819 - protein, 8 aa, Plasmodium falciparum
SDQKDNKN

SEQ ID NO: 3342820 - protein, 7 aa, Plasmodium falciparum
SDQQEKN

SEQ ID NO: 3342821 - protein, 5 aa, Plasmodium falciparum
SDQTF

SEQ ID NO: 3342822 - protein, 30 aa, Plasmodium falciparum
SDQVQNKINEQNQNDNKTQNNKDVTHKSNL

SEQ ID NO: 3342823 - protein, 6 aa, Plasmodium falciparum
SDQWGN

SEQ ID NO: 3342824 - protein, 4 aa, Plasmodium falciparum
SDRA

SEQ ID NO: 3342825 - protein, 10 aa, Plasmodium falciparum
SDRDEPSDAC

SEQ ID NO: 3342826 - protein, 10 aa, Plasmodium falciparum
SDREKTREEI

SEQ ID NO: 3342827 - protein, 5 aa, Plasmodium falciparum
SDRGN

SEQ ID NO: 3342828 - protein, 6 aa, Plasmodium falciparum
SDRKVK

SEQ ID NO: 3342829 - protein, 29 aa, Plasmodium falciparum
SDRLRNKEQNKKEENNNNNNNNNNNNNNN

SEQ ID NO: 3342830 - protein, 77 aa, Plasmodium falciparum
SDRRNRNKDDNDDNDDDDDNTYDEYNDSRNTYSYESNSDESNSLNKRRRKRKMNNNRNLKKNGTKYNKYKKKNVNEN

SEQ ID NO: 3342831 - protein, 12 aa, Plasmodium falciparum
SDRTKVKKNNKR

SEQ ID NO: 3342832 - protein, 6 aa, Plasmodium falciparum
SDRYKG

SEQ ID NO: 3342833 - protein, 18 aa, Plasmodium falciparum
SDSADEYNNSEKKNKAVL

SEQ ID NO: 3342834 - protein, 13 aa, Plasmodium falciparum
SDSAYKPDLNIWT

SEQ ID NO: 3342835 - protein, 4 aa, Plasmodium falciparum
SDSC

SEQ ID NO: 3342836 - protein, 9 aa, Plasmodium falciparum
SDSCQPNID

SEQ ID NO: 3342837 - protein, 8 aa, Plasmodium falciparum
SDSDKNLI

SEQ ID NO: 3342838 - protein, 7 aa, Plasmodium falciparum
SDSDSYI

SEQ ID NO: 3342839 - protein, 8 aa, Plasmodium falciparum
SDSDTYTY

SEQ ID NO: 3342840 - protein, 24 aa, Plasmodium falciparum
SDSEESDNSEKKDDKKKKKEKQKY

SEQ ID NO: 3342841 - protein, 9 aa, Plasmodium falciparum
SDSERLNST

SEQ ID NO: 3342842 - protein, 26 aa, Plasmodium falciparum
SDSFSSAYEDEDEYSNNNNNNNNNNI

SEQ ID NO: 3342843 - protein, 11 aa, Plasmodium falciparum
SDSGKDGGRLT

SEQ ID NO: 3342844 - protein, 7 aa, Plasmodium falciparum
SDSIGKN

SEQ ID NO: 3342845 - protein, 8 aa, Plasmodium falciparum
SDSKNSFD

SEQ ID NO: 3342846 - protein, 12 aa, Plasmodium falciparum
SDSNNLNKYKGS

SEQ ID NO: 3342847 - protein, 9 aa, Plasmodium falciparum
SDSNQKCKR

SEQ ID NO: 3342848 - protein, 10 aa, Plasmodium falciparum
SDSNSGRRDK

SEQ ID NO: 3342849 - protein, 7 aa, Plasmodium falciparum
SDSPAVS

SEQ ID NO: 3342850 - protein, 14 aa, Plasmodium falciparum
SDSRKIADDCENGN

SEQ ID NO: 3342851 - protein, 7 aa, Plasmodium falciparum
SDSSEYK

SEQ ID NO: 3342852 - protein, 12 aa, Plasmodium falciparum
SDSSYNSNHNNN

SEQ ID NO: 3342853 - protein, 7 aa, Plasmodium falciparum
SDSTDDY

SEQ ID NO: 3342854 - protein, 9 aa, Plasmodium falciparum
SDSVASANK

SEQ ID NO: 3342855 - protein, 8 aa, Plasmodium falciparum
SDSVENKS

SEQ ID NO: 3342856 - protein, 6 aa, Plasmodium falciparum
SDTCDT

SEQ ID NO: 3342857 - protein, 6 aa, Plasmodium falciparum
SDTDCN

SEQ ID NO: 3342858 - protein, 34 aa, Plasmodium falciparum
SDTEKDNNNNKEKDNNNNNNNNKEKDNDNDKENI

SEQ ID NO: 3342859 - protein, 21 aa, Plasmodium falciparum
SDTEKKKNNLKKNVHSESSVS

SEQ ID NO: 3342860 - protein, 20 aa, Plasmodium falciparum
SDTEQITTSGNQTNKSNDNK

SEQ ID NO: 3342861 - protein, 22 aa, Plasmodium falciparum
SDTERRKENDNENNNIYSNGDV

SEQ ID NO: 3342862 - protein, 6 aa, Plasmodium falciparum
SDTKVN

SEQ ID NO: 3342863 - protein, 13 aa, Plasmodium falciparum
SDTLNNSNNYNKD

SEQ ID NO: 3342864 - protein, 14 aa, Plasmodium falciparum
SDTNINIESSRGIS

SEQ ID NO: 3342865 - protein, 7 aa, Plasmodium falciparum
SDTQECS

SEQ ID NO: 3342866 - protein, 18 aa, Plasmodium falciparum
SDTTENDTSENEKNEKKY

SEQ ID NO: 3342867 - protein, 13 aa, Plasmodium falciparum
SDTTTNKLTDNEW

SEQ ID NO: 3342868 - protein, 8 aa, Plasmodium falciparum
SDTVDDDA

SEQ ID NO: 3342869 - protein, 4 aa, Plasmodium falciparum
SDTY

SEQ ID NO: 3342870 - protein, 10 aa, Plasmodium falciparum
SDVDKKRATL

SEQ ID NO: 3342871 - protein, 6 aa, Plasmodium falciparum
SDVEEN

SEQ ID NO: 3342872 - protein, 12 aa, Plasmodium falciparum
SDVEGSHKYESY

SEQ ID NO: 3342873 - protein, 39 aa, Plasmodium falciparum
SDVNNKTNKAQQGEINTHKEPNSMLPNKSENITTPATSL

SEQ ID NO: 3342874 - protein, 9 aa, Plasmodium falciparum
SDVNTKDTS

SEQ ID NO: 3342875 - protein, 5 aa, Plasmodium falciparum
SDVQQ

SEQ ID NO: 3342876 - protein, 7 aa, Plasmodium falciparum
SDVQYER

SEQ ID NO: 3342877 - protein, 5 aa, Plasmodium falciparum
SDVRP

SEQ ID NO: 3342878 - protein, 8 aa, Plasmodium falciparum
SDVTNAKD

SEQ ID NO: 3342879 - protein, 6 aa, Plasmodium falciparum
SDYDKQ

SEQ ID NO: 3342880 - protein, 6 aa, Plasmodium falciparum
SDYEEN

SEQ ID NO: 3342881 - protein, 17 aa, Plasmodium falciparum
SDYENYNKKDKKIKKNK

SEQ ID NO: 3342882 - protein, 9 aa, Plasmodium falciparum
SDYKGNSNI

SEQ ID NO: 3342883 - protein, 5 aa, Plasmodium falciparum
SDYKK

SEQ ID NO: 3342884 - protein, 6 aa, Plasmodium falciparum
SDYKSG

SEQ ID NO: 3342885 - protein, 4 aa, Plasmodium falciparum
SDYN

SEQ ID NO: 3342886 - protein, 14 aa, Plasmodium falciparum
SDYNKTENKESNKY

SEQ ID NO: 3342887 - protein, 8 aa, Plasmodium falciparum
SDYNRNED

SEQ ID NO: 3342888 - protein, 9 aa, Plasmodium falciparum
SDYNSNYDN

SEQ ID NO: 3342889 - protein, 22 aa, Plasmodium falciparum
SDYPKLDEKNEDNYEQSSDEYH

SEQ ID NO: 3342890 - protein, 7 aa, Plasmodium falciparum
SDYPTNS

SEQ ID NO: 3342891 - protein, 9 aa, Plasmodium falciparum
SDYSNDEYR

SEQ ID NO: 3342892 - protein, 11 aa, Plasmodium falciparum
SDYSNTNVKEN

SEQ ID NO: 3342893 - protein, 4 aa, Plasmodium falciparum
SEAD

SEQ ID NO: 3342894 - protein, 4 aa, Plasmodium falciparum
SEAE

SEQ ID NO: 3342895 - protein, 5 aa, Plasmodium falciparum
SEAKD

SEQ ID NO: 3342896 - protein, 7 aa, Plasmodium falciparum
SEANRSA

SEQ ID NO: 3342897 - protein, 10 aa, Plasmodium falciparum
SEASDDKNIT

SEQ ID NO: 3342898 - protein, 24 aa, Plasmodium falciparum
SECSNSKIKGNENKSDGGACAPPR

SEQ ID NO: 3342899 - protein, 11 aa, Plasmodium falciparum
SEDAGLKGQTG

SEQ ID NO: 3342900 - protein, 14 aa, Plasmodium falciparum
SEDDSYPGSSDHEK

SEQ ID NO: 3342901 - protein, 5 aa, Plasmodium falciparum
SEDEE

SEQ ID NO: 3342902 - protein, 4 aa, Plasmodium falciparum
SEDH

SEQ ID NO: 3342903 - protein, 7 aa, Plasmodium falciparum
SEDIKKD

SEQ ID NO: 3342904 - protein, 6 aa, Plasmodium falciparum
SEDIQN

SEQ ID NO: 3342905 - protein, 16 aa, Plasmodium falciparum
SEDKELNSDKQSDKYI

SEQ ID NO: 3342906 - protein, 9 aa, Plasmodium falciparum
SEDKHTKVC

SEQ ID NO: 3342907 - protein, 5 aa, Plasmodium falciparum
SEDKK

SEQ ID NO: 3342908 - protein, 8 aa, Plasmodium falciparum
SEDKKKHN

SEQ ID NO: 3342909 - protein, 17 aa, Plasmodium falciparum
SEDKLNNESKDKNMKNN

SEQ ID NO: 3342910 - protein, 9 aa, Plasmodium falciparum
SEDKNEENH

SEQ ID NO: 3342911 - protein, 4 aa, Plasmodium falciparum
SEDN

SEQ ID NO: 3342912 - protein, 7 aa, Plasmodium falciparum
SEDNEEI

SEQ ID NO: 3342913 - protein, 7 aa, Plasmodium falciparum
SEDNITS

SEQ ID NO: 3342914 - protein, 35 aa, Plasmodium falciparum
SEDNNNNNNKNNDDSNNEDSNNDEDNINNNNNNNN

SEQ ID NO: 3342915 - protein, 10 aa, Plasmodium falciparum
SEDNSPNNIH

SEQ ID NO: 3342916 - protein, 9 aa, Plasmodium falciparum
SEDNSYASG

SEQ ID NO: 3342917 - protein, 15 aa, Plasmodium falciparum
SEDNTDGNSTGKYKH

SEQ ID NO: 3342918 - protein, 4 aa, Plasmodium falciparum
SEDP

SEQ ID NO: 3342919 - protein, 7 aa, Plasmodium falciparum
SEDQAKK

SEQ ID NO: 3342920 - protein, 7 aa, Plasmodium falciparum
SEDREKN

SEQ ID NO: 3342921 - protein, 7 aa, Plasmodium falciparum
SEDSKSR

SEQ ID NO: 3342922 - protein, 11 aa, Plasmodium falciparum
SEDSKVDIDPP

SEQ ID NO: 3342923 - protein, 8 aa, Plasmodium falciparum
SEDSYKDS

SEQ ID NO: 3342924 - protein, 8 aa, Plasmodium falciparum
SEDTIKEH

SEQ ID NO: 3342925 - protein, 6 aa, Plasmodium falciparum
SEDYNN

SEQ ID NO: 3342926 - protein, 7 aa, Plasmodium falciparum
SEEARKN

SEQ ID NO: 3342927 - protein, 5 aa, Plasmodium falciparum
SEECV

SEQ ID NO: 3342928 - protein, 28 aa, Plasmodium falciparum
SEEDEEEEDKEMYNSSKQIKQKKQQQED

SEQ ID NO: 3342929 - protein, 39 aa, Plasmodium falciparum
SEEDEKEVKSENESKHRDKKEKKEKRKNHRSSSDDSESI

SEQ ID NO: 3342930 - protein, 8 aa, Plasmodium falciparum
SEEDNTYY

SEQ ID NO: 3342931 - protein, 6 aa, Plasmodium falciparum
SEEDPQ

SEQ ID NO: 3342932 - protein, 17 aa, Plasmodium falciparum
SEEDQSAKNLDDSKKKN

SEQ ID NO: 3342933 - protein, 5 aa, Plasmodium falciparum
SEEDT

SEQ ID NO: 3342934 - protein, 8 aa, Plasmodium falciparum
SEEEIEGL

SEQ ID NO: 3342935 - protein, 14 aa, Plasmodium falciparum
SEEEKIERNQKIED

SEQ ID NO: 3342936 - protein, 8 aa, Plasmodium falciparum
SEEEKKGK

SEQ ID NO: 3342937 - protein, 10 aa, Plasmodium falciparum
SEEEKNNYFP

SEQ ID NO: 3342938 - protein, 9 aa, Plasmodium falciparum
SEEELQKQV

SEQ ID NO: 3342939 - protein, 18 aa, Plasmodium falciparum
SEEESIGNNKKSEEQKNY

SEQ ID NO: 3342940 - protein, 6 aa, Plasmodium falciparum
SEEEVN

SEQ ID NO: 3342941 - protein, 5 aa, Plasmodium falciparum
SEEGL

SEQ ID NO: 3342942 - protein, 6 aa, Plasmodium falciparum
SEEGYI

SEQ ID NO: 3342943 - protein, 4 aa, Plasmodium falciparum
SEEI

SEQ ID NO: 3342944 - protein, 16 aa, Plasmodium falciparum
SEEISEGKKDGAMEDT

SEQ ID NO: 3342945 - protein, 5 aa, Plasmodium falciparum
SEEKD

SEQ ID NO: 3342946 - protein, 8 aa, Plasmodium falciparum
SEEKEEGL

SEQ ID NO: 3342947 - protein, 7 aa, Plasmodium falciparum
SEEKEGM

SEQ ID NO: 3342948 - protein, 9 aa, Plasmodium falciparum
SEEKENLYN

SEQ ID NO: 3342949 - protein, 5 aa, Plasmodium falciparum
SEEKI

SEQ ID NO: 3342950 - protein, 6 aa, Plasmodium falciparum
SEEKIN

SEQ ID NO: 3342951 - protein, 7 aa, Plasmodium falciparum
SEEKKKK

SEQ ID NO: 3342952 - protein, 11 aa, Plasmodium falciparum
SEEKLKREEEY

SEQ ID NO: 3342953 - protein, 7 aa, Plasmodium falciparum
SEEKNKY

SEQ ID NO: 3342954 - protein, 59 aa, Plasmodium falciparum
SEEKPFSEKEKEVNKKKKRENNMSSGDHGTKKRKEKNSSRNKESEINKKENNKNDEINH

SEQ ID NO: 3342955 - protein, 114 aa, Plasmodium falciparum
SEEKTTELANKQDEPQEENGNEDTSKSNENKNGDSDENKNGDNNENKNGHNNENKNGHNNENKNGDNNENKNGDINENKNDETSKTNSQNDNKEKKSENKNETVLNSSGEKKTT

SEQ ID NO: 3342956 - protein, 4 aa, Plasmodium falciparum
SEEM

SEQ ID NO: 3342957 - protein, 8 aa, Plasmodium falciparum
SEEMGDTN

SEQ ID NO: 3342958 - protein, 10 aa, Plasmodium falciparum
SEEMKRDDYN

SEQ ID NO: 3342959 - protein, 19 aa, Plasmodium falciparum
SEENDQDLSSVNSTSDIEP

SEQ ID NO: 3342960 - protein, 6 aa, Plasmodium falciparum
SEENEP

SEQ ID NO: 3342961 - protein, 28 aa, Plasmodium falciparum
SEENESGDNQTGENDSEEEDSEEDEDYE

SEQ ID NO: 3342962 - protein, 16 aa, Plasmodium falciparum
SEENETEKNNKEENKI

SEQ ID NO: 3342963 - protein, 27 aa, Plasmodium falciparum
SEENKNYINNNEHETTEEQATNGNLHN

SEQ ID NO: 3342964 - protein, 12 aa, Plasmodium falciparum
SEENNNKNRRSS

SEQ ID NO: 3342965 - protein, 19 aa, Plasmodium falciparum
SEENNVSVNENSKKSSANL

SEQ ID NO: 3342966 - protein, 13 aa, Plasmodium falciparum
SEENRNDKINEED

SEQ ID NO: 3342967 - protein, 6 aa, Plasmodium falciparum
SEENSY

SEQ ID NO: 3342968 - protein, 5 aa, Plasmodium falciparum
SEENV

SEQ ID NO: 3342969 - protein, 4 aa, Plasmodium falciparum
SEEP

SEQ ID NO: 3342970 - protein, 6 aa, Plasmodium falciparum
SEEPPD

SEQ ID NO: 3342971 - protein, 4 aa, Plasmodium falciparum
SEEQ

SEQ ID NO: 3342972 - protein, 8 aa, Plasmodium falciparum
SEEQSVQN

SEQ ID NO: 3342973 - protein, 62 aa, Plasmodium falciparum
SEERERKRKRKEKRKKQTNTKDDVDRKDKSDKDNKNYENNTNDKSDKNEDEISSQKDSDESI

SEQ ID NO: 3342974 - protein, 5 aa, Plasmodium falciparum
SEERK

SEQ ID NO: 3342975 - protein, 8 aa, Plasmodium falciparum
SEESIAPP

SEQ ID NO: 3342976 - protein, 9 aa, Plasmodium falciparum
SEETSSQIS

SEQ ID NO: 3342977 - protein, 7 aa, Plasmodium falciparum
SEETTTG

SEQ ID NO: 3342978 - protein, 5 aa, Plasmodium falciparum
SEETW

SEQ ID NO: 3342979 - protein, 5 aa, Plasmodium falciparum
SEEVK

SEQ ID NO: 3342980 - protein, 5 aa, Plasmodium falciparum
SEEYE

SEQ ID NO: 3342981 - protein, 22 aa, Plasmodium falciparum
SEEYNEREKIKKKKKKNERDIK

SEQ ID NO: 3342982 - protein, 7 aa, Plasmodium falciparum
SEFEDEK

SEQ ID NO: 3342983 - protein, 6 aa, Plasmodium falciparum
SEGAKM

SEQ ID NO: 3342984 - protein, 8 aa, Plasmodium falciparum
SEGAQAGL

SEQ ID NO: 3342985 - protein, 72 aa, Plasmodium falciparum
SEGEEESRKEQEKKQNEKNEENEKNEKNEENEKNEENEKNEENEKNEKNEENEKNEENEKNEKNETKEHPTV

SEQ ID NO: 3342986 - protein, 16 aa, Plasmodium falciparum
SEGEGEHSDGNNINEV

SEQ ID NO: 3342987 - protein, 6 aa, Plasmodium falciparum
SEGESI

SEQ ID NO: 3342988 - protein, 4 aa, Plasmodium falciparum
SEGF

SEQ ID NO: 3342989 - protein, 8 aa, Plasmodium falciparum
SEGGLSND

SEQ ID NO: 3342990 - protein, 9 aa, Plasmodium falciparum
SEGIGTNKR

SEQ ID NO: 3342991 - protein, 10 aa, Plasmodium falciparum
SEGISKTAAG

SEQ ID NO: 3342992 - protein, 13 aa, Plasmodium falciparum
SEGITNASRLNGE

SEQ ID NO: 3342993 - protein, 4 aa, Plasmodium falciparum
SEGK

SEQ ID NO: 3342994 - protein, 11 aa, Plasmodium falciparum
SEGKEGKEGKF

SEQ ID NO: 3342995 - protein, 8 aa, Plasmodium falciparum
SEGKKERI

SEQ ID NO: 3342996 - protein, 6 aa, Plasmodium falciparum
SEGKSG

SEQ ID NO: 3342997 - protein, 13 aa, Plasmodium falciparum
SEGKYDSFNNDKD

SEQ ID NO: 3342998 - protein, 4 aa, Plasmodium falciparum
SEGP

SEQ ID NO: 3342999 - protein, 4 aa, Plasmodium falciparum
SEGQ

SEQ ID NO: 3343000 - protein, 4 aa, Plasmodium falciparum
SEGS

SEQ ID NO: 3343001 - protein, 6 aa, Plasmodium falciparum
SEGSRT

SEQ ID NO: 3343002 - protein, 7 aa, Plasmodium falciparum
SEGSSEY

SEQ ID NO: 3343003 - protein, 6 aa, Plasmodium falciparum
SEGTQI

SEQ ID NO: 3343004 - protein, 12 aa, Plasmodium falciparum
SEHEKDERDGKY

SEQ ID NO: 3343005 - protein, 6 aa, Plasmodium falciparum
SEHERD

SEQ ID NO: 3343006 - protein, 9 aa, Plasmodium falciparum
SEHGNNFPS

SEQ ID NO: 3343007 - protein, 6 aa, Plasmodium falciparum
SEHNEG

SEQ ID NO: 3343008 - protein, 69 aa, Plasmodium falciparum
SEHNNEKGVPSNKNKTTSNNNKNNKNKTNKTNNTNKTNNTNKTNNTNKTNNTNKTNKTSNNSYNNNSYN

SEQ ID NO: 3343009 - protein, 8 aa, Plasmodium falciparum
SEHNPPYS

SEQ ID NO: 3343010 - protein, 4 aa, Plasmodium falciparum
SEHY

SEQ ID NO: 3343011 - protein, 5 aa, Plasmodium falciparum
SEIED

SEQ ID NO: 3343012 - protein, 13 aa, Plasmodium falciparum
SEIEETGDLSSDV

SEQ ID NO: 3343013 - protein, 10 aa, Plasmodium falciparum
SEIKKKEEKK

SEQ ID NO: 3343014 - protein, 6 aa, Plasmodium falciparum
SEINSL

SEQ ID NO: 3343015 - protein, 6 aa, Plasmodium falciparum
SEIQQD

SEQ ID NO: 3343016 - protein, 5 aa, Plasmodium falciparum
SEISE

SEQ ID NO: 3343017 - protein, 6 aa, Plasmodium falciparum
SEITSD

SEQ ID NO: 3343018 - protein, 15 aa, Plasmodium falciparum
SEKASNYDKYNEYNK

SEQ ID NO: 3343019 - protein, 6 aa, Plasmodium falciparum
SEKDIN

SEQ ID NO: 3343020 - protein, 5 aa, Plasmodium falciparum
SEKDN

SEQ ID NO: 3343021 - protein, 6 aa, Plasmodium falciparum
SEKDRT

SEQ ID NO: 3343022 - protein, 6 aa, Plasmodium falciparum
SEKEDV

SEQ ID NO: 3343023 - protein, 5 aa, Plasmodium falciparum
SEKEH

SEQ ID NO: 3343024 - protein, 7 aa, Plasmodium falciparum
SEKEIPN

SEQ ID NO: 3343025 - protein, 6 aa, Plasmodium falciparum
SEKENH

SEQ ID NO: 3343026 - protein, 6 aa, Plasmodium falciparum
SEKERW

SEQ ID NO: 3343027 - protein, 6 aa, Plasmodium falciparum
SEKEYD

SEQ ID NO: 3343028 - protein, 4 aa, Plasmodium falciparum
SEKF

SEQ ID NO: 3343029 - protein, 8 aa, Plasmodium falciparum
SEKGNKTD

SEQ ID NO: 3343030 - protein, 7 aa, Plasmodium falciparum
SEKGNSF

SEQ ID NO: 3343031 - protein, 4 aa, Plasmodium falciparum
SEKI

SEQ ID NO: 3343032 - protein, 7 aa, Plasmodium falciparum
SEKIEQK

SEQ ID NO: 3343033 - protein, 9 aa, Plasmodium falciparum
SEKKDKKEE

SEQ ID NO: 3343034 - protein, 29 aa, Plasmodium falciparum
SEKKKKTYSLDTSGKINTLTKNDNKEKYN

SEQ ID NO: 3343035 - protein, 6 aa, Plasmodium falciparum
SEKKND

SEQ ID NO: 3343036 - protein, 24 aa, Plasmodium falciparum
SEKKNGFTTKYDSKKSYSSKKSSL

SEQ ID NO: 3343037 - protein, 9 aa, Plasmodium falciparum
SEKKNVKKS

SEQ ID NO: 3343038 - protein, 15 aa, Plasmodium falciparum
SEKKSEEDDDDGDSI

SEQ ID NO: 3343039 - protein, 7 aa, Plasmodium falciparum
SEKKVDN

SEQ ID NO: 3343040 - protein, 14 aa, Plasmodium falciparum
SEKLKARALRFGIT

SEQ ID NO: 3343041 - protein, 13 aa, Plasmodium falciparum
SEKLYDSDEEEVV

SEQ ID NO: 3343042 - protein, 9 aa, Plasmodium falciparum
SEKNDGAKN

SEQ ID NO: 3343043 - protein, 13 aa, Plasmodium falciparum
SEKNGTTNEDQKN

SEQ ID NO: 3343044 - protein, 27 aa, Plasmodium falciparum
SEKNIKNKSRKRTDTLKQEDEKKRKSI

SEQ ID NO: 3343045 - protein, 10 aa, Plasmodium falciparum
SEKNKENEKY

SEQ ID NO: 3343046 - protein, 6 aa, Plasmodium falciparum
SEKNKS

SEQ ID NO: 3343047 - protein, 5 aa, Plasmodium falciparum
SEKNL

SEQ ID NO: 3343048 - protein, 19 aa, Plasmodium falciparum
SEKNNMYKQKEDKKQINNK

SEQ ID NO: 3343049 - protein, 6 aa, Plasmodium falciparum
SEKNQK

SEQ ID NO: 3343050 - protein, 10 aa, Plasmodium falciparum
SEKPGEDKNT

SEQ ID NO: 3343051 - protein, 7 aa, Plasmodium falciparum
SEKPLNE

SEQ ID NO: 3343052 - protein, 26 aa, Plasmodium falciparum
SEKRKKERKEQKKRKHSNEQEKEDEF

SEQ ID NO: 3343053 - protein, 6 aa, Plasmodium falciparum
SEKRKL

SEQ ID NO: 3343054 - protein, 7 aa, Plasmodium falciparum
SEKRNVP

SEQ ID NO: 3343055 - protein, 19 aa, Plasmodium falciparum
SEKRQKRQGNNTFTKGNKG

SEQ ID NO: 3343056 - protein, 7 aa, Plasmodium falciparum
SEKSDDL

SEQ ID NO: 3343057 - protein, 5 aa, Plasmodium falciparum
SEKSI

SEQ ID NO: 3343058 - protein, 8 aa, Plasmodium falciparum
SEKSKEER

SEQ ID NO: 3343059 - protein, 9 aa, Plasmodium falciparum
SEKSQVQNT

SEQ ID NO: 3343060 - protein, 7 aa, Plasmodium falciparum
SEKSRSL

SEQ ID NO: 3343061 - protein, 28 aa, Plasmodium falciparum
SEKSYEQKCGEHSKRGEEMNGEYEKGDI

SEQ ID NO: 3343062 - protein, 8 aa, Plasmodium falciparum
SEKTDNDK

SEQ ID NO: 3343063 - protein, 11 aa, Plasmodium falciparum
SEKTRNSDNFN

SEQ ID NO: 3343064 - protein, 11 aa, Plasmodium falciparum
SEKYDETSKSE

SEQ ID NO: 3343065 - protein, 14 aa, Plasmodium falciparum
SEKYGKSKKGNKNL

SEQ ID NO: 3343066 - protein, 4 aa, Plasmodium falciparum
SELE

SEQ ID NO: 3343067 - protein, 7 aa, Plasmodium falciparum
SELEAGK

SEQ ID NO: 3343068 - protein, 6 aa, Plasmodium falciparum
SELEKK

SEQ ID NO: 3343069 - protein, 7 aa, Plasmodium falciparum
SELENKE

SEQ ID NO: 3343070 - protein, 6 aa, Plasmodium falciparum
SELKPI

SEQ ID NO: 3343071 - protein, 5 aa, Plasmodium falciparum
SELNQ

SEQ ID NO: 3343072 - protein, 13 aa, Plasmodium falciparum
SELNSKDDEVKKR

SEQ ID NO: 3343073 - protein, 10 aa, Plasmodium falciparum
SELQKDNESL

SEQ ID NO: 3343074 - protein, 8 aa, Plasmodium falciparum
SELRGSSN

SEQ ID NO: 3343075 - protein, 19 aa, Plasmodium falciparum
SELRNKEGVARSVDPSKVE

SEQ ID NO: 3343076 - protein, 13 aa, Plasmodium falciparum
SELSHNPKNNIPN

SEQ ID NO: 3343077 - protein, 8 aa, Plasmodium falciparum
SELSNNNE

SEQ ID NO: 3343078 - protein, 12 aa, Plasmodium falciparum
SELSPQSNTSPI

SEQ ID NO: 3343079 - protein, 12 aa, Plasmodium falciparum
SELSQYSYNDSN

SEQ ID NO: 3343080 - protein, 10 aa, Plasmodium falciparum
SELSSNEESP

SEQ ID NO: 3343081 - protein, 5 aa, Plasmodium falciparum
SELST

SEQ ID NO: 3343082 - protein, 4 aa, Plasmodium falciparum
SELT

SEQ ID NO: 3343083 - protein, 9 aa, Plasmodium falciparum
SELTTEDPV

SEQ ID NO: 3343084 - protein, 6 aa, Plasmodium falciparum
SEMKTK

SEQ ID NO: 3343085 - protein, 21 aa, Plasmodium falciparum
SEMSGEMSGEMSGEMSGEMSG

SEQ ID NO: 3343086 - protein, 114 aa, Plasmodium falciparum
SEMSRNNTYNGTDNDNNNNNNDNNNDNNNNDNNNDNNNNDNNNDNNNDNNNNNSNNDSNNNNNDSNNNNNDSNNNNNDSNNNNNDSNNNNNDNNSNNNNSRRHNADEANYNTLG

SEQ ID NO: 3343087 - protein, 13 aa, Plasmodium falciparum
SENAQTKNDASTN

SEQ ID NO: 3343088 - protein, 5 aa, Plasmodium falciparum
SENDF

SEQ ID NO: 3343089 - protein, 12 aa, Plasmodium falciparum
SENDHNEKNENT

SEQ ID NO: 3343090 - protein, 7 aa, Plasmodium falciparum
SENDKNE

SEQ ID NO: 3343091 - protein, 24 aa, Plasmodium falciparum
SENEEDNNIDNNSNNNNSDNNLDN

SEQ ID NO: 3343092 - protein, 19 aa, Plasmodium falciparum
SENEKGIIGSQKEEEQNIS

SEQ ID NO: 3343093 - protein, 8 aa, Plasmodium falciparum
SENEKNKN

SEQ ID NO: 3343094 - protein, 11 aa, Plasmodium falciparum
SENEKSKARDR

SEQ ID NO: 3343095 - protein, 25 aa, Plasmodium falciparum
SENENEKEKEKENKNEEKNRNTTNS

SEQ ID NO: 3343096 - protein, 8 aa, Plasmodium falciparum
SENENSVI

SEQ ID NO: 3343097 - protein, 8 aa, Plasmodium falciparum
SENEQAEK

SEQ ID NO: 3343098 - protein, 9 aa, Plasmodium falciparum
SENEQSNKT

SEQ ID NO: 3343099 - protein, 5 aa, Plasmodium falciparum
SENER

SEQ ID NO: 3343100 - protein, 28 aa, Plasmodium falciparum
SENGEIKKSTSGRLSDDGIKRTPSGKPI

SEQ ID NO: 3343101 - protein, 6 aa, Plasmodium falciparum
SENGKV

SEQ ID NO: 3343102 - protein, 4 aa, Plasmodium falciparum
SENK

SEQ ID NO: 3343103 - protein, 5 aa, Plasmodium falciparum
SENKD

SEQ ID NO: 3343104 - protein, 8 aa, Plasmodium falciparum
SENKELDL

SEQ ID NO: 3343105 - protein, 7 aa, Plasmodium falciparum
SENKKAS

SEQ ID NO: 3343106 - protein, 64 aa, Plasmodium falciparum
SENKKEPKDQQNGNNDNNDNNDNNENNKNNENNENNENNENNENNENNENNKNNENNKDKYDDV

SEQ ID NO: 3343107 - protein, 6 aa, Plasmodium falciparum
SENKNV

SEQ ID NO: 3343108 - protein, 13 aa, Plasmodium falciparum
SENKRDKNNYGEH

SEQ ID NO: 3343109 - protein, 9 aa, Plasmodium falciparum
SENKSINNE

SEQ ID NO: 3343110 - protein, 8 aa, Plasmodium falciparum
SENKTRKN

SEQ ID NO: 3343111 - protein, 9 aa, Plasmodium falciparum
SENKVSEQN

SEQ ID NO: 3343112 - protein, 19 aa, Plasmodium falciparum
SENLDTSKNKEQKSGNNSW

SEQ ID NO: 3343113 - protein, 11 aa, Plasmodium falciparum
SENLKKQTVTK

SEQ ID NO: 3343114 - protein, 6 aa, Plasmodium falciparum
SENLNE

SEQ ID NO: 3343115 - protein, 4 aa, Plasmodium falciparum
SENN

SEQ ID NO: 3343116 - protein, 28 aa, Plasmodium falciparum
SENNKDKNICKDEEKKFSNDNKTDDNEM

SEQ ID NO: 3343117 - protein, 35 aa, Plasmodium falciparum
SENNKIKSSEKDIEENDKNSQKDMKKYKPKVQTKI

SEQ ID NO: 3343118 - protein, 6 aa, Plasmodium falciparum
SENNKN

SEQ ID NO: 3343119 - protein, 36 aa, Plasmodium falciparum
SENNKSNNKSNESTKKKKTTKFKETCEKKKYKTKKK

SEQ ID NO: 3343120 - protein, 15 aa, Plasmodium falciparum
SENNLESQDDENEHK

SEQ ID NO: 3343121 - protein, 9 aa, Plasmodium falciparum
SENNNNNNN

SEQ ID NO: 3343122 - protein, 9 aa, Plasmodium falciparum
SENNPLLEE

SEQ ID NO: 3343123 - protein, 12 aa, Plasmodium falciparum
SENNRNNMNDTK

SEQ ID NO: 3343124 - protein, 13 aa, Plasmodium falciparum
SENNTNDKHNLKE

SEQ ID NO: 3343125 - protein, 39 aa, Plasmodium falciparum
SENNTTSENITTSENITTSENITTSENITTGENITTGEN

SEQ ID NO: 3343126 - protein, 10 aa, Plasmodium falciparum
SENPEENAKE

SEQ ID NO: 3343127 - protein, 8 aa, Plasmodium falciparum
SENPNEPF

SEQ ID NO: 3343128 - protein, 11 aa, Plasmodium falciparum
SENRKKGLRDM

SEQ ID NO: 3343129 - protein, 5 aa, Plasmodium falciparum
SENSI

SEQ ID NO: 3343130 - protein, 7 aa, Plasmodium falciparum
SENTFGE

SEQ ID NO: 3343131 - protein, 8 aa, Plasmodium falciparum
SENTGTAY

SEQ ID NO: 3343132 - protein, 12 aa, Plasmodium falciparum
SENTLTKQPKNI

SEQ ID NO: 3343133 - protein, 11 aa, Plasmodium falciparum
SENTMDNIGNT

SEQ ID NO: 3343134 - protein, 4 aa, Plasmodium falciparum
SENV

SEQ ID NO: 3343135 - protein, 9 aa, Plasmodium falciparum
SENVDSNKF

SEQ ID NO: 3343136 - protein, 11 aa, Plasmodium falciparum
SENVKNSQMGP

SEQ ID NO: 3343137 - protein, 20 aa, Plasmodium falciparum
SENVNSDNNIPDDSEQYGDD

SEQ ID NO: 3343138 - protein, 10 aa, Plasmodium falciparum
SENYENKEEF

SEQ ID NO: 3343139 - protein, 13 aa, Plasmodium falciparum
SENYERKSISSEN

SEQ ID NO: 3343140 - protein, 5 aa, Plasmodium falciparum
SENYK

SEQ ID NO: 3343141 - protein, 5 aa, Plasmodium falciparum
SENYN

SEQ ID NO: 3343142 - protein, 6 aa, Plasmodium falciparum
SENYNN

SEQ ID NO: 3343143 - protein, 16 aa, Plasmodium falciparum
SENYNNDNNNNNNNNV

SEQ ID NO: 3343144 - protein, 5 aa, Plasmodium falciparum
SENYT

SEQ ID NO: 3343145 - protein, 4 aa, Plasmodium falciparum
SEPA

SEQ ID NO: 3343146 - protein, 6 aa, Plasmodium falciparum
SEPAHE

SEQ ID NO: 3343147 - protein, 5 aa, Plasmodium falciparum
SEPER

SEQ ID NO: 3343148 - protein, 4 aa, Plasmodium falciparum
SEPL

SEQ ID NO: 3343149 - protein, 6 aa, Plasmodium falciparum
SEPLSA

SEQ ID NO: 3343150 - protein, 4 aa, Plasmodium falciparum
SEPN

SEQ ID NO: 3343151 - protein, 11 aa, Plasmodium falciparum
SEPRDKNSTGI

SEQ ID NO: 3343152 - protein, 33 aa, Plasmodium falciparum
SEQEDQPISDTSKNDINKNKDLHNQSNNINNNN

SEQ ID NO: 3343153 - protein, 9 aa, Plasmodium falciparum
SEQEEKTLE

SEQ ID NO: 3343154 - protein, 13 aa, Plasmodium falciparum
SEQEEVKNKNESV

SEQ ID NO: 3343155 - protein, 6 aa, Plasmodium falciparum
SEQENI

SEQ ID NO: 3343156 - protein, 9 aa, Plasmodium falciparum
SEQKDDLGT

SEQ ID NO: 3343157 - protein, 12 aa, Plasmodium falciparum
SEQKLPGCQDTG

SEQ ID NO: 3343158 - protein, 5 aa, Plasmodium falciparum
SEQLA

SEQ ID NO: 3343159 - protein, 5 aa, Plasmodium falciparum
SEQLT

SEQ ID NO: 3343160 - protein, 14 aa, Plasmodium falciparum
SEQNHKSNDNNYDN

SEQ ID NO: 3343161 - protein, 19 aa, Plasmodium falciparum
SEQNKINSDPKPYKPLSNE

SEQ ID NO: 3343162 - protein, 23 aa, Plasmodium falciparum
SEQNNKKKKISKTKKDKSHQNTT

SEQ ID NO: 3343163 - protein, 13 aa, Plasmodium falciparum
SEQNNSLADNKPM

SEQ ID NO: 3343164 - protein, 8 aa, Plasmodium falciparum
SEQPTLET

SEQ ID NO: 3343165 - protein, 8 aa, Plasmodium falciparum
SEQPVPPQ

SEQ ID NO: 3343166 - protein, 17 aa, Plasmodium falciparum
SEQSRNSTENVASNNDM

SEQ ID NO: 3343167 - protein, 19 aa, Plasmodium falciparum
SEQTNDDEENSDTDNDLPY

SEQ ID NO: 3343168 - protein, 44 aa, Plasmodium falciparum
SEQTNEINYDEEKKVNKKTNHEKMKKKKKKKKKKKKKKKKEKKQ

SEQ ID NO: 3343169 - protein, 17 aa, Plasmodium falciparum
SEQYGNLTNESGETTSH

SEQ ID NO: 3343170 - protein, 9 aa, Plasmodium falciparum
SERATNDTK

SEQ ID NO: 3343171 - protein, 8 aa, Plasmodium falciparum
SERDPKEE

SEQ ID NO: 3343172 - protein, 8 aa, Plasmodium falciparum
SERDPTEE

SEQ ID NO: 3343173 - protein, 5 aa, Plasmodium falciparum
SERGK

SEQ ID NO: 3343174 - protein, 8 aa, Plasmodium falciparum
SERKFTDD

SEQ ID NO: 3343175 - protein, 9 aa, Plasmodium falciparum
SERKKKKRF

SEQ ID NO: 3343176 - protein, 15 aa, Plasmodium falciparum
SERKRRGRKKKDPNN

SEQ ID NO: 3343177 - protein, 13 aa, Plasmodium falciparum
SERLKQTKATGSI

SEQ ID NO: 3343178 - protein, 4 aa, Plasmodium falciparum
SERM

SEQ ID NO: 3343179 - protein, 7 aa, Plasmodium falciparum
SERNDTN

SEQ ID NO: 3343180 - protein, 8 aa, Plasmodium falciparum
SERQENDL

SEQ ID NO: 3343181 - protein, 22 aa, Plasmodium falciparum
SERRKKNKIQKEKKKAQKLEGE

SEQ ID NO: 3343182 - protein, 5 aa, Plasmodium falciparum
SERSQ

SEQ ID NO: 3343183 - protein, 9 aa, Plasmodium falciparum
SERSSFTKS

SEQ ID NO: 3343184 - protein, 5 aa, Plasmodium falciparum
SERVR

SEQ ID NO: 3343185 - protein, 6 aa, Plasmodium falciparum
SERVSN

SEQ ID NO: 3343186 - protein, 7 aa, Plasmodium falciparum
SESDDSV

SEQ ID NO: 3343187 - protein, 8 aa, Plasmodium falciparum
SESDVNRK

SEQ ID NO: 3343188 - protein, 4 aa, Plasmodium falciparum
SESE

SEQ ID NO: 3343189 - protein, 15 aa, Plasmodium falciparum
SESEDYNSSSSNNTD

SEQ ID NO: 3343190 - protein, 16 aa, Plasmodium falciparum
SESEEDDNVTKNIKKN

SEQ ID NO: 3343191 - protein, 8 aa, Plasmodium falciparum
SESEEMNT

SEQ ID NO: 3343192 - protein, 16 aa, Plasmodium falciparum
SESEKKDSYEVKGRGE

SEQ ID NO: 3343193 - protein, 5 aa, Plasmodium falciparum
SESEY

SEQ ID NO: 3343194 - protein, 6 aa, Plasmodium falciparum
SESMGD

SEQ ID NO: 3343195 - protein, 13 aa, Plasmodium falciparum
SESPTQKAIVHKY

SEQ ID NO: 3343196 - protein, 6 aa, Plasmodium falciparum
SESRGF

SEQ ID NO: 3343197 - protein, 5 aa, Plasmodium falciparum
SESRL

SEQ ID NO: 3343198 - protein, 9 aa, Plasmodium falciparum
SESSGPPGA

SEQ ID NO: 3343199 - protein, 10 aa, Plasmodium falciparum
SESSLPKEEI

SEQ ID NO: 3343200 - protein, 13 aa, Plasmodium falciparum
SESSSNDEESSDM

SEQ ID NO: 3343201 - protein, 8 aa, Plasmodium falciparum
SESTKKKY

SEQ ID NO: 3343202 - protein, 18 aa, Plasmodium falciparum
SESTNSLLSSQKNTQVGN

SEQ ID NO: 3343203 - protein, 10 aa, Plasmodium falciparum
SESTNTRGSI

SEQ ID NO: 3343204 - protein, 4 aa, Plasmodium falciparum
SESV

SEQ ID NO: 3343205 - protein, 12 aa, Plasmodium falciparum
SESYKNSRDINY

SEQ ID NO: 3343206 - protein, 25 aa, Plasmodium falciparum
SESYPSSGNLNNNGNSNMNGNHNRY

SEQ ID NO: 3343207 - protein, 20 aa, Plasmodium falciparum
SETDDDSYKEEDYTYNRDEN

SEQ ID NO: 3343208 - protein, 8 aa, Plasmodium falciparum
SETGSGKT

SEQ ID NO: 3343209 - protein, 12 aa, Plasmodium falciparum
SETHAESATRPF

SEQ ID NO: 3343210 - protein, 44 aa, Plasmodium falciparum
SETHTKKNHLDEKENNNNNNNNNKIVEKKKNKQTDDNKTNQDDV

SEQ ID NO: 3343211 - protein, 7 aa, Plasmodium falciparum
SETKNMG

SEQ ID NO: 3343212 - protein, 13 aa, Plasmodium falciparum
SETNKNKMDSNLK

SEQ ID NO: 3343213 - protein, 5 aa, Plasmodium falciparum
SETPI

SEQ ID NO: 3343214 - protein, 5 aa, Plasmodium falciparum
SETRD

SEQ ID NO: 3343215 - protein, 6 aa, Plasmodium falciparum
SETSAT

SEQ ID NO: 3343216 - protein, 6 aa, Plasmodium falciparum
SETSQS

SEQ ID NO: 3343217 - protein, 7 aa, Plasmodium falciparum
SETVNDK

SEQ ID NO: 3343218 - protein, 21 aa, Plasmodium falciparum
SETVSKSNVKINEGKIEKEKL

SEQ ID NO: 3343219 - protein, 8 aa, Plasmodium falciparum
SEVEDEGI

SEQ ID NO: 3343220 - protein, 6 aa, Plasmodium falciparum
SEVPIN

SEQ ID NO: 3343221 - protein, 6 aa, Plasmodium falciparum
SEVVPN

SEQ ID NO: 3343222 - protein, 7 aa, Plasmodium falciparum
SEVYPQK

SEQ ID NO: 3343223 - protein, 10 aa, Plasmodium falciparum
SEYDKAKEQN

SEQ ID NO: 3343224 - protein, 5 aa, Plasmodium falciparum
SEYEN

SEQ ID NO: 3343225 - protein, 5 aa, Plasmodium falciparum
SEYIK

SEQ ID NO: 3343226 - protein, 4 aa, Plasmodium falciparum
SEYN

SEQ ID NO: 3343227 - protein, 18 aa, Plasmodium falciparum
SEYNIEKQNKHNKNNDIN

SEQ ID NO: 3343228 - protein, 6 aa, Plasmodium falciparum
SEYRNY

SEQ ID NO: 3343229 - protein, 4 aa, Plasmodium falciparum
SEYS

SEQ ID NO: 3343230 - protein, 6 aa, Plasmodium falciparum
SEYSFP

SEQ ID NO: 3343231 - protein, 5 aa, Plasmodium falciparum
SEYSS

SEQ ID NO: 3343232 - protein, 18 aa, Plasmodium falciparum
SEYTQMSGRAGRRSSDKY

SEQ ID NO: 3343233 - protein, 6 aa, Plasmodium falciparum
SEYVST

SEQ ID NO: 3343234 - protein, 21 aa, Plasmodium falciparum
SFATSQDMNNSIKENNNNKNC

SEQ ID NO: 3343235 - protein, 6 aa, Plasmodium falciparum
SFDDEG

SEQ ID NO: 3343236 - protein, 11 aa, Plasmodium falciparum
SFDKPREGFTS

SEQ ID NO: 3343237 - protein, 50 aa, Plasmodium falciparum
SFDKSKNESDNDDENDYKITNQEKENAQSEKEGKGKNAQSPNNDNDQNEV

SEQ ID NO: 3343238 - protein, 5 aa, Plasmodium falciparum
SFDNN

SEQ ID NO: 3343239 - protein, 15 aa, Plasmodium falciparum
SFDNNPKESYSDNND

SEQ ID NO: 3343240 - protein, 11 aa, Plasmodium falciparum
SFDNPKEVANS

SEQ ID NO: 3343241 - protein, 4 aa, Plasmodium falciparum
SFDS

SEQ ID NO: 3343242 - protein, 19 aa, Plasmodium falciparum
SFDSKKSMDCNDPSSSSIY

SEQ ID NO: 3343243 - protein, 8 aa, Plasmodium falciparum
SFEDNNYR

SEQ ID NO: 3343244 - protein, 7 aa, Plasmodium falciparum
SFEENKQ

SEQ ID NO: 3343245 - protein, 14 aa, Plasmodium falciparum
SFEKKKQKKSSSHG

SEQ ID NO: 3343246 - protein, 6 aa, Plasmodium falciparum
SFEKRE

SEQ ID NO: 3343247 - protein, 6 aa, Plasmodium falciparum
SFENNK

SEQ ID NO: 3343248 - protein, 11 aa, Plasmodium falciparum
SFENNKKNNIN

SEQ ID NO: 3343249 - protein, 11 aa, Plasmodium falciparum
SFENSKKSSLY

SEQ ID NO: 3343250 - protein, 7 aa, Plasmodium falciparum
SFENTNI

SEQ ID NO: 3343251 - protein, 31 aa, Plasmodium falciparum
SFEPSENIKEQSNKKGSIETSSSRTSDTSMS

SEQ ID NO: 3343252 - protein, 8 aa, Plasmodium falciparum
SFERETDG

SEQ ID NO: 3343253 - protein, 7 aa, Plasmodium falciparum
SFESTTS

SEQ ID NO: 3343254 - protein, 7 aa, Plasmodium falciparum
SFGDKNY

SEQ ID NO: 3343255 - protein, 5 aa, Plasmodium falciparum
SFGEK

SEQ ID NO: 3343256 - protein, 5 aa, Plasmodium falciparum
SFGGN

SEQ ID NO: 3343257 - protein, 7 aa, Plasmodium falciparum
SFGNDKN

SEQ ID NO: 3343258 - protein, 10 aa, Plasmodium falciparum
SFGPAEYDNN

SEQ ID NO: 3343259 - protein, 4 aa, Plasmodium falciparum
SFHN

SEQ ID NO: 3343260 - protein, 7 aa, Plasmodium falciparum
SFHSNKK

SEQ ID NO: 3343261 - protein, 6 aa, Plasmodium falciparum
SFKRNK

SEQ ID NO: 3343262 - protein, 10 aa, Plasmodium falciparum
SFKSSRNNLN

SEQ ID NO: 3343263 - protein, 14 aa, Plasmodium falciparum
SFLKQDKDKNISKC

SEQ ID NO: 3343264 - protein, 11 aa, Plasmodium falciparum
SFNDKNPYNHN

SEQ ID NO: 3343265 - protein, 5 aa, Plasmodium falciparum
SFNDS

SEQ ID NO: 3343266 - protein, 11 aa, Plasmodium falciparum
SFNENEPKYDD

SEQ ID NO: 3343267 - protein, 7 aa, Plasmodium falciparum
SFNERAP

SEQ ID NO: 3343268 - protein, 15 aa, Plasmodium falciparum
SFNGKEQNKDDAEEI

SEQ ID NO: 3343269 - protein, 6 aa, Plasmodium falciparum
SFNGQV

SEQ ID NO: 3343270 - protein, 4 aa, Plasmodium falciparum
SFNK

SEQ ID NO: 3343271 - protein, 10 aa, Plasmodium falciparum
SFNKNSDNNN

SEQ ID NO: 3343272 - protein, 5 aa, Plasmodium falciparum
SFNNE

SEQ ID NO: 3343273 - protein, 10 aa, Plasmodium falciparum
SFNNNDNNID

SEQ ID NO: 3343274 - protein, 14 aa, Plasmodium falciparum
SFNNSTNNKSSINY

SEQ ID NO: 3343275 - protein, 17 aa, Plasmodium falciparum
SFNSNSDHMEPKYDGYD

SEQ ID NO: 3343276 - protein, 10 aa, Plasmodium falciparum
SFNTSNATTI

SEQ ID NO: 3343277 - protein, 5 aa, Plasmodium falciparum
SFPDA

SEQ ID NO: 3343278 - protein, 14 aa, Plasmodium falciparum
SFPEEKKRNNSITN

SEQ ID NO: 3343279 - protein, 12 aa, Plasmodium falciparum
SFPENLSSNAQY

SEQ ID NO: 3343280 - protein, 12 aa, Plasmodium falciparum
SFPKDDKEKPPH

SEQ ID NO: 3343281 - protein, 16 aa, Plasmodium falciparum
SFPKNTHELDNREKKF

SEQ ID NO: 3343282 - protein, 14 aa, Plasmodium falciparum
SFPNSNKEFNSNSE

SEQ ID NO: 3343283 - protein, 5 aa, Plasmodium falciparum
SFPPY

SEQ ID NO: 3343284 - protein, 6 aa, Plasmodium falciparum
SFPSKN

SEQ ID NO: 3343285 - protein, 5 aa, Plasmodium falciparum
SFPYP

SEQ ID NO: 3343286 - protein, 22 aa, Plasmodium falciparum
SFQKKKKKKKKKKKIKNITHNE

SEQ ID NO: 3343287 - protein, 14 aa, Plasmodium falciparum
SFRSRSRSKNYNTY

SEQ ID NO: 3343288 - protein, 22 aa, Plasmodium falciparum
SFSDVDNNKTQSSSLNSSSSTF

SEQ ID NO: 3343289 - protein, 30 aa, Plasmodium falciparum
SFSDYNKESDNNSYLTKQKRKRKNENINYD

SEQ ID NO: 3343290 - protein, 7 aa, Plasmodium falciparum
SFSGNND

SEQ ID NO: 3343291 - protein, 5 aa, Plasmodium falciparum
SFSKN

SEQ ID NO: 3343292 - protein, 5 aa, Plasmodium falciparum
SFSMT

SEQ ID NO: 3343293 - protein, 11 aa, Plasmodium falciparum
SFSNDKNNIHN

SEQ ID NO: 3343294 - protein, 10 aa, Plasmodium falciparum
SFSSSEAQKL

SEQ ID NO: 3343295 - protein, 21 aa, Plasmodium falciparum
SFSSSSSSSSSSSSSSSSSSF

SEQ ID NO: 3343296 - protein, 5 aa, Plasmodium falciparum
SFSSY

SEQ ID NO: 3343297 - protein, 6 aa, Plasmodium falciparum
SFSTKN

SEQ ID NO: 3343298 - protein, 5 aa, Plasmodium falciparum
SFSYE

SEQ ID NO: 3343299 - protein, 22 aa, Plasmodium falciparum
SFTESENKEKQSVIEDTKDNVH

SEQ ID NO: 3343300 - protein, 6 aa, Plasmodium falciparum
SFTNEE

SEQ ID NO: 3343301 - protein, 5 aa, Plasmodium falciparum
SFTSK

SEQ ID NO: 3343302 - protein, 18 aa, Plasmodium falciparum
SFTSSTLGKKKNSIGNTS

SEQ ID NO: 3343303 - protein, 12 aa, Plasmodium falciparum
SFVENKEKKENG

SEQ ID NO: 3343304 - protein, 35 aa, Plasmodium falciparum
SFVKDGNEDENSNYSNSSSDNSSSYADLSDSSNDN

SEQ ID NO: 3343305 - protein, 9 aa, Plasmodium falciparum
SFVPTPKEK

SEQ ID NO: 3343306 - protein, 12 aa, Plasmodium falciparum
SFYNQKKKEQIL

SEQ ID NO: 3343307 - protein, 6 aa, Plasmodium falciparum
SGAGKT

SEQ ID NO: 3343308 - protein, 9 aa, Plasmodium falciparum
SGATPKTSK

SEQ ID NO: 3343309 - protein, 6 aa, Plasmodium falciparum
SGAVSE

SEQ ID NO: 3343310 - protein, 6 aa, Plasmodium falciparum
SGCGPV

SEQ ID NO: 3343311 - protein, 40 aa, Plasmodium falciparum
SGDDINDDNISGDNINDDNISGDNINDDNINDDNIKDNNI

SEQ ID NO: 3343312 - protein, 9 aa, Plasmodium falciparum
SGDEKGNTN

SEQ ID NO: 3343313 - protein, 14 aa, Plasmodium falciparum
SGDGKIKESDHKTT

SEQ ID NO: 3343314 - protein, 18 aa, Plasmodium falciparum
SGDGKKNISEEYNMNDKE

SEQ ID NO: 3343315 - protein, 11 aa, Plasmodium falciparum
SGDGSSSVINE

SEQ ID NO: 3343316 - protein, 8 aa, Plasmodium falciparum
SGDGTLRK

SEQ ID NO: 3343317 - protein, 5 aa, Plasmodium falciparum
SGDHT

SEQ ID NO: 3343318 - protein, 15 aa, Plasmodium falciparum
SGDISTNKLTDNEWN

SEQ ID NO: 3343319 - protein, 12 aa, Plasmodium falciparum
SGDKKNKSRTSL

SEQ ID NO: 3343320 - protein, 9 aa, Plasmodium falciparum
SGDKKTDLD

SEQ ID NO: 3343321 - protein, 4 aa, Plasmodium falciparum
SGDN

SEQ ID NO: 3343322 - protein, 6 aa, Plasmodium falciparum
SGDNSK

SEQ ID NO: 3343323 - protein, 8 aa, Plasmodium falciparum
SGDQSNAV

SEQ ID NO: 3343324 - protein, 8 aa, Plasmodium falciparum
SGDQSSAV

SEQ ID NO: 3343325 - protein, 7 aa, Plasmodium falciparum
SGDRLTR

SEQ ID NO: 3343326 - protein, 6 aa, Plasmodium falciparum
SGDSNG

SEQ ID NO: 3343327 - protein, 9 aa, Plasmodium falciparum
SGEASKEAL

SEQ ID NO: 3343328 - protein, 50 aa, Plasmodium falciparum
SGEEEDDDDDDDEEDEDDDDDDDDDDDDDDDEDEDDDDDDEDEYEDDDEH

SEQ ID NO: 3343329 - protein, 8 aa, Plasmodium falciparum
SGEGASRE

SEQ ID NO: 3343330 - protein, 20 aa, Plasmodium falciparum
SGEKKDMLSSSQRNKLTKEG

SEQ ID NO: 3343331 - protein, 5 aa, Plasmodium falciparum
SGENL

SEQ ID NO: 3343332 - protein, 8 aa, Plasmodium falciparum
SGENQNKN

SEQ ID NO: 3343333 - protein, 4 aa, Plasmodium falciparum
SGET

SEQ ID NO: 3343334 - protein, 5 aa, Plasmodium falciparum
SGETI

SEQ ID NO: 3343335 - protein, 9 aa, Plasmodium falciparum
SGETKWNKQ

SEQ ID NO: 3343336 - protein, 7 aa, Plasmodium falciparum
SGETLED

SEQ ID NO: 3343337 - protein, 6 aa, Plasmodium falciparum
SGETRD

SEQ ID NO: 3343338 - protein, 13 aa, Plasmodium falciparum
SGFEHPSEVQQET

SEQ ID NO: 3343339 - protein, 11 aa, Plasmodium falciparum
SGFPNRSTNTS

SEQ ID NO: 3343340 - protein, 8 aa, Plasmodium falciparum
SGGEAGAR

SEQ ID NO: 3343341 - protein, 5 aa, Plasmodium falciparum
SGGER

SEQ ID NO: 3343342 - protein, 5 aa, Plasmodium falciparum
SGGFQ

SEQ ID NO: 3343343 - protein, 6 aa, Plasmodium falciparum
SGGHDD

SEQ ID NO: 3343344 - protein, 5 aa, Plasmodium falciparum
SGGHY

SEQ ID NO: 3343345 - protein, 8 aa, Plasmodium falciparum
SGGKGGQL

SEQ ID NO: 3343346 - protein, 11 aa, Plasmodium falciparum
SGGKGTADGKI

SEQ ID NO: 3343347 - protein, 7 aa, Plasmodium falciparum
SGGKKRT

SEQ ID NO: 3343348 - protein, 6 aa, Plasmodium falciparum
SGGMAA

SEQ ID NO: 3343349 - protein, 6 aa, Plasmodium falciparum
SGGNKA

SEQ ID NO: 3343350 - protein, 5 aa, Plasmodium falciparum
SGGRG

SEQ ID NO: 3343351 - protein, 4 aa, Plasmodium falciparum
SGGS

SEQ ID NO: 3343352 - protein, 6 aa, Plasmodium falciparum
SGGSDN

SEQ ID NO: 3343353 - protein, 6 aa, Plasmodium falciparum
SGGSQS

SEQ ID NO: 3343354 - protein, 7 aa, Plasmodium falciparum
SGGTTFN

SEQ ID NO: 3343355 - protein, 9 aa, Plasmodium falciparum
SGGTTGFGD

SEQ ID NO: 3343356 - protein, 20 aa, Plasmodium falciparum
SGGVSRDDTTDDKDKNDYSD

SEQ ID NO: 3343357 - protein, 4 aa, Plasmodium falciparum
SGGY

SEQ ID NO: 3343358 - protein, 6 aa, Plasmodium falciparum
SGHCQS

SEQ ID NO: 3343359 - protein, 9 aa, Plasmodium falciparum
SGHEKKKEI

SEQ ID NO: 3343360 - protein, 8 aa, Plasmodium falciparum
SGHENNHN

SEQ ID NO: 3343361 - protein, 4 aa, Plasmodium falciparum
SGHK

SEQ ID NO: 3343362 - protein, 5 aa, Plasmodium falciparum
SGHPI

SEQ ID NO: 3343363 - protein, 13 aa, Plasmodium falciparum
SGINNSKSREHSL

SEQ ID NO: 3343364 - protein, 9 aa, Plasmodium falciparum
SGINSTGIS

SEQ ID NO: 3343365 - protein, 6 aa, Plasmodium falciparum
SGIPKK

SEQ ID NO: 3343366 - protein, 5 aa, Plasmodium falciparum
SGISS

SEQ ID NO: 3343367 - protein, 11 aa, Plasmodium falciparum
SGITSSQLSTL

SEQ ID NO: 3343368 - protein, 5 aa, Plasmodium falciparum
SGKAR

SEQ ID NO: 3343369 - protein, 9 aa, Plasmodium falciparum
SGKDKGKIG

SEQ ID NO: 3343370 - protein, 12 aa, Plasmodium falciparum
SGKENEQPYNKL

SEQ ID NO: 3343371 - protein, 6 aa, Plasmodium falciparum
SGKERL

SEQ ID NO: 3343372 - protein, 8 aa, Plasmodium falciparum
SGKETNKF

SEQ ID NO: 3343373 - protein, 10 aa, Plasmodium falciparum
SGKGNALSAY

SEQ ID NO: 3343374 - protein, 10 aa, Plasmodium falciparum
SGKGSTAAGL

SEQ ID NO: 3343375 - protein, 8 aa, Plasmodium falciparum
SGKGYYDK

SEQ ID NO: 3343376 - protein, 5 aa, Plasmodium falciparum
SGKII

SEQ ID NO: 3343377 - protein, 16 aa, Plasmodium falciparum
SGKKDTYKTDQQQNYL

SEQ ID NO: 3343378 - protein, 18 aa, Plasmodium falciparum
SGKKKKNKAKNNEEANQE

SEQ ID NO: 3343379 - protein, 7 aa, Plasmodium falciparum
SGKKVEG

SEQ ID NO: 3343380 - protein, 11 aa, Plasmodium falciparum
SGKNEMNRKTK

SEQ ID NO: 3343381 - protein, 11 aa, Plasmodium falciparum
SGKNHENSRNK

SEQ ID NO: 3343382 - protein, 6 aa, Plasmodium falciparum
SGKQRN

SEQ ID NO: 3343383 - protein, 8 aa, Plasmodium falciparum
SGKRKESW

SEQ ID NO: 3343384 - protein, 8 aa, Plasmodium falciparum
SGKRRRKT

SEQ ID NO: 3343385 - protein, 8 aa, Plasmodium falciparum
SGKRSEQS

SEQ ID NO: 3343386 - protein, 13 aa, Plasmodium falciparum
SGKSDKQYSSWKG

SEQ ID NO: 3343387 - protein, 5 aa, Plasmodium falciparum
SGLCK

SEQ ID NO: 3343388 - protein, 12 aa, Plasmodium falciparum
SGLDSSTNSSVS

SEQ ID NO: 3343389 - protein, 7 aa, Plasmodium falciparum
SGLQNVN

SEQ ID NO: 3343390 - protein, 7 aa, Plasmodium falciparum
SGLRSNN

SEQ ID NO: 3343391 - protein, 9 aa, Plasmodium falciparum
SGLSAPSDL

SEQ ID NO: 3343392 - protein, 5 aa, Plasmodium falciparum
SGLST

SEQ ID NO: 3343393 - protein, 6 aa, Plasmodium falciparum
SGLVSN

SEQ ID NO: 3343394 - protein, 12 aa, Plasmodium falciparum
SGMNKETTKKTL

SEQ ID NO: 3343395 - protein, 6 aa, Plasmodium falciparum
SGMQSD

SEQ ID NO: 3343396 - protein, 8 aa, Plasmodium falciparum
SGMTSSMT

SEQ ID NO: 3343397 - protein, 5 aa, Plasmodium falciparum
SGNEK

SEQ ID NO: 3343398 - protein, 7 aa, Plasmodium falciparum
SGNGDVK

SEQ ID NO: 3343399 - protein, 9 aa, Plasmodium falciparum
SGNGTEKER

SEQ ID NO: 3343400 - protein, 9 aa, Plasmodium falciparum
SGNHPNSNN

SEQ ID NO: 3343401 - protein, 4 aa, Plasmodium falciparum
SGNI

SEQ ID NO: 3343402 - protein, 6 aa, Plasmodium falciparum
SGNINR

SEQ ID NO: 3343403 - protein, 6 aa, Plasmodium falciparum
SGNINT

SEQ ID NO: 3343404 - protein, 20 aa, Plasmodium falciparum
SGNISYQKNKNNNNNNNNNY

SEQ ID NO: 3343405 - protein, 8 aa, Plasmodium falciparum
SGNKNKKI

SEQ ID NO: 3343406 - protein, 7 aa, Plasmodium falciparum
SGNKSTA

SEQ ID NO: 3343407 - protein, 6 aa, Plasmodium falciparum
SGNMTE

SEQ ID NO: 3343408 - protein, 8 aa, Plasmodium falciparum
SGNNAYNR

SEQ ID NO: 3343409 - protein, 8 aa, Plasmodium falciparum
SGNNDYKN

SEQ ID NO: 3343410 - protein, 25 aa, Plasmodium falciparum
SGNNTNQTHSYDKNADDNKPTCNYS

SEQ ID NO: 3343411 - protein, 7 aa, Plasmodium falciparum
SGNNVRE

SEQ ID NO: 3343412 - protein, 6 aa, Plasmodium falciparum
SGNRTH

SEQ ID NO: 3343413 - protein, 7 aa, Plasmodium falciparum
SGNSKTA

SEQ ID NO: 3343414 - protein, 9 aa, Plasmodium falciparum
SGNSNYYDD

SEQ ID NO: 3343415 - protein, 4 aa, Plasmodium falciparum
SGNT

SEQ ID NO: 3343416 - protein, 110 aa, Plasmodium falciparum
SGNTAKMENQNTGNDVNSGNSENAEKSEQSEKVEKVEKAEQSENSGKSENSGKSEISGKSEISGNSENARNSENFGNSEISENSESAERSRIPEDCPTPENTPNSENSVN

SEQ ID NO: 3343417 - protein, 5 aa, Plasmodium falciparum
SGNVK

SEQ ID NO: 3343418 - protein, 16 aa, Plasmodium falciparum
SGNYNHENDPNNHHNY

SEQ ID NO: 3343419 - protein, 19 aa, Plasmodium falciparum
SGPKDFSVNNNDDDVYNNN

SEQ ID NO: 3343420 - protein, 9 aa, Plasmodium falciparum
SGPQPKEGE

SEQ ID NO: 3343421 - protein, 9 aa, Plasmodium falciparum
SGPQPTLPQ

SEQ ID NO: 3343422 - protein, 7 aa, Plasmodium falciparum
SGPRDNP

SEQ ID NO: 3343423 - protein, 4 aa, Plasmodium falciparum
SGPY

SEQ ID NO: 3343424 - protein, 10 aa, Plasmodium falciparum
SGQDSQRGTF

SEQ ID NO: 3343425 - protein, 6 aa, Plasmodium falciparum
SGQMPA

SEQ ID NO: 3343426 - protein, 17 aa, Plasmodium falciparum
SGQTAGSSNSNTKYGTT

SEQ ID NO: 3343427 - protein, 16 aa, Plasmodium falciparum
SGQYYDETNNINNKNT

SEQ ID NO: 3343428 - protein, 4 aa, Plasmodium falciparum
SGRE

SEQ ID NO: 3343429 - protein, 9 aa, Plasmodium falciparum
SGREEDEKL

SEQ ID NO: 3343430 - protein, 8 aa, Plasmodium falciparum
SGRHKQEN

SEQ ID NO: 3343431 - protein, 15 aa, Plasmodium falciparum
SGRNASKKNVSTKKY

SEQ ID NO: 3343432 - protein, 10 aa, Plasmodium falciparum
SGRPQYDKSG

SEQ ID NO: 3343433 - protein, 6 aa, Plasmodium falciparum
SGRSAK

SEQ ID NO: 3343434 - protein, 10 aa, Plasmodium falciparum
SGRTGRGKEK

SEQ ID NO: 3343435 - protein, 5 aa, Plasmodium falciparum
SGRTT

SEQ ID NO: 3343436 - protein, 10 aa, Plasmodium falciparum
SGRVTNPRTS

SEQ ID NO: 3343437 - protein, 12 aa, Plasmodium falciparum
SGSACTSSTLEP

SEQ ID NO: 3343438 - protein, 6 aa, Plasmodium falciparum
SGSDDK

SEQ ID NO: 3343439 - protein, 7 aa, Plasmodium falciparum
SGSDNGK

SEQ ID NO: 3343440 - protein, 4 aa, Plasmodium falciparum
SGSE

SEQ ID NO: 3343441 - protein, 6 aa, Plasmodium falciparum
SGSEDV

SEQ ID NO: 3343442 - protein, 5 aa, Plasmodium falciparum
SGSFN

SEQ ID NO: 3343443 - protein, 10 aa, Plasmodium falciparum
SGSKALDDNF

SEQ ID NO: 3343444 - protein, 7 aa, Plasmodium falciparum
SGSKGSI

SEQ ID NO: 3343445 - protein, 9 aa, Plasmodium falciparum
SGSKNYNYK

SEQ ID NO: 3343446 - protein, 9 aa, Plasmodium falciparum
SGSNNNINN

SEQ ID NO: 3343447 - protein, 10 aa, Plasmodium falciparum
SGSNNQENME

SEQ ID NO: 3343448 - protein, 7 aa, Plasmodium falciparum
SGSQEQT

SEQ ID NO: 3343449 - protein, 9 aa, Plasmodium falciparum
SGSSGMPKG

SEQ ID NO: 3343450 - protein, 5 aa, Plasmodium falciparum
SGSSH

SEQ ID NO: 3343451 - protein, 10 aa, Plasmodium falciparum
SGSSSSSNFS

SEQ ID NO: 3343452 - protein, 4 aa, Plasmodium falciparum
SGST

SEQ ID NO: 3343453 - protein, 13 aa, Plasmodium falciparum
SGSTGKPKGVAHT

SEQ ID NO: 3343454 - protein, 8 aa, Plasmodium falciparum
SGTGGTEA

SEQ ID NO: 3343455 - protein, 7 aa, Plasmodium falciparum
SGTGSTA

SEQ ID NO: 3343456 - protein, 20 aa, Plasmodium falciparum
SGTHGSSEYQLESQETHDTT

SEQ ID NO: 3343457 - protein, 4 aa, Plasmodium falciparum
SGTL

SEQ ID NO: 3343458 - protein, 13 aa, Plasmodium falciparum
SGTNKNVFTENEK

SEQ ID NO: 3343459 - protein, 10 aa, Plasmodium falciparum
SGTNTNITKN

SEQ ID NO: 3343460 - protein, 8 aa, Plasmodium falciparum
SGTPRPQM

SEQ ID NO: 3343461 - protein, 5 aa, Plasmodium falciparum
SGTRL

SEQ ID NO: 3343462 - protein, 5 aa, Plasmodium falciparum
SGTRR

SEQ ID NO: 3343463 - protein, 10 aa, Plasmodium falciparum
SGTSGKPKGV

SEQ ID NO: 3343464 - protein, 9 aa, Plasmodium falciparum
SGTSGRPKG

SEQ ID NO: 3343465 - protein, 8 aa, Plasmodium falciparum
SGTTGYPK

SEQ ID NO: 3343466 - protein, 6 aa, Plasmodium falciparum
SGTTNV

SEQ ID NO: 3343467 - protein, 4 aa, Plasmodium falciparum
SGTY

SEQ ID NO: 3343468 - protein, 6 aa, Plasmodium falciparum
SGVDEK

SEQ ID NO: 3343469 - protein, 7 aa, Plasmodium falciparum
SGVEKNE

SEQ ID NO: 3343470 - protein, 10 aa, Plasmodium falciparum
SGVENAETQE

SEQ ID NO: 3343471 - protein, 7 aa, Plasmodium falciparum
SGVGKGT

SEQ ID NO: 3343472 - protein, 6 aa, Plasmodium falciparum
SGVGKT

SEQ ID NO: 3343473 - protein, 6 aa, Plasmodium falciparum
SGVNKK

SEQ ID NO: 3343474 - protein, 98 aa, Plasmodium falciparum
SGVNKKKGKKTGVEANSKNVEQKGDTKTSTKVDEEVKTDEVNNKKKDLIEDKNANNVNDVDTKPDGDDDNNNNNNNKGEEDNKEKKEDDNTVAEKPAK

SEQ ID NO: 3343475 - protein, 10 aa, Plasmodium falciparum
SGVTSGSDCV

SEQ ID NO: 3343476 - protein, 23 aa, Plasmodium falciparum
SGYGQNISGPDSSHFNYGTKKDV

SEQ ID NO: 3343477 - protein, 5 aa, Plasmodium falciparum
SGYNE

SEQ ID NO: 3343478 - protein, 16 aa, Plasmodium falciparum
SGYNEYKNEEKKNDLM

SEQ ID NO: 3343479 - protein, 5 aa, Plasmodium falciparum
SGYNK

SEQ ID NO: 3343480 - protein, 6 aa, Plasmodium falciparum
SGYNLE

SEQ ID NO: 3343481 - protein, 8 aa, Plasmodium falciparum
SGYNPNIK

SEQ ID NO: 3343482 - protein, 6 aa, Plasmodium falciparum
SGYQAL

SEQ ID NO: 3343483 - protein, 9 aa, Plasmodium falciparum
SGYSLNSGY

SEQ ID NO: 3343484 - protein, 6 aa, Plasmodium falciparum
SGYSYS

SEQ ID NO: 3343485 - protein, 5 aa, Plasmodium falciparum
SGYYK

SEQ ID NO: 3343486 - protein, 9 aa, Plasmodium falciparum
SHAENNKKE

SEQ ID NO: 3343487 - protein, 5 aa, Plasmodium falciparum
SHANN

SEQ ID NO: 3343488 - protein, 7 aa, Plasmodium falciparum
SHASHHD

SEQ ID NO: 3343489 - protein, 11 aa, Plasmodium falciparum
SHDDNKNGNDH

SEQ ID NO: 3343490 - protein, 5 aa, Plasmodium falciparum
SHDDT

SEQ ID NO: 3343491 - protein, 5 aa, Plasmodium falciparum
SHDKD

SEQ ID NO: 3343492 - protein, 9 aa, Plasmodium falciparum
SHDTPNSIN

SEQ ID NO: 3343493 - protein, 4 aa, Plasmodium falciparum
SHEE

SEQ ID NO: 3343494 - protein, 35 aa, Plasmodium falciparum
SHEKERKRKKRYSNSANYSSYDEETKERDKKKKSY

SEQ ID NO: 3343495 - protein, 22 aa, Plasmodium falciparum
SHEKKEESEENEENADNNKDER

SEQ ID NO: 3343496 - protein, 4 aa, Plasmodium falciparum
SHEM

SEQ ID NO: 3343497 - protein, 17 aa, Plasmodium falciparum
SHENSMENQRYEDDKMG

SEQ ID NO: 3343498 - protein, 10 aa, Plasmodium falciparum
SHEQNEESYT

SEQ ID NO: 3343499 - protein, 12 aa, Plasmodium falciparum
SHESNNQDKEIK

SEQ ID NO: 3343500 - protein, 7 aa, Plasmodium falciparum
SHETRSE

SEQ ID NO: 3343501 - protein, 20 aa, Plasmodium falciparum
SHGASGPYAPSNFSQQPHGV

SEQ ID NO: 3343502 - protein, 10 aa, Plasmodium falciparum
SHGKSDGWQN

SEQ ID NO: 3343503 - protein, 6 aa, Plasmodium falciparum
SHGMEK

SEQ ID NO: 3343504 - protein, 77 aa, Plasmodium falciparum
SHGMSNNTSHGMSNNTSHGMSNNTSHGMSNNTSHGMSNNTSHGMSNNTSHGMSNNTSHSMNNTSHSMNNTSHSMNNP

SEQ ID NO: 3343505 - protein, 11 aa, Plasmodium falciparum
SHGNNVTPPYM

SEQ ID NO: 3343506 - protein, 7 aa, Plasmodium falciparum
SHGQRVE

SEQ ID NO: 3343507 - protein, 8 aa, Plasmodium falciparum
SHGQSEGW

SEQ ID NO: 3343508 - protein, 9 aa, Plasmodium falciparum
SHGSFPNNS

SEQ ID NO: 3343509 - protein, 5 aa, Plasmodium falciparum
SHGSR

SEQ ID NO: 3343510 - protein, 16 aa, Plasmodium falciparum
SHHEDKNNYSEQETEK

SEQ ID NO: 3343511 - protein, 4 aa, Plasmodium falciparum
SHIP

SEQ ID NO: 3343512 - protein, 4 aa, Plasmodium falciparum
SHIS

SEQ ID NO: 3343513 - protein, 7 aa, Plasmodium falciparum
SHITSAQ

SEQ ID NO: 3343514 - protein, 9 aa, Plasmodium falciparum
SHKEDEKNH

SEQ ID NO: 3343515 - protein, 10 aa, Plasmodium falciparum
SHKKEYTAAG

SEQ ID NO: 3343516 - protein, 18 aa, Plasmodium falciparum
SHKKPDENIKKEHQNNEH

SEQ ID NO: 3343517 - protein, 19 aa, Plasmodium falciparum
SHKNEMKRKTYNHANNRNE

SEQ ID NO: 3343518 - protein, 9 aa, Plasmodium falciparum
SHKNTYNNI

SEQ ID NO: 3343519 - protein, 19 aa, Plasmodium falciparum
SHKNTYNNVSSHKNTYNNI

SEQ ID NO: 3343520 - protein, 7 aa, Plasmodium falciparum
SHKQGYK

SEQ ID NO: 3343521 - protein, 8 aa, Plasmodium falciparum
SHKQNEKE

SEQ ID NO: 3343522 - protein, 7 aa, Plasmodium falciparum
SHLKGGA

SEQ ID NO: 3343523 - protein, 12 aa, Plasmodium falciparum
SHLKNEKDNLKR

SEQ ID NO: 3343524 - protein, 5 aa, Plasmodium falciparum
SHLNN

SEQ ID NO: 3343525 - protein, 4 aa, Plasmodium falciparum
SHLR

SEQ ID NO: 3343526 - protein, 6 aa, Plasmodium falciparum
SHMKSE

SEQ ID NO: 3343527 - protein, 9 aa, Plasmodium falciparum
SHNDNDKIP

SEQ ID NO: 3343528 - protein, 9 aa, Plasmodium falciparum
SHNKTNEEK

SEQ ID NO: 3343529 - protein, 6 aa, Plasmodium falciparum
SHNNED

SEQ ID NO: 3343530 - protein, 9 aa, Plasmodium falciparum
SHNNEDEKH

SEQ ID NO: 3343531 - protein, 10 aa, Plasmodium falciparum
SHNNIGDNNI

SEQ ID NO: 3343532 - protein, 6 aa, Plasmodium falciparum
SHNNIN

SEQ ID NO: 3343533 - protein, 9 aa, Plasmodium falciparum
SHNNINKNN

SEQ ID NO: 3343534 - protein, 16 aa, Plasmodium falciparum
SHNNKKVKNKLNNQTY

SEQ ID NO: 3343535 - protein, 19 aa, Plasmodium falciparum
SHNNNKSDYDEDGDAENNN

SEQ ID NO: 3343536 - protein, 9 aa, Plasmodium falciparum
SHNNNTSHN

SEQ ID NO: 3343537 - protein, 9 aa, Plasmodium falciparum
SHNNQYNNN

SEQ ID NO: 3343538 - protein, 8 aa, Plasmodium falciparum
SHNNTDDN

SEQ ID NO: 3343539 - protein, 15 aa, Plasmodium falciparum
SHNQEEMDKTNNQQM

SEQ ID NO: 3343540 - protein, 8 aa, Plasmodium falciparum
SHNSEHSI

SEQ ID NO: 3343541 - protein, 20 aa, Plasmodium falciparum
SHNTSNVQSVGEVSNNIQND

SEQ ID NO: 3343542 - protein, 10 aa, Plasmodium falciparum
SHPGKNNFKS

SEQ ID NO: 3343543 - protein, 8 aa, Plasmodium falciparum
SHPNNDDM

SEQ ID NO: 3343544 - protein, 19 aa, Plasmodium falciparum
SHREGNQHNVQTQRKQRID

SEQ ID NO: 3343545 - protein, 7 aa, Plasmodium falciparum
SHSDISD

SEQ ID NO: 3343546 - protein, 4 aa, Plasmodium falciparum
SHSE

SEQ ID NO: 3343547 - protein, 25 aa, Plasmodium falciparum
SHSEGYKKPGYTSASSKLNQKGDSN

SEQ ID NO: 3343548 - protein, 7 aa, Plasmodium falciparum
SHSEKKN

SEQ ID NO: 3343549 - protein, 6 aa, Plasmodium falciparum
SHSKED

SEQ ID NO: 3343550 - protein, 15 aa, Plasmodium falciparum
SHSKINKEKKKSYLS

SEQ ID NO: 3343551 - protein, 5 aa, Plasmodium falciparum
SHSND

SEQ ID NO: 3343552 - protein, 69 aa, Plasmodium falciparum
SHSNNSHETDKVNDEDKEENYDVKDSNKKKKKKKKKEITQKEIDKNKNRAKYEDSKNDENYKNSDDDIN

SEQ ID NO: 3343553 - protein, 13 aa, Plasmodium falciparum
SHSNSKNSSKIRN

SEQ ID NO: 3343554 - protein, 46 aa, Plasmodium falciparum
SHSPRSNNISSNSSSSSTSSSNSGGSNNSSSSSSCGGSPKNIPNQL

SEQ ID NO: 3343555 - protein, 19 aa, Plasmodium falciparum
SHSPSINKDSIHEEKKNNF

SEQ ID NO: 3343556 - protein, 25 aa, Plasmodium falciparum
SHSSDEGEEDVSSYDENDNEEYTND

SEQ ID NO: 3343557 - protein, 5 aa, Plasmodium falciparum
SHSSL

SEQ ID NO: 3343558 - protein, 8 aa, Plasmodium falciparum
SHSSTNSY

SEQ ID NO: 3343559 - protein, 6 aa, Plasmodium falciparum
SHSTSK

SEQ ID NO: 3343560 - protein, 6 aa, Plasmodium falciparum
SHSVNS

SEQ ID NO: 3343561 - protein, 4 aa, Plasmodium falciparum
SHTF

SEQ ID NO: 3343562 - protein, 13 aa, Plasmodium falciparum
SHTKKYENNTTTD

SEQ ID NO: 3343563 - protein, 6 aa, Plasmodium falciparum
SHTLDN

SEQ ID NO: 3343564 - protein, 4 aa, Plasmodium falciparum
SHTQ

SEQ ID NO: 3343565 - protein, 35 aa, Plasmodium falciparum
SHTTSSNNNHMNDNSNSQQNMKPKRKRRKKKEMEE

SEQ ID NO: 3343566 - protein, 14 aa, Plasmodium falciparum
SHVNKNEVKKKKNN

SEQ ID NO: 3343567 - protein, 4 aa, Plasmodium falciparum
SHYD

SEQ ID NO: 3343568 - protein, 7 aa, Plasmodium falciparum
SHYEENN

SEQ ID NO: 3343569 - protein, 5 aa, Plasmodium falciparum
SIADA

SEQ ID NO: 3343570 - protein, 6 aa, Plasmodium falciparum
SIAEEN

SEQ ID NO: 3343571 - protein, 6 aa, Plasmodium falciparum
SIAGQG

SEQ ID NO: 3343572 - protein, 32 aa, Plasmodium falciparum
SIAPGFDNNQNNATNQQNNQSIQNNIASQDNT

SEQ ID NO: 3343573 - protein, 5 aa, Plasmodium falciparum
SICGD

SEQ ID NO: 3343574 - protein, 10 aa, Plasmodium falciparum
SIDAEKPDKK

SEQ ID NO: 3343575 - protein, 8 aa, Plasmodium falciparum
SIDDEENE

SEQ ID NO: 3343576 - protein, 86 aa, Plasmodium falciparum
SIDEDKESTKKYNNDEGNVGSNNIDDEDDNLNDELGKAEQRKETNQTNQTNEKNQTNQTNEKNETNQTNEKNETNQTNEKNETNQI

SEQ ID NO: 3343577 - protein, 9 aa, Plasmodium falciparum
SIDNDDSNI

SEQ ID NO: 3343578 - protein, 4 aa, Plasmodium falciparum
SIDP

SEQ ID NO: 3343579 - protein, 22 aa, Plasmodium falciparum
SIDPNKEKQLNNNSNVSDGGKM

SEQ ID NO: 3343580 - protein, 5 aa, Plasmodium falciparum
SIDRG

SEQ ID NO: 3343581 - protein, 12 aa, Plasmodium falciparum
SIDSNDQKINKS

SEQ ID NO: 3343582 - protein, 69 aa, Plasmodium falciparum
SIDSYESSKSSSGEVRHKKKKKNNEKITKKKNDTKYKNISKTKNISKYSDESNYSSDDSRYDHKHSDRL

SEQ ID NO: 3343583 - protein, 4 aa, Plasmodium falciparum
SIED

SEQ ID NO: 3343584 - protein, 13 aa, Plasmodium falciparum
SIEDTNDNSYSKY

SEQ ID NO: 3343585 - protein, 5 aa, Plasmodium falciparum
SIEED

SEQ ID NO: 3343586 - protein, 5 aa, Plasmodium falciparum
SIEKD

SEQ ID NO: 3343587 - protein, 12 aa, Plasmodium falciparum
SIENKESNNNSR

SEQ ID NO: 3343588 - protein, 9 aa, Plasmodium falciparum
SIENNKNKE

SEQ ID NO: 3343589 - protein, 4 aa, Plasmodium falciparum
SIER

SEQ ID NO: 3343590 - protein, 12 aa, Plasmodium falciparum
SIESNNSSITLS

SEQ ID NO: 3343591 - protein, 7 aa, Plasmodium falciparum
SIETNEN

SEQ ID NO: 3343592 - protein, 6 aa, Plasmodium falciparum
SIGPRG

SEQ ID NO: 3343593 - protein, 9 aa, Plasmodium falciparum
SIGSAQEGA

SEQ ID NO: 3343594 - protein, 8 aa, Plasmodium falciparum
SIGTAGSG

SEQ ID NO: 3343595 - protein, 6 aa, Plasmodium falciparum
SIHDEN

SEQ ID NO: 3343596 - protein, 4 aa, Plasmodium falciparum
SIHE

SEQ ID NO: 3343597 - protein, 5 aa, Plasmodium falciparum
SIHKS

SEQ ID NO: 3343598 - protein, 19 aa, Plasmodium falciparum
SIHKSDEEEKINDLKEDSN

SEQ ID NO: 3343599 - protein, 17 aa, Plasmodium falciparum
SIHSNDSESSEKDSDIE

SEQ ID NO: 3343600 - protein, 5 aa, Plasmodium falciparum
SIHTQ

SEQ ID NO: 3343601 - protein, 19 aa, Plasmodium falciparum
SIISGRSKKMHEKSKLTTN

SEQ ID NO: 3343602 - protein, 4 aa, Plasmodium falciparum
SIKD

SEQ ID NO: 3343603 - protein, 6 aa, Plasmodium falciparum
SIKDDG

SEQ ID NO: 3343604 - protein, 8 aa, Plasmodium falciparum
SIKDEENK

SEQ ID NO: 3343605 - protein, 6 aa, Plasmodium falciparum
SIKEDR

SEQ ID NO: 3343606 - protein, 5 aa, Plasmodium falciparum
SIKEK

SEQ ID NO: 3343607 - protein, 12 aa, Plasmodium falciparum
SIKEKKYQKKTY

SEQ ID NO: 3343608 - protein, 5 aa, Plasmodium falciparum
SIKES

SEQ ID NO: 3343609 - protein, 6 aa, Plasmodium falciparum
SIKGGS

SEQ ID NO: 3343610 - protein, 5 aa, Plasmodium falciparum
SIKIE

SEQ ID NO: 3343611 - protein, 156 aa, Plasmodium falciparum
SIKKGDSNHELKGKNSQKTDDSDYKNDKSKIYNKSKKYNKYDKYDKYNKYNKYDKYDKYDKYDKYDKYNKYDKYNKYDKYDKYDKYDKYNASYSSTSKKESSNTEERSLNSLDDQDNSSYLSDNPNYKTNKHTKHRKDKYKLTSTSNSTNSSHNNY

SEQ ID NO: 3343612 - protein, 7 aa, Plasmodium falciparum
SIKKGTG

SEQ ID NO: 3343613 - protein, 6 aa, Plasmodium falciparum
SIKKSI

SEQ ID NO: 3343614 - protein, 11 aa, Plasmodium falciparum
SIKNEKDNYDS

SEQ ID NO: 3343615 - protein, 10 aa, Plasmodium falciparum
SIKNKNIKDL

SEQ ID NO: 3343616 - protein, 14 aa, Plasmodium falciparum
SIKNNTIDNYNNST

SEQ ID NO: 3343617 - protein, 50 aa, Plasmodium falciparum
SIKNTSKNRKNNKNENNDKDDNNNNNNNNNNNNNNNNNNNNNNNNNNKNN

SEQ ID NO: 3343618 - protein, 14 aa, Plasmodium falciparum
SIKRRKKLPSPRTE

SEQ ID NO: 3343619 - protein, 21 aa, Plasmodium falciparum
SIKRSTVDYEKKNLKSESYYG

SEQ ID NO: 3343620 - protein, 7 aa, Plasmodium falciparum
SIKTDSS

SEQ ID NO: 3343621 - protein, 16 aa, Plasmodium falciparum
SILESETRSDTLDKEQ

SEQ ID NO: 3343622 - protein, 23 aa, Plasmodium falciparum
SINDEQNYKNINEQNNNSSGKIS

SEQ ID NO: 3343623 - protein, 19 aa, Plasmodium falciparum
SINDNTSQHMNNEEKQQNE

SEQ ID NO: 3343624 - protein, 8 aa, Plasmodium falciparum
SINDPGKI

SEQ ID NO: 3343625 - protein, 9 aa, Plasmodium falciparum
SINDTNSIN

SEQ ID NO: 3343626 - protein, 18 aa, Plasmodium falciparum
SINDYQNGDNDDNDDNYE

SEQ ID NO: 3343627 - protein, 16 aa, Plasmodium falciparum
SINEEKKNNTNEGGES

SEQ ID NO: 3343628 - protein, 8 aa, Plasmodium falciparum
SINEEQTR

SEQ ID NO: 3343629 - protein, 18 aa, Plasmodium falciparum
SINEKQKGKNKNLGYKGK

SEQ ID NO: 3343630 - protein, 8 aa, Plasmodium falciparum
SINERTER

SEQ ID NO: 3343631 - protein, 10 aa, Plasmodium falciparum
SINKKEQDRI

SEQ ID NO: 3343632 - protein, 17 aa, Plasmodium falciparum
SINKKKKKKKCKKNNQI

SEQ ID NO: 3343633 - protein, 12 aa, Plasmodium falciparum
SINKSKGKLDKN

SEQ ID NO: 3343634 - protein, 6 aa, Plasmodium falciparum
SINKTT

SEQ ID NO: 3343635 - protein, 4 aa, Plasmodium falciparum
SINM

SEQ ID NO: 3343636 - protein, 10 aa, Plasmodium falciparum
SINNASPYGY

SEQ ID NO: 3343637 - protein, 9 aa, Plasmodium falciparum
SINNDDKSK

SEQ ID NO: 3343638 - protein, 8 aa, Plasmodium falciparum
SINNGNNI

SEQ ID NO: 3343639 - protein, 5 aa, Plasmodium falciparum
SINNK

SEQ ID NO: 3343640 - protein, 9 aa, Plasmodium falciparum
SINNKGDYS

SEQ ID NO: 3343641 - protein, 9 aa, Plasmodium falciparum
SINNNDKQI

SEQ ID NO: 3343642 - protein, 31 aa, Plasmodium falciparum
SINNNDRRSNSIASDEPKTNITNQKIGKNNI

SEQ ID NO: 3343643 - protein, 5 aa, Plasmodium falciparum
SINNP

SEQ ID NO: 3343644 - protein, 68 aa, Plasmodium falciparum
SINNPRNYNDEDKNNDNNNYDDKNNDNNNYDDSHNNNYDDKNNDNNNYDDSHNNNYEDSHNNNYDDSD

SEQ ID NO: 3343645 - protein, 6 aa, Plasmodium falciparum
SINPDD

SEQ ID NO: 3343646 - protein, 15 aa, Plasmodium falciparum
SINPDNSANRKNSNR

SEQ ID NO: 3343647 - protein, 5 aa, Plasmodium falciparum
SINPH

SEQ ID NO: 3343648 - protein, 8 aa, Plasmodium falciparum
SINQHNNN

SEQ ID NO: 3343649 - protein, 7 aa, Plasmodium falciparum
SINRTSS

SEQ ID NO: 3343650 - protein, 4 aa, Plasmodium falciparum
SINS

SEQ ID NO: 3343651 - protein, 10 aa, Plasmodium falciparum
SINSDDITNK

SEQ ID NO: 3343652 - protein, 12 aa, Plasmodium falciparum
SINSESSTEKEK

SEQ ID NO: 3343653 - protein, 26 aa, Plasmodium falciparum
SINSNQSDESFNSIKSNNSNNTNEQN

SEQ ID NO: 3343654 - protein, 6 aa, Plasmodium falciparum
SINSNS

SEQ ID NO: 3343655 - protein, 8 aa, Plasmodium falciparum
SINSTNTS

SEQ ID NO: 3343656 - protein, 21 aa, Plasmodium falciparum
SINTISNKNTQSYSNSSTHIN

SEQ ID NO: 3343657 - protein, 8 aa, Plasmodium falciparum
SINTQNNN

SEQ ID NO: 3343658 - protein, 30 aa, Plasmodium falciparum
SINTSKNNNNINNNNINNNNINNNNNNNHL

SEQ ID NO: 3343659 - protein, 6 aa, Plasmodium falciparum
SINVTK

SEQ ID NO: 3343660 - protein, 5 aa, Plasmodium falciparum
SIPED

SEQ ID NO: 3343661 - protein, 5 aa, Plasmodium falciparum
SIPKN

SEQ ID NO: 3343662 - protein, 10 aa, Plasmodium falciparum
SIPKQHDTTM

SEQ ID NO: 3343663 - protein, 6 aa, Plasmodium falciparum
SIPNNK

SEQ ID NO: 3343664 - protein, 5 aa, Plasmodium falciparum
SIPPQ

SEQ ID NO: 3343665 - protein, 16 aa, Plasmodium falciparum
SIPPTHIPSSTYPTKM

SEQ ID NO: 3343666 - protein, 5 aa, Plasmodium falciparum
SIPSI

SEQ ID NO: 3343667 - protein, 5 aa, Plasmodium falciparum
SIPTN

SEQ ID NO: 3343668 - protein, 5 aa, Plasmodium falciparum
SIPTP

SEQ ID NO: 3343669 - protein, 8 aa, Plasmodium falciparum
SIQKDPNL

SEQ ID NO: 3343670 - protein, 16 aa, Plasmodium falciparum
SIQNDNTKNLKGNNDS

SEQ ID NO: 3343671 - protein, 19 aa, Plasmodium falciparum
SIQNENHGNSNNKEKIGGK

SEQ ID NO: 3343672 - protein, 8 aa, Plasmodium falciparum
SIQNKDRA

SEQ ID NO: 3343673 - protein, 14 aa, Plasmodium falciparum
SIQNNNKLDEQDKK

SEQ ID NO: 3343674 - protein, 4 aa, Plasmodium falciparum
SIQP

SEQ ID NO: 3343675 - protein, 7 aa, Plasmodium falciparum
SIQTSQL

SEQ ID NO: 3343676 - protein, 8 aa, Plasmodium falciparum
SIRKQNQN

SEQ ID NO: 3343677 - protein, 22 aa, Plasmodium falciparum
SIRQKQSKQCKDDNNNNNHNIT

SEQ ID NO: 3343678 - protein, 10 aa, Plasmodium falciparum
SIRSNNTSNL

SEQ ID NO: 3343679 - protein, 16 aa, Plasmodium falciparum
SIRTDDSDFTDDPYGS

SEQ ID NO: 3343680 - protein, 6 aa, Plasmodium falciparum
SISEEE

SEQ ID NO: 3343681 - protein, 13 aa, Plasmodium falciparum
SISEKHRTEDVSN

SEQ ID NO: 3343682 - protein, 5 aa, Plasmodium falciparum
SISET

SEQ ID NO: 3343683 - protein, 35 aa, Plasmodium falciparum
SISGTTNTINNNIDNNNNNNSSSLNNNSSGGISGG

SEQ ID NO: 3343684 - protein, 27 aa, Plasmodium falciparum
SISKNDSDKERDNNTKKEENDDTRDSQ

SEQ ID NO: 3343685 - protein, 6 aa, Plasmodium falciparum
SISKSE

SEQ ID NO: 3343686 - protein, 4 aa, Plasmodium falciparum
SISL

SEQ ID NO: 3343687 - protein, 5 aa, Plasmodium falciparum
SISMD

SEQ ID NO: 3343688 - protein, 9 aa, Plasmodium falciparum
SISNDKKTP

SEQ ID NO: 3343689 - protein, 9 aa, Plasmodium falciparum
SISNETSSV

SEQ ID NO: 3343690 - protein, 5 aa, Plasmodium falciparum
SISNK

SEQ ID NO: 3343691 - protein, 13 aa, Plasmodium falciparum
SISNNKRDEENDL

SEQ ID NO: 3343692 - protein, 11 aa, Plasmodium falciparum
SISNNNSISNN

SEQ ID NO: 3343693 - protein, 14 aa, Plasmodium falciparum
SISNPKDKKDRIEN

SEQ ID NO: 3343694 - protein, 16 aa, Plasmodium falciparum
SISNSDNDTYETRRKK

SEQ ID NO: 3343695 - protein, 8 aa, Plasmodium falciparum
SISNSSRV

SEQ ID NO: 3343696 - protein, 4 aa, Plasmodium falciparum
SISR

SEQ ID NO: 3343697 - protein, 4 aa, Plasmodium falciparum
SISS

SEQ ID NO: 3343698 - protein, 8 aa, Plasmodium falciparum
SISSDAKN

SEQ ID NO: 3343699 - protein, 15 aa, Plasmodium falciparum
SISSDEGNIEEGNTL

SEQ ID NO: 3343700 - protein, 12 aa, Plasmodium falciparum
SISSNNNGKDLR

SEQ ID NO: 3343701 - protein, 5 aa, Plasmodium falciparum
SISTD

SEQ ID NO: 3343702 - protein, 8 aa, Plasmodium falciparum
SISTEDHS

SEQ ID NO: 3343703 - protein, 6 aa, Plasmodium falciparum
SITDKE

SEQ ID NO: 3343704 - protein, 6 aa, Plasmodium falciparum
SITERK

SEQ ID NO: 3343705 - protein, 8 aa, Plasmodium falciparum
SITIGGGD

SEQ ID NO: 3343706 - protein, 6 aa, Plasmodium falciparum
SITKKT

SEQ ID NO: 3343707 - protein, 12 aa, Plasmodium falciparum
SITNDHDANNTD

SEQ ID NO: 3343708 - protein, 4 aa, Plasmodium falciparum
SITQ

SEQ ID NO: 3343709 - protein, 5 aa, Plasmodium falciparum
SIYKN

SEQ ID NO: 3343710 - protein, 23 aa, Plasmodium falciparum
SIYPPKNKKNNYNNNNNNNNDNK

SEQ ID NO: 3343711 - protein, 17 aa, Plasmodium falciparum
SIYSNTSECNTKNYMKG

SEQ ID NO: 3343712 - protein, 13 aa, Plasmodium falciparum
SIYSSNKDEDSSE

SEQ ID NO: 3343713 - protein, 23 aa, Plasmodium falciparum
SKAEQDKKSIIKNDNKNKNNQNN

SEQ ID NO: 3343714 - protein, 4 aa, Plasmodium falciparum
SKAI

SEQ ID NO: 3343715 - protein, 8 aa, Plasmodium falciparum
SKAIEGAT

SEQ ID NO: 3343716 - protein, 7 aa, Plasmodium falciparum
SKAKTNF

SEQ ID NO: 3343717 - protein, 4 aa, Plasmodium falciparum
SKAN

SEQ ID NO: 3343718 - protein, 8 aa, Plasmodium falciparum
SKAPISEN

SEQ ID NO: 3343719 - protein, 8 aa, Plasmodium falciparum
SKAQHEDM

SEQ ID NO: 3343720 - protein, 5 aa, Plasmodium falciparum
SKASM

SEQ ID NO: 3343721 - protein, 6 aa, Plasmodium falciparum
SKATDT

SEQ ID NO: 3343722 - protein, 17 aa, Plasmodium falciparum
SKATKHPQKNIQNQTKD

SEQ ID NO: 3343723 - protein, 27 aa, Plasmodium falciparum
SKCKSNKTWKDNIRNRKKENSKKYEKN

SEQ ID NO: 3343724 - protein, 5 aa, Plasmodium falciparum
SKCNN

SEQ ID NO: 3343725 - protein, 14 aa, Plasmodium falciparum
SKCSPNKQNKNNKI

SEQ ID NO: 3343726 - protein, 14 aa, Plasmodium falciparum
SKCYNDTNKKNEKH

SEQ ID NO: 3343727 - protein, 6 aa, Plasmodium falciparum
SKDAGE

SEQ ID NO: 3343728 - protein, 6 aa, Plasmodium falciparum
SKDAKI

SEQ ID NO: 3343729 - protein, 10 aa, Plasmodium falciparum
SKDCESRTIN

SEQ ID NO: 3343730 - protein, 11 aa, Plasmodium falciparum
SKDDENKSINM

SEQ ID NO: 3343731 - protein, 9 aa, Plasmodium falciparum
SKDDKGEIT

SEQ ID NO: 3343732 - protein, 14 aa, Plasmodium falciparum
SKDDNRKKKNKQKI

SEQ ID NO: 3343733 - protein, 9 aa, Plasmodium falciparum
SKDDNYNKN

SEQ ID NO: 3343734 - protein, 8 aa, Plasmodium falciparum
SKDDQSKI

SEQ ID NO: 3343735 - protein, 7 aa, Plasmodium falciparum
SKDDSTD

SEQ ID NO: 3343736 - protein, 6 aa, Plasmodium falciparum
SKDEKK

SEQ ID NO: 3343737 - protein, 11 aa, Plasmodium falciparum
SKDEKKKKNEI

SEQ ID NO: 3343738 - protein, 15 aa, Plasmodium falciparum
SKDEKKKNNCEQNND

SEQ ID NO: 3343739 - protein, 7 aa, Plasmodium falciparum
SKDENLD

SEQ ID NO: 3343740 - protein, 8 aa, Plasmodium falciparum
SKDEQSSI

SEQ ID NO: 3343741 - protein, 6 aa, Plasmodium falciparum
SKDEYL

SEQ ID NO: 3343742 - protein, 4 aa, Plasmodium falciparum
SKDG

SEQ ID NO: 3343743 - protein, 6 aa, Plasmodium falciparum
SKDGDK

SEQ ID NO: 3343744 - protein, 5 aa, Plasmodium falciparum
SKDIE

SEQ ID NO: 3343745 - protein, 10 aa, Plasmodium falciparum
SKDISSEELS

SEQ ID NO: 3343746 - protein, 4 aa, Plasmodium falciparum
SKDK

SEQ ID NO: 3343747 - protein, 13 aa, Plasmodium falciparum
SKDKEEKKMEDDN

SEQ ID NO: 3343748 - protein, 20 aa, Plasmodium falciparum
SKDKNDTSINKKKTKNENNA

SEQ ID NO: 3343749 - protein, 7 aa, Plasmodium falciparum
SKDKNKN

SEQ ID NO: 3343750 - protein, 15 aa, Plasmodium falciparum
SKDKNKSKKSHAYHN

SEQ ID NO: 3343751 - protein, 18 aa, Plasmodium falciparum
SKDKNYNSNINNDNASIS

SEQ ID NO: 3343752 - protein, 11 aa, Plasmodium falciparum
SKDKPFDPNKD

SEQ ID NO: 3343753 - protein, 7 aa, Plasmodium falciparum
SKDKTKK

SEQ ID NO: 3343754 - protein, 7 aa, Plasmodium falciparum
SKDKTYK

SEQ ID NO: 3343755 - protein, 4 aa, Plasmodium falciparum
SKDL

SEQ ID NO: 3343756 - protein, 7 aa, Plasmodium falciparum
SKDLDNT

SEQ ID NO: 3343757 - protein, 12 aa, Plasmodium falciparum
SKDLHNNNNNDN

SEQ ID NO: 3343758 - protein, 9 aa, Plasmodium falciparum
SKDLSSTTK

SEQ ID NO: 3343759 - protein, 4 aa, Plasmodium falciparum
SKDN

SEQ ID NO: 3343760 - protein, 35 aa, Plasmodium falciparum
SKDNISNKINDENNVNKNINSENVSNKKDFRKPMD

SEQ ID NO: 3343761 - protein, 5 aa, Plasmodium falciparum
SKDNN

SEQ ID NO: 3343762 - protein, 26 aa, Plasmodium falciparum
SKDNNNDNLRNEKKSTNLENGKYDKK

SEQ ID NO: 3343763 - protein, 14 aa, Plasmodium falciparum
SKDNSINNYNPKNM

SEQ ID NO: 3343764 - protein, 12 aa, Plasmodium falciparum
SKDNSLKSVDNS

SEQ ID NO: 3343765 - protein, 7 aa, Plasmodium falciparum
SKDNTEK

SEQ ID NO: 3343766 - protein, 9 aa, Plasmodium falciparum
SKDNYMSKE

SEQ ID NO: 3343767 - protein, 6 aa, Plasmodium falciparum
SKDPNI

SEQ ID NO: 3343768 - protein, 8 aa, Plasmodium falciparum
SKDPNSSS

SEQ ID NO: 3343769 - protein, 8 aa, Plasmodium falciparum
SKDQKVEL

SEQ ID NO: 3343770 - protein, 8 aa, Plasmodium falciparum
SKDQNENI

SEQ ID NO: 3343771 - protein, 10 aa, Plasmodium falciparum
SKDSEKEEGK

SEQ ID NO: 3343772 - protein, 8 aa, Plasmodium falciparum
SKDSGFPS

SEQ ID NO: 3343773 - protein, 7 aa, Plasmodium falciparum
SKDSKIE

SEQ ID NO: 3343774 - protein, 9 aa, Plasmodium falciparum
SKDSNLLDK

SEQ ID NO: 3343775 - protein, 37 aa, Plasmodium falciparum
SKDSQSKSDASSTSSIDNDSISNENITNKKKKKDEKV

SEQ ID NO: 3343776 - protein, 8 aa, Plasmodium falciparum
SKDSVTST

SEQ ID NO: 3343777 - protein, 6 aa, Plasmodium falciparum
SKDTDI

SEQ ID NO: 3343778 - protein, 7 aa, Plasmodium falciparum
SKDTEFP

SEQ ID NO: 3343779 - protein, 25 aa, Plasmodium falciparum
SKDTNNEEKKNSSKQMYTANDKEYN

SEQ ID NO: 3343780 - protein, 16 aa, Plasmodium falciparum
SKDTSKAEYSNDPDMI

SEQ ID NO: 3343781 - protein, 8 aa, Plasmodium falciparum
SKDTSQQD

SEQ ID NO: 3343782 - protein, 8 aa, Plasmodium falciparum
SKDVTEKD

SEQ ID NO: 3343783 - protein, 4 aa, Plasmodium falciparum
SKDY

SEQ ID NO: 3343784 - protein, 8 aa, Plasmodium falciparum
SKDYSKAR

SEQ ID NO: 3343785 - protein, 4 aa, Plasmodium falciparum
SKEC

SEQ ID NO: 3343786 - protein, 6 aa, Plasmodium falciparum
SKEDEN

SEQ ID NO: 3343787 - protein, 16 aa, Plasmodium falciparum
SKEDISRSIKENKDNY

SEQ ID NO: 3343788 - protein, 8 aa, Plasmodium falciparum
SKEDKDHL

SEQ ID NO: 3343789 - protein, 9 aa, Plasmodium falciparum
SKEDKENID

SEQ ID NO: 3343790 - protein, 90 aa, Plasmodium falciparum
SKEDKNKNNSNNNNNNNNSNNNNNSNNNNNSNSNSNSNNNTNSNSNSNSNSNNNTNSNNNSNSNSNNNNSNNNTTTNNSSSSNNSNNNNY

SEQ ID NO: 3343791 - protein, 6 aa, Plasmodium falciparum
SKEDRL

SEQ ID NO: 3343792 - protein, 4 aa, Plasmodium falciparum
SKEE

SEQ ID NO: 3343793 - protein, 6 aa, Plasmodium falciparum
SKEEED

SEQ ID NO: 3343794 - protein, 7 aa, Plasmodium falciparum
SKEEEKY

SEQ ID NO: 3343795 - protein, 5 aa, Plasmodium falciparum
SKEEG

SEQ ID NO: 3343796 - protein, 8 aa, Plasmodium falciparum
SKEEGRPY

SEQ ID NO: 3343797 - protein, 6 aa, Plasmodium falciparum
SKEEID

SEQ ID NO: 3343798 - protein, 8 aa, Plasmodium falciparum
SKEEIRRD

SEQ ID NO: 3343799 - protein, 6 aa, Plasmodium falciparum
SKEEIS

SEQ ID NO: 3343800 - protein, 14 aa, Plasmodium falciparum
SKEEKKNDKDKDMD

SEQ ID NO: 3343801 - protein, 6 aa, Plasmodium falciparum
SKEEKS

SEQ ID NO: 3343802 - protein, 22 aa, Plasmodium falciparum
SKEEMSNNNNNNNSSSNGGAFN

SEQ ID NO: 3343803 - protein, 9 aa, Plasmodium falciparum
SKEENNKKN

SEQ ID NO: 3343804 - protein, 6 aa, Plasmodium falciparum
SKEEPL

SEQ ID NO: 3343805 - protein, 28 aa, Plasmodium falciparum
SKEEQENLDDNISKNEYMNDKQNKTTQY

SEQ ID NO: 3343806 - protein, 12 aa, Plasmodium falciparum
SKEEREKDNLEE

SEQ ID NO: 3343807 - protein, 11 aa, Plasmodium falciparum
SKEEVTKKKSI

SEQ ID NO: 3343808 - protein, 4 aa, Plasmodium falciparum
SKEF

SEQ ID NO: 3343809 - protein, 8 aa, Plasmodium falciparum
SKEGEDEG

SEQ ID NO: 3343810 - protein, 7 aa, Plasmodium falciparum
SKEGITT

SEQ ID NO: 3343811 - protein, 7 aa, Plasmodium falciparum
SKEGQNY

SEQ ID NO: 3343812 - protein, 4 aa, Plasmodium falciparum
SKEI

SEQ ID NO: 3343813 - protein, 12 aa, Plasmodium falciparum
SKEIEEYRKKNQ

SEQ ID NO: 3343814 - protein, 13 aa, Plasmodium falciparum
SKEIEKDKKENES

SEQ ID NO: 3343815 - protein, 11 aa, Plasmodium falciparum
SKEINNNNIDE

SEQ ID NO: 3343816 - protein, 6 aa, Plasmodium falciparum
SKEKCD

SEQ ID NO: 3343817 - protein, 20 aa, Plasmodium falciparum
SKEKEDGIEDKDMNDKEEMN

SEQ ID NO: 3343818 - protein, 9 aa, Plasmodium falciparum
SKEKEDQIE

SEQ ID NO: 3343819 - protein, 12 aa, Plasmodium falciparum
SKEKNWDNNNNN

SEQ ID NO: 3343820 - protein, 11 aa, Plasmodium falciparum
SKEKQIENKNN

SEQ ID NO: 3343821 - protein, 8 aa, Plasmodium falciparum
SKEKRNSV

SEQ ID NO: 3343822 - protein, 5 aa, Plasmodium falciparum
SKEKS

SEQ ID NO: 3343823 - protein, 10 aa, Plasmodium falciparum
SKEKVEEESF

SEQ ID NO: 3343824 - protein, 13 aa, Plasmodium falciparum
SKELENKNPPSRD

SEQ ID NO: 3343825 - protein, 7 aa, Plasmodium falciparum
SKELSYE

SEQ ID NO: 3343826 - protein, 9 aa, Plasmodium falciparum
SKEMKRGDI

SEQ ID NO: 3343827 - protein, 21 aa, Plasmodium falciparum
SKEMKSSKEYLSDSELSKDDY

SEQ ID NO: 3343828 - protein, 16 aa, Plasmodium falciparum
SKENDSSQEQNEGEDN

SEQ ID NO: 3343829 - protein, 22 aa, Plasmodium falciparum
SKENETKSNNIQNLNDEKNEVH

SEQ ID NO: 3343830 - protein, 14 aa, Plasmodium falciparum
SKENIEKNKHDDNN

SEQ ID NO: 3343831 - protein, 6 aa, Plasmodium falciparum
SKENKI

SEQ ID NO: 3343832 - protein, 15 aa, Plasmodium falciparum
SKENNEENKNTYMNT

SEQ ID NO: 3343833 - protein, 57 aa, Plasmodium falciparum
SKENNGVDNVNEAKKKNTSHQNISKKGEEKYLPPEEQTKKRKKKTTQKNNKKNNMNN

SEQ ID NO: 3343834 - protein, 22 aa, Plasmodium falciparum
SKENNKREISDDDDDNKGPKGD

SEQ ID NO: 3343835 - protein, 19 aa, Plasmodium falciparum
SKENNNNNNYNNVQPTTHT

SEQ ID NO: 3343836 - protein, 14 aa, Plasmodium falciparum
SKENNTPKVKLSSL

SEQ ID NO: 3343837 - protein, 10 aa, Plasmodium falciparum
SKENQEICEE

SEQ ID NO: 3343838 - protein, 9 aa, Plasmodium falciparum
SKENQQKYT

SEQ ID NO: 3343839 - protein, 9 aa, Plasmodium falciparum
SKENTKEGS

SEQ ID NO: 3343840 - protein, 5 aa, Plasmodium falciparum
SKEPL

SEQ ID NO: 3343841 - protein, 17 aa, Plasmodium falciparum
SKEQGVGEKRSSTLSAP

SEQ ID NO: 3343842 - protein, 5 aa, Plasmodium falciparum
SKEQK

SEQ ID NO: 3343843 - protein, 9 aa, Plasmodium falciparum
SKERRSINE

SEQ ID NO: 3343844 - protein, 7 aa, Plasmodium falciparum
SKESHDQ

SEQ ID NO: 3343845 - protein, 39 aa, Plasmodium falciparum
SKESKENKSQNNESPKNKKKDVQNKNNAPNKKVEETKKL

SEQ ID NO: 3343846 - protein, 5 aa, Plasmodium falciparum
SKESR

SEQ ID NO: 3343847 - protein, 9 aa, Plasmodium falciparum
SKESYEERL

SEQ ID NO: 3343848 - protein, 5 aa, Plasmodium falciparum
SKETN

SEQ ID NO: 3343849 - protein, 4 aa, Plasmodium falciparum
SKEV

SEQ ID NO: 3343850 - protein, 7 aa, Plasmodium falciparum
SKEVNDN

SEQ ID NO: 3343851 - protein, 5 aa, Plasmodium falciparum
SKEYK

SEQ ID NO: 3343852 - protein, 5 aa, Plasmodium falciparum
SKFEG

SEQ ID NO: 3343853 - protein, 5 aa, Plasmodium falciparum
SKFKG

SEQ ID NO: 3343854 - protein, 23 aa, Plasmodium falciparum
SKFPKEEKRNEIKKKNGNNQKTI

SEQ ID NO: 3343855 - protein, 12 aa, Plasmodium falciparum
SKGCENENESKM

SEQ ID NO: 3343856 - protein, 20 aa, Plasmodium falciparum
SKGDHLDSSINNNNNNNIGR

SEQ ID NO: 3343857 - protein, 6 aa, Plasmodium falciparum
SKGDIE

SEQ ID NO: 3343858 - protein, 9 aa, Plasmodium falciparum
SKGDIKELS

SEQ ID NO: 3343859 - protein, 6 aa, Plasmodium falciparum
SKGDVK

SEQ ID NO: 3343860 - protein, 17 aa, Plasmodium falciparum
SKGEDDEKNEINEEKSY

SEQ ID NO: 3343861 - protein, 43 aa, Plasmodium falciparum
SKGEKKNKKDKKDKKNEKDKKDKKNEKNEKNEKNKKNYDSYDN

SEQ ID NO: 3343862 - protein, 4 aa, Plasmodium falciparum
SKGI

SEQ ID NO: 3343863 - protein, 4 aa, Plasmodium falciparum
SKGK

SEQ ID NO: 3343864 - protein, 12 aa, Plasmodium falciparum
SKGKKNKNENIK

SEQ ID NO: 3343865 - protein, 14 aa, Plasmodium falciparum
SKGKSKYKNNNNYK

SEQ ID NO: 3343866 - protein, 4 aa, Plasmodium falciparum
SKGL

SEQ ID NO: 3343867 - protein, 7 aa, Plasmodium falciparum
SKGLESI

SEQ ID NO: 3343868 - protein, 9 aa, Plasmodium falciparum
SKGNKNISY

SEQ ID NO: 3343869 - protein, 10 aa, Plasmodium falciparum
SKGNNNDIVD

SEQ ID NO: 3343870 - protein, 6 aa, Plasmodium falciparum
SKGNQC

SEQ ID NO: 3343871 - protein, 8 aa, Plasmodium falciparum
SKGNSKSN

SEQ ID NO: 3343872 - protein, 10 aa, Plasmodium falciparum
SKGNTQKKEV

SEQ ID NO: 3343873 - protein, 10 aa, Plasmodium falciparum
SKGNTSIQSK

SEQ ID NO: 3343874 - protein, 7 aa, Plasmodium falciparum
SKGNVEG

SEQ ID NO: 3343875 - protein, 7 aa, Plasmodium falciparum
SKGPDRK

SEQ ID NO: 3343876 - protein, 9 aa, Plasmodium falciparum
SKGPPGGVV

SEQ ID NO: 3343877 - protein, 8 aa, Plasmodium falciparum
SKGQNNIN

SEQ ID NO: 3343878 - protein, 9 aa, Plasmodium falciparum
SKGQYDDEK

SEQ ID NO: 3343879 - protein, 4 aa, Plasmodium falciparum
SKGR

SEQ ID NO: 3343880 - protein, 11 aa, Plasmodium falciparum
SKGRDKKDVRN

SEQ ID NO: 3343881 - protein, 9 aa, Plasmodium falciparum
SKGSEMNAS

SEQ ID NO: 3343882 - protein, 36 aa, Plasmodium falciparum
SKGSKNNKYFPSNNNDDEDDGVNNNNNNNNNDDGHN

SEQ ID NO: 3343883 - protein, 10 aa, Plasmodium falciparum
SKGTEKEGID

SEQ ID NO: 3343884 - protein, 7 aa, Plasmodium falciparum
SKGVEYE

SEQ ID NO: 3343885 - protein, 4 aa, Plasmodium falciparum
SKHD

SEQ ID NO: 3343886 - protein, 14 aa, Plasmodium falciparum
SKHDEPINESEKND

SEQ ID NO: 3343887 - protein, 24 aa, Plasmodium falciparum
SKHDGDKNKNDKKKEDAKLNTTYR

SEQ ID NO: 3343888 - protein, 4 aa, Plasmodium falciparum
SKHH

SEQ ID NO: 3343889 - protein, 72 aa, Plasmodium falciparum
SKHNKMSPNKGKLNVATDKNGSNEKNNMNGKNNMTDRNNMNDRNNMNSKNNMNSKNNMNSKNNMTDRNNNNY

SEQ ID NO: 3343890 - protein, 6 aa, Plasmodium falciparum
SKHNKN

SEQ ID NO: 3343891 - protein, 12 aa, Plasmodium falciparum
SKHNNNNNNNNI

SEQ ID NO: 3343892 - protein, 9 aa, Plasmodium falciparum
SKHNSNEYY

SEQ ID NO: 3343893 - protein, 7 aa, Plasmodium falciparum
SKHQNKV

SEQ ID NO: 3343894 - protein, 20 aa, Plasmodium falciparum
SKHTQDYRKDGSYEQEEIED

SEQ ID NO: 3343895 - protein, 6 aa, Plasmodium falciparum
SKHTSD

SEQ ID NO: 3343896 - protein, 5 aa, Plasmodium falciparum
SKICE

SEQ ID NO: 3343897 - protein, 34 aa, Plasmodium falciparum
SKIDEAEGEEYGEDGDNNDDENIEKTKRTKSNLS

SEQ ID NO: 3343898 - protein, 14 aa, Plasmodium falciparum
SKIDNEDKLDDNNK

SEQ ID NO: 3343899 - protein, 6 aa, Plasmodium falciparum
SKIDNN

SEQ ID NO: 3343900 - protein, 5 aa, Plasmodium falciparum
SKIDY

SEQ ID NO: 3343901 - protein, 16 aa, Plasmodium falciparum
SKIEDDEKIKNYNNKN

SEQ ID NO: 3343902 - protein, 6 aa, Plasmodium falciparum
SKIENE

SEQ ID NO: 3343903 - protein, 6 aa, Plasmodium falciparum
SKIENH

SEQ ID NO: 3343904 - protein, 8 aa, Plasmodium falciparum
SKIKDSTM

SEQ ID NO: 3343905 - protein, 6 aa, Plasmodium falciparum
SKIKNK

SEQ ID NO: 3343906 - protein, 5 aa, Plasmodium falciparum
SKIKT

SEQ ID NO: 3343907 - protein, 11 aa, Plasmodium falciparum
SKINDCNNYNN

SEQ ID NO: 3343908 - protein, 5 aa, Plasmodium falciparum
SKINE

SEQ ID NO: 3343909 - protein, 14 aa, Plasmodium falciparum
SKINEPDNKEIAPT

SEQ ID NO: 3343910 - protein, 24 aa, Plasmodium falciparum
SKININNNKGGTSYMGGGRRRRGK

SEQ ID NO: 3343911 - protein, 5 aa, Plasmodium falciparum
SKINN

SEQ ID NO: 3343912 - protein, 13 aa, Plasmodium falciparum
SKINNISNETIKQ

SEQ ID NO: 3343913 - protein, 6 aa, Plasmodium falciparum
SKINNK

SEQ ID NO: 3343914 - protein, 5 aa, Plasmodium falciparum
SKINP

SEQ ID NO: 3343915 - protein, 18 aa, Plasmodium falciparum
SKISEDISENSNSSYNSN

SEQ ID NO: 3343916 - protein, 7 aa, Plasmodium falciparum
SKISNDK

SEQ ID NO: 3343917 - protein, 9 aa, Plasmodium falciparum
SKITEKNKE

SEQ ID NO: 3343918 - protein, 19 aa, Plasmodium falciparum
SKITERKNKSQKAKKNKEK

SEQ ID NO: 3343919 - protein, 4 aa, Plasmodium falciparum
SKIY

SEQ ID NO: 3343920 - protein, 13 aa, Plasmodium falciparum
SKKANAKNKGGME

SEQ ID NO: 3343921 - protein, 9 aa, Plasmodium falciparum
SKKCTNDNN

SEQ ID NO: 3343922 - protein, 7 aa, Plasmodium falciparum
SKKDDCD

SEQ ID NO: 3343923 - protein, 19 aa, Plasmodium falciparum
SKKDEKNNKIDEDKEFDEK

SEQ ID NO: 3343924 - protein, 8 aa, Plasmodium falciparum
SKKDITQD

SEQ ID NO: 3343925 - protein, 9 aa, Plasmodium falciparum
SKKDNYNNH

SEQ ID NO: 3343926 - protein, 15 aa, Plasmodium falciparum
SKKEDASKNETKYNI

SEQ ID NO: 3343927 - protein, 62 aa, Plasmodium falciparum
SKKEDSSSNNMNGNNNMNGNNNMNGNNNMNGNNNMNGNNNMNGNNNMNGNNNMNDNNNMNGN

SEQ ID NO: 3343928 - protein, 5 aa, Plasmodium falciparum
SKKEE

SEQ ID NO: 3343929 - protein, 7 aa, Plasmodium falciparum
SKKEEEI

SEQ ID NO: 3343930 - protein, 10 aa, Plasmodium falciparum
SKKEEKDIND

SEQ ID NO: 3343931 - protein, 7 aa, Plasmodium falciparum
SKKEEKV

SEQ ID NO: 3343932 - protein, 7 aa, Plasmodium falciparum
SKKEENY

SEQ ID NO: 3343933 - protein, 6 aa, Plasmodium falciparum
SKKEER

SEQ ID NO: 3343934 - protein, 14 aa, Plasmodium falciparum
SKKEKNKKIEQKKQ

SEQ ID NO: 3343935 - protein, 14 aa, Plasmodium falciparum
SKKEKNKSNTQNVE

SEQ ID NO: 3343936 - protein, 14 aa, Plasmodium falciparum
SKKEKPTHQKNTGK

SEQ ID NO: 3343937 - protein, 26 aa, Plasmodium falciparum
SKKEKTNKNNNDKLNNVDDYQNDDEN

SEQ ID NO: 3343938 - protein, 13 aa, Plasmodium falciparum
SKKENENNQNKYM

SEQ ID NO: 3343939 - protein, 6 aa, Plasmodium falciparum
SKKENF

SEQ ID NO: 3343940 - protein, 11 aa, Plasmodium falciparum
SKKENKKLKTT

SEQ ID NO: 3343941 - protein, 24 aa, Plasmodium falciparum
SKKGIDPYSDISTSYNNNSNNISS

SEQ ID NO: 3343942 - protein, 24 aa, Plasmodium falciparum
SKKGKNKRKERNNNMENSMKNNNS

SEQ ID NO: 3343943 - protein, 5 aa, Plasmodium falciparum
SKKGL

SEQ ID NO: 3343944 - protein, 13 aa, Plasmodium falciparum
SKKGNKSEEPLSK

SEQ ID NO: 3343945 - protein, 4 aa, Plasmodium falciparum
SKKH

SEQ ID NO: 3343946 - protein, 5 aa, Plasmodium falciparum
SKKHD

SEQ ID NO: 3343947 - protein, 22 aa, Plasmodium falciparum
SKKIKKNKKENDSSTNKETKKK

SEQ ID NO: 3343948 - protein, 4 aa, Plasmodium falciparum
SKKK

SEQ ID NO: 3343949 - protein, 16 aa, Plasmodium falciparum
SKKKAKKKKKCSKINT

SEQ ID NO: 3343950 - protein, 18 aa, Plasmodium falciparum
SKKKDENVTRKYNDDNNI

SEQ ID NO: 3343951 - protein, 9 aa, Plasmodium falciparum
SKKKEESTI

SEQ ID NO: 3343952 - protein, 26 aa, Plasmodium falciparum
SKKKEKLMNNSEKKDKEENCSNKENR

SEQ ID NO: 3343953 - protein, 10 aa, Plasmodium falciparum
SKKKELPNNK

SEQ ID NO: 3343954 - protein, 19 aa, Plasmodium falciparum
SKKKEQDNFSKSKCGTSTL

SEQ ID NO: 3343955 - protein, 8 aa, Plasmodium falciparum
SKKKEQSY

SEQ ID NO: 3343956 - protein, 8 aa, Plasmodium falciparum
SKKKESFF

SEQ ID NO: 3343957 - protein, 8 aa, Plasmodium falciparum
SKKKGGEI

SEQ ID NO: 3343958 - protein, 10 aa, Plasmodium falciparum
SKKKGKKKID

SEQ ID NO: 3343959 - protein, 15 aa, Plasmodium falciparum
SKKKKKEKKKVDQDS

SEQ ID NO: 3343960 - protein, 13 aa, Plasmodium falciparum
SKKKKKKDESSDM

SEQ ID NO: 3343961 - protein, 21 aa, Plasmodium falciparum
SKKKKKKKEEEEEENKRERVK

SEQ ID NO: 3343962 - protein, 139 aa, Plasmodium falciparum
SKKKKNEEKEKMENDEKEAKREKEKKEERKEKERIEERKEKERTEERKEKERKEERKEKEKKEEKNEKEKKEEKNEKLSGKKRDKENEKEKEKKKDKEKKKDNEKKKENEIKKEQQKRKENEIKKEQQKRKEEEREKEG

SEQ ID NO: 3343963 - protein, 10 aa, Plasmodium falciparum
SKKKKNEKSQ

SEQ ID NO: 3343964 - protein, 17 aa, Plasmodium falciparum
SKKKKNKIKKRKKNNSF

SEQ ID NO: 3343965 - protein, 30 aa, Plasmodium falciparum
SKKKKRSVSWESTRSSSHEGEERMKGGRDY

SEQ ID NO: 3343966 - protein, 26 aa, Plasmodium falciparum
SKKKKTTSNNNNNDNNNNNNKSNNNI

SEQ ID NO: 3343967 - protein, 6 aa, Plasmodium falciparum
SKKKNA

SEQ ID NO: 3343968 - protein, 34 aa, Plasmodium falciparum
SKKKNKKRKNKKKKINLKKKKKSYEIKENNYEDY

SEQ ID NO: 3343969 - protein, 6 aa, Plasmodium falciparum
SKKKNL

SEQ ID NO: 3343970 - protein, 35 aa, Plasmodium falciparum
SKKKNSNQLQNNKTDQNNLTNNENQNNDNSSVQTK

SEQ ID NO: 3343971 - protein, 15 aa, Plasmodium falciparum
SKKKQKKKPLGNEDV

SEQ ID NO: 3343972 - protein, 14 aa, Plasmodium falciparum
SKKKRKKNNKTEDD

SEQ ID NO: 3343973 - protein, 7 aa, Plasmodium falciparum
SKKKSNL

SEQ ID NO: 3343974 - protein, 38 aa, Plasmodium falciparum
SKKKSYDFKNRKDNSTNTTKENSSRENVSSNNSETKRT

SEQ ID NO: 3343975 - protein, 9 aa, Plasmodium falciparum
SKKLKEKQI

SEQ ID NO: 3343976 - protein, 8 aa, Plasmodium falciparum
SKKLKENI

SEQ ID NO: 3343977 - protein, 18 aa, Plasmodium falciparum
SKKMEINQNNNNNNNNSN

SEQ ID NO: 3343978 - protein, 8 aa, Plasmodium falciparum
SKKMKYSS

SEQ ID NO: 3343979 - protein, 17 aa, Plasmodium falciparum
SKKNENIKQKKNNKELN

SEQ ID NO: 3343980 - protein, 13 aa, Plasmodium falciparum
SKKNEQNNTKPNV

SEQ ID NO: 3343981 - protein, 12 aa, Plasmodium falciparum
SKKNIQNDEYTC

SEQ ID NO: 3343982 - protein, 31 aa, Plasmodium falciparum
SKKNKNNKSDKNDINSKNKKNNDNNKTNDNY

SEQ ID NO: 3343983 - protein, 9 aa, Plasmodium falciparum
SKKNMTDDK

SEQ ID NO: 3343984 - protein, 6 aa, Plasmodium falciparum
SKKNNI

SEQ ID NO: 3343985 - protein, 8 aa, Plasmodium falciparum
SKKNNKSD

SEQ ID NO: 3343986 - protein, 15 aa, Plasmodium falciparum
SKKNNNNNNNSNNIM

SEQ ID NO: 3343987 - protein, 8 aa, Plasmodium falciparum
SKKNQDKI

SEQ ID NO: 3343988 - protein, 5 aa, Plasmodium falciparum
SKKNR

SEQ ID NO: 3343989 - protein, 12 aa, Plasmodium falciparum
SKKNTNVKSNKN

SEQ ID NO: 3343990 - protein, 9 aa, Plasmodium falciparum
SKKNTSKLD

SEQ ID NO: 3343991 - protein, 7 aa, Plasmodium falciparum
SKKNVNS

SEQ ID NO: 3343992 - protein, 10 aa, Plasmodium falciparum
SKKPCNENTP

SEQ ID NO: 3343993 - protein, 8 aa, Plasmodium falciparum
SKKPKNIP

SEQ ID NO: 3343994 - protein, 9 aa, Plasmodium falciparum
SKKPKPRCS

SEQ ID NO: 3343995 - protein, 17 aa, Plasmodium falciparum
SKKPSKTKIPITKTDSE

SEQ ID NO: 3343996 - protein, 6 aa, Plasmodium falciparum
SKKPTR

SEQ ID NO: 3343997 - protein, 6 aa, Plasmodium falciparum
SKKPTV

SEQ ID NO: 3343998 - protein, 4 aa, Plasmodium falciparum
SKKQ

SEQ ID NO: 3343999 - protein, 7 aa, Plasmodium falciparum
SKKQKKK

SEQ ID NO: 3344000 - protein, 7 aa, Plasmodium falciparum
SKKQKKL

SEQ ID NO: 3344001 - protein, 4 aa, Plasmodium falciparum
SKKR

SEQ ID NO: 3344002 - protein, 16 aa, Plasmodium falciparum
SKKRDSHKKGSSFRGR

SEQ ID NO: 3344003 - protein, 7 aa, Plasmodium falciparum
SKKRNSP

SEQ ID NO: 3344004 - protein, 18 aa, Plasmodium falciparum
SKKSAQNKKKKNHEYKEE

SEQ ID NO: 3344005 - protein, 7 aa, Plasmodium falciparum
SKKSDYD

SEQ ID NO: 3344006 - protein, 7 aa, Plasmodium falciparum
SKKSENN

SEQ ID NO: 3344007 - protein, 6 aa, Plasmodium falciparum
SKKSGV

SEQ ID NO: 3344008 - protein, 7 aa, Plasmodium falciparum
SKKSIKK

SEQ ID NO: 3344009 - protein, 8 aa, Plasmodium falciparum
SKKSLPYE

SEQ ID NO: 3344010 - protein, 40 aa, Plasmodium falciparum
SKKSNKTEKEKKKTQPAKKSKKEKADKKVQESTKEQENEF

SEQ ID NO: 3344011 - protein, 10 aa, Plasmodium falciparum
SKKSSNMEYE

SEQ ID NO: 3344012 - protein, 7 aa, Plasmodium falciparum
SKKSVSK

SEQ ID NO: 3344013 - protein, 6 aa, Plasmodium falciparum
SKKSVT

SEQ ID NO: 3344014 - protein, 6 aa, Plasmodium falciparum
SKKSYK

SEQ ID NO: 3344015 - protein, 15 aa, Plasmodium falciparum
SKKTDLNKSEEDLGE

SEQ ID NO: 3344016 - protein, 8 aa, Plasmodium falciparum
SKKTESDI

SEQ ID NO: 3344017 - protein, 6 aa, Plasmodium falciparum
SKKTNC

SEQ ID NO: 3344018 - protein, 9 aa, Plasmodium falciparum
SKKTPAPCP

SEQ ID NO: 3344019 - protein, 93 aa, Plasmodium falciparum
SKKTQAGNVDPLENPMDKENKNDGDNKNDDDNNKNDGDDNNNDSNDNNNNDGDDNNNDGDNNNDDDNNNDDDNNNDGDDNNDDDNEEEDLTHP

SEQ ID NO: 3344020 - protein, 5 aa, Plasmodium falciparum
SKKTY

SEQ ID NO: 3344021 - protein, 9 aa, Plasmodium falciparum
SKKWKEDKN

SEQ ID NO: 3344022 - protein, 13 aa, Plasmodium falciparum
SKKYDNNNDMGGI

SEQ ID NO: 3344023 - protein, 16 aa, Plasmodium falciparum
SKKYIKNDYKNEDADI

SEQ ID NO: 3344024 - protein, 15 aa, Plasmodium falciparum
SKKYKKKNLSNTSLN

SEQ ID NO: 3344025 - protein, 6 aa, Plasmodium falciparum
SKKYYK

SEQ ID NO: 3344026 - protein, 19 aa, Plasmodium falciparum
SKLDDSEYEEKCEKDGNKL

SEQ ID NO: 3344027 - protein, 4 aa, Plasmodium falciparum
SKLE

SEQ ID NO: 3344028 - protein, 21 aa, Plasmodium falciparum
SKLKDSNEKKKEINEKREQYR

SEQ ID NO: 3344029 - protein, 6 aa, Plasmodium falciparum
SKLKND

SEQ ID NO: 3344030 - protein, 8 aa, Plasmodium falciparum
SKLKNEKI

SEQ ID NO: 3344031 - protein, 4 aa, Plasmodium falciparum
SKLN

SEQ ID NO: 3344032 - protein, 8 aa, Plasmodium falciparum
SKLNEKEK

SEQ ID NO: 3344033 - protein, 12 aa, Plasmodium falciparum
SKLNSKDSDNMY

SEQ ID NO: 3344034 - protein, 8 aa, Plasmodium falciparum
SKLNSSDI

SEQ ID NO: 3344035 - protein, 5 aa, Plasmodium falciparum
SKLPE

SEQ ID NO: 3344036 - protein, 7 aa, Plasmodium falciparum
SKLQGLN

SEQ ID NO: 3344037 - protein, 12 aa, Plasmodium falciparum
SKLSTKEVKEIR

SEQ ID NO: 3344038 - protein, 4 aa, Plasmodium falciparum
SKLT

SEQ ID NO: 3344039 - protein, 13 aa, Plasmodium falciparum
SKLTKAKDEGKTK

SEQ ID NO: 3344040 - protein, 9 aa, Plasmodium falciparum
SKMAGTEDN

SEQ ID NO: 3344041 - protein, 19 aa, Plasmodium falciparum
SKMDRNDSDKVKCKNQEGI

SEQ ID NO: 3344042 - protein, 5 aa, Plasmodium falciparum
SKMNE

SEQ ID NO: 3344043 - protein, 14 aa, Plasmodium falciparum
SKMNPHNAREGGCG

SEQ ID NO: 3344044 - protein, 15 aa, Plasmodium falciparum
SKMNPKKKSIPQFGM

SEQ ID NO: 3344045 - protein, 12 aa, Plasmodium falciparum
SKMREENSSNSV

SEQ ID NO: 3344046 - protein, 25 aa, Plasmodium falciparum
SKMRNETVSRKQNKQIKSAENKYDK

SEQ ID NO: 3344047 - protein, 16 aa, Plasmodium falciparum
SKMSGGNSISEDNDMN

SEQ ID NO: 3344048 - protein, 9 aa, Plasmodium falciparum
SKNAPPNNE

SEQ ID NO: 3344049 - protein, 7 aa, Plasmodium falciparum
SKNCNTA

SEQ ID NO: 3344050 - protein, 4 aa, Plasmodium falciparum
SKND

SEQ ID NO: 3344051 - protein, 9 aa, Plasmodium falciparum
SKNDDNKNN

SEQ ID NO: 3344052 - protein, 10 aa, Plasmodium falciparum
SKNDETNNIN

SEQ ID NO: 3344053 - protein, 11 aa, Plasmodium falciparum
SKNDKEEKKRQ

SEQ ID NO: 3344054 - protein, 9 aa, Plasmodium falciparum
SKNDQENVA

SEQ ID NO: 3344055 - protein, 10 aa, Plasmodium falciparum
SKNEEDGYDK

SEQ ID NO: 3344056 - protein, 6 aa, Plasmodium falciparum
SKNEEM

SEQ ID NO: 3344057 - protein, 5 aa, Plasmodium falciparum
SKNEH

SEQ ID NO: 3344058 - protein, 14 aa, Plasmodium falciparum
SKNEKNIKYEKDKK

SEQ ID NO: 3344059 - protein, 8 aa, Plasmodium falciparum
SKNENNEK

SEQ ID NO: 3344060 - protein, 6 aa, Plasmodium falciparum
SKNEPY

SEQ ID NO: 3344061 - protein, 14 aa, Plasmodium falciparum
SKNEQVDDNKKEKD

SEQ ID NO: 3344062 - protein, 16 aa, Plasmodium falciparum
SKNERTHAKEDRLAEK

SEQ ID NO: 3344063 - protein, 7 aa, Plasmodium falciparum
SKNESDK

SEQ ID NO: 3344064 - protein, 7 aa, Plasmodium falciparum
SKNESLP

SEQ ID NO: 3344065 - protein, 26 aa, Plasmodium falciparum
SKNEVDTNIESNENSIHESGHKIDGE

SEQ ID NO: 3344066 - protein, 5 aa, Plasmodium falciparum
SKNEY

SEQ ID NO: 3344067 - protein, 4 aa, Plasmodium falciparum
SKNF

SEQ ID NO: 3344068 - protein, 7 aa, Plasmodium falciparum
SKNFNSY

SEQ ID NO: 3344069 - protein, 11 aa, Plasmodium falciparum
SKNGNDSQQEI

SEQ ID NO: 3344070 - protein, 7 aa, Plasmodium falciparum
SKNGQEI

SEQ ID NO: 3344071 - protein, 5 aa, Plasmodium falciparum
SKNGT

SEQ ID NO: 3344072 - protein, 22 aa, Plasmodium falciparum
SKNHKCDDPLNNNKTDHCDKER

SEQ ID NO: 3344073 - protein, 11 aa, Plasmodium falciparum
SKNHKRNAYQS

SEQ ID NO: 3344074 - protein, 25 aa, Plasmodium falciparum
SKNIEKAEGDENRTYTEKNIDGQEI

SEQ ID NO: 3344075 - protein, 25 aa, Plasmodium falciparum
SKNIKNYNSNKKETTDDEDEQQDQH

SEQ ID NO: 3344076 - protein, 21 aa, Plasmodium falciparum
SKNITQEEKDELKKKYNDYKS

SEQ ID NO: 3344077 - protein, 25 aa, Plasmodium falciparum
SKNKEHEETHQQARINDDHKYDNIS

SEQ ID NO: 3344078 - protein, 9 aa, Plasmodium falciparum
SKNKENPEL

SEQ ID NO: 3344079 - protein, 9 aa, Plasmodium falciparum
SKNKKFGPN

SEQ ID NO: 3344080 - protein, 10 aa, Plasmodium falciparum
SKNKKNYKRP

SEQ ID NO: 3344081 - protein, 11 aa, Plasmodium falciparum
SKNKMNDKNYE

SEQ ID NO: 3344082 - protein, 6 aa, Plasmodium falciparum
SKNKNK

SEQ ID NO: 3344083 - protein, 9 aa, Plasmodium falciparum
SKNKNKEKI

SEQ ID NO: 3344084 - protein, 9 aa, Plasmodium falciparum
SKNKNKKKA

SEQ ID NO: 3344085 - protein, 14 aa, Plasmodium falciparum
SKNKPNERKRFDRE

SEQ ID NO: 3344086 - protein, 13 aa, Plasmodium falciparum
SKNKTKEKQSFKG

SEQ ID NO: 3344087 - protein, 7 aa, Plasmodium falciparum
SKNKYTD

SEQ ID NO: 3344088 - protein, 10 aa, Plasmodium falciparum
SKNKYTTNEY

SEQ ID NO: 3344089 - protein, 16 aa, Plasmodium falciparum
SKNLGSSSIKYGENGT

SEQ ID NO: 3344090 - protein, 6 aa, Plasmodium falciparum
SKNLNE

SEQ ID NO: 3344091 - protein, 5 aa, Plasmodium falciparum
SKNLP

SEQ ID NO: 3344092 - protein, 7 aa, Plasmodium falciparum
SKNLSDT

SEQ ID NO: 3344093 - protein, 8 aa, Plasmodium falciparum
SKNMKEDE

SEQ ID NO: 3344094 - protein, 9 aa, Plasmodium falciparum
SKNNDTSKI

SEQ ID NO: 3344095 - protein, 9 aa, Plasmodium falciparum
SKNNETHNN

SEQ ID NO: 3344096 - protein, 8 aa, Plasmodium falciparum
SKNNIENK

SEQ ID NO: 3344097 - protein, 13 aa, Plasmodium falciparum
SKNNINDNINNEQ

SEQ ID NO: 3344098 - protein, 13 aa, Plasmodium falciparum
SKNNIQPYEQPSG

SEQ ID NO: 3344099 - protein, 8 aa, Plasmodium falciparum
SKNNKKKK

SEQ ID NO: 3344100 - protein, 9 aa, Plasmodium falciparum
SKNNLGKNN

SEQ ID NO: 3344101 - protein, 15 aa, Plasmodium falciparum
SKNNNMSSGNSNKNL

SEQ ID NO: 3344102 - protein, 33 aa, Plasmodium falciparum
SKNNNNEQKKKKNSQSSTESSGTTNNNIDSKND

SEQ ID NO: 3344103 - protein, 6 aa, Plasmodium falciparum
SKNNPN

SEQ ID NO: 3344104 - protein, 8 aa, Plasmodium falciparum
SKNNSIHN

SEQ ID NO: 3344105 - protein, 7 aa, Plasmodium falciparum
SKNNVSV

SEQ ID NO: 3344106 - protein, 7 aa, Plasmodium falciparum
SKNNYNT

SEQ ID NO: 3344107 - protein, 9 aa, Plasmodium falciparum
SKNPYAESK

SEQ ID NO: 3344108 - protein, 17 aa, Plasmodium falciparum
SKNQSDEESYISSTAPS

SEQ ID NO: 3344109 - protein, 8 aa, Plasmodium falciparum
SKNRDEQK

SEQ ID NO: 3344110 - protein, 5 aa, Plasmodium falciparum
SKNRR

SEQ ID NO: 3344111 - protein, 7 aa, Plasmodium falciparum
SKNSFSK

SEQ ID NO: 3344112 - protein, 5 aa, Plasmodium falciparum
SKNSK

SEQ ID NO: 3344113 - protein, 13 aa, Plasmodium falciparum
SKNSLNKNLKKEV

SEQ ID NO: 3344114 - protein, 12 aa, Plasmodium falciparum
SKNSSSIFDEEI

SEQ ID NO: 3344115 - protein, 62 aa, Plasmodium falciparum
SKNSVMKKKNNKKKKKTKIIDKGKTKRNVEKNEPSEENQHQGNNNNNNNNNNNNKEEKGKEM

SEQ ID NO: 3344116 - protein, 20 aa, Plasmodium falciparum
SKNSVSKDTNKESSHNITDN

SEQ ID NO: 3344117 - protein, 9 aa, Plasmodium falciparum
SKNTEQSPA

SEQ ID NO: 3344118 - protein, 8 aa, Plasmodium falciparum
SKNTKEIN

SEQ ID NO: 3344119 - protein, 12 aa, Plasmodium falciparum
SKNTSFVSKNKN

SEQ ID NO: 3344120 - protein, 4 aa, Plasmodium falciparum
SKNV

SEQ ID NO: 3344121 - protein, 6 aa, Plasmodium falciparum
SKNVEE

SEQ ID NO: 3344122 - protein, 14 aa, Plasmodium falciparum
SKNVEKKNETNSVK

SEQ ID NO: 3344123 - protein, 5 aa, Plasmodium falciparum
SKNYK

SEQ ID NO: 3344124 - protein, 6 aa, Plasmodium falciparum
SKPDAN

SEQ ID NO: 3344125 - protein, 30 aa, Plasmodium falciparum
SKPDELENYNKQNENEFDENNNNKNNKIDQ

SEQ ID NO: 3344126 - protein, 9 aa, Plasmodium falciparum
SKPGESKNN

SEQ ID NO: 3344127 - protein, 6 aa, Plasmodium falciparum
SKPHGS

SEQ ID NO: 3344128 - protein, 4 aa, Plasmodium falciparum
SKPI

SEQ ID NO: 3344129 - protein, 5 aa, Plasmodium falciparum
SKPIE

SEQ ID NO: 3344130 - protein, 6 aa, Plasmodium falciparum
SKPIEK

SEQ ID NO: 3344131 - protein, 7 aa, Plasmodium falciparum
SKPPNGS

SEQ ID NO: 3344132 - protein, 6 aa, Plasmodium falciparum
SKPQHK

SEQ ID NO: 3344133 - protein, 5 aa, Plasmodium falciparum
SKPSK

SEQ ID NO: 3344134 - protein, 12 aa, Plasmodium falciparum
SKPSLKGQPNKH

SEQ ID NO: 3344135 - protein, 11 aa, Plasmodium falciparum
SKPSRPDKARR

SEQ ID NO: 3344136 - protein, 4 aa, Plasmodium falciparum
SKPV

SEQ ID NO: 3344137 - protein, 13 aa, Plasmodium falciparum
SKPVEKKKKKGKV

SEQ ID NO: 3344138 - protein, 4 aa, Plasmodium falciparum
SKQA

SEQ ID NO: 3344139 - protein, 8 aa, Plasmodium falciparum
SKQDKNYT

SEQ ID NO: 3344140 - protein, 9 aa, Plasmodium falciparum
SKQEKPSNI

SEQ ID NO: 3344141 - protein, 8 aa, Plasmodium falciparum
SKQGEEKT

SEQ ID NO: 3344142 - protein, 5 aa, Plasmodium falciparum
SKQGL

SEQ ID NO: 3344143 - protein, 4 aa, Plasmodium falciparum
SKQI

SEQ ID NO: 3344144 - protein, 11 aa, Plasmodium falciparum
SKQINNTNSYD

SEQ ID NO: 3344145 - protein, 10 aa, Plasmodium falciparum
SKQKKGNYSY

SEQ ID NO: 3344146 - protein, 13 aa, Plasmodium falciparum
SKQKKNEKKNKKK

SEQ ID NO: 3344147 - protein, 5 aa, Plasmodium falciparum
SKQKT

SEQ ID NO: 3344148 - protein, 11 aa, Plasmodium falciparum
SKQNIQKQNNN

SEQ ID NO: 3344149 - protein, 5 aa, Plasmodium falciparum
SKQPH

SEQ ID NO: 3344150 - protein, 7 aa, Plasmodium falciparum
SKQPIYR

SEQ ID NO: 3344151 - protein, 19 aa, Plasmodium falciparum
SKQPNVDSKERKYNKYEKD

SEQ ID NO: 3344152 - protein, 9 aa, Plasmodium falciparum
SKQQHDTNN

SEQ ID NO: 3344153 - protein, 6 aa, Plasmodium falciparum
SKQQNL

SEQ ID NO: 3344154 - protein, 9 aa, Plasmodium falciparum
SKQSEKTQN

SEQ ID NO: 3344155 - protein, 8 aa, Plasmodium falciparum
SKQSHSDP

SEQ ID NO: 3344156 - protein, 10 aa, Plasmodium falciparum
SKQSTQNDET

SEQ ID NO: 3344157 - protein, 4 aa, Plasmodium falciparum
SKQT

SEQ ID NO: 3344158 - protein, 17 aa, Plasmodium falciparum
SKQTSNKRFNNSNHHNI

SEQ ID NO: 3344159 - protein, 18 aa, Plasmodium falciparum
SKRAQTITAGDEKKIKRI

SEQ ID NO: 3344160 - protein, 15 aa, Plasmodium falciparum
SKRDENRSNSTNNYS

SEQ ID NO: 3344161 - protein, 5 aa, Plasmodium falciparum
SKRES

SEQ ID NO: 3344162 - protein, 5 aa, Plasmodium falciparum
SKREY

SEQ ID NO: 3344163 - protein, 8 aa, Plasmodium falciparum
SKRISAEN

SEQ ID NO: 3344164 - protein, 18 aa, Plasmodium falciparum
SKRKEDDMKEQKSNKDFQ

SEQ ID NO: 3344165 - protein, 12 aa, Plasmodium falciparum
SKRKEQKNETCN

SEQ ID NO: 3344166 - protein, 5 aa, Plasmodium falciparum
SKRKR

SEQ ID NO: 3344167 - protein, 5 aa, Plasmodium falciparum
SKRNN

SEQ ID NO: 3344168 - protein, 12 aa, Plasmodium falciparum
SKRNPQKDIHGT

SEQ ID NO: 3344169 - protein, 8 aa, Plasmodium falciparum
SKRNVENF

SEQ ID NO: 3344170 - protein, 4 aa, Plasmodium falciparum
SKRQ

SEQ ID NO: 3344171 - protein, 6 aa, Plasmodium falciparum
SKRSIT

SEQ ID NO: 3344172 - protein, 6 aa, Plasmodium falciparum
SKRSRG

SEQ ID NO: 3344173 - protein, 11 aa, Plasmodium falciparum
SKRTGNDNYQS

SEQ ID NO: 3344174 - protein, 8 aa, Plasmodium falciparum
SKRTGQQR

SEQ ID NO: 3344175 - protein, 9 aa, Plasmodium falciparum
SKRTTRDSA

SEQ ID NO: 3344176 - protein, 26 aa, Plasmodium falciparum
SKRYEENDKDHGNNENKQNNESDKSL

SEQ ID NO: 3344177 - protein, 136 aa, Plasmodium falciparum
SKRYSDKSSDSSKSSGSSKSSGSSKSSGSSKSSGSSKSSGSSKSSGSYKSSDSSKSSDSSKSSGSSKSSGSSKSSDSSKSSDSSKSSDSSKSSDSSKSSDSDNSSKSSQSYSSSTKRKKKKKILKKKKKGKEEKKM

SEQ ID NO: 3344178 - protein, 8 aa, Plasmodium falciparum
SKRYTPDQ

SEQ ID NO: 3344179 - protein, 4 aa, Plasmodium falciparum
SKSE

SEQ ID NO: 3344180 - protein, 7 aa, Plasmodium falciparum
SKSEDAT

SEQ ID NO: 3344181 - protein, 5 aa, Plasmodium falciparum
SKSEN

SEQ ID NO: 3344182 - protein, 8 aa, Plasmodium falciparum
SKSFNDNR

SEQ ID NO: 3344183 - protein, 9 aa, Plasmodium falciparum
SKSGKKGSG

SEQ ID NO: 3344184 - protein, 6 aa, Plasmodium falciparum
SKSGNM

SEQ ID NO: 3344185 - protein, 7 aa, Plasmodium falciparum
SKSGTKL

SEQ ID NO: 3344186 - protein, 5 aa, Plasmodium falciparum
SKSIE

SEQ ID NO: 3344187 - protein, 5 aa, Plasmodium falciparum
SKSIK

SEQ ID NO: 3344188 - protein, 9 aa, Plasmodium falciparum
SKSINLNPS

SEQ ID NO: 3344189 - protein, 9 aa, Plasmodium falciparum
SKSKENNNN

SEQ ID NO: 3344190 - protein, 10 aa, Plasmodium falciparum
SKSKKKKKNE

SEQ ID NO: 3344191 - protein, 9 aa, Plasmodium falciparum
SKSKNAKSV

SEQ ID NO: 3344192 - protein, 5 aa, Plasmodium falciparum
SKSMS

SEQ ID NO: 3344193 - protein, 11 aa, Plasmodium falciparum
SKSNDKLKNGL

SEQ ID NO: 3344194 - protein, 8 aa, Plasmodium falciparum
SKSNKKEI

SEQ ID NO: 3344195 - protein, 7 aa, Plasmodium falciparum
SKSNKKV

SEQ ID NO: 3344196 - protein, 18 aa, Plasmodium falciparum
SKSNSSYNGPDASAEGVQ

SEQ ID NO: 3344197 - protein, 15 aa, Plasmodium falciparum
SKSNSYKNTDVLHLI

SEQ ID NO: 3344198 - protein, 14 aa, Plasmodium falciparum
SKSNYNVKSNEDQI

SEQ ID NO: 3344199 - protein, 8 aa, Plasmodium falciparum
SKSPDKTR

SEQ ID NO: 3344200 - protein, 5 aa, Plasmodium falciparum
SKSPF

SEQ ID NO: 3344201 - protein, 14 aa, Plasmodium falciparum
SKSPKASLRKKIID

SEQ ID NO: 3344202 - protein, 9 aa, Plasmodium falciparum
SKSPNEKFN

SEQ ID NO: 3344203 - protein, 15 aa, Plasmodium falciparum
SKSQNTLTDEENYDS

SEQ ID NO: 3344204 - protein, 7 aa, Plasmodium falciparum
SKSRVGN

SEQ ID NO: 3344205 - protein, 4 aa, Plasmodium falciparum
SKSS

SEQ ID NO: 3344206 - protein, 7 aa, Plasmodium falciparum
SKSSATV

SEQ ID NO: 3344207 - protein, 14 aa, Plasmodium falciparum
SKSSHTTKNSNTKL

SEQ ID NO: 3344208 - protein, 7 aa, Plasmodium falciparum
SKSSIKY

SEQ ID NO: 3344209 - protein, 8 aa, Plasmodium falciparum
SKSSNRVQ

SEQ ID NO: 3344210 - protein, 12 aa, Plasmodium falciparum
SKSSSGDSYPYG

SEQ ID NO: 3344211 - protein, 4 aa, Plasmodium falciparum
SKST

SEQ ID NO: 3344212 - protein, 7 aa, Plasmodium falciparum
SKSTENI

SEQ ID NO: 3344213 - protein, 12 aa, Plasmodium falciparum
SKSTNENMITGQ

SEQ ID NO: 3344214 - protein, 5 aa, Plasmodium falciparum
SKSVD

SEQ ID NO: 3344215 - protein, 15 aa, Plasmodium falciparum
SKSVEYKNDNNCSNQ

SEQ ID NO: 3344216 - protein, 5 aa, Plasmodium falciparum
SKSVR

SEQ ID NO: 3344217 - protein, 9 aa, Plasmodium falciparum
SKSVSSSNA

SEQ ID NO: 3344218 - protein, 7 aa, Plasmodium falciparum
SKSYNDG

SEQ ID NO: 3344219 - protein, 15 aa, Plasmodium falciparum
SKSYNNLKDESDNAY

SEQ ID NO: 3344220 - protein, 8 aa, Plasmodium falciparum
SKSYSNEY

SEQ ID NO: 3344221 - protein, 9 aa, Plasmodium falciparum
SKTCENETT

SEQ ID NO: 3344222 - protein, 8 aa, Plasmodium falciparum
SKTDRENN

SEQ ID NO: 3344223 - protein, 4 aa, Plasmodium falciparum
SKTE

SEQ ID NO: 3344224 - protein, 7 aa, Plasmodium falciparum
SKTGHGI

SEQ ID NO: 3344225 - protein, 8 aa, Plasmodium falciparum
SKTGSGKT

SEQ ID NO: 3344226 - protein, 11 aa, Plasmodium falciparum
SKTHQNEEKIK

SEQ ID NO: 3344227 - protein, 7 aa, Plasmodium falciparum
SKTINND

SEQ ID NO: 3344228 - protein, 7 aa, Plasmodium falciparum
SKTKEYA

SEQ ID NO: 3344229 - protein, 6 aa, Plasmodium falciparum
SKTKKS

SEQ ID NO: 3344230 - protein, 8 aa, Plasmodium falciparum
SKTKTEYT

SEQ ID NO: 3344231 - protein, 6 aa, Plasmodium falciparum
SKTLHP

SEQ ID NO: 3344232 - protein, 11 aa, Plasmodium falciparum
SKTQGTSSTFI

SEQ ID NO: 3344233 - protein, 4 aa, Plasmodium falciparum
SKTS

SEQ ID NO: 3344234 - protein, 15 aa, Plasmodium falciparum
SKTSIKKNENKYNQN

SEQ ID NO: 3344235 - protein, 14 aa, Plasmodium falciparum
SKTSLNSSTQSTMD

SEQ ID NO: 3344236 - protein, 22 aa, Plasmodium falciparum
SKTSQRYSNSNKNKQNNEETNV

SEQ ID NO: 3344237 - protein, 13 aa, Plasmodium falciparum
SKTTMKSSATTFK

SEQ ID NO: 3344238 - protein, 7 aa, Plasmodium falciparum
SKTYESV

SEQ ID NO: 3344239 - protein, 7 aa, Plasmodium falciparum
SKVDDTQ

SEQ ID NO: 3344240 - protein, 6 aa, Plasmodium falciparum
SKVDQK

SEQ ID NO: 3344241 - protein, 4 aa, Plasmodium falciparum
SKVE

SEQ ID NO: 3344242 - protein, 9 aa, Plasmodium falciparum
SKVKKDTIQ

SEQ ID NO: 3344243 - protein, 8 aa, Plasmodium falciparum
SKVNDKNV

SEQ ID NO: 3344244 - protein, 98 aa, Plasmodium falciparum
SKVNDTTYRNTKGNNNNNTNDDNKNDVNKNDVNKNDVNKNDVNKNDVNKNDVNKNDVNKNDDNTNDVNTNNINTYDNTYNQTAPNYSYNTNKYDSKYN

SEQ ID NO: 3344245 - protein, 10 aa, Plasmodium falciparum
SKVPADSSKW

SEQ ID NO: 3344246 - protein, 13 aa, Plasmodium falciparum
SKVPKDIETNTYD

SEQ ID NO: 3344247 - protein, 44 aa, Plasmodium falciparum
SKVSEKKKTKKNEDKKKKKKKDDTSESSDSSSDSDDDSEEDNKI

SEQ ID NO: 3344248 - protein, 14 aa, Plasmodium falciparum
SKYANDNNDINNNY

SEQ ID NO: 3344249 - protein, 4 aa, Plasmodium falciparum
SKYD

SEQ ID NO: 3344250 - protein, 6 aa, Plasmodium falciparum
SKYDDF

SEQ ID NO: 3344251 - protein, 6 aa, Plasmodium falciparum
SKYDFR

SEQ ID NO: 3344252 - protein, 10 aa, Plasmodium falciparum
SKYDNVDSDH

SEQ ID NO: 3344253 - protein, 8 aa, Plasmodium falciparum
SKYENKKD

SEQ ID NO: 3344254 - protein, 6 aa, Plasmodium falciparum
SKYENY

SEQ ID NO: 3344255 - protein, 18 aa, Plasmodium falciparum
SKYFTQKNEQFKNSYSLK

SEQ ID NO: 3344256 - protein, 7 aa, Plasmodium falciparum
SKYGEKK

SEQ ID NO: 3344257 - protein, 15 aa, Plasmodium falciparum
SKYGKQNEKNENFDE

SEQ ID NO: 3344258 - protein, 6 aa, Plasmodium falciparum
SKYKDK

SEQ ID NO: 3344259 - protein, 17 aa, Plasmodium falciparum
SKYKNHNKDEKYDEKSL

SEQ ID NO: 3344260 - protein, 10 aa, Plasmodium falciparum
SKYKSGKQTC

SEQ ID NO: 3344261 - protein, 5 aa, Plasmodium falciparum
SKYND

SEQ ID NO: 3344262 - protein, 18 aa, Plasmodium falciparum
SKYNDGYVGDNKKYSKRE

SEQ ID NO: 3344263 - protein, 10 aa, Plasmodium falciparum
SKYNEENNSK

SEQ ID NO: 3344264 - protein, 7 aa, Plasmodium falciparum
SKYNEKK

SEQ ID NO: 3344265 - protein, 9 aa, Plasmodium falciparum
SKYNEKNNY

SEQ ID NO: 3344266 - protein, 49 aa, Plasmodium falciparum
SKYNEQKKQKKKTDKKKDDTVKTYDDEKEDTDKTHDNDNIQNNREEKRN

SEQ ID NO: 3344267 - protein, 8 aa, Plasmodium falciparum
SKYNKNYK

SEQ ID NO: 3344268 - protein, 10 aa, Plasmodium falciparum
SKYNNYKRSS

SEQ ID NO: 3344269 - protein, 20 aa, Plasmodium falciparum
SKYNTQTNNKHINEKDNNSY

SEQ ID NO: 3344270 - protein, 7 aa, Plasmodium falciparum
SKYPEIE

SEQ ID NO: 3344271 - protein, 7 aa, Plasmodium falciparum
SKYPETN

SEQ ID NO: 3344272 - protein, 6 aa, Plasmodium falciparum
SKYPNR

SEQ ID NO: 3344273 - protein, 6 aa, Plasmodium falciparum
SKYPTS

SEQ ID NO: 3344274 - protein, 28 aa, Plasmodium falciparum
SKYRKNEVQQDEENEQPANIKKGENTQL

SEQ ID NO: 3344275 - protein, 6 aa, Plasmodium falciparum
SKYSNS

SEQ ID NO: 3344276 - protein, 6 aa, Plasmodium falciparum
SKYTDK

SEQ ID NO: 3344277 - protein, 7 aa, Plasmodium falciparum
SKYTEEN

SEQ ID NO: 3344278 - protein, 5 aa, Plasmodium falciparum
SKYVQ

SEQ ID NO: 3344279 - protein, 4 aa, Plasmodium falciparum
SKYY

SEQ ID NO: 3344280 - protein, 5 aa, Plasmodium falciparum
SKYYD

SEQ ID NO: 3344281 - protein, 18 aa, Plasmodium falciparum
SKYYSDSTSASSKNFDNH

SEQ ID NO: 3344282 - protein, 9 aa, Plasmodium falciparum
SLAKNKYTG

SEQ ID NO: 3344283 - protein, 7 aa, Plasmodium falciparum
SLAPKKG

SEQ ID NO: 3344284 - protein, 12 aa, Plasmodium falciparum
SLASSSSSCSSS

SEQ ID NO: 3344285 - protein, 6 aa, Plasmodium falciparum
SLCTSP

SEQ ID NO: 3344286 - protein, 5 aa, Plasmodium falciparum
SLDDE

SEQ ID NO: 3344287 - protein, 8 aa, Plasmodium falciparum
SLDDNDVT

SEQ ID NO: 3344288 - protein, 4 aa, Plasmodium falciparum
SLDE

SEQ ID NO: 3344289 - protein, 18 aa, Plasmodium falciparum
SLDENNKQSLSAKEQINK

SEQ ID NO: 3344290 - protein, 10 aa, Plasmodium falciparum
SLDEQNEDHD

SEQ ID NO: 3344291 - protein, 15 aa, Plasmodium falciparum
SLDGKGKIKRDQETY

SEQ ID NO: 3344292 - protein, 15 aa, Plasmodium falciparum
SLDKNNKDKEINNVE

SEQ ID NO: 3344293 - protein, 5 aa, Plasmodium falciparum
SLDMP

SEQ ID NO: 3344294 - protein, 33 aa, Plasmodium falciparum
SLDNNNNNNNLNSGNNINDHGNNSGKGINHTNP

SEQ ID NO: 3344295 - protein, 7 aa, Plasmodium falciparum
SLDNSIN

SEQ ID NO: 3344296 - protein, 5 aa, Plasmodium falciparum
SLEAE

SEQ ID NO: 3344297 - protein, 6 aa, Plasmodium falciparum
SLEDQK

SEQ ID NO: 3344298 - protein, 12 aa, Plasmodium falciparum
SLEEQKKKNSGW

SEQ ID NO: 3344299 - protein, 11 aa, Plasmodium falciparum
SLEKAEEKKKI

SEQ ID NO: 3344300 - protein, 5 aa, Plasmodium falciparum
SLEKK

SEQ ID NO: 3344301 - protein, 13 aa, Plasmodium falciparum
SLENEDTSKKRKN

SEQ ID NO: 3344302 - protein, 6 aa, Plasmodium falciparum
SLENNI

SEQ ID NO: 3344303 - protein, 4 aa, Plasmodium falciparum
SLEQ

SEQ ID NO: 3344304 - protein, 23 aa, Plasmodium falciparum
SLEQQQQQQQQAEDEKINKTQDV

SEQ ID NO: 3344305 - protein, 7 aa, Plasmodium falciparum
SLETGKN

SEQ ID NO: 3344306 - protein, 10 aa, Plasmodium falciparum
SLFGNSPNNM

SEQ ID NO: 3344307 - protein, 4 aa, Plasmodium falciparum
SLGA

SEQ ID NO: 3344308 - protein, 4 aa, Plasmodium falciparum
SLGE

SEQ ID NO: 3344309 - protein, 7 aa, Plasmodium falciparum
SLGGKTK

SEQ ID NO: 3344310 - protein, 5 aa, Plasmodium falciparum
SLGGN

SEQ ID NO: 3344311 - protein, 7 aa, Plasmodium falciparum
SLGGSSK

SEQ ID NO: 3344312 - protein, 9 aa, Plasmodium falciparum
SLGGSTSNI

SEQ ID NO: 3344313 - protein, 5 aa, Plasmodium falciparum
SLGNN

SEQ ID NO: 3344314 - protein, 7 aa, Plasmodium falciparum
SLGPQGL

SEQ ID NO: 3344315 - protein, 4 aa, Plasmodium falciparum
SLGS

SEQ ID NO: 3344316 - protein, 43 aa, Plasmodium falciparum
SLHEKSKKKKKKLKKKLAEDDDDNNNNNERFPNSNENISTNKL

SEQ ID NO: 3344317 - protein, 13 aa, Plasmodium falciparum
SLIENNKKKEENI

SEQ ID NO: 3344318 - protein, 7 aa, Plasmodium falciparum
SLKEDEK

SEQ ID NO: 3344319 - protein, 9 aa, Plasmodium falciparum
SLKEQNENI

SEQ ID NO: 3344320 - protein, 9 aa, Plasmodium falciparum
SLKKENKNL

SEQ ID NO: 3344321 - protein, 6 aa, Plasmodium falciparum
SLKKKE

SEQ ID NO: 3344322 - protein, 9 aa, Plasmodium falciparum
SLKKPNGKL

SEQ ID NO: 3344323 - protein, 15 aa, Plasmodium falciparum
SLKNCKREKWKGTKY

SEQ ID NO: 3344324 - protein, 15 aa, Plasmodium falciparum
SLKNISNEELTNTNP

SEQ ID NO: 3344325 - protein, 9 aa, Plasmodium falciparum
SLKNKNKKL

SEQ ID NO: 3344326 - protein, 11 aa, Plasmodium falciparum
SLKNKTSAYVK

SEQ ID NO: 3344327 - protein, 7 aa, Plasmodium falciparum
SLKPGKK

SEQ ID NO: 3344328 - protein, 5 aa, Plasmodium falciparum
SLKQK

SEQ ID NO: 3344329 - protein, 6 aa, Plasmodium falciparum
SLKSEK

SEQ ID NO: 3344330 - protein, 11 aa, Plasmodium falciparum
SLKSKKNETTL

SEQ ID NO: 3344331 - protein, 6 aa, Plasmodium falciparum
SLKTTE

SEQ ID NO: 3344332 - protein, 7 aa, Plasmodium falciparum
SLKVKRR

SEQ ID NO: 3344333 - protein, 6 aa, Plasmodium falciparum
SLNDED

SEQ ID NO: 3344334 - protein, 9 aa, Plasmodium falciparum
SLNDSDNNI

SEQ ID NO: 3344335 - protein, 12 aa, Plasmodium falciparum
SLNDSYKDKTFE

SEQ ID NO: 3344336 - protein, 5 aa, Plasmodium falciparum
SLNDY

SEQ ID NO: 3344337 - protein, 4 aa, Plasmodium falciparum
SLNE

SEQ ID NO: 3344338 - protein, 8 aa, Plasmodium falciparum
SLNEEKKY

SEQ ID NO: 3344339 - protein, 11 aa, Plasmodium falciparum
SLNEHKKIGGD

SEQ ID NO: 3344340 - protein, 9 aa, Plasmodium falciparum
SLNGTSAGI

SEQ ID NO: 3344341 - protein, 4 aa, Plasmodium falciparum
SLNK

SEQ ID NO: 3344342 - protein, 18 aa, Plasmodium falciparum
SLNKDNKDVYSDPCHNNN

SEQ ID NO: 3344343 - protein, 6 aa, Plasmodium falciparum
SLNKNT

SEQ ID NO: 3344344 - protein, 21 aa, Plasmodium falciparum
SLNKNYKSKNIDDYESSEPIY

SEQ ID NO: 3344345 - protein, 5 aa, Plasmodium falciparum
SLNMG

SEQ ID NO: 3344346 - protein, 19 aa, Plasmodium falciparum
SLNNHNNNNKEEDNDYTEK

SEQ ID NO: 3344347 - protein, 5 aa, Plasmodium falciparum
SLNNM

SEQ ID NO: 3344348 - protein, 13 aa, Plasmodium falciparum
SLNNNDEDEETED

SEQ ID NO: 3344349 - protein, 13 aa, Plasmodium falciparum
SLNNNDNNNMNRR

SEQ ID NO: 3344350 - protein, 9 aa, Plasmodium falciparum
SLNNNKKKK

SEQ ID NO: 3344351 - protein, 41 aa, Plasmodium falciparum
SLNNNTKDDSNIDGCDEKSDNIDGCDEKSDTTNKGDDTSQC

SEQ ID NO: 3344352 - protein, 24 aa, Plasmodium falciparum
SLNNSNNIASKEDGQGKKKKRIDN

SEQ ID NO: 3344353 - protein, 6 aa, Plasmodium falciparum
SLNPNN

SEQ ID NO: 3344354 - protein, 20 aa, Plasmodium falciparum
SLNQERERTYQEDDHENDLK

SEQ ID NO: 3344355 - protein, 10 aa, Plasmodium falciparum
SLNQQTNKKI

SEQ ID NO: 3344356 - protein, 7 aa, Plasmodium falciparum
SLNRNGS

SEQ ID NO: 3344357 - protein, 4 aa, Plasmodium falciparum
SLNS

SEQ ID NO: 3344358 - protein, 10 aa, Plasmodium falciparum
SLNSKGNELL

SEQ ID NO: 3344359 - protein, 14 aa, Plasmodium falciparum
SLNSNTSRIKKRKT

SEQ ID NO: 3344360 - protein, 6 aa, Plasmodium falciparum
SLNTNE

SEQ ID NO: 3344361 - protein, 9 aa, Plasmodium falciparum
SLPGFPSPD

SEQ ID NO: 3344362 - protein, 9 aa, Plasmodium falciparum
SLPKDEKYR

SEQ ID NO: 3344363 - protein, 7 aa, Plasmodium falciparum
SLPKGLP

SEQ ID NO: 3344364 - protein, 12 aa, Plasmodium falciparum
SLPKGSNKIINQ

SEQ ID NO: 3344365 - protein, 5 aa, Plasmodium falciparum
SLPKK

SEQ ID NO: 3344366 - protein, 5 aa, Plasmodium falciparum
SLPNN

SEQ ID NO: 3344367 - protein, 7 aa, Plasmodium falciparum
SLPPDRQ

SEQ ID NO: 3344368 - protein, 6 aa, Plasmodium falciparum
SLPPLK

SEQ ID NO: 3344369 - protein, 21 aa, Plasmodium falciparum
SLPSPITTENHQDVNSNVNKR

SEQ ID NO: 3344370 - protein, 7 aa, Plasmodium falciparum
SLPSSNM

SEQ ID NO: 3344371 - protein, 5 aa, Plasmodium falciparum
SLPVQ

SEQ ID NO: 3344372 - protein, 11 aa, Plasmodium falciparum
SLQLSKEKDNI

SEQ ID NO: 3344373 - protein, 8 aa, Plasmodium falciparum
SLQSKNAA

SEQ ID NO: 3344374 - protein, 13 aa, Plasmodium falciparum
SLQTNTNNTYSDL

SEQ ID NO: 3344375 - protein, 5 aa, Plasmodium falciparum
SLQTS

SEQ ID NO: 3344376 - protein, 13 aa, Plasmodium falciparum
SLRGSDKIKNDQI

SEQ ID NO: 3344377 - protein, 7 aa, Plasmodium falciparum
SLRKKQK

SEQ ID NO: 3344378 - protein, 4 aa, Plasmodium falciparum
SLRQ

SEQ ID NO: 3344379 - protein, 4 aa, Plasmodium falciparum
SLRS

SEQ ID NO: 3344380 - protein, 19 aa, Plasmodium falciparum
SLSADRKRSIESTDPSDTV

SEQ ID NO: 3344381 - protein, 20 aa, Plasmodium falciparum
SLSDDESDTYQGKDYDNKSP

SEQ ID NO: 3344382 - protein, 18 aa, Plasmodium falciparum
SLSEETEEKSHTKKKKSS

SEQ ID NO: 3344383 - protein, 6 aa, Plasmodium falciparum
SLSEPY

SEQ ID NO: 3344384 - protein, 18 aa, Plasmodium falciparum
SLSKGTKKTTLKKSNNIK

SEQ ID NO: 3344385 - protein, 15 aa, Plasmodium falciparum
SLSKTKKNKPDKKEI

SEQ ID NO: 3344386 - protein, 7 aa, Plasmodium falciparum
SLSNANN

SEQ ID NO: 3344387 - protein, 5 aa, Plasmodium falciparum
SLSNI

SEQ ID NO: 3344388 - protein, 11 aa, Plasmodium falciparum
SLSNNTTKNVD

SEQ ID NO: 3344389 - protein, 9 aa, Plasmodium falciparum
SLSPGSKTV

SEQ ID NO: 3344390 - protein, 13 aa, Plasmodium falciparum
SLSSKAVNKKKSK

SEQ ID NO: 3344391 - protein, 6 aa, Plasmodium falciparum
SLSSKE

SEQ ID NO: 3344392 - protein, 8 aa, Plasmodium falciparum
SLSSKEKK

SEQ ID NO: 3344393 - protein, 15 aa, Plasmodium falciparum
SLSSPESSLSSPLST

SEQ ID NO: 3344394 - protein, 12 aa, Plasmodium falciparum
SLSSPNITPIFP

SEQ ID NO: 3344395 - protein, 10 aa, Plasmodium falciparum
SLSSSSTKSL

SEQ ID NO: 3344396 - protein, 6 aa, Plasmodium falciparum
SLSTSC

SEQ ID NO: 3344397 - protein, 9 aa, Plasmodium falciparum
SLSTTTDEV

SEQ ID NO: 3344398 - protein, 7 aa, Plasmodium falciparum
SLTDQNT

SEQ ID NO: 3344399 - protein, 5 aa, Plasmodium falciparum
SLTEL

SEQ ID NO: 3344400 - protein, 4 aa, Plasmodium falciparum
SLTK

SEQ ID NO: 3344401 - protein, 9 aa, Plasmodium falciparum
SLTKDVKSK

SEQ ID NO: 3344402 - protein, 5 aa, Plasmodium falciparum
SLTKS

SEQ ID NO: 3344403 - protein, 11 aa, Plasmodium falciparum
SLTNDDQNLKR

SEQ ID NO: 3344404 - protein, 17 aa, Plasmodium falciparum
SLTSEKKKIIRETLANT

SEQ ID NO: 3344405 - protein, 5 aa, Plasmodium falciparum
SLVEK

SEQ ID NO: 3344406 - protein, 6 aa, Plasmodium falciparum
SLVGDN

SEQ ID NO: 3344407 - protein, 4 aa, Plasmodium falciparum
SLVN

SEQ ID NO: 3344408 - protein, 8 aa, Plasmodium falciparum
SLYEETRK

SEQ ID NO: 3344409 - protein, 5 aa, Plasmodium falciparum
SLYPT

SEQ ID NO: 3344410 - protein, 6 aa, Plasmodium falciparum
SMADPE

SEQ ID NO: 3344411 - protein, 15 aa, Plasmodium falciparum
SMDASNNQNDYYNQN

SEQ ID NO: 3344412 - protein, 6 aa, Plasmodium falciparum
SMDESS

SEQ ID NO: 3344413 - protein, 12 aa, Plasmodium falciparum
SMDKTNEENVNS

SEQ ID NO: 3344414 - protein, 6 aa, Plasmodium falciparum
SMDNKN

SEQ ID NO: 3344415 - protein, 16 aa, Plasmodium falciparum
SMDNNSSNSNSNNTHF

SEQ ID NO: 3344416 - protein, 6 aa, Plasmodium falciparum
SMDNNT

SEQ ID NO: 3344417 - protein, 9 aa, Plasmodium falciparum
SMDQTHKNQ

SEQ ID NO: 3344418 - protein, 5 aa, Plasmodium falciparum
SMEEN

SEQ ID NO: 3344419 - protein, 13 aa, Plasmodium falciparum
SMEEQEKNGEIEQ

SEQ ID NO: 3344420 - protein, 12 aa, Plasmodium falciparum
SMENKTKRNKNF

SEQ ID NO: 3344421 - protein, 8 aa, Plasmodium falciparum
SMEQSNKY

SEQ ID NO: 3344422 - protein, 10 aa, Plasmodium falciparum
SMESKSTAVT

SEQ ID NO: 3344423 - protein, 5 aa, Plasmodium falciparum
SMGDE

SEQ ID NO: 3344424 - protein, 6 aa, Plasmodium falciparum
SMGEGQ

SEQ ID NO: 3344425 - protein, 20 aa, Plasmodium falciparum
SMGGGKGGSDFDPKGKSDNE

SEQ ID NO: 3344426 - protein, 4 aa, Plasmodium falciparum
SMGT

SEQ ID NO: 3344427 - protein, 6 aa, Plasmodium falciparum
SMHNNN

SEQ ID NO: 3344428 - protein, 8 aa, Plasmodium falciparum
SMKENGKM

SEQ ID NO: 3344429 - protein, 14 aa, Plasmodium falciparum
SMKENNKDQRNNVT

SEQ ID NO: 3344430 - protein, 11 aa, Plasmodium falciparum
SMKERDLKPDR

SEQ ID NO: 3344431 - protein, 6 aa, Plasmodium falciparum
SMKGDE

SEQ ID NO: 3344432 - protein, 8 aa, Plasmodium falciparum
SMKNDNPT

SEQ ID NO: 3344433 - protein, 15 aa, Plasmodium falciparum
SMKNENNDEEEQTAT

SEQ ID NO: 3344434 - protein, 7 aa, Plasmodium falciparum
SMNDEKD

SEQ ID NO: 3344435 - protein, 6 aa, Plasmodium falciparum
SMNDKN

SEQ ID NO: 3344436 - protein, 27 aa, Plasmodium falciparum
SMNDTNNDYNNNDKFNVDEKKDIEEDI

SEQ ID NO: 3344437 - protein, 28 aa, Plasmodium falciparum
SMNNKNVDKEDNYKKCSDTIKGKSYNSE

SEQ ID NO: 3344438 - protein, 30 aa, Plasmodium falciparum
SMNNNNMNNNNMNNNNMNNNNMNNNNMNNN

SEQ ID NO: 3344439 - protein, 10 aa, Plasmodium falciparum
SMNNNNSNSI

SEQ ID NO: 3344440 - protein, 9 aa, Plasmodium falciparum
SMNNNTKNV

SEQ ID NO: 3344441 - protein, 8 aa, Plasmodium falciparum
SMNNQKSN

SEQ ID NO: 3344442 - protein, 7 aa, Plasmodium falciparum
SMNRTNY

SEQ ID NO: 3344443 - protein, 27 aa, Plasmodium falciparum
SMQDNNKRNSMHNNNGMNKNRGGGNKG

SEQ ID NO: 3344444 - protein, 4 aa, Plasmodium falciparum
SMQY

SEQ ID NO: 3344445 - protein, 4 aa, Plasmodium falciparum
SMRK

SEQ ID NO: 3344446 - protein, 19 aa, Plasmodium falciparum
SMRNETNKTTATITTTSDN

SEQ ID NO: 3344447 - protein, 6 aa, Plasmodium falciparum
SMSKNN

SEQ ID NO: 3344448 - protein, 4 aa, Plasmodium falciparum
SMSN

SEQ ID NO: 3344449 - protein, 5 aa, Plasmodium falciparum
SMSPP

SEQ ID NO: 3344450 - protein, 43 aa, Plasmodium falciparum
SMSSISNNNMKNGNDMNNTNNNTNNNTNNNTNNNTNNNINSNI

SEQ ID NO: 3344451 - protein, 5 aa, Plasmodium falciparum
SMTET

SEQ ID NO: 3344452 - protein, 10 aa, Plasmodium falciparum
SMTSKESHTS

SEQ ID NO: 3344453 - protein, 22 aa, Plasmodium falciparum
SMTSSMTNNMTSSMTNNMTSSM

SEQ ID NO: 3344454 - protein, 10 aa, Plasmodium falciparum
SMVNSNGGGI

SEQ ID NO: 3344455 - protein, 4 aa, Plasmodium falciparum
SMVS

SEQ ID NO: 3344456 - protein, 8 aa, Plasmodium falciparum
SMYPSNGN

SEQ ID NO: 3344457 - protein, 7 aa, Plasmodium falciparum
SNAEKTY

SEQ ID NO: 3344458 - protein, 39 aa, Plasmodium falciparum
SNAKGANKKGGKKNSVVKKEDNKKKGKNNKKKNKNQNLK

SEQ ID NO: 3344459 - protein, 4 aa, Plasmodium falciparum
SNAL

SEQ ID NO: 3344460 - protein, 11 aa, Plasmodium falciparum
SNANNESNNYL

SEQ ID NO: 3344461 - protein, 8 aa, Plasmodium falciparum
SNANNGAS

SEQ ID NO: 3344462 - protein, 7 aa, Plasmodium falciparum
SNAQHNI

SEQ ID NO: 3344463 - protein, 19 aa, Plasmodium falciparum
SNASLEDQKTENLKETEPQ

SEQ ID NO: 3344464 - protein, 20 aa, Plasmodium falciparum
SNASNSDDTKSNTKNKKASP

SEQ ID NO: 3344465 - protein, 35 aa, Plasmodium falciparum
SNASNSGSSDKVSSRSLTTPPSTSSKKSKQKEKRM

SEQ ID NO: 3344466 - protein, 5 aa, Plasmodium falciparum
SNATT

SEQ ID NO: 3344467 - protein, 8 aa, Plasmodium falciparum
SNCFSSGS

SEQ ID NO: 3344468 - protein, 9 aa, Plasmodium falciparum
SNCGEQQVT

SEQ ID NO: 3344469 - protein, 13 aa, Plasmodium falciparum
SNCRKKKKKNTNP

SEQ ID NO: 3344470 - protein, 24 aa, Plasmodium falciparum
SNCSKSSKYEKSSCGSKNKSGDSL

SEQ ID NO: 3344471 - protein, 57 aa, Plasmodium falciparum
SNCSSTTYSGSATSHKRKKKKKKKKKEQTNEGKKSVKGINKKDKKRNSKVESKKEQA

SEQ ID NO: 3344472 - protein, 9 aa, Plasmodium falciparum
SNDATSDYV

SEQ ID NO: 3344473 - protein, 14 aa, Plasmodium falciparum
SNDCKKRKGSRYTS

SEQ ID NO: 3344474 - protein, 5 aa, Plasmodium falciparum
SNDDE

SEQ ID NO: 3344475 - protein, 8 aa, Plasmodium falciparum
SNDDEIDD

SEQ ID NO: 3344476 - protein, 11 aa, Plasmodium falciparum
SNDDEIDDTDE

SEQ ID NO: 3344477 - protein, 6 aa, Plasmodium falciparum
SNDDEN

SEQ ID NO: 3344478 - protein, 6 aa, Plasmodium falciparum
SNDDNK

SEQ ID NO: 3344479 - protein, 10 aa, Plasmodium falciparum
SNDDYKNNSM

SEQ ID NO: 3344480 - protein, 7 aa, Plasmodium falciparum
SNDEDKI

SEQ ID NO: 3344481 - protein, 5 aa, Plasmodium falciparum
SNDEE

SEQ ID NO: 3344482 - protein, 8 aa, Plasmodium falciparum
SNDEHNNS

SEQ ID NO: 3344483 - protein, 6 aa, Plasmodium falciparum
SNDEIK

SEQ ID NO: 3344484 - protein, 12 aa, Plasmodium falciparum
SNDEIKNNPINN

SEQ ID NO: 3344485 - protein, 14 aa, Plasmodium falciparum
SNDEKDSNENTYNN

SEQ ID NO: 3344486 - protein, 11 aa, Plasmodium falciparum
SNDEKKKEEKI

SEQ ID NO: 3344487 - protein, 15 aa, Plasmodium falciparum
SNDEKQENNKKFPSL

SEQ ID NO: 3344488 - protein, 7 aa, Plasmodium falciparum
SNDEKRI

SEQ ID NO: 3344489 - protein, 9 aa, Plasmodium falciparum
SNDEKTKTI

SEQ ID NO: 3344490 - protein, 37 aa, Plasmodium falciparum
SNDEMNKQDNNNENINTTSTSNINDNNSTKSNNNKSN

SEQ ID NO: 3344491 - protein, 10 aa, Plasmodium falciparum
SNDENIGSDP

SEQ ID NO: 3344492 - protein, 15 aa, Plasmodium falciparum
SNDESNDESNSNNCN

SEQ ID NO: 3344493 - protein, 8 aa, Plasmodium falciparum
SNDESQYI

SEQ ID NO: 3344494 - protein, 5 aa, Plasmodium falciparum
SNDFT

SEQ ID NO: 3344495 - protein, 8 aa, Plasmodium falciparum
SNDHSNDY

SEQ ID NO: 3344496 - protein, 14 aa, Plasmodium falciparum
SNDINNNNNNNNNN

SEQ ID NO: 3344497 - protein, 15 aa, Plasmodium falciparum
SNDINSKNDTSEQIQ

SEQ ID NO: 3344498 - protein, 7 aa, Plasmodium falciparum
SNDITNE

SEQ ID NO: 3344499 - protein, 22 aa, Plasmodium falciparum
SNDKDSDELDEFDEENKNDIVN

SEQ ID NO: 3344500 - protein, 10 aa, Plasmodium falciparum
SNDKEQIDNP

SEQ ID NO: 3344501 - protein, 8 aa, Plasmodium falciparum
SNDKGSND

SEQ ID NO: 3344502 - protein, 11 aa, Plasmodium falciparum
SNDKKNNLTNE

SEQ ID NO: 3344503 - protein, 7 aa, Plasmodium falciparum
SNDKNEA

SEQ ID NO: 3344504 - protein, 31 aa, Plasmodium falciparum
SNDKYSKRQKNKSRRTPSKYSNTSSSYDNKK

SEQ ID NO: 3344505 - protein, 4 aa, Plasmodium falciparum
SNDN

SEQ ID NO: 3344506 - protein, 7 aa, Plasmodium falciparum
SNDNDNV

SEQ ID NO: 3344507 - protein, 18 aa, Plasmodium falciparum
SNDNFKDNYNNSNDKKKN

SEQ ID NO: 3344508 - protein, 5 aa, Plasmodium falciparum
SNDNI

SEQ ID NO: 3344509 - protein, 6 aa, Plasmodium falciparum
SNDNIN

SEQ ID NO: 3344510 - protein, 9 aa, Plasmodium falciparum
SNDNKKECR

SEQ ID NO: 3344511 - protein, 5 aa, Plasmodium falciparum
SNDNL

SEQ ID NO: 3344512 - protein, 6 aa, Plasmodium falciparum
SNDNLN

SEQ ID NO: 3344513 - protein, 13 aa, Plasmodium falciparum
SNDNMKNENGNNF

SEQ ID NO: 3344514 - protein, 16 aa, Plasmodium falciparum
SNDNMKNKKSNNSFNS

SEQ ID NO: 3344515 - protein, 9 aa, Plasmodium falciparum
SNDNNGYIP

SEQ ID NO: 3344516 - protein, 9 aa, Plasmodium falciparum
SNDNNHKGG

SEQ ID NO: 3344517 - protein, 11 aa, Plasmodium falciparum
SNDNNSSNNAE

SEQ ID NO: 3344518 - protein, 16 aa, Plasmodium falciparum
SNDNQSDSLPKKSIRN

SEQ ID NO: 3344519 - protein, 9 aa, Plasmodium falciparum
SNDNSDNVS

SEQ ID NO: 3344520 - protein, 31 aa, Plasmodium falciparum
SNDNTKNEHNDDINGDINGDINNDDINDDIN

SEQ ID NO: 3344521 - protein, 22 aa, Plasmodium falciparum
SNDNYEQNKTEEICDTTKSDNS

SEQ ID NO: 3344522 - protein, 10 aa, Plasmodium falciparum
SNDPNNNKNV

SEQ ID NO: 3344523 - protein, 8 aa, Plasmodium falciparum
SNDPTQRK

SEQ ID NO: 3344524 - protein, 8 aa, Plasmodium falciparum
SNDPYTQK

SEQ ID NO: 3344525 - protein, 9 aa, Plasmodium falciparum
SNDQQKAKD

SEQ ID NO: 3344526 - protein, 46 aa, Plasmodium falciparum
SNDRASDGVKKKKNKENKKDNTNNNRECNDKDTNNVTNNNESNQDI

SEQ ID NO: 3344527 - protein, 11 aa, Plasmodium falciparum
SNDRKNYNNNN

SEQ ID NO: 3344528 - protein, 30 aa, Plasmodium falciparum
SNDRSSDLSSDLSDDKSTNSSSISSNSSLN

SEQ ID NO: 3344529 - protein, 8 aa, Plasmodium falciparum
SNDSISGN

SEQ ID NO: 3344530 - protein, 7 aa, Plasmodium falciparum
SNDSKTL

SEQ ID NO: 3344531 - protein, 12 aa, Plasmodium falciparum
SNDSSKVSCADQ

SEQ ID NO: 3344532 - protein, 20 aa, Plasmodium falciparum
SNDSSNNNNNNNNNNNNNNS

SEQ ID NO: 3344533 - protein, 12 aa, Plasmodium falciparum
SNDTLSVEAQNN

SEQ ID NO: 3344534 - protein, 12 aa, Plasmodium falciparum
SNDTNSNNDTKY

SEQ ID NO: 3344535 - protein, 6 aa, Plasmodium falciparum
SNDTVK

SEQ ID NO: 3344536 - protein, 14 aa, Plasmodium falciparum
SNDVNEEKKNDVGS

SEQ ID NO: 3344537 - protein, 94 aa, Plasmodium falciparum
SNDVPNDMSNDVPNGMSNDVPNGMSNDVPNDISNDVPNDISNDVSNDVPNDVSNDISNDVSNNVPNDVSNDVPNDVPNDVPNDVPNDVPNDTSI

SEQ ID NO: 3344538 - protein, 9 aa, Plasmodium falciparum
SNDVSGELP

SEQ ID NO: 3344539 - protein, 22 aa, Plasmodium falciparum
SNDYAADANKHNSYKKKKTFEN

SEQ ID NO: 3344540 - protein, 5 aa, Plasmodium falciparum
SNDYT

SEQ ID NO: 3344541 - protein, 10 aa, Plasmodium falciparum
SNEAKYNAGY

SEQ ID NO: 3344542 - protein, 4 aa, Plasmodium falciparum
SNEC

SEQ ID NO: 3344543 - protein, 13 aa, Plasmodium falciparum
SNEDDNSRTPSNT

SEQ ID NO: 3344544 - protein, 6 aa, Plasmodium falciparum
SNEDKL

SEQ ID NO: 3344545 - protein, 24 aa, Plasmodium falciparum
SNEDNDVSSDDEDLYNNEDDKKKV

SEQ ID NO: 3344546 - protein, 10 aa, Plasmodium falciparum
SNEDNETEKK

SEQ ID NO: 3344547 - protein, 16 aa, Plasmodium falciparum
SNEDTLNVSNKENTTF

SEQ ID NO: 3344548 - protein, 16 aa, Plasmodium falciparum
SNEEAERKGKLSTSYN

SEQ ID NO: 3344549 - protein, 78 aa, Plasmodium falciparum
SNEEDEEEDEEEEEEEEEEDELEEDEEDDDDEEEKLKKKRRQRQKRASRKRSGEKKDLASNKKKKKKSEQPNENGNEN

SEQ ID NO: 3344550 - protein, 18 aa, Plasmodium falciparum
SNEEENKNIQDTHSIDSN

SEQ ID NO: 3344551 - protein, 5 aa, Plasmodium falciparum
SNEEK

SEQ ID NO: 3344552 - protein, 8 aa, Plasmodium falciparum
SNEEKKSY

SEQ ID NO: 3344553 - protein, 9 aa, Plasmodium falciparum
SNEENDETA

SEQ ID NO: 3344554 - protein, 7 aa, Plasmodium falciparum
SNEENKI

SEQ ID NO: 3344555 - protein, 5 aa, Plasmodium falciparum
SNEER

SEQ ID NO: 3344556 - protein, 13 aa, Plasmodium falciparum
SNEESNPNNNNSN

SEQ ID NO: 3344557 - protein, 9 aa, Plasmodium falciparum
SNEGEEKEM

SEQ ID NO: 3344558 - protein, 7 aa, Plasmodium falciparum
SNEGEIR

SEQ ID NO: 3344559 - protein, 30 aa, Plasmodium falciparum
SNEHEENEDNNGDIIENNNGDVIENNNGDI

SEQ ID NO: 3344560 - protein, 6 aa, Plasmodium falciparum
SNEIKN

SEQ ID NO: 3344561 - protein, 7 aa, Plasmodium falciparum
SNEINSN

SEQ ID NO: 3344562 - protein, 5 aa, Plasmodium falciparum
SNEKD

SEQ ID NO: 3344563 - protein, 24 aa, Plasmodium falciparum
SNEKDIYKNDKKNIEKKNNTNENI

SEQ ID NO: 3344564 - protein, 19 aa, Plasmodium falciparum
SNEKDKEEKKKKSESRDSY

SEQ ID NO: 3344565 - protein, 6 aa, Plasmodium falciparum
SNEKDS

SEQ ID NO: 3344566 - protein, 7 aa, Plasmodium falciparum
SNEKEKI

SEQ ID NO: 3344567 - protein, 9 aa, Plasmodium falciparum
SNEKEMQDT

SEQ ID NO: 3344568 - protein, 9 aa, Plasmodium falciparum
SNEKESTSR

SEQ ID NO: 3344569 - protein, 10 aa, Plasmodium falciparum
SNEKGENINN

SEQ ID NO: 3344570 - protein, 10 aa, Plasmodium falciparum
SNEKGNNANV

SEQ ID NO: 3344571 - protein, 7 aa, Plasmodium falciparum
SNEKKRN

SEQ ID NO: 3344572 - protein, 13 aa, Plasmodium falciparum
SNEKKSSEKKYDP

SEQ ID NO: 3344573 - protein, 9 aa, Plasmodium falciparum
SNEKKTKNF

SEQ ID NO: 3344574 - protein, 9 aa, Plasmodium falciparum
SNEKNKEKK

SEQ ID NO: 3344575 - protein, 7 aa, Plasmodium falciparum
SNEKNNK

SEQ ID NO: 3344576 - protein, 10 aa, Plasmodium falciparum
SNEKSDNINV

SEQ ID NO: 3344577 - protein, 7 aa, Plasmodium falciparum
SNEKSKI

SEQ ID NO: 3344578 - protein, 34 aa, Plasmodium falciparum
SNEKSTQINISSKKKKKLKKNNKMHKKNKKKLKN

SEQ ID NO: 3344579 - protein, 5 aa, Plasmodium falciparum
SNELK

SEQ ID NO: 3344580 - protein, 5 aa, Plasmodium falciparum
SNELT

SEQ ID NO: 3344581 - protein, 6 aa, Plasmodium falciparum
SNEMKQ

SEQ ID NO: 3344582 - protein, 11 aa, Plasmodium falciparum
SNENGKDHKGV

SEQ ID NO: 3344583 - protein, 6 aa, Plasmodium falciparum
SNENKD

SEQ ID NO: 3344584 - protein, 7 aa, Plasmodium falciparum
SNENKEK

SEQ ID NO: 3344585 - protein, 9 aa, Plasmodium falciparum
SNENNNEQH

SEQ ID NO: 3344586 - protein, 16 aa, Plasmodium falciparum
SNENTLEKIDENDNSL

SEQ ID NO: 3344587 - protein, 43 aa, Plasmodium falciparum
SNENTLPNDHEKSNENALPNDHEKSNENALPNDHEKSNENALP

SEQ ID NO: 3344588 - protein, 6 aa, Plasmodium falciparum
SNENYE

SEQ ID NO: 3344589 - protein, 24 aa, Plasmodium falciparum
SNEPADGTPTKNNNNNNNNNDEDE

SEQ ID NO: 3344590 - protein, 10 aa, Plasmodium falciparum
SNEPAQQTLG

SEQ ID NO: 3344591 - protein, 21 aa, Plasmodium falciparum
SNEPDSRGGIEGCNPKTYGQY

SEQ ID NO: 3344592 - protein, 18 aa, Plasmodium falciparum
SNEPNKKIRNYQEDYNNM

SEQ ID NO: 3344593 - protein, 5 aa, Plasmodium falciparum
SNEPV

SEQ ID NO: 3344594 - protein, 6 aa, Plasmodium falciparum
SNEQEI

SEQ ID NO: 3344595 - protein, 52 aa, Plasmodium falciparum
SNEQQGLNKKGANNYEEVHDGDDDDDYYNNNGNEYNNYEEGYNDDEEERNNY

SEQ ID NO: 3344596 - protein, 8 aa, Plasmodium falciparum
SNEQSSEN

SEQ ID NO: 3344597 - protein, 6 aa, Plasmodium falciparum
SNERLE

SEQ ID NO: 3344598 - protein, 9 aa, Plasmodium falciparum
SNERYSQST

SEQ ID NO: 3344599 - protein, 4 aa, Plasmodium falciparum
SNES

SEQ ID NO: 3344600 - protein, 9 aa, Plasmodium falciparum
SNESENSNI

SEQ ID NO: 3344601 - protein, 17 aa, Plasmodium falciparum
SNESKIESINEQSTSRK

SEQ ID NO: 3344602 - protein, 39 aa, Plasmodium falciparum
SNESYNNNNDDKKNNNDNNDDNKDDNNNDGHNNNNNNNN

SEQ ID NO: 3344603 - protein, 4 aa, Plasmodium falciparum
SNET

SEQ ID NO: 3344604 - protein, 13 aa, Plasmodium falciparum
SNETDSNNINNNF

SEQ ID NO: 3344605 - protein, 28 aa, Plasmodium falciparum
SNETEEKNTQKNDTKNNKHNKNNKNVEN

SEQ ID NO: 3344606 - protein, 7 aa, Plasmodium falciparum
SNETIQN

SEQ ID NO: 3344607 - protein, 12 aa, Plasmodium falciparum
SNETKNKTNIDN

SEQ ID NO: 3344608 - protein, 9 aa, Plasmodium falciparum
SNETTPNEN

SEQ ID NO: 3344609 - protein, 13 aa, Plasmodium falciparum
SNEYDKKDNKDHQ

SEQ ID NO: 3344610 - protein, 5 aa, Plasmodium falciparum
SNEYI

SEQ ID NO: 3344611 - protein, 18 aa, Plasmodium falciparum
SNEYPGENEKDNLDGDSN

SEQ ID NO: 3344612 - protein, 41 aa, Plasmodium falciparum
SNEYSHYSKTKRSESHQNYENVGSKKNSNNNNNNNNTYDSN

SEQ ID NO: 3344613 - protein, 8 aa, Plasmodium falciparum
SNFEPSGS

SEQ ID NO: 3344614 - protein, 8 aa, Plasmodium falciparum
SNFGDKNN

SEQ ID NO: 3344615 - protein, 7 aa, Plasmodium falciparum
SNFGKYS

SEQ ID NO: 3344616 - protein, 29 aa, Plasmodium falciparum
SNGADGNDKEKYNNDKKDNDDKSKKNNSL

SEQ ID NO: 3344617 - protein, 4 aa, Plasmodium falciparum
SNGD

SEQ ID NO: 3344618 - protein, 5 aa, Plasmodium falciparum
SNGDD

SEQ ID NO: 3344619 - protein, 5 aa, Plasmodium falciparum
SNGDI

SEQ ID NO: 3344620 - protein, 63 aa, Plasmodium falciparum
SNGDNNEDNDEDNDVDNDEDNDVDINDDNSDDNNDNNSDDNSDDNSDDNSDDNSDDNNDEGGD

SEQ ID NO: 3344621 - protein, 4 aa, Plasmodium falciparum
SNGG

SEQ ID NO: 3344622 - protein, 11 aa, Plasmodium falciparum
SNGGKRNQNND

SEQ ID NO: 3344623 - protein, 10 aa, Plasmodium falciparum
SNGGYGYDST

SEQ ID NO: 3344624 - protein, 5 aa, Plasmodium falciparum
SNGIS

SEQ ID NO: 3344625 - protein, 13 aa, Plasmodium falciparum
SNGKNGNLENNAS

SEQ ID NO: 3344626 - protein, 7 aa, Plasmodium falciparum
SNGNDSI

SEQ ID NO: 3344627 - protein, 15 aa, Plasmodium falciparum
SNGNNIKQNKNNTNY

SEQ ID NO: 3344628 - protein, 8 aa, Plasmodium falciparum
SNGPLDLP

SEQ ID NO: 3344629 - protein, 17 aa, Plasmodium falciparum
SNGPVNNSVNSNNTNNN

SEQ ID NO: 3344630 - protein, 9 aa, Plasmodium falciparum
SNGSINIPS

SEQ ID NO: 3344631 - protein, 7 aa, Plasmodium falciparum
SNGSYRS

SEQ ID NO: 3344632 - protein, 6 aa, Plasmodium falciparum
SNGVNY

SEQ ID NO: 3344633 - protein, 5 aa, Plasmodium falciparum
SNGYV

SEQ ID NO: 3344634 - protein, 21 aa, Plasmodium falciparum
SNHAKSRSDSSVSYAGVISTV

SEQ ID NO: 3344635 - protein, 29 aa, Plasmodium falciparum
SNHCEESKKSYDNNNNNNNNNNSSSSSSC

SEQ ID NO: 3344636 - protein, 35 aa, Plasmodium falciparum
SNHDSKDNSNNNIKDKDREDNNKNIYNNNNDRSIG

SEQ ID NO: 3344637 - protein, 7 aa, Plasmodium falciparum
SNHEKQQ

SEQ ID NO: 3344638 - protein, 8 aa, Plasmodium falciparum
SNHENDDT

SEQ ID NO: 3344639 - protein, 10 aa, Plasmodium falciparum
SNHENEENIQ

SEQ ID NO: 3344640 - protein, 8 aa, Plasmodium falciparum
SNHHNRSM

SEQ ID NO: 3344641 - protein, 9 aa, Plasmodium falciparum
SNHKNTKIE

SEQ ID NO: 3344642 - protein, 8 aa, Plasmodium falciparum
SNHKPEEM

SEQ ID NO: 3344643 - protein, 6 aa, Plasmodium falciparum
SNHMGG

SEQ ID NO: 3344644 - protein, 4 aa, Plasmodium falciparum
SNHN

SEQ ID NO: 3344645 - protein, 10 aa, Plasmodium falciparum
SNHNGDENHQ

SEQ ID NO: 3344646 - protein, 5 aa, Plasmodium falciparum
SNHNN

SEQ ID NO: 3344647 - protein, 7 aa, Plasmodium falciparum
SNHNNNK

SEQ ID NO: 3344648 - protein, 21 aa, Plasmodium falciparum
SNHNNSDGKEKSSIPSKNGSW

SEQ ID NO: 3344649 - protein, 13 aa, Plasmodium falciparum
SNHNPNHNSNNNN

SEQ ID NO: 3344650 - protein, 5 aa, Plasmodium falciparum
SNHQN

SEQ ID NO: 3344651 - protein, 13 aa, Plasmodium falciparum
SNHVQDKNRHDKN

SEQ ID NO: 3344652 - protein, 5 aa, Plasmodium falciparum
SNIDG

SEQ ID NO: 3344653 - protein, 6 aa, Plasmodium falciparum
SNIDKD

SEQ ID NO: 3344654 - protein, 10 aa, Plasmodium falciparum
SNIDNDEKDM

SEQ ID NO: 3344655 - protein, 23 aa, Plasmodium falciparum
SNIEEKQKKKQQVDENISKKDLE

SEQ ID NO: 3344656 - protein, 6 aa, Plasmodium falciparum
SNIERD

SEQ ID NO: 3344657 - protein, 7 aa, Plasmodium falciparum
SNIERDA

SEQ ID NO: 3344658 - protein, 7 aa, Plasmodium falciparum
SNIETEK

SEQ ID NO: 3344659 - protein, 6 aa, Plasmodium falciparum
SNIGSS

SEQ ID NO: 3344660 - protein, 8 aa, Plasmodium falciparum
SNIGTENK

SEQ ID NO: 3344661 - protein, 9 aa, Plasmodium falciparum
SNIKEDTQT

SEQ ID NO: 3344662 - protein, 38 aa, Plasmodium falciparum
SNIKEKKKVQDKEEAVEEEDDNMTYTTSSVSQNDEGGY

SEQ ID NO: 3344663 - protein, 11 aa, Plasmodium falciparum
SNIKKKGNHMN

SEQ ID NO: 3344664 - protein, 13 aa, Plasmodium falciparum
SNIKKTEKELERQ

SEQ ID NO: 3344665 - protein, 5 aa, Plasmodium falciparum
SNIKN

SEQ ID NO: 3344666 - protein, 9 aa, Plasmodium falciparum
SNIKNKGTI

SEQ ID NO: 3344667 - protein, 7 aa, Plasmodium falciparum
SNIKNKK

SEQ ID NO: 3344668 - protein, 7 aa, Plasmodium falciparum
SNIKNNI

SEQ ID NO: 3344669 - protein, 10 aa, Plasmodium falciparum
SNIKPNDLSP

SEQ ID NO: 3344670 - protein, 4 aa, Plasmodium falciparum
SNIN

SEQ ID NO: 3344671 - protein, 6 aa, Plasmodium falciparum
SNINDE

SEQ ID NO: 3344672 - protein, 69 aa, Plasmodium falciparum
SNINDNETNTSISHNNNINNNNSNNSNNNNNSNNNNNSNNNNNNSNNSNNNSNNNNNNNNNNNNNHYSN

SEQ ID NO: 3344673 - protein, 32 aa, Plasmodium falciparum
SNINDSGVSLGGPKENKSNDKNEHQVKEKRAS

SEQ ID NO: 3344674 - protein, 12 aa, Plasmodium falciparum
SNINHKDSKGMS

SEQ ID NO: 3344675 - protein, 6 aa, Plasmodium falciparum
SNINNI

SEQ ID NO: 3344676 - protein, 6 aa, Plasmodium falciparum
SNINNN

SEQ ID NO: 3344677 - protein, 25 aa, Plasmodium falciparum
SNINNNKSTFGGPPPPLPSTSTTPI

SEQ ID NO: 3344678 - protein, 15 aa, Plasmodium falciparum
SNINNQAEKKKRNMS

SEQ ID NO: 3344679 - protein, 8 aa, Plasmodium falciparum
SNINSGLT

SEQ ID NO: 3344680 - protein, 20 aa, Plasmodium falciparum
SNINSNNNNNNNNNNNNNKM

SEQ ID NO: 3344681 - protein, 8 aa, Plasmodium falciparum
SNINTPSI

SEQ ID NO: 3344682 - protein, 17 aa, Plasmodium falciparum
SNINTSTDQNIDENDKD

SEQ ID NO: 3344683 - protein, 32 aa, Plasmodium falciparum
SNINTYNNGYNNSYNNNSPFNYENNNEKTERN

SEQ ID NO: 3344684 - protein, 4 aa, Plasmodium falciparum
SNIP

SEQ ID NO: 3344685 - protein, 5 aa, Plasmodium falciparum
SNIPN

SEQ ID NO: 3344686 - protein, 5 aa, Plasmodium falciparum
SNIPS

SEQ ID NO: 3344687 - protein, 31 aa, Plasmodium falciparum
SNIPSSFSSPPKETNNKNDIDKEQSDKHNNV

SEQ ID NO: 3344688 - protein, 51 aa, Plasmodium falciparum
SNIPSTNTSTVSNKIQGKGSVSYKSKEKTGDHSSNNKNTKGNNNKVRTSGK

SEQ ID NO: 3344689 - protein, 5 aa, Plasmodium falciparum
SNIQT

SEQ ID NO: 3344690 - protein, 4 aa, Plasmodium falciparum
SNIR

SEQ ID NO: 3344691 - protein, 5 aa, Plasmodium falciparum
SNIRD

SEQ ID NO: 3344692 - protein, 4 aa, Plasmodium falciparum
SNIS

SEQ ID NO: 3344693 - protein, 109 aa, Plasmodium falciparum
SNISARKKKTHGKEKEIKKGDHDVEKEDDDDEEKENDDDEEKENDDDEEKENDDDEEKENDDDEEKENDDDEEKENDDDEEKENDDDEEKENDDDEEKENDDDDEKANY

SEQ ID NO: 3344694 - protein, 83 aa, Plasmodium falciparum
SNISHSANNSNISHSANNSNSEDKTNNCNIEDKTNNCNIEDKTNNCNSEDKTNNCNNEDKTNNCNIEDKTNNCNNLDKEDDIN

SEQ ID NO: 3344695 - protein, 14 aa, Plasmodium falciparum
SNISMTKNTSNGII

SEQ ID NO: 3344696 - protein, 5 aa, Plasmodium falciparum
SNISN

SEQ ID NO: 3344697 - protein, 10 aa, Plasmodium falciparum
SNISNKSNIS

SEQ ID NO: 3344698 - protein, 6 aa, Plasmodium falciparum
SNISTF

SEQ ID NO: 3344699 - protein, 13 aa, Plasmodium falciparum
SNISTSTNNIGTN

SEQ ID NO: 3344700 - protein, 23 aa, Plasmodium falciparum
SNISYDANNSNISYDANNSNISY

SEQ ID NO: 3344701 - protein, 13 aa, Plasmodium falciparum
SNISYGADNSNIS

SEQ ID NO: 3344702 - protein, 7 aa, Plasmodium falciparum
SNITDSQ

SEQ ID NO: 3344703 - protein, 8 aa, Plasmodium falciparum
SNITGTNT

SEQ ID NO: 3344704 - protein, 6 aa, Plasmodium falciparum
SNITNS

SEQ ID NO: 3344705 - protein, 31 aa, Plasmodium falciparum
SNITNTNSSSLHNSCSSSSSGGNNSLYNEND

SEQ ID NO: 3344706 - protein, 15 aa, Plasmodium falciparum
SNITQPYKKKKKNIL

SEQ ID NO: 3344707 - protein, 13 aa, Plasmodium falciparum
SNITRAADNTCAQ

SEQ ID NO: 3344708 - protein, 25 aa, Plasmodium falciparum
SNKATGNHDIPTDVASTNSHKSSNT

SEQ ID NO: 3344709 - protein, 7 aa, Plasmodium falciparum
SNKCDQN

SEQ ID NO: 3344710 - protein, 10 aa, Plasmodium falciparum
SNKDDKDKAP

SEQ ID NO: 3344711 - protein, 71 aa, Plasmodium falciparum
SNKDDKDKAPIFGSPSNKDDKDKAPIFGSPSNKDDKDKTPIFGSPSNKDDKDKTPIFGSPSNKDDKDKTAI

SEQ ID NO: 3344712 - protein, 26 aa, Plasmodium falciparum
SNKDDKDKAPIFGSPSNKDDKDKATI

SEQ ID NO: 3344713 - protein, 16 aa, Plasmodium falciparum
SNKDDSTENSHQCEEK

SEQ ID NO: 3344714 - protein, 7 aa, Plasmodium falciparum
SNKDNLE

SEQ ID NO: 3344715 - protein, 9 aa, Plasmodium falciparum
SNKDPAYGM

SEQ ID NO: 3344716 - protein, 13 aa, Plasmodium falciparum
SNKDSKENDNINE

SEQ ID NO: 3344717 - protein, 7 aa, Plasmodium falciparum
SNKDYKQ

SEQ ID NO: 3344718 - protein, 62 aa, Plasmodium falciparum
SNKDYNNQNNQNIENNQNIENNQNNQNIENNQNIENNQNNQNNQNNQNNQNNQNNQNNQNNA

SEQ ID NO: 3344719 - protein, 5 aa, Plasmodium falciparum
SNKED

SEQ ID NO: 3344720 - protein, 9 aa, Plasmodium falciparum
SNKEDEKND

SEQ ID NO: 3344721 - protein, 17 aa, Plasmodium falciparum
SNKEKEKRKNDKSNNKT

SEQ ID NO: 3344722 - protein, 14 aa, Plasmodium falciparum
SNKEKKSKSLSGTA

SEQ ID NO: 3344723 - protein, 7 aa, Plasmodium falciparum
SNKEKNR

SEQ ID NO: 3344724 - protein, 9 aa, Plasmodium falciparum
SNKEKQAIN

SEQ ID NO: 3344725 - protein, 17 aa, Plasmodium falciparum
SNKENKVITNQKNNGLV

SEQ ID NO: 3344726 - protein, 8 aa, Plasmodium falciparum
SNKERGKT

SEQ ID NO: 3344727 - protein, 6 aa, Plasmodium falciparum
SNKFNN

SEQ ID NO: 3344728 - protein, 17 aa, Plasmodium falciparum
SNKFNRKTNEDIYTRQN

SEQ ID NO: 3344729 - protein, 58 aa, Plasmodium falciparum
SNKGKEKEQDKKVIGKNNKGKDKEKYKNKDREKYKNKEEKNQDKVRSNDNRTSHNNNN

SEQ ID NO: 3344730 - protein, 5 aa, Plasmodium falciparum
SNKGN

SEQ ID NO: 3344731 - protein, 15 aa, Plasmodium falciparum
SNKGTKKKENRNINS

SEQ ID NO: 3344732 - protein, 9 aa, Plasmodium falciparum
SNKHTSNNM

SEQ ID NO: 3344733 - protein, 7 aa, Plasmodium falciparum
SNKIKPN

SEQ ID NO: 3344734 - protein, 12 aa, Plasmodium falciparum
SNKKDKNNLHNS

SEQ ID NO: 3344735 - protein, 10 aa, Plasmodium falciparum
SNKKDQQPQM

SEQ ID NO: 3344736 - protein, 19 aa, Plasmodium falciparum
SNKKEKKSNKKKRTRFNKE

SEQ ID NO: 3344737 - protein, 6 aa, Plasmodium falciparum
SNKKEW

SEQ ID NO: 3344738 - protein, 11 aa, Plasmodium falciparum
SNKKIKSNQKI

SEQ ID NO: 3344739 - protein, 8 aa, Plasmodium falciparum
SNKKISNE

SEQ ID NO: 3344740 - protein, 15 aa, Plasmodium falciparum
SNKKKENRTRDKLKR

SEQ ID NO: 3344741 - protein, 9 aa, Plasmodium falciparum
SNKKNNNKI

SEQ ID NO: 3344742 - protein, 8 aa, Plasmodium falciparum
SNKKRNPH

SEQ ID NO: 3344743 - protein, 10 aa, Plasmodium falciparum
SNKMSENNTH

SEQ ID NO: 3344744 - protein, 4 aa, Plasmodium falciparum
SNKN

SEQ ID NO: 3344745 - protein, 11 aa, Plasmodium falciparum
SNKNDKGPTKT

SEQ ID NO: 3344746 - protein, 7 aa, Plasmodium falciparum
SNKNEDL

SEQ ID NO: 3344747 - protein, 14 aa, Plasmodium falciparum
SNKNEKNASGEKDI

SEQ ID NO: 3344748 - protein, 8 aa, Plasmodium falciparum
SNKNINYN

SEQ ID NO: 3344749 - protein, 5 aa, Plasmodium falciparum
SNKNK

SEQ ID NO: 3344750 - protein, 16 aa, Plasmodium falciparum
SNKNKKNDETKKTAEN

SEQ ID NO: 3344751 - protein, 11 aa, Plasmodium falciparum
SNKNKNNNANT

SEQ ID NO: 3344752 - protein, 9 aa, Plasmodium falciparum
SNKNKNTLQ

SEQ ID NO: 3344753 - protein, 10 aa, Plasmodium falciparum
SNKNKPLDEY

SEQ ID NO: 3344754 - protein, 10 aa, Plasmodium falciparum
SNKNKSLNSA

SEQ ID NO: 3344755 - protein, 12 aa, Plasmodium falciparum
SNKNKSNNNINS

SEQ ID NO: 3344756 - protein, 5 aa, Plasmodium falciparum
SNKNL

SEQ ID NO: 3344757 - protein, 20 aa, Plasmodium falciparum
SNKNNMQTNCSSSNNKNYIN

SEQ ID NO: 3344758 - protein, 19 aa, Plasmodium falciparum
SNKNNNKINCEENEKGTIH

SEQ ID NO: 3344759 - protein, 12 aa, Plasmodium falciparum
SNKNNNNNNNNI

SEQ ID NO: 3344760 - protein, 9 aa, Plasmodium falciparum
SNKNNVKNG

SEQ ID NO: 3344761 - protein, 9 aa, Plasmodium falciparum
SNKNSMNKN

SEQ ID NO: 3344762 - protein, 8 aa, Plasmodium falciparum
SNKNSTKM

SEQ ID NO: 3344763 - protein, 8 aa, Plasmodium falciparum
SNKNTYGY

SEQ ID NO: 3344764 - protein, 32 aa, Plasmodium falciparum
SNKNVPDDLEYDDTNNYHNNNNNNNNNTSFNS

SEQ ID NO: 3344765 - protein, 4 aa, Plasmodium falciparum
SNKP

SEQ ID NO: 3344766 - protein, 35 aa, Plasmodium falciparum
SNKPEGSIMSTDKKNNKLNYNNDTYDVDKSSDINK

SEQ ID NO: 3344767 - protein, 9 aa, Plasmodium falciparum
SNKPNNNNM

SEQ ID NO: 3344768 - protein, 10 aa, Plasmodium falciparum
SNKPSDESQN

SEQ ID NO: 3344769 - protein, 16 aa, Plasmodium falciparum
SNKQESTNKNMKKKTN

SEQ ID NO: 3344770 - protein, 14 aa, Plasmodium falciparum
SNKQNDDVGKDEQI

SEQ ID NO: 3344771 - protein, 13 aa, Plasmodium falciparum
SNKRYDEKTNKRF

SEQ ID NO: 3344772 - protein, 6 aa, Plasmodium falciparum
SNKSKI

SEQ ID NO: 3344773 - protein, 5 aa, Plasmodium falciparum
SNKSN

SEQ ID NO: 3344774 - protein, 10 aa, Plasmodium falciparum
SNKSNDKNSV

SEQ ID NO: 3344775 - protein, 9 aa, Plasmodium falciparum
SNKSNIEGK

SEQ ID NO: 3344776 - protein, 9 aa, Plasmodium falciparum
SNKSQNNNV

SEQ ID NO: 3344777 - protein, 7 aa, Plasmodium falciparum
SNKSRSD

SEQ ID NO: 3344778 - protein, 7 aa, Plasmodium falciparum
SNKSTEC

SEQ ID NO: 3344779 - protein, 10 aa, Plasmodium falciparum
SNKSTIDSPS

SEQ ID NO: 3344780 - protein, 9 aa, Plasmodium falciparum
SNKTDSSDD

SEQ ID NO: 3344781 - protein, 9 aa, Plasmodium falciparum
SNKTGECDM

SEQ ID NO: 3344782 - protein, 5 aa, Plasmodium falciparum
SNKTL

SEQ ID NO: 3344783 - protein, 17 aa, Plasmodium falciparum
SNKTSNKLNPVSYNTRE

SEQ ID NO: 3344784 - protein, 4 aa, Plasmodium falciparum
SNKY

SEQ ID NO: 3344785 - protein, 7 aa, Plasmodium falciparum
SNKYHNR

SEQ ID NO: 3344786 - protein, 5 aa, Plasmodium falciparum
SNKYN

SEQ ID NO: 3344787 - protein, 27 aa, Plasmodium falciparum
SNKYNKEKSNISRCTTDNDKKCSSSIC

SEQ ID NO: 3344788 - protein, 20 aa, Plasmodium falciparum
SNKYQNDEFDENVSHKNDAV

SEQ ID NO: 3344789 - protein, 13 aa, Plasmodium falciparum
SNKYQTEANENHI

SEQ ID NO: 3344790 - protein, 5 aa, Plasmodium falciparum
SNLAS

SEQ ID NO: 3344791 - protein, 9 aa, Plasmodium falciparum
SNLDDSPSD

SEQ ID NO: 3344792 - protein, 6 aa, Plasmodium falciparum
SNLDKG

SEQ ID NO: 3344793 - protein, 37 aa, Plasmodium falciparum
SNLEYRDEERKKNDGTTEDHNEAKENKENKESKENIK

SEQ ID NO: 3344794 - protein, 8 aa, Plasmodium falciparum
SNLGGRNL

SEQ ID NO: 3344795 - protein, 15 aa, Plasmodium falciparum
SNLGPPSSIGSTEIQ

SEQ ID NO: 3344796 - protein, 4 aa, Plasmodium falciparum
SNLK

SEQ ID NO: 3344797 - protein, 14 aa, Plasmodium falciparum
SNLKDGDHSNMKHS

SEQ ID NO: 3344798 - protein, 11 aa, Plasmodium falciparum
SNLNHNKNEDI

SEQ ID NO: 3344799 - protein, 16 aa, Plasmodium falciparum
SNLNNINKNENNKIDS

SEQ ID NO: 3344800 - protein, 10 aa, Plasmodium falciparum
SNLNNNNNNN

SEQ ID NO: 3344801 - protein, 17 aa, Plasmodium falciparum
SNLNNNNNNNNNNTNNT

SEQ ID NO: 3344802 - protein, 16 aa, Plasmodium falciparum
SNLNTQQNEKQSSNHN

SEQ ID NO: 3344803 - protein, 6 aa, Plasmodium falciparum
SNLPNY

SEQ ID NO: 3344804 - protein, 158 aa, Plasmodium falciparum
SNLPPNIPPNLPPNFPPNFPPNLPPNLPPTLPPTLPPTLPPTLPPNLPPTLPPTLPPNLPPTLPPTLPPNLPPNLPPNFPPTLPPNFPPTLPPNFPPTLPPNFPPGFPPNLPPNFPPTLPPNIPPGFPPNIPPNLPPNIPSYSENNLNTKGENKENTS

SEQ ID NO: 3344805 - protein, 7 aa, Plasmodium falciparum
SNLSTNN

SEQ ID NO: 3344806 - protein, 13 aa, Plasmodium falciparum
SNLTHSKNTNYNN

SEQ ID NO: 3344807 - protein, 7 aa, Plasmodium falciparum
SNLTKDY

SEQ ID NO: 3344808 - protein, 5 aa, Plasmodium falciparum
SNMEE

SEQ ID NO: 3344809 - protein, 11 aa, Plasmodium falciparum
SNMEHNKTQTL

SEQ ID NO: 3344810 - protein, 4 aa, Plasmodium falciparum
SNMG

SEQ ID NO: 3344811 - protein, 6 aa, Plasmodium falciparum
SNMKST

SEQ ID NO: 3344812 - protein, 5 aa, Plasmodium falciparum
SNMNG

SEQ ID NO: 3344813 - protein, 25 aa, Plasmodium falciparum
SNMNNINNNDSNMNNINNNDSNMNS

SEQ ID NO: 3344814 - protein, 11 aa, Plasmodium falciparum
SNMNNKNNMNN

SEQ ID NO: 3344815 - protein, 17 aa, Plasmodium falciparum
SNMNNKSYKKSSSYPNK

SEQ ID NO: 3344816 - protein, 6 aa, Plasmodium falciparum
SNMPAR

SEQ ID NO: 3344817 - protein, 8 aa, Plasmodium falciparum
SNMSNNYS

SEQ ID NO: 3344818 - protein, 4 aa, Plasmodium falciparum
SNNA

SEQ ID NO: 3344819 - protein, 8 aa, Plasmodium falciparum
SNNADEIT

SEQ ID NO: 3344820 - protein, 5 aa, Plasmodium falciparum
SNNCN

SEQ ID NO: 3344821 - protein, 11 aa, Plasmodium falciparum
SNNDDKNDHDI

SEQ ID NO: 3344822 - protein, 8 aa, Plasmodium falciparum
SNNDDNGV

SEQ ID NO: 3344823 - protein, 5 aa, Plasmodium falciparum
SNNDE

SEQ ID NO: 3344824 - protein, 74 aa, Plasmodium falciparum
SNNDEKIDLNSESTYKSDDSISSGSISNDSISNGSISNDSISNGSISNDSISSGSVSNDSISKGSASKDSSSFD

SEQ ID NO: 3344825 - protein, 10 aa, Plasmodium falciparum
SNNDENKIKK

SEQ ID NO: 3344826 - protein, 17 aa, Plasmodium falciparum
SNNDENNIQDKSNNTSI

SEQ ID NO: 3344827 - protein, 7 aa, Plasmodium falciparum
SNNDESL

SEQ ID NO: 3344828 - protein, 18 aa, Plasmodium falciparum
SNNDGNNNSNNSNSNNNV

SEQ ID NO: 3344829 - protein, 9 aa, Plasmodium falciparum
SNNDKNNNQ

SEQ ID NO: 3344830 - protein, 8 aa, Plasmodium falciparum
SNNDNDKM

SEQ ID NO: 3344831 - protein, 11 aa, Plasmodium falciparum
SNNDNNNNNNY

SEQ ID NO: 3344832 - protein, 18 aa, Plasmodium falciparum
SNNDNVLDPSYKNEIGNN

SEQ ID NO: 3344833 - protein, 6 aa, Plasmodium falciparum
SNNDQN

SEQ ID NO: 3344834 - protein, 9 aa, Plasmodium falciparum
SNNDSKDEL

SEQ ID NO: 3344835 - protein, 7 aa, Plasmodium falciparum
SNNDSNI

SEQ ID NO: 3344836 - protein, 6 aa, Plasmodium falciparum
SNNDVL

SEQ ID NO: 3344837 - protein, 6 aa, Plasmodium falciparum
SNNEDS

SEQ ID NO: 3344838 - protein, 22 aa, Plasmodium falciparum
SNNEETSCHKENGDTQENEDNN

SEQ ID NO: 3344839 - protein, 10 aa, Plasmodium falciparum
SNNEKKQKVN

SEQ ID NO: 3344840 - protein, 6 aa, Plasmodium falciparum
SNNEKP

SEQ ID NO: 3344841 - protein, 5 aa, Plasmodium falciparum
SNNEL

SEQ ID NO: 3344842 - protein, 14 aa, Plasmodium falciparum
SNNEMNKKNNDSDN

SEQ ID NO: 3344843 - protein, 9 aa, Plasmodium falciparum
SNNENDDVE

SEQ ID NO: 3344844 - protein, 15 aa, Plasmodium falciparum
SNNENNNDNTTQTTS

SEQ ID NO: 3344845 - protein, 27 aa, Plasmodium falciparum
SNNEVEEKENDKKEENVAHDKSQQNKK

SEQ ID NO: 3344846 - protein, 10 aa, Plasmodium falciparum
SNNHDDTKKH

SEQ ID NO: 3344847 - protein, 7 aa, Plasmodium falciparum
SNNHTNR

SEQ ID NO: 3344848 - protein, 4 aa, Plasmodium falciparum
SNNI

SEQ ID NO: 3344849 - protein, 9 aa, Plasmodium falciparum
SNNIENSGN

SEQ ID NO: 3344850 - protein, 5 aa, Plasmodium falciparum
SNNIF

SEQ ID NO: 3344851 - protein, 17 aa, Plasmodium falciparum
SNNIKRETLNNEVDNKK

SEQ ID NO: 3344852 - protein, 8 aa, Plasmodium falciparum
SNNIKRND

SEQ ID NO: 3344853 - protein, 15 aa, Plasmodium falciparum
SNNILGKNKNSENNN

SEQ ID NO: 3344854 - protein, 6 aa, Plasmodium falciparum
SNNIND

SEQ ID NO: 3344855 - protein, 11 aa, Plasmodium falciparum
SNNINDSNNKE

SEQ ID NO: 3344856 - protein, 10 aa, Plasmodium falciparum
SNNINNNTHF

SEQ ID NO: 3344857 - protein, 11 aa, Plasmodium falciparum
SNNINNNVNNN

SEQ ID NO: 3344858 - protein, 7 aa, Plasmodium falciparum
SNNINSG

SEQ ID NO: 3344859 - protein, 10 aa, Plasmodium falciparum
SNNIPNNSNS

SEQ ID NO: 3344860 - protein, 24 aa, Plasmodium falciparum
SNNIRKHSKNISKYADNRKKSDNK

SEQ ID NO: 3344861 - protein, 9 aa, Plasmodium falciparum
SNNISTSAS

SEQ ID NO: 3344862 - protein, 12 aa, Plasmodium falciparum
SNNISVSKGTSR

SEQ ID NO: 3344863 - protein, 22 aa, Plasmodium falciparum
SNNKDNNNKDNNNNNYNNKTNK

SEQ ID NO: 3344864 - protein, 10 aa, Plasmodium falciparum
SNNKIAQADS

SEQ ID NO: 3344865 - protein, 7 aa, Plasmodium falciparum
SNNKIKS

SEQ ID NO: 3344866 - protein, 7 aa, Plasmodium falciparum
SNNKKEQ

SEQ ID NO: 3344867 - protein, 8 aa, Plasmodium falciparum
SNNKKERV

SEQ ID NO: 3344868 - protein, 20 aa, Plasmodium falciparum
SNNKKIDEQENKMNNNNNKM

SEQ ID NO: 3344869 - protein, 7 aa, Plasmodium falciparum
SNNKKTY

SEQ ID NO: 3344870 - protein, 13 aa, Plasmodium falciparum
SNNKNIPNNSVNN

SEQ ID NO: 3344871 - protein, 6 aa, Plasmodium falciparum
SNNKNK

SEQ ID NO: 3344872 - protein, 8 aa, Plasmodium falciparum
SNNKNNCV

SEQ ID NO: 3344873 - protein, 27 aa, Plasmodium falciparum
SNNKNTTYNTNNEHNTNQYHQDNENHH

SEQ ID NO: 3344874 - protein, 11 aa, Plasmodium falciparum
SNNKSVSASDR

SEQ ID NO: 3344875 - protein, 10 aa, Plasmodium falciparum
SNNKTTSPLF

SEQ ID NO: 3344876 - protein, 8 aa, Plasmodium falciparum
SNNKVSDD

SEQ ID NO: 3344877 - protein, 14 aa, Plasmodium falciparum
SNNKYNSMNAYTGD

SEQ ID NO: 3344878 - protein, 4 aa, Plasmodium falciparum
SNNL

SEQ ID NO: 3344879 - protein, 5 aa, Plasmodium falciparum
SNNLN

SEQ ID NO: 3344880 - protein, 32 aa, Plasmodium falciparum
SNNLNNSNNHYKEINNKSDSIYNRKRHSGSDI

SEQ ID NO: 3344881 - protein, 17 aa, Plasmodium falciparum
SNNLNRKNENDNIPSSY

SEQ ID NO: 3344882 - protein, 9 aa, Plasmodium falciparum
SNNLNTSNG

SEQ ID NO: 3344883 - protein, 49 aa, Plasmodium falciparum
SNNLQSKNGSPDNKNNKNKSNDEHNTYEKNNNNDEKKKDVFNNNEEEHM

SEQ ID NO: 3344884 - protein, 20 aa, Plasmodium falciparum
SNNMRKGGDNNNDDSNNITI

SEQ ID NO: 3344885 - protein, 5 aa, Plasmodium falciparum
SNNNA

SEQ ID NO: 3344886 - protein, 6 aa, Plasmodium falciparum
SNNNDF

SEQ ID NO: 3344887 - protein, 16 aa, Plasmodium falciparum
SNNNDHSDDRNKNNCE

SEQ ID NO: 3344888 - protein, 18 aa, Plasmodium falciparum
SNNNDNNEMTTTSATTVT

SEQ ID NO: 3344889 - protein, 6 aa, Plasmodium falciparum
SNNNDT

SEQ ID NO: 3344890 - protein, 13 aa, Plasmodium falciparum
SNNNDYSNKNYNS

SEQ ID NO: 3344891 - protein, 11 aa, Plasmodium falciparum
SNNNEDETRDF

SEQ ID NO: 3344892 - protein, 20 aa, Plasmodium falciparum
SNNNEPKEEEHVKNKEYSDD

SEQ ID NO: 3344893 - protein, 7 aa, Plasmodium falciparum
SNNNEPQ

SEQ ID NO: 3344894 - protein, 12 aa, Plasmodium falciparum
SNNNGKNEYKSK

SEQ ID NO: 3344895 - protein, 11 aa, Plasmodium falciparum
SNNNHKTNHDN

SEQ ID NO: 3344896 - protein, 19 aa, Plasmodium falciparum
SNNNHNNNNNNNNNNNGVS

SEQ ID NO: 3344897 - protein, 18 aa, Plasmodium falciparum
SNNNHNSCNDIPCNNNVK

SEQ ID NO: 3344898 - protein, 18 aa, Plasmodium falciparum
SNNNITSIRNKKENESME

SEQ ID NO: 3344899 - protein, 25 aa, Plasmodium falciparum
SNNNKQPISSNQHPYQQKQSHHHNN

SEQ ID NO: 3344900 - protein, 11 aa, Plasmodium falciparum
SNNNKSEYNEK

SEQ ID NO: 3344901 - protein, 7 aa, Plasmodium falciparum
SNNNKSV

SEQ ID NO: 3344902 - protein, 7 aa, Plasmodium falciparum
SNNNKSY

SEQ ID NO: 3344903 - protein, 5 aa, Plasmodium falciparum
SNNNL

SEQ ID NO: 3344904 - protein, 12 aa, Plasmodium falciparum
SNNNLKGVTRES

SEQ ID NO: 3344905 - protein, 14 aa, Plasmodium falciparum
SNNNNDNNNNNNYY

SEQ ID NO: 3344906 - protein, 41 aa, Plasmodium falciparum
SNNNNEREDNKNHSRQEDDKGRQQTKGKEKCKEKDKYKDKE

SEQ ID NO: 3344907 - protein, 10 aa, Plasmodium falciparum
SNNNNNKDNI

SEQ ID NO: 3344908 - protein, 18 aa, Plasmodium falciparum
SNNNNNKINRGKINDKIE

SEQ ID NO: 3344909 - protein, 13 aa, Plasmodium falciparum
SNNNNNNKNKNNI

SEQ ID NO: 3344910 - protein, 9 aa, Plasmodium falciparum
SNNNNNNMN

SEQ ID NO: 3344911 - protein, 8 aa, Plasmodium falciparum
SNNNNNNN

SEQ ID NO: 3344912 - protein, 12 aa, Plasmodium falciparum
SNNNNNNNAADI

SEQ ID NO: 3344913 - protein, 12 aa, Plasmodium falciparum
SNNNNNNNDNNF

SEQ ID NO: 3344914 - protein, 23 aa, Plasmodium falciparum
SNNNNNNNNKMDHSRNGSGSDDF

SEQ ID NO: 3344915 - protein, 10 aa, Plasmodium falciparum
SNNNNNNNNN

SEQ ID NO: 3344916 - protein, 30 aa, Plasmodium falciparum
SNNNNNNNNNNNNNNNNNNNKCNDQDNNYN

SEQ ID NO: 3344917 - protein, 53 aa, Plasmodium falciparum
SNNNNNNNNNNNNNNNNNNNNNNNNNNNNNNNNNNNNNNSSSGNNNTNKPGND

SEQ ID NO: 3344918 - protein, 14 aa, Plasmodium falciparum
SNNNNNNNNNNSNM

SEQ ID NO: 3344919 - protein, 17 aa, Plasmodium falciparum
SNNNNNNNNNNTYSRKE

SEQ ID NO: 3344920 - protein, 17 aa, Plasmodium falciparum
SNNNNNNNNNSDVKKDW

SEQ ID NO: 3344921 - protein, 11 aa, Plasmodium falciparum
SNNNNNNNNSD

SEQ ID NO: 3344922 - protein, 25 aa, Plasmodium falciparum
SNNNNNNNSSSNNNSNSNNNNNNNV

SEQ ID NO: 3344923 - protein, 48 aa, Plasmodium falciparum
SNNNNNRDNNGDNNSSNNNSSNNNSSNNNSSNNNSSNNNSSNNNSNME

SEQ ID NO: 3344924 - protein, 12 aa, Plasmodium falciparum
SNNNNNRNELHN

SEQ ID NO: 3344925 - protein, 46 aa, Plasmodium falciparum
SNNNNSDGNNINSKNSDTNHNITNNKSSNNNTTNHNTTNHSITNKN

SEQ ID NO: 3344926 - protein, 7 aa, Plasmodium falciparum
SNNNPDG

SEQ ID NO: 3344927 - protein, 7 aa, Plasmodium falciparum
SNNNSND

SEQ ID NO: 3344928 - protein, 7 aa, Plasmodium falciparum
SNNNSNM

SEQ ID NO: 3344929 - protein, 6 aa, Plasmodium falciparum
SNNNSQ

SEQ ID NO: 3344930 - protein, 7 aa, Plasmodium falciparum
SNNNSYA

SEQ ID NO: 3344931 - protein, 35 aa, Plasmodium falciparum
SNNNTDINKATAKENDDEKKKLLNDDKTKEANNLS

SEQ ID NO: 3344932 - protein, 7 aa, Plasmodium falciparum
SNNNTLN

SEQ ID NO: 3344933 - protein, 9 aa, Plasmodium falciparum
SNNNTNVGN

SEQ ID NO: 3344934 - protein, 14 aa, Plasmodium falciparum
SNNNYDSSSRNVSS

SEQ ID NO: 3344935 - protein, 6 aa, Plasmodium falciparum
SNNNYN

SEQ ID NO: 3344936 - protein, 7 aa, Plasmodium falciparum
SNNNYNN

SEQ ID NO: 3344937 - protein, 17 aa, Plasmodium falciparum
SNNNYPNQLNNTEPYNN

SEQ ID NO: 3344938 - protein, 5 aa, Plasmodium falciparum
SNNPE

SEQ ID NO: 3344939 - protein, 7 aa, Plasmodium falciparum
SNNPEAY

SEQ ID NO: 3344940 - protein, 18 aa, Plasmodium falciparum
SNNPNAFNTGYREENSEA

SEQ ID NO: 3344941 - protein, 6 aa, Plasmodium falciparum
SNNPPH

SEQ ID NO: 3344942 - protein, 8 aa, Plasmodium falciparum
SNNPPNYN

SEQ ID NO: 3344943 - protein, 7 aa, Plasmodium falciparum
SNNPSNF

SEQ ID NO: 3344944 - protein, 10 aa, Plasmodium falciparum
SNNPTTANKG

SEQ ID NO: 3344945 - protein, 8 aa, Plasmodium falciparum
SNNPYDNN

SEQ ID NO: 3344946 - protein, 10 aa, Plasmodium falciparum
SNNPYGIQNN

SEQ ID NO: 3344947 - protein, 6 aa, Plasmodium falciparum
SNNPYN

SEQ ID NO: 3344948 - protein, 4 aa, Plasmodium falciparum
SNNQ

SEQ ID NO: 3344949 - protein, 5 aa, Plasmodium falciparum
SNNQR

SEQ ID NO: 3344950 - protein, 9 aa, Plasmodium falciparum
SNNREKLNG

SEQ ID NO: 3344951 - protein, 11 aa, Plasmodium falciparum
SNNRNKNSSTV

SEQ ID NO: 3344952 - protein, 9 aa, Plasmodium falciparum
SNNRPWRRP

SEQ ID NO: 3344953 - protein, 7 aa, Plasmodium falciparum
SNNSKHS

SEQ ID NO: 3344954 - protein, 10 aa, Plasmodium falciparum
SNNSKNKRNN

SEQ ID NO: 3344955 - protein, 12 aa, Plasmodium falciparum
SNNSLSKRGSSN

SEQ ID NO: 3344956 - protein, 12 aa, Plasmodium falciparum
SNNSNDHNNNSN

SEQ ID NO: 3344957 - protein, 9 aa, Plasmodium falciparum
SNNSRCNNF

SEQ ID NO: 3344958 - protein, 11 aa, Plasmodium falciparum
SNNSSESKKQE

SEQ ID NO: 3344959 - protein, 10 aa, Plasmodium falciparum
SNNTDKEINK

SEQ ID NO: 3344960 - protein, 8 aa, Plasmodium falciparum
SNNTDNSF

SEQ ID NO: 3344961 - protein, 26 aa, Plasmodium falciparum
SNNTEKEKYDSDDSHKYTSSNNLSEK

SEQ ID NO: 3344962 - protein, 18 aa, Plasmodium falciparum
SNNTGDVNTIGKKDSYKK

SEQ ID NO: 3344963 - protein, 34 aa, Plasmodium falciparum
SNNTGTTQNNNKYGTNSNNNNNNNNNNNNNNNNN

SEQ ID NO: 3344964 - protein, 6 aa, Plasmodium falciparum
SNNTHE

SEQ ID NO: 3344965 - protein, 17 aa, Plasmodium falciparum
SNNTHVNNDDDNIENSR

SEQ ID NO: 3344966 - protein, 9 aa, Plasmodium falciparum
SNNTLKAGG

SEQ ID NO: 3344967 - protein, 25 aa, Plasmodium falciparum
SNNTNEKDYDYNESDNASYSTDDSK

SEQ ID NO: 3344968 - protein, 13 aa, Plasmodium falciparum
SNNTNEQKDNTQL

SEQ ID NO: 3344969 - protein, 10 aa, Plasmodium falciparum
SNNTNNNIQT

SEQ ID NO: 3344970 - protein, 7 aa, Plasmodium falciparum
SNNTSNH

SEQ ID NO: 3344971 - protein, 14 aa, Plasmodium falciparum
SNNTYGNNNNDVNR

SEQ ID NO: 3344972 - protein, 11 aa, Plasmodium falciparum
SNNTYSNNTYS

SEQ ID NO: 3344973 - protein, 14 aa, Plasmodium falciparum
SNNTYSYTSPYPPN

SEQ ID NO: 3344974 - protein, 4 aa, Plasmodium falciparum
SNNV

SEQ ID NO: 3344975 - protein, 41 aa, Plasmodium falciparum
SNNVDNNDDANSIDSNDDSNNMDNSNDTHNVNNKDDTNNKY

SEQ ID NO: 3344976 - protein, 21 aa, Plasmodium falciparum
SNNVEDDKYTNQGKTKTDISY

SEQ ID NO: 3344977 - protein, 4 aa, Plasmodium falciparum
SNNY

SEQ ID NO: 3344978 - protein, 9 aa, Plasmodium falciparum
SNNYDEEEN

SEQ ID NO: 3344979 - protein, 6 aa, Plasmodium falciparum
SNNYKN

SEQ ID NO: 3344980 - protein, 7 aa, Plasmodium falciparum
SNNYKNA

SEQ ID NO: 3344981 - protein, 5 aa, Plasmodium falciparum
SNNYN

SEQ ID NO: 3344982 - protein, 9 aa, Plasmodium falciparum
SNNYSTNLN

SEQ ID NO: 3344983 - protein, 7 aa, Plasmodium falciparum
SNNYTKK

SEQ ID NO: 3344984 - protein, 5 aa, Plasmodium falciparum
SNPDS

SEQ ID NO: 3344985 - protein, 23 aa, Plasmodium falciparum
SNPFNKEEPCGEKKNSPQVNDSK

SEQ ID NO: 3344986 - protein, 14 aa, Plasmodium falciparum
SNPGYPSIYIYNTE

SEQ ID NO: 3344987 - protein, 15 aa, Plasmodium falciparum
SNPHDNDNDNPYSHN

SEQ ID NO: 3344988 - protein, 9 aa, Plasmodium falciparum
SNPKEGKYN

SEQ ID NO: 3344989 - protein, 20 aa, Plasmodium falciparum
SNPLNNDNNNNNNNNNGNNN

SEQ ID NO: 3344990 - protein, 6 aa, Plasmodium falciparum
SNPNEE

SEQ ID NO: 3344991 - protein, 7 aa, Plasmodium falciparum
SNPNNQK

SEQ ID NO: 3344992 - protein, 5 aa, Plasmodium falciparum
SNPNS

SEQ ID NO: 3344993 - protein, 5 aa, Plasmodium falciparum
SNPNV

SEQ ID NO: 3344994 - protein, 10 aa, Plasmodium falciparum
SNPPPRSRGI

SEQ ID NO: 3344995 - protein, 6 aa, Plasmodium falciparum
SNPPYK

SEQ ID NO: 3344996 - protein, 33 aa, Plasmodium falciparum
SNPSCPKPAKCEDDNNKMNKDCRKKSYEEEQTY

SEQ ID NO: 3344997 - protein, 7 aa, Plasmodium falciparum
SNPSEKR

SEQ ID NO: 3344998 - protein, 4 aa, Plasmodium falciparum
SNPT

SEQ ID NO: 3344999 - protein, 5 aa, Plasmodium falciparum
SNPTY

SEQ ID NO: 3345000 - protein, 4 aa, Plasmodium falciparum
SNPY

SEQ ID NO: 3345001 - protein, 12 aa, Plasmodium falciparum
SNPYEKSGNKNN

SEQ ID NO: 3345002 - protein, 6 aa, Plasmodium falciparum
SNPYKN

SEQ ID NO: 3345003 - protein, 13 aa, Plasmodium falciparum
SNQEDNQNKKDDI

SEQ ID NO: 3345004 - protein, 5 aa, Plasmodium falciparum
SNQEI

SEQ ID NO: 3345005 - protein, 9 aa, Plasmodium falciparum
SNQEKKSDI

SEQ ID NO: 3345006 - protein, 5 aa, Plasmodium falciparum
SNQEL

SEQ ID NO: 3345007 - protein, 8 aa, Plasmodium falciparum
SNQENYSS

SEQ ID NO: 3345008 - protein, 4 aa, Plasmodium falciparum
SNQG

SEQ ID NO: 3345009 - protein, 7 aa, Plasmodium falciparum
SNQIESF

SEQ ID NO: 3345010 - protein, 4 aa, Plasmodium falciparum
SNQK

SEQ ID NO: 3345011 - protein, 10 aa, Plasmodium falciparum
SNQKYRDLGE

SEQ ID NO: 3345012 - protein, 18 aa, Plasmodium falciparum
SNQLKTNDNHNNSNVNTP

SEQ ID NO: 3345013 - protein, 9 aa, Plasmodium falciparum
SNQNTVKDV

SEQ ID NO: 3345014 - protein, 15 aa, Plasmodium falciparum
SNQSISDSDENDYQQ

SEQ ID NO: 3345015 - protein, 7 aa, Plasmodium falciparum
SNQSQNT

SEQ ID NO: 3345016 - protein, 8 aa, Plasmodium falciparum
SNQTDEYN

SEQ ID NO: 3345017 - protein, 11 aa, Plasmodium falciparum
SNQTHQKLTKS

SEQ ID NO: 3345018 - protein, 6 aa, Plasmodium falciparum
SNQTSQ

SEQ ID NO: 3345019 - protein, 4 aa, Plasmodium falciparum
SNRA

SEQ ID NO: 3345020 - protein, 19 aa, Plasmodium falciparum
SNRDPFESKGPCYGKDGNK

SEQ ID NO: 3345021 - protein, 8 aa, Plasmodium falciparum
SNREESNK

SEQ ID NO: 3345022 - protein, 5 aa, Plasmodium falciparum
SNREM

SEQ ID NO: 3345023 - protein, 30 aa, Plasmodium falciparum
SNRKKKKHKIKRTSEYSRRNINDPRNLRQS

SEQ ID NO: 3345024 - protein, 12 aa, Plasmodium falciparum
SNRKNEKKRDHQ

SEQ ID NO: 3345025 - protein, 6 aa, Plasmodium falciparum
SNRKNY

SEQ ID NO: 3345026 - protein, 5 aa, Plasmodium falciparum
SNRKY

SEQ ID NO: 3345027 - protein, 7 aa, Plasmodium falciparum
SNRNGDI

SEQ ID NO: 3345028 - protein, 17 aa, Plasmodium falciparum
SNRNNELERISSDTKLS

SEQ ID NO: 3345029 - protein, 8 aa, Plasmodium falciparum
SNRNNTIA

SEQ ID NO: 3345030 - protein, 9 aa, Plasmodium falciparum
SNRNSNEAR

SEQ ID NO: 3345031 - protein, 6 aa, Plasmodium falciparum
SNRPAP

SEQ ID NO: 3345032 - protein, 10 aa, Plasmodium falciparum
SNRPNQKEHI

SEQ ID NO: 3345033 - protein, 10 aa, Plasmodium falciparum
SNRSGKNMKN

SEQ ID NO: 3345034 - protein, 10 aa, Plasmodium falciparum
SNRSPRRNVS

SEQ ID NO: 3345035 - protein, 10 aa, Plasmodium falciparum
SNRSTSNKHI

SEQ ID NO: 3345036 - protein, 15 aa, Plasmodium falciparum
SNRSTSYSKQKNELT

SEQ ID NO: 3345037 - protein, 10 aa, Plasmodium falciparum
SNRTNQNEKG

SEQ ID NO: 3345038 - protein, 17 aa, Plasmodium falciparum
SNSAKKKEKNKINGKSI

SEQ ID NO: 3345039 - protein, 7 aa, Plasmodium falciparum
SNSANLE

SEQ ID NO: 3345040 - protein, 11 aa, Plasmodium falciparum
SNSCDNNTTSL

SEQ ID NO: 3345041 - protein, 24 aa, Plasmodium falciparum
SNSDEEESGDISVTTDDENYPNLE

SEQ ID NO: 3345042 - protein, 25 aa, Plasmodium falciparum
SNSDFSNERKYKNAEKYKSVKSNNA

SEQ ID NO: 3345043 - protein, 7 aa, Plasmodium falciparum
SNSDGKV

SEQ ID NO: 3345044 - protein, 6 aa, Plasmodium falciparum
SNSDSY

SEQ ID NO: 3345045 - protein, 9 aa, Plasmodium falciparum
SNSDVKEDD

SEQ ID NO: 3345046 - protein, 8 aa, Plasmodium falciparum
SNSECVQG

SEQ ID NO: 3345047 - protein, 9 aa, Plasmodium falciparum
SNSEDKTLN

SEQ ID NO: 3345048 - protein, 6 aa, Plasmodium falciparum
SNSEHD

SEQ ID NO: 3345049 - protein, 6 aa, Plasmodium falciparum
SNSEIK

SEQ ID NO: 3345050 - protein, 18 aa, Plasmodium falciparum
SNSEKANSSNSQNNEKKE

SEQ ID NO: 3345051 - protein, 7 aa, Plasmodium falciparum
SNSEQIE

SEQ ID NO: 3345052 - protein, 10 aa, Plasmodium falciparum
SNSESSQENI

SEQ ID NO: 3345053 - protein, 4 aa, Plasmodium falciparum
SNSG

SEQ ID NO: 3345054 - protein, 18 aa, Plasmodium falciparum
SNSGCSDDDTKDDEDTHK

SEQ ID NO: 3345055 - protein, 4 aa, Plasmodium falciparum
SNSI

SEQ ID NO: 3345056 - protein, 6 aa, Plasmodium falciparum
SNSIGG

SEQ ID NO: 3345057 - protein, 10 aa, Plasmodium falciparum
SNSINTGDIY

SEQ ID NO: 3345058 - protein, 4 aa, Plasmodium falciparum
SNSK

SEQ ID NO: 3345059 - protein, 13 aa, Plasmodium falciparum
SNSKSEDGDDENL

SEQ ID NO: 3345060 - protein, 7 aa, Plasmodium falciparum
SNSKYPW

SEQ ID NO: 3345061 - protein, 15 aa, Plasmodium falciparum
SNSLTDNKENTERSN

SEQ ID NO: 3345062 - protein, 14 aa, Plasmodium falciparum
SNSMDTKKEIEENL

SEQ ID NO: 3345063 - protein, 15 aa, Plasmodium falciparum
SNSMESINNKKGTRI

SEQ ID NO: 3345064 - protein, 4 aa, Plasmodium falciparum
SNSN

SEQ ID NO: 3345065 - protein, 8 aa, Plasmodium falciparum
SNSNEQYL

SEQ ID NO: 3345066 - protein, 12 aa, Plasmodium falciparum
SNSNETETTTMT

SEQ ID NO: 3345067 - protein, 13 aa, Plasmodium falciparum
SNSNLKKNDKEQI

SEQ ID NO: 3345068 - protein, 17 aa, Plasmodium falciparum
SNSNNNNNINSNNNSRE

SEQ ID NO: 3345069 - protein, 20 aa, Plasmodium falciparum
SNSNNNNNNNNNNNNNNNND

SEQ ID NO: 3345070 - protein, 9 aa, Plasmodium falciparum
SNSNNSHKN

SEQ ID NO: 3345071 - protein, 47 aa, Plasmodium falciparum
SNSNSESKYYSDDEKKDEKQKKEKDKTEHRKHHNDKKKKKNKKIENA

SEQ ID NO: 3345072 - protein, 13 aa, Plasmodium falciparum
SNSNSSSYNNEKK

SEQ ID NO: 3345073 - protein, 9 aa, Plasmodium falciparum
SNSNYEKEN

SEQ ID NO: 3345074 - protein, 8 aa, Plasmodium falciparum
SNSPKTLS

SEQ ID NO: 3345075 - protein, 8 aa, Plasmodium falciparum
SNSPRNNR

SEQ ID NO: 3345076 - protein, 43 aa, Plasmodium falciparum
SNSPSLKDTNIKSNNNKNMKNTNHNNEENNNNNNTNNTLSNKE

SEQ ID NO: 3345077 - protein, 9 aa, Plasmodium falciparum
SNSQNEKKI

SEQ ID NO: 3345078 - protein, 11 aa, Plasmodium falciparum
SNSRDKDDTYK

SEQ ID NO: 3345079 - protein, 8 aa, Plasmodium falciparum
SNSRGNKF

SEQ ID NO: 3345080 - protein, 18 aa, Plasmodium falciparum
SNSRNIKDITTSSKNIST

SEQ ID NO: 3345081 - protein, 15 aa, Plasmodium falciparum
SNSRNKSRISSSDSY

SEQ ID NO: 3345082 - protein, 4 aa, Plasmodium falciparum
SNSS

SEQ ID NO: 3345083 - protein, 9 aa, Plasmodium falciparum
SNSSDKNDS

SEQ ID NO: 3345084 - protein, 11 aa, Plasmodium falciparum
SNSSENKLNQF

SEQ ID NO: 3345085 - protein, 48 aa, Plasmodium falciparum
SNSSGTNNMNAQKGEGEDEKAKDKEMSNNRKNEENERKRCDNVSNSNY

SEQ ID NO: 3345086 - protein, 6 aa, Plasmodium falciparum
SNSSKF

SEQ ID NO: 3345087 - protein, 8 aa, Plasmodium falciparum
SNSSKQIK

SEQ ID NO: 3345088 - protein, 29 aa, Plasmodium falciparum
SNSSLNNNRNNNSNNNNNSSNSHNNSSNN

SEQ ID NO: 3345089 - protein, 15 aa, Plasmodium falciparum
SNSSNGVRYGANNND

SEQ ID NO: 3345090 - protein, 10 aa, Plasmodium falciparum
SNSSNKSNIK

SEQ ID NO: 3345091 - protein, 9 aa, Plasmodium falciparum
SNSSNPSKM

SEQ ID NO: 3345092 - protein, 13 aa, Plasmodium falciparum
SNSSSSENSSDIL

SEQ ID NO: 3345093 - protein, 13 aa, Plasmodium falciparum
SNSSSSGKKKYNI

SEQ ID NO: 3345094 - protein, 17 aa, Plasmodium falciparum
SNSSTEKNKNSSKKNDA

SEQ ID NO: 3345095 - protein, 36 aa, Plasmodium falciparum
SNSSTTSSSISSDEVDDISSNNDTEKYDDNYNSTGR

SEQ ID NO: 3345096 - protein, 8 aa, Plasmodium falciparum
SNSSYNVN

SEQ ID NO: 3345097 - protein, 7 aa, Plasmodium falciparum
SNSTNIS

SEQ ID NO: 3345098 - protein, 12 aa, Plasmodium falciparum
SNSVDTKNMENS

SEQ ID NO: 3345099 - protein, 5 aa, Plasmodium falciparum
SNSVH

SEQ ID NO: 3345100 - protein, 12 aa, Plasmodium falciparum
SNSVNNKAKLNR

SEQ ID NO: 3345101 - protein, 8 aa, Plasmodium falciparum
SNSVPSNN

SEQ ID NO: 3345102 - protein, 9 aa, Plasmodium falciparum
SNSYETSDV

SEQ ID NO: 3345103 - protein, 24 aa, Plasmodium falciparum
SNSYRTNKTVSQDMNNSIDDNTKP

SEQ ID NO: 3345104 - protein, 30 aa, Plasmodium falciparum
SNSYSESNRSYETDLKKERKAKKHVGSKRN

SEQ ID NO: 3345105 - protein, 4 aa, Plasmodium falciparum
SNTD

SEQ ID NO: 3345106 - protein, 17 aa, Plasmodium falciparum
SNTELKKKGSSQNIKGN

SEQ ID NO: 3345107 - protein, 8 aa, Plasmodium falciparum
SNTENINN

SEQ ID NO: 3345108 - protein, 9 aa, Plasmodium falciparum
SNTIGDSSN

SEQ ID NO: 3345109 - protein, 9 aa, Plasmodium falciparum
SNTINDKNM

SEQ ID NO: 3345110 - protein, 6 aa, Plasmodium falciparum
SNTINN

SEQ ID NO: 3345111 - protein, 7 aa, Plasmodium falciparum
SNTISND

SEQ ID NO: 3345112 - protein, 4 aa, Plasmodium falciparum
SNTK

SEQ ID NO: 3345113 - protein, 23 aa, Plasmodium falciparum
SNTKGDDQTCKNTNEYSDTSSNH

SEQ ID NO: 3345114 - protein, 8 aa, Plasmodium falciparum
SNTKNNVN

SEQ ID NO: 3345115 - protein, 6 aa, Plasmodium falciparum
SNTKSC

SEQ ID NO: 3345116 - protein, 18 aa, Plasmodium falciparum
SNTKYTKNNEKEKNNYNI

SEQ ID NO: 3345117 - protein, 6 aa, Plasmodium falciparum
SNTLDR

SEQ ID NO: 3345118 - protein, 5 aa, Plasmodium falciparum
SNTLS

SEQ ID NO: 3345119 - protein, 5 aa, Plasmodium falciparum
SNTMS

SEQ ID NO: 3345120 - protein, 15 aa, Plasmodium falciparum
SNTMSSSNNNNSVNS

SEQ ID NO: 3345121 - protein, 22 aa, Plasmodium falciparum
SNTNHSVNNSTYQSCNNKYNKN

SEQ ID NO: 3345122 - protein, 6 aa, Plasmodium falciparum
SNTNIN

SEQ ID NO: 3345123 - protein, 6 aa, Plasmodium falciparum
SNTNNM

SEQ ID NO: 3345124 - protein, 17 aa, Plasmodium falciparum
SNTNNNSIDTYNENNNN

SEQ ID NO: 3345125 - protein, 8 aa, Plasmodium falciparum
SNTNNTPS

SEQ ID NO: 3345126 - protein, 10 aa, Plasmodium falciparum
SNTNNTTSQQ

SEQ ID NO: 3345127 - protein, 9 aa, Plasmodium falciparum
SNTNTTASG

SEQ ID NO: 3345128 - protein, 13 aa, Plasmodium falciparum
SNTNVDSDVDEQR

SEQ ID NO: 3345129 - protein, 5 aa, Plasmodium falciparum
SNTNY

SEQ ID NO: 3345130 - protein, 30 aa, Plasmodium falciparum
SNTPNSTYDKNNGTNDHKNNPNKDSNDQKS

SEQ ID NO: 3345131 - protein, 9 aa, Plasmodium falciparum
SNTPSNDRM

SEQ ID NO: 3345132 - protein, 11 aa, Plasmodium falciparum
SNTQLKKEQDN

SEQ ID NO: 3345133 - protein, 8 aa, Plasmodium falciparum
SNTRKENI

SEQ ID NO: 3345134 - protein, 5 aa, Plasmodium falciparum
SNTRN

SEQ ID NO: 3345135 - protein, 19 aa, Plasmodium falciparum
SNTSGSITNKGSKILFSIK

SEQ ID NO: 3345136 - protein, 7 aa, Plasmodium falciparum
SNTSKMN

SEQ ID NO: 3345137 - protein, 8 aa, Plasmodium falciparum
SNTSNNIN

SEQ ID NO: 3345138 - protein, 39 aa, Plasmodium falciparum
SNTSNNNNNNNMNSSSNSSTGNDNGYKLNNKKGNSEYNY

SEQ ID NO: 3345139 - protein, 21 aa, Plasmodium falciparum
SNTSSDNDNNNNNNDNHSNEE

SEQ ID NO: 3345140 - protein, 34 aa, Plasmodium falciparum
SNTSSTRRKKNDSSCNESTNNTGNNKENGSNNTH

SEQ ID NO: 3345141 - protein, 4 aa, Plasmodium falciparum
SNTT

SEQ ID NO: 3345142 - protein, 6 aa, Plasmodium falciparum
SNTTGM

SEQ ID NO: 3345143 - protein, 5 aa, Plasmodium falciparum
SNTTK

SEQ ID NO: 3345144 - protein, 17 aa, Plasmodium falciparum
SNTTNDDNTKGTNTYDN

SEQ ID NO: 3345145 - protein, 8 aa, Plasmodium falciparum
SNTTNYNE

SEQ ID NO: 3345146 - protein, 5 aa, Plasmodium falciparum
SNTTP

SEQ ID NO: 3345147 - protein, 32 aa, Plasmodium falciparum
SNTTTNNEDDNYFDKDNNKINSKESYPRGDKN

SEQ ID NO: 3345148 - protein, 12 aa, Plasmodium falciparum
SNTVNDTTQIKN

SEQ ID NO: 3345149 - protein, 13 aa, Plasmodium falciparum
SNTYKEDKNNNHD

SEQ ID NO: 3345150 - protein, 9 aa, Plasmodium falciparum
SNTYKNNKY

SEQ ID NO: 3345151 - protein, 4 aa, Plasmodium falciparum
SNVC

SEQ ID NO: 3345152 - protein, 20 aa, Plasmodium falciparum
SNVDNGNQSKNISDLSYTDQ

SEQ ID NO: 3345153 - protein, 9 aa, Plasmodium falciparum
SNVDNQQLN

SEQ ID NO: 3345154 - protein, 27 aa, Plasmodium falciparum
SNVENKTDANLENNQNGPFSNNNISTS

SEQ ID NO: 3345155 - protein, 6 aa, Plasmodium falciparum
SNVENN

SEQ ID NO: 3345156 - protein, 5 aa, Plasmodium falciparum
SNVGN

SEQ ID NO: 3345157 - protein, 11 aa, Plasmodium falciparum
SNVHDNNNNNN

SEQ ID NO: 3345158 - protein, 6 aa, Plasmodium falciparum
SNVKEE

SEQ ID NO: 3345159 - protein, 5 aa, Plasmodium falciparum
SNVKH

SEQ ID NO: 3345160 - protein, 10 aa, Plasmodium falciparum
SNVKHQKDEE

SEQ ID NO: 3345161 - protein, 17 aa, Plasmodium falciparum
SNVKKKKKKKNEQEKNV

SEQ ID NO: 3345162 - protein, 4 aa, Plasmodium falciparum
SNVL

SEQ ID NO: 3345163 - protein, 6 aa, Plasmodium falciparum
SNVLPE

SEQ ID NO: 3345164 - protein, 6 aa, Plasmodium falciparum
SNVNEE

SEQ ID NO: 3345165 - protein, 10 aa, Plasmodium falciparum
SNVNEKAGDR

SEQ ID NO: 3345166 - protein, 7 aa, Plasmodium falciparum
SNVNHND

SEQ ID NO: 3345167 - protein, 14 aa, Plasmodium falciparum
SNVNKSNKDTSKDV

SEQ ID NO: 3345168 - protein, 7 aa, Plasmodium falciparum
SNVSSSI

SEQ ID NO: 3345169 - protein, 5 aa, Plasmodium falciparum
SNVTD

SEQ ID NO: 3345170 - protein, 15 aa, Plasmodium falciparum
SNVTLKEDNNVTSGD

SEQ ID NO: 3345171 - protein, 13 aa, Plasmodium falciparum
SNVTTNSSDGITS

SEQ ID NO: 3345172 - protein, 10 aa, Plasmodium falciparum
SNYDDSQPLY

SEQ ID NO: 3345173 - protein, 12 aa, Plasmodium falciparum
SNYDNNYDNNYD

SEQ ID NO: 3345174 - protein, 5 aa, Plasmodium falciparum
SNYGD

SEQ ID NO: 3345175 - protein, 6 aa, Plasmodium falciparum
SNYGYR

SEQ ID NO: 3345176 - protein, 4 aa, Plasmodium falciparum
SNYI

SEQ ID NO: 3345177 - protein, 12 aa, Plasmodium falciparum
SNYIKEKEKEKL

SEQ ID NO: 3345178 - protein, 7 aa, Plasmodium falciparum
SNYKGNM

SEQ ID NO: 3345179 - protein, 5 aa, Plasmodium falciparum
SNYLD

SEQ ID NO: 3345180 - protein, 8 aa, Plasmodium falciparum
SNYNKNDE

SEQ ID NO: 3345181 - protein, 9 aa, Plasmodium falciparum
SNYNNGPNL

SEQ ID NO: 3345182 - protein, 7 aa, Plasmodium falciparum
SNYNNNY

SEQ ID NO: 3345183 - protein, 9 aa, Plasmodium falciparum
SNYNNPDDV

SEQ ID NO: 3345184 - protein, 10 aa, Plasmodium falciparum
SNYNSSENMN

SEQ ID NO: 3345185 - protein, 161 aa, Plasmodium falciparum
SNYNYDNNNGYSNESSDNYNNGYNDSTDNNNGYNSNSSYNSNNNEDDNNNNNNNDENCDNNNNHNNNNYNNNNNYGNNNNNNNNNKDNNNNDGNGSSNNNNNDDDDEEEEDDEDDNNNNNDDDNMSDNEEMEDNDEDNDEYNNSNDSYKYEEKDSNHEKDL

SEQ ID NO: 3345186 - protein, 7 aa, Plasmodium falciparum
SNYPPKM

SEQ ID NO: 3345187 - protein, 9 aa, Plasmodium falciparum
SNYQDKADD

SEQ ID NO: 3345188 - protein, 27 aa, Plasmodium falciparum
SNYRKNKEEEENNNFTSEKQLSEKRNA

SEQ ID NO: 3345189 - protein, 6 aa, Plasmodium falciparum
SNYSDE

SEQ ID NO: 3345190 - protein, 36 aa, Plasmodium falciparum
SNYSDKNSDAPKKYDNEEKPSNTLSENNSKVEKKSL

SEQ ID NO: 3345191 - protein, 10 aa, Plasmodium falciparum
SNYSNDKNNK

SEQ ID NO: 3345192 - protein, 6 aa, Plasmodium falciparum
SNYSSS

SEQ ID NO: 3345193 - protein, 10 aa, Plasmodium falciparum
SNYSTDTLSS

SEQ ID NO: 3345194 - protein, 6 aa, Plasmodium falciparum
SNYTHS

SEQ ID NO: 3345195 - protein, 9 aa, Plasmodium falciparum
SNYVTEDNK

SEQ ID NO: 3345196 - protein, 6 aa, Plasmodium falciparum
SPANTQ

SEQ ID NO: 3345197 - protein, 13 aa, Plasmodium falciparum
SPAPPPPPPPPPL

SEQ ID NO: 3345198 - protein, 14 aa, Plasmodium falciparum
SPAQQQKKNAQDTK

SEQ ID NO: 3345199 - protein, 11 aa, Plasmodium falciparum
SPASNNDMSKA

SEQ ID NO: 3345200 - protein, 5 aa, Plasmodium falciparum
SPAYQ

SEQ ID NO: 3345201 - protein, 8 aa, Plasmodium falciparum
SPDDKFSS

SEQ ID NO: 3345202 - protein, 15 aa, Plasmodium falciparum
SPDEEKKNSLQSLSN

SEQ ID NO: 3345203 - protein, 15 aa, Plasmodium falciparum
SPDGTSIATGSPDQT

SEQ ID NO: 3345204 - protein, 17 aa, Plasmodium falciparum
SPDHNSKKVHEKSNRDQ

SEQ ID NO: 3345205 - protein, 31 aa, Plasmodium falciparum
SPDKNKNINKKNNNNNNKKNKSRSHSKNTEM

SEQ ID NO: 3345206 - protein, 4 aa, Plasmodium falciparum
SPDN

SEQ ID NO: 3345207 - protein, 5 aa, Plasmodium falciparum
SPDNR

SEQ ID NO: 3345208 - protein, 11 aa, Plasmodium falciparum
SPDSLSQNTIT

SEQ ID NO: 3345209 - protein, 7 aa, Plasmodium falciparum
SPDSVEG

SEQ ID NO: 3345210 - protein, 14 aa, Plasmodium falciparum
SPEAYAAHAKKYYK

SEQ ID NO: 3345211 - protein, 4 aa, Plasmodium falciparum
SPEE

SEQ ID NO: 3345212 - protein, 7 aa, Plasmodium falciparum
SPEEANE

SEQ ID NO: 3345213 - protein, 6 aa, Plasmodium falciparum
SPEETR

SEQ ID NO: 3345214 - protein, 5 aa, Plasmodium falciparum
SPEKQ

SEQ ID NO: 3345215 - protein, 4 aa, Plasmodium falciparum
SPEL

SEQ ID NO: 3345216 - protein, 9 aa, Plasmodium falciparum
SPENFDPTN

SEQ ID NO: 3345217 - protein, 6 aa, Plasmodium falciparum
SPENQK

SEQ ID NO: 3345218 - protein, 6 aa, Plasmodium falciparum
SPENTK

SEQ ID NO: 3345219 - protein, 4 aa, Plasmodium falciparum
SPEQ

SEQ ID NO: 3345220 - protein, 4 aa, Plasmodium falciparum
SPER

SEQ ID NO: 3345221 - protein, 9 aa, Plasmodium falciparum
SPESKSESI

SEQ ID NO: 3345222 - protein, 5 aa, Plasmodium falciparum
SPEVT

SEQ ID NO: 3345223 - protein, 4 aa, Plasmodium falciparum
SPFE

SEQ ID NO: 3345224 - protein, 4 aa, Plasmodium falciparum
SPFH

SEQ ID NO: 3345225 - protein, 8 aa, Plasmodium falciparum
SPFNAQNK

SEQ ID NO: 3345226 - protein, 44 aa, Plasmodium falciparum
SPFNEQQKKKKDMNNKNKKAKKYHDFEGDEENYNTSERDENSMY

SEQ ID NO: 3345227 - protein, 6 aa, Plasmodium falciparum
SPFRGR

SEQ ID NO: 3345228 - protein, 11 aa, Plasmodium falciparum
SPFSENPIENE

SEQ ID NO: 3345229 - protein, 4 aa, Plasmodium falciparum
SPFY

SEQ ID NO: 3345230 - protein, 7 aa, Plasmodium falciparum
SPGETKK

SEQ ID NO: 3345231 - protein, 8 aa, Plasmodium falciparum
SPGGDKNI

SEQ ID NO: 3345232 - protein, 6 aa, Plasmodium falciparum
SPGGKS

SEQ ID NO: 3345233 - protein, 5 aa, Plasmodium falciparum
SPGLT

SEQ ID NO: 3345234 - protein, 18 aa, Plasmodium falciparum
SPGNNYDKDINTDENNKN

SEQ ID NO: 3345235 - protein, 6 aa, Plasmodium falciparum
SPGNVN

SEQ ID NO: 3345236 - protein, 5 aa, Plasmodium falciparum
SPGPI

SEQ ID NO: 3345237 - protein, 5 aa, Plasmodium falciparum
SPGRT

SEQ ID NO: 3345238 - protein, 8 aa, Plasmodium falciparum
SPGTGKTS

SEQ ID NO: 3345239 - protein, 4 aa, Plasmodium falciparum
SPGV

SEQ ID NO: 3345240 - protein, 4 aa, Plasmodium falciparum
SPGY

SEQ ID NO: 3345241 - protein, 4 aa, Plasmodium falciparum
SPHC

SEQ ID NO: 3345242 - protein, 11 aa, Plasmodium falciparum
SPHEQQTFTTK

SEQ ID NO: 3345243 - protein, 5 aa, Plasmodium falciparum
SPHIN

SEQ ID NO: 3345244 - protein, 6 aa, Plasmodium falciparum
SPHKPN

SEQ ID NO: 3345245 - protein, 7 aa, Plasmodium falciparum
SPHNNNN

SEQ ID NO: 3345246 - protein, 4 aa, Plasmodium falciparum
SPHV

SEQ ID NO: 3345247 - protein, 6 aa, Plasmodium falciparum
SPIDGR

SEQ ID NO: 3345248 - protein, 5 aa, Plasmodium falciparum
SPIDL

SEQ ID NO: 3345249 - protein, 4 aa, Plasmodium falciparum
SPIE

SEQ ID NO: 3345250 - protein, 23 aa, Plasmodium falciparum
SPIGTNKNVDSESTLKNNNNNNN

SEQ ID NO: 3345251 - protein, 10 aa, Plasmodium falciparum
SPIQNKTQEL

SEQ ID NO: 3345252 - protein, 4 aa, Plasmodium falciparum
SPIR

SEQ ID NO: 3345253 - protein, 4 aa, Plasmodium falciparum
SPIT

SEQ ID NO: 3345254 - protein, 9 aa, Plasmodium falciparum
SPITRKSKN

SEQ ID NO: 3345255 - protein, 7 aa, Plasmodium falciparum
SPKAQKK

SEQ ID NO: 3345256 - protein, 12 aa, Plasmodium falciparum
SPKCYNNSPVNA

SEQ ID NO: 3345257 - protein, 7 aa, Plasmodium falciparum
SPKDPEN

SEQ ID NO: 3345258 - protein, 6 aa, Plasmodium falciparum
SPKEIN

SEQ ID NO: 3345259 - protein, 4 aa, Plasmodium falciparum
SPKF

SEQ ID NO: 3345260 - protein, 15 aa, Plasmodium falciparum
SPKGGYKNNKGSGIY

SEQ ID NO: 3345261 - protein, 8 aa, Plasmodium falciparum
SPKINTTK

SEQ ID NO: 3345262 - protein, 9 aa, Plasmodium falciparum
SPKKKKKKN

SEQ ID NO: 3345263 - protein, 10 aa, Plasmodium falciparum
SPKKSRKESP

SEQ ID NO: 3345264 - protein, 19 aa, Plasmodium falciparum
SPKKTKKNNSYKKSVNNSN

SEQ ID NO: 3345265 - protein, 6 aa, Plasmodium falciparum
SPKNIK

SEQ ID NO: 3345266 - protein, 7 aa, Plasmodium falciparum
SPKPEQI

SEQ ID NO: 3345267 - protein, 29 aa, Plasmodium falciparum
SPKSSNTRNKKTKKDTYGKYSNNKETKYE

SEQ ID NO: 3345268 - protein, 11 aa, Plasmodium falciparum
SPKSTKRSYSP

SEQ ID NO: 3345269 - protein, 6 aa, Plasmodium falciparum
SPKVSD

SEQ ID NO: 3345270 - protein, 25 aa, Plasmodium falciparum
SPLGNNNIKKKKDNKKNNDNENKEI

SEQ ID NO: 3345271 - protein, 4 aa, Plasmodium falciparum
SPLK

SEQ ID NO: 3345272 - protein, 39 aa, Plasmodium falciparum
SPLKATSDNKNQNESVQNGNVQNENVQNENDNKKEEENS

SEQ ID NO: 3345273 - protein, 6 aa, Plasmodium falciparum
SPLRGK

SEQ ID NO: 3345274 - protein, 4 aa, Plasmodium falciparum
SPLS

SEQ ID NO: 3345275 - protein, 5 aa, Plasmodium falciparum
SPLSS

SEQ ID NO: 3345276 - protein, 4 aa, Plasmodium falciparum
SPMS

SEQ ID NO: 3345277 - protein, 48 aa, Plasmodium falciparum
SPNDDTKVKKKKKKKDSDLDGYPKDQKNYTNCDDGDKINSDDNGINKE

SEQ ID NO: 3345278 - protein, 6 aa, Plasmodium falciparum
SPNDMR

SEQ ID NO: 3345279 - protein, 8 aa, Plasmodium falciparum
SPNGLRSE

SEQ ID NO: 3345280 - protein, 5 aa, Plasmodium falciparum
SPNGS

SEQ ID NO: 3345281 - protein, 6 aa, Plasmodium falciparum
SPNGTI

SEQ ID NO: 3345282 - protein, 7 aa, Plasmodium falciparum
SPNGVSD

SEQ ID NO: 3345283 - protein, 9 aa, Plasmodium falciparum
SPNKDKNCN

SEQ ID NO: 3345284 - protein, 22 aa, Plasmodium falciparum
SPNLQNDDPNITIENKEEKNIN

SEQ ID NO: 3345285 - protein, 15 aa, Plasmodium falciparum
SPNLSHTRGSRKRSD

SEQ ID NO: 3345286 - protein, 5 aa, Plasmodium falciparum
SPNNN

SEQ ID NO: 3345287 - protein, 11 aa, Plasmodium falciparum
SPNNSYFPNTQ

SEQ ID NO: 3345288 - protein, 4 aa, Plasmodium falciparum
SPNS

SEQ ID NO: 3345289 - protein, 9 aa, Plasmodium falciparum
SPNSCNKNN

SEQ ID NO: 3345290 - protein, 12 aa, Plasmodium falciparum
SPNTTMEKDSRT

SEQ ID NO: 3345291 - protein, 18 aa, Plasmodium falciparum
SPNYKEEEEEENDDRETA

SEQ ID NO: 3345292 - protein, 5 aa, Plasmodium falciparum
SPPGK

SEQ ID NO: 3345293 - protein, 7 aa, Plasmodium falciparum
SPPHSRR

SEQ ID NO: 3345294 - protein, 13 aa, Plasmodium falciparum
SPPINSKEEIKQG

SEQ ID NO: 3345295 - protein, 4 aa, Plasmodium falciparum
SPPP

SEQ ID NO: 3345296 - protein, 8 aa, Plasmodium falciparum
SPPTSPND

SEQ ID NO: 3345297 - protein, 4 aa, Plasmodium falciparum
SPQC

SEQ ID NO: 3345298 - protein, 7 aa, Plasmodium falciparum
SPQGNKP

SEQ ID NO: 3345299 - protein, 4 aa, Plasmodium falciparum
SPQN

SEQ ID NO: 3345300 - protein, 12 aa, Plasmodium falciparum
SPQNNNNNNTKK

SEQ ID NO: 3345301 - protein, 12 aa, Plasmodium falciparum
SPQNSDTTNYMG

SEQ ID NO: 3345302 - protein, 7 aa, Plasmodium falciparum
SPQREKY

SEQ ID NO: 3345303 - protein, 5 aa, Plasmodium falciparum
SPQVS

SEQ ID NO: 3345304 - protein, 4 aa, Plasmodium falciparum
SPRD

SEQ ID NO: 3345305 - protein, 4 aa, Plasmodium falciparum
SPRE

SEQ ID NO: 3345306 - protein, 5 aa, Plasmodium falciparum
SPREF

SEQ ID NO: 3345307 - protein, 8 aa, Plasmodium falciparum
SPRKMSSG

SEQ ID NO: 3345308 - protein, 8 aa, Plasmodium falciparum
SPRSSVSK

SEQ ID NO: 3345309 - protein, 4 aa, Plasmodium falciparum
SPRY

SEQ ID NO: 3345310 - protein, 41 aa, Plasmodium falciparum
SPSDFPQDDDKCAQRDSRKEGQSKKRRGVKKEQGEEERSKA

SEQ ID NO: 3345311 - protein, 11 aa, Plasmodium falciparum
SPSDLKSNNSI

SEQ ID NO: 3345312 - protein, 17 aa, Plasmodium falciparum
SPSDSLNGDAENENENE

SEQ ID NO: 3345313 - protein, 16 aa, Plasmodium falciparum
SPSFNSTTKGNKHSSF

SEQ ID NO: 3345314 - protein, 5 aa, Plasmodium falciparum
SPSFS

SEQ ID NO: 3345315 - protein, 4 aa, Plasmodium falciparum
SPSG

SEQ ID NO: 3345316 - protein, 4 aa, Plasmodium falciparum
SPSH

SEQ ID NO: 3345317 - protein, 4 aa, Plasmodium falciparum
SPSI

SEQ ID NO: 3345318 - protein, 5 aa, Plasmodium falciparum
SPSIE

SEQ ID NO: 3345319 - protein, 8 aa, Plasmodium falciparum
SPSKSKYR

SEQ ID NO: 3345320 - protein, 4 aa, Plasmodium falciparum
SPSP

SEQ ID NO: 3345321 - protein, 6 aa, Plasmodium falciparum
SPSPNQ

SEQ ID NO: 3345322 - protein, 22 aa, Plasmodium falciparum
SPSPQYDNDEKNIYNNTNERTI

SEQ ID NO: 3345323 - protein, 6 aa, Plasmodium falciparum
SPSQSS

SEQ ID NO: 3345324 - protein, 5 aa, Plasmodium falciparum
SPSSL

SEQ ID NO: 3345325 - protein, 13 aa, Plasmodium falciparum
SPSSYKKKNQLQN

SEQ ID NO: 3345326 - protein, 7 aa, Plasmodium falciparum
SPTAPID

SEQ ID NO: 3345327 - protein, 6 aa, Plasmodium falciparum
SPTAYT

SEQ ID NO: 3345328 - protein, 13 aa, Plasmodium falciparum
SPTHTEIDKEEKQ

SEQ ID NO: 3345329 - protein, 16 aa, Plasmodium falciparum
SPTNAGDRSKMSSPAL

SEQ ID NO: 3345330 - protein, 15 aa, Plasmodium falciparum
SPTNNNSTKQLSANT

SEQ ID NO: 3345331 - protein, 6 aa, Plasmodium falciparum
SPTNYT

SEQ ID NO: 3345332 - protein, 5 aa, Plasmodium falciparum
SPTPI

SEQ ID NO: 3345333 - protein, 7 aa, Plasmodium falciparum
SPTSPDT

SEQ ID NO: 3345334 - protein, 13 aa, Plasmodium falciparum
SPTVVEKSNDKEK

SEQ ID NO: 3345335 - protein, 5 aa, Plasmodium falciparum
SPVDY

SEQ ID NO: 3345336 - protein, 5 aa, Plasmodium falciparum
SPVGR

SEQ ID NO: 3345337 - protein, 5 aa, Plasmodium falciparum
SPVKR

SEQ ID NO: 3345338 - protein, 12 aa, Plasmodium falciparum
SPVNDISPTNDP

SEQ ID NO: 3345339 - protein, 6 aa, Plasmodium falciparum
SPVNDS

SEQ ID NO: 3345340 - protein, 6 aa, Plasmodium falciparum
SPVNPS

SEQ ID NO: 3345341 - protein, 4 aa, Plasmodium falciparum
SPYD

SEQ ID NO: 3345342 - protein, 20 aa, Plasmodium falciparum
SPYDTKKNDLINSEENIDQL

SEQ ID NO: 3345343 - protein, 10 aa, Plasmodium falciparum
SPYKNDNGEK

SEQ ID NO: 3345344 - protein, 25 aa, Plasmodium falciparum
SPYNNENIKTKEDYIKDKQKSNNYF

SEQ ID NO: 3345345 - protein, 15 aa, Plasmodium falciparum
SPYNNKNTDDENNCS

SEQ ID NO: 3345346 - protein, 8 aa, Plasmodium falciparum
SPYNPAPS

SEQ ID NO: 3345347 - protein, 4 aa, Plasmodium falciparum
SPYS

SEQ ID NO: 3345348 - protein, 17 aa, Plasmodium falciparum
SQANANQRSGRAGRTGA

SEQ ID NO: 3345349 - protein, 10 aa, Plasmodium falciparum
SQASNTPGRT

SEQ ID NO: 3345350 - protein, 4 aa, Plasmodium falciparum
SQAV

SEQ ID NO: 3345351 - protein, 7 aa, Plasmodium falciparum
SQDAGTH

SEQ ID NO: 3345352 - protein, 4 aa, Plasmodium falciparum
SQDD

SEQ ID NO: 3345353 - protein, 17 aa, Plasmodium falciparum
SQDEDNYNKSSFDKNDL

SEQ ID NO: 3345354 - protein, 10 aa, Plasmodium falciparum
SQDKEQNNNY

SEQ ID NO: 3345355 - protein, 16 aa, Plasmodium falciparum
SQDKKNWHRTDSYEEE

SEQ ID NO: 3345356 - protein, 8 aa, Plasmodium falciparum
SQDLSNSS

SEQ ID NO: 3345357 - protein, 4 aa, Plasmodium falciparum
SQDN

SEQ ID NO: 3345358 - protein, 6 aa, Plasmodium falciparum
SQDNIK

SEQ ID NO: 3345359 - protein, 21 aa, Plasmodium falciparum
SQDNQNGNTTNNNNNNNNNNV

SEQ ID NO: 3345360 - protein, 7 aa, Plasmodium falciparum
SQDSDVY

SEQ ID NO: 3345361 - protein, 18 aa, Plasmodium falciparum
SQDSERDINNYEQSEDTH

SEQ ID NO: 3345362 - protein, 19 aa, Plasmodium falciparum
SQDSYENHTYDKSNNSIDL

SEQ ID NO: 3345363 - protein, 6 aa, Plasmodium falciparum
SQDTDQ

SEQ ID NO: 3345364 - protein, 5 aa, Plasmodium falciparum
SQDYT

SEQ ID NO: 3345365 - protein, 5 aa, Plasmodium falciparum
SQEDT

SEQ ID NO: 3345366 - protein, 24 aa, Plasmodium falciparum
SQEEDDKQASTVNISSDDNDDEYN

SEQ ID NO: 3345367 - protein, 11 aa, Plasmodium falciparum
SQEEDTNKNGL

SEQ ID NO: 3345368 - protein, 16 aa, Plasmodium falciparum
SQEEKKKKNHLASQQY

SEQ ID NO: 3345369 - protein, 5 aa, Plasmodium falciparum
SQEIE

SEQ ID NO: 3345370 - protein, 20 aa, Plasmodium falciparum
SQEKEDTDNSSCSNSAESLQ

SEQ ID NO: 3345371 - protein, 8 aa, Plasmodium falciparum
SQEKTNNV

SEQ ID NO: 3345372 - protein, 4 aa, Plasmodium falciparum
SQEN

SEQ ID NO: 3345373 - protein, 12 aa, Plasmodium falciparum
SQENDEGKNSLS

SEQ ID NO: 3345374 - protein, 7 aa, Plasmodium falciparum
SQENNDE

SEQ ID NO: 3345375 - protein, 19 aa, Plasmodium falciparum
SQENNRSEEDGLEKEKDDI

SEQ ID NO: 3345376 - protein, 6 aa, Plasmodium falciparum
SQEPDE

SEQ ID NO: 3345377 - protein, 8 aa, Plasmodium falciparum
SQESGFSP

SEQ ID NO: 3345378 - protein, 184 aa, Plasmodium falciparum
SQESSRKNSMKYKEEDDEEEEEDDDDEEDDDDDDEEDEEEEGEDEEDEDEEKEDQEKEEDQENQNENQDENQDENQDENQDENQDENQDENQDENRDENQDESQNENQNENQDDNENEEKPNEGSNENEEKPNDGSIENNEEADKEAKDSDENNNSSSNNNGEENIENTNECKQKKKKQEDNEV

SEQ ID NO: 3345379 - protein, 14 aa, Plasmodium falciparum
SQESVKKKADDVSS

SEQ ID NO: 3345380 - protein, 9 aa, Plasmodium falciparum
SQETNTKHT

SEQ ID NO: 3345381 - protein, 6 aa, Plasmodium falciparum
SQEYDK

SEQ ID NO: 3345382 - protein, 7 aa, Plasmodium falciparum
SQFDERD

SEQ ID NO: 3345383 - protein, 11 aa, Plasmodium falciparum
SQGDHRNGKSN

SEQ ID NO: 3345384 - protein, 4 aa, Plasmodium falciparum
SQGK

SEQ ID NO: 3345385 - protein, 122 aa, Plasmodium falciparum
SQGNLKEKVEEKKDDDKKEKKDDNSDNNKKTKEDEEEKKDKVEKDEKKKEDEKENVKKDVKEDDEEKDKDDKTKDDDTSKDEKEKEVEQKEDVKEKEEKEKEKDDKRSDDKKSDEEENIKRE

SEQ ID NO: 3345386 - protein, 9 aa, Plasmodium falciparum
SQHNGKDTR

SEQ ID NO: 3345387 - protein, 13 aa, Plasmodium falciparum
SQHNQKKKTYFSN

SEQ ID NO: 3345388 - protein, 4 aa, Plasmodium falciparum
SQHT

SEQ ID NO: 3345389 - protein, 6 aa, Plasmodium falciparum
SQIEEE

SEQ ID NO: 3345390 - protein, 8 aa, Plasmodium falciparum
SQIENQKG

SEQ ID NO: 3345391 - protein, 7 aa, Plasmodium falciparum
SQKDQKG

SEQ ID NO: 3345392 - protein, 5 aa, Plasmodium falciparum
SQKEE

SEQ ID NO: 3345393 - protein, 4 aa, Plasmodium falciparum
SQKI

SEQ ID NO: 3345394 - protein, 6 aa, Plasmodium falciparum
SQKIKE

SEQ ID NO: 3345395 - protein, 25 aa, Plasmodium falciparum
SQKITSTSSKENIELSSEQKVNREN

SEQ ID NO: 3345396 - protein, 6 aa, Plasmodium falciparum
SQKKEL

SEQ ID NO: 3345397 - protein, 9 aa, Plasmodium falciparum
SQKKISERN

SEQ ID NO: 3345398 - protein, 12 aa, Plasmodium falciparum
SQKKKENKKEEN

SEQ ID NO: 3345399 - protein, 8 aa, Plasmodium falciparum
SQKKSDNV

SEQ ID NO: 3345400 - protein, 7 aa, Plasmodium falciparum
SQKLGGS

SEQ ID NO: 3345401 - protein, 4 aa, Plasmodium falciparum
SQKN

SEQ ID NO: 3345402 - protein, 9 aa, Plasmodium falciparum
SQKNIDSNN

SEQ ID NO: 3345403 - protein, 5 aa, Plasmodium falciparum
SQKNK

SEQ ID NO: 3345404 - protein, 8 aa, Plasmodium falciparum
SQKNNDNI

SEQ ID NO: 3345405 - protein, 10 aa, Plasmodium falciparum
SQKNNNNTNM

SEQ ID NO: 3345406 - protein, 9 aa, Plasmodium falciparum
SQKNNNSIF

SEQ ID NO: 3345407 - protein, 8 aa, Plasmodium falciparum
SQKNYKNT

SEQ ID NO: 3345408 - protein, 19 aa, Plasmodium falciparum
SQKPANEDSDDDSWSKEDK

SEQ ID NO: 3345409 - protein, 6 aa, Plasmodium falciparum
SQKPYY

SEQ ID NO: 3345410 - protein, 32 aa, Plasmodium falciparum
SQKSKSKNLGSKKGKSNSKIRSVSRKSERKIN

SEQ ID NO: 3345411 - protein, 8 aa, Plasmodium falciparum
SQKSLTSS

SEQ ID NO: 3345412 - protein, 10 aa, Plasmodium falciparum
SQKSREEMTD

SEQ ID NO: 3345413 - protein, 5 aa, Plasmodium falciparum
SQKTI

SEQ ID NO: 3345414 - protein, 9 aa, Plasmodium falciparum
SQKVDSNAT

SEQ ID NO: 3345415 - protein, 9 aa, Plasmodium falciparum
SQKYDNNDD

SEQ ID NO: 3345416 - protein, 13 aa, Plasmodium falciparum
SQKYETNLPKSNN

SEQ ID NO: 3345417 - protein, 6 aa, Plasmodium falciparum
SQLGPR

SEQ ID NO: 3345418 - protein, 6 aa, Plasmodium falciparum
SQLHKN

SEQ ID NO: 3345419 - protein, 30 aa, Plasmodium falciparum
SQLKKRKTYQEEDGKKNDHADYDGEGNYDE

SEQ ID NO: 3345420 - protein, 4 aa, Plasmodium falciparum
SQLP

SEQ ID NO: 3345421 - protein, 9 aa, Plasmodium falciparum
SQLPEGDIP

SEQ ID NO: 3345422 - protein, 7 aa, Plasmodium falciparum
SQLPTKK

SEQ ID NO: 3345423 - protein, 30 aa, Plasmodium falciparum
SQLTQSNQNESNKNSYIEKNKTDNKCTNDN

SEQ ID NO: 3345424 - protein, 4 aa, Plasmodium falciparum
SQMG

SEQ ID NO: 3345425 - protein, 8 aa, Plasmodium falciparum
SQMNTPNN

SEQ ID NO: 3345426 - protein, 10 aa, Plasmodium falciparum
SQNDEVSENK

SEQ ID NO: 3345427 - protein, 13 aa, Plasmodium falciparum
SQNEKDTSSQSVK

SEQ ID NO: 3345428 - protein, 17 aa, Plasmodium falciparum
SQNENINNKKNNTNNNI

SEQ ID NO: 3345429 - protein, 4 aa, Plasmodium falciparum
SQNG

SEQ ID NO: 3345430 - protein, 8 aa, Plasmodium falciparum
SQNGDNAK

SEQ ID NO: 3345431 - protein, 8 aa, Plasmodium falciparum
SQNGINKK

SEQ ID NO: 3345432 - protein, 9 aa, Plasmodium falciparum
SQNGNQKRQ

SEQ ID NO: 3345433 - protein, 11 aa, Plasmodium falciparum
SQNHDSTKINS

SEQ ID NO: 3345434 - protein, 5 aa, Plasmodium falciparum
SQNIT

SEQ ID NO: 3345435 - protein, 20 aa, Plasmodium falciparum
SQNITEKNKNKNNNNNNSDL

SEQ ID NO: 3345436 - protein, 4 aa, Plasmodium falciparum
SQNK

SEQ ID NO: 3345437 - protein, 11 aa, Plasmodium falciparum
SQNKEKGMTSY

SEQ ID NO: 3345438 - protein, 10 aa, Plasmodium falciparum
SQNKEKQKHQ

SEQ ID NO: 3345439 - protein, 10 aa, Plasmodium falciparum
SQNKHNSERL

SEQ ID NO: 3345440 - protein, 9 aa, Plasmodium falciparum
SQNKSSSDI

SEQ ID NO: 3345441 - protein, 9 aa, Plasmodium falciparum
SQNLGNPDI

SEQ ID NO: 3345442 - protein, 6 aa, Plasmodium falciparum
SQNPGN

SEQ ID NO: 3345443 - protein, 11 aa, Plasmodium falciparum
SQNQQDNNYQG

SEQ ID NO: 3345444 - protein, 8 aa, Plasmodium falciparum
SQNSSKNN

SEQ ID NO: 3345445 - protein, 9 aa, Plasmodium falciparum
SQNSYHPMG

SEQ ID NO: 3345446 - protein, 11 aa, Plasmodium falciparum
SQNVSDDNSVQ

SEQ ID NO: 3345447 - protein, 11 aa, Plasmodium falciparum
SQNWSETQNYN

SEQ ID NO: 3345448 - protein, 4 aa, Plasmodium falciparum
SQPA

SEQ ID NO: 3345449 - protein, 7 aa, Plasmodium falciparum
SQPEKED

SEQ ID NO: 3345450 - protein, 4 aa, Plasmodium falciparum
SQPK

SEQ ID NO: 3345451 - protein, 4 aa, Plasmodium falciparum
SQPS

SEQ ID NO: 3345452 - protein, 10 aa, Plasmodium falciparum
SQPTSSEYEG

SEQ ID NO: 3345453 - protein, 4 aa, Plasmodium falciparum
SQQD

SEQ ID NO: 3345454 - protein, 20 aa, Plasmodium falciparum
SQQDEKKDGTLSNNYTNNYT

SEQ ID NO: 3345455 - protein, 10 aa, Plasmodium falciparum
SQQKPELKKT

SEQ ID NO: 3345456 - protein, 43 aa, Plasmodium falciparum
SQQQQSNDENNYYSQNKKRNTYSNNNKTNRSDIYTKENKYERG

SEQ ID NO: 3345457 - protein, 25 aa, Plasmodium falciparum
SQQSVTSQSTQSSQANQPNHTNQST

SEQ ID NO: 3345458 - protein, 6 aa, Plasmodium falciparum
SQQTKY

SEQ ID NO: 3345459 - protein, 7 aa, Plasmodium falciparum
SQRDENH

SEQ ID NO: 3345460 - protein, 4 aa, Plasmodium falciparum
SQRI

SEQ ID NO: 3345461 - protein, 8 aa, Plasmodium falciparum
SQRKAPTE

SEQ ID NO: 3345462 - protein, 6 aa, Plasmodium falciparum
SQRKSF

SEQ ID NO: 3345463 - protein, 21 aa, Plasmodium falciparum
SQRNKDKSKIINQRNSNEHYT

SEQ ID NO: 3345464 - protein, 4 aa, Plasmodium falciparum
SQRP

SEQ ID NO: 3345465 - protein, 9 aa, Plasmodium falciparum
SQRRENGME

SEQ ID NO: 3345466 - protein, 127 aa, Plasmodium falciparum
SQRSNIKKSNSTNSTRRNYNRNNNNNNNKNNNNNNNNNNNNNNNNNNNSRNNNNNNNNNNNNNNNNNNNNNNNNNNNHNNNNKDDNTSDNNNNNINKEEDKKNKTTNNKKKENEKDDENKCKGNLNG

SEQ ID NO: 3345467 - protein, 6 aa, Plasmodium falciparum
SQSERG

SEQ ID NO: 3345468 - protein, 8 aa, Plasmodium falciparum
SQSGTGKT

SEQ ID NO: 3345469 - protein, 10 aa, Plasmodium falciparum
SQSKVDKKIQ

SEQ ID NO: 3345470 - protein, 5 aa, Plasmodium falciparum
SQSLS

SEQ ID NO: 3345471 - protein, 9 aa, Plasmodium falciparum
SQSNKYELE

SEQ ID NO: 3345472 - protein, 6 aa, Plasmodium falciparum
SQSNNL

SEQ ID NO: 3345473 - protein, 14 aa, Plasmodium falciparum
SQSNVEVNNANDAF

SEQ ID NO: 3345474 - protein, 10 aa, Plasmodium falciparum
SQSPAQYNRP

SEQ ID NO: 3345475 - protein, 5 aa, Plasmodium falciparum
SQSPE

SEQ ID NO: 3345476 - protein, 9 aa, Plasmodium falciparum
SQSPPTSSL

SEQ ID NO: 3345477 - protein, 14 aa, Plasmodium falciparum
SQSRSQSYSADEGK

SEQ ID NO: 3345478 - protein, 11 aa, Plasmodium falciparum
SQSSSKQSSEI

SEQ ID NO: 3345479 - protein, 14 aa, Plasmodium falciparum
SQSSYIDEKNNING

SEQ ID NO: 3345480 - protein, 10 aa, Plasmodium falciparum
SQSTTTPNNN

SEQ ID NO: 3345481 - protein, 13 aa, Plasmodium falciparum
SQTGDSLSSPIPN

SEQ ID NO: 3345482 - protein, 8 aa, Plasmodium falciparum
SQTGSGKT

SEQ ID NO: 3345483 - protein, 7 aa, Plasmodium falciparum
SQTIGKE

SEQ ID NO: 3345484 - protein, 22 aa, Plasmodium falciparum
SQTISSDNNNNNNNNNNSKVIN

SEQ ID NO: 3345485 - protein, 10 aa, Plasmodium falciparum
SQTKEGENKI

SEQ ID NO: 3345486 - protein, 5 aa, Plasmodium falciparum
SQTLK

SEQ ID NO: 3345487 - protein, 5 aa, Plasmodium falciparum
SQTLS

SEQ ID NO: 3345488 - protein, 5 aa, Plasmodium falciparum
SQTNI

SEQ ID NO: 3345489 - protein, 11 aa, Plasmodium falciparum
SQTNNISNDEL

SEQ ID NO: 3345490 - protein, 6 aa, Plasmodium falciparum
SQTNNL

SEQ ID NO: 3345491 - protein, 12 aa, Plasmodium falciparum
SQTYNRICLSNN

SEQ ID NO: 3345492 - protein, 4 aa, Plasmodium falciparum
SQVQ

SEQ ID NO: 3345493 - protein, 10 aa, Plasmodium falciparum
SQVSSSDNFS

SEQ ID NO: 3345494 - protein, 6 aa, Plasmodium falciparum
SQYNNN

SEQ ID NO: 3345495 - protein, 34 aa, Plasmodium falciparum
SQYRYANGSDSNSKTQNSNNRRSYYPKKGPNKDK

SEQ ID NO: 3345496 - protein, 4 aa, Plasmodium falciparum
SQYS

SEQ ID NO: 3345497 - protein, 5 aa, Plasmodium falciparum
SRAHA

SEQ ID NO: 3345498 - protein, 4 aa, Plasmodium falciparum
SRAY

SEQ ID NO: 3345499 - protein, 5 aa, Plasmodium falciparum
SRDDD

SEQ ID NO: 3345500 - protein, 6 aa, Plasmodium falciparum
SRDDKL

SEQ ID NO: 3345501 - protein, 7 aa, Plasmodium falciparum
SRDHENF

SEQ ID NO: 3345502 - protein, 13 aa, Plasmodium falciparum
SRDQDTNHNNKEI

SEQ ID NO: 3345503 - protein, 4 aa, Plasmodium falciparum
SRDR

SEQ ID NO: 3345504 - protein, 11 aa, Plasmodium falciparum
SRDRKSEVSIN

SEQ ID NO: 3345505 - protein, 7 aa, Plasmodium falciparum
SRDSEIN

SEQ ID NO: 3345506 - protein, 33 aa, Plasmodium falciparum
SRDVGESRSGPNSRNDNNNNDGNNNSNNTNSRH

SEQ ID NO: 3345507 - protein, 21 aa, Plasmodium falciparum
SRDYNNKDNYERYNAEQENTF

SEQ ID NO: 3345508 - protein, 8 aa, Plasmodium falciparum
SREDTEDT

SEQ ID NO: 3345509 - protein, 14 aa, Plasmodium falciparum
SREEKEGRKAYQGY

SEQ ID NO: 3345510 - protein, 10 aa, Plasmodium falciparum
SREENEKNSS

SEQ ID NO: 3345511 - protein, 5 aa, Plasmodium falciparum
SREGE

SEQ ID NO: 3345512 - protein, 9 aa, Plasmodium falciparum
SREGTTTLE

SEQ ID NO: 3345513 - protein, 12 aa, Plasmodium falciparum
SREKNKNPESKP

SEQ ID NO: 3345514 - protein, 5 aa, Plasmodium falciparum
SREKR

SEQ ID NO: 3345515 - protein, 10 aa, Plasmodium falciparum
SRELSNKRKK

SEQ ID NO: 3345516 - protein, 4 aa, Plasmodium falciparum
SREN

SEQ ID NO: 3345517 - protein, 5 aa, Plasmodium falciparum
SRENV

SEQ ID NO: 3345518 - protein, 7 aa, Plasmodium falciparum
SREQEKK

SEQ ID NO: 3345519 - protein, 4 aa, Plasmodium falciparum
SRER

SEQ ID NO: 3345520 - protein, 7 aa, Plasmodium falciparum
SRERENR

SEQ ID NO: 3345521 - protein, 14 aa, Plasmodium falciparum
SRGEKMSKSKGNVV

SEQ ID NO: 3345522 - protein, 5 aa, Plasmodium falciparum
SRGKL

SEQ ID NO: 3345523 - protein, 5 aa, Plasmodium falciparum
SRGLG

SEQ ID NO: 3345524 - protein, 7 aa, Plasmodium falciparum
SRGNPTV

SEQ ID NO: 3345525 - protein, 8 aa, Plasmodium falciparum
SRHGEKQK

SEQ ID NO: 3345526 - protein, 10 aa, Plasmodium falciparum
SRHNDNNVES

SEQ ID NO: 3345527 - protein, 63 aa, Plasmodium falciparum
SRHRSYSSRSYSRSGKRSYTRSRSRSYSSRSYSRSRSSSSRSRSRSMDRRRDTYDKKRSYSRS

SEQ ID NO: 3345528 - protein, 12 aa, Plasmodium falciparum
SRIANDKRDVYD

SEQ ID NO: 3345529 - protein, 8 aa, Plasmodium falciparum
SRIQEAKS

SEQ ID NO: 3345530 - protein, 5 aa, Plasmodium falciparum
SRKGE

SEQ ID NO: 3345531 - protein, 5 aa, Plasmodium falciparum
SRKHK

SEQ ID NO: 3345532 - protein, 9 aa, Plasmodium falciparum
SRKIDTENN

SEQ ID NO: 3345533 - protein, 10 aa, Plasmodium falciparum
SRKIGEKSSK

SEQ ID NO: 3345534 - protein, 7 aa, Plasmodium falciparum
SRKKDSP

SEQ ID NO: 3345535 - protein, 9 aa, Plasmodium falciparum
SRKKEKYNV

SEQ ID NO: 3345536 - protein, 11 aa, Plasmodium falciparum
SRKKKKKKKKK

SEQ ID NO: 3345537 - protein, 16 aa, Plasmodium falciparum
SRKKTKIEKTPNKHEQ

SEQ ID NO: 3345538 - protein, 15 aa, Plasmodium falciparum
SRKKTSNNKSDSSQM

SEQ ID NO: 3345539 - protein, 9 aa, Plasmodium falciparum
SRKKTSNTL

SEQ ID NO: 3345540 - protein, 6 aa, Plasmodium falciparum
SRKKYT

SEQ ID NO: 3345541 - protein, 8 aa, Plasmodium falciparum
SRKNNDFN

SEQ ID NO: 3345542 - protein, 6 aa, Plasmodium falciparum
SRKNNM

SEQ ID NO: 3345543 - protein, 7 aa, Plasmodium falciparum
SRKQDDQ

SEQ ID NO: 3345544 - protein, 19 aa, Plasmodium falciparum
SRKRDKQSRRDSKKGNEMN

SEQ ID NO: 3345545 - protein, 40 aa, Plasmodium falciparum
SRKSLTNKLENKKNLSLSDNSLKKSDEEDNESVKHENHVN

SEQ ID NO: 3345546 - protein, 8 aa, Plasmodium falciparum
SRKSQTNM

SEQ ID NO: 3345547 - protein, 23 aa, Plasmodium falciparum
SRKSRPSTTTNINTNNYNKPATY

SEQ ID NO: 3345548 - protein, 6 aa, Plasmodium falciparum
SRKSYD

SEQ ID NO: 3345549 - protein, 4 aa, Plasmodium falciparum
SRKT

SEQ ID NO: 3345550 - protein, 6 aa, Plasmodium falciparum
SRKYNS

SEQ ID NO: 3345551 - protein, 6 aa, Plasmodium falciparum
SRLGRP

SEQ ID NO: 3345552 - protein, 5 aa, Plasmodium falciparum
SRMSY

SEQ ID NO: 3345553 - protein, 6 aa, Plasmodium falciparum
SRNAQD

SEQ ID NO: 3345554 - protein, 6 aa, Plasmodium falciparum
SRNDQT

SEQ ID NO: 3345555 - protein, 7 aa, Plasmodium falciparum
SRNDSKK

SEQ ID NO: 3345556 - protein, 6 aa, Plasmodium falciparum
SRNEEK

SEQ ID NO: 3345557 - protein, 10 aa, Plasmodium falciparum
SRNKDQDGIN

SEQ ID NO: 3345558 - protein, 7 aa, Plasmodium falciparum
SRNKESV

SEQ ID NO: 3345559 - protein, 15 aa, Plasmodium falciparum
SRNKKYSNTLQKDRY

SEQ ID NO: 3345560 - protein, 21 aa, Plasmodium falciparum
SRNNNGKNKKMKKNKKNKKQN

SEQ ID NO: 3345561 - protein, 5 aa, Plasmodium falciparum
SRNNQ

SEQ ID NO: 3345562 - protein, 8 aa, Plasmodium falciparum
SRNPSSTL

SEQ ID NO: 3345563 - protein, 15 aa, Plasmodium falciparum
SRNQAYKNNNDNEND

SEQ ID NO: 3345564 - protein, 9 aa, Plasmodium falciparum
SRNRSHKKK

SEQ ID NO: 3345565 - protein, 8 aa, Plasmodium falciparum
SRNSNTNY

SEQ ID NO: 3345566 - protein, 17 aa, Plasmodium falciparum
SRNSSNIMSSQNSWKKN

SEQ ID NO: 3345567 - protein, 22 aa, Plasmodium falciparum
SRNTNHSSKENINKYNKNKEEY

SEQ ID NO: 3345568 - protein, 5 aa, Plasmodium falciparum
SRNVN

SEQ ID NO: 3345569 - protein, 4 aa, Plasmodium falciparum
SRNY

SEQ ID NO: 3345570 - protein, 9 aa, Plasmodium falciparum
SRPGQCGKA

SEQ ID NO: 3345571 - protein, 4 aa, Plasmodium falciparum
SRPI

SEQ ID NO: 3345572 - protein, 5 aa, Plasmodium falciparum
SRPIP

SEQ ID NO: 3345573 - protein, 14 aa, Plasmodium falciparum
SRPNDYSTNTVKQN

SEQ ID NO: 3345574 - protein, 5 aa, Plasmodium falciparum
SRPSQ

SEQ ID NO: 3345575 - protein, 14 aa, Plasmodium falciparum
SRPWEDPKPNLGER

SEQ ID NO: 3345576 - protein, 7 aa, Plasmodium falciparum
SRQKERK

SEQ ID NO: 3345577 - protein, 16 aa, Plasmodium falciparum
SRQNNKESYGEEKEHL

SEQ ID NO: 3345578 - protein, 8 aa, Plasmodium falciparum
SRQSFEDT

SEQ ID NO: 3345579 - protein, 18 aa, Plasmodium falciparum
SRRATKNSTLSTNTLNQE

SEQ ID NO: 3345580 - protein, 5 aa, Plasmodium falciparum
SRRDN

SEQ ID NO: 3345581 - protein, 7 aa, Plasmodium falciparum
SRREPNI

SEQ ID NO: 3345582 - protein, 28 aa, Plasmodium falciparum
SRRESKERINNNNENNNIDGNNKSTDRI

SEQ ID NO: 3345583 - protein, 25 aa, Plasmodium falciparum
SRRKNKMKKKKKKKKKKKEQDDDYY

SEQ ID NO: 3345584 - protein, 5 aa, Plasmodium falciparum
SRRQK

SEQ ID NO: 3345585 - protein, 18 aa, Plasmodium falciparum
SRSDFSKECENTTESKNI

SEQ ID NO: 3345586 - protein, 6 aa, Plasmodium falciparum
SRSDVY

SEQ ID NO: 3345587 - protein, 5 aa, Plasmodium falciparum
SRSFG

SEQ ID NO: 3345588 - protein, 5 aa, Plasmodium falciparum
SRSHP

SEQ ID NO: 3345589 - protein, 35 aa, Plasmodium falciparum
SRSKKIKSELNSNNSIKENGMNSKEMDSQNSYSDV

SEQ ID NO: 3345590 - protein, 9 aa, Plasmodium falciparum
SRSKNTPLF

SEQ ID NO: 3345591 - protein, 10 aa, Plasmodium falciparum
SRSKNVEEEK

SEQ ID NO: 3345592 - protein, 4 aa, Plasmodium falciparum
SRSN

SEQ ID NO: 3345593 - protein, 45 aa, Plasmodium falciparum
SRSNNINNKTKHSNNNVNKKKDKSHLKDEKKINENSKNKDIYNNK

SEQ ID NO: 3345594 - protein, 14 aa, Plasmodium falciparum
SRSNNNNNNYNNME

SEQ ID NO: 3345595 - protein, 25 aa, Plasmodium falciparum
SRSNPKENKEKNKTFKYKDKNKTNI

SEQ ID NO: 3345596 - protein, 6 aa, Plasmodium falciparum
SRSNPY

SEQ ID NO: 3345597 - protein, 12 aa, Plasmodium falciparum
SRSNSNTKNNMN

SEQ ID NO: 3345598 - protein, 4 aa, Plasmodium falciparum
SRSQ

SEQ ID NO: 3345599 - protein, 8 aa, Plasmodium falciparum
SRSTSINY

SEQ ID NO: 3345600 - protein, 6 aa, Plasmodium falciparum
SRTGTH

SEQ ID NO: 3345601 - protein, 7 aa, Plasmodium falciparum
SRTIRTE

SEQ ID NO: 3345602 - protein, 8 aa, Plasmodium falciparum
SRTKNNYT

SEQ ID NO: 3345603 - protein, 69 aa, Plasmodium falciparum
SRTKRGSSKKEHIESNMENNNDNINNNDDDNNSNNNDDNNDNINNNNDNINNNNDNINNNNNSNNNDDD

SEQ ID NO: 3345604 - protein, 11 aa, Plasmodium falciparum
SRTNENIKNNN

SEQ ID NO: 3345605 - protein, 12 aa, Plasmodium falciparum
SRTNENVNGDDM

SEQ ID NO: 3345606 - protein, 6 aa, Plasmodium falciparum
SRTNIE

SEQ ID NO: 3345607 - protein, 4 aa, Plasmodium falciparum
SRTQ

SEQ ID NO: 3345608 - protein, 8 aa, Plasmodium falciparum
SRTSSGTF

SEQ ID NO: 3345609 - protein, 13 aa, Plasmodium falciparum
SRTSSSRNNNNNI

SEQ ID NO: 3345610 - protein, 11 aa, Plasmodium falciparum
SRTTYENNTYE

SEQ ID NO: 3345611 - protein, 7 aa, Plasmodium falciparum
SRVGNNI

SEQ ID NO: 3345612 - protein, 6 aa, Plasmodium falciparum
SRYATG

SEQ ID NO: 3345613 - protein, 5 aa, Plasmodium falciparum
SRYTS

SEQ ID NO: 3345614 - protein, 11 aa, Plasmodium falciparum
SSAEVSVESPS

SEQ ID NO: 3345615 - protein, 6 aa, Plasmodium falciparum
SSAFKK

SEQ ID NO: 3345616 - protein, 8 aa, Plasmodium falciparum
SSAGAGSD

SEQ ID NO: 3345617 - protein, 4 aa, Plasmodium falciparum
SSAI

SEQ ID NO: 3345618 - protein, 8 aa, Plasmodium falciparum
SSAKKAKE

SEQ ID NO: 3345619 - protein, 5 aa, Plasmodium falciparum
SSANT

SEQ ID NO: 3345620 - protein, 9 aa, Plasmodium falciparum
SSANVSKND

SEQ ID NO: 3345621 - protein, 22 aa, Plasmodium falciparum
SSAPIISNQENNISNLGNTSAY

SEQ ID NO: 3345622 - protein, 5 aa, Plasmodium falciparum
SSAQS

SEQ ID NO: 3345623 - protein, 33 aa, Plasmodium falciparum
SSASKENERKNSSEDTKEPQENLYGKSNTSSSI

SEQ ID NO: 3345624 - protein, 70 aa, Plasmodium falciparum
SSASNRTHASDYSNNRSEESDYSSSDKKGYKNGNMNTNSNSSYDDYTSDCNKSQSNDYSEDSQRGRENKY

SEQ ID NO: 3345625 - protein, 17 aa, Plasmodium falciparum
SSASYGTPRNENIKQTN

SEQ ID NO: 3345626 - protein, 5 aa, Plasmodium falciparum
SSCDK

SEQ ID NO: 3345627 - protein, 4 aa, Plasmodium falciparum
SSCE

SEQ ID NO: 3345628 - protein, 8 aa, Plasmodium falciparum
SSCEEEKI

SEQ ID NO: 3345629 - protein, 13 aa, Plasmodium falciparum
SSCEEKKDNINNN

SEQ ID NO: 3345630 - protein, 11 aa, Plasmodium falciparum
SSCGKTKTKGN

SEQ ID NO: 3345631 - protein, 6 aa, Plasmodium falciparum
SSCNSN

SEQ ID NO: 3345632 - protein, 12 aa, Plasmodium falciparum
SSCSSDDDQSGK

SEQ ID NO: 3345633 - protein, 5 aa, Plasmodium falciparum
SSDAI

SEQ ID NO: 3345634 - protein, 5 aa, Plasmodium falciparum
SSDAL

SEQ ID NO: 3345635 - protein, 7 aa, Plasmodium falciparum
SSDASTL

SEQ ID NO: 3345636 - protein, 9 aa, Plasmodium falciparum
SSDAYASYE

SEQ ID NO: 3345637 - protein, 9 aa, Plasmodium falciparum
SSDCRGTSI

SEQ ID NO: 3345638 - protein, 32 aa, Plasmodium falciparum
SSDDALSHSNEKNKYKYKNKYKNKYKNKNKKY

SEQ ID NO: 3345639 - protein, 9 aa, Plasmodium falciparum
SSDDDQSLD

SEQ ID NO: 3345640 - protein, 11 aa, Plasmodium falciparum
SSDDEDDEELY

SEQ ID NO: 3345641 - protein, 61 aa, Plasmodium falciparum
SSDDEGDSHSDSHSDSHSDSNSDSNSDSNSDSNSNSHSDSNSNSHSDYSYKKKKHSHHHSK

SEQ ID NO: 3345642 - protein, 23 aa, Plasmodium falciparum
SSDDKKKLIDQNNKKNKLKTKDK

SEQ ID NO: 3345643 - protein, 7 aa, Plasmodium falciparum
SSDDNKG

SEQ ID NO: 3345644 - protein, 11 aa, Plasmodium falciparum
SSDDSQGEKRN

SEQ ID NO: 3345645 - protein, 6 aa, Plasmodium falciparum
SSDEDL

SEQ ID NO: 3345646 - protein, 6 aa, Plasmodium falciparum
SSDEED

SEQ ID NO: 3345647 - protein, 10 aa, Plasmodium falciparum
SSDEEEEGEV

SEQ ID NO: 3345648 - protein, 18 aa, Plasmodium falciparum
SSDEENENYHEKNRDNNS

SEQ ID NO: 3345649 - protein, 8 aa, Plasmodium falciparum
SSDEFNDE

SEQ ID NO: 3345650 - protein, 19 aa, Plasmodium falciparum
SSDEKKKKSELNDDGYEEI

SEQ ID NO: 3345651 - protein, 5 aa, Plasmodium falciparum
SSDEM

SEQ ID NO: 3345652 - protein, 8 aa, Plasmodium falciparum
SSDENMNN

SEQ ID NO: 3345653 - protein, 7 aa, Plasmodium falciparum
SSDESYF

SEQ ID NO: 3345654 - protein, 9 aa, Plasmodium falciparum
SSDETTDTN

SEQ ID NO: 3345655 - protein, 6 aa, Plasmodium falciparum
SSDEYE

SEQ ID NO: 3345656 - protein, 5 aa, Plasmodium falciparum
SSDFP

SEQ ID NO: 3345657 - protein, 13 aa, Plasmodium falciparum
SSDGNKKNNDKIQ

SEQ ID NO: 3345658 - protein, 5 aa, Plasmodium falciparum
SSDGT

SEQ ID NO: 3345659 - protein, 13 aa, Plasmodium falciparum
SSDHESEETENKK

SEQ ID NO: 3345660 - protein, 9 aa, Plasmodium falciparum
SSDHTTQHY

SEQ ID NO: 3345661 - protein, 5 aa, Plasmodium falciparum
SSDIK

SEQ ID NO: 3345662 - protein, 11 aa, Plasmodium falciparum
SSDIKNKDEKS

SEQ ID NO: 3345663 - protein, 13 aa, Plasmodium falciparum
SSDIQKEDINKEL

SEQ ID NO: 3345664 - protein, 9 aa, Plasmodium falciparum
SSDISQNNT

SEQ ID NO: 3345665 - protein, 14 aa, Plasmodium falciparum
SSDITSSSESEYEE

SEQ ID NO: 3345666 - protein, 5 aa, Plasmodium falciparum
SSDKI

SEQ ID NO: 3345667 - protein, 27 aa, Plasmodium falciparum
SSDKIKVGAGKESQSLHTSNRRKKKTL

SEQ ID NO: 3345668 - protein, 5 aa, Plasmodium falciparum
SSDKK

SEQ ID NO: 3345669 - protein, 8 aa, Plasmodium falciparum
SSDKMTNN

SEQ ID NO: 3345670 - protein, 6 aa, Plasmodium falciparum
SSDKNI

SEQ ID NO: 3345671 - protein, 8 aa, Plasmodium falciparum
SSDKPQPN

SEQ ID NO: 3345672 - protein, 4 aa, Plasmodium falciparum
SSDL

SEQ ID NO: 3345673 - protein, 9 aa, Plasmodium falciparum
SSDNERKEN

SEQ ID NO: 3345674 - protein, 5 aa, Plasmodium falciparum
SSDNI

SEQ ID NO: 3345675 - protein, 5 aa, Plasmodium falciparum
SSDNK

SEQ ID NO: 3345676 - protein, 13 aa, Plasmodium falciparum
SSDNKNVEENNIG

SEQ ID NO: 3345677 - protein, 16 aa, Plasmodium falciparum
SSDNNNNNNNNNTTYN

SEQ ID NO: 3345678 - protein, 13 aa, Plasmodium falciparum
SSDNSLNQKNRLP

SEQ ID NO: 3345679 - protein, 10 aa, Plasmodium falciparum
SSDNVNPDQM

SEQ ID NO: 3345680 - protein, 11 aa, Plasmodium falciparum
SSDSSSEKENK

SEQ ID NO: 3345681 - protein, 82 aa, Plasmodium falciparum
SSDSSSSTEDKSIRSKGDEYDEEDEDEEEEEEDDENEDDDDDDVEDEDDDEESGECDKEEETGKRKRRRNSRYYKSSNKYIK

SEQ ID NO: 3345682 - protein, 4 aa, Plasmodium falciparum
SSDV

SEQ ID NO: 3345683 - protein, 45 aa, Plasmodium falciparum
SSDVENDKKGVEEKYKDKNKNSYQTLKKNDNNINEKEYDKNRSSI

SEQ ID NO: 3345684 - protein, 5 aa, Plasmodium falciparum
SSDVR

SEQ ID NO: 3345685 - protein, 4 aa, Plasmodium falciparum
SSDY

SEQ ID NO: 3345686 - protein, 28 aa, Plasmodium falciparum
SSDYDDGRSDNTLDDEGKGNGNYSDDSL

SEQ ID NO: 3345687 - protein, 8 aa, Plasmodium falciparum
SSDYDSSL

SEQ ID NO: 3345688 - protein, 8 aa, Plasmodium falciparum
SSDYSDTK

SEQ ID NO: 3345689 - protein, 6 aa, Plasmodium falciparum
SSEAKF

SEQ ID NO: 3345690 - protein, 4 aa, Plasmodium falciparum
SSED

SEQ ID NO: 3345691 - protein, 18 aa, Plasmodium falciparum
SSEEEDYTQYLNKYFDMD

SEQ ID NO: 3345692 - protein, 12 aa, Plasmodium falciparum
SSEEEMNSNSSY

SEQ ID NO: 3345693 - protein, 6 aa, Plasmodium falciparum
SSEEEV

SEQ ID NO: 3345694 - protein, 15 aa, Plasmodium falciparum
SSEEIKPAGCCSAAC

SEQ ID NO: 3345695 - protein, 6 aa, Plasmodium falciparum
SSEEIS

SEQ ID NO: 3345696 - protein, 6 aa, Plasmodium falciparum
SSEELN

SEQ ID NO: 3345697 - protein, 11 aa, Plasmodium falciparum
SSEENEERDIN

SEQ ID NO: 3345698 - protein, 9 aa, Plasmodium falciparum
SSEESMNDE

SEQ ID NO: 3345699 - protein, 6 aa, Plasmodium falciparum
SSEETL

SEQ ID NO: 3345700 - protein, 6 aa, Plasmodium falciparum
SSEETR

SEQ ID NO: 3345701 - protein, 5 aa, Plasmodium falciparum
SSEEV

SEQ ID NO: 3345702 - protein, 4 aa, Plasmodium falciparum
SSEF

SEQ ID NO: 3345703 - protein, 8 aa, Plasmodium falciparum
SSEHEKKY

SEQ ID NO: 3345704 - protein, 18 aa, Plasmodium falciparum
SSEHTRTSKDNSYYDSKR

SEQ ID NO: 3345705 - protein, 8 aa, Plasmodium falciparum
SSEIGQAQ

SEQ ID NO: 3345706 - protein, 4 aa, Plasmodium falciparum
SSEK

SEQ ID NO: 3345707 - protein, 18 aa, Plasmodium falciparum
SSEKDDTTKEYSDTHDPY

SEQ ID NO: 3345708 - protein, 22 aa, Plasmodium falciparum
SSEKEKKRMKNKDMKQPKYVSN

SEQ ID NO: 3345709 - protein, 13 aa, Plasmodium falciparum
SSEKINDNGISNK

SEQ ID NO: 3345710 - protein, 33 aa, Plasmodium falciparum
SSENEEEKKYENENKDGNKYDTERKSKNIKNND

SEQ ID NO: 3345711 - protein, 7 aa, Plasmodium falciparum
SSENERV

SEQ ID NO: 3345712 - protein, 22 aa, Plasmodium falciparum
SSENEYSPKSLSDVEGSSSFYE

SEQ ID NO: 3345713 - protein, 10 aa, Plasmodium falciparum
SSENKSHNDD

SEQ ID NO: 3345714 - protein, 18 aa, Plasmodium falciparum
SSENTRNVPAGINEDGQE

SEQ ID NO: 3345715 - protein, 6 aa, Plasmodium falciparum
SSENVE

SEQ ID NO: 3345716 - protein, 6 aa, Plasmodium falciparum
SSENYT

SEQ ID NO: 3345717 - protein, 19 aa, Plasmodium falciparum
SSEPKKYINNRKKKKYFNI

SEQ ID NO: 3345718 - protein, 9 aa, Plasmodium falciparum
SSEPTEPYL

SEQ ID NO: 3345719 - protein, 6 aa, Plasmodium falciparum
SSEPYK

SEQ ID NO: 3345720 - protein, 5 aa, Plasmodium falciparum
SSERR

SEQ ID NO: 3345721 - protein, 15 aa, Plasmodium falciparum
SSERTESETSESSCT

SEQ ID NO: 3345722 - protein, 4 aa, Plasmodium falciparum
SSES

SEQ ID NO: 3345723 - protein, 7 aa, Plasmodium falciparum
SSESEHC

SEQ ID NO: 3345724 - protein, 7 aa, Plasmodium falciparum
SSESGCE

SEQ ID NO: 3345725 - protein, 23 aa, Plasmodium falciparum
SSESNDNNHSEYNAQKGDDNEHI

SEQ ID NO: 3345726 - protein, 7 aa, Plasmodium falciparum
SSESNIT

SEQ ID NO: 3345727 - protein, 14 aa, Plasmodium falciparum
SSESNLGIGICCTD

SEQ ID NO: 3345728 - protein, 14 aa, Plasmodium falciparum
SSETIKPNNVPKQT

SEQ ID NO: 3345729 - protein, 9 aa, Plasmodium falciparum
SSETNNVQK

SEQ ID NO: 3345730 - protein, 10 aa, Plasmodium falciparum
SSETNQEEAY

SEQ ID NO: 3345731 - protein, 9 aa, Plasmodium falciparum
SSFKTSKDK

SEQ ID NO: 3345732 - protein, 9 aa, Plasmodium falciparum
SSFNPPPKV

SEQ ID NO: 3345733 - protein, 6 aa, Plasmodium falciparum
SSFSSV

SEQ ID NO: 3345734 - protein, 4 aa, Plasmodium falciparum
SSFY

SEQ ID NO: 3345735 - protein, 4 aa, Plasmodium falciparum
SSGA

SEQ ID NO: 3345736 - protein, 5 aa, Plasmodium falciparum
SSGAI

SEQ ID NO: 3345737 - protein, 9 aa, Plasmodium falciparum
SSGATGGLS

SEQ ID NO: 3345738 - protein, 8 aa, Plasmodium falciparum
SSGEAPCP

SEQ ID NO: 3345739 - protein, 4 aa, Plasmodium falciparum
SSGG

SEQ ID NO: 3345740 - protein, 8 aa, Plasmodium falciparum
SSGGGSVD

SEQ ID NO: 3345741 - protein, 8 aa, Plasmodium falciparum
SSGGLEAT

SEQ ID NO: 3345742 - protein, 14 aa, Plasmodium falciparum
SSGKAQNSATEEVK

SEQ ID NO: 3345743 - protein, 9 aa, Plasmodium falciparum
SSGKEKGIG

SEQ ID NO: 3345744 - protein, 14 aa, Plasmodium falciparum
SSGNDNENKQNDSI

SEQ ID NO: 3345745 - protein, 6 aa, Plasmodium falciparum
SSGPRY

SEQ ID NO: 3345746 - protein, 5 aa, Plasmodium falciparum
SSGQE

SEQ ID NO: 3345747 - protein, 7 aa, Plasmodium falciparum
SSGRNED

SEQ ID NO: 3345748 - protein, 5 aa, Plasmodium falciparum
SSGRS

SEQ ID NO: 3345749 - protein, 6 aa, Plasmodium falciparum
SSGRTT

SEQ ID NO: 3345750 - protein, 5 aa, Plasmodium falciparum
SSGSL

SEQ ID NO: 3345751 - protein, 17 aa, Plasmodium falciparum
SSGSNNNRNSSSRSNYY

SEQ ID NO: 3345752 - protein, 7 aa, Plasmodium falciparum
SSGTNIP

SEQ ID NO: 3345753 - protein, 6 aa, Plasmodium falciparum
SSGTNN

SEQ ID NO: 3345754 - protein, 5 aa, Plasmodium falciparum
SSGTS

SEQ ID NO: 3345755 - protein, 29 aa, Plasmodium falciparum
SSGYSETSCKSTNSIENGNSSSTSSCDDD

SEQ ID NO: 3345756 - protein, 6 aa, Plasmodium falciparum
SSHDNM

SEQ ID NO: 3345757 - protein, 8 aa, Plasmodium falciparum
SSHEDEAK

SEQ ID NO: 3345758 - protein, 14 aa, Plasmodium falciparum
SSHEKQIKADEQYE

SEQ ID NO: 3345759 - protein, 8 aa, Plasmodium falciparum
SSHKDTYN

SEQ ID NO: 3345760 - protein, 14 aa, Plasmodium falciparum
SSHMKKKEKEKEKD

SEQ ID NO: 3345761 - protein, 9 aa, Plasmodium falciparum
SSHNNIDNN

SEQ ID NO: 3345762 - protein, 9 aa, Plasmodium falciparum
SSHNSPLDN

SEQ ID NO: 3345763 - protein, 5 aa, Plasmodium falciparum
SSHSA

SEQ ID NO: 3345764 - protein, 32 aa, Plasmodium falciparum
SSHSSDSKEKNNSTSSTNSNNKFSDTNDSIYN

SEQ ID NO: 3345765 - protein, 7 aa, Plasmodium falciparum
SSIDEEQ

SEQ ID NO: 3345766 - protein, 4 aa, Plasmodium falciparum
SSIE

SEQ ID NO: 3345767 - protein, 11 aa, Plasmodium falciparum
SSIEKKNTKND

SEQ ID NO: 3345768 - protein, 15 aa, Plasmodium falciparum
SSIKNNEGNTNSSPI

SEQ ID NO: 3345769 - protein, 7 aa, Plasmodium falciparum
SSIKNSG

SEQ ID NO: 3345770 - protein, 4 aa, Plasmodium falciparum
SSIL

SEQ ID NO: 3345771 - protein, 5 aa, Plasmodium falciparum
SSINE

SEQ ID NO: 3345772 - protein, 8 aa, Plasmodium falciparum
SSINEEGE

SEQ ID NO: 3345773 - protein, 7 aa, Plasmodium falciparum
SSINEKR

SEQ ID NO: 3345774 - protein, 21 aa, Plasmodium falciparum
SSINNNNNNNNNNNNNNGDTI

SEQ ID NO: 3345775 - protein, 8 aa, Plasmodium falciparum
SSINNPGE

SEQ ID NO: 3345776 - protein, 7 aa, Plasmodium falciparum
SSIPKKY

SEQ ID NO: 3345777 - protein, 8 aa, Plasmodium falciparum
SSIQHGEE

SEQ ID NO: 3345778 - protein, 10 aa, Plasmodium falciparum
SSISNNSNHQ

SEQ ID NO: 3345779 - protein, 8 aa, Plasmodium falciparum
SSISSTYE

SEQ ID NO: 3345780 - protein, 12 aa, Plasmodium falciparum
SSITDNKKASDD

SEQ ID NO: 3345781 - protein, 5 aa, Plasmodium falciparum
SSITE

SEQ ID NO: 3345782 - protein, 8 aa, Plasmodium falciparum
SSITNNNP

SEQ ID NO: 3345783 - protein, 7 aa, Plasmodium falciparum
SSIYNSP

SEQ ID NO: 3345784 - protein, 8 aa, Plasmodium falciparum
SSKAAADI

SEQ ID NO: 3345785 - protein, 9 aa, Plasmodium falciparum
SSKADEEYN

SEQ ID NO: 3345786 - protein, 8 aa, Plasmodium falciparum
SSKDANMS

SEQ ID NO: 3345787 - protein, 8 aa, Plasmodium falciparum
SSKDDEDN

SEQ ID NO: 3345788 - protein, 25 aa, Plasmodium falciparum
SSKDDPKKRNSQYGKQRKQNEEDDY

SEQ ID NO: 3345789 - protein, 9 aa, Plasmodium falciparum
SSKDKEINN

SEQ ID NO: 3345790 - protein, 7 aa, Plasmodium falciparum
SSKDLDN

SEQ ID NO: 3345791 - protein, 16 aa, Plasmodium falciparum
SSKDNINNDNNNNNNY

SEQ ID NO: 3345792 - protein, 10 aa, Plasmodium falciparum
SSKDNYNKSV

SEQ ID NO: 3345793 - protein, 7 aa, Plasmodium falciparum
SSKEIVP

SEQ ID NO: 3345794 - protein, 9 aa, Plasmodium falciparum
SSKEQINGP

SEQ ID NO: 3345795 - protein, 10 aa, Plasmodium falciparum
SSKGAIPKQH

SEQ ID NO: 3345796 - protein, 8 aa, Plasmodium falciparum
SSKGNPMD

SEQ ID NO: 3345797 - protein, 4 aa, Plasmodium falciparum
SSKH

SEQ ID NO: 3345798 - protein, 9 aa, Plasmodium falciparum
SSKHDEKNN

SEQ ID NO: 3345799 - protein, 7 aa, Plasmodium falciparum
SSKIGHG

SEQ ID NO: 3345800 - protein, 5 aa, Plasmodium falciparum
SSKIK

SEQ ID NO: 3345801 - protein, 9 aa, Plasmodium falciparum
SSKINKDKL

SEQ ID NO: 3345802 - protein, 8 aa, Plasmodium falciparum
SSKKEDHI

SEQ ID NO: 3345803 - protein, 30 aa, Plasmodium falciparum
SSKKHISSENINNENGEKRKKKKNEQNDDN

SEQ ID NO: 3345804 - protein, 28 aa, Plasmodium falciparum
SSKKKSDVSSNYSCSNQNDKISTDSSSV

SEQ ID NO: 3345805 - protein, 6 aa, Plasmodium falciparum
SSKKLK

SEQ ID NO: 3345806 - protein, 17 aa, Plasmodium falciparum
SSKKNKKMQDTTTTMNE

SEQ ID NO: 3345807 - protein, 8 aa, Plasmodium falciparum
SSKKNNFL

SEQ ID NO: 3345808 - protein, 9 aa, Plasmodium falciparum
SSKKRSREL

SEQ ID NO: 3345809 - protein, 18 aa, Plasmodium falciparum
SSKKTKKKNLSDNFGNDT

SEQ ID NO: 3345810 - protein, 9 aa, Plasmodium falciparum
SSKLDDSTL

SEQ ID NO: 3345811 - protein, 24 aa, Plasmodium falciparum
SSKLGNKNKFKNENDEFEEEEEEI

SEQ ID NO: 3345812 - protein, 7 aa, Plasmodium falciparum
SSKLNQG

SEQ ID NO: 3345813 - protein, 20 aa, Plasmodium falciparum
SSKLQEREKKLKEKKNELQK

SEQ ID NO: 3345814 - protein, 10 aa, Plasmodium falciparum
SSKMRPFNDT

SEQ ID NO: 3345815 - protein, 19 aa, Plasmodium falciparum
SSKNAGDARFTDTRQDEQE

SEQ ID NO: 3345816 - protein, 13 aa, Plasmodium falciparum
SSKNEKQNETNIS

SEQ ID NO: 3345817 - protein, 9 aa, Plasmodium falciparum
SSKNEKYGK

SEQ ID NO: 3345818 - protein, 9 aa, Plasmodium falciparum
SSKNERNHI

SEQ ID NO: 3345819 - protein, 9 aa, Plasmodium falciparum
SSKNGENSL

SEQ ID NO: 3345820 - protein, 14 aa, Plasmodium falciparum
SSKNKDMKKSTYDE

SEQ ID NO: 3345821 - protein, 31 aa, Plasmodium falciparum
SSKNKSNMNKRQHDKNKTQSDSSSCYKETNN

SEQ ID NO: 3345822 - protein, 7 aa, Plasmodium falciparum
SSKNNIL

SEQ ID NO: 3345823 - protein, 14 aa, Plasmodium falciparum
SSKNNKKNSNLKKS

SEQ ID NO: 3345824 - protein, 12 aa, Plasmodium falciparum
SSKNNNNHIHNS

SEQ ID NO: 3345825 - protein, 17 aa, Plasmodium falciparum
SSKNRSIKYGDEYEEEI

SEQ ID NO: 3345826 - protein, 10 aa, Plasmodium falciparum
SSKQKQKKVQ

SEQ ID NO: 3345827 - protein, 16 aa, Plasmodium falciparum
SSKQRRGVAPNHTSLA

SEQ ID NO: 3345828 - protein, 5 aa, Plasmodium falciparum
SSKRD

SEQ ID NO: 3345829 - protein, 6 aa, Plasmodium falciparum
SSKRIA

SEQ ID NO: 3345830 - protein, 7 aa, Plasmodium falciparum
SSKRTYD

SEQ ID NO: 3345831 - protein, 26 aa, Plasmodium falciparum
SSKRVNKSRNKNKLPDNNRNNNNNMK

SEQ ID NO: 3345832 - protein, 4 aa, Plasmodium falciparum
SSKS

SEQ ID NO: 3345833 - protein, 8 aa, Plasmodium falciparum
SSKSPLNI

SEQ ID NO: 3345834 - protein, 8 aa, Plasmodium falciparum
SSKTIHER

SEQ ID NO: 3345835 - protein, 8 aa, Plasmodium falciparum
SSKTINKG

SEQ ID NO: 3345836 - protein, 30 aa, Plasmodium falciparum
SSKTLNIDNGEEEYEKLGNERRDVQNMNDA

SEQ ID NO: 3345837 - protein, 94 aa, Plasmodium falciparum
SSKTNKEKYKYEGKKKDEKKKKDEGEYTNDDNKYVNDENKYVNDDNKYVNDENKYVNDENKYVNNDNKYVNNDNKYVNNDNKYTYDENTKKDKV

SEQ ID NO: 3345838 - protein, 7 aa, Plasmodium falciparum
SSKTNNH

SEQ ID NO: 3345839 - protein, 29 aa, Plasmodium falciparum
SSKTNNKTNSNYSSNNNNDNNNNNNNSNP

SEQ ID NO: 3345840 - protein, 8 aa, Plasmodium falciparum
SSKTNVNN

SEQ ID NO: 3345841 - protein, 8 aa, Plasmodium falciparum
SSKTSNEP

SEQ ID NO: 3345842 - protein, 19 aa, Plasmodium falciparum
SSKTTNINRPSVNRGGINE

SEQ ID NO: 3345843 - protein, 9 aa, Plasmodium falciparum
SSKYGANEY

SEQ ID NO: 3345844 - protein, 12 aa, Plasmodium falciparum
SSKYSSSNNNTV

SEQ ID NO: 3345845 - protein, 27 aa, Plasmodium falciparum
SSLDAKKKKRKNSRSSKNRNTLETPYD

SEQ ID NO: 3345846 - protein, 13 aa, Plasmodium falciparum
SSLDEKCDEEEIN

SEQ ID NO: 3345847 - protein, 5 aa, Plasmodium falciparum
SSLET

SEQ ID NO: 3345848 - protein, 22 aa, Plasmodium falciparum
SSLGDKDNNKTKKSVLGKSGTI

SEQ ID NO: 3345849 - protein, 5 aa, Plasmodium falciparum
SSLGG

SEQ ID NO: 3345850 - protein, 6 aa, Plasmodium falciparum
SSLKNG

SEQ ID NO: 3345851 - protein, 31 aa, Plasmodium falciparum
SSLKNNEDVTKKDIEDKEKKNVQQNEKNQSF

SEQ ID NO: 3345852 - protein, 12 aa, Plasmodium falciparum
SSLNNNYSPNNI

SEQ ID NO: 3345853 - protein, 8 aa, Plasmodium falciparum
SSLNNTNE

SEQ ID NO: 3345854 - protein, 6 aa, Plasmodium falciparum
SSLPTV

SEQ ID NO: 3345855 - protein, 18 aa, Plasmodium falciparum
SSLRNKQKDDEEKKREKK

SEQ ID NO: 3345856 - protein, 4 aa, Plasmodium falciparum
SSLS

SEQ ID NO: 3345857 - protein, 10 aa, Plasmodium falciparum
SSLSNDNPNF

SEQ ID NO: 3345858 - protein, 9 aa, Plasmodium falciparum
SSLSNKGYY

SEQ ID NO: 3345859 - protein, 5 aa, Plasmodium falciparum
SSLSS

SEQ ID NO: 3345860 - protein, 16 aa, Plasmodium falciparum
SSLSSSLKGKTSKDDL

SEQ ID NO: 3345861 - protein, 13 aa, Plasmodium falciparum
SSLSSSSNGAYDS

SEQ ID NO: 3345862 - protein, 11 aa, Plasmodium falciparum
SSLTHSNESYK

SEQ ID NO: 3345863 - protein, 5 aa, Plasmodium falciparum
SSLTK

SEQ ID NO: 3345864 - protein, 6 aa, Plasmodium falciparum
SSLTQE

SEQ ID NO: 3345865 - protein, 16 aa, Plasmodium falciparum
SSLTSNNENPQNTATL

SEQ ID NO: 3345866 - protein, 39 aa, Plasmodium falciparum
SSMDNNKKKGFKEKNNDNNNNNNNNNTNIDNNDNNIDNN

SEQ ID NO: 3345867 - protein, 10 aa, Plasmodium falciparum
SSMSQNNKEF

SEQ ID NO: 3345868 - protein, 7 aa, Plasmodium falciparum
SSMTTNT

SEQ ID NO: 3345869 - protein, 8 aa, Plasmodium falciparum
SSNAPSVQ

SEQ ID NO: 3345870 - protein, 8 aa, Plasmodium falciparum
SSNATTKY

SEQ ID NO: 3345871 - protein, 11 aa, Plasmodium falciparum
SSNDEEKQNCD

SEQ ID NO: 3345872 - protein, 16 aa, Plasmodium falciparum
SSNDENIKTNEPNNSI

SEQ ID NO: 3345873 - protein, 10 aa, Plasmodium falciparum
SSNDEPTPGY

SEQ ID NO: 3345874 - protein, 10 aa, Plasmodium falciparum
SSNDEQKNKI

SEQ ID NO: 3345875 - protein, 5 aa, Plasmodium falciparum
SSNDG

SEQ ID NO: 3345876 - protein, 31 aa, Plasmodium falciparum
SSNDIKKNYSLKNKNNNNRDKNNQHNKREDV

SEQ ID NO: 3345877 - protein, 5 aa, Plasmodium falciparum
SSNDK

SEQ ID NO: 3345878 - protein, 6 aa, Plasmodium falciparum
SSNDLV

SEQ ID NO: 3345879 - protein, 8 aa, Plasmodium falciparum
SSNDRKSY

SEQ ID NO: 3345880 - protein, 9 aa, Plasmodium falciparum
SSNDRNMNN

SEQ ID NO: 3345881 - protein, 7 aa, Plasmodium falciparum
SSNEELS

SEQ ID NO: 3345882 - protein, 35 aa, Plasmodium falciparum
SSNEENNNESSNKDDNDNNNNNNNIYNENTKMKND

SEQ ID NO: 3345883 - protein, 10 aa, Plasmodium falciparum
SSNEGTSKNI

SEQ ID NO: 3345884 - protein, 7 aa, Plasmodium falciparum
SSNEKKK

SEQ ID NO: 3345885 - protein, 11 aa, Plasmodium falciparum
SSNELKNNPFS

SEQ ID NO: 3345886 - protein, 8 aa, Plasmodium falciparum
SSNEPEDK

SEQ ID NO: 3345887 - protein, 8 aa, Plasmodium falciparum
SSNESNKN

SEQ ID NO: 3345888 - protein, 22 aa, Plasmodium falciparum
SSNEYKDANNDSSDEEDDEYLN

SEQ ID NO: 3345889 - protein, 7 aa, Plasmodium falciparum
SSNEYKE

SEQ ID NO: 3345890 - protein, 16 aa, Plasmodium falciparum
SSNEYNITKGEQTSDV

SEQ ID NO: 3345891 - protein, 5 aa, Plasmodium falciparum
SSNFS

SEQ ID NO: 3345892 - protein, 4 aa, Plasmodium falciparum
SSNG

SEQ ID NO: 3345893 - protein, 11 aa, Plasmodium falciparum
SSNGDNIKQNE

SEQ ID NO: 3345894 - protein, 5 aa, Plasmodium falciparum
SSNGK

SEQ ID NO: 3345895 - protein, 7 aa, Plasmodium falciparum
SSNGTLL

SEQ ID NO: 3345896 - protein, 24 aa, Plasmodium falciparum
SSNGTNKKKELNNDNSNNFDESQR

SEQ ID NO: 3345897 - protein, 5 aa, Plasmodium falciparum
SSNGY

SEQ ID NO: 3345898 - protein, 7 aa, Plasmodium falciparum
SSNIENE

SEQ ID NO: 3345899 - protein, 9 aa, Plasmodium falciparum
SSNIKEHPV

SEQ ID NO: 3345900 - protein, 10 aa, Plasmodium falciparum
SSNISPTNVR

SEQ ID NO: 3345901 - protein, 7 aa, Plasmodium falciparum
SSNISST

SEQ ID NO: 3345902 - protein, 10 aa, Plasmodium falciparum
SSNKAEPPGL

SEQ ID NO: 3345903 - protein, 8 aa, Plasmodium falciparum
SSNKEGVG

SEQ ID NO: 3345904 - protein, 7 aa, Plasmodium falciparum
SSNKKED

SEQ ID NO: 3345905 - protein, 9 aa, Plasmodium falciparum
SSNKNNPKL

SEQ ID NO: 3345906 - protein, 6 aa, Plasmodium falciparum
SSNKSK

SEQ ID NO: 3345907 - protein, 10 aa, Plasmodium falciparum
SSNLKSEKVR

SEQ ID NO: 3345908 - protein, 9 aa, Plasmodium falciparum
SSNLNQNGI

SEQ ID NO: 3345909 - protein, 7 aa, Plasmodium falciparum
SSNLNTT

SEQ ID NO: 3345910 - protein, 6 aa, Plasmodium falciparum
SSNLSN

SEQ ID NO: 3345911 - protein, 4 aa, Plasmodium falciparum
SSNM

SEQ ID NO: 3345912 - protein, 52 aa, Plasmodium falciparum
SSNMDNQNVETLKDKNNVVDSNDTSDEEEYNEGNLEHKNETRYHEATNEYSN

SEQ ID NO: 3345913 - protein, 4 aa, Plasmodium falciparum
SSNN

SEQ ID NO: 3345914 - protein, 13 aa, Plasmodium falciparum
SSNNDNNVYTTNM

SEQ ID NO: 3345915 - protein, 8 aa, Plasmodium falciparum
SSNNDSNM

SEQ ID NO: 3345916 - protein, 5 aa, Plasmodium falciparum
SSNNG

SEQ ID NO: 3345917 - protein, 5 aa, Plasmodium falciparum
SSNNI

SEQ ID NO: 3345918 - protein, 21 aa, Plasmodium falciparum
SSNNIKNDQEKSSLNDNKNFD

SEQ ID NO: 3345919 - protein, 13 aa, Plasmodium falciparum
SSNNKKKEKYEKD

SEQ ID NO: 3345920 - protein, 10 aa, Plasmodium falciparum
SSNNKNKNEF

SEQ ID NO: 3345921 - protein, 23 aa, Plasmodium falciparum
SSNNKNNNTNKKRRSKKKDSVVK

SEQ ID NO: 3345922 - protein, 8 aa, Plasmodium falciparum
SSNNKSYH

SEQ ID NO: 3345923 - protein, 19 aa, Plasmodium falciparum
SSNNNMNEQEKKNDNINNQ

SEQ ID NO: 3345924 - protein, 20 aa, Plasmodium falciparum
SSNNNNKYNNDDDNNNNNNY

SEQ ID NO: 3345925 - protein, 11 aa, Plasmodium falciparum
SSNNNNNNITG

SEQ ID NO: 3345926 - protein, 9 aa, Plasmodium falciparum
SSNNNNNNN

SEQ ID NO: 3345927 - protein, 38 aa, Plasmodium falciparum
SSNNNNNNNNNNNNNNNNNNNNNNNNNNNNNNNNNNNI

SEQ ID NO: 3345928 - protein, 36 aa, Plasmodium falciparum
SSNNNNNNNNNNNNNNYGNFNNNKDSPRSKKKRFDA

SEQ ID NO: 3345929 - protein, 28 aa, Plasmodium falciparum
SSNNNNNNNNNNTYNNINNNNVDDFNNS

SEQ ID NO: 3345930 - protein, 21 aa, Plasmodium falciparum
SSNNNNNNSNSSTTVASGPSN

SEQ ID NO: 3345931 - protein, 13 aa, Plasmodium falciparum
SSNNNSTNGDNNL

SEQ ID NO: 3345932 - protein, 10 aa, Plasmodium falciparum
SSNNNSVQSS

SEQ ID NO: 3345933 - protein, 5 aa, Plasmodium falciparum
SSNNS

SEQ ID NO: 3345934 - protein, 6 aa, Plasmodium falciparum
SSNNSS

SEQ ID NO: 3345935 - protein, 9 aa, Plasmodium falciparum
SSNNSTTEL

SEQ ID NO: 3345936 - protein, 31 aa, Plasmodium falciparum
SSNNTKSNKKKINKSKNKSKSKKNEKNEKRI

SEQ ID NO: 3345937 - protein, 17 aa, Plasmodium falciparum
SSNNTNLSKSKTSNDNI

SEQ ID NO: 3345938 - protein, 5 aa, Plasmodium falciparum
SSNNV

SEQ ID NO: 3345939 - protein, 9 aa, Plasmodium falciparum
SSNNYNNKK

SEQ ID NO: 3345940 - protein, 17 aa, Plasmodium falciparum
SSNNYSDKEMSEGNKEL

SEQ ID NO: 3345941 - protein, 8 aa, Plasmodium falciparum
SSNNYSSY

SEQ ID NO: 3345942 - protein, 9 aa, Plasmodium falciparum
SSNPFSNEK

SEQ ID NO: 3345943 - protein, 6 aa, Plasmodium falciparum
SSNPIE

SEQ ID NO: 3345944 - protein, 15 aa, Plasmodium falciparum
SSNPQSTDNYSSEEY

SEQ ID NO: 3345945 - protein, 9 aa, Plasmodium falciparum
SSNPSNCKK

SEQ ID NO: 3345946 - protein, 25 aa, Plasmodium falciparum
SSNPSTKGLNKQNNNYDKKKMDKAN

SEQ ID NO: 3345947 - protein, 10 aa, Plasmodium falciparum
SSNPVEDEYK

SEQ ID NO: 3345948 - protein, 7 aa, Plasmodium falciparum
SSNPVNQ

SEQ ID NO: 3345949 - protein, 4 aa, Plasmodium falciparum
SSNQ

SEQ ID NO: 3345950 - protein, 5 aa, Plasmodium falciparum
SSNQF

SEQ ID NO: 3345951 - protein, 5 aa, Plasmodium falciparum
SSNQP

SEQ ID NO: 3345952 - protein, 4 aa, Plasmodium falciparum
SSNR

SEQ ID NO: 3345953 - protein, 8 aa, Plasmodium falciparum
SSNRDSTV

SEQ ID NO: 3345954 - protein, 12 aa, Plasmodium falciparum
SSNRKKYSDQIS

SEQ ID NO: 3345955 - protein, 12 aa, Plasmodium falciparum
SSNRNRNNINDE

SEQ ID NO: 3345956 - protein, 13 aa, Plasmodium falciparum
SSNRVTKNKYSDM

SEQ ID NO: 3345957 - protein, 15 aa, Plasmodium falciparum
SSNSDGDSSSSSYDH

SEQ ID NO: 3345958 - protein, 15 aa, Plasmodium falciparum
SSNSFSSNSDTTLSY

SEQ ID NO: 3345959 - protein, 9 aa, Plasmodium falciparum
SSNSNCKDE

SEQ ID NO: 3345960 - protein, 58 aa, Plasmodium falciparum
SSNSNNYNNNNNNGNNYNNNNNNNYNNNNNNNNGNNFNKNNKKKFSKPFNNFKNKKSF

SEQ ID NO: 3345961 - protein, 13 aa, Plasmodium falciparum
SSNSNNYSNNNSN

SEQ ID NO: 3345962 - protein, 9 aa, Plasmodium falciparum
SSNSNQFSR

SEQ ID NO: 3345963 - protein, 9 aa, Plasmodium falciparum
SSNSPKKNI

SEQ ID NO: 3345964 - protein, 17 aa, Plasmodium falciparum
SSNSPYDKNKKLKDDEF

SEQ ID NO: 3345965 - protein, 10 aa, Plasmodium falciparum
SSNSSHLSNV

SEQ ID NO: 3345966 - protein, 17 aa, Plasmodium falciparum
SSNSSKDFTSNNEENNF

SEQ ID NO: 3345967 - protein, 9 aa, Plasmodium falciparum
SSNSTTNLT

SEQ ID NO: 3345968 - protein, 8 aa, Plasmodium falciparum
SSNSYEDG

SEQ ID NO: 3345969 - protein, 10 aa, Plasmodium falciparum
SSNTDSWNDP

SEQ ID NO: 3345970 - protein, 9 aa, Plasmodium falciparum
SSNTLKEGN

SEQ ID NO: 3345971 - protein, 8 aa, Plasmodium falciparum
SSNTNKDA

SEQ ID NO: 3345972 - protein, 14 aa, Plasmodium falciparum
SSNTPRVDNKKGEY

SEQ ID NO: 3345973 - protein, 4 aa, Plasmodium falciparum
SSNV

SEQ ID NO: 3345974 - protein, 5 aa, Plasmodium falciparum
SSNVQ

SEQ ID NO: 3345975 - protein, 5 aa, Plasmodium falciparum
SSNVT

SEQ ID NO: 3345976 - protein, 13 aa, Plasmodium falciparum
SSNVTNRNNKNEF

SEQ ID NO: 3345977 - protein, 7 aa, Plasmodium falciparum
SSNYEDN

SEQ ID NO: 3345978 - protein, 6 aa, Plasmodium falciparum
SSNYGS

SEQ ID NO: 3345979 - protein, 6 aa, Plasmodium falciparum
SSNYHN

SEQ ID NO: 3345980 - protein, 8 aa, Plasmodium falciparum
SSNYNELD

SEQ ID NO: 3345981 - protein, 9 aa, Plasmodium falciparum
SSNYNKIKS

SEQ ID NO: 3345982 - protein, 7 aa, Plasmodium falciparum
SSNYPNV

SEQ ID NO: 3345983 - protein, 4 aa, Plasmodium falciparum
SSPD

SEQ ID NO: 3345984 - protein, 8 aa, Plasmodium falciparum
SSPEDNSY

SEQ ID NO: 3345985 - protein, 11 aa, Plasmodium falciparum
SSPEPDDPLDS

SEQ ID NO: 3345986 - protein, 7 aa, Plasmodium falciparum
SSPFGND

SEQ ID NO: 3345987 - protein, 7 aa, Plasmodium falciparum
SSPGSKA

SEQ ID NO: 3345988 - protein, 5 aa, Plasmodium falciparum
SSPKI

SEQ ID NO: 3345989 - protein, 9 aa, Plasmodium falciparum
SSPNTENTF

SEQ ID NO: 3345990 - protein, 25 aa, Plasmodium falciparum
SSPQIQDDDYNKNDDTHNKGGDDNI

SEQ ID NO: 3345991 - protein, 5 aa, Plasmodium falciparum
SSPQT

SEQ ID NO: 3345992 - protein, 25 aa, Plasmodium falciparum
SSPRNINEEGNKKKDSKKNKKGTKV

SEQ ID NO: 3345993 - protein, 9 aa, Plasmodium falciparum
SSPRNMKKS

SEQ ID NO: 3345994 - protein, 33 aa, Plasmodium falciparum
SSPSDDNISTLKKKKKNSYKDNTSYNIKTNGTD

SEQ ID NO: 3345995 - protein, 13 aa, Plasmodium falciparum
SSPSFSSNTKDDY

SEQ ID NO: 3345996 - protein, 14 aa, Plasmodium falciparum
SSPSPVLSSSHTEH

SEQ ID NO: 3345997 - protein, 15 aa, Plasmodium falciparum
SSPSSLSSSSSSSSF

SEQ ID NO: 3345998 - protein, 11 aa, Plasmodium falciparum
SSQANNLNSRP

SEQ ID NO: 3345999 - protein, 5 aa, Plasmodium falciparum
SSQCK

SEQ ID NO: 3346000 - protein, 9 aa, Plasmodium falciparum
SSQGDEKCE

SEQ ID NO: 3346001 - protein, 28 aa, Plasmodium falciparum
SSQGNNDDLSNDNYLSSEELNTDEYDDD

SEQ ID NO: 3346002 - protein, 7 aa, Plasmodium falciparum
SSQGNSI

SEQ ID NO: 3346003 - protein, 5 aa, Plasmodium falciparum
SSQGY

SEQ ID NO: 3346004 - protein, 7 aa, Plasmodium falciparum
SSQKDFQ

SEQ ID NO: 3346005 - protein, 8 aa, Plasmodium falciparum
SSQPNQEY

SEQ ID NO: 3346006 - protein, 4 aa, Plasmodium falciparum
SSQS

SEQ ID NO: 3346007 - protein, 15 aa, Plasmodium falciparum
SSQSCNEKRERYSNY

SEQ ID NO: 3346008 - protein, 9 aa, Plasmodium falciparum
SSQSDHEEI

SEQ ID NO: 3346009 - protein, 5 aa, Plasmodium falciparum
SSQSV

SEQ ID NO: 3346010 - protein, 5 aa, Plasmodium falciparum
SSQTG

SEQ ID NO: 3346011 - protein, 21 aa, Plasmodium falciparum
SSQTSEGKTTSKSSGKDPREA

SEQ ID NO: 3346012 - protein, 4 aa, Plasmodium falciparum
SSRE

SEQ ID NO: 3346013 - protein, 9 aa, Plasmodium falciparum
SSREDSDIR

SEQ ID NO: 3346014 - protein, 8 aa, Plasmodium falciparum
SSREKENY

SEQ ID NO: 3346015 - protein, 5 aa, Plasmodium falciparum
SSRGL

SEQ ID NO: 3346016 - protein, 18 aa, Plasmodium falciparum
SSRKDQSIKNNTNKNNIH

SEQ ID NO: 3346017 - protein, 25 aa, Plasmodium falciparum
SSRLNKKDNKNDARHKSENKNKLYN

SEQ ID NO: 3346018 - protein, 6 aa, Plasmodium falciparum
SSRMNN

SEQ ID NO: 3346019 - protein, 22 aa, Plasmodium falciparum
SSRNLDTTSSINYNQKTKKNIY

SEQ ID NO: 3346020 - protein, 9 aa, Plasmodium falciparum
SSRNMEEPQ

SEQ ID NO: 3346021 - protein, 5 aa, Plasmodium falciparum
SSRNY

SEQ ID NO: 3346022 - protein, 51 aa, Plasmodium falciparum
SSRRSNRRTSQNSSINNKTEHESYNRKESNKYYENKKRKYNDYQNKDNTNY

SEQ ID NO: 3346023 - protein, 8 aa, Plasmodium falciparum
SSRRSVSA

SEQ ID NO: 3346024 - protein, 10 aa, Plasmodium falciparum
SSRRTKNSKS

SEQ ID NO: 3346025 - protein, 6 aa, Plasmodium falciparum
SSRSEH

SEQ ID NO: 3346026 - protein, 23 aa, Plasmodium falciparum
SSRSSDEENDKGECKQSNEMSNI

SEQ ID NO: 3346027 - protein, 16 aa, Plasmodium falciparum
SSRSSSNINNSSDDTK

SEQ ID NO: 3346028 - protein, 164 aa, Plasmodium falciparum
SSRSVSSDSNKSESNKIESNESVSSRSVSSESNKSESNKSESNKSESNESESNKSESNESESNKSESNKSESNKSESNESESNKSESNESESNESYSKKSISNKKYKNKRYKNKRDKNKRYKNKRYKSKRYKSKSKSSLSSCDEKKKKGYEEFEEDDKNTEETL

SEQ ID NO: 3346029 - protein, 6 aa, Plasmodium falciparum
SSRTFS

SEQ ID NO: 3346030 - protein, 4 aa, Plasmodium falciparum
SSRW

SEQ ID NO: 3346031 - protein, 14 aa, Plasmodium falciparum
SSRYNYKTYKKKKK

SEQ ID NO: 3346032 - protein, 6 aa, Plasmodium falciparum
SSSAKD

SEQ ID NO: 3346033 - protein, 10 aa, Plasmodium falciparum
SSSANDPNIK

SEQ ID NO: 3346034 - protein, 9 aa, Plasmodium falciparum
SSSAREEDV

SEQ ID NO: 3346035 - protein, 21 aa, Plasmodium falciparum
SSSASISERRRNKRKRRRSRS

SEQ ID NO: 3346036 - protein, 30 aa, Plasmodium falciparum
SSSDENYKKRSNIQHNKNNEKFNKSNDSQF

SEQ ID NO: 3346037 - protein, 9 aa, Plasmodium falciparum
SSSDEQEYS

SEQ ID NO: 3346038 - protein, 5 aa, Plasmodium falciparum
SSSDG

SEQ ID NO: 3346039 - protein, 21 aa, Plasmodium falciparum
SSSDILRTSDKGNSHNPTTYY

SEQ ID NO: 3346040 - protein, 15 aa, Plasmodium falciparum
SSSDITSSSESEYEE

SEQ ID NO: 3346041 - protein, 16 aa, Plasmodium falciparum
SSSDPNKLNTTPSPFG

SEQ ID NO: 3346042 - protein, 7 aa, Plasmodium falciparum
SSSDSDL

SEQ ID NO: 3346043 - protein, 12 aa, Plasmodium falciparum
SSSDSSNSNQNN

SEQ ID NO: 3346044 - protein, 14 aa, Plasmodium falciparum
SSSDTRNNSNKIKR

SEQ ID NO: 3346045 - protein, 4 aa, Plasmodium falciparum
SSSE

SEQ ID NO: 3346046 - protein, 8 aa, Plasmodium falciparum
SSSEEEAL

SEQ ID NO: 3346047 - protein, 8 aa, Plasmodium falciparum
SSSENEDK

SEQ ID NO: 3346048 - protein, 13 aa, Plasmodium falciparum
SSSENGNDEEIDS

SEQ ID NO: 3346049 - protein, 8 aa, Plasmodium falciparum
SSSERNIE

SEQ ID NO: 3346050 - protein, 7 aa, Plasmodium falciparum
SSSESFE

SEQ ID NO: 3346051 - protein, 14 aa, Plasmodium falciparum
SSSESGKGATVSHT

SEQ ID NO: 3346052 - protein, 7 aa, Plasmodium falciparum
SSSESHI

SEQ ID NO: 3346053 - protein, 39 aa, Plasmodium falciparum
SSSEYDDSEDDEEENEESEEEEVDEENYDSGYSTTKNHS

SEQ ID NO: 3346054 - protein, 5 aa, Plasmodium falciparum
SSSFE

SEQ ID NO: 3346055 - protein, 7 aa, Plasmodium falciparum
SSSFNNK

SEQ ID NO: 3346056 - protein, 29 aa, Plasmodium falciparum
SSSFNSKDNIYKKNKKISKNLKKRNSEPD

SEQ ID NO: 3346057 - protein, 8 aa, Plasmodium falciparum
SSSGTTTA

SEQ ID NO: 3346058 - protein, 8 aa, Plasmodium falciparum
SSSIGTYD

SEQ ID NO: 3346059 - protein, 8 aa, Plasmodium falciparum
SSSIKNTK

SEQ ID NO: 3346060 - protein, 20 aa, Plasmodium falciparum
SSSINNNNNDNNNNNNNGDH

SEQ ID NO: 3346061 - protein, 6 aa, Plasmodium falciparum
SSSIRN

SEQ ID NO: 3346062 - protein, 5 aa, Plasmodium falciparum
SSSIS

SEQ ID NO: 3346063 - protein, 7 aa, Plasmodium falciparum
SSSISSD

SEQ ID NO: 3346064 - protein, 6 aa, Plasmodium falciparum
SSSITL

SEQ ID NO: 3346065 - protein, 6 aa, Plasmodium falciparum
SSSKCV

SEQ ID NO: 3346066 - protein, 7 aa, Plasmodium falciparum
SSSKDNT

SEQ ID NO: 3346067 - protein, 13 aa, Plasmodium falciparum
SSSKEKSKQNPLQ

SEQ ID NO: 3346068 - protein, 33 aa, Plasmodium falciparum
SSSKGIVNSTPDYQKIQPSTLSNYNDKESDFSF

SEQ ID NO: 3346069 - protein, 12 aa, Plasmodium falciparum
SSSKKNISSNEW

SEQ ID NO: 3346070 - protein, 10 aa, Plasmodium falciparum
SSSKNMNEEE

SEQ ID NO: 3346071 - protein, 7 aa, Plasmodium falciparum
SSSKSYN

SEQ ID NO: 3346072 - protein, 15 aa, Plasmodium falciparum
SSSLNNEEEENTAKM

SEQ ID NO: 3346073 - protein, 8 aa, Plasmodium falciparum
SSSLTNRK

SEQ ID NO: 3346074 - protein, 6 aa, Plasmodium falciparum
SSSMDK

SEQ ID NO: 3346075 - protein, 21 aa, Plasmodium falciparum
SSSMGNIKNNNKYNSKKKRNY

SEQ ID NO: 3346076 - protein, 4 aa, Plasmodium falciparum
SSSN

SEQ ID NO: 3346077 - protein, 14 aa, Plasmodium falciparum
SSSNEKKNNVLEND

SEQ ID NO: 3346078 - protein, 7 aa, Plasmodium falciparum
SSSNEMK

SEQ ID NO: 3346079 - protein, 9 aa, Plasmodium falciparum
SSSNEPSLD

SEQ ID NO: 3346080 - protein, 9 aa, Plasmodium falciparum
SSSNGMNEN

SEQ ID NO: 3346081 - protein, 5 aa, Plasmodium falciparum
SSSNH

SEQ ID NO: 3346082 - protein, 21 aa, Plasmodium falciparum
SSSNNHSDIQKKRNKNPKGKE

SEQ ID NO: 3346083 - protein, 7 aa, Plasmodium falciparum
SSSNNLE

SEQ ID NO: 3346084 - protein, 8 aa, Plasmodium falciparum
SSSNSSFS

SEQ ID NO: 3346085 - protein, 9 aa, Plasmodium falciparum
SSSNTTNSI

SEQ ID NO: 3346086 - protein, 5 aa, Plasmodium falciparum
SSSNV

SEQ ID NO: 3346087 - protein, 7 aa, Plasmodium falciparum
SSSPNLL

SEQ ID NO: 3346088 - protein, 7 aa, Plasmodium falciparum
SSSPNLT

SEQ ID NO: 3346089 - protein, 29 aa, Plasmodium falciparum
SSSPNNHTCGTNHGNNNYTSCANNSSSLN

SEQ ID NO: 3346090 - protein, 13 aa, Plasmodium falciparum
SSSQKKKSYSNGL

SEQ ID NO: 3346091 - protein, 6 aa, Plasmodium falciparum
SSSRDE

SEQ ID NO: 3346092 - protein, 13 aa, Plasmodium falciparum
SSSRSNNNQNVNS

SEQ ID NO: 3346093 - protein, 7 aa, Plasmodium falciparum
SSSRSSF

SEQ ID NO: 3346094 - protein, 16 aa, Plasmodium falciparum
SSSSDDNNENEEISSK

SEQ ID NO: 3346095 - protein, 11 aa, Plasmodium falciparum
SSSSDIKTDAK

SEQ ID NO: 3346096 - protein, 31 aa, Plasmodium falciparum
SSSSDSSYYNNKKKKEKTHRDKKNEEDKSYD

SEQ ID NO: 3346097 - protein, 32 aa, Plasmodium falciparum
SSSSEKIKKKKKQKELEYKEKEKKKKKNSDNV

SEQ ID NO: 3346098 - protein, 6 aa, Plasmodium falciparum
SSSSFK

SEQ ID NO: 3346099 - protein, 23 aa, Plasmodium falciparum
SSSSKKNKKEKGKDNKGKEKEKK

SEQ ID NO: 3346100 - protein, 8 aa, Plasmodium falciparum
SSSSLKKK

SEQ ID NO: 3346101 - protein, 8 aa, Plasmodium falciparum
SSSSNTSL

SEQ ID NO: 3346102 - protein, 16 aa, Plasmodium falciparum
SSSSPYSYDNTNEDDI

SEQ ID NO: 3346103 - protein, 8 aa, Plasmodium falciparum
SSSSSIKE

SEQ ID NO: 3346104 - protein, 23 aa, Plasmodium falciparum
SSSSSKDIKTNHNIEKKQGNIED

SEQ ID NO: 3346105 - protein, 35 aa, Plasmodium falciparum
SSSSSSSSSSSSSSLSDDSHVNEKKLNDSSNKNYN

SEQ ID NO: 3346106 - protein, 17 aa, Plasmodium falciparum
SSSSYSGYDSTDDGTLN

SEQ ID NO: 3346107 - protein, 10 aa, Plasmodium falciparum
SSSTASSATN

SEQ ID NO: 3346108 - protein, 9 aa, Plasmodium falciparum
SSSTGAKNY

SEQ ID NO: 3346109 - protein, 14 aa, Plasmodium falciparum
SSSTLPYKRKQPSW

SEQ ID NO: 3346110 - protein, 11 aa, Plasmodium falciparum
SSSTNGNNNMN

SEQ ID NO: 3346111 - protein, 9 aa, Plasmodium falciparum
SSSTNSNYQ

SEQ ID NO: 3346112 - protein, 9 aa, Plasmodium falciparum
SSSTNTCDT

SEQ ID NO: 3346113 - protein, 6 aa, Plasmodium falciparum
SSSTSD

SEQ ID NO: 3346114 - protein, 17 aa, Plasmodium falciparum
SSSTSHNNNNNNKNNNV

SEQ ID NO: 3346115 - protein, 8 aa, Plasmodium falciparum
SSSTTKKK

SEQ ID NO: 3346116 - protein, 13 aa, Plasmodium falciparum
SSSTYEEKIQNSN

SEQ ID NO: 3346117 - protein, 7 aa, Plasmodium falciparum
SSSVKAS

SEQ ID NO: 3346118 - protein, 7 aa, Plasmodium falciparum
SSSVKKN

SEQ ID NO: 3346119 - protein, 8 aa, Plasmodium falciparum
SSSVNEDE

SEQ ID NO: 3346120 - protein, 7 aa, Plasmodium falciparum
SSSVNNS

SEQ ID NO: 3346121 - protein, 6 aa, Plasmodium falciparum
SSSVPC

SEQ ID NO: 3346122 - protein, 15 aa, Plasmodium falciparum
SSSVQSDDMNEEEYE

SEQ ID NO: 3346123 - protein, 5 aa, Plasmodium falciparum
SSSYI

SEQ ID NO: 3346124 - protein, 7 aa, Plasmodium falciparum
SSSYNKA

SEQ ID NO: 3346125 - protein, 9 aa, Plasmodium falciparum
SSSYTNEGA

SEQ ID NO: 3346126 - protein, 7 aa, Plasmodium falciparum
SSTAGSN

SEQ ID NO: 3346127 - protein, 11 aa, Plasmodium falciparum
SSTAKYFPNEK

SEQ ID NO: 3346128 - protein, 47 aa, Plasmodium falciparum
SSTASKKCQGQKKVKNKGNVGKRDNKYKDKNKDEYENNNNNNNMNEE

SEQ ID NO: 3346129 - protein, 7 aa, Plasmodium falciparum
SSTDDYN

SEQ ID NO: 3346130 - protein, 6 aa, Plasmodium falciparum
SSTDGT

SEQ ID NO: 3346131 - protein, 11 aa, Plasmodium falciparum
SSTDISKEKYE

SEQ ID NO: 3346132 - protein, 9 aa, Plasmodium falciparum
SSTDRDENK

SEQ ID NO: 3346133 - protein, 4 aa, Plasmodium falciparum
SSTE

SEQ ID NO: 3346134 - protein, 18 aa, Plasmodium falciparum
SSTFGRKDKKLKKEKKLK

SEQ ID NO: 3346135 - protein, 12 aa, Plasmodium falciparum
SSTFNHDTNNRL

SEQ ID NO: 3346136 - protein, 10 aa, Plasmodium falciparum
SSTHSNDEEY

SEQ ID NO: 3346137 - protein, 6 aa, Plasmodium falciparum
SSTIQE

SEQ ID NO: 3346138 - protein, 8 aa, Plasmodium falciparum
SSTKARTN

SEQ ID NO: 3346139 - protein, 10 aa, Plasmodium falciparum
SSTKDDTEIP

SEQ ID NO: 3346140 - protein, 6 aa, Plasmodium falciparum
SSTKGT

SEQ ID NO: 3346141 - protein, 15 aa, Plasmodium falciparum
SSTKLKSNLTNEEGL

SEQ ID NO: 3346142 - protein, 9 aa, Plasmodium falciparum
SSTKNKLTQ

SEQ ID NO: 3346143 - protein, 7 aa, Plasmodium falciparum
SSTKQNT

SEQ ID NO: 3346144 - protein, 5 aa, Plasmodium falciparum
SSTKY

SEQ ID NO: 3346145 - protein, 11 aa, Plasmodium falciparum
SSTLAKSSDIT

SEQ ID NO: 3346146 - protein, 20 aa, Plasmodium falciparum
SSTLSHKQAKKLNNILNPNR

SEQ ID NO: 3346147 - protein, 17 aa, Plasmodium falciparum
SSTMDKNVSSDKNLQKE

SEQ ID NO: 3346148 - protein, 5 aa, Plasmodium falciparum
SSTNA

SEQ ID NO: 3346149 - protein, 8 aa, Plasmodium falciparum
SSTNENGL

SEQ ID NO: 3346150 - protein, 19 aa, Plasmodium falciparum
SSTNGKIEEEEEKIGDEEM

SEQ ID NO: 3346151 - protein, 6 aa, Plasmodium falciparum
SSTNID

SEQ ID NO: 3346152 - protein, 6 aa, Plasmodium falciparum
SSTNLG

SEQ ID NO: 3346153 - protein, 7 aa, Plasmodium falciparum
SSTNNKL

SEQ ID NO: 3346154 - protein, 8 aa, Plasmodium falciparum
SSTNNKSI

SEQ ID NO: 3346155 - protein, 8 aa, Plasmodium falciparum
SSTNNTDL

SEQ ID NO: 3346156 - protein, 9 aa, Plasmodium falciparum
SSTNSLNKY

SEQ ID NO: 3346157 - protein, 10 aa, Plasmodium falciparum
SSTNTDDGIY

SEQ ID NO: 3346158 - protein, 8 aa, Plasmodium falciparum
SSTNVERE

SEQ ID NO: 3346159 - protein, 7 aa, Plasmodium falciparum
SSTPEYE

SEQ ID NO: 3346160 - protein, 10 aa, Plasmodium falciparum
SSTQSGNTNK

SEQ ID NO: 3346161 - protein, 7 aa, Plasmodium falciparum
SSTQTYE

SEQ ID NO: 3346162 - protein, 25 aa, Plasmodium falciparum
SSTRFEKKNVKNKDFKNKNSKNTII

SEQ ID NO: 3346163 - protein, 5 aa, Plasmodium falciparum
SSTRS

SEQ ID NO: 3346164 - protein, 5 aa, Plasmodium falciparum
SSTSI

SEQ ID NO: 3346165 - protein, 13 aa, Plasmodium falciparum
SSTSKTSKCTNLT

SEQ ID NO: 3346166 - protein, 6 aa, Plasmodium falciparum
SSTSNY

SEQ ID NO: 3346167 - protein, 6 aa, Plasmodium falciparum
SSTTAV

SEQ ID NO: 3346168 - protein, 16 aa, Plasmodium falciparum
SSTTNMKNSKQKKDIN

SEQ ID NO: 3346169 - protein, 13 aa, Plasmodium falciparum
SSTVNEDTEHKEN

SEQ ID NO: 3346170 - protein, 7 aa, Plasmodium falciparum
SSTVSTA

SEQ ID NO: 3346171 - protein, 10 aa, Plasmodium falciparum
SSTYHESDNF

SEQ ID NO: 3346172 - protein, 15 aa, Plasmodium falciparum
SSTYYSKDEKEDKAK

SEQ ID NO: 3346173 - protein, 4 aa, Plasmodium falciparum
SSVD

SEQ ID NO: 3346174 - protein, 6 aa, Plasmodium falciparum
SSVGKS

SEQ ID NO: 3346175 - protein, 8 aa, Plasmodium falciparum
SSVHGSNI

SEQ ID NO: 3346176 - protein, 9 aa, Plasmodium falciparum
SSVINQNDG

SEQ ID NO: 3346177 - protein, 13 aa, Plasmodium falciparum
SSVKRSSVKSNKF

SEQ ID NO: 3346178 - protein, 5 aa, Plasmodium falciparum
SSVNK

SEQ ID NO: 3346179 - protein, 8 aa, Plasmodium falciparum
SSVNNQSM

SEQ ID NO: 3346180 - protein, 7 aa, Plasmodium falciparum
SSVPRKR

SEQ ID NO: 3346181 - protein, 10 aa, Plasmodium falciparum
SSVQDNISSA

SEQ ID NO: 3346182 - protein, 5 aa, Plasmodium falciparum
SSVRT

SEQ ID NO: 3346183 - protein, 5 aa, Plasmodium falciparum
SSVSR

SEQ ID NO: 3346184 - protein, 6 aa, Plasmodium falciparum
SSVTGK

SEQ ID NO: 3346185 - protein, 4 aa, Plasmodium falciparum
SSYD

SEQ ID NO: 3346186 - protein, 12 aa, Plasmodium falciparum
SSYDDNDDEVNP

SEQ ID NO: 3346187 - protein, 15 aa, Plasmodium falciparum
SSYDKGKEKKKQTTE

SEQ ID NO: 3346188 - protein, 16 aa, Plasmodium falciparum
SSYDNSIKNDNSRDIR

SEQ ID NO: 3346189 - protein, 7 aa, Plasmodium falciparum
SSYGNVK

SEQ ID NO: 3346190 - protein, 12 aa, Plasmodium falciparum
SSYGSTYKNEDH

SEQ ID NO: 3346191 - protein, 28 aa, Plasmodium falciparum
SSYKERNNSKNFNNVEEDNMNRDYNEDG

SEQ ID NO: 3346192 - protein, 20 aa, Plasmodium falciparum
SSYKGKNRDYNIDTNDNVNN

SEQ ID NO: 3346193 - protein, 5 aa, Plasmodium falciparum
SSYKS

SEQ ID NO: 3346194 - protein, 4 aa, Plasmodium falciparum
SSYL

SEQ ID NO: 3346195 - protein, 6 aa, Plasmodium falciparum
SSYLST

SEQ ID NO: 3346196 - protein, 13 aa, Plasmodium falciparum
SSYMNSKSTDPIG

SEQ ID NO: 3346197 - protein, 5 aa, Plasmodium falciparum
SSYND

SEQ ID NO: 3346198 - protein, 13 aa, Plasmodium falciparum
SSYNFDGDEDAIK

SEQ ID NO: 3346199 - protein, 10 aa, Plasmodium falciparum
SSYNKKKNTY

SEQ ID NO: 3346200 - protein, 21 aa, Plasmodium falciparum
SSYNKYNDKERNNNKNKMSIK

SEQ ID NO: 3346201 - protein, 5 aa, Plasmodium falciparum
SSYNL

SEQ ID NO: 3346202 - protein, 25 aa, Plasmodium falciparum
SSYNNLNDGHSDKSSSNNKPSRKKN

SEQ ID NO: 3346203 - protein, 17 aa, Plasmodium falciparum
SSYNSNNGNKIKSNNVK

SEQ ID NO: 3346204 - protein, 15 aa, Plasmodium falciparum
SSYNSSSKRSGTIES

SEQ ID NO: 3346205 - protein, 7 aa, Plasmodium falciparum
SSYNTND

SEQ ID NO: 3346206 - protein, 6 aa, Plasmodium falciparum
SSYPEH

SEQ ID NO: 3346207 - protein, 14 aa, Plasmodium falciparum
SSYPSKKKYANANS

SEQ ID NO: 3346208 - protein, 17 aa, Plasmodium falciparum
SSYRNNSDNKKDGSEKR

SEQ ID NO: 3346209 - protein, 7 aa, Plasmodium falciparum
SSYSEVN

SEQ ID NO: 3346210 - protein, 6 aa, Plasmodium falciparum
SSYSNT

SEQ ID NO: 3346211 - protein, 18 aa, Plasmodium falciparum
SSYSSDDDRYSNESGSAL

SEQ ID NO: 3346212 - protein, 10 aa, Plasmodium falciparum
SSYSSDSSIS

SEQ ID NO: 3346213 - protein, 20 aa, Plasmodium falciparum
SSYTEKEKEKEKEKERKKKK

SEQ ID NO: 3346214 - protein, 7 aa, Plasmodium falciparum
SSYTQKK

SEQ ID NO: 3346215 - protein, 16 aa, Plasmodium falciparum
SSYTSSGDSSSSISSV

SEQ ID NO: 3346216 - protein, 6 aa, Plasmodium falciparum
STAETA

SEQ ID NO: 3346217 - protein, 19 aa, Plasmodium falciparum
STALASSKKHMNSAGDQEK

SEQ ID NO: 3346218 - protein, 11 aa, Plasmodium falciparum
STASDQQNGIN

SEQ ID NO: 3346219 - protein, 8 aa, Plasmodium falciparum
STASEKSF

SEQ ID NO: 3346220 - protein, 7 aa, Plasmodium falciparum
STAYEST

SEQ ID NO: 3346221 - protein, 15 aa, Plasmodium falciparum
STCEKKNKEDNKMND

SEQ ID NO: 3346222 - protein, 5 aa, Plasmodium falciparum
STCPD

SEQ ID NO: 3346223 - protein, 9 aa, Plasmodium falciparum
STCSSSPLG

SEQ ID NO: 3346224 - protein, 18 aa, Plasmodium falciparum
STDDNDSYLSEEKKRELR

SEQ ID NO: 3346225 - protein, 6 aa, Plasmodium falciparum
STDENN

SEQ ID NO: 3346226 - protein, 6 aa, Plasmodium falciparum
STDENV

SEQ ID NO: 3346227 - protein, 7 aa, Plasmodium falciparum
STDKDDI

SEQ ID NO: 3346228 - protein, 17 aa, Plasmodium falciparum
STDKKDIKNNNCNNISN

SEQ ID NO: 3346229 - protein, 9 aa, Plasmodium falciparum
STDNNNDKN

SEQ ID NO: 3346230 - protein, 17 aa, Plasmodium falciparum
STDNQSNEYKNNIENNA

SEQ ID NO: 3346231 - protein, 5 aa, Plasmodium falciparum
STDNT

SEQ ID NO: 3346232 - protein, 10 aa, Plasmodium falciparum
STDSDTDNHI

SEQ ID NO: 3346233 - protein, 5 aa, Plasmodium falciparum
STDTN

SEQ ID NO: 3346234 - protein, 8 aa, Plasmodium falciparum
STEATGAV

SEQ ID NO: 3346235 - protein, 6 aa, Plasmodium falciparum
STEDTI

SEQ ID NO: 3346236 - protein, 8 aa, Plasmodium falciparum
STEEDKKY

SEQ ID NO: 3346237 - protein, 6 aa, Plasmodium falciparum
STEEKN

SEQ ID NO: 3346238 - protein, 11 aa, Plasmodium falciparum
STEESDNPDLR

SEQ ID NO: 3346239 - protein, 7 aa, Plasmodium falciparum
STEGTTV

SEQ ID NO: 3346240 - protein, 4 aa, Plasmodium falciparum
STEI

SEQ ID NO: 3346241 - protein, 4 aa, Plasmodium falciparum
STEK

SEQ ID NO: 3346242 - protein, 7 aa, Plasmodium falciparum
STEKKTD

SEQ ID NO: 3346243 - protein, 13 aa, Plasmodium falciparum
STEKSPSKENHVN

SEQ ID NO: 3346244 - protein, 8 aa, Plasmodium falciparum
STELKNKN

SEQ ID NO: 3346245 - protein, 6 aa, Plasmodium falciparum
STENEE

SEQ ID NO: 3346246 - protein, 5 aa, Plasmodium falciparum
STENI

SEQ ID NO: 3346247 - protein, 4 aa, Plasmodium falciparum
STEY

SEQ ID NO: 3346248 - protein, 54 aa, Plasmodium falciparum
STEYDNTTNNKSTNKDTKTNNQIEDKKKKKEQGDKSNIIERKNSKDSKSKRDTL

SEQ ID NO: 3346249 - protein, 6 aa, Plasmodium falciparum
STFEST

SEQ ID NO: 3346250 - protein, 4 aa, Plasmodium falciparum
STFK

SEQ ID NO: 3346251 - protein, 13 aa, Plasmodium falciparum
STFNDSSSDEENL

SEQ ID NO: 3346252 - protein, 23 aa, Plasmodium falciparum
STFNQKKERTLNSVEKKGKSSYF

SEQ ID NO: 3346253 - protein, 4 aa, Plasmodium falciparum
STFP

SEQ ID NO: 3346254 - protein, 4 aa, Plasmodium falciparum
STFS

SEQ ID NO: 3346255 - protein, 10 aa, Plasmodium falciparum
STFSDNNKKF

SEQ ID NO: 3346256 - protein, 24 aa, Plasmodium falciparum
STFSSSMENKSQNKSQNKSHNKNI

SEQ ID NO: 3346257 - protein, 10 aa, Plasmodium falciparum
STGAVTKEQL

SEQ ID NO: 3346258 - protein, 8 aa, Plasmodium falciparum
STGEPSKR

SEQ ID NO: 3346259 - protein, 6 aa, Plasmodium falciparum
STGGTF

SEQ ID NO: 3346260 - protein, 4 aa, Plasmodium falciparum
STGI

SEQ ID NO: 3346261 - protein, 4 aa, Plasmodium falciparum
STGK

SEQ ID NO: 3346262 - protein, 5 aa, Plasmodium falciparum
STGKT

SEQ ID NO: 3346263 - protein, 6 aa, Plasmodium falciparum
STGNIT

SEQ ID NO: 3346264 - protein, 4 aa, Plasmodium falciparum
STGR

SEQ ID NO: 3346265 - protein, 8 aa, Plasmodium falciparum
STGSAKTS

SEQ ID NO: 3346266 - protein, 5 aa, Plasmodium falciparum
STGSP

SEQ ID NO: 3346267 - protein, 10 aa, Plasmodium falciparum
STGSQKDDSI

SEQ ID NO: 3346268 - protein, 4 aa, Plasmodium falciparum
STGY

SEQ ID NO: 3346269 - protein, 8 aa, Plasmodium falciparum
STHDGQNK

SEQ ID NO: 3346270 - protein, 9 aa, Plasmodium falciparum
STHDMNNNK

SEQ ID NO: 3346271 - protein, 12 aa, Plasmodium falciparum
STHDNSPQSFCS

SEQ ID NO: 3346272 - protein, 9 aa, Plasmodium falciparum
STHESNTKD

SEQ ID NO: 3346273 - protein, 4 aa, Plasmodium falciparum
STHG

SEQ ID NO: 3346274 - protein, 5 aa, Plasmodium falciparum
STHID

SEQ ID NO: 3346275 - protein, 14 aa, Plasmodium falciparum
STHISTPNYSMNKD

SEQ ID NO: 3346276 - protein, 6 aa, Plasmodium falciparum
STHKKQ

SEQ ID NO: 3346277 - protein, 18 aa, Plasmodium falciparum
STHNDNRNYDKNINPEDL

SEQ ID NO: 3346278 - protein, 6 aa, Plasmodium falciparum
STHNGK

SEQ ID NO: 3346279 - protein, 9 aa, Plasmodium falciparum
STHNGSTSS

SEQ ID NO: 3346280 - protein, 6 aa, Plasmodium falciparum
STHTIK

SEQ ID NO: 3346281 - protein, 18 aa, Plasmodium falciparum
STIENKKKSQIDHTTNGN

SEQ ID NO: 3346282 - protein, 10 aa, Plasmodium falciparum
STINNEIKEK

SEQ ID NO: 3346283 - protein, 16 aa, Plasmodium falciparum
STINNNYNNNNYNNNK

SEQ ID NO: 3346284 - protein, 11 aa, Plasmodium falciparum
STISNSSGIDS

SEQ ID NO: 3346285 - protein, 14 aa, Plasmodium falciparum
STISSQNKTKSISQ

SEQ ID NO: 3346286 - protein, 19 aa, Plasmodium falciparum
STITNNMNNNNNNINGNNY

SEQ ID NO: 3346287 - protein, 7 aa, Plasmodium falciparum
STKDEAI

SEQ ID NO: 3346288 - protein, 25 aa, Plasmodium falciparum
STKDGTEKKDSDDQLTNIDSSDDVA

SEQ ID NO: 3346289 - protein, 9 aa, Plasmodium falciparum
STKDKIVNE

SEQ ID NO: 3346290 - protein, 10 aa, Plasmodium falciparum
STKEHSEHGQ

SEQ ID NO: 3346291 - protein, 7 aa, Plasmodium falciparum
STKELDD

SEQ ID NO: 3346292 - protein, 9 aa, Plasmodium falciparum
STKGTIGGP

SEQ ID NO: 3346293 - protein, 12 aa, Plasmodium falciparum
STKKEITKTKSS

SEQ ID NO: 3346294 - protein, 8 aa, Plasmodium falciparum
STKKESDL

SEQ ID NO: 3346295 - protein, 8 aa, Plasmodium falciparum
STKKRIKN

SEQ ID NO: 3346296 - protein, 10 aa, Plasmodium falciparum
STKNAEEDLE

SEQ ID NO: 3346297 - protein, 8 aa, Plasmodium falciparum
STKNDTIS

SEQ ID NO: 3346298 - protein, 9 aa, Plasmodium falciparum
STKNFNDTY

SEQ ID NO: 3346299 - protein, 8 aa, Plasmodium falciparum
STKNIYDT

SEQ ID NO: 3346300 - protein, 10 aa, Plasmodium falciparum
STKNKKKDLF

SEQ ID NO: 3346301 - protein, 6 aa, Plasmodium falciparum
STKNKN

SEQ ID NO: 3346302 - protein, 47 aa, Plasmodium falciparum
STKNRIETDKNNNNVNDNVNDNVNDNVNDNDNDNDINRMNSNDDNME

SEQ ID NO: 3346303 - protein, 8 aa, Plasmodium falciparum
STKPECSG

SEQ ID NO: 3346304 - protein, 7 aa, Plasmodium falciparum
STKPLNT

SEQ ID NO: 3346305 - protein, 6 aa, Plasmodium falciparum
STKQNE

SEQ ID NO: 3346306 - protein, 23 aa, Plasmodium falciparum
STKRSNKNIEEDEYGKKRLPSYD

SEQ ID NO: 3346307 - protein, 5 aa, Plasmodium falciparum
STKSE

SEQ ID NO: 3346308 - protein, 6 aa, Plasmodium falciparum
STKSNV

SEQ ID NO: 3346309 - protein, 4 aa, Plasmodium falciparum
STKT

SEQ ID NO: 3346310 - protein, 6 aa, Plasmodium falciparum
STKTIS

SEQ ID NO: 3346311 - protein, 14 aa, Plasmodium falciparum
STKTKNKKNGNINE

SEQ ID NO: 3346312 - protein, 9 aa, Plasmodium falciparum
STKTNNENA

SEQ ID NO: 3346313 - protein, 7 aa, Plasmodium falciparum
STKTQHD

SEQ ID NO: 3346314 - protein, 7 aa, Plasmodium falciparum
STKTSCT

SEQ ID NO: 3346315 - protein, 8 aa, Plasmodium falciparum
STKVEESG

SEQ ID NO: 3346316 - protein, 8 aa, Plasmodium falciparum
STKVEQRQ

SEQ ID NO: 3346317 - protein, 4 aa, Plasmodium falciparum
STKY

SEQ ID NO: 3346318 - protein, 8 aa, Plasmodium falciparum
STKYNEKE

SEQ ID NO: 3346319 - protein, 8 aa, Plasmodium falciparum
STKYSKPF

SEQ ID NO: 3346320 - protein, 6 aa, Plasmodium falciparum
STLAEE

SEQ ID NO: 3346321 - protein, 8 aa, Plasmodium falciparum
STLDETSY

SEQ ID NO: 3346322 - protein, 6 aa, Plasmodium falciparum
STLGSS

SEQ ID NO: 3346323 - protein, 20 aa, Plasmodium falciparum
STLHSRSSIKNTLDNDKKKI

SEQ ID NO: 3346324 - protein, 5 aa, Plasmodium falciparum
STLKN

SEQ ID NO: 3346325 - protein, 5 aa, Plasmodium falciparum
STLNT

SEQ ID NO: 3346326 - protein, 7 aa, Plasmodium falciparum
STLSNEK

SEQ ID NO: 3346327 - protein, 11 aa, Plasmodium falciparum
STMKNDLNDKN

SEQ ID NO: 3346328 - protein, 8 aa, Plasmodium falciparum
STMNDDDN

SEQ ID NO: 3346329 - protein, 5 aa, Plasmodium falciparum
STMTT

SEQ ID NO: 3346330 - protein, 25 aa, Plasmodium falciparum
STNADSITSPCDPTNATEGDPNKQY

SEQ ID NO: 3346331 - protein, 9 aa, Plasmodium falciparum
STNDKYKNN

SEQ ID NO: 3346332 - protein, 16 aa, Plasmodium falciparum
STNDSTNKKNDHSSSQ

SEQ ID NO: 3346333 - protein, 5 aa, Plasmodium falciparum
STNEN

SEQ ID NO: 3346334 - protein, 12 aa, Plasmodium falciparum
STNEQQNVSPNF

SEQ ID NO: 3346335 - protein, 11 aa, Plasmodium falciparum
STNESEGKNND

SEQ ID NO: 3346336 - protein, 7 aa, Plasmodium falciparum
STNGKNV

SEQ ID NO: 3346337 - protein, 9 aa, Plasmodium falciparum
STNGNISDN

SEQ ID NO: 3346338 - protein, 6 aa, Plasmodium falciparum
STNGNM

SEQ ID NO: 3346339 - protein, 7 aa, Plasmodium falciparum
STNGTYI

SEQ ID NO: 3346340 - protein, 4 aa, Plasmodium falciparum
STNI

SEQ ID NO: 3346341 - protein, 53 aa, Plasmodium falciparum
STNIKAPTNVKAPTNVKAPTNVKAPTNVNAPTNVNAPTNANAPTYVNTPTNIK

SEQ ID NO: 3346342 - protein, 7 aa, Plasmodium falciparum
STNINDS

SEQ ID NO: 3346343 - protein, 10 aa, Plasmodium falciparum
STNINGGVNQ

SEQ ID NO: 3346344 - protein, 7 aa, Plasmodium falciparum
STNISQT

SEQ ID NO: 3346345 - protein, 12 aa, Plasmodium falciparum
STNKKRNSYEND

SEQ ID NO: 3346346 - protein, 9 aa, Plasmodium falciparum
STNKKTDRH

SEQ ID NO: 3346347 - protein, 9 aa, Plasmodium falciparum
STNKNELNN

SEQ ID NO: 3346348 - protein, 8 aa, Plasmodium falciparum
STNKRHSR

SEQ ID NO: 3346349 - protein, 10 aa, Plasmodium falciparum
STNKSNLGQN

SEQ ID NO: 3346350 - protein, 32 aa, Plasmodium falciparum
STNKSSDDDSYESYDTSERSTSSKNEKRKNYW

SEQ ID NO: 3346351 - protein, 43 aa, Plasmodium falciparum
STNKSVSNSAGTLNNKSNDYTNTNKGKNTMNNLSKDNSDKHKE

SEQ ID NO: 3346352 - protein, 4 aa, Plasmodium falciparum
STNN

SEQ ID NO: 3346353 - protein, 8 aa, Plasmodium falciparum
STNNEHKK

SEQ ID NO: 3346354 - protein, 8 aa, Plasmodium falciparum
STNNEKRN

SEQ ID NO: 3346355 - protein, 41 aa, Plasmodium falciparum
STNNHNNNNNNYNNNNYNNNNNNNSNNNNNNNNNNNCNNNN

SEQ ID NO: 3346356 - protein, 8 aa, Plasmodium falciparum
STNNLNSS

SEQ ID NO: 3346357 - protein, 6 aa, Plasmodium falciparum
STNNMG

SEQ ID NO: 3346358 - protein, 7 aa, Plasmodium falciparum
STNNNCD

SEQ ID NO: 3346359 - protein, 11 aa, Plasmodium falciparum
STNNNMDQKHG

SEQ ID NO: 3346360 - protein, 25 aa, Plasmodium falciparum
STNNNNNTSSATNNNNNNNNTSNVN

SEQ ID NO: 3346361 - protein, 10 aa, Plasmodium falciparum
STNNQKDESN

SEQ ID NO: 3346362 - protein, 9 aa, Plasmodium falciparum
STNNQRNYY

SEQ ID NO: 3346363 - protein, 7 aa, Plasmodium falciparum
STNNSNK

SEQ ID NO: 3346364 - protein, 10 aa, Plasmodium falciparum
STNNYENPYE

SEQ ID NO: 3346365 - protein, 9 aa, Plasmodium falciparum
STNPKHGPG

SEQ ID NO: 3346366 - protein, 6 aa, Plasmodium falciparum
STNPKY

SEQ ID NO: 3346367 - protein, 5 aa, Plasmodium falciparum
STNQD

SEQ ID NO: 3346368 - protein, 16 aa, Plasmodium falciparum
STNQEKETTDSNPEKI

SEQ ID NO: 3346369 - protein, 6 aa, Plasmodium falciparum
STNQYN

SEQ ID NO: 3346370 - protein, 8 aa, Plasmodium falciparum
STNRNSKD

SEQ ID NO: 3346371 - protein, 13 aa, Plasmodium falciparum
STNSCIDSNNSGT

SEQ ID NO: 3346372 - protein, 5 aa, Plasmodium falciparum
STNTE

SEQ ID NO: 3346373 - protein, 5 aa, Plasmodium falciparum
STNTF

SEQ ID NO: 3346374 - protein, 9 aa, Plasmodium falciparum
STNTSSYTN

SEQ ID NO: 3346375 - protein, 6 aa, Plasmodium falciparum
STNYDK

SEQ ID NO: 3346376 - protein, 10 aa, Plasmodium falciparum
STPGDAVGSI

SEQ ID NO: 3346377 - protein, 5 aa, Plasmodium falciparum
STPHE

SEQ ID NO: 3346378 - protein, 6 aa, Plasmodium falciparum
STPHID

SEQ ID NO: 3346379 - protein, 4 aa, Plasmodium falciparum
STPI

SEQ ID NO: 3346380 - protein, 8 aa, Plasmodium falciparum
STPKKTWE

SEQ ID NO: 3346381 - protein, 7 aa, Plasmodium falciparum
STPKSGY

SEQ ID NO: 3346382 - protein, 4 aa, Plasmodium falciparum
STPL

SEQ ID NO: 3346383 - protein, 9 aa, Plasmodium falciparum
STPNKNYNK

SEQ ID NO: 3346384 - protein, 13 aa, Plasmodium falciparum
STPNNNNNNNNIN

SEQ ID NO: 3346385 - protein, 11 aa, Plasmodium falciparum
STPNNRKSYNA

SEQ ID NO: 3346386 - protein, 9 aa, Plasmodium falciparum
STPQPEDIG

SEQ ID NO: 3346387 - protein, 8 aa, Plasmodium falciparum
STPQYSYE

SEQ ID NO: 3346388 - protein, 6 aa, Plasmodium falciparum
STPRSS

SEQ ID NO: 3346389 - protein, 19 aa, Plasmodium falciparum
STPSNKSTKVDEKKEKEKK

SEQ ID NO: 3346390 - protein, 4 aa, Plasmodium falciparum
STQE

SEQ ID NO: 3346391 - protein, 11 aa, Plasmodium falciparum
STQNEISKKYK

SEQ ID NO: 3346392 - protein, 6 aa, Plasmodium falciparum
STQNKQ

SEQ ID NO: 3346393 - protein, 6 aa, Plasmodium falciparum
STQNNT

SEQ ID NO: 3346394 - protein, 6 aa, Plasmodium falciparum
STQQKG

SEQ ID NO: 3346395 - protein, 12 aa, Plasmodium falciparum
STQRGNQLADEN

SEQ ID NO: 3346396 - protein, 6 aa, Plasmodium falciparum
STQSEQ

SEQ ID NO: 3346397 - protein, 5 aa, Plasmodium falciparum
STRCA

SEQ ID NO: 3346398 - protein, 6 aa, Plasmodium falciparum
STRDKL

SEQ ID NO: 3346399 - protein, 11 aa, Plasmodium falciparum
STRDTTRRKTE

SEQ ID NO: 3346400 - protein, 4 aa, Plasmodium falciparum
STRE

SEQ ID NO: 3346401 - protein, 6 aa, Plasmodium falciparum
STREHD

SEQ ID NO: 3346402 - protein, 4 aa, Plasmodium falciparum
STRI

SEQ ID NO: 3346403 - protein, 5 aa, Plasmodium falciparum
STRIP

SEQ ID NO: 3346404 - protein, 5 aa, Plasmodium falciparum
STRKG

SEQ ID NO: 3346405 - protein, 27 aa, Plasmodium falciparum
STRKNINNNNNNDNNNNNDNNNNNNDE

SEQ ID NO: 3346406 - protein, 10 aa, Plasmodium falciparum
STRPDNSYGR

SEQ ID NO: 3346407 - protein, 5 aa, Plasmodium falciparum
STRSI

SEQ ID NO: 3346408 - protein, 11 aa, Plasmodium falciparum
STSANNTSSTL

SEQ ID NO: 3346409 - protein, 7 aa, Plasmodium falciparum
STSCQNT

SEQ ID NO: 3346410 - protein, 7 aa, Plasmodium falciparum
STSEDNT

SEQ ID NO: 3346411 - protein, 6 aa, Plasmodium falciparum
STSEKI

SEQ ID NO: 3346412 - protein, 5 aa, Plasmodium falciparum
STSIH

SEQ ID NO: 3346413 - protein, 4 aa, Plasmodium falciparum
STSK

SEQ ID NO: 3346414 - protein, 8 aa, Plasmodium falciparum
STSKEYGS

SEQ ID NO: 3346415 - protein, 17 aa, Plasmodium falciparum
STSKGSINMETSETTAT

SEQ ID NO: 3346416 - protein, 10 aa, Plasmodium falciparum
STSKQNISNT

SEQ ID NO: 3346417 - protein, 11 aa, Plasmodium falciparum
STSKTGKHGHA

SEQ ID NO: 3346418 - protein, 20 aa, Plasmodium falciparum
STSNCDEETRHRNNTSISSS

SEQ ID NO: 3346419 - protein, 5 aa, Plasmodium falciparum
STSNN

SEQ ID NO: 3346420 - protein, 8 aa, Plasmodium falciparum
STSNNGNI

SEQ ID NO: 3346421 - protein, 6 aa, Plasmodium falciparum
STSNTN

SEQ ID NO: 3346422 - protein, 9 aa, Plasmodium falciparum
STSNYQNNN

SEQ ID NO: 3346423 - protein, 4 aa, Plasmodium falciparum
STSQ

SEQ ID NO: 3346424 - protein, 5 aa, Plasmodium falciparum
STSQH

SEQ ID NO: 3346425 - protein, 9 aa, Plasmodium falciparum
STSQTKNEI

SEQ ID NO: 3346426 - protein, 10 aa, Plasmodium falciparum
STSRLKEKKS

SEQ ID NO: 3346427 - protein, 6 aa, Plasmodium falciparum
STSRNV

SEQ ID NO: 3346428 - protein, 5 aa, Plasmodium falciparum
STSRW

SEQ ID NO: 3346429 - protein, 12 aa, Plasmodium falciparum
STSSEKDNINND

SEQ ID NO: 3346430 - protein, 7 aa, Plasmodium falciparum
STSSLTR

SEQ ID NO: 3346431 - protein, 9 aa, Plasmodium falciparum
STSSNNNMM

SEQ ID NO: 3346432 - protein, 22 aa, Plasmodium falciparum
STSSSLKNTEDKSYDSNTTISS

SEQ ID NO: 3346433 - protein, 12 aa, Plasmodium falciparum
STSTIDNEINNN

SEQ ID NO: 3346434 - protein, 18 aa, Plasmodium falciparum
STSTSGSFGNDNYKSTPL

SEQ ID NO: 3346435 - protein, 35 aa, Plasmodium falciparum
STSVPPPAFSSDTQGMQNKNSITSNFNNNSNNSFS

SEQ ID NO: 3346436 - protein, 5 aa, Plasmodium falciparum
STSYK

SEQ ID NO: 3346437 - protein, 10 aa, Plasmodium falciparum
STTCENSYDE

SEQ ID NO: 3346438 - protein, 91 aa, Plasmodium falciparum
STTEDRNKKEDVSKGKKKKINNTPQSYNTPQSYNTPQSYNTPQSYNTTQNYNTTQNYNTTQNCNTTQNYNTTQNYNTTQHNNNINENNDDD

SEQ ID NO: 3346439 - protein, 24 aa, Plasmodium falciparum
STTELNNNNGLNDVKNNTPSYSNI

SEQ ID NO: 3346440 - protein, 5 aa, Plasmodium falciparum
STTFN

SEQ ID NO: 3346441 - protein, 8 aa, Plasmodium falciparum
STTIEKEP

SEQ ID NO: 3346442 - protein, 4 aa, Plasmodium falciparum
STTK

SEQ ID NO: 3346443 - protein, 6 aa, Plasmodium falciparum
STTKEV

SEQ ID NO: 3346444 - protein, 13 aa, Plasmodium falciparum
STTLGSSNNVGNI

SEQ ID NO: 3346445 - protein, 12 aa, Plasmodium falciparum
STTNDDRQNYDE

SEQ ID NO: 3346446 - protein, 33 aa, Plasmodium falciparum
STTNESNEKDNINKNKSSNLNDNNNNNLNGTTG

SEQ ID NO: 3346447 - protein, 7 aa, Plasmodium falciparum
STTNFSD

SEQ ID NO: 3346448 - protein, 9 aa, Plasmodium falciparum
STTNKPKVE

SEQ ID NO: 3346449 - protein, 17 aa, Plasmodium falciparum
STTNNKMNNTLKENNFN

SEQ ID NO: 3346450 - protein, 19 aa, Plasmodium falciparum
STTNSTNDEEDNEKKNKVS

SEQ ID NO: 3346451 - protein, 9 aa, Plasmodium falciparum
STTQIGDPS

SEQ ID NO: 3346452 - protein, 15 aa, Plasmodium falciparum
STTSFDAKSRNVSIS

SEQ ID NO: 3346453 - protein, 8 aa, Plasmodium falciparum
STTSIQPG

SEQ ID NO: 3346454 - protein, 15 aa, Plasmodium falciparum
STTSYESSNYNENVP

SEQ ID NO: 3346455 - protein, 5 aa, Plasmodium falciparum
STTTK

SEQ ID NO: 3346456 - protein, 7 aa, Plasmodium falciparum
STTTQEN

SEQ ID NO: 3346457 - protein, 37 aa, Plasmodium falciparum
STTTSTAASASESPSTSTSTSTSPSSSEPYTSSYDNG

SEQ ID NO: 3346458 - protein, 30 aa, Plasmodium falciparum
STTTTTNNNNNNDNNNDNNNDNNDNNNDTY

SEQ ID NO: 3346459 - protein, 15 aa, Plasmodium falciparum
STVATHGSQENSSAA

SEQ ID NO: 3346460 - protein, 6 aa, Plasmodium falciparum
STVKDD

SEQ ID NO: 3346461 - protein, 7 aa, Plasmodium falciparum
STVSRTN

SEQ ID NO: 3346462 - protein, 20 aa, Plasmodium falciparum
STVSSNKPYSSSDEKGGEHI

SEQ ID NO: 3346463 - protein, 5 aa, Plasmodium falciparum
STVTS

SEQ ID NO: 3346464 - protein, 16 aa, Plasmodium falciparum
STVTTNNTSLKDEEDI

SEQ ID NO: 3346465 - protein, 21 aa, Plasmodium falciparum
STYDEKDNLKISKKKEKCLSS

SEQ ID NO: 3346466 - protein, 5 aa, Plasmodium falciparum
STYEP

SEQ ID NO: 3346467 - protein, 21 aa, Plasmodium falciparum
STYKNQHDNDNNNVHNKDNNN

SEQ ID NO: 3346468 - protein, 5 aa, Plasmodium falciparum
STYNE

SEQ ID NO: 3346469 - protein, 7 aa, Plasmodium falciparum
STYNNNK

SEQ ID NO: 3346470 - protein, 15 aa, Plasmodium falciparum
STYNYTNNKEQHKNL

SEQ ID NO: 3346471 - protein, 4 aa, Plasmodium falciparum
STYP

SEQ ID NO: 3346472 - protein, 9 aa, Plasmodium falciparum
STYSNDKDK

SEQ ID NO: 3346473 - protein, 46 aa, Plasmodium falciparum
STYSNNNNNNNNNNNNNNNNNNGSVSFKTKDDKYKNSYNNRPSTSI

SEQ ID NO: 3346474 - protein, 47 aa, Plasmodium falciparum
STYSSTTSSIYKRSDDSEYYTKRRKKKKQKRTNKEKRIKKERSITYT

SEQ ID NO: 3346475 - protein, 17 aa, Plasmodium falciparum
STYTDDKIKNTSGSNIK

SEQ ID NO: 3346476 - protein, 5 aa, Plasmodium falciparum
STYTS

SEQ ID NO: 3346477 - protein, 13 aa, Plasmodium falciparum
STYYYPNNNSKNY

SEQ ID NO: 3346478 - protein, 4 aa, Plasmodium falciparum
SVCA

SEQ ID NO: 3346479 - protein, 6 aa, Plasmodium falciparum
SVDDSS

SEQ ID NO: 3346480 - protein, 7 aa, Plasmodium falciparum
SVDGDNS

SEQ ID NO: 3346481 - protein, 9 aa, Plasmodium falciparum
SVDGENRMN

SEQ ID NO: 3346482 - protein, 7 aa, Plasmodium falciparum
SVDKNNQ

SEQ ID NO: 3346483 - protein, 13 aa, Plasmodium falciparum
SVDNNNENVGTGE

SEQ ID NO: 3346484 - protein, 8 aa, Plasmodium falciparum
SVDSGLSD

SEQ ID NO: 3346485 - protein, 13 aa, Plasmodium falciparum
SVDSNGRDDHTYD

SEQ ID NO: 3346486 - protein, 9 aa, Plasmodium falciparum
SVDSRRENV

SEQ ID NO: 3346487 - protein, 15 aa, Plasmodium falciparum
SVDYNNNNNENDTMN

SEQ ID NO: 3346488 - protein, 7 aa, Plasmodium falciparum
SVEDNTD

SEQ ID NO: 3346489 - protein, 9 aa, Plasmodium falciparum
SVEDPNEKI

SEQ ID NO: 3346490 - protein, 6 aa, Plasmodium falciparum
SVEEEG

SEQ ID NO: 3346491 - protein, 13 aa, Plasmodium falciparum
SVELSDENSSLDT

SEQ ID NO: 3346492 - protein, 12 aa, Plasmodium falciparum
SVENKESTMTIG

SEQ ID NO: 3346493 - protein, 50 aa, Plasmodium falciparum
SVENTNNVDKTNNVDKTNNIDKTNNVNKTNNVDKTNNVNKTNSVSENGPV

SEQ ID NO: 3346494 - protein, 7 aa, Plasmodium falciparum
SVEPPED

SEQ ID NO: 3346495 - protein, 34 aa, Plasmodium falciparum
SVERNKKKQSNNKEENKVSKEQEQLNNNESEGID

SEQ ID NO: 3346496 - protein, 9 aa, Plasmodium falciparum
SVESNKNNV

SEQ ID NO: 3346497 - protein, 7 aa, Plasmodium falciparum
SVGDKKK

SEQ ID NO: 3346498 - protein, 7 aa, Plasmodium falciparum
SVGGGES

SEQ ID NO: 3346499 - protein, 11 aa, Plasmodium falciparum
SVGNKNTEVSN

SEQ ID NO: 3346500 - protein, 7 aa, Plasmodium falciparum
SVGPGSA

SEQ ID NO: 3346501 - protein, 11 aa, Plasmodium falciparum
SVGSNDHTNKE

SEQ ID NO: 3346502 - protein, 10 aa, Plasmodium falciparum
SVGVRGDARS

SEQ ID NO: 3346503 - protein, 10 aa, Plasmodium falciparum
SVHDEEENYK

SEQ ID NO: 3346504 - protein, 17 aa, Plasmodium falciparum
SVISSTPNTSSKISDIR

SEQ ID NO: 3346505 - protein, 9 aa, Plasmodium falciparum
SVKDLRKKK

SEQ ID NO: 3346506 - protein, 6 aa, Plasmodium falciparum
SVKEGT

SEQ ID NO: 3346507 - protein, 10 aa, Plasmodium falciparum
SVKENKKNKI

SEQ ID NO: 3346508 - protein, 10 aa, Plasmodium falciparum
SVKEQPNAKS

SEQ ID NO: 3346509 - protein, 14 aa, Plasmodium falciparum
SVKKEYADAYGSST

SEQ ID NO: 3346510 - protein, 15 aa, Plasmodium falciparum
SVKKPDKKKKNITRE

SEQ ID NO: 3346511 - protein, 6 aa, Plasmodium falciparum
SVKMSS

SEQ ID NO: 3346512 - protein, 6 aa, Plasmodium falciparum
SVKNHR

SEQ ID NO: 3346513 - protein, 10 aa, Plasmodium falciparum
SVKSKTPFMK

SEQ ID NO: 3346514 - protein, 6 aa, Plasmodium falciparum
SVKSSN

SEQ ID NO: 3346515 - protein, 4 aa, Plasmodium falciparum
SVLD

SEQ ID NO: 3346516 - protein, 4 aa, Plasmodium falciparum
SVNE

SEQ ID NO: 3346517 - protein, 8 aa, Plasmodium falciparum
SVNEGHPD

SEQ ID NO: 3346518 - protein, 6 aa, Plasmodium falciparum
SVNKDT

SEQ ID NO: 3346519 - protein, 9 aa, Plasmodium falciparum
SVNKGAHGY

SEQ ID NO: 3346520 - protein, 12 aa, Plasmodium falciparum
SVNNDDKKVDNI

SEQ ID NO: 3346521 - protein, 24 aa, Plasmodium falciparum
SVNNENNVNNENNVNNKNNVNNTY

SEQ ID NO: 3346522 - protein, 19 aa, Plasmodium falciparum
SVNNKKNKEEIRNHSNNVE

SEQ ID NO: 3346523 - protein, 11 aa, Plasmodium falciparum
SVNNNNNNNNN

SEQ ID NO: 3346524 - protein, 12 aa, Plasmodium falciparum
SVNNTNDLNNSD

SEQ ID NO: 3346525 - protein, 9 aa, Plasmodium falciparum
SVNPGKRAY

SEQ ID NO: 3346526 - protein, 8 aa, Plasmodium falciparum
SVNSDDPG

SEQ ID NO: 3346527 - protein, 7 aa, Plasmodium falciparum
SVNSEGQ

SEQ ID NO: 3346528 - protein, 18 aa, Plasmodium falciparum
SVNTKDDNENNNNNDDNI

SEQ ID NO: 3346529 - protein, 5 aa, Plasmodium falciparum
SVPAN

SEQ ID NO: 3346530 - protein, 5 aa, Plasmodium falciparum
SVPLD

SEQ ID NO: 3346531 - protein, 15 aa, Plasmodium falciparum
SVPPNQHSEHNNNNY

SEQ ID NO: 3346532 - protein, 20 aa, Plasmodium falciparum
SVQAATKDAPTSSANKKSRS

SEQ ID NO: 3346533 - protein, 5 aa, Plasmodium falciparum
SVQHN

SEQ ID NO: 3346534 - protein, 8 aa, Plasmodium falciparum
SVQNDTSD

SEQ ID NO: 3346535 - protein, 13 aa, Plasmodium falciparum
SVQSNTQKAFDLI

SEQ ID NO: 3346536 - protein, 4 aa, Plasmodium falciparum
SVQY

SEQ ID NO: 3346537 - protein, 25 aa, Plasmodium falciparum
SVREAGQHNMKNNEDDKKKKKNKVS

SEQ ID NO: 3346538 - protein, 6 aa, Plasmodium falciparum
SVRNIP

SEQ ID NO: 3346539 - protein, 11 aa, Plasmodium falciparum
SVSAENKKQDV

SEQ ID NO: 3346540 - protein, 49 aa, Plasmodium falciparum
SVSGLQESNVKEKTRNGYSNSNNKKEKHIYPDEKNNKKNIKLNNPKKSF

SEQ ID NO: 3346541 - protein, 11 aa, Plasmodium falciparum
SVSGYGNDMNT

SEQ ID NO: 3346542 - protein, 10 aa, Plasmodium falciparum
SVSKSEANIN

SEQ ID NO: 3346543 - protein, 12 aa, Plasmodium falciparum
SVSNGKTEESNV

SEQ ID NO: 3346544 - protein, 10 aa, Plasmodium falciparum
SVSPGKSATQ

SEQ ID NO: 3346545 - protein, 5 aa, Plasmodium falciparum
SVSPL

SEQ ID NO: 3346546 - protein, 5 aa, Plasmodium falciparum
SVSQA

SEQ ID NO: 3346547 - protein, 11 aa, Plasmodium falciparum
SVSSNEDPLDN

SEQ ID NO: 3346548 - protein, 22 aa, Plasmodium falciparum
SVSSSNEKQKNKNNNIEQNENM

SEQ ID NO: 3346549 - protein, 17 aa, Plasmodium falciparum
SVSSSNNSEDIKNEPNI

SEQ ID NO: 3346550 - protein, 12 aa, Plasmodium falciparum
SVSSTNASVSPT

SEQ ID NO: 3346551 - protein, 9 aa, Plasmodium falciparum
SVSTSRVED

SEQ ID NO: 3346552 - protein, 15 aa, Plasmodium falciparum
SVSTSTLATKVGDKL

SEQ ID NO: 3346553 - protein, 7 aa, Plasmodium falciparum
SVSTTNE

SEQ ID NO: 3346554 - protein, 6 aa, Plasmodium falciparum
SVTDEH

SEQ ID NO: 3346555 - protein, 17 aa, Plasmodium falciparum
SVTDYSDRENLKPTFDN

SEQ ID NO: 3346556 - protein, 5 aa, Plasmodium falciparum
SVTGN

SEQ ID NO: 3346557 - protein, 8 aa, Plasmodium falciparum
SVTKNESN

SEQ ID NO: 3346558 - protein, 9 aa, Plasmodium falciparum
SVTNSNGYV

SEQ ID NO: 3346559 - protein, 12 aa, Plasmodium falciparum
SVTSSTPSSTTI

SEQ ID NO: 3346560 - protein, 7 aa, Plasmodium falciparum
SVTTNNH

SEQ ID NO: 3346561 - protein, 5 aa, Plasmodium falciparum
SVTYG

SEQ ID NO: 3346562 - protein, 5 aa, Plasmodium falciparum
SVYDD

SEQ ID NO: 3346563 - protein, 8 aa, Plasmodium falciparum
SVYDSSNN

SEQ ID NO: 3346564 - protein, 4 aa, Plasmodium falciparum
SVYE

SEQ ID NO: 3346565 - protein, 6 aa, Plasmodium falciparum
SVYEPN

SEQ ID NO: 3346566 - protein, 5 aa, Plasmodium falciparum
SVYPQ

SEQ ID NO: 3346567 - protein, 13 aa, Plasmodium falciparum
SVYYKKNNDDDTI

SEQ ID NO: 3346568 - protein, 23 aa, Plasmodium falciparum
SWENDKSDDEKEHSLEKTNNNRD

SEQ ID NO: 3346569 - protein, 5 aa, Plasmodium falciparum
SWGGK

SEQ ID NO: 3346570 - protein, 10 aa, Plasmodium falciparum
SWHPETPRYN

SEQ ID NO: 3346571 - protein, 5 aa, Plasmodium falciparum
SWLPK

SEQ ID NO: 3346572 - protein, 13 aa, Plasmodium falciparum
SYAAKGGCGGGKC

SEQ ID NO: 3346573 - protein, 7 aa, Plasmodium falciparum
SYADNNK

SEQ ID NO: 3346574 - protein, 23 aa, Plasmodium falciparum
SYAHKSQKYASDLEKKKHTKNNI

SEQ ID NO: 3346575 - protein, 9 aa, Plasmodium falciparum
SYANSNGQA

SEQ ID NO: 3346576 - protein, 7 aa, Plasmodium falciparum
SYAPSEL

SEQ ID NO: 3346577 - protein, 78 aa, Plasmodium falciparum
SYDAHNNGKKKNIHNNTSVAHKEKKKDNTQHSSKDTNPNKTHQNNHDQIKETLKKDRKFSDPTGLSQVKPSNEPKRKT

SEQ ID NO: 3346578 - protein, 4 aa, Plasmodium falciparum
SYDD

SEQ ID NO: 3346579 - protein, 6 aa, Plasmodium falciparum
SYDELN

SEQ ID NO: 3346580 - protein, 6 aa, Plasmodium falciparum
SYDENN

SEQ ID NO: 3346581 - protein, 14 aa, Plasmodium falciparum
SYDEPEHNEELDSK

SEQ ID NO: 3346582 - protein, 9 aa, Plasmodium falciparum
SYDETNKKI

SEQ ID NO: 3346583 - protein, 7 aa, Plasmodium falciparum
SYDHHGR

SEQ ID NO: 3346584 - protein, 6 aa, Plasmodium falciparum
SYDHTN

SEQ ID NO: 3346585 - protein, 17 aa, Plasmodium falciparum
SYDIPTSHSKNKNNTKR

SEQ ID NO: 3346586 - protein, 20 aa, Plasmodium falciparum
SYDKKKKKKKSKKRESDSDM

SEQ ID NO: 3346587 - protein, 10 aa, Plasmodium falciparum
SYDKKNKKFE

SEQ ID NO: 3346588 - protein, 6 aa, Plasmodium falciparum
SYDKRK

SEQ ID NO: 3346589 - protein, 8 aa, Plasmodium falciparum
SYDKYENK

SEQ ID NO: 3346590 - protein, 104 aa, Plasmodium falciparum
SYDNNEEDEFRNKKDDSMEMNDKEKGSTNMSTINDNNNNHNDDSNNHNDDSNNHNDDSNNHNDDSNNHNDDNNNHNEDNNNHNDDNNNHNDDNNYNSEEKPNYL

SEQ ID NO: 3346591 - protein, 10 aa, Plasmodium falciparum
SYDNNPSYNT

SEQ ID NO: 3346592 - protein, 5 aa, Plasmodium falciparum
SYDNV

SEQ ID NO: 3346593 - protein, 5 aa, Plasmodium falciparum
SYDPT

SEQ ID NO: 3346594 - protein, 4 aa, Plasmodium falciparum
SYDS

SEQ ID NO: 3346595 - protein, 8 aa, Plasmodium falciparum
SYDTSPNL

SEQ ID NO: 3346596 - protein, 6 aa, Plasmodium falciparum
SYDVNN

SEQ ID NO: 3346597 - protein, 5 aa, Plasmodium falciparum
SYEDE

SEQ ID NO: 3346598 - protein, 20 aa, Plasmodium falciparum
SYEDTTSSNSSHSNCSSSSV

SEQ ID NO: 3346599 - protein, 4 aa, Plasmodium falciparum
SYEE

SEQ ID NO: 3346600 - protein, 6 aa, Plasmodium falciparum
SYEELE

SEQ ID NO: 3346601 - protein, 11 aa, Plasmodium falciparum
SYEHSDKEKEC

SEQ ID NO: 3346602 - protein, 6 aa, Plasmodium falciparum
SYEINK

SEQ ID NO: 3346603 - protein, 13 aa, Plasmodium falciparum
SYEKKKKKNYKDY

SEQ ID NO: 3346604 - protein, 10 aa, Plasmodium falciparum
SYEKNGRNKE

SEQ ID NO: 3346605 - protein, 21 aa, Plasmodium falciparum
SYENEGHKSDNEFDDNDDDDN

SEQ ID NO: 3346606 - protein, 7 aa, Plasmodium falciparum
SYENEQN

SEQ ID NO: 3346607 - protein, 19 aa, Plasmodium falciparum
SYENKGNDMNRVNSNSNNN

SEQ ID NO: 3346608 - protein, 5 aa, Plasmodium falciparum
SYENR

SEQ ID NO: 3346609 - protein, 6 aa, Plasmodium falciparum
SYEQNN

SEQ ID NO: 3346610 - protein, 4 aa, Plasmodium falciparum
SYER

SEQ ID NO: 3346611 - protein, 12 aa, Plasmodium falciparum
SYESSKEDNPIC

SEQ ID NO: 3346612 - protein, 15 aa, Plasmodium falciparum
SYESSTKRRRSNNNN

SEQ ID NO: 3346613 - protein, 29 aa, Plasmodium falciparum
SYETEKVDDKTGNNIQNNNNEKNETHGNI

SEQ ID NO: 3346614 - protein, 8 aa, Plasmodium falciparum
SYETKEHM

SEQ ID NO: 3346615 - protein, 21 aa, Plasmodium falciparum
SYETPQKEKKKTKKKKNGNTL

SEQ ID NO: 3346616 - protein, 11 aa, Plasmodium falciparum
SYFKEGNSNII

SEQ ID NO: 3346617 - protein, 7 aa, Plasmodium falciparum
SYGERKL

SEQ ID NO: 3346618 - protein, 8 aa, Plasmodium falciparum
SYGESHGK

SEQ ID NO: 3346619 - protein, 7 aa, Plasmodium falciparum
SYGGAEK

SEQ ID NO: 3346620 - protein, 6 aa, Plasmodium falciparum
SYGKND

SEQ ID NO: 3346621 - protein, 44 aa, Plasmodium falciparum
SYGNNEKVTNDDNNNNSNTNQSDSNNNNNNNNKNLCDSNNEGNY

SEQ ID NO: 3346622 - protein, 4 aa, Plasmodium falciparum
SYGR

SEQ ID NO: 3346623 - protein, 8 aa, Plasmodium falciparum
SYGSNDMN

SEQ ID NO: 3346624 - protein, 11 aa, Plasmodium falciparum
SYGTYDNRSMQ

SEQ ID NO: 3346625 - protein, 28 aa, Plasmodium falciparum
SYGYNEPNNYVDNNNNNNSDNDDNNNIN

SEQ ID NO: 3346626 - protein, 22 aa, Plasmodium falciparum
SYHDDSSTDDDSSADEQQDERR

SEQ ID NO: 3346627 - protein, 13 aa, Plasmodium falciparum
SYHRNSGNTNNFS

SEQ ID NO: 3346628 - protein, 11 aa, Plasmodium falciparum
SYINSGNGNIN

SEQ ID NO: 3346629 - protein, 13 aa, Plasmodium falciparum
SYISEDENEEEEN

SEQ ID NO: 3346630 - protein, 4 aa, Plasmodium falciparum
SYKD

SEQ ID NO: 3346631 - protein, 5 aa, Plasmodium falciparum
SYKDM

SEQ ID NO: 3346632 - protein, 8 aa, Plasmodium falciparum
SYKENDKK

SEQ ID NO: 3346633 - protein, 7 aa, Plasmodium falciparum
SYKENNN

SEQ ID NO: 3346634 - protein, 12 aa, Plasmodium falciparum
SYKEQKNSTNIN

SEQ ID NO: 3346635 - protein, 6 aa, Plasmodium falciparum
SYKEYK

SEQ ID NO: 3346636 - protein, 23 aa, Plasmodium falciparum
SYKGEDENNYDIDPNTGYPKSMP

SEQ ID NO: 3346637 - protein, 7 aa, Plasmodium falciparum
SYKGEPK

SEQ ID NO: 3346638 - protein, 5 aa, Plasmodium falciparum
SYKKE

SEQ ID NO: 3346639 - protein, 6 aa, Plasmodium falciparum
SYKKEY

SEQ ID NO: 3346640 - protein, 10 aa, Plasmodium falciparum
SYKKKKRKKK

SEQ ID NO: 3346641 - protein, 8 aa, Plasmodium falciparum
SYKKPEQN

SEQ ID NO: 3346642 - protein, 8 aa, Plasmodium falciparum
SYKNDGNI

SEQ ID NO: 3346643 - protein, 8 aa, Plasmodium falciparum
SYKNGRNG

SEQ ID NO: 3346644 - protein, 30 aa, Plasmodium falciparum
SYKNRYRNDNNNKKNNNNNNNNNNSNSNNN

SEQ ID NO: 3346645 - protein, 8 aa, Plasmodium falciparum
SYKNSSSN

SEQ ID NO: 3346646 - protein, 9 aa, Plasmodium falciparum
SYKSNVKTK

SEQ ID NO: 3346647 - protein, 5 aa, Plasmodium falciparum
SYNDE

SEQ ID NO: 3346648 - protein, 7 aa, Plasmodium falciparum
SYNDRKG

SEQ ID NO: 3346649 - protein, 4 aa, Plasmodium falciparum
SYNE

SEQ ID NO: 3346650 - protein, 24 aa, Plasmodium falciparum
SYNEEGNENNRNDINNNNNNNNIN

SEQ ID NO: 3346651 - protein, 9 aa, Plasmodium falciparum
SYNEKKDNI

SEQ ID NO: 3346652 - protein, 9 aa, Plasmodium falciparum
SYNEKNKNI

SEQ ID NO: 3346653 - protein, 8 aa, Plasmodium falciparum
SYNESEVS

SEQ ID NO: 3346654 - protein, 8 aa, Plasmodium falciparum
SYNGNNND

SEQ ID NO: 3346655 - protein, 4 aa, Plasmodium falciparum
SYNI

SEQ ID NO: 3346656 - protein, 10 aa, Plasmodium falciparum
SYNKDDDENI

SEQ ID NO: 3346657 - protein, 5 aa, Plasmodium falciparum
SYNKG

SEQ ID NO: 3346658 - protein, 26 aa, Plasmodium falciparum
SYNKKNKNMPKSDNDKRNNNNNNSSF

SEQ ID NO: 3346659 - protein, 6 aa, Plasmodium falciparum
SYNKST

SEQ ID NO: 3346660 - protein, 4 aa, Plasmodium falciparum
SYNN

SEQ ID NO: 3346661 - protein, 11 aa, Plasmodium falciparum
SYNNDAEKYQK

SEQ ID NO: 3346662 - protein, 16 aa, Plasmodium falciparum
SYNNNDGDNYGDNNNN

SEQ ID NO: 3346663 - protein, 8 aa, Plasmodium falciparum
SYNNNHNN

SEQ ID NO: 3346664 - protein, 19 aa, Plasmodium falciparum
SYNNNNNNNNNNNENYTNY

SEQ ID NO: 3346665 - protein, 30 aa, Plasmodium falciparum
SYNNNNNNNNNNSNNNNNSNSNNNSNSNNF

SEQ ID NO: 3346666 - protein, 17 aa, Plasmodium falciparum
SYNNPKSDINKSDSNYI

SEQ ID NO: 3346667 - protein, 5 aa, Plasmodium falciparum
SYNNY

SEQ ID NO: 3346668 - protein, 7 aa, Plasmodium falciparum
SYNPPPE

SEQ ID NO: 3346669 - protein, 6 aa, Plasmodium falciparum
SYNQCN

SEQ ID NO: 3346670 - protein, 9 aa, Plasmodium falciparum
SYNQTKVSN

SEQ ID NO: 3346671 - protein, 4 aa, Plasmodium falciparum
SYNS

SEQ ID NO: 3346672 - protein, 10 aa, Plasmodium falciparum
SYNSFNSKKE

SEQ ID NO: 3346673 - protein, 5 aa, Plasmodium falciparum
SYNSH

SEQ ID NO: 3346674 - protein, 10 aa, Plasmodium falciparum
SYNSNKNKNI

SEQ ID NO: 3346675 - protein, 19 aa, Plasmodium falciparum
SYNSQDTNSENTSKNNTLV

SEQ ID NO: 3346676 - protein, 17 aa, Plasmodium falciparum
SYNSSENNKEDDNGSDV

SEQ ID NO: 3346677 - protein, 10 aa, Plasmodium falciparum
SYNSSNENGI

SEQ ID NO: 3346678 - protein, 16 aa, Plasmodium falciparum
SYNTQKNKKNKKNVHN

SEQ ID NO: 3346679 - protein, 4 aa, Plasmodium falciparum
SYNV

SEQ ID NO: 3346680 - protein, 7 aa, Plasmodium falciparum
SYPEEEL

SEQ ID NO: 3346681 - protein, 8 aa, Plasmodium falciparum
SYPEQKNN

SEQ ID NO: 3346682 - protein, 8 aa, Plasmodium falciparum
SYPGRTPV

SEQ ID NO: 3346683 - protein, 5 aa, Plasmodium falciparum
SYPHS

SEQ ID NO: 3346684 - protein, 4 aa, Plasmodium falciparum
SYPK

SEQ ID NO: 3346685 - protein, 4 aa, Plasmodium falciparum
SYPL

SEQ ID NO: 3346686 - protein, 4 aa, Plasmodium falciparum
SYPN

SEQ ID NO: 3346687 - protein, 9 aa, Plasmodium falciparum
SYPNTKDEK

SEQ ID NO: 3346688 - protein, 7 aa, Plasmodium falciparum
SYPQLRD

SEQ ID NO: 3346689 - protein, 5 aa, Plasmodium falciparum
SYPQN

SEQ ID NO: 3346690 - protein, 13 aa, Plasmodium falciparum
SYPSKNKNHFAFS

SEQ ID NO: 3346691 - protein, 5 aa, Plasmodium falciparum
SYPTK

SEQ ID NO: 3346692 - protein, 8 aa, Plasmodium falciparum
SYPTQSKN

SEQ ID NO: 3346693 - protein, 10 aa, Plasmodium falciparum
SYQKDDNKSF

SEQ ID NO: 3346694 - protein, 21 aa, Plasmodium falciparum
SYQKSTSDKDLSKKKNSNVGA

SEQ ID NO: 3346695 - protein, 9 aa, Plasmodium falciparum
SYQNPTSFN

SEQ ID NO: 3346696 - protein, 9 aa, Plasmodium falciparum
SYQTGTQTF

SEQ ID NO: 3346697 - protein, 7 aa, Plasmodium falciparum
SYRKDQE

SEQ ID NO: 3346698 - protein, 16 aa, Plasmodium falciparum
SYRKNKYKKQKKVQSA

SEQ ID NO: 3346699 - protein, 17 aa, Plasmodium falciparum
SYRNSQDKVDIQNKNEY

SEQ ID NO: 3346700 - protein, 7 aa, Plasmodium falciparum
SYRQTTS

SEQ ID NO: 3346701 - protein, 16 aa, Plasmodium falciparum
SYRRRYRRGGRGGDRF

SEQ ID NO: 3346702 - protein, 13 aa, Plasmodium falciparum
SYRRSKSSSMKDS

SEQ ID NO: 3346703 - protein, 5 aa, Plasmodium falciparum
SYRSK

SEQ ID NO: 3346704 - protein, 5 aa, Plasmodium falciparum
SYRSP

SEQ ID NO: 3346705 - protein, 13 aa, Plasmodium falciparum
SYSDKEKKASQAN

SEQ ID NO: 3346706 - protein, 34 aa, Plasmodium falciparum
SYSEESKTCSDNTHNEDGSKKQNFSRTLGTEGRK

SEQ ID NO: 3346707 - protein, 8 aa, Plasmodium falciparum
SYSGPSPF

SEQ ID NO: 3346708 - protein, 4 aa, Plasmodium falciparum
SYSH

SEQ ID NO: 3346709 - protein, 5 aa, Plasmodium falciparum
SYSID

SEQ ID NO: 3346710 - protein, 4 aa, Plasmodium falciparum
SYSK

SEQ ID NO: 3346711 - protein, 5 aa, Plasmodium falciparum
SYSKN

SEQ ID NO: 3346712 - protein, 8 aa, Plasmodium falciparum
SYSKNNKM

SEQ ID NO: 3346713 - protein, 7 aa, Plasmodium falciparum
SYSNGSE

SEQ ID NO: 3346714 - protein, 75 aa, Plasmodium falciparum
SYSSDKENEGNNDSDNSQKDEQINDNNNINNDDNVNNINNDNNNNNDDDNNISRNKRKKKKNDDEDYKNLKNDND

SEQ ID NO: 3346715 - protein, 6 aa, Plasmodium falciparum
SYSSGN

SEQ ID NO: 3346716 - protein, 9 aa, Plasmodium falciparum
SYSTINNNS

SEQ ID NO: 3346717 - protein, 8 aa, Plasmodium falciparum
SYSTNINR

SEQ ID NO: 3346718 - protein, 8 aa, Plasmodium falciparum
SYSTTVSD

SEQ ID NO: 3346719 - protein, 7 aa, Plasmodium falciparum
SYSVPNK

SEQ ID NO: 3346720 - protein, 4 aa, Plasmodium falciparum
SYSY

SEQ ID NO: 3346721 - protein, 5 aa, Plasmodium falciparum
SYTDD

SEQ ID NO: 3346722 - protein, 10 aa, Plasmodium falciparum
SYTDDDMDDK

SEQ ID NO: 3346723 - protein, 5 aa, Plasmodium falciparum
SYTDQ

SEQ ID NO: 3346724 - protein, 32 aa, Plasmodium falciparum
SYTNPDKNCNRSNSFTSNIDKESNDNNVNKKS

SEQ ID NO: 3346725 - protein, 4 aa, Plasmodium falciparum
SYTP

SEQ ID NO: 3346726 - protein, 8 aa, Plasmodium falciparum
SYTQNNVE

SEQ ID NO: 3346727 - protein, 5 aa, Plasmodium falciparum
SYTQY

SEQ ID NO: 3346728 - protein, 5 aa, Plasmodium falciparum
SYTSK

SEQ ID NO: 3346729 - protein, 4 aa, Plasmodium falciparum
SYTY

SEQ ID NO: 3346730 - protein, 14 aa, Plasmodium falciparum
SYVDGKEKYTDKLN

SEQ ID NO: 3346731 - protein, 34 aa, Plasmodium falciparum
SYVQRKTNITNKKRISQNKPVTRNSYKKNDRINT

SEQ ID NO: 3346732 - protein, 10 aa, Plasmodium falciparum
SYYKNNEQNH

SEQ ID NO: 3346733 - protein, 11 aa, Plasmodium falciparum
SYYNTRADENF

SEQ ID NO: 3346734 - protein, 5 aa, Plasmodium falciparum
SYYRN

SEQ ID NO: 3346735 - protein, 9 aa, Plasmodium falciparum
TADDDKEIN

SEQ ID NO: 3346736 - protein, 4 aa, Plasmodium falciparum
TADG

SEQ ID NO: 3346737 - protein, 7 aa, Plasmodium falciparum
TADPYNP

SEQ ID NO: 3346738 - protein, 4 aa, Plasmodium falciparum
TAEE

SEQ ID NO: 3346739 - protein, 7 aa, Plasmodium falciparum
TAEEKNK

SEQ ID NO: 3346740 - protein, 55 aa, Plasmodium falciparum
TAEENDDKNKKEITKQMEKKNDKVPNIRKGGNTNNSQNKRKTYHGEKNANTTNKD

SEQ ID NO: 3346741 - protein, 9 aa, Plasmodium falciparum
TAEERISAD

SEQ ID NO: 3346742 - protein, 9 aa, Plasmodium falciparum
TAEEYKDKE

SEQ ID NO: 3346743 - protein, 12 aa, Plasmodium falciparum
TAGDTHLGGEDF

SEQ ID NO: 3346744 - protein, 7 aa, Plasmodium falciparum
TAGFSGA

SEQ ID NO: 3346745 - protein, 5 aa, Plasmodium falciparum
TAGGI

SEQ ID NO: 3346746 - protein, 4 aa, Plasmodium falciparum
TAGK

SEQ ID NO: 3346747 - protein, 24 aa, Plasmodium falciparum
TAGKAPRKQLASKAARKSAPISAG

SEQ ID NO: 3346748 - protein, 17 aa, Plasmodium falciparum
TAGMSKGNSPFQTSPDL

SEQ ID NO: 3346749 - protein, 6 aa, Plasmodium falciparum
TAGRYQ

SEQ ID NO: 3346750 - protein, 7 aa, Plasmodium falciparum
TAGTNKE

SEQ ID NO: 3346751 - protein, 7 aa, Plasmodium falciparum
TAGYRAR

SEQ ID NO: 3346752 - protein, 9 aa, Plasmodium falciparum
TAHKNEEEA

SEQ ID NO: 3346753 - protein, 6 aa, Plasmodium falciparum
TAIGGG

SEQ ID NO: 3346754 - protein, 16 aa, Plasmodium falciparum
TAINTNENNNNNNNNN

SEQ ID NO: 3346755 - protein, 7 aa, Plasmodium falciparum
TAIPNLP

SEQ ID NO: 3346756 - protein, 8 aa, Plasmodium falciparum
TAKATYKN

SEQ ID NO: 3346757 - protein, 5 aa, Plasmodium falciparum
TAKEA

SEQ ID NO: 3346758 - protein, 16 aa, Plasmodium falciparum
TAKGKGKNKDKEQKID

SEQ ID NO: 3346759 - protein, 11 aa, Plasmodium falciparum
TAKNSSSNKEH

SEQ ID NO: 3346760 - protein, 11 aa, Plasmodium falciparum
TAKPSASIGQT

SEQ ID NO: 3346761 - protein, 8 aa, Plasmodium falciparum
TAKREEDD

SEQ ID NO: 3346762 - protein, 8 aa, Plasmodium falciparum
TAKTTTQD

SEQ ID NO: 3346763 - protein, 7 aa, Plasmodium falciparum
TALEESA

SEQ ID NO: 3346764 - protein, 9 aa, Plasmodium falciparum
TALTTKRDK

SEQ ID NO: 3346765 - protein, 6 aa, Plasmodium falciparum
TANAYS

SEQ ID NO: 3346766 - protein, 14 aa, Plasmodium falciparum
TANDKEKKTTDENS

SEQ ID NO: 3346767 - protein, 9 aa, Plasmodium falciparum
TANETFGPD

SEQ ID NO: 3346768 - protein, 29 aa, Plasmodium falciparum
TANGSTNNNTYVNDDDDHNNNNNNRRDKL

SEQ ID NO: 3346769 - protein, 299 aa, Plasmodium falciparum
TANNEKNKNNNINKNNNINKNNDINKNNDINKNNDINKNNDINKNNDINKNNDINKNNDINKNNDINKNNDINKNNDINKNNNINKNNNINKNNNINKNNDINKNNDINKNNDINKNNNINKNNDINKNNNINKNNDINKNNDINKNNDINKNNDINKNNNINKNNNINKNNDINKNNNINKNNNINKNNNINKNNDINKNNDINKNNNINKNNDINKNNNINKNNNINKNNNINKNNNINKNNDINKNNNINKNNNINKNNDINKNNNINKNNNINKNNNINNVNNNSSNSYKNRRHH

SEQ ID NO: 3346770 - protein, 11 aa, Plasmodium falciparum
TANNISRSSFD

SEQ ID NO: 3346771 - protein, 44 aa, Plasmodium falciparum
TANPTQEENNNNMNHNNNYNNNNNNNNNNNNNNNNNNNTNHGKN

SEQ ID NO: 3346772 - protein, 9 aa, Plasmodium falciparum
TANSDNEYD

SEQ ID NO: 3346773 - protein, 62 aa, Plasmodium falciparum
TANSRQEGKRNDTQNDKTEKENEKENEKEKDKENEKDKEKDNNSIDKSSYDRHRERKKSDNI

SEQ ID NO: 3346774 - protein, 15 aa, Plasmodium falciparum
TAPTTNSNNTNNNIN

SEQ ID NO: 3346775 - protein, 10 aa, Plasmodium falciparum
TAPYNNVQDN

SEQ ID NO: 3346776 - protein, 7 aa, Plasmodium falciparum
TAQAGDQ

SEQ ID NO: 3346777 - protein, 10 aa, Plasmodium falciparum
TAQNGSKNYT

SEQ ID NO: 3346778 - protein, 10 aa, Plasmodium falciparum
TAQNPHASDP

SEQ ID NO: 3346779 - protein, 7 aa, Plasmodium falciparum
TAQSPRG

SEQ ID NO: 3346780 - protein, 10 aa, Plasmodium falciparum
TARAGRSGKS

SEQ ID NO: 3346781 - protein, 7 aa, Plasmodium falciparum
TAREQTG

SEQ ID NO: 3346782 - protein, 9 aa, Plasmodium falciparum
TARLNKQGS

SEQ ID NO: 3346783 - protein, 5 aa, Plasmodium falciparum
TARPN

SEQ ID NO: 3346784 - protein, 18 aa, Plasmodium falciparum
TARSSGPGGQSVNKAETK

SEQ ID NO: 3346785 - protein, 16 aa, Plasmodium falciparum
TASAPTYLKGPSAEDI

SEQ ID NO: 3346786 - protein, 9 aa, Plasmodium falciparum
TASEAKKNM

SEQ ID NO: 3346787 - protein, 13 aa, Plasmodium falciparum
TASKQMEIFRNKK

SEQ ID NO: 3346788 - protein, 4 aa, Plasmodium falciparum
TASM

SEQ ID NO: 3346789 - protein, 6 aa, Plasmodium falciparum
TASNDT

SEQ ID NO: 3346790 - protein, 5 aa, Plasmodium falciparum
TASNV

SEQ ID NO: 3346791 - protein, 18 aa, Plasmodium falciparum
TASVSSNGSNKHNNILPD

SEQ ID NO: 3346792 - protein, 5 aa, Plasmodium falciparum
TATDS

SEQ ID NO: 3346793 - protein, 5 aa, Plasmodium falciparum
TATKR

SEQ ID NO: 3346794 - protein, 8 aa, Plasmodium falciparum
TATRSAQL

SEQ ID NO: 3346795 - protein, 8 aa, Plasmodium falciparum
TATTPDRR

SEQ ID NO: 3346796 - protein, 51 aa, Plasmodium falciparum
TAYSTQDNKINENDENENDENKNDENKNDENKNDENEYKNKNGENKRTNNE

SEQ ID NO: 3346797 - protein, 6 aa, Plasmodium falciparum
TCAGNE

SEQ ID NO: 3346798 - protein, 17 aa, Plasmodium falciparum
TCAPTEKKDPHQNDLNN

SEQ ID NO: 3346799 - protein, 15 aa, Plasmodium falciparum
TCDDNNEKGDGTNNY

SEQ ID NO: 3346800 - protein, 8 aa, Plasmodium falciparum
TCDHTNNE

SEQ ID NO: 3346801 - protein, 11 aa, Plasmodium falciparum
TCDSKGDNMYT

SEQ ID NO: 3346802 - protein, 7 aa, Plasmodium falciparum
TCDSNNN

SEQ ID NO: 3346803 - protein, 14 aa, Plasmodium falciparum
TCEEGSNKCYEPSN

SEQ ID NO: 3346804 - protein, 8 aa, Plasmodium falciparum
TCGEKQAN

SEQ ID NO: 3346805 - protein, 12 aa, Plasmodium falciparum
TCGNEKKEMEGE

SEQ ID NO: 3346806 - protein, 12 aa, Plasmodium falciparum
TCHNKTSVNNNL

SEQ ID NO: 3346807 - protein, 13 aa, Plasmodium falciparum
TCIKGKDSNYLSH

SEQ ID NO: 3346808 - protein, 13 aa, Plasmodium falciparum
TCINEEDDTNTER

SEQ ID NO: 3346809 - protein, 5 aa, Plasmodium falciparum
TCKIN

SEQ ID NO: 3346810 - protein, 19 aa, Plasmodium falciparum
TCNNNNDFNHANNNNNNYN

SEQ ID NO: 3346811 - protein, 32 aa, Plasmodium falciparum
TCNTTTGTSTNNNNNNNNNNMGNNNIGNNMGN

SEQ ID NO: 3346812 - protein, 5 aa, Plasmodium falciparum
TCPSL

SEQ ID NO: 3346813 - protein, 5 aa, Plasmodium falciparum
TCSDD

SEQ ID NO: 3346814 - protein, 5 aa, Plasmodium falciparum
TCSEE

SEQ ID NO: 3346815 - protein, 10 aa, Plasmodium falciparum
TCSGDNVTKD

SEQ ID NO: 3346816 - protein, 5 aa, Plasmodium falciparum
TCSLP

SEQ ID NO: 3346817 - protein, 6 aa, Plasmodium falciparum
TCSSDN

SEQ ID NO: 3346818 - protein, 12 aa, Plasmodium falciparum
TCSTSYNSMPSS

SEQ ID NO: 3346819 - protein, 5 aa, Plasmodium falciparum
TCSYE

SEQ ID NO: 3346820 - protein, 7 aa, Plasmodium falciparum
TCTDPEE

SEQ ID NO: 3346821 - protein, 6 aa, Plasmodium falciparum
TCTEES

SEQ ID NO: 3346822 - protein, 4 aa, Plasmodium falciparum
TCTN

SEQ ID NO: 3346823 - protein, 6 aa, Plasmodium falciparum
TCTNKE

SEQ ID NO: 3346824 - protein, 8 aa, Plasmodium falciparum
TCTNNRSH

SEQ ID NO: 3346825 - protein, 10 aa, Plasmodium falciparum
TCTSTLPGHT

SEQ ID NO: 3346826 - protein, 15 aa, Plasmodium falciparum
TCVSNENKSNNNIPY

SEQ ID NO: 3346827 - protein, 15 aa, Plasmodium falciparum
TDANEDSNRRYPKRN

SEQ ID NO: 3346828 - protein, 5 aa, Plasmodium falciparum
TDARR

SEQ ID NO: 3346829 - protein, 11 aa, Plasmodium falciparum
TDASVDDIKKS

SEQ ID NO: 3346830 - protein, 15 aa, Plasmodium falciparum
TDDDGYDDDKSNSSF

SEQ ID NO: 3346831 - protein, 20 aa, Plasmodium falciparum
TDDDSGEIGTAKKSLTGHSQ

SEQ ID NO: 3346832 - protein, 6 aa, Plasmodium falciparum
TDDDTD

SEQ ID NO: 3346833 - protein, 8 aa, Plasmodium falciparum
TDDDVDDN

SEQ ID NO: 3346834 - protein, 4 aa, Plasmodium falciparum
TDDE

SEQ ID NO: 3346835 - protein, 5 aa, Plasmodium falciparum
TDDEQ

SEQ ID NO: 3346836 - protein, 8 aa, Plasmodium falciparum
TDDESDSI

SEQ ID NO: 3346837 - protein, 10 aa, Plasmodium falciparum
TDDGNMDEDD

SEQ ID NO: 3346838 - protein, 13 aa, Plasmodium falciparum
TDDHYGKKDLKNK

SEQ ID NO: 3346839 - protein, 11 aa, Plasmodium falciparum
TDDIEEASKLS

SEQ ID NO: 3346840 - protein, 4 aa, Plasmodium falciparum
TDDM

SEQ ID NO: 3346841 - protein, 5 aa, Plasmodium falciparum
TDDNI

SEQ ID NO: 3346842 - protein, 10 aa, Plasmodium falciparum
TDDNKHINNN

SEQ ID NO: 3346843 - protein, 10 aa, Plasmodium falciparum
TDDNVSNKNS

SEQ ID NO: 3346844 - protein, 8 aa, Plasmodium falciparum
TDDQEYNC

SEQ ID NO: 3346845 - protein, 10 aa, Plasmodium falciparum
TDDQYKDAAA

SEQ ID NO: 3346846 - protein, 10 aa, Plasmodium falciparum
TDDSSNDERD

SEQ ID NO: 3346847 - protein, 12 aa, Plasmodium falciparum
TDDVDDDSSIRN

SEQ ID NO: 3346848 - protein, 6 aa, Plasmodium falciparum
TDECNY

SEQ ID NO: 3346849 - protein, 43 aa, Plasmodium falciparum
TDECSNNNDSKSEDMSKKKNNKKKNKSSNKKKDGKKDNIFNDD

SEQ ID NO: 3346850 - protein, 6 aa, Plasmodium falciparum
TDEDTQ

SEQ ID NO: 3346851 - protein, 8 aa, Plasmodium falciparum
TDEDVREK

SEQ ID NO: 3346852 - protein, 6 aa, Plasmodium falciparum
TDEEEP

SEQ ID NO: 3346853 - protein, 11 aa, Plasmodium falciparum
TDEEKSTQGLD

SEQ ID NO: 3346854 - protein, 5 aa, Plasmodium falciparum
TDEEL

SEQ ID NO: 3346855 - protein, 11 aa, Plasmodium falciparum
TDEELNRAKKS

SEQ ID NO: 3346856 - protein, 8 aa, Plasmodium falciparum
TDEENKTK

SEQ ID NO: 3346857 - protein, 7 aa, Plasmodium falciparum
TDEETDK

SEQ ID NO: 3346858 - protein, 9 aa, Plasmodium falciparum
TDEFGKSKS

SEQ ID NO: 3346859 - protein, 9 aa, Plasmodium falciparum
TDEGKKNFN

SEQ ID NO: 3346860 - protein, 7 aa, Plasmodium falciparum
TDEKNNK

SEQ ID NO: 3346861 - protein, 4 aa, Plasmodium falciparum
TDEL

SEQ ID NO: 3346862 - protein, 5 aa, Plasmodium falciparum
TDENA

SEQ ID NO: 3346863 - protein, 8 aa, Plasmodium falciparum
TDENAQNL

SEQ ID NO: 3346864 - protein, 5 aa, Plasmodium falciparum
TDEND

SEQ ID NO: 3346865 - protein, 16 aa, Plasmodium falciparum
TDENEKTNVEETQPVE

SEQ ID NO: 3346866 - protein, 6 aa, Plasmodium falciparum
TDENMY

SEQ ID NO: 3346867 - protein, 26 aa, Plasmodium falciparum
TDENNNNNNDNNNEKYNDDNNNNNNR

SEQ ID NO: 3346868 - protein, 4 aa, Plasmodium falciparum
TDEQ

SEQ ID NO: 3346869 - protein, 8 aa, Plasmodium falciparum
TDEQTKET

SEQ ID NO: 3346870 - protein, 7 aa, Plasmodium falciparum
TDEYNKN

SEQ ID NO: 3346871 - protein, 6 aa, Plasmodium falciparum
TDEYNQ

SEQ ID NO: 3346872 - protein, 19 aa, Plasmodium falciparum
TDGDEQNKEQNISSQTDKG

SEQ ID NO: 3346873 - protein, 26 aa, Plasmodium falciparum
TDGEYKNKRNKEKADIQKKRNNKRRS

SEQ ID NO: 3346874 - protein, 4 aa, Plasmodium falciparum
TDGG

SEQ ID NO: 3346875 - protein, 5 aa, Plasmodium falciparum
TDGHP

SEQ ID NO: 3346876 - protein, 4 aa, Plasmodium falciparum
TDGK

SEQ ID NO: 3346877 - protein, 15 aa, Plasmodium falciparum
TDGKGEEQKNDTQIN

SEQ ID NO: 3346878 - protein, 10 aa, Plasmodium falciparum
TDGKNKKIST

SEQ ID NO: 3346879 - protein, 8 aa, Plasmodium falciparum
TDGMSSKT

SEQ ID NO: 3346880 - protein, 4 aa, Plasmodium falciparum
TDGN

SEQ ID NO: 3346881 - protein, 14 aa, Plasmodium falciparum
TDGNTKDGYKNCQN

SEQ ID NO: 3346882 - protein, 19 aa, Plasmodium falciparum
TDGSFNPPNNNINSNSNNN

SEQ ID NO: 3346883 - protein, 9 aa, Plasmodium falciparum
TDGTGTIDP

SEQ ID NO: 3346884 - protein, 6 aa, Plasmodium falciparum
TDHDTN

SEQ ID NO: 3346885 - protein, 6 aa, Plasmodium falciparum
TDHEDS

SEQ ID NO: 3346886 - protein, 11 aa, Plasmodium falciparum
TDHTDYSNYQK

SEQ ID NO: 3346887 - protein, 30 aa, Plasmodium falciparum
TDHTEENMEDADEHTDHQEEEHVNDDNNEC

SEQ ID NO: 3346888 - protein, 11 aa, Plasmodium falciparum
TDHTNQNAKSK

SEQ ID NO: 3346889 - protein, 6 aa, Plasmodium falciparum
TDIENT

SEQ ID NO: 3346890 - protein, 4 aa, Plasmodium falciparum
TDIK

SEQ ID NO: 3346891 - protein, 4 aa, Plasmodium falciparum
TDIN

SEQ ID NO: 3346892 - protein, 8 aa, Plasmodium falciparum
TDINGKGR

SEQ ID NO: 3346893 - protein, 6 aa, Plasmodium falciparum
TDINNT

SEQ ID NO: 3346894 - protein, 5 aa, Plasmodium falciparum
TDITS

SEQ ID NO: 3346895 - protein, 13 aa, Plasmodium falciparum
TDIYSDKEKEDKI

SEQ ID NO: 3346896 - protein, 7 aa, Plasmodium falciparum
TDKDNKI

SEQ ID NO: 3346897 - protein, 7 aa, Plasmodium falciparum
TDKDRYS

SEQ ID NO: 3346898 - protein, 14 aa, Plasmodium falciparum
TDKEISENKNEKII

SEQ ID NO: 3346899 - protein, 37 aa, Plasmodium falciparum
TDKFKNDKGKNDKGEDKNVDKTKKDADKKKEKNEEKI

SEQ ID NO: 3346900 - protein, 8 aa, Plasmodium falciparum
TDKGEEFI

SEQ ID NO: 3346901 - protein, 8 aa, Plasmodium falciparum
TDKGNDHF

SEQ ID NO: 3346902 - protein, 13 aa, Plasmodium falciparum
TDKGTIDQKMKKT

SEQ ID NO: 3346903 - protein, 6 aa, Plasmodium falciparum
TDKHTY

SEQ ID NO: 3346904 - protein, 4 aa, Plasmodium falciparum
TDKI

SEQ ID NO: 3346905 - protein, 21 aa, Plasmodium falciparum
TDKIKNGTKKTTKTKENGEHV

SEQ ID NO: 3346906 - protein, 9 aa, Plasmodium falciparum
TDKKKSEEK

SEQ ID NO: 3346907 - protein, 19 aa, Plasmodium falciparum
TDKKNLTNTRNTKNSTLPY

SEQ ID NO: 3346908 - protein, 14 aa, Plasmodium falciparum
TDKKNVNPSQINNN

SEQ ID NO: 3346909 - protein, 5 aa, Plasmodium falciparum
TDKKP

SEQ ID NO: 3346910 - protein, 4 aa, Plasmodium falciparum
TDKL

SEQ ID NO: 3346911 - protein, 4 aa, Plasmodium falciparum
TDKN

SEQ ID NO: 3346912 - protein, 8 aa, Plasmodium falciparum
TDKNEYNK

SEQ ID NO: 3346913 - protein, 10 aa, Plasmodium falciparum
TDKNKDDIKG

SEQ ID NO: 3346914 - protein, 15 aa, Plasmodium falciparum
TDKNSASTDADITEK

SEQ ID NO: 3346915 - protein, 9 aa, Plasmodium falciparum
TDKNSNKEL

SEQ ID NO: 3346916 - protein, 4 aa, Plasmodium falciparum
TDKQ

SEQ ID NO: 3346917 - protein, 12 aa, Plasmodium falciparum
TDKYENLNFTFN

SEQ ID NO: 3346918 - protein, 13 aa, Plasmodium falciparum
TDLSNKDENTTIS

SEQ ID NO: 3346919 - protein, 17 aa, Plasmodium falciparum
TDLSRNPYEQDTDKKQR

SEQ ID NO: 3346920 - protein, 11 aa, Plasmodium falciparum
TDLTEEQKETL

SEQ ID NO: 3346921 - protein, 9 aa, Plasmodium falciparum
TDMYGTKED

SEQ ID NO: 3346922 - protein, 6 aa, Plasmodium falciparum
TDNAMP

SEQ ID NO: 3346923 - protein, 28 aa, Plasmodium falciparum
TDNDESKKKIKTDGEENDIMESKGKDSY

SEQ ID NO: 3346924 - protein, 5 aa, Plasmodium falciparum
TDNDI

SEQ ID NO: 3346925 - protein, 9 aa, Plasmodium falciparum
TDNDSNTLE

SEQ ID NO: 3346926 - protein, 4 aa, Plasmodium falciparum
TDNE

SEQ ID NO: 3346927 - protein, 19 aa, Plasmodium falciparum
TDNECANAKTTIMALQILK

SEQ ID NO: 3346928 - protein, 12 aa, Plasmodium falciparum
TDNEEDHGDNKI

SEQ ID NO: 3346929 - protein, 8 aa, Plasmodium falciparum
TDNEKENN

SEQ ID NO: 3346930 - protein, 23 aa, Plasmodium falciparum
TDNELKEEDNNMSSKKKIDSPSY

SEQ ID NO: 3346931 - protein, 6 aa, Plasmodium falciparum
TDNIEP

SEQ ID NO: 3346932 - protein, 14 aa, Plasmodium falciparum
TDNIRNDKNKNSTF

SEQ ID NO: 3346933 - protein, 8 aa, Plasmodium falciparum
TDNKEPNY

SEQ ID NO: 3346934 - protein, 11 aa, Plasmodium falciparum
TDNKNNESENS

SEQ ID NO: 3346935 - protein, 37 aa, Plasmodium falciparum
TDNLDNDENYESFDNHPDDYKTSNKDMDENDKLNTNE

SEQ ID NO: 3346936 - protein, 6 aa, Plasmodium falciparum
TDNNCD

SEQ ID NO: 3346937 - protein, 7 aa, Plasmodium falciparum
TDNNMED

SEQ ID NO: 3346938 - protein, 10 aa, Plasmodium falciparum
TDNNTNADHT

SEQ ID NO: 3346939 - protein, 4 aa, Plasmodium falciparum
TDNS

SEQ ID NO: 3346940 - protein, 8 aa, Plasmodium falciparum
TDNSEDHS

SEQ ID NO: 3346941 - protein, 6 aa, Plasmodium falciparum
TDNSFT

SEQ ID NO: 3346942 - protein, 9 aa, Plasmodium falciparum
TDNSTLYNK

SEQ ID NO: 3346943 - protein, 5 aa, Plasmodium falciparum
TDNTD

SEQ ID NO: 3346944 - protein, 5 aa, Plasmodium falciparum
TDNYN

SEQ ID NO: 3346945 - protein, 6 aa, Plasmodium falciparum
TDPENK

SEQ ID NO: 3346946 - protein, 15 aa, Plasmodium falciparum
TDPHYNSTSCSPQNN

SEQ ID NO: 3346947 - protein, 29 aa, Plasmodium falciparum
TDPKEESGKNVNALPESKEATNILTAELK

SEQ ID NO: 3346948 - protein, 7 aa, Plasmodium falciparum
TDPKNGD

SEQ ID NO: 3346949 - protein, 9 aa, Plasmodium falciparum
TDPNADDPL

SEQ ID NO: 3346950 - protein, 5 aa, Plasmodium falciparum
TDPNL

SEQ ID NO: 3346951 - protein, 4 aa, Plasmodium falciparum
TDPS

SEQ ID NO: 3346952 - protein, 8 aa, Plasmodium falciparum
TDPSGNYS

SEQ ID NO: 3346953 - protein, 6 aa, Plasmodium falciparum
TDPTEN

SEQ ID NO: 3346954 - protein, 11 aa, Plasmodium falciparum
TDQDATDEDKK

SEQ ID NO: 3346955 - protein, 10 aa, Plasmodium falciparum
TDQDTGERVV

SEQ ID NO: 3346956 - protein, 5 aa, Plasmodium falciparum
TDQEA

SEQ ID NO: 3346957 - protein, 6 aa, Plasmodium falciparum
TDQEKR

SEQ ID NO: 3346958 - protein, 4 aa, Plasmodium falciparum
TDQI

SEQ ID NO: 3346959 - protein, 12 aa, Plasmodium falciparum
TDQNKQTVKNNK

SEQ ID NO: 3346960 - protein, 8 aa, Plasmodium falciparum
TDQTELND

SEQ ID NO: 3346961 - protein, 4 aa, Plasmodium falciparum
TDRA

SEQ ID NO: 3346962 - protein, 4 aa, Plasmodium falciparum
TDRK

SEQ ID NO: 3346963 - protein, 4 aa, Plasmodium falciparum
TDRN

SEQ ID NO: 3346964 - protein, 7 aa, Plasmodium falciparum
TDRSNGT

SEQ ID NO: 3346965 - protein, 5 aa, Plasmodium falciparum
TDRTF

SEQ ID NO: 3346966 - protein, 8 aa, Plasmodium falciparum
TDRTSTND

SEQ ID NO: 3346967 - protein, 4 aa, Plasmodium falciparum
TDSA

SEQ ID NO: 3346968 - protein, 9 aa, Plasmodium falciparum
TDSDPNNIP

SEQ ID NO: 3346969 - protein, 18 aa, Plasmodium falciparum
TDSEKNMTSQKSITSEKN

SEQ ID NO: 3346970 - protein, 7 aa, Plasmodium falciparum
TDSKEDT

SEQ ID NO: 3346971 - protein, 14 aa, Plasmodium falciparum
TDSNIPDSNENVEN

SEQ ID NO: 3346972 - protein, 9 aa, Plasmodium falciparum
TDSNNNKYA

SEQ ID NO: 3346973 - protein, 14 aa, Plasmodium falciparum
TDSPFGVSGSPIGN

SEQ ID NO: 3346974 - protein, 7 aa, Plasmodium falciparum
TDSPYIG

SEQ ID NO: 3346975 - protein, 17 aa, Plasmodium falciparum
TDSSKEENNFKGESYEQ

SEQ ID NO: 3346976 - protein, 4 aa, Plasmodium falciparum
TDST

SEQ ID NO: 3346977 - protein, 31 aa, Plasmodium falciparum
TDTDNNKRNETNDTKDINNSFNNNTNENNYT

SEQ ID NO: 3346978 - protein, 9 aa, Plasmodium falciparum
TDTENNEFN

SEQ ID NO: 3346979 - protein, 7 aa, Plasmodium falciparum
TDTKKKI

SEQ ID NO: 3346980 - protein, 6 aa, Plasmodium falciparum
TDTQAP

SEQ ID NO: 3346981 - protein, 6 aa, Plasmodium falciparum
TDTSEN

SEQ ID NO: 3346982 - protein, 7 aa, Plasmodium falciparum
TDTSFNN

SEQ ID NO: 3346983 - protein, 5 aa, Plasmodium falciparum
TDTSL

SEQ ID NO: 3346984 - protein, 22 aa, Plasmodium falciparum
TDTSSCSNYSSDYSYTSESEKI

SEQ ID NO: 3346985 - protein, 8 aa, Plasmodium falciparum
TDVAGRDI

SEQ ID NO: 3346986 - protein, 8 aa, Plasmodium falciparum
TDVEKENS

SEQ ID NO: 3346987 - protein, 4 aa, Plasmodium falciparum
TDVK

SEQ ID NO: 3346988 - protein, 6 aa, Plasmodium falciparum
TDVQNE

SEQ ID NO: 3346989 - protein, 4 aa, Plasmodium falciparum
TDVT

SEQ ID NO: 3346990 - protein, 6 aa, Plasmodium falciparum
TDVTRT

SEQ ID NO: 3346991 - protein, 5 aa, Plasmodium falciparum
TDYSE

SEQ ID NO: 3346992 - protein, 4 aa, Plasmodium falciparum
TEAL

SEQ ID NO: 3346993 - protein, 8 aa, Plasmodium falciparum
TECSDKRE

SEQ ID NO: 3346994 - protein, 7 aa, Plasmodium falciparum
TEDAQSA

SEQ ID NO: 3346995 - protein, 12 aa, Plasmodium falciparum
TEDAVLNKDFTF

SEQ ID NO: 3346996 - protein, 4 aa, Plasmodium falciparum
TEDD

SEQ ID NO: 3346997 - protein, 17 aa, Plasmodium falciparum
TEDDHVNNAETGGKEDE

SEQ ID NO: 3346998 - protein, 13 aa, Plasmodium falciparum
TEDDIYNNPNPVP

SEQ ID NO: 3346999 - protein, 5 aa, Plasmodium falciparum
TEDEN

SEQ ID NO: 3347000 - protein, 9 aa, Plasmodium falciparum
TEDGKEKKM

SEQ ID NO: 3347001 - protein, 8 aa, Plasmodium falciparum
TEDKIQNV

SEQ ID NO: 3347002 - protein, 13 aa, Plasmodium falciparum
TEDKNNLQKSSDY

SEQ ID NO: 3347003 - protein, 16 aa, Plasmodium falciparum
TEDKSEGDSKSHHKNK

SEQ ID NO: 3347004 - protein, 6 aa, Plasmodium falciparum
TEDKYG

SEQ ID NO: 3347005 - protein, 5 aa, Plasmodium falciparum
TEDNE

SEQ ID NO: 3347006 - protein, 6 aa, Plasmodium falciparum
TEDNEQ

SEQ ID NO: 3347007 - protein, 5 aa, Plasmodium falciparum
TEDNK

SEQ ID NO: 3347008 - protein, 12 aa, Plasmodium falciparum
TEDNVEQVSTTQ

SEQ ID NO: 3347009 - protein, 4 aa, Plasmodium falciparum
TEED

SEQ ID NO: 3347010 - protein, 14 aa, Plasmodium falciparum
TEEDDKENEDDSKE

SEQ ID NO: 3347011 - protein, 5 aa, Plasmodium falciparum
TEEDN

SEQ ID NO: 3347012 - protein, 31 aa, Plasmodium falciparum
TEEDSTEEDNTEEQNKRRHNAKEDNTQKFSH

SEQ ID NO: 3347013 - protein, 11 aa, Plasmodium falciparum
TEEEIKKETQR

SEQ ID NO: 3347014 - protein, 6 aa, Plasmodium falciparum
TEEEKR

SEQ ID NO: 3347015 - protein, 10 aa, Plasmodium falciparum
TEEESNKKHS

SEQ ID NO: 3347016 - protein, 11 aa, Plasmodium falciparum
TEEGYGNNSTY

SEQ ID NO: 3347017 - protein, 11 aa, Plasmodium falciparum
TEEIEKENSKL

SEQ ID NO: 3347018 - protein, 8 aa, Plasmodium falciparum
TEEKDSER

SEQ ID NO: 3347019 - protein, 45 aa, Plasmodium falciparum
TEEKNDLNGVEGKNKRKNINVEENKKGKNKKQKLGNNVETENMNE

SEQ ID NO: 3347020 - protein, 23 aa, Plasmodium falciparum
TEENENMDEKKYNDGDINKTENE

SEQ ID NO: 3347021 - protein, 9 aa, Plasmodium falciparum
TEENKSEEE

SEQ ID NO: 3347022 - protein, 9 aa, Plasmodium falciparum
TEENNERDN

SEQ ID NO: 3347023 - protein, 6 aa, Plasmodium falciparum
TEENYE

SEQ ID NO: 3347024 - protein, 12 aa, Plasmodium falciparum
TEEQEGKEKNDI

SEQ ID NO: 3347025 - protein, 12 aa, Plasmodium falciparum
TEEQNKDQLKNH

SEQ ID NO: 3347026 - protein, 5 aa, Plasmodium falciparum
TEEQR

SEQ ID NO: 3347027 - protein, 5 aa, Plasmodium falciparum
TEESC

SEQ ID NO: 3347028 - protein, 4 aa, Plasmodium falciparum
TEET

SEQ ID NO: 3347029 - protein, 7 aa, Plasmodium falciparum
TEETNEF

SEQ ID NO: 3347030 - protein, 7 aa, Plasmodium falciparum
TEETPNS

SEQ ID NO: 3347031 - protein, 7 aa, Plasmodium falciparum
TEEYYDG

SEQ ID NO: 3347032 - protein, 14 aa, Plasmodium falciparum
TEGEQVQNNNRNVD

SEQ ID NO: 3347033 - protein, 5 aa, Plasmodium falciparum
TEGGI

SEQ ID NO: 3347034 - protein, 6 aa, Plasmodium falciparum
TEGGSG

SEQ ID NO: 3347035 - protein, 10 aa, Plasmodium falciparum
TEGKNNPDHA

SEQ ID NO: 3347036 - protein, 4 aa, Plasmodium falciparum
TEGY

SEQ ID NO: 3347037 - protein, 30 aa, Plasmodium falciparum
TEGYDSSSKNRRTPRINAPSNIHNNNDSSN

SEQ ID NO: 3347038 - protein, 8 aa, Plasmodium falciparum
TEHHENAK

SEQ ID NO: 3347039 - protein, 5 aa, Plasmodium falciparum
TEIDE

SEQ ID NO: 3347040 - protein, 5 aa, Plasmodium falciparum
TEIED

SEQ ID NO: 3347041 - protein, 6 aa, Plasmodium falciparum
TEIEQN

SEQ ID NO: 3347042 - protein, 17 aa, Plasmodium falciparum
TEINNAQTDTQNNTRNL

SEQ ID NO: 3347043 - protein, 4 aa, Plasmodium falciparum
TEIS

SEQ ID NO: 3347044 - protein, 75 aa, Plasmodium falciparum
TEKAQNEKIQTQNIQTDNVKTQNAQPDNVQTQNAQPDNVQTQNAQPDNVQTQNAQPDNVQTQNAQPDNTQYKNEP

SEQ ID NO: 3347045 - protein, 9 aa, Plasmodium falciparum
TEKAQNENI

SEQ ID NO: 3347046 - protein, 14 aa, Plasmodium falciparum
TEKARNKNKQPVVK

SEQ ID NO: 3347047 - protein, 6 aa, Plasmodium falciparum
TEKDTK

SEQ ID NO: 3347048 - protein, 6 aa, Plasmodium falciparum
TEKECE

SEQ ID NO: 3347049 - protein, 9 aa, Plasmodium falciparum
TEKEEDIKD

SEQ ID NO: 3347050 - protein, 10 aa, Plasmodium falciparum
TEKEEKKVTA

SEQ ID NO: 3347051 - protein, 5 aa, Plasmodium falciparum
TEKEI

SEQ ID NO: 3347052 - protein, 6 aa, Plasmodium falciparum
TEKELE

SEQ ID NO: 3347053 - protein, 7 aa, Plasmodium falciparum
TEKENIQ

SEQ ID NO: 3347054 - protein, 9 aa, Plasmodium falciparum
TEKENNKKV

SEQ ID NO: 3347055 - protein, 17 aa, Plasmodium falciparum
TEKENQNKSTSSKKEKQ

SEQ ID NO: 3347056 - protein, 8 aa, Plasmodium falciparum
TEKENWDD

SEQ ID NO: 3347057 - protein, 7 aa, Plasmodium falciparum
TEKGESQ

SEQ ID NO: 3347058 - protein, 10 aa, Plasmodium falciparum
TEKHAEDETV

SEQ ID NO: 3347059 - protein, 6 aa, Plasmodium falciparum
TEKHKK

SEQ ID NO: 3347060 - protein, 4 aa, Plasmodium falciparum
TEKI

SEQ ID NO: 3347061 - protein, 11 aa, Plasmodium falciparum
TEKIKSKSVEY

SEQ ID NO: 3347062 - protein, 4 aa, Plasmodium falciparum
TEKK

SEQ ID NO: 3347063 - protein, 8 aa, Plasmodium falciparum
TEKKDSLD

SEQ ID NO: 3347064 - protein, 9 aa, Plasmodium falciparum
TEKKHKEND

SEQ ID NO: 3347065 - protein, 5 aa, Plasmodium falciparum
TEKKK

SEQ ID NO: 3347066 - protein, 15 aa, Plasmodium falciparum
TEKKKNTSNDSEQIN

SEQ ID NO: 3347067 - protein, 18 aa, Plasmodium falciparum
TEKLQNQSIEKNKETSQK

SEQ ID NO: 3347068 - protein, 28 aa, Plasmodium falciparum
TEKMKSELSKEKDKKKKQLKDGKKVEDN

SEQ ID NO: 3347069 - protein, 80 aa, Plasmodium falciparum
TEKNKLENKDTTSNNNNNNNESNNNNNESNNNNNESNNNNNESNNNNNESNNNNNESNNNNNESNNNNNGNTCGNNNNNS

SEQ ID NO: 3347070 - protein, 5 aa, Plasmodium falciparum
TEKNN

SEQ ID NO: 3347071 - protein, 9 aa, Plasmodium falciparum
TEKNNNQIN

SEQ ID NO: 3347072 - protein, 19 aa, Plasmodium falciparum
TEKNRKNEEHNKNKNINNN

SEQ ID NO: 3347073 - protein, 5 aa, Plasmodium falciparum
TEKNS

SEQ ID NO: 3347074 - protein, 13 aa, Plasmodium falciparum
TEKRTGTPERPLS

SEQ ID NO: 3347075 - protein, 8 aa, Plasmodium falciparum
TEKRTNGP

SEQ ID NO: 3347076 - protein, 9 aa, Plasmodium falciparum
TEKSKEEIC

SEQ ID NO: 3347077 - protein, 5 aa, Plasmodium falciparum
TEKSP

SEQ ID NO: 3347078 - protein, 15 aa, Plasmodium falciparum
TEKSQDLSSLSKEQI

SEQ ID NO: 3347079 - protein, 12 aa, Plasmodium falciparum
TEKTKGKDHEDE

SEQ ID NO: 3347080 - protein, 9 aa, Plasmodium falciparum
TEKTRIPKE

SEQ ID NO: 3347081 - protein, 5 aa, Plasmodium falciparum
TEKVN

SEQ ID NO: 3347082 - protein, 8 aa, Plasmodium falciparum
TEKYGKKE

SEQ ID NO: 3347083 - protein, 19 aa, Plasmodium falciparum
TEKYKRKRAEDIIKDINRN

SEQ ID NO: 3347084 - protein, 8 aa, Plasmodium falciparum
TEKYNDKN

SEQ ID NO: 3347085 - protein, 5 aa, Plasmodium falciparum
TEKYS

SEQ ID NO: 3347086 - protein, 13 aa, Plasmodium falciparum
TELEKKEKELKDI

SEQ ID NO: 3347087 - protein, 6 aa, Plasmodium falciparum
TELQRK

SEQ ID NO: 3347088 - protein, 8 aa, Plasmodium falciparum
TELSGGQR

SEQ ID NO: 3347089 - protein, 7 aa, Plasmodium falciparum
TELTERE

SEQ ID NO: 3347090 - protein, 8 aa, Plasmodium falciparum
TELTNNSS

SEQ ID NO: 3347091 - protein, 5 aa, Plasmodium falciparum
TEMDN

SEQ ID NO: 3347092 - protein, 4 aa, Plasmodium falciparum
TEND

SEQ ID NO: 3347093 - protein, 8 aa, Plasmodium falciparum
TENDNPLD

SEQ ID NO: 3347094 - protein, 5 aa, Plasmodium falciparum
TENGL

SEQ ID NO: 3347095 - protein, 5 aa, Plasmodium falciparum
TENKD

SEQ ID NO: 3347096 - protein, 12 aa, Plasmodium falciparum
TENKDNNDQGID

SEQ ID NO: 3347097 - protein, 12 aa, Plasmodium falciparum
TENKESYKVDET

SEQ ID NO: 3347098 - protein, 11 aa, Plasmodium falciparum
TENKKSTHKCY

SEQ ID NO: 3347099 - protein, 4 aa, Plasmodium falciparum
TENL

SEQ ID NO: 3347100 - protein, 9 aa, Plasmodium falciparum
TENMSNTDD

SEQ ID NO: 3347101 - protein, 8 aa, Plasmodium falciparum
TENMTDEE

SEQ ID NO: 3347102 - protein, 13 aa, Plasmodium falciparum
TENNDLKEQHNSI

SEQ ID NO: 3347103 - protein, 8 aa, Plasmodium falciparum
TENNEVEK

SEQ ID NO: 3347104 - protein, 41 aa, Plasmodium falciparum
TENNSDKKSKIDDDLSSNEDSNLSSNKLNKKSIYSKKSNVQ

SEQ ID NO: 3347105 - protein, 30 aa, Plasmodium falciparum
TENNSSNNDNNLSISSEKKKDLNKGKNSQI

SEQ ID NO: 3347106 - protein, 5 aa, Plasmodium falciparum
TENPE

SEQ ID NO: 3347107 - protein, 96 aa, Plasmodium falciparum
TENRNNEGVNDRENNNNNDDDNNKYGDNNKYGDNNKYGDNNKYGDNNKYGDNNKCGDNNKYGDNNKYGDNNKYGDNNKYGDNNKYGDNNKYGDHNN

SEQ ID NO: 3347108 - protein, 7 aa, Plasmodium falciparum
TENVPKV

SEQ ID NO: 3347109 - protein, 15 aa, Plasmodium falciparum
TENVQQSLQNEEDYV

SEQ ID NO: 3347110 - protein, 4 aa, Plasmodium falciparum
TENY

SEQ ID NO: 3347111 - protein, 12 aa, Plasmodium falciparum
TENYHNNKGEQI

SEQ ID NO: 3347112 - protein, 5 aa, Plasmodium falciparum
TENYK

SEQ ID NO: 3347113 - protein, 4 aa, Plasmodium falciparum
TEQD

SEQ ID NO: 3347114 - protein, 7 aa, Plasmodium falciparum
TEQDESI

SEQ ID NO: 3347115 - protein, 5 aa, Plasmodium falciparum
TEQEK

SEQ ID NO: 3347116 - protein, 44 aa, Plasmodium falciparum
TEQIENDEYDENDEYDEYDKNDENDKNDYNNYNGNKNYGDINND

SEQ ID NO: 3347117 - protein, 11 aa, Plasmodium falciparum
TEQKKKNDNED

SEQ ID NO: 3347118 - protein, 11 aa, Plasmodium falciparum
TEQPERETQQE

SEQ ID NO: 3347119 - protein, 21 aa, Plasmodium falciparum
TEQSKASVSLQTEKRRRKDVS

SEQ ID NO: 3347120 - protein, 22 aa, Plasmodium falciparum
TEQTEIGKDIKNTEERNTDNPV

SEQ ID NO: 3347121 - protein, 9 aa, Plasmodium falciparum
TEQTPYFGD

SEQ ID NO: 3347122 - protein, 5 aa, Plasmodium falciparum
TERAL

SEQ ID NO: 3347123 - protein, 8 aa, Plasmodium falciparum
TERDEEKM

SEQ ID NO: 3347124 - protein, 9 aa, Plasmodium falciparum
TERDTGRNR

SEQ ID NO: 3347125 - protein, 6 aa, Plasmodium falciparum
TEREYS

SEQ ID NO: 3347126 - protein, 10 aa, Plasmodium falciparum
TERKGSVGNS

SEQ ID NO: 3347127 - protein, 131 aa, Plasmodium falciparum
TERNEDGNDEDNTEENVEEKKDDIKEEKQDDLKEEKKDDSKDDSKDDSKDDSKDNSKDDSKGDSKDDSKGDSKDDSKDDSKDDSKDDSKDNSKDDSKDDSKGDSKNDSKDDSKNDSKDDTKEESKKENELD

SEQ ID NO: 3347128 - protein, 7 aa, Plasmodium falciparum
TERNEPQ

SEQ ID NO: 3347129 - protein, 5 aa, Plasmodium falciparum
TESDC

SEQ ID NO: 3347130 - protein, 11 aa, Plasmodium falciparum
TESETEKEDEK

SEQ ID NO: 3347131 - protein, 6 aa, Plasmodium falciparum
TESEYD

SEQ ID NO: 3347132 - protein, 4 aa, Plasmodium falciparum
TESK

SEQ ID NO: 3347133 - protein, 5 aa, Plasmodium falciparum
TESKI

SEQ ID NO: 3347134 - protein, 9 aa, Plasmodium falciparum
TESNANEEI

SEQ ID NO: 3347135 - protein, 8 aa, Plasmodium falciparum
TESSQNTT

SEQ ID NO: 3347136 - protein, 5 aa, Plasmodium falciparum
TESVE

SEQ ID NO: 3347137 - protein, 4 aa, Plasmodium falciparum
TETC

SEQ ID NO: 3347138 - protein, 19 aa, Plasmodium falciparum
TETEKNQEREKLEREKDKY

SEQ ID NO: 3347139 - protein, 4 aa, Plasmodium falciparum
TETG

SEQ ID NO: 3347140 - protein, 12 aa, Plasmodium falciparum
TETNEEKNQNNE

SEQ ID NO: 3347141 - protein, 7 aa, Plasmodium falciparum
TETNKKK

SEQ ID NO: 3347142 - protein, 8 aa, Plasmodium falciparum
TEVKSNES

SEQ ID NO: 3347143 - protein, 11 aa, Plasmodium falciparum
TEVQQKRSLSN

SEQ ID NO: 3347144 - protein, 6 aa, Plasmodium falciparum
TEVTNK

SEQ ID NO: 3347145 - protein, 13 aa, Plasmodium falciparum
TEYDEEDKEADEI

SEQ ID NO: 3347146 - protein, 10 aa, Plasmodium falciparum
TEYDNSEYNV

SEQ ID NO: 3347147 - protein, 6 aa, Plasmodium falciparum
TEYEDS

SEQ ID NO: 3347148 - protein, 10 aa, Plasmodium falciparum
TEYKYGPREL

SEQ ID NO: 3347149 - protein, 5 aa, Plasmodium falciparum
TEYNN

SEQ ID NO: 3347150 - protein, 14 aa, Plasmodium falciparum
TEYRNKSSKSSDEL

SEQ ID NO: 3347151 - protein, 9 aa, Plasmodium falciparum
TEYTNKEKE

SEQ ID NO: 3347152 - protein, 12 aa, Plasmodium falciparum
TEYTSSDRSSED

SEQ ID NO: 3347153 - protein, 22 aa, Plasmodium falciparum
TFDASATIKGSKNSDIEEAEEK

SEQ ID NO: 3347154 - protein, 12 aa, Plasmodium falciparum
TFDENKYSNQNN

SEQ ID NO: 3347155 - protein, 10 aa, Plasmodium falciparum
TFDETKNKNN

SEQ ID NO: 3347156 - protein, 5 aa, Plasmodium falciparum
TFDTH

SEQ ID NO: 3347157 - protein, 17 aa, Plasmodium falciparum
TFEKNKNRQNNNYDNNN

SEQ ID NO: 3347158 - protein, 19 aa, Plasmodium falciparum
TFERNESNNEKMKDIKNDD

SEQ ID NO: 3347159 - protein, 9 aa, Plasmodium falciparum
TFGNNKSPM

SEQ ID NO: 3347160 - protein, 7 aa, Plasmodium falciparum
TFKNEDS

SEQ ID NO: 3347161 - protein, 11 aa, Plasmodium falciparum
TFNDQQKDEVI

SEQ ID NO: 3347162 - protein, 20 aa, Plasmodium falciparum
TFNKQPTTITTNNNMNNQNP

SEQ ID NO: 3347163 - protein, 25 aa, Plasmodium falciparum
TFNNDKENITNNNTTNNINNNAENN

SEQ ID NO: 3347164 - protein, 5 aa, Plasmodium falciparum
TFNNK

SEQ ID NO: 3347165 - protein, 11 aa, Plasmodium falciparum
TFNNKKKNTQN

SEQ ID NO: 3347166 - protein, 10 aa, Plasmodium falciparum
TFNNKPKDNN

SEQ ID NO: 3347167 - protein, 9 aa, Plasmodium falciparum
TFNSNTNPS

SEQ ID NO: 3347168 - protein, 15 aa, Plasmodium falciparum
TFNTNNQQVNTYNQY

SEQ ID NO: 3347169 - protein, 9 aa, Plasmodium falciparum
TFPETHDDR

SEQ ID NO: 3347170 - protein, 6 aa, Plasmodium falciparum
TFPNAK

SEQ ID NO: 3347171 - protein, 4 aa, Plasmodium falciparum
TFPY

SEQ ID NO: 3347172 - protein, 5 aa, Plasmodium falciparum
TFRTR

SEQ ID NO: 3347173 - protein, 5 aa, Plasmodium falciparum
TFSDK

SEQ ID NO: 3347174 - protein, 7 aa, Plasmodium falciparum
TFSPDGR

SEQ ID NO: 3347175 - protein, 5 aa, Plasmodium falciparum
TFSPE

SEQ ID NO: 3347176 - protein, 4 aa, Plasmodium falciparum
TFST

SEQ ID NO: 3347177 - protein, 4 aa, Plasmodium falciparum
TFSY

SEQ ID NO: 3347178 - protein, 4 aa, Plasmodium falciparum
TFTG

SEQ ID NO: 3347179 - protein, 11 aa, Plasmodium falciparum
TFYTNDNNKNS

SEQ ID NO: 3347180 - protein, 7 aa, Plasmodium falciparum
TGAGNNW

SEQ ID NO: 3347181 - protein, 9 aa, Plasmodium falciparum
TGCGKTTQV

SEQ ID NO: 3347182 - protein, 13 aa, Plasmodium falciparum
TGDKNENKENIAE

SEQ ID NO: 3347183 - protein, 4 aa, Plasmodium falciparum
TGDM

SEQ ID NO: 3347184 - protein, 6 aa, Plasmodium falciparum
TGDNNG

SEQ ID NO: 3347185 - protein, 9 aa, Plasmodium falciparum
TGDNRGKTN

SEQ ID NO: 3347186 - protein, 5 aa, Plasmodium falciparum
TGDPN

SEQ ID NO: 3347187 - protein, 19 aa, Plasmodium falciparum
TGDTNNEHNMDNKKDKNEK

SEQ ID NO: 3347188 - protein, 4 aa, Plasmodium falciparum
TGED

SEQ ID NO: 3347189 - protein, 6 aa, Plasmodium falciparum
TGEKQN

SEQ ID NO: 3347190 - protein, 9 aa, Plasmodium falciparum
TGEKYGTNN

SEQ ID NO: 3347191 - protein, 4 aa, Plasmodium falciparum
TGEP

SEQ ID NO: 3347192 - protein, 5 aa, Plasmodium falciparum
TGEPL

SEQ ID NO: 3347193 - protein, 8 aa, Plasmodium falciparum
TGEQKEEH

SEQ ID NO: 3347194 - protein, 7 aa, Plasmodium falciparum
TGERPQN

SEQ ID NO: 3347195 - protein, 5 aa, Plasmodium falciparum
TGESR

SEQ ID NO: 3347196 - protein, 12 aa, Plasmodium falciparum
TGETQWQKPRKI

SEQ ID NO: 3347197 - protein, 6 aa, Plasmodium falciparum
TGGDDG

SEQ ID NO: 3347198 - protein, 14 aa, Plasmodium falciparum
TGGEKKKSEKNRLK

SEQ ID NO: 3347199 - protein, 4 aa, Plasmodium falciparum
TGGH

SEQ ID NO: 3347200 - protein, 25 aa, Plasmodium falciparum
TGGKAPRKQLASKAARKSAPVSTGI

SEQ ID NO: 3347201 - protein, 5 aa, Plasmodium falciparum
TGGKC

SEQ ID NO: 3347202 - protein, 28 aa, Plasmodium falciparum
TGGKKKIHKKKRKYELGRPPSNTKLGSR

SEQ ID NO: 3347203 - protein, 6 aa, Plasmodium falciparum
TGGKTE

SEQ ID NO: 3347204 - protein, 10 aa, Plasmodium falciparum
TGGQSQKSCN

SEQ ID NO: 3347205 - protein, 5 aa, Plasmodium falciparum
TGGSC

SEQ ID NO: 3347206 - protein, 11 aa, Plasmodium falciparum
TGGSKKKNVNV

SEQ ID NO: 3347207 - protein, 7 aa, Plasmodium falciparum
TGGTIKD

SEQ ID NO: 3347208 - protein, 9 aa, Plasmodium falciparum
TGGTSKKKL

SEQ ID NO: 3347209 - protein, 17 aa, Plasmodium falciparum
TGGTSTTGSATNAASTI

SEQ ID NO: 3347210 - protein, 14 aa, Plasmodium falciparum
TGHESTKKKFDSKG

SEQ ID NO: 3347211 - protein, 8 aa, Plasmodium falciparum
TGHNADDL

SEQ ID NO: 3347212 - protein, 6 aa, Plasmodium falciparum
TGHVPE

SEQ ID NO: 3347213 - protein, 10 aa, Plasmodium falciparum
TGIDPKKKNI

SEQ ID NO: 3347214 - protein, 32 aa, Plasmodium falciparum
TGKDHEEEVKGKEKKRGDNNNNNNKNYDNNYD

SEQ ID NO: 3347215 - protein, 9 aa, Plasmodium falciparum
TGKEASSQN

SEQ ID NO: 3347216 - protein, 6 aa, Plasmodium falciparum
TGKGNK

SEQ ID NO: 3347217 - protein, 6 aa, Plasmodium falciparum
TGKHIS

SEQ ID NO: 3347218 - protein, 10 aa, Plasmodium falciparum
TGKKENSEIN

SEQ ID NO: 3347219 - protein, 18 aa, Plasmodium falciparum
TGKKKRKYGKKQNTTNIK

SEQ ID NO: 3347220 - protein, 7 aa, Plasmodium falciparum
TGKNKNL

SEQ ID NO: 3347221 - protein, 9 aa, Plasmodium falciparum
TGKQGTFHT

SEQ ID NO: 3347222 - protein, 4 aa, Plasmodium falciparum
TGKS

SEQ ID NO: 3347223 - protein, 11 aa, Plasmodium falciparum
TGKSEENGYHR

SEQ ID NO: 3347224 - protein, 6 aa, Plasmodium falciparum
TGKSSV

SEQ ID NO: 3347225 - protein, 5 aa, Plasmodium falciparum
TGKTK

SEQ ID NO: 3347226 - protein, 14 aa, Plasmodium falciparum
TGKTSTTKKNEKRL

SEQ ID NO: 3347227 - protein, 11 aa, Plasmodium falciparum
TGKVKNPYPNV

SEQ ID NO: 3347228 - protein, 4 aa, Plasmodium falciparum
TGLN

SEQ ID NO: 3347229 - protein, 23 aa, Plasmodium falciparum
TGNAQTKNKLDNHTSKKKTKIND

SEQ ID NO: 3347230 - protein, 4 aa, Plasmodium falciparum
TGND

SEQ ID NO: 3347231 - protein, 9 aa, Plasmodium falciparum
TGNEEKNPF

SEQ ID NO: 3347232 - protein, 7 aa, Plasmodium falciparum
TGNETSI

SEQ ID NO: 3347233 - protein, 4 aa, Plasmodium falciparum
TGNK

SEQ ID NO: 3347234 - protein, 11 aa, Plasmodium falciparum
TGNKSATSKNV

SEQ ID NO: 3347235 - protein, 6 aa, Plasmodium falciparum
TGNNNK

SEQ ID NO: 3347236 - protein, 5 aa, Plasmodium falciparum
TGNNS

SEQ ID NO: 3347237 - protein, 7 aa, Plasmodium falciparum
TGNQTCQ

SEQ ID NO: 3347238 - protein, 7 aa, Plasmodium falciparum
TGNSLNE

SEQ ID NO: 3347239 - protein, 5 aa, Plasmodium falciparum
TGNTT

SEQ ID NO: 3347240 - protein, 9 aa, Plasmodium falciparum
TGNVQENYK

SEQ ID NO: 3347241 - protein, 6 aa, Plasmodium falciparum
TGPMTE

SEQ ID NO: 3347242 - protein, 4 aa, Plasmodium falciparum
TGPT

SEQ ID NO: 3347243 - protein, 4 aa, Plasmodium falciparum
TGPV

SEQ ID NO: 3347244 - protein, 6 aa, Plasmodium falciparum
TGPYGA

SEQ ID NO: 3347245 - protein, 7 aa, Plasmodium falciparum
TGPYPRT

SEQ ID NO: 3347246 - protein, 5 aa, Plasmodium falciparum
TGQNL

SEQ ID NO: 3347247 - protein, 20 aa, Plasmodium falciparum
TGQVPTKLTQSGASSKSAST

SEQ ID NO: 3347248 - protein, 8 aa, Plasmodium falciparum
TGQYKDKR

SEQ ID NO: 3347249 - protein, 7 aa, Plasmodium falciparum
TGRDKEK

SEQ ID NO: 3347250 - protein, 7 aa, Plasmodium falciparum
TGRENKG

SEQ ID NO: 3347251 - protein, 7 aa, Plasmodium falciparum
TGRFGTK

SEQ ID NO: 3347252 - protein, 7 aa, Plasmodium falciparum
TGRIGKG

SEQ ID NO: 3347253 - protein, 5 aa, Plasmodium falciparum
TGSDI

SEQ ID NO: 3347254 - protein, 5 aa, Plasmodium falciparum
TGSGK

SEQ ID NO: 3347255 - protein, 8 aa, Plasmodium falciparum
TGSGKTTQ

SEQ ID NO: 3347256 - protein, 5 aa, Plasmodium falciparum
TGSKN

SEQ ID NO: 3347257 - protein, 5 aa, Plasmodium falciparum
TGSKQ

SEQ ID NO: 3347258 - protein, 8 aa, Plasmodium falciparum
TGSLGTGV

SEQ ID NO: 3347259 - protein, 4 aa, Plasmodium falciparum
TGSM

SEQ ID NO: 3347260 - protein, 5 aa, Plasmodium falciparum
TGSND

SEQ ID NO: 3347261 - protein, 5 aa, Plasmodium falciparum
TGSNK

SEQ ID NO: 3347262 - protein, 9 aa, Plasmodium falciparum
TGSNKKIKN

SEQ ID NO: 3347263 - protein, 12 aa, Plasmodium falciparum
TGSNYPSKLREK

SEQ ID NO: 3347264 - protein, 7 aa, Plasmodium falciparum
TGSSDET

SEQ ID NO: 3347265 - protein, 4 aa, Plasmodium falciparum
TGST

SEQ ID NO: 3347266 - protein, 4 aa, Plasmodium falciparum
TGSV

SEQ ID NO: 3347267 - protein, 6 aa, Plasmodium falciparum
TGTAEG

SEQ ID NO: 3347268 - protein, 6 aa, Plasmodium falciparum
TGTGKT

SEQ ID NO: 3347269 - protein, 18 aa, Plasmodium falciparum
TGTGPDGKKKRKKSRYDS

SEQ ID NO: 3347270 - protein, 5 aa, Plasmodium falciparum
TGTGY

SEQ ID NO: 3347271 - protein, 6 aa, Plasmodium falciparum
TGTHNS

SEQ ID NO: 3347272 - protein, 11 aa, Plasmodium falciparum
TGTNKNLNPAI

SEQ ID NO: 3347273 - protein, 37 aa, Plasmodium falciparum
TGTNNNNNNNNNNNNNNNNNNNNNNNNNNNNNNNNNI

SEQ ID NO: 3347274 - protein, 11 aa, Plasmodium falciparum
TGTNVSKNTKK

SEQ ID NO: 3347275 - protein, 4 aa, Plasmodium falciparum
TGTR

SEQ ID NO: 3347276 - protein, 4 aa, Plasmodium falciparum
TGTT

SEQ ID NO: 3347277 - protein, 4 aa, Plasmodium falciparum
TGVA

SEQ ID NO: 3347278 - protein, 4 aa, Plasmodium falciparum
TGVG

SEQ ID NO: 3347279 - protein, 39 aa, Plasmodium falciparum
TGVKGKNTNSNNNNNNNNNNNNNNNNNNNNNNNNNKSNR

SEQ ID NO: 3347280 - protein, 4 aa, Plasmodium falciparum
TGVN

SEQ ID NO: 3347281 - protein, 11 aa, Plasmodium falciparum
TGYDSTTADKK

SEQ ID NO: 3347282 - protein, 6 aa, Plasmodium falciparum
TGYNNA

SEQ ID NO: 3347283 - protein, 5 aa, Plasmodium falciparum
TGYPY

SEQ ID NO: 3347284 - protein, 4 aa, Plasmodium falciparum
TGYS

SEQ ID NO: 3347285 - protein, 11 aa, Plasmodium falciparum
TGYSNKDDKNI

SEQ ID NO: 3347286 - protein, 5 aa, Plasmodium falciparum
THDEG

SEQ ID NO: 3347287 - protein, 12 aa, Plasmodium falciparum
THDNEKKNVENN

SEQ ID NO: 3347288 - protein, 10 aa, Plasmodium falciparum
THDNNSNNIN

SEQ ID NO: 3347289 - protein, 26 aa, Plasmodium falciparum
THEEKNVNNEIKDKGKTVSSNLLKCF

SEQ ID NO: 3347290 - protein, 9 aa, Plasmodium falciparum
THEENKNIE

SEQ ID NO: 3347291 - protein, 8 aa, Plasmodium falciparum
THEHDDNH

SEQ ID NO: 3347292 - protein, 34 aa, Plasmodium falciparum
THEKDNKDLNDINDSNIRNNINKKNEKNNIKNGK

SEQ ID NO: 3347293 - protein, 17 aa, Plasmodium falciparum
THENNNNNNNNNNCDHK

SEQ ID NO: 3347294 - protein, 5 aa, Plasmodium falciparum
THEYD

SEQ ID NO: 3347295 - protein, 6 aa, Plasmodium falciparum
THGGTY

SEQ ID NO: 3347296 - protein, 21 aa, Plasmodium falciparum
THGNMDKKNVDHNNNNTPYQK

SEQ ID NO: 3347297 - protein, 5 aa, Plasmodium falciparum
THGNS

SEQ ID NO: 3347298 - protein, 12 aa, Plasmodium falciparum
THGQPASPTTFG

SEQ ID NO: 3347299 - protein, 16 aa, Plasmodium falciparum
THGQQNGYNNKKGYDT

SEQ ID NO: 3347300 - protein, 4 aa, Plasmodium falciparum
THGY

SEQ ID NO: 3347301 - protein, 18 aa, Plasmodium falciparum
THHDISTKDENHNDNKIN

SEQ ID NO: 3347302 - protein, 18 aa, Plasmodium falciparum
THHNNNNNNNNNNDMKTP

SEQ ID NO: 3347303 - protein, 4 aa, Plasmodium falciparum
THHT

SEQ ID NO: 3347304 - protein, 12 aa, Plasmodium falciparum
THHTSNDRTNIN

SEQ ID NO: 3347305 - protein, 4 aa, Plasmodium falciparum
THIS

SEQ ID NO: 3347306 - protein, 9 aa, Plasmodium falciparum
THKEEQNND

SEQ ID NO: 3347307 - protein, 6 aa, Plasmodium falciparum
THKERT

SEQ ID NO: 3347308 - protein, 11 aa, Plasmodium falciparum
THKKKKKNSYQ

SEQ ID NO: 3347309 - protein, 4 aa, Plasmodium falciparum
THKL

SEQ ID NO: 3347310 - protein, 5 aa, Plasmodium falciparum
THKNE

SEQ ID NO: 3347311 - protein, 5 aa, Plasmodium falciparum
THKNI

SEQ ID NO: 3347312 - protein, 6 aa, Plasmodium falciparum
THKNTE

SEQ ID NO: 3347313 - protein, 7 aa, Plasmodium falciparum
THKPSNK

SEQ ID NO: 3347314 - protein, 22 aa, Plasmodium falciparum
THNDNSNNKNNDDRNIEKTNNY

SEQ ID NO: 3347315 - protein, 4 aa, Plasmodium falciparum
THNE

SEQ ID NO: 3347316 - protein, 24 aa, Plasmodium falciparum
THNKNNSMSTNQQTIQNKHTGQHQ

SEQ ID NO: 3347317 - protein, 12 aa, Plasmodium falciparum
THNNGKKSEVRI

SEQ ID NO: 3347318 - protein, 9 aa, Plasmodium falciparum
THNNMNNSD

SEQ ID NO: 3347319 - protein, 5 aa, Plasmodium falciparum
THNNN

SEQ ID NO: 3347320 - protein, 64 aa, Plasmodium falciparum
THNNNINHDDNKNGDNKNNDDNNINDDNNKNDDNKNNDDNNINDDDNKNNDDNNINDDNNINDD

SEQ ID NO: 3347321 - protein, 7 aa, Plasmodium falciparum
THNNTSP

SEQ ID NO: 3347322 - protein, 6 aa, Plasmodium falciparum
THNTKD

SEQ ID NO: 3347323 - protein, 10 aa, Plasmodium falciparum
THPETTNNIS

SEQ ID NO: 3347324 - protein, 12 aa, Plasmodium falciparum
THPNKDKNQESF

SEQ ID NO: 3347325 - protein, 6 aa, Plasmodium falciparum
THQHEE

SEQ ID NO: 3347326 - protein, 5 aa, Plasmodium falciparum
THQQE

SEQ ID NO: 3347327 - protein, 4 aa, Plasmodium falciparum
THRN

SEQ ID NO: 3347328 - protein, 4 aa, Plasmodium falciparum
THRP

SEQ ID NO: 3347329 - protein, 10 aa, Plasmodium falciparum
THSGSIANTT

SEQ ID NO: 3347330 - protein, 17 aa, Plasmodium falciparum
THSHDNDKERNRKENLK

SEQ ID NO: 3347331 - protein, 11 aa, Plasmodium falciparum
THSHQSDHQND

SEQ ID NO: 3347332 - protein, 7 aa, Plasmodium falciparum
THSNNDH

SEQ ID NO: 3347333 - protein, 8 aa, Plasmodium falciparum
THSNNKNS

SEQ ID NO: 3347334 - protein, 10 aa, Plasmodium falciparum
THSPSISSQQ

SEQ ID NO: 3347335 - protein, 4 aa, Plasmodium falciparum
THSQ

SEQ ID NO: 3347336 - protein, 5 aa, Plasmodium falciparum
THSSN

SEQ ID NO: 3347337 - protein, 15 aa, Plasmodium falciparum
THTEHSMEDSNNVET

SEQ ID NO: 3347338 - protein, 4 aa, Plasmodium falciparum
THTN

SEQ ID NO: 3347339 - protein, 10 aa, Plasmodium falciparum
THTNKQTSKK

SEQ ID NO: 3347340 - protein, 11 aa, Plasmodium falciparum
THTNRKSTSDL

SEQ ID NO: 3347341 - protein, 7 aa, Plasmodium falciparum
THTSNQD

SEQ ID NO: 3347342 - protein, 5 aa, Plasmodium falciparum
THTYN

SEQ ID NO: 3347343 - protein, 26 aa, Plasmodium falciparum
THVSYDDKRKSYLDNNEENSEQMNDN

SEQ ID NO: 3347344 - protein, 5 aa, Plasmodium falciparum
THYAS

SEQ ID NO: 3347345 - protein, 19 aa, Plasmodium falciparum
THYDNNNNATINNKKNSPL

SEQ ID NO: 3347346 - protein, 6 aa, Plasmodium falciparum
THYGKQ

SEQ ID NO: 3347347 - protein, 5 aa, Plasmodium falciparum
THYNS

SEQ ID NO: 3347348 - protein, 10 aa, Plasmodium falciparum
TIAPPNGTLP

SEQ ID NO: 3347349 - protein, 4 aa, Plasmodium falciparum
TICT

SEQ ID NO: 3347350 - protein, 10 aa, Plasmodium falciparum
TIDDEPKQIC

SEQ ID NO: 3347351 - protein, 12 aa, Plasmodium falciparum
TIDENSNKLDNN

SEQ ID NO: 3347352 - protein, 9 aa, Plasmodium falciparum
TIDGDLKSE

SEQ ID NO: 3347353 - protein, 5 aa, Plasmodium falciparum
TIDGN

SEQ ID NO: 3347354 - protein, 5 aa, Plasmodium falciparum
TIDKE

SEQ ID NO: 3347355 - protein, 12 aa, Plasmodium falciparum
TIDNENAQKKSS

SEQ ID NO: 3347356 - protein, 8 aa, Plasmodium falciparum
TIDNSNEV

SEQ ID NO: 3347357 - protein, 8 aa, Plasmodium falciparum
TIDNTPRE

SEQ ID NO: 3347358 - protein, 12 aa, Plasmodium falciparum
TIDQKNKNVDEN

SEQ ID NO: 3347359 - protein, 4 aa, Plasmodium falciparum
TIDT

SEQ ID NO: 3347360 - protein, 28 aa, Plasmodium falciparum
TIEGEENNTDIESIKENKKKKKNKDEHI

SEQ ID NO: 3347361 - protein, 11 aa, Plasmodium falciparum
TIEGGRTNLRQ

SEQ ID NO: 3347362 - protein, 4 aa, Plasmodium falciparum
TIEN

SEQ ID NO: 3347363 - protein, 7 aa, Plasmodium falciparum
TIENRAS

SEQ ID NO: 3347364 - protein, 17 aa, Plasmodium falciparum
TIEREGQRNISSDCSTQ

SEQ ID NO: 3347365 - protein, 5 aa, Plasmodium falciparum
TIESN

SEQ ID NO: 3347366 - protein, 6 aa, Plasmodium falciparum
TIESTN

SEQ ID NO: 3347367 - protein, 9 aa, Plasmodium falciparum
TIETDDNAG

SEQ ID NO: 3347368 - protein, 15 aa, Plasmodium falciparum
TIGAKYARDDPPYTN

SEQ ID NO: 3347369 - protein, 12 aa, Plasmodium falciparum
TIGSNAGNEQKG

SEQ ID NO: 3347370 - protein, 9 aa, Plasmodium falciparum
TIGSTKNYN

SEQ ID NO: 3347371 - protein, 5 aa, Plasmodium falciparum
TIGTS

SEQ ID NO: 3347372 - protein, 47 aa, Plasmodium falciparum
TIHGDPKKRIERNKQEIEDHRREQDGENDQEEDNYDDYDDEDDDDDN

SEQ ID NO: 3347373 - protein, 6 aa, Plasmodium falciparum
TIHPRK

SEQ ID NO: 3347374 - protein, 5 aa, Plasmodium falciparum
TIKDE

SEQ ID NO: 3347375 - protein, 4 aa, Plasmodium falciparum
TIKE

SEQ ID NO: 3347376 - protein, 18 aa, Plasmodium falciparum
TIKENDEMYNGQNYSNYQ

SEQ ID NO: 3347377 - protein, 5 aa, Plasmodium falciparum
TIKKN

SEQ ID NO: 3347378 - protein, 12 aa, Plasmodium falciparum
TIKKNERNVSPQ

SEQ ID NO: 3347379 - protein, 5 aa, Plasmodium falciparum
TIKNE

SEQ ID NO: 3347380 - protein, 11 aa, Plasmodium falciparum
TIKNTEDDTEK

SEQ ID NO: 3347381 - protein, 16 aa, Plasmodium falciparum
TIKNTEKYKDKKISQY

SEQ ID NO: 3347382 - protein, 27 aa, Plasmodium falciparum
TIKSGDTTKSGDHIKSGDHIKSGDTIK

SEQ ID NO: 3347383 - protein, 5 aa, Plasmodium falciparum
TIKTD

SEQ ID NO: 3347384 - protein, 7 aa, Plasmodium falciparum
TIKTDQN

SEQ ID NO: 3347385 - protein, 5 aa, Plasmodium falciparum
TILNN

SEQ ID NO: 3347386 - protein, 12 aa, Plasmodium falciparum
TINEEKNEKEEV

SEQ ID NO: 3347387 - protein, 12 aa, Plasmodium falciparum
TINGEESKNKTK

SEQ ID NO: 3347388 - protein, 5 aa, Plasmodium falciparum
TINHP

SEQ ID NO: 3347389 - protein, 10 aa, Plasmodium falciparum
TINKKGNDNI

SEQ ID NO: 3347390 - protein, 11 aa, Plasmodium falciparum
TINKQNKIKKS

SEQ ID NO: 3347391 - protein, 8 aa, Plasmodium falciparum
TINNDNNN

SEQ ID NO: 3347392 - protein, 6 aa, Plasmodium falciparum
TINNDT

SEQ ID NO: 3347393 - protein, 10 aa, Plasmodium falciparum
TINNKNEKMN

SEQ ID NO: 3347394 - protein, 8 aa, Plasmodium falciparum
TINNNDNN

SEQ ID NO: 3347395 - protein, 15 aa, Plasmodium falciparum
TINNNKKKKKKKCTI

SEQ ID NO: 3347396 - protein, 20 aa, Plasmodium falciparum
TINNTENNNTSTNNNNNNNK

SEQ ID NO: 3347397 - protein, 11 aa, Plasmodium falciparum
TINQDKDTDDI

SEQ ID NO: 3347398 - protein, 9 aa, Plasmodium falciparum
TINQNDTPN

SEQ ID NO: 3347399 - protein, 74 aa, Plasmodium falciparum
TINSDTKVNEINENNNINSNNNNNNNNNNNNNNNNNNNNNNNNNNNNNNNNNNNNNNNNNNNNNNNNNNNNSDM

SEQ ID NO: 3347400 - protein, 11 aa, Plasmodium falciparum
TINTDRKNINY

SEQ ID NO: 3347401 - protein, 23 aa, Plasmodium falciparum
TINTPKTQSQENKDINKETKNTI

SEQ ID NO: 3347402 - protein, 8 aa, Plasmodium falciparum
TIPEPPGI

SEQ ID NO: 3347403 - protein, 17 aa, Plasmodium falciparum
TIPKDNKTNEEIEKSKN

SEQ ID NO: 3347404 - protein, 6 aa, Plasmodium falciparum
TIPNNT

SEQ ID NO: 3347405 - protein, 4 aa, Plasmodium falciparum
TIPP

SEQ ID NO: 3347406 - protein, 5 aa, Plasmodium falciparum
TIPRN

SEQ ID NO: 3347407 - protein, 13 aa, Plasmodium falciparum
TIPRRGRKNKYSK

SEQ ID NO: 3347408 - protein, 4 aa, Plasmodium falciparum
TIPV

SEQ ID NO: 3347409 - protein, 4 aa, Plasmodium falciparum
TIQE

SEQ ID NO: 3347410 - protein, 13 aa, Plasmodium falciparum
TIQEGKEEENKTL

SEQ ID NO: 3347411 - protein, 11 aa, Plasmodium falciparum
TIQEKKSSYGN

SEQ ID NO: 3347412 - protein, 14 aa, Plasmodium falciparum
TIQEQKNIHSDNKY

SEQ ID NO: 3347413 - protein, 4 aa, Plasmodium falciparum
TIQK

SEQ ID NO: 3347414 - protein, 11 aa, Plasmodium falciparum
TIQKKHKKDSK

SEQ ID NO: 3347415 - protein, 21 aa, Plasmodium falciparum
TIQNDNERINNEDNKNKENVT

SEQ ID NO: 3347416 - protein, 41 aa, Plasmodium falciparum
TIQNNNNDGNNNNDDNNNNDNNNNNNNNDGNNNQDHVNDND

SEQ ID NO: 3347417 - protein, 4 aa, Plasmodium falciparum
TIQS

SEQ ID NO: 3347418 - protein, 5 aa, Plasmodium falciparum
TIQST

SEQ ID NO: 3347419 - protein, 6 aa, Plasmodium falciparum
TIRERS

SEQ ID NO: 3347420 - protein, 11 aa, Plasmodium falciparum
TISDNRSDNMS

SEQ ID NO: 3347421 - protein, 8 aa, Plasmodium falciparum
TISESDVE

SEQ ID NO: 3347422 - protein, 7 aa, Plasmodium falciparum
TISKNGY

SEQ ID NO: 3347423 - protein, 9 aa, Plasmodium falciparum
TISNNSSSF

SEQ ID NO: 3347424 - protein, 9 aa, Plasmodium falciparum
TISPSKKKD

SEQ ID NO: 3347425 - protein, 14 aa, Plasmodium falciparum
TISQQNKKSHTQGI

SEQ ID NO: 3347426 - protein, 4 aa, Plasmodium falciparum
TISS

SEQ ID NO: 3347427 - protein, 14 aa, Plasmodium falciparum
TISTNENHKDNDES

SEQ ID NO: 3347428 - protein, 5 aa, Plasmodium falciparum
TISYE

SEQ ID NO: 3347429 - protein, 24 aa, Plasmodium falciparum
TITKDDNQYNQNNDNYSNNSSTQN

SEQ ID NO: 3347430 - protein, 4 aa, Plasmodium falciparum
TITN

SEQ ID NO: 3347431 - protein, 9 aa, Plasmodium falciparum
TITNEKKKE

SEQ ID NO: 3347432 - protein, 51 aa, Plasmodium falciparum
TITNNNNSNNNNNNNSNNSHNNNNNNNSNNNHNNNNHNNNNNNNSNSTNCE

SEQ ID NO: 3347433 - protein, 27 aa, Plasmodium falciparum
TITSEKNSYHDNVTNDNINEKDINKNN

SEQ ID NO: 3347434 - protein, 14 aa, Plasmodium falciparum
TITSNKNSSNEKQI

SEQ ID NO: 3347435 - protein, 13 aa, Plasmodium falciparum
TITSQNKEREEKK

SEQ ID NO: 3347436 - protein, 13 aa, Plasmodium falciparum
TIYDDNNQIKRRG

SEQ ID NO: 3347437 - protein, 12 aa, Plasmodium falciparum
TKADEDRKTKIE

SEQ ID NO: 3347438 - protein, 8 aa, Plasmodium falciparum
TKAESNFN

SEQ ID NO: 3347439 - protein, 7 aa, Plasmodium falciparum
TKAFKSK

SEQ ID NO: 3347440 - protein, 7 aa, Plasmodium falciparum
TKAKTLS

SEQ ID NO: 3347441 - protein, 8 aa, Plasmodium falciparum
TKANEEER

SEQ ID NO: 3347442 - protein, 6 aa, Plasmodium falciparum
TKAPLS

SEQ ID NO: 3347443 - protein, 11 aa, Plasmodium falciparum
TKASLNDNNNN

SEQ ID NO: 3347444 - protein, 7 aa, Plasmodium falciparum
TKATTSI

SEQ ID NO: 3347445 - protein, 8 aa, Plasmodium falciparum
TKCKNDET

SEQ ID NO: 3347446 - protein, 11 aa, Plasmodium falciparum
TKCNNASVRSY

SEQ ID NO: 3347447 - protein, 23 aa, Plasmodium falciparum
TKCTTTNNINNDKQQKKNDENNV

SEQ ID NO: 3347448 - protein, 12 aa, Plasmodium falciparum
TKDDKKNDDIRG

SEQ ID NO: 3347449 - protein, 10 aa, Plasmodium falciparum
TKDDLKNNNK

SEQ ID NO: 3347450 - protein, 30 aa, Plasmodium falciparum
TKDDSSDYVEEKSTRNKDLSKKKKKKDKDL

SEQ ID NO: 3347451 - protein, 10 aa, Plasmodium falciparum
TKDEIKKGNK

SEQ ID NO: 3347452 - protein, 16 aa, Plasmodium falciparum
TKDEKNDNKGETKDNL

SEQ ID NO: 3347453 - protein, 6 aa, Plasmodium falciparum
TKDEKR

SEQ ID NO: 3347454 - protein, 12 aa, Plasmodium falciparum
TKDETNEKLGRG

SEQ ID NO: 3347455 - protein, 4 aa, Plasmodium falciparum
TKDF

SEQ ID NO: 3347456 - protein, 4 aa, Plasmodium falciparum
TKDI

SEQ ID NO: 3347457 - protein, 6 aa, Plasmodium falciparum
TKDIKN

SEQ ID NO: 3347458 - protein, 9 aa, Plasmodium falciparum
TKDISNDIK

SEQ ID NO: 3347459 - protein, 7 aa, Plasmodium falciparum
TKDKIGK

SEQ ID NO: 3347460 - protein, 9 aa, Plasmodium falciparum
TKDKNRRDF

SEQ ID NO: 3347461 - protein, 9 aa, Plasmodium falciparum
TKDKNSELK

SEQ ID NO: 3347462 - protein, 13 aa, Plasmodium falciparum
TKDKQKRNKANDM

SEQ ID NO: 3347463 - protein, 15 aa, Plasmodium falciparum
TKDKRGKNKKDTCEN

SEQ ID NO: 3347464 - protein, 10 aa, Plasmodium falciparum
TKDMNSANDC

SEQ ID NO: 3347465 - protein, 4 aa, Plasmodium falciparum
TKDN

SEQ ID NO: 3347466 - protein, 11 aa, Plasmodium falciparum
TKDNEADNDND

SEQ ID NO: 3347467 - protein, 5 aa, Plasmodium falciparum
TKDNI

SEQ ID NO: 3347468 - protein, 7 aa, Plasmodium falciparum
TKDNINN

SEQ ID NO: 3347469 - protein, 5 aa, Plasmodium falciparum
TKDNL

SEQ ID NO: 3347470 - protein, 13 aa, Plasmodium falciparum
TKDNNNKDNGPLN

SEQ ID NO: 3347471 - protein, 9 aa, Plasmodium falciparum
TKDNTPNRK

SEQ ID NO: 3347472 - protein, 64 aa, Plasmodium falciparum
TKDNVKKNEDHDDEKAGKNKRKNSSNNKTKQIEKEEEHDEHVKNTKKKKQKIKTISEDYKDDVN

SEQ ID NO: 3347473 - protein, 6 aa, Plasmodium falciparum
TKDQIS

SEQ ID NO: 3347474 - protein, 9 aa, Plasmodium falciparum
TKDQKKKEK

SEQ ID NO: 3347475 - protein, 4 aa, Plasmodium falciparum
TKDR

SEQ ID NO: 3347476 - protein, 11 aa, Plasmodium falciparum
TKDSTDAGTEY

SEQ ID NO: 3347477 - protein, 12 aa, Plasmodium falciparum
TKDTKETRNNNM

SEQ ID NO: 3347478 - protein, 6 aa, Plasmodium falciparum
TKDTRA

SEQ ID NO: 3347479 - protein, 13 aa, Plasmodium falciparum
TKDTRNDEDNTNK

SEQ ID NO: 3347480 - protein, 4 aa, Plasmodium falciparum
TKDV

SEQ ID NO: 3347481 - protein, 36 aa, Plasmodium falciparum
TKDVAQEEKESNKNENATNNDQSRPSNENNNEMGDN

SEQ ID NO: 3347482 - protein, 5 aa, Plasmodium falciparum
TKDYG

SEQ ID NO: 3347483 - protein, 14 aa, Plasmodium falciparum
TKEDDEGKASYISN

SEQ ID NO: 3347484 - protein, 6 aa, Plasmodium falciparum
TKEDIK

SEQ ID NO: 3347485 - protein, 6 aa, Plasmodium falciparum
TKEDNI

SEQ ID NO: 3347486 - protein, 6 aa, Plasmodium falciparum
TKEDVE

SEQ ID NO: 3347487 - protein, 7 aa, Plasmodium falciparum
TKEEEKN

SEQ ID NO: 3347488 - protein, 6 aa, Plasmodium falciparum
TKEEEN

SEQ ID NO: 3347489 - protein, 7 aa, Plasmodium falciparum
TKEEHVD

SEQ ID NO: 3347490 - protein, 12 aa, Plasmodium falciparum
TKEEIKKEENNI

SEQ ID NO: 3347491 - protein, 13 aa, Plasmodium falciparum
TKEEITPKTEYID

SEQ ID NO: 3347492 - protein, 10 aa, Plasmodium falciparum
TKEEKKNSLL

SEQ ID NO: 3347493 - protein, 19 aa, Plasmodium falciparum
TKEEKNEDNISTSDTQNVS

SEQ ID NO: 3347494 - protein, 8 aa, Plasmodium falciparum
TKEEKPSN

SEQ ID NO: 3347495 - protein, 5 aa, Plasmodium falciparum
TKEEL

SEQ ID NO: 3347496 - protein, 9 aa, Plasmodium falciparum
TKEENKKSC

SEQ ID NO: 3347497 - protein, 44 aa, Plasmodium falciparum
TKEENTKNKNVKKDNNSDDQTVCSQTDAVDKNSSKKRKSTGNDV

SEQ ID NO: 3347498 - protein, 13 aa, Plasmodium falciparum
TKEFTSKSSNKDT

SEQ ID NO: 3347499 - protein, 11 aa, Plasmodium falciparum
TKEGDNNGDID

SEQ ID NO: 3347500 - protein, 10 aa, Plasmodium falciparum
TKEGTRKDNI

SEQ ID NO: 3347501 - protein, 14 aa, Plasmodium falciparum
TKEHHNKKSNGNNV

SEQ ID NO: 3347502 - protein, 4 aa, Plasmodium falciparum
TKEI

SEQ ID NO: 3347503 - protein, 4 aa, Plasmodium falciparum
TKEK

SEQ ID NO: 3347504 - protein, 9 aa, Plasmodium falciparum
TKEKDDVDN

SEQ ID NO: 3347505 - protein, 9 aa, Plasmodium falciparum
TKEKDNSRM

SEQ ID NO: 3347506 - protein, 6 aa, Plasmodium falciparum
TKEKEK

SEQ ID NO: 3347507 - protein, 9 aa, Plasmodium falciparum
TKEKITEYN

SEQ ID NO: 3347508 - protein, 9 aa, Plasmodium falciparum
TKEKKNEQI

SEQ ID NO: 3347509 - protein, 22 aa, Plasmodium falciparum
TKEKKNSKHENEEEYDSDNKYH

SEQ ID NO: 3347510 - protein, 8 aa, Plasmodium falciparum
TKEKQGKL

SEQ ID NO: 3347511 - protein, 9 aa, Plasmodium falciparum
TKEKYQANS

SEQ ID NO: 3347512 - protein, 4 aa, Plasmodium falciparum
TKEN

SEQ ID NO: 3347513 - protein, 5 aa, Plasmodium falciparum
TKEND

SEQ ID NO: 3347514 - protein, 15 aa, Plasmodium falciparum
TKENDTMQKGTSSRN

SEQ ID NO: 3347515 - protein, 5 aa, Plasmodium falciparum
TKENH

SEQ ID NO: 3347516 - protein, 8 aa, Plasmodium falciparum
TKENIPES

SEQ ID NO: 3347517 - protein, 5 aa, Plasmodium falciparum
TKENN

SEQ ID NO: 3347518 - protein, 8 aa, Plasmodium falciparum
TKENNKKE

SEQ ID NO: 3347519 - protein, 19 aa, Plasmodium falciparum
TKENNTNDDSVMKEAQSSN

SEQ ID NO: 3347520 - protein, 6 aa, Plasmodium falciparum
TKEQEE

SEQ ID NO: 3347521 - protein, 7 aa, Plasmodium falciparum
TKEQGDH

SEQ ID NO: 3347522 - protein, 6 aa, Plasmodium falciparum
TKERSN

SEQ ID NO: 3347523 - protein, 8 aa, Plasmodium falciparum
TKESKRKY

SEQ ID NO: 3347524 - protein, 5 aa, Plasmodium falciparum
TKESM

SEQ ID NO: 3347525 - protein, 6 aa, Plasmodium falciparum
TKESWN

SEQ ID NO: 3347526 - protein, 6 aa, Plasmodium falciparum
TKETDI

SEQ ID NO: 3347527 - protein, 6 aa, Plasmodium falciparum
TKETNT

SEQ ID NO: 3347528 - protein, 6 aa, Plasmodium falciparum
TKETPF

SEQ ID NO: 3347529 - protein, 5 aa, Plasmodium falciparum
TKEVD

SEQ ID NO: 3347530 - protein, 8 aa, Plasmodium falciparum
TKEYNNDE

SEQ ID NO: 3347531 - protein, 10 aa, Plasmodium falciparum
TKEYQRNEEK

SEQ ID NO: 3347532 - protein, 8 aa, Plasmodium falciparum
TKEYSKKR

SEQ ID NO: 3347533 - protein, 5 aa, Plasmodium falciparum
TKFDY

SEQ ID NO: 3347534 - protein, 8 aa, Plasmodium falciparum
TKFKQREK

SEQ ID NO: 3347535 - protein, 11 aa, Plasmodium falciparum
TKFQPKTRKEI

SEQ ID NO: 3347536 - protein, 28 aa, Plasmodium falciparum
TKGDDKENEEGKKQQQQQQRRQDYPYDD

SEQ ID NO: 3347537 - protein, 9 aa, Plasmodium falciparum
TKGEAGTGN

SEQ ID NO: 3347538 - protein, 6 aa, Plasmodium falciparum
TKGEKQ

SEQ ID NO: 3347539 - protein, 9 aa, Plasmodium falciparum
TKGERKSDI

SEQ ID NO: 3347540 - protein, 4 aa, Plasmodium falciparum
TKGF

SEQ ID NO: 3347541 - protein, 4 aa, Plasmodium falciparum
TKGK

SEQ ID NO: 3347542 - protein, 5 aa, Plasmodium falciparum
TKGKY

SEQ ID NO: 3347543 - protein, 15 aa, Plasmodium falciparum
TKGLYSKNILSEIDR

SEQ ID NO: 3347544 - protein, 4 aa, Plasmodium falciparum
TKGM

SEQ ID NO: 3347545 - protein, 87 aa, Plasmodium falciparum
TKGNEKNVENEKYEKNVENEKNEKNVENEKNVENEKNVENEKNEKNEKYEKNEKYEKNEKCEQYEQNEQYEQYEQNVQNEKYEKCEK

SEQ ID NO: 3347546 - protein, 28 aa, Plasmodium falciparum
TKGSSNNKKSNKYDNDKYNSKKDVDMDS

SEQ ID NO: 3347547 - protein, 5 aa, Plasmodium falciparum
TKGSY

SEQ ID NO: 3347548 - protein, 6 aa, Plasmodium falciparum
TKGVYG

SEQ ID NO: 3347549 - protein, 6 aa, Plasmodium falciparum
TKHEMN

SEQ ID NO: 3347550 - protein, 7 aa, Plasmodium falciparum
TKHNPQR

SEQ ID NO: 3347551 - protein, 11 aa, Plasmodium falciparum
TKHTQNDQNNL

SEQ ID NO: 3347552 - protein, 10 aa, Plasmodium falciparum
TKIGNNKERE

SEQ ID NO: 3347553 - protein, 5 aa, Plasmodium falciparum
TKIGQ

SEQ ID NO: 3347554 - protein, 7 aa, Plasmodium falciparum
TKINEND

SEQ ID NO: 3347555 - protein, 6 aa, Plasmodium falciparum
TKINKQ

SEQ ID NO: 3347556 - protein, 11 aa, Plasmodium falciparum
TKIPKDDSEKC

SEQ ID NO: 3347557 - protein, 11 aa, Plasmodium falciparum
TKIPSSPEQGE

SEQ ID NO: 3347558 - protein, 6 aa, Plasmodium falciparum
TKIRYN

SEQ ID NO: 3347559 - protein, 13 aa, Plasmodium falciparum
TKISKDDELNNEV

SEQ ID NO: 3347560 - protein, 5 aa, Plasmodium falciparum
TKISQ

SEQ ID NO: 3347561 - protein, 4 aa, Plasmodium falciparum
TKIY

SEQ ID NO: 3347562 - protein, 6 aa, Plasmodium falciparum
TKKDDI

SEQ ID NO: 3347563 - protein, 45 aa, Plasmodium falciparum
TKKDEEKVDSEISKQEKKKRKKDKFLSKKEKKRKAMSEEEIAERN

SEQ ID NO: 3347564 - protein, 16 aa, Plasmodium falciparum
TKKDEELSTKNKYSEK

SEQ ID NO: 3347565 - protein, 9 aa, Plasmodium falciparum
TKKDIPSYS

SEQ ID NO: 3347566 - protein, 6 aa, Plasmodium falciparum
TKKDQE

SEQ ID NO: 3347567 - protein, 9 aa, Plasmodium falciparum
TKKDTNNII

SEQ ID NO: 3347568 - protein, 15 aa, Plasmodium falciparum
TKKEETEKEMKKDYA

SEQ ID NO: 3347569 - protein, 8 aa, Plasmodium falciparum
TKKEHSQD

SEQ ID NO: 3347570 - protein, 9 aa, Plasmodium falciparum
TKKENINNT

SEQ ID NO: 3347571 - protein, 9 aa, Plasmodium falciparum
TKKENSNNF

SEQ ID NO: 3347572 - protein, 7 aa, Plasmodium falciparum
TKKEPKI

SEQ ID NO: 3347573 - protein, 28 aa, Plasmodium falciparum
TKKEQTLPARKGKKRPTAGDKNKQKAVK

SEQ ID NO: 3347574 - protein, 5 aa, Plasmodium falciparum
TKKET

SEQ ID NO: 3347575 - protein, 6 aa, Plasmodium falciparum
TKKGNE

SEQ ID NO: 3347576 - protein, 10 aa, Plasmodium falciparum
TKKGNKKEHM

SEQ ID NO: 3347577 - protein, 8 aa, Plasmodium falciparum
TKKGNKPD

SEQ ID NO: 3347578 - protein, 17 aa, Plasmodium falciparum
TKKIETNQMKNKNTAKY

SEQ ID NO: 3347579 - protein, 25 aa, Plasmodium falciparum
TKKIKNTKNKKNSTDYNNNNVTSKD

SEQ ID NO: 3347580 - protein, 19 aa, Plasmodium falciparum
TKKITENVNTQENKEISSN

SEQ ID NO: 3347581 - protein, 8 aa, Plasmodium falciparum
TKKKALSS

SEQ ID NO: 3347582 - protein, 9 aa, Plasmodium falciparum
TKKKATQNT

SEQ ID NO: 3347583 - protein, 9 aa, Plasmodium falciparum
TKKKEGSKT

SEQ ID NO: 3347584 - protein, 10 aa, Plasmodium falciparum
TKKKKDGGLI

SEQ ID NO: 3347585 - protein, 9 aa, Plasmodium falciparum
TKKKSIEED

SEQ ID NO: 3347586 - protein, 9 aa, Plasmodium falciparum
TKKKSNEKK

SEQ ID NO: 3347587 - protein, 15 aa, Plasmodium falciparum
TKKKWNEEDVSKYEK

SEQ ID NO: 3347588 - protein, 8 aa, Plasmodium falciparum
TKKLEKKN

SEQ ID NO: 3347589 - protein, 17 aa, Plasmodium falciparum
TKKMNNKNNNGKNKNNH

SEQ ID NO: 3347590 - protein, 6 aa, Plasmodium falciparum
TKKNDK

SEQ ID NO: 3347591 - protein, 10 aa, Plasmodium falciparum
TKKNEHQNEW

SEQ ID NO: 3347592 - protein, 10 aa, Plasmodium falciparum
TKKNGKEKIK

SEQ ID NO: 3347593 - protein, 7 aa, Plasmodium falciparum
TKKNKND

SEQ ID NO: 3347594 - protein, 5 aa, Plasmodium falciparum
TKKNL

SEQ ID NO: 3347595 - protein, 7 aa, Plasmodium falciparum
TKKNNIK

SEQ ID NO: 3347596 - protein, 6 aa, Plasmodium falciparum
TKKNNK

SEQ ID NO: 3347597 - protein, 18 aa, Plasmodium falciparum
TKKNNKNYKNDKNDKNYF

SEQ ID NO: 3347598 - protein, 5 aa, Plasmodium falciparum
TKKNR

SEQ ID NO: 3347599 - protein, 8 aa, Plasmodium falciparum
TKKNSPKN

SEQ ID NO: 3347600 - protein, 31 aa, Plasmodium falciparum
TKKNYQKNLPPYYNNNNNNNNNNNNNSNNIH

SEQ ID NO: 3347601 - protein, 37 aa, Plasmodium falciparum
TKKNYTHNNKNNDNDKNNDNNKNDNNNNHNNHNNHNH

SEQ ID NO: 3347602 - protein, 6 aa, Plasmodium falciparum
TKKPIF

SEQ ID NO: 3347603 - protein, 7 aa, Plasmodium falciparum
TKKRDGQ

SEQ ID NO: 3347604 - protein, 18 aa, Plasmodium falciparum
TKKRDSKKKDKKEKSTNI

SEQ ID NO: 3347605 - protein, 10 aa, Plasmodium falciparum
TKKRKENRDY

SEQ ID NO: 3347606 - protein, 7 aa, Plasmodium falciparum
TKKRNRI

SEQ ID NO: 3347607 - protein, 8 aa, Plasmodium falciparum
TKKRQHKQ

SEQ ID NO: 3347608 - protein, 9 aa, Plasmodium falciparum
TKKSDDNAF

SEQ ID NO: 3347609 - protein, 8 aa, Plasmodium falciparum
TKKSSKYE

SEQ ID NO: 3347610 - protein, 5 aa, Plasmodium falciparum
TKKST

SEQ ID NO: 3347611 - protein, 4 aa, Plasmodium falciparum
TKKT

SEQ ID NO: 3347612 - protein, 5 aa, Plasmodium falciparum
TKKTF

SEQ ID NO: 3347613 - protein, 14 aa, Plasmodium falciparum
TKKTVSKNITNEQE

SEQ ID NO: 3347614 - protein, 7 aa, Plasmodium falciparum
TKKYEKE

SEQ ID NO: 3347615 - protein, 15 aa, Plasmodium falciparum
TKKYENHNKMNKRKK

SEQ ID NO: 3347616 - protein, 23 aa, Plasmodium falciparum
TKLGDSSYKQYENNEIDTSEDKH

SEQ ID NO: 3347617 - protein, 6 aa, Plasmodium falciparum
TKLGKP

SEQ ID NO: 3347618 - protein, 16 aa, Plasmodium falciparum
TKLKNKNKKKKLTNNN

SEQ ID NO: 3347619 - protein, 43 aa, Plasmodium falciparum
TKLPSKSNYINNNNNNNNNNNNNNYNNNNNINRSMSSSKKQYH

SEQ ID NO: 3347620 - protein, 6 aa, Plasmodium falciparum
TKLRTK

SEQ ID NO: 3347621 - protein, 8 aa, Plasmodium falciparum
TKLSGQNI

SEQ ID NO: 3347622 - protein, 9 aa, Plasmodium falciparum
TKLYKSNDH

SEQ ID NO: 3347623 - protein, 9 aa, Plasmodium falciparum
TKMDPDDTV

SEQ ID NO: 3347624 - protein, 5 aa, Plasmodium falciparum
TKMEM

SEQ ID NO: 3347625 - protein, 4 aa, Plasmodium falciparum
TKMK

SEQ ID NO: 3347626 - protein, 6 aa, Plasmodium falciparum
TKMKDK

SEQ ID NO: 3347627 - protein, 17 aa, Plasmodium falciparum
TKMREDGSNNINEEEKK

SEQ ID NO: 3347628 - protein, 21 aa, Plasmodium falciparum
TKNAPKGEVSDLKKNDENNSI

SEQ ID NO: 3347629 - protein, 6 aa, Plasmodium falciparum
TKNCGN

SEQ ID NO: 3347630 - protein, 21 aa, Plasmodium falciparum
TKNCNITNSKAKKTDNNIQND

SEQ ID NO: 3347631 - protein, 5 aa, Plasmodium falciparum
TKNDK

SEQ ID NO: 3347632 - protein, 8 aa, Plasmodium falciparum
TKNDNNNN

SEQ ID NO: 3347633 - protein, 8 aa, Plasmodium falciparum
TKNDPALG

SEQ ID NO: 3347634 - protein, 7 aa, Plasmodium falciparum
TKNDTNN

SEQ ID NO: 3347635 - protein, 7 aa, Plasmodium falciparum
TKNDTYT

SEQ ID NO: 3347636 - protein, 4 aa, Plasmodium falciparum
TKNE

SEQ ID NO: 3347637 - protein, 21 aa, Plasmodium falciparum
TKNEANQNETIKNQKTFTNKR

SEQ ID NO: 3347638 - protein, 7 aa, Plasmodium falciparum
TKNEDEI

SEQ ID NO: 3347639 - protein, 10 aa, Plasmodium falciparum
TKNEKRNTYT

SEQ ID NO: 3347640 - protein, 8 aa, Plasmodium falciparum
TKNENKEK

SEQ ID NO: 3347641 - protein, 7 aa, Plasmodium falciparum
TKNENNL

SEQ ID NO: 3347642 - protein, 29 aa, Plasmodium falciparum
TKNESEEQKKENDSTDTKKNKKKNQNNQL

SEQ ID NO: 3347643 - protein, 9 aa, Plasmodium falciparum
TKNGAGTKG

SEQ ID NO: 3347644 - protein, 7 aa, Plasmodium falciparum
TKNGKTK

SEQ ID NO: 3347645 - protein, 6 aa, Plasmodium falciparum
TKNGSI

SEQ ID NO: 3347646 - protein, 4 aa, Plasmodium falciparum
TKNI

SEQ ID NO: 3347647 - protein, 14 aa, Plasmodium falciparum
TKNKDKKRKIDSLG

SEQ ID NO: 3347648 - protein, 9 aa, Plasmodium falciparum
TKNKEPITP

SEQ ID NO: 3347649 - protein, 23 aa, Plasmodium falciparum
TKNKGEDGFYDDQKNEELKRGNY

SEQ ID NO: 3347650 - protein, 10 aa, Plasmodium falciparum
TKNKKNKGDQ

SEQ ID NO: 3347651 - protein, 9 aa, Plasmodium falciparum
TKNKKQENV

SEQ ID NO: 3347652 - protein, 56 aa, Plasmodium falciparum
TKNKKSNNNDGKKRSNKNIKEDKKNDVTDNNENNGKRNKKIRKAKTFGGTVKKGGT

SEQ ID NO: 3347653 - protein, 24 aa, Plasmodium falciparum
TKNKNDNNNNNNNNNNNNKYDNNY

SEQ ID NO: 3347654 - protein, 111 aa, Plasmodium falciparum
TKNKNKYSNNNNNNENKNNENKNNENNNNNKNNNNENKKNNNKKNNNNNNNNNNNNNNKNNNINNNNNNNNNPQVHNKKNEKKSGCNIKTKEQNNNKNTNNMKKQNLKNEI

SEQ ID NO: 3347655 - protein, 28 aa, Plasmodium falciparum
TKNKRNQSANEVKSNNNDNHNNKKNNNF

SEQ ID NO: 3347656 - protein, 10 aa, Plasmodium falciparum
TKNLNEDKSY

SEQ ID NO: 3347657 - protein, 6 aa, Plasmodium falciparum
TKNLSY

SEQ ID NO: 3347658 - protein, 7 aa, Plasmodium falciparum
TKNLTKR

SEQ ID NO: 3347659 - protein, 4 aa, Plasmodium falciparum
TKNN

SEQ ID NO: 3347660 - protein, 15 aa, Plasmodium falciparum
TKNNDLQEQLKIFMN

SEQ ID NO: 3347661 - protein, 9 aa, Plasmodium falciparum
TKNNDSNTI

SEQ ID NO: 3347662 - protein, 7 aa, Plasmodium falciparum
TKNNEER

SEQ ID NO: 3347663 - protein, 22 aa, Plasmodium falciparum
TKNNENQIGYEETEKQLNTGVS

SEQ ID NO: 3347664 - protein, 12 aa, Plasmodium falciparum
TKNNIEKCHSKD

SEQ ID NO: 3347665 - protein, 7 aa, Plasmodium falciparum
TKNNINN

SEQ ID NO: 3347666 - protein, 30 aa, Plasmodium falciparum
TKNNKNEKKTHSGSSSYTISTSRESNNSDV

SEQ ID NO: 3347667 - protein, 17 aa, Plasmodium falciparum
TKNNNENYNLEKGDGVI

SEQ ID NO: 3347668 - protein, 6 aa, Plasmodium falciparum
TKNNPI

SEQ ID NO: 3347669 - protein, 7 aa, Plasmodium falciparum
TKNPDEF

SEQ ID NO: 3347670 - protein, 6 aa, Plasmodium falciparum
TKNPEH

SEQ ID NO: 3347671 - protein, 6 aa, Plasmodium falciparum
TKNQLQ

SEQ ID NO: 3347672 - protein, 4 aa, Plasmodium falciparum
TKNS

SEQ ID NO: 3347673 - protein, 9 aa, Plasmodium falciparum
TKNSHTLSS

SEQ ID NO: 3347674 - protein, 9 aa, Plasmodium falciparum
TKNTEQDKI

SEQ ID NO: 3347675 - protein, 8 aa, Plasmodium falciparum
TKNTNPRK

SEQ ID NO: 3347676 - protein, 35 aa, Plasmodium falciparum
TKNTNTYEKKNENKNVSNVDSKTKSNEKGRPPTYS

SEQ ID NO: 3347677 - protein, 9 aa, Plasmodium falciparum
TKNTSNEKD

SEQ ID NO: 3347678 - protein, 4 aa, Plasmodium falciparum
TKNY

SEQ ID NO: 3347679 - protein, 6 aa, Plasmodium falciparum
TKNYID

SEQ ID NO: 3347680 - protein, 5 aa, Plasmodium falciparum
TKNYP

SEQ ID NO: 3347681 - protein, 7 aa, Plasmodium falciparum
TKPGDTV

SEQ ID NO: 3347682 - protein, 7 aa, Plasmodium falciparum
TKPGLKH

SEQ ID NO: 3347683 - protein, 4 aa, Plasmodium falciparum
TKPH

SEQ ID NO: 3347684 - protein, 11 aa, Plasmodium falciparum
TKPKASRNESR

SEQ ID NO: 3347685 - protein, 4 aa, Plasmodium falciparum
TKPN

SEQ ID NO: 3347686 - protein, 10 aa, Plasmodium falciparum
TKPNEEKTNV

SEQ ID NO: 3347687 - protein, 9 aa, Plasmodium falciparum
TKPNETNTI

SEQ ID NO: 3347688 - protein, 13 aa, Plasmodium falciparum
TKPNMAPPPNRRK

SEQ ID NO: 3347689 - protein, 6 aa, Plasmodium falciparum
TKPPSD

SEQ ID NO: 3347690 - protein, 36 aa, Plasmodium falciparum
TKPTRKNNKSNKNAGKDKTKSRDGKNNNDSSNSPQI

SEQ ID NO: 3347691 - protein, 4 aa, Plasmodium falciparum
TKPY

SEQ ID NO: 3347692 - protein, 9 aa, Plasmodium falciparum
TKQDNSHNY

SEQ ID NO: 3347693 - protein, 7 aa, Plasmodium falciparum
TKQEVGD

SEQ ID NO: 3347694 - protein, 5 aa, Plasmodium falciparum
TKQID

SEQ ID NO: 3347695 - protein, 9 aa, Plasmodium falciparum
TKQKEYEKQ

SEQ ID NO: 3347696 - protein, 8 aa, Plasmodium falciparum
TKQKLQER

SEQ ID NO: 3347697 - protein, 4 aa, Plasmodium falciparum
TKQN

SEQ ID NO: 3347698 - protein, 7 aa, Plasmodium falciparum
TKQRIEQ

SEQ ID NO: 3347699 - protein, 28 aa, Plasmodium falciparum
TKQSSENNNNINNSSTMYKEKKEEPNLN

SEQ ID NO: 3347700 - protein, 11 aa, Plasmodium falciparum
TKQSTKKNPFL

SEQ ID NO: 3347701 - protein, 7 aa, Plasmodium falciparum
TKQTINE

SEQ ID NO: 3347702 - protein, 27 aa, Plasmodium falciparum
TKQTTTYDSNNNINSNSNTQKKGNKKI

SEQ ID NO: 3347703 - protein, 4 aa, Plasmodium falciparum
TKQY

SEQ ID NO: 3347704 - protein, 5 aa, Plasmodium falciparum
TKRDN

SEQ ID NO: 3347705 - protein, 8 aa, Plasmodium falciparum
TKRENNNI

SEQ ID NO: 3347706 - protein, 6 aa, Plasmodium falciparum
TKREWE

SEQ ID NO: 3347707 - protein, 7 aa, Plasmodium falciparum
TKRGCDT

SEQ ID NO: 3347708 - protein, 8 aa, Plasmodium falciparum
TKRGGNSF

SEQ ID NO: 3347709 - protein, 9 aa, Plasmodium falciparum
TKRGSPEGL

SEQ ID NO: 3347710 - protein, 5 aa, Plasmodium falciparum
TKRKE

SEQ ID NO: 3347711 - protein, 29 aa, Plasmodium falciparum
TKRNSLKENKKIEKQKKGGRVGRPSKIDK

SEQ ID NO: 3347712 - protein, 7 aa, Plasmodium falciparum
TKRRSNI

SEQ ID NO: 3347713 - protein, 7 aa, Plasmodium falciparum
TKRSKSI

SEQ ID NO: 3347714 - protein, 7 aa, Plasmodium falciparum
TKRSTSE

SEQ ID NO: 3347715 - protein, 8 aa, Plasmodium falciparum
TKRTSGGI

SEQ ID NO: 3347716 - protein, 5 aa, Plasmodium falciparum
TKRVR

SEQ ID NO: 3347717 - protein, 14 aa, Plasmodium falciparum
TKSEENESSEEIEK

SEQ ID NO: 3347718 - protein, 11 aa, Plasmodium falciparum
TKSEEQEEEEH

SEQ ID NO: 3347719 - protein, 19 aa, Plasmodium falciparum
TKSEKEQNKKKQNKNEQVK

SEQ ID NO: 3347720 - protein, 43 aa, Plasmodium falciparum
TKSESDTKQNNDSSSNNNNNNNYSVSEKVSGEENTNNNNNEEV

SEQ ID NO: 3347721 - protein, 15 aa, Plasmodium falciparum
TKSGKKREDFNEEAE

SEQ ID NO: 3347722 - protein, 9 aa, Plasmodium falciparum
TKSHKKNCS

SEQ ID NO: 3347723 - protein, 4 aa, Plasmodium falciparum
TKSI

SEQ ID NO: 3347724 - protein, 8 aa, Plasmodium falciparum
TKSKEDNE

SEQ ID NO: 3347725 - protein, 11 aa, Plasmodium falciparum
TKSKNIDDDYS

SEQ ID NO: 3347726 - protein, 8 aa, Plasmodium falciparum
TKSKTPKY

SEQ ID NO: 3347727 - protein, 5 aa, Plasmodium falciparum
TKSLI

SEQ ID NO: 3347728 - protein, 6 aa, Plasmodium falciparum
TKSLNE

SEQ ID NO: 3347729 - protein, 7 aa, Plasmodium falciparum
TKSLTSA

SEQ ID NO: 3347730 - protein, 8 aa, Plasmodium falciparum
TKSNTSAI

SEQ ID NO: 3347731 - protein, 31 aa, Plasmodium falciparum
TKSPFKDNVTNRSNYNNDNNYNSNNNQNNDL

SEQ ID NO: 3347732 - protein, 6 aa, Plasmodium falciparum
TKSPKI

SEQ ID NO: 3347733 - protein, 7 aa, Plasmodium falciparum
TKSPNEK

SEQ ID NO: 3347734 - protein, 11 aa, Plasmodium falciparum
TKSQKKITEDD

SEQ ID NO: 3347735 - protein, 6 aa, Plasmodium falciparum
TKSSFP

SEQ ID NO: 3347736 - protein, 15 aa, Plasmodium falciparum
TKSSTVAKKNGCAST

SEQ ID NO: 3347737 - protein, 4 aa, Plasmodium falciparum
TKST

SEQ ID NO: 3347738 - protein, 8 aa, Plasmodium falciparum
TKSTQHIN

SEQ ID NO: 3347739 - protein, 14 aa, Plasmodium falciparum
TKSTSNNNKINDND

SEQ ID NO: 3347740 - protein, 4 aa, Plasmodium falciparum
TKSY

SEQ ID NO: 3347741 - protein, 8 aa, Plasmodium falciparum
TKSYEDDN

SEQ ID NO: 3347742 - protein, 8 aa, Plasmodium falciparum
TKSYKNVQ

SEQ ID NO: 3347743 - protein, 8 aa, Plasmodium falciparum
TKTGGTGD

SEQ ID NO: 3347744 - protein, 8 aa, Plasmodium falciparum
TKTGNRYN

SEQ ID NO: 3347745 - protein, 7 aa, Plasmodium falciparum
TKTKKNK

SEQ ID NO: 3347746 - protein, 9 aa, Plasmodium falciparum
TKTKVGEEM

SEQ ID NO: 3347747 - protein, 6 aa, Plasmodium falciparum
TKTNEY

SEQ ID NO: 3347748 - protein, 11 aa, Plasmodium falciparum
TKTNGSKYVNK

SEQ ID NO: 3347749 - protein, 9 aa, Plasmodium falciparum
TKTNKEYNE

SEQ ID NO: 3347750 - protein, 15 aa, Plasmodium falciparum
TKTNNNKKKKKKNKH

SEQ ID NO: 3347751 - protein, 14 aa, Plasmodium falciparum
TKTQDMKNKQDYLG

SEQ ID NO: 3347752 - protein, 8 aa, Plasmodium falciparum
TKTQKERD

SEQ ID NO: 3347753 - protein, 5 aa, Plasmodium falciparum
TKTQN

SEQ ID NO: 3347754 - protein, 11 aa, Plasmodium falciparum
TKTQNRNQNED

SEQ ID NO: 3347755 - protein, 20 aa, Plasmodium falciparum
TKTRKEKKEPSLAQKRTSAI

SEQ ID NO: 3347756 - protein, 5 aa, Plasmodium falciparum
TKTRN

SEQ ID NO: 3347757 - protein, 32 aa, Plasmodium falciparum
TKTSNYEQSNNTNSKDEHNISSDKSKKEDTLN

SEQ ID NO: 3347758 - protein, 9 aa, Plasmodium falciparum
TKVSKEVDA

SEQ ID NO: 3347759 - protein, 8 aa, Plasmodium falciparum
TKVSSNGY

SEQ ID NO: 3347760 - protein, 6 aa, Plasmodium falciparum
TKVTQN

SEQ ID NO: 3347761 - protein, 22 aa, Plasmodium falciparum
TKYDKDNDNENDNENDNTYNKN

SEQ ID NO: 3347762 - protein, 46 aa, Plasmodium falciparum
TKYEKNDNPFNNNNEEEEEKEKEKEKEHQPHQGNQINNDNNSNQEK

SEQ ID NO: 3347763 - protein, 5 aa, Plasmodium falciparum
TKYKN

SEQ ID NO: 3347764 - protein, 13 aa, Plasmodium falciparum
TKYNNNHKKAYQP

SEQ ID NO: 3347765 - protein, 7 aa, Plasmodium falciparum
TKYNNNK

SEQ ID NO: 3347766 - protein, 6 aa, Plasmodium falciparum
TKYPSS

SEQ ID NO: 3347767 - protein, 24 aa, Plasmodium falciparum
TKYQKKKNNAINNMNNNSSSGINN

SEQ ID NO: 3347768 - protein, 8 aa, Plasmodium falciparum
TKYSDSRM

SEQ ID NO: 3347769 - protein, 8 aa, Plasmodium falciparum
TKYTNDDE

SEQ ID NO: 3347770 - protein, 13 aa, Plasmodium falciparum
TLADDTGKISDEN

SEQ ID NO: 3347771 - protein, 8 aa, Plasmodium falciparum
TLADTNDS

SEQ ID NO: 3347772 - protein, 5 aa, Plasmodium falciparum
TLCES

SEQ ID NO: 3347773 - protein, 7 aa, Plasmodium falciparum
TLDDENS

SEQ ID NO: 3347774 - protein, 10 aa, Plasmodium falciparum
TLDDQPEEDM

SEQ ID NO: 3347775 - protein, 5 aa, Plasmodium falciparum
TLDSE

SEQ ID NO: 3347776 - protein, 20 aa, Plasmodium falciparum
TLEDNDEYNTNDQRTTRSSL

SEQ ID NO: 3347777 - protein, 39 aa, Plasmodium falciparum
TLEENKRKEMKKNKINHEKDNKNDEKNDEKNDEKNNEMY

SEQ ID NO: 3347778 - protein, 5 aa, Plasmodium falciparum
TLEER

SEQ ID NO: 3347779 - protein, 7 aa, Plasmodium falciparum
TLEKKRK

SEQ ID NO: 3347780 - protein, 29 aa, Plasmodium falciparum
TLEKTNGTLEETNGTLEKTNGTLEETSEI

SEQ ID NO: 3347781 - protein, 7 aa, Plasmodium falciparum
TLENDSK

SEQ ID NO: 3347782 - protein, 35 aa, Plasmodium falciparum
TLENEEEQQNKENKTNKENKDNKENKTNKENKEKC

SEQ ID NO: 3347783 - protein, 7 aa, Plasmodium falciparum
TLENNSL

SEQ ID NO: 3347784 - protein, 10 aa, Plasmodium falciparum
TLENSSNIDD

SEQ ID NO: 3347785 - protein, 10 aa, Plasmodium falciparum
TLGKNDKTTF

SEQ ID NO: 3347786 - protein, 11 aa, Plasmodium falciparum
TLGKSSISTNY

SEQ ID NO: 3347787 - protein, 7 aa, Plasmodium falciparum
TLGNDKI

SEQ ID NO: 3347788 - protein, 6 aa, Plasmodium falciparum
TLGSRE

SEQ ID NO: 3347789 - protein, 14 aa, Plasmodium falciparum
TLKDENKGENEIKR

SEQ ID NO: 3347790 - protein, 9 aa, Plasmodium falciparum
TLKDERNQK

SEQ ID NO: 3347791 - protein, 12 aa, Plasmodium falciparum
TLKEKNNSITST

SEQ ID NO: 3347792 - protein, 11 aa, Plasmodium falciparum
TLKEQNEDKIN

SEQ ID NO: 3347793 - protein, 5 aa, Plasmodium falciparum
TLKET

SEQ ID NO: 3347794 - protein, 8 aa, Plasmodium falciparum
TLKNEDNK

SEQ ID NO: 3347795 - protein, 10 aa, Plasmodium falciparum
TLKNKTTKEI

SEQ ID NO: 3347796 - protein, 10 aa, Plasmodium falciparum
TLKNPSTEDI

SEQ ID NO: 3347797 - protein, 4 aa, Plasmodium falciparum
TLKP

SEQ ID NO: 3347798 - protein, 27 aa, Plasmodium falciparum
TLKSKGQQKINKSNHAVQNGNNNMDEK

SEQ ID NO: 3347799 - protein, 9 aa, Plasmodium falciparum
TLKSNKGKK

SEQ ID NO: 3347800 - protein, 6 aa, Plasmodium falciparum
TLKTKE

SEQ ID NO: 3347801 - protein, 6 aa, Plasmodium falciparum
TLMEKG

SEQ ID NO: 3347802 - protein, 5 aa, Plasmodium falciparum
TLNDD

SEQ ID NO: 3347803 - protein, 4 aa, Plasmodium falciparum
TLNE

SEQ ID NO: 3347804 - protein, 6 aa, Plasmodium falciparum
TLNEEY

SEQ ID NO: 3347805 - protein, 13 aa, Plasmodium falciparum
TLNEQNEDKMNSL

SEQ ID NO: 3347806 - protein, 7 aa, Plasmodium falciparum
TLNGDPS

SEQ ID NO: 3347807 - protein, 6 aa, Plasmodium falciparum
TLNNES

SEQ ID NO: 3347808 - protein, 40 aa, Plasmodium falciparum
TLNNGNDDNNTNNNNNKSYYEKECSEENNMYSPNSNVKNN

SEQ ID NO: 3347809 - protein, 12 aa, Plasmodium falciparum
TLNNKNKHGQKI

SEQ ID NO: 3347810 - protein, 7 aa, Plasmodium falciparum
TLNQKEN

SEQ ID NO: 3347811 - protein, 8 aa, Plasmodium falciparum
TLNRKKQK

SEQ ID NO: 3347812 - protein, 13 aa, Plasmodium falciparum
TLNRNNRKITPYQ

SEQ ID NO: 3347813 - protein, 7 aa, Plasmodium falciparum
TLNSNKN

SEQ ID NO: 3347814 - protein, 13 aa, Plasmodium falciparum
TLNSNKSLNSEGY

SEQ ID NO: 3347815 - protein, 11 aa, Plasmodium falciparum
TLNSNNKQDMS

SEQ ID NO: 3347816 - protein, 8 aa, Plasmodium falciparum
TLNSNSDH

SEQ ID NO: 3347817 - protein, 8 aa, Plasmodium falciparum
TLNSTPKK

SEQ ID NO: 3347818 - protein, 14 aa, Plasmodium falciparum
TLNTSQKKKNNIPS

SEQ ID NO: 3347819 - protein, 14 aa, Plasmodium falciparum
TLPEELKKKNSESL

SEQ ID NO: 3347820 - protein, 13 aa, Plasmodium falciparum
TLPEKNEEQTDDM

SEQ ID NO: 3347821 - protein, 4 aa, Plasmodium falciparum
TLPG

SEQ ID NO: 3347822 - protein, 5 aa, Plasmodium falciparum
TLPKT

SEQ ID NO: 3347823 - protein, 12 aa, Plasmodium falciparum
TLPLNQNNECGN

SEQ ID NO: 3347824 - protein, 22 aa, Plasmodium falciparum
TLPNGTVERTVTEREEDDRGNI

SEQ ID NO: 3347825 - protein, 5 aa, Plasmodium falciparum
TLPNN

SEQ ID NO: 3347826 - protein, 17 aa, Plasmodium falciparum
TLPSESPSESSSKSDSY

SEQ ID NO: 3347827 - protein, 12 aa, Plasmodium falciparum
TLPSRTKYYKDS

SEQ ID NO: 3347828 - protein, 10 aa, Plasmodium falciparum
TLPSSKKSVI

SEQ ID NO: 3347829 - protein, 6 aa, Plasmodium falciparum
TLQDEN

SEQ ID NO: 3347830 - protein, 33 aa, Plasmodium falciparum
TLQDGDTLQNNNNNDNNNDNTNEHNNNNNDNSL

SEQ ID NO: 3347831 - protein, 10 aa, Plasmodium falciparum
TLQENKSPLD

SEQ ID NO: 3347832 - protein, 10 aa, Plasmodium falciparum
TLQNNSEYDK

SEQ ID NO: 3347833 - protein, 7 aa, Plasmodium falciparum
TLQTSDY

SEQ ID NO: 3347834 - protein, 4 aa, Plasmodium falciparum
TLRG

SEQ ID NO: 3347835 - protein, 4 aa, Plasmodium falciparum
TLRN

SEQ ID NO: 3347836 - protein, 10 aa, Plasmodium falciparum
TLRNNNSSRF

SEQ ID NO: 3347837 - protein, 7 aa, Plasmodium falciparum
TLRPSPA

SEQ ID NO: 3347838 - protein, 13 aa, Plasmodium falciparum
TLSDDNKKKMYDS

SEQ ID NO: 3347839 - protein, 5 aa, Plasmodium falciparum
TLSGK

SEQ ID NO: 3347840 - protein, 5 aa, Plasmodium falciparum
TLSGP

SEQ ID NO: 3347841 - protein, 26 aa, Plasmodium falciparum
TLSKNQGQIYKGRKEKKRKRSYRNDE

SEQ ID NO: 3347842 - protein, 5 aa, Plasmodium falciparum
TLSND

SEQ ID NO: 3347843 - protein, 13 aa, Plasmodium falciparum
TLSRSSIDSNAQL

SEQ ID NO: 3347844 - protein, 6 aa, Plasmodium falciparum
TLSSPQ

SEQ ID NO: 3347845 - protein, 10 aa, Plasmodium falciparum
TLSSRKERKK

SEQ ID NO: 3347846 - protein, 18 aa, Plasmodium falciparum
TLSSSSTDPLNQTSNENL

SEQ ID NO: 3347847 - protein, 14 aa, Plasmodium falciparum
TLSTSSVGTQNDAG

SEQ ID NO: 3347848 - protein, 5 aa, Plasmodium falciparum
TLSYD

SEQ ID NO: 3347849 - protein, 9 aa, Plasmodium falciparum
TLTEERAKE

SEQ ID NO: 3347850 - protein, 14 aa, Plasmodium falciparum
TLTEKRDKEREKRK

SEQ ID NO: 3347851 - protein, 9 aa, Plasmodium falciparum
TLTNSNSLS

SEQ ID NO: 3347852 - protein, 6 aa, Plasmodium falciparum
TLTQQK

SEQ ID NO: 3347853 - protein, 5 aa, Plasmodium falciparum
TLTSN

SEQ ID NO: 3347854 - protein, 12 aa, Plasmodium falciparum
TLTTKERKKSRF

SEQ ID NO: 3347855 - protein, 11 aa, Plasmodium falciparum
TLTTNNENEVN

SEQ ID NO: 3347856 - protein, 5 aa, Plasmodium falciparum
TLTTT

SEQ ID NO: 3347857 - protein, 6 aa, Plasmodium falciparum
TLYPDG

SEQ ID NO: 3347858 - protein, 11 aa, Plasmodium falciparum
TMKDETNKDNM

SEQ ID NO: 3347859 - protein, 10 aa, Plasmodium falciparum
TMKDKNDLGQ

SEQ ID NO: 3347860 - protein, 12 aa, Plasmodium falciparum
TMKGKTNKNNID

SEQ ID NO: 3347861 - protein, 9 aa, Plasmodium falciparum
TMNKDKEES

SEQ ID NO: 3347862 - protein, 5 aa, Plasmodium falciparum
TMNNQ

SEQ ID NO: 3347863 - protein, 5 aa, Plasmodium falciparum
TMNPE

SEQ ID NO: 3347864 - protein, 5 aa, Plasmodium falciparum
TMNSH

SEQ ID NO: 3347865 - protein, 6 aa, Plasmodium falciparum
TMNSSM

SEQ ID NO: 3347866 - protein, 5 aa, Plasmodium falciparum
TMNST

SEQ ID NO: 3347867 - protein, 12 aa, Plasmodium falciparum
TMNTTYKNNDKN

SEQ ID NO: 3347868 - protein, 9 aa, Plasmodium falciparum
TMRSEDEIK

SEQ ID NO: 3347869 - protein, 9 aa, Plasmodium falciparum
TMSESNKYM

SEQ ID NO: 3347870 - protein, 5 aa, Plasmodium falciparum
TMSPY

SEQ ID NO: 3347871 - protein, 8 aa, Plasmodium falciparum
TMSSNNNN

SEQ ID NO: 3347872 - protein, 4 aa, Plasmodium falciparum
TMTE

SEQ ID NO: 3347873 - protein, 12 aa, Plasmodium falciparum
TMTKNEDDYTKK

SEQ ID NO: 3347874 - protein, 8 aa, Plasmodium falciparum
TNAEADNM

SEQ ID NO: 3347875 - protein, 4 aa, Plasmodium falciparum
TNAS

SEQ ID NO: 3347876 - protein, 12 aa, Plasmodium falciparum
TNASTRSKSIDT

SEQ ID NO: 3347877 - protein, 10 aa, Plasmodium falciparum
TNAVSNEEND

SEQ ID NO: 3347878 - protein, 12 aa, Plasmodium falciparum
TNCDNNKNNKNK

SEQ ID NO: 3347879 - protein, 11 aa, Plasmodium falciparum
TNCDYKKEKEV

SEQ ID NO: 3347880 - protein, 10 aa, Plasmodium falciparum
TNCNNDVEKN

SEQ ID NO: 3347881 - protein, 5 aa, Plasmodium falciparum
TNDAF

SEQ ID NO: 3347882 - protein, 22 aa, Plasmodium falciparum
TNDANNNDGATTTTTDNASEKN

SEQ ID NO: 3347883 - protein, 8 aa, Plasmodium falciparum
TNDDCTTC

SEQ ID NO: 3347884 - protein, 25 aa, Plasmodium falciparum
TNDDITNDNITNDNITNDNTPNDYI

SEQ ID NO: 3347885 - protein, 6 aa, Plasmodium falciparum
TNDDNY

SEQ ID NO: 3347886 - protein, 5 aa, Plasmodium falciparum
TNDEK

SEQ ID NO: 3347887 - protein, 10 aa, Plasmodium falciparum
TNDEKKEMNI

SEQ ID NO: 3347888 - protein, 92 aa, Plasmodium falciparum
TNDEKYVNEDNVGNLKKKKKNKKKKNKKNKNAQDCTTSEEVKNNVERNNEEEEIKKSNHINDTTKNEKDTHSDNNMKSVPNNKNKNKNQNKN

SEQ ID NO: 3347889 - protein, 7 aa, Plasmodium falciparum
TNDEYEE

SEQ ID NO: 3347890 - protein, 4 aa, Plasmodium falciparum
TNDF

SEQ ID NO: 3347891 - protein, 5 aa, Plasmodium falciparum
TNDGA

SEQ ID NO: 3347892 - protein, 28 aa, Plasmodium falciparum
TNDGNDHSSNNNNNNNNNYNDENKQKSI

SEQ ID NO: 3347893 - protein, 5 aa, Plasmodium falciparum
TNDGP

SEQ ID NO: 3347894 - protein, 6 aa, Plasmodium falciparum
TNDHTD

SEQ ID NO: 3347895 - protein, 4 aa, Plasmodium falciparum
TNDK

SEQ ID NO: 3347896 - protein, 11 aa, Plasmodium falciparum
TNDKENNNLNN

SEQ ID NO: 3347897 - protein, 6 aa, Plasmodium falciparum
TNDKIN

SEQ ID NO: 3347898 - protein, 13 aa, Plasmodium falciparum
TNDKNNGQDINKP

SEQ ID NO: 3347899 - protein, 45 aa, Plasmodium falciparum
TNDKREYGKGDDKYHRPCTGKGTGQKRFEIGTPWETKKDDVNQNQ

SEQ ID NO: 3347900 - protein, 6 aa, Plasmodium falciparum
TNDLDN

SEQ ID NO: 3347901 - protein, 5 aa, Plasmodium falciparum
TNDMT

SEQ ID NO: 3347902 - protein, 4 aa, Plasmodium falciparum
TNDN

SEQ ID NO: 3347903 - protein, 19 aa, Plasmodium falciparum
TNDNINNDSLNNDNINKDN

SEQ ID NO: 3347904 - protein, 6 aa, Plasmodium falciparum
TNDNKN

SEQ ID NO: 3347905 - protein, 16 aa, Plasmodium falciparum
TNDNKNDVQTSNVRKR

SEQ ID NO: 3347906 - protein, 11 aa, Plasmodium falciparum
TNDNKNNNNIY

SEQ ID NO: 3347907 - protein, 8 aa, Plasmodium falciparum
TNDNLNNE

SEQ ID NO: 3347908 - protein, 83 aa, Plasmodium falciparum
TNDNNNDGINNNNDDNNDDNNDDNNNNNNNNNKNNNKNSSNNKSNNNKKNYNNKNQNNNDNNNDNGNNNNNNNDDNNDDNNIR

SEQ ID NO: 3347909 - protein, 40 aa, Plasmodium falciparum
TNDNNNNDNDNNNDNNNNNNNNNDNNNNNNNDNNNNNNNY

SEQ ID NO: 3347910 - protein, 25 aa, Plasmodium falciparum
TNDNNNNNNKKNSSSSNNNNNNNDI

SEQ ID NO: 3347911 - protein, 9 aa, Plasmodium falciparum
TNDNTPNDY

SEQ ID NO: 3347912 - protein, 4 aa, Plasmodium falciparum
TNDP

SEQ ID NO: 3347913 - protein, 6 aa, Plasmodium falciparum
TNDPLD

SEQ ID NO: 3347914 - protein, 10 aa, Plasmodium falciparum
TNDQKKEAHE

SEQ ID NO: 3347915 - protein, 5 aa, Plasmodium falciparum
TNDRR

SEQ ID NO: 3347916 - protein, 9 aa, Plasmodium falciparum
TNDSDHSIK

SEQ ID NO: 3347917 - protein, 18 aa, Plasmodium falciparum
TNDSFKGLSSYDNNRQEH

SEQ ID NO: 3347918 - protein, 5 aa, Plasmodium falciparum
TNDSN

SEQ ID NO: 3347919 - protein, 9 aa, Plasmodium falciparum
TNDSRKNIS

SEQ ID NO: 3347920 - protein, 30 aa, Plasmodium falciparum
TNDTIKKKENINNVTNDPIKKKENINNATN

SEQ ID NO: 3347921 - protein, 19 aa, Plasmodium falciparum
TNDTLSSGKNYKNLPRNSE

SEQ ID NO: 3347922 - protein, 7 aa, Plasmodium falciparum
TNDTPGT

SEQ ID NO: 3347923 - protein, 12 aa, Plasmodium falciparum
TNDTQKIKDTQQ

SEQ ID NO: 3347924 - protein, 11 aa, Plasmodium falciparum
TNDTTKSNPVY

SEQ ID NO: 3347925 - protein, 14 aa, Plasmodium falciparum
TNDYKKDDNITNDM

SEQ ID NO: 3347926 - protein, 11 aa, Plasmodium falciparum
TNEANKGEVKK

SEQ ID NO: 3347927 - protein, 4 aa, Plasmodium falciparum
TNEC

SEQ ID NO: 3347928 - protein, 5 aa, Plasmodium falciparum
TNECT

SEQ ID NO: 3347929 - protein, 4 aa, Plasmodium falciparum
TNED

SEQ ID NO: 3347930 - protein, 18 aa, Plasmodium falciparum
TNEDGNDNNDNNKLDKNN

SEQ ID NO: 3347931 - protein, 11 aa, Plasmodium falciparum
TNEEENDNEVE

SEQ ID NO: 3347932 - protein, 5 aa, Plasmodium falciparum
TNEEK

SEQ ID NO: 3347933 - protein, 14 aa, Plasmodium falciparum
TNEEKDQKEDAHKN

SEQ ID NO: 3347934 - protein, 16 aa, Plasmodium falciparum
TNEEKKGGKEKMPIGR

SEQ ID NO: 3347935 - protein, 10 aa, Plasmodium falciparum
TNEEKQKIHT

SEQ ID NO: 3347936 - protein, 9 aa, Plasmodium falciparum
TNEENINSN

SEQ ID NO: 3347937 - protein, 13 aa, Plasmodium falciparum
TNEEQKKEENNLT

SEQ ID NO: 3347938 - protein, 10 aa, Plasmodium falciparum
TNEEREKQNV

SEQ ID NO: 3347939 - protein, 6 aa, Plasmodium falciparum
TNEESK

SEQ ID NO: 3347940 - protein, 5 aa, Plasmodium falciparum
TNEET

SEQ ID NO: 3347941 - protein, 21 aa, Plasmodium falciparum
TNEGDTNIPNVTQNKNHINSN

SEQ ID NO: 3347942 - protein, 12 aa, Plasmodium falciparum
TNEGEENRSSLD

SEQ ID NO: 3347943 - protein, 6 aa, Plasmodium falciparum
TNEGNN

SEQ ID NO: 3347944 - protein, 7 aa, Plasmodium falciparum
TNEGSYK

SEQ ID NO: 3347945 - protein, 6 aa, Plasmodium falciparum
TNEGYK

SEQ ID NO: 3347946 - protein, 26 aa, Plasmodium falciparum
TNEHNETSYKPHRNYSTSNQKGKDDI

SEQ ID NO: 3347947 - protein, 24 aa, Plasmodium falciparum
TNEIKNDNIQTDEIKNDNIQTDEI

SEQ ID NO: 3347948 - protein, 5 aa, Plasmodium falciparum
TNEKD

SEQ ID NO: 3347949 - protein, 11 aa, Plasmodium falciparum
TNEKDNKEMNN

SEQ ID NO: 3347950 - protein, 10 aa, Plasmodium falciparum
TNEKDSKNNM

SEQ ID NO: 3347951 - protein, 16 aa, Plasmodium falciparum
TNEKEKKKKDKKRNTN

SEQ ID NO: 3347952 - protein, 5 aa, Plasmodium falciparum
TNEKK

SEQ ID NO: 3347953 - protein, 26 aa, Plasmodium falciparum
TNEKKKKLEKYSKKHSQKYAHKDEVE

SEQ ID NO: 3347954 - protein, 5 aa, Plasmodium falciparum
TNEKL

SEQ ID NO: 3347955 - protein, 9 aa, Plasmodium falciparum
TNEKNKNTL

SEQ ID NO: 3347956 - protein, 8 aa, Plasmodium falciparum
TNEKYEGA

SEQ ID NO: 3347957 - protein, 10 aa, Plasmodium falciparum
TNELKKNNTY

SEQ ID NO: 3347958 - protein, 8 aa, Plasmodium falciparum
TNEMSTRS

SEQ ID NO: 3347959 - protein, 80 aa, Plasmodium falciparum
TNENDKNKKDTNTSDVMSSSSSTKTGSRTTTTTTTTTTTNNNNNNNNNNNMDGNSSNNAGDINSCKNNTSVTDHNISNKN

SEQ ID NO: 3347960 - protein, 21 aa, Plasmodium falciparum
TNENDTSNNNKQNNKNNTESV

SEQ ID NO: 3347961 - protein, 5 aa, Plasmodium falciparum
TNENE

SEQ ID NO: 3347962 - protein, 48 aa, Plasmodium falciparum
TNENENYKENNDSSIQSIRSNSKSIEKNDDDNNNNNNDNTLQSEENEE

SEQ ID NO: 3347963 - protein, 12 aa, Plasmodium falciparum
TNENKKENEHNH

SEQ ID NO: 3347964 - protein, 11 aa, Plasmodium falciparum
TNENKKSKKID

SEQ ID NO: 3347965 - protein, 5 aa, Plasmodium falciparum
TNENL

SEQ ID NO: 3347966 - protein, 11 aa, Plasmodium falciparum
TNENMEEQKKN

SEQ ID NO: 3347967 - protein, 10 aa, Plasmodium falciparum
TNENNKKKKK

SEQ ID NO: 3347968 - protein, 14 aa, Plasmodium falciparum
TNENNVDNQNKNEH

SEQ ID NO: 3347969 - protein, 12 aa, Plasmodium falciparum
TNENTHNNDDRD

SEQ ID NO: 3347970 - protein, 29 aa, Plasmodium falciparum
TNENVHSTKKSPYNMRSSKRRSDTSSTYM

SEQ ID NO: 3347971 - protein, 6 aa, Plasmodium falciparum
TNENYN

SEQ ID NO: 3347972 - protein, 6 aa, Plasmodium falciparum
TNENYT

SEQ ID NO: 3347973 - protein, 6 aa, Plasmodium falciparum
TNEPNN

SEQ ID NO: 3347974 - protein, 7 aa, Plasmodium falciparum
TNEPYEE

SEQ ID NO: 3347975 - protein, 9 aa, Plasmodium falciparum
TNEQPEDKH

SEQ ID NO: 3347976 - protein, 7 aa, Plasmodium falciparum
TNEQTTS

SEQ ID NO: 3347977 - protein, 4 aa, Plasmodium falciparum
TNER

SEQ ID NO: 3347978 - protein, 5 aa, Plasmodium falciparum
TNESA

SEQ ID NO: 3347979 - protein, 8 aa, Plasmodium falciparum
TNESEEVT

SEQ ID NO: 3347980 - protein, 8 aa, Plasmodium falciparum
TNESLNNS

SEQ ID NO: 3347981 - protein, 18 aa, Plasmodium falciparum
TNESNKNIRNNKKDKISE

SEQ ID NO: 3347982 - protein, 8 aa, Plasmodium falciparum
TNESYKSA

SEQ ID NO: 3347983 - protein, 14 aa, Plasmodium falciparum
TNETRISKTHKPSE

SEQ ID NO: 3347984 - protein, 6 aa, Plasmodium falciparum
TNEYDT

SEQ ID NO: 3347985 - protein, 7 aa, Plasmodium falciparum
TNEYSDR

SEQ ID NO: 3347986 - protein, 4 aa, Plasmodium falciparum
TNFE

SEQ ID NO: 3347987 - protein, 9 aa, Plasmodium falciparum
TNFKNSNHL

SEQ ID NO: 3347988 - protein, 12 aa, Plasmodium falciparum
TNFNKRASKFES

SEQ ID NO: 3347989 - protein, 23 aa, Plasmodium falciparum
TNFPTNNKGISSTSISSSSTKNF

SEQ ID NO: 3347990 - protein, 8 aa, Plasmodium falciparum
TNGDSDVN

SEQ ID NO: 3347991 - protein, 8 aa, Plasmodium falciparum
TNGKYKPA

SEQ ID NO: 3347992 - protein, 11 aa, Plasmodium falciparum
TNGMSNKNNMN

SEQ ID NO: 3347993 - protein, 4 aa, Plasmodium falciparum
TNGN

SEQ ID NO: 3347994 - protein, 12 aa, Plasmodium falciparum
TNGNNLSPTLSA

SEQ ID NO: 3347995 - protein, 11 aa, Plasmodium falciparum
TNGQKTNSSNQ

SEQ ID NO: 3347996 - protein, 15 aa, Plasmodium falciparum
TNGQVEGQENEIKEK

SEQ ID NO: 3347997 - protein, 11 aa, Plasmodium falciparum
TNGSIKNTLNN

SEQ ID NO: 3347998 - protein, 10 aa, Plasmodium falciparum
TNGSNNNNME

SEQ ID NO: 3347999 - protein, 5 aa, Plasmodium falciparum
TNGTD

SEQ ID NO: 3348000 - protein, 8 aa, Plasmodium falciparum
TNGTYDNK

SEQ ID NO: 3348001 - protein, 6 aa, Plasmodium falciparum
TNGYQT

SEQ ID NO: 3348002 - protein, 7 aa, Plasmodium falciparum
TNHNGSL

SEQ ID NO: 3348003 - protein, 16 aa, Plasmodium falciparum
TNHNNKNNHNNNSNCN

SEQ ID NO: 3348004 - protein, 35 aa, Plasmodium falciparum
TNHNNNDNNNNNNDNNNNNYNNNNNNYNNNNNNDN

SEQ ID NO: 3348005 - protein, 4 aa, Plasmodium falciparum
TNHS

SEQ ID NO: 3348006 - protein, 9 aa, Plasmodium falciparum
TNIDSKSSL

SEQ ID NO: 3348007 - protein, 4 aa, Plasmodium falciparum
TNIE

SEQ ID NO: 3348008 - protein, 7 aa, Plasmodium falciparum
TNIEEDE

SEQ ID NO: 3348009 - protein, 14 aa, Plasmodium falciparum
TNIEKQYSLEKINI

SEQ ID NO: 3348010 - protein, 14 aa, Plasmodium falciparum
TNIENNNNNKKNKM

SEQ ID NO: 3348011 - protein, 11 aa, Plasmodium falciparum
TNIGNNNNNNY

SEQ ID NO: 3348012 - protein, 13 aa, Plasmodium falciparum
TNIGNTNNNINND

SEQ ID NO: 3348013 - protein, 5 aa, Plasmodium falciparum
TNIKN

SEQ ID NO: 3348014 - protein, 15 aa, Plasmodium falciparum
TNIKTKKKKKNQAYS

SEQ ID NO: 3348015 - protein, 4 aa, Plasmodium falciparum
TNIL

SEQ ID NO: 3348016 - protein, 24 aa, Plasmodium falciparum
TNINEDKNVEKNDDYKNLSNNENS

SEQ ID NO: 3348017 - protein, 9 aa, Plasmodium falciparum
TNINHQNED

SEQ ID NO: 3348018 - protein, 5 aa, Plasmodium falciparum
TNINN

SEQ ID NO: 3348019 - protein, 20 aa, Plasmodium falciparum
TNINRNENKKDDERTQHDEK

SEQ ID NO: 3348020 - protein, 8 aa, Plasmodium falciparum
TNINSRNI

SEQ ID NO: 3348021 - protein, 5 aa, Plasmodium falciparum
TNINT

SEQ ID NO: 3348022 - protein, 17 aa, Plasmodium falciparum
TNIQSCSENQIDNTKSV

SEQ ID NO: 3348023 - protein, 6 aa, Plasmodium falciparum
TNISEE

SEQ ID NO: 3348024 - protein, 14 aa, Plasmodium falciparum
TNISKKRNRNENNN

SEQ ID NO: 3348025 - protein, 6 aa, Plasmodium falciparum
TNISNE

SEQ ID NO: 3348026 - protein, 7 aa, Plasmodium falciparum
TNISNEI

SEQ ID NO: 3348027 - protein, 14 aa, Plasmodium falciparum
TNKAGQKFYDQAFC

SEQ ID NO: 3348028 - protein, 35 aa, Plasmodium falciparum
TNKDKNSNEKKKNKDKGKKKKKKNDNRNNISQTNL

SEQ ID NO: 3348029 - protein, 8 aa, Plasmodium falciparum
TNKDNTDL

SEQ ID NO: 3348030 - protein, 10 aa, Plasmodium falciparum
TNKDPKKSEI

SEQ ID NO: 3348031 - protein, 11 aa, Plasmodium falciparum
TNKEESSTLER

SEQ ID NO: 3348032 - protein, 9 aa, Plasmodium falciparum
TNKENDTNK

SEQ ID NO: 3348033 - protein, 8 aa, Plasmodium falciparum
TNKENEEK

SEQ ID NO: 3348034 - protein, 16 aa, Plasmodium falciparum
TNKENFPSKTSEYEKN

SEQ ID NO: 3348035 - protein, 5 aa, Plasmodium falciparum
TNKES

SEQ ID NO: 3348036 - protein, 7 aa, Plasmodium falciparum
TNKETSI

SEQ ID NO: 3348037 - protein, 4 aa, Plasmodium falciparum
TNKG

SEQ ID NO: 3348038 - protein, 4 aa, Plasmodium falciparum
TNKH

SEQ ID NO: 3348039 - protein, 6 aa, Plasmodium falciparum
TNKIPN

SEQ ID NO: 3348040 - protein, 4 aa, Plasmodium falciparum
TNKK

SEQ ID NO: 3348041 - protein, 9 aa, Plasmodium falciparum
TNKKEYSAQ

SEQ ID NO: 3348042 - protein, 9 aa, Plasmodium falciparum
TNKKEYSDY

SEQ ID NO: 3348043 - protein, 23 aa, Plasmodium falciparum
TNKKKEDETVSENKMSGDKENNI

SEQ ID NO: 3348044 - protein, 9 aa, Plasmodium falciparum
TNKKNDKPL

SEQ ID NO: 3348045 - protein, 34 aa, Plasmodium falciparum
TNKKNNMINSEDDIKTDQEYERDKRKKNKRKKNI

SEQ ID NO: 3348046 - protein, 10 aa, Plasmodium falciparum
TNKKNQDITQ

SEQ ID NO: 3348047 - protein, 9 aa, Plasmodium falciparum
TNKKNYNRN

SEQ ID NO: 3348048 - protein, 9 aa, Plasmodium falciparum
TNKKPTSYN

SEQ ID NO: 3348049 - protein, 5 aa, Plasmodium falciparum
TNKKS

SEQ ID NO: 3348050 - protein, 7 aa, Plasmodium falciparum
TNKLNDS

SEQ ID NO: 3348051 - protein, 9 aa, Plasmodium falciparum
TNKMKENRI

SEQ ID NO: 3348052 - protein, 8 aa, Plasmodium falciparum
TNKMNEKI

SEQ ID NO: 3348053 - protein, 10 aa, Plasmodium falciparum
TNKNDNEKKQ

SEQ ID NO: 3348054 - protein, 15 aa, Plasmodium falciparum
TNKNEYKDFDDPQQN

SEQ ID NO: 3348055 - protein, 18 aa, Plasmodium falciparum
TNKNGNNNNINSNSNNFD

SEQ ID NO: 3348056 - protein, 10 aa, Plasmodium falciparum
TNKNGQLDPN

SEQ ID NO: 3348057 - protein, 9 aa, Plasmodium falciparum
TNKNGTNII

SEQ ID NO: 3348058 - protein, 13 aa, Plasmodium falciparum
TNKNKEDKNNVKN

SEQ ID NO: 3348059 - protein, 8 aa, Plasmodium falciparum
TNKNKNDN

SEQ ID NO: 3348060 - protein, 9 aa, Plasmodium falciparum
TNKNKSKYI

SEQ ID NO: 3348061 - protein, 9 aa, Plasmodium falciparum
TNKNKVLSS

SEQ ID NO: 3348062 - protein, 16 aa, Plasmodium falciparum
TNKNMHTKKNKRKTIV

SEQ ID NO: 3348063 - protein, 8 aa, Plasmodium falciparum
TNKNNESL

SEQ ID NO: 3348064 - protein, 22 aa, Plasmodium falciparum
TNKNNGDSNNNNNNNNNNNDNI

SEQ ID NO: 3348065 - protein, 24 aa, Plasmodium falciparum
TNKNNKKQKDKKTIEENKDFNNEL

SEQ ID NO: 3348066 - protein, 12 aa, Plasmodium falciparum
TNKNNSEGTYQL

SEQ ID NO: 3348067 - protein, 8 aa, Plasmodium falciparum
TNKNNTNY

SEQ ID NO: 3348068 - protein, 31 aa, Plasmodium falciparum
TNKNQNDTLSTNRLTNNNKDNKLDETIENSS

SEQ ID NO: 3348069 - protein, 8 aa, Plasmodium falciparum
TNKNRYDD

SEQ ID NO: 3348070 - protein, 14 aa, Plasmodium falciparum
TNKNSDIQNEKDSY

SEQ ID NO: 3348071 - protein, 27 aa, Plasmodium falciparum
TNKNSLPNYTKDKQNVDITEPKTQHIN

SEQ ID NO: 3348072 - protein, 9 aa, Plasmodium falciparum
TNKNSTLNP

SEQ ID NO: 3348073 - protein, 6 aa, Plasmodium falciparum
TNKNTK

SEQ ID NO: 3348074 - protein, 7 aa, Plasmodium falciparum
TNKNYGS

SEQ ID NO: 3348075 - protein, 11 aa, Plasmodium falciparum
TNKPDEQNNEN

SEQ ID NO: 3348076 - protein, 9 aa, Plasmodium falciparum
TNKQDTTNF

SEQ ID NO: 3348077 - protein, 6 aa, Plasmodium falciparum
TNKQEN

SEQ ID NO: 3348078 - protein, 5 aa, Plasmodium falciparum
TNKRK

SEQ ID NO: 3348079 - protein, 12 aa, Plasmodium falciparum
TNKRKNENSTIT

SEQ ID NO: 3348080 - protein, 9 aa, Plasmodium falciparum
TNKRKTLEK

SEQ ID NO: 3348081 - protein, 4 aa, Plasmodium falciparum
TNKS

SEQ ID NO: 3348082 - protein, 9 aa, Plasmodium falciparum
TNKSANVEN

SEQ ID NO: 3348083 - protein, 5 aa, Plasmodium falciparum
TNKSE

SEQ ID NO: 3348084 - protein, 19 aa, Plasmodium falciparum
TNKSENNRFKTNKEKEKKK

SEQ ID NO: 3348085 - protein, 5 aa, Plasmodium falciparum
TNKSL

SEQ ID NO: 3348086 - protein, 9 aa, Plasmodium falciparum
TNKSPTELT

SEQ ID NO: 3348087 - protein, 10 aa, Plasmodium falciparum
TNKSRLSTKS

SEQ ID NO: 3348088 - protein, 8 aa, Plasmodium falciparum
TNKTNNDL

SEQ ID NO: 3348089 - protein, 5 aa, Plasmodium falciparum
TNKYI

SEQ ID NO: 3348090 - protein, 7 aa, Plasmodium falciparum
TNKYNSS

SEQ ID NO: 3348091 - protein, 6 aa, Plasmodium falciparum
TNKYQN

SEQ ID NO: 3348092 - protein, 5 aa, Plasmodium falciparum
TNKYR

SEQ ID NO: 3348093 - protein, 7 aa, Plasmodium falciparum
TNKYRNN

SEQ ID NO: 3348094 - protein, 9 aa, Plasmodium falciparum
TNLEEEQSY

SEQ ID NO: 3348095 - protein, 6 aa, Plasmodium falciparum
TNLERE

SEQ ID NO: 3348096 - protein, 4 aa, Plasmodium falciparum
TNLN

SEQ ID NO: 3348097 - protein, 5 aa, Plasmodium falciparum
TNLNN

SEQ ID NO: 3348098 - protein, 8 aa, Plasmodium falciparum
TNLQENDK

SEQ ID NO: 3348099 - protein, 4 aa, Plasmodium falciparum
TNME

SEQ ID NO: 3348100 - protein, 6 aa, Plasmodium falciparum
TNMETY

SEQ ID NO: 3348101 - protein, 10 aa, Plasmodium falciparum
TNMKEDNAES

SEQ ID NO: 3348102 - protein, 5 aa, Plasmodium falciparum
TNMPN

SEQ ID NO: 3348103 - protein, 5 aa, Plasmodium falciparum
TNNAN

SEQ ID NO: 3348104 - protein, 5 aa, Plasmodium falciparum
TNNAQ

SEQ ID NO: 3348105 - protein, 9 aa, Plasmodium falciparum
TNNATDENC

SEQ ID NO: 3348106 - protein, 7 aa, Plasmodium falciparum
TNNCTYS

SEQ ID NO: 3348107 - protein, 20 aa, Plasmodium falciparum
TNNDEYSNEISNKSDKKFSY

SEQ ID NO: 3348108 - protein, 13 aa, Plasmodium falciparum
TNNDIREKKKKNE

SEQ ID NO: 3348109 - protein, 5 aa, Plasmodium falciparum
TNNDN

SEQ ID NO: 3348110 - protein, 9 aa, Plasmodium falciparum
TNNDNDKDI

SEQ ID NO: 3348111 - protein, 41 aa, Plasmodium falciparum
TNNDNDNNNNDNNNDNNNDNNNDNNNNNNNNNNNNDNNNND

SEQ ID NO: 3348112 - protein, 8 aa, Plasmodium falciparum
TNNDNEKK

SEQ ID NO: 3348113 - protein, 18 aa, Plasmodium falciparum
TNNDNINNNINEKKSSNI

SEQ ID NO: 3348114 - protein, 17 aa, Plasmodium falciparum
TNNDNNNDNNNDNNNNN

SEQ ID NO: 3348115 - protein, 6 aa, Plasmodium falciparum
TNNDSI

SEQ ID NO: 3348116 - protein, 16 aa, Plasmodium falciparum
TNNDTQTKDQDIANET

SEQ ID NO: 3348117 - protein, 6 aa, Plasmodium falciparum
TNNDTY

SEQ ID NO: 3348118 - protein, 4 aa, Plasmodium falciparum
TNNE

SEQ ID NO: 3348119 - protein, 15 aa, Plasmodium falciparum
TNNEHDEEDNHKNKS

SEQ ID NO: 3348120 - protein, 6 aa, Plasmodium falciparum
TNNEIN

SEQ ID NO: 3348121 - protein, 8 aa, Plasmodium falciparum
TNNEINKE

SEQ ID NO: 3348122 - protein, 7 aa, Plasmodium falciparum
TNNEKNK

SEQ ID NO: 3348123 - protein, 7 aa, Plasmodium falciparum
TNNEKQK

SEQ ID NO: 3348124 - protein, 7 aa, Plasmodium falciparum
TNNETRK

SEQ ID NO: 3348125 - protein, 4 aa, Plasmodium falciparum
TNNF

SEQ ID NO: 3348126 - protein, 49 aa, Plasmodium falciparum
TNNFDSTNNFDSTNNFDSTNNFDSTNNFDSTNNFNNRNNFNNRNNFNNR

SEQ ID NO: 3348127 - protein, 5 aa, Plasmodium falciparum
TNNFN

SEQ ID NO: 3348128 - protein, 10 aa, Plasmodium falciparum
TNNGKKKNPH

SEQ ID NO: 3348129 - protein, 9 aa, Plasmodium falciparum
TNNGNNGYV

SEQ ID NO: 3348130 - protein, 10 aa, Plasmodium falciparum
TNNHNNSNNS

SEQ ID NO: 3348131 - protein, 4 aa, Plasmodium falciparum
TNNI

SEQ ID NO: 3348132 - protein, 20 aa, Plasmodium falciparum
TNNIANDNNDKGKRFNNEDN

SEQ ID NO: 3348133 - protein, 16 aa, Plasmodium falciparum
TNNIEDDTINTTTNYN

SEQ ID NO: 3348134 - protein, 15 aa, Plasmodium falciparum
TNNIKDETSNKMNSN

SEQ ID NO: 3348135 - protein, 5 aa, Plasmodium falciparum
TNNIN

SEQ ID NO: 3348136 - protein, 11 aa, Plasmodium falciparum
TNNINNNDNYD

SEQ ID NO: 3348137 - protein, 11 aa, Plasmodium falciparum
TNNINNNNKST

SEQ ID NO: 3348138 - protein, 4 aa, Plasmodium falciparum
TNNK

SEQ ID NO: 3348139 - protein, 9 aa, Plasmodium falciparum
TNNKGHKNN

SEQ ID NO: 3348140 - protein, 6 aa, Plasmodium falciparum
TNNKKD

SEQ ID NO: 3348141 - protein, 24 aa, Plasmodium falciparum
TNNKNDKKIDYDDDDDDDNNNNNI

SEQ ID NO: 3348142 - protein, 9 aa, Plasmodium falciparum
TNNKNEGRK

SEQ ID NO: 3348143 - protein, 16 aa, Plasmodium falciparum
TNNKNINQNEKGKNTY

SEQ ID NO: 3348144 - protein, 6 aa, Plasmodium falciparum
TNNKNQ

SEQ ID NO: 3348145 - protein, 8 aa, Plasmodium falciparum
TNNKNSNT

SEQ ID NO: 3348146 - protein, 6 aa, Plasmodium falciparum
TNNKNV

SEQ ID NO: 3348147 - protein, 29 aa, Plasmodium falciparum
TNNKSSTTNSKTNSNSSSSRTKGKVNNTV

SEQ ID NO: 3348148 - protein, 4 aa, Plasmodium falciparum
TNNL

SEQ ID NO: 3348149 - protein, 6 aa, Plasmodium falciparum
TNNLTA

SEQ ID NO: 3348150 - protein, 6 aa, Plasmodium falciparum
TNNMDK

SEQ ID NO: 3348151 - protein, 7 aa, Plasmodium falciparum
TNNNDVV

SEQ ID NO: 3348152 - protein, 5 aa, Plasmodium falciparum
TNNNE

SEQ ID NO: 3348153 - protein, 13 aa, Plasmodium falciparum
TNNNENKLDEKEK

SEQ ID NO: 3348154 - protein, 8 aa, Plasmodium falciparum
TNNNGNVV

SEQ ID NO: 3348155 - protein, 17 aa, Plasmodium falciparum
TNNNGSSNNNKHNSNVY

SEQ ID NO: 3348156 - protein, 6 aa, Plasmodium falciparum
TNNNHK

SEQ ID NO: 3348157 - protein, 9 aa, Plasmodium falciparum
TNNNISEND

SEQ ID NO: 3348158 - protein, 5 aa, Plasmodium falciparum
TNNNK

SEQ ID NO: 3348159 - protein, 14 aa, Plasmodium falciparum
TNNNKRRTTSDKYG

SEQ ID NO: 3348160 - protein, 14 aa, Plasmodium falciparum
TNNNMEQNTNNNNM

SEQ ID NO: 3348161 - protein, 21 aa, Plasmodium falciparum
TNNNNDPYNRNSTNNNGIAEN

SEQ ID NO: 3348162 - protein, 18 aa, Plasmodium falciparum
TNNNNNINNNNNNNNNYH

SEQ ID NO: 3348163 - protein, 87 aa, Plasmodium falciparum
TNNNNNNNDNDSSNNNNNSNNNNNSNNSNNNINNNNSNNSNNNNNNNNNNNNNNNNNNNKNNNNNSNNNNNSYNNNNSNNNNNAQIT

SEQ ID NO: 3348164 - protein, 18 aa, Plasmodium falciparum
TNNNNNNNNNNNNNNNNI

SEQ ID NO: 3348165 - protein, 24 aa, Plasmodium falciparum
TNNNNNNNNNNNNNNNNNNNNNNK

SEQ ID NO: 3348166 - protein, 24 aa, Plasmodium falciparum
TNNNNNNNNNNNNNNNNNNNNNNN

SEQ ID NO: 3348167 - protein, 36 aa, Plasmodium falciparum
TNNNNNNNNNNNSGEKNKKNKKNKNNNNNNNIDNTE

SEQ ID NO: 3348168 - protein, 10 aa, Plasmodium falciparum
TNNNNNNNNV

SEQ ID NO: 3348169 - protein, 32 aa, Plasmodium falciparum
TNNNNNSNNNNNNNNSNNNNNSNNNNNSNNNN

SEQ ID NO: 3348170 - protein, 14 aa, Plasmodium falciparum
TNNNNRSEKNNSAI

SEQ ID NO: 3348171 - protein, 17 aa, Plasmodium falciparum
TNNNNSVYDKETKCDEH

SEQ ID NO: 3348172 - protein, 13 aa, Plasmodium falciparum
TNNNNYDNKKNKV

SEQ ID NO: 3348173 - protein, 8 aa, Plasmodium falciparum
TNNNNYNP

SEQ ID NO: 3348174 - protein, 7 aa, Plasmodium falciparum
TNNNQKN

SEQ ID NO: 3348175 - protein, 9 aa, Plasmodium falciparum
TNNNSSSNH

SEQ ID NO: 3348176 - protein, 19 aa, Plasmodium falciparum
TNNNTGTNSKNERKKKKSF

SEQ ID NO: 3348177 - protein, 16 aa, Plasmodium falciparum
TNNNTSPKSSNEKNKI

SEQ ID NO: 3348178 - protein, 15 aa, Plasmodium falciparum
TNNNTTTDNNNNNIN

SEQ ID NO: 3348179 - protein, 8 aa, Plasmodium falciparum
TNNNVGNI

SEQ ID NO: 3348180 - protein, 7 aa, Plasmodium falciparum
TNNPMKN

SEQ ID NO: 3348181 - protein, 6 aa, Plasmodium falciparum
TNNQDM

SEQ ID NO: 3348182 - protein, 10 aa, Plasmodium falciparum
TNNQDNSSTV

SEQ ID NO: 3348183 - protein, 10 aa, Plasmodium falciparum
TNNQISNTYE

SEQ ID NO: 3348184 - protein, 18 aa, Plasmodium falciparum
TNNQKNNTLYNQTTGCDN

SEQ ID NO: 3348185 - protein, 11 aa, Plasmodium falciparum
TNNQKSDFNNA

SEQ ID NO: 3348186 - protein, 7 aa, Plasmodium falciparum
TNNQNKN

SEQ ID NO: 3348187 - protein, 22 aa, Plasmodium falciparum
TNNQSKDMPSPPKKKNNDKLTN

SEQ ID NO: 3348188 - protein, 25 aa, Plasmodium falciparum
TNNSDVKKETKGIEEKNFNKEDPRD

SEQ ID NO: 3348189 - protein, 10 aa, Plasmodium falciparum
TNNSGDQNEY

SEQ ID NO: 3348190 - protein, 10 aa, Plasmodium falciparum
TNNSKNDHNE

SEQ ID NO: 3348191 - protein, 11 aa, Plasmodium falciparum
TNNSNDDKYGD

SEQ ID NO: 3348192 - protein, 16 aa, Plasmodium falciparum
TNNSNINNNNNNNNCS

SEQ ID NO: 3348193 - protein, 9 aa, Plasmodium falciparum
TNNSNINTT

SEQ ID NO: 3348194 - protein, 16 aa, Plasmodium falciparum
TNNSNKNDKNMLSKCL

SEQ ID NO: 3348195 - protein, 15 aa, Plasmodium falciparum
TNNSNNNNNNHNNNR

SEQ ID NO: 3348196 - protein, 31 aa, Plasmodium falciparum
TNNSNTNEVSKHGKKSKKKSLHDAKKNLKKK

SEQ ID NO: 3348197 - protein, 9 aa, Plasmodium falciparum
TNNSSENLR

SEQ ID NO: 3348198 - protein, 10 aa, Plasmodium falciparum
TNNSSNDLGY

SEQ ID NO: 3348199 - protein, 48 aa, Plasmodium falciparum
TNNSSNNINNNNNNNNNDINNNSTNDINNNGTNDTNNKKDPKGIPNNS

SEQ ID NO: 3348200 - protein, 8 aa, Plasmodium falciparum
TNNSTYKN

SEQ ID NO: 3348201 - protein, 5 aa, Plasmodium falciparum
TNNTN

SEQ ID NO: 3348202 - protein, 11 aa, Plasmodium falciparum
TNNTYNNSNTN

SEQ ID NO: 3348203 - protein, 4 aa, Plasmodium falciparum
TNNV

SEQ ID NO: 3348204 - protein, 9 aa, Plasmodium falciparum
TNNVNSGAS

SEQ ID NO: 3348205 - protein, 5 aa, Plasmodium falciparum
TNNYN

SEQ ID NO: 3348206 - protein, 7 aa, Plasmodium falciparum
TNPNEHS

SEQ ID NO: 3348207 - protein, 6 aa, Plasmodium falciparum
TNPNIN

SEQ ID NO: 3348208 - protein, 4 aa, Plasmodium falciparum
TNPS

SEQ ID NO: 3348209 - protein, 6 aa, Plasmodium falciparum
TNPVTE

SEQ ID NO: 3348210 - protein, 7 aa, Plasmodium falciparum
TNPYEHK

SEQ ID NO: 3348211 - protein, 5 aa, Plasmodium falciparum
TNQDD

SEQ ID NO: 3348212 - protein, 13 aa, Plasmodium falciparum
TNQEENQNVEKKK

SEQ ID NO: 3348213 - protein, 5 aa, Plasmodium falciparum
TNQGP

SEQ ID NO: 3348214 - protein, 13 aa, Plasmodium falciparum
TNQHSDSNKNTNN

SEQ ID NO: 3348215 - protein, 5 aa, Plasmodium falciparum
TNQKE

SEQ ID NO: 3348216 - protein, 11 aa, Plasmodium falciparum
TNQKEQQNNLE

SEQ ID NO: 3348217 - protein, 5 aa, Plasmodium falciparum
TNQKV

SEQ ID NO: 3348218 - protein, 7 aa, Plasmodium falciparum
TNQNENS

SEQ ID NO: 3348219 - protein, 7 aa, Plasmodium falciparum
TNQNNND

SEQ ID NO: 3348220 - protein, 7 aa, Plasmodium falciparum
TNQNNNV

SEQ ID NO: 3348221 - protein, 6 aa, Plasmodium falciparum
TNQNSI

SEQ ID NO: 3348222 - protein, 4 aa, Plasmodium falciparum
TNQP

SEQ ID NO: 3348223 - protein, 12 aa, Plasmodium falciparum
TNQQKQNRMNNQ

SEQ ID NO: 3348224 - protein, 9 aa, Plasmodium falciparum
TNQTENYYT

SEQ ID NO: 3348225 - protein, 11 aa, Plasmodium falciparum
TNQTKNIQNDF

SEQ ID NO: 3348226 - protein, 7 aa, Plasmodium falciparum
TNQTNPH

SEQ ID NO: 3348227 - protein, 6 aa, Plasmodium falciparum
TNQTQN

SEQ ID NO: 3348228 - protein, 15 aa, Plasmodium falciparum
TNQTVPPQLKEIAYS

SEQ ID NO: 3348229 - protein, 9 aa, Plasmodium falciparum
TNRADKKRY

SEQ ID NO: 3348230 - protein, 4 aa, Plasmodium falciparum
TNRI

SEQ ID NO: 3348231 - protein, 19 aa, Plasmodium falciparum
TNRKKQSNGNMDLPENNKN

SEQ ID NO: 3348232 - protein, 46 aa, Plasmodium falciparum
TNRKSIKRESFEEKKMNESPTKKKKKRKDDIESDNKCDKDEKYDKY

SEQ ID NO: 3348233 - protein, 15 aa, Plasmodium falciparum
TNRNKEEENKIDKNI

SEQ ID NO: 3348234 - protein, 6 aa, Plasmodium falciparum
TNRNNS

SEQ ID NO: 3348235 - protein, 11 aa, Plasmodium falciparum
TNRNNSNNNNN

SEQ ID NO: 3348236 - protein, 8 aa, Plasmodium falciparum
TNRPDTLD

SEQ ID NO: 3348237 - protein, 25 aa, Plasmodium falciparum
TNRPISSNRRRGRNEITDEQKNEIK

SEQ ID NO: 3348238 - protein, 5 aa, Plasmodium falciparum
TNRPR

SEQ ID NO: 3348239 - protein, 5 aa, Plasmodium falciparum
TNRRY

SEQ ID NO: 3348240 - protein, 10 aa, Plasmodium falciparum
TNRSYSSDNI

SEQ ID NO: 3348241 - protein, 9 aa, Plasmodium falciparum
TNSEHTLNN

SEQ ID NO: 3348242 - protein, 15 aa, Plasmodium falciparum
TNSFNKNDNNSTQEE

SEQ ID NO: 3348243 - protein, 9 aa, Plasmodium falciparum
TNSFNQNNF

SEQ ID NO: 3348244 - protein, 7 aa, Plasmodium falciparum
TNSFPNQ

SEQ ID NO: 3348245 - protein, 17 aa, Plasmodium falciparum
TNSGSCKKGNDTSHNNN

SEQ ID NO: 3348246 - protein, 4 aa, Plasmodium falciparum
TNSK

SEQ ID NO: 3348247 - protein, 8 aa, Plasmodium falciparum
TNSKDEEG

SEQ ID NO: 3348248 - protein, 8 aa, Plasmodium falciparum
TNSKDNLL

SEQ ID NO: 3348249 - protein, 10 aa, Plasmodium falciparum
TNSKESESNM

SEQ ID NO: 3348250 - protein, 19 aa, Plasmodium falciparum
TNSKYNPLNSKENNSMKKE

SEQ ID NO: 3348251 - protein, 12 aa, Plasmodium falciparum
TNSLNNNNNNNI

SEQ ID NO: 3348252 - protein, 7 aa, Plasmodium falciparum
TNSLTDK

SEQ ID NO: 3348253 - protein, 4 aa, Plasmodium falciparum
TNSM

SEQ ID NO: 3348254 - protein, 10 aa, Plasmodium falciparum
TNSMDDPKYV

SEQ ID NO: 3348255 - protein, 8 aa, Plasmodium falciparum
TNSNDRKV

SEQ ID NO: 3348256 - protein, 16 aa, Plasmodium falciparum
TNSNDYSDKNKNNNNN

SEQ ID NO: 3348257 - protein, 12 aa, Plasmodium falciparum
TNSNNGNVKNRG

SEQ ID NO: 3348258 - protein, 62 aa, Plasmodium falciparum
TNSNNNNNNNNINNNNNNINNINNNNNNINNNNNNNNNINNINNNNNNINNNNNNNNSQRKY

SEQ ID NO: 3348259 - protein, 12 aa, Plasmodium falciparum
TNSNNNNVASKN

SEQ ID NO: 3348260 - protein, 5 aa, Plasmodium falciparum
TNSQS

SEQ ID NO: 3348261 - protein, 9 aa, Plasmodium falciparum
TNSRYSNSH

SEQ ID NO: 3348262 - protein, 4 aa, Plasmodium falciparum
TNSS

SEQ ID NO: 3348263 - protein, 9 aa, Plasmodium falciparum
TNSSDEFQR

SEQ ID NO: 3348264 - protein, 18 aa, Plasmodium falciparum
TNSSELHANDEADHIGTD

SEQ ID NO: 3348265 - protein, 5 aa, Plasmodium falciparum
TNSSF

SEQ ID NO: 3348266 - protein, 10 aa, Plasmodium falciparum
TNSSHNPKEL

SEQ ID NO: 3348267 - protein, 27 aa, Plasmodium falciparum
TNSTNDKEAFNDPNDNQLKKNDNNNQC

SEQ ID NO: 3348268 - protein, 7 aa, Plasmodium falciparum
TNSTNYD

SEQ ID NO: 3348269 - protein, 5 aa, Plasmodium falciparum
TNSTQ

SEQ ID NO: 3348270 - protein, 6 aa, Plasmodium falciparum
TNSTTY

SEQ ID NO: 3348271 - protein, 13 aa, Plasmodium falciparum
TNSVSSLNNKASS

SEQ ID NO: 3348272 - protein, 8 aa, Plasmodium falciparum
TNSVTSSL

SEQ ID NO: 3348273 - protein, 4 aa, Plasmodium falciparum
TNTA

SEQ ID NO: 3348274 - protein, 5 aa, Plasmodium falciparum
TNTDF

SEQ ID NO: 3348275 - protein, 18 aa, Plasmodium falciparum
TNTGRRYNTRRGSTLSSH

SEQ ID NO: 3348276 - protein, 5 aa, Plasmodium falciparum
TNTHD

SEQ ID NO: 3348277 - protein, 11 aa, Plasmodium falciparum
TNTKKNDNINN

SEQ ID NO: 3348278 - protein, 5 aa, Plasmodium falciparum
TNTLE

SEQ ID NO: 3348279 - protein, 16 aa, Plasmodium falciparum
TNTLPSNASQKPIQIN

SEQ ID NO: 3348280 - protein, 14 aa, Plasmodium falciparum
TNTNDNKENSNDLQ

SEQ ID NO: 3348281 - protein, 18 aa, Plasmodium falciparum
TNTNINTHSNTHSNNNTT

SEQ ID NO: 3348282 - protein, 6 aa, Plasmodium falciparum
TNTNNN

SEQ ID NO: 3348283 - protein, 10 aa, Plasmodium falciparum
TNTNPKKGPL

SEQ ID NO: 3348284 - protein, 9 aa, Plasmodium falciparum
TNTNSEQLD

SEQ ID NO: 3348285 - protein, 11 aa, Plasmodium falciparum
TNTNSYNSHSN

SEQ ID NO: 3348286 - protein, 29 aa, Plasmodium falciparum
TNTNTNTNTNKIEKENVAGNNDEEDPNDG

SEQ ID NO: 3348287 - protein, 10 aa, Plasmodium falciparum
TNTQNKQKTH

SEQ ID NO: 3348288 - protein, 6 aa, Plasmodium falciparum
TNTQPR

SEQ ID NO: 3348289 - protein, 7 aa, Plasmodium falciparum
TNTQTKK

SEQ ID NO: 3348290 - protein, 14 aa, Plasmodium falciparum
TNTSSSSYNQGSSF

SEQ ID NO: 3348291 - protein, 4 aa, Plasmodium falciparum
TNTT

SEQ ID NO: 3348292 - protein, 21 aa, Plasmodium falciparum
TNTTASTTNATATATPAPFGS

SEQ ID NO: 3348293 - protein, 7 aa, Plasmodium falciparum
TNTTDTH

SEQ ID NO: 3348294 - protein, 5 aa, Plasmodium falciparum
TNTTN

SEQ ID NO: 3348295 - protein, 8 aa, Plasmodium falciparum
TNTTNPYR

SEQ ID NO: 3348296 - protein, 19 aa, Plasmodium falciparum
TNTTTTTTSSNNNNNDDDQ

SEQ ID NO: 3348297 - protein, 8 aa, Plasmodium falciparum
TNTYDNNN

SEQ ID NO: 3348298 - protein, 4 aa, Plasmodium falciparum
TNVD

SEQ ID NO: 3348299 - protein, 12 aa, Plasmodium falciparum
TNVDKDKNKDFE

SEQ ID NO: 3348300 - protein, 6 aa, Plasmodium falciparum
TNVDTP

SEQ ID NO: 3348301 - protein, 7 aa, Plasmodium falciparum
TNVETPQ

SEQ ID NO: 3348302 - protein, 4 aa, Plasmodium falciparum
TNVG

SEQ ID NO: 3348303 - protein, 10 aa, Plasmodium falciparum
TNVGNENSND

SEQ ID NO: 3348304 - protein, 9 aa, Plasmodium falciparum
TNVHNKTTS

SEQ ID NO: 3348305 - protein, 4 aa, Plasmodium falciparum
TNVL

SEQ ID NO: 3348306 - protein, 5 aa, Plasmodium falciparum
TNVNE

SEQ ID NO: 3348307 - protein, 10 aa, Plasmodium falciparum
TNVNIKEDNL

SEQ ID NO: 3348308 - protein, 20 aa, Plasmodium falciparum
TNVNNTYSKNSETSQSTQLT

SEQ ID NO: 3348309 - protein, 13 aa, Plasmodium falciparum
TNVQDNEAGGITQ

SEQ ID NO: 3348310 - protein, 6 aa, Plasmodium falciparum
TNVQNT

SEQ ID NO: 3348311 - protein, 6 aa, Plasmodium falciparum
TNVSEE

SEQ ID NO: 3348312 - protein, 7 aa, Plasmodium falciparum
TNVSSDD

SEQ ID NO: 3348313 - protein, 14 aa, Plasmodium falciparum
TNVTDNRPPEERYA

SEQ ID NO: 3348314 - protein, 8 aa, Plasmodium falciparum
TNVTGESE

SEQ ID NO: 3348315 - protein, 37 aa, Plasmodium falciparum
TNVYNNKKENNNNNNNNDDNNNDNNDDNNNNDNNNNN

SEQ ID NO: 3348316 - protein, 7 aa, Plasmodium falciparum
TNWGDKN

SEQ ID NO: 3348317 - protein, 8 aa, Plasmodium falciparum
TNYDEEQL

SEQ ID NO: 3348318 - protein, 5 aa, Plasmodium falciparum
TNYDQ

SEQ ID NO: 3348319 - protein, 5 aa, Plasmodium falciparum
TNYDS

SEQ ID NO: 3348320 - protein, 11 aa, Plasmodium falciparum
TNYEKKDKKLT

SEQ ID NO: 3348321 - protein, 5 aa, Plasmodium falciparum
TNYGE

SEQ ID NO: 3348322 - protein, 26 aa, Plasmodium falciparum
TNYKHNDNLDQTTKDGYSKNQDKQIK

SEQ ID NO: 3348323 - protein, 9 aa, Plasmodium falciparum
TNYKNPTYN

SEQ ID NO: 3348324 - protein, 4 aa, Plasmodium falciparum
TNYN

SEQ ID NO: 3348325 - protein, 7 aa, Plasmodium falciparum
TNYNDSQ

SEQ ID NO: 3348326 - protein, 6 aa, Plasmodium falciparum
TNYNRN

SEQ ID NO: 3348327 - protein, 11 aa, Plasmodium falciparum
TNYSTSNKEPF

SEQ ID NO: 3348328 - protein, 7 aa, Plasmodium falciparum
TPAAVAA

SEQ ID NO: 3348329 - protein, 8 aa, Plasmodium falciparum
TPAGGKDV

SEQ ID NO: 3348330 - protein, 9 aa, Plasmodium falciparum
TPAHDKNDY

SEQ ID NO: 3348331 - protein, 10 aa, Plasmodium falciparum
TPALNKPSEL

SEQ ID NO: 3348332 - protein, 4 aa, Plasmodium falciparum
TPAN

SEQ ID NO: 3348333 - protein, 14 aa, Plasmodium falciparum
TPAQPQLTPAQPYS

SEQ ID NO: 3348334 - protein, 6 aa, Plasmodium falciparum
TPDECN

SEQ ID NO: 3348335 - protein, 7 aa, Plasmodium falciparum
TPDGNKD

SEQ ID NO: 3348336 - protein, 9 aa, Plasmodium falciparum
TPDHADYDS

SEQ ID NO: 3348337 - protein, 4 aa, Plasmodium falciparum
TPDK

SEQ ID NO: 3348338 - protein, 9 aa, Plasmodium falciparum
TPDKANTMS

SEQ ID NO: 3348339 - protein, 14 aa, Plasmodium falciparum
TPDKKKKNEVKNNH

SEQ ID NO: 3348340 - protein, 7 aa, Plasmodium falciparum
TPDPTKP

SEQ ID NO: 3348341 - protein, 17 aa, Plasmodium falciparum
TPDSRNSIKNKATIPYF

SEQ ID NO: 3348342 - protein, 5 aa, Plasmodium falciparum
TPDYP

SEQ ID NO: 3348343 - protein, 6 aa, Plasmodium falciparum
TPEEAK

SEQ ID NO: 3348344 - protein, 7 aa, Plasmodium falciparum
TPEERNK

SEQ ID NO: 3348345 - protein, 6 aa, Plasmodium falciparum
TPEGQS

SEQ ID NO: 3348346 - protein, 7 aa, Plasmodium falciparum
TPEKNEE

SEQ ID NO: 3348347 - protein, 5 aa, Plasmodium falciparum
TPEKP

SEQ ID NO: 3348348 - protein, 20 aa, Plasmodium falciparum
TPENDAENNDINNDKNNSDL

SEQ ID NO: 3348349 - protein, 16 aa, Plasmodium falciparum
TPESKSTDNQKEEVEK

SEQ ID NO: 3348350 - protein, 10 aa, Plasmodium falciparum
TPEYGRGRRT

SEQ ID NO: 3348351 - protein, 5 aa, Plasmodium falciparum
TPFAE

SEQ ID NO: 3348352 - protein, 10 aa, Plasmodium falciparum
TPGHSDFGGE

SEQ ID NO: 3348353 - protein, 5 aa, Plasmodium falciparum
TPGKT

SEQ ID NO: 3348354 - protein, 6 aa, Plasmodium falciparum
TPGLKT

SEQ ID NO: 3348355 - protein, 6 aa, Plasmodium falciparum
TPGRGE

SEQ ID NO: 3348356 - protein, 4 aa, Plasmodium falciparum
TPGT

SEQ ID NO: 3348357 - protein, 10 aa, Plasmodium falciparum
TPHETRRRSD

SEQ ID NO: 3348358 - protein, 5 aa, Plasmodium falciparum
TPHPY

SEQ ID NO: 3348359 - protein, 16 aa, Plasmodium falciparum
TPHRTEEDNFKENNNY

SEQ ID NO: 3348360 - protein, 4 aa, Plasmodium falciparum
TPHS

SEQ ID NO: 3348361 - protein, 11 aa, Plasmodium falciparum
TPIEKVPNKTI

SEQ ID NO: 3348362 - protein, 6 aa, Plasmodium falciparum
TPIETV

SEQ ID NO: 3348363 - protein, 10 aa, Plasmodium falciparum
TPINDDSQNN

SEQ ID NO: 3348364 - protein, 15 aa, Plasmodium falciparum
TPINKTEEVKKEYKN

SEQ ID NO: 3348365 - protein, 18 aa, Plasmodium falciparum
TPIPTDSTRKKSGRRGRR

SEQ ID NO: 3348366 - protein, 5 aa, Plasmodium falciparum
TPIQN

SEQ ID NO: 3348367 - protein, 7 aa, Plasmodium falciparum
TPISDGT

SEQ ID NO: 3348368 - protein, 27 aa, Plasmodium falciparum
TPKDDEENINSKRKKKTGKMNNEENKN

SEQ ID NO: 3348369 - protein, 21 aa, Plasmodium falciparum
TPKELEQRNKESIGPKDKAIK

SEQ ID NO: 3348370 - protein, 5 aa, Plasmodium falciparum
TPKEV

SEQ ID NO: 3348371 - protein, 4 aa, Plasmodium falciparum
TPKG

SEQ ID NO: 3348372 - protein, 8 aa, Plasmodium falciparum
TPKGNKQQ

SEQ ID NO: 3348373 - protein, 4 aa, Plasmodium falciparum
TPKK

SEQ ID NO: 3348374 - protein, 4 aa, Plasmodium falciparum
TPKN

SEQ ID NO: 3348375 - protein, 8 aa, Plasmodium falciparum
TPKNKEEC

SEQ ID NO: 3348376 - protein, 14 aa, Plasmodium falciparum
TPKQISKYKKEQNY

SEQ ID NO: 3348377 - protein, 5 aa, Plasmodium falciparum
TPKRC

SEQ ID NO: 3348378 - protein, 5 aa, Plasmodium falciparum
TPKSR

SEQ ID NO: 3348379 - protein, 7 aa, Plasmodium falciparum
TPKTKEG

SEQ ID NO: 3348380 - protein, 5 aa, Plasmodium falciparum
TPKYN

SEQ ID NO: 3348381 - protein, 4 aa, Plasmodium falciparum
TPLE

SEQ ID NO: 3348382 - protein, 17 aa, Plasmodium falciparum
TPLESKMKTSAPIQRGK

SEQ ID NO: 3348383 - protein, 14 aa, Plasmodium falciparum
TPLGREGKMAKPRQ

SEQ ID NO: 3348384 - protein, 8 aa, Plasmodium falciparum
TPLNNNDN

SEQ ID NO: 3348385 - protein, 5 aa, Plasmodium falciparum
TPLNS

SEQ ID NO: 3348386 - protein, 7 aa, Plasmodium falciparum
TPLQNNS

SEQ ID NO: 3348387 - protein, 4 aa, Plasmodium falciparum
TPLS

SEQ ID NO: 3348388 - protein, 8 aa, Plasmodium falciparum
TPLTKGGI

SEQ ID NO: 3348389 - protein, 5 aa, Plasmodium falciparum
TPMDT

SEQ ID NO: 3348390 - protein, 5 aa, Plasmodium falciparum
TPNDE

SEQ ID NO: 3348391 - protein, 4 aa, Plasmodium falciparum
TPNG

SEQ ID NO: 3348392 - protein, 11 aa, Plasmodium falciparum
TPNIGGENTYV

SEQ ID NO: 3348393 - protein, 4 aa, Plasmodium falciparum
TPNK

SEQ ID NO: 3348394 - protein, 5 aa, Plasmodium falciparum
TPNKI

SEQ ID NO: 3348395 - protein, 5 aa, Plasmodium falciparum
TPNNG

SEQ ID NO: 3348396 - protein, 10 aa, Plasmodium falciparum
TPNNNGEDTD

SEQ ID NO: 3348397 - protein, 7 aa, Plasmodium falciparum
TPNRSEE

SEQ ID NO: 3348398 - protein, 6 aa, Plasmodium falciparum
TPNRYD

SEQ ID NO: 3348399 - protein, 35 aa, Plasmodium falciparum
TPNRYQQGNNINTNPNVAQRNENNYYGKNNDAPYD

SEQ ID NO: 3348400 - protein, 9 aa, Plasmodium falciparum
TPNSKNWPN

SEQ ID NO: 3348401 - protein, 7 aa, Plasmodium falciparum
TPNYGDE

SEQ ID NO: 3348402 - protein, 6 aa, Plasmodium falciparum
TPPDGT

SEQ ID NO: 3348403 - protein, 6 aa, Plasmodium falciparum
TPPEED

SEQ ID NO: 3348404 - protein, 9 aa, Plasmodium falciparum
TPPEELRSN

SEQ ID NO: 3348405 - protein, 6 aa, Plasmodium falciparum
TPPMDE

SEQ ID NO: 3348406 - protein, 15 aa, Plasmodium falciparum
TPPMPSNQLNNTRSS

SEQ ID NO: 3348407 - protein, 14 aa, Plasmodium falciparum
TPPPPSGQPPTGIQ

SEQ ID NO: 3348408 - protein, 5 aa, Plasmodium falciparum
TPPYC

SEQ ID NO: 3348409 - protein, 6 aa, Plasmodium falciparum
TPQDIS

SEQ ID NO: 3348410 - protein, 8 aa, Plasmodium falciparum
TPQEEQDV

SEQ ID NO: 3348411 - protein, 5 aa, Plasmodium falciparum
TPQGF

SEQ ID NO: 3348412 - protein, 5 aa, Plasmodium falciparum
TPQGV

SEQ ID NO: 3348413 - protein, 4 aa, Plasmodium falciparum
TPQN

SEQ ID NO: 3348414 - protein, 7 aa, Plasmodium falciparum
TPQNDEE

SEQ ID NO: 3348415 - protein, 5 aa, Plasmodium falciparum
TPQNY

SEQ ID NO: 3348416 - protein, 15 aa, Plasmodium falciparum
TPQQITKEEDIKNAK

SEQ ID NO: 3348417 - protein, 4 aa, Plasmodium falciparum
TPRA

SEQ ID NO: 3348418 - protein, 9 aa, Plasmodium falciparum
TPRALNPKH

SEQ ID NO: 3348419 - protein, 4 aa, Plasmodium falciparum
TPRD

SEQ ID NO: 3348420 - protein, 4 aa, Plasmodium falciparum
TPRG

SEQ ID NO: 3348421 - protein, 9 aa, Plasmodium falciparum
TPRHSDDEP

SEQ ID NO: 3348422 - protein, 5 aa, Plasmodium falciparum
TPRNN

SEQ ID NO: 3348423 - protein, 5 aa, Plasmodium falciparum
TPSDE

SEQ ID NO: 3348424 - protein, 18 aa, Plasmodium falciparum
TPSDNIYNNNEKHTKELY

SEQ ID NO: 3348425 - protein, 4 aa, Plasmodium falciparum
TPSE

SEQ ID NO: 3348426 - protein, 5 aa, Plasmodium falciparum
TPSKE

SEQ ID NO: 3348427 - protein, 8 aa, Plasmodium falciparum
TPSKEVAE

SEQ ID NO: 3348428 - protein, 4 aa, Plasmodium falciparum
TPSL

SEQ ID NO: 3348429 - protein, 14 aa, Plasmodium falciparum
TPSNDNKKEENTIE

SEQ ID NO: 3348430 - protein, 6 aa, Plasmodium falciparum
TPSNHN

SEQ ID NO: 3348431 - protein, 5 aa, Plasmodium falciparum
TPSWE

SEQ ID NO: 3348432 - protein, 7 aa, Plasmodium falciparum
TPTEDQL

SEQ ID NO: 3348433 - protein, 15 aa, Plasmodium falciparum
TPTEGNNKELTQKKK

SEQ ID NO: 3348434 - protein, 4 aa, Plasmodium falciparum
TPTG

SEQ ID NO: 3348435 - protein, 5 aa, Plasmodium falciparum
TPTKL

SEQ ID NO: 3348436 - protein, 8 aa, Plasmodium falciparum
TPTSEYTN

SEQ ID NO: 3348437 - protein, 17 aa, Plasmodium falciparum
TPTTGQHINPKNNNDIN

SEQ ID NO: 3348438 - protein, 19 aa, Plasmodium falciparum
TPTTNNDDKGSEGGQDESV

SEQ ID NO: 3348439 - protein, 16 aa, Plasmodium falciparum
TPTTTTNNNNNNNNNN

SEQ ID NO: 3348440 - protein, 5 aa, Plasmodium falciparum
TPVGK

SEQ ID NO: 3348441 - protein, 8 aa, Plasmodium falciparum
TPVKSKNE

SEQ ID NO: 3348442 - protein, 15 aa, Plasmodium falciparum
TPYESDKEKNNSNNI

SEQ ID NO: 3348443 - protein, 11 aa, Plasmodium falciparum
TPYTGSNISNT

SEQ ID NO: 3348444 - protein, 7 aa, Plasmodium falciparum
TQANKRE

SEQ ID NO: 3348445 - protein, 5 aa, Plasmodium falciparum
TQCKD

SEQ ID NO: 3348446 - protein, 7 aa, Plasmodium falciparum
TQCTGGY

SEQ ID NO: 3348447 - protein, 6 aa, Plasmodium falciparum
TQDDED

SEQ ID NO: 3348448 - protein, 22 aa, Plasmodium falciparum
TQDDLSGESDGSEDKCNELEAT

SEQ ID NO: 3348449 - protein, 8 aa, Plasmodium falciparum
TQDDNERS

SEQ ID NO: 3348450 - protein, 14 aa, Plasmodium falciparum
TQDHNKKKKITLTS

SEQ ID NO: 3348451 - protein, 9 aa, Plasmodium falciparum
TQDQGKSID

SEQ ID NO: 3348452 - protein, 20 aa, Plasmodium falciparum
TQEDNELKERHKSNENNKHH

SEQ ID NO: 3348453 - protein, 6 aa, Plasmodium falciparum
TQEDVN

SEQ ID NO: 3348454 - protein, 13 aa, Plasmodium falciparum
TQEEGKDKNEEKI

SEQ ID NO: 3348455 - protein, 6 aa, Plasmodium falciparum
TQEEMI

SEQ ID NO: 3348456 - protein, 20 aa, Plasmodium falciparum
TQEENNENNNSLKKKKKKKI

SEQ ID NO: 3348457 - protein, 9 aa, Plasmodium falciparum
TQEGNKLNT

SEQ ID NO: 3348458 - protein, 4 aa, Plasmodium falciparum
TQEK

SEQ ID NO: 3348459 - protein, 5 aa, Plasmodium falciparum
TQEKE

SEQ ID NO: 3348460 - protein, 9 aa, Plasmodium falciparum
TQEKKDKIK

SEQ ID NO: 3348461 - protein, 4 aa, Plasmodium falciparum
TQEN

SEQ ID NO: 3348462 - protein, 7 aa, Plasmodium falciparum
TQENEDK

SEQ ID NO: 3348463 - protein, 5 aa, Plasmodium falciparum
TQENG

SEQ ID NO: 3348464 - protein, 22 aa, Plasmodium falciparum
TQEPSTTQEHADEKKASEGDNI

SEQ ID NO: 3348465 - protein, 28 aa, Plasmodium falciparum
TQEPSTTQEPSTTQEHADEKKASEGDNI

SEQ ID NO: 3348466 - protein, 27 aa, Plasmodium falciparum
TQEQKEEHINSEQNIKQEGNTDEQEHI

SEQ ID NO: 3348467 - protein, 7 aa, Plasmodium falciparum
TQEQKNN

SEQ ID NO: 3348468 - protein, 15 aa, Plasmodium falciparum
TQEREDANIKRGGTL

SEQ ID NO: 3348469 - protein, 5 aa, Plasmodium falciparum
TQFPS

SEQ ID NO: 3348470 - protein, 7 aa, Plasmodium falciparum
TQGGTNF

SEQ ID NO: 3348471 - protein, 7 aa, Plasmodium falciparum
TQGGWKS

SEQ ID NO: 3348472 - protein, 5 aa, Plasmodium falciparum
TQGLS

SEQ ID NO: 3348473 - protein, 7 aa, Plasmodium falciparum
TQGQGTY

SEQ ID NO: 3348474 - protein, 4 aa, Plasmodium falciparum
TQGS

SEQ ID NO: 3348475 - protein, 26 aa, Plasmodium falciparum
TQGYNNNNNNNNNNNNNISNHNNNYY

SEQ ID NO: 3348476 - protein, 19 aa, Plasmodium falciparum
TQHDHNNSTHKMNSNNDSC

SEQ ID NO: 3348477 - protein, 12 aa, Plasmodium falciparum
TQHGNNKKNDIM

SEQ ID NO: 3348478 - protein, 4 aa, Plasmodium falciparum
TQID

SEQ ID NO: 3348479 - protein, 11 aa, Plasmodium falciparum
TQINNEKNSLN

SEQ ID NO: 3348480 - protein, 8 aa, Plasmodium falciparum
TQINPSAG

SEQ ID NO: 3348481 - protein, 5 aa, Plasmodium falciparum
TQIQQ

SEQ ID NO: 3348482 - protein, 13 aa, Plasmodium falciparum
TQKDNAKMDNIDE

SEQ ID NO: 3348483 - protein, 7 aa, Plasmodium falciparum
TQKDRGM

SEQ ID NO: 3348484 - protein, 10 aa, Plasmodium falciparum
TQKETNEVTH

SEQ ID NO: 3348485 - protein, 8 aa, Plasmodium falciparum
TQKKEEYN

SEQ ID NO: 3348486 - protein, 11 aa, Plasmodium falciparum
TQKKEKKKKNF

SEQ ID NO: 3348487 - protein, 6 aa, Plasmodium falciparum
TQKKKN

SEQ ID NO: 3348488 - protein, 12 aa, Plasmodium falciparum
TQKKQKQNDNKE

SEQ ID NO: 3348489 - protein, 8 aa, Plasmodium falciparum
TQKNDTTY

SEQ ID NO: 3348490 - protein, 7 aa, Plasmodium falciparum
TQKNEIS

SEQ ID NO: 3348491 - protein, 10 aa, Plasmodium falciparum
TQKVGKGIGG

SEQ ID NO: 3348492 - protein, 9 aa, Plasmodium falciparum
TQLSSENNE

SEQ ID NO: 3348493 - protein, 46 aa, Plasmodium falciparum
TQMKEEKSNWTQKKGDQKYQKNYNQKKNAHYKKNYKDNNANKNYKK

SEQ ID NO: 3348494 - protein, 6 aa, Plasmodium falciparum
TQNAEY

SEQ ID NO: 3348495 - protein, 10 aa, Plasmodium falciparum
TQNDTSNENN

SEQ ID NO: 3348496 - protein, 26 aa, Plasmodium falciparum
TQNDYNNDLDNNNNNNNNTHSEYNTN

SEQ ID NO: 3348497 - protein, 5 aa, Plasmodium falciparum
TQNEK

SEQ ID NO: 3348498 - protein, 13 aa, Plasmodium falciparum
TQNEKTEKPKDNI

SEQ ID NO: 3348499 - protein, 7 aa, Plasmodium falciparum
TQNENEK

SEQ ID NO: 3348500 - protein, 4 aa, Plasmodium falciparum
TQNG

SEQ ID NO: 3348501 - protein, 8 aa, Plasmodium falciparum
TQNHNSTE

SEQ ID NO: 3348502 - protein, 64 aa, Plasmodium falciparum
TQNKNYSSINYDDNNNYDDNNNYDDNNNYDDDDNNNYDDNNNYDDDDNNNNNSCSSIRRNEKKR

SEQ ID NO: 3348503 - protein, 8 aa, Plasmodium falciparum
TQNKPNEK

SEQ ID NO: 3348504 - protein, 10 aa, Plasmodium falciparum
TQNNDNNENI

SEQ ID NO: 3348505 - protein, 8 aa, Plasmodium falciparum
TQNNNNNE

SEQ ID NO: 3348506 - protein, 9 aa, Plasmodium falciparum
TQNNYNDIN

SEQ ID NO: 3348507 - protein, 10 aa, Plasmodium falciparum
TQNRDSKYKN

SEQ ID NO: 3348508 - protein, 4 aa, Plasmodium falciparum
TQNS

SEQ ID NO: 3348509 - protein, 7 aa, Plasmodium falciparum
TQNVNNK

SEQ ID NO: 3348510 - protein, 11 aa, Plasmodium falciparum
TQNVQTNSKRN

SEQ ID NO: 3348511 - protein, 16 aa, Plasmodium falciparum
TQPANDLEKKISQHID

SEQ ID NO: 3348512 - protein, 10 aa, Plasmodium falciparum
TQPNKKNNDH

SEQ ID NO: 3348513 - protein, 5 aa, Plasmodium falciparum
TQPPY

SEQ ID NO: 3348514 - protein, 12 aa, Plasmodium falciparum
TQPRNSLSIDNS

SEQ ID NO: 3348515 - protein, 13 aa, Plasmodium falciparum
TQPSKCPSASCSN

SEQ ID NO: 3348516 - protein, 9 aa, Plasmodium falciparum
TQPSKTPLR

SEQ ID NO: 3348517 - protein, 23 aa, Plasmodium falciparum
TQQDQKQMNNSYEDNVEGQNGQE

SEQ ID NO: 3348518 - protein, 5 aa, Plasmodium falciparum
TQQDT

SEQ ID NO: 3348519 - protein, 6 aa, Plasmodium falciparum
TQQENK

SEQ ID NO: 3348520 - protein, 10 aa, Plasmodium falciparum
TQQGDSNNIN

SEQ ID NO: 3348521 - protein, 4 aa, Plasmodium falciparum
TQQP

SEQ ID NO: 3348522 - protein, 22 aa, Plasmodium falciparum
TQQVDNKSFSSSYRNDHEKKNS

SEQ ID NO: 3348523 - protein, 9 aa, Plasmodium falciparum
TQRKTPTEI

SEQ ID NO: 3348524 - protein, 7 aa, Plasmodium falciparum
TQRNPEE

SEQ ID NO: 3348525 - protein, 7 aa, Plasmodium falciparum
TQRNRNQ

SEQ ID NO: 3348526 - protein, 17 aa, Plasmodium falciparum
TQRYNNNGNNSNMYNPS

SEQ ID NO: 3348527 - protein, 20 aa, Plasmodium falciparum
TQRYTNNNNNNDDDTNNTTH

SEQ ID NO: 3348528 - protein, 10 aa, Plasmodium falciparum
TQSELKNETE

SEQ ID NO: 3348529 - protein, 10 aa, Plasmodium falciparum
TQSGDTKNSL

SEQ ID NO: 3348530 - protein, 14 aa, Plasmodium falciparum
TQSNNNPKKYYQDK

SEQ ID NO: 3348531 - protein, 9 aa, Plasmodium falciparum
TQSSGKSSV

SEQ ID NO: 3348532 - protein, 10 aa, Plasmodium falciparum
TQSSKSPSFE

SEQ ID NO: 3348533 - protein, 4 aa, Plasmodium falciparum
TQST

SEQ ID NO: 3348534 - protein, 5 aa, Plasmodium falciparum
TQSTC

SEQ ID NO: 3348535 - protein, 51 aa, Plasmodium falciparum
TQTCEGKELAERTNQMTEVKSRSKENINNTDINKSNSQEVVKSKGKSENKI

SEQ ID NO: 3348536 - protein, 5 aa, Plasmodium falciparum
TQTEK

SEQ ID NO: 3348537 - protein, 7 aa, Plasmodium falciparum
TQTGGVR

SEQ ID NO: 3348538 - protein, 18 aa, Plasmodium falciparum
TQTNQQNDTNHTSNYNKS

SEQ ID NO: 3348539 - protein, 8 aa, Plasmodium falciparum
TQTSNKKS

SEQ ID NO: 3348540 - protein, 19 aa, Plasmodium falciparum
TQTSRKSLEIESNTYESYR

SEQ ID NO: 3348541 - protein, 6 aa, Plasmodium falciparum
TQTTKV

SEQ ID NO: 3348542 - protein, 4 aa, Plasmodium falciparum
TQTY

SEQ ID NO: 3348543 - protein, 9 aa, Plasmodium falciparum
TQVANPGDN

SEQ ID NO: 3348544 - protein, 5 aa, Plasmodium falciparum
TQVDD

SEQ ID NO: 3348545 - protein, 13 aa, Plasmodium falciparum
TQVDKEKEKKNYK

SEQ ID NO: 3348546 - protein, 9 aa, Plasmodium falciparum
TQVEKDSKG

SEQ ID NO: 3348547 - protein, 5 aa, Plasmodium falciparum
TQYAK

SEQ ID NO: 3348548 - protein, 8 aa, Plasmodium falciparum
TQYNTTGR

SEQ ID NO: 3348549 - protein, 4 aa, Plasmodium falciparum
TQYS

SEQ ID NO: 3348550 - protein, 8 aa, Plasmodium falciparum
TRDDLNEK

SEQ ID NO: 3348551 - protein, 8 aa, Plasmodium falciparum
TRDDSQKI

SEQ ID NO: 3348552 - protein, 5 aa, Plasmodium falciparum
TRDKQ

SEQ ID NO: 3348553 - protein, 53 aa, Plasmodium falciparum
TRDLSDSSYQKKRRKKKNSSGGSSKNTESSFETKDIKKDNKYESGKKRKYDER

SEQ ID NO: 3348554 - protein, 7 aa, Plasmodium falciparum
TRDNTSR

SEQ ID NO: 3348555 - protein, 7 aa, Plasmodium falciparum
TRDQTKL

SEQ ID NO: 3348556 - protein, 17 aa, Plasmodium falciparum
TREEEKQIREENRWCGD

SEQ ID NO: 3348557 - protein, 4 aa, Plasmodium falciparum
TREF

SEQ ID NO: 3348558 - protein, 5 aa, Plasmodium falciparum
TREIK

SEQ ID NO: 3348559 - protein, 7 aa, Plasmodium falciparum
TREKNKV

SEQ ID NO: 3348560 - protein, 18 aa, Plasmodium falciparum
TREKRNDSLNNTNDNSLY

SEQ ID NO: 3348561 - protein, 10 aa, Plasmodium falciparum
TRENNNDINR

SEQ ID NO: 3348562 - protein, 4 aa, Plasmodium falciparum
TREQ

SEQ ID NO: 3348563 - protein, 8 aa, Plasmodium falciparum
TRGEDNHR

SEQ ID NO: 3348564 - protein, 6 aa, Plasmodium falciparum
TRGKSI

SEQ ID NO: 3348565 - protein, 9 aa, Plasmodium falciparum
TRGTINENS

SEQ ID NO: 3348566 - protein, 11 aa, Plasmodium falciparum
TRGTLNKNERK

SEQ ID NO: 3348567 - protein, 8 aa, Plasmodium falciparum
TRGTYEDT

SEQ ID NO: 3348568 - protein, 6 aa, Plasmodium falciparum
TRGYSG

SEQ ID NO: 3348569 - protein, 17 aa, Plasmodium falciparum
TRHHSSDKRHSKRDRHH

SEQ ID NO: 3348570 - protein, 6 aa, Plasmodium falciparum
TRHNTG

SEQ ID NO: 3348571 - protein, 11 aa, Plasmodium falciparum
TRKDNHHEVNK

SEQ ID NO: 3348572 - protein, 4 aa, Plasmodium falciparum
TRKE

SEQ ID NO: 3348573 - protein, 9 aa, Plasmodium falciparum
TRKGKGQKG

SEQ ID NO: 3348574 - protein, 4 aa, Plasmodium falciparum
TRKK

SEQ ID NO: 3348575 - protein, 11 aa, Plasmodium falciparum
TRKKDEDDTTI

SEQ ID NO: 3348576 - protein, 10 aa, Plasmodium falciparum
TRKKNTQPTE

SEQ ID NO: 3348577 - protein, 11 aa, Plasmodium falciparum
TRKKREKEKEG

SEQ ID NO: 3348578 - protein, 24 aa, Plasmodium falciparum
TRKMSTLGEKEIKQREKNLNMESK

SEQ ID NO: 3348579 - protein, 8 aa, Plasmodium falciparum
TRKNIDEE

SEQ ID NO: 3348580 - protein, 5 aa, Plasmodium falciparum
TRKNN

SEQ ID NO: 3348581 - protein, 6 aa, Plasmodium falciparum
TRKNPK

SEQ ID NO: 3348582 - protein, 8 aa, Plasmodium falciparum
TRKNSSFN

SEQ ID NO: 3348583 - protein, 15 aa, Plasmodium falciparum
TRKRGGGYSNASTNI

SEQ ID NO: 3348584 - protein, 9 aa, Plasmodium falciparum
TRKRKRDYD

SEQ ID NO: 3348585 - protein, 5 aa, Plasmodium falciparum
TRKSK

SEQ ID NO: 3348586 - protein, 5 aa, Plasmodium falciparum
TRKTN

SEQ ID NO: 3348587 - protein, 4 aa, Plasmodium falciparum
TRNK

SEQ ID NO: 3348588 - protein, 10 aa, Plasmodium falciparum
TRNNQNSTTI

SEQ ID NO: 3348589 - protein, 11 aa, Plasmodium falciparum
TRNNSNNNNNG

SEQ ID NO: 3348590 - protein, 10 aa, Plasmodium falciparum
TRNNSTNVSE

SEQ ID NO: 3348591 - protein, 4 aa, Plasmodium falciparum
TRNP

SEQ ID NO: 3348592 - protein, 48 aa, Plasmodium falciparum
TRNRARRTSQRTRNNRRNNNNNNNNNRKSRKRSTRTNRKKNERTKKKN

SEQ ID NO: 3348593 - protein, 9 aa, Plasmodium falciparum
TRNSDEDIP

SEQ ID NO: 3348594 - protein, 5 aa, Plasmodium falciparum
TRNTG

SEQ ID NO: 3348595 - protein, 14 aa, Plasmodium falciparum
TRNTYDNKNMTDDS

SEQ ID NO: 3348596 - protein, 4 aa, Plasmodium falciparum
TRNY

SEQ ID NO: 3348597 - protein, 5 aa, Plasmodium falciparum
TRPID

SEQ ID NO: 3348598 - protein, 5 aa, Plasmodium falciparum
TRPSK

SEQ ID NO: 3348599 - protein, 9 aa, Plasmodium falciparum
TRPTDVPDN

SEQ ID NO: 3348600 - protein, 22 aa, Plasmodium falciparum
TRRCEPKKFGGKGARARYQKSY

SEQ ID NO: 3348601 - protein, 6 aa, Plasmodium falciparum
TRRKKT

SEQ ID NO: 3348602 - protein, 4 aa, Plasmodium falciparum
TRRS

SEQ ID NO: 3348603 - protein, 9 aa, Plasmodium falciparum
TRRTKTPIS

SEQ ID NO: 3348604 - protein, 6 aa, Plasmodium falciparum
TRSGSI

SEQ ID NO: 3348605 - protein, 4 aa, Plasmodium falciparum
TRSN

SEQ ID NO: 3348606 - protein, 12 aa, Plasmodium falciparum
TRSNKTNNNKKT

SEQ ID NO: 3348607 - protein, 7 aa, Plasmodium falciparum
TRSRASR

SEQ ID NO: 3348608 - protein, 8 aa, Plasmodium falciparum
TRSSDEPM

SEQ ID NO: 3348609 - protein, 41 aa, Plasmodium falciparum
TRSSGDTTSNNNNTNSTNKSNIVTKNKKVNKKKKKKESKND

SEQ ID NO: 3348610 - protein, 5 aa, Plasmodium falciparum
TRSYK

SEQ ID NO: 3348611 - protein, 5 aa, Plasmodium falciparum
TRTAD

SEQ ID NO: 3348612 - protein, 4 aa, Plasmodium falciparum
TRTC

SEQ ID NO: 3348613 - protein, 4 aa, Plasmodium falciparum
TRTG

SEQ ID NO: 3348614 - protein, 12 aa, Plasmodium falciparum
TRTLEKRDSCED

SEQ ID NO: 3348615 - protein, 18 aa, Plasmodium falciparum
TRTNNNKLPNNNKNEKVN

SEQ ID NO: 3348616 - protein, 6 aa, Plasmodium falciparum
TRTNNP

SEQ ID NO: 3348617 - protein, 6 aa, Plasmodium falciparum
TRTQGD

SEQ ID NO: 3348618 - protein, 7 aa, Plasmodium falciparum
TRTTTGN

SEQ ID NO: 3348619 - protein, 13 aa, Plasmodium falciparum
TRTYDAHKEQELA

SEQ ID NO: 3348620 - protein, 35 aa, Plasmodium falciparum
TRVKNEKNLSKKKKNVDSSTDSKNNDSEKTRQGSY

SEQ ID NO: 3348621 - protein, 5 aa, Plasmodium falciparum
TRVPG

SEQ ID NO: 3348622 - protein, 10 aa, Plasmodium falciparum
TRVTSQEAEI

SEQ ID NO: 3348623 - protein, 5 aa, Plasmodium falciparum
TRYEE

SEQ ID NO: 3348624 - protein, 10 aa, Plasmodium falciparum
TRYSKEEEEK

SEQ ID NO: 3348625 - protein, 13 aa, Plasmodium falciparum
TSADTNVSPNEHL

SEQ ID NO: 3348626 - protein, 7 aa, Plasmodium falciparum
TSAGENI

SEQ ID NO: 3348627 - protein, 5 aa, Plasmodium falciparum
TSAGK

SEQ ID NO: 3348628 - protein, 5 aa, Plasmodium falciparum
TSAKK

SEQ ID NO: 3348629 - protein, 12 aa, Plasmodium falciparum
TSANSEEKKEMK

SEQ ID NO: 3348630 - protein, 6 aa, Plasmodium falciparum
TSAQNV

SEQ ID NO: 3348631 - protein, 9 aa, Plasmodium falciparum
TSAQRDIKE

SEQ ID NO: 3348632 - protein, 10 aa, Plasmodium falciparum
TSASTKRSLK

SEQ ID NO: 3348633 - protein, 11 aa, Plasmodium falciparum
TSATERDIYTG

SEQ ID NO: 3348634 - protein, 10 aa, Plasmodium falciparum
TSATSDGKLS

SEQ ID NO: 3348635 - protein, 12 aa, Plasmodium falciparum
TSAYETNRNDYG

SEQ ID NO: 3348636 - protein, 5 aa, Plasmodium falciparum
TSCNE

SEQ ID NO: 3348637 - protein, 12 aa, Plasmodium falciparum
TSDDNLSSNECS

SEQ ID NO: 3348638 - protein, 5 aa, Plasmodium falciparum
TSDDV

SEQ ID NO: 3348639 - protein, 41 aa, Plasmodium falciparum
TSDDVTDKYSLNENNDQMISSESNRRNYSNDISEKDDLTIQ

SEQ ID NO: 3348640 - protein, 4 aa, Plasmodium falciparum
TSDE

SEQ ID NO: 3348641 - protein, 7 aa, Plasmodium falciparum
TSDEKKN

SEQ ID NO: 3348642 - protein, 7 aa, Plasmodium falciparum
TSDESKT

SEQ ID NO: 3348643 - protein, 8 aa, Plasmodium falciparum
TSDGSYTS

SEQ ID NO: 3348644 - protein, 6 aa, Plasmodium falciparum
TSDGYS

SEQ ID NO: 3348645 - protein, 4 aa, Plasmodium falciparum
TSDI

SEQ ID NO: 3348646 - protein, 6 aa, Plasmodium falciparum
TSDKPK

SEQ ID NO: 3348647 - protein, 7 aa, Plasmodium falciparum
TSDNETK

SEQ ID NO: 3348648 - protein, 11 aa, Plasmodium falciparum
TSDNNNNNNNI

SEQ ID NO: 3348649 - protein, 4 aa, Plasmodium falciparum
TSDR

SEQ ID NO: 3348650 - protein, 4 aa, Plasmodium falciparum
TSDS

SEQ ID NO: 3348651 - protein, 11 aa, Plasmodium falciparum
TSDSDSSEKYI

SEQ ID NO: 3348652 - protein, 6 aa, Plasmodium falciparum
TSDSNV

SEQ ID NO: 3348653 - protein, 4 aa, Plasmodium falciparum
TSDT

SEQ ID NO: 3348654 - protein, 7 aa, Plasmodium falciparum
TSDTEKE

SEQ ID NO: 3348655 - protein, 6 aa, Plasmodium falciparum
TSDVDS

SEQ ID NO: 3348656 - protein, 4 aa, Plasmodium falciparum
TSEA

SEQ ID NO: 3348657 - protein, 17 aa, Plasmodium falciparum
TSEDLDSIKDATKQLQE

SEQ ID NO: 3348658 - protein, 4 aa, Plasmodium falciparum
TSEE

SEQ ID NO: 3348659 - protein, 17 aa, Plasmodium falciparum
TSEEESVKENEEEHTVD

SEQ ID NO: 3348660 - protein, 9 aa, Plasmodium falciparum
TSEEKQQGS

SEQ ID NO: 3348661 - protein, 12 aa, Plasmodium falciparum
TSEENDMNPNNN

SEQ ID NO: 3348662 - protein, 7 aa, Plasmodium falciparum
TSEETND

SEQ ID NO: 3348663 - protein, 90 aa, Plasmodium falciparum
TSEGNGNTYKDDKNYDDNKNYGDNKNYGDNKNYGDNKYYDDNKNYGDNKYYDDNKNYGDNKNYGDNKNYGDNKNYGDNKNDDDNKNYDEN

SEQ ID NO: 3348664 - protein, 16 aa, Plasmodium falciparum
TSEIKSSGEINPKGKK

SEQ ID NO: 3348665 - protein, 4 aa, Plasmodium falciparum
TSEK

SEQ ID NO: 3348666 - protein, 8 aa, Plasmodium falciparum
TSEKANYD

SEQ ID NO: 3348667 - protein, 60 aa, Plasmodium falciparum
TSEKDNINNDNDNNDNNNNNNNNNNNNNNNDKNNNDKNNNEDADKSKSNYNSSSDSNNKN

SEQ ID NO: 3348668 - protein, 6 aa, Plasmodium falciparum
TSENKY

SEQ ID NO: 3348669 - protein, 33 aa, Plasmodium falciparum
TSENYENNSKNMYPQNNNNNNNNYSSNDNNPYY

SEQ ID NO: 3348670 - protein, 7 aa, Plasmodium falciparum
TSERTTD

SEQ ID NO: 3348671 - protein, 47 aa, Plasmodium falciparum
TSESINNSSNTRDIKEEENYREIKTEEKDNQNNSIKTIKDSKDIDNN

SEQ ID NO: 3348672 - protein, 16 aa, Plasmodium falciparum
TSESITNSNENTNSIN

SEQ ID NO: 3348673 - protein, 11 aa, Plasmodium falciparum
TSESKISNESL

SEQ ID NO: 3348674 - protein, 16 aa, Plasmodium falciparum
TSEYDNNEKEKSDDLK

SEQ ID NO: 3348675 - protein, 5 aa, Plasmodium falciparum
TSEYE

SEQ ID NO: 3348676 - protein, 6 aa, Plasmodium falciparum
TSFSDN

SEQ ID NO: 3348677 - protein, 20 aa, Plasmodium falciparum
TSFSGTDDEIENNQKKQKKY

SEQ ID NO: 3348678 - protein, 5 aa, Plasmodium falciparum
TSFSS

SEQ ID NO: 3348679 - protein, 4 aa, Plasmodium falciparum
TSFT

SEQ ID NO: 3348680 - protein, 17 aa, Plasmodium falciparum
TSGDPPAPIRNLSLHFL

SEQ ID NO: 3348681 - protein, 11 aa, Plasmodium falciparum
TSGIDNKNSYV

SEQ ID NO: 3348682 - protein, 6 aa, Plasmodium falciparum
TSGKEI

SEQ ID NO: 3348683 - protein, 11 aa, Plasmodium falciparum
TSGKGSSAAGL

SEQ ID NO: 3348684 - protein, 4 aa, Plasmodium falciparum
TSGL

SEQ ID NO: 3348685 - protein, 14 aa, Plasmodium falciparum
TSGNLENKDIKDNH

SEQ ID NO: 3348686 - protein, 7 aa, Plasmodium falciparum
TSGSPFA

SEQ ID NO: 3348687 - protein, 9 aa, Plasmodium falciparum
TSGTGKTTL

SEQ ID NO: 3348688 - protein, 12 aa, Plasmodium falciparum
TSGVGKNYTTET

SEQ ID NO: 3348689 - protein, 11 aa, Plasmodium falciparum
TSHEKEEKRND

SEQ ID NO: 3348690 - protein, 131 aa, Plasmodium falciparum
TSHNDEKSGDNSIGEDDNNNDEKGGDNNIDEDDNNNDEKSGDNSIGEDDNNNDHKSGDNNIDEDDNNNDHKSEDNSIGEDDNNNDEKGGDNNIDENDNNSDHKSEDNNIDENDNNSDHQSDQEQFNHETKD

SEQ ID NO: 3348691 - protein, 5 aa, Plasmodium falciparum
TSIDE

SEQ ID NO: 3348692 - protein, 5 aa, Plasmodium falciparum
TSIIS

SEQ ID NO: 3348693 - protein, 11 aa, Plasmodium falciparum
TSIKDKSGGEK

SEQ ID NO: 3348694 - protein, 20 aa, Plasmodium falciparum
TSIKESSSRDEEEEDANVNK

SEQ ID NO: 3348695 - protein, 9 aa, Plasmodium falciparum
TSIKNEEKE

SEQ ID NO: 3348696 - protein, 4 aa, Plasmodium falciparum
TSIN

SEQ ID NO: 3348697 - protein, 6 aa, Plasmodium falciparum
TSKAYD

SEQ ID NO: 3348698 - protein, 6 aa, Plasmodium falciparum
TSKDLS

SEQ ID NO: 3348699 - protein, 12 aa, Plasmodium falciparum
TSKDNYESEEKA

SEQ ID NO: 3348700 - protein, 20 aa, Plasmodium falciparum
TSKDRTNVNNEKQNIENDPD

SEQ ID NO: 3348701 - protein, 8 aa, Plasmodium falciparum
TSKDSSER

SEQ ID NO: 3348702 - protein, 5 aa, Plasmodium falciparum
TSKDV

SEQ ID NO: 3348703 - protein, 8 aa, Plasmodium falciparum
TSKENVSD

SEQ ID NO: 3348704 - protein, 7 aa, Plasmodium falciparum
TSKESNV

SEQ ID NO: 3348705 - protein, 8 aa, Plasmodium falciparum
TSKGEALH

SEQ ID NO: 3348706 - protein, 10 aa, Plasmodium falciparum
TSKKEKTINN

SEQ ID NO: 3348707 - protein, 5 aa, Plasmodium falciparum
TSKKI

SEQ ID NO: 3348708 - protein, 12 aa, Plasmodium falciparum
TSKKKNNKSVQG

SEQ ID NO: 3348709 - protein, 11 aa, Plasmodium falciparum
TSKKKNNYINN

SEQ ID NO: 3348710 - protein, 9 aa, Plasmodium falciparum
TSKKKTQVE

SEQ ID NO: 3348711 - protein, 8 aa, Plasmodium falciparum
TSKKPADN

SEQ ID NO: 3348712 - protein, 11 aa, Plasmodium falciparum
TSKKTPKSDEE

SEQ ID NO: 3348713 - protein, 4 aa, Plasmodium falciparum
TSKN

SEQ ID NO: 3348714 - protein, 5 aa, Plasmodium falciparum
TSKND

SEQ ID NO: 3348715 - protein, 8 aa, Plasmodium falciparum
TSKNFDRG

SEQ ID NO: 3348716 - protein, 10 aa, Plasmodium falciparum
TSKNFEDSRK

SEQ ID NO: 3348717 - protein, 48 aa, Plasmodium falciparum
TSKNKSDKQEYEKKKNSSNSSNNPNNNNSNINNNNINSNNNNNNNNNN

SEQ ID NO: 3348718 - protein, 9 aa, Plasmodium falciparum
TSKNQNNQD

SEQ ID NO: 3348719 - protein, 16 aa, Plasmodium falciparum
TSKNSDEIYDNSVDGV

SEQ ID NO: 3348720 - protein, 5 aa, Plasmodium falciparum
TSKNV

SEQ ID NO: 3348721 - protein, 6 aa, Plasmodium falciparum
TSKQID

SEQ ID NO: 3348722 - protein, 9 aa, Plasmodium falciparum
TSKRNEEAQ

SEQ ID NO: 3348723 - protein, 8 aa, Plasmodium falciparum
TSKSGDEM

SEQ ID NO: 3348724 - protein, 11 aa, Plasmodium falciparum
TSKYDKIKNNN

SEQ ID NO: 3348725 - protein, 12 aa, Plasmodium falciparum
TSKYNNKSNDIQ

SEQ ID NO: 3348726 - protein, 6 aa, Plasmodium falciparum
TSLAST

SEQ ID NO: 3348727 - protein, 14 aa, Plasmodium falciparum
TSLDNDADKGDKNK

SEQ ID NO: 3348728 - protein, 4 aa, Plasmodium falciparum
TSLE

SEQ ID NO: 3348729 - protein, 8 aa, Plasmodium falciparum
TSLKDSTK

SEQ ID NO: 3348730 - protein, 6 aa, Plasmodium falciparum
TSLKNE

SEQ ID NO: 3348731 - protein, 4 aa, Plasmodium falciparum
TSLL

SEQ ID NO: 3348732 - protein, 35 aa, Plasmodium falciparum
TSLNKRNNNNSYSYENKNNYNKPINDEKSLNYDKN

SEQ ID NO: 3348733 - protein, 8 aa, Plasmodium falciparum
TSLNTSYG

SEQ ID NO: 3348734 - protein, 15 aa, Plasmodium falciparum
TSLPPQKKKKKEKKK

SEQ ID NO: 3348735 - protein, 13 aa, Plasmodium falciparum
TSLQNNYNPNNNF

SEQ ID NO: 3348736 - protein, 6 aa, Plasmodium falciparum
TSLQTE

SEQ ID NO: 3348737 - protein, 20 aa, Plasmodium falciparum
TSLSEHQKKINDRSANLNNS

SEQ ID NO: 3348738 - protein, 74 aa, Plasmodium falciparum
TSLSNGNETTKIKESSNVNEKRNSEEINLPGTENSKEDMEISRSTNNEANNNEHDNKEKEEKRVNEKKEEITQR

SEQ ID NO: 3348739 - protein, 11 aa, Plasmodium falciparum
TSLSPDGTSGR

SEQ ID NO: 3348740 - protein, 8 aa, Plasmodium falciparum
TSLSSGIK

SEQ ID NO: 3348741 - protein, 9 aa, Plasmodium falciparum
TSLTKAQQE

SEQ ID NO: 3348742 - protein, 14 aa, Plasmodium falciparum
TSLYNEKKNEKIEP

SEQ ID NO: 3348743 - protein, 4 aa, Plasmodium falciparum
TSMD

SEQ ID NO: 3348744 - protein, 6 aa, Plasmodium falciparum
TSNAQN

SEQ ID NO: 3348745 - protein, 4 aa, Plasmodium falciparum
TSND

SEQ ID NO: 3348746 - protein, 8 aa, Plasmodium falciparum
TSNDDEKM

SEQ ID NO: 3348747 - protein, 10 aa, Plasmodium falciparum
TSNDEKKKEK

SEQ ID NO: 3348748 - protein, 12 aa, Plasmodium falciparum
TSNDHKKNKAVP

SEQ ID NO: 3348749 - protein, 8 aa, Plasmodium falciparum
TSNDHSNL

SEQ ID NO: 3348750 - protein, 5 aa, Plasmodium falciparum
TSNEF

SEQ ID NO: 3348751 - protein, 5 aa, Plasmodium falciparum
TSNEN

SEQ ID NO: 3348752 - protein, 38 aa, Plasmodium falciparum
TSNERERSVSNYKDKKKKKEKYNDINKKDERDIKENDR

SEQ ID NO: 3348753 - protein, 13 aa, Plasmodium falciparum
TSNESVKSLKSNS

SEQ ID NO: 3348754 - protein, 6 aa, Plasmodium falciparum
TSNFQN

SEQ ID NO: 3348755 - protein, 13 aa, Plasmodium falciparum
TSNFSNPIDSNNH

SEQ ID NO: 3348756 - protein, 7 aa, Plasmodium falciparum
TSNGDDE

SEQ ID NO: 3348757 - protein, 10 aa, Plasmodium falciparum
TSNGEDIKNK

SEQ ID NO: 3348758 - protein, 5 aa, Plasmodium falciparum
TSNGN

SEQ ID NO: 3348759 - protein, 16 aa, Plasmodium falciparum
TSNGNNNNNNNNNNNH

SEQ ID NO: 3348760 - protein, 17 aa, Plasmodium falciparum
TSNGYPDGSIVLWAFVA

SEQ ID NO: 3348761 - protein, 4 aa, Plasmodium falciparum
TSNH

SEQ ID NO: 3348762 - protein, 8 aa, Plasmodium falciparum
TSNHEYSN

SEQ ID NO: 3348763 - protein, 7 aa, Plasmodium falciparum
TSNKEDI

SEQ ID NO: 3348764 - protein, 86 aa, Plasmodium falciparum
TSNKKKETNVNRDTETQSCENKNNDDKNKNKKNKKNKNNKNSKNNKNNNDDDNSMTNEMSEEDNIKSSNKKDRKNKSKNKKDQIND

SEQ ID NO: 3348765 - protein, 28 aa, Plasmodium falciparum
TSNKSEKKELKPINKQNTLKSEGEKKNK

SEQ ID NO: 3348766 - protein, 4 aa, Plasmodium falciparum
TSNN

SEQ ID NO: 3348767 - protein, 9 aa, Plasmodium falciparum
TSNNDFQKN

SEQ ID NO: 3348768 - protein, 10 aa, Plasmodium falciparum
TSNNFRDKSN

SEQ ID NO: 3348769 - protein, 13 aa, Plasmodium falciparum
TSNNNDSQTSIHD

SEQ ID NO: 3348770 - protein, 27 aa, Plasmodium falciparum
TSNNNKKNNTNNKINNNTNNTSYSNGV

SEQ ID NO: 3348771 - protein, 36 aa, Plasmodium falciparum
TSNNNNIDNNNDNNDNNNNNNNNSVQQNDHNNKDIS

SEQ ID NO: 3348772 - protein, 25 aa, Plasmodium falciparum
TSNNNNNNEDNYEDNNEDNYDNNNN

SEQ ID NO: 3348773 - protein, 13 aa, Plasmodium falciparum
TSNNNNNNNNNGL

SEQ ID NO: 3348774 - protein, 6 aa, Plasmodium falciparum
TSNNNY

SEQ ID NO: 3348775 - protein, 9 aa, Plasmodium falciparum
TSNNPIESN

SEQ ID NO: 3348776 - protein, 8 aa, Plasmodium falciparum
TSNNQTVQ

SEQ ID NO: 3348777 - protein, 37 aa, Plasmodium falciparum
TSNNSHSCNDSDLKRYDKKNDHVTDSFKNNKNDKELC

SEQ ID NO: 3348778 - protein, 9 aa, Plasmodium falciparum
TSNQYSNAH

SEQ ID NO: 3348779 - protein, 5 aa, Plasmodium falciparum
TSNRA

SEQ ID NO: 3348780 - protein, 12 aa, Plasmodium falciparum
TSNSAYDSSRYN

SEQ ID NO: 3348781 - protein, 8 aa, Plasmodium falciparum
TSNSETYF

SEQ ID NO: 3348782 - protein, 9 aa, Plasmodium falciparum
TSNSGTGKT

SEQ ID NO: 3348783 - protein, 13 aa, Plasmodium falciparum
TSNSNIGEEFNEG

SEQ ID NO: 3348784 - protein, 15 aa, Plasmodium falciparum
TSNSSNTYSSESSLD

SEQ ID NO: 3348785 - protein, 5 aa, Plasmodium falciparum
TSNTC

SEQ ID NO: 3348786 - protein, 12 aa, Plasmodium falciparum
TSNTNNSTSNSF

SEQ ID NO: 3348787 - protein, 6 aa, Plasmodium falciparum
TSNTSV

SEQ ID NO: 3348788 - protein, 4 aa, Plasmodium falciparum
TSNV

SEQ ID NO: 3348789 - protein, 18 aa, Plasmodium falciparum
TSNYGSNEKKPNDIEKNK

SEQ ID NO: 3348790 - protein, 5 aa, Plasmodium falciparum
TSPDE

SEQ ID NO: 3348791 - protein, 8 aa, Plasmodium falciparum
TSPDHSLK

SEQ ID NO: 3348792 - protein, 4 aa, Plasmodium falciparum
TSPE

SEQ ID NO: 3348793 - protein, 28 aa, Plasmodium falciparum
TSPFGGARPGRVKRKSLKKQKEKTEAEA

SEQ ID NO: 3348794 - protein, 11 aa, Plasmodium falciparum
TSPGGKLDDVE

SEQ ID NO: 3348795 - protein, 16 aa, Plasmodium falciparum
TSPHKYSHNDNRHNHY

SEQ ID NO: 3348796 - protein, 12 aa, Plasmodium falciparum
TSPKKKEHSINN

SEQ ID NO: 3348797 - protein, 69 aa, Plasmodium falciparum
TSPKYSPTSPKYSPTSPKYSPTSPKYSPTSPKYSPTSPKYSPTSPKYSPTSPKYSPTSPKYSPTSPVAQ

SEQ ID NO: 3348798 - protein, 19 aa, Plasmodium falciparum
TSPLSGNTKNISNEAGNDY

SEQ ID NO: 3348799 - protein, 5 aa, Plasmodium falciparum
TSPLT

SEQ ID NO: 3348800 - protein, 4 aa, Plasmodium falciparum
TSPN

SEQ ID NO: 3348801 - protein, 12 aa, Plasmodium falciparum
TSPNNISYENAE

SEQ ID NO: 3348802 - protein, 8 aa, Plasmodium falciparum
TSPPVSIP

SEQ ID NO: 3348803 - protein, 5 aa, Plasmodium falciparum
TSPQV

SEQ ID NO: 3348804 - protein, 6 aa, Plasmodium falciparum
TSPSNC

SEQ ID NO: 3348805 - protein, 5 aa, Plasmodium falciparum
TSPTI

SEQ ID NO: 3348806 - protein, 11 aa, Plasmodium falciparum
TSPYNADFDGD

SEQ ID NO: 3348807 - protein, 12 aa, Plasmodium falciparum
TSQGDVNYSPNT

SEQ ID NO: 3348808 - protein, 10 aa, Plasmodium falciparum
TSQGEHNKEN

SEQ ID NO: 3348809 - protein, 9 aa, Plasmodium falciparum
TSQMGETSQ

SEQ ID NO: 3348810 - protein, 15 aa, Plasmodium falciparum
TSQMGETSQMGETSQ

SEQ ID NO: 3348811 - protein, 5 aa, Plasmodium falciparum
TSQQA

SEQ ID NO: 3348812 - protein, 10 aa, Plasmodium falciparum
TSQSSEEDSL

SEQ ID NO: 3348813 - protein, 5 aa, Plasmodium falciparum
TSQTF

SEQ ID NO: 3348814 - protein, 12 aa, Plasmodium falciparum
TSRDKKKENNNI

SEQ ID NO: 3348815 - protein, 6 aa, Plasmodium falciparum
TSREDE

SEQ ID NO: 3348816 - protein, 8 aa, Plasmodium falciparum
TSRGSQQY

SEQ ID NO: 3348817 - protein, 8 aa, Plasmodium falciparum
TSRKSVRK

SEQ ID NO: 3348818 - protein, 4 aa, Plasmodium falciparum
TSRL

SEQ ID NO: 3348819 - protein, 9 aa, Plasmodium falciparum
TSRNKKRNG

SEQ ID NO: 3348820 - protein, 7 aa, Plasmodium falciparum
TSRNNDS

SEQ ID NO: 3348821 - protein, 10 aa, Plasmodium falciparum
TSRNSSNNWN

SEQ ID NO: 3348822 - protein, 5 aa, Plasmodium falciparum
TSRPI

SEQ ID NO: 3348823 - protein, 9 aa, Plasmodium falciparum
TSRPSASTI

SEQ ID NO: 3348824 - protein, 5 aa, Plasmodium falciparum
TSRRT

SEQ ID NO: 3348825 - protein, 12 aa, Plasmodium falciparum
TSRSNNNSTVNM

SEQ ID NO: 3348826 - protein, 6 aa, Plasmodium falciparum
TSRTSR

SEQ ID NO: 3348827 - protein, 27 aa, Plasmodium falciparum
TSSANNNVVSKSGSYKCDAENNNTNMK

SEQ ID NO: 3348828 - protein, 11 aa, Plasmodium falciparum
TSSCNENNLNN

SEQ ID NO: 3348829 - protein, 8 aa, Plasmodium falciparum
TSSDDDNS

SEQ ID NO: 3348830 - protein, 11 aa, Plasmodium falciparum
TSSDEYDSSMD

SEQ ID NO: 3348831 - protein, 6 aa, Plasmodium falciparum
TSSDKT

SEQ ID NO: 3348832 - protein, 7 aa, Plasmodium falciparum
TSSDNGS

SEQ ID NO: 3348833 - protein, 13 aa, Plasmodium falciparum
TSSENFNIFKPCN

SEQ ID NO: 3348834 - protein, 7 aa, Plasmodium falciparum
TSSENQI

SEQ ID NO: 3348835 - protein, 8 aa, Plasmodium falciparum
TSSENTNL

SEQ ID NO: 3348836 - protein, 5 aa, Plasmodium falciparum
TSSFD

SEQ ID NO: 3348837 - protein, 8 aa, Plasmodium falciparum
TSSGSSAY

SEQ ID NO: 3348838 - protein, 9 aa, Plasmodium falciparum
TSSKNINES

SEQ ID NO: 3348839 - protein, 4 aa, Plasmodium falciparum
TSSL

SEQ ID NO: 3348840 - protein, 6 aa, Plasmodium falciparum
TSSNEV

SEQ ID NO: 3348841 - protein, 7 aa, Plasmodium falciparum
TSSNHTS

SEQ ID NO: 3348842 - protein, 189 aa, Plasmodium falciparum
TSSNIKSEKYEKREKKEIISQKDQNKKKKIMREKDEKKKKKKIKEEKDEKKRKRRRRKKKKKKKKERKKEISDTESEEMLSSSNDQSSSSNSSNDSSYISDYSSDDSYISNNSTDSSSNSKMSSDSSSNSKMSSGSSSNSKVSSDSRSNSKKSRDRSSNSKSSCISKSKSDCDNSSYHSDGSNNSRFSR

SEQ ID NO: 3348843 - protein, 15 aa, Plasmodium falciparum
TSSNKNALNAFIHNN

SEQ ID NO: 3348844 - protein, 9 aa, Plasmodium falciparum
TSSNKPQNN

SEQ ID NO: 3348845 - protein, 8 aa, Plasmodium falciparum
TSSNNGNT

SEQ ID NO: 3348846 - protein, 19 aa, Plasmodium falciparum
TSSNNNNLNDDDKNNKQML

SEQ ID NO: 3348847 - protein, 5 aa, Plasmodium falciparum
TSSPK

SEQ ID NO: 3348848 - protein, 6 aa, Plasmodium falciparum
TSSQIH

SEQ ID NO: 3348849 - protein, 6 aa, Plasmodium falciparum
TSSQTA

SEQ ID NO: 3348850 - protein, 5 aa, Plasmodium falciparum
TSSSD

SEQ ID NO: 3348851 - protein, 10 aa, Plasmodium falciparum
TSSSESEYEE

SEQ ID NO: 3348852 - protein, 37 aa, Plasmodium falciparum
TSSSEYDSYEKRRKKEEKKKKKDDDNYKRKMTNTEYE

SEQ ID NO: 3348853 - protein, 9 aa, Plasmodium falciparum
TSSSGSIYS

SEQ ID NO: 3348854 - protein, 32 aa, Plasmodium falciparum
TSSSHDNNNNNNNNDDDEKENNKNKNKEKSMI

SEQ ID NO: 3348855 - protein, 5 aa, Plasmodium falciparum
TSSSI

SEQ ID NO: 3348856 - protein, 7 aa, Plasmodium falciparum
TSSSNLI

SEQ ID NO: 3348857 - protein, 14 aa, Plasmodium falciparum
TSSSNTSDNSDNNI

SEQ ID NO: 3348858 - protein, 12 aa, Plasmodium falciparum
TSSSSKKNFNDH

SEQ ID NO: 3348859 - protein, 11 aa, Plasmodium falciparum
TSSSTNSAGEE

SEQ ID NO: 3348860 - protein, 6 aa, Plasmodium falciparum
TSSTIS

SEQ ID NO: 3348861 - protein, 16 aa, Plasmodium falciparum
TSSTYNNGTNNTNISQ

SEQ ID NO: 3348862 - protein, 4 aa, Plasmodium falciparum
TSSV

SEQ ID NO: 3348863 - protein, 21 aa, Plasmodium falciparum
TSSYKRKARSSPNGQGQKAKI

SEQ ID NO: 3348864 - protein, 13 aa, Plasmodium falciparum
TSTCKEKQEGLYD

SEQ ID NO: 3348865 - protein, 6 aa, Plasmodium falciparum
TSTEVK

SEQ ID NO: 3348866 - protein, 6 aa, Plasmodium falciparum
TSTFGS

SEQ ID NO: 3348867 - protein, 4 aa, Plasmodium falciparum
TSTI

SEQ ID NO: 3348868 - protein, 10 aa, Plasmodium falciparum
TSTISKNEHD

SEQ ID NO: 3348869 - protein, 5 aa, Plasmodium falciparum
TSTKI

SEQ ID NO: 3348870 - protein, 43 aa, Plasmodium falciparum
TSTKVEKKKTVKQKKVKKESTKKEEKANRVVEDSQSAKNKGYA

SEQ ID NO: 3348871 - protein, 87 aa, Plasmodium falciparum
TSTNADNDKDEAPTSNNNNGNNNGNNNGNNNGNNSGNNSGNNSGNNSGNNNSNNNMPPGYNNDKPEDLKKSFSSEKYSSSKEALEEE

SEQ ID NO: 3348872 - protein, 7 aa, Plasmodium falciparum
TSTNDGG

SEQ ID NO: 3348873 - protein, 5 aa, Plasmodium falciparum
TSTNN

SEQ ID NO: 3348874 - protein, 5 aa, Plasmodium falciparum
TSTQQ

SEQ ID NO: 3348875 - protein, 6 aa, Plasmodium falciparum
TSTSKE

SEQ ID NO: 3348876 - protein, 6 aa, Plasmodium falciparum
TSTSRK

SEQ ID NO: 3348877 - protein, 13 aa, Plasmodium falciparum
TSTSYYKIVSEFN

SEQ ID NO: 3348878 - protein, 9 aa, Plasmodium falciparum
TSTTAESKS

SEQ ID NO: 3348879 - protein, 10 aa, Plasmodium falciparum
TSTTDKRPIT

SEQ ID NO: 3348880 - protein, 33 aa, Plasmodium falciparum
TSTTEKKYKIEDNNTNGNCKNNDINKDIDNTNI

SEQ ID NO: 3348881 - protein, 6 aa, Plasmodium falciparum
TSTTIP

SEQ ID NO: 3348882 - protein, 7 aa, Plasmodium falciparum
TSTTSEV

SEQ ID NO: 3348883 - protein, 9 aa, Plasmodium falciparum
TSTTSKSLN

SEQ ID NO: 3348884 - protein, 14 aa, Plasmodium falciparum
TSTYSNTTIQGTTR

SEQ ID NO: 3348885 - protein, 5 aa, Plasmodium falciparum
TSVAE

SEQ ID NO: 3348886 - protein, 10 aa, Plasmodium falciparum
TSVDENNNGI

SEQ ID NO: 3348887 - protein, 10 aa, Plasmodium falciparum
TSVDNTNPNV

SEQ ID NO: 3348888 - protein, 4 aa, Plasmodium falciparum
TSVG

SEQ ID NO: 3348889 - protein, 10 aa, Plasmodium falciparum
TSVKTENKDI

SEQ ID NO: 3348890 - protein, 5 aa, Plasmodium falciparum
TSVPS

SEQ ID NO: 3348891 - protein, 33 aa, Plasmodium falciparum
TSVTSQKMRNKTKREDNDKRNSKIPVKKKLKSE

SEQ ID NO: 3348892 - protein, 16 aa, Plasmodium falciparum
TSVTTNKDKNVGNHDD

SEQ ID NO: 3348893 - protein, 6 aa, Plasmodium falciparum
TSYLTT

SEQ ID NO: 3348894 - protein, 7 aa, Plasmodium falciparum
TSYNDKD

SEQ ID NO: 3348895 - protein, 5 aa, Plasmodium falciparum
TSYNN

SEQ ID NO: 3348896 - protein, 16 aa, Plasmodium falciparum
TSYNNDHVSDSLQTDI

SEQ ID NO: 3348897 - protein, 17 aa, Plasmodium falciparum
TSYPNSNNNNNNNNNNL

SEQ ID NO: 3348898 - protein, 22 aa, Plasmodium falciparum
TSYQSVDGTTNNPMKTSNTHHE

SEQ ID NO: 3348899 - protein, 24 aa, Plasmodium falciparum
TSYSSEFENDDDHRENKPNELNEL

SEQ ID NO: 3348900 - protein, 25 aa, Plasmodium falciparum
TSYSSNIEQKTNKQNDNDKEEEEET

SEQ ID NO: 3348901 - protein, 14 aa, Plasmodium falciparum
TSYTKDKNNLYNNG

SEQ ID NO: 3348902 - protein, 8 aa, Plasmodium falciparum
TSYTTKYE

SEQ ID NO: 3348903 - protein, 14 aa, Plasmodium falciparum
TTAKLNESEASSTS

SEQ ID NO: 3348904 - protein, 8 aa, Plasmodium falciparum
TTATTATT

SEQ ID NO: 3348905 - protein, 7 aa, Plasmodium falciparum
TTCNDND

SEQ ID NO: 3348906 - protein, 31 aa, Plasmodium falciparum
TTCTTDSTLYSKEEKSEKKKNEEKKNTKSTF

SEQ ID NO: 3348907 - protein, 12 aa, Plasmodium falciparum
TTDDETKTGLTH

SEQ ID NO: 3348908 - protein, 11 aa, Plasmodium falciparum
TTDECNKKKNG

SEQ ID NO: 3348909 - protein, 26 aa, Plasmodium falciparum
TTDESNTMTTPSQLKENGNIKNIDEQ

SEQ ID NO: 3348910 - protein, 5 aa, Plasmodium falciparum
TTDKS

SEQ ID NO: 3348911 - protein, 9 aa, Plasmodium falciparum
TTDKSSSKY

SEQ ID NO: 3348912 - protein, 12 aa, Plasmodium falciparum
TTDLKNKQQLNK

SEQ ID NO: 3348913 - protein, 5 aa, Plasmodium falciparum
TTDQN

SEQ ID NO: 3348914 - protein, 37 aa, Plasmodium falciparum
TTDSADDEDEENDNDNDNDEHDDDHDNEKEDNDDELN

SEQ ID NO: 3348915 - protein, 6 aa, Plasmodium falciparum
TTDTQY

SEQ ID NO: 3348916 - protein, 15 aa, Plasmodium falciparum
TTDVKNDKTLKDDTI

SEQ ID NO: 3348917 - protein, 6 aa, Plasmodium falciparum
TTEATA

SEQ ID NO: 3348918 - protein, 5 aa, Plasmodium falciparum
TTEEQ

SEQ ID NO: 3348919 - protein, 11 aa, Plasmodium falciparum
TTEFANNENKG

SEQ ID NO: 3348920 - protein, 4 aa, Plasmodium falciparum
TTEG

SEQ ID NO: 3348921 - protein, 6 aa, Plasmodium falciparum
TTEGDL

SEQ ID NO: 3348922 - protein, 5 aa, Plasmodium falciparum
TTEIS

SEQ ID NO: 3348923 - protein, 18 aa, Plasmodium falciparum
TTEKECKGSRRNINHRNK

SEQ ID NO: 3348924 - protein, 5 aa, Plasmodium falciparum
TTEKN

SEQ ID NO: 3348925 - protein, 5 aa, Plasmodium falciparum
TTEKV

SEQ ID NO: 3348926 - protein, 16 aa, Plasmodium falciparum
TTENEENETESDGSSQ

SEQ ID NO: 3348927 - protein, 16 aa, Plasmodium falciparum
TTENEKGKKISKNYND

SEQ ID NO: 3348928 - protein, 9 aa, Plasmodium falciparum
TTERNMKTT

SEQ ID NO: 3348929 - protein, 12 aa, Plasmodium falciparum
TTERSKSYNRKN

SEQ ID NO: 3348930 - protein, 52 aa, Plasmodium falciparum
TTESTTFHNRSSKKGSNKSVSTNSTSINTNKNNINELSNSQPNNSGQTCDEM

SEQ ID NO: 3348931 - protein, 13 aa, Plasmodium falciparum
TTFKENKNDKVQN

SEQ ID NO: 3348932 - protein, 4 aa, Plasmodium falciparum
TTFN

SEQ ID NO: 3348933 - protein, 5 aa, Plasmodium falciparum
TTFNS

SEQ ID NO: 3348934 - protein, 6 aa, Plasmodium falciparum
TTFSEK

SEQ ID NO: 3348935 - protein, 15 aa, Plasmodium falciparum
TTGALKNNEYKSTSF

SEQ ID NO: 3348936 - protein, 4 aa, Plasmodium falciparum
TTGC

SEQ ID NO: 3348937 - protein, 6 aa, Plasmodium falciparum
TTGDES

SEQ ID NO: 3348938 - protein, 5 aa, Plasmodium falciparum
TTGFD

SEQ ID NO: 3348939 - protein, 5 aa, Plasmodium falciparum
TTGGA

SEQ ID NO: 3348940 - protein, 5 aa, Plasmodium falciparum
TTGIK

SEQ ID NO: 3348941 - protein, 10 aa, Plasmodium falciparum
TTGKGASAVG

SEQ ID NO: 3348942 - protein, 6 aa, Plasmodium falciparum
TTGKPA

SEQ ID NO: 3348943 - protein, 8 aa, Plasmodium falciparum
TTGNGNKV

SEQ ID NO: 3348944 - protein, 5 aa, Plasmodium falciparum
TTGNN

SEQ ID NO: 3348945 - protein, 18 aa, Plasmodium falciparum
TTGNNANLSDNWNDSEGY

SEQ ID NO: 3348946 - protein, 17 aa, Plasmodium falciparum
TTGNNNSSSVDTNNKNY

SEQ ID NO: 3348947 - protein, 6 aa, Plasmodium falciparum
TTHANQ

SEQ ID NO: 3348948 - protein, 9 aa, Plasmodium falciparum
TTHEDTSEK

SEQ ID NO: 3348949 - protein, 8 aa, Plasmodium falciparum
TTHGKHEN

SEQ ID NO: 3348950 - protein, 13 aa, Plasmodium falciparum
TTHPYTTVGENKK

SEQ ID NO: 3348951 - protein, 4 aa, Plasmodium falciparum
TTID

SEQ ID NO: 3348952 - protein, 7 aa, Plasmodium falciparum
TTIDETK

SEQ ID NO: 3348953 - protein, 16 aa, Plasmodium falciparum
TTIDGNKKRVSEHSGD

SEQ ID NO: 3348954 - protein, 5 aa, Plasmodium falciparum
TTIGS

SEQ ID NO: 3348955 - protein, 4 aa, Plasmodium falciparum
TTIN

SEQ ID NO: 3348956 - protein, 11 aa, Plasmodium falciparum
TTINNPNAPPC

SEQ ID NO: 3348957 - protein, 11 aa, Plasmodium falciparum
TTINSSSVNNT

SEQ ID NO: 3348958 - protein, 7 aa, Plasmodium falciparum
TTIPAKK

SEQ ID NO: 3348959 - protein, 13 aa, Plasmodium falciparum
TTIQNKKKSITEE

SEQ ID NO: 3348960 - protein, 12 aa, Plasmodium falciparum
TTISKSDDTEVE

SEQ ID NO: 3348961 - protein, 19 aa, Plasmodium falciparum
TTKDMNKEKQENSTKVNSD

SEQ ID NO: 3348962 - protein, 8 aa, Plasmodium falciparum
TTKETAEI

SEQ ID NO: 3348963 - protein, 7 aa, Plasmodium falciparum
TTKGGSH

SEQ ID NO: 3348964 - protein, 9 aa, Plasmodium falciparum
TTKGKEDKE

SEQ ID NO: 3348965 - protein, 7 aa, Plasmodium falciparum
TTKGNES

SEQ ID NO: 3348966 - protein, 6 aa, Plasmodium falciparum
TTKHES

SEQ ID NO: 3348967 - protein, 4 aa, Plasmodium falciparum
TTKI

SEQ ID NO: 3348968 - protein, 10 aa, Plasmodium falciparum
TTKKEKDEDN

SEQ ID NO: 3348969 - protein, 16 aa, Plasmodium falciparum
TTKKEKEEDKKNQGDF

SEQ ID NO: 3348970 - protein, 9 aa, Plasmodium falciparum
TTKKNDNTI

SEQ ID NO: 3348971 - protein, 15 aa, Plasmodium falciparum
TTKKSVHKNQKDHKN

SEQ ID NO: 3348972 - protein, 9 aa, Plasmodium falciparum
TTKNEENDH

SEQ ID NO: 3348973 - protein, 6 aa, Plasmodium falciparum
TTKNIN

SEQ ID NO: 3348974 - protein, 8 aa, Plasmodium falciparum
TTKNNNCL

SEQ ID NO: 3348975 - protein, 32 aa, Plasmodium falciparum
TTKNNNDEIKNNDEKKNNNNNNNNHNNNNHNN

SEQ ID NO: 3348976 - protein, 10 aa, Plasmodium falciparum
TTKNQDNNMN

SEQ ID NO: 3348977 - protein, 5 aa, Plasmodium falciparum
TTKPI

SEQ ID NO: 3348978 - protein, 5 aa, Plasmodium falciparum
TTKSI

SEQ ID NO: 3348979 - protein, 10 aa, Plasmodium falciparum
TTKYASNTTC

SEQ ID NO: 3348980 - protein, 6 aa, Plasmodium falciparum
TTKYTE

SEQ ID NO: 3348981 - protein, 12 aa, Plasmodium falciparum
TTLISQNNKNAN

SEQ ID NO: 3348982 - protein, 15 aa, Plasmodium falciparum
TTLKSSENKKDNKFK

SEQ ID NO: 3348983 - protein, 4 aa, Plasmodium falciparum
TTLQ

SEQ ID NO: 3348984 - protein, 8 aa, Plasmodium falciparum
TTNASPKV

SEQ ID NO: 3348985 - protein, 7 aa, Plasmodium falciparum
TTNATSG

SEQ ID NO: 3348986 - protein, 9 aa, Plasmodium falciparum
TTNCSNTNN

SEQ ID NO: 3348987 - protein, 19 aa, Plasmodium falciparum
TTNDNNNNNNKYNQNKQQC

SEQ ID NO: 3348988 - protein, 16 aa, Plasmodium falciparum
TTNEALNNEGNNNNNI

SEQ ID NO: 3348989 - protein, 9 aa, Plasmodium falciparum
TTNEKLEYD

SEQ ID NO: 3348990 - protein, 6 aa, Plasmodium falciparum
TTNERE

SEQ ID NO: 3348991 - protein, 6 aa, Plasmodium falciparum
TTNEYN

SEQ ID NO: 3348992 - protein, 9 aa, Plasmodium falciparum
TTNGTPLQQ

SEQ ID NO: 3348993 - protein, 5 aa, Plasmodium falciparum
TTNIN

SEQ ID NO: 3348994 - protein, 5 aa, Plasmodium falciparum
TTNKK

SEQ ID NO: 3348995 - protein, 9 aa, Plasmodium falciparum
TTNKRRRRN

SEQ ID NO: 3348996 - protein, 4 aa, Plasmodium falciparum
TTNN

SEQ ID NO: 3348997 - protein, 6 aa, Plasmodium falciparum
TTNNDI

SEQ ID NO: 3348998 - protein, 17 aa, Plasmodium falciparum
TTNNDINKHEEEKDEEH

SEQ ID NO: 3348999 - protein, 5 aa, Plasmodium falciparum
TTNNI

SEQ ID NO: 3349000 - protein, 8 aa, Plasmodium falciparum
TTNNNDDH

SEQ ID NO: 3349001 - protein, 12 aa, Plasmodium falciparum
TTNNNNNNTNMN

SEQ ID NO: 3349002 - protein, 7 aa, Plasmodium falciparum
TTNNSDN

SEQ ID NO: 3349003 - protein, 6 aa, Plasmodium falciparum
TTNNYN

SEQ ID NO: 3349004 - protein, 6 aa, Plasmodium falciparum
TTNNYY

SEQ ID NO: 3349005 - protein, 7 aa, Plasmodium falciparum
TTNPDSA

SEQ ID NO: 3349006 - protein, 5 aa, Plasmodium falciparum
TTNQK

SEQ ID NO: 3349007 - protein, 23 aa, Plasmodium falciparum
TTNRDGNNNNLEEKDKKMNNTHE

SEQ ID NO: 3349008 - protein, 5 aa, Plasmodium falciparum
TTNSA

SEQ ID NO: 3349009 - protein, 6 aa, Plasmodium falciparum
TTNSFQ

SEQ ID NO: 3349010 - protein, 28 aa, Plasmodium falciparum
TTNSINNNIQKDNSDTLGTESYSTHKSN

SEQ ID NO: 3349011 - protein, 8 aa, Plasmodium falciparum
TTNSITEA

SEQ ID NO: 3349012 - protein, 8 aa, Plasmodium falciparum
TTNSNTRG

SEQ ID NO: 3349013 - protein, 5 aa, Plasmodium falciparum
TTNTK

SEQ ID NO: 3349014 - protein, 9 aa, Plasmodium falciparum
TTNTQPSSM

SEQ ID NO: 3349015 - protein, 15 aa, Plasmodium falciparum
TTPAENDDKYKSTNN

SEQ ID NO: 3349016 - protein, 8 aa, Plasmodium falciparum
TTPDTQSK

SEQ ID NO: 3349017 - protein, 4 aa, Plasmodium falciparum
TTPE

SEQ ID NO: 3349018 - protein, 5 aa, Plasmodium falciparum
TTPEM

SEQ ID NO: 3349019 - protein, 5 aa, Plasmodium falciparum
TTPIP

SEQ ID NO: 3349020 - protein, 6 aa, Plasmodium falciparum
TTPKNE

SEQ ID NO: 3349021 - protein, 5 aa, Plasmodium falciparum
TTPKY

SEQ ID NO: 3349022 - protein, 6 aa, Plasmodium falciparum
TTPNFG

SEQ ID NO: 3349023 - protein, 7 aa, Plasmodium falciparum
TTPNIST

SEQ ID NO: 3349024 - protein, 9 aa, Plasmodium falciparum
TTPPIPDNN

SEQ ID NO: 3349025 - protein, 6 aa, Plasmodium falciparum
TTPTYG

SEQ ID NO: 3349026 - protein, 5 aa, Plasmodium falciparum
TTPVN

SEQ ID NO: 3349027 - protein, 10 aa, Plasmodium falciparum
TTQDDEDNND

SEQ ID NO: 3349028 - protein, 4 aa, Plasmodium falciparum
TTQF

SEQ ID NO: 3349029 - protein, 6 aa, Plasmodium falciparum
TTQKSE

SEQ ID NO: 3349030 - protein, 22 aa, Plasmodium falciparum
TTQNVEEKKKKKKKKKKNVDDE

SEQ ID NO: 3349031 - protein, 12 aa, Plasmodium falciparum
TTQTTTQNKDLN

SEQ ID NO: 3349032 - protein, 15 aa, Plasmodium falciparum
TTRCQGGNIRNNKYS

SEQ ID NO: 3349033 - protein, 8 aa, Plasmodium falciparum
TTRDSHKK

SEQ ID NO: 3349034 - protein, 5 aa, Plasmodium falciparum
TTRGT

SEQ ID NO: 3349035 - protein, 5 aa, Plasmodium falciparum
TTRKE

SEQ ID NO: 3349036 - protein, 9 aa, Plasmodium falciparum
TTRSKKPIK

SEQ ID NO: 3349037 - protein, 9 aa, Plasmodium falciparum
TTSCSKKKD

SEQ ID NO: 3349038 - protein, 14 aa, Plasmodium falciparum
TTSDEDYDKKRRIK

SEQ ID NO: 3349039 - protein, 18 aa, Plasmodium falciparum
TTSENVGSPHTNNKTSIY

SEQ ID NO: 3349040 - protein, 11 aa, Plasmodium falciparum
TTSETTSDTLN

SEQ ID NO: 3349041 - protein, 8 aa, Plasmodium falciparum
TTSGFSSR

SEQ ID NO: 3349042 - protein, 11 aa, Plasmodium falciparum
TTSKTTTKHGN

SEQ ID NO: 3349043 - protein, 4 aa, Plasmodium falciparum
TTSN

SEQ ID NO: 3349044 - protein, 5 aa, Plasmodium falciparum
TTSNG

SEQ ID NO: 3349045 - protein, 13 aa, Plasmodium falciparum
TTSNKYSQHNHSN

SEQ ID NO: 3349046 - protein, 5 aa, Plasmodium falciparum
TTSNN

SEQ ID NO: 3349047 - protein, 14 aa, Plasmodium falciparum
TTSNNFNKNNSFPY

SEQ ID NO: 3349048 - protein, 6 aa, Plasmodium falciparum
TTSPVS

SEQ ID NO: 3349049 - protein, 16 aa, Plasmodium falciparum
TTSRNKYESHYSNYYV

SEQ ID NO: 3349050 - protein, 6 aa, Plasmodium falciparum
TTSSDP

SEQ ID NO: 3349051 - protein, 7 aa, Plasmodium falciparum
TTSSNLS

SEQ ID NO: 3349052 - protein, 14 aa, Plasmodium falciparum
TTSSNNNNNSNNKI

SEQ ID NO: 3349053 - protein, 23 aa, Plasmodium falciparum
TTSSYLNDTKDNIKGSNNNDNIY

SEQ ID NO: 3349054 - protein, 27 aa, Plasmodium falciparum
TTSTNSYYNENDDIKRQYQNKNSNVNT

SEQ ID NO: 3349055 - protein, 19 aa, Plasmodium falciparum
TTSTSDHISTKSPNSISSL

SEQ ID NO: 3349056 - protein, 23 aa, Plasmodium falciparum
TTSTTHNTYNNNNNNNNSSSSSH

SEQ ID NO: 3349057 - protein, 5 aa, Plasmodium falciparum
TTSYQ

SEQ ID NO: 3349058 - protein, 8 aa, Plasmodium falciparum
TTTGKSVY

SEQ ID NO: 3349059 - protein, 28 aa, Plasmodium falciparum
TTTKNFEEKKEHVDENSKESQKSNEIKK

SEQ ID NO: 3349060 - protein, 7 aa, Plasmodium falciparum
TTTNDTI

SEQ ID NO: 3349061 - protein, 5 aa, Plasmodium falciparum
TTTNM

SEQ ID NO: 3349062 - protein, 11 aa, Plasmodium falciparum
TTTNNDHNEEM

SEQ ID NO: 3349063 - protein, 79 aa, Plasmodium falciparum
TTTNNNDNNKNNDNINNEDNNKNNDNINNDDNNNNDDDNNNNDDDNNNNDDNNKNNDDNNKNNDDKNICKKGRKTNNIK

SEQ ID NO: 3349064 - protein, 10 aa, Plasmodium falciparum
TTTNNNNNMT

SEQ ID NO: 3349065 - protein, 35 aa, Plasmodium falciparum
TTTNNNNNNNNNNNNNNNNNNNNNNNNNNPSSSNL

SEQ ID NO: 3349066 - protein, 29 aa, Plasmodium falciparum
TTTQQLGSTTQSTANENKKIQTATKEQNG

SEQ ID NO: 3349067 - protein, 14 aa, Plasmodium falciparum
TTTRPRRRNPNPYI

SEQ ID NO: 3349068 - protein, 17 aa, Plasmodium falciparum
TTTSGDTTSNEEEYAKE

SEQ ID NO: 3349069 - protein, 20 aa, Plasmodium falciparum
TTTTATNINSCNNNSNNANS

SEQ ID NO: 3349070 - protein, 27 aa, Plasmodium falciparum
TTTTTTTTTNNNNNNNNNNNNTDENIR

SEQ ID NO: 3349071 - protein, 14 aa, Plasmodium falciparum
TTTTTTTTTTTTTN

SEQ ID NO: 3349072 - protein, 4 aa, Plasmodium falciparum
TTTY

SEQ ID NO: 3349073 - protein, 31 aa, Plasmodium falciparum
TTTYNNNNNNNNNNNNNSNNNNNNNNSNNSY

SEQ ID NO: 3349074 - protein, 12 aa, Plasmodium falciparum
TTVNNDLTKSTG

SEQ ID NO: 3349075 - protein, 6 aa, Plasmodium falciparum
TTYEDI

SEQ ID NO: 3349076 - protein, 7 aa, Plasmodium falciparum
TTYGSYK

SEQ ID NO: 3349077 - protein, 10 aa, Plasmodium falciparum
TTYHNSSSYY

SEQ ID NO: 3349078 - protein, 18 aa, Plasmodium falciparum
TTYNNNNNMKEESVVNSK

SEQ ID NO: 3349079 - protein, 6 aa, Plasmodium falciparum
TTYNNS

SEQ ID NO: 3349080 - protein, 4 aa, Plasmodium falciparum
TTYR

SEQ ID NO: 3349081 - protein, 6 aa, Plasmodium falciparum
TTYRNE

SEQ ID NO: 3349082 - protein, 6 aa, Plasmodium falciparum
TTYTHP

SEQ ID NO: 3349083 - protein, 6 aa, Plasmodium falciparum
TVATGQ

SEQ ID NO: 3349084 - protein, 4 aa, Plasmodium falciparum
TVDK

SEQ ID NO: 3349085 - protein, 13 aa, Plasmodium falciparum
TVDNRPLVDRKVW

SEQ ID NO: 3349086 - protein, 7 aa, Plasmodium falciparum
TVDPTGT

SEQ ID NO: 3349087 - protein, 11 aa, Plasmodium falciparum
TVEENKVNQSL

SEQ ID NO: 3349088 - protein, 21 aa, Plasmodium falciparum
TVEKKKDKVKQKSEGSKYTNQ

SEQ ID NO: 3349089 - protein, 65 aa, Plasmodium falciparum
TVENDSHDGSLKKEKNKKKRKNPYNDDNYKGDDKNKSDDDDNYKGDDNNDNNNKYKSDNISSCKK

SEQ ID NO: 3349090 - protein, 5 aa, Plasmodium falciparum
TVEPT

SEQ ID NO: 3349091 - protein, 4 aa, Plasmodium falciparum
TVEV

SEQ ID NO: 3349092 - protein, 4 aa, Plasmodium falciparum
TVGD

SEQ ID NO: 3349093 - protein, 4 aa, Plasmodium falciparum
TVGE

SEQ ID NO: 3349094 - protein, 4 aa, Plasmodium falciparum
TVGS

SEQ ID NO: 3349095 - protein, 9 aa, Plasmodium falciparum
TVGSNTPVK

SEQ ID NO: 3349096 - protein, 18 aa, Plasmodium falciparum
TVKTINKKNRKKKKQNVT

SEQ ID NO: 3349097 - protein, 12 aa, Plasmodium falciparum
TVNKKKNQKYKS

SEQ ID NO: 3349098 - protein, 50 aa, Plasmodium falciparum
TVNNSNDDHKTVNNNNDDHKTVNNNNDDHKTVTNNNNDHKTVNNNNNDEN

SEQ ID NO: 3349099 - protein, 9 aa, Plasmodium falciparum
TVNNTSNYK

SEQ ID NO: 3349100 - protein, 16 aa, Plasmodium falciparum
TVNPKLTQKSTSKNSM

SEQ ID NO: 3349101 - protein, 27 aa, Plasmodium falciparum
TVPKNLEQNNDPSNVSNKSLGKNTYEQ

SEQ ID NO: 3349102 - protein, 7 aa, Plasmodium falciparum
TVPPGRN

SEQ ID NO: 3349103 - protein, 5 aa, Plasmodium falciparum
TVPQD

SEQ ID NO: 3349104 - protein, 9 aa, Plasmodium falciparum
TVPQKEKGW

SEQ ID NO: 3349105 - protein, 14 aa, Plasmodium falciparum
TVQELNQNNPDWSN

SEQ ID NO: 3349106 - protein, 15 aa, Plasmodium falciparum
TVQTSSAISAPTEEV

SEQ ID NO: 3349107 - protein, 4 aa, Plasmodium falciparum
TVQV

SEQ ID NO: 3349108 - protein, 5 aa, Plasmodium falciparum
TVSAP

SEQ ID NO: 3349109 - protein, 12 aa, Plasmodium falciparum
TVSNNDDDDTYN

SEQ ID NO: 3349110 - protein, 6 aa, Plasmodium falciparum
TVSSLN

SEQ ID NO: 3349111 - protein, 15 aa, Plasmodium falciparum
TVSSNSTFTTGSTKS

SEQ ID NO: 3349112 - protein, 24 aa, Plasmodium falciparum
TVTEEEKLDEYEKTKKKQKKQNAN

SEQ ID NO: 3349113 - protein, 6 aa, Plasmodium falciparum
TVTEES

SEQ ID NO: 3349114 - protein, 5 aa, Plasmodium falciparum
TWDNN

SEQ ID NO: 3349115 - protein, 10 aa, Plasmodium falciparum
TWGPDSKNEE

SEQ ID NO: 3349116 - protein, 5 aa, Plasmodium falciparum
TWKSN

SEQ ID NO: 3349117 - protein, 5 aa, Plasmodium falciparum
TWTRD

SEQ ID NO: 3349118 - protein, 4 aa, Plasmodium falciparum
TYAT

SEQ ID NO: 3349119 - protein, 13 aa, Plasmodium falciparum
TYDDNNENTYNEH

SEQ ID NO: 3349120 - protein, 8 aa, Plasmodium falciparum
TYDEKNSK

SEQ ID NO: 3349121 - protein, 13 aa, Plasmodium falciparum
TYDKEGQNGNEMN

SEQ ID NO: 3349122 - protein, 4 aa, Plasmodium falciparum
TYDN

SEQ ID NO: 3349123 - protein, 6 aa, Plasmodium falciparum
TYDNED

SEQ ID NO: 3349124 - protein, 72 aa, Plasmodium falciparum
TYDNNDSNIKKNNTYVEEDDQYKNEEDSNDRRDECVDKNSKEKDHDNKNKNQNQDKNQSQDKYQNEEKNNDI

SEQ ID NO: 3349125 - protein, 8 aa, Plasmodium falciparum
TYDNPETN

SEQ ID NO: 3349126 - protein, 7 aa, Plasmodium falciparum
TYDNQQK

SEQ ID NO: 3349127 - protein, 5 aa, Plasmodium falciparum
TYDPV

SEQ ID NO: 3349128 - protein, 16 aa, Plasmodium falciparum
TYDQKNGNTTSGNTSN

SEQ ID NO: 3349129 - protein, 27 aa, Plasmodium falciparum
TYDSSNNNTCNKNNNDEDVESNNADAL

SEQ ID NO: 3349130 - protein, 4 aa, Plasmodium falciparum
TYDT

SEQ ID NO: 3349131 - protein, 15 aa, Plasmodium falciparum
TYDTNDEKNSTTENS

SEQ ID NO: 3349132 - protein, 12 aa, Plasmodium falciparum
TYDTYKKDEKYP

SEQ ID NO: 3349133 - protein, 5 aa, Plasmodium falciparum
TYDYK

SEQ ID NO: 3349134 - protein, 29 aa, Plasmodium falciparum
TYEDNSDDNYEDKLNNSYNKSKAYEESNN

SEQ ID NO: 3349135 - protein, 6 aa, Plasmodium falciparum
TYEEEA

SEQ ID NO: 3349136 - protein, 4 aa, Plasmodium falciparum
TYEK

SEQ ID NO: 3349137 - protein, 25 aa, Plasmodium falciparum
TYEKDEDNKDQQSDINNDTNRTNNI

SEQ ID NO: 3349138 - protein, 5 aa, Plasmodium falciparum
TYEKE

SEQ ID NO: 3349139 - protein, 8 aa, Plasmodium falciparum
TYEQPISS

SEQ ID NO: 3349140 - protein, 5 aa, Plasmodium falciparum
TYESI

SEQ ID NO: 3349141 - protein, 6 aa, Plasmodium falciparum
TYETNS

SEQ ID NO: 3349142 - protein, 17 aa, Plasmodium falciparum
TYEVGEEDETKEEDEEI

SEQ ID NO: 3349143 - protein, 5 aa, Plasmodium falciparum
TYGAS

SEQ ID NO: 3349144 - protein, 14 aa, Plasmodium falciparum
TYGDNGANVKVIGY

SEQ ID NO: 3349145 - protein, 26 aa, Plasmodium falciparum
TYGDNKNNTSEYNKNDKQTNKEQYRP

SEQ ID NO: 3349146 - protein, 17 aa, Plasmodium falciparum
TYGEEGLKGSIPTGGNT

SEQ ID NO: 3349147 - protein, 11 aa, Plasmodium falciparum
TYGRSNKERKA

SEQ ID NO: 3349148 - protein, 5 aa, Plasmodium falciparum
TYIND

SEQ ID NO: 3349149 - protein, 10 aa, Plasmodium falciparum
TYINNGNNNY

SEQ ID NO: 3349150 - protein, 6 aa, Plasmodium falciparum
TYINNK

SEQ ID NO: 3349151 - protein, 5 aa, Plasmodium falciparum
TYKEY

SEQ ID NO: 3349152 - protein, 5 aa, Plasmodium falciparum
TYKGK

SEQ ID NO: 3349153 - protein, 4 aa, Plasmodium falciparum
TYKK

SEQ ID NO: 3349154 - protein, 10 aa, Plasmodium falciparum
TYKKDKHSLP

SEQ ID NO: 3349155 - protein, 7 aa, Plasmodium falciparum
TYKKKNY

SEQ ID NO: 3349156 - protein, 7 aa, Plasmodium falciparum
TYKKRKQ

SEQ ID NO: 3349157 - protein, 27 aa, Plasmodium falciparum
TYKNKQGDKISNINKNEIKKNKKINDT

SEQ ID NO: 3349158 - protein, 12 aa, Plasmodium falciparum
TYKNPRNSFHDE

SEQ ID NO: 3349159 - protein, 9 aa, Plasmodium falciparum
TYKNSEEHH

SEQ ID NO: 3349160 - protein, 5 aa, Plasmodium falciparum
TYKNY

SEQ ID NO: 3349161 - protein, 8 aa, Plasmodium falciparum
TYKQKEGR

SEQ ID NO: 3349162 - protein, 7 aa, Plasmodium falciparum
TYKSKSF

SEQ ID NO: 3349163 - protein, 10 aa, Plasmodium falciparum
TYMTPPTSVK

SEQ ID NO: 3349164 - protein, 33 aa, Plasmodium falciparum
TYNDNNNDNNNDDDNNNNDSNSGHREEDRYPSD

SEQ ID NO: 3349165 - protein, 17 aa, Plasmodium falciparum
TYNDSYKTNFQRKKDYN

SEQ ID NO: 3349166 - protein, 8 aa, Plasmodium falciparum
TYNDTYSN

SEQ ID NO: 3349167 - protein, 81 aa, Plasmodium falciparum
TYNEKEGNTNDKLNEKGNEKSNEKSNEKSNEKINDKSNEKINEKSNEKSNEKSNDKRVDKYRGDKGNEYIKSDQQTENQKE

SEQ ID NO: 3349168 - protein, 5 aa, Plasmodium falciparum
TYNGK

SEQ ID NO: 3349169 - protein, 9 aa, Plasmodium falciparum
TYNHPNDKS

SEQ ID NO: 3349170 - protein, 12 aa, Plasmodium falciparum
TYNIDSDDEAPC

SEQ ID NO: 3349171 - protein, 6 aa, Plasmodium falciparum
TYNKEK

SEQ ID NO: 3349172 - protein, 9 aa, Plasmodium falciparum
TYNKEKEVK

SEQ ID NO: 3349173 - protein, 37 aa, Plasmodium falciparum
TYNKKKASQYNNNNNDNNNDNNDNNNNNNNDNNNYGN

SEQ ID NO: 3349174 - protein, 5 aa, Plasmodium falciparum
TYNNI

SEQ ID NO: 3349175 - protein, 20 aa, Plasmodium falciparum
TYNNNNNNINNNNNNNNNNF

SEQ ID NO: 3349176 - protein, 39 aa, Plasmodium falciparum
TYNNNSNKTNITDNNSNNNDNNNDNNNNNNNNNNTNYST

SEQ ID NO: 3349177 - protein, 57 aa, Plasmodium falciparum
TYNNSNNNNNNNNNNNNGNNNNNNGNNNNNNGNNNNNNGNNNNNNGNNNNNNGNNNV

SEQ ID NO: 3349178 - protein, 5 aa, Plasmodium falciparum
TYNNY

SEQ ID NO: 3349179 - protein, 6 aa, Plasmodium falciparum
TYNPES

SEQ ID NO: 3349180 - protein, 7 aa, Plasmodium falciparum
TYNPNKK

SEQ ID NO: 3349181 - protein, 11 aa, Plasmodium falciparum
TYNQTDTNAVN

SEQ ID NO: 3349182 - protein, 10 aa, Plasmodium falciparum
TYNSEETTQF

SEQ ID NO: 3349183 - protein, 8 aa, Plasmodium falciparum
TYNSYQNE

SEQ ID NO: 3349184 - protein, 6 aa, Plasmodium falciparum
TYNTNS

SEQ ID NO: 3349185 - protein, 4 aa, Plasmodium falciparum
TYPD

SEQ ID NO: 3349186 - protein, 5 aa, Plasmodium falciparum
TYPID

SEQ ID NO: 3349187 - protein, 8 aa, Plasmodium falciparum
TYPKGTSL

SEQ ID NO: 3349188 - protein, 5 aa, Plasmodium falciparum
TYPKN

SEQ ID NO: 3349189 - protein, 9 aa, Plasmodium falciparum
TYPRENNQI

SEQ ID NO: 3349190 - protein, 6 aa, Plasmodium falciparum
TYPTLS

SEQ ID NO: 3349191 - protein, 4 aa, Plasmodium falciparum
TYQG

SEQ ID NO: 3349192 - protein, 6 aa, Plasmodium falciparum
TYQKST

SEQ ID NO: 3349193 - protein, 13 aa, Plasmodium falciparum
TYQNNTNQKLNDK

SEQ ID NO: 3349194 - protein, 9 aa, Plasmodium falciparum
TYQSDSTHE

SEQ ID NO: 3349195 - protein, 7 aa, Plasmodium falciparum
TYQTNPP

SEQ ID NO: 3349196 - protein, 13 aa, Plasmodium falciparum
TYRNEKEDNITSL

SEQ ID NO: 3349197 - protein, 17 aa, Plasmodium falciparum
TYSDGKKKKEKSNERLK

SEQ ID NO: 3349198 - protein, 9 aa, Plasmodium falciparum
TYSEESGKY

SEQ ID NO: 3349199 - protein, 4 aa, Plasmodium falciparum
TYSH

SEQ ID NO: 3349200 - protein, 7 aa, Plasmodium falciparum
TYSHTSS

SEQ ID NO: 3349201 - protein, 6 aa, Plasmodium falciparum
TYSNEH

SEQ ID NO: 3349202 - protein, 6 aa, Plasmodium falciparum
TYSNNN

SEQ ID NO: 3349203 - protein, 17 aa, Plasmodium falciparum
TYSQHGSYNSHKKNDSP

SEQ ID NO: 3349204 - protein, 27 aa, Plasmodium falciparum
TYSQHYPHNNKQNINNTAISSTTNKNH

SEQ ID NO: 3349205 - protein, 5 aa, Plasmodium falciparum
TYSQI

SEQ ID NO: 3349206 - protein, 4 aa, Plasmodium falciparum
TYSS

SEQ ID NO: 3349207 - protein, 11 aa, Plasmodium falciparum
TYSSLNNNNNN

SEQ ID NO: 3349208 - protein, 14 aa, Plasmodium falciparum
TYSYYSDESNQHTN

SEQ ID NO: 3349209 - protein, 10 aa, Plasmodium falciparum
TYTDNNNNNI

SEQ ID NO: 3349210 - protein, 15 aa, Plasmodium falciparum
TYTHSNEQDNVEGEM

SEQ ID NO: 3349211 - protein, 4 aa, Plasmodium falciparum
TYTK

SEQ ID NO: 3349212 - protein, 4 aa, Plasmodium falciparum
TYTN

SEQ ID NO: 3349213 - protein, 5 aa, Plasmodium falciparum
TYTNC

SEQ ID NO: 3349214 - protein, 9 aa, Plasmodium falciparum
TYTTSESNK

SEQ ID NO: 3349215 - protein, 13 aa, Plasmodium falciparum
TYTTSYTDLFNKF

SEQ ID NO: 3349216 - protein, 6 aa, Plasmodium falciparum
TYVPEN

SEQ ID NO: 3349217 - protein, 8 aa, Plasmodium falciparum
TYYGDNNK

SEQ ID NO: 3349218 - protein, 73 aa, Plasmodium falciparum
VADGSSGGIRGKNKDANRYNNNDDKKNDDNNNDDKKNDDNNNDDKKNDDNNNDDDDNYNGGGVNSVRQNKYGE

SEQ ID NO: 3349219 - protein, 5 aa, Plasmodium falciparum
VADNN

SEQ ID NO: 3349220 - protein, 11 aa, Plasmodium falciparum
VADNVKNKDLE

SEQ ID NO: 3349221 - protein, 9 aa, Plasmodium falciparum
VAEDGSTNN

SEQ ID NO: 3349222 - protein, 8 aa, Plasmodium falciparum
VAEGKVGK

SEQ ID NO: 3349223 - protein, 16 aa, Plasmodium falciparum
VAENNFDDNKMGESAF

SEQ ID NO: 3349224 - protein, 4 aa, Plasmodium falciparum
VAER

SEQ ID NO: 3349225 - protein, 6 aa, Plasmodium falciparum
VAGGDD

SEQ ID NO: 3349226 - protein, 4 aa, Plasmodium falciparum
VAHK

SEQ ID NO: 3349227 - protein, 6 aa, Plasmodium falciparum
VAKIPK

SEQ ID NO: 3349228 - protein, 23 aa, Plasmodium falciparum
VAKNTNVEIDNSAEKNKEGEKNK

SEQ ID NO: 3349229 - protein, 15 aa, Plasmodium falciparum
VAKNTQKLSAQKNSL

SEQ ID NO: 3349230 - protein, 11 aa, Plasmodium falciparum
VAKSGKEDTQH

SEQ ID NO: 3349231 - protein, 16 aa, Plasmodium falciparum
VANKGKEEYNKKKKDI

SEQ ID NO: 3349232 - protein, 6 aa, Plasmodium falciparum
VAPTTG

SEQ ID NO: 3349233 - protein, 11 aa, Plasmodium falciparum
VARTGKTDKYK

SEQ ID NO: 3349234 - protein, 5 aa, Plasmodium falciparum
VASEA

SEQ ID NO: 3349235 - protein, 9 aa, Plasmodium falciparum
VASESLDER

SEQ ID NO: 3349236 - protein, 14 aa, Plasmodium falciparum
VASGGKDKVLKLWS

SEQ ID NO: 3349237 - protein, 4 aa, Plasmodium falciparum
VASN

SEQ ID NO: 3349238 - protein, 5 aa, Plasmodium falciparum
VASNN

SEQ ID NO: 3349239 - protein, 10 aa, Plasmodium falciparum
VASSRTTKRK

SEQ ID NO: 3349240 - protein, 4 aa, Plasmodium falciparum
VATD

SEQ ID NO: 3349241 - protein, 12 aa, Plasmodium falciparum
VAVETNKEKINE

SEQ ID NO: 3349242 - protein, 4 aa, Plasmodium falciparum
VAYN

SEQ ID NO: 3349243 - protein, 5 aa, Plasmodium falciparum
VCGEG

SEQ ID NO: 3349244 - protein, 24 aa, Plasmodium falciparum
VCKDDDDKKRYTLEDNNNNNNNIE

SEQ ID NO: 3349245 - protein, 23 aa, Plasmodium falciparum
VDADGEINKNNAENINKKEKLPR

SEQ ID NO: 3349246 - protein, 9 aa, Plasmodium falciparum
VDADTKKNM

SEQ ID NO: 3349247 - protein, 7 aa, Plasmodium falciparum
VDAKNEL

SEQ ID NO: 3349248 - protein, 7 aa, Plasmodium falciparum
VDDDINN

SEQ ID NO: 3349249 - protein, 9 aa, Plasmodium falciparum
VDDDKGEGM

SEQ ID NO: 3349250 - protein, 40 aa, Plasmodium falciparum
VDDEKYEEITKETKNVQKVQDEKNKDNEKSINKNTNKLNE

SEQ ID NO: 3349251 - protein, 15 aa, Plasmodium falciparum
VDDENKKRVKKRKSS

SEQ ID NO: 3349252 - protein, 12 aa, Plasmodium falciparum
VDDENKSKPNIN

SEQ ID NO: 3349253 - protein, 78 aa, Plasmodium falciparum
VDDESSNQNISNEKKNKEKKIKNNKNKNDDDDDNDDDDDNDDNDDNDNNDDNDNNDDNDNNDDNDNNDDNDDNDNNDD

SEQ ID NO: 3349254 - protein, 18 aa, Plasmodium falciparum
VDDKNNVTTQEGKNNINE

SEQ ID NO: 3349255 - protein, 7 aa, Plasmodium falciparum
VDDKSDM

SEQ ID NO: 3349256 - protein, 12 aa, Plasmodium falciparum
VDDNADKIKEKQ

SEQ ID NO: 3349257 - protein, 15 aa, Plasmodium falciparum
VDDNNHKDDTKKKIY

SEQ ID NO: 3349258 - protein, 6 aa, Plasmodium falciparum
VDDPTD

SEQ ID NO: 3349259 - protein, 33 aa, Plasmodium falciparum
VDEAKGGVQGTEGRVKPNGQTAEGSQSHPVSSA

SEQ ID NO: 3349260 - protein, 7 aa, Plasmodium falciparum
VDEASGS

SEQ ID NO: 3349261 - protein, 8 aa, Plasmodium falciparum
VDEDVSNE

SEQ ID NO: 3349262 - protein, 4 aa, Plasmodium falciparum
VDEE

SEQ ID NO: 3349263 - protein, 7 aa, Plasmodium falciparum
VDEEDEL

SEQ ID NO: 3349264 - protein, 12 aa, Plasmodium falciparum
VDEEDKYSEECK

SEQ ID NO: 3349265 - protein, 6 aa, Plasmodium falciparum
VDEENK

SEQ ID NO: 3349266 - protein, 13 aa, Plasmodium falciparum
VDEKDEKKNKPVE

SEQ ID NO: 3349267 - protein, 10 aa, Plasmodium falciparum
VDEKENNNIN

SEQ ID NO: 3349268 - protein, 16 aa, Plasmodium falciparum
VDEKESISLDGTGRSA

SEQ ID NO: 3349269 - protein, 5 aa, Plasmodium falciparum
VDEKK

SEQ ID NO: 3349270 - protein, 12 aa, Plasmodium falciparum
VDEKKKKNDINN

SEQ ID NO: 3349271 - protein, 50 aa, Plasmodium falciparum
VDEKNESDEKNEVDEKNEGGEKNVDEKNEGGEKNVDEKNEGDEKNITNQN

SEQ ID NO: 3349272 - protein, 6 aa, Plasmodium falciparum
VDENER

SEQ ID NO: 3349273 - protein, 9 aa, Plasmodium falciparum
VDENKDDDN

SEQ ID NO: 3349274 - protein, 6 aa, Plasmodium falciparum
VDENNG

SEQ ID NO: 3349275 - protein, 9 aa, Plasmodium falciparum
VDEPNNGSS

SEQ ID NO: 3349276 - protein, 6 aa, Plasmodium falciparum
VDESIK

SEQ ID NO: 3349277 - protein, 7 aa, Plasmodium falciparum
VDESSDI

SEQ ID NO: 3349278 - protein, 10 aa, Plasmodium falciparum
VDETNKRKVQ

SEQ ID NO: 3349279 - protein, 7 aa, Plasmodium falciparum
VDETYPD

SEQ ID NO: 3349280 - protein, 4 aa, Plasmodium falciparum
VDGC

SEQ ID NO: 3349281 - protein, 7 aa, Plasmodium falciparum
VDGEKSI

SEQ ID NO: 3349282 - protein, 16 aa, Plasmodium falciparum
VDGGKRKKDDGLTDTC

SEQ ID NO: 3349283 - protein, 6 aa, Plasmodium falciparum
VDGKED

SEQ ID NO: 3349284 - protein, 10 aa, Plasmodium falciparum
VDGKGNEEQR

SEQ ID NO: 3349285 - protein, 24 aa, Plasmodium falciparum
VDGKNVDGKNVDGKNVDGKNVDEK

SEQ ID NO: 3349286 - protein, 12 aa, Plasmodium falciparum
VDGKNVNDVGGE

SEQ ID NO: 3349287 - protein, 6 aa, Plasmodium falciparum
VDGMDK

SEQ ID NO: 3349288 - protein, 20 aa, Plasmodium falciparum
VDGNNKNDPIDNNNNNDNDN

SEQ ID NO: 3349289 - protein, 19 aa, Plasmodium falciparum
VDGNNVNYTNSVNDTNSVN

SEQ ID NO: 3349290 - protein, 6 aa, Plasmodium falciparum
VDGQKR

SEQ ID NO: 3349291 - protein, 106 aa, Plasmodium falciparum
VDGSNKKYVDGGNKKYVDGGNKKYVDGSNKKYVDGSNRKYVDGGNKKYVDGSSKKYVDGGNKKYVDGSSKKYVDEGNKKYVDGGNKKYVDGGNKKYVDGRDKKYNH

SEQ ID NO: 3349292 - protein, 4 aa, Plasmodium falciparum
VDHM

SEQ ID NO: 3349293 - protein, 10 aa, Plasmodium falciparum
VDHSNENNIG

SEQ ID NO: 3349294 - protein, 7 aa, Plasmodium falciparum
VDHTTRK

SEQ ID NO: 3349295 - protein, 14 aa, Plasmodium falciparum
VDINEKKNGNSKDL

SEQ ID NO: 3349296 - protein, 21 aa, Plasmodium falciparum
VDINPSRQHPLDTKEVNNNSD

SEQ ID NO: 3349297 - protein, 11 aa, Plasmodium falciparum
VDKEDELDAEE

SEQ ID NO: 3349298 - protein, 10 aa, Plasmodium falciparum
VDKEEEKKEW

SEQ ID NO: 3349299 - protein, 11 aa, Plasmodium falciparum
VDKESVEYDNS

SEQ ID NO: 3349300 - protein, 6 aa, Plasmodium falciparum
VDKEYT

SEQ ID NO: 3349301 - protein, 7 aa, Plasmodium falciparum
VDKKDLE

SEQ ID NO: 3349302 - protein, 10 aa, Plasmodium falciparum
VDKKENDMYD

SEQ ID NO: 3349303 - protein, 39 aa, Plasmodium falciparum
VDKKKGEEKKKDLISKKNKNKDNSPNNNNKNNDKNNIKN

SEQ ID NO: 3349304 - protein, 30 aa, Plasmodium falciparum
VDKKNEKKENCTNNNDNVGKNTNTNGNGEG

SEQ ID NO: 3349305 - protein, 9 aa, Plasmodium falciparum
VDKKTNNLK

SEQ ID NO: 3349306 - protein, 8 aa, Plasmodium falciparum
VDKNRNND

SEQ ID NO: 3349307 - protein, 12 aa, Plasmodium falciparum
VDKRDNKLKLKD

SEQ ID NO: 3349308 - protein, 9 aa, Plasmodium falciparum
VDKSDKKDN

SEQ ID NO: 3349309 - protein, 20 aa, Plasmodium falciparum
VDKTNDYKYHSEKKKKNNVI

SEQ ID NO: 3349310 - protein, 37 aa, Plasmodium falciparum
VDKTNNHNNNHSNNQSSENNGYSNGSHSSDLSLENPT

SEQ ID NO: 3349311 - protein, 7 aa, Plasmodium falciparum
VDKYKDD

SEQ ID NO: 3349312 - protein, 6 aa, Plasmodium falciparum
VDLNND

SEQ ID NO: 3349313 - protein, 4 aa, Plasmodium falciparum
VDND

SEQ ID NO: 3349314 - protein, 12 aa, Plasmodium falciparum
VDNDDDNNSNML

SEQ ID NO: 3349315 - protein, 14 aa, Plasmodium falciparum
VDNDKRNNDINSNN

SEQ ID NO: 3349316 - protein, 5 aa, Plasmodium falciparum
VDNEE

SEQ ID NO: 3349317 - protein, 10 aa, Plasmodium falciparum
VDNEEEESIE

SEQ ID NO: 3349318 - protein, 34 aa, Plasmodium falciparum
VDNEEINDEPNKNNKKKCENINSSNEDEKEHEEP

SEQ ID NO: 3349319 - protein, 10 aa, Plasmodium falciparum
VDNGKRKKKP

SEQ ID NO: 3349320 - protein, 8 aa, Plasmodium falciparum
VDNGSDNM

SEQ ID NO: 3349321 - protein, 15 aa, Plasmodium falciparum
VDNKENDKKDDGCCG

SEQ ID NO: 3349322 - protein, 7 aa, Plasmodium falciparum
VDNKNAD

SEQ ID NO: 3349323 - protein, 9 aa, Plasmodium falciparum
VDNKSTNED

SEQ ID NO: 3349324 - protein, 7 aa, Plasmodium falciparum
VDNNEQV

SEQ ID NO: 3349325 - protein, 5 aa, Plasmodium falciparum
VDNNK

SEQ ID NO: 3349326 - protein, 6 aa, Plasmodium falciparum
VDNNQN

SEQ ID NO: 3349327 - protein, 5 aa, Plasmodium falciparum
VDNNY

SEQ ID NO: 3349328 - protein, 4 aa, Plasmodium falciparum
VDNP

SEQ ID NO: 3349329 - protein, 59 aa, Plasmodium falciparum
VDNPNIKDDKSSISEDENTSSGHNKDIDSQYTYNTTKMSKSDKVDNTENIKNSENINNK

SEQ ID NO: 3349330 - protein, 7 aa, Plasmodium falciparum
VDNSDNL

SEQ ID NO: 3349331 - protein, 12 aa, Plasmodium falciparum
VDNSEEKLRTQM

SEQ ID NO: 3349332 - protein, 10 aa, Plasmodium falciparum
VDNSYAENKW

SEQ ID NO: 3349333 - protein, 8 aa, Plasmodium falciparum
VDNTDDSL

SEQ ID NO: 3349334 - protein, 10 aa, Plasmodium falciparum
VDNTNEEPKD

SEQ ID NO: 3349335 - protein, 35 aa, Plasmodium falciparum
VDNTNGEDNTNDVDNTNDEDNTNDEDNTNDGDNEQ

SEQ ID NO: 3349336 - protein, 7 aa, Plasmodium falciparum
VDNTNKL

SEQ ID NO: 3349337 - protein, 9 aa, Plasmodium falciparum
VDNTNKQDF

SEQ ID NO: 3349338 - protein, 13 aa, Plasmodium falciparum
VDNVEKKEKIKNN

SEQ ID NO: 3349339 - protein, 6 aa, Plasmodium falciparum
VDPKGL

SEQ ID NO: 3349340 - protein, 7 aa, Plasmodium falciparum
VDPKHER

SEQ ID NO: 3349341 - protein, 4 aa, Plasmodium falciparum
VDPP

SEQ ID NO: 3349342 - protein, 6 aa, Plasmodium falciparum
VDPSKG

SEQ ID NO: 3349343 - protein, 6 aa, Plasmodium falciparum
VDPTGS

SEQ ID NO: 3349344 - protein, 11 aa, Plasmodium falciparum
VDQGGGKRKGS

SEQ ID NO: 3349345 - protein, 9 aa, Plasmodium falciparum
VDQKTGKNL

SEQ ID NO: 3349346 - protein, 9 aa, Plasmodium falciparum
VDQNNDGEI

SEQ ID NO: 3349347 - protein, 5 aa, Plasmodium falciparum
VDQTE

SEQ ID NO: 3349348 - protein, 5 aa, Plasmodium falciparum
VDRDE

SEQ ID NO: 3349349 - protein, 30 aa, Plasmodium falciparum
VDRNEQKDQTNQQKDQTNEQKNQPSQQNEQ

SEQ ID NO: 3349350 - protein, 14 aa, Plasmodium falciparum
VDRNKESNEKEKRV

SEQ ID NO: 3349351 - protein, 6 aa, Plasmodium falciparum
VDRQNL

SEQ ID NO: 3349352 - protein, 4 aa, Plasmodium falciparum
VDSD

SEQ ID NO: 3349353 - protein, 74 aa, Plasmodium falciparum
VDSFDEDDSYDEDDSCDEDNSCDEDNSCGEVNSCGEDDSYDEDDSYDEDDSYDEDNSYDEDNSYDEDNRCGEKL

SEQ ID NO: 3349354 - protein, 4 aa, Plasmodium falciparum
VDSG

SEQ ID NO: 3349355 - protein, 13 aa, Plasmodium falciparum
VDSKEQKTNDEKV

SEQ ID NO: 3349356 - protein, 7 aa, Plasmodium falciparum
VDSKGYG

SEQ ID NO: 3349357 - protein, 6 aa, Plasmodium falciparum
VDSKNI

SEQ ID NO: 3349358 - protein, 30 aa, Plasmodium falciparum
VDSMKSRKEENNPKGFKKDNRKRRKPKYRF

SEQ ID NO: 3349359 - protein, 15 aa, Plasmodium falciparum
VDSNEDNDKSEKDVL

SEQ ID NO: 3349360 - protein, 22 aa, Plasmodium falciparum
VDSNEKSNDEKNNSVQGHNTEQ

SEQ ID NO: 3349361 - protein, 7 aa, Plasmodium falciparum
VDSNNDG

SEQ ID NO: 3349362 - protein, 12 aa, Plasmodium falciparum
VDSNNKNYSSYN

SEQ ID NO: 3349363 - protein, 18 aa, Plasmodium falciparum
VDSNNNMDCSNKDNNKID

SEQ ID NO: 3349364 - protein, 4 aa, Plasmodium falciparum
VDSP

SEQ ID NO: 3349365 - protein, 7 aa, Plasmodium falciparum
VDSTAKP

SEQ ID NO: 3349366 - protein, 4 aa, Plasmodium falciparum
VDTF

SEQ ID NO: 3349367 - protein, 23 aa, Plasmodium falciparum
VDTKLEDDKKKNKKKKKNNSMNN

SEQ ID NO: 3349368 - protein, 7 aa, Plasmodium falciparum
VDTKQNY

SEQ ID NO: 3349369 - protein, 13 aa, Plasmodium falciparum
VDTNDDDTNDLDI

SEQ ID NO: 3349370 - protein, 8 aa, Plasmodium falciparum
VDTNKQEK

SEQ ID NO: 3349371 - protein, 9 aa, Plasmodium falciparum
VDTNPAEGY

SEQ ID NO: 3349372 - protein, 12 aa, Plasmodium falciparum
VDTQNINNNSKN

SEQ ID NO: 3349373 - protein, 158 aa, Plasmodium falciparum
VDTSENEDDKEDDDDDEDDDDDDDDDDDEDDDDEDDDDDDDDDDDDDDDDDEDDDDDDDDDEDDDDEDDEDDDDDDEDDDDDFDDMDEDDDDDDDDDEDDDDEEDYDDDDDDDDDDDEDDDEDDDEDDDDENDQNEYAGDDKKDEDGDAKKGSDDEGF

SEQ ID NO: 3349374 - protein, 8 aa, Plasmodium falciparum
VDTSEYKD

SEQ ID NO: 3349375 - protein, 8 aa, Plasmodium falciparum
VDTSGTLE

SEQ ID NO: 3349376 - protein, 10 aa, Plasmodium falciparum
VDTSQYNNDN

SEQ ID NO: 3349377 - protein, 8 aa, Plasmodium falciparum
VDTSTPKY

SEQ ID NO: 3349378 - protein, 4 aa, Plasmodium falciparum
VDTT

SEQ ID NO: 3349379 - protein, 5 aa, Plasmodium falciparum
VDYDY

SEQ ID NO: 3349380 - protein, 9 aa, Plasmodium falciparum
VDYGKRREI

SEQ ID NO: 3349381 - protein, 8 aa, Plasmodium falciparum
VDYNDKEH

SEQ ID NO: 3349382 - protein, 5 aa, Plasmodium falciparum
VEANI

SEQ ID NO: 3349383 - protein, 13 aa, Plasmodium falciparum
VEAYNNNNNYNNV

SEQ ID NO: 3349384 - protein, 4 aa, Plasmodium falciparum
VEDD

SEQ ID NO: 3349385 - protein, 8 aa, Plasmodium falciparum
VEDDKNND

SEQ ID NO: 3349386 - protein, 9 aa, Plasmodium falciparum
VEDDNNKKN

SEQ ID NO: 3349387 - protein, 8 aa, Plasmodium falciparum
VEDDTLDE

SEQ ID NO: 3349388 - protein, 10 aa, Plasmodium falciparum
VEDEEKSKEG

SEQ ID NO: 3349389 - protein, 10 aa, Plasmodium falciparum
VEDEKNKDIP

SEQ ID NO: 3349390 - protein, 12 aa, Plasmodium falciparum
VEDENEEEYEEY

SEQ ID NO: 3349391 - protein, 7 aa, Plasmodium falciparum
VEDINKE

SEQ ID NO: 3349392 - protein, 5 aa, Plasmodium falciparum
VEDKD

SEQ ID NO: 3349393 - protein, 14 aa, Plasmodium falciparum
VEDKESDINNVQNK

SEQ ID NO: 3349394 - protein, 6 aa, Plasmodium falciparum
VEDNEK

SEQ ID NO: 3349395 - protein, 6 aa, Plasmodium falciparum
VEDNNM

SEQ ID NO: 3349396 - protein, 21 aa, Plasmodium falciparum
VEDNNNNNNNNKETNKKKSTT

SEQ ID NO: 3349397 - protein, 4 aa, Plasmodium falciparum
VEDR

SEQ ID NO: 3349398 - protein, 8 aa, Plasmodium falciparum
VEDSNKHL

SEQ ID NO: 3349399 - protein, 6 aa, Plasmodium falciparum
VEDSNY

SEQ ID NO: 3349400 - protein, 12 aa, Plasmodium falciparum
VEDTDSNKKNTD

SEQ ID NO: 3349401 - protein, 7 aa, Plasmodium falciparum
VEDVRKE

SEQ ID NO: 3349402 - protein, 7 aa, Plasmodium falciparum
VEDYTTH

SEQ ID NO: 3349403 - protein, 5 aa, Plasmodium falciparum
VEEAE

SEQ ID NO: 3349404 - protein, 28 aa, Plasmodium falciparum
VEEDEERHKKKRKKEKEERGKHKKKKSI

SEQ ID NO: 3349405 - protein, 12 aa, Plasmodium falciparum
VEEDEKTVDDIN

SEQ ID NO: 3349406 - protein, 7 aa, Plasmodium falciparum
VEEDKYS

SEQ ID NO: 3349407 - protein, 4 aa, Plasmodium falciparum
VEEE

SEQ ID NO: 3349408 - protein, 10 aa, Plasmodium falciparum
VEEEEDIKKT

SEQ ID NO: 3349409 - protein, 13 aa, Plasmodium falciparum
VEEEKKKKKNMEE

SEQ ID NO: 3349410 - protein, 6 aa, Plasmodium falciparum
VEEEYD

SEQ ID NO: 3349411 - protein, 5 aa, Plasmodium falciparum
VEEGD

SEQ ID NO: 3349412 - protein, 17 aa, Plasmodium falciparum
VEEGEERKREYSEDEIK

SEQ ID NO: 3349413 - protein, 7 aa, Plasmodium falciparum
VEEGNKK

SEQ ID NO: 3349414 - protein, 27 aa, Plasmodium falciparum
VEEHTADDEHVEEPTVADDEHVEEPTV

SEQ ID NO: 3349415 - protein, 6 aa, Plasmodium falciparum
VEEKDQ

SEQ ID NO: 3349416 - protein, 17 aa, Plasmodium falciparum
VEEKEKNENSIGNAEEE

SEQ ID NO: 3349417 - protein, 19 aa, Plasmodium falciparum
VEEKRDKDILKGKGESPFQ

SEQ ID NO: 3349418 - protein, 6 aa, Plasmodium falciparum
VEENDQ

SEQ ID NO: 3349419 - protein, 22 aa, Plasmodium falciparum
VEENHDTHSKGDKENNGVSTKN

SEQ ID NO: 3349420 - protein, 11 aa, Plasmodium falciparum
VEENKPASHKN

SEQ ID NO: 3349421 - protein, 11 aa, Plasmodium falciparum
VEENNDDETKI

SEQ ID NO: 3349422 - protein, 11 aa, Plasmodium falciparum
VEENNESINTL

SEQ ID NO: 3349423 - protein, 7 aa, Plasmodium falciparum
VEENNQK

SEQ ID NO: 3349424 - protein, 10 aa, Plasmodium falciparum
VEENTEDEKA

SEQ ID NO: 3349425 - protein, 10 aa, Plasmodium falciparum
VEERGKRNYD

SEQ ID NO: 3349426 - protein, 7 aa, Plasmodium falciparum
VEETEQE

SEQ ID NO: 3349427 - protein, 4 aa, Plasmodium falciparum
VEEV

SEQ ID NO: 3349428 - protein, 16 aa, Plasmodium falciparum
VEFGRQKEKRGNQGED

SEQ ID NO: 3349429 - protein, 4 aa, Plasmodium falciparum
VEGD

SEQ ID NO: 3349430 - protein, 22 aa, Plasmodium falciparum
VEGKDNENLDDFNDKDKRNNNK

SEQ ID NO: 3349431 - protein, 4 aa, Plasmodium falciparum
VEGN

SEQ ID NO: 3349432 - protein, 6 aa, Plasmodium falciparum
VEGNCD

SEQ ID NO: 3349433 - protein, 14 aa, Plasmodium falciparum
VEGNTNDDDQNNGI

SEQ ID NO: 3349434 - protein, 4 aa, Plasmodium falciparum
VEGQ

SEQ ID NO: 3349435 - protein, 59 aa, Plasmodium falciparum
VEGSNNKSKDTNNQELKDSNENNNNNNDVENDNFNDSSFSYKGQKNYNSKNKSNTSINN

SEQ ID NO: 3349436 - protein, 11 aa, Plasmodium falciparum
VEGSSSNSLSS

SEQ ID NO: 3349437 - protein, 5 aa, Plasmodium falciparum
VEHNN

SEQ ID NO: 3349438 - protein, 27 aa, Plasmodium falciparum
VEHNNNNMDGTNNSNMNYSNNEGSNIA

SEQ ID NO: 3349439 - protein, 8 aa, Plasmodium falciparum
VEIPKNTE

SEQ ID NO: 3349440 - protein, 4 aa, Plasmodium falciparum
VEKD

SEQ ID NO: 3349441 - protein, 8 aa, Plasmodium falciparum
VEKDENEI

SEQ ID NO: 3349442 - protein, 8 aa, Plasmodium falciparum
VEKEEPNV

SEQ ID NO: 3349443 - protein, 7 aa, Plasmodium falciparum
VEKEKEN

SEQ ID NO: 3349444 - protein, 6 aa, Plasmodium falciparum
VEKEMP

SEQ ID NO: 3349445 - protein, 19 aa, Plasmodium falciparum
VEKENCNDTIEGEESNHNM

SEQ ID NO: 3349446 - protein, 36 aa, Plasmodium falciparum
VEKENDQYDEKRSIQYNGNSYDKSYSYYSDRAQKDI

SEQ ID NO: 3349447 - protein, 10 aa, Plasmodium falciparum
VEKEPKPNVQ

SEQ ID NO: 3349448 - protein, 11 aa, Plasmodium falciparum
VEKEQKKKDGI

SEQ ID NO: 3349449 - protein, 7 aa, Plasmodium falciparum
VEKKGTQ

SEQ ID NO: 3349450 - protein, 9 aa, Plasmodium falciparum
VEKKKDEIL

SEQ ID NO: 3349451 - protein, 11 aa, Plasmodium falciparum
VEKKNKQNLPN

SEQ ID NO: 3349452 - protein, 7 aa, Plasmodium falciparum
VEKKNSF

SEQ ID NO: 3349453 - protein, 32 aa, Plasmodium falciparum
VEKKQESNKEDSTTNKITKNNSVNNKDNENID

SEQ ID NO: 3349454 - protein, 15 aa, Plasmodium falciparum
VEKLSSSSSSTLDTS

SEQ ID NO: 3349455 - protein, 12 aa, Plasmodium falciparum
VEKNDDENIDNK

SEQ ID NO: 3349456 - protein, 16 aa, Plasmodium falciparum
VEKNEKNKKNKERTHV

SEQ ID NO: 3349457 - protein, 30 aa, Plasmodium falciparum
VEKNMKETSNHKNDIEQNNSSNYSNNNNNN

SEQ ID NO: 3349458 - protein, 14 aa, Plasmodium falciparum
VEKNNIEKNVNNDN

SEQ ID NO: 3349459 - protein, 11 aa, Plasmodium falciparum
VEKNNKDQRNY

SEQ ID NO: 3349460 - protein, 5 aa, Plasmodium falciparum
VEKNR

SEQ ID NO: 3349461 - protein, 8 aa, Plasmodium falciparum
VEKNSPNY

SEQ ID NO: 3349462 - protein, 22 aa, Plasmodium falciparum
VEKPTDQKSEKMKRRGRKKGSM

SEQ ID NO: 3349463 - protein, 12 aa, Plasmodium falciparum
VEKSAESKKADK

SEQ ID NO: 3349464 - protein, 56 aa, Plasmodium falciparum
VEKSEEEKCNNNNNNNNNSDDNNNNNNNSDNNNNSNHFSNNNNNHFSNNEQRDNMN

SEQ ID NO: 3349465 - protein, 4 aa, Plasmodium falciparum
VEKT

SEQ ID NO: 3349466 - protein, 33 aa, Plasmodium falciparum
VEKTQQKQDNEKDKEKENNNSYVNQDGNNTEQH

SEQ ID NO: 3349467 - protein, 9 aa, Plasmodium falciparum
VEKYNTNKK

SEQ ID NO: 3349468 - protein, 30 aa, Plasmodium falciparum
VELPDTQKKCNSSCKKDNPNNDKNEELELK

SEQ ID NO: 3349469 - protein, 5 aa, Plasmodium falciparum
VEMDD

SEQ ID NO: 3349470 - protein, 4 aa, Plasmodium falciparum
VENC

SEQ ID NO: 3349471 - protein, 12 aa, Plasmodium falciparum
VENDPAEEDELN

SEQ ID NO: 3349472 - protein, 20 aa, Plasmodium falciparum
VENDVSHEKIDEDEEEDVET

SEQ ID NO: 3349473 - protein, 59 aa, Plasmodium falciparum
VENENLNKNEQKGKMNKMKTKTQRFNKEEQNETNNFTNNNKKGSNRYQQNKKGQFKNSN

SEQ ID NO: 3349474 - protein, 9 aa, Plasmodium falciparum
VENGEVQAN

SEQ ID NO: 3349475 - protein, 13 aa, Plasmodium falciparum
VENIENKNNQSNF

SEQ ID NO: 3349476 - protein, 34 aa, Plasmodium falciparum
VENKEENKEENKEENKEENKEENKEGDINKDSNN

SEQ ID NO: 3349477 - protein, 9 aa, Plasmodium falciparum
VENNMNSGR

SEQ ID NO: 3349478 - protein, 11 aa, Plasmodium falciparum
VENNSSLNKTL

SEQ ID NO: 3349479 - protein, 9 aa, Plasmodium falciparum
VENQDDVNN

SEQ ID NO: 3349480 - protein, 15 aa, Plasmodium falciparum
VENSKTEQYEEYQNK

SEQ ID NO: 3349481 - protein, 11 aa, Plasmodium falciparum
VENSPHSPRMK

SEQ ID NO: 3349482 - protein, 8 aa, Plasmodium falciparum
VENSSPVH

SEQ ID NO: 3349483 - protein, 11 aa, Plasmodium falciparum
VEPQVVSGSQD

SEQ ID NO: 3349484 - protein, 8 aa, Plasmodium falciparum
VEPRGNNK

SEQ ID NO: 3349485 - protein, 7 aa, Plasmodium falciparum
VEPSPDQ

SEQ ID NO: 3349486 - protein, 5 aa, Plasmodium falciparum
VEPSS

SEQ ID NO: 3349487 - protein, 4 aa, Plasmodium falciparum
VEPT

SEQ ID NO: 3349488 - protein, 10 aa, Plasmodium falciparum
VEQHSNNQKC

SEQ ID NO: 3349489 - protein, 5 aa, Plasmodium falciparum
VEQKH

SEQ ID NO: 3349490 - protein, 5 aa, Plasmodium falciparum
VEQKN

SEQ ID NO: 3349491 - protein, 7 aa, Plasmodium falciparum
VEQKSNA

SEQ ID NO: 3349492 - protein, 11 aa, Plasmodium falciparum
VEQNDNNIESV

SEQ ID NO: 3349493 - protein, 50 aa, Plasmodium falciparum
VEQNKNIEQNKNIEQNKNIEQNKNIEQNKNIEQNKNIEQNTNIEQNTNVE

SEQ ID NO: 3349494 - protein, 17 aa, Plasmodium falciparum
VEQNLNEKNENDQTNKI

SEQ ID NO: 3349495 - protein, 5 aa, Plasmodium falciparum
VEQNN

SEQ ID NO: 3349496 - protein, 75 aa, Plasmodium falciparum
VEQQDNNVENNNNNNNNNNDNNNNNNNNNNNNNNNNKEDEEDGKIQSGDTITKTTDGNVGTGHNTSHSLNQSKEK

SEQ ID NO: 3349497 - protein, 17 aa, Plasmodium falciparum
VEQTTQELSDVKESSQI

SEQ ID NO: 3349498 - protein, 6 aa, Plasmodium falciparum
VERDCN

SEQ ID NO: 3349499 - protein, 8 aa, Plasmodium falciparum
VERDTYDE

SEQ ID NO: 3349500 - protein, 79 aa, Plasmodium falciparum
VEREKTKKKTDMINNDNKNDSNNYDNNNDSNNYDNNNDSNNYDNKNDSNNYDNNNDSNNYDNKNDSNNYDNKNDSNNYD

SEQ ID NO: 3349501 - protein, 10 aa, Plasmodium falciparum
VERGNEMNNK

SEQ ID NO: 3349502 - protein, 6 aa, Plasmodium falciparum
VERNNN

SEQ ID NO: 3349503 - protein, 5 aa, Plasmodium falciparum
VESAP

SEQ ID NO: 3349504 - protein, 8 aa, Plasmodium falciparum
VESEKHGR

SEQ ID NO: 3349505 - protein, 7 aa, Plasmodium falciparum
VESKANE

SEQ ID NO: 3349506 - protein, 6 aa, Plasmodium falciparum
VESKNT

SEQ ID NO: 3349507 - protein, 9 aa, Plasmodium falciparum
VESKSNSDI

SEQ ID NO: 3349508 - protein, 9 aa, Plasmodium falciparum
VESNNSGVS

SEQ ID NO: 3349509 - protein, 5 aa, Plasmodium falciparum
VESPD

SEQ ID NO: 3349510 - protein, 19 aa, Plasmodium falciparum
VESSAQDETNEAKSDDSKM

SEQ ID NO: 3349511 - protein, 9 aa, Plasmodium falciparum
VESSSKEEA

SEQ ID NO: 3349512 - protein, 10 aa, Plasmodium falciparum
VETCTSSSKK

SEQ ID NO: 3349513 - protein, 11 aa, Plasmodium falciparum
VETEKRNLKSN

SEQ ID NO: 3349514 - protein, 12 aa, Plasmodium falciparum
VETKENESSNNE

SEQ ID NO: 3349515 - protein, 7 aa, Plasmodium falciparum
VETKSDI

SEQ ID NO: 3349516 - protein, 4 aa, Plasmodium falciparum
VETN

SEQ ID NO: 3349517 - protein, 8 aa, Plasmodium falciparum
VETNNPIK

SEQ ID NO: 3349518 - protein, 32 aa, Plasmodium falciparum
VETQNENDKRNEKKEEDDDEDVDEAEEKEEEG

SEQ ID NO: 3349519 - protein, 6 aa, Plasmodium falciparum
VETSKP

SEQ ID NO: 3349520 - protein, 13 aa, Plasmodium falciparum
VETYNEKKKLKEK

SEQ ID NO: 3349521 - protein, 5 aa, Plasmodium falciparum
VEYKK

SEQ ID NO: 3349522 - protein, 8 aa, Plasmodium falciparum
VEYRKKRK

SEQ ID NO: 3349523 - protein, 9 aa, Plasmodium falciparum
VEYSNKNKK

SEQ ID NO: 3349524 - protein, 5 aa, Plasmodium falciparum
VFPPE

SEQ ID NO: 3349525 - protein, 20 aa, Plasmodium falciparum
VFPSNSTTSCNDNSNNDDIN

SEQ ID NO: 3349526 - protein, 7 aa, Plasmodium falciparum
VGDGNEK

SEQ ID NO: 3349527 - protein, 7 aa, Plasmodium falciparum
VGDIPPP

SEQ ID NO: 3349528 - protein, 7 aa, Plasmodium falciparum
VGDKTSN

SEQ ID NO: 3349529 - protein, 13 aa, Plasmodium falciparum
VGDLSKENTLDKE

SEQ ID NO: 3349530 - protein, 24 aa, Plasmodium falciparum
VGDNKYDKKKNYKKNNDDTNGVGY

SEQ ID NO: 3349531 - protein, 8 aa, Plasmodium falciparum
VGDNNNNN

SEQ ID NO: 3349532 - protein, 18 aa, Plasmodium falciparum
VGDQENSVYTSKKSYDKN

SEQ ID NO: 3349533 - protein, 10 aa, Plasmodium falciparum
VGDSSKGKED

SEQ ID NO: 3349534 - protein, 12 aa, Plasmodium falciparum
VGDVKDAYNEEN

SEQ ID NO: 3349535 - protein, 8 aa, Plasmodium falciparum
VGEDSNNM

SEQ ID NO: 3349536 - protein, 17 aa, Plasmodium falciparum
VGEEEIEHDEEKTKDDE

SEQ ID NO: 3349537 - protein, 23 aa, Plasmodium falciparum
VGEEVEEEVEEEVQGNIEEGDEE

SEQ ID NO: 3349538 - protein, 6 aa, Plasmodium falciparum
VGEGGT

SEQ ID NO: 3349539 - protein, 11 aa, Plasmodium falciparum
VGEHNKRENED

SEQ ID NO: 3349540 - protein, 29 aa, Plasmodium falciparum
VGEHSHNENNNYYDDPTNKDQKNEKIKNL

SEQ ID NO: 3349541 - protein, 11 aa, Plasmodium falciparum
VGELSQKDERR

SEQ ID NO: 3349542 - protein, 6 aa, Plasmodium falciparum
VGERIE

SEQ ID NO: 3349543 - protein, 17 aa, Plasmodium falciparum
VGERKESSKNNKKEYDI

SEQ ID NO: 3349544 - protein, 5 aa, Plasmodium falciparum
VGESI

SEQ ID NO: 3349545 - protein, 57 aa, Plasmodium falciparum
VGGDNDNNDDDNNDDNDDDDNDDDNNDDDNNNDDDNDDSYDDEEKEQENYSNDVNTE

SEQ ID NO: 3349546 - protein, 6 aa, Plasmodium falciparum
VGGKVG

SEQ ID NO: 3349547 - protein, 10 aa, Plasmodium falciparum
VGGPDGDLGS

SEQ ID NO: 3349548 - protein, 14 aa, Plasmodium falciparum
VGHTNNNSQKNNTY

SEQ ID NO: 3349549 - protein, 5 aa, Plasmodium falciparum
VGIQN

SEQ ID NO: 3349550 - protein, 15 aa, Plasmodium falciparum
VGKGGSMTDHGLNSN

SEQ ID NO: 3349551 - protein, 12 aa, Plasmodium falciparum
VGKKLGPKRASK

SEQ ID NO: 3349552 - protein, 4 aa, Plasmodium falciparum
VGKN

SEQ ID NO: 3349553 - protein, 12 aa, Plasmodium falciparum
VGKNDNNKYSSS

SEQ ID NO: 3349554 - protein, 52 aa, Plasmodium falciparum
VGKNNNIEQRNNNNDNNDNNNNDNNNNNNNDNNNNNNNNNNNNNNNNDNLNE

SEQ ID NO: 3349555 - protein, 20 aa, Plasmodium falciparum
VGKNTNNINNTESNEKNSTN

SEQ ID NO: 3349556 - protein, 6 aa, Plasmodium falciparum
VGKSTN

SEQ ID NO: 3349557 - protein, 6 aa, Plasmodium falciparum
VGKSTT

SEQ ID NO: 3349558 - protein, 4 aa, Plasmodium falciparum
VGKT

SEQ ID NO: 3349559 - protein, 9 aa, Plasmodium falciparum
VGKTRQSSK

SEQ ID NO: 3349560 - protein, 4 aa, Plasmodium falciparum
VGMN

SEQ ID NO: 3349561 - protein, 13 aa, Plasmodium falciparum
VGNDEAQKRADTF

SEQ ID NO: 3349562 - protein, 8 aa, Plasmodium falciparum
VGNKPSME

SEQ ID NO: 3349563 - protein, 6 aa, Plasmodium falciparum
VGNPNM

SEQ ID NO: 3349564 - protein, 9 aa, Plasmodium falciparum
VGNQPQNVE

SEQ ID NO: 3349565 - protein, 9 aa, Plasmodium falciparum
VGNSKKSSL

SEQ ID NO: 3349566 - protein, 10 aa, Plasmodium falciparum
VGNSNISDEE

SEQ ID NO: 3349567 - protein, 5 aa, Plasmodium falciparum
VGPEQ

SEQ ID NO: 3349568 - protein, 9 aa, Plasmodium falciparum
VGQNNQPLY

SEQ ID NO: 3349569 - protein, 27 aa, Plasmodium falciparum
VGQNSNAYDNNRYRTPNGQNYSGGNNN

SEQ ID NO: 3349570 - protein, 6 aa, Plasmodium falciparum
VGQPLG

SEQ ID NO: 3349571 - protein, 7 aa, Plasmodium falciparum
VGRDGKN

SEQ ID NO: 3349572 - protein, 9 aa, Plasmodium falciparum
VGRDGQEIE

SEQ ID NO: 3349573 - protein, 10 aa, Plasmodium falciparum
VGRKNDDDYE

SEQ ID NO: 3349574 - protein, 21 aa, Plasmodium falciparum
VGRNNYNKTSEKHEERSNNRP

SEQ ID NO: 3349575 - protein, 43 aa, Plasmodium falciparum
VGSAPAAAAQVTTEKPSEDKKEAKKEEKVEEEEEEDDLGFSLF

SEQ ID NO: 3349576 - protein, 4 aa, Plasmodium falciparum
VGSG

SEQ ID NO: 3349577 - protein, 6 aa, Plasmodium falciparum
VGSPDS

SEQ ID NO: 3349578 - protein, 7 aa, Plasmodium falciparum
VGSSEQM

SEQ ID NO: 3349579 - protein, 7 aa, Plasmodium falciparum
VGSSSGS

SEQ ID NO: 3349580 - protein, 20 aa, Plasmodium falciparum
VGTEKKKKKNNKKEKGENNL

SEQ ID NO: 3349581 - protein, 7 aa, Plasmodium falciparum
VGTGKSS

SEQ ID NO: 3349582 - protein, 13 aa, Plasmodium falciparum
VGTGNNNNNNNNN

SEQ ID NO: 3349583 - protein, 4 aa, Plasmodium falciparum
VGTK

SEQ ID NO: 3349584 - protein, 14 aa, Plasmodium falciparum
VGTNMDTQKGITNI

SEQ ID NO: 3349585 - protein, 4 aa, Plasmodium falciparum
VGTQ

SEQ ID NO: 3349586 - protein, 12 aa, Plasmodium falciparum
VHDDKKDEMDGT

SEQ ID NO: 3349587 - protein, 12 aa, Plasmodium falciparum
VHDDTSYDNNSF

SEQ ID NO: 3349588 - protein, 5 aa, Plasmodium falciparum
VHDEK

SEQ ID NO: 3349589 - protein, 9 aa, Plasmodium falciparum
VHDTKEEQN

SEQ ID NO: 3349590 - protein, 11 aa, Plasmodium falciparum
VHEDKDGNFDE

SEQ ID NO: 3349591 - protein, 4 aa, Plasmodium falciparum
VHEK

SEQ ID NO: 3349592 - protein, 8 aa, Plasmodium falciparum
VHESERKN

SEQ ID NO: 3349593 - protein, 11 aa, Plasmodium falciparum
VHHDKKKSEDS

SEQ ID NO: 3349594 - protein, 35 aa, Plasmodium falciparum
VHMNNGEDNNNNNRDDDLKNGSENMKNNYNNSNNS

SEQ ID NO: 3349595 - protein, 4 aa, Plasmodium falciparum
VHNN

SEQ ID NO: 3349596 - protein, 32 aa, Plasmodium falciparum
VHNNNKVKHNNNNNNNNNNNNNNNNNNNSEKM

SEQ ID NO: 3349597 - protein, 19 aa, Plasmodium falciparum
VHNRKHSSNKNKLNDTDNW

SEQ ID NO: 3349598 - protein, 5 aa, Plasmodium falciparum
VHPPY

SEQ ID NO: 3349599 - protein, 12 aa, Plasmodium falciparum
VHSPSPKKTKKI

SEQ ID NO: 3349600 - protein, 4 aa, Plasmodium falciparum
VHTN

SEQ ID NO: 3349601 - protein, 26 aa, Plasmodium falciparum
VHTNSREDNKMEKKKKSDIKEYSKEC

SEQ ID NO: 3349602 - protein, 10 aa, Plasmodium falciparum
VIDSTNDKKI

SEQ ID NO: 3349603 - protein, 23 aa, Plasmodium falciparum
VIETSNDQNQNNQNDQNDQQSDI

SEQ ID NO: 3349604 - protein, 7 aa, Plasmodium falciparum
VIGQEDK

SEQ ID NO: 3349605 - protein, 23 aa, Plasmodium falciparum
VIGSDTKEHTNERINDQTSEEKC

SEQ ID NO: 3349606 - protein, 33 aa, Plasmodium falciparum
VIKQEEEHAKVKSSNDDDNKIEKYKKNNGEQTY

SEQ ID NO: 3349607 - protein, 14 aa, Plasmodium falciparum
VINDTQKNDKNIEY

SEQ ID NO: 3349608 - protein, 14 aa, Plasmodium falciparum
VINENNGDKIYKPN

SEQ ID NO: 3349609 - protein, 52 aa, Plasmodium falciparum
VINNQSTHYGNQNDHGDPPSYDLKNKNEKDNISNDKDNTNDDKNCKKIEPPS

SEQ ID NO: 3349610 - protein, 11 aa, Plasmodium falciparum
VIPGPIKTTTV

SEQ ID NO: 3349611 - protein, 6 aa, Plasmodium falciparum
VIRNSS

SEQ ID NO: 3349612 - protein, 7 aa, Plasmodium falciparum
VISPKKK

SEQ ID NO: 3349613 - protein, 16 aa, Plasmodium falciparum
VITNNDDEKHTSSKIN

SEQ ID NO: 3349614 - protein, 15 aa, Plasmodium falciparum
VITPDKHENKNNNDI

SEQ ID NO: 3349615 - protein, 7 aa, Plasmodium falciparum
VITTGSD

SEQ ID NO: 3349616 - protein, 9 aa, Plasmodium falciparum
VKAKNTSSF

SEQ ID NO: 3349617 - protein, 20 aa, Plasmodium falciparum
VKANNGEDFKENSRGKDGKD

SEQ ID NO: 3349618 - protein, 13 aa, Plasmodium falciparum
VKAREKEKSENPM

SEQ ID NO: 3349619 - protein, 9 aa, Plasmodium falciparum
VKASSERTQ

SEQ ID NO: 3349620 - protein, 6 aa, Plasmodium falciparum
VKDEED

SEQ ID NO: 3349621 - protein, 44 aa, Plasmodium falciparum
VKDEGKKEKIEDKKYEQDDEEENEEEEEEEEEEEGEEENKEDEE

SEQ ID NO: 3349622 - protein, 6 aa, Plasmodium falciparum
VKDEHK

SEQ ID NO: 3349623 - protein, 4 aa, Plasmodium falciparum
VKDI

SEQ ID NO: 3349624 - protein, 10 aa, Plasmodium falciparum
VKDKYESEQK

SEQ ID NO: 3349625 - protein, 4 aa, Plasmodium falciparum
VKDN

SEQ ID NO: 3349626 - protein, 9 aa, Plasmodium falciparum
VKDNNKKDN

SEQ ID NO: 3349627 - protein, 32 aa, Plasmodium falciparum
VKDQEKVPQPCSDDDNIKNNVQQGEDKIKKKE

SEQ ID NO: 3349628 - protein, 8 aa, Plasmodium falciparum
VKDRQVKS

SEQ ID NO: 3349629 - protein, 43 aa, Plasmodium falciparum
VKDSLSDYEYSKNNKLDSDIESPRFGNTSEEDDVDKMEEENET

SEQ ID NO: 3349630 - protein, 5 aa, Plasmodium falciparum
VKDVG

SEQ ID NO: 3349631 - protein, 34 aa, Plasmodium falciparum
VKEEKKESAPKKDTPKSKGAPKGGKGGKKGPPAF

SEQ ID NO: 3349632 - protein, 10 aa, Plasmodium falciparum
VKEEKKRKNV

SEQ ID NO: 3349633 - protein, 7 aa, Plasmodium falciparum
VKEKENH

SEQ ID NO: 3349634 - protein, 9 aa, Plasmodium falciparum
VKEKERAQQ

SEQ ID NO: 3349635 - protein, 11 aa, Plasmodium falciparum
VKEKKEQLNKE

SEQ ID NO: 3349636 - protein, 9 aa, Plasmodium falciparum
VKEKPTTKL

SEQ ID NO: 3349637 - protein, 35 aa, Plasmodium falciparum
VKEMSEKSFDSDTSSIDDNSEVDIDENEDATNEKA

SEQ ID NO: 3349638 - protein, 11 aa, Plasmodium falciparum
VKENDKDQGDI

SEQ ID NO: 3349639 - protein, 23 aa, Plasmodium falciparum
VKENEDVKDEKDEDDEEEEEKYE

SEQ ID NO: 3349640 - protein, 11 aa, Plasmodium falciparum
VKENNPKKSVS

SEQ ID NO: 3349641 - protein, 14 aa, Plasmodium falciparum
VKENSKNKKRKKKI

SEQ ID NO: 3349642 - protein, 4 aa, Plasmodium falciparum
VKEQ

SEQ ID NO: 3349643 - protein, 6 aa, Plasmodium falciparum
VKEQNH

SEQ ID NO: 3349644 - protein, 6 aa, Plasmodium falciparum
VKERAK

SEQ ID NO: 3349645 - protein, 7 aa, Plasmodium falciparum
VKESNED

SEQ ID NO: 3349646 - protein, 18 aa, Plasmodium falciparum
VKETKYKDIEEENTQVKQ

SEQ ID NO: 3349647 - protein, 9 aa, Plasmodium falciparum
VKETNNLDP

SEQ ID NO: 3349648 - protein, 15 aa, Plasmodium falciparum
VKETNNTESTGNIKN

SEQ ID NO: 3349649 - protein, 17 aa, Plasmodium falciparum
VKGDEKDSNEHKSNERV

SEQ ID NO: 3349650 - protein, 6 aa, Plasmodium falciparum
VKGEDH

SEQ ID NO: 3349651 - protein, 5 aa, Plasmodium falciparum
VKGLN

SEQ ID NO: 3349652 - protein, 18 aa, Plasmodium falciparum
VKGNHEEGHDDDTNELED

SEQ ID NO: 3349653 - protein, 8 aa, Plasmodium falciparum
VKGRYKDE

SEQ ID NO: 3349654 - protein, 7 aa, Plasmodium falciparum
VKGSKTL

SEQ ID NO: 3349655 - protein, 13 aa, Plasmodium falciparum
VKGSTKNNDQNIE

SEQ ID NO: 3349656 - protein, 20 aa, Plasmodium falciparum
VKGTPNNQERGNNNDQNNHD

SEQ ID NO: 3349657 - protein, 10 aa, Plasmodium falciparum
VKHDMSEDEM

SEQ ID NO: 3349658 - protein, 13 aa, Plasmodium falciparum
VKHDNNKSTYENV

SEQ ID NO: 3349659 - protein, 11 aa, Plasmodium falciparum
VKHKAPSKGTI

SEQ ID NO: 3349660 - protein, 14 aa, Plasmodium falciparum
VKHNNNNNNNNNNI

SEQ ID NO: 3349661 - protein, 8 aa, Plasmodium falciparum
VKIGEREN

SEQ ID NO: 3349662 - protein, 14 aa, Plasmodium falciparum
VKKDISKKKQIKDN

SEQ ID NO: 3349663 - protein, 75 aa, Plasmodium falciparum
VKKEEEQKDEHEDDEKKFNNDENNENNENNNNNENNNNNENNNNNDDNDDNENNDDNSDDEKDDINNVSSDNPNI

SEQ ID NO: 3349664 - protein, 14 aa, Plasmodium falciparum
VKKEEQQDIKTFTI

SEQ ID NO: 3349665 - protein, 12 aa, Plasmodium falciparum
VKKETEKNSTGF

SEQ ID NO: 3349666 - protein, 9 aa, Plasmodium falciparum
VKKGEEDEM

SEQ ID NO: 3349667 - protein, 9 aa, Plasmodium falciparum
VKKGEHDSK

SEQ ID NO: 3349668 - protein, 7 aa, Plasmodium falciparum
VKKIQHK

SEQ ID NO: 3349669 - protein, 11 aa, Plasmodium falciparum
VKKKDTGSGTD

SEQ ID NO: 3349670 - protein, 43 aa, Plasmodium falciparum
VKKKKGNDDNDENNNNSNNNVDGDKKNNNKSNTSSKKKDDKDL

SEQ ID NO: 3349671 - protein, 17 aa, Plasmodium falciparum
VKKKNTMPIPKEGSKNI

SEQ ID NO: 3349672 - protein, 10 aa, Plasmodium falciparum
VKKNKKENVA

SEQ ID NO: 3349673 - protein, 19 aa, Plasmodium falciparum
VKKNKNKKNNNKNNDKNNT

SEQ ID NO: 3349674 - protein, 6 aa, Plasmodium falciparum
VKKNTK

SEQ ID NO: 3349675 - protein, 22 aa, Plasmodium falciparum
VKKQKKKKKKKKNNNEKREKEI

SEQ ID NO: 3349676 - protein, 6 aa, Plasmodium falciparum
VKKSED

SEQ ID NO: 3349677 - protein, 6 aa, Plasmodium falciparum
VKKSSS

SEQ ID NO: 3349678 - protein, 4 aa, Plasmodium falciparum
VKKY

SEQ ID NO: 3349679 - protein, 5 aa, Plasmodium falciparum
VKKYK

SEQ ID NO: 3349680 - protein, 11 aa, Plasmodium falciparum
VKMTETENAFE

SEQ ID NO: 3349681 - protein, 10 aa, Plasmodium falciparum
VKNAKRNTYN

SEQ ID NO: 3349682 - protein, 11 aa, Plasmodium falciparum
VKNDEYTPEDI

SEQ ID NO: 3349683 - protein, 9 aa, Plasmodium falciparum
VKNDTKLNN

SEQ ID NO: 3349684 - protein, 6 aa, Plasmodium falciparum
VKNDTN

SEQ ID NO: 3349685 - protein, 9 aa, Plasmodium falciparum
VKNEEEKSN

SEQ ID NO: 3349686 - protein, 8 aa, Plasmodium falciparum
VKNEEERK

SEQ ID NO: 3349687 - protein, 9 aa, Plasmodium falciparum
VKNEEHENN

SEQ ID NO: 3349688 - protein, 11 aa, Plasmodium falciparum
VKNEKDEDKKM

SEQ ID NO: 3349689 - protein, 7 aa, Plasmodium falciparum
VKNENIK

SEQ ID NO: 3349690 - protein, 16 aa, Plasmodium falciparum
VKNENKDAIYDDGHNN

SEQ ID NO: 3349691 - protein, 24 aa, Plasmodium falciparum
VKNENNNKYDFNKNNKKKIYNNPK

SEQ ID NO: 3349692 - protein, 9 aa, Plasmodium falciparum
VKNGNNNNI

SEQ ID NO: 3349693 - protein, 8 aa, Plasmodium falciparum
VKNIPKKN

SEQ ID NO: 3349694 - protein, 5 aa, Plasmodium falciparum
VKNKK

SEQ ID NO: 3349695 - protein, 10 aa, Plasmodium falciparum
VKNKKDVYEN

SEQ ID NO: 3349696 - protein, 23 aa, Plasmodium falciparum
VKNKKKKGETLEESSKGNEQNDA

SEQ ID NO: 3349697 - protein, 7 aa, Plasmodium falciparum
VKNKKKN

SEQ ID NO: 3349698 - protein, 35 aa, Plasmodium falciparum
VKNKNEQGNTAEDNNNNNNNYSNNNNNNSNYNSNY

SEQ ID NO: 3349699 - protein, 24 aa, Plasmodium falciparum
VKNKQKKKEHQKKKKKKIKEQNDI

SEQ ID NO: 3349700 - protein, 5 aa, Plasmodium falciparum
VKNKR

SEQ ID NO: 3349701 - protein, 9 aa, Plasmodium falciparum
VKNNDNKKL

SEQ ID NO: 3349702 - protein, 9 aa, Plasmodium falciparum
VKNNESNIN

SEQ ID NO: 3349703 - protein, 6 aa, Plasmodium falciparum
VKNNEY

SEQ ID NO: 3349704 - protein, 11 aa, Plasmodium falciparum
VKNNKKKNNLE

SEQ ID NO: 3349705 - protein, 17 aa, Plasmodium falciparum
VKNNNINSVNDKNTSIV

SEQ ID NO: 3349706 - protein, 11 aa, Plasmodium falciparum
VKNNSNIKHKG

SEQ ID NO: 3349707 - protein, 19 aa, Plasmodium falciparum
VKNSNNNCSNNKGDDNIGN

SEQ ID NO: 3349708 - protein, 5 aa, Plasmodium falciparum
VKNVK

SEQ ID NO: 3349709 - protein, 36 aa, Plasmodium falciparum
VKPAKKSTNKTRKNNKSLKNKEQDEKVNDMKNNNIS

SEQ ID NO: 3349710 - protein, 6 aa, Plasmodium falciparum
VKPGEE

SEQ ID NO: 3349711 - protein, 7 aa, Plasmodium falciparum
VKPNTNS

SEQ ID NO: 3349712 - protein, 5 aa, Plasmodium falciparum
VKPPR

SEQ ID NO: 3349713 - protein, 5 aa, Plasmodium falciparum
VKQKN

SEQ ID NO: 3349714 - protein, 38 aa, Plasmodium falciparum
VKQNNGDKQNNGDKQNNGDKQNNGDKQNNGDKHNCANR

SEQ ID NO: 3349715 - protein, 4 aa, Plasmodium falciparum
VKQP

SEQ ID NO: 3349716 - protein, 6 aa, Plasmodium falciparum
VKQSYV

SEQ ID NO: 3349717 - protein, 4 aa, Plasmodium falciparum
VKQT

SEQ ID NO: 3349718 - protein, 11 aa, Plasmodium falciparum
VKRDNQNKENI

SEQ ID NO: 3349719 - protein, 11 aa, Plasmodium falciparum
VKRDNTQNNNK

SEQ ID NO: 3349720 - protein, 16 aa, Plasmodium falciparum
VKRKKKKGKDKKYKEE

SEQ ID NO: 3349721 - protein, 9 aa, Plasmodium falciparum
VKRKTDKES

SEQ ID NO: 3349722 - protein, 7 aa, Plasmodium falciparum
VKRKTSD

SEQ ID NO: 3349723 - protein, 9 aa, Plasmodium falciparum
VKRNKENEI

SEQ ID NO: 3349724 - protein, 7 aa, Plasmodium falciparum
VKRNNSF

SEQ ID NO: 3349725 - protein, 5 aa, Plasmodium falciparum
VKRNQ

SEQ ID NO: 3349726 - protein, 32 aa, Plasmodium falciparum
VKRSKKKKKKKKKKKHKHKHKSEDKCDDDKTV

SEQ ID NO: 3349727 - protein, 5 aa, Plasmodium falciparum
VKRTS

SEQ ID NO: 3349728 - protein, 9 aa, Plasmodium falciparum
VKSDEPKGR

SEQ ID NO: 3349729 - protein, 9 aa, Plasmodium falciparum
VKSDFKKEN

SEQ ID NO: 3349730 - protein, 17 aa, Plasmodium falciparum
VKSENKKKSISHEHQAT

SEQ ID NO: 3349731 - protein, 6 aa, Plasmodium falciparum
VKSERG

SEQ ID NO: 3349732 - protein, 14 aa, Plasmodium falciparum
VKSEYDGNNNGPLE

SEQ ID NO: 3349733 - protein, 26 aa, Plasmodium falciparum
VKSGDKNEEEKNKVNDVDADAKAKED

SEQ ID NO: 3349734 - protein, 7 aa, Plasmodium falciparum
VKSHNKT

SEQ ID NO: 3349735 - protein, 4 aa, Plasmodium falciparum
VKSK

SEQ ID NO: 3349736 - protein, 23 aa, Plasmodium falciparum
VKSNNTSSIYSNKKNETDNSLNT

SEQ ID NO: 3349737 - protein, 9 aa, Plasmodium falciparum
VKSNQENNN

SEQ ID NO: 3349738 - protein, 18 aa, Plasmodium falciparum
VKSNTNYQHSNNSNYSDE

SEQ ID NO: 3349739 - protein, 5 aa, Plasmodium falciparum
VKSNY

SEQ ID NO: 3349740 - protein, 4 aa, Plasmodium falciparum
VKSP

SEQ ID NO: 3349741 - protein, 8 aa, Plasmodium falciparum
VKSSEQLN

SEQ ID NO: 3349742 - protein, 11 aa, Plasmodium falciparum
VKSSSNNDYSF

SEQ ID NO: 3349743 - protein, 16 aa, Plasmodium falciparum
VKSTEGAKKNKESKLH

SEQ ID NO: 3349744 - protein, 5 aa, Plasmodium falciparum
VKTEG

SEQ ID NO: 3349745 - protein, 9 aa, Plasmodium falciparum
VKTENEENV

SEQ ID NO: 3349746 - protein, 7 aa, Plasmodium falciparum
VKTGSYG

SEQ ID NO: 3349747 - protein, 12 aa, Plasmodium falciparum
VKTMGKGSSFGE

SEQ ID NO: 3349748 - protein, 6 aa, Plasmodium falciparum
VKTNED

SEQ ID NO: 3349749 - protein, 7 aa, Plasmodium falciparum
VKTNEGK

SEQ ID NO: 3349750 - protein, 26 aa, Plasmodium falciparum
VKTRLNDEEVKTRLNDEEVKTRLNDE

SEQ ID NO: 3349751 - protein, 9 aa, Plasmodium falciparum
VKTSAYTES

SEQ ID NO: 3349752 - protein, 16 aa, Plasmodium falciparum
VKTSDTNDNLRKEAEK

SEQ ID NO: 3349753 - protein, 29 aa, Plasmodium falciparum
VKTSSGSNKTRNISNNRNNIHNKPNGYNL

SEQ ID NO: 3349754 - protein, 26 aa, Plasmodium falciparum
VKTTHKKNKSSTNKEIKRKEKNETND

SEQ ID NO: 3349755 - protein, 7 aa, Plasmodium falciparum
VKVNDEG

SEQ ID NO: 3349756 - protein, 41 aa, Plasmodium falciparum
VKYNKKDQEDIPGDLGEEYEEDDEEEEEQKKKAQKNRDLGK

SEQ ID NO: 3349757 - protein, 5 aa, Plasmodium falciparum
VKYNP

SEQ ID NO: 3349758 - protein, 26 aa, Plasmodium falciparum
VLEGEKNKRVVNASKDKKKEEEGEVD

SEQ ID NO: 3349759 - protein, 5 aa, Plasmodium falciparum
VLGSS

SEQ ID NO: 3349760 - protein, 8 aa, Plasmodium falciparum
VLNDSRQK

SEQ ID NO: 3349761 - protein, 22 aa, Plasmodium falciparum
VLNSSNEKKDTEYKKSQNMNDD

SEQ ID NO: 3349762 - protein, 6 aa, Plasmodium falciparum
VLPDDS

SEQ ID NO: 3349763 - protein, 12 aa, Plasmodium falciparum
VLPTPSRKSVDS

SEQ ID NO: 3349764 - protein, 4 aa, Plasmodium falciparum
VLSK

SEQ ID NO: 3349765 - protein, 4 aa, Plasmodium falciparum
VMEE

SEQ ID NO: 3349766 - protein, 4 aa, Plasmodium falciparum
VMNN

SEQ ID NO: 3349767 - protein, 4 aa, Plasmodium falciparum
VNAN

SEQ ID NO: 3349768 - protein, 35 aa, Plasmodium falciparum
VNANDSKYESHNENYNKNNNTNFDSKQENKNNTNI

SEQ ID NO: 3349769 - protein, 6 aa, Plasmodium falciparum
VNANED

SEQ ID NO: 3349770 - protein, 5 aa, Plasmodium falciparum
VNCNK

SEQ ID NO: 3349771 - protein, 14 aa, Plasmodium falciparum
VNDDNQSLNNTNPC

SEQ ID NO: 3349772 - protein, 130 aa, Plasmodium falciparum
VNDDVRKNKKAKTEQVEETTNNAAEEQVQQEEPVETAPAHEEPAHGEEAQGEEVQGEEAQGEEVQGEEVQGEEAHEEPANDEPANDEPANDEPANEEPANEEPANEEPANEEPANEEPANEEPANEEPAN

SEQ ID NO: 3349773 - protein, 5 aa, Plasmodium falciparum
VNDED

SEQ ID NO: 3349774 - protein, 16 aa, Plasmodium falciparum
VNDEDISNSNKKRKIY

SEQ ID NO: 3349775 - protein, 74 aa, Plasmodium falciparum
VNDEEDDELNQYSDDDDEEDEEDDDDDDEDDDEEDSDDDKPSNKKQLKNNKKIQNEREKDKYKLEKNKKNNNKH

SEQ ID NO: 3349776 - protein, 9 aa, Plasmodium falciparum
VNDEKKEVE

SEQ ID NO: 3349777 - protein, 11 aa, Plasmodium falciparum
VNDENNKQKNI

SEQ ID NO: 3349778 - protein, 6 aa, Plasmodium falciparum
VNDESN

SEQ ID NO: 3349779 - protein, 4 aa, Plasmodium falciparum
VNDK

SEQ ID NO: 3349780 - protein, 18 aa, Plasmodium falciparum
VNDKDQVQENVKDPHQIN

SEQ ID NO: 3349781 - protein, 14 aa, Plasmodium falciparum
VNDKHNDKLSCEED

SEQ ID NO: 3349782 - protein, 8 aa, Plasmodium falciparum
VNDKNKKN

SEQ ID NO: 3349783 - protein, 9 aa, Plasmodium falciparum
VNDNNRDEK

SEQ ID NO: 3349784 - protein, 16 aa, Plasmodium falciparum
VNDNTSCKNITNNDVT

SEQ ID NO: 3349785 - protein, 6 aa, Plasmodium falciparum
VNDQSN

SEQ ID NO: 3349786 - protein, 10 aa, Plasmodium falciparum
VNDTVSYNKD

SEQ ID NO: 3349787 - protein, 5 aa, Plasmodium falciparum
VNDTY

SEQ ID NO: 3349788 - protein, 67 aa, Plasmodium falciparum
VNEDTKEDNKTKEDNKKKEDNKTKEDNKKKEDNKKDEDNKKEEDNKKDEDNKKEEDNKTKEDNLHNG

SEQ ID NO: 3349789 - protein, 9 aa, Plasmodium falciparum
VNEDTNNRS

SEQ ID NO: 3349790 - protein, 4 aa, Plasmodium falciparum
VNEE

SEQ ID NO: 3349791 - protein, 88 aa, Plasmodium falciparum
VNEEDGNKCGDNDEDGNKCGDNDEDGNKCGDNDEDGNKCGDNDENGNKCGDNDENGNKCGDNDDDGNKCGYNDENGNKCGYNDEDGNK

SEQ ID NO: 3349792 - protein, 12 aa, Plasmodium falciparum
VNEEGEGEGEED

SEQ ID NO: 3349793 - protein, 18 aa, Plasmodium falciparum
VNEENKSGDSNEQDINND

SEQ ID NO: 3349794 - protein, 15 aa, Plasmodium falciparum
VNEHEDEEEEEENNK

SEQ ID NO: 3349795 - protein, 4 aa, Plasmodium falciparum
VNEK

SEQ ID NO: 3349796 - protein, 10 aa, Plasmodium falciparum
VNEKERSNLN

SEQ ID NO: 3349797 - protein, 15 aa, Plasmodium falciparum
VNEKGNNNNNNDGCT

SEQ ID NO: 3349798 - protein, 20 aa, Plasmodium falciparum
VNEKKKKKHTKNKNELNSNV

SEQ ID NO: 3349799 - protein, 5 aa, Plasmodium falciparum
VNEKN

SEQ ID NO: 3349800 - protein, 17 aa, Plasmodium falciparum
VNEKNNKTDENAKPNYE

SEQ ID NO: 3349801 - protein, 4 aa, Plasmodium falciparum
VNEN

SEQ ID NO: 3349802 - protein, 9 aa, Plasmodium falciparum
VNENDERGK

SEQ ID NO: 3349803 - protein, 12 aa, Plasmodium falciparum
VNENGEKPDEEV

SEQ ID NO: 3349804 - protein, 5 aa, Plasmodium falciparum
VNENP

SEQ ID NO: 3349805 - protein, 5 aa, Plasmodium falciparum
VNENT

SEQ ID NO: 3349806 - protein, 10 aa, Plasmodium falciparum
VNENTDNSSI

SEQ ID NO: 3349807 - protein, 9 aa, Plasmodium falciparum
VNENTYRSY

SEQ ID NO: 3349808 - protein, 83 aa, Plasmodium falciparum
VNENYESDNEYDSDEDDTESDNDDEQNKENERGDEKDGYEEMNGGDKNEEMNGGDKNEEMNVGDKNGGINEEHKNEGINEEHK

SEQ ID NO: 3349809 - protein, 9 aa, Plasmodium falciparum
VNEQNNVEN

SEQ ID NO: 3349810 - protein, 7 aa, Plasmodium falciparum
VNEQNTN

SEQ ID NO: 3349811 - protein, 15 aa, Plasmodium falciparum
VNEQSSINNNNNNNN

SEQ ID NO: 3349812 - protein, 6 aa, Plasmodium falciparum
VNESEK

SEQ ID NO: 3349813 - protein, 9 aa, Plasmodium falciparum
VNESNGDVN

SEQ ID NO: 3349814 - protein, 11 aa, Plasmodium falciparum
VNESNTETYNE

SEQ ID NO: 3349815 - protein, 9 aa, Plasmodium falciparum
VNEYDEDKN

SEQ ID NO: 3349816 - protein, 6 aa, Plasmodium falciparum
VNGDGM

SEQ ID NO: 3349817 - protein, 426 aa, Plasmodium falciparum
VNGDNKKEKSSNDDDKKKKPNDAEKKKTPNNADKKKTPNDAEKKKTPNDAEKKKTPNNADKKKTSNGANKERTPNNAEKKKNPNDANTKKASNGANKERTPNGANKEKTPNDAEKKKTPNGANKEKTPNDAEKKKTPNDSEKKKTPNDAEKKKNPNDAEKKKNPNDAEKKKNPNDANTKKASKGANKERTPNGANKEKTPNGANKEKTPNNAEKKKNPNDANTKKASNGANKERTPNNAEKKKNPNDAEKKKNPNDANTKKASNGANKERTPNNAEKKKNPNDANTKKASNGANKERTPNDAEKKKTPNDAEKKKNPNDAEKKKNPNDAEKKKNPNDANTKKASNGANKERTPNDAEKKKTSNDAEKKKTLNDKEKTVNFNQKKDDNLNVDNKKENTVNDAEKGRTLNDKEKTANCNQKKEDNFNV

SEQ ID NO: 3349818 - protein, 6 aa, Plasmodium falciparum
VNGENK

SEQ ID NO: 3349819 - protein, 11 aa, Plasmodium falciparum
VNGKNENEKNI

SEQ ID NO: 3349820 - protein, 36 aa, Plasmodium falciparum
VNGKNKTNNINKNKEDYKNNNDNEKKNLDDNSSNNY

SEQ ID NO: 3349821 - protein, 4 aa, Plasmodium falciparum
VNGN

SEQ ID NO: 3349822 - protein, 116 aa, Plasmodium falciparum
VNGNVEEKKKKKKKNKNKDKDKKRDEEKEEDKNKDKDKDKDKNNNNNNNNNNNNNKNNNKNKNKKKKNKINNNNINKNKDKDMSKNKRKNKNKNEVVEDNKNKQYLEKKENNINEI

SEQ ID NO: 3349823 - protein, 29 aa, Plasmodium falciparum
VNGQDSVTTEEPVTTQEQVTTQEADTAQV

SEQ ID NO: 3349824 - protein, 17 aa, Plasmodium falciparum
VNGSYNSNIHTNSNNNN

SEQ ID NO: 3349825 - protein, 4 aa, Plasmodium falciparum
VNGY

SEQ ID NO: 3349826 - protein, 9 aa, Plasmodium falciparum
VNHNNNGKY

SEQ ID NO: 3349827 - protein, 4 aa, Plasmodium falciparum
VNHP

SEQ ID NO: 3349828 - protein, 18 aa, Plasmodium falciparum
VNINKESDKEKNNKEENV

SEQ ID NO: 3349829 - protein, 5 aa, Plasmodium falciparum
VNIPQ

SEQ ID NO: 3349830 - protein, 23 aa, Plasmodium falciparum
VNKDNDNNNNNNYNNNNNNVYRE

SEQ ID NO: 3349831 - protein, 24 aa, Plasmodium falciparum
VNKDNMNNNMNGNNNNNNNNNENV

SEQ ID NO: 3349832 - protein, 8 aa, Plasmodium falciparum
VNKETQAQ

SEQ ID NO: 3349833 - protein, 7 aa, Plasmodium falciparum
VNKGDHK

SEQ ID NO: 3349834 - protein, 15 aa, Plasmodium falciparum
VNKGRNKKIDCTPNN

SEQ ID NO: 3349835 - protein, 19 aa, Plasmodium falciparum
VNKGRSHRNNFDKKMSKGM

SEQ ID NO: 3349836 - protein, 35 aa, Plasmodium falciparum
VNKKKNSYKNNEENPYSKRKKKINEDEHRNSSTCD

SEQ ID NO: 3349837 - protein, 12 aa, Plasmodium falciparum
VNKKKRKEKISN

SEQ ID NO: 3349838 - protein, 50 aa, Plasmodium falciparum
VNKKNLEEINESDPLNSSDNSMTSSSEESCSEESDKESDKESDKDGNLYD

SEQ ID NO: 3349839 - protein, 8 aa, Plasmodium falciparum
VNKKSNKH

SEQ ID NO: 3349840 - protein, 4 aa, Plasmodium falciparum
VNKM

SEQ ID NO: 3349841 - protein, 9 aa, Plasmodium falciparum
VNKNDEIGK

SEQ ID NO: 3349842 - protein, 8 aa, Plasmodium falciparum
VNKNEETN

SEQ ID NO: 3349843 - protein, 10 aa, Plasmodium falciparum
VNKNGINHTK

SEQ ID NO: 3349844 - protein, 9 aa, Plasmodium falciparum
VNKNGNKKT

SEQ ID NO: 3349845 - protein, 13 aa, Plasmodium falciparum
VNKNKDDKTNSIT

SEQ ID NO: 3349846 - protein, 12 aa, Plasmodium falciparum
VNKNKDKYDSTY

SEQ ID NO: 3349847 - protein, 10 aa, Plasmodium falciparum
VNKNNNDSFE

SEQ ID NO: 3349848 - protein, 5 aa, Plasmodium falciparum
VNKSD

SEQ ID NO: 3349849 - protein, 5 aa, Plasmodium falciparum
VNKSR

SEQ ID NO: 3349850 - protein, 20 aa, Plasmodium falciparum
VNKTKHHKNINEEKEELSPE
